United States Patent 8,178,503 (RIBONUCLEIC ACID INTERFERENCE MOLECULES AND BINDING SITES DERIVED BY ANALYZING INTERGENIC AND INTRONIC REGIONS OF GENOMES) - sequence listing, part 9

SEQ ID NO: 358081 - DNA, 16 bp, M. musculus
agcagcagcagcctgg

SEQ ID NO: 358082 - DNA, 16 bp, M. musculus
agcagcagcagcggag

SEQ ID NO: 358083 - DNA, 16 bp, M. musculus
agcagcagcaggaaca

SEQ ID NO: 358084 - DNA, 16 bp, M. musculus
agcagcagcaggaacc

SEQ ID NO: 358085 - DNA, 16 bp, M. musculus
agcagcagcaggagca

SEQ ID NO: 358086 - DNA, 16 bp, M. musculus
agcagcagcaggagga

SEQ ID NO: 358087 - DNA, 16 bp, M. musculus
agcagcagcaggcagg

SEQ ID NO: 358088 - DNA, 16 bp, M. musculus
agcagcagcaggggca

SEQ ID NO: 358089 - DNA, 16 bp, M. musculus
agcagcagcagtaaca

SEQ ID NO: 358090 - DNA, 16 bp, M. musculus
agcagcagcagtagct

SEQ ID NO: 358091 - DNA, 17 bp, M. musculus
agcagcagcagtggagt

SEQ ID NO: 358092 - DNA, 16 bp, M. musculus
agcagcagcagtgtgt

SEQ ID NO: 358093 - DNA, 16 bp, M. musculus
agcagcagcatctcca

SEQ ID NO: 358094 - DNA, 16 bp, M. musculus
agcagcagccaccaca

SEQ ID NO: 358095 - DNA, 16 bp, M. musculus
agcagcagcctacaga

SEQ ID NO: 358096 - DNA, 16 bp, M. musculus
agcagcagctgagcca

SEQ ID NO: 358097 - DNA, 17 bp, M. musculus
agcagcagctgcactgg

SEQ ID NO: 358098 - DNA, 16 bp, M. musculus
agcagcagctgctgct

SEQ ID NO: 358099 - DNA, 16 bp, M. musculus
agcagcagctgggaga

SEQ ID NO: 358100 - DNA, 16 bp, M. musculus
agcagcaggaagagga

SEQ ID NO: 358101 - DNA, 16 bp, M. musculus
agcagcaggaaggaag

SEQ ID NO: 358102 - DNA, 16 bp, M. musculus
agcagcaggaggagaa

SEQ ID NO: 358103 - DNA, 16 bp, M. musculus
agcagcaggaggagga

SEQ ID NO: 358104 - DNA, 16 bp, M. musculus
agcagcaggcagagga

SEQ ID NO: 358105 - DNA, 16 bp, M. musculus
agcagcaggcagatct

SEQ ID NO: 358106 - DNA, 16 bp, M. musculus
agcagcagtagcagta

SEQ ID NO: 358107 - DNA, 16 bp, M. musculus
agcagcagtagtggag

SEQ ID NO: 358108 - DNA, 16 bp, M. musculus
agcagcagtccagttc

SEQ ID NO: 358109 - DNA, 16 bp, M. musculus
agcagcagtggaatgg

SEQ ID NO: 358110 - DNA, 16 bp, M. musculus
agcagcagtggctgaa

SEQ ID NO: 358111 - DNA, 16 bp, M. musculus
agcagcagtggtggca

SEQ ID NO: 358112 - DNA, 16 bp, M. musculus
agcagcagttctcaat

SEQ ID NO: 358113 - DNA, 16 bp, M. musculus
agcagcatccaggcag

SEQ ID NO: 358114 - DNA, 16 bp, M. musculus
agcagcatccctccat

SEQ ID NO: 358115 - DNA, 16 bp, M. musculus
agcagcattaggaagg

SEQ ID NO: 358116 - DNA, 16 bp, M. musculus
agcagcattgacttca

SEQ ID NO: 358117 - DNA, 16 bp, M. musculus
agcagcattttggaga

SEQ ID NO: 358118 - DNA, 16 bp, M. musculus
agcagccacacctgca

SEQ ID NO: 358119 - DNA, 16 bp, M. musculus
agcagccacactggaa

SEQ ID NO: 358120 - DNA, 16 bp, M. musculus
agcagccacagcagcc

SEQ ID NO: 358121 - DNA, 16 bp, M. musculus
agcagccacatggcag

SEQ ID NO: 358122 - DNA, 16 bp, M. musculus
agcagccactgagcca

SEQ ID NO: 358123 - DNA, 16 bp, M. musculus
agcagccagaagctgg

SEQ ID NO: 358124 - DNA, 16 bp, M. musculus
agcagccagcacagac

SEQ ID NO: 358125 - DNA, 16 bp, M. musculus
agcagccagcagccag

SEQ ID NO: 358126 - DNA, 16 bp, M. musculus
agcagccagccagcca

SEQ ID NO: 358127 - DNA, 16 bp, M. musculus
agcagccagtgcccct

SEQ ID NO: 358128 - DNA, 16 bp, M. musculus
agcagccagtgctcag

SEQ ID NO: 358129 - DNA, 16 bp, M. musculus
agcagccagtgtgctt

SEQ ID NO: 358130 - DNA, 16 bp, M. musculus
agcagccagttctctt

SEQ ID NO: 358131 - DNA, 16 bp, M. musculus
agcagccatatggtgg

SEQ ID NO: 358132 - DNA, 16 bp, M. musculus
agcagccatgttcttc

SEQ ID NO: 358133 - DNA, 16 bp, M. musculus
agcagccatgtttgaa

SEQ ID NO: 358134 - DNA, 16 bp, M. musculus
agcagccattgctctt

SEQ ID NO: 358135 - DNA, 16 bp, M. musculus
agcagccattgttctt

SEQ ID NO: 358136 - DNA, 16 bp, M. musculus
agcagcctaacagcac

SEQ ID NO: 358137 - DNA, 16 bp, M. musculus
agcagcctacatagca

SEQ ID NO: 358138 - DNA, 16 bp, M. musculus
agcagcctgggctggc

SEQ ID NO: 358139 - DNA, 16 bp, M. musculus
agcagcctgtgtggcc

SEQ ID NO: 358140 - DNA, 16 bp, M. musculus
agcagccttagtccat

SEQ ID NO: 358141 - DNA, 16 bp, M. musculus
agcagcggcagctcga

SEQ ID NO: 358142 - DNA, 16 bp, M. musculus
agcagctcacaaccac

SEQ ID NO: 358143 - DNA, 16 bp, M. musculus
agcagctcacaactgt

SEQ ID NO: 358144 - DNA, 16 bp, M. musculus
agcagctctcaacctg

SEQ ID NO: 358145 - DNA, 16 bp, M. musculus
agcagctgaaagggtc

SEQ ID NO: 358146 - DNA, 16 bp, M. musculus
agcagctgagacatcc

SEQ ID NO: 358147 - DNA, 16 bp, M. musculus
agcagctgagagacac

SEQ ID NO: 358148 - DNA, 16 bp, M. musculus
agcagctgagagctca

SEQ ID NO: 358149 - DNA, 16 bp, M. musculus
agcagctgaggcttga

SEQ ID NO: 358150 - DNA, 16 bp, M. musculus
agcagctgaggcttgg

SEQ ID NO: 358151 - DNA, 16 bp, M. musculus
agcagctgcagaccag

SEQ ID NO: 358152 - DNA, 16 bp, M. musculus
agcagctgctgctctt

SEQ ID NO: 358153 - DNA, 16 bp, M. musculus
agcagctggggacagg

SEQ ID NO: 358154 - DNA, 16 bp, M. musculus
agcagctggggaggaa

SEQ ID NO: 358155 - DNA, 16 bp, M. musculus
agcagctgggggaggg

SEQ ID NO: 358156 - DNA, 16 bp, M. musculus
agcagctgggggtggg

SEQ ID NO: 358157 - DNA, 16 bp, M. musculus
agcagctgtggctacc

SEQ ID NO: 358158 - DNA, 16 bp, M. musculus
agcagctgtggtcacc

SEQ ID NO: 358159 - DNA, 16 bp, M. musculus
agcagcttcagtccag

SEQ ID NO: 358160 - DNA, 17 bp, M. musculus
agcagcttctcaagttc

SEQ ID NO: 358161 - DNA, 16 bp, M. musculus
agcagcttgacagaac

SEQ ID NO: 358162 - DNA, 17 bp, M. musculus
agcagcttggcaacaca

SEQ ID NO: 358163 - DNA, 16 bp, M. musculus
agcagctttccttagc

SEQ ID NO: 358164 - DNA, 16 bp, M. musculus
agcaggaaacagagag

SEQ ID NO: 358165 - DNA, 16 bp, M. musculus
agcaggaaataaccaa

SEQ ID NO: 358166 - DNA, 16 bp, M. musculus
agcaggaacagccagg

SEQ ID NO: 358167 - DNA, 16 bp, M. musculus
agcaggaacagctgag

SEQ ID NO: 358168 - DNA, 16 bp, M. musculus
agcaggaacagggaca

SEQ ID NO: 358169 - DNA, 16 bp, M. musculus
agcaggaaccagcagc

SEQ ID NO: 358170 - DNA, 16 bp, M. musculus
agcaggaacctggaag

SEQ ID NO: 358171 - DNA, 16 bp, M. musculus
agcaggaactaaagca

SEQ ID NO: 358172 - DNA, 16 bp, M. musculus
agcaggaactgaagca

SEQ ID NO: 358173 - DNA, 16 bp, M. musculus
agcaggaacttgaggc

SEQ ID NO: 358174 - DNA, 16 bp, M. musculus
agcaggaagacagagc

SEQ ID NO: 358175 - DNA, 16 bp, M. musculus
agcaggaagagacagt

SEQ ID NO: 358176 - DNA, 16 bp, M. musculus
agcaggaagagactga

SEQ ID NO: 358177 - DNA, 16 bp, M. musculus
agcaggaagagagaca

SEQ ID NO: 358178 - DNA, 16 bp, M. musculus
agcaggaagagctgag

SEQ ID NO: 358179 - DNA, 16 bp, M. musculus
agcaggaagatcagga

SEQ ID NO: 358180 - DNA, 16 bp, M. musculus
agcaggaagcaggaag

SEQ ID NO: 358181 - DNA, 16 bp, M. musculus
agcaggaagcaggagc

SEQ ID NO: 358182 - DNA, 16 bp, M. musculus
agcaggaagcatggtg

SEQ ID NO: 358183 - DNA, 16 bp, M. musculus
agcaggaagctgggag

SEQ ID NO: 358184 - DNA, 16 bp, M. musculus
agcaggaaggatgcag

SEQ ID NO: 358185 - DNA, 16 bp, M. musculus
agcaggaatgggtggg

SEQ ID NO: 358186 - DNA, 16 bp, M. musculus
agcaggacaggaagca

SEQ ID NO: 358187 - DNA, 16 bp, M. musculus
agcaggacagtggtgg

SEQ ID NO: 358188 - DNA, 18 bp, M. musculus
agcaggacctctcctgct

SEQ ID NO: 358189 - DNA, 16 bp, M. musculus
agcaggactaggcaca

SEQ ID NO: 358190 - DNA, 16 bp, M. musculus
agcaggagaaaactca

SEQ ID NO: 358191 - DNA, 16 bp, M. musculus
agcaggagaagcagga

SEQ ID NO: 358192 - DNA, 16 bp, M. musculus
agcaggagagctgccc

SEQ ID NO: 358193 - DNA, 16 bp, M. musculus
agcaggagaggagagc

SEQ ID NO: 358194 - DNA, 16 bp, M. musculus
agcaggagcaaggaca

SEQ ID NO: 358195 - DNA, 16 bp, M. musculus
agcaggagcaggaaca

SEQ ID NO: 358196 - DNA, 16 bp, M. musculus
agcaggagcaggaaga

SEQ ID NO: 358197 - DNA, 16 bp, M. musculus
agcaggagcaggaagc

SEQ ID NO: 358198 - DNA, 16 bp, M. musculus
agcaggagcaggagaa

SEQ ID NO: 358199 - DNA, 16 bp, M. musculus
agcaggagcaggagca

SEQ ID NO: 358200 - DNA, 16 bp, M. musculus
agcaggagccaccaca

SEQ ID NO: 358201 - DNA, 16 bp, M. musculus
agcaggagcctgaggc

SEQ ID NO: 358202 - DNA, 16 bp, M. musculus
agcaggagctgagcag

SEQ ID NO: 358203 - DNA, 17 bp, M. musculus
agcaggagctgatgctg

SEQ ID NO: 358204 - DNA, 16 bp, M. musculus
agcaggagctgatgga

SEQ ID NO: 358205 - DNA, 16 bp, M. musculus
agcaggagctggaagc

SEQ ID NO: 358206 - DNA, 16 bp, M. musculus
agcaggagctggagag

SEQ ID NO: 358207 - DNA, 16 bp, M. musculus
agcaggagctgtccct

SEQ ID NO: 358208 - DNA, 16 bp, M. musculus
agcaggaggacctgaa

SEQ ID NO: 358209 - DNA, 17 bp, M. musculus
agcaggaggagcaaaca

SEQ ID NO: 358210 - DNA, 16 bp, M. musculus
agcaggaggaggtggg

SEQ ID NO: 358211 - DNA, 16 bp, M. musculus
agcaggaggatcagag

SEQ ID NO: 358212 - DNA, 16 bp, M. musculus
agcaggaggatcatga

SEQ ID NO: 358213 - DNA, 16 bp, M. musculus
agcaggaggcagagaa

SEQ ID NO: 358214 - DNA, 16 bp, M. musculus
agcaggaggcagaggc

SEQ ID NO: 358215 - DNA, 16 bp, M. musculus
agcaggaggcctgtga

SEQ ID NO: 358216 - DNA, 16 bp, M. musculus
agcaggaggctggctg

SEQ ID NO: 358217 - DNA, 16 bp, M. musculus
agcaggagtggctggg

SEQ ID NO: 358218 - DNA, 16 bp, M. musculus
agcaggagtgggtaga

SEQ ID NO: 358219 - DNA, 16 bp, M. musculus
agcaggagttggtggg

SEQ ID NO: 358220 - DNA, 16 bp, M. musculus
agcaggatctgatgat

SEQ ID NO: 358221 - DNA, 16 bp, M. musculus
agcaggatgagcaagc

SEQ ID NO: 358222 - DNA, 17 bp, M. musculus
agcaggcaaaagaatta

SEQ ID NO: 358223 - DNA, 16 bp, M. musculus
agcaggcaagcaggca

SEQ ID NO: 358224 - DNA, 16 bp, M. musculus
agcaggcacagcagca

SEQ ID NO: 358225 - DNA, 16 bp, M. musculus
agcaggcacaggtgaa

SEQ ID NO: 358226 - DNA, 16 bp, M. musculus
agcaggcagagcaagc

SEQ ID NO: 358227 - DNA, 16 bp, M. musculus
agcaggcagagctgag

SEQ ID NO: 358228 - DNA, 16 bp, M. musculus
agcaggcagaggcagg

SEQ ID NO: 358229 - DNA, 16 bp, M. musculus
agcaggcagcagaaag

SEQ ID NO: 358230 - DNA, 16 bp, M. musculus
agcaggcaggcagagg

SEQ ID NO: 358231 - DNA, 16 bp, M. musculus
agcaggcaggcagcag

SEQ ID NO: 358232 - DNA, 16 bp, M. musculus
agcaggcaggcatggc

SEQ ID NO: 358233 - DNA, 16 bp, M. musculus
agcaggcatggtacag

SEQ ID NO: 358234 - DNA, 20 bp, M. musculus
agcaggcggatttctgagtt

SEQ ID NO: 358235 - DNA, 16 bp, M. musculus
agcaggctaggctggc

SEQ ID NO: 358236 - DNA, 16 bp, M. musculus
agcaggctccaggaag

SEQ ID NO: 358237 - DNA, 16 bp, M. musculus
agcaggctgaacagac

SEQ ID NO: 358238 - DNA, 17 bp, M. musculus
agcaggctgagcaagcc

SEQ ID NO: 358239 - DNA, 18 bp, M. musculus
agcaggctgagcaagcca

SEQ ID NO: 358240 - DNA, 16 bp, M. musculus
agcaggctgagcaggc

SEQ ID NO: 358241 - DNA, 16 bp, M. musculus
agcaggctgagccaga

SEQ ID NO: 358242 - DNA, 16 bp, M. musculus
agcaggctggcctcag

SEQ ID NO: 358243 - DNA, 16 bp, M. musculus
agcaggcttctgtttt

SEQ ID NO: 358244 - DNA, 16 bp, M. musculus
agcagggaaaggcact

SEQ ID NO: 358245 - DNA, 16 bp, M. musculus
agcagggacagcaggg

SEQ ID NO: 358246 - DNA, 16 bp, M. musculus
agcagggaccctcctg

SEQ ID NO: 358247 - DNA, 16 bp, M. musculus
agcagggactgagcaa

SEQ ID NO: 358248 - DNA, 16 bp, M. musculus
agcagggcaggaagca

SEQ ID NO: 358249 - DNA, 16 bp, M. musculus
agcagggcaggagaag

SEQ ID NO: 358250 - DNA, 16 bp, M. musculus
agcagggcaggtggag

SEQ ID NO: 358251 - DNA, 16 bp, M. musculus
agcagggcatgggcct

SEQ ID NO: 358252 - DNA, 16 bp, M. musculus
agcagggcatggggag

SEQ ID NO: 358253 - DNA, 16 bp, M. musculus
agcagggctggagaga

SEQ ID NO: 358254 - DNA, 16 bp, M. musculus
agcagggcttttccag

SEQ ID NO: 358255 - DNA, 16 bp, M. musculus
agcaggggcaggcaga

SEQ ID NO: 358256 - DNA, 16 bp, M. musculus
agcaggggctggtgag

SEQ ID NO: 358257 - DNA, 16 bp, M. musculus
agcaggggctgtttct

SEQ ID NO: 358258 - DNA, 16 bp, M. musculus
agcaggggtgggtgtg

SEQ ID NO: 358259 - DNA, 16 bp, M. musculus
agcaggggttccagcc

SEQ ID NO: 358260 - DNA, 16 bp, M. musculus
agcagggtcccttcag

SEQ ID NO: 358261 - DNA, 16 bp, M. musculus
agcagggtgcagggag

SEQ ID NO: 358262 - DNA, 16 bp, M. musculus
agcagggtggagggag

SEQ ID NO: 358263 - DNA, 16 bp, M. musculus
agcagggtgggaggag

SEQ ID NO: 358264 - DNA, 16 bp, M. musculus
agcagggtttctctgt

SEQ ID NO: 358265 - DNA, 16 bp, M. musculus
agcaggtaaaggtact

SEQ ID NO: 358266 - DNA, 27 bp, M. musculus
agcaggtgaatcagattgccataaggg

SEQ ID NO: 358267 - DNA, 16 bp, M. musculus
agcaggtgcagcaggg

SEQ ID NO: 358268 - DNA, 16 bp, M. musculus
agcaggtgctcaataa

SEQ ID NO: 358269 - DNA, 16 bp, M. musculus
agcaggtggagggagg

SEQ ID NO: 358270 - DNA, 17 bp, M. musculus
agcaggtggatctctgt

SEQ ID NO: 358271 - DNA, 16 bp, M. musculus
agcaggtggatttcta

SEQ ID NO: 358272 - DNA, 16 bp, M. musculus
agcaggtggccttcct

SEQ ID NO: 358273 - DNA, 16 bp, M. musculus
agcaggtggctcacaa

SEQ ID NO: 358274 - DNA, 16 bp, M. musculus
agcaggtggtcctggg

SEQ ID NO: 358275 - DNA, 16 bp, M. musculus
agcaggttactggaga

SEQ ID NO: 358276 - DNA, 16 bp, M. musculus
agcaggttatatttag

SEQ ID NO: 358277 - DNA, 16 bp, M. musculus
agcaggttggggagga

SEQ ID NO: 358278 - DNA, 16 bp, M. musculus
agcaggttgtgtttat

SEQ ID NO: 358279 - DNA, 16 bp, M. musculus
agcagtaagagagaaa

SEQ ID NO: 358280 - DNA, 16 bp, M. musculus
agcagtaagtattctt

SEQ ID NO: 358281 - DNA, 16 bp, M. musculus
agcagtaccccggagc

SEQ ID NO: 358282 - DNA, 16 bp, M. musculus
agcagtagcaacaaca

SEQ ID NO: 358283 - DNA, 17 bp, M. musculus
agcagtagcagtagcag

SEQ ID NO: 358284 - DNA, 16 bp, M. musculus
agcagtagctgagaga

SEQ ID NO: 358285 - DNA, 16 bp, M. musculus
agcagtagctgagagt

SEQ ID NO: 358286 - DNA, 16 bp, M. musculus
agcagtatcttgaaga

SEQ ID NO: 358287 - DNA, 16 bp, M. musculus
agcagtcaaagaaaat

SEQ ID NO: 358288 - DNA, 17 bp, M. musculus
agcagtcaatgctctta

SEQ ID NO: 358289 - DNA, 16 bp, M. musculus
agcagtcagagctctt

SEQ ID NO: 358290 - DNA, 16 bp, M. musculus
agcagtcaggaggaag

SEQ ID NO: 358291 - DNA, 16 bp, M. musculus
agcagtcaggccaggg

SEQ ID NO: 358292 - DNA, 17 bp, M. musculus
agcagtcagtgatctta

SEQ ID NO: 358293 - DNA, 17 bp, M. musculus
agcagtcagtgctcttt

SEQ ID NO: 358294 - DNA, 16 bp, M. musculus
agcagtcagtgtgctt

SEQ ID NO: 358295 - DNA, 16 bp, M. musculus
agcagtcatctccgaa

SEQ ID NO: 358296 - DNA, 16 bp, M. musculus
agcagtcatgtttgaa

SEQ ID NO: 358297 - DNA, 16 bp, M. musculus
agcagtccaattcagt

SEQ ID NO: 358298 - DNA, 16 bp, M. musculus
agcagtccctctgcct

SEQ ID NO: 358299 - DNA, 16 bp, M. musculus
agcagtctcaggctgt

SEQ ID NO: 358300 - DNA, 16 bp, M. musculus
agcagtctggaggcag

SEQ ID NO: 358301 - DNA, 16 bp, M. musculus
agcagtctgtactctt

SEQ ID NO: 358302 - DNA, 16 bp, M. musculus
agcagtgacagcaaca

SEQ ID NO: 358303 - DNA, 16 bp, M. musculus
agcagtgactgctctt

SEQ ID NO: 358304 - DNA, 16 bp, M. musculus
agcagtgaggagggag

SEQ ID NO: 358305 - DNA, 16 bp, M. musculus
agcagtgaggcaggag

SEQ ID NO: 358306 - DNA, 17 bp, M. musculus
agcagtgattatgaaga

SEQ ID NO: 358307 - DNA, 16 bp, M. musculus
agcagtgccaagagga

SEQ ID NO: 358308 - DNA, 17 bp, M. musculus
agcagtgctaagagaaa

SEQ ID NO: 358309 - DNA, 16 bp, M. musculus
agcagtgctaagagga

SEQ ID NO: 358310 - DNA, 16 bp, M. musculus
agcagtggaggactct

SEQ ID NO: 358311 - DNA, 16 bp, M. musculus
agcagtggcagtggca

SEQ ID NO: 358312 - DNA, 16 bp, M. musculus
agcagtggctaaagga

SEQ ID NO: 358313 - DNA, 16 bp, M. musculus
agcagtggctgctctt

SEQ ID NO: 358314 - DNA, 42 bp, M. musculus
agcagtgggcgtggcagaacgaatgagcaggaagctccaccc

SEQ ID NO: 358315 - DNA, 16 bp, M. musculus
agcagtggggtgatga

SEQ ID NO: 358316 - DNA, 16 bp, M. musculus
agcagtggtggcgcac

SEQ ID NO: 358317 - DNA, 16 bp, M. musculus
agcagtggttctcagt

SEQ ID NO: 358318 - DNA, 16 bp, M. musculus
agcagtgtccaggcag

SEQ ID NO: 358319 - DNA, 16 bp, M. musculus
agcagtgtttctttta

SEQ ID NO: 358320 - DNA, 16 bp, M. musculus
agcagttaagaacacc

SEQ ID NO: 358321 - DNA, 16 bp, M. musculus
agcagttaagaacact

SEQ ID NO: 358322 - DNA, 16 bp, M. musculus
agcagttaagagcacc

SEQ ID NO: 358323 - DNA, 16 bp, M. musculus
agcagttacagagaca

SEQ ID NO: 358324 - DNA, 17 bp, M. musculus
agcagttagtgctctta

SEQ ID NO: 358325 - DNA, 16 bp, M. musculus
agcagttcctgctgag

SEQ ID NO: 358326 - DNA, 16 bp, M. musculus
agcagttctcaaactg

SEQ ID NO: 358327 - DNA, 16 bp, M. musculus
agcagttctcagcctt

SEQ ID NO: 358328 - DNA, 16 bp, M. musculus
agcagttgagaagttg

SEQ ID NO: 358329 - DNA, 16 bp, M. musculus
agcagttgagagcaca

SEQ ID NO: 358330 - DNA, 16 bp, M. musculus
agcagttgagagcact

SEQ ID NO: 358331 - DNA, 16 bp, M. musculus
agcagtttggggagga

SEQ ID NO: 358332 - DNA, 16 bp, M. musculus
agcagttttggggacc

SEQ ID NO: 358333 - DNA, 16 bp, M. musculus
agcataaagaagctgt

SEQ ID NO: 358334 - DNA, 17 bp, M. musculus
agcataacctccatctc

SEQ ID NO: 358335 - DNA, 16 bp, M. musculus
agcatacatctcgggg

SEQ ID NO: 358336 - DNA, 16 bp, M. musculus
agcataccacacacac

SEQ ID NO: 358337 - DNA, 16 bp, M. musculus
agcatagactgaagga

SEQ ID NO: 358338 - DNA, 16 bp, M. musculus
agcatagccttttgta

SEQ ID NO: 358339 - DNA, 16 bp, M. musculus
agcataggcttttgta

SEQ ID NO: 358340 - DNA, 16 bp, M. musculus
agcatcaaatataatt

SEQ ID NO: 358341 - DNA, 16 bp, M. musculus
agcatcaaatttttta

SEQ ID NO: 358342 - DNA, 16 bp, M. musculus
agcatcaaggcaggca

SEQ ID NO: 358343 - DNA, 16 bp, M. musculus
agcatcaatagtctca

SEQ ID NO: 358344 - DNA, 16 bp, M. musculus
agcatcaattatccca

SEQ ID NO: 358345 - DNA, 16 bp, M. musculus
agcatcagaaaacaca

SEQ ID NO: 358346 - DNA, 16 bp, M. musculus
agcatcagaaccactc

SEQ ID NO: 358347 - DNA, 16 bp, M. musculus
agcatcagaagttcaa

SEQ ID NO: 358348 - DNA, 23 bp, M. musculus
agcatcagatcccattacagatg

SEQ ID NO: 358349 - DNA, 23 bp, M. musculus
agcatcagcaacagaatacaaga

SEQ ID NO: 358350 - DNA, 18 bp, M. musculus
agcatcagcaactaggca

SEQ ID NO: 358351 - DNA, 16 bp, M. musculus
agcatcaggaggcaga

SEQ ID NO: 358352 - DNA, 16 bp, M. musculus
agcatcagtaacagtg

SEQ ID NO: 358353 - DNA, 16 bp, M. musculus
agcatcataaagtcag

SEQ ID NO: 358354 - DNA, 16 bp, M. musculus
agcatcatgtctgcct

SEQ ID NO: 358355 - DNA, 16 bp, M. musculus
agcatcatttaaaaaa

SEQ ID NO: 358356 - DNA, 16 bp, M. musculus
agcatcatttattgaa

SEQ ID NO: 358357 - DNA, 16 bp, M. musculus
agcatccaagcaggca

SEQ ID NO: 358358 - DNA, 16 bp, M. musculus
agcatccacacagtgg

SEQ ID NO: 358359 - DNA, 16 bp, M. musculus
agcatccacactttgt

SEQ ID NO: 358360 - DNA, 16 bp, M. musculus
agcatccacatggaag

SEQ ID NO: 358361 - DNA, 16 bp, M. musculus
agcatccaggaaggca

SEQ ID NO: 358362 - DNA, 16 bp, M. musculus
agcatccagtgctttt

SEQ ID NO: 358363 - DNA, 16 bp, M. musculus
agcatccagtggaaaa

SEQ ID NO: 358364 - DNA, 16 bp, M. musculus
agcatccagtgttctt

SEQ ID NO: 358365 - DNA, 16 bp, M. musculus
agcatccatgcaagca

SEQ ID NO: 358366 - DNA, 16 bp, M. musculus
agcatcccagcatccc

SEQ ID NO: 358367 - DNA, 16 bp, M. musculus
agcatcccccagtccc

SEQ ID NO: 358368 - DNA, 16 bp, M. musculus
agcatcctcacttggg

SEQ ID NO: 358369 - DNA, 16 bp, M. musculus
agcatcctcctcctcc

SEQ ID NO: 358370 - DNA, 16 bp, M. musculus
agcatcctctcagagg

SEQ ID NO: 358371 - DNA, 16 bp, M. musculus
agcatcctgagtgagg

SEQ ID NO: 358372 - DNA, 16 bp, M. musculus
agcatcctgcagaaaa

SEQ ID NO: 358373 - DNA, 16 bp, M. musculus
agcatccttcagatga

SEQ ID NO: 358374 - DNA, 16 bp, M. musculus
agcatccttgcttgtg

SEQ ID NO: 358375 - DNA, 16 bp, M. musculus
agcatcgttgaggtga

SEQ ID NO: 358376 - DNA, 16 bp, M. musculus
agcatctaagcaggca

SEQ ID NO: 358377 - DNA, 16 bp, M. musculus
agcatctaattagatg

SEQ ID NO: 358378 - DNA, 16 bp, M. musculus
agcatctactgagatg

SEQ ID NO: 358379 - DNA, 16 bp, M. musculus
agcatctcccttccct

SEQ ID NO: 358380 - DNA, 16 bp, M. musculus
agcatctctcactgaa

SEQ ID NO: 358381 - DNA, 16 bp, M. musculus
agcatctctcagcatc

SEQ ID NO: 358382 - DNA, 16 bp, M. musculus
agcatctctggataaa

SEQ ID NO: 358383 - DNA, 16 bp, M. musculus
agcatctctgggatga

SEQ ID NO: 358384 - DNA, 16 bp, M. musculus
agcatctgacccctgt

SEQ ID NO: 358385 - DNA, 16 bp, M. musculus
agcatctgcaacagaa

SEQ ID NO: 358386 - DNA, 17 bp, M. musculus
agcatctgccccagatg

SEQ ID NO: 358387 - DNA, 16 bp, M. musculus
agcatctgctgccacc

SEQ ID NO: 358388 - DNA, 16 bp, M. musculus
agcatctgctgtaacc

SEQ ID NO: 358389 - DNA, 16 bp, M. musculus
agcatctgctgtctcc

SEQ ID NO: 358390 - DNA, 16 bp, M. musculus
agcatctgtgtgtgtg

SEQ ID NO: 358391 - DNA, 16 bp, M. musculus
agcatcttggaatctg

SEQ ID NO: 358392 - DNA, 16 bp, M. musculus
agcatcttttcatgtt

SEQ ID NO: 358393 - DNA, 16 bp, M. musculus
agcatcttttggttat

SEQ ID NO: 358394 - DNA, 16 bp, M. musculus
agcatgaagaagaatg

SEQ ID NO: 358395 - DNA, 16 bp, M. musculus
agcatgaagacctgtg

SEQ ID NO: 358396 - DNA, 16 bp, M. musculus
agcatgaagcagccag

SEQ ID NO: 358397 - DNA, 16 bp, M. musculus
agcatgacagcaggca

SEQ ID NO: 358398 - DNA, 16 bp, M. musculus
agcatgaccaaggcaa

SEQ ID NO: 358399 - DNA, 16 bp, M. musculus
agcatgaccccagcca

SEQ ID NO: 358400 - DNA, 16 bp, M. musculus
agcatgagcaacagaa

SEQ ID NO: 358401 - DNA, 16 bp, M. musculus
agcatgagccattgga

SEQ ID NO: 358402 - DNA, 16 bp, M. musculus
agcatgaggaaggctg

SEQ ID NO: 358403 - DNA, 16 bp, M. musculus
agcatgaggaaggttg

SEQ ID NO: 358404 - DNA, 16 bp, M. musculus
agcatgaggagctgag

SEQ ID NO: 358405 - DNA, 16 bp, M. musculus
agcatgaggcagagag

SEQ ID NO: 358406 - DNA, 16 bp, M. musculus
agcatgagtccaggag

SEQ ID NO: 358407 - DNA, 16 bp, M. musculus
agcatgatgaagaagg

SEQ ID NO: 358408 - DNA, 16 bp, M. musculus
agcatgcacaaagcct

SEQ ID NO: 358409 - DNA, 16 bp, M. musculus
agcatgcacaggacct

SEQ ID NO: 358410 - DNA, 16 bp, M. musculus
agcatgcactgctctt

SEQ ID NO: 358411 - DNA, 16 bp, M. musculus
agcatgcagaaagccc

SEQ ID NO: 358412 - DNA, 16 bp, M. musculus
agcatgcagaaggccc

SEQ ID NO: 358413 - DNA, 16 bp, M. musculus
agcatgcaggagctgg

SEQ ID NO: 358414 - DNA, 16 bp, M. musculus
agcatgcaggaggcag

SEQ ID NO: 358415 - DNA, 16 bp, M. musculus
agcatgcatgtgcatg

SEQ ID NO: 358416 - DNA, 16 bp, M. musculus
agcatgctaggcaagc

SEQ ID NO: 358417 - DNA, 16 bp, M. musculus
agcatggaagatcttt

SEQ ID NO: 358418 - DNA, 16 bp, M. musculus
agcatggcagcaggca

SEQ ID NO: 358419 - DNA, 16 bp, M. musculus
agcatggcagcatcta

SEQ ID NO: 358420 - DNA, 17 bp, M. musculus
agcatggcagtatccag

SEQ ID NO: 358421 - DNA, 16 bp, M. musculus
agcatggctgcaggca

SEQ ID NO: 358422 - DNA, 16 bp, M. musculus
agcatggctggagaag

SEQ ID NO: 358423 - DNA, 16 bp, M. musculus
agcatggggtcctcaa

SEQ ID NO: 358424 - DNA, 16 bp, M. musculus
agcatggtagcatcca

SEQ ID NO: 358425 - DNA, 16 bp, M. musculus
agcatggtgctggagc

SEQ ID NO: 358426 - DNA, 16 bp, M. musculus
agcatggtggcctgca

SEQ ID NO: 358427 - DNA, 16 bp, M. musculus
agcatgtaaaagaatg

SEQ ID NO: 358428 - DNA, 17 bp, M. musculus
agcatgtctgatgatga

SEQ ID NO: 358429 - DNA, 16 bp, M. musculus
agcatgtgcaaagccc

SEQ ID NO: 358430 - DNA, 16 bp, M. musculus
agcatgtgcttagcat

SEQ ID NO: 358431 - DNA, 16 bp, M. musculus
agcatgtgtccttacc

SEQ ID NO: 358432 - DNA, 16 bp, M. musculus
agcatgtgtgcttatt

SEQ ID NO: 358433 - DNA, 16 bp, M. musculus
agcatgtgttcatatt

SEQ ID NO: 358434 - DNA, 16 bp, M. musculus
agcatgttcaacaaat

SEQ ID NO: 358435 - DNA, 16 bp, M. musculus
agcattaaccccagaa

SEQ ID NO: 358436 - DNA, 16 bp, M. musculus
agcattattgaggtga

SEQ ID NO: 358437 - DNA, 16 bp, M. musculus
agcattattttatttt

SEQ ID NO: 358438 - DNA, 16 bp, M. musculus
agcattcaaatatatg

SEQ ID NO: 358439 - DNA, 16 bp, M. musculus
agcattctacccctga

SEQ ID NO: 358440 - DNA, 16 bp, M. musculus
agcattctgaaggctg

SEQ ID NO: 358441 - DNA, 16 bp, M. musculus
agcattcttctcaaag

SEQ ID NO: 358442 - DNA, 16 bp, M. musculus
agcattgactgctctt

SEQ ID NO: 358443 - DNA, 16 bp, M. musculus
agcattgagaaagatg

SEQ ID NO: 358444 - DNA, 16 bp, M. musculus
agcattgctaagagga

SEQ ID NO: 358445 - DNA, 16 bp, M. musculus
agcattggaaatgaaa

SEQ ID NO: 358446 - DNA, 16 bp, M. musculus
agcattggaattgtaa

SEQ ID NO: 358447 - DNA, 16 bp, M. musculus
agcattggctgctttt

SEQ ID NO: 358448 - DNA, 16 bp, M. musculus
agcattggctgttctt

SEQ ID NO: 358449 - DNA, 16 bp, M. musculus
agcatttaagagcact

SEQ ID NO: 358450 - DNA, 16 bp, M. musculus
agcatttatacaccct

SEQ ID NO: 358451 - DNA, 16 bp, M. musculus
agcatttgaaaaaaat

SEQ ID NO: 358452 - DNA, 16 bp, M. musculus
agcatttgaaaaataa

SEQ ID NO: 358453 - DNA, 16 bp, M. musculus
agcatttgaataatac

SEQ ID NO: 358454 - DNA, 16 bp, M. musculus
agcatttgagaggcag

SEQ ID NO: 358455 - DNA, 16 bp, M. musculus
agcatttggaagacag

SEQ ID NO: 358456 - DNA, 16 bp, M. musculus
agcatttggaagttga

SEQ ID NO: 358457 - DNA, 16 bp, M. musculus
agcatttgggagactg

SEQ ID NO: 358458 - DNA, 16 bp, M. musculus
agcatttgggagccag

SEQ ID NO: 358459 - DNA, 16 bp, M. musculus
agcatttggtaggcag

SEQ ID NO: 358460 - DNA, 16 bp, M. musculus
agcatttgtaattttt

SEQ ID NO: 358461 - DNA, 16 bp, M. musculus
agcatttgttgctctt

SEQ ID NO: 358462 - DNA, 16 bp, M. musculus
agcatttgttgctttt

SEQ ID NO: 358463 - DNA, 16 bp, M. musculus
agcattttgctacttg

SEQ ID NO: 358464 - DNA, 16 bp, M. musculus
agcattttgctgcaaa

SEQ ID NO: 358465 - DNA, 16 bp, M. musculus
agcattttgcttcata

SEQ ID NO: 358466 - DNA, 16 bp, M. musculus
agcatttttattttat

SEQ ID NO: 358467 - DNA, 16 bp, M. musculus
agcatttttcaacaaa

SEQ ID NO: 358468 - DNA, 16 bp, M. musculus
agccaaaaggccaaga

SEQ ID NO: 358469 - DNA, 16 bp, M. musculus
agccaaaagttctaca

SEQ ID NO: 358470 - DNA, 16 bp, M. musculus
agccaaaataaaccct

SEQ ID NO: 358471 - DNA, 16 bp, M. musculus
agccaaaataaattct

SEQ ID NO: 358472 - DNA, 16 bp, M. musculus
agccaaaatggctgag

SEQ ID NO: 358473 - DNA, 16 bp, M. musculus
agccaaaatgtccaac

SEQ ID NO: 358474 - DNA, 16 bp, M. musculus
agccaaacatcaggca

SEQ ID NO: 358475 - DNA, 16 bp, M. musculus
agccaaagaaaatgca

SEQ ID NO: 358476 - DNA, 16 bp, M. musculus
agccaaagagaagggc

SEQ ID NO: 358477 - DNA, 16 bp, M. musculus
agccaaagatgacctt

SEQ ID NO: 358478 - DNA, 16 bp, M. musculus
agccaaagatgatctt

SEQ ID NO: 358479 - DNA, 16 bp, M. musculus
agccaaagctcctgaa

SEQ ID NO: 358480 - DNA, 16 bp, M. musculus
agccaaagtcagagac

SEQ ID NO: 358481 - DNA, 16 bp, M. musculus
agccaaatggattgac

SEQ ID NO: 358482 - DNA, 16 bp, M. musculus
agccaaattcattaaa

SEQ ID NO: 358483 - DNA, 16 bp, M. musculus
agccaacaccatttgt

SEQ ID NO: 358484 - DNA, 16 bp, M. musculus
agccaacaccctcttc

SEQ ID NO: 358485 - DNA, 16 bp, M. musculus
agccaaccctgagctt

SEQ ID NO: 358486 - DNA, 16 bp, M. musculus
agccaacctgaagaga

SEQ ID NO: 358487 - DNA, 16 bp, M. musculus
agccaagagttttaat

SEQ ID NO: 358488 - DNA, 17 bp, M. musculus
agccaagagttttaatc

SEQ ID NO: 358489 - DNA, 16 bp, M. musculus
agccaagcagatctct

SEQ ID NO: 358490 - DNA, 16 bp, M. musculus
agccaagcctcagcct

SEQ ID NO: 358491 - DNA, 16 bp, M. musculus
agccaaggatagcctt

SEQ ID NO: 358492 - DNA, 16 bp, M. musculus
agccaaggatgaccta

SEQ ID NO: 358493 - DNA, 16 bp, M. musculus
agccaaggcaacatag

SEQ ID NO: 358494 - DNA, 16 bp, M. musculus
agccaaggcaggaaga

SEQ ID NO: 358495 - DNA, 16 bp, M. musculus
agccaaggctggcctt

SEQ ID NO: 358496 - DNA, 16 bp, M. musculus
agccaaggctggcttc

SEQ ID NO: 358497 - DNA, 16 bp, M. musculus
agccaaggctgtacct

SEQ ID NO: 358498 - DNA, 16 bp, M. musculus
agccaagtctccagcc

SEQ ID NO: 358499 - DNA, 16 bp, M. musculus
agccaagtggagcaag

SEQ ID NO: 358500 - DNA, 16 bp, M. musculus
agccaagtggtggtgg

SEQ ID NO: 358501 - DNA, 16 bp, M. musculus
agccaataaagaacat

SEQ ID NO: 358502 - DNA, 18 bp, M. musculus
agccaatatcaaagtaaa

SEQ ID NO: 358503 - DNA, 16 bp, M. musculus
agccaatcagaagctg

SEQ ID NO: 358504 - DNA, 16 bp, M. musculus
agccaatccctgacac

SEQ ID NO: 358505 - DNA, 16 bp, M. musculus
agccaatgagcttccc

SEQ ID NO: 358506 - DNA, 16 bp, M. musculus
agccaatgctcttaac

SEQ ID NO: 358507 - DNA, 16 bp, M. musculus
agccaattatgttaaa

SEQ ID NO: 358508 - DNA, 16 bp, M. musculus
agccacaaaaagaccc

SEQ ID NO: 358509 - DNA, 16 bp, M. musculus
agccacaacatagcca

SEQ ID NO: 358510 - DNA, 16 bp, M. musculus
agccacaagaagatta

SEQ ID NO: 358511 - DNA, 16 bp, M. musculus
agccacaagctggaaa

SEQ ID NO: 358512 - DNA, 17 bp, M. musculus
agccacaagttccacca

SEQ ID NO: 358513 - DNA, 16 bp, M. musculus
agccacaattaaatgc

SEQ ID NO: 358514 - DNA, 16 bp, M. musculus
agccacacatgtagca

SEQ ID NO: 358515 - DNA, 16 bp, M. musculus
agccacactttatttc

SEQ ID NO: 358516 - DNA, 16 bp, M. musculus
agccacagaacagaat

SEQ ID NO: 358517 - DNA, 16 bp, M. musculus
agccacagagattctg

SEQ ID NO: 358518 - DNA, 16 bp, M. musculus
agccacagagccacag

SEQ ID NO: 358519 - DNA, 16 bp, M. musculus
agccacagagccactg

SEQ ID NO: 358520 - DNA, 16 bp, M. musculus
agccacagcagcagtg

SEQ ID NO: 358521 - DNA, 16 bp, M. musculus
agccacagcagccaca

SEQ ID NO: 358522 - DNA, 16 bp, M. musculus
agccacagcctcagcc

SEQ ID NO: 358523 - DNA, 16 bp, M. musculus
agccacagctgctgag

SEQ ID NO: 358524 - DNA, 16 bp, M. musculus
agccacagctggagcc

SEQ ID NO: 358525 - DNA, 16 bp, M. musculus
agccacaggagccaca

SEQ ID NO: 358526 - DNA, 16 bp, M. musculus
agccacaggggtcagc

SEQ ID NO: 358527 - DNA, 16 bp, M. musculus
agccacagtataggaa

SEQ ID NO: 358528 - DNA, 16 bp, M. musculus
agccacagtcaggaag

SEQ ID NO: 358529 - DNA, 16 bp, M. musculus
agccacagtttgcaaa

SEQ ID NO: 358530 - DNA, 16 bp, M. musculus
agccacatcccagccc

SEQ ID NO: 358531 - DNA, 16 bp, M. musculus
agccacatcccagctg

SEQ ID NO: 358532 - DNA, 16 bp, M. musculus
agccacatcctcagcc

SEQ ID NO: 358533 - DNA, 16 bp, M. musculus
agccacatgcccagcc

SEQ ID NO: 358534 - DNA, 16 bp, M. musculus
agccaccaaccagaca

SEQ ID NO: 358535 - DNA, 16 bp, M. musculus
agccaccaagtatctg

SEQ ID NO: 358536 - DNA, 16 bp, M. musculus
agccaccaccatcacc

SEQ ID NO: 358537 - DNA, 16 bp, M. musculus
agccaccaggacacag

SEQ ID NO: 358538 - DNA, 16 bp, M. musculus
agccaccatatgagtg

SEQ ID NO: 358539 - DNA, 16 bp, M. musculus
agccaccatgcaggtg

SEQ ID NO: 358540 - DNA, 16 bp, M. musculus
agccaccatgtcattg

SEQ ID NO: 358541 - DNA, 17 bp, M. musculus
agccaccatgtggttgg

SEQ ID NO: 358542 - DNA, 16 bp, M. musculus
agccacccctccagcc

SEQ ID NO: 358543 - DNA, 16 bp, M. musculus
agccacctcactggcc

SEQ ID NO: 358544 - DNA, 16 bp, M. musculus
agccacctcagcagcc

SEQ ID NO: 358545 - DNA, 16 bp, M. musculus
agccacctcccagccc

SEQ ID NO: 358546 - DNA, 16 bp, M. musculus
agccacctccccagca

SEQ ID NO: 358547 - DNA, 16 bp, M. musculus
agccacctccccagcc

SEQ ID NO: 358548 - DNA, 16 bp, M. musculus
agccacctccccagct

SEQ ID NO: 358549 - DNA, 16 bp, M. musculus
agccacctccctagcc

SEQ ID NO: 358550 - DNA, 16 bp, M. musculus
agccacctctccagac

SEQ ID NO: 358551 - DNA, 16 bp, M. musculus
agccacctcttcagtc

SEQ ID NO: 358552 - DNA, 16 bp, M. musculus
agccacctgcctctgc

SEQ ID NO: 358553 - DNA, 16 bp, M. musculus
agccacctggaaagga

SEQ ID NO: 358554 - DNA, 16 bp, M. musculus
agccaccttcccagcc

SEQ ID NO: 358555 - DNA, 16 bp, M. musculus
agccacctttccagcc

SEQ ID NO: 358556 - DNA, 16 bp, M. musculus
agccactaagcagcac

SEQ ID NO: 358557 - DNA, 16 bp, M. musculus
agccactatgtgattg

SEQ ID NO: 358558 - DNA, 16 bp, M. musculus
agccactgctgctgct

SEQ ID NO: 358559 - DNA, 16 bp, M. musculus
agccactgctggaaaa

SEQ ID NO: 358560 - DNA, 16 bp, M. musculus
agccactgggcctggc

SEQ ID NO: 358561 - DNA, 16 bp, M. musculus
agccacttcctcctcc

SEQ ID NO: 358562 - DNA, 16 bp, M. musculus
agccacttggctgaag

SEQ ID NO: 358563 - DNA, 16 bp, M. musculus
agccacttgggtttta

SEQ ID NO: 358564 - DNA, 16 bp, M. musculus
agccactttgttgaag

SEQ ID NO: 358565 - DNA, 16 bp, M. musculus
agccagaaaccagaaa

SEQ ID NO: 358566 - DNA, 16 bp, M. musculus
agccagaaactggaag

SEQ ID NO: 358567 - DNA, 16 bp, M. musculus
agccagaactacatag

SEQ ID NO: 358568 - DNA, 16 bp, M. musculus
agccagaagagcctag

SEQ ID NO: 358569 - DNA, 16 bp, M. musculus
agccagaagagcctgt

SEQ ID NO: 358570 - DNA, 16 bp, M. musculus
agccagaagatcaggg

SEQ ID NO: 358571 - DNA, 16 bp, M. musculus
agccagaagatgagaa

SEQ ID NO: 358572 - DNA, 16 bp, M. musculus
agccagaagattctgg

SEQ ID NO: 358573 - DNA, 16 bp, M. musculus
agccagaagctgaaag

SEQ ID NO: 358574 - DNA, 16 bp, M. musculus
agccagaagctggaag

SEQ ID NO: 358575 - DNA, 16 bp, M. musculus
agccagaaggagactg

SEQ ID NO: 358576 - DNA, 16 bp, M. musculus
agccagaattacatag

SEQ ID NO: 358577 - DNA, 16 bp, M. musculus
agccagacaaaccaga

SEQ ID NO: 358578 - DNA, 16 bp, M. musculus
agccagacacaggtga

SEQ ID NO: 358579 - DNA, 16 bp, M. musculus
agccagacccagaaag

SEQ ID NO: 358580 - DNA, 16 bp, M. musculus
agccagactgactaga

SEQ ID NO: 358581 - DNA, 16 bp, M. musculus
agccagacttactaga

SEQ ID NO: 358582 - DNA, 16 bp, M. musculus
agccagagaaactctg

SEQ ID NO: 358583 - DNA, 16 bp, M. musculus
agccagagaacaactt

SEQ ID NO: 358584 - DNA, 16 bp, M. musculus
agccagagaaggagaa

SEQ ID NO: 358585 - DNA, 16 bp, M. musculus
agccagagacacaagc

SEQ ID NO: 358586 - DNA, 16 bp, M. musculus
agccagagacaggttt

SEQ ID NO: 358587 - DNA, 16 bp, M. musculus
agccagagagagaaag

SEQ ID NO: 358588 - DNA, 16 bp, M. musculus
agccagagagagcaag

SEQ ID NO: 358589 - DNA, 16 bp, M. musculus
agccagagagccagag

SEQ ID NO: 358590 - DNA, 16 bp, M. musculus
agccagagaggctatc

SEQ ID NO: 358591 - DNA, 16 bp, M. musculus
agccagagagtaagaa

SEQ ID NO: 358592 - DNA, 16 bp, M. musculus
agccagagatcttgaa

SEQ ID NO: 358593 - DNA, 16 bp, M. musculus
agccagagcaggaagc

SEQ ID NO: 358594 - DNA, 16 bp, M. musculus
agccagagccacacag

SEQ ID NO: 358595 - DNA, 16 bp, M. musculus
agccagagccacagag

SEQ ID NO: 358596 - DNA, 16 bp, M. musculus
agccagagccaggtgg

SEQ ID NO: 358597 - DNA, 16 bp, M. musculus
agccagagctctggga

SEQ ID NO: 358598 - DNA, 16 bp, M. musculus
agccagagctgcagag

SEQ ID NO: 358599 - DNA, 16 bp, M. musculus
agccagaggaagccag

SEQ ID NO: 358600 - DNA, 16 bp, M. musculus
agccagaggagccaga

SEQ ID NO: 358601 - DNA, 16 bp, M. musculus
agccagaggaggagga

SEQ ID NO: 358602 - DNA, 16 bp, M. musculus
agccagaggagggcat

SEQ ID NO: 358603 - DNA, 16 bp, M. musculus
agccagaggatgagaa

SEQ ID NO: 358604 - DNA, 16 bp, M. musculus
agccagaggcagctgg

SEQ ID NO: 358605 - DNA, 16 bp, M. musculus
agccagaggcaggagg

SEQ ID NO: 358606 - DNA, 16 bp, M. musculus
agccagaggcatctgg

SEQ ID NO: 358607 - DNA, 16 bp, M. musculus
agccagaggccagcct

SEQ ID NO: 358608 - DNA, 16 bp, M. musculus
agccagagttacaggt

SEQ ID NO: 358609 - DNA, 16 bp, M. musculus
agccagagttccagga

SEQ ID NO: 358610 - DNA, 16 bp, M. musculus
agccagatgtggtggc

SEQ ID NO: 358611 - DNA, 16 bp, M. musculus
agccagattttttttt

SEQ ID NO: 358612 - DNA, 16 bp, M. musculus
agccagcaagcagcac

SEQ ID NO: 358613 - DNA, 16 bp, M. musculus
agccagcaagccccag

SEQ ID NO: 358614 - DNA, 16 bp, M. musculus
agccagcacagctgct

SEQ ID NO: 358615 - DNA, 16 bp, M. musculus
agccagcacctcagca

SEQ ID NO: 358616 - DNA, 16 bp, M. musculus
agccagcagcagcagc

SEQ ID NO: 358617 - DNA, 16 bp, M. musculus
agccagcagcaggccc

SEQ ID NO: 358618 - DNA, 16 bp, M. musculus
agccagcagccagcag

SEQ ID NO: 358619 - DNA, 16 bp, M. musculus
agccagcagctcaggg

SEQ ID NO: 358620 - DNA, 16 bp, M. musculus
agccagcagtcctcag

SEQ ID NO: 358621 - DNA, 16 bp, M. musculus
agccagcattcctcag

SEQ ID NO: 358622 - DNA, 16 bp, M. musculus
agccagccagccaacc

SEQ ID NO: 358623 - DNA, 16 bp, M. musculus
agccagccagccaccc

SEQ ID NO: 358624 - DNA, 16 bp, M. musculus
agccagccagccagag

SEQ ID NO: 358625 - DNA, 16 bp, M. musculus
agccagccagccagca

SEQ ID NO: 358626 - DNA, 16 bp, M. musculus
agccagccagccagcc

SEQ ID NO: 358627 - DNA, 16 bp, M. musculus
agccagccagccagct

SEQ ID NO: 358628 - DNA, 16 bp, M. musculus
agccagccagccaggg

SEQ ID NO: 358629 - DNA, 16 bp, M. musculus
agccagccagcctgcc

SEQ ID NO: 358630 - DNA, 16 bp, M. musculus
agccagccagggccac

SEQ ID NO: 358631 - DNA, 16 bp, M. musculus
agccagcccagcccag

SEQ ID NO: 358632 - DNA, 16 bp, M. musculus
agccagcccagcctac

SEQ ID NO: 358633 - DNA, 16 bp, M. musculus
agccagccccaattca

SEQ ID NO: 358634 - DNA, 16 bp, M. musculus
agccagccccagccag

SEQ ID NO: 358635 - DNA, 16 bp, M. musculus
agccagcctcaaactc

SEQ ID NO: 358636 - DNA, 16 bp, M. musculus
agccagcctgctcaag

SEQ ID NO: 358637 - DNA, 16 bp, M. musculus
agccagcctggactgc

SEQ ID NO: 358638 - DNA, 16 bp, M. musculus
agccagcctggcctac

SEQ ID NO: 358639 - DNA, 16 bp, M. musculus
agccagcctgggctat

SEQ ID NO: 358640 - DNA, 17 bp, M. musculus
agccagcctggtctaca

SEQ ID NO: 358641 - DNA, 16 bp, M. musculus
agccagcgccactctg

SEQ ID NO: 358642 - DNA, 16 bp, M. musculus
agccagctcactggcc

SEQ ID NO: 358643 - DNA, 16 bp, M. musculus
agccagctcccccaca

SEQ ID NO: 358644 - DNA, 16 bp, M. musculus
agccagctctgcagcc

SEQ ID NO: 358645 - DNA, 16 bp, M. musculus
agccagctcttagtaa

SEQ ID NO: 358646 - DNA, 16 bp, M. musculus
agccagcttgctccag

SEQ ID NO: 358647 - DNA, 16 bp, M. musculus
agccagcttgctctag

SEQ ID NO: 358648 - DNA, 16 bp, M. musculus
agccagcttgctctga

SEQ ID NO: 358649 - DNA, 16 bp, M. musculus
agccaggaacctggag

SEQ ID NO: 358650 - DNA, 16 bp, M. musculus
agccaggaactggaaa

SEQ ID NO: 358651 - DNA, 16 bp, M. musculus
agccaggaagagactg

SEQ ID NO: 358652 - DNA, 16 bp, M. musculus
agccaggacaatacag

SEQ ID NO: 358653 - DNA, 16 bp, M. musculus
agccaggaccaccagc

SEQ ID NO: 358654 - DNA, 16 bp, M. musculus
agccaggactacacgg

SEQ ID NO: 358655 - DNA, 16 bp, M. musculus
agccaggactacagaa

SEQ ID NO: 358656 - DNA, 16 bp, M. musculus
agccaggactataaag

SEQ ID NO: 358657 - DNA, 16 bp, M. musculus
agccaggagacagagc

SEQ ID NO: 358658 - DNA, 16 bp, M. musculus
agccaggagaggcagg

SEQ ID NO: 358659 - DNA, 16 bp, M. musculus
agccaggaggaacaag

SEQ ID NO: 358660 - DNA, 16 bp, M. musculus
agccaggaggacacct

SEQ ID NO: 358661 - DNA, 16 bp, M. musculus
agccaggaggagactc

SEQ ID NO: 358662 - DNA, 16 bp, M. musculus
agccaggagggcaagc

SEQ ID NO: 358663 - DNA, 16 bp, M. musculus
agccaggagtacacag

SEQ ID NO: 358664 - DNA, 16 bp, M. musculus
agccaggattacagga

SEQ ID NO: 358665 - DNA, 16 bp, M. musculus
agccaggcacagaaag

SEQ ID NO: 358666 - DNA, 16 bp, M. musculus
agccaggcacagtggc

SEQ ID NO: 358667 - DNA, 16 bp, M. musculus
agccaggcactggcag

SEQ ID NO: 358668 - DNA, 16 bp, M. musculus
agccaggcactggtgg

SEQ ID NO: 358669 - DNA, 16 bp, M. musculus
agccaggcagaaaccc

SEQ ID NO: 358670 - DNA, 16 bp, M. musculus
agccaggcagaggcag

SEQ ID NO: 358671 - DNA, 16 bp, M. musculus
agccaggcagtgatgg

SEQ ID NO: 358672 - DNA, 16 bp, M. musculus
agccaggcagtggtgg

SEQ ID NO: 358673 - DNA, 16 bp, M. musculus
agccaggcagttgtgg

SEQ ID NO: 358674 - DNA, 16 bp, M. musculus
agccaggcatggccac

SEQ ID NO: 358675 - DNA, 16 bp, M. musculus
agccaggccaggccag

SEQ ID NO: 358676 - DNA, 16 bp, M. musculus
agccaggccatgttta

SEQ ID NO: 358677 - DNA, 16 bp, M. musculus
agccaggcctacagag

SEQ ID NO: 358678 - DNA, 16 bp, M. musculus
agccaggcctacatag

SEQ ID NO: 358679 - DNA, 16 bp, M. musculus
agccaggcctacctgg

SEQ ID NO: 358680 - DNA, 16 bp, M. musculus
agccaggcctcagcca

SEQ ID NO: 358681 - DNA, 16 bp, M. musculus
agccaggcctcagctg

SEQ ID NO: 358682 - DNA, 16 bp, M. musculus
agccaggcctggtgac

SEQ ID NO: 358683 - DNA, 16 bp, M. musculus
agccaggcgtgatggc

SEQ ID NO: 358684 - DNA, 16 bp, M. musculus
agccaggctgacctca

SEQ ID NO: 358685 - DNA, 16 bp, M. musculus
agccaggcttccacag

SEQ ID NO: 358686 - DNA, 16 bp, M. musculus
agccagggagacacag

SEQ ID NO: 358687 - DNA, 16 bp, M. musculus
agccagggagctgaag

SEQ ID NO: 358688 - DNA, 16 bp, M. musculus
agccagggcaacacag

SEQ ID NO: 358689 - DNA, 16 bp, M. musculus
agccagggctacacaa

SEQ ID NO: 358690 - DNA, 17 bp, M. musculus
agccagggctacacagg

SEQ ID NO: 358691 - DNA, 16 bp, M. musculus
agccagggctacactg

SEQ ID NO: 358692 - DNA, 16 bp, M. musculus
agccagggctacagaa

SEQ ID NO: 358693 - DNA, 16 bp, M. musculus
agccagggctacatag

SEQ ID NO: 358694 - DNA, 16 bp, M. musculus
agccagggctattaca

SEQ ID NO: 358695 - DNA, 19 bp, M. musculus
agccagggctgcacagaga

SEQ ID NO: 358696 - DNA, 16 bp, M. musculus
agccagggctgtgtag

SEQ ID NO: 358697 - DNA, 16 bp, M. musculus
agccagggctttgtgc

SEQ ID NO: 358698 - DNA, 16 bp, M. musculus
agccagggtctcactg

SEQ ID NO: 358699 - DNA, 16 bp, M. musculus
agccagggttgcacag

SEQ ID NO: 358700 - DNA, 16 bp, M. musculus
agccaggtatggtggt

SEQ ID NO: 358701 - DNA, 16 bp, M. musculus
agccaggtgcccagga

SEQ ID NO: 358702 - DNA, 16 bp, M. musculus
agccaggtggtgatgg

SEQ ID NO: 358703 - DNA, 16 bp, M. musculus
agccaggtggtggcac

SEQ ID NO: 358704 - DNA, 16 bp, M. musculus
agccaggtggtggcgg

SEQ ID NO: 358705 - DNA, 16 bp, M. musculus
agccaggtggtggtgg

SEQ ID NO: 358706 - DNA, 16 bp, M. musculus
agccaggtgtagtggt

SEQ ID NO: 358707 - DNA, 16 bp, M. musculus
agccaggtgtgatggt

SEQ ID NO: 358708 - DNA, 16 bp, M. musculus
agccaggtgtggtagc

SEQ ID NO: 358709 - DNA, 16 bp, M. musculus
agccaggtgtggtggc

SEQ ID NO: 358710 - DNA, 16 bp, M. musculus
agccaggtgttggtgg

SEQ ID NO: 358711 - DNA, 16 bp, M. musculus
agccaggtttggtggc

SEQ ID NO: 358712 - DNA, 16 bp, M. musculus
agccagtaaagtgctt

SEQ ID NO: 358713 - DNA, 16 bp, M. musculus
agccagtacaatgacc

SEQ ID NO: 358714 - DNA, 16 bp, M. musculus
agccagtactcttaac

SEQ ID NO: 358715 - DNA, 16 bp, M. musculus
agccagtcagcattcc

SEQ ID NO: 358716 - DNA, 16 bp, M. musculus
agccagtctagcctac

SEQ ID NO: 358717 - DNA, 16 bp, M. musculus
agccagtctagctgaa

SEQ ID NO: 358718 - DNA, 16 bp, M. musculus
agccagtgaggggtgg

SEQ ID NO: 358719 - DNA, 16 bp, M. musculus
agccagtgctctaaac

SEQ ID NO: 358720 - DNA, 16 bp, M. musculus
agccagtgctcttaac

SEQ ID NO: 358721 - DNA, 16 bp, M. musculus
agccagtgctgcacag

SEQ ID NO: 358722 - DNA, 16 bp, M. musculus
agccagtgcttttaac

SEQ ID NO: 358723 - DNA, 17 bp, M. musculus
agccagtggaagcaagc

SEQ ID NO: 358724 - DNA, 16 bp, M. musculus
agccagtggtggcaca

SEQ ID NO: 358725 - DNA, 16 bp, M. musculus
agccagtgttcttaac

SEQ ID NO: 358726 - DNA, 16 bp, M. musculus
agccagttccaggaca

SEQ ID NO: 358727 - DNA, 16 bp, M. musculus
agccagttctccagcc

SEQ ID NO: 358728 - DNA, 16 bp, M. musculus
agccagttctgagact

SEQ ID NO: 358729 - DNA, 16 bp, M. musculus
agccagttgtggtggt

SEQ ID NO: 358730 - DNA, 16 bp, M. musculus
agccataaaattattt

SEQ ID NO: 358731 - DNA, 16 bp, M. musculus
agccataaagaagaat

SEQ ID NO: 358732 - DNA, 16 bp, M. musculus
agccataaagataaag

SEQ ID NO: 358733 - DNA, 16 bp, M. musculus
agccatagagagcaag

SEQ ID NO: 358734 - DNA, 16 bp, M. musculus
agccatagctgtcctg

SEQ ID NO: 358735 - DNA, 16 bp, M. musculus
agccatcaaatgcaga

SEQ ID NO: 358736 - DNA, 16 bp, M. musculus
agccatcaactgccag

SEQ ID NO: 358737 - DNA, 16 bp, M. musculus
agccatcaaggagaag

SEQ ID NO: 358738 - DNA, 16 bp, M. musculus
agccatcagctgccaa

SEQ ID NO: 358739 - DNA, 16 bp, M. musculus
agccatcatcactgag

SEQ ID NO: 358740 - DNA, 16 bp, M. musculus
agccatcatcagcatc

SEQ ID NO: 358741 - DNA, 16 bp, M. musculus
agccatcatggaaatg

SEQ ID NO: 358742 - DNA, 16 bp, M. musculus
agccatcatgtggctg

SEQ ID NO: 358743 - DNA, 16 bp, M. musculus
agccatcatgtgtgtg

SEQ ID NO: 358744 - DNA, 16 bp, M. musculus
agccatcattgagaag

SEQ ID NO: 358745 - DNA, 16 bp, M. musculus
agccatccagatggct

SEQ ID NO: 358746 - DNA, 16 bp, M. musculus
agccatccccccagcc

SEQ ID NO: 358747 - DNA, 16 bp, M. musculus
agccatcctccagccc

SEQ ID NO: 358748 - DNA, 16 bp, M. musculus
agccatcctgctggcc

SEQ ID NO: 358749 - DNA, 16 bp, M. musculus
agccatctaggaaagg

SEQ ID NO: 358750 - DNA, 16 bp, M. musculus
agccatctataatgag

SEQ ID NO: 358751 - DNA, 20 bp, M. musculus
agccatctcaccagccccct

SEQ ID NO: 358752 - DNA, 16 bp, M. musculus
agccatctcaccagct

SEQ ID NO: 358753 - DNA, 16 bp, M. musculus
agccatctcaccaggc

SEQ ID NO: 358754 - DNA, 16 bp, M. musculus
agccatctcactggcc

SEQ ID NO: 358755 - DNA, 16 bp, M. musculus
agccatctcatcaacc

SEQ ID NO: 358756 - DNA, 16 bp, M. musculus
agccatctccacagcc

SEQ ID NO: 358757 - DNA, 16 bp, M. musculus
agccatctccacagct

SEQ ID NO: 358758 - DNA, 16 bp, M. musculus
agccatctccagcctc

SEQ ID NO: 358759 - DNA, 16 bp, M. musculus
agccatctcccagacc

SEQ ID NO: 358760 - DNA, 16 bp, M. musculus
agccatctcctcagcc

SEQ ID NO: 358761 - DNA, 16 bp, M. musculus
agccatctcctgtaac

SEQ ID NO: 358762 - DNA, 16 bp, M. musculus
agccatctctaactcc

SEQ ID NO: 358763 - DNA, 16 bp, M. musculus
agccatctctagccct

SEQ ID NO: 358764 - DNA, 16 bp, M. musculus
agccatctctccaagc

SEQ ID NO: 358765 - DNA, 16 bp, M. musculus
agccatctctccagca

SEQ ID NO: 358766 - DNA, 18 bp, M. musculus
agccatctctccagcccg

SEQ ID NO: 358767 - DNA, 16 bp, M. musculus
agccatctctcctgct

SEQ ID NO: 358768 - DNA, 16 bp, M. musculus
agccatctctctagca

SEQ ID NO: 358769 - DNA, 16 bp, M. musculus
agccatctctctgccc

SEQ ID NO: 358770 - DNA, 16 bp, M. musculus
agccatctctctggcc

SEQ ID NO: 358771 - DNA, 16 bp, M. musculus
agccatctctctggtc

SEQ ID NO: 358772 - DNA, 16 bp, M. musculus
agccatctctgcagac

SEQ ID NO: 358773 - DNA, 16 bp, M. musculus
agccatctctgtggcc

SEQ ID NO: 358774 - DNA, 16 bp, M. musculus
agccatctcttcagcc

SEQ ID NO: 358775 - DNA, 16 bp, M. musculus
agccatctgaccagcc

SEQ ID NO: 358776 - DNA, 16 bp, M. musculus
agccatctggtcaacc

SEQ ID NO: 358777 - DNA, 16 bp, M. musculus
agccatctggtctacc

SEQ ID NO: 358778 - DNA, 16 bp, M. musculus
agccatctgtaacccc

SEQ ID NO: 358779 - DNA, 16 bp, M. musculus
agccatcttcagagaa

SEQ ID NO: 358780 - DNA, 16 bp, M. musculus
agccatcttccagtaa

SEQ ID NO: 358781 - DNA, 16 bp, M. musculus
agccatcttcccagtc

SEQ ID NO: 358782 - DNA, 16 bp, M. musculus
agccatcttctcagcc

SEQ ID NO: 358783 - DNA, 16 bp, M. musculus
agccatcttgcaagcc

SEQ ID NO: 358784 - DNA, 16 bp, M. musculus
agccatcttgccaatc

SEQ ID NO: 358785 - DNA, 16 bp, M. musculus
agccatcttgccagtc

SEQ ID NO: 358786 - DNA, 16 bp, M. musculus
agccatcttgcctgcc

SEQ ID NO: 358787 - DNA, 16 bp, M. musculus
agccatcttggtccct

SEQ ID NO: 358788 - DNA, 16 bp, M. musculus
agccatcttgtcagtc

SEQ ID NO: 358789 - DNA, 16 bp, M. musculus
agccatcttgttggct

SEQ ID NO: 358790 - DNA, 16 bp, M. musculus
agccatctttccagca

SEQ ID NO: 358791 - DNA, 16 bp, M. musculus
agccatctttctaccc

SEQ ID NO: 358792 - DNA, 16 bp, M. musculus
agccatgaaattattt

SEQ ID NO: 358793 - DNA, 16 bp, M. musculus
agccatgactacacag

SEQ ID NO: 358794 - DNA, 16 bp, M. musculus
agccatgaggagcaaa

SEQ ID NO: 358795 - DNA, 16 bp, M. musculus
agccatgaggagcaat

SEQ ID NO: 358796 - DNA, 16 bp, M. musculus
agccatggccatgtgg

SEQ ID NO: 358797 - DNA, 16 bp, M. musculus
agccatggctacacag

SEQ ID NO: 358798 - DNA, 16 bp, M. musculus
agccatggctccagct

SEQ ID NO: 358799 - DNA, 16 bp, M. musculus
agccatggctgtccta

SEQ ID NO: 358800 - DNA, 16 bp, M. musculus
agccatggctgtcttg

SEQ ID NO: 358801 - DNA, 16 bp, M. musculus
agccatggggataatt

SEQ ID NO: 358802 - DNA, 16 bp, M. musculus
agccatggtccctcca

SEQ ID NO: 358803 - DNA, 16 bp, M. musculus
agccatgtccccagcc

SEQ ID NO: 358804 - DNA, 16 bp, M. musculus
agccatgtctccaacc

SEQ ID NO: 358805 - DNA, 16 bp, M. musculus
agccatgtgaggagag

SEQ ID NO: 358806 - DNA, 16 bp, M. musculus
agccatgtggctctga

SEQ ID NO: 358807 - DNA, 16 bp, M. musculus
agccatgtgtcccacc

SEQ ID NO: 358808 - DNA, 16 bp, M. musculus
agccatgttgccagcc

SEQ ID NO: 358809 - DNA, 16 bp, M. musculus
agccatgtttctggat

SEQ ID NO: 358810 - DNA, 16 bp, M. musculus
agccattcaaatatct

SEQ ID NO: 358811 - DNA, 16 bp, M. musculus
agccattctaagttaa

SEQ ID NO: 358812 - DNA, 16 bp, M. musculus
agccattctcaacctg

SEQ ID NO: 358813 - DNA, 16 bp, M. musculus
agccattctgactgct

SEQ ID NO: 358814 - DNA, 16 bp, M. musculus
agccattgaattttat

SEQ ID NO: 358815 - DNA, 16 bp, M. musculus
agccattgagccatct

SEQ ID NO: 358816 - DNA, 16 bp, M. musculus
agccattgctccagct

SEQ ID NO: 358817 - DNA, 16 bp, M. musculus
agccattgctgatctg

SEQ ID NO: 358818 - DNA, 16 bp, M. musculus
agccattggctgatca

SEQ ID NO: 358819 - DNA, 16 bp, M. musculus
agccatttccaaagca

SEQ ID NO: 358820 - DNA, 16 bp, M. musculus
agccatttcccagccc

SEQ ID NO: 358821 - DNA, 16 bp, M. musculus
agccatttctccaacc

SEQ ID NO: 358822 - DNA, 17 bp, M. musculus
agccatttctccagccc

SEQ ID NO: 358823 - DNA, 16 bp, M. musculus
agccatttctcctgcc

SEQ ID NO: 358824 - DNA, 16 bp, M. musculus
agccattttttctata

SEQ ID NO: 358825 - DNA, 16 bp, M. musculus
agcccaaagatttatt

SEQ ID NO: 358826 - DNA, 16 bp, M. musculus
agcccaacccctgggg

SEQ ID NO: 358827 - DNA, 16 bp, M. musculus
agcccaagaagaagga

SEQ ID NO: 358828 - DNA, 16 bp, M. musculus
agcccaagagaaagaa

SEQ ID NO: 358829 - DNA, 16 bp, M. musculus
agcccaagctagcctt

SEQ ID NO: 358830 - DNA, 16 bp, M. musculus
agcccacaactgcctg

SEQ ID NO: 358831 - DNA, 16 bp, M. musculus
agcccacacctacagt

SEQ ID NO: 358832 - DNA, 16 bp, M. musculus
agcccacagaggccag

SEQ ID NO: 358833 - DNA, 16 bp, M. musculus
agcccacatccagcag

SEQ ID NO: 358834 - DNA, 16 bp, M. musculus
agcccaccagctctcc

SEQ ID NO: 358835 - DNA, 16 bp, M. musculus
agcccaccatccacca

SEQ ID NO: 358836 - DNA, 16 bp, M. musculus
agcccacctccagtga

SEQ ID NO: 358837 - DNA, 16 bp, M. musculus
agcccactatgggcac

SEQ ID NO: 358838 - DNA, 16 bp, M. musculus
agcccactgtgggcag

SEQ ID NO: 358839 - DNA, 16 bp, M. musculus
agcccactgtgggcgg

SEQ ID NO: 358840 - DNA, 16 bp, M. musculus
agcccagaaacttgga

SEQ ID NO: 358841 - DNA, 21 bp, M. musculus
agcccagaactggtgctgctt

SEQ ID NO: 358842 - DNA, 16 bp, M. musculus
agcccagactggcctt

SEQ ID NO: 358843 - DNA, 16 bp, M. musculus
agcccagactggcttc

SEQ ID NO: 358844 - DNA, 16 bp, M. musculus
agcccagagaattcca

SEQ ID NO: 358845 - DNA, 16 bp, M. musculus
agcccagagagccaga

SEQ ID NO: 358846 - DNA, 16 bp, M. musculus
agcccagaggtggtcc

SEQ ID NO: 358847 - DNA, 16 bp, M. musculus
agcccagagtccccca

SEQ ID NO: 358848 - DNA, 16 bp, M. musculus
agcccagcaccagatg

SEQ ID NO: 358849 - DNA, 16 bp, M. musculus
agcccagcagaggctg

SEQ ID NO: 358850 - DNA, 16 bp, M. musculus
agcccagcagtggtgg

SEQ ID NO: 358851 - DNA, 16 bp, M. musculus
agcccagcagttcctg

SEQ ID NO: 358852 - DNA, 16 bp, M. musculus
agcccagccagggcta

SEQ ID NO: 358853 - DNA, 16 bp, M. musculus
agcccagcccagccag

SEQ ID NO: 358854 - DNA, 16 bp, M. musculus
agcccagcccagcctc

SEQ ID NO: 358855 - DNA, 16 bp, M. musculus
agcccagcccagctca

SEQ ID NO: 358856 - DNA, 16 bp, M. musculus
agcccagccctgccct

SEQ ID NO: 358857 - DNA, 16 bp, M. musculus
agcccagcctctgggc

SEQ ID NO: 358858 - DNA, 16 bp, M. musculus
agcccagcctggcctc

SEQ ID NO: 358859 - DNA, 16 bp, M. musculus
agcccagcctggcttc

SEQ ID NO: 358860 - DNA, 16 bp, M. musculus
agcccagcctgggcta

SEQ ID NO: 358861 - DNA, 16 bp, M. musculus
agcccagctagaggaa

SEQ ID NO: 358862 - DNA, 16 bp, M. musculus
agcccagctcagctca

SEQ ID NO: 358863 - DNA, 16 bp, M. musculus
agcccagctgcaggtg

SEQ ID NO: 358864 - DNA, 16 bp, M. musculus
agcccagctggccttg

SEQ ID NO: 358865 - DNA, 16 bp, M. musculus
agcccaggaccatatg

SEQ ID NO: 358866 - DNA, 16 bp, M. musculus
agcccaggagaaagaa

SEQ ID NO: 358867 - DNA, 16 bp, M. musculus
agcccaggagctggag

SEQ ID NO: 358868 - DNA, 16 bp, M. musculus
agcccaggctagcccc

SEQ ID NO: 358869 - DNA, 16 bp, M. musculus
agcccaggctagccct

SEQ ID NO: 358870 - DNA, 16 bp, M. musculus
agcccaggctgaccct

SEQ ID NO: 358871 - DNA, 16 bp, M. musculus
agcccaggctgccctg

SEQ ID NO: 358872 - DNA, 16 bp, M. musculus
agcccaggctgccttt

SEQ ID NO: 358873 - DNA, 16 bp, M. musculus
agcccaggctggcctc

SEQ ID NO: 358874 - DNA, 17 bp, M. musculus
agcccaggctggcttca

SEQ ID NO: 358875 - DNA, 16 bp, M. musculus
agcccaggctggtctc

SEQ ID NO: 358876 - DNA, 16 bp, M. musculus
agcccaggctggtctt

SEQ ID NO: 358877 - DNA, 16 bp, M. musculus
agcccaggctgtccca

SEQ ID NO: 358878 - DNA, 16 bp, M. musculus
agcccaggctgtcccc

SEQ ID NO: 358879 - DNA, 16 bp, M. musculus
agcccagggaatgatg

SEQ ID NO: 358880 - DNA, 16 bp, M. musculus
agcccagggagtggca

SEQ ID NO: 358881 - DNA, 16 bp, M. musculus
agcccagggccacctg

SEQ ID NO: 358882 - DNA, 16 bp, M. musculus
agcccagggcttcctg

SEQ ID NO: 358883 - DNA, 16 bp, M. musculus
agcccagggctttgtg

SEQ ID NO: 358884 - DNA, 16 bp, M. musculus
agcccaggggtgacac

SEQ ID NO: 358885 - DNA, 16 bp, M. musculus
agcccagggtagcctc

SEQ ID NO: 358886 - DNA, 16 bp, M. musculus
agcccagggtggcctc

SEQ ID NO: 358887 - DNA, 16 bp, M. musculus
agcccaggttgacctc

SEQ ID NO: 358888 - DNA, 16 bp, M. musculus
agcccaggttggcccc

SEQ ID NO: 358889 - DNA, 16 bp, M. musculus
agcccaggttggcttc

SEQ ID NO: 358890 - DNA, 16 bp, M. musculus
agcccagtccctgggc

SEQ ID NO: 358891 - DNA, 16 bp, M. musculus
agcccagtctggcctg

SEQ ID NO: 358892 - DNA, 16 bp, M. musculus
agcccagtggttaaga

SEQ ID NO: 358893 - DNA, 16 bp, M. musculus
agcccagttaggggaa

SEQ ID NO: 358894 - DNA, 16 bp, M. musculus
agcccagttggtagag

SEQ ID NO: 358895 - DNA, 16 bp, M. musculus
agcccatcatggaggg

SEQ ID NO: 358896 - DNA, 16 bp, M. musculus
agcccatgccaagccc

SEQ ID NO: 358897 - DNA, 16 bp, M. musculus
agccccaaaagaccac

SEQ ID NO: 358898 - DNA, 16 bp, M. musculus
agccccacctccacag

SEQ ID NO: 358899 - DNA, 16 bp, M. musculus
agccccagcatcaaag

SEQ ID NO: 358900 - DNA, 16 bp, M. musculus
agccccagccccagag

SEQ ID NO: 358901 - DNA, 16 bp, M. musculus
agccccagccccagct

SEQ ID NO: 358902 - DNA, 16 bp, M. musculus
agccccagccccaggc

SEQ ID NO: 358903 - DNA, 16 bp, M. musculus
agccccagctccagcc

SEQ ID NO: 358904 - DNA, 16 bp, M. musculus
agccccaggcccagcc

SEQ ID NO: 358905 - DNA, 16 bp, M. musculus
agccccaggccccagc

SEQ ID NO: 358906 - DNA, 16 bp, M. musculus
agccccagggaccctc

SEQ ID NO: 358907 - DNA, 16 bp, M. musculus
agccccagggatccac

SEQ ID NO: 358908 - DNA, 16 bp, M. musculus
agccccagggatcttc

SEQ ID NO: 358909 - DNA, 16 bp, M. musculus
agccccagtaagtcag

SEQ ID NO: 358910 - DNA, 16 bp, M. musculus
agccccatagaagaaa

SEQ ID NO: 358911 - DNA, 16 bp, M. musculus
agccccattgctgaag

SEQ ID NO: 358912 - DNA, 16 bp, M. musculus
agccccattggaggaa

SEQ ID NO: 358913 - DNA, 16 bp, M. musculus
agcccccaattaaatg

SEQ ID NO: 358914 - DNA, 16 bp, M. musculus
agcccccacaggagcc

SEQ ID NO: 358915 - DNA, 27 bp, M. musculus
agcccccagtatgggaatgtatcttga

SEQ ID NO: 358916 - DNA, 16 bp, M. musculus
agcccctccctcctct

SEQ ID NO: 358917 - DNA, 16 bp, M. musculus
agcccctcctgcacca

SEQ ID NO: 358918 - DNA, 16 bp, M. musculus
agcccctcctggtttt

SEQ ID NO: 358919 - DNA, 16 bp, M. musculus
agcccctgccaaacat

SEQ ID NO: 358920 - DNA, 16 bp, M. musculus
agcccctgcccctgcc

SEQ ID NO: 358921 - DNA, 16 bp, M. musculus
agcccctgcctccagg

SEQ ID NO: 358922 - DNA, 16 bp, M. musculus
agcccctgctccagct

SEQ ID NO: 358923 - DNA, 16 bp, M. musculus
agcccctgctcctgct

SEQ ID NO: 358924 - DNA, 16 bp, M. musculus
agcccctgctgtcctg

SEQ ID NO: 358925 - DNA, 16 bp, M. musculus
agcccctggacatcca

SEQ ID NO: 358926 - DNA, 16 bp, M. musculus
agcccctggctgtcct

SEQ ID NO: 358927 - DNA, 16 bp, M. musculus
agccccttcagctcct

SEQ ID NO: 358928 - DNA, 16 bp, M. musculus
agccccttggttctgt

SEQ ID NO: 358929 - DNA, 16 bp, M. musculus
agcccgggctacacag

SEQ ID NO: 358930 - DNA, 16 bp, M. musculus
agcccggggctccagt

SEQ ID NO: 358931 - DNA, 16 bp, M. musculus
agcccggtgtggtggc

SEQ ID NO: 358932 - DNA, 16 bp, M. musculus
agccctaaaaaggata

SEQ ID NO: 358933 - DNA, 16 bp, M. musculus
agccctagaactcact

SEQ ID NO: 358934 - DNA, 16 bp, M. musculus
agccctagctggtctg

SEQ ID NO: 358935 - DNA, 16 bp, M. musculus
agccctcagcttcctg

SEQ ID NO: 358936 - DNA, 16 bp, M. musculus
agccctcattaagcaa

SEQ ID NO: 358937 - DNA, 16 bp, M. musculus
agccctcccaggcagg

SEQ ID NO: 358938 - DNA, 16 bp, M. musculus
agccctcccaggtgga

SEQ ID NO: 358939 - DNA, 16 bp, M. musculus
agccctcccccagtga

SEQ ID NO: 358940 - DNA, 16 bp, M. musculus
agccctccctggaggc

SEQ ID NO: 358941 - DNA, 16 bp, M. musculus
agccctcctagggaca

SEQ ID NO: 358942 - DNA, 16 bp, M. musculus
agccctcctgctgtgc

SEQ ID NO: 358943 - DNA, 16 bp, M. musculus
agccctcgggaggcag

SEQ ID NO: 358944 - DNA, 29 bp, M. musculus
agccctctactaagaaaaagccttatact

SEQ ID NO: 358945 - DNA, 16 bp, M. musculus
agccctctcaccagcc

SEQ ID NO: 358946 - DNA, 16 bp, M. musculus
agccctctgcctcagg

SEQ ID NO: 358947 - DNA, 16 bp, M. musculus
agccctcttctggtgt

SEQ ID NO: 358948 - DNA, 16 bp, M. musculus
agccctgaaagaggaa

SEQ ID NO: 358949 - DNA, 16 bp, M. musculus
agccctgaatacccca

SEQ ID NO: 358950 - DNA, 16 bp, M. musculus
agccctgaccacagac

SEQ ID NO: 358951 - DNA, 16 bp, M. musculus
agccctgactgtccag

SEQ ID NO: 358952 - DNA, 16 bp, M. musculus
agccctgagagccagc

SEQ ID NO: 358953 - DNA, 16 bp, M. musculus
agccctgagccctgag

SEQ ID NO: 358954 - DNA, 16 bp, M. musculus
agccctgaggcaaggg

SEQ ID NO: 358955 - DNA, 16 bp, M. musculus
agccctgcaaatctat

SEQ ID NO: 358956 - DNA, 16 bp, M. musculus
agccctgcagccctgc

SEQ ID NO: 358957 - DNA, 16 bp, M. musculus
agccctgccctgccct

SEQ ID NO: 358958 - DNA, 16 bp, M. musculus
agccctgcctacctct

SEQ ID NO: 358959 - DNA, 16 bp, M. musculus
agccctgctggctgtc

SEQ ID NO: 358960 - DNA, 16 bp, M. musculus
agccctgcttgtcctt

SEQ ID NO: 358961 - DNA, 16 bp, M. musculus
agccctggaactcact

SEQ ID NO: 358962 - DNA, 16 bp, M. musculus
agccctggaactggag

SEQ ID NO: 358963 - DNA, 16 bp, M. musculus
agccctggagctggag

SEQ ID NO: 358964 - DNA, 16 bp, M. musculus
agccctggccatcctg

SEQ ID NO: 358965 - DNA, 16 bp, M. musculus
agccctggccctggcc

SEQ ID NO: 358966 - DNA, 16 bp, M. musculus
agccctggccttcctg

SEQ ID NO: 358967 - DNA, 16 bp, M. musculus
agccctggctaccctg

SEQ ID NO: 358968 - DNA, 16 bp, M. musculus
agccctggctcctgga

SEQ ID NO: 358969 - DNA, 16 bp, M. musculus
agccctggctgacctg

SEQ ID NO: 358970 - DNA, 16 bp, M. musculus
agccctggctgccttg

SEQ ID NO: 358971 - DNA, 16 bp, M. musculus
agccctggctgctcct

SEQ ID NO: 358972 - DNA, 16 bp, M. musculus
agccctggctgctctg

SEQ ID NO: 358973 - DNA, 16 bp, M. musculus
agccctggctggactg

SEQ ID NO: 358974 - DNA, 16 bp, M. musculus
agccctggctggcctc

SEQ ID NO: 358975 - DNA, 16 bp, M. musculus
agccctggctgtccag

SEQ ID NO: 358976 - DNA, 16 bp, M. musculus
agccctggctgtcctc

SEQ ID NO: 358977 - DNA, 16 bp, M. musculus
agccctggcttcctgg

SEQ ID NO: 358978 - DNA, 16 bp, M. musculus
agccctgggcaggtgg

SEQ ID NO: 358979 - DNA, 16 bp, M. musculus
agccctggggaagtgg

SEQ ID NO: 358980 - DNA, 16 bp, M. musculus
agccctggggaggtgg

SEQ ID NO: 358981 - DNA, 16 bp, M. musculus
agccctggttgtccta

SEQ ID NO: 358982 - DNA, 16 bp, M. musculus
agccctgtggccacca

SEQ ID NO: 358983 - DNA, 16 bp, M. musculus
agccctgttgttgaat

SEQ ID NO: 358984 - DNA, 16 bp, M. musculus
agcccttacctaggaa

SEQ ID NO: 358985 - DNA, 17 bp, M. musculus
agcccttcacaatctcc

SEQ ID NO: 358986 - DNA, 17 bp, M. musculus
agcccttcatcttccaa

SEQ ID NO: 358987 - DNA, 16 bp, M. musculus
agcccttcattctgag

SEQ ID NO: 358988 - DNA, 16 bp, M. musculus
agcccttgccccagga

SEQ ID NO: 358989 - DNA, 16 bp, M. musculus
agcccttgtatgctct

SEQ ID NO: 358990 - DNA, 16 bp, M. musculus
agcccttgttgctctt

SEQ ID NO: 358991 - DNA, 16 bp, M. musculus
agccctttacccactg

SEQ ID NO: 358992 - DNA, 16 bp, M. musculus
agccctttcacctggc

SEQ ID NO: 358993 - DNA, 16 bp, M. musculus
agccgactgtgagcat

SEQ ID NO: 358994 - DNA, 16 bp, M. musculus
agccgcctccccagcc

SEQ ID NO: 358995 - DNA, 16 bp, M. musculus
agccgggaggtggtgg

SEQ ID NO: 358996 - DNA, 16 bp, M. musculus
agccgggagtggtggc

SEQ ID NO: 358997 - DNA, 16 bp, M. musculus
agccgggcatggtgac

SEQ ID NO: 358998 - DNA, 16 bp, M. musculus
agccgggcatggtggc

SEQ ID NO: 358999 - DNA, 19 bp, M. musculus
agccgggcgtggtagcgca

SEQ ID NO: 359000 - DNA, 16 bp, M. musculus
agccgggtatggtggc

SEQ ID NO: 359001 - DNA, 16 bp, M. musculus
agccggtgccggtgga

SEQ ID NO: 359002 - DNA, 16 bp, M. musculus
agccgtctctgcagcc

SEQ ID NO: 359003 - DNA, 16 bp, M. musculus
agcctaagatggaggc

SEQ ID NO: 359004 - DNA, 16 bp, M. musculus
agcctaagctacacag

SEQ ID NO: 359005 - DNA, 16 bp, M. musculus
agcctacaaagtgagt

SEQ ID NO: 359006 - DNA, 16 bp, M. musculus
agcctacacaactcca

SEQ ID NO: 359007 - DNA, 16 bp, M. musculus
agcctacctccagcag

SEQ ID NO: 359008 - DNA, 16 bp, M. musculus
agcctacctctgcctc

SEQ ID NO: 359009 - DNA, 16 bp, M. musculus
agcctacctgcttccc

SEQ ID NO: 359010 - DNA, 16 bp, M. musculus
agcctacttcttcagg

SEQ ID NO: 359011 - DNA, 16 bp, M. musculus
agcctactttcttata

SEQ ID NO: 359012 - DNA, 16 bp, M. musculus
agcctagaacttgcta

SEQ ID NO: 359013 - DNA, 16 bp, M. musculus
agcctagaagaaatgc

SEQ ID NO: 359014 - DNA, 16 bp, M. musculus
agcctagcataactgt

SEQ ID NO: 359015 - DNA, 16 bp, M. musculus
agcctaggctacctga

SEQ ID NO: 359016 - DNA, 16 bp, M. musculus
agcctaggctggcctc

SEQ ID NO: 359017 - DNA, 16 bp, M. musculus
agcctaggctggcctg

SEQ ID NO: 359018 - DNA, 16 bp, M. musculus
agcctagtctatataa

SEQ ID NO: 359019 - DNA, 16 bp, M. musculus
agcctagtctatatag

SEQ ID NO: 359020 - DNA, 16 bp, M. musculus
agcctatataaggaca

SEQ ID NO: 359021 - DNA, 16 bp, M. musculus
agcctatcagaattat

SEQ ID NO: 359022 - DNA, 16 bp, M. musculus
agcctatggaggccat

SEQ ID NO: 359023 - DNA, 16 bp, M. musculus
agcctatgggagccag

SEQ ID NO: 359024 - DNA, 16 bp, M. musculus
agcctcaaaaacaaaa

SEQ ID NO: 359025 - DNA, 16 bp, M. musculus
agcctcaaactcactg

SEQ ID NO: 359026 - DNA, 16 bp, M. musculus
agcctcaaactcatag

SEQ ID NO: 359027 - DNA, 16 bp, M. musculus
agcctcaaagatatag

SEQ ID NO: 359028 - DNA, 16 bp, M. musculus
agcctcaacagacaca

SEQ ID NO: 359029 - DNA, 16 bp, M. musculus
agcctcaacagattca

SEQ ID NO: 359030 - DNA, 16 bp, M. musculus
agcctcacaagtgaca

SEQ ID NO: 359031 - DNA, 16 bp, M. musculus
agcctcacaggagaca

SEQ ID NO: 359032 - DNA, 16 bp, M. musculus
agcctcacaggaggca

SEQ ID NO: 359033 - DNA, 16 bp, M. musculus
agcctcagaaacaaaa

SEQ ID NO: 359034 - DNA, 16 bp, M. musculus
agcctcagagacaaca

SEQ ID NO: 359035 - DNA, 16 bp, M. musculus
agcctcagcctcacct

SEQ ID NO: 359036 - DNA, 16 bp, M. musculus
agcctcagcctctcag

SEQ ID NO: 359037 - DNA, 16 bp, M. musculus
agcctcagctacaaag

SEQ ID NO: 359038 - DNA, 16 bp, M. musculus
agcctcagctacatat

SEQ ID NO: 359039 - DNA, 16 bp, M. musculus
agcctcagctcccagg

SEQ ID NO: 359040 - DNA, 16 bp, M. musculus
agcctcagctgctctc

SEQ ID NO: 359041 - DNA, 16 bp, M. musculus
agcctcagctgctctg

SEQ ID NO: 359042 - DNA, 16 bp, M. musculus
agcctcagctgctttg

SEQ ID NO: 359043 - DNA, 23 bp, M. musculus
agcctcagctgtagttgatggcc

SEQ ID NO: 359044 - DNA, 16 bp, M. musculus
agcctcagctgttctg

SEQ ID NO: 359045 - DNA, 16 bp, M. musculus
agcctcaggaggagga

SEQ ID NO: 359046 - DNA, 16 bp, M. musculus
agcctcaggggactta

SEQ ID NO: 359047 - DNA, 16 bp, M. musculus
agcctcaggtgccagg

SEQ ID NO: 359048 - DNA, 16 bp, M. musculus
agcctcagtgggaaag

SEQ ID NO: 359049 - DNA, 16 bp, M. musculus
agcctcagtttcccca

SEQ ID NO: 359050 - DNA, 16 bp, M. musculus
agcctcagtttcccta

SEQ ID NO: 359051 - DNA, 16 bp, M. musculus
agcctcatgcatgcta

SEQ ID NO: 359052 - DNA, 16 bp, M. musculus
agcctccaagtgctgg

SEQ ID NO: 359053 - DNA, 16 bp, M. musculus
agcctccacatgacca

SEQ ID NO: 359054 - DNA, 16 bp, M. musculus
agcctccagaatgctg

SEQ ID NO: 359055 - DNA, 16 bp, M. musculus
agcctccaggcaggca

SEQ ID NO: 359056 - DNA, 16 bp, M. musculus
agcctccagttaaatg

SEQ ID NO: 359057 - DNA, 16 bp, M. musculus
agcctccatgtaggtg

SEQ ID NO: 359058 - DNA, 16 bp, M. musculus
agcctccatgtggatg

SEQ ID NO: 359059 - DNA, 23 bp, M. musculus
agcctcccaagtgctgggattaa

SEQ ID NO: 359060 - DNA, 16 bp, M. musculus
agcctcccacagcccc

SEQ ID NO: 359061 - DNA, 16 bp, M. musculus
agcctcccagcctccc

SEQ ID NO: 359062 - DNA, 16 bp, M. musculus
agcctcccaggctggg

SEQ ID NO: 359063 - DNA, 16 bp, M. musculus
agcctcccctccccag

SEQ ID NO: 359064 - DNA, 16 bp, M. musculus
agcctcccgggctggg

SEQ ID NO: 359065 - DNA, 16 bp, M. musculus
agcctccctccccagc

SEQ ID NO: 359066 - DNA, 16 bp, M. musculus
agcctcctcagcagag

SEQ ID NO: 359067 - DNA, 16 bp, M. musculus
agcctcctctccagcc

SEQ ID NO: 359068 - DNA, 16 bp, M. musculus
agcctcctgaatgctg

SEQ ID NO: 359069 - DNA, 16 bp, M. musculus
agcctcctgagtcctg

SEQ ID NO: 359070 - DNA, 16 bp, M. musculus
agcctcctgagtgctg

SEQ ID NO: 359071 - DNA, 16 bp, M. musculus
agcctcctgcctcagc

SEQ ID NO: 359072 - DNA, 16 bp, M. musculus
agcctccttcaaatct

SEQ ID NO: 359073 - DNA, 16 bp, M. musculus
agcctcgtggccaaca

SEQ ID NO: 359074 - DNA, 18 bp, M. musculus
agcctcgtggccgacatc

SEQ ID NO: 359075 - DNA, 16 bp, M. musculus
agcctctaagttcctc

SEQ ID NO: 359076 - DNA, 16 bp, M. musculus
agcctctcaagtgctg

SEQ ID NO: 359077 - DNA, 16 bp, M. musculus
agcctctcacttccct

SEQ ID NO: 359078 - DNA, 16 bp, M. musculus
agcctctcagagagca

SEQ ID NO: 359079 - DNA, 16 bp, M. musculus
agcctctcagcagaca

SEQ ID NO: 359080 - DNA, 16 bp, M. musculus
agcctctcaggagaca

SEQ ID NO: 359081 - DNA, 16 bp, M. musculus
agcctctcaggaggca

SEQ ID NO: 359082 - DNA, 16 bp, M. musculus
agcctctccttcctgt

SEQ ID NO: 359083 - DNA, 16 bp, M. musculus
agcctctctcagcaga

SEQ ID NO: 359084 - DNA, 16 bp, M. musculus
agcctctctcctccct

SEQ ID NO: 359085 - DNA, 16 bp, M. musculus
agcctctgaaactgga

SEQ ID NO: 359086 - DNA, 16 bp, M. musculus
agcctctgaaactgta

SEQ ID NO: 359087 - DNA, 16 bp, M. musculus
agcctctgagaggaca

SEQ ID NO: 359088 - DNA, 16 bp, M. musculus
agcctctgaggcagca

SEQ ID NO: 359089 - DNA, 16 bp, M. musculus
agcctctgcctcccaa

SEQ ID NO: 359090 - DNA, 16 bp, M. musculus
agcctctggaatgctg

SEQ ID NO: 359091 - DNA, 16 bp, M. musculus
agcctctgggaagaga

SEQ ID NO: 359092 - DNA, 16 bp, M. musculus
agcctctgggcatgcc

SEQ ID NO: 359093 - DNA, 16 bp, M. musculus
agcctctgtacagtct

SEQ ID NO: 359094 - DNA, 16 bp, M. musculus
agcctgaaaaagaaat

SEQ ID NO: 359095 - DNA, 16 bp, M. musculus
agcctgaaaaccaaaa

SEQ ID NO: 359096 - DNA, 16 bp, M. musculus
agcctgaaaaggtgtc

SEQ ID NO: 359097 - DNA, 16 bp, M. musculus
agcctgaagacttgag

SEQ ID NO: 359098 - DNA, 16 bp, M. musculus
agcctgaatctgttca

SEQ ID NO: 359099 - DNA, 16 bp, M. musculus
agcctgaatggtactt

SEQ ID NO: 359100 - DNA, 16 bp, M. musculus
agcctgacaacacatc

SEQ ID NO: 359101 - DNA, 16 bp, M. musculus
agcctgacaactggag

SEQ ID NO: 359102 - DNA, 16 bp, M. musculus
agcctgagaacctgaa

SEQ ID NO: 359103 - DNA, 16 bp, M. musculus
agcctgagaatctgag

SEQ ID NO: 359104 - DNA, 16 bp, M. musculus
agcctgagacagagca

SEQ ID NO: 359105 - DNA, 16 bp, M. musculus
agcctgagagaaagga

SEQ ID NO: 359106 - DNA, 16 bp, M. musculus
agcctgagcaggggca

SEQ ID NO: 359107 - DNA, 16 bp, M. musculus
agcctgagctacacag

SEQ ID NO: 359108 - DNA, 16 bp, M. musculus
agcctgagctacagaa

SEQ ID NO: 359109 - DNA, 16 bp, M. musculus
agcctgagctacagag

SEQ ID NO: 359110 - DNA, 16 bp, M. musculus
agcctgaggaaaaaaa

SEQ ID NO: 359111 - DNA, 16 bp, M. musculus
agcctgaggaaaagag

SEQ ID NO: 359112 - DNA, 16 bp, M. musculus
agcctgaggaaaagga

SEQ ID NO: 359113 - DNA, 16 bp, M. musculus
agcctgaggcaggagg

SEQ ID NO: 359114 - DNA, 16 bp, M. musculus
agcctgaggctccaag

SEQ ID NO: 359115 - DNA, 16 bp, M. musculus
agcctgagggaaagaa

SEQ ID NO: 359116 - DNA, 16 bp, M. musculus
agcctgagggaaagga

SEQ ID NO: 359117 - DNA, 16 bp, M. musculus
agcctgagttcagttc

SEQ ID NO: 359118 - DNA, 16 bp, M. musculus
agcctgatcaatacag

SEQ ID NO: 359119 - DNA, 16 bp, M. musculus
agcctgatccacagag

SEQ ID NO: 359120 - DNA, 16 bp, M. musculus
agcctgatctacaaat

SEQ ID NO: 359121 - DNA, 17 bp, M. musculus
agcctgatctacagagc

SEQ ID NO: 359122 - DNA, 16 bp, M. musculus
agcctgatcttatgga

SEQ ID NO: 359123 - DNA, 16 bp, M. musculus
agcctgatttacacag

SEQ ID NO: 359124 - DNA, 16 bp, M. musculus
agcctgatttccagag

SEQ ID NO: 359125 - DNA, 23 bp, M. musculus
agcctgcaaagggtactgcctca

SEQ ID NO: 359126 - DNA, 16 bp, M. musculus
agcctgcaaccccacc

SEQ ID NO: 359127 - DNA, 16 bp, M. musculus
agcctgcaatcagcat

SEQ ID NO: 359128 - DNA, 16 bp, M. musculus
agcctgcagcagtgcc

SEQ ID NO: 359129 - DNA, 16 bp, M. musculus
agcctgcagcctgcag

SEQ ID NO: 359130 - DNA, 16 bp, M. musculus
agcctgcagctccagg

SEQ ID NO: 359131 - DNA, 16 bp, M. musculus
agcctgcagggaacag

SEQ ID NO: 359132 - DNA, 16 bp, M. musculus
agcctgcagggcattt

SEQ ID NO: 359133 - DNA, 16 bp, M. musculus
agcctgcatcctgcac

SEQ ID NO: 359134 - DNA, 16 bp, M. musculus
agcctgcctgcctgcc

SEQ ID NO: 359135 - DNA, 16 bp, M. musculus
agcctgcctgccttcc

SEQ ID NO: 359136 - DNA, 16 bp, M. musculus
agcctgcctgctctct

SEQ ID NO: 359137 - DNA, 16 bp, M. musculus
agcctgcctgggctac

SEQ ID NO: 359138 - DNA, 16 bp, M. musculus
agcctgcctggtgagg

SEQ ID NO: 359139 - DNA, 16 bp, M. musculus
agcctgctccaccagc

SEQ ID NO: 359140 - DNA, 16 bp, M. musculus
agcctgctctacacag

SEQ ID NO: 359141 - DNA, 16 bp, M. musculus
agcctgctttcttaga

SEQ ID NO: 359142 - DNA, 16 bp, M. musculus
agcctggaaccagctg

SEQ ID NO: 359143 - DNA, 16 bp, M. musculus
agcctggaactcacta

SEQ ID NO: 359144 - DNA, 16 bp, M. musculus
agcctggaactcatag

SEQ ID NO: 359145 - DNA, 26 bp, M. musculus
agcctggacctgttgaagggccttct

SEQ ID NO: 359146 - DNA, 16 bp, M. musculus
agcctggactacagtg

SEQ ID NO: 359147 - DNA, 16 bp, M. musculus
agcctggagcctggag

SEQ ID NO: 359148 - DNA, 16 bp, M. musculus
agcctggagtacacag

SEQ ID NO: 359149 - DNA, 16 bp, M. musculus
agcctggatgctgcca

SEQ ID NO: 359150 - DNA, 16 bp, M. musculus
agcctggcagcctggg

SEQ ID NO: 359151 - DNA, 16 bp, M. musculus
agcctggccatggctg

SEQ ID NO: 359152 - DNA, 16 bp, M. musculus
agcctggcctcagact

SEQ ID NO: 359153 - DNA, 16 bp, M. musculus
agcctggctggccatg

SEQ ID NO: 359154 - DNA, 16 bp, M. musculus
agcctggctgtcctga

SEQ ID NO: 359155 - DNA, 16 bp, M. musculus
agcctggcttcaaact

SEQ ID NO: 359156 - DNA, 16 bp, M. musculus
agcctggcttggtggc

SEQ ID NO: 359157 - DNA, 16 bp, M. musculus
agcctgggaaccccaa

SEQ ID NO: 359158 - DNA, 16 bp, M. musculus
agcctgggacagaggg

SEQ ID NO: 359159 - DNA, 16 bp, M. musculus
agcctgggatacagag

SEQ ID NO: 359160 - DNA, 16 bp, M. musculus
agcctgggcaacttag

SEQ ID NO: 359161 - DNA, 16 bp, M. musculus
agcctgggcaacttgg

SEQ ID NO: 359162 - DNA, 16 bp, M. musculus
agcctgggcagcttgg

SEQ ID NO: 359163 - DNA, 16 bp, M. musculus
agcctgggctacaaaa

SEQ ID NO: 359164 - DNA, 16 bp, M. musculus
agcctgggctacacag

SEQ ID NO: 359165 - DNA, 16 bp, M. musculus
agcctgggctacagag

SEQ ID NO: 359166 - DNA, 16 bp, M. musculus
agcctgggctacagga

SEQ ID NO: 359167 - DNA, 16 bp, M. musculus
agcctgggctacatgg

SEQ ID NO: 359168 - DNA, 16 bp, M. musculus
agcctgggctacctgg

SEQ ID NO: 359169 - DNA, 16 bp, M. musculus
agcctgggctatacat

SEQ ID NO: 359170 - DNA, 16 bp, M. musculus
agcctgggctatgtag

SEQ ID NO: 359171 - DNA, 16 bp, M. musculus
agcctgggctatgtga

SEQ ID NO: 359172 - DNA, 16 bp, M. musculus
agcctgggctgcatgg

SEQ ID NO: 359173 - DNA, 16 bp, M. musculus
agcctgggctgtatga

SEQ ID NO: 359174 - DNA, 16 bp, M. musculus
agcctgggcttggaga

SEQ ID NO: 359175 - DNA, 16 bp, M. musculus
agcctggggatgcagc

SEQ ID NO: 359176 - DNA, 16 bp, M. musculus
agcctgggtaacatag

SEQ ID NO: 359177 - DNA, 17 bp, M. musculus
agcctggtccacagagc

SEQ ID NO: 359178 - DNA, 16 bp, M. musculus
agcctggtctaaaaag

SEQ ID NO: 359179 - DNA, 16 bp, M. musculus
agcctggtctaaacag

SEQ ID NO: 359180 - DNA, 16 bp, M. musculus
agcctggtctacagtg

SEQ ID NO: 359181 - DNA, 16 bp, M. musculus
agcctggtctacatga

SEQ ID NO: 359182 - DNA, 16 bp, M. musculus
agcctggtgtccagga

SEQ ID NO: 359183 - DNA, 16 bp, M. musculus
agcctgtcacagaagc

SEQ ID NO: 359184 - DNA, 16 bp, M. musculus
agcctgtcaggagaca

SEQ ID NO: 359185 - DNA, 16 bp, M. musculus
agcctgtcatggagtc

SEQ ID NO: 359186 - DNA, 16 bp, M. musculus
agcctgtctacagagt

SEQ ID NO: 359187 - DNA, 16 bp, M. musculus
agcctgtctcaagaaa

SEQ ID NO: 359188 - DNA, 16 bp, M. musculus
agcctgtctttcctgt

SEQ ID NO: 359189 - DNA, 16 bp, M. musculus
agcctgtgatgtttgg

SEQ ID NO: 359190 - DNA, 16 bp, M. musculus
agcctgtgattggaca

SEQ ID NO: 359191 - DNA, 16 bp, M. musculus
agcctgtgcctgtgcc

SEQ ID NO: 359192 - DNA, 16 bp, M. musculus
agcctgtgctacagag

SEQ ID NO: 359193 - DNA, 16 bp, M. musculus
agcctgtgctcccagc

SEQ ID NO: 359194 - DNA, 16 bp, M. musculus
agcctgtgggggccag

SEQ ID NO: 359195 - DNA, 16 bp, M. musculus
agcctgtggttgggca

SEQ ID NO: 359196 - DNA, 16 bp, M. musculus
agcctgtgtctttttt

SEQ ID NO: 359197 - DNA, 16 bp, M. musculus
agcctgtgtgctgttg

SEQ ID NO: 359198 - DNA, 16 bp, M. musculus
agcctgttctacagaa

SEQ ID NO: 359199 - DNA, 16 bp, M. musculus
agcctgtttgtttgtt

SEQ ID NO: 359200 - DNA, 18 bp, M. musculus
agcctgttttcaggctgt

SEQ ID NO: 359201 - DNA, 16 bp, M. musculus
agcctgttttctggtc

SEQ ID NO: 359202 - DNA, 16 bp, M. musculus
agcctgttttcttttt

SEQ ID NO: 359203 - DNA, 18 bp, M. musculus
agccttacaaatgtactg

SEQ ID NO: 359204 - DNA, 16 bp, M. musculus
agccttacctcattca

SEQ ID NO: 359205 - DNA, 17 bp, M. musculus
agccttatttataataa

SEQ ID NO: 359206 - DNA, 16 bp, M. musculus
agccttcagaactcca

SEQ ID NO: 359207 - DNA, 16 bp, M. musculus
agccttcagatgaagt

SEQ ID NO: 359208 - DNA, 16 bp, M. musculus
agccttcagatgtaga

SEQ ID NO: 359209 - DNA, 16 bp, M. musculus
agccttcatcagagaa

SEQ ID NO: 359210 - DNA, 16 bp, M. musculus
agccttcatcccaggg

SEQ ID NO: 359211 - DNA, 16 bp, M. musculus
agccttcatcttctgc

SEQ ID NO: 359212 - DNA, 16 bp, M. musculus
agccttcatgtgggtg

SEQ ID NO: 359213 - DNA, 16 bp, M. musculus
agccttccaaatgaag

SEQ ID NO: 359214 - DNA, 16 bp, M. musculus
agccttccaaatgctg

SEQ ID NO: 359215 - DNA, 16 bp, M. musculus
agccttccaagtagct

SEQ ID NO: 359216 - DNA, 16 bp, M. musculus
agccttccaattctgg

SEQ ID NO: 359217 - DNA, 16 bp, M. musculus
agccttccagtctgtg

SEQ ID NO: 359218 - DNA, 17 bp, M. musculus
agccttcctccctagat

SEQ ID NO: 359219 - DNA, 16 bp, M. musculus
agccttcctgtataca

SEQ ID NO: 359220 - DNA, 16 bp, M. musculus
agccttcggatgaaga

SEQ ID NO: 359221 - DNA, 16 bp, M. musculus
agccttctctccagct

SEQ ID NO: 359222 - DNA, 16 bp, M. musculus
agccttctctctagcc

SEQ ID NO: 359223 - DNA, 16 bp, M. musculus
agccttctctgcagcc

SEQ ID NO: 359224 - DNA, 16 bp, M. musculus
agccttctctttctct

SEQ ID NO: 359225 - DNA, 16 bp, M. musculus
agccttgaaatcattg

SEQ ID NO: 359226 - DNA, 16 bp, M. musculus
agccttgaagatgtgg

SEQ ID NO: 359227 - DNA, 16 bp, M. musculus
agccttgaagatttgg

SEQ ID NO: 359228 - DNA, 19 bp, M. musculus
agccttgaagcaggctgat

SEQ ID NO: 359229 - DNA, 16 bp, M. musculus
agccttgatcagaaaa

SEQ ID NO: 359230 - DNA, 16 bp, M. musculus
agccttgcaagagaca

SEQ ID NO: 359231 - DNA, 16 bp, M. musculus
agccttgcaggagaca

SEQ ID NO: 359232 - DNA, 16 bp, M. musculus
agccttgcttaatgag

SEQ ID NO: 359233 - DNA, 16 bp, M. musculus
agccttggaagcagga

SEQ ID NO: 359234 - DNA, 16 bp, M. musculus
agccttggctgtctta

SEQ ID NO: 359235 - DNA, 16 bp, M. musculus
agccttggctgtgctg

SEQ ID NO: 359236 - DNA, 16 bp, M. musculus
agccttgggggtcagg

SEQ ID NO: 359237 - DNA, 16 bp, M. musculus
agccttgtctacatag

SEQ ID NO: 359238 - DNA, 16 bp, M. musculus
agccttgtctcaaaaa

SEQ ID NO: 359239 - DNA, 16 bp, M. musculus
agccttgtctgcagag

SEQ ID NO: 359240 - DNA, 16 bp, M. musculus
agcctttaatcctagc

SEQ ID NO: 359241 - DNA, 16 bp, M. musculus
agcctttcacacctgt

SEQ ID NO: 359242 - DNA, 16 bp, M. musculus
agcctttcttctctgt

SEQ ID NO: 359243 - DNA, 16 bp, M. musculus
agcctttcttctttct

SEQ ID NO: 359244 - DNA, 16 bp, M. musculus
agcctttgatcccagc

SEQ ID NO: 359245 - DNA, 16 bp, M. musculus
agcctttgcactgctg

SEQ ID NO: 359246 - DNA, 16 bp, M. musculus
agcctttgccaccatt

SEQ ID NO: 359247 - DNA, 16 bp, M. musculus
agcctttgctgctctt

SEQ ID NO: 359248 - DNA, 16 bp, M. musculus
agcctttggaagctga

SEQ ID NO: 359249 - DNA, 16 bp, M. musculus
agccttttactctgag

SEQ ID NO: 359250 - DNA, 16 bp, M. musculus
agccttttctccagcc

SEQ ID NO: 359251 - DNA, 16 bp, M. musculus
agccttttgaagaagg

SEQ ID NO: 359252 - DNA, 16 bp, M. musculus
agccttttgtagaaag

SEQ ID NO: 359253 - DNA, 16 bp, M. musculus
agcctttttgtttctg

SEQ ID NO: 359254 - DNA, 17 bp, M. musculus
agcgacagagaagtaga

SEQ ID NO: 359255 - DNA, 47 bp, M. musculus
agcgacgggtcctactatctggctgctcccgccgggaccatttgggc

SEQ ID NO: 359256 - DNA, 16 bp, M. musculus
agcgagagagatgaag

SEQ ID NO: 359257 - DNA, 16 bp, M. musculus
agcgagagtgggtggg

SEQ ID NO: 359258 - DNA, 16 bp, M. musculus
agcgagttcaaggcca

SEQ ID NO: 359259 - DNA, 16 bp, M. musculus
agcgcactgatagagc

SEQ ID NO: 359260 - DNA, 16 bp, M. musculus
agcgctcaggaggcaa

SEQ ID NO: 359261 - DNA, 16 bp, M. musculus
agcgctggaattaaag

SEQ ID NO: 359262 - DNA, 16 bp, M. musculus
agcgctgggattaagg

SEQ ID NO: 359263 - DNA, 24 bp, M. musculus
agcgctttggcacgaagctgcaca

SEQ ID NO: 359264 - DNA, 16 bp, M. musculus
agcggactgtgagcat

SEQ ID NO: 359265 - DNA, 16 bp, M. musculus
agcggcagcggcagca

SEQ ID NO: 359266 - DNA, 16 bp, M. musculus
agcggctctgtgcctc

SEQ ID NO: 359267 - DNA, 16 bp, M. musculus
agcggctggcaaaggc

SEQ ID NO: 359268 - DNA, 16 bp, M. musculus
agcggttaagaacact

SEQ ID NO: 359269 - DNA, 16 bp, M. musculus
agcgtctcaggagaca

SEQ ID NO: 359270 - DNA, 17 bp, M. musculus
agcgtggtggcgcacgc

SEQ ID NO: 359271 - DNA, 16 bp, M. musculus
agcgtgtggaggactt

SEQ ID NO: 359272 - DNA, 16 bp, M. musculus
agcgttaggaaggttg

SEQ ID NO: 359273 - DNA, 16 bp, M. musculus
agcgtttggaagctga

SEQ ID NO: 359274 - DNA, 16 bp, M. musculus
agctaaaataaaccct

SEQ ID NO: 359275 - DNA, 16 bp, M. musculus
agctaaacaagaaaga

SEQ ID NO: 359276 - DNA, 24 bp, M. musculus
agctaaagaaggtggtctttgcct

SEQ ID NO: 359277 - DNA, 16 bp, M. musculus
agctaaagcaggagga

SEQ ID NO: 359278 - DNA, 16 bp, M. musculus
agctaaagggatctgt

SEQ ID NO: 359279 - DNA, 16 bp, M. musculus
agctaaataagaagga

SEQ ID NO: 359280 - DNA, 16 bp, M. musculus
agctaaccaccaagaa

SEQ ID NO: 359281 - DNA, 16 bp, M. musculus
agctaactgaaacaga

SEQ ID NO: 359282 - DNA, 16 bp, M. musculus
agctaagaaattagct

SEQ ID NO: 359283 - DNA, 16 bp, M. musculus
agctaaggcccaggct

SEQ ID NO: 359284 - DNA, 91 bp, M. musculus
agctaagtcatatgacttgcacctgacttcctcatataagacacaaacatcttgagtgctgcgcaggtgtaccaggatacaggtgaatcca

SEQ ID NO: 359285 - DNA, 39 bp, M. musculus
agctaagtcgtatgacttgcacctgacttcctcatataa

SEQ ID NO: 359286 - DNA, 16 bp, M. musculus
agctaagtttattgtt

SEQ ID NO: 359287 - DNA, 16 bp, M. musculus
agctaatccaacaatg

SEQ ID NO: 359288 - DNA, 16 bp, M. musculus
agctaatgccaatact

SEQ ID NO: 359289 - DNA, 16 bp, M. musculus
agctacaacaacaaca

SEQ ID NO: 359290 - DNA, 16 bp, M. musculus
agctacacaaagaaac

SEQ ID NO: 359291 - DNA, 16 bp, M. musculus
agctacacagagaaat

SEQ ID NO: 359292 - DNA, 16 bp, M. musculus
agctacacagggaagc

SEQ ID NO: 359293 - DNA, 16 bp, M. musculus
agctacacagtaagac

SEQ ID NO: 359294 - DNA, 16 bp, M. musculus
agctacaccactcctg

SEQ ID NO: 359295 - DNA, 16 bp, M. musculus
agctacaccccagccc

SEQ ID NO: 359296 - DNA, 16 bp, M. musculus
agctacagccccagct

SEQ ID NO: 359297 - DNA, 16 bp, M. musculus
agctacaggaaaccca

SEQ ID NO: 359298 - DNA, 16 bp, M. musculus
agctacagtgtacttg

SEQ ID NO: 359299 - DNA, 16 bp, M. musculus
agctacatagggagtt

SEQ ID NO: 359300 - DNA, 17 bp, M. musculus
agctacatagtgagact

SEQ ID NO: 359301 - DNA, 16 bp, M. musculus
agctacatagtgagtt

SEQ ID NO: 359302 - DNA, 16 bp, M. musculus
agctacatccccagca

SEQ ID NO: 359303 - DNA, 16 bp, M. musculus
agctacatcctcagcc

SEQ ID NO: 359304 - DNA, 18 bp, M. musculus
agctacatctgggacctt

SEQ ID NO: 359305 - DNA, 16 bp, M. musculus
agctacatggccaagg

SEQ ID NO: 359306 - DNA, 16 bp, M. musculus
agctaccactgctgat

SEQ ID NO: 359307 - DNA, 16 bp, M. musculus
agctaccagcatcaga

SEQ ID NO: 359308 - DNA, 16 bp, M. musculus
agctaccaggcacaca

SEQ ID NO: 359309 - DNA, 16 bp, M. musculus
agctaccatgtggctg

SEQ ID NO: 359310 - DNA, 16 bp, M. musculus
agctaccctgcaactg

SEQ ID NO: 359311 - DNA, 16 bp, M. musculus
agctaccgtgtggttg

SEQ ID NO: 359312 - DNA, 16 bp, M. musculus
agctactatggaaatc

SEQ ID NO: 359313 - DNA, 16 bp, M. musculus
agctactatgtgggtg

SEQ ID NO: 359314 - DNA, 16 bp, M. musculus
agctactctccatgac

SEQ ID NO: 359315 - DNA, 16 bp, M. musculus
agctactgctgctgat

SEQ ID NO: 359316 - DNA, 16 bp, M. musculus
agctacttgggaagct

SEQ ID NO: 359317 - DNA, 16 bp, M. musculus
agctactttggaaatc

SEQ ID NO: 359318 - DNA, 16 bp, M. musculus
agctagaagaacatat

SEQ ID NO: 359319 - DNA, 16 bp, M. musculus
agctagaagaatatat

SEQ ID NO: 359320 - DNA, 16 bp, M. musculus
agctagaagcccttaa

SEQ ID NO: 359321 - DNA, 16 bp, M. musculus
agctagacacggattt

SEQ ID NO: 359322 - DNA, 16 bp, M. musculus
agctagactctgagga

SEQ ID NO: 359323 - DNA, 16 bp, M. musculus
agctagagaaagcact

SEQ ID NO: 359324 - DNA, 16 bp, M. musculus
agctagagagagtacc

SEQ ID NO: 359325 - DNA, 17 bp, M. musculus
agctagagtaagagtcc

SEQ ID NO: 359326 - DNA, 16 bp, M. musculus
agctagagttatctgg

SEQ ID NO: 359327 - DNA, 16 bp, M. musculus
agctagcaggctttca

SEQ ID NO: 359328 - DNA, 16 bp, M. musculus
agctagccagcatcaa

SEQ ID NO: 359329 - DNA, 16 bp, M. musculus
agctagccagggctac

SEQ ID NO: 359330 - DNA, 16 bp, M. musculus
agctagcctggtctac

SEQ ID NO: 359331 - DNA, 16 bp, M. musculus
agctagctagctagct

SEQ ID NO: 359332 - DNA, 16 bp, M. musculus
agctagctatgcaagc

SEQ ID NO: 359333 - DNA, 16 bp, M. musculus
agctagctccaggaca

SEQ ID NO: 359334 - DNA, 16 bp, M. musculus
agctaggcatgatggt

SEQ ID NO: 359335 - DNA, 16 bp, M. musculus
agctaggcatggtggt

SEQ ID NO: 359336 - DNA, 16 bp, M. musculus
agctaggggtgggact

SEQ ID NO: 359337 - DNA, 16 bp, M. musculus
agctagggttacacag

SEQ ID NO: 359338 - DNA, 16 bp, M. musculus
agctaggtttaaaccc

SEQ ID NO: 359339 - DNA, 20 bp, M. musculus
agctagtagaatccttggaa

SEQ ID NO: 359340 - DNA, 16 bp, M. musculus
agctagtgcttttaac

SEQ ID NO: 359341 - DNA, 16 bp, M. musculus
agctagttccaggaca

SEQ ID NO: 359342 - DNA, 16 bp, M. musculus
agctatagaatgtgca

SEQ ID NO: 359343 - DNA, 17 bp, M. musculus
agctatatcaggctcct

SEQ ID NO: 359344 - DNA, 16 bp, M. musculus
agctatatcagggtcc

SEQ ID NO: 359345 - DNA, 16 bp, M. musculus
agctatatcagggttt

SEQ ID NO: 359346 - DNA, 16 bp, M. musculus
agctatatccctagcc

SEQ ID NO: 359347 - DNA, 16 bp, M. musculus
agctatatggccaagg

SEQ ID NO: 359348 - DNA, 16 bp, M. musculus
agctatcaaaaaagat

SEQ ID NO: 359349 - DNA, 16 bp, M. musculus
agctatcaattgccaa

SEQ ID NO: 359350 - DNA, 16 bp, M. musculus
agctatcctgaaactc

SEQ ID NO: 359351 - DNA, 16 bp, M. musculus
agctatcttcagacac

SEQ ID NO: 359352 - DNA, 16 bp, M. musculus
agctatgaaaaagaat

SEQ ID NO: 359353 - DNA, 16 bp, M. musculus
agctatgaccagcaat

SEQ ID NO: 359354 - DNA, 16 bp, M. musculus
agctatgaggacatgg

SEQ ID NO: 359355 - DNA, 16 bp, M. musculus
agctatgggtccctcc

SEQ ID NO: 359356 - DNA, 16 bp, M. musculus
agctatggtcatctgt

SEQ ID NO: 359357 - DNA, 16 bp, M. musculus
agctattacaaagaat

SEQ ID NO: 359358 - DNA, 16 bp, M. musculus
agctattccagagact

SEQ ID NO: 359359 - DNA, 16 bp, M. musculus
agctattgaaaacggc

SEQ ID NO: 359360 - DNA, 16 bp, M. musculus
agctattggtgctttg

SEQ ID NO: 359361 - DNA, 16 bp, M. musculus
agctatttcactgaag

SEQ ID NO: 359362 - DNA, 16 bp, M. musculus
agctatttctccagct

SEQ ID NO: 359363 - DNA, 16 bp, M. musculus
agctcaaagaacggga

SEQ ID NO: 359364 - DNA, 16 bp, M. musculus
agctcaaagcacacaa

SEQ ID NO: 359365 - DNA, 16 bp, M. musculus
agctcaaagcacagat

SEQ ID NO: 359366 - DNA, 16 bp, M. musculus
agctcaaagcccaccc

SEQ ID NO: 359367 - DNA, 16 bp, M. musculus
agctcaaaggaaaaaa

SEQ ID NO: 359368 - DNA, 16 bp, M. musculus
agctcaaaggcacaga

SEQ ID NO: 359369 - DNA, 16 bp, M. musculus
agctcaaataacattt

SEQ ID NO: 359370 - DNA, 16 bp, M. musculus
agctcaactacacaat

SEQ ID NO: 359371 - DNA, 16 bp, M. musculus
agctcaagaaactgga

SEQ ID NO: 359372 - DNA, 16 bp, M. musculus
agctcaagaacaagga

SEQ ID NO: 359373 - DNA, 16 bp, M. musculus
agctcaagaaggaaaa

SEQ ID NO: 359374 - DNA, 16 bp, M. musculus
agctcaagaagttgga

SEQ ID NO: 359375 - DNA, 16 bp, M. musculus
agctcaagaggaggtc

SEQ ID NO: 359376 - DNA, 16 bp, M. musculus
agctcaaggcaagcct

SEQ ID NO: 359377 - DNA, 16 bp, M. musculus
agctcaaggccaacct

SEQ ID NO: 359378 - DNA, 16 bp, M. musculus
agctcaaggccagcct

SEQ ID NO: 359379 - DNA, 16 bp, M. musculus
agctcaagggagacca

SEQ ID NO: 359380 - DNA, 16 bp, M. musculus
agctcaaggggatgtc

SEQ ID NO: 359381 - DNA, 16 bp, M. musculus
agctcaattttactgt

SEQ ID NO: 359382 - DNA, 16 bp, M. musculus
agctcacaaaggaaaa

SEQ ID NO: 359383 - DNA, 16 bp, M. musculus
agctcacaaccacctg

SEQ ID NO: 359384 - DNA, 17 bp, M. musculus
agctcacaaccatctgt

SEQ ID NO: 359385 - DNA, 16 bp, M. musculus
agctcacaaccatctt

SEQ ID NO: 359386 - DNA, 16 bp, M. musculus
agctcacaactatctg

SEQ ID NO: 359387 - DNA, 19 bp, M. musculus
agctcacaactgcctgtaa

SEQ ID NO: 359388 - DNA, 16 bp, M. musculus
agctcacaatcatctg

SEQ ID NO: 359389 - DNA, 16 bp, M. musculus
agctcacactgtctgt

SEQ ID NO: 359390 - DNA, 16 bp, M. musculus
agctcacagacatctg

SEQ ID NO: 359391 - DNA, 16 bp, M. musculus
agctcacagccatcca

SEQ ID NO: 359392 - DNA, 16 bp, M. musculus
agctcacatgaactca

SEQ ID NO: 359393 - DNA, 16 bp, M. musculus
agctcacctccagcag

SEQ ID NO: 359394 - DNA, 16 bp, M. musculus
agctcactgatatggc

SEQ ID NO: 359395 - DNA, 16 bp, M. musculus
agctcactggccagcc

SEQ ID NO: 359396 - DNA, 16 bp, M. musculus
agctcactgtgggcag

SEQ ID NO: 359397 - DNA, 16 bp, M. musculus
agctcactgtgtagcc

SEQ ID NO: 359398 - DNA, 16 bp, M. musculus
agctcagaagctcaga

SEQ ID NO: 359399 - DNA, 16 bp, M. musculus
agctcagaatccttct

SEQ ID NO: 359400 - DNA, 16 bp, M. musculus
agctcagagcagcttt

SEQ ID NO: 359401 - DNA, 16 bp, M. musculus
agctcagagcaggaca

SEQ ID NO: 359402 - DNA, 16 bp, M. musculus
agctcagagcccaaca

SEQ ID NO: 359403 - DNA, 16 bp, M. musculus
agctcagagctcagag

SEQ ID NO: 359404 - DNA, 16 bp, M. musculus
agctcagaggacagct

SEQ ID NO: 359405 - DNA, 16 bp, M. musculus
agctcagagggtaaag

SEQ ID NO: 359406 - DNA, 16 bp, M. musculus
agctcagagttctaca

SEQ ID NO: 359407 - DNA, 16 bp, M. musculus
agctcagatcccagca

SEQ ID NO: 359408 - DNA, 16 bp, M. musculus
agctcagatctgcctc

SEQ ID NO: 359409 - DNA, 16 bp, M. musculus
agctcagcagcagcag

SEQ ID NO: 359410 - DNA, 16 bp, M. musculus
agctcagcagcctccc

SEQ ID NO: 359411 - DNA, 16 bp, M. musculus
agctcagcccagccca

SEQ ID NO: 359412 - DNA, 16 bp, M. musculus
agctcagctagaagaa

SEQ ID NO: 359413 - DNA, 16 bp, M. musculus
agctcagctcagctcc

SEQ ID NO: 359414 - DNA, 16 bp, M. musculus
agctcaggatgtcctc

SEQ ID NO: 359415 - DNA, 16 bp, M. musculus
agctcaggctagcctc

SEQ ID NO: 359416 - DNA, 16 bp, M. musculus
agctcaggctagctca

SEQ ID NO: 359417 - DNA, 16 bp, M. musculus
agctcaggctgccctt

SEQ ID NO: 359418 - DNA, 16 bp, M. musculus
agctcaggctggcttt

SEQ ID NO: 359419 - DNA, 16 bp, M. musculus
agctcaggctggtctc

SEQ ID NO: 359420 - DNA, 16 bp, M. musculus
agctcaggctgtcagg

SEQ ID NO: 359421 - DNA, 16 bp, M. musculus
agctcagggattggtg

SEQ ID NO: 359422 - DNA, 16 bp, M. musculus
agctcaggggctggag

SEQ ID NO: 359423 - DNA, 16 bp, M. musculus
agctcaggggtggggg

SEQ ID NO: 359424 - DNA, 16 bp, M. musculus
agctcagggtccccaa

SEQ ID NO: 359425 - DNA, 16 bp, M. musculus
agctcaggtcatcagg

SEQ ID NO: 359426 - DNA, 16 bp, M. musculus
agctcaggtcctcatg

SEQ ID NO: 359427 - DNA, 16 bp, M. musculus
agctcaggttggcctt

SEQ ID NO: 359428 - DNA, 16 bp, M. musculus
agctcagtagtagagc

SEQ ID NO: 359429 - DNA, 16 bp, M. musculus
agctcagtagtagagt

SEQ ID NO: 359430 - DNA, 16 bp, M. musculus
agctcagtcagtagag

SEQ ID NO: 359431 - DNA, 16 bp, M. musculus
agctcagtggctgggc

SEQ ID NO: 359432 - DNA, 16 bp, M. musculus
agctcagtggtggagt

SEQ ID NO: 359433 - DNA, 16 bp, M. musculus
agctcagtggttaaga

SEQ ID NO: 359434 - DNA, 16 bp, M. musculus
agctcagtgtctgaga

SEQ ID NO: 359435 - DNA, 16 bp, M. musculus
agctcagtttgtagag

SEQ ID NO: 359436 - DNA, 16 bp, M. musculus
agctcataaccatctg

SEQ ID NO: 359437 - DNA, 16 bp, M. musculus
agctcatctcctgcag

SEQ ID NO: 359438 - DNA, 16 bp, M. musculus
agctcatgctgacaag

SEQ ID NO: 359439 - DNA, 16 bp, M. musculus
agctcatggctctagc

SEQ ID NO: 359440 - DNA, 16 bp, M. musculus
agctcatttacatttc

SEQ ID NO: 359441 - DNA, 16 bp, M. musculus
agctccaaatttgtct

SEQ ID NO: 359442 - DNA, 16 bp, M. musculus
agctccaagagatcca

SEQ ID NO: 359443 - DNA, 16 bp, M. musculus
agctccaaggcccaga

SEQ ID NO: 359444 - DNA, 16 bp, M. musculus
agctccaagggaagga

SEQ ID NO: 359445 - DNA, 16 bp, M. musculus
agctccaagttcagtg

SEQ ID NO: 359446 - DNA, 16 bp, M. musculus
agctccaccccagccc

SEQ ID NO: 359447 - DNA, 16 bp, M. musculus
agctccagaagatctg

SEQ ID NO: 359448 - DNA, 16 bp, M. musculus
agctccagcttgtgtc

SEQ ID NO: 359449 - DNA, 16 bp, M. musculus
agctccaggaaatctg

SEQ ID NO: 359450 - DNA, 16 bp, M. musculus
agctccaggaatccca

SEQ ID NO: 359451 - DNA, 18 bp, M. musculus
agctccaggacagccaga

SEQ ID NO: 359452 - DNA, 19 bp, M. musculus
agctccaggacagccagga

SEQ ID NO: 359453 - DNA, 16 bp, M. musculus
agctccaggacagcct

SEQ ID NO: 359454 - DNA, 16 bp, M. musculus
agctccaggccagcct

SEQ ID NO: 359455 - DNA, 16 bp, M. musculus
agctccaggctagcca

SEQ ID NO: 359456 - DNA, 16 bp, M. musculus
agctccaggcttttca

SEQ ID NO: 359457 - DNA, 16 bp, M. musculus
agctccagggagtact

SEQ ID NO: 359458 - DNA, 16 bp, M. musculus
agctccaggggaatct

SEQ ID NO: 359459 - DNA, 16 bp, M. musculus
agctccaggggatcca

SEQ ID NO: 359460 - DNA, 16 bp, M. musculus
agctccaggttcagtg

SEQ ID NO: 359461 - DNA, 16 bp, M. musculus
agctccagttaaatgt

SEQ ID NO: 359462 - DNA, 16 bp, M. musculus
agctccatccccagcc

SEQ ID NO: 359463 - DNA, 16 bp, M. musculus
agctccatctgcctct

SEQ ID NO: 359464 - DNA, 16 bp, M. musculus
agctccatctgcttct

SEQ ID NO: 359465 - DNA, 25 bp, M. musculus
agctccatgttctagtcctgcaagc

SEQ ID NO: 359466 - DNA, 16 bp, M. musculus
agctcccagagctccc

SEQ ID NO: 359467 - DNA, 16 bp, M. musculus
agctcccagaggtcca

SEQ ID NO: 359468 - DNA, 16 bp, M. musculus
agctcccagcacccat

SEQ ID NO: 359469 - DNA, 16 bp, M. musculus
agctcccagctcccag

SEQ ID NO: 359470 - DNA, 16 bp, M. musculus
agctcccccaccaggg

SEQ ID NO: 359471 - DNA, 16 bp, M. musculus
agctccccctgccaca

SEQ ID NO: 359472 - DNA, 16 bp, M. musculus
agctcccctgtcaaag

SEQ ID NO: 359473 - DNA, 16 bp, M. musculus
agctccctcagtcctt

SEQ ID NO: 359474 - DNA, 16 bp, M. musculus
agctccctgagtactt

SEQ ID NO: 359475 - DNA, 16 bp, M. musculus
agctccctgtccaggc

SEQ ID NO: 359476 - DNA, 16 bp, M. musculus
agctccggggcctctc

SEQ ID NO: 359477 - DNA, 29 bp, M. musculus
agctcctaatatagcctaagagccacaaa

SEQ ID NO: 359478 - DNA, 16 bp, M. musculus
agctcctcatgttgtg

SEQ ID NO: 359479 - DNA, 16 bp, M. musculus
agctcctccccacagt

SEQ ID NO: 359480 - DNA, 16 bp, M. musculus
agctcctcctacacca

SEQ ID NO: 359481 - DNA, 16 bp, M. musculus
agctcctcctccacca

SEQ ID NO: 359482 - DNA, 16 bp, M. musculus
agctcctcctccagca

SEQ ID NO: 359483 - DNA, 16 bp, M. musculus
agctcctcctcctccc

SEQ ID NO: 359484 - DNA, 18 bp, M. musculus
agctcctcctgcgccatg

SEQ ID NO: 359485 - DNA, 16 bp, M. musculus
agctcctctccatttc

SEQ ID NO: 359486 - DNA, 16 bp, M. musculus
agctcctgcctctgtg

SEQ ID NO: 359487 - DNA, 16 bp, M. musculus
agctcctgctcctgct

SEQ ID NO: 359488 - DNA, 16 bp, M. musculus
agctcctgcttccatg

SEQ ID NO: 359489 - DNA, 16 bp, M. musculus
agctcctgcttcctca

SEQ ID NO: 359490 - DNA, 16 bp, M. musculus
agctcctgcttcctgc

SEQ ID NO: 359491 - DNA, 16 bp, M. musculus
agctcctggacagcca

SEQ ID NO: 359492 - DNA, 16 bp, M. musculus
agctcctgggaatcaa

SEQ ID NO: 359493 - DNA, 16 bp, M. musculus
agctcctggtaggagc

SEQ ID NO: 359494 - DNA, 16 bp, M. musculus
agctcctggttttgct

SEQ ID NO: 359495 - DNA, 16 bp, M. musculus
agctcctgtcctggct

SEQ ID NO: 359496 - DNA, 16 bp, M. musculus
agctcctgtgacatct

SEQ ID NO: 359497 - DNA, 16 bp, M. musculus
agctcctgttatcctg

SEQ ID NO: 359498 - DNA, 16 bp, M. musculus
agctccttcagtactt

SEQ ID NO: 359499 - DNA, 17 bp, M. musculus
agctccttctccagcac

SEQ ID NO: 359500 - DNA, 16 bp, M. musculus
agctccttctccatca

SEQ ID NO: 359501 - DNA, 16 bp, M. musculus
agctccttgtgtcctt

SEQ ID NO: 359502 - DNA, 16 bp, M. musculus
agctccttgtgtgaga

SEQ ID NO: 359503 - DNA, 16 bp, M. musculus
agctcctttgtcaaat

SEQ ID NO: 359504 - DNA, 16 bp, M. musculus
agctcctttgtcaagg

SEQ ID NO: 359505 - DNA, 16 bp, M. musculus
agctcgctctctctct

SEQ ID NO: 359506 - DNA, 16 bp, M. musculus
agctctaagccccatt

SEQ ID NO: 359507 - DNA, 16 bp, M. musculus
agctctacctaatgtt

SEQ ID NO: 359508 - DNA, 16 bp, M. musculus
agctctagaacaaaaa

SEQ ID NO: 359509 - DNA, 16 bp, M. musculus
agctctagctaaccag

SEQ ID NO: 359510 - DNA, 16 bp, M. musculus
agctctaggacaaaaa

SEQ ID NO: 359511 - DNA, 16 bp, M. musculus
agctctaggacagcca

SEQ ID NO: 359512 - DNA, 16 bp, M. musculus
agctctataagcaagc

SEQ ID NO: 359513 - DNA, 16 bp, M. musculus
agctctcacctttctt

SEQ ID NO: 359514 - DNA, 16 bp, M. musculus
agctctcagagaaaga

SEQ ID NO: 359515 - DNA, 16 bp, M. musculus
agctctcagagactga

SEQ ID NO: 359516 - DNA, 16 bp, M. musculus
agctctcagccactgc

SEQ ID NO: 359517 - DNA, 16 bp, M. musculus
agctctcagtcagatt

SEQ ID NO: 359518 - DNA, 16 bp, M. musculus
agctctcagttactgc

SEQ ID NO: 359519 - DNA, 16 bp, M. musculus
agctctcattacagat

SEQ ID NO: 359520 - DNA, 16 bp, M. musculus
agctctccagcaccca

SEQ ID NO: 359521 - DNA, 16 bp, M. musculus
agctctcccagctctc

SEQ ID NO: 359522 - DNA, 16 bp, M. musculus
agctctccttctcccc

SEQ ID NO: 359523 - DNA, 16 bp, M. musculus
agctctccttctctcc

SEQ ID NO: 359524 - DNA, 16 bp, M. musculus
agctctccttctctct

SEQ ID NO: 359525 - DNA, 16 bp, M. musculus
agctctctcctctggg

SEQ ID NO: 359526 - DNA, 16 bp, M. musculus
agctctctcttctctc

SEQ ID NO: 359527 - DNA, 16 bp, M. musculus
agctctcttctggcag

SEQ ID NO: 359528 - DNA, 16 bp, M. musculus
agctctcttcttgcag

SEQ ID NO: 359529 - DNA, 16 bp, M. musculus
agctctcttgctctct

SEQ ID NO: 359530 - DNA, 16 bp, M. musculus
agctctgaaaacatat

SEQ ID NO: 359531 - DNA, 16 bp, M. musculus
agctctgaaatccatt

SEQ ID NO: 359532 - DNA, 16 bp, M. musculus
agctctgaagcaagtg

SEQ ID NO: 359533 - DNA, 16 bp, M. musculus
agctctgaagcaggtg

SEQ ID NO: 359534 - DNA, 16 bp, M. musculus
agctctgaatcccatt

SEQ ID NO: 359535 - DNA, 16 bp, M. musculus
agctctgactcaagcc

SEQ ID NO: 359536 - DNA, 16 bp, M. musculus
agctctgactgctctt

SEQ ID NO: 359537 - DNA, 16 bp, M. musculus
agctctgagtcccatt

SEQ ID NO: 359538 - DNA, 17 bp, M. musculus
agctctgagtgccgcca

SEQ ID NO: 359539 - DNA, 16 bp, M. musculus
agctctgagtttgatt

SEQ ID NO: 359540 - DNA, 16 bp, M. musculus
agctctgccctctgta

SEQ ID NO: 359541 - DNA, 16 bp, M. musculus
agctctgcctccaggt

SEQ ID NO: 359542 - DNA, 16 bp, M. musculus
agctctgcctcctggt

SEQ ID NO: 359543 - DNA, 16 bp, M. musculus
agctctgcctgcttct

SEQ ID NO: 359544 - DNA, 16 bp, M. musculus
agctctgccttcccac

SEQ ID NO: 359545 - DNA, 16 bp, M. musculus
agctctgctctgctct

SEQ ID NO: 359546 - DNA, 16 bp, M. musculus
agctctggatctgggc

SEQ ID NO: 359547 - DNA, 16 bp, M. musculus
agctctggcctccagg

SEQ ID NO: 359548 - DNA, 16 bp, M. musculus
agctctggctgacctg

SEQ ID NO: 359549 - DNA, 16 bp, M. musculus
agctctggctgccttg

SEQ ID NO: 359550 - DNA, 16 bp, M. musculus
agctctggctgctctt

SEQ ID NO: 359551 - DNA, 16 bp, M. musculus
agctctggctggcttt

SEQ ID NO: 359552 - DNA, 16 bp, M. musculus
agctctggctgtcctc

SEQ ID NO: 359553 - DNA, 20 bp, M. musculus
agctctggctgtcctggaat

SEQ ID NO: 359554 - DNA, 16 bp, M. musculus
agctctgggaaaagaa

SEQ ID NO: 359555 - DNA, 16 bp, M. musculus
agctctgggaatactg

SEQ ID NO: 359556 - DNA, 16 bp, M. musculus
agctctgggagtactg

SEQ ID NO: 359557 - DNA, 16 bp, M. musculus
agctctgggattaaag

SEQ ID NO: 359558 - DNA, 16 bp, M. musculus
agctctggggaagcag

SEQ ID NO: 359559 - DNA, 16 bp, M. musculus
agctctggggctctgg

SEQ ID NO: 359560 - DNA, 16 bp, M. musculus
agctctgggtcagaga

SEQ ID NO: 359561 - DNA, 60 bp, M. musculus
agctctggtactttttcatgccttgcaaaatggcgttactgcagctagcttgctaagcct

SEQ ID NO: 359562 - DNA, 16 bp, M. musculus
agctctgtagaccagc

SEQ ID NO: 359563 - DNA, 16 bp, M. musculus
agctctgtcagatgtt

SEQ ID NO: 359564 - DNA, 16 bp, M. musculus
agctctgtctccagca

SEQ ID NO: 359565 - DNA, 16 bp, M. musculus
agctctgtctgcacca

SEQ ID NO: 359566 - DNA, 16 bp, M. musculus
agctctgtgagtttga

SEQ ID NO: 359567 - DNA, 16 bp, M. musculus
agctctgtggcacagg

SEQ ID NO: 359568 - DNA, 16 bp, M. musculus
agctcttcagttttca

SEQ ID NO: 359569 - DNA, 16 bp, M. musculus
agctcttcctgcacca

SEQ ID NO: 359570 - DNA, 16 bp, M. musculus
agctcttccttccttc

SEQ ID NO: 359571 - DNA, 16 bp, M. musculus
agctcttctttgaagg

SEQ ID NO: 359572 - DNA, 16 bp, M. musculus
agctcttgctctggct

SEQ ID NO: 359573 - DNA, 16 bp, M. musculus
agctcttgctcttgct

SEQ ID NO: 359574 - DNA, 16 bp, M. musculus
agctcttgttgtcatc

SEQ ID NO: 359575 - DNA, 16 bp, M. musculus
agctctttcagttctt

SEQ ID NO: 359576 - DNA, 16 bp, M. musculus
agctctttccttccac

SEQ ID NO: 359577 - DNA, 16 bp, M. musculus
agctctttctacttgt

SEQ ID NO: 359578 - DNA, 16 bp, M. musculus
agctctttggaggcag

SEQ ID NO: 359579 - DNA, 16 bp, M. musculus
agctgaaagaagtgga

SEQ ID NO: 359580 - DNA, 16 bp, M. musculus
agctgaaagaggcaga

SEQ ID NO: 359581 - DNA, 16 bp, M. musculus
agctgaaagtgtcaga

SEQ ID NO: 359582 - DNA, 16 bp, M. musculus
agctgaaatgaaagga

SEQ ID NO: 359583 - DNA, 16 bp, M. musculus
agctgaacaaggagga

SEQ ID NO: 359584 - DNA, 16 bp, M. musculus
agctgaagatgacctt

SEQ ID NO: 359585 - DNA, 16 bp, M. musculus
agctgaagcagaaaga

SEQ ID NO: 359586 - DNA, 16 bp, M. musculus
agctgaagcagaagga

SEQ ID NO: 359587 - DNA, 16 bp, M. musculus
agctgaagcaggagaa

SEQ ID NO: 359588 - DNA, 16 bp, M. musculus
agctgaagcaggaggc

SEQ ID NO: 359589 - DNA, 16 bp, M. musculus
agctgaaggaggagga

SEQ ID NO: 359590 - DNA, 17 bp, M. musculus
agctgaaggcatttgca

SEQ ID NO: 359591 - DNA, 16 bp, M. musculus
agctgaagggaatggc

SEQ ID NO: 359592 - DNA, 16 bp, M. musculus
agctgaagggctctgc

SEQ ID NO: 359593 - DNA, 16 bp, M. musculus
agctgaaggggtcagc

SEQ ID NO: 359594 - DNA, 16 bp, M. musculus
agctgaaggggtgtgc

SEQ ID NO: 359595 - DNA, 16 bp, M. musculus
agctgaagttacaggt

SEQ ID NO: 359596 - DNA, 16 bp, M. musculus
agctgaataaagaatt

SEQ ID NO: 359597 - DNA, 16 bp, M. musculus
agctgacacaaaacca

SEQ ID NO: 359598 - DNA, 16 bp, M. musculus
agctgaccctgcctct

SEQ ID NO: 359599 - DNA, 16 bp, M. musculus
agctgaccctggtggt

SEQ ID NO: 359600 - DNA, 16 bp, M. musculus
agctgaccctgtacca

SEQ ID NO: 359601 - DNA, 16 bp, M. musculus
agctgacctgcctcct

SEQ ID NO: 359602 - DNA, 16 bp, M. musculus
agctgacctgcctgag

SEQ ID NO: 359603 - DNA, 16 bp, M. musculus
agctgactatgatttg

SEQ ID NO: 359604 - DNA, 16 bp, M. musculus
agctgactgtgaccat

SEQ ID NO: 359605 - DNA, 16 bp, M. musculus
agctgactgtgatttg

SEQ ID NO: 359606 - DNA, 16 bp, M. musculus
agctgagaaacaactt

SEQ ID NO: 359607 - DNA, 16 bp, M. musculus
agctgagaaagaaatc

SEQ ID NO: 359608 - DNA, 16 bp, M. musculus
agctgagaaagccagg

SEQ ID NO: 359609 - DNA, 16 bp, M. musculus
agctgagaagaaagaa

SEQ ID NO: 359610 - DNA, 16 bp, M. musculus
agctgagaagaaagga

SEQ ID NO: 359611 - DNA, 16 bp, M. musculus
agctgagaaggaagaa

SEQ ID NO: 359612 - DNA, 16 bp, M. musculus
agctgagaaggagggc

SEQ ID NO: 359613 - DNA, 16 bp, M. musculus
agctgagacacagacc

SEQ ID NO: 359614 - DNA, 16 bp, M. musculus
agctgagactcacagc

SEQ ID NO: 359615 - DNA, 16 bp, M. musculus
agctgagagctcacat

SEQ ID NO: 359616 - DNA, 16 bp, M. musculus
agctgagagctctaca

SEQ ID NO: 359617 - DNA, 16 bp, M. musculus
agctgagaggaaagaa

SEQ ID NO: 359618 - DNA, 16 bp, M. musculus
agctgagatgaaagga

SEQ ID NO: 359619 - DNA, 16 bp, M. musculus
agctgagattacaggt

SEQ ID NO: 359620 - DNA, 16 bp, M. musculus
agctgagcagaagcac

SEQ ID NO: 359621 - DNA, 16 bp, M. musculus
agctgagctgagcaga

SEQ ID NO: 359622 - DNA, 16 bp, M. musculus
agctgagctgcatccc

SEQ ID NO: 359623 - DNA, 16 bp, M. musculus
agctgagctgcatttg

SEQ ID NO: 359624 - DNA, 16 bp, M. musculus
agctgagctgtctgga

SEQ ID NO: 359625 - DNA, 16 bp, M. musculus
agctgaggactgaacc

SEQ ID NO: 359626 - DNA, 16 bp, M. musculus
agctgaggatgacttt

SEQ ID NO: 359627 - DNA, 16 bp, M. musculus
agctgaggcagaggag

SEQ ID NO: 359628 - DNA, 16 bp, M. musculus
agctgaggcagaggcc

SEQ ID NO: 359629 - DNA, 16 bp, M. musculus
agctgaggcaggaaat

SEQ ID NO: 359630 - DNA, 16 bp, M. musculus
agctgaggcaggagaa

SEQ ID NO: 359631 - DNA, 16 bp, M. musculus
agctgaggcaggagac

SEQ ID NO: 359632 - DNA, 16 bp, M. musculus
agctgaggcaggagag

SEQ ID NO: 359633 - DNA, 16 bp, M. musculus
agctgaggcaggaggc

SEQ ID NO: 359634 - DNA, 16 bp, M. musculus
agctgaggctcagaga

SEQ ID NO: 359635 - DNA, 16 bp, M. musculus
agctgaggctgacctc

SEQ ID NO: 359636 - DNA, 16 bp, M. musculus
agctgaggctgaggcc

SEQ ID NO: 359637 - DNA, 16 bp, M. musculus
agctgaggctggagga

SEQ ID NO: 359638 - DNA, 23 bp, M. musculus
agctgaggcttagcactgtgaga

SEQ ID NO: 359639 - DNA, 16 bp, M. musculus
agctgaggcttggcac

SEQ ID NO: 359640 - DNA, 16 bp, M. musculus
agctgagtagtagtac

SEQ ID NO: 359641 - DNA, 16 bp, M. musculus
agctgagtgtggtggt

SEQ ID NO: 359642 - DNA, 16 bp, M. musculus
agctgataaaccactt

SEQ ID NO: 359643 - DNA, 17 bp, M. musculus
agctgatgatctttctc

SEQ ID NO: 359644 - DNA, 16 bp, M. musculus
agctgatgcagacaga

SEQ ID NO: 359645 - DNA, 16 bp, M. musculus
agctgatgcagagatc

SEQ ID NO: 359646 - DNA, 21 bp, M. musculus
agctgatgcagaggccatgga

SEQ ID NO: 359647 - DNA, 16 bp, M. musculus
agctgatgcagaggct

SEQ ID NO: 359648 - DNA, 16 bp, M. musculus
agctgatgggtgcaga

SEQ ID NO: 359649 - DNA, 20 bp, M. musculus
agctgatgtgaagcccccaa

SEQ ID NO: 359650 - DNA, 16 bp, M. musculus
agctgatgtgaggccc

SEQ ID NO: 359651 - DNA, 16 bp, M. musculus
agctgatgttgtgttc

SEQ ID NO: 359652 - DNA, 16 bp, M. musculus
agctgattcttcagct

SEQ ID NO: 359653 - DNA, 16 bp, M. musculus
agctgattggcagagt

SEQ ID NO: 359654 - DNA, 16 bp, M. musculus
agctgcaacaggagcc

SEQ ID NO: 359655 - DNA, 16 bp, M. musculus
agctgcacacatctgt

SEQ ID NO: 359656 - DNA, 16 bp, M. musculus
agctgcacatttgcta

SEQ ID NO: 359657 - DNA, 16 bp, M. musculus
agctgcacccctccat

SEQ ID NO: 359658 - DNA, 16 bp, M. musculus
agctgcagcagtctgg

SEQ ID NO: 359659 - DNA, 16 bp, M. musculus
agctgcaggagagaaa

SEQ ID NO: 359660 - DNA, 16 bp, M. musculus
agctgcaggccagcct

SEQ ID NO: 359661 - DNA, 16 bp, M. musculus
agctgcagtgcctggc

SEQ ID NO: 359662 - DNA, 16 bp, M. musculus
agctgcagttacaggc

SEQ ID NO: 359663 - DNA, 16 bp, M. musculus
agctgcatacatagca

SEQ ID NO: 359664 - DNA, 16 bp, M. musculus
agctgcatcactgaaa

SEQ ID NO: 359665 - DNA, 16 bp, M. musculus
agctgcatccccagct

SEQ ID NO: 359666 - DNA, 16 bp, M. musculus
agctgccacagctgcc

SEQ ID NO: 359667 - DNA, 16 bp, M. musculus
agctgccactgctgat

SEQ ID NO: 359668 - DNA, 16 bp, M. musculus
agctgccactgtggac

SEQ ID NO: 359669 - DNA, 16 bp, M. musculus
agctgccactgtgggc

SEQ ID NO: 359670 - DNA, 16 bp, M. musculus
agctgcccagctcttg

SEQ ID NO: 359671 - DNA, 16 bp, M. musculus
agctgccccaccacct

SEQ ID NO: 359672 - DNA, 16 bp, M. musculus
agctgcccctgcccct

SEQ ID NO: 359673 - DNA, 16 bp, M. musculus
agctgccctctgacct

SEQ ID NO: 359674 - DNA, 16 bp, M. musculus
agctgcctccccagcc

SEQ ID NO: 359675 - DNA, 16 bp, M. musculus
agctgcctctgttcct

SEQ ID NO: 359676 - DNA, 16 bp, M. musculus
agctgcctcttacaag

SEQ ID NO: 359677 - DNA, 19 bp, M. musculus
agctgcctgagtaaactgc

SEQ ID NO: 359678 - DNA, 16 bp, M. musculus
agctgcctgatgtagg

SEQ ID NO: 359679 - DNA, 16 bp, M. musculus
agctgcctgatgtggg

SEQ ID NO: 359680 - DNA, 16 bp, M. musculus
agctgcctgcaagctg

SEQ ID NO: 359681 - DNA, 16 bp, M. musculus
agctgcctgccaagct

SEQ ID NO: 359682 - DNA, 16 bp, M. musculus
agctgcctgctgcctg

SEQ ID NO: 359683 - DNA, 16 bp, M. musculus
agctgcctgctgtggg

SEQ ID NO: 359684 - DNA, 16 bp, M. musculus
agctgcctggaaggca

SEQ ID NO: 359685 - DNA, 16 bp, M. musculus
agctgcctggaatcca

SEQ ID NO: 359686 - DNA, 16 bp, M. musculus
agctgcctggaggagg

SEQ ID NO: 359687 - DNA, 16 bp, M. musculus
agctgcctgggagaca

SEQ ID NO: 359688 - DNA, 16 bp, M. musculus
agctgcctgggagcca

SEQ ID NO: 359689 - DNA, 16 bp, M. musculus
agctgcctgtctctgc

SEQ ID NO: 359690 - DNA, 16 bp, M. musculus
agctgcctgtgagcat

SEQ ID NO: 359691 - DNA, 16 bp, M. musculus
agctgccttcctccaa

SEQ ID NO: 359692 - DNA, 16 bp, M. musculus
agctgctctgtgggtg

SEQ ID NO: 359693 - DNA, 16 bp, M. musculus
agctgctcttccagag

SEQ ID NO: 359694 - DNA, 16 bp, M. musculus
agctgctcttccaggg

SEQ ID NO: 359695 - DNA, 16 bp, M. musculus
agctgctgaagagcct

SEQ ID NO: 359696 - DNA, 16 bp, M. musculus
agctgctgacacctgt

SEQ ID NO: 359697 - DNA, 16 bp, M. musculus
agctgctgagccctgt

SEQ ID NO: 359698 - DNA, 16 bp, M. musculus
agctgctgagctgtct

SEQ ID NO: 359699 - DNA, 16 bp, M. musculus
agctgctgcagacagt

SEQ ID NO: 359700 - DNA, 16 bp, M. musculus
agctgctgccaccacc

SEQ ID NO: 359701 - DNA, 16 bp, M. musculus
agctgctgcccagcca

SEQ ID NO: 359702 - DNA, 16 bp, M. musculus
agctgctgctgagggc

SEQ ID NO: 359703 - DNA, 17 bp, M. musculus
agctgctgctgctgcta

SEQ ID NO: 359704 - DNA, 16 bp, M. musculus
agctgctgcttctcct

SEQ ID NO: 359705 - DNA, 16 bp, M. musculus
agctgctggctgctgc

SEQ ID NO: 359706 - DNA, 16 bp, M. musculus
agctgctggggaagag

SEQ ID NO: 359707 - DNA, 16 bp, M. musculus
agctgctgtgtaggtg

SEQ ID NO: 359708 - DNA, 16 bp, M. musculus
agctgctgtgtggatg

SEQ ID NO: 359709 - DNA, 16 bp, M. musculus
agctgctgttgctgct

SEQ ID NO: 359710 - DNA, 16 bp, M. musculus
agctgcttggaagtca

SEQ ID NO: 359711 - DNA, 16 bp, M. musculus
agctgcttttgatcat

SEQ ID NO: 359712 - DNA, 16 bp, M. musculus
agctgcttttggtcac

SEQ ID NO: 359713 - DNA, 16 bp, M. musculus
agctggaaaacaattt

SEQ ID NO: 359714 - DNA, 16 bp, M. musculus
agctggaaacagccca

SEQ ID NO: 359715 - DNA, 16 bp, M. musculus
agctggaacctggagg

SEQ ID NO: 359716 - DNA, 16 bp, M. musculus
agctggaagaagctga

SEQ ID NO: 359717 - DNA, 16 bp, M. musculus
agctggaagcaatcct

SEQ ID NO: 359718 - DNA, 16 bp, M. musculus
agctggaagctgagag

SEQ ID NO: 359719 - DNA, 16 bp, M. musculus
agctggacaaactcca

SEQ ID NO: 359720 - DNA, 16 bp, M. musculus
agctggacgtggtggc

SEQ ID NO: 359721 - DNA, 16 bp, M. musculus
agctggactccagaaa

SEQ ID NO: 359722 - DNA, 16 bp, M. musculus
agctggactctgagga

SEQ ID NO: 359723 - DNA, 16 bp, M. musculus
agctggactggggcat

SEQ ID NO: 359724 - DNA, 16 bp, M. musculus
agctggactttgagga

SEQ ID NO: 359725 - DNA, 16 bp, M. musculus
agctggagaagttctc

SEQ ID NO: 359726 - DNA, 16 bp, M. musculus
agctggagacacttaa

SEQ ID NO: 359727 - DNA, 16 bp, M. musculus
agctggagacaggaag

SEQ ID NO: 359728 - DNA, 16 bp, M. musculus
agctggagacatgagc

SEQ ID NO: 359729 - DNA, 16 bp, M. musculus
agctggagacatgagt

SEQ ID NO: 359730 - DNA, 16 bp, M. musculus
agctggagacctggga

SEQ ID NO: 359731 - DNA, 16 bp, M. musculus
agctggagagaaggct

SEQ ID NO: 359732 - DNA, 16 bp, M. musculus
agctggagaggcagct

SEQ ID NO: 359733 - DNA, 16 bp, M. musculus
agctggagaggtggct

SEQ ID NO: 359734 - DNA, 16 bp, M. musculus
agctggagcaatgggt

SEQ ID NO: 359735 - DNA, 16 bp, M. musculus
agctggagcacagaca

SEQ ID NO: 359736 - DNA, 16 bp, M. musculus
agctggagcaggggct

SEQ ID NO: 359737 - DNA, 16 bp, M. musculus
agctggagcagtagct

SEQ ID NO: 359738 - DNA, 17 bp, M. musculus
agctggagccacgagtc

SEQ ID NO: 359739 - DNA, 16 bp, M. musculus
agctggagcctagaag

SEQ ID NO: 359740 - DNA, 16 bp, M. musculus
agctggagctaagaaa

SEQ ID NO: 359741 - DNA, 16 bp, M. musculus
agctggagctaagaca

SEQ ID NO: 359742 - DNA, 16 bp, M. musculus
agctggagctacacag

SEQ ID NO: 359743 - DNA, 16 bp, M. musculus
agctggagctgaagaa

SEQ ID NO: 359744 - DNA, 16 bp, M. musculus
agctggagctgagaaa

SEQ ID NO: 359745 - DNA, 16 bp, M. musculus
agctggagctgagagt

SEQ ID NO: 359746 - DNA, 16 bp, M. musculus
agctggaggaagtacc

SEQ ID NO: 359747 - DNA, 16 bp, M. musculus
agctggaggaagtagg

SEQ ID NO: 359748 - DNA, 16 bp, M. musculus
agctggaggatatcat

SEQ ID NO: 359749 - DNA, 16 bp, M. musculus
agctggaggcagctgg

SEQ ID NO: 359750 - DNA, 16 bp, M. musculus
agctggaggcctggga

SEQ ID NO: 359751 - DNA, 16 bp, M. musculus
agctggaggggtctgc

SEQ ID NO: 359752 - DNA, 16 bp, M. musculus
agctggagttacagat

SEQ ID NO: 359753 - DNA, 16 bp, M. musculus
agctggatataaaatt

SEQ ID NO: 359754 - DNA, 16 bp, M. musculus
agctggatctcatgga

SEQ ID NO: 359755 - DNA, 17 bp, M. musculus
agctggatctcatggag

SEQ ID NO: 359756 - DNA, 16 bp, M. musculus
agctggatcttataga

SEQ ID NO: 359757 - DNA, 16 bp, M. musculus
agctggcaaagattct

SEQ ID NO: 359758 - DNA, 16 bp, M. musculus
agctggcagctggcag

SEQ ID NO: 359759 - DNA, 16 bp, M. musculus
agctggccccagggtc

SEQ ID NO: 359760 - DNA, 16 bp, M. musculus
agctggccctgaggat

SEQ ID NO: 359761 - DNA, 16 bp, M. musculus
agctggccctgatggc

SEQ ID NO: 359762 - DNA, 16 bp, M. musculus
agctggccctgcacct

SEQ ID NO: 359763 - DNA, 16 bp, M. musculus
agctggccctgccact

SEQ ID NO: 359764 - DNA, 16 bp, M. musculus
agctggccctgcccct

SEQ ID NO: 359765 - DNA, 16 bp, M. musculus
agctggccctgctcct

SEQ ID NO: 359766 - DNA, 16 bp, M. musculus
agctggccctggatgt

SEQ ID NO: 359767 - DNA, 16 bp, M. musculus
agctggccctggggtc

SEQ ID NO: 359768 - DNA, 16 bp, M. musculus
agctggcctagaactc

SEQ ID NO: 359769 - DNA, 19 bp, M. musculus
agctggcctcaaactcaca

SEQ ID NO: 359770 - DNA, 16 bp, M. musculus
agctggcctggaactt

SEQ ID NO: 359771 - DNA, 16 bp, M. musculus
agctggcctggaattt

SEQ ID NO: 359772 - DNA, 16 bp, M. musculus
agctggcctggagctt

SEQ ID NO: 359773 - DNA, 16 bp, M. musculus
agctggcctgtgagct

SEQ ID NO: 359774 - DNA, 17 bp, M. musculus
agctggccttaaactca

SEQ ID NO: 359775 - DNA, 16 bp, M. musculus
agctggccttgaattt

SEQ ID NO: 359776 - DNA, 16 bp, M. musculus
agctggccttgcccct

SEQ ID NO: 359777 - DNA, 16 bp, M. musculus
agctggctctgcccct

SEQ ID NO: 359778 - DNA, 16 bp, M. musculus
agctggctctggtggc

SEQ ID NO: 359779 - DNA, 16 bp, M. musculus
agctggctgtggtggc

SEQ ID NO: 359780 - DNA, 18 bp, M. musculus
agctggcttcaaactcac

SEQ ID NO: 359781 - DNA, 16 bp, M. musculus
agctgggactgaagaa

SEQ ID NO: 359782 - DNA, 16 bp, M. musculus
agctgggaggagctgg

SEQ ID NO: 359783 - DNA, 16 bp, M. musculus
agctgggaggggctgg

SEQ ID NO: 359784 - DNA, 16 bp, M. musculus
agctgggagtggtggt

SEQ ID NO: 359785 - DNA, 16 bp, M. musculus
agctgggattaaagat

SEQ ID NO: 359786 - DNA, 16 bp, M. musculus
agctgggattataggt

SEQ ID NO: 359787 - DNA, 16 bp, M. musculus
agctgggcaaggtggt

SEQ ID NO: 359788 - DNA, 16 bp, M. musculus
agctgggcagaaaaga

SEQ ID NO: 359789 - DNA, 16 bp, M. musculus
agctgggcagaggtgg

SEQ ID NO: 359790 - DNA, 16 bp, M. musculus
agctgggcagatatct

SEQ ID NO: 359791 - DNA, 16 bp, M. musculus
agctgggcagctgcct

SEQ ID NO: 359792 - DNA, 16 bp, M. musculus
agctgggcatgatggc

SEQ ID NO: 359793 - DNA, 16 bp, M. musculus
agctgggcatggaggc

SEQ ID NO: 359794 - DNA, 16 bp, M. musculus
agctgggcatggtagt

SEQ ID NO: 359795 - DNA, 16 bp, M. musculus
agctgggcatggtggc

SEQ ID NO: 359796 - DNA, 16 bp, M. musculus
agctgggcctggtggc

SEQ ID NO: 359797 - DNA, 16 bp, M. musculus
agctgggctccaagaa

SEQ ID NO: 359798 - DNA, 16 bp, M. musculus
agctgggctggagaga

SEQ ID NO: 359799 - DNA, 16 bp, M. musculus
agctgggcttggtggc

SEQ ID NO: 359800 - DNA, 16 bp, M. musculus
agctggggaaactgag

SEQ ID NO: 359801 - DNA, 16 bp, M. musculus
agctggggaggaaagg

SEQ ID NO: 359802 - DNA, 16 bp, M. musculus
agctggggatatagct

SEQ ID NO: 359803 - DNA, 16 bp, M. musculus
agctggggctacagag

SEQ ID NO: 359804 - DNA, 17 bp, M. musculus
agctggggctgaagaat

SEQ ID NO: 359805 - DNA, 16 bp, M. musculus
agctggggctgtctct

SEQ ID NO: 359806 - DNA, 16 bp, M. musculus
agctgggtcctgaggt

SEQ ID NO: 359807 - DNA, 16 bp, M. musculus
agctgggtgagatctt

SEQ ID NO: 359808 - DNA, 16 bp, M. musculus
agctgggtgatggtgg

SEQ ID NO: 359809 - DNA, 16 bp, M. musculus
agctgggtgcagtggt

SEQ ID NO: 359810 - DNA, 16 bp, M. musculus
agctgggtgctggtgg

SEQ ID NO: 359811 - DNA, 16 bp, M. musculus
agctgggtggagacat

SEQ ID NO: 359812 - DNA, 17 bp, M. musculus
agctgggtggagagatt

SEQ ID NO: 359813 - DNA, 16 bp, M. musculus
agctgggtgggcacct

SEQ ID NO: 359814 - DNA, 16 bp, M. musculus
agctgggtggtggtag

SEQ ID NO: 359815 - DNA, 16 bp, M. musculus
agctgggtgtagtggc

SEQ ID NO: 359816 - DNA, 16 bp, M. musculus
agctgggtgtggtgac

SEQ ID NO: 359817 - DNA, 16 bp, M. musculus
agctgggttccagaga

SEQ ID NO: 359818 - DNA, 16 bp, M. musculus
agctggtctggtctca

SEQ ID NO: 359819 - DNA, 16 bp, M. musculus
agctggtcttctgtag

SEQ ID NO: 359820 - DNA, 16 bp, M. musculus
agctggtgagatggct

SEQ ID NO: 359821 - DNA, 16 bp, M. musculus
agctggtggtcctgga

SEQ ID NO: 359822 - DNA, 16 bp, M. musculus
agctggtggtcctggg

SEQ ID NO: 359823 - DNA, 16 bp, M. musculus
agctggttctctgaga

SEQ ID NO: 359824 - DNA, 16 bp, M. musculus
agctgtaaagaaaaat

SEQ ID NO: 359825 - DNA, 16 bp, M. musculus
agctgtaattcaccat

SEQ ID NO: 359826 - DNA, 16 bp, M. musculus
agctgtacagatgttt

SEQ ID NO: 359827 - DNA, 16 bp, M. musculus
agctgtagagatggct

SEQ ID NO: 359828 - DNA, 17 bp, M. musculus
agctgtatcaggctcct

SEQ ID NO: 359829 - DNA, 16 bp, M. musculus
agctgtattagtcagg

SEQ ID NO: 359830 - DNA, 16 bp, M. musculus
agctgtcatatgggtg

SEQ ID NO: 359831 - DNA, 16 bp, M. musculus
agctgtcatccatgct

SEQ ID NO: 359832 - DNA, 16 bp, M. musculus
agctgtcatgtgggtg

SEQ ID NO: 359833 - DNA, 16 bp, M. musculus
agctgtcatgtgtgtg

SEQ ID NO: 359834 - DNA, 16 bp, M. musculus
agctgtccacagtggc

SEQ ID NO: 359835 - DNA, 16 bp, M. musculus
agctgtccactctctc

SEQ ID NO: 359836 - DNA, 16 bp, M. musculus
agctgtccagaagagg

SEQ ID NO: 359837 - DNA, 16 bp, M. musculus
agctgtccagcagcca

SEQ ID NO: 359838 - DNA, 16 bp, M. musculus
agctgtccctccagcc

SEQ ID NO: 359839 - DNA, 16 bp, M. musculus
agctgtccctcccaga

SEQ ID NO: 359840 - DNA, 16 bp, M. musculus
agctgtccctgcctct

SEQ ID NO: 359841 - DNA, 17 bp, M. musculus
agctgtcctagaactca

SEQ ID NO: 359842 - DNA, 16 bp, M. musculus
agctgtcctcaaactc

SEQ ID NO: 359843 - DNA, 16 bp, M. musculus
agctgtcctggaactc

SEQ ID NO: 359844 - DNA, 16 bp, M. musculus
agctgtcctggaactt

SEQ ID NO: 359845 - DNA, 16 bp, M. musculus
agctgtctccccagcc

SEQ ID NO: 359846 - DNA, 16 bp, M. musculus
agctgtctcctgagtg

SEQ ID NO: 359847 - DNA, 16 bp, M. musculus
agctgtctctagtgag

SEQ ID NO: 359848 - DNA, 16 bp, M. musculus
agctgtctctccagcc

SEQ ID NO: 359849 - DNA, 16 bp, M. musculus
agctgtctctccatcc

SEQ ID NO: 359850 - DNA, 16 bp, M. musculus
agctgtctctctagcc

SEQ ID NO: 359851 - DNA, 16 bp, M. musculus
agctgtctctgggatc

SEQ ID NO: 359852 - DNA, 16 bp, M. musculus
agctgtctcttcttcc

SEQ ID NO: 359853 - DNA, 16 bp, M. musculus
agctgtctgggaacac

SEQ ID NO: 359854 - DNA, 16 bp, M. musculus
agctgtctgtaactct

SEQ ID NO: 359855 - DNA, 16 bp, M. musculus
agctgtcttcaaacac

SEQ ID NO: 359856 - DNA, 16 bp, M. musculus
agctgtcttcaaactc

SEQ ID NO: 359857 - DNA, 18 bp, M. musculus
agctgtcttcagacactt

SEQ ID NO: 359858 - DNA, 16 bp, M. musculus
agctgtcttcagacag

SEQ ID NO: 359859 - DNA, 16 bp, M. musculus
agctgtcttcagactt

SEQ ID NO: 359860 - DNA, 16 bp, M. musculus
agctgtcttcagatgc

SEQ ID NO: 359861 - DNA, 16 bp, M. musculus
agctgtcttcagtcac

SEQ ID NO: 359862 - DNA, 16 bp, M. musculus
agctgtcttccaacac

SEQ ID NO: 359863 - DNA, 16 bp, M. musculus
agctgtcttcccagcc

SEQ ID NO: 359864 - DNA, 16 bp, M. musculus
agctgtcttctgagag

SEQ ID NO: 359865 - DNA, 16 bp, M. musculus
agctgtcttgagcaga

SEQ ID NO: 359866 - DNA, 16 bp, M. musculus
agctgtctttgagtca

SEQ ID NO: 359867 - DNA, 16 bp, M. musculus
agctgtgaagttgaag

SEQ ID NO: 359868 - DNA, 21 bp, M. musculus
agctgtgaatggaagtccaag

SEQ ID NO: 359869 - DNA, 17 bp, M. musculus
agctgtgacaaaagaat

SEQ ID NO: 359870 - DNA, 16 bp, M. musculus
agctgtgactaaagga

SEQ ID NO: 359871 - DNA, 16 bp, M. musculus
agctgtgagtgctgtg

SEQ ID NO: 359872 - DNA, 16 bp, M. musculus
agctgtgcaggttcac

SEQ ID NO: 359873 - DNA, 16 bp, M. musculus
agctgtgctctgcagc

SEQ ID NO: 359874 - DNA, 16 bp, M. musculus
agctgtgctgctttgg

SEQ ID NO: 359875 - DNA, 16 bp, M. musculus
agctgtggaactctgt

SEQ ID NO: 359876 - DNA, 16 bp, M. musculus
agctgtggacattttt

SEQ ID NO: 359877 - DNA, 16 bp, M. musculus
agctgtggagcccagt

SEQ ID NO: 359878 - DNA, 16 bp, M. musculus
agctgtgggtctctgc

SEQ ID NO: 359879 - DNA, 16 bp, M. musculus
agctgtggtgtgtgtg

SEQ ID NO: 359880 - DNA, 16 bp, M. musculus
agctgtggttgctggg

SEQ ID NO: 359881 - DNA, 16 bp, M. musculus
agctgtgtagtatttc

SEQ ID NO: 359882 - DNA, 16 bp, M. musculus
agctgtgtcacctcct

SEQ ID NO: 359883 - DNA, 16 bp, M. musculus
agctgtgtgactttgg

SEQ ID NO: 359884 - DNA, 16 bp, M. musculus
agctgtgtggttcctg

SEQ ID NO: 359885 - DNA, 16 bp, M. musculus
agctgtgtgtccttgg

SEQ ID NO: 359886 - DNA, 16 bp, M. musculus
agctgtgttacttctg

SEQ ID NO: 359887 - DNA, 16 bp, M. musculus
agctgtgttccaaaga

SEQ ID NO: 359888 - DNA, 16 bp, M. musculus
agctgttaaaaaaatg

SEQ ID NO: 359889 - DNA, 16 bp, M. musculus
agctgttaagaaaaat

SEQ ID NO: 359890 - DNA, 16 bp, M. musculus
agctgttaagagaact

SEQ ID NO: 359891 - DNA, 18 bp, M. musculus
agctgttaaggaagggca

SEQ ID NO: 359892 - DNA, 16 bp, M. musculus
agctgttagcttctga

SEQ ID NO: 359893 - DNA, 17 bp, M. musculus
agctgttctatcagagg

SEQ ID NO: 359894 - DNA, 16 bp, M. musculus
agctgttctcagagaa

SEQ ID NO: 359895 - DNA, 16 bp, M. musculus
agctgttctcccagga

SEQ ID NO: 359896 - DNA, 16 bp, M. musculus
agctgttctgactggt

SEQ ID NO: 359897 - DNA, 16 bp, M. musculus
agctgttctggaactc

SEQ ID NO: 359898 - DNA, 16 bp, M. musculus
agctgttgggagccgc

SEQ ID NO: 359899 - DNA, 16 bp, M. musculus
agctgttgtcaatgat

SEQ ID NO: 359900 - DNA, 16 bp, M. musculus
agctgttgtgtgggtg

SEQ ID NO: 359901 - DNA, 16 bp, M. musculus
agctgtttgcctgtgt

SEQ ID NO: 359902 - DNA, 16 bp, M. musculus
agctgtttgcttctgt

SEQ ID NO: 359903 - DNA, 16 bp, M. musculus
agcttaaaaagaagga

SEQ ID NO: 359904 - DNA, 16 bp, M. musculus
agcttaagaaggaaga

SEQ ID NO: 359905 - DNA, 16 bp, M. musculus
agcttaataaattgta

SEQ ID NO: 359906 - DNA, 16 bp, M. musculus
agcttacaactctcag

SEQ ID NO: 359907 - DNA, 16 bp, M. musculus
agcttacacttccaca

SEQ ID NO: 359908 - DNA, 16 bp, M. musculus
agcttacacttccatg

SEQ ID NO: 359909 - DNA, 16 bp, M. musculus
agcttacacttttcac

SEQ ID NO: 359910 - DNA, 16 bp, M. musculus
agcttacagtttcaga

SEQ ID NO: 359911 - DNA, 16 bp, M. musculus
agcttagagagtaaga

SEQ ID NO: 359912 - DNA, 16 bp, M. musculus
agcttagtctctggga

SEQ ID NO: 359913 - DNA, 16 bp, M. musculus
agcttatttttaaaat

SEQ ID NO: 359914 - DNA, 16 bp, M. musculus
agcttcactgtgtccc

SEQ ID NO: 359915 - DNA, 16 bp, M. musculus
agcttcacttgaggaa

SEQ ID NO: 359916 - DNA, 16 bp, M. musculus
agcttcagcacagtag

SEQ ID NO: 359917 - DNA, 16 bp, M. musculus
agcttcaggaagctct

SEQ ID NO: 359918 - DNA, 16 bp, M. musculus
agcttcaggggatcca

SEQ ID NO: 359919 - DNA, 16 bp, M. musculus
agcttcagtccattgg

SEQ ID NO: 359920 - DNA, 16 bp, M. musculus
agcttcagttcctgcc

SEQ ID NO: 359921 - DNA, 16 bp, M. musculus
agcttcagttgtcaac

SEQ ID NO: 359922 - DNA, 16 bp, M. musculus
agcttcatgaggtctg

SEQ ID NO: 359923 - DNA, 16 bp, M. musculus
agcttccaaaggagag

SEQ ID NO: 359924 - DNA, 16 bp, M. musculus
agcttccagcctccat

SEQ ID NO: 359925 - DNA, 16 bp, M. musculus
agcttccagcctctgt

SEQ ID NO: 359926 - DNA, 16 bp, M. musculus
agcttcccaaatgctg

SEQ ID NO: 359927 - DNA, 16 bp, M. musculus
agcttcccccacccca

SEQ ID NO: 359928 - DNA, 16 bp, M. musculus
agcttcccttcctggg

SEQ ID NO: 359929 - DNA, 16 bp, M. musculus
agcttcctccctgctg

SEQ ID NO: 359930 - DNA, 16 bp, M. musculus
agcttcctcctcctcc

SEQ ID NO: 359931 - DNA, 16 bp, M. musculus
agcttcctctgagtgt

SEQ ID NO: 359932 - DNA, 16 bp, M. musculus
agcttcctggaagaca

SEQ ID NO: 359933 - DNA, 16 bp, M. musculus
agcttcctggaggagg

SEQ ID NO: 359934 - DNA, 16 bp, M. musculus
agcttctagaagcttc

SEQ ID NO: 359935 - DNA, 16 bp, M. musculus
agcttctatcagcctt

SEQ ID NO: 359936 - DNA, 16 bp, M. musculus
agcttctatgtgtgct

SEQ ID NO: 359937 - DNA, 16 bp, M. musculus
agcttctccctcctcc

SEQ ID NO: 359938 - DNA, 16 bp, M. musculus
agcttctctgaggagg

SEQ ID NO: 359939 - DNA, 16 bp, M. musculus
agcttctgaaaggcaa

SEQ ID NO: 359940 - DNA, 16 bp, M. musculus
agcttctgacttgtga

SEQ ID NO: 359941 - DNA, 16 bp, M. musculus
agcttctgagaaagat

SEQ ID NO: 359942 - DNA, 16 bp, M. musculus
agcttctgagacaggg

SEQ ID NO: 359943 - DNA, 16 bp, M. musculus
agcttctgaggcagat

SEQ ID NO: 359944 - DNA, 16 bp, M. musculus
agcttctggaagaggc

SEQ ID NO: 359945 - DNA, 16 bp, M. musculus
agcttctggctaccac

SEQ ID NO: 359946 - DNA, 16 bp, M. musculus
agcttctggctgtcac

SEQ ID NO: 359947 - DNA, 16 bp, M. musculus
agcttctgggacaggc

SEQ ID NO: 359948 - DNA, 16 bp, M. musculus
agcttctggggtaata

SEQ ID NO: 359949 - DNA, 16 bp, M. musculus
agcttctgtaaggaaa

SEQ ID NO: 359950 - DNA, 16 bp, M. musculus
agcttctgtaaggcag

SEQ ID NO: 359951 - DNA, 16 bp, M. musculus
agcttctgtattccgc

SEQ ID NO: 359952 - DNA, 16 bp, M. musculus
agcttctgtcttagtt

SEQ ID NO: 359953 - DNA, 16 bp, M. musculus
agcttctgtggcagac

SEQ ID NO: 359954 - DNA, 16 bp, M. musculus
agcttctgtgtgtgtg

SEQ ID NO: 359955 - DNA, 17 bp, M. musculus
agcttcttaaaaccatc

SEQ ID NO: 359956 - DNA, 16 bp, M. musculus
agcttcttaccttctg

SEQ ID NO: 359957 - DNA, 16 bp, M. musculus
agcttcttcattgggg

SEQ ID NO: 359958 - DNA, 16 bp, M. musculus
agcttcttccagtctt

SEQ ID NO: 359959 - DNA, 16 bp, M. musculus
agcttcttgctttcct

SEQ ID NO: 359960 - DNA, 16 bp, M. musculus
agcttctttaatgaat

SEQ ID NO: 359961 - DNA, 16 bp, M. musculus
agcttctttatgctct

SEQ ID NO: 359962 - DNA, 16 bp, M. musculus
agcttctttcagactt

SEQ ID NO: 359963 - DNA, 16 bp, M. musculus
agcttctttcagcatt

SEQ ID NO: 359964 - DNA, 16 bp, M. musculus
agcttcttttgcagtg

SEQ ID NO: 359965 - DNA, 16 bp, M. musculus
agcttcttttggaaag

SEQ ID NO: 359966 - DNA, 16 bp, M. musculus
agcttgagcataggac

SEQ ID NO: 359967 - DNA, 16 bp, M. musculus
agcttgaggccagctt

SEQ ID NO: 359968 - DNA, 16 bp, M. musculus
agcttgagtcaagagc

SEQ ID NO: 359969 - DNA, 16 bp, M. musculus
agcttgagtttgatcc

SEQ ID NO: 359970 - DNA, 16 bp, M. musculus
agcttgatcctcctgt

SEQ ID NO: 359971 - DNA, 16 bp, M. musculus
agcttgatttctccat

SEQ ID NO: 359972 - DNA, 16 bp, M. musculus
agcttgcaagaccaag

SEQ ID NO: 359973 - DNA, 17 bp, M. musculus
agcttgcaatcccacca

SEQ ID NO: 359974 - DNA, 17 bp, M. musculus
agcttgcaatcctacca

SEQ ID NO: 359975 - DNA, 17 bp, M. musculus
agcttgcaatctcacca

SEQ ID NO: 359976 - DNA, 16 bp, M. musculus
agcttgcagtcccacc

SEQ ID NO: 359977 - DNA, 16 bp, M. musculus
agcttgccaccaagcc

SEQ ID NO: 359978 - DNA, 16 bp, M. musculus
agcttgcctgcaaaga

SEQ ID NO: 359979 - DNA, 16 bp, M. musculus
agcttgcctgcctgcc

SEQ ID NO: 359980 - DNA, 16 bp, M. musculus
agcttgctccagggat

SEQ ID NO: 359981 - DNA, 16 bp, M. musculus
agcttgctctttgttt

SEQ ID NO: 359982 - DNA, 16 bp, M. musculus
agcttgcttgcagaga

SEQ ID NO: 359983 - DNA, 16 bp, M. musculus
agcttgcttgcttgct

SEQ ID NO: 359984 - DNA, 16 bp, M. musculus
agcttggaagataaga

SEQ ID NO: 359985 - DNA, 16 bp, M. musculus
agcttggcagcaaaca

SEQ ID NO: 359986 - DNA, 16 bp, M. musculus
agcttggctgtcctgg

SEQ ID NO: 359987 - DNA, 16 bp, M. musculus
agcttgggacattgtc

SEQ ID NO: 359988 - DNA, 16 bp, M. musculus
agcttggtctatgtag

SEQ ID NO: 359989 - DNA, 16 bp, M. musculus
agcttggtctttatgt

SEQ ID NO: 359990 - DNA, 16 bp, M. musculus
agcttggtgtgtgtgt

SEQ ID NO: 359991 - DNA, 16 bp, M. musculus
agcttgtataaccact

SEQ ID NO: 359992 - DNA, 16 bp, M. musculus
agcttgtctgctcccc

SEQ ID NO: 359993 - DNA, 16 bp, M. musculus
agcttgtttcttggga

SEQ ID NO: 359994 - DNA, 16 bp, M. musculus
agctttaaaattttta

SEQ ID NO: 359995 - DNA, 16 bp, M. musculus
agctttaataatgttt

SEQ ID NO: 359996 - DNA, 16 bp, M. musculus
agctttaatgctgttc

SEQ ID NO: 359997 - DNA, 16 bp, M. musculus
agctttacaatttgca

SEQ ID NO: 359998 - DNA, 16 bp, M. musculus
agctttacagagaaac

SEQ ID NO: 359999 - DNA, 16 bp, M. musculus
agctttaccacagagc

SEQ ID NO: 360000 - DNA, 16 bp, M. musculus
agctttactcccagga

SEQ ID NO: 360001 - DNA, 16 bp, M. musculus
agctttagttttcaaa

SEQ ID NO: 360002 - DNA, 16 bp, M. musculus
agctttattgcagaaa

SEQ ID NO: 360003 - DNA, 16 bp, M. musculus
agctttattgcttact

SEQ ID NO: 360004 - DNA, 16 bp, M. musculus
agctttattttttgta

SEQ ID NO: 360005 - DNA, 16 bp, M. musculus
agctttcacagtgctg

SEQ ID NO: 360006 - DNA, 16 bp, M. musculus
agctttccatcactgt

SEQ ID NO: 360007 - DNA, 16 bp, M. musculus
agctttcctgctctca

SEQ ID NO: 360008 - DNA, 16 bp, M. musculus
agctttctctctctct

SEQ ID NO: 360009 - DNA, 16 bp, M. musculus
agctttctgttttcaa

SEQ ID NO: 360010 - DNA, 16 bp, M. musculus
agctttctgttttctg

SEQ ID NO: 360011 - DNA, 16 bp, M. musculus
agctttcttcttaaaa

SEQ ID NO: 360012 - DNA, 16 bp, M. musculus
agctttgctggaggaa

SEQ ID NO: 360013 - DNA, 16 bp, M. musculus
agctttgtacaagaaa

SEQ ID NO: 360014 - DNA, 16 bp, M. musculus
agctttgtacaatgag

SEQ ID NO: 360015 - DNA, 16 bp, M. musculus
agctttgtcttgtccc

SEQ ID NO: 360016 - DNA, 16 bp, M. musculus
agctttgtgccaccac

SEQ ID NO: 360017 - DNA, 16 bp, M. musculus
agctttgtgtcctcct

SEQ ID NO: 360018 - DNA, 16 bp, M. musculus
agctttgttatagaaa

SEQ ID NO: 360019 - DNA, 16 bp, M. musculus
agctttgttccctcag

SEQ ID NO: 360020 - DNA, 16 bp, M. musculus
agctttgttgctttgg

SEQ ID NO: 360021 - DNA, 16 bp, M. musculus
agctttgtttgtttgt

SEQ ID NO: 360022 - DNA, 16 bp, M. musculus
agcttttaatattctt

SEQ ID NO: 360023 - DNA, 23 bp, M. musculus
agcttttacagcctcaggtgcca

SEQ ID NO: 360024 - DNA, 16 bp, M. musculus
agcttttcttctttct

SEQ ID NO: 360025 - DNA, 18 bp, M. musculus
agcttttgtccccaccgg

SEQ ID NO: 360026 - DNA, 16 bp, M. musculus
agctttttccacttgt

SEQ ID NO: 360027 - DNA, 16 bp, M. musculus
agctttttggttttgt

SEQ ID NO: 360028 - DNA, 16 bp, M. musculus
agctttttgtatatat

SEQ ID NO: 360029 - DNA, 16 bp, M. musculus
agcttttttagttctg

SEQ ID NO: 360030 - DNA, 16 bp, M. musculus
agctttttttccccct

SEQ ID NO: 360031 - DNA, 16 bp, M. musculus
aggaaaaaaaatgact

SEQ ID NO: 360032 - DNA, 16 bp, M. musculus
aggaaaaaaaatgtca

SEQ ID NO: 360033 - DNA, 16 bp, M. musculus
aggaaaaaaatcctga

SEQ ID NO: 360034 - DNA, 16 bp, M. musculus
aggaaaaaaatctctt

SEQ ID NO: 360035 - DNA, 16 bp, M. musculus
aggaaaaaaatctgga

SEQ ID NO: 360036 - DNA, 16 bp, M. musculus
aggaaaaaaatggttt

SEQ ID NO: 360037 - DNA, 16 bp, M. musculus
aggaaaaaaatgtatt

SEQ ID NO: 360038 - DNA, 16 bp, M. musculus
aggaaaaagaagcagt

SEQ ID NO: 360039 - DNA, 16 bp, M. musculus
aggaaaaagaatgccc

SEQ ID NO: 360040 - DNA, 16 bp, M. musculus
aggaaaaagaggctac

SEQ ID NO: 360041 - DNA, 16 bp, M. musculus
aggaaaaagatcagga

SEQ ID NO: 360042 - DNA, 16 bp, M. musculus
aggaaaaagcctcgaa

SEQ ID NO: 360043 - DNA, 16 bp, M. musculus
aggaaaaattgtgggt

SEQ ID NO: 360044 - DNA, 16 bp, M. musculus
aggaaaacaagagcct

SEQ ID NO: 360045 - DNA, 16 bp, M. musculus
aggaaaacaagaggct

SEQ ID NO: 360046 - DNA, 16 bp, M. musculus
aggaaaacactccttc

SEQ ID NO: 360047 - DNA, 16 bp, M. musculus
aggaaaacactggaga

SEQ ID NO: 360048 - DNA, 16 bp, M. musculus
aggaaaacacttccaa

SEQ ID NO: 360049 - DNA, 16 bp, M. musculus
aggaaaacagctagaa

SEQ ID NO: 360050 - DNA, 16 bp, M. musculus
aggaaaacataacaac

SEQ ID NO: 360051 - DNA, 16 bp, M. musculus
aggaaaacatttattt

SEQ ID NO: 360052 - DNA, 16 bp, M. musculus
aggaaaaccatctcag

SEQ ID NO: 360053 - DNA, 16 bp, M. musculus
aggaaaactcagctct

SEQ ID NO: 360054 - DNA, 16 bp, M. musculus
aggaaaagaaaattca

SEQ ID NO: 360055 - DNA, 16 bp, M. musculus
aggaaaagaagatcca

SEQ ID NO: 360056 - DNA, 16 bp, M. musculus
aggaaaagaaggtcca

SEQ ID NO: 360057 - DNA, 16 bp, M. musculus
aggaaaagacatccaa

SEQ ID NO: 360058 - DNA, 16 bp, M. musculus
aggaaaagaggccatg

SEQ ID NO: 360059 - DNA, 16 bp, M. musculus
aggaaaagatttattt

SEQ ID NO: 360060 - DNA, 16 bp, M. musculus
aggaaaagccttgaag

SEQ ID NO: 360061 - DNA, 16 bp, M. musculus
aggaaaaggaaaaact

SEQ ID NO: 360062 - DNA, 16 bp, M. musculus
aggaaaaggcaggcag

SEQ ID NO: 360063 - DNA, 16 bp, M. musculus
aggaaaagggagtgtg

SEQ ID NO: 360064 - DNA, 16 bp, M. musculus
aggaaaaggggatcca

SEQ ID NO: 360065 - DNA, 16 bp, M. musculus
aggaaaaggtttattt

SEQ ID NO: 360066 - DNA, 46 bp, M. musculus
aggaaaagtttaggtcaggtaagaatacctggagagagattagaag

SEQ ID NO: 360067 - DNA, 41 bp, M. musculus
aggaaaagtttaggtcaggtaagaatacctggggagagatt

SEQ ID NO: 360068 - DNA, 16 bp, M. musculus
aggaaaataaaatgtt

SEQ ID NO: 360069 - DNA, 16 bp, M. musculus
aggaaaataatcaaac

SEQ ID NO: 360070 - DNA, 16 bp, M. musculus
aggaaaatacaatgaa

SEQ ID NO: 360071 - DNA, 16 bp, M. musculus
aggaaaatacctaaat

SEQ ID NO: 360072 - DNA, 16 bp, M. musculus
aggaaaatcaactaaa

SEQ ID NO: 360073 - DNA, 16 bp, M. musculus
aggaaaatgaaaatca

SEQ ID NO: 360074 - DNA, 16 bp, M. musculus
aggaaaatgaaggcaa

SEQ ID NO: 360075 - DNA, 16 bp, M. musculus
aggaaaatgaccagta

SEQ ID NO: 360076 - DNA, 16 bp, M. musculus
aggaaaatggaaactc

SEQ ID NO: 360077 - DNA, 16 bp, M. musculus
aggaaaatggactgga

SEQ ID NO: 360078 - DNA, 16 bp, M. musculus
aggaaaatggatttta

SEQ ID NO: 360079 - DNA, 16 bp, M. musculus
aggaaaatgtcaaaat

SEQ ID NO: 360080 - DNA, 16 bp, M. musculus
aggaaaatgttgggtc

SEQ ID NO: 360081 - DNA, 16 bp, M. musculus
aggaaaattccagcca

SEQ ID NO: 360082 - DNA, 16 bp, M. musculus
aggaaaattcctaatt

SEQ ID NO: 360083 - DNA, 16 bp, M. musculus
aggaaacaaaactaag

SEQ ID NO: 360084 - DNA, 16 bp, M. musculus
aggaaacaaagccttc

SEQ ID NO: 360085 - DNA, 16 bp, M. musculus
aggaaacaagctggag

SEQ ID NO: 360086 - DNA, 16 bp, M. musculus
aggaaacaccaggagc

SEQ ID NO: 360087 - DNA, 16 bp, M. musculus
aggaaacagacttaga

SEQ ID NO: 360088 - DNA, 16 bp, M. musculus
aggaaacatggagaaa

SEQ ID NO: 360089 - DNA, 16 bp, M. musculus
aggaaacatggtggca

SEQ ID NO: 360090 - DNA, 16 bp, M. musculus
aggaaaccaacctcag

SEQ ID NO: 360091 - DNA, 16 bp, M. musculus
aggaaacccacctcag

SEQ ID NO: 360092 - DNA, 16 bp, M. musculus
aggaaaccctgtctca

SEQ ID NO: 360093 - DNA, 16 bp, M. musculus
aggaaaccctgtcttg

SEQ ID NO: 360094 - DNA, 16 bp, M. musculus
aggaaacctgaagcaa

SEQ ID NO: 360095 - DNA, 16 bp, M. musculus
aggaaacctgaagtaa

SEQ ID NO: 360096 - DNA, 16 bp, M. musculus
aggaaactagaaaagg

SEQ ID NO: 360097 - DNA, 16 bp, M. musculus
aggaaactctagcagc

SEQ ID NO: 360098 - DNA, 16 bp, M. musculus
aggaaactgaagaaga

SEQ ID NO: 360099 - DNA, 16 bp, M. musculus
aggaaactgaagctca

SEQ ID NO: 360100 - DNA, 16 bp, M. musculus
aggaaactgagacagg

SEQ ID NO: 360101 - DNA, 16 bp, M. musculus
aggaaactgaggctca

SEQ ID NO: 360102 - DNA, 16 bp, M. musculus
aggaaactgctacaca

SEQ ID NO: 360103 - DNA, 16 bp, M. musculus
aggaaactttttacaa

SEQ ID NO: 360104 - DNA, 16 bp, M. musculus
aggaaagaaacctgga

SEQ ID NO: 360105 - DNA, 16 bp, M. musculus
aggaaagaaactgaag

SEQ ID NO: 360106 - DNA, 16 bp, M. musculus
aggaaagaaagctgga

SEQ ID NO: 360107 - DNA, 16 bp, M. musculus
aggaaagaaatcaaga

SEQ ID NO: 360108 - DNA, 16 bp, M. musculus
aggaaagaaatcagga

SEQ ID NO: 360109 - DNA, 16 bp, M. musculus
aggaaagaaatttgag

SEQ ID NO: 360110 - DNA, 16 bp, M. musculus
aggaaagaactgactc

SEQ ID NO: 360111 - DNA, 16 bp, M. musculus
aggaaagacaatccag

SEQ ID NO: 360112 - DNA, 16 bp, M. musculus
aggaaagacagggaca

SEQ ID NO: 360113 - DNA, 17 bp, M. musculus
aggaaagaccatccaga

SEQ ID NO: 360114 - DNA, 16 bp, M. musculus
aggaaagagatgccca

SEQ ID NO: 360115 - DNA, 16 bp, M. musculus
aggaaagagccaactc

SEQ ID NO: 360116 - DNA, 16 bp, M. musculus
aggaaagagtttattt

SEQ ID NO: 360117 - DNA, 16 bp, M. musculus
aggaaagagtttgttt

SEQ ID NO: 360118 - DNA, 16 bp, M. musculus
aggaaagatgcaacaa

SEQ ID NO: 360119 - DNA, 16 bp, M. musculus
aggaaagatttatttt

SEQ ID NO: 360120 - DNA, 16 bp, M. musculus
aggaaagcaaaaggct

SEQ ID NO: 360121 - DNA, 16 bp, M. musculus
aggaaagcagagacag

SEQ ID NO: 360122 - DNA, 16 bp, M. musculus
aggaaagccaaagcta

SEQ ID NO: 360123 - DNA, 16 bp, M. musculus
aggaaagccatctcag

SEQ ID NO: 360124 - DNA, 16 bp, M. musculus
aggaaagctagggcta

SEQ ID NO: 360125 - DNA, 16 bp, M. musculus
aggaaagctcaaagca

SEQ ID NO: 360126 - DNA, 16 bp, M. musculus
aggaaagctgaaagaa

SEQ ID NO: 360127 - DNA, 17 bp, M. musculus
aggaaagctgctaacag

SEQ ID NO: 360128 - DNA, 16 bp, M. musculus
aggaaagctggaagaa

SEQ ID NO: 360129 - DNA, 17 bp, M. musculus
aggaaaggatacagaaa

SEQ ID NO: 360130 - DNA, 16 bp, M. musculus
aggaaaggatgggcca

SEQ ID NO: 360131 - DNA, 16 bp, M. musculus
aggaaaggggatacca

SEQ ID NO: 360132 - DNA, 16 bp, M. musculus
aggaaaggggatatca

SEQ ID NO: 360133 - DNA, 16 bp, M. musculus
aggaaagggtttatct

SEQ ID NO: 360134 - DNA, 16 bp, M. musculus
aggaaagggtttgttt

SEQ ID NO: 360135 - DNA, 16 bp, M. musculus
aggaaaggtgcacaga

SEQ ID NO: 360136 - DNA, 16 bp, M. musculus
aggaaaggttttgttt

SEQ ID NO: 360137 - DNA, 16 bp, M. musculus
aggaaagtaactaata

SEQ ID NO: 360138 - DNA, 16 bp, M. musculus
aggaaagtggatctct

SEQ ID NO: 360139 - DNA, 16 bp, M. musculus
aggaaataaaaacatt

SEQ ID NO: 360140 - DNA, 16 bp, M. musculus
aggaaataaaatatcc

SEQ ID NO: 360141 - DNA, 16 bp, M. musculus
aggaaataataaaact

SEQ ID NO: 360142 - DNA, 16 bp, M. musculus
aggaaatatgaagaca

SEQ ID NO: 360143 - DNA, 16 bp, M. musculus
aggaaatatttatttt

SEQ ID NO: 360144 - DNA, 16 bp, M. musculus
aggaaatatttttaaa

SEQ ID NO: 360145 - DNA, 16 bp, M. musculus
aggaaatcaagaggct

SEQ ID NO: 360146 - DNA, 16 bp, M. musculus
aggaaatcaaggacac

SEQ ID NO: 360147 - DNA, 16 bp, M. musculus
aggaaatcatgagttt

SEQ ID NO: 360148 - DNA, 16 bp, M. musculus
aggaaatgaaaagcag

SEQ ID NO: 360149 - DNA, 16 bp, M. musculus
aggaaatgaaacagaa

SEQ ID NO: 360150 - DNA, 16 bp, M. musculus
aggaaatgcaaaatgc

SEQ ID NO: 360151 - DNA, 16 bp, M. musculus
aggaaatgcatccatg

SEQ ID NO: 360152 - DNA, 16 bp, M. musculus
aggaaatgccaccatg

SEQ ID NO: 360153 - DNA, 16 bp, M. musculus
aggaaatgcctccaca

SEQ ID NO: 360154 - DNA, 16 bp, M. musculus
aggaaatgcctccttg

SEQ ID NO: 360155 - DNA, 16 bp, M. musculus
aggaaatggaaaaaca

SEQ ID NO: 360156 - DNA, 16 bp, M. musculus
aggaaatgtacctcag

SEQ ID NO: 360157 - DNA, 16 bp, M. musculus
aggaaatgtgtcactg

SEQ ID NO: 360158 - DNA, 16 bp, M. musculus
aggaaatgtgtggaat

SEQ ID NO: 360159 - DNA, 16 bp, M. musculus
aggaaattaggaaagg

SEQ ID NO: 360160 - DNA, 16 bp, M. musculus
aggaaattcaaaaagt

SEQ ID NO: 360161 - DNA, 16 bp, M. musculus
aggaaattgaacagag

SEQ ID NO: 360162 - DNA, 16 bp, M. musculus
aggaaattgtctcctg

SEQ ID NO: 360163 - DNA, 16 bp, M. musculus
aggaaatttccctctg

SEQ ID NO: 360164 - DNA, 16 bp, M. musculus
aggaaatttcctgaac

SEQ ID NO: 360165 - DNA, 16 bp, M. musculus
aggaacaaaggcagct

SEQ ID NO: 360166 - DNA, 16 bp, M. musculus
aggaacaataaaacca

SEQ ID NO: 360167 - DNA, 16 bp, M. musculus
aggaacaattctgggt

SEQ ID NO: 360168 - DNA, 16 bp, M. musculus
aggaacacacacatac

SEQ ID NO: 360169 - DNA, 16 bp, M. musculus
aggaacacagagaaac

SEQ ID NO: 360170 - DNA, 16 bp, M. musculus
aggaacacatggagag

SEQ ID NO: 360171 - DNA, 16 bp, M. musculus
aggaacaccaggagaa

SEQ ID NO: 360172 - DNA, 16 bp, M. musculus
aggaacactaaaagca

SEQ ID NO: 360173 - DNA, 17 bp, M. musculus
aggaacactacccaatt

SEQ ID NO: 360174 - DNA, 16 bp, M. musculus
aggaacagaacccagg

SEQ ID NO: 360175 - DNA, 16 bp, M. musculus
aggaacagagagacag

SEQ ID NO: 360176 - DNA, 16 bp, M. musculus
aggaacagaggaaaat

SEQ ID NO: 360177 - DNA, 16 bp, M. musculus
aggaacagatgaatat

SEQ ID NO: 360178 - DNA, 16 bp, M. musculus
aggaacagcagcagtg

SEQ ID NO: 360179 - DNA, 16 bp, M. musculus
aggaacagccacacca

SEQ ID NO: 360180 - DNA, 17 bp, M. musculus
aggaacagccagggaca

SEQ ID NO: 360181 - DNA, 16 bp, M. musculus
aggaacaggaacaaat

SEQ ID NO: 360182 - DNA, 16 bp, M. musculus
aggaacaggaacagga

SEQ ID NO: 360183 - DNA, 16 bp, M. musculus
aggaacaggaagctgg

SEQ ID NO: 360184 - DNA, 16 bp, M. musculus
aggaacaggagcagga

SEQ ID NO: 360185 - DNA, 16 bp, M. musculus
aggaacatggcagcat

SEQ ID NO: 360186 - DNA, 16 bp, M. musculus
aggaacatttctggat

SEQ ID NO: 360187 - DNA, 16 bp, M. musculus
aggaaccagctcctgg

SEQ ID NO: 360188 - DNA, 16 bp, M. musculus
aggaaccaggaggcag

SEQ ID NO: 360189 - DNA, 16 bp, M. musculus
aggaacccagaagatc

SEQ ID NO: 360190 - DNA, 16 bp, M. musculus
aggaaccccagtgctg

SEQ ID NO: 360191 - DNA, 16 bp, M. musculus
aggaacccctcaccca

SEQ ID NO: 360192 - DNA, 16 bp, M. musculus
aggaacctggagggag

SEQ ID NO: 360193 - DNA, 16 bp, M. musculus
aggaacctggaggtgg

SEQ ID NO: 360194 - DNA, 16 bp, M. musculus
aggaacggaagcagag

SEQ ID NO: 360195 - DNA, 16 bp, M. musculus
aggaactacagagaca

SEQ ID NO: 360196 - DNA, 16 bp, M. musculus
aggaactattacctca

SEQ ID NO: 360197 - DNA, 16 bp, M. musculus
aggaactcaacaggaa

SEQ ID NO: 360198 - DNA, 16 bp, M. musculus
aggaactcaagaagtt

SEQ ID NO: 360199 - DNA, 16 bp, M. musculus
aggaactcaagcagga

SEQ ID NO: 360200 - DNA, 16 bp, M. musculus
aggaactcaagcaggg

SEQ ID NO: 360201 - DNA, 16 bp, M. musculus
aggaactcaagtagga

SEQ ID NO: 360202 - DNA, 16 bp, M. musculus
aggaactcactctgta

SEQ ID NO: 360203 - DNA, 16 bp, M. musculus
aggaactccacaggaa

SEQ ID NO: 360204 - DNA, 16 bp, M. musculus
aggaactctgccagac

SEQ ID NO: 360205 - DNA, 16 bp, M. musculus
aggaactctgcctgac

SEQ ID NO: 360206 - DNA, 16 bp, M. musculus
aggaactctgtctcaa

SEQ ID NO: 360207 - DNA, 16 bp, M. musculus
aggaactgaaacagaa

SEQ ID NO: 360208 - DNA, 16 bp, M. musculus
aggaactgaacctggg

SEQ ID NO: 360209 - DNA, 16 bp, M. musculus
aggaactgaagaagat

SEQ ID NO: 360210 - DNA, 16 bp, M. musculus
aggaactgaagcagaa

SEQ ID NO: 360211 - DNA, 16 bp, M. musculus
aggaactgaagcagga

SEQ ID NO: 360212 - DNA, 16 bp, M. musculus
aggaactgaaggagat

SEQ ID NO: 360213 - DNA, 16 bp, M. musculus
aggaactgaggagcag

SEQ ID NO: 360214 - DNA, 16 bp, M. musculus
aggaactgatgcaaag

SEQ ID NO: 360215 - DNA, 16 bp, M. musculus
aggaactgcattaaag

SEQ ID NO: 360216 - DNA, 16 bp, M. musculus
aggaactgccaaaatg

SEQ ID NO: 360217 - DNA, 16 bp, M. musculus
aggaactgctgggctc

SEQ ID NO: 360218 - DNA, 16 bp, M. musculus
aggaactggaaagagt

SEQ ID NO: 360219 - DNA, 16 bp, M. musculus
aggaactggagaaatg

SEQ ID NO: 360220 - DNA, 16 bp, M. musculus
aggaactgtactaaag

SEQ ID NO: 360221 - DNA, 16 bp, M. musculus
aggaactgtataaaag

SEQ ID NO: 360222 - DNA, 16 bp, M. musculus
aggaactgtattaaag

SEQ ID NO: 360223 - DNA, 16 bp, M. musculus
aggaactgtattaagg

SEQ ID NO: 360224 - DNA, 16 bp, M. musculus
aggaactgtattaatg

SEQ ID NO: 360225 - DNA, 16 bp, M. musculus
aggaactgtcagactg

SEQ ID NO: 360226 - DNA, 16 bp, M. musculus
aggaactgtgggagga

SEQ ID NO: 360227 - DNA, 16 bp, M. musculus
aggaactgtgtcactg

SEQ ID NO: 360228 - DNA, 16 bp, M. musculus
aggaactgtgttaaag

SEQ ID NO: 360229 - DNA, 17 bp, M. musculus
aggaacttagaggcttg

SEQ ID NO: 360230 - DNA, 16 bp, M. musculus
aggaacttcacaggaa

SEQ ID NO: 360231 - DNA, 16 bp, M. musculus
aggaacttgaagcaga

SEQ ID NO: 360232 - DNA, 16 bp, M. musculus
aggaacttggggtcaa

SEQ ID NO: 360233 - DNA, 16 bp, M. musculus
aggaagaaaaactgaa

SEQ ID NO: 360234 - DNA, 16 bp, M. musculus
aggaagaaaaatgttt

SEQ ID NO: 360235 - DNA, 16 bp, M. musculus
aggaagaaatacagaa

SEQ ID NO: 360236 - DNA, 16 bp, M. musculus
aggaagaaatcaaaat

SEQ ID NO: 360237 - DNA, 16 bp, M. musculus
aggaagaaatcaggaa

SEQ ID NO: 360238 - DNA, 16 bp, M. musculus
aggaagaacaatatta

SEQ ID NO: 360239 - DNA, 16 bp, M. musculus
aggaagaacacagcaa

SEQ ID NO: 360240 - DNA, 16 bp, M. musculus
aggaagaacagcagtg

SEQ ID NO: 360241 - DNA, 16 bp, M. musculus
aggaagaacctgtaga

SEQ ID NO: 360242 - DNA, 16 bp, M. musculus
aggaagaagaagctgc

SEQ ID NO: 360243 - DNA, 16 bp, M. musculus
aggaagaagcagaagc

SEQ ID NO: 360244 - DNA, 16 bp, M. musculus
aggaagaagcagccca

SEQ ID NO: 360245 - DNA, 16 bp, M. musculus
aggaagaagccaaaat

SEQ ID NO: 360246 - DNA, 16 bp, M. musculus
aggaagaagccaccat

SEQ ID NO: 360247 - DNA, 16 bp, M. musculus
aggaagaaggaaggtt

SEQ ID NO: 360248 - DNA, 16 bp, M. musculus
aggaagaagtcaaaaa

SEQ ID NO: 360249 - DNA, 16 bp, M. musculus
aggaagaagttaaaat

SEQ ID NO: 360250 - DNA, 16 bp, M. musculus
aggaagaattctggat

SEQ ID NO: 360251 - DNA, 16 bp, M. musculus
aggaagacactcagtg

SEQ ID NO: 360252 - DNA, 16 bp, M. musculus
aggaagacaggagtgg

SEQ ID NO: 360253 - DNA, 16 bp, M. musculus
aggaagacaggatatc

SEQ ID NO: 360254 - DNA, 16 bp, M. musculus
aggaagacatgcacca

SEQ ID NO: 360255 - DNA, 16 bp, M. musculus
aggaagaccaacaatg

SEQ ID NO: 360256 - DNA, 16 bp, M. musculus
aggaagaccagcagag

SEQ ID NO: 360257 - DNA, 16 bp, M. musculus
aggaagaccagcagtt

SEQ ID NO: 360258 - DNA, 16 bp, M. musculus
aggaagaccctgaacc

SEQ ID NO: 360259 - DNA, 16 bp, M. musculus
aggaagactgccatga

SEQ ID NO: 360260 - DNA, 16 bp, M. musculus
aggaagagaagccagg

SEQ ID NO: 360261 - DNA, 16 bp, M. musculus
aggaagagacaggcag

SEQ ID NO: 360262 - DNA, 16 bp, M. musculus
aggaagagactgtctt

SEQ ID NO: 360263 - DNA, 16 bp, M. musculus
aggaagagagagccac

SEQ ID NO: 360264 - DNA, 16 bp, M. musculus
aggaagagatggagac

SEQ ID NO: 360265 - DNA, 16 bp, M. musculus
aggaagagcaaaatgt

SEQ ID NO: 360266 - DNA, 16 bp, M. musculus
aggaagagcacaccaa

SEQ ID NO: 360267 - DNA, 16 bp, M. musculus
aggaagagcagtcagt

SEQ ID NO: 360268 - DNA, 28 bp, M. musculus
aggaagagcagtcgggtgctcttaccca

SEQ ID NO: 360269 - DNA, 16 bp, M. musculus
aggaagagctgagagc

SEQ ID NO: 360270 - DNA, 16 bp, M. musculus
aggaagagctggagag

SEQ ID NO: 360271 - DNA, 16 bp, M. musculus
aggaagaggacacaga

SEQ ID NO: 360272 - DNA, 16 bp, M. musculus
aggaagaggcaagcag

SEQ ID NO: 360273 - DNA, 16 bp, M. musculus
aggaagaggcagaggc

SEQ ID NO: 360274 - DNA, 16 bp, M. musculus
aggaagaggcaggcaa

SEQ ID NO: 360275 - DNA, 16 bp, M. musculus
aggaagaggcaggcag

SEQ ID NO: 360276 - DNA, 16 bp, M. musculus
aggaagagggcatcag

SEQ ID NO: 360277 - DNA, 16 bp, M. musculus
aggaagagtttatttc

SEQ ID NO: 360278 - DNA, 16 bp, M. musculus
aggaagatcaatggaa

SEQ ID NO: 360279 - DNA, 16 bp, M. musculus
aggaagatcacaagtt

SEQ ID NO: 360280 - DNA, 16 bp, M. musculus
aggaagatcaggagtt

SEQ ID NO: 360281 - DNA, 16 bp, M. musculus
aggaagatcatgaatt

SEQ ID NO: 360282 - DNA, 16 bp, M. musculus
aggaagatctctgaat

SEQ ID NO: 360283 - DNA, 16 bp, M. musculus
aggaagatctctgagt

SEQ ID NO: 360284 - DNA, 16 bp, M. musculus
aggaagatgagtggga

SEQ ID NO: 360285 - DNA, 16 bp, M. musculus
aggaagatggagacag

SEQ ID NO: 360286 - DNA, 16 bp, M. musculus
aggaagatggagcaga

SEQ ID NO: 360287 - DNA, 16 bp, M. musculus
aggaagatggctcagt

SEQ ID NO: 360288 - DNA, 16 bp, M. musculus
aggaagattgagaatc

SEQ ID NO: 360289 - DNA, 16 bp, M. musculus
aggaagattgcaagtt

SEQ ID NO: 360290 - DNA, 16 bp, M. musculus
aggaagattgccatga

SEQ ID NO: 360291 - DNA, 16 bp, M. musculus
aggaagatttccaaat

SEQ ID NO: 360292 - DNA, 16 bp, M. musculus
aggaagattttatttt

SEQ ID NO: 360293 - DNA, 16 bp, M. musculus
aggaagattttttttt

SEQ ID NO: 360294 - DNA, 16 bp, M. musculus
aggaagcaaattcccc

SEQ ID NO: 360295 - DNA, 16 bp, M. musculus
aggaagcaagctgagc

SEQ ID NO: 360296 - DNA, 16 bp, M. musculus
aggaagcacacacaca

SEQ ID NO: 360297 - DNA, 16 bp, M. musculus
aggaagcagaaactga

SEQ ID NO: 360298 - DNA, 16 bp, M. musculus
aggaagcagaaagaat

SEQ ID NO: 360299 - DNA, 16 bp, M. musculus
aggaagcagaaagatt

SEQ ID NO: 360300 - DNA, 16 bp, M. musculus
aggaagcagaagcaag

SEQ ID NO: 360301 - DNA, 16 bp, M. musculus
aggaagcagaagcagg

SEQ ID NO: 360302 - DNA, 16 bp, M. musculus
aggaagcagaaggcag

SEQ ID NO: 360303 - DNA, 16 bp, M. musculus
aggaagcagaagtggg

SEQ ID NO: 360304 - DNA, 16 bp, M. musculus
aggaagcagacagaca

SEQ ID NO: 360305 - DNA, 16 bp, M. musculus
aggaagcagagaatga

SEQ ID NO: 360306 - DNA, 16 bp, M. musculus
aggaagcagagagaat

SEQ ID NO: 360307 - DNA, 16 bp, M. musculus
aggaagcagagagatg

SEQ ID NO: 360308 - DNA, 16 bp, M. musculus
aggaagcagagagcag

SEQ ID NO: 360309 - DNA, 16 bp, M. musculus
aggaagcagagagtga

SEQ ID NO: 360310 - DNA, 16 bp, M. musculus
aggaagcagagatgga

SEQ ID NO: 360311 - DNA, 16 bp, M. musculus
aggaagcagagcagag

SEQ ID NO: 360312 - DNA, 16 bp, M. musculus
aggaagcagaggcaga

SEQ ID NO: 360313 - DNA, 17 bp, M. musculus
aggaagcagaggcagga

SEQ ID NO: 360314 - DNA, 16 bp, M. musculus
aggaagcagaggctgg

SEQ ID NO: 360315 - DNA, 16 bp, M. musculus
aggaagcagatctctg

SEQ ID NO: 360316 - DNA, 16 bp, M. musculus
aggaagcagatgcagg

SEQ ID NO: 360317 - DNA, 16 bp, M. musculus
aggaagcagcagcagc

SEQ ID NO: 360318 - DNA, 16 bp, M. musculus
aggaagcagccatgtt

SEQ ID NO: 360319 - DNA, 16 bp, M. musculus
aggaagcaggagccga

SEQ ID NO: 360320 - DNA, 16 bp, M. musculus
aggaagcaggaggtga

SEQ ID NO: 360321 - DNA, 16 bp, M. musculus
aggaagcaggatgtct

SEQ ID NO: 360322 - DNA, 16 bp, M. musculus
aggaagcaggcagaga

SEQ ID NO: 360323 - DNA, 16 bp, M. musculus
aggaagcaggcaggca

SEQ ID NO: 360324 - DNA, 16 bp, M. musculus
aggaagcaggctgagt

SEQ ID NO: 360325 - DNA, 16 bp, M. musculus
aggaagcaggctttgg

SEQ ID NO: 360326 - DNA, 16 bp, M. musculus
aggaagcaggtgctga

SEQ ID NO: 360327 - DNA, 22 bp, M. musculus
aggaagcagtggtcttgaatat

SEQ ID NO: 360328 - DNA, 16 bp, M. musculus
aggaagcatggcagcg

SEQ ID NO: 360329 - DNA, 16 bp, M. musculus
aggaagccaccatgag

SEQ ID NO: 360330 - DNA, 16 bp, M. musculus
aggaagccagagaaag

SEQ ID NO: 360331 - DNA, 16 bp, M. musculus
aggaagccaggacaga

SEQ ID NO: 360332 - DNA, 16 bp, M. musculus
aggaagccagggcagg

SEQ ID NO: 360333 - DNA, 16 bp, M. musculus
aggaagccaggtgtgg

SEQ ID NO: 360334 - DNA, 16 bp, M. musculus
aggaagccatgaggag

SEQ ID NO: 360335 - DNA, 16 bp, M. musculus
aggaagccctgggttc

SEQ ID NO: 360336 - DNA, 16 bp, M. musculus
aggaagcctcagttga

SEQ ID NO: 360337 - DNA, 16 bp, M. musculus
aggaagctgagaaatc

SEQ ID NO: 360338 - DNA, 16 bp, M. musculus
aggaagctgaggcaga

SEQ ID NO: 360339 - DNA, 16 bp, M. musculus
aggaagctgatgcagg

SEQ ID NO: 360340 - DNA, 16 bp, M. musculus
aggaagctgcagatgt

SEQ ID NO: 360341 - DNA, 16 bp, M. musculus
aggaagctgggggtgg

SEQ ID NO: 360342 - DNA, 16 bp, M. musculus
aggaaggaaatcagga

SEQ ID NO: 360343 - DNA, 16 bp, M. musculus
aggaaggaaatctgga

SEQ ID NO: 360344 - DNA, 16 bp, M. musculus
aggaaggaagactgaa

SEQ ID NO: 360345 - DNA, 16 bp, M. musculus
aggaaggaagctggag

SEQ ID NO: 360346 - DNA, 16 bp, M. musculus
aggaaggaagctgggg

SEQ ID NO: 360347 - DNA, 16 bp, M. musculus
aggaaggaaggcaggc

SEQ ID NO: 360348 - DNA, 16 bp, M. musculus
aggaaggacaaaataa

SEQ ID NO: 360349 - DNA, 16 bp, M. musculus
aggaaggacagatgga

SEQ ID NO: 360350 - DNA, 16 bp, M. musculus
aggaaggactgggagg

SEQ ID NO: 360351 - DNA, 16 bp, M. musculus
aggaaggagcctccct

SEQ ID NO: 360352 - DNA, 16 bp, M. musculus
aggaaggagctgagag

SEQ ID NO: 360353 - DNA, 16 bp, M. musculus
aggaaggcagagacag

SEQ ID NO: 360354 - DNA, 16 bp, M. musculus
aggaaggcaggcaagc

SEQ ID NO: 360355 - DNA, 16 bp, M. musculus
aggaaggccacacctc

SEQ ID NO: 360356 - DNA, 16 bp, M. musculus
aggaaggccattgatt

SEQ ID NO: 360357 - DNA, 16 bp, M. musculus
aggaaggctgaaagaa

SEQ ID NO: 360358 - DNA, 16 bp, M. musculus
aggaaggctgagagcc

SEQ ID NO: 360359 - DNA, 16 bp, M. musculus
aggaagggaaactgag

SEQ ID NO: 360360 - DNA, 16 bp, M. musculus
aggaagggacctgggt

SEQ ID NO: 360361 - DNA, 16 bp, M. musculus
aggaagggcacttcat

SEQ ID NO: 360362 - DNA, 16 bp, M. musculus
aggaagggcagcccag

SEQ ID NO: 360363 - DNA, 16 bp, M. musculus
aggaagggcatgatgg

SEQ ID NO: 360364 - DNA, 16 bp, M. musculus
aggaagggccatctgg

SEQ ID NO: 360365 - DNA, 16 bp, M. musculus
aggaagggtttctctg

SEQ ID NO: 360366 - DNA, 16 bp, M. musculus
aggaaggtggagagcc

SEQ ID NO: 360367 - DNA, 16 bp, M. musculus
aggaaggtggagcaga

SEQ ID NO: 360368 - DNA, 16 bp, M. musculus
aggaaggttgaggacc

SEQ ID NO: 360369 - DNA, 16 bp, M. musculus
aggaagtagcaacaaa

SEQ ID NO: 360370 - DNA, 16 bp, M. musculus
aggaagtcaagcagga

SEQ ID NO: 360371 - DNA, 16 bp, M. musculus
aggaagtcagaactgg

SEQ ID NO: 360372 - DNA, 17 bp, M. musculus
aggaagtcaggactgaa

SEQ ID NO: 360373 - DNA, 16 bp, M. musculus
aggaagtcaggcctgg

SEQ ID NO: 360374 - DNA, 16 bp, M. musculus
aggaagtcagggaagg

SEQ ID NO: 360375 - DNA, 17 bp, M. musculus
aggaagtccaggacaca

SEQ ID NO: 360376 - DNA, 16 bp, M. musculus
aggaagtctcagagac

SEQ ID NO: 360377 - DNA, 18 bp, M. musculus
aggaagtgaaagatctgt

SEQ ID NO: 360378 - DNA, 16 bp, M. musculus
aggaagtgaggacagg

SEQ ID NO: 360379 - DNA, 16 bp, M. musculus
aggaagtgctgctggg

SEQ ID NO: 360380 - DNA, 16 bp, M. musculus
aggaagtggaggcaga

SEQ ID NO: 360381 - DNA, 16 bp, M. musculus
aggaagtgtgtcacag

SEQ ID NO: 360382 - DNA, 16 bp, M. musculus
aggaagtgtgtcaccg

SEQ ID NO: 360383 - DNA, 16 bp, M. musculus
aggaagtttccactgc

SEQ ID NO: 360384 - DNA, 16 bp, M. musculus
aggaagtttccagaag

SEQ ID NO: 360385 - DNA, 16 bp, M. musculus
aggaagtttgagatcc

SEQ ID NO: 360386 - DNA, 16 bp, M. musculus
aggaataaggcagaga

SEQ ID NO: 360387 - DNA, 16 bp, M. musculus
aggaatacagtagagt

SEQ ID NO: 360388 - DNA, 16 bp, M. musculus
aggaatacccaatggc

SEQ ID NO: 360389 - DNA, 26 bp, M. musculus
aggaatagaaaccctgactaagacaa

SEQ ID NO: 360390 - DNA, 26 bp, M. musculus
aggaatagaaaccctgactaagacat

SEQ ID NO: 360391 - DNA, 16 bp, M. musculus
aggaatagaaactctg

SEQ ID NO: 360392 - DNA, 16 bp, M. musculus
aggaatagaagccctg

SEQ ID NO: 360393 - DNA, 16 bp, M. musculus
aggaatagggccaccc

SEQ ID NO: 360394 - DNA, 16 bp, M. musculus
aggaatagtgattatt

SEQ ID NO: 360395 - DNA, 16 bp, M. musculus
aggaatatatatgcat

SEQ ID NO: 360396 - DNA, 16 bp, M. musculus
aggaatatatatgtgt

SEQ ID NO: 360397 - DNA, 16 bp, M. musculus
aggaatatcaaatggc

SEQ ID NO: 360398 - DNA, 16 bp, M. musculus
aggaatatcaactcag

SEQ ID NO: 360399 - DNA, 16 bp, M. musculus
aggaatattcctcttt

SEQ ID NO: 360400 - DNA, 16 bp, M. musculus
aggaatcctgaatggc

SEQ ID NO: 360401 - DNA, 16 bp, M. musculus
aggaatctgaggcagg

SEQ ID NO: 360402 - DNA, 16 bp, M. musculus
aggaatctggaagcag

SEQ ID NO: 360403 - DNA, 16 bp, M. musculus
aggaatcttcaaaaaa

SEQ ID NO: 360404 - DNA, 16 bp, M. musculus
aggaatgaaggaatga

SEQ ID NO: 360405 - DNA, 16 bp, M. musculus
aggaatgaagtatcca

SEQ ID NO: 360406 - DNA, 16 bp, M. musculus
aggaatgaatacaaaa

SEQ ID NO: 360407 - DNA, 16 bp, M. musculus
aggaatgctgcttact

SEQ ID NO: 360408 - DNA, 16 bp, M. musculus
aggaatgctgggaagg

SEQ ID NO: 360409 - DNA, 16 bp, M. musculus
aggaatgcttcttact

SEQ ID NO: 360410 - DNA, 22 bp, M. musculus
aggaatgctttggtggatggca

SEQ ID NO: 360411 - DNA, 16 bp, M. musculus
aggaatggaaaaatac

SEQ ID NO: 360412 - DNA, 16 bp, M. musculus
aggaatggaaaccctg

SEQ ID NO: 360413 - DNA, 16 bp, M. musculus
aggaatggagatctga

SEQ ID NO: 360414 - DNA, 17 bp, M. musculus
aggaatggatccagaaa

SEQ ID NO: 360415 - DNA, 16 bp, M. musculus
aggaatggccatccag

SEQ ID NO: 360416 - DNA, 16 bp, M. musculus
aggaatggctgaggtg

SEQ ID NO: 360417 - DNA, 16 bp, M. musculus
aggaatggggcagtgg

SEQ ID NO: 360418 - DNA, 16 bp, M. musculus
aggaatgggtcaattc

SEQ ID NO: 360419 - DNA, 21 bp, M. musculus
aggaatggtgccatatctggg

SEQ ID NO: 360420 - DNA, 16 bp, M. musculus
aggaatggttcaatat

SEQ ID NO: 360421 - DNA, 16 bp, M. musculus
aggaatggtttatttg

SEQ ID NO: 360422 - DNA, 16 bp, M. musculus
aggaatgtaaacacaa

SEQ ID NO: 360423 - DNA, 16 bp, M. musculus
aggaatgtcctctctg

SEQ ID NO: 360424 - DNA, 16 bp, M. musculus
aggaatgtctcaggaa

SEQ ID NO: 360425 - DNA, 16 bp, M. musculus
aggaatgtctgggaaa

SEQ ID NO: 360426 - DNA, 33 bp, M. musculus
aggaatgtgtgtaacctctgttcagtatcagaa

SEQ ID NO: 360427 - DNA, 16 bp, M. musculus
aggaattaaagacttt

SEQ ID NO: 360428 - DNA, 16 bp, M. musculus
aggaattaaaggccca

SEQ ID NO: 360429 - DNA, 16 bp, M. musculus
aggaattattttattg

SEQ ID NO: 360430 - DNA, 16 bp, M. musculus
aggaattcaaggcgca

SEQ ID NO: 360431 - DNA, 16 bp, M. musculus
aggaattcactctgta

SEQ ID NO: 360432 - DNA, 16 bp, M. musculus
aggaattgaacccagg

SEQ ID NO: 360433 - DNA, 17 bp, M. musculus
aggaattgaactcagaa

SEQ ID NO: 360434 - DNA, 16 bp, M. musculus
aggaattgggacacca

SEQ ID NO: 360435 - DNA, 16 bp, M. musculus
aggaattgtgataaaa

SEQ ID NO: 360436 - DNA, 16 bp, M. musculus
aggaatttcagaaatt

SEQ ID NO: 360437 - DNA, 16 bp, M. musculus
aggaatttcataaagt

SEQ ID NO: 360438 - DNA, 16 bp, M. musculus
aggaatttccccctgt

SEQ ID NO: 360439 - DNA, 16 bp, M. musculus
aggaatttcttctctg

SEQ ID NO: 360440 - DNA, 16 bp, M. musculus
aggaatttgaagagaa

SEQ ID NO: 360441 - DNA, 16 bp, M. musculus
aggaatttgataaatt

SEQ ID NO: 360442 - DNA, 16 bp, M. musculus
aggaatttgtctcctg

SEQ ID NO: 360443 - DNA, 16 bp, M. musculus
aggaattttaatctag

SEQ ID NO: 360444 - DNA, 16 bp, M. musculus
aggaattttgggttta

SEQ ID NO: 360445 - DNA, 16 bp, M. musculus
aggaattttgtgaatt

SEQ ID NO: 360446 - DNA, 16 bp, M. musculus
aggaatttttttttcc

SEQ ID NO: 360447 - DNA, 16 bp, M. musculus
aggacaaaaagcagcc

SEQ ID NO: 360448 - DNA, 16 bp, M. musculus
aggacaaaagagcaac

SEQ ID NO: 360449 - DNA, 16 bp, M. musculus
aggacaaaatgagaat

SEQ ID NO: 360450 - DNA, 16 bp, M. musculus
aggacaaaatggaaac

SEQ ID NO: 360451 - DNA, 16 bp, M. musculus
aggacaaagacagaca

SEQ ID NO: 360452 - DNA, 16 bp, M. musculus
aggacaaagcagcaac

SEQ ID NO: 360453 - DNA, 16 bp, M. musculus
aggacaaaggacctct

SEQ ID NO: 360454 - DNA, 16 bp, M. musculus
aggacaaatgctccac

SEQ ID NO: 360455 - DNA, 16 bp, M. musculus
aggacaaattttaggt

SEQ ID NO: 360456 - DNA, 16 bp, M. musculus
aggacaaccagagcta

SEQ ID NO: 360457 - DNA, 16 bp, M. musculus
aggacaaccagcccag

SEQ ID NO: 360458 - DNA, 17 bp, M. musculus
aggacaaccagggctat

SEQ ID NO: 360459 - DNA, 16 bp, M. musculus
aggacaacctcagctg

SEQ ID NO: 360460 - DNA, 16 bp, M. musculus
aggacaaccttcagga

SEQ ID NO: 360461 - DNA, 16 bp, M. musculus
aggacaactacagtgt

SEQ ID NO: 360462 - DNA, 16 bp, M. musculus
aggacaacttccagga

SEQ ID NO: 360463 - DNA, 16 bp, M. musculus
aggacaacttctggga

SEQ ID NO: 360464 - DNA, 16 bp, M. musculus
aggacaacttgaaaga

SEQ ID NO: 360465 - DNA, 16 bp, M. musculus
aggacaactttcagaa

SEQ ID NO: 360466 - DNA, 16 bp, M. musculus
aggacaactttgagga

SEQ ID NO: 360467 - DNA, 16 bp, M. musculus
aggacaaggaagtgga

SEQ ID NO: 360468 - DNA, 16 bp, M. musculus
aggacaaggacaagga

SEQ ID NO: 360469 - DNA, 16 bp, M. musculus
aggacaaggtggcttt

SEQ ID NO: 360470 - DNA, 16 bp, M. musculus
aggacaatcagggcta

SEQ ID NO: 360471 - DNA, 16 bp, M. musculus
aggacaatcttgggtg

SEQ ID NO: 360472 - DNA, 16 bp, M. musculus
aggacacaacaagaag

SEQ ID NO: 360473 - DNA, 16 bp, M. musculus
aggacacaatggagaa

SEQ ID NO: 360474 - DNA, 16 bp, M. musculus
aggacacacagagaaa

SEQ ID NO: 360475 - DNA, 16 bp, M. musculus
aggacacacaggacac

SEQ ID NO: 360476 - DNA, 16 bp, M. musculus
aggacacagaagaagg

SEQ ID NO: 360477 - DNA, 17 bp, M. musculus
aggacacagaagccctg

SEQ ID NO: 360478 - DNA, 16 bp, M. musculus
aggacacagagataaa

SEQ ID NO: 360479 - DNA, 16 bp, M. musculus
aggacacaggaaccaa

SEQ ID NO: 360480 - DNA, 16 bp, M. musculus
aggacacaggaatcaa

SEQ ID NO: 360481 - DNA, 16 bp, M. musculus
aggacacaggacacag

SEQ ID NO: 360482 - DNA, 16 bp, M. musculus
aggacacatgttccac

SEQ ID NO: 360483 - DNA, 16 bp, M. musculus
aggacaccagaagatg

SEQ ID NO: 360484 - DNA, 16 bp, M. musculus
aggacaccagagccct

SEQ ID NO: 360485 - DNA, 16 bp, M. musculus
aggacaccagatctca

SEQ ID NO: 360486 - DNA, 16 bp, M. musculus
aggacaccaggaaaac

SEQ ID NO: 360487 - DNA, 16 bp, M. musculus
aggacacccagagcta

SEQ ID NO: 360488 - DNA, 16 bp, M. musculus
aggacacctgatgttt

SEQ ID NO: 360489 - DNA, 16 bp, M. musculus
aggacactgagagcaa

SEQ ID NO: 360490 - DNA, 16 bp, M. musculus
aggacactgtcaacag

SEQ ID NO: 360491 - DNA, 16 bp, M. musculus
aggacactgtcagtag

SEQ ID NO: 360492 - DNA, 16 bp, M. musculus
aggacagaaactcaca

SEQ ID NO: 360493 - DNA, 16 bp, M. musculus
aggacagaaaggacag

SEQ ID NO: 360494 - DNA, 16 bp, M. musculus
aggacagaagagagca

SEQ ID NO: 360495 - DNA, 16 bp, M. musculus
aggacagaagctgctg

SEQ ID NO: 360496 - DNA, 16 bp, M. musculus
aggacagagagacaga

SEQ ID NO: 360497 - DNA, 16 bp, M. musculus
aggacagagatggaga

SEQ ID NO: 360498 - DNA, 16 bp, M. musculus
aggacagaggacaact

SEQ ID NO: 360499 - DNA, 16 bp, M. musculus
aggacagatggacaga

SEQ ID NO: 360500 - DNA, 16 bp, M. musculus
aggacagcacagagaa

SEQ ID NO: 360501 - DNA, 16 bp, M. musculus
aggacagcatttcatt

SEQ ID NO: 360502 - DNA, 16 bp, M. musculus
aggacagccaaagcca

SEQ ID NO: 360503 - DNA, 16 bp, M. musculus
aggacagccaaagctg

SEQ ID NO: 360504 - DNA, 16 bp, M. musculus
aggacagccaaggcca

SEQ ID NO: 360505 - DNA, 16 bp, M. musculus
aggacagccagaacta

SEQ ID NO: 360506 - DNA, 16 bp, M. musculus
aggacagccagatcta

SEQ ID NO: 360507 - DNA, 16 bp, M. musculus
aggacagccagcgcta

SEQ ID NO: 360508 - DNA, 16 bp, M. musculus
aggacagccaggacca

SEQ ID NO: 360509 - DNA, 17 bp, M. musculus
aggacagccaggactac

SEQ ID NO: 360510 - DNA, 16 bp, M. musculus
aggacagccaggactt

SEQ ID NO: 360511 - DNA, 16 bp, M. musculus
aggacagccaggatga

SEQ ID NO: 360512 - DNA, 16 bp, M. musculus
aggacagccaggattg

SEQ ID NO: 360513 - DNA, 16 bp, M. musculus
aggacagccaggccta

SEQ ID NO: 360514 - DNA, 16 bp, M. musculus
aggacagccagggaaa

SEQ ID NO: 360515 - DNA, 19 bp, M. musculus
aggacagccagggctatat

SEQ ID NO: 360516 - DNA, 16 bp, M. musculus
aggacagccagggctt

SEQ ID NO: 360517 - DNA, 16 bp, M. musculus
aggacagccagggggc

SEQ ID NO: 360518 - DNA, 16 bp, M. musculus
aggacagccatgacta

SEQ ID NO: 360519 - DNA, 16 bp, M. musculus
aggacagccatgctag

SEQ ID NO: 360520 - DNA, 16 bp, M. musculus
aggacagccatggcca

SEQ ID NO: 360521 - DNA, 16 bp, M. musculus
aggacagcctgggcaa

SEQ ID NO: 360522 - DNA, 16 bp, M. musculus
aggacagcctgggtta

SEQ ID NO: 360523 - DNA, 16 bp, M. musculus
aggacagcctggtcca

SEQ ID NO: 360524 - DNA, 16 bp, M. musculus
aggacagcctggtcta

SEQ ID NO: 360525 - DNA, 19 bp, M. musculus
aggacagcctggtctacaa

SEQ ID NO: 360526 - DNA, 16 bp, M. musculus
aggacagcctggtgta

SEQ ID NO: 360527 - DNA, 16 bp, M. musculus
aggacagctataccag

SEQ ID NO: 360528 - DNA, 16 bp, M. musculus
aggacagctccagaga

SEQ ID NO: 360529 - DNA, 16 bp, M. musculus
aggacagctgacagag

SEQ ID NO: 360530 - DNA, 16 bp, M. musculus
aggacagcttctgaga

SEQ ID NO: 360531 - DNA, 16 bp, M. musculus
aggacagcttgctgga

SEQ ID NO: 360532 - DNA, 16 bp, M. musculus
aggacagcttggtcta

SEQ ID NO: 360533 - DNA, 16 bp, M. musculus
aggacaggaacctaga

SEQ ID NO: 360534 - DNA, 16 bp, M. musculus
aggacaggaagcagga

SEQ ID NO: 360535 - DNA, 16 bp, M. musculus
aggacaggacagccag

SEQ ID NO: 360536 - DNA, 16 bp, M. musculus
aggacaggacaggaga

SEQ ID NO: 360537 - DNA, 16 bp, M. musculus
aggacaggagcctgga

SEQ ID NO: 360538 - DNA, 16 bp, M. musculus
aggacaggaggacagg

SEQ ID NO: 360539 - DNA, 16 bp, M. musculus
aggacaggcagggcta

SEQ ID NO: 360540 - DNA, 16 bp, M. musculus
aggacagggactccac

SEQ ID NO: 360541 - DNA, 16 bp, M. musculus
aggacagggggagggt

SEQ ID NO: 360542 - DNA, 16 bp, M. musculus
aggacagtcagagcta

SEQ ID NO: 360543 - DNA, 17 bp, M. musculus
aggacagtcaggactat

SEQ ID NO: 360544 - DNA, 16 bp, M. musculus
aggacagtctggtcta

SEQ ID NO: 360545 - DNA, 16 bp, M. musculus
aggacagtggaagaag

SEQ ID NO: 360546 - DNA, 16 bp, M. musculus
aggacagttatgttag

SEQ ID NO: 360547 - DNA, 16 bp, M. musculus
aggacatactttaaaa

SEQ ID NO: 360548 - DNA, 16 bp, M. musculus
aggacatcaaatccca

SEQ ID NO: 360549 - DNA, 18 bp, M. musculus
aggacatcaagaaggaca

SEQ ID NO: 360550 - DNA, 16 bp, M. musculus
aggacatcctgggcta

SEQ ID NO: 360551 - DNA, 16 bp, M. musculus
aggacatctggaagaa

SEQ ID NO: 360552 - DNA, 16 bp, M. musculus
aggacatctggctaag

SEQ ID NO: 360553 - DNA, 16 bp, M. musculus
aggacatctgggttat

SEQ ID NO: 360554 - DNA, 16 bp, M. musculus
aggacatgaagaagga

SEQ ID NO: 360555 - DNA, 16 bp, M. musculus
aggacatgagttcaat

SEQ ID NO: 360556 - DNA, 16 bp, M. musculus
aggacatggaagaaga

SEQ ID NO: 360557 - DNA, 16 bp, M. musculus
aggacatggaaggcca

SEQ ID NO: 360558 - DNA, 16 bp, M. musculus
aggacatggacagaga

SEQ ID NO: 360559 - DNA, 16 bp, M. musculus
aggacatgtgatgttt

SEQ ID NO: 360560 - DNA, 16 bp, M. musculus
aggacatgtttgtgtt

SEQ ID NO: 360561 - DNA, 16 bp, M. musculus
aggacatttcatactc

SEQ ID NO: 360562 - DNA, 16 bp, M. musculus
aggacattttgcctct

SEQ ID NO: 360563 - DNA, 16 bp, M. musculus
aggaccaaaagttcaa

SEQ ID NO: 360564 - DNA, 16 bp, M. musculus
aggaccaaagcaccca

SEQ ID NO: 360565 - DNA, 16 bp, M. musculus
aggaccaaaggagctg

SEQ ID NO: 360566 - DNA, 16 bp, M. musculus
aggaccaagcattcaa

SEQ ID NO: 360567 - DNA, 16 bp, M. musculus
aggaccaaggggttcc

SEQ ID NO: 360568 - DNA, 16 bp, M. musculus
aggaccacaccttcta

SEQ ID NO: 360569 - DNA, 16 bp, M. musculus
aggaccaccaccacca

SEQ ID NO: 360570 - DNA, 16 bp, M. musculus
aggaccaccagcccaa

SEQ ID NO: 360571 - DNA, 16 bp, M. musculus
aggaccaccagtctag

SEQ ID NO: 360572 - DNA, 16 bp, M. musculus
aggaccagaagtctca

SEQ ID NO: 360573 - DNA, 16 bp, M. musculus
aggaccagagtttagt

SEQ ID NO: 360574 - DNA, 16 bp, M. musculus
aggaccagagtttggt

SEQ ID NO: 360575 - DNA, 16 bp, M. musculus
aggaccagcagcctca

SEQ ID NO: 360576 - DNA, 16 bp, M. musculus
aggaccagccttggct

SEQ ID NO: 360577 - DNA, 16 bp, M. musculus
aggaccagctcctggt

SEQ ID NO: 360578 - DNA, 16 bp, M. musculus
aggaccaggaagcagg

SEQ ID NO: 360579 - DNA, 16 bp, M. musculus
aggaccatgagtttga

SEQ ID NO: 360580 - DNA, 16 bp, M. musculus
aggacccaaatttgat

SEQ ID NO: 360581 - DNA, 16 bp, M. musculus
aggacccacatagtag

SEQ ID NO: 360582 - DNA, 16 bp, M. musculus
aggacccacatagtgg

SEQ ID NO: 360583 - DNA, 16 bp, M. musculus
aggacccacatgaaaa

SEQ ID NO: 360584 - DNA, 16 bp, M. musculus
aggacccaggaagcag

SEQ ID NO: 360585 - DNA, 16 bp, M. musculus
aggacccaggcttggt

SEQ ID NO: 360586 - DNA, 16 bp, M. musculus
aggacccagggagtgg

SEQ ID NO: 360587 - DNA, 16 bp, M. musculus
aggacccagggagttt

SEQ ID NO: 360588 - DNA, 16 bp, M. musculus
aggacccaggttcaaa

SEQ ID NO: 360589 - DNA, 16 bp, M. musculus
aggacccagtttcagt

SEQ ID NO: 360590 - DNA, 16 bp, M. musculus
aggacccgggttcaat

SEQ ID NO: 360591 - DNA, 16 bp, M. musculus
aggaccctgaagccaa

SEQ ID NO: 360592 - DNA, 16 bp, M. musculus
aggaccctgaagctga

SEQ ID NO: 360593 - DNA, 16 bp, M. musculus
aggaccgctggaagag

SEQ ID NO: 360594 - DNA, 16 bp, M. musculus
aggacctaggttcaat

SEQ ID NO: 360595 - DNA, 16 bp, M. musculus
aggacctctcctccca

SEQ ID NO: 360596 - DNA, 16 bp, M. musculus
aggacctctgaagagc

SEQ ID NO: 360597 - DNA, 17 bp, M. musculus
aggacctctgctcgctc

SEQ ID NO: 360598 - DNA, 16 bp, M. musculus
aggacctctgcttgct

SEQ ID NO: 360599 - DNA, 16 bp, M. musculus
aggacctctggaaaga

SEQ ID NO: 360600 - DNA, 16 bp, M. musculus
aggacctctggagaag

SEQ ID NO: 360601 - DNA, 16 bp, M. musculus
aggacctcttctccca

SEQ ID NO: 360602 - DNA, 16 bp, M. musculus
aggacctgagagaaag

SEQ ID NO: 360603 - DNA, 16 bp, M. musculus
aggacctgagttcggt

SEQ ID NO: 360604 - DNA, 16 bp, M. musculus
aggacctgagtttaaa

SEQ ID NO: 360605 - DNA, 16 bp, M. musculus
aggacctgatgcagac

SEQ ID NO: 360606 - DNA, 16 bp, M. musculus
aggacctgcctcctgg

SEQ ID NO: 360607 - DNA, 16 bp, M. musculus
aggacctggaggcagg

SEQ ID NO: 360608 - DNA, 16 bp, M. musculus
aggacctgggaaggaa

SEQ ID NO: 360609 - DNA, 16 bp, M. musculus
aggacctgggagggaa

SEQ ID NO: 360610 - DNA, 16 bp, M. musculus
aggacctgggcttgat

SEQ ID NO: 360611 - DNA, 16 bp, M. musculus
aggacctgggtttaat

SEQ ID NO: 360612 - DNA, 16 bp, M. musculus
aggacctgtggaagag

SEQ ID NO: 360613 - DNA, 16 bp, M. musculus
aggaccttcagaagag

SEQ ID NO: 360614 - DNA, 16 bp, M. musculus
aggacgaggaatgtca

SEQ ID NO: 360615 - DNA, 16 bp, M. musculus
aggacgaggacaagga

SEQ ID NO: 360616 - DNA, 16 bp, M. musculus
aggacgaggaggacga

SEQ ID NO: 360617 - DNA, 16 bp, M. musculus
aggactacacagaaaa

SEQ ID NO: 360618 - DNA, 16 bp, M. musculus
aggactaccaggccag

SEQ ID NO: 360619 - DNA, 16 bp, M. musculus
aggactatacaaagaa

SEQ ID NO: 360620 - DNA, 16 bp, M. musculus
aggactatagagagaa

SEQ ID NO: 360621 - DNA, 16 bp, M. musculus
aggactatgcagagac

SEQ ID NO: 360622 - DNA, 16 bp, M. musculus
aggactcaggggaggg

SEQ ID NO: 360623 - DNA, 16 bp, M. musculus
aggactccatagaaag

SEQ ID NO: 360624 - DNA, 16 bp, M. musculus
aggactccctggagct

SEQ ID NO: 360625 - DNA, 16 bp, M. musculus
aggactccgcgggacc

SEQ ID NO: 360626 - DNA, 17 bp, M. musculus
aggactcctctggcgac

SEQ ID NO: 360627 - DNA, 16 bp, M. musculus
aggactcttaaccact

SEQ ID NO: 360628 - DNA, 16 bp, M. musculus
aggactgaacttgggt

SEQ ID NO: 360629 - DNA, 16 bp, M. musculus
aggactgaagaagctg

SEQ ID NO: 360630 - DNA, 16 bp, M. musculus
aggactgaagacctga

SEQ ID NO: 360631 - DNA, 16 bp, M. musculus
aggactgaagcagctg

SEQ ID NO: 360632 - DNA, 16 bp, M. musculus
aggactgagaaagaaa

SEQ ID NO: 360633 - DNA, 16 bp, M. musculus
aggactgccaggtttg

SEQ ID NO: 360634 - DNA, 16 bp, M. musculus
aggactgcctgagaga

SEQ ID NO: 360635 - DNA, 16 bp, M. musculus
aggactgccttgtatg

SEQ ID NO: 360636 - DNA, 16 bp, M. musculus
aggactgctcacatca

SEQ ID NO: 360637 - DNA, 16 bp, M. musculus
aggactgctgcaagtt

SEQ ID NO: 360638 - DNA, 16 bp, M. musculus
aggactgctgggtctg

SEQ ID NO: 360639 - DNA, 16 bp, M. musculus
aggactggagagacag

SEQ ID NO: 360640 - DNA, 16 bp, M. musculus
aggactggagagatgg

SEQ ID NO: 360641 - DNA, 16 bp, M. musculus
aggactggagaggcag

SEQ ID NO: 360642 - DNA, 16 bp, M. musculus
aggactggaggagctg

SEQ ID NO: 360643 - DNA, 16 bp, M. musculus
aggactggagttcaat

SEQ ID NO: 360644 - DNA, 16 bp, M. musculus
aggactggagtttgat

SEQ ID NO: 360645 - DNA, 16 bp, M. musculus
aggactggctgaagtg

SEQ ID NO: 360646 - DNA, 16 bp, M. musculus
aggactggctgtggtg

SEQ ID NO: 360647 - DNA, 16 bp, M. musculus
aggactgggaggtgtg

SEQ ID NO: 360648 - DNA, 16 bp, M. musculus
aggactggggaggcag

SEQ ID NO: 360649 - DNA, 16 bp, M. musculus
aggactgtccacacta

SEQ ID NO: 360650 - DNA, 16 bp, M. musculus
aggactgtgaaagagc

SEQ ID NO: 360651 - DNA, 16 bp, M. musculus
aggactgtgctgtgct

SEQ ID NO: 360652 - DNA, 16 bp, M. musculus
aggactgtggagctgt

SEQ ID NO: 360653 - DNA, 16 bp, M. musculus
aggacttaaggggtca

SEQ ID NO: 360654 - DNA, 16 bp, M. musculus
aggacttagccaataa

SEQ ID NO: 360655 - DNA, 16 bp, M. musculus
aggacttcaaaacaga

SEQ ID NO: 360656 - DNA, 17 bp, M. musculus
aggacttcaaatactat

SEQ ID NO: 360657 - DNA, 16 bp, M. musculus
aggacttcaagaacaa

SEQ ID NO: 360658 - DNA, 16 bp, M. musculus
aggacttcaagcacaa

SEQ ID NO: 360659 - DNA, 16 bp, M. musculus
aggacttcatgaattt

SEQ ID NO: 360660 - DNA, 16 bp, M. musculus
aggacttccatgtctg

SEQ ID NO: 360661 - DNA, 16 bp, M. musculus
aggacttgctggctgc

SEQ ID NO: 360662 - DNA, 16 bp, M. musculus
aggacttgggggaggg

SEQ ID NO: 360663 - DNA, 16 bp, M. musculus
aggactttaagaagaa

SEQ ID NO: 360664 - DNA, 16 bp, M. musculus
aggactttaagaagga

SEQ ID NO: 360665 - DNA, 16 bp, M. musculus
aggactttaagaaggt

SEQ ID NO: 360666 - DNA, 16 bp, M. musculus
aggactttagaatgca

SEQ ID NO: 360667 - DNA, 16 bp, M. musculus
aggactttctaggact

SEQ ID NO: 360668 - DNA, 16 bp, M. musculus
aggactttgaacattt

SEQ ID NO: 360669 - DNA, 16 bp, M. musculus
aggacttttattccag

SEQ ID NO: 360670 - DNA, 16 bp, M. musculus
aggacttttggaagaa

SEQ ID NO: 360671 - DNA, 16 bp, M. musculus
aggactttttagaatt

SEQ ID NO: 360672 - DNA, 16 bp, M. musculus
aggagaaaacagcatt

SEQ ID NO: 360673 - DNA, 16 bp, M. musculus
aggagaaaaccaaata

SEQ ID NO: 360674 - DNA, 16 bp, M. musculus
aggagaaaactgttaa

SEQ ID NO: 360675 - DNA, 16 bp, M. musculus
aggagaaaagaaatca

SEQ ID NO: 360676 - DNA, 16 bp, M. musculus
aggagaaaagcagagc

SEQ ID NO: 360677 - DNA, 16 bp, M. musculus
aggagaaaaggggtcc

SEQ ID NO: 360678 - DNA, 16 bp, M. musculus
aggagaaaatatggag

SEQ ID NO: 360679 - DNA, 16 bp, M. musculus
aggagaaacagcaaat

SEQ ID NO: 360680 - DNA, 16 bp, M. musculus
aggagaaacagcaagt

SEQ ID NO: 360681 - DNA, 16 bp, M. musculus
aggagaaacccttggt

SEQ ID NO: 360682 - DNA, 16 bp, M. musculus
aggagaaactgagaaa

SEQ ID NO: 360683 - DNA, 16 bp, M. musculus
aggagaaactgaggca

SEQ ID NO: 360684 - DNA, 16 bp, M. musculus
aggagaaactgggaag

SEQ ID NO: 360685 - DNA, 16 bp, M. musculus
aggagaaagatatttg

SEQ ID NO: 360686 - DNA, 16 bp, M. musculus
aggagaaagatctgtg

SEQ ID NO: 360687 - DNA, 16 bp, M. musculus
aggagaaagccagggc

SEQ ID NO: 360688 - DNA, 16 bp, M. musculus
aggagaaagcttctct

SEQ ID NO: 360689 - DNA, 16 bp, M. musculus
aggagaaaggattgtg

SEQ ID NO: 360690 - DNA, 16 bp, M. musculus
aggagaaagtgggcaa

SEQ ID NO: 360691 - DNA, 16 bp, M. musculus
aggagaaagtggggca

SEQ ID NO: 360692 - DNA, 16 bp, M. musculus
aggagaaagtgttgaa

SEQ ID NO: 360693 - DNA, 16 bp, M. musculus
aggagaaatggacaca

SEQ ID NO: 360694 - DNA, 16 bp, M. musculus
aggagaacaaggccct

SEQ ID NO: 360695 - DNA, 16 bp, M. musculus
aggagaacacatccaa

SEQ ID NO: 360696 - DNA, 16 bp, M. musculus
aggagaacagaattag

SEQ ID NO: 360697 - DNA, 16 bp, M. musculus
aggagaacatggctca

SEQ ID NO: 360698 - DNA, 17 bp, M. musculus
aggagaacattgctaaa

SEQ ID NO: 360699 - DNA, 16 bp, M. musculus
aggagaagaattgctg

SEQ ID NO: 360700 - DNA, 16 bp, M. musculus
aggagaagagacatga

SEQ ID NO: 360701 - DNA, 16 bp, M. musculus
aggagaagatgtgcct

SEQ ID NO: 360702 - DNA, 16 bp, M. musculus
aggagaagcaagccag

SEQ ID NO: 360703 - DNA, 16 bp, M. musculus
aggagaagcagcagaa

SEQ ID NO: 360704 - DNA, 16 bp, M. musculus
aggagaagcagcagca

SEQ ID NO: 360705 - DNA, 16 bp, M. musculus
aggagaagcaggagca

SEQ ID NO: 360706 - DNA, 16 bp, M. musculus
aggagaagcatggcta

SEQ ID NO: 360707 - DNA, 16 bp, M. musculus
aggagaagcctttggt

SEQ ID NO: 360708 - DNA, 16 bp, M. musculus
aggagaagctgaagga

SEQ ID NO: 360709 - DNA, 16 bp, M. musculus
aggagaagctgagagt

SEQ ID NO: 360710 - DNA, 16 bp, M. musculus
aggagaaggaattgaa

SEQ ID NO: 360711 - DNA, 16 bp, M. musculus
aggagaaggagcagca

SEQ ID NO: 360712 - DNA, 16 bp, M. musculus
aggagaagtttttaga

SEQ ID NO: 360713 - DNA, 16 bp, M. musculus
aggagaatcagaagct

SEQ ID NO: 360714 - DNA, 16 bp, M. musculus
aggagaatgccaaggc

SEQ ID NO: 360715 - DNA, 16 bp, M. musculus
aggagaatgctttaaa

SEQ ID NO: 360716 - DNA, 16 bp, M. musculus
aggagaatgttgttca

SEQ ID NO: 360717 - DNA, 16 bp, M. musculus
aggagaattagaagtt

SEQ ID NO: 360718 - DNA, 16 bp, M. musculus
aggagacacacttctg

SEQ ID NO: 360719 - DNA, 16 bp, M. musculus
aggagacaccacttct

SEQ ID NO: 360720 - DNA, 16 bp, M. musculus
aggagacagaaagagt

SEQ ID NO: 360721 - DNA, 16 bp, M. musculus
aggagacagaagtagg

SEQ ID NO: 360722 - DNA, 16 bp, M. musculus
aggagacagacacaca

SEQ ID NO: 360723 - DNA, 16 bp, M. musculus
aggagacagacatatc

SEQ ID NO: 360724 - DNA, 16 bp, M. musculus
aggagacagagacagg

SEQ ID NO: 360725 - DNA, 16 bp, M. musculus
aggagacagagccagg

SEQ ID NO: 360726 - DNA, 16 bp, M. musculus
aggagacagagctgag

SEQ ID NO: 360727 - DNA, 16 bp, M. musculus
aggagacagaggacaa

SEQ ID NO: 360728 - DNA, 16 bp, M. musculus
aggagacagaggcaga

SEQ ID NO: 360729 - DNA, 16 bp, M. musculus
aggagacagaggcagg

SEQ ID NO: 360730 - DNA, 16 bp, M. musculus
aggagacagaggtgag

SEQ ID NO: 360731 - DNA, 16 bp, M. musculus
aggagacaggagacag

SEQ ID NO: 360732 - DNA, 16 bp, M. musculus
aggagacagtggggaa

SEQ ID NO: 360733 - DNA, 16 bp, M. musculus
aggagaccaaggcagg

SEQ ID NO: 360734 - DNA, 16 bp, M. musculus
aggagaccagctctct

SEQ ID NO: 360735 - DNA, 16 bp, M. musculus
aggagaccaggaaggg

SEQ ID NO: 360736 - DNA, 16 bp, M. musculus
aggagaccagtttcca

SEQ ID NO: 360737 - DNA, 16 bp, M. musculus
aggagaccctgcttca

SEQ ID NO: 360738 - DNA, 16 bp, M. musculus
aggagacctcaaagcc

SEQ ID NO: 360739 - DNA, 16 bp, M. musculus
aggagactaagtttct

SEQ ID NO: 360740 - DNA, 16 bp, M. musculus
aggagactgagacagg

SEQ ID NO: 360741 - DNA, 16 bp, M. musculus
aggagactgaggcaga

SEQ ID NO: 360742 - DNA, 16 bp, M. musculus
aggagactgtcttctg

SEQ ID NO: 360743 - DNA, 16 bp, M. musculus
aggagagaaacaactc

SEQ ID NO: 360744 - DNA, 16 bp, M. musculus
aggagagaaacccaga

SEQ ID NO: 360745 - DNA, 16 bp, M. musculus
aggagagaaaccttat

SEQ ID NO: 360746 - DNA, 16 bp, M. musculus
aggagagaaatttgag

SEQ ID NO: 360747 - DNA, 16 bp, M. musculus
aggagagaaccaactc

SEQ ID NO: 360748 - DNA, 16 bp, M. musculus
aggagagaatcaactt

SEQ ID NO: 360749 - DNA, 16 bp, M. musculus
aggagagaatgtggag

SEQ ID NO: 360750 - DNA, 16 bp, M. musculus
aggagagacacagaga

SEQ ID NO: 360751 - DNA, 16 bp, M. musculus
aggagagacaggaggc

SEQ ID NO: 360752 - DNA, 16 bp, M. musculus
aggagagaccagacca

SEQ ID NO: 360753 - DNA, 16 bp, M. musculus
aggagagactgaggga

SEQ ID NO: 360754 - DNA, 16 bp, M. musculus
aggagagagaccctat

SEQ ID NO: 360755 - DNA, 16 bp, M. musculus
aggagagagcaagatt

SEQ ID NO: 360756 - DNA, 20 bp, M. musculus
aggagagagctagcctccca

SEQ ID NO: 360757 - DNA, 16 bp, M. musculus
aggagagagctgatct

SEQ ID NO: 360758 - DNA, 16 bp, M. musculus
aggagagagctgttct

SEQ ID NO: 360759 - DNA, 16 bp, M. musculus
aggagagagggctgag

SEQ ID NO: 360760 - DNA, 16 bp, M. musculus
aggagagatggccaga

SEQ ID NO: 360761 - DNA, 16 bp, M. musculus
aggagagatggctcag

SEQ ID NO: 360762 - DNA, 16 bp, M. musculus
aggagagcaaccctgt

SEQ ID NO: 360763 - DNA, 16 bp, M. musculus
aggagagcagaccctg

SEQ ID NO: 360764 - DNA, 16 bp, M. musculus
aggagagcagagcaga

SEQ ID NO: 360765 - DNA, 16 bp, M. musculus
aggagagccagagaag

SEQ ID NO: 360766 - DNA, 16 bp, M. musculus
aggagagccagccctg

SEQ ID NO: 360767 - DNA, 17 bp, M. musculus
aggagagccagggctat

SEQ ID NO: 360768 - DNA, 16 bp, M. musculus
aggagagcctacctgc

SEQ ID NO: 360769 - DNA, 16 bp, M. musculus
aggagagcgccttcca

SEQ ID NO: 360770 - DNA, 16 bp, M. musculus
aggagagctctgaaat

SEQ ID NO: 360771 - DNA, 16 bp, M. musculus
aggagagctctggctg

SEQ ID NO: 360772 - DNA, 16 bp, M. musculus
aggagagctgaggaga

SEQ ID NO: 360773 - DNA, 16 bp, M. musculus
aggagagctggcccag

SEQ ID NO: 360774 - DNA, 16 bp, M. musculus
aggagagctggggatg

SEQ ID NO: 360775 - DNA, 16 bp, M. musculus
aggagaggacatcctc

SEQ ID NO: 360776 - DNA, 16 bp, M. musculus
aggagaggcaagtttc

SEQ ID NO: 360777 - DNA, 16 bp, M. musculus
aggagaggccctaggt

SEQ ID NO: 360778 - DNA, 17 bp, M. musculus
aggagaggcccttggta

SEQ ID NO: 360779 - DNA, 16 bp, M. musculus
aggagagggagaacct

SEQ ID NO: 360780 - DNA, 16 bp, M. musculus
aggagaggggctggag

SEQ ID NO: 360781 - DNA, 16 bp, M. musculus
aggagagggtgtcaga

SEQ ID NO: 360782 - DNA, 16 bp, M. musculus
aggagaggtattgtgg

SEQ ID NO: 360783 - DNA, 16 bp, M. musculus
aggagaggtatttcag

SEQ ID NO: 360784 - DNA, 16 bp, M. musculus
aggagaggtattttgg

SEQ ID NO: 360785 - DNA, 16 bp, M. musculus
aggagaggtggccacc

SEQ ID NO: 360786 - DNA, 16 bp, M. musculus
aggagaggtgtgtgac

SEQ ID NO: 360787 - DNA, 16 bp, M. musculus
aggagagtcattgtgt

SEQ ID NO: 360788 - DNA, 17 bp, M. musculus
aggagagtttttgctat

SEQ ID NO: 360789 - DNA, 16 bp, M. musculus
aggagataacatttta

SEQ ID NO: 360790 - DNA, 16 bp, M. musculus
aggagataagcatgga

SEQ ID NO: 360791 - DNA, 16 bp, M. musculus
aggagataaggatgga

SEQ ID NO: 360792 - DNA, 16 bp, M. musculus
aggagatacaaagaca

SEQ ID NO: 360793 - DNA, 16 bp, M. musculus
aggagatagaaatgga

SEQ ID NO: 360794 - DNA, 16 bp, M. musculus
aggagatagtactgga

SEQ ID NO: 360795 - DNA, 16 bp, M. musculus
aggagatcaagcagat

SEQ ID NO: 360796 - DNA, 16 bp, M. musculus
aggagatcaaggggac

SEQ ID NO: 360797 - DNA, 16 bp, M. musculus
aggagatcaaggtgat

SEQ ID NO: 360798 - DNA, 16 bp, M. musculus
aggagatctgctgcag

SEQ ID NO: 360799 - DNA, 16 bp, M. musculus
aggagatgatgatgat

SEQ ID NO: 360800 - DNA, 16 bp, M. musculus
aggagatggagcagag

SEQ ID NO: 360801 - DNA, 16 bp, M. musculus
aggagatggaggcaga

SEQ ID NO: 360802 - DNA, 16 bp, M. musculus
aggagatggagtcaga

SEQ ID NO: 360803 - DNA, 16 bp, M. musculus
aggagatggctcagca

SEQ ID NO: 360804 - DNA, 16 bp, M. musculus
aggagatgtccttggt

SEQ ID NO: 360805 - DNA, 16 bp, M. musculus
aggagatgtggccctg

SEQ ID NO: 360806 - DNA, 16 bp, M. musculus
aggagatgtggccttg

SEQ ID NO: 360807 - DNA, 16 bp, M. musculus
aggagatgtgtccttg

SEQ ID NO: 360808 - DNA, 16 bp, M. musculus
aggagatttcaagaca

SEQ ID NO: 360809 - DNA, 16 bp, M. musculus
aggagattttttttaa

SEQ ID NO: 360810 - DNA, 16 bp, M. musculus
aggagcaacaacaata

SEQ ID NO: 360811 - DNA, 16 bp, M. musculus
aggagcaacacagaca

SEQ ID NO: 360812 - DNA, 16 bp, M. musculus
aggagcaagagccaga

SEQ ID NO: 360813 - DNA, 16 bp, M. musculus
aggagcaagaggacag

SEQ ID NO: 360814 - DNA, 16 bp, M. musculus
aggagcaaggacacag

SEQ ID NO: 360815 - DNA, 16 bp, M. musculus
aggagcacaggctgct

SEQ ID NO: 360816 - DNA, 16 bp, M. musculus
aggagcacctgctgct

SEQ ID NO: 360817 - DNA, 16 bp, M. musculus
aggagcactggatgct

SEQ ID NO: 360818 - DNA, 16 bp, M. musculus
aggagcagaaatgact

SEQ ID NO: 360819 - DNA, 16 bp, M. musculus
aggagcagaagcagga

SEQ ID NO: 360820 - DNA, 16 bp, M. musculus
aggagcagatgagaat

SEQ ID NO: 360821 - DNA, 16 bp, M. musculus
aggagcagatgcagag

SEQ ID NO: 360822 - DNA, 16 bp, M. musculus
aggagcagcagcagag

SEQ ID NO: 360823 - DNA, 16 bp, M. musculus
aggagcagcagcagga

SEQ ID NO: 360824 - DNA, 16 bp, M. musculus
aggagcagcagctgcc

SEQ ID NO: 360825 - DNA, 16 bp, M. musculus
aggagcagccagagca

SEQ ID NO: 360826 - DNA, 16 bp, M. musculus
aggagcagccagggct

SEQ ID NO: 360827 - DNA, 16 bp, M. musculus
aggagcagccagtgcc

SEQ ID NO: 360828 - DNA, 16 bp, M. musculus
aggagcaggaacagga

SEQ ID NO: 360829 - DNA, 17 bp, M. musculus
aggagcaggagcagcag

SEQ ID NO: 360830 - DNA, 16 bp, M. musculus
aggagcaggagcgcaa

SEQ ID NO: 360831 - DNA, 16 bp, M. musculus
aggagcaggaggagca

SEQ ID NO: 360832 - DNA, 16 bp, M. musculus
aggagcaggaggcagc

SEQ ID NO: 360833 - DNA, 16 bp, M. musculus
aggagcagggccagct

SEQ ID NO: 360834 - DNA, 16 bp, M. musculus
aggagcagtcagtgct

SEQ ID NO: 360835 - DNA, 16 bp, M. musculus
aggagcatgaggagga

SEQ ID NO: 360836 - DNA, 16 bp, M. musculus
aggagcatggagctgt

SEQ ID NO: 360837 - DNA, 16 bp, M. musculus
aggagcattcctcttt

SEQ ID NO: 360838 - DNA, 16 bp, M. musculus
aggagccaagagttct

SEQ ID NO: 360839 - DNA, 16 bp, M. musculus
aggagccagaagaggg

SEQ ID NO: 360840 - DNA, 16 bp, M. musculus
aggagccagagaaaat

SEQ ID NO: 360841 - DNA, 16 bp, M. musculus
aggagccagagaaagt

SEQ ID NO: 360842 - DNA, 16 bp, M. musculus
aggagccagagaagaa

SEQ ID NO: 360843 - DNA, 16 bp, M. musculus
aggagccagagagatg

SEQ ID NO: 360844 - DNA, 16 bp, M. musculus
aggagccagagaggaa

SEQ ID NO: 360845 - DNA, 16 bp, M. musculus
aggagccagaggagcc

SEQ ID NO: 360846 - DNA, 16 bp, M. musculus
aggagccagagttcca

SEQ ID NO: 360847 - DNA, 16 bp, M. musculus
aggagccagcaatacc

SEQ ID NO: 360848 - DNA, 16 bp, M. musculus
aggagcccaagagaag

SEQ ID NO: 360849 - DNA, 16 bp, M. musculus
aggagcccaggagccc

SEQ ID NO: 360850 - DNA, 16 bp, M. musculus
aggagcctagtgaatc

SEQ ID NO: 360851 - DNA, 16 bp, M. musculus
aggagcctcccttgaa

SEQ ID NO: 360852 - DNA, 16 bp, M. musculus
aggagcctgaggaaga

SEQ ID NO: 360853 - DNA, 16 bp, M. musculus
aggagcctgaggcagg

SEQ ID NO: 360854 - DNA, 16 bp, M. musculus
aggagcctggaatcac

SEQ ID NO: 360855 - DNA, 16 bp, M. musculus
aggagcctggtgtcca

SEQ ID NO: 360856 - DNA, 16 bp, M. musculus
aggagcctgtgctctg

SEQ ID NO: 360857 - DNA, 16 bp, M. musculus
aggagcctgtggaggc

SEQ ID NO: 360858 - DNA, 16 bp, M. musculus
aggagctaaaaggatc

SEQ ID NO: 360859 - DNA, 20 bp, M. musculus
aggagctaaagagatctgca

SEQ ID NO: 360860 - DNA, 17 bp, M. musculus
aggagctaaagagttct

SEQ ID NO: 360861 - DNA, 17 bp, M. musculus
aggagctaaaggggtct

SEQ ID NO: 360862 - DNA, 16 bp, M. musculus
aggagctaagagttct

SEQ ID NO: 360863 - DNA, 16 bp, M. musculus
aggagctagaagatta

SEQ ID NO: 360864 - DNA, 16 bp, M. musculus
aggagctagagagatg

SEQ ID NO: 360865 - DNA, 16 bp, M. musculus
aggagctcaaacagga

SEQ ID NO: 360866 - DNA, 16 bp, M. musculus
aggagctcaaacaggg

SEQ ID NO: 360867 - DNA, 16 bp, M. musculus
aggagctcgcagaagc

SEQ ID NO: 360868 - DNA, 16 bp, M. musculus
aggagctctcagagac

SEQ ID NO: 360869 - DNA, 17 bp, M. musculus
aggagctctgtgagttt

SEQ ID NO: 360870 - DNA, 16 bp, M. musculus
aggagctgaaaagaac

SEQ ID NO: 360871 - DNA, 16 bp, M. musculus
aggagctgaaaggatt

SEQ ID NO: 360872 - DNA, 16 bp, M. musculus
aggagctgaagaagtt

SEQ ID NO: 360873 - DNA, 16 bp, M. musculus
aggagctgaagcagag

SEQ ID NO: 360874 - DNA, 16 bp, M. musculus
aggagctgaaggaatt

SEQ ID NO: 360875 - DNA, 16 bp, M. musculus
aggagctgaaggagct

SEQ ID NO: 360876 - DNA, 16 bp, M. musculus
aggagctgaaggagtt

SEQ ID NO: 360877 - DNA, 16 bp, M. musculus
aggagctgaagggctt

SEQ ID NO: 360878 - DNA, 16 bp, M. musculus
aggagctgaaggtgtc

SEQ ID NO: 360879 - DNA, 16 bp, M. musculus
aggagctgaaggtgtt

SEQ ID NO: 360880 - DNA, 16 bp, M. musculus
aggagctgacatgtct

SEQ ID NO: 360881 - DNA, 16 bp, M. musculus
aggagctgaggaggag

SEQ ID NO: 360882 - DNA, 16 bp, M. musculus
aggagctgaggaggtt

SEQ ID NO: 360883 - DNA, 16 bp, M. musculus
aggagctgaggctgag

SEQ ID NO: 360884 - DNA, 16 bp, M. musculus
aggagctgatgaagag

SEQ ID NO: 360885 - DNA, 16 bp, M. musculus
aggagctgattctgat

SEQ ID NO: 360886 - DNA, 16 bp, M. musculus
aggagctgcaggagag

SEQ ID NO: 360887 - DNA, 16 bp, M. musculus
aggagctgctgcagag

SEQ ID NO: 360888 - DNA, 16 bp, M. musculus
aggagctgctgctgct

SEQ ID NO: 360889 - DNA, 16 bp, M. musculus
aggagctggacctaga

SEQ ID NO: 360890 - DNA, 16 bp, M. musculus
aggagctggagaaagg

SEQ ID NO: 360891 - DNA, 16 bp, M. musculus
aggagctggagaaatg

SEQ ID NO: 360892 - DNA, 16 bp, M. musculus
aggagctggagagaca

SEQ ID NO: 360893 - DNA, 16 bp, M. musculus
aggagctggagagatg

SEQ ID NO: 360894 - DNA, 16 bp, M. musculus
aggagctggagagctg

SEQ ID NO: 360895 - DNA, 16 bp, M. musculus
aggagctggaggaaga

SEQ ID NO: 360896 - DNA, 16 bp, M. musculus
aggagctggaggaggg

SEQ ID NO: 360897 - DNA, 16 bp, M. musculus
aggagctgggcagtgg

SEQ ID NO: 360898 - DNA, 16 bp, M. musculus
aggagctgggcgtggt

SEQ ID NO: 360899 - DNA, 16 bp, M. musculus
aggagctggggaaatg

SEQ ID NO: 360900 - DNA, 16 bp, M. musculus
aggagctggggaaggg

SEQ ID NO: 360901 - DNA, 16 bp, M. musculus
aggagctggggaggag

SEQ ID NO: 360902 - DNA, 16 bp, M. musculus
aggagctgggggaagg

SEQ ID NO: 360903 - DNA, 16 bp, M. musculus
aggagctgggggtgtg

SEQ ID NO: 360904 - DNA, 16 bp, M. musculus
aggagctggggtgtgg

SEQ ID NO: 360905 - DNA, 16 bp, M. musculus
aggagctggttcattg

SEQ ID NO: 360906 - DNA, 16 bp, M. musculus
aggagctggttctctc

SEQ ID NO: 360907 - DNA, 16 bp, M. musculus
aggagctgtcacacca

SEQ ID NO: 360908 - DNA, 16 bp, M. musculus
aggagctgtccacagt

SEQ ID NO: 360909 - DNA, 16 bp, M. musculus
aggagctgtgtcacca

SEQ ID NO: 360910 - DNA, 17 bp, M. musculus
aggagctgtgtcaccag

SEQ ID NO: 360911 - DNA, 16 bp, M. musculus
aggagctgtgtgaggg

SEQ ID NO: 360912 - DNA, 17 bp, M. musculus
aggagcttagcatggct

SEQ ID NO: 360913 - DNA, 16 bp, M. musculus
aggagcttcagctgag

SEQ ID NO: 360914 - DNA, 16 bp, M. musculus
aggagcttgaggaaaa

SEQ ID NO: 360915 - DNA, 18 bp, M. musculus
aggagcttgcagaagcag

SEQ ID NO: 360916 - DNA, 16 bp, M. musculus
aggagcttgctgccaa

SEQ ID NO: 360917 - DNA, 16 bp, M. musculus
aggaggaaagggtccc

SEQ ID NO: 360918 - DNA, 16 bp, M. musculus
aggaggaaatgcagag

SEQ ID NO: 360919 - DNA, 16 bp, M. musculus
aggaggaactgggagg

SEQ ID NO: 360920 - DNA, 16 bp, M. musculus
aggaggaagaagtggc

SEQ ID NO: 360921 - DNA, 16 bp, M. musculus
aggaggaagagctgag

SEQ ID NO: 360922 - DNA, 16 bp, M. musculus
aggaggaagaggctga

SEQ ID NO: 360923 - DNA, 16 bp, M. musculus
aggaggaagatggaca

SEQ ID NO: 360924 - DNA, 16 bp, M. musculus
aggaggaaggcagctg

SEQ ID NO: 360925 - DNA, 16 bp, M. musculus
aggaggacaggacagg

SEQ ID NO: 360926 - DNA, 16 bp, M. musculus
aggaggaccaacagtc

SEQ ID NO: 360927 - DNA, 16 bp, M. musculus
aggaggaccagctgtc

SEQ ID NO: 360928 - DNA, 16 bp, M. musculus
aggaggaccagggcct

SEQ ID NO: 360929 - DNA, 16 bp, M. musculus
aggaggacctgagagt

SEQ ID NO: 360930 - DNA, 16 bp, M. musculus
aggaggagagtctcaa

SEQ ID NO: 360931 - DNA, 16 bp, M. musculus
aggaggagcagaagca

SEQ ID NO: 360932 - DNA, 16 bp, M. musculus
aggaggagcagaagtt

SEQ ID NO: 360933 - DNA, 16 bp, M. musculus
aggaggagcagagagt

SEQ ID NO: 360934 - DNA, 16 bp, M. musculus
aggaggagcaggagtt

SEQ ID NO: 360935 - DNA, 16 bp, M. musculus
aggaggagctgatgca

SEQ ID NO: 360936 - DNA, 16 bp, M. musculus
aggaggagctggaggg

SEQ ID NO: 360937 - DNA, 16 bp, M. musculus
aggaggaggaacagca

SEQ ID NO: 360938 - DNA, 16 bp, M. musculus
aggaggaggaagagtt

SEQ ID NO: 360939 - DNA, 16 bp, M. musculus
aggaggaggaagctgg

SEQ ID NO: 360940 - DNA, 16 bp, M. musculus
aggaggaggagccaga

SEQ ID NO: 360941 - DNA, 16 bp, M. musculus
aggaggaggaggaacc

SEQ ID NO: 360942 - DNA, 16 bp, M. musculus
aggaggaggaggaact

SEQ ID NO: 360943 - DNA, 16 bp, M. musculus
aggaggaggaggactc

SEQ ID NO: 360944 - DNA, 16 bp, M. musculus
aggaggaggaggagtc

SEQ ID NO: 360945 - DNA, 16 bp, M. musculus
aggaggaggaggattc

SEQ ID NO: 360946 - DNA, 16 bp, M. musculus
aggaggaggaggctgt

SEQ ID NO: 360947 - DNA, 16 bp, M. musculus
aggaggaggagggctg

SEQ ID NO: 360948 - DNA, 16 bp, M. musculus
aggaggaggcagaggt

SEQ ID NO: 360949 - DNA, 16 bp, M. musculus
aggaggaggctgtgag

SEQ ID NO: 360950 - DNA, 16 bp, M. musculus
aggaggagggcagccc

SEQ ID NO: 360951 - DNA, 16 bp, M. musculus
aggaggaggtggtggc

SEQ ID NO: 360952 - DNA, 16 bp, M. musculus
aggaggatcaccatga

SEQ ID NO: 360953 - DNA, 16 bp, M. musculus
aggaggatcagcagtt

SEQ ID NO: 360954 - DNA, 16 bp, M. musculus
aggaggatcaggagtc

SEQ ID NO: 360955 - DNA, 16 bp, M. musculus
aggaggatccagcaat

SEQ ID NO: 360956 - DNA, 16 bp, M. musculus
aggaggatctctgggg

SEQ ID NO: 360957 - DNA, 16 bp, M. musculus
aggaggatctctgtgg

SEQ ID NO: 360958 - DNA, 16 bp, M. musculus
aggaggatgctggaga

SEQ ID NO: 360959 - DNA, 16 bp, M. musculus
aggaggatggggcagg

SEQ ID NO: 360960 - DNA, 16 bp, M. musculus
aggaggatgtctgtga

SEQ ID NO: 360961 - DNA, 16 bp, M. musculus
aggaggatgtggacct

SEQ ID NO: 360962 - DNA, 16 bp, M. musculus
aggaggatgtggagaa

SEQ ID NO: 360963 - DNA, 16 bp, M. musculus
aggaggattgctataa

SEQ ID NO: 360964 - DNA, 16 bp, M. musculus
aggaggattgtgagtt

SEQ ID NO: 360965 - DNA, 16 bp, M. musculus
aggaggatttcaagtt

SEQ ID NO: 360966 - DNA, 16 bp, M. musculus
aggaggatttctatga

SEQ ID NO: 360967 - DNA, 19 bp, M. musculus
aggaggatttctgagtttg

SEQ ID NO: 360968 - DNA, 16 bp, M. musculus
aggaggcaaaggcaga

SEQ ID NO: 360969 - DNA, 16 bp, M. musculus
aggaggcaaagtttcc

SEQ ID NO: 360970 - DNA, 16 bp, M. musculus
aggaggcacagaagct

SEQ ID NO: 360971 - DNA, 16 bp, M. musculus
aggaggcacaggaggc

SEQ ID NO: 360972 - DNA, 16 bp, M. musculus
aggaggcagaaagact

SEQ ID NO: 360973 - DNA, 16 bp, M. musculus
aggaggcagaaagagt

SEQ ID NO: 360974 - DNA, 16 bp, M. musculus
aggaggcagaagcaga

SEQ ID NO: 360975 - DNA, 16 bp, M. musculus
aggaggcagaagcagg

SEQ ID NO: 360976 - DNA, 16 bp, M. musculus
aggaggcagaagctgg

SEQ ID NO: 360977 - DNA, 16 bp, M. musculus
aggaggcagacacaga

SEQ ID NO: 360978 - DNA, 16 bp, M. musculus
aggaggcagagacagg

SEQ ID NO: 360979 - DNA, 16 bp, M. musculus
aggaggcagagagatg

SEQ ID NO: 360980 - DNA, 16 bp, M. musculus
aggaggcagagagtga

SEQ ID NO: 360981 - DNA, 16 bp, M. musculus
aggaggcagagcctgg

SEQ ID NO: 360982 - DNA, 16 bp, M. musculus
aggaggcagagctggg

SEQ ID NO: 360983 - DNA, 16 bp, M. musculus
aggaggcagaggcaag

SEQ ID NO: 360984 - DNA, 16 bp, M. musculus
aggaggcagaggcaga

SEQ ID NO: 360985 - DNA, 16 bp, M. musculus
aggaggcagaggcagc

SEQ ID NO: 360986 - DNA, 19 bp, M. musculus
aggaggcagaggcagtcgg

SEQ ID NO: 360987 - DNA, 16 bp, M. musculus
aggaggcagaggctct

SEQ ID NO: 360988 - DNA, 16 bp, M. musculus
aggaggcagaggctga

SEQ ID NO: 360989 - DNA, 16 bp, M. musculus
aggaggcagaggtaag

SEQ ID NO: 360990 - DNA, 16 bp, M. musculus
aggaggcagagtcagc

SEQ ID NO: 360991 - DNA, 16 bp, M. musculus
aggaggcagatgcaga

SEQ ID NO: 360992 - DNA, 16 bp, M. musculus
aggaggcagatggagg

SEQ ID NO: 360993 - DNA, 16 bp, M. musculus
aggaggcagcagcagc

SEQ ID NO: 360994 - DNA, 16 bp, M. musculus
aggaggcaggaagagt

SEQ ID NO: 360995 - DNA, 16 bp, M. musculus
aggaggcaggggtagg

SEQ ID NO: 360996 - DNA, 16 bp, M. musculus
aggaggcagtgacagg

SEQ ID NO: 360997 - DNA, 16 bp, M. musculus
aggaggcagtggcagg

SEQ ID NO: 360998 - DNA, 16 bp, M. musculus
aggaggcatggccttg

SEQ ID NO: 360999 - DNA, 16 bp, M. musculus
aggaggccaaggcaga

SEQ ID NO: 361000 - DNA, 16 bp, M. musculus
aggaggccaggaggcc

SEQ ID NO: 361001 - DNA, 16 bp, M. musculus
aggaggccatgttcca

SEQ ID NO: 361002 - DNA, 16 bp, M. musculus
aggaggcgtggccttg

SEQ ID NO: 361003 - DNA, 16 bp, M. musculus
aggaggctgaagcagg

SEQ ID NO: 361004 - DNA, 16 bp, M. musculus
aggaggctgagaaaga

SEQ ID NO: 361005 - DNA, 16 bp, M. musculus
aggaggctgagacagg

SEQ ID NO: 361006 - DNA, 16 bp, M. musculus
aggaggctgaggaagg

SEQ ID NO: 361007 - DNA, 16 bp, M. musculus
aggaggctgaggaggc

SEQ ID NO: 361008 - DNA, 16 bp, M. musculus
aggaggctgaggaggg

SEQ ID NO: 361009 - DNA, 20 bp, M. musculus
aggaggctgaggcaggagaa

SEQ ID NO: 361010 - DNA, 16 bp, M. musculus
aggaggctgctgcaga

SEQ ID NO: 361011 - DNA, 16 bp, M. musculus
aggaggctggaggcag

SEQ ID NO: 361012 - DNA, 16 bp, M. musculus
aggagggaaacactac

SEQ ID NO: 361013 - DNA, 16 bp, M. musculus
aggagggaaccaactc

SEQ ID NO: 361014 - DNA, 16 bp, M. musculus
aggagggaacctcagt

SEQ ID NO: 361015 - DNA, 16 bp, M. musculus
aggagggaacttcagt

SEQ ID NO: 361016 - DNA, 16 bp, M. musculus
aggagggacctgggag

SEQ ID NO: 361017 - DNA, 16 bp, M. musculus
aggagggaggggcctg

SEQ ID NO: 361018 - DNA, 16 bp, M. musculus
aggagggaggtctgaa

SEQ ID NO: 361019 - DNA, 16 bp, M. musculus
aggagggagtgaagct

SEQ ID NO: 361020 - DNA, 16 bp, M. musculus
aggagggcaaccctat

SEQ ID NO: 361021 - DNA, 16 bp, M. musculus
aggagggcatcagatc

SEQ ID NO: 361022 - DNA, 16 bp, M. musculus
aggagggccagcacca

SEQ ID NO: 361023 - DNA, 16 bp, M. musculus
aggagggccaggatgc

SEQ ID NO: 361024 - DNA, 16 bp, M. musculus
aggagggctactgatt

SEQ ID NO: 361025 - DNA, 16 bp, M. musculus
aggaggggcaagcagc

SEQ ID NO: 361026 - DNA, 16 bp, M. musculus
aggaggggccaccttc

SEQ ID NO: 361027 - DNA, 16 bp, M. musculus
aggagggggctggtga

SEQ ID NO: 361028 - DNA, 16 bp, M. musculus
aggagggtgaggcagg

SEQ ID NO: 361029 - DNA, 16 bp, M. musculus
aggagggttgtggttt

SEQ ID NO: 361030 - DNA, 16 bp, M. musculus
aggaggtagacacagg

SEQ ID NO: 361031 - DNA, 17 bp, M. musculus
aggaggtagaggcagga

SEQ ID NO: 361032 - DNA, 16 bp, M. musculus
aggaggtatgagatgt

SEQ ID NO: 361033 - DNA, 16 bp, M. musculus
aggaggtcagaagaca

SEQ ID NO: 361034 - DNA, 16 bp, M. musculus
aggaggtcagaagatg

SEQ ID NO: 361035 - DNA, 16 bp, M. musculus
aggaggtggagcctgg

SEQ ID NO: 361036 - DNA, 16 bp, M. musculus
aggaggtggagctgat

SEQ ID NO: 361037 - DNA, 16 bp, M. musculus
aggaggtggaggctgg

SEQ ID NO: 361038 - DNA, 16 bp, M. musculus
aggaggtgggaggacc

SEQ ID NO: 361039 - DNA, 16 bp, M. musculus
aggaggtggtggtggc

SEQ ID NO: 361040 - DNA, 16 bp, M. musculus
aggaggtgtggccttg

SEQ ID NO: 361041 - DNA, 16 bp, M. musculus
aggaggtgtgtcacca

SEQ ID NO: 361042 - DNA, 16 bp, M. musculus
aggaggtgtgtcactg

SEQ ID NO: 361043 - DNA, 16 bp, M. musculus
aggaggtgtgtctctg

SEQ ID NO: 361044 - DNA, 16 bp, M. musculus
aggaggtgtgttactg

SEQ ID NO: 361045 - DNA, 16 bp, M. musculus
aggaggttagaagagg

SEQ ID NO: 361046 - DNA, 16 bp, M. musculus
aggaggttcaggagtt

SEQ ID NO: 361047 - DNA, 16 bp, M. musculus
aggaggtttgagagag

SEQ ID NO: 361048 - DNA, 16 bp, M. musculus
aggagtacagagacaa

SEQ ID NO: 361049 - DNA, 16 bp, M. musculus
aggagtaccagcagtc

SEQ ID NO: 361050 - DNA, 17 bp, M. musculus
aggagtacccagtctct

SEQ ID NO: 361051 - DNA, 37 bp, M. musculus
aggagtagaaaccataggcatttgagcaacttcttca

SEQ ID NO: 361052 - DNA, 16 bp, M. musculus
aggagtagaaaccctg

SEQ ID NO: 361053 - DNA, 16 bp, M. musculus
aggagtcagaagcagg

SEQ ID NO: 361054 - DNA, 16 bp, M. musculus
aggagtcagtcagagg

SEQ ID NO: 361055 - DNA, 16 bp, M. musculus
aggagtccagaagatc

SEQ ID NO: 361056 - DNA, 16 bp, M. musculus
aggagtctagccagaa

SEQ ID NO: 361057 - DNA, 16 bp, M. musculus
aggagtctgaggaaaa

SEQ ID NO: 361058 - DNA, 16 bp, M. musculus
aggagtcttcctcttt

SEQ ID NO: 361059 - DNA, 17 bp, M. musculus
aggagtgcaaaaagagt

SEQ ID NO: 361060 - DNA, 16 bp, M. musculus
aggagtgctgcttact

SEQ ID NO: 361061 - DNA, 16 bp, M. musculus
aggagtggataaagaa

SEQ ID NO: 361062 - DNA, 16 bp, M. musculus
aggagtggggacggga

SEQ ID NO: 361063 - DNA, 16 bp, M. musculus
aggagtgggtgggcag

SEQ ID NO: 361064 - DNA, 16 bp, M. musculus
aggagtgtaccaccat

SEQ ID NO: 361065 - DNA, 16 bp, M. musculus
aggagtgtcactgtgg

SEQ ID NO: 361066 - DNA, 16 bp, M. musculus
aggagtgtgggttcat

SEQ ID NO: 361067 - DNA, 18 bp, M. musculus
aggagtgttctgggaaca

SEQ ID NO: 361068 - DNA, 16 bp, M. musculus
aggagtgttgtatttt

SEQ ID NO: 361069 - DNA, 16 bp, M. musculus
aggagtgtttttcttt

SEQ ID NO: 361070 - DNA, 16 bp, M. musculus
aggagttaaagagatc

SEQ ID NO: 361071 - DNA, 16 bp, M. musculus
aggagttacagacaaa

SEQ ID NO: 361072 - DNA, 16 bp, M. musculus
aggagttacagagtca

SEQ ID NO: 361073 - DNA, 16 bp, M. musculus
aggagttaggagaaag

SEQ ID NO: 361074 - DNA, 16 bp, M. musculus
aggagttagggcaagg

SEQ ID NO: 361075 - DNA, 16 bp, M. musculus
aggagttcaagaccat

SEQ ID NO: 361076 - DNA, 16 bp, M. musculus
aggagttcaaggccaa

SEQ ID NO: 361077 - DNA, 16 bp, M. musculus
aggagttctctggtgg

SEQ ID NO: 361078 - DNA, 16 bp, M. musculus
aggagttctctggtgt

SEQ ID NO: 361079 - DNA, 16 bp, M. musculus
aggagttgaaggccag

SEQ ID NO: 361080 - DNA, 16 bp, M. musculus
aggagttggttttctc

SEQ ID NO: 361081 - DNA, 16 bp, M. musculus
aggagtttaagaagga

SEQ ID NO: 361082 - DNA, 16 bp, M. musculus
aggagtttagcctgaa

SEQ ID NO: 361083 - DNA, 16 bp, M. musculus
aggagtttgctgtgag

SEQ ID NO: 361084 - DNA, 16 bp, M. musculus
aggataaacaggatga

SEQ ID NO: 361085 - DNA, 16 bp, M. musculus
aggataaacagggtga

SEQ ID NO: 361086 - DNA, 16 bp, M. musculus
aggataacctgggcta

SEQ ID NO: 361087 - DNA, 16 bp, M. musculus
aggataaccttgaact

SEQ ID NO: 361088 - DNA, 16 bp, M. musculus
aggataaggataagga

SEQ ID NO: 361089 - DNA, 16 bp, M. musculus
aggataatgaacattt

SEQ ID NO: 361090 - DNA, 16 bp, M. musculus
aggataatgacagaaa

SEQ ID NO: 361091 - DNA, 17 bp, M. musculus
aggataattctccttaa

SEQ ID NO: 361092 - DNA, 16 bp, M. musculus
aggatacagagacagt

SEQ ID NO: 361093 - DNA, 16 bp, M. musculus
aggatagacaggctga

SEQ ID NO: 361094 - DNA, 16 bp, M. musculus
aggatagcaaacatga

SEQ ID NO: 361095 - DNA, 16 bp, M. musculus
aggatagccatgctag

SEQ ID NO: 361096 - DNA, 16 bp, M. musculus
aggatagcctggaact

SEQ ID NO: 361097 - DNA, 16 bp, M. musculus
aggatagctatgaatg

SEQ ID NO: 361098 - DNA, 16 bp, M. musculus
aggatagctttgaact

SEQ ID NO: 361099 - DNA, 16 bp, M. musculus
aggatagtcagggcta

SEQ ID NO: 361100 - DNA, 16 bp, M. musculus
aggatagtgaaaacaa

SEQ ID NO: 361101 - DNA, 16 bp, M. musculus
aggatataaagtgaat

SEQ ID NO: 361102 - DNA, 16 bp, M. musculus
aggatatgagggaagt

SEQ ID NO: 361103 - DNA, 16 bp, M. musculus
aggatatgccagagac

SEQ ID NO: 361104 - DNA, 16 bp, M. musculus
aggatatgggggaagt

SEQ ID NO: 361105 - DNA, 16 bp, M. musculus
aggatattgaacactt

SEQ ID NO: 361106 - DNA, 18 bp, M. musculus
aggatcaaacccagggcc

SEQ ID NO: 361107 - DNA, 16 bp, M. musculus
aggatcacaagttcaa

SEQ ID NO: 361108 - DNA, 16 bp, M. musculus
aggatcacaagtttaa

SEQ ID NO: 361109 - DNA, 16 bp, M. musculus
aggatcagaaattaaa

SEQ ID NO: 361110 - DNA, 16 bp, M. musculus
aggatcagaaattcaa

SEQ ID NO: 361111 - DNA, 16 bp, M. musculus
aggatcagaagttcag

SEQ ID NO: 361112 - DNA, 16 bp, M. musculus
aggatcagattaacga

SEQ ID NO: 361113 - DNA, 16 bp, M. musculus
aggatcagattagtga

SEQ ID NO: 361114 - DNA, 16 bp, M. musculus
aggatcaggaatggga

SEQ ID NO: 361115 - DNA, 16 bp, M. musculus
aggatcaggaatttga

SEQ ID NO: 361116 - DNA, 16 bp, M. musculus
aggatcaggaggtcaa

SEQ ID NO: 361117 - DNA, 16 bp, M. musculus
aggatcaggagttcaa

SEQ ID NO: 361118 - DNA, 16 bp, M. musculus
aggatcatattttcta

SEQ ID NO: 361119 - DNA, 19 bp, M. musculus
aggatcatcgacaacagct

SEQ ID NO: 361120 - DNA, 16 bp, M. musculus
aggatccaatgccttc

SEQ ID NO: 361121 - DNA, 16 bp, M. musculus
aggatccaggtttggt

SEQ ID NO: 361122 - DNA, 16 bp, M. musculus
aggatccatgggtcca

SEQ ID NO: 361123 - DNA, 16 bp, M. musculus
aggatcccacccagct

SEQ ID NO: 361124 - DNA, 16 bp, M. musculus
aggatcccagaatccc

SEQ ID NO: 361125 - DNA, 16 bp, M. musculus
aggatcccctggagct

SEQ ID NO: 361126 - DNA, 16 bp, M. musculus
aggatcccgtggcaga

SEQ ID NO: 361127 - DNA, 16 bp, M. musculus
aggatcctggaaggaa

SEQ ID NO: 361128 - DNA, 16 bp, M. musculus
aggatcctggaggcag

SEQ ID NO: 361129 - DNA, 16 bp, M. musculus
aggatcctgtcccagg

SEQ ID NO: 361130 - DNA, 16 bp, M. musculus
aggatcctgtggggag

SEQ ID NO: 361131 - DNA, 24 bp, M. musculus
aggatccttctgcacacgtttatt

SEQ ID NO: 361132 - DNA, 17 bp, M. musculus
aggatctaaaaatggaa

SEQ ID NO: 361133 - DNA, 16 bp, M. musculus
aggatctcactatgta

SEQ ID NO: 361134 - DNA, 16 bp, M. musculus
aggatctccatgacac

SEQ ID NO: 361135 - DNA, 16 bp, M. musculus
aggatctcctgtagcc

SEQ ID NO: 361136 - DNA, 16 bp, M. musculus
aggatctctgagtttg

SEQ ID NO: 361137 - DNA, 16 bp, M. musculus
aggatctgatggtgtt

SEQ ID NO: 361138 - DNA, 16 bp, M. musculus
aggatctgggttcagt

SEQ ID NO: 361139 - DNA, 16 bp, M. musculus
aggatcttaaagccca

SEQ ID NO: 361140 - DNA, 16 bp, M. musculus
aggatcttactatgta

SEQ ID NO: 361141 - DNA, 16 bp, M. musculus
aggatcttcaggcttt

SEQ ID NO: 361142 - DNA, 16 bp, M. musculus
aggatcttctggcttt

SEQ ID NO: 361143 - DNA, 16 bp, M. musculus
aggatcttctgggttt

SEQ ID NO: 361144 - DNA, 17 bp, M. musculus
aggatctttttgcactt

SEQ ID NO: 361145 - DNA, 16 bp, M. musculus
aggatctttttgcagt

SEQ ID NO: 361146 - DNA, 16 bp, M. musculus
aggatgaaatgtttca

SEQ ID NO: 361147 - DNA, 16 bp, M. musculus
aggatgaacttgaact

SEQ ID NO: 361148 - DNA, 16 bp, M. musculus
aggatgaagaagatgg

SEQ ID NO: 361149 - DNA, 16 bp, M. musculus
aggatgaagtcaaaat

SEQ ID NO: 361150 - DNA, 16 bp, M. musculus
aggatgaatatgatca

SEQ ID NO: 361151 - DNA, 16 bp, M. musculus
aggatgacacagagaa

SEQ ID NO: 361152 - DNA, 16 bp, M. musculus
aggatgaccctgaact

SEQ ID NO: 361153 - DNA, 16 bp, M. musculus
aggatgacctcgaact

SEQ ID NO: 361154 - DNA, 16 bp, M. musculus
aggatgaccttcaact

SEQ ID NO: 361155 - DNA, 16 bp, M. musculus
aggatgaccttgaact

SEQ ID NO: 361156 - DNA, 16 bp, M. musculus
aggatgaccttgaatt

SEQ ID NO: 361157 - DNA, 16 bp, M. musculus
aggatgaccttgacct

SEQ ID NO: 361158 - DNA, 16 bp, M. musculus
aggatgaccttggact

SEQ ID NO: 361159 - DNA, 17 bp, M. musculus
aggatgacgtgtgtgct

SEQ ID NO: 361160 - DNA, 16 bp, M. musculus
aggatgactttgaact

SEQ ID NO: 361161 - DNA, 16 bp, M. musculus
aggatgaggagttcag

SEQ ID NO: 361162 - DNA, 16 bp, M. musculus
aggatgagggtctgaa

SEQ ID NO: 361163 - DNA, 16 bp, M. musculus
aggatgatatatttta

SEQ ID NO: 361164 - DNA, 16 bp, M. musculus
aggatgatgccctcaa

SEQ ID NO: 361165 - DNA, 16 bp, M. musculus
aggatgcagaagcagg

SEQ ID NO: 361166 - DNA, 16 bp, M. musculus
aggatgcagagagaga

SEQ ID NO: 361167 - DNA, 16 bp, M. musculus
aggatgcagaggaaga

SEQ ID NO: 361168 - DNA, 16 bp, M. musculus
aggatgcagaggagga

SEQ ID NO: 361169 - DNA, 16 bp, M. musculus
aggatgcagcacagaa

SEQ ID NO: 361170 - DNA, 16 bp, M. musculus
aggatgcagctctcag

SEQ ID NO: 361171 - DNA, 16 bp, M. musculus
aggatgcatgggattt

SEQ ID NO: 361172 - DNA, 16 bp, M. musculus
aggatgcccttgaact

SEQ ID NO: 361173 - DNA, 16 bp, M. musculus
aggatgctccccctcc

SEQ ID NO: 361174 - DNA, 16 bp, M. musculus
aggatgctgaacagtt

SEQ ID NO: 361175 - DNA, 16 bp, M. musculus
aggatgctgaaggagg

SEQ ID NO: 361176 - DNA, 16 bp, M. musculus
aggatgctgagaagag

SEQ ID NO: 361177 - DNA, 16 bp, M. musculus
aggatgctgattcccc

SEQ ID NO: 361178 - DNA, 16 bp, M. musculus
aggatgctgctgtgct

SEQ ID NO: 361179 - DNA, 16 bp, M. musculus
aggatgctgtccctct

SEQ ID NO: 361180 - DNA, 16 bp, M. musculus
aggatgcttgcctagc

SEQ ID NO: 361181 - DNA, 16 bp, M. musculus
aggatggaaaccacac

SEQ ID NO: 361182 - DNA, 16 bp, M. musculus
aggatggaaggagctg

SEQ ID NO: 361183 - DNA, 16 bp, M. musculus
aggatggacagagaga

SEQ ID NO: 361184 - DNA, 16 bp, M. musculus
aggatggacagggagg

SEQ ID NO: 361185 - DNA, 16 bp, M. musculus
aggatggaccatccaa

SEQ ID NO: 361186 - DNA, 16 bp, M. musculus
aggatggactacccag

SEQ ID NO: 361187 - DNA, 16 bp, M. musculus
aggatggatcccaagt

SEQ ID NO: 361188 - DNA, 16 bp, M. musculus
aggatggattcccagg

SEQ ID NO: 361189 - DNA, 16 bp, M. musculus
aggatggcaagttcaa

SEQ ID NO: 361190 - DNA, 16 bp, M. musculus
aggatggcactgccca

SEQ ID NO: 361191 - DNA, 16 bp, M. musculus
aggatggccattttta

SEQ ID NO: 361192 - DNA, 16 bp, M. musculus
aggatggcctcaaact

SEQ ID NO: 361193 - DNA, 16 bp, M. musculus
aggatggccttgaact

SEQ ID NO: 361194 - DNA, 16 bp, M. musculus
aggatggccttgaagt

SEQ ID NO: 361195 - DNA, 16 bp, M. musculus
aggatggctcagctgc

SEQ ID NO: 361196 - DNA, 16 bp, M. musculus
aggatggctttgtggg

SEQ ID NO: 361197 - DNA, 16 bp, M. musculus
aggatgggtcttccca

SEQ ID NO: 361198 - DNA, 16 bp, M. musculus
aggatggtgattccac

SEQ ID NO: 361199 - DNA, 16 bp, M. musculus
aggatggtgtggaaga

SEQ ID NO: 361200 - DNA, 16 bp, M. musculus
aggatgtagaactctc

SEQ ID NO: 361201 - DNA, 16 bp, M. musculus
aggatgtagctcagtt

SEQ ID NO: 361202 - DNA, 16 bp, M. musculus
aggatgtcatcctgag

SEQ ID NO: 361203 - DNA, 16 bp, M. musculus
aggatgtcctcattcc

SEQ ID NO: 361204 - DNA, 16 bp, M. musculus
aggatgtgaagaaaga

SEQ ID NO: 361205 - DNA, 16 bp, M. musculus
aggatgtgaaggaaga

SEQ ID NO: 361206 - DNA, 16 bp, M. musculus
aggatgtgactgttct

SEQ ID NO: 361207 - DNA, 16 bp, M. musculus
aggatgtgatgatttt

SEQ ID NO: 361208 - DNA, 16 bp, M. musculus
aggatgtggacctgtt

SEQ ID NO: 361209 - DNA, 16 bp, M. musculus
aggatgtggagaagga

SEQ ID NO: 361210 - DNA, 16 bp, M. musculus
aggatgtggctcagtt

SEQ ID NO: 361211 - DNA, 17 bp, M. musculus
aggatgtgtctctggaa

SEQ ID NO: 361212 - DNA, 16 bp, M. musculus
aggatgttctgttaaa

SEQ ID NO: 361213 - DNA, 16 bp, M. musculus
aggatgttttctagtt

SEQ ID NO: 361214 - DNA, 16 bp, M. musculus
aggatgtttttgcatt

SEQ ID NO: 361215 - DNA, 16 bp, M. musculus
aggattaaaggtgtgc

SEQ ID NO: 361216 - DNA, 16 bp, M. musculus
aggattacaaatgtgt

SEQ ID NO: 361217 - DNA, 16 bp, M. musculus
aggattcctgggactt

SEQ ID NO: 361218 - DNA, 16 bp, M. musculus
aggattctgctagcag

SEQ ID NO: 361219 - DNA, 16 bp, M. musculus
aggattctggaggcag

SEQ ID NO: 361220 - DNA, 16 bp, M. musculus
aggattgaacccaggg

SEQ ID NO: 361221 - DNA, 16 bp, M. musculus
aggattgccaggagtt

SEQ ID NO: 361222 - DNA, 16 bp, M. musculus
aggattgccatgaatt

SEQ ID NO: 361223 - DNA, 16 bp, M. musculus
aggattgctgtgagtt

SEQ ID NO: 361224 - DNA, 16 bp, M. musculus
aggattgtgggccctg

SEQ ID NO: 361225 - DNA, 16 bp, M. musculus
aggattgtttatgtaa

SEQ ID NO: 361226 - DNA, 16 bp, M. musculus
aggatttaaaaatgga

SEQ ID NO: 361227 - DNA, 21 bp, M. musculus
aggatttagaaaacataaagc

SEQ ID NO: 361228 - DNA, 16 bp, M. musculus
aggatttatttggctt

SEQ ID NO: 361229 - DNA, 16 bp, M. musculus
aggatttattttggtt

SEQ ID NO: 361230 - DNA, 16 bp, M. musculus
aggatttcagggtctc

SEQ ID NO: 361231 - DNA, 16 bp, M. musculus
aggatttctgagttca

SEQ ID NO: 361232 - DNA, 16 bp, M. musculus
aggatttctgagttcg

SEQ ID NO: 361233 - DNA, 16 bp, M. musculus
aggatttctgtgagtt

SEQ ID NO: 361234 - DNA, 16 bp, M. musculus
aggatttgaacccagg

SEQ ID NO: 361235 - DNA, 16 bp, M. musculus
aggatttgaattcagg

SEQ ID NO: 361236 - DNA, 16 bp, M. musculus
aggatttgcttttgtg

SEQ ID NO: 361237 - DNA, 16 bp, M. musculus
aggatttggaaaacat

SEQ ID NO: 361238 - DNA, 16 bp, M. musculus
aggatttggagaaaga

SEQ ID NO: 361239 - DNA, 16 bp, M. musculus
aggatttgggaggcag

SEQ ID NO: 361240 - DNA, 16 bp, M. musculus
aggattttagggtttt

SEQ ID NO: 361241 - DNA, 16 bp, M. musculus
aggattttattttctt

SEQ ID NO: 361242 - DNA, 16 bp, M. musculus
aggattttctgacctg

SEQ ID NO: 361243 - DNA, 17 bp, M. musculus
aggattttgtctctgtg

SEQ ID NO: 361244 - DNA, 16 bp, M. musculus
aggatttttattcaag

SEQ ID NO: 361245 - DNA, 16 bp, M. musculus
aggatttttgcattga

SEQ ID NO: 361246 - DNA, 16 bp, M. musculus
aggatttttttccccc

SEQ ID NO: 361247 - DNA, 16 bp, M. musculus
aggatttttttttcca

SEQ ID NO: 361248 - DNA, 16 bp, M. musculus
aggcaaaaatactcaa

SEQ ID NO: 361249 - DNA, 16 bp, M. musculus
aggcaaaacacacata

SEQ ID NO: 361250 - DNA, 16 bp, M. musculus
aggcaaaacactcata

SEQ ID NO: 361251 - DNA, 16 bp, M. musculus
aggcaaaacagccata

SEQ ID NO: 361252 - DNA, 16 bp, M. musculus
aggcaaaacatgcata

SEQ ID NO: 361253 - DNA, 16 bp, M. musculus
aggcaaaacattcaga

SEQ ID NO: 361254 - DNA, 16 bp, M. musculus
aggcaaaactctcata

SEQ ID NO: 361255 - DNA, 16 bp, M. musculus
aggcaaaactgtgaag

SEQ ID NO: 361256 - DNA, 16 bp, M. musculus
aggcaaaagaaactgt

SEQ ID NO: 361257 - DNA, 16 bp, M. musculus
aggcaaaagaatcaga

SEQ ID NO: 361258 - DNA, 16 bp, M. musculus
aggcaaaagacagcat

SEQ ID NO: 361259 - DNA, 16 bp, M. musculus
aggcaaaagcaagcag

SEQ ID NO: 361260 - DNA, 16 bp, M. musculus
aggcaaaataataata

SEQ ID NO: 361261 - DNA, 16 bp, M. musculus
aggcaaaatacccata

SEQ ID NO: 361262 - DNA, 16 bp, M. musculus
aggcaaaatatccata

SEQ ID NO: 361263 - DNA, 16 bp, M. musculus
aggcaaacacccatac

SEQ ID NO: 361264 - DNA, 16 bp, M. musculus
aggcaaacatttcatt

SEQ ID NO: 361265 - DNA, 16 bp, M. musculus
aggcaaagacaggaga

SEQ ID NO: 361266 - DNA, 16 bp, M. musculus
aggcaaagacaggcag

SEQ ID NO: 361267 - DNA, 16 bp, M. musculus
aggcaaagctggagat

SEQ ID NO: 361268 - DNA, 16 bp, M. musculus
aggcaaaggaaactgt

SEQ ID NO: 361269 - DNA, 16 bp, M. musculus
aggcaaaggacacagt

SEQ ID NO: 361270 - DNA, 16 bp, M. musculus
aggcaaaggacactga

SEQ ID NO: 361271 - DNA, 16 bp, M. musculus
aggcaaaggacactgg

SEQ ID NO: 361272 - DNA, 16 bp, M. musculus
aggcaaaggcacttgc

SEQ ID NO: 361273 - DNA, 16 bp, M. musculus
aggcaaaggcagacag

SEQ ID NO: 361274 - DNA, 16 bp, M. musculus
aggcaaaggcagatga

SEQ ID NO: 361275 - DNA, 17 bp, M. musculus
aggcaaaggcaggtgga

SEQ ID NO: 361276 - DNA, 16 bp, M. musculus
aggcaaaggcagtcag

SEQ ID NO: 361277 - DNA, 16 bp, M. musculus
aggcaaatagatctct

SEQ ID NO: 361278 - DNA, 16 bp, M. musculus
aggcaaatgaatggag

SEQ ID NO: 361279 - DNA, 16 bp, M. musculus
aggcaaattgatggaa

SEQ ID NO: 361280 - DNA, 16 bp, M. musculus
aggcaacaaagacaca

SEQ ID NO: 361281 - DNA, 16 bp, M. musculus
aggcaacagagcttct

SEQ ID NO: 361282 - DNA, 16 bp, M. musculus
aggcaacagagtcaga

SEQ ID NO: 361283 - DNA, 16 bp, M. musculus
aggcaaccaggaggag

SEQ ID NO: 361284 - DNA, 16 bp, M. musculus
aggcaacccagaagga

SEQ ID NO: 361285 - DNA, 16 bp, M. musculus
aggcaacctcagaaaa

SEQ ID NO: 361286 - DNA, 16 bp, M. musculus
aggcaagaaaaccacc

SEQ ID NO: 361287 - DNA, 16 bp, M. musculus
aggcaagaacaagaac

SEQ ID NO: 361288 - DNA, 16 bp, M. musculus
aggcaagagcaagaac

SEQ ID NO: 361289 - DNA, 16 bp, M. musculus
aggcaagagccagaga

SEQ ID NO: 361290 - DNA, 16 bp, M. musculus
aggcaagaggaccaga

SEQ ID NO: 361291 - DNA, 16 bp, M. musculus
aggcaagaggagcaga

SEQ ID NO: 361292 - DNA, 16 bp, M. musculus
aggcaagagtgaagac

SEQ ID NO: 361293 - DNA, 16 bp, M. musculus
aggcaagcaccttacc

SEQ ID NO: 361294 - DNA, 16 bp, M. musculus
aggcaagcactccacc

SEQ ID NO: 361295 - DNA, 17 bp, M. musculus
aggcaagcataagaaca

SEQ ID NO: 361296 - DNA, 16 bp, M. musculus
aggcaagcattctacc

SEQ ID NO: 361297 - DNA, 16 bp, M. musculus
aggcaagccagggcta

SEQ ID NO: 361298 - DNA, 16 bp, M. musculus
aggcaagccctctgcc

SEQ ID NO: 361299 - DNA, 16 bp, M. musculus
aggcaagcctgggcta

SEQ ID NO: 361300 - DNA, 16 bp, M. musculus
aggcaagcctggtcta

SEQ ID NO: 361301 - DNA, 16 bp, M. musculus
aggcaaggattttaca

SEQ ID NO: 361302 - DNA, 16 bp, M. musculus
aggcaagggcaagaac

SEQ ID NO: 361303 - DNA, 16 bp, M. musculus
aggcaagggctggaga

SEQ ID NO: 361304 - DNA, 16 bp, M. musculus
aggcaaggggtggggc

SEQ ID NO: 361305 - DNA, 16 bp, M. musculus
aggcaaggtgctggag

SEQ ID NO: 361306 - DNA, 16 bp, M. musculus
aggcaagtcttttttt

SEQ ID NO: 361307 - DNA, 16 bp, M. musculus
aggcaagtgaatggaa

SEQ ID NO: 361308 - DNA, 16 bp, M. musculus
aggcaagtgctctaca

SEQ ID NO: 361309 - DNA, 16 bp, M. musculus
aggcaagtgctctacc

SEQ ID NO: 361310 - DNA, 16 bp, M. musculus
aggcaagtgctctgcc

SEQ ID NO: 361311 - DNA, 16 bp, M. musculus
aggcaagtggacctct

SEQ ID NO: 361312 - DNA, 16 bp, M. musculus
aggcaagtgttctacc

SEQ ID NO: 361313 - DNA, 16 bp, M. musculus
aggcaatctctgtgaa

SEQ ID NO: 361314 - DNA, 16 bp, M. musculus
aggcacaaggcacaag

SEQ ID NO: 361315 - DNA, 16 bp, M. musculus
aggcacaaggcacaca

SEQ ID NO: 361316 - DNA, 17 bp, M. musculus
aggcacacacacacaca

SEQ ID NO: 361317 - DNA, 16 bp, M. musculus
aggcacacagagagaa

SEQ ID NO: 361318 - DNA, 16 bp, M. musculus
aggcacacatagacac

SEQ ID NO: 361319 - DNA, 16 bp, M. musculus
aggcacaccacacaca

SEQ ID NO: 361320 - DNA, 16 bp, M. musculus
aggcacagagaggcag

SEQ ID NO: 361321 - DNA, 16 bp, M. musculus
aggcacagaggcagag

SEQ ID NO: 361322 - DNA, 16 bp, M. musculus
aggcacagccgagaac

SEQ ID NO: 361323 - DNA, 16 bp, M. musculus
aggcacaggcaggcag

SEQ ID NO: 361324 - DNA, 16 bp, M. musculus
aggcacagggacaaaa

SEQ ID NO: 361325 - DNA, 16 bp, M. musculus
aggcacagtggccctg

SEQ ID NO: 361326 - DNA, 16 bp, M. musculus
aggcacagttcattgg

SEQ ID NO: 361327 - DNA, 16 bp, M. musculus
aggcacatgctccact

SEQ ID NO: 361328 - DNA, 16 bp, M. musculus
aggcacatggaggaca

SEQ ID NO: 361329 - DNA, 16 bp, M. musculus
aggcaccagaagaggg

SEQ ID NO: 361330 - DNA, 16 bp, M. musculus
aggcaccagacatgca

SEQ ID NO: 361331 - DNA, 16 bp, M. musculus
aggcaccaggcaagca

SEQ ID NO: 361332 - DNA, 16 bp, M. musculus
aggcaccagggactgc

SEQ ID NO: 361333 - DNA, 16 bp, M. musculus
aggcaccatgcaagct

SEQ ID NO: 361334 - DNA, 20 bp, M. musculus
aggcacctcagcctaataaa

SEQ ID NO: 361335 - DNA, 16 bp, M. musculus
aggcacctgcactcac

SEQ ID NO: 361336 - DNA, 16 bp, M. musculus
aggcacctgctgccaa

SEQ ID NO: 361337 - DNA, 16 bp, M. musculus
aggcacctggaaagga

SEQ ID NO: 361338 - DNA, 16 bp, M. musculus
aggcacgtggatttct

SEQ ID NO: 361339 - DNA, 16 bp, M. musculus
aggcactaggcatgca

SEQ ID NO: 361340 - DNA, 16 bp, M. musculus
aggcactggcagagcc

SEQ ID NO: 361341 - DNA, 16 bp, M. musculus
aggcactggcagatcc

SEQ ID NO: 361342 - DNA, 17 bp, M. musculus
aggcactgtagccctgt

SEQ ID NO: 361343 - DNA, 16 bp, M. musculus
aggcacttaccaccaa

SEQ ID NO: 361344 - DNA, 16 bp, M. musculus
aggcacttcatactca

SEQ ID NO: 361345 - DNA, 16 bp, M. musculus
aggcacttgctgtcaa

SEQ ID NO: 361346 - DNA, 16 bp, M. musculus
aggcagaaacagagag

SEQ ID NO: 361347 - DNA, 16 bp, M. musculus
aggcagaaacaggaga

SEQ ID NO: 361348 - DNA, 16 bp, M. musculus
aggcagaaaccacaga

SEQ ID NO: 361349 - DNA, 16 bp, M. musculus
aggcagaaactcaagc

SEQ ID NO: 361350 - DNA, 16 bp, M. musculus
aggcagaaactgaagc

SEQ ID NO: 361351 - DNA, 16 bp, M. musculus
aggcagaaagaagatg

SEQ ID NO: 361352 - DNA, 16 bp, M. musculus
aggcagaaagagtgta

SEQ ID NO: 361353 - DNA, 16 bp, M. musculus
aggcagaaatgccaaa

SEQ ID NO: 361354 - DNA, 16 bp, M. musculus
aggcagaagaatcaaa

SEQ ID NO: 361355 - DNA, 16 bp, M. musculus
aggcagaagcaacaca

SEQ ID NO: 361356 - DNA, 16 bp, M. musculus
aggcagaagcaagcaa

SEQ ID NO: 361357 - DNA, 16 bp, M. musculus
aggcagaagcacagag

SEQ ID NO: 361358 - DNA, 16 bp, M. musculus
aggcagaagcagaagc

SEQ ID NO: 361359 - DNA, 16 bp, M. musculus
aggcagaagcagaagg

SEQ ID NO: 361360 - DNA, 16 bp, M. musculus
aggcagaagcagagag

SEQ ID NO: 361361 - DNA, 16 bp, M. musculus
aggcagaagcagatgg

SEQ ID NO: 361362 - DNA, 16 bp, M. musculus
aggcagaagccacaca

SEQ ID NO: 361363 - DNA, 16 bp, M. musculus
aggcagaagcctcctg

SEQ ID NO: 361364 - DNA, 16 bp, M. musculus
aggcagaagctggaaa

SEQ ID NO: 361365 - DNA, 16 bp, M. musculus
aggcagaagctggagg

SEQ ID NO: 361366 - DNA, 16 bp, M. musculus
aggcagaagtgggcag

SEQ ID NO: 361367 - DNA, 16 bp, M. musculus
aggcagacacagagag

SEQ ID NO: 361368 - DNA, 16 bp, M. musculus
aggcagacacaggcag

SEQ ID NO: 361369 - DNA, 16 bp, M. musculus
aggcagacagaaagac

SEQ ID NO: 361370 - DNA, 16 bp, M. musculus
aggcagacagacagca

SEQ ID NO: 361371 - DNA, 16 bp, M. musculus
aggcagacagagagag

SEQ ID NO: 361372 - DNA, 16 bp, M. musculus
aggcagacatggtgct

SEQ ID NO: 361373 - DNA, 16 bp, M. musculus
aggcagacattgtgct

SEQ ID NO: 361374 - DNA, 16 bp, M. musculus
aggcagacccatcaga

SEQ ID NO: 361375 - DNA, 16 bp, M. musculus
aggcagagaagcagag

SEQ ID NO: 361376 - DNA, 16 bp, M. musculus
aggcagagaaggcaga

SEQ ID NO: 361377 - DNA, 16 bp, M. musculus
aggcagagacagcaag

SEQ ID NO: 361378 - DNA, 16 bp, M. musculus
aggcagagacagcaga

SEQ ID NO: 361379 - DNA, 16 bp, M. musculus
aggcagagacaggaaa

SEQ ID NO: 361380 - DNA, 16 bp, M. musculus
aggcagagacaggagt

SEQ ID NO: 361381 - DNA, 16 bp, M. musculus
aggcagagacaggtgt

SEQ ID NO: 361382 - DNA, 16 bp, M. musculus
aggcagagaggcagaa

SEQ ID NO: 361383 - DNA, 16 bp, M. musculus
aggcagagaggcaggt

SEQ ID NO: 361384 - DNA, 16 bp, M. musculus
aggcagagagtagctg

SEQ ID NO: 361385 - DNA, 16 bp, M. musculus
aggcagagagtgacag

SEQ ID NO: 361386 - DNA, 16 bp, M. musculus
aggcagagatggagga

SEQ ID NO: 361387 - DNA, 16 bp, M. musculus
aggcagagatggggag

SEQ ID NO: 361388 - DNA, 16 bp, M. musculus
aggcagagcaagcaac

SEQ ID NO: 361389 - DNA, 16 bp, M. musculus
aggcagagcaagccag

SEQ ID NO: 361390 - DNA, 16 bp, M. musculus
aggcagagcagagcaa

SEQ ID NO: 361391 - DNA, 16 bp, M. musculus
aggcagagcagagcag

SEQ ID NO: 361392 - DNA, 16 bp, M. musculus
aggcagagcaggagga

SEQ ID NO: 361393 - DNA, 16 bp, M. musculus
aggcagagcaggcaga

SEQ ID NO: 361394 - DNA, 16 bp, M. musculus
aggcagagcatcatgg

SEQ ID NO: 361395 - DNA, 16 bp, M. musculus
aggcagagccagaggc

SEQ ID NO: 361396 - DNA, 16 bp, M. musculus
aggcagagccagatgg

SEQ ID NO: 361397 - DNA, 16 bp, M. musculus
aggcagagccagggga

SEQ ID NO: 361398 - DNA, 16 bp, M. musculus
aggcagagcccagagg

SEQ ID NO: 361399 - DNA, 16 bp, M. musculus
aggcagagcccaggga

SEQ ID NO: 361400 - DNA, 16 bp, M. musculus
aggcagagctgtgggc

SEQ ID NO: 361401 - DNA, 16 bp, M. musculus
aggcagagcttgtaga

SEQ ID NO: 361402 - DNA, 16 bp, M. musculus
aggcagaggagggtgg

SEQ ID NO: 361403 - DNA, 16 bp, M. musculus
aggcagaggcagagac

SEQ ID NO: 361404 - DNA, 16 bp, M. musculus
aggcagaggcagagat

SEQ ID NO: 361405 - DNA, 16 bp, M. musculus
aggcagaggcagagga

SEQ ID NO: 361406 - DNA, 16 bp, M. musculus
aggcagaggcagcagg

SEQ ID NO: 361407 - DNA, 27 bp, M. musculus
aggcagaggcaggtggatttctgagtt

SEQ ID NO: 361408 - DNA, 30 bp, M. musculus
aggcagaggcaggtggatttctgagttcaa

SEQ ID NO: 361409 - DNA, 16 bp, M. musculus
aggcagaggcagtcaa

SEQ ID NO: 361410 - DNA, 16 bp, M. musculus
aggcagaggccatgga

SEQ ID NO: 361411 - DNA, 16 bp, M. musculus
aggcagaggcggaggc

SEQ ID NO: 361412 - DNA, 16 bp, M. musculus
aggcagaggctgatgc

SEQ ID NO: 361413 - DNA, 16 bp, M. musculus
aggcagagggaggtgg

SEQ ID NO: 361414 - DNA, 16 bp, M. musculus
aggcagaggtaggaag

SEQ ID NO: 361415 - DNA, 16 bp, M. musculus
aggcagaggtgggagg

SEQ ID NO: 361416 - DNA, 16 bp, M. musculus
aggcagaggtgggcag

SEQ ID NO: 361417 - DNA, 16 bp, M. musculus
aggcagaggtgggcgg

SEQ ID NO: 361418 - DNA, 16 bp, M. musculus
aggcagagtcaggcag

SEQ ID NO: 361419 - DNA, 16 bp, M. musculus
aggcagagttaggtgg

SEQ ID NO: 361420 - DNA, 16 bp, M. musculus
aggcagagttcaaggc

SEQ ID NO: 361421 - DNA, 16 bp, M. musculus
aggcagagtttctctg

SEQ ID NO: 361422 - DNA, 16 bp, M. musculus
aggcagatagagctct

SEQ ID NO: 361423 - DNA, 16 bp, M. musculus
aggcagataggcagat

SEQ ID NO: 361424 - DNA, 16 bp, M. musculus
aggcagatatctgtga

SEQ ID NO: 361425 - DNA, 16 bp, M. musculus
aggcagatctatgtga

SEQ ID NO: 361426 - DNA, 16 bp, M. musculus
aggcagatctcagtga

SEQ ID NO: 361427 - DNA, 16 bp, M. musculus
aggcagatctctcagt

SEQ ID NO: 361428 - DNA, 16 bp, M. musculus
aggcagatctctctga

SEQ ID NO: 361429 - DNA, 16 bp, M. musculus
aggcagatgcaggcaa

SEQ ID NO: 361430 - DNA, 16 bp, M. musculus
aggcagatgggcaaag

SEQ ID NO: 361431 - DNA, 16 bp, M. musculus
aggcagatgtctgagt

SEQ ID NO: 361432 - DNA, 16 bp, M. musculus
aggcagatttctgtga

SEQ ID NO: 361433 - DNA, 17 bp, M. musculus
aggcagatttttgagtt

SEQ ID NO: 361434 - DNA, 16 bp, M. musculus
aggcagcaaaacataa

SEQ ID NO: 361435 - DNA, 16 bp, M. musculus
aggcagcaaggagaga

SEQ ID NO: 361436 - DNA, 16 bp, M. musculus
aggcagcaaggatcag

SEQ ID NO: 361437 - DNA, 16 bp, M. musculus
aggcagcacagagtcc

SEQ ID NO: 361438 - DNA, 16 bp, M. musculus
aggcagcacagtggag

SEQ ID NO: 361439 - DNA, 16 bp, M. musculus
aggcagcaccatcttc

SEQ ID NO: 361440 - DNA, 17 bp, M. musculus
aggcagcaccctgtgtg

SEQ ID NO: 361441 - DNA, 16 bp, M. musculus
aggcagcagaaggaga

SEQ ID NO: 361442 - DNA, 16 bp, M. musculus
aggcagcagaggcagc

SEQ ID NO: 361443 - DNA, 16 bp, M. musculus
aggcagcagagtcagg

SEQ ID NO: 361444 - DNA, 16 bp, M. musculus
aggcagcagcaagaga

SEQ ID NO: 361445 - DNA, 16 bp, M. musculus
aggcagcagcagaaga

SEQ ID NO: 361446 - DNA, 16 bp, M. musculus
aggcagcagcagcagg

SEQ ID NO: 361447 - DNA, 16 bp, M. musculus
aggcagcagcaggaga

SEQ ID NO: 361448 - DNA, 16 bp, M. musculus
aggcagcagcaggcag

SEQ ID NO: 361449 - DNA, 16 bp, M. musculus
aggcagcaggaagaga

SEQ ID NO: 361450 - DNA, 16 bp, M. musculus
aggcagcaggaagagt

SEQ ID NO: 361451 - DNA, 16 bp, M. musculus
aggcagcaggaggcag

SEQ ID NO: 361452 - DNA, 16 bp, M. musculus
aggcagcaggatgaga

SEQ ID NO: 361453 - DNA, 22 bp, M. musculus
aggcagcagggaggatatttgg

SEQ ID NO: 361454 - DNA, 16 bp, M. musculus
aggcagccaggaggag

SEQ ID NO: 361455 - DNA, 16 bp, M. musculus
aggcagccatgttggt

SEQ ID NO: 361456 - DNA, 16 bp, M. musculus
aggcagccattgttgg

SEQ ID NO: 361457 - DNA, 16 bp, M. musculus
aggcagcctcagcctc

SEQ ID NO: 361458 - DNA, 16 bp, M. musculus
aggcagcctggagctg

SEQ ID NO: 361459 - DNA, 16 bp, M. musculus
aggcagcctggtttct

SEQ ID NO: 361460 - DNA, 16 bp, M. musculus
aggcagctaaaatgag

SEQ ID NO: 361461 - DNA, 16 bp, M. musculus
aggcagctgctcacac

SEQ ID NO: 361462 - DNA, 16 bp, M. musculus
aggcagctgctcacat

SEQ ID NO: 361463 - DNA, 16 bp, M. musculus
aggcagctggaagaga

SEQ ID NO: 361464 - DNA, 16 bp, M. musculus
aggcagctggtcacag

SEQ ID NO: 361465 - DNA, 16 bp, M. musculus
aggcagcttttataaa

SEQ ID NO: 361466 - DNA, 16 bp, M. musculus
aggcaggaaataaact

SEQ ID NO: 361467 - DNA, 16 bp, M. musculus
aggcaggaaccaggag

SEQ ID NO: 361468 - DNA, 16 bp, M. musculus
aggcaggaacctcagt

SEQ ID NO: 361469 - DNA, 16 bp, M. musculus
aggcaggaacctgaag

SEQ ID NO: 361470 - DNA, 16 bp, M. musculus
aggcaggaactcaagc

SEQ ID NO: 361471 - DNA, 16 bp, M. musculus
aggcaggaagaccaag

SEQ ID NO: 361472 - DNA, 16 bp, M. musculus
aggcaggaagaggcag

SEQ ID NO: 361473 - DNA, 16 bp, M. musculus
aggcaggaagatcaga

SEQ ID NO: 361474 - DNA, 16 bp, M. musculus
aggcaggaagatcata

SEQ ID NO: 361475 - DNA, 16 bp, M. musculus
aggcaggaagattgca

SEQ ID NO: 361476 - DNA, 16 bp, M. musculus
aggcaggaagcagctg

SEQ ID NO: 361477 - DNA, 16 bp, M. musculus
aggcaggaatctgact

SEQ ID NO: 361478 - DNA, 16 bp, M. musculus
aggcaggaatctggag

SEQ ID NO: 361479 - DNA, 16 bp, M. musculus
aggcaggacagacaga

SEQ ID NO: 361480 - DNA, 16 bp, M. musculus
aggcaggacatatttt

SEQ ID NO: 361481 - DNA, 16 bp, M. musculus
aggcaggagcagaagc

SEQ ID NO: 361482 - DNA, 16 bp, M. musculus
aggcaggagcagaggc

SEQ ID NO: 361483 - DNA, 16 bp, M. musculus
aggcaggagccacaga

SEQ ID NO: 361484 - DNA, 16 bp, M. musculus
aggcaggagctctacc

SEQ ID NO: 361485 - DNA, 16 bp, M. musculus
aggcaggagctgaaac

SEQ ID NO: 361486 - DNA, 16 bp, M. musculus
aggcaggaggaacaga

SEQ ID NO: 361487 - DNA, 16 bp, M. musculus
aggcaggaggaactct

SEQ ID NO: 361488 - DNA, 16 bp, M. musculus
aggcaggaggatcagg

SEQ ID NO: 361489 - DNA, 16 bp, M. musculus
aggcaggaggatcggg

SEQ ID NO: 361490 - DNA, 22 bp, M. musculus
aggcaggaggatctctgagttt

SEQ ID NO: 361491 - DNA, 16 bp, M. musculus
aggcaggaggattgct

SEQ ID NO: 361492 - DNA, 16 bp, M. musculus
aggcaggaggatttcc

SEQ ID NO: 361493 - DNA, 17 bp, M. musculus
aggcaggaggatttcta

SEQ ID NO: 361494 - DNA, 16 bp, M. musculus
aggcaggaggcagcag

SEQ ID NO: 361495 - DNA, 16 bp, M. musculus
aggcaggagtgtgtgg

SEQ ID NO: 361496 - DNA, 16 bp, M. musculus
aggcaggatctgaagc

SEQ ID NO: 361497 - DNA, 16 bp, M. musculus
aggcaggcaaaatacc

SEQ ID NO: 361498 - DNA, 16 bp, M. musculus
aggcaggcaagtctct

SEQ ID NO: 361499 - DNA, 16 bp, M. musculus
aggcaggcaccaccac

SEQ ID NO: 361500 - DNA, 16 bp, M. musculus
aggcaggcactctacc

SEQ ID NO: 361501 - DNA, 16 bp, M. musculus
aggcaggcactgatgc

SEQ ID NO: 361502 - DNA, 16 bp, M. musculus
aggcaggcagacagga

SEQ ID NO: 361503 - DNA, 16 bp, M. musculus
aggcaggcagagacag

SEQ ID NO: 361504 - DNA, 16 bp, M. musculus
aggcaggcagatatct

SEQ ID NO: 361505 - DNA, 16 bp, M. musculus
aggcaggcagatcgct

SEQ ID NO: 361506 - DNA, 17 bp, M. musculus
aggcaggcagatctcta

SEQ ID NO: 361507 - DNA, 16 bp, M. musculus
aggcaggcagatcttt

SEQ ID NO: 361508 - DNA, 16 bp, M. musculus
aggcaggcaggcagag

SEQ ID NO: 361509 - DNA, 17 bp, M. musculus
aggcaggcaggcaggca

SEQ ID NO: 361510 - DNA, 17 bp, M. musculus
aggcaggcaggcaggct

SEQ ID NO: 361511 - DNA, 16 bp, M. musculus
aggcaggcaggcatgt

SEQ ID NO: 361512 - DNA, 16 bp, M. musculus
aggcaggcagggcagg

SEQ ID NO: 361513 - DNA, 16 bp, M. musculus
aggcaggcagggctct

SEQ ID NO: 361514 - DNA, 16 bp, M. musculus
aggcaggcagggtgct

SEQ ID NO: 361515 - DNA, 16 bp, M. musculus
aggcaggcagtgctgt

SEQ ID NO: 361516 - DNA, 16 bp, M. musculus
aggcaggccaatctct

SEQ ID NO: 361517 - DNA, 16 bp, M. musculus
aggcaggccagtctct

SEQ ID NO: 361518 - DNA, 16 bp, M. musculus
aggcaggcctgcttgc

SEQ ID NO: 361519 - DNA, 16 bp, M. musculus
aggcaggccttgaact

SEQ ID NO: 361520 - DNA, 17 bp, M. musculus
aggcaggcggatctcta

SEQ ID NO: 361521 - DNA, 16 bp, M. musculus
aggcaggcgtggtgca

SEQ ID NO: 361522 - DNA, 16 bp, M. musculus
aggcaggctgatctct

SEQ ID NO: 361523 - DNA, 16 bp, M. musculus
aggcaggctggagaga

SEQ ID NO: 361524 - DNA, 16 bp, M. musculus
aggcaggctggggctg

SEQ ID NO: 361525 - DNA, 16 bp, M. musculus
aggcaggcttctcctt

SEQ ID NO: 361526 - DNA, 16 bp, M. musculus
aggcagggactgaagc

SEQ ID NO: 361527 - DNA, 16 bp, M. musculus
aggcagggaggggtga

SEQ ID NO: 361528 - DNA, 16 bp, M. musculus
aggcagggcagcagga

SEQ ID NO: 361529 - DNA, 16 bp, M. musculus
aggcagggcagggcag

SEQ ID NO: 361530 - DNA, 17 bp, M. musculus
aggcagggctatacaga

SEQ ID NO: 361531 - DNA, 16 bp, M. musculus
aggcaggggcaggtag

SEQ ID NO: 361532 - DNA, 16 bp, M. musculus
aggcagggggatcaag

SEQ ID NO: 361533 - DNA, 17 bp, M. musculus
aggcagggggatctctg

SEQ ID NO: 361534 - DNA, 16 bp, M. musculus
aggcagggtctcacta

SEQ ID NO: 361535 - DNA, 16 bp, M. musculus
aggcaggtctcctgtg

SEQ ID NO: 361536 - DNA, 16 bp, M. musculus
aggcaggtgctgatgc

SEQ ID NO: 361537 - DNA, 16 bp, M. musculus
aggcaggtggagctct

SEQ ID NO: 361538 - DNA, 17 bp, M. musculus
aggcaggtggatctcta

SEQ ID NO: 361539 - DNA, 16 bp, M. musculus
aggcaggtggatcttt

SEQ ID NO: 361540 - DNA, 18 bp, M. musculus
aggcaggtggatttctgg

SEQ ID NO: 361541 - DNA, 21 bp, M. musculus
aggcaggtggatttttgagtt

SEQ ID NO: 361542 - DNA, 16 bp, M. musculus
aggcaggtggtcctga

SEQ ID NO: 361543 - DNA, 16 bp, M. musculus
aggcaggtggttctct

SEQ ID NO: 361544 - DNA, 16 bp, M. musculus
aggcaggtgtggtgca

SEQ ID NO: 361545 - DNA, 16 bp, M. musculus
aggcaggttgagaaat

SEQ ID NO: 361546 - DNA, 16 bp, M. musculus
aggcagtcagatctct

SEQ ID NO: 361547 - DNA, 16 bp, M. musculus
aggcagtcaggcaggc

SEQ ID NO: 361548 - DNA, 16 bp, M. musculus
aggcagtccctgtcat

SEQ ID NO: 361549 - DNA, 16 bp, M. musculus
aggcagtcctaaaagg

SEQ ID NO: 361550 - DNA, 16 bp, M. musculus
aggcagtgagggagtt

SEQ ID NO: 361551 - DNA, 16 bp, M. musculus
aggcagtgctcttaac

SEQ ID NO: 361552 - DNA, 16 bp, M. musculus
aggcagtggcctgtgg

SEQ ID NO: 361553 - DNA, 16 bp, M. musculus
aggcagtgggaggcag

SEQ ID NO: 361554 - DNA, 16 bp, M. musculus
aggcagtggtggcaca

SEQ ID NO: 361555 - DNA, 16 bp, M. musculus
aggcagtggtggccca

SEQ ID NO: 361556 - DNA, 16 bp, M. musculus
aggcagtggtggttca

SEQ ID NO: 361557 - DNA, 16 bp, M. musculus
aggcagttgggagcca

SEQ ID NO: 361558 - DNA, 16 bp, M. musculus
aggcagttgggagctg

SEQ ID NO: 361559 - DNA, 16 bp, M. musculus
aggcagttgtgaactg

SEQ ID NO: 361560 - DNA, 16 bp, M. musculus
aggcagttgtgagcca

SEQ ID NO: 361561 - DNA, 16 bp, M. musculus
aggcagttgtgagctg

SEQ ID NO: 361562 - DNA, 16 bp, M. musculus
aggcataaaatttatt

SEQ ID NO: 361563 - DNA, 16 bp, M. musculus
aggcatacaccaccac

SEQ ID NO: 361564 - DNA, 16 bp, M. musculus
aggcatattaagtttg

SEQ ID NO: 361565 - DNA, 16 bp, M. musculus
aggcatcattgagaag

SEQ ID NO: 361566 - DNA, 16 bp, M. musculus
aggcatcccttccccc

SEQ ID NO: 361567 - DNA, 16 bp, M. musculus
aggcatgagccatcat

SEQ ID NO: 361568 - DNA, 16 bp, M. musculus
aggcatgatgattcca

SEQ ID NO: 361569 - DNA, 16 bp, M. musculus
aggcatgcaccaccac

SEQ ID NO: 361570 - DNA, 16 bp, M. musculus
aggcatgcaccaccat

SEQ ID NO: 361571 - DNA, 16 bp, M. musculus
aggcatgcatcaccac

SEQ ID NO: 361572 - DNA, 16 bp, M. musculus
aggcatgcccagaggt

SEQ ID NO: 361573 - DNA, 16 bp, M. musculus
aggcatggaggcagga

SEQ ID NO: 361574 - DNA, 16 bp, M. musculus
aggcatggcagcagga

SEQ ID NO: 361575 - DNA, 16 bp, M. musculus
aggcatgggccaccac

SEQ ID NO: 361576 - DNA, 16 bp, M. musculus
aggcatgggccaccat

SEQ ID NO: 361577 - DNA, 16 bp, M. musculus
aggcatgggggacttt

SEQ ID NO: 361578 - DNA, 16 bp, M. musculus
aggcatgggtcaccat

SEQ ID NO: 361579 - DNA, 16 bp, M. musculus
aggcatggtgactcca

SEQ ID NO: 361580 - DNA, 16 bp, M. musculus
aggcatggtgcagaaa

SEQ ID NO: 361581 - DNA, 16 bp, M. musculus
aggcatggtgctggag

SEQ ID NO: 361582 - DNA, 16 bp, M. musculus
aggcatggtggcagga

SEQ ID NO: 361583 - DNA, 16 bp, M. musculus
aggcatggtgtctctc

SEQ ID NO: 361584 - DNA, 16 bp, M. musculus
aggcatgtaccaccat

SEQ ID NO: 361585 - DNA, 16 bp, M. musculus
aggcatgtgatgtttt

SEQ ID NO: 361586 - DNA, 16 bp, M. musculus
aggcatgtgctgccat

SEQ ID NO: 361587 - DNA, 16 bp, M. musculus
aggcatgtgtcaccat

SEQ ID NO: 361588 - DNA, 16 bp, M. musculus
aggcattattattatt

SEQ ID NO: 361589 - DNA, 16 bp, M. musculus
aggcattgcagaaatt

SEQ ID NO: 361590 - DNA, 16 bp, M. musculus
aggcatttacaactta

SEQ ID NO: 361591 - DNA, 16 bp, M. musculus
aggcatttcactggcc

SEQ ID NO: 361592 - DNA, 16 bp, M. musculus
aggcatttcataaatt

SEQ ID NO: 361593 - DNA, 16 bp, M. musculus
aggcatttccccagct

SEQ ID NO: 361594 - DNA, 16 bp, M. musculus
aggcatttcctcaaga

SEQ ID NO: 361595 - DNA, 18 bp, M. musculus
aggcatttcctcaaggga

SEQ ID NO: 361596 - DNA, 16 bp, M. musculus
aggcatttgccaccaa

SEQ ID NO: 361597 - DNA, 16 bp, M. musculus
aggcattttaaaatta

SEQ ID NO: 361598 - DNA, 16 bp, M. musculus
aggcattttctcaact

SEQ ID NO: 361599 - DNA, 16 bp, M. musculus
aggcattttctcagtt

SEQ ID NO: 361600 - DNA, 16 bp, M. musculus
aggcattttctccatt

SEQ ID NO: 361601 - DNA, 16 bp, M. musculus
aggcattttcttgatt

SEQ ID NO: 361602 - DNA, 16 bp, M. musculus
aggcattttgtctgaa

SEQ ID NO: 361603 - DNA, 16 bp, M. musculus
aggccaaaagagagca

SEQ ID NO: 361604 - DNA, 16 bp, M. musculus
aggccaaacaccaatg

SEQ ID NO: 361605 - DNA, 16 bp, M. musculus
aggccaaagacactgt

SEQ ID NO: 361606 - DNA, 16 bp, M. musculus
aggccaaagcaggagg

SEQ ID NO: 361607 - DNA, 16 bp, M. musculus
aggccaaatgcacaga

SEQ ID NO: 361608 - DNA, 16 bp, M. musculus
aggccaacctgagcta

SEQ ID NO: 361609 - DNA, 16 bp, M. musculus
aggccaacctggacaa

SEQ ID NO: 361610 - DNA, 16 bp, M. musculus
aggccaacctggacta

SEQ ID NO: 361611 - DNA, 16 bp, M. musculus
aggccaacctggatta

SEQ ID NO: 361612 - DNA, 16 bp, M. musculus
aggccaacctgggcta

SEQ ID NO: 361613 - DNA, 16 bp, M. musculus
aggccaacctggtcta

SEQ ID NO: 361614 - DNA, 16 bp, M. musculus
aggccaacctggttta

SEQ ID NO: 361615 - DNA, 17 bp, M. musculus
aggccaactctcctctg

SEQ ID NO: 361616 - DNA, 16 bp, M. musculus
aggccaacttggtcta

SEQ ID NO: 361617 - DNA, 16 bp, M. musculus
aggccaagaggctggg

SEQ ID NO: 361618 - DNA, 16 bp, M. musculus
aggccaagctggtcta

SEQ ID NO: 361619 - DNA, 16 bp, M. musculus
aggccaatctgatgaa

SEQ ID NO: 361620 - DNA, 16 bp, M. musculus
aggccacaccacttca

SEQ ID NO: 361621 - DNA, 27 bp, M. musculus
aggccacacctccagatggtgccactc

SEQ ID NO: 361622 - DNA, 16 bp, M. musculus
aggccacagaagcagc

SEQ ID NO: 361623 - DNA, 16 bp, M. musculus
aggccacagcagcagc

SEQ ID NO: 361624 - DNA, 16 bp, M. musculus
aggccacagccaactc

SEQ ID NO: 361625 - DNA, 16 bp, M. musculus
aggccacagctccaaa

SEQ ID NO: 361626 - DNA, 16 bp, M. musculus
aggccaccctggtcta

SEQ ID NO: 361627 - DNA, 16 bp, M. musculus
aggccactgaccccac

SEQ ID NO: 361628 - DNA, 16 bp, M. musculus
aggccactgtgggtgg

SEQ ID NO: 361629 - DNA, 16 bp, M. musculus
aggccagaaaaaggca

SEQ ID NO: 361630 - DNA, 16 bp, M. musculus
aggccagaaactgcag

SEQ ID NO: 361631 - DNA, 16 bp, M. musculus
aggccagaaagcagga

SEQ ID NO: 361632 - DNA, 16 bp, M. musculus
aggccagaagaaagca

SEQ ID NO: 361633 - DNA, 16 bp, M. musculus
aggccagaagagaaca

SEQ ID NO: 361634 - DNA, 16 bp, M. musculus
aggccagaagaggatg

SEQ ID NO: 361635 - DNA, 16 bp, M. musculus
aggccagaagaggcag

SEQ ID NO: 361636 - DNA, 16 bp, M. musculus
aggccagaagagggca

SEQ ID NO: 361637 - DNA, 16 bp, M. musculus
aggccagaagagggcg

SEQ ID NO: 361638 - DNA, 16 bp, M. musculus
aggccagaagctgcag

SEQ ID NO: 361639 - DNA, 17 bp, M. musculus
aggccagaagtcaatgt

SEQ ID NO: 361640 - DNA, 16 bp, M. musculus
aggccagacagggcag

SEQ ID NO: 361641 - DNA, 16 bp, M. musculus
aggccagactggtcta

SEQ ID NO: 361642 - DNA, 16 bp, M. musculus
aggccagagaaaccat

SEQ ID NO: 361643 - DNA, 16 bp, M. musculus
aggccagagaacaacc

SEQ ID NO: 361644 - DNA, 16 bp, M. musculus
aggccagagaagggca

SEQ ID NO: 361645 - DNA, 16 bp, M. musculus
aggccagaggacaacc

SEQ ID NO: 361646 - DNA, 16 bp, M. musculus
aggccagaggacagct

SEQ ID NO: 361647 - DNA, 16 bp, M. musculus
aggccagaggaggaag

SEQ ID NO: 361648 - DNA, 16 bp, M. musculus
aggccagaggagggca

SEQ ID NO: 361649 - DNA, 16 bp, M. musculus
aggccagaggccagag

SEQ ID NO: 361650 - DNA, 16 bp, M. musculus
aggccagaggccagcc

SEQ ID NO: 361651 - DNA, 16 bp, M. musculus
aggccagaggtgtcag

SEQ ID NO: 361652 - DNA, 16 bp, M. musculus
aggccagcagagggcg

SEQ ID NO: 361653 - DNA, 16 bp, M. musculus
aggccagcagttagaa

SEQ ID NO: 361654 - DNA, 16 bp, M. musculus
aggccagcatgggcta

SEQ ID NO: 361655 - DNA, 16 bp, M. musculus
aggccagcatggtcta

SEQ ID NO: 361656 - DNA, 31 bp, M. musculus
aggccagcatttggcaaacatgagaatatgc

SEQ ID NO: 361657 - DNA, 16 bp, M. musculus
aggccagccaaagcta

SEQ ID NO: 361658 - DNA, 16 bp, M. musculus
aggccagccagagcca

SEQ ID NO: 361659 - DNA, 16 bp, M. musculus
aggccagccagagcta

SEQ ID NO: 361660 - DNA, 16 bp, M. musculus
aggccagccagggcta

SEQ ID NO: 361661 - DNA, 16 bp, M. musculus
aggccagccagggtga

SEQ ID NO: 361662 - DNA, 16 bp, M. musculus
aggccagccaggtcta

SEQ ID NO: 361663 - DNA, 16 bp, M. musculus
aggccagccagtgcta

SEQ ID NO: 361664 - DNA, 16 bp, M. musculus
aggccagcccaagcca

SEQ ID NO: 361665 - DNA, 16 bp, M. musculus
aggccagccctgccat

SEQ ID NO: 361666 - DNA, 16 bp, M. musculus
aggccagccgggtcta

SEQ ID NO: 361667 - DNA, 16 bp, M. musculus
aggccagcctagtcta

SEQ ID NO: 361668 - DNA, 16 bp, M. musculus
aggccagcctagttta

SEQ ID NO: 361669 - DNA, 16 bp, M. musculus
aggccagcctcaaact

SEQ ID NO: 361670 - DNA, 16 bp, M. musculus
aggccagcctcatcta

SEQ ID NO: 361671 - DNA, 18 bp, M. musculus
aggccagcctcgtctaca

SEQ ID NO: 361672 - DNA, 16 bp, M. musculus
aggccagcctgaacta

SEQ ID NO: 361673 - DNA, 16 bp, M. musculus
aggccagcctgagcaa

SEQ ID NO: 361674 - DNA, 16 bp, M. musculus
aggccagcctgagcca

SEQ ID NO: 361675 - DNA, 16 bp, M. musculus
aggccagcctgatcta

SEQ ID NO: 361676 - DNA, 16 bp, M. musculus
aggccagcctgatctg

SEQ ID NO: 361677 - DNA, 16 bp, M. musculus
aggccagcctgctgta

SEQ ID NO: 361678 - DNA, 16 bp, M. musculus
aggccagcctggaaca

SEQ ID NO: 361679 - DNA, 16 bp, M. musculus
aggccagcctggaata

SEQ ID NO: 361680 - DNA, 16 bp, M. musculus
aggccagcctggacta

SEQ ID NO: 361681 - DNA, 16 bp, M. musculus
aggccagcctggagta

SEQ ID NO: 361682 - DNA, 16 bp, M. musculus
aggccagcctggccta

SEQ ID NO: 361683 - DNA, 16 bp, M. musculus
aggccagcctggcctc

SEQ ID NO: 361684 - DNA, 16 bp, M. musculus
aggccagcctggctta

SEQ ID NO: 361685 - DNA, 16 bp, M. musculus
aggccagcctgggaca

SEQ ID NO: 361686 - DNA, 16 bp, M. musculus
aggccagcctgggcca

SEQ ID NO: 361687 - DNA, 16 bp, M. musculus
aggccagcctgggcta

SEQ ID NO: 361688 - DNA, 16 bp, M. musculus
aggccagcctgggctg

SEQ ID NO: 361689 - DNA, 16 bp, M. musculus
aggccagcctgggctt

SEQ ID NO: 361690 - DNA, 16 bp, M. musculus
aggccagcctggggca

SEQ ID NO: 361691 - DNA, 16 bp, M. musculus
aggccagcctgggtga

SEQ ID NO: 361692 - DNA, 16 bp, M. musculus
aggccagcctggtata

SEQ ID NO: 361693 - DNA, 16 bp, M. musculus
aggccagcctggtcca

SEQ ID NO: 361694 - DNA, 16 bp, M. musculus
aggccagcctggtcct

SEQ ID NO: 361695 - DNA, 16 bp, M. musculus
aggccagcctggtcga

SEQ ID NO: 361696 - DNA, 17 bp, M. musculus
aggccagcctggtctaa

SEQ ID NO: 361697 - DNA, 18 bp, M. musculus
aggccagcctggtctaca

SEQ ID NO: 361698 - DNA, 17 bp, M. musculus
aggccagcctggtctat

SEQ ID NO: 361699 - DNA, 16 bp, M. musculus
aggccagcctggtctc

SEQ ID NO: 361700 - DNA, 16 bp, M. musculus
aggccagcctggtctg

SEQ ID NO: 361701 - DNA, 16 bp, M. musculus
aggccagcctggtctt

SEQ ID NO: 361702 - DNA, 16 bp, M. musculus
aggccagcctggttta

SEQ ID NO: 361703 - DNA, 16 bp, M. musculus
aggccagcctgtctac

SEQ ID NO: 361704 - DNA, 16 bp, M. musculus
aggccagcctgttcta

SEQ ID NO: 361705 - DNA, 16 bp, M. musculus
aggccagccttggcca

SEQ ID NO: 361706 - DNA, 16 bp, M. musculus
aggccagccttggcta

SEQ ID NO: 361707 - DNA, 16 bp, M. musculus
aggccagccttgtcta

SEQ ID NO: 361708 - DNA, 16 bp, M. musculus
aggccagctagggcta

SEQ ID NO: 361709 - DNA, 16 bp, M. musculus
aggccagctgcagagc

SEQ ID NO: 361710 - DNA, 16 bp, M. musculus
aggccagctggagcta

SEQ ID NO: 361711 - DNA, 16 bp, M. musculus
aggccagctgggacta

SEQ ID NO: 361712 - DNA, 16 bp, M. musculus
aggccagctgggctac

SEQ ID NO: 361713 - DNA, 16 bp, M. musculus
aggccagcttagacta

SEQ ID NO: 361714 - DNA, 16 bp, M. musculus
aggccagcttggacta

SEQ ID NO: 361715 - DNA, 16 bp, M. musculus
aggccagcttgggcaa

SEQ ID NO: 361716 - DNA, 16 bp, M. musculus
aggccagcttgggcta

SEQ ID NO: 361717 - DNA, 16 bp, M. musculus
aggccagcttggtcta

SEQ ID NO: 361718 - DNA, 16 bp, M. musculus
aggccaggaagcagaa

SEQ ID NO: 361719 - DNA, 16 bp, M. musculus
aggccaggaccccacc

SEQ ID NO: 361720 - DNA, 16 bp, M. musculus
aggccaggagaatgaa

SEQ ID NO: 361721 - DNA, 16 bp, M. musculus
aggccaggagaggatg

SEQ ID NO: 361722 - DNA, 16 bp, M. musculus
aggccaggaggagcaa

SEQ ID NO: 361723 - DNA, 16 bp, M. musculus
aggccaggatgctgat

SEQ ID NO: 361724 - DNA, 16 bp, M. musculus
aggccaggccaggcca

SEQ ID NO: 361725 - DNA, 16 bp, M. musculus
aggccaggcctggtgg

SEQ ID NO: 361726 - DNA, 16 bp, M. musculus
aggccaggctgacctc

SEQ ID NO: 361727 - DNA, 16 bp, M. musculus
aggccaggctggtcta

SEQ ID NO: 361728 - DNA, 16 bp, M. musculus
aggccaggctgtcctt

SEQ ID NO: 361729 - DNA, 16 bp, M. musculus
aggccagggagcagga

SEQ ID NO: 361730 - DNA, 16 bp, M. musculus
aggccagggctggaga

SEQ ID NO: 361731 - DNA, 16 bp, M. musculus
aggccaggtatggtgg

SEQ ID NO: 361732 - DNA, 16 bp, M. musculus
aggccaggttttctgc

SEQ ID NO: 361733 - DNA, 16 bp, M. musculus
aggccagtcaaggcta

SEQ ID NO: 361734 - DNA, 16 bp, M. musculus
aggccagtcagggcta

SEQ ID NO: 361735 - DNA, 16 bp, M. musculus
aggccagtcaggtcta

SEQ ID NO: 361736 - DNA, 16 bp, M. musculus
aggccagtctgagcta

SEQ ID NO: 361737 - DNA, 16 bp, M. musculus
aggccagtctgatcta

SEQ ID NO: 361738 - DNA, 16 bp, M. musculus
aggccagtctgatgga

SEQ ID NO: 361739 - DNA, 16 bp, M. musculus
aggccagtctgggata

SEQ ID NO: 361740 - DNA, 16 bp, M. musculus
aggccagtctgggcta

SEQ ID NO: 361741 - DNA, 16 bp, M. musculus
aggccagtctgggctg

SEQ ID NO: 361742 - DNA, 16 bp, M. musculus
aggccagtctggtcta

SEQ ID NO: 361743 - DNA, 16 bp, M. musculus
aggccagtctggtctt

SEQ ID NO: 361744 - DNA, 16 bp, M. musculus
aggccagtgagagacc

SEQ ID NO: 361745 - DNA, 16 bp, M. musculus
aggccagtgcctggca

SEQ ID NO: 361746 - DNA, 16 bp, M. musculus
aggccagtgtggtcta

SEQ ID NO: 361747 - DNA, 16 bp, M. musculus
aggccatacctccaaa

SEQ ID NO: 361748 - DNA, 16 bp, M. musculus
aggccatacctcctag

SEQ ID NO: 361749 - DNA, 16 bp, M. musculus
aggccatattttgata

SEQ ID NO: 361750 - DNA, 16 bp, M. musculus
aggccatcatcctctg

SEQ ID NO: 361751 - DNA, 16 bp, M. musculus
aggccatccaaggcta

SEQ ID NO: 361752 - DNA, 16 bp, M. musculus
aggccatccagagaca

SEQ ID NO: 361753 - DNA, 16 bp, M. musculus
aggccatcctcagcca

SEQ ID NO: 361754 - DNA, 16 bp, M. musculus
aggccatcctcagctg

SEQ ID NO: 361755 - DNA, 16 bp, M. musculus
aggccatcctgggcca

SEQ ID NO: 361756 - DNA, 16 bp, M. musculus
aggccatcctgggcta

SEQ ID NO: 361757 - DNA, 16 bp, M. musculus
aggccatggaagggtg

SEQ ID NO: 361758 - DNA, 16 bp, M. musculus
aggccatggagaggtg

SEQ ID NO: 361759 - DNA, 17 bp, M. musculus
aggccatggaggatgct

SEQ ID NO: 361760 - DNA, 16 bp, M. musculus
aggccatggagtggtg

SEQ ID NO: 361761 - DNA, 16 bp, M. musculus
aggccatggccaagag

SEQ ID NO: 361762 - DNA, 16 bp, M. musculus
aggccatggtgaagtc

SEQ ID NO: 361763 - DNA, 16 bp, M. musculus
aggccatgtggatgtc

SEQ ID NO: 361764 - DNA, 16 bp, M. musculus
aggccattctcagcta

SEQ ID NO: 361765 - DNA, 16 bp, M. musculus
aggccattctctgctg

SEQ ID NO: 361766 - DNA, 16 bp, M. musculus
aggccattggagaagg

SEQ ID NO: 361767 - DNA, 17 bp, M. musculus
aggccattggtgaaggt

SEQ ID NO: 361768 - DNA, 16 bp, M. musculus
aggccatttcaggttt

SEQ ID NO: 361769 - DNA, 16 bp, M. musculus
aggccatttggcctgt

SEQ ID NO: 361770 - DNA, 16 bp, M. musculus
aggcccacagtgggat

SEQ ID NO: 361771 - DNA, 16 bp, M. musculus
aggcccagacccaggg

SEQ ID NO: 361772 - DNA, 16 bp, M. musculus
aggcccagagagacca

SEQ ID NO: 361773 - DNA, 16 bp, M. musculus
aggcccagagaggtta

SEQ ID NO: 361774 - DNA, 16 bp, M. musculus
aggcccagaggcccag

SEQ ID NO: 361775 - DNA, 16 bp, M. musculus
aggcccagagggccag

SEQ ID NO: 361776 - DNA, 16 bp, M. musculus
aggcccagatccagga

SEQ ID NO: 361777 - DNA, 16 bp, M. musculus
aggcccagtctctctc

SEQ ID NO: 361778 - DNA, 16 bp, M. musculus
aggccccagacatcca

SEQ ID NO: 361779 - DNA, 16 bp, M. musculus
aggccccaggccccag

SEQ ID NO: 361780 - DNA, 16 bp, M. musculus
aggccccagggaaggg

SEQ ID NO: 361781 - DNA, 16 bp, M. musculus
aggccccatgcccagc

SEQ ID NO: 361782 - DNA, 16 bp, M. musculus
aggcccccacagttca

SEQ ID NO: 361783 - DNA, 17 bp, M. musculus
aggccccggcattgtct

SEQ ID NO: 361784 - DNA, 16 bp, M. musculus
aggcccctggcacaaa

SEQ ID NO: 361785 - DNA, 16 bp, M. musculus
aggcccctggcttctg

SEQ ID NO: 361786 - DNA, 16 bp, M. musculus
aggcccgtggaaaggc

SEQ ID NO: 361787 - DNA, 16 bp, M. musculus
aggccctagattcaat

SEQ ID NO: 361788 - DNA, 16 bp, M. musculus
aggccctattgctgaa

SEQ ID NO: 361789 - DNA, 16 bp, M. musculus
aggccctcaggggaga

SEQ ID NO: 361790 - DNA, 16 bp, M. musculus
aggccctcctccatca

SEQ ID NO: 361791 - DNA, 16 bp, M. musculus
aggccctgaattcaat

SEQ ID NO: 361792 - DNA, 16 bp, M. musculus
aggccctgagttcaat

SEQ ID NO: 361793 - DNA, 16 bp, M. musculus
aggccctgggctcaat

SEQ ID NO: 361794 - DNA, 16 bp, M. musculus
aggccctgggtctgat

SEQ ID NO: 361795 - DNA, 16 bp, M. musculus
aggccctgggttcaag

SEQ ID NO: 361796 - DNA, 16 bp, M. musculus
aggccctgggttcaat

SEQ ID NO: 361797 - DNA, 16 bp, M. musculus
aggccctgggtttaat

SEQ ID NO: 361798 - DNA, 16 bp, M. musculus
aggccctgggtttcat

SEQ ID NO: 361799 - DNA, 16 bp, M. musculus
aggccctgggtttggt

SEQ ID NO: 361800 - DNA, 16 bp, M. musculus
aggccctgtgttccac

SEQ ID NO: 361801 - DNA, 16 bp, M. musculus
aggccctgtttcaaaa

SEQ ID NO: 361802 - DNA, 16 bp, M. musculus
aggcccttgggcctgt

SEQ ID NO: 361803 - DNA, 16 bp, M. musculus
aggccggccatgagca

SEQ ID NO: 361804 - DNA, 18 bp, M. musculus
aggccggcctggtctaca

SEQ ID NO: 361805 - DNA, 17 bp, M. musculus
aggccgggcagtggtgg

SEQ ID NO: 361806 - DNA, 16 bp, M. musculus
aggccgggcgtggtgg

SEQ ID NO: 361807 - DNA, 18 bp, M. musculus
aggccgtgtgtgtgtgtg

SEQ ID NO: 361808 - DNA, 16 bp, M. musculus
aggcctacctggctgt

SEQ ID NO: 361809 - DNA, 16 bp, M. musculus
aggcctagaccagcct

SEQ ID NO: 361810 - DNA, 16 bp, M. musculus
aggcctagatccaggg

SEQ ID NO: 361811 - DNA, 17 bp, M. musculus
aggcctaggaggggcgt

SEQ ID NO: 361812 - DNA, 16 bp, M. musculus
aggcctaggtaaaata

SEQ ID NO: 361813 - DNA, 16 bp, M. musculus
aggcctataatcccag

SEQ ID NO: 361814 - DNA, 16 bp, M. musculus
aggcctccaagagaca

SEQ ID NO: 361815 - DNA, 16 bp, M. musculus
aggcctccacccatcc

SEQ ID NO: 361816 - DNA, 16 bp, M. musculus
aggcctccagcagaag

SEQ ID NO: 361817 - DNA, 16 bp, M. musculus
aggcctccccttctct

SEQ ID NO: 361818 - DNA, 16 bp, M. musculus
aggcctccctgtgctc

SEQ ID NO: 361819 - DNA, 16 bp, M. musculus
aggcctctcagaggac

SEQ ID NO: 361820 - DNA, 16 bp, M. musculus
aggcctctccttccat

SEQ ID NO: 361821 - DNA, 16 bp, M. musculus
aggcctctctctctct

SEQ ID NO: 361822 - DNA, 16 bp, M. musculus
aggcctctggctcctg

SEQ ID NO: 361823 - DNA, 16 bp, M. musculus
aggcctctggcttctg

SEQ ID NO: 361824 - DNA, 16 bp, M. musculus
aggcctcttttttttt

SEQ ID NO: 361825 - DNA, 16 bp, M. musculus
aggcctgaaggccaag

SEQ ID NO: 361826 - DNA, 16 bp, M. musculus
aggcctgaatgggctc

SEQ ID NO: 361827 - DNA, 16 bp, M. musculus
aggcctgaggttgatg

SEQ ID NO: 361828 - DNA, 16 bp, M. musculus
aggcctgcctgcctct

SEQ ID NO: 361829 - DNA, 16 bp, M. musculus
aggcctgcctgcctgc

SEQ ID NO: 361830 - DNA, 16 bp, M. musculus
aggcctgcctgggcta

SEQ ID NO: 361831 - DNA, 16 bp, M. musculus
aggcctgcctggtcta

SEQ ID NO: 361832 - DNA, 16 bp, M. musculus
aggcctgcctttttat

SEQ ID NO: 361833 - DNA, 16 bp, M. musculus
aggcctggagagatgg

SEQ ID NO: 361834 - DNA, 16 bp, M. musculus
aggcctggagcaagag

SEQ ID NO: 361835 - DNA, 16 bp, M. musculus
aggcctggcagggtgt

SEQ ID NO: 361836 - DNA, 16 bp, M. musculus
aggcctgggaataggg

SEQ ID NO: 361837 - DNA, 16 bp, M. musculus
aggcctggtcttttct

SEQ ID NO: 361838 - DNA, 16 bp, M. musculus
aggcctggtgcaggag

SEQ ID NO: 361839 - DNA, 16 bp, M. musculus
aggcctgtaatctcag

SEQ ID NO: 361840 - DNA, 16 bp, M. musculus
aggcctgtcacaattg

SEQ ID NO: 361841 - DNA, 16 bp, M. musculus
aggcctgtcatcccag

SEQ ID NO: 361842 - DNA, 16 bp, M. musculus
aggcctgtcctggagt

SEQ ID NO: 361843 - DNA, 16 bp, M. musculus
aggcctgtttggtgac

SEQ ID NO: 361844 - DNA, 16 bp, M. musculus
aggccttcctggagga

SEQ ID NO: 361845 - DNA, 16 bp, M. musculus
aggccttctccatgct

SEQ ID NO: 361846 - DNA, 17 bp, M. musculus
aggccttctccatggct

SEQ ID NO: 361847 - DNA, 16 bp, M. musculus
aggccttgagacctcc

SEQ ID NO: 361848 - DNA, 16 bp, M. musculus
aggccttgcccttctc

SEQ ID NO: 361849 - DNA, 16 bp, M. musculus
aggccttgggttcagt

SEQ ID NO: 361850 - DNA, 16 bp, M. musculus
aggccttgtacatgct

SEQ ID NO: 361851 - DNA, 16 bp, M. musculus
aggccttgtgcttgct

SEQ ID NO: 361852 - DNA, 16 bp, M. musculus
aggcctttaatttctt

SEQ ID NO: 361853 - DNA, 16 bp, M. musculus
aggcctttacttcttc

SEQ ID NO: 361854 - DNA, 16 bp, M. musculus
aggcctttattcccag

SEQ ID NO: 361855 - DNA, 16 bp, M. musculus
aggccttttcccctgc

SEQ ID NO: 361856 - DNA, 17 bp, M. musculus
aggccttttcccctgcc

SEQ ID NO: 361857 - DNA, 16 bp, M. musculus
aggcgaaggagcaaga

SEQ ID NO: 361858 - DNA, 17 bp, M. musculus
aggcgaatttctgagtt

SEQ ID NO: 361859 - DNA, 16 bp, M. musculus
aggcgcgcgcgcgcac

SEQ ID NO: 361860 - DNA, 22 bp, M. musculus
aggcggatttctgagttcgagg

SEQ ID NO: 361861 - DNA, 18 bp, M. musculus
aggcggatttttgagttt

SEQ ID NO: 361862 - DNA, 16 bp, M. musculus
aggcggcgccatcttc

SEQ ID NO: 361863 - DNA, 17 bp, M. musculus
aggcgtcagatctcatt

SEQ ID NO: 361864 - DNA, 16 bp, M. musculus
aggcgtgcaccaccaa

SEQ ID NO: 361865 - DNA, 16 bp, M. musculus
aggcgtgtaccaccat

SEQ ID NO: 361866 - DNA, 17 bp, M. musculus
aggcgtgtgccaccatc

SEQ ID NO: 361867 - DNA, 16 bp, M. musculus
aggcgtgtgccacctc

SEQ ID NO: 361868 - DNA, 17 bp, M. musculus
aggcgtgtgctaccaca

SEQ ID NO: 361869 - DNA, 16 bp, M. musculus
aggctaaactcttccc

SEQ ID NO: 361870 - DNA, 16 bp, M. musculus
aggctaacctcaaact

SEQ ID NO: 361871 - DNA, 16 bp, M. musculus
aggctaacctggtcta

SEQ ID NO: 361872 - DNA, 19 bp, M. musculus
aggctaagcactgcacaga

SEQ ID NO: 361873 - DNA, 16 bp, M. musculus
aggctaaggcaggaag

SEQ ID NO: 361874 - DNA, 16 bp, M. musculus
aggctacacagagaaa

SEQ ID NO: 361875 - DNA, 16 bp, M. musculus
aggctacaggagaccc

SEQ ID NO: 361876 - DNA, 16 bp, M. musculus
aggctacatagtgaga

SEQ ID NO: 361877 - DNA, 17 bp, M. musculus
aggctacatagtgagtt

SEQ ID NO: 361878 - DNA, 16 bp, M. musculus
aggctaccaggaacat

SEQ ID NO: 361879 - DNA, 16 bp, M. musculus
aggctaccctgggcta

SEQ ID NO: 361880 - DNA, 16 bp, M. musculus
aggctagaagcttcca

SEQ ID NO: 361881 - DNA, 16 bp, M. musculus
aggctagaagggaggt

SEQ ID NO: 361882 - DNA, 16 bp, M. musculus
aggctagccaaggcta

SEQ ID NO: 361883 - DNA, 16 bp, M. musculus
aggctagcctcagcta

SEQ ID NO: 361884 - DNA, 16 bp, M. musculus
aggctagcctccaact

SEQ ID NO: 361885 - DNA, 16 bp, M. musculus
aggctagcctccagct

SEQ ID NO: 361886 - DNA, 16 bp, M. musculus
aggctagcctgagcta

SEQ ID NO: 361887 - DNA, 16 bp, M. musculus
aggctagcctgatcta

SEQ ID NO: 361888 - DNA, 16 bp, M. musculus
aggctagcctggagct

SEQ ID NO: 361889 - DNA, 16 bp, M. musculus
aggctagcctgggcaa

SEQ ID NO: 361890 - DNA, 16 bp, M. musculus
aggctagcctgggcta

SEQ ID NO: 361891 - DNA, 16 bp, M. musculus
aggctagcctgggtta

SEQ ID NO: 361892 - DNA, 16 bp, M. musculus
aggctagcctggtcta

SEQ ID NO: 361893 - DNA, 16 bp, M. musculus
aggctagccttgaact

SEQ ID NO: 361894 - DNA, 16 bp, M. musculus
aggctagccttgagct

SEQ ID NO: 361895 - DNA, 16 bp, M. musculus
aggctagccttggcta

SEQ ID NO: 361896 - DNA, 16 bp, M. musculus
aggctagctttaaact

SEQ ID NO: 361897 - DNA, 16 bp, M. musculus
aggctagctttgaact

SEQ ID NO: 361898 - DNA, 16 bp, M. musculus
aggctaggcacttcct

SEQ ID NO: 361899 - DNA, 16 bp, M. musculus
aggctagtctggaatt

SEQ ID NO: 361900 - DNA, 16 bp, M. musculus
aggctagtcttgaact

SEQ ID NO: 361901 - DNA, 16 bp, M. musculus
aggctagtcttgaatt

SEQ ID NO: 361902 - DNA, 16 bp, M. musculus
aggctatccttgaact

SEQ ID NO: 361903 - DNA, 16 bp, M. musculus
aggctatccttggcta

SEQ ID NO: 361904 - DNA, 16 bp, M. musculus
aggctatgcagagaaa

SEQ ID NO: 361905 - DNA, 17 bp, M. musculus
aggctatgctggtgcct

SEQ ID NO: 361906 - DNA, 16 bp, M. musculus
aggctcaattttacca

SEQ ID NO: 361907 - DNA, 16 bp, M. musculus
aggctcagagcagctg

SEQ ID NO: 361908 - DNA, 16 bp, M. musculus
aggctcagccagagcc

SEQ ID NO: 361909 - DNA, 16 bp, M. musculus
aggctcaggaaacatc

SEQ ID NO: 361910 - DNA, 16 bp, M. musculus
aggctcagggagagac

SEQ ID NO: 361911 - DNA, 16 bp, M. musculus
aggctcaggtgtttga

SEQ ID NO: 361912 - DNA, 16 bp, M. musculus
aggctcagtggttaag

SEQ ID NO: 361913 - DNA, 16 bp, M. musculus
aggctcatcctttccc

SEQ ID NO: 361914 - DNA, 16 bp, M. musculus
aggctccaatgccagt

SEQ ID NO: 361915 - DNA, 16 bp, M. musculus
aggctccaccaagcag

SEQ ID NO: 361916 - DNA, 16 bp, M. musculus
aggctccaccagcagc

SEQ ID NO: 361917 - DNA, 16 bp, M. musculus
aggctccacctcctaa

SEQ ID NO: 361918 - DNA, 16 bp, M. musculus
aggctccagatacctg

SEQ ID NO: 361919 - DNA, 16 bp, M. musculus
aggctccagggagtct

SEQ ID NO: 361920 - DNA, 16 bp, M. musculus
aggctccagtcagcaa

SEQ ID NO: 361921 - DNA, 16 bp, M. musculus
aggctccatccagcag

SEQ ID NO: 361922 - DNA, 16 bp, M. musculus
aggctcccaagaatca

SEQ ID NO: 361923 - DNA, 16 bp, M. musculus
aggctcccagcagcag

SEQ ID NO: 361924 - DNA, 16 bp, M. musculus
aggctcccaggacaca

SEQ ID NO: 361925 - DNA, 16 bp, M. musculus
aggctccctgatctct

SEQ ID NO: 361926 - DNA, 16 bp, M. musculus
aggctcctgacacaag

SEQ ID NO: 361927 - DNA, 16 bp, M. musculus
aggctcctgagctcct

SEQ ID NO: 361928 - DNA, 16 bp, M. musculus
aggctcctgatccagt

SEQ ID NO: 361929 - DNA, 16 bp, M. musculus
aggctcctgtctgtaa

SEQ ID NO: 361930 - DNA, 17 bp, M. musculus
aggctcctttctctgtg

SEQ ID NO: 361931 - DNA, 16 bp, M. musculus
aggctctaccctaggt

SEQ ID NO: 361932 - DNA, 16 bp, M. musculus
aggctctacctcctaa

SEQ ID NO: 361933 - DNA, 16 bp, M. musculus
aggctctatcagcagc

SEQ ID NO: 361934 - DNA, 16 bp, M. musculus
aggctctcagagactg

SEQ ID NO: 361935 - DNA, 16 bp, M. musculus
aggctctcccagagcc

SEQ ID NO: 361936 - DNA, 16 bp, M. musculus
aggctctgacagagcc

SEQ ID NO: 361937 - DNA, 16 bp, M. musculus
aggctctgcactgtga

SEQ ID NO: 361938 - DNA, 17 bp, M. musculus
aggctctgccagagcct

SEQ ID NO: 361939 - DNA, 16 bp, M. musculus
aggctctgctcaaggt

SEQ ID NO: 361940 - DNA, 16 bp, M. musculus
aggctctggagagatg

SEQ ID NO: 361941 - DNA, 16 bp, M. musculus
aggctctggattcaat

SEQ ID NO: 361942 - DNA, 16 bp, M. musculus
aggctctggcaaggcc

SEQ ID NO: 361943 - DNA, 17 bp, M. musculus
aggctctggcagggcct

SEQ ID NO: 361944 - DNA, 16 bp, M. musculus
aggctctgggttcaat

SEQ ID NO: 361945 - DNA, 16 bp, M. musculus
aggctcttccagagcc

SEQ ID NO: 361946 - DNA, 17 bp, M. musculus
aggctcttccccacttt

SEQ ID NO: 361947 - DNA, 16 bp, M. musculus
aggctcttggtaaaga

SEQ ID NO: 361948 - DNA, 16 bp, M. musculus
aggctcttgtctgcaa

SEQ ID NO: 361949 - DNA, 16 bp, M. musculus
aggctgaaaagatggc

SEQ ID NO: 361950 - DNA, 16 bp, M. musculus
aggctgaaacaggaag

SEQ ID NO: 361951 - DNA, 16 bp, M. musculus
aggctgaagcagaaga

SEQ ID NO: 361952 - DNA, 16 bp, M. musculus
aggctgaagcaggagg

SEQ ID NO: 361953 - DNA, 16 bp, M. musculus
aggctgaaggctgaag

SEQ ID NO: 361954 - DNA, 16 bp, M. musculus
aggctgacaaggatct

SEQ ID NO: 361955 - DNA, 16 bp, M. musculus
aggctgacacaggagg

SEQ ID NO: 361956 - DNA, 16 bp, M. musculus
aggctgacatcaaact

SEQ ID NO: 361957 - DNA, 16 bp, M. musculus
aggctgacctcagact

SEQ ID NO: 361958 - DNA, 16 bp, M. musculus
aggctgacctccaact

SEQ ID NO: 361959 - DNA, 16 bp, M. musculus
aggctgaccttgaatt

SEQ ID NO: 361960 - DNA, 16 bp, M. musculus
aggctgaccttgacct

SEQ ID NO: 361961 - DNA, 16 bp, M. musculus
aggctgaccttggact

SEQ ID NO: 361962 - DNA, 16 bp, M. musculus
aggctgactctcctct

SEQ ID NO: 361963 - DNA, 16 bp, M. musculus
aggctgactgtccaca

SEQ ID NO: 361964 - DNA, 16 bp, M. musculus
aggctgacttcaaact

SEQ ID NO: 361965 - DNA, 16 bp, M. musculus
aggctgactttgaact

SEQ ID NO: 361966 - DNA, 16 bp, M. musculus
aggctgagaacctggt

SEQ ID NO: 361967 - DNA, 16 bp, M. musculus
aggctgagaagcactg

SEQ ID NO: 361968 - DNA, 16 bp, M. musculus
aggctgagagaagcca

SEQ ID NO: 361969 - DNA, 16 bp, M. musculus
aggctgagagaagctg

SEQ ID NO: 361970 - DNA, 16 bp, M. musculus
aggctgagcaagacag

SEQ ID NO: 361971 - DNA, 16 bp, M. musculus
aggctgagcaggccag

SEQ ID NO: 361972 - DNA, 16 bp, M. musculus
aggctgagccaggctt

SEQ ID NO: 361973 - DNA, 16 bp, M. musculus
aggctgaggagatggc

SEQ ID NO: 361974 - DNA, 16 bp, M. musculus
aggctgaggcaagaaa

SEQ ID NO: 361975 - DNA, 16 bp, M. musculus
aggctgaggcaagaga

SEQ ID NO: 361976 - DNA, 16 bp, M. musculus
aggctgaggcaggaac

SEQ ID NO: 361977 - DNA, 16 bp, M. musculus
aggctgaggcaggagg

SEQ ID NO: 361978 - DNA, 16 bp, M. musculus
aggctgaggcagggga

SEQ ID NO: 361979 - DNA, 16 bp, M. musculus
aggctgaggccacctc

SEQ ID NO: 361980 - DNA, 16 bp, M. musculus
aggctgaggccgcctc

SEQ ID NO: 361981 - DNA, 16 bp, M. musculus
aggctgagggaggaag

SEQ ID NO: 361982 - DNA, 16 bp, M. musculus
aggctgagggagggag

SEQ ID NO: 361983 - DNA, 16 bp, M. musculus
aggctgaggtgggagg

SEQ ID NO: 361984 - DNA, 16 bp, M. musculus
aggctgatagtggaag

SEQ ID NO: 361985 - DNA, 16 bp, M. musculus
aggctgatctcaaact

SEQ ID NO: 361986 - DNA, 16 bp, M. musculus
aggctgatcttgaatt

SEQ ID NO: 361987 - DNA, 16 bp, M. musculus
aggctgccaactttct

SEQ ID NO: 361988 - DNA, 16 bp, M. musculus
aggctgccactttgtc

SEQ ID NO: 361989 - DNA, 16 bp, M. musculus
aggctgccagcagaag

SEQ ID NO: 361990 - DNA, 16 bp, M. musculus
aggctgccagcttgga

SEQ ID NO: 361991 - DNA, 16 bp, M. musculus
aggctgccctcaaact

SEQ ID NO: 361992 - DNA, 16 bp, M. musculus
aggctgccctccaact

SEQ ID NO: 361993 - DNA, 16 bp, M. musculus
aggctgccctggaact

SEQ ID NO: 361994 - DNA, 16 bp, M. musculus
aggctgcccttaaact

SEQ ID NO: 361995 - DNA, 16 bp, M. musculus
aggctgcccttgaact

SEQ ID NO: 361996 - DNA, 17 bp, M. musculus
aggctgcctcccaagcc

SEQ ID NO: 361997 - DNA, 16 bp, M. musculus
aggctgcctcccaggc

SEQ ID NO: 361998 - DNA, 16 bp, M. musculus
aggctgcctggccagc

SEQ ID NO: 361999 - DNA, 16 bp, M. musculus
aggctgccttcaaact

SEQ ID NO: 362000 - DNA, 16 bp, M. musculus
aggctgctggtggaag

SEQ ID NO: 362001 - DNA, 16 bp, M. musculus
aggctgctgtaacaaa

SEQ ID NO: 362002 - DNA, 16 bp, M. musculus
aggctgctgtctgcaa

SEQ ID NO: 362003 - DNA, 16 bp, M. musculus
aggctgcttcagattg

SEQ ID NO: 362004 - DNA, 16 bp, M. musculus
aggctggaaaacaagt

SEQ ID NO: 362005 - DNA, 16 bp, M. musculus
aggctggaagaagctg

SEQ ID NO: 362006 - DNA, 16 bp, M. musculus
aggctggaagaggagg

SEQ ID NO: 362007 - DNA, 16 bp, M. musculus
aggctggacaaggcag

SEQ ID NO: 362008 - DNA, 16 bp, M. musculus
aggctggagcaggaag

SEQ ID NO: 362009 - DNA, 16 bp, M. musculus
aggctggagcaggagg

SEQ ID NO: 362010 - DNA, 16 bp, M. musculus
aggctggagctggagc

SEQ ID NO: 362011 - DNA, 16 bp, M. musculus
aggctggaggaagggc

SEQ ID NO: 362012 - DNA, 16 bp, M. musculus
aggctggaggccccag

SEQ ID NO: 362013 - DNA, 16 bp, M. musculus
aggctggagtgatggc

SEQ ID NO: 362014 - DNA, 16 bp, M. musculus
aggctggataaggcaa

SEQ ID NO: 362015 - DNA, 16 bp, M. musculus
aggctggccagaaact

SEQ ID NO: 362016 - DNA, 16 bp, M. musculus
aggctggccatggcca

SEQ ID NO: 362017 - DNA, 16 bp, M. musculus
aggctggccctctttg

SEQ ID NO: 362018 - DNA, 16 bp, M. musculus
aggctggccctgaatt

SEQ ID NO: 362019 - DNA, 16 bp, M. musculus
aggctggcctaaactc

SEQ ID NO: 362020 - DNA, 16 bp, M. musculus
aggctggcctcaaaat

SEQ ID NO: 362021 - DNA, 16 bp, M. musculus
aggctggcctcaaaca

SEQ ID NO: 362022 - DNA, 16 bp, M. musculus
aggctggcctcaaacc

SEQ ID NO: 362023 - DNA, 16 bp, M. musculus
aggctggcctcaaact

SEQ ID NO: 362024 - DNA, 16 bp, M. musculus
aggctggcctcaaagt

SEQ ID NO: 362025 - DNA, 16 bp, M. musculus
aggctggcctcaagct

SEQ ID NO: 362026 - DNA, 29 bp, M. musculus
aggctggcctcgaactcagaaatctgcct

SEQ ID NO: 362027 - DNA, 16 bp, M. musculus
aggctggcctctggct

SEQ ID NO: 362028 - DNA, 16 bp, M. musculus
aggctggcctgcagct

SEQ ID NO: 362029 - DNA, 16 bp, M. musculus
aggctggcctgcctct

SEQ ID NO: 362030 - DNA, 16 bp, M. musculus
aggctggccttcaata

SEQ ID NO: 362031 - DNA, 16 bp, M. musculus
aggctggccttgaact

SEQ ID NO: 362032 - DNA, 16 bp, M. musculus
aggctggccttgacct

SEQ ID NO: 362033 - DNA, 16 bp, M. musculus
aggctggccttgagtt

SEQ ID NO: 362034 - DNA, 16 bp, M. musculus
aggctggccttgtact

SEQ ID NO: 362035 - DNA, 16 bp, M. musculus
aggctggcctttaact

SEQ ID NO: 362036 - DNA, 16 bp, M. musculus
aggctggctagccagc

SEQ ID NO: 362037 - DNA, 16 bp, M. musculus
aggctggctatgaact

SEQ ID NO: 362038 - DNA, 16 bp, M. musculus
aggctggcttcaaacc

SEQ ID NO: 362039 - DNA, 16 bp, M. musculus
aggctggcttcaaact

SEQ ID NO: 362040 - DNA, 16 bp, M. musculus
aggctggcttctaact

SEQ ID NO: 362041 - DNA, 16 bp, M. musculus
aggctggctttaaact

SEQ ID NO: 362042 - DNA, 16 bp, M. musculus
aggctggctttgaact

SEQ ID NO: 362043 - DNA, 16 bp, M. musculus
aggctggctttgaatt

SEQ ID NO: 362044 - DNA, 16 bp, M. musculus
aggctggctttgagct

SEQ ID NO: 362045 - DNA, 16 bp, M. musculus
aggctgggaagtccaa

SEQ ID NO: 362046 - DNA, 16 bp, M. musculus
aggctgggcatggcag

SEQ ID NO: 362047 - DNA, 16 bp, M. musculus
aggctgggctggctgg

SEQ ID NO: 362048 - DNA, 16 bp, M. musculus
aggctgggctgggctg

SEQ ID NO: 362049 - DNA, 16 bp, M. musculus
aggctggggcaggaga

SEQ ID NO: 362050 - DNA, 16 bp, M. musculus
aggctggggccatctg

SEQ ID NO: 362051 - DNA, 16 bp, M. musculus
aggctggggctggggc

SEQ ID NO: 362052 - DNA, 16 bp, M. musculus
aggctgggggagggca

SEQ ID NO: 362053 - DNA, 16 bp, M. musculus
aggctgggggctggag

SEQ ID NO: 362054 - DNA, 16 bp, M. musculus
aggctgggtgaggcaa

SEQ ID NO: 362055 - DNA, 16 bp, M. musculus
aggctgggtgtgatgg

SEQ ID NO: 362056 - DNA, 16 bp, M. musculus
aggctggtccttggca

SEQ ID NO: 362057 - DNA, 16 bp, M. musculus
aggctggtctacacag

SEQ ID NO: 362058 - DNA, 16 bp, M. musculus
aggctggtctcaaact

SEQ ID NO: 362059 - DNA, 16 bp, M. musculus
aggctggtctcaaatt

SEQ ID NO: 362060 - DNA, 16 bp, M. musculus
aggctggtctcacact

SEQ ID NO: 362061 - DNA, 16 bp, M. musculus
aggctggtcttcaact

SEQ ID NO: 362062 - DNA, 17 bp, M. musculus
aggctggtgagatggct

SEQ ID NO: 362063 - DNA, 16 bp, M. musculus
aggctggtggatttct

SEQ ID NO: 362064 - DNA, 16 bp, M. musculus
aggctggtttagaact

SEQ ID NO: 362065 - DNA, 16 bp, M. musculus
aggctgtaaaagctga

SEQ ID NO: 362066 - DNA, 16 bp, M. musculus
aggctgtactacagag

SEQ ID NO: 362067 - DNA, 18 bp, M. musculus
aggctgtcctagaactca

SEQ ID NO: 362068 - DNA, 16 bp, M. musculus
aggctgtcctcaaact

SEQ ID NO: 362069 - DNA, 16 bp, M. musculus
aggctgtcctctctct

SEQ ID NO: 362070 - DNA, 16 bp, M. musculus
aggctgtcctggaact

SEQ ID NO: 362071 - DNA, 19 bp, M. musculus
aggctgtcctggaactcac

SEQ ID NO: 362072 - DNA, 16 bp, M. musculus
aggctgtccttgaatt

SEQ ID NO: 362073 - DNA, 16 bp, M. musculus
aggctgtctctgactc

SEQ ID NO: 362074 - DNA, 16 bp, M. musculus
aggctgtgaagaactg

SEQ ID NO: 362075 - DNA, 16 bp, M. musculus
aggctgtgctctctcc

SEQ ID NO: 362076 - DNA, 16 bp, M. musculus
aggctgtgctggagga

SEQ ID NO: 362077 - DNA, 16 bp, M. musculus
aggctgtggagaaaga

SEQ ID NO: 362078 - DNA, 16 bp, M. musculus
aggctgtggaggagtg

SEQ ID NO: 362079 - DNA, 16 bp, M. musculus
aggctgtggagggatg

SEQ ID NO: 362080 - DNA, 16 bp, M. musculus
aggctgtggtggcaca

SEQ ID NO: 362081 - DNA, 16 bp, M. musculus
aggctgtggttctcaa

SEQ ID NO: 362082 - DNA, 16 bp, M. musculus
aggctgtgtgtgtgtg

SEQ ID NO: 362083 - DNA, 17 bp, M. musculus
aggctgtgttccagaga

SEQ ID NO: 362084 - DNA, 16 bp, M. musculus
aggctgtgtttgttca

SEQ ID NO: 362085 - DNA, 16 bp, M. musculus
aggcttattatgggat

SEQ ID NO: 362086 - DNA, 16 bp, M. musculus
aggcttcagtcagata

SEQ ID NO: 362087 - DNA, 16 bp, M. musculus
aggcttccaggagtca

SEQ ID NO: 362088 - DNA, 16 bp, M. musculus
aggcttcccagggata

SEQ ID NO: 362089 - DNA, 16 bp, M. musculus
aggcttcctcctgcag

SEQ ID NO: 362090 - DNA, 16 bp, M. musculus
aggcttcctgcatgct

SEQ ID NO: 362091 - DNA, 16 bp, M. musculus
aggcttcctggaggag

SEQ ID NO: 362092 - DNA, 16 bp, M. musculus
aggcttctaagagaag

SEQ ID NO: 362093 - DNA, 16 bp, M. musculus
aggcttctgcctcagc

SEQ ID NO: 362094 - DNA, 16 bp, M. musculus
aggcttcttggaggag

SEQ ID NO: 362095 - DNA, 16 bp, M. musculus
aggcttgcaccaccac

SEQ ID NO: 362096 - DNA, 16 bp, M. musculus
aggcttgcagagcaag

SEQ ID NO: 362097 - DNA, 16 bp, M. musculus
aggcttgcgccaccac

SEQ ID NO: 362098 - DNA, 16 bp, M. musculus
aggcttgctcagcctg

SEQ ID NO: 362099 - DNA, 16 bp, M. musculus
aggcttgctggaggaa

SEQ ID NO: 362100 - DNA, 16 bp, M. musculus
aggcttgctggccagc

SEQ ID NO: 362101 - DNA, 16 bp, M. musculus
aggcttgggttttgtt

SEQ ID NO: 362102 - DNA, 16 bp, M. musculus
aggcttggtggcaagt

SEQ ID NO: 362103 - DNA, 16 bp, M. musculus
aggcttgtactaccat

SEQ ID NO: 362104 - DNA, 16 bp, M. musculus
aggcttgtctgcactc

SEQ ID NO: 362105 - DNA, 16 bp, M. musculus
aggcttgtgccaccat

SEQ ID NO: 362106 - DNA, 16 bp, M. musculus
aggcttgttttgtgaa

SEQ ID NO: 362107 - DNA, 16 bp, M. musculus
aggctttaccagcagc

SEQ ID NO: 362108 - DNA, 16 bp, M. musculus
aggctttcctggaact

SEQ ID NO: 362109 - DNA, 16 bp, M. musculus
aggctttctctgtata

SEQ ID NO: 362110 - DNA, 16 bp, M. musculus
aggctttcttttcctt

SEQ ID NO: 362111 - DNA, 16 bp, M. musculus
aggctttgcaatttta

SEQ ID NO: 362112 - DNA, 16 bp, M. musculus
aggcttttacccagag

SEQ ID NO: 362113 - DNA, 16 bp, M. musculus
aggcttttcccacttt

SEQ ID NO: 362114 - DNA, 16 bp, M. musculus
aggcttttccccacat

SEQ ID NO: 362115 - DNA, 16 bp, M. musculus
aggcttttccgcactt

SEQ ID NO: 362116 - DNA, 16 bp, M. musculus
aggctttttcagcatt

SEQ ID NO: 362117 - DNA, 16 bp, M. musculus
aggctttttttttcct

SEQ ID NO: 362118 - DNA, 16 bp, M. musculus
agggaaaaactggaag

SEQ ID NO: 362119 - DNA, 16 bp, M. musculus
agggaaaactccaaaa

SEQ ID NO: 362120 - DNA, 16 bp, M. musculus
agggaaaagattctag

SEQ ID NO: 362121 - DNA, 16 bp, M. musculus
agggaaaagccttgaa

SEQ ID NO: 362122 - DNA, 16 bp, M. musculus
agggaaaaggctctag

SEQ ID NO: 362123 - DNA, 16 bp, M. musculus
agggaaaatacaccct

SEQ ID NO: 362124 - DNA, 16 bp, M. musculus
agggaaaatgactgaa

SEQ ID NO: 362125 - DNA, 16 bp, M. musculus
agggaaacaacaccgt

SEQ ID NO: 362126 - DNA, 16 bp, M. musculus
agggaaacaatacctt

SEQ ID NO: 362127 - DNA, 16 bp, M. musculus
agggaaacagaaacca

SEQ ID NO: 362128 - DNA, 16 bp, M. musculus
agggaaacagtgaaac

SEQ ID NO: 362129 - DNA, 16 bp, M. musculus
agggaaacatttgaaa

SEQ ID NO: 362130 - DNA, 16 bp, M. musculus
agggaaaccaaggcag

SEQ ID NO: 362131 - DNA, 16 bp, M. musculus
agggaaactgaggcag

SEQ ID NO: 362132 - DNA, 16 bp, M. musculus
agggaaagaaaaatca

SEQ ID NO: 362133 - DNA, 16 bp, M. musculus
agggaaagaactgaag

SEQ ID NO: 362134 - DNA, 16 bp, M. musculus
agggaaagaatatgat

SEQ ID NO: 362135 - DNA, 16 bp, M. musculus
agggaaagaggagtta

SEQ ID NO: 362136 - DNA, 16 bp, M. musculus
agggaaagcacacaga

SEQ ID NO: 362137 - DNA, 16 bp, M. musculus
agggaaagcccacaga

SEQ ID NO: 362138 - DNA, 16 bp, M. musculus
agggaaagtacacaga

SEQ ID NO: 362139 - DNA, 16 bp, M. musculus
agggaaatcaggaaag

SEQ ID NO: 362140 - DNA, 16 bp, M. musculus
agggaaatgagaggct

SEQ ID NO: 362141 - DNA, 16 bp, M. musculus
agggaaatgcaaatta

SEQ ID NO: 362142 - DNA, 16 bp, M. musculus
agggaaatgctggaag

SEQ ID NO: 362143 - DNA, 17 bp, M. musculus
agggaaattggtttgaa

SEQ ID NO: 362144 - DNA, 16 bp, M. musculus
agggaacaaactcagg

SEQ ID NO: 362145 - DNA, 16 bp, M. musculus
agggaacaaagcttaa

SEQ ID NO: 362146 - DNA, 16 bp, M. musculus
agggaacaatttgaag

SEQ ID NO: 362147 - DNA, 16 bp, M. musculus
agggaacagagacaga

SEQ ID NO: 362148 - DNA, 16 bp, M. musculus
agggaacagagaccaa

SEQ ID NO: 362149 - DNA, 16 bp, M. musculus
agggaacatcaattga

SEQ ID NO: 362150 - DNA, 16 bp, M. musculus
agggaacatggtggca

SEQ ID NO: 362151 - DNA, 16 bp, M. musculus
agggaacattacagaa

SEQ ID NO: 362152 - DNA, 16 bp, M. musculus
agggaacattccagaa

SEQ ID NO: 362153 - DNA, 16 bp, M. musculus
agggaacattgcagaa

SEQ ID NO: 362154 - DNA, 16 bp, M. musculus
agggaaccacaaccct

SEQ ID NO: 362155 - DNA, 16 bp, M. musculus
agggaacctcagctga

SEQ ID NO: 362156 - DNA, 21 bp, M. musculus
agggaactgcaaccctatagg

SEQ ID NO: 362157 - DNA, 16 bp, M. musculus
agggaactggagagat

SEQ ID NO: 362158 - DNA, 16 bp, M. musculus
agggaagaaaatcaaa

SEQ ID NO: 362159 - DNA, 16 bp, M. musculus
agggaagaagtcaaaa

SEQ ID NO: 362160 - DNA, 16 bp, M. musculus
agggaagacagacaga

SEQ ID NO: 362161 - DNA, 16 bp, M. musculus
agggaagaccaatgga

SEQ ID NO: 362162 - DNA, 16 bp, M. musculus
agggaagagagaacct

SEQ ID NO: 362163 - DNA, 16 bp, M. musculus
agggaagagcacagca

SEQ ID NO: 362164 - DNA, 16 bp, M. musculus
agggaagagctggaag

SEQ ID NO: 362165 - DNA, 16 bp, M. musculus
agggaagcaccctcat

SEQ ID NO: 362166 - DNA, 16 bp, M. musculus
agggaagcagaggcaa

SEQ ID NO: 362167 - DNA, 16 bp, M. musculus
agggaagcaggggtgg

SEQ ID NO: 362168 - DNA, 16 bp, M. musculus
agggaagccaaggcag

SEQ ID NO: 362169 - DNA, 16 bp, M. musculus
agggaagccagagcag

SEQ ID NO: 362170 - DNA, 16 bp, M. musculus
agggaagccaggacag

SEQ ID NO: 362171 - DNA, 16 bp, M. musculus
agggaagcccatcccc

SEQ ID NO: 362172 - DNA, 16 bp, M. musculus
agggaagcctgtgctt

SEQ ID NO: 362173 - DNA, 16 bp, M. musculus
agggaagctggagaga

SEQ ID NO: 362174 - DNA, 16 bp, M. musculus
agggaaggcagagcag

SEQ ID NO: 362175 - DNA, 16 bp, M. musculus
agggaaggctcagtgg

SEQ ID NO: 362176 - DNA, 16 bp, M. musculus
agggaaggtaggccct

SEQ ID NO: 362177 - DNA, 16 bp, M. musculus
agggaaggtgaacaga

SEQ ID NO: 362178 - DNA, 16 bp, M. musculus
agggaaggtgcccagt

SEQ ID NO: 362179 - DNA, 16 bp, M. musculus
agggaagtcagggcag

SEQ ID NO: 362180 - DNA, 16 bp, M. musculus
agggaagtgcttgctg

SEQ ID NO: 362181 - DNA, 17 bp, M. musculus
agggaatcccactgaga

SEQ ID NO: 362182 - DNA, 16 bp, M. musculus
agggaatggcactatt

SEQ ID NO: 362183 - DNA, 16 bp, M. musculus
agggaatggcactgtt

SEQ ID NO: 362184 - DNA, 16 bp, M. musculus
agggaattccaggaca

SEQ ID NO: 362185 - DNA, 16 bp, M. musculus
agggacaagaggacag

SEQ ID NO: 362186 - DNA, 16 bp, M. musculus
agggacaagccaaagt

SEQ ID NO: 362187 - DNA, 16 bp, M. musculus
agggacaaggctgccc

SEQ ID NO: 362188 - DNA, 16 bp, M. musculus
agggacacaggaaccc

SEQ ID NO: 362189 - DNA, 16 bp, M. musculus
agggacacagtgaaaa

SEQ ID NO: 362190 - DNA, 16 bp, M. musculus
agggacaccaggagaa

SEQ ID NO: 362191 - DNA, 16 bp, M. musculus
agggacacttggacac

SEQ ID NO: 362192 - DNA, 16 bp, M. musculus
agggacagaaacagag

SEQ ID NO: 362193 - DNA, 16 bp, M. musculus
agggacagacagacag

SEQ ID NO: 362194 - DNA, 16 bp, M. musculus
agggacagacagatgg

SEQ ID NO: 362195 - DNA, 16 bp, M. musculus
agggacagagacacag

SEQ ID NO: 362196 - DNA, 16 bp, M. musculus
agggacagagagacag

SEQ ID NO: 362197 - DNA, 16 bp, M. musculus
agggacagagatagag

SEQ ID NO: 362198 - DNA, 16 bp, M. musculus
agggacagaggcagag

SEQ ID NO: 362199 - DNA, 16 bp, M. musculus
agggacagcaccaccc

SEQ ID NO: 362200 - DNA, 16 bp, M. musculus
agggacagggagatga

SEQ ID NO: 362201 - DNA, 16 bp, M. musculus
agggacagtatcataa

SEQ ID NO: 362202 - DNA, 16 bp, M. musculus
agggacattttctcaa

SEQ ID NO: 362203 - DNA, 16 bp, M. musculus
agggaccaagtgttca

SEQ ID NO: 362204 - DNA, 16 bp, M. musculus
agggacccaaagagga

SEQ ID NO: 362205 - DNA, 16 bp, M. musculus
agggacccaaggctcc

SEQ ID NO: 362206 - DNA, 16 bp, M. musculus
agggaccccctgagtg

SEQ ID NO: 362207 - DNA, 16 bp, M. musculus
agggaccctgccccca

SEQ ID NO: 362208 - DNA, 16 bp, M. musculus
agggacctgaaggcag

SEQ ID NO: 362209 - DNA, 16 bp, M. musculus
agggacctgggaagga

SEQ ID NO: 362210 - DNA, 16 bp, M. musculus
agggacctgggaggga

SEQ ID NO: 362211 - DNA, 16 bp, M. musculus
agggacctgggttcaa

SEQ ID NO: 362212 - DNA, 21 bp, M. musculus
agggacggggttctggcactc

SEQ ID NO: 362213 - DNA, 16 bp, M. musculus
agggactcaaggctcc

SEQ ID NO: 362214 - DNA, 16 bp, M. musculus
agggactgatgcagag

SEQ ID NO: 362215 - DNA, 16 bp, M. musculus
agggactggaaagatg

SEQ ID NO: 362216 - DNA, 16 bp, M. musculus
agggactggaagcccc

SEQ ID NO: 362217 - DNA, 16 bp, M. musculus
agggactggagagatg

SEQ ID NO: 362218 - DNA, 16 bp, M. musculus
agggactgtccaggtg

SEQ ID NO: 362219 - DNA, 16 bp, M. musculus
agggacttcatcctca

SEQ ID NO: 362220 - DNA, 16 bp, M. musculus
agggacttgggaagaa

SEQ ID NO: 362221 - DNA, 17 bp, M. musculus
agggacttgtgccccag

SEQ ID NO: 362222 - DNA, 16 bp, M. musculus
agggactttagatgaa

SEQ ID NO: 362223 - DNA, 16 bp, M. musculus
agggactttgtcctca

SEQ ID NO: 362224 - DNA, 16 bp, M. musculus
agggagaaaagtcaag

SEQ ID NO: 362225 - DNA, 19 bp, M. musculus
agggagaaacgctctaagt

SEQ ID NO: 362226 - DNA, 16 bp, M. musculus
agggagaaactgggag

SEQ ID NO: 362227 - DNA, 16 bp, M. musculus
agggagaaagtgtgca

SEQ ID NO: 362228 - DNA, 16 bp, M. musculus
agggagaacctgtcaa

SEQ ID NO: 362229 - DNA, 16 bp, M. musculus
agggagaagcaggcag

SEQ ID NO: 362230 - DNA, 16 bp, M. musculus
agggagaagccagaga

SEQ ID NO: 362231 - DNA, 16 bp, M. musculus
agggagaaggaactta

SEQ ID NO: 362232 - DNA, 16 bp, M. musculus
agggagacaaccatgg

SEQ ID NO: 362233 - DNA, 16 bp, M. musculus
agggagacacagagag

SEQ ID NO: 362234 - DNA, 16 bp, M. musculus
agggagaccagaagag

SEQ ID NO: 362235 - DNA, 16 bp, M. musculus
agggagaccctatctc

SEQ ID NO: 362236 - DNA, 16 bp, M. musculus
agggagactgggaagg

SEQ ID NO: 362237 - DNA, 16 bp, M. musculus
agggagagagagccac

SEQ ID NO: 362238 - DNA, 16 bp, M. musculus
agggagagagttggca

SEQ ID NO: 362239 - DNA, 16 bp, M. musculus
agggagagatggctca

SEQ ID NO: 362240 - DNA, 16 bp, M. musculus
agggagagctcatgat

SEQ ID NO: 362241 - DNA, 16 bp, M. musculus
agggagaggacacaga

SEQ ID NO: 362242 - DNA, 16 bp, M. musculus
agggagaggcaggtgg

SEQ ID NO: 362243 - DNA, 16 bp, M. musculus
agggagatcctgtctc

SEQ ID NO: 362244 - DNA, 16 bp, M. musculus
agggagcaccctcata

SEQ ID NO: 362245 - DNA, 16 bp, M. musculus
agggagcagaaagaat

SEQ ID NO: 362246 - DNA, 16 bp, M. musculus
agggagcagagcagag

SEQ ID NO: 362247 - DNA, 17 bp, M. musculus
agggagcaggagctgat

SEQ ID NO: 362248 - DNA, 16 bp, M. musculus
agggagcatgtggggg

SEQ ID NO: 362249 - DNA, 16 bp, M. musculus
agggagccatggctcc

SEQ ID NO: 362250 - DNA, 16 bp, M. musculus
agggagcctaggcagg

SEQ ID NO: 362251 - DNA, 16 bp, M. musculus
agggagctccaggaca

SEQ ID NO: 362252 - DNA, 16 bp, M. musculus
agggagctgaaggttg

SEQ ID NO: 362253 - DNA, 16 bp, M. musculus
agggagctttggggat

SEQ ID NO: 362254 - DNA, 16 bp, M. musculus
agggaggaagagtctg

SEQ ID NO: 362255 - DNA, 16 bp, M. musculus
agggaggaatccagga

SEQ ID NO: 362256 - DNA, 16 bp, M. musculus
agggaggagaaactgt

SEQ ID NO: 362257 - DNA, 16 bp, M. musculus
agggaggagacacagg

SEQ ID NO: 362258 - DNA, 16 bp, M. musculus
agggaggagcctctgg

SEQ ID NO: 362259 - DNA, 16 bp, M. musculus
agggaggagctgatgc

SEQ ID NO: 362260 - DNA, 16 bp, M. musculus
agggaggagctgggag

SEQ ID NO: 362261 - DNA, 16 bp, M. musculus
agggaggatatgatag

SEQ ID NO: 362262 - DNA, 16 bp, M. musculus
agggaggcaactctgg

SEQ ID NO: 362263 - DNA, 16 bp, M. musculus
agggaggcagagtcag

SEQ ID NO: 362264 - DNA, 16 bp, M. musculus
agggaggctggggctg

SEQ ID NO: 362265 - DNA, 16 bp, M. musculus
agggagggacatgggt

SEQ ID NO: 362266 - DNA, 16 bp, M. musculus
agggagggaccttagg

SEQ ID NO: 362267 - DNA, 16 bp, M. musculus
agggagggactgaggg

SEQ ID NO: 362268 - DNA, 16 bp, M. musculus
agggagggagagactg

SEQ ID NO: 362269 - DNA, 16 bp, M. musculus
agggagggagggactg

SEQ ID NO: 362270 - DNA, 16 bp, M. musculus
agggagggcttcctgg

SEQ ID NO: 362271 - DNA, 17 bp, M. musculus
agggaggtgctgggcca

SEQ ID NO: 362272 - DNA, 16 bp, M. musculus
agggaggttttggagg

SEQ ID NO: 362273 - DNA, 16 bp, M. musculus
agggagtcagatctcc

SEQ ID NO: 362274 - DNA, 16 bp, M. musculus
agggagtgacactatt

SEQ ID NO: 362275 - DNA, 16 bp, M. musculus
agggagtgaggattga

SEQ ID NO: 362276 - DNA, 16 bp, M. musculus
agggagtgctggagga

SEQ ID NO: 362277 - DNA, 16 bp, M. musculus
agggagtggcactact

SEQ ID NO: 362278 - DNA, 16 bp, M. musculus
agggagtggcactatt

SEQ ID NO: 362279 - DNA, 17 bp, M. musculus
agggagtgtggcatatg

SEQ ID NO: 362280 - DNA, 16 bp, M. musculus
agggagttcaaggcca

SEQ ID NO: 362281 - DNA, 16 bp, M. musculus
agggataaagagtgga

SEQ ID NO: 362282 - DNA, 16 bp, M. musculus
agggataaagatggaa

SEQ ID NO: 362283 - DNA, 17 bp, M. musculus
agggatagcatttgaaa

SEQ ID NO: 362284 - DNA, 16 bp, M. musculus
agggatatgcagagaa

SEQ ID NO: 362285 - DNA, 16 bp, M. musculus
agggatatggctcagt

SEQ ID NO: 362286 - DNA, 16 bp, M. musculus
agggatcaaactctgg

SEQ ID NO: 362287 - DNA, 16 bp, M. musculus
agggatccagtgccct

SEQ ID NO: 362288 - DNA, 16 bp, M. musculus
agggatctagcatgac

SEQ ID NO: 362289 - DNA, 16 bp, M. musculus
agggatctctgagttc

SEQ ID NO: 362290 - DNA, 16 bp, M. musculus
agggatctgatgctct

SEQ ID NO: 362291 - DNA, 16 bp, M. musculus
agggatctggaggcag

SEQ ID NO: 362292 - DNA, 16 bp, M. musculus
agggatctgggaggaa

SEQ ID NO: 362293 - DNA, 16 bp, M. musculus
agggatctgggtggga

SEQ ID NO: 362294 - DNA, 16 bp, M. musculus
agggatgatgatgatg

SEQ ID NO: 362295 - DNA, 16 bp, M. musculus
agggatgcaaggatgg

SEQ ID NO: 362296 - DNA, 16 bp, M. musculus
agggatgctgctcact

SEQ ID NO: 362297 - DNA, 17 bp, M. musculus
agggatggaaatggaga

SEQ ID NO: 362298 - DNA, 16 bp, M. musculus
agggatggaacccagg

SEQ ID NO: 362299 - DNA, 16 bp, M. musculus
agggatggagacaggg

SEQ ID NO: 362300 - DNA, 16 bp, M. musculus
agggatggagcagaga

SEQ ID NO: 362301 - DNA, 16 bp, M. musculus
agggatggatccccag

SEQ ID NO: 362302 - DNA, 16 bp, M. musculus
agggatggatggatgg

SEQ ID NO: 362303 - DNA, 16 bp, M. musculus
agggatggattcatgg

SEQ ID NO: 362304 - DNA, 16 bp, M. musculus
agggatggcaccattc

SEQ ID NO: 362305 - DNA, 16 bp, M. musculus
agggatggggttgcca

SEQ ID NO: 362306 - DNA, 16 bp, M. musculus
agggatgtggagaatg

SEQ ID NO: 362307 - DNA, 16 bp, M. musculus
agggatgttgcttact

SEQ ID NO: 362308 - DNA, 16 bp, M. musculus
agggattgaactcagg

SEQ ID NO: 362309 - DNA, 16 bp, M. musculus
agggattgaatccagg

SEQ ID NO: 362310 - DNA, 16 bp, M. musculus
agggattggactcagg

SEQ ID NO: 362311 - DNA, 16 bp, M. musculus
agggatttgaactcag

SEQ ID NO: 362312 - DNA, 16 bp, M. musculus
agggattttctgtgta

SEQ ID NO: 362313 - DNA, 16 bp, M. musculus
agggattttttttcct

SEQ ID NO: 362314 - DNA, 16 bp, M. musculus
agggcaacaacagggt

SEQ ID NO: 362315 - DNA, 16 bp, M. musculus
agggcaaccctgtagg

SEQ ID NO: 362316 - DNA, 16 bp, M. musculus
agggcaactttcagga

SEQ ID NO: 362317 - DNA, 16 bp, M. musculus
agggcaagaacttgga

SEQ ID NO: 362318 - DNA, 16 bp, M. musculus
agggcaaggctggaga

SEQ ID NO: 362319 - DNA, 16 bp, M. musculus
agggcaatctgcagat

SEQ ID NO: 362320 - DNA, 16 bp, M. musculus
agggcaatgccccaag

SEQ ID NO: 362321 - DNA, 16 bp, M. musculus
agggcacagggacagc

SEQ ID NO: 362322 - DNA, 16 bp, M. musculus
agggcacattgcctca

SEQ ID NO: 362323 - DNA, 16 bp, M. musculus
agggcacgtgatgttt

SEQ ID NO: 362324 - DNA, 16 bp, M. musculus
agggcacttgctgcca

SEQ ID NO: 362325 - DNA, 16 bp, M. musculus
agggcagaagcaagag

SEQ ID NO: 362326 - DNA, 16 bp, M. musculus
agggcagagaaatcaa

SEQ ID NO: 362327 - DNA, 16 bp, M. musculus
agggcagagaacttct

SEQ ID NO: 362328 - DNA, 16 bp, M. musculus
agggcagagctgaaga

SEQ ID NO: 362329 - DNA, 16 bp, M. musculus
agggcagatatgaagg

SEQ ID NO: 362330 - DNA, 16 bp, M. musculus
agggcagatgtgggat

SEQ ID NO: 362331 - DNA, 16 bp, M. musculus
agggcagcaagcagag

SEQ ID NO: 362332 - DNA, 16 bp, M. musculus
agggcagccagagcta

SEQ ID NO: 362333 - DNA, 16 bp, M. musculus
agggcagccagggata

SEQ ID NO: 362334 - DNA, 16 bp, M. musculus
agggcagccagggcag

SEQ ID NO: 362335 - DNA, 16 bp, M. musculus
agggcagccagggcta

SEQ ID NO: 362336 - DNA, 16 bp, M. musculus
agggcagcctaggcta

SEQ ID NO: 362337 - DNA, 16 bp, M. musculus
agggcagcctgagcta

SEQ ID NO: 362338 - DNA, 16 bp, M. musculus
agggcagcctggacta

SEQ ID NO: 362339 - DNA, 16 bp, M. musculus
agggcagcctgggata

SEQ ID NO: 362340 - DNA, 16 bp, M. musculus
agggcaggaacctgag

SEQ ID NO: 362341 - DNA, 16 bp, M. musculus
agggcaggaacttgaa

SEQ ID NO: 362342 - DNA, 16 bp, M. musculus
agggcaggaagctgga

SEQ ID NO: 362343 - DNA, 16 bp, M. musculus
agggcaggagtatcag

SEQ ID NO: 362344 - DNA, 16 bp, M. musculus
agggcaggcagagtga

SEQ ID NO: 362345 - DNA, 16 bp, M. musculus
agggcaggggagatgg

SEQ ID NO: 362346 - DNA, 16 bp, M. musculus
agggcaggggtagggt

SEQ ID NO: 362347 - DNA, 16 bp, M. musculus
agggcaggtggagctg

SEQ ID NO: 362348 - DNA, 16 bp, M. musculus
agggcagtcagggcta

SEQ ID NO: 362349 - DNA, 16 bp, M. musculus
agggcagtcatgacag

SEQ ID NO: 362350 - DNA, 16 bp, M. musculus
agggcagtgaggcagg

SEQ ID NO: 362351 - DNA, 16 bp, M. musculus
agggcagtggtggtgc

SEQ ID NO: 362352 - DNA, 16 bp, M. musculus
agggcatagagacagt

SEQ ID NO: 362353 - DNA, 16 bp, M. musculus
agggcatcagacctca

SEQ ID NO: 362354 - DNA, 16 bp, M. musculus
agggcatcagatcccc

SEQ ID NO: 362355 - DNA, 16 bp, M. musculus
agggcatccagagact

SEQ ID NO: 362356 - DNA, 16 bp, M. musculus
agggcatcctcagcta

SEQ ID NO: 362357 - DNA, 16 bp, M. musculus
agggcatctcctccca

SEQ ID NO: 362358 - DNA, 16 bp, M. musculus
agggcatcttctgcta

SEQ ID NO: 362359 - DNA, 16 bp, M. musculus
agggcattggatcccc

SEQ ID NO: 362360 - DNA, 16 bp, M. musculus
agggcatttccagaga

SEQ ID NO: 362361 - DNA, 16 bp, M. musculus
agggcattttcttcat

SEQ ID NO: 362362 - DNA, 16 bp, M. musculus
agggcattttcttttt

SEQ ID NO: 362363 - DNA, 16 bp, M. musculus
agggccaagaagtaga

SEQ ID NO: 362364 - DNA, 16 bp, M. musculus
agggccacaggcctac

SEQ ID NO: 362365 - DNA, 16 bp, M. musculus
agggccaccagcccag

SEQ ID NO: 362366 - DNA, 16 bp, M. musculus
agggccacctgcctag

SEQ ID NO: 362367 - DNA, 16 bp, M. musculus
agggccagcctgggct

SEQ ID NO: 362368 - DNA, 16 bp, M. musculus
agggccagctctcctg

SEQ ID NO: 362369 - DNA, 16 bp, M. musculus
agggccaggaatggga

SEQ ID NO: 362370 - DNA, 16 bp, M. musculus
agggccaggcagcagg

SEQ ID NO: 362371 - DNA, 16 bp, M. musculus
agggccatttttattc

SEQ ID NO: 362372 - DNA, 16 bp, M. musculus
agggcccaagtgagga

SEQ ID NO: 362373 - DNA, 16 bp, M. musculus
agggcccagaagtggg

SEQ ID NO: 362374 - DNA, 16 bp, M. musculus
agggcccagggcccag

SEQ ID NO: 362375 - DNA, 16 bp, M. musculus
agggcccaggttcaat

SEQ ID NO: 362376 - DNA, 16 bp, M. musculus
agggcccagttcactg

SEQ ID NO: 362377 - DNA, 16 bp, M. musculus
agggcctcacatcttc

SEQ ID NO: 362378 - DNA, 16 bp, M. musculus
agggcctcccctcaca

SEQ ID NO: 362379 - DNA, 16 bp, M. musculus
agggcctcctgcatgc

SEQ ID NO: 362380 - DNA, 16 bp, M. musculus
agggcctgagttcaat

SEQ ID NO: 362381 - DNA, 16 bp, M. musculus
agggcctgcagaaaga

SEQ ID NO: 362382 - DNA, 16 bp, M. musculus
agggcctgcctttgtc

SEQ ID NO: 362383 - DNA, 16 bp, M. musculus
agggcctggagaaatg

SEQ ID NO: 362384 - DNA, 16 bp, M. musculus
agggcctgggagatgg

SEQ ID NO: 362385 - DNA, 16 bp, M. musculus
agggccttgagcatgc

SEQ ID NO: 362386 - DNA, 16 bp, M. musculus
agggccttggtcctgt

SEQ ID NO: 362387 - DNA, 16 bp, M. musculus
agggctacacagagac

SEQ ID NO: 362388 - DNA, 16 bp, M. musculus
agggctacacagcaag

SEQ ID NO: 362389 - DNA, 16 bp, M. musculus
agggctacagagatgg

SEQ ID NO: 362390 - DNA, 16 bp, M. musculus
agggctacatagtgaa

SEQ ID NO: 362391 - DNA, 16 bp, M. musculus
agggctacatggtgag

SEQ ID NO: 362392 - DNA, 16 bp, M. musculus
agggctaggattatag

SEQ ID NO: 362393 - DNA, 16 bp, M. musculus
agggctatccacaaca

SEQ ID NO: 362394 - DNA, 16 bp, M. musculus
agggctcacaggggct

SEQ ID NO: 362395 - DNA, 16 bp, M. musculus
agggctcctaatggag

SEQ ID NO: 362396 - DNA, 16 bp, M. musculus
agggctcctgtgtcct

SEQ ID NO: 362397 - DNA, 16 bp, M. musculus
agggctctgaggcact

SEQ ID NO: 362398 - DNA, 16 bp, M. musculus
agggctgaaaagatgg

SEQ ID NO: 362399 - DNA, 29 bp, M. musculus
agggctgaaaattctggatgaaattcagg

SEQ ID NO: 362400 - DNA, 16 bp, M. musculus
agggctgagattaaag

SEQ ID NO: 362401 - DNA, 16 bp, M. musculus
agggctgagattacag

SEQ ID NO: 362402 - DNA, 16 bp, M. musculus
agggctgccatctgct

SEQ ID NO: 362403 - DNA, 16 bp, M. musculus
agggctgcccagaagc

SEQ ID NO: 362404 - DNA, 16 bp, M. musculus
agggctgctctgagga

SEQ ID NO: 362405 - DNA, 16 bp, M. musculus
agggctggagagctgg

SEQ ID NO: 362406 - DNA, 16 bp, M. musculus
agggctggagggagga

SEQ ID NO: 362407 - DNA, 16 bp, M. musculus
agggctggagggctgg

SEQ ID NO: 362408 - DNA, 16 bp, M. musculus
agggctggatttatgg

SEQ ID NO: 362409 - DNA, 16 bp, M. musculus
agggctggcaaaatgg

SEQ ID NO: 362410 - DNA, 16 bp, M. musculus
agggctggcaagatgg

SEQ ID NO: 362411 - DNA, 16 bp, M. musculus
agggctggccaactgg

SEQ ID NO: 362412 - DNA, 16 bp, M. musculus
agggctgggactaaag

SEQ ID NO: 362413 - DNA, 16 bp, M. musculus
agggctgggattacag

SEQ ID NO: 362414 - DNA, 16 bp, M. musculus
agggctgggattgcag

SEQ ID NO: 362415 - DNA, 16 bp, M. musculus
agggctgggcagatgg

SEQ ID NO: 362416 - DNA, 16 bp, M. musculus
agggctggggaaatgg

SEQ ID NO: 362417 - DNA, 16 bp, M. musculus
agggctggggacacag

SEQ ID NO: 362418 - DNA, 16 bp, M. musculus
agggctggggacatgg

SEQ ID NO: 362419 - DNA, 16 bp, M. musculus
agggctggggagatgg

SEQ ID NO: 362420 - DNA, 16 bp, M. musculus
agggctggggatacag

SEQ ID NO: 362421 - DNA, 16 bp, M. musculus
agggctggggatgtgg

SEQ ID NO: 362422 - DNA, 16 bp, M. musculus
agggctggggcagcag

SEQ ID NO: 362423 - DNA, 16 bp, M. musculus
agggctggggtgtagc

SEQ ID NO: 362424 - DNA, 16 bp, M. musculus
agggctgtgggacagc

SEQ ID NO: 362425 - DNA, 16 bp, M. musculus
agggctgttgagatgg

SEQ ID NO: 362426 - DNA, 16 bp, M. musculus
agggcttattttggct

SEQ ID NO: 362427 - DNA, 16 bp, M. musculus
agggcttcacagagaa

SEQ ID NO: 362428 - DNA, 16 bp, M. musculus
agggcttcctggaaga

SEQ ID NO: 362429 - DNA, 16 bp, M. musculus
agggcttctccttcca

SEQ ID NO: 362430 - DNA, 16 bp, M. musculus
agggcttctctcctgc

SEQ ID NO: 362431 - DNA, 17 bp, M. musculus
agggctttgcaggagca

SEQ ID NO: 362432 - DNA, 16 bp, M. musculus
agggctttggatcccc

SEQ ID NO: 362433 - DNA, 16 bp, M. musculus
agggctttgtgcatgg

SEQ ID NO: 362434 - DNA, 16 bp, M. musculus
aggggaaaaaaaatcc

SEQ ID NO: 362435 - DNA, 16 bp, M. musculus
aggggaaaaaaaatct

SEQ ID NO: 362436 - DNA, 16 bp, M. musculus
aggggaaaaagcagtt

SEQ ID NO: 362437 - DNA, 16 bp, M. musculus
aggggaaacatttgaa

SEQ ID NO: 362438 - DNA, 16 bp, M. musculus
aggggaaaccaggaag

SEQ ID NO: 362439 - DNA, 16 bp, M. musculus
aggggaaaccatctct

SEQ ID NO: 362440 - DNA, 16 bp, M. musculus
aggggaaaccgggaag

SEQ ID NO: 362441 - DNA, 16 bp, M. musculus
aggggaaactgaggcc

SEQ ID NO: 362442 - DNA, 16 bp, M. musculus
aggggaaactggaaag

SEQ ID NO: 362443 - DNA, 16 bp, M. musculus
aggggaaagtcagggc

SEQ ID NO: 362444 - DNA, 16 bp, M. musculus
aggggaaggactaaag

SEQ ID NO: 362445 - DNA, 16 bp, M. musculus
aggggaaggccaggac

SEQ ID NO: 362446 - DNA, 16 bp, M. musculus
aggggaatcgagggtg

SEQ ID NO: 362447 - DNA, 18 bp, M. musculus
aggggaatgccagggcca

SEQ ID NO: 362448 - DNA, 16 bp, M. musculus
aggggaatgccagggt

SEQ ID NO: 362449 - DNA, 16 bp, M. musculus
aggggaatttgagggt

SEQ ID NO: 362450 - DNA, 16 bp, M. musculus
aggggacaactttcag

SEQ ID NO: 362451 - DNA, 17 bp, M. musculus
aggggaccaatatccaa

SEQ ID NO: 362452 - DNA, 16 bp, M. musculus
aggggacccacatgaa

SEQ ID NO: 362453 - DNA, 26 bp, M. musculus
aggggaccttctcctaagaaccaaat

SEQ ID NO: 362454 - DNA, 16 bp, M. musculus
aggggagactgggaag

SEQ ID NO: 362455 - DNA, 16 bp, M. musculus
aggggagcagagcaga

SEQ ID NO: 362456 - DNA, 16 bp, M. musculus
aggggagcagggcagc

SEQ ID NO: 362457 - DNA, 16 bp, M. musculus
aggggagcgccagggc

SEQ ID NO: 362458 - DNA, 16 bp, M. musculus
aggggaggaagaacct

SEQ ID NO: 362459 - DNA, 16 bp, M. musculus
aggggaggactgggag

SEQ ID NO: 362460 - DNA, 16 bp, M. musculus
aggggaggagctagag

SEQ ID NO: 362461 - DNA, 16 bp, M. musculus
aggggaggaggcgctc

SEQ ID NO: 362462 - DNA, 16 bp, M. musculus
aggggaggctggagag

SEQ ID NO: 362463 - DNA, 16 bp, M. musculus
aggggagggaggcttg

SEQ ID NO: 362464 - DNA, 16 bp, M. musculus
aggggagggcccagcc

SEQ ID NO: 362465 - DNA, 17 bp, M. musculus
aggggagtggacacaga

SEQ ID NO: 362466 - DNA, 16 bp, M. musculus
aggggatctgaaaccc

SEQ ID NO: 362467 - DNA, 16 bp, M. musculus
aggggatctgacaccc

SEQ ID NO: 362468 - DNA, 16 bp, M. musculus
aggggatctgatgcct

SEQ ID NO: 362469 - DNA, 16 bp, M. musculus
aggggatctggcgccc

SEQ ID NO: 362470 - DNA, 16 bp, M. musculus
aggggatggaaatgaa

SEQ ID NO: 362471 - DNA, 16 bp, M. musculus
aggggatggaggcagg

SEQ ID NO: 362472 - DNA, 16 bp, M. musculus
aggggcagccctgcct

SEQ ID NO: 362473 - DNA, 16 bp, M. musculus
aggggcaggaccagct

SEQ ID NO: 362474 - DNA, 16 bp, M. musculus
aggggcaggagagatg

SEQ ID NO: 362475 - DNA, 16 bp, M. musculus
aggggcaggtggatct

SEQ ID NO: 362476 - DNA, 16 bp, M. musculus
aggggcatctggcttc

SEQ ID NO: 362477 - DNA, 16 bp, M. musculus
aggggccaagcagtcc

SEQ ID NO: 362478 - DNA, 16 bp, M. musculus
aggggccagggagatg

SEQ ID NO: 362479 - DNA, 23 bp, M. musculus
aggggcctagggagccctcccta

SEQ ID NO: 362480 - DNA, 17 bp, M. musculus
aggggcctgccagaggc

SEQ ID NO: 362481 - DNA, 16 bp, M. musculus
aggggcctggtgcctg

SEQ ID NO: 362482 - DNA, 16 bp, M. musculus
aggggctaaaccacca

SEQ ID NO: 362483 - DNA, 16 bp, M. musculus
aggggctagagagatg

SEQ ID NO: 362484 - DNA, 16 bp, M. musculus
aggggctgaagaaatg

SEQ ID NO: 362485 - DNA, 16 bp, M. musculus
aggggctgaggggctg

SEQ ID NO: 362486 - DNA, 16 bp, M. musculus
aggggctgcagtatta

SEQ ID NO: 362487 - DNA, 16 bp, M. musculus
aggggctgcttgccct

SEQ ID NO: 362488 - DNA, 16 bp, M. musculus
aggggctggaagagag

SEQ ID NO: 362489 - DNA, 16 bp, M. musculus
aggggctggaagatgg

SEQ ID NO: 362490 - DNA, 16 bp, M. musculus
aggggctggagacatg

SEQ ID NO: 362491 - DNA, 19 bp, M. musculus
aggggctggagagatggcc

SEQ ID NO: 362492 - DNA, 16 bp, M. musculus
aggggctggagaggtg

SEQ ID NO: 362493 - DNA, 16 bp, M. musculus
aggggctggagatggc

SEQ ID NO: 362494 - DNA, 16 bp, M. musculus
aggggctggagggatg

SEQ ID NO: 362495 - DNA, 16 bp, M. musculus
aggggctgggaggaga

SEQ ID NO: 362496 - DNA, 16 bp, M. musculus
aggggctgggctgggc

SEQ ID NO: 362497 - DNA, 16 bp, M. musculus
aggggctggggacatg

SEQ ID NO: 362498 - DNA, 16 bp, M. musculus
aggggctgtccctgac

SEQ ID NO: 362499 - DNA, 16 bp, M. musculus
aggggctgtccctgag

SEQ ID NO: 362500 - DNA, 16 bp, M. musculus
aggggcttgtgcccca

SEQ ID NO: 362501 - DNA, 16 bp, M. musculus
agggggaaaaaaaatc

SEQ ID NO: 362502 - DNA, 16 bp, M. musculus
agggggaaaaaatcaa

SEQ ID NO: 362503 - DNA, 16 bp, M. musculus
agggggaaaattcctg

SEQ ID NO: 362504 - DNA, 16 bp, M. musculus
agggggaactgtggga

SEQ ID NO: 362505 - DNA, 16 bp, M. musculus
agggggaagggatgcc

SEQ ID NO: 362506 - DNA, 16 bp, M. musculus
agggggaatctctgtg

SEQ ID NO: 362507 - DNA, 16 bp, M. musculus
agggggagaggcccaa

SEQ ID NO: 362508 - DNA, 16 bp, M. musculus
agggggagctggagag

SEQ ID NO: 362509 - DNA, 16 bp, M. musculus
agggggatgctggaga

SEQ ID NO: 362510 - DNA, 16 bp, M. musculus
agggggcagaaagact

SEQ ID NO: 362511 - DNA, 16 bp, M. musculus
aggggggaaaaaaccc

SEQ ID NO: 362512 - DNA, 16 bp, M. musculus
aggggggaaaggcccc

SEQ ID NO: 362513 - DNA, 18 bp, M. musculus
agggggtatttaaaggaa

SEQ ID NO: 362514 - DNA, 16 bp, M. musculus
agggggtgggggcatc

SEQ ID NO: 362515 - DNA, 16 bp, M. musculus
aggggtcaaggacatc

SEQ ID NO: 362516 - DNA, 16 bp, M. musculus
aggggtcaccagcttc

SEQ ID NO: 362517 - DNA, 16 bp, M. musculus
aggggtcagaagaggg

SEQ ID NO: 362518 - DNA, 17 bp, M. musculus
aggggtcatgcaaagga

SEQ ID NO: 362519 - DNA, 16 bp, M. musculus
aggggtgtatgtgtgt

SEQ ID NO: 362520 - DNA, 16 bp, M. musculus
aggggtgtgtgtatgt

SEQ ID NO: 362521 - DNA, 16 bp, M. musculus
aggggttgcaacccac

SEQ ID NO: 362522 - DNA, 16 bp, M. musculus
aggggtttgcaaaccc

SEQ ID NO: 362523 - DNA, 16 bp, M. musculus
agggtaaccttgaact

SEQ ID NO: 362524 - DNA, 16 bp, M. musculus
agggtaagcggaaggc

SEQ ID NO: 362525 - DNA, 16 bp, M. musculus
agggtacaataagcac

SEQ ID NO: 362526 - DNA, 16 bp, M. musculus
agggtactggttagtt

SEQ ID NO: 362527 - DNA, 16 bp, M. musculus
agggtagagggcagag

SEQ ID NO: 362528 - DNA, 16 bp, M. musculus
agggtagccctggctg

SEQ ID NO: 362529 - DNA, 16 bp, M. musculus
agggtagcctgagcta

SEQ ID NO: 362530 - DNA, 16 bp, M. musculus
agggtattaaagctca

SEQ ID NO: 362531 - DNA, 16 bp, M. musculus
agggtattggatccct

SEQ ID NO: 362532 - DNA, 16 bp, M. musculus
agggtcacacagcagg

SEQ ID NO: 362533 - DNA, 16 bp, M. musculus
agggtcagaagttcaa

SEQ ID NO: 362534 - DNA, 16 bp, M. musculus
agggtcagagatggct

SEQ ID NO: 362535 - DNA, 16 bp, M. musculus
agggtccccaaggaag

SEQ ID NO: 362536 - DNA, 16 bp, M. musculus
agggtccccaatgcag

SEQ ID NO: 362537 - DNA, 16 bp, M. musculus
agggtccccaatggtg

SEQ ID NO: 362538 - DNA, 16 bp, M. musculus
agggtcccttctggcc

SEQ ID NO: 362539 - DNA, 16 bp, M. musculus
agggtctcaaagccca

SEQ ID NO: 362540 - DNA, 16 bp, M. musculus
agggtctcacactgaa

SEQ ID NO: 362541 - DNA, 16 bp, M. musculus
agggtctcacatagcc

SEQ ID NO: 362542 - DNA, 16 bp, M. musculus
agggtctcactatata

SEQ ID NO: 362543 - DNA, 16 bp, M. musculus
agggtctcactatgta

SEQ ID NO: 362544 - DNA, 16 bp, M. musculus
agggtctcactctgta

SEQ ID NO: 362545 - DNA, 16 bp, M. musculus
agggtctcactgttta

SEQ ID NO: 362546 - DNA, 16 bp, M. musculus
agggtctcagtatgta

SEQ ID NO: 362547 - DNA, 16 bp, M. musculus
agggtctcattatgta

SEQ ID NO: 362548 - DNA, 16 bp, M. musculus
agggtctctcactgga

SEQ ID NO: 362549 - DNA, 19 bp, M. musculus
agggtctctctgtgtagcc

SEQ ID NO: 362550 - DNA, 16 bp, M. musculus
agggtctctctttgta

SEQ ID NO: 362551 - DNA, 16 bp, M. musculus
agggtctctgcttcag

SEQ ID NO: 362552 - DNA, 16 bp, M. musculus
agggtctctggaagag

SEQ ID NO: 362553 - DNA, 16 bp, M. musculus
agggtcttaaacccca

SEQ ID NO: 362554 - DNA, 16 bp, M. musculus
agggtcttaaagccca

SEQ ID NO: 362555 - DNA, 16 bp, M. musculus
agggtcttaaatccca

SEQ ID NO: 362556 - DNA, 16 bp, M. musculus
agggtcttactatgta

SEQ ID NO: 362557 - DNA, 16 bp, M. musculus
agggtcttactgtgta

SEQ ID NO: 362558 - DNA, 16 bp, M. musculus
agggtcttggatttgt

SEQ ID NO: 362559 - DNA, 16 bp, M. musculus
agggtgacccccttcc

SEQ ID NO: 362560 - DNA, 16 bp, M. musculus
agggtgaccctggagg

SEQ ID NO: 362561 - DNA, 16 bp, M. musculus
agggtgaccttgaact

SEQ ID NO: 362562 - DNA, 16 bp, M. musculus
agggtgactgtggcct

SEQ ID NO: 362563 - DNA, 16 bp, M. musculus
agggtgagtcttccca

SEQ ID NO: 362564 - DNA, 17 bp, M. musculus
agggtgatcatgatttc

SEQ ID NO: 362565 - DNA, 16 bp, M. musculus
agggtgcagacagaaa

SEQ ID NO: 362566 - DNA, 16 bp, M. musculus
agggtgcccccccccc

SEQ ID NO: 362567 - DNA, 16 bp, M. musculus
agggtgctcttccacc

SEQ ID NO: 362568 - DNA, 16 bp, M. musculus
agggtgctgcctcagc

SEQ ID NO: 362569 - DNA, 16 bp, M. musculus
agggtggaccaggatg

SEQ ID NO: 362570 - DNA, 16 bp, M. musculus
agggtggaccgggagg

SEQ ID NO: 362571 - DNA, 16 bp, M. musculus
agggtggacctggagg

SEQ ID NO: 362572 - DNA, 16 bp, M. musculus
agggtggactatccag

SEQ ID NO: 362573 - DNA, 16 bp, M. musculus
agggtggagccttctg

SEQ ID NO: 362574 - DNA, 16 bp, M. musculus
agggtggtcttgaact

SEQ ID NO: 362575 - DNA, 16 bp, M. musculus
agggtgtcagatcaca

SEQ ID NO: 362576 - DNA, 16 bp, M. musculus
agggtgtcagatccct

SEQ ID NO: 362577 - DNA, 16 bp, M. musculus
agggtgtcatttcctt

SEQ ID NO: 362578 - DNA, 16 bp, M. musculus
agggtgtggccctggg

SEQ ID NO: 362579 - DNA, 16 bp, M. musculus
agggtgtggctcagtg

SEQ ID NO: 362580 - DNA, 16 bp, M. musculus
agggtgtggttcccgt

SEQ ID NO: 362581 - DNA, 16 bp, M. musculus
agggtgtggtttccat

SEQ ID NO: 362582 - DNA, 16 bp, M. musculus
agggtgttggatcttg

SEQ ID NO: 362583 - DNA, 16 bp, M. musculus
agggtgttggttccct

SEQ ID NO: 362584 - DNA, 16 bp, M. musculus
agggttacacaaagaa

SEQ ID NO: 362585 - DNA, 16 bp, M. musculus
agggttagagagatgg

SEQ ID NO: 362586 - DNA, 16 bp, M. musculus
agggttcaaactcagg

SEQ ID NO: 362587 - DNA, 16 bp, M. musculus
agggttcctctgtgta

SEQ ID NO: 362588 - DNA, 16 bp, M. musculus
agggttccttcagcaa

SEQ ID NO: 362589 - DNA, 22 bp, M. musculus
agggttctctagagtcacagaa

SEQ ID NO: 362590 - DNA, 16 bp, M. musculus
agggttctttccagct

SEQ ID NO: 362591 - DNA, 16 bp, M. musculus
agggttctttggaaag

SEQ ID NO: 362592 - DNA, 16 bp, M. musculus
agggttgaactcaggt

SEQ ID NO: 362593 - DNA, 16 bp, M. musculus
agggttgcagttccct

SEQ ID NO: 362594 - DNA, 16 bp, M. musculus
agggttgtttggttct

SEQ ID NO: 362595 - DNA, 16 bp, M. musculus
agggtttattctggct

SEQ ID NO: 362596 - DNA, 16 bp, M. musculus
agggtttattttggct

SEQ ID NO: 362597 - DNA, 16 bp, M. musculus
agggtttcactatgta

SEQ ID NO: 362598 - DNA, 16 bp, M. musculus
agggtttcatgcatgc

SEQ ID NO: 362599 - DNA, 16 bp, M. musculus
agggtttccatctcca

SEQ ID NO: 362600 - DNA, 16 bp, M. musculus
agggtttctacctcca

SEQ ID NO: 362601 - DNA, 22 bp, M. musculus
agggtttctattcctgcacaaa

SEQ ID NO: 362602 - DNA, 16 bp, M. musculus
agggtttctctttgta

SEQ ID NO: 362603 - DNA, 16 bp, M. musculus
agggtttcttactgaa

SEQ ID NO: 362604 - DNA, 16 bp, M. musculus
agggtttctttgtgta

SEQ ID NO: 362605 - DNA, 16 bp, M. musculus
agggttttcctgtgta

SEQ ID NO: 362606 - DNA, 16 bp, M. musculus
agggttttctgctctc

SEQ ID NO: 362607 - DNA, 16 bp, M. musculus
agggtttttaaaaata

SEQ ID NO: 362608 - DNA, 16 bp, M. musculus
agggtttttttttccc

SEQ ID NO: 362609 - DNA, 16 bp, M. musculus
aggtaaaacaccaatg

SEQ ID NO: 362610 - DNA, 16 bp, M. musculus
aggtaaaacactcata

SEQ ID NO: 362611 - DNA, 16 bp, M. musculus
aggtaaaatcctccag

SEQ ID NO: 362612 - DNA, 16 bp, M. musculus
aggtaaaatctttcaa

SEQ ID NO: 362613 - DNA, 16 bp, M. musculus
aggtaaacactctacc

SEQ ID NO: 362614 - DNA, 16 bp, M. musculus
aggtaaacttaagaat

SEQ ID NO: 362615 - DNA, 16 bp, M. musculus
aggtaaaggcacttgc

SEQ ID NO: 362616 - DNA, 16 bp, M. musculus
aggtaaaggcaggaag

SEQ ID NO: 362617 - DNA, 16 bp, M. musculus
aggtaaaggcaggtgg

SEQ ID NO: 362618 - DNA, 16 bp, M. musculus
aggtaaaggtgctttc

SEQ ID NO: 362619 - DNA, 16 bp, M. musculus
aggtaaatgagctaaa

SEQ ID NO: 362620 - DNA, 16 bp, M. musculus
aggtaaattatctaaa

SEQ ID NO: 362621 - DNA, 16 bp, M. musculus
aggtaacacagaccca

SEQ ID NO: 362622 - DNA, 16 bp, M. musculus
aggtaactgtgaggag

SEQ ID NO: 362623 - DNA, 16 bp, M. musculus
aggtaagtgttctgag

SEQ ID NO: 362624 - DNA, 16 bp, M. musculus
aggtaatccagaccca

SEQ ID NO: 362625 - DNA, 16 bp, M. musculus
aggtaattgtgagctg

SEQ ID NO: 362626 - DNA, 16 bp, M. musculus
aggtacaaaagttaaa

SEQ ID NO: 362627 - DNA, 16 bp, M. musculus
aggtacaaaggttctt

SEQ ID NO: 362628 - DNA, 16 bp, M. musculus
aggtacagagaagaag

SEQ ID NO: 362629 - DNA, 16 bp, M. musculus
aggtacatcctcttcc

SEQ ID NO: 362630 - DNA, 16 bp, M. musculus
aggtaccacagttaaa

SEQ ID NO: 362631 - DNA, 16 bp, M. musculus
aggtaccaggaggtgc

SEQ ID NO: 362632 - DNA, 17 bp, M. musculus
aggtaccctgaggtgct

SEQ ID NO: 362633 - DNA, 16 bp, M. musculus
aggtacctgcaaacct

SEQ ID NO: 362634 - DNA, 16 bp, M. musculus
aggtacgaccaccctc

SEQ ID NO: 362635 - DNA, 16 bp, M. musculus
aggtactgagagagag

SEQ ID NO: 362636 - DNA, 16 bp, M. musculus
aggtactgtgtgtgtg

SEQ ID NO: 362637 - DNA, 16 bp, M. musculus
aggtacttgccaccaa

SEQ ID NO: 362638 - DNA, 16 bp, M. musculus
aggtagaaaaccttaa

SEQ ID NO: 362639 - DNA, 16 bp, M. musculus
aggtagaagagaactg

SEQ ID NO: 362640 - DNA, 16 bp, M. musculus
aggtagaagagagaat

SEQ ID NO: 362641 - DNA, 16 bp, M. musculus
aggtagaagtccttat

SEQ ID NO: 362642 - DNA, 16 bp, M. musculus
aggtagaattatattt

SEQ ID NO: 362643 - DNA, 16 bp, M. musculus
aggtagacagatctct

SEQ ID NO: 362644 - DNA, 16 bp, M. musculus
aggtagacatggtgct

SEQ ID NO: 362645 - DNA, 16 bp, M. musculus
aggtagagacaagcag

SEQ ID NO: 362646 - DNA, 16 bp, M. musculus
aggtagaggcaagaga

SEQ ID NO: 362647 - DNA, 16 bp, M. musculus
aggtagaggcaggcag

SEQ ID NO: 362648 - DNA, 16 bp, M. musculus
aggtagaggcagggag

SEQ ID NO: 362649 - DNA, 16 bp, M. musculus
aggtagagtcaggtgg

SEQ ID NO: 362650 - DNA, 16 bp, M. musculus
aggtagatctctgtga

SEQ ID NO: 362651 - DNA, 16 bp, M. musculus
aggtagcaacaaaaat

SEQ ID NO: 362652 - DNA, 16 bp, M. musculus
aggtagcagccctccc

SEQ ID NO: 362653 - DNA, 16 bp, M. musculus
aggtagccaggccagc

SEQ ID NO: 362654 - DNA, 16 bp, M. musculus
aggtagcccaggctgg

SEQ ID NO: 362655 - DNA, 16 bp, M. musculus
aggtagccctgggctc

SEQ ID NO: 362656 - DNA, 16 bp, M. musculus
aggtagcctggtctac

SEQ ID NO: 362657 - DNA, 16 bp, M. musculus
aggtagctgtgagcca

SEQ ID NO: 362658 - DNA, 16 bp, M. musculus
aggtaggtaggtatgt

SEQ ID NO: 362659 - DNA, 16 bp, M. musculus
aggtagtgtctgtatt

SEQ ID NO: 362660 - DNA, 16 bp, M. musculus
aggtagtgtctgtctt

SEQ ID NO: 362661 - DNA, 26 bp, M. musculus
aggtatagtagcctgggctggcattt

SEQ ID NO: 362662 - DNA, 16 bp, M. musculus
aggtatataggtatat

SEQ ID NO: 362663 - DNA, 16 bp, M. musculus
aggtatatatatatat

SEQ ID NO: 362664 - DNA, 16 bp, M. musculus
aggtatatgccaccac

SEQ ID NO: 362665 - DNA, 17 bp, M. musculus
aggtatcaatggaaggt

SEQ ID NO: 362666 - DNA, 16 bp, M. musculus
aggtatcagagtaatt

SEQ ID NO: 362667 - DNA, 16 bp, M. musculus
aggtatcctcacttgg

SEQ ID NO: 362668 - DNA, 16 bp, M. musculus
aggtatgagccaccac

SEQ ID NO: 362669 - DNA, 16 bp, M. musculus
aggtatgagctgccat

SEQ ID NO: 362670 - DNA, 16 bp, M. musculus
aggtatgcaccaccac

SEQ ID NO: 362671 - DNA, 16 bp, M. musculus
aggtatgcagatctct

SEQ ID NO: 362672 - DNA, 16 bp, M. musculus
aggtatgcgccaccat

SEQ ID NO: 362673 - DNA, 16 bp, M. musculus
aggtatgtgccaccat

SEQ ID NO: 362674 - DNA, 16 bp, M. musculus
aggtatgtgtcaccac

SEQ ID NO: 362675 - DNA, 16 bp, M. musculus
aggtattaagactttt

SEQ ID NO: 362676 - DNA, 16 bp, M. musculus
aggtatttcttcattt

SEQ ID NO: 362677 - DNA, 16 bp, M. musculus
aggtattttcctcagt

SEQ ID NO: 362678 - DNA, 16 bp, M. musculus
aggtattttcctcctt

SEQ ID NO: 362679 - DNA, 16 bp, M. musculus
aggtcaaaggaataca

SEQ ID NO: 362680 - DNA, 16 bp, M. musculus
aggtcaaaggacaatt

SEQ ID NO: 362681 - DNA, 16 bp, M. musculus
aggtcaaaggtcaaca

SEQ ID NO: 362682 - DNA, 16 bp, M. musculus
aggtcaacctgggcta

SEQ ID NO: 362683 - DNA, 16 bp, M. musculus
aggtcaaggccagcct

SEQ ID NO: 362684 - DNA, 16 bp, M. musculus
aggtcaagggtcacat

SEQ ID NO: 362685 - DNA, 16 bp, M. musculus
aggtcaagtacaaaag

SEQ ID NO: 362686 - DNA, 16 bp, M. musculus
aggtcaattaacatat

SEQ ID NO: 362687 - DNA, 16 bp, M. musculus
aggtcacacagctggt

SEQ ID NO: 362688 - DNA, 16 bp, M. musculus
aggtcacacctcccaa

SEQ ID NO: 362689 - DNA, 16 bp, M. musculus
aggtcacaggtcacag

SEQ ID NO: 362690 - DNA, 16 bp, M. musculus
aggtcacatgtctgtg

SEQ ID NO: 362691 - DNA, 16 bp, M. musculus
aggtcaccacaacatg

SEQ ID NO: 362692 - DNA, 16 bp, M. musculus
aggtcaccaggcctgg

SEQ ID NO: 362693 - DNA, 16 bp, M. musculus
aggtcaccctcagcta

SEQ ID NO: 362694 - DNA, 16 bp, M. musculus
aggtcactctcagcta

SEQ ID NO: 362695 - DNA, 16 bp, M. musculus
aggtcactgactacct

SEQ ID NO: 362696 - DNA, 16 bp, M. musculus
aggtcacttatatata

SEQ ID NO: 362697 - DNA, 16 bp, M. musculus
aggtcagaagagggca

SEQ ID NO: 362698 - DNA, 16 bp, M. musculus
aggtcagaagttcaaa

SEQ ID NO: 362699 - DNA, 16 bp, M. musculus
aggtcagagaacaact

SEQ ID NO: 362700 - DNA, 16 bp, M. musculus
aggtcagaggacaaat

SEQ ID NO: 362701 - DNA, 16 bp, M. musculus
aggtcagaggacaatt

SEQ ID NO: 362702 - DNA, 16 bp, M. musculus
aggtcagaggacagct

SEQ ID NO: 362703 - DNA, 16 bp, M. musculus
aggtcagaggagggca

SEQ ID NO: 362704 - DNA, 16 bp, M. musculus
aggtcagaggataact

SEQ ID NO: 362705 - DNA, 16 bp, M. musculus
aggtcagaggatgact

SEQ ID NO: 362706 - DNA, 16 bp, M. musculus
aggtcagaggtcagga

SEQ ID NO: 362707 - DNA, 16 bp, M. musculus
aggtcagatgacagct

SEQ ID NO: 362708 - DNA, 16 bp, M. musculus
aggtcagccaggacta

SEQ ID NO: 362709 - DNA, 16 bp, M. musculus
aggtcagcctaggcta

SEQ ID NO: 362710 - DNA, 16 bp, M. musculus
aggtcagcctagtcta

SEQ ID NO: 362711 - DNA, 16 bp, M. musculus
aggtcagcctcagctg

SEQ ID NO: 362712 - DNA, 16 bp, M. musculus
aggtcagctagcctgg

SEQ ID NO: 362713 - DNA, 16 bp, M. musculus
aggtcagctgcttctg

SEQ ID NO: 362714 - DNA, 16 bp, M. musculus
aggtcaggaagctgga

SEQ ID NO: 362715 - DNA, 16 bp, M. musculus
aggtcagggatggtta

SEQ ID NO: 362716 - DNA, 16 bp, M. musculus
aggtcagggcaggaac

SEQ ID NO: 362717 - DNA, 16 bp, M. musculus
aggtcagggctggaga

SEQ ID NO: 362718 - DNA, 16 bp, M. musculus
aggtcaggttgggtgg

SEQ ID NO: 362719 - DNA, 16 bp, M. musculus
aggtcagtaccagctt

SEQ ID NO: 362720 - DNA, 16 bp, M. musculus
aggtcagtctctcctt

SEQ ID NO: 362721 - DNA, 16 bp, M. musculus
aggtcagtctgggaca

SEQ ID NO: 362722 - DNA, 16 bp, M. musculus
aggtcataaaagaaaa

SEQ ID NO: 362723 - DNA, 16 bp, M. musculus
aggtcataaaagggaa

SEQ ID NO: 362724 - DNA, 16 bp, M. musculus
aggtcataagttcaaa

SEQ ID NO: 362725 - DNA, 16 bp, M. musculus
aggtcataggacaact

SEQ ID NO: 362726 - DNA, 16 bp, M. musculus
aggtcatccagggcta

SEQ ID NO: 362727 - DNA, 16 bp, M. musculus
aggtcatcctctgcta

SEQ ID NO: 362728 - DNA, 16 bp, M. musculus
aggtcatcctgggcta

SEQ ID NO: 362729 - DNA, 16 bp, M. musculus
aggtcatctggaagag

SEQ ID NO: 362730 - DNA, 16 bp, M. musculus
aggtcatgaaggaata

SEQ ID NO: 362731 - DNA, 16 bp, M. musculus
aggtcatgagagcagg

SEQ ID NO: 362732 - DNA, 18 bp, M. musculus
aggtcatgagttcaaatc

SEQ ID NO: 362733 - DNA, 16 bp, M. musculus
aggtcatggtgtggtc

SEQ ID NO: 362734 - DNA, 16 bp, M. musculus
aggtccacatcccctt

SEQ ID NO: 362735 - DNA, 16 bp, M. musculus
aggtccagcaatcaaa

SEQ ID NO: 362736 - DNA, 16 bp, M. musculus
aggtccagcagtctca

SEQ ID NO: 362737 - DNA, 16 bp, M. musculus
aggtccagcctgtgtg

SEQ ID NO: 362738 - DNA, 16 bp, M. musculus
aggtccatgaagcccc

SEQ ID NO: 362739 - DNA, 16 bp, M. musculus
aggtcccaagacctga

SEQ ID NO: 362740 - DNA, 16 bp, M. musculus
aggtcccaagttcaaa

SEQ ID NO: 362741 - DNA, 16 bp, M. musculus
aggtcccagcacccat

SEQ ID NO: 362742 - DNA, 16 bp, M. musculus
aggtcccaggaggaaa

SEQ ID NO: 362743 - DNA, 16 bp, M. musculus
aggtcccagtgagaga

SEQ ID NO: 362744 - DNA, 20 bp, M. musculus
aggtcccatttgtcaattct

SEQ ID NO: 362745 - DNA, 16 bp, M. musculus
aggtccccagaaccca

SEQ ID NO: 362746 - DNA, 18 bp, M. musculus
aggtcccctcgagaccct

SEQ ID NO: 362747 - DNA, 16 bp, M. musculus
aggtcccctggaactg

SEQ ID NO: 362748 - DNA, 27 bp, M. musculus
aggtcccgagttcaaatcccagcaacc

SEQ ID NO: 362749 - DNA, 38 bp, M. musculus
aggtcccgagttcaaatcccagcaaccacatggtggct

SEQ ID NO: 362750 - DNA, 16 bp, M. musculus
aggtccctccatgtgt

SEQ ID NO: 362751 - DNA, 16 bp, M. musculus
aggtcctatttattaa

SEQ ID NO: 362752 - DNA, 16 bp, M. musculus
aggtcctcctgcacca

SEQ ID NO: 362753 - DNA, 16 bp, M. musculus
aggtcctcctgcttgc

SEQ ID NO: 362754 - DNA, 16 bp, M. musculus
aggtcctctaggatgg

SEQ ID NO: 362755 - DNA, 16 bp, M. musculus
aggtcctctgaaagag

SEQ ID NO: 362756 - DNA, 16 bp, M. musculus
aggtcctgaagaaatc

SEQ ID NO: 362757 - DNA, 16 bp, M. musculus
aggtcctgagttcaaa

SEQ ID NO: 362758 - DNA, 16 bp, M. musculus
aggtcctgagttcaca

SEQ ID NO: 362759 - DNA, 16 bp, M. musculus
aggtcctgagttcagt

SEQ ID NO: 362760 - DNA, 16 bp, M. musculus
aggtcctgagttcgat

SEQ ID NO: 362761 - DNA, 16 bp, M. musculus
aggtcctggagtggga

SEQ ID NO: 362762 - DNA, 16 bp, M. musculus
aggtcctggattcaat

SEQ ID NO: 362763 - DNA, 16 bp, M. musculus
aggtcctggcgctggc

SEQ ID NO: 362764 - DNA, 16 bp, M. musculus
aggtcctgggtttgat

SEQ ID NO: 362765 - DNA, 16 bp, M. musculus
aggtcctgtgtgtgct

SEQ ID NO: 362766 - DNA, 16 bp, M. musculus
aggtccttccctttga

SEQ ID NO: 362767 - DNA, 17 bp, M. musculus
aggtccttgatccactt

SEQ ID NO: 362768 - DNA, 16 bp, M. musculus
aggtctacagagtgag

SEQ ID NO: 362769 - DNA, 16 bp, M. musculus
aggtctacatagagaa

SEQ ID NO: 362770 - DNA, 16 bp, M. musculus
aggtctcactatatag

SEQ ID NO: 362771 - DNA, 16 bp, M. musculus
aggtctcagaggaagc

SEQ ID NO: 362772 - DNA, 16 bp, M. musculus
aggtctccaagaagat

SEQ ID NO: 362773 - DNA, 16 bp, M. musculus
aggtctccagcagaag

SEQ ID NO: 362774 - DNA, 16 bp, M. musculus
aggtctccatttcttt

SEQ ID NO: 362775 - DNA, 16 bp, M. musculus
aggtctctctctctct

SEQ ID NO: 362776 - DNA, 16 bp, M. musculus
aggtctctctctgtct

SEQ ID NO: 362777 - DNA, 16 bp, M. musculus
aggtctctggatggcc

SEQ ID NO: 362778 - DNA, 16 bp, M. musculus
aggtctctggcttctg

SEQ ID NO: 362779 - DNA, 16 bp, M. musculus
aggtctctggtgaatt

SEQ ID NO: 362780 - DNA, 16 bp, M. musculus
aggtctggggagatgg

SEQ ID NO: 362781 - DNA, 16 bp, M. musculus
aggtctgtggaggagg

SEQ ID NO: 362782 - DNA, 16 bp, M. musculus
aggtcttcaatttctt

SEQ ID NO: 362783 - DNA, 16 bp, M. musculus
aggtcttcatgcttgt

SEQ ID NO: 362784 - DNA, 16 bp, M. musculus
aggtcttctctgggct

SEQ ID NO: 362785 - DNA, 16 bp, M. musculus
aggtcttgaggtagaa

SEQ ID NO: 362786 - DNA, 16 bp, M. musculus
aggtctttaggcttgg

SEQ ID NO: 362787 - DNA, 16 bp, M. musculus
aggtctttgacccact

SEQ ID NO: 362788 - DNA, 16 bp, M. musculus
aggtctttggtcctgt

SEQ ID NO: 362789 - DNA, 16 bp, M. musculus
aggtctttttattggg

SEQ ID NO: 362790 - DNA, 16 bp, M. musculus
aggtgaaaagttcatg

SEQ ID NO: 362791 - DNA, 16 bp, M. musculus
aggtgaaagaactgaa

SEQ ID NO: 362792 - DNA, 16 bp, M. musculus
aggtgaaatctcagtg

SEQ ID NO: 362793 - DNA, 16 bp, M. musculus
aggtgaaatgtgtgct

SEQ ID NO: 362794 - DNA, 16 bp, M. musculus
aggtgaagaagagtga

SEQ ID NO: 362795 - DNA, 16 bp, M. musculus
aggtgaaggcagaagg

SEQ ID NO: 362796 - DNA, 16 bp, M. musculus
aggtgaaggcaggaag

SEQ ID NO: 362797 - DNA, 16 bp, M. musculus
aggtgaaggtgtggct

SEQ ID NO: 362798 - DNA, 18 bp, M. musculus
aggtgaatttctgagttt

SEQ ID NO: 362799 - DNA, 16 bp, M. musculus
aggtgacagcagaggc

SEQ ID NO: 362800 - DNA, 16 bp, M. musculus
aggtgacagcagatga

SEQ ID NO: 362801 - DNA, 16 bp, M. musculus
aggtgacagtgtggac

SEQ ID NO: 362802 - DNA, 16 bp, M. musculus
aggtgaccacagctgc

SEQ ID NO: 362803 - DNA, 16 bp, M. musculus
aggtgacccagagctg

SEQ ID NO: 362804 - DNA, 16 bp, M. musculus
aggtgacctctatctt

SEQ ID NO: 362805 - DNA, 16 bp, M. musculus
aggtgacctggagctg

SEQ ID NO: 362806 - DNA, 16 bp, M. musculus
aggtgactcagtgggt

SEQ ID NO: 362807 - DNA, 16 bp, M. musculus
aggtgacttaagagag

SEQ ID NO: 362808 - DNA, 16 bp, M. musculus
aggtgagagactctca

SEQ ID NO: 362809 - DNA, 16 bp, M. musculus
aggtgagagtgaggac

SEQ ID NO: 362810 - DNA, 16 bp, M. musculus
aggtgagagtgtggac

SEQ ID NO: 362811 - DNA, 16 bp, M. musculus
aggtgagcaagccagg

SEQ ID NO: 362812 - DNA, 17 bp, M. musculus
aggtgagccaagtggat

SEQ ID NO: 362813 - DNA, 16 bp, M. musculus
aggtgagccagccctg

SEQ ID NO: 362814 - DNA, 16 bp, M. musculus
aggtgagttcactggc

SEQ ID NO: 362815 - DNA, 16 bp, M. musculus
aggtgataaggaagtt

SEQ ID NO: 362816 - DNA, 16 bp, M. musculus
aggtgatatcttctgg

SEQ ID NO: 362817 - DNA, 16 bp, M. musculus
aggtgatgatgtaagc

SEQ ID NO: 362818 - DNA, 16 bp, M. musculus
aggtgatggaaataaa

SEQ ID NO: 362819 - DNA, 16 bp, M. musculus
aggtgatgtctatcct

SEQ ID NO: 362820 - DNA, 16 bp, M. musculus
aggtgattgccaccaa

SEQ ID NO: 362821 - DNA, 16 bp, M. musculus
aggtgatttttggagg

SEQ ID NO: 362822 - DNA, 16 bp, M. musculus
aggtgcacagatgtct

SEQ ID NO: 362823 - DNA, 16 bp, M. musculus
aggtgcagagcctgct

SEQ ID NO: 362824 - DNA, 16 bp, M. musculus
aggtgcagagtgtgcg

SEQ ID NO: 362825 - DNA, 16 bp, M. musculus
aggtgcaggacctgct

SEQ ID NO: 362826 - DNA, 16 bp, M. musculus
aggtgcatcatttctg

SEQ ID NO: 362827 - DNA, 16 bp, M. musculus
aggtgcccatgaacat

SEQ ID NO: 362828 - DNA, 16 bp, M. musculus
aggtgcccatggaggc

SEQ ID NO: 362829 - DNA, 16 bp, M. musculus
aggtgccccagtgctg

SEQ ID NO: 362830 - DNA, 16 bp, M. musculus
aggtgccctctgacct

SEQ ID NO: 362831 - DNA, 19 bp, M. musculus
aggtgcctccttgccatcc

SEQ ID NO: 362832 - DNA, 16 bp, M. musculus
aggtgctagaattaaa

SEQ ID NO: 362833 - DNA, 16 bp, M. musculus
aggtgctagcagagcc

SEQ ID NO: 362834 - DNA, 16 bp, M. musculus
aggtgctagctgaaca

SEQ ID NO: 362835 - DNA, 16 bp, M. musculus
aggtgctcaataaatg

SEQ ID NO: 362836 - DNA, 16 bp, M. musculus
aggtgctcctcagcca

SEQ ID NO: 362837 - DNA, 16 bp, M. musculus
aggtgctgaatcaggt

SEQ ID NO: 362838 - DNA, 16 bp, M. musculus
aggtgctgagaaaaag

SEQ ID NO: 362839 - DNA, 16 bp, M. musculus
aggtgctgagaagcag

SEQ ID NO: 362840 - DNA, 16 bp, M. musculus
aggtgctgctcagcca

SEQ ID NO: 362841 - DNA, 16 bp, M. musculus
aggtgctgggaactga

SEQ ID NO: 362842 - DNA, 20 bp, M. musculus
aggtgctgggaattgaaccc

SEQ ID NO: 362843 - DNA, 16 bp, M. musculus
aggtgctgggattaca

SEQ ID NO: 362844 - DNA, 16 bp, M. musculus
aggtgctggggacaga

SEQ ID NO: 362845 - DNA, 16 bp, M. musculus
aggtgcttcctttccc

SEQ ID NO: 362846 - DNA, 16 bp, M. musculus
aggtgcttctcagcct

SEQ ID NO: 362847 - DNA, 16 bp, M. musculus
aggtgcttgctgtcaa

SEQ ID NO: 362848 - DNA, 16 bp, M. musculus
aggtgcttgtgagcca

SEQ ID NO: 362849 - DNA, 16 bp, M. musculus
aggtgcttttctgcca

SEQ ID NO: 362850 - DNA, 16 bp, M. musculus
aggtgcttttggagaa

SEQ ID NO: 362851 - DNA, 16 bp, M. musculus
aggtggaaagatctcc

SEQ ID NO: 362852 - DNA, 16 bp, M. musculus
aggtggaagcacagag

SEQ ID NO: 362853 - DNA, 16 bp, M. musculus
aggtggaagcagaagg

SEQ ID NO: 362854 - DNA, 16 bp, M. musculus
aggtggaaggcaagga

SEQ ID NO: 362855 - DNA, 16 bp, M. musculus
aggtggacacctgtcc

SEQ ID NO: 362856 - DNA, 18 bp, M. musculus
aggtggacttctgagttc

SEQ ID NO: 362857 - DNA, 16 bp, M. musculus
aggtggagcaaaccaa

SEQ ID NO: 362858 - DNA, 16 bp, M. musculus
aggtggagccttgctg

SEQ ID NO: 362859 - DNA, 16 bp, M. musculus
aggtggagcgggagat

SEQ ID NO: 362860 - DNA, 16 bp, M. musculus
aggtggaggcagagga

SEQ ID NO: 362861 - DNA, 16 bp, M. musculus
aggtggatctttgtga

SEQ ID NO: 362862 - DNA, 16 bp, M. musculus
aggtggatgctgagga

SEQ ID NO: 362863 - DNA, 16 bp, M. musculus
aggtggatgcttgcag

SEQ ID NO: 362864 - DNA, 16 bp, M. musculus
aggtggatgctttcag

SEQ ID NO: 362865 - DNA, 16 bp, M. musculus
aggtggatgtctatga

SEQ ID NO: 362866 - DNA, 16 bp, M. musculus
aggtggatgttctcag

SEQ ID NO: 362867 - DNA, 16 bp, M. musculus
aggtggatttcagaaa

SEQ ID NO: 362868 - DNA, 16 bp, M. musculus
aggtggcaaggtgctg

SEQ ID NO: 362869 - DNA, 16 bp, M. musculus
aggtggcacagaaatt

SEQ ID NO: 362870 - DNA, 16 bp, M. musculus
aggtggcagaggcaga

SEQ ID NO: 362871 - DNA, 16 bp, M. musculus
aggtggcaggtggcag

SEQ ID NO: 362872 - DNA, 16 bp, M. musculus
aggtggccaagaacct

SEQ ID NO: 362873 - DNA, 16 bp, M. musculus
aggtggccccacctca

SEQ ID NO: 362874 - DNA, 16 bp, M. musculus
aggtggcccccgagga

SEQ ID NO: 362875 - DNA, 16 bp, M. musculus
aggtggcctggagctg

SEQ ID NO: 362876 - DNA, 16 bp, M. musculus
aggtggcctgttgtct

SEQ ID NO: 362877 - DNA, 16 bp, M. musculus
aggtggctcacaacca

SEQ ID NO: 362878 - DNA, 16 bp, M. musculus
aggtggctcagcgggt

SEQ ID NO: 362879 - DNA, 16 bp, M. musculus
aggtggctcagtgggt

SEQ ID NO: 362880 - DNA, 16 bp, M. musculus
aggtggctgctggggc

SEQ ID NO: 362881 - DNA, 16 bp, M. musculus
aggtgggaagagccac

SEQ ID NO: 362882 - DNA, 16 bp, M. musculus
aggtgggacttctggg

SEQ ID NO: 362883 - DNA, 16 bp, M. musculus
aggtgggagcatgaca

SEQ ID NO: 362884 - DNA, 17 bp, M. musculus
aggtgggagcatggcag

SEQ ID NO: 362885 - DNA, 16 bp, M. musculus
aggtgggcatggtggc

SEQ ID NO: 362886 - DNA, 16 bp, M. musculus
aggtggggcctggctg

SEQ ID NO: 362887 - DNA, 16 bp, M. musculus
aggtggggctgttcca

SEQ ID NO: 362888 - DNA, 19 bp, M. musculus
aggtgggggaaggactctg

SEQ ID NO: 362889 - DNA, 16 bp, M. musculus
aggtggggtagaaacc

SEQ ID NO: 362890 - DNA, 16 bp, M. musculus
aggtgggtgagcaccc

SEQ ID NO: 362891 - DNA, 16 bp, M. musculus
aggtgggtgctgggga

SEQ ID NO: 362892 - DNA, 16 bp, M. musculus
aggtgggtgtggtggc

SEQ ID NO: 362893 - DNA, 16 bp, M. musculus
aggtggtcctgggttg

SEQ ID NO: 362894 - DNA, 16 bp, M. musculus
aggtggtcttgggttg

SEQ ID NO: 362895 - DNA, 16 bp, M. musculus
aggtggtgcatgcctt

SEQ ID NO: 362896 - DNA, 16 bp, M. musculus
aggtggtgctgtctat

SEQ ID NO: 362897 - DNA, 16 bp, M. musculus
aggtggtggcgcacgc

SEQ ID NO: 362898 - DNA, 16 bp, M. musculus
aggtggtggggcagct

SEQ ID NO: 362899 - DNA, 16 bp, M. musculus
aggtggtggtggagca

SEQ ID NO: 362900 - DNA, 16 bp, M. musculus
aggtggtggtggcagt

SEQ ID NO: 362901 - DNA, 16 bp, M. musculus
aggtggtggtggctca

SEQ ID NO: 362902 - DNA, 69 bp, M. musculus
aggtgtaccaggatacaggtgaatccaatttggtggagatttgcccctgctgccctgattagctgaagc

SEQ ID NO: 362903 - DNA, 16 bp, M. musculus
aggtgtactggctggt

SEQ ID NO: 362904 - DNA, 16 bp, M. musculus
aggtgtagctcagatt

SEQ ID NO: 362905 - DNA, 16 bp, M. musculus
aggtgtatctctgagt

SEQ ID NO: 362906 - DNA, 16 bp, M. musculus
aggtgtcagatcccct

SEQ ID NO: 362907 - DNA, 16 bp, M. musculus
aggtgtcaggtcccct

SEQ ID NO: 362908 - DNA, 17 bp, M. musculus
aggtgtcatgaagaaca

SEQ ID NO: 362909 - DNA, 16 bp, M. musculus
aggtgtctgcccagga

SEQ ID NO: 362910 - DNA, 16 bp, M. musculus
aggtgtcttcctcagt

SEQ ID NO: 362911 - DNA, 16 bp, M. musculus
aggtgtcttccttgat

SEQ ID NO: 362912 - DNA, 16 bp, M. musculus
aggtgtctttacccac

SEQ ID NO: 362913 - DNA, 16 bp, M. musculus
aggtgtgaccttgctg

SEQ ID NO: 362914 - DNA, 16 bp, M. musculus
aggtgtgcaccaccac

SEQ ID NO: 362915 - DNA, 16 bp, M. musculus
aggtgtgcacctccac

SEQ ID NO: 362916 - DNA, 16 bp, M. musculus
aggtgtgccctccatt

SEQ ID NO: 362917 - DNA, 16 bp, M. musculus
aggtgtgcctgtgtgt

SEQ ID NO: 362918 - DNA, 16 bp, M. musculus
aggtgtgcgctaccac

SEQ ID NO: 362919 - DNA, 16 bp, M. musculus
aggtgtgctccaccac

SEQ ID NO: 362920 - DNA, 16 bp, M. musculus
aggtgtgctgtcaagc

SEQ ID NO: 362921 - DNA, 16 bp, M. musculus
aggtgtgggaggagat

SEQ ID NO: 362922 - DNA, 16 bp, M. musculus
aggtgtgggataagag

SEQ ID NO: 362923 - DNA, 16 bp, M. musculus
aggtgtgggatgtgaa

SEQ ID NO: 362924 - DNA, 16 bp, M. musculus
aggtgtggtcttggag

SEQ ID NO: 362925 - DNA, 16 bp, M. musculus
aggtgtgtaccaccat

SEQ ID NO: 362926 - DNA, 16 bp, M. musculus
aggtgtgtactaccac

SEQ ID NO: 362927 - DNA, 16 bp, M. musculus
aggtgtgtcacagcag

SEQ ID NO: 362928 - DNA, 16 bp, M. musculus
aggtgtgtctgaagac

SEQ ID NO: 362929 - DNA, 16 bp, M. musculus
aggtgtgtgagagcac

SEQ ID NO: 362930 - DNA, 16 bp, M. musculus
aggtgtgtgccaacac

SEQ ID NO: 362931 - DNA, 16 bp, M. musculus
aggtgtgtgccacaac

SEQ ID NO: 362932 - DNA, 16 bp, M. musculus
aggtgtgtgccatcat

SEQ ID NO: 362933 - DNA, 16 bp, M. musculus
aggtgtgtggattcat

SEQ ID NO: 362934 - DNA, 20 bp, M. musculus
aggtgtgtgggttcatttct

SEQ ID NO: 362935 - DNA, 16 bp, M. musculus
aggtgtgtgttaccat

SEQ ID NO: 362936 - DNA, 16 bp, M. musculus
aggtgtgttccaccac

SEQ ID NO: 362937 - DNA, 16 bp, M. musculus
aggtgttaagagcact

SEQ ID NO: 362938 - DNA, 16 bp, M. musculus
aggtgtttaattttga

SEQ ID NO: 362939 - DNA, 16 bp, M. musculus
aggtgtttagaaaagg

SEQ ID NO: 362940 - DNA, 17 bp, M. musculus
aggtgtttctcagcctt

SEQ ID NO: 362941 - DNA, 16 bp, M. musculus
aggtgtttgccaccac

SEQ ID NO: 362942 - DNA, 16 bp, M. musculus
aggtgtttgtgagctg

SEQ ID NO: 362943 - DNA, 16 bp, M. musculus
aggttaaacttccttt

SEQ ID NO: 362944 - DNA, 16 bp, M. musculus
aggttaaagcatttaa

SEQ ID NO: 362945 - DNA, 16 bp, M. musculus
aggttaagaacactga

SEQ ID NO: 362946 - DNA, 16 bp, M. musculus
aggttaagagcactgc

SEQ ID NO: 362947 - DNA, 16 bp, M. musculus
aggttaagatcctttc

SEQ ID NO: 362948 - DNA, 16 bp, M. musculus
aggttaagatgttttt

SEQ ID NO: 362949 - DNA, 16 bp, M. musculus
aggttaatgatctcaa

SEQ ID NO: 362950 - DNA, 16 bp, M. musculus
aggttaatggagccaa

SEQ ID NO: 362951 - DNA, 16 bp, M. musculus
aggttacaattcatca

SEQ ID NO: 362952 - DNA, 16 bp, M. musculus
aggttacaatttcctc

SEQ ID NO: 362953 - DNA, 16 bp, M. musculus
aggttacatagcatca

SEQ ID NO: 362954 - DNA, 16 bp, M. musculus
aggttacctcactcag

SEQ ID NO: 362955 - DNA, 16 bp, M. musculus
aggttagagaacaact

SEQ ID NO: 362956 - DNA, 16 bp, M. musculus
aggttagatgtggctc

SEQ ID NO: 362957 - DNA, 16 bp, M. musculus
aggttagcctgggcta

SEQ ID NO: 362958 - DNA, 16 bp, M. musculus
aggttagccttgaatt

SEQ ID NO: 362959 - DNA, 16 bp, M. musculus
aggttatcaggtttgg

SEQ ID NO: 362960 - DNA, 16 bp, M. musculus
aggttatccttgaact

SEQ ID NO: 362961 - DNA, 16 bp, M. musculus
aggttattttatcaca

SEQ ID NO: 362962 - DNA, 16 bp, M. musculus
aggttcaaggagagac

SEQ ID NO: 362963 - DNA, 16 bp, M. musculus
aggttcaattcccagc

SEQ ID NO: 362964 - DNA, 16 bp, M. musculus
aggttcacggtttcag

SEQ ID NO: 362965 - DNA, 16 bp, M. musculus
aggttcagaaaggaaa

SEQ ID NO: 362966 - DNA, 16 bp, M. musculus
aggttcagagactcag

SEQ ID NO: 362967 - DNA, 16 bp, M. musculus
aggttcagcaagagac

SEQ ID NO: 362968 - DNA, 16 bp, M. musculus
aggttcagcagtgagg

SEQ ID NO: 362969 - DNA, 16 bp, M. musculus
aggttcagcgagagac

SEQ ID NO: 362970 - DNA, 16 bp, M. musculus
aggttcagggaaagac

SEQ ID NO: 362971 - DNA, 16 bp, M. musculus
aggttcagtggcagtg

SEQ ID NO: 362972 - DNA, 17 bp, M. musculus
aggttcatccatttgcc

SEQ ID NO: 362973 - DNA, 16 bp, M. musculus
aggttcatttcccagc

SEQ ID NO: 362974 - DNA, 16 bp, M. musculus
aggttccaggaggctg

SEQ ID NO: 362975 - DNA, 16 bp, M. musculus
aggttccagtattgat

SEQ ID NO: 362976 - DNA, 16 bp, M. musculus
aggttccatgagagac

SEQ ID NO: 362977 - DNA, 16 bp, M. musculus
aggttcccacacaggc

SEQ ID NO: 362978 - DNA, 16 bp, M. musculus
aggttcccctctaccc

SEQ ID NO: 362979 - DNA, 16 bp, M. musculus
aggttcctaaaatgct

SEQ ID NO: 362980 - DNA, 16 bp, M. musculus
aggttcctctgtggac

SEQ ID NO: 362981 - DNA, 16 bp, M. musculus
aggttcctgccctgtt

SEQ ID NO: 362982 - DNA, 16 bp, M. musculus
aggttcctgcctcaag

SEQ ID NO: 362983 - DNA, 16 bp, M. musculus
aggttcctgtcttcaa

SEQ ID NO: 362984 - DNA, 16 bp, M. musculus
aggttcctttcagcat

SEQ ID NO: 362985 - DNA, 16 bp, M. musculus
aggttctcactatgta

SEQ ID NO: 362986 - DNA, 16 bp, M. musculus
aggttctccctcctct

SEQ ID NO: 362987 - DNA, 16 bp, M. musculus
aggttctcccttccct

SEQ ID NO: 362988 - DNA, 16 bp, M. musculus
aggttctctcccactc

SEQ ID NO: 362989 - DNA, 16 bp, M. musculus
aggttcttccagcttt

SEQ ID NO: 362990 - DNA, 16 bp, M. musculus
aggttctttgtgtata

SEQ ID NO: 362991 - DNA, 16 bp, M. musculus
aggttgaaaaccactg

SEQ ID NO: 362992 - DNA, 16 bp, M. musculus
aggttgaaaaccattg

SEQ ID NO: 362993 - DNA, 16 bp, M. musculus
aggttgaccctgaact

SEQ ID NO: 362994 - DNA, 16 bp, M. musculus
aggttgacctcaaact

SEQ ID NO: 362995 - DNA, 16 bp, M. musculus
aggttgaccttgaact

SEQ ID NO: 362996 - DNA, 16 bp, M. musculus
aggttgacctttgacc

SEQ ID NO: 362997 - DNA, 16 bp, M. musculus
aggttgactttgaact

SEQ ID NO: 362998 - DNA, 16 bp, M. musculus
aggttgagaaccactg

SEQ ID NO: 362999 - DNA, 16 bp, M. musculus
aggttgagaaccgctg

SEQ ID NO: 363000 - DNA, 16 bp, M. musculus
aggttgagaagcactg

SEQ ID NO: 363001 - DNA, 16 bp, M. musculus
aggttgagaatcactg

SEQ ID NO: 363002 - DNA, 16 bp, M. musculus
aggttgagagccactg

SEQ ID NO: 363003 - DNA, 16 bp, M. musculus
aggttgagcaagccat

SEQ ID NO: 363004 - DNA, 16 bp, M. musculus
aggttgaggcagaaag

SEQ ID NO: 363005 - DNA, 16 bp, M. musculus
aggttgctgatttgtc

SEQ ID NO: 363006 - DNA, 16 bp, M. musculus
aggttggcctagaact

SEQ ID NO: 363007 - DNA, 16 bp, M. musculus
aggttggccttaaact

SEQ ID NO: 363008 - DNA, 16 bp, M. musculus
aggttgggaaccactg

SEQ ID NO: 363009 - DNA, 16 bp, M. musculus
aggttggggctgggga

SEQ ID NO: 363010 - DNA, 16 bp, M. musculus
aggttgtaaagtgaat

SEQ ID NO: 363011 - DNA, 16 bp, M. musculus
aggttgtaagccacca

SEQ ID NO: 363012 - DNA, 16 bp, M. musculus
aggttgtatcaagttg

SEQ ID NO: 363013 - DNA, 16 bp, M. musculus
aggttgtcaggctggg

SEQ ID NO: 363014 - DNA, 16 bp, M. musculus
aggttgtcctgtgacc

SEQ ID NO: 363015 - DNA, 16 bp, M. musculus
aggttgtggggaccct

SEQ ID NO: 363016 - DNA, 16 bp, M. musculus
aggttgtgtctgtctt

SEQ ID NO: 363017 - DNA, 16 bp, M. musculus
aggttgttaggcttgg

SEQ ID NO: 363018 - DNA, 17 bp, M. musculus
aggttgttccaggaggc

SEQ ID NO: 363019 - DNA, 16 bp, M. musculus
aggtttaactgaggag

SEQ ID NO: 363020 - DNA, 16 bp, M. musculus
aggtttaattgtttta

SEQ ID NO: 363021 - DNA, 16 bp, M. musculus
aggtttattgggaaac

SEQ ID NO: 363022 - DNA, 16 bp, M. musculus
aggtttattgtaaata

SEQ ID NO: 363023 - DNA, 16 bp, M. musculus
aggtttatttcatctt

SEQ ID NO: 363024 - DNA, 16 bp, M. musculus
aggtttatttttaaaa

SEQ ID NO: 363025 - DNA, 16 bp, M. musculus
aggtttcaaaggagaa

SEQ ID NO: 363026 - DNA, 16 bp, M. musculus
aggtttcagagaagaa

SEQ ID NO: 363027 - DNA, 16 bp, M. musculus
aggtttcctttttgtt

SEQ ID NO: 363028 - DNA, 16 bp, M. musculus
aggtttctcagtgtag

SEQ ID NO: 363029 - DNA, 16 bp, M. musculus
aggtttctctgtgcag

SEQ ID NO: 363030 - DNA, 16 bp, M. musculus
aggtttctgttgttgt

SEQ ID NO: 363031 - DNA, 16 bp, M. musculus
aggtttcttttggctc

SEQ ID NO: 363032 - DNA, 16 bp, M. musculus
aggtttgagaagtttt

SEQ ID NO: 363033 - DNA, 16 bp, M. musculus
aggtttgcaattttat

SEQ ID NO: 363034 - DNA, 16 bp, M. musculus
aggtttgcagagaact

SEQ ID NO: 363035 - DNA, 16 bp, M. musculus
aggtttgctttgtgac

SEQ ID NO: 363036 - DNA, 16 bp, M. musculus
aggtttgggtatgttg

SEQ ID NO: 363037 - DNA, 16 bp, M. musculus
aggtttggtggcaagc

SEQ ID NO: 363038 - DNA, 16 bp, M. musculus
aggtttgtgtatgttg

SEQ ID NO: 363039 - DNA, 24 bp, M. musculus
aggttttattatcagctagctgag

SEQ ID NO: 363040 - DNA, 16 bp, M. musculus
aggttttatttttgga

SEQ ID NO: 363041 - DNA, 16 bp, M. musculus
aggttttcaggtgtgt

SEQ ID NO: 363042 - DNA, 16 bp, M. musculus
aggttttccacggaga

SEQ ID NO: 363043 - DNA, 16 bp, M. musculus
aggttttcccccactt

SEQ ID NO: 363044 - DNA, 16 bp, M. musculus
aggttttctttgtgta

SEQ ID NO: 363045 - DNA, 16 bp, M. musculus
aggttttgaaaaatat

SEQ ID NO: 363046 - DNA, 16 bp, M. musculus
aggttttgagacaggg

SEQ ID NO: 363047 - DNA, 16 bp, M. musculus
aggttttgtagagttt

SEQ ID NO: 363048 - DNA, 16 bp, M. musculus
aggttttgtggctagg

SEQ ID NO: 363049 - DNA, 16 bp, M. musculus
aggtttttggtgcatt

SEQ ID NO: 363050 - DNA, 16 bp, M. musculus
aggttttttctgtgta

SEQ ID NO: 363051 - DNA, 16 bp, M. musculus
aggttttttttatcct

SEQ ID NO: 363052 - DNA, 16 bp, M. musculus
agtaaaaacaatgaat

SEQ ID NO: 363053 - DNA, 16 bp, M. musculus
agtaaaaacagaagga

SEQ ID NO: 363054 - DNA, 16 bp, M. musculus
agtaaaaatctaccaa

SEQ ID NO: 363055 - DNA, 16 bp, M. musculus
agtaaaaatgactatc

SEQ ID NO: 363056 - DNA, 16 bp, M. musculus
agtaaaaatggctgtc

SEQ ID NO: 363057 - DNA, 16 bp, M. musculus
agtaaaaatggctttc

SEQ ID NO: 363058 - DNA, 16 bp, M. musculus
agtaaaaggtttctga

SEQ ID NO: 363059 - DNA, 16 bp, M. musculus
agtaaaatcttgctgg

SEQ ID NO: 363060 - DNA, 16 bp, M. musculus
agtaaaatgtattttt

SEQ ID NO: 363061 - DNA, 16 bp, M. musculus
agtaaaattacagtta

SEQ ID NO: 363062 - DNA, 38 bp, M. musculus
agtaaacttcagaggctttgaacagaaaggtttgtctt

SEQ ID NO: 363063 - DNA, 17 bp, M. musculus
agtaaacttgtggttgt

SEQ ID NO: 363064 - DNA, 16 bp, M. musculus
agtaaagaaaatatct

SEQ ID NO: 363065 - DNA, 16 bp, M. musculus
agtaaagaaatctgga

SEQ ID NO: 363066 - DNA, 16 bp, M. musculus
agtaaagaattttgga

SEQ ID NO: 363067 - DNA, 16 bp, M. musculus
agtaaagatcttttct

SEQ ID NO: 363068 - DNA, 16 bp, M. musculus
agtaaagcacttgcct

SEQ ID NO: 363069 - DNA, 16 bp, M. musculus
agtaaagggtgagaag

SEQ ID NO: 363070 - DNA, 16 bp, M. musculus
agtaaagtttgtttta

SEQ ID NO: 363071 - DNA, 16 bp, M. musculus
agtaaataaataaagc

SEQ ID NO: 363072 - DNA, 16 bp, M. musculus
agtaaataaataaatc

SEQ ID NO: 363073 - DNA, 16 bp, M. musculus
agtaaataaatacaca

SEQ ID NO: 363074 - DNA, 16 bp, M. musculus
agtaaataacacagtc

SEQ ID NO: 363075 - DNA, 16 bp, M. musculus
agtaaatacattttta

SEQ ID NO: 363076 - DNA, 16 bp, M. musculus
agtaaatatacaaaat

SEQ ID NO: 363077 - DNA, 16 bp, M. musculus
agtaaatcctttcctc

SEQ ID NO: 363078 - DNA, 16 bp, M. musculus
agtaaatctccaaccc

SEQ ID NO: 363079 - DNA, 16 bp, M. musculus
agtaaatgcctggact

SEQ ID NO: 363080 - DNA, 17 bp, M. musculus
agtaaatggtgagaagc

SEQ ID NO: 363081 - DNA, 16 bp, M. musculus
agtaaattaagctttg

SEQ ID NO: 363082 - DNA, 16 bp, M. musculus
agtaacaacagcagca

SEQ ID NO: 363083 - DNA, 16 bp, M. musculus
agtaacaataataata

SEQ ID NO: 363084 - DNA, 19 bp, M. musculus
agtaacacacccaagtgag

SEQ ID NO: 363085 - DNA, 16 bp, M. musculus
agtaacacacttcctc

SEQ ID NO: 363086 - DNA, 16 bp, M. musculus
agtaacattatacaga

SEQ ID NO: 363087 - DNA, 16 bp, M. musculus
agtaaccaaccatttt

SEQ ID NO: 363088 - DNA, 16 bp, M. musculus
agtaaccattttaata

SEQ ID NO: 363089 - DNA, 17 bp, M. musculus
agtaacccggagctctt

SEQ ID NO: 363090 - DNA, 16 bp, M. musculus
agtaactcttctgaag

SEQ ID NO: 363091 - DNA, 16 bp, M. musculus
agtaactggggaggag

SEQ ID NO: 363092 - DNA, 16 bp, M. musculus
agtaactgtggggagg

SEQ ID NO: 363093 - DNA, 16 bp, M. musculus
agtaacttcttttgtg

SEQ ID NO: 363094 - DNA, 16 bp, M. musculus
agtaagaaaattcttg

SEQ ID NO: 363095 - DNA, 16 bp, M. musculus
agtaagatccaggaca

SEQ ID NO: 363096 - DNA, 16 bp, M. musculus
agtaagattcttactt

SEQ ID NO: 363097 - DNA, 18 bp, M. musculus
agtaagcaataaagcttt

SEQ ID NO: 363098 - DNA, 16 bp, M. musculus
agtaagcactttaccc

SEQ ID NO: 363099 - DNA, 16 bp, M. musculus
agtaagcagcacccct

SEQ ID NO: 363100 - DNA, 16 bp, M. musculus
agtaagcagtatccct

SEQ ID NO: 363101 - DNA, 16 bp, M. musculus
agtaagctccaggcca

SEQ ID NO: 363102 - DNA, 16 bp, M. musculus
agtaaggaagaccaag

SEQ ID NO: 363103 - DNA, 16 bp, M. musculus
agtaagggagaaatgt

SEQ ID NO: 363104 - DNA, 16 bp, M. musculus
agtaagtgccaggaca

SEQ ID NO: 363105 - DNA, 16 bp, M. musculus
agtaagtgctcttaac

SEQ ID NO: 363106 - DNA, 16 bp, M. musculus
agtaagtgtggccttg

SEQ ID NO: 363107 - DNA, 16 bp, M. musculus
agtaagtgtgtcactg

SEQ ID NO: 363108 - DNA, 16 bp, M. musculus
agtaagttccaggaaa

SEQ ID NO: 363109 - DNA, 16 bp, M. musculus
agtaataagcaaataa

SEQ ID NO: 363110 - DNA, 16 bp, M. musculus
agtaatcctcttgcct

SEQ ID NO: 363111 - DNA, 16 bp, M. musculus
agtaattgtgctaaag

SEQ ID NO: 363112 - DNA, 16 bp, M. musculus
agtaattttttaaaag

SEQ ID NO: 363113 - DNA, 16 bp, M. musculus
agtacaagaacaatta

SEQ ID NO: 363114 - DNA, 17 bp, M. musculus
agtacaagccattgctg

SEQ ID NO: 363115 - DNA, 16 bp, M. musculus
agtacaaggagagaga

SEQ ID NO: 363116 - DNA, 16 bp, M. musculus
agtacaatattgaata

SEQ ID NO: 363117 - DNA, 16 bp, M. musculus
agtacacagacatgca

SEQ ID NO: 363118 - DNA, 16 bp, M. musculus
agtacacagtagctgt

SEQ ID NO: 363119 - DNA, 16 bp, M. musculus
agtacacagttactgt

SEQ ID NO: 363120 - DNA, 16 bp, M. musculus
agtacactgaagctgt

SEQ ID NO: 363121 - DNA, 23 bp, M. musculus
agtacactgtagctgtcctcaga

SEQ ID NO: 363122 - DNA, 17 bp, M. musculus
agtacactgtagctgtt

SEQ ID NO: 363123 - DNA, 16 bp, M. musculus
agtacactgtctctgt

SEQ ID NO: 363124 - DNA, 18 bp, M. musculus
agtacagctacagtgtac

SEQ ID NO: 363125 - DNA, 16 bp, M. musculus
agtacagcttcaggtc

SEQ ID NO: 363126 - DNA, 16 bp, M. musculus
agtacagggaaatgcc

SEQ ID NO: 363127 - DNA, 16 bp, M. musculus
agtacaggtgcctgtg

SEQ ID NO: 363128 - DNA, 16 bp, M. musculus
agtacagtgtgtgtgt

SEQ ID NO: 363129 - DNA, 16 bp, M. musculus
agtacataaatgaaca

SEQ ID NO: 363130 - DNA, 16 bp, M. musculus
agtacatgcaaagaat

SEQ ID NO: 363131 - DNA, 16 bp, M. musculus
agtacatgctggtgag

SEQ ID NO: 363132 - DNA, 16 bp, M. musculus
agtacattctagaggg

SEQ ID NO: 363133 - DNA, 16 bp, M. musculus
agtacattgtaactgt

SEQ ID NO: 363134 - DNA, 16 bp, M. musculus
agtaccaggacagcca

SEQ ID NO: 363135 - DNA, 16 bp, M. musculus
agtaccaggcatgaat

SEQ ID NO: 363136 - DNA, 16 bp, M. musculus
agtaccaggccagcca

SEQ ID NO: 363137 - DNA, 17 bp, M. musculus
agtaccatgccctaaag

SEQ ID NO: 363138 - DNA, 16 bp, M. musculus
agtaccatgggatgac

SEQ ID NO: 363139 - DNA, 17 bp, M. musculus
agtacccaagaagctga

SEQ ID NO: 363140 - DNA, 16 bp, M. musculus
agtacccaaggtgctg

SEQ ID NO: 363141 - DNA, 16 bp, M. musculus
agtacccacatggcag

SEQ ID NO: 363142 - DNA, 17 bp, M. musculus
agtacccagatgcccct

SEQ ID NO: 363143 - DNA, 16 bp, M. musculus
agtaccccacagagct

SEQ ID NO: 363144 - DNA, 16 bp, M. musculus
agtaccccgagagctc

SEQ ID NO: 363145 - DNA, 16 bp, M. musculus
agtacctactatgtgt

SEQ ID NO: 363146 - DNA, 16 bp, M. musculus
agtacctactgtgtgc

SEQ ID NO: 363147 - DNA, 16 bp, M. musculus
agtacctccaagaaga

SEQ ID NO: 363148 - DNA, 17 bp, M. musculus
agtacctctgcaccaag

SEQ ID NO: 363149 - DNA, 16 bp, M. musculus
agtacctgtggctcct

SEQ ID NO: 363150 - DNA, 17 bp, M. musculus
agtacctgttaatgaga

SEQ ID NO: 363151 - DNA, 16 bp, M. musculus
agtactaccagaagat

SEQ ID NO: 363152 - DNA, 16 bp, M. musculus
agtactacttctgcta

SEQ ID NO: 363153 - DNA, 16 bp, M. musculus
agtactagctgctctt

SEQ ID NO: 363154 - DNA, 16 bp, M. musculus
agtactaggattaaag

SEQ ID NO: 363155 - DNA, 16 bp, M. musculus
agtactatattgaaaa

SEQ ID NO: 363156 - DNA, 16 bp, M. musculus
agtactatgtccaaat

SEQ ID NO: 363157 - DNA, 16 bp, M. musculus
agtactatgttgaata

SEQ ID NO: 363158 - DNA, 16 bp, M. musculus
agtactccaatgtgta

SEQ ID NO: 363159 - DNA, 16 bp, M. musculus
agtactccagaggcag

SEQ ID NO: 363160 - DNA, 16 bp, M. musculus
agtactcctttgtgta

SEQ ID NO: 363161 - DNA, 17 bp, M. musculus
agtactcgggaggcaga

SEQ ID NO: 363162 - DNA, 16 bp, M. musculus
agtactctatctgcat

SEQ ID NO: 363163 - DNA, 16 bp, M. musculus
agtactgactgctctt

SEQ ID NO: 363164 - DNA, 16 bp, M. musculus
agtactgagattaaag

SEQ ID NO: 363165 - DNA, 16 bp, M. musculus
agtactgagattatag

SEQ ID NO: 363166 - DNA, 17 bp, M. musculus
agtactgaggacaaaga

SEQ ID NO: 363167 - DNA, 16 bp, M. musculus
agtactgcaagtgcct

SEQ ID NO: 363168 - DNA, 16 bp, M. musculus
agtactgcctgaggac

SEQ ID NO: 363169 - DNA, 16 bp, M. musculus
agtactggaattaaag

SEQ ID NO: 363170 - DNA, 16 bp, M. musculus
agtactggagattgaa

SEQ ID NO: 363171 - DNA, 16 bp, M. musculus
agtactggctagtttt

SEQ ID NO: 363172 - DNA, 16 bp, M. musculus
agtactggctgctctt

SEQ ID NO: 363173 - DNA, 16 bp, M. musculus
agtactgggagtaaag

SEQ ID NO: 363174 - DNA, 16 bp, M. musculus
agtactgggataaaag

SEQ ID NO: 363175 - DNA, 16 bp, M. musculus
agtactgggattaaag

SEQ ID NO: 363176 - DNA, 16 bp, M. musculus
agtactgggattaagg

SEQ ID NO: 363177 - DNA, 16 bp, M. musculus
agtactggggagacag

SEQ ID NO: 363178 - DNA, 16 bp, M. musculus
agtactggggttatag

SEQ ID NO: 363179 - DNA, 16 bp, M. musculus
agtacttctcagccat

SEQ ID NO: 363180 - DNA, 16 bp, M. musculus
agtacttgaagtttta

SEQ ID NO: 363181 - DNA, 16 bp, M. musculus
agtacttgctgctctt

SEQ ID NO: 363182 - DNA, 16 bp, M. musculus
agtacttgggagacag

SEQ ID NO: 363183 - DNA, 16 bp, M. musculus
agtacttgggatgcag

SEQ ID NO: 363184 - DNA, 16 bp, M. musculus
agtactttgaatttta

SEQ ID NO: 363185 - DNA, 16 bp, M. musculus
agtagaaacaggagga

SEQ ID NO: 363186 - DNA, 16 bp, M. musculus
agtagaagaaggctac

SEQ ID NO: 363187 - DNA, 16 bp, M. musculus
agtagaatccttggga

SEQ ID NO: 363188 - DNA, 16 bp, M. musculus
agtagacagaaggaaa

SEQ ID NO: 363189 - DNA, 16 bp, M. musculus
agtagactgcaggaaa

SEQ ID NO: 363190 - DNA, 16 bp, M. musculus
agtagagacaggcaga

SEQ ID NO: 363191 - DNA, 16 bp, M. musculus
agtagagatggtgaaa

SEQ ID NO: 363192 - DNA, 16 bp, M. musculus
agtagagattctaggt

SEQ ID NO: 363193 - DNA, 18 bp, M. musculus
agtagaggcaggaggatc

SEQ ID NO: 363194 - DNA, 16 bp, M. musculus
agtagagtgtttgcct

SEQ ID NO: 363195 - DNA, 16 bp, M. musculus
agtagagttcatttta

SEQ ID NO: 363196 - DNA, 18 bp, M. musculus
agtagatacagctgaaca

SEQ ID NO: 363197 - DNA, 16 bp, M. musculus
agtagatacttcccca

SEQ ID NO: 363198 - DNA, 16 bp, M. musculus
agtagatttttaaaaa

SEQ ID NO: 363199 - DNA, 16 bp, M. musculus
agtagcagcagcaaca

SEQ ID NO: 363200 - DNA, 16 bp, M. musculus
agtagcagcagcagca

SEQ ID NO: 363201 - DNA, 16 bp, M. musculus
agtagcagcagtagca

SEQ ID NO: 363202 - DNA, 16 bp, M. musculus
agtagcagcagtggag

SEQ ID NO: 363203 - DNA, 16 bp, M. musculus
agtagcattttttttt

SEQ ID NO: 363204 - DNA, 16 bp, M. musculus
agtagccttcagatga

SEQ ID NO: 363205 - DNA, 16 bp, M. musculus
agtagccttggctgga

SEQ ID NO: 363206 - DNA, 17 bp, M. musculus
agtagctcagaatcgga

SEQ ID NO: 363207 - DNA, 16 bp, M. musculus
agtagctctgggatca

SEQ ID NO: 363208 - DNA, 16 bp, M. musculus
agtagctctgtggctc

SEQ ID NO: 363209 - DNA, 16 bp, M. musculus
agtagctgccatctgc

SEQ ID NO: 363210 - DNA, 17 bp, M. musculus
agtagctgcctgagtaa

SEQ ID NO: 363211 - DNA, 16 bp, M. musculus
agtagctgtcttcaga

SEQ ID NO: 363212 - DNA, 16 bp, M. musculus
agtaggattaacacag

SEQ ID NO: 363213 - DNA, 16 bp, M. musculus
agtaggattcctatgt

SEQ ID NO: 363214 - DNA, 16 bp, M. musculus
agtaggcaagcactct

SEQ ID NO: 363215 - DNA, 16 bp, M. musculus
agtaggccatcttctg

SEQ ID NO: 363216 - DNA, 16 bp, M. musculus
agtagggctggagaga

SEQ ID NO: 363217 - DNA, 16 bp, M. musculus
agtaggggcaggggag

SEQ ID NO: 363218 - DNA, 16 bp, M. musculus
agtaggggctggtgag

SEQ ID NO: 363219 - DNA, 16 bp, M. musculus
agtaggtgtagctttg

SEQ ID NO: 363220 - DNA, 20 bp, M. musculus
agtagtcataagataccctt

SEQ ID NO: 363221 - DNA, 16 bp, M. musculus
agtagtcattaaaaat

SEQ ID NO: 363222 - DNA, 16 bp, M. musculus
agtagtgacatgcatg

SEQ ID NO: 363223 - DNA, 16 bp, M. musculus
agtagtgccactccct

SEQ ID NO: 363224 - DNA, 16 bp, M. musculus
agtagttggagataca

SEQ ID NO: 363225 - DNA, 16 bp, M. musculus
agtagttgttcagtcc

SEQ ID NO: 363226 - DNA, 16 bp, M. musculus
agtagttttaatttac

SEQ ID NO: 363227 - DNA, 16 bp, M. musculus
agtatacacacataca

SEQ ID NO: 363228 - DNA, 16 bp, M. musculus
agtataggtttttgta

SEQ ID NO: 363229 - DNA, 16 bp, M. musculus
agtatagtacagtaca

SEQ ID NO: 363230 - DNA, 16 bp, M. musculus
agtatatagtatataa

SEQ ID NO: 363231 - DNA, 16 bp, M. musculus
agtatatatatatgta

SEQ ID NO: 363232 - DNA, 16 bp, M. musculus
agtatatatctatata

SEQ ID NO: 363233 - DNA, 16 bp, M. musculus
agtatatgcctggaac

SEQ ID NO: 363234 - DNA, 16 bp, M. musculus
agtatccaaataaaca

SEQ ID NO: 363235 - DNA, 16 bp, M. musculus
agtatccagagacggg

SEQ ID NO: 363236 - DNA, 16 bp, M. musculus
agtatctctgtagtaa

SEQ ID NO: 363237 - DNA, 16 bp, M. musculus
agtatgcaaagaagca

SEQ ID NO: 363238 - DNA, 16 bp, M. musculus
agtatgccattgtgta

SEQ ID NO: 363239 - DNA, 17 bp, M. musculus
agtatggaattgtaagc

SEQ ID NO: 363240 - DNA, 16 bp, M. musculus
agtatggatactttgg

SEQ ID NO: 363241 - DNA, 16 bp, M. musculus
agtatgtgtatgtatg

SEQ ID NO: 363242 - DNA, 16 bp, M. musculus
agtatgtgtgtgtgtg

SEQ ID NO: 363243 - DNA, 16 bp, M. musculus
agtatgttttcatttt

SEQ ID NO: 363244 - DNA, 16 bp, M. musculus
agtattaaccccagaa

SEQ ID NO: 363245 - DNA, 16 bp, M. musculus
agtattattcagcctt

SEQ ID NO: 363246 - DNA, 16 bp, M. musculus
agtattcaatttgaaa

SEQ ID NO: 363247 - DNA, 16 bp, M. musculus
agtattcatgagaagg

SEQ ID NO: 363248 - DNA, 16 bp, M. musculus
agtattccactgtgta

SEQ ID NO: 363249 - DNA, 16 bp, M. musculus
agtattcccaccacag

SEQ ID NO: 363250 - DNA, 16 bp, M. musculus
agtattctgcacaggt

SEQ ID NO: 363251 - DNA, 16 bp, M. musculus
agtattctgcctgcat

SEQ ID NO: 363252 - DNA, 16 bp, M. musculus
agtattctgctagcag

SEQ ID NO: 363253 - DNA, 16 bp, M. musculus
agtattcttcaaaata

SEQ ID NO: 363254 - DNA, 16 bp, M. musculus
agtattgacattttta

SEQ ID NO: 363255 - DNA, 16 bp, M. musculus
agtattgggattaaag

SEQ ID NO: 363256 - DNA, 16 bp, M. musculus
agtatttaataaagct

SEQ ID NO: 363257 - DNA, 16 bp, M. musculus
agtatttatttttact

SEQ ID NO: 363258 - DNA, 16 bp, M. musculus
agtatttgaagtatta

SEQ ID NO: 363259 - DNA, 16 bp, M. musculus
agtatttgacaaaata

SEQ ID NO: 363260 - DNA, 16 bp, M. musculus
agtattttattgaaaa

SEQ ID NO: 363261 - DNA, 16 bp, M. musculus
agtattttctttaaaa

SEQ ID NO: 363262 - DNA, 16 bp, M. musculus
agtattttgtctgcag

SEQ ID NO: 363263 - DNA, 16 bp, M. musculus
agtattttgttgagaa

SEQ ID NO: 363264 - DNA, 16 bp, M. musculus
agtatttttccattga

SEQ ID NO: 363265 - DNA, 16 bp, M. musculus
agtatttttttccatt

SEQ ID NO: 363266 - DNA, 16 bp, M. musculus
agtcaaaaaatgcaaa

SEQ ID NO: 363267 - DNA, 16 bp, M. musculus
agtcaaaagcaccctc

SEQ ID NO: 363268 - DNA, 16 bp, M. musculus
agtcaaaataccacta

SEQ ID NO: 363269 - DNA, 16 bp, M. musculus
agtcaaaatgtcacta

SEQ ID NO: 363270 - DNA, 16 bp, M. musculus
agtcaaagaagaaata

SEQ ID NO: 363271 - DNA, 16 bp, M. musculus
agtcaaagcatttctc

SEQ ID NO: 363272 - DNA, 16 bp, M. musculus
agtcaaagctacacag

SEQ ID NO: 363273 - DNA, 16 bp, M. musculus
agtcaaaggacactgt

SEQ ID NO: 363274 - DNA, 17 bp, M. musculus
agtcaacaaagatgaaa

SEQ ID NO: 363275 - DNA, 16 bp, M. musculus
agtcaacaacaacaac

SEQ ID NO: 363276 - DNA, 16 bp, M. musculus
agtcaactaacatgga

SEQ ID NO: 363277 - DNA, 16 bp, M. musculus
agtcaactaacctgaa

SEQ ID NO: 363278 - DNA, 16 bp, M. musculus
agtcaagaagcagaaa

SEQ ID NO: 363279 - DNA, 16 bp, M. musculus
agtcaagacaggaatt

SEQ ID NO: 363280 - DNA, 16 bp, M. musculus
agtcaagagcagagag

SEQ ID NO: 363281 - DNA, 16 bp, M. musculus
agtcaagagttcaagg

SEQ ID NO: 363282 - DNA, 16 bp, M. musculus
agtcaaggacaccaca

SEQ ID NO: 363283 - DNA, 16 bp, M. musculus
agtcaaggatgacctt

SEQ ID NO: 363284 - DNA, 16 bp, M. musculus
agtcacaaaaatataa

SEQ ID NO: 363285 - DNA, 16 bp, M. musculus
agtcacaaaagaacat

SEQ ID NO: 363286 - DNA, 16 bp, M. musculus
agtcacaatcaaaagc

SEQ ID NO: 363287 - DNA, 16 bp, M. musculus
agtcacacagacagac

SEQ ID NO: 363288 - DNA, 16 bp, M. musculus
agtcacagaacatatt

SEQ ID NO: 363289 - DNA, 16 bp, M. musculus
agtcacagagattctg

SEQ ID NO: 363290 - DNA, 16 bp, M. musculus
agtcacagcactcagg

SEQ ID NO: 363291 - DNA, 16 bp, M. musculus
agtcacaggaagagaa

SEQ ID NO: 363292 - DNA, 16 bp, M. musculus
agtcacagtcagagac

SEQ ID NO: 363293 - DNA, 16 bp, M. musculus
agtcacagtctctgag

SEQ ID NO: 363294 - DNA, 16 bp, M. musculus
agtcacattcttcacc

SEQ ID NO: 363295 - DNA, 16 bp, M. musculus
agtcaccaaacccaga

SEQ ID NO: 363296 - DNA, 16 bp, M. musculus
agtcaccaaacctgga

SEQ ID NO: 363297 - DNA, 16 bp, M. musculus
agtcaccagaagaggg

SEQ ID NO: 363298 - DNA, 16 bp, M. musculus
agtcacctaacctgga

SEQ ID NO: 363299 - DNA, 16 bp, M. musculus
agtcacctctctagcc

SEQ ID NO: 363300 - DNA, 16 bp, M. musculus
agtcacctgaagaaca

SEQ ID NO: 363301 - DNA, 16 bp, M. musculus
agtcacctgctgtgaa

SEQ ID NO: 363302 - DNA, 18 bp, M. musculus
agtcactgaggctgacaa

SEQ ID NO: 363303 - DNA, 16 bp, M. musculus
agtcactgcaggacta

SEQ ID NO: 363304 - DNA, 16 bp, M. musculus
agtcactgcccatctc

SEQ ID NO: 363305 - DNA, 16 bp, M. musculus
agtcactggagagaaa

SEQ ID NO: 363306 - DNA, 16 bp, M. musculus
agtcactggatggtct

SEQ ID NO: 363307 - DNA, 16 bp, M. musculus
agtcacttttcatgat

SEQ ID NO: 363308 - DNA, 16 bp, M. musculus
agtcagaaactgccct

SEQ ID NO: 363309 - DNA, 16 bp, M. musculus
agtcagaacagctgag

SEQ ID NO: 363310 - DNA, 16 bp, M. musculus
agtcagaagctgaaaa

SEQ ID NO: 363311 - DNA, 16 bp, M. musculus
agtcagaaggcagaga

SEQ ID NO: 363312 - DNA, 16 bp, M. musculus
agtcagaaggtggatg

SEQ ID NO: 363313 - DNA, 16 bp, M. musculus
agtcagaatggtgaag

SEQ ID NO: 363314 - DNA, 16 bp, M. musculus
agtcagacaagaaaaa

SEQ ID NO: 363315 - DNA, 16 bp, M. musculus
agtcagacactacctc

SEQ ID NO: 363316 - DNA, 16 bp, M. musculus
agtcagagaaggtgca

SEQ ID NO: 363317 - DNA, 16 bp, M. musculus
agtcagagacagcaag

SEQ ID NO: 363318 - DNA, 16 bp, M. musculus
agtcagagagagagag

SEQ ID NO: 363319 - DNA, 16 bp, M. musculus
agtcagagagagcaag

SEQ ID NO: 363320 - DNA, 16 bp, M. musculus
agtcagagccacatgg

SEQ ID NO: 363321 - DNA, 16 bp, M. musculus
agtcagagccctacca

SEQ ID NO: 363322 - DNA, 16 bp, M. musculus
agtcagaggacaactt

SEQ ID NO: 363323 - DNA, 16 bp, M. musculus
agtcagaggacaatgt

SEQ ID NO: 363324 - DNA, 16 bp, M. musculus
agtcagagggaggagg

SEQ ID NO: 363325 - DNA, 16 bp, M. musculus
agtcagagggtggacc

SEQ ID NO: 363326 - DNA, 16 bp, M. musculus
agtcagattttttttt

SEQ ID NO: 363327 - DNA, 16 bp, M. musculus
agtcagcaacagtttc

SEQ ID NO: 363328 - DNA, 16 bp, M. musculus
agtcagcaggagggac

SEQ ID NO: 363329 - DNA, 16 bp, M. musculus
agtcagcagtggcagc

SEQ ID NO: 363330 - DNA, 16 bp, M. musculus
agtcagccaccaaacg

SEQ ID NO: 363331 - DNA, 16 bp, M. musculus
agtcagcctgagctac

SEQ ID NO: 363332 - DNA, 16 bp, M. musculus
agtcagcctgatctac

SEQ ID NO: 363333 - DNA, 16 bp, M. musculus
agtcagctctctcctt

SEQ ID NO: 363334 - DNA, 16 bp, M. musculus
agtcagctgctgggag

SEQ ID NO: 363335 - DNA, 16 bp, M. musculus
agtcagctgctgtgtg

SEQ ID NO: 363336 - DNA, 16 bp, M. musculus
agtcagcttgacaggc

SEQ ID NO: 363337 - DNA, 16 bp, M. musculus
agtcaggaaacaaaga

SEQ ID NO: 363338 - DNA, 16 bp, M. musculus
agtcaggaaataatca

SEQ ID NO: 363339 - DNA, 16 bp, M. musculus
agtcaggaagagatag

SEQ ID NO: 363340 - DNA, 16 bp, M. musculus
agtcaggaaggagaga

SEQ ID NO: 363341 - DNA, 16 bp, M. musculus
agtcaggaccagaact

SEQ ID NO: 363342 - DNA, 16 bp, M. musculus
agtcagggaagtggcc

SEQ ID NO: 363343 - DNA, 16 bp, M. musculus
agtcagggagggaggg

SEQ ID NO: 363344 - DNA, 16 bp, M. musculus
agtcagggtaggaact

SEQ ID NO: 363345 - DNA, 16 bp, M. musculus
agtcagggttacacag

SEQ ID NO: 363346 - DNA, 16 bp, M. musculus
agtcagggttctctaa

SEQ ID NO: 363347 - DNA, 16 bp, M. musculus
agtcagtaaagtgcct

SEQ ID NO: 363348 - DNA, 16 bp, M. musculus
agtcagtattctgcta

SEQ ID NO: 363349 - DNA, 16 bp, M. musculus
agtcagtcagtcagtc

SEQ ID NO: 363350 - DNA, 16 bp, M. musculus
agtcagtcagtcattc

SEQ ID NO: 363351 - DNA, 16 bp, M. musculus
agtcagtcagtctgtc

SEQ ID NO: 363352 - DNA, 16 bp, M. musculus
agtcagtcatcaatgg

SEQ ID NO: 363353 - DNA, 16 bp, M. musculus
agtcagtgagtgctct

SEQ ID NO: 363354 - DNA, 16 bp, M. musculus
agtcagtgcccttacc

SEQ ID NO: 363355 - DNA, 16 bp, M. musculus
agtcagtgcgcttaac

SEQ ID NO: 363356 - DNA, 16 bp, M. musculus
agtcagtgctcttaac

SEQ ID NO: 363357 - DNA, 16 bp, M. musculus
agtcagtgttcttaac

SEQ ID NO: 363358 - DNA, 29 bp, M. musculus
agtcagttcagcttaccttgacagaactc

SEQ ID NO: 363359 - DNA, 16 bp, M. musculus
agtcagttctcccctt

SEQ ID NO: 363360 - DNA, 16 bp, M. musculus
agtcagttctctcctt

SEQ ID NO: 363361 - DNA, 16 bp, M. musculus
agtcagttctggaaag

SEQ ID NO: 363362 - DNA, 16 bp, M. musculus
agtcagttttctcctc

SEQ ID NO: 363363 - DNA, 16 bp, M. musculus
agtcagttttctttaa

SEQ ID NO: 363364 - DNA, 16 bp, M. musculus
agtcataagacttggc

SEQ ID NO: 363365 - DNA, 16 bp, M. musculus
agtcatacagacatta

SEQ ID NO: 363366 - DNA, 17 bp, M. musculus
agtcataccccatgttt

SEQ ID NO: 363367 - DNA, 16 bp, M. musculus
agtcatagctctgagt

SEQ ID NO: 363368 - DNA, 16 bp, M. musculus
agtcatagtcatagtc

SEQ ID NO: 363369 - DNA, 16 bp, M. musculus
agtcatattcaaagac

SEQ ID NO: 363370 - DNA, 16 bp, M. musculus
agtcatcaataggagg

SEQ ID NO: 363371 - DNA, 17 bp, M. musculus
agtcatcaggaaatgca

SEQ ID NO: 363372 - DNA, 16 bp, M. musculus
agtcatcatcagagaa

SEQ ID NO: 363373 - DNA, 16 bp, M. musculus
agtcatcccaggaacc

SEQ ID NO: 363374 - DNA, 16 bp, M. musculus
agtcatcctcagctac

SEQ ID NO: 363375 - DNA, 16 bp, M. musculus
agtcatctataaaatg

SEQ ID NO: 363376 - DNA, 16 bp, M. musculus
agtcatctgaaaggag

SEQ ID NO: 363377 - DNA, 16 bp, M. musculus
agtcatctgagaagag

SEQ ID NO: 363378 - DNA, 16 bp, M. musculus
agtcatctgagagaag

SEQ ID NO: 363379 - DNA, 16 bp, M. musculus
agtcatctgagaggag

SEQ ID NO: 363380 - DNA, 16 bp, M. musculus
agtcattaaagaaaaa

SEQ ID NO: 363381 - DNA, 16 bp, M. musculus
agtcattagagaggaa

SEQ ID NO: 363382 - DNA, 16 bp, M. musculus
agtcattccaataaat

SEQ ID NO: 363383 - DNA, 16 bp, M. musculus
agtcattcctttgttt

SEQ ID NO: 363384 - DNA, 16 bp, M. musculus
agtcattctgactggg

SEQ ID NO: 363385 - DNA, 16 bp, M. musculus
agtcattgacacagaa

SEQ ID NO: 363386 - DNA, 16 bp, M. musculus
agtcattgctgttctg

SEQ ID NO: 363387 - DNA, 16 bp, M. musculus
agtcatttcttttctt

SEQ ID NO: 363388 - DNA, 16 bp, M. musculus
agtcattttccctcaa

SEQ ID NO: 363389 - DNA, 16 bp, M. musculus
agtcattttctcagtt

SEQ ID NO: 363390 - DNA, 16 bp, M. musculus
agtcattttggaagag

SEQ ID NO: 363391 - DNA, 16 bp, M. musculus
agtcatttttttttcc

SEQ ID NO: 363392 - DNA, 16 bp, M. musculus
agtccaactttcaaag

SEQ ID NO: 363393 - DNA, 20 bp, M. musculus
agtccaaggatctagcagtt

SEQ ID NO: 363394 - DNA, 16 bp, M. musculus
agtccaaggtcatcct

SEQ ID NO: 363395 - DNA, 16 bp, M. musculus
agtccaagtggaccaa

SEQ ID NO: 363396 - DNA, 16 bp, M. musculus
agtccaatggttggct

SEQ ID NO: 363397 - DNA, 17 bp, M. musculus
agtccaatggttggcta

SEQ ID NO: 363398 - DNA, 16 bp, M. musculus
agtccaatttgtgctg

SEQ ID NO: 363399 - DNA, 16 bp, M. musculus
agtccaatttgtgttg

SEQ ID NO: 363400 - DNA, 16 bp, M. musculus
agtccacaaggctgga

SEQ ID NO: 363401 - DNA, 16 bp, M. musculus
agtccacacaggagag

SEQ ID NO: 363402 - DNA, 16 bp, M. musculus
agtccacactctcaac

SEQ ID NO: 363403 - DNA, 16 bp, M. musculus
agtccacactctcccc

SEQ ID NO: 363404 - DNA, 16 bp, M. musculus
agtccacctgcccaga

SEQ ID NO: 363405 - DNA, 16 bp, M. musculus
agtccactcatcatgg

SEQ ID NO: 363406 - DNA, 16 bp, M. musculus
agtccagaagagggtg

SEQ ID NO: 363407 - DNA, 16 bp, M. musculus
agtccagaatagaagg

SEQ ID NO: 363408 - DNA, 16 bp, M. musculus
agtccagagcagagag

SEQ ID NO: 363409 - DNA, 16 bp, M. musculus
agtccagatttctctg

SEQ ID NO: 363410 - DNA, 16 bp, M. musculus
agtccagccagggcta

SEQ ID NO: 363411 - DNA, 16 bp, M. musculus
agtccagcttcctctg

SEQ ID NO: 363412 - DNA, 16 bp, M. musculus
agtccaggatgacctt

SEQ ID NO: 363413 - DNA, 16 bp, M. musculus
agtccaggctagcctc

SEQ ID NO: 363414 - DNA, 16 bp, M. musculus
agtccaggctgacctc

SEQ ID NO: 363415 - DNA, 16 bp, M. musculus
agtccaggctggcctt

SEQ ID NO: 363416 - DNA, 16 bp, M. musculus
agtccatcatagcagg

SEQ ID NO: 363417 - DNA, 16 bp, M. musculus
agtccatcatggtggg

SEQ ID NO: 363418 - DNA, 16 bp, M. musculus
agtccatcattgaagg

SEQ ID NO: 363419 - DNA, 16 bp, M. musculus
agtccatccttggtgc

SEQ ID NO: 363420 - DNA, 16 bp, M. musculus
agtccatgaccatcat

SEQ ID NO: 363421 - DNA, 16 bp, M. musculus
agtccatgatcatcat

SEQ ID NO: 363422 - DNA, 16 bp, M. musculus
agtccattaccatcat

SEQ ID NO: 363423 - DNA, 16 bp, M. musculus
agtccattatcatcat

SEQ ID NO: 363424 - DNA, 16 bp, M. musculus
agtccattattgtcat

SEQ ID NO: 363425 - DNA, 16 bp, M. musculus
agtccattgtggtggg

SEQ ID NO: 363426 - DNA, 16 bp, M. musculus
agtccatttgtatttg

SEQ ID NO: 363427 - DNA, 17 bp, M. musculus
agtcccaagaaggtgcc

SEQ ID NO: 363428 - DNA, 16 bp, M. musculus
agtcccacaataccca

SEQ ID NO: 363429 - DNA, 16 bp, M. musculus
agtcccagaacagcca

SEQ ID NO: 363430 - DNA, 16 bp, M. musculus
agtcccagcactccag

SEQ ID NO: 363431 - DNA, 16 bp, M. musculus
agtcccagcactctgg

SEQ ID NO: 363432 - DNA, 16 bp, M. musculus
agtcccaggacaacca

SEQ ID NO: 363433 - DNA, 16 bp, M. musculus
agtcccaggacagtca

SEQ ID NO: 363434 - DNA, 16 bp, M. musculus
agtcccaggagatcca

SEQ ID NO: 363435 - DNA, 16 bp, M. musculus
agtcccaggagctctg

SEQ ID NO: 363436 - DNA, 16 bp, M. musculus
agtcccaggccagcca

SEQ ID NO: 363437 - DNA, 16 bp, M. musculus
agtcccaggccagtga

SEQ ID NO: 363438 - DNA, 16 bp, M. musculus
agtcccagggaactct

SEQ ID NO: 363439 - DNA, 16 bp, M. musculus
agtcccagtcaggtct

SEQ ID NO: 363440 - DNA, 16 bp, M. musculus
agtcccatataccctc

SEQ ID NO: 363441 - DNA, 16 bp, M. musculus
agtccccagaattcca

SEQ ID NO: 363442 - DNA, 16 bp, M. musculus
agtccccagagcccac

SEQ ID NO: 363443 - DNA, 16 bp, M. musculus
agtccccaggacccac

SEQ ID NO: 363444 - DNA, 16 bp, M. musculus
agtcccccaaacccac

SEQ ID NO: 363445 - DNA, 16 bp, M. musculus
agtcccctggagctgg

SEQ ID NO: 363446 - DNA, 16 bp, M. musculus
agtcccgggatgagct

SEQ ID NO: 363447 - DNA, 16 bp, M. musculus
agtccctaaagaaaga

SEQ ID NO: 363448 - DNA, 16 bp, M. musculus
agtccctcaaggagga

SEQ ID NO: 363449 - DNA, 16 bp, M. musculus
agtccctgaaagctct

SEQ ID NO: 363450 - DNA, 16 bp, M. musculus
agtccctgaagaaaaa

SEQ ID NO: 363451 - DNA, 16 bp, M. musculus
agtccctgatattagt

SEQ ID NO: 363452 - DNA, 16 bp, M. musculus
agtccctggaagctct

SEQ ID NO: 363453 - DNA, 16 bp, M. musculus
agtccctggagaaagg

SEQ ID NO: 363454 - DNA, 16 bp, M. musculus
agtccctgggagcttc

SEQ ID NO: 363455 - DNA, 16 bp, M. musculus
agtccctggtgatctg

SEQ ID NO: 363456 - DNA, 16 bp, M. musculus
agtccctgtctccaaa

SEQ ID NO: 363457 - DNA, 16 bp, M. musculus
agtccctgtttcaaaa

SEQ ID NO: 363458 - DNA, 17 bp, M. musculus
agtcccttacttcaaca

SEQ ID NO: 363459 - DNA, 16 bp, M. musculus
agtcccttgtcccagg

SEQ ID NO: 363460 - DNA, 16 bp, M. musculus
agtcctagccagagga

SEQ ID NO: 363461 - DNA, 16 bp, M. musculus
agtcctaggaggaaaa

SEQ ID NO: 363462 - DNA, 16 bp, M. musculus
agtcctcagagaggag

SEQ ID NO: 363463 - DNA, 16 bp, M. musculus
agtcctcagggaggag

SEQ ID NO: 363464 - DNA, 16 bp, M. musculus
agtcctcagttgagaa

SEQ ID NO: 363465 - DNA, 16 bp, M. musculus
agtcctcctcctcctc

SEQ ID NO: 363466 - DNA, 16 bp, M. musculus
agtcctccttctctct

SEQ ID NO: 363467 - DNA, 16 bp, M. musculus
agtcctctactacata

SEQ ID NO: 363468 - DNA, 16 bp, M. musculus
agtcctctactgtatg

SEQ ID NO: 363469 - DNA, 16 bp, M. musculus
agtcctctgaaagagc

SEQ ID NO: 363470 - DNA, 16 bp, M. musculus
agtcctctgcctgctg

SEQ ID NO: 363471 - DNA, 17 bp, M. musculus
agtcctctggaagaaca

SEQ ID NO: 363472 - DNA, 16 bp, M. musculus
agtcctgagattaaag

SEQ ID NO: 363473 - DNA, 16 bp, M. musculus
agtcctgctgcagcag

SEQ ID NO: 363474 - DNA, 16 bp, M. musculus
agtcctgctgggacta

SEQ ID NO: 363475 - DNA, 16 bp, M. musculus
agtcctggaaacttct

SEQ ID NO: 363476 - DNA, 16 bp, M. musculus
agtcctggaactcact

SEQ ID NO: 363477 - DNA, 16 bp, M. musculus
agtcctggaacttact

SEQ ID NO: 363478 - DNA, 16 bp, M. musculus
agtcctggatactcca

SEQ ID NO: 363479 - DNA, 16 bp, M. musculus
agtcctggccatcctg

SEQ ID NO: 363480 - DNA, 16 bp, M. musculus
agtcctggctgtcctg

SEQ ID NO: 363481 - DNA, 16 bp, M. musculus
agtcctggctgtgctg

SEQ ID NO: 363482 - DNA, 16 bp, M. musculus
agtcctgggattacag

SEQ ID NO: 363483 - DNA, 16 bp, M. musculus
agtcctgggattccag

SEQ ID NO: 363484 - DNA, 16 bp, M. musculus
agtccttagtgatcag

SEQ ID NO: 363485 - DNA, 16 bp, M. musculus
agtccttccttctgtc

SEQ ID NO: 363486 - DNA, 16 bp, M. musculus
agtccttctcagattt

SEQ ID NO: 363487 - DNA, 16 bp, M. musculus
agtccttggaggagcc

SEQ ID NO: 363488 - DNA, 16 bp, M. musculus
agtcctttgaagtcat

SEQ ID NO: 363489 - DNA, 16 bp, M. musculus
agtcctttggaagaac

SEQ ID NO: 363490 - DNA, 16 bp, M. musculus
agtcctttggaagagc

SEQ ID NO: 363491 - DNA, 16 bp, M. musculus
agtccttttcagaaag

SEQ ID NO: 363492 - DNA, 18 bp, M. musculus
agtcgagcgcgcgcaaga

SEQ ID NO: 363493 - DNA, 16 bp, M. musculus
agtcggaggccagcct

SEQ ID NO: 363494 - DNA, 16 bp, M. musculus
agtcggccatcagtgg

SEQ ID NO: 363495 - DNA, 16 bp, M. musculus
agtcgggacaggaact

SEQ ID NO: 363496 - DNA, 16 bp, M. musculus
agtcgggcgtggtggc

SEQ ID NO: 363497 - DNA, 16 bp, M. musculus
agtctaaggaggaatg

SEQ ID NO: 363498 - DNA, 16 bp, M. musculus
agtctacagagcaaat

SEQ ID NO: 363499 - DNA, 16 bp, M. musculus
agtctacagagcaagt

SEQ ID NO: 363500 - DNA, 17 bp, M. musculus
agtctagctggattgca

SEQ ID NO: 363501 - DNA, 17 bp, M. musculus
agtctatagagtgagtt

SEQ ID NO: 363502 - DNA, 16 bp, M. musculus
agtctatgggagccat

SEQ ID NO: 363503 - DNA, 16 bp, M. musculus
agtctattttgtgttg

SEQ ID NO: 363504 - DNA, 16 bp, M. musculus
agtctcaagaaaaaaa

SEQ ID NO: 363505 - DNA, 16 bp, M. musculus
agtctcagaagagata

SEQ ID NO: 363506 - DNA, 16 bp, M. musculus
agtctcagaattgact

SEQ ID NO: 363507 - DNA, 16 bp, M. musculus
agtctcagaggctgaa

SEQ ID NO: 363508 - DNA, 16 bp, M. musculus
agtctcagcaaccaca

SEQ ID NO: 363509 - DNA, 16 bp, M. musculus
agtctcagcacttgga

SEQ ID NO: 363510 - DNA, 16 bp, M. musculus
agtctcaggttccaca

SEQ ID NO: 363511 - DNA, 16 bp, M. musculus
agtctcaggttccacg

SEQ ID NO: 363512 - DNA, 16 bp, M. musculus
agtctcagtgagcccc

SEQ ID NO: 363513 - DNA, 105 bp, M. musculus
agtctcatatcgcttagctattgcaaaaggaacacacagtgattaggtgacaagtatatgtctaaaacctagtaataagcaaataatccatagtatatctgagct

SEQ ID NO: 363514 - DNA, 16 bp, M. musculus
agtctccatgagatga

SEQ ID NO: 363515 - DNA, 16 bp, M. musculus
agtctcccaagtctgc

SEQ ID NO: 363516 - DNA, 16 bp, M. musculus
agtctcctgctgctgc

SEQ ID NO: 363517 - DNA, 16 bp, M. musculus
agtctcctggaactgt

SEQ ID NO: 363518 - DNA, 16 bp, M. musculus
agtctcctgtccccaa

SEQ ID NO: 363519 - DNA, 16 bp, M. musculus
agtctcctgtctctgc

SEQ ID NO: 363520 - DNA, 16 bp, M. musculus
agtctctcacctcctg

SEQ ID NO: 363521 - DNA, 16 bp, M. musculus
agtctctcaggagaca

SEQ ID NO: 363522 - DNA, 16 bp, M. musculus
agtctctctacatagc

SEQ ID NO: 363523 - DNA, 16 bp, M. musculus
agtctctgaaactgta

SEQ ID NO: 363524 - DNA, 16 bp, M. musculus
agtctctgaagaaaca

SEQ ID NO: 363525 - DNA, 16 bp, M. musculus
agtctctgaagaagaa

SEQ ID NO: 363526 - DNA, 16 bp, M. musculus
agtctctgaaggaaga

SEQ ID NO: 363527 - DNA, 16 bp, M. musculus
agtctctgaatagtcc

SEQ ID NO: 363528 - DNA, 16 bp, M. musculus
agtctctgagggatcc

SEQ ID NO: 363529 - DNA, 16 bp, M. musculus
agtctctgcagaccct

SEQ ID NO: 363530 - DNA, 16 bp, M. musculus
agtctctgcattaacc

SEQ ID NO: 363531 - DNA, 16 bp, M. musculus
agtctctgctgagaag

SEQ ID NO: 363532 - DNA, 16 bp, M. musculus
agtctctggaagagca

SEQ ID NO: 363533 - DNA, 16 bp, M. musculus
agtctctggatggctt

SEQ ID NO: 363534 - DNA, 16 bp, M. musculus
agtctctgggtggcct

SEQ ID NO: 363535 - DNA, 16 bp, M. musculus
agtctctgtctcattt

SEQ ID NO: 363536 - DNA, 16 bp, M. musculus
agtctctgtgagccca

SEQ ID NO: 363537 - DNA, 16 bp, M. musculus
agtctctgtgagttca

SEQ ID NO: 363538 - DNA, 16 bp, M. musculus
agtctcttagtctatg

SEQ ID NO: 363539 - DNA, 16 bp, M. musculus
agtctcttcccttctg

SEQ ID NO: 363540 - DNA, 16 bp, M. musculus
agtctcttctccaatt

SEQ ID NO: 363541 - DNA, 16 bp, M. musculus
agtctcttctgagagt

SEQ ID NO: 363542 - DNA, 16 bp, M. musculus
agtctcttgagggtta

SEQ ID NO: 363543 - DNA, 16 bp, M. musculus
agtctgaaatgaaaga

SEQ ID NO: 363544 - DNA, 16 bp, M. musculus
agtctgagaaatggaa

SEQ ID NO: 363545 - DNA, 16 bp, M. musculus
agtctgaggccagact

SEQ ID NO: 363546 - DNA, 16 bp, M. musculus
agtctgaggccaggct

SEQ ID NO: 363547 - DNA, 16 bp, M. musculus
agtctgatggttggct

SEQ ID NO: 363548 - DNA, 16 bp, M. musculus
agtctgcagcacatct

SEQ ID NO: 363549 - DNA, 16 bp, M. musculus
agtctgccaatcacca

SEQ ID NO: 363550 - DNA, 16 bp, M. musculus
agtctgcgcattgcct

SEQ ID NO: 363551 - DNA, 16 bp, M. musculus
agtctggaactcacta

SEQ ID NO: 363552 - DNA, 16 bp, M. musculus
agtctggcctagaact

SEQ ID NO: 363553 - DNA, 16 bp, M. musculus
agtctggcctggaact

SEQ ID NO: 363554 - DNA, 16 bp, M. musculus
agtctggccttgaact

SEQ ID NO: 363555 - DNA, 16 bp, M. musculus
agtctggcggatcctc

SEQ ID NO: 363556 - DNA, 17 bp, M. musculus
agtctggctaagggttt

SEQ ID NO: 363557 - DNA, 16 bp, M. musculus
agtctggctgttcctc

SEQ ID NO: 363558 - DNA, 16 bp, M. musculus
agtctggtctacatgg

SEQ ID NO: 363559 - DNA, 16 bp, M. musculus
agtctggtctcaaact

SEQ ID NO: 363560 - DNA, 16 bp, M. musculus
agtctgtctgtctgtc

SEQ ID NO: 363561 - DNA, 16 bp, M. musculus
agtctgtgctcttaac

SEQ ID NO: 363562 - DNA, 16 bp, M. musculus
agtctgtgtcaagttg

SEQ ID NO: 363563 - DNA, 16 bp, M. musculus
agtctgttttacagga

SEQ ID NO: 363564 - DNA, 16 bp, M. musculus
agtcttaaaaataaaa

SEQ ID NO: 363565 - DNA, 16 bp, M. musculus
agtcttaagacataaa

SEQ ID NO: 363566 - DNA, 16 bp, M. musculus
agtcttacttcttgag

SEQ ID NO: 363567 - DNA, 16 bp, M. musculus
agtcttataaaaacag

SEQ ID NO: 363568 - DNA, 22 bp, M. musculus
agtcttattcggcaaaagagag

SEQ ID NO: 363569 - DNA, 16 bp, M. musculus
agtcttcctcctcctc

SEQ ID NO: 363570 - DNA, 16 bp, M. musculus
agtcttctcaatgata

SEQ ID NO: 363571 - DNA, 16 bp, M. musculus
agtcttctccagggaa

SEQ ID NO: 363572 - DNA, 16 bp, M. musculus
agtcttctcttagagg

SEQ ID NO: 363573 - DNA, 16 bp, M. musculus
agtcttctggctgcct

SEQ ID NO: 363574 - DNA, 16 bp, M. musculus
agtcttgcccaatacc

SEQ ID NO: 363575 - DNA, 16 bp, M. musculus
agtcttgctagtgtat

SEQ ID NO: 363576 - DNA, 16 bp, M. musculus
agtcttgcttttttgg

SEQ ID NO: 363577 - DNA, 16 bp, M. musculus
agtcttggctctgtct

SEQ ID NO: 363578 - DNA, 16 bp, M. musculus
agtcttgggcatccca

SEQ ID NO: 363579 - DNA, 16 bp, M. musculus
agtcttgtaaaggaca

SEQ ID NO: 363580 - DNA, 16 bp, M. musculus
agtcttgtgaaagagt

SEQ ID NO: 363581 - DNA, 16 bp, M. musculus
agtcttgtttttctgg

SEQ ID NO: 363582 - DNA, 16 bp, M. musculus
agtctttaaaaaagaa

SEQ ID NO: 363583 - DNA, 16 bp, M. musculus
agtctttaaaagattt

SEQ ID NO: 363584 - DNA, 16 bp, M. musculus
agtctttgagaatttc

SEQ ID NO: 363585 - DNA, 16 bp, M. musculus
agtctttggatgtgat

SEQ ID NO: 363586 - DNA, 16 bp, M. musculus
agtcttttggagggca

SEQ ID NO: 363587 - DNA, 16 bp, M. musculus
agtcttttgtagaagg

SEQ ID NO: 363588 - DNA, 16 bp, M. musculus
agtcttttgttttagg

SEQ ID NO: 363589 - DNA, 16 bp, M. musculus
agtctttttaaaaatt

SEQ ID NO: 363590 - DNA, 16 bp, M. musculus
agtctttttaaaataa

SEQ ID NO: 363591 - DNA, 16 bp, M. musculus
agtctttttaaagttt

SEQ ID NO: 363592 - DNA, 16 bp, M. musculus
agtgaaaaatcatgta

SEQ ID NO: 363593 - DNA, 18 bp, M. musculus
agtgaaaacttgactctc

SEQ ID NO: 363594 - DNA, 16 bp, M. musculus
agtgaaaagtctggtg

SEQ ID NO: 363595 - DNA, 16 bp, M. musculus
agtgaaaatcaaaaca

SEQ ID NO: 363596 - DNA, 16 bp, M. musculus
agtgaaaattctgtat

SEQ ID NO: 363597 - DNA, 16 bp, M. musculus
agtgaaagaagccaga

SEQ ID NO: 363598 - DNA, 16 bp, M. musculus
agtgaaagacacacac

SEQ ID NO: 363599 - DNA, 16 bp, M. musculus
agtgaaagacctgtat

SEQ ID NO: 363600 - DNA, 17 bp, M. musculus
agtgaaagactggaaaa

SEQ ID NO: 363601 - DNA, 16 bp, M. musculus
agtgaaataaaagcag

SEQ ID NO: 363602 - DNA, 16 bp, M. musculus
agtgaaataagccagc

SEQ ID NO: 363603 - DNA, 16 bp, M. musculus
agtgaaatgttccttc

SEQ ID NO: 363604 - DNA, 16 bp, M. musculus
agtgaaatgtttttct

SEQ ID NO: 363605 - DNA, 16 bp, M. musculus
agtgaaatttatagag

SEQ ID NO: 363606 - DNA, 16 bp, M. musculus
agtgaaccccagggat

SEQ ID NO: 363607 - DNA, 16 bp, M. musculus
agtgaactccaggcca

SEQ ID NO: 363608 - DNA, 16 bp, M. musculus
agtgaagaccagcaaa

SEQ ID NO: 363609 - DNA, 16 bp, M. musculus
agtgaagatcagagaa

SEQ ID NO: 363610 - DNA, 16 bp, M. musculus
agtgaagctaacagaa

SEQ ID NO: 363611 - DNA, 17 bp, M. musculus
agtgaaggagttggaaa

SEQ ID NO: 363612 - DNA, 16 bp, M. musculus
agtgaaggcaagcagg

SEQ ID NO: 363613 - DNA, 16 bp, M. musculus
agtgaaggcaggaaga

SEQ ID NO: 363614 - DNA, 16 bp, M. musculus
agtgaaggtgcagcct

SEQ ID NO: 363615 - DNA, 16 bp, M. musculus
agtgaagtaactcaga

SEQ ID NO: 363616 - DNA, 16 bp, M. musculus
agtgaagtgtggacac

SEQ ID NO: 363617 - DNA, 16 bp, M. musculus
agtgaatcctagagga

SEQ ID NO: 363618 - DNA, 16 bp, M. musculus
agtgaatctctctctc

SEQ ID NO: 363619 - DNA, 16 bp, M. musculus
agtgaatctgaggcca

SEQ ID NO: 363620 - DNA, 16 bp, M. musculus
agtgaatgactatgaa

SEQ ID NO: 363621 - DNA, 16 bp, M. musculus
agtgaatgcataccat

SEQ ID NO: 363622 - DNA, 16 bp, M. musculus
agtgaatgtttacatg

SEQ ID NO: 363623 - DNA, 16 bp, M. musculus
agtgaattccaggcta

SEQ ID NO: 363624 - DNA, 16 bp, M. musculus
agtgacaattctggaa

SEQ ID NO: 363625 - DNA, 16 bp, M. musculus
agtgacacacttcctc

SEQ ID NO: 363626 - DNA, 16 bp, M. musculus
agtgacacactttctc

SEQ ID NO: 363627 - DNA, 16 bp, M. musculus
agtgacacatcttctc

SEQ ID NO: 363628 - DNA, 16 bp, M. musculus
agtgacaccatttgga

SEQ ID NO: 363629 - DNA, 16 bp, M. musculus
agtgacactgggcctg

SEQ ID NO: 363630 - DNA, 16 bp, M. musculus
agtgacagaaaatgaa

SEQ ID NO: 363631 - DNA, 16 bp, M. musculus
agtgacagacaggaag

SEQ ID NO: 363632 - DNA, 16 bp, M. musculus
agtgacagagacaaag

SEQ ID NO: 363633 - DNA, 16 bp, M. musculus
agtgacaggtggctgt

SEQ ID NO: 363634 - DNA, 16 bp, M. musculus
agtgacatacttcatc

SEQ ID NO: 363635 - DNA, 16 bp, M. musculus
agtgacatactttctc

SEQ ID NO: 363636 - DNA, 16 bp, M. musculus
agtgacattattagaa

SEQ ID NO: 363637 - DNA, 16 bp, M. musculus
agtgacatttacattt

SEQ ID NO: 363638 - DNA, 17 bp, M. musculus
agtgacccactccttcc

SEQ ID NO: 363639 - DNA, 16 bp, M. musculus
agtgacccacttcctc

SEQ ID NO: 363640 - DNA, 16 bp, M. musculus
agtgaccctttcacag

SEQ ID NO: 363641 - DNA, 16 bp, M. musculus
agtgacctacttcttc

SEQ ID NO: 363642 - DNA, 16 bp, M. musculus
agtgacctgcttcctc

SEQ ID NO: 363643 - DNA, 16 bp, M. musculus
agtgaccttagatgaa

SEQ ID NO: 363644 - DNA, 16 bp, M. musculus
agtgaccttagccaaa

SEQ ID NO: 363645 - DNA, 16 bp, M. musculus
agtgaccttcagatga

SEQ ID NO: 363646 - DNA, 16 bp, M. musculus
agtgactcacttcctc

SEQ ID NO: 363647 - DNA, 16 bp, M. musculus
agtgactcagctgtta

SEQ ID NO: 363648 - DNA, 16 bp, M. musculus
agtgactctgtgtgtg

SEQ ID NO: 363649 - DNA, 16 bp, M. musculus
agtgactgaagaagac

SEQ ID NO: 363650 - DNA, 16 bp, M. musculus
agtgactgaaggaaag

SEQ ID NO: 363651 - DNA, 16 bp, M. musculus
agtgactgaggaagac

SEQ ID NO: 363652 - DNA, 16 bp, M. musculus
agtgactgtcccacct

SEQ ID NO: 363653 - DNA, 16 bp, M. musculus
agtgacttcaaaggga

SEQ ID NO: 363654 - DNA, 16 bp, M. musculus
agtgacttccaggata

SEQ ID NO: 363655 - DNA, 16 bp, M. musculus
agtgacttccaggcca

SEQ ID NO: 363656 - DNA, 16 bp, M. musculus
agtgacttctttgtga

SEQ ID NO: 363657 - DNA, 16 bp, M. musculus
agtgactttttaaaaa

SEQ ID NO: 363658 - DNA, 16 bp, M. musculus
agtgagaacctgtttc

SEQ ID NO: 363659 - DNA, 16 bp, M. musculus
agtgagaagaaagcaa

SEQ ID NO: 363660 - DNA, 16 bp, M. musculus
agtgagaatggaaatt

SEQ ID NO: 363661 - DNA, 16 bp, M. musculus
agtgagacacacacac

SEQ ID NO: 363662 - DNA, 16 bp, M. musculus
agtgagaccctgcttc

SEQ ID NO: 363663 - DNA, 16 bp, M. musculus
agtgagaccctgtcct

SEQ ID NO: 363664 - DNA, 16 bp, M. musculus
agtgagaccttgcctc

SEQ ID NO: 363665 - DNA, 16 bp, M. musculus
agtgagaccttgtttc

SEQ ID NO: 363666 - DNA, 16 bp, M. musculus
agtgagactctgtttc

SEQ ID NO: 363667 - DNA, 16 bp, M. musculus
agtgagaggctcccag

SEQ ID NO: 363668 - DNA, 16 bp, M. musculus
agtgagagttttggtt

SEQ ID NO: 363669 - DNA, 16 bp, M. musculus
agtgagataactcaat

SEQ ID NO: 363670 - DNA, 17 bp, M. musculus
agtgagatcctgtctca

SEQ ID NO: 363671 - DNA, 16 bp, M. musculus
agtgagatggctcagt

SEQ ID NO: 363672 - DNA, 16 bp, M. musculus
agtgagatttttgtct

SEQ ID NO: 363673 - DNA, 16 bp, M. musculus
agtgagcacataccat

SEQ ID NO: 363674 - DNA, 16 bp, M. musculus
agtgagcagactgcag

SEQ ID NO: 363675 - DNA, 19 bp, M. musculus
agtgagcatccacttctgt

SEQ ID NO: 363676 - DNA, 16 bp, M. musculus
agtgagccaaggagaa

SEQ ID NO: 363677 - DNA, 16 bp, M. musculus
agtgagccagtaagca

SEQ ID NO: 363678 - DNA, 16 bp, M. musculus
agtgagccatctcttc

SEQ ID NO: 363679 - DNA, 16 bp, M. musculus
agtgagccccaggggt

SEQ ID NO: 363680 - DNA, 16 bp, M. musculus
agtgagcgagcgagcg

SEQ ID NO: 363681 - DNA, 21 bp, M. musculus
agtgagctccaggacagccag

SEQ ID NO: 363682 - DNA, 16 bp, M. musculus
agtgagctccaggcca

SEQ ID NO: 363683 - DNA, 16 bp, M. musculus
agtgagctcctgggat

SEQ ID NO: 363684 - DNA, 16 bp, M. musculus
agtgagctctgggttc

SEQ ID NO: 363685 - DNA, 16 bp, M. musculus
agtgagctgggccctc

SEQ ID NO: 363686 - DNA, 16 bp, M. musculus
agtgagctgggccttc

SEQ ID NO: 363687 - DNA, 16 bp, M. musculus
agtgaggaaagcataa

SEQ ID NO: 363688 - DNA, 16 bp, M. musculus
agtgaggcagaggcag

SEQ ID NO: 363689 - DNA, 16 bp, M. musculus
agtgaggccagacaag

SEQ ID NO: 363690 - DNA, 16 bp, M. musculus
agtgaggccctgtctc

SEQ ID NO: 363691 - DNA, 16 bp, M. musculus
agtgagggtttcccca

SEQ ID NO: 363692 - DNA, 16 bp, M. musculus
agtgaggtagcccaga

SEQ ID NO: 363693 - DNA, 16 bp, M. musculus
agtgagtcccaggaat

SEQ ID NO: 363694 - DNA, 16 bp, M. musculus
agtgagtgaatgaatg

SEQ ID NO: 363695 - DNA, 16 bp, M. musculus
agtgagtgagtgagag

SEQ ID NO: 363696 - DNA, 16 bp, M. musculus
agtgagtgagtgagtg

SEQ ID NO: 363697 - DNA, 21 bp, M. musculus
agtgagtgagtgagtgagtga

SEQ ID NO: 363698 - DNA, 16 bp, M. musculus
agtgagtgcatattgt

SEQ ID NO: 363699 - DNA, 20 bp, M. musculus
agtgagtgccaggacagcca

SEQ ID NO: 363700 - DNA, 16 bp, M. musculus
agtgagtggggctgga

SEQ ID NO: 363701 - DNA, 16 bp, M. musculus
agtgagtgtgaggcca

SEQ ID NO: 363702 - DNA, 16 bp, M. musculus
agtgagtgtgtgtgtg

SEQ ID NO: 363703 - DNA, 16 bp, M. musculus
agtgagttagaggcca

SEQ ID NO: 363704 - DNA, 16 bp, M. musculus
agtgagttcaaggcca

SEQ ID NO: 363705 - DNA, 16 bp, M. musculus
agtgagttccagcaca

SEQ ID NO: 363706 - DNA, 16 bp, M. musculus
agtgagttccagcata

SEQ ID NO: 363707 - DNA, 16 bp, M. musculus
agtgagttccagccag

SEQ ID NO: 363708 - DNA, 17 bp, M. musculus
agtgagttccaggacac

SEQ ID NO: 363709 - DNA, 19 bp, M. musculus
agtgagttccaggacagca

SEQ ID NO: 363710 - DNA, 20 bp, M. musculus
agtgagttccaggacagcca

SEQ ID NO: 363711 - DNA, 16 bp, M. musculus
agtgagttccaggacg

SEQ ID NO: 363712 - DNA, 16 bp, M. musculus
agtgagttccagggct

SEQ ID NO: 363713 - DNA, 16 bp, M. musculus
agtgagttcctggaca

SEQ ID NO: 363714 - DNA, 16 bp, M. musculus
agtgagttctaagata

SEQ ID NO: 363715 - DNA, 16 bp, M. musculus
agtgagtttcaagaca

SEQ ID NO: 363716 - DNA, 16 bp, M. musculus
agtgagtttcaggaga

SEQ ID NO: 363717 - DNA, 16 bp, M. musculus
agtgagtttcaggata

SEQ ID NO: 363718 - DNA, 16 bp, M. musculus
agtgagtttcctggag

SEQ ID NO: 363719 - DNA, 16 bp, M. musculus
agtgagtttgaagcca

SEQ ID NO: 363720 - DNA, 16 bp, M. musculus
agtgagtttgagacca

SEQ ID NO: 363721 - DNA, 16 bp, M. musculus
agtgagtttgaggaca

SEQ ID NO: 363722 - DNA, 16 bp, M. musculus
agtgagtttgaggcca

SEQ ID NO: 363723 - DNA, 16 bp, M. musculus
agtgagttttaggaca

SEQ ID NO: 363724 - DNA, 16 bp, M. musculus
agtgataaaaactgta

SEQ ID NO: 363725 - DNA, 16 bp, M. musculus
agtgataaaaactgtg

SEQ ID NO: 363726 - DNA, 16 bp, M. musculus
agtgataatgtaatag

SEQ ID NO: 363727 - DNA, 16 bp, M. musculus
agtgataccctgtctc

SEQ ID NO: 363728 - DNA, 16 bp, M. musculus
agtgatattttgtctt

SEQ ID NO: 363729 - DNA, 16 bp, M. musculus
agtgatatttttactt

SEQ ID NO: 363730 - DNA, 16 bp, M. musculus
agtgatcaagggggga

SEQ ID NO: 363731 - DNA, 16 bp, M. musculus
agtgatcaagggtggg

SEQ ID NO: 363732 - DNA, 16 bp, M. musculus
agtgatcctcctgtct

SEQ ID NO: 363733 - DNA, 16 bp, M. musculus
agtgatgatgatgata

SEQ ID NO: 363734 - DNA, 16 bp, M. musculus
agtgatgctgatgctg

SEQ ID NO: 363735 - DNA, 16 bp, M. musculus
agtgatggaattatag

SEQ ID NO: 363736 - DNA, 16 bp, M. musculus
agtgatggagagagag

SEQ ID NO: 363737 - DNA, 16 bp, M. musculus
agtgatggaggaagac

SEQ ID NO: 363738 - DNA, 16 bp, M. musculus
agtgatggccagctag

SEQ ID NO: 363739 - DNA, 16 bp, M. musculus
agtgatggccgacgag

SEQ ID NO: 363740 - DNA, 16 bp, M. musculus
agtgatggctcagtga

SEQ ID NO: 363741 - DNA, 16 bp, M. musculus
agtgatggtgatggtg

SEQ ID NO: 363742 - DNA, 16 bp, M. musculus
agtgatggttttgatg

SEQ ID NO: 363743 - DNA, 16 bp, M. musculus
agtgattaagagccct

SEQ ID NO: 363744 - DNA, 16 bp, M. musculus
agtgattgaaagtttt

SEQ ID NO: 363745 - DNA, 16 bp, M. musculus
agtgattgtcttcatt

SEQ ID NO: 363746 - DNA, 16 bp, M. musculus
agtgattgttgctttc

SEQ ID NO: 363747 - DNA, 16 bp, M. musculus
agtgatttccccagaa

SEQ ID NO: 363748 - DNA, 16 bp, M. musculus
agtgatttctaggaca

SEQ ID NO: 363749 - DNA, 16 bp, M. musculus
agtgattttttaaaaa

SEQ ID NO: 363750 - DNA, 16 bp, M. musculus
agtgatttttttaaaa

SEQ ID NO: 363751 - DNA, 16 bp, M. musculus
agtgattttttttcct

SEQ ID NO: 363752 - DNA, 16 bp, M. musculus
agtgcaaaccatgtgt

SEQ ID NO: 363753 - DNA, 16 bp, M. musculus
agtgcaaggtcagcct

SEQ ID NO: 363754 - DNA, 16 bp, M. musculus
agtgcacacacacaca

SEQ ID NO: 363755 - DNA, 16 bp, M. musculus
agtgcacctctgccct

SEQ ID NO: 363756 - DNA, 16 bp, M. musculus
agtgcactgtagctgt

SEQ ID NO: 363757 - DNA, 16 bp, M. musculus
agtgcagaagatagag

SEQ ID NO: 363758 - DNA, 16 bp, M. musculus
agtgcagaagattcca

SEQ ID NO: 363759 - DNA, 16 bp, M. musculus
agtgcagaagcagact

SEQ ID NO: 363760 - DNA, 17 bp, M. musculus
agtgcagaattctaaca

SEQ ID NO: 363761 - DNA, 16 bp, M. musculus
agtgcagagctggaga

SEQ ID NO: 363762 - DNA, 16 bp, M. musculus
agtgcagaggaggaga

SEQ ID NO: 363763 - DNA, 16 bp, M. musculus
agtgcagaggaggtct

SEQ ID NO: 363764 - DNA, 16 bp, M. musculus
agtgcagaggtcagag

SEQ ID NO: 363765 - DNA, 17 bp, M. musculus
agtgcagcaggaggcct

SEQ ID NO: 363766 - DNA, 16 bp, M. musculus
agtgcagctgcctctg

SEQ ID NO: 363767 - DNA, 16 bp, M. musculus
agtgcagctggagaca

SEQ ID NO: 363768 - DNA, 16 bp, M. musculus
agtgcaggaggagctg

SEQ ID NO: 363769 - DNA, 16 bp, M. musculus
agtgcaggcagggaga

SEQ ID NO: 363770 - DNA, 16 bp, M. musculus
agtgcagggatcaaag

SEQ ID NO: 363771 - DNA, 16 bp, M. musculus
agtgcagggattaaag

SEQ ID NO: 363772 - DNA, 16 bp, M. musculus
agtgcaggtacctgca

SEQ ID NO: 363773 - DNA, 16 bp, M. musculus
agtgcatgagtgtgtg

SEQ ID NO: 363774 - DNA, 18 bp, M. musculus
agtgcatttgttgttctg

SEQ ID NO: 363775 - DNA, 16 bp, M. musculus
agtgccacccctgagc

SEQ ID NO: 363776 - DNA, 16 bp, M. musculus
agtgccactcagcaac

SEQ ID NO: 363777 - DNA, 16 bp, M. musculus
agtgccagactgattt

SEQ ID NO: 363778 - DNA, 16 bp, M. musculus
agtgccagcctcatcc

SEQ ID NO: 363779 - DNA, 16 bp, M. musculus
agtgccaggattaaag

SEQ ID NO: 363780 - DNA, 16 bp, M. musculus
agtgccaggattacag

SEQ ID NO: 363781 - DNA, 16 bp, M. musculus
agtgccagggccagga

SEQ ID NO: 363782 - DNA, 16 bp, M. musculus
agtgccattttttttt

SEQ ID NO: 363783 - DNA, 16 bp, M. musculus
agtgcccaaggaggcc

SEQ ID NO: 363784 - DNA, 16 bp, M. musculus
agtgccctgaccactg

SEQ ID NO: 363785 - DNA, 16 bp, M. musculus
agtgcccttttctggc

SEQ ID NO: 363786 - DNA, 16 bp, M. musculus
agtgcctactatgtgc

SEQ ID NO: 363787 - DNA, 16 bp, M. musculus
agtgcctactgtgtgc

SEQ ID NO: 363788 - DNA, 18 bp, M. musculus
agtgcctccaaaaagaaa

SEQ ID NO: 363789 - DNA, 16 bp, M. musculus
agtgcctcccctccca

SEQ ID NO: 363790 - DNA, 16 bp, M. musculus
agtgcctctcaggaga

SEQ ID NO: 363791 - DNA, 16 bp, M. musculus
agtgcctgagaaagtt

SEQ ID NO: 363792 - DNA, 16 bp, M. musculus
agtgcctgaggaggcc

SEQ ID NO: 363793 - DNA, 16 bp, M. musculus
agtgcctgcctctccc

SEQ ID NO: 363794 - DNA, 16 bp, M. musculus
agtgcctggcacatag

SEQ ID NO: 363795 - DNA, 17 bp, M. musculus
agtgccttccaggccct

SEQ ID NO: 363796 - DNA, 16 bp, M. musculus
agtgccttccagtacc

SEQ ID NO: 363797 - DNA, 16 bp, M. musculus
agtgccttctgcttct

SEQ ID NO: 363798 - DNA, 16 bp, M. musculus
agtgccttgctcagcc

SEQ ID NO: 363799 - DNA, 16 bp, M. musculus
agtgcctttataaaga

SEQ ID NO: 363800 - DNA, 16 bp, M. musculus
agtgcctttggaggcc

SEQ ID NO: 363801 - DNA, 16 bp, M. musculus
agtgcgtgcatgtgtg

SEQ ID NO: 363802 - DNA, 16 bp, M. musculus
agtgctaagactaaag

SEQ ID NO: 363803 - DNA, 16 bp, M. musculus
agtgctaagattaaag

SEQ ID NO: 363804 - DNA, 16 bp, M. musculus
agtgctaagattatag

SEQ ID NO: 363805 - DNA, 16 bp, M. musculus
agtgctaaggttacag

SEQ ID NO: 363806 - DNA, 16 bp, M. musculus
agtgctagaattaaag

SEQ ID NO: 363807 - DNA, 16 bp, M. musculus
agtgctaggatgacag

SEQ ID NO: 363808 - DNA, 16 bp, M. musculus
agtgctaggattaaag

SEQ ID NO: 363809 - DNA, 16 bp, M. musculus
agtgctaggattacag

SEQ ID NO: 363810 - DNA, 16 bp, M. musculus
agtgctaggattatag

SEQ ID NO: 363811 - DNA, 16 bp, M. musculus
agtgctaggattgaag

SEQ ID NO: 363812 - DNA, 16 bp, M. musculus
agtgctatgaatttcc

SEQ ID NO: 363813 - DNA, 16 bp, M. musculus
agtgctcagagaggtg

SEQ ID NO: 363814 - DNA, 16 bp, M. musculus
agtgctcaggagacag

SEQ ID NO: 363815 - DNA, 16 bp, M. musculus
agtgctcaggaggcag

SEQ ID NO: 363816 - DNA, 16 bp, M. musculus
agtgctccaccactga

SEQ ID NO: 363817 - DNA, 16 bp, M. musculus
agtgctcctgaccact

SEQ ID NO: 363818 - DNA, 16 bp, M. musculus
agtgctctcagctgct

SEQ ID NO: 363819 - DNA, 16 bp, M. musculus
agtgctctctctctct

SEQ ID NO: 363820 - DNA, 16 bp, M. musculus
agtgctctgaaccact

SEQ ID NO: 363821 - DNA, 16 bp, M. musculus
agtgctctgaccccag

SEQ ID NO: 363822 - DNA, 16 bp, M. musculus
agtgctctgagctgct

SEQ ID NO: 363823 - DNA, 16 bp, M. musculus
agtgctctgcctgcat

SEQ ID NO: 363824 - DNA, 16 bp, M. musculus
agtgctcttaacagat

SEQ ID NO: 363825 - DNA, 16 bp, M. musculus
agtgctcttaaccacc

SEQ ID NO: 363826 - DNA, 16 bp, M. musculus
agtgctcttaacccca

SEQ ID NO: 363827 - DNA, 16 bp, M. musculus
agtgctcttccaaagg

SEQ ID NO: 363828 - DNA, 16 bp, M. musculus
agtgctcttccagaag

SEQ ID NO: 363829 - DNA, 16 bp, M. musculus
agtgctgaaaattaaa

SEQ ID NO: 363830 - DNA, 16 bp, M. musculus
agtgctgaaattaaag

SEQ ID NO: 363831 - DNA, 16 bp, M. musculus
agtgctgaaattatag

SEQ ID NO: 363832 - DNA, 16 bp, M. musculus
agtgctgacacaggtt

SEQ ID NO: 363833 - DNA, 16 bp, M. musculus
agtgctgacagcatgg

SEQ ID NO: 363834 - DNA, 16 bp, M. musculus
agtgctgagaattaaa

SEQ ID NO: 363835 - DNA, 16 bp, M. musculus
agtgctgagactaaag

SEQ ID NO: 363836 - DNA, 16 bp, M. musculus
agtgctgagactacag

SEQ ID NO: 363837 - DNA, 16 bp, M. musculus
agtgctgagatgacag

SEQ ID NO: 363838 - DNA, 16 bp, M. musculus
agtgctgagattaaag

SEQ ID NO: 363839 - DNA, 16 bp, M. musculus
agtgctgagattacaa

SEQ ID NO: 363840 - DNA, 16 bp, M. musculus
agtgctgagattacag

SEQ ID NO: 363841 - DNA, 16 bp, M. musculus
agtgctgagattagag

SEQ ID NO: 363842 - DNA, 16 bp, M. musculus
agtgctgagattataa

SEQ ID NO: 363843 - DNA, 16 bp, M. musculus
agtgctgagattatag

SEQ ID NO: 363844 - DNA, 16 bp, M. musculus
agtgctgagattgaag

SEQ ID NO: 363845 - DNA, 17 bp, M. musculus
agtgctgagcctcagct

SEQ ID NO: 363846 - DNA, 16 bp, M. musculus
agtgctgaggacaaag

SEQ ID NO: 363847 - DNA, 16 bp, M. musculus
agtgctgaggttaaag

SEQ ID NO: 363848 - DNA, 16 bp, M. musculus
agtgctgcaattaaag

SEQ ID NO: 363849 - DNA, 16 bp, M. musculus
agtgctgcccacagtg

SEQ ID NO: 363850 - DNA, 16 bp, M. musculus
agtgctgcctactggc

SEQ ID NO: 363851 - DNA, 16 bp, M. musculus
agtgctggaaaccaaa

SEQ ID NO: 363852 - DNA, 16 bp, M. musculus
agtgctggaaataaag

SEQ ID NO: 363853 - DNA, 16 bp, M. musculus
agtgctggaaattgaa

SEQ ID NO: 363854 - DNA, 16 bp, M. musculus
agtgctggaactaaag

SEQ ID NO: 363855 - DNA, 16 bp, M. musculus
agtgctggaactgaag

SEQ ID NO: 363856 - DNA, 16 bp, M. musculus
agtgctggaagtaaag

SEQ ID NO: 363857 - DNA, 16 bp, M. musculus
agtgctggaattaaaa

SEQ ID NO: 363858 - DNA, 16 bp, M. musculus
agtgctggaattaaag

SEQ ID NO: 363859 - DNA, 16 bp, M. musculus
agtgctggaattaaat

SEQ ID NO: 363860 - DNA, 16 bp, M. musculus
agtgctggaattacag

SEQ ID NO: 363861 - DNA, 16 bp, M. musculus
agtgctggagaagcag

SEQ ID NO: 363862 - DNA, 16 bp, M. musculus
agtgctggagaggcag

SEQ ID NO: 363863 - DNA, 16 bp, M. musculus
agtgctggagatggaa

SEQ ID NO: 363864 - DNA, 16 bp, M. musculus
agtgctggaggagcca

SEQ ID NO: 363865 - DNA, 16 bp, M. musculus
agtgctggattaaagg

SEQ ID NO: 363866 - DNA, 16 bp, M. musculus
agtgctggatttaaag

SEQ ID NO: 363867 - DNA, 16 bp, M. musculus
agtgctggcatcaaag

SEQ ID NO: 363868 - DNA, 16 bp, M. musculus
agtgctggcattaaaa

SEQ ID NO: 363869 - DNA, 16 bp, M. musculus
agtgctggcattaaag

SEQ ID NO: 363870 - DNA, 16 bp, M. musculus
agtgctggcattgaag

SEQ ID NO: 363871 - DNA, 16 bp, M. musculus
agtgctggctgctctt

SEQ ID NO: 363872 - DNA, 16 bp, M. musculus
agtgctggctgtcctg

SEQ ID NO: 363873 - DNA, 16 bp, M. musculus
agtgctgggaacacag

SEQ ID NO: 363874 - DNA, 16 bp, M. musculus
agtgctgggactaaaa

SEQ ID NO: 363875 - DNA, 16 bp, M. musculus
agtgctgggactaaag

SEQ ID NO: 363876 - DNA, 16 bp, M. musculus
agtgctgggactccag

SEQ ID NO: 363877 - DNA, 16 bp, M. musculus
agtgctgggactgcaa

SEQ ID NO: 363878 - DNA, 16 bp, M. musculus
agtgctgggactgcag

SEQ ID NO: 363879 - DNA, 16 bp, M. musculus
agtgctgggagtaaag

SEQ ID NO: 363880 - DNA, 16 bp, M. musculus
agtgctgggatcaaag

SEQ ID NO: 363881 - DNA, 16 bp, M. musculus
agtgctgggatcacag

SEQ ID NO: 363882 - DNA, 16 bp, M. musculus
agtgctgggatcgaag

SEQ ID NO: 363883 - DNA, 16 bp, M. musculus
agtgctgggatgaaag

SEQ ID NO: 363884 - DNA, 16 bp, M. musculus
agtgctgggattaaaa

SEQ ID NO: 363885 - DNA, 16 bp, M. musculus
agtgctgggattaaac

SEQ ID NO: 363886 - DNA, 16 bp, M. musculus
agtgctgggattaaag

SEQ ID NO: 363887 - DNA, 16 bp, M. musculus
agtgctgggattaaat

SEQ ID NO: 363888 - DNA, 16 bp, M. musculus
agtgctgggattaatg

SEQ ID NO: 363889 - DNA, 16 bp, M. musculus
agtgctgggattacaa

SEQ ID NO: 363890 - DNA, 16 bp, M. musculus
agtgctgggattacag

SEQ ID NO: 363891 - DNA, 16 bp, M. musculus
agtgctgggattatag

SEQ ID NO: 363892 - DNA, 16 bp, M. musculus
agtgctgggattgaag

SEQ ID NO: 363893 - DNA, 16 bp, M. musculus
agtgctgggattgcag

SEQ ID NO: 363894 - DNA, 16 bp, M. musculus
agtgctgggattgtag

SEQ ID NO: 363895 - DNA, 16 bp, M. musculus
agtgctgggatttaag

SEQ ID NO: 363896 - DNA, 16 bp, M. musculus
agtgctgggatttgaa

SEQ ID NO: 363897 - DNA, 16 bp, M. musculus
agtgctggggaagcag

SEQ ID NO: 363898 - DNA, 16 bp, M. musculus
agtgctggggacacag

SEQ ID NO: 363899 - DNA, 16 bp, M. musculus
agtgctggggacagaa

SEQ ID NO: 363900 - DNA, 16 bp, M. musculus
agtgctggggagacag

SEQ ID NO: 363901 - DNA, 16 bp, M. musculus
agtgctggggttaaaa

SEQ ID NO: 363902 - DNA, 16 bp, M. musculus
agtgctggggttaaag

SEQ ID NO: 363903 - DNA, 16 bp, M. musculus
agtgctggggttaagg

SEQ ID NO: 363904 - DNA, 16 bp, M. musculus
agtgctggggttacag

SEQ ID NO: 363905 - DNA, 16 bp, M. musculus
agtgctgggttacaag

SEQ ID NO: 363906 - DNA, 16 bp, M. musculus
agtgctggtattaaag

SEQ ID NO: 363907 - DNA, 16 bp, M. musculus
agtgctggtgttacag

SEQ ID NO: 363908 - DNA, 16 bp, M. musculus
agtgctgtgatcacag

SEQ ID NO: 363909 - DNA, 16 bp, M. musculus
agtgctgtgattaaag

SEQ ID NO: 363910 - DNA, 16 bp, M. musculus
agtgctgtgtgacagt

SEQ ID NO: 363911 - DNA, 16 bp, M. musculus
agtgctgttaactgct

SEQ ID NO: 363912 - DNA, 16 bp, M. musculus
agtgctgttgagtttg

SEQ ID NO: 363913 - DNA, 16 bp, M. musculus
agtgctgtttgtattt

SEQ ID NO: 363914 - DNA, 16 bp, M. musculus
agtgcttaccacacaa

SEQ ID NO: 363915 - DNA, 16 bp, M. musculus
agtgcttcctcttcct

SEQ ID NO: 363916 - DNA, 16 bp, M. musculus
agtgcttctcagccat

SEQ ID NO: 363917 - DNA, 16 bp, M. musculus
agtgcttgccaggcaa

SEQ ID NO: 363918 - DNA, 16 bp, M. musculus
agtgcttgcccagcat

SEQ ID NO: 363919 - DNA, 16 bp, M. musculus
agtgcttgcctgacat

SEQ ID NO: 363920 - DNA, 16 bp, M. musculus
agtgcttgcctgcatg

SEQ ID NO: 363921 - DNA, 16 bp, M. musculus
agtgcttgcctggcat

SEQ ID NO: 363922 - DNA, 16 bp, M. musculus
agtgcttgccttgcat

SEQ ID NO: 363923 - DNA, 16 bp, M. musculus
agtgcttgctctgcaa

SEQ ID NO: 363924 - DNA, 16 bp, M. musculus
agtgcttgctttgcaa

SEQ ID NO: 363925 - DNA, 16 bp, M. musculus
agtgcttggtccccag

SEQ ID NO: 363926 - DNA, 17 bp, M. musculus
agtgcttgtacaagctt

SEQ ID NO: 363927 - DNA, 16 bp, M. musculus
agtgcttgtggaggcc

SEQ ID NO: 363928 - DNA, 16 bp, M. musculus
agtgctttgattaaag

SEQ ID NO: 363929 - DNA, 16 bp, M. musculus
agtggaaaaaacacag

SEQ ID NO: 363930 - DNA, 16 bp, M. musculus
agtggaaaactaccct

SEQ ID NO: 363931 - DNA, 16 bp, M. musculus
agtggaaaactgactt

SEQ ID NO: 363932 - DNA, 16 bp, M. musculus
agtggaaaagacagca

SEQ ID NO: 363933 - DNA, 16 bp, M. musculus
agtggaaaattccaga

SEQ ID NO: 363934 - DNA, 16 bp, M. musculus
agtggaaacaagaaaa

SEQ ID NO: 363935 - DNA, 17 bp, M. musculus
agtggaaacagaaacta

SEQ ID NO: 363936 - DNA, 16 bp, M. musculus
agtggaaacaggaaga

SEQ ID NO: 363937 - DNA, 16 bp, M. musculus
agtggaaactgaacaa

SEQ ID NO: 363938 - DNA, 16 bp, M. musculus
agtggaaagcatctgg

SEQ ID NO: 363939 - DNA, 16 bp, M. musculus
agtggaaatatttgta

SEQ ID NO: 363940 - DNA, 16 bp, M. musculus
agtggaacacagcacc

SEQ ID NO: 363941 - DNA, 16 bp, M. musculus
agtggaacacagtgcc

SEQ ID NO: 363942 - DNA, 16 bp, M. musculus
agtggaacagaacttc

SEQ ID NO: 363943 - DNA, 16 bp, M. musculus
agtggaactgttttaa

SEQ ID NO: 363944 - DNA, 16 bp, M. musculus
agtggaagaaagagca

SEQ ID NO: 363945 - DNA, 16 bp, M. musculus
agtggaagaagcaaaa

SEQ ID NO: 363946 - DNA, 16 bp, M. musculus
agtggaagactgaatt

SEQ ID NO: 363947 - DNA, 17 bp, M. musculus
agtggaagacttcaaca

SEQ ID NO: 363948 - DNA, 16 bp, M. musculus
agtggaaggagagaac

SEQ ID NO: 363949 - DNA, 16 bp, M. musculus
agtggaagtccatgtt

SEQ ID NO: 363950 - DNA, 16 bp, M. musculus
agtggaatcacgtgaa

SEQ ID NO: 363951 - DNA, 16 bp, M. musculus
agtggaatcttagggt

SEQ ID NO: 363952 - DNA, 16 bp, M. musculus
agtggaatgtggtggc

SEQ ID NO: 363953 - DNA, 16 bp, M. musculus
agtggaatgttttatt

SEQ ID NO: 363954 - DNA, 16 bp, M. musculus
agtggaattgttttga

SEQ ID NO: 363955 - DNA, 16 bp, M. musculus
agtggacatttgacaa

SEQ ID NO: 363956 - DNA, 16 bp, M. musculus
agtggaccaaggaact

SEQ ID NO: 363957 - DNA, 16 bp, M. musculus
agtggactataaacaa

SEQ ID NO: 363958 - DNA, 16 bp, M. musculus
agtggactggaaggga

SEQ ID NO: 363959 - DNA, 16 bp, M. musculus
agtggagaaaagcctc

SEQ ID NO: 363960 - DNA, 16 bp, M. musculus
agtggagaaactgagg

SEQ ID NO: 363961 - DNA, 16 bp, M. musculus
agtggagaaatctcag

SEQ ID NO: 363962 - DNA, 16 bp, M. musculus
agtggagaactaccct

SEQ ID NO: 363963 - DNA, 16 bp, M. musculus
agtggagacagaaaga

SEQ ID NO: 363964 - DNA, 16 bp, M. musculus
agtggagacaggagaa

SEQ ID NO: 363965 - DNA, 16 bp, M. musculus
agtggagacaggagga

SEQ ID NO: 363966 - DNA, 16 bp, M. musculus
agtggagactgaagga

SEQ ID NO: 363967 - DNA, 16 bp, M. musculus
agtggagagagaggcc

SEQ ID NO: 363968 - DNA, 16 bp, M. musculus
agtggagagagctgta

SEQ ID NO: 363969 - DNA, 16 bp, M. musculus
agtggagcacaccttt

SEQ ID NO: 363970 - DNA, 16 bp, M. musculus
agtggagcagaaactg

SEQ ID NO: 363971 - DNA, 16 bp, M. musculus
agtggagctgcctctg

SEQ ID NO: 363972 - DNA, 16 bp, M. musculus
agtggagctggagaga

SEQ ID NO: 363973 - DNA, 16 bp, M. musculus
agtggaggagctggag

SEQ ID NO: 363974 - DNA, 16 bp, M. musculus
agtggaggcccagctt

SEQ ID NO: 363975 - DNA, 16 bp, M. musculus
agtggagtagacagca

SEQ ID NO: 363976 - DNA, 17 bp, M. musculus
agtggagttgaccagag

SEQ ID NO: 363977 - DNA, 16 bp, M. musculus
agtggagttgactgga

SEQ ID NO: 363978 - DNA, 16 bp, M. musculus
agtggataagagtgct

SEQ ID NO: 363979 - DNA, 16 bp, M. musculus
agtggatcaaagagct

SEQ ID NO: 363980 - DNA, 16 bp, M. musculus
agtggatcaaggccct

SEQ ID NO: 363981 - DNA, 16 bp, M. musculus
agtggatcaatgaact

SEQ ID NO: 363982 - DNA, 16 bp, M. musculus
agtggatcccctggaa

SEQ ID NO: 363983 - DNA, 16 bp, M. musculus
agtggatctcctggga

SEQ ID NO: 363984 - DNA, 16 bp, M. musculus
agtggatctgggagag

SEQ ID NO: 363985 - DNA, 16 bp, M. musculus
agtggatcttgatgag

SEQ ID NO: 363986 - DNA, 16 bp, M. musculus
agtggatggaactgga

SEQ ID NO: 363987 - DNA, 16 bp, M. musculus
agtggatggatgagtg

SEQ ID NO: 363988 - DNA, 16 bp, M. musculus
agtggatgtgtaaaac

SEQ ID NO: 363989 - DNA, 16 bp, M. musculus
agtggatttttccttt

SEQ ID NO: 363990 - DNA, 16 bp, M. musculus
agtggcacaagttcct

SEQ ID NO: 363991 - DNA, 16 bp, M. musculus
agtggcactattagga

SEQ ID NO: 363992 - DNA, 16 bp, M. musculus
agtggcactgttagga

SEQ ID NO: 363993 - DNA, 16 bp, M. musculus
agtggcagaacacttg

SEQ ID NO: 363994 - DNA, 16 bp, M. musculus
agtggcagagcacttg

SEQ ID NO: 363995 - DNA, 16 bp, M. musculus
agtggcagagcagctg

SEQ ID NO: 363996 - DNA, 16 bp, M. musculus
agtggcagggccagct

SEQ ID NO: 363997 - DNA, 16 bp, M. musculus
agtggcagtgggtggg

SEQ ID NO: 363998 - DNA, 16 bp, M. musculus
agtggcatgaatgtta

SEQ ID NO: 363999 - DNA, 16 bp, M. musculus
agtggcattattagaa

SEQ ID NO: 364000 - DNA, 16 bp, M. musculus
agtggccacagaggcc

SEQ ID NO: 364001 - DNA, 16 bp, M. musculus
agtggccagagcactg

SEQ ID NO: 364002 - DNA, 16 bp, M. musculus
agtggccagccagcct

SEQ ID NO: 364003 - DNA, 16 bp, M. musculus
agtggccagcctggtc

SEQ ID NO: 364004 - DNA, 16 bp, M. musculus
agtggccatctcctgt

SEQ ID NO: 364005 - DNA, 16 bp, M. musculus
agtggccatgtgggtg

SEQ ID NO: 364006 - DNA, 16 bp, M. musculus
agtggcccacacttta

SEQ ID NO: 364007 - DNA, 16 bp, M. musculus
agtggccccacactct

SEQ ID NO: 364008 - DNA, 16 bp, M. musculus
agtggctaagagcaca

SEQ ID NO: 364009 - DNA, 16 bp, M. musculus
agtggctatcttgcca

SEQ ID NO: 364010 - DNA, 18 bp, M. musculus
agtggctcacaaccacct

SEQ ID NO: 364011 - DNA, 16 bp, M. musculus
agtggctcacaaccat

SEQ ID NO: 364012 - DNA, 16 bp, M. musculus
agtggctcacagctgt

SEQ ID NO: 364013 - DNA, 16 bp, M. musculus
agtggctcccaaccat

SEQ ID NO: 364014 - DNA, 16 bp, M. musculus
agtggctctcaacctg

SEQ ID NO: 364015 - DNA, 16 bp, M. musculus
agtggctctgccagag

SEQ ID NO: 364016 - DNA, 16 bp, M. musculus
agtggctctgccagtg

SEQ ID NO: 364017 - DNA, 16 bp, M. musculus
agtggctctggtttta

SEQ ID NO: 364018 - DNA, 16 bp, M. musculus
agtggctgaggcagga

SEQ ID NO: 364019 - DNA, 16 bp, M. musculus
agtggctgcaaacaag

SEQ ID NO: 364020 - DNA, 16 bp, M. musculus
agtggctggatgtaaa

SEQ ID NO: 364021 - DNA, 16 bp, M. musculus
agtggctggctggctg

SEQ ID NO: 364022 - DNA, 16 bp, M. musculus
agtggctgtaccagct

SEQ ID NO: 364023 - DNA, 16 bp, M. musculus
agtggctgtgggaaga

SEQ ID NO: 364024 - DNA, 16 bp, M. musculus
agtggcttttctctac

SEQ ID NO: 364025 - DNA, 16 bp, M. musculus
agtgggaaaagatgca

SEQ ID NO: 364026 - DNA, 16 bp, M. musculus
agtgggaaaggaagca

SEQ ID NO: 364027 - DNA, 16 bp, M. musculus
agtgggaacctagtga

SEQ ID NO: 364028 - DNA, 16 bp, M. musculus
agtgggaagaagacag

SEQ ID NO: 364029 - DNA, 16 bp, M. musculus
agtgggactggggtgt

SEQ ID NO: 364030 - DNA, 16 bp, M. musculus
agtgggagaagatgaa

SEQ ID NO: 364031 - DNA, 16 bp, M. musculus
agtgggagaccctgtc

SEQ ID NO: 364032 - DNA, 16 bp, M. musculus
agtgggagacgagcac

SEQ ID NO: 364033 - DNA, 24 bp, M. musculus
agtgggagagcccctgcctagaat

SEQ ID NO: 364034 - DNA, 16 bp, M. musculus
agtgggagagctggct

SEQ ID NO: 364035 - DNA, 16 bp, M. musculus
agtgggagaggaagct

SEQ ID NO: 364036 - DNA, 16 bp, M. musculus
agtgggagcatggcag

SEQ ID NO: 364037 - DNA, 16 bp, M. musculus
agtgggaggggaagcc

SEQ ID NO: 364038 - DNA, 16 bp, M. musculus
agtgggcaagtgagct

SEQ ID NO: 364039 - DNA, 16 bp, M. musculus
agtgggccctgtacct

SEQ ID NO: 364040 - DNA, 16 bp, M. musculus
agtggggaaaagcctt

SEQ ID NO: 364041 - DNA, 16 bp, M. musculus
agtggggaagtctctg

SEQ ID NO: 364042 - DNA, 16 bp, M. musculus
agtggggagaaggaac

SEQ ID NO: 364043 - DNA, 16 bp, M. musculus
agtggggaggggagca

SEQ ID NO: 364044 - DNA, 16 bp, M. musculus
agtggggccagagcaa

SEQ ID NO: 364045 - DNA, 16 bp, M. musculus
agtggggcttagtggg

SEQ ID NO: 364046 - DNA, 16 bp, M. musculus
agtgggggagcaccct

SEQ ID NO: 364047 - DNA, 16 bp, M. musculus
agtggggttatttgat

SEQ ID NO: 364048 - DNA, 16 bp, M. musculus
agtgggtaaaagccct

SEQ ID NO: 364049 - DNA, 16 bp, M. musculus
agtgggtgaaggagca

SEQ ID NO: 364050 - DNA, 16 bp, M. musculus
agtgggtggcttgggg

SEQ ID NO: 364051 - DNA, 16 bp, M. musculus
agtgggtgggctggtg

SEQ ID NO: 364052 - DNA, 16 bp, M. musculus
agtgggtgggggagct

SEQ ID NO: 364053 - DNA, 18 bp, M. musculus
agtgggtgtggcagcagt

SEQ ID NO: 364054 - DNA, 16 bp, M. musculus
agtgggtgtggccttg

SEQ ID NO: 364055 - DNA, 16 bp, M. musculus
agtgggttacctcact

SEQ ID NO: 364056 - DNA, 16 bp, M. musculus
agtgggttggtgtccc

SEQ ID NO: 364057 - DNA, 16 bp, M. musculus
agtggtacatgcctgt

SEQ ID NO: 364058 - DNA, 16 bp, M. musculus
agtggtagaacatttg

SEQ ID NO: 364059 - DNA, 19 bp, M. musculus
agtggtagagccctgccta

SEQ ID NO: 364060 - DNA, 16 bp, M. musculus
agtggtagggcacttg

SEQ ID NO: 364061 - DNA, 16 bp, M. musculus
agtggtcaaggacacc

SEQ ID NO: 364062 - DNA, 16 bp, M. musculus
agtggtcagagcacac

SEQ ID NO: 364063 - DNA, 16 bp, M. musculus
agtggtcagtcctgaa

SEQ ID NO: 364064 - DNA, 16 bp, M. musculus
agtggtctcacagccc

SEQ ID NO: 364065 - DNA, 16 bp, M. musculus
agtggtgaaatcaacc

SEQ ID NO: 364066 - DNA, 16 bp, M. musculus
agtggtgcatgccttt

SEQ ID NO: 364067 - DNA, 16 bp, M. musculus
agtggtgcatgtcttt

SEQ ID NO: 364068 - DNA, 16 bp, M. musculus
agtggtggcacctgcc

SEQ ID NO: 364069 - DNA, 26 bp, M. musculus
agtggtggcgcatgcctttaatccca

SEQ ID NO: 364070 - DNA, 16 bp, M. musculus
agtggtggctcagtgg

SEQ ID NO: 364071 - DNA, 16 bp, M. musculus
agtggtggttgtaggt

SEQ ID NO: 364072 - DNA, 16 bp, M. musculus
agtggtgtatgccttt

SEQ ID NO: 364073 - DNA, 17 bp, M. musculus
agtggtgtctcctttga

SEQ ID NO: 364074 - DNA, 16 bp, M. musculus
agtggttaaagcattt

SEQ ID NO: 364075 - DNA, 16 bp, M. musculus
agtggttaagaacatt

SEQ ID NO: 364076 - DNA, 16 bp, M. musculus
agtggttaagagcact

SEQ ID NO: 364077 - DNA, 16 bp, M. musculus
agtggttaagagcatg

SEQ ID NO: 364078 - DNA, 16 bp, M. musculus
agtggttaagaggtcc

SEQ ID NO: 364079 - DNA, 16 bp, M. musculus
agtggttaagagtacc

SEQ ID NO: 364080 - DNA, 16 bp, M. musculus
agtggttaggagcatg

SEQ ID NO: 364081 - DNA, 16 bp, M. musculus
agtggttagttcaaat

SEQ ID NO: 364082 - DNA, 16 bp, M. musculus
agtggttctaaacctg

SEQ ID NO: 364083 - DNA, 16 bp, M. musculus
agtggttgagagcact

SEQ ID NO: 364084 - DNA, 16 bp, M. musculus
agtggtttgctgtaga

SEQ ID NO: 364085 - DNA, 16 bp, M. musculus
agtgtaaaaacatcaa

SEQ ID NO: 364086 - DNA, 16 bp, M. musculus
agtgtaaaagtaactt

SEQ ID NO: 364087 - DNA, 16 bp, M. musculus
agtgtaaatatttttg

SEQ ID NO: 364088 - DNA, 16 bp, M. musculus
agtgtacaaactgtgc

SEQ ID NO: 364089 - DNA, 16 bp, M. musculus
agtgtacacagtaagc

SEQ ID NO: 364090 - DNA, 16 bp, M. musculus
agtgtacacatgcaca

SEQ ID NO: 364091 - DNA, 16 bp, M. musculus
agtgtacatgtggagg

SEQ ID NO: 364092 - DNA, 16 bp, M. musculus
agtgtacctatgtata

SEQ ID NO: 364093 - DNA, 16 bp, M. musculus
agtgtactcatataaa

SEQ ID NO: 364094 - DNA, 16 bp, M. musculus
agtgtactctttggtt

SEQ ID NO: 364095 - DNA, 16 bp, M. musculus
agtgtacttaaataaa

SEQ ID NO: 364096 - DNA, 16 bp, M. musculus
agtgtacttacattta

SEQ ID NO: 364097 - DNA, 16 bp, M. musculus
agtgtacttggatata

SEQ ID NO: 364098 - DNA, 16 bp, M. musculus
agtgtagctcagtggt

SEQ ID NO: 364099 - DNA, 16 bp, M. musculus
agtgtaggaaggcctt

SEQ ID NO: 364100 - DNA, 16 bp, M. musculus
agtgtatatatgtata

SEQ ID NO: 364101 - DNA, 16 bp, M. musculus
agtgtatatgcatgta

SEQ ID NO: 364102 - DNA, 16 bp, M. musculus
agtgtatctggtttta

SEQ ID NO: 364103 - DNA, 16 bp, M. musculus
agtgtatctggttttg

SEQ ID NO: 364104 - DNA, 16 bp, M. musculus
agtgtatggcagctct

SEQ ID NO: 364105 - DNA, 16 bp, M. musculus
agtgtatgtatgtatg

SEQ ID NO: 364106 - DNA, 16 bp, M. musculus
agtgtatgtgagtgtg

SEQ ID NO: 364107 - DNA, 16 bp, M. musculus
agtgtatgtgtgtatg

SEQ ID NO: 364108 - DNA, 16 bp, M. musculus
agtgtatgtgtgtgtg

SEQ ID NO: 364109 - DNA, 16 bp, M. musculus
agtgtattggagatgc

SEQ ID NO: 364110 - DNA, 16 bp, M. musculus
agtgtatttagatata

SEQ ID NO: 364111 - DNA, 16 bp, M. musculus
agtgtatttatataca

SEQ ID NO: 364112 - DNA, 16 bp, M. musculus
agtgtcaacttgacac

SEQ ID NO: 364113 - DNA, 16 bp, M. musculus
agtgtcacttcccatg

SEQ ID NO: 364114 - DNA, 16 bp, M. musculus
agtgtcagaatggagc

SEQ ID NO: 364115 - DNA, 16 bp, M. musculus
agtgtcaggaattggt

SEQ ID NO: 364116 - DNA, 16 bp, M. musculus
agtgtccacactgtgg

SEQ ID NO: 364117 - DNA, 17 bp, M. musculus
agtgtccacactttggt

SEQ ID NO: 364118 - DNA, 16 bp, M. musculus
agtgtccacagtttgg

SEQ ID NO: 364119 - DNA, 26 bp, M. musculus
agtgtccagacttttacaaggcctaa

SEQ ID NO: 364120 - DNA, 16 bp, M. musculus
agtgtccccactttgg

SEQ ID NO: 364121 - DNA, 16 bp, M. musculus
agtgtcccttttcttt

SEQ ID NO: 364122 - DNA, 16 bp, M. musculus
agtgtctagttttggt

SEQ ID NO: 364123 - DNA, 16 bp, M. musculus
agtgtctatgtgtatg

SEQ ID NO: 364124 - DNA, 16 bp, M. musculus
agtgtctcatgtagcc

SEQ ID NO: 364125 - DNA, 16 bp, M. musculus
agtgtctgaagacaga

SEQ ID NO: 364126 - DNA, 16 bp, M. musculus
agtgtctgagtgtgtg

SEQ ID NO: 364127 - DNA, 16 bp, M. musculus
agtgtctgctgtcacc

SEQ ID NO: 364128 - DNA, 16 bp, M. musculus
agtgtctggcaaacac

SEQ ID NO: 364129 - DNA, 16 bp, M. musculus
agtgtctgggtttggt

SEQ ID NO: 364130 - DNA, 16 bp, M. musculus
agtgtctggtgagaag

SEQ ID NO: 364131 - DNA, 16 bp, M. musculus
agtgtctgtacaagtt

SEQ ID NO: 364132 - DNA, 16 bp, M. musculus
agtgtctgtatttttc

SEQ ID NO: 364133 - DNA, 16 bp, M. musculus
agtgtctgtctctgtc

SEQ ID NO: 364134 - DNA, 16 bp, M. musculus
agtgtctgtctttatt

SEQ ID NO: 364135 - DNA, 16 bp, M. musculus
agtgtctgtgagatct

SEQ ID NO: 364136 - DNA, 16 bp, M. musculus
agtgtctgtgtaacat

SEQ ID NO: 364137 - DNA, 16 bp, M. musculus
agtgtctgtgttttgt

SEQ ID NO: 364138 - DNA, 16 bp, M. musculus
agtgtgaagaaatact

SEQ ID NO: 364139 - DNA, 16 bp, M. musculus
agtgtgaagaccagag

SEQ ID NO: 364140 - DNA, 16 bp, M. musculus
agtgtgaagagtgcca

SEQ ID NO: 364141 - DNA, 16 bp, M. musculus
agtgtgacactgtggg

SEQ ID NO: 364142 - DNA, 16 bp, M. musculus
agtgtgaggacctgag

SEQ ID NO: 364143 - DNA, 16 bp, M. musculus
agtgtgagtgtgtatg

SEQ ID NO: 364144 - DNA, 16 bp, M. musculus
agtgtgagtgtgtgcg

SEQ ID NO: 364145 - DNA, 16 bp, M. musculus
agtgtgatgaagaagg

SEQ ID NO: 364146 - DNA, 16 bp, M. musculus
agtgtgcaccacagaa

SEQ ID NO: 364147 - DNA, 16 bp, M. musculus
agtgtgcagatggcag

SEQ ID NO: 364148 - DNA, 16 bp, M. musculus
agtgtgcaggtgtgtg

SEQ ID NO: 364149 - DNA, 16 bp, M. musculus
agtgtgcatacataca

SEQ ID NO: 364150 - DNA, 16 bp, M. musculus
agtgtgcatgcttcag

SEQ ID NO: 364151 - DNA, 16 bp, M. musculus
agtgtgcatgggagag

SEQ ID NO: 364152 - DNA, 16 bp, M. musculus
agtgtggaaaagcctt

SEQ ID NO: 364153 - DNA, 16 bp, M. musculus
agtgtggagaaggaga

SEQ ID NO: 364154 - DNA, 16 bp, M. musculus
agtgtggagcaaagac

SEQ ID NO: 364155 - DNA, 16 bp, M. musculus
agtgtggagctgagac

SEQ ID NO: 364156 - DNA, 16 bp, M. musculus
agtgtggcagtctcct

SEQ ID NO: 364157 - DNA, 16 bp, M. musculus
agtgtggccttgaact

SEQ ID NO: 364158 - DNA, 16 bp, M. musculus
agtgtggcctttttgg

SEQ ID NO: 364159 - DNA, 16 bp, M. musculus
agtgtgggaagccaca

SEQ ID NO: 364160 - DNA, 16 bp, M. musculus
agtgtggggacctgag

SEQ ID NO: 364161 - DNA, 16 bp, M. musculus
agtgtggggcagagac

SEQ ID NO: 364162 - DNA, 16 bp, M. musculus
agtgtggggctggaga

SEQ ID NO: 364163 - DNA, 17 bp, M. musculus
agtgtggtaaagccttt

SEQ ID NO: 364164 - DNA, 16 bp, M. musculus
agtgtggtggcacatg

SEQ ID NO: 364165 - DNA, 16 bp, M. musculus
agtgtggtggtgcatg

SEQ ID NO: 364166 - DNA, 16 bp, M. musculus
agtgtgtacacacaca

SEQ ID NO: 364167 - DNA, 16 bp, M. musculus
agtgtgtataagtgtg

SEQ ID NO: 364168 - DNA, 16 bp, M. musculus
agtgtgtatgtatgtg

SEQ ID NO: 364169 - DNA, 16 bp, M. musculus
agtgtgtatttctggc

SEQ ID NO: 364170 - DNA, 16 bp, M. musculus
agtgtgtcactggtgg

SEQ ID NO: 364171 - DNA, 30 bp, M. musculus
agtgtgtccaactctctggataggaactta

SEQ ID NO: 364172 - DNA, 16 bp, M. musculus
agtgtgtcccacagtc

SEQ ID NO: 364173 - DNA, 16 bp, M. musculus
agtgtgtctgtattcc

SEQ ID NO: 364174 - DNA, 16 bp, M. musculus
agtgtgtgagtgagtg

SEQ ID NO: 364175 - DNA, 16 bp, M. musculus
agtgtgtgagtgtgag

SEQ ID NO: 364176 - DNA, 16 bp, M. musculus
agtgtgtgctgtgtgt

SEQ ID NO: 364177 - DNA, 16 bp, M. musculus
agtgtgtgtatatata

SEQ ID NO: 364178 - DNA, 16 bp, M. musculus
agtgtgtgtatgtggg

SEQ ID NO: 364179 - DNA, 16 bp, M. musculus
agtgtgtgtcactgtg

SEQ ID NO: 364180 - DNA, 16 bp, M. musculus
agtgtgtgtgagagtg

SEQ ID NO: 364181 - DNA, 16 bp, M. musculus
agtgtgtgtgcatgca

SEQ ID NO: 364182 - DNA, 16 bp, M. musculus
agtgtgtgtgccagtg

SEQ ID NO: 364183 - DNA, 16 bp, M. musculus
agtgtgtgtgtatgtg

SEQ ID NO: 364184 - DNA, 16 bp, M. musculus
agtgtgtgtgtgtata

SEQ ID NO: 364185 - DNA, 16 bp, M. musculus
agtgtgtgtgtgtgaa

SEQ ID NO: 364186 - DNA, 16 bp, M. musculus
agtgtgtgtgtgtgag

SEQ ID NO: 364187 - DNA, 16 bp, M. musculus
agtgtgtgttaactgt

SEQ ID NO: 364188 - DNA, 16 bp, M. musculus
agtgtgttccaggata

SEQ ID NO: 364189 - DNA, 16 bp, M. musculus
agtgtgttcctggaga

SEQ ID NO: 364190 - DNA, 16 bp, M. musculus
agtgttaggattaaag

SEQ ID NO: 364191 - DNA, 16 bp, M. musculus
agtgttcccagaacac

SEQ ID NO: 364192 - DNA, 16 bp, M. musculus
agtgttccctcttttg

SEQ ID NO: 364193 - DNA, 16 bp, M. musculus
agtgttcctctttcct

SEQ ID NO: 364194 - DNA, 16 bp, M. musculus
agtgttctaaccactg

SEQ ID NO: 364195 - DNA, 16 bp, M. musculus
agtgttctgagttcca

SEQ ID NO: 364196 - DNA, 16 bp, M. musculus
agtgttctgcttgcat

SEQ ID NO: 364197 - DNA, 16 bp, M. musculus
agtgttctgtaaatat

SEQ ID NO: 364198 - DNA, 16 bp, M. musculus
agtgttcttagattcc

SEQ ID NO: 364199 - DNA, 16 bp, M. musculus
agtgttctttctccac

SEQ ID NO: 364200 - DNA, 16 bp, M. musculus
agtgttgagattaaag

SEQ ID NO: 364201 - DNA, 16 bp, M. musculus
agtgttgaggtttggt

SEQ ID NO: 364202 - DNA, 17 bp, M. musculus
agtgttgcctcactttg

SEQ ID NO: 364203 - DNA, 16 bp, M. musculus
agtgttggaattaaag

SEQ ID NO: 364204 - DNA, 16 bp, M. musculus
agtgttggatcccctg

SEQ ID NO: 364205 - DNA, 16 bp, M. musculus
agtgttggctgctctt

SEQ ID NO: 364206 - DNA, 16 bp, M. musculus
agtgttgggactaaag

SEQ ID NO: 364207 - DNA, 16 bp, M. musculus
agtgttgggatcacag

SEQ ID NO: 364208 - DNA, 16 bp, M. musculus
agtgttgggattacag

SEQ ID NO: 364209 - DNA, 16 bp, M. musculus
agtgttggggattggt

SEQ ID NO: 364210 - DNA, 16 bp, M. musculus
agtgttgtgtctggcc

SEQ ID NO: 364211 - DNA, 16 bp, M. musculus
agtgttgttgagctca

SEQ ID NO: 364212 - DNA, 16 bp, M. musculus
agtgtttaaaagaaaa

SEQ ID NO: 364213 - DNA, 16 bp, M. musculus
agtgtttatatatata

SEQ ID NO: 364214 - DNA, 16 bp, M. musculus
agtgtttattcagctt

SEQ ID NO: 364215 - DNA, 16 bp, M. musculus
agtgtttctcaacctg

SEQ ID NO: 364216 - DNA, 16 bp, M. musculus
agtgtttctctgtgtg

SEQ ID NO: 364217 - DNA, 16 bp, M. musculus
agtgtttctttgtgta

SEQ ID NO: 364218 - DNA, 16 bp, M. musculus
agtgtttcttttagtg

SEQ ID NO: 364219 - DNA, 16 bp, M. musculus
agtgtttgagtttggt

SEQ ID NO: 364220 - DNA, 16 bp, M. musculus
agtgtttgcaaatgga

SEQ ID NO: 364221 - DNA, 16 bp, M. musculus
agtgtttgccatgcaa

SEQ ID NO: 364222 - DNA, 16 bp, M. musculus
agtgtttgcctaacat

SEQ ID NO: 364223 - DNA, 16 bp, M. musculus
agtgtttgcctagcat

SEQ ID NO: 364224 - DNA, 16 bp, M. musculus
agtgtttgctgtgcaa

SEQ ID NO: 364225 - DNA, 16 bp, M. musculus
agtgtttggatttggt

SEQ ID NO: 364226 - DNA, 16 bp, M. musculus
agtgtttgggtttgat

SEQ ID NO: 364227 - DNA, 16 bp, M. musculus
agtgttttaaaataaa

SEQ ID NO: 364228 - DNA, 16 bp, M. musculus
agtgttttcttgtatt

SEQ ID NO: 364229 - DNA, 16 bp, M. musculus
agtgttttgcattgta

SEQ ID NO: 364230 - DNA, 16 bp, M. musculus
agtgttttgcctgcat

SEQ ID NO: 364231 - DNA, 16 bp, M. musculus
agtgttttggttatta

SEQ ID NO: 364232 - DNA, 17 bp, M. musculus
agtgttttttaaaaaaa

SEQ ID NO: 364233 - DNA, 16 bp, M. musculus
agtgttttttaaaaag

SEQ ID NO: 364234 - DNA, 16 bp, M. musculus
agttaaaagcacttac

SEQ ID NO: 364235 - DNA, 16 bp, M. musculus
agttaaaggcagttgt

SEQ ID NO: 364236 - DNA, 16 bp, M. musculus
agttaaaggccagtct

SEQ ID NO: 364237 - DNA, 16 bp, M. musculus
agttaaatcaaaatca

SEQ ID NO: 364238 - DNA, 16 bp, M. musculus
agttaaatgtttgcct

SEQ ID NO: 364239 - DNA, 16 bp, M. musculus
agttaaatttgaattt

SEQ ID NO: 364240 - DNA, 16 bp, M. musculus
agttaacaaagatgaa

SEQ ID NO: 364241 - DNA, 16 bp, M. musculus
agttaacaatcagaag

SEQ ID NO: 364242 - DNA, 16 bp, M. musculus
agttaacagaacaaca

SEQ ID NO: 364243 - DNA, 16 bp, M. musculus
agttaagaaatcattt

SEQ ID NO: 364244 - DNA, 16 bp, M. musculus
agttaagaacactgtc

SEQ ID NO: 364245 - DNA, 17 bp, M. musculus
agttaagagcagtgact

SEQ ID NO: 364246 - DNA, 16 bp, M. musculus
agttaagtgattagat

SEQ ID NO: 364247 - DNA, 16 bp, M. musculus
agttaattcctctaca

SEQ ID NO: 364248 - DNA, 16 bp, M. musculus
agttacaaacaattgt

SEQ ID NO: 364249 - DNA, 16 bp, M. musculus
agttacaaagaaagga

SEQ ID NO: 364250 - DNA, 16 bp, M. musculus
agttacaaagtagcaa

SEQ ID NO: 364251 - DNA, 16 bp, M. musculus
agttacacaatggagt

SEQ ID NO: 364252 - DNA, 16 bp, M. musculus
agttacagaaacaaaa

SEQ ID NO: 364253 - DNA, 16 bp, M. musculus
agttacagaaacaaat

SEQ ID NO: 364254 - DNA, 16 bp, M. musculus
agttacagacaattgt

SEQ ID NO: 364255 - DNA, 16 bp, M. musculus
agttacagacagctgt

SEQ ID NO: 364256 - DNA, 16 bp, M. musculus
agttacagacagttat

SEQ ID NO: 364257 - DNA, 16 bp, M. musculus
agttacagagaaaaaa

SEQ ID NO: 364258 - DNA, 16 bp, M. musculus
agttacagagacggag

SEQ ID NO: 364259 - DNA, 16 bp, M. musculus
agttacagagatggag

SEQ ID NO: 364260 - DNA, 16 bp, M. musculus
agttacagatggttat

SEQ ID NO: 364261 - DNA, 16 bp, M. musculus
agttacagatggttgt

SEQ ID NO: 364262 - DNA, 16 bp, M. musculus
agttacaggacagcca

SEQ ID NO: 364263 - DNA, 16 bp, M. musculus
agttacaggcagctgt

SEQ ID NO: 364264 - DNA, 16 bp, M. musculus
agttacaggcagttct

SEQ ID NO: 364265 - DNA, 16 bp, M. musculus
agttacaggcagttgt

SEQ ID NO: 364266 - DNA, 24 bp, M. musculus
agttacaggcccttaaagaaaagc

SEQ ID NO: 364267 - DNA, 16 bp, M. musculus
agttacaggctgctgt

SEQ ID NO: 364268 - DNA, 16 bp, M. musculus
agttacaggtggctgt

SEQ ID NO: 364269 - DNA, 17 bp, M. musculus
agttacaggtggttgtg

SEQ ID NO: 364270 - DNA, 16 bp, M. musculus
agttacagttgtgagc

SEQ ID NO: 364271 - DNA, 16 bp, M. musculus
agttacatagacaaag

SEQ ID NO: 364272 - DNA, 16 bp, M. musculus
agttacatgttctgag

SEQ ID NO: 364273 - DNA, 72 bp, M. musculus
agttaccaacttaatgacaggacaaacagctaatgctacctccctcctggggacaatgaccgatgcctttcc

SEQ ID NO: 364274 - DNA, 16 bp, M. musculus
agttaccactgtttct

SEQ ID NO: 364275 - DNA, 16 bp, M. musculus
agttacctcactcaga

SEQ ID NO: 364276 - DNA, 16 bp, M. musculus
agttacgaagtagcaa

SEQ ID NO: 364277 - DNA, 16 bp, M. musculus
agttactattgctgtg

SEQ ID NO: 364278 - DNA, 16 bp, M. musculus
agttactgctccagca

SEQ ID NO: 364279 - DNA, 16 bp, M. musculus
agttactggcagttgt

SEQ ID NO: 364280 - DNA, 16 bp, M. musculus
agttactgtgtttaaa

SEQ ID NO: 364281 - DNA, 16 bp, M. musculus
agttacttttatattt

SEQ ID NO: 364282 - DNA, 16 bp, M. musculus
agttacttttctcatt

SEQ ID NO: 364283 - DNA, 16 bp, M. musculus
agttagagacagttgt

SEQ ID NO: 364284 - DNA, 16 bp, M. musculus
agttagaggcagctgt

SEQ ID NO: 364285 - DNA, 16 bp, M. musculus
agttagaggccagact

SEQ ID NO: 364286 - DNA, 16 bp, M. musculus
agttagaggtggctgt

SEQ ID NO: 364287 - DNA, 16 bp, M. musculus
agttaggaatgatggt

SEQ ID NO: 364288 - DNA, 16 bp, M. musculus
agttagggaggaaaga

SEQ ID NO: 364289 - DNA, 16 bp, M. musculus
agttagggtttccatt

SEQ ID NO: 364290 - DNA, 16 bp, M. musculus
agttagggtttctatt

SEQ ID NO: 364291 - DNA, 16 bp, M. musculus
agttagtgcctgcttc

SEQ ID NO: 364292 - DNA, 16 bp, M. musculus
agttagtggaagggaa

SEQ ID NO: 364293 - DNA, 16 bp, M. musculus
agttagtttgaggcca

SEQ ID NO: 364294 - DNA, 16 bp, M. musculus
agttagttttttaaaa

SEQ ID NO: 364295 - DNA, 16 bp, M. musculus
agttataaagaagcaa

SEQ ID NO: 364296 - DNA, 16 bp, M. musculus
agttataattttgatg

SEQ ID NO: 364297 - DNA, 16 bp, M. musculus
agttatatatacatat

SEQ ID NO: 364298 - DNA, 16 bp, M. musculus
agttatcccagagaaa

SEQ ID NO: 364299 - DNA, 16 bp, M. musculus
agttatctacagaaca

SEQ ID NO: 364300 - DNA, 16 bp, M. musculus
agttatctgagaagag

SEQ ID NO: 364301 - DNA, 16 bp, M. musculus
agttatctgagaggag

SEQ ID NO: 364302 - DNA, 16 bp, M. musculus
agttatgaaccaaaag

SEQ ID NO: 364303 - DNA, 16 bp, M. musculus
agttatgaagtaacaa

SEQ ID NO: 364304 - DNA, 16 bp, M. musculus
agttatgaagtagcaa

SEQ ID NO: 364305 - DNA, 16 bp, M. musculus
agttatgcttttttct

SEQ ID NO: 364306 - DNA, 16 bp, M. musculus
agttattaattcaaaa

SEQ ID NO: 364307 - DNA, 16 bp, M. musculus
agttattaatttcctt

SEQ ID NO: 364308 - DNA, 16 bp, M. musculus
agttattcagaattga

SEQ ID NO: 364309 - DNA, 16 bp, M. musculus
agttatttatttcctt

SEQ ID NO: 364310 - DNA, 16 bp, M. musculus
agttatttgagaattt

SEQ ID NO: 364311 - DNA, 16 bp, M. musculus
agttatttgattctct

SEQ ID NO: 364312 - DNA, 16 bp, M. musculus
agttattttgatgatg

SEQ ID NO: 364313 - DNA, 16 bp, M. musculus
agttattttgttgcta

SEQ ID NO: 364314 - DNA, 16 bp, M. musculus
agttatttttaaaatg

SEQ ID NO: 364315 - DNA, 16 bp, M. musculus
agttcaaaaccagcct

SEQ ID NO: 364316 - DNA, 16 bp, M. musculus
agttcaaacccagcaa

SEQ ID NO: 364317 - DNA, 16 bp, M. musculus
agttcaaacctcagca

SEQ ID NO: 364318 - DNA, 16 bp, M. musculus
agttcaaactaaaatt

SEQ ID NO: 364319 - DNA, 16 bp, M. musculus
agttcaaagacagtct

SEQ ID NO: 364320 - DNA, 16 bp, M. musculus
agttcaaagccagctt

SEQ ID NO: 364321 - DNA, 16 bp, M. musculus
agttcaaagccagtct

SEQ ID NO: 364322 - DNA, 16 bp, M. musculus
agttcaaagccatcct

SEQ ID NO: 364323 - DNA, 16 bp, M. musculus
agttcaaagcctgcct

SEQ ID NO: 364324 - DNA, 16 bp, M. musculus
agttcaaagctagcct

SEQ ID NO: 364325 - DNA, 16 bp, M. musculus
agttcaaagtcagcct

SEQ ID NO: 364326 - DNA, 16 bp, M. musculus
agttcaaagtcatcct

SEQ ID NO: 364327 - DNA, 16 bp, M. musculus
agttcaaagttcaagg

SEQ ID NO: 364328 - DNA, 16 bp, M. musculus
agttcaaatccagcaa

SEQ ID NO: 364329 - DNA, 16 bp, M. musculus
agttcaaatcccagaa

SEQ ID NO: 364330 - DNA, 25 bp, M. musculus
agttcaaatcccagcaaccacatga

SEQ ID NO: 364331 - DNA, 28 bp, M. musculus
agttcaaatcccagcaaccatatggtgg

SEQ ID NO: 364332 - DNA, 18 bp, M. musculus
agttcaaatcccagcaat

SEQ ID NO: 364333 - DNA, 16 bp, M. musculus
agttcaaattgttgtt

SEQ ID NO: 364334 - DNA, 16 bp, M. musculus
agttcaacaacaacaa

SEQ ID NO: 364335 - DNA, 16 bp, M. musculus
agttcaacaagctgaa

SEQ ID NO: 364336 - DNA, 16 bp, M. musculus
agttcaacttcttgag

SEQ ID NO: 364337 - DNA, 16 bp, M. musculus
agttcaagaacagcct

SEQ ID NO: 364338 - DNA, 16 bp, M. musculus
agttcaagaatagcct

SEQ ID NO: 364339 - DNA, 16 bp, M. musculus
agttcaagaccaactt

SEQ ID NO: 364340 - DNA, 16 bp, M. musculus
agttcaagaccaccct

SEQ ID NO: 364341 - DNA, 16 bp, M. musculus
agttcaagaccagctt

SEQ ID NO: 364342 - DNA, 16 bp, M. musculus
agttcaagaccagtct

SEQ ID NO: 364343 - DNA, 16 bp, M. musculus
agttcaagaccatcct

SEQ ID NO: 364344 - DNA, 16 bp, M. musculus
agttcaagactatcct

SEQ ID NO: 364345 - DNA, 16 bp, M. musculus
agttcaagatgagcct

SEQ ID NO: 364346 - DNA, 16 bp, M. musculus
agttcaagattagcct

SEQ ID NO: 364347 - DNA, 16 bp, M. musculus
agttcaagccagcctg

SEQ ID NO: 364348 - DNA, 16 bp, M. musculus
agttcaagcccaacct

SEQ ID NO: 364349 - DNA, 16 bp, M. musculus
agttcaaggacaacct

SEQ ID NO: 364350 - DNA, 16 bp, M. musculus
agttcaaggacagcat

SEQ ID NO: 364351 - DNA, 16 bp, M. musculus
agttcaaggactgcct

SEQ ID NO: 364352 - DNA, 16 bp, M. musculus
agttcaaggataacct

SEQ ID NO: 364353 - DNA, 16 bp, M. musculus
agttcaaggatctttc

SEQ ID NO: 364354 - DNA, 16 bp, M. musculus
agttcaaggcaagctt

SEQ ID NO: 364355 - DNA, 16 bp, M. musculus
agttcaaggccaactt

SEQ ID NO: 364356 - DNA, 16 bp, M. musculus
agttcaaggccacact

SEQ ID NO: 364357 - DNA, 16 bp, M. musculus
agttcaaggccaccct

SEQ ID NO: 364358 - DNA, 16 bp, M. musculus
agttcaaggccagact

SEQ ID NO: 364359 - DNA, 16 bp, M. musculus
agttcaaggccagcat

SEQ ID NO: 364360 - DNA, 16 bp, M. musculus
agttcaaggccagccc

SEQ ID NO: 364361 - DNA, 16 bp, M. musculus
agttcaaggccagccg

SEQ ID NO: 364362 - DNA, 16 bp, M. musculus
agttcaaggccggcct

SEQ ID NO: 364363 - DNA, 16 bp, M. musculus
agttcaaggcctgcct

SEQ ID NO: 364364 - DNA, 16 bp, M. musculus
agttcaaggctaacct

SEQ ID NO: 364365 - DNA, 16 bp, M. musculus
agttcaaggctagcca

SEQ ID NO: 364366 - DNA, 16 bp, M. musculus
agttcaaggctagccc

SEQ ID NO: 364367 - DNA, 16 bp, M. musculus
agttcaaggctaggct

SEQ ID NO: 364368 - DNA, 16 bp, M. musculus
agttcaagggcaacct

SEQ ID NO: 364369 - DNA, 16 bp, M. musculus
agttcaagggcagcca

SEQ ID NO: 364370 - DNA, 16 bp, M. musculus
agttcaaggtcaacct

SEQ ID NO: 364371 - DNA, 16 bp, M. musculus
agttcaaggtcagcct

SEQ ID NO: 364372 - DNA, 16 bp, M. musculus
agttcaaggtcagctt

SEQ ID NO: 364373 - DNA, 16 bp, M. musculus
agttcaaggtcatcca

SEQ ID NO: 364374 - DNA, 16 bp, M. musculus
agttcaaggtcatcct

SEQ ID NO: 364375 - DNA, 16 bp, M. musculus
agttcaaggtcattct

SEQ ID NO: 364376 - DNA, 16 bp, M. musculus
agttcaaggttatcct

SEQ ID NO: 364377 - DNA, 16 bp, M. musculus
agttcaaggttgtctt

SEQ ID NO: 364378 - DNA, 16 bp, M. musculus
agttcaagtccaccct

SEQ ID NO: 364379 - DNA, 16 bp, M. musculus
agttcaagtccagcct

SEQ ID NO: 364380 - DNA, 16 bp, M. musculus
agttcaagtccagctt

SEQ ID NO: 364381 - DNA, 16 bp, M. musculus
agttcaagtcccacca

SEQ ID NO: 364382 - DNA, 16 bp, M. musculus
agttcaagttcagctt

SEQ ID NO: 364383 - DNA, 16 bp, M. musculus
agttcaatctccagca

SEQ ID NO: 364384 - DNA, 16 bp, M. musculus
agttcaatgcccagca

SEQ ID NO: 364385 - DNA, 16 bp, M. musculus
agttcaattcccagca

SEQ ID NO: 364386 - DNA, 16 bp, M. musculus
agttcaattcccagct

SEQ ID NO: 364387 - DNA, 16 bp, M. musculus
agttcaattcccagta

SEQ ID NO: 364388 - DNA, 16 bp, M. musculus
agttcacaactacctg

SEQ ID NO: 364389 - DNA, 16 bp, M. musculus
agttcacagagatctg

SEQ ID NO: 364390 - DNA, 16 bp, M. musculus
agttcagaaagaaaaa

SEQ ID NO: 364391 - DNA, 16 bp, M. musculus
agttcagaacataggg

SEQ ID NO: 364392 - DNA, 16 bp, M. musculus
agttcagaatacctaa

SEQ ID NO: 364393 - DNA, 16 bp, M. musculus
agttcagagccagtct

SEQ ID NO: 364394 - DNA, 16 bp, M. musculus
agttcagagccatcct

SEQ ID NO: 364395 - DNA, 16 bp, M. musculus
agttcagagtcagcct

SEQ ID NO: 364396 - DNA, 16 bp, M. musculus
agttcagatcccagaa

SEQ ID NO: 364397 - DNA, 16 bp, M. musculus
agttcagctcccagca

SEQ ID NO: 364398 - DNA, 16 bp, M. musculus
agttcagctgccagca

SEQ ID NO: 364399 - DNA, 16 bp, M. musculus
agttcaggacagccag

SEQ ID NO: 364400 - DNA, 16 bp, M. musculus
agttcagggccatcct

SEQ ID NO: 364401 - DNA, 16 bp, M. musculus
agttcaggggaacacc

SEQ ID NO: 364402 - DNA, 16 bp, M. musculus
agttcagggtcagcct

SEQ ID NO: 364403 - DNA, 16 bp, M. musculus
agttcagtagagtcgg

SEQ ID NO: 364404 - DNA, 16 bp, M. musculus
agttcagtatctgaga

SEQ ID NO: 364405 - DNA, 16 bp, M. musculus
agttcagtcctcagaa

SEQ ID NO: 364406 - DNA, 16 bp, M. musculus
agttcagtctccagga

SEQ ID NO: 364407 - DNA, 16 bp, M. musculus
agttcagtggtagagc

SEQ ID NO: 364408 - DNA, 16 bp, M. musculus
agttcagttaccagca

SEQ ID NO: 364409 - DNA, 16 bp, M. musculus
agttcagttcccagaa

SEQ ID NO: 364410 - DNA, 16 bp, M. musculus
agttcagttcccagca

SEQ ID NO: 364411 - DNA, 17 bp, M. musculus
agttcagttcccagcac

SEQ ID NO: 364412 - DNA, 16 bp, M. musculus
agttcagttcctggca

SEQ ID NO: 364413 - DNA, 16 bp, M. musculus
agttcagttctcagca

SEQ ID NO: 364414 - DNA, 16 bp, M. musculus
agttcagttctgagca

SEQ ID NO: 364415 - DNA, 16 bp, M. musculus
agttcatccatggctg

SEQ ID NO: 364416 - DNA, 16 bp, M. musculus
agttcatcttcatgtt

SEQ ID NO: 364417 - DNA, 16 bp, M. musculus
agttcatcttggagga

SEQ ID NO: 364418 - DNA, 16 bp, M. musculus
agttcatggccaacct

SEQ ID NO: 364419 - DNA, 16 bp, M. musculus
agttcatttcccagca

SEQ ID NO: 364420 - DNA, 16 bp, M. musculus
agttcatttcctagca

SEQ ID NO: 364421 - DNA, 16 bp, M. musculus
agttccaaaatagcca

SEQ ID NO: 364422 - DNA, 16 bp, M. musculus
agttccaagacagcca

SEQ ID NO: 364423 - DNA, 16 bp, M. musculus
agttccaagacagcta

SEQ ID NO: 364424 - DNA, 16 bp, M. musculus
agttccaagactgcca

SEQ ID NO: 364425 - DNA, 16 bp, M. musculus
agttccaagagatctg

SEQ ID NO: 364426 - DNA, 16 bp, M. musculus
agttccaagatagcca

SEQ ID NO: 364427 - DNA, 16 bp, M. musculus
agttccaagccagcca

SEQ ID NO: 364428 - DNA, 16 bp, M. musculus
agttccacagcctcat

SEQ ID NO: 364429 - DNA, 16 bp, M. musculus
agttccagaaaagcca

SEQ ID NO: 364430 - DNA, 16 bp, M. musculus
agttccagaacaacca

SEQ ID NO: 364431 - DNA, 16 bp, M. musculus
agttccagaacagcca

SEQ ID NO: 364432 - DNA, 16 bp, M. musculus
agttccagaggatctg

SEQ ID NO: 364433 - DNA, 16 bp, M. musculus
agttccagcacagcca

SEQ ID NO: 364434 - DNA, 16 bp, M. musculus
agttccaggacaacca

SEQ ID NO: 364435 - DNA, 16 bp, M. musculus
agttccaggacaagca

SEQ ID NO: 364436 - DNA, 16 bp, M. musculus
agttccaggacacaga

SEQ ID NO: 364437 - DNA, 16 bp, M. musculus
agttccaggacaccag

SEQ ID NO: 364438 - DNA, 20 bp, M. musculus
agttccaggacagccaggga

SEQ ID NO: 364439 - DNA, 16 bp, M. musculus
agttccaggacagtca

SEQ ID NO: 364440 - DNA, 16 bp, M. musculus
agttccaggacagtct

SEQ ID NO: 364441 - DNA, 16 bp, M. musculus
agttccaggacagtga

SEQ ID NO: 364442 - DNA, 17 bp, M. musculus
agttccaggacatccag

SEQ ID NO: 364443 - DNA, 16 bp, M. musculus
agttccaggagacatg

SEQ ID NO: 364444 - DNA, 16 bp, M. musculus
agttccaggagagcca

SEQ ID NO: 364445 - DNA, 16 bp, M. musculus
agttccaggatagcca

SEQ ID NO: 364446 - DNA, 16 bp, M. musculus
agttccaggatagtca

SEQ ID NO: 364447 - DNA, 16 bp, M. musculus
agttccaggatatcca

SEQ ID NO: 364448 - DNA, 16 bp, M. musculus
agttccaggatggcca

SEQ ID NO: 364449 - DNA, 16 bp, M. musculus
agttccaggcagccag

SEQ ID NO: 364450 - DNA, 16 bp, M. musculus
agttccaggccaacct

SEQ ID NO: 364451 - DNA, 16 bp, M. musculus
agttccaggccaactt

SEQ ID NO: 364452 - DNA, 16 bp, M. musculus
agttccaggccaatga

SEQ ID NO: 364453 - DNA, 16 bp, M. musculus
agttccaggccaccca

SEQ ID NO: 364454 - DNA, 16 bp, M. musculus
agttccaggccagcca

SEQ ID NO: 364455 - DNA, 16 bp, M. musculus
agttccaggccagcta

SEQ ID NO: 364456 - DNA, 16 bp, M. musculus
agttccaggccaggca

SEQ ID NO: 364457 - DNA, 16 bp, M. musculus
agttccaggccaggga

SEQ ID NO: 364458 - DNA, 16 bp, M. musculus
agttccaggccagtct

SEQ ID NO: 364459 - DNA, 16 bp, M. musculus
agttccaggctagcca

SEQ ID NO: 364460 - DNA, 16 bp, M. musculus
agttccaggctagccc

SEQ ID NO: 364461 - DNA, 16 bp, M. musculus
agttccagggagctct

SEQ ID NO: 364462 - DNA, 16 bp, M. musculus
agttccagggcagcca

SEQ ID NO: 364463 - DNA, 16 bp, M. musculus
agttccagggcatctg

SEQ ID NO: 364464 - DNA, 16 bp, M. musculus
agttccaggggaacca

SEQ ID NO: 364465 - DNA, 16 bp, M. musculus
agttccagggtatctg

SEQ ID NO: 364466 - DNA, 16 bp, M. musculus
agttccaggtcagcca

SEQ ID NO: 364467 - DNA, 16 bp, M. musculus
agttccaggttagcct

SEQ ID NO: 364468 - DNA, 16 bp, M. musculus
agttccagtacagcca

SEQ ID NO: 364469 - DNA, 16 bp, M. musculus
agttccagtcttgact

SEQ ID NO: 364470 - DNA, 16 bp, M. musculus
agttccagtgcagcca

SEQ ID NO: 364471 - DNA, 16 bp, M. musculus
agttccagtggatcca

SEQ ID NO: 364472 - DNA, 16 bp, M. musculus
agttccatccagttgc

SEQ ID NO: 364473 - DNA, 16 bp, M. musculus
agttccatgacagcca

SEQ ID NO: 364474 - DNA, 16 bp, M. musculus
agttccatgccagcca

SEQ ID NO: 364475 - DNA, 16 bp, M. musculus
agttccatgccagcct

SEQ ID NO: 364476 - DNA, 16 bp, M. musculus
agttcccaaacccaga

SEQ ID NO: 364477 - DNA, 16 bp, M. musculus
agttcccagaactcac

SEQ ID NO: 364478 - DNA, 16 bp, M. musculus
agttcccagaactcat

SEQ ID NO: 364479 - DNA, 18 bp, M. musculus
agttcccagcacccacac

SEQ ID NO: 364480 - DNA, 16 bp, M. musculus
agttcccagcatccat

SEQ ID NO: 364481 - DNA, 16 bp, M. musculus
agttcccctcttctgt

SEQ ID NO: 364482 - DNA, 16 bp, M. musculus
agttccctatacccta

SEQ ID NO: 364483 - DNA, 16 bp, M. musculus
agttcctagcatccat

SEQ ID NO: 364484 - DNA, 16 bp, M. musculus
agttcctatctccttc

SEQ ID NO: 364485 - DNA, 16 bp, M. musculus
agttcctcaggctgtg

SEQ ID NO: 364486 - DNA, 16 bp, M. musculus
agttcctcatcccatt

SEQ ID NO: 364487 - DNA, 16 bp, M. musculus
agttcctcatgctatg

SEQ ID NO: 364488 - DNA, 16 bp, M. musculus
agttcctcatggagga

SEQ ID NO: 364489 - DNA, 16 bp, M. musculus
agttcctcatgtggtg

SEQ ID NO: 364490 - DNA, 16 bp, M. musculus
agttcctcctgccatg

SEQ ID NO: 364491 - DNA, 16 bp, M. musculus
agttcctcgtgttgtg

SEQ ID NO: 364492 - DNA, 16 bp, M. musculus
agttcctcttctcttt

SEQ ID NO: 364493 - DNA, 16 bp, M. musculus
agttcctcttgcagga

SEQ ID NO: 364494 - DNA, 16 bp, M. musculus
agttcctgacttcctt

SEQ ID NO: 364495 - DNA, 16 bp, M. musculus
agttcctgatcctcct

SEQ ID NO: 364496 - DNA, 16 bp, M. musculus
agttcctgatctctac

SEQ ID NO: 364497 - DNA, 16 bp, M. musculus
agttcctgatctttcc

SEQ ID NO: 364498 - DNA, 16 bp, M. musculus
agttcctgccctggct

SEQ ID NO: 364499 - DNA, 16 bp, M. musculus
agttcctgcctccagg

SEQ ID NO: 364500 - DNA, 16 bp, M. musculus
agttcctgcttcccag

SEQ ID NO: 364501 - DNA, 16 bp, M. musculus
agttcctggacagcca

SEQ ID NO: 364502 - DNA, 16 bp, M. musculus
agttcctgggtcagag

SEQ ID NO: 364503 - DNA, 16 bp, M. musculus
agttcctgtcctgaca

SEQ ID NO: 364504 - DNA, 16 bp, M. musculus
agttccttcagtcctt

SEQ ID NO: 364505 - DNA, 16 bp, M. musculus
agttccttctctaact

SEQ ID NO: 364506 - DNA, 16 bp, M. musculus
agttccttctgctggc

SEQ ID NO: 364507 - DNA, 17 bp, M. musculus
agttccttcttagacca

SEQ ID NO: 364508 - DNA, 17 bp, M. musculus
agttccttgatccactt

SEQ ID NO: 364509 - DNA, 16 bp, M. musculus
agttccttggggcaag

SEQ ID NO: 364510 - DNA, 16 bp, M. musculus
agttccttgtttggtt

SEQ ID NO: 364511 - DNA, 16 bp, M. musculus
agttcgaagccagtct

SEQ ID NO: 364512 - DNA, 16 bp, M. musculus
agttcgaggcagcctg

SEQ ID NO: 364513 - DNA, 16 bp, M. musculus
agttcgaggctagcct

SEQ ID NO: 364514 - DNA, 16 bp, M. musculus
agttcgaggtcagctt

SEQ ID NO: 364515 - DNA, 16 bp, M. musculus
agttctaagacagcca

SEQ ID NO: 364516 - DNA, 16 bp, M. musculus
agttctaagtcagcca

SEQ ID NO: 364517 - DNA, 16 bp, M. musculus
agttctacaccttgtt

SEQ ID NO: 364518 - DNA, 16 bp, M. musculus
agttctacagcttcat

SEQ ID NO: 364519 - DNA, 16 bp, M. musculus
agttctacatcaggat

SEQ ID NO: 364520 - DNA, 16 bp, M. musculus
agttctacatccagat

SEQ ID NO: 364521 - DNA, 16 bp, M. musculus
agttctaccatgtgtt

SEQ ID NO: 364522 - DNA, 16 bp, M. musculus
agttctacctcaagaa

SEQ ID NO: 364523 - DNA, 16 bp, M. musculus
agttctacctgcctct

SEQ ID NO: 364524 - DNA, 16 bp, M. musculus
agttctagccaaagca

SEQ ID NO: 364525 - DNA, 16 bp, M. musculus
agttctagctgtcctg

SEQ ID NO: 364526 - DNA, 16 bp, M. musculus
agttctaggacaacca

SEQ ID NO: 364527 - DNA, 16 bp, M. musculus
agttctaggacagcca

SEQ ID NO: 364528 - DNA, 16 bp, M. musculus
agttctaggatagcca

SEQ ID NO: 364529 - DNA, 16 bp, M. musculus
agttctaggattaaag

SEQ ID NO: 364530 - DNA, 16 bp, M. musculus
agttctaggccagcct

SEQ ID NO: 364531 - DNA, 16 bp, M. musculus
agttctaggccagctt

SEQ ID NO: 364532 - DNA, 16 bp, M. musculus
agttctaggtcagcta

SEQ ID NO: 364533 - DNA, 16 bp, M. musculus
agttctcaacctgtgg

SEQ ID NO: 364534 - DNA, 16 bp, M. musculus
agttctcaaccttcct

SEQ ID NO: 364535 - DNA, 16 bp, M. musculus
agttctcagccccatt

SEQ ID NO: 364536 - DNA, 16 bp, M. musculus
agttctccatacccaa

SEQ ID NO: 364537 - DNA, 16 bp, M. musculus
agttctccatctttgt

SEQ ID NO: 364538 - DNA, 16 bp, M. musculus
agttctccatggctgc

SEQ ID NO: 364539 - DNA, 16 bp, M. musculus
agttctcccaccacaa

SEQ ID NO: 364540 - DNA, 16 bp, M. musculus
agttctcccaccacag

SEQ ID NO: 364541 - DNA, 16 bp, M. musculus
agttctcctttatttt

SEQ ID NO: 364542 - DNA, 16 bp, M. musculus
agttctctcctaccat

SEQ ID NO: 364543 - DNA, 16 bp, M. musculus
agttctctctttgttg

SEQ ID NO: 364544 - DNA, 16 bp, M. musculus
agttctctgcaccaag

SEQ ID NO: 364545 - DNA, 16 bp, M. musculus
agttctctgtctttgt

SEQ ID NO: 364546 - DNA, 16 bp, M. musculus
agttctctgtgtgttt

SEQ ID NO: 364547 - DNA, 16 bp, M. musculus
agttctcttcttccac

SEQ ID NO: 364548 - DNA, 16 bp, M. musculus
agttctctttctttgt

SEQ ID NO: 364549 - DNA, 16 bp, M. musculus
agttctctttttccac

SEQ ID NO: 364550 - DNA, 16 bp, M. musculus
agttctgcagaaacta

SEQ ID NO: 364551 - DNA, 16 bp, M. musculus
agttctgcagtgactt

SEQ ID NO: 364552 - DNA, 16 bp, M. musculus
agttctgccctctgta

SEQ ID NO: 364553 - DNA, 16 bp, M. musculus
agttctgcttcttgct

SEQ ID NO: 364554 - DNA, 16 bp, M. musculus
agttctggaagctgga

SEQ ID NO: 364555 - DNA, 16 bp, M. musculus
agttctggaagcttct

SEQ ID NO: 364556 - DNA, 16 bp, M. musculus
agttctggctggcctg

SEQ ID NO: 364557 - DNA, 16 bp, M. musculus
agttctgggaaacaga

SEQ ID NO: 364558 - DNA, 16 bp, M. musculus
agttctgggacaacca

SEQ ID NO: 364559 - DNA, 16 bp, M. musculus
agttctgggacagcta

SEQ ID NO: 364560 - DNA, 16 bp, M. musculus
agttctgggactaaag

SEQ ID NO: 364561 - DNA, 16 bp, M. musculus
agttctgggatcaaag

SEQ ID NO: 364562 - DNA, 16 bp, M. musculus
agttctgggattaaag

SEQ ID NO: 364563 - DNA, 16 bp, M. musculus
agttctgggattagag

SEQ ID NO: 364564 - DNA, 16 bp, M. musculus
agttctgggattatag

SEQ ID NO: 364565 - DNA, 16 bp, M. musculus
agttctgggattccag

SEQ ID NO: 364566 - DNA, 16 bp, M. musculus
agttctgggccaacct

SEQ ID NO: 364567 - DNA, 17 bp, M. musculus
agttctgggctcggggt

SEQ ID NO: 364568 - DNA, 16 bp, M. musculus
agttctgggggtgatt

SEQ ID NO: 364569 - DNA, 16 bp, M. musculus
agttctggggtccctg

SEQ ID NO: 364570 - DNA, 16 bp, M. musculus
agttctggggttacag

SEQ ID NO: 364571 - DNA, 16 bp, M. musculus
agttctggggttactg

SEQ ID NO: 364572 - DNA, 16 bp, M. musculus
agttctgtacctaaat

SEQ ID NO: 364573 - DNA, 16 bp, M. musculus
agttctgtgaactgta

SEQ ID NO: 364574 - DNA, 16 bp, M. musculus
agttctgtgaagaatg

SEQ ID NO: 364575 - DNA, 16 bp, M. musculus
agttctgtgaatcatg

SEQ ID NO: 364576 - DNA, 16 bp, M. musculus
agttctgtgactctaa

SEQ ID NO: 364577 - DNA, 16 bp, M. musculus
agttcttaacaataaa

SEQ ID NO: 364578 - DNA, 16 bp, M. musculus
agttcttacattcttt

SEQ ID NO: 364579 - DNA, 16 bp, M. musculus
agttcttactcaggct

SEQ ID NO: 364580 - DNA, 16 bp, M. musculus
agttcttagcacccac

SEQ ID NO: 364581 - DNA, 16 bp, M. musculus
agttcttcaaagacat

SEQ ID NO: 364582 - DNA, 16 bp, M. musculus
agttcttcacagaaat

SEQ ID NO: 364583 - DNA, 16 bp, M. musculus
agttcttcacagagat

SEQ ID NO: 364584 - DNA, 16 bp, M. musculus
agttcttcctcagcca

SEQ ID NO: 364585 - DNA, 16 bp, M. musculus
agttcttccttccttc

SEQ ID NO: 364586 - DNA, 16 bp, M. musculus
agttcttctaacagca

SEQ ID NO: 364587 - DNA, 16 bp, M. musculus
agttcttctattgttg

SEQ ID NO: 364588 - DNA, 16 bp, M. musculus
agttcttcttcttctt

SEQ ID NO: 364589 - DNA, 16 bp, M. musculus
agttcttggaaacaga

SEQ ID NO: 364590 - DNA, 16 bp, M. musculus
agttcttgtcatgcag

SEQ ID NO: 364591 - DNA, 16 bp, M. musculus
agttctttaatttgta

SEQ ID NO: 364592 - DNA, 16 bp, M. musculus
agttctttcagacctt

SEQ ID NO: 364593 - DNA, 16 bp, M. musculus
agttctttgtacattt

SEQ ID NO: 364594 - DNA, 16 bp, M. musculus
agttctttgtatatgt

SEQ ID NO: 364595 - DNA, 16 bp, M. musculus
agttcttttagaaagg

SEQ ID NO: 364596 - DNA, 16 bp, M. musculus
agttcttttcaaacta

SEQ ID NO: 364597 - DNA, 16 bp, M. musculus
agttcttttgccaaga

SEQ ID NO: 364598 - DNA, 23 bp, M. musculus
agttgaaaatcttcattctcatc

SEQ ID NO: 364599 - DNA, 16 bp, M. musculus
agttgaaagtcagcct

SEQ ID NO: 364600 - DNA, 16 bp, M. musculus
agttgaaggccagcct

SEQ ID NO: 364601 - DNA, 16 bp, M. musculus
agttgaaggtgctggt

SEQ ID NO: 364602 - DNA, 16 bp, M. musculus
agttgacaaccaagaa

SEQ ID NO: 364603 - DNA, 16 bp, M. musculus
agttgacagccaagaa

SEQ ID NO: 364604 - DNA, 16 bp, M. musculus
agttgacagtgaagat

SEQ ID NO: 364605 - DNA, 16 bp, M. musculus
agttgacctctggcct

SEQ ID NO: 364606 - DNA, 16 bp, M. musculus
agttgagaactgctgc

SEQ ID NO: 364607 - DNA, 16 bp, M. musculus
agttgagatttctctg

SEQ ID NO: 364608 - DNA, 16 bp, M. musculus
agttgaggatggcctt

SEQ ID NO: 364609 - DNA, 16 bp, M. musculus
agttgaggcaagagga

SEQ ID NO: 364610 - DNA, 16 bp, M. musculus
agttgaggcagaagga

SEQ ID NO: 364611 - DNA, 16 bp, M. musculus
agttgaggttcctctt

SEQ ID NO: 364612 - DNA, 16 bp, M. musculus
agttgagtgcgcgcaa

SEQ ID NO: 364613 - DNA, 16 bp, M. musculus
agttgatgctgttggt

SEQ ID NO: 364614 - DNA, 16 bp, M. musculus
agttgattcagaactc

SEQ ID NO: 364615 - DNA, 16 bp, M. musculus
agttgattctgtgggc

SEQ ID NO: 364616 - DNA, 16 bp, M. musculus
agttgattctttcctt

SEQ ID NO: 364617 - DNA, 16 bp, M. musculus
agttgcaaatagcttc

SEQ ID NO: 364618 - DNA, 16 bp, M. musculus
agttgcagacagttgt

SEQ ID NO: 364619 - DNA, 16 bp, M. musculus
agttgcagagacagag

SEQ ID NO: 364620 - DNA, 16 bp, M. musculus
agttgcagagacaggg

SEQ ID NO: 364621 - DNA, 16 bp, M. musculus
agttgcagcagaagac

SEQ ID NO: 364622 - DNA, 16 bp, M. musculus
agttgcagcagaagat

SEQ ID NO: 364623 - DNA, 16 bp, M. musculus
agttgcaggctagcct

SEQ ID NO: 364624 - DNA, 16 bp, M. musculus
agttgcatatgtagaa

SEQ ID NO: 364625 - DNA, 24 bp, M. musculus
agttgccaaggacagccacaggct

SEQ ID NO: 364626 - DNA, 16 bp, M. musculus
agttgcccaggttggc

SEQ ID NO: 364627 - DNA, 16 bp, M. musculus
agttgccctctgacct

SEQ ID NO: 364628 - DNA, 16 bp, M. musculus
agttgcctcactttgg

SEQ ID NO: 364629 - DNA, 16 bp, M. musculus
agttgcctcggtcatg

SEQ ID NO: 364630 - DNA, 16 bp, M. musculus
agttgcctgacaccca

SEQ ID NO: 364631 - DNA, 16 bp, M. musculus
agttgctatggtcatg

SEQ ID NO: 364632 - DNA, 16 bp, M. musculus
agttgctcagtcccac

SEQ ID NO: 364633 - DNA, 16 bp, M. musculus
agttgctggaatttga

SEQ ID NO: 364634 - DNA, 16 bp, M. musculus
agttgctggctggacc

SEQ ID NO: 364635 - DNA, 16 bp, M. musculus
agttgctgggaattaa

SEQ ID NO: 364636 - DNA, 17 bp, M. musculus
agttgctgtctatgtag

SEQ ID NO: 364637 - DNA, 16 bp, M. musculus
agttgcttctgtccat

SEQ ID NO: 364638 - DNA, 16 bp, M. musculus
agttgctttggttatg

SEQ ID NO: 364639 - DNA, 16 bp, M. musculus
agttgctttgttttgt

SEQ ID NO: 364640 - DNA, 16 bp, M. musculus
agttggaacagtgctg

SEQ ID NO: 364641 - DNA, 16 bp, M. musculus
agttggaagccagcct

SEQ ID NO: 364642 - DNA, 16 bp, M. musculus
agttggaaggccccac

SEQ ID NO: 364643 - DNA, 16 bp, M. musculus
agttggaagtcagcct

SEQ ID NO: 364644 - DNA, 16 bp, M. musculus
agttggaatgttgcag

SEQ ID NO: 364645 - DNA, 16 bp, M. musculus
agttggaattctgttt

SEQ ID NO: 364646 - DNA, 16 bp, M. musculus
agttggaccagcacca

SEQ ID NO: 364647 - DNA, 16 bp, M. musculus
agttggagaagtgcct

SEQ ID NO: 364648 - DNA, 16 bp, M. musculus
agttggagccatgtgt

SEQ ID NO: 364649 - DNA, 16 bp, M. musculus
agttggagggcagcct

SEQ ID NO: 364650 - DNA, 16 bp, M. musculus
agttggatctcataga

SEQ ID NO: 364651 - DNA, 16 bp, M. musculus
agttggcaaaatgctt

SEQ ID NO: 364652 - DNA, 16 bp, M. musculus
agttggcatcctgttc

SEQ ID NO: 364653 - DNA, 16 bp, M. musculus
agttggctctctcctt

SEQ ID NO: 364654 - DNA, 16 bp, M. musculus
agttggctgtggcctg

SEQ ID NO: 364655 - DNA, 16 bp, M. musculus
agttgggactctgtct

SEQ ID NO: 364656 - DNA, 16 bp, M. musculus
agttgggcgcacgcaa

SEQ ID NO: 364657 - DNA, 16 bp, M. musculus
agttgggcgcgcgcaa

SEQ ID NO: 364658 - DNA, 16 bp, M. musculus
agttgggctagtcact

SEQ ID NO: 364659 - DNA, 16 bp, M. musculus
agttgggctggtgaga

SEQ ID NO: 364660 - DNA, 16 bp, M. musculus
agttggggaagaaagg

SEQ ID NO: 364661 - DNA, 16 bp, M. musculus
agttggggaaggaaag

SEQ ID NO: 364662 - DNA, 16 bp, M. musculus
agttggggaggaaaga

SEQ ID NO: 364663 - DNA, 16 bp, M. musculus
agttggggatgaaagg

SEQ ID NO: 364664 - DNA, 16 bp, M. musculus
agttgggggaagaatt

SEQ ID NO: 364665 - DNA, 16 bp, M. musculus
agttgggggctgggat

SEQ ID NO: 364666 - DNA, 16 bp, M. musculus
agttgggttcccagca

SEQ ID NO: 364667 - DNA, 16 bp, M. musculus
agttggtaaagtgctg

SEQ ID NO: 364668 - DNA, 16 bp, M. musculus
agttggtaccagggag

SEQ ID NO: 364669 - DNA, 16 bp, M. musculus
agttggtagcttttat

SEQ ID NO: 364670 - DNA, 16 bp, M. musculus
agttggtcttccttct

SEQ ID NO: 364671 - DNA, 16 bp, M. musculus
agttggttcctgggat

SEQ ID NO: 364672 - DNA, 16 bp, M. musculus
agttggttttctcctt

SEQ ID NO: 364673 - DNA, 16 bp, M. musculus
agttggttttctttaa

SEQ ID NO: 364674 - DNA, 16 bp, M. musculus
agttgtcagatgaacc

SEQ ID NO: 364675 - DNA, 16 bp, M. musculus
agttgtcatctgactt

SEQ ID NO: 364676 - DNA, 16 bp, M. musculus
agttgtcccctgaccc

SEQ ID NO: 364677 - DNA, 16 bp, M. musculus
agttgtcccctggcct

SEQ ID NO: 364678 - DNA, 16 bp, M. musculus
agttgtcctctgatgt

SEQ ID NO: 364679 - DNA, 16 bp, M. musculus
agttgtcctctggcct

SEQ ID NO: 364680 - DNA, 16 bp, M. musculus
agttgtgagccaccat

SEQ ID NO: 364681 - DNA, 16 bp, M. musculus
agttgtgagctgccac

SEQ ID NO: 364682 - DNA, 16 bp, M. musculus
agttgtgaggcaccat

SEQ ID NO: 364683 - DNA, 16 bp, M. musculus
agttgtgctaaggtct

SEQ ID NO: 364684 - DNA, 16 bp, M. musculus
agttgtggaatttctt

SEQ ID NO: 364685 - DNA, 16 bp, M. musculus
agttgtgtattttaaa

SEQ ID NO: 364686 - DNA, 28 bp, M. musculus
agttgtgtgttgggcccaggcatgcttc

SEQ ID NO: 364687 - DNA, 16 bp, M. musculus
agttgtgttcctctca

SEQ ID NO: 364688 - DNA, 16 bp, M. musculus
agttgttaacctttac

SEQ ID NO: 364689 - DNA, 16 bp, M. musculus
agttgttagaattgtc

SEQ ID NO: 364690 - DNA, 17 bp, M. musculus
agttgttatagttgtct

SEQ ID NO: 364691 - DNA, 16 bp, M. musculus
agttgttctgtgacct

SEQ ID NO: 364692 - DNA, 16 bp, M. musculus
agttgtttccctttgt

SEQ ID NO: 364693 - DNA, 16 bp, M. musculus
agttgtttctcttctt

SEQ ID NO: 364694 - DNA, 16 bp, M. musculus
agttgttttgatttgc

SEQ ID NO: 364695 - DNA, 16 bp, M. musculus
agttgttttgattttc

SEQ ID NO: 364696 - DNA, 16 bp, M. musculus
agttgtttttttccta

SEQ ID NO: 364697 - DNA, 16 bp, M. musculus
agtttaaaaataaaca

SEQ ID NO: 364698 - DNA, 16 bp, M. musculus
agtttaaaagagagaa

SEQ ID NO: 364699 - DNA, 16 bp, M. musculus
agtttaaaataaacaa

SEQ ID NO: 364700 - DNA, 16 bp, M. musculus
agtttaaagaaaagcc

SEQ ID NO: 364701 - DNA, 16 bp, M. musculus
agtttaaagccagctt

SEQ ID NO: 364702 - DNA, 16 bp, M. musculus
agtttaaagccatcct

SEQ ID NO: 364703 - DNA, 16 bp, M. musculus
agtttaaaggtctggt

SEQ ID NO: 364704 - DNA, 16 bp, M. musculus
agtttaaagtcatcct

SEQ ID NO: 364705 - DNA, 16 bp, M. musculus
agtttaacaacaacaa

SEQ ID NO: 364706 - DNA, 16 bp, M. musculus
agtttaacaagcagaa

SEQ ID NO: 364707 - DNA, 16 bp, M. musculus
agtttaagatcatcct

SEQ ID NO: 364708 - DNA, 16 bp, M. musculus
agtttaaggccaacct

SEQ ID NO: 364709 - DNA, 16 bp, M. musculus
agtttaaggccagctt

SEQ ID NO: 364710 - DNA, 16 bp, M. musculus
agtttaaggtcagcct

SEQ ID NO: 364711 - DNA, 16 bp, M. musculus
agtttaatgaaaagga

SEQ ID NO: 364712 - DNA, 16 bp, M. musculus
agtttaatttccagca

SEQ ID NO: 364713 - DNA, 16 bp, M. musculus
agtttacaacagagaa

SEQ ID NO: 364714 - DNA, 16 bp, M. musculus
agtttacacaatatct

SEQ ID NO: 364715 - DNA, 16 bp, M. musculus
agtttacatagtgagt

SEQ ID NO: 364716 - DNA, 16 bp, M. musculus
agtttacatttttaaa

SEQ ID NO: 364717 - DNA, 16 bp, M. musculus
agtttactcagggcat

SEQ ID NO: 364718 - DNA, 16 bp, M. musculus
agtttagaggttcagt

SEQ ID NO: 364719 - DNA, 16 bp, M. musculus
agtttagagtccttct

SEQ ID NO: 364720 - DNA, 52 bp, M. musculus
agtttagatataaatggtatgatcaagctttgtaatgaggtagatgtgtttt

SEQ ID NO: 364721 - DNA, 16 bp, M. musculus
agtttagtgaaaatga

SEQ ID NO: 364722 - DNA, 16 bp, M. musculus
agtttagtgttttatg

SEQ ID NO: 364723 - DNA, 16 bp, M. musculus
agtttatgatttgatt

SEQ ID NO: 364724 - DNA, 16 bp, M. musculus
agtttatttagcttat

SEQ ID NO: 364725 - DNA, 16 bp, M. musculus
agtttcaaagaactaa

SEQ ID NO: 364726 - DNA, 16 bp, M. musculus
agtttcaagccagcct

SEQ ID NO: 364727 - DNA, 16 bp, M. musculus
agtttcactatgtagc

SEQ ID NO: 364728 - DNA, 16 bp, M. musculus
agtttcagaagagact

SEQ ID NO: 364729 - DNA, 16 bp, M. musculus
agtttcagagagtgag

SEQ ID NO: 364730 - DNA, 16 bp, M. musculus
agtttcagaggatcag

SEQ ID NO: 364731 - DNA, 16 bp, M. musculus
agtttcaggacaccca

SEQ ID NO: 364732 - DNA, 16 bp, M. musculus
agtttcaggacagcca

SEQ ID NO: 364733 - DNA, 16 bp, M. musculus
agtttcaggatagcca

SEQ ID NO: 364734 - DNA, 16 bp, M. musculus
agtttcaggccagtga

SEQ ID NO: 364735 - DNA, 17 bp, M. musculus
agtttcagtatctctgg

SEQ ID NO: 364736 - DNA, 17 bp, M. musculus
agtttcagtgatcagag

SEQ ID NO: 364737 - DNA, 17 bp, M. musculus
agtttcagtggtcagag

SEQ ID NO: 364738 - DNA, 16 bp, M. musculus
agtttcagtgttcaga

SEQ ID NO: 364739 - DNA, 16 bp, M. musculus
agtttcatgaagtttt

SEQ ID NO: 364740 - DNA, 16 bp, M. musculus
agtttccaaatgctga

SEQ ID NO: 364741 - DNA, 16 bp, M. musculus
agtttccagacttcct

SEQ ID NO: 364742 - DNA, 16 bp, M. musculus
agtttcctgtgtttag

SEQ ID NO: 364743 - DNA, 16 bp, M. musculus
agtttccttataaaaa

SEQ ID NO: 364744 - DNA, 16 bp, M. musculus
agtttccttgaaactc

SEQ ID NO: 364745 - DNA, 16 bp, M. musculus
agtttcctttcttctt

SEQ ID NO: 364746 - DNA, 16 bp, M. musculus
agtttctagaaggaag

SEQ ID NO: 364747 - DNA, 16 bp, M. musculus
agtttctcagaagatt

SEQ ID NO: 364748 - DNA, 16 bp, M. musculus
agtttctccagaagca

SEQ ID NO: 364749 - DNA, 16 bp, M. musculus
agtttctcctccaaaa

SEQ ID NO: 364750 - DNA, 16 bp, M. musculus
agtttctcctccttcc

SEQ ID NO: 364751 - DNA, 16 bp, M. musculus
agtttctcctctgcaa

SEQ ID NO: 364752 - DNA, 16 bp, M. musculus
agtttctctcaatggc

SEQ ID NO: 364753 - DNA, 16 bp, M. musculus
agtttctctgtatagt

SEQ ID NO: 364754 - DNA, 16 bp, M. musculus
agtttctctgtgtagc

SEQ ID NO: 364755 - DNA, 16 bp, M. musculus
agtttctgactattat

SEQ ID NO: 364756 - DNA, 16 bp, M. musculus
agtttctgctccacat

SEQ ID NO: 364757 - DNA, 16 bp, M. musculus
agtttctggatgacct

SEQ ID NO: 364758 - DNA, 16 bp, M. musculus
agtttctgtgtctctg

SEQ ID NO: 364759 - DNA, 16 bp, M. musculus
agtttctgtttcaatt

SEQ ID NO: 364760 - DNA, 16 bp, M. musculus
agtttctgtttgattt

SEQ ID NO: 364761 - DNA, 16 bp, M. musculus
agtttcttcagttctt

SEQ ID NO: 364762 - DNA, 16 bp, M. musculus
agtttcttcctgcttt

SEQ ID NO: 364763 - DNA, 16 bp, M. musculus
agtttctttatccatt

SEQ ID NO: 364764 - DNA, 16 bp, M. musculus
agtttcttttggaggc

SEQ ID NO: 364765 - DNA, 16 bp, M. musculus
agtttctttttaatat

SEQ ID NO: 364766 - DNA, 16 bp, M. musculus
agtttcttttttaaaa

SEQ ID NO: 364767 - DNA, 16 bp, M. musculus
agtttcttttttgagg

SEQ ID NO: 364768 - DNA, 16 bp, M. musculus
agtttgaaaatatttt

SEQ ID NO: 364769 - DNA, 16 bp, M. musculus
agtttgaaaccagtct

SEQ ID NO: 364770 - DNA, 16 bp, M. musculus
agtttgaaatcagcct

SEQ ID NO: 364771 - DNA, 16 bp, M. musculus
agtttgaaccccagaa

SEQ ID NO: 364772 - DNA, 16 bp, M. musculus
agtttgaagacagcct

SEQ ID NO: 364773 - DNA, 16 bp, M. musculus
agtttgaagccagact

SEQ ID NO: 364774 - DNA, 16 bp, M. musculus
agtttgaagctaagat

SEQ ID NO: 364775 - DNA, 16 bp, M. musculus
agtttgaagtcagcct

SEQ ID NO: 364776 - DNA, 16 bp, M. musculus
agtttgaagtcagtct

SEQ ID NO: 364777 - DNA, 16 bp, M. musculus
agtttgaagtcatcct

SEQ ID NO: 364778 - DNA, 16 bp, M. musculus
agtttgaataggtttg

SEQ ID NO: 364779 - DNA, 16 bp, M. musculus
agtttgacagagccag

SEQ ID NO: 364780 - DNA, 16 bp, M. musculus
agtttgactgtttcct

SEQ ID NO: 364781 - DNA, 16 bp, M. musculus
agtttgagaccaacct

SEQ ID NO: 364782 - DNA, 16 bp, M. musculus
agtttgagaccagcat

SEQ ID NO: 364783 - DNA, 16 bp, M. musculus
agtttgagactaacct

SEQ ID NO: 364784 - DNA, 16 bp, M. musculus
agtttgagccagaaaa

SEQ ID NO: 364785 - DNA, 16 bp, M. musculus
agtttgagccagaaca

SEQ ID NO: 364786 - DNA, 16 bp, M. musculus
agtttgaggacaacct

SEQ ID NO: 364787 - DNA, 16 bp, M. musculus
agtttgaggacagcca

SEQ ID NO: 364788 - DNA, 16 bp, M. musculus
agtttgaggcaagcct

SEQ ID NO: 364789 - DNA, 16 bp, M. musculus
agtttgaggcagcctg

SEQ ID NO: 364790 - DNA, 16 bp, M. musculus
agtttgaggccaatct

SEQ ID NO: 364791 - DNA, 16 bp, M. musculus
agtttgaggccagcat

SEQ ID NO: 364792 - DNA, 16 bp, M. musculus
agtttgaggccagcct

SEQ ID NO: 364793 - DNA, 16 bp, M. musculus
agtttgaggccagcgt

SEQ ID NO: 364794 - DNA, 16 bp, M. musculus
agtttgaggccaggca

SEQ ID NO: 364795 - DNA, 16 bp, M. musculus
agtttgaggccagttt

SEQ ID NO: 364796 - DNA, 16 bp, M. musculus
agtttgaggcctgcct

SEQ ID NO: 364797 - DNA, 16 bp, M. musculus
agtttgaggctaacct

SEQ ID NO: 364798 - DNA, 16 bp, M. musculus
agtttgaggctaccct

SEQ ID NO: 364799 - DNA, 16 bp, M. musculus
agtttgaggctggcct

SEQ ID NO: 364800 - DNA, 16 bp, M. musculus
agtttgaggtcagctt

SEQ ID NO: 364801 - DNA, 16 bp, M. musculus
agtttgaggtcatcct

SEQ ID NO: 364802 - DNA, 16 bp, M. musculus
agtttgagtccagcct

SEQ ID NO: 364803 - DNA, 16 bp, M. musculus
agtttgagttagaatg

SEQ ID NO: 364804 - DNA, 16 bp, M. musculus
agtttgagttttcttt

SEQ ID NO: 364805 - DNA, 16 bp, M. musculus
agtttgatcccaagaa

SEQ ID NO: 364806 - DNA, 16 bp, M. musculus
agtttgatccccagaa

SEQ ID NO: 364807 - DNA, 16 bp, M. musculus
agtttgatccccagga

SEQ ID NO: 364808 - DNA, 16 bp, M. musculus
agtttgatgaaaatga

SEQ ID NO: 364809 - DNA, 16 bp, M. musculus
agtttgatgccagcct

SEQ ID NO: 364810 - DNA, 16 bp, M. musculus
agtttgattatgtgat

SEQ ID NO: 364811 - DNA, 16 bp, M. musculus
agtttgattattttcc

SEQ ID NO: 364812 - DNA, 16 bp, M. musculus
agtttgattcccaaaa

SEQ ID NO: 364813 - DNA, 16 bp, M. musculus
agtttgattcccagaa

SEQ ID NO: 364814 - DNA, 16 bp, M. musculus
agtttgatttccagga

SEQ ID NO: 364815 - DNA, 16 bp, M. musculus
agtttgattttcagca

SEQ ID NO: 364816 - DNA, 16 bp, M. musculus
agtttgcaacagatgg

SEQ ID NO: 364817 - DNA, 16 bp, M. musculus
agtttgcaagacctaa

SEQ ID NO: 364818 - DNA, 16 bp, M. musculus
agtttgcaaggatttt

SEQ ID NO: 364819 - DNA, 16 bp, M. musculus
agtttgcagagagcaa

SEQ ID NO: 364820 - DNA, 16 bp, M. musculus
agtttgcctgcagaga

SEQ ID NO: 364821 - DNA, 16 bp, M. musculus
agtttgcttttttata

SEQ ID NO: 364822 - DNA, 16 bp, M. musculus
agtttggaagatgaag

SEQ ID NO: 364823 - DNA, 16 bp, M. musculus
agtttggaccagaaaa

SEQ ID NO: 364824 - DNA, 16 bp, M. musculus
agtttggagctgggat

SEQ ID NO: 364825 - DNA, 16 bp, M. musculus
agtttggcagggagct

SEQ ID NO: 364826 - DNA, 16 bp, M. musculus
agtttggctgccagca

SEQ ID NO: 364827 - DNA, 16 bp, M. musculus
agtttggcttccagca

SEQ ID NO: 364828 - DNA, 16 bp, M. musculus
agtttggggaggaaag

SEQ ID NO: 364829 - DNA, 16 bp, M. musculus
agtttggggctagcct

SEQ ID NO: 364830 - DNA, 16 bp, M. musculus
agtttggtggttcttc

SEQ ID NO: 364831 - DNA, 16 bp, M. musculus
agtttggtgttcttgt

SEQ ID NO: 364832 - DNA, 16 bp, M. musculus
agtttggttcttagca

SEQ ID NO: 364833 - DNA, 16 bp, M. musculus
agtttggtttctccat

SEQ ID NO: 364834 - DNA, 16 bp, M. musculus
agtttgtagaaggaaa

SEQ ID NO: 364835 - DNA, 16 bp, M. musculus
agtttgtcaggcttgg

SEQ ID NO: 364836 - DNA, 16 bp, M. musculus
agtttgtctattttga

SEQ ID NO: 364837 - DNA, 17 bp, M. musculus
agtttgtgaagaactgg

SEQ ID NO: 364838 - DNA, 16 bp, M. musculus
agtttgtgagtgtgtg

SEQ ID NO: 364839 - DNA, 16 bp, M. musculus
agtttgtggagaacaa

SEQ ID NO: 364840 - DNA, 16 bp, M. musculus
agtttgtggagaactg

SEQ ID NO: 364841 - DNA, 16 bp, M. musculus
agtttgtgtcaagctg

SEQ ID NO: 364842 - DNA, 16 bp, M. musculus
agtttgttcatttgtt

SEQ ID NO: 364843 - DNA, 16 bp, M. musculus
agtttgttcctcctgt

SEQ ID NO: 364844 - DNA, 16 bp, M. musculus
agtttgttgctgcttc

SEQ ID NO: 364845 - DNA, 16 bp, M. musculus
agtttgtttatatagt

SEQ ID NO: 364846 - DNA, 16 bp, M. musculus
agtttgtttcccagaa

SEQ ID NO: 364847 - DNA, 16 bp, M. musculus
agttttaaaaaaatgt

SEQ ID NO: 364848 - DNA, 16 bp, M. musculus
agttttaaaaatctat

SEQ ID NO: 364849 - DNA, 16 bp, M. musculus
agttttaaattaagga

SEQ ID NO: 364850 - DNA, 16 bp, M. musculus
agttttaagaaattaa

SEQ ID NO: 364851 - DNA, 16 bp, M. musculus
agttttaagtgttttg

SEQ ID NO: 364852 - DNA, 16 bp, M. musculus
agttttacagaaacag

SEQ ID NO: 364853 - DNA, 16 bp, M. musculus
agttttacagcctgaa

SEQ ID NO: 364854 - DNA, 16 bp, M. musculus
agttttacatcttcat

SEQ ID NO: 364855 - DNA, 16 bp, M. musculus
agttttagaggttcag

SEQ ID NO: 364856 - DNA, 16 bp, M. musculus
agttttagatattaaa

SEQ ID NO: 364857 - DNA, 16 bp, M. musculus
agttttagctcccttg

SEQ ID NO: 364858 - DNA, 16 bp, M. musculus
agttttagctcctttg

SEQ ID NO: 364859 - DNA, 16 bp, M. musculus
agttttaggacagcca

SEQ ID NO: 364860 - DNA, 16 bp, M. musculus
agttttaggccagcct

SEQ ID NO: 364861 - DNA, 16 bp, M. musculus
agttttatatcaactt

SEQ ID NO: 364862 - DNA, 16 bp, M. musculus
agttttatattgaggt

SEQ ID NO: 364863 - DNA, 16 bp, M. musculus
agttttatccctagaa

SEQ ID NO: 364864 - DNA, 16 bp, M. musculus
agttttatgtcaactt

SEQ ID NO: 364865 - DNA, 16 bp, M. musculus
agttttatgtcaattt

SEQ ID NO: 364866 - DNA, 16 bp, M. musculus
agttttcaaacatatg

SEQ ID NO: 364867 - DNA, 55 bp, M. musculus
agttttcaggagttgtttcaggccagaggagtaaggcttgaagtacaattagtaa

SEQ ID NO: 364868 - DNA, 16 bp, M. musculus
agttttcatgaccaat

SEQ ID NO: 364869 - DNA, 16 bp, M. musculus
agttttccaagaaaat

SEQ ID NO: 364870 - DNA, 16 bp, M. musculus
agttttcctctcagga

SEQ ID NO: 364871 - DNA, 16 bp, M. musculus
agttttcctcttaaca

SEQ ID NO: 364872 - DNA, 16 bp, M. musculus
agttttcctcttacca

SEQ ID NO: 364873 - DNA, 16 bp, M. musculus
agttttcctctttctc

SEQ ID NO: 364874 - DNA, 16 bp, M. musculus
agttttccttctagta

SEQ ID NO: 364875 - DNA, 16 bp, M. musculus
agttttcctttccttt

SEQ ID NO: 364876 - DNA, 16 bp, M. musculus
agttttctaaaaaaat

SEQ ID NO: 364877 - DNA, 16 bp, M. musculus
agttttctcaacagca

SEQ ID NO: 364878 - DNA, 16 bp, M. musculus
agttttctccatgaag

SEQ ID NO: 364879 - DNA, 16 bp, M. musculus
agttttctcctgcttc

SEQ ID NO: 364880 - DNA, 16 bp, M. musculus
agttttctgcttccct

SEQ ID NO: 364881 - DNA, 16 bp, M. musculus
agttttcttcctgttc

SEQ ID NO: 364882 - DNA, 16 bp, M. musculus
agttttcttctgtctt

SEQ ID NO: 364883 - DNA, 16 bp, M. musculus
agttttcttggtttct

SEQ ID NO: 364884 - DNA, 16 bp, M. musculus
agttttctttaaagat

SEQ ID NO: 364885 - DNA, 16 bp, M. musculus
agttttctttctttga

SEQ ID NO: 364886 - DNA, 16 bp, M. musculus
agttttcttttttaaa

SEQ ID NO: 364887 - DNA, 16 bp, M. musculus
agttttgaaaagaaaa

SEQ ID NO: 364888 - DNA, 16 bp, M. musculus
agttttgactgtgctt

SEQ ID NO: 364889 - DNA, 16 bp, M. musculus
agttttgattagttta

SEQ ID NO: 364890 - DNA, 16 bp, M. musculus
agttttgtggcaaaat

SEQ ID NO: 364891 - DNA, 16 bp, M. musculus
agttttgttaaatata

SEQ ID NO: 364892 - DNA, 16 bp, M. musculus
agttttgtttcctgtt

SEQ ID NO: 364893 - DNA, 16 bp, M. musculus
agtttttaaaaactta

SEQ ID NO: 364894 - DNA, 16 bp, M. musculus
agtttttaatcacagt

SEQ ID NO: 364895 - DNA, 16 bp, M. musculus
agtttttatagatacc

SEQ ID NO: 364896 - DNA, 16 bp, M. musculus
agtttttatcacagtt

SEQ ID NO: 364897 - DNA, 16 bp, M. musculus
agtttttccagcaggg

SEQ ID NO: 364898 - DNA, 16 bp, M. musculus
agtttttctacatttt

SEQ ID NO: 364899 - DNA, 16 bp, M. musculus
agtttttcttctagaa

SEQ ID NO: 364900 - DNA, 16 bp, M. musculus
agtttttgctatttta

SEQ ID NO: 364901 - DNA, 16 bp, M. musculus
agtttttgttttatca

SEQ ID NO: 364902 - DNA, 16 bp, M. musculus
agttttttaatgaaca

SEQ ID NO: 364903 - DNA, 16 bp, M. musculus
agttttttgagacagg

SEQ ID NO: 364904 - DNA, 17 bp, M. musculus
agttttttgccaagaca

SEQ ID NO: 364905 - DNA, 16 bp, M. musculus
agtttttttttccccc

SEQ ID NO: 364906 - DNA, 16 bp, M. musculus
ataaaaacaaatcttg

SEQ ID NO: 364907 - DNA, 16 bp, M. musculus
ataaaaacagacacat

SEQ ID NO: 364908 - DNA, 16 bp, M. musculus
ataaaaacaggttggc

SEQ ID NO: 364909 - DNA, 16 bp, M. musculus
ataaaaacatcaagtc

SEQ ID NO: 364910 - DNA, 16 bp, M. musculus
ataaaaaccaacattt

SEQ ID NO: 364911 - DNA, 16 bp, M. musculus
ataaaaacttcatgaa

SEQ ID NO: 364912 - DNA, 16 bp, M. musculus
ataaaaacttgtcttc

SEQ ID NO: 364913 - DNA, 16 bp, M. musculus
ataaaaagactttgga

SEQ ID NO: 364914 - DNA, 16 bp, M. musculus
ataaaaaggctgagaa

SEQ ID NO: 364915 - DNA, 16 bp, M. musculus
ataaaaataaaacttg

SEQ ID NO: 364916 - DNA, 16 bp, M. musculus
ataaaaatagatcttt

SEQ ID NO: 364917 - DNA, 16 bp, M. musculus
ataaaaatattaagct

SEQ ID NO: 364918 - DNA, 16 bp, M. musculus
ataaaaatatttccat

SEQ ID NO: 364919 - DNA, 16 bp, M. musculus
ataaaaatctcaagaa

SEQ ID NO: 364920 - DNA, 16 bp, M. musculus
ataaaaatctgaaaat

SEQ ID NO: 364921 - DNA, 16 bp, M. musculus
ataaaaatcttcattt

SEQ ID NO: 364922 - DNA, 16 bp, M. musculus
ataaaaatctttttct

SEQ ID NO: 364923 - DNA, 16 bp, M. musculus
ataaaaatgaacattt

SEQ ID NO: 364924 - DNA, 16 bp, M. musculus
ataaaaatgaagacac

SEQ ID NO: 364925 - DNA, 16 bp, M. musculus
ataaaaatgaagacat

SEQ ID NO: 364926 - DNA, 16 bp, M. musculus
ataaaaatgaatcttt

SEQ ID NO: 364927 - DNA, 16 bp, M. musculus
ataaaaatgcaaagct

SEQ ID NO: 364928 - DNA, 16 bp, M. musculus
ataaaaatgcagaatt

SEQ ID NO: 364929 - DNA, 16 bp, M. musculus
ataaaaatgtatacat

SEQ ID NO: 364930 - DNA, 16 bp, M. musculus
ataaaaatgttcaaat

SEQ ID NO: 364931 - DNA, 16 bp, M. musculus
ataaaaattacaatgt

SEQ ID NO: 364932 - DNA, 16 bp, M. musculus
ataaaaattggaaagg

SEQ ID NO: 364933 - DNA, 16 bp, M. musculus
ataaaacaaatggcag

SEQ ID NO: 364934 - DNA, 16 bp, M. musculus
ataaaacaagcatgtt

SEQ ID NO: 364935 - DNA, 22 bp, M. musculus
ataaaacaaggagaagatgtcc

SEQ ID NO: 364936 - DNA, 16 bp, M. musculus
ataaaacaccatgaca

SEQ ID NO: 364937 - DNA, 16 bp, M. musculus
ataaaacagaaaatgt

SEQ ID NO: 364938 - DNA, 16 bp, M. musculus
ataaaacagactttca

SEQ ID NO: 364939 - DNA, 16 bp, M. musculus
ataaaacagttttaaa

SEQ ID NO: 364940 - DNA, 16 bp, M. musculus
ataaaacatttagaaa

SEQ ID NO: 364941 - DNA, 16 bp, M. musculus
ataaaaccagagactg

SEQ ID NO: 364942 - DNA, 16 bp, M. musculus
ataaaacctacatggt

SEQ ID NO: 364943 - DNA, 18 bp, M. musculus
ataaaacctgcctgggaa

SEQ ID NO: 364944 - DNA, 16 bp, M. musculus
ataaaacctttcctcc

SEQ ID NO: 364945 - DNA, 16 bp, M. musculus
ataaaactagagcagg

SEQ ID NO: 364946 - DNA, 16 bp, M. musculus
ataaaactctccagca

SEQ ID NO: 364947 - DNA, 16 bp, M. musculus
ataaaactggaaaacc

SEQ ID NO: 364948 - DNA, 16 bp, M. musculus
ataaaagaaaatgcat

SEQ ID NO: 364949 - DNA, 16 bp, M. musculus
ataaaagaaagtgttt

SEQ ID NO: 364950 - DNA, 16 bp, M. musculus
ataaaagaaattctga

SEQ ID NO: 364951 - DNA, 16 bp, M. musculus
ataaaagaagatctca

SEQ ID NO: 364952 - DNA, 16 bp, M. musculus
ataaaagaagcattta

SEQ ID NO: 364953 - DNA, 16 bp, M. musculus
ataaaagaagctctgg

SEQ ID NO: 364954 - DNA, 16 bp, M. musculus
ataaaagaatttctga

SEQ ID NO: 364955 - DNA, 16 bp, M. musculus
ataaaagagagcaaag

SEQ ID NO: 364956 - DNA, 16 bp, M. musculus
ataaaagagcttctgg

SEQ ID NO: 364957 - DNA, 16 bp, M. musculus
ataaaagcaaacattt

SEQ ID NO: 364958 - DNA, 16 bp, M. musculus
ataaaagcaatctata

SEQ ID NO: 364959 - DNA, 16 bp, M. musculus
ataaaagcacacacac

SEQ ID NO: 364960 - DNA, 16 bp, M. musculus
ataaaagctttaaaaa

SEQ ID NO: 364961 - DNA, 16 bp, M. musculus
ataaaaggaactgctt

SEQ ID NO: 364962 - DNA, 16 bp, M. musculus
ataaaaggatttattt

SEQ ID NO: 364963 - DNA, 16 bp, M. musculus
ataaaagtaactcaaa

SEQ ID NO: 364964 - DNA, 16 bp, M. musculus
ataaaagtcctagaga

SEQ ID NO: 364965 - DNA, 16 bp, M. musculus
ataaaagtggctgctt

SEQ ID NO: 364966 - DNA, 16 bp, M. musculus
ataaaagttttggaaa

SEQ ID NO: 364967 - DNA, 16 bp, M. musculus
ataaaataaaaagtct

SEQ ID NO: 364968 - DNA, 16 bp, M. musculus
ataaaataaagcattt

SEQ ID NO: 364969 - DNA, 16 bp, M. musculus
ataaaataaatctttg

SEQ ID NO: 364970 - DNA, 16 bp, M. musculus
ataaaataaatgttct

SEQ ID NO: 364971 - DNA, 16 bp, M. musculus
ataaaatacatcttta

SEQ ID NO: 364972 - DNA, 16 bp, M. musculus
ataaaatactcagaaa

SEQ ID NO: 364973 - DNA, 16 bp, M. musculus
ataaaatagagtttat

SEQ ID NO: 364974 - DNA, 16 bp, M. musculus
ataaaatagcaatgaa

SEQ ID NO: 364975 - DNA, 16 bp, M. musculus
ataaaatagtacatac

SEQ ID NO: 364976 - DNA, 16 bp, M. musculus
ataaaatatctcagcg

SEQ ID NO: 364977 - DNA, 16 bp, M. musculus
ataaaatatgtacata

SEQ ID NO: 364978 - DNA, 16 bp, M. musculus
ataaaatattgactgg

SEQ ID NO: 364979 - DNA, 16 bp, M. musculus
ataaaatatttgaaca

SEQ ID NO: 364980 - DNA, 16 bp, M. musculus
ataaaatatttggttt

SEQ ID NO: 364981 - DNA, 16 bp, M. musculus
ataaaatcaatcaatc

SEQ ID NO: 364982 - DNA, 16 bp, M. musculus
ataaaatcacacactt

SEQ ID NO: 364983 - DNA, 16 bp, M. musculus
ataaaatcagaaatgg

SEQ ID NO: 364984 - DNA, 16 bp, M. musculus
ataaaatcattatcag

SEQ ID NO: 364985 - DNA, 16 bp, M. musculus
ataaaatccagaaaca

SEQ ID NO: 364986 - DNA, 16 bp, M. musculus
ataaaatccaggagct

SEQ ID NO: 364987 - DNA, 16 bp, M. musculus
ataaaatctatttctt

SEQ ID NO: 364988 - DNA, 16 bp, M. musculus
ataaaatctgaaatgt

SEQ ID NO: 364989 - DNA, 16 bp, M. musculus
ataaaatgaaaatcat

SEQ ID NO: 364990 - DNA, 16 bp, M. musculus
ataaaatgaactttca

SEQ ID NO: 364991 - DNA, 16 bp, M. musculus
ataaaatgactcttaa

SEQ ID NO: 364992 - DNA, 16 bp, M. musculus
ataaaatgacttttaa

SEQ ID NO: 364993 - DNA, 16 bp, M. musculus
ataaaatgctttaaaa

SEQ ID NO: 364994 - DNA, 16 bp, M. musculus
ataaaatgcttttaaa

SEQ ID NO: 364995 - DNA, 16 bp, M. musculus
ataaaatggaatttta

SEQ ID NO: 364996 - DNA, 16 bp, M. musculus
ataaaatggatgattt

SEQ ID NO: 364997 - DNA, 16 bp, M. musculus
ataaaatgtgttttca

SEQ ID NO: 364998 - DNA, 16 bp, M. musculus
ataaaatgttgtcctt

SEQ ID NO: 364999 - DNA, 16 bp, M. musculus
ataaaatgtttaacaa

SEQ ID NO: 365000 - DNA, 16 bp, M. musculus
ataaaatgtttttctt

SEQ ID NO: 365001 - DNA, 16 bp, M. musculus
ataaaattaactcaag

SEQ ID NO: 365002 - DNA, 16 bp, M. musculus
ataaaattaatgcaaa

SEQ ID NO: 365003 - DNA, 16 bp, M. musculus
ataaaattacaaagtt

SEQ ID NO: 365004 - DNA, 16 bp, M. musculus
ataaaattacctcata

SEQ ID NO: 365005 - DNA, 16 bp, M. musculus
ataaaattatacacac

SEQ ID NO: 365006 - DNA, 16 bp, M. musculus
ataaaattattcatgg

SEQ ID NO: 365007 - DNA, 16 bp, M. musculus
ataaaattattcttgt

SEQ ID NO: 365008 - DNA, 16 bp, M. musculus
ataaaattattgctaa

SEQ ID NO: 365009 - DNA, 16 bp, M. musculus
ataaaattattttcct

SEQ ID NO: 365010 - DNA, 16 bp, M. musculus
ataaaattattttgtc

SEQ ID NO: 365011 - DNA, 16 bp, M. musculus
ataaaattcatgcaaa

SEQ ID NO: 365012 - DNA, 16 bp, M. musculus
ataaaattcttgcaaa

SEQ ID NO: 365013 - DNA, 16 bp, M. musculus
ataaaattcttgctat

SEQ ID NO: 365014 - DNA, 16 bp, M. musculus
ataaaattgtgcagct

SEQ ID NO: 365015 - DNA, 16 bp, M. musculus
ataaaatttacttatg

SEQ ID NO: 365016 - DNA, 17 bp, M. musculus
ataaaatttgacaacaa

SEQ ID NO: 365017 - DNA, 16 bp, M. musculus
ataaaattttaaatgg

SEQ ID NO: 365018 - DNA, 16 bp, M. musculus
ataaacaaaatcagta

SEQ ID NO: 365019 - DNA, 16 bp, M. musculus
ataaacaaataaatgt

SEQ ID NO: 365020 - DNA, 16 bp, M. musculus
ataaacaacagaaatc

SEQ ID NO: 365021 - DNA, 16 bp, M. musculus
ataaacaagaacatag

SEQ ID NO: 365022 - DNA, 16 bp, M. musculus
ataaacaatttcagtg

SEQ ID NO: 365023 - DNA, 16 bp, M. musculus
ataaacacacatatct

SEQ ID NO: 365024 - DNA, 16 bp, M. musculus
ataaacacagacacac

SEQ ID NO: 365025 - DNA, 16 bp, M. musculus
ataaacacttcaactt

SEQ ID NO: 365026 - DNA, 16 bp, M. musculus
ataaacagaattctca

SEQ ID NO: 365027 - DNA, 16 bp, M. musculus
ataaacagacagacaa

SEQ ID NO: 365028 - DNA, 16 bp, M. musculus
ataaacaggatgaaaa

SEQ ID NO: 365029 - DNA, 16 bp, M. musculus
ataaacaggcttctaa

SEQ ID NO: 365030 - DNA, 16 bp, M. musculus
ataaacaggttcaatg

SEQ ID NO: 365031 - DNA, 16 bp, M. musculus
ataaacagtcaccaaa

SEQ ID NO: 365032 - DNA, 16 bp, M. musculus
ataaacatagacaatc

SEQ ID NO: 365033 - DNA, 16 bp, M. musculus
ataaacatctgtgttt

SEQ ID NO: 365034 - DNA, 16 bp, M. musculus
ataaacatcttcagca

SEQ ID NO: 365035 - DNA, 16 bp, M. musculus
ataaacattttcatta

SEQ ID NO: 365036 - DNA, 16 bp, M. musculus
ataaaccaaacagcag

SEQ ID NO: 365037 - DNA, 16 bp, M. musculus
ataaaccacacaaaga

SEQ ID NO: 365038 - DNA, 16 bp, M. musculus
ataaaccagatgtggt

SEQ ID NO: 365039 - DNA, 17 bp, M. musculus
ataaaccagggtagagg

SEQ ID NO: 365040 - DNA, 16 bp, M. musculus
ataaacccttccttcc

SEQ ID NO: 365041 - DNA, 16 bp, M. musculus
ataaaccctttctctc

SEQ ID NO: 365042 - DNA, 16 bp, M. musculus
ataaaccctttctttc

SEQ ID NO: 365043 - DNA, 16 bp, M. musculus
ataaactcttgtggtg

SEQ ID NO: 365044 - DNA, 16 bp, M. musculus
ataaactctttcttct

SEQ ID NO: 365045 - DNA, 16 bp, M. musculus
ataaactgggcagtgg

SEQ ID NO: 365046 - DNA, 16 bp, M. musculus
ataaactgggcatggt

SEQ ID NO: 365047 - DNA, 16 bp, M. musculus
ataaagaaaacccaga

SEQ ID NO: 365048 - DNA, 16 bp, M. musculus
ataaagaaaatacttt

SEQ ID NO: 365049 - DNA, 16 bp, M. musculus
ataaagaaaatgtgat

SEQ ID NO: 365050 - DNA, 16 bp, M. musculus
ataaagaaaatgtgct

SEQ ID NO: 365051 - DNA, 16 bp, M. musculus
ataaagaaaatgtggg

SEQ ID NO: 365052 - DNA, 16 bp, M. musculus
ataaagaaaatgtggt

SEQ ID NO: 365053 - DNA, 16 bp, M. musculus
ataaagaaaccctgtt

SEQ ID NO: 365054 - DNA, 16 bp, M. musculus
ataaagaaatcatgaa

SEQ ID NO: 365055 - DNA, 16 bp, M. musculus
ataaagaacaagatta

SEQ ID NO: 365056 - DNA, 16 bp, M. musculus
ataaagaacatcagca

SEQ ID NO: 365057 - DNA, 16 bp, M. musculus
ataaagaacatgtagt

SEQ ID NO: 365058 - DNA, 16 bp, M. musculus
ataaagaactcaaaac

SEQ ID NO: 365059 - DNA, 16 bp, M. musculus
ataaagaacttaagaa

SEQ ID NO: 365060 - DNA, 16 bp, M. musculus
ataaagaagtcaagaa

SEQ ID NO: 365061 - DNA, 16 bp, M. musculus
ataaagaatacatcta

SEQ ID NO: 365062 - DNA, 16 bp, M. musculus
ataaagacaaatttaa

SEQ ID NO: 365063 - DNA, 16 bp, M. musculus
ataaagacatttattt

SEQ ID NO: 365064 - DNA, 16 bp, M. musculus
ataaagactggactgt

SEQ ID NO: 365065 - DNA, 16 bp, M. musculus
ataaagactggttttg

SEQ ID NO: 365066 - DNA, 16 bp, M. musculus
ataaagagaaatgcac

SEQ ID NO: 365067 - DNA, 16 bp, M. musculus
ataaagagttccaggc

SEQ ID NO: 365068 - DNA, 16 bp, M. musculus
ataaagataagaactt

SEQ ID NO: 365069 - DNA, 16 bp, M. musculus
ataaagataagatcct

SEQ ID NO: 365070 - DNA, 16 bp, M. musculus
ataaagatgaagcaga

SEQ ID NO: 365071 - DNA, 16 bp, M. musculus
ataaagatgcaatatg

SEQ ID NO: 365072 - DNA, 16 bp, M. musculus
ataaagatgcctacag

SEQ ID NO: 365073 - DNA, 16 bp, M. musculus
ataaagatgctgaagt

SEQ ID NO: 365074 - DNA, 16 bp, M. musculus
ataaagatggagcaga

SEQ ID NO: 365075 - DNA, 16 bp, M. musculus
ataaagatttttttca

SEQ ID NO: 365076 - DNA, 16 bp, M. musculus
ataaagcagtccaaga

SEQ ID NO: 365077 - DNA, 17 bp, M. musculus
ataaagcatttaacccc

SEQ ID NO: 365078 - DNA, 16 bp, M. musculus
ataaagccaggcagtg

SEQ ID NO: 365079 - DNA, 16 bp, M. musculus
ataaagccaggtatgg

SEQ ID NO: 365080 - DNA, 16 bp, M. musculus
ataaagctgtcttctg

SEQ ID NO: 365081 - DNA, 16 bp, M. musculus
ataaagctttcatttt

SEQ ID NO: 365082 - DNA, 16 bp, M. musculus
ataaagcttttttttt

SEQ ID NO: 365083 - DNA, 16 bp, M. musculus
ataaaggaaaaactcc

SEQ ID NO: 365084 - DNA, 16 bp, M. musculus
ataaaggaacacatac

SEQ ID NO: 365085 - DNA, 16 bp, M. musculus
ataaaggacaacactt

SEQ ID NO: 365086 - DNA, 17 bp, M. musculus
ataaaggacctccacat

SEQ ID NO: 365087 - DNA, 16 bp, M. musculus
ataaaggagatttatt

SEQ ID NO: 365088 - DNA, 16 bp, M. musculus
ataaaggagccagaga

SEQ ID NO: 365089 - DNA, 16 bp, M. musculus
ataaaggatcttaaaa

SEQ ID NO: 365090 - DNA, 16 bp, M. musculus
ataaaggcaaaaacca

SEQ ID NO: 365091 - DNA, 16 bp, M. musculus
ataaaggcagacctgt

SEQ ID NO: 365092 - DNA, 16 bp, M. musculus
ataaaggcatcaaaac

SEQ ID NO: 365093 - DNA, 16 bp, M. musculus
ataaaggctatttttt

SEQ ID NO: 365094 - DNA, 16 bp, M. musculus
ataaagggaaaggtga

SEQ ID NO: 365095 - DNA, 16 bp, M. musculus
ataaagggggaaagcc

SEQ ID NO: 365096 - DNA, 16 bp, M. musculus
ataaaggtgtgtgcca

SEQ ID NO: 365097 - DNA, 16 bp, M. musculus
ataaaggtgtttgctg

SEQ ID NO: 365098 - DNA, 16 bp, M. musculus
ataaagtacctgctgt

SEQ ID NO: 365099 - DNA, 16 bp, M. musculus
ataaagtatgttttat

SEQ ID NO: 365100 - DNA, 16 bp, M. musculus
ataaagttctcaaaaa

SEQ ID NO: 365101 - DNA, 16 bp, M. musculus
ataaagttcttgcaaa

SEQ ID NO: 365102 - DNA, 16 bp, M. musculus
ataaagtttgagttag

SEQ ID NO: 365103 - DNA, 22 bp, M. musculus
ataaagtttgcacgaccaatgg

SEQ ID NO: 365104 - DNA, 16 bp, M. musculus
ataaagtttgtaagac

SEQ ID NO: 365105 - DNA, 17 bp, M. musculus
ataaagtttgtaagacc

SEQ ID NO: 365106 - DNA, 16 bp, M. musculus
ataaagttttattgac

SEQ ID NO: 365107 - DNA, 16 bp, M. musculus
ataaagttttattgga

SEQ ID NO: 365108 - DNA, 16 bp, M. musculus
ataaataaaccacatt

SEQ ID NO: 365109 - DNA, 16 bp, M. musculus
ataaataaagctttaa

SEQ ID NO: 365110 - DNA, 16 bp, M. musculus
ataaataaataatgca

SEQ ID NO: 365111 - DNA, 16 bp, M. musculus
ataaataaatacttga

SEQ ID NO: 365112 - DNA, 16 bp, M. musculus
ataaataaatattctc

SEQ ID NO: 365113 - DNA, 16 bp, M. musculus
ataaataaatcttttc

SEQ ID NO: 365114 - DNA, 16 bp, M. musculus
ataaataaatggcaga

SEQ ID NO: 365115 - DNA, 16 bp, M. musculus
ataaataaatgtacaa

SEQ ID NO: 365116 - DNA, 16 bp, M. musculus
ataaataagcaaatgt

SEQ ID NO: 365117 - DNA, 16 bp, M. musculus
ataaataattcctttt

SEQ ID NO: 365118 - DNA, 16 bp, M. musculus
ataaatacacacatgc

SEQ ID NO: 365119 - DNA, 16 bp, M. musculus
ataaatacatacatac

SEQ ID NO: 365120 - DNA, 16 bp, M. musculus
ataaatacatagaaat

SEQ ID NO: 365121 - DNA, 16 bp, M. musculus
ataaatacatagatag

SEQ ID NO: 365122 - DNA, 16 bp, M. musculus
ataaatacatctttag

SEQ ID NO: 365123 - DNA, 16 bp, M. musculus
ataaatacatgaaaat

SEQ ID NO: 365124 - DNA, 16 bp, M. musculus
ataaatacatgcatgc

SEQ ID NO: 365125 - DNA, 16 bp, M. musculus
ataaatacatgtttta

SEQ ID NO: 365126 - DNA, 16 bp, M. musculus
ataaatacatttgttt

SEQ ID NO: 365127 - DNA, 16 bp, M. musculus
ataaatactttagaag

SEQ ID NO: 365128 - DNA, 16 bp, M. musculus
ataaatagacagatag

SEQ ID NO: 365129 - DNA, 16 bp, M. musculus
ataaatagatcttaaa

SEQ ID NO: 365130 - DNA, 19 bp, M. musculus
ataaatagggctgctatga

SEQ ID NO: 365131 - DNA, 16 bp, M. musculus
ataaatatatgcatac

SEQ ID NO: 365132 - DNA, 16 bp, M. musculus
ataaatatcaagagag

SEQ ID NO: 365133 - DNA, 16 bp, M. musculus
ataaatatctgttgaa

SEQ ID NO: 365134 - DNA, 16 bp, M. musculus
ataaatatgcatatat

SEQ ID NO: 365135 - DNA, 16 bp, M. musculus
ataaatatgtatacat

SEQ ID NO: 365136 - DNA, 16 bp, M. musculus
ataaatatttgtcctt

SEQ ID NO: 365137 - DNA, 16 bp, M. musculus
ataaatattttcttca

SEQ ID NO: 365138 - DNA, 16 bp, M. musculus
ataaatattttgaaga

SEQ ID NO: 365139 - DNA, 16 bp, M. musculus
ataaatcctttaccta

SEQ ID NO: 365140 - DNA, 16 bp, M. musculus
ataaatctttaaaaag

SEQ ID NO: 365141 - DNA, 16 bp, M. musculus
ataaatctttaaagga

SEQ ID NO: 365142 - DNA, 16 bp, M. musculus
ataaatctttcaaaag

SEQ ID NO: 365143 - DNA, 16 bp, M. musculus
ataaatctttcttctt

SEQ ID NO: 365144 - DNA, 16 bp, M. musculus
ataaatctttctttaa

SEQ ID NO: 365145 - DNA, 16 bp, M. musculus
ataaatcttttaaaag

SEQ ID NO: 365146 - DNA, 16 bp, M. musculus
ataaatgaaaatgttt

SEQ ID NO: 365147 - DNA, 16 bp, M. musculus
ataaatgaacacatac

SEQ ID NO: 365148 - DNA, 16 bp, M. musculus
ataaatgatgatgatg

SEQ ID NO: 365149 - DNA, 16 bp, M. musculus
ataaatgccttatagt

SEQ ID NO: 365150 - DNA, 16 bp, M. musculus
ataaatgctttcattg

SEQ ID NO: 365151 - DNA, 16 bp, M. musculus
ataaatgtaaacattt

SEQ ID NO: 365152 - DNA, 16 bp, M. musculus
ataaatgtaatacaaa

SEQ ID NO: 365153 - DNA, 16 bp, M. musculus
ataaatgtatatacac

SEQ ID NO: 365154 - DNA, 16 bp, M. musculus
ataaatgtatatgtgt

SEQ ID NO: 365155 - DNA, 16 bp, M. musculus
ataaatgtatgaaatt

SEQ ID NO: 365156 - DNA, 16 bp, M. musculus
ataaatgtatgtgtgt

SEQ ID NO: 365157 - DNA, 22 bp, M. musculus
ataaatgtgagccagataatca

SEQ ID NO: 365158 - DNA, 16 bp, M. musculus
ataaatgtgtttttaa

SEQ ID NO: 365159 - DNA, 16 bp, M. musculus
ataaattcacttttta

SEQ ID NO: 365160 - DNA, 16 bp, M. musculus
ataaattcattccttt

SEQ ID NO: 365161 - DNA, 16 bp, M. musculus
ataaattctgtaccaa

SEQ ID NO: 365162 - DNA, 16 bp, M. musculus
ataaattctttgaaaa

SEQ ID NO: 365163 - DNA, 16 bp, M. musculus
ataaattgttttgaaa

SEQ ID NO: 365164 - DNA, 16 bp, M. musculus
ataaatttaaggtcat

SEQ ID NO: 365165 - DNA, 20 bp, M. musculus
ataacaaccagtcatggaga

SEQ ID NO: 365166 - DNA, 17 bp, M. musculus
ataacaacttcaagtct

SEQ ID NO: 365167 - DNA, 17 bp, M. musculus
ataacaagcaggttact

SEQ ID NO: 365168 - DNA, 26 bp, M. musculus
ataacaagcaggttactggagaagag

SEQ ID NO: 365169 - DNA, 16 bp, M. musculus
ataacaagctacaata

SEQ ID NO: 365170 - DNA, 16 bp, M. musculus
ataacaaggacacatg

SEQ ID NO: 365171 - DNA, 16 bp, M. musculus
ataacaaggggcctct

SEQ ID NO: 365172 - DNA, 16 bp, M. musculus
ataacaataatgatga

SEQ ID NO: 365173 - DNA, 16 bp, M. musculus
ataacacagacacaca

SEQ ID NO: 365174 - DNA, 16 bp, M. musculus
ataacagcaaaattat

SEQ ID NO: 365175 - DNA, 16 bp, M. musculus
ataacagcaatggctt

SEQ ID NO: 365176 - DNA, 16 bp, M. musculus
ataacaggaagcaaaa

SEQ ID NO: 365177 - DNA, 16 bp, M. musculus
ataacagtcttattta

SEQ ID NO: 365178 - DNA, 16 bp, M. musculus
ataacatatgcagagg

SEQ ID NO: 365179 - DNA, 16 bp, M. musculus
ataacatgattttttt

SEQ ID NO: 365180 - DNA, 16 bp, M. musculus
ataacatttctgtgtt

SEQ ID NO: 365181 - DNA, 16 bp, M. musculus
ataaccaaactccatt

SEQ ID NO: 365182 - DNA, 16 bp, M. musculus
ataaccaataaaaatg

SEQ ID NO: 365183 - DNA, 16 bp, M. musculus
ataaccaatatataca

SEQ ID NO: 365184 - DNA, 16 bp, M. musculus
ataaccatgagtttac

SEQ ID NO: 365185 - DNA, 16 bp, M. musculus
ataacccaaaacatcc

SEQ ID NO: 365186 - DNA, 16 bp, M. musculus
ataaccctcaagagac

SEQ ID NO: 365187 - DNA, 29 bp, M. musculus
ataaccctcacaattaccaggtattcctc

SEQ ID NO: 365188 - DNA, 16 bp, M. musculus
ataacctcccattgtg

SEQ ID NO: 365189 - DNA, 16 bp, M. musculus
ataacctgagttcagt

SEQ ID NO: 365190 - DNA, 17 bp, M. musculus
ataactaccattataaa

SEQ ID NO: 365191 - DNA, 16 bp, M. musculus
ataactatatatacat

SEQ ID NO: 365192 - DNA, 16 bp, M. musculus
ataactattcctacag

SEQ ID NO: 365193 - DNA, 16 bp, M. musculus
ataactcctttaaaga

SEQ ID NO: 365194 - DNA, 16 bp, M. musculus
ataactggtccaactt

SEQ ID NO: 365195 - DNA, 16 bp, M. musculus
ataactgtaattttac

SEQ ID NO: 365196 - DNA, 16 bp, M. musculus
ataactgtatatggga

SEQ ID NO: 365197 - DNA, 16 bp, M. musculus
ataactgtcattttgc

SEQ ID NO: 365198 - DNA, 16 bp, M. musculus
ataacttctgtaagtt

SEQ ID NO: 365199 - DNA, 16 bp, M. musculus
ataactttattccatt

SEQ ID NO: 365200 - DNA, 16 bp, M. musculus
ataactttcttttaaa

SEQ ID NO: 365201 - DNA, 16 bp, M. musculus
ataagaaaacatgctc

SEQ ID NO: 365202 - DNA, 16 bp, M. musculus
ataagaaaatatgcat

SEQ ID NO: 365203 - DNA, 16 bp, M. musculus
ataagaaacagaaacc

SEQ ID NO: 365204 - DNA, 16 bp, M. musculus
ataagaaagggctgag

SEQ ID NO: 365205 - DNA, 16 bp, M. musculus
ataagaaatccagctc

SEQ ID NO: 365206 - DNA, 16 bp, M. musculus
ataagaacacatgctt

SEQ ID NO: 365207 - DNA, 16 bp, M. musculus
ataagaacatttaatt

SEQ ID NO: 365208 - DNA, 16 bp, M. musculus
ataagaagaccaaaca

SEQ ID NO: 365209 - DNA, 16 bp, M. musculus
ataagaatgaagattt

SEQ ID NO: 365210 - DNA, 16 bp, M. musculus
ataagaatttgtataa

SEQ ID NO: 365211 - DNA, 21 bp, M. musculus
ataagacacaaagagataatg

SEQ ID NO: 365212 - DNA, 16 bp, M. musculus
ataagagagcatgctg

SEQ ID NO: 365213 - DNA, 16 bp, M. musculus
ataagagcaccgactg

SEQ ID NO: 365214 - DNA, 16 bp, M. musculus
ataagagcactgactg

SEQ ID NO: 365215 - DNA, 16 bp, M. musculus
ataagatcctggacag

SEQ ID NO: 365216 - DNA, 16 bp, M. musculus
ataagcaaacacatac

SEQ ID NO: 365217 - DNA, 16 bp, M. musculus
ataagcaagcaagcaa

SEQ ID NO: 365218 - DNA, 16 bp, M. musculus
ataagcaagtatagaa

SEQ ID NO: 365219 - DNA, 16 bp, M. musculus
ataagcaatttaaaca

SEQ ID NO: 365220 - DNA, 16 bp, M. musculus
ataagcagaagctgga

SEQ ID NO: 365221 - DNA, 16 bp, M. musculus
ataagccagccccaat

SEQ ID NO: 365222 - DNA, 16 bp, M. musculus
ataagctggagctgca

SEQ ID NO: 365223 - DNA, 16 bp, M. musculus
ataagctgggcagtgg

SEQ ID NO: 365224 - DNA, 16 bp, M. musculus
ataaggaaaacccaaa

SEQ ID NO: 365225 - DNA, 16 bp, M. musculus
ataaggaaatattttt

SEQ ID NO: 365226 - DNA, 16 bp, M. musculus
ataaggaagctggctg

SEQ ID NO: 365227 - DNA, 16 bp, M. musculus
ataaggacattggaaa

SEQ ID NO: 365228 - DNA, 16 bp, M. musculus
ataaggataatattta

SEQ ID NO: 365229 - DNA, 16 bp, M. musculus
ataaggcagagaatga

SEQ ID NO: 365230 - DNA, 16 bp, M. musculus
ataaggcagagagcaa

SEQ ID NO: 365231 - DNA, 16 bp, M. musculus
ataaggcagcccaaga

SEQ ID NO: 365232 - DNA, 16 bp, M. musculus
ataagggcatggaaat

SEQ ID NO: 365233 - DNA, 23 bp, M. musculus
ataagggcgtggaaatcattgcc

SEQ ID NO: 365234 - DNA, 16 bp, M. musculus
ataagggggtatttaa

SEQ ID NO: 365235 - DNA, 16 bp, M. musculus
ataaggtaaagctata

SEQ ID NO: 365236 - DNA, 16 bp, M. musculus
ataaggtagaaagtaa

SEQ ID NO: 365237 - DNA, 16 bp, M. musculus
ataaggtagagaatga

SEQ ID NO: 365238 - DNA, 16 bp, M. musculus
ataaggtctcactatg

SEQ ID NO: 365239 - DNA, 16 bp, M. musculus
ataaggtggaaagtga

SEQ ID NO: 365240 - DNA, 16 bp, M. musculus
ataagtatctgatatg

SEQ ID NO: 365241 - DNA, 21 bp, M. musculus
ataagtcagatagcagaaaaa

SEQ ID NO: 365242 - DNA, 16 bp, M. musculus
ataagtctgtgtgtgt

SEQ ID NO: 365243 - DNA, 16 bp, M. musculus
ataagtgaacacatac

SEQ ID NO: 365244 - DNA, 16 bp, M. musculus
ataagtgtgcatgtgt

SEQ ID NO: 365245 - DNA, 16 bp, M. musculus
ataagtgtgtatatat

SEQ ID NO: 365246 - DNA, 16 bp, M. musculus
ataagttcatatattt

SEQ ID NO: 365247 - DNA, 16 bp, M. musculus
ataagttggaacatct

SEQ ID NO: 365248 - DNA, 16 bp, M. musculus
ataagtttagaattct

SEQ ID NO: 365249 - DNA, 16 bp, M. musculus
ataagtttgaggccag

SEQ ID NO: 365250 - DNA, 16 bp, M. musculus
ataagttttctttgct

SEQ ID NO: 365251 - DNA, 16 bp, M. musculus
ataataaaatacagag

SEQ ID NO: 365252 - DNA, 16 bp, M. musculus
ataataaagcttatat

SEQ ID NO: 365253 - DNA, 16 bp, M. musculus
ataataaataagtctt

SEQ ID NO: 365254 - DNA, 16 bp, M. musculus
ataataaatcaatctt

SEQ ID NO: 365255 - DNA, 16 bp, M. musculus
ataataaccagaaatt

SEQ ID NO: 365256 - DNA, 16 bp, M. musculus
ataataagaagcaaca

SEQ ID NO: 365257 - DNA, 16 bp, M. musculus
ataataagcctttaaa

SEQ ID NO: 365258 - DNA, 16 bp, M. musculus
ataataataatatcag

SEQ ID NO: 365259 - DNA, 16 bp, M. musculus
ataatacacacatata

SEQ ID NO: 365260 - DNA, 16 bp, M. musculus
ataatagggatagaag

SEQ ID NO: 365261 - DNA, 16 bp, M. musculus
ataatagtcttggaaa

SEQ ID NO: 365262 - DNA, 16 bp, M. musculus
ataatatacatgtaca

SEQ ID NO: 365263 - DNA, 16 bp, M. musculus
ataatcaaactcaaga

SEQ ID NO: 365264 - DNA, 16 bp, M. musculus
ataatcaaggcaactc

SEQ ID NO: 365265 - DNA, 16 bp, M. musculus
ataatcaagggaagta

SEQ ID NO: 365266 - DNA, 16 bp, M. musculus
ataatcactctggaaa

SEQ ID NO: 365267 - DNA, 16 bp, M. musculus
ataatccagacatttt

SEQ ID NO: 365268 - DNA, 16 bp, M. musculus
ataatcccagcactca

SEQ ID NO: 365269 - DNA, 16 bp, M. musculus
ataatcccagccctca

SEQ ID NO: 365270 - DNA, 16 bp, M. musculus
ataatctactacataa

SEQ ID NO: 365271 - DNA, 16 bp, M. musculus
ataatgaaaatgttat

SEQ ID NO: 365272 - DNA, 16 bp, M. musculus
ataatgaagggaaaac

SEQ ID NO: 365273 - DNA, 16 bp, M. musculus
ataatgaattccaggc

SEQ ID NO: 365274 - DNA, 16 bp, M. musculus
ataatgaatttcatta

SEQ ID NO: 365275 - DNA, 16 bp, M. musculus
ataatgagcctccaaa

SEQ ID NO: 365276 - DNA, 16 bp, M. musculus
ataatgatgacaatga

SEQ ID NO: 365277 - DNA, 16 bp, M. musculus
ataatgatgataatga

SEQ ID NO: 365278 - DNA, 16 bp, M. musculus
ataatgatggtgatga

SEQ ID NO: 365279 - DNA, 16 bp, M. musculus
ataatgcaaaaatgca

SEQ ID NO: 365280 - DNA, 16 bp, M. musculus
ataatgcaaaatgcat

SEQ ID NO: 365281 - DNA, 16 bp, M. musculus
ataatgcatgttttaa

SEQ ID NO: 365282 - DNA, 16 bp, M. musculus
ataatgccactccctg

SEQ ID NO: 365283 - DNA, 16 bp, M. musculus
ataatgccacttcctg

SEQ ID NO: 365284 - DNA, 16 bp, M. musculus
ataatggaaacagaaa

SEQ ID NO: 365285 - DNA, 16 bp, M. musculus
ataatggaagaagagg

SEQ ID NO: 365286 - DNA, 16 bp, M. musculus
ataatggaatatatat

SEQ ID NO: 365287 - DNA, 16 bp, M. musculus
ataatggaatctgatg

SEQ ID NO: 365288 - DNA, 16 bp, M. musculus
ataatggactaaaact

SEQ ID NO: 365289 - DNA, 16 bp, M. musculus
ataatggattatgttg

SEQ ID NO: 365290 - DNA, 16 bp, M. musculus
ataatgtaaacatctg

SEQ ID NO: 365291 - DNA, 17 bp, M. musculus
ataatgtgaagttcaag

SEQ ID NO: 365292 - DNA, 16 bp, M. musculus
ataatgtgtgtgtgtg

SEQ ID NO: 365293 - DNA, 16 bp, M. musculus
ataatgtgtgttcttt

SEQ ID NO: 365294 - DNA, 16 bp, M. musculus
ataattacatcatttt

SEQ ID NO: 365295 - DNA, 16 bp, M. musculus
ataattatccctttaa

SEQ ID NO: 365296 - DNA, 16 bp, M. musculus
ataattattttgagat

SEQ ID NO: 365297 - DNA, 16 bp, M. musculus
ataattctaagtatct

SEQ ID NO: 365298 - DNA, 16 bp, M. musculus
ataattctcttaaaga

SEQ ID NO: 365299 - DNA, 16 bp, M. musculus
ataattgagagtttgg

SEQ ID NO: 365300 - DNA, 16 bp, M. musculus
ataattgggctatttt

SEQ ID NO: 365301 - DNA, 16 bp, M. musculus
ataattgttcctgtat

SEQ ID NO: 365302 - DNA, 16 bp, M. musculus
ataatttaaaatacct

SEQ ID NO: 365303 - DNA, 16 bp, M. musculus
ataatttcaatgtttt

SEQ ID NO: 365304 - DNA, 16 bp, M. musculus
ataatttcaattgaga

SEQ ID NO: 365305 - DNA, 16 bp, M. musculus
ataatttcagcactca

SEQ ID NO: 365306 - DNA, 16 bp, M. musculus
ataatttcattgattt

SEQ ID NO: 365307 - DNA, 17 bp, M. musculus
ataatttggtcaaggaa

SEQ ID NO: 365308 - DNA, 16 bp, M. musculus
ataattttaaaaagct

SEQ ID NO: 365309 - DNA, 16 bp, M. musculus
ataattttaaatctga

SEQ ID NO: 365310 - DNA, 16 bp, M. musculus
ataattttagctttaa

SEQ ID NO: 365311 - DNA, 16 bp, M. musculus
ataattttaggaagaa

SEQ ID NO: 365312 - DNA, 16 bp, M. musculus
ataattttatatgtca

SEQ ID NO: 365313 - DNA, 16 bp, M. musculus
ataattttcataattg

SEQ ID NO: 365314 - DNA, 16 bp, M. musculus
ataattttctgaggaa

SEQ ID NO: 365315 - DNA, 17 bp, M. musculus
ataattttgttgaagat

SEQ ID NO: 365316 - DNA, 16 bp, M. musculus
ataatttttaaaagga

SEQ ID NO: 365317 - DNA, 16 bp, M. musculus
ataatttttaaaggga

SEQ ID NO: 365318 - DNA, 16 bp, M. musculus
ataatttttaaagtgt

SEQ ID NO: 365319 - DNA, 16 bp, M. musculus
ataatttttcatgttt

SEQ ID NO: 365320 - DNA, 16 bp, M. musculus
ataatttttggttgaa

SEQ ID NO: 365321 - DNA, 16 bp, M. musculus
ataatttttttctgtg

SEQ ID NO: 365322 - DNA, 16 bp, M. musculus
ataattttttttctgg

SEQ ID NO: 365323 - DNA, 16 bp, M. musculus
atacaaaaaatggaag

SEQ ID NO: 365324 - DNA, 16 bp, M. musculus
atacaaaacagttcta

SEQ ID NO: 365325 - DNA, 16 bp, M. musculus
atacaaaagatgaaag

SEQ ID NO: 365326 - DNA, 16 bp, M. musculus
atacaaaataaaatgt

SEQ ID NO: 365327 - DNA, 16 bp, M. musculus
atacaaaataaatgta

SEQ ID NO: 365328 - DNA, 16 bp, M. musculus
atacaaaatattttga

SEQ ID NO: 365329 - DNA, 16 bp, M. musculus
atacaaaatgaaaatt

SEQ ID NO: 365330 - DNA, 16 bp, M. musculus
atacaaaatgcaaaat

SEQ ID NO: 365331 - DNA, 16 bp, M. musculus
atacaaacagtaccag

SEQ ID NO: 365332 - DNA, 16 bp, M. musculus
atacaaaccaaaatgg

SEQ ID NO: 365333 - DNA, 16 bp, M. musculus
atacaaaccatcacac

SEQ ID NO: 365334 - DNA, 16 bp, M. musculus
atacaaactcatggaa

SEQ ID NO: 365335 - DNA, 16 bp, M. musculus
atacaaagaactacag

SEQ ID NO: 365336 - DNA, 16 bp, M. musculus
atacaaagaacttaaa

SEQ ID NO: 365337 - DNA, 16 bp, M. musculus
atacaaagagaaattt

SEQ ID NO: 365338 - DNA, 16 bp, M. musculus
atacaaagagttcaag

SEQ ID NO: 365339 - DNA, 16 bp, M. musculus
atacaaagatatatat

SEQ ID NO: 365340 - DNA, 17 bp, M. musculus
atacaaaggcagccaca

SEQ ID NO: 365341 - DNA, 16 bp, M. musculus
atacaaatatatgaat

SEQ ID NO: 365342 - DNA, 16 bp, M. musculus
atacaaatgcacacac

SEQ ID NO: 365343 - DNA, 16 bp, M. musculus
atacaacatgcacaca

SEQ ID NO: 365344 - DNA, 16 bp, M. musculus
atacaagaagagggca

SEQ ID NO: 365345 - DNA, 16 bp, M. musculus
atacaagaagcacaca

SEQ ID NO: 365346 - DNA, 16 bp, M. musculus
atacaagaatattgaa

SEQ ID NO: 365347 - DNA, 16 bp, M. musculus
atacaagacacaaaca

SEQ ID NO: 365348 - DNA, 16 bp, M. musculus
atacaagatggaggaa

SEQ ID NO: 365349 - DNA, 16 bp, M. musculus
atacaagcagcaccag

SEQ ID NO: 365350 - DNA, 16 bp, M. musculus
atacaaggtttctctg

SEQ ID NO: 365351 - DNA, 16 bp, M. musculus
atacaagttttttttt

SEQ ID NO: 365352 - DNA, 16 bp, M. musculus
atacaattcacagaac

SEQ ID NO: 365353 - DNA, 16 bp, M. musculus
atacacaaatatattt

SEQ ID NO: 365354 - DNA, 16 bp, M. musculus
atacacaagcaagatt

SEQ ID NO: 365355 - DNA, 16 bp, M. musculus
atacacaagcacacat

SEQ ID NO: 365356 - DNA, 16 bp, M. musculus
atacacaatacacata

SEQ ID NO: 365357 - DNA, 16 bp, M. musculus
atacacaatcacacac

SEQ ID NO: 365358 - DNA, 16 bp, M. musculus
atacacacacaaatat

SEQ ID NO: 365359 - DNA, 16 bp, M. musculus
atacacacacacacag

SEQ ID NO: 365360 - DNA, 16 bp, M. musculus
atacacacacacacat

SEQ ID NO: 365361 - DNA, 16 bp, M. musculus
atacacacacactaca

SEQ ID NO: 365362 - DNA, 16 bp, M. musculus
atacacacacatctat

SEQ ID NO: 365363 - DNA, 16 bp, M. musculus
atacacacacctgcac

SEQ ID NO: 365364 - DNA, 16 bp, M. musculus
atacacacactcacat

SEQ ID NO: 365365 - DNA, 16 bp, M. musculus
atacacacactctcat

SEQ ID NO: 365366 - DNA, 16 bp, M. musculus
atacacacaggtaaaa

SEQ ID NO: 365367 - DNA, 16 bp, M. musculus
atacacacatacacat

SEQ ID NO: 365368 - DNA, 16 bp, M. musculus
atacacacatacatag

SEQ ID NO: 365369 - DNA, 16 bp, M. musculus
atacacacatagacac

SEQ ID NO: 365370 - DNA, 16 bp, M. musculus
atacacacatatatat

SEQ ID NO: 365371 - DNA, 16 bp, M. musculus
atacacacatatatgt

SEQ ID NO: 365372 - DNA, 16 bp, M. musculus
atacacacatatttat

SEQ ID NO: 365373 - DNA, 16 bp, M. musculus
atacacacatgcagac

SEQ ID NO: 365374 - DNA, 16 bp, M. musculus
atacacacatgtgtgt

SEQ ID NO: 365375 - DNA, 16 bp, M. musculus
atacacaccatacaca

SEQ ID NO: 365376 - DNA, 16 bp, M. musculus
atacacactggagaaa

SEQ ID NO: 365377 - DNA, 16 bp, M. musculus
atacacagaaagacag

SEQ ID NO: 365378 - DNA, 16 bp, M. musculus
atacacagactacttt

SEQ ID NO: 365379 - DNA, 16 bp, M. musculus
atacacagagaaactg

SEQ ID NO: 365380 - DNA, 16 bp, M. musculus
atacacaggcacacag

SEQ ID NO: 365381 - DNA, 16 bp, M. musculus
atacacataaaataag

SEQ ID NO: 365382 - DNA, 16 bp, M. musculus
atacacataaactttt

SEQ ID NO: 365383 - DNA, 16 bp, M. musculus
atacacataaccacat

SEQ ID NO: 365384 - DNA, 16 bp, M. musculus
atacacataagcaaaa

SEQ ID NO: 365385 - DNA, 16 bp, M. musculus
atacacataagtaaaa

SEQ ID NO: 365386 - DNA, 16 bp, M. musculus
atacacataattttaa

SEQ ID NO: 365387 - DNA, 16 bp, M. musculus
atacacatacatacat

SEQ ID NO: 365388 - DNA, 16 bp, M. musculus
atacacatacatagaa

SEQ ID NO: 365389 - DNA, 16 bp, M. musculus
atacacatacatgtgt

SEQ ID NO: 365390 - DNA, 16 bp, M. musculus
atacacatacattcat

SEQ ID NO: 365391 - DNA, 16 bp, M. musculus
atacacataccacaca

SEQ ID NO: 365392 - DNA, 16 bp, M. musculus
atacacatacgcacac

SEQ ID NO: 365393 - DNA, 16 bp, M. musculus
atacacatatgtatat

SEQ ID NO: 365394 - DNA, 16 bp, M. musculus
atacacatcacataca

SEQ ID NO: 365395 - DNA, 16 bp, M. musculus
atacacatgaaagaaa

SEQ ID NO: 365396 - DNA, 16 bp, M. musculus
atacacatgaacatgt

SEQ ID NO: 365397 - DNA, 16 bp, M. musculus
atacacatgaatatat

SEQ ID NO: 365398 - DNA, 16 bp, M. musculus
atacacatgcacacac

SEQ ID NO: 365399 - DNA, 16 bp, M. musculus
atacacatgcacacat

SEQ ID NO: 365400 - DNA, 16 bp, M. musculus
atacacatgtacatat

SEQ ID NO: 365401 - DNA, 16 bp, M. musculus
atacacatgtgtatat

SEQ ID NO: 365402 - DNA, 16 bp, M. musculus
atacacatttatattt

SEQ ID NO: 365403 - DNA, 16 bp, M. musculus
atacaccatcacatca

SEQ ID NO: 365404 - DNA, 16 bp, M. musculus
atacacccacatatat

SEQ ID NO: 365405 - DNA, 16 bp, M. musculus
atacactagctggtct

SEQ ID NO: 365406 - DNA, 17 bp, M. musculus
atacactatagctgtct

SEQ ID NO: 365407 - DNA, 16 bp, M. musculus
atacactgaaactaat

SEQ ID NO: 365408 - DNA, 16 bp, M. musculus
atacactgtcactgtc

SEQ ID NO: 365409 - DNA, 16 bp, M. musculus
atacacttcctcatgt

SEQ ID NO: 365410 - DNA, 16 bp, M. musculus
atacacttgtcagcag

SEQ ID NO: 365411 - DNA, 16 bp, M. musculus
atacagaaaagctggg

SEQ ID NO: 365412 - DNA, 16 bp, M. musculus
atacagaaaatgttca

SEQ ID NO: 365413 - DNA, 16 bp, M. musculus
atacagaaaatttggt

SEQ ID NO: 365414 - DNA, 16 bp, M. musculus
atacagaacacacaca

SEQ ID NO: 365415 - DNA, 16 bp, M. musculus
atacagacaaaacact

SEQ ID NO: 365416 - DNA, 16 bp, M. musculus
atacagacacaaagag

SEQ ID NO: 365417 - DNA, 16 bp, M. musculus
atacagacagatacac

SEQ ID NO: 365418 - DNA, 16 bp, M. musculus
atacagagacacacag

SEQ ID NO: 365419 - DNA, 16 bp, M. musculus
atacagagacacagaa

SEQ ID NO: 365420 - DNA, 16 bp, M. musculus
atacagagaccatgga

SEQ ID NO: 365421 - DNA, 16 bp, M. musculus
atacagagagaaagag

SEQ ID NO: 365422 - DNA, 16 bp, M. musculus
atacagagagacaaag

SEQ ID NO: 365423 - DNA, 16 bp, M. musculus
atacagatatttacat

SEQ ID NO: 365424 - DNA, 16 bp, M. musculus
atacagatggttgtga

SEQ ID NO: 365425 - DNA, 16 bp, M. musculus
atacagcaagttcaag

SEQ ID NO: 365426 - DNA, 16 bp, M. musculus
atacagcaatccagta

SEQ ID NO: 365427 - DNA, 16 bp, M. musculus
atacagcagaggattg

SEQ ID NO: 365428 - DNA, 16 bp, M. musculus
atacagcagctgatat

SEQ ID NO: 365429 - DNA, 16 bp, M. musculus
atacagccagaaagaa

SEQ ID NO: 365430 - DNA, 16 bp, M. musculus
atacagctaccaaacc

SEQ ID NO: 365431 - DNA, 16 bp, M. musculus
atacagctctctcctg

SEQ ID NO: 365432 - DNA, 16 bp, M. musculus
atacaggaaaacaaag

SEQ ID NO: 365433 - DNA, 16 bp, M. musculus
atacaggaaaacagaa

SEQ ID NO: 365434 - DNA, 16 bp, M. musculus
atacaggaaagcactg

SEQ ID NO: 365435 - DNA, 16 bp, M. musculus
atacaggagaccagtg

SEQ ID NO: 365436 - DNA, 16 bp, M. musculus
atacaggcaaaacacc

SEQ ID NO: 365437 - DNA, 16 bp, M. musculus
atacaggcctttccaa

SEQ ID NO: 365438 - DNA, 16 bp, M. musculus
atacaggtgctgggaa

SEQ ID NO: 365439 - DNA, 16 bp, M. musculus
atacagtaggtgctca

SEQ ID NO: 365440 - DNA, 16 bp, M. musculus
atacagtgagctttca

SEQ ID NO: 365441 - DNA, 16 bp, M. musculus
atacagtgagtttgag

SEQ ID NO: 365442 - DNA, 16 bp, M. musculus
atacagtgcacacaca

SEQ ID NO: 365443 - DNA, 16 bp, M. musculus
atacagtgtgtgtgtg

SEQ ID NO: 365444 - DNA, 16 bp, M. musculus
atacagttccttatgt

SEQ ID NO: 365445 - DNA, 16 bp, M. musculus
atacagtttgcaagtc

SEQ ID NO: 365446 - DNA, 16 bp, M. musculus
atacagttttggggat

SEQ ID NO: 365447 - DNA, 16 bp, M. musculus
atacagtttttaaaaa

SEQ ID NO: 365448 - DNA, 16 bp, M. musculus
atacataaacacatat

SEQ ID NO: 365449 - DNA, 16 bp, M. musculus
atacataaacagaacc

SEQ ID NO: 365450 - DNA, 16 bp, M. musculus
atacataaatgtgtgt

SEQ ID NO: 365451 - DNA, 16 bp, M. musculus
atacataactatatat

SEQ ID NO: 365452 - DNA, 16 bp, M. musculus
atacataatgtatata

SEQ ID NO: 365453 - DNA, 16 bp, M. musculus
atacatacaagtaaca

SEQ ID NO: 365454 - DNA, 16 bp, M. musculus
atacatacacacacag

SEQ ID NO: 365455 - DNA, 16 bp, M. musculus
atacatacacacacat

SEQ ID NO: 365456 - DNA, 16 bp, M. musculus
atacatacacacctac

SEQ ID NO: 365457 - DNA, 16 bp, M. musculus
atacatacacatatgt

SEQ ID NO: 365458 - DNA, 16 bp, M. musculus
atacatacagagaaaa

SEQ ID NO: 365459 - DNA, 16 bp, M. musculus
atacatacagagagag

SEQ ID NO: 365460 - DNA, 16 bp, M. musculus
atacatacagttttat

SEQ ID NO: 365461 - DNA, 16 bp, M. musculus
atacatacatacacaa

SEQ ID NO: 365462 - DNA, 17 bp, M. musculus
atacatacatacataca

SEQ ID NO: 365463 - DNA, 18 bp, M. musculus
atacatacatacatacat

SEQ ID NO: 365464 - DNA, 16 bp, M. musculus
atacatacatacattt

SEQ ID NO: 365465 - DNA, 16 bp, M. musculus
atacatacatatacat

SEQ ID NO: 365466 - DNA, 16 bp, M. musculus
atacatacatatatat

SEQ ID NO: 365467 - DNA, 16 bp, M. musculus
atacatacatatatct

SEQ ID NO: 365468 - DNA, 16 bp, M. musculus
atacatacatatgtat

SEQ ID NO: 365469 - DNA, 16 bp, M. musculus
atacatacatcacaca

SEQ ID NO: 365470 - DNA, 16 bp, M. musculus
atacatacttacatac

SEQ ID NO: 365471 - DNA, 16 bp, M. musculus
atacatacttttaaaa

SEQ ID NO: 365472 - DNA, 16 bp, M. musculus
atacatagaataaata

SEQ ID NO: 365473 - DNA, 16 bp, M. musculus
atacatagactaacag

SEQ ID NO: 365474 - DNA, 16 bp, M. musculus
atacatagttaaaaat

SEQ ID NO: 365475 - DNA, 16 bp, M. musculus
atacatataaaaatag

SEQ ID NO: 365476 - DNA, 16 bp, M. musculus
atacatataaatgaaa

SEQ ID NO: 365477 - DNA, 16 bp, M. musculus
atacatatacacacag

SEQ ID NO: 365478 - DNA, 16 bp, M. musculus
atacatatacacacat

SEQ ID NO: 365479 - DNA, 16 bp, M. musculus
atacatatacatacat

SEQ ID NO: 365480 - DNA, 16 bp, M. musculus
atacatatacatatat

SEQ ID NO: 365481 - DNA, 16 bp, M. musculus
atacatataggcaaaa

SEQ ID NO: 365482 - DNA, 16 bp, M. musculus
atacatatatatatgt

SEQ ID NO: 365483 - DNA, 16 bp, M. musculus
atacatatatatgaag

SEQ ID NO: 365484 - DNA, 16 bp, M. musculus
atacatatatcatatt

SEQ ID NO: 365485 - DNA, 16 bp, M. musculus
atacatatatgcacac

SEQ ID NO: 365486 - DNA, 16 bp, M. musculus
atacatatatgtgcat

SEQ ID NO: 365487 - DNA, 16 bp, M. musculus
atacatatatttgcat

SEQ ID NO: 365488 - DNA, 16 bp, M. musculus
atacatatgaacaaca

SEQ ID NO: 365489 - DNA, 16 bp, M. musculus
atacatatgatatata

SEQ ID NO: 365490 - DNA, 16 bp, M. musculus
atacatatgcacacat

SEQ ID NO: 365491 - DNA, 16 bp, M. musculus
atacatatggtacaca

SEQ ID NO: 365492 - DNA, 16 bp, M. musculus
atacatatgtatatgt

SEQ ID NO: 365493 - DNA, 16 bp, M. musculus
atacatatgtgtatat

SEQ ID NO: 365494 - DNA, 16 bp, M. musculus
atacatatgttttata

SEQ ID NO: 365495 - DNA, 16 bp, M. musculus
atacatattcatatac

SEQ ID NO: 365496 - DNA, 16 bp, M. musculus
atacatatttctaaat

SEQ ID NO: 365497 - DNA, 16 bp, M. musculus
atacatccagaagatg

SEQ ID NO: 365498 - DNA, 16 bp, M. musculus
atacatgaaaaaaatc

SEQ ID NO: 365499 - DNA, 16 bp, M. musculus
atacatgaaataaata

SEQ ID NO: 365500 - DNA, 16 bp, M. musculus
atacatgacaaaatgt

SEQ ID NO: 365501 - DNA, 16 bp, M. musculus
atacatgagaccctgt

SEQ ID NO: 365502 - DNA, 16 bp, M. musculus
atacatgaggccctgg

SEQ ID NO: 365503 - DNA, 16 bp, M. musculus
atacatgatacaattt

SEQ ID NO: 365504 - DNA, 16 bp, M. musculus
atacatgatatatatg

SEQ ID NO: 365505 - DNA, 16 bp, M. musculus
atacatgcagaaaaaa

SEQ ID NO: 365506 - DNA, 16 bp, M. musculus
atacatgcaggcaaaa

SEQ ID NO: 365507 - DNA, 16 bp, M. musculus
atacatgcaggcaaga

SEQ ID NO: 365508 - DNA, 16 bp, M. musculus
atacatgcaggccaaa

SEQ ID NO: 365509 - DNA, 16 bp, M. musculus
atacatggatatatat

SEQ ID NO: 365510 - DNA, 16 bp, M. musculus
atacatgtaaacacat

SEQ ID NO: 365511 - DNA, 16 bp, M. musculus
atacatgtacacacat

SEQ ID NO: 365512 - DNA, 16 bp, M. musculus
atacatgtacatgcat

SEQ ID NO: 365513 - DNA, 16 bp, M. musculus
atacatgtatacaatg

SEQ ID NO: 365514 - DNA, 16 bp, M. musculus
atacatgtatgtgtgt

SEQ ID NO: 365515 - DNA, 16 bp, M. musculus
atacatgtatttacat

SEQ ID NO: 365516 - DNA, 16 bp, M. musculus
atacatgtgaaataaa

SEQ ID NO: 365517 - DNA, 16 bp, M. musculus
atacatgtgggcaaaa

SEQ ID NO: 365518 - DNA, 16 bp, M. musculus
atacatgtggtacaca

SEQ ID NO: 365519 - DNA, 16 bp, M. musculus
atacatgtggtgcaca

SEQ ID NO: 365520 - DNA, 16 bp, M. musculus
atacatgtgtacatat

SEQ ID NO: 365521 - DNA, 16 bp, M. musculus
atacatgtgtatttat

SEQ ID NO: 365522 - DNA, 16 bp, M. musculus
atacatgtgtgtgtgg

SEQ ID NO: 365523 - DNA, 16 bp, M. musculus
atacatgttatatata

SEQ ID NO: 365524 - DNA, 16 bp, M. musculus
atacatgtttttaaaa

SEQ ID NO: 365525 - DNA, 16 bp, M. musculus
atacattcaggtaaaa

SEQ ID NO: 365526 - DNA, 16 bp, M. musculus
atacattcatatatat

SEQ ID NO: 365527 - DNA, 16 bp, M. musculus
atacatttaaagtttt

SEQ ID NO: 365528 - DNA, 16 bp, M. musculus
atacatttatacatat

SEQ ID NO: 365529 - DNA, 16 bp, M. musculus
atacatttatctggtt

SEQ ID NO: 365530 - DNA, 16 bp, M. musculus
atacatttcaaatact

SEQ ID NO: 365531 - DNA, 16 bp, M. musculus
atacatttgaatactt

SEQ ID NO: 365532 - DNA, 16 bp, M. musculus
atacatttgtgtgtgt

SEQ ID NO: 365533 - DNA, 16 bp, M. musculus
atacattttctgtttt

SEQ ID NO: 365534 - DNA, 16 bp, M. musculus
atacatttttaaaaag

SEQ ID NO: 365535 - DNA, 16 bp, M. musculus
atacattttttaaaga

SEQ ID NO: 365536 - DNA, 16 bp, M. musculus
atacatttttttctga

SEQ ID NO: 365537 - DNA, 16 bp, M. musculus
ataccaaaaccacaga

SEQ ID NO: 365538 - DNA, 16 bp, M. musculus
ataccaaagaaataac

SEQ ID NO: 365539 - DNA, 16 bp, M. musculus
ataccaacaaaagcaa

SEQ ID NO: 365540 - DNA, 16 bp, M. musculus
ataccaagaagcactt

SEQ ID NO: 365541 - DNA, 16 bp, M. musculus
ataccaagagtccccc

SEQ ID NO: 365542 - DNA, 17 bp, M. musculus
ataccaagcaaaactct

SEQ ID NO: 365543 - DNA, 16 bp, M. musculus
ataccaataccaatac

SEQ ID NO: 365544 - DNA, 62 bp, M. musculus
ataccacaccccttccgtgtcggcgacaccgtgtgggtacgccggcaccagactaagaactt

SEQ ID NO: 365545 - DNA, 16 bp, M. musculus
ataccacattttgttt

SEQ ID NO: 365546 - DNA, 16 bp, M. musculus
ataccaccacacctgg

SEQ ID NO: 365547 - DNA, 16 bp, M. musculus
ataccacttctgagca

SEQ ID NO: 365548 - DNA, 16 bp, M. musculus
ataccacttctggaca

SEQ ID NO: 365549 - DNA, 16 bp, M. musculus
ataccagaaagatttt

SEQ ID NO: 365550 - DNA, 16 bp, M. musculus
ataccagaagcctaca

SEQ ID NO: 365551 - DNA, 23 bp, M. musculus
ataccagagaggaaccttttaaa

SEQ ID NO: 365552 - DNA, 16 bp, M. musculus
ataccatagaagaaat

SEQ ID NO: 365553 - DNA, 16 bp, M. musculus
ataccatattttcatt

SEQ ID NO: 365554 - DNA, 16 bp, M. musculus
ataccatgaccaaggc

SEQ ID NO: 365555 - DNA, 16 bp, M. musculus
ataccatgcatttcct

SEQ ID NO: 365556 - DNA, 16 bp, M. musculus
ataccattcccagtta

SEQ ID NO: 365557 - DNA, 16 bp, M. musculus
atacccaaaaggtgct

SEQ ID NO: 365558 - DNA, 16 bp, M. musculus
atacccaaaccacaga

SEQ ID NO: 365559 - DNA, 19 bp, M. musculus
atacccaagatataagata

SEQ ID NO: 365560 - DNA, 16 bp, M. musculus
atacccaatggcagag

SEQ ID NO: 365561 - DNA, 16 bp, M. musculus
atacccacacaaacat

SEQ ID NO: 365562 - DNA, 16 bp, M. musculus
atacccactggcaaag

SEQ ID NO: 365563 - DNA, 16 bp, M. musculus
atacccagaagacatt

SEQ ID NO: 365564 - DNA, 16 bp, M. musculus
atacccagaagatatt

SEQ ID NO: 365565 - DNA, 16 bp, M. musculus
atacccagctactctc

SEQ ID NO: 365566 - DNA, 16 bp, M. musculus
atacccatgatacatc

SEQ ID NO: 365567 - DNA, 16 bp, M. musculus
ataccccaatacaggg

SEQ ID NO: 365568 - DNA, 16 bp, M. musculus
atacccccttatccag

SEQ ID NO: 365569 - DNA, 16 bp, M. musculus
atacccctacacacac

SEQ ID NO: 365570 - DNA, 16 bp, M. musculus
ataccctaacacacct

SEQ ID NO: 365571 - DNA, 16 bp, M. musculus
ataccctccctgcccc

SEQ ID NO: 365572 - DNA, 16 bp, M. musculus
ataccctctgaaaagt

SEQ ID NO: 365573 - DNA, 17 bp, M. musculus
ataccctctgtcaccct

SEQ ID NO: 365574 - DNA, 16 bp, M. musculus
atacccttccccctgc

SEQ ID NO: 365575 - DNA, 16 bp, M. musculus
atacccttttgtccat

SEQ ID NO: 365576 - DNA, 16 bp, M. musculus
atacccttttgtttta

SEQ ID NO: 365577 - DNA, 16 bp, M. musculus
atacctaaacatgaca

SEQ ID NO: 365578 - DNA, 16 bp, M. musculus
atacctaaggctcagg

SEQ ID NO: 365579 - DNA, 16 bp, M. musculus
atacctaataaatttt

SEQ ID NO: 365580 - DNA, 16 bp, M. musculus
atacctattcaaacca

SEQ ID NO: 365581 - DNA, 16 bp, M. musculus
atacctcattgttttc

SEQ ID NO: 365582 - DNA, 16 bp, M. musculus
atacctcctaatcctt

SEQ ID NO: 365583 - DNA, 29 bp, M. musculus
atacctctcctgggcatatatccagaaga

SEQ ID NO: 365584 - DNA, 31 bp, M. musculus
atacctctcctgggcatttatccagaagatg

SEQ ID NO: 365585 - DNA, 16 bp, M. musculus
atacctgcctgcctgc

SEQ ID NO: 365586 - DNA, 16 bp, M. musculus
atacctggctgctgcc

SEQ ID NO: 365587 - DNA, 16 bp, M. musculus
atacctgggcatatac

SEQ ID NO: 365588 - DNA, 16 bp, M. musculus
atacctgtaacctcag

SEQ ID NO: 365589 - DNA, 16 bp, M. musculus
atacctgtaatcctag

SEQ ID NO: 365590 - DNA, 16 bp, M. musculus
atacctgtagtcccag

SEQ ID NO: 365591 - DNA, 16 bp, M. musculus
ataccttcctctcagc

SEQ ID NO: 365592 - DNA, 17 bp, M. musculus
atacctttgtgtccaag

SEQ ID NO: 365593 - DNA, 16 bp, M. musculus
ataccttttttaaaaa

SEQ ID NO: 365594 - DNA, 16 bp, M. musculus
atacgtaattaaaaaa

SEQ ID NO: 365595 - DNA, 16 bp, M. musculus
atactaaggaaaagtg

SEQ ID NO: 365596 - DNA, 16 bp, M. musculus
atactacatatacata

SEQ ID NO: 365597 - DNA, 16 bp, M. musculus
atactactcagctatt

SEQ ID NO: 365598 - DNA, 16 bp, M. musculus
atactatacacacata

SEQ ID NO: 365599 - DNA, 16 bp, M. musculus
atactcaacacaactg

SEQ ID NO: 365600 - DNA, 16 bp, M. musculus
atactcacagccaacc

SEQ ID NO: 365601 - DNA, 16 bp, M. musculus
atactcacagccaact

SEQ ID NO: 365602 - DNA, 17 bp, M. musculus
atactcatatacataaa

SEQ ID NO: 365603 - DNA, 16 bp, M. musculus
atactcatttttaaaa

SEQ ID NO: 365604 - DNA, 16 bp, M. musculus
atactccaaatacaag

SEQ ID NO: 365605 - DNA, 16 bp, M. musculus
atactccaacatgtaa

SEQ ID NO: 365606 - DNA, 16 bp, M. musculus
atactccattatataa

SEQ ID NO: 365607 - DNA, 16 bp, M. musculus
atactcctgcctctgc

SEQ ID NO: 365608 - DNA, 16 bp, M. musculus
atactctaccactgaa

SEQ ID NO: 365609 - DNA, 16 bp, M. musculus
atactgaactgaacct

SEQ ID NO: 365610 - DNA, 16 bp, M. musculus
atactgaattccaaaa

SEQ ID NO: 365611 - DNA, 16 bp, M. musculus
atactgaatttttttt

SEQ ID NO: 365612 - DNA, 16 bp, M. musculus
atactgatcagcctga

SEQ ID NO: 365613 - DNA, 16 bp, M. musculus
atactgggaattgaac

SEQ ID NO: 365614 - DNA, 16 bp, M. musculus
atactgggattaaagg

SEQ ID NO: 365615 - DNA, 16 bp, M. musculus
atactggggcttagaa

SEQ ID NO: 365616 - DNA, 16 bp, M. musculus
atactggtgaatccat

SEQ ID NO: 365617 - DNA, 16 bp, M. musculus
atactgtcagaaagct

SEQ ID NO: 365618 - DNA, 16 bp, M. musculus
atactgtcttcagaca

SEQ ID NO: 365619 - DNA, 16 bp, M. musculus
atacttaataaacatt

SEQ ID NO: 365620 - DNA, 16 bp, M. musculus
atacttacacacacac

SEQ ID NO: 365621 - DNA, 16 bp, M. musculus
atacttacacacatac

SEQ ID NO: 365622 - DNA, 16 bp, M. musculus
atacttcatttttaaa

SEQ ID NO: 365623 - DNA, 16 bp, M. musculus
atacttcctccagcaa

SEQ ID NO: 365624 - DNA, 16 bp, M. musculus
atacttctacatgata

SEQ ID NO: 365625 - DNA, 16 bp, M. musculus
atacttggagaagctg

SEQ ID NO: 365626 - DNA, 16 bp, M. musculus
atacttgttgaatgaa

SEQ ID NO: 365627 - DNA, 16 bp, M. musculus
atacttgtttttaaaa

SEQ ID NO: 365628 - DNA, 16 bp, M. musculus
atactttaaaaatatc

SEQ ID NO: 365629 - DNA, 16 bp, M. musculus
atactttaatcccagc

SEQ ID NO: 365630 - DNA, 16 bp, M. musculus
atactttgactttttc

SEQ ID NO: 365631 - DNA, 16 bp, M. musculus
atactttgactttttt

SEQ ID NO: 365632 - DNA, 16 bp, M. musculus
atactttggtctttct

SEQ ID NO: 365633 - DNA, 16 bp, M. musculus
atactttggtttctac

SEQ ID NO: 365634 - DNA, 16 bp, M. musculus
atactttgttcctcct

SEQ ID NO: 365635 - DNA, 16 bp, M. musculus
atacttttgtgttggg

SEQ ID NO: 365636 - DNA, 16 bp, M. musculus
atactttttaaaagat

SEQ ID NO: 365637 - DNA, 16 bp, M. musculus
atactttttaaatgaa

SEQ ID NO: 365638 - DNA, 16 bp, M. musculus
atagaaaaaaattcta

SEQ ID NO: 365639 - DNA, 16 bp, M. musculus
atagaaaaatggctat

SEQ ID NO: 365640 - DNA, 16 bp, M. musculus
atagaaaacaaaacct

SEQ ID NO: 365641 - DNA, 16 bp, M. musculus
atagaaaacattgaca

SEQ ID NO: 365642 - DNA, 16 bp, M. musculus
atagaaaacattttca

SEQ ID NO: 365643 - DNA, 16 bp, M. musculus
atagaaaagtaactaa

SEQ ID NO: 365644 - DNA, 16 bp, M. musculus
atagaaaagtaagtgg

SEQ ID NO: 365645 - DNA, 16 bp, M. musculus
atagaaaatagatttt

SEQ ID NO: 365646 - DNA, 17 bp, M. musculus
atagaaacaaaaaggct

SEQ ID NO: 365647 - DNA, 16 bp, M. musculus
atagaaacactaagac

SEQ ID NO: 365648 - DNA, 16 bp, M. musculus
atagaaacataaggta

SEQ ID NO: 365649 - DNA, 16 bp, M. musculus
atagaaaccctatgaa

SEQ ID NO: 365650 - DNA, 16 bp, M. musculus
atagaaacttgaagca

SEQ ID NO: 365651 - DNA, 16 bp, M. musculus
atagaaatagaagcag

SEQ ID NO: 365652 - DNA, 16 bp, M. musculus
atagaaatgcaaatta

SEQ ID NO: 365653 - DNA, 16 bp, M. musculus
atagaaatggatcaat

SEQ ID NO: 365654 - DNA, 16 bp, M. musculus
atagaacactgtatcc

SEQ ID NO: 365655 - DNA, 16 bp, M. musculus
atagaacacttgccta

SEQ ID NO: 365656 - DNA, 16 bp, M. musculus
atagaacattctagaa

SEQ ID NO: 365657 - DNA, 16 bp, M. musculus
atagaacatttcatct

SEQ ID NO: 365658 - DNA, 16 bp, M. musculus
atagaacatttcattc

SEQ ID NO: 365659 - DNA, 16 bp, M. musculus
atagaacattttatct

SEQ ID NO: 365660 - DNA, 16 bp, M. musculus
atagaacatttttttt

SEQ ID NO: 365661 - DNA, 16 bp, M. musculus
atagaactctcagctc

SEQ ID NO: 365662 - DNA, 16 bp, M. musculus
atagaagaaaagtttc

SEQ ID NO: 365663 - DNA, 16 bp, M. musculus
atagaagaaagggttt

SEQ ID NO: 365664 - DNA, 16 bp, M. musculus
atagaagaacctccag

SEQ ID NO: 365665 - DNA, 16 bp, M. musculus
atagaagagaaaaatc

SEQ ID NO: 365666 - DNA, 16 bp, M. musculus
atagaagagaaagttg

SEQ ID NO: 365667 - DNA, 16 bp, M. musculus
atagaagctgggggag

SEQ ID NO: 365668 - DNA, 16 bp, M. musculus
atagaaggactgggtc

SEQ ID NO: 365669 - DNA, 16 bp, M. musculus
atagaaggcaggaaag

SEQ ID NO: 365670 - DNA, 16 bp, M. musculus
atagaagtctgtggct

SEQ ID NO: 365671 - DNA, 16 bp, M. musculus
atagaagtcttattta

SEQ ID NO: 365672 - DNA, 16 bp, M. musculus
atagaagtttgccaaa

SEQ ID NO: 365673 - DNA, 16 bp, M. musculus
atagaatccaggacca

SEQ ID NO: 365674 - DNA, 16 bp, M. musculus
atagaatccaggacta

SEQ ID NO: 365675 - DNA, 16 bp, M. musculus
atagaatgaattatat

SEQ ID NO: 365676 - DNA, 16 bp, M. musculus
atagaatgaattcggt

SEQ ID NO: 365677 - DNA, 16 bp, M. musculus
atagaattggaaatgt

SEQ ID NO: 365678 - DNA, 16 bp, M. musculus
atagaatttttttctt

SEQ ID NO: 365679 - DNA, 16 bp, M. musculus
atagaattttttttct

SEQ ID NO: 365680 - DNA, 16 bp, M. musculus
atagacaaactcaaag

SEQ ID NO: 365681 - DNA, 16 bp, M. musculus
atagacaaataaatga

SEQ ID NO: 365682 - DNA, 17 bp, M. musculus
atagacactacttcaga

SEQ ID NO: 365683 - DNA, 16 bp, M. musculus
atagacagagagctgt

SEQ ID NO: 365684 - DNA, 16 bp, M. musculus
atagacagctatatca

SEQ ID NO: 365685 - DNA, 16 bp, M. musculus
atagacatatatgtat

SEQ ID NO: 365686 - DNA, 16 bp, M. musculus
atagacattttttaaa

SEQ ID NO: 365687 - DNA, 16 bp, M. musculus
atagaccaggctgacc

SEQ ID NO: 365688 - DNA, 17 bp, M. musculus
atagaccaggctggcct

SEQ ID NO: 365689 - DNA, 16 bp, M. musculus
atagaccaggctggct

SEQ ID NO: 365690 - DNA, 16 bp, M. musculus
atagaccaggctggtc

SEQ ID NO: 365691 - DNA, 16 bp, M. musculus
atagactaacaaactg

SEQ ID NO: 365692 - DNA, 16 bp, M. musculus
atagactgtctgagat

SEQ ID NO: 365693 - DNA, 16 bp, M. musculus
atagactttttatttt

SEQ ID NO: 365694 - DNA, 16 bp, M. musculus
atagagaaaacaattc

SEQ ID NO: 365695 - DNA, 16 bp, M. musculus
atagagaaaatgtggt

SEQ ID NO: 365696 - DNA, 16 bp, M. musculus
atagagaacatgaaca

SEQ ID NO: 365697 - DNA, 16 bp, M. musculus
atagagaacattggca

SEQ ID NO: 365698 - DNA, 16 bp, M. musculus
atagagacaaaatcct

SEQ ID NO: 365699 - DNA, 16 bp, M. musculus
atagagacacagagac

SEQ ID NO: 365700 - DNA, 16 bp, M. musculus
atagagaccaggctgg

SEQ ID NO: 365701 - DNA, 16 bp, M. musculus
atagagaccctgtctc

SEQ ID NO: 365702 - DNA, 16 bp, M. musculus
atagagagaatatctt

SEQ ID NO: 365703 - DNA, 16 bp, M. musculus
atagagatatgttgct

SEQ ID NO: 365704 - DNA, 16 bp, M. musculus
atagagcatatccaat

SEQ ID NO: 365705 - DNA, 16 bp, M. musculus
atagagcatgtgtcct

SEQ ID NO: 365706 - DNA, 16 bp, M. musculus
atagagccttcagagg

SEQ ID NO: 365707 - DNA, 16 bp, M. musculus
atagaggaaaacttcc

SEQ ID NO: 365708 - DNA, 16 bp, M. musculus
atagaggaattttaat

SEQ ID NO: 365709 - DNA, 16 bp, M. musculus
atagaggactaatatc

SEQ ID NO: 365710 - DNA, 16 bp, M. musculus
atagaggacttcaaga

SEQ ID NO: 365711 - DNA, 16 bp, M. musculus
atagaggagaaaatgg

SEQ ID NO: 365712 - DNA, 16 bp, M. musculus
atagaggagaacgtgg

SEQ ID NO: 365713 - DNA, 16 bp, M. musculus
atagaggagagagtgg

SEQ ID NO: 365714 - DNA, 16 bp, M. musculus
atagaggcagggggag

SEQ ID NO: 365715 - DNA, 16 bp, M. musculus
atagaggcagggggga

SEQ ID NO: 365716 - DNA, 16 bp, M. musculus
atagaggtcagaggac

SEQ ID NO: 365717 - DNA, 16 bp, M. musculus
atagagtactacacag

SEQ ID NO: 365718 - DNA, 16 bp, M. musculus
atagagtacttcaaaa

SEQ ID NO: 365719 - DNA, 16 bp, M. musculus
atagataataaataca

SEQ ID NO: 365720 - DNA, 16 bp, M. musculus
atagataatgattatg

SEQ ID NO: 365721 - DNA, 16 bp, M. musculus
atagatacagaaaaat

SEQ ID NO: 365722 - DNA, 16 bp, M. musculus
atagatacagaaaagg

SEQ ID NO: 365723 - DNA, 16 bp, M. musculus
atagatagataagtag

SEQ ID NO: 365724 - DNA, 16 bp, M. musculus
atagatagataataca

SEQ ID NO: 365725 - DNA, 25 bp, M. musculus
atagatagatagatagatagataga

SEQ ID NO: 365726 - DNA, 16 bp, M. musculus
atagatagatagatgc

SEQ ID NO: 365727 - DNA, 16 bp, M. musculus
atagatagatggagag

SEQ ID NO: 365728 - DNA, 16 bp, M. musculus
atagatatatgtatat

SEQ ID NO: 365729 - DNA, 16 bp, M. musculus
atagatatgcatatat

SEQ ID NO: 365730 - DNA, 16 bp, M. musculus
atagatatgtagatat

SEQ ID NO: 365731 - DNA, 16 bp, M. musculus
atagatattttcaaaa

SEQ ID NO: 365732 - DNA, 16 bp, M. musculus
atagatcaaatattaa

SEQ ID NO: 365733 - DNA, 16 bp, M. musculus
atagatccattcctat

SEQ ID NO: 365734 - DNA, 16 bp, M. musculus
atagatctacctgaaa

SEQ ID NO: 365735 - DNA, 16 bp, M. musculus
atagatcttgtccaga

SEQ ID NO: 365736 - DNA, 16 bp, M. musculus
atagatgaagaaaatg

SEQ ID NO: 365737 - DNA, 16 bp, M. musculus
atagatgactgtgagc

SEQ ID NO: 365738 - DNA, 19 bp, M. musculus
atagatgactgtgagcatc

SEQ ID NO: 365739 - DNA, 16 bp, M. musculus
atagatgatagatata

SEQ ID NO: 365740 - DNA, 16 bp, M. musculus
atagatgcaagcatca

SEQ ID NO: 365741 - DNA, 16 bp, M. musculus
atagatgcatagatag

SEQ ID NO: 365742 - DNA, 16 bp, M. musculus
atagatggagaaaatg

SEQ ID NO: 365743 - DNA, 16 bp, M. musculus
atagatggatggatga

SEQ ID NO: 365744 - DNA, 16 bp, M. musculus
atagatggctgtgaac

SEQ ID NO: 365745 - DNA, 16 bp, M. musculus
atagatgtatatacat

SEQ ID NO: 365746 - DNA, 16 bp, M. musculus
atagatgtctgtgagc

SEQ ID NO: 365747 - DNA, 16 bp, M. musculus
atagattattttctta

SEQ ID NO: 365748 - DNA, 16 bp, M. musculus
atagattctttaaaaa

SEQ ID NO: 365749 - DNA, 16 bp, M. musculus
atagatttatttttca

SEQ ID NO: 365750 - DNA, 16 bp, M. musculus
atagatttgaatactt

SEQ ID NO: 365751 - DNA, 16 bp, M. musculus
atagattttaataagt

SEQ ID NO: 365752 - DNA, 16 bp, M. musculus
atagcaaaataaatta

SEQ ID NO: 365753 - DNA, 16 bp, M. musculus
atagcaaaattacagt

SEQ ID NO: 365754 - DNA, 16 bp, M. musculus
atagcaacacacacac

SEQ ID NO: 365755 - DNA, 25 bp, M. musculus
atagcaacatgcttttaggagaggg

SEQ ID NO: 365756 - DNA, 16 bp, M. musculus
atagcaagccctggat

SEQ ID NO: 365757 - DNA, 16 bp, M. musculus
atagcaagttcaaggc

SEQ ID NO: 365758 - DNA, 16 bp, M. musculus
atagcaatagaaaact

SEQ ID NO: 365759 - DNA, 16 bp, M. musculus
atagcaatggatcaat

SEQ ID NO: 365760 - DNA, 16 bp, M. musculus
atagcacattttctgt

SEQ ID NO: 365761 - DNA, 16 bp, M. musculus
atagcagcagcagcag

SEQ ID NO: 365762 - DNA, 16 bp, M. musculus
atagcagccatatttg

SEQ ID NO: 365763 - DNA, 16 bp, M. musculus
atagcagtggttctca

SEQ ID NO: 365764 - DNA, 17 bp, M. musculus
atagcatagcatagcat

SEQ ID NO: 365765 - DNA, 17 bp, M. musculus
atagcatcaataatagt

SEQ ID NO: 365766 - DNA, 18 bp, M. musculus
atagcatcggaaatgtaa

SEQ ID NO: 365767 - DNA, 18 bp, M. musculus
atagcattggaaatataa

SEQ ID NO: 365768 - DNA, 18 bp, M. musculus
atagcattggaaatgtaa

SEQ ID NO: 365769 - DNA, 16 bp, M. musculus
atagccaacataaaat

SEQ ID NO: 365770 - DNA, 16 bp, M. musculus
atagccacagaaaaag

SEQ ID NO: 365771 - DNA, 16 bp, M. musculus
atagccacagtgtact

SEQ ID NO: 365772 - DNA, 16 bp, M. musculus
atagccagaagccaga

SEQ ID NO: 365773 - DNA, 16 bp, M. musculus
atagccaggagctgaa

SEQ ID NO: 365774 - DNA, 16 bp, M. musculus
atagccagggctacat

SEQ ID NO: 365775 - DNA, 21 bp, M. musculus
atagccagggctatacagaga

SEQ ID NO: 365776 - DNA, 16 bp, M. musculus
atagccagtgctctta

SEQ ID NO: 365777 - DNA, 16 bp, M. musculus
atagccatttttccta

SEQ ID NO: 365778 - DNA, 16 bp, M. musculus
atagcccaaagaccta

SEQ ID NO: 365779 - DNA, 16 bp, M. musculus
atagcccaagctggcc

SEQ ID NO: 365780 - DNA, 16 bp, M. musculus
atagcccagcccacta

SEQ ID NO: 365781 - DNA, 17 bp, M. musculus
atagccctggctggcct

SEQ ID NO: 365782 - DNA, 16 bp, M. musculus
atagccctggctgtac

SEQ ID NO: 365783 - DNA, 16 bp, M. musculus
atagcctcacaagaga

SEQ ID NO: 365784 - DNA, 16 bp, M. musculus
atagcctttggtagaa

SEQ ID NO: 365785 - DNA, 16 bp, M. musculus
atagccttttgttgta

SEQ ID NO: 365786 - DNA, 16 bp, M. musculus
atagctacctgtggct

SEQ ID NO: 365787 - DNA, 16 bp, M. musculus
atagctataaaaagta

SEQ ID NO: 365788 - DNA, 16 bp, M. musculus
atagctatcttcagac

SEQ ID NO: 365789 - DNA, 16 bp, M. musculus
atagctcaatggtaga

SEQ ID NO: 365790 - DNA, 16 bp, M. musculus
atagctcagaccctga

SEQ ID NO: 365791 - DNA, 16 bp, M. musculus
atagctcagtgataga

SEQ ID NO: 365792 - DNA, 16 bp, M. musculus
atagctcagtgggtaa

SEQ ID NO: 365793 - DNA, 16 bp, M. musculus
atagctcagtgggtag

SEQ ID NO: 365794 - DNA, 16 bp, M. musculus
atagctcagtggtgga

SEQ ID NO: 365795 - DNA, 18 bp, M. musculus
atagctctctcttgtgag

SEQ ID NO: 365796 - DNA, 16 bp, M. musculus
atagctctggctggcc

SEQ ID NO: 365797 - DNA, 16 bp, M. musculus
atagctctgtagtaaa

SEQ ID NO: 365798 - DNA, 16 bp, M. musculus
atagctgaatagcatt

SEQ ID NO: 365799 - DNA, 16 bp, M. musculus
atagctgcaagaacag

SEQ ID NO: 365800 - DNA, 16 bp, M. musculus
atagctgctgagagag

SEQ ID NO: 365801 - DNA, 16 bp, M. musculus
atagctggaagctgga

SEQ ID NO: 365802 - DNA, 16 bp, M. musculus
atagctgggcaggaag

SEQ ID NO: 365803 - DNA, 16 bp, M. musculus
atagctgtctctggag

SEQ ID NO: 365804 - DNA, 16 bp, M. musculus
atagctgtctcttttg

SEQ ID NO: 365805 - DNA, 17 bp, M. musculus
atagctgtcttcagaca

SEQ ID NO: 365806 - DNA, 16 bp, M. musculus
atagcttccctttcct

SEQ ID NO: 365807 - DNA, 16 bp, M. musculus
atagcttctctttcct

SEQ ID NO: 365808 - DNA, 19 bp, M. musculus
ataggaaagaaatctggaa

SEQ ID NO: 365809 - DNA, 16 bp, M. musculus
ataggaacaaggacct

SEQ ID NO: 365810 - DNA, 16 bp, M. musculus
ataggaactccacagg

SEQ ID NO: 365811 - DNA, 16 bp, M. musculus
ataggaagaacaacag

SEQ ID NO: 365812 - DNA, 16 bp, M. musculus
ataggacaagggaatg

SEQ ID NO: 365813 - DNA, 16 bp, M. musculus
ataggagctgatgcag

SEQ ID NO: 365814 - DNA, 16 bp, M. musculus
ataggaggaacaacaa

SEQ ID NO: 365815 - DNA, 16 bp, M. musculus
ataggagggcccagcc

SEQ ID NO: 365816 - DNA, 16 bp, M. musculus
ataggaggttgggggt

SEQ ID NO: 365817 - DNA, 16 bp, M. musculus
ataggcaatagtgtct

SEQ ID NO: 365818 - DNA, 16 bp, M. musculus
ataggcagctggagcc

SEQ ID NO: 365819 - DNA, 16 bp, M. musculus
ataggcctaggagagg

SEQ ID NO: 365820 - DNA, 16 bp, M. musculus
ataggcttgcttttat

SEQ ID NO: 365821 - DNA, 16 bp, M. musculus
ataggcttttgtacta

SEQ ID NO: 365822 - DNA, 16 bp, M. musculus
atagggaaactgaggc

SEQ ID NO: 365823 - DNA, 16 bp, M. musculus
atagggaagcttgaaa

SEQ ID NO: 365824 - DNA, 16 bp, M. musculus
atagggacagtatcct

SEQ ID NO: 365825 - DNA, 16 bp, M. musculus
atagggactgagggat

SEQ ID NO: 365826 - DNA, 16 bp, M. musculus
atagggatgacattag

SEQ ID NO: 365827 - DNA, 16 bp, M. musculus
atagggctgcagaccc

SEQ ID NO: 365828 - DNA, 16 bp, M. musculus
ataggggacgaatatc

SEQ ID NO: 365829 - DNA, 16 bp, M. musculus
ataggggacttttggg

SEQ ID NO: 365830 - DNA, 16 bp, M. musculus
ataggggagcagggca

SEQ ID NO: 365831 - DNA, 16 bp, M. musculus
ataggggagttttggg

SEQ ID NO: 365832 - DNA, 16 bp, M. musculus
ataggggattttggag

SEQ ID NO: 365833 - DNA, 16 bp, M. musculus
ataggggctggagaga

SEQ ID NO: 365834 - DNA, 16 bp, M. musculus
atagggtatgagtata

SEQ ID NO: 365835 - DNA, 16 bp, M. musculus
atagggtctctctgta

SEQ ID NO: 365836 - DNA, 17 bp, M. musculus
atagggttaccctatga

SEQ ID NO: 365837 - DNA, 16 bp, M. musculus
atagggttatttgttt

SEQ ID NO: 365838 - DNA, 16 bp, M. musculus
ataggtaaggagaaag

SEQ ID NO: 365839 - DNA, 16 bp, M. musculus
ataggtagatagatag

SEQ ID NO: 365840 - DNA, 16 bp, M. musculus
ataggtagatatagat

SEQ ID NO: 365841 - DNA, 16 bp, M. musculus
ataggtaggtagatag

SEQ ID NO: 365842 - DNA, 16 bp, M. musculus
ataggtatatagatag

SEQ ID NO: 365843 - DNA, 16 bp, M. musculus
ataggtatgtagatag

SEQ ID NO: 365844 - DNA, 16 bp, M. musculus
ataggtgtgtgagttc

SEQ ID NO: 365845 - DNA, 16 bp, M. musculus
ataggtgtgtgccact

SEQ ID NO: 365846 - DNA, 16 bp, M. musculus
ataggtgtgtgtgtgt

SEQ ID NO: 365847 - DNA, 16 bp, M. musculus
atagtaaagaaacaat

SEQ ID NO: 365848 - DNA, 16 bp, M. musculus
atagtaagtttgaggc

SEQ ID NO: 365849 - DNA, 16 bp, M. musculus
atagtaataaaaacag

SEQ ID NO: 365850 - DNA, 22 bp, M. musculus
atagtagataagctaagagttg

SEQ ID NO: 365851 - DNA, 16 bp, M. musculus
atagtataaaatacct

SEQ ID NO: 365852 - DNA, 16 bp, M. musculus
atagtatacatacata

SEQ ID NO: 365853 - DNA, 29 bp, M. musculus
atagtatatctgagctcaatgatatactt

SEQ ID NO: 365854 - DNA, 16 bp, M. musculus
atagtatttcattgta

SEQ ID NO: 365855 - DNA, 16 bp, M. musculus
atagtatttggttttc

SEQ ID NO: 365856 - DNA, 16 bp, M. musculus
atagtcacaaacaata

SEQ ID NO: 365857 - DNA, 16 bp, M. musculus
atagtcacatctctga

SEQ ID NO: 365858 - DNA, 16 bp, M. musculus
atagtcagcatccaaa

SEQ ID NO: 365859 - DNA, 16 bp, M. musculus
atagtcagctgctatg

SEQ ID NO: 365860 - DNA, 16 bp, M. musculus
atagtcagctgctgtg

SEQ ID NO: 365861 - DNA, 16 bp, M. musculus
atagtccagctgtctc

SEQ ID NO: 365862 - DNA, 16 bp, M. musculus
atagtcccactccctg

SEQ ID NO: 365863 - DNA, 16 bp, M. musculus
atagtctacagagtga

SEQ ID NO: 365864 - DNA, 16 bp, M. musculus
atagtctcacaggaga

SEQ ID NO: 365865 - DNA, 16 bp, M. musculus
atagtctcatatattt

SEQ ID NO: 365866 - DNA, 17 bp, M. musculus
atagtctctctctctct

SEQ ID NO: 365867 - DNA, 16 bp, M. musculus
atagtgacaggaaagg

SEQ ID NO: 365868 - DNA, 16 bp, M. musculus
atagtgagaccctgtc

SEQ ID NO: 365869 - DNA, 16 bp, M. musculus
atagtgagttctaggc

SEQ ID NO: 365870 - DNA, 16 bp, M. musculus
atagtgatgatgatga

SEQ ID NO: 365871 - DNA, 16 bp, M. musculus
atagtgcaggaggagc

SEQ ID NO: 365872 - DNA, 16 bp, M. musculus
atagtgccaccagctg

SEQ ID NO: 365873 - DNA, 16 bp, M. musculus
atagtgccatttcctg

SEQ ID NO: 365874 - DNA, 16 bp, M. musculus
atagtgctgagcctca

SEQ ID NO: 365875 - DNA, 16 bp, M. musculus
atagtggaacttgtgg

SEQ ID NO: 365876 - DNA, 16 bp, M. musculus
atagtggagaggagag

SEQ ID NO: 365877 - DNA, 16 bp, M. musculus
atagtggagcaggact

SEQ ID NO: 365878 - DNA, 18 bp, M. musculus
atagtggccattactgaa

SEQ ID NO: 365879 - DNA, 16 bp, M. musculus
atagtggtggtgatgg

SEQ ID NO: 365880 - DNA, 16 bp, M. musculus
atagtgtataatttaa

SEQ ID NO: 365881 - DNA, 16 bp, M. musculus
atagtgtctcctcaca

SEQ ID NO: 365882 - DNA, 16 bp, M. musculus
atagttcagttggtaa

SEQ ID NO: 365883 - DNA, 16 bp, M. musculus
atagttccacagtgtc

SEQ ID NO: 365884 - DNA, 16 bp, M. musculus
atagttccaggccagc

SEQ ID NO: 365885 - DNA, 16 bp, M. musculus
atagttctatttgttt

SEQ ID NO: 365886 - DNA, 16 bp, M. musculus
atagttctggtatctt

SEQ ID NO: 365887 - DNA, 16 bp, M. musculus
atagttgtaattttgc

SEQ ID NO: 365888 - DNA, 16 bp, M. musculus
atagttgtcttagtca

SEQ ID NO: 365889 - DNA, 16 bp, M. musculus
atagtttctttaaaaa

SEQ ID NO: 365890 - DNA, 16 bp, M. musculus
atagtttgtgaagaag

SEQ ID NO: 365891 - DNA, 16 bp, M. musculus
atagttttaaaagttt

SEQ ID NO: 365892 - DNA, 16 bp, M. musculus
atagttttatatcaac

SEQ ID NO: 365893 - DNA, 16 bp, M. musculus
atagtttttccaaaat

SEQ ID NO: 365894 - DNA, 16 bp, M. musculus
atataaaacatttcat

SEQ ID NO: 365895 - DNA, 16 bp, M. musculus
atataaaagaaagcat

SEQ ID NO: 365896 - DNA, 16 bp, M. musculus
atataaaatacatgaa

SEQ ID NO: 365897 - DNA, 16 bp, M. musculus
atataaaatatcttgt

SEQ ID NO: 365898 - DNA, 16 bp, M. musculus
atataaaatatttcca

SEQ ID NO: 365899 - DNA, 16 bp, M. musculus
atataaaatgtattca

SEQ ID NO: 365900 - DNA, 16 bp, M. musculus
atataaaattccttgg

SEQ ID NO: 365901 - DNA, 16 bp, M. musculus
atataaacaactgaaa

SEQ ID NO: 365902 - DNA, 16 bp, M. musculus
atataaacaagggaaa

SEQ ID NO: 365903 - DNA, 16 bp, M. musculus
atataaacacacatat

SEQ ID NO: 365904 - DNA, 16 bp, M. musculus
atataaacatgtgtat

SEQ ID NO: 365905 - DNA, 16 bp, M. musculus
atataaagaagtcaag

SEQ ID NO: 365906 - DNA, 16 bp, M. musculus
atataaagtcatatat

SEQ ID NO: 365907 - DNA, 21 bp, M. musculus
atataaagtttgcaataccaa

SEQ ID NO: 365908 - DNA, 16 bp, M. musculus
atataaataaatgcat

SEQ ID NO: 365909 - DNA, 16 bp, M. musculus
atataaatacaacctg

SEQ ID NO: 365910 - DNA, 16 bp, M. musculus
atataaatacacacat

SEQ ID NO: 365911 - DNA, 16 bp, M. musculus
atataaatgtatatag

SEQ ID NO: 365912 - DNA, 16 bp, M. musculus
atataaatgtatgtgt

SEQ ID NO: 365913 - DNA, 16 bp, M. musculus
atataaattgagcaca

SEQ ID NO: 365914 - DNA, 16 bp, M. musculus
atataacagatgtgca

SEQ ID NO: 365915 - DNA, 16 bp, M. musculus
atataacaggaagcaa

SEQ ID NO: 365916 - DNA, 16 bp, M. musculus
atataacccaggctgg

SEQ ID NO: 365917 - DNA, 16 bp, M. musculus
atataactctgcacta

SEQ ID NO: 365918 - DNA, 16 bp, M. musculus
atataagcaaactgaa

SEQ ID NO: 365919 - DNA, 16 bp, M. musculus
atataagcaaatacat

SEQ ID NO: 365920 - DNA, 16 bp, M. musculus
atataagcatatatat

SEQ ID NO: 365921 - DNA, 18 bp, M. musculus
atataagccacaaacatc

SEQ ID NO: 365922 - DNA, 16 bp, M. musculus
atataagtgtatatat

SEQ ID NO: 365923 - DNA, 16 bp, M. musculus
atataataaatgtgtt

SEQ ID NO: 365924 - DNA, 16 bp, M. musculus
atataatatacacaca

SEQ ID NO: 365925 - DNA, 16 bp, M. musculus
atataatccaaccatt

SEQ ID NO: 365926 - DNA, 16 bp, M. musculus
atataatccaggctgg

SEQ ID NO: 365927 - DNA, 16 bp, M. musculus
atataatgaaacttca

SEQ ID NO: 365928 - DNA, 16 bp, M. musculus
atataatgaattatgt

SEQ ID NO: 365929 - DNA, 16 bp, M. musculus
atataatgtatacatt

SEQ ID NO: 365930 - DNA, 16 bp, M. musculus
atatacaaagaagtta

SEQ ID NO: 365931 - DNA, 16 bp, M. musculus
atatacaacttaaagt

SEQ ID NO: 365932 - DNA, 16 bp, M. musculus
atatacaagaagccta

SEQ ID NO: 365933 - DNA, 16 bp, M. musculus
atatacaagtaaaata

SEQ ID NO: 365934 - DNA, 16 bp, M. musculus
atatacacaaatgaaa

SEQ ID NO: 365935 - DNA, 16 bp, M. musculus
atatacacaatggaat

SEQ ID NO: 365936 - DNA, 16 bp, M. musculus
atatacacacaaagga

SEQ ID NO: 365937 - DNA, 16 bp, M. musculus
atatacacacacacat

SEQ ID NO: 365938 - DNA, 16 bp, M. musculus
atatacacacagacac

SEQ ID NO: 365939 - DNA, 16 bp, M. musculus
atatacacacatgcat

SEQ ID NO: 365940 - DNA, 16 bp, M. musculus
atatacacagatatat

SEQ ID NO: 365941 - DNA, 16 bp, M. musculus
atatacacatacatgt

SEQ ID NO: 365942 - DNA, 16 bp, M. musculus
atatacacatatatgt

SEQ ID NO: 365943 - DNA, 16 bp, M. musculus
atatacacatatgtgt

SEQ ID NO: 365944 - DNA, 16 bp, M. musculus
atatacacatgtgtgt

SEQ ID NO: 365945 - DNA, 16 bp, M. musculus
atatacaccacacaca

SEQ ID NO: 365946 - DNA, 16 bp, M. musculus
atatacaccatacata

SEQ ID NO: 365947 - DNA, 16 bp, M. musculus
atatacacttttaaaa

SEQ ID NO: 365948 - DNA, 16 bp, M. musculus
atatacagacacacaa

SEQ ID NO: 365949 - DNA, 16 bp, M. musculus
atatacagacatacac

SEQ ID NO: 365950 - DNA, 16 bp, M. musculus
atatacagaggacctg

SEQ ID NO: 365951 - DNA, 16 bp, M. musculus
atatacagcaaatcaa

SEQ ID NO: 365952 - DNA, 16 bp, M. musculus
atatacagtaaataaa

SEQ ID NO: 365953 - DNA, 16 bp, M. musculus
atatacataaaatgaa

SEQ ID NO: 365954 - DNA, 16 bp, M. musculus
atatacatacacacac

SEQ ID NO: 365955 - DNA, 16 bp, M. musculus
atatacatacacacag

SEQ ID NO: 365956 - DNA, 16 bp, M. musculus
atatacatacacacat

SEQ ID NO: 365957 - DNA, 16 bp, M. musculus
atatacatacatatat

SEQ ID NO: 365958 - DNA, 16 bp, M. musculus
atatacatagatacat

SEQ ID NO: 365959 - DNA, 16 bp, M. musculus
atatacatatacacaa

SEQ ID NO: 365960 - DNA, 16 bp, M. musculus
atatacatatacacat

SEQ ID NO: 365961 - DNA, 17 bp, M. musculus
atatacatatacatata

SEQ ID NO: 365962 - DNA, 16 bp, M. musculus
atatacatatatacag

SEQ ID NO: 365963 - DNA, 16 bp, M. musculus
atatacatatatacgt

SEQ ID NO: 365964 - DNA, 16 bp, M. musculus
atatacatatatattc

SEQ ID NO: 365965 - DNA, 16 bp, M. musculus
atatacatatatgaag

SEQ ID NO: 365966 - DNA, 16 bp, M. musculus
atatacatatgtacat

SEQ ID NO: 365967 - DNA, 16 bp, M. musculus
atatacatgcaggaaa

SEQ ID NO: 365968 - DNA, 16 bp, M. musculus
atatacatgcatatat

SEQ ID NO: 365969 - DNA, 16 bp, M. musculus
atatacatgtaaacac

SEQ ID NO: 365970 - DNA, 16 bp, M. musculus
atatacatgtacatat

SEQ ID NO: 365971 - DNA, 16 bp, M. musculus
atatacatgtatgtaa

SEQ ID NO: 365972 - DNA, 16 bp, M. musculus
atatacatgtgtgtac

SEQ ID NO: 365973 - DNA, 16 bp, M. musculus
atatacattacaaatg

SEQ ID NO: 365974 - DNA, 16 bp, M. musculus
atatacattatatatg

SEQ ID NO: 365975 - DNA, 16 bp, M. musculus
atatacattggctctt

SEQ ID NO: 365976 - DNA, 16 bp, M. musculus
atatacattttaaatg

SEQ ID NO: 365977 - DNA, 16 bp, M. musculus
atataccatcatatca

SEQ ID NO: 365978 - DNA, 16 bp, M. musculus
atatacccaaaagatg

SEQ ID NO: 365979 - DNA, 16 bp, M. musculus
atatacctgcttctca

SEQ ID NO: 365980 - DNA, 20 bp, M. musculus
atataccttcttctcagcac

SEQ ID NO: 365981 - DNA, 16 bp, M. musculus
atatactatatgatat

SEQ ID NO: 365982 - DNA, 16 bp, M. musculus
atatactgtataaaaa

SEQ ID NO: 365983 - DNA, 16 bp, M. musculus
atatacttttaaatgt

SEQ ID NO: 365984 - DNA, 16 bp, M. musculus
atatagacaaatagat

SEQ ID NO: 365985 - DNA, 16 bp, M. musculus
atatagacacatacac

SEQ ID NO: 365986 - DNA, 17 bp, M. musculus
atatagatatagatata

SEQ ID NO: 365987 - DNA, 16 bp, M. musculus
atatagatatatagat

SEQ ID NO: 365988 - DNA, 16 bp, M. musculus
atatagatatgtagat

SEQ ID NO: 365989 - DNA, 16 bp, M. musculus
atatagcacacacaca

SEQ ID NO: 365990 - DNA, 16 bp, M. musculus
atatagcatataatat

SEQ ID NO: 365991 - DNA, 16 bp, M. musculus
atatagccatttttac

SEQ ID NO: 365992 - DNA, 16 bp, M. musculus
atatagcccaggttgg

SEQ ID NO: 365993 - DNA, 16 bp, M. musculus
atatagctgtctcctg

SEQ ID NO: 365994 - DNA, 16 bp, M. musculus
atatagctttttaaaa

SEQ ID NO: 365995 - DNA, 16 bp, M. musculus
atatagtatattacat

SEQ ID NO: 365996 - DNA, 16 bp, M. musculus
atatagtatattttga

SEQ ID NO: 365997 - DNA, 16 bp, M. musculus
atatagtatgtatatg

SEQ ID NO: 365998 - DNA, 16 bp, M. musculus
atatagtcaaaatagc

SEQ ID NO: 365999 - DNA, 16 bp, M. musculus
atatagtcaagctgac

SEQ ID NO: 366000 - DNA, 16 bp, M. musculus
atatagtgtatgtgtg

SEQ ID NO: 366001 - DNA, 16 bp, M. musculus
atatagttccttatgt

SEQ ID NO: 366002 - DNA, 16 bp, M. musculus
atatataaacatgtat

SEQ ID NO: 366003 - DNA, 16 bp, M. musculus
atatataaattctgta

SEQ ID NO: 366004 - DNA, 16 bp, M. musculus
atatataagccaaata

SEQ ID NO: 366005 - DNA, 16 bp, M. musculus
atatataaggaactca

SEQ ID NO: 366006 - DNA, 16 bp, M. musculus
atatataatctcattc

SEQ ID NO: 366007 - DNA, 16 bp, M. musculus
atatatacacacacag

SEQ ID NO: 366008 - DNA, 16 bp, M. musculus
atatatacacacacat

SEQ ID NO: 366009 - DNA, 16 bp, M. musculus
atatatacacataaac

SEQ ID NO: 366010 - DNA, 16 bp, M. musculus
atatatacacatacta

SEQ ID NO: 366011 - DNA, 16 bp, M. musculus
atatatacacatatat

SEQ ID NO: 366012 - DNA, 16 bp, M. musculus
atatatacacatatgt

SEQ ID NO: 366013 - DNA, 16 bp, M. musculus
atatatacacatgtat

SEQ ID NO: 366014 - DNA, 16 bp, M. musculus
atatatacacatgtgc

SEQ ID NO: 366015 - DNA, 16 bp, M. musculus
atatatacacatgtgt

SEQ ID NO: 366016 - DNA, 16 bp, M. musculus
atatatacagtatata

SEQ ID NO: 366017 - DNA, 16 bp, M. musculus
atatatacataaatgt

SEQ ID NO: 366018 - DNA, 16 bp, M. musculus
atatatacatacatat

SEQ ID NO: 366019 - DNA, 16 bp, M. musculus
atatatacatagatat

SEQ ID NO: 366020 - DNA, 16 bp, M. musculus
atatatacatatacat

SEQ ID NO: 366021 - DNA, 16 bp, M. musculus
atatatacatattgta

SEQ ID NO: 366022 - DNA, 16 bp, M. musculus
atatatacatgaaaat

SEQ ID NO: 366023 - DNA, 16 bp, M. musculus
atatatacattataca

SEQ ID NO: 366024 - DNA, 16 bp, M. musculus
atatatacatttctat

SEQ ID NO: 366025 - DNA, 16 bp, M. musculus
atatatacattttcat

SEQ ID NO: 366026 - DNA, 16 bp, M. musculus
atatatacccaaaaga

SEQ ID NO: 366027 - DNA, 16 bp, M. musculus
atatatactatgatat

SEQ ID NO: 366028 - DNA, 16 bp, M. musculus
atatatagagagagat

SEQ ID NO: 366029 - DNA, 16 bp, M. musculus
atatatagatatagat

SEQ ID NO: 366030 - DNA, 16 bp, M. musculus
atatatagctcagtgg

SEQ ID NO: 366031 - DNA, 16 bp, M. musculus
atatatatacacacaa

SEQ ID NO: 366032 - DNA, 16 bp, M. musculus
atatatatacacactc

SEQ ID NO: 366033 - DNA, 16 bp, M. musculus
atatatatacatatgt

SEQ ID NO: 366034 - DNA, 16 bp, M. musculus
atatatatacatattc

SEQ ID NO: 366035 - DNA, 16 bp, M. musculus
atatatatagatacat

SEQ ID NO: 366036 - DNA, 16 bp, M. musculus
atatatatataaatgg

SEQ ID NO: 366037 - DNA, 16 bp, M. musculus
atatatatataatgtg

SEQ ID NO: 366038 - DNA, 16 bp, M. musculus
atatatatataccaat

SEQ ID NO: 366039 - DNA, 16 bp, M. musculus
atatatatatactcaa

SEQ ID NO: 366040 - DNA, 16 bp, M. musculus
atatatatatactcta

SEQ ID NO: 366041 - DNA, 16 bp, M. musculus
atatatatatagcata

SEQ ID NO: 366042 - DNA, 16 bp, M. musculus
atatatatatagtgta

SEQ ID NO: 366043 - DNA, 20 bp, M. musculus
atatatatatatacacacat

SEQ ID NO: 366044 - DNA, 17 bp, M. musculus
atatatatatatagtga

SEQ ID NO: 366045 - DNA, 16 bp, M. musculus
atatatatatatatcc

SEQ ID NO: 366046 - DNA, 16 bp, M. musculus
atatatatatatcttg

SEQ ID NO: 366047 - DNA, 16 bp, M. musculus
atatatatatatgtac

SEQ ID NO: 366048 - DNA, 16 bp, M. musculus
atatatatatattctc

SEQ ID NO: 366049 - DNA, 16 bp, M. musculus
atatatatatattgtc

SEQ ID NO: 366050 - DNA, 16 bp, M. musculus
atatatatatattgtg

SEQ ID NO: 366051 - DNA, 16 bp, M. musculus
atatatatatatttgc

SEQ ID NO: 366052 - DNA, 16 bp, M. musculus
atatatatatctcaag

SEQ ID NO: 366053 - DNA, 16 bp, M. musculus
atatatatatctccca

SEQ ID NO: 366054 - DNA, 16 bp, M. musculus
atatatatatgaagag

SEQ ID NO: 366055 - DNA, 16 bp, M. musculus
atatatatatgagata

SEQ ID NO: 366056 - DNA, 16 bp, M. musculus
atatatatatgagttt

SEQ ID NO: 366057 - DNA, 16 bp, M. musculus
atatatatatgatgga

SEQ ID NO: 366058 - DNA, 16 bp, M. musculus
atatatatatgtgtat

SEQ ID NO: 366059 - DNA, 16 bp, M. musculus
atatatatattacaca

SEQ ID NO: 366060 - DNA, 16 bp, M. musculus
atatatatattcatgt

SEQ ID NO: 366061 - DNA, 16 bp, M. musculus
atatatatattttcca

SEQ ID NO: 366062 - DNA, 16 bp, M. musculus
atatatatcacatata

SEQ ID NO: 366063 - DNA, 16 bp, M. musculus
atatatatgcacacac

SEQ ID NO: 366064 - DNA, 16 bp, M. musculus
atatatatgcatacat

SEQ ID NO: 366065 - DNA, 16 bp, M. musculus
atatatatgcttttat

SEQ ID NO: 366066 - DNA, 16 bp, M. musculus
atatatatggaatata

SEQ ID NO: 366067 - DNA, 16 bp, M. musculus
atatatatgtacatac

SEQ ID NO: 366068 - DNA, 16 bp, M. musculus
atatatatgtatgtgt

SEQ ID NO: 366069 - DNA, 16 bp, M. musculus
atatatatgttacata

SEQ ID NO: 366070 - DNA, 16 bp, M. musculus
atatatatgttcacat

SEQ ID NO: 366071 - DNA, 16 bp, M. musculus
atatatattacacata

SEQ ID NO: 366072 - DNA, 16 bp, M. musculus
atatatattcatgcat

SEQ ID NO: 366073 - DNA, 16 bp, M. musculus
atatatattgtataca

SEQ ID NO: 366074 - DNA, 16 bp, M. musculus
atatatatttatgtga

SEQ ID NO: 366075 - DNA, 16 bp, M. musculus
atatatcatataacat

SEQ ID NO: 366076 - DNA, 16 bp, M. musculus
atatatcatatgatat

SEQ ID NO: 366077 - DNA, 16 bp, M. musculus
atatatcccaggctgg

SEQ ID NO: 366078 - DNA, 16 bp, M. musculus
atatatctatctgtat

SEQ ID NO: 366079 - DNA, 16 bp, M. musculus
atatatctctatatat

SEQ ID NO: 366080 - DNA, 16 bp, M. musculus
atatatctctatctct

SEQ ID NO: 366081 - DNA, 16 bp, M. musculus
atatatctgtatacat

SEQ ID NO: 366082 - DNA, 16 bp, M. musculus
atatatctgtgtgtgt

SEQ ID NO: 366083 - DNA, 16 bp, M. musculus
atatatgaaaaacata

SEQ ID NO: 366084 - DNA, 16 bp, M. musculus
atatatgaagccctgg

SEQ ID NO: 366085 - DNA, 16 bp, M. musculus
atatatgaaggtcaga

SEQ ID NO: 366086 - DNA, 16 bp, M. musculus
atatatgaatatatgt

SEQ ID NO: 366087 - DNA, 16 bp, M. musculus
atatatgaatgtgtgt

SEQ ID NO: 366088 - DNA, 16 bp, M. musculus
atatatgatgagtaca

SEQ ID NO: 366089 - DNA, 16 bp, M. musculus
atatatgcaatatatt

SEQ ID NO: 366090 - DNA, 16 bp, M. musculus
atatatgcacatacat

SEQ ID NO: 366091 - DNA, 16 bp, M. musculus
atatatgcataataca

SEQ ID NO: 366092 - DNA, 16 bp, M. musculus
atatatgcatatatac

SEQ ID NO: 366093 - DNA, 19 bp, M. musculus
atatatgcatatatatata

SEQ ID NO: 366094 - DNA, 16 bp, M. musculus
atatatgcatatattt

SEQ ID NO: 366095 - DNA, 16 bp, M. musculus
atatatgcatatgtat

SEQ ID NO: 366096 - DNA, 16 bp, M. musculus
atatatgcccaggaga

SEQ ID NO: 366097 - DNA, 16 bp, M. musculus
atatatgctaataaaa

SEQ ID NO: 366098 - DNA, 16 bp, M. musculus
atatatgctatatata

SEQ ID NO: 366099 - DNA, 67 bp, M. musculus
atatatggactctgttactgtttgaaactgtgtgtagaggcagtcaagacaggtcagaaaatcctta

SEQ ID NO: 366100 - DNA, 16 bp, M. musculus
atatatgtaaatatgt

SEQ ID NO: 366101 - DNA, 16 bp, M. musculus
atatatgtaagtatac

SEQ ID NO: 366102 - DNA, 16 bp, M. musculus
atatatgtaatatgta

SEQ ID NO: 366103 - DNA, 16 bp, M. musculus
atatatgtacatatat

SEQ ID NO: 366104 - DNA, 16 bp, M. musculus
atatatgtacatgtgt

SEQ ID NO: 366105 - DNA, 16 bp, M. musculus
atatatgtatataaca

SEQ ID NO: 366106 - DNA, 16 bp, M. musculus
atatatgtatatacaa

SEQ ID NO: 366107 - DNA, 16 bp, M. musculus
atatatgtatatatgt

SEQ ID NO: 366108 - DNA, 16 bp, M. musculus
atatatgtatatgtgt

SEQ ID NO: 366109 - DNA, 16 bp, M. musculus
atatatgtatattaca

SEQ ID NO: 366110 - DNA, 16 bp, M. musculus
atatatgtatgcatat

SEQ ID NO: 366111 - DNA, 16 bp, M. musculus
atatatgtatgtaaat

SEQ ID NO: 366112 - DNA, 16 bp, M. musculus
atatatgtatgtatat

SEQ ID NO: 366113 - DNA, 16 bp, M. musculus
atatatgtatgtgtaa

SEQ ID NO: 366114 - DNA, 16 bp, M. musculus
atatatgtatgtgtgg

SEQ ID NO: 366115 - DNA, 16 bp, M. musculus
atatatgtatgtgtgt

SEQ ID NO: 366116 - DNA, 16 bp, M. musculus
atatatgtatttatga

SEQ ID NO: 366117 - DNA, 16 bp, M. musculus
atatatgtatttttct

SEQ ID NO: 366118 - DNA, 16 bp, M. musculus
atatatgtgaatatat

SEQ ID NO: 366119 - DNA, 16 bp, M. musculus
atatatgtgggcatca

SEQ ID NO: 366120 - DNA, 16 bp, M. musculus
atatatgtgtacatat

SEQ ID NO: 366121 - DNA, 16 bp, M. musculus
atatatgtgtatatat

SEQ ID NO: 366122 - DNA, 16 bp, M. musculus
atatatgtgtatatga

SEQ ID NO: 366123 - DNA, 18 bp, M. musculus
atatatgtgtatatgtat

SEQ ID NO: 366124 - DNA, 16 bp, M. musculus
atatatgtgtgtgtac

SEQ ID NO: 366125 - DNA, 16 bp, M. musculus
atatatgtgtgtgtat

SEQ ID NO: 366126 - DNA, 16 bp, M. musculus
atatatgttacatata

SEQ ID NO: 366127 - DNA, 16 bp, M. musculus
atatatgtttatgtgt

SEQ ID NO: 366128 - DNA, 16 bp, M. musculus
atatattaattgtaca

SEQ ID NO: 366129 - DNA, 16 bp, M. musculus
atatattacatgcata

SEQ ID NO: 366130 - DNA, 16 bp, M. musculus
atatattatacatgta

SEQ ID NO: 366131 - DNA, 16 bp, M. musculus
atatattatatacaca

SEQ ID NO: 366132 - DNA, 16 bp, M. musculus
atatattcaggcaaaa

SEQ ID NO: 366133 - DNA, 16 bp, M. musculus
atatattcataaatac

SEQ ID NO: 366134 - DNA, 16 bp, M. musculus
atatattcatatttgt

SEQ ID NO: 366135 - DNA, 16 bp, M. musculus
atatattctgattata

SEQ ID NO: 366136 - DNA, 16 bp, M. musculus
atatattgagatataa

SEQ ID NO: 366137 - DNA, 16 bp, M. musculus
atatattgtatgagaa

SEQ ID NO: 366138 - DNA, 16 bp, M. musculus
atatatttatgaatgt

SEQ ID NO: 366139 - DNA, 16 bp, M. musculus
atatatttcacacaca

SEQ ID NO: 366140 - DNA, 16 bp, M. musculus
atatatttcacatata

SEQ ID NO: 366141 - DNA, 16 bp, M. musculus
atatatttccaaatat

SEQ ID NO: 366142 - DNA, 16 bp, M. musculus
atatatttgaatgtgt

SEQ ID NO: 366143 - DNA, 16 bp, M. musculus
atatatttgcattctt

SEQ ID NO: 366144 - DNA, 16 bp, M. musculus
atatatttgtgtgtgt

SEQ ID NO: 366145 - DNA, 16 bp, M. musculus
atatatttgttttcta

SEQ ID NO: 366146 - DNA, 16 bp, M. musculus
atatattttaagaagt

SEQ ID NO: 366147 - DNA, 16 bp, M. musculus
atatattttaagtgaa

SEQ ID NO: 366148 - DNA, 16 bp, M. musculus
atatattttctcaatg

SEQ ID NO: 366149 - DNA, 16 bp, M. musculus
atatattttgcaaata

SEQ ID NO: 366150 - DNA, 16 bp, M. musculus
atatatttttaaaagc

SEQ ID NO: 366151 - DNA, 16 bp, M. musculus
atatatttttacatgt

SEQ ID NO: 366152 - DNA, 16 bp, M. musculus
atatcaaagcaaaaat

SEQ ID NO: 366153 - DNA, 16 bp, M. musculus
atatcaagtcactgca

SEQ ID NO: 366154 - DNA, 16 bp, M. musculus
atatcaagttcaaggc

SEQ ID NO: 366155 - DNA, 16 bp, M. musculus
atatcaatcaaccaga

SEQ ID NO: 366156 - DNA, 16 bp, M. musculus
atatcaatgaaatcaa

SEQ ID NO: 366157 - DNA, 16 bp, M. musculus
atatcaatgctccaaa

SEQ ID NO: 366158 - DNA, 16 bp, M. musculus
atatcacaaacacctg

SEQ ID NO: 366159 - DNA, 16 bp, M. musculus
atatcacacacacata

SEQ ID NO: 366160 - DNA, 16 bp, M. musculus
atatcacacacatata

SEQ ID NO: 366161 - DNA, 16 bp, M. musculus
atatcactgaaaaaaa

SEQ ID NO: 366162 - DNA, 16 bp, M. musculus
atatcagaatatcatt

SEQ ID NO: 366163 - DNA, 16 bp, M. musculus
atatcagagtaactgt

SEQ ID NO: 366164 - DNA, 16 bp, M. musculus
atatcagatattctgt

SEQ ID NO: 366165 - DNA, 16 bp, M. musculus
atatcagatatttaca

SEQ ID NO: 366166 - DNA, 16 bp, M. musculus
atatcagatatttatg

SEQ ID NO: 366167 - DNA, 16 bp, M. musculus
atatcagcagcaagaa

SEQ ID NO: 366168 - DNA, 16 bp, M. musculus
atatcagcagtccagt

SEQ ID NO: 366169 - DNA, 16 bp, M. musculus
atatcagctggagtat

SEQ ID NO: 366170 - DNA, 16 bp, M. musculus
atatcagtctcctgtc

SEQ ID NO: 366171 - DNA, 16 bp, M. musculus
atatcatctgtgaata

SEQ ID NO: 366172 - DNA, 16 bp, M. musculus
atatcatgtgagttct

SEQ ID NO: 366173 - DNA, 17 bp, M. musculus
atatcatgtgtgttctt

SEQ ID NO: 366174 - DNA, 16 bp, M. musculus
atatcatgttttcttt

SEQ ID NO: 366175 - DNA, 16 bp, M. musculus
atatcatttgaaattt

SEQ ID NO: 366176 - DNA, 18 bp, M. musculus
atatccaatatatgcaaa

SEQ ID NO: 366177 - DNA, 16 bp, M. musculus
atatccaatgaaaaaa

SEQ ID NO: 366178 - DNA, 16 bp, M. musculus
atatccacacacatac

SEQ ID NO: 366179 - DNA, 16 bp, M. musculus
atatccagaaaatatt

SEQ ID NO: 366180 - DNA, 16 bp, M. musculus
atatccagaagatatt

SEQ ID NO: 366181 - DNA, 16 bp, M. musculus
atatccagaagctgga

SEQ ID NO: 366182 - DNA, 16 bp, M. musculus
atatccataagggaaa

SEQ ID NO: 366183 - DNA, 16 bp, M. musculus
atatccatatccatat

SEQ ID NO: 366184 - DNA, 17 bp, M. musculus
atatcccactgcttaga

SEQ ID NO: 366185 - DNA, 16 bp, M. musculus
atatccccaggagagg

SEQ ID NO: 366186 - DNA, 16 bp, M. musculus
atatccccatgcacat

SEQ ID NO: 366187 - DNA, 16 bp, M. musculus
atatccctaaagaaat

SEQ ID NO: 366188 - DNA, 16 bp, M. musculus
atatccctgactgtcc

SEQ ID NO: 366189 - DNA, 16 bp, M. musculus
atatccgcctgcctct

SEQ ID NO: 366190 - DNA, 16 bp, M. musculus
atatcctgagttttgc

SEQ ID NO: 366191 - DNA, 16 bp, M. musculus
atatcctgatgatgaa

SEQ ID NO: 366192 - DNA, 16 bp, M. musculus
atatcctgccactttg

SEQ ID NO: 366193 - DNA, 16 bp, M. musculus
atatcctgcttatcag

SEQ ID NO: 366194 - DNA, 16 bp, M. musculus
atatccttgaacacat

SEQ ID NO: 366195 - DNA, 16 bp, M. musculus
atatccttttaaaaaa

SEQ ID NO: 366196 - DNA, 16 bp, M. musculus
atatctaaaatatgta

SEQ ID NO: 366197 - DNA, 16 bp, M. musculus
atatctaataaaaatg

SEQ ID NO: 366198 - DNA, 16 bp, M. musculus
atatctaatacatata

SEQ ID NO: 366199 - DNA, 16 bp, M. musculus
atatctacatatacat

SEQ ID NO: 366200 - DNA, 16 bp, M. musculus
atatctacctgaagac

SEQ ID NO: 366201 - DNA, 16 bp, M. musculus
atatctagaagatgtt

SEQ ID NO: 366202 - DNA, 16 bp, M. musculus
atatctataatctcag

SEQ ID NO: 366203 - DNA, 24 bp, M. musculus
atatctatctatctatctatctat

SEQ ID NO: 366204 - DNA, 19 bp, M. musculus
atatctatctatctatctg

SEQ ID NO: 366205 - DNA, 16 bp, M. musculus
atatctatgtctatat

SEQ ID NO: 366206 - DNA, 16 bp, M. musculus
atatctctcaatatca

SEQ ID NO: 366207 - DNA, 16 bp, M. musculus
atatctctgacccata

SEQ ID NO: 366208 - DNA, 16 bp, M. musculus
atatctctgagtgcct

SEQ ID NO: 366209 - DNA, 16 bp, M. musculus
atatctgaagattcag

SEQ ID NO: 366210 - DNA, 16 bp, M. musculus
atatctgactggagcc

SEQ ID NO: 366211 - DNA, 16 bp, M. musculus
atatctgagtttgagg

SEQ ID NO: 366212 - DNA, 16 bp, M. musculus
atatctgatatgcagg

SEQ ID NO: 366213 - DNA, 16 bp, M. musculus
atatctgatatgcgac

SEQ ID NO: 366214 - DNA, 16 bp, M. musculus
atatctgatatgtaac

SEQ ID NO: 366215 - DNA, 16 bp, M. musculus
atatctgatatgtagg

SEQ ID NO: 366216 - DNA, 16 bp, M. musculus
atatctggagactgtc

SEQ ID NO: 366217 - DNA, 16 bp, M. musculus
atatctgggagaattt

SEQ ID NO: 366218 - DNA, 16 bp, M. musculus
atatctgtatatatct

SEQ ID NO: 366219 - DNA, 16 bp, M. musculus
atatctgtgtatgtgt

SEQ ID NO: 366220 - DNA, 16 bp, M. musculus
atatctgtgtgtgtgt

SEQ ID NO: 366221 - DNA, 16 bp, M. musculus
atatcttatgatgctg

SEQ ID NO: 366222 - DNA, 16 bp, M. musculus
atatcttcattctcat

SEQ ID NO: 366223 - DNA, 16 bp, M. musculus
atatcttctgaagcta

SEQ ID NO: 366224 - DNA, 16 bp, M. musculus
atatcttcttttaaaa

SEQ ID NO: 366225 - DNA, 16 bp, M. musculus
atatcttgcagacagg

SEQ ID NO: 366226 - DNA, 16 bp, M. musculus
atatcttgggtaacct

SEQ ID NO: 366227 - DNA, 16 bp, M. musculus
atatcttggtttctct

SEQ ID NO: 366228 - DNA, 16 bp, M. musculus
atatctttcttttctg

SEQ ID NO: 366229 - DNA, 16 bp, M. musculus
atatcttttgagttct

SEQ ID NO: 366230 - DNA, 16 bp, M. musculus
atatgaaaaagaacac

SEQ ID NO: 366231 - DNA, 16 bp, M. musculus
atatgaaaaattcaaa

SEQ ID NO: 366232 - DNA, 16 bp, M. musculus
atatgaaagagaacat

SEQ ID NO: 366233 - DNA, 16 bp, M. musculus
atatgaaattcacaaa

SEQ ID NO: 366234 - DNA, 16 bp, M. musculus
atatgaacatagtaga

SEQ ID NO: 366235 - DNA, 16 bp, M. musculus
atatgaactaagcagt

SEQ ID NO: 366236 - DNA, 16 bp, M. musculus
atatgaagatgtactt

SEQ ID NO: 366237 - DNA, 16 bp, M. musculus
atatgaatgtatatgt

SEQ ID NO: 366238 - DNA, 16 bp, M. musculus
atatgagacctcaaag

SEQ ID NO: 366239 - DNA, 16 bp, M. musculus
atatgagactatgggg

SEQ ID NO: 366240 - DNA, 16 bp, M. musculus
atatgagagaaaacat

SEQ ID NO: 366241 - DNA, 16 bp, M. musculus
atatgagcctatgggg

SEQ ID NO: 366242 - DNA, 16 bp, M. musculus
atatgagtgtgtgtgt

SEQ ID NO: 366243 - DNA, 16 bp, M. musculus
atatgataggatatat

SEQ ID NO: 366244 - DNA, 16 bp, M. musculus
atatgatatatacaca

SEQ ID NO: 366245 - DNA, 16 bp, M. musculus
atatgatatatgacat

SEQ ID NO: 366246 - DNA, 16 bp, M. musculus
atatgatatggtatga

SEQ ID NO: 366247 - DNA, 16 bp, M. musculus
atatgatcaaagtaca

SEQ ID NO: 366248 - DNA, 16 bp, M. musculus
atatgatcaagataca

SEQ ID NO: 366249 - DNA, 16 bp, M. musculus
atatgatgaaaataca

SEQ ID NO: 366250 - DNA, 16 bp, M. musculus
atatgatgcacataca

SEQ ID NO: 366251 - DNA, 16 bp, M. musculus
atatgatgtatatgca

SEQ ID NO: 366252 - DNA, 16 bp, M. musculus
atatgatgtgtatgta

SEQ ID NO: 366253 - DNA, 16 bp, M. musculus
atatgattttatacat

SEQ ID NO: 366254 - DNA, 16 bp, M. musculus
atatgcaaatgtatat

SEQ ID NO: 366255 - DNA, 16 bp, M. musculus
atatgcacatatattc

SEQ ID NO: 366256 - DNA, 16 bp, M. musculus
atatgcacccacacac

SEQ ID NO: 366257 - DNA, 16 bp, M. musculus
atatgcagaagacctg

SEQ ID NO: 366258 - DNA, 16 bp, M. musculus
atatgcagattatatt

SEQ ID NO: 366259 - DNA, 16 bp, M. musculus
atatgcagctgcagcc

SEQ ID NO: 366260 - DNA, 16 bp, M. musculus
atatgcaggaccatta

SEQ ID NO: 366261 - DNA, 16 bp, M. musculus
atatgcaggcagaaca

SEQ ID NO: 366262 - DNA, 16 bp, M. musculus
atatgcaggctatctg

SEQ ID NO: 366263 - DNA, 16 bp, M. musculus
atatgcataaaacaaa

SEQ ID NO: 366264 - DNA, 16 bp, M. musculus
atatgcatacaaaata

SEQ ID NO: 366265 - DNA, 16 bp, M. musculus
atatgcatacaaatgt

SEQ ID NO: 366266 - DNA, 16 bp, M. musculus
atatgcatatacatat

SEQ ID NO: 366267 - DNA, 16 bp, M. musculus
atatgcatatatttct

SEQ ID NO: 366268 - DNA, 16 bp, M. musculus
atatgcatatgtatat

SEQ ID NO: 366269 - DNA, 16 bp, M. musculus
atatgcatatgtgttt

SEQ ID NO: 366270 - DNA, 16 bp, M. musculus
atatgcatcagtacag

SEQ ID NO: 366271 - DNA, 16 bp, M. musculus
atatgcatgtgtacat

SEQ ID NO: 366272 - DNA, 16 bp, M. musculus
atatgcatgtgtgttt

SEQ ID NO: 366273 - DNA, 16 bp, M. musculus
atatgccatagtgtct

SEQ ID NO: 366274 - DNA, 16 bp, M. musculus
atatgcccacgagtgg

SEQ ID NO: 366275 - DNA, 16 bp, M. musculus
atatgcccaggagtgt

SEQ ID NO: 366276 - DNA, 16 bp, M. musculus
atatgcctggtgcctg

SEQ ID NO: 366277 - DNA, 16 bp, M. musculus
atatgccttaaacagc

SEQ ID NO: 366278 - DNA, 16 bp, M. musculus
atatgctgtggactgg

SEQ ID NO: 366279 - DNA, 16 bp, M. musculus
atatgcttatatttta

SEQ ID NO: 366280 - DNA, 16 bp, M. musculus
atatgcttatgtgtat

SEQ ID NO: 366281 - DNA, 16 bp, M. musculus
atatgctttttaaaaa

SEQ ID NO: 366282 - DNA, 16 bp, M. musculus
atatggaaattcatca

SEQ ID NO: 366283 - DNA, 16 bp, M. musculus
atatggaacagatgat

SEQ ID NO: 366284 - DNA, 16 bp, M. musculus
atatggaacagtcaga

SEQ ID NO: 366285 - DNA, 16 bp, M. musculus
atatggaaccagaaga

SEQ ID NO: 366286 - DNA, 17 bp, M. musculus
atatggaagagagaatc

SEQ ID NO: 366287 - DNA, 16 bp, M. musculus
atatggaagtcagaga

SEQ ID NO: 366288 - DNA, 17 bp, M. musculus
atatggaagtggatact

SEQ ID NO: 366289 - DNA, 16 bp, M. musculus
atatggagctcaagaa

SEQ ID NO: 366290 - DNA, 16 bp, M. musculus
atatggaggccagaag

SEQ ID NO: 366291 - DNA, 16 bp, M. musculus
atatggagtgtgaaaa

SEQ ID NO: 366292 - DNA, 16 bp, M. musculus
atatggatattttaaa

SEQ ID NO: 366293 - DNA, 16 bp, M. musculus
atatggctctggcttt

SEQ ID NO: 366294 - DNA, 16 bp, M. musculus
atatggctgctatgaa

SEQ ID NO: 366295 - DNA, 68 bp, M. musculus
atatgggaaccggtttgtcaggacccaggaagcagtcagagaggcgacccaggaagacccacaagggt

SEQ ID NO: 366296 - DNA, 16 bp, M. musculus
atatgggagggctcag

SEQ ID NO: 366297 - DNA, 16 bp, M. musculus
atatgggtcctttcag

SEQ ID NO: 366298 - DNA, 16 bp, M. musculus
atatggtatatatata

SEQ ID NO: 366299 - DNA, 16 bp, M. musculus
atatggtcaattttgt

SEQ ID NO: 366300 - DNA, 16 bp, M. musculus
atatggtctgtgaatt

SEQ ID NO: 366301 - DNA, 16 bp, M. musculus
atatggtgatttgaat

SEQ ID NO: 366302 - DNA, 16 bp, M. musculus
atatggtgcacataaa

SEQ ID NO: 366303 - DNA, 16 bp, M. musculus
atatggtggctcacaa

SEQ ID NO: 366304 - DNA, 16 bp, M. musculus
atatggtggttcacaa

SEQ ID NO: 366305 - DNA, 16 bp, M. musculus
atatgtaaaatatgta

SEQ ID NO: 366306 - DNA, 16 bp, M. musculus
atatgtaacagaagat

SEQ ID NO: 366307 - DNA, 16 bp, M. musculus
atatgtacacacatat

SEQ ID NO: 366308 - DNA, 16 bp, M. musculus
atatgtacacatacac

SEQ ID NO: 366309 - DNA, 16 bp, M. musculus
atatgtacaggcaaaa

SEQ ID NO: 366310 - DNA, 16 bp, M. musculus
atatgtacatatatgt

SEQ ID NO: 366311 - DNA, 16 bp, M. musculus
atatgtacatatatta

SEQ ID NO: 366312 - DNA, 16 bp, M. musculus
atatgtacatatattc

SEQ ID NO: 366313 - DNA, 16 bp, M. musculus
atatgtacgtgtatat

SEQ ID NO: 366314 - DNA, 16 bp, M. musculus
atatgtactttatttt

SEQ ID NO: 366315 - DNA, 16 bp, M. musculus
atatgtagaagacaaa

SEQ ID NO: 366316 - DNA, 16 bp, M. musculus
atatgtagaagaggat

SEQ ID NO: 366317 - DNA, 16 bp, M. musculus
atatgtagaatatata

SEQ ID NO: 366318 - DNA, 16 bp, M. musculus
atatgtagcagaaatg

SEQ ID NO: 366319 - DNA, 21 bp, M. musculus
atatgtagcagaagatggcct

SEQ ID NO: 366320 - DNA, 16 bp, M. musculus
atatgtagcagagcat

SEQ ID NO: 366321 - DNA, 16 bp, M. musculus
atatgtagcagaggat

SEQ ID NO: 366322 - DNA, 16 bp, M. musculus
atatgtagcagagggc

SEQ ID NO: 366323 - DNA, 16 bp, M. musculus
atatgtagcagatgtg

SEQ ID NO: 366324 - DNA, 16 bp, M. musculus
atatgtagctgaggct

SEQ ID NO: 366325 - DNA, 16 bp, M. musculus
atatgtaggtatgtat

SEQ ID NO: 366326 - DNA, 16 bp, M. musculus
atatgtatacaatata

SEQ ID NO: 366327 - DNA, 16 bp, M. musculus
atatgtatacaatgta

SEQ ID NO: 366328 - DNA, 16 bp, M. musculus
atatgtatacatatat

SEQ ID NO: 366329 - DNA, 16 bp, M. musculus
atatgtatacatgcat

SEQ ID NO: 366330 - DNA, 16 bp, M. musculus
atatgtatataagtat

SEQ ID NO: 366331 - DNA, 16 bp, M. musculus
atatgtatatatactt

SEQ ID NO: 366332 - DNA, 16 bp, M. musculus
atatgtatatatctgt

SEQ ID NO: 366333 - DNA, 16 bp, M. musculus
atatgtatatatgatt

SEQ ID NO: 366334 - DNA, 16 bp, M. musculus
atatgtatatatgtaa

SEQ ID NO: 366335 - DNA, 16 bp, M. musculus
atatgtatatgtattc

SEQ ID NO: 366336 - DNA, 16 bp, M. musculus
atatgtatatgtgtat

SEQ ID NO: 366337 - DNA, 16 bp, M. musculus
atatgtatatttatac

SEQ ID NO: 366338 - DNA, 16 bp, M. musculus
atatgtatatttttct

SEQ ID NO: 366339 - DNA, 16 bp, M. musculus
atatgtatctgtgtgt

SEQ ID NO: 366340 - DNA, 17 bp, M. musculus
atatgtatgaaaagatg

SEQ ID NO: 366341 - DNA, 16 bp, M. musculus
atatgtatgaatatat

SEQ ID NO: 366342 - DNA, 16 bp, M. musculus
atatgtatgagaagat

SEQ ID NO: 366343 - DNA, 16 bp, M. musculus
atatgtatgtaattat

SEQ ID NO: 366344 - DNA, 16 bp, M. musculus
atatgtatgtatatat

SEQ ID NO: 366345 - DNA, 16 bp, M. musculus
atatgtatgtatgtaa

SEQ ID NO: 366346 - DNA, 17 bp, M. musculus
atatgtatgtatgtata

SEQ ID NO: 366347 - DNA, 16 bp, M. musculus
atatgtatgtgcctgt

SEQ ID NO: 366348 - DNA, 16 bp, M. musculus
atatgtatgtgtacca

SEQ ID NO: 366349 - DNA, 16 bp, M. musculus
atatgtatgtgtatat

SEQ ID NO: 366350 - DNA, 16 bp, M. musculus
atatgtatgtgtatgt

SEQ ID NO: 366351 - DNA, 16 bp, M. musculus
atatgtatgtgtgtat

SEQ ID NO: 366352 - DNA, 16 bp, M. musculus
atatgtattcactgat

SEQ ID NO: 366353 - DNA, 16 bp, M. musculus
atatgtattcatatat

SEQ ID NO: 366354 - DNA, 16 bp, M. musculus
atatgtattgtgtata

SEQ ID NO: 366355 - DNA, 16 bp, M. musculus
atatgtatttgtatac

SEQ ID NO: 366356 - DNA, 16 bp, M. musculus
atatgtcaaaatatca

SEQ ID NO: 366357 - DNA, 16 bp, M. musculus
atatgtcaggaatgtg

SEQ ID NO: 366358 - DNA, 16 bp, M. musculus
atatgtcagtatttat

SEQ ID NO: 366359 - DNA, 16 bp, M. musculus
atatgtcagttatatg

SEQ ID NO: 366360 - DNA, 16 bp, M. musculus
atatgtctaaaataaa

SEQ ID NO: 366361 - DNA, 16 bp, M. musculus
atatgtctatatacat

SEQ ID NO: 366362 - DNA, 16 bp, M. musculus
atatgtctatatatgt

SEQ ID NO: 366363 - DNA, 16 bp, M. musculus
atatgtctgtctttct

SEQ ID NO: 366364 - DNA, 16 bp, M. musculus
atatgtctgtgcacca

SEQ ID NO: 366365 - DNA, 16 bp, M. musculus
atatgtgcaaatatat

SEQ ID NO: 366366 - DNA, 16 bp, M. musculus
atatgtgcacatatat

SEQ ID NO: 366367 - DNA, 16 bp, M. musculus
atatgtgcatgcatgt

SEQ ID NO: 366368 - DNA, 16 bp, M. musculus
atatgtgcatttatat

SEQ ID NO: 366369 - DNA, 16 bp, M. musculus
atatgtggtacattta

SEQ ID NO: 366370 - DNA, 16 bp, M. musculus
atatgtgtactgtgtg

SEQ ID NO: 366371 - DNA, 16 bp, M. musculus
atatgtgtatatgaaa

SEQ ID NO: 366372 - DNA, 16 bp, M. musculus
atatgtgtatatgtgt

SEQ ID NO: 366373 - DNA, 16 bp, M. musculus
atatgtgtatattcat

SEQ ID NO: 366374 - DNA, 18 bp, M. musculus
atatgtgtatgtgtgtgt

SEQ ID NO: 366375 - DNA, 16 bp, M. musculus
atatgtgtatttgtat

SEQ ID NO: 366376 - DNA, 16 bp, M. musculus
atatgtgtgaatgtgt

SEQ ID NO: 366377 - DNA, 16 bp, M. musculus
atatgtgtgcatatat

SEQ ID NO: 366378 - DNA, 16 bp, M. musculus
atatgtgtgctgtgtg

SEQ ID NO: 366379 - DNA, 16 bp, M. musculus
atatgtgtgtagatat

SEQ ID NO: 366380 - DNA, 16 bp, M. musculus
atatgtgtgtatatac

SEQ ID NO: 366381 - DNA, 16 bp, M. musculus
atatgtgtgtatgtat

SEQ ID NO: 366382 - DNA, 16 bp, M. musculus
atatgtgtgtatgtgt

SEQ ID NO: 366383 - DNA, 16 bp, M. musculus
atatgtgtgtgcgtgt

SEQ ID NO: 366384 - DNA, 16 bp, M. musculus
atatgtgtgtgggttc

SEQ ID NO: 366385 - DNA, 16 bp, M. musculus
atatgtgtgtggtgtg

SEQ ID NO: 366386 - DNA, 16 bp, M. musculus
atatgtgtgtgtacat

SEQ ID NO: 366387 - DNA, 16 bp, M. musculus
atatgtgtgtgtataa

SEQ ID NO: 366388 - DNA, 16 bp, M. musculus
atatgtgtgtgtatgt

SEQ ID NO: 366389 - DNA, 16 bp, M. musculus
atatgtgtgtgtgtat

SEQ ID NO: 366390 - DNA, 16 bp, M. musculus
atatgtgtgtgtgtgt

SEQ ID NO: 366391 - DNA, 16 bp, M. musculus
atatgttatatatcat

SEQ ID NO: 366392 - DNA, 16 bp, M. musculus
atatgttatggctgtt

SEQ ID NO: 366393 - DNA, 16 bp, M. musculus
atatgttatgtcaaat

SEQ ID NO: 366394 - DNA, 16 bp, M. musculus
atatgttcatatgtgt

SEQ ID NO: 366395 - DNA, 16 bp, M. musculus
atatgtttgaattctt

SEQ ID NO: 366396 - DNA, 16 bp, M. musculus
atatgtttgtgtacat

SEQ ID NO: 366397 - DNA, 16 bp, M. musculus
atatgtttttaaaagt

SEQ ID NO: 366398 - DNA, 16 bp, M. musculus
atattaaaaacaaatg

SEQ ID NO: 366399 - DNA, 16 bp, M. musculus
atattaaaagtccaaa

SEQ ID NO: 366400 - DNA, 16 bp, M. musculus
atattaaacaaaactg

SEQ ID NO: 366401 - DNA, 16 bp, M. musculus
atattaaccaatcaga

SEQ ID NO: 366402 - DNA, 16 bp, M. musculus
atattaagagatatca

SEQ ID NO: 366403 - DNA, 16 bp, M. musculus
atattaaggaaaaagt

SEQ ID NO: 366404 - DNA, 16 bp, M. musculus
atattaaggaaaagga

SEQ ID NO: 366405 - DNA, 16 bp, M. musculus
atattaagtgaattaa

SEQ ID NO: 366406 - DNA, 16 bp, M. musculus
atattaatatgctttt

SEQ ID NO: 366407 - DNA, 23 bp, M. musculus
atattacaaggcctgggctatgc

SEQ ID NO: 366408 - DNA, 16 bp, M. musculus
atattacaattcacaa

SEQ ID NO: 366409 - DNA, 16 bp, M. musculus
atattacagaagaaaa

SEQ ID NO: 366410 - DNA, 16 bp, M. musculus
atattacatatatatg

SEQ ID NO: 366411 - DNA, 16 bp, M. musculus
atattacctttgatga

SEQ ID NO: 366412 - DNA, 16 bp, M. musculus
atattactgatgctat

SEQ ID NO: 366413 - DNA, 16 bp, M. musculus
atattagaatagctac

SEQ ID NO: 366414 - DNA, 17 bp, M. musculus
atattagaatggctact

SEQ ID NO: 366415 - DNA, 16 bp, M. musculus
atattagatacaattt

SEQ ID NO: 366416 - DNA, 16 bp, M. musculus
atattagccaaaagaa

SEQ ID NO: 366417 - DNA, 16 bp, M. musculus
atattagcccaaaagt

SEQ ID NO: 366418 - DNA, 16 bp, M. musculus
atattagctggtgtat

SEQ ID NO: 366419 - DNA, 16 bp, M. musculus
atattagtaaaactaa

SEQ ID NO: 366420 - DNA, 27 bp, M. musculus
atattagtcccctatctgatttaggat

SEQ ID NO: 366421 - DNA, 16 bp, M. musculus
atattagtgtttaaat

SEQ ID NO: 366422 - DNA, 16 bp, M. musculus
atattataaggaaact

SEQ ID NO: 366423 - DNA, 16 bp, M. musculus
atattatacagactga

SEQ ID NO: 366424 - DNA, 16 bp, M. musculus
atattatatatcatgt

SEQ ID NO: 366425 - DNA, 16 bp, M. musculus
atattatatatgcaaa

SEQ ID NO: 366426 - DNA, 16 bp, M. musculus
atattatatatgtaca

SEQ ID NO: 366427 - DNA, 16 bp, M. musculus
atattatctgtatttt

SEQ ID NO: 366428 - DNA, 16 bp, M. musculus
atattatgattcataa

SEQ ID NO: 366429 - DNA, 16 bp, M. musculus
atattatgttaacatt

SEQ ID NO: 366430 - DNA, 16 bp, M. musculus
atattatttgaaatgt

SEQ ID NO: 366431 - DNA, 16 bp, M. musculus
atattcaaatacatga

SEQ ID NO: 366432 - DNA, 16 bp, M. musculus
atattcaaatatatga

SEQ ID NO: 366433 - DNA, 16 bp, M. musculus
atattcaacaaacaga

SEQ ID NO: 366434 - DNA, 16 bp, M. musculus
atattcaataaatgtt

SEQ ID NO: 366435 - DNA, 16 bp, M. musculus
atattcaattttctga

SEQ ID NO: 366436 - DNA, 16 bp, M. musculus
atattcacacacacac

SEQ ID NO: 366437 - DNA, 16 bp, M. musculus
atattcactggagcat

SEQ ID NO: 366438 - DNA, 16 bp, M. musculus
atattcacttatatat

SEQ ID NO: 366439 - DNA, 16 bp, M. musculus
atattcagaaataaaa

SEQ ID NO: 366440 - DNA, 16 bp, M. musculus
atattcagcagaggac

SEQ ID NO: 366441 - DNA, 16 bp, M. musculus
atattcaggaaaagta

SEQ ID NO: 366442 - DNA, 16 bp, M. musculus
atattcagggatccac

SEQ ID NO: 366443 - DNA, 16 bp, M. musculus
atattcataaagaaaa

SEQ ID NO: 366444 - DNA, 16 bp, M. musculus
atattcataaaggaaa

SEQ ID NO: 366445 - DNA, 16 bp, M. musculus
atattcatacacacac

SEQ ID NO: 366446 - DNA, 16 bp, M. musculus
atattcataggagaaa

SEQ ID NO: 366447 - DNA, 16 bp, M. musculus
atattcatatatatgt

SEQ ID NO: 366448 - DNA, 16 bp, M. musculus
atattcatgtatatgt

SEQ ID NO: 366449 - DNA, 16 bp, M. musculus
atattccaagcaaatg

SEQ ID NO: 366450 - DNA, 16 bp, M. musculus
atattccagaacaaaa

SEQ ID NO: 366451 - DNA, 16 bp, M. musculus
atattccagatgaatt

SEQ ID NO: 366452 - DNA, 16 bp, M. musculus
atattccaggacaaaa

SEQ ID NO: 366453 - DNA, 16 bp, M. musculus
atattcctaagtataa

SEQ ID NO: 366454 - DNA, 16 bp, M. musculus
atattcctccattgct

SEQ ID NO: 366455 - DNA, 16 bp, M. musculus
atattcctctctctct

SEQ ID NO: 366456 - DNA, 16 bp, M. musculus
atattctaccactgag

SEQ ID NO: 366457 - DNA, 16 bp, M. musculus
atattctattctgtca

SEQ ID NO: 366458 - DNA, 16 bp, M. musculus
atattctcttttaaaa

SEQ ID NO: 366459 - DNA, 16 bp, M. musculus
atattctgaagctaaa

SEQ ID NO: 366460 - DNA, 16 bp, M. musculus
atattctgtaaatttg

SEQ ID NO: 366461 - DNA, 16 bp, M. musculus
atattctgtatttatt

SEQ ID NO: 366462 - DNA, 16 bp, M. musculus
atattctgttatgttt

SEQ ID NO: 366463 - DNA, 16 bp, M. musculus
atattctgtttcaaaa

SEQ ID NO: 366464 - DNA, 16 bp, M. musculus
atattcttatctgagc

SEQ ID NO: 366465 - DNA, 16 bp, M. musculus
atattcttatgcatgt

SEQ ID NO: 366466 - DNA, 16 bp, M. musculus
atattcttctcctctg

SEQ ID NO: 366467 - DNA, 16 bp, M. musculus
atattcttgtttttaa

SEQ ID NO: 366468 - DNA, 16 bp, M. musculus
atattctttcattgtt

SEQ ID NO: 366469 - DNA, 16 bp, M. musculus
atattgaagttaaaat

SEQ ID NO: 366470 - DNA, 16 bp, M. musculus
atattgaagttggaca

SEQ ID NO: 366471 - DNA, 16 bp, M. musculus
atattgacatagagtt

SEQ ID NO: 366472 - DNA, 16 bp, M. musculus
atattgataatttttc

SEQ ID NO: 366473 - DNA, 16 bp, M. musculus
atattgatgaggaaga

SEQ ID NO: 366474 - DNA, 16 bp, M. musculus
atattgatgatgatga

SEQ ID NO: 366475 - DNA, 16 bp, M. musculus
atattgatggattttt

SEQ ID NO: 366476 - DNA, 16 bp, M. musculus
atattgattgattgat

SEQ ID NO: 366477 - DNA, 16 bp, M. musculus
atattgatttctccca

SEQ ID NO: 366478 - DNA, 16 bp, M. musculus
atattgccaaagttaa

SEQ ID NO: 366479 - DNA, 37 bp, M. musculus
atattgctgcctacagagctaaaggaaaacctgatgc

SEQ ID NO: 366480 - DNA, 16 bp, M. musculus
atattgctgcttacag

SEQ ID NO: 366481 - DNA, 16 bp, M. musculus
atattgctgtctcctg

SEQ ID NO: 366482 - DNA, 16 bp, M. musculus
atattgctttttaaaa

SEQ ID NO: 366483 - DNA, 16 bp, M. musculus
atattgctttttacta

SEQ ID NO: 366484 - DNA, 16 bp, M. musculus
atattgggtgagggaa

SEQ ID NO: 366485 - DNA, 16 bp, M. musculus
atattgtgagttccag

SEQ ID NO: 366486 - DNA, 16 bp, M. musculus
atattgtggtgactcc

SEQ ID NO: 366487 - DNA, 16 bp, M. musculus
atattgtgtgtgtgtg

SEQ ID NO: 366488 - DNA, 17 bp, M. musculus
atattgttgttcctcct

SEQ ID NO: 366489 - DNA, 16 bp, M. musculus
atattgttgtttctct

SEQ ID NO: 366490 - DNA, 16 bp, M. musculus
atattgttttctaagt

SEQ ID NO: 366491 - DNA, 16 bp, M. musculus
atatttaaaactgaaa

SEQ ID NO: 366492 - DNA, 16 bp, M. musculus
atatttaaaagacaaa

SEQ ID NO: 366493 - DNA, 16 bp, M. musculus
atatttaaacacattt

SEQ ID NO: 366494 - DNA, 16 bp, M. musculus
atatttaacagttttt

SEQ ID NO: 366495 - DNA, 16 bp, M. musculus
atatttaacctcaggc

SEQ ID NO: 366496 - DNA, 16 bp, M. musculus
atatttaagcacagca

SEQ ID NO: 366497 - DNA, 16 bp, M. musculus
atatttaataaagctt

SEQ ID NO: 366498 - DNA, 16 bp, M. musculus
atatttacaaaagaaa

SEQ ID NO: 366499 - DNA, 16 bp, M. musculus
atatttacaaagaact

SEQ ID NO: 366500 - DNA, 16 bp, M. musculus
atatttacataacaat

SEQ ID NO: 366501 - DNA, 16 bp, M. musculus
atatttacatatacat

SEQ ID NO: 366502 - DNA, 16 bp, M. musculus
atatttacatgtattt

SEQ ID NO: 366503 - DNA, 16 bp, M. musculus
atatttacatgtgtgt

SEQ ID NO: 366504 - DNA, 16 bp, M. musculus
atatttacattaagat

SEQ ID NO: 366505 - DNA, 16 bp, M. musculus
atatttacattatgat

SEQ ID NO: 366506 - DNA, 16 bp, M. musculus
atatttactatgttaa

SEQ ID NO: 366507 - DNA, 16 bp, M. musculus
atatttactgaccttt

SEQ ID NO: 366508 - DNA, 16 bp, M. musculus
atatttagaaacaaaa

SEQ ID NO: 366509 - DNA, 16 bp, M. musculus
atatttaggaatgtat

SEQ ID NO: 366510 - DNA, 16 bp, M. musculus
atatttataaatgtgt

SEQ ID NO: 366511 - DNA, 16 bp, M. musculus
atatttatacacagaa

SEQ ID NO: 366512 - DNA, 16 bp, M. musculus
atatttatgtacatat

SEQ ID NO: 366513 - DNA, 16 bp, M. musculus
atatttatgtatacat

SEQ ID NO: 366514 - DNA, 16 bp, M. musculus
atatttatgtgtgtac

SEQ ID NO: 366515 - DNA, 16 bp, M. musculus
atatttatgttacaat

SEQ ID NO: 366516 - DNA, 16 bp, M. musculus
atatttcaaaagaaaa

SEQ ID NO: 366517 - DNA, 16 bp, M. musculus
atatttcaaagtattt

SEQ ID NO: 366518 - DNA, 16 bp, M. musculus
atatttcatcctaaaa

SEQ ID NO: 366519 - DNA, 16 bp, M. musculus
atatttcatctttaaa

SEQ ID NO: 366520 - DNA, 16 bp, M. musculus
atatttccatagcttt

SEQ ID NO: 366521 - DNA, 16 bp, M. musculus
atatttccattcattc

SEQ ID NO: 366522 - DNA, 16 bp, M. musculus
atatttcctgtgtgta

SEQ ID NO: 366523 - DNA, 16 bp, M. musculus
atatttctaaagaaat

SEQ ID NO: 366524 - DNA, 16 bp, M. musculus
atatttctggatgtga

SEQ ID NO: 366525 - DNA, 16 bp, M. musculus
atatttctgtatatat

SEQ ID NO: 366526 - DNA, 16 bp, M. musculus
atatttctgtatattt

SEQ ID NO: 366527 - DNA, 16 bp, M. musculus
atatttctgtatttat

SEQ ID NO: 366528 - DNA, 16 bp, M. musculus
atatttcttaacatca

SEQ ID NO: 366529 - DNA, 16 bp, M. musculus
atatttcttttatgaa

SEQ ID NO: 366530 - DNA, 16 bp, M. musculus
atatttctttttagaa

SEQ ID NO: 366531 - DNA, 16 bp, M. musculus
atatttgaaaatatgt

SEQ ID NO: 366532 - DNA, 16 bp, M. musculus
atatttgaaacataaa

SEQ ID NO: 366533 - DNA, 16 bp, M. musculus
atatttgaaatgttat

SEQ ID NO: 366534 - DNA, 16 bp, M. musculus
atatttgagaagatag

SEQ ID NO: 366535 - DNA, 16 bp, M. musculus
atatttgagaatatat

SEQ ID NO: 366536 - DNA, 16 bp, M. musculus
atatttgatatttctt

SEQ ID NO: 366537 - DNA, 16 bp, M. musculus
atatttgcaaaaaaaa

SEQ ID NO: 366538 - DNA, 16 bp, M. musculus
atatttgcatataaaa

SEQ ID NO: 366539 - DNA, 16 bp, M. musculus
atatttgcatattatt

SEQ ID NO: 366540 - DNA, 16 bp, M. musculus
atatttgcatatttat

SEQ ID NO: 366541 - DNA, 16 bp, M. musculus
atatttgcatatttta

SEQ ID NO: 366542 - DNA, 16 bp, M. musculus
atatttgcattaaaat

SEQ ID NO: 366543 - DNA, 16 bp, M. musculus
atatttgcttttaaaa

SEQ ID NO: 366544 - DNA, 16 bp, M. musculus
atatttgggatggaga

SEQ ID NO: 366545 - DNA, 16 bp, M. musculus
atatttggtttttcaa

SEQ ID NO: 366546 - DNA, 16 bp, M. musculus
atatttgtacacatat

SEQ ID NO: 366547 - DNA, 16 bp, M. musculus
atatttgtctttctga

SEQ ID NO: 366548 - DNA, 16 bp, M. musculus
atatttgtgaatatat

SEQ ID NO: 366549 - DNA, 16 bp, M. musculus
atatttgtgcatgtgt

SEQ ID NO: 366550 - DNA, 16 bp, M. musculus
atatttgttcatattt

SEQ ID NO: 366551 - DNA, 16 bp, M. musculus
atatttgttcccatga

SEQ ID NO: 366552 - DNA, 16 bp, M. musculus
atatttgttgaatgga

SEQ ID NO: 366553 - DNA, 16 bp, M. musculus
atatttgtttttctaa

SEQ ID NO: 366554 - DNA, 16 bp, M. musculus
atattttaaaagacat

SEQ ID NO: 366555 - DNA, 16 bp, M. musculus
atattttaaagttttc

SEQ ID NO: 366556 - DNA, 16 bp, M. musculus
atattttaaatgtctt

SEQ ID NO: 366557 - DNA, 16 bp, M. musculus
atattttaatcatgtt

SEQ ID NO: 366558 - DNA, 16 bp, M. musculus
atattttacatagttg

SEQ ID NO: 366559 - DNA, 16 bp, M. musculus
atattttagaaaaact

SEQ ID NO: 366560 - DNA, 16 bp, M. musculus
atattttagtttcaaa

SEQ ID NO: 366561 - DNA, 16 bp, M. musculus
atattttagttttcca

SEQ ID NO: 366562 - DNA, 16 bp, M. musculus
atattttatacacata

SEQ ID NO: 366563 - DNA, 16 bp, M. musculus
atattttatcttctgc

SEQ ID NO: 366564 - DNA, 16 bp, M. musculus
atattttatcttctgt

SEQ ID NO: 366565 - DNA, 16 bp, M. musculus
atattttattctcccc

SEQ ID NO: 366566 - DNA, 16 bp, M. musculus
atattttatttctgaa

SEQ ID NO: 366567 - DNA, 16 bp, M. musculus
atattttattttgtca

SEQ ID NO: 366568 - DNA, 16 bp, M. musculus
atattttcaaagaaat

SEQ ID NO: 366569 - DNA, 16 bp, M. musculus
atattttcaaagaaca

SEQ ID NO: 366570 - DNA, 16 bp, M. musculus
atattttcaaagagaa

SEQ ID NO: 366571 - DNA, 16 bp, M. musculus
atattttcatattttg

SEQ ID NO: 366572 - DNA, 16 bp, M. musculus
atattttcatcttctg

SEQ ID NO: 366573 - DNA, 16 bp, M. musculus
atattttcatgtattt

SEQ ID NO: 366574 - DNA, 16 bp, M. musculus
atattttcattgaaaa

SEQ ID NO: 366575 - DNA, 16 bp, M. musculus
atattttcattttgaa

SEQ ID NO: 366576 - DNA, 16 bp, M. musculus
atattttcattttgtg

SEQ ID NO: 366577 - DNA, 16 bp, M. musculus
atattttccaatttgt

SEQ ID NO: 366578 - DNA, 16 bp, M. musculus
atattttccagtttta

SEQ ID NO: 366579 - DNA, 16 bp, M. musculus
atattttcccattctg

SEQ ID NO: 366580 - DNA, 16 bp, M. musculus
atattttcctcattcc

SEQ ID NO: 366581 - DNA, 16 bp, M. musculus
atattttcgttattta

SEQ ID NO: 366582 - DNA, 16 bp, M. musculus
atattttctagaaata

SEQ ID NO: 366583 - DNA, 16 bp, M. musculus
atattttctgtatata

SEQ ID NO: 366584 - DNA, 16 bp, M. musculus
atattttctgtattta

SEQ ID NO: 366585 - DNA, 16 bp, M. musculus
atattttctgtctcca

SEQ ID NO: 366586 - DNA, 16 bp, M. musculus
atattttcttcattga

SEQ ID NO: 366587 - DNA, 16 bp, M. musculus
atattttcttctgata

SEQ ID NO: 366588 - DNA, 16 bp, M. musculus
atattttctttgtata

SEQ ID NO: 366589 - DNA, 16 bp, M. musculus
atattttcttttaagt

SEQ ID NO: 366590 - DNA, 16 bp, M. musculus
atattttgagaaaaat

SEQ ID NO: 366591 - DNA, 16 bp, M. musculus
atattttgctttttaa

SEQ ID NO: 366592 - DNA, 16 bp, M. musculus
atattttggaacaaaa

SEQ ID NO: 366593 - DNA, 16 bp, M. musculus
atattttggaatggat

SEQ ID NO: 366594 - DNA, 16 bp, M. musculus
atattttggatatata

SEQ ID NO: 366595 - DNA, 16 bp, M. musculus
atattttggatttcct

SEQ ID NO: 366596 - DNA, 16 bp, M. musculus
atattttgtaaaatgt

SEQ ID NO: 366597 - DNA, 16 bp, M. musculus
atattttgtcaaatgc

SEQ ID NO: 366598 - DNA, 16 bp, M. musculus
atattttgttcatgtt

SEQ ID NO: 366599 - DNA, 16 bp, M. musculus
atattttgttctcctt

SEQ ID NO: 366600 - DNA, 16 bp, M. musculus
atattttgtttagaaa

SEQ ID NO: 366601 - DNA, 16 bp, M. musculus
atattttgtttgaaaa

SEQ ID NO: 366602 - DNA, 16 bp, M. musculus
atatttttaaaaaagg

SEQ ID NO: 366603 - DNA, 16 bp, M. musculus
atatttttaaaagcta

SEQ ID NO: 366604 - DNA, 16 bp, M. musculus
atatttttaaacagaa

SEQ ID NO: 366605 - DNA, 16 bp, M. musculus
atatttttaaaggaat

SEQ ID NO: 366606 - DNA, 16 bp, M. musculus
atatttttaaatggat

SEQ ID NO: 366607 - DNA, 16 bp, M. musculus
atatttttaatcccag

SEQ ID NO: 366608 - DNA, 16 bp, M. musculus
atatttttacatgtat

SEQ ID NO: 366609 - DNA, 16 bp, M. musculus
atatttttcaaagaaa

SEQ ID NO: 366610 - DNA, 16 bp, M. musculus
atatttttccaatctg

SEQ ID NO: 366611 - DNA, 16 bp, M. musculus
atatttttcccttttg

SEQ ID NO: 366612 - DNA, 16 bp, M. musculus
atatttttctaaaaca

SEQ ID NO: 366613 - DNA, 16 bp, M. musculus
atatttttcttagaaa

SEQ ID NO: 366614 - DNA, 16 bp, M. musculus
atatttttcttcaaaa

SEQ ID NO: 366615 - DNA, 16 bp, M. musculus
atatttttgaatttca

SEQ ID NO: 366616 - DNA, 16 bp, M. musculus
atatttttgacatttt

SEQ ID NO: 366617 - DNA, 16 bp, M. musculus
atatttttgcatatgt

SEQ ID NO: 366618 - DNA, 16 bp, M. musculus
atatttttgcatattt

SEQ ID NO: 366619 - DNA, 16 bp, M. musculus
atatttttgtacatat

SEQ ID NO: 366620 - DNA, 16 bp, M. musculus
atattttttaaaggaa

SEQ ID NO: 366621 - DNA, 16 bp, M. musculus
atcaaaaaagagaagg

SEQ ID NO: 366622 - DNA, 16 bp, M. musculus
atcaaaaaagtcaagg

SEQ ID NO: 366623 - DNA, 16 bp, M. musculus
atcaaaaaccaattgg

SEQ ID NO: 366624 - DNA, 16 bp, M. musculus
atcaaaaactcttctc

SEQ ID NO: 366625 - DNA, 16 bp, M. musculus
atcaaaaagatcattc

SEQ ID NO: 366626 - DNA, 16 bp, M. musculus
atcaaaacaactatga

SEQ ID NO: 366627 - DNA, 16 bp, M. musculus
atcaaaacaactctga

SEQ ID NO: 366628 - DNA, 16 bp, M. musculus
atcaaaacagccctga

SEQ ID NO: 366629 - DNA, 16 bp, M. musculus
atcaaaacatcaaatg

SEQ ID NO: 366630 - DNA, 16 bp, M. musculus
atcaaaacttattttt

SEQ ID NO: 366631 - DNA, 16 bp, M. musculus
atcaaaagaaggcggg

SEQ ID NO: 366632 - DNA, 16 bp, M. musculus
atcaaaagatggaaag

SEQ ID NO: 366633 - DNA, 16 bp, M. musculus
atcaaaagcaagttgg

SEQ ID NO: 366634 - DNA, 16 bp, M. musculus
atcaaaagcagctcca

SEQ ID NO: 366635 - DNA, 16 bp, M. musculus
atcaaaagcccccttt

SEQ ID NO: 366636 - DNA, 16 bp, M. musculus
atcaaaagggaacctg

SEQ ID NO: 366637 - DNA, 16 bp, M. musculus
atcaaaatatagtgta

SEQ ID NO: 366638 - DNA, 16 bp, M. musculus
atcaaaatctttctgg

SEQ ID NO: 366639 - DNA, 16 bp, M. musculus
atcaaaatgaccccaa

SEQ ID NO: 366640 - DNA, 16 bp, M. musculus
atcaaaatgcagaact

SEQ ID NO: 366641 - DNA, 16 bp, M. musculus
atcaaaatgttttgaa

SEQ ID NO: 366642 - DNA, 16 bp, M. musculus
atcaaacaaaagcaga

SEQ ID NO: 366643 - DNA, 16 bp, M. musculus
atcaaacacctcaaca

SEQ ID NO: 366644 - DNA, 16 bp, M. musculus
atcaaacaccttctgt

SEQ ID NO: 366645 - DNA, 16 bp, M. musculus
atcaaacccaaggcct

SEQ ID NO: 366646 - DNA, 16 bp, M. musculus
atcaaacccagagcct

SEQ ID NO: 366647 - DNA, 16 bp, M. musculus
atcaaacccaggacct

SEQ ID NO: 366648 - DNA, 16 bp, M. musculus
atcaaacccaggcctt

SEQ ID NO: 366649 - DNA, 16 bp, M. musculus
atcaaactcaagtcat

SEQ ID NO: 366650 - DNA, 16 bp, M. musculus
atcaaactcaggtctc

SEQ ID NO: 366651 - DNA, 16 bp, M. musculus
atcaaacttgggttgt

SEQ ID NO: 366652 - DNA, 16 bp, M. musculus
atcaaagaaaatgcaa

SEQ ID NO: 366653 - DNA, 16 bp, M. musculus
atcaaagaaattgcaa

SEQ ID NO: 366654 - DNA, 16 bp, M. musculus
atcaaagaagacatca

SEQ ID NO: 366655 - DNA, 16 bp, M. musculus
atcaaagaatacacat

SEQ ID NO: 366656 - DNA, 16 bp, M. musculus
atcaaagacagacatt

SEQ ID NO: 366657 - DNA, 16 bp, M. musculus
atcaaagaggaaggag

SEQ ID NO: 366658 - DNA, 16 bp, M. musculus
atcaaagcaaaaatca

SEQ ID NO: 366659 - DNA, 16 bp, M. musculus
atcaaagcaggaagca

SEQ ID NO: 366660 - DNA, 16 bp, M. musculus
atcaaagccagctggg

SEQ ID NO: 366661 - DNA, 16 bp, M. musculus
atcaaagcccaaggtt

SEQ ID NO: 366662 - DNA, 16 bp, M. musculus
atcaaaggaaaaaatc

SEQ ID NO: 366663 - DNA, 16 bp, M. musculus
atcaaaggcttgtgcc

SEQ ID NO: 366664 - DNA, 16 bp, M. musculus
atcaaaggtaaattct

SEQ ID NO: 366665 - DNA, 16 bp, M. musculus
atcaaagtccaacttg

SEQ ID NO: 366666 - DNA, 16 bp, M. musculus
atcaaataccctgcaa

SEQ ID NO: 366667 - DNA, 16 bp, M. musculus
atcaaatacctcaaca

SEQ ID NO: 366668 - DNA, 16 bp, M. musculus
atcaaatatttacatt

SEQ ID NO: 366669 - DNA, 16 bp, M. musculus
atcaaatctctctcct

SEQ ID NO: 366670 - DNA, 16 bp, M. musculus
atcaaatgaccttttc

SEQ ID NO: 366671 - DNA, 16 bp, M. musculus
atcaaatgtttttcct

SEQ ID NO: 366672 - DNA, 18 bp, M. musculus
atcaaattaatactgctg

SEQ ID NO: 366673 - DNA, 16 bp, M. musculus
atcaaattcaaaagaa

SEQ ID NO: 366674 - DNA, 16 bp, M. musculus
atcaacaaaatcatga

SEQ ID NO: 366675 - DNA, 16 bp, M. musculus
atcaacaaagtagaaa

SEQ ID NO: 366676 - DNA, 16 bp, M. musculus
atcaacaaatgagacc

SEQ ID NO: 366677 - DNA, 16 bp, M. musculus
atcaacaacagcaaca

SEQ ID NO: 366678 - DNA, 16 bp, M. musculus
atcaacaagagccagg

SEQ ID NO: 366679 - DNA, 16 bp, M. musculus
atcaacaagataaata

SEQ ID NO: 366680 - DNA, 16 bp, M. musculus
atcaacaagattgaca

SEQ ID NO: 366681 - DNA, 16 bp, M. musculus
atcaacacccttcaca

SEQ ID NO: 366682 - DNA, 16 bp, M. musculus
atcaacaccttcagcc

SEQ ID NO: 366683 - DNA, 16 bp, M. musculus
atcaacagagagagtc

SEQ ID NO: 366684 - DNA, 16 bp, M. musculus
atcaacagcagcagca

SEQ ID NO: 366685 - DNA, 16 bp, M. musculus
atcaacatccttctgt

SEQ ID NO: 366686 - DNA, 16 bp, M. musculus
atcaaccaagaagaaa

SEQ ID NO: 366687 - DNA, 16 bp, M. musculus
atcaaccaatccagga

SEQ ID NO: 366688 - DNA, 16 bp, M. musculus
atcaaccaggattaca

SEQ ID NO: 366689 - DNA, 16 bp, M. musculus
atcaacctgtctgtca

SEQ ID NO: 366690 - DNA, 16 bp, M. musculus
atcaacctgtctgtct

SEQ ID NO: 366691 - DNA, 16 bp, M. musculus
atcaagaaaaccagga

SEQ ID NO: 366692 - DNA, 16 bp, M. musculus
atcaagaaaatcatcc

SEQ ID NO: 366693 - DNA, 16 bp, M. musculus
atcaagaaaatggccc

SEQ ID NO: 366694 - DNA, 16 bp, M. musculus
atcaagaaaatgtacc

SEQ ID NO: 366695 - DNA, 16 bp, M. musculus
atcaagaaaattcctc

SEQ ID NO: 366696 - DNA, 16 bp, M. musculus
atcaagaagaagaaag

SEQ ID NO: 366697 - DNA, 16 bp, M. musculus
atcaagaaggaagatc

SEQ ID NO: 366698 - DNA, 26 bp, M. musculus
atcaagaaggactttaataactcact

SEQ ID NO: 366699 - DNA, 16 bp, M. musculus
atcaagaattgaaaaa

SEQ ID NO: 366700 - DNA, 17 bp, M. musculus
atcaagaattgacaaat

SEQ ID NO: 366701 - DNA, 16 bp, M. musculus
atcaagaattggtaaa

SEQ ID NO: 366702 - DNA, 16 bp, M. musculus
atcaagacccccatgt

SEQ ID NO: 366703 - DNA, 16 bp, M. musculus
atcaagacgtagaact

SEQ ID NO: 366704 - DNA, 16 bp, M. musculus
atcaagagtgggaggg

SEQ ID NO: 366705 - DNA, 16 bp, M. musculus
atcaagataacttttt

SEQ ID NO: 366706 - DNA, 16 bp, M. musculus
atcaagataatcccca

SEQ ID NO: 366707 - DNA, 16 bp, M. musculus
atcaagatggagaact

SEQ ID NO: 366708 - DNA, 16 bp, M. musculus
atcaagatgggaacat

SEQ ID NO: 366709 - DNA, 16 bp, M. musculus
atcaagcaagcaaaca

SEQ ID NO: 366710 - DNA, 17 bp, M. musculus
atcaagcggggaggtcc

SEQ ID NO: 366711 - DNA, 16 bp, M. musculus
atcaagcttggcagca

SEQ ID NO: 366712 - DNA, 16 bp, M. musculus
atcaagcttttaattt

SEQ ID NO: 366713 - DNA, 16 bp, M. musculus
atcaaggaaaacattc

SEQ ID NO: 366714 - DNA, 16 bp, M. musculus
atcaaggaaacagaaa

SEQ ID NO: 366715 - DNA, 17 bp, M. musculus
atcaaggacctccacat

SEQ ID NO: 366716 - DNA, 16 bp, M. musculus
atcaaggactttttgg

SEQ ID NO: 366717 - DNA, 16 bp, M. musculus
atcaaggagactttga

SEQ ID NO: 366718 - DNA, 16 bp, M. musculus
atcaaggaggaaaggc

SEQ ID NO: 366719 - DNA, 16 bp, M. musculus
atcaaggatctccaca

SEQ ID NO: 366720 - DNA, 16 bp, M. musculus
atcaaggcaactttta

SEQ ID NO: 366721 - DNA, 16 bp, M. musculus
atcaaggcagggacat

SEQ ID NO: 366722 - DNA, 16 bp, M. musculus
atcaagggatacaaat

SEQ ID NO: 366723 - DNA, 16 bp, M. musculus
atcaagggcttctcct

SEQ ID NO: 366724 - DNA, 16 bp, M. musculus
atcaaggggaaaggcc

SEQ ID NO: 366725 - DNA, 16 bp, M. musculus
atcaagggggaaggcc

SEQ ID NO: 366726 - DNA, 16 bp, M. musculus
atcaagggggaaggtc

SEQ ID NO: 366727 - DNA, 16 bp, M. musculus
atcaaggtatcattga

SEQ ID NO: 366728 - DNA, 16 bp, M. musculus
atcaaggttttcattg

SEQ ID NO: 366729 - DNA, 16 bp, M. musculus
atcaagtaaccctatt

SEQ ID NO: 366730 - DNA, 16 bp, M. musculus
atcaagtatgcttcat

SEQ ID NO: 366731 - DNA, 16 bp, M. musculus
atcaagtctctgcagg

SEQ ID NO: 366732 - DNA, 16 bp, M. musculus
atcaagtggaaaaaag

SEQ ID NO: 366733 - DNA, 16 bp, M. musculus
atcaagtggaagaaag

SEQ ID NO: 366734 - DNA, 16 bp, M. musculus
atcaagtggaggaatg

SEQ ID NO: 366735 - DNA, 16 bp, M. musculus
atcaagtgtcttcctc

SEQ ID NO: 366736 - DNA, 16 bp, M. musculus
atcaagttgacaatta

SEQ ID NO: 366737 - DNA, 16 bp, M. musculus
atcaagtttctgcagg

SEQ ID NO: 366738 - DNA, 16 bp, M. musculus
atcaataaaacatttt

SEQ ID NO: 366739 - DNA, 16 bp, M. musculus
atcaataaaatgttaa

SEQ ID NO: 366740 - DNA, 16 bp, M. musculus
atcaataaagatgcca

SEQ ID NO: 366741 - DNA, 16 bp, M. musculus
atcaataaagatgcta

SEQ ID NO: 366742 - DNA, 16 bp, M. musculus
atcaataaagttcact

SEQ ID NO: 366743 - DNA, 16 bp, M. musculus
atcaataattcaaagt

SEQ ID NO: 366744 - DNA, 16 bp, M. musculus
atcaatacatgtgtgt

SEQ ID NO: 366745 - DNA, 16 bp, M. musculus
atcaatatatgaaaat

SEQ ID NO: 366746 - DNA, 16 bp, M. musculus
atcaatatgaagaagc

SEQ ID NO: 366747 - DNA, 16 bp, M. musculus
atcaatcaatcaatga

SEQ ID NO: 366748 - DNA, 16 bp, M. musculus
atcaatcatcaatgaa

SEQ ID NO: 366749 - DNA, 16 bp, M. musculus
atcaatcatctgtcta

SEQ ID NO: 366750 - DNA, 16 bp, M. musculus
atcaatcattcatcaa

SEQ ID NO: 366751 - DNA, 16 bp, M. musculus
atcaatgaagatgtac

SEQ ID NO: 366752 - DNA, 16 bp, M. musculus
atcaatggacagatcg

SEQ ID NO: 366753 - DNA, 16 bp, M. musculus
atcaatggacagatgg

SEQ ID NO: 366754 - DNA, 25 bp, M. musculus
atcaatggactcaattccccaataa

SEQ ID NO: 366755 - DNA, 16 bp, M. musculus
atcaatggattaatcc

SEQ ID NO: 366756 - DNA, 16 bp, M. musculus
atcaatggccttccat

SEQ ID NO: 366757 - DNA, 16 bp, M. musculus
atcaatgggagaagag

SEQ ID NO: 366758 - DNA, 16 bp, M. musculus
atcaatgtaatcctct

SEQ ID NO: 366759 - DNA, 16 bp, M. musculus
atcaattaacttaatt

SEQ ID NO: 366760 - DNA, 16 bp, M. musculus
atcaatttgtcttagt

SEQ ID NO: 366761 - DNA, 16 bp, M. musculus
atcacaaaagaaccca

SEQ ID NO: 366762 - DNA, 16 bp, M. musculus
atcacaaaagagcaca

SEQ ID NO: 366763 - DNA, 16 bp, M. musculus
atcacaaaaggaagtc

SEQ ID NO: 366764 - DNA, 16 bp, M. musculus
atcacaaagggagata

SEQ ID NO: 366765 - DNA, 16 bp, M. musculus
atcacaaatggagaca

SEQ ID NO: 366766 - DNA, 16 bp, M. musculus
atcacaacatgaggaa

SEQ ID NO: 366767 - DNA, 16 bp, M. musculus
atcacaagaagaccta

SEQ ID NO: 366768 - DNA, 16 bp, M. musculus
atcacaagagaactca

SEQ ID NO: 366769 - DNA, 16 bp, M. musculus
atcacaagatggccta

SEQ ID NO: 366770 - DNA, 16 bp, M. musculus
atcacaagtgctctgt

SEQ ID NO: 366771 - DNA, 16 bp, M. musculus
atcacacaaagaccca

SEQ ID NO: 366772 - DNA, 16 bp, M. musculus
atcacacccctgccag

SEQ ID NO: 366773 - DNA, 16 bp, M. musculus
atcacactggccagac

SEQ ID NO: 366774 - DNA, 16 bp, M. musculus
atcacagaaatagaaa

SEQ ID NO: 366775 - DNA, 16 bp, M. musculus
atcacagaagaagtca

SEQ ID NO: 366776 - DNA, 16 bp, M. musculus
atcacagaagatctca

SEQ ID NO: 366777 - DNA, 16 bp, M. musculus
atcacagacacacaca

SEQ ID NO: 366778 - DNA, 16 bp, M. musculus
atcacagagaaagttg

SEQ ID NO: 366779 - DNA, 18 bp, M. musculus
atcacagagctctaaatt

SEQ ID NO: 366780 - DNA, 16 bp, M. musculus
atcacagatgattctt

SEQ ID NO: 366781 - DNA, 16 bp, M. musculus
atcacagatggagaaa

SEQ ID NO: 366782 - DNA, 16 bp, M. musculus
atcacagcaataagaa

SEQ ID NO: 366783 - DNA, 16 bp, M. musculus
atcacagcaatagaac

SEQ ID NO: 366784 - DNA, 16 bp, M. musculus
atcacagcaatgggaa

SEQ ID NO: 366785 - DNA, 16 bp, M. musculus
atcacagcactaggga

SEQ ID NO: 366786 - DNA, 16 bp, M. musculus
atcacagcagaagaaa

SEQ ID NO: 366787 - DNA, 16 bp, M. musculus
atcacaggtgagccct

SEQ ID NO: 366788 - DNA, 16 bp, M. musculus
atcacagtgacagaaa

SEQ ID NO: 366789 - DNA, 16 bp, M. musculus
atcacagttcatcact

SEQ ID NO: 366790 - DNA, 16 bp, M. musculus
atcacatatacttctc

SEQ ID NO: 366791 - DNA, 16 bp, M. musculus
atcacatatatacata

SEQ ID NO: 366792 - DNA, 16 bp, M. musculus
atcacatatcatgatg

SEQ ID NO: 366793 - DNA, 16 bp, M. musculus
atcacatcaacagaaa

SEQ ID NO: 366794 - DNA, 16 bp, M. musculus
atcacatcaatagaaa

SEQ ID NO: 366795 - DNA, 16 bp, M. musculus
atcacatcccctggaa

SEQ ID NO: 366796 - DNA, 16 bp, M. musculus
atcacatgcatgcctg

SEQ ID NO: 366797 - DNA, 16 bp, M. musculus
atcacatggtggttca

SEQ ID NO: 366798 - DNA, 16 bp, M. musculus
atcacatgtcctctca

SEQ ID NO: 366799 - DNA, 16 bp, M. musculus
atcacatgtcctttca

SEQ ID NO: 366800 - DNA, 16 bp, M. musculus
atcacatttcctttat

SEQ ID NO: 366801 - DNA, 16 bp, M. musculus
atcaccaaacagacag

SEQ ID NO: 366802 - DNA, 16 bp, M. musculus
atcaccaaagaagtca

SEQ ID NO: 366803 - DNA, 16 bp, M. musculus
atcaccaaaggaaatc

SEQ ID NO: 366804 - DNA, 16 bp, M. musculus
atcaccaaaggatttt

SEQ ID NO: 366805 - DNA, 16 bp, M. musculus
atcaccaaggaagaag

SEQ ID NO: 366806 - DNA, 17 bp, M. musculus
atcaccaagggaagtca

SEQ ID NO: 366807 - DNA, 16 bp, M. musculus
atcaccaatcaaagaa

SEQ ID NO: 366808 - DNA, 16 bp, M. musculus
atcaccacagaataag

SEQ ID NO: 366809 - DNA, 16 bp, M. musculus
atcaccaccaccactg

SEQ ID NO: 366810 - DNA, 16 bp, M. musculus
atcaccaccagctgag

SEQ ID NO: 366811 - DNA, 16 bp, M. musculus
atcaccaccatcacca

SEQ ID NO: 366812 - DNA, 16 bp, M. musculus
atcaccaccatcacta

SEQ ID NO: 366813 - DNA, 16 bp, M. musculus
atcaccaccatcagca

SEQ ID NO: 366814 - DNA, 16 bp, M. musculus
atcaccaccattatca

SEQ ID NO: 366815 - DNA, 16 bp, M. musculus
atcaccagaacccagt

SEQ ID NO: 366816 - DNA, 16 bp, M. musculus
atcaccagcagcagca

SEQ ID NO: 366817 - DNA, 16 bp, M. musculus
atcaccatcaccaaca

SEQ ID NO: 366818 - DNA, 16 bp, M. musculus
atcaccatcaccagca

SEQ ID NO: 366819 - DNA, 16 bp, M. musculus
atcaccatcaccatca

SEQ ID NO: 366820 - DNA, 16 bp, M. musculus
atcaccatcatcttca

SEQ ID NO: 366821 - DNA, 16 bp, M. musculus
atcaccatgctggacc

SEQ ID NO: 366822 - DNA, 16 bp, M. musculus
atcaccatggaaacag

SEQ ID NO: 366823 - DNA, 16 bp, M. musculus
atcaccatggacaaag

SEQ ID NO: 366824 - DNA, 16 bp, M. musculus
atcaccatggtgggaa

SEQ ID NO: 366825 - DNA, 16 bp, M. musculus
atcacccaggagacaa

SEQ ID NO: 366826 - DNA, 16 bp, M. musculus
atcacccccagaactg

SEQ ID NO: 366827 - DNA, 16 bp, M. musculus
atcaccctcagcacca

SEQ ID NO: 366828 - DNA, 16 bp, M. musculus
atcaccctgaacaaaa

SEQ ID NO: 366829 - DNA, 16 bp, M. musculus
atcacctggaactgga

SEQ ID NO: 366830 - DNA, 16 bp, M. musculus
atcacctttacccact

SEQ ID NO: 366831 - DNA, 16 bp, M. musculus
atcacgtgtcctttca

SEQ ID NO: 366832 - DNA, 16 bp, M. musculus
atcactaagaaaatgc

SEQ ID NO: 366833 - DNA, 16 bp, M. musculus
atcactaaggagcagg

SEQ ID NO: 366834 - DNA, 16 bp, M. musculus
atcactatagtaaaaa

SEQ ID NO: 366835 - DNA, 16 bp, M. musculus
atcactatttgcaggt

SEQ ID NO: 366836 - DNA, 16 bp, M. musculus
atcactgaaaagccca

SEQ ID NO: 366837 - DNA, 16 bp, M. musculus
atcactgagaagagtg

SEQ ID NO: 366838 - DNA, 17 bp, M. musculus
atcactgatatcatcat

SEQ ID NO: 366839 - DNA, 16 bp, M. musculus
atcactggtgagcaga

SEQ ID NO: 366840 - DNA, 16 bp, M. musculus
atcactgtctgtctgt

SEQ ID NO: 366841 - DNA, 16 bp, M. musculus
atcactgtctgttgag

SEQ ID NO: 366842 - DNA, 16 bp, M. musculus
atcactgtgagcatcc

SEQ ID NO: 366843 - DNA, 16 bp, M. musculus
atcactgtttctaagg

SEQ ID NO: 366844 - DNA, 16 bp, M. musculus
atcacttctccagctc

SEQ ID NO: 366845 - DNA, 16 bp, M. musculus
atcacttgaggaacaa

SEQ ID NO: 366846 - DNA, 16 bp, M. musculus
atcacttgtcaataaa

SEQ ID NO: 366847 - DNA, 16 bp, M. musculus
atcagaaaagaagtca

SEQ ID NO: 366848 - DNA, 16 bp, M. musculus
atcagaaaccaagacc

SEQ ID NO: 366849 - DNA, 16 bp, M. musculus
atcagaaagaaaacag

SEQ ID NO: 366850 - DNA, 16 bp, M. musculus
atcagaaagaactaga

SEQ ID NO: 366851 - DNA, 16 bp, M. musculus
atcagaaatcctcctg

SEQ ID NO: 366852 - DNA, 16 bp, M. musculus
atcagaaatctgagaa

SEQ ID NO: 366853 - DNA, 16 bp, M. musculus
atcagaaattcaaggt

SEQ ID NO: 366854 - DNA, 16 bp, M. musculus
atcagaaatttccact

SEQ ID NO: 366855 - DNA, 16 bp, M. musculus
atcagaaccttgtctt

SEQ ID NO: 366856 - DNA, 16 bp, M. musculus
atcagaagaaggccta

SEQ ID NO: 366857 - DNA, 16 bp, M. musculus
atcagaagacctggga

SEQ ID NO: 366858 - DNA, 16 bp, M. musculus
atcagaagagggtgtt

SEQ ID NO: 366859 - DNA, 16 bp, M. musculus
atcagaagatggaaag

SEQ ID NO: 366860 - DNA, 16 bp, M. musculus
atcagaagatggccca

SEQ ID NO: 366861 - DNA, 16 bp, M. musculus
atcagaagcatcatgg

SEQ ID NO: 366862 - DNA, 16 bp, M. musculus
atcagaagccagtttc

SEQ ID NO: 366863 - DNA, 16 bp, M. musculus
atcagaaggtgatgga

SEQ ID NO: 366864 - DNA, 16 bp, M. musculus
atcagaagttcaagat

SEQ ID NO: 366865 - DNA, 16 bp, M. musculus
atcagaagttcaaggt

SEQ ID NO: 366866 - DNA, 17 bp, M. musculus
atcagaatcattttcag

SEQ ID NO: 366867 - DNA, 16 bp, M. musculus
atcagacaatttatat

SEQ ID NO: 366868 - DNA, 17 bp, M. musculus
atcagacacaccagaag

SEQ ID NO: 366869 - DNA, 16 bp, M. musculus
atcagacatggaaatg

SEQ ID NO: 366870 - DNA, 16 bp, M. musculus
atcagacctccccact

SEQ ID NO: 366871 - DNA, 22 bp, M. musculus
atcagacctctacctctaccca

SEQ ID NO: 366872 - DNA, 16 bp, M. musculus
atcagactgaactcag

SEQ ID NO: 366873 - DNA, 16 bp, M. musculus
atcagagactgaagga

SEQ ID NO: 366874 - DNA, 16 bp, M. musculus
atcagagagaaaggag

SEQ ID NO: 366875 - DNA, 16 bp, M. musculus
atcagagaggaaggag

SEQ ID NO: 366876 - DNA, 16 bp, M. musculus
atcagagcccagttct

SEQ ID NO: 366877 - DNA, 19 bp, M. musculus
atcagaggacatgttttaa

SEQ ID NO: 366878 - DNA, 16 bp, M. musculus
atcagaggcatggaca

SEQ ID NO: 366879 - DNA, 16 bp, M. musculus
atcagaggtgaggagg

SEQ ID NO: 366880 - DNA, 16 bp, M. musculus
atcagagtaaaacttt

SEQ ID NO: 366881 - DNA, 16 bp, M. musculus
atcagataaactatct

SEQ ID NO: 366882 - DNA, 16 bp, M. musculus
atcagatattctgcat

SEQ ID NO: 366883 - DNA, 16 bp, M. musculus
atcagatatttatatc

SEQ ID NO: 366884 - DNA, 16 bp, M. musculus
atcagatcaacatgga

SEQ ID NO: 366885 - DNA, 16 bp, M. musculus
atcagatcactacaga

SEQ ID NO: 366886 - DNA, 16 bp, M. musculus
atcagatccctggaac

SEQ ID NO: 366887 - DNA, 16 bp, M. musculus
atcagatgctggtgag

SEQ ID NO: 366888 - DNA, 16 bp, M. musculus
atcagattccctggaa

SEQ ID NO: 366889 - DNA, 16 bp, M. musculus
atcagattggcctata

SEQ ID NO: 366890 - DNA, 16 bp, M. musculus
atcagattggcctgtg

SEQ ID NO: 366891 - DNA, 16 bp, M. musculus
atcagatttagaagtt

SEQ ID NO: 366892 - DNA, 16 bp, M. musculus
atcagcaaaagtgtct

SEQ ID NO: 366893 - DNA, 16 bp, M. musculus
atcagcaaagatgaaa

SEQ ID NO: 366894 - DNA, 16 bp, M. musculus
atcagcaacaacaaca

SEQ ID NO: 366895 - DNA, 16 bp, M. musculus
atcagcaagctccagg

SEQ ID NO: 366896 - DNA, 16 bp, M. musculus
atcagcaatagagaca

SEQ ID NO: 366897 - DNA, 16 bp, M. musculus
atcagcaatcaagaaa

SEQ ID NO: 366898 - DNA, 16 bp, M. musculus
atcagcacaggggaaa

SEQ ID NO: 366899 - DNA, 16 bp, M. musculus
atcagcagtggcagct

SEQ ID NO: 366900 - DNA, 17 bp, M. musculus
atcagcatttaccttgg

SEQ ID NO: 366901 - DNA, 16 bp, M. musculus
atcagcccctgcctcc

SEQ ID NO: 366902 - DNA, 16 bp, M. musculus
atcagcctagtctaca

SEQ ID NO: 366903 - DNA, 16 bp, M. musculus
atcagcctctggcctc

SEQ ID NO: 366904 - DNA, 16 bp, M. musculus
atcagccttactccat

SEQ ID NO: 366905 - DNA, 16 bp, M. musculus
atcagccttggcctgg

SEQ ID NO: 366906 - DNA, 16 bp, M. musculus
atcagctccaaagaat

SEQ ID NO: 366907 - DNA, 16 bp, M. musculus
atcagctcctacctcc

SEQ ID NO: 366908 - DNA, 16 bp, M. musculus
atcagctcctgcctct

SEQ ID NO: 366909 - DNA, 16 bp, M. musculus
atcagctcctggttcc

SEQ ID NO: 366910 - DNA, 16 bp, M. musculus
atcagctgctgcctcc

SEQ ID NO: 366911 - DNA, 16 bp, M. musculus
atcaggaaaatgtaaa

SEQ ID NO: 366912 - DNA, 16 bp, M. musculus
atcaggaagcagaaaa

SEQ ID NO: 366913 - DNA, 16 bp, M. musculus
atcaggaatccaaggc

SEQ ID NO: 366914 - DNA, 16 bp, M. musculus
atcaggacagaaactc

SEQ ID NO: 366915 - DNA, 16 bp, M. musculus
atcaggagaaaggaag

SEQ ID NO: 366916 - DNA, 16 bp, M. musculus
atcaggaggcagaggc

SEQ ID NO: 366917 - DNA, 16 bp, M. musculus
atcaggaggtcaaggt

SEQ ID NO: 366918 - DNA, 16 bp, M. musculus
atcaggatgaagactg

SEQ ID NO: 366919 - DNA, 16 bp, M. musculus
atcaggatgactgtgg

SEQ ID NO: 366920 - DNA, 16 bp, M. musculus
atcaggatgtagctct

SEQ ID NO: 366921 - DNA, 16 bp, M. musculus
atcaggcaaataaaag

SEQ ID NO: 366922 - DNA, 16 bp, M. musculus
atcaggcacagcagga

SEQ ID NO: 366923 - DNA, 16 bp, M. musculus
atcaggctggccctga

SEQ ID NO: 366924 - DNA, 16 bp, M. musculus
atcaggctggcctcag

SEQ ID NO: 366925 - DNA, 16 bp, M. musculus
atcaggcttggcagca

SEQ ID NO: 366926 - DNA, 16 bp, M. musculus
atcagggaaatggaaa

SEQ ID NO: 366927 - DNA, 16 bp, M. musculus
atcagggactggccaa

SEQ ID NO: 366928 - DNA, 16 bp, M. musculus
atcagggcaatgcaaa

SEQ ID NO: 366929 - DNA, 16 bp, M. musculus
atcaggtagctcacaa

SEQ ID NO: 366930 - DNA, 19 bp, M. musculus
atcaggtatattgccctgt

SEQ ID NO: 366931 - DNA, 16 bp, M. musculus
atcaggtcttgttaca

SEQ ID NO: 366932 - DNA, 16 bp, M. musculus
atcaggtgctgaaacg

SEQ ID NO: 366933 - DNA, 16 bp, M. musculus
atcaggtgtggagaga

SEQ ID NO: 366934 - DNA, 16 bp, M. musculus
atcaggttcctgtcag

SEQ ID NO: 366935 - DNA, 40 bp, M. musculus
atcagtaatgccttccttggagaatctcttgtatctagga

SEQ ID NO: 366936 - DNA, 16 bp, M. musculus
atcagtatatattttg

SEQ ID NO: 366937 - DNA, 16 bp, M. musculus
atcagtcagtcagtca

SEQ ID NO: 366938 - DNA, 16 bp, M. musculus
atcagtcatttctact

SEQ ID NO: 366939 - DNA, 16 bp, M. musculus
atcagtctggcagctc

SEQ ID NO: 366940 - DNA, 16 bp, M. musculus
atcagtgaagaccagc

SEQ ID NO: 366941 - DNA, 16 bp, M. musculus
atcagtgacaaagaca

SEQ ID NO: 366942 - DNA, 16 bp, M. musculus
atcagtgacatcatca

SEQ ID NO: 366943 - DNA, 16 bp, M. musculus
atcagtggaagaagag

SEQ ID NO: 366944 - DNA, 16 bp, M. musculus
atcagtgggaaaggat

SEQ ID NO: 366945 - DNA, 16 bp, M. musculus
atcagtgggaggagca

SEQ ID NO: 366946 - DNA, 16 bp, M. musculus
atcagtgttcttaacc

SEQ ID NO: 366947 - DNA, 16 bp, M. musculus
atcagttgttcttgga

SEQ ID NO: 366948 - DNA, 16 bp, M. musculus
atcagtttccaaatgc

SEQ ID NO: 366949 - DNA, 16 bp, M. musculus
atcagtttgtcactct

SEQ ID NO: 366950 - DNA, 16 bp, M. musculus
atcataaaagaacaca

SEQ ID NO: 366951 - DNA, 17 bp, M. musculus
atcataaaagaacacat

SEQ ID NO: 366952 - DNA, 16 bp, M. musculus
atcataaaagaaccca

SEQ ID NO: 366953 - DNA, 16 bp, M. musculus
atcataaattcattgt

SEQ ID NO: 366954 - DNA, 16 bp, M. musculus
atcataatgtaaatat

SEQ ID NO: 366955 - DNA, 16 bp, M. musculus
atcatacagatctttg

SEQ ID NO: 366956 - DNA, 16 bp, M. musculus
atcataccaaaagcaa

SEQ ID NO: 366957 - DNA, 18 bp, M. musculus
atcatactgatcttagca

SEQ ID NO: 366958 - DNA, 16 bp, M. musculus
atcatagaagaaaact

SEQ ID NO: 366959 - DNA, 16 bp, M. musculus
atcatagaaggagaaa

SEQ ID NO: 366960 - DNA, 16 bp, M. musculus
atcatagcaacagaaa

SEQ ID NO: 366961 - DNA, 16 bp, M. musculus
atcataggtattctgt

SEQ ID NO: 366962 - DNA, 16 bp, M. musculus
atcatatatctatata

SEQ ID NO: 366963 - DNA, 16 bp, M. musculus
atcatatgaatacagt

SEQ ID NO: 366964 - DNA, 16 bp, M. musculus
atcatatttcattata

SEQ ID NO: 366965 - DNA, 16 bp, M. musculus
atcatatttggtgttt

SEQ ID NO: 366966 - DNA, 16 bp, M. musculus
atcatcaaagtgggaa

SEQ ID NO: 366967 - DNA, 16 bp, M. musculus
atcatcaaggtggaaa

SEQ ID NO: 366968 - DNA, 16 bp, M. musculus
atcatcaatgggaaga

SEQ ID NO: 366969 - DNA, 16 bp, M. musculus
atcatcaccaccacca

SEQ ID NO: 366970 - DNA, 16 bp, M. musculus
atcatcaccattacca

SEQ ID NO: 366971 - DNA, 16 bp, M. musculus
atcatcactaccacca

SEQ ID NO: 366972 - DNA, 16 bp, M. musculus
atcatcactaccatca

SEQ ID NO: 366973 - DNA, 16 bp, M. musculus
atcatcagagaagctt

SEQ ID NO: 366974 - DNA, 16 bp, M. musculus
atcatcagcaaagacc

SEQ ID NO: 366975 - DNA, 16 bp, M. musculus
atcatcagcatcatca

SEQ ID NO: 366976 - DNA, 16 bp, M. musculus
atcatcagccctccct

SEQ ID NO: 366977 - DNA, 16 bp, M. musculus
atcatcataacccagt

SEQ ID NO: 366978 - DNA, 16 bp, M. musculus
atcatcatcaacaaca

SEQ ID NO: 366979 - DNA, 16 bp, M. musculus
atcatcatcaccacca

SEQ ID NO: 366980 - DNA, 16 bp, M. musculus
atcatcatcaccatca

SEQ ID NO: 366981 - DNA, 16 bp, M. musculus
atcatcatcaccatcc

SEQ ID NO: 366982 - DNA, 16 bp, M. musculus
atcatcatcaccgtca

SEQ ID NO: 366983 - DNA, 16 bp, M. musculus
atcatcatcactgtca

SEQ ID NO: 366984 - DNA, 16 bp, M. musculus
atcatcatcatcatca

SEQ ID NO: 366985 - DNA, 16 bp, M. musculus
atcatcatcatcatcg

SEQ ID NO: 366986 - DNA, 16 bp, M. musculus
atcatcatcatcatct

SEQ ID NO: 366987 - DNA, 16 bp, M. musculus
atcatcatcatcatta

SEQ ID NO: 366988 - DNA, 16 bp, M. musculus
atcatcatcatctctg

SEQ ID NO: 366989 - DNA, 16 bp, M. musculus
atcatcatcatgagaa

SEQ ID NO: 366990 - DNA, 16 bp, M. musculus
atcatcatcatgatca

SEQ ID NO: 366991 - DNA, 16 bp, M. musculus
atcatcatcattgtta

SEQ ID NO: 366992 - DNA, 16 bp, M. musculus
atcatcatctgaaggc

SEQ ID NO: 366993 - DNA, 17 bp, M. musculus
atcatcatgagaagtga

SEQ ID NO: 366994 - DNA, 16 bp, M. musculus
atcatcatggatgata

SEQ ID NO: 366995 - DNA, 16 bp, M. musculus
atcatcatggcaggaa

SEQ ID NO: 366996 - DNA, 16 bp, M. musculus
atcatcatggtggaga

SEQ ID NO: 366997 - DNA, 16 bp, M. musculus
atcatcatttgttgaa

SEQ ID NO: 366998 - DNA, 16 bp, M. musculus
atcatccatccattca

SEQ ID NO: 366999 - DNA, 16 bp, M. musculus
atcatccatcctgaca

SEQ ID NO: 367000 - DNA, 16 bp, M. musculus
atcatcccaagtgagg

SEQ ID NO: 367001 - DNA, 16 bp, M. musculus
atcatcctcagtgagg

SEQ ID NO: 367002 - DNA, 16 bp, M. musculus
atcatcctctgacctc

SEQ ID NO: 367003 - DNA, 16 bp, M. musculus
atcatcctgaatgagg

SEQ ID NO: 367004 - DNA, 16 bp, M. musculus
atcatcctgagtaaag

SEQ ID NO: 367005 - DNA, 20 bp, M. musculus
atcatcctgagtgaggtaac

SEQ ID NO: 367006 - DNA, 19 bp, M. musculus
atcatccttagtgaggtaa

SEQ ID NO: 367007 - DNA, 16 bp, M. musculus
atcatcgtcatcacca

SEQ ID NO: 367008 - DNA, 16 bp, M. musculus
atcatctatctatcca

SEQ ID NO: 367009 - DNA, 16 bp, M. musculus
atcatctccatagatg

SEQ ID NO: 367010 - DNA, 17 bp, M. musculus
atcatctctgccacaat

SEQ ID NO: 367011 - DNA, 16 bp, M. musculus
atcatctcttcccact

SEQ ID NO: 367012 - DNA, 16 bp, M. musculus
atcatctgcaaataaa

SEQ ID NO: 367013 - DNA, 16 bp, M. musculus
atcatctgcaaatgat

SEQ ID NO: 367014 - DNA, 16 bp, M. musculus
atcatcttcagtgagg

SEQ ID NO: 367015 - DNA, 16 bp, M. musculus
atcatcttcttcatca

SEQ ID NO: 367016 - DNA, 16 bp, M. musculus
atcatcttggagatgg

SEQ ID NO: 367017 - DNA, 16 bp, M. musculus
atcatgaagaagaatg

SEQ ID NO: 367018 - DNA, 16 bp, M. musculus
atcatgaagggtgttg

SEQ ID NO: 367019 - DNA, 16 bp, M. musculus
atcatgaatcaagaaa

SEQ ID NO: 367020 - DNA, 16 bp, M. musculus
atcatgacaggaaaca

SEQ ID NO: 367021 - DNA, 16 bp, M. musculus
atcatgacaggaagca

SEQ ID NO: 367022 - DNA, 16 bp, M. musculus
atcatgacatcaaaat

SEQ ID NO: 367023 - DNA, 16 bp, M. musculus
atcatgaccaagaaag

SEQ ID NO: 367024 - DNA, 16 bp, M. musculus
atcatgagctcaaggc

SEQ ID NO: 367025 - DNA, 16 bp, M. musculus
atcatgatcaagaagc

SEQ ID NO: 367026 - DNA, 16 bp, M. musculus
atcatgatgatgatga

SEQ ID NO: 367027 - DNA, 16 bp, M. musculus
atcatgcccttcaaag

SEQ ID NO: 367028 - DNA, 16 bp, M. musculus
atcatggaaacagaag

SEQ ID NO: 367029 - DNA, 16 bp, M. musculus
atcatggaaactgaaa

SEQ ID NO: 367030 - DNA, 16 bp, M. musculus
atcatggaaagaaaaa

SEQ ID NO: 367031 - DNA, 16 bp, M. musculus
atcatggaactccaca

SEQ ID NO: 367032 - DNA, 16 bp, M. musculus
atcatggagacagaaa

SEQ ID NO: 367033 - DNA, 16 bp, M. musculus
atcatggagggaagca

SEQ ID NO: 367034 - DNA, 16 bp, M. musculus
atcatggagtcagttg

SEQ ID NO: 367035 - DNA, 16 bp, M. musculus
atcatggcagcatgca

SEQ ID NO: 367036 - DNA, 16 bp, M. musculus
atcatggtggatgatg

SEQ ID NO: 367037 - DNA, 16 bp, M. musculus
atcatggtggggagca

SEQ ID NO: 367038 - DNA, 16 bp, M. musculus
atcatggtgtttccag

SEQ ID NO: 367039 - DNA, 16 bp, M. musculus
atcatgtaattttttt

SEQ ID NO: 367040 - DNA, 16 bp, M. musculus
atcatgtacatttaaa

SEQ ID NO: 367041 - DNA, 16 bp, M. musculus
atcatgtcaggaagca

SEQ ID NO: 367042 - DNA, 16 bp, M. musculus
atcatgtctacctgca

SEQ ID NO: 367043 - DNA, 16 bp, M. musculus
atcatgtggttactgg

SEQ ID NO: 367044 - DNA, 16 bp, M. musculus
atcatgtggtttttct

SEQ ID NO: 367045 - DNA, 16 bp, M. musculus
atcatgtgtatgcctg

SEQ ID NO: 367046 - DNA, 16 bp, M. musculus
atcatgtgtattttgt

SEQ ID NO: 367047 - DNA, 16 bp, M. musculus
atcattaaaggaagtc

SEQ ID NO: 367048 - DNA, 16 bp, M. musculus
atcattaatccagaaa

SEQ ID NO: 367049 - DNA, 16 bp, M. musculus
atcattaatgaaaaat

SEQ ID NO: 367050 - DNA, 16 bp, M. musculus
atcattatagatatta

SEQ ID NO: 367051 - DNA, 16 bp, M. musculus
atcattatcatcacca

SEQ ID NO: 367052 - DNA, 17 bp, M. musculus
atcattcatcatgacca

SEQ ID NO: 367053 - DNA, 16 bp, M. musculus
atcattctctgagaac

SEQ ID NO: 367054 - DNA, 16 bp, M. musculus
atcattgacaaagaag

SEQ ID NO: 367055 - DNA, 16 bp, M. musculus
atcattgagaagaatg

SEQ ID NO: 367056 - DNA, 17 bp, M. musculus
atcattgagaagagtat

SEQ ID NO: 367057 - DNA, 16 bp, M. musculus
atcattgagaagagtg

SEQ ID NO: 367058 - DNA, 19 bp, M. musculus
atcattgatcagcccttgc

SEQ ID NO: 367059 - DNA, 16 bp, M. musculus
atcattgcagaagagg

SEQ ID NO: 367060 - DNA, 16 bp, M. musculus
atcattgggtagagag

SEQ ID NO: 367061 - DNA, 16 bp, M. musculus
atcattgttttattta

SEQ ID NO: 367062 - DNA, 16 bp, M. musculus
atcatttaagaaaaaa

SEQ ID NO: 367063 - DNA, 16 bp, M. musculus
atcatttctgctcctg

SEQ ID NO: 367064 - DNA, 16 bp, M. musculus
atcatttgaaaacatt

SEQ ID NO: 367065 - DNA, 16 bp, M. musculus
atcatttgttttcttg

SEQ ID NO: 367066 - DNA, 16 bp, M. musculus
atcattttaaaaaatc

SEQ ID NO: 367067 - DNA, 16 bp, M. musculus
atcattttaggaaaga

SEQ ID NO: 367068 - DNA, 16 bp, M. musculus
atcattttgatgtgct

SEQ ID NO: 367069 - DNA, 16 bp, M. musculus
atcattttgatgtttt

SEQ ID NO: 367070 - DNA, 16 bp, M. musculus
atcattttttttcctg

SEQ ID NO: 367071 - DNA, 16 bp, M. musculus
atccaaaaacaaaagg

SEQ ID NO: 367072 - DNA, 16 bp, M. musculus
atccaaaaagacaagg

SEQ ID NO: 367073 - DNA, 16 bp, M. musculus
atccaaaactacagga

SEQ ID NO: 367074 - DNA, 16 bp, M. musculus
atccaaaactcttcaa

SEQ ID NO: 367075 - DNA, 16 bp, M. musculus
atccaaaatgaattca

SEQ ID NO: 367076 - DNA, 16 bp, M. musculus
atccaaacaaatgaaa

SEQ ID NO: 367077 - DNA, 16 bp, M. musculus
atccaaagagctgaag

SEQ ID NO: 367078 - DNA, 16 bp, M. musculus
atccaaagaggtgatg

SEQ ID NO: 367079 - DNA, 16 bp, M. musculus
atccaaagcttcagga

SEQ ID NO: 367080 - DNA, 16 bp, M. musculus
atccaaagtcttttaa

SEQ ID NO: 367081 - DNA, 16 bp, M. musculus
atccaaatttaaacaa

SEQ ID NO: 367082 - DNA, 16 bp, M. musculus
atccaacaccccttca

SEQ ID NO: 367083 - DNA, 16 bp, M. musculus
atccaacattttgctg

SEQ ID NO: 367084 - DNA, 17 bp, M. musculus
atccaacgagatgatca

SEQ ID NO: 367085 - DNA, 16 bp, M. musculus
atccaactgaaaggca

SEQ ID NO: 367086 - DNA, 16 bp, M. musculus
atccaagaaaacacaa

SEQ ID NO: 367087 - DNA, 16 bp, M. musculus
atccaagacagggaaa

SEQ ID NO: 367088 - DNA, 16 bp, M. musculus
atccaagatctaaaaa

SEQ ID NO: 367089 - DNA, 16 bp, M. musculus
atccaagcatttggga

SEQ ID NO: 367090 - DNA, 16 bp, M. musculus
atccaagctcaggtcc

SEQ ID NO: 367091 - DNA, 16 bp, M. musculus
atccaagtggaaacaa

SEQ ID NO: 367092 - DNA, 16 bp, M. musculus
atccaagttcagttcc

SEQ ID NO: 367093 - DNA, 16 bp, M. musculus
atccaatatatacaag

SEQ ID NO: 367094 - DNA, 16 bp, M. musculus
atccaatatatatata

SEQ ID NO: 367095 - DNA, 16 bp, M. musculus
atccaatcaagttgac

SEQ ID NO: 367096 - DNA, 16 bp, M. musculus
atccaatgccctcttc

SEQ ID NO: 367097 - DNA, 17 bp, M. musculus
atccacaacagtgtctg

SEQ ID NO: 367098 - DNA, 16 bp, M. musculus
atccacactgcctgca

SEQ ID NO: 367099 - DNA, 16 bp, M. musculus
atccacactgtggtct

SEQ ID NO: 367100 - DNA, 16 bp, M. musculus
atccacagagccatct

SEQ ID NO: 367101 - DNA, 16 bp, M. musculus
atccacagccaggaag

SEQ ID NO: 367102 - DNA, 16 bp, M. musculus
atccacaggacccaca

SEQ ID NO: 367103 - DNA, 16 bp, M. musculus
atccacagtcaaacat

SEQ ID NO: 367104 - DNA, 16 bp, M. musculus
atccacatatatttat

SEQ ID NO: 367105 - DNA, 16 bp, M. musculus
atccacatctgtatca

SEQ ID NO: 367106 - DNA, 16 bp, M. musculus
atccaccatccatcca

SEQ ID NO: 367107 - DNA, 16 bp, M. musculus
atccacccatccatct

SEQ ID NO: 367108 - DNA, 17 bp, M. musculus
atccacccattggtctt

SEQ ID NO: 367109 - DNA, 16 bp, M. musculus
atccacccatttgtct

SEQ ID NO: 367110 - DNA, 16 bp, M. musculus
atccacccgcctctgc

SEQ ID NO: 367111 - DNA, 16 bp, M. musculus
atccacctacctgcct

SEQ ID NO: 367112 - DNA, 16 bp, M. musculus
atccacctctctctgc

SEQ ID NO: 367113 - DNA, 16 bp, M. musculus
atccacctctgtattt

SEQ ID NO: 367114 - DNA, 16 bp, M. musculus
atccacctgactctgc

SEQ ID NO: 367115 - DNA, 16 bp, M. musculus
atccacctgcctcagc

SEQ ID NO: 367116 - DNA, 16 bp, M. musculus
atccacctgcctctga

SEQ ID NO: 367117 - DNA, 16 bp, M. musculus
atccacctgcctcttg

SEQ ID NO: 367118 - DNA, 16 bp, M. musculus
atccacctgcctgcct

SEQ ID NO: 367119 - DNA, 16 bp, M. musculus
atccacctgtctgtgc

SEQ ID NO: 367120 - DNA, 16 bp, M. musculus
atccacgttttccagt

SEQ ID NO: 367121 - DNA, 16 bp, M. musculus
atccactcctattatt

SEQ ID NO: 367122 - DNA, 16 bp, M. musculus
atccactctctgactg

SEQ ID NO: 367123 - DNA, 16 bp, M. musculus
atccactgagccagct

SEQ ID NO: 367124 - DNA, 16 bp, M. musculus
atccactggcaaacac

SEQ ID NO: 367125 - DNA, 16 bp, M. musculus
atccactggcctctgc

SEQ ID NO: 367126 - DNA, 18 bp, M. musculus
atccactggtgctgccaa

SEQ ID NO: 367127 - DNA, 16 bp, M. musculus
atccacttccatattt

SEQ ID NO: 367128 - DNA, 16 bp, M. musculus
atccagaaagatgatg

SEQ ID NO: 367129 - DNA, 16 bp, M. musculus
atccagaagatgttct

SEQ ID NO: 367130 - DNA, 16 bp, M. musculus
atccagaagattttcc

SEQ ID NO: 367131 - DNA, 16 bp, M. musculus
atccagactgatttcc

SEQ ID NO: 367132 - DNA, 16 bp, M. musculus
atccagagactacccc

SEQ ID NO: 367133 - DNA, 16 bp, M. musculus
atccagagactgggga

SEQ ID NO: 367134 - DNA, 16 bp, M. musculus
atccagagctatacag

SEQ ID NO: 367135 - DNA, 16 bp, M. musculus
atccagagtgaggtaa

SEQ ID NO: 367136 - DNA, 16 bp, M. musculus
atccagatgtaaaact

SEQ ID NO: 367137 - DNA, 16 bp, M. musculus
atccagatgttcctca

SEQ ID NO: 367138 - DNA, 16 bp, M. musculus
atccagcactctcttc

SEQ ID NO: 367139 - DNA, 16 bp, M. musculus
atccagcactggggag

SEQ ID NO: 367140 - DNA, 16 bp, M. musculus
atccagcccaaaagag

SEQ ID NO: 367141 - DNA, 17 bp, M. musculus
atccagcctggtctaca

SEQ ID NO: 367142 - DNA, 16 bp, M. musculus
atccagctcaagggga

SEQ ID NO: 367143 - DNA, 16 bp, M. musculus
atccagctcatgggga

SEQ ID NO: 367144 - DNA, 16 bp, M. musculus
atccagctcgcccttt

SEQ ID NO: 367145 - DNA, 16 bp, M. musculus
atccagctctacaaag

SEQ ID NO: 367146 - DNA, 16 bp, M. musculus
atccagctgcccccct

SEQ ID NO: 367147 - DNA, 16 bp, M. musculus
atccaggaaacccagg

SEQ ID NO: 367148 - DNA, 16 bp, M. musculus
atccaggaaatacaga

SEQ ID NO: 367149 - DNA, 16 bp, M. musculus
atccaggaaatcctgg

SEQ ID NO: 367150 - DNA, 16 bp, M. musculus
atccaggaaggcatgg

SEQ ID NO: 367151 - DNA, 16 bp, M. musculus
atccaggaagtccagg

SEQ ID NO: 367152 - DNA, 16 bp, M. musculus
atccaggactaccagc

SEQ ID NO: 367153 - DNA, 17 bp, M. musculus
atccaggagatccagga

SEQ ID NO: 367154 - DNA, 16 bp, M. musculus
atccaggaggcagagg

SEQ ID NO: 367155 - DNA, 16 bp, M. musculus
atccaggcaaaacacc

SEQ ID NO: 367156 - DNA, 16 bp, M. musculus
atccaggcaggcatgg

SEQ ID NO: 367157 - DNA, 16 bp, M. musculus
atccaggcaggcatgt

SEQ ID NO: 367158 - DNA, 16 bp, M. musculus
atccaggcaggcttgg

SEQ ID NO: 367159 - DNA, 16 bp, M. musculus
atccaggccttcaaag

SEQ ID NO: 367160 - DNA, 16 bp, M. musculus
atccaggctcttctgg

SEQ ID NO: 367161 - DNA, 16 bp, M. musculus
atccaggcttcacctt

SEQ ID NO: 367162 - DNA, 16 bp, M. musculus
atccaggcttcatctt

SEQ ID NO: 367163 - DNA, 16 bp, M. musculus
atccagggaggagcag

SEQ ID NO: 367164 - DNA, 16 bp, M. musculus
atccagggctacaaag

SEQ ID NO: 367165 - DNA, 16 bp, M. musculus
atccaggtcctctgca

SEQ ID NO: 367166 - DNA, 16 bp, M. musculus
atccaggtcctctgta

SEQ ID NO: 367167 - DNA, 16 bp, M. musculus
atccaggtcttgcttt

SEQ ID NO: 367168 - DNA, 16 bp, M. musculus
atccaggtgtcagagc

SEQ ID NO: 367169 - DNA, 16 bp, M. musculus
atccaggttgatgaag

SEQ ID NO: 367170 - DNA, 16 bp, M. musculus
atccagtattcactga

SEQ ID NO: 367171 - DNA, 16 bp, M. musculus
atccagtgccctcttc

SEQ ID NO: 367172 - DNA, 16 bp, M. musculus
atccagtgtctgagag

SEQ ID NO: 367173 - DNA, 16 bp, M. musculus
atccatactttggtct

SEQ ID NO: 367174 - DNA, 16 bp, M. musculus
atccataggacttcca

SEQ ID NO: 367175 - DNA, 16 bp, M. musculus
atccatatatatacat

SEQ ID NO: 367176 - DNA, 16 bp, M. musculus
atccatcaatgtgatc

SEQ ID NO: 367177 - DNA, 16 bp, M. musculus
atccatcatccaccca

SEQ ID NO: 367178 - DNA, 16 bp, M. musculus
atccatccacttgcct

SEQ ID NO: 367179 - DNA, 16 bp, M. musculus
atccatccatcatcca

SEQ ID NO: 367180 - DNA, 17 bp, M. musculus
atccatccatccatcca

SEQ ID NO: 367181 - DNA, 16 bp, M. musculus
atccatccatccattt

SEQ ID NO: 367182 - DNA, 16 bp, M. musculus
atccatccattcattc

SEQ ID NO: 367183 - DNA, 16 bp, M. musculus
atccatcccatagtca

SEQ ID NO: 367184 - DNA, 16 bp, M. musculus
atccatcccatcttca

SEQ ID NO: 367185 - DNA, 16 bp, M. musculus
atccatcccatgagca

SEQ ID NO: 367186 - DNA, 16 bp, M. musculus
atccatcccatgggca

SEQ ID NO: 367187 - DNA, 16 bp, M. musculus
atccatcccatgtaca

SEQ ID NO: 367188 - DNA, 16 bp, M. musculus
atccatccctctgttg

SEQ ID NO: 367189 - DNA, 16 bp, M. musculus
atccatctatccactc

SEQ ID NO: 367190 - DNA, 16 bp, M. musculus
atccatctatccatct

SEQ ID NO: 367191 - DNA, 16 bp, M. musculus
atccatctccaaaatt

SEQ ID NO: 367192 - DNA, 16 bp, M. musculus
atccatctgcctctga

SEQ ID NO: 367193 - DNA, 16 bp, M. musculus
atccatctgggtctga

SEQ ID NO: 367194 - DNA, 16 bp, M. musculus
atccatctgtctctgc

SEQ ID NO: 367195 - DNA, 16 bp, M. musculus
atccatctttccatct

SEQ ID NO: 367196 - DNA, 16 bp, M. musculus
atccatgaagtgtttg

SEQ ID NO: 367197 - DNA, 16 bp, M. musculus
atccatgacttgctgt

SEQ ID NO: 367198 - DNA, 16 bp, M. musculus
atccatgagcatggca

SEQ ID NO: 367199 - DNA, 16 bp, M. musculus
atccatgcaaaaatcc

SEQ ID NO: 367200 - DNA, 16 bp, M. musculus
atccatgctgaccaag

SEQ ID NO: 367201 - DNA, 16 bp, M. musculus
atccattagcatggga

SEQ ID NO: 367202 - DNA, 16 bp, M. musculus
atccattcatttattt

SEQ ID NO: 367203 - DNA, 17 bp, M. musculus
atccattcgtctgttga

SEQ ID NO: 367204 - DNA, 16 bp, M. musculus
atccattcttatctcc

SEQ ID NO: 367205 - DNA, 16 bp, M. musculus
atccattcttcagtgg

SEQ ID NO: 367206 - DNA, 16 bp, M. musculus
atccattcttctatca

SEQ ID NO: 367207 - DNA, 16 bp, M. musculus
atccatttacctgcaa

SEQ ID NO: 367208 - DNA, 16 bp, M. musculus
atccatttctctgtta

SEQ ID NO: 367209 - DNA, 16 bp, M. musculus
atccatttcttctacc

SEQ ID NO: 367210 - DNA, 16 bp, M. musculus
atccatttgcaaacac

SEQ ID NO: 367211 - DNA, 16 bp, M. musculus
atccatttgcataaga

SEQ ID NO: 367212 - DNA, 18 bp, M. musculus
atccatttgccagctcaa

SEQ ID NO: 367213 - DNA, 16 bp, M. musculus
atccattttcctgaaa

SEQ ID NO: 367214 - DNA, 16 bp, M. musculus
atcccaaaagccccca

SEQ ID NO: 367215 - DNA, 16 bp, M. musculus
atcccaaaagtcctct

SEQ ID NO: 367216 - DNA, 16 bp, M. musculus
atcccaaacactgccc

SEQ ID NO: 367217 - DNA, 16 bp, M. musculus
atcccaaagtggggca

SEQ ID NO: 367218 - DNA, 16 bp, M. musculus
atcccaaatcagacag

SEQ ID NO: 367219 - DNA, 16 bp, M. musculus
atcccaacaaccacat

SEQ ID NO: 367220 - DNA, 16 bp, M. musculus
atcccaacaaggccac

SEQ ID NO: 367221 - DNA, 16 bp, M. musculus
atcccaacactcagga

SEQ ID NO: 367222 - DNA, 16 bp, M. musculus
atcccaacactgagaa

SEQ ID NO: 367223 - DNA, 16 bp, M. musculus
atcccaacacttagga

SEQ ID NO: 367224 - DNA, 16 bp, M. musculus
atcccaacacttgaaa

SEQ ID NO: 367225 - DNA, 16 bp, M. musculus
atcccaacacttgaga

SEQ ID NO: 367226 - DNA, 16 bp, M. musculus
atcccaacacttggaa

SEQ ID NO: 367227 - DNA, 16 bp, M. musculus
atcccaaggtggggca

SEQ ID NO: 367228 - DNA, 16 bp, M. musculus
atcccaagtgctggga

SEQ ID NO: 367229 - DNA, 16 bp, M. musculus
atcccaatacttggga

SEQ ID NO: 367230 - DNA, 16 bp, M. musculus
atcccacaacagaaga

SEQ ID NO: 367231 - DNA, 16 bp, M. musculus
atcccacacctccttc

SEQ ID NO: 367232 - DNA, 16 bp, M. musculus
atcccacagtacctct

SEQ ID NO: 367233 - DNA, 16 bp, M. musculus
atcccaccaatcctca

SEQ ID NO: 367234 - DNA, 16 bp, M. musculus
atcccaccaggagaga

SEQ ID NO: 367235 - DNA, 16 bp, M. musculus
atcccacccccacagt

SEQ ID NO: 367236 - DNA, 16 bp, M. musculus
atcccacctccagcag

SEQ ID NO: 367237 - DNA, 16 bp, M. musculus
atcccactgtgggcag

SEQ ID NO: 367238 - DNA, 16 bp, M. musculus
atcccagaactccaga

SEQ ID NO: 367239 - DNA, 16 bp, M. musculus
atcccagaacttagga

SEQ ID NO: 367240 - DNA, 16 bp, M. musculus
atcccagaacttggga

SEQ ID NO: 367241 - DNA, 16 bp, M. musculus
atcccagaagaatttc

SEQ ID NO: 367242 - DNA, 16 bp, M. musculus
atcccagaagatttca

SEQ ID NO: 367243 - DNA, 16 bp, M. musculus
atcccagaatcacaga

SEQ ID NO: 367244 - DNA, 16 bp, M. musculus
atcccagaatcacagg

SEQ ID NO: 367245 - DNA, 16 bp, M. musculus
atcccagagatgcccc

SEQ ID NO: 367246 - DNA, 16 bp, M. musculus
atcccagagctcccag

SEQ ID NO: 367247 - DNA, 16 bp, M. musculus
atcccagagcttggga

SEQ ID NO: 367248 - DNA, 16 bp, M. musculus
atcccagaggcagagg

SEQ ID NO: 367249 - DNA, 16 bp, M. musculus
atcccagagttcctct

SEQ ID NO: 367250 - DNA, 16 bp, M. musculus
atcccagcaaccatct

SEQ ID NO: 367251 - DNA, 16 bp, M. musculus
atcccagcaactggga

SEQ ID NO: 367252 - DNA, 16 bp, M. musculus
atcccagcaatcagga

SEQ ID NO: 367253 - DNA, 16 bp, M. musculus
atcccagcaccacaga

SEQ ID NO: 367254 - DNA, 17 bp, M. musculus
atcccagcacccacata

SEQ ID NO: 367255 - DNA, 16 bp, M. musculus
atcccagcacccagga

SEQ ID NO: 367256 - DNA, 16 bp, M. musculus
atcccagcacctgggg

SEQ ID NO: 367257 - DNA, 16 bp, M. musculus
atcccagcactcagag

SEQ ID NO: 367258 - DNA, 16 bp, M. musculus
atcccagcactcagca

SEQ ID NO: 367259 - DNA, 16 bp, M. musculus
atcccagcactcagga

SEQ ID NO: 367260 - DNA, 16 bp, M. musculus
atcccagcactccaga

SEQ ID NO: 367261 - DNA, 16 bp, M. musculus
atcccagcactctaga

SEQ ID NO: 367262 - DNA, 16 bp, M. musculus
atcccagcactctgag

SEQ ID NO: 367263 - DNA, 16 bp, M. musculus
atcccagcactctgga

SEQ ID NO: 367264 - DNA, 16 bp, M. musculus
atcccagcactgaggg

SEQ ID NO: 367265 - DNA, 16 bp, M. musculus
atcccagcactgggaa

SEQ ID NO: 367266 - DNA, 16 bp, M. musculus
atcccagcacttagaa

SEQ ID NO: 367267 - DNA, 16 bp, M. musculus
atcccagcacttcaga

SEQ ID NO: 367268 - DNA, 16 bp, M. musculus
atcccagcacttgggg

SEQ ID NO: 367269 - DNA, 16 bp, M. musculus
atcccagcagaggcaa

SEQ ID NO: 367270 - DNA, 16 bp, M. musculus
atcccagcagaggcag

SEQ ID NO: 367271 - DNA, 16 bp, M. musculus
atcccagcagttggga

SEQ ID NO: 367272 - DNA, 16 bp, M. musculus
atcccagcatccagga

SEQ ID NO: 367273 - DNA, 16 bp, M. musculus
atcccagcattaggaa

SEQ ID NO: 367274 - DNA, 16 bp, M. musculus
atcccagcattcagag

SEQ ID NO: 367275 - DNA, 16 bp, M. musculus
atcccagcattctgaa

SEQ ID NO: 367276 - DNA, 16 bp, M. musculus
atcccagcatttgaga

SEQ ID NO: 367277 - DNA, 16 bp, M. musculus
atcccagccctcagga

SEQ ID NO: 367278 - DNA, 16 bp, M. musculus
atcccagcccttggga

SEQ ID NO: 367279 - DNA, 16 bp, M. musculus
atcccagcctttggga

SEQ ID NO: 367280 - DNA, 16 bp, M. musculus
atcccagcgttcagga

SEQ ID NO: 367281 - DNA, 16 bp, M. musculus
atcccagctactcaga

SEQ ID NO: 367282 - DNA, 16 bp, M. musculus
atcccagctactcagg

SEQ ID NO: 367283 - DNA, 16 bp, M. musculus
atcccagctctccaga

SEQ ID NO: 367284 - DNA, 16 bp, M. musculus
atcccagctctgggaa

SEQ ID NO: 367285 - DNA, 16 bp, M. musculus
atcccagctcttagga

SEQ ID NO: 367286 - DNA, 16 bp, M. musculus
atcccagcttttctgt

SEQ ID NO: 367287 - DNA, 16 bp, M. musculus
atcccaggactcaaga

SEQ ID NO: 367288 - DNA, 16 bp, M. musculus
atcccaggactctgga

SEQ ID NO: 367289 - DNA, 16 bp, M. musculus
atcccaggagacagag

SEQ ID NO: 367290 - DNA, 16 bp, M. musculus
atcccaggagacaggc

SEQ ID NO: 367291 - DNA, 16 bp, M. musculus
atcccagggatgcaaa

SEQ ID NO: 367292 - DNA, 16 bp, M. musculus
atcccagggcccccaa

SEQ ID NO: 367293 - DNA, 16 bp, M. musculus
atcccagggctcagga

SEQ ID NO: 367294 - DNA, 16 bp, M. musculus
atcccaggtctctgga

SEQ ID NO: 367295 - DNA, 16 bp, M. musculus
atcccaggtgtgagat

SEQ ID NO: 367296 - DNA, 16 bp, M. musculus
atcccagtacttagaa

SEQ ID NO: 367297 - DNA, 23 bp, M. musculus
atcccagtacttgggaggcagag

SEQ ID NO: 367298 - DNA, 16 bp, M. musculus
atcccagtatagatgg

SEQ ID NO: 367299 - DNA, 16 bp, M. musculus
atcccagtatttggga

SEQ ID NO: 367300 - DNA, 16 bp, M. musculus
atcccagtgcccagga

SEQ ID NO: 367301 - DNA, 16 bp, M. musculus
atcccagtgctaggga

SEQ ID NO: 367302 - DNA, 16 bp, M. musculus
atcccagtgctcagga

SEQ ID NO: 367303 - DNA, 16 bp, M. musculus
atcccagtgcttggga

SEQ ID NO: 367304 - DNA, 16 bp, M. musculus
atcccataataagcct

SEQ ID NO: 367305 - DNA, 16 bp, M. musculus
atcccatacctcctct

SEQ ID NO: 367306 - DNA, 16 bp, M. musculus
atcccatgacagatgg

SEQ ID NO: 367307 - DNA, 16 bp, M. musculus
atccccaaagccccta

SEQ ID NO: 367308 - DNA, 16 bp, M. musculus
atccccaacaagacca

SEQ ID NO: 367309 - DNA, 16 bp, M. musculus
atccccaacctcaagc

SEQ ID NO: 367310 - DNA, 16 bp, M. musculus
atccccactgctgtga

SEQ ID NO: 367311 - DNA, 16 bp, M. musculus
atccccagaaaccaca

SEQ ID NO: 367312 - DNA, 16 bp, M. musculus
atccccagaatccata

SEQ ID NO: 367313 - DNA, 16 bp, M. musculus
atccccagaattccaa

SEQ ID NO: 367314 - DNA, 16 bp, M. musculus
atccccagagtccaca

SEQ ID NO: 367315 - DNA, 16 bp, M. musculus
atccccagcatccaca

SEQ ID NO: 367316 - DNA, 16 bp, M. musculus
atccccagcatcccca

SEQ ID NO: 367317 - DNA, 16 bp, M. musculus
atccccagctgagctg

SEQ ID NO: 367318 - DNA, 16 bp, M. musculus
atccccaggacctaca

SEQ ID NO: 367319 - DNA, 16 bp, M. musculus
atccccatcaaaatcc

SEQ ID NO: 367320 - DNA, 16 bp, M. musculus
atccccctgcctcagc

SEQ ID NO: 367321 - DNA, 16 bp, M. musculus
atccccctgcctccac

SEQ ID NO: 367322 - DNA, 16 bp, M. musculus
atccccctgtctcagc

SEQ ID NO: 367323 - DNA, 16 bp, M. musculus
atcccctaaaaaaata

SEQ ID NO: 367324 - DNA, 16 bp, M. musculus
atcccctagaactgaa

SEQ ID NO: 367325 - DNA, 16 bp, M. musculus
atcccctagaactgga

SEQ ID NO: 367326 - DNA, 16 bp, M. musculus
atcccctagagctgga

SEQ ID NO: 367327 - DNA, 16 bp, M. musculus
atcccctcagctcctt

SEQ ID NO: 367328 - DNA, 16 bp, M. musculus
atcccctgctgtttta

SEQ ID NO: 367329 - DNA, 16 bp, M. musculus
atcccctggagcagga

SEQ ID NO: 367330 - DNA, 16 bp, M. musculus
atcccctggcactgga

SEQ ID NO: 367331 - DNA, 16 bp, M. musculus
atcccctttcccattt

SEQ ID NO: 367332 - DNA, 16 bp, M. musculus
atcccctttcctcatt

SEQ ID NO: 367333 - DNA, 16 bp, M. musculus
atcccgaaagtcctct

SEQ ID NO: 367334 - DNA, 16 bp, M. musculus
atcccgaaagtttcct

SEQ ID NO: 367335 - DNA, 16 bp, M. musculus
atcccgaggtgatccc

SEQ ID NO: 367336 - DNA, 16 bp, M. musculus
atcccgtggaactgga

SEQ ID NO: 367337 - DNA, 19 bp, M. musculus
atccctaacaatcataaag

SEQ ID NO: 367338 - DNA, 16 bp, M. musculus
atccctcaacagagaa

SEQ ID NO: 367339 - DNA, 16 bp, M. musculus
atccctcagacactga

SEQ ID NO: 367340 - DNA, 16 bp, M. musculus
atccctccagccccag

SEQ ID NO: 367341 - DNA, 16 bp, M. musculus
atccctgaaacccaca

SEQ ID NO: 367342 - DNA, 16 bp, M. musculus
atccctgagtttgagg

SEQ ID NO: 367343 - DNA, 16 bp, M. musculus
atccctgatctttcca

SEQ ID NO: 367344 - DNA, 16 bp, M. musculus
atccctgcatttggga

SEQ ID NO: 367345 - DNA, 16 bp, M. musculus
atccctggaacccaca

SEQ ID NO: 367346 - DNA, 16 bp, M. musculus
atccctggaactcact

SEQ ID NO: 367347 - DNA, 16 bp, M. musculus
atccctggagcaagct

SEQ ID NO: 367348 - DNA, 16 bp, M. musculus
atccctgggacccaca

SEQ ID NO: 367349 - DNA, 16 bp, M. musculus
atccctgggcaggtgg

SEQ ID NO: 367350 - DNA, 16 bp, M. musculus
atccctgtgaaagggt

SEQ ID NO: 367351 - DNA, 16 bp, M. musculus
atcccttcagctcctt

SEQ ID NO: 367352 - DNA, 16 bp, M. musculus
atcccttcccactgag

SEQ ID NO: 367353 - DNA, 16 bp, M. musculus
atcccttccccagttc

SEQ ID NO: 367354 - DNA, 16 bp, M. musculus
atcccttcctggcacc

SEQ ID NO: 367355 - DNA, 16 bp, M. musculus
atccctttaaaaaaaa

SEQ ID NO: 367356 - DNA, 16 bp, M. musculus
atccgatgccctcttt

SEQ ID NO: 367357 - DNA, 16 bp, M. musculus
atccgcctgactctgc

SEQ ID NO: 367358 - DNA, 18 bp, M. musculus
atccgcctgcatctgcct

SEQ ID NO: 367359 - DNA, 16 bp, M. musculus
atccgcctgcctcccg

SEQ ID NO: 367360 - DNA, 16 bp, M. musculus
atccgcctgcctctga

SEQ ID NO: 367361 - DNA, 16 bp, M. musculus
atccgcttatcagtga

SEQ ID NO: 367362 - DNA, 16 bp, M. musculus
atccggagactgcccc

SEQ ID NO: 367363 - DNA, 16 bp, M. musculus
atccgggcaccttccc

SEQ ID NO: 367364 - DNA, 16 bp, M. musculus
atcctaaaacaaaagg

SEQ ID NO: 367365 - DNA, 16 bp, M. musculus
atcctaaaagtcccgc

SEQ ID NO: 367366 - DNA, 16 bp, M. musculus
atcctaaaattcatat

SEQ ID NO: 367367 - DNA, 16 bp, M. musculus
atcctaaaattgctca

SEQ ID NO: 367368 - DNA, 16 bp, M. musculus
atcctaaatgagatag

SEQ ID NO: 367369 - DNA, 16 bp, M. musculus
atcctaacactcagga

SEQ ID NO: 367370 - DNA, 16 bp, M. musculus
atcctaacccaaaaca

SEQ ID NO: 367371 - DNA, 16 bp, M. musculus
atcctaagatcctggg

SEQ ID NO: 367372 - DNA, 16 bp, M. musculus
atcctaccagcaatag

SEQ ID NO: 367373 - DNA, 16 bp, M. musculus
atcctacccagctaaa

SEQ ID NO: 367374 - DNA, 16 bp, M. musculus
atcctagaacttgctc

SEQ ID NO: 367375 - DNA, 16 bp, M. musculus
atcctagcacttgaga

SEQ ID NO: 367376 - DNA, 16 bp, M. musculus
atcctagcattcagga

SEQ ID NO: 367377 - DNA, 16 bp, M. musculus
atcctagggatgcagg

SEQ ID NO: 367378 - DNA, 16 bp, M. musculus
atcctaggtttttggt

SEQ ID NO: 367379 - DNA, 16 bp, M. musculus
atcctagtactgggga

SEQ ID NO: 367380 - DNA, 16 bp, M. musculus
atcctagtacttagga

SEQ ID NO: 367381 - DNA, 16 bp, M. musculus
atcctagtacttggga

SEQ ID NO: 367382 - DNA, 16 bp, M. musculus
atcctatcacttggga

SEQ ID NO: 367383 - DNA, 20 bp, M. musculus
atcctatcagaccaccatgg

SEQ ID NO: 367384 - DNA, 16 bp, M. musculus
atcctatcagcaatgg

SEQ ID NO: 367385 - DNA, 16 bp, M. musculus
atcctatgagatcacc

SEQ ID NO: 367386 - DNA, 16 bp, M. musculus
atcctatgtcctcttc

SEQ ID NO: 367387 - DNA, 16 bp, M. musculus
atcctcaaagaaagac

SEQ ID NO: 367388 - DNA, 16 bp, M. musculus
atcctcacaggagaca

SEQ ID NO: 367389 - DNA, 16 bp, M. musculus
atcctcactctcttct

SEQ ID NO: 367390 - DNA, 16 bp, M. musculus
atcctcagccaggagg

SEQ ID NO: 367391 - DNA, 16 bp, M. musculus
atcctcagctacatat

SEQ ID NO: 367392 - DNA, 16 bp, M. musculus
atcctcagctgcatag

SEQ ID NO: 367393 - DNA, 16 bp, M. musculus
atcctcatctcattct

SEQ ID NO: 367394 - DNA, 16 bp, M. musculus
atcctccaagaccctt

SEQ ID NO: 367395 - DNA, 16 bp, M. musculus
atcctccccaaaacat

SEQ ID NO: 367396 - DNA, 16 bp, M. musculus
atcctccctcctcctg

SEQ ID NO: 367397 - DNA, 16 bp, M. musculus
atcctcctctgccctc

SEQ ID NO: 367398 - DNA, 16 bp, M. musculus
atcctcctctggcctc

SEQ ID NO: 367399 - DNA, 16 bp, M. musculus
atcctcctgactctgt

SEQ ID NO: 367400 - DNA, 16 bp, M. musculus
atcctcctgcaccatg

SEQ ID NO: 367401 - DNA, 16 bp, M. musculus
atcctcctgcctatgc

SEQ ID NO: 367402 - DNA, 16 bp, M. musculus
atcctcctgcctcaac

SEQ ID NO: 367403 - DNA, 16 bp, M. musculus
atcctcctgcctcagc

SEQ ID NO: 367404 - DNA, 16 bp, M. musculus
atcctcctgcctcagg

SEQ ID NO: 367405 - DNA, 16 bp, M. musculus
atcctcctgcctcagt

SEQ ID NO: 367406 - DNA, 16 bp, M. musculus
atcctcctgcctccac

SEQ ID NO: 367407 - DNA, 16 bp, M. musculus
atcctcctgcctccat

SEQ ID NO: 367408 - DNA, 16 bp, M. musculus
atcctcctgcctctac

SEQ ID NO: 367409 - DNA, 16 bp, M. musculus
atcctcctgccttagc

SEQ ID NO: 367410 - DNA, 16 bp, M. musculus
atcctcctgctgcctg

SEQ ID NO: 367411 - DNA, 16 bp, M. musculus
atcctcctgcttcagc

SEQ ID NO: 367412 - DNA, 16 bp, M. musculus
atcctcctgtctcagc

SEQ ID NO: 367413 - DNA, 16 bp, M. musculus
atcctcctgtctccac

SEQ ID NO: 367414 - DNA, 16 bp, M. musculus
atcctcctgtctctac

SEQ ID NO: 367415 - DNA, 16 bp, M. musculus
atcctcctgtttctgc

SEQ ID NO: 367416 - DNA, 16 bp, M. musculus
atcctccttcctctgc

SEQ ID NO: 367417 - DNA, 21 bp, M. musculus
atcctccttgacagccttggg

SEQ ID NO: 367418 - DNA, 16 bp, M. musculus
atcctcgccatcatct

SEQ ID NO: 367419 - DNA, 16 bp, M. musculus
atcctctaccagtatc

SEQ ID NO: 367420 - DNA, 16 bp, M. musculus
atcctctagaagagca

SEQ ID NO: 367421 - DNA, 16 bp, M. musculus
atcctctcagaggaca

SEQ ID NO: 367422 - DNA, 16 bp, M. musculus
atcctctccagcatct

SEQ ID NO: 367423 - DNA, 16 bp, M. musculus
atcctctccagcattt

SEQ ID NO: 367424 - DNA, 16 bp, M. musculus
atcctctctacctgtc

SEQ ID NO: 367425 - DNA, 16 bp, M. musculus
atcctctggaagaaca

SEQ ID NO: 367426 - DNA, 16 bp, M. musculus
atcctctggaagaata

SEQ ID NO: 367427 - DNA, 16 bp, M. musculus
atcctctggaagagaa

SEQ ID NO: 367428 - DNA, 16 bp, M. musculus
atcctctggcctctgc

SEQ ID NO: 367429 - DNA, 16 bp, M. musculus
atcctcttcatcctcc

SEQ ID NO: 367430 - DNA, 16 bp, M. musculus
atcctcttctgacctc

SEQ ID NO: 367431 - DNA, 16 bp, M. musculus
atcctcttgcttctgc

SEQ ID NO: 367432 - DNA, 16 bp, M. musculus
atcctcttggagacaa

SEQ ID NO: 367433 - DNA, 16 bp, M. musculus
atcctcttgtctctgt

SEQ ID NO: 367434 - DNA, 16 bp, M. musculus
atcctgaagaaatgca

SEQ ID NO: 367435 - DNA, 16 bp, M. musculus
atcctgacaacctgag

SEQ ID NO: 367436 - DNA, 16 bp, M. musculus
atcctgaccacgtagg

SEQ ID NO: 367437 - DNA, 16 bp, M. musculus
atcctgactgaggtaa

SEQ ID NO: 367438 - DNA, 16 bp, M. musculus
atcctgacttcctttg

SEQ ID NO: 367439 - DNA, 16 bp, M. musculus
atcctgaggaaacaca

SEQ ID NO: 367440 - DNA, 16 bp, M. musculus
atcctgaggaaatcca

SEQ ID NO: 367441 - DNA, 16 bp, M. musculus
atcctgagtgagataa

SEQ ID NO: 367442 - DNA, 16 bp, M. musculus
atcctgagtgagatga

SEQ ID NO: 367443 - DNA, 16 bp, M. musculus
atcctgagtgatgtaa

SEQ ID NO: 367444 - DNA, 23 bp, M. musculus
atcctgagttcaaatcccagcaa

SEQ ID NO: 367445 - DNA, 16 bp, M. musculus
atcctgatacagctgt

SEQ ID NO: 367446 - DNA, 16 bp, M. musculus
atcctgatgaaaagag

SEQ ID NO: 367447 - DNA, 16 bp, M. musculus
atcctgatgatgaaga

SEQ ID NO: 367448 - DNA, 16 bp, M. musculus
atcctgatggtgaaga

SEQ ID NO: 367449 - DNA, 16 bp, M. musculus
atcctgattgaggtaa

SEQ ID NO: 367450 - DNA, 16 bp, M. musculus
atcctgcaaatccatg

SEQ ID NO: 367451 - DNA, 16 bp, M. musculus
atcctgcatatcaggt

SEQ ID NO: 367452 - DNA, 16 bp, M. musculus
atcctgccagcattta

SEQ ID NO: 367453 - DNA, 16 bp, M. musculus
atcctgcctcagcctc

SEQ ID NO: 367454 - DNA, 16 bp, M. musculus
atcctgcgaatccatg

SEQ ID NO: 367455 - DNA, 16 bp, M. musculus
atcctgctgctgctgc

SEQ ID NO: 367456 - DNA, 16 bp, M. musculus
atcctggaaacaaaaa

SEQ ID NO: 367457 - DNA, 16 bp, M. musculus
atcctggaaagagaaa

SEQ ID NO: 367458 - DNA, 16 bp, M. musculus
atcctggaacccactc

SEQ ID NO: 367459 - DNA, 16 bp, M. musculus
atcctggaactccctc

SEQ ID NO: 367460 - DNA, 16 bp, M. musculus
atcctggaacttgatc

SEQ ID NO: 367461 - DNA, 16 bp, M. musculus
atcctggaagacagga

SEQ ID NO: 367462 - DNA, 16 bp, M. musculus
atcctggaatcagaaa

SEQ ID NO: 367463 - DNA, 16 bp, M. musculus
atcctggaatttgctc

SEQ ID NO: 367464 - DNA, 16 bp, M. musculus
atcctggacacatgtt

SEQ ID NO: 367465 - DNA, 16 bp, M. musculus
atcctggagctcactg

SEQ ID NO: 367466 - DNA, 16 bp, M. musculus
atcctggaggcaggaa

SEQ ID NO: 367467 - DNA, 16 bp, M. musculus
atcctggatggatttg

SEQ ID NO: 367468 - DNA, 16 bp, M. musculus
atcctggcacttagga

SEQ ID NO: 367469 - DNA, 16 bp, M. musculus
atcctggccctggcat

SEQ ID NO: 367470 - DNA, 16 bp, M. musculus
atcctggctgtgtcag

SEQ ID NO: 367471 - DNA, 16 bp, M. musculus
atcctgggacccacat

SEQ ID NO: 367472 - DNA, 16 bp, M. musculus
atcctgggccagaagg

SEQ ID NO: 367473 - DNA, 16 bp, M. musculus
atcctgggctacacag

SEQ ID NO: 367474 - DNA, 16 bp, M. musculus
atcctgggctggaatt

SEQ ID NO: 367475 - DNA, 16 bp, M. musculus
atcctgggctttttgt

SEQ ID NO: 367476 - DNA, 16 bp, M. musculus
atcctgggggctggag

SEQ ID NO: 367477 - DNA, 16 bp, M. musculus
atcctgggtatcctaa

SEQ ID NO: 367478 - DNA, 16 bp, M. musculus
atcctgggttcaatcc

SEQ ID NO: 367479 - DNA, 16 bp, M. musculus
atcctggtgtgtgtgt

SEQ ID NO: 367480 - DNA, 16 bp, M. musculus
atcctggtttacagag

SEQ ID NO: 367481 - DNA, 16 bp, M. musculus
atcctgtaatcctgag

SEQ ID NO: 367482 - DNA, 16 bp, M. musculus
atcctgtcccaatctg

SEQ ID NO: 367483 - DNA, 16 bp, M. musculus
atcctgtccttcctgt

SEQ ID NO: 367484 - DNA, 16 bp, M. musculus
atcctgtctcaaaaac

SEQ ID NO: 367485 - DNA, 16 bp, M. musculus
atcctgtctcaaaaat

SEQ ID NO: 367486 - DNA, 16 bp, M. musculus
atcctgtctcaaaatc

SEQ ID NO: 367487 - DNA, 16 bp, M. musculus
atcctgtctcaaacaa

SEQ ID NO: 367488 - DNA, 16 bp, M. musculus
atcctgtggtctctct

SEQ ID NO: 367489 - DNA, 16 bp, M. musculus
atcctgtgtgggacct

SEQ ID NO: 367490 - DNA, 16 bp, M. musculus
atcctgttgtggcgtc

SEQ ID NO: 367491 - DNA, 16 bp, M. musculus
atccttatccctccac

SEQ ID NO: 367492 - DNA, 16 bp, M. musculus
atccttccacatgacc

SEQ ID NO: 367493 - DNA, 16 bp, M. musculus
atccttcctaaatagt

SEQ ID NO: 367494 - DNA, 18 bp, M. musculus
atccttctcaacagtctg

SEQ ID NO: 367495 - DNA, 16 bp, M. musculus
atccttctgcagtaaa

SEQ ID NO: 367496 - DNA, 16 bp, M. musculus
atccttctgcctcagc

SEQ ID NO: 367497 - DNA, 16 bp, M. musculus
atccttctgcttcagc

SEQ ID NO: 367498 - DNA, 16 bp, M. musculus
atccttctgtttctct

SEQ ID NO: 367499 - DNA, 16 bp, M. musculus
atccttgaacacagga

SEQ ID NO: 367500 - DNA, 16 bp, M. musculus
atccttgactacatag

SEQ ID NO: 367501 - DNA, 18 bp, M. musculus
atccttgagaagaatttt

SEQ ID NO: 367502 - DNA, 16 bp, M. musculus
atccttgaggcaaaac

SEQ ID NO: 367503 - DNA, 16 bp, M. musculus
atccttgccatcatct

SEQ ID NO: 367504 - DNA, 16 bp, M. musculus
atccttggctacctag

SEQ ID NO: 367505 - DNA, 16 bp, M. musculus
atccttgttctgtgct

SEQ ID NO: 367506 - DNA, 16 bp, M. musculus
atcctttcccaatttg

SEQ ID NO: 367507 - DNA, 16 bp, M. musculus
atcctttcctctcagc

SEQ ID NO: 367508 - DNA, 16 bp, M. musculus
atcctttctcccattt

SEQ ID NO: 367509 - DNA, 16 bp, M. musculus
atcctttgcaagagca

SEQ ID NO: 367510 - DNA, 16 bp, M. musculus
atcctttggatgcaaa

SEQ ID NO: 367511 - DNA, 17 bp, M. musculus
atcctttgtgcttgtgg

SEQ ID NO: 367512 - DNA, 16 bp, M. musculus
atccttttcatctcac

SEQ ID NO: 367513 - DNA, 16 bp, M. musculus
atccttttccaatctg

SEQ ID NO: 367514 - DNA, 16 bp, M. musculus
atccttttccacactt

SEQ ID NO: 367515 - DNA, 16 bp, M. musculus
atccttttgcattttg

SEQ ID NO: 367516 - DNA, 16 bp, M. musculus
atcctttttcctggtt

SEQ ID NO: 367517 - DNA, 16 bp, M. musculus
atcgaacccagggcct

SEQ ID NO: 367518 - DNA, 16 bp, M. musculus
atcgacagtgtactca

SEQ ID NO: 367519 - DNA, 16 bp, M. musculus
atcgatcgatcgatcg

SEQ ID NO: 367520 - DNA, 16 bp, M. musculus
atcgcctggaactgga

SEQ ID NO: 367521 - DNA, 16 bp, M. musculus
atcgctgagttcaagg

SEQ ID NO: 367522 - DNA, 16 bp, M. musculus
atcgcttctcagcctt

SEQ ID NO: 367523 - DNA, 16 bp, M. musculus
atcgtcatcaccatca

SEQ ID NO: 367524 - DNA, 16 bp, M. musculus
atcgtggaagctgtag

SEQ ID NO: 367525 - DNA, 16 bp, M. musculus
atcgttttgcattttg

SEQ ID NO: 367526 - DNA, 16 bp, M. musculus
atctaaaaatggaaat

SEQ ID NO: 367527 - DNA, 16 bp, M. musculus
atctaaaagttctaga

SEQ ID NO: 367528 - DNA, 16 bp, M. musculus
atctaaactgtcccat

SEQ ID NO: 367529 - DNA, 16 bp, M. musculus
atctaaaggaaagaaa

SEQ ID NO: 367530 - DNA, 16 bp, M. musculus
atctaaagtcagctat

SEQ ID NO: 367531 - DNA, 16 bp, M. musculus
atctaaatgaaatgga

SEQ ID NO: 367532 - DNA, 16 bp, M. musculus
atctaaatttcaaaat

SEQ ID NO: 367533 - DNA, 16 bp, M. musculus
atctaacagcttctgg

SEQ ID NO: 367534 - DNA, 16 bp, M. musculus
atctaataaaaaagag

SEQ ID NO: 367535 - DNA, 16 bp, M. musculus
atctaataaaaagtta

SEQ ID NO: 367536 - DNA, 16 bp, M. musculus
atctaataaaaattgg

SEQ ID NO: 367537 - DNA, 16 bp, M. musculus
atctaataaaatctac

SEQ ID NO: 367538 - DNA, 16 bp, M. musculus
atctaataaagaaaat

SEQ ID NO: 367539 - DNA, 16 bp, M. musculus
atctaataggatgcat

SEQ ID NO: 367540 - DNA, 16 bp, M. musculus
atctaatgttataaag

SEQ ID NO: 367541 - DNA, 16 bp, M. musculus
atctaattgagttgtt

SEQ ID NO: 367542 - DNA, 16 bp, M. musculus
atctacaaaacaactc

SEQ ID NO: 367543 - DNA, 16 bp, M. musculus
atctacaataaaaatc

SEQ ID NO: 367544 - DNA, 16 bp, M. musculus
atctacaatagtgtct

SEQ ID NO: 367545 - DNA, 16 bp, M. musculus
atctacaatgaaaagg

SEQ ID NO: 367546 - DNA, 20 bp, M. musculus
atctacacaatggagtacta

SEQ ID NO: 367547 - DNA, 16 bp, M. musculus
atctacagacaccaaa

SEQ ID NO: 367548 - DNA, 16 bp, M. musculus
atctacagagtaagtt

SEQ ID NO: 367549 - DNA, 16 bp, M. musculus
atctacagagtgaatt

SEQ ID NO: 367550 - DNA, 17 bp, M. musculus
atctacagcaaacctgt

SEQ ID NO: 367551 - DNA, 16 bp, M. musculus
atctacatatacagct

SEQ ID NO: 367552 - DNA, 16 bp, M. musculus
atctaccaggaaggtg

SEQ ID NO: 367553 - DNA, 16 bp, M. musculus
atctacctgaagacct

SEQ ID NO: 367554 - DNA, 16 bp, M. musculus
atctacctgactctgc

SEQ ID NO: 367555 - DNA, 16 bp, M. musculus
atctacctgcctctga

SEQ ID NO: 367556 - DNA, 16 bp, M. musculus
atctacctgcctctgt

SEQ ID NO: 367557 - DNA, 16 bp, M. musculus
atctacctgcttctgc

SEQ ID NO: 367558 - DNA, 20 bp, M. musculus
atctactacatccacagtcc

SEQ ID NO: 367559 - DNA, 16 bp, M. musculus
atctactggagcatgg

SEQ ID NO: 367560 - DNA, 16 bp, M. musculus
atctacttatcatcta

SEQ ID NO: 367561 - DNA, 16 bp, M. musculus
atctacttcctaaacc

SEQ ID NO: 367562 - DNA, 16 bp, M. musculus
atctacttctattttg

SEQ ID NO: 367563 - DNA, 16 bp, M. musculus
atctacttgtacaaag

SEQ ID NO: 367564 - DNA, 16 bp, M. musculus
atctacttttaatctg

SEQ ID NO: 367565 - DNA, 16 bp, M. musculus
atctagacaggaaatc

SEQ ID NO: 367566 - DNA, 16 bp, M. musculus
atctagagatggccat

SEQ ID NO: 367567 - DNA, 16 bp, M. musculus
atctagatgtagaact

SEQ ID NO: 367568 - DNA, 23 bp, M. musculus
atctagcagttactcagtctcac

SEQ ID NO: 367569 - DNA, 16 bp, M. musculus
atctagcagtttctca

SEQ ID NO: 367570 - DNA, 16 bp, M. musculus
atctagctctgaaggg

SEQ ID NO: 367571 - DNA, 16 bp, M. musculus
atctaggcctagaatg

SEQ ID NO: 367572 - DNA, 16 bp, M. musculus
atctagtccctgattt

SEQ ID NO: 367573 - DNA, 17 bp, M. musculus
atctagtgtttcttctt

SEQ ID NO: 367574 - DNA, 16 bp, M. musculus
atctagttaaaaaaaa

SEQ ID NO: 367575 - DNA, 16 bp, M. musculus
atctataatgggatcc

SEQ ID NO: 367576 - DNA, 22 bp, M. musculus
atctatagttccagatttcttt

SEQ ID NO: 367577 - DNA, 16 bp, M. musculus
atctatatatctatat

SEQ ID NO: 367578 - DNA, 16 bp, M. musculus
atctatatcatctttc

SEQ ID NO: 367579 - DNA, 36 bp, M. musculus
atctatatctatatctatatctatatctatatctat

SEQ ID NO: 367580 - DNA, 16 bp, M. musculus
atctatcaatctatct

SEQ ID NO: 367581 - DNA, 46 bp, M. musculus
atctatccacatacttcttccccagatgtctttctcaccaattttc

SEQ ID NO: 367582 - DNA, 16 bp, M. musculus
atctatccatccatca

SEQ ID NO: 367583 - DNA, 16 bp, M. musculus
atctatcctgctgctg

SEQ ID NO: 367584 - DNA, 16 bp, M. musculus
atctatctatacatat

SEQ ID NO: 367585 - DNA, 16 bp, M. musculus
atctatctatatataa

SEQ ID NO: 367586 - DNA, 18 bp, M. musculus
atctatctatatatatat

SEQ ID NO: 367587 - DNA, 16 bp, M. musculus
atctatctatcatcat

SEQ ID NO: 367588 - DNA, 16 bp, M. musculus
atctatctatccatct

SEQ ID NO: 367589 - DNA, 16 bp, M. musculus
atctatctatcttcct

SEQ ID NO: 367590 - DNA, 16 bp, M. musculus
atctatctctccatcc

SEQ ID NO: 367591 - DNA, 16 bp, M. musculus
atctatgagtttagca

SEQ ID NO: 367592 - DNA, 19 bp, M. musculus
atctatgctccaaatgcaa

SEQ ID NO: 367593 - DNA, 16 bp, M. musculus
atctatggggaagaga

SEQ ID NO: 367594 - DNA, 24 bp, M. musculus
atctatggtaattgagagtttggc

SEQ ID NO: 367595 - DNA, 16 bp, M. musculus
atctatggttccagat

SEQ ID NO: 367596 - DNA, 16 bp, M. musculus
atctatgtgtgtgtgt

SEQ ID NO: 367597 - DNA, 16 bp, M. musculus
atctattcattcattt

SEQ ID NO: 367598 - DNA, 16 bp, M. musculus
atctattctccaaatg

SEQ ID NO: 367599 - DNA, 16 bp, M. musculus
atctattcttcagttg

SEQ ID NO: 367600 - DNA, 16 bp, M. musculus
atctatttatctatcc

SEQ ID NO: 367601 - DNA, 16 bp, M. musculus
atctatttatctgtct

SEQ ID NO: 367602 - DNA, 16 bp, M. musculus
atctatttggtgttct

SEQ ID NO: 367603 - DNA, 16 bp, M. musculus
atctattttcaatgaa

SEQ ID NO: 367604 - DNA, 16 bp, M. musculus
atctattttgtgtgtg

SEQ ID NO: 367605 - DNA, 16 bp, M. musculus
atctcaaacatcttgg

SEQ ID NO: 367606 - DNA, 16 bp, M. musculus
atctcaagaaaataaa

SEQ ID NO: 367607 - DNA, 16 bp, M. musculus
atctcacaccagtcag

SEQ ID NO: 367608 - DNA, 16 bp, M. musculus
atctcacaccctcttc

SEQ ID NO: 367609 - DNA, 16 bp, M. musculus
atctcaccagcccctc

SEQ ID NO: 367610 - DNA, 16 bp, M. musculus
atctcaccagcccctt

SEQ ID NO: 367611 - DNA, 16 bp, M. musculus
atctcaccagccctga

SEQ ID NO: 367612 - DNA, 16 bp, M. musculus
atctcactgtggtttt

SEQ ID NO: 367613 - DNA, 16 bp, M. musculus
atctcacttagaaggg

SEQ ID NO: 367614 - DNA, 16 bp, M. musculus
atctcagaaaggaaaa

SEQ ID NO: 367615 - DNA, 16 bp, M. musculus
atctcagaacttggaa

SEQ ID NO: 367616 - DNA, 16 bp, M. musculus
atctcagaagagactt

SEQ ID NO: 367617 - DNA, 16 bp, M. musculus
atctcagaagatggta

SEQ ID NO: 367618 - DNA, 16 bp, M. musculus
atctcagagaaaaaaa

SEQ ID NO: 367619 - DNA, 16 bp, M. musculus
atctcagagctcacaa

SEQ ID NO: 367620 - DNA, 16 bp, M. musculus
atctcagagttcgagg

SEQ ID NO: 367621 - DNA, 16 bp, M. musculus
atctcagagtttgagg

SEQ ID NO: 367622 - DNA, 16 bp, M. musculus
atctcagcaaccacat

SEQ ID NO: 367623 - DNA, 16 bp, M. musculus
atctcagcacccagga

SEQ ID NO: 367624 - DNA, 16 bp, M. musculus
atctcagcactcggga

SEQ ID NO: 367625 - DNA, 16 bp, M. musculus
atctcagcactgggaa

SEQ ID NO: 367626 - DNA, 17 bp, M. musculus
atctcagcatcacagga

SEQ ID NO: 367627 - DNA, 16 bp, M. musculus
atctcagcatgtggga

SEQ ID NO: 367628 - DNA, 16 bp, M. musculus
atctcagcattctgga

SEQ ID NO: 367629 - DNA, 16 bp, M. musculus
atctcagctgctgctg

SEQ ID NO: 367630 - DNA, 16 bp, M. musculus
atctcaggaggcagag

SEQ ID NO: 367631 - DNA, 16 bp, M. musculus
atctcaggagtggtct

SEQ ID NO: 367632 - DNA, 16 bp, M. musculus
atctcaggcaatctat

SEQ ID NO: 367633 - DNA, 16 bp, M. musculus
atctcagggatccagg

SEQ ID NO: 367634 - DNA, 16 bp, M. musculus
atctcaggtgtagaaa

SEQ ID NO: 367635 - DNA, 16 bp, M. musculus
atctcagtacttagga

SEQ ID NO: 367636 - DNA, 16 bp, M. musculus
atctcagtcagacagg

SEQ ID NO: 367637 - DNA, 16 bp, M. musculus
atctcagtgaagaatt

SEQ ID NO: 367638 - DNA, 16 bp, M. musculus
atctcagtgctgggaa

SEQ ID NO: 367639 - DNA, 16 bp, M. musculus
atctcagtgctgtgga

SEQ ID NO: 367640 - DNA, 16 bp, M. musculus
atctcagttaagcaag

SEQ ID NO: 367641 - DNA, 16 bp, M. musculus
atctcatgaaactgca

SEQ ID NO: 367642 - DNA, 19 bp, M. musculus
atctcatgatgctggtaga

SEQ ID NO: 367643 - DNA, 16 bp, M. musculus
atctcatggagactct

SEQ ID NO: 367644 - DNA, 19 bp, M. musculus
atctcatggaggcatttcc

SEQ ID NO: 367645 - DNA, 16 bp, M. musculus
atctcattatagatga

SEQ ID NO: 367646 - DNA, 16 bp, M. musculus
atctcattcctcctcc

SEQ ID NO: 367647 - DNA, 16 bp, M. musculus
atctcattgtgggtgg

SEQ ID NO: 367648 - DNA, 16 bp, M. musculus
atctcatttaatcctc

SEQ ID NO: 367649 - DNA, 16 bp, M. musculus
atctcattttccttca

SEQ ID NO: 367650 - DNA, 16 bp, M. musculus
atctccaaacactgca

SEQ ID NO: 367651 - DNA, 16 bp, M. musculus
atctccaacattttgg

SEQ ID NO: 367652 - DNA, 16 bp, M. musculus
atctccacatgtgcac

SEQ ID NO: 367653 - DNA, 16 bp, M. musculus
atctccagaacccaca

SEQ ID NO: 367654 - DNA, 16 bp, M. musculus
atctccagagttttct

SEQ ID NO: 367655 - DNA, 16 bp, M. musculus
atctccagcacccaca

SEQ ID NO: 367656 - DNA, 16 bp, M. musculus
atctccagggctgtct

SEQ ID NO: 367657 - DNA, 16 bp, M. musculus
atctccagttccaggg

SEQ ID NO: 367658 - DNA, 16 bp, M. musculus
atctccatgcctgatg

SEQ ID NO: 367659 - DNA, 16 bp, M. musculus
atctccatggaaacca

SEQ ID NO: 367660 - DNA, 16 bp, M. musculus
atctccatgtcaagat

SEQ ID NO: 367661 - DNA, 16 bp, M. musculus
atctccattttaatga

SEQ ID NO: 367662 - DNA, 16 bp, M. musculus
atctcccacctggaaa

SEQ ID NO: 367663 - DNA, 16 bp, M. musculus
atctcccagagctgga

SEQ ID NO: 367664 - DNA, 16 bp, M. musculus
atctcccaggctcatg

SEQ ID NO: 367665 - DNA, 16 bp, M. musculus
atctcccatgttcatg

SEQ ID NO: 367666 - DNA, 16 bp, M. musculus
atctccccctttttgt

SEQ ID NO: 367667 - DNA, 25 bp, M. musculus
atctccctcacaatttccaccccag

SEQ ID NO: 367668 - DNA, 16 bp, M. musculus
atctccctgcctcagc

SEQ ID NO: 367669 - DNA, 16 bp, M. musculus
atctccctgctgttgg

SEQ ID NO: 367670 - DNA, 16 bp, M. musculus
atctccgtggaaagcc

SEQ ID NO: 367671 - DNA, 16 bp, M. musculus
atctcctacctcctga

SEQ ID NO: 367672 - DNA, 16 bp, M. musculus
atctcctagaactgga

SEQ ID NO: 367673 - DNA, 16 bp, M. musculus
atctcctctcatgggt

SEQ ID NO: 367674 - DNA, 16 bp, M. musculus
atctcctctggctctt

SEQ ID NO: 367675 - DNA, 16 bp, M. musculus
atctcctggaacagga

SEQ ID NO: 367676 - DNA, 16 bp, M. musculus
atctcctgggaagtgt

SEQ ID NO: 367677 - DNA, 16 bp, M. musculus
atctcctgtagcccag

SEQ ID NO: 367678 - DNA, 16 bp, M. musculus
atctccttagatgcag

SEQ ID NO: 367679 - DNA, 16 bp, M. musculus
atctccttaggaaggg

SEQ ID NO: 367680 - DNA, 16 bp, M. musculus
atctccttcattgggg

SEQ ID NO: 367681 - DNA, 16 bp, M. musculus
atctccttggacaaag

SEQ ID NO: 367682 - DNA, 16 bp, M. musculus
atctcctttagttgtt

SEQ ID NO: 367683 - DNA, 16 bp, M. musculus
atctcctttcctcatt

SEQ ID NO: 367684 - DNA, 56 bp, M. musculus
atctccttttgttgtcgaattgctctggctaatacttcaagtactatgttgaaaag

SEQ ID NO: 367685 - DNA, 16 bp, M. musculus
atctctacctccccag

SEQ ID NO: 367686 - DNA, 16 bp, M. musculus
atctctatctatctat

SEQ ID NO: 367687 - DNA, 16 bp, M. musculus
atctctatctctctct

SEQ ID NO: 367688 - DNA, 16 bp, M. musculus
atctctatgagtctga

SEQ ID NO: 367689 - DNA, 16 bp, M. musculus
atctctcaagaaagaa

SEQ ID NO: 367690 - DNA, 16 bp, M. musculus
atctctcagactctga

SEQ ID NO: 367691 - DNA, 16 bp, M. musculus
atctctccaacccagt

SEQ ID NO: 367692 - DNA, 16 bp, M. musculus
atctctccaactccct

SEQ ID NO: 367693 - DNA, 16 bp, M. musculus
atctctccagacccac

SEQ ID NO: 367694 - DNA, 16 bp, M. musculus
atctctccagacccct

SEQ ID NO: 367695 - DNA, 16 bp, M. musculus
atctctccagacctct

SEQ ID NO: 367696 - DNA, 16 bp, M. musculus
atctctccagcaccag

SEQ ID NO: 367697 - DNA, 16 bp, M. musculus
atctctccagcccatg

SEQ ID NO: 367698 - DNA, 16 bp, M. musculus
atctctccagccccat

SEQ ID NO: 367699 - DNA, 16 bp, M. musculus
atctctccagccccgg

SEQ ID NO: 367700 - DNA, 16 bp, M. musculus
atctctccagccctct

SEQ ID NO: 367701 - DNA, 16 bp, M. musculus
atctctccagcctgat

SEQ ID NO: 367702 - DNA, 16 bp, M. musculus
atctctccagccttct

SEQ ID NO: 367703 - DNA, 16 bp, M. musculus
atctctccagctcagt

SEQ ID NO: 367704 - DNA, 16 bp, M. musculus
atctctccagctccca

SEQ ID NO: 367705 - DNA, 16 bp, M. musculus
atctctccagctcctg

SEQ ID NO: 367706 - DNA, 16 bp, M. musculus
atctctccagttccag

SEQ ID NO: 367707 - DNA, 16 bp, M. musculus
atctctccatccccca

SEQ ID NO: 367708 - DNA, 16 bp, M. musculus
atctctccatccctgg

SEQ ID NO: 367709 - DNA, 16 bp, M. musculus
atctctccctctgtct

SEQ ID NO: 367710 - DNA, 16 bp, M. musculus
atctctctagccccaa

SEQ ID NO: 367711 - DNA, 16 bp, M. musculus
atctctctagccccta

SEQ ID NO: 367712 - DNA, 16 bp, M. musculus
atctctctcctctgag

SEQ ID NO: 367713 - DNA, 16 bp, M. musculus
atctctctctctgctt

SEQ ID NO: 367714 - DNA, 16 bp, M. musculus
atctctctgccattct

SEQ ID NO: 367715 - DNA, 16 bp, M. musculus
atctctctgtctctct

SEQ ID NO: 367716 - DNA, 16 bp, M. musculus
atctctcttcatctct

SEQ ID NO: 367717 - DNA, 16 bp, M. musculus
atctctgaatttgagg

SEQ ID NO: 367718 - DNA, 16 bp, M. musculus
atctctgagagttcaa

SEQ ID NO: 367719 - DNA, 16 bp, M. musculus
atctctgagctccagg

SEQ ID NO: 367720 - DNA, 16 bp, M. musculus
atctctgagctcgagg

SEQ ID NO: 367721 - DNA, 16 bp, M. musculus
atctctgagttctaag

SEQ ID NO: 367722 - DNA, 16 bp, M. musculus
atctctgagtttgaga

SEQ ID NO: 367723 - DNA, 16 bp, M. musculus
atctctgagtttgagg

SEQ ID NO: 367724 - DNA, 16 bp, M. musculus
atctctgcatccctgg

SEQ ID NO: 367725 - DNA, 16 bp, M. musculus
atctctgctccatttt

SEQ ID NO: 367726 - DNA, 16 bp, M. musculus
atctctgcttcatcta

SEQ ID NO: 367727 - DNA, 16 bp, M. musculus
atctctggaactggag

SEQ ID NO: 367728 - DNA, 16 bp, M. musculus
atctctggaagaacag

SEQ ID NO: 367729 - DNA, 16 bp, M. musculus
atctctggagctagtt

SEQ ID NO: 367730 - DNA, 16 bp, M. musculus
atctctggctggagct

SEQ ID NO: 367731 - DNA, 16 bp, M. musculus
atctctgggcttgtag

SEQ ID NO: 367732 - DNA, 16 bp, M. musculus
atctctgggggagaga

SEQ ID NO: 367733 - DNA, 16 bp, M. musculus
atctctgtctgtctct

SEQ ID NO: 367734 - DNA, 16 bp, M. musculus
atctctgtgaattcaa

SEQ ID NO: 367735 - DNA, 16 bp, M. musculus
atctctgtgactttga

SEQ ID NO: 367736 - DNA, 16 bp, M. musculus
atctctgtgagttgga

SEQ ID NO: 367737 - DNA, 16 bp, M. musculus
atctctgtgagtttca

SEQ ID NO: 367738 - DNA, 16 bp, M. musculus
atctctgtgagtttga

SEQ ID NO: 367739 - DNA, 16 bp, M. musculus
atctctgtgtcttcaa

SEQ ID NO: 367740 - DNA, 16 bp, M. musculus
atctctgtgtgtctct

SEQ ID NO: 367741 - DNA, 16 bp, M. musculus
atctctgttgggtcct

SEQ ID NO: 367742 - DNA, 16 bp, M. musculus
atctcttaagtttgag

SEQ ID NO: 367743 - DNA, 16 bp, M. musculus
atctcttagaactgga

SEQ ID NO: 367744 - DNA, 16 bp, M. musculus
atctcttcagcccatg

SEQ ID NO: 367745 - DNA, 16 bp, M. musculus
atctcttcagcccctc

SEQ ID NO: 367746 - DNA, 16 bp, M. musculus
atctcttcagccctga

SEQ ID NO: 367747 - DNA, 16 bp, M. musculus
atctcttcccaatctg

SEQ ID NO: 367748 - DNA, 16 bp, M. musculus
atctcttctggcctct

SEQ ID NO: 367749 - DNA, 16 bp, M. musculus
atctcttctttccctg

SEQ ID NO: 367750 - DNA, 17 bp, M. musculus
atctcttgaggcctgtt

SEQ ID NO: 367751 - DNA, 17 bp, M. musculus
atctcttggatggaaca

SEQ ID NO: 367752 - DNA, 16 bp, M. musculus
atctctttagctcctt

SEQ ID NO: 367753 - DNA, 16 bp, M. musculus
atctctttcatctcta

SEQ ID NO: 367754 - DNA, 16 bp, M. musculus
atctctttcttaaggt

SEQ ID NO: 367755 - DNA, 16 bp, M. musculus
atctctttgagttcaa

SEQ ID NO: 367756 - DNA, 16 bp, M. musculus
atctctttgagtttga

SEQ ID NO: 367757 - DNA, 16 bp, M. musculus
atctgaaaaccatcct

SEQ ID NO: 367758 - DNA, 16 bp, M. musculus
atctgaaacaaagaga

SEQ ID NO: 367759 - DNA, 16 bp, M. musculus
atctgaaacagtcctt

SEQ ID NO: 367760 - DNA, 16 bp, M. musculus
atctgaaaccaagaga

SEQ ID NO: 367761 - DNA, 16 bp, M. musculus
atctgaaatctcaaag

SEQ ID NO: 367762 - DNA, 16 bp, M. musculus
atctgaaattccagtt

SEQ ID NO: 367763 - DNA, 16 bp, M. musculus
atctgaagaccacttt

SEQ ID NO: 367764 - DNA, 16 bp, M. musculus
atctgaagagagtgac

SEQ ID NO: 367765 - DNA, 16 bp, M. musculus
atctgaagatttggag

SEQ ID NO: 367766 - DNA, 16 bp, M. musculus
atctgaagccagcctg

SEQ ID NO: 367767 - DNA, 16 bp, M. musculus
atctgaaggcagcaga

SEQ ID NO: 367768 - DNA, 16 bp, M. musculus
atctgaaggcagccag

SEQ ID NO: 367769 - DNA, 16 bp, M. musculus
atctgaagtcctcttc

SEQ ID NO: 367770 - DNA, 16 bp, M. musculus
atctgaatgaaatgga

SEQ ID NO: 367771 - DNA, 17 bp, M. musculus
atctgaatgtaatttgt

SEQ ID NO: 367772 - DNA, 16 bp, M. musculus
atctgacaaaatccaa

SEQ ID NO: 367773 - DNA, 16 bp, M. musculus
atctgacactctcaca

SEQ ID NO: 367774 - DNA, 16 bp, M. musculus
atctgacagacatcta

SEQ ID NO: 367775 - DNA, 16 bp, M. musculus
atctgacatcatcttc

SEQ ID NO: 367776 - DNA, 18 bp, M. musculus
atctgacgccctcttctg

SEQ ID NO: 367777 - DNA, 18 bp, M. musculus
atctgacgtcctcttctg

SEQ ID NO: 367778 - DNA, 18 bp, M. musculus
atctgactccctcttcta

SEQ ID NO: 367779 - DNA, 16 bp, M. musculus
atctgactgcctctgc

SEQ ID NO: 367780 - DNA, 16 bp, M. musculus
atctgacttatggtgt

SEQ ID NO: 367781 - DNA, 16 bp, M. musculus
atctgagaacacatca

SEQ ID NO: 367782 - DNA, 16 bp, M. musculus
atctgagaggaaggaa

SEQ ID NO: 367783 - DNA, 16 bp, M. musculus
atctgagcctcagttt

SEQ ID NO: 367784 - DNA, 16 bp, M. musculus
atctgagcctgggtgg

SEQ ID NO: 367785 - DNA, 16 bp, M. musculus
atctgagtctttcagc

SEQ ID NO: 367786 - DNA, 16 bp, M. musculus
atctgagttcaagacc

SEQ ID NO: 367787 - DNA, 16 bp, M. musculus
atctgagttcaattcc

SEQ ID NO: 367788 - DNA, 16 bp, M. musculus
atctgagtttagttcc

SEQ ID NO: 367789 - DNA, 16 bp, M. musculus
atctgataacctcttc

SEQ ID NO: 367790 - DNA, 16 bp, M. musculus
atctgatatacaggat

SEQ ID NO: 367791 - DNA, 16 bp, M. musculus
atctgatccacaagca

SEQ ID NO: 367792 - DNA, 16 bp, M. musculus
atctgatgccctcttg

SEQ ID NO: 367793 - DNA, 16 bp, M. musculus
atctgatgccttttct

SEQ ID NO: 367794 - DNA, 16 bp, M. musculus
atctgatggcctcttt

SEQ ID NO: 367795 - DNA, 16 bp, M. musculus
atctgattttaaaaat

SEQ ID NO: 367796 - DNA, 16 bp, M. musculus
atctgcaacttcagtt

SEQ ID NO: 367797 - DNA, 16 bp, M. musculus
atctgcaccctgatgc

SEQ ID NO: 367798 - DNA, 16 bp, M. musculus
atctgcagacagcagg

SEQ ID NO: 367799 - DNA, 16 bp, M. musculus
atctgcagccaggaag

SEQ ID NO: 367800 - DNA, 16 bp, M. musculus
atctgcagctcaccaa

SEQ ID NO: 367801 - DNA, 16 bp, M. musculus
atctgcaggcagcaaa

SEQ ID NO: 367802 - DNA, 16 bp, M. musculus
atctgcaggcctttta

SEQ ID NO: 367803 - DNA, 16 bp, M. musculus
atctgcatggtactgg

SEQ ID NO: 367804 - DNA, 16 bp, M. musculus
atctgccaagatgaac

SEQ ID NO: 367805 - DNA, 16 bp, M. musculus
atctgccaccctcttc

SEQ ID NO: 367806 - DNA, 16 bp, M. musculus
atctgccagcctctgc

SEQ ID NO: 367807 - DNA, 16 bp, M. musculus
atctgcccagctctgg

SEQ ID NO: 367808 - DNA, 16 bp, M. musculus
atctgcccagctttag

SEQ ID NO: 367809 - DNA, 16 bp, M. musculus
atctgccctctcctcc

SEQ ID NO: 367810 - DNA, 16 bp, M. musculus
atctgcctacctctgc

SEQ ID NO: 367811 - DNA, 16 bp, M. musculus
atctgcctatctgtct

SEQ ID NO: 367812 - DNA, 16 bp, M. musculus
atctgcctctgcctct

SEQ ID NO: 367813 - DNA, 16 bp, M. musculus
atctgcctgactctgc

SEQ ID NO: 367814 - DNA, 16 bp, M. musculus
atctgcctgccactgc

SEQ ID NO: 367815 - DNA, 16 bp, M. musculus
atctgcctgcccctgc

SEQ ID NO: 367816 - DNA, 16 bp, M. musculus
atctgcctgcctctga

SEQ ID NO: 367817 - DNA, 18 bp, M. musculus
atctgcctgcctctgcct

SEQ ID NO: 367818 - DNA, 19 bp, M. musculus
atctgcctgcctctgcctg

SEQ ID NO: 367819 - DNA, 16 bp, M. musculus
atctgcctgcttctac

SEQ ID NO: 367820 - DNA, 16 bp, M. musculus
atctgcctgcttctgt

SEQ ID NO: 367821 - DNA, 16 bp, M. musculus
atctgcctgcttcttc

SEQ ID NO: 367822 - DNA, 16 bp, M. musculus
atctgcctgcttttgt

SEQ ID NO: 367823 - DNA, 16 bp, M. musculus
atctgcctgtcactgt

SEQ ID NO: 367824 - DNA, 16 bp, M. musculus
atctgcctgtttcttt

SEQ ID NO: 367825 - DNA, 16 bp, M. musculus
atctgccttcttctgc

SEQ ID NO: 367826 - DNA, 16 bp, M. musculus
atctgcctttgcctcc

SEQ ID NO: 367827 - DNA, 16 bp, M. musculus
atctgctcagggaact

SEQ ID NO: 367828 - DNA, 16 bp, M. musculus
atctgctgggggactc

SEQ ID NO: 367829 - DNA, 16 bp, M. musculus
atctgctgtcacctgt

SEQ ID NO: 367830 - DNA, 16 bp, M. musculus
atctgctgtctcctga

SEQ ID NO: 367831 - DNA, 16 bp, M. musculus
atctgcttccctagtt

SEQ ID NO: 367832 - DNA, 16 bp, M. musculus
atctgcttctgtattt

SEQ ID NO: 367833 - DNA, 16 bp, M. musculus
atctgcttgcttctgt

SEQ ID NO: 367834 - DNA, 16 bp, M. musculus
atctgcttgtctctgt

SEQ ID NO: 367835 - DNA, 16 bp, M. musculus
atctggaaaaaaacaa

SEQ ID NO: 367836 - DNA, 16 bp, M. musculus
atctggaaaaacaaaa

SEQ ID NO: 367837 - DNA, 16 bp, M. musculus
atctggaaacatagat

SEQ ID NO: 367838 - DNA, 16 bp, M. musculus
atctggaaagctgtct

SEQ ID NO: 367839 - DNA, 16 bp, M. musculus
atctggaaaggcaaaa

SEQ ID NO: 367840 - DNA, 16 bp, M. musculus
atctggaaccatagag

SEQ ID NO: 367841 - DNA, 16 bp, M. musculus
atctggaaccatagat

SEQ ID NO: 367842 - DNA, 16 bp, M. musculus
atctggaacttgcttt

SEQ ID NO: 367843 - DNA, 16 bp, M. musculus
atctggaagagaagag

SEQ ID NO: 367844 - DNA, 17 bp, M. musculus
atctggaagagaagagg

SEQ ID NO: 367845 - DNA, 16 bp, M. musculus
atctggaagatgaagt

SEQ ID NO: 367846 - DNA, 16 bp, M. musculus
atctggaagcaggagc

SEQ ID NO: 367847 - DNA, 16 bp, M. musculus
atctggaaggaaggaa

SEQ ID NO: 367848 - DNA, 16 bp, M. musculus
atctggaccacacctt

SEQ ID NO: 367849 - DNA, 16 bp, M. musculus
atctggaggatatcat

SEQ ID NO: 367850 - DNA, 16 bp, M. musculus
atctggaggctgctag

SEQ ID NO: 367851 - DNA, 16 bp, M. musculus
atctggagtctaagaa

SEQ ID NO: 367852 - DNA, 16 bp, M. musculus
atctggagtgtaaaat

SEQ ID NO: 367853 - DNA, 16 bp, M. musculus
atctggagtgtctgaa

SEQ ID NO: 367854 - DNA, 16 bp, M. musculus
atctggagtttcctca

SEQ ID NO: 367855 - DNA, 16 bp, M. musculus
atctggatggagtcta

SEQ ID NO: 367856 - DNA, 16 bp, M. musculus
atctggattacctcac

SEQ ID NO: 367857 - DNA, 16 bp, M. musculus
atctggatttaacttt

SEQ ID NO: 367858 - DNA, 16 bp, M. musculus
atctggcattcagcag

SEQ ID NO: 367859 - DNA, 16 bp, M. musculus
atctggccactttcct

SEQ ID NO: 367860 - DNA, 18 bp, M. musculus
atctggccatagattaat

SEQ ID NO: 367861 - DNA, 16 bp, M. musculus
atctgggaggagttgg

SEQ ID NO: 367862 - DNA, 16 bp, M. musculus
atctgggaggcagaga

SEQ ID NO: 367863 - DNA, 16 bp, M. musculus
atctgggcatggtggt

SEQ ID NO: 367864 - DNA, 16 bp, M. musculus
atctgggctgctctta

SEQ ID NO: 367865 - DNA, 17 bp, M. musculus
atctggggctcagtgtt

SEQ ID NO: 367866 - DNA, 16 bp, M. musculus
atctggggtgtgtgtg

SEQ ID NO: 367867 - DNA, 16 bp, M. musculus
atctgggtgctggaaa

SEQ ID NO: 367868 - DNA, 16 bp, M. musculus
atctgggttcaattcc

SEQ ID NO: 367869 - DNA, 16 bp, M. musculus
atctgggttgcttcta

SEQ ID NO: 367870 - DNA, 16 bp, M. musculus
atctggtgccctcttt

SEQ ID NO: 367871 - DNA, 16 bp, M. musculus
atctggtgtggtctct

SEQ ID NO: 367872 - DNA, 16 bp, M. musculus
atctggtgttagatgt

SEQ ID NO: 367873 - DNA, 16 bp, M. musculus
atctggttagttgata

SEQ ID NO: 367874 - DNA, 16 bp, M. musculus
atctgtaaagaaaaat

SEQ ID NO: 367875 - DNA, 16 bp, M. musculus
atctgtaactccagct

SEQ ID NO: 367876 - DNA, 16 bp, M. musculus
atctgtaactccagtt

SEQ ID NO: 367877 - DNA, 16 bp, M. musculus
atctgtaactccggtt

SEQ ID NO: 367878 - DNA, 16 bp, M. musculus
atctgtaagaaacagg

SEQ ID NO: 367879 - DNA, 17 bp, M. musculus
atctgtaatgggatcca

SEQ ID NO: 367880 - DNA, 16 bp, M. musculus
atctgtatttttaaaa

SEQ ID NO: 367881 - DNA, 16 bp, M. musculus
atctgtccattgatga

SEQ ID NO: 367882 - DNA, 16 bp, M. musculus
atctgtccattggaga

SEQ ID NO: 367883 - DNA, 16 bp, M. musculus
atctgtcctttggtga

SEQ ID NO: 367884 - DNA, 16 bp, M. musculus
atctgtctcccaggtc

SEQ ID NO: 367885 - DNA, 16 bp, M. musculus
atctgtctctgcctcc

SEQ ID NO: 367886 - DNA, 16 bp, M. musculus
atctgtctctgcttcc

SEQ ID NO: 367887 - DNA, 16 bp, M. musculus
atctgtctgtcatttc

SEQ ID NO: 367888 - DNA, 16 bp, M. musculus
atctgtgaaatgggag

SEQ ID NO: 367889 - DNA, 16 bp, M. musculus
atctgtgaaatgggga

SEQ ID NO: 367890 - DNA, 16 bp, M. musculus
atctgtgcagctacag

SEQ ID NO: 367891 - DNA, 16 bp, M. musculus
atctgtgccaagttat

SEQ ID NO: 367892 - DNA, 16 bp, M. musculus
atctgtggaagagcag

SEQ ID NO: 367893 - DNA, 16 bp, M. musculus
atctgtggattgcttt

SEQ ID NO: 367894 - DNA, 16 bp, M. musculus
atctgtggtggtctga

SEQ ID NO: 367895 - DNA, 16 bp, M. musculus
atctgtgtatatatgt

SEQ ID NO: 367896 - DNA, 16 bp, M. musculus
atctgtgtctctgtgt

SEQ ID NO: 367897 - DNA, 16 bp, M. musculus
atctgtgtgcatgcat

SEQ ID NO: 367898 - DNA, 16 bp, M. musculus
atctgtgtgcctctgc

SEQ ID NO: 367899 - DNA, 16 bp, M. musculus
atctgtgtgtgtgtct

SEQ ID NO: 367900 - DNA, 16 bp, M. musculus
atctgtgttcatctga

SEQ ID NO: 367901 - DNA, 16 bp, M. musculus
atctgtgtttgtgtgt

SEQ ID NO: 367902 - DNA, 16 bp, M. musculus
atctgtgttttccaat

SEQ ID NO: 367903 - DNA, 16 bp, M. musculus
atctgtgttttctgat

SEQ ID NO: 367904 - DNA, 16 bp, M. musculus
atctgttaatttttaa

SEQ ID NO: 367905 - DNA, 16 bp, M. musculus
atctgttgaggcctct

SEQ ID NO: 367906 - DNA, 16 bp, M. musculus
atctgttgattctaaa

SEQ ID NO: 367907 - DNA, 16 bp, M. musculus
atctgttgcaggagga

SEQ ID NO: 367908 - DNA, 16 bp, M. musculus
atctgttggctgccat

SEQ ID NO: 367909 - DNA, 16 bp, M. musculus
atctgttggtggccat

SEQ ID NO: 367910 - DNA, 16 bp, M. musculus
atctgttgtaatgtct

SEQ ID NO: 367911 - DNA, 16 bp, M. musculus
atctgttgtcatctga

SEQ ID NO: 367912 - DNA, 16 bp, M. musculus
atctgttttatgatta

SEQ ID NO: 367913 - DNA, 16 bp, M. musculus
atcttaaaaacaaaag

SEQ ID NO: 367914 - DNA, 16 bp, M. musculus
atcttaaacagtttgt

SEQ ID NO: 367915 - DNA, 16 bp, M. musculus
atcttaaagaaattaa

SEQ ID NO: 367916 - DNA, 23 bp, M. musculus
atcttacagcacaagccattgct

SEQ ID NO: 367917 - DNA, 16 bp, M. musculus
atcttacagcgcaagc

SEQ ID NO: 367918 - DNA, 18 bp, M. musculus
atcttacagctcaagcca

SEQ ID NO: 367919 - DNA, 16 bp, M. musculus
atcttaccaggcaata

SEQ ID NO: 367920 - DNA, 17 bp, M. musculus
atcttactatgtagccc

SEQ ID NO: 367921 - DNA, 16 bp, M. musculus
atcttactgattcctt

SEQ ID NO: 367922 - DNA, 16 bp, M. musculus
atcttacttctcatct

SEQ ID NO: 367923 - DNA, 16 bp, M. musculus
atcttagaaaatggaa

SEQ ID NO: 367924 - DNA, 16 bp, M. musculus
atcttagagtcatttt

SEQ ID NO: 367925 - DNA, 16 bp, M. musculus
atcttagcacttggga

SEQ ID NO: 367926 - DNA, 16 bp, M. musculus
atcttagctagagcaa

SEQ ID NO: 367927 - DNA, 17 bp, M. musculus
atcttaggaccacctgt

SEQ ID NO: 367928 - DNA, 16 bp, M. musculus
atcttagtcactgttc

SEQ ID NO: 367929 - DNA, 25 bp, M. musculus
atcttagtcagggtttctattcctg

SEQ ID NO: 367930 - DNA, 16 bp, M. musculus
atcttatctcaaaaca

SEQ ID NO: 367931 - DNA, 16 bp, M. musculus
atcttatctctgactc

SEQ ID NO: 367932 - DNA, 16 bp, M. musculus
atcttatctttaaaaa

SEQ ID NO: 367933 - DNA, 16 bp, M. musculus
atcttatgagagtgct

SEQ ID NO: 367934 - DNA, 16 bp, M. musculus
atcttatgcaggtctt

SEQ ID NO: 367935 - DNA, 17 bp, M. musculus
atcttcaacaaaattat

SEQ ID NO: 367936 - DNA, 16 bp, M. musculus
atcttcaaggcctttc

SEQ ID NO: 367937 - DNA, 16 bp, M. musculus
atcttcaatgaaatta

SEQ ID NO: 367938 - DNA, 16 bp, M. musculus
atcttcacaatcaaag

SEQ ID NO: 367939 - DNA, 16 bp, M. musculus
atcttcacatcctttg

SEQ ID NO: 367940 - DNA, 16 bp, M. musculus
atcttcacttccttga

SEQ ID NO: 367941 - DNA, 16 bp, M. musculus
atcttcagaaagctgt

SEQ ID NO: 367942 - DNA, 16 bp, M. musculus
atcttcagcatcctta

SEQ ID NO: 367943 - DNA, 16 bp, M. musculus
atcttcagccaagagg

SEQ ID NO: 367944 - DNA, 16 bp, M. musculus
atcttcagccaggaag

SEQ ID NO: 367945 - DNA, 16 bp, M. musculus
atcttcagtaacaaaa

SEQ ID NO: 367946 - DNA, 16 bp, M. musculus
atcttcagtacaggct

SEQ ID NO: 367947 - DNA, 16 bp, M. musculus
atcttcatctcaaggc

SEQ ID NO: 367948 - DNA, 16 bp, M. musculus
atcttcatctcatgtt

SEQ ID NO: 367949 - DNA, 16 bp, M. musculus
atcttcattatcatct

SEQ ID NO: 367950 - DNA, 16 bp, M. musculus
atcttcattcttcttg

SEQ ID NO: 367951 - DNA, 16 bp, M. musculus
atcttcattgtcagca

SEQ ID NO: 367952 - DNA, 16 bp, M. musculus
atcttcattgtcatct

SEQ ID NO: 367953 - DNA, 16 bp, M. musculus
atcttcattttaaaaa

SEQ ID NO: 367954 - DNA, 16 bp, M. musculus
atcttcattttcatct

SEQ ID NO: 367955 - DNA, 16 bp, M. musculus
atcttccactagcagc

SEQ ID NO: 367956 - DNA, 16 bp, M. musculus
atcttccatgctcata

SEQ ID NO: 367957 - DNA, 16 bp, M. musculus
atcttcccacctcagt

SEQ ID NO: 367958 - DNA, 16 bp, M. musculus
atcttcccagccccaa

SEQ ID NO: 367959 - DNA, 16 bp, M. musculus
atcttcctcaatcact

SEQ ID NO: 367960 - DNA, 16 bp, M. musculus
atcttcctcttgctcc

SEQ ID NO: 367961 - DNA, 16 bp, M. musculus
atcttcctgagttctt

SEQ ID NO: 367962 - DNA, 16 bp, M. musculus
atcttcctgcctcctt

SEQ ID NO: 367963 - DNA, 16 bp, M. musculus
atcttcctgcctttgt

SEQ ID NO: 367964 - DNA, 16 bp, M. musculus
atcttcctgcttccat

SEQ ID NO: 367965 - DNA, 16 bp, M. musculus
atcttcctgcttgtct

SEQ ID NO: 367966 - DNA, 16 bp, M. musculus
atcttcctgtttctac

SEQ ID NO: 367967 - DNA, 16 bp, M. musculus
atcttccttttaaaaa

SEQ ID NO: 367968 - DNA, 16 bp, M. musculus
atcttctacaagggag

SEQ ID NO: 367969 - DNA, 16 bp, M. musculus
atcttctcaattagtg

SEQ ID NO: 367970 - DNA, 16 bp, M. musculus
atcttctctcctgaag

SEQ ID NO: 367971 - DNA, 16 bp, M. musculus
atcttctgaaagagca

SEQ ID NO: 367972 - DNA, 17 bp, M. musculus
atcttctgcatgaaccc

SEQ ID NO: 367973 - DNA, 16 bp, M. musculus
atcttctgcctgaacc

SEQ ID NO: 367974 - DNA, 16 bp, M. musculus
atcttctggaaagtgt

SEQ ID NO: 367975 - DNA, 23 bp, M. musculus
atcttctggctttcatagtctct

SEQ ID NO: 367976 - DNA, 22 bp, M. musculus
atcttctgggaagtgttttctg

SEQ ID NO: 367977 - DNA, 16 bp, M. musculus
atcttctgtagagctg

SEQ ID NO: 367978 - DNA, 16 bp, M. musculus
atcttctgtggcaaaa

SEQ ID NO: 367979 - DNA, 16 bp, M. musculus
atcttctgtttctctc

SEQ ID NO: 367980 - DNA, 16 bp, M. musculus
atcttcttcagttcct

SEQ ID NO: 367981 - DNA, 16 bp, M. musculus
atcttcttttggggaa

SEQ ID NO: 367982 - DNA, 16 bp, M. musculus
atcttgaaatcctggt

SEQ ID NO: 367983 - DNA, 16 bp, M. musculus
atcttgaactcctgat

SEQ ID NO: 367984 - DNA, 16 bp, M. musculus
atcttgaagaaaaaaa

SEQ ID NO: 367985 - DNA, 16 bp, M. musculus
atcttgagaatgttca

SEQ ID NO: 367986 - DNA, 16 bp, M. musculus
atcttgagtgaggtaa

SEQ ID NO: 367987 - DNA, 16 bp, M. musculus
atcttgatccgaaggc

SEQ ID NO: 367988 - DNA, 16 bp, M. musculus
atcttgatgttctgtc

SEQ ID NO: 367989 - DNA, 16 bp, M. musculus
atcttgcaaaaagcaa

SEQ ID NO: 367990 - DNA, 16 bp, M. musculus
atcttgccagccccca

SEQ ID NO: 367991 - DNA, 16 bp, M. musculus
atcttgctggtgtgtg

SEQ ID NO: 367992 - DNA, 16 bp, M. musculus
atcttgcttttctggt

SEQ ID NO: 367993 - DNA, 16 bp, M. musculus
atcttggaaaaaaaaa

SEQ ID NO: 367994 - DNA, 16 bp, M. musculus
atcttggaactcactt

SEQ ID NO: 367995 - DNA, 16 bp, M. musculus
atcttggaactgaaag

SEQ ID NO: 367996 - DNA, 16 bp, M. musculus
atcttggagtaaggtt

SEQ ID NO: 367997 - DNA, 16 bp, M. musculus
atcttggctgctctta

SEQ ID NO: 367998 - DNA, 16 bp, M. musculus
atcttggctgtcctgg

SEQ ID NO: 367999 - DNA, 16 bp, M. musculus
atcttggggattctaa

SEQ ID NO: 368000 - DNA, 16 bp, M. musculus
atcttggtgccagggc

SEQ ID NO: 368001 - DNA, 16 bp, M. musculus
atcttggtttaactct

SEQ ID NO: 368002 - DNA, 16 bp, M. musculus
atcttggtttctctgt

SEQ ID NO: 368003 - DNA, 16 bp, M. musculus
atcttgtattctctgg

SEQ ID NO: 368004 - DNA, 16 bp, M. musculus
atcttgtcttgaaaaa

SEQ ID NO: 368005 - DNA, 16 bp, M. musculus
atcttgtgcctgccct

SEQ ID NO: 368006 - DNA, 16 bp, M. musculus
atcttgtgtcctgggt

SEQ ID NO: 368007 - DNA, 16 bp, M. musculus
atcttgttcagaaggc

SEQ ID NO: 368008 - DNA, 16 bp, M. musculus
atctttaaaaaacaga

SEQ ID NO: 368009 - DNA, 16 bp, M. musculus
atctttaaaaaacatt

SEQ ID NO: 368010 - DNA, 16 bp, M. musculus
atctttaaaaacattt

SEQ ID NO: 368011 - DNA, 16 bp, M. musculus
atctttaaagatttat

SEQ ID NO: 368012 - DNA, 16 bp, M. musculus
atctttaacttccctg

SEQ ID NO: 368013 - DNA, 16 bp, M. musculus
atctttaatcccaaca

SEQ ID NO: 368014 - DNA, 16 bp, M. musculus
atctttagctacatag

SEQ ID NO: 368015 - DNA, 16 bp, M. musculus
atctttaggagccaaa

SEQ ID NO: 368016 - DNA, 16 bp, M. musculus
atctttagtcccagca

SEQ ID NO: 368017 - DNA, 16 bp, M. musculus
atctttatatgttact

SEQ ID NO: 368018 - DNA, 16 bp, M. musculus
atctttatctatctat

SEQ ID NO: 368019 - DNA, 16 bp, M. musculus
atctttatgaatccta

SEQ ID NO: 368020 - DNA, 16 bp, M. musculus
atctttatgagtttga

SEQ ID NO: 368021 - DNA, 16 bp, M. musculus
atctttatgtctgagg

SEQ ID NO: 368022 - DNA, 16 bp, M. musculus
atctttcaaaacaaaa

SEQ ID NO: 368023 - DNA, 16 bp, M. musculus
atctttcactgaacct

SEQ ID NO: 368024 - DNA, 16 bp, M. musculus
atctttccaaaagcaa

SEQ ID NO: 368025 - DNA, 16 bp, M. musculus
atctttccaagtcttt

SEQ ID NO: 368026 - DNA, 16 bp, M. musculus
atctttccagccccta

SEQ ID NO: 368027 - DNA, 16 bp, M. musculus
atctttccagtcccaa

SEQ ID NO: 368028 - DNA, 16 bp, M. musculus
atctttccatctcctg

SEQ ID NO: 368029 - DNA, 16 bp, M. musculus
atctttccatgaatca

SEQ ID NO: 368030 - DNA, 16 bp, M. musculus
atctttcctttgatga

SEQ ID NO: 368031 - DNA, 16 bp, M. musculus
atctttctatgtagcc

SEQ ID NO: 368032 - DNA, 16 bp, M. musculus
atctttctccacatcc

SEQ ID NO: 368033 - DNA, 16 bp, M. musculus
atctttctgcttcctc

SEQ ID NO: 368034 - DNA, 16 bp, M. musculus
atctttctgcttctgc

SEQ ID NO: 368035 - DNA, 16 bp, M. musculus
atctttctgcttcttc

SEQ ID NO: 368036 - DNA, 16 bp, M. musculus
atctttcttcatctcc

SEQ ID NO: 368037 - DNA, 16 bp, M. musculus
atctttgaaaaaaaaa

SEQ ID NO: 368038 - DNA, 16 bp, M. musculus
atctttgaaaaagaag

SEQ ID NO: 368039 - DNA, 16 bp, M. musculus
atctttgaggcttttt

SEQ ID NO: 368040 - DNA, 16 bp, M. musculus
atctttgaggtgggaa

SEQ ID NO: 368041 - DNA, 16 bp, M. musculus
atctttgctaatttgc

SEQ ID NO: 368042 - DNA, 16 bp, M. musculus
atctttgctgatcttc

SEQ ID NO: 368043 - DNA, 16 bp, M. musculus
atctttgcttctgttt

SEQ ID NO: 368044 - DNA, 16 bp, M. musculus
atctttgctttcttct

SEQ ID NO: 368045 - DNA, 16 bp, M. musculus
atctttggcttttgaa

SEQ ID NO: 368046 - DNA, 17 bp, M. musculus
atctttgggagccagga

SEQ ID NO: 368047 - DNA, 16 bp, M. musculus
atctttgtccctgaat

SEQ ID NO: 368048 - DNA, 16 bp, M. musculus
atctttgtctctctct

SEQ ID NO: 368049 - DNA, 16 bp, M. musculus
atctttgtgagttcaa

SEQ ID NO: 368050 - DNA, 16 bp, M. musculus
atctttgtgagttcga

SEQ ID NO: 368051 - DNA, 16 bp, M. musculus
atctttgtgagtttga

SEQ ID NO: 368052 - DNA, 16 bp, M. musculus
atctttgttaattaaa

SEQ ID NO: 368053 - DNA, 16 bp, M. musculus
atctttgttaattgcc

SEQ ID NO: 368054 - DNA, 16 bp, M. musculus
atcttttaaaaaaaga

SEQ ID NO: 368055 - DNA, 16 bp, M. musculus
atcttttaaaaacttt

SEQ ID NO: 368056 - DNA, 16 bp, M. musculus
atcttttaataatgaa

SEQ ID NO: 368057 - DNA, 16 bp, M. musculus
atcttttcagcaaaat

SEQ ID NO: 368058 - DNA, 16 bp, M. musculus
atcttttcccattttg

SEQ ID NO: 368059 - DNA, 16 bp, M. musculus
atcttttcctaatctg

SEQ ID NO: 368060 - DNA, 16 bp, M. musculus
atcttttctagtttca

SEQ ID NO: 368061 - DNA, 16 bp, M. musculus
atcttttctgaaggga

SEQ ID NO: 368062 - DNA, 16 bp, M. musculus
atcttttgagccactg

SEQ ID NO: 368063 - DNA, 16 bp, M. musculus
atcttttgatacaaat

SEQ ID NO: 368064 - DNA, 16 bp, M. musculus
atcttttgggaaatta

SEQ ID NO: 368065 - DNA, 16 bp, M. musculus
atcttttgggaagtgt

SEQ ID NO: 368066 - DNA, 16 bp, M. musculus
atcttttggggagggg

SEQ ID NO: 368067 - DNA, 16 bp, M. musculus
atcttttgggtttatt

SEQ ID NO: 368068 - DNA, 16 bp, M. musculus
atctttttaaaaaatg

SEQ ID NO: 368069 - DNA, 16 bp, M. musculus
atctttttaaaatatc

SEQ ID NO: 368070 - DNA, 16 bp, M. musculus
atctttttaaagtaaa

SEQ ID NO: 368071 - DNA, 16 bp, M. musculus
atctttttgcattttg

SEQ ID NO: 368072 - DNA, 16 bp, M. musculus
atcttttttaaaaacc

SEQ ID NO: 368073 - DNA, 16 bp, M. musculus
atcttttttaaaaaga

SEQ ID NO: 368074 - DNA, 16 bp, M. musculus
atcttttttaaaaagt

SEQ ID NO: 368075 - DNA, 16 bp, M. musculus
atctttttttaaaaag

SEQ ID NO: 368076 - DNA, 16 bp, M. musculus
atctttttttaaaagg

SEQ ID NO: 368077 - DNA, 16 bp, M. musculus
atgaaaaaaacttcaa

SEQ ID NO: 368078 - DNA, 16 bp, M. musculus
atgaaaaaaatctatt

SEQ ID NO: 368079 - DNA, 16 bp, M. musculus
atgaaaaaatatctaa

SEQ ID NO: 368080 - DNA, 16 bp, M. musculus
atgaaaaaggagtgga

SEQ ID NO: 368081 - DNA, 16 bp, M. musculus
atgaaaaatacatttt

SEQ ID NO: 368082 - DNA, 16 bp, M. musculus
atgaaaaatactcaat

SEQ ID NO: 368083 - DNA, 16 bp, M. musculus
atgaaaaatgaaatgt

SEQ ID NO: 368084 - DNA, 16 bp, M. musculus
atgaaaacaatgtttt

SEQ ID NO: 368085 - DNA, 16 bp, M. musculus
atgaaaacatttattt

SEQ ID NO: 368086 - DNA, 16 bp, M. musculus
atgaaaacatttttat

SEQ ID NO: 368087 - DNA, 16 bp, M. musculus
atgaaaaccaagctgt

SEQ ID NO: 368088 - DNA, 16 bp, M. musculus
atgaaaactagtacta

SEQ ID NO: 368089 - DNA, 16 bp, M. musculus
atgaaaagacctaacc

SEQ ID NO: 368090 - DNA, 16 bp, M. musculus
atgaaaagcagaaagc

SEQ ID NO: 368091 - DNA, 16 bp, M. musculus
atgaaaagcagtatgg

SEQ ID NO: 368092 - DNA, 16 bp, M. musculus
atgaaaaggacaattt

SEQ ID NO: 368093 - DNA, 16 bp, M. musculus
atgaaaataaatacat

SEQ ID NO: 368094 - DNA, 16 bp, M. musculus
atgaaaatatacatat

SEQ ID NO: 368095 - DNA, 16 bp, M. musculus
atgaaaatatcttaaa

SEQ ID NO: 368096 - DNA, 16 bp, M. musculus
atgaaaatattctttt

SEQ ID NO: 368097 - DNA, 16 bp, M. musculus
atgaaaatatttctaa

SEQ ID NO: 368098 - DNA, 16 bp, M. musculus
atgaaaatattttccc

SEQ ID NO: 368099 - DNA, 16 bp, M. musculus
atgaaaatcaatcaat

SEQ ID NO: 368100 - DNA, 16 bp, M. musculus
atgaaaatcagaaaat

SEQ ID NO: 368101 - DNA, 16 bp, M. musculus
atgaaaatctattttt

SEQ ID NO: 368102 - DNA, 16 bp, M. musculus
atgaaaatctcaaaga

SEQ ID NO: 368103 - DNA, 16 bp, M. musculus
atgaaaatgaactgaa

SEQ ID NO: 368104 - DNA, 16 bp, M. musculus
atgaaaatgaagaaac

SEQ ID NO: 368105 - DNA, 16 bp, M. musculus
atgaaaatgaagacaa

SEQ ID NO: 368106 - DNA, 16 bp, M. musculus
atgaaaatgaagacat

SEQ ID NO: 368107 - DNA, 16 bp, M. musculus
atgaaaatgaagatga

SEQ ID NO: 368108 - DNA, 17 bp, M. musculus
atgaaaatgaagatttt

SEQ ID NO: 368109 - DNA, 16 bp, M. musculus
atgaaaatgaagccaa

SEQ ID NO: 368110 - DNA, 16 bp, M. musculus
atgaaaatgaagtcat

SEQ ID NO: 368111 - DNA, 16 bp, M. musculus
atgaaaatgaggacat

SEQ ID NO: 368112 - DNA, 16 bp, M. musculus
atgaaaatgatagagg

SEQ ID NO: 368113 - DNA, 16 bp, M. musculus
atgaaaatgtaaattt

SEQ ID NO: 368114 - DNA, 16 bp, M. musculus
atgaaaatgtatttga

SEQ ID NO: 368115 - DNA, 16 bp, M. musculus
atgaaaatgtcataaa

SEQ ID NO: 368116 - DNA, 16 bp, M. musculus
atgaaaatttcaaaaa

SEQ ID NO: 368117 - DNA, 16 bp, M. musculus
atgaaaatttgaattt

SEQ ID NO: 368118 - DNA, 16 bp, M. musculus
atgaaaatttggtttt

SEQ ID NO: 368119 - DNA, 16 bp, M. musculus
atgaaacacaaatggc

SEQ ID NO: 368120 - DNA, 16 bp, M. musculus
atgaaacacatgaaac

SEQ ID NO: 368121 - DNA, 16 bp, M. musculus
atgaaacccaaactaa

SEQ ID NO: 368122 - DNA, 16 bp, M. musculus
atgaaacccaagaaaa

SEQ ID NO: 368123 - DNA, 16 bp, M. musculus
atgaaacccattattt

SEQ ID NO: 368124 - DNA, 16 bp, M. musculus
atgaaaccctaagaca

SEQ ID NO: 368125 - DNA, 16 bp, M. musculus
atgaaactcaagaaga

SEQ ID NO: 368126 - DNA, 17 bp, M. musculus
atgaaactctagaagaa

SEQ ID NO: 368127 - DNA, 16 bp, M. musculus
atgaaactctgtctca

SEQ ID NO: 368128 - DNA, 16 bp, M. musculus
atgaaactgaaaagca

SEQ ID NO: 368129 - DNA, 16 bp, M. musculus
atgaaactgaaaagct

SEQ ID NO: 368130 - DNA, 16 bp, M. musculus
atgaaactgaaaagtt

SEQ ID NO: 368131 - DNA, 16 bp, M. musculus
atgaaactgaacatga

SEQ ID NO: 368132 - DNA, 16 bp, M. musculus
atgaaactgaagaaaa

SEQ ID NO: 368133 - DNA, 16 bp, M. musculus
atgaaactgaagaaga

SEQ ID NO: 368134 - DNA, 17 bp, M. musculus
atgaaactgaagaagaa

SEQ ID NO: 368135 - DNA, 16 bp, M. musculus
atgaaactgaagaagg

SEQ ID NO: 368136 - DNA, 16 bp, M. musculus
atgaaactgaggagag

SEQ ID NO: 368137 - DNA, 16 bp, M. musculus
atgaaagaaatggatt

SEQ ID NO: 368138 - DNA, 16 bp, M. musculus
atgaaagaaatggttt

SEQ ID NO: 368139 - DNA, 16 bp, M. musculus
atgaaagaacttctgg

SEQ ID NO: 368140 - DNA, 16 bp, M. musculus
atgaaagaccctgtct

SEQ ID NO: 368141 - DNA, 16 bp, M. musculus
atgaaagagacagtcc

SEQ ID NO: 368142 - DNA, 16 bp, M. musculus
atgaaagagctagaga

SEQ ID NO: 368143 - DNA, 16 bp, M. musculus
atgaaagcagtgctga

SEQ ID NO: 368144 - DNA, 16 bp, M. musculus
atgaaagcatggacca

SEQ ID NO: 368145 - DNA, 16 bp, M. musculus
atgaaaggagagaact

SEQ ID NO: 368146 - DNA, 16 bp, M. musculus
atgaaaggagttaaag

SEQ ID NO: 368147 - DNA, 16 bp, M. musculus
atgaaagtggggtgtt

SEQ ID NO: 368148 - DNA, 16 bp, M. musculus
atgaaataaagttgtt

SEQ ID NO: 368149 - DNA, 16 bp, M. musculus
atgaaatatgctttta

SEQ ID NO: 368150 - DNA, 16 bp, M. musculus
atgaaatattttcctt

SEQ ID NO: 368151 - DNA, 16 bp, M. musculus
atgaaatattttcttt

SEQ ID NO: 368152 - DNA, 16 bp, M. musculus
atgaaatcatgaactt

SEQ ID NO: 368153 - DNA, 16 bp, M. musculus
atgaaatgaaaatgtt

SEQ ID NO: 368154 - DNA, 16 bp, M. musculus
atgaaatgacagacag

SEQ ID NO: 368155 - DNA, 16 bp, M. musculus
atgaaatgattcctag

SEQ ID NO: 368156 - DNA, 16 bp, M. musculus
atgaaatggacaaatt

SEQ ID NO: 368157 - DNA, 16 bp, M. musculus
atgaaatggacaactt

SEQ ID NO: 368158 - DNA, 16 bp, M. musculus
atgaaatggacatttt

SEQ ID NO: 368159 - DNA, 16 bp, M. musculus
atgaaattaaaaggct

SEQ ID NO: 368160 - DNA, 16 bp, M. musculus
atgaaattcaagaaag

SEQ ID NO: 368161 - DNA, 16 bp, M. musculus
atgaaattcacagaaa

SEQ ID NO: 368162 - DNA, 16 bp, M. musculus
atgaaattcagaaaat

SEQ ID NO: 368163 - DNA, 27 bp, M. musculus
atgaaattcctaggcaaatggatggaa

SEQ ID NO: 368164 - DNA, 16 bp, M. musculus
atgaaattctcaaaca

SEQ ID NO: 368165 - DNA, 19 bp, M. musculus
atgaaattcttaggcaaat

SEQ ID NO: 368166 - DNA, 16 bp, M. musculus
atgaaattcttgaaga

SEQ ID NO: 368167 - DNA, 16 bp, M. musculus
atgaaattgaacaaaa

SEQ ID NO: 368168 - DNA, 16 bp, M. musculus
atgaaattgccaaata

SEQ ID NO: 368169 - DNA, 16 bp, M. musculus
atgaaattgtagatat

SEQ ID NO: 368170 - DNA, 16 bp, M. musculus
atgaaattgtcaaaaa

SEQ ID NO: 368171 - DNA, 16 bp, M. musculus
atgaaatttgcagaaa

SEQ ID NO: 368172 - DNA, 16 bp, M. musculus
atgaaattttaaaaca

SEQ ID NO: 368173 - DNA, 16 bp, M. musculus
atgaaattttaaaatg

SEQ ID NO: 368174 - DNA, 16 bp, M. musculus
atgaaatttttaggca

SEQ ID NO: 368175 - DNA, 16 bp, M. musculus
atgaacaaaatggatt

SEQ ID NO: 368176 - DNA, 16 bp, M. musculus
atgaacaaaatttaaa

SEQ ID NO: 368177 - DNA, 16 bp, M. musculus
atgaacacacacatac

SEQ ID NO: 368178 - DNA, 16 bp, M. musculus
atgaacacacatatgc

SEQ ID NO: 368179 - DNA, 16 bp, M. musculus
atgaacaccatgacca

SEQ ID NO: 368180 - DNA, 16 bp, M. musculus
atgaacactgaattca

SEQ ID NO: 368181 - DNA, 16 bp, M. musculus
atgaacagaaatcaca

SEQ ID NO: 368182 - DNA, 16 bp, M. musculus
atgaacagcattaaag

SEQ ID NO: 368183 - DNA, 18 bp, M. musculus
atgaacatacaagaagcc

SEQ ID NO: 368184 - DNA, 16 bp, M. musculus
atgaacatacaaggag

SEQ ID NO: 368185 - DNA, 16 bp, M. musculus
atgaacatactagaag

SEQ ID NO: 368186 - DNA, 16 bp, M. musculus
atgaacatattaaaaa

SEQ ID NO: 368187 - DNA, 16 bp, M. musculus
atgaacatgggagatc

SEQ ID NO: 368188 - DNA, 16 bp, M. musculus
atgaacatggtacaca

SEQ ID NO: 368189 - DNA, 16 bp, M. musculus
atgaacatgtatatat

SEQ ID NO: 368190 - DNA, 16 bp, M. musculus
atgaacatgtgcacac

SEQ ID NO: 368191 - DNA, 16 bp, M. musculus
atgaacatgtggagag

SEQ ID NO: 368192 - DNA, 16 bp, M. musculus
atgaacatgtggtttt

SEQ ID NO: 368193 - DNA, 16 bp, M. musculus
atgaacattttatttt

SEQ ID NO: 368194 - DNA, 16 bp, M. musculus
atgaacccacgcacct

SEQ ID NO: 368195 - DNA, 16 bp, M. musculus
atgaacccccacacct

SEQ ID NO: 368196 - DNA, 22 bp, M. musculus
atgaactaaccagtacccccca

SEQ ID NO: 368197 - DNA, 16 bp, M. musculus
atgaactcacaaagac

SEQ ID NO: 368198 - DNA, 16 bp, M. musculus
atgaacttaggcagca

SEQ ID NO: 368199 - DNA, 16 bp, M. musculus
atgaacttgcctctta

SEQ ID NO: 368200 - DNA, 16 bp, M. musculus
atgaacttttaaaaaa

SEQ ID NO: 368201 - DNA, 16 bp, M. musculus
atgaagaaaaatatct

SEQ ID NO: 368202 - DNA, 16 bp, M. musculus
atgaagaaaacccaaa

SEQ ID NO: 368203 - DNA, 16 bp, M. musculus
atgaagaaaatatcaa

SEQ ID NO: 368204 - DNA, 16 bp, M. musculus
atgaagaaaatgaatt

SEQ ID NO: 368205 - DNA, 16 bp, M. musculus
atgaagaaaatgcccc

SEQ ID NO: 368206 - DNA, 16 bp, M. musculus
atgaagaaaatgtggt

SEQ ID NO: 368207 - DNA, 16 bp, M. musculus
atgaagaaacagaaca

SEQ ID NO: 368208 - DNA, 16 bp, M. musculus
atgaagaaacaggaga

SEQ ID NO: 368209 - DNA, 16 bp, M. musculus
atgaagaaaccaaaat

SEQ ID NO: 368210 - DNA, 16 bp, M. musculus
atgaagaaactgaggc

SEQ ID NO: 368211 - DNA, 16 bp, M. musculus
atgaagaaagcctatg

SEQ ID NO: 368212 - DNA, 16 bp, M. musculus
atgaagaaatattttt

SEQ ID NO: 368213 - DNA, 16 bp, M. musculus
atgaagaacaagctgt

SEQ ID NO: 368214 - DNA, 16 bp, M. musculus
atgaagaacacacaca

SEQ ID NO: 368215 - DNA, 16 bp, M. musculus
atgaagaagccagaga

SEQ ID NO: 368216 - DNA, 16 bp, M. musculus
atgaagaagctgatct

SEQ ID NO: 368217 - DNA, 16 bp, M. musculus
atgaagaagttagaga

SEQ ID NO: 368218 - DNA, 16 bp, M. musculus
atgaagaatgaagact

SEQ ID NO: 368219 - DNA, 16 bp, M. musculus
atgaagacaaaagtgt

SEQ ID NO: 368220 - DNA, 20 bp, M. musculus
atgaagacagctacagtgta

SEQ ID NO: 368221 - DNA, 16 bp, M. musculus
atgaagacagtgacag

SEQ ID NO: 368222 - DNA, 16 bp, M. musculus
atgaagacattccatt

SEQ ID NO: 368223 - DNA, 16 bp, M. musculus
atgaagaccaggctgg

SEQ ID NO: 368224 - DNA, 16 bp, M. musculus
atgaagagaaactcaa

SEQ ID NO: 368225 - DNA, 16 bp, M. musculus
atgaagagaaacttaa

SEQ ID NO: 368226 - DNA, 16 bp, M. musculus
atgaagagaaatttga

SEQ ID NO: 368227 - DNA, 16 bp, M. musculus
atgaagagaagaaaca

SEQ ID NO: 368228 - DNA, 16 bp, M. musculus
atgaagagaggcagaa

SEQ ID NO: 368229 - DNA, 16 bp, M. musculus
atgaagagcaactgag

SEQ ID NO: 368230 - DNA, 16 bp, M. musculus
atgaagagcaatgtgg

SEQ ID NO: 368231 - DNA, 16 bp, M. musculus
atgaagagctgtggca

SEQ ID NO: 368232 - DNA, 16 bp, M. musculus
atgaagaggaagaccc

SEQ ID NO: 368233 - DNA, 16 bp, M. musculus
atgaagaggaagatga

SEQ ID NO: 368234 - DNA, 16 bp, M. musculus
atgaagaggtgttgaa

SEQ ID NO: 368235 - DNA, 16 bp, M. musculus
atgaagataaacaagg

SEQ ID NO: 368236 - DNA, 16 bp, M. musculus
atgaagataatggact

SEQ ID NO: 368237 - DNA, 16 bp, M. musculus
atgaagatgaactctc

SEQ ID NO: 368238 - DNA, 16 bp, M. musculus
atgaagatggagaact

SEQ ID NO: 368239 - DNA, 16 bp, M. musculus
atgaagatgggttcta

SEQ ID NO: 368240 - DNA, 16 bp, M. musculus
atgaagatgtagagct

SEQ ID NO: 368241 - DNA, 16 bp, M. musculus
atgaagatttgggaaa

SEQ ID NO: 368242 - DNA, 16 bp, M. musculus
atgaagattttcaacc

SEQ ID NO: 368243 - DNA, 16 bp, M. musculus
atgaagattttcaagt

SEQ ID NO: 368244 - DNA, 16 bp, M. musculus
atgaagcagaagatgg

SEQ ID NO: 368245 - DNA, 16 bp, M. musculus
atgaagcagaggcagg

SEQ ID NO: 368246 - DNA, 16 bp, M. musculus
atgaagcagctctctg

SEQ ID NO: 368247 - DNA, 16 bp, M. musculus
atgaagcagctggtca

SEQ ID NO: 368248 - DNA, 16 bp, M. musculus
atgaagcatggcagca

SEQ ID NO: 368249 - DNA, 16 bp, M. musculus
atgaagccaagcagag

SEQ ID NO: 368250 - DNA, 16 bp, M. musculus
atgaagccattgtttt

SEQ ID NO: 368251 - DNA, 16 bp, M. musculus
atgaagcccaggctgg

SEQ ID NO: 368252 - DNA, 16 bp, M. musculus
atgaagccctgtctca

SEQ ID NO: 368253 - DNA, 16 bp, M. musculus
atgaagcctacttggt

SEQ ID NO: 368254 - DNA, 16 bp, M. musculus
atgaagcctgcttgat

SEQ ID NO: 368255 - DNA, 16 bp, M. musculus
atgaagcctttcagga

SEQ ID NO: 368256 - DNA, 16 bp, M. musculus
atgaagctcaagaaag

SEQ ID NO: 368257 - DNA, 16 bp, M. musculus
atgaagctcaagaaga

SEQ ID NO: 368258 - DNA, 16 bp, M. musculus
atgaagctcaagagaa

SEQ ID NO: 368259 - DNA, 16 bp, M. musculus
atgaagctcctgacac

SEQ ID NO: 368260 - DNA, 16 bp, M. musculus
atgaagctgaaaagct

SEQ ID NO: 368261 - DNA, 16 bp, M. musculus
atgaagctgaagaaga

SEQ ID NO: 368262 - DNA, 16 bp, M. musculus
atgaagcttctcagga

SEQ ID NO: 368263 - DNA, 16 bp, M. musculus
atgaaggagacagaga

SEQ ID NO: 368264 - DNA, 16 bp, M. musculus
atgaaggagggagtga

SEQ ID NO: 368265 - DNA, 16 bp, M. musculus
atgaaggaggtagaga

SEQ ID NO: 368266 - DNA, 16 bp, M. musculus
atgaaggattctttgc

SEQ ID NO: 368267 - DNA, 16 bp, M. musculus
atgaaggcacaatata

SEQ ID NO: 368268 - DNA, 23 bp, M. musculus
atgaaggcatctaatgttataaa

SEQ ID NO: 368269 - DNA, 16 bp, M. musculus
atgaaggccagaagag

SEQ ID NO: 368270 - DNA, 16 bp, M. musculus
atgaaggccagaggtt

SEQ ID NO: 368271 - DNA, 16 bp, M. musculus
atgaaggctcacaact

SEQ ID NO: 368272 - DNA, 16 bp, M. musculus
atgaaggtgcagcctc

SEQ ID NO: 368273 - DNA, 16 bp, M. musculus
atgaagtagaaacaaa

SEQ ID NO: 368274 - DNA, 16 bp, M. musculus
atgaagtatccctcct

SEQ ID NO: 368275 - DNA, 16 bp, M. musculus
atgaagtcactgtttt

SEQ ID NO: 368276 - DNA, 16 bp, M. musculus
atgaagtcatgaaatt

SEQ ID NO: 368277 - DNA, 16 bp, M. musculus
atgaagtctcatttgt

SEQ ID NO: 368278 - DNA, 17 bp, M. musculus
atgaagtgcccctcctt

SEQ ID NO: 368279 - DNA, 16 bp, M. musculus
atgaagtgcttgctga

SEQ ID NO: 368280 - DNA, 16 bp, M. musculus
atgaagtgtttaattt

SEQ ID NO: 368281 - DNA, 16 bp, M. musculus
atgaagttgaaaatta

SEQ ID NO: 368282 - DNA, 16 bp, M. musculus
atgaagttgtctcctg

SEQ ID NO: 368283 - DNA, 16 bp, M. musculus
atgaagtttgcaagtc

SEQ ID NO: 368284 - DNA, 16 bp, M. musculus
atgaataaacaaaatg

SEQ ID NO: 368285 - DNA, 16 bp, M. musculus
atgaataaataaagca

SEQ ID NO: 368286 - DNA, 16 bp, M. musculus
atgaataagaaactaa

SEQ ID NO: 368287 - DNA, 16 bp, M. musculus
atgaatacattttaat

SEQ ID NO: 368288 - DNA, 16 bp, M. musculus
atgaatactcaccaca

SEQ ID NO: 368289 - DNA, 16 bp, M. musculus
atgaatatgatcaaaa

SEQ ID NO: 368290 - DNA, 16 bp, M. musculus
atgaatattttaatga

SEQ ID NO: 368291 - DNA, 16 bp, M. musculus
atgaatcagaagatga

SEQ ID NO: 368292 - DNA, 16 bp, M. musculus
atgaatcagcagctgc

SEQ ID NO: 368293 - DNA, 16 bp, M. musculus
atgaatcatttgaaag

SEQ ID NO: 368294 - DNA, 17 bp, M. musculus
atgaatccccgggtatg

SEQ ID NO: 368295 - DNA, 16 bp, M. musculus
atgaatctgaaagaga

SEQ ID NO: 368296 - DNA, 16 bp, M. musculus
atgaatctgaggccag

SEQ ID NO: 368297 - DNA, 16 bp, M. musculus
atgaatgaagaaaaca

SEQ ID NO: 368298 - DNA, 16 bp, M. musculus
atgaatgaataaatga

SEQ ID NO: 368299 - DNA, 16 bp, M. musculus
atgaatgaatctgaat

SEQ ID NO: 368300 - DNA, 16 bp, M. musculus
atgaatgaatgaacca

SEQ ID NO: 368301 - DNA, 16 bp, M. musculus
atgaatgaatgaagaa

SEQ ID NO: 368302 - DNA, 16 bp, M. musculus
atgaatgaatgaatat

SEQ ID NO: 368303 - DNA, 16 bp, M. musculus
atgaatgaatgaatct

SEQ ID NO: 368304 - DNA, 16 bp, M. musculus
atgaatgagtgggtgg

SEQ ID NO: 368305 - DNA, 16 bp, M. musculus
atgaatgcatacatgt

SEQ ID NO: 368306 - DNA, 16 bp, M. musculus
atgaatgcttctattt

SEQ ID NO: 368307 - DNA, 17 bp, M. musculus
atgaatggaaatataca

SEQ ID NO: 368308 - DNA, 16 bp, M. musculus
atgaatggctgagaag

SEQ ID NO: 368309 - DNA, 17 bp, M. musculus
atgaatgggtgttggat

SEQ ID NO: 368310 - DNA, 16 bp, M. musculus
atgaatgtatgaatgt

SEQ ID NO: 368311 - DNA, 16 bp, M. musculus
atgaatgtgcaccaca

SEQ ID NO: 368312 - DNA, 16 bp, M. musculus
atgaatgtgtgtgcat

SEQ ID NO: 368313 - DNA, 16 bp, M. musculus
atgaatgtgtgtgtgc

SEQ ID NO: 368314 - DNA, 16 bp, M. musculus
atgaatgttttgcctg

SEQ ID NO: 368315 - DNA, 16 bp, M. musculus
atgaattcagaaaatg

SEQ ID NO: 368316 - DNA, 16 bp, M. musculus
atgaattcccatttta

SEQ ID NO: 368317 - DNA, 16 bp, M. musculus
atgaattgtattaaaa

SEQ ID NO: 368318 - DNA, 16 bp, M. musculus
atgaatttattcattt

SEQ ID NO: 368319 - DNA, 16 bp, M. musculus
atgaatttgaaaaaga

SEQ ID NO: 368320 - DNA, 16 bp, M. musculus
atgaatttgaaaagaa

SEQ ID NO: 368321 - DNA, 16 bp, M. musculus
atgaatttgaaaatga

SEQ ID NO: 368322 - DNA, 16 bp, M. musculus
atgaatttgaaagaga

SEQ ID NO: 368323 - DNA, 16 bp, M. musculus
atgaatttgaagattg

SEQ ID NO: 368324 - DNA, 16 bp, M. musculus
atgaatttgagaagga

SEQ ID NO: 368325 - DNA, 16 bp, M. musculus
atgaatttgcaaatta

SEQ ID NO: 368326 - DNA, 16 bp, M. musculus
atgaatttgcaatttg

SEQ ID NO: 368327 - DNA, 16 bp, M. musculus
atgacaaaaatttcaa

SEQ ID NO: 368328 - DNA, 16 bp, M. musculus
atgacaaaatatattt

SEQ ID NO: 368329 - DNA, 16 bp, M. musculus
atgacaaaattgttga

SEQ ID NO: 368330 - DNA, 16 bp, M. musculus
atgacaaagactctga

SEQ ID NO: 368331 - DNA, 16 bp, M. musculus
atgacaaagggcaaca

SEQ ID NO: 368332 - DNA, 16 bp, M. musculus
atgacaagaagtgctt

SEQ ID NO: 368333 - DNA, 16 bp, M. musculus
atgacaagcagcccta

SEQ ID NO: 368334 - DNA, 16 bp, M. musculus
atgacaaggacttaag

SEQ ID NO: 368335 - DNA, 16 bp, M. musculus
atgacaataatgaact

SEQ ID NO: 368336 - DNA, 16 bp, M. musculus
atgacaattttaaaaa

SEQ ID NO: 368337 - DNA, 16 bp, M. musculus
atgacacacctcctcc

SEQ ID NO: 368338 - DNA, 16 bp, M. musculus
atgacacagactccag

SEQ ID NO: 368339 - DNA, 16 bp, M. musculus
atgacacagactctgg

SEQ ID NO: 368340 - DNA, 16 bp, M. musculus
atgacacagtaggtgt

SEQ ID NO: 368341 - DNA, 16 bp, M. musculus
atgacagacagaagca

SEQ ID NO: 368342 - DNA, 16 bp, M. musculus
atgacagacagatgca

SEQ ID NO: 368343 - DNA, 16 bp, M. musculus
atgacagcagatactg

SEQ ID NO: 368344 - DNA, 16 bp, M. musculus
atgacaggaggaattt

SEQ ID NO: 368345 - DNA, 16 bp, M. musculus
atgacagtgatgatga

SEQ ID NO: 368346 - DNA, 16 bp, M. musculus
atgacagtggactgaa

SEQ ID NO: 368347 - DNA, 16 bp, M. musculus
atgacagtgtccaggc

SEQ ID NO: 368348 - DNA, 16 bp, M. musculus
atgacataatttcatt

SEQ ID NO: 368349 - DNA, 16 bp, M. musculus
atgacatagactaaca

SEQ ID NO: 368350 - DNA, 16 bp, M. musculus
atgacatcacataggc

SEQ ID NO: 368351 - DNA, 16 bp, M. musculus
atgacatcagtaatag

SEQ ID NO: 368352 - DNA, 16 bp, M. musculus
atgacatcatgaaaat

SEQ ID NO: 368353 - DNA, 16 bp, M. musculus
atgacatgaacttcaa

SEQ ID NO: 368354 - DNA, 16 bp, M. musculus
atgacatgatcatctc

SEQ ID NO: 368355 - DNA, 16 bp, M. musculus
atgacattcctaggca

SEQ ID NO: 368356 - DNA, 16 bp, M. musculus
atgacatttgcagaaa

SEQ ID NO: 368357 - DNA, 16 bp, M. musculus
atgacatttgctgaaa

SEQ ID NO: 368358 - DNA, 16 bp, M. musculus
atgacattttcataca

SEQ ID NO: 368359 - DNA, 16 bp, M. musculus
atgacattttcatata

SEQ ID NO: 368360 - DNA, 16 bp, M. musculus
atgaccaaaagcaacg

SEQ ID NO: 368361 - DNA, 16 bp, M. musculus
atgaccaaagcaactc

SEQ ID NO: 368362 - DNA, 17 bp, M. musculus
atgaccaagaagcaaga

SEQ ID NO: 368363 - DNA, 16 bp, M. musculus
atgaccaaggaaattc

SEQ ID NO: 368364 - DNA, 16 bp, M. musculus
atgaccaaggcacctt

SEQ ID NO: 368365 - DNA, 16 bp, M. musculus
atgaccaatgcaactt

SEQ ID NO: 368366 - DNA, 16 bp, M. musculus
atgaccacagcagctc

SEQ ID NO: 368367 - DNA, 16 bp, M. musculus
atgaccagcaaagagt

SEQ ID NO: 368368 - DNA, 16 bp, M. musculus
atgaccagcatggcag

SEQ ID NO: 368369 - DNA, 16 bp, M. musculus
atgaccaggaagcaag

SEQ ID NO: 368370 - DNA, 16 bp, M. musculus
atgaccaggacaactc

SEQ ID NO: 368371 - DNA, 16 bp, M. musculus
atgaccataggtatgt

SEQ ID NO: 368372 - DNA, 16 bp, M. musculus
atgaccatattaacta

SEQ ID NO: 368373 - DNA, 16 bp, M. musculus
atgacccaatataata

SEQ ID NO: 368374 - DNA, 16 bp, M. musculus
atgacccacagaatca

SEQ ID NO: 368375 - DNA, 16 bp, M. musculus
atgacccacagtttga

SEQ ID NO: 368376 - DNA, 16 bp, M. musculus
atgacccagcagaccc

SEQ ID NO: 368377 - DNA, 16 bp, M. musculus
atgaccccaaccataa

SEQ ID NO: 368378 - DNA, 16 bp, M. musculus
atgaccccacccccac

SEQ ID NO: 368379 - DNA, 16 bp, M. musculus
atgaccccagccagtt

SEQ ID NO: 368380 - DNA, 16 bp, M. musculus
atgaccccttcatgtc

SEQ ID NO: 368381 - DNA, 16 bp, M. musculus
atgaccctcaacagaa

SEQ ID NO: 368382 - DNA, 16 bp, M. musculus
atgaccctgctctgag

SEQ ID NO: 368383 - DNA, 16 bp, M. musculus
atgaccctttcagagg

SEQ ID NO: 368384 - DNA, 18 bp, M. musculus
atgacctctcagatagac

SEQ ID NO: 368385 - DNA, 16 bp, M. musculus
atgacctctgacctct

SEQ ID NO: 368386 - DNA, 16 bp, M. musculus
atgacctctgtccagg

SEQ ID NO: 368387 - DNA, 16 bp, M. musculus
atgacctgagttcaat

SEQ ID NO: 368388 - DNA, 16 bp, M. musculus
atgacctgagttcagt

SEQ ID NO: 368389 - DNA, 16 bp, M. musculus
atgacctgtctgttgg

SEQ ID NO: 368390 - DNA, 16 bp, M. musculus
atgacctgttcattgg

SEQ ID NO: 368391 - DNA, 16 bp, M. musculus
atgacctgttctgtgg

SEQ ID NO: 368392 - DNA, 16 bp, M. musculus
atgacctgtttgtcca

SEQ ID NO: 368393 - DNA, 16 bp, M. musculus
atgaccttgaagctga

SEQ ID NO: 368394 - DNA, 16 bp, M. musculus
atgacgacgacgacaa

SEQ ID NO: 368395 - DNA, 17 bp, M. musculus
atgacgacgacgacgat

SEQ ID NO: 368396 - DNA, 16 bp, M. musculus
atgacgatgacaatga

SEQ ID NO: 368397 - DNA, 16 bp, M. musculus
atgacgatgacgatga

SEQ ID NO: 368398 - DNA, 16 bp, M. musculus
atgactaaggacactg

SEQ ID NO: 368399 - DNA, 16 bp, M. musculus
atgactaaggcaactt

SEQ ID NO: 368400 - DNA, 16 bp, M. musculus
atgactaattttacta

SEQ ID NO: 368401 - DNA, 16 bp, M. musculus
atgactatgactatga

SEQ ID NO: 368402 - DNA, 16 bp, M. musculus
atgactattccagctt

SEQ ID NO: 368403 - DNA, 16 bp, M. musculus
atgactattcctggtt

SEQ ID NO: 368404 - DNA, 16 bp, M. musculus
atgactattttattcc

SEQ ID NO: 368405 - DNA, 16 bp, M. musculus
atgactcaactcacca

SEQ ID NO: 368406 - DNA, 16 bp, M. musculus
atgactcaatgggtaa

SEQ ID NO: 368407 - DNA, 16 bp, M. musculus
atgactcagcaggtaa

SEQ ID NO: 368408 - DNA, 16 bp, M. musculus
atgactcagtgggtaa

SEQ ID NO: 368409 - DNA, 16 bp, M. musculus
atgactccagctgtat

SEQ ID NO: 368410 - DNA, 16 bp, M. musculus
atgactcggtgggtaa

SEQ ID NO: 368411 - DNA, 16 bp, M. musculus
atgactctagtttgtg

SEQ ID NO: 368412 - DNA, 16 bp, M. musculus
atgactctattgtctc

SEQ ID NO: 368413 - DNA, 16 bp, M. musculus
atgactctgagactaa

SEQ ID NO: 368414 - DNA, 16 bp, M. musculus
atgactctgtgggtaa

SEQ ID NO: 368415 - DNA, 16 bp, M. musculus
atgactgccagcagct

SEQ ID NO: 368416 - DNA, 16 bp, M. musculus
atgactgctctccaaa

SEQ ID NO: 368417 - DNA, 16 bp, M. musculus
atgactgcttctattc

SEQ ID NO: 368418 - DNA, 16 bp, M. musculus
atgactgcttttcagt

SEQ ID NO: 368419 - DNA, 16 bp, M. musculus
atgactggagagatgg

SEQ ID NO: 368420 - DNA, 17 bp, M. musculus
atgactgtgagcatcca

SEQ ID NO: 368421 - DNA, 16 bp, M. musculus
atgacttccaaggaca

SEQ ID NO: 368422 - DNA, 16 bp, M. musculus
atgacttcttgaaatt

SEQ ID NO: 368423 - DNA, 16 bp, M. musculus
atgactttgaacattt

SEQ ID NO: 368424 - DNA, 16 bp, M. musculus
atgactttgtgaaatt

SEQ ID NO: 368425 - DNA, 16 bp, M. musculus
atgactttttaaaatg

SEQ ID NO: 368426 - DNA, 16 bp, M. musculus
atgagaaaagtaatga

SEQ ID NO: 368427 - DNA, 16 bp, M. musculus
atgagaaactgtggga

SEQ ID NO: 368428 - DNA, 16 bp, M. musculus
atgagaaagaacatgt

SEQ ID NO: 368429 - DNA, 16 bp, M. musculus
atgagaacagactgaa

SEQ ID NO: 368430 - DNA, 16 bp, M. musculus
atgagaacatcatgaa

SEQ ID NO: 368431 - DNA, 16 bp, M. musculus
atgagaacttgagttt

SEQ ID NO: 368432 - DNA, 16 bp, M. musculus
atgagaagacctggga

SEQ ID NO: 368433 - DNA, 16 bp, M. musculus
atgagaagcagagaga

SEQ ID NO: 368434 - DNA, 16 bp, M. musculus
atgagaaggcattggt

SEQ ID NO: 368435 - DNA, 16 bp, M. musculus
atgagaagtacctgct

SEQ ID NO: 368436 - DNA, 16 bp, M. musculus
atgagaagtgactttg

SEQ ID NO: 368437 - DNA, 16 bp, M. musculus
atgagaataattttat

SEQ ID NO: 368438 - DNA, 16 bp, M. musculus
atgagaatgaagtgtc

SEQ ID NO: 368439 - DNA, 16 bp, M. musculus
atgagacacaggagga

SEQ ID NO: 368440 - DNA, 16 bp, M. musculus
atgagaccccatctca

SEQ ID NO: 368441 - DNA, 16 bp, M. musculus
atgagaccctgcctca

SEQ ID NO: 368442 - DNA, 16 bp, M. musculus
atgagaccctgtctcc

SEQ ID NO: 368443 - DNA, 16 bp, M. musculus
atgagacctgtctcaa

SEQ ID NO: 368444 - DNA, 16 bp, M. musculus
atgagactggagagat

SEQ ID NO: 368445 - DNA, 16 bp, M. musculus
atgagactttatctca

SEQ ID NO: 368446 - DNA, 16 bp, M. musculus
atgagactttgtctca

SEQ ID NO: 368447 - DNA, 16 bp, M. musculus
atgagagaaaacatga

SEQ ID NO: 368448 - DNA, 16 bp, M. musculus
atgagagaagtgagag

SEQ ID NO: 368449 - DNA, 16 bp, M. musculus
atgagagaccctgtct

SEQ ID NO: 368450 - DNA, 16 bp, M. musculus
atgagagactgtctca

SEQ ID NO: 368451 - DNA, 16 bp, M. musculus
atgagagccagaagat

SEQ ID NO: 368452 - DNA, 16 bp, M. musculus
atgagagtggccccca

SEQ ID NO: 368453 - DNA, 16 bp, M. musculus
atgagatattttctat

SEQ ID NO: 368454 - DNA, 16 bp, M. musculus
atgagatcatcatgtg

SEQ ID NO: 368455 - DNA, 16 bp, M. musculus
atgagatctgatgccc

SEQ ID NO: 368456 - DNA, 16 bp, M. musculus
atgagatcttctttga

SEQ ID NO: 368457 - DNA, 16 bp, M. musculus
atgagatgatcatgtg

SEQ ID NO: 368458 - DNA, 16 bp, M. musculus
atgagatgctgagaaa

SEQ ID NO: 368459 - DNA, 16 bp, M. musculus
atgagatgtaatttta

SEQ ID NO: 368460 - DNA, 16 bp, M. musculus
atgagattagatgaga

SEQ ID NO: 368461 - DNA, 16 bp, M. musculus
atgagattcagctgta

SEQ ID NO: 368462 - DNA, 16 bp, M. musculus
atgagattctcaaaga

SEQ ID NO: 368463 - DNA, 16 bp, M. musculus
atgagattctgtctca

SEQ ID NO: 368464 - DNA, 16 bp, M. musculus
atgagcaaggccctgg

SEQ ID NO: 368465 - DNA, 16 bp, M. musculus
atgagcagaccttgag

SEQ ID NO: 368466 - DNA, 16 bp, M. musculus
atgagcagcagtgtgg

SEQ ID NO: 368467 - DNA, 16 bp, M. musculus
atgagcaggagagagc

SEQ ID NO: 368468 - DNA, 21 bp, M. musculus
atgagccaccatgtggttgct

SEQ ID NO: 368469 - DNA, 16 bp, M. musculus
atgagcctatgggacc

SEQ ID NO: 368470 - DNA, 16 bp, M. musculus
atgagcctgaggaaaa

SEQ ID NO: 368471 - DNA, 16 bp, M. musculus
atgagcctgtggggac

SEQ ID NO: 368472 - DNA, 16 bp, M. musculus
atgagccttcatgtgg

SEQ ID NO: 368473 - DNA, 16 bp, M. musculus
atgagcctttggggga

SEQ ID NO: 368474 - DNA, 16 bp, M. musculus
atgagctctcaattct

SEQ ID NO: 368475 - DNA, 16 bp, M. musculus
atgagctgaggcagaa

SEQ ID NO: 368476 - DNA, 16 bp, M. musculus
atgagctggagaagtt

SEQ ID NO: 368477 - DNA, 16 bp, M. musculus
atgagctggccagcac

SEQ ID NO: 368478 - DNA, 16 bp, M. musculus
atgagctgggccctcc

SEQ ID NO: 368479 - DNA, 16 bp, M. musculus
atgaggaaacctcagt

SEQ ID NO: 368480 - DNA, 16 bp, M. musculus
atgaggaaactgaggc

SEQ ID NO: 368481 - DNA, 16 bp, M. musculus
atgaggaaatccaaaa

SEQ ID NO: 368482 - DNA, 16 bp, M. musculus
atgaggaactgtattt

SEQ ID NO: 368483 - DNA, 16 bp, M. musculus
atgaggaagaatatga

SEQ ID NO: 368484 - DNA, 16 bp, M. musculus
atgaggacctgagctc

SEQ ID NO: 368485 - DNA, 16 bp, M. musculus
atgaggacctgagttc

SEQ ID NO: 368486 - DNA, 16 bp, M. musculus
atgaggagctggagag

SEQ ID NO: 368487 - DNA, 16 bp, M. musculus
atgaggaggatgagga

SEQ ID NO: 368488 - DNA, 16 bp, M. musculus
atgaggagggtggtga

SEQ ID NO: 368489 - DNA, 16 bp, M. musculus
atgaggatgaagattt

SEQ ID NO: 368490 - DNA, 16 bp, M. musculus
atgaggatgaggagga

SEQ ID NO: 368491 - DNA, 16 bp, M. musculus
atgaggatgcttcccc

SEQ ID NO: 368492 - DNA, 16 bp, M. musculus
atgaggatgtgtgtgt

SEQ ID NO: 368493 - DNA, 16 bp, M. musculus
atgaggcagaggcagg

SEQ ID NO: 368494 - DNA, 16 bp, M. musculus
atgaggccaggcagag

SEQ ID NO: 368495 - DNA, 16 bp, M. musculus
atgaggccccacccct

SEQ ID NO: 368496 - DNA, 16 bp, M. musculus
atgaggccctaggttc

SEQ ID NO: 368497 - DNA, 16 bp, M. musculus
atgaggccctgggttc

SEQ ID NO: 368498 - DNA, 16 bp, M. musculus
atgaggccctgtctca

SEQ ID NO: 368499 - DNA, 17 bp, M. musculus
atgaggccttctccaaa

SEQ ID NO: 368500 - DNA, 16 bp, M. musculus
atgaggcttttttttt

SEQ ID NO: 368501 - DNA, 16 bp, M. musculus
atgagggaaaaaaatc

SEQ ID NO: 368502 - DNA, 16 bp, M. musculus
atgagggagggcccag

SEQ ID NO: 368503 - DNA, 16 bp, M. musculus
atgagggcagatagta

SEQ ID NO: 368504 - DNA, 16 bp, M. musculus
atgagggccttaaagc

SEQ ID NO: 368505 - DNA, 16 bp, M. musculus
atgagggctggagaga

SEQ ID NO: 368506 - DNA, 16 bp, M. musculus
atgaggtcctgtctca

SEQ ID NO: 368507 - DNA, 16 bp, M. musculus
atgaggtgaagaactc

SEQ ID NO: 368508 - DNA, 16 bp, M. musculus
atgaggtggtgagaag

SEQ ID NO: 368509 - DNA, 16 bp, M. musculus
atgaggtgtgtgtgtg

SEQ ID NO: 368510 - DNA, 16 bp, M. musculus
atgaggtttttaaaaa

SEQ ID NO: 368511 - DNA, 16 bp, M. musculus
atgagtacactgcagc

SEQ ID NO: 368512 - DNA, 16 bp, M. musculus
atgagtacactgtggc

SEQ ID NO: 368513 - DNA, 16 bp, M. musculus
atgagtacatatcatg

SEQ ID NO: 368514 - DNA, 17 bp, M. musculus
atgagtaccctgtagct

SEQ ID NO: 368515 - DNA, 16 bp, M. musculus
atgagtacctgggcag

SEQ ID NO: 368516 - DNA, 16 bp, M. musculus
atgagtatactgtagt

SEQ ID NO: 368517 - DNA, 16 bp, M. musculus
atgagtatgaagtgtt

SEQ ID NO: 368518 - DNA, 16 bp, M. musculus
atgagtatgagtgtgt

SEQ ID NO: 368519 - DNA, 16 bp, M. musculus
atgagtcccaccatgt

SEQ ID NO: 368520 - DNA, 16 bp, M. musculus
atgagtcccactatgt

SEQ ID NO: 368521 - DNA, 16 bp, M. musculus
atgagtctgaggccag

SEQ ID NO: 368522 - DNA, 16 bp, M. musculus
atgagtgagtgggtgg

SEQ ID NO: 368523 - DNA, 16 bp, M. musculus
atgagtgcaggtgccc

SEQ ID NO: 368524 - DNA, 16 bp, M. musculus
atgagtgcatgtgtgt

SEQ ID NO: 368525 - DNA, 16 bp, M. musculus
atgagtgctctatctg

SEQ ID NO: 368526 - DNA, 16 bp, M. musculus
atgagtgtgcctgtgt

SEQ ID NO: 368527 - DNA, 16 bp, M. musculus
atgagtgtgtgtgagt

SEQ ID NO: 368528 - DNA, 16 bp, M. musculus
atgagtgtttgcctgc

SEQ ID NO: 368529 - DNA, 16 bp, M. musculus
atgagtgttttgcctg

SEQ ID NO: 368530 - DNA, 16 bp, M. musculus
atgagttacaggacag

SEQ ID NO: 368531 - DNA, 16 bp, M. musculus
atgagttattaaagtc

SEQ ID NO: 368532 - DNA, 16 bp, M. musculus
atgagttcaaggacag

SEQ ID NO: 368533 - DNA, 16 bp, M. musculus
atgagttcaaggccaa

SEQ ID NO: 368534 - DNA, 16 bp, M. musculus
atgagttcaaggtcag

SEQ ID NO: 368535 - DNA, 16 bp, M. musculus
atgagttcaattccca

SEQ ID NO: 368536 - DNA, 16 bp, M. musculus
atgagttccaggacag

SEQ ID NO: 368537 - DNA, 19 bp, M. musculus
atgagttcgaggccagcct

SEQ ID NO: 368538 - DNA, 16 bp, M. musculus
atgagtttgaagccat

SEQ ID NO: 368539 - DNA, 16 bp, M. musculus
atgagtttgaagctag

SEQ ID NO: 368540 - DNA, 16 bp, M. musculus
atgagtttgaggacag

SEQ ID NO: 368541 - DNA, 21 bp, M. musculus
atgagtttgaggccagcctgg

SEQ ID NO: 368542 - DNA, 16 bp, M. musculus
atgagtttgaggctag

SEQ ID NO: 368543 - DNA, 16 bp, M. musculus
atgagtttgagtccag

SEQ ID NO: 368544 - DNA, 16 bp, M. musculus
atgataaaaacaatct

SEQ ID NO: 368545 - DNA, 16 bp, M. musculus
atgataaaaacatcaa

SEQ ID NO: 368546 - DNA, 16 bp, M. musculus
atgataaaagttttgg

SEQ ID NO: 368547 - DNA, 16 bp, M. musculus
atgataaaatattctg

SEQ ID NO: 368548 - DNA, 16 bp, M. musculus
atgataaacaggctga

SEQ ID NO: 368549 - DNA, 16 bp, M. musculus
atgataaagttgatga

SEQ ID NO: 368550 - DNA, 16 bp, M. musculus
atgataaccaccagtt

SEQ ID NO: 368551 - DNA, 16 bp, M. musculus
atgataatgacaatga

SEQ ID NO: 368552 - DNA, 26 bp, M. musculus
atgataatgaggttctgtaaggtact

SEQ ID NO: 368553 - DNA, 16 bp, M. musculus
atgataatgataacaa

SEQ ID NO: 368554 - DNA, 16 bp, M. musculus
atgataatggaatgaa

SEQ ID NO: 368555 - DNA, 16 bp, M. musculus
atgataatggactgac

SEQ ID NO: 368556 - DNA, 17 bp, M. musculus
atgatacctttgtcaag

SEQ ID NO: 368557 - DNA, 16 bp, M. musculus
atgatagaagtcttta

SEQ ID NO: 368558 - DNA, 16 bp, M. musculus
atgatagagaacttca

SEQ ID NO: 368559 - DNA, 16 bp, M. musculus
atgatagagatagaga

SEQ ID NO: 368560 - DNA, 16 bp, M. musculus
atgatagcaaaaactc

SEQ ID NO: 368561 - DNA, 16 bp, M. musculus
atgatagctgatgaag

SEQ ID NO: 368562 - DNA, 17 bp, M. musculus
atgatagggcagcagcc

SEQ ID NO: 368563 - DNA, 16 bp, M. musculus
atgatagtatatttaa

SEQ ID NO: 368564 - DNA, 16 bp, M. musculus
atgatagtgaggaaag

SEQ ID NO: 368565 - DNA, 16 bp, M. musculus
atgatagtttatataa

SEQ ID NO: 368566 - DNA, 16 bp, M. musculus
atgatatcccacttcc

SEQ ID NO: 368567 - DNA, 16 bp, M. musculus
atgatatcctcaagat

SEQ ID NO: 368568 - DNA, 16 bp, M. musculus
atgatatcctccagat

SEQ ID NO: 368569 - DNA, 16 bp, M. musculus
atgatattttctaatt

SEQ ID NO: 368570 - DNA, 16 bp, M. musculus
atgatattttctagtt

SEQ ID NO: 368571 - DNA, 16 bp, M. musculus
atgatcaaacaccttc

SEQ ID NO: 368572 - DNA, 16 bp, M. musculus
atgatcaactcattag

SEQ ID NO: 368573 - DNA, 16 bp, M. musculus
atgatcaagtagcctt

SEQ ID NO: 368574 - DNA, 16 bp, M. musculus
atgatcaagtagtctt

SEQ ID NO: 368575 - DNA, 16 bp, M. musculus
atgatcaccaagaaca

SEQ ID NO: 368576 - DNA, 16 bp, M. musculus
atgatcagaatacatt

SEQ ID NO: 368577 - DNA, 16 bp, M. musculus
atgatcatctcattag

SEQ ID NO: 368578 - DNA, 16 bp, M. musculus
atgatcatctgaccaa

SEQ ID NO: 368579 - DNA, 16 bp, M. musculus
atgatcattcatcatg

SEQ ID NO: 368580 - DNA, 16 bp, M. musculus
atgatcattttaatgt

SEQ ID NO: 368581 - DNA, 16 bp, M. musculus
atgatccagcagaccc

SEQ ID NO: 368582 - DNA, 16 bp, M. musculus
atgatccagctggaat

SEQ ID NO: 368583 - DNA, 18 bp, M. musculus
atgatccatagtcagaaa

SEQ ID NO: 368584 - DNA, 16 bp, M. musculus
atgatcctgaaaaaca

SEQ ID NO: 368585 - DNA, 16 bp, M. musculus
atgatctttgcaagac

SEQ ID NO: 368586 - DNA, 16 bp, M. musculus
atgatgaattttgtca

SEQ ID NO: 368587 - DNA, 16 bp, M. musculus
atgatgacaatggatt

SEQ ID NO: 368588 - DNA, 16 bp, M. musculus
atgatgacagaaagga

SEQ ID NO: 368589 - DNA, 16 bp, M. musculus
atgatgaccatggact

SEQ ID NO: 368590 - DNA, 16 bp, M. musculus
atgatgacgatgacaa

SEQ ID NO: 368591 - DNA, 16 bp, M. musculus
atgatgagagagagag

SEQ ID NO: 368592 - DNA, 16 bp, M. musculus
atgatgagctaatttt

SEQ ID NO: 368593 - DNA, 16 bp, M. musculus
atgatgaggaaggaca

SEQ ID NO: 368594 - DNA, 16 bp, M. musculus
atgatgataatgataa

SEQ ID NO: 368595 - DNA, 16 bp, M. musculus
atgatgatatgatgat

SEQ ID NO: 368596 - DNA, 16 bp, M. musculus
atgatgatcatggact

SEQ ID NO: 368597 - DNA, 16 bp, M. musculus
atgatgatcctataag

SEQ ID NO: 368598 - DNA, 16 bp, M. musculus
atgatgatgaactgaa

SEQ ID NO: 368599 - DNA, 16 bp, M. musculus
atgatgatgacaacaa

SEQ ID NO: 368600 - DNA, 16 bp, M. musculus
atgatgatgacagtga

SEQ ID NO: 368601 - DNA, 16 bp, M. musculus
atgatgatgataaaca

SEQ ID NO: 368602 - DNA, 16 bp, M. musculus
atgatgatgatagaga

SEQ ID NO: 368603 - DNA, 16 bp, M. musculus
atgatgatgatgaata

SEQ ID NO: 368604 - DNA, 16 bp, M. musculus
atgatgatgatgacga

SEQ ID NO: 368605 - DNA, 16 bp, M. musculus
atgatgatgatgataa

SEQ ID NO: 368606 - DNA, 16 bp, M. musculus
atgatgatgatgatct

SEQ ID NO: 368607 - DNA, 16 bp, M. musculus
atgatgatgatgatgt

SEQ ID NO: 368608 - DNA, 16 bp, M. musculus
atgatgatgatggagg

SEQ ID NO: 368609 - DNA, 16 bp, M. musculus
atgatgatggtgatga

SEQ ID NO: 368610 - DNA, 16 bp, M. musculus
atgatgatgtgtgtgt

SEQ ID NO: 368611 - DNA, 16 bp, M. musculus
atgatgattcacaacc

SEQ ID NO: 368612 - DNA, 16 bp, M. musculus
atgatgattgatgatg

SEQ ID NO: 368613 - DNA, 18 bp, M. musculus
atgatgccacattcatga

SEQ ID NO: 368614 - DNA, 16 bp, M. musculus
atgatgcccccaacac

SEQ ID NO: 368615 - DNA, 16 bp, M. musculus
atgatgccctcttctg

SEQ ID NO: 368616 - DNA, 16 bp, M. musculus
atgatgccttccaggt

SEQ ID NO: 368617 - DNA, 16 bp, M. musculus
atgatgctctcaagag

SEQ ID NO: 368618 - DNA, 16 bp, M. musculus
atgatggaaatgaaca

SEQ ID NO: 368619 - DNA, 16 bp, M. musculus
atgatggaagaagaga

SEQ ID NO: 368620 - DNA, 16 bp, M. musculus
atgatggaaggagaga

SEQ ID NO: 368621 - DNA, 16 bp, M. musculus
atgatggactgaacct

SEQ ID NO: 368622 - DNA, 16 bp, M. musculus
atgatggatggatgga

SEQ ID NO: 368623 - DNA, 35 bp, M. musculus
atgatggatgtcatacaaatgagttgtgtggcatc

SEQ ID NO: 368624 - DNA, 16 bp, M. musculus
atgatggcacacacct

SEQ ID NO: 368625 - DNA, 16 bp, M. musculus
atgatggcacatgcct

SEQ ID NO: 368626 - DNA, 16 bp, M. musculus
atgatggctcacagct

SEQ ID NO: 368627 - DNA, 16 bp, M. musculus
atgatgggaagcatgg

SEQ ID NO: 368628 - DNA, 16 bp, M. musculus
atgatggggagacaga

SEQ ID NO: 368629 - DNA, 16 bp, M. musculus
atgatggtacacacct

SEQ ID NO: 368630 - DNA, 16 bp, M. musculus
atgatggtggtggtga

SEQ ID NO: 368631 - DNA, 17 bp, M. musculus
atgatggttgacctaga

SEQ ID NO: 368632 - DNA, 16 bp, M. musculus
atgatggtttgtatat

SEQ ID NO: 368633 - DNA, 16 bp, M. musculus
atgatgtgaaagtcac

SEQ ID NO: 368634 - DNA, 16 bp, M. musculus
atgatgttattgaaga

SEQ ID NO: 368635 - DNA, 16 bp, M. musculus
atgatgttgatgatga

SEQ ID NO: 368636 - DNA, 16 bp, M. musculus
atgattaaggatggtg

SEQ ID NO: 368637 - DNA, 16 bp, M. musculus
atgattacttctattt

SEQ ID NO: 368638 - DNA, 16 bp, M. musculus
atgattatacttggaa

SEQ ID NO: 368639 - DNA, 16 bp, M. musculus
atgattatgattatga

SEQ ID NO: 368640 - DNA, 16 bp, M. musculus
atgattatgggatgga

SEQ ID NO: 368641 - DNA, 16 bp, M. musculus
atgattattttcttct

SEQ ID NO: 368642 - DNA, 16 bp, M. musculus
atgattattttgatgt

SEQ ID NO: 368643 - DNA, 16 bp, M. musculus
atgattcataactgta

SEQ ID NO: 368644 - DNA, 16 bp, M. musculus
atgattctctggattt

SEQ ID NO: 368645 - DNA, 23 bp, M. musculus
atgattgagaccgggataagtat

SEQ ID NO: 368646 - DNA, 16 bp, M. musculus
atgattgctttgatgt

SEQ ID NO: 368647 - DNA, 16 bp, M. musculus
atgattgggtgttgga

SEQ ID NO: 368648 - DNA, 16 bp, M. musculus
atgattgtgagccatc

SEQ ID NO: 368649 - DNA, 16 bp, M. musculus
atgattgtgagctgcc

SEQ ID NO: 368650 - DNA, 16 bp, M. musculus
atgattgttgttctgt

SEQ ID NO: 368651 - DNA, 16 bp, M. musculus
atgattgttttgatgt

SEQ ID NO: 368652 - DNA, 16 bp, M. musculus
atgatttaataaaaac

SEQ ID NO: 368653 - DNA, 16 bp, M. musculus
atgatttataacagta

SEQ ID NO: 368654 - DNA, 16 bp, M. musculus
atgatttgccaaagaa

SEQ ID NO: 368655 - DNA, 16 bp, M. musculus
atgatttgcctcttga

SEQ ID NO: 368656 - DNA, 16 bp, M. musculus
atgattttaaatatga

SEQ ID NO: 368657 - DNA, 16 bp, M. musculus
atgattttctttcctt

SEQ ID NO: 368658 - DNA, 16 bp, M. musculus
atgattttgatgtgtt

SEQ ID NO: 368659 - DNA, 16 bp, M. musculus
atgatttttaaaaagg

SEQ ID NO: 368660 - DNA, 16 bp, M. musculus
atgatttttaaaatgt

SEQ ID NO: 368661 - DNA, 16 bp, M. musculus
atgatttttaaagtta

SEQ ID NO: 368662 - DNA, 16 bp, M. musculus
atgcaaaataaattta

SEQ ID NO: 368663 - DNA, 16 bp, M. musculus
atgcaaaatacattta

SEQ ID NO: 368664 - DNA, 16 bp, M. musculus
atgcaaacatgaagac

SEQ ID NO: 368665 - DNA, 16 bp, M. musculus
atgcaaaccaaaacaa

SEQ ID NO: 368666 - DNA, 16 bp, M. musculus
atgcaaagaccatgga

SEQ ID NO: 368667 - DNA, 16 bp, M. musculus
atgcaaaggcagccac

SEQ ID NO: 368668 - DNA, 16 bp, M. musculus
atgcaaaggtttcact

SEQ ID NO: 368669 - DNA, 16 bp, M. musculus
atgcaaagtaaataaa

SEQ ID NO: 368670 - DNA, 16 bp, M. musculus
atgcaaatcaaaactg

SEQ ID NO: 368671 - DNA, 16 bp, M. musculus
atgcaaatgaaataaa

SEQ ID NO: 368672 - DNA, 16 bp, M. musculus
atgcaaatgaggcatc

SEQ ID NO: 368673 - DNA, 21 bp, M. musculus
atgcaaatgtgctattgttag

SEQ ID NO: 368674 - DNA, 16 bp, M. musculus
atgcaaatttttaaaa

SEQ ID NO: 368675 - DNA, 16 bp, M. musculus
atgcaactcttataag

SEQ ID NO: 368676 - DNA, 16 bp, M. musculus
atgcaagaagaaaaga

SEQ ID NO: 368677 - DNA, 16 bp, M. musculus
atgcaagagatggaag

SEQ ID NO: 368678 - DNA, 16 bp, M. musculus
atgcaagcaagcatca

SEQ ID NO: 368679 - DNA, 16 bp, M. musculus
atgcaagcagaacact

SEQ ID NO: 368680 - DNA, 16 bp, M. musculus
atgcaaggatggttca

SEQ ID NO: 368681 - DNA, 16 bp, M. musculus
atgcaagtggtgcaca

SEQ ID NO: 368682 - DNA, 16 bp, M. musculus
atgcaagttggggagg

SEQ ID NO: 368683 - DNA, 16 bp, M. musculus
atgcaatgaaagcagt

SEQ ID NO: 368684 - DNA, 16 bp, M. musculus
atgcacaaaaccctgg

SEQ ID NO: 368685 - DNA, 16 bp, M. musculus
atgcacaaacacatat

SEQ ID NO: 368686 - DNA, 16 bp, M. musculus
atgcacaaatgcacac

SEQ ID NO: 368687 - DNA, 16 bp, M. musculus
atgcacaactgtttct

SEQ ID NO: 368688 - DNA, 16 bp, M. musculus
atgcacaaggccctga

SEQ ID NO: 368689 - DNA, 16 bp, M. musculus
atgcacacaaaacacc

SEQ ID NO: 368690 - DNA, 16 bp, M. musculus
atgcacacaaatatat

SEQ ID NO: 368691 - DNA, 16 bp, M. musculus
atgcacacacacacat

SEQ ID NO: 368692 - DNA, 16 bp, M. musculus
atgcacacacacactc

SEQ ID NO: 368693 - DNA, 16 bp, M. musculus
atgcacacacatatgt

SEQ ID NO: 368694 - DNA, 16 bp, M. musculus
atgcacacacatgcat

SEQ ID NO: 368695 - DNA, 16 bp, M. musculus
atgcacacacatggac

SEQ ID NO: 368696 - DNA, 16 bp, M. musculus
atgcacacacgtacac

SEQ ID NO: 368697 - DNA, 16 bp, M. musculus
atgcacacactcacac

SEQ ID NO: 368698 - DNA, 16 bp, M. musculus
atgcacacactgctgc

SEQ ID NO: 368699 - DNA, 16 bp, M. musculus
atgcacacactttaaa

SEQ ID NO: 368700 - DNA, 16 bp, M. musculus
atgcacacagcacaca

SEQ ID NO: 368701 - DNA, 16 bp, M. musculus
atgcacacagtgcaca

SEQ ID NO: 368702 - DNA, 16 bp, M. musculus
atgcacacatacaaat

SEQ ID NO: 368703 - DNA, 16 bp, M. musculus
atgcacacatacacag

SEQ ID NO: 368704 - DNA, 16 bp, M. musculus
atgcacacatacacat

SEQ ID NO: 368705 - DNA, 16 bp, M. musculus
atgcacaccacataca

SEQ ID NO: 368706 - DNA, 16 bp, M. musculus
atgcacacggtacaca

SEQ ID NO: 368707 - DNA, 16 bp, M. musculus
atgcacacttacacat

SEQ ID NO: 368708 - DNA, 16 bp, M. musculus
atgcacactttggtct

SEQ ID NO: 368709 - DNA, 16 bp, M. musculus
atgcacagacagaaga

SEQ ID NO: 368710 - DNA, 16 bp, M. musculus
atgcacagactctctc

SEQ ID NO: 368711 - DNA, 16 bp, M. musculus
atgcacagaggccaga

SEQ ID NO: 368712 - DNA, 17 bp, M. musculus
atgcacagtgaggctgc

SEQ ID NO: 368713 - DNA, 16 bp, M. musculus
atgcacataaaataaa

SEQ ID NO: 368714 - DNA, 16 bp, M. musculus
atgcacataaaataca

SEQ ID NO: 368715 - DNA, 16 bp, M. musculus
atgcacataaaatatt

SEQ ID NO: 368716 - DNA, 16 bp, M. musculus
atgcacatacaacaca

SEQ ID NO: 368717 - DNA, 16 bp, M. musculus
atgcacatacacacca

SEQ ID NO: 368718 - DNA, 16 bp, M. musculus
atgcacatataaacac

SEQ ID NO: 368719 - DNA, 16 bp, M. musculus
atgcacatatatataa

SEQ ID NO: 368720 - DNA, 16 bp, M. musculus
atgcacatggacacac

SEQ ID NO: 368721 - DNA, 16 bp, M. musculus
atgcacatggtacaca

SEQ ID NO: 368722 - DNA, 16 bp, M. musculus
atgcacatggtgcaga

SEQ ID NO: 368723 - DNA, 16 bp, M. musculus
atgcacatgtacatat

SEQ ID NO: 368724 - DNA, 16 bp, M. musculus
atgcacatgtgtttgt

SEQ ID NO: 368725 - DNA, 16 bp, M. musculus
atgcacattcacacac

SEQ ID NO: 368726 - DNA, 16 bp, M. musculus
atgcaccaccaccgcc

SEQ ID NO: 368727 - DNA, 16 bp, M. musculus
atgcaccaccactgcc

SEQ ID NO: 368728 - DNA, 16 bp, M. musculus
atgcaccagaagagga

SEQ ID NO: 368729 - DNA, 16 bp, M. musculus
atgcaccagagacttg

SEQ ID NO: 368730 - DNA, 16 bp, M. musculus
atgcacgcacacatgc

SEQ ID NO: 368731 - DNA, 16 bp, M. musculus
atgcacgcgcgcacac

SEQ ID NO: 368732 - DNA, 16 bp, M. musculus
atgcactaaatgaaga

SEQ ID NO: 368733 - DNA, 16 bp, M. musculus
atgcactcatgtacac

SEQ ID NO: 368734 - DNA, 16 bp, M. musculus
atgcactttttaaaaa

SEQ ID NO: 368735 - DNA, 16 bp, M. musculus
atgcagaaaaggcatt

SEQ ID NO: 368736 - DNA, 16 bp, M. musculus
atgcagaaactgaggc

SEQ ID NO: 368737 - DNA, 16 bp, M. musculus
atgcagaaagagagag

SEQ ID NO: 368738 - DNA, 16 bp, M. musculus
atgcagaaatctttgg

SEQ ID NO: 368739 - DNA, 16 bp, M. musculus
atgcagaacatattta

SEQ ID NO: 368740 - DNA, 16 bp, M. musculus
atgcagaagacagagg

SEQ ID NO: 368741 - DNA, 16 bp, M. musculus
atgcagaagatggagg

SEQ ID NO: 368742 - DNA, 16 bp, M. musculus
atgcagaagatggtgg

SEQ ID NO: 368743 - DNA, 16 bp, M. musculus
atgcagaagccagagg

SEQ ID NO: 368744 - DNA, 16 bp, M. musculus
atgcagaaggatcctg

SEQ ID NO: 368745 - DNA, 16 bp, M. musculus
atgcagaatatctgat

SEQ ID NO: 368746 - DNA, 16 bp, M. musculus
atgcagacaaaacaca

SEQ ID NO: 368747 - DNA, 16 bp, M. musculus
atgcagacaaaacatt

SEQ ID NO: 368748 - DNA, 16 bp, M. musculus
atgcagacaaaatatc

SEQ ID NO: 368749 - DNA, 16 bp, M. musculus
atgcagacaccattgc

SEQ ID NO: 368750 - DNA, 16 bp, M. musculus
atgcagaccagactgg

SEQ ID NO: 368751 - DNA, 16 bp, M. musculus
atgcagaccaggctga

SEQ ID NO: 368752 - DNA, 16 bp, M. musculus
atgcagagaaagcatt

SEQ ID NO: 368753 - DNA, 16 bp, M. musculus
atgcagagaaccacag

SEQ ID NO: 368754 - DNA, 16 bp, M. musculus
atgcagagacagacac

SEQ ID NO: 368755 - DNA, 16 bp, M. musculus
atgcagagacagagac

SEQ ID NO: 368756 - DNA, 16 bp, M. musculus
atgcagagaccacaga

SEQ ID NO: 368757 - DNA, 16 bp, M. musculus
atgcagagcagctgag

SEQ ID NO: 368758 - DNA, 16 bp, M. musculus
atgcagaggccataga

SEQ ID NO: 368759 - DNA, 25 bp, M. musculus
atgcagaggccatggagggatgtta

SEQ ID NO: 368760 - DNA, 16 bp, M. musculus
atgcagaggccttgga

SEQ ID NO: 368761 - DNA, 16 bp, M. musculus
atgcagaggtcagagg

SEQ ID NO: 368762 - DNA, 16 bp, M. musculus
atgcagagtgtgtgtg

SEQ ID NO: 368763 - DNA, 16 bp, M. musculus
atgcagagtttggagt

SEQ ID NO: 368764 - DNA, 16 bp, M. musculus
atgcagataaaacact

SEQ ID NO: 368765 - DNA, 16 bp, M. musculus
atgcagatagagcact

SEQ ID NO: 368766 - DNA, 16 bp, M. musculus
atgcagatattcacag

SEQ ID NO: 368767 - DNA, 16 bp, M. musculus
atgcagatctctgtga

SEQ ID NO: 368768 - DNA, 16 bp, M. musculus
atgcagatgtccctgg

SEQ ID NO: 368769 - DNA, 16 bp, M. musculus
atgcagatgtgtgtgt

SEQ ID NO: 368770 - DNA, 16 bp, M. musculus
atgcagcaaaaagttg

SEQ ID NO: 368771 - DNA, 16 bp, M. musculus
atgcagcaaaggatgg

SEQ ID NO: 368772 - DNA, 16 bp, M. musculus
atgcagcatattatat

SEQ ID NO: 368773 - DNA, 16 bp, M. musculus
atgcagccatccagtt

SEQ ID NO: 368774 - DNA, 16 bp, M. musculus
atgcagcccaggctgg

SEQ ID NO: 368775 - DNA, 16 bp, M. musculus
atgcagccggaaagtc

SEQ ID NO: 368776 - DNA, 22 bp, M. musculus
atgcagcctcactgtgcatgct

SEQ ID NO: 368777 - DNA, 16 bp, M. musculus
atgcagcctgccctcc

SEQ ID NO: 368778 - DNA, 16 bp, M. musculus
atgcagctagagacac

SEQ ID NO: 368779 - DNA, 16 bp, M. musculus
atgcagctagagacgc

SEQ ID NO: 368780 - DNA, 16 bp, M. musculus
atgcagctagagactt

SEQ ID NO: 368781 - DNA, 16 bp, M. musculus
atgcagctagagatac

SEQ ID NO: 368782 - DNA, 18 bp, M. musculus
atgcagctagagatatga

SEQ ID NO: 368783 - DNA, 16 bp, M. musculus
atgcagctcaactatg

SEQ ID NO: 368784 - DNA, 16 bp, M. musculus
atgcagctgcctttga

SEQ ID NO: 368785 - DNA, 16 bp, M. musculus
atgcagctggagccac

SEQ ID NO: 368786 - DNA, 16 bp, M. musculus
atgcagctggagccat

SEQ ID NO: 368787 - DNA, 16 bp, M. musculus
atgcagctgtctttga

SEQ ID NO: 368788 - DNA, 16 bp, M. musculus
atgcagctgtgtgtgt

SEQ ID NO: 368789 - DNA, 16 bp, M. musculus
atgcagcttttttttt

SEQ ID NO: 368790 - DNA, 16 bp, M. musculus
atgcaggaatggttca

SEQ ID NO: 368791 - DNA, 16 bp, M. musculus
atgcaggactggaact

SEQ ID NO: 368792 - DNA, 16 bp, M. musculus
atgcaggagctggacc

SEQ ID NO: 368793 - DNA, 16 bp, M. musculus
atgcaggaggcagagg

SEQ ID NO: 368794 - DNA, 16 bp, M. musculus
atgcaggaggccctgg

SEQ ID NO: 368795 - DNA, 16 bp, M. musculus
atgcaggcaaaacact

SEQ ID NO: 368796 - DNA, 16 bp, M. musculus
atgcaggcaaaacatc

SEQ ID NO: 368797 - DNA, 16 bp, M. musculus
atgcaggcaaaaccac

SEQ ID NO: 368798 - DNA, 16 bp, M. musculus
atgcaggcacagcaga

SEQ ID NO: 368799 - DNA, 16 bp, M. musculus
atgcaggcagaacacc

SEQ ID NO: 368800 - DNA, 16 bp, M. musculus
atgcaggcaggcaaaa

SEQ ID NO: 368801 - DNA, 16 bp, M. musculus
atgcaggcatacatgc

SEQ ID NO: 368802 - DNA, 16 bp, M. musculus
atgcagggacaaagag

SEQ ID NO: 368803 - DNA, 16 bp, M. musculus
atgcagggatggttcc

SEQ ID NO: 368804 - DNA, 17 bp, M. musculus
atgcagggatggtttaa

SEQ ID NO: 368805 - DNA, 16 bp, M. musculus
atgcagggctggctgc

SEQ ID NO: 368806 - DNA, 16 bp, M. musculus
atgcaggtgaaacacc

SEQ ID NO: 368807 - DNA, 16 bp, M. musculus
atgcaggtgcaggaag

SEQ ID NO: 368808 - DNA, 16 bp, M. musculus
atgcagtcattaatag

SEQ ID NO: 368809 - DNA, 16 bp, M. musculus
atgcagtgatggttta

SEQ ID NO: 368810 - DNA, 16 bp, M. musculus
atgcagtgcagtgcag

SEQ ID NO: 368811 - DNA, 16 bp, M. musculus
atgcagttaggaatta

SEQ ID NO: 368812 - DNA, 16 bp, M. musculus
atgcagttcctcatgc

SEQ ID NO: 368813 - DNA, 16 bp, M. musculus
atgcataaaataagta

SEQ ID NO: 368814 - DNA, 16 bp, M. musculus
atgcataaagccctgg

SEQ ID NO: 368815 - DNA, 16 bp, M. musculus
atgcatacacacaccc

SEQ ID NO: 368816 - DNA, 16 bp, M. musculus
atgcatacataaacac

SEQ ID NO: 368817 - DNA, 16 bp, M. musculus
atgcatacataggcag

SEQ ID NO: 368818 - DNA, 16 bp, M. musculus
atgcatacatatgtac

SEQ ID NO: 368819 - DNA, 16 bp, M. musculus
atgcatacatgtatgc

SEQ ID NO: 368820 - DNA, 16 bp, M. musculus
atgcatacatgtgcat

SEQ ID NO: 368821 - DNA, 16 bp, M. musculus
atgcatacatttattt

SEQ ID NO: 368822 - DNA, 16 bp, M. musculus
atgcatataatataca

SEQ ID NO: 368823 - DNA, 16 bp, M. musculus
atgcatataattaaaa

SEQ ID NO: 368824 - DNA, 16 bp, M. musculus
atgcatatacacacat

SEQ ID NO: 368825 - DNA, 16 bp, M. musculus
atgcatatataaatgt

SEQ ID NO: 368826 - DNA, 16 bp, M. musculus
atgcatatatacataa

SEQ ID NO: 368827 - DNA, 16 bp, M. musculus
atgcatatatatatgc

SEQ ID NO: 368828 - DNA, 16 bp, M. musculus
atgcatatatatttta

SEQ ID NO: 368829 - DNA, 16 bp, M. musculus
atgcatatatgtgcac

SEQ ID NO: 368830 - DNA, 16 bp, M. musculus
atgcatatatttaaat

SEQ ID NO: 368831 - DNA, 16 bp, M. musculus
atgcatatgaatattt

SEQ ID NO: 368832 - DNA, 16 bp, M. musculus
atgcatatggtataca

SEQ ID NO: 368833 - DNA, 16 bp, M. musculus
atgcatatggtgcaca

SEQ ID NO: 368834 - DNA, 16 bp, M. musculus
atgcatatgtatgtga

SEQ ID NO: 368835 - DNA, 16 bp, M. musculus
atgcatatgtgcatgc

SEQ ID NO: 368836 - DNA, 16 bp, M. musculus
atgcatatgtgtttgt

SEQ ID NO: 368837 - DNA, 16 bp, M. musculus
atgcatattatataca

SEQ ID NO: 368838 - DNA, 16 bp, M. musculus
atgcatattcatatat

SEQ ID NO: 368839 - DNA, 16 bp, M. musculus
atgcatcaaaatacaa

SEQ ID NO: 368840 - DNA, 16 bp, M. musculus
atgcatcaccatgcct

SEQ ID NO: 368841 - DNA, 16 bp, M. musculus
atgcatcatatacata

SEQ ID NO: 368842 - DNA, 16 bp, M. musculus
atgcatctgcacacac

SEQ ID NO: 368843 - DNA, 16 bp, M. musculus
atgcatgaagccctgg

SEQ ID NO: 368844 - DNA, 22 bp, M. musculus
atgcatgagaagtccatggagg

SEQ ID NO: 368845 - DNA, 16 bp, M. musculus
atgcatgaggtgcaca

SEQ ID NO: 368846 - DNA, 16 bp, M. musculus
atgcatgcacacacat

SEQ ID NO: 368847 - DNA, 16 bp, M. musculus
atgcatgcacatacat

SEQ ID NO: 368848 - DNA, 16 bp, M. musculus
atgcatgcagacaaaa

SEQ ID NO: 368849 - DNA, 16 bp, M. musculus
atgcatgcatacatat

SEQ ID NO: 368850 - DNA, 16 bp, M. musculus
atgcatgcatgcacac

SEQ ID NO: 368851 - DNA, 16 bp, M. musculus
atgcatgcatgccaca

SEQ ID NO: 368852 - DNA, 16 bp, M. musculus
atgcatgccacagcac

SEQ ID NO: 368853 - DNA, 16 bp, M. musculus
atgcatgcctgctgca

SEQ ID NO: 368854 - DNA, 16 bp, M. musculus
atgcatgcctggtacc

SEQ ID NO: 368855 - DNA, 16 bp, M. musculus
atgcatgcgtgtgtgt

SEQ ID NO: 368856 - DNA, 16 bp, M. musculus
atgcatgcttgtgtgt

SEQ ID NO: 368857 - DNA, 16 bp, M. musculus
atgcatggatgcatgg

SEQ ID NO: 368858 - DNA, 16 bp, M. musculus
atgcatggatgtgtgt

SEQ ID NO: 368859 - DNA, 16 bp, M. musculus
atgcatggctccagct

SEQ ID NO: 368860 - DNA, 16 bp, M. musculus
atgcatgggctgcctg

SEQ ID NO: 368861 - DNA, 16 bp, M. musculus
atgcatgtaagtatgt

SEQ ID NO: 368862 - DNA, 16 bp, M. musculus
atgcatgtagtgcaca

SEQ ID NO: 368863 - DNA, 16 bp, M. musculus
atgcatgtataaaatt

SEQ ID NO: 368864 - DNA, 16 bp, M. musculus
atgcatgtatgtacat

SEQ ID NO: 368865 - DNA, 16 bp, M. musculus
atgcatgtctgtatat

SEQ ID NO: 368866 - DNA, 16 bp, M. musculus
atgcatgtgaacacac

SEQ ID NO: 368867 - DNA, 16 bp, M. musculus
atgcatgtgctacaca

SEQ ID NO: 368868 - DNA, 16 bp, M. musculus
atgcatgtggtgcaca

SEQ ID NO: 368869 - DNA, 16 bp, M. musculus
atgcatgtggtgtaca

SEQ ID NO: 368870 - DNA, 16 bp, M. musculus
atgcatgtggtgtgtg

SEQ ID NO: 368871 - DNA, 16 bp, M. musculus
atgcatgtgtctgtgt

SEQ ID NO: 368872 - DNA, 16 bp, M. musculus
atgcatgtgtgcctgt

SEQ ID NO: 368873 - DNA, 16 bp, M. musculus
atgcatgtgtgtatgt

SEQ ID NO: 368874 - DNA, 17 bp, M. musculus
atgcatgtgtgtgtatg

SEQ ID NO: 368875 - DNA, 16 bp, M. musculus
atgcatgtgttgtgtg

SEQ ID NO: 368876 - DNA, 16 bp, M. musculus
atgcatgtgtttgcat

SEQ ID NO: 368877 - DNA, 16 bp, M. musculus
atgcatgttagttagg

SEQ ID NO: 368878 - DNA, 16 bp, M. musculus
atgcattaaaaaaaat

SEQ ID NO: 368879 - DNA, 16 bp, M. musculus
atgcattctatctgat

SEQ ID NO: 368880 - DNA, 16 bp, M. musculus
atgcattctttgtgca

SEQ ID NO: 368881 - DNA, 16 bp, M. musculus
atgcattgtttttaat

SEQ ID NO: 368882 - DNA, 16 bp, M. musculus
atgcatttacatacat

SEQ ID NO: 368883 - DNA, 16 bp, M. musculus
atgcatttatatataa

SEQ ID NO: 368884 - DNA, 16 bp, M. musculus
atgcattttacattat

SEQ ID NO: 368885 - DNA, 16 bp, M. musculus
atgcatttttatcaca

SEQ ID NO: 368886 - DNA, 16 bp, M. musculus
atgccaaaaagagctt

SEQ ID NO: 368887 - DNA, 16 bp, M. musculus
atgccaaaatctctct

SEQ ID NO: 368888 - DNA, 16 bp, M. musculus
atgccaacccagacta

SEQ ID NO: 368889 - DNA, 16 bp, M. musculus
atgccaacctagacta

SEQ ID NO: 368890 - DNA, 16 bp, M. musculus
atgccaagaagggctt

SEQ ID NO: 368891 - DNA, 16 bp, M. musculus
atgccaccaacaatgg

SEQ ID NO: 368892 - DNA, 16 bp, M. musculus
atgccaccactgccag

SEQ ID NO: 368893 - DNA, 16 bp, M. musculus
atgccaccagcaatgg

SEQ ID NO: 368894 - DNA, 16 bp, M. musculus
atgccaccatgcctga

SEQ ID NO: 368895 - DNA, 16 bp, M. musculus
atgccaccatgcttcc

SEQ ID NO: 368896 - DNA, 16 bp, M. musculus
atgccagagccatgga

SEQ ID NO: 368897 - DNA, 16 bp, M. musculus
atgccagcaagtgctt

SEQ ID NO: 368898 - DNA, 16 bp, M. musculus
atgccagcactcggga

SEQ ID NO: 368899 - DNA, 16 bp, M. musculus
atgccagcacttggaa

SEQ ID NO: 368900 - DNA, 16 bp, M. musculus
atgccagctgagacag

SEQ ID NO: 368901 - DNA, 16 bp, M. musculus
atgccaggagagggca

SEQ ID NO: 368902 - DNA, 16 bp, M. musculus
atgccaggcaagtgct

SEQ ID NO: 368903 - DNA, 16 bp, M. musculus
atgccagggacaggaa

SEQ ID NO: 368904 - DNA, 16 bp, M. musculus
atgccagggccaagac

SEQ ID NO: 368905 - DNA, 16 bp, M. musculus
atgccagggccaggga

SEQ ID NO: 368906 - DNA, 16 bp, M. musculus
atgccagggtcctgtc

SEQ ID NO: 368907 - DNA, 16 bp, M. musculus
atgccagtacttggga

SEQ ID NO: 368908 - DNA, 16 bp, M. musculus
atgccagtatcatgag

SEQ ID NO: 368909 - DNA, 16 bp, M. musculus
atgccagtgcctggga

SEQ ID NO: 368910 - DNA, 16 bp, M. musculus
atgccatcactgccac

SEQ ID NO: 368911 - DNA, 16 bp, M. musculus
atgccatctgctgcca

SEQ ID NO: 368912 - DNA, 16 bp, M. musculus
atgccatgaagtgctt

SEQ ID NO: 368913 - DNA, 16 bp, M. musculus
atgccatgctggtcat

SEQ ID NO: 368914 - DNA, 16 bp, M. musculus
atgccatgctgttttt

SEQ ID NO: 368915 - DNA, 16 bp, M. musculus
atgccatggaggggtg

SEQ ID NO: 368916 - DNA, 16 bp, M. musculus
atgccatggcacacac

SEQ ID NO: 368917 - DNA, 16 bp, M. musculus
atgccatggtgtgcat

SEQ ID NO: 368918 - DNA, 16 bp, M. musculus
atgccattgagttcat

SEQ ID NO: 368919 - DNA, 16 bp, M. musculus
atgcccaaagccctgg

SEQ ID NO: 368920 - DNA, 16 bp, M. musculus
atgcccaagagaggaa

SEQ ID NO: 368921 - DNA, 16 bp, M. musculus
atgcccaaggaggcca

SEQ ID NO: 368922 - DNA, 16 bp, M. musculus
atgcccacagtcagct

SEQ ID NO: 368923 - DNA, 16 bp, M. musculus
atgcccagaagaggaa

SEQ ID NO: 368924 - DNA, 16 bp, M. musculus
atgcccagattccctg

SEQ ID NO: 368925 - DNA, 16 bp, M. musculus
atgcccagtgtgtgtg

SEQ ID NO: 368926 - DNA, 16 bp, M. musculus
atgcccatgagcatac

SEQ ID NO: 368927 - DNA, 16 bp, M. musculus
atgcccatgtgtgtgt

SEQ ID NO: 368928 - DNA, 16 bp, M. musculus
atgccccaaatatttc

SEQ ID NO: 368929 - DNA, 16 bp, M. musculus
atgccccaactgttaa

SEQ ID NO: 368930 - DNA, 16 bp, M. musculus
atgccccacctgtaac

SEQ ID NO: 368931 - DNA, 16 bp, M. musculus
atgccccaggacaggg

SEQ ID NO: 368932 - DNA, 16 bp, M. musculus
atgccccaggataggg

SEQ ID NO: 368933 - DNA, 16 bp, M. musculus
atgccccagtataggg

SEQ ID NO: 368934 - DNA, 16 bp, M. musculus
atgccccagtgtacag

SEQ ID NO: 368935 - DNA, 16 bp, M. musculus
atgccccagtgtagga

SEQ ID NO: 368936 - DNA, 16 bp, M. musculus
atgccccccccccaaa

SEQ ID NO: 368937 - DNA, 16 bp, M. musculus
atgcccctgccaccct

SEQ ID NO: 368938 - DNA, 16 bp, M. musculus
atgcccctgtctctgc

SEQ ID NO: 368939 - DNA, 16 bp, M. musculus
atgcccctgtggcatg

SEQ ID NO: 368940 - DNA, 16 bp, M. musculus
atgcccctgtggggtc

SEQ ID NO: 368941 - DNA, 16 bp, M. musculus
atgccctccagggcca

SEQ ID NO: 368942 - DNA, 16 bp, M. musculus
atgccctccaggttca

SEQ ID NO: 368943 - DNA, 16 bp, M. musculus
atgccctccagttcca

SEQ ID NO: 368944 - DNA, 16 bp, M. musculus
atgccctctggcctct

SEQ ID NO: 368945 - DNA, 16 bp, M. musculus
atgccctcttctaatg

SEQ ID NO: 368946 - DNA, 16 bp, M. musculus
atgccctcttctgctg

SEQ ID NO: 368947 - DNA, 16 bp, M. musculus
atgccctcttctggca

SEQ ID NO: 368948 - DNA, 16 bp, M. musculus
atgccctcttctggcg

SEQ ID NO: 368949 - DNA, 16 bp, M. musculus
atgccctcttcttctg

SEQ ID NO: 368950 - DNA, 16 bp, M. musculus
atgcccttaaagagga

SEQ ID NO: 368951 - DNA, 16 bp, M. musculus
atgcctaagaacaaga

SEQ ID NO: 368952 - DNA, 16 bp, M. musculus
atgcctagatttgtac

SEQ ID NO: 368953 - DNA, 16 bp, M. musculus
atgcctataaccccag

SEQ ID NO: 368954 - DNA, 16 bp, M. musculus
atgcctataatcacag

SEQ ID NO: 368955 - DNA, 16 bp, M. musculus
atgcctataatcccag

SEQ ID NO: 368956 - DNA, 16 bp, M. musculus
atgcctataattccag

SEQ ID NO: 368957 - DNA, 16 bp, M. musculus
atgcctatagtcccag

SEQ ID NO: 368958 - DNA, 16 bp, M. musculus
atgcctcagtgcaggg

SEQ ID NO: 368959 - DNA, 16 bp, M. musculus
atgcctcagttccact

SEQ ID NO: 368960 - DNA, 16 bp, M. musculus
atgcctcatctgcatg

SEQ ID NO: 368961 - DNA, 16 bp, M. musculus
atgcctccaagaagaa

SEQ ID NO: 368962 - DNA, 16 bp, M. musculus
atgcctccataagatc

SEQ ID NO: 368963 - DNA, 16 bp, M. musculus
atgcctccatggcctc

SEQ ID NO: 368964 - DNA, 16 bp, M. musculus
atgcctctggcctcca

SEQ ID NO: 368965 - DNA, 16 bp, M. musculus
atgcctgaagacagct

SEQ ID NO: 368966 - DNA, 16 bp, M. musculus
atgcctgatttctttc

SEQ ID NO: 368967 - DNA, 16 bp, M. musculus
atgcctgcaattccag

SEQ ID NO: 368968 - DNA, 16 bp, M. musculus
atgcctgcactcacat

SEQ ID NO: 368969 - DNA, 16 bp, M. musculus
atgcctgcctggaggc

SEQ ID NO: 368970 - DNA, 16 bp, M. musculus
atgcctgcttcaccac

SEQ ID NO: 368971 - DNA, 16 bp, M. musculus
atgcctggaaccccag

SEQ ID NO: 368972 - DNA, 16 bp, M. musculus
atgcctggaatctcag

SEQ ID NO: 368973 - DNA, 17 bp, M. musculus
atgcctggatgctgcca

SEQ ID NO: 368974 - DNA, 16 bp, M. musculus
atgcctggtgtccatg

SEQ ID NO: 368975 - DNA, 16 bp, M. musculus
atgcctgtaactccag

SEQ ID NO: 368976 - DNA, 16 bp, M. musculus
atgcctgtaatcccaa

SEQ ID NO: 368977 - DNA, 16 bp, M. musculus
atgcctgtgaaccaca

SEQ ID NO: 368978 - DNA, 16 bp, M. musculus
atgcctgtgcagcaag

SEQ ID NO: 368979 - DNA, 16 bp, M. musculus
atgcctgtttgtttgt

SEQ ID NO: 368980 - DNA, 16 bp, M. musculus
atgccttacagttaga

SEQ ID NO: 368981 - DNA, 16 bp, M. musculus
atgccttcaaaacaag

SEQ ID NO: 368982 - DNA, 16 bp, M. musculus
atgcctttaatcacag

SEQ ID NO: 368983 - DNA, 16 bp, M. musculus
atgcctttaatcccaa

SEQ ID NO: 368984 - DNA, 16 bp, M. musculus
atgcctttaatcccag

SEQ ID NO: 368985 - DNA, 16 bp, M. musculus
atgcctttaattgcag

SEQ ID NO: 368986 - DNA, 16 bp, M. musculus
atgcctttagtcctag

SEQ ID NO: 368987 - DNA, 16 bp, M. musculus
atgcctttataaattt

SEQ ID NO: 368988 - DNA, 16 bp, M. musculus
atgcctttgtttccta

SEQ ID NO: 368989 - DNA, 16 bp, M. musculus
atgcgcacatgcacac

SEQ ID NO: 368990 - DNA, 16 bp, M. musculus
atgcgcacgtgcacac

SEQ ID NO: 368991 - DNA, 16 bp, M. musculus
atgcgcgcacgcacac

SEQ ID NO: 368992 - DNA, 16 bp, M. musculus
atgcgtgcatgcacac

SEQ ID NO: 368993 - DNA, 16 bp, M. musculus
atgcgtgtgagtgtgt

SEQ ID NO: 368994 - DNA, 16 bp, M. musculus
atgcgtgtgtgagtgt

SEQ ID NO: 368995 - DNA, 16 bp, M. musculus
atgcgtgtgtgcgtgc

SEQ ID NO: 368996 - DNA, 16 bp, M. musculus
atgcgtgtgtgcgtgt

SEQ ID NO: 368997 - DNA, 16 bp, M. musculus
atgctaaacaagtgct

SEQ ID NO: 368998 - DNA, 16 bp, M. musculus
atgctaacaagtgctt

SEQ ID NO: 368999 - DNA, 16 bp, M. musculus
atgctaagcaagtgct

SEQ ID NO: 369000 - DNA, 21 bp, M. musculus
atgctaatcataaaacagata

SEQ ID NO: 369001 - DNA, 16 bp, M. musculus
atgctaccatgcttcc

SEQ ID NO: 369002 - DNA, 16 bp, M. musculus
atgctaggattatagg

SEQ ID NO: 369003 - DNA, 16 bp, M. musculus
atgctaggcaaacact

SEQ ID NO: 369004 - DNA, 16 bp, M. musculus
atgctaggcaagtatt

SEQ ID NO: 369005 - DNA, 16 bp, M. musculus
atgctaggcaggcact

SEQ ID NO: 369006 - DNA, 16 bp, M. musculus
atgctaggcttctgtt

SEQ ID NO: 369007 - DNA, 16 bp, M. musculus
atgctagggattgaac

SEQ ID NO: 369008 - DNA, 16 bp, M. musculus
atgctagtgctcagct

SEQ ID NO: 369009 - DNA, 19 bp, M. musculus
atgctataaatgtgagcca

SEQ ID NO: 369010 - DNA, 16 bp, M. musculus
atgctatcccaaaaag

SEQ ID NO: 369011 - DNA, 16 bp, M. musculus
atgctatcccgaaaat

SEQ ID NO: 369012 - DNA, 16 bp, M. musculus
atgctatcctgaaaat

SEQ ID NO: 369013 - DNA, 16 bp, M. musculus
atgctatcttttttcc

SEQ ID NO: 369014 - DNA, 16 bp, M. musculus
atgctatgtagacaaa

SEQ ID NO: 369015 - DNA, 16 bp, M. musculus
atgctatgtgaccttg

SEQ ID NO: 369016 - DNA, 16 bp, M. musculus
atgctcaagaattagt

SEQ ID NO: 369017 - DNA, 16 bp, M. musculus
atgctcaagccaggct

SEQ ID NO: 369018 - DNA, 16 bp, M. musculus
atgctcaataaatatt

SEQ ID NO: 369019 - DNA, 16 bp, M. musculus
atgctcaataaatgtt

SEQ ID NO: 369020 - DNA, 16 bp, M. musculus
atgctcacagacatcc

SEQ ID NO: 369021 - DNA, 16 bp, M. musculus
atgctcagctcaggga

SEQ ID NO: 369022 - DNA, 16 bp, M. musculus
atgctcaggcaaaatg

SEQ ID NO: 369023 - DNA, 18 bp, M. musculus
atgctcaggcaaagcgct

SEQ ID NO: 369024 - DNA, 16 bp, M. musculus
atgctcaggctctgcc

SEQ ID NO: 369025 - DNA, 16 bp, M. musculus
atgctcatgcacacat

SEQ ID NO: 369026 - DNA, 16 bp, M. musculus
atgctccaaaaacaag

SEQ ID NO: 369027 - DNA, 16 bp, M. musculus
atgctccaacatataa

SEQ ID NO: 369028 - DNA, 16 bp, M. musculus
atgctccaccatgttt

SEQ ID NO: 369029 - DNA, 16 bp, M. musculus
atgctccagaacaggg

SEQ ID NO: 369030 - DNA, 16 bp, M. musculus
atgctccagagtcaga

SEQ ID NO: 369031 - DNA, 20 bp, M. musculus
atgctcctagatacggaccg

SEQ ID NO: 369032 - DNA, 16 bp, M. musculus
atgctcctcctcacag

SEQ ID NO: 369033 - DNA, 16 bp, M. musculus
atgctcctggaactct

SEQ ID NO: 369034 - DNA, 16 bp, M. musculus
atgctctacagacttg

SEQ ID NO: 369035 - DNA, 16 bp, M. musculus
atgctctgggctcagc

SEQ ID NO: 369036 - DNA, 16 bp, M. musculus
atgctcttccagaaga

SEQ ID NO: 369037 - DNA, 16 bp, M. musculus
atgctcttccagagga

SEQ ID NO: 369038 - DNA, 16 bp, M. musculus
atgctcttttgatttt

SEQ ID NO: 369039 - DNA, 16 bp, M. musculus
atgctgaaattttttt

SEQ ID NO: 369040 - DNA, 16 bp, M. musculus
atgctgaaccatctct

SEQ ID NO: 369041 - DNA, 16 bp, M. musculus
atgctgaagcaggagg

SEQ ID NO: 369042 - DNA, 16 bp, M. musculus
atgctgaaggtccttg

SEQ ID NO: 369043 - DNA, 16 bp, M. musculus
atgctgacaagagcct

SEQ ID NO: 369044 - DNA, 16 bp, M. musculus
atgctgacaggaacct

SEQ ID NO: 369045 - DNA, 16 bp, M. musculus
atgctgagaaagcctt

SEQ ID NO: 369046 - DNA, 16 bp, M. musculus
atgctgagaaagcgtt

SEQ ID NO: 369047 - DNA, 16 bp, M. musculus
atgctgagaaccaaac

SEQ ID NO: 369048 - DNA, 16 bp, M. musculus
atgctgagagagagag

SEQ ID NO: 369049 - DNA, 16 bp, M. musculus
atgctgagagtggaag

SEQ ID NO: 369050 - DNA, 16 bp, M. musculus
atgctgaggcaggagg

SEQ ID NO: 369051 - DNA, 16 bp, M. musculus
atgctgataaagcatt

SEQ ID NO: 369052 - DNA, 27 bp, M. musculus
atgctgatctctgcattcaaggtcaat

SEQ ID NO: 369053 - DNA, 16 bp, M. musculus
atgctgatttctgagt

SEQ ID NO: 369054 - DNA, 16 bp, M. musculus
atgctgcaacccttta

SEQ ID NO: 369055 - DNA, 16 bp, M. musculus
atgctgcaatccacag

SEQ ID NO: 369056 - DNA, 16 bp, M. musculus
atgctgcaggagcatg

SEQ ID NO: 369057 - DNA, 16 bp, M. musculus
atgctgccatattccc

SEQ ID NO: 369058 - DNA, 16 bp, M. musculus
atgctgccctgcttcc

SEQ ID NO: 369059 - DNA, 16 bp, M. musculus
atgctgccctgggtat

SEQ ID NO: 369060 - DNA, 16 bp, M. musculus
atgctgcctggctggt

SEQ ID NO: 369061 - DNA, 16 bp, M. musculus
atgctgctaggaaatt

SEQ ID NO: 369062 - DNA, 16 bp, M. musculus
atgctgctctcttctt

SEQ ID NO: 369063 - DNA, 16 bp, M. musculus
atgctgctcttacaga

SEQ ID NO: 369064 - DNA, 16 bp, M. musculus
atgctgctgctgctgg

SEQ ID NO: 369065 - DNA, 16 bp, M. musculus
atgctgctgctgctgt

SEQ ID NO: 369066 - DNA, 16 bp, M. musculus
atgctgctgctgcttc

SEQ ID NO: 369067 - DNA, 16 bp, M. musculus
atgctgctgtctgtct

SEQ ID NO: 369068 - DNA, 16 bp, M. musculus
atgctgctttctggct

SEQ ID NO: 369069 - DNA, 16 bp, M. musculus
atgctggaatcacagg

SEQ ID NO: 369070 - DNA, 16 bp, M. musculus
atgctggcaaagatgt

SEQ ID NO: 369071 - DNA, 16 bp, M. musculus
atgctggcaagtatgt

SEQ ID NO: 369072 - DNA, 17 bp, M. musculus
atgctggcatctatgtt

SEQ ID NO: 369073 - DNA, 16 bp, M. musculus
atgctggcctggaact

SEQ ID NO: 369074 - DNA, 16 bp, M. musculus
atgctggccttgaact

SEQ ID NO: 369075 - DNA, 16 bp, M. musculus
atgctggccttgaatt

SEQ ID NO: 369076 - DNA, 16 bp, M. musculus
atgctggctggctggc

SEQ ID NO: 369077 - DNA, 18 bp, M. musculus
atgctgggaactgaacct

SEQ ID NO: 369078 - DNA, 16 bp, M. musculus
atgctgggaactgagc

SEQ ID NO: 369079 - DNA, 16 bp, M. musculus
atgctgggatgaaagg

SEQ ID NO: 369080 - DNA, 16 bp, M. musculus
atgctgggatggttta

SEQ ID NO: 369081 - DNA, 19 bp, M. musculus
atgctgggattaaaggcat

SEQ ID NO: 369082 - DNA, 16 bp, M. musculus
atgctgggcaagcact

SEQ ID NO: 369083 - DNA, 16 bp, M. musculus
atgctggggctggaga

SEQ ID NO: 369084 - DNA, 16 bp, M. musculus
atgctggggtcaccct

SEQ ID NO: 369085 - DNA, 16 bp, M. musculus
atgctggggttacagg

SEQ ID NO: 369086 - DNA, 16 bp, M. musculus
atgctgggtaagcact

SEQ ID NO: 369087 - DNA, 16 bp, M. musculus
atgctgggtcctgttt

SEQ ID NO: 369088 - DNA, 16 bp, M. musculus
atgctgggtttttttt

SEQ ID NO: 369089 - DNA, 16 bp, M. musculus
atgctggtacccatag

SEQ ID NO: 369090 - DNA, 16 bp, M. musculus
atgctggtgagcatgt

SEQ ID NO: 369091 - DNA, 16 bp, M. musculus
atgctggtgatgatgt

SEQ ID NO: 369092 - DNA, 16 bp, M. musculus
atgctggtgtgtgtgt

SEQ ID NO: 369093 - DNA, 16 bp, M. musculus
atgctggttggctgga

SEQ ID NO: 369094 - DNA, 16 bp, M. musculus
atgctgtaagtttaaa

SEQ ID NO: 369095 - DNA, 16 bp, M. musculus
atgctgtcattggcca

SEQ ID NO: 369096 - DNA, 16 bp, M. musculus
atgctgtctgtctctg

SEQ ID NO: 369097 - DNA, 16 bp, M. musculus
atgctgtcttccttcc

SEQ ID NO: 369098 - DNA, 16 bp, M. musculus
atgctgtcttctggat

SEQ ID NO: 369099 - DNA, 29 bp, M. musculus
atgctgtctttcttccactggatggtttt

SEQ ID NO: 369100 - DNA, 16 bp, M. musculus
atgctgtgaaagcatt

SEQ ID NO: 369101 - DNA, 16 bp, M. musculus
atgctgtgctgacccc

SEQ ID NO: 369102 - DNA, 16 bp, M. musculus
atgctgtgctgtgctg

SEQ ID NO: 369103 - DNA, 16 bp, M. musculus
atgctgtggctaaaag

SEQ ID NO: 369104 - DNA, 16 bp, M. musculus
atgctgtggtttgaat

SEQ ID NO: 369105 - DNA, 16 bp, M. musculus
atgctgtgtgatgtgt

SEQ ID NO: 369106 - DNA, 16 bp, M. musculus
atgctgtgtgctctca

SEQ ID NO: 369107 - DNA, 16 bp, M. musculus
atgctgtgttcagttg

SEQ ID NO: 369108 - DNA, 16 bp, M. musculus
atgctgttgctgctgc

SEQ ID NO: 369109 - DNA, 16 bp, M. musculus
atgctgttttctcctg

SEQ ID NO: 369110 - DNA, 16 bp, M. musculus
atgcttaaaaataaaa

SEQ ID NO: 369111 - DNA, 16 bp, M. musculus
atgcttatatatttat

SEQ ID NO: 369112 - DNA, 16 bp, M. musculus
atgcttatgtgtatat

SEQ ID NO: 369113 - DNA, 16 bp, M. musculus
atgcttcagtgtttct

SEQ ID NO: 369114 - DNA, 16 bp, M. musculus
atgcttcataaaaata

SEQ ID NO: 369115 - DNA, 16 bp, M. musculus
atgcttcccactgtga

SEQ ID NO: 369116 - DNA, 16 bp, M. musculus
atgcttctcttgtagg

SEQ ID NO: 369117 - DNA, 16 bp, M. musculus
atgcttctgctctgct

SEQ ID NO: 369118 - DNA, 16 bp, M. musculus
atgcttctgtcaaatt

SEQ ID NO: 369119 - DNA, 36 bp, M. musculus
atgcttctgtcaacttctcagagttctccaagaagt

SEQ ID NO: 369120 - DNA, 16 bp, M. musculus
atgcttctgtctgcaa

SEQ ID NO: 369121 - DNA, 16 bp, M. musculus
atgcttctttttgttc

SEQ ID NO: 369122 - DNA, 16 bp, M. musculus
atgcttgaaaatgttc

SEQ ID NO: 369123 - DNA, 16 bp, M. musculus
atgcttgacttattta

SEQ ID NO: 369124 - DNA, 16 bp, M. musculus
atgcttgcatagcaaa

SEQ ID NO: 369125 - DNA, 16 bp, M. musculus
atgcttgcttagcatg

SEQ ID NO: 369126 - DNA, 16 bp, M. musculus
atgcttgctttctttt

SEQ ID NO: 369127 - DNA, 16 bp, M. musculus
atgcttgtaatcccag

SEQ ID NO: 369128 - DNA, 16 bp, M. musculus
atgcttgtggtacaca

SEQ ID NO: 369129 - DNA, 16 bp, M. musculus
atgcttgtgtgcatgt

SEQ ID NO: 369130 - DNA, 16 bp, M. musculus
atgcttgtgtggcaaa

SEQ ID NO: 369131 - DNA, 16 bp, M. musculus
atgctttccctgtgcc

SEQ ID NO: 369132 - DNA, 16 bp, M. musculus
atgctttccctgttcc

SEQ ID NO: 369133 - DNA, 16 bp, M. musculus
atgctttctttaaaat

SEQ ID NO: 369134 - DNA, 16 bp, M. musculus
atgctttcttttatcc

SEQ ID NO: 369135 - DNA, 16 bp, M. musculus
atgctttgcccacctg

SEQ ID NO: 369136 - DNA, 16 bp, M. musculus
atgctttgctaaagca

SEQ ID NO: 369137 - DNA, 16 bp, M. musculus
atgctttggtccttct

SEQ ID NO: 369138 - DNA, 16 bp, M. musculus
atgcttttaaagaaat

SEQ ID NO: 369139 - DNA, 16 bp, M. musculus
atgcttttaatcccag

SEQ ID NO: 369140 - DNA, 16 bp, M. musculus
atgcttttacacagtg

SEQ ID NO: 369141 - DNA, 16 bp, M. musculus
atgcttttacccactg

SEQ ID NO: 369142 - DNA, 16 bp, M. musculus
atgcttttgtttagaa

SEQ ID NO: 369143 - DNA, 16 bp, M. musculus
atgctttttaaaattt

SEQ ID NO: 369144 - DNA, 16 bp, M. musculus
atggaaaaaggaagct

SEQ ID NO: 369145 - DNA, 16 bp, M. musculus
atggaaaaagttacag

SEQ ID NO: 369146 - DNA, 16 bp, M. musculus
atggaaaacaatgaaa

SEQ ID NO: 369147 - DNA, 16 bp, M. musculus
atggaaaacatcaaca

SEQ ID NO: 369148 - DNA, 16 bp, M. musculus
atggaaaacgccaaca

SEQ ID NO: 369149 - DNA, 16 bp, M. musculus
atggaaaactccaaca

SEQ ID NO: 369150 - DNA, 16 bp, M. musculus
atggaaaatatatttt

SEQ ID NO: 369151 - DNA, 16 bp, M. musculus
atggaaaatgagaaat

SEQ ID NO: 369152 - DNA, 16 bp, M. musculus
atggaaaatgcaaaaa

SEQ ID NO: 369153 - DNA, 16 bp, M. musculus
atggaaacaaaatgaa

SEQ ID NO: 369154 - DNA, 16 bp, M. musculus
atggaaacacacctct

SEQ ID NO: 369155 - DNA, 16 bp, M. musculus
atggaaacacatgtaa

SEQ ID NO: 369156 - DNA, 16 bp, M. musculus
atggaaacagaaaatg

SEQ ID NO: 369157 - DNA, 16 bp, M. musculus
atggaaaccacaccct

SEQ ID NO: 369158 - DNA, 16 bp, M. musculus
atggaaactggtctcc

SEQ ID NO: 369159 - DNA, 16 bp, M. musculus
atggaaagaacaattt

SEQ ID NO: 369160 - DNA, 16 bp, M. musculus
atggaaagaacccaga

SEQ ID NO: 369161 - DNA, 16 bp, M. musculus
atggaaagagagacaa

SEQ ID NO: 369162 - DNA, 16 bp, M. musculus
atggaaagattgtaag

SEQ ID NO: 369163 - DNA, 16 bp, M. musculus
atggaaaggagcctga

SEQ ID NO: 369164 - DNA, 16 bp, M. musculus
atggaaagtgaacaac

SEQ ID NO: 369165 - DNA, 16 bp, M. musculus
atggaaatagaaaaca

SEQ ID NO: 369166 - DNA, 16 bp, M. musculus
atggaaatcaaaataa

SEQ ID NO: 369167 - DNA, 16 bp, M. musculus
atggaaatcctgcagc

SEQ ID NO: 369168 - DNA, 16 bp, M. musculus
atggaaatgaacagca

SEQ ID NO: 369169 - DNA, 16 bp, M. musculus
atggaaatggggagga

SEQ ID NO: 369170 - DNA, 16 bp, M. musculus
atggaaatgtaaatca

SEQ ID NO: 369171 - DNA, 16 bp, M. musculus
atggaaattgagagga

SEQ ID NO: 369172 - DNA, 16 bp, M. musculus
atggaacaaaatggct

SEQ ID NO: 369173 - DNA, 16 bp, M. musculus
atggaacacacacaca

SEQ ID NO: 369174 - DNA, 16 bp, M. musculus
atggaacacagggccc

SEQ ID NO: 369175 - DNA, 16 bp, M. musculus
atggaacagaaattga

SEQ ID NO: 369176 - DNA, 16 bp, M. musculus
atggaacccagggcct

SEQ ID NO: 369177 - DNA, 16 bp, M. musculus
atggaacccagggctt

SEQ ID NO: 369178 - DNA, 16 bp, M. musculus
atggaacttgaagagg

SEQ ID NO: 369179 - DNA, 16 bp, M. musculus
atggaagaagaaaact

SEQ ID NO: 369180 - DNA, 16 bp, M. musculus
atggaagaatgaatac

SEQ ID NO: 369181 - DNA, 16 bp, M. musculus
atggaagacaccaaga

SEQ ID NO: 369182 - DNA, 16 bp, M. musculus
atggaagacagaagag

SEQ ID NO: 369183 - DNA, 16 bp, M. musculus
atggaagacagaatct

SEQ ID NO: 369184 - DNA, 16 bp, M. musculus
atggaagagagaacct

SEQ ID NO: 369185 - DNA, 44 bp, M. musculus
atggaagagagaatctcaggtgcagaagattccatagagaacat

SEQ ID NO: 369186 - DNA, 16 bp, M. musculus
atggaagaggaggcag

SEQ ID NO: 369187 - DNA, 16 bp, M. musculus
atggaagatgaagagc

SEQ ID NO: 369188 - DNA, 16 bp, M. musculus
atggaagatgtcacat

SEQ ID NO: 369189 - DNA, 16 bp, M. musculus
atggaagcatcaccaa

SEQ ID NO: 369190 - DNA, 16 bp, M. musculus
atggaagcatttctaa

SEQ ID NO: 369191 - DNA, 16 bp, M. musculus
atggaagccaaaagag

SEQ ID NO: 369192 - DNA, 16 bp, M. musculus
atggaaggagaagccc

SEQ ID NO: 369193 - DNA, 16 bp, M. musculus
atggaaggagtgacag

SEQ ID NO: 369194 - DNA, 16 bp, M. musculus
atggaagggtccagat

SEQ ID NO: 369195 - DNA, 16 bp, M. musculus
atggaagggtttggag

SEQ ID NO: 369196 - DNA, 16 bp, M. musculus
atggaagggttttttt

SEQ ID NO: 369197 - DNA, 16 bp, M. musculus
atggaagtgaaagatc

SEQ ID NO: 369198 - DNA, 16 bp, M. musculus
atggaatactacacag

SEQ ID NO: 369199 - DNA, 16 bp, M. musculus
atggaatagtttgaag

SEQ ID NO: 369200 - DNA, 16 bp, M. musculus
atggaatggaattgaa

SEQ ID NO: 369201 - DNA, 16 bp, M. musculus
atggaatggatacaga

SEQ ID NO: 369202 - DNA, 16 bp, M. musculus
atggaatgtaaataaa

SEQ ID NO: 369203 - DNA, 16 bp, M. musculus
atggaatgtttcagtc

SEQ ID NO: 369204 - DNA, 16 bp, M. musculus
atggaattcttagaca

SEQ ID NO: 369205 - DNA, 16 bp, M. musculus
atggaatttgaaaata

SEQ ID NO: 369206 - DNA, 16 bp, M. musculus
atggacaatggcctca

SEQ ID NO: 369207 - DNA, 16 bp, M. musculus
atggacacagaaaata

SEQ ID NO: 369208 - DNA, 16 bp, M. musculus
atggacacatggacac

SEQ ID NO: 369209 - DNA, 16 bp, M. musculus
atggacagaaacttga

SEQ ID NO: 369210 - DNA, 16 bp, M. musculus
atggacagacaggcag

SEQ ID NO: 369211 - DNA, 16 bp, M. musculus
atggacagagaggcaa

SEQ ID NO: 369212 - DNA, 28 bp, M. musculus
atggacagatcatggaaacagaaactaa

SEQ ID NO: 369213 - DNA, 17 bp, M. musculus
atggacagatcctagaa

SEQ ID NO: 369214 - DNA, 16 bp, M. musculus
atggacagatgggtgg

SEQ ID NO: 369215 - DNA, 16 bp, M. musculus
atggacagattttttt

SEQ ID NO: 369216 - DNA, 16 bp, M. musculus
atggacagctgtgagc

SEQ ID NO: 369217 - DNA, 16 bp, M. musculus
atggacaggtgggtgg

SEQ ID NO: 369218 - DNA, 16 bp, M. musculus
atggacagtactgcta

SEQ ID NO: 369219 - DNA, 16 bp, M. musculus
atggacatctggggtg

SEQ ID NO: 369220 - DNA, 16 bp, M. musculus
atggacatgcaactaa

SEQ ID NO: 369221 - DNA, 16 bp, M. musculus
atggacatttcataga

SEQ ID NO: 369222 - DNA, 16 bp, M. musculus
atggacatttttaaaa

SEQ ID NO: 369223 - DNA, 16 bp, M. musculus
atggaccacagggtcc

SEQ ID NO: 369224 - DNA, 16 bp, M. musculus
atggaccaggctggcc

SEQ ID NO: 369225 - DNA, 16 bp, M. musculus
atggacctagaaaata

SEQ ID NO: 369226 - DNA, 16 bp, M. musculus
atggacctggagtgca

SEQ ID NO: 369227 - DNA, 16 bp, M. musculus
atggaccttgaattct

SEQ ID NO: 369228 - DNA, 16 bp, M. musculus
atggactatgtagaga

SEQ ID NO: 369229 - DNA, 16 bp, M. musculus
atggactcagcctctg

SEQ ID NO: 369230 - DNA, 16 bp, M. musculus
atggactgaagaccag

SEQ ID NO: 369231 - DNA, 18 bp, M. musculus
atggactgctgttatgtg

SEQ ID NO: 369232 - DNA, 16 bp, M. musculus
atggactggaaagatg

SEQ ID NO: 369233 - DNA, 16 bp, M. musculus
atggacttgccagcaa

SEQ ID NO: 369234 - DNA, 16 bp, M. musculus
atggactttttaattg

SEQ ID NO: 369235 - DNA, 16 bp, M. musculus
atggagaaaagttgac

SEQ ID NO: 369236 - DNA, 16 bp, M. musculus
atggagaaaatatcta

SEQ ID NO: 369237 - DNA, 16 bp, M. musculus
atggagaaaatgcctt

SEQ ID NO: 369238 - DNA, 16 bp, M. musculus
atggagaaactgaggc

SEQ ID NO: 369239 - DNA, 16 bp, M. musculus
atggagaaagaagaac

SEQ ID NO: 369240 - DNA, 16 bp, M. musculus
atggagaaagaggaac

SEQ ID NO: 369241 - DNA, 16 bp, M. musculus
atggagaacaagccag

SEQ ID NO: 369242 - DNA, 16 bp, M. musculus
atggagaagaacctga

SEQ ID NO: 369243 - DNA, 16 bp, M. musculus
atggagaagaatgtga

SEQ ID NO: 369244 - DNA, 16 bp, M. musculus
atggagaagagaatga

SEQ ID NO: 369245 - DNA, 16 bp, M. musculus
atggagaagagacaga

SEQ ID NO: 369246 - DNA, 16 bp, M. musculus
atggagaagagattga

SEQ ID NO: 369247 - DNA, 16 bp, M. musculus
atggagaagagcctga

SEQ ID NO: 369248 - DNA, 16 bp, M. musculus
atggagaagatcctga

SEQ ID NO: 369249 - DNA, 16 bp, M. musculus
atggagaagcaaacat

SEQ ID NO: 369250 - DNA, 16 bp, M. musculus
atggagaagccaagat

SEQ ID NO: 369251 - DNA, 16 bp, M. musculus
atggagaagccagaga

SEQ ID NO: 369252 - DNA, 16 bp, M. musculus
atggagaagctacaga

SEQ ID NO: 369253 - DNA, 16 bp, M. musculus
atggagaagctagaaa

SEQ ID NO: 369254 - DNA, 16 bp, M. musculus
atggagaaggacctga

SEQ ID NO: 369255 - DNA, 16 bp, M. musculus
atggagaagttggaga

SEQ ID NO: 369256 - DNA, 16 bp, M. musculus
atggagacaagacagt

SEQ ID NO: 369257 - DNA, 16 bp, M. musculus
atggagacagacagat

SEQ ID NO: 369258 - DNA, 16 bp, M. musculus
atggagactgcattga

SEQ ID NO: 369259 - DNA, 16 bp, M. musculus
atggagagaaatttga

SEQ ID NO: 369260 - DNA, 16 bp, M. musculus
atggagagagacagag

SEQ ID NO: 369261 - DNA, 16 bp, M. musculus
atggagagagtgaaca

SEQ ID NO: 369262 - DNA, 16 bp, M. musculus
atggagaggaaccact

SEQ ID NO: 369263 - DNA, 16 bp, M. musculus
atggagaggaggctga

SEQ ID NO: 369264 - DNA, 16 bp, M. musculus
atggagaggagtctga

SEQ ID NO: 369265 - DNA, 16 bp, M. musculus
atggagaggtgggaaa

SEQ ID NO: 369266 - DNA, 16 bp, M. musculus
atggagatagaaacaa

SEQ ID NO: 369267 - DNA, 16 bp, M. musculus
atggagatgcagagtt

SEQ ID NO: 369268 - DNA, 16 bp, M. musculus
atggagatggagagga

SEQ ID NO: 369269 - DNA, 16 bp, M. musculus
atggagatggaggatg

SEQ ID NO: 369270 - DNA, 16 bp, M. musculus
atggagcacagggccc

SEQ ID NO: 369271 - DNA, 16 bp, M. musculus
atggagcagaaactga

SEQ ID NO: 369272 - DNA, 16 bp, M. musculus
atggagcagaattgaa

SEQ ID NO: 369273 - DNA, 16 bp, M. musculus
atggagcaggtcttcc

SEQ ID NO: 369274 - DNA, 16 bp, M. musculus
atggagcatgccttta

SEQ ID NO: 369275 - DNA, 16 bp, M. musculus
atggagcccaggctga

SEQ ID NO: 369276 - DNA, 25 bp, M. musculus
atggagccgagatgggagatccttt

SEQ ID NO: 369277 - DNA, 16 bp, M. musculus
atggagcctgaaccag

SEQ ID NO: 369278 - DNA, 16 bp, M. musculus
atggagctgagactga

SEQ ID NO: 369279 - DNA, 16 bp, M. musculus
atggagctggagaagg

SEQ ID NO: 369280 - DNA, 16 bp, M. musculus
atggagcttggggagt

SEQ ID NO: 369281 - DNA, 16 bp, M. musculus
atggaggaacactgtt

SEQ ID NO: 369282 - DNA, 16 bp, M. musculus
atggaggaagaagatg

SEQ ID NO: 369283 - DNA, 16 bp, M. musculus
atggaggaatgtttct

SEQ ID NO: 369284 - DNA, 16 bp, M. musculus
atggaggacagcagag

SEQ ID NO: 369285 - DNA, 16 bp, M. musculus
atggaggagacagaga

SEQ ID NO: 369286 - DNA, 16 bp, M. musculus
atggaggagagctgct

SEQ ID NO: 369287 - DNA, 17 bp, M. musculus
atggaggagctagagaa

SEQ ID NO: 369288 - DNA, 16 bp, M. musculus
atggaggaggtagaga

SEQ ID NO: 369289 - DNA, 16 bp, M. musculus
atggaggagtgtgcct

SEQ ID NO: 369290 - DNA, 16 bp, M. musculus
atggaggcagagcact

SEQ ID NO: 369291 - DNA, 16 bp, M. musculus
atggaggcaggaggat

SEQ ID NO: 369292 - DNA, 16 bp, M. musculus
atggaggcatatagga

SEQ ID NO: 369293 - DNA, 16 bp, M. musculus
atggaggcatgttctt

SEQ ID NO: 369294 - DNA, 16 bp, M. musculus
atggaggcatttcctc

SEQ ID NO: 369295 - DNA, 16 bp, M. musculus
atggaggccagaaaag

SEQ ID NO: 369296 - DNA, 16 bp, M. musculus
atggaggccagagagg

SEQ ID NO: 369297 - DNA, 16 bp, M. musculus
atggagggacccaagg

SEQ ID NO: 369298 - DNA, 16 bp, M. musculus
atggagggagccatgg

SEQ ID NO: 369299 - DNA, 16 bp, M. musculus
atggaggtttctcaaa

SEQ ID NO: 369300 - DNA, 16 bp, M. musculus
atggagtcagcctggc

SEQ ID NO: 369301 - DNA, 16 bp, M. musculus
atggagtcatgacaaa

SEQ ID NO: 369302 - DNA, 16 bp, M. musculus
atggagtcctgacaaa

SEQ ID NO: 369303 - DNA, 16 bp, M. musculus
atggataaagaagatg

SEQ ID NO: 369304 - DNA, 16 bp, M. musculus
atggatacacagagaa

SEQ ID NO: 369305 - DNA, 16 bp, M. musculus
atggatacagaaatgt

SEQ ID NO: 369306 - DNA, 16 bp, M. musculus
atggatactgccatgc

SEQ ID NO: 369307 - DNA, 16 bp, M. musculus
atggatacttcagtcc

SEQ ID NO: 369308 - DNA, 16 bp, M. musculus
atggatagacagatga

SEQ ID NO: 369309 - DNA, 16 bp, M. musculus
atggatagatgatggg

SEQ ID NO: 369310 - DNA, 16 bp, M. musculus
atggatataaatatat

SEQ ID NO: 369311 - DNA, 16 bp, M. musculus
atggatatagaaaatg

SEQ ID NO: 369312 - DNA, 16 bp, M. musculus
atggatattctgtact

SEQ ID NO: 369313 - DNA, 16 bp, M. musculus
atggatattttgcctg

SEQ ID NO: 369314 - DNA, 17 bp, M. musculus
atggatcacaggcctcc

SEQ ID NO: 369315 - DNA, 19 bp, M. musculus
atggatcaggcggttgccc

SEQ ID NO: 369316 - DNA, 21 bp, M. musculus
atggatccacgtgctctcttt

SEQ ID NO: 369317 - DNA, 16 bp, M. musculus
atggatcccaagatgg

SEQ ID NO: 369318 - DNA, 18 bp, M. musculus
atggatctaaagtcactt

SEQ ID NO: 369319 - DNA, 16 bp, M. musculus
atggatctatttttat

SEQ ID NO: 369320 - DNA, 16 bp, M. musculus
atggatctggatggga

SEQ ID NO: 369321 - DNA, 16 bp, M. musculus
atggatctttgtgtgg

SEQ ID NO: 369322 - DNA, 16 bp, M. musculus
atggatgaagaaaatg

SEQ ID NO: 369323 - DNA, 16 bp, M. musculus
atggatgagtgagtga

SEQ ID NO: 369324 - DNA, 16 bp, M. musculus
atggatgagtgtgagc

SEQ ID NO: 369325 - DNA, 16 bp, M. musculus
atggatgcagaaaata

SEQ ID NO: 369326 - DNA, 17 bp, M. musculus
atggatgcagaaaatgt

SEQ ID NO: 369327 - DNA, 16 bp, M. musculus
atggatgctgggaaca

SEQ ID NO: 369328 - DNA, 16 bp, M. musculus
atggatggaaggatgg

SEQ ID NO: 369329 - DNA, 16 bp, M. musculus
atggatggacctgaag

SEQ ID NO: 369330 - DNA, 16 bp, M. musculus
atggatggaccttgag

SEQ ID NO: 369331 - DNA, 16 bp, M. musculus
atggatggagctggaa

SEQ ID NO: 369332 - DNA, 16 bp, M. musculus
atggatggagctggag

SEQ ID NO: 369333 - DNA, 16 bp, M. musculus
atggatggatagatga

SEQ ID NO: 369334 - DNA, 16 bp, M. musculus
atggatggatctgaag

SEQ ID NO: 369335 - DNA, 16 bp, M. musculus
atggatggatgaaagg

SEQ ID NO: 369336 - DNA, 16 bp, M. musculus
atggatggatggatgc

SEQ ID NO: 369337 - DNA, 16 bp, M. musculus
atggatggatggattg

SEQ ID NO: 369338 - DNA, 16 bp, M. musculus
atggatggctgtgagc

SEQ ID NO: 369339 - DNA, 16 bp, M. musculus
atggatggctgtgtgc

SEQ ID NO: 369340 - DNA, 16 bp, M. musculus
atggatgggattagaa

SEQ ID NO: 369341 - DNA, 16 bp, M. musculus
atggatgggcagatgg

SEQ ID NO: 369342 - DNA, 16 bp, M. musculus
atggatgtgatggatg

SEQ ID NO: 369343 - DNA, 16 bp, M. musculus
atggatgttactcatg

SEQ ID NO: 369344 - DNA, 16 bp, M. musculus
atggatgttttgccta

SEQ ID NO: 369345 - DNA, 16 bp, M. musculus
atggattctggggatc

SEQ ID NO: 369346 - DNA, 16 bp, M. musculus
atggattggcagaatc

SEQ ID NO: 369347 - DNA, 16 bp, M. musculus
atggatttgaagctga

SEQ ID NO: 369348 - DNA, 16 bp, M. musculus
atggatttggggactt

SEQ ID NO: 369349 - DNA, 16 bp, M. musculus
atggatttttttcata

SEQ ID NO: 369350 - DNA, 16 bp, M. musculus
atggattttttttcct

SEQ ID NO: 369351 - DNA, 16 bp, M. musculus
atggcaaaaacaaaca

SEQ ID NO: 369352 - DNA, 16 bp, M. musculus
atggcaaaaagcaaac

SEQ ID NO: 369353 - DNA, 17 bp, M. musculus
atggcaaaaggcaaaca

SEQ ID NO: 369354 - DNA, 16 bp, M. musculus
atggcaaacttaaagc

SEQ ID NO: 369355 - DNA, 16 bp, M. musculus
atggcaaagccttcct

SEQ ID NO: 369356 - DNA, 16 bp, M. musculus
atggcaacctcatccc

SEQ ID NO: 369357 - DNA, 16 bp, M. musculus
atggcaaggagcatgg

SEQ ID NO: 369358 - DNA, 16 bp, M. musculus
atggcaaggccatcct

SEQ ID NO: 369359 - DNA, 16 bp, M. musculus
atggcaagtcatatct

SEQ ID NO: 369360 - DNA, 16 bp, M. musculus
atggcaattgcattga

SEQ ID NO: 369361 - DNA, 16 bp, M. musculus
atggcacacacctgta

SEQ ID NO: 369362 - DNA, 16 bp, M. musculus
atggcaccatccaggc

SEQ ID NO: 369363 - DNA, 16 bp, M. musculus
atggcactgcccacag

SEQ ID NO: 369364 - DNA, 16 bp, M. musculus
atggcagaaggagaga

SEQ ID NO: 369365 - DNA, 16 bp, M. musculus
atggcagaccagtgac

SEQ ID NO: 369366 - DNA, 16 bp, M. musculus
atggcagagaacatgg

SEQ ID NO: 369367 - DNA, 16 bp, M. musculus
atggcagagaagaacc

SEQ ID NO: 369368 - DNA, 17 bp, M. musculus
atggcagagaagtacct

SEQ ID NO: 369369 - DNA, 16 bp, M. musculus
atggcagagaggagag

SEQ ID NO: 369370 - DNA, 16 bp, M. musculus
atggcagaggcaggca

SEQ ID NO: 369371 - DNA, 16 bp, M. musculus
atggcagcacaaaaca

SEQ ID NO: 369372 - DNA, 16 bp, M. musculus
atggcagcactggctg

SEQ ID NO: 369373 - DNA, 16 bp, M. musculus
atggcagcatccaggc

SEQ ID NO: 369374 - DNA, 16 bp, M. musculus
atggcagcccacaacc

SEQ ID NO: 369375 - DNA, 16 bp, M. musculus
atggcagctcaaaact

SEQ ID NO: 369376 - DNA, 16 bp, M. musculus
atggcaggaacatggc

SEQ ID NO: 369377 - DNA, 16 bp, M. musculus
atggcaggaaccatgg

SEQ ID NO: 369378 - DNA, 16 bp, M. musculus
atggcaggaagcatgg

SEQ ID NO: 369379 - DNA, 16 bp, M. musculus
atggcaggaatcatgg

SEQ ID NO: 369380 - DNA, 16 bp, M. musculus
atggcaggatccaggc

SEQ ID NO: 369381 - DNA, 16 bp, M. musculus
atggcaggcaggcagg

SEQ ID NO: 369382 - DNA, 16 bp, M. musculus
atggcaggtgtgtgtg

SEQ ID NO: 369383 - DNA, 16 bp, M. musculus
atggcagtgttcaggc

SEQ ID NO: 369384 - DNA, 16 bp, M. musculus
atggcatcttctcctc

SEQ ID NO: 369385 - DNA, 16 bp, M. musculus
atggcatgatcctgaa

SEQ ID NO: 369386 - DNA, 16 bp, M. musculus
atggcattttcttttt

SEQ ID NO: 369387 - DNA, 18 bp, M. musculus
atggccaaacttagagaa

SEQ ID NO: 369388 - DNA, 16 bp, M. musculus
atggccaacgaggcca

SEQ ID NO: 369389 - DNA, 16 bp, M. musculus
atggccaacttggcca

SEQ ID NO: 369390 - DNA, 16 bp, M. musculus
atggccaagaagcaca

SEQ ID NO: 369391 - DNA, 16 bp, M. musculus
atggccaaggcaactt

SEQ ID NO: 369392 - DNA, 16 bp, M. musculus
atggccactccagctt

SEQ ID NO: 369393 - DNA, 16 bp, M. musculus
atggccacttggagag

SEQ ID NO: 369394 - DNA, 16 bp, M. musculus
atggccagccagccta

SEQ ID NO: 369395 - DNA, 16 bp, M. musculus
atggccagtctctctt

SEQ ID NO: 369396 - DNA, 16 bp, M. musculus
atggccatgaacatca

SEQ ID NO: 369397 - DNA, 16 bp, M. musculus
atggccatgagaatga

SEQ ID NO: 369398 - DNA, 16 bp, M. musculus
atggccatggctggcc

SEQ ID NO: 369399 - DNA, 16 bp, M. musculus
atggcccaccatgcca

SEQ ID NO: 369400 - DNA, 16 bp, M. musculus
atggcccagcccactg

SEQ ID NO: 369401 - DNA, 16 bp, M. musculus
atggccccatccctca

SEQ ID NO: 369402 - DNA, 16 bp, M. musculus
atggcccctgcatcag

SEQ ID NO: 369403 - DNA, 16 bp, M. musculus
atggcctatgaccgct

SEQ ID NO: 369404 - DNA, 16 bp, M. musculus
atggcctcaaacttgc

SEQ ID NO: 369405 - DNA, 18 bp, M. musculus
atggcctccaaggagtaa

SEQ ID NO: 369406 - DNA, 16 bp, M. musculus
atggcctctgcctcag

SEQ ID NO: 369407 - DNA, 16 bp, M. musculus
atggcctgtgctctgc

SEQ ID NO: 369408 - DNA, 16 bp, M. musculus
atggccttcagtggca

SEQ ID NO: 369409 - DNA, 16 bp, M. musculus
atggcctttctccaca

SEQ ID NO: 369410 - DNA, 16 bp, M. musculus
atggccttttcttcag

SEQ ID NO: 369411 - DNA, 46 bp, M. musculus
atggcgaaaggcaaacgtaagaatcctactaacagaaatcaagacc

SEQ ID NO: 369412 - DNA, 19 bp, M. musculus
atggcgaaaggtaaatgta

SEQ ID NO: 369413 - DNA, 16 bp, M. musculus
atggcgaaagtgagtt

SEQ ID NO: 369414 - DNA, 16 bp, M. musculus
atggcgccgcctcaga

SEQ ID NO: 369415 - DNA, 16 bp, M. musculus
atggcggaaggagaga

SEQ ID NO: 369416 - DNA, 16 bp, M. musculus
atggcgtttgtggctt

SEQ ID NO: 369417 - DNA, 16 bp, M. musculus
atggctaaagatgttg

SEQ ID NO: 369418 - DNA, 16 bp, M. musculus
atggctaagcaggtaa

SEQ ID NO: 369419 - DNA, 16 bp, M. musculus
atggctactccagatt

SEQ ID NO: 369420 - DNA, 16 bp, M. musculus
atggctactcctgctt

SEQ ID NO: 369421 - DNA, 16 bp, M. musculus
atggctattcttggtt

SEQ ID NO: 369422 - DNA, 16 bp, M. musculus
atggctatttctggtt

SEQ ID NO: 369423 - DNA, 16 bp, M. musculus
atggctcaacaggtaa

SEQ ID NO: 369424 - DNA, 16 bp, M. musculus
atggctcaataggtaa

SEQ ID NO: 369425 - DNA, 16 bp, M. musculus
atggctcaatgggtaa

SEQ ID NO: 369426 - DNA, 16 bp, M. musculus
atggctcacaaccacc

SEQ ID NO: 369427 - DNA, 16 bp, M. musculus
atggctcacaaccatc

SEQ ID NO: 369428 - DNA, 16 bp, M. musculus
atggctcagagaccta

SEQ ID NO: 369429 - DNA, 16 bp, M. musculus
atggctcagagggcaa

SEQ ID NO: 369430 - DNA, 16 bp, M. musculus
atggctcagaggtaga

SEQ ID NO: 369431 - DNA, 16 bp, M. musculus
atggctcagaggttag

SEQ ID NO: 369432 - DNA, 16 bp, M. musculus
atggctcagcaattaa

SEQ ID NO: 369433 - DNA, 16 bp, M. musculus
atggctcagcagctga

SEQ ID NO: 369434 - DNA, 16 bp, M. musculus
atggctcagcaggcaa

SEQ ID NO: 369435 - DNA, 16 bp, M. musculus
atggctcagcagtgaa

SEQ ID NO: 369436 - DNA, 16 bp, M. musculus
atggctcagcagttac

SEQ ID NO: 369437 - DNA, 16 bp, M. musculus
atggctcagcagttag

SEQ ID NO: 369438 - DNA, 16 bp, M. musculus
atggctcagcagttgg

SEQ ID NO: 369439 - DNA, 16 bp, M. musculus
atggctcagtgactaa

SEQ ID NO: 369440 - DNA, 16 bp, M. musculus
atggctcagtgagtaa

SEQ ID NO: 369441 - DNA, 16 bp, M. musculus
atggctcagtgatgat

SEQ ID NO: 369442 - DNA, 16 bp, M. musculus
atggctcagtggcaga

SEQ ID NO: 369443 - DNA, 16 bp, M. musculus
atggctcagtggctaa

SEQ ID NO: 369444 - DNA, 16 bp, M. musculus
atggctcagtgggcta

SEQ ID NO: 369445 - DNA, 18 bp, M. musculus
atggctcagtggttaaag

SEQ ID NO: 369446 - DNA, 16 bp, M. musculus
atggctcattgggtaa

SEQ ID NO: 369447 - DNA, 16 bp, M. musculus
atggctccagctgcat

SEQ ID NO: 369448 - DNA, 16 bp, M. musculus
atggctccagctgctt

SEQ ID NO: 369449 - DNA, 16 bp, M. musculus
atggctcccactacat

SEQ ID NO: 369450 - DNA, 18 bp, M. musculus
atggctcccccaggtgct

SEQ ID NO: 369451 - DNA, 16 bp, M. musculus
atggctccctccatgt

SEQ ID NO: 369452 - DNA, 16 bp, M. musculus
atggctcctgagaaat

SEQ ID NO: 369453 - DNA, 16 bp, M. musculus
atggctcctttacctg

SEQ ID NO: 369454 - DNA, 16 bp, M. musculus
atggctcggcggttaa

SEQ ID NO: 369455 - DNA, 16 bp, M. musculus
atggctctcctcagag

SEQ ID NO: 369456 - DNA, 17 bp, M. musculus
atggctctgaggtcatg

SEQ ID NO: 369457 - DNA, 16 bp, M. musculus
atggctctggccacat

SEQ ID NO: 369458 - DNA, 16 bp, M. musculus
atggctctgtagttaa

SEQ ID NO: 369459 - DNA, 16 bp, M. musculus
atggctctgtgagtaa

SEQ ID NO: 369460 - DNA, 16 bp, M. musculus
atggctctgtggtgta

SEQ ID NO: 369461 - DNA, 16 bp, M. musculus
atggctctgtggtgtg

SEQ ID NO: 369462 - DNA, 16 bp, M. musculus
atggctctgtgtgtgt

SEQ ID NO: 369463 - DNA, 16 bp, M. musculus
atggctgaagctgctg

SEQ ID NO: 369464 - DNA, 16 bp, M. musculus
atggctgagaagcatg

SEQ ID NO: 369465 - DNA, 16 bp, M. musculus
atggctgagcaagtgt

SEQ ID NO: 369466 - DNA, 16 bp, M. musculus
atggctgaggaagaaa

SEQ ID NO: 369467 - DNA, 16 bp, M. musculus
atggctgagtgggtaa

SEQ ID NO: 369468 - DNA, 16 bp, M. musculus
atggctgcctgaaaga

SEQ ID NO: 369469 - DNA, 16 bp, M. musculus
atggctgcgaagcacc

SEQ ID NO: 369470 - DNA, 16 bp, M. musculus
atggctgctccagctt

SEQ ID NO: 369471 - DNA, 16 bp, M. musculus
atggctgctctaggca

SEQ ID NO: 369472 - DNA, 16 bp, M. musculus
atggctgctggagaga

SEQ ID NO: 369473 - DNA, 16 bp, M. musculus
atggctgctggaggag

SEQ ID NO: 369474 - DNA, 16 bp, M. musculus
atggctgcttctattt

SEQ ID NO: 369475 - DNA, 16 bp, M. musculus
atggctgctttttttt

SEQ ID NO: 369476 - DNA, 16 bp, M. musculus
atggctggacttggta

SEQ ID NO: 369477 - DNA, 16 bp, M. musculus
atggctggattatata

SEQ ID NO: 369478 - DNA, 16 bp, M. musculus
atggctgggcagaaag

SEQ ID NO: 369479 - DNA, 16 bp, M. musculus
atggctggggagagag

SEQ ID NO: 369480 - DNA, 16 bp, M. musculus
atggctggtattgaat

SEQ ID NO: 369481 - DNA, 16 bp, M. musculus
atggctgtcctgagag

SEQ ID NO: 369482 - DNA, 16 bp, M. musculus
atggctgtctcctgtg

SEQ ID NO: 369483 - DNA, 16 bp, M. musculus
atggctgtggctgtgg

SEQ ID NO: 369484 - DNA, 16 bp, M. musculus
atggctgttttccctc

SEQ ID NO: 369485 - DNA, 16 bp, M. musculus
atggcttaatggttaa

SEQ ID NO: 369486 - DNA, 16 bp, M. musculus
atggcttagcaagtaa

SEQ ID NO: 369487 - DNA, 16 bp, M. musculus
atggcttagctgttaa

SEQ ID NO: 369488 - DNA, 16 bp, M. musculus
atggcttagtggctaa

SEQ ID NO: 369489 - DNA, 16 bp, M. musculus
atggcttcattttcat

SEQ ID NO: 369490 - DNA, 16 bp, M. musculus
atggcttccaggcagc

SEQ ID NO: 369491 - DNA, 16 bp, M. musculus
atggcttctgcatcag

SEQ ID NO: 369492 - DNA, 16 bp, M. musculus
atggcttctggtgggg

SEQ ID NO: 369493 - DNA, 16 bp, M. musculus
atggcttctgtgacag

SEQ ID NO: 369494 - DNA, 16 bp, M. musculus
atggcttctttactga

SEQ ID NO: 369495 - DNA, 16 bp, M. musculus
atggcttgatcctgaa

SEQ ID NO: 369496 - DNA, 17 bp, M. musculus
atggctttacaagattt

SEQ ID NO: 369497 - DNA, 16 bp, M. musculus
atggctttgaacttct

SEQ ID NO: 369498 - DNA, 16 bp, M. musculus
atggctttgtcaggca

SEQ ID NO: 369499 - DNA, 16 bp, M. musculus
atgggaaaacaaacaa

SEQ ID NO: 369500 - DNA, 16 bp, M. musculus
atgggaaaatatatat

SEQ ID NO: 369501 - DNA, 16 bp, M. musculus
atgggaaacaagccag

SEQ ID NO: 369502 - DNA, 16 bp, M. musculus
atgggaaaggacactt

SEQ ID NO: 369503 - DNA, 16 bp, M. musculus
atgggaaatgtaaatg

SEQ ID NO: 369504 - DNA, 16 bp, M. musculus
atgggaacaaatgcag

SEQ ID NO: 369505 - DNA, 16 bp, M. musculus
atgggaacaggggaaa

SEQ ID NO: 369506 - DNA, 16 bp, M. musculus
atgggaacagtattga

SEQ ID NO: 369507 - DNA, 16 bp, M. musculus
atgggaaccctaacta

SEQ ID NO: 369508 - DNA, 16 bp, M. musculus
atgggaagcatggtgg

SEQ ID NO: 369509 - DNA, 16 bp, M. musculus
atgggaagtgctacta

SEQ ID NO: 369510 - DNA, 20 bp, M. musculus
atgggaatctcaggacaatt

SEQ ID NO: 369511 - DNA, 33 bp, M. musculus
atgggacacaaatatcttcacatcctttgccca

SEQ ID NO: 369512 - DNA, 17 bp, M. musculus
atgggacagaccgtaac

SEQ ID NO: 369513 - DNA, 16 bp, M. musculus
atgggacagactgtat

SEQ ID NO: 369514 - DNA, 16 bp, M. musculus
atgggacagactgtgt

SEQ ID NO: 369515 - DNA, 20 bp, M. musculus
atgggacagccgctagtcat

SEQ ID NO: 369516 - DNA, 16 bp, M. musculus
atgggacatctatatc

SEQ ID NO: 369517 - DNA, 16 bp, M. musculus
atgggacccagggcct

SEQ ID NO: 369518 - DNA, 16 bp, M. musculus
atgggaccttctccaa

SEQ ID NO: 369519 - DNA, 16 bp, M. musculus
atgggactatttagat

SEQ ID NO: 369520 - DNA, 16 bp, M. musculus
atgggactcaagttgg

SEQ ID NO: 369521 - DNA, 16 bp, M. musculus
atgggactcagagctg

SEQ ID NO: 369522 - DNA, 16 bp, M. musculus
atgggactgggaggag

SEQ ID NO: 369523 - DNA, 16 bp, M. musculus
atgggagaaggaagct

SEQ ID NO: 369524 - DNA, 16 bp, M. musculus
atgggagagagcacag

SEQ ID NO: 369525 - DNA, 24 bp, M. musculus
atgggagatctttccatcttctga

SEQ ID NO: 369526 - DNA, 16 bp, M. musculus
atgggagatttttcca

SEQ ID NO: 369527 - DNA, 16 bp, M. musculus
atgggagcatcagcaa

SEQ ID NO: 369528 - DNA, 16 bp, M. musculus
atgggagccagtcttc

SEQ ID NO: 369529 - DNA, 16 bp, M. musculus
atgggaggctgagaca

SEQ ID NO: 369530 - DNA, 16 bp, M. musculus
atgggagggtttgaag

SEQ ID NO: 369531 - DNA, 16 bp, M. musculus
atgggaggtctcccct

SEQ ID NO: 369532 - DNA, 16 bp, M. musculus
atgggagtgctgggaa

SEQ ID NO: 369533 - DNA, 16 bp, M. musculus
atgggataaggggttt

SEQ ID NO: 369534 - DNA, 16 bp, M. musculus
atgggataggagattt

SEQ ID NO: 369535 - DNA, 16 bp, M. musculus
atgggatagggggttt

SEQ ID NO: 369536 - DNA, 16 bp, M. musculus
atgggatcatttcaat

SEQ ID NO: 369537 - DNA, 16 bp, M. musculus
atgggatcccatgccc

SEQ ID NO: 369538 - DNA, 17 bp, M. musculus
atgggatggaaccccgg

SEQ ID NO: 369539 - DNA, 16 bp, M. musculus
atgggatggatctcag

SEQ ID NO: 369540 - DNA, 16 bp, M. musculus
atgggatggctcagtg

SEQ ID NO: 369541 - DNA, 16 bp, M. musculus
atgggatgggggtttc

SEQ ID NO: 369542 - DNA, 16 bp, M. musculus
atgggattaaaagtgt

SEQ ID NO: 369543 - DNA, 16 bp, M. musculus
atgggatttctgtgtg

SEQ ID NO: 369544 - DNA, 16 bp, M. musculus
atgggcacaaggaaaa

SEQ ID NO: 369545 - DNA, 16 bp, M. musculus
atgggcacagggaaaa

SEQ ID NO: 369546 - DNA, 16 bp, M. musculus
atgggcacagggcaaa

SEQ ID NO: 369547 - DNA, 16 bp, M. musculus
atgggcacagggggaa

SEQ ID NO: 369548 - DNA, 16 bp, M. musculus
atgggcagaggaagct

SEQ ID NO: 369549 - DNA, 16 bp, M. musculus
atgggcagatggatgg

SEQ ID NO: 369550 - DNA, 16 bp, M. musculus
atgggcatagggaaaa

SEQ ID NO: 369551 - DNA, 16 bp, M. musculus
atgggcatctctttat

SEQ ID NO: 369552 - DNA, 16 bp, M. musculus
atgggcatggggaagg

SEQ ID NO: 369553 - DNA, 16 bp, M. musculus
atgggcatgtctgtgg

SEQ ID NO: 369554 - DNA, 16 bp, M. musculus
atgggccaagatggca

SEQ ID NO: 369555 - DNA, 16 bp, M. musculus
atgggccaccactgcc

SEQ ID NO: 369556 - DNA, 16 bp, M. musculus
atgggccaccatgcct

SEQ ID NO: 369557 - DNA, 22 bp, M. musculus
atgggcctaccctctttataag

SEQ ID NO: 369558 - DNA, 17 bp, M. musculus
atgggcctctatttcca

SEQ ID NO: 369559 - DNA, 16 bp, M. musculus
atgggcctctcctccc

SEQ ID NO: 369560 - DNA, 16 bp, M. musculus
atgggcctggtgctgt

SEQ ID NO: 369561 - DNA, 16 bp, M. musculus
atgggctccattcaga

SEQ ID NO: 369562 - DNA, 63 bp, M. musculus
atgggctcctcaggaaatgattctgcctatttggttgtatctttaaatgatagacctaagctc

SEQ ID NO: 369563 - DNA, 23 bp, M. musculus
atgggctgcagccaatcagggag

SEQ ID NO: 369564 - DNA, 16 bp, M. musculus
atgggctggaccaagg

SEQ ID NO: 369565 - DNA, 18 bp, M. musculus
atgggctgtatgctcctc

SEQ ID NO: 369566 - DNA, 16 bp, M. musculus
atgggctgtgccctcc

SEQ ID NO: 369567 - DNA, 16 bp, M. musculus
atggggaaaaaaatct

SEQ ID NO: 369568 - DNA, 16 bp, M. musculus
atggggaaaccgaggc

SEQ ID NO: 369569 - DNA, 16 bp, M. musculus
atggggaaactgaagc

SEQ ID NO: 369570 - DNA, 16 bp, M. musculus
atggggaaactgaggc

SEQ ID NO: 369571 - DNA, 16 bp, M. musculus
atggggaagagccttg

SEQ ID NO: 369572 - DNA, 16 bp, M. musculus
atggggaagcaggaac

SEQ ID NO: 369573 - DNA, 16 bp, M. musculus
atggggaagcaggagt

SEQ ID NO: 369574 - DNA, 23 bp, M. musculus
atggggaaggttctgtccaaaga

SEQ ID NO: 369575 - DNA, 16 bp, M. musculus
atggggactgcattga

SEQ ID NO: 369576 - DNA, 16 bp, M. musculus
atggggactttggaag

SEQ ID NO: 369577 - DNA, 16 bp, M. musculus
atggggattggaagtg

SEQ ID NO: 369578 - DNA, 16 bp, M. musculus
atggggcagaggaaat

SEQ ID NO: 369579 - DNA, 16 bp, M. musculus
atggggcatagaacct

SEQ ID NO: 369580 - DNA, 16 bp, M. musculus
atggggctgcaaaccc

SEQ ID NO: 369581 - DNA, 16 bp, M. musculus
atggggctggagagat

SEQ ID NO: 369582 - DNA, 16 bp, M. musculus
atgggggctggggaga

SEQ ID NO: 369583 - DNA, 26 bp, M. musculus
atggggggagatggccagcttcagta

SEQ ID NO: 369584 - DNA, 16 bp, M. musculus
atgggggtggggagca

SEQ ID NO: 369585 - DNA, 16 bp, M. musculus
atggggtgatgggtga

SEQ ID NO: 369586 - DNA, 16 bp, M. musculus
atggggttgcaaaccc

SEQ ID NO: 369587 - DNA, 16 bp, M. musculus
atggggttgccatccc

SEQ ID NO: 369588 - DNA, 16 bp, M. musculus
atgggtaaaggggaaa

SEQ ID NO: 369589 - DNA, 19 bp, M. musculus
atgggtactggccagtcta

SEQ ID NO: 369590 - DNA, 16 bp, M. musculus
atgggtatgggtggga

SEQ ID NO: 369591 - DNA, 16 bp, M. musculus
atgggtattgcattga

SEQ ID NO: 369592 - DNA, 16 bp, M. musculus
atgggtattttgatcc

SEQ ID NO: 369593 - DNA, 16 bp, M. musculus
atgggtattttgcttg

SEQ ID NO: 369594 - DNA, 16 bp, M. musculus
atgggtatttttgcct

SEQ ID NO: 369595 - DNA, 16 bp, M. musculus
atgggtccctgcatgt

SEQ ID NO: 369596 - DNA, 16 bp, M. musculus
atgggtctctgtgagt

SEQ ID NO: 369597 - DNA, 16 bp, M. musculus
atgggtgctgggagct

SEQ ID NO: 369598 - DNA, 16 bp, M. musculus
atgggtggatggatgg

SEQ ID NO: 369599 - DNA, 16 bp, M. musculus
atgggtgtctgtgtgt

SEQ ID NO: 369600 - DNA, 16 bp, M. musculus
atgggtgtgtgtgagt

SEQ ID NO: 369601 - DNA, 17 bp, M. musculus
atgggtgttttgttcca

SEQ ID NO: 369602 - DNA, 16 bp, M. musculus
atgggttccaggacag

SEQ ID NO: 369603 - DNA, 16 bp, M. musculus
atgggttctctctctc

SEQ ID NO: 369604 - DNA, 16 bp, M. musculus
atgggttctgagaact

SEQ ID NO: 369605 - DNA, 16 bp, M. musculus
atgggttcttggattc

SEQ ID NO: 369606 - DNA, 16 bp, M. musculus
atgggttttcctctta

SEQ ID NO: 369607 - DNA, 16 bp, M. musculus
atggtacagaaggagc

SEQ ID NO: 369608 - DNA, 16 bp, M. musculus
atggtacaggaggagc

SEQ ID NO: 369609 - DNA, 16 bp, M. musculus
atggtacctcatgaaa

SEQ ID NO: 369610 - DNA, 17 bp, M. musculus
atggtacctcttccaaa

SEQ ID NO: 369611 - DNA, 16 bp, M. musculus
atggtaccttctctaa

SEQ ID NO: 369612 - DNA, 30 bp, M. musculus
atggtactggtatagtgacagacaagtaga

SEQ ID NO: 369613 - DNA, 16 bp, M. musculus
atggtagaaggaaaga

SEQ ID NO: 369614 - DNA, 16 bp, M. musculus
atggtagatgacatca

SEQ ID NO: 369615 - DNA, 16 bp, M. musculus
atggtagattatattg

SEQ ID NO: 369616 - DNA, 16 bp, M. musculus
atggtagctcacaact

SEQ ID NO: 369617 - DNA, 16 bp, M. musculus
atggtagtacatacct

SEQ ID NO: 369618 - DNA, 16 bp, M. musculus
atggtagtgcacacct

SEQ ID NO: 369619 - DNA, 16 bp, M. musculus
atggtagtgcatgcct

SEQ ID NO: 369620 - DNA, 16 bp, M. musculus
atggtagtggtggtga

SEQ ID NO: 369621 - DNA, 16 bp, M. musculus
atggtatacagacata

SEQ ID NO: 369622 - DNA, 16 bp, M. musculus
atggtatctattcaca

SEQ ID NO: 369623 - DNA, 16 bp, M. musculus
atggtatcttctgccc

SEQ ID NO: 369624 - DNA, 16 bp, M. musculus
atggtatgcactcatt

SEQ ID NO: 369625 - DNA, 16 bp, M. musculus
atggtattggtacaga

SEQ ID NO: 369626 - DNA, 16 bp, M. musculus
atggtcaaagaagaaa

SEQ ID NO: 369627 - DNA, 16 bp, M. musculus
atggtcacaagaaaca

SEQ ID NO: 369628 - DNA, 16 bp, M. musculus
atggtcacctgatctt

SEQ ID NO: 369629 - DNA, 16 bp, M. musculus
atggtcacctttccct

SEQ ID NO: 369630 - DNA, 16 bp, M. musculus
atggtcacttatatat

SEQ ID NO: 369631 - DNA, 16 bp, M. musculus
atggtcagaattgaga

SEQ ID NO: 369632 - DNA, 16 bp, M. musculus
atggtcagttttgaag

SEQ ID NO: 369633 - DNA, 16 bp, M. musculus
atggtccacagaatca

SEQ ID NO: 369634 - DNA, 16 bp, M. musculus
atggtccatcctttag

SEQ ID NO: 369635 - DNA, 23 bp, M. musculus
atggtccatcctttcatctcagc

SEQ ID NO: 369636 - DNA, 18 bp, M. musculus
atggtccatcctttcgtc

SEQ ID NO: 369637 - DNA, 16 bp, M. musculus
atggtctacacagtga

SEQ ID NO: 369638 - DNA, 16 bp, M. musculus
atggtctcacacacac

SEQ ID NO: 369639 - DNA, 16 bp, M. musculus
atggtctcagccagcc

SEQ ID NO: 369640 - DNA, 16 bp, M. musculus
atggtctcagggaccc

SEQ ID NO: 369641 - DNA, 16 bp, M. musculus
atggtctctgcttcag

SEQ ID NO: 369642 - DNA, 16 bp, M. musculus
atggtctgtgtgtgtg

SEQ ID NO: 369643 - DNA, 16 bp, M. musculus
atggtcttaggtgaca

SEQ ID NO: 369644 - DNA, 16 bp, M. musculus
atggtctttccttcaa

SEQ ID NO: 369645 - DNA, 16 bp, M. musculus
atggtgaaactaagtt

SEQ ID NO: 369646 - DNA, 16 bp, M. musculus
atggtgaaaggagaaa

SEQ ID NO: 369647 - DNA, 16 bp, M. musculus
atggtgaaagtcagct

SEQ ID NO: 369648 - DNA, 16 bp, M. musculus
atggtgacatacacct

SEQ ID NO: 369649 - DNA, 16 bp, M. musculus
atggtgagaagatgga

SEQ ID NO: 369650 - DNA, 16 bp, M. musculus
atggtgagaagcagga

SEQ ID NO: 369651 - DNA, 16 bp, M. musculus
atggtgagtggtcttt

SEQ ID NO: 369652 - DNA, 16 bp, M. musculus
atggtgatacctccag

SEQ ID NO: 369653 - DNA, 16 bp, M. musculus
atggtgatgatgaaga

SEQ ID NO: 369654 - DNA, 16 bp, M. musculus
atggtgatggtgataa

SEQ ID NO: 369655 - DNA, 16 bp, M. musculus
atggtgatggtggtaa

SEQ ID NO: 369656 - DNA, 16 bp, M. musculus
atggtgatggtggtga

SEQ ID NO: 369657 - DNA, 16 bp, M. musculus
atggtgattacaccag

SEQ ID NO: 369658 - DNA, 16 bp, M. musculus
atggtgattccaccag

SEQ ID NO: 369659 - DNA, 16 bp, M. musculus
atggtgattggagcca

SEQ ID NO: 369660 - DNA, 16 bp, M. musculus
atggtgcaagaggagc

SEQ ID NO: 369661 - DNA, 16 bp, M. musculus
atggtgcacacacaca

SEQ ID NO: 369662 - DNA, 16 bp, M. musculus
atggtgcacacctgta

SEQ ID NO: 369663 - DNA, 16 bp, M. musculus
atggtgcaggaggagc

SEQ ID NO: 369664 - DNA, 16 bp, M. musculus
atggtgccacacacct

SEQ ID NO: 369665 - DNA, 16 bp, M. musculus
atggtgccctggccca

SEQ ID NO: 369666 - DNA, 16 bp, M. musculus
atggtgctatccctgg

SEQ ID NO: 369667 - DNA, 16 bp, M. musculus
atggtgctgcctcaga

SEQ ID NO: 369668 - DNA, 16 bp, M. musculus
atggtgctggaggagc

SEQ ID NO: 369669 - DNA, 16 bp, M. musculus
atggtgctggggatca

SEQ ID NO: 369670 - DNA, 16 bp, M. musculus
atggtggaaagagaaa

SEQ ID NO: 369671 - DNA, 16 bp, M. musculus
atggtggaaagagaac

SEQ ID NO: 369672 - DNA, 16 bp, M. musculus
atggtggaaattgtgg

SEQ ID NO: 369673 - DNA, 16 bp, M. musculus
atggtggaagaggaga

SEQ ID NO: 369674 - DNA, 16 bp, M. musculus
atggtggagatagaaa

SEQ ID NO: 369675 - DNA, 16 bp, M. musculus
atggtggatggagaga

SEQ ID NO: 369676 - DNA, 18 bp, M. musculus
atggtggcacacaccttt

SEQ ID NO: 369677 - DNA, 16 bp, M. musculus
atggtggcacatacct

SEQ ID NO: 369678 - DNA, 17 bp, M. musculus
atggtggcacatgcctg

SEQ ID NO: 369679 - DNA, 25 bp, M. musculus
atggtggcacatgcctttaatccca

SEQ ID NO: 369680 - DNA, 16 bp, M. musculus
atggtggcacatgtct

SEQ ID NO: 369681 - DNA, 16 bp, M. musculus
atggtggcacattcct

SEQ ID NO: 369682 - DNA, 16 bp, M. musculus
atggtggcacctgcct

SEQ ID NO: 369683 - DNA, 16 bp, M. musculus
atggtggcagaggcag

SEQ ID NO: 369684 - DNA, 16 bp, M. musculus
atggtggcccatgcct

SEQ ID NO: 369685 - DNA, 16 bp, M. musculus
atggtggctcacattt

SEQ ID NO: 369686 - DNA, 16 bp, M. musculus
atggtggctcagtggt

SEQ ID NO: 369687 - DNA, 16 bp, M. musculus
atggtggctctcaacc

SEQ ID NO: 369688 - DNA, 16 bp, M. musculus
atggtggctggctgtc

SEQ ID NO: 369689 - DNA, 16 bp, M. musculus
atggtggtacacacct

SEQ ID NO: 369690 - DNA, 16 bp, M. musculus
atggtggtacacactt

SEQ ID NO: 369691 - DNA, 16 bp, M. musculus
atggtggtagtggtag

SEQ ID NO: 369692 - DNA, 16 bp, M. musculus
atggtggtatacacct

SEQ ID NO: 369693 - DNA, 21 bp, M. musculus
atggtggtgcacgcctttaat

SEQ ID NO: 369694 - DNA, 16 bp, M. musculus
atggtggtgcatgcct

SEQ ID NO: 369695 - DNA, 16 bp, M. musculus
atggtggtgtacacct

SEQ ID NO: 369696 - DNA, 16 bp, M. musculus
atggtggttcatgcct

SEQ ID NO: 369697 - DNA, 16 bp, M. musculus
atggtgtctcttctca

SEQ ID NO: 369698 - DNA, 16 bp, M. musculus
atggtgtggtgacccc

SEQ ID NO: 369699 - DNA, 16 bp, M. musculus
atggtgtgtggtcttg

SEQ ID NO: 369700 - DNA, 16 bp, M. musculus
atggtgttttataaca

SEQ ID NO: 369701 - DNA, 16 bp, M. musculus
atggtgttttgaattt

SEQ ID NO: 369702 - DNA, 16 bp, M. musculus
atggttaagagcaccg

SEQ ID NO: 369703 - DNA, 18 bp, M. musculus
atggttcaatataaggaa

SEQ ID NO: 369704 - DNA, 16 bp, M. musculus
atggttcaatggataa

SEQ ID NO: 369705 - DNA, 16 bp, M. musculus
atggttcaggagtctg

SEQ ID NO: 369706 - DNA, 16 bp, M. musculus
atggttcaggctctaa

SEQ ID NO: 369707 - DNA, 16 bp, M. musculus
atggttcagtgggtaa

SEQ ID NO: 369708 - DNA, 16 bp, M. musculus
atggttccaagaaaca

SEQ ID NO: 369709 - DNA, 16 bp, M. musculus
atggttgactgtgagc

SEQ ID NO: 369710 - DNA, 16 bp, M. musculus
atggttggctgcaagc

SEQ ID NO: 369711 - DNA, 16 bp, M. musculus
atggttgtgagccaca

SEQ ID NO: 369712 - DNA, 29 bp, M. musculus
atggttgtgagccaccatgtggttgctga

SEQ ID NO: 369713 - DNA, 16 bp, M. musculus
atggttgtgagccacg

SEQ ID NO: 369714 - DNA, 16 bp, M. musculus
atggttgtgagccact

SEQ ID NO: 369715 - DNA, 16 bp, M. musculus
atggttgtgggctacc

SEQ ID NO: 369716 - DNA, 16 bp, M. musculus
atggtttatctgatac

SEQ ID NO: 369717 - DNA, 16 bp, M. musculus
atggtttattttggct

SEQ ID NO: 369718 - DNA, 16 bp, M. musculus
atggtttcctgcccct

SEQ ID NO: 369719 - DNA, 16 bp, M. musculus
atggtttctttggaaa

SEQ ID NO: 369720 - DNA, 16 bp, M. musculus
atggtttgaatatgaa

SEQ ID NO: 369721 - DNA, 16 bp, M. musculus
atggtttgtataagct

SEQ ID NO: 369722 - DNA, 16 bp, M. musculus
atggtttgtatatggt

SEQ ID NO: 369723 - DNA, 16 bp, M. musculus
atggtttgtatgtgct

SEQ ID NO: 369724 - DNA, 16 bp, M. musculus
atggttttagagcatt

SEQ ID NO: 369725 - DNA, 16 bp, M. musculus
atggttttattcatcc

SEQ ID NO: 369726 - DNA, 16 bp, M. musculus
atggttttcttcattt

SEQ ID NO: 369727 - DNA, 16 bp, M. musculus
atggttttggcttttt

SEQ ID NO: 369728 - DNA, 16 bp, M. musculus
atggttttgttcaaat

SEQ ID NO: 369729 - DNA, 16 bp, M. musculus
atggttttgttcaatt

SEQ ID NO: 369730 - DNA, 16 bp, M. musculus
atggttttgtttctgt

SEQ ID NO: 369731 - DNA, 16 bp, M. musculus
atgtaaaaaggacaca

SEQ ID NO: 369732 - DNA, 16 bp, M. musculus
atgtaaacacacagag

SEQ ID NO: 369733 - DNA, 16 bp, M. musculus
atgtaaacattttaaa

SEQ ID NO: 369734 - DNA, 16 bp, M. musculus
atgtaaaccaggctgg

SEQ ID NO: 369735 - DNA, 16 bp, M. musculus
atgtaaagtgaataaa

SEQ ID NO: 369736 - DNA, 16 bp, M. musculus
atgtaaatatatatgt

SEQ ID NO: 369737 - DNA, 16 bp, M. musculus
atgtaaatatctggta

SEQ ID NO: 369738 - DNA, 16 bp, M. musculus
atgtaaatatgttaca

SEQ ID NO: 369739 - DNA, 16 bp, M. musculus
atgtaaatattttctt

SEQ ID NO: 369740 - DNA, 16 bp, M. musculus
atgtaaatgaagaaca

SEQ ID NO: 369741 - DNA, 16 bp, M. musculus
atgtaaatgaagcaaa

SEQ ID NO: 369742 - DNA, 16 bp, M. musculus
atgtaaatgtaaatat

SEQ ID NO: 369743 - DNA, 16 bp, M. musculus
atgtaaatttctgata

SEQ ID NO: 369744 - DNA, 16 bp, M. musculus
atgtaacaacaattaa

SEQ ID NO: 369745 - DNA, 16 bp, M. musculus
atgtaacaacagttaa

SEQ ID NO: 369746 - DNA, 16 bp, M. musculus
atgtaacatcaattaa

SEQ ID NO: 369747 - DNA, 16 bp, M. musculus
atgtaaccctctcagt

SEQ ID NO: 369748 - DNA, 16 bp, M. musculus
atgtaacttttatttg

SEQ ID NO: 369749 - DNA, 16 bp, M. musculus
atgtaactttttaaaa

SEQ ID NO: 369750 - DNA, 17 bp, M. musculus
atgtaagactcccataa

SEQ ID NO: 369751 - DNA, 16 bp, M. musculus
atgtaagccaaacaaa

SEQ ID NO: 369752 - DNA, 16 bp, M. musculus
atgtaagggcacccac

SEQ ID NO: 369753 - DNA, 16 bp, M. musculus
atgtaagtgcactgta

SEQ ID NO: 369754 - DNA, 16 bp, M. musculus
atgtaagtgctgggaa

SEQ ID NO: 369755 - DNA, 16 bp, M. musculus
atgtaagtgtgtgtgt

SEQ ID NO: 369756 - DNA, 16 bp, M. musculus
atgtaataaggacaca

SEQ ID NO: 369757 - DNA, 16 bp, M. musculus
atgtaatagaacaagg

SEQ ID NO: 369758 - DNA, 16 bp, M. musculus
atgtaatatgtgtgtg

SEQ ID NO: 369759 - DNA, 16 bp, M. musculus
atgtaatgccaaggct

SEQ ID NO: 369760 - DNA, 16 bp, M. musculus
atgtaatgtgtgtgtg

SEQ ID NO: 369761 - DNA, 16 bp, M. musculus
atgtaattattgtttg

SEQ ID NO: 369762 - DNA, 16 bp, M. musculus
atgtaattctatttta

SEQ ID NO: 369763 - DNA, 16 bp, M. musculus
atgtaattttaaaatg

SEQ ID NO: 369764 - DNA, 16 bp, M. musculus
atgtaatttttgaaca

SEQ ID NO: 369765 - DNA, 16 bp, M. musculus
atgtacaaaacaaaga

SEQ ID NO: 369766 - DNA, 16 bp, M. musculus
atgtacaagaagctta

SEQ ID NO: 369767 - DNA, 16 bp, M. musculus
atgtacacacaaaata

SEQ ID NO: 369768 - DNA, 16 bp, M. musculus
atgtacacacacacat

SEQ ID NO: 369769 - DNA, 16 bp, M. musculus
atgtacacacaggcac

SEQ ID NO: 369770 - DNA, 16 bp, M. musculus
atgtacacagacacat

SEQ ID NO: 369771 - DNA, 16 bp, M. musculus
atgtacacatttgtgt

SEQ ID NO: 369772 - DNA, 16 bp, M. musculus
atgtacagaaggtcag

SEQ ID NO: 369773 - DNA, 16 bp, M. musculus
atgtacataaaataaa

SEQ ID NO: 369774 - DNA, 16 bp, M. musculus
atgtacataatatatt

SEQ ID NO: 369775 - DNA, 16 bp, M. musculus
atgtacatacacacaa

SEQ ID NO: 369776 - DNA, 16 bp, M. musculus
atgtacatagacacac

SEQ ID NO: 369777 - DNA, 16 bp, M. musculus
atgtacatatataatt

SEQ ID NO: 369778 - DNA, 16 bp, M. musculus
atgtacatatgtatta

SEQ ID NO: 369779 - DNA, 16 bp, M. musculus
atgtacatatgtgcat

SEQ ID NO: 369780 - DNA, 16 bp, M. musculus
atgtacatgcagtgcc

SEQ ID NO: 369781 - DNA, 16 bp, M. musculus
atgtacatgcatacat

SEQ ID NO: 369782 - DNA, 16 bp, M. musculus
atgtacattcatgtgt

SEQ ID NO: 369783 - DNA, 16 bp, M. musculus
atgtacatttatgtat

SEQ ID NO: 369784 - DNA, 16 bp, M. musculus
atgtacatttttaaaa

SEQ ID NO: 369785 - DNA, 38 bp, M. musculus
atgtaccacatcttctgtatccattcctctgttgaggg

SEQ ID NO: 369786 - DNA, 38 bp, M. musculus
atgtaccacattttctgtatccattcctctgttgaggg

SEQ ID NO: 369787 - DNA, 16 bp, M. musculus
atgtaccaccactgcc

SEQ ID NO: 369788 - DNA, 16 bp, M. musculus
atgtaccagaagatgg

SEQ ID NO: 369789 - DNA, 16 bp, M. musculus
atgtaccctctgaaaa

SEQ ID NO: 369790 - DNA, 16 bp, M. musculus
atgtactcaccgataa

SEQ ID NO: 369791 - DNA, 16 bp, M. musculus
atgtactctacccaat

SEQ ID NO: 369792 - DNA, 16 bp, M. musculus
atgtactgctcttgca

SEQ ID NO: 369793 - DNA, 16 bp, M. musculus
atgtactggctggttt

SEQ ID NO: 369794 - DNA, 16 bp, M. musculus
atgtactgtaagatat

SEQ ID NO: 369795 - DNA, 16 bp, M. musculus
atgtactttattttca

SEQ ID NO: 369796 - DNA, 16 bp, M. musculus
atgtactttgatcata

SEQ ID NO: 369797 - DNA, 16 bp, M. musculus
atgtacttttaaaatt

SEQ ID NO: 369798 - DNA, 16 bp, M. musculus
atgtagaagagaatgg

SEQ ID NO: 369799 - DNA, 16 bp, M. musculus
atgtagaccaagctgg

SEQ ID NO: 369800 - DNA, 16 bp, M. musculus
atgtagacgaggctgg

SEQ ID NO: 369801 - DNA, 16 bp, M. musculus
atgtagactaggttgg

SEQ ID NO: 369802 - DNA, 16 bp, M. musculus
atgtagagaccatgga

SEQ ID NO: 369803 - DNA, 18 bp, M. musculus
atgtagatcaggctggct

SEQ ID NO: 369804 - DNA, 16 bp, M. musculus
atgtagatgctgggaa

SEQ ID NO: 369805 - DNA, 16 bp, M. musculus
atgtagcagaggactg

SEQ ID NO: 369806 - DNA, 16 bp, M. musculus
atgtagcagaggatga

SEQ ID NO: 369807 - DNA, 16 bp, M. musculus
atgtagcccaagctgg

SEQ ID NO: 369808 - DNA, 16 bp, M. musculus
atgtagcccaggcagg

SEQ ID NO: 369809 - DNA, 17 bp, M. musculus
atgtagcccaggctggt

SEQ ID NO: 369810 - DNA, 16 bp, M. musculus
atgtagcccagtggta

SEQ ID NO: 369811 - DNA, 16 bp, M. musculus
atgtagccctggctaa

SEQ ID NO: 369812 - DNA, 16 bp, M. musculus
atgtagccctgggtgg

SEQ ID NO: 369813 - DNA, 16 bp, M. musculus
atgtagctcaagctgg

SEQ ID NO: 369814 - DNA, 16 bp, M. musculus
atgtagctcaggctgg

SEQ ID NO: 369815 - DNA, 17 bp, M. musculus
atgtagctcagttggta

SEQ ID NO: 369816 - DNA, 16 bp, M. musculus
atgtagctctgtctgg

SEQ ID NO: 369817 - DNA, 16 bp, M. musculus
atgtagctctgtctgt

SEQ ID NO: 369818 - DNA, 16 bp, M. musculus
atgtagctgaggctga

SEQ ID NO: 369819 - DNA, 16 bp, M. musculus
atgtagctttggctgg

SEQ ID NO: 369820 - DNA, 16 bp, M. musculus
atgtaggagggcctag

SEQ ID NO: 369821 - DNA, 16 bp, M. musculus
atgtaggcattttctc

SEQ ID NO: 369822 - DNA, 16 bp, M. musculus
atgtaggccagaagag

SEQ ID NO: 369823 - DNA, 16 bp, M. musculus
atgtaggccatgaggt

SEQ ID NO: 369824 - DNA, 16 bp, M. musculus
atgtaggtgctagaaa

SEQ ID NO: 369825 - DNA, 16 bp, M. musculus
atgtaggtgctgggaa

SEQ ID NO: 369826 - DNA, 16 bp, M. musculus
atgtaggtggaaatta

SEQ ID NO: 369827 - DNA, 16 bp, M. musculus
atgtagtaagttccag

SEQ ID NO: 369828 - DNA, 16 bp, M. musculus
atgtagtgtgtgtgtg

SEQ ID NO: 369829 - DNA, 16 bp, M. musculus
atgtagttgatctttg

SEQ ID NO: 369830 - DNA, 16 bp, M. musculus
atgtataaatatatgt

SEQ ID NO: 369831 - DNA, 16 bp, M. musculus
atgtataaatgtatat

SEQ ID NO: 369832 - DNA, 16 bp, M. musculus
atgtatacaaacacat

SEQ ID NO: 369833 - DNA, 16 bp, M. musculus
atgtatacacacatga

SEQ ID NO: 369834 - DNA, 16 bp, M. musculus
atgtatacacatatgt

SEQ ID NO: 369835 - DNA, 16 bp, M. musculus
atgtatacattttagg

SEQ ID NO: 369836 - DNA, 16 bp, M. musculus
atgtatacatttttat

SEQ ID NO: 369837 - DNA, 16 bp, M. musculus
atgtatactgtcatat

SEQ ID NO: 369838 - DNA, 16 bp, M. musculus
atgtatataatttcag

SEQ ID NO: 369839 - DNA, 16 bp, M. musculus
atgtatatacaaatac

SEQ ID NO: 369840 - DNA, 16 bp, M. musculus
atgtatatacacacat

SEQ ID NO: 369841 - DNA, 16 bp, M. musculus
atgtatatacatatta

SEQ ID NO: 369842 - DNA, 16 bp, M. musculus
atgtatatacatgtat

SEQ ID NO: 369843 - DNA, 16 bp, M. musculus
atgtatatacgtgtat

SEQ ID NO: 369844 - DNA, 16 bp, M. musculus
atgtatatatacactt

SEQ ID NO: 369845 - DNA, 16 bp, M. musculus
atgtatatatagagag

SEQ ID NO: 369846 - DNA, 16 bp, M. musculus
atgtatatatgtatgt

SEQ ID NO: 369847 - DNA, 16 bp, M. musculus
atgtatatatgtgcat

SEQ ID NO: 369848 - DNA, 16 bp, M. musculus
atgtatatattttctt

SEQ ID NO: 369849 - DNA, 16 bp, M. musculus
atgtatatctgtgtat

SEQ ID NO: 369850 - DNA, 16 bp, M. musculus
atgtatatctgtgtgc

SEQ ID NO: 369851 - DNA, 16 bp, M. musculus
atgtatatctgtgtgt

SEQ ID NO: 369852 - DNA, 16 bp, M. musculus
atgtatatgagtatgt

SEQ ID NO: 369853 - DNA, 16 bp, M. musculus
atgtatatgagtgtac

SEQ ID NO: 369854 - DNA, 16 bp, M. musculus
atgtatatgtaaatat

SEQ ID NO: 369855 - DNA, 16 bp, M. musculus
atgtatatgtacatat

SEQ ID NO: 369856 - DNA, 16 bp, M. musculus
atgtatatgtatgttt

SEQ ID NO: 369857 - DNA, 16 bp, M. musculus
atgtatatgtattatg

SEQ ID NO: 369858 - DNA, 17 bp, M. musculus
atgtatatgtgtgtgtg

SEQ ID NO: 369859 - DNA, 16 bp, M. musculus
atgtatatttgtgtgt

SEQ ID NO: 369860 - DNA, 16 bp, M. musculus
atgtatattttcaata

SEQ ID NO: 369861 - DNA, 16 bp, M. musculus
atgtatcaaattttct

SEQ ID NO: 369862 - DNA, 16 bp, M. musculus
atgtatcagaggatgg

SEQ ID NO: 369863 - DNA, 16 bp, M. musculus
atgtatccatgtatgt

SEQ ID NO: 369864 - DNA, 16 bp, M. musculus
atgtatctgtaggata

SEQ ID NO: 369865 - DNA, 16 bp, M. musculus
atgtatctgtgtgtct

SEQ ID NO: 369866 - DNA, 16 bp, M. musculus
atgtatctgtgtgtgg

SEQ ID NO: 369867 - DNA, 16 bp, M. musculus
atgtatgacattttca

SEQ ID NO: 369868 - DNA, 16 bp, M. musculus
atgtatgcatgtattt

SEQ ID NO: 369869 - DNA, 16 bp, M. musculus
atgtatgcattatgta

SEQ ID NO: 369870 - DNA, 16 bp, M. musculus
atgtatgctccttggt

SEQ ID NO: 369871 - DNA, 16 bp, M. musculus
atgtatgcttgtgtga

SEQ ID NO: 369872 - DNA, 86 bp, M. musculus
atgtatgctttaagtgtggaagtttagatcattttagaattgattgtcctcagaacaagggtgccgaggttagacaaacaggccgt

SEQ ID NO: 369873 - DNA, 16 bp, M. musculus
atgtatggaaatccat

SEQ ID NO: 369874 - DNA, 16 bp, M. musculus
atgtatggaattctca

SEQ ID NO: 369875 - DNA, 16 bp, M. musculus
atgtatgtaaagtttt

SEQ ID NO: 369876 - DNA, 16 bp, M. musculus
atgtatgtaaatatat

SEQ ID NO: 369877 - DNA, 16 bp, M. musculus
atgtatgtaatatgta

SEQ ID NO: 369878 - DNA, 16 bp, M. musculus
atgtatgtacatatgt

SEQ ID NO: 369879 - DNA, 16 bp, M. musculus
atgtatgtataaatgt

SEQ ID NO: 369880 - DNA, 16 bp, M. musculus
atgtatgtataattta

SEQ ID NO: 369881 - DNA, 16 bp, M. musculus
atgtatgtatatacat

SEQ ID NO: 369882 - DNA, 16 bp, M. musculus
atgtatgtatatatac

SEQ ID NO: 369883 - DNA, 16 bp, M. musculus
atgtatgtatatatta

SEQ ID NO: 369884 - DNA, 16 bp, M. musculus
atgtatgtatatgagt

SEQ ID NO: 369885 - DNA, 16 bp, M. musculus
atgtatgtatatgtat

SEQ ID NO: 369886 - DNA, 16 bp, M. musculus
atgtatgtatatgtgt

SEQ ID NO: 369887 - DNA, 17 bp, M. musculus
atgtatgtatatgtgtt

SEQ ID NO: 369888 - DNA, 16 bp, M. musculus
atgtatgtatctgtct

SEQ ID NO: 369889 - DNA, 16 bp, M. musculus
atgtatgtatgcaaat

SEQ ID NO: 369890 - DNA, 16 bp, M. musculus
atgtatgtatgcatgt

SEQ ID NO: 369891 - DNA, 16 bp, M. musculus
atgtatgtatgcattt

SEQ ID NO: 369892 - DNA, 16 bp, M. musculus
atgtatgtatgtgcac

SEQ ID NO: 369893 - DNA, 16 bp, M. musculus
atgtatgtatgtgtgt

SEQ ID NO: 369894 - DNA, 16 bp, M. musculus
atgtatgtatgtttct

SEQ ID NO: 369895 - DNA, 16 bp, M. musculus
atgtatgtcaggctgg

SEQ ID NO: 369896 - DNA, 16 bp, M. musculus
atgtatgtctgtgtac

SEQ ID NO: 369897 - DNA, 16 bp, M. musculus
atgtatgtgattgtgt

SEQ ID NO: 369898 - DNA, 16 bp, M. musculus
atgtatgtgcttgtat

SEQ ID NO: 369899 - DNA, 16 bp, M. musculus
atgtatgtgggttctt

SEQ ID NO: 369900 - DNA, 16 bp, M. musculus
atgtatgtggtatgtg

SEQ ID NO: 369901 - DNA, 16 bp, M. musculus
atgtatgtgtaaatac

SEQ ID NO: 369902 - DNA, 16 bp, M. musculus
atgtatgtgtatatgt

SEQ ID NO: 369903 - DNA, 16 bp, M. musculus
atgtatgtgtgccaca

SEQ ID NO: 369904 - DNA, 16 bp, M. musculus
atgtatgtgtgcgtgt

SEQ ID NO: 369905 - DNA, 16 bp, M. musculus
atgtatgtgtgggcac

SEQ ID NO: 369906 - DNA, 16 bp, M. musculus
atgtatgtgtgtctct

SEQ ID NO: 369907 - DNA, 16 bp, M. musculus
atgtatgtgtgtctgt

SEQ ID NO: 369908 - DNA, 16 bp, M. musculus
atgtatgtgtgtgcat

SEQ ID NO: 369909 - DNA, 16 bp, M. musculus
atgtatgtgtgtgtct

SEQ ID NO: 369910 - DNA, 16 bp, M. musculus
atgtatgtgtgtgtgc

SEQ ID NO: 369911 - DNA, 16 bp, M. musculus
atgtatgtgtgtgtgt

SEQ ID NO: 369912 - DNA, 17 bp, M. musculus
atgtatgtgtgtgtgta

SEQ ID NO: 369913 - DNA, 16 bp, M. musculus
atgtatgttgtgtgta

SEQ ID NO: 369914 - DNA, 16 bp, M. musculus
atgtatgttttcagaa

SEQ ID NO: 369915 - DNA, 16 bp, M. musculus
atgtattaatttcttc

SEQ ID NO: 369916 - DNA, 16 bp, M. musculus
atgtattcatgtattt

SEQ ID NO: 369917 - DNA, 16 bp, M. musculus
atgtattcatttctct

SEQ ID NO: 369918 - DNA, 16 bp, M. musculus
atgtattcatttttat

SEQ ID NO: 369919 - DNA, 16 bp, M. musculus
atgtattcttttatat

SEQ ID NO: 369920 - DNA, 16 bp, M. musculus
atgtattcttttgtga

SEQ ID NO: 369921 - DNA, 16 bp, M. musculus
atgtattcttttttaa

SEQ ID NO: 369922 - DNA, 16 bp, M. musculus
atgtattgcatgagag

SEQ ID NO: 369923 - DNA, 16 bp, M. musculus
atgtattgggaggaat

SEQ ID NO: 369924 - DNA, 16 bp, M. musculus
atgtattgtatatata

SEQ ID NO: 369925 - DNA, 16 bp, M. musculus
atgtatttacttattt

SEQ ID NO: 369926 - DNA, 16 bp, M. musculus
atgtatttatgtatgt

SEQ ID NO: 369927 - DNA, 16 bp, M. musculus
atgtatttcaatcata

SEQ ID NO: 369928 - DNA, 16 bp, M. musculus
atgtatttgcatacat

SEQ ID NO: 369929 - DNA, 16 bp, M. musculus
atgtatttgcatatgt

SEQ ID NO: 369930 - DNA, 16 bp, M. musculus
atgtatttggagttct

SEQ ID NO: 369931 - DNA, 16 bp, M. musculus
atgtatttgtacatgt

SEQ ID NO: 369932 - DNA, 16 bp, M. musculus
atgtatttgtgtatgt

SEQ ID NO: 369933 - DNA, 16 bp, M. musculus
atgtattttatcttat

SEQ ID NO: 369934 - DNA, 16 bp, M. musculus
atgtattttcaataaa

SEQ ID NO: 369935 - DNA, 16 bp, M. musculus
atgtattttcttatat

SEQ ID NO: 369936 - DNA, 16 bp, M. musculus
atgtattttgaccata

SEQ ID NO: 369937 - DNA, 16 bp, M. musculus
atgtatttttatactt

SEQ ID NO: 369938 - DNA, 16 bp, M. musculus
atgtatttttcatatt

SEQ ID NO: 369939 - DNA, 16 bp, M. musculus
atgtatttttctatat

SEQ ID NO: 369940 - DNA, 16 bp, M. musculus
atgtatttttctcaat

SEQ ID NO: 369941 - DNA, 16 bp, M. musculus
atgtatttttttctca

SEQ ID NO: 369942 - DNA, 16 bp, M. musculus
atgtatttttttctcc

SEQ ID NO: 369943 - DNA, 16 bp, M. musculus
atgtcaaaaatacaaa

SEQ ID NO: 369944 - DNA, 16 bp, M. musculus
atgtcaaaagtttgtg

SEQ ID NO: 369945 - DNA, 16 bp, M. musculus
atgtcaaaatcaatcc

SEQ ID NO: 369946 - DNA, 16 bp, M. musculus
atgtcaacctctggcc

SEQ ID NO: 369947 - DNA, 16 bp, M. musculus
atgtcaacttgacaca

SEQ ID NO: 369948 - DNA, 16 bp, M. musculus
atgtcaagtcctttgg

SEQ ID NO: 369949 - DNA, 16 bp, M. musculus
atgtcaatatttttgt

SEQ ID NO: 369950 - DNA, 16 bp, M. musculus
atgtcacacacacaca

SEQ ID NO: 369951 - DNA, 16 bp, M. musculus
atgtcactcaacagag

SEQ ID NO: 369952 - DNA, 16 bp, M. musculus
atgtcactttaaagaa

SEQ ID NO: 369953 - DNA, 16 bp, M. musculus
atgtcagaagaggaca

SEQ ID NO: 369954 - DNA, 16 bp, M. musculus
atgtcagaggacaact

SEQ ID NO: 369955 - DNA, 16 bp, M. musculus
atgtcagatctcatta

SEQ ID NO: 369956 - DNA, 16 bp, M. musculus
atgtcaggatcctgtc

SEQ ID NO: 369957 - DNA, 16 bp, M. musculus
atgtcagtgcctggca

SEQ ID NO: 369958 - DNA, 16 bp, M. musculus
atgtcagtgtgtatgt

SEQ ID NO: 369959 - DNA, 16 bp, M. musculus
atgtcatagtgaggaa

SEQ ID NO: 369960 - DNA, 16 bp, M. musculus
atgtcatatatatata

SEQ ID NO: 369961 - DNA, 16 bp, M. musculus
atgtcatatgtcatat

SEQ ID NO: 369962 - DNA, 16 bp, M. musculus
atgtcattctgtccct

SEQ ID NO: 369963 - DNA, 16 bp, M. musculus
atgtcattgtttttaa

SEQ ID NO: 369964 - DNA, 16 bp, M. musculus
atgtcattttaaaata

SEQ ID NO: 369965 - DNA, 16 bp, M. musculus
atgtcattttatattt

SEQ ID NO: 369966 - DNA, 16 bp, M. musculus
atgtcattttctttct

SEQ ID NO: 369967 - DNA, 16 bp, M. musculus
atgtcattttttaaaa

SEQ ID NO: 369968 - DNA, 16 bp, M. musculus
atgtcattttttaaat

SEQ ID NO: 369969 - DNA, 16 bp, M. musculus
atgtcatttttttaaa

SEQ ID NO: 369970 - DNA, 16 bp, M. musculus
atgtccaaatgctgaa

SEQ ID NO: 369971 - DNA, 16 bp, M. musculus
atgtccaactcctttc

SEQ ID NO: 369972 - DNA, 16 bp, M. musculus
atgtccaagaaggcca

SEQ ID NO: 369973 - DNA, 16 bp, M. musculus
atgtccaagagcctga

SEQ ID NO: 369974 - DNA, 16 bp, M. musculus
atgtccagccactttg

SEQ ID NO: 369975 - DNA, 16 bp, M. musculus
atgtccagtgacaggc

SEQ ID NO: 369976 - DNA, 22 bp, M. musculus
atgtccatggtttattatagat

SEQ ID NO: 369977 - DNA, 16 bp, M. musculus
atgtccatgttctctg

SEQ ID NO: 369978 - DNA, 16 bp, M. musculus
atgtcccacagtcttt

SEQ ID NO: 369979 - DNA, 16 bp, M. musculus
atgtccccaagttcac

SEQ ID NO: 369980 - DNA, 16 bp, M. musculus
atgtccccacccctcc

SEQ ID NO: 369981 - DNA, 16 bp, M. musculus
atgtccctcaacagaa

SEQ ID NO: 369982 - DNA, 16 bp, M. musculus
atgtccctcaagagag

SEQ ID NO: 369983 - DNA, 16 bp, M. musculus
atgtcctagtgtaggg

SEQ ID NO: 369984 - DNA, 16 bp, M. musculus
atgtcctcagtttctg

SEQ ID NO: 369985 - DNA, 39 bp, M. musculus
atgtcctctaccatcatcatgagatatgcttttaaatcc

SEQ ID NO: 369986 - DNA, 16 bp, M. musculus
atgtcctctcccactg

SEQ ID NO: 369987 - DNA, 16 bp, M. musculus
atgtcctcttctgggg

SEQ ID NO: 369988 - DNA, 16 bp, M. musculus
atgtcctctttcttaa

SEQ ID NO: 369989 - DNA, 22 bp, M. musculus
atgtcctggaactcactctgta

SEQ ID NO: 369990 - DNA, 16 bp, M. musculus
atgtcctggctttaga

SEQ ID NO: 369991 - DNA, 16 bp, M. musculus
atgtccttcaacagag

SEQ ID NO: 369992 - DNA, 16 bp, M. musculus
atgtcctttttaaaaa

SEQ ID NO: 369993 - DNA, 16 bp, M. musculus
atgtctatgctcagtg

SEQ ID NO: 369994 - DNA, 16 bp, M. musculus
atgtctattctcaaga

SEQ ID NO: 369995 - DNA, 16 bp, M. musculus
atgtctattttatttc

SEQ ID NO: 369996 - DNA, 16 bp, M. musculus
atgtctcacttttcat

SEQ ID NO: 369997 - DNA, 17 bp, M. musculus
atgtctcaggaagacag

SEQ ID NO: 369998 - DNA, 16 bp, M. musculus
atgtctccagcccctg

SEQ ID NO: 369999 - DNA, 16 bp, M. musculus
atgtctccatcaaatt

SEQ ID NO: 370000 - DNA, 16 bp, M. musculus
atgtctcccctttcat

SEQ ID NO: 370001 - DNA, 16 bp, M. musculus
atgtctcccttttcct

SEQ ID NO: 370002 - DNA, 16 bp, M. musculus
atgtctctcaacagaa

SEQ ID NO: 370003 - DNA, 16 bp, M. musculus
atgtctctcaacatca

SEQ ID NO: 370004 - DNA, 16 bp, M. musculus
atgtctgagttccagg

SEQ ID NO: 370005 - DNA, 17 bp, M. musculus
atgtctgatgatgaaat

SEQ ID NO: 370006 - DNA, 16 bp, M. musculus
atgtctgatgatgaga

SEQ ID NO: 370007 - DNA, 16 bp, M. musculus
atgtctgcctggatac

SEQ ID NO: 370008 - DNA, 16 bp, M. musculus
atgtctgcctgtctgt

SEQ ID NO: 370009 - DNA, 16 bp, M. musculus
atgtctgctttgagct

SEQ ID NO: 370010 - DNA, 17 bp, M. musculus
atgtctggagcctgaaa

SEQ ID NO: 370011 - DNA, 16 bp, M. musculus
atgtctgggattcact

SEQ ID NO: 370012 - DNA, 16 bp, M. musculus
atgtctgggccaggaa

SEQ ID NO: 370013 - DNA, 16 bp, M. musculus
atgtctggtgtgtgtg

SEQ ID NO: 370014 - DNA, 16 bp, M. musculus
atgtctgtagtcccag

SEQ ID NO: 370015 - DNA, 16 bp, M. musculus
atgtctgtctgtgtgt

SEQ ID NO: 370016 - DNA, 16 bp, M. musculus
atgtctgtcttagatt

SEQ ID NO: 370017 - DNA, 16 bp, M. musculus
atgtctgtgcaccacg

SEQ ID NO: 370018 - DNA, 16 bp, M. musculus
atgtctgtgcatgtgt

SEQ ID NO: 370019 - DNA, 16 bp, M. musculus
atgtctgtgtaccatg

SEQ ID NO: 370020 - DNA, 16 bp, M. musculus
atgtctgtgtctgtgt

SEQ ID NO: 370021 - DNA, 16 bp, M. musculus
atgtctgtgtgagagt

SEQ ID NO: 370022 - DNA, 16 bp, M. musculus
atgtctgtgtgagggc

SEQ ID NO: 370023 - DNA, 16 bp, M. musculus
atgtctgtgtgccatg

SEQ ID NO: 370024 - DNA, 16 bp, M. musculus
atgtctgtgtgtgtat

SEQ ID NO: 370025 - DNA, 16 bp, M. musculus
atgtcttaacttgtca

SEQ ID NO: 370026 - DNA, 16 bp, M. musculus
atgtcttaattagggt

SEQ ID NO: 370027 - DNA, 16 bp, M. musculus
atgtcttatttattta

SEQ ID NO: 370028 - DNA, 16 bp, M. musculus
atgtcttcatcaaatt

SEQ ID NO: 370029 - DNA, 16 bp, M. musculus
atgtcttcattcttaa

SEQ ID NO: 370030 - DNA, 16 bp, M. musculus
atgtcttcattttgaa

SEQ ID NO: 370031 - DNA, 16 bp, M. musculus
atgtcttccatattcc

SEQ ID NO: 370032 - DNA, 16 bp, M. musculus
atgtcttcctcttcat

SEQ ID NO: 370033 - DNA, 16 bp, M. musculus
atgtcttcctgctgga

SEQ ID NO: 370034 - DNA, 16 bp, M. musculus
atgtcttctctttctt

SEQ ID NO: 370035 - DNA, 16 bp, M. musculus
atgtcttctgtgtaac

SEQ ID NO: 370036 - DNA, 16 bp, M. musculus
atgtcttcttttctct

SEQ ID NO: 370037 - DNA, 16 bp, M. musculus
atgtcttgctcagcct

SEQ ID NO: 370038 - DNA, 16 bp, M. musculus
atgtctttcaacagag

SEQ ID NO: 370039 - DNA, 16 bp, M. musculus
atgtctttgcttttaa

SEQ ID NO: 370040 - DNA, 16 bp, M. musculus
atgtcttttaaaaata

SEQ ID NO: 370041 - DNA, 16 bp, M. musculus
atgtgaaaatagcact

SEQ ID NO: 370042 - DNA, 16 bp, M. musculus
atgtgaaaatattttt

SEQ ID NO: 370043 - DNA, 16 bp, M. musculus
atgtgaaactcaaaaa

SEQ ID NO: 370044 - DNA, 16 bp, M. musculus
atgtgaaagaatgttt

SEQ ID NO: 370045 - DNA, 16 bp, M. musculus
atgtgaaagccagaag

SEQ ID NO: 370046 - DNA, 16 bp, M. musculus
atgtgaaatgtaaata

SEQ ID NO: 370047 - DNA, 16 bp, M. musculus
atgtgaaattcagaaa

SEQ ID NO: 370048 - DNA, 16 bp, M. musculus
atgtgaactctcagct

SEQ ID NO: 370049 - DNA, 16 bp, M. musculus
atgtgaagaaatgtat

SEQ ID NO: 370050 - DNA, 21 bp, M. musculus
atgtgaaggtcagaggacaac

SEQ ID NO: 370051 - DNA, 16 bp, M. musculus
atgtgaagtggaatct

SEQ ID NO: 370052 - DNA, 16 bp, M. musculus
atgtgaagtgtgtgtg

SEQ ID NO: 370053 - DNA, 16 bp, M. musculus
atgtgaatatatatgt

SEQ ID NO: 370054 - DNA, 16 bp, M. musculus
atgtgaatgaagaaag

SEQ ID NO: 370055 - DNA, 16 bp, M. musculus
atgtgaatgcatacac

SEQ ID NO: 370056 - DNA, 16 bp, M. musculus
atgtgaatgtatgtat

SEQ ID NO: 370057 - DNA, 16 bp, M. musculus
atgtgaatgtgtgcat

SEQ ID NO: 370058 - DNA, 16 bp, M. musculus
atgtgaattcttttgt

SEQ ID NO: 370059 - DNA, 16 bp, M. musculus
atgtgaattgatctat

SEQ ID NO: 370060 - DNA, 16 bp, M. musculus
atgtgaatttgaggcc

SEQ ID NO: 370061 - DNA, 16 bp, M. musculus
atgtgacatttggaat

SEQ ID NO: 370062 - DNA, 16 bp, M. musculus
atgtgacccttgacct

SEQ ID NO: 370063 - DNA, 16 bp, M. musculus
atgtgactctggcttt

SEQ ID NO: 370064 - DNA, 16 bp, M. musculus
atgtgactgtgtgtgt

SEQ ID NO: 370065 - DNA, 16 bp, M. musculus
atgtgagaaagagaga

SEQ ID NO: 370066 - DNA, 16 bp, M. musculus
atgtgagagaaagaga

SEQ ID NO: 370067 - DNA, 16 bp, M. musculus
atgtgagagagagaga

SEQ ID NO: 370068 - DNA, 23 bp, M. musculus
atgtgagccaccatgtggttgct

SEQ ID NO: 370069 - DNA, 16 bp, M. musculus
atgtgagctctcagct

SEQ ID NO: 370070 - DNA, 16 bp, M. musculus
atgtgaggagaggaga

SEQ ID NO: 370071 - DNA, 16 bp, M. musculus
atgtgagtgcatgcat

SEQ ID NO: 370072 - DNA, 16 bp, M. musculus
atgtgagtgtatatgt

SEQ ID NO: 370073 - DNA, 16 bp, M. musculus
atgtgagtgtgtgagt

SEQ ID NO: 370074 - DNA, 16 bp, M. musculus
atgtgagttctcagct

SEQ ID NO: 370075 - DNA, 16 bp, M. musculus
atgtgagttttctatt

SEQ ID NO: 370076 - DNA, 16 bp, M. musculus
atgtgataaagccttt

SEQ ID NO: 370077 - DNA, 16 bp, M. musculus
atgtgatatgatttta

SEQ ID NO: 370078 - DNA, 16 bp, M. musculus
atgtgatattttcttt

SEQ ID NO: 370079 - DNA, 16 bp, M. musculus
atgtgatatttttctt

SEQ ID NO: 370080 - DNA, 16 bp, M. musculus
atgtgatctctcagct

SEQ ID NO: 370081 - DNA, 16 bp, M. musculus
atgtgatgctggagat

SEQ ID NO: 370082 - DNA, 16 bp, M. musculus
atgtgatggatggatg

SEQ ID NO: 370083 - DNA, 16 bp, M. musculus
atgtgatgtgtgtgca

SEQ ID NO: 370084 - DNA, 16 bp, M. musculus
atgtgatgtttggaaa

SEQ ID NO: 370085 - DNA, 16 bp, M. musculus
atgtgatgtttgtctt

SEQ ID NO: 370086 - DNA, 16 bp, M. musculus
atgtgatttctgtcct

SEQ ID NO: 370087 - DNA, 16 bp, M. musculus
atgtgattttgtcttt

SEQ ID NO: 370088 - DNA, 16 bp, M. musculus
atgtgattttttaaaa

SEQ ID NO: 370089 - DNA, 16 bp, M. musculus
atgtgcaagtgtaagc

SEQ ID NO: 370090 - DNA, 16 bp, M. musculus
atgtgcacacgtgcac

SEQ ID NO: 370091 - DNA, 16 bp, M. musculus
atgtgcacatgtgtgt

SEQ ID NO: 370092 - DNA, 16 bp, M. musculus
atgtgcacctgtgtat

SEQ ID NO: 370093 - DNA, 16 bp, M. musculus
atgtgcactcttcctg

SEQ ID NO: 370094 - DNA, 16 bp, M. musculus
atgtgcaggtaaaaca

SEQ ID NO: 370095 - DNA, 16 bp, M. musculus
atgtgcatacatgtgt

SEQ ID NO: 370096 - DNA, 16 bp, M. musculus
atgtgcatatatgtgt

SEQ ID NO: 370097 - DNA, 16 bp, M. musculus
atgtgcatgagtgttt

SEQ ID NO: 370098 - DNA, 16 bp, M. musculus
atgtgcatgcagtacc

SEQ ID NO: 370099 - DNA, 16 bp, M. musculus
atgtgcatgcatgctt

SEQ ID NO: 370100 - DNA, 16 bp, M. musculus
atgtgcatgcatgtgt

SEQ ID NO: 370101 - DNA, 16 bp, M. musculus
atgtgcatggctgtga

SEQ ID NO: 370102 - DNA, 16 bp, M. musculus
atgtgcatgtatgtgt

SEQ ID NO: 370103 - DNA, 16 bp, M. musculus
atgtgcatgtgaactt

SEQ ID NO: 370104 - DNA, 16 bp, M. musculus
atgtgcatgtgcacat

SEQ ID NO: 370105 - DNA, 16 bp, M. musculus
atgtgcatgtgtacat

SEQ ID NO: 370106 - DNA, 16 bp, M. musculus
atgtgcatgtttatat

SEQ ID NO: 370107 - DNA, 16 bp, M. musculus
atgtgcattgtgtgtg

SEQ ID NO: 370108 - DNA, 16 bp, M. musculus
atgtgcatttatgtat

SEQ ID NO: 370109 - DNA, 50 bp, M. musculus
atgtgccaaaaaacgggtcatcgggccctcggtcccagggccctcaaaga

SEQ ID NO: 370110 - DNA, 16 bp, M. musculus
atgtgccaatgagttc

SEQ ID NO: 370111 - DNA, 16 bp, M. musculus
atgtgccacagagtgt

SEQ ID NO: 370112 - DNA, 16 bp, M. musculus
atgtgccaggcactgt

SEQ ID NO: 370113 - DNA, 16 bp, M. musculus
atgtgccatgaattcc

SEQ ID NO: 370114 - DNA, 16 bp, M. musculus
atgtgccgccaccacc

SEQ ID NO: 370115 - DNA, 16 bp, M. musculus
atgtgcctaaaataaa

SEQ ID NO: 370116 - DNA, 16 bp, M. musculus
atgtgcctgtgcatgt

SEQ ID NO: 370117 - DNA, 16 bp, M. musculus
atgtgcctgtggaggc

SEQ ID NO: 370118 - DNA, 16 bp, M. musculus
atgtgcctgtgtacat

SEQ ID NO: 370119 - DNA, 16 bp, M. musculus
atgtgcctgtgtgtgt

SEQ ID NO: 370120 - DNA, 16 bp, M. musculus
atgtgccttcttctca

SEQ ID NO: 370121 - DNA, 16 bp, M. musculus
atgtgcgcatgtgtgt

SEQ ID NO: 370122 - DNA, 16 bp, M. musculus
atgtgcgcgcgcgcgc

SEQ ID NO: 370123 - DNA, 16 bp, M. musculus
atgtgcgtgtctgtgt

SEQ ID NO: 370124 - DNA, 16 bp, M. musculus
atgtgcgtgtgagtgt

SEQ ID NO: 370125 - DNA, 16 bp, M. musculus
atgtgctcatgtgcac

SEQ ID NO: 370126 - DNA, 16 bp, M. musculus
atgtgctctgagtagg

SEQ ID NO: 370127 - DNA, 16 bp, M. musculus
atgtgctgcagtttct

SEQ ID NO: 370128 - DNA, 16 bp, M. musculus
atgtgctgctgctgct

SEQ ID NO: 370129 - DNA, 16 bp, M. musculus
atgtgcttagcatgtg

SEQ ID NO: 370130 - DNA, 16 bp, M. musculus
atgtgcttatgtgtat

SEQ ID NO: 370131 - DNA, 16 bp, M. musculus
atgtgcttatgtgtgt

SEQ ID NO: 370132 - DNA, 16 bp, M. musculus
atgtgcttctgtgtgt

SEQ ID NO: 370133 - DNA, 16 bp, M. musculus
atgtgcttgcacacac

SEQ ID NO: 370134 - DNA, 16 bp, M. musculus
atgtgcttgcatgtgt

SEQ ID NO: 370135 - DNA, 16 bp, M. musculus
atgtgcttgtggctct

SEQ ID NO: 370136 - DNA, 16 bp, M. musculus
atgtgcttgttgtgtt

SEQ ID NO: 370137 - DNA, 16 bp, M. musculus
atgtgctttgagtttt

SEQ ID NO: 370138 - DNA, 16 bp, M. musculus
atgtgcttttaaaata

SEQ ID NO: 370139 - DNA, 16 bp, M. musculus
atgtggaaaagccttt

SEQ ID NO: 370140 - DNA, 16 bp, M. musculus
atgtggaaaccagagg

SEQ ID NO: 370141 - DNA, 16 bp, M. musculus
atgtggaaagtataag

SEQ ID NO: 370142 - DNA, 16 bp, M. musculus
atgtggaacagttgaa

SEQ ID NO: 370143 - DNA, 16 bp, M. musculus
atgtggaagaagagaa

SEQ ID NO: 370144 - DNA, 16 bp, M. musculus
atgtggaagaagagga

SEQ ID NO: 370145 - DNA, 16 bp, M. musculus
atgtggaagctgaaca

SEQ ID NO: 370146 - DNA, 16 bp, M. musculus
atgtggaagtgtaaac

SEQ ID NO: 370147 - DNA, 16 bp, M. musculus
atgtggaagtgtaagc

SEQ ID NO: 370148 - DNA, 16 bp, M. musculus
atgtggaagtttaagc

SEQ ID NO: 370149 - DNA, 16 bp, M. musculus
atgtggaagtttggga

SEQ ID NO: 370150 - DNA, 16 bp, M. musculus
atgtggacatccagtt

SEQ ID NO: 370151 - DNA, 16 bp, M. musculus
atgtggagaaagaaga

SEQ ID NO: 370152 - DNA, 17 bp, M. musculus
atgtggagaaagagaaa

SEQ ID NO: 370153 - DNA, 16 bp, M. musculus
atgtggagaaagatga

SEQ ID NO: 370154 - DNA, 16 bp, M. musculus
atgtggagagccgtga

SEQ ID NO: 370155 - DNA, 16 bp, M. musculus
atgtggagagctgtgc

SEQ ID NO: 370156 - DNA, 16 bp, M. musculus
atgtggagatagagga

SEQ ID NO: 370157 - DNA, 16 bp, M. musculus
atgtggagctccttaa

SEQ ID NO: 370158 - DNA, 16 bp, M. musculus
atgtggaggaagaaga

SEQ ID NO: 370159 - DNA, 16 bp, M. musculus
atgtggaggacatgtg

SEQ ID NO: 370160 - DNA, 16 bp, M. musculus
atgtggaggcctgaag

SEQ ID NO: 370161 - DNA, 16 bp, M. musculus
atgtggaggtcaaagg

SEQ ID NO: 370162 - DNA, 16 bp, M. musculus
atgtggaggttctgat

SEQ ID NO: 370163 - DNA, 16 bp, M. musculus
atgtggagttttttga

SEQ ID NO: 370164 - DNA, 16 bp, M. musculus
atgtggatatgtgtgt

SEQ ID NO: 370165 - DNA, 16 bp, M. musculus
atgtggatgctctcag

SEQ ID NO: 370166 - DNA, 16 bp, M. musculus
atgtggatgctggaaa

SEQ ID NO: 370167 - DNA, 16 bp, M. musculus
atgtggatgctgggaa

SEQ ID NO: 370168 - DNA, 16 bp, M. musculus
atgtggatgcttacag

SEQ ID NO: 370169 - DNA, 16 bp, M. musculus
atgtggattctgggaa

SEQ ID NO: 370170 - DNA, 16 bp, M. musculus
atgtggcagaatgtag

SEQ ID NO: 370171 - DNA, 17 bp, M. musculus
atgtggcataaagactg

SEQ ID NO: 370172 - DNA, 16 bp, M. musculus
atgtggcatatataca

SEQ ID NO: 370173 - DNA, 16 bp, M. musculus
atgtggcatgtgtgtg

SEQ ID NO: 370174 - DNA, 16 bp, M. musculus
atgtggccttgttgga

SEQ ID NO: 370175 - DNA, 16 bp, M. musculus
atgtggctatcttttt

SEQ ID NO: 370176 - DNA, 16 bp, M. musculus
atgtggctcagtgata

SEQ ID NO: 370177 - DNA, 16 bp, M. musculus
atgtggctctggtttt

SEQ ID NO: 370178 - DNA, 16 bp, M. musculus
atgtggctgccctttc

SEQ ID NO: 370179 - DNA, 16 bp, M. musculus
atgtggctgctcttgt

SEQ ID NO: 370180 - DNA, 16 bp, M. musculus
atgtggctggagccac

SEQ ID NO: 370181 - DNA, 16 bp, M. musculus
atgtgggcactgggga

SEQ ID NO: 370182 - DNA, 17 bp, M. musculus
atgtgggcgcggctccc

SEQ ID NO: 370183 - DNA, 16 bp, M. musculus
atgtgggcgctgggaa

SEQ ID NO: 370184 - DNA, 16 bp, M. musculus
atgtgggctctgggga

SEQ ID NO: 370185 - DNA, 16 bp, M. musculus
atgtgggctttctgtt

SEQ ID NO: 370186 - DNA, 16 bp, M. musculus
atgtgggggctgggaa

SEQ ID NO: 370187 - DNA, 16 bp, M. musculus
atgtggggtctgggga

SEQ ID NO: 370188 - DNA, 16 bp, M. musculus
atgtggggttggtgaa

SEQ ID NO: 370189 - DNA, 16 bp, M. musculus
atgtgggtactgggaa

SEQ ID NO: 370190 - DNA, 16 bp, M. musculus
atgtgggtcctgaaca

SEQ ID NO: 370191 - DNA, 16 bp, M. musculus
atgtgggtgacaccat

SEQ ID NO: 370192 - DNA, 16 bp, M. musculus
atgtgggtgatgggaa

SEQ ID NO: 370193 - DNA, 16 bp, M. musculus
atgtgggtgctagaaa

SEQ ID NO: 370194 - DNA, 16 bp, M. musculus
atgtgggtgctcagaa

SEQ ID NO: 370195 - DNA, 16 bp, M. musculus
atgtgggtgctgagaa

SEQ ID NO: 370196 - DNA, 16 bp, M. musculus
atgtgggtgctgagga

SEQ ID NO: 370197 - DNA, 16 bp, M. musculus
atgtgggtgctggaaa

SEQ ID NO: 370198 - DNA, 16 bp, M. musculus
atgtgggtgctgggaa

SEQ ID NO: 370199 - DNA, 16 bp, M. musculus
atgtgggtgctgggac

SEQ ID NO: 370200 - DNA, 16 bp, M. musculus
atgtgggtgctgggca

SEQ ID NO: 370201 - DNA, 16 bp, M. musculus
atgtgggtgttgggaa

SEQ ID NO: 370202 - DNA, 16 bp, M. musculus
atgtgggttcctggga

SEQ ID NO: 370203 - DNA, 16 bp, M. musculus
atgtgggttctgggaa

SEQ ID NO: 370204 - DNA, 16 bp, M. musculus
atgtgggttttctgtt

SEQ ID NO: 370205 - DNA, 16 bp, M. musculus
atgtggtaaacatttt

SEQ ID NO: 370206 - DNA, 16 bp, M. musculus
atgtggtaaataaagc

SEQ ID NO: 370207 - DNA, 16 bp, M. musculus
atgtggtacacagaaa

SEQ ID NO: 370208 - DNA, 16 bp, M. musculus
atgtggtacacagaca

SEQ ID NO: 370209 - DNA, 16 bp, M. musculus
atgtggtagaggatgg

SEQ ID NO: 370210 - DNA, 16 bp, M. musculus
atgtggtatatgtatg

SEQ ID NO: 370211 - DNA, 16 bp, M. musculus
atgtggtatatttata

SEQ ID NO: 370212 - DNA, 16 bp, M. musculus
atgtggtatggtgtgt

SEQ ID NO: 370213 - DNA, 16 bp, M. musculus
atgtggtccatgagtt

SEQ ID NO: 370214 - DNA, 16 bp, M. musculus
atgtggtctctgggaa

SEQ ID NO: 370215 - DNA, 16 bp, M. musculus
atgtggtgcacaggca

SEQ ID NO: 370216 - DNA, 16 bp, M. musculus
atgtggtgctgagaac

SEQ ID NO: 370217 - DNA, 16 bp, M. musculus
atgtggtggtccttga

SEQ ID NO: 370218 - DNA, 16 bp, M. musculus
atgtggtgtgtatgta

SEQ ID NO: 370219 - DNA, 16 bp, M. musculus
atgtggtgttccttga

SEQ ID NO: 370220 - DNA, 16 bp, M. musculus
atgtggttattgggaa

SEQ ID NO: 370221 - DNA, 16 bp, M. musculus
atgtggttgctggatt

SEQ ID NO: 370222 - DNA, 24 bp, M. musculus
atgtggttgctgggatttgaactc

SEQ ID NO: 370223 - DNA, 16 bp, M. musculus
atgtggtttctgggga

SEQ ID NO: 370224 - DNA, 16 bp, M. musculus
atgtgtaaatatgtgt

SEQ ID NO: 370225 - DNA, 16 bp, M. musculus
atgtgtaatttttaaa

SEQ ID NO: 370226 - DNA, 19 bp, M. musculus
atgtgtacacacacacaca

SEQ ID NO: 370227 - DNA, 16 bp, M. musculus
atgtgtacacacacat

SEQ ID NO: 370228 - DNA, 16 bp, M. musculus
atgtgtacacatgtac

SEQ ID NO: 370229 - DNA, 16 bp, M. musculus
atgtgtacaggtattt

SEQ ID NO: 370230 - DNA, 16 bp, M. musculus
atgtgtacatatatgt

SEQ ID NO: 370231 - DNA, 16 bp, M. musculus
atgtgtacatgtatgt

SEQ ID NO: 370232 - DNA, 16 bp, M. musculus
atgtgtacatgtgggt

SEQ ID NO: 370233 - DNA, 16 bp, M. musculus
atgtgtacatgtgtgc

SEQ ID NO: 370234 - DNA, 16 bp, M. musculus
atgtgtaccatgtgta

SEQ ID NO: 370235 - DNA, 16 bp, M. musculus
atgtgtacctggtacc

SEQ ID NO: 370236 - DNA, 16 bp, M. musculus
atgtgtactggctggt

SEQ ID NO: 370237 - DNA, 16 bp, M. musculus
atgtgtactgtgtgtg

SEQ ID NO: 370238 - DNA, 16 bp, M. musculus
atgtgtaggtcagagg

SEQ ID NO: 370239 - DNA, 16 bp, M. musculus
atgtgtaggtgtgtgt

SEQ ID NO: 370240 - DNA, 16 bp, M. musculus
atgtgtataagtattt

SEQ ID NO: 370241 - DNA, 16 bp, M. musculus
atgtgtataatttaaa

SEQ ID NO: 370242 - DNA, 16 bp, M. musculus
atgtgtatacatatat

SEQ ID NO: 370243 - DNA, 16 bp, M. musculus
atgtgtatacatgcat

SEQ ID NO: 370244 - DNA, 16 bp, M. musculus
atgtgtatatatagat

SEQ ID NO: 370245 - DNA, 16 bp, M. musculus
atgtgtatatatataa

SEQ ID NO: 370246 - DNA, 17 bp, M. musculus
atgtgtatatatatata

SEQ ID NO: 370247 - DNA, 16 bp, M. musculus
atgtgtatatatatgt

SEQ ID NO: 370248 - DNA, 16 bp, M. musculus
atgtgtatatatattc

SEQ ID NO: 370249 - DNA, 16 bp, M. musculus
atgtgtatatatgaat

SEQ ID NO: 370250 - DNA, 16 bp, M. musculus
atgtgtatatgtaaat

SEQ ID NO: 370251 - DNA, 16 bp, M. musculus
atgtgtatatgtgttg

SEQ ID NO: 370252 - DNA, 16 bp, M. musculus
atgtgtatattttatg

SEQ ID NO: 370253 - DNA, 16 bp, M. musculus
atgtgtatctatgtaa

SEQ ID NO: 370254 - DNA, 16 bp, M. musculus
atgtgtatgaatattt

SEQ ID NO: 370255 - DNA, 16 bp, M. musculus
atgtgtatgagtgttt

SEQ ID NO: 370256 - DNA, 16 bp, M. musculus
atgtgtatgcacacaa

SEQ ID NO: 370257 - DNA, 16 bp, M. musculus
atgtgtatgcattcat

SEQ ID NO: 370258 - DNA, 16 bp, M. musculus
atgtgtatggatattt

SEQ ID NO: 370259 - DNA, 16 bp, M. musculus
atgtgtatgtacatat

SEQ ID NO: 370260 - DNA, 17 bp, M. musculus
atgtgtatgtacatgta

SEQ ID NO: 370261 - DNA, 16 bp, M. musculus
atgtgtatgtagtgtg

SEQ ID NO: 370262 - DNA, 16 bp, M. musculus
atgtgtatgtatctat

SEQ ID NO: 370263 - DNA, 16 bp, M. musculus
atgtgtatgtatctgt

SEQ ID NO: 370264 - DNA, 16 bp, M. musculus
atgtgtatgtatgtac

SEQ ID NO: 370265 - DNA, 16 bp, M. musculus
atgtgtatgtatgtgt

SEQ ID NO: 370266 - DNA, 16 bp, M. musculus
atgtgtatgtatgttt

SEQ ID NO: 370267 - DNA, 16 bp, M. musculus
atgtgtatgtgatata

SEQ ID NO: 370268 - DNA, 16 bp, M. musculus
atgtgtatgtgcctgt

SEQ ID NO: 370269 - DNA, 16 bp, M. musculus
atgtgtatgtgtatat

SEQ ID NO: 370270 - DNA, 16 bp, M. musculus
atgtgtatgtgtatgt

SEQ ID NO: 370271 - DNA, 16 bp, M. musculus
atgtgtatgtgtgagt

SEQ ID NO: 370272 - DNA, 16 bp, M. musculus
atgtgtatgtgtgtat

SEQ ID NO: 370273 - DNA, 16 bp, M. musculus
atgtgtatgtgtgtgt

SEQ ID NO: 370274 - DNA, 16 bp, M. musculus
atgtgtattctttggt

SEQ ID NO: 370275 - DNA, 16 bp, M. musculus
atgtgtatttacatat

SEQ ID NO: 370276 - DNA, 16 bp, M. musculus
atgtgtatttgcatgt

SEQ ID NO: 370277 - DNA, 16 bp, M. musculus
atgtgtatttgtatat

SEQ ID NO: 370278 - DNA, 16 bp, M. musculus
atgtgtcaacttgaca

SEQ ID NO: 370279 - DNA, 17 bp, M. musculus
atgtgtcaactttatgt

SEQ ID NO: 370280 - DNA, 16 bp, M. musculus
atgtgtcagagttctt

SEQ ID NO: 370281 - DNA, 16 bp, M. musculus
atgtgtcagtacaggg

SEQ ID NO: 370282 - DNA, 16 bp, M. musculus
atgtgtccattgatga

SEQ ID NO: 370283 - DNA, 16 bp, M. musculus
atgtgtccctgtggca

SEQ ID NO: 370284 - DNA, 16 bp, M. musculus
atgtgtccctgtgtgt

SEQ ID NO: 370285 - DNA, 16 bp, M. musculus
atgtgtctatgcatgt

SEQ ID NO: 370286 - DNA, 16 bp, M. musculus
atgtgtctcctaggtg

SEQ ID NO: 370287 - DNA, 16 bp, M. musculus
atgtgtctctagctgc

SEQ ID NO: 370288 - DNA, 16 bp, M. musculus
atgtgtctctggcttt

SEQ ID NO: 370289 - DNA, 16 bp, M. musculus
atgtgtctgaagacag

SEQ ID NO: 370290 - DNA, 16 bp, M. musculus
atgtgtctgaagtcag

SEQ ID NO: 370291 - DNA, 16 bp, M. musculus
atgtgtctgagtgtgt

SEQ ID NO: 370292 - DNA, 16 bp, M. musculus
atgtgtctgagtgttt

SEQ ID NO: 370293 - DNA, 16 bp, M. musculus
atgtgtctgtctctct

SEQ ID NO: 370294 - DNA, 16 bp, M. musculus
atgtgtctgtgtatat

SEQ ID NO: 370295 - DNA, 16 bp, M. musculus
atgtgtctgtgtgtgt

SEQ ID NO: 370296 - DNA, 16 bp, M. musculus
atgtgtctttcttacc

SEQ ID NO: 370297 - DNA, 16 bp, M. musculus
atgtgtgaatgtgtgt

SEQ ID NO: 370298 - DNA, 16 bp, M. musculus
atgtgtgaatgtgttt

SEQ ID NO: 370299 - DNA, 16 bp, M. musculus
atgtgtgaatgttttg

SEQ ID NO: 370300 - DNA, 16 bp, M. musculus
atgtgtgaccttagag

SEQ ID NO: 370301 - DNA, 16 bp, M. musculus
atgtgtgaggtcctgg

SEQ ID NO: 370302 - DNA, 16 bp, M. musculus
atgtgtgaggtgtgtg

SEQ ID NO: 370303 - DNA, 16 bp, M. musculus
atgtgtgagtgttttg

SEQ ID NO: 370304 - DNA, 16 bp, M. musculus
atgtgtgatgtgtgtg

SEQ ID NO: 370305 - DNA, 16 bp, M. musculus
atgtgtgcaagtgtat

SEQ ID NO: 370306 - DNA, 16 bp, M. musculus
atgtgtgcacacacca

SEQ ID NO: 370307 - DNA, 16 bp, M. musculus
atgtgtgcacacgtgt

SEQ ID NO: 370308 - DNA, 16 bp, M. musculus
atgtgtgcacataaat

SEQ ID NO: 370309 - DNA, 16 bp, M. musculus
atgtgtgcacatgtgt

SEQ ID NO: 370310 - DNA, 16 bp, M. musculus
atgtgtgcaggtcaga

SEQ ID NO: 370311 - DNA, 16 bp, M. musculus
atgtgtgcatatttgt

SEQ ID NO: 370312 - DNA, 16 bp, M. musculus
atgtgtgcatgcttgt

SEQ ID NO: 370313 - DNA, 16 bp, M. musculus
atgtgtgcatggtgtg

SEQ ID NO: 370314 - DNA, 17 bp, M. musculus
atgtgtgcatgtatgtg

SEQ ID NO: 370315 - DNA, 16 bp, M. musculus
atgtgtgcatgtgtgt

SEQ ID NO: 370316 - DNA, 16 bp, M. musculus
atgtgtgcctctgtgt

SEQ ID NO: 370317 - DNA, 16 bp, M. musculus
atgtgtgcctggtgcc

SEQ ID NO: 370318 - DNA, 16 bp, M. musculus
atgtgtgcctgtgtgt

SEQ ID NO: 370319 - DNA, 17 bp, M. musculus
atgtgtgcgtgtgcgtg

SEQ ID NO: 370320 - DNA, 16 bp, M. musculus
atgtgtgctgtggtat

SEQ ID NO: 370321 - DNA, 16 bp, M. musculus
atgtgtgcttgtatgt

SEQ ID NO: 370322 - DNA, 16 bp, M. musculus
atgtgtgcttgtgtgt

SEQ ID NO: 370323 - DNA, 16 bp, M. musculus
atgtgtggaggtcaga

SEQ ID NO: 370324 - DNA, 16 bp, M. musculus
atgtgtggatgtatgt

SEQ ID NO: 370325 - DNA, 16 bp, M. musculus
atgtgtggatgtgtgt

SEQ ID NO: 370326 - DNA, 16 bp, M. musculus
atgtgtgggcatgtgt

SEQ ID NO: 370327 - DNA, 16 bp, M. musculus
atgtgtggtatgtact

SEQ ID NO: 370328 - DNA, 16 bp, M. musculus
atgtgtggtgtatatg

SEQ ID NO: 370329 - DNA, 16 bp, M. musculus
atgtgtgtaaatatgt

SEQ ID NO: 370330 - DNA, 16 bp, M. musculus
atgtgtgtacaggtgc

SEQ ID NO: 370331 - DNA, 16 bp, M. musculus
atgtgtgtacatgtat

SEQ ID NO: 370332 - DNA, 16 bp, M. musculus
atgtgtgtactgggaa

SEQ ID NO: 370333 - DNA, 16 bp, M. musculus
atgtgtgtatatgtgt

SEQ ID NO: 370334 - DNA, 16 bp, M. musculus
atgtgtgtatatgttt

SEQ ID NO: 370335 - DNA, 16 bp, M. musculus
atgtgtgtatgcatgt

SEQ ID NO: 370336 - DNA, 16 bp, M. musculus
atgtgtgtatggatgt

SEQ ID NO: 370337 - DNA, 16 bp, M. musculus
atgtgtgtatgtagtg

SEQ ID NO: 370338 - DNA, 16 bp, M. musculus
atgtgtgtatgtatat

SEQ ID NO: 370339 - DNA, 19 bp, M. musculus
atgtgtgtatgtatgtgtg

SEQ ID NO: 370340 - DNA, 16 bp, M. musculus
atgtgtgtatgtgaga

SEQ ID NO: 370341 - DNA, 16 bp, M. musculus
atgtgtgtatgtgctt

SEQ ID NO: 370342 - DNA, 16 bp, M. musculus
atgtgtgtatgtgtat

SEQ ID NO: 370343 - DNA, 16 bp, M. musculus
atgtgtgtatgtgtct

SEQ ID NO: 370344 - DNA, 16 bp, M. musculus
atgtgtgtcatgtgtg

SEQ ID NO: 370345 - DNA, 16 bp, M. musculus
atgtgtgtcctgtgtg

SEQ ID NO: 370346 - DNA, 16 bp, M. musculus
atgtgtgtctatgtgt

SEQ ID NO: 370347 - DNA, 16 bp, M. musculus
atgtgtgtctgcatat

SEQ ID NO: 370348 - DNA, 16 bp, M. musculus
atgtgtgtctgtgggg

SEQ ID NO: 370349 - DNA, 16 bp, M. musculus
atgtgtgtctgtgtgt

SEQ ID NO: 370350 - DNA, 16 bp, M. musculus
atgtgtgtgaatacac

SEQ ID NO: 370351 - DNA, 16 bp, M. musculus
atgtgtgtgaatgtgc

SEQ ID NO: 370352 - DNA, 16 bp, M. musculus
atgtgtgtgagagaga

SEQ ID NO: 370353 - DNA, 16 bp, M. musculus
atgtgtgtgagagagg

SEQ ID NO: 370354 - DNA, 16 bp, M. musculus
atgtgtgtgagagcat

SEQ ID NO: 370355 - DNA, 16 bp, M. musculus
atgtgtgtgagagtgt

SEQ ID NO: 370356 - DNA, 16 bp, M. musculus
atgtgtgtgagcacag

SEQ ID NO: 370357 - DNA, 16 bp, M. musculus
atgtgtgtgcaaatgt

SEQ ID NO: 370358 - DNA, 16 bp, M. musculus
atgtgtgtgcacacac

SEQ ID NO: 370359 - DNA, 16 bp, M. musculus
atgtgtgtgcacacag

SEQ ID NO: 370360 - DNA, 16 bp, M. musculus
atgtgtgtgcagtgtg

SEQ ID NO: 370361 - DNA, 16 bp, M. musculus
atgtgtgtgcatggtg

SEQ ID NO: 370362 - DNA, 16 bp, M. musculus
atgtgtgtgcatgttc

SEQ ID NO: 370363 - DNA, 16 bp, M. musculus
atgtgtgtgcctctgt

SEQ ID NO: 370364 - DNA, 16 bp, M. musculus
atgtgtgtgctctgtg

SEQ ID NO: 370365 - DNA, 16 bp, M. musculus
atgtgtgtggatgtgt

SEQ ID NO: 370366 - DNA, 16 bp, M. musculus
atgtgtgtgggtttat

SEQ ID NO: 370367 - DNA, 16 bp, M. musculus
atgtgtgtgtaaatgt

SEQ ID NO: 370368 - DNA, 16 bp, M. musculus
atgtgtgtgtacattt

SEQ ID NO: 370369 - DNA, 17 bp, M. musculus
atgtgtgtgtataaata

SEQ ID NO: 370370 - DNA, 16 bp, M. musculus
atgtgtgtgtccatgc

SEQ ID NO: 370371 - DNA, 16 bp, M. musculus
atgtgtgtgtctttgt

SEQ ID NO: 370372 - DNA, 16 bp, M. musculus
atgtgtgtgtgaatgt

SEQ ID NO: 370373 - DNA, 16 bp, M. musculus
atgtgtgtgtgagaga

SEQ ID NO: 370374 - DNA, 16 bp, M. musculus
atgtgtgtgtgatgta

SEQ ID NO: 370375 - DNA, 16 bp, M. musculus
atgtgtgtgtgcatgt

SEQ ID NO: 370376 - DNA, 16 bp, M. musculus
atgtgtgtgtgcctgt

SEQ ID NO: 370377 - DNA, 16 bp, M. musculus
atgtgtgtgtgcgtgt

SEQ ID NO: 370378 - DNA, 16 bp, M. musculus
atgtgtgtgtgtatgt

SEQ ID NO: 370379 - DNA, 19 bp, M. musculus
atgtgtgtgtgtatgtatg

SEQ ID NO: 370380 - DNA, 16 bp, M. musculus
atgtgtgtgtgtctgt

SEQ ID NO: 370381 - DNA, 16 bp, M. musculus
atgtgtgtgtgtgtaa

SEQ ID NO: 370382 - DNA, 16 bp, M. musculus
atgtgtgtgtgtgtac

SEQ ID NO: 370383 - DNA, 16 bp, M. musculus
atgtgtgtgtgtgttc

SEQ ID NO: 370384 - DNA, 16 bp, M. musculus
atgtgtgtgtgttcat

SEQ ID NO: 370385 - DNA, 16 bp, M. musculus
atgtgtgtgttcatgt

SEQ ID NO: 370386 - DNA, 16 bp, M. musculus
atgtgtgttctttggt

SEQ ID NO: 370387 - DNA, 16 bp, M. musculus
atgtgtgtttgtgcat

SEQ ID NO: 370388 - DNA, 16 bp, M. musculus
atgtgtgttttcaggg

SEQ ID NO: 370389 - DNA, 16 bp, M. musculus
atgtgttaatttgctc

SEQ ID NO: 370390 - DNA, 16 bp, M. musculus
atgtgttcacatgtgt

SEQ ID NO: 370391 - DNA, 16 bp, M. musculus
atgtgttcctggccag

SEQ ID NO: 370392 - DNA, 16 bp, M. musculus
atgtgttcttgaattc

SEQ ID NO: 370393 - DNA, 16 bp, M. musculus
atgtgttctttgattt

SEQ ID NO: 370394 - DNA, 16 bp, M. musculus
atgtgtttagcaaaat

SEQ ID NO: 370395 - DNA, 16 bp, M. musculus
atgtgtttagtaaatt

SEQ ID NO: 370396 - DNA, 16 bp, M. musculus
atgtgtttatatatgt

SEQ ID NO: 370397 - DNA, 16 bp, M. musculus
atgtgtttgtatgcat

SEQ ID NO: 370398 - DNA, 16 bp, M. musculus
atgtgtttgtctgtat

SEQ ID NO: 370399 - DNA, 16 bp, M. musculus
atgtgtttgtgtgcct

SEQ ID NO: 370400 - DNA, 16 bp, M. musculus
atgtgtttgtgtgtct

SEQ ID NO: 370401 - DNA, 16 bp, M. musculus
atgtgtttgtgtgtgc

SEQ ID NO: 370402 - DNA, 16 bp, M. musculus
atgtgttttacaagtt

SEQ ID NO: 370403 - DNA, 16 bp, M. musculus
atgtgttttatgtata

SEQ ID NO: 370404 - DNA, 16 bp, M. musculus
atgtgttttccaatgg

SEQ ID NO: 370405 - DNA, 16 bp, M. musculus
atgtgttttcctctta

SEQ ID NO: 370406 - DNA, 16 bp, M. musculus
atgtgttttgcttgca

SEQ ID NO: 370407 - DNA, 16 bp, M. musculus
atgtgtttttattaca

SEQ ID NO: 370408 - DNA, 16 bp, M. musculus
atgtgtttttcaaatt

SEQ ID NO: 370409 - DNA, 16 bp, M. musculus
atgttaaacaaacaaa

SEQ ID NO: 370410 - DNA, 16 bp, M. musculus
atgttaaatgttaaat

SEQ ID NO: 370411 - DNA, 16 bp, M. musculus
atgttaacacacacac

SEQ ID NO: 370412 - DNA, 16 bp, M. musculus
atgttaagcaagcact

SEQ ID NO: 370413 - DNA, 16 bp, M. musculus
atgttaatgaggaaaa

SEQ ID NO: 370414 - DNA, 16 bp, M. musculus
atgttacatgttacat

SEQ ID NO: 370415 - DNA, 16 bp, M. musculus
atgttacttggctttt

SEQ ID NO: 370416 - DNA, 16 bp, M. musculus
atgttagactccagag

SEQ ID NO: 370417 - DNA, 27 bp, M. musculus
atgttagccatctggaacttggtcagg

SEQ ID NO: 370418 - DNA, 16 bp, M. musculus
atgttagctgagacag

SEQ ID NO: 370419 - DNA, 16 bp, M. musculus
atgttatcccttttcc

SEQ ID NO: 370420 - DNA, 16 bp, M. musculus
atgttatctatggaat

SEQ ID NO: 370421 - DNA, 16 bp, M. musculus
atgttcaaaagaaaaa

SEQ ID NO: 370422 - DNA, 16 bp, M. musculus
atgttcaaacacatga

SEQ ID NO: 370423 - DNA, 16 bp, M. musculus
atgttcacagtagcct

SEQ ID NO: 370424 - DNA, 16 bp, M. musculus
atgttcacagtcaact

SEQ ID NO: 370425 - DNA, 16 bp, M. musculus
atgttcacatacacac

SEQ ID NO: 370426 - DNA, 16 bp, M. musculus
atgttcacatgcatgt

SEQ ID NO: 370427 - DNA, 16 bp, M. musculus
atgttcagaattgaga

SEQ ID NO: 370428 - DNA, 16 bp, M. musculus
atgttcatgcctggtg

SEQ ID NO: 370429 - DNA, 16 bp, M. musculus
atgttcatggacatct

SEQ ID NO: 370430 - DNA, 16 bp, M. musculus
atgttcatgggcttct

SEQ ID NO: 370431 - DNA, 16 bp, M. musculus
atgttcatgtgcatct

SEQ ID NO: 370432 - DNA, 16 bp, M. musculus
atgttcattaaaaaac

SEQ ID NO: 370433 - DNA, 16 bp, M. musculus
atgttcattttgccat

SEQ ID NO: 370434 - DNA, 16 bp, M. musculus
atgttcattttttaaa

SEQ ID NO: 370435 - DNA, 16 bp, M. musculus
atgttccatccaatag

SEQ ID NO: 370436 - DNA, 16 bp, M. musculus
atgttccccaccatcc

SEQ ID NO: 370437 - DNA, 16 bp, M. musculus
atgttccttactggtt

SEQ ID NO: 370438 - DNA, 16 bp, M. musculus
atgttccttttcttct

SEQ ID NO: 370439 - DNA, 16 bp, M. musculus
atgttcgtgggcatct

SEQ ID NO: 370440 - DNA, 16 bp, M. musculus
atgttctaaatattta

SEQ ID NO: 370441 - DNA, 17 bp, M. musculus
atgttctacaaacatca

SEQ ID NO: 370442 - DNA, 16 bp, M. musculus
atgttctacaggcttg

SEQ ID NO: 370443 - DNA, 16 bp, M. musculus
atgttctatgggggtg

SEQ ID NO: 370444 - DNA, 16 bp, M. musculus
atgttctcagggcagt

SEQ ID NO: 370445 - DNA, 16 bp, M. musculus
atgttctctatgggat

SEQ ID NO: 370446 - DNA, 16 bp, M. musculus
atgttctcttctggtg

SEQ ID NO: 370447 - DNA, 16 bp, M. musculus
atgttctgctttctct

SEQ ID NO: 370448 - DNA, 16 bp, M. musculus
atgttcttacccactg

SEQ ID NO: 370449 - DNA, 16 bp, M. musculus
atgttcttattgaaga

SEQ ID NO: 370450 - DNA, 16 bp, M. musculus
atgttcttatttttaa

SEQ ID NO: 370451 - DNA, 16 bp, M. musculus
atgttcttcaacagag

SEQ ID NO: 370452 - DNA, 16 bp, M. musculus
atgttcttgttcttaa

SEQ ID NO: 370453 - DNA, 16 bp, M. musculus
atgttctttgaaggtc

SEQ ID NO: 370454 - DNA, 16 bp, M. musculus
atgttctttgcttggt

SEQ ID NO: 370455 - DNA, 16 bp, M. musculus
atgttgaacatttctt

SEQ ID NO: 370456 - DNA, 16 bp, M. musculus
atgttgaacattttat

SEQ ID NO: 370457 - DNA, 16 bp, M. musculus
atgttgaagaatgtga

SEQ ID NO: 370458 - DNA, 16 bp, M. musculus
atgttgaagtctctca

SEQ ID NO: 370459 - DNA, 16 bp, M. musculus
atgttgaataaaaaag

SEQ ID NO: 370460 - DNA, 16 bp, M. musculus
atgttgactggcttgg

SEQ ID NO: 370461 - DNA, 16 bp, M. musculus
atgttgaggcaggagg

SEQ ID NO: 370462 - DNA, 16 bp, M. musculus
atgttgatcctgtcaa

SEQ ID NO: 370463 - DNA, 16 bp, M. musculus
atgttgatgatgatga

SEQ ID NO: 370464 - DNA, 16 bp, M. musculus
atgttgatgggtttcc

SEQ ID NO: 370465 - DNA, 16 bp, M. musculus
atgttgcattttgtca

SEQ ID NO: 370466 - DNA, 16 bp, M. musculus
atgttgcccaggttgg

SEQ ID NO: 370467 - DNA, 16 bp, M. musculus
atgttgccctttataa

SEQ ID NO: 370468 - DNA, 16 bp, M. musculus
atgttgcctaggctgg

SEQ ID NO: 370469 - DNA, 16 bp, M. musculus
atgttgctactgttat

SEQ ID NO: 370470 - DNA, 16 bp, M. musculus
atgttgctttttgtca

SEQ ID NO: 370471 - DNA, 16 bp, M. musculus
atgttggactccagaa

SEQ ID NO: 370472 - DNA, 16 bp, M. musculus
atgttggagtgggcca

SEQ ID NO: 370473 - DNA, 16 bp, M. musculus
atgttggagttttcct

SEQ ID NO: 370474 - DNA, 16 bp, M. musculus
atgttggatcccctgg

SEQ ID NO: 370475 - DNA, 16 bp, M. musculus
atgttggcaagaatgt

SEQ ID NO: 370476 - DNA, 16 bp, M. musculus
atgttggcaaggatat

SEQ ID NO: 370477 - DNA, 16 bp, M. musculus
atgttgtattttaaaa

SEQ ID NO: 370478 - DNA, 16 bp, M. musculus
atgttgtcattgaaga

SEQ ID NO: 370479 - DNA, 17 bp, M. musculus
atgttgtccttaaaaga

SEQ ID NO: 370480 - DNA, 16 bp, M. musculus
atgttgtccttcttca

SEQ ID NO: 370481 - DNA, 16 bp, M. musculus
atgttgtcctttagaa

SEQ ID NO: 370482 - DNA, 16 bp, M. musculus
atgttgtcttctttcc

SEQ ID NO: 370483 - DNA, 16 bp, M. musculus
atgttgtgattaaaga

SEQ ID NO: 370484 - DNA, 17 bp, M. musculus
atgttgtggctgctgaa

SEQ ID NO: 370485 - DNA, 16 bp, M. musculus
atgttgtggcttcttt

SEQ ID NO: 370486 - DNA, 16 bp, M. musculus
atgttgtggtgaccca

SEQ ID NO: 370487 - DNA, 16 bp, M. musculus
atgttgtggttaagaa

SEQ ID NO: 370488 - DNA, 16 bp, M. musculus
atgttgtttccagttt

SEQ ID NO: 370489 - DNA, 16 bp, M. musculus
atgttgttttaaaatg

SEQ ID NO: 370490 - DNA, 16 bp, M. musculus
atgtttaaaaaaatgt

SEQ ID NO: 370491 - DNA, 16 bp, M. musculus
atgtttaaaaagaaga

SEQ ID NO: 370492 - DNA, 16 bp, M. musculus
atgtttaaaatgaaat

SEQ ID NO: 370493 - DNA, 16 bp, M. musculus
atgtttaactttaata

SEQ ID NO: 370494 - DNA, 16 bp, M. musculus
atgtttacacagcaag

SEQ ID NO: 370495 - DNA, 16 bp, M. musculus
atgtttacattttaaa

SEQ ID NO: 370496 - DNA, 16 bp, M. musculus
atgtttatagaagcct

SEQ ID NO: 370497 - DNA, 16 bp, M. musculus
atgtttatcctgccaa

SEQ ID NO: 370498 - DNA, 16 bp, M. musculus
atgtttatgtgtgcat

SEQ ID NO: 370499 - DNA, 16 bp, M. musculus
atgtttatttcattat

SEQ ID NO: 370500 - DNA, 16 bp, M. musculus
atgtttcaatttggag

SEQ ID NO: 370501 - DNA, 29 bp, M. musculus
atgtttcagtgaacacatttcaacagttc

SEQ ID NO: 370502 - DNA, 16 bp, M. musculus
atgtttccatggtgat

SEQ ID NO: 370503 - DNA, 16 bp, M. musculus
atgtttcctgccatga

SEQ ID NO: 370504 - DNA, 16 bp, M. musculus
atgtttcctttccttt

SEQ ID NO: 370505 - DNA, 16 bp, M. musculus
atgtttcttactgact

SEQ ID NO: 370506 - DNA, 16 bp, M. musculus
atgtttcttttccctt

SEQ ID NO: 370507 - DNA, 16 bp, M. musculus
atgtttgagatgccag

SEQ ID NO: 370508 - DNA, 16 bp, M. musculus
atgtttgcagacagaa

SEQ ID NO: 370509 - DNA, 16 bp, M. musculus
atgtttgcatgtgtgt

SEQ ID NO: 370510 - DNA, 16 bp, M. musculus
atgtttgctactggtt

SEQ ID NO: 370511 - DNA, 16 bp, M. musculus
atgtttgctcctgttt

SEQ ID NO: 370512 - DNA, 16 bp, M. musculus
atgtttgctttaaaaa

SEQ ID NO: 370513 - DNA, 16 bp, M. musculus
atgtttggaaaatatt

SEQ ID NO: 370514 - DNA, 16 bp, M. musculus
atgtttggcaaatgga

SEQ ID NO: 370515 - DNA, 16 bp, M. musculus
atgtttggcaggggct

SEQ ID NO: 370516 - DNA, 24 bp, M. musculus
atgtttggccttgaattttttcta

SEQ ID NO: 370517 - DNA, 16 bp, M. musculus
atgtttggctatgggt

SEQ ID NO: 370518 - DNA, 16 bp, M. musculus
atgtttgtctttctgt

SEQ ID NO: 370519 - DNA, 16 bp, M. musculus
atgtttgtgcacatgt

SEQ ID NO: 370520 - DNA, 16 bp, M. musculus
atgtttgtgtatatat

SEQ ID NO: 370521 - DNA, 16 bp, M. musculus
atgtttgtgtctctgt

SEQ ID NO: 370522 - DNA, 16 bp, M. musculus
atgtttgtgtctgtgt

SEQ ID NO: 370523 - DNA, 16 bp, M. musculus
atgtttgtgtgcatgc

SEQ ID NO: 370524 - DNA, 16 bp, M. musculus
atgtttgtgtgtataa

SEQ ID NO: 370525 - DNA, 16 bp, M. musculus
atgtttgttgaatgaa

SEQ ID NO: 370526 - DNA, 16 bp, M. musculus
atgtttgttgctactt

SEQ ID NO: 370527 - DNA, 16 bp, M. musculus
atgttttaaaaacaaa

SEQ ID NO: 370528 - DNA, 16 bp, M. musculus
atgttttaaaaacata

SEQ ID NO: 370529 - DNA, 16 bp, M. musculus
atgttttaaaaataca

SEQ ID NO: 370530 - DNA, 16 bp, M. musculus
atgttttaaaatacat

SEQ ID NO: 370531 - DNA, 16 bp, M. musculus
atgttttaaagaaaca

SEQ ID NO: 370532 - DNA, 16 bp, M. musculus
atgttttaaagagaaa

SEQ ID NO: 370533 - DNA, 16 bp, M. musculus
atgttttaaatgtgga

SEQ ID NO: 370534 - DNA, 16 bp, M. musculus
atgttttaaatgttaa

SEQ ID NO: 370535 - DNA, 16 bp, M. musculus
atgttttaagtgtgga

SEQ ID NO: 370536 - DNA, 16 bp, M. musculus
atgttttatctgcatg

SEQ ID NO: 370537 - DNA, 16 bp, M. musculus
atgttttcaaaataaa

SEQ ID NO: 370538 - DNA, 16 bp, M. musculus
atgttttcaacatttt

SEQ ID NO: 370539 - DNA, 16 bp, M. musculus
atgttttcagtgttct

SEQ ID NO: 370540 - DNA, 16 bp, M. musculus
atgttttcattgtgtc

SEQ ID NO: 370541 - DNA, 16 bp, M. musculus
atgttttccaatggtc

SEQ ID NO: 370542 - DNA, 16 bp, M. musculus
atgttttcctatattt

SEQ ID NO: 370543 - DNA, 16 bp, M. musculus
atgttttcctgaagca

SEQ ID NO: 370544 - DNA, 18 bp, M. musculus
atgttttcctgcaattct

SEQ ID NO: 370545 - DNA, 16 bp, M. musculus
atgttttcctttatag

SEQ ID NO: 370546 - DNA, 16 bp, M. musculus
atgttttctaaggaat

SEQ ID NO: 370547 - DNA, 16 bp, M. musculus
atgttttctatgatat

SEQ ID NO: 370548 - DNA, 16 bp, M. musculus
atgttttctctcattt

SEQ ID NO: 370549 - DNA, 16 bp, M. musculus
atgttttctgagcctt

SEQ ID NO: 370550 - DNA, 16 bp, M. musculus
atgttttctttcataa

SEQ ID NO: 370551 - DNA, 16 bp, M. musculus
atgttttctttgattg

SEQ ID NO: 370552 - DNA, 16 bp, M. musculus
atgttttcttttataa

SEQ ID NO: 370553 - DNA, 16 bp, M. musculus
atgttttcttttgtaa

SEQ ID NO: 370554 - DNA, 16 bp, M. musculus
atgttttgaaaaacaa

SEQ ID NO: 370555 - DNA, 16 bp, M. musculus
atgttttgccagcatg

SEQ ID NO: 370556 - DNA, 16 bp, M. musculus
atgttttgcctgtgtg

SEQ ID NO: 370557 - DNA, 16 bp, M. musculus
atgttttgcttgcatg

SEQ ID NO: 370558 - DNA, 16 bp, M. musculus
atgttttgtttaaaaa

SEQ ID NO: 370559 - DNA, 16 bp, M. musculus
atgtttttaaaagctg

SEQ ID NO: 370560 - DNA, 16 bp, M. musculus
atgtttttaaatttct

SEQ ID NO: 370561 - DNA, 16 bp, M. musculus
atgtttttcagtctgt

SEQ ID NO: 370562 - DNA, 16 bp, M. musculus
atgtttttctgaaaac

SEQ ID NO: 370563 - DNA, 16 bp, M. musculus
atgtttttgtaagaga

SEQ ID NO: 370564 - DNA, 16 bp, M. musculus
atgttttttatggaat

SEQ ID NO: 370565 - DNA, 16 bp, M. musculus
attaaaaaatgtggct

SEQ ID NO: 370566 - DNA, 16 bp, M. musculus
attaaaaacatgaatt

SEQ ID NO: 370567 - DNA, 16 bp, M. musculus
attaaaaacctcccaa

SEQ ID NO: 370568 - DNA, 16 bp, M. musculus
attaaaaagaaatcag

SEQ ID NO: 370569 - DNA, 16 bp, M. musculus
attaaaaagaaatctg

SEQ ID NO: 370570 - DNA, 16 bp, M. musculus
attaaaaataaaactg

SEQ ID NO: 370571 - DNA, 16 bp, M. musculus
attaaaaataaagctg

SEQ ID NO: 370572 - DNA, 16 bp, M. musculus
attaaaaataagactg

SEQ ID NO: 370573 - DNA, 16 bp, M. musculus
attaaaaataggcttt

SEQ ID NO: 370574 - DNA, 16 bp, M. musculus
attaaaaatgaagaca

SEQ ID NO: 370575 - DNA, 16 bp, M. musculus
attaaaaatgtggtac

SEQ ID NO: 370576 - DNA, 16 bp, M. musculus
attaaaacaagtttaa

SEQ ID NO: 370577 - DNA, 16 bp, M. musculus
attaaaaccaatagaa

SEQ ID NO: 370578 - DNA, 16 bp, M. musculus
attaaaactattttga

SEQ ID NO: 370579 - DNA, 16 bp, M. musculus
attaaaactgacaatg

SEQ ID NO: 370580 - DNA, 16 bp, M. musculus
attaaaagcttgattt

SEQ ID NO: 370581 - DNA, 16 bp, M. musculus
attaaaaggaacaaag

SEQ ID NO: 370582 - DNA, 16 bp, M. musculus
attaaaagtaaacttt

SEQ ID NO: 370583 - DNA, 16 bp, M. musculus
attaaaagtcatttta

SEQ ID NO: 370584 - DNA, 16 bp, M. musculus
attaaaagtttggctg

SEQ ID NO: 370585 - DNA, 16 bp, M. musculus
attaaaagttttcctt

SEQ ID NO: 370586 - DNA, 16 bp, M. musculus
attaaaatcagtaagg

SEQ ID NO: 370587 - DNA, 16 bp, M. musculus
attaaaatcatggctg

SEQ ID NO: 370588 - DNA, 16 bp, M. musculus
attaaaatgaagacac

SEQ ID NO: 370589 - DNA, 16 bp, M. musculus
attaaaatgcaagcca

SEQ ID NO: 370590 - DNA, 16 bp, M. musculus
attaaaatggaaaaca

SEQ ID NO: 370591 - DNA, 16 bp, M. musculus
attaaaatgtacatat

SEQ ID NO: 370592 - DNA, 16 bp, M. musculus
attaaaattgaggttt

SEQ ID NO: 370593 - DNA, 16 bp, M. musculus
attaaacaaaaccatc

SEQ ID NO: 370594 - DNA, 20 bp, M. musculus
attaaacatttgaaccttga

SEQ ID NO: 370595 - DNA, 16 bp, M. musculus
attaaaccctttcctc

SEQ ID NO: 370596 - DNA, 16 bp, M. musculus
attaaagaaaactcaa

SEQ ID NO: 370597 - DNA, 16 bp, M. musculus
attaaagaaaattcat

SEQ ID NO: 370598 - DNA, 16 bp, M. musculus
attaaagaaaatttgt

SEQ ID NO: 370599 - DNA, 16 bp, M. musculus
attaaagaagagctca

SEQ ID NO: 370600 - DNA, 16 bp, M. musculus
attaaagacatgaacc

SEQ ID NO: 370601 - DNA, 16 bp, M. musculus
attaaagacatgcacc

SEQ ID NO: 370602 - DNA, 16 bp, M. musculus
attaaagacattttag

SEQ ID NO: 370603 - DNA, 16 bp, M. musculus
attaaagaggaaacaa

SEQ ID NO: 370604 - DNA, 16 bp, M. musculus
attaaagagttgcagc

SEQ ID NO: 370605 - DNA, 16 bp, M. musculus
attaaagatgtgcact

SEQ ID NO: 370606 - DNA, 16 bp, M. musculus
attaaagatgtgtgcc

SEQ ID NO: 370607 - DNA, 16 bp, M. musculus
attaaagcaagcttta

SEQ ID NO: 370608 - DNA, 16 bp, M. musculus
attaaagccaatcaga

SEQ ID NO: 370609 - DNA, 16 bp, M. musculus
attaaagctttacaaa

SEQ ID NO: 370610 - DNA, 16 bp, M. musculus
attaaaggaaagctca

SEQ ID NO: 370611 - DNA, 16 bp, M. musculus
attaaaggcacaggcc

SEQ ID NO: 370612 - DNA, 16 bp, M. musculus
attaaaggcatacatc

SEQ ID NO: 370613 - DNA, 16 bp, M. musculus
attaaaggcatgtgca

SEQ ID NO: 370614 - DNA, 20 bp, M. musculus
attaaaggcgtgcaccacca

SEQ ID NO: 370615 - DNA, 18 bp, M. musculus
attaaaggcgtgtgccac

SEQ ID NO: 370616 - DNA, 16 bp, M. musculus
attaaaggtatgcact

SEQ ID NO: 370617 - DNA, 16 bp, M. musculus
attaaaggtgcatgcc

SEQ ID NO: 370618 - DNA, 16 bp, M. musculus
attaaaggtgtgcact

SEQ ID NO: 370619 - DNA, 16 bp, M. musculus
attaaaggtgtgttcc

SEQ ID NO: 370620 - DNA, 16 bp, M. musculus
attaaagtatatgttt

SEQ ID NO: 370621 - DNA, 17 bp, M. musculus
attaaagtcatgcgcca

SEQ ID NO: 370622 - DNA, 16 bp, M. musculus
attaaagtcctttttg

SEQ ID NO: 370623 - DNA, 16 bp, M. musculus
attaaataaatgtctg

SEQ ID NO: 370624 - DNA, 16 bp, M. musculus
attaaatattttcctc

SEQ ID NO: 370625 - DNA, 35 bp, M. musculus
attaaatcacaacatgagaagacaatgttggatat

SEQ ID NO: 370626 - DNA, 16 bp, M. musculus
attaaatcagaatcta

SEQ ID NO: 370627 - DNA, 16 bp, M. musculus
attaaatgaatgaatg

SEQ ID NO: 370628 - DNA, 16 bp, M. musculus
attaaatgagataatg

SEQ ID NO: 370629 - DNA, 16 bp, M. musculus
attaaatgattttcaa

SEQ ID NO: 370630 - DNA, 16 bp, M. musculus
attaaatgcttctttt

SEQ ID NO: 370631 - DNA, 16 bp, M. musculus
attaaatgttgtcctt

SEQ ID NO: 370632 - DNA, 16 bp, M. musculus
attaaatgttgtcttt

SEQ ID NO: 370633 - DNA, 16 bp, M. musculus
attaaatgttgttctt

SEQ ID NO: 370634 - DNA, 16 bp, M. musculus
attaaatgttgttttc

SEQ ID NO: 370635 - DNA, 16 bp, M. musculus
attaaatgtttgcttt

SEQ ID NO: 370636 - DNA, 16 bp, M. musculus
attaaattccaaaaag

SEQ ID NO: 370637 - DNA, 16 bp, M. musculus
attaaattctgttata

SEQ ID NO: 370638 - DNA, 16 bp, M. musculus
attaacaattaagaaa

SEQ ID NO: 370639 - DNA, 16 bp, M. musculus
attaacatagtctttc

SEQ ID NO: 370640 - DNA, 16 bp, M. musculus
attaacatccacattt

SEQ ID NO: 370641 - DNA, 20 bp, M. musculus
attaaccagttttgttaagt

SEQ ID NO: 370642 - DNA, 16 bp, M. musculus
attaaccctttccttt

SEQ ID NO: 370643 - DNA, 16 bp, M. musculus
attaactaaactagta

SEQ ID NO: 370644 - DNA, 16 bp, M. musculus
attaactagaaaagaa

SEQ ID NO: 370645 - DNA, 16 bp, M. musculus
attaactcaaatgaat

SEQ ID NO: 370646 - DNA, 16 bp, M. musculus
attaactgaaaatata

SEQ ID NO: 370647 - DNA, 16 bp, M. musculus
attaagaaaatgccct

SEQ ID NO: 370648 - DNA, 16 bp, M. musculus
attaagaaaatgtcct

SEQ ID NO: 370649 - DNA, 16 bp, M. musculus
attaagaagattgaga

SEQ ID NO: 370650 - DNA, 16 bp, M. musculus
attaagaatagacaaa

SEQ ID NO: 370651 - DNA, 16 bp, M. musculus
attaagaatgaagaca

SEQ ID NO: 370652 - DNA, 16 bp, M. musculus
attaagaatgaggata

SEQ ID NO: 370653 - DNA, 16 bp, M. musculus
attaagaattccttgt

SEQ ID NO: 370654 - DNA, 16 bp, M. musculus
attaagacatttaaaa

SEQ ID NO: 370655 - DNA, 16 bp, M. musculus
attaagacttttgaag

SEQ ID NO: 370656 - DNA, 16 bp, M. musculus
attaagagcactggct

SEQ ID NO: 370657 - DNA, 16 bp, M. musculus
attaagagtgcttgct

SEQ ID NO: 370658 - DNA, 16 bp, M. musculus
attaagcaaggctgtg

SEQ ID NO: 370659 - DNA, 16 bp, M. musculus
attaagccaggtgtgg

SEQ ID NO: 370660 - DNA, 16 bp, M. musculus
attaagcctctgaaac

SEQ ID NO: 370661 - DNA, 16 bp, M. musculus
attaaggactagccta

SEQ ID NO: 370662 - DNA, 22 bp, M. musculus
attaaggatgctgaacattttt

SEQ ID NO: 370663 - DNA, 16 bp, M. musculus
attaaggatgcttaac

SEQ ID NO: 370664 - DNA, 16 bp, M. musculus
attaaggtgggaacat

SEQ ID NO: 370665 - DNA, 16 bp, M. musculus
attaagtggaaaagat

SEQ ID NO: 370666 - DNA, 16 bp, M. musculus
attaatagaagtctgt

SEQ ID NO: 370667 - DNA, 16 bp, M. musculus
attaatagtgttaggg

SEQ ID NO: 370668 - DNA, 16 bp, M. musculus
attaatatagttctca

SEQ ID NO: 370669 - DNA, 16 bp, M. musculus
attaatatctagaata

SEQ ID NO: 370670 - DNA, 16 bp, M. musculus
attaatattcagagat

SEQ ID NO: 370671 - DNA, 16 bp, M. musculus
attaatcaataaaatg

SEQ ID NO: 370672 - DNA, 16 bp, M. musculus
attaatcaataaagag

SEQ ID NO: 370673 - DNA, 16 bp, M. musculus
attaatcactaattaa

SEQ ID NO: 370674 - DNA, 16 bp, M. musculus
attaatcattccattt

SEQ ID NO: 370675 - DNA, 26 bp, M. musculus
attaatcccacccattttttaaagaa

SEQ ID NO: 370676 - DNA, 16 bp, M. musculus
attaatgacctaaaca

SEQ ID NO: 370677 - DNA, 16 bp, M. musculus
attaatgatatcaaag

SEQ ID NO: 370678 - DNA, 16 bp, M. musculus
attaatgattaatatg

SEQ ID NO: 370679 - DNA, 16 bp, M. musculus
attaatgcacagatgc

SEQ ID NO: 370680 - DNA, 16 bp, M. musculus
attaatgcatctctca

SEQ ID NO: 370681 - DNA, 16 bp, M. musculus
attaatggatttctgt

SEQ ID NO: 370682 - DNA, 16 bp, M. musculus
attaatgtggattcat

SEQ ID NO: 370683 - DNA, 16 bp, M. musculus
attaatgttttctctt

SEQ ID NO: 370684 - DNA, 16 bp, M. musculus
attaattaagaaactg

SEQ ID NO: 370685 - DNA, 16 bp, M. musculus
attaattctgccaatt

SEQ ID NO: 370686 - DNA, 17 bp, M. musculus
attaattgcattgacaa

SEQ ID NO: 370687 - DNA, 16 bp, M. musculus
attaatttgaaaacat

SEQ ID NO: 370688 - DNA, 16 bp, M. musculus
attaattttccattcc

SEQ ID NO: 370689 - DNA, 16 bp, M. musculus
attaatttttaaagga

SEQ ID NO: 370690 - DNA, 16 bp, M. musculus
attacaaacagttgtg

SEQ ID NO: 370691 - DNA, 29 bp, M. musculus
attacaaagttaactaggaggtatacctt

SEQ ID NO: 370692 - DNA, 16 bp, M. musculus
attacaaataagtctg

SEQ ID NO: 370693 - DNA, 16 bp, M. musculus
attacaaatgtgtcca

SEQ ID NO: 370694 - DNA, 16 bp, M. musculus
attacaatatttttgt

SEQ ID NO: 370695 - DNA, 16 bp, M. musculus
attacaccagacttca

SEQ ID NO: 370696 - DNA, 16 bp, M. musculus
attacagaaaaattaa

SEQ ID NO: 370697 - DNA, 16 bp, M. musculus
attacagaaatagaaa

SEQ ID NO: 370698 - DNA, 16 bp, M. musculus
attacagaagttgctg

SEQ ID NO: 370699 - DNA, 16 bp, M. musculus
attacagatctatcca

SEQ ID NO: 370700 - DNA, 17 bp, M. musculus
attacagatggatgtga

SEQ ID NO: 370701 - DNA, 17 bp, M. musculus
attacagatggttatga

SEQ ID NO: 370702 - DNA, 18 bp, M. musculus
attacagatggttgtgaa

SEQ ID NO: 370703 - DNA, 16 bp, M. musculus
attacagcagacttct

SEQ ID NO: 370704 - DNA, 16 bp, M. musculus
attacaggaaaaaaca

SEQ ID NO: 370705 - DNA, 16 bp, M. musculus
attacaggaggcagag

SEQ ID NO: 370706 - DNA, 16 bp, M. musculus
attacaggcatgtgcc

SEQ ID NO: 370707 - DNA, 16 bp, M. musculus
attacaggtggttgtg

SEQ ID NO: 370708 - DNA, 17 bp, M. musculus
attacaggtggttgtga

SEQ ID NO: 370709 - DNA, 16 bp, M. musculus
attacagtgatggaaa

SEQ ID NO: 370710 - DNA, 16 bp, M. musculus
attacagttatgaagt

SEQ ID NO: 370711 - DNA, 16 bp, M. musculus
attacatatatatgta

SEQ ID NO: 370712 - DNA, 16 bp, M. musculus
attacatcaaggaaca

SEQ ID NO: 370713 - DNA, 16 bp, M. musculus
attacatcatgaaatt

SEQ ID NO: 370714 - DNA, 16 bp, M. musculus
attacatcttttaaaa

SEQ ID NO: 370715 - DNA, 16 bp, M. musculus
attacatgaatatatg

SEQ ID NO: 370716 - DNA, 16 bp, M. musculus
attacattagtgcaga

SEQ ID NO: 370717 - DNA, 16 bp, M. musculus
attacattgactgatt

SEQ ID NO: 370718 - DNA, 16 bp, M. musculus
attacatttatttgtt

SEQ ID NO: 370719 - DNA, 16 bp, M. musculus
attaccatgagtttga

SEQ ID NO: 370720 - DNA, 16 bp, M. musculus
attacccaatttaggc

SEQ ID NO: 370721 - DNA, 16 bp, M. musculus
attacctcagagataa

SEQ ID NO: 370722 - DNA, 16 bp, M. musculus
attacctggttcctgt

SEQ ID NO: 370723 - DNA, 16 bp, M. musculus
attacctgtagctctt

SEQ ID NO: 370724 - DNA, 21 bp, M. musculus
attacggatggttgtgagcca

SEQ ID NO: 370725 - DNA, 16 bp, M. musculus
attactcctggatgaa

SEQ ID NO: 370726 - DNA, 19 bp, M. musculus
attactctgatacctaaac

SEQ ID NO: 370727 - DNA, 16 bp, M. musculus
attactgtgtttaaaa

SEQ ID NO: 370728 - DNA, 16 bp, M. musculus
attacttagctaacat

SEQ ID NO: 370729 - DNA, 16 bp, M. musculus
attacttcaattgttt

SEQ ID NO: 370730 - DNA, 16 bp, M. musculus
attacttgtgtgtgtg

SEQ ID NO: 370731 - DNA, 16 bp, M. musculus
attactttcatgcttt

SEQ ID NO: 370732 - DNA, 16 bp, M. musculus
attactttgaattttt

SEQ ID NO: 370733 - DNA, 16 bp, M. musculus
attactttgtgtgtgt

SEQ ID NO: 370734 - DNA, 16 bp, M. musculus
attagaaaaaattcaa

SEQ ID NO: 370735 - DNA, 16 bp, M. musculus
attagaaaagcagttg

SEQ ID NO: 370736 - DNA, 16 bp, M. musculus
attagaaagggtaatt

SEQ ID NO: 370737 - DNA, 16 bp, M. musculus
attagaaatttcattt

SEQ ID NO: 370738 - DNA, 16 bp, M. musculus
attagaacttcacaag

SEQ ID NO: 370739 - DNA, 17 bp, M. musculus
attagaagcaagttggt

SEQ ID NO: 370740 - DNA, 16 bp, M. musculus
attagaaggtatggcc

SEQ ID NO: 370741 - DNA, 16 bp, M. musculus
attagaccttatttaa

SEQ ID NO: 370742 - DNA, 16 bp, M. musculus
attagagagagagaga

SEQ ID NO: 370743 - DNA, 16 bp, M. musculus
attagatactttattt

SEQ ID NO: 370744 - DNA, 16 bp, M. musculus
attagatattagttcc

SEQ ID NO: 370745 - DNA, 16 bp, M. musculus
attagatatttacttt

SEQ ID NO: 370746 - DNA, 16 bp, M. musculus
attagatattttctgc

SEQ ID NO: 370747 - DNA, 16 bp, M. musculus
attagatgtggccttg

SEQ ID NO: 370748 - DNA, 16 bp, M. musculus
attagatgttgaaaaa

SEQ ID NO: 370749 - DNA, 16 bp, M. musculus
attagattctagaaaa

SEQ ID NO: 370750 - DNA, 16 bp, M. musculus
attagcatggagaact

SEQ ID NO: 370751 - DNA, 16 bp, M. musculus
attagccacaagaaga

SEQ ID NO: 370752 - DNA, 16 bp, M. musculus
attagccaggcccgag

SEQ ID NO: 370753 - DNA, 16 bp, M. musculus
attagcccagaagctc

SEQ ID NO: 370754 - DNA, 16 bp, M. musculus
attagccctttatcgg

SEQ ID NO: 370755 - DNA, 16 bp, M. musculus
attagcctcttccttc

SEQ ID NO: 370756 - DNA, 62 bp, M. musculus
attagcggaggtctctaggagatactcgtcactagatgagctcaggaagccagctcttagta

SEQ ID NO: 370757 - DNA, 16 bp, M. musculus
attaggaaagcagaaa

SEQ ID NO: 370758 - DNA, 16 bp, M. musculus
attaggaattcaaggt

SEQ ID NO: 370759 - DNA, 16 bp, M. musculus
attaggacaaaatggc

SEQ ID NO: 370760 - DNA, 16 bp, M. musculus
attaggacagaatttc

SEQ ID NO: 370761 - DNA, 16 bp, M. musculus
attagggaaacaaaac

SEQ ID NO: 370762 - DNA, 16 bp, M. musculus
attagggaggttgaga

SEQ ID NO: 370763 - DNA, 16 bp, M. musculus
attaggggaaagctgg

SEQ ID NO: 370764 - DNA, 17 bp, M. musculus
attaggtattttcctcg

SEQ ID NO: 370765 - DNA, 16 bp, M. musculus
attaggtcccatttat

SEQ ID NO: 370766 - DNA, 17 bp, M. musculus
attagtcactgcccatg

SEQ ID NO: 370767 - DNA, 16 bp, M. musculus
attagtttcaatgtgt

SEQ ID NO: 370768 - DNA, 16 bp, M. musculus
attagttttcttcaat

SEQ ID NO: 370769 - DNA, 16 bp, M. musculus
attagttttgttgcta

SEQ ID NO: 370770 - DNA, 16 bp, M. musculus
attataaatatggctt

SEQ ID NO: 370771 - DNA, 16 bp, M. musculus
attataatggacagca

SEQ ID NO: 370772 - DNA, 16 bp, M. musculus
attataattccactga

SEQ ID NO: 370773 - DNA, 16 bp, M. musculus
attatacataactaca

SEQ ID NO: 370774 - DNA, 16 bp, M. musculus
attatacctgacttct

SEQ ID NO: 370775 - DNA, 16 bp, M. musculus
attatagattatagat

SEQ ID NO: 370776 - DNA, 16 bp, M. musculus
attatagatttaaaag

SEQ ID NO: 370777 - DNA, 16 bp, M. musculus
attataggagccagag

SEQ ID NO: 370778 - DNA, 16 bp, M. musculus
attataggcatgtgcc

SEQ ID NO: 370779 - DNA, 16 bp, M. musculus
attatatacatatgta

SEQ ID NO: 370780 - DNA, 16 bp, M. musculus
attatatacatgtatg

SEQ ID NO: 370781 - DNA, 16 bp, M. musculus
attatatagggaggag

SEQ ID NO: 370782 - DNA, 16 bp, M. musculus
attatatatcatatgt

SEQ ID NO: 370783 - DNA, 16 bp, M. musculus
attatatatgtgtata

SEQ ID NO: 370784 - DNA, 16 bp, M. musculus
attatatattacacat

SEQ ID NO: 370785 - DNA, 16 bp, M. musculus
attatatattagaatg

SEQ ID NO: 370786 - DNA, 16 bp, M. musculus
attatatctacctgtg

SEQ ID NO: 370787 - DNA, 16 bp, M. musculus
attatatctcaataaa

SEQ ID NO: 370788 - DNA, 16 bp, M. musculus
attatatggaagtaca

SEQ ID NO: 370789 - DNA, 16 bp, M. musculus
attatatggtcaattt

SEQ ID NO: 370790 - DNA, 16 bp, M. musculus
attatatgtaaggaca

SEQ ID NO: 370791 - DNA, 16 bp, M. musculus
attatatgtatacatg

SEQ ID NO: 370792 - DNA, 16 bp, M. musculus
attatattgatcctgc

SEQ ID NO: 370793 - DNA, 16 bp, M. musculus
attatatttcataaca

SEQ ID NO: 370794 - DNA, 16 bp, M. musculus
attatcaatcaagaaa

SEQ ID NO: 370795 - DNA, 16 bp, M. musculus
attatcagaacaacaa

SEQ ID NO: 370796 - DNA, 16 bp, M. musculus
attatcatcaagatgg

SEQ ID NO: 370797 - DNA, 16 bp, M. musculus
attatcatcatagcaa

SEQ ID NO: 370798 - DNA, 16 bp, M. musculus
attatcatcatcatca

SEQ ID NO: 370799 - DNA, 16 bp, M. musculus
attatcatcatggtgg

SEQ ID NO: 370800 - DNA, 16 bp, M. musculus
attatcattaggtttg

SEQ ID NO: 370801 - DNA, 16 bp, M. musculus
attatcattggggagc

SEQ ID NO: 370802 - DNA, 17 bp, M. musculus
attatcccagaaactta

SEQ ID NO: 370803 - DNA, 16 bp, M. musculus
attatctcaagtgctt

SEQ ID NO: 370804 - DNA, 16 bp, M. musculus
attatctccagtgcca

SEQ ID NO: 370805 - DNA, 17 bp, M. musculus
attatcttgctgaggcc

SEQ ID NO: 370806 - DNA, 16 bp, M. musculus
attatctttgttaatt

SEQ ID NO: 370807 - DNA, 16 bp, M. musculus
attatgaaaatttctt

SEQ ID NO: 370808 - DNA, 16 bp, M. musculus
attatgaaagagaaac

SEQ ID NO: 370809 - DNA, 16 bp, M. musculus
attatgaaatggatcc

SEQ ID NO: 370810 - DNA, 34 bp, M. musculus
attatgaagcatactctgaagtactcttctcctt

SEQ ID NO: 370811 - DNA, 16 bp, M. musculus
attatgacattttcat

SEQ ID NO: 370812 - DNA, 16 bp, M. musculus
attatgatgaaattgc

SEQ ID NO: 370813 - DNA, 16 bp, M. musculus
attatgcaaattataa

SEQ ID NO: 370814 - DNA, 16 bp, M. musculus
attatgctaaaggcca

SEQ ID NO: 370815 - DNA, 16 bp, M. musculus
attatgctttttaaaa

SEQ ID NO: 370816 - DNA, 16 bp, M. musculus
attatggctatgcaat

SEQ ID NO: 370817 - DNA, 16 bp, M. musculus
attatgggcccttgat

SEQ ID NO: 370818 - DNA, 16 bp, M. musculus
attatgtagctttggc

SEQ ID NO: 370819 - DNA, 16 bp, M. musculus
attatgttcacagcag

SEQ ID NO: 370820 - DNA, 16 bp, M. musculus
attatgttgttggatt

SEQ ID NO: 370821 - DNA, 16 bp, M. musculus
attatgtttagatatg

SEQ ID NO: 370822 - DNA, 16 bp, M. musculus
attattaaattgttga

SEQ ID NO: 370823 - DNA, 16 bp, M. musculus
attattaattctcaag

SEQ ID NO: 370824 - DNA, 16 bp, M. musculus
attattagtattagta

SEQ ID NO: 370825 - DNA, 16 bp, M. musculus
attattatgtattttc

SEQ ID NO: 370826 - DNA, 16 bp, M. musculus
attattatgtgttgtg

SEQ ID NO: 370827 - DNA, 16 bp, M. musculus
attattattattcctg

SEQ ID NO: 370828 - DNA, 16 bp, M. musculus
attattattattgaga

SEQ ID NO: 370829 - DNA, 16 bp, M. musculus
attattcaagaaaatg

SEQ ID NO: 370830 - DNA, 16 bp, M. musculus
attattccttagaagc

SEQ ID NO: 370831 - DNA, 16 bp, M. musculus
attattctgctaaata

SEQ ID NO: 370832 - DNA, 16 bp, M. musculus
attattgctattttat

SEQ ID NO: 370833 - DNA, 16 bp, M. musculus
attattgtacataagt

SEQ ID NO: 370834 - DNA, 16 bp, M. musculus
attattgtatcaattt

SEQ ID NO: 370835 - DNA, 16 bp, M. musculus
attattgtgtccatgt

SEQ ID NO: 370836 - DNA, 16 bp, M. musculus
attattgtgtggggtt

SEQ ID NO: 370837 - DNA, 16 bp, M. musculus
attatttatgtgtgtg

SEQ ID NO: 370838 - DNA, 16 bp, M. musculus
attatttatttcctgt

SEQ ID NO: 370839 - DNA, 16 bp, M. musculus
attatttatttgcatt

SEQ ID NO: 370840 - DNA, 16 bp, M. musculus
attatttcaaaatgaa

SEQ ID NO: 370841 - DNA, 16 bp, M. musculus
attatttcagaatatt

SEQ ID NO: 370842 - DNA, 16 bp, M. musculus
attatttgataatttc

SEQ ID NO: 370843 - DNA, 16 bp, M. musculus
attatttgggaatttt

SEQ ID NO: 370844 - DNA, 16 bp, M. musculus
attatttgtttacatt

SEQ ID NO: 370845 - DNA, 16 bp, M. musculus
attattttaaaacaca

SEQ ID NO: 370846 - DNA, 16 bp, M. musculus
attattttaaaagaca

SEQ ID NO: 370847 - DNA, 16 bp, M. musculus
attattttatatgcta

SEQ ID NO: 370848 - DNA, 16 bp, M. musculus
attattttatgtctat

SEQ ID NO: 370849 - DNA, 16 bp, M. musculus
attattttgtttctac

SEQ ID NO: 370850 - DNA, 16 bp, M. musculus
attatttttaaaagct

SEQ ID NO: 370851 - DNA, 16 bp, M. musculus
attatttttgttacat

SEQ ID NO: 370852 - DNA, 16 bp, M. musculus
attatttttgttgcta

SEQ ID NO: 370853 - DNA, 16 bp, M. musculus
attcaaaatgaatttg

SEQ ID NO: 370854 - DNA, 16 bp, M. musculus
attcaaaccaccagag

SEQ ID NO: 370855 - DNA, 16 bp, M. musculus
attcaaaccaccccag

SEQ ID NO: 370856 - DNA, 16 bp, M. musculus
attcaaaccactacac

SEQ ID NO: 370857 - DNA, 16 bp, M. musculus
attcaaactaccatag

SEQ ID NO: 370858 - DNA, 16 bp, M. musculus
attcaaactcagggct

SEQ ID NO: 370859 - DNA, 16 bp, M. musculus
attcaaagaaaatgca

SEQ ID NO: 370860 - DNA, 16 bp, M. musculus
attcaaagaaaatgga

SEQ ID NO: 370861 - DNA, 16 bp, M. musculus
attcaaagaagaccta

SEQ ID NO: 370862 - DNA, 16 bp, M. musculus
attcaaagaattaact

SEQ ID NO: 370863 - DNA, 16 bp, M. musculus
attcaaagcccaaggt

SEQ ID NO: 370864 - DNA, 16 bp, M. musculus
attcaaatatatgagc

SEQ ID NO: 370865 - DNA, 16 bp, M. musculus
attcaaatcccagcaa

SEQ ID NO: 370866 - DNA, 16 bp, M. musculus
attcaaatgctaaata

SEQ ID NO: 370867 - DNA, 16 bp, M. musculus
attcaaatgttgattt

SEQ ID NO: 370868 - DNA, 16 bp, M. musculus
attcaacaaatggtgc

SEQ ID NO: 370869 - DNA, 16 bp, M. musculus
attcaacattttcttt

SEQ ID NO: 370870 - DNA, 60 bp, M. musculus
attcaaccgcataagggaacgacagatttggcgggatatgtccgcctttgcgcagacatc

SEQ ID NO: 370871 - DNA, 16 bp, M. musculus
attcaactgctttcct

SEQ ID NO: 370872 - DNA, 16 bp, M. musculus
attcaactttgtactt

SEQ ID NO: 370873 - DNA, 16 bp, M. musculus
attcaagaagaacaaa

SEQ ID NO: 370874 - DNA, 16 bp, M. musculus
attcaagagcgctctc

SEQ ID NO: 370875 - DNA, 16 bp, M. musculus
attcaagatcagcctg

SEQ ID NO: 370876 - DNA, 16 bp, M. musculus
attcaagattcctctg

SEQ ID NO: 370877 - DNA, 16 bp, M. musculus
attcaaggcaagcctg

SEQ ID NO: 370878 - DNA, 16 bp, M. musculus
attcaaggtgtgtgcc

SEQ ID NO: 370879 - DNA, 16 bp, M. musculus
attcaatacaattccc

SEQ ID NO: 370880 - DNA, 16 bp, M. musculus
attcaatgaaaatgat

SEQ ID NO: 370881 - DNA, 16 bp, M. musculus
attcaattcaatctcc

SEQ ID NO: 370882 - DNA, 16 bp, M. musculus
attcacacagagacac

SEQ ID NO: 370883 - DNA, 17 bp, M. musculus
attcacacattatcttt

SEQ ID NO: 370884 - DNA, 16 bp, M. musculus
attcacagaacaaatg

SEQ ID NO: 370885 - DNA, 16 bp, M. musculus
attcacagagaaacat

SEQ ID NO: 370886 - DNA, 16 bp, M. musculus
attcacatacacacac

SEQ ID NO: 370887 - DNA, 16 bp, M. musculus
attcacatatactttt

SEQ ID NO: 370888 - DNA, 16 bp, M. musculus
attcacatgtactttt

SEQ ID NO: 370889 - DNA, 16 bp, M. musculus
attcacatgtgtgtat

SEQ ID NO: 370890 - DNA, 16 bp, M. musculus
attcacattacatccc

SEQ ID NO: 370891 - DNA, 16 bp, M. musculus
attcacatttcaaatg

SEQ ID NO: 370892 - DNA, 16 bp, M. musculus
attcaccactttttct

SEQ ID NO: 370893 - DNA, 16 bp, M. musculus
attcaccctctgaaac

SEQ ID NO: 370894 - DNA, 16 bp, M. musculus
attcacctgtctctgc

SEQ ID NO: 370895 - DNA, 16 bp, M. musculus
attcactatgtagacc

SEQ ID NO: 370896 - DNA, 16 bp, M. musculus
attcactcactcactc

SEQ ID NO: 370897 - DNA, 16 bp, M. musculus
attcactctcctggcc

SEQ ID NO: 370898 - DNA, 16 bp, M. musculus
attcacttattcattt

SEQ ID NO: 370899 - DNA, 16 bp, M. musculus
attcacttgcaaacac

SEQ ID NO: 370900 - DNA, 16 bp, M. musculus
attcactttccatccc

SEQ ID NO: 370901 - DNA, 16 bp, M. musculus
attcagaaaaattaca

SEQ ID NO: 370902 - DNA, 16 bp, M. musculus
attcagaaaagagcag

SEQ ID NO: 370903 - DNA, 16 bp, M. musculus
attcagaaaattaaaa

SEQ ID NO: 370904 - DNA, 16 bp, M. musculus
attcagaaacaaagat

SEQ ID NO: 370905 - DNA, 16 bp, M. musculus
attcagaaatttttcc

SEQ ID NO: 370906 - DNA, 16 bp, M. musculus
attcagaagacagagg

SEQ ID NO: 370907 - DNA, 16 bp, M. musculus
attcagaaggctgagg

SEQ ID NO: 370908 - DNA, 16 bp, M. musculus
attcagaagttcaagg

SEQ ID NO: 370909 - DNA, 16 bp, M. musculus
attcagagaaagaaaa

SEQ ID NO: 370910 - DNA, 16 bp, M. musculus
attcagagaaatcctg

SEQ ID NO: 370911 - DNA, 16 bp, M. musculus
attcagagactgcctc

SEQ ID NO: 370912 - DNA, 16 bp, M. musculus
attcagagacttcccc

SEQ ID NO: 370913 - DNA, 16 bp, M. musculus
attcagagcatgggga

SEQ ID NO: 370914 - DNA, 16 bp, M. musculus
attcagagccctggat

SEQ ID NO: 370915 - DNA, 16 bp, M. musculus
attcagcaaatattta

SEQ ID NO: 370916 - DNA, 16 bp, M. musculus
attcagcaacaggggt

SEQ ID NO: 370917 - DNA, 16 bp, M. musculus
attcagcagctgcaga

SEQ ID NO: 370918 - DNA, 16 bp, M. musculus
attcagctatgaaaaa

SEQ ID NO: 370919 - DNA, 16 bp, M. musculus
attcagcttgctttct

SEQ ID NO: 370920 - DNA, 16 bp, M. musculus
attcaggaattcaagg

SEQ ID NO: 370921 - DNA, 16 bp, M. musculus
attcaggaattttgcc

SEQ ID NO: 370922 - DNA, 16 bp, M. musculus
attcaggacttctgga

SEQ ID NO: 370923 - DNA, 16 bp, M. musculus
attcaggaggcagagg

SEQ ID NO: 370924 - DNA, 16 bp, M. musculus
attcaggaggctgagg

SEQ ID NO: 370925 - DNA, 16 bp, M. musculus
attcaggatagcattt

SEQ ID NO: 370926 - DNA, 16 bp, M. musculus
attcaggatggtattt

SEQ ID NO: 370927 - DNA, 16 bp, M. musculus
attcaggcaaaacact

SEQ ID NO: 370928 - DNA, 16 bp, M. musculus
attcaggctggagaga

SEQ ID NO: 370929 - DNA, 16 bp, M. musculus
attcagtcaacaaaaa

SEQ ID NO: 370930 - DNA, 16 bp, M. musculus
attcagtccattatca

SEQ ID NO: 370931 - DNA, 16 bp, M. musculus
attcagtctcagttta

SEQ ID NO: 370932 - DNA, 16 bp, M. musculus
attcagtgcagaattc

SEQ ID NO: 370933 - DNA, 16 bp, M. musculus
attcagttcccaggac

SEQ ID NO: 370934 - DNA, 16 bp, M. musculus
attcataaaagaaact

SEQ ID NO: 370935 - DNA, 16 bp, M. musculus
attcataacagcaaaa

SEQ ID NO: 370936 - DNA, 16 bp, M. musculus
attcataactccagtt

SEQ ID NO: 370937 - DNA, 16 bp, M. musculus
attcataatagccaag

SEQ ID NO: 370938 - DNA, 16 bp, M. musculus
attcataatgtctgtt

SEQ ID NO: 370939 - DNA, 16 bp, M. musculus
attcatacacacaaat

SEQ ID NO: 370940 - DNA, 16 bp, M. musculus
attcatacagataaaa

SEQ ID NO: 370941 - DNA, 16 bp, M. musculus
attcatagcagtagca

SEQ ID NO: 370942 - DNA, 16 bp, M. musculus
attcatatattttaga

SEQ ID NO: 370943 - DNA, 16 bp, M. musculus
attcatattaagagat

SEQ ID NO: 370944 - DNA, 16 bp, M. musculus
attcatattcaaacca

SEQ ID NO: 370945 - DNA, 16 bp, M. musculus
attcatattcatattc

SEQ ID NO: 370946 - DNA, 16 bp, M. musculus
attcatcaaggggaaa

SEQ ID NO: 370947 - DNA, 21 bp, M. musculus
attcatcaccaaaggaagtca

SEQ ID NO: 370948 - DNA, 16 bp, M. musculus
attcatcactttttct

SEQ ID NO: 370949 - DNA, 16 bp, M. musculus
attcatcatcatcttc

SEQ ID NO: 370950 - DNA, 16 bp, M. musculus
attcatcattttaaat

SEQ ID NO: 370951 - DNA, 16 bp, M. musculus
attcatccccaagatc

SEQ ID NO: 370952 - DNA, 16 bp, M. musculus
attcatctaatcactt

SEQ ID NO: 370953 - DNA, 16 bp, M. musculus
attcatctcagagaaa

SEQ ID NO: 370954 - DNA, 16 bp, M. musculus
attcatctgtattaac

SEQ ID NO: 370955 - DNA, 16 bp, M. musculus
attcatctttttaaaa

SEQ ID NO: 370956 - DNA, 16 bp, M. musculus
attcatgatctttcca

SEQ ID NO: 370957 - DNA, 16 bp, M. musculus
attcatgcagttgaat

SEQ ID NO: 370958 - DNA, 16 bp, M. musculus
attcatgctcatttat

SEQ ID NO: 370959 - DNA, 16 bp, M. musculus
attcatggaaagatac

SEQ ID NO: 370960 - DNA, 16 bp, M. musculus
attcatgtctcaactt

SEQ ID NO: 370961 - DNA, 16 bp, M. musculus
attcatgtgacataca

SEQ ID NO: 370962 - DNA, 16 bp, M. musculus
attcattaaaggaact

SEQ ID NO: 370963 - DNA, 16 bp, M. musculus
attcattaaattctaa

SEQ ID NO: 370964 - DNA, 18 bp, M. musculus
attcattaagaaaatcaa

SEQ ID NO: 370965 - DNA, 16 bp, M. musculus
attcattatataaaca

SEQ ID NO: 370966 - DNA, 16 bp, M. musculus
attcattcaaagaaag

SEQ ID NO: 370967 - DNA, 16 bp, M. musculus
attcattcaacaaaca

SEQ ID NO: 370968 - DNA, 16 bp, M. musculus
attcattcattcactc

SEQ ID NO: 370969 - DNA, 16 bp, M. musculus
attcattcattcatgt

SEQ ID NO: 370970 - DNA, 16 bp, M. musculus
attcattcattccatt

SEQ ID NO: 370971 - DNA, 16 bp, M. musculus
attcattcatttgcat

SEQ ID NO: 370972 - DNA, 16 bp, M. musculus
attcattcatttgttt

SEQ ID NO: 370973 - DNA, 16 bp, M. musculus
attcattgataagtgg

SEQ ID NO: 370974 - DNA, 16 bp, M. musculus
attcattgtttttaat

SEQ ID NO: 370975 - DNA, 16 bp, M. musculus
attcatttattagtga

SEQ ID NO: 370976 - DNA, 16 bp, M. musculus
attcatttctctctgt

SEQ ID NO: 370977 - DNA, 16 bp, M. musculus
attcatttggaataaa

SEQ ID NO: 370978 - DNA, 16 bp, M. musculus
attcatttgtttgctt

SEQ ID NO: 370979 - DNA, 16 bp, M. musculus
attccaaaaggaaaaa

SEQ ID NO: 370980 - DNA, 16 bp, M. musculus
attccaaacaaatttg

SEQ ID NO: 370981 - DNA, 16 bp, M. musculus
attccaacactcaaga

SEQ ID NO: 370982 - DNA, 16 bp, M. musculus
attccaacacttggga

SEQ ID NO: 370983 - DNA, 16 bp, M. musculus
attccaacagagaact

SEQ ID NO: 370984 - DNA, 16 bp, M. musculus
attccaagtacccaca

SEQ ID NO: 370985 - DNA, 16 bp, M. musculus
attccaatattcctca

SEQ ID NO: 370986 - DNA, 16 bp, M. musculus
attccaatatttttgt

SEQ ID NO: 370987 - DNA, 16 bp, M. musculus
attccaattccaattc

SEQ ID NO: 370988 - DNA, 16 bp, M. musculus
attccaatttttaaaa

SEQ ID NO: 370989 - DNA, 17 bp, M. musculus
attccacaacaaaacca

SEQ ID NO: 370990 - DNA, 16 bp, M. musculus
attccaccaaagttca

SEQ ID NO: 370991 - DNA, 16 bp, M. musculus
attccaccagaagttt

SEQ ID NO: 370992 - DNA, 16 bp, M. musculus
attccaccagagaagt

SEQ ID NO: 370993 - DNA, 16 bp, M. musculus
attccaccatgtgttt

SEQ ID NO: 370994 - DNA, 16 bp, M. musculus
attccaccttacaaca

SEQ ID NO: 370995 - DNA, 16 bp, M. musculus
attccactccctggct

SEQ ID NO: 370996 - DNA, 16 bp, M. musculus
attccactgtgttcca

SEQ ID NO: 370997 - DNA, 16 bp, M. musculus
attccacttcctggtt

SEQ ID NO: 370998 - DNA, 16 bp, M. musculus
attccagaaccagaac

SEQ ID NO: 370999 - DNA, 16 bp, M. musculus
attccagaattctttc

SEQ ID NO: 371000 - DNA, 16 bp, M. musculus
attccagaattgtcac

SEQ ID NO: 371001 - DNA, 16 bp, M. musculus
attccagatcctgtca

SEQ ID NO: 371002 - DNA, 16 bp, M. musculus
attccagcacccagga

SEQ ID NO: 371003 - DNA, 16 bp, M. musculus
attccagcactcagaa

SEQ ID NO: 371004 - DNA, 16 bp, M. musculus
attccagcactgggga

SEQ ID NO: 371005 - DNA, 16 bp, M. musculus
attccagcattctgga

SEQ ID NO: 371006 - DNA, 16 bp, M. musculus
attccagccagaagga

SEQ ID NO: 371007 - DNA, 16 bp, M. musculus
attccagcctaggcta

SEQ ID NO: 371008 - DNA, 16 bp, M. musculus
attccagctccaggaa

SEQ ID NO: 371009 - DNA, 16 bp, M. musculus
attccaggagatggtg

SEQ ID NO: 371010 - DNA, 16 bp, M. musculus
attccaggccagcctg

SEQ ID NO: 371011 - DNA, 16 bp, M. musculus
attccaggccaggctg

SEQ ID NO: 371012 - DNA, 16 bp, M. musculus
attccaggtatagtca

SEQ ID NO: 371013 - DNA, 16 bp, M. musculus
attccaggtgaatttg

SEQ ID NO: 371014 - DNA, 16 bp, M. musculus
attccaggtgtcaaaa

SEQ ID NO: 371015 - DNA, 16 bp, M. musculus
attccaggtgtgtgcc

SEQ ID NO: 371016 - DNA, 16 bp, M. musculus
attccagtaacccagt

SEQ ID NO: 371017 - DNA, 16 bp, M. musculus
attccagtacttgaga

SEQ ID NO: 371018 - DNA, 16 bp, M. musculus
attccagtacttggga

SEQ ID NO: 371019 - DNA, 16 bp, M. musculus
attccataagttctgt

SEQ ID NO: 371020 - DNA, 31 bp, M. musculus
attccatagagaacattggcacaacaatcaa

SEQ ID NO: 371021 - DNA, 16 bp, M. musculus
attccataggaaacat

SEQ ID NO: 371022 - DNA, 16 bp, M. musculus
attccatcttacacct

SEQ ID NO: 371023 - DNA, 16 bp, M. musculus
attccatctttattta

SEQ ID NO: 371024 - DNA, 16 bp, M. musculus
attccatgacaaaaca

SEQ ID NO: 371025 - DNA, 16 bp, M. musculus
attccatggagaacat

SEQ ID NO: 371026 - DNA, 16 bp, M. musculus
attccattctgtaaat

SEQ ID NO: 371027 - DNA, 16 bp, M. musculus
attccattgatcaaca

SEQ ID NO: 371028 - DNA, 16 bp, M. musculus
attccattgtataaat

SEQ ID NO: 371029 - DNA, 16 bp, M. musculus
attccattgtatgaat

SEQ ID NO: 371030 - DNA, 16 bp, M. musculus
attccattgtgtgtat

SEQ ID NO: 371031 - DNA, 16 bp, M. musculus
attccatttatctacc

SEQ ID NO: 371032 - DNA, 16 bp, M. musculus
attcccaatacccaca

SEQ ID NO: 371033 - DNA, 16 bp, M. musculus
attcccactgttagga

SEQ ID NO: 371034 - DNA, 21 bp, M. musculus
attcccagaagaaggagataa

SEQ ID NO: 371035 - DNA, 16 bp, M. musculus
attcccagcacccact

SEQ ID NO: 371036 - DNA, 16 bp, M. musculus
attcccagcacccatg

SEQ ID NO: 371037 - DNA, 16 bp, M. musculus
attcccagcactcaca

SEQ ID NO: 371038 - DNA, 16 bp, M. musculus
attcccagcatcccca

SEQ ID NO: 371039 - DNA, 16 bp, M. musculus
attcccagctcccaca

SEQ ID NO: 371040 - DNA, 16 bp, M. musculus
attcccaggacaagaa

SEQ ID NO: 371041 - DNA, 16 bp, M. musculus
attcccagggagctct

SEQ ID NO: 371042 - DNA, 16 bp, M. musculus
attcccagtactcaca

SEQ ID NO: 371043 - DNA, 16 bp, M. musculus
attcccagttagttct

SEQ ID NO: 371044 - DNA, 16 bp, M. musculus
attcccatggaaggag

SEQ ID NO: 371045 - DNA, 16 bp, M. musculus
attcccatggcctttt

SEQ ID NO: 371046 - DNA, 16 bp, M. musculus
attcccatttttttgg

SEQ ID NO: 371047 - DNA, 16 bp, M. musculus
attccccaaatgcaag

SEQ ID NO: 371048 - DNA, 16 bp, M. musculus
attcccctacactggg

SEQ ID NO: 371049 - DNA, 22 bp, M. musculus
attcccctgtactggggcatat

SEQ ID NO: 371050 - DNA, 21 bp, M. musculus
attcccgccaattaatcttgg

SEQ ID NO: 371051 - DNA, 16 bp, M. musculus
attccctgatcctctg

SEQ ID NO: 371052 - DNA, 16 bp, M. musculus
attccctggagctgga

SEQ ID NO: 371053 - DNA, 16 bp, M. musculus
attcctaaaattatac

SEQ ID NO: 371054 - DNA, 16 bp, M. musculus
attcctaaagctagcc

SEQ ID NO: 371055 - DNA, 16 bp, M. musculus
attcctagacaaaaca

SEQ ID NO: 371056 - DNA, 16 bp, M. musculus
attcctcaggagagaa

SEQ ID NO: 371057 - DNA, 16 bp, M. musculus
attcctcaggtgggaa

SEQ ID NO: 371058 - DNA, 16 bp, M. musculus
attcctcagtggagaa

SEQ ID NO: 371059 - DNA, 16 bp, M. musculus
attcctcagttgaaaa

SEQ ID NO: 371060 - DNA, 16 bp, M. musculus
attcctcagttgacaa

SEQ ID NO: 371061 - DNA, 16 bp, M. musculus
attcctcatcaaagaa

SEQ ID NO: 371062 - DNA, 16 bp, M. musculus
attcctccaaacaaaa

SEQ ID NO: 371063 - DNA, 16 bp, M. musculus
attcctccagtgagaa

SEQ ID NO: 371064 - DNA, 16 bp, M. musculus
attcctcctcccctgt

SEQ ID NO: 371065 - DNA, 16 bp, M. musculus
attcctcctcctcctg

SEQ ID NO: 371066 - DNA, 93 bp, M. musculus
attcctcgaggtgaccagccagcaacctggtggcaggttgactacattggaccacttccttcgtggaaaggacagcgttttgttcttactgga

SEQ ID NO: 371067 - DNA, 16 bp, M. musculus
attcctctatactggg

SEQ ID NO: 371068 - DNA, 16 bp, M. musculus
attcctctattgagaa

SEQ ID NO: 371069 - DNA, 16 bp, M. musculus
attcctctgcctctgc

SEQ ID NO: 371070 - DNA, 16 bp, M. musculus
attcctctgctgagaa

SEQ ID NO: 371071 - DNA, 16 bp, M. musculus
attcctgaccagaaca

SEQ ID NO: 371072 - DNA, 16 bp, M. musculus
attcctgagagtctct

SEQ ID NO: 371073 - DNA, 31 bp, M. musculus
attcctgaggtcttttatctgttgtagcttt

SEQ ID NO: 371074 - DNA, 16 bp, M. musculus
attcctgagttaacat

SEQ ID NO: 371075 - DNA, 16 bp, M. musculus
attcctgatcctggca

SEQ ID NO: 371076 - DNA, 16 bp, M. musculus
attcctgcaagctgtc

SEQ ID NO: 371077 - DNA, 16 bp, M. musculus
attcctgcaccaacat

SEQ ID NO: 371078 - DNA, 16 bp, M. musculus
attcctggaaagatat

SEQ ID NO: 371079 - DNA, 16 bp, M. musculus
attcctggaatgcctc

SEQ ID NO: 371080 - DNA, 16 bp, M. musculus
attcctggagctggag

SEQ ID NO: 371081 - DNA, 16 bp, M. musculus
attcctggctgaagca

SEQ ID NO: 371082 - DNA, 16 bp, M. musculus
attcctgggatgcagg

SEQ ID NO: 371083 - DNA, 16 bp, M. musculus
attcctggggaaattt

SEQ ID NO: 371084 - DNA, 16 bp, M. musculus
attcctgtctaaaaga

SEQ ID NO: 371085 - DNA, 16 bp, M. musculus
attcctgttgctgtga

SEQ ID NO: 371086 - DNA, 16 bp, M. musculus
attccttatgatatgt

SEQ ID NO: 371087 - DNA, 16 bp, M. musculus
attccttcatctttgt

SEQ ID NO: 371088 - DNA, 16 bp, M. musculus
attccttcattgctgg

SEQ ID NO: 371089 - DNA, 16 bp, M. musculus
attccttggttcctgt

SEQ ID NO: 371090 - DNA, 16 bp, M. musculus
attcctttgttgtgaa

SEQ ID NO: 371091 - DNA, 16 bp, M. musculus
attcctttttgtgagt

SEQ ID NO: 371092 - DNA, 16 bp, M. musculus
attcgagacagggttt

SEQ ID NO: 371093 - DNA, 16 bp, M. musculus
attcgtggtcataaca

SEQ ID NO: 371094 - DNA, 16 bp, M. musculus
attctaaagtcctgta

SEQ ID NO: 371095 - DNA, 16 bp, M. musculus
attctaactggagtga

SEQ ID NO: 371096 - DNA, 16 bp, M. musculus
attctaagaagaggca

SEQ ID NO: 371097 - DNA, 16 bp, M. musculus
attctaagcaggggct

SEQ ID NO: 371098 - DNA, 16 bp, M. musculus
attctaatgctaattt

SEQ ID NO: 371099 - DNA, 16 bp, M. musculus
attctaattcaaacca

SEQ ID NO: 371100 - DNA, 16 bp, M. musculus
attctacaaaatagaa

SEQ ID NO: 371101 - DNA, 16 bp, M. musculus
attctagaaaatattt

SEQ ID NO: 371102 - DNA, 16 bp, M. musculus
attctagaaatgaaaa

SEQ ID NO: 371103 - DNA, 22 bp, M. musculus
attctagaggaaattcaggaca

SEQ ID NO: 371104 - DNA, 16 bp, M. musculus
attctagattatgtca

SEQ ID NO: 371105 - DNA, 16 bp, M. musculus
attctagcactcaaga

SEQ ID NO: 371106 - DNA, 16 bp, M. musculus
attctagcacttggga

SEQ ID NO: 371107 - DNA, 16 bp, M. musculus
attctaggaaagagag

SEQ ID NO: 371108 - DNA, 16 bp, M. musculus
attctatcagctctgt

SEQ ID NO: 371109 - DNA, 16 bp, M. musculus
attctatctgtattta

SEQ ID NO: 371110 - DNA, 16 bp, M. musculus
attctatgatgaagac

SEQ ID NO: 371111 - DNA, 16 bp, M. musculus
attctatgtatgtgag

SEQ ID NO: 371112 - DNA, 16 bp, M. musculus
attctattcagttata

SEQ ID NO: 371113 - DNA, 16 bp, M. musculus
attctattgctgtgat

SEQ ID NO: 371114 - DNA, 16 bp, M. musculus
attctattttgtaaat

SEQ ID NO: 371115 - DNA, 16 bp, M. musculus
attctcaaagaattaa

SEQ ID NO: 371116 - DNA, 16 bp, M. musculus
attctcaaagaattca

SEQ ID NO: 371117 - DNA, 16 bp, M. musculus
attctcaaattcatct

SEQ ID NO: 371118 - DNA, 16 bp, M. musculus
attctcaacaaaggaa

SEQ ID NO: 371119 - DNA, 16 bp, M. musculus
attctcaacaaccaca

SEQ ID NO: 371120 - DNA, 16 bp, M. musculus
attctcaacagaagaa

SEQ ID NO: 371121 - DNA, 16 bp, M. musculus
attctcaacatctatg

SEQ ID NO: 371122 - DNA, 16 bp, M. musculus
attctcaactgaggac

SEQ ID NO: 371123 - DNA, 16 bp, M. musculus
attctcaactgagtaa

SEQ ID NO: 371124 - DNA, 16 bp, M. musculus
attctcacttccatct

SEQ ID NO: 371125 - DNA, 16 bp, M. musculus
attctcagctacatat

SEQ ID NO: 371126 - DNA, 16 bp, M. musculus
attctcagcttcaaca

SEQ ID NO: 371127 - DNA, 16 bp, M. musculus
attctcatcaataaaa

SEQ ID NO: 371128 - DNA, 16 bp, M. musculus
attctcatgtactcct

SEQ ID NO: 371129 - DNA, 16 bp, M. musculus
attctcattcattctc

SEQ ID NO: 371130 - DNA, 16 bp, M. musculus
attctcattttacaga

SEQ ID NO: 371131 - DNA, 16 bp, M. musculus
attctccatctaccca

SEQ ID NO: 371132 - DNA, 16 bp, M. musculus
attctcccaaaggaaa

SEQ ID NO: 371133 - DNA, 16 bp, M. musculus
attctcccttccatct

SEQ ID NO: 371134 - DNA, 16 bp, M. musculus
attctcctctgagaag

SEQ ID NO: 371135 - DNA, 16 bp, M. musculus
attctcctgaaaaagg

SEQ ID NO: 371136 - DNA, 16 bp, M. musculus
attctcctgacaaatg

SEQ ID NO: 371137 - DNA, 16 bp, M. musculus
attctcctgcctcaac

SEQ ID NO: 371138 - DNA, 16 bp, M. musculus
attctcctgcctcagc

SEQ ID NO: 371139 - DNA, 16 bp, M. musculus
attctcctgcctccac

SEQ ID NO: 371140 - DNA, 16 bp, M. musculus
attctcctgcctcggc

SEQ ID NO: 371141 - DNA, 16 bp, M. musculus
attctcctgcttcagc

SEQ ID NO: 371142 - DNA, 16 bp, M. musculus
attctcctggctttct

SEQ ID NO: 371143 - DNA, 24 bp, M. musculus
attctccttcgcctcggacgtgtc

SEQ ID NO: 371144 - DNA, 16 bp, M. musculus
attctctccagcatct

SEQ ID NO: 371145 - DNA, 16 bp, M. musculus
attctctcctgaggaa

SEQ ID NO: 371146 - DNA, 16 bp, M. musculus
attctctcttgctctt

SEQ ID NO: 371147 - DNA, 16 bp, M. musculus
attctctgcaccttga

SEQ ID NO: 371148 - DNA, 16 bp, M. musculus
attctctgccctgcct

SEQ ID NO: 371149 - DNA, 16 bp, M. musculus
attctctgctacatat

SEQ ID NO: 371150 - DNA, 16 bp, M. musculus
attctctgctgtatat

SEQ ID NO: 371151 - DNA, 16 bp, M. musculus
attctcttcagacaca

SEQ ID NO: 371152 - DNA, 16 bp, M. musculus
attctcttggagatgg

SEQ ID NO: 371153 - DNA, 16 bp, M. musculus
attctcttgtctctgc

SEQ ID NO: 371154 - DNA, 16 bp, M. musculus
attctctttcagatga

SEQ ID NO: 371155 - DNA, 16 bp, M. musculus
attctctttgattgtt

SEQ ID NO: 371156 - DNA, 16 bp, M. musculus
attctgaaaataaaga

SEQ ID NO: 371157 - DNA, 16 bp, M. musculus
attctgactggagtaa

SEQ ID NO: 371158 - DNA, 16 bp, M. musculus
attctgaggcaaatgg

SEQ ID NO: 371159 - DNA, 16 bp, M. musculus
attctgatgattctaa

SEQ ID NO: 371160 - DNA, 16 bp, M. musculus
attctgattatggttt

SEQ ID NO: 371161 - DNA, 16 bp, M. musculus
attctgatttaattat

SEQ ID NO: 371162 - DNA, 16 bp, M. musculus
attctgattttaaaaa

SEQ ID NO: 371163 - DNA, 16 bp, M. musculus
attctgcctgcctctg

SEQ ID NO: 371164 - DNA, 16 bp, M. musculus
attctgctgcttgctg

SEQ ID NO: 371165 - DNA, 16 bp, M. musculus
attctgctggccctca

SEQ ID NO: 371166 - DNA, 16 bp, M. musculus
attctggaaaaaaaaa

SEQ ID NO: 371167 - DNA, 17 bp, M. musculus
attctggaactcactct

SEQ ID NO: 371168 - DNA, 16 bp, M. musculus
attctggaggcagagg

SEQ ID NO: 371169 - DNA, 16 bp, M. musculus
attctggaggctgagg

SEQ ID NO: 371170 - DNA, 16 bp, M. musculus
attctggccttcctgg

SEQ ID NO: 371171 - DNA, 16 bp, M. musculus
attctggctagactcc

SEQ ID NO: 371172 - DNA, 16 bp, M. musculus
attctggctgattctg

SEQ ID NO: 371173 - DNA, 16 bp, M. musculus
attctggctgtcctgg

SEQ ID NO: 371174 - DNA, 16 bp, M. musculus
attctgggacccacag

SEQ ID NO: 371175 - DNA, 16 bp, M. musculus
attctgggattaaagg

SEQ ID NO: 371176 - DNA, 16 bp, M. musculus
attctgggctcctgtg

SEQ ID NO: 371177 - DNA, 16 bp, M. musculus
attctggttggttgat

SEQ ID NO: 371178 - DNA, 16 bp, M. musculus
attctggtttctgttt

SEQ ID NO: 371179 - DNA, 16 bp, M. musculus
attctgtagcccagac

SEQ ID NO: 371180 - DNA, 16 bp, M. musculus
attctgtaggcttctt

SEQ ID NO: 371181 - DNA, 16 bp, M. musculus
attctgtataataaaa

SEQ ID NO: 371182 - DNA, 16 bp, M. musculus
attctgtattttatgg

SEQ ID NO: 371183 - DNA, 16 bp, M. musculus
attctgtctacttccc

SEQ ID NO: 371184 - DNA, 16 bp, M. musculus
attctgtctcaaaaaa

SEQ ID NO: 371185 - DNA, 16 bp, M. musculus
attctgtctcaaagaa

SEQ ID NO: 371186 - DNA, 16 bp, M. musculus
attctgtcttctgctt

SEQ ID NO: 371187 - DNA, 16 bp, M. musculus
attctgtgattcatgt

SEQ ID NO: 371188 - DNA, 16 bp, M. musculus
attctgtgattctgtg

SEQ ID NO: 371189 - DNA, 16 bp, M. musculus
attctgtggacttctg

SEQ ID NO: 371190 - DNA, 16 bp, M. musculus
attctgttaaaaaaaa

SEQ ID NO: 371191 - DNA, 16 bp, M. musculus
attctgttaaatcttt

SEQ ID NO: 371192 - DNA, 16 bp, M. musculus
attctgttggtgatgc

SEQ ID NO: 371193 - DNA, 16 bp, M. musculus
attcttaaaaaattgg

SEQ ID NO: 371194 - DNA, 16 bp, M. musculus
attcttaacaaaatat

SEQ ID NO: 371195 - DNA, 16 bp, M. musculus
attcttaggacaaggg

SEQ ID NO: 371196 - DNA, 16 bp, M. musculus
attcttaggcaaatga

SEQ ID NO: 371197 - DNA, 16 bp, M. musculus
attcttatctctttgt

SEQ ID NO: 371198 - DNA, 16 bp, M. musculus
attcttcagcaaatca

SEQ ID NO: 371199 - DNA, 16 bp, M. musculus
attcttcatagaaatt

SEQ ID NO: 371200 - DNA, 19 bp, M. musculus
attcttcatctgcttcaga

SEQ ID NO: 371201 - DNA, 16 bp, M. musculus
attcttccataaaagt

SEQ ID NO: 371202 - DNA, 16 bp, M. musculus
attcttcctttgttct

SEQ ID NO: 371203 - DNA, 16 bp, M. musculus
attcttctaatatctg

SEQ ID NO: 371204 - DNA, 16 bp, M. musculus
attcttctacatgaaa

SEQ ID NO: 371205 - DNA, 18 bp, M. musculus
attcttctacatgataac

SEQ ID NO: 371206 - DNA, 16 bp, M. musculus
attcttctacatgtaa

SEQ ID NO: 371207 - DNA, 16 bp, M. musculus
attcttctatatgttg

SEQ ID NO: 371208 - DNA, 17 bp, M. musculus
attcttctcctttgaaa

SEQ ID NO: 371209 - DNA, 16 bp, M. musculus
attcttctctgaaacc

SEQ ID NO: 371210 - DNA, 16 bp, M. musculus
attcttctgtcctggg

SEQ ID NO: 371211 - DNA, 16 bp, M. musculus
attcttctgtgtttgg

SEQ ID NO: 371212 - DNA, 16 bp, M. musculus
attcttcttgagattc

SEQ ID NO: 371213 - DNA, 16 bp, M. musculus
attcttcttgagtttc

SEQ ID NO: 371214 - DNA, 16 bp, M. musculus
attcttgaaatatttt

SEQ ID NO: 371215 - DNA, 16 bp, M. musculus
attcttggacttccca

SEQ ID NO: 371216 - DNA, 16 bp, M. musculus
attcttgtatctgttg

SEQ ID NO: 371217 - DNA, 16 bp, M. musculus
attcttgtgatatttt

SEQ ID NO: 371218 - DNA, 16 bp, M. musculus
attctttactggcttg

SEQ ID NO: 371219 - DNA, 16 bp, M. musculus
attctttatgtaaaaa

SEQ ID NO: 371220 - DNA, 27 bp, M. musculus
attctttccagcttctggctattataa

SEQ ID NO: 371221 - DNA, 16 bp, M. musculus
attctttctgccttct

SEQ ID NO: 371222 - DNA, 16 bp, M. musculus
attctttctgctagcc

SEQ ID NO: 371223 - DNA, 16 bp, M. musculus
attctttctgctgacc

SEQ ID NO: 371224 - DNA, 16 bp, M. musculus
attctttctgtttcct

SEQ ID NO: 371225 - DNA, 16 bp, M. musculus
attctttgagaaaatc

SEQ ID NO: 371226 - DNA, 16 bp, M. musculus
attctttggaactgat

SEQ ID NO: 371227 - DNA, 16 bp, M. musculus
attctttggccagaaa

SEQ ID NO: 371228 - DNA, 16 bp, M. musculus
attctttggtgaatca

SEQ ID NO: 371229 - DNA, 16 bp, M. musculus
attctttgtaaatttc

SEQ ID NO: 371230 - DNA, 16 bp, M. musculus
attctttgtacatttt

SEQ ID NO: 371231 - DNA, 16 bp, M. musculus
attctttgttcagctc

SEQ ID NO: 371232 - DNA, 16 bp, M. musculus
attcttttaaaaagat

SEQ ID NO: 371233 - DNA, 16 bp, M. musculus
attcttttaaaatatg

SEQ ID NO: 371234 - DNA, 16 bp, M. musculus
attcttttaaatgttt

SEQ ID NO: 371235 - DNA, 16 bp, M. musculus
attcttttctcataca

SEQ ID NO: 371236 - DNA, 16 bp, M. musculus
attcttttctcatata

SEQ ID NO: 371237 - DNA, 16 bp, M. musculus
attcttttgcctcagc

SEQ ID NO: 371238 - DNA, 16 bp, M. musculus
attcttttgttgagaa

SEQ ID NO: 371239 - DNA, 16 bp, M. musculus
attctttttaaacaaa

SEQ ID NO: 371240 - DNA, 16 bp, M. musculus
attctttttaatggct

SEQ ID NO: 371241 - DNA, 16 bp, M. musculus
attcttttttaaaaag

SEQ ID NO: 371242 - DNA, 16 bp, M. musculus
attgaaaagggagaca

SEQ ID NO: 371243 - DNA, 16 bp, M. musculus
attgaaaatagattct

SEQ ID NO: 371244 - DNA, 16 bp, M. musculus
attgaaaatgctgtct

SEQ ID NO: 371245 - DNA, 16 bp, M. musculus
attgaaaatttcaaaa

SEQ ID NO: 371246 - DNA, 16 bp, M. musculus
attgaaacagaaggaa

SEQ ID NO: 371247 - DNA, 16 bp, M. musculus
attgaaagaagccaca

SEQ ID NO: 371248 - DNA, 16 bp, M. musculus
attgaaagattaaaac

SEQ ID NO: 371249 - DNA, 16 bp, M. musculus
attgaaatatattgta

SEQ ID NO: 371250 - DNA, 16 bp, M. musculus
attgaaattattccat

SEQ ID NO: 371251 - DNA, 16 bp, M. musculus
attgaacaaaacaaac

SEQ ID NO: 371252 - DNA, 16 bp, M. musculus
attgaacagagttgtg

SEQ ID NO: 371253 - DNA, 16 bp, M. musculus
attgaaccagaaaaga

SEQ ID NO: 371254 - DNA, 16 bp, M. musculus
attgaaccatcccttc

SEQ ID NO: 371255 - DNA, 16 bp, M. musculus
attgaacccagaacct

SEQ ID NO: 371256 - DNA, 16 bp, M. musculus
attgaacccagagcct

SEQ ID NO: 371257 - DNA, 16 bp, M. musculus
attgaacccagggcct

SEQ ID NO: 371258 - DNA, 16 bp, M. musculus
attgaacctgggttct

SEQ ID NO: 371259 - DNA, 16 bp, M. musculus
attgaactcaaggctt

SEQ ID NO: 371260 - DNA, 16 bp, M. musculus
attgaactcagagcct

SEQ ID NO: 371261 - DNA, 16 bp, M. musculus
attgaactcagggctt

SEQ ID NO: 371262 - DNA, 16 bp, M. musculus
attgaacttgagtcct

SEQ ID NO: 371263 - DNA, 16 bp, M. musculus
attgaagaaactgaag

SEQ ID NO: 371264 - DNA, 16 bp, M. musculus
attgaagaactagaaa

SEQ ID NO: 371265 - DNA, 16 bp, M. musculus
attgaagaagacacct

SEQ ID NO: 371266 - DNA, 16 bp, M. musculus
attgaagaagatccca

SEQ ID NO: 371267 - DNA, 16 bp, M. musculus
attgaagacaaagaaa

SEQ ID NO: 371268 - DNA, 16 bp, M. musculus
attgaagacccagaag

SEQ ID NO: 371269 - DNA, 16 bp, M. musculus
attgaagatccagaga

SEQ ID NO: 371270 - DNA, 16 bp, M. musculus
attgaagatgctgtct

SEQ ID NO: 371271 - DNA, 16 bp, M. musculus
attgaagcattctcac

SEQ ID NO: 371272 - DNA, 16 bp, M. musculus
attgaagccccagaaa

SEQ ID NO: 371273 - DNA, 16 bp, M. musculus
attgaaggacctgaag

SEQ ID NO: 371274 - DNA, 16 bp, M. musculus
attgaaggcgtgtgcc

SEQ ID NO: 371275 - DNA, 16 bp, M. musculus
attgaagtaatattta

SEQ ID NO: 371276 - DNA, 16 bp, M. musculus
attgaagttttgtata

SEQ ID NO: 371277 - DNA, 16 bp, M. musculus
attgaattcagggcct

SEQ ID NO: 371278 - DNA, 16 bp, M. musculus
attgaattctataaag

SEQ ID NO: 371279 - DNA, 16 bp, M. musculus
attgaattctgatgat

SEQ ID NO: 371280 - DNA, 16 bp, M. musculus
attgaatttgtgtctt

SEQ ID NO: 371281 - DNA, 16 bp, M. musculus
attgacaaaggagcta

SEQ ID NO: 371282 - DNA, 16 bp, M. musculus
attgacaaataaaaat

SEQ ID NO: 371283 - DNA, 16 bp, M. musculus
attgacctctgacctc

SEQ ID NO: 371284 - DNA, 16 bp, M. musculus
attgaccttataattg

SEQ ID NO: 371285 - DNA, 16 bp, M. musculus
attgacttccaacccc

SEQ ID NO: 371286 - DNA, 16 bp, M. musculus
attgagaaaatacctc

SEQ ID NO: 371287 - DNA, 16 bp, M. musculus
attgagaaaatgactt

SEQ ID NO: 371288 - DNA, 16 bp, M. musculus
attgagaaaatgcccc

SEQ ID NO: 371289 - DNA, 16 bp, M. musculus
attgagaaagaatttt

SEQ ID NO: 371290 - DNA, 16 bp, M. musculus
attgagaagagtgttg

SEQ ID NO: 371291 - DNA, 16 bp, M. musculus
attgagacagggtctc

SEQ ID NO: 371292 - DNA, 16 bp, M. musculus
attgagagaaactcac

SEQ ID NO: 371293 - DNA, 16 bp, M. musculus
attgagagagagagag

SEQ ID NO: 371294 - DNA, 16 bp, M. musculus
attgagagtttctctt

SEQ ID NO: 371295 - DNA, 16 bp, M. musculus
attgagagttttgctg

SEQ ID NO: 371296 - DNA, 16 bp, M. musculus
attgagatttttgctg

SEQ ID NO: 371297 - DNA, 16 bp, M. musculus
attgagcacatcaagc

SEQ ID NO: 371298 - DNA, 17 bp, M. musculus
attgagcagatggtaat

SEQ ID NO: 371299 - DNA, 16 bp, M. musculus
attgagcccaggtcct

SEQ ID NO: 371300 - DNA, 16 bp, M. musculus
attgagcccattgatg

SEQ ID NO: 371301 - DNA, 17 bp, M. musculus
attgagccttcacagga

SEQ ID NO: 371302 - DNA, 16 bp, M. musculus
attgagccttcccagg

SEQ ID NO: 371303 - DNA, 20 bp, M. musculus
attgagctccatagagacag

SEQ ID NO: 371304 - DNA, 16 bp, M. musculus
attgaggagctagaga

SEQ ID NO: 371305 - DNA, 16 bp, M. musculus
attgaggccagcctgg

SEQ ID NO: 371306 - DNA, 16 bp, M. musculus
attgaggctggagaga

SEQ ID NO: 371307 - DNA, 18 bp, M. musculus
attgagtgggttccacat

SEQ ID NO: 371308 - DNA, 16 bp, M. musculus
attgagttaattatca

SEQ ID NO: 371309 - DNA, 16 bp, M. musculus
attgagttggaaattt

SEQ ID NO: 371310 - DNA, 16 bp, M. musculus
attgatagatttttgt

SEQ ID NO: 371311 - DNA, 16 bp, M. musculus
attgatattgagagat

SEQ ID NO: 371312 - DNA, 16 bp, M. musculus
attgatatttaccttc

SEQ ID NO: 371313 - DNA, 16 bp, M. musculus
attgatcaagaaaatg

SEQ ID NO: 371314 - DNA, 16 bp, M. musculus
attgatcaatggaata

SEQ ID NO: 371315 - DNA, 16 bp, M. musculus
attgatcagtggaata

SEQ ID NO: 371316 - DNA, 16 bp, M. musculus
attgatccatacttat

SEQ ID NO: 371317 - DNA, 16 bp, M. musculus
attgatgacagataag

SEQ ID NO: 371318 - DNA, 16 bp, M. musculus
attgatgcaagataag

SEQ ID NO: 371319 - DNA, 16 bp, M. musculus
attgatgcctgacaag

SEQ ID NO: 371320 - DNA, 16 bp, M. musculus
attgatgctggttatc

SEQ ID NO: 371321 - DNA, 16 bp, M. musculus
attgatgtgggagggc

SEQ ID NO: 371322 - DNA, 16 bp, M. musculus
attgatgtgtgtgtgt

SEQ ID NO: 371323 - DNA, 16 bp, M. musculus
attgatgttccctctt

SEQ ID NO: 371324 - DNA, 16 bp, M. musculus
attgattccagataag

SEQ ID NO: 371325 - DNA, 16 bp, M. musculus
attgattgaaattcaa

SEQ ID NO: 371326 - DNA, 16 bp, M. musculus
attgattgattgactg

SEQ ID NO: 371327 - DNA, 16 bp, M. musculus
attgattgattgattg

SEQ ID NO: 371328 - DNA, 16 bp, M. musculus
attgatttatttactt

SEQ ID NO: 371329 - DNA, 16 bp, M. musculus
attgatttcagccatg

SEQ ID NO: 371330 - DNA, 16 bp, M. musculus
attgatttcagccctg

SEQ ID NO: 371331 - DNA, 16 bp, M. musculus
attgatttccagagag

SEQ ID NO: 371332 - DNA, 16 bp, M. musculus
attgatttctgggaaa

SEQ ID NO: 371333 - DNA, 16 bp, M. musculus
attgattttcttgtgt

SEQ ID NO: 371334 - DNA, 16 bp, M. musculus
attgatttttaaagag

SEQ ID NO: 371335 - DNA, 16 bp, M. musculus
attgatttttctctct

SEQ ID NO: 371336 - DNA, 16 bp, M. musculus
attgattttttttcaa

SEQ ID NO: 371337 - DNA, 16 bp, M. musculus
attgcaaagcttcagt

SEQ ID NO: 371338 - DNA, 16 bp, M. musculus
attgcaagaattttat

SEQ ID NO: 371339 - DNA, 16 bp, M. musculus
attgcaagagccagag

SEQ ID NO: 371340 - DNA, 17 bp, M. musculus
attgcaagctggtacaa

SEQ ID NO: 371341 - DNA, 16 bp, M. musculus
attgcaataaacattt

SEQ ID NO: 371342 - DNA, 16 bp, M. musculus
attgcaatgagtcatt

SEQ ID NO: 371343 - DNA, 16 bp, M. musculus
attgcagagcttctgt

SEQ ID NO: 371344 - DNA, 16 bp, M. musculus
attgcagaggcaaaga

SEQ ID NO: 371345 - DNA, 16 bp, M. musculus
attgcagatgccaaga

SEQ ID NO: 371346 - DNA, 16 bp, M. musculus
attgcagcaacagaaa

SEQ ID NO: 371347 - DNA, 16 bp, M. musculus
attgcatacacacaca

SEQ ID NO: 371348 - DNA, 17 bp, M. musculus
attgcatatgcctgcaa

SEQ ID NO: 371349 - DNA, 16 bp, M. musculus
attgccaagttaaaag

SEQ ID NO: 371350 - DNA, 16 bp, M. musculus
attgccagcatctgct

SEQ ID NO: 371351 - DNA, 16 bp, M. musculus
attgccagttagacca

SEQ ID NO: 371352 - DNA, 16 bp, M. musculus
attgccatggcaacag

SEQ ID NO: 371353 - DNA, 16 bp, M. musculus
attgccatttctaact

SEQ ID NO: 371354 - DNA, 21 bp, M. musculus
attgcccaacagaggggaagc

SEQ ID NO: 371355 - DNA, 16 bp, M. musculus
attgcccaggcacttg

SEQ ID NO: 371356 - DNA, 16 bp, M. musculus
attgccccatgcatcc

SEQ ID NO: 371357 - DNA, 16 bp, M. musculus
attgccctggcttttg

SEQ ID NO: 371358 - DNA, 16 bp, M. musculus
attgccttgagtctca

SEQ ID NO: 371359 - DNA, 19 bp, M. musculus
attgccttggagactcaaa

SEQ ID NO: 371360 - DNA, 16 bp, M. musculus
attgctacttcatagc

SEQ ID NO: 371361 - DNA, 16 bp, M. musculus
attgctagaacttaga

SEQ ID NO: 371362 - DNA, 16 bp, M. musculus
attgctatgatgaaac

SEQ ID NO: 371363 - DNA, 16 bp, M. musculus
attgctatgatgaaat

SEQ ID NO: 371364 - DNA, 18 bp, M. musculus
attgctcacggctcccca

SEQ ID NO: 371365 - DNA, 16 bp, M. musculus
attgctcagcagttaa

SEQ ID NO: 371366 - DNA, 16 bp, M. musculus
attgctctggccagga

SEQ ID NO: 371367 - DNA, 16 bp, M. musculus
attgctctgtagacca

SEQ ID NO: 371368 - DNA, 16 bp, M. musculus
attgctctgtgtgtgt

SEQ ID NO: 371369 - DNA, 16 bp, M. musculus
attgctcttattatgt

SEQ ID NO: 371370 - DNA, 16 bp, M. musculus
attgctcttccagaag

SEQ ID NO: 371371 - DNA, 16 bp, M. musculus
attgctcttctgaagg

SEQ ID NO: 371372 - DNA, 16 bp, M. musculus
attgctctttataact

SEQ ID NO: 371373 - DNA, 16 bp, M. musculus
attgctctttctaact

SEQ ID NO: 371374 - DNA, 16 bp, M. musculus
attgctctttctaatt

SEQ ID NO: 371375 - DNA, 16 bp, M. musculus
attgctctttctagct

SEQ ID NO: 371376 - DNA, 16 bp, M. musculus
attgctctttctatct

SEQ ID NO: 371377 - DNA, 16 bp, M. musculus
attgctgaagacacca

SEQ ID NO: 371378 - DNA, 16 bp, M. musculus
attgctgactggaacc

SEQ ID NO: 371379 - DNA, 16 bp, M. musculus
attgctgatgccagga

SEQ ID NO: 371380 - DNA, 16 bp, M. musculus
attgctgcaaataaat

SEQ ID NO: 371381 - DNA, 16 bp, M. musculus
attgctgcttttaata

SEQ ID NO: 371382 - DNA, 19 bp, M. musculus
attgctggatcttccagta

SEQ ID NO: 371383 - DNA, 16 bp, M. musculus
attgctggatgaagcc

SEQ ID NO: 371384 - DNA, 16 bp, M. musculus
attgctgggattacag

SEQ ID NO: 371385 - DNA, 16 bp, M. musculus
attgctggtgaaattg

SEQ ID NO: 371386 - DNA, 16 bp, M. musculus
attgctggtgcagaca

SEQ ID NO: 371387 - DNA, 16 bp, M. musculus
attgctgtaagtttga

SEQ ID NO: 371388 - DNA, 16 bp, M. musculus
attgctgtatcttcca

SEQ ID NO: 371389 - DNA, 16 bp, M. musculus
attgctgtgaagagaa

SEQ ID NO: 371390 - DNA, 16 bp, M. musculus
attgctgtgaagagac

SEQ ID NO: 371391 - DNA, 16 bp, M. musculus
attgctgtggtcatgg

SEQ ID NO: 371392 - DNA, 16 bp, M. musculus
attgctgtgtcttcag

SEQ ID NO: 371393 - DNA, 16 bp, M. musculus
attgctgttctgtaca

SEQ ID NO: 371394 - DNA, 16 bp, M. musculus
attgctgttttgtttg

SEQ ID NO: 371395 - DNA, 16 bp, M. musculus
attgcttaagattgtt

SEQ ID NO: 371396 - DNA, 16 bp, M. musculus
attgcttcaaatttct

SEQ ID NO: 371397 - DNA, 16 bp, M. musculus
attgctttgagtttct

SEQ ID NO: 371398 - DNA, 16 bp, M. musculus
attgcttttatagtat

SEQ ID NO: 371399 - DNA, 16 bp, M. musculus
attgcttttctccctt

SEQ ID NO: 371400 - DNA, 16 bp, M. musculus
attgcttttggcaaaa

SEQ ID NO: 371401 - DNA, 16 bp, M. musculus
attgctttttaaaatt

SEQ ID NO: 371402 - DNA, 16 bp, M. musculus
attggaaaaatatttt

SEQ ID NO: 371403 - DNA, 16 bp, M. musculus
attggaaaacacaaat

SEQ ID NO: 371404 - DNA, 16 bp, M. musculus
attggaaaatctggat

SEQ ID NO: 371405 - DNA, 16 bp, M. musculus
attggaaacaatcacc

SEQ ID NO: 371406 - DNA, 17 bp, M. musculus
attggaaagagaggccc

SEQ ID NO: 371407 - DNA, 16 bp, M. musculus
attggaaaggaacaag

SEQ ID NO: 371408 - DNA, 16 bp, M. musculus
attggaaatagatgta

SEQ ID NO: 371409 - DNA, 16 bp, M. musculus
attggaaatgttattg

SEQ ID NO: 371410 - DNA, 16 bp, M. musculus
attggaattttaaaaa

SEQ ID NO: 371411 - DNA, 16 bp, M. musculus
attggacagatcatgg

SEQ ID NO: 371412 - DNA, 16 bp, M. musculus
attggacaggggaaat

SEQ ID NO: 371413 - DNA, 16 bp, M. musculus
attggagcagcagctg

SEQ ID NO: 371414 - DNA, 16 bp, M. musculus
attggagcaggggctg

SEQ ID NO: 371415 - DNA, 16 bp, M. musculus
attggaggaagtgtgt

SEQ ID NO: 371416 - DNA, 16 bp, M. musculus
attggaggagctgaga

SEQ ID NO: 371417 - DNA, 16 bp, M. musculus
attggataccctggaa

SEQ ID NO: 371418 - DNA, 16 bp, M. musculus
attggatagaacacag

SEQ ID NO: 371419 - DNA, 16 bp, M. musculus
attggatattttcttt

SEQ ID NO: 371420 - DNA, 16 bp, M. musculus
attggatcacctggaa

SEQ ID NO: 371421 - DNA, 16 bp, M. musculus
attggatcctttggaa

SEQ ID NO: 371422 - DNA, 16 bp, M. musculus
attggatggatcagag

SEQ ID NO: 371423 - DNA, 16 bp, M. musculus
attggattacctcttc

SEQ ID NO: 371424 - DNA, 16 bp, M. musculus
attggattggagcaga

SEQ ID NO: 371425 - DNA, 16 bp, M. musculus
attggattttatcaaa

SEQ ID NO: 371426 - DNA, 16 bp, M. musculus
attggcaactctactg

SEQ ID NO: 371427 - DNA, 16 bp, M. musculus
attggcagtgtctttt

SEQ ID NO: 371428 - DNA, 16 bp, M. musculus
attggccagacaactg

SEQ ID NO: 371429 - DNA, 16 bp, M. musculus
attggctaagacctca

SEQ ID NO: 371430 - DNA, 16 bp, M. musculus
attggctgaagctgtg

SEQ ID NO: 371431 - DNA, 16 bp, M. musculus
attggctgagaaagaa

SEQ ID NO: 371432 - DNA, 19 bp, M. musculus
attggctgcagcccatggc

SEQ ID NO: 371433 - DNA, 16 bp, M. musculus
attggctgggcagtgg

SEQ ID NO: 371434 - DNA, 16 bp, M. musculus
attggcttaaaaaaaa

SEQ ID NO: 371435 - DNA, 16 bp, M. musculus
attgggaaaggagctt

SEQ ID NO: 371436 - DNA, 16 bp, M. musculus
attgggaaagtatttt

SEQ ID NO: 371437 - DNA, 16 bp, M. musculus
attgggaaagttgaga

SEQ ID NO: 371438 - DNA, 18 bp, M. musculus
attgggaaccctgtgatc

SEQ ID NO: 371439 - DNA, 16 bp, M. musculus
attgggaagagaggca

SEQ ID NO: 371440 - DNA, 16 bp, M. musculus
attgggatgctgtccc

SEQ ID NO: 371441 - DNA, 16 bp, M. musculus
attgggattaaaggtg

SEQ ID NO: 371442 - DNA, 16 bp, M. musculus
attgggattgcttcaa

SEQ ID NO: 371443 - DNA, 16 bp, M. musculus
attgggcaggtttgga

SEQ ID NO: 371444 - DNA, 19 bp, M. musculus
attggggaatcatcagaga

SEQ ID NO: 371445 - DNA, 16 bp, M. musculus
attggggaattgagtt

SEQ ID NO: 371446 - DNA, 17 bp, M. musculus
attggggcccctgtgtt

SEQ ID NO: 371447 - DNA, 17 bp, M. musculus
attggggctgccttaca

SEQ ID NO: 371448 - DNA, 16 bp, M. musculus
attggggctggagaaa

SEQ ID NO: 371449 - DNA, 16 bp, M. musculus
attggggctggctgac

SEQ ID NO: 371450 - DNA, 16 bp, M. musculus
attggggttggagaga

SEQ ID NO: 371451 - DNA, 16 bp, M. musculus
attgggtagagcacct

SEQ ID NO: 371452 - DNA, 16 bp, M. musculus
attgggtatttatttc

SEQ ID NO: 371453 - DNA, 16 bp, M. musculus
attgggttcaatatat

SEQ ID NO: 371454 - DNA, 16 bp, M. musculus
attggtaacaaaacag

SEQ ID NO: 371455 - DNA, 16 bp, M. musculus
attggtctgaaagatt

SEQ ID NO: 371456 - DNA, 16 bp, M. musculus
attggtctttcaaact

SEQ ID NO: 371457 - DNA, 16 bp, M. musculus
attggtgaaattggtg

SEQ ID NO: 371458 - DNA, 16 bp, M. musculus
attggtgctttgcctg

SEQ ID NO: 371459 - DNA, 16 bp, M. musculus
attggtggcccgtacg

SEQ ID NO: 371460 - DNA, 16 bp, M. musculus
attggtggtttagtct

SEQ ID NO: 371461 - DNA, 25 bp, M. musculus
attggttatgccaataacccaaaac

SEQ ID NO: 371462 - DNA, 16 bp, M. musculus
attggttctaatgttt

SEQ ID NO: 371463 - DNA, 16 bp, M. musculus
attggttctactgaaa

SEQ ID NO: 371464 - DNA, 16 bp, M. musculus
attggttggacattcc

SEQ ID NO: 371465 - DNA, 16 bp, M. musculus
attggtttcttgccct

SEQ ID NO: 371466 - DNA, 16 bp, M. musculus
attgtaaaacaaacaa

SEQ ID NO: 371467 - DNA, 16 bp, M. musculus
attgtaaaagaaactt

SEQ ID NO: 371468 - DNA, 16 bp, M. musculus
attgtaatctcaaaaa

SEQ ID NO: 371469 - DNA, 16 bp, M. musculus
attgtaatgaaaatat

SEQ ID NO: 371470 - DNA, 16 bp, M. musculus
attgtaattgttgtca

SEQ ID NO: 371471 - DNA, 16 bp, M. musculus
attgtaccttgccagt

SEQ ID NO: 371472 - DNA, 16 bp, M. musculus
attgtagcctccccca

SEQ ID NO: 371473 - DNA, 16 bp, M. musculus
attgtaggcatgtgcc

SEQ ID NO: 371474 - DNA, 16 bp, M. musculus
attgtagttcattcca

SEQ ID NO: 371475 - DNA, 16 bp, M. musculus
attgtataaaattctc

SEQ ID NO: 371476 - DNA, 16 bp, M. musculus
attgtatatatgtgtg

SEQ ID NO: 371477 - DNA, 16 bp, M. musculus
attgtatggttttgcc

SEQ ID NO: 371478 - DNA, 16 bp, M. musculus
attgtatgttcttccc

SEQ ID NO: 371479 - DNA, 16 bp, M. musculus
attgtattttcttgta

SEQ ID NO: 371480 - DNA, 16 bp, M. musculus
attgtattttgtcaaa

SEQ ID NO: 371481 - DNA, 16 bp, M. musculus
attgtcaaaaataaaa

SEQ ID NO: 371482 - DNA, 16 bp, M. musculus
attgtcaacttgacag

SEQ ID NO: 371483 - DNA, 16 bp, M. musculus
attgtcactgtcttca

SEQ ID NO: 371484 - DNA, 16 bp, M. musculus
attgtcagtggctgcc

SEQ ID NO: 371485 - DNA, 16 bp, M. musculus
attgtcatggcaggga

SEQ ID NO: 371486 - DNA, 16 bp, M. musculus
attgtcctaagaacaa

SEQ ID NO: 371487 - DNA, 16 bp, M. musculus
attgtcctggaactca

SEQ ID NO: 371488 - DNA, 16 bp, M. musculus
attgtcctggaacttg

SEQ ID NO: 371489 - DNA, 16 bp, M. musculus
attgtccttctatata

SEQ ID NO: 371490 - DNA, 16 bp, M. musculus
attgtctagatcttgt

SEQ ID NO: 371491 - DNA, 16 bp, M. musculus
attgtctcaatccttt

SEQ ID NO: 371492 - DNA, 18 bp, M. musculus
attgtctctgtaactcct

SEQ ID NO: 371493 - DNA, 16 bp, M. musculus
attgtctctgtgccct

SEQ ID NO: 371494 - DNA, 16 bp, M. musculus
attgtctcttatatct

SEQ ID NO: 371495 - DNA, 16 bp, M. musculus
attgtctggagccgaa

SEQ ID NO: 371496 - DNA, 16 bp, M. musculus
attgtctggtgttttc

SEQ ID NO: 371497 - DNA, 16 bp, M. musculus
attgtctttgattgtt

SEQ ID NO: 371498 - DNA, 16 bp, M. musculus
attgtgaaaagtgttg

SEQ ID NO: 371499 - DNA, 16 bp, M. musculus
attgtgaagagtgttg

SEQ ID NO: 371500 - DNA, 16 bp, M. musculus
attgtgaaggatgtta

SEQ ID NO: 371501 - DNA, 16 bp, M. musculus
attgtgaagggtatca

SEQ ID NO: 371502 - DNA, 24 bp, M. musculus
attgtgagccaccatgtggttgct

SEQ ID NO: 371503 - DNA, 16 bp, M. musculus
attgtgataaaaaaca

SEQ ID NO: 371504 - DNA, 16 bp, M. musculus
attgtgattaaaaact

SEQ ID NO: 371505 - DNA, 16 bp, M. musculus
attgtgattttaaaaa

SEQ ID NO: 371506 - DNA, 16 bp, M. musculus
attgtgatttttaaaa

SEQ ID NO: 371507 - DNA, 16 bp, M. musculus
attgtgcttctttctt

SEQ ID NO: 371508 - DNA, 16 bp, M. musculus
attgtggaaaatggat

SEQ ID NO: 371509 - DNA, 16 bp, M. musculus
attgtggatgccaaca

SEQ ID NO: 371510 - DNA, 16 bp, M. musculus
attgtggatgccaaga

SEQ ID NO: 371511 - DNA, 16 bp, M. musculus
attgtggatgtcaaga

SEQ ID NO: 371512 - DNA, 16 bp, M. musculus
attgtggttttctgta

SEQ ID NO: 371513 - DNA, 16 bp, M. musculus
attgtgtgagttccct

SEQ ID NO: 371514 - DNA, 16 bp, M. musculus
attgtgtgagttgcaa

SEQ ID NO: 371515 - DNA, 16 bp, M. musculus
attgtgtgtatatata

SEQ ID NO: 371516 - DNA, 16 bp, M. musculus
attgtgtgtcaagttg

SEQ ID NO: 371517 - DNA, 16 bp, M. musculus
attgtgtgttttctca

SEQ ID NO: 371518 - DNA, 16 bp, M. musculus
attgtgttggaagttt

SEQ ID NO: 371519 - DNA, 16 bp, M. musculus
attgttaaagatcttt

SEQ ID NO: 371520 - DNA, 16 bp, M. musculus
attgttagcaaaatat

SEQ ID NO: 371521 - DNA, 32 bp, M. musculus
attgttaggggctcttagaaactgtcttgaga

SEQ ID NO: 371522 - DNA, 16 bp, M. musculus
attgttattgaagatc

SEQ ID NO: 371523 - DNA, 16 bp, M. musculus
attgttcagagccaga

SEQ ID NO: 371524 - DNA, 16 bp, M. musculus
attgttcagtcacagc

SEQ ID NO: 371525 - DNA, 17 bp, M. musculus
attgttccagtgcactg

SEQ ID NO: 371526 - DNA, 16 bp, M. musculus
attgttcccatctaaa

SEQ ID NO: 371527 - DNA, 16 bp, M. musculus
attgttcctctcatga

SEQ ID NO: 371528 - DNA, 16 bp, M. musculus
attgttcctcttatgg

SEQ ID NO: 371529 - DNA, 16 bp, M. musculus
attgttctttggagca

SEQ ID NO: 371530 - DNA, 16 bp, M. musculus
attgttgcaactgcta

SEQ ID NO: 371531 - DNA, 16 bp, M. musculus
attgttgctgtcttca

SEQ ID NO: 371532 - DNA, 20 bp, M. musculus
attgttgggaattgggctgc

SEQ ID NO: 371533 - DNA, 16 bp, M. musculus
attgttgggacacttt

SEQ ID NO: 371534 - DNA, 17 bp, M. musculus
attgttgtgcctatgtt

SEQ ID NO: 371535 - DNA, 16 bp, M. musculus
attgtttcccataaat

SEQ ID NO: 371536 - DNA, 16 bp, M. musculus
attgtttctatttaca

SEQ ID NO: 371537 - DNA, 16 bp, M. musculus
attgtttcttttaaaa

SEQ ID NO: 371538 - DNA, 16 bp, M. musculus
attgttttcaagcctt

SEQ ID NO: 371539 - DNA, 16 bp, M. musculus
attgttttcagtttct

SEQ ID NO: 371540 - DNA, 16 bp, M. musculus
attgttttcatttgga

SEQ ID NO: 371541 - DNA, 16 bp, M. musculus
attgttttcatttgta

SEQ ID NO: 371542 - DNA, 16 bp, M. musculus
attgttttcttctccc

SEQ ID NO: 371543 - DNA, 16 bp, M. musculus
attgttttgctgtgtt

SEQ ID NO: 371544 - DNA, 16 bp, M. musculus
attgttttggcttctt

SEQ ID NO: 371545 - DNA, 16 bp, M. musculus
attgtttttaagagct

SEQ ID NO: 371546 - DNA, 16 bp, M. musculus
attgtttttaaggata

SEQ ID NO: 371547 - DNA, 16 bp, M. musculus
attgttttttgagaca

SEQ ID NO: 371548 - DNA, 16 bp, M. musculus
atttaaaaaaatactg

SEQ ID NO: 371549 - DNA, 16 bp, M. musculus
atttaaaaacaaacct

SEQ ID NO: 371550 - DNA, 16 bp, M. musculus
atttaaaaacagaaag

SEQ ID NO: 371551 - DNA, 16 bp, M. musculus
atttaaaaacatttct

SEQ ID NO: 371552 - DNA, 16 bp, M. musculus
atttaaaaactacatt

SEQ ID NO: 371553 - DNA, 16 bp, M. musculus
atttaaaaagcaaaga

SEQ ID NO: 371554 - DNA, 16 bp, M. musculus
atttaaaaagtcattt

SEQ ID NO: 371555 - DNA, 16 bp, M. musculus
atttaaaaagtgttta

SEQ ID NO: 371556 - DNA, 16 bp, M. musculus
atttaaaaatacaagt

SEQ ID NO: 371557 - DNA, 16 bp, M. musculus
atttaaaaatcacatt

SEQ ID NO: 371558 - DNA, 16 bp, M. musculus
atttaaaacaatgatt

SEQ ID NO: 371559 - DNA, 16 bp, M. musculus
atttaaaacacagtac

SEQ ID NO: 371560 - DNA, 16 bp, M. musculus
atttaaaacagaaaag

SEQ ID NO: 371561 - DNA, 16 bp, M. musculus
atttaaaacatgaaaa

SEQ ID NO: 371562 - DNA, 16 bp, M. musculus
atttaaaagaaaagca

SEQ ID NO: 371563 - DNA, 16 bp, M. musculus
atttaaaagcaaagca

SEQ ID NO: 371564 - DNA, 16 bp, M. musculus
atttaaaagcattttt

SEQ ID NO: 371565 - DNA, 16 bp, M. musculus
atttaaaataacatct

SEQ ID NO: 371566 - DNA, 16 bp, M. musculus
atttaaaatgcaaata

SEQ ID NO: 371567 - DNA, 16 bp, M. musculus
atttaaaattcaaatg

SEQ ID NO: 371568 - DNA, 16 bp, M. musculus
atttaaactttaactt

SEQ ID NO: 371569 - DNA, 16 bp, M. musculus
atttaaagaaaataca

SEQ ID NO: 371570 - DNA, 16 bp, M. musculus
atttaaagaatctaaa

SEQ ID NO: 371571 - DNA, 16 bp, M. musculus
atttaaagactttctc

SEQ ID NO: 371572 - DNA, 16 bp, M. musculus
atttaaagttttcatt

SEQ ID NO: 371573 - DNA, 16 bp, M. musculus
atttaaatcatgcttt

SEQ ID NO: 371574 - DNA, 16 bp, M. musculus
atttaaatgaacaaaa

SEQ ID NO: 371575 - DNA, 16 bp, M. musculus
atttaaatgtgtgtgt

SEQ ID NO: 371576 - DNA, 16 bp, M. musculus
atttaacagaaatcta

SEQ ID NO: 371577 - DNA, 16 bp, M. musculus
atttaagaatatgtaa

SEQ ID NO: 371578 - DNA, 16 bp, M. musculus
atttaagagtttgttt

SEQ ID NO: 371579 - DNA, 16 bp, M. musculus
atttaagcttttcttc

SEQ ID NO: 371580 - DNA, 16 bp, M. musculus
atttaaggaaggaagg

SEQ ID NO: 371581 - DNA, 16 bp, M. musculus
atttaagtgtttctca

SEQ ID NO: 371582 - DNA, 16 bp, M. musculus
atttaagtttgtgtgt

SEQ ID NO: 371583 - DNA, 16 bp, M. musculus
atttaataaacatgaa

SEQ ID NO: 371584 - DNA, 16 bp, M. musculus
atttaatacagttcct

SEQ ID NO: 371585 - DNA, 16 bp, M. musculus
atttaatattttcaca

SEQ ID NO: 371586 - DNA, 16 bp, M. musculus
atttaatcccagcact

SEQ ID NO: 371587 - DNA, 16 bp, M. musculus
atttaatcctaagaaa

SEQ ID NO: 371588 - DNA, 16 bp, M. musculus
atttaatgaaaatgac

SEQ ID NO: 371589 - DNA, 16 bp, M. musculus
atttaatgaaagtgaa

SEQ ID NO: 371590 - DNA, 16 bp, M. musculus
atttaatgaatatgaa

SEQ ID NO: 371591 - DNA, 16 bp, M. musculus
atttaatgaattcatt

SEQ ID NO: 371592 - DNA, 16 bp, M. musculus
atttaatgacttcttt

SEQ ID NO: 371593 - DNA, 16 bp, M. musculus
atttaatggaaatgaa

SEQ ID NO: 371594 - DNA, 16 bp, M. musculus
atttaattagggctgg

SEQ ID NO: 371595 - DNA, 16 bp, M. musculus
atttacaaatgtgttt

SEQ ID NO: 371596 - DNA, 16 bp, M. musculus
atttacaaggtagaat

SEQ ID NO: 371597 - DNA, 16 bp, M. musculus
atttacaataaagtac

SEQ ID NO: 371598 - DNA, 16 bp, M. musculus
atttacaattcaaatg

SEQ ID NO: 371599 - DNA, 16 bp, M. musculus
atttacactgtgattc

SEQ ID NO: 371600 - DNA, 16 bp, M. musculus
atttacagaaataaaa

SEQ ID NO: 371601 - DNA, 16 bp, M. musculus
atttacagaatatctt

SEQ ID NO: 371602 - DNA, 16 bp, M. musculus
atttacagaatggaat

SEQ ID NO: 371603 - DNA, 16 bp, M. musculus
atttacataattttca

SEQ ID NO: 371604 - DNA, 16 bp, M. musculus
atttacatcatttcca

SEQ ID NO: 371605 - DNA, 16 bp, M. musculus
atttacatgtgtgtgt

SEQ ID NO: 371606 - DNA, 16 bp, M. musculus
atttacattacaaata

SEQ ID NO: 371607 - DNA, 16 bp, M. musculus
atttacattacgattc

SEQ ID NO: 371608 - DNA, 16 bp, M. musculus
atttacattcaaaatg

SEQ ID NO: 371609 - DNA, 16 bp, M. musculus
atttacattcacttct

SEQ ID NO: 371610 - DNA, 16 bp, M. musculus
atttacatttaaaatg

SEQ ID NO: 371611 - DNA, 16 bp, M. musculus
atttacatttataatg

SEQ ID NO: 371612 - DNA, 16 bp, M. musculus
atttacatttcaaaaa

SEQ ID NO: 371613 - DNA, 16 bp, M. musculus
atttacatttcaaaag

SEQ ID NO: 371614 - DNA, 16 bp, M. musculus
atttacatttcaaata

SEQ ID NO: 371615 - DNA, 16 bp, M. musculus
atttacatttcaaatg

SEQ ID NO: 371616 - DNA, 16 bp, M. musculus
atttacattttcctaa

SEQ ID NO: 371617 - DNA, 16 bp, M. musculus
atttaccattttccaa

SEQ ID NO: 371618 - DNA, 16 bp, M. musculus
atttacccagaagatg

SEQ ID NO: 371619 - DNA, 16 bp, M. musculus
atttacctgaaatttt

SEQ ID NO: 371620 - DNA, 16 bp, M. musculus
atttacctgtaaattt

SEQ ID NO: 371621 - DNA, 16 bp, M. musculus
atttactatgtataca

SEQ ID NO: 371622 - DNA, 16 bp, M. musculus
atttactggcctttta

SEQ ID NO: 371623 - DNA, 16 bp, M. musculus
atttacttgtttttaa

SEQ ID NO: 371624 - DNA, 16 bp, M. musculus
atttactttgttattg

SEQ ID NO: 371625 - DNA, 16 bp, M. musculus
atttacttttctgttg

SEQ ID NO: 371626 - DNA, 16 bp, M. musculus
atttagaaaatgcctt

SEQ ID NO: 371627 - DNA, 16 bp, M. musculus
atttagaaatagttct

SEQ ID NO: 371628 - DNA, 16 bp, M. musculus
atttagaacaaataag

SEQ ID NO: 371629 - DNA, 16 bp, M. musculus
atttagaactgaaaat

SEQ ID NO: 371630 - DNA, 16 bp, M. musculus
atttagaagacagttt

SEQ ID NO: 371631 - DNA, 16 bp, M. musculus
atttagagatctgcct

SEQ ID NO: 371632 - DNA, 16 bp, M. musculus
atttagataggcattt

SEQ ID NO: 371633 - DNA, 16 bp, M. musculus
atttagatcaattaaa

SEQ ID NO: 371634 - DNA, 16 bp, M. musculus
atttagcattttattt

SEQ ID NO: 371635 - DNA, 16 bp, M. musculus
atttaggagagttctt

SEQ ID NO: 371636 - DNA, 16 bp, M. musculus
atttaggattggcaaa

SEQ ID NO: 371637 - DNA, 16 bp, M. musculus
atttaggatttttaaa

SEQ ID NO: 371638 - DNA, 16 bp, M. musculus
atttaggtgctgggaa

SEQ ID NO: 371639 - DNA, 16 bp, M. musculus
atttagtccaggtttt

SEQ ID NO: 371640 - DNA, 16 bp, M. musculus
atttagtgacaagaga

SEQ ID NO: 371641 - DNA, 16 bp, M. musculus
atttagtgctttgatt

SEQ ID NO: 371642 - DNA, 16 bp, M. musculus
atttagtgtgtgtgtg

SEQ ID NO: 371643 - DNA, 16 bp, M. musculus
atttagtttcatgttg

SEQ ID NO: 371644 - DNA, 16 bp, M. musculus
atttataaaagaaaca

SEQ ID NO: 371645 - DNA, 16 bp, M. musculus
atttataaacattttc

SEQ ID NO: 371646 - DNA, 16 bp, M. musculus
atttataataccagaa

SEQ ID NO: 371647 - DNA, 16 bp, M. musculus
atttatacaagtacac

SEQ ID NO: 371648 - DNA, 16 bp, M. musculus
atttatacaggagaaa

SEQ ID NO: 371649 - DNA, 16 bp, M. musculus
atttataccaatgaaa

SEQ ID NO: 371650 - DNA, 16 bp, M. musculus
atttataccctctcca

SEQ ID NO: 371651 - DNA, 16 bp, M. musculus
atttatactgttattg

SEQ ID NO: 371652 - DNA, 16 bp, M. musculus
atttatagaagaaaca

SEQ ID NO: 371653 - DNA, 16 bp, M. musculus
atttatagaagataca

SEQ ID NO: 371654 - DNA, 16 bp, M. musculus
atttatataaatacac

SEQ ID NO: 371655 - DNA, 16 bp, M. musculus
atttatatatctgtat

SEQ ID NO: 371656 - DNA, 16 bp, M. musculus
atttatatcaatgaaa

SEQ ID NO: 371657 - DNA, 16 bp, M. musculus
atttatatctgagaga

SEQ ID NO: 371658 - DNA, 16 bp, M. musculus
atttatatggaaaatg

SEQ ID NO: 371659 - DNA, 16 bp, M. musculus
atttatatgttcaata

SEQ ID NO: 371660 - DNA, 16 bp, M. musculus
atttatatttcctggt

SEQ ID NO: 371661 - DNA, 16 bp, M. musculus
atttatcaacctaaaa

SEQ ID NO: 371662 - DNA, 16 bp, M. musculus
atttatcaggacattg

SEQ ID NO: 371663 - DNA, 16 bp, M. musculus
atttatcagtgaatac

SEQ ID NO: 371664 - DNA, 16 bp, M. musculus
atttatcccagtgaca

SEQ ID NO: 371665 - DNA, 16 bp, M. musculus
atttatctgatcctga

SEQ ID NO: 371666 - DNA, 16 bp, M. musculus
atttatcttcttctca

SEQ ID NO: 371667 - DNA, 16 bp, M. musculus
atttatcttgttattg

SEQ ID NO: 371668 - DNA, 16 bp, M. musculus
atttatctttcaaatg

SEQ ID NO: 371669 - DNA, 16 bp, M. musculus
atttatctttctgagt

SEQ ID NO: 371670 - DNA, 17 bp, M. musculus
atttatgaaattcttgg

SEQ ID NO: 371671 - DNA, 16 bp, M. musculus
atttatgaatatacat

SEQ ID NO: 371672 - DNA, 16 bp, M. musculus
atttatgataggtaaa

SEQ ID NO: 371673 - DNA, 16 bp, M. musculus
atttatgattgatgtg

SEQ ID NO: 371674 - DNA, 16 bp, M. musculus
atttatgcatatacat

SEQ ID NO: 371675 - DNA, 16 bp, M. musculus
atttatgccccaaatg

SEQ ID NO: 371676 - DNA, 16 bp, M. musculus
atttatggttccagat

SEQ ID NO: 371677 - DNA, 16 bp, M. musculus
atttatggttcctgat

SEQ ID NO: 371678 - DNA, 16 bp, M. musculus
atttatgtacatattt

SEQ ID NO: 371679 - DNA, 17 bp, M. musculus
atttatgtgtatgagtg

SEQ ID NO: 371680 - DNA, 16 bp, M. musculus
atttatgtgtatgcat

SEQ ID NO: 371681 - DNA, 16 bp, M. musculus
atttatgttgccccat

SEQ ID NO: 371682 - DNA, 16 bp, M. musculus
atttattaagcaccta

SEQ ID NO: 371683 - DNA, 16 bp, M. musculus
atttattaagttcttt

SEQ ID NO: 371684 - DNA, 16 bp, M. musculus
atttattaattgctga

SEQ ID NO: 371685 - DNA, 16 bp, M. musculus
atttattatcagtaaa

SEQ ID NO: 371686 - DNA, 20 bp, M. musculus
atttattcattatatgtaag

SEQ ID NO: 371687 - DNA, 16 bp, M. musculus
atttattctgcagaaa

SEQ ID NO: 371688 - DNA, 16 bp, M. musculus
atttattctttgagaa

SEQ ID NO: 371689 - DNA, 16 bp, M. musculus
atttattctttgcctt

SEQ ID NO: 371690 - DNA, 16 bp, M. musculus
atttattgagcaccta

SEQ ID NO: 371691 - DNA, 16 bp, M. musculus
atttattgattactta

SEQ ID NO: 371692 - DNA, 16 bp, M. musculus
atttattgatttcctc

SEQ ID NO: 371693 - DNA, 16 bp, M. musculus
atttattgtttgaatg

SEQ ID NO: 371694 - DNA, 16 bp, M. musculus
atttatttaaaaggaa

SEQ ID NO: 371695 - DNA, 16 bp, M. musculus
atttatttaaaatgca

SEQ ID NO: 371696 - DNA, 16 bp, M. musculus
atttatttagtcttca

SEQ ID NO: 371697 - DNA, 16 bp, M. musculus
atttatttagtgtgtg

SEQ ID NO: 371698 - DNA, 16 bp, M. musculus
atttatttatctatgt

SEQ ID NO: 371699 - DNA, 16 bp, M. musculus
atttatttattcatgt

SEQ ID NO: 371700 - DNA, 16 bp, M. musculus
atttatttatttccag

SEQ ID NO: 371701 - DNA, 16 bp, M. musculus
atttatttatttgtac

SEQ ID NO: 371702 - DNA, 16 bp, M. musculus
atttatttcaaaacaa

SEQ ID NO: 371703 - DNA, 16 bp, M. musculus
atttatttcatcttac

SEQ ID NO: 371704 - DNA, 16 bp, M. musculus
atttatttcatttatg

SEQ ID NO: 371705 - DNA, 16 bp, M. musculus
atttatttctgtgtgt

SEQ ID NO: 371706 - DNA, 16 bp, M. musculus
atttatttgctttaca

SEQ ID NO: 371707 - DNA, 16 bp, M. musculus
atttatttgtttgcat

SEQ ID NO: 371708 - DNA, 16 bp, M. musculus
atttattttatgtaca

SEQ ID NO: 371709 - DNA, 16 bp, M. musculus
atttattttcaagttt

SEQ ID NO: 371710 - DNA, 16 bp, M. musculus
atttattttctctctg

SEQ ID NO: 371711 - DNA, 16 bp, M. musculus
atttattttgcatatt

SEQ ID NO: 371712 - DNA, 16 bp, M. musculus
atttattttgtcattg

SEQ ID NO: 371713 - DNA, 16 bp, M. musculus
atttatttttcccaaa

SEQ ID NO: 371714 - DNA, 16 bp, M. musculus
atttcaaaaatgaaat

SEQ ID NO: 371715 - DNA, 16 bp, M. musculus
atttcaaaacagaaaa

SEQ ID NO: 371716 - DNA, 16 bp, M. musculus
atttcaaaagaaatta

SEQ ID NO: 371717 - DNA, 16 bp, M. musculus
atttcaaaagagaaaa

SEQ ID NO: 371718 - DNA, 16 bp, M. musculus
atttcaaaagagaaga

SEQ ID NO: 371719 - DNA, 16 bp, M. musculus
atttcaaaatatttct

SEQ ID NO: 371720 - DNA, 16 bp, M. musculus
atttcaaacatttatt

SEQ ID NO: 371721 - DNA, 16 bp, M. musculus
atttcaaagaagaaaa

SEQ ID NO: 371722 - DNA, 16 bp, M. musculus
atttcaaagtaaaata

SEQ ID NO: 371723 - DNA, 16 bp, M. musculus
atttcaaagtaatttt

SEQ ID NO: 371724 - DNA, 16 bp, M. musculus
atttcaaagtcatttt

SEQ ID NO: 371725 - DNA, 16 bp, M. musculus
atttcaaagtgaaaat

SEQ ID NO: 371726 - DNA, 16 bp, M. musculus
atttcaaagttatttt

SEQ ID NO: 371727 - DNA, 16 bp, M. musculus
atttcaaagtttttaa

SEQ ID NO: 371728 - DNA, 16 bp, M. musculus
atttcaaatgctaaac

SEQ ID NO: 371729 - DNA, 16 bp, M. musculus
atttcaaatgctaccc

SEQ ID NO: 371730 - DNA, 24 bp, M. musculus
atttcaaatgctatcccaaaagtc

SEQ ID NO: 371731 - DNA, 21 bp, M. musculus
atttcaaatgctatcccgaaa

SEQ ID NO: 371732 - DNA, 16 bp, M. musculus
atttcaaatgctatct

SEQ ID NO: 371733 - DNA, 16 bp, M. musculus
atttcaaatgctcaag

SEQ ID NO: 371734 - DNA, 17 bp, M. musculus
atttcaaatgttatccc

SEQ ID NO: 371735 - DNA, 19 bp, M. musculus
atttcaaatgttatccccc

SEQ ID NO: 371736 - DNA, 16 bp, M. musculus
atttcaaatgttttct

SEQ ID NO: 371737 - DNA, 16 bp, M. musculus
atttcaaccttcttgt

SEQ ID NO: 371738 - DNA, 16 bp, M. musculus
atttcaacttttaaaa

SEQ ID NO: 371739 - DNA, 16 bp, M. musculus
atttcaagaaaacaaa

SEQ ID NO: 371740 - DNA, 16 bp, M. musculus
atttcaaggaaaaaaa

SEQ ID NO: 371741 - DNA, 17 bp, M. musculus
atttcaatatttttgta

SEQ ID NO: 371742 - DNA, 16 bp, M. musculus
atttcacagatgaaga

SEQ ID NO: 371743 - DNA, 16 bp, M. musculus
atttcacagatgggaa

SEQ ID NO: 371744 - DNA, 16 bp, M. musculus
atttcactgacttttt

SEQ ID NO: 371745 - DNA, 16 bp, M. musculus
atttcacttaacataa

SEQ ID NO: 371746 - DNA, 16 bp, M. musculus
atttcagaaagaaaaa

SEQ ID NO: 371747 - DNA, 16 bp, M. musculus
atttcagaaattgttg

SEQ ID NO: 371748 - DNA, 16 bp, M. musculus
atttcagaagctcaag

SEQ ID NO: 371749 - DNA, 16 bp, M. musculus
atttcagagaaaaaaa

SEQ ID NO: 371750 - DNA, 16 bp, M. musculus
atttcagagccaactg

SEQ ID NO: 371751 - DNA, 16 bp, M. musculus
atttcagaggctgaaa

SEQ ID NO: 371752 - DNA, 16 bp, M. musculus
atttcaggaaaaaaaa

SEQ ID NO: 371753 - DNA, 16 bp, M. musculus
atttcaggacagtcag

SEQ ID NO: 371754 - DNA, 16 bp, M. musculus
atttcaggctggagag

SEQ ID NO: 371755 - DNA, 16 bp, M. musculus
atttcaggcttaaaag

SEQ ID NO: 371756 - DNA, 16 bp, M. musculus
atttcagggaaaaaga

SEQ ID NO: 371757 - DNA, 16 bp, M. musculus
atttcagtatttttgt

SEQ ID NO: 371758 - DNA, 16 bp, M. musculus
atttcagtgtctgtgg

SEQ ID NO: 371759 - DNA, 16 bp, M. musculus
atttcagtttctctgg

SEQ ID NO: 371760 - DNA, 16 bp, M. musculus
atttcataaaatagtt

SEQ ID NO: 371761 - DNA, 16 bp, M. musculus
atttcataaatgcatt

SEQ ID NO: 371762 - DNA, 16 bp, M. musculus
atttcataattttgtt

SEQ ID NO: 371763 - DNA, 16 bp, M. musculus
atttcatacaatatat

SEQ ID NO: 371764 - DNA, 16 bp, M. musculus
atttcatacagatttt

SEQ ID NO: 371765 - DNA, 16 bp, M. musculus
atttcatacaggtttt

SEQ ID NO: 371766 - DNA, 16 bp, M. musculus
atttcatataaatgga

SEQ ID NO: 371767 - DNA, 16 bp, M. musculus
atttcatatggctaca

SEQ ID NO: 371768 - DNA, 16 bp, M. musculus
atttcatattttcaaa

SEQ ID NO: 371769 - DNA, 16 bp, M. musculus
atttcatcattttaaa

SEQ ID NO: 371770 - DNA, 16 bp, M. musculus
atttcatctaggttct

SEQ ID NO: 371771 - DNA, 16 bp, M. musculus
atttcatctgaatgag

SEQ ID NO: 371772 - DNA, 16 bp, M. musculus
atttcatcttgatttt

SEQ ID NO: 371773 - DNA, 16 bp, M. musculus
atttcatctttgaaaa

SEQ ID NO: 371774 - DNA, 16 bp, M. musculus
atttcatgatgtcatt

SEQ ID NO: 371775 - DNA, 16 bp, M. musculus
atttcatggatgtttt

SEQ ID NO: 371776 - DNA, 16 bp, M. musculus
atttcatgtgagttct

SEQ ID NO: 371777 - DNA, 16 bp, M. musculus
atttcatgtgttttgc

SEQ ID NO: 371778 - DNA, 16 bp, M. musculus
atttcattaaaataca

SEQ ID NO: 371779 - DNA, 16 bp, M. musculus
atttcattaagaaaaa

SEQ ID NO: 371780 - DNA, 16 bp, M. musculus
atttcattcctgtttt

SEQ ID NO: 371781 - DNA, 16 bp, M. musculus
atttcattctctggag

SEQ ID NO: 371782 - DNA, 16 bp, M. musculus
atttcattgattcttt

SEQ ID NO: 371783 - DNA, 16 bp, M. musculus
atttcattttatatgt

SEQ ID NO: 371784 - DNA, 16 bp, M. musculus
atttcattttgtaaat

SEQ ID NO: 371785 - DNA, 16 bp, M. musculus
atttccaaagctatac

SEQ ID NO: 371786 - DNA, 16 bp, M. musculus
atttccaaatgaaaac

SEQ ID NO: 371787 - DNA, 16 bp, M. musculus
atttccaaattatccc

SEQ ID NO: 371788 - DNA, 16 bp, M. musculus
atttccaagacagcca

SEQ ID NO: 371789 - DNA, 16 bp, M. musculus
atttccaagaggatgt

SEQ ID NO: 371790 - DNA, 23 bp, M. musculus
atttccaatgctatcccaaaagt

SEQ ID NO: 371791 - DNA, 20 bp, M. musculus
atttccaatgctattccaaa

SEQ ID NO: 371792 - DNA, 16 bp, M. musculus
atttccaatgctctcc

SEQ ID NO: 371793 - DNA, 16 bp, M. musculus
atttccaattttctca

SEQ ID NO: 371794 - DNA, 16 bp, M. musculus
atttccacactgctgt

SEQ ID NO: 371795 - DNA, 16 bp, M. musculus
atttccactgtactgt

SEQ ID NO: 371796 - DNA, 16 bp, M. musculus
atttccacttggttga

SEQ ID NO: 371797 - DNA, 16 bp, M. musculus
atttccacttttctga

SEQ ID NO: 371798 - DNA, 16 bp, M. musculus
atttccagaatgattg

SEQ ID NO: 371799 - DNA, 16 bp, M. musculus
atttccagagaagttg

SEQ ID NO: 371800 - DNA, 16 bp, M. musculus
atttccagagttgtct

SEQ ID NO: 371801 - DNA, 16 bp, M. musculus
atttccagattttttt

SEQ ID NO: 371802 - DNA, 16 bp, M. musculus
atttccagcaccaaca

SEQ ID NO: 371803 - DNA, 16 bp, M. musculus
atttccagcacccaca

SEQ ID NO: 371804 - DNA, 16 bp, M. musculus
atttccagtttcatga

SEQ ID NO: 371805 - DNA, 16 bp, M. musculus
atttccatacattaaa

SEQ ID NO: 371806 - DNA, 16 bp, M. musculus
atttccatacattgaa

SEQ ID NO: 371807 - DNA, 16 bp, M. musculus
atttccatatagtaaa

SEQ ID NO: 371808 - DNA, 16 bp, M. musculus
atttccatgatgacta

SEQ ID NO: 371809 - DNA, 16 bp, M. musculus
atttccatggtggctg

SEQ ID NO: 371810 - DNA, 16 bp, M. musculus
atttccattctcactc

SEQ ID NO: 371811 - DNA, 16 bp, M. musculus
atttccatttccctaa

SEQ ID NO: 371812 - DNA, 16 bp, M. musculus
atttcccaataaaaaa

SEQ ID NO: 371813 - DNA, 17 bp, M. musculus
atttcccaatgctatcc

SEQ ID NO: 371814 - DNA, 16 bp, M. musculus
atttcccactttctct

SEQ ID NO: 371815 - DNA, 16 bp, M. musculus
atttccccaggaatct

SEQ ID NO: 371816 - DNA, 16 bp, M. musculus
atttcccctccaaaac

SEQ ID NO: 371817 - DNA, 16 bp, M. musculus
atttcccctgtgctca

SEQ ID NO: 371818 - DNA, 16 bp, M. musculus
atttccctatattaaa

SEQ ID NO: 371819 - DNA, 16 bp, M. musculus
atttccctcaactgaa

SEQ ID NO: 371820 - DNA, 16 bp, M. musculus
atttccctgatgacca

SEQ ID NO: 371821 - DNA, 16 bp, M. musculus
atttccctgtatttct

SEQ ID NO: 371822 - DNA, 23 bp, M. musculus
atttcccttaagcgaggaaacac

SEQ ID NO: 371823 - DNA, 16 bp, M. musculus
atttcccttcaggaaa

SEQ ID NO: 371824 - DNA, 16 bp, M. musculus
atttccctttctcagt

SEQ ID NO: 371825 - DNA, 16 bp, M. musculus
atttcccttttcaggt

SEQ ID NO: 371826 - DNA, 16 bp, M. musculus
atttcctaacttttct

SEQ ID NO: 371827 - DNA, 16 bp, M. musculus
atttcctattttaaaa

SEQ ID NO: 371828 - DNA, 16 bp, M. musculus
atttcctcaagagagg

SEQ ID NO: 371829 - DNA, 16 bp, M. musculus
atttcctcagatgaag

SEQ ID NO: 371830 - DNA, 16 bp, M. musculus
atttcctcattttctg

SEQ ID NO: 371831 - DNA, 16 bp, M. musculus
atttcctccaggtttt

SEQ ID NO: 371832 - DNA, 16 bp, M. musculus
atttcctctgtgccca

SEQ ID NO: 371833 - DNA, 16 bp, M. musculus
atttcctcttcttgct

SEQ ID NO: 371834 - DNA, 16 bp, M. musculus
atttcctgaaggggaa

SEQ ID NO: 371835 - DNA, 16 bp, M. musculus
atttcctgcaagatat

SEQ ID NO: 371836 - DNA, 16 bp, M. musculus
atttcctgcagtctat

SEQ ID NO: 371837 - DNA, 16 bp, M. musculus
atttcctgctcttcca

SEQ ID NO: 371838 - DNA, 16 bp, M. musculus
atttcctggatgattt

SEQ ID NO: 371839 - DNA, 16 bp, M. musculus
atttcctgtcttctac

SEQ ID NO: 371840 - DNA, 16 bp, M. musculus
atttccttcttaaatt

SEQ ID NO: 371841 - DNA, 16 bp, M. musculus
atttccttgctacatt

SEQ ID NO: 371842 - DNA, 16 bp, M. musculus
atttcctttaaaaaaa

SEQ ID NO: 371843 - DNA, 16 bp, M. musculus
atttcctttaaaatat

SEQ ID NO: 371844 - DNA, 16 bp, M. musculus
atttcctttgtttctg

SEQ ID NO: 371845 - DNA, 16 bp, M. musculus
atttcgacctggagct

SEQ ID NO: 371846 - DNA, 16 bp, M. musculus
atttctaaaaatgttt

SEQ ID NO: 371847 - DNA, 16 bp, M. musculus
atttctaaaaggaaaa

SEQ ID NO: 371848 - DNA, 16 bp, M. musculus
atttctaagaagaaaa

SEQ ID NO: 371849 - DNA, 16 bp, M. musculus
atttctatacacacac

SEQ ID NO: 371850 - DNA, 16 bp, M. musculus
atttctatctcagtgg

SEQ ID NO: 371851 - DNA, 17 bp, M. musculus
atttctatctccagcat

SEQ ID NO: 371852 - DNA, 16 bp, M. musculus
atttctatgaagaaat

SEQ ID NO: 371853 - DNA, 16 bp, M. musculus
atttctattattccaa

SEQ ID NO: 371854 - DNA, 16 bp, M. musculus
atttctatttgagtaa

SEQ ID NO: 371855 - DNA, 16 bp, M. musculus
atttctatttttaaag

SEQ ID NO: 371856 - DNA, 16 bp, M. musculus
atttctcaaaagaaga

SEQ ID NO: 371857 - DNA, 16 bp, M. musculus
atttctcaggagccat

SEQ ID NO: 371858 - DNA, 16 bp, M. musculus
atttctcagttcccag

SEQ ID NO: 371859 - DNA, 16 bp, M. musculus
atttctcatttgaaaa

SEQ ID NO: 371860 - DNA, 16 bp, M. musculus
atttctccaactgaag

SEQ ID NO: 371861 - DNA, 16 bp, M. musculus
atttctccaagaattt

SEQ ID NO: 371862 - DNA, 16 bp, M. musculus
atttctccagccccaa

SEQ ID NO: 371863 - DNA, 16 bp, M. musculus
atttctcctgtctaaa

SEQ ID NO: 371864 - DNA, 16 bp, M. musculus
atttctccttctctgt

SEQ ID NO: 371865 - DNA, 16 bp, M. musculus
atttctcctttgaaat

SEQ ID NO: 371866 - DNA, 16 bp, M. musculus
atttctctatgttctg

SEQ ID NO: 371867 - DNA, 16 bp, M. musculus
atttctctgggtagcc

SEQ ID NO: 371868 - DNA, 16 bp, M. musculus
atttctctgtcactgt

SEQ ID NO: 371869 - DNA, 16 bp, M. musculus
atttctctgtgtagcc

SEQ ID NO: 371870 - DNA, 16 bp, M. musculus
atttctcttgcttttg

SEQ ID NO: 371871 - DNA, 16 bp, M. musculus
atttctctttcttaga

SEQ ID NO: 371872 - DNA, 16 bp, M. musculus
atttctctttgtattc

SEQ ID NO: 371873 - DNA, 16 bp, M. musculus
atttctgaagacacca

SEQ ID NO: 371874 - DNA, 16 bp, M. musculus
atttctgaagtccagc

SEQ ID NO: 371875 - DNA, 16 bp, M. musculus
atttctgaattcaaag

SEQ ID NO: 371876 - DNA, 16 bp, M. musculus
atttctgagttcaagc

SEQ ID NO: 371877 - DNA, 16 bp, M. musculus
atttctgagttctagg

SEQ ID NO: 371878 - DNA, 16 bp, M. musculus
atttctgagttctgag

SEQ ID NO: 371879 - DNA, 16 bp, M. musculus
atttctgagtttcagg

SEQ ID NO: 371880 - DNA, 16 bp, M. musculus
atttctgagtttgaag

SEQ ID NO: 371881 - DNA, 16 bp, M. musculus
atttctgataaaaatg

SEQ ID NO: 371882 - DNA, 16 bp, M. musculus
atttctgatattttta

SEQ ID NO: 371883 - DNA, 16 bp, M. musculus
atttctgattttttaa

SEQ ID NO: 371884 - DNA, 16 bp, M. musculus
atttctgcatattaaa

SEQ ID NO: 371885 - DNA, 16 bp, M. musculus
atttctgcctcacaag

SEQ ID NO: 371886 - DNA, 16 bp, M. musculus
atttctgctcctgtga

SEQ ID NO: 371887 - DNA, 16 bp, M. musculus
atttctggaaaaaaaa

SEQ ID NO: 371888 - DNA, 16 bp, M. musculus
atttctggaatttttt

SEQ ID NO: 371889 - DNA, 16 bp, M. musculus
atttctggccctggca

SEQ ID NO: 371890 - DNA, 16 bp, M. musculus
atttctggcctccaca

SEQ ID NO: 371891 - DNA, 16 bp, M. musculus
atttctggctcttcaa

SEQ ID NO: 371892 - DNA, 16 bp, M. musculus
atttctgggatttgaa

SEQ ID NO: 371893 - DNA, 18 bp, M. musculus
atttctgggtcttcaatc

SEQ ID NO: 371894 - DNA, 29 bp, M. musculus
atttctgggtcttcaattctattccattg

SEQ ID NO: 371895 - DNA, 16 bp, M. musculus
atttctgggttttcag

SEQ ID NO: 371896 - DNA, 16 bp, M. musculus
atttctgtatataaaa

SEQ ID NO: 371897 - DNA, 16 bp, M. musculus
atttctgtctgtgtgt

SEQ ID NO: 371898 - DNA, 16 bp, M. musculus
atttctgtgaagagac

SEQ ID NO: 371899 - DNA, 16 bp, M. musculus
atttctgtgactttga

SEQ ID NO: 371900 - DNA, 16 bp, M. musculus
atttctgtgccacctt

SEQ ID NO: 371901 - DNA, 16 bp, M. musculus
atttctgtgggaaaaa

SEQ ID NO: 371902 - DNA, 16 bp, M. musculus
atttctgttactttta

SEQ ID NO: 371903 - DNA, 16 bp, M. musculus
atttctgttagtttca

SEQ ID NO: 371904 - DNA, 16 bp, M. musculus
atttctgttcattttc

SEQ ID NO: 371905 - DNA, 16 bp, M. musculus
atttctgttctgttca

SEQ ID NO: 371906 - DNA, 16 bp, M. musculus
atttctgttttataaa

SEQ ID NO: 371907 - DNA, 16 bp, M. musculus
atttcttaacaggaat

SEQ ID NO: 371908 - DNA, 16 bp, M. musculus
atttcttattttgaaa

SEQ ID NO: 371909 - DNA, 16 bp, M. musculus
atttcttcacctgttt

SEQ ID NO: 371910 - DNA, 16 bp, M. musculus
atttcttcagagactt

SEQ ID NO: 371911 - DNA, 16 bp, M. musculus
atttcttcattcattc

SEQ ID NO: 371912 - DNA, 16 bp, M. musculus
atttcttccatgtttt

SEQ ID NO: 371913 - DNA, 16 bp, M. musculus
atttcttcctctctgt

SEQ ID NO: 371914 - DNA, 16 bp, M. musculus
atttcttccttggcca

SEQ ID NO: 371915 - DNA, 16 bp, M. musculus
atttcttctaggatct

SEQ ID NO: 371916 - DNA, 16 bp, M. musculus
atttcttctatcaaca

SEQ ID NO: 371917 - DNA, 16 bp, M. musculus
atttcttctatcatat

SEQ ID NO: 371918 - DNA, 16 bp, M. musculus
atttcttctcagcacc

SEQ ID NO: 371919 - DNA, 16 bp, M. musculus
atttcttctgccaagt

SEQ ID NO: 371920 - DNA, 16 bp, M. musculus
atttcttcttcagaga

SEQ ID NO: 371921 - DNA, 16 bp, M. musculus
atttcttctttgccaa

SEQ ID NO: 371922 - DNA, 16 bp, M. musculus
atttcttcttttgaaa

SEQ ID NO: 371923 - DNA, 16 bp, M. musculus
atttcttggtgaatga

SEQ ID NO: 371924 - DNA, 16 bp, M. musculus
atttctttaaaaacaa

SEQ ID NO: 371925 - DNA, 16 bp, M. musculus
atttctttaaagattt

SEQ ID NO: 371926 - DNA, 16 bp, M. musculus
atttctttaaatgtgt

SEQ ID NO: 371927 - DNA, 16 bp, M. musculus
atttctttaagaaaaa

SEQ ID NO: 371928 - DNA, 16 bp, M. musculus
atttctttaaggggaa

SEQ ID NO: 371929 - DNA, 16 bp, M. musculus
atttctttaagtattt

SEQ ID NO: 371930 - DNA, 16 bp, M. musculus
atttctttaggtgctt

SEQ ID NO: 371931 - DNA, 16 bp, M. musculus
atttctttagtgtttc

SEQ ID NO: 371932 - DNA, 16 bp, M. musculus
atttctttctcagaca

SEQ ID NO: 371933 - DNA, 16 bp, M. musculus
atttctttctcagtgt

SEQ ID NO: 371934 - DNA, 16 bp, M. musculus
atttctttctcttgcc

SEQ ID NO: 371935 - DNA, 16 bp, M. musculus
atttctttctcttgct

SEQ ID NO: 371936 - DNA, 16 bp, M. musculus
atttctttctgttctc

SEQ ID NO: 371937 - DNA, 17 bp, M. musculus
atttctttcttcagaga

SEQ ID NO: 371938 - DNA, 16 bp, M. musculus
atttctttcttgcctt

SEQ ID NO: 371939 - DNA, 16 bp, M. musculus
atttctttctttggag

SEQ ID NO: 371940 - DNA, 16 bp, M. musculus
atttcttttataaatg

SEQ ID NO: 371941 - DNA, 16 bp, M. musculus
atttcttttcagaaaa

SEQ ID NO: 371942 - DNA, 16 bp, M. musculus
atttcttttcagcctg

SEQ ID NO: 371943 - DNA, 16 bp, M. musculus
atttcttttctggtgc

SEQ ID NO: 371944 - DNA, 16 bp, M. musculus
atttctttttgtaaat

SEQ ID NO: 371945 - DNA, 16 bp, M. musculus
atttgaaaaacacaaa

SEQ ID NO: 371946 - DNA, 16 bp, M. musculus
atttgaaaacataaag

SEQ ID NO: 371947 - DNA, 16 bp, M. musculus
atttgaaaacattgaa

SEQ ID NO: 371948 - DNA, 16 bp, M. musculus
atttgaaaaggaagaa

SEQ ID NO: 371949 - DNA, 16 bp, M. musculus
atttgaaaagtatttt

SEQ ID NO: 371950 - DNA, 16 bp, M. musculus
atttgaaaattttcat

SEQ ID NO: 371951 - DNA, 16 bp, M. musculus
atttgaaagaatattt

SEQ ID NO: 371952 - DNA, 16 bp, M. musculus
atttgaaagacagaaa

SEQ ID NO: 371953 - DNA, 16 bp, M. musculus
atttgaaagagagaaa

SEQ ID NO: 371954 - DNA, 16 bp, M. musculus
atttgaaatatatttc

SEQ ID NO: 371955 - DNA, 16 bp, M. musculus
atttgaaatatttgaa

SEQ ID NO: 371956 - DNA, 16 bp, M. musculus
atttgaaatgaaaatg

SEQ ID NO: 371957 - DNA, 16 bp, M. musculus
atttgaaatgagaaga

SEQ ID NO: 371958 - DNA, 16 bp, M. musculus
atttgaaatgcaaaca

SEQ ID NO: 371959 - DNA, 16 bp, M. musculus
atttgaaatgcaaaga

SEQ ID NO: 371960 - DNA, 16 bp, M. musculus
atttgaaatgggaaga

SEQ ID NO: 371961 - DNA, 16 bp, M. musculus
atttgaaatgtaatta

SEQ ID NO: 371962 - DNA, 16 bp, M. musculus
atttgaaatgtaattg

SEQ ID NO: 371963 - DNA, 16 bp, M. musculus
atttgaaattaaaatg

SEQ ID NO: 371964 - DNA, 16 bp, M. musculus
atttgaaattcaaata

SEQ ID NO: 371965 - DNA, 16 bp, M. musculus
atttgaaattcatttt

SEQ ID NO: 371966 - DNA, 16 bp, M. musculus
atttgaactcagttct

SEQ ID NO: 371967 - DNA, 20 bp, M. musculus
atttgaactgtgttgacctg

SEQ ID NO: 371968 - DNA, 27 bp, M. musculus
atttgaactgtgttgacctggcccaag

SEQ ID NO: 371969 - DNA, 16 bp, M. musculus
atttgaagaaaatgaa

SEQ ID NO: 371970 - DNA, 16 bp, M. musculus
atttgaagattttaat

SEQ ID NO: 371971 - DNA, 16 bp, M. musculus
atttgaaggaaaataa

SEQ ID NO: 371972 - DNA, 16 bp, M. musculus
atttgaaggagagtgg

SEQ ID NO: 371973 - DNA, 16 bp, M. musculus
atttgaagttcttgtt

SEQ ID NO: 371974 - DNA, 16 bp, M. musculus
atttgaagttttcttt

SEQ ID NO: 371975 - DNA, 17 bp, M. musculus
atttgaataacagtccc

SEQ ID NO: 371976 - DNA, 16 bp, M. musculus
atttgaatatttgatc

SEQ ID NO: 371977 - DNA, 16 bp, M. musculus
atttgaatgtaaataa

SEQ ID NO: 371978 - DNA, 16 bp, M. musculus
atttgaattgtaaata

SEQ ID NO: 371979 - DNA, 16 bp, M. musculus
atttgaatttatgtgt

SEQ ID NO: 371980 - DNA, 16 bp, M. musculus
atttgacaaaatagga

SEQ ID NO: 371981 - DNA, 16 bp, M. musculus
atttgacaccctcttc

SEQ ID NO: 371982 - DNA, 16 bp, M. musculus
atttgacagaatgagt

SEQ ID NO: 371983 - DNA, 16 bp, M. musculus
atttgactgcaaaact

SEQ ID NO: 371984 - DNA, 16 bp, M. musculus
atttgacttttttccc

SEQ ID NO: 371985 - DNA, 16 bp, M. musculus
atttgagaaaatgcct

SEQ ID NO: 371986 - DNA, 16 bp, M. musculus
atttgagaggctgagg

SEQ ID NO: 371987 - DNA, 16 bp, M. musculus
atttgagaggtggagg

SEQ ID NO: 371988 - DNA, 16 bp, M. musculus
atttgaggccagcctg

SEQ ID NO: 371989 - DNA, 16 bp, M. musculus
atttgaggccagtctg

SEQ ID NO: 371990 - DNA, 16 bp, M. musculus
atttgaggctagcctg

SEQ ID NO: 371991 - DNA, 16 bp, M. musculus
atttgaggggaaaaaa

SEQ ID NO: 371992 - DNA, 16 bp, M. musculus
atttgaggtcagcctg

SEQ ID NO: 371993 - DNA, 16 bp, M. musculus
atttgataacaaaagg

SEQ ID NO: 371994 - DNA, 16 bp, M. musculus
atttgatatcagaatg

SEQ ID NO: 371995 - DNA, 16 bp, M. musculus
atttgatatgtaaata

SEQ ID NO: 371996 - DNA, 16 bp, M. musculus
atttgatattaaaatg

SEQ ID NO: 371997 - DNA, 16 bp, M. musculus
atttgatctcaggacc

SEQ ID NO: 371998 - DNA, 16 bp, M. musculus
atttgatgaaaatgaa

SEQ ID NO: 371999 - DNA, 16 bp, M. musculus
atttgatgaagacatt

SEQ ID NO: 372000 - DNA, 16 bp, M. musculus
atttgatgagaatgaa

SEQ ID NO: 372001 - DNA, 16 bp, M. musculus
atttgatgatgatgat

SEQ ID NO: 372002 - DNA, 16 bp, M. musculus
atttgatgccagcctg

SEQ ID NO: 372003 - DNA, 16 bp, M. musculus
atttgatgttttaaaa

SEQ ID NO: 372004 - DNA, 16 bp, M. musculus
atttgattcaaataat

SEQ ID NO: 372005 - DNA, 16 bp, M. musculus
atttgatttctagcac

SEQ ID NO: 372006 - DNA, 18 bp, M. musculus
atttgattttctggagta

SEQ ID NO: 372007 - DNA, 16 bp, M. musculus
atttgcaaaacaaaag

SEQ ID NO: 372008 - DNA, 16 bp, M. musculus
atttgcaaaactcaag

SEQ ID NO: 372009 - DNA, 16 bp, M. musculus
atttgcaaaataaaat

SEQ ID NO: 372010 - DNA, 16 bp, M. musculus
atttgcaaaatacaag

SEQ ID NO: 372011 - DNA, 16 bp, M. musculus
atttgcaaagcacaag

SEQ ID NO: 372012 - DNA, 17 bp, M. musculus
atttgcaaagcacatga

SEQ ID NO: 372013 - DNA, 16 bp, M. musculus
atttgcaaatgatata

SEQ ID NO: 372014 - DNA, 16 bp, M. musculus
atttgcaagtatttta

SEQ ID NO: 372015 - DNA, 27 bp, M. musculus
atttgcaagtccaatgggcctctcttt

SEQ ID NO: 372016 - DNA, 16 bp, M. musculus
atttgcagatgaccag

SEQ ID NO: 372017 - DNA, 16 bp, M. musculus
atttgcagatgatagg

SEQ ID NO: 372018 - DNA, 16 bp, M. musculus
atttgcagatttttct

SEQ ID NO: 372019 - DNA, 16 bp, M. musculus
atttgcataccaatca

SEQ ID NO: 372020 - DNA, 16 bp, M. musculus
atttgcatatctctga

SEQ ID NO: 372021 - DNA, 16 bp, M. musculus
atttgcatatttattt

SEQ ID NO: 372022 - DNA, 16 bp, M. musculus
atttgcatattttaaa

SEQ ID NO: 372023 - DNA, 16 bp, M. musculus
atttgcatgtaaagct

SEQ ID NO: 372024 - DNA, 16 bp, M. musculus
atttgcatgtgtgtga

SEQ ID NO: 372025 - DNA, 16 bp, M. musculus
atttgcatttccatga

SEQ ID NO: 372026 - DNA, 40 bp, M. musculus
atttgcatttccctgatgattaaggatgttgaacattttt

SEQ ID NO: 372027 - DNA, 16 bp, M. musculus
atttgcatttctctga

SEQ ID NO: 372028 - DNA, 16 bp, M. musculus
atttgcatttgcattt

SEQ ID NO: 372029 - DNA, 16 bp, M. musculus
atttgcattttaaaat

SEQ ID NO: 372030 - DNA, 16 bp, M. musculus
atttgcatttttaaaa

SEQ ID NO: 372031 - DNA, 16 bp, M. musculus
atttgccaaagaactt

SEQ ID NO: 372032 - DNA, 16 bp, M. musculus
atttgccaccaagcct

SEQ ID NO: 372033 - DNA, 16 bp, M. musculus
atttgcccaatgtctt

SEQ ID NO: 372034 - DNA, 16 bp, M. musculus
atttgccccagcaaaa

SEQ ID NO: 372035 - DNA, 19 bp, M. musculus
atttgcctaagaatttcat

SEQ ID NO: 372036 - DNA, 16 bp, M. musculus
atttgcctgcaaattt

SEQ ID NO: 372037 - DNA, 16 bp, M. musculus
atttgcctgtgaattt

SEQ ID NO: 372038 - DNA, 16 bp, M. musculus
atttgccttgtgctct

SEQ ID NO: 372039 - DNA, 16 bp, M. musculus
atttgccttttctccc

SEQ ID NO: 372040 - DNA, 16 bp, M. musculus
atttgctatgtagccc

SEQ ID NO: 372041 - DNA, 16 bp, M. musculus
atttgctgaagaattt

SEQ ID NO: 372042 - DNA, 16 bp, M. musculus
atttgctgccaagcct

SEQ ID NO: 372043 - DNA, 16 bp, M. musculus
atttgctggatgtttt

SEQ ID NO: 372044 - DNA, 16 bp, M. musculus
atttgctggcccttta

SEQ ID NO: 372045 - DNA, 16 bp, M. musculus
atttgctgttcttgca

SEQ ID NO: 372046 - DNA, 16 bp, M. musculus
atttgcttacaaaatt

SEQ ID NO: 372047 - DNA, 16 bp, M. musculus
atttgcttcataactt

SEQ ID NO: 372048 - DNA, 16 bp, M. musculus
atttgcttctttgtgt

SEQ ID NO: 372049 - DNA, 16 bp, M. musculus
atttgctttacaggga

SEQ ID NO: 372050 - DNA, 16 bp, M. musculus
atttgctttgagcttt

SEQ ID NO: 372051 - DNA, 16 bp, M. musculus
atttgctttgtgaaga

SEQ ID NO: 372052 - DNA, 16 bp, M. musculus
atttgcttttaaaatt

SEQ ID NO: 372053 - DNA, 16 bp, M. musculus
atttgcttttgtgtta

SEQ ID NO: 372054 - DNA, 16 bp, M. musculus
atttgctttttaaatt

SEQ ID NO: 372055 - DNA, 16 bp, M. musculus
atttggaaaaaacaaa

SEQ ID NO: 372056 - DNA, 16 bp, M. musculus
atttggaaaatatttt

SEQ ID NO: 372057 - DNA, 16 bp, M. musculus
atttggaaaattaatt

SEQ ID NO: 372058 - DNA, 16 bp, M. musculus
atttggaaagaagaaa

SEQ ID NO: 372059 - DNA, 16 bp, M. musculus
atttggaaatcttcct

SEQ ID NO: 372060 - DNA, 16 bp, M. musculus
atttggaacatgaaca

SEQ ID NO: 372061 - DNA, 16 bp, M. musculus
atttggaagaaggaaa

SEQ ID NO: 372062 - DNA, 16 bp, M. musculus
atttggaagacagagg

SEQ ID NO: 372063 - DNA, 16 bp, M. musculus
atttggaagatgcttt

SEQ ID NO: 372064 - DNA, 16 bp, M. musculus
atttggaagctgataa

SEQ ID NO: 372065 - DNA, 16 bp, M. musculus
atttggaaggaagaaa

SEQ ID NO: 372066 - DNA, 16 bp, M. musculus
atttggaaggtagagg

SEQ ID NO: 372067 - DNA, 16 bp, M. musculus
atttggaagtgtaagc

SEQ ID NO: 372068 - DNA, 16 bp, M. musculus
atttggaattctctgg

SEQ ID NO: 372069 - DNA, 16 bp, M. musculus
atttggagctgagatg

SEQ ID NO: 372070 - DNA, 16 bp, M. musculus
atttggagcttttggg

SEQ ID NO: 372071 - DNA, 16 bp, M. musculus
atttggaggaaagaaa

SEQ ID NO: 372072 - DNA, 16 bp, M. musculus
atttggaggctgatta

SEQ ID NO: 372073 - DNA, 16 bp, M. musculus
atttggagtttgccca

SEQ ID NO: 372074 - DNA, 16 bp, M. musculus
atttggagttttatag

SEQ ID NO: 372075 - DNA, 24 bp, M. musculus
atttggcaatgtacccggttcatt

SEQ ID NO: 372076 - DNA, 16 bp, M. musculus
atttggccagttttta

SEQ ID NO: 372077 - DNA, 16 bp, M. musculus
atttggctgtttctca

SEQ ID NO: 372078 - DNA, 16 bp, M. musculus
atttggctttttaaaa

SEQ ID NO: 372079 - DNA, 16 bp, M. musculus
atttgggaacaattta

SEQ ID NO: 372080 - DNA, 16 bp, M. musculus
atttgggaggctgaga

SEQ ID NO: 372081 - DNA, 16 bp, M. musculus
atttgggaggtgaagg

SEQ ID NO: 372082 - DNA, 16 bp, M. musculus
atttgggaggtggaag

SEQ ID NO: 372083 - DNA, 16 bp, M. musculus
atttgggggaaatttt

SEQ ID NO: 372084 - DNA, 16 bp, M. musculus
atttgggggctggaga

SEQ ID NO: 372085 - DNA, 16 bp, M. musculus
atttgggtgctgggaa

SEQ ID NO: 372086 - DNA, 16 bp, M. musculus
atttgggtggcagagg

SEQ ID NO: 372087 - DNA, 16 bp, M. musculus
atttgggtttgtcatg

SEQ ID NO: 372088 - DNA, 16 bp, M. musculus
atttggtctgttgcta

SEQ ID NO: 372089 - DNA, 16 bp, M. musculus
atttggtgtgcaccca

SEQ ID NO: 372090 - DNA, 16 bp, M. musculus
atttggtgttttaact

SEQ ID NO: 372091 - DNA, 16 bp, M. musculus
atttggttcttaggag

SEQ ID NO: 372092 - DNA, 16 bp, M. musculus
atttggtttacatttc

SEQ ID NO: 372093 - DNA, 16 bp, M. musculus
atttggttttcctctg

SEQ ID NO: 372094 - DNA, 16 bp, M. musculus
atttggttttctcatt

SEQ ID NO: 372095 - DNA, 16 bp, M. musculus
atttgtaaatgtacca

SEQ ID NO: 372096 - DNA, 16 bp, M. musculus
atttgtaagagggaaa

SEQ ID NO: 372097 - DNA, 16 bp, M. musculus
atttgtaagggtggaa

SEQ ID NO: 372098 - DNA, 16 bp, M. musculus
atttgtaattccagtt

SEQ ID NO: 372099 - DNA, 16 bp, M. musculus
atttgtacatatttat

SEQ ID NO: 372100 - DNA, 16 bp, M. musculus
atttgtacccaaccaa

SEQ ID NO: 372101 - DNA, 16 bp, M. musculus
atttgtacttttaaaa

SEQ ID NO: 372102 - DNA, 16 bp, M. musculus
atttgtagaaaaatat

SEQ ID NO: 372103 - DNA, 16 bp, M. musculus
atttgtagaccaggct

SEQ ID NO: 372104 - DNA, 16 bp, M. musculus
atttgtagcagagaat

SEQ ID NO: 372105 - DNA, 16 bp, M. musculus
atttgtagttaaggtt

SEQ ID NO: 372106 - DNA, 16 bp, M. musculus
atttgtagttctgtag

SEQ ID NO: 372107 - DNA, 16 bp, M. musculus
atttgtatagttcttt

SEQ ID NO: 372108 - DNA, 16 bp, M. musculus
atttgtatatatacac

SEQ ID NO: 372109 - DNA, 16 bp, M. musculus
atttgtatgaatgttt

SEQ ID NO: 372110 - DNA, 16 bp, M. musculus
atttgtatgagtgttt

SEQ ID NO: 372111 - DNA, 16 bp, M. musculus
atttgtatgtacatat

SEQ ID NO: 372112 - DNA, 16 bp, M. musculus
atttgtattcatattt

SEQ ID NO: 372113 - DNA, 16 bp, M. musculus
atttgtatttctggag

SEQ ID NO: 372114 - DNA, 16 bp, M. musculus
atttgtcagaagaact

SEQ ID NO: 372115 - DNA, 16 bp, M. musculus
atttgtcagcatcctt

SEQ ID NO: 372116 - DNA, 16 bp, M. musculus
atttgtcagtaaagaa

SEQ ID NO: 372117 - DNA, 16 bp, M. musculus
atttgtccaatctagg

SEQ ID NO: 372118 - DNA, 16 bp, M. musculus
atttgtctaagaaatt

SEQ ID NO: 372119 - DNA, 16 bp, M. musculus
atttgtctgagtcagc

SEQ ID NO: 372120 - DNA, 16 bp, M. musculus
atttgtctgcaaattt

SEQ ID NO: 372121 - DNA, 16 bp, M. musculus
atttgtctttatcaga

SEQ ID NO: 372122 - DNA, 16 bp, M. musculus
atttgtcttttaaaaa

SEQ ID NO: 372123 - DNA, 16 bp, M. musculus
atttgtcttttaaaat

SEQ ID NO: 372124 - DNA, 16 bp, M. musculus
atttgtctttttaaaa

SEQ ID NO: 372125 - DNA, 16 bp, M. musculus
atttgtgactcttgag

SEQ ID NO: 372126 - DNA, 16 bp, M. musculus
atttgtggaaagaaat

SEQ ID NO: 372127 - DNA, 16 bp, M. musculus
atttgtggaaagatgt

SEQ ID NO: 372128 - DNA, 16 bp, M. musculus
atttgtggaggggaga

SEQ ID NO: 372129 - DNA, 16 bp, M. musculus
atttgtgttgtctgga

SEQ ID NO: 372130 - DNA, 16 bp, M. musculus
atttgtgtttccctga

SEQ ID NO: 372131 - DNA, 16 bp, M. musculus
atttgttaaatctcaa

SEQ ID NO: 372132 - DNA, 35 bp, M. musculus
atttgttaaatctcaaattgattcatctctttcaa

SEQ ID NO: 372133 - DNA, 16 bp, M. musculus
atttgttaaatgcatg

SEQ ID NO: 372134 - DNA, 16 bp, M. musculus
atttgttaactcttgt

SEQ ID NO: 372135 - DNA, 24 bp, M. musculus
atttgttaagaatgagagaggaca

SEQ ID NO: 372136 - DNA, 16 bp, M. musculus
atttgttacagaaaaa

SEQ ID NO: 372137 - DNA, 16 bp, M. musculus
atttgttacagcagca

SEQ ID NO: 372138 - DNA, 16 bp, M. musculus
atttgttactttgtct

SEQ ID NO: 372139 - DNA, 16 bp, M. musculus
atttgttagcttttat

SEQ ID NO: 372140 - DNA, 16 bp, M. musculus
atttgttcaggatctg

SEQ ID NO: 372141 - DNA, 16 bp, M. musculus
atttgttcatttcatc

SEQ ID NO: 372142 - DNA, 16 bp, M. musculus
atttgttgaaaaatgt

SEQ ID NO: 372143 - DNA, 16 bp, M. musculus
atttgttgaaaacact

SEQ ID NO: 372144 - DNA, 16 bp, M. musculus
atttgttgaaaatgtt

SEQ ID NO: 372145 - DNA, 16 bp, M. musculus
atttgttgaagaattg

SEQ ID NO: 372146 - DNA, 16 bp, M. musculus
atttgttgaagaggct

SEQ ID NO: 372147 - DNA, 16 bp, M. musculus
atttgttgaagatgct

SEQ ID NO: 372148 - DNA, 16 bp, M. musculus
atttgttgaatgaatg

SEQ ID NO: 372149 - DNA, 16 bp, M. musculus
atttgttgatggacat

SEQ ID NO: 372150 - DNA, 16 bp, M. musculus
atttgttgattctcta

SEQ ID NO: 372151 - DNA, 16 bp, M. musculus
atttgttggggaataa

SEQ ID NO: 372152 - DNA, 16 bp, M. musculus
atttgttgttatgtct

SEQ ID NO: 372153 - DNA, 16 bp, M. musculus
atttgttgttcagatt

SEQ ID NO: 372154 - DNA, 16 bp, M. musculus
atttgtttaaaatgct

SEQ ID NO: 372155 - DNA, 16 bp, M. musculus
atttgtttacatatat

SEQ ID NO: 372156 - DNA, 16 bp, M. musculus
atttgtttacattcca

SEQ ID NO: 372157 - DNA, 16 bp, M. musculus
atttgtttatacattt

SEQ ID NO: 372158 - DNA, 16 bp, M. musculus
atttgtttcagttcat

SEQ ID NO: 372159 - DNA, 16 bp, M. musculus
atttgtttgagataat

SEQ ID NO: 372160 - DNA, 16 bp, M. musculus
atttgtttgcaaattt

SEQ ID NO: 372161 - DNA, 16 bp, M. musculus
atttgtttggaataac

SEQ ID NO: 372162 - DNA, 16 bp, M. musculus
atttgttttctttaaa

SEQ ID NO: 372163 - DNA, 16 bp, M. musculus
atttgttttgtgagaa

SEQ ID NO: 372164 - DNA, 16 bp, M. musculus
atttgtttttctcatg

SEQ ID NO: 372165 - DNA, 16 bp, M. musculus
attttaaaaaacagat

SEQ ID NO: 372166 - DNA, 16 bp, M. musculus
attttaaaaaggtatt

SEQ ID NO: 372167 - DNA, 16 bp, M. musculus
attttaaaaagtaaca

SEQ ID NO: 372168 - DNA, 16 bp, M. musculus
attttaaaaagttctt

SEQ ID NO: 372169 - DNA, 16 bp, M. musculus
attttaaaaataagct

SEQ ID NO: 372170 - DNA, 16 bp, M. musculus
attttaaaaatcactt

SEQ ID NO: 372171 - DNA, 16 bp, M. musculus
attttaaaaatgaagt

SEQ ID NO: 372172 - DNA, 16 bp, M. musculus
attttaaaaattgctg

SEQ ID NO: 372173 - DNA, 16 bp, M. musculus
attttaaaacaaagaa

SEQ ID NO: 372174 - DNA, 16 bp, M. musculus
attttaaaacacacac

SEQ ID NO: 372175 - DNA, 16 bp, M. musculus
attttaaaacactgtt

SEQ ID NO: 372176 - DNA, 16 bp, M. musculus
attttaaaacacttta

SEQ ID NO: 372177 - DNA, 16 bp, M. musculus
attttaaaactgtgtt

SEQ ID NO: 372178 - DNA, 16 bp, M. musculus
attttaaaacttgtat

SEQ ID NO: 372179 - DNA, 16 bp, M. musculus
attttaaaacttgttt

SEQ ID NO: 372180 - DNA, 16 bp, M. musculus
attttaaaagaacaaa

SEQ ID NO: 372181 - DNA, 16 bp, M. musculus
attttaaaagaacatt

SEQ ID NO: 372182 - DNA, 16 bp, M. musculus
attttaaaagaagatt

SEQ ID NO: 372183 - DNA, 16 bp, M. musculus
attttaaaagaagttt

SEQ ID NO: 372184 - DNA, 16 bp, M. musculus
attttaaaagcataat

SEQ ID NO: 372185 - DNA, 16 bp, M. musculus
attttaaaaggaaaag

SEQ ID NO: 372186 - DNA, 16 bp, M. musculus
attttaaaaggaaaca

SEQ ID NO: 372187 - DNA, 16 bp, M. musculus
attttaaaaggtaaat

SEQ ID NO: 372188 - DNA, 16 bp, M. musculus
attttaaaatatggaa

SEQ ID NO: 372189 - DNA, 16 bp, M. musculus
attttaaaatcccaaa

SEQ ID NO: 372190 - DNA, 16 bp, M. musculus
attttaaaatgaaaca

SEQ ID NO: 372191 - DNA, 16 bp, M. musculus
attttaaaatgcattt

SEQ ID NO: 372192 - DNA, 16 bp, M. musculus
attttaaaatgtaaca

SEQ ID NO: 372193 - DNA, 16 bp, M. musculus
attttaaaatgtcatt

SEQ ID NO: 372194 - DNA, 16 bp, M. musculus
attttaaaattcagaa

SEQ ID NO: 372195 - DNA, 16 bp, M. musculus
attttaaacattgttt

SEQ ID NO: 372196 - DNA, 16 bp, M. musculus
attttaaagaaaagtt

SEQ ID NO: 372197 - DNA, 16 bp, M. musculus
attttaaagaaactga

SEQ ID NO: 372198 - DNA, 16 bp, M. musculus
attttaaagaaattga

SEQ ID NO: 372199 - DNA, 16 bp, M. musculus
attttaaagagagaaa

SEQ ID NO: 372200 - DNA, 16 bp, M. musculus
attttaaagatgaata

SEQ ID NO: 372201 - DNA, 16 bp, M. musculus
attttaaaggaaatga

SEQ ID NO: 372202 - DNA, 16 bp, M. musculus
attttaaagtgaaaat

SEQ ID NO: 372203 - DNA, 16 bp, M. musculus
attttaaagttttctt

SEQ ID NO: 372204 - DNA, 16 bp, M. musculus
attttaaatcagtttt

SEQ ID NO: 372205 - DNA, 16 bp, M. musculus
attttaaatctgaatc

SEQ ID NO: 372206 - DNA, 16 bp, M. musculus
attttaaatgaaatga

SEQ ID NO: 372207 - DNA, 16 bp, M. musculus
attttaaatgactttt

SEQ ID NO: 372208 - DNA, 16 bp, M. musculus
attttaaatggaattt

SEQ ID NO: 372209 - DNA, 16 bp, M. musculus
attttaaatgtatgta

SEQ ID NO: 372210 - DNA, 16 bp, M. musculus
attttaaatgttatcc

SEQ ID NO: 372211 - DNA, 16 bp, M. musculus
attttaaattctgtgt

SEQ ID NO: 372212 - DNA, 16 bp, M. musculus
attttaaattgtgtgt

SEQ ID NO: 372213 - DNA, 16 bp, M. musculus
attttaacagctgagt

SEQ ID NO: 372214 - DNA, 16 bp, M. musculus
attttaaccaatcaga

SEQ ID NO: 372215 - DNA, 16 bp, M. musculus
attttaagaaaaacaa

SEQ ID NO: 372216 - DNA, 16 bp, M. musculus
attttaagaaaaatgt

SEQ ID NO: 372217 - DNA, 16 bp, M. musculus
attttaagcatttaaa

SEQ ID NO: 372218 - DNA, 16 bp, M. musculus
attttaaggtcttttt

SEQ ID NO: 372219 - DNA, 16 bp, M. musculus
attttaaggtgtgtgt

SEQ ID NO: 372220 - DNA, 16 bp, M. musculus
attttaatatttgaca

SEQ ID NO: 372221 - DNA, 16 bp, M. musculus
attttaatcccagcac

SEQ ID NO: 372222 - DNA, 16 bp, M. musculus
attttaatcttccaaa

SEQ ID NO: 372223 - DNA, 16 bp, M. musculus
attttaatgctatttt

SEQ ID NO: 372224 - DNA, 16 bp, M. musculus
attttaatgcttattt

SEQ ID NO: 372225 - DNA, 16 bp, M. musculus
attttaatgtattctt

SEQ ID NO: 372226 - DNA, 16 bp, M. musculus
attttaattacatgca

SEQ ID NO: 372227 - DNA, 16 bp, M. musculus
attttaattctgaaaa

SEQ ID NO: 372228 - DNA, 16 bp, M. musculus
attttaattttccaaa

SEQ ID NO: 372229 - DNA, 16 bp, M. musculus
attttacaaatgaaat

SEQ ID NO: 372230 - DNA, 16 bp, M. musculus
attttacaaatgaaga

SEQ ID NO: 372231 - DNA, 16 bp, M. musculus
attttacaagtgagaa

SEQ ID NO: 372232 - DNA, 16 bp, M. musculus
attttacagatgtgaa

SEQ ID NO: 372233 - DNA, 16 bp, M. musculus
attttacataccaaag

SEQ ID NO: 372234 - DNA, 16 bp, M. musculus
attttacatatttatg

SEQ ID NO: 372235 - DNA, 16 bp, M. musculus
attttacatgaagtag

SEQ ID NO: 372236 - DNA, 16 bp, M. musculus
attttacatgtatttt

SEQ ID NO: 372237 - DNA, 16 bp, M. musculus
attttacattaaaagt

SEQ ID NO: 372238 - DNA, 16 bp, M. musculus
attttaccaaatgaag

SEQ ID NO: 372239 - DNA, 16 bp, M. musculus
attttaccaataaaga

SEQ ID NO: 372240 - DNA, 16 bp, M. musculus
attttaccaatgaaga

SEQ ID NO: 372241 - DNA, 16 bp, M. musculus
attttaccatttaaaa

SEQ ID NO: 372242 - DNA, 17 bp, M. musculus
attttacctcttggctt

SEQ ID NO: 372243 - DNA, 16 bp, M. musculus
attttacctttaaaaa

SEQ ID NO: 372244 - DNA, 17 bp, M. musculus
attttacctttgatgag

SEQ ID NO: 372245 - DNA, 16 bp, M. musculus
attttacctttgatgt

SEQ ID NO: 372246 - DNA, 16 bp, M. musculus
attttaccttttaaaa

SEQ ID NO: 372247 - DNA, 16 bp, M. musculus
attttactatgagcaa

SEQ ID NO: 372248 - DNA, 16 bp, M. musculus
attttactcatttaca

SEQ ID NO: 372249 - DNA, 16 bp, M. musculus
attttactgaagggac

SEQ ID NO: 372250 - DNA, 16 bp, M. musculus
attttactgttatgaa

SEQ ID NO: 372251 - DNA, 16 bp, M. musculus
attttactttcaaaat

SEQ ID NO: 372252 - DNA, 16 bp, M. musculus
attttacttttgaaat

SEQ ID NO: 372253 - DNA, 16 bp, M. musculus
attttagaacaatttt

SEQ ID NO: 372254 - DNA, 16 bp, M. musculus
attttagatggttgtg

SEQ ID NO: 372255 - DNA, 16 bp, M. musculus
attttagctaatgtca

SEQ ID NO: 372256 - DNA, 16 bp, M. musculus
attttagcttttgatt

SEQ ID NO: 372257 - DNA, 16 bp, M. musculus
attttaggaagaaaat

SEQ ID NO: 372258 - DNA, 16 bp, M. musculus
attttaggggaaaaaa

SEQ ID NO: 372259 - DNA, 16 bp, M. musculus
attttaggttttaaaa

SEQ ID NO: 372260 - DNA, 16 bp, M. musculus
attttagtggattcca

SEQ ID NO: 372261 - DNA, 16 bp, M. musculus
attttataactgtaat

SEQ ID NO: 372262 - DNA, 16 bp, M. musculus
attttatacaaagaaa

SEQ ID NO: 372263 - DNA, 16 bp, M. musculus
attttatacatgtttt

SEQ ID NO: 372264 - DNA, 16 bp, M. musculus
attttatagaatttct

SEQ ID NO: 372265 - DNA, 16 bp, M. musculus
attttatagacagaaa

SEQ ID NO: 372266 - DNA, 16 bp, M. musculus
attttatatatatgag

SEQ ID NO: 372267 - DNA, 16 bp, M. musculus
attttatatgaagaaa

SEQ ID NO: 372268 - DNA, 16 bp, M. musculus
attttatatgcatttt

SEQ ID NO: 372269 - DNA, 16 bp, M. musculus
attttatatgtttgag

SEQ ID NO: 372270 - DNA, 16 bp, M. musculus
attttatattggctgt

SEQ ID NO: 372271 - DNA, 16 bp, M. musculus
attttatattgttcat

SEQ ID NO: 372272 - DNA, 16 bp, M. musculus
attttatatttgcata

SEQ ID NO: 372273 - DNA, 16 bp, M. musculus
attttatcacagcaaa

SEQ ID NO: 372274 - DNA, 22 bp, M. musculus
attttatcgaaaggacccagat

SEQ ID NO: 372275 - DNA, 16 bp, M. musculus
attttatcttatatgt

SEQ ID NO: 372276 - DNA, 16 bp, M. musculus
attttatgaagaaaat

SEQ ID NO: 372277 - DNA, 16 bp, M. musculus
attttatgagaaaaat

SEQ ID NO: 372278 - DNA, 16 bp, M. musculus
attttatgagttagaa

SEQ ID NO: 372279 - DNA, 16 bp, M. musculus
attttatgcaaatata

SEQ ID NO: 372280 - DNA, 16 bp, M. musculus
attttatgctgaattt

SEQ ID NO: 372281 - DNA, 16 bp, M. musculus
attttatggttgagga

SEQ ID NO: 372282 - DNA, 16 bp, M. musculus
attttatgtgtgtaca

SEQ ID NO: 372283 - DNA, 16 bp, M. musculus
attttattaatttcag

SEQ ID NO: 372284 - DNA, 16 bp, M. musculus
attttattaccccttc

SEQ ID NO: 372285 - DNA, 16 bp, M. musculus
attttattctcaaaat

SEQ ID NO: 372286 - DNA, 16 bp, M. musculus
attttattctctggag

SEQ ID NO: 372287 - DNA, 16 bp, M. musculus
attttattcttcaaaa

SEQ ID NO: 372288 - DNA, 16 bp, M. musculus
attttattgagaagtt

SEQ ID NO: 372289 - DNA, 16 bp, M. musculus
attttattgctatgtt

SEQ ID NO: 372290 - DNA, 16 bp, M. musculus
attttattgctgtgtt

SEQ ID NO: 372291 - DNA, 16 bp, M. musculus
attttattgttttcag

SEQ ID NO: 372292 - DNA, 16 bp, M. musculus
attttatttacatgtg

SEQ ID NO: 372293 - DNA, 16 bp, M. musculus
attttatttcaaatgt

SEQ ID NO: 372294 - DNA, 16 bp, M. musculus
attttatttggaaaat

SEQ ID NO: 372295 - DNA, 16 bp, M. musculus
attttattttcaagat

SEQ ID NO: 372296 - DNA, 16 bp, M. musculus
attttattttcaagta

SEQ ID NO: 372297 - DNA, 16 bp, M. musculus
attttattttctgata

SEQ ID NO: 372298 - DNA, 16 bp, M. musculus
attttattttgtcatg

SEQ ID NO: 372299 - DNA, 16 bp, M. musculus
attttcaaaaacattt

SEQ ID NO: 372300 - DNA, 16 bp, M. musculus
attttcaaaatgaaaa

SEQ ID NO: 372301 - DNA, 16 bp, M. musculus
attttcaaaatgtttt

SEQ ID NO: 372302 - DNA, 16 bp, M. musculus
attttcaaagaaacaa

SEQ ID NO: 372303 - DNA, 16 bp, M. musculus
attttcaaagagaaaa

SEQ ID NO: 372304 - DNA, 16 bp, M. musculus
attttcaaaggagaaa

SEQ ID NO: 372305 - DNA, 16 bp, M. musculus
attttcaacaaatgtt

SEQ ID NO: 372306 - DNA, 16 bp, M. musculus
attttcaacaaattgt

SEQ ID NO: 372307 - DNA, 16 bp, M. musculus
attttcaacagagaaa

SEQ ID NO: 372308 - DNA, 16 bp, M. musculus
attttcaactgaagaa

SEQ ID NO: 372309 - DNA, 16 bp, M. musculus
attttcaagaaaatta

SEQ ID NO: 372310 - DNA, 16 bp, M. musculus
attttcaagaagaaaa

SEQ ID NO: 372311 - DNA, 16 bp, M. musculus
attttcaagatatttt

SEQ ID NO: 372312 - DNA, 16 bp, M. musculus
attttcaataaaatgt

SEQ ID NO: 372313 - DNA, 16 bp, M. musculus
attttcaataaaggaa

SEQ ID NO: 372314 - DNA, 16 bp, M. musculus
attttcaatgatgaaa

SEQ ID NO: 372315 - DNA, 16 bp, M. musculus
attttcacaaaaatat

SEQ ID NO: 372316 - DNA, 16 bp, M. musculus
attttcacaatgttga

SEQ ID NO: 372317 - DNA, 23 bp, M. musculus
attttcaccagagactatgaaag

SEQ ID NO: 372318 - DNA, 16 bp, M. musculus
attttcactgctactt

SEQ ID NO: 372319 - DNA, 16 bp, M. musculus
attttcactgtgtccc

SEQ ID NO: 372320 - DNA, 16 bp, M. musculus
attttcactttgaaat

SEQ ID NO: 372321 - DNA, 16 bp, M. musculus
attttcacttttaaaa

SEQ ID NO: 372322 - DNA, 16 bp, M. musculus
attttcagaaaacaaa

SEQ ID NO: 372323 - DNA, 16 bp, M. musculus
attttcagaagaaaaa

SEQ ID NO: 372324 - DNA, 16 bp, M. musculus
attttcagaatatttt

SEQ ID NO: 372325 - DNA, 16 bp, M. musculus
attttcagaggactat

SEQ ID NO: 372326 - DNA, 16 bp, M. musculus
attttcagagggaaac

SEQ ID NO: 372327 - DNA, 16 bp, M. musculus
attttcagagtggaaa

SEQ ID NO: 372328 - DNA, 16 bp, M. musculus
attttcagagtggtct

SEQ ID NO: 372329 - DNA, 16 bp, M. musculus
attttcagagttcttt

SEQ ID NO: 372330 - DNA, 16 bp, M. musculus
attttcagattatttt

SEQ ID NO: 372331 - DNA, 16 bp, M. musculus
attttcagctgaggaa

SEQ ID NO: 372332 - DNA, 16 bp, M. musculus
attttcaggatagcat

SEQ ID NO: 372333 - DNA, 16 bp, M. musculus
attttcaggtcctttg

SEQ ID NO: 372334 - DNA, 16 bp, M. musculus
attttcagtagaacca

SEQ ID NO: 372335 - DNA, 19 bp, M. musculus
attttcagtagcggccact

SEQ ID NO: 372336 - DNA, 16 bp, M. musculus
attttcagtatccatt

SEQ ID NO: 372337 - DNA, 16 bp, M. musculus
attttcataagaaaaa

SEQ ID NO: 372338 - DNA, 16 bp, M. musculus
attttcataatgtgta

SEQ ID NO: 372339 - DNA, 16 bp, M. musculus
attttcatacaatata

SEQ ID NO: 372340 - DNA, 16 bp, M. musculus
attttcatacattaaa

SEQ ID NO: 372341 - DNA, 16 bp, M. musculus
attttcatatgtattt

SEQ ID NO: 372342 - DNA, 16 bp, M. musculus
attttcatatgtgtat

SEQ ID NO: 372343 - DNA, 16 bp, M. musculus
attttcatcaaaattc

SEQ ID NO: 372344 - DNA, 16 bp, M. musculus
attttcatcaagccca

SEQ ID NO: 372345 - DNA, 16 bp, M. musculus
attttcatcatattct

SEQ ID NO: 372346 - DNA, 16 bp, M. musculus
attttcatgaataaaa

SEQ ID NO: 372347 - DNA, 16 bp, M. musculus
attttcatgatgatga

SEQ ID NO: 372348 - DNA, 16 bp, M. musculus
attttcatgtattaaa

SEQ ID NO: 372349 - DNA, 16 bp, M. musculus
attttcatgtgtattt

SEQ ID NO: 372350 - DNA, 16 bp, M. musculus
attttcattactactt

SEQ ID NO: 372351 - DNA, 16 bp, M. musculus
attttcattcaaacca

SEQ ID NO: 372352 - DNA, 16 bp, M. musculus
attttcattctcctac

SEQ ID NO: 372353 - DNA, 16 bp, M. musculus
attttcattcttaaaa

SEQ ID NO: 372354 - DNA, 16 bp, M. musculus
attttcattggattct

SEQ ID NO: 372355 - DNA, 16 bp, M. musculus
attttcatttaaattg

SEQ ID NO: 372356 - DNA, 16 bp, M. musculus
attttcatttcaaatg

SEQ ID NO: 372357 - DNA, 16 bp, M. musculus
attttcattttcttga

SEQ ID NO: 372358 - DNA, 16 bp, M. musculus
attttccaaatattta

SEQ ID NO: 372359 - DNA, 16 bp, M. musculus
attttccaaatgaaat

SEQ ID NO: 372360 - DNA, 16 bp, M. musculus
attttccaataaaaag

SEQ ID NO: 372361 - DNA, 16 bp, M. musculus
attttccagcaggctt

SEQ ID NO: 372362 - DNA, 16 bp, M. musculus
attttccattgtcttt

SEQ ID NO: 372363 - DNA, 16 bp, M. musculus
attttccctgtccaat

SEQ ID NO: 372364 - DNA, 16 bp, M. musculus
attttcccttctgagt

SEQ ID NO: 372365 - DNA, 16 bp, M. musculus
attttcctcattcccc

SEQ ID NO: 372366 - DNA, 16 bp, M. musculus
attttcctcatttgca

SEQ ID NO: 372367 - DNA, 16 bp, M. musculus
attttcctcctttaca

SEQ ID NO: 372368 - DNA, 16 bp, M. musculus
attttcctctctgaaa

SEQ ID NO: 372369 - DNA, 16 bp, M. musculus
attttcctcttaggaa

SEQ ID NO: 372370 - DNA, 16 bp, M. musculus
attttcctgaaaatat

SEQ ID NO: 372371 - DNA, 16 bp, M. musculus
attttcctgaagagaa

SEQ ID NO: 372372 - DNA, 16 bp, M. musculus
attttccttctgtttc

SEQ ID NO: 372373 - DNA, 16 bp, M. musculus
attttccttgaattct

SEQ ID NO: 372374 - DNA, 16 bp, M. musculus
attttcctttaaaaat

SEQ ID NO: 372375 - DNA, 16 bp, M. musculus
attttccttttaaaaa

SEQ ID NO: 372376 - DNA, 16 bp, M. musculus
attttccttttgaaaa

SEQ ID NO: 372377 - DNA, 16 bp, M. musculus
attttctaaaataaga

SEQ ID NO: 372378 - DNA, 16 bp, M. musculus
attttctaaacagata

SEQ ID NO: 372379 - DNA, 16 bp, M. musculus
attttctaaagaaaat

SEQ ID NO: 372380 - DNA, 16 bp, M. musculus
attttctaaattgagg

SEQ ID NO: 372381 - DNA, 16 bp, M. musculus
attttctaagcaaata

SEQ ID NO: 372382 - DNA, 16 bp, M. musculus
attttctaattctatc

SEQ ID NO: 372383 - DNA, 16 bp, M. musculus
attttctagaagaaaa

SEQ ID NO: 372384 - DNA, 16 bp, M. musculus
attttctagatatttt

SEQ ID NO: 372385 - DNA, 16 bp, M. musculus
attttctagtttcatt

SEQ ID NO: 372386 - DNA, 16 bp, M. musculus
attttctatatccagt

SEQ ID NO: 372387 - DNA, 16 bp, M. musculus
attttctatgctttgt

SEQ ID NO: 372388 - DNA, 16 bp, M. musculus
attttctcaaagaaaa

SEQ ID NO: 372389 - DNA, 16 bp, M. musculus
attttctcaaagaccc

SEQ ID NO: 372390 - DNA, 16 bp, M. musculus
attttctcaaataaaa

SEQ ID NO: 372391 - DNA, 16 bp, M. musculus
attttctcaactgaag

SEQ ID NO: 372392 - DNA, 16 bp, M. musculus
attttctcaatcaagg

SEQ ID NO: 372393 - DNA, 16 bp, M. musculus
attttctcaattaagg

SEQ ID NO: 372394 - DNA, 21 bp, M. musculus
attttctcaattagtgatcaa

SEQ ID NO: 372395 - DNA, 16 bp, M. musculus
attttctcagtgatca

SEQ ID NO: 372396 - DNA, 16 bp, M. musculus
attttctcatctgtaa

SEQ ID NO: 372397 - DNA, 16 bp, M. musculus
attttctcccactgag

SEQ ID NO: 372398 - DNA, 16 bp, M. musculus
attttctctgtttctg

SEQ ID NO: 372399 - DNA, 16 bp, M. musculus
attttctcttcctgtt

SEQ ID NO: 372400 - DNA, 16 bp, M. musculus
attttctcttttagaa

SEQ ID NO: 372401 - DNA, 16 bp, M. musculus
attttctgaaaaagaa

SEQ ID NO: 372402 - DNA, 16 bp, M. musculus
attttctgaaattaaa

SEQ ID NO: 372403 - DNA, 16 bp, M. musculus
attttctgaatatttt

SEQ ID NO: 372404 - DNA, 16 bp, M. musculus
attttctgaattcatt

SEQ ID NO: 372405 - DNA, 16 bp, M. musculus
attttctgagcctttg

SEQ ID NO: 372406 - DNA, 16 bp, M. musculus
attttctgataaaatt

SEQ ID NO: 372407 - DNA, 16 bp, M. musculus
attttctgatttccag

SEQ ID NO: 372408 - DNA, 16 bp, M. musculus
attttctgcaaagcct

SEQ ID NO: 372409 - DNA, 16 bp, M. musculus
attttctgcatttaca

SEQ ID NO: 372410 - DNA, 16 bp, M. musculus
attttctgccatctac

SEQ ID NO: 372411 - DNA, 16 bp, M. musculus
attttctgtactcatt

SEQ ID NO: 372412 - DNA, 16 bp, M. musculus
attttctgtatccatc

SEQ ID NO: 372413 - DNA, 17 bp, M. musculus
attttctgtatccatta

SEQ ID NO: 372414 - DNA, 16 bp, M. musculus
attttctgtattcatt

SEQ ID NO: 372415 - DNA, 16 bp, M. musculus
attttctgtcaacttg

SEQ ID NO: 372416 - DNA, 16 bp, M. musculus
attttctgtgtagccc

SEQ ID NO: 372417 - DNA, 16 bp, M. musculus
attttctgtgtctttg

SEQ ID NO: 372418 - DNA, 16 bp, M. musculus
attttctgttgctgtg

SEQ ID NO: 372419 - DNA, 16 bp, M. musculus
attttctgtttccaag

SEQ ID NO: 372420 - DNA, 16 bp, M. musculus
attttctgtttcctct

SEQ ID NO: 372421 - DNA, 16 bp, M. musculus
attttctgttttataa

SEQ ID NO: 372422 - DNA, 16 bp, M. musculus
attttcttaaagaaat

SEQ ID NO: 372423 - DNA, 16 bp, M. musculus
attttcttaaatccta

SEQ ID NO: 372424 - DNA, 16 bp, M. musculus
attttcttagcatttt

SEQ ID NO: 372425 - DNA, 16 bp, M. musculus
attttcttcattaatg

SEQ ID NO: 372426 - DNA, 16 bp, M. musculus
attttcttccttcaaa

SEQ ID NO: 372427 - DNA, 16 bp, M. musculus
attttcttctctgttc

SEQ ID NO: 372428 - DNA, 16 bp, M. musculus
attttcttctttgaaa

SEQ ID NO: 372429 - DNA, 16 bp, M. musculus
attttcttgattaatg

SEQ ID NO: 372430 - DNA, 16 bp, M. musculus
attttcttgtgtgtgt

SEQ ID NO: 372431 - DNA, 16 bp, M. musculus
attttcttgtgtttca

SEQ ID NO: 372432 - DNA, 16 bp, M. musculus
attttctttaaggaaa

SEQ ID NO: 372433 - DNA, 16 bp, M. musculus
attttctttagccatt

SEQ ID NO: 372434 - DNA, 16 bp, M. musculus
attttctttatccact

SEQ ID NO: 372435 - DNA, 16 bp, M. musculus
attttctttcttcaaa

SEQ ID NO: 372436 - DNA, 16 bp, M. musculus
attttctttgactatt

SEQ ID NO: 372437 - DNA, 16 bp, M. musculus
attttctttgactgat

SEQ ID NO: 372438 - DNA, 16 bp, M. musculus
attttcttttaagtta

SEQ ID NO: 372439 - DNA, 16 bp, M. musculus
attttcttttgaaaca

SEQ ID NO: 372440 - DNA, 16 bp, M. musculus
attttctttttggagg

SEQ ID NO: 372441 - DNA, 16 bp, M. musculus
attttcttttttgaga

SEQ ID NO: 372442 - DNA, 16 bp, M. musculus
attttgaaaagcaaaa

SEQ ID NO: 372443 - DNA, 16 bp, M. musculus
attttgaaaatgtaaa

SEQ ID NO: 372444 - DNA, 16 bp, M. musculus
attttgaaaatttcaa

SEQ ID NO: 372445 - DNA, 16 bp, M. musculus
attttgaaactgtttt

SEQ ID NO: 372446 - DNA, 16 bp, M. musculus
attttgaaagagaaaa

SEQ ID NO: 372447 - DNA, 16 bp, M. musculus
attttgaaagatttat

SEQ ID NO: 372448 - DNA, 16 bp, M. musculus
attttgaaagttaaaa

SEQ ID NO: 372449 - DNA, 16 bp, M. musculus
attttgaaatatgtaa

SEQ ID NO: 372450 - DNA, 16 bp, M. musculus
attttgaacatttttt

SEQ ID NO: 372451 - DNA, 16 bp, M. musculus
attttgaagaagaaaa

SEQ ID NO: 372452 - DNA, 16 bp, M. musculus
attttgaagataaaat

SEQ ID NO: 372453 - DNA, 16 bp, M. musculus
attttgaagtcatttt

SEQ ID NO: 372454 - DNA, 16 bp, M. musculus
attttgaagtgttctt

SEQ ID NO: 372455 - DNA, 16 bp, M. musculus
attttgacattttaaa

SEQ ID NO: 372456 - DNA, 16 bp, M. musculus
attttgacatttttct

SEQ ID NO: 372457 - DNA, 16 bp, M. musculus
attttgactttttcct

SEQ ID NO: 372458 - DNA, 16 bp, M. musculus
attttgagaaagaaat

SEQ ID NO: 372459 - DNA, 16 bp, M. musculus
attttgagacaaagtc

SEQ ID NO: 372460 - DNA, 16 bp, M. musculus
attttgaggttgttcc

SEQ ID NO: 372461 - DNA, 16 bp, M. musculus
attttgatagctggac

SEQ ID NO: 372462 - DNA, 16 bp, M. musculus
attttgatatgccttg

SEQ ID NO: 372463 - DNA, 16 bp, M. musculus
attttgatcacatttt

SEQ ID NO: 372464 - DNA, 16 bp, M. musculus
attttgatggagattt

SEQ ID NO: 372465 - DNA, 16 bp, M. musculus
attttgattcataaca

SEQ ID NO: 372466 - DNA, 16 bp, M. musculus
attttgatttcttaaa

SEQ ID NO: 372467 - DNA, 16 bp, M. musculus
attttgatttgcattc

SEQ ID NO: 372468 - DNA, 16 bp, M. musculus
attttgcaaatatttt

SEQ ID NO: 372469 - DNA, 16 bp, M. musculus
attttgcaaattttat

SEQ ID NO: 372470 - DNA, 16 bp, M. musculus
attttgcagaaaaaaa

SEQ ID NO: 372471 - DNA, 16 bp, M. musculus
attttgcatattcttt

SEQ ID NO: 372472 - DNA, 16 bp, M. musculus
attttgcattaatttt

SEQ ID NO: 372473 - DNA, 16 bp, M. musculus
attttgccaatttcag

SEQ ID NO: 372474 - DNA, 16 bp, M. musculus
attttgccatctttaa

SEQ ID NO: 372475 - DNA, 16 bp, M. musculus
attttgcccacatgta

SEQ ID NO: 372476 - DNA, 16 bp, M. musculus
attttgcccttgagtt

SEQ ID NO: 372477 - DNA, 16 bp, M. musculus
attttgcccttgtctg

SEQ ID NO: 372478 - DNA, 16 bp, M. musculus
attttgcctgtgtgta

SEQ ID NO: 372479 - DNA, 16 bp, M. musculus
attttgctactactat

SEQ ID NO: 372480 - DNA, 16 bp, M. musculus
attttgctattgttgt

SEQ ID NO: 372481 - DNA, 18 bp, M. musculus
attttgctgaaaggaccc

SEQ ID NO: 372482 - DNA, 16 bp, M. musculus
attttgctgaaagtgt

SEQ ID NO: 372483 - DNA, 16 bp, M. musculus
attttgctgagaggac

SEQ ID NO: 372484 - DNA, 16 bp, M. musculus
attttgctgctgtttt

SEQ ID NO: 372485 - DNA, 16 bp, M. musculus
attttgctgtgttctt

SEQ ID NO: 372486 - DNA, 16 bp, M. musculus
attttgctgttgttat

SEQ ID NO: 372487 - DNA, 17 bp, M. musculus
attttgcttaaaggacc

SEQ ID NO: 372488 - DNA, 16 bp, M. musculus
attttgcttttccagt

SEQ ID NO: 372489 - DNA, 16 bp, M. musculus
attttggaaaagaaaa

SEQ ID NO: 372490 - DNA, 16 bp, M. musculus
attttggaaattataa

SEQ ID NO: 372491 - DNA, 16 bp, M. musculus
attttggctaaggtca

SEQ ID NO: 372492 - DNA, 16 bp, M. musculus
attttggctcacagtt

SEQ ID NO: 372493 - DNA, 16 bp, M. musculus
attttggctcctggtt

SEQ ID NO: 372494 - DNA, 16 bp, M. musculus
attttgggacctgagg

SEQ ID NO: 372495 - DNA, 16 bp, M. musculus
attttggtttacagtt

SEQ ID NO: 372496 - DNA, 16 bp, M. musculus
attttggtttccttaa

SEQ ID NO: 372497 - DNA, 16 bp, M. musculus
attttggtttctctat

SEQ ID NO: 372498 - DNA, 16 bp, M. musculus
attttgtaaaaacaaa

SEQ ID NO: 372499 - DNA, 16 bp, M. musculus
attttgtattaggtat

SEQ ID NO: 372500 - DNA, 16 bp, M. musculus
attttgtcaaatatta

SEQ ID NO: 372501 - DNA, 16 bp, M. musculus
attttgtcaaatgcat

SEQ ID NO: 372502 - DNA, 16 bp, M. musculus
attttgtcacagaaat

SEQ ID NO: 372503 - DNA, 16 bp, M. musculus
attttgtctgacttga

SEQ ID NO: 372504 - DNA, 16 bp, M. musculus
attttgtcttcttcct

SEQ ID NO: 372505 - DNA, 16 bp, M. musculus
attttgtgaatggatt

SEQ ID NO: 372506 - DNA, 16 bp, M. musculus
attttgtgactgagtt

SEQ ID NO: 372507 - DNA, 16 bp, M. musculus
attttgtgatttaaaa

SEQ ID NO: 372508 - DNA, 16 bp, M. musculus
attttgtggaaaattt

SEQ ID NO: 372509 - DNA, 16 bp, M. musculus
attttgtggaagatat

SEQ ID NO: 372510 - DNA, 16 bp, M. musculus
attttgtggaatagtt

SEQ ID NO: 372511 - DNA, 16 bp, M. musculus
attttgtgtcaagttg

SEQ ID NO: 372512 - DNA, 16 bp, M. musculus
attttgttaaaggctt

SEQ ID NO: 372513 - DNA, 16 bp, M. musculus
attttgttactgttat

SEQ ID NO: 372514 - DNA, 17 bp, M. musculus
attttgttccaccttct

SEQ ID NO: 372515 - DNA, 16 bp, M. musculus
attttgttccctttct

SEQ ID NO: 372516 - DNA, 16 bp, M. musculus
attttgttctggattt

SEQ ID NO: 372517 - DNA, 16 bp, M. musculus
attttgttcttccttc

SEQ ID NO: 372518 - DNA, 16 bp, M. musculus
attttgttctttaaaa

SEQ ID NO: 372519 - DNA, 16 bp, M. musculus
attttgttgctgttat

SEQ ID NO: 372520 - DNA, 16 bp, M. musculus
attttgtttacaaatg

SEQ ID NO: 372521 - DNA, 16 bp, M. musculus
atttttaaaaaagtgt

SEQ ID NO: 372522 - DNA, 16 bp, M. musculus
atttttaaaaactctt

SEQ ID NO: 372523 - DNA, 16 bp, M. musculus
atttttaaaaaggaat

SEQ ID NO: 372524 - DNA, 16 bp, M. musculus
atttttaaaaagtgtt

SEQ ID NO: 372525 - DNA, 16 bp, M. musculus
atttttaaaaatcaag

SEQ ID NO: 372526 - DNA, 16 bp, M. musculus
atttttaaaaatgctt

SEQ ID NO: 372527 - DNA, 16 bp, M. musculus
atttttaaaacatcat

SEQ ID NO: 372528 - DNA, 16 bp, M. musculus
atttttaaaacttcaa

SEQ ID NO: 372529 - DNA, 16 bp, M. musculus
atttttaaaagaaagt

SEQ ID NO: 372530 - DNA, 16 bp, M. musculus
atttttaaaagaatga

SEQ ID NO: 372531 - DNA, 16 bp, M. musculus
atttttaaaagaggaa

SEQ ID NO: 372532 - DNA, 16 bp, M. musculus
atttttaaaagagtta

SEQ ID NO: 372533 - DNA, 16 bp, M. musculus
atttttaaaagatgtt

SEQ ID NO: 372534 - DNA, 16 bp, M. musculus
atttttaaaagcattt

SEQ ID NO: 372535 - DNA, 16 bp, M. musculus
atttttaaaagggaaa

SEQ ID NO: 372536 - DNA, 16 bp, M. musculus
atttttaaaagggtta

SEQ ID NO: 372537 - DNA, 16 bp, M. musculus
atttttaaaagttaca

SEQ ID NO: 372538 - DNA, 16 bp, M. musculus
atttttaaaatacatg

SEQ ID NO: 372539 - DNA, 16 bp, M. musculus
atttttaaaatgtgaa

SEQ ID NO: 372540 - DNA, 16 bp, M. musculus
atttttaaagaaaagt

SEQ ID NO: 372541 - DNA, 16 bp, M. musculus
atttttaaagagaaat

SEQ ID NO: 372542 - DNA, 16 bp, M. musculus
atttttaaagcaattt

SEQ ID NO: 372543 - DNA, 16 bp, M. musculus
atttttaaagctttta

SEQ ID NO: 372544 - DNA, 16 bp, M. musculus
atttttaaaggcaaaa

SEQ ID NO: 372545 - DNA, 16 bp, M. musculus
atttttaaaggttaaa

SEQ ID NO: 372546 - DNA, 16 bp, M. musculus
atttttaaagtaaaca

SEQ ID NO: 372547 - DNA, 16 bp, M. musculus
atttttaaatcagagt

SEQ ID NO: 372548 - DNA, 16 bp, M. musculus
atttttaaatgaatgg

SEQ ID NO: 372549 - DNA, 16 bp, M. musculus
atttttaaatggagtt

SEQ ID NO: 372550 - DNA, 16 bp, M. musculus
atttttaaattcacat

SEQ ID NO: 372551 - DNA, 16 bp, M. musculus
atttttaaattgtctt

SEQ ID NO: 372552 - DNA, 16 bp, M. musculus
atttttaagaaaatgt

SEQ ID NO: 372553 - DNA, 16 bp, M. musculus
atttttaagaggaaaa

SEQ ID NO: 372554 - DNA, 16 bp, M. musculus
atttttaagagggaaa

SEQ ID NO: 372555 - DNA, 16 bp, M. musculus
atttttaagtaaaaca

SEQ ID NO: 372556 - DNA, 16 bp, M. musculus
atttttaagttttcat

SEQ ID NO: 372557 - DNA, 16 bp, M. musculus
atttttaatcatgtgt

SEQ ID NO: 372558 - DNA, 16 bp, M. musculus
atttttaatgacttct

SEQ ID NO: 372559 - DNA, 16 bp, M. musculus
atttttacagtccagt

SEQ ID NO: 372560 - DNA, 16 bp, M. musculus
atttttaccaactcca

SEQ ID NO: 372561 - DNA, 16 bp, M. musculus
atttttactaatccta

SEQ ID NO: 372562 - DNA, 16 bp, M. musculus
atttttagaaaaacag

SEQ ID NO: 372563 - DNA, 16 bp, M. musculus
atttttagaaaacaaa

SEQ ID NO: 372564 - DNA, 16 bp, M. musculus
atttttagaaaaggtg

SEQ ID NO: 372565 - DNA, 16 bp, M. musculus
atttttagaatagcaa

SEQ ID NO: 372566 - DNA, 16 bp, M. musculus
atttttagatctagat

SEQ ID NO: 372567 - DNA, 16 bp, M. musculus
atttttagctttttga

SEQ ID NO: 372568 - DNA, 16 bp, M. musculus
atttttaggtattttc

SEQ ID NO: 372569 - DNA, 16 bp, M. musculus
atttttagttttcaaa

SEQ ID NO: 372570 - DNA, 16 bp, M. musculus
atttttataacagaaa

SEQ ID NO: 372571 - DNA, 16 bp, M. musculus
atttttatacacacac

SEQ ID NO: 372572 - DNA, 16 bp, M. musculus
atttttatagctttat

SEQ ID NO: 372573 - DNA, 16 bp, M. musculus
atttttatatgtacat

SEQ ID NO: 372574 - DNA, 16 bp, M. musculus
atttttatcaaaaatg

SEQ ID NO: 372575 - DNA, 16 bp, M. musculus
atttttatcttatgta

SEQ ID NO: 372576 - DNA, 16 bp, M. musculus
atttttatgaaaatga

SEQ ID NO: 372577 - DNA, 16 bp, M. musculus
atttttatggttgtag

SEQ ID NO: 372578 - DNA, 16 bp, M. musculus
atttttatgtatctgt

SEQ ID NO: 372579 - DNA, 16 bp, M. musculus
atttttatgtcaattt

SEQ ID NO: 372580 - DNA, 16 bp, M. musculus
atttttatgtgcattt

SEQ ID NO: 372581 - DNA, 16 bp, M. musculus
atttttatgtgtacat

SEQ ID NO: 372582 - DNA, 16 bp, M. musculus
atttttatgttgcatt

SEQ ID NO: 372583 - DNA, 16 bp, M. musculus
atttttattaaagcaa

SEQ ID NO: 372584 - DNA, 16 bp, M. musculus
atttttattattccca

SEQ ID NO: 372585 - DNA, 16 bp, M. musculus
atttttattcaaacta

SEQ ID NO: 372586 - DNA, 16 bp, M. musculus
atttttattcaaatca

SEQ ID NO: 372587 - DNA, 16 bp, M. musculus
atttttattcagattt

SEQ ID NO: 372588 - DNA, 16 bp, M. musculus
atttttatttgcaatt

SEQ ID NO: 372589 - DNA, 16 bp, M. musculus
atttttatttgtcaat

SEQ ID NO: 372590 - DNA, 16 bp, M. musculus
atttttattttacatg

SEQ ID NO: 372591 - DNA, 16 bp, M. musculus
atttttattttctgag

SEQ ID NO: 372592 - DNA, 16 bp, M. musculus
atttttcaaaatgttt

SEQ ID NO: 372593 - DNA, 16 bp, M. musculus
atttttcaaatgaaaa

SEQ ID NO: 372594 - DNA, 16 bp, M. musculus
atttttcaagcaaatg

SEQ ID NO: 372595 - DNA, 16 bp, M. musculus
atttttcagaaaaaaa

SEQ ID NO: 372596 - DNA, 16 bp, M. musculus
atttttcagttttgtg

SEQ ID NO: 372597 - DNA, 16 bp, M. musculus
atttttcattttcaga

SEQ ID NO: 372598 - DNA, 16 bp, M. musculus
atttttccacaaatcc

SEQ ID NO: 372599 - DNA, 16 bp, M. musculus
atttttcccctatgcc

SEQ ID NO: 372600 - DNA, 16 bp, M. musculus
atttttcccctgggcc

SEQ ID NO: 372601 - DNA, 16 bp, M. musculus
atttttctaagaattt

SEQ ID NO: 372602 - DNA, 16 bp, M. musculus
atttttctaagtattt

SEQ ID NO: 372603 - DNA, 16 bp, M. musculus
atttttctacatgtta

SEQ ID NO: 372604 - DNA, 16 bp, M. musculus
atttttctcaaagaaa

SEQ ID NO: 372605 - DNA, 16 bp, M. musculus
atttttctcaataaaa

SEQ ID NO: 372606 - DNA, 16 bp, M. musculus
atttttctctccttgt

SEQ ID NO: 372607 - DNA, 16 bp, M. musculus
atttttctctttctga

SEQ ID NO: 372608 - DNA, 16 bp, M. musculus
atttttctgaaaggac

SEQ ID NO: 372609 - DNA, 16 bp, M. musculus
atttttcttaaagaac

SEQ ID NO: 372610 - DNA, 16 bp, M. musculus
atttttcttaaagatt

SEQ ID NO: 372611 - DNA, 16 bp, M. musculus
atttttcttataagtt

SEQ ID NO: 372612 - DNA, 16 bp, M. musculus
atttttcttctaaaaa

SEQ ID NO: 372613 - DNA, 16 bp, M. musculus
atttttctttaaatgt

SEQ ID NO: 372614 - DNA, 16 bp, M. musculus
atttttctttactgaa

SEQ ID NO: 372615 - DNA, 16 bp, M. musculus
atttttctttatagct

SEQ ID NO: 372616 - DNA, 16 bp, M. musculus
atttttctttcttaga

SEQ ID NO: 372617 - DNA, 16 bp, M. musculus
atttttgaaaaaacaa

SEQ ID NO: 372618 - DNA, 16 bp, M. musculus
atttttgaaaaacaaa

SEQ ID NO: 372619 - DNA, 16 bp, M. musculus
atttttgaaaatcatt

SEQ ID NO: 372620 - DNA, 16 bp, M. musculus
atttttgaaacagggt

SEQ ID NO: 372621 - DNA, 16 bp, M. musculus
atttttgaaagaaaag

SEQ ID NO: 372622 - DNA, 16 bp, M. musculus
atttttgaagaaaaat

SEQ ID NO: 372623 - DNA, 16 bp, M. musculus
atttttgaagttaaaa

SEQ ID NO: 372624 - DNA, 16 bp, M. musculus
atttttgactgctgaa

SEQ ID NO: 372625 - DNA, 16 bp, M. musculus
atttttgagaaaagaa

SEQ ID NO: 372626 - DNA, 16 bp, M. musculus
atttttgataaagaag

SEQ ID NO: 372627 - DNA, 16 bp, M. musculus
atttttgatttttaac

SEQ ID NO: 372628 - DNA, 16 bp, M. musculus
atttttgcattgttat

SEQ ID NO: 372629 - DNA, 16 bp, M. musculus
atttttgcattttgta

SEQ ID NO: 372630 - DNA, 16 bp, M. musculus
atttttggagatagag

SEQ ID NO: 372631 - DNA, 16 bp, M. musculus
atttttggaggcactc

SEQ ID NO: 372632 - DNA, 16 bp, M. musculus
atttttgtaggaaaaa

SEQ ID NO: 372633 - DNA, 16 bp, M. musculus
atttttgtccctgaag

SEQ ID NO: 372634 - DNA, 16 bp, M. musculus
atttttgtctcctatg

SEQ ID NO: 372635 - DNA, 16 bp, M. musculus
atttttgtcttgtctc

SEQ ID NO: 372636 - DNA, 16 bp, M. musculus
atttttgtggctactt

SEQ ID NO: 372637 - DNA, 16 bp, M. musculus
atttttgtgtgtgcat

SEQ ID NO: 372638 - DNA, 16 bp, M. musculus
atttttgttacattta

SEQ ID NO: 372639 - DNA, 16 bp, M. musculus
attttttaaaaaagga

SEQ ID NO: 372640 - DNA, 16 bp, M. musculus
attttttaaaaagtga

SEQ ID NO: 372641 - DNA, 16 bp, M. musculus
attttttaaaaagttg

SEQ ID NO: 372642 - DNA, 16 bp, M. musculus
attttttaaaagaagt

SEQ ID NO: 372643 - DNA, 16 bp, M. musculus
attttttaaaagagaa

SEQ ID NO: 372644 - DNA, 16 bp, M. musculus
attttttaaaattagg

SEQ ID NO: 372645 - DNA, 16 bp, M. musculus
attttttaaagaagga

SEQ ID NO: 372646 - DNA, 16 bp, M. musculus
attttttaaagagaaa

SEQ ID NO: 372647 - DNA, 16 bp, M. musculus
attttttaaagttaca

SEQ ID NO: 372648 - DNA, 16 bp, M. musculus
attttttaaagtttca

SEQ ID NO: 372649 - DNA, 16 bp, M. musculus
attttttcaaaagaaa

SEQ ID NO: 372650 - DNA, 16 bp, M. musculus
attttttccccctgtg

SEQ ID NO: 372651 - DNA, 16 bp, M. musculus
attttttctgctggcc

SEQ ID NO: 372652 - DNA, 16 bp, M. musculus
attttttcttttggca

SEQ ID NO: 372653 - DNA, 16 bp, M. musculus
attttttgagacaggg

SEQ ID NO: 372654 - DNA, 16 bp, M. musculus
attttttggtcctggc

SEQ ID NO: 372655 - DNA, 16 bp, M. musculus
atttttttaaaaagga

SEQ ID NO: 372656 - DNA, 16 bp, M. musculus
atttttttaaactatg

SEQ ID NO: 372657 - DNA, 16 bp, M. musculus
atttttttaaagaaca

SEQ ID NO: 372658 - DNA, 16 bp, M. musculus
atttttttaaaggaaa

SEQ ID NO: 372659 - DNA, 16 bp, M. musculus
atttttttaaatgtac

SEQ ID NO: 372660 - DNA, 16 bp, M. musculus
atttttttaaatgtct

SEQ ID NO: 372661 - DNA, 16 bp, M. musculus
atttttttacagtcca

SEQ ID NO: 372662 - DNA, 16 bp, M. musculus
atttttttcaaaagta

SEQ ID NO: 372663 - DNA, 16 bp, M. musculus
atttttttcaaagaaa

SEQ ID NO: 372664 - DNA, 16 bp, M. musculus
atttttttccaaagaa

SEQ ID NO: 372665 - DNA, 16 bp, M. musculus
atttttttccagtaaa

SEQ ID NO: 372666 - DNA, 16 bp, M. musculus
atttttttccagtttc

SEQ ID NO: 372667 - DNA, 16 bp, M. musculus
atttttttccctctgt

SEQ ID NO: 372668 - DNA, 16 bp, M. musculus
atttttttctcacata

SEQ ID NO: 372669 - DNA, 16 bp, M. musculus
atttttttctcagatt

SEQ ID NO: 372670 - DNA, 16 bp, M. musculus
atttttttctctcaaa

SEQ ID NO: 372671 - DNA, 16 bp, M. musculus
atttttttctctgtaa

SEQ ID NO: 372672 - DNA, 16 bp, M. musculus
atttttttctgtataa

SEQ ID NO: 372673 - DNA, 16 bp, M. musculus
atttttttgagacagg

SEQ ID NO: 372674 - DNA, 16 bp, M. musculus
atttttttgtcaactt

SEQ ID NO: 372675 - DNA, 16 bp, M. musculus
attttttttaaaggaa

SEQ ID NO: 372676 - DNA, 16 bp, M. musculus
attttttttcagatat

SEQ ID NO: 372677 - DNA, 16 bp, M. musculus
attttttttcccctga

SEQ ID NO: 372678 - DNA, 16 bp, M. musculus
attttttttccctgtg

SEQ ID NO: 372679 - DNA, 16 bp, M. musculus
attttttttcctggaa

SEQ ID NO: 372680 - DNA, 16 bp, M. musculus
attttttttctggtcc

SEQ ID NO: 372681 - DNA, 16 bp, M. musculus
atttttttttaagcaa

SEQ ID NO: 372682 - DNA, 16 bp, M. musculus
atttttttttaatcag

SEQ ID NO: 372683 - DNA, 16 bp, M. musculus
atttttttttcatgaa

SEQ ID NO: 372684 - DNA, 16 bp, M. musculus
atttttttttccccag

SEQ ID NO: 372685 - DNA, 16 bp, M. musculus
atttttttttcctaga

SEQ ID NO: 372686 - DNA, 16 bp, M. musculus
atttttttttcctgaa

SEQ ID NO: 372687 - DNA, 16 bp, M. musculus
atttttttttctagaa

SEQ ID NO: 372688 - DNA, 17 bp, M. musculus
attttttttttaaagca

SEQ ID NO: 372689 - DNA, 16 bp, M. musculus
attttttttttgagac

SEQ ID NO: 372690 - DNA, 16 bp, M. musculus
caaaaaaaaatgttga

SEQ ID NO: 372691 - DNA, 16 bp, M. musculus
caaaaaaagacactgt

SEQ ID NO: 372692 - DNA, 16 bp, M. musculus
caaaaaacaatgatgc

SEQ ID NO: 372693 - DNA, 16 bp, M. musculus
caaaaaaccaaatgca

SEQ ID NO: 372694 - DNA, 16 bp, M. musculus
caaaaaagacaatgag

SEQ ID NO: 372695 - DNA, 16 bp, M. musculus
caaaaaagataaggag

SEQ ID NO: 372696 - DNA, 16 bp, M. musculus
caaaaaagatgaggag

SEQ ID NO: 372697 - DNA, 16 bp, M. musculus
caaaaaaggagatcaa

SEQ ID NO: 372698 - DNA, 16 bp, M. musculus
caaaaaatgtacagaa

SEQ ID NO: 372699 - DNA, 16 bp, M. musculus
caaaaacaatgaattt

SEQ ID NO: 372700 - DNA, 16 bp, M. musculus
caaaaacaattcttaa

SEQ ID NO: 372701 - DNA, 16 bp, M. musculus
caaaaacagagcagag

SEQ ID NO: 372702 - DNA, 16 bp, M. musculus
caaaaacatgacaagg

SEQ ID NO: 372703 - DNA, 16 bp, M. musculus
caaaaaccaaatgaag

SEQ ID NO: 372704 - DNA, 16 bp, M. musculus
caaaaaccaaggagca

SEQ ID NO: 372705 - DNA, 16 bp, M. musculus
caaaaaccacatcctg

SEQ ID NO: 372706 - DNA, 16 bp, M. musculus
caaaaacgaaagcccc

SEQ ID NO: 372707 - DNA, 16 bp, M. musculus
caaaaactcttctgaa

SEQ ID NO: 372708 - DNA, 16 bp, M. musculus
caaaaactgaaggaaa

SEQ ID NO: 372709 - DNA, 16 bp, M. musculus
caaaaactggagcaga

SEQ ID NO: 372710 - DNA, 16 bp, M. musculus
caaaaacttgaagttc

SEQ ID NO: 372711 - DNA, 16 bp, M. musculus
caaaaagaaaatgtag

SEQ ID NO: 372712 - DNA, 16 bp, M. musculus
caaaaagaaactggag

SEQ ID NO: 372713 - DNA, 16 bp, M. musculus
caaaaagaagcttctt

SEQ ID NO: 372714 - DNA, 16 bp, M. musculus
caaaaagcaagctggg

SEQ ID NO: 372715 - DNA, 16 bp, M. musculus
caaaaagcaaggtgga

SEQ ID NO: 372716 - DNA, 16 bp, M. musculus
caaaaagctcaacaag

SEQ ID NO: 372717 - DNA, 16 bp, M. musculus
caaaaagggggagtag

SEQ ID NO: 372718 - DNA, 16 bp, M. musculus
caaaaagtgcttgctg

SEQ ID NO: 372719 - DNA, 16 bp, M. musculus
caaaaataaggtgaag

SEQ ID NO: 372720 - DNA, 16 bp, M. musculus
caaaaatagacaaatg

SEQ ID NO: 372721 - DNA, 16 bp, M. musculus
caaaaatatcatccac

SEQ ID NO: 372722 - DNA, 16 bp, M. musculus
caaaaatatctcaatg

SEQ ID NO: 372723 - DNA, 16 bp, M. musculus
caaaaatcaagtgaca

SEQ ID NO: 372724 - DNA, 16 bp, M. musculus
caaaaatcaagtgtct

SEQ ID NO: 372725 - DNA, 16 bp, M. musculus
caaaaatcagcagctg

SEQ ID NO: 372726 - DNA, 93 bp, M. musculus
caaaaatccatttcatattcaccagcagatgtaacacactcaccatctgtactaggtactcaggggcatcctctatctagtaaagactctcaa

SEQ ID NO: 372727 - DNA, 16 bp, M. musculus
caaaaatccctcaagg

SEQ ID NO: 372728 - DNA, 16 bp, M. musculus
caaaaatctagaccca

SEQ ID NO: 372729 - DNA, 16 bp, M. musculus
caaaaatgaaatggct

SEQ ID NO: 372730 - DNA, 16 bp, M. musculus
caaaaatgaccttgaa

SEQ ID NO: 372731 - DNA, 16 bp, M. musculus
caaaaattaataaatg

SEQ ID NO: 372732 - DNA, 16 bp, M. musculus
caaaaattattcttaa

SEQ ID NO: 372733 - DNA, 16 bp, M. musculus
caaaaattttaccaga

SEQ ID NO: 372734 - DNA, 16 bp, M. musculus
caaaaattttgaagat

SEQ ID NO: 372735 - DNA, 16 bp, M. musculus
caaaacaaaaacagtt

SEQ ID NO: 372736 - DNA, 16 bp, M. musculus
caaaacaaaaaccatg

SEQ ID NO: 372737 - DNA, 16 bp, M. musculus
caaaacaaaaatccag

SEQ ID NO: 372738 - DNA, 16 bp, M. musculus
caaaacaaaacacctg

SEQ ID NO: 372739 - DNA, 16 bp, M. musculus
caaaacaaaacagctg

SEQ ID NO: 372740 - DNA, 16 bp, M. musculus
caaaacaaaacattag

SEQ ID NO: 372741 - DNA, 16 bp, M. musculus
caaaacaaaacttaag

SEQ ID NO: 372742 - DNA, 16 bp, M. musculus
caaaacaaacaagtta

SEQ ID NO: 372743 - DNA, 16 bp, M. musculus
caaaacaacatggtca

SEQ ID NO: 372744 - DNA, 16 bp, M. musculus
caaaacaaccttgata

SEQ ID NO: 372745 - DNA, 16 bp, M. musculus
caaaacaatcattcac

SEQ ID NO: 372746 - DNA, 16 bp, M. musculus
caaaacaatgctgaga

SEQ ID NO: 372747 - DNA, 16 bp, M. musculus
caaaacacaagaaact

SEQ ID NO: 372748 - DNA, 16 bp, M. musculus
caaaacacatgaacct

SEQ ID NO: 372749 - DNA, 16 bp, M. musculus
caaaacactgctgtct

SEQ ID NO: 372750 - DNA, 16 bp, M. musculus
caaaacagaaatggaa

SEQ ID NO: 372751 - DNA, 16 bp, M. musculus
caaaacagaggaatac

SEQ ID NO: 372752 - DNA, 16 bp, M. musculus
caaaacagcttctggg

SEQ ID NO: 372753 - DNA, 16 bp, M. musculus
caaaacagggctggag

SEQ ID NO: 372754 - DNA, 16 bp, M. musculus
caaaacagtgtcttct

SEQ ID NO: 372755 - DNA, 16 bp, M. musculus
caaaacataacacctg

SEQ ID NO: 372756 - DNA, 16 bp, M. musculus
caaaacatcatcatat

SEQ ID NO: 372757 - DNA, 16 bp, M. musculus
caaaacatccagaaga

SEQ ID NO: 372758 - DNA, 16 bp, M. musculus
caaaacatccatacat

SEQ ID NO: 372759 - DNA, 16 bp, M. musculus
caaaacatctcaaatc

SEQ ID NO: 372760 - DNA, 16 bp, M. musculus
caaaacatgaagagct

SEQ ID NO: 372761 - DNA, 16 bp, M. musculus
caaaacatgcaaaata

SEQ ID NO: 372762 - DNA, 16 bp, M. musculus
caaaaccaaattcacc

SEQ ID NO: 372763 - DNA, 16 bp, M. musculus
caaaaccagccactac

SEQ ID NO: 372764 - DNA, 16 bp, M. musculus
caaaaccatcaaggat

SEQ ID NO: 372765 - DNA, 16 bp, M. musculus
caaaacccaagaaaat

SEQ ID NO: 372766 - DNA, 16 bp, M. musculus
caaaacccagacacta

SEQ ID NO: 372767 - DNA, 16 bp, M. musculus
caaaaccctggatctg

SEQ ID NO: 372768 - DNA, 16 bp, M. musculus
caaaacctggaaagaa

SEQ ID NO: 372769 - DNA, 16 bp, M. musculus
caaaactggaaacctg

SEQ ID NO: 372770 - DNA, 16 bp, M. musculus
caaaactggaaattct

SEQ ID NO: 372771 - DNA, 16 bp, M. musculus
caaaacttctgaccca

SEQ ID NO: 372772 - DNA, 16 bp, M. musculus
caaaactttgtctctg

SEQ ID NO: 372773 - DNA, 16 bp, M. musculus
caaaactttttttttc

SEQ ID NO: 372774 - DNA, 16 bp, M. musculus
caaaagaaaaaatttc

SEQ ID NO: 372775 - DNA, 16 bp, M. musculus
caaaagaaaaattatt

SEQ ID NO: 372776 - DNA, 16 bp, M. musculus
caaaagaaaattttct

SEQ ID NO: 372777 - DNA, 16 bp, M. musculus
caaaagaaagaatttc

SEQ ID NO: 372778 - DNA, 16 bp, M. musculus
caaaagaaagcatctt

SEQ ID NO: 372779 - DNA, 16 bp, M. musculus
caaaagaaatctatag

SEQ ID NO: 372780 - DNA, 16 bp, M. musculus
caaaagaagataacca

SEQ ID NO: 372781 - DNA, 16 bp, M. musculus
caaaagaagtttcttt

SEQ ID NO: 372782 - DNA, 16 bp, M. musculus
caaaagaatatacttt

SEQ ID NO: 372783 - DNA, 16 bp, M. musculus
caaaagaattagaagg

SEQ ID NO: 372784 - DNA, 16 bp, M. musculus
caaaagacaaatgtaa

SEQ ID NO: 372785 - DNA, 16 bp, M. musculus
caaaagacaccataaa

SEQ ID NO: 372786 - DNA, 16 bp, M. musculus
caaaagacagagccag

SEQ ID NO: 372787 - DNA, 16 bp, M. musculus
caaaagacatctcacc

SEQ ID NO: 372788 - DNA, 16 bp, M. musculus
caaaagacctaacaag

SEQ ID NO: 372789 - DNA, 16 bp, M. musculus
caaaagacttactagg

SEQ ID NO: 372790 - DNA, 16 bp, M. musculus
caaaagagagcatcag

SEQ ID NO: 372791 - DNA, 16 bp, M. musculus
caaaagagatgggaaa

SEQ ID NO: 372792 - DNA, 16 bp, M. musculus
caaaagaggaggcaga

SEQ ID NO: 372793 - DNA, 16 bp, M. musculus
caaaagatatccagct

SEQ ID NO: 372794 - DNA, 17 bp, M. musculus
caaaagatcaagtggaa

SEQ ID NO: 372795 - DNA, 16 bp, M. musculus
caaaagatgccctact

SEQ ID NO: 372796 - DNA, 16 bp, M. musculus
caaaagatggccaagt

SEQ ID NO: 372797 - DNA, 16 bp, M. musculus
caaaagattttttaaa

SEQ ID NO: 372798 - DNA, 16 bp, M. musculus
caaaagcaactgaagg

SEQ ID NO: 372799 - DNA, 16 bp, M. musculus
caaaagcaactgggga

SEQ ID NO: 372800 - DNA, 16 bp, M. musculus
caaaagcaacttaagg

SEQ ID NO: 372801 - DNA, 16 bp, M. musculus
caaaagcaatcttcag

SEQ ID NO: 372802 - DNA, 16 bp, M. musculus
caaaagcaatttaagg

SEQ ID NO: 372803 - DNA, 16 bp, M. musculus
caaaagcagccagtac

SEQ ID NO: 372804 - DNA, 16 bp, M. musculus
caaaagcaggtggatc

SEQ ID NO: 372805 - DNA, 16 bp, M. musculus
caaaagccacatgatc

SEQ ID NO: 372806 - DNA, 16 bp, M. musculus
caaaagcctatgccag

SEQ ID NO: 372807 - DNA, 17 bp, M. musculus
caaaagcgaaactaagc

SEQ ID NO: 372808 - DNA, 16 bp, M. musculus
caaaagctgaaaacaa

SEQ ID NO: 372809 - DNA, 16 bp, M. musculus
caaaagctgggatatg

SEQ ID NO: 372810 - DNA, 16 bp, M. musculus
caaaagctgtcctctg

SEQ ID NO: 372811 - DNA, 16 bp, M. musculus
caaaagctgtcttctg

SEQ ID NO: 372812 - DNA, 17 bp, M. musculus
caaaagctgttgggaga

SEQ ID NO: 372813 - DNA, 16 bp, M. musculus
caaaaggaactctcaa

SEQ ID NO: 372814 - DNA, 16 bp, M. musculus
caaaaggaagcaaatt

SEQ ID NO: 372815 - DNA, 16 bp, M. musculus
caaaaggaagtaaaat

SEQ ID NO: 372816 - DNA, 16 bp, M. musculus
caaaaggacatcaagg

SEQ ID NO: 372817 - DNA, 16 bp, M. musculus
caaaaggacatgcata

SEQ ID NO: 372818 - DNA, 16 bp, M. musculus
caaaaggacatgcatg

SEQ ID NO: 372819 - DNA, 16 bp, M. musculus
caaaaggactttccaa

SEQ ID NO: 372820 - DNA, 16 bp, M. musculus
caaaaggatatatctt

SEQ ID NO: 372821 - DNA, 16 bp, M. musculus
caaaaggcagatgtaa

SEQ ID NO: 372822 - DNA, 16 bp, M. musculus
caaaaggctgagaagc

SEQ ID NO: 372823 - DNA, 16 bp, M. musculus
caaaagtacagaatac

SEQ ID NO: 372824 - DNA, 16 bp, M. musculus
caaaagtccccccccc

SEQ ID NO: 372825 - DNA, 16 bp, M. musculus
caaaagtcccctccag

SEQ ID NO: 372826 - DNA, 16 bp, M. musculus
caaaagttatcaaaaa

SEQ ID NO: 372827 - DNA, 16 bp, M. musculus
caaaataaaccatttt

SEQ ID NO: 372828 - DNA, 16 bp, M. musculus
caaaataaagattttt

SEQ ID NO: 372829 - DNA, 16 bp, M. musculus
caaaataaaggaggag

SEQ ID NO: 372830 - DNA, 16 bp, M. musculus
caaaataaaggcaata

SEQ ID NO: 372831 - DNA, 16 bp, M. musculus
caaaataaatccttct

SEQ ID NO: 372832 - DNA, 16 bp, M. musculus
caaaataacttgccta

SEQ ID NO: 372833 - DNA, 16 bp, M. musculus
caaaataagaaattat

SEQ ID NO: 372834 - DNA, 16 bp, M. musculus
caaaataatcaagaga

SEQ ID NO: 372835 - DNA, 16 bp, M. musculus
caaaataatgcaggtt

SEQ ID NO: 372836 - DNA, 16 bp, M. musculus
caaaataattttgatt

SEQ ID NO: 372837 - DNA, 16 bp, M. musculus
caaaataatttttctt

SEQ ID NO: 372838 - DNA, 16 bp, M. musculus
caaaatactcacagaa

SEQ ID NO: 372839 - DNA, 16 bp, M. musculus
caaaatacttaatttt

SEQ ID NO: 372840 - DNA, 16 bp, M. musculus
caaaatacttatggga

SEQ ID NO: 372841 - DNA, 16 bp, M. musculus
caaaatagaaacagga

SEQ ID NO: 372842 - DNA, 16 bp, M. musculus
caaaatagaaggggat

SEQ ID NO: 372843 - DNA, 16 bp, M. musculus
caaaatatatactgat

SEQ ID NO: 372844 - DNA, 16 bp, M. musculus
caaaatatattttgta

SEQ ID NO: 372845 - DNA, 16 bp, M. musculus
caaaatattccacaaa

SEQ ID NO: 372846 - DNA, 16 bp, M. musculus
caaaatcaaagccaaa

SEQ ID NO: 372847 - DNA, 16 bp, M. musculus
caaaatcacacacatt

SEQ ID NO: 372848 - DNA, 17 bp, M. musculus
caaaatcagaactgaaa

SEQ ID NO: 372849 - DNA, 16 bp, M. musculus
caaaatcccttaaaga

SEQ ID NO: 372850 - DNA, 16 bp, M. musculus
caaaatcctgggtcct

SEQ ID NO: 372851 - DNA, 16 bp, M. musculus
caaaatctggaaagaa

SEQ ID NO: 372852 - DNA, 16 bp, M. musculus
caaaatgaaaagacca

SEQ ID NO: 372853 - DNA, 16 bp, M. musculus
caaaatgaaaaggaag

SEQ ID NO: 372854 - DNA, 16 bp, M. musculus
caaaatgaaagagaga

SEQ ID NO: 372855 - DNA, 16 bp, M. musculus
caaaatgaaaggaaat

SEQ ID NO: 372856 - DNA, 16 bp, M. musculus
caaaatgaaattaaat

SEQ ID NO: 372857 - DNA, 16 bp, M. musculus
caaaatgactctttac

SEQ ID NO: 372858 - DNA, 16 bp, M. musculus
caaaatgagagagaga

SEQ ID NO: 372859 - DNA, 16 bp, M. musculus
caaaatgagtcagaga

SEQ ID NO: 372860 - DNA, 16 bp, M. musculus
caaaatgagttccaag

SEQ ID NO: 372861 - DNA, 21 bp, M. musculus
caaaatgcaaaaagatcctaa

SEQ ID NO: 372862 - DNA, 16 bp, M. musculus
caaaatgcaaaagatc

SEQ ID NO: 372863 - DNA, 16 bp, M. musculus
caaaatgcacaattac

SEQ ID NO: 372864 - DNA, 16 bp, M. musculus
caaaatgcagagctgt

SEQ ID NO: 372865 - DNA, 16 bp, M. musculus
caaaatggaggactcc

SEQ ID NO: 372866 - DNA, 16 bp, M. musculus
caaaatggggcccaac

SEQ ID NO: 372867 - DNA, 16 bp, M. musculus
caaaatggtcctttag

SEQ ID NO: 372868 - DNA, 16 bp, M. musculus
caaaatgtaaataaag

SEQ ID NO: 372869 - DNA, 16 bp, M. musculus
caaaatgtacaaagaa

SEQ ID NO: 372870 - DNA, 16 bp, M. musculus
caaaatgtattatttt

SEQ ID NO: 372871 - DNA, 16 bp, M. musculus
caaaatgtatttaatc

SEQ ID NO: 372872 - DNA, 25 bp, M. musculus
caaaatgtcctcatatgcattcttt

SEQ ID NO: 372873 - DNA, 16 bp, M. musculus
caaaatgtgatatttt

SEQ ID NO: 372874 - DNA, 16 bp, M. musculus
caaaatgttggctcct

SEQ ID NO: 372875 - DNA, 16 bp, M. musculus
caaaattaaacatttt

SEQ ID NO: 372876 - DNA, 16 bp, M. musculus
caaaattaaccctttc

SEQ ID NO: 372877 - DNA, 16 bp, M. musculus
caaaattatttcattg

SEQ ID NO: 372878 - DNA, 16 bp, M. musculus
caaaattcccatggaa

SEQ ID NO: 372879 - DNA, 16 bp, M. musculus
caaaattctaattcaa

SEQ ID NO: 372880 - DNA, 16 bp, M. musculus
caaaattgaaacagaa

SEQ ID NO: 372881 - DNA, 16 bp, M. musculus
caaaattggaaaacat

SEQ ID NO: 372882 - DNA, 16 bp, M. musculus
caaaatttctcaataa

SEQ ID NO: 372883 - DNA, 16 bp, M. musculus
caaaatttgaaattaa

SEQ ID NO: 372884 - DNA, 16 bp, M. musculus
caaaattttaaaactt

SEQ ID NO: 372885 - DNA, 16 bp, M. musculus
caaaattttaatgaaa

SEQ ID NO: 372886 - DNA, 16 bp, M. musculus
caaaattttctctgat

SEQ ID NO: 372887 - DNA, 16 bp, M. musculus
caaacaaaaaaagttt

SEQ ID NO: 372888 - DNA, 16 bp, M. musculus
caaacaaaaaacagtc

SEQ ID NO: 372889 - DNA, 16 bp, M. musculus
caaacaaaaaagtttt

SEQ ID NO: 372890 - DNA, 16 bp, M. musculus
caaacaaaaaccctga

SEQ ID NO: 372891 - DNA, 16 bp, M. musculus
caaacaaacaagaatg

SEQ ID NO: 372892 - DNA, 16 bp, M. musculus
caaacaaacagaaatt

SEQ ID NO: 372893 - DNA, 16 bp, M. musculus
caaacaaatctttaaa

SEQ ID NO: 372894 - DNA, 16 bp, M. musculus
caaacaactctttcac

SEQ ID NO: 372895 - DNA, 16 bp, M. musculus
caaacaagatggaagg

SEQ ID NO: 372896 - DNA, 16 bp, M. musculus
caaacaagccaatggc

SEQ ID NO: 372897 - DNA, 16 bp, M. musculus
caaacaatcaaaaggg

SEQ ID NO: 372898 - DNA, 16 bp, M. musculus
caaacacaaatcaatg

SEQ ID NO: 372899 - DNA, 16 bp, M. musculus
caaacacacacacgtg

SEQ ID NO: 372900 - DNA, 16 bp, M. musculus
caaacacacacatgaa

SEQ ID NO: 372901 - DNA, 16 bp, M. musculus
caaacacagaagagga

SEQ ID NO: 372902 - DNA, 16 bp, M. musculus
caaacacagaaggtct

SEQ ID NO: 372903 - DNA, 16 bp, M. musculus
caaacacagagaccca

SEQ ID NO: 372904 - DNA, 16 bp, M. musculus
caaacacagagataca

SEQ ID NO: 372905 - DNA, 16 bp, M. musculus
caaacacaggagccta

SEQ ID NO: 372906 - DNA, 16 bp, M. musculus
caaacacataaagtaa

SEQ ID NO: 372907 - DNA, 16 bp, M. musculus
caaacacatccaagag

SEQ ID NO: 372908 - DNA, 16 bp, M. musculus
caaacacatgaaaaga

SEQ ID NO: 372909 - DNA, 16 bp, M. musculus
caaacacatgaaagaa

SEQ ID NO: 372910 - DNA, 16 bp, M. musculus
caaacacattcacaca

SEQ ID NO: 372911 - DNA, 16 bp, M. musculus
caaacagatgatggaa

SEQ ID NO: 372912 - DNA, 16 bp, M. musculus
caaacagcaagaggtt

SEQ ID NO: 372913 - DNA, 16 bp, M. musculus
caaacagctcccctgg

SEQ ID NO: 372914 - DNA, 16 bp, M. musculus
caaacaggaatcagca

SEQ ID NO: 372915 - DNA, 16 bp, M. musculus
caaacaggaggacctg

SEQ ID NO: 372916 - DNA, 16 bp, M. musculus
caaacaggtgaaagaa

SEQ ID NO: 372917 - DNA, 16 bp, M. musculus
caaacaggtgacagaa

SEQ ID NO: 372918 - DNA, 16 bp, M. musculus
caaacaggtggtggaa

SEQ ID NO: 372919 - DNA, 16 bp, M. musculus
caaacaggtttctaag

SEQ ID NO: 372920 - DNA, 16 bp, M. musculus
caaacagtgatatttt

SEQ ID NO: 372921 - DNA, 16 bp, M. musculus
caaacagtgccaccaa

SEQ ID NO: 372922 - DNA, 16 bp, M. musculus
caaacagtgctcttaa

SEQ ID NO: 372923 - DNA, 16 bp, M. musculus
caaacagtggatggag

SEQ ID NO: 372924 - DNA, 16 bp, M. musculus
caaacagttgatggaa

SEQ ID NO: 372925 - DNA, 21 bp, M. musculus
caaacagtttcaagggctcct

SEQ ID NO: 372926 - DNA, 16 bp, M. musculus
caaacataaaaatctt

SEQ ID NO: 372927 - DNA, 16 bp, M. musculus
caaacataaggacctg

SEQ ID NO: 372928 - DNA, 16 bp, M. musculus
caaacatacagacaca

SEQ ID NO: 372929 - DNA, 16 bp, M. musculus
caaacatacatataca

SEQ ID NO: 372930 - DNA, 16 bp, M. musculus
caaacatagagaactt

SEQ ID NO: 372931 - DNA, 16 bp, M. musculus
caaacatccaggaaat

SEQ ID NO: 372932 - DNA, 16 bp, M. musculus
caaacatgaaaacctg

SEQ ID NO: 372933 - DNA, 16 bp, M. musculus
caaacatgaagacttg

SEQ ID NO: 372934 - DNA, 16 bp, M. musculus
caaacatgaatcagca

SEQ ID NO: 372935 - DNA, 16 bp, M. musculus
caaacatgaatcagta

SEQ ID NO: 372936 - DNA, 16 bp, M. musculus
caaacatgatgaccaa

SEQ ID NO: 372937 - DNA, 16 bp, M. musculus
caaacatggctctgtg

SEQ ID NO: 372938 - DNA, 16 bp, M. musculus
caaacattaatcaaga

SEQ ID NO: 372939 - DNA, 16 bp, M. musculus
caaacattcagtttcc

SEQ ID NO: 372940 - DNA, 16 bp, M. musculus
caaacattctgcagtt

SEQ ID NO: 372941 - DNA, 16 bp, M. musculus
caaaccaccacactct

SEQ ID NO: 372942 - DNA, 16 bp, M. musculus
caaaccaccacagctg

SEQ ID NO: 372943 - DNA, 16 bp, M. musculus
caaaccaccacatctg

SEQ ID NO: 372944 - DNA, 16 bp, M. musculus
caaaccaccacattcc

SEQ ID NO: 372945 - DNA, 16 bp, M. musculus
caaaccaccatattcc

SEQ ID NO: 372946 - DNA, 16 bp, M. musculus
caaaccaggagccaac

SEQ ID NO: 372947 - DNA, 16 bp, M. musculus
caaaccaggcccagtg

SEQ ID NO: 372948 - DNA, 16 bp, M. musculus
caaaccagtaagcagc

SEQ ID NO: 372949 - DNA, 16 bp, M. musculus
caaaccagtaagcagt

SEQ ID NO: 372950 - DNA, 16 bp, M. musculus
caaacccacactttgc

SEQ ID NO: 372951 - DNA, 16 bp, M. musculus
caaacccactaaaatc

SEQ ID NO: 372952 - DNA, 16 bp, M. musculus
caaacccagagctctg

SEQ ID NO: 372953 - DNA, 16 bp, M. musculus
caaacccagcccttca

SEQ ID NO: 372954 - DNA, 16 bp, M. musculus
caaacccagggcctcc

SEQ ID NO: 372955 - DNA, 16 bp, M. musculus
caaacccagggcttct

SEQ ID NO: 372956 - DNA, 16 bp, M. musculus
caaacccaggtcctct

SEQ ID NO: 372957 - DNA, 16 bp, M. musculus
caaacccagttccttg

SEQ ID NO: 372958 - DNA, 16 bp, M. musculus
caaacccatggtcaca

SEQ ID NO: 372959 - DNA, 16 bp, M. musculus
caaaccccaggatctc

SEQ ID NO: 372960 - DNA, 16 bp, M. musculus
caaaccctgtcttgaa

SEQ ID NO: 372961 - DNA, 16 bp, M. musculus
caaacctaaaagaaca

SEQ ID NO: 372962 - DNA, 16 bp, M. musculus
caaacctcacacaaga

SEQ ID NO: 372963 - DNA, 16 bp, M. musculus
caaacctcctcagctc

SEQ ID NO: 372964 - DNA, 16 bp, M. musculus
caaacctgacaacctg

SEQ ID NO: 372965 - DNA, 16 bp, M. musculus
caaacctgacactatt

SEQ ID NO: 372966 - DNA, 16 bp, M. musculus
caaacctgatgacctg

SEQ ID NO: 372967 - DNA, 16 bp, M. musculus
caaacctgggtcctct

SEQ ID NO: 372968 - DNA, 16 bp, M. musculus
caaacctgtaggtgca

SEQ ID NO: 372969 - DNA, 16 bp, M. musculus
caaacctgtgtgtcag

SEQ ID NO: 372970 - DNA, 16 bp, M. musculus
caaacgaggatttggt

SEQ ID NO: 372971 - DNA, 16 bp, M. musculus
caaacggagacatgga

SEQ ID NO: 372972 - DNA, 16 bp, M. musculus
caaactaaatggacag

SEQ ID NO: 372973 - DNA, 17 bp, M. musculus
caaactactaatcagtt

SEQ ID NO: 372974 - DNA, 16 bp, M. musculus
caaactattccagaaa

SEQ ID NO: 372975 - DNA, 16 bp, M. musculus
caaactcaaagacaga

SEQ ID NO: 372976 - DNA, 16 bp, M. musculus
caaactcaaagagatc

SEQ ID NO: 372977 - DNA, 16 bp, M. musculus
caaactcaaagccaaa

SEQ ID NO: 372978 - DNA, 16 bp, M. musculus
caaactcaaaggaaaa

SEQ ID NO: 372979 - DNA, 16 bp, M. musculus
caaactcacaaagatc

SEQ ID NO: 372980 - DNA, 16 bp, M. musculus
caaactcacagagacc

SEQ ID NO: 372981 - DNA, 16 bp, M. musculus
caaactcacagagatc

SEQ ID NO: 372982 - DNA, 16 bp, M. musculus
caaactcacagagatt

SEQ ID NO: 372983 - DNA, 16 bp, M. musculus
caaactcacccaagag

SEQ ID NO: 372984 - DNA, 16 bp, M. musculus
caaactcagaaaccca

SEQ ID NO: 372985 - DNA, 16 bp, M. musculus
caaactcagaaatcca

SEQ ID NO: 372986 - DNA, 16 bp, M. musculus
caaactcagaaatccc

SEQ ID NO: 372987 - DNA, 16 bp, M. musculus
caaactcagaaatccg

SEQ ID NO: 372988 - DNA, 16 bp, M. musculus
caaactcagaaatcct

SEQ ID NO: 372989 - DNA, 16 bp, M. musculus
caaactcagaaatcta

SEQ ID NO: 372990 - DNA, 16 bp, M. musculus
caaactcagaaatctg

SEQ ID NO: 372991 - DNA, 25 bp, M. musculus
caaactcagaaatctgcctgcctct

SEQ ID NO: 372992 - DNA, 16 bp, M. musculus
caaactcagaaatctt

SEQ ID NO: 372993 - DNA, 16 bp, M. musculus
caaactcagaaattca

SEQ ID NO: 372994 - DNA, 16 bp, M. musculus
caaactcagacatctg

SEQ ID NO: 372995 - DNA, 16 bp, M. musculus
caaactcagagagatc

SEQ ID NO: 372996 - DNA, 16 bp, M. musculus
caaactcagagatcag

SEQ ID NO: 372997 - DNA, 16 bp, M. musculus
caaactcagagatcca

SEQ ID NO: 372998 - DNA, 16 bp, M. musculus
caaactcagagatctg

SEQ ID NO: 372999 - DNA, 16 bp, M. musculus
caaactcagagattca

SEQ ID NO: 373000 - DNA, 16 bp, M. musculus
caaactcagatatcca

SEQ ID NO: 373001 - DNA, 16 bp, M. musculus
caaactcaggatcctc

SEQ ID NO: 373002 - DNA, 16 bp, M. musculus
caaactcagttcttca

SEQ ID NO: 373003 - DNA, 16 bp, M. musculus
caaactcatagagatc

SEQ ID NO: 373004 - DNA, 16 bp, M. musculus
caaactcccagagatc

SEQ ID NO: 373005 - DNA, 16 bp, M. musculus
caaactcgggtcctct

SEQ ID NO: 373006 - DNA, 16 bp, M. musculus
caaactctgcagccag

SEQ ID NO: 373007 - DNA, 16 bp, M. musculus
caaactctggtcctct

SEQ ID NO: 373008 - DNA, 16 bp, M. musculus
caaactcttccatata

SEQ ID NO: 373009 - DNA, 16 bp, M. musculus
caaactgaaaaaggaa

SEQ ID NO: 373010 - DNA, 16 bp, M. musculus
caaactgaccaaccct

SEQ ID NO: 373011 - DNA, 16 bp, M. musculus
caaactgagaaagaaa

SEQ ID NO: 373012 - DNA, 16 bp, M. musculus
caaactgagcaagtca

SEQ ID NO: 373013 - DNA, 16 bp, M. musculus
caaactgagggaaatc

SEQ ID NO: 373014 - DNA, 16 bp, M. musculus
caaactggaaaatctg

SEQ ID NO: 373015 - DNA, 16 bp, M. musculus
caaactggaaagaaag

SEQ ID NO: 373016 - DNA, 16 bp, M. musculus
caaactggggctgaaa

SEQ ID NO: 373017 - DNA, 16 bp, M. musculus
caaactgttttaagac

SEQ ID NO: 373018 - DNA, 16 bp, M. musculus
caaacttacaaagatc

SEQ ID NO: 373019 - DNA, 16 bp, M. musculus
caaacttacagagatc

SEQ ID NO: 373020 - DNA, 16 bp, M. musculus
caaacttaggtcatca

SEQ ID NO: 373021 - DNA, 16 bp, M. musculus
caaacttatggacaca

SEQ ID NO: 373022 - DNA, 16 bp, M. musculus
caaacttcaaactctg

SEQ ID NO: 373023 - DNA, 22 bp, M. musculus
caaacttctagaagtcatggaa

SEQ ID NO: 373024 - DNA, 31 bp, M. musculus
caaacttctagaagtcatggaaggtaatttt

SEQ ID NO: 373025 - DNA, 29 bp, M. musculus
caaactttatatgccccagtacaggggaa

SEQ ID NO: 373026 - DNA, 20 bp, M. musculus
caaactttatatgcctcagt

SEQ ID NO: 373027 - DNA, 16 bp, M. musculus
caaacttttaatacag

SEQ ID NO: 373028 - DNA, 16 bp, M. musculus
caaagaaaaaaatctg

SEQ ID NO: 373029 - DNA, 16 bp, M. musculus
caaagaaaacaatgca

SEQ ID NO: 373030 - DNA, 16 bp, M. musculus
caaagaaaacagatgg

SEQ ID NO: 373031 - DNA, 16 bp, M. musculus
caaagaaaacatatgg

SEQ ID NO: 373032 - DNA, 16 bp, M. musculus
caaagaaaacatggtg

SEQ ID NO: 373033 - DNA, 16 bp, M. musculus
caaagaaaacattttt

SEQ ID NO: 373034 - DNA, 16 bp, M. musculus
caaagaaaactttaaa

SEQ ID NO: 373035 - DNA, 16 bp, M. musculus
caaagaaaagtttcct

SEQ ID NO: 373036 - DNA, 16 bp, M. musculus
caaagaaaatggagag

SEQ ID NO: 373037 - DNA, 16 bp, M. musculus
caaagaaaatgttaaa

SEQ ID NO: 373038 - DNA, 16 bp, M. musculus
caaagaaagacaactt

SEQ ID NO: 373039 - DNA, 16 bp, M. musculus
caaagaaagcacatgg

SEQ ID NO: 373040 - DNA, 16 bp, M. musculus
caaagaaagcatttct

SEQ ID NO: 373041 - DNA, 16 bp, M. musculus
caaagaaagtcaggac

SEQ ID NO: 373042 - DNA, 16 bp, M. musculus
caaagaaagtggaaaa

SEQ ID NO: 373043 - DNA, 16 bp, M. musculus
caaagaaatgattcca

SEQ ID NO: 373044 - DNA, 16 bp, M. musculus
caaagaaatggaagca

SEQ ID NO: 373045 - DNA, 16 bp, M. musculus
caaagaaattcagaat

SEQ ID NO: 373046 - DNA, 16 bp, M. musculus
caaagaaccagctgct

SEQ ID NO: 373047 - DNA, 16 bp, M. musculus
caaagaaccagttcct

SEQ ID NO: 373048 - DNA, 16 bp, M. musculus
caaagaactcaaatga

SEQ ID NO: 373049 - DNA, 16 bp, M. musculus
caaagaactcaggaaa

SEQ ID NO: 373050 - DNA, 16 bp, M. musculus
caaagaactgtaggca

SEQ ID NO: 373051 - DNA, 16 bp, M. musculus
caaagaacttaataaa

SEQ ID NO: 373052 - DNA, 16 bp, M. musculus
caaagaacttcttgtg

SEQ ID NO: 373053 - DNA, 16 bp, M. musculus
caaagaagaagtcaag

SEQ ID NO: 373054 - DNA, 16 bp, M. musculus
caaagaagagttaaca

SEQ ID NO: 373055 - DNA, 16 bp, M. musculus
caaagaagatatcaga

SEQ ID NO: 373056 - DNA, 16 bp, M. musculus
caaagaagcagctcct

SEQ ID NO: 373057 - DNA, 16 bp, M. musculus
caaagaagtcaaataa

SEQ ID NO: 373058 - DNA, 16 bp, M. musculus
caaagaagtcagaaga

SEQ ID NO: 373059 - DNA, 16 bp, M. musculus
caaagaataaacaggc

SEQ ID NO: 373060 - DNA, 16 bp, M. musculus
caaagaatcaaataac

SEQ ID NO: 373061 - DNA, 16 bp, M. musculus
caaagaatcaacaaag

SEQ ID NO: 373062 - DNA, 16 bp, M. musculus
caaagaatcaacccat

SEQ ID NO: 373063 - DNA, 16 bp, M. musculus
caaagaatctttctaa

SEQ ID NO: 373064 - DNA, 16 bp, M. musculus
caaagaattaatgaaa

SEQ ID NO: 373065 - DNA, 16 bp, M. musculus
caaagaattagaaaga

SEQ ID NO: 373066 - DNA, 16 bp, M. musculus
caaagaattctgccat

SEQ ID NO: 373067 - DNA, 16 bp, M. musculus
caaagacaaagttcag

SEQ ID NO: 373068 - DNA, 16 bp, M. musculus
caaagacaagcagatc

SEQ ID NO: 373069 - DNA, 16 bp, M. musculus
caaagacagaaactac

SEQ ID NO: 373070 - DNA, 16 bp, M. musculus
caaagacagacactac

SEQ ID NO: 373071 - DNA, 16 bp, M. musculus
caaagacagacaggta

SEQ ID NO: 373072 - DNA, 16 bp, M. musculus
caaagacaggagacag

SEQ ID NO: 373073 - DNA, 16 bp, M. musculus
caaagacatatatgca

SEQ ID NO: 373074 - DNA, 16 bp, M. musculus
caaagacatggttgca

SEQ ID NO: 373075 - DNA, 16 bp, M. musculus
caaagaccacatgaag

SEQ ID NO: 373076 - DNA, 16 bp, M. musculus
caaagaccagctacac

SEQ ID NO: 373077 - DNA, 16 bp, M. musculus
caaagactcaacaaaa

SEQ ID NO: 373078 - DNA, 16 bp, M. musculus
caaagactggaaatgc

SEQ ID NO: 373079 - DNA, 16 bp, M. musculus
caaagagaaactggag

SEQ ID NO: 373080 - DNA, 16 bp, M. musculus
caaagagaaatggaaa

SEQ ID NO: 373081 - DNA, 16 bp, M. musculus
caaagagaacacaaat

SEQ ID NO: 373082 - DNA, 16 bp, M. musculus
caaagagaacacatgg

SEQ ID NO: 373083 - DNA, 16 bp, M. musculus
caaagagaatttattg

SEQ ID NO: 373084 - DNA, 16 bp, M. musculus
caaagagactagaaca

SEQ ID NO: 373085 - DNA, 16 bp, M. musculus
caaagagagacccatt

SEQ ID NO: 373086 - DNA, 16 bp, M. musculus
caaagagatggctcag

SEQ ID NO: 373087 - DNA, 16 bp, M. musculus
caaagagcatttattc

SEQ ID NO: 373088 - DNA, 16 bp, M. musculus
caaagagccaggcatg

SEQ ID NO: 373089 - DNA, 16 bp, M. musculus
caaagagctcaaaaag

SEQ ID NO: 373090 - DNA, 16 bp, M. musculus
caaagagctcaagaag

SEQ ID NO: 373091 - DNA, 16 bp, M. musculus
caaagagctgaagaag

SEQ ID NO: 373092 - DNA, 16 bp, M. musculus
caaagagctgaaggag

SEQ ID NO: 373093 - DNA, 16 bp, M. musculus
caaagaggaaatatgg

SEQ ID NO: 373094 - DNA, 16 bp, M. musculus
caaagaggaactctca

SEQ ID NO: 373095 - DNA, 16 bp, M. musculus
caaagaggtgaaggaa

SEQ ID NO: 373096 - DNA, 16 bp, M. musculus
caaagagtatacatag

SEQ ID NO: 373097 - DNA, 16 bp, M. musculus
caaagagtatatatgg

SEQ ID NO: 373098 - DNA, 18 bp, M. musculus
caaagagtggattggttg

SEQ ID NO: 373099 - DNA, 16 bp, M. musculus
caaagagtgtttattc

SEQ ID NO: 373100 - DNA, 16 bp, M. musculus
caaagataaatcaaga

SEQ ID NO: 373101 - DNA, 16 bp, M. musculus
caaagatacacataca

SEQ ID NO: 373102 - DNA, 16 bp, M. musculus
caaagataccagttaa

SEQ ID NO: 373103 - DNA, 16 bp, M. musculus
caaagatactgatcaa

SEQ ID NO: 373104 - DNA, 16 bp, M. musculus
caaagatattgaaatt

SEQ ID NO: 373105 - DNA, 16 bp, M. musculus
caaagatctgcctgcc

SEQ ID NO: 373106 - DNA, 16 bp, M. musculus
caaagatgaccctgaa

SEQ ID NO: 373107 - DNA, 16 bp, M. musculus
caaagatgactttgaa

SEQ ID NO: 373108 - DNA, 16 bp, M. musculus
caaagatgctgacaaa

SEQ ID NO: 373109 - DNA, 16 bp, M. musculus
caaagatggccttgaa

SEQ ID NO: 373110 - DNA, 16 bp, M. musculus
caaagatgttcagaat

SEQ ID NO: 373111 - DNA, 16 bp, M. musculus
caaagattatccctat

SEQ ID NO: 373112 - DNA, 16 bp, M. musculus
caaagattttatttat

SEQ ID NO: 373113 - DNA, 16 bp, M. musculus
caaagatttttttttt

SEQ ID NO: 373114 - DNA, 16 bp, M. musculus
caaagcaaagcaaagc

SEQ ID NO: 373115 - DNA, 16 bp, M. musculus
caaagcaaagcagaat

SEQ ID NO: 373116 - DNA, 16 bp, M. musculus
caaagcaaatcaaaac

SEQ ID NO: 373117 - DNA, 16 bp, M. musculus
caaagcaacttgagga

SEQ ID NO: 373118 - DNA, 16 bp, M. musculus
caaagcaagttccaga

SEQ ID NO: 373119 - DNA, 16 bp, M. musculus
caaagcacactgtcaa

SEQ ID NO: 373120 - DNA, 16 bp, M. musculus
caaagcacagattgca

SEQ ID NO: 373121 - DNA, 16 bp, M. musculus
caaagcacagcacagc

SEQ ID NO: 373122 - DNA, 16 bp, M. musculus
caaagcaccatgacca

SEQ ID NO: 373123 - DNA, 16 bp, M. musculus
caaagcagaacacatg

SEQ ID NO: 373124 - DNA, 16 bp, M. musculus
caaagcagacctggcc

SEQ ID NO: 373125 - DNA, 16 bp, M. musculus
caaagcagagagagag

SEQ ID NO: 373126 - DNA, 19 bp, M. musculus
caaagcagcagcagcagca

SEQ ID NO: 373127 - DNA, 16 bp, M. musculus
caaagcagtgaaccca

SEQ ID NO: 373128 - DNA, 16 bp, M. musculus
caaagcagttctaact

SEQ ID NO: 373129 - DNA, 16 bp, M. musculus
caaagcatcaataaaa

SEQ ID NO: 373130 - DNA, 16 bp, M. musculus
caaagcatcagaacca

SEQ ID NO: 373131 - DNA, 16 bp, M. musculus
caaagcatttctctca

SEQ ID NO: 373132 - DNA, 16 bp, M. musculus
caaagccaacctgggc

SEQ ID NO: 373133 - DNA, 16 bp, M. musculus
caaagccagcctcagc

SEQ ID NO: 373134 - DNA, 16 bp, M. musculus
caaagccagcctgctc

SEQ ID NO: 373135 - DNA, 16 bp, M. musculus
caaagccagcctggct

SEQ ID NO: 373136 - DNA, 16 bp, M. musculus
caaagccagcctggta

SEQ ID NO: 373137 - DNA, 16 bp, M. musculus
caaagccatccaggat

SEQ ID NO: 373138 - DNA, 16 bp, M. musculus
caaagccatccttggc

SEQ ID NO: 373139 - DNA, 16 bp, M. musculus
caaagcccaagtctaa

SEQ ID NO: 373140 - DNA, 16 bp, M. musculus
caaagcccacccccat

SEQ ID NO: 373141 - DNA, 16 bp, M. musculus
caaagcccatcccagc

SEQ ID NO: 373142 - DNA, 16 bp, M. musculus
caaagcccatgcccac

SEQ ID NO: 373143 - DNA, 16 bp, M. musculus
caaagccccacctcca

SEQ ID NO: 373144 - DNA, 16 bp, M. musculus
caaagccctggctgtc

SEQ ID NO: 373145 - DNA, 16 bp, M. musculus
caaagccctgggttcc

SEQ ID NO: 373146 - DNA, 16 bp, M. musculus
caaagcctaccccagt

SEQ ID NO: 373147 - DNA, 16 bp, M. musculus
caaagcctctggcttc

SEQ ID NO: 373148 - DNA, 16 bp, M. musculus
caaagccttggatctg

SEQ ID NO: 373149 - DNA, 16 bp, M. musculus
caaagccttgggtttg

SEQ ID NO: 373150 - DNA, 16 bp, M. musculus
caaagctacacagaga

SEQ ID NO: 373151 - DNA, 16 bp, M. musculus
caaagctagcctggac

SEQ ID NO: 373152 - DNA, 16 bp, M. musculus
caaagctctggatctg

SEQ ID NO: 373153 - DNA, 16 bp, M. musculus
caaagctgacctcaaa

SEQ ID NO: 373154 - DNA, 16 bp, M. musculus
caaagctgagagttct

SEQ ID NO: 373155 - DNA, 16 bp, M. musculus
caaagctgcaagatct

SEQ ID NO: 373156 - DNA, 16 bp, M. musculus
caaagctgcagggtct

SEQ ID NO: 373157 - DNA, 16 bp, M. musculus
caaagctggtgtttgt

SEQ ID NO: 373158 - DNA, 16 bp, M. musculus
caaagctgtcctctga

SEQ ID NO: 373159 - DNA, 16 bp, M. musculus
caaagcttagggaact

SEQ ID NO: 373160 - DNA, 16 bp, M. musculus
caaagcttctttctgt

SEQ ID NO: 373161 - DNA, 16 bp, M. musculus
caaagcttcttttggg

SEQ ID NO: 373162 - DNA, 16 bp, M. musculus
caaagcttttattgct

SEQ ID NO: 373163 - DNA, 16 bp, M. musculus
caaaggaaaataaagg

SEQ ID NO: 373164 - DNA, 16 bp, M. musculus
caaaggaaaggccatc

SEQ ID NO: 373165 - DNA, 16 bp, M. musculus
caaaggaagccagaag

SEQ ID NO: 373166 - DNA, 16 bp, M. musculus
caaaggaagccaggag

SEQ ID NO: 373167 - DNA, 16 bp, M. musculus
caaaggaagtcaggaa

SEQ ID NO: 373168 - DNA, 16 bp, M. musculus
caaaggaagtgaaaga

SEQ ID NO: 373169 - DNA, 16 bp, M. musculus
caaaggaatggagaga

SEQ ID NO: 373170 - DNA, 16 bp, M. musculus
caaaggaatgtcccca

SEQ ID NO: 373171 - DNA, 16 bp, M. musculus
caaaggacaacttgtg

SEQ ID NO: 373172 - DNA, 16 bp, M. musculus
caaaggacactctcaa

SEQ ID NO: 373173 - DNA, 16 bp, M. musculus
caaaggacactgtcca

SEQ ID NO: 373174 - DNA, 16 bp, M. musculus
caaaggaccagcaaac

SEQ ID NO: 373175 - DNA, 16 bp, M. musculus
caaaggacccaggttc

SEQ ID NO: 373176 - DNA, 16 bp, M. musculus
caaaggacccaggttt

SEQ ID NO: 373177 - DNA, 16 bp, M. musculus
caaaggacctaggttc

SEQ ID NO: 373178 - DNA, 16 bp, M. musculus
caaaggacctgaaaat

SEQ ID NO: 373179 - DNA, 16 bp, M. musculus
caaaggacctgagttt

SEQ ID NO: 373180 - DNA, 16 bp, M. musculus
caaaggactcaagaag

SEQ ID NO: 373181 - DNA, 16 bp, M. musculus
caaaggagccaaaacc

SEQ ID NO: 373182 - DNA, 16 bp, M. musculus
caaaggagctaaaaac

SEQ ID NO: 373183 - DNA, 16 bp, M. musculus
caaaggatgaccttga

SEQ ID NO: 373184 - DNA, 16 bp, M. musculus
caaaggatgcctgtgt

SEQ ID NO: 373185 - DNA, 16 bp, M. musculus
caaaggcaaacaggaa

SEQ ID NO: 373186 - DNA, 16 bp, M. musculus
caaaggcaaccagaag

SEQ ID NO: 373187 - DNA, 16 bp, M. musculus
caaaggcaagaggatc

SEQ ID NO: 373188 - DNA, 16 bp, M. musculus
caaaggcacatgtggc

SEQ ID NO: 373189 - DNA, 16 bp, M. musculus
caaaggcagaggcagg

SEQ ID NO: 373190 - DNA, 16 bp, M. musculus
caaaggcagcagcagg

SEQ ID NO: 373191 - DNA, 16 bp, M. musculus
caaaggcaggtaacag

SEQ ID NO: 373192 - DNA, 16 bp, M. musculus
caaaggcagtgagtgc

SEQ ID NO: 373193 - DNA, 16 bp, M. musculus
caaaggcatgaaagaa

SEQ ID NO: 373194 - DNA, 16 bp, M. musculus
caaaggcatgcacaca

SEQ ID NO: 373195 - DNA, 16 bp, M. musculus
caaaggcatgtgccat

SEQ ID NO: 373196 - DNA, 16 bp, M. musculus
caaaggcattttaaga

SEQ ID NO: 373197 - DNA, 16 bp, M. musculus
caaaggccacattccc

SEQ ID NO: 373198 - DNA, 16 bp, M. musculus
caaaggccagaaaagg

SEQ ID NO: 373199 - DNA, 16 bp, M. musculus
caaaggccagcttgct

SEQ ID NO: 373200 - DNA, 16 bp, M. musculus
caaaggccatgcagat

SEQ ID NO: 373201 - DNA, 16 bp, M. musculus
caaagggatggggaga

SEQ ID NO: 373202 - DNA, 16 bp, M. musculus
caaaggggcctctctt

SEQ ID NO: 373203 - DNA, 16 bp, M. musculus
caaagggtgaaattat

SEQ ID NO: 373204 - DNA, 16 bp, M. musculus
caaagggtgctggcac

SEQ ID NO: 373205 - DNA, 16 bp, M. musculus
caaagggtttgtggct

SEQ ID NO: 373206 - DNA, 16 bp, M. musculus
caaaggtccagcaaac

SEQ ID NO: 373207 - DNA, 16 bp, M. musculus
caaaggtcctaaaaat

SEQ ID NO: 373208 - DNA, 16 bp, M. musculus
caaaggttttgtccag

SEQ ID NO: 373209 - DNA, 16 bp, M. musculus
caaagtaaaaggctgg

SEQ ID NO: 373210 - DNA, 16 bp, M. musculus
caaagtaaaatatttt

SEQ ID NO: 373211 - DNA, 16 bp, M. musculus
caaagtacctcctgcc

SEQ ID NO: 373212 - DNA, 16 bp, M. musculus
caaagtagaagcagaa

SEQ ID NO: 373213 - DNA, 16 bp, M. musculus
caaagtataattacat

SEQ ID NO: 373214 - DNA, 16 bp, M. musculus
caaagtatctacagag

SEQ ID NO: 373215 - DNA, 17 bp, M. musculus
caaagtatggggtgaat

SEQ ID NO: 373216 - DNA, 16 bp, M. musculus
caaagtattttatatt

SEQ ID NO: 373217 - DNA, 16 bp, M. musculus
caaagtcagaaatctg

SEQ ID NO: 373218 - DNA, 16 bp, M. musculus
caaagtcatagaagaa

SEQ ID NO: 373219 - DNA, 16 bp, M. musculus
caaagtcccatgatca

SEQ ID NO: 373220 - DNA, 16 bp, M. musculus
caaagtctctcaactg

SEQ ID NO: 373221 - DNA, 16 bp, M. musculus
caaagtctctggtgag

SEQ ID NO: 373222 - DNA, 16 bp, M. musculus
caaagtctcttctgat

SEQ ID NO: 373223 - DNA, 16 bp, M. musculus
caaagtcttgctatgt

SEQ ID NO: 373224 - DNA, 16 bp, M. musculus
caaagtgaacaccagt

SEQ ID NO: 373225 - DNA, 16 bp, M. musculus
caaagtgctgggatca

SEQ ID NO: 373226 - DNA, 16 bp, M. musculus
caaagtgctgggtcct

SEQ ID NO: 373227 - DNA, 16 bp, M. musculus
caaagtggcacatgct

SEQ ID NO: 373228 - DNA, 19 bp, M. musculus
caaagtggcaggttccagc

SEQ ID NO: 373229 - DNA, 16 bp, M. musculus
caaagtgtccacattt

SEQ ID NO: 373230 - DNA, 16 bp, M. musculus
caaagtgtgggtgctt

SEQ ID NO: 373231 - DNA, 16 bp, M. musculus
caaagtgttcacattt

SEQ ID NO: 373232 - DNA, 16 bp, M. musculus
caaagtgttgggtcct

SEQ ID NO: 373233 - DNA, 16 bp, M. musculus
caaagttgtcctctga

SEQ ID NO: 373234 - DNA, 16 bp, M. musculus
caaagtttaaaataaa

SEQ ID NO: 373235 - DNA, 16 bp, M. musculus
caaagtttggagcttt

SEQ ID NO: 373236 - DNA, 16 bp, M. musculus
caaataaaacattttt

SEQ ID NO: 373237 - DNA, 16 bp, M. musculus
caaataaaaccagaga

SEQ ID NO: 373238 - DNA, 16 bp, M. musculus
caaataaaatcaactt

SEQ ID NO: 373239 - DNA, 16 bp, M. musculus
caaataaaatcttttt

SEQ ID NO: 373240 - DNA, 16 bp, M. musculus
caaataaaattaaatg

SEQ ID NO: 373241 - DNA, 16 bp, M. musculus
caaataaacctattaa

SEQ ID NO: 373242 - DNA, 16 bp, M. musculus
caaataaagaagtgga

SEQ ID NO: 373243 - DNA, 16 bp, M. musculus
caaataaagcttctat

SEQ ID NO: 373244 - DNA, 16 bp, M. musculus
caaataaagctttatt

SEQ ID NO: 373245 - DNA, 16 bp, M. musculus
caaataaatctccttt

SEQ ID NO: 373246 - DNA, 16 bp, M. musculus
caaataaatgaatgaa

SEQ ID NO: 373247 - DNA, 16 bp, M. musculus
caaataaattacattt

SEQ ID NO: 373248 - DNA, 16 bp, M. musculus
caaataaccttattta

SEQ ID NO: 373249 - DNA, 16 bp, M. musculus
caaataactttaaaag

SEQ ID NO: 373250 - DNA, 16 bp, M. musculus
caaataattctattaa

SEQ ID NO: 373251 - DNA, 16 bp, M. musculus
caaataattggtcaca

SEQ ID NO: 373252 - DNA, 16 bp, M. musculus
caaatacaaatcagca

SEQ ID NO: 373253 - DNA, 16 bp, M. musculus
caaatacaattggcac

SEQ ID NO: 373254 - DNA, 16 bp, M. musculus
caaatacacatgtgca

SEQ ID NO: 373255 - DNA, 16 bp, M. musculus
caaatacagagacaca

SEQ ID NO: 373256 - DNA, 16 bp, M. musculus
caaatacagaggaaga

SEQ ID NO: 373257 - DNA, 16 bp, M. musculus
caaatacagaggggga

SEQ ID NO: 373258 - DNA, 16 bp, M. musculus
caaatacagcataaca

SEQ ID NO: 373259 - DNA, 16 bp, M. musculus
caaatacatatgtgtg

SEQ ID NO: 373260 - DNA, 16 bp, M. musculus
caaatacatccatatt

SEQ ID NO: 373261 - DNA, 16 bp, M. musculus
caaatacatctggaat

SEQ ID NO: 373262 - DNA, 16 bp, M. musculus
caaatacatgaaagaa

SEQ ID NO: 373263 - DNA, 16 bp, M. musculus
caaatacattcacaca

SEQ ID NO: 373264 - DNA, 16 bp, M. musculus
caaatacttttttaaa

SEQ ID NO: 373265 - DNA, 16 bp, M. musculus
caaatagtaatacctt

SEQ ID NO: 373266 - DNA, 16 bp, M. musculus
caaatagtataaaata

SEQ ID NO: 373267 - DNA, 16 bp, M. musculus
caaatatatacataca

SEQ ID NO: 373268 - DNA, 16 bp, M. musculus
caaatatatacatgta

SEQ ID NO: 373269 - DNA, 16 bp, M. musculus
caaatatattttagaa

SEQ ID NO: 373270 - DNA, 16 bp, M. musculus
caaatatcagtattct

SEQ ID NO: 373271 - DNA, 16 bp, M. musculus
caaatatgtctttgat

SEQ ID NO: 373272 - DNA, 16 bp, M. musculus
caaatatgtgatccaa

SEQ ID NO: 373273 - DNA, 16 bp, M. musculus
caaatatttaaatgta

SEQ ID NO: 373274 - DNA, 16 bp, M. musculus
caaatatttattaagc

SEQ ID NO: 373275 - DNA, 16 bp, M. musculus
caaatatttctctgat

SEQ ID NO: 373276 - DNA, 16 bp, M. musculus
caaatatttctgaagg

SEQ ID NO: 373277 - DNA, 16 bp, M. musculus
caaatatttgctgaat

SEQ ID NO: 373278 - DNA, 16 bp, M. musculus
caaatattttaaaaga

SEQ ID NO: 373279 - DNA, 16 bp, M. musculus
caaatattttaaaatg

SEQ ID NO: 373280 - DNA, 16 bp, M. musculus
caaatattttcataat

SEQ ID NO: 373281 - DNA, 16 bp, M. musculus
caaatcaaaatgacta

SEQ ID NO: 373282 - DNA, 16 bp, M. musculus
caaatcaccctcagca

SEQ ID NO: 373283 - DNA, 17 bp, M. musculus
caaatcagaacaaccct

SEQ ID NO: 373284 - DNA, 16 bp, M. musculus
caaatcatagtcagct

SEQ ID NO: 373285 - DNA, 16 bp, M. musculus
caaatcatatttttaa

SEQ ID NO: 373286 - DNA, 16 bp, M. musculus
caaatcccagcaaccc

SEQ ID NO: 373287 - DNA, 16 bp, M. musculus
caaatccccagagccc

SEQ ID NO: 373288 - DNA, 16 bp, M. musculus
caaatcccctgcctct

SEQ ID NO: 373289 - DNA, 16 bp, M. musculus
caaatcccttggaact

SEQ ID NO: 373290 - DNA, 16 bp, M. musculus
caaatcctatctaata

SEQ ID NO: 373291 - DNA, 16 bp, M. musculus
caaatcctcagacccc

SEQ ID NO: 373292 - DNA, 16 bp, M. musculus
caaatcctggaaacag

SEQ ID NO: 373293 - DNA, 16 bp, M. musculus
caaatcgagcatcaga

SEQ ID NO: 373294 - DNA, 16 bp, M. musculus
caaatctctgtgaggc

SEQ ID NO: 373295 - DNA, 16 bp, M. musculus
caaatctgacaacctg

SEQ ID NO: 373296 - DNA, 16 bp, M. musculus
caaatctggaccacat

SEQ ID NO: 373297 - DNA, 16 bp, M. musculus
caaatctgggtcctaa

SEQ ID NO: 373298 - DNA, 16 bp, M. musculus
caaatcttcagatgtg

SEQ ID NO: 373299 - DNA, 16 bp, M. musculus
caaatcttcctcctcc

SEQ ID NO: 373300 - DNA, 16 bp, M. musculus
caaatgaaactgaaga

SEQ ID NO: 373301 - DNA, 16 bp, M. musculus
caaatgaaagacccac

SEQ ID NO: 373302 - DNA, 16 bp, M. musculus
caaatgaaagatctgt

SEQ ID NO: 373303 - DNA, 16 bp, M. musculus
caaatgaaagggcatc

SEQ ID NO: 373304 - DNA, 16 bp, M. musculus
caaatgaacacacaca

SEQ ID NO: 373305 - DNA, 22 bp, M. musculus
caaatgaacaggcagtggctaa

SEQ ID NO: 373306 - DNA, 16 bp, M. musculus
caaatgaagagctggt

SEQ ID NO: 373307 - DNA, 16 bp, M. musculus
caaatgaatggaccta

SEQ ID NO: 373308 - DNA, 19 bp, M. musculus
caaatgaatggacctggag

SEQ ID NO: 373309 - DNA, 16 bp, M. musculus
caaatgacaaatggac

SEQ ID NO: 373310 - DNA, 16 bp, M. musculus
caaatgacccttttac

SEQ ID NO: 373311 - DNA, 16 bp, M. musculus
caaatgagagaaaatg

SEQ ID NO: 373312 - DNA, 16 bp, M. musculus
caaatgagagagagag

SEQ ID NO: 373313 - DNA, 16 bp, M. musculus
caaatgaggaaactga

SEQ ID NO: 373314 - DNA, 16 bp, M. musculus
caaatgatatcctgaa

SEQ ID NO: 373315 - DNA, 16 bp, M. musculus
caaatgatgatgatga

SEQ ID NO: 373316 - DNA, 16 bp, M. musculus
caaatgcaaaggcagc

SEQ ID NO: 373317 - DNA, 16 bp, M. musculus
caaatgcaatctacag

SEQ ID NO: 373318 - DNA, 16 bp, M. musculus
caaatgcacttgaaag

SEQ ID NO: 373319 - DNA, 16 bp, M. musculus
caaatgcagaaaacaa

SEQ ID NO: 373320 - DNA, 16 bp, M. musculus
caaatgcataaaacaa

SEQ ID NO: 373321 - DNA, 16 bp, M. musculus
caaatgcatacataca

SEQ ID NO: 373322 - DNA, 16 bp, M. musculus
caaatgccagcccagt

SEQ ID NO: 373323 - DNA, 17 bp, M. musculus
caaatgcctatggtttc

SEQ ID NO: 373324 - DNA, 16 bp, M. musculus
caaatgctattccgaa

SEQ ID NO: 373325 - DNA, 16 bp, M. musculus
caaatgctgctggttc

SEQ ID NO: 373326 - DNA, 16 bp, M. musculus
caaatgctttcccgaa

SEQ ID NO: 373327 - DNA, 16 bp, M. musculus
caaatgctttctccaa

SEQ ID NO: 373328 - DNA, 16 bp, M. musculus
caaatgctttcttttc

SEQ ID NO: 373329 - DNA, 16 bp, M. musculus
caaatgctttttccac

SEQ ID NO: 373330 - DNA, 17 bp, M. musculus
caaatgctttttctgca

SEQ ID NO: 373331 - DNA, 16 bp, M. musculus
caaatggaaacaaaga

SEQ ID NO: 373332 - DNA, 16 bp, M. musculus
caaatggaaacaagaa

SEQ ID NO: 373333 - DNA, 17 bp, M. musculus
caaatggactgaagaaa

SEQ ID NO: 373334 - DNA, 16 bp, M. musculus
caaatggagatcaaag

SEQ ID NO: 373335 - DNA, 16 bp, M. musculus
caaatggatcaagaac

SEQ ID NO: 373336 - DNA, 16 bp, M. musculus
caaatggatctaacag

SEQ ID NO: 373337 - DNA, 19 bp, M. musculus
caaatggatggacctggag

SEQ ID NO: 373338 - DNA, 16 bp, M. musculus
caaatggatggatttg

SEQ ID NO: 373339 - DNA, 16 bp, M. musculus
caaatggatgtgtctg

SEQ ID NO: 373340 - DNA, 16 bp, M. musculus
caaatggctgagatgc

SEQ ID NO: 373341 - DNA, 16 bp, M. musculus
caaatggttatgagcc

SEQ ID NO: 373342 - DNA, 16 bp, M. musculus
caaatgtaaacaatat

SEQ ID NO: 373343 - DNA, 16 bp, M. musculus
caaatgtaaatatttc

SEQ ID NO: 373344 - DNA, 16 bp, M. musculus
caaatgtatttttaaa

SEQ ID NO: 373345 - DNA, 16 bp, M. musculus
caaatgtgatcattgt

SEQ ID NO: 373346 - DNA, 16 bp, M. musculus
caaatgtgtgcacaca

SEQ ID NO: 373347 - DNA, 16 bp, M. musculus
caaatgttattctctt

SEQ ID NO: 373348 - DNA, 16 bp, M. musculus
caaatgttatttaaaa

SEQ ID NO: 373349 - DNA, 16 bp, M. musculus
caaatgttatttttaa

SEQ ID NO: 373350 - DNA, 16 bp, M. musculus
caaatgttctaccact

SEQ ID NO: 373351 - DNA, 16 bp, M. musculus
caaatgttcttcatcc

SEQ ID NO: 373352 - DNA, 16 bp, M. musculus
caaatgtttccatttt

SEQ ID NO: 373353 - DNA, 16 bp, M. musculus
caaatgttttcttaat

SEQ ID NO: 373354 - DNA, 16 bp, M. musculus
caaatgttttggattc

SEQ ID NO: 373355 - DNA, 16 bp, M. musculus
caaattaatttccaaa

SEQ ID NO: 373356 - DNA, 16 bp, M. musculus
caaattcaccaaagag

SEQ ID NO: 373357 - DNA, 16 bp, M. musculus
caaattcagaaatcca

SEQ ID NO: 373358 - DNA, 16 bp, M. musculus
caaattcagagatctg

SEQ ID NO: 373359 - DNA, 16 bp, M. musculus
caaattcagagctgaa

SEQ ID NO: 373360 - DNA, 16 bp, M. musculus
caaattcataaaagaa

SEQ ID NO: 373361 - DNA, 16 bp, M. musculus
caaattcatggactct

SEQ ID NO: 373362 - DNA, 16 bp, M. musculus
caaattcatttgaaat

SEQ ID NO: 373363 - DNA, 16 bp, M. musculus
caaattccaggccagc

SEQ ID NO: 373364 - DNA, 16 bp, M. musculus
caaattccattacaga

SEQ ID NO: 373365 - DNA, 16 bp, M. musculus
caaattcctcccagag

SEQ ID NO: 373366 - DNA, 16 bp, M. musculus
caaattccttctctgg

SEQ ID NO: 373367 - DNA, 16 bp, M. musculus
caaattcgtctggaat

SEQ ID NO: 373368 - DNA, 16 bp, M. musculus
caaattctcagcacaa

SEQ ID NO: 373369 - DNA, 16 bp, M. musculus
caaattgaggaggaaa

SEQ ID NO: 373370 - DNA, 16 bp, M. musculus
caaattgagttctagg

SEQ ID NO: 373371 - DNA, 16 bp, M. musculus
caaattgatagactgg

SEQ ID NO: 373372 - DNA, 16 bp, M. musculus
caaattgcttctggtg

SEQ ID NO: 373373 - DNA, 16 bp, M. musculus
caaattgtctgaagaa

SEQ ID NO: 373374 - DNA, 16 bp, M. musculus
caaatttacacacaca

SEQ ID NO: 373375 - DNA, 16 bp, M. musculus
caaatttcaggccagc

SEQ ID NO: 373376 - DNA, 83 bp, M. musculus
caaatttgcctgtaaccctgtggggaagagatctgttgtcacagatgggcgttatcctgtgcagttctaaggagatggtgact

SEQ ID NO: 373377 - DNA, 16 bp, M. musculus
caaatttgtcaaaaac

SEQ ID NO: 373378 - DNA, 16 bp, M. musculus
caaatttgtcctgcct

SEQ ID NO: 373379 - DNA, 16 bp, M. musculus
caaattttgtctttgt

SEQ ID NO: 373380 - DNA, 16 bp, M. musculus
caacaaaactggaaga

SEQ ID NO: 373381 - DNA, 16 bp, M. musculus
caacaaaactgtaaaa

SEQ ID NO: 373382 - DNA, 16 bp, M. musculus
caacaaaagaaagctt

SEQ ID NO: 373383 - DNA, 16 bp, M. musculus
caacaaaagaatgaat

SEQ ID NO: 373384 - DNA, 16 bp, M. musculus
caacaaaatcatggaa

SEQ ID NO: 373385 - DNA, 16 bp, M. musculus
caacaaaatcttagaa

SEQ ID NO: 373386 - DNA, 16 bp, M. musculus
caacaaaattatagaa

SEQ ID NO: 373387 - DNA, 16 bp, M. musculus
caacaaacatttcatt

SEQ ID NO: 373388 - DNA, 16 bp, M. musculus
caacaaaccctgagcc

SEQ ID NO: 373389 - DNA, 16 bp, M. musculus
caacaaagagaatttc

SEQ ID NO: 373390 - DNA, 16 bp, M. musculus
caacaacaaaaacagt

SEQ ID NO: 373391 - DNA, 16 bp, M. musculus
caacaacaaaaagcat

SEQ ID NO: 373392 - DNA, 16 bp, M. musculus
caacaacaaaaatcag

SEQ ID NO: 373393 - DNA, 16 bp, M. musculus
caacaacaaaaatgga

SEQ ID NO: 373394 - DNA, 16 bp, M. musculus
caacaacaaaaatgtc

SEQ ID NO: 373395 - DNA, 16 bp, M. musculus
caacaacaaaacagtg

SEQ ID NO: 373396 - DNA, 16 bp, M. musculus
caacaacaaaacctgt

SEQ ID NO: 373397 - DNA, 16 bp, M. musculus
caacaacaacaaactg

SEQ ID NO: 373398 - DNA, 16 bp, M. musculus
caacaacaacaacagt

SEQ ID NO: 373399 - DNA, 16 bp, M. musculus
caacaacaacagcatc

SEQ ID NO: 373400 - DNA, 16 bp, M. musculus
caacaacagaaacatc

SEQ ID NO: 373401 - DNA, 16 bp, M. musculus
caacaacagcctccaa

SEQ ID NO: 373402 - DNA, 16 bp, M. musculus
caacaacatggctgcc

SEQ ID NO: 373403 - DNA, 16 bp, M. musculus
caacaaccacaggaag

SEQ ID NO: 373404 - DNA, 16 bp, M. musculus
caacaactggagcaag

SEQ ID NO: 373405 - DNA, 16 bp, M. musculus
caacaactttattttt

SEQ ID NO: 373406 - DNA, 16 bp, M. musculus
caacaagaccacactt

SEQ ID NO: 373407 - DNA, 16 bp, M. musculus
caacaagacctgtgtc

SEQ ID NO: 373408 - DNA, 16 bp, M. musculus
caacaagagagtatgt

SEQ ID NO: 373409 - DNA, 16 bp, M. musculus
caacaagagcctgctg

SEQ ID NO: 373410 - DNA, 16 bp, M. musculus
caacaagatcatagaa

SEQ ID NO: 373411 - DNA, 16 bp, M. musculus
caacaagatccaacac

SEQ ID NO: 373412 - DNA, 16 bp, M. musculus
caacaagcaaagatca

SEQ ID NO: 373413 - DNA, 16 bp, M. musculus
caacaagcaactgaaa

SEQ ID NO: 373414 - DNA, 16 bp, M. musculus
caacaagcagctgact

SEQ ID NO: 373415 - DNA, 16 bp, M. musculus
caacaagcagctggaa

SEQ ID NO: 373416 - DNA, 16 bp, M. musculus
caacaagccagaatct

SEQ ID NO: 373417 - DNA, 16 bp, M. musculus
caacaaggccacacct

SEQ ID NO: 373418 - DNA, 16 bp, M. musculus
caacaaggccacatct

SEQ ID NO: 373419 - DNA, 16 bp, M. musculus
caacaaggtggactcc

SEQ ID NO: 373420 - DNA, 16 bp, M. musculus
caacaagtacttgctg

SEQ ID NO: 373421 - DNA, 16 bp, M. musculus
caacaagtgcttcctg

SEQ ID NO: 373422 - DNA, 16 bp, M. musculus
caacaagtgcttgttg

SEQ ID NO: 373423 - DNA, 16 bp, M. musculus
caacaagttagataaa

SEQ ID NO: 373424 - DNA, 16 bp, M. musculus
caacaataaaagtact

SEQ ID NO: 373425 - DNA, 16 bp, M. musculus
caacaatatgacctaa

SEQ ID NO: 373426 - DNA, 16 bp, M. musculus
caacaatattctcaga

SEQ ID NO: 373427 - DNA, 16 bp, M. musculus
caacaatcaaagataa

SEQ ID NO: 373428 - DNA, 16 bp, M. musculus
caacaatcactatttc

SEQ ID NO: 373429 - DNA, 16 bp, M. musculus
caacaatcctcctgcc

SEQ ID NO: 373430 - DNA, 16 bp, M. musculus
caacaatgacaacaaa

SEQ ID NO: 373431 - DNA, 16 bp, M. musculus
caacaatgcaggagtg

SEQ ID NO: 373432 - DNA, 16 bp, M. musculus
caacaattagtgaaaa

SEQ ID NO: 373433 - DNA, 16 bp, M. musculus
caacacagtggagctg

SEQ ID NO: 373434 - DNA, 16 bp, M. musculus
caacacatacaagaag

SEQ ID NO: 373435 - DNA, 16 bp, M. musculus
caacacccaactttca

SEQ ID NO: 373436 - DNA, 16 bp, M. musculus
caacaccctcctcaat

SEQ ID NO: 373437 - DNA, 16 bp, M. musculus
caacacctgaggttgt

SEQ ID NO: 373438 - DNA, 16 bp, M. musculus
caacacctggatagat

SEQ ID NO: 373439 - DNA, 16 bp, M. musculus
caacaccttgatgtaa

SEQ ID NO: 373440 - DNA, 16 bp, M. musculus
caacactccagaggca

SEQ ID NO: 373441 - DNA, 16 bp, M. musculus
caacactctactcagt

SEQ ID NO: 373442 - DNA, 16 bp, M. musculus
caacactggggcattt

SEQ ID NO: 373443 - DNA, 16 bp, M. musculus
caacagaaaacaaagt

SEQ ID NO: 373444 - DNA, 16 bp, M. musculus
caacagaaaacaaggc

SEQ ID NO: 373445 - DNA, 16 bp, M. musculus
caacagaaaactaaca

SEQ ID NO: 373446 - DNA, 16 bp, M. musculus
caacagaaactgggga

SEQ ID NO: 373447 - DNA, 16 bp, M. musculus
caacagaaagcaaact

SEQ ID NO: 373448 - DNA, 16 bp, M. musculus
caacagaaagcctaca

SEQ ID NO: 373449 - DNA, 16 bp, M. musculus
caacagaacattttat

SEQ ID NO: 373450 - DNA, 16 bp, M. musculus
caacagaaccagcagc

SEQ ID NO: 373451 - DNA, 16 bp, M. musculus
caacagaacttcttgg

SEQ ID NO: 373452 - DNA, 16 bp, M. musculus
caacagaagagtggat

SEQ ID NO: 373453 - DNA, 16 bp, M. musculus
caacagaagccagaag

SEQ ID NO: 373454 - DNA, 16 bp, M. musculus
caacagacagtgacag

SEQ ID NO: 373455 - DNA, 16 bp, M. musculus
caacagagaaatggat

SEQ ID NO: 373456 - DNA, 16 bp, M. musculus
caacagagacacagtg

SEQ ID NO: 373457 - DNA, 16 bp, M. musculus
caacagagccatctcc

SEQ ID NO: 373458 - DNA, 16 bp, M. musculus
caacagagcttcttga

SEQ ID NO: 373459 - DNA, 16 bp, M. musculus
caacagaggccagaag

SEQ ID NO: 373460 - DNA, 16 bp, M. musculus
caacagagtcaactca

SEQ ID NO: 373461 - DNA, 16 bp, M. musculus
caacagataaaagaag

SEQ ID NO: 373462 - DNA, 16 bp, M. musculus
caacagatacaagaat

SEQ ID NO: 373463 - DNA, 16 bp, M. musculus
caacagatagaaaaat

SEQ ID NO: 373464 - DNA, 16 bp, M. musculus
caacagatatgctggc

SEQ ID NO: 373465 - DNA, 16 bp, M. musculus
caacagatgcaagcat

SEQ ID NO: 373466 - DNA, 16 bp, M. musculus
caacagatgctggaga

SEQ ID NO: 373467 - DNA, 16 bp, M. musculus
caacagatgtgctagc

SEQ ID NO: 373468 - DNA, 16 bp, M. musculus
caacagattagaaaaa

SEQ ID NO: 373469 - DNA, 16 bp, M. musculus
caacagattaggaaaa

SEQ ID NO: 373470 - DNA, 16 bp, M. musculus
caacagatttggaaaa

SEQ ID NO: 373471 - DNA, 16 bp, M. musculus
caacagcaacaaaact

SEQ ID NO: 373472 - DNA, 16 bp, M. musculus
caacagcagcagcatc

SEQ ID NO: 373473 - DNA, 16 bp, M. musculus
caacagcagcagtagc

SEQ ID NO: 373474 - DNA, 16 bp, M. musculus
caacagcagtgacatg

SEQ ID NO: 373475 - DNA, 16 bp, M. musculus
caacagccaatatcaa

SEQ ID NO: 373476 - DNA, 16 bp, M. musculus
caacagccctgccctg

SEQ ID NO: 373477 - DNA, 16 bp, M. musculus
caacagccctggcaga

SEQ ID NO: 373478 - DNA, 16 bp, M. musculus
caacagctgactcaga

SEQ ID NO: 373479 - DNA, 16 bp, M. musculus
caacagctgccctgcc

SEQ ID NO: 373480 - DNA, 16 bp, M. musculus
caacaggactgatgca

SEQ ID NO: 373481 - DNA, 16 bp, M. musculus
caacagggtcacacct

SEQ ID NO: 373482 - DNA, 16 bp, M. musculus
caacagtaaaatttga

SEQ ID NO: 373483 - DNA, 16 bp, M. musculus
caacagtagcaaaatt

SEQ ID NO: 373484 - DNA, 16 bp, M. musculus
caacagtcaatgaaaa

SEQ ID NO: 373485 - DNA, 16 bp, M. musculus
caacagtgcaggaagg

SEQ ID NO: 373486 - DNA, 16 bp, M. musculus
caacagtgggaagatg

SEQ ID NO: 373487 - DNA, 16 bp, M. musculus
caacagttaatgaaaa

SEQ ID NO: 373488 - DNA, 16 bp, M. musculus
caacagtttccagccc

SEQ ID NO: 373489 - DNA, 16 bp, M. musculus
caacataagagggcag

SEQ ID NO: 373490 - DNA, 16 bp, M. musculus
caacataattatagaa

SEQ ID NO: 373491 - DNA, 16 bp, M. musculus
caacatataataagaa

SEQ ID NO: 373492 - DNA, 16 bp, M. musculus
caacatcaaaggaaat

SEQ ID NO: 373493 - DNA, 16 bp, M. musculus
caacatcacagtaaat

SEQ ID NO: 373494 - DNA, 16 bp, M. musculus
caacatcaccaatgga

SEQ ID NO: 373495 - DNA, 16 bp, M. musculus
caacatcagcaaagtg

SEQ ID NO: 373496 - DNA, 16 bp, M. musculus
caacatcatcctaaat

SEQ ID NO: 373497 - DNA, 16 bp, M. musculus
caacatccatagtcat

SEQ ID NO: 373498 - DNA, 16 bp, M. musculus
caacatccttagccat

SEQ ID NO: 373499 - DNA, 16 bp, M. musculus
caacatctgctgtcac

SEQ ID NO: 373500 - DNA, 16 bp, M. musculus
caacatctggcttcta

SEQ ID NO: 373501 - DNA, 16 bp, M. musculus
caacatctggttatct

SEQ ID NO: 373502 - DNA, 16 bp, M. musculus
caacatgaaactcaag

SEQ ID NO: 373503 - DNA, 16 bp, M. musculus
caacattataaaaatg

SEQ ID NO: 373504 - DNA, 16 bp, M. musculus
caacattatgatctaa

SEQ ID NO: 373505 - DNA, 16 bp, M. musculus
caacattatttttaaa

SEQ ID NO: 373506 - DNA, 16 bp, M. musculus
caacattcaagtggaa

SEQ ID NO: 373507 - DNA, 16 bp, M. musculus
caacattctgctgcct

SEQ ID NO: 373508 - DNA, 16 bp, M. musculus
caacattctgttgctt

SEQ ID NO: 373509 - DNA, 16 bp, M. musculus
caacattcttctgctt

SEQ ID NO: 373510 - DNA, 16 bp, M. musculus
caacattgagattcca

SEQ ID NO: 373511 - DNA, 16 bp, M. musculus
caacattgtgaactaa

SEQ ID NO: 373512 - DNA, 16 bp, M. musculus
caacattttcaataaa

SEQ ID NO: 373513 - DNA, 16 bp, M. musculus
caaccaaaagcaactt

SEQ ID NO: 373514 - DNA, 16 bp, M. musculus
caaccaaactggaaaa

SEQ ID NO: 373515 - DNA, 16 bp, M. musculus
caaccaaagagtatac

SEQ ID NO: 373516 - DNA, 16 bp, M. musculus
caaccaaccactttct

SEQ ID NO: 373517 - DNA, 16 bp, M. musculus
caaccaaccagattcc

SEQ ID NO: 373518 - DNA, 16 bp, M. musculus
caaccaaccatccatc

SEQ ID NO: 373519 - DNA, 16 bp, M. musculus
caaccaatcagacccc

SEQ ID NO: 373520 - DNA, 16 bp, M. musculus
caaccaatggaaagaa

SEQ ID NO: 373521 - DNA, 16 bp, M. musculus
caaccacaaccatctg

SEQ ID NO: 373522 - DNA, 16 bp, M. musculus
caaccacagcctggcc

SEQ ID NO: 373523 - DNA, 16 bp, M. musculus
caaccacatggaagct

SEQ ID NO: 373524 - DNA, 16 bp, M. musculus
caaccactggactgag

SEQ ID NO: 373525 - DNA, 17 bp, M. musculus
caaccacttctggaaat

SEQ ID NO: 373526 - DNA, 16 bp, M. musculus
caaccactttttctgt

SEQ ID NO: 373527 - DNA, 16 bp, M. musculus
caaccagaaagcatgc

SEQ ID NO: 373528 - DNA, 16 bp, M. musculus
caaccagaaattagaa

SEQ ID NO: 373529 - DNA, 16 bp, M. musculus
caaccagaacctagag

SEQ ID NO: 373530 - DNA, 16 bp, M. musculus
caaccagacagtccag

SEQ ID NO: 373531 - DNA, 16 bp, M. musculus
caaccagagactgccc

SEQ ID NO: 373532 - DNA, 16 bp, M. musculus
caaccagagcttccag

SEQ ID NO: 373533 - DNA, 16 bp, M. musculus
caaccagagtgagcag

SEQ ID NO: 373534 - DNA, 16 bp, M. musculus
caaccagcagcagcag

SEQ ID NO: 373535 - DNA, 16 bp, M. musculus
caaccaggaagcagaa

SEQ ID NO: 373536 - DNA, 16 bp, M. musculus
caaccagggttacata

SEQ ID NO: 373537 - DNA, 16 bp, M. musculus
caaccagtcctggata

SEQ ID NO: 373538 - DNA, 16 bp, M. musculus
caaccagttttgccag

SEQ ID NO: 373539 - DNA, 16 bp, M. musculus
caaccataacatatat

SEQ ID NO: 373540 - DNA, 16 bp, M. musculus
caaccataggactgag

SEQ ID NO: 373541 - DNA, 16 bp, M. musculus
caaccatcagactgag

SEQ ID NO: 373542 - DNA, 16 bp, M. musculus
caaccatccatcctga

SEQ ID NO: 373543 - DNA, 16 bp, M. musculus
caaccatctataactc

SEQ ID NO: 373544 - DNA, 16 bp, M. musculus
caaccatggactgaaa

SEQ ID NO: 373545 - DNA, 16 bp, M. musculus
caaccatttgtaatag

SEQ ID NO: 373546 - DNA, 16 bp, M. musculus
caacccacctgacctc

SEQ ID NO: 373547 - DNA, 16 bp, M. musculus
caacccagatgtccca

SEQ ID NO: 373548 - DNA, 16 bp, M. musculus
caacccaggctattta

SEQ ID NO: 373549 - DNA, 16 bp, M. musculus
caacccatcctggcac

SEQ ID NO: 373550 - DNA, 16 bp, M. musculus
caaccccactcatctc

SEQ ID NO: 373551 - DNA, 26 bp, M. musculus
caaccccctgaccgctggctatccaa

SEQ ID NO: 373552 - DNA, 16 bp, M. musculus
caaccccctgtctcca

SEQ ID NO: 373553 - DNA, 16 bp, M. musculus
caaccctatacaaaga

SEQ ID NO: 373554 - DNA, 16 bp, M. musculus
caaccctataggaaga

SEQ ID NO: 373555 - DNA, 16 bp, M. musculus
caaccctgagattcta

SEQ ID NO: 373556 - DNA, 16 bp, M. musculus
caaccctttaacacag

SEQ ID NO: 373557 - DNA, 16 bp, M. musculus
caaccctttaatacat

SEQ ID NO: 373558 - DNA, 16 bp, M. musculus
caacctacagattggg

SEQ ID NO: 373559 - DNA, 16 bp, M. musculus
caacctagaatcactt

SEQ ID NO: 373560 - DNA, 16 bp, M. musculus
caacctcagctacata

SEQ ID NO: 373561 - DNA, 16 bp, M. musculus
caacctctggcctcca

SEQ ID NO: 373562 - DNA, 16 bp, M. musculus
caacctgaatttgatc

SEQ ID NO: 373563 - DNA, 16 bp, M. musculus
caacctgagttcaacc

SEQ ID NO: 373564 - DNA, 16 bp, M. musculus
caacctgatctacaaa

SEQ ID NO: 373565 - DNA, 16 bp, M. musculus
caacctgatctacaga

SEQ ID NO: 373566 - DNA, 16 bp, M. musculus
caacctgctttcttac

SEQ ID NO: 373567 - DNA, 16 bp, M. musculus
caacctggggagaaaa

SEQ ID NO: 373568 - DNA, 16 bp, M. musculus
caacctggtcctcagt

SEQ ID NO: 373569 - DNA, 16 bp, M. musculus
caacctggtctacagt

SEQ ID NO: 373570 - DNA, 16 bp, M. musculus
caacctgtctctataa

SEQ ID NO: 373571 - DNA, 16 bp, M. musculus
caacctgtgggccaca

SEQ ID NO: 373572 - DNA, 16 bp, M. musculus
caacctgtgggtcagg

SEQ ID NO: 373573 - DNA, 16 bp, M. musculus
caacctgtgggtcttg

SEQ ID NO: 373574 - DNA, 16 bp, M. musculus
caacctgtgggttgtg

SEQ ID NO: 373575 - DNA, 16 bp, M. musculus
caaccttcccaatgct

SEQ ID NO: 373576 - DNA, 16 bp, M. musculus
caaccttccttatgct

SEQ ID NO: 373577 - DNA, 16 bp, M. musculus
caaccttctgaatgct

SEQ ID NO: 373578 - DNA, 16 bp, M. musculus
caaccttggagaaagt

SEQ ID NO: 373579 - DNA, 16 bp, M. musculus
caacctttccagctcc

SEQ ID NO: 373580 - DNA, 16 bp, M. musculus
caacggattgggaaag

SEQ ID NO: 373581 - DNA, 16 bp, M. musculus
caacgtgtggagcaga

SEQ ID NO: 373582 - DNA, 16 bp, M. musculus
caactaagtggaaaca

SEQ ID NO: 373583 - DNA, 16 bp, M. musculus
caactacacagtggct

SEQ ID NO: 373584 - DNA, 25 bp, M. musculus
caactacaccaggaacaatgtgaac

SEQ ID NO: 373585 - DNA, 16 bp, M. musculus
caactactccaaaatt

SEQ ID NO: 373586 - DNA, 16 bp, M. musculus
caactacttcattgaa

SEQ ID NO: 373587 - DNA, 16 bp, M. musculus
caactactttctgatt

SEQ ID NO: 373588 - DNA, 16 bp, M. musculus
caactagcttctactt

SEQ ID NO: 373589 - DNA, 16 bp, M. musculus
caactaggccacacct

SEQ ID NO: 373590 - DNA, 16 bp, M. musculus
caactagtggttatca

SEQ ID NO: 373591 - DNA, 16 bp, M. musculus
caactatatatatata

SEQ ID NO: 373592 - DNA, 16 bp, M. musculus
caactatgtcctttgc

SEQ ID NO: 373593 - DNA, 16 bp, M. musculus
caactcacagagatct

SEQ ID NO: 373594 - DNA, 16 bp, M. musculus
caactcacagccatct

SEQ ID NO: 373595 - DNA, 16 bp, M. musculus
caactcagagatccac

SEQ ID NO: 373596 - DNA, 16 bp, M. musculus
caactcagagatctgc

SEQ ID NO: 373597 - DNA, 16 bp, M. musculus
caactcagctcttctg

SEQ ID NO: 373598 - DNA, 16 bp, M. musculus
caactcagttcttcaa

SEQ ID NO: 373599 - DNA, 16 bp, M. musculus
caactccagttccagg

SEQ ID NO: 373600 - DNA, 16 bp, M. musculus
caactcccaggtctct

SEQ ID NO: 373601 - DNA, 16 bp, M. musculus
caactcctaaaagttg

SEQ ID NO: 373602 - DNA, 16 bp, M. musculus
caactcctcccagaga

SEQ ID NO: 373603 - DNA, 16 bp, M. musculus
caactcctgcaagctg

SEQ ID NO: 373604 - DNA, 16 bp, M. musculus
caactcctgcctccaa

SEQ ID NO: 373605 - DNA, 16 bp, M. musculus
caactcctgcctccag

SEQ ID NO: 373606 - DNA, 16 bp, M. musculus
caactcctgcttccag

SEQ ID NO: 373607 - DNA, 16 bp, M. musculus
caactctccaccatga

SEQ ID NO: 373608 - DNA, 16 bp, M. musculus
caactctgagatttca

SEQ ID NO: 373609 - DNA, 16 bp, M. musculus
caactcttacaaagga

SEQ ID NO: 373610 - DNA, 16 bp, M. musculus
caactcttataaagga

SEQ ID NO: 373611 - DNA, 16 bp, M. musculus
caactcttttaaagga

SEQ ID NO: 373612 - DNA, 16 bp, M. musculus
caactgaactacatct

SEQ ID NO: 373613 - DNA, 16 bp, M. musculus
caactgaagaacagat

SEQ ID NO: 373614 - DNA, 16 bp, M. musculus
caactgaagctcattt

SEQ ID NO: 373615 - DNA, 23 bp, M. musculus
caactgaagctcctttttctgtg

SEQ ID NO: 373616 - DNA, 16 bp, M. musculus
caactgaatctccttt

SEQ ID NO: 373617 - DNA, 16 bp, M. musculus
caactgagaaaatgtc

SEQ ID NO: 373618 - DNA, 16 bp, M. musculus
caactgagaaagacac

SEQ ID NO: 373619 - DNA, 16 bp, M. musculus
caactgagccatcccc

SEQ ID NO: 373620 - DNA, 16 bp, M. musculus
caactgagtcacttgg

SEQ ID NO: 373621 - DNA, 16 bp, M. musculus
caactgagtcatctcc

SEQ ID NO: 373622 - DNA, 16 bp, M. musculus
caactgcctgtaaatc

SEQ ID NO: 373623 - DNA, 16 bp, M. musculus
caactgcctgtaattc

SEQ ID NO: 373624 - DNA, 16 bp, M. musculus
caactgctgagccatc

SEQ ID NO: 373625 - DNA, 16 bp, M. musculus
caactgctgctgctgc

SEQ ID NO: 373626 - DNA, 16 bp, M. musculus
caactggaggtcagca

SEQ ID NO: 373627 - DNA, 16 bp, M. musculus
caactggatttaacag

SEQ ID NO: 373628 - DNA, 16 bp, M. musculus
caactggcgtttatca

SEQ ID NO: 373629 - DNA, 16 bp, M. musculus
caactggggattgatt

SEQ ID NO: 373630 - DNA, 16 bp, M. musculus
caactggttccaggag

SEQ ID NO: 373631 - DNA, 16 bp, M. musculus
caactggtttttatca

SEQ ID NO: 373632 - DNA, 16 bp, M. musculus
caacttaaaaggccag

SEQ ID NO: 373633 - DNA, 16 bp, M. musculus
caacttaaaggagaaa

SEQ ID NO: 373634 - DNA, 16 bp, M. musculus
caacttaatacaagct

SEQ ID NO: 373635 - DNA, 16 bp, M. musculus
caacttataaaaagaa

SEQ ID NO: 373636 - DNA, 16 bp, M. musculus
caacttatagaagaaa

SEQ ID NO: 373637 - DNA, 16 bp, M. musculus
caacttatttttaaaa

SEQ ID NO: 373638 - DNA, 16 bp, M. musculus
caacttcaagggccag

SEQ ID NO: 373639 - DNA, 16 bp, M. musculus
caacttcagccaagtg

SEQ ID NO: 373640 - DNA, 16 bp, M. musculus
caacttccaaaacaca

SEQ ID NO: 373641 - DNA, 16 bp, M. musculus
caacttccagaagccc

SEQ ID NO: 373642 - DNA, 16 bp, M. musculus
caacttctaagtatat

SEQ ID NO: 373643 - DNA, 16 bp, M. musculus
caacttctaccaggag

SEQ ID NO: 373644 - DNA, 16 bp, M. musculus
caacttctgatgacct

SEQ ID NO: 373645 - DNA, 16 bp, M. musculus
caacttctgccagaag

SEQ ID NO: 373646 - DNA, 16 bp, M. musculus
caacttctgccaggag

SEQ ID NO: 373647 - DNA, 16 bp, M. musculus
caacttctgttctaat

SEQ ID NO: 373648 - DNA, 16 bp, M. musculus
caacttcttcttcttc

SEQ ID NO: 373649 - DNA, 16 bp, M. musculus
caacttgacagagctg

SEQ ID NO: 373650 - DNA, 16 bp, M. musculus
caacttgatacaagct

SEQ ID NO: 373651 - DNA, 16 bp, M. musculus
caacttgcaggaattg

SEQ ID NO: 373652 - DNA, 16 bp, M. musculus
caacttgctttttggt

SEQ ID NO: 373653 - DNA, 16 bp, M. musculus
caacttggtcttcatg

SEQ ID NO: 373654 - DNA, 16 bp, M. musculus
caacttgtcccaaaac

SEQ ID NO: 373655 - DNA, 17 bp, M. musculus
caactttatgtgcaaga

SEQ ID NO: 373656 - DNA, 16 bp, M. musculus
caactttcaggagtta

SEQ ID NO: 373657 - DNA, 16 bp, M. musculus
caactttccctcttcc

SEQ ID NO: 373658 - DNA, 16 bp, M. musculus
caactttctggagtca

SEQ ID NO: 373659 - DNA, 16 bp, M. musculus
caacttttattgttgt

SEQ ID NO: 373660 - DNA, 16 bp, M. musculus
caacttttccacaaga

SEQ ID NO: 373661 - DNA, 16 bp, M. musculus
caagaaaaggagatca

SEQ ID NO: 373662 - DNA, 16 bp, M. musculus
caagaaaagttctttt

SEQ ID NO: 373663 - DNA, 16 bp, M. musculus
caagaaaatcaacaag

SEQ ID NO: 373664 - DNA, 16 bp, M. musculus
caagaaaatcaaggag

SEQ ID NO: 373665 - DNA, 16 bp, M. musculus
caagaaaatgattaaa

SEQ ID NO: 373666 - DNA, 16 bp, M. musculus
caagaaaatgtcccac

SEQ ID NO: 373667 - DNA, 16 bp, M. musculus
caagaaaattaagaag

SEQ ID NO: 373668 - DNA, 16 bp, M. musculus
caagaaacaagctaga

SEQ ID NO: 373669 - DNA, 16 bp, M. musculus
caagaaacaggctgga

SEQ ID NO: 373670 - DNA, 16 bp, M. musculus
caagaaactgaactcc

SEQ ID NO: 373671 - DNA, 16 bp, M. musculus
caagaaacttacagaa

SEQ ID NO: 373672 - DNA, 16 bp, M. musculus
caagaaacttctggtg

SEQ ID NO: 373673 - DNA, 16 bp, M. musculus
caagaaactttgcaca

SEQ ID NO: 373674 - DNA, 16 bp, M. musculus
caagaaagagaatttc

SEQ ID NO: 373675 - DNA, 16 bp, M. musculus
caagaaagagatcagg

SEQ ID NO: 373676 - DNA, 16 bp, M. musculus
caagaaagtcatcctt

SEQ ID NO: 373677 - DNA, 17 bp, M. musculus
caagaaatacaggagaa

SEQ ID NO: 373678 - DNA, 16 bp, M. musculus
caagaaatccgcctgc

SEQ ID NO: 373679 - DNA, 16 bp, M. musculus
caagaaatctacagaa

SEQ ID NO: 373680 - DNA, 16 bp, M. musculus
caagaaattcaagaag

SEQ ID NO: 373681 - DNA, 16 bp, M. musculus
caagaacaaatgctct

SEQ ID NO: 373682 - DNA, 16 bp, M. musculus
caagaacacatctaaa

SEQ ID NO: 373683 - DNA, 16 bp, M. musculus
caagaacacatgaaaa

SEQ ID NO: 373684 - DNA, 16 bp, M. musculus
caagaacagaagcaac

SEQ ID NO: 373685 - DNA, 16 bp, M. musculus
caagaacagaatacca

SEQ ID NO: 373686 - DNA, 16 bp, M. musculus
caagaacagcaagtgc

SEQ ID NO: 373687 - DNA, 16 bp, M. musculus
caagaacagcagctgt

SEQ ID NO: 373688 - DNA, 16 bp, M. musculus
caagaacaggaagtgc

SEQ ID NO: 373689 - DNA, 16 bp, M. musculus
caagaacataagaaac

SEQ ID NO: 373690 - DNA, 16 bp, M. musculus
caagaacatattaaaa

SEQ ID NO: 373691 - DNA, 16 bp, M. musculus
caagaacatcatgaat

SEQ ID NO: 373692 - DNA, 16 bp, M. musculus
caagaacattttaaaa

SEQ ID NO: 373693 - DNA, 16 bp, M. musculus
caagaacctgagacta

SEQ ID NO: 373694 - DNA, 16 bp, M. musculus
caagaacctggagaca

SEQ ID NO: 373695 - DNA, 17 bp, M. musculus
caagaactcacagcagc

SEQ ID NO: 373696 - DNA, 16 bp, M. musculus
caagaactctgacata

SEQ ID NO: 373697 - DNA, 16 bp, M. musculus
caagaactcttaactg

SEQ ID NO: 373698 - DNA, 16 bp, M. musculus
caagaacttcttggca

SEQ ID NO: 373699 - DNA, 16 bp, M. musculus
caagaagaactctcta

SEQ ID NO: 373700 - DNA, 16 bp, M. musculus
caagaagaagaaagat

SEQ ID NO: 373701 - DNA, 16 bp, M. musculus
caagaagaagaaatta

SEQ ID NO: 373702 - DNA, 16 bp, M. musculus
caagaagaagaagacc

SEQ ID NO: 373703 - DNA, 16 bp, M. musculus
caagaagaaggaagat

SEQ ID NO: 373704 - DNA, 16 bp, M. musculus
caagaagaaggaaggc

SEQ ID NO: 373705 - DNA, 16 bp, M. musculus
caagaagaaggaatac

SEQ ID NO: 373706 - DNA, 16 bp, M. musculus
caagaagaatcaggac

SEQ ID NO: 373707 - DNA, 16 bp, M. musculus
caagaagaatgaagac

SEQ ID NO: 373708 - DNA, 16 bp, M. musculus
caagaagaatgaatac

SEQ ID NO: 373709 - DNA, 19 bp, M. musculus
caagaagaatgctgtttct

SEQ ID NO: 373710 - DNA, 16 bp, M. musculus
caagaagagggaagac

SEQ ID NO: 373711 - DNA, 16 bp, M. musculus
caagaagatagactcc

SEQ ID NO: 373712 - DNA, 16 bp, M. musculus
caagaagatcctagaa

SEQ ID NO: 373713 - DNA, 16 bp, M. musculus
caagaagatgcagctg

SEQ ID NO: 373714 - DNA, 16 bp, M. musculus
caagaagatgtcccca

SEQ ID NO: 373715 - DNA, 16 bp, M. musculus
caagaagcaagttgga

SEQ ID NO: 373716 - DNA, 17 bp, M. musculus
caagaagcaagttggga

SEQ ID NO: 373717 - DNA, 16 bp, M. musculus
caagaagcaatgaaga

SEQ ID NO: 373718 - DNA, 16 bp, M. musculus
caagaagcagagacag

SEQ ID NO: 373719 - DNA, 16 bp, M. musculus
caagaagcagaggcag

SEQ ID NO: 373720 - DNA, 16 bp, M. musculus
caagaagcagctggaa

SEQ ID NO: 373721 - DNA, 16 bp, M. musculus
caagaagcaggagctg

SEQ ID NO: 373722 - DNA, 16 bp, M. musculus
caagaagcagttggag

SEQ ID NO: 373723 - DNA, 16 bp, M. musculus
caagaagcatatagaa

SEQ ID NO: 373724 - DNA, 16 bp, M. musculus
caagaagccaagagtt

SEQ ID NO: 373725 - DNA, 16 bp, M. musculus
caagaagccacaggaa

SEQ ID NO: 373726 - DNA, 16 bp, M. musculus
caagaagccacctgag

SEQ ID NO: 373727 - DNA, 16 bp, M. musculus
caagaagcctggcatg

SEQ ID NO: 373728 - DNA, 16 bp, M. musculus
caagaagcgggagtga

SEQ ID NO: 373729 - DNA, 18 bp, M. musculus
caagaagctaaaaaagca

SEQ ID NO: 373730 - DNA, 30 bp, M. musculus
caagaagctcttttgccagtgagggaacaa

SEQ ID NO: 373731 - DNA, 16 bp, M. musculus
caagaagctgaaagaa

SEQ ID NO: 373732 - DNA, 16 bp, M. musculus
caagaagctgaaagag

SEQ ID NO: 373733 - DNA, 16 bp, M. musculus
caagaagctggaaaca

SEQ ID NO: 373734 - DNA, 16 bp, M. musculus
caagaaggaagtccaa

SEQ ID NO: 373735 - DNA, 16 bp, M. musculus
caagaagggacacttc

SEQ ID NO: 373736 - DNA, 16 bp, M. musculus
caagaaggtggacctc

SEQ ID NO: 373737 - DNA, 16 bp, M. musculus
caagaaggtggattcc

SEQ ID NO: 373738 - DNA, 16 bp, M. musculus
caagaagtacttgctg

SEQ ID NO: 373739 - DNA, 16 bp, M. musculus
caagaagtaggaagac

SEQ ID NO: 373740 - DNA, 16 bp, M. musculus
caagaagtctacagaa

SEQ ID NO: 373741 - DNA, 16 bp, M. musculus
caagaagtgggagcag

SEQ ID NO: 373742 - DNA, 16 bp, M. musculus
caagaagtgggagtag

SEQ ID NO: 373743 - DNA, 16 bp, M. musculus
caagaagttcatgctg

SEQ ID NO: 373744 - DNA, 16 bp, M. musculus
caagaagtttacagaa

SEQ ID NO: 373745 - DNA, 16 bp, M. musculus
caagaatcaagcacag

SEQ ID NO: 373746 - DNA, 16 bp, M. musculus
caagaatctgagacta

SEQ ID NO: 373747 - DNA, 46 bp, M. musculus
caagaatgaggctcctgatccagttgcccctgtggatgtggtggat

SEQ ID NO: 373748 - DNA, 16 bp, M. musculus
caagaatgtgaattga

SEQ ID NO: 373749 - DNA, 16 bp, M. musculus
caagaatgtggaaaaa

SEQ ID NO: 373750 - DNA, 16 bp, M. musculus
caagaatttataaatg

SEQ ID NO: 373751 - DNA, 16 bp, M. musculus
caagaatttggaaaaa

SEQ ID NO: 373752 - DNA, 16 bp, M. musculus
caagaattttattcag

SEQ ID NO: 373753 - DNA, 16 bp, M. musculus
caagaatttttttttt

SEQ ID NO: 373754 - DNA, 16 bp, M. musculus
caagacaagcacttta

SEQ ID NO: 373755 - DNA, 16 bp, M. musculus
caagacaatggcattt

SEQ ID NO: 373756 - DNA, 16 bp, M. musculus
caagacacttggctga

SEQ ID NO: 373757 - DNA, 16 bp, M. musculus
caagacagagtcttct

SEQ ID NO: 373758 - DNA, 16 bp, M. musculus
caagacagctttccag

SEQ ID NO: 373759 - DNA, 16 bp, M. musculus
caagacaggagcatgg

SEQ ID NO: 373760 - DNA, 16 bp, M. musculus
caagacagggtttcta

SEQ ID NO: 373761 - DNA, 16 bp, M. musculus
caagacatccaggaaa

SEQ ID NO: 373762 - DNA, 16 bp, M. musculus
caagaccaacctgggc

SEQ ID NO: 373763 - DNA, 16 bp, M. musculus
caagaccaagaccaag

SEQ ID NO: 373764 - DNA, 16 bp, M. musculus
caagaccaaggggcat

SEQ ID NO: 373765 - DNA, 16 bp, M. musculus
caagaccacacccact

SEQ ID NO: 373766 - DNA, 16 bp, M. musculus
caagaccacacctact

SEQ ID NO: 373767 - DNA, 16 bp, M. musculus
caagaccacacctcct

SEQ ID NO: 373768 - DNA, 16 bp, M. musculus
caagaccacaccttct

SEQ ID NO: 373769 - DNA, 16 bp, M. musculus
caagaccacatctact

SEQ ID NO: 373770 - DNA, 16 bp, M. musculus
caagaccacatctcct

SEQ ID NO: 373771 - DNA, 16 bp, M. musculus
caagaccagccagggc

SEQ ID NO: 373772 - DNA, 16 bp, M. musculus
caagaccagcctggat

SEQ ID NO: 373773 - DNA, 16 bp, M. musculus
caagaccagcctggcc

SEQ ID NO: 373774 - DNA, 16 bp, M. musculus
caagaccagcctgggt

SEQ ID NO: 373775 - DNA, 16 bp, M. musculus
caagaccagcctggtc

SEQ ID NO: 373776 - DNA, 16 bp, M. musculus
caagaccagtgcacag

SEQ ID NO: 373777 - DNA, 16 bp, M. musculus
caagacccacatggta

SEQ ID NO: 373778 - DNA, 16 bp, M. musculus
caagacccagtctcaa

SEQ ID NO: 373779 - DNA, 16 bp, M. musculus
caagacccatggaaag

SEQ ID NO: 373780 - DNA, 16 bp, M. musculus
caagaccctccacaat

SEQ ID NO: 373781 - DNA, 16 bp, M. musculus
caagaccctgtcacaa

SEQ ID NO: 373782 - DNA, 16 bp, M. musculus
caagaccctgtctcaa

SEQ ID NO: 373783 - DNA, 16 bp, M. musculus
caagaccctttctcaa

SEQ ID NO: 373784 - DNA, 16 bp, M. musculus
caagacctcaggcaca

SEQ ID NO: 373785 - DNA, 16 bp, M. musculus
caagacctccgggaag

SEQ ID NO: 373786 - DNA, 16 bp, M. musculus
caagacctgaaaatga

SEQ ID NO: 373787 - DNA, 16 bp, M. musculus
caagacctgactccct

SEQ ID NO: 373788 - DNA, 16 bp, M. musculus
caagacctgcacaagt

SEQ ID NO: 373789 - DNA, 16 bp, M. musculus
caagacctgcacaatg

SEQ ID NO: 373790 - DNA, 16 bp, M. musculus
caagaccttgcctcaa

SEQ ID NO: 373791 - DNA, 16 bp, M. musculus
caagactcaacagata

SEQ ID NO: 373792 - DNA, 16 bp, M. musculus
caagactccacctcct

SEQ ID NO: 373793 - DNA, 16 bp, M. musculus
caagactctgctggcc

SEQ ID NO: 373794 - DNA, 17 bp, M. musculus
caagactgccagcccag

SEQ ID NO: 373795 - DNA, 16 bp, M. musculus
caagactgggtttctc

SEQ ID NO: 373796 - DNA, 16 bp, M. musculus
caagactgtgtctcaa

SEQ ID NO: 373797 - DNA, 16 bp, M. musculus
caagacttccaatgga

SEQ ID NO: 373798 - DNA, 16 bp, M. musculus
caagactttatcatga

SEQ ID NO: 373799 - DNA, 16 bp, M. musculus
caagagaaaccaaggt

SEQ ID NO: 373800 - DNA, 16 bp, M. musculus
caagagaagccaaggc

SEQ ID NO: 373801 - DNA, 16 bp, M. musculus
caagagacaacttcct

SEQ ID NO: 373802 - DNA, 16 bp, M. musculus
caagagacagaagcag

SEQ ID NO: 373803 - DNA, 16 bp, M. musculus
caagagacagctagat

SEQ ID NO: 373804 - DNA, 16 bp, M. musculus
caagagactggaggcc

SEQ ID NO: 373805 - DNA, 16 bp, M. musculus
caagagactggatgcc

SEQ ID NO: 373806 - DNA, 16 bp, M. musculus
caagagagaaaatggc

SEQ ID NO: 373807 - DNA, 16 bp, M. musculus
caagagagaagcaagt

SEQ ID NO: 373808 - DNA, 17 bp, M. musculus
caagagaggcccattgg

SEQ ID NO: 373809 - DNA, 16 bp, M. musculus
caagagaggctccttt

SEQ ID NO: 373810 - DNA, 16 bp, M. musculus
caagagatcctgaaga

SEQ ID NO: 373811 - DNA, 28 bp, M. musculus
caagagatttcaaaggagaagaatttca

SEQ ID NO: 373812 - DNA, 16 bp, M. musculus
caagagatttcagagg

SEQ ID NO: 373813 - DNA, 16 bp, M. musculus
caagagcaagagcttt

SEQ ID NO: 373814 - DNA, 16 bp, M. musculus
caagagcacccacatt

SEQ ID NO: 373815 - DNA, 17 bp, M. musculus
caagagcactgactgct

SEQ ID NO: 373816 - DNA, 16 bp, M. musculus
caagagcagaaagtgc

SEQ ID NO: 373817 - DNA, 16 bp, M. musculus
caagagcagcaagggc

SEQ ID NO: 373818 - DNA, 16 bp, M. musculus
caagagcagcaggtgc

SEQ ID NO: 373819 - DNA, 16 bp, M. musculus
caagagccacagagct

SEQ ID NO: 373820 - DNA, 16 bp, M. musculus
caagagccccagagga

SEQ ID NO: 373821 - DNA, 16 bp, M. musculus
caagagcctggtatag

SEQ ID NO: 373822 - DNA, 16 bp, M. musculus
caagagctctctggat

SEQ ID NO: 373823 - DNA, 16 bp, M. musculus
caagagctgaaggagt

SEQ ID NO: 373824 - DNA, 16 bp, M. musculus
caagagctgcttcagg

SEQ ID NO: 373825 - DNA, 16 bp, M. musculus
caagagctggaaagaa

SEQ ID NO: 373826 - DNA, 16 bp, M. musculus
caagagctgtgcccag

SEQ ID NO: 373827 - DNA, 16 bp, M. musculus
caagagcttgaagcag

SEQ ID NO: 373828 - DNA, 16 bp, M. musculus
caagagcttgggtcac

SEQ ID NO: 373829 - DNA, 16 bp, M. musculus
caagaggaaagcttgc

SEQ ID NO: 373830 - DNA, 16 bp, M. musculus
caagaggaactctcca

SEQ ID NO: 373831 - DNA, 16 bp, M. musculus
caagaggaactgagag

SEQ ID NO: 373832 - DNA, 16 bp, M. musculus
caagaggagcagaagg

SEQ ID NO: 373833 - DNA, 16 bp, M. musculus
caagaggatcaatgtg

SEQ ID NO: 373834 - DNA, 16 bp, M. musculus
caagaggatcaggagt

SEQ ID NO: 373835 - DNA, 16 bp, M. musculus
caagaggatctctggg

SEQ ID NO: 373836 - DNA, 16 bp, M. musculus
caagaggatgtctcca

SEQ ID NO: 373837 - DNA, 16 bp, M. musculus
caagaggattgcaagt

SEQ ID NO: 373838 - DNA, 16 bp, M. musculus
caagaggcagagccag

SEQ ID NO: 373839 - DNA, 16 bp, M. musculus
caagaggcagaggcag

SEQ ID NO: 373840 - DNA, 16 bp, M. musculus
caagaggcagaggctg

SEQ ID NO: 373841 - DNA, 16 bp, M. musculus
caagaggccatggttt

SEQ ID NO: 373842 - DNA, 16 bp, M. musculus
caagaggctgaggcag

SEQ ID NO: 373843 - DNA, 16 bp, M. musculus
caagaggctgcacaag

SEQ ID NO: 373844 - DNA, 16 bp, M. musculus
caagagggtaagagag

SEQ ID NO: 373845 - DNA, 16 bp, M. musculus
caagaggtggagcaag

SEQ ID NO: 373846 - DNA, 16 bp, M. musculus
caagaggtggaggcag

SEQ ID NO: 373847 - DNA, 16 bp, M. musculus
caagaggttgaaaact

SEQ ID NO: 373848 - DNA, 16 bp, M. musculus
caagagtcagagaacc

SEQ ID NO: 373849 - DNA, 16 bp, M. musculus
caagagtggacagcct

SEQ ID NO: 373850 - DNA, 16 bp, M. musculus
caagagtgtctgtgtc

SEQ ID NO: 373851 - DNA, 16 bp, M. musculus
caagagttcaaggtca

SEQ ID NO: 373852 - DNA, 16 bp, M. musculus
caagataaaagataca

SEQ ID NO: 373853 - DNA, 16 bp, M. musculus
caagataaacaaaccc

SEQ ID NO: 373854 - DNA, 16 bp, M. musculus
caagatacaagatata

SEQ ID NO: 373855 - DNA, 16 bp, M. musculus
caagatacaattcaca

SEQ ID NO: 373856 - DNA, 16 bp, M. musculus
caagatacagcccaca

SEQ ID NO: 373857 - DNA, 16 bp, M. musculus
caagatagccaatttt

SEQ ID NO: 373858 - DNA, 17 bp, M. musculus
caagataggttgataaa

SEQ ID NO: 373859 - DNA, 16 bp, M. musculus
caagatatatatatat

SEQ ID NO: 373860 - DNA, 16 bp, M. musculus
caagatattttatgtt

SEQ ID NO: 373861 - DNA, 16 bp, M. musculus
caagatcaagatcaag

SEQ ID NO: 373862 - DNA, 16 bp, M. musculus
caagatcaagggcctc

SEQ ID NO: 373863 - DNA, 16 bp, M. musculus
caagatctcactgtgt

SEQ ID NO: 373864 - DNA, 16 bp, M. musculus
caagatctgatgtcct

SEQ ID NO: 373865 - DNA, 16 bp, M. musculus
caagatgaactttcaa

SEQ ID NO: 373866 - DNA, 16 bp, M. musculus
caagatgaatacagct

SEQ ID NO: 373867 - DNA, 16 bp, M. musculus
caagatgacctcaaac

SEQ ID NO: 373868 - DNA, 16 bp, M. musculus
caagatgattctcctg

SEQ ID NO: 373869 - DNA, 16 bp, M. musculus
caagatgatttttttc

SEQ ID NO: 373870 - DNA, 16 bp, M. musculus
caagatgcagaactct

SEQ ID NO: 373871 - DNA, 16 bp, M. musculus
caagatggaatatagg

SEQ ID NO: 373872 - DNA, 16 bp, M. musculus
caagatggacattttt

SEQ ID NO: 373873 - DNA, 17 bp, M. musculus
caagatggcacctggga

SEQ ID NO: 373874 - DNA, 16 bp, M. musculus
caagatggcctcaaat

SEQ ID NO: 373875 - DNA, 16 bp, M. musculus
caagatggcgctgaca

SEQ ID NO: 373876 - DNA, 16 bp, M. musculus
caagatggcgctggct

SEQ ID NO: 373877 - DNA, 16 bp, M. musculus
caagatggctgcagag

SEQ ID NO: 373878 - DNA, 16 bp, M. musculus
caagattcaggtcaga

SEQ ID NO: 373879 - DNA, 16 bp, M. musculus
caagattgctcagtgg

SEQ ID NO: 373880 - DNA, 16 bp, M. musculus
caagatttaaaagaaa

SEQ ID NO: 373881 - DNA, 16 bp, M. musculus
caagattttatctaaa

SEQ ID NO: 373882 - DNA, 16 bp, M. musculus
caagattttgggcttg

SEQ ID NO: 373883 - DNA, 16 bp, M. musculus
caagcaaacttcactg

SEQ ID NO: 373884 - DNA, 16 bp, M. musculus
caagcaaagcaaagca

SEQ ID NO: 373885 - DNA, 16 bp, M. musculus
caagcaaatagtccca

SEQ ID NO: 373886 - DNA, 16 bp, M. musculus
caagcaaatgaaagac

SEQ ID NO: 373887 - DNA, 16 bp, M. musculus
caagcaaatgaacaaa

SEQ ID NO: 373888 - DNA, 16 bp, M. musculus
caagcaaatggatgaa

SEQ ID NO: 373889 - DNA, 16 bp, M. musculus
caagcaacagcacatg

SEQ ID NO: 373890 - DNA, 16 bp, M. musculus
caagcaactccacata

SEQ ID NO: 373891 - DNA, 16 bp, M. musculus
caagcaagcaaagaga

SEQ ID NO: 373892 - DNA, 16 bp, M. musculus
caagcaagcaagcaaa

SEQ ID NO: 373893 - DNA, 16 bp, M. musculus
caagcaagcaagcaga

SEQ ID NO: 373894 - DNA, 16 bp, M. musculus
caagcaagcaagccag

SEQ ID NO: 373895 - DNA, 16 bp, M. musculus
caagcaagcaagctag

SEQ ID NO: 373896 - DNA, 16 bp, M. musculus
caagcaagccagtaaa

SEQ ID NO: 373897 - DNA, 16 bp, M. musculus
caagcaagtgaaagac

SEQ ID NO: 373898 - DNA, 16 bp, M. musculus
caagcacagagagaaa

SEQ ID NO: 373899 - DNA, 16 bp, M. musculus
caagcacagggacctg

SEQ ID NO: 373900 - DNA, 16 bp, M. musculus
caagcacccaggaggc

SEQ ID NO: 373901 - DNA, 16 bp, M. musculus
caagcactccaccact

SEQ ID NO: 373902 - DNA, 16 bp, M. musculus
caagcactctaccagc

SEQ ID NO: 373903 - DNA, 16 bp, M. musculus
caagcactggaattaa

SEQ ID NO: 373904 - DNA, 16 bp, M. musculus
caagcacttcactgag

SEQ ID NO: 373905 - DNA, 16 bp, M. musculus
caagcacttgctgaca

SEQ ID NO: 373906 - DNA, 16 bp, M. musculus
caagcagaaactggtg

SEQ ID NO: 373907 - DNA, 16 bp, M. musculus
caagcagaaagaatgg

SEQ ID NO: 373908 - DNA, 16 bp, M. musculus
caagcagaaccattct

SEQ ID NO: 373909 - DNA, 16 bp, M. musculus
caagcagagactgagc

SEQ ID NO: 373910 - DNA, 16 bp, M. musculus
caagcagcagaactct

SEQ ID NO: 373911 - DNA, 16 bp, M. musculus
caagcagcagcagcag

SEQ ID NO: 373912 - DNA, 16 bp, M. musculus
caagcagccagtgctc

SEQ ID NO: 373913 - DNA, 16 bp, M. musculus
caagcagctgaagggg

SEQ ID NO: 373914 - DNA, 16 bp, M. musculus
caagcaggaactgaag

SEQ ID NO: 373915 - DNA, 16 bp, M. musculus
caagcaggagctgatg

SEQ ID NO: 373916 - DNA, 16 bp, M. musculus
caagcaggaggacctg

SEQ ID NO: 373917 - DNA, 16 bp, M. musculus
caagcaggaggcagag

SEQ ID NO: 373918 - DNA, 16 bp, M. musculus
caagcaggcaaagaaa

SEQ ID NO: 373919 - DNA, 16 bp, M. musculus
caagcaggcaaagagt

SEQ ID NO: 373920 - DNA, 16 bp, M. musculus
caagcaggcacacaca

SEQ ID NO: 373921 - DNA, 16 bp, M. musculus
caagcaggtgaagaag

SEQ ID NO: 373922 - DNA, 16 bp, M. musculus
caagcaggtgaaggag

SEQ ID NO: 373923 - DNA, 16 bp, M. musculus
caagcatcagcaaaag

SEQ ID NO: 373924 - DNA, 16 bp, M. musculus
caagcatccacatctg

SEQ ID NO: 373925 - DNA, 16 bp, M. musculus
caagcatctgtaatga

SEQ ID NO: 373926 - DNA, 16 bp, M. musculus
caagcatgaccttgaa

SEQ ID NO: 373927 - DNA, 16 bp, M. musculus
caagcatgaggatctg

SEQ ID NO: 373928 - DNA, 16 bp, M. musculus
caagcatgaggcagag

SEQ ID NO: 373929 - DNA, 16 bp, M. musculus
caagcatggagacctg

SEQ ID NO: 373930 - DNA, 16 bp, M. musculus
caagcattagcaacag

SEQ ID NO: 373931 - DNA, 16 bp, M. musculus
caagcattaggtggag

SEQ ID NO: 373932 - DNA, 16 bp, M. musculus
caagcattcaaacaca

SEQ ID NO: 373933 - DNA, 16 bp, M. musculus
caagcattcacacata

SEQ ID NO: 373934 - DNA, 16 bp, M. musculus
caagcatttgctgaaa

SEQ ID NO: 373935 - DNA, 16 bp, M. musculus
caagccaagctcagcc

SEQ ID NO: 373936 - DNA, 16 bp, M. musculus
caagccaagctgcaaa

SEQ ID NO: 373937 - DNA, 16 bp, M. musculus
caagccacctcccaaa

SEQ ID NO: 373938 - DNA, 16 bp, M. musculus
caagccagagaatgag

SEQ ID NO: 373939 - DNA, 16 bp, M. musculus
caagccagccaaggct

SEQ ID NO: 373940 - DNA, 16 bp, M. musculus
caagccaggaagcagc

SEQ ID NO: 373941 - DNA, 16 bp, M. musculus
caagccaggcatggtg

SEQ ID NO: 373942 - DNA, 16 bp, M. musculus
caagccaggcccagtc

SEQ ID NO: 373943 - DNA, 16 bp, M. musculus
caagccaggcccagtg

SEQ ID NO: 373944 - DNA, 16 bp, M. musculus
caagccaggcctagtg

SEQ ID NO: 373945 - DNA, 16 bp, M. musculus
caagccaggcctggtg

SEQ ID NO: 373946 - DNA, 16 bp, M. musculus
caagccagtaagcact

SEQ ID NO: 373947 - DNA, 16 bp, M. musculus
caagccagtgaacagc

SEQ ID NO: 373948 - DNA, 16 bp, M. musculus
caagccatctctccag

SEQ ID NO: 373949 - DNA, 16 bp, M. musculus
caagccatggggagca

SEQ ID NO: 373950 - DNA, 16 bp, M. musculus
caagcccaaaatcttg

SEQ ID NO: 373951 - DNA, 16 bp, M. musculus
caagcccaaggacctg

SEQ ID NO: 373952 - DNA, 16 bp, M. musculus
caagcccacagtgaca

SEQ ID NO: 373953 - DNA, 16 bp, M. musculus
caagcccagagtctct

SEQ ID NO: 373954 - DNA, 16 bp, M. musculus
caagcccagggccttg

SEQ ID NO: 373955 - DNA, 16 bp, M. musculus
caagccccaattaaat

SEQ ID NO: 373956 - DNA, 16 bp, M. musculus
caagcctaaaagaaga

SEQ ID NO: 373957 - DNA, 16 bp, M. musculus
caagcctaggctacat

SEQ ID NO: 373958 - DNA, 16 bp, M. musculus
caagcctccctcccct

SEQ ID NO: 373959 - DNA, 16 bp, M. musculus
caagcctgaagaccag

SEQ ID NO: 373960 - DNA, 16 bp, M. musculus
caagcctgaagacctg

SEQ ID NO: 373961 - DNA, 16 bp, M. musculus
caagcctgacaaactg

SEQ ID NO: 373962 - DNA, 16 bp, M. musculus
caagcctgagaacctg

SEQ ID NO: 373963 - DNA, 16 bp, M. musculus
caagcctgagaatctg

SEQ ID NO: 373964 - DNA, 16 bp, M. musculus
caagcctgagattcca

SEQ ID NO: 373965 - DNA, 16 bp, M. musculus
caagcctgaggacatg

SEQ ID NO: 373966 - DNA, 16 bp, M. musculus
caagcctgatgaccta

SEQ ID NO: 373967 - DNA, 16 bp, M. musculus
caagcctgcaatccca

SEQ ID NO: 373968 - DNA, 16 bp, M. musculus
caagcctgcccctggc

SEQ ID NO: 373969 - DNA, 16 bp, M. musculus
caagcctgcctctgcc

SEQ ID NO: 373970 - DNA, 16 bp, M. musculus
caagcctgcctgcctg

SEQ ID NO: 373971 - DNA, 16 bp, M. musculus
caagcctggcaacctg

SEQ ID NO: 373972 - DNA, 16 bp, M. musculus
caagcgagagagagag

SEQ ID NO: 373973 - DNA, 16 bp, M. musculus
caagcgctctctctct

SEQ ID NO: 373974 - DNA, 16 bp, M. musculus
caagcggatctctgtg

SEQ ID NO: 373975 - DNA, 16 bp, M. musculus
caagcgtgcacacaca

SEQ ID NO: 373976 - DNA, 16 bp, M. musculus
caagctaggctccaaa

SEQ ID NO: 373977 - DNA, 16 bp, M. musculus
caagctcaaggtcagc

SEQ ID NO: 373978 - DNA, 16 bp, M. musculus
caagctcaagtccaag

SEQ ID NO: 373979 - DNA, 16 bp, M. musculus
caagctcagcctctgt

SEQ ID NO: 373980 - DNA, 16 bp, M. musculus
caagctcaggattctt

SEQ ID NO: 373981 - DNA, 17 bp, M. musculus
caagctcagggtcggct

SEQ ID NO: 373982 - DNA, 16 bp, M. musculus
caagctccaacaactt

SEQ ID NO: 373983 - DNA, 16 bp, M. musculus
caagctccaggctcag

SEQ ID NO: 373984 - DNA, 16 bp, M. musculus
caagctccatccacta

SEQ ID NO: 373985 - DNA, 16 bp, M. musculus
caagctcctacacagc

SEQ ID NO: 373986 - DNA, 16 bp, M. musculus
caagctcctgttatcc

SEQ ID NO: 373987 - DNA, 16 bp, M. musculus
caagctctaactagag

SEQ ID NO: 373988 - DNA, 16 bp, M. musculus
caagctgaaaaagaaa

SEQ ID NO: 373989 - DNA, 16 bp, M. musculus
caagctgaacaagcca

SEQ ID NO: 373990 - DNA, 16 bp, M. musculus
caagctgacagctctg

SEQ ID NO: 373991 - DNA, 16 bp, M. musculus
caagctgactcgactg

SEQ ID NO: 373992 - DNA, 16 bp, M. musculus
caagctgagaaccact

SEQ ID NO: 373993 - DNA, 16 bp, M. musculus
caagctgagcaagcca

SEQ ID NO: 373994 - DNA, 16 bp, M. musculus
caagctgagccatctc

SEQ ID NO: 373995 - DNA, 16 bp, M. musculus
caagctgcaaatctgc

SEQ ID NO: 373996 - DNA, 16 bp, M. musculus
caagctgcagggctaa

SEQ ID NO: 373997 - DNA, 16 bp, M. musculus
caagctgctccacttc

SEQ ID NO: 373998 - DNA, 16 bp, M. musculus
caagctgctgaaagag

SEQ ID NO: 373999 - DNA, 16 bp, M. musculus
caagctgctgctgctg

SEQ ID NO: 374000 - DNA, 16 bp, M. musculus
caagctgctggcccag

SEQ ID NO: 374001 - DNA, 16 bp, M. musculus
caagctggagagatgg

SEQ ID NO: 374002 - DNA, 16 bp, M. musculus
caagctggagttgcca

SEQ ID NO: 374003 - DNA, 16 bp, M. musculus
caagctggatgtggtg

SEQ ID NO: 374004 - DNA, 16 bp, M. musculus
caagctggctcagcag

SEQ ID NO: 374005 - DNA, 17 bp, M. musculus
caagctggggaggaaag

SEQ ID NO: 374006 - DNA, 16 bp, M. musculus
caagctggggttatca

SEQ ID NO: 374007 - DNA, 16 bp, M. musculus
caagctgtctctggga

SEQ ID NO: 374008 - DNA, 16 bp, M. musculus
caagctgtggaggaaa

SEQ ID NO: 374009 - DNA, 16 bp, M. musculus
caagctgttagtgtaa

SEQ ID NO: 374010 - DNA, 16 bp, M. musculus
caagcttaaggacctg

SEQ ID NO: 374011 - DNA, 16 bp, M. musculus
caagcttaggcagtga

SEQ ID NO: 374012 - DNA, 16 bp, M. musculus
caagcttcttaccatt

SEQ ID NO: 374013 - DNA, 16 bp, M. musculus
caagcttgcaatacca

SEQ ID NO: 374014 - DNA, 16 bp, M. musculus
caagcttggtctcttg

SEQ ID NO: 374015 - DNA, 16 bp, M. musculus
caagctttcacaaggc

SEQ ID NO: 374016 - DNA, 16 bp, M. musculus
caagctttcctctttc

SEQ ID NO: 374017 - DNA, 16 bp, M. musculus
caaggaaacagtgtct

SEQ ID NO: 374018 - DNA, 16 bp, M. musculus
caaggaaacttctctt

SEQ ID NO: 374019 - DNA, 16 bp, M. musculus
caaggaaacttttctt

SEQ ID NO: 374020 - DNA, 16 bp, M. musculus
caaggaaataatttta

SEQ ID NO: 374021 - DNA, 16 bp, M. musculus
caaggaaatacaaatt

SEQ ID NO: 374022 - DNA, 16 bp, M. musculus
caaggaaatcaagaag

SEQ ID NO: 374023 - DNA, 16 bp, M. musculus
caaggaactaaagaga

SEQ ID NO: 374024 - DNA, 16 bp, M. musculus
caaggaactaaaggaa

SEQ ID NO: 374025 - DNA, 16 bp, M. musculus
caaggaactaaaggga

SEQ ID NO: 374026 - DNA, 16 bp, M. musculus
caaggaactcatttca

SEQ ID NO: 374027 - DNA, 16 bp, M. musculus
caaggaacttcacaaa

SEQ ID NO: 374028 - DNA, 16 bp, M. musculus
caaggaagaagaaact

SEQ ID NO: 374029 - DNA, 16 bp, M. musculus
caaggaagaccttgaa

SEQ ID NO: 374030 - DNA, 16 bp, M. musculus
caaggaataccacaaa

SEQ ID NO: 374031 - DNA, 16 bp, M. musculus
caaggaatgaattgta

SEQ ID NO: 374032 - DNA, 16 bp, M. musculus
caaggaattctgggaa

SEQ ID NO: 374033 - DNA, 16 bp, M. musculus
caaggacaaagatgga

SEQ ID NO: 374034 - DNA, 16 bp, M. musculus
caaggacaaccttgaa

SEQ ID NO: 374035 - DNA, 16 bp, M. musculus
caaggacaaggaaatg

SEQ ID NO: 374036 - DNA, 16 bp, M. musculus
caaggacaaggacaag

SEQ ID NO: 374037 - DNA, 16 bp, M. musculus
caaggacacatctcct

SEQ ID NO: 374038 - DNA, 16 bp, M. musculus
caaggacaccagagcc

SEQ ID NO: 374039 - DNA, 16 bp, M. musculus
caaggacagacaaaat

SEQ ID NO: 374040 - DNA, 16 bp, M. musculus
caaggacagcctggtt

SEQ ID NO: 374041 - DNA, 16 bp, M. musculus
caaggacatccacata

SEQ ID NO: 374042 - DNA, 16 bp, M. musculus
caaggacatcctgact

SEQ ID NO: 374043 - DNA, 16 bp, M. musculus
caaggacatgagttac

SEQ ID NO: 374044 - DNA, 16 bp, M. musculus
caaggacatgtgctcc

SEQ ID NO: 374045 - DNA, 16 bp, M. musculus
caaggacatttccagc

SEQ ID NO: 374046 - DNA, 16 bp, M. musculus
caaggaccactcctcc

SEQ ID NO: 374047 - DNA, 16 bp, M. musculus
caaggactctaccaac

SEQ ID NO: 374048 - DNA, 16 bp, M. musculus
caaggactctaccact

SEQ ID NO: 374049 - DNA, 16 bp, M. musculus
caaggagacagaaatg

SEQ ID NO: 374050 - DNA, 16 bp, M. musculus
caaggagacagagaga

SEQ ID NO: 374051 - DNA, 16 bp, M. musculus
caaggagaccagaaga

SEQ ID NO: 374052 - DNA, 16 bp, M. musculus
caaggagatctctgag

SEQ ID NO: 374053 - DNA, 16 bp, M. musculus
caaggagcagaagggg

SEQ ID NO: 374054 - DNA, 16 bp, M. musculus
caaggagccctgtggc

SEQ ID NO: 374055 - DNA, 16 bp, M. musculus
caaggagctaacgggg

SEQ ID NO: 374056 - DNA, 16 bp, M. musculus
caaggagctcaaggga

SEQ ID NO: 374057 - DNA, 16 bp, M. musculus
caaggagctgaacggg

SEQ ID NO: 374058 - DNA, 16 bp, M. musculus
caaggagctgaagagg

SEQ ID NO: 374059 - DNA, 16 bp, M. musculus
caaggagctgaagcag

SEQ ID NO: 374060 - DNA, 16 bp, M. musculus
caaggagctgaaggaa

SEQ ID NO: 374061 - DNA, 16 bp, M. musculus
caaggagctgaaggag

SEQ ID NO: 374062 - DNA, 16 bp, M. musculus
caaggagctgaaggga

SEQ ID NO: 374063 - DNA, 16 bp, M. musculus
caaggagctgggggaa

SEQ ID NO: 374064 - DNA, 16 bp, M. musculus
caaggagctggttctt

SEQ ID NO: 374065 - DNA, 16 bp, M. musculus
caaggaggaatgaagt

SEQ ID NO: 374066 - DNA, 16 bp, M. musculus
caaggaggagctgctg

SEQ ID NO: 374067 - DNA, 16 bp, M. musculus
caaggaggcagagaca

SEQ ID NO: 374068 - DNA, 16 bp, M. musculus
caaggaggccagagag

SEQ ID NO: 374069 - DNA, 16 bp, M. musculus
caaggaggctggagag

SEQ ID NO: 374070 - DNA, 16 bp, M. musculus
caaggaggtgaagggg

SEQ ID NO: 374071 - DNA, 16 bp, M. musculus
caaggaggtggggagg

SEQ ID NO: 374072 - DNA, 16 bp, M. musculus
caaggaggttttattc

SEQ ID NO: 374073 - DNA, 16 bp, M. musculus
caaggagtgcttgctg

SEQ ID NO: 374074 - DNA, 17 bp, M. musculus
caaggagtggccagagc

SEQ ID NO: 374075 - DNA, 16 bp, M. musculus
caaggataaccttgaa

SEQ ID NO: 374076 - DNA, 16 bp, M. musculus
caaggatatggagaaa

SEQ ID NO: 374077 - DNA, 16 bp, M. musculus
caaggatgagaagatc

SEQ ID NO: 374078 - DNA, 16 bp, M. musculus
caaggatgatcttgaa

SEQ ID NO: 374079 - DNA, 16 bp, M. musculus
caaggatgcccacttt

SEQ ID NO: 374080 - DNA, 16 bp, M. musculus
caaggatggctttgaa

SEQ ID NO: 374081 - DNA, 16 bp, M. musculus
caaggatgtgaagaaa

SEQ ID NO: 374082 - DNA, 16 bp, M. musculus
caaggatgtggaaaaa

SEQ ID NO: 374083 - DNA, 16 bp, M. musculus
caaggatgtggagaaa

SEQ ID NO: 374084 - DNA, 16 bp, M. musculus
caaggatgtggaggaa

SEQ ID NO: 374085 - DNA, 16 bp, M. musculus
caaggatgtggtgaaa

SEQ ID NO: 374086 - DNA, 16 bp, M. musculus
caaggatttaaagtaa

SEQ ID NO: 374087 - DNA, 16 bp, M. musculus
caaggatttttgcctg

SEQ ID NO: 374088 - DNA, 16 bp, M. musculus
caaggcaaaagacaca

SEQ ID NO: 374089 - DNA, 16 bp, M. musculus
caaggcaactgttgag

SEQ ID NO: 374090 - DNA, 16 bp, M. musculus
caaggcaagcatttta

SEQ ID NO: 374091 - DNA, 16 bp, M. musculus
caaggcagccagagct

SEQ ID NO: 374092 - DNA, 16 bp, M. musculus
caaggcagccagggct

SEQ ID NO: 374093 - DNA, 16 bp, M. musculus
caaggcagcctggtct

SEQ ID NO: 374094 - DNA, 16 bp, M. musculus
caaggcaggaaaatgg

SEQ ID NO: 374095 - DNA, 16 bp, M. musculus
caaggcaggaagcaag

SEQ ID NO: 374096 - DNA, 16 bp, M. musculus
caaggcattgtggaaa

SEQ ID NO: 374097 - DNA, 16 bp, M. musculus
caaggccaagaagcag

SEQ ID NO: 374098 - DNA, 16 bp, M. musculus
caaggccacaccttca

SEQ ID NO: 374099 - DNA, 16 bp, M. musculus
caaggccacagcttct

SEQ ID NO: 374100 - DNA, 16 bp, M. musculus
caaggccacgcccact

SEQ ID NO: 374101 - DNA, 16 bp, M. musculus
caaggccagccacatt

SEQ ID NO: 374102 - DNA, 16 bp, M. musculus
caaggccagccagaga

SEQ ID NO: 374103 - DNA, 16 bp, M. musculus
caaggccagcctcaac

SEQ ID NO: 374104 - DNA, 16 bp, M. musculus
caaggccagcctcagc

SEQ ID NO: 374105 - DNA, 16 bp, M. musculus
caaggccagcctgctc

SEQ ID NO: 374106 - DNA, 16 bp, M. musculus
caaggccagcctggga

SEQ ID NO: 374107 - DNA, 16 bp, M. musculus
caaggccagcctggta

SEQ ID NO: 374108 - DNA, 16 bp, M. musculus
caaggccagccttgaa

SEQ ID NO: 374109 - DNA, 16 bp, M. musculus
caaggccaggaagcag

SEQ ID NO: 374110 - DNA, 16 bp, M. musculus
caaggccaggctggga

SEQ ID NO: 374111 - DNA, 16 bp, M. musculus
caaggccatcctggga

SEQ ID NO: 374112 - DNA, 16 bp, M. musculus
caaggccatggctgag

SEQ ID NO: 374113 - DNA, 16 bp, M. musculus
caaggccattctcagc

SEQ ID NO: 374114 - DNA, 16 bp, M. musculus
caaggccattctttgc

SEQ ID NO: 374115 - DNA, 16 bp, M. musculus
caaggcccaggagaaa

SEQ ID NO: 374116 - DNA, 16 bp, M. musculus
caaggccctgggctca

SEQ ID NO: 374117 - DNA, 16 bp, M. musculus
caaggcctatgtagat

SEQ ID NO: 374118 - DNA, 16 bp, M. musculus
caaggccttgggttca

SEQ ID NO: 374119 - DNA, 16 bp, M. musculus
caaggctaaacagaga

SEQ ID NO: 374120 - DNA, 16 bp, M. musculus
caaggctacacagaaa

SEQ ID NO: 374121 - DNA, 16 bp, M. musculus
caaggctacacctcca

SEQ ID NO: 374122 - DNA, 16 bp, M. musculus
caaggctacagagaaa

SEQ ID NO: 374123 - DNA, 16 bp, M. musculus
caaggctagcctggaa

SEQ ID NO: 374124 - DNA, 16 bp, M. musculus
caaggctagcctggac

SEQ ID NO: 374125 - DNA, 16 bp, M. musculus
caaggctatcctgggc

SEQ ID NO: 374126 - DNA, 16 bp, M. musculus
caaggctattggttgc

SEQ ID NO: 374127 - DNA, 16 bp, M. musculus
caaggctcaagctcag

SEQ ID NO: 374128 - DNA, 16 bp, M. musculus
caaggctcagagacca

SEQ ID NO: 374129 - DNA, 16 bp, M. musculus
caaggctcagagatca

SEQ ID NO: 374130 - DNA, 16 bp, M. musculus
caaggctcagggaaca

SEQ ID NO: 374131 - DNA, 16 bp, M. musculus
caaggctccagccaca

SEQ ID NO: 374132 - DNA, 16 bp, M. musculus
caaggctctgccagtg

SEQ ID NO: 374133 - DNA, 16 bp, M. musculus
caaggctcttccctac

SEQ ID NO: 374134 - DNA, 16 bp, M. musculus
caaggctgaagagatg

SEQ ID NO: 374135 - DNA, 16 bp, M. musculus
caaggctgacaacctg

SEQ ID NO: 374136 - DNA, 16 bp, M. musculus
caaggctgacctggaa

SEQ ID NO: 374137 - DNA, 16 bp, M. musculus
caaggctgagaacctg

SEQ ID NO: 374138 - DNA, 16 bp, M. musculus
caaggctggaacctgg

SEQ ID NO: 374139 - DNA, 16 bp, M. musculus
caaggctggaggaagg

SEQ ID NO: 374140 - DNA, 16 bp, M. musculus
caaggctggcctagaa

SEQ ID NO: 374141 - DNA, 16 bp, M. musculus
caaggctggcctggtc

SEQ ID NO: 374142 - DNA, 17 bp, M. musculus
caaggctgtcaaggagg

SEQ ID NO: 374143 - DNA, 16 bp, M. musculus
caaggctgtcttctga

SEQ ID NO: 374144 - DNA, 16 bp, M. musculus
caaggctgttgaggag

SEQ ID NO: 374145 - DNA, 16 bp, M. musculus
caaggcttcccactct

SEQ ID NO: 374146 - DNA, 16 bp, M. musculus
caaggcttctgtaagg

SEQ ID NO: 374147 - DNA, 16 bp, M. musculus
caagggaagccaaggc

SEQ ID NO: 374148 - DNA, 16 bp, M. musculus
caagggaagctgggag

SEQ ID NO: 374149 - DNA, 16 bp, M. musculus
caagggacagagccag

SEQ ID NO: 374150 - DNA, 16 bp, M. musculus
caagggaggttaaagt

SEQ ID NO: 374151 - DNA, 16 bp, M. musculus
caagggataggcccag

SEQ ID NO: 374152 - DNA, 16 bp, M. musculus
caagggatctaacacc

SEQ ID NO: 374153 - DNA, 16 bp, M. musculus
caagggattggttatt

SEQ ID NO: 374154 - DNA, 21 bp, M. musculus
caagggcagccacattcatta

SEQ ID NO: 374155 - DNA, 16 bp, M. musculus
caagggcagcctcatt

SEQ ID NO: 374156 - DNA, 16 bp, M. musculus
caagggcagggaggtg

SEQ ID NO: 374157 - DNA, 16 bp, M. musculus
caagggcctctcccat

SEQ ID NO: 374158 - DNA, 16 bp, M. musculus
caagggcctggagaga

SEQ ID NO: 374159 - DNA, 16 bp, M. musculus
caagggctgcacagag

SEQ ID NO: 374160 - DNA, 16 bp, M. musculus
caagggctggagagat

SEQ ID NO: 374161 - DNA, 16 bp, M. musculus
caagggcttctccttc

SEQ ID NO: 374162 - DNA, 16 bp, M. musculus
caagggctttcacacc

SEQ ID NO: 374163 - DNA, 16 bp, M. musculus
caaggggaaaaaaaat

SEQ ID NO: 374164 - DNA, 16 bp, M. musculus
caaggggaagcaggaa

SEQ ID NO: 374165 - DNA, 16 bp, M. musculus
caaggggaaggcagag

SEQ ID NO: 374166 - DNA, 16 bp, M. musculus
caaggggacctcctcc

SEQ ID NO: 374167 - DNA, 16 bp, M. musculus
caaggggcctcccccg

SEQ ID NO: 374168 - DNA, 16 bp, M. musculus
caaggggctggggaga

SEQ ID NO: 374169 - DNA, 16 bp, M. musculus
caaggggcttttcccc

SEQ ID NO: 374170 - DNA, 16 bp, M. musculus
caagggggagggccca

SEQ ID NO: 374171 - DNA, 16 bp, M. musculus
caagggtaaaagaacc

SEQ ID NO: 374172 - DNA, 16 bp, M. musculus
caagggtctcccctcc

SEQ ID NO: 374173 - DNA, 16 bp, M. musculus
caagggtgaagggcag

SEQ ID NO: 374174 - DNA, 16 bp, M. musculus
caagggtgctaaaacc

SEQ ID NO: 374175 - DNA, 16 bp, M. musculus
caagggtggcaccacc

SEQ ID NO: 374176 - DNA, 16 bp, M. musculus
caagggtggggaggca

SEQ ID NO: 374177 - DNA, 16 bp, M. musculus
caagggtgtgtgtgtg

SEQ ID NO: 374178 - DNA, 16 bp, M. musculus
caagggtttttttttt

SEQ ID NO: 374179 - DNA, 16 bp, M. musculus
caaggtattttttatt

SEQ ID NO: 374180 - DNA, 16 bp, M. musculus
caaggtcaaggtcaag

SEQ ID NO: 374181 - DNA, 16 bp, M. musculus
caaggtcaccctcaac

SEQ ID NO: 374182 - DNA, 16 bp, M. musculus
caaggtcagagaagaa

SEQ ID NO: 374183 - DNA, 16 bp, M. musculus
caaggtcagcctggtg

SEQ ID NO: 374184 - DNA, 16 bp, M. musculus
caaggtcagggcagtt

SEQ ID NO: 374185 - DNA, 16 bp, M. musculus
caaggtcagtctggga

SEQ ID NO: 374186 - DNA, 16 bp, M. musculus
caaggtcatccttgcc

SEQ ID NO: 374187 - DNA, 16 bp, M. musculus
caaggtcccaaaggca

SEQ ID NO: 374188 - DNA, 16 bp, M. musculus
caaggtcccacacagg

SEQ ID NO: 374189 - DNA, 16 bp, M. musculus
caaggtccccacagga

SEQ ID NO: 374190 - DNA, 16 bp, M. musculus
caaggtcctcaatgaa

SEQ ID NO: 374191 - DNA, 16 bp, M. musculus
caaggtcctcttctcc

SEQ ID NO: 374192 - DNA, 16 bp, M. musculus
caaggtctatttcctt

SEQ ID NO: 374193 - DNA, 16 bp, M. musculus
caaggtctcacaatgt

SEQ ID NO: 374194 - DNA, 16 bp, M. musculus
caaggtctcactgtat

SEQ ID NO: 374195 - DNA, 16 bp, M. musculus
caaggtctctgggcct

SEQ ID NO: 374196 - DNA, 16 bp, M. musculus
caaggtctgcacaagc

SEQ ID NO: 374197 - DNA, 16 bp, M. musculus
caaggtcttgctgtgt

SEQ ID NO: 374198 - DNA, 16 bp, M. musculus
caaggtgaaaaaacta

SEQ ID NO: 374199 - DNA, 16 bp, M. musculus
caaggtgaaccaatgc

SEQ ID NO: 374200 - DNA, 16 bp, M. musculus
caaggtgacccagtgc

SEQ ID NO: 374201 - DNA, 16 bp, M. musculus
caaggtgacctggagc

SEQ ID NO: 374202 - DNA, 16 bp, M. musculus
caaggtgaccttgaac

SEQ ID NO: 374203 - DNA, 16 bp, M. musculus
caaggtgactcttata

SEQ ID NO: 374204 - DNA, 16 bp, M. musculus
caaggtgcctctcttc

SEQ ID NO: 374205 - DNA, 16 bp, M. musculus
caaggtgctcctctct

SEQ ID NO: 374206 - DNA, 16 bp, M. musculus
caaggtggacaagaaa

SEQ ID NO: 374207 - DNA, 16 bp, M. musculus
caaggtggatggcacc

SEQ ID NO: 374208 - DNA, 16 bp, M. musculus
caaggtgggacagtct

SEQ ID NO: 374209 - DNA, 16 bp, M. musculus
caaggttcaaatgttt

SEQ ID NO: 374210 - DNA, 16 bp, M. musculus
caaggttcccagagga

SEQ ID NO: 374211 - DNA, 16 bp, M. musculus
caaggttctctcctcc

SEQ ID NO: 374212 - DNA, 16 bp, M. musculus
caaggttgtacttcat

SEQ ID NO: 374213 - DNA, 16 bp, M. musculus
caagtaaagaagtgtg

SEQ ID NO: 374214 - DNA, 16 bp, M. musculus
caagtaccaggacagc

SEQ ID NO: 374215 - DNA, 16 bp, M. musculus
caagtacctttacctg

SEQ ID NO: 374216 - DNA, 16 bp, M. musculus
caagtactctaccaat

SEQ ID NO: 374217 - DNA, 17 bp, M. musculus
caagtactgggattaag

SEQ ID NO: 374218 - DNA, 16 bp, M. musculus
caagtacttcttggca

SEQ ID NO: 374219 - DNA, 16 bp, M. musculus
caagtactttaccact

SEQ ID NO: 374220 - DNA, 16 bp, M. musculus
caagtagagggatggg

SEQ ID NO: 374221 - DNA, 16 bp, M. musculus
caagtaggctaggctg

SEQ ID NO: 374222 - DNA, 16 bp, M. musculus
caagtatacacacaca

SEQ ID NO: 374223 - DNA, 16 bp, M. musculus
caagtatgaggacctg

SEQ ID NO: 374224 - DNA, 16 bp, M. musculus
caagtatgtggagaaa

SEQ ID NO: 374225 - DNA, 16 bp, M. musculus
caagtatgtggtggac

SEQ ID NO: 374226 - DNA, 16 bp, M. musculus
caagtattcaaacata

SEQ ID NO: 374227 - DNA, 16 bp, M. musculus
caagtatttattgagt

SEQ ID NO: 374228 - DNA, 16 bp, M. musculus
caagtcacctttatta

SEQ ID NO: 374229 - DNA, 16 bp, M. musculus
caagtcactgcaggat

SEQ ID NO: 374230 - DNA, 16 bp, M. musculus
caagtcagaaagcagg

SEQ ID NO: 374231 - DNA, 16 bp, M. musculus
caagtcagaggaagca

SEQ ID NO: 374232 - DNA, 16 bp, M. musculus
caagtcagcctgggct

SEQ ID NO: 374233 - DNA, 16 bp, M. musculus
caagtcagtcctctgc

SEQ ID NO: 374234 - DNA, 16 bp, M. musculus
caagtcatcctctgac

SEQ ID NO: 374235 - DNA, 16 bp, M. musculus
caagtccacagcagat

SEQ ID NO: 374236 - DNA, 16 bp, M. musculus
caagtcccagcaccca

SEQ ID NO: 374237 - DNA, 16 bp, M. musculus
caagtcccaggacagc

SEQ ID NO: 374238 - DNA, 16 bp, M. musculus
caagtcccaggatgag

SEQ ID NO: 374239 - DNA, 16 bp, M. musculus
caagtcccagggatcc

SEQ ID NO: 374240 - DNA, 16 bp, M. musculus
caagtcctctgcagga

SEQ ID NO: 374241 - DNA, 16 bp, M. musculus
caagtcctctggaaga

SEQ ID NO: 374242 - DNA, 16 bp, M. musculus
caagtccttagagaaa

SEQ ID NO: 374243 - DNA, 16 bp, M. musculus
caagtccttggaggag

SEQ ID NO: 374244 - DNA, 17 bp, M. musculus
caagtcggaaagctgca

SEQ ID NO: 374245 - DNA, 16 bp, M. musculus
caagtctctcaagagt

SEQ ID NO: 374246 - DNA, 16 bp, M. musculus
caagtctctgcaggac

SEQ ID NO: 374247 - DNA, 16 bp, M. musculus
caagtctgagaccagc

SEQ ID NO: 374248 - DNA, 16 bp, M. musculus
caagtcttgcttttcc

SEQ ID NO: 374249 - DNA, 16 bp, M. musculus
caagtgaaaaatctgt

SEQ ID NO: 374250 - DNA, 16 bp, M. musculus
caagtgaaaacaagaa

SEQ ID NO: 374251 - DNA, 16 bp, M. musculus
caagtgaataaataac

SEQ ID NO: 374252 - DNA, 16 bp, M. musculus
caagtgaatgatctgt

SEQ ID NO: 374253 - DNA, 16 bp, M. musculus
caagtgaccataggtt

SEQ ID NO: 374254 - DNA, 16 bp, M. musculus
caagtgaccatatgtg

SEQ ID NO: 374255 - DNA, 16 bp, M. musculus
caagtgagagaccctg

SEQ ID NO: 374256 - DNA, 16 bp, M. musculus
caagtgatatcttggg

SEQ ID NO: 374257 - DNA, 16 bp, M. musculus
caagtgattttttttt

SEQ ID NO: 374258 - DNA, 16 bp, M. musculus
caagtgcaagagtgaa

SEQ ID NO: 374259 - DNA, 16 bp, M. musculus
caagtgcaagggcacc

SEQ ID NO: 374260 - DNA, 16 bp, M. musculus
caagtgcatgctggga

SEQ ID NO: 374261 - DNA, 16 bp, M. musculus
caagtgctgcagctgg

SEQ ID NO: 374262 - DNA, 16 bp, M. musculus
caagtgctggaaataa

SEQ ID NO: 374263 - DNA, 16 bp, M. musculus
caagtgctggaatgaa

SEQ ID NO: 374264 - DNA, 16 bp, M. musculus
caagtgctgggattac

SEQ ID NO: 374265 - DNA, 16 bp, M. musculus
caagtgctgggattga

SEQ ID NO: 374266 - DNA, 16 bp, M. musculus
caagtgctgtgattaa

SEQ ID NO: 374267 - DNA, 16 bp, M. musculus
caagtgcttctaacca

SEQ ID NO: 374268 - DNA, 16 bp, M. musculus
caagtgctttactgac

SEQ ID NO: 374269 - DNA, 16 bp, M. musculus
caagtggaaacaaaga

SEQ ID NO: 374270 - DNA, 16 bp, M. musculus
caagtggatcaaaaac

SEQ ID NO: 374271 - DNA, 16 bp, M. musculus
caagtggatctctgtg

SEQ ID NO: 374272 - DNA, 16 bp, M. musculus
caagtggatgaaggac

SEQ ID NO: 374273 - DNA, 16 bp, M. musculus
caagtggcagaggcag

SEQ ID NO: 374274 - DNA, 16 bp, M. musculus
caagtgggaagggagg

SEQ ID NO: 374275 - DNA, 16 bp, M. musculus
caagtgggactgagga

SEQ ID NO: 374276 - DNA, 16 bp, M. musculus
caagtggggagagagg

SEQ ID NO: 374277 - DNA, 16 bp, M. musculus
caagtggggtcagtgg

SEQ ID NO: 374278 - DNA, 16 bp, M. musculus
caagtggttgtgagct

SEQ ID NO: 374279 - DNA, 16 bp, M. musculus
caagtgtatcaaggac

SEQ ID NO: 374280 - DNA, 16 bp, M. musculus
caagtgtccttaccca

SEQ ID NO: 374281 - DNA, 16 bp, M. musculus
caagtgtgaggccagc

SEQ ID NO: 374282 - DNA, 16 bp, M. musculus
caagtgtgtgccatca

SEQ ID NO: 374283 - DNA, 16 bp, M. musculus
caagtgtgtgtgtgca

SEQ ID NO: 374284 - DNA, 16 bp, M. musculus
caagtgttacatacag

SEQ ID NO: 374285 - DNA, 16 bp, M. musculus
caagtgttctaccact

SEQ ID NO: 374286 - DNA, 16 bp, M. musculus
caagttattaattcaa

SEQ ID NO: 374287 - DNA, 16 bp, M. musculus
caagttcaaaaccagc

SEQ ID NO: 374288 - DNA, 16 bp, M. musculus
caagttcaaaccctgg

SEQ ID NO: 374289 - DNA, 16 bp, M. musculus
caagttcaaatcccag

SEQ ID NO: 374290 - DNA, 16 bp, M. musculus
caagttcaaggacagc

SEQ ID NO: 374291 - DNA, 16 bp, M. musculus
caagttcaaggccagt

SEQ ID NO: 374292 - DNA, 16 bp, M. musculus
caagttcaaggctacc

SEQ ID NO: 374293 - DNA, 16 bp, M. musculus
caagttcaaggctagc

SEQ ID NO: 374294 - DNA, 16 bp, M. musculus
caagttcaaggtcacc

SEQ ID NO: 374295 - DNA, 16 bp, M. musculus
caagttcaaggtcagc

SEQ ID NO: 374296 - DNA, 16 bp, M. musculus
caagttcactggcccc

SEQ ID NO: 374297 - DNA, 16 bp, M. musculus
caagttcagcaaagtg

SEQ ID NO: 374298 - DNA, 16 bp, M. musculus
caagttcagctgccag

SEQ ID NO: 374299 - DNA, 16 bp, M. musculus
caagttcagtttccag

SEQ ID NO: 374300 - DNA, 16 bp, M. musculus
caagttcatggccagc

SEQ ID NO: 374301 - DNA, 16 bp, M. musculus
caagttccaatttttc

SEQ ID NO: 374302 - DNA, 16 bp, M. musculus
caagttccaggccatc

SEQ ID NO: 374303 - DNA, 16 bp, M. musculus
caagttccctctccct

SEQ ID NO: 374304 - DNA, 16 bp, M. musculus
caagttcctggacagc

SEQ ID NO: 374305 - DNA, 16 bp, M. musculus
caagttctaaggagtc

SEQ ID NO: 374306 - DNA, 16 bp, M. musculus
caagttctctttcaca

SEQ ID NO: 374307 - DNA, 16 bp, M. musculus
caagttgacataaaat

SEQ ID NO: 374308 - DNA, 16 bp, M. musculus
caagttgcagtaagac

SEQ ID NO: 374309 - DNA, 16 bp, M. musculus
caagttgccctctgac

SEQ ID NO: 374310 - DNA, 16 bp, M. musculus
caagttgcttttgatc

SEQ ID NO: 374311 - DNA, 16 bp, M. musculus
caagttggagtagcca

SEQ ID NO: 374312 - DNA, 16 bp, M. musculus
caagttgggaaggaag

SEQ ID NO: 374313 - DNA, 16 bp, M. musculus
caagttgggcctgtca

SEQ ID NO: 374314 - DNA, 16 bp, M. musculus
caagttggggatgaaa

SEQ ID NO: 374315 - DNA, 16 bp, M. musculus
caagttgtcctctcac

SEQ ID NO: 374316 - DNA, 16 bp, M. musculus
caagtttaaggccaac

SEQ ID NO: 374317 - DNA, 16 bp, M. musculus
caagtttgaggccaac

SEQ ID NO: 374318 - DNA, 16 bp, M. musculus
caagtttgaggtcaac

SEQ ID NO: 374319 - DNA, 16 bp, M. musculus
caagtttgatctttgc

SEQ ID NO: 374320 - DNA, 16 bp, M. musculus
caagtttggcagcaag

SEQ ID NO: 374321 - DNA, 16 bp, M. musculus
caagtttggttcctag

SEQ ID NO: 374322 - DNA, 16 bp, M. musculus
caagtttgtaaaagaa

SEQ ID NO: 374323 - DNA, 16 bp, M. musculus
caagtttgtaatccca

SEQ ID NO: 374324 - DNA, 16 bp, M. musculus
caagttttaaaaatta

SEQ ID NO: 374325 - DNA, 16 bp, M. musculus
caataaaaactttaag

SEQ ID NO: 374326 - DNA, 16 bp, M. musculus
caataaaacaactgaa

SEQ ID NO: 374327 - DNA, 16 bp, M. musculus
caataaaaccatctgg

SEQ ID NO: 374328 - DNA, 16 bp, M. musculus
caataaaaccctgact

SEQ ID NO: 374329 - DNA, 16 bp, M. musculus
caataaaagaactact

SEQ ID NO: 374330 - DNA, 16 bp, M. musculus
caataaaagaatttct

SEQ ID NO: 374331 - DNA, 16 bp, M. musculus
caataaaagcccagga

SEQ ID NO: 374332 - DNA, 17 bp, M. musculus
caataaaagccttgcaa

SEQ ID NO: 374333 - DNA, 16 bp, M. musculus
caataaaatcatagaa

SEQ ID NO: 374334 - DNA, 16 bp, M. musculus
caataaaatcattttt

SEQ ID NO: 374335 - DNA, 16 bp, M. musculus
caataaaatgactcct

SEQ ID NO: 374336 - DNA, 16 bp, M. musculus
caataaaatgctttct

SEQ ID NO: 374337 - DNA, 16 bp, M. musculus
caataaacctctccca

SEQ ID NO: 374338 - DNA, 16 bp, M. musculus
caataaagaaaatgca

SEQ ID NO: 374339 - DNA, 16 bp, M. musculus
caataaagaaagcaca

SEQ ID NO: 374340 - DNA, 16 bp, M. musculus
caataaagatagagaa

SEQ ID NO: 374341 - DNA, 16 bp, M. musculus
caataaagatgctagt

SEQ ID NO: 374342 - DNA, 16 bp, M. musculus
caataaagctctaaag

SEQ ID NO: 374343 - DNA, 16 bp, M. musculus
caataaaggaaaccca

SEQ ID NO: 374344 - DNA, 16 bp, M. musculus
caataaatatttattg

SEQ ID NO: 374345 - DNA, 16 bp, M. musculus
caataaatatttgtca

SEQ ID NO: 374346 - DNA, 16 bp, M. musculus
caataaatctttttaa

SEQ ID NO: 374347 - DNA, 16 bp, M. musculus
caataaatgtaatttt

SEQ ID NO: 374348 - DNA, 16 bp, M. musculus
caataacagaatgcca

SEQ ID NO: 374349 - DNA, 16 bp, M. musculus
caataacagcagcagc

SEQ ID NO: 374350 - DNA, 16 bp, M. musculus
caataaccagcccaac

SEQ ID NO: 374351 - DNA, 16 bp, M. musculus
caataacttcaagttt

SEQ ID NO: 374352 - DNA, 16 bp, M. musculus
caataagacaaaaatg

SEQ ID NO: 374353 - DNA, 16 bp, M. musculus
caataagactaggcac

SEQ ID NO: 374354 - DNA, 16 bp, M. musculus
caataaggaaatcaca

SEQ ID NO: 374355 - DNA, 16 bp, M. musculus
caataataaacatttt

SEQ ID NO: 374356 - DNA, 16 bp, M. musculus
caataatacaagtgac

SEQ ID NO: 374357 - DNA, 16 bp, M. musculus
caataatcaacaaatg

SEQ ID NO: 374358 - DNA, 16 bp, M. musculus
caataatgatgataat

SEQ ID NO: 374359 - DNA, 16 bp, M. musculus
caatacagtacttgaa

SEQ ID NO: 374360 - DNA, 16 bp, M. musculus
caatacctcagtccct

SEQ ID NO: 374361 - DNA, 31 bp, M. musculus
caatacctctcctgggcatatatccagaaga

SEQ ID NO: 374362 - DNA, 16 bp, M. musculus
caatagaaaagaaagt

SEQ ID NO: 374363 - DNA, 16 bp, M. musculus
caatagaaagcaaagt

SEQ ID NO: 374364 - DNA, 16 bp, M. musculus
caatagactagaattg

SEQ ID NO: 374365 - DNA, 16 bp, M. musculus
caatagctcttcagct

SEQ ID NO: 374366 - DNA, 16 bp, M. musculus
caatagctgactctga

SEQ ID NO: 374367 - DNA, 16 bp, M. musculus
caataggtcactggcc

SEQ ID NO: 374368 - DNA, 16 bp, M. musculus
caataggttttttttt

SEQ ID NO: 374369 - DNA, 16 bp, M. musculus
caatagttacaaaaaa

SEQ ID NO: 374370 - DNA, 16 bp, M. musculus
caatatattcaaagag

SEQ ID NO: 374371 - DNA, 16 bp, M. musculus
caatatattttcatca

SEQ ID NO: 374372 - DNA, 16 bp, M. musculus
caatatcattccacaa

SEQ ID NO: 374373 - DNA, 16 bp, M. musculus
caatatcccttcatgt

SEQ ID NO: 374374 - DNA, 16 bp, M. musculus
caatatgtacttaaaa

SEQ ID NO: 374375 - DNA, 16 bp, M. musculus
caatattaatgatact

SEQ ID NO: 374376 - DNA, 16 bp, M. musculus
caatattcctcaaact

SEQ ID NO: 374377 - DNA, 16 bp, M. musculus
caatatttacatgttt

SEQ ID NO: 374378 - DNA, 16 bp, M. musculus
caatatttgatcttac

SEQ ID NO: 374379 - DNA, 16 bp, M. musculus
caatatttgctttgag

SEQ ID NO: 374380 - DNA, 16 bp, M. musculus
caatattttggtatct

SEQ ID NO: 374381 - DNA, 16 bp, M. musculus
caatcaaagaaaatga

SEQ ID NO: 374382 - DNA, 16 bp, M. musculus
caatcaaagccaactg

SEQ ID NO: 374383 - DNA, 16 bp, M. musculus
caatcaagaaaatatc

SEQ ID NO: 374384 - DNA, 16 bp, M. musculus
caatcaagacaatccc

SEQ ID NO: 374385 - DNA, 16 bp, M. musculus
caatcaaggaaaccca

SEQ ID NO: 374386 - DNA, 16 bp, M. musculus
caatcacaaaagagct

SEQ ID NO: 374387 - DNA, 17 bp, M. musculus
caatcacaaaggaactc

SEQ ID NO: 374388 - DNA, 16 bp, M. musculus
caatcacaaggacaag

SEQ ID NO: 374389 - DNA, 16 bp, M. musculus
caatcacaggcctgcc

SEQ ID NO: 374390 - DNA, 16 bp, M. musculus
caatcaccatagatgg

SEQ ID NO: 374391 - DNA, 16 bp, M. musculus
caatcacctatggaag

SEQ ID NO: 374392 - DNA, 18 bp, M. musculus
caatcacgaaagaactca

SEQ ID NO: 374393 - DNA, 16 bp, M. musculus
caatcactaattaaga

SEQ ID NO: 374394 - DNA, 16 bp, M. musculus
caatcagaaagtgatt

SEQ ID NO: 374395 - DNA, 16 bp, M. musculus
caatcagagatgatgc

SEQ ID NO: 374396 - DNA, 16 bp, M. musculus
caatcagatgagagaa

SEQ ID NO: 374397 - DNA, 16 bp, M. musculus
caatcagtgctcttaa

SEQ ID NO: 374398 - DNA, 16 bp, M. musculus
caatcataaatcaaga

SEQ ID NO: 374399 - DNA, 16 bp, M. musculus
caatcatcaggagcaa

SEQ ID NO: 374400 - DNA, 16 bp, M. musculus
caatcatcaggagcag

SEQ ID NO: 374401 - DNA, 16 bp, M. musculus
caatccacagaactca

SEQ ID NO: 374402 - DNA, 16 bp, M. musculus
caatccagaaatgaag

SEQ ID NO: 374403 - DNA, 16 bp, M. musculus
caatccaggctgttgc

SEQ ID NO: 374404 - DNA, 16 bp, M. musculus
caatccatcctagagg

SEQ ID NO: 374405 - DNA, 16 bp, M. musculus
caatccatgagcaggg

SEQ ID NO: 374406 - DNA, 16 bp, M. musculus
caatcccagcactcag

SEQ ID NO: 374407 - DNA, 16 bp, M. musculus
caatcccagcattcaa

SEQ ID NO: 374408 - DNA, 16 bp, M. musculus
caatcccagcattcag

SEQ ID NO: 374409 - DNA, 16 bp, M. musculus
caatcccagcatttgg

SEQ ID NO: 374410 - DNA, 16 bp, M. musculus
caatcccagggaccca

SEQ ID NO: 374411 - DNA, 16 bp, M. musculus
caatccccagaatcca

SEQ ID NO: 374412 - DNA, 16 bp, M. musculus
caatccccagcactgt

SEQ ID NO: 374413 - DNA, 16 bp, M. musculus
caatccctggagccca

SEQ ID NO: 374414 - DNA, 16 bp, M. musculus
caatcccttcagctcc

SEQ ID NO: 374415 - DNA, 16 bp, M. musculus
caatcctagcactcaa

SEQ ID NO: 374416 - DNA, 16 bp, M. musculus
caatcctcctgcatca

SEQ ID NO: 374417 - DNA, 16 bp, M. musculus
caatcctgaagaaacc

SEQ ID NO: 374418 - DNA, 16 bp, M. musculus
caatccttagcagaaa

SEQ ID NO: 374419 - DNA, 16 bp, M. musculus
caatcctttccccaac

SEQ ID NO: 374420 - DNA, 16 bp, M. musculus
caatctagaggttcct

SEQ ID NO: 374421 - DNA, 16 bp, M. musculus
caatctattctcttta

SEQ ID NO: 374422 - DNA, 16 bp, M. musculus
caatctcagctctcag

SEQ ID NO: 374423 - DNA, 16 bp, M. musculus
caatctcattctttac

SEQ ID NO: 374424 - DNA, 16 bp, M. musculus
caatctccaccaaaat

SEQ ID NO: 374425 - DNA, 16 bp, M. musculus
caatctccctgacagg

SEQ ID NO: 374426 - DNA, 18 bp, M. musculus
caatctctctgctctgga

SEQ ID NO: 374427 - DNA, 16 bp, M. musculus
caatctgcagagcaag

SEQ ID NO: 374428 - DNA, 16 bp, M. musculus
caatctggtctacaga

SEQ ID NO: 374429 - DNA, 16 bp, M. musculus
caatctggtgattcct

SEQ ID NO: 374430 - DNA, 16 bp, M. musculus
caatctgttggttgcc

SEQ ID NO: 374431 - DNA, 16 bp, M. musculus
caatgaaaactttaaa

SEQ ID NO: 374432 - DNA, 16 bp, M. musculus
caatgaaaagaaagca

SEQ ID NO: 374433 - DNA, 16 bp, M. musculus
caatgaaaagatgaaa

SEQ ID NO: 374434 - DNA, 16 bp, M. musculus
caatgaaaataatttc

SEQ ID NO: 374435 - DNA, 16 bp, M. musculus
caatgaaagcattact

SEQ ID NO: 374436 - DNA, 16 bp, M. musculus
caatgaaagcatttgt

SEQ ID NO: 374437 - DNA, 16 bp, M. musculus
caatgaaagctgtgct

SEQ ID NO: 374438 - DNA, 16 bp, M. musculus
caatgaaatgatttct

SEQ ID NO: 374439 - DNA, 16 bp, M. musculus
caatgaactgaggcag

SEQ ID NO: 374440 - DNA, 16 bp, M. musculus
caatgaagaaaaccca

SEQ ID NO: 374441 - DNA, 16 bp, M. musculus
caatgaagaaagaaat

SEQ ID NO: 374442 - DNA, 16 bp, M. musculus
caatgaagaaagagaa

SEQ ID NO: 374443 - DNA, 16 bp, M. musculus
caatgaagaagttaga

SEQ ID NO: 374444 - DNA, 16 bp, M. musculus
caatgaagactcagga

SEQ ID NO: 374445 - DNA, 16 bp, M. musculus
caatgaaggagacaga

SEQ ID NO: 374446 - DNA, 16 bp, M. musculus
caatgaataaataaat

SEQ ID NO: 374447 - DNA, 16 bp, M. musculus
caatgaatgcatttct

SEQ ID NO: 374448 - DNA, 16 bp, M. musculus
caatgacaacaacaac

SEQ ID NO: 374449 - DNA, 16 bp, M. musculus
caatgacttcaaggct

SEQ ID NO: 374450 - DNA, 16 bp, M. musculus
caatgacttcctgaaa

SEQ ID NO: 374451 - DNA, 16 bp, M. musculus
caatgagaaaagtaaa

SEQ ID NO: 374452 - DNA, 16 bp, M. musculus
caatgagaaagagaca

SEQ ID NO: 374453 - DNA, 16 bp, M. musculus
caatgagctgggccct

SEQ ID NO: 374454 - DNA, 16 bp, M. musculus
caatgagtttgaggtt

SEQ ID NO: 374455 - DNA, 17 bp, M. musculus
caatgatcctggcagtc

SEQ ID NO: 374456 - DNA, 17 bp, M. musculus
caatgatggccaactag

SEQ ID NO: 374457 - DNA, 16 bp, M. musculus
caatgatggctgacaa

SEQ ID NO: 374458 - DNA, 16 bp, M. musculus
caatgatgtacactca

SEQ ID NO: 374459 - DNA, 16 bp, M. musculus
caatgattttatgaaa

SEQ ID NO: 374460 - DNA, 16 bp, M. musculus
caatgcaattaatcca

SEQ ID NO: 374461 - DNA, 49 bp, M. musculus
caatgcaggtttagcggctgccatccttcaatcccaaaaccgctccatg

SEQ ID NO: 374462 - DNA, 16 bp, M. musculus
caatgcagtttttatc

SEQ ID NO: 374463 - DNA, 16 bp, M. musculus
caatgccagggccaag

SEQ ID NO: 374464 - DNA, 16 bp, M. musculus
caatgccctccccacc

SEQ ID NO: 374465 - DNA, 16 bp, M. musculus
caatgcctgaaagaga

SEQ ID NO: 374466 - DNA, 16 bp, M. musculus
caatgccttcctctgg

SEQ ID NO: 374467 - DNA, 16 bp, M. musculus
caatgccttcttctgg

SEQ ID NO: 374468 - DNA, 16 bp, M. musculus
caatgctaagaagggg

SEQ ID NO: 374469 - DNA, 16 bp, M. musculus
caatgctatctcaaag

SEQ ID NO: 374470 - DNA, 16 bp, M. musculus
caatgctcagtctaca

SEQ ID NO: 374471 - DNA, 16 bp, M. musculus
caatgctcctgcctca

SEQ ID NO: 374472 - DNA, 16 bp, M. musculus
caatgctctggctgct

SEQ ID NO: 374473 - DNA, 21 bp, M. musculus
caatgctgcttttccccttga

SEQ ID NO: 374474 - DNA, 16 bp, M. musculus
caatgctttcattgtg

SEQ ID NO: 374475 - DNA, 16 bp, M. musculus
caatggaaaggctctg

SEQ ID NO: 374476 - DNA, 16 bp, M. musculus
caatggaacactgact

SEQ ID NO: 374477 - DNA, 16 bp, M. musculus
caatggaagaaaaaag

SEQ ID NO: 374478 - DNA, 16 bp, M. musculus
caatggaaggaaaggc

SEQ ID NO: 374479 - DNA, 20 bp, M. musculus
caatggaatagaattgaaga

SEQ ID NO: 374480 - DNA, 16 bp, M. musculus
caatggaatgctttaa

SEQ ID NO: 374481 - DNA, 16 bp, M. musculus
caatggacaggtcatt

SEQ ID NO: 374482 - DNA, 16 bp, M. musculus
caatggactcagttcc

SEQ ID NO: 374483 - DNA, 16 bp, M. musculus
caatggacttaattcc

SEQ ID NO: 374484 - DNA, 16 bp, M. musculus
caatggagaactactc

SEQ ID NO: 374485 - DNA, 16 bp, M. musculus
caatggagaagccaga

SEQ ID NO: 374486 - DNA, 16 bp, M. musculus
caatggagaagttaga

SEQ ID NO: 374487 - DNA, 16 bp, M. musculus
caatggaggagataaa

SEQ ID NO: 374488 - DNA, 16 bp, M. musculus
caatggaggagtgtcc

SEQ ID NO: 374489 - DNA, 16 bp, M. musculus
caatggaggccagaag

SEQ ID NO: 374490 - DNA, 16 bp, M. musculus
caatggaggtgacaaa

SEQ ID NO: 374491 - DNA, 16 bp, M. musculus
caatggagtactaagc

SEQ ID NO: 374492 - DNA, 16 bp, M. musculus
caatggagtactgttc

SEQ ID NO: 374493 - DNA, 16 bp, M. musculus
caatggatttataaaa

SEQ ID NO: 374494 - DNA, 16 bp, M. musculus
caatggatttatgaag

SEQ ID NO: 374495 - DNA, 16 bp, M. musculus
caatggcatcatgaaa

SEQ ID NO: 374496 - DNA, 16 bp, M. musculus
caatggctggaccact

SEQ ID NO: 374497 - DNA, 16 bp, M. musculus
caatggctttctgtct

SEQ ID NO: 374498 - DNA, 18 bp, M. musculus
caatgggaaactacaaca

SEQ ID NO: 374499 - DNA, 16 bp, M. musculus
caatgggagaaaaggc

SEQ ID NO: 374500 - DNA, 16 bp, M. musculus
caatgggaggagtggc

SEQ ID NO: 374501 - DNA, 16 bp, M. musculus
caatgggcctcccttt

SEQ ID NO: 374502 - DNA, 16 bp, M. musculus
caatgggccttcttgc

SEQ ID NO: 374503 - DNA, 16 bp, M. musculus
caatgggctaggccct

SEQ ID NO: 374504 - DNA, 16 bp, M. musculus
caatgggctgggacct

SEQ ID NO: 374505 - DNA, 16 bp, M. musculus
caatggtagttccaga

SEQ ID NO: 374506 - DNA, 16 bp, M. musculus
caatggtcactctttt

SEQ ID NO: 374507 - DNA, 16 bp, M. musculus
caatggtcagcagcag

SEQ ID NO: 374508 - DNA, 16 bp, M. musculus
caatggtggccaacta

SEQ ID NO: 374509 - DNA, 16 bp, M. musculus
caatggttggctgtga

SEQ ID NO: 374510 - DNA, 16 bp, M. musculus
caatgtaaatatctga

SEQ ID NO: 374511 - DNA, 16 bp, M. musculus
caatgtaacagaattg

SEQ ID NO: 374512 - DNA, 16 bp, M. musculus
caatgtaccaatgaaa

SEQ ID NO: 374513 - DNA, 16 bp, M. musculus
caatgtatcctgatta

SEQ ID NO: 374514 - DNA, 16 bp, M. musculus
caatgtatttatgaaa

SEQ ID NO: 374515 - DNA, 16 bp, M. musculus
caatgtccttttctgg

SEQ ID NO: 374516 - DNA, 16 bp, M. musculus
caatgtctgagatcca

SEQ ID NO: 374517 - DNA, 16 bp, M. musculus
caatgtgcagagaatg

SEQ ID NO: 374518 - DNA, 16 bp, M. musculus
caatgtgcgcatgtgc

SEQ ID NO: 374519 - DNA, 16 bp, M. musculus
caatgtggcaaagcct

SEQ ID NO: 374520 - DNA, 18 bp, M. musculus
caatgtggtaaagccttt

SEQ ID NO: 374521 - DNA, 21 bp, M. musculus
caatgtggtaaagtctttgca

SEQ ID NO: 374522 - DNA, 16 bp, M. musculus
caatgtgtcctttgag

SEQ ID NO: 374523 - DNA, 16 bp, M. musculus
caatgtgtggaacagg

SEQ ID NO: 374524 - DNA, 16 bp, M. musculus
caatgtgtgtgtgtgt

SEQ ID NO: 374525 - DNA, 16 bp, M. musculus
caatgttctggattcc

SEQ ID NO: 374526 - DNA, 16 bp, M. musculus
caatgtttaaaaaaaa

SEQ ID NO: 374527 - DNA, 16 bp, M. musculus
caattaaaatgttttc

SEQ ID NO: 374528 - DNA, 16 bp, M. musculus
caattacatctggtga

SEQ ID NO: 374529 - DNA, 16 bp, M. musculus
caattacatttacaat

SEQ ID NO: 374530 - DNA, 16 bp, M. musculus
caattagacaacaaaa

SEQ ID NO: 374531 - DNA, 16 bp, M. musculus
caattatgacaatgat

SEQ ID NO: 374532 - DNA, 16 bp, M. musculus
caattatttgggagct

SEQ ID NO: 374533 - DNA, 16 bp, M. musculus
caattcaatgctttct

SEQ ID NO: 374534 - DNA, 16 bp, M. musculus
caattcacagacctca

SEQ ID NO: 374535 - DNA, 16 bp, M. musculus
caattcacccaagagg

SEQ ID NO: 374536 - DNA, 16 bp, M. musculus
caattcattctgtgaa

SEQ ID NO: 374537 - DNA, 16 bp, M. musculus
caattccagcacttgg

SEQ ID NO: 374538 - DNA, 16 bp, M. musculus
caattccaggggatct

SEQ ID NO: 374539 - DNA, 16 bp, M. musculus
caattcccacatggtg

SEQ ID NO: 374540 - DNA, 16 bp, M. musculus
caattcccagaatcca

SEQ ID NO: 374541 - DNA, 16 bp, M. musculus
caattcccagacccca

SEQ ID NO: 374542 - DNA, 16 bp, M. musculus
caattcctggaaccca

SEQ ID NO: 374543 - DNA, 44 bp, M. musculus
caattcgagcagctccaggcagccatacatacagaccttggggc

SEQ ID NO: 374544 - DNA, 16 bp, M. musculus
caattctcagcaacca

SEQ ID NO: 374545 - DNA, 16 bp, M. musculus
caattctcagcacaca

SEQ ID NO: 374546 - DNA, 16 bp, M. musculus
caattctcccaccata

SEQ ID NO: 374547 - DNA, 16 bp, M. musculus
caattctcctgcctta

SEQ ID NO: 374548 - DNA, 16 bp, M. musculus
caattctgagtcagag

SEQ ID NO: 374549 - DNA, 16 bp, M. musculus
caattctgggttaaaa

SEQ ID NO: 374550 - DNA, 16 bp, M. musculus
caattcttaacagtaa

SEQ ID NO: 374551 - DNA, 16 bp, M. musculus
caattcttcagttgag

SEQ ID NO: 374552 - DNA, 16 bp, M. musculus
caattctttaaggggt

SEQ ID NO: 374553 - DNA, 16 bp, M. musculus
caattctttattacca

SEQ ID NO: 374554 - DNA, 16 bp, M. musculus
caattctttctctttg

SEQ ID NO: 374555 - DNA, 16 bp, M. musculus
caattgaattttattt

SEQ ID NO: 374556 - DNA, 16 bp, M. musculus
caattgagaaagacat

SEQ ID NO: 374557 - DNA, 23 bp, M. musculus
caattggcttatgagaatgctaa

SEQ ID NO: 374558 - DNA, 16 bp, M. musculus
caattgtgatgaaaac

SEQ ID NO: 374559 - DNA, 16 bp, M. musculus
caatttaaaaatggag

SEQ ID NO: 374560 - DNA, 16 bp, M. musculus
caatttaaaagtcaca

SEQ ID NO: 374561 - DNA, 16 bp, M. musculus
caatttaaagggccag

SEQ ID NO: 374562 - DNA, 16 bp, M. musculus
caatttacagaagaaa

SEQ ID NO: 374563 - DNA, 16 bp, M. musculus
caatttaccaagcaaa

SEQ ID NO: 374564 - DNA, 16 bp, M. musculus
caatttagcctcaggc

SEQ ID NO: 374565 - DNA, 16 bp, M. musculus
caatttataaaaactt

SEQ ID NO: 374566 - DNA, 16 bp, M. musculus
caatttcaccagcaat

SEQ ID NO: 374567 - DNA, 16 bp, M. musculus
caatttcagggacttc

SEQ ID NO: 374568 - DNA, 16 bp, M. musculus
caatttcataaaagaa

SEQ ID NO: 374569 - DNA, 16 bp, M. musculus
caatttcatctggaat

SEQ ID NO: 374570 - DNA, 16 bp, M. musculus
caatttcttcttttgt

SEQ ID NO: 374571 - DNA, 16 bp, M. musculus
caatttcttgagttct

SEQ ID NO: 374572 - DNA, 16 bp, M. musculus
caatttctttatgaaa

SEQ ID NO: 374573 - DNA, 16 bp, M. musculus
caatttgaaaattcat

SEQ ID NO: 374574 - DNA, 16 bp, M. musculus
caatttgacagaatct

SEQ ID NO: 374575 - DNA, 16 bp, M. musculus
caatttgactacatct

SEQ ID NO: 374576 - DNA, 16 bp, M. musculus
caatttgatggagatt

SEQ ID NO: 374577 - DNA, 16 bp, M. musculus
caatttgggttttctt

SEQ ID NO: 374578 - DNA, 16 bp, M. musculus
caatttggtcttcatt

SEQ ID NO: 374579 - DNA, 16 bp, M. musculus
caatttgttcatgttt

SEQ ID NO: 374580 - DNA, 16 bp, M. musculus
caattttatagacaga

SEQ ID NO: 374581 - DNA, 16 bp, M. musculus
caattttcaaagcaaa

SEQ ID NO: 374582 - DNA, 17 bp, M. musculus
caattttccagtataac

SEQ ID NO: 374583 - DNA, 16 bp, M. musculus
caattttcttctatct

SEQ ID NO: 374584 - DNA, 16 bp, M. musculus
caattttggagaagga

SEQ ID NO: 374585 - DNA, 16 bp, M. musculus
caattttttaaaagat

SEQ ID NO: 374586 - DNA, 16 bp, M. musculus
caattttttatctaca

SEQ ID NO: 374587 - DNA, 16 bp, M. musculus
caattttttttattag

SEQ ID NO: 374588 - DNA, 16 bp, M. musculus
cacaaaaagaagatgg

SEQ ID NO: 374589 - DNA, 16 bp, M. musculus
cacaaaaatattttta

SEQ ID NO: 374590 - DNA, 16 bp, M. musculus
cacaaaacctgcacaa

SEQ ID NO: 374591 - DNA, 16 bp, M. musculus
cacaaaacctttgacc

SEQ ID NO: 374592 - DNA, 16 bp, M. musculus
cacaaaacttgtggga

SEQ ID NO: 374593 - DNA, 16 bp, M. musculus
cacaaaagaactcaca

SEQ ID NO: 374594 - DNA, 16 bp, M. musculus
cacaaaagaactcata

SEQ ID NO: 374595 - DNA, 16 bp, M. musculus
cacaaaagaattcaaa

SEQ ID NO: 374596 - DNA, 16 bp, M. musculus
cacaaaagaattcaca

SEQ ID NO: 374597 - DNA, 16 bp, M. musculus
cacaaaagacctcaca

SEQ ID NO: 374598 - DNA, 19 bp, M. musculus
cacaaaagagagcctatct

SEQ ID NO: 374599 - DNA, 16 bp, M. musculus
cacaaaaggatcctaa

SEQ ID NO: 374600 - DNA, 16 bp, M. musculus
cacaaaataaatgttt

SEQ ID NO: 374601 - DNA, 40 bp, M. musculus
cacaaaataagtatacaggcctttccacgggtcttgaacc

SEQ ID NO: 374602 - DNA, 16 bp, M. musculus
cacaaaatctattcta

SEQ ID NO: 374603 - DNA, 16 bp, M. musculus
cacaaaattattttaa

SEQ ID NO: 374604 - DNA, 16 bp, M. musculus
cacaaaattattttca

SEQ ID NO: 374605 - DNA, 16 bp, M. musculus
cacaaacacagagaga

SEQ ID NO: 374606 - DNA, 16 bp, M. musculus
cacaaacacatgtaca

SEQ ID NO: 374607 - DNA, 16 bp, M. musculus
cacaaacacctgtaat

SEQ ID NO: 374608 - DNA, 16 bp, M. musculus
cacaaacagggcagga

SEQ ID NO: 374609 - DNA, 16 bp, M. musculus
cacaaacatacagaga

SEQ ID NO: 374610 - DNA, 16 bp, M. musculus
cacaaacatacatgta

SEQ ID NO: 374611 - DNA, 16 bp, M. musculus
cacaaacatatgtaca

SEQ ID NO: 374612 - DNA, 20 bp, M. musculus
cacaaacatcttgagagctg

SEQ ID NO: 374613 - DNA, 16 bp, M. musculus
cacaaacatgtatata

SEQ ID NO: 374614 - DNA, 21 bp, M. musculus
cacaaacctctcaggccgggc

SEQ ID NO: 374615 - DNA, 16 bp, M. musculus
cacaaactcacacaga

SEQ ID NO: 374616 - DNA, 16 bp, M. musculus
cacaaactgagtccct

SEQ ID NO: 374617 - DNA, 16 bp, M. musculus
cacaaagaactacaga

SEQ ID NO: 374618 - DNA, 16 bp, M. musculus
cacaaagaataaatag

SEQ ID NO: 374619 - DNA, 16 bp, M. musculus
cacaaagacatgcaca

SEQ ID NO: 374620 - DNA, 17 bp, M. musculus
cacaaagagaagtttga

SEQ ID NO: 374621 - DNA, 16 bp, M. musculus
cacaaagagacacaga

SEQ ID NO: 374622 - DNA, 16 bp, M. musculus
cacaaagagacagaga

SEQ ID NO: 374623 - DNA, 16 bp, M. musculus
cacaaagagagagagg

SEQ ID NO: 374624 - DNA, 16 bp, M. musculus
cacaaagaggaggagc

SEQ ID NO: 374625 - DNA, 16 bp, M. musculus
cacaaagccctaggtt

SEQ ID NO: 374626 - DNA, 16 bp, M. musculus
cacaaagccctgagtt

SEQ ID NO: 374627 - DNA, 16 bp, M. musculus
cacaaagccctgggct

SEQ ID NO: 374628 - DNA, 16 bp, M. musculus
cacaaaggaacccaca

SEQ ID NO: 374629 - DNA, 16 bp, M. musculus
cacaaaggccaccaac

SEQ ID NO: 374630 - DNA, 16 bp, M. musculus
cacaaagggaaacaac

SEQ ID NO: 374631 - DNA, 16 bp, M. musculus
cacaaagtcacacaca

SEQ ID NO: 374632 - DNA, 16 bp, M. musculus
cacaaagtggctcaca

SEQ ID NO: 374633 - DNA, 16 bp, M. musculus
cacaaagtttgtggga

SEQ ID NO: 374634 - DNA, 16 bp, M. musculus
cacaaataaatgcaaa

SEQ ID NO: 374635 - DNA, 16 bp, M. musculus
cacaaataacccaatt

SEQ ID NO: 374636 - DNA, 16 bp, M. musculus
cacaaatatacataca

SEQ ID NO: 374637 - DNA, 16 bp, M. musculus
cacaaatatatattta

SEQ ID NO: 374638 - DNA, 16 bp, M. musculus
cacaaatatatgtatg

SEQ ID NO: 374639 - DNA, 16 bp, M. musculus
cacaaatctgcctgcc

SEQ ID NO: 374640 - DNA, 16 bp, M. musculus
cacaaatgcatatata

SEQ ID NO: 374641 - DNA, 16 bp, M. musculus
cacaaatgccatccca

SEQ ID NO: 374642 - DNA, 16 bp, M. musculus
cacaaatggagacaac

SEQ ID NO: 374643 - DNA, 16 bp, M. musculus
cacaaattaagaaaat

SEQ ID NO: 374644 - DNA, 16 bp, M. musculus
cacaaattttatatgc

SEQ ID NO: 374645 - DNA, 16 bp, M. musculus
cacaacaaagaaaatg

SEQ ID NO: 374646 - DNA, 16 bp, M. musculus
cacaacacacatatac

SEQ ID NO: 374647 - DNA, 16 bp, M. musculus
cacaacacagactgtt

SEQ ID NO: 374648 - DNA, 16 bp, M. musculus
cacaacagaagaggac

SEQ ID NO: 374649 - DNA, 16 bp, M. musculus
cacaacagtagcaaaa

SEQ ID NO: 374650 - DNA, 22 bp, M. musculus
cacaaccacatggtggctcaca

SEQ ID NO: 374651 - DNA, 16 bp, M. musculus
cacaaccatctgtcat

SEQ ID NO: 374652 - DNA, 16 bp, M. musculus
cacaacctttatattt

SEQ ID NO: 374653 - DNA, 16 bp, M. musculus
cacaactatggtcact

SEQ ID NO: 374654 - DNA, 16 bp, M. musculus
cacaactcctaatagt

SEQ ID NO: 374655 - DNA, 16 bp, M. musculus
cacaactgcacacaca

SEQ ID NO: 374656 - DNA, 16 bp, M. musculus
cacaactggtgattat

SEQ ID NO: 374657 - DNA, 17 bp, M. musculus
cacaacttctgccaaga

SEQ ID NO: 374658 - DNA, 16 bp, M. musculus
cacaagaaaactcaca

SEQ ID NO: 374659 - DNA, 16 bp, M. musculus
cacaagaaaatgaaga

SEQ ID NO: 374660 - DNA, 16 bp, M. musculus
cacaagaaaatgactt

SEQ ID NO: 374661 - DNA, 16 bp, M. musculus
cacaagaaaattacct

SEQ ID NO: 374662 - DNA, 16 bp, M. musculus
cacaagaaatggtctt

SEQ ID NO: 374663 - DNA, 16 bp, M. musculus
cacaagaacataaaca

SEQ ID NO: 374664 - DNA, 16 bp, M. musculus
cacaagaagacctaga

SEQ ID NO: 374665 - DNA, 16 bp, M. musculus
cacaagaccaaggacc

SEQ ID NO: 374666 - DNA, 16 bp, M. musculus
cacaagaccaaggggc

SEQ ID NO: 374667 - DNA, 16 bp, M. musculus
cacaagagaagaatgg

SEQ ID NO: 374668 - DNA, 16 bp, M. musculus
cacaagagacacctat

SEQ ID NO: 374669 - DNA, 16 bp, M. musculus
cacaagagacagccat

SEQ ID NO: 374670 - DNA, 16 bp, M. musculus
cacaagagagagctgt

SEQ ID NO: 374671 - DNA, 16 bp, M. musculus
cacaagatcaaaccag

SEQ ID NO: 374672 - DNA, 16 bp, M. musculus
cacaagatcaagccag

SEQ ID NO: 374673 - DNA, 16 bp, M. musculus
cacaagatcaagggcc

SEQ ID NO: 374674 - DNA, 16 bp, M. musculus
cacaagatccccaatg

SEQ ID NO: 374675 - DNA, 16 bp, M. musculus
cacaagatggcgctga

SEQ ID NO: 374676 - DNA, 16 bp, M. musculus
cacaagatttttcacc

SEQ ID NO: 374677 - DNA, 16 bp, M. musculus
cacaagcacagacaat

SEQ ID NO: 374678 - DNA, 16 bp, M. musculus
cacaagcacagacaca

SEQ ID NO: 374679 - DNA, 16 bp, M. musculus
cacaagcacaggcaca

SEQ ID NO: 374680 - DNA, 16 bp, M. musculus
cacaagcacatacatg

SEQ ID NO: 374681 - DNA, 16 bp, M. musculus
cacaagcactgggacc

SEQ ID NO: 374682 - DNA, 16 bp, M. musculus
cacaagcaggaggcag

SEQ ID NO: 374683 - DNA, 16 bp, M. musculus
cacaagcattattgga

SEQ ID NO: 374684 - DNA, 16 bp, M. musculus
cacaagccactggtgt

SEQ ID NO: 374685 - DNA, 16 bp, M. musculus
cacaagccattgctgt

SEQ ID NO: 374686 - DNA, 16 bp, M. musculus
cacaagcgcacacaca

SEQ ID NO: 374687 - DNA, 16 bp, M. musculus
cacaagctagagtcat

SEQ ID NO: 374688 - DNA, 16 bp, M. musculus
cacaagctctggaggg

SEQ ID NO: 374689 - DNA, 16 bp, M. musculus
cacaagctctgggagg

SEQ ID NO: 374690 - DNA, 16 bp, M. musculus
cacaagctggagttac

SEQ ID NO: 374691 - DNA, 16 bp, M. musculus
cacaaggccctgggtt

SEQ ID NO: 374692 - DNA, 16 bp, M. musculus
cacaagggaactcaca

SEQ ID NO: 374693 - DNA, 16 bp, M. musculus
cacaaggtagctcaca

SEQ ID NO: 374694 - DNA, 16 bp, M. musculus
cacaaggtcctcaatg

SEQ ID NO: 374695 - DNA, 16 bp, M. musculus
cacaagttacaggtta

SEQ ID NO: 374696 - DNA, 16 bp, M. musculus
cacaagttatcaatga

SEQ ID NO: 374697 - DNA, 16 bp, M. musculus
cacaagttgccctctg

SEQ ID NO: 374698 - DNA, 16 bp, M. musculus
cacaagttgttctctg

SEQ ID NO: 374699 - DNA, 16 bp, M. musculus
cacaagtttgaggcta

SEQ ID NO: 374700 - DNA, 16 bp, M. musculus
cacaataaaattctca

SEQ ID NO: 374701 - DNA, 16 bp, M. musculus
cacaatacacacatgt

SEQ ID NO: 374702 - DNA, 16 bp, M. musculus
cacaatatagaaacag

SEQ ID NO: 374703 - DNA, 16 bp, M. musculus
cacaatatttgcattt

SEQ ID NO: 374704 - DNA, 16 bp, M. musculus
cacaatcactctgata

SEQ ID NO: 374705 - DNA, 16 bp, M. musculus
cacaatcatacataca

SEQ ID NO: 374706 - DNA, 16 bp, M. musculus
cacaatcatctgtaat

SEQ ID NO: 374707 - DNA, 16 bp, M. musculus
cacaatcatggctctt

SEQ ID NO: 374708 - DNA, 16 bp, M. musculus
cacaatgaaaacagtg

SEQ ID NO: 374709 - DNA, 16 bp, M. musculus
cacaatgaagaaaacc

SEQ ID NO: 374710 - DNA, 16 bp, M. musculus
cacaatgcacatacat

SEQ ID NO: 374711 - DNA, 16 bp, M. musculus
cacaatgcctggcttt

SEQ ID NO: 374712 - DNA, 16 bp, M. musculus
cacaatgggccctcct

SEQ ID NO: 374713 - DNA, 16 bp, M. musculus
cacaatgggttgggcc

SEQ ID NO: 374714 - DNA, 16 bp, M. musculus
cacaattgtgtctggg

SEQ ID NO: 374715 - DNA, 17 bp, M. musculus
cacaatttctctgtagt

SEQ ID NO: 374716 - DNA, 16 bp, M. musculus
cacacaaacacacatt

SEQ ID NO: 374717 - DNA, 16 bp, M. musculus
cacacaaacacatact

SEQ ID NO: 374718 - DNA, 16 bp, M. musculus
cacacaaacacatgca

SEQ ID NO: 374719 - DNA, 16 bp, M. musculus
cacacaaacagagaga

SEQ ID NO: 374720 - DNA, 16 bp, M. musculus
cacacaaatatatgta

SEQ ID NO: 374721 - DNA, 16 bp, M. musculus
cacacaaatgtatata

SEQ ID NO: 374722 - DNA, 16 bp, M. musculus
cacacaacacacatgt

SEQ ID NO: 374723 - DNA, 16 bp, M. musculus
cacacaagtatacaca

SEQ ID NO: 374724 - DNA, 16 bp, M. musculus
cacacaagtgcacata

SEQ ID NO: 374725 - DNA, 16 bp, M. musculus
cacacaatacacacat

SEQ ID NO: 374726 - DNA, 16 bp, M. musculus
cacacaatacatacat

SEQ ID NO: 374727 - DNA, 16 bp, M. musculus
cacacaattttttttt

SEQ ID NO: 374728 - DNA, 16 bp, M. musculus
cacacacaaaaggaat

SEQ ID NO: 374729 - DNA, 16 bp, M. musculus
cacacacaaacacagt

SEQ ID NO: 374730 - DNA, 16 bp, M. musculus
cacacacaaacatgca

SEQ ID NO: 374731 - DNA, 16 bp, M. musculus
cacacacaaagaatat

SEQ ID NO: 374732 - DNA, 16 bp, M. musculus
cacacacaactgcaca

SEQ ID NO: 374733 - DNA, 16 bp, M. musculus
cacacacaagtaaaaa

SEQ ID NO: 374734 - DNA, 16 bp, M. musculus
cacacacaagtgtgca

SEQ ID NO: 374735 - DNA, 16 bp, M. musculus
cacacacaatcacata

SEQ ID NO: 374736 - DNA, 16 bp, M. musculus
cacacacaattttaaa

SEQ ID NO: 374737 - DNA, 16 bp, M. musculus
cacacacacaaacatg

SEQ ID NO: 374738 - DNA, 16 bp, M. musculus
cacacacacaaagcct

SEQ ID NO: 374739 - DNA, 16 bp, M. musculus
cacacacacaaatagg

SEQ ID NO: 374740 - DNA, 16 bp, M. musculus
cacacacacaaatgta

SEQ ID NO: 374741 - DNA, 16 bp, M. musculus
cacacacacaaccagt

SEQ ID NO: 374742 - DNA, 16 bp, M. musculus
cacacacacaagcaga

SEQ ID NO: 374743 - DNA, 16 bp, M. musculus
cacacacacaagctgt

SEQ ID NO: 374744 - DNA, 16 bp, M. musculus
cacacacacaaggaag

SEQ ID NO: 374745 - DNA, 16 bp, M. musculus
cacacacacaaggcag

SEQ ID NO: 374746 - DNA, 16 bp, M. musculus
cacacacacaatattt

SEQ ID NO: 374747 - DNA, 16 bp, M. musculus
cacacacacaatcagt

SEQ ID NO: 374748 - DNA, 16 bp, M. musculus
cacacacacaatggaa

SEQ ID NO: 374749 - DNA, 16 bp, M. musculus
cacacacacaatgggg

SEQ ID NO: 374750 - DNA, 16 bp, M. musculus
cacacacacaatgtgc

SEQ ID NO: 374751 - DNA, 16 bp, M. musculus
cacacacacaattaga

SEQ ID NO: 374752 - DNA, 16 bp, M. musculus
cacacacacacaagag

SEQ ID NO: 374753 - DNA, 16 bp, M. musculus
cacacacacacaagga

SEQ ID NO: 374754 - DNA, 16 bp, M. musculus
cacacacacacaagta

SEQ ID NO: 374755 - DNA, 16 bp, M. musculus
cacacacacacacatg

SEQ ID NO: 374756 - DNA, 17 bp, M. musculus
cacacacacacacgatg

SEQ ID NO: 374757 - DNA, 17 bp, M. musculus
cacacacacacacgggt

SEQ ID NO: 374758 - DNA, 17 bp, M. musculus
cacacacacacacgtta

SEQ ID NO: 374759 - DNA, 18 bp, M. musculus
cacacacacacacgttta

SEQ ID NO: 374760 - DNA, 17 bp, M. musculus
cacacacacacacttcg

SEQ ID NO: 374761 - DNA, 16 bp, M. musculus
cacacacacacacttg

SEQ ID NO: 374762 - DNA, 16 bp, M. musculus
cacacacacacacttt

SEQ ID NO: 374763 - DNA, 16 bp, M. musculus
cacacacacacagagg

SEQ ID NO: 374764 - DNA, 16 bp, M. musculus
cacacacacacagctc

SEQ ID NO: 374765 - DNA, 16 bp, M. musculus
cacacacacacagctt

SEQ ID NO: 374766 - DNA, 16 bp, M. musculus
cacacacacacagtaa

SEQ ID NO: 374767 - DNA, 16 bp, M. musculus
cacacacacacagtat

SEQ ID NO: 374768 - DNA, 16 bp, M. musculus
cacacacacacagtcc

SEQ ID NO: 374769 - DNA, 16 bp, M. musculus
cacacacacacagtct

SEQ ID NO: 374770 - DNA, 16 bp, M. musculus
cacacacacacagtta

SEQ ID NO: 374771 - DNA, 16 bp, M. musculus
cacacacacacagttt

SEQ ID NO: 374772 - DNA, 16 bp, M. musculus
cacacacacacataga

SEQ ID NO: 374773 - DNA, 16 bp, M. musculus
cacacacacacatatc

SEQ ID NO: 374774 - DNA, 16 bp, M. musculus
cacacacacacatcat

SEQ ID NO: 374775 - DNA, 16 bp, M. musculus
cacacacacacatccg

SEQ ID NO: 374776 - DNA, 16 bp, M. musculus
cacacacacacatgct

SEQ ID NO: 374777 - DNA, 18 bp, M. musculus
cacacacacacattgcat

SEQ ID NO: 374778 - DNA, 16 bp, M. musculus
cacacacacaccaagg

SEQ ID NO: 374779 - DNA, 16 bp, M. musculus
cacacacacaccaggc

SEQ ID NO: 374780 - DNA, 16 bp, M. musculus
cacacacacacccagt

SEQ ID NO: 374781 - DNA, 16 bp, M. musculus
cacacacacaccctgt

SEQ ID NO: 374782 - DNA, 16 bp, M. musculus
cacacacacaccgaga

SEQ ID NO: 374783 - DNA, 17 bp, M. musculus
cacacacacacctgtct

SEQ ID NO: 374784 - DNA, 16 bp, M. musculus
cacacacacaccttgt

SEQ ID NO: 374785 - DNA, 16 bp, M. musculus
cacacacacacctttt

SEQ ID NO: 374786 - DNA, 16 bp, M. musculus
cacacacacacgagtc

SEQ ID NO: 374787 - DNA, 16 bp, M. musculus
cacacacacacgcaag

SEQ ID NO: 374788 - DNA, 16 bp, M. musculus
cacacacacacggaga

SEQ ID NO: 374789 - DNA, 16 bp, M. musculus
cacacacacacggcag

SEQ ID NO: 374790 - DNA, 16 bp, M. musculus
cacacacacacggggg

SEQ ID NO: 374791 - DNA, 16 bp, M. musculus
cacacacacacgtaca

SEQ ID NO: 374792 - DNA, 16 bp, M. musculus
cacacacacacgtatg

SEQ ID NO: 374793 - DNA, 16 bp, M. musculus
cacacacacacgtgtg

SEQ ID NO: 374794 - DNA, 16 bp, M. musculus
cacacacacactacag

SEQ ID NO: 374795 - DNA, 16 bp, M. musculus
cacacacacactcaga

SEQ ID NO: 374796 - DNA, 16 bp, M. musculus
cacacacacactcagt

SEQ ID NO: 374797 - DNA, 16 bp, M. musculus
cacacacacactcatg

SEQ ID NO: 374798 - DNA, 16 bp, M. musculus
cacacacacactccat

SEQ ID NO: 374799 - DNA, 16 bp, M. musculus
cacacacacactctct

SEQ ID NO: 374800 - DNA, 16 bp, M. musculus
cacacacacactggag

SEQ ID NO: 374801 - DNA, 17 bp, M. musculus
cacacacacactggcac

SEQ ID NO: 374802 - DNA, 16 bp, M. musculus
cacacacacactgtgg

SEQ ID NO: 374803 - DNA, 16 bp, M. musculus
cacacacacactgttt

SEQ ID NO: 374804 - DNA, 16 bp, M. musculus
cacacacacacttaaa

SEQ ID NO: 374805 - DNA, 16 bp, M. musculus
cacacacacacttatt

SEQ ID NO: 374806 - DNA, 16 bp, M. musculus
cacacacacacttctc

SEQ ID NO: 374807 - DNA, 16 bp, M. musculus
cacacacacagaaata

SEQ ID NO: 374808 - DNA, 16 bp, M. musculus
cacacacacagaagga

SEQ ID NO: 374809 - DNA, 16 bp, M. musculus
cacacacacagagcaa

SEQ ID NO: 374810 - DNA, 16 bp, M. musculus
cacacacacagagcca

SEQ ID NO: 374811 - DNA, 16 bp, M. musculus
cacacacacagagcta

SEQ ID NO: 374812 - DNA, 16 bp, M. musculus
cacacacacagagtct

SEQ ID NO: 374813 - DNA, 16 bp, M. musculus
cacacacacagagtta

SEQ ID NO: 374814 - DNA, 16 bp, M. musculus
cacacacacagatggg

SEQ ID NO: 374815 - DNA, 16 bp, M. musculus
cacacacacagattct

SEQ ID NO: 374816 - DNA, 16 bp, M. musculus
cacacacacagatttt

SEQ ID NO: 374817 - DNA, 16 bp, M. musculus
cacacacacagcacta

SEQ ID NO: 374818 - DNA, 16 bp, M. musculus
cacacacacagcagat

SEQ ID NO: 374819 - DNA, 16 bp, M. musculus
cacacacacagcagca

SEQ ID NO: 374820 - DNA, 16 bp, M. musculus
cacacacacagcagtt

SEQ ID NO: 374821 - DNA, 16 bp, M. musculus
cacacacacagcatat

SEQ ID NO: 374822 - DNA, 16 bp, M. musculus
cacacacacagcatgc

SEQ ID NO: 374823 - DNA, 16 bp, M. musculus
cacacacacagcccat

SEQ ID NO: 374824 - DNA, 16 bp, M. musculus
cacacacacagcctat

SEQ ID NO: 374825 - DNA, 16 bp, M. musculus
cacacacacagccttc

SEQ ID NO: 374826 - DNA, 16 bp, M. musculus
cacacacacagctacc

SEQ ID NO: 374827 - DNA, 16 bp, M. musculus
cacacacacagctatg

SEQ ID NO: 374828 - DNA, 16 bp, M. musculus
cacacacacaggagag

SEQ ID NO: 374829 - DNA, 16 bp, M. musculus
cacacacacaggcaaa

SEQ ID NO: 374830 - DNA, 16 bp, M. musculus
cacacacacaggcaag

SEQ ID NO: 374831 - DNA, 16 bp, M. musculus
cacacacacaggggaa

SEQ ID NO: 374832 - DNA, 16 bp, M. musculus
cacacacacaggtgag

SEQ ID NO: 374833 - DNA, 16 bp, M. musculus
cacacacacaggtttg

SEQ ID NO: 374834 - DNA, 16 bp, M. musculus
cacacacacagtataa

SEQ ID NO: 374835 - DNA, 16 bp, M. musculus
cacacacacagtccac

SEQ ID NO: 374836 - DNA, 16 bp, M. musculus
cacacacacagtcctt

SEQ ID NO: 374837 - DNA, 16 bp, M. musculus
cacacacacagtgaaa

SEQ ID NO: 374838 - DNA, 16 bp, M. musculus
cacacacacagtgaag

SEQ ID NO: 374839 - DNA, 16 bp, M. musculus
cacacacacagtgcct

SEQ ID NO: 374840 - DNA, 16 bp, M. musculus
cacacacacagtgggg

SEQ ID NO: 374841 - DNA, 16 bp, M. musculus
cacacacacagtggtg

SEQ ID NO: 374842 - DNA, 16 bp, M. musculus
cacacacacagtgttt

SEQ ID NO: 374843 - DNA, 16 bp, M. musculus
cacacacacatacatg

SEQ ID NO: 374844 - DNA, 16 bp, M. musculus
cacacacacatagagt

SEQ ID NO: 374845 - DNA, 16 bp, M. musculus
cacacacacatagtta

SEQ ID NO: 374846 - DNA, 16 bp, M. musculus
cacacacacatatatt

SEQ ID NO: 374847 - DNA, 16 bp, M. musculus
cacacacacatcacag

SEQ ID NO: 374848 - DNA, 16 bp, M. musculus
cacacacacatcatta

SEQ ID NO: 374849 - DNA, 16 bp, M. musculus
cacacacacatctcac

SEQ ID NO: 374850 - DNA, 16 bp, M. musculus
cacacacacatctcta

SEQ ID NO: 374851 - DNA, 16 bp, M. musculus
cacacacacatgcaca

SEQ ID NO: 374852 - DNA, 16 bp, M. musculus
cacacacacatgcatg

SEQ ID NO: 374853 - DNA, 16 bp, M. musculus
cacacacacatggaga

SEQ ID NO: 374854 - DNA, 16 bp, M. musculus
cacacacacatgtata

SEQ ID NO: 374855 - DNA, 16 bp, M. musculus
cacacacacatgtcct

SEQ ID NO: 374856 - DNA, 16 bp, M. musculus
cacacacacatgttct

SEQ ID NO: 374857 - DNA, 16 bp, M. musculus
cacacacacattaatt

SEQ ID NO: 374858 - DNA, 16 bp, M. musculus
cacacacacattacat

SEQ ID NO: 374859 - DNA, 16 bp, M. musculus
cacacacacattcaaa

SEQ ID NO: 374860 - DNA, 16 bp, M. musculus
cacacacacattcaac

SEQ ID NO: 374861 - DNA, 16 bp, M. musculus
cacacacacattcaca

SEQ ID NO: 374862 - DNA, 16 bp, M. musculus
cacacacacattcatc

SEQ ID NO: 374863 - DNA, 16 bp, M. musculus
cacacacacattctaa

SEQ ID NO: 374864 - DNA, 16 bp, M. musculus
cacacacacattgtgg

SEQ ID NO: 374865 - DNA, 16 bp, M. musculus
cacacacacatttctc

SEQ ID NO: 374866 - DNA, 16 bp, M. musculus
cacacacaccacagag

SEQ ID NO: 374867 - DNA, 16 bp, M. musculus
cacacacaccacatat

SEQ ID NO: 374868 - DNA, 16 bp, M. musculus
cacacacaccactgtg

SEQ ID NO: 374869 - DNA, 16 bp, M. musculus
cacacacaccatctgt

SEQ ID NO: 374870 - DNA, 16 bp, M. musculus
cacacacaccatgaaa

SEQ ID NO: 374871 - DNA, 16 bp, M. musculus
cacacacaccatgctt

SEQ ID NO: 374872 - DNA, 16 bp, M. musculus
cacacacaccatggct

SEQ ID NO: 374873 - DNA, 16 bp, M. musculus
cacacacaccatgtac

SEQ ID NO: 374874 - DNA, 16 bp, M. musculus
cacacacaccccagta

SEQ ID NO: 374875 - DNA, 16 bp, M. musculus
cacacacaccccatgt

SEQ ID NO: 374876 - DNA, 16 bp, M. musculus
cacacacacccctttg

SEQ ID NO: 374877 - DNA, 16 bp, M. musculus
cacacacaccctgcac

SEQ ID NO: 374878 - DNA, 16 bp, M. musculus
cacacacaccctgctc

SEQ ID NO: 374879 - DNA, 16 bp, M. musculus
cacacacacctacata

SEQ ID NO: 374880 - DNA, 16 bp, M. musculus
cacacacacctacatg

SEQ ID NO: 374881 - DNA, 16 bp, M. musculus
cacacacacctctgtg

SEQ ID NO: 374882 - DNA, 16 bp, M. musculus
cacacacacctcttcc

SEQ ID NO: 374883 - DNA, 16 bp, M. musculus
cacacacacctgaaaa

SEQ ID NO: 374884 - DNA, 16 bp, M. musculus
cacacacacctgcttc

SEQ ID NO: 374885 - DNA, 16 bp, M. musculus
cacacacacctgtaca

SEQ ID NO: 374886 - DNA, 16 bp, M. musculus
cacacacacctgtata

SEQ ID NO: 374887 - DNA, 16 bp, M. musculus
cacacacacctttccc

SEQ ID NO: 374888 - DNA, 16 bp, M. musculus
cacacacacgagaaag

SEQ ID NO: 374889 - DNA, 16 bp, M. musculus
cacacacacgagagag

SEQ ID NO: 374890 - DNA, 16 bp, M. musculus
cacacacacgagaggg

SEQ ID NO: 374891 - DNA, 16 bp, M. musculus
cacacacacgcacact

SEQ ID NO: 374892 - DNA, 16 bp, M. musculus
cacacacacgcatata

SEQ ID NO: 374893 - DNA, 16 bp, M. musculus
cacacacacgtgcgtg

SEQ ID NO: 374894 - DNA, 16 bp, M. musculus
cacacacactcacacg

SEQ ID NO: 374895 - DNA, 16 bp, M. musculus
cacacacactcactct

SEQ ID NO: 374896 - DNA, 16 bp, M. musculus
cacacacactcactta

SEQ ID NO: 374897 - DNA, 16 bp, M. musculus
cacacacactcattca

SEQ ID NO: 374898 - DNA, 16 bp, M. musculus
cacacacactcctcct

SEQ ID NO: 374899 - DNA, 16 bp, M. musculus
cacacacactccttcc

SEQ ID NO: 374900 - DNA, 16 bp, M. musculus
cacacacactgaaaag

SEQ ID NO: 374901 - DNA, 16 bp, M. musculus
cacacacactgaaatg

SEQ ID NO: 374902 - DNA, 16 bp, M. musculus
cacacacactgagtgg

SEQ ID NO: 374903 - DNA, 16 bp, M. musculus
cacacacactgtaaat

SEQ ID NO: 374904 - DNA, 16 bp, M. musculus
cacacacacttcacta

SEQ ID NO: 374905 - DNA, 16 bp, M. musculus
cacacacacttcatac

SEQ ID NO: 374906 - DNA, 16 bp, M. musculus
cacacacacttcccag

SEQ ID NO: 374907 - DNA, 16 bp, M. musculus
cacacacacttcctct

SEQ ID NO: 374908 - DNA, 16 bp, M. musculus
cacacacacttccttc

SEQ ID NO: 374909 - DNA, 16 bp, M. musculus
cacacacacttgaaca

SEQ ID NO: 374910 - DNA, 16 bp, M. musculus
cacacacacttgcaca

SEQ ID NO: 374911 - DNA, 16 bp, M. musculus
cacacacactttctgt

SEQ ID NO: 374912 - DNA, 16 bp, M. musculus
cacacacactttcttc

SEQ ID NO: 374913 - DNA, 16 bp, M. musculus
cacacacacttttata

SEQ ID NO: 374914 - DNA, 16 bp, M. musculus
cacacacactttttaa

SEQ ID NO: 374915 - DNA, 16 bp, M. musculus
cacacacagaaagata

SEQ ID NO: 374916 - DNA, 16 bp, M. musculus
cacacacagacaaatg

SEQ ID NO: 374917 - DNA, 16 bp, M. musculus
cacacacagacactgg

SEQ ID NO: 374918 - DNA, 16 bp, M. musculus
cacacacagacattca

SEQ ID NO: 374919 - DNA, 16 bp, M. musculus
cacacacagacctaca

SEQ ID NO: 374920 - DNA, 16 bp, M. musculus
cacacacagagaaatg

SEQ ID NO: 374921 - DNA, 16 bp, M. musculus
cacacacagagaacat

SEQ ID NO: 374922 - DNA, 16 bp, M. musculus
cacacacagagaagaa

SEQ ID NO: 374923 - DNA, 16 bp, M. musculus
cacacacagagaaggg

SEQ ID NO: 374924 - DNA, 16 bp, M. musculus
cacacacagagacaca

SEQ ID NO: 374925 - DNA, 16 bp, M. musculus
cacacacagagagaaa

SEQ ID NO: 374926 - DNA, 16 bp, M. musculus
cacacacagagagagc

SEQ ID NO: 374927 - DNA, 16 bp, M. musculus
cacacacagagcacag

SEQ ID NO: 374928 - DNA, 16 bp, M. musculus
cacacacagagcttct

SEQ ID NO: 374929 - DNA, 16 bp, M. musculus
cacacacagaggcaaa

SEQ ID NO: 374930 - DNA, 16 bp, M. musculus
cacacacagaggcagc

SEQ ID NO: 374931 - DNA, 16 bp, M. musculus
cacacacagagtatgt

SEQ ID NO: 374932 - DNA, 16 bp, M. musculus
cacacacagccaccag

SEQ ID NO: 374933 - DNA, 16 bp, M. musculus
cacacacagctaccag

SEQ ID NO: 374934 - DNA, 16 bp, M. musculus
cacacacagctccagc

SEQ ID NO: 374935 - DNA, 16 bp, M. musculus
cacacacaggaagaga

SEQ ID NO: 374936 - DNA, 16 bp, M. musculus
cacacacaggacatct

SEQ ID NO: 374937 - DNA, 16 bp, M. musculus
cacacacaggagagag

SEQ ID NO: 374938 - DNA, 16 bp, M. musculus
cacacacaggagagtt

SEQ ID NO: 374939 - DNA, 16 bp, M. musculus
cacacacaggcacaaa

SEQ ID NO: 374940 - DNA, 16 bp, M. musculus
cacacacaggcacaca

SEQ ID NO: 374941 - DNA, 16 bp, M. musculus
cacacacaggcacatg

SEQ ID NO: 374942 - DNA, 16 bp, M. musculus
cacacacagggtgggg

SEQ ID NO: 374943 - DNA, 16 bp, M. musculus
cacacacaggtacaca

SEQ ID NO: 374944 - DNA, 16 bp, M. musculus
cacacacagtggcaca

SEQ ID NO: 374945 - DNA, 16 bp, M. musculus
cacacacataagaaaa

SEQ ID NO: 374946 - DNA, 16 bp, M. musculus
cacacacatacaaaga

SEQ ID NO: 374947 - DNA, 16 bp, M. musculus
cacacacatacacact

SEQ ID NO: 374948 - DNA, 16 bp, M. musculus
cacacacatacacatg

SEQ ID NO: 374949 - DNA, 16 bp, M. musculus
cacacacatacagaca

SEQ ID NO: 374950 - DNA, 16 bp, M. musculus
cacacacatacagtga

SEQ ID NO: 374951 - DNA, 16 bp, M. musculus
cacacacatacatctt

SEQ ID NO: 374952 - DNA, 16 bp, M. musculus
cacacacatacatgca

SEQ ID NO: 374953 - DNA, 16 bp, M. musculus
cacacacatacatgtg

SEQ ID NO: 374954 - DNA, 16 bp, M. musculus
cacacacataccactc

SEQ ID NO: 374955 - DNA, 16 bp, M. musculus
cacacacatacgcata

SEQ ID NO: 374956 - DNA, 16 bp, M. musculus
cacacacatactcaga

SEQ ID NO: 374957 - DNA, 16 bp, M. musculus
cacacacatacttaca

SEQ ID NO: 374958 - DNA, 16 bp, M. musculus
cacacacataggcaca

SEQ ID NO: 374959 - DNA, 16 bp, M. musculus
cacacacatatacaca

SEQ ID NO: 374960 - DNA, 16 bp, M. musculus
cacacacatatatgtt

SEQ ID NO: 374961 - DNA, 16 bp, M. musculus
cacacacatatgaaaa

SEQ ID NO: 374962 - DNA, 16 bp, M. musculus
cacacacatattcatt

SEQ ID NO: 374963 - DNA, 16 bp, M. musculus
cacacacatatttatg

SEQ ID NO: 374964 - DNA, 16 bp, M. musculus
cacacacatccatgtg

SEQ ID NO: 374965 - DNA, 16 bp, M. musculus
cacacacatgaataca

SEQ ID NO: 374966 - DNA, 16 bp, M. musculus
cacacacatgcaaaga

SEQ ID NO: 374967 - DNA, 16 bp, M. musculus
cacacacatgcaaata

SEQ ID NO: 374968 - DNA, 16 bp, M. musculus
cacacacatgcacaca

SEQ ID NO: 374969 - DNA, 16 bp, M. musculus
cacacacatgcacacc

SEQ ID NO: 374970 - DNA, 16 bp, M. musculus
cacacacatgcacacg

SEQ ID NO: 374971 - DNA, 16 bp, M. musculus
cacacacatgcagaaa

SEQ ID NO: 374972 - DNA, 16 bp, M. musculus
cacacacatgccacag

SEQ ID NO: 374973 - DNA, 16 bp, M. musculus
cacacacatgcttgca

SEQ ID NO: 374974 - DNA, 16 bp, M. musculus
cacacacatgctttct

SEQ ID NO: 374975 - DNA, 16 bp, M. musculus
cacacacatgtacaca

SEQ ID NO: 374976 - DNA, 16 bp, M. musculus
cacacacatgtattca

SEQ ID NO: 374977 - DNA, 16 bp, M. musculus
cacacacatgtgcaca

SEQ ID NO: 374978 - DNA, 16 bp, M. musculus
cacacacatgtgcttg

SEQ ID NO: 374979 - DNA, 16 bp, M. musculus
cacacacatgtgtgca

SEQ ID NO: 374980 - DNA, 16 bp, M. musculus
cacacacatgtgtgtg

SEQ ID NO: 374981 - DNA, 16 bp, M. musculus
cacacacatgttcaca

SEQ ID NO: 374982 - DNA, 16 bp, M. musculus
cacacacattaataaa

SEQ ID NO: 374983 - DNA, 16 bp, M. musculus
cacacacattcaaaac

SEQ ID NO: 374984 - DNA, 16 bp, M. musculus
cacacacattcatgca

SEQ ID NO: 374985 - DNA, 16 bp, M. musculus
cacacacatttattat

SEQ ID NO: 374986 - DNA, 16 bp, M. musculus
cacacacatttgaaaa

SEQ ID NO: 374987 - DNA, 16 bp, M. musculus
cacacacattttcttt

SEQ ID NO: 374988 - DNA, 16 bp, M. musculus
cacacaccacaggcac

SEQ ID NO: 374989 - DNA, 16 bp, M. musculus
cacacaccatatacca

SEQ ID NO: 374990 - DNA, 16 bp, M. musculus
cacacacccatacata

SEQ ID NO: 374991 - DNA, 16 bp, M. musculus
cacacacccatgtaca

SEQ ID NO: 374992 - DNA, 16 bp, M. musculus
cacacacccatgtact

SEQ ID NO: 374993 - DNA, 16 bp, M. musculus
cacacacctatacaca

SEQ ID NO: 374994 - DNA, 16 bp, M. musculus
cacacacctgtgtgtg

SEQ ID NO: 374995 - DNA, 16 bp, M. musculus
cacacaccttttatct

SEQ ID NO: 374996 - DNA, 16 bp, M. musculus
cacacacgaacatgca

SEQ ID NO: 374997 - DNA, 16 bp, M. musculus
cacacacgcacacaga

SEQ ID NO: 374998 - DNA, 16 bp, M. musculus
cacacacgcacgcaca

SEQ ID NO: 374999 - DNA, 16 bp, M. musculus
cacacacgcacgcact

SEQ ID NO: 375000 - DNA, 16 bp, M. musculus
cacacacgcacgcgcg

SEQ ID NO: 375001 - DNA, 16 bp, M. musculus
cacacacgcgcacgca

SEQ ID NO: 375002 - DNA, 16 bp, M. musculus
cacacacgctccaggc

SEQ ID NO: 375003 - DNA, 16 bp, M. musculus
cacacacggctctcct

SEQ ID NO: 375004 - DNA, 16 bp, M. musculus
cacacacgtatgtata

SEQ ID NO: 375005 - DNA, 16 bp, M. musculus
cacacacgtgcacaca

SEQ ID NO: 375006 - DNA, 16 bp, M. musculus
cacacacgtgcgcgtg

SEQ ID NO: 375007 - DNA, 16 bp, M. musculus
cacacacgtgtgtgtg

SEQ ID NO: 375008 - DNA, 16 bp, M. musculus
cacacactcacacatg

SEQ ID NO: 375009 - DNA, 16 bp, M. musculus
cacacactcacacgta

SEQ ID NO: 375010 - DNA, 16 bp, M. musculus
cacacactcacatact

SEQ ID NO: 375011 - DNA, 16 bp, M. musculus
cacacactcacatata

SEQ ID NO: 375012 - DNA, 16 bp, M. musculus
cacacactcacgcaca

SEQ ID NO: 375013 - DNA, 16 bp, M. musculus
cacacactcatccaca

SEQ ID NO: 375014 - DNA, 16 bp, M. musculus
cacacactcattcata

SEQ ID NO: 375015 - DNA, 16 bp, M. musculus
cacacactcctacttc

SEQ ID NO: 375016 - DNA, 16 bp, M. musculus
cacacactctctctca

SEQ ID NO: 375017 - DNA, 16 bp, M. musculus
cacacactgagacaca

SEQ ID NO: 375018 - DNA, 16 bp, M. musculus
cacacacttacactca

SEQ ID NO: 375019 - DNA, 16 bp, M. musculus
cacacacttacataca

SEQ ID NO: 375020 - DNA, 16 bp, M. musculus
cacacacttgcacaga

SEQ ID NO: 375021 - DNA, 16 bp, M. musculus
cacacactttctcaca

SEQ ID NO: 375022 - DNA, 16 bp, M. musculus
cacacactttctttct

SEQ ID NO: 375023 - DNA, 16 bp, M. musculus
cacacactttcttttt

SEQ ID NO: 375024 - DNA, 16 bp, M. musculus
cacacactttttgttt

SEQ ID NO: 375025 - DNA, 16 bp, M. musculus
cacacagaaacatgca

SEQ ID NO: 375026 - DNA, 16 bp, M. musculus
cacacagaaatcccat

SEQ ID NO: 375027 - DNA, 16 bp, M. musculus
cacacagacaaaatac

SEQ ID NO: 375028 - DNA, 16 bp, M. musculus
cacacagacacaataa

SEQ ID NO: 375029 - DNA, 16 bp, M. musculus
cacacagacacattca

SEQ ID NO: 375030 - DNA, 16 bp, M. musculus
cacacagacacggaca

SEQ ID NO: 375031 - DNA, 16 bp, M. musculus
cacacagacactcaca

SEQ ID NO: 375032 - DNA, 16 bp, M. musculus
cacacagacactgaca

SEQ ID NO: 375033 - DNA, 16 bp, M. musculus
cacacagacatacatg

SEQ ID NO: 375034 - DNA, 16 bp, M. musculus
cacacagacatataca

SEQ ID NO: 375035 - DNA, 16 bp, M. musculus
cacacagacatgcaca

SEQ ID NO: 375036 - DNA, 16 bp, M. musculus
cacacagacatgtgca

SEQ ID NO: 375037 - DNA, 16 bp, M. musculus
cacacagacttacaca

SEQ ID NO: 375038 - DNA, 16 bp, M. musculus
cacacagagaaaggga

SEQ ID NO: 375039 - DNA, 16 bp, M. musculus
cacacagagacacata

SEQ ID NO: 375040 - DNA, 16 bp, M. musculus
cacacagagagacaga

SEQ ID NO: 375041 - DNA, 16 bp, M. musculus
cacacagagagagata

SEQ ID NO: 375042 - DNA, 16 bp, M. musculus
cacacagagagatgca

SEQ ID NO: 375043 - DNA, 16 bp, M. musculus
cacacagagcacagag

SEQ ID NO: 375044 - DNA, 16 bp, M. musculus
cacacagagccacaca

SEQ ID NO: 375045 - DNA, 16 bp, M. musculus
cacacagagctctggg

SEQ ID NO: 375046 - DNA, 16 bp, M. musculus
cacacagaggaagagg

SEQ ID NO: 375047 - DNA, 16 bp, M. musculus
cacacagaggacctgg

SEQ ID NO: 375048 - DNA, 16 bp, M. musculus
cacacagaggctcaca

SEQ ID NO: 375049 - DNA, 16 bp, M. musculus
cacacagatatataca

SEQ ID NO: 375050 - DNA, 16 bp, M. musculus
cacacagatccacaca

SEQ ID NO: 375051 - DNA, 16 bp, M. musculus
cacacagatgctcaca

SEQ ID NO: 375052 - DNA, 16 bp, M. musculus
cacacagcaagcaggt

SEQ ID NO: 375053 - DNA, 16 bp, M. musculus
cacacagcacacacat

SEQ ID NO: 375054 - DNA, 16 bp, M. musculus
cacacagcacagctgt

SEQ ID NO: 375055 - DNA, 16 bp, M. musculus
cacacagcagcagcag

SEQ ID NO: 375056 - DNA, 16 bp, M. musculus
cacacagcaggtgctc

SEQ ID NO: 375057 - DNA, 16 bp, M. musculus
cacacagcagttcaca

SEQ ID NO: 375058 - DNA, 16 bp, M. musculus
cacacagccctgggtg

SEQ ID NO: 375059 - DNA, 16 bp, M. musculus
cacacagcctttatat

SEQ ID NO: 375060 - DNA, 16 bp, M. musculus
cacacagctacacaca

SEQ ID NO: 375061 - DNA, 16 bp, M. musculus
cacacagctccacaca

SEQ ID NO: 375062 - DNA, 16 bp, M. musculus
cacacagcttttatat

SEQ ID NO: 375063 - DNA, 16 bp, M. musculus
cacacaggacacacag

SEQ ID NO: 375064 - DNA, 16 bp, M. musculus
cacacaggagaaaagc

SEQ ID NO: 375065 - DNA, 16 bp, M. musculus
cacacaggagagagaa

SEQ ID NO: 375066 - DNA, 16 bp, M. musculus
cacacaggcaaaacac

SEQ ID NO: 375067 - DNA, 16 bp, M. musculus
cacacaggcacacaaa

SEQ ID NO: 375068 - DNA, 16 bp, M. musculus
cacacaggcacacaca

SEQ ID NO: 375069 - DNA, 16 bp, M. musculus
cacacaggcacaccca

SEQ ID NO: 375070 - DNA, 16 bp, M. musculus
cacacaggcacaggca

SEQ ID NO: 375071 - DNA, 16 bp, M. musculus
cacacaggcacgcaca

SEQ ID NO: 375072 - DNA, 16 bp, M. musculus
cacacagggacacaca

SEQ ID NO: 375073 - DNA, 16 bp, M. musculus
cacacaggtacacaca

SEQ ID NO: 375074 - DNA, 16 bp, M. musculus
cacacaggtgaaaaga

SEQ ID NO: 375075 - DNA, 29 bp, M. musculus
cacacaggtgattgaggttatggtctcat

SEQ ID NO: 375076 - DNA, 16 bp, M. musculus
cacacaggtgtgctca

SEQ ID NO: 375077 - DNA, 16 bp, M. musculus
cacacagtagattcca

SEQ ID NO: 375078 - DNA, 16 bp, M. musculus
cacacagtcacataca

SEQ ID NO: 375079 - DNA, 16 bp, M. musculus
cacacagtcatacaca

SEQ ID NO: 375080 - DNA, 16 bp, M. musculus
cacacagtgcacacac

SEQ ID NO: 375081 - DNA, 16 bp, M. musculus
cacacagtggctcaca

SEQ ID NO: 375082 - DNA, 16 bp, M. musculus
cacacataaatacata

SEQ ID NO: 375083 - DNA, 16 bp, M. musculus
cacacataaatgaaaa

SEQ ID NO: 375084 - DNA, 16 bp, M. musculus
cacacatacaagcaca

SEQ ID NO: 375085 - DNA, 16 bp, M. musculus
cacacatacacacata

SEQ ID NO: 375086 - DNA, 16 bp, M. musculus
cacacatacacactca

SEQ ID NO: 375087 - DNA, 16 bp, M. musculus
cacacatacacatgta

SEQ ID NO: 375088 - DNA, 16 bp, M. musculus
cacacatacacctgca

SEQ ID NO: 375089 - DNA, 16 bp, M. musculus
cacacatacacgcaca

SEQ ID NO: 375090 - DNA, 16 bp, M. musculus
cacacatacagataaa

SEQ ID NO: 375091 - DNA, 16 bp, M. musculus
cacacatacatataaa

SEQ ID NO: 375092 - DNA, 16 bp, M. musculus
cacacatacatataca

SEQ ID NO: 375093 - DNA, 16 bp, M. musculus
cacacatacatgtgca

SEQ ID NO: 375094 - DNA, 16 bp, M. musculus
cacacataccacacat

SEQ ID NO: 375095 - DNA, 16 bp, M. musculus
cacacatacgtgtgtg

SEQ ID NO: 375096 - DNA, 16 bp, M. musculus
cacacatagacacaca

SEQ ID NO: 375097 - DNA, 16 bp, M. musculus
cacacatagacagaca

SEQ ID NO: 375098 - DNA, 16 bp, M. musculus
cacacatagatacaca

SEQ ID NO: 375099 - DNA, 16 bp, M. musculus
cacacatatacaaata

SEQ ID NO: 375100 - DNA, 17 bp, M. musculus
cacacatatacacacat

SEQ ID NO: 375101 - DNA, 16 bp, M. musculus
cacacatatacacact

SEQ ID NO: 375102 - DNA, 16 bp, M. musculus
cacacatatacaccat

SEQ ID NO: 375103 - DNA, 16 bp, M. musculus
cacacatatatattta

SEQ ID NO: 375104 - DNA, 16 bp, M. musculus
cacacatatatgcaca

SEQ ID NO: 375105 - DNA, 16 bp, M. musculus
cacacatatgaataaa

SEQ ID NO: 375106 - DNA, 16 bp, M. musculus
cacacatatgcacaca

SEQ ID NO: 375107 - DNA, 16 bp, M. musculus
cacacatatgcacata

SEQ ID NO: 375108 - DNA, 16 bp, M. musculus
cacacatatgcacatg

SEQ ID NO: 375109 - DNA, 16 bp, M. musculus
cacacatatgtacaca

SEQ ID NO: 375110 - DNA, 16 bp, M. musculus
cacacatatgtgcaca

SEQ ID NO: 375111 - DNA, 16 bp, M. musculus
cacacatatgtgtgca

SEQ ID NO: 375112 - DNA, 16 bp, M. musculus
cacacatattcaaaca

SEQ ID NO: 375113 - DNA, 16 bp, M. musculus
cacacatcatttaaaa

SEQ ID NO: 375114 - DNA, 16 bp, M. musculus
cacacatctgtaattc

SEQ ID NO: 375115 - DNA, 16 bp, M. musculus
cacacatgaaataaat

SEQ ID NO: 375116 - DNA, 16 bp, M. musculus
cacacatgaacacaca

SEQ ID NO: 375117 - DNA, 16 bp, M. musculus
cacacatgaacataca

SEQ ID NO: 375118 - DNA, 16 bp, M. musculus
cacacatgcaagtgtg

SEQ ID NO: 375119 - DNA, 16 bp, M. musculus
cacacatgcacaaatg

SEQ ID NO: 375120 - DNA, 16 bp, M. musculus
cacacatgcacacaca

SEQ ID NO: 375121 - DNA, 16 bp, M. musculus
cacacatgcacacacg

SEQ ID NO: 375122 - DNA, 16 bp, M. musculus
cacacatgcacacata

SEQ ID NO: 375123 - DNA, 16 bp, M. musculus
cacacatgcacacgtg

SEQ ID NO: 375124 - DNA, 16 bp, M. musculus
cacacatgcacagaca

SEQ ID NO: 375125 - DNA, 16 bp, M. musculus
cacacatgcacatgca

SEQ ID NO: 375126 - DNA, 16 bp, M. musculus
cacacatgcacgcact

SEQ ID NO: 375127 - DNA, 16 bp, M. musculus
cacacatgcagagaga

SEQ ID NO: 375128 - DNA, 16 bp, M. musculus
cacacatgcagatgtg

SEQ ID NO: 375129 - DNA, 16 bp, M. musculus
cacacatgcatacaca

SEQ ID NO: 375130 - DNA, 16 bp, M. musculus
cacacatgcatataca

SEQ ID NO: 375131 - DNA, 16 bp, M. musculus
cacacatgcatgcatg

SEQ ID NO: 375132 - DNA, 16 bp, M. musculus
cacacatgcatgtgaa

SEQ ID NO: 375133 - DNA, 16 bp, M. musculus
cacacatgcttgtaca

SEQ ID NO: 375134 - DNA, 16 bp, M. musculus
cacacatggacacaca

SEQ ID NO: 375135 - DNA, 16 bp, M. musculus
cacacatggtgcacac

SEQ ID NO: 375136 - DNA, 16 bp, M. musculus
cacacatgtacataca

SEQ ID NO: 375137 - DNA, 16 bp, M. musculus
cacacatgtacatgca

SEQ ID NO: 375138 - DNA, 16 bp, M. musculus
cacacatgtacatgtg

SEQ ID NO: 375139 - DNA, 16 bp, M. musculus
cacacatgtatataat

SEQ ID NO: 375140 - DNA, 16 bp, M. musculus
cacacatgtatatatg

SEQ ID NO: 375141 - DNA, 16 bp, M. musculus
cacacatgtctgtgtg

SEQ ID NO: 375142 - DNA, 16 bp, M. musculus
cacacatgtgaacata

SEQ ID NO: 375143 - DNA, 16 bp, M. musculus
cacacatgtgaatata

SEQ ID NO: 375144 - DNA, 16 bp, M. musculus
cacacatgtgcacgtg

SEQ ID NO: 375145 - DNA, 16 bp, M. musculus
cacacatgtgcaggtg

SEQ ID NO: 375146 - DNA, 16 bp, M. musculus
cacacatgtgtacaca

SEQ ID NO: 375147 - DNA, 16 bp, M. musculus
cacacatgtgtgagtg

SEQ ID NO: 375148 - DNA, 16 bp, M. musculus
cacacatgtgtgcaca

SEQ ID NO: 375149 - DNA, 16 bp, M. musculus
cacacattcacacaca

SEQ ID NO: 375150 - DNA, 16 bp, M. musculus
cacacatttacacatg

SEQ ID NO: 375151 - DNA, 16 bp, M. musculus
cacacattttaaaaat

SEQ ID NO: 375152 - DNA, 16 bp, M. musculus
cacacattttatattt

SEQ ID NO: 375153 - DNA, 16 bp, M. musculus
cacaccaatggtcact

SEQ ID NO: 375154 - DNA, 16 bp, M. musculus
cacaccacaagagggc

SEQ ID NO: 375155 - DNA, 16 bp, M. musculus
cacaccacacacaggc

SEQ ID NO: 375156 - DNA, 16 bp, M. musculus
cacaccagaaaaggac

SEQ ID NO: 375157 - DNA, 16 bp, M. musculus
cacaccagcagagggc

SEQ ID NO: 375158 - DNA, 16 bp, M. musculus
cacaccaggccaaagc

SEQ ID NO: 375159 - DNA, 16 bp, M. musculus
cacaccaggctggcct

SEQ ID NO: 375160 - DNA, 16 bp, M. musculus
cacaccattaatccca

SEQ ID NO: 375161 - DNA, 16 bp, M. musculus
cacacccacagagaga

SEQ ID NO: 375162 - DNA, 16 bp, M. musculus
cacacccacagtgatg

SEQ ID NO: 375163 - DNA, 16 bp, M. musculus
cacacccacatgtaca

SEQ ID NO: 375164 - DNA, 16 bp, M. musculus
cacacccacttcctgg

SEQ ID NO: 375165 - DNA, 16 bp, M. musculus
cacacccagctctttt

SEQ ID NO: 375166 - DNA, 16 bp, M. musculus
cacacccagcttttct

SEQ ID NO: 375167 - DNA, 16 bp, M. musculus
cacacccaggctcaca

SEQ ID NO: 375168 - DNA, 16 bp, M. musculus
cacacccatgcatgca

SEQ ID NO: 375169 - DNA, 16 bp, M. musculus
cacacccctgcacaca

SEQ ID NO: 375170 - DNA, 16 bp, M. musculus
cacacctacaatccca

SEQ ID NO: 375171 - DNA, 16 bp, M. musculus
cacacctactcaaaca

SEQ ID NO: 375172 - DNA, 16 bp, M. musculus
cacacctactccaaca

SEQ ID NO: 375173 - DNA, 16 bp, M. musculus
cacacctactccagca

SEQ ID NO: 375174 - DNA, 16 bp, M. musculus
cacacctactctaaca

SEQ ID NO: 375175 - DNA, 16 bp, M. musculus
cacacctattccaaca

SEQ ID NO: 375176 - DNA, 16 bp, M. musculus
cacacctcacacacat

SEQ ID NO: 375177 - DNA, 16 bp, M. musculus
cacacctcatccaaca

SEQ ID NO: 375178 - DNA, 16 bp, M. musculus
cacacctccaaataat

SEQ ID NO: 375179 - DNA, 16 bp, M. musculus
cacacctcctaatcct

SEQ ID NO: 375180 - DNA, 16 bp, M. musculus
cacacctctgcagcag

SEQ ID NO: 375181 - DNA, 16 bp, M. musculus
cacacctctgggcatg

SEQ ID NO: 375182 - DNA, 16 bp, M. musculus
cacacctcttaacagt

SEQ ID NO: 375183 - DNA, 16 bp, M. musculus
cacacctgacagacca

SEQ ID NO: 375184 - DNA, 16 bp, M. musculus
cacacctgcctctgcc

SEQ ID NO: 375185 - DNA, 16 bp, M. musculus
cacacctgcctgcctg

SEQ ID NO: 375186 - DNA, 16 bp, M. musculus
cacacctggacctaaa

SEQ ID NO: 375187 - DNA, 16 bp, M. musculus
cacacctggcttttta

SEQ ID NO: 375188 - DNA, 16 bp, M. musculus
cacacctgggaagagg

SEQ ID NO: 375189 - DNA, 16 bp, M. musculus
cacacctgtaatccta

SEQ ID NO: 375190 - DNA, 16 bp, M. musculus
cacacctgtaatctca

SEQ ID NO: 375191 - DNA, 16 bp, M. musculus
cacacctgtgatcctg

SEQ ID NO: 375192 - DNA, 16 bp, M. musculus
cacacctgtgtacaca

SEQ ID NO: 375193 - DNA, 17 bp, M. musculus
cacaccttcagatggtg

SEQ ID NO: 375194 - DNA, 18 bp, M. musculus
cacacctttaatcccaga

SEQ ID NO: 375195 - DNA, 16 bp, M. musculus
cacacctttaatcccg

SEQ ID NO: 375196 - DNA, 16 bp, M. musculus
cacacctttaatccct

SEQ ID NO: 375197 - DNA, 16 bp, M. musculus
cacacctttaatctta

SEQ ID NO: 375198 - DNA, 16 bp, M. musculus
cacacctttagttcca

SEQ ID NO: 375199 - DNA, 16 bp, M. musculus
cacacctttcatccca

SEQ ID NO: 375200 - DNA, 16 bp, M. musculus
cacacctttgcctcct

SEQ ID NO: 375201 - DNA, 16 bp, M. musculus
cacacctttggtccca

SEQ ID NO: 375202 - DNA, 19 bp, M. musculus
cacacgcacacgcacacgc

SEQ ID NO: 375203 - DNA, 16 bp, M. musculus
cacacgcacacgtgca

SEQ ID NO: 375204 - DNA, 16 bp, M. musculus
cacacgcacagagaga

SEQ ID NO: 375205 - DNA, 16 bp, M. musculus
cacacgcatacacata

SEQ ID NO: 375206 - DNA, 16 bp, M. musculus
cacacgcatgcatgca

SEQ ID NO: 375207 - DNA, 16 bp, M. musculus
cacacgcatgcgcaca

SEQ ID NO: 375208 - DNA, 16 bp, M. musculus
cacacgcatgtgtgtg

SEQ ID NO: 375209 - DNA, 16 bp, M. musculus
cacacgcgtcatcctc

SEQ ID NO: 375210 - DNA, 16 bp, M. musculus
cacacggacacagaca

SEQ ID NO: 375211 - DNA, 16 bp, M. musculus
cacacggtgactcaca

SEQ ID NO: 375212 - DNA, 16 bp, M. musculus
cacacggtggaaggaa

SEQ ID NO: 375213 - DNA, 16 bp, M. musculus
cacacggtggctcaca

SEQ ID NO: 375214 - DNA, 16 bp, M. musculus
cacacgtgcacacaga

SEQ ID NO: 375215 - DNA, 16 bp, M. musculus
cacacgtgcgcgcgca

SEQ ID NO: 375216 - DNA, 16 bp, M. musculus
cacacgtgtgctgtgg

SEQ ID NO: 375217 - DNA, 16 bp, M. musculus
cacactagaagaggga

SEQ ID NO: 375218 - DNA, 16 bp, M. musculus
cacactcacaaacact

SEQ ID NO: 375219 - DNA, 16 bp, M. musculus
cacactcacaaaggaa

SEQ ID NO: 375220 - DNA, 16 bp, M. musculus
cacactcacacacgca

SEQ ID NO: 375221 - DNA, 16 bp, M. musculus
cacactcacacataca

SEQ ID NO: 375222 - DNA, 16 bp, M. musculus
cacactcacacatgaa

SEQ ID NO: 375223 - DNA, 16 bp, M. musculus
cacactcacacatgtg

SEQ ID NO: 375224 - DNA, 16 bp, M. musculus
cacactcacactcaca

SEQ ID NO: 375225 - DNA, 16 bp, M. musculus
cacactcacatgcaca

SEQ ID NO: 375226 - DNA, 16 bp, M. musculus
cacactcatacacata

SEQ ID NO: 375227 - DNA, 16 bp, M. musculus
cacactcatatacaca

SEQ ID NO: 375228 - DNA, 16 bp, M. musculus
cacactcatccacaca

SEQ ID NO: 375229 - DNA, 16 bp, M. musculus
cacactcatgcactca

SEQ ID NO: 375230 - DNA, 16 bp, M. musculus
cacactcatgtataca

SEQ ID NO: 375231 - DNA, 16 bp, M. musculus
cacactcatgtgcaca

SEQ ID NO: 375232 - DNA, 16 bp, M. musculus
cacactccagggcagg

SEQ ID NO: 375233 - DNA, 16 bp, M. musculus
cacactccagtggatg

SEQ ID NO: 375234 - DNA, 16 bp, M. musculus
cacactcccttttcct

SEQ ID NO: 375235 - DNA, 16 bp, M. musculus
cacactcctgccacca

SEQ ID NO: 375236 - DNA, 16 bp, M. musculus
cacactcctgctgcca

SEQ ID NO: 375237 - DNA, 31 bp, M. musculus
cacactctgcacctaacacatgtgccaaaca

SEQ ID NO: 375238 - DNA, 16 bp, M. musculus
cacactctggaagacc

SEQ ID NO: 375239 - DNA, 16 bp, M. musculus
cacactgacacaccta

SEQ ID NO: 375240 - DNA, 16 bp, M. musculus
cacactgacacacttc

SEQ ID NO: 375241 - DNA, 16 bp, M. musculus
cacactgagaaagaaa

SEQ ID NO: 375242 - DNA, 16 bp, M. musculus
cacactgagaagacca

SEQ ID NO: 375243 - DNA, 16 bp, M. musculus
cacactgcagctcaca

SEQ ID NO: 375244 - DNA, 16 bp, M. musculus
cacactgctcttccag

SEQ ID NO: 375245 - DNA, 16 bp, M. musculus
cacactgctgggaggg

SEQ ID NO: 375246 - DNA, 16 bp, M. musculus
cacactggaaaaaaag

SEQ ID NO: 375247 - DNA, 16 bp, M. musculus
cacactggagaaaaga

SEQ ID NO: 375248 - DNA, 16 bp, M. musculus
cacactggagaggctg

SEQ ID NO: 375249 - DNA, 16 bp, M. musculus
cacactgggaacattt

SEQ ID NO: 375250 - DNA, 18 bp, M. musculus
cacactgggtcccctgtt

SEQ ID NO: 375251 - DNA, 16 bp, M. musculus
cacactgggtggaact

SEQ ID NO: 375252 - DNA, 16 bp, M. musculus
cacactgtgctccctc

SEQ ID NO: 375253 - DNA, 16 bp, M. musculus
cacacttacaatccca

SEQ ID NO: 375254 - DNA, 16 bp, M. musculus
cacacttacacacatt

SEQ ID NO: 375255 - DNA, 16 bp, M. musculus
cacacttcctccacca

SEQ ID NO: 375256 - DNA, 16 bp, M. musculus
cacacttctctctctc

SEQ ID NO: 375257 - DNA, 16 bp, M. musculus
cacacttgggaagcag

SEQ ID NO: 375258 - DNA, 16 bp, M. musculus
cacactttcacacaca

SEQ ID NO: 375259 - DNA, 16 bp, M. musculus
cacactttgtctcctt

SEQ ID NO: 375260 - DNA, 16 bp, M. musculus
cacagaaaaccacagc

SEQ ID NO: 375261 - DNA, 16 bp, M. musculus
cacagaaagccctgga

SEQ ID NO: 375262 - DNA, 16 bp, M. musculus
cacagaaagttccagg

SEQ ID NO: 375263 - DNA, 16 bp, M. musculus
cacagaaataaaaatg

SEQ ID NO: 375264 - DNA, 16 bp, M. musculus
cacagaaatcagcctg

SEQ ID NO: 375265 - DNA, 16 bp, M. musculus
cacagaaatcctcctg

SEQ ID NO: 375266 - DNA, 16 bp, M. musculus
cacagaaatggaaacc

SEQ ID NO: 375267 - DNA, 16 bp, M. musculus
cacagaaatggatgct

SEQ ID NO: 375268 - DNA, 16 bp, M. musculus
cacagaaccaagagcc

SEQ ID NO: 375269 - DNA, 16 bp, M. musculus
cacagaaccaagggcc

SEQ ID NO: 375270 - DNA, 16 bp, M. musculus
cacagaactcaaaaat

SEQ ID NO: 375271 - DNA, 16 bp, M. musculus
cacagaactcaagaaa

SEQ ID NO: 375272 - DNA, 16 bp, M. musculus
cacagaactcagaaag

SEQ ID NO: 375273 - DNA, 16 bp, M. musculus
cacagaactcagaact

SEQ ID NO: 375274 - DNA, 16 bp, M. musculus
cacagaactggatgct

SEQ ID NO: 375275 - DNA, 16 bp, M. musculus
cacagaacttatgggt

SEQ ID NO: 375276 - DNA, 16 bp, M. musculus
cacagaagaaaaagat

SEQ ID NO: 375277 - DNA, 16 bp, M. musculus
cacagaagacagacaa

SEQ ID NO: 375278 - DNA, 16 bp, M. musculus
cacagaagaccagctg

SEQ ID NO: 375279 - DNA, 16 bp, M. musculus
cacagaagacctggtg

SEQ ID NO: 375280 - DNA, 16 bp, M. musculus
cacagaagaggaggag

SEQ ID NO: 375281 - DNA, 16 bp, M. musculus
cacagaagcaagaaga

SEQ ID NO: 375282 - DNA, 16 bp, M. musculus
cacagaagcagcagag

SEQ ID NO: 375283 - DNA, 16 bp, M. musculus
cacagaagccagagaa

SEQ ID NO: 375284 - DNA, 16 bp, M. musculus
cacagaagccagaggc

SEQ ID NO: 375285 - DNA, 23 bp, M. musculus
cacagaagccctgaaattggcaa

SEQ ID NO: 375286 - DNA, 16 bp, M. musculus
cacagaagctgtggtc

SEQ ID NO: 375287 - DNA, 16 bp, M. musculus
cacagaagctgttagc

SEQ ID NO: 375288 - DNA, 16 bp, M. musculus
cacagaaggaaaaact

SEQ ID NO: 375289 - DNA, 16 bp, M. musculus
cacagaaggaaggaag

SEQ ID NO: 375290 - DNA, 16 bp, M. musculus
cacagaaggcagaggg

SEQ ID NO: 375291 - DNA, 16 bp, M. musculus
cacagaatgggagaaa

SEQ ID NO: 375292 - DNA, 16 bp, M. musculus
cacagaattcaaaaag

SEQ ID NO: 375293 - DNA, 16 bp, M. musculus
cacagaatttttaaaa

SEQ ID NO: 375294 - DNA, 16 bp, M. musculus
cacagacaagcaacag

SEQ ID NO: 375295 - DNA, 16 bp, M. musculus
cacagacaagcacaca

SEQ ID NO: 375296 - DNA, 16 bp, M. musculus
cacagacacaatcaca

SEQ ID NO: 375297 - DNA, 16 bp, M. musculus
cacagacacacaaatc

SEQ ID NO: 375298 - DNA, 16 bp, M. musculus
cacagacacacacact

SEQ ID NO: 375299 - DNA, 16 bp, M. musculus
cacagacacacacata

SEQ ID NO: 375300 - DNA, 16 bp, M. musculus
cacagacacacagaga

SEQ ID NO: 375301 - DNA, 16 bp, M. musculus
cacagacacacagatg

SEQ ID NO: 375302 - DNA, 16 bp, M. musculus
cacagacacacataca

SEQ ID NO: 375303 - DNA, 16 bp, M. musculus
cacagacacacatgca

SEQ ID NO: 375304 - DNA, 16 bp, M. musculus
cacagacacaggcaga

SEQ ID NO: 375305 - DNA, 16 bp, M. musculus
cacagacacagtgaaa

SEQ ID NO: 375306 - DNA, 16 bp, M. musculus
cacagacacataaata

SEQ ID NO: 375307 - DNA, 16 bp, M. musculus
cacagacacatgcaca

SEQ ID NO: 375308 - DNA, 18 bp, M. musculus
cacagacaccagaccaag

SEQ ID NO: 375309 - DNA, 16 bp, M. musculus
cacagacaccatgacc

SEQ ID NO: 375310 - DNA, 16 bp, M. musculus
cacagacacctgcact

SEQ ID NO: 375311 - DNA, 16 bp, M. musculus
cacagacactgaacca

SEQ ID NO: 375312 - DNA, 16 bp, M. musculus
cacagacagcacagca

SEQ ID NO: 375313 - DNA, 16 bp, M. musculus
cacagacagctggcca

SEQ ID NO: 375314 - DNA, 16 bp, M. musculus
cacagacaggaaacag

SEQ ID NO: 375315 - DNA, 16 bp, M. musculus
cacagacaggtgctct

SEQ ID NO: 375316 - DNA, 16 bp, M. musculus
cacagacatacataca

SEQ ID NO: 375317 - DNA, 16 bp, M. musculus
cacagacatacatcca

SEQ ID NO: 375318 - DNA, 16 bp, M. musculus
cacagacatacatgca

SEQ ID NO: 375319 - DNA, 16 bp, M. musculus
cacagacatagataca

SEQ ID NO: 375320 - DNA, 16 bp, M. musculus
cacagacatcatgacc

SEQ ID NO: 375321 - DNA, 16 bp, M. musculus
cacagacatcctcctg

SEQ ID NO: 375322 - DNA, 16 bp, M. musculus
cacagacatgcacaca

SEQ ID NO: 375323 - DNA, 16 bp, M. musculus
cacagacatgcccaca

SEQ ID NO: 375324 - DNA, 16 bp, M. musculus
cacagacatggaaaaa

SEQ ID NO: 375325 - DNA, 16 bp, M. musculus
cacagacatgtacaca

SEQ ID NO: 375326 - DNA, 16 bp, M. musculus
cacagaccaacctgat

SEQ ID NO: 375327 - DNA, 16 bp, M. musculus
cacagaccacagacat

SEQ ID NO: 375328 - DNA, 16 bp, M. musculus
cacagaccatatgaag

SEQ ID NO: 375329 - DNA, 16 bp, M. musculus
cacagacccaaggaag

SEQ ID NO: 375330 - DNA, 16 bp, M. musculus
cacagacccagaaaga

SEQ ID NO: 375331 - DNA, 16 bp, M. musculus
cacagacccagagagg

SEQ ID NO: 375332 - DNA, 16 bp, M. musculus
cacagaccctctgggt

SEQ ID NO: 375333 - DNA, 16 bp, M. musculus
cacagacctacatgca

SEQ ID NO: 375334 - DNA, 16 bp, M. musculus
cacagacgtgtgtgtg

SEQ ID NO: 375335 - DNA, 16 bp, M. musculus
cacagactatgaaagc

SEQ ID NO: 375336 - DNA, 16 bp, M. musculus
cacagactcacagaga

SEQ ID NO: 375337 - DNA, 16 bp, M. musculus
cacagactcacatgca

SEQ ID NO: 375338 - DNA, 16 bp, M. musculus
cacagactccaggagc

SEQ ID NO: 375339 - DNA, 16 bp, M. musculus
cacagactgtctctgt

SEQ ID NO: 375340 - DNA, 16 bp, M. musculus
cacagagaaaaaatca

SEQ ID NO: 375341 - DNA, 16 bp, M. musculus
cacagagaaaaccctg

SEQ ID NO: 375342 - DNA, 16 bp, M. musculus
cacagagaaaccctac

SEQ ID NO: 375343 - DNA, 16 bp, M. musculus
cacagagaaaccctgc

SEQ ID NO: 375344 - DNA, 16 bp, M. musculus
cacagagaaaccttgt

SEQ ID NO: 375345 - DNA, 16 bp, M. musculus
cacagagaaactcaaa

SEQ ID NO: 375346 - DNA, 16 bp, M. musculus
cacagagaaactctgg

SEQ ID NO: 375347 - DNA, 16 bp, M. musculus
cacagagaaactttgt

SEQ ID NO: 375348 - DNA, 20 bp, M. musculus
cacagagaaaggagcttcag

SEQ ID NO: 375349 - DNA, 16 bp, M. musculus
cacagagaaatcctga

SEQ ID NO: 375350 - DNA, 16 bp, M. musculus
cacagagaagagagag

SEQ ID NO: 375351 - DNA, 16 bp, M. musculus
cacagagaagcacaca

SEQ ID NO: 375352 - DNA, 16 bp, M. musculus
cacagagaagcactaa

SEQ ID NO: 375353 - DNA, 16 bp, M. musculus
cacagagaagcactgt

SEQ ID NO: 375354 - DNA, 16 bp, M. musculus
cacagagaagccctat

SEQ ID NO: 375355 - DNA, 16 bp, M. musculus
cacagagaagctctgt

SEQ ID NO: 375356 - DNA, 16 bp, M. musculus
cacagagaagctgtgt

SEQ ID NO: 375357 - DNA, 16 bp, M. musculus
cacagagaagggggag

SEQ ID NO: 375358 - DNA, 16 bp, M. musculus
cacagagacacaccca

SEQ ID NO: 375359 - DNA, 16 bp, M. musculus
cacagagacagaaagt

SEQ ID NO: 375360 - DNA, 16 bp, M. musculus
cacagagacagctaga

SEQ ID NO: 375361 - DNA, 16 bp, M. musculus
cacagagacagggaga

SEQ ID NO: 375362 - DNA, 16 bp, M. musculus
cacagagacagtattc

SEQ ID NO: 375363 - DNA, 16 bp, M. musculus
cacagagaccagagag

SEQ ID NO: 375364 - DNA, 16 bp, M. musculus
cacagagacccacaca

SEQ ID NO: 375365 - DNA, 16 bp, M. musculus
cacagagacccaccta

SEQ ID NO: 375366 - DNA, 16 bp, M. musculus
cacagagactagaaga

SEQ ID NO: 375367 - DNA, 16 bp, M. musculus
cacagagactcacaaa

SEQ ID NO: 375368 - DNA, 16 bp, M. musculus
cacagagactgagaga

SEQ ID NO: 375369 - DNA, 16 bp, M. musculus
cacagagagacataga

SEQ ID NO: 375370 - DNA, 16 bp, M. musculus
cacagagagagaaaca

SEQ ID NO: 375371 - DNA, 16 bp, M. musculus
cacagagagagagaca

SEQ ID NO: 375372 - DNA, 16 bp, M. musculus
cacagagagagaggca

SEQ ID NO: 375373 - DNA, 16 bp, M. musculus
cacagagagagggaga

SEQ ID NO: 375374 - DNA, 16 bp, M. musculus
cacagagagggagaag

SEQ ID NO: 375375 - DNA, 16 bp, M. musculus
cacagagatagaaagg

SEQ ID NO: 375376 - DNA, 16 bp, M. musculus
cacagagatcagaaaa

SEQ ID NO: 375377 - DNA, 16 bp, M. musculus
cacagagatcagcctg

SEQ ID NO: 375378 - DNA, 16 bp, M. musculus
cacagagatccaccta

SEQ ID NO: 375379 - DNA, 17 bp, M. musculus
cacagagatcctcctgt

SEQ ID NO: 375380 - DNA, 16 bp, M. musculus
cacagagatctgcttt

SEQ ID NO: 375381 - DNA, 16 bp, M. musculus
cacagagatggtccca

SEQ ID NO: 375382 - DNA, 16 bp, M. musculus
cacagagattcaccta

SEQ ID NO: 375383 - DNA, 16 bp, M. musculus
cacagagcacacagac

SEQ ID NO: 375384 - DNA, 16 bp, M. musculus
cacagagcacagcaca

SEQ ID NO: 375385 - DNA, 16 bp, M. musculus
cacagagcacagctgt

SEQ ID NO: 375386 - DNA, 16 bp, M. musculus
cacagagccatctctt

SEQ ID NO: 375387 - DNA, 16 bp, M. musculus
cacagagccatcttcc

SEQ ID NO: 375388 - DNA, 16 bp, M. musculus
cacagagcccagaaga

SEQ ID NO: 375389 - DNA, 16 bp, M. musculus
cacagagccctgggtt

SEQ ID NO: 375390 - DNA, 16 bp, M. musculus
cacagagcctgcccca

SEQ ID NO: 375391 - DNA, 16 bp, M. musculus
cacagagctctgccta

SEQ ID NO: 375392 - DNA, 16 bp, M. musculus
cacagagcttctcagg

SEQ ID NO: 375393 - DNA, 16 bp, M. musculus
cacagaggaacatgca

SEQ ID NO: 375394 - DNA, 16 bp, M. musculus
cacagaggaagctcga

SEQ ID NO: 375395 - DNA, 16 bp, M. musculus
cacagaggaaggagag

SEQ ID NO: 375396 - DNA, 16 bp, M. musculus
cacagaggacacagag

SEQ ID NO: 375397 - DNA, 16 bp, M. musculus
cacagaggacagaaag

SEQ ID NO: 375398 - DNA, 16 bp, M. musculus
cacagaggacagaagg

SEQ ID NO: 375399 - DNA, 16 bp, M. musculus
cacagaggacctggtg

SEQ ID NO: 375400 - DNA, 16 bp, M. musculus
cacagaggcaaacaca

SEQ ID NO: 375401 - DNA, 16 bp, M. musculus
cacagaggcacagaga

SEQ ID NO: 375402 - DNA, 16 bp, M. musculus
cacagaggcagaagca

SEQ ID NO: 375403 - DNA, 16 bp, M. musculus
cacagaggcagagaga

SEQ ID NO: 375404 - DNA, 16 bp, M. musculus
cacagaggcagagagg

SEQ ID NO: 375405 - DNA, 16 bp, M. musculus
cacagaggccagcagc

SEQ ID NO: 375406 - DNA, 16 bp, M. musculus
cacagagggtagatat

SEQ ID NO: 375407 - DNA, 16 bp, M. musculus
cacagaggtcaggaga

SEQ ID NO: 375408 - DNA, 16 bp, M. musculus
cacagaggtccatctg

SEQ ID NO: 375409 - DNA, 16 bp, M. musculus
cacagaggttagaaga

SEQ ID NO: 375410 - DNA, 16 bp, M. musculus
cacagagtcagcagac

SEQ ID NO: 375411 - DNA, 16 bp, M. musculus
cacagagtccagaaga

SEQ ID NO: 375412 - DNA, 16 bp, M. musculus
cacagataagtaagca

SEQ ID NO: 375413 - DNA, 16 bp, M. musculus
cacagatacacaaata

SEQ ID NO: 375414 - DNA, 16 bp, M. musculus
cacagatacacagaaa

SEQ ID NO: 375415 - DNA, 16 bp, M. musculus
cacagatacacataaa

SEQ ID NO: 375416 - DNA, 16 bp, M. musculus
cacagatacatacata

SEQ ID NO: 375417 - DNA, 16 bp, M. musculus
cacagatatacccaga

SEQ ID NO: 375418 - DNA, 16 bp, M. musculus
cacagatatgcatgca

SEQ ID NO: 375419 - DNA, 16 bp, M. musculus
cacagatattcacatt

SEQ ID NO: 375420 - DNA, 16 bp, M. musculus
cacagatgaagaaaaa

SEQ ID NO: 375421 - DNA, 16 bp, M. musculus
cacagatgcacacaca

SEQ ID NO: 375422 - DNA, 16 bp, M. musculus
cacagatgccagaaga

SEQ ID NO: 375423 - DNA, 16 bp, M. musculus
cacagatgccagccca

SEQ ID NO: 375424 - DNA, 16 bp, M. musculus
cacagatggacacaca

SEQ ID NO: 375425 - DNA, 16 bp, M. musculus
cacagattgtgtgtgt

SEQ ID NO: 375426 - DNA, 16 bp, M. musculus
cacagatttaaaaaca

SEQ ID NO: 375427 - DNA, 16 bp, M. musculus
cacagatttttttttt

SEQ ID NO: 375428 - DNA, 16 bp, M. musculus
cacagcaaacatttta

SEQ ID NO: 375429 - DNA, 16 bp, M. musculus
cacagcaacaaaaagg

SEQ ID NO: 375430 - DNA, 16 bp, M. musculus
cacagcaacagaaaat

SEQ ID NO: 375431 - DNA, 16 bp, M. musculus
cacagcaacagaaagg

SEQ ID NO: 375432 - DNA, 16 bp, M. musculus
cacagcaacagaacag

SEQ ID NO: 375433 - DNA, 16 bp, M. musculus
cacagcaacagcttca

SEQ ID NO: 375434 - DNA, 16 bp, M. musculus
cacagcaacaggacag

SEQ ID NO: 375435 - DNA, 16 bp, M. musculus
cacagcaaccacatgg

SEQ ID NO: 375436 - DNA, 16 bp, M. musculus
cacagcaactcttaca

SEQ ID NO: 375437 - DNA, 16 bp, M. musculus
cacagcaagacactgt

SEQ ID NO: 375438 - DNA, 16 bp, M. musculus
cacagcaagcactctg

SEQ ID NO: 375439 - DNA, 16 bp, M. musculus
cacagcaagcagctta

SEQ ID NO: 375440 - DNA, 16 bp, M. musculus
cacagcaagctcatct

SEQ ID NO: 375441 - DNA, 16 bp, M. musculus
cacagcaagttctgga

SEQ ID NO: 375442 - DNA, 16 bp, M. musculus
cacagcaataaaacaa

SEQ ID NO: 375443 - DNA, 16 bp, M. musculus
cacagcaatgaaaaaa

SEQ ID NO: 375444 - DNA, 16 bp, M. musculus
cacagcaatgagaaaa

SEQ ID NO: 375445 - DNA, 16 bp, M. musculus
cacagcaatgggaaag

SEQ ID NO: 375446 - DNA, 16 bp, M. musculus
cacagcacacacagca

SEQ ID NO: 375447 - DNA, 16 bp, M. musculus
cacagcacagcacagc

SEQ ID NO: 375448 - DNA, 16 bp, M. musculus
cacagcacagcagcag

SEQ ID NO: 375449 - DNA, 16 bp, M. musculus
cacagcacagtcctaa

SEQ ID NO: 375450 - DNA, 16 bp, M. musculus
cacagcacccacagca

SEQ ID NO: 375451 - DNA, 16 bp, M. musculus
cacagcactcagaagg

SEQ ID NO: 375452 - DNA, 16 bp, M. musculus
cacagcactcaggaga

SEQ ID NO: 375453 - DNA, 16 bp, M. musculus
cacagcagaaaaaccc

SEQ ID NO: 375454 - DNA, 16 bp, M. musculus
cacagcagaagagagc

SEQ ID NO: 375455 - DNA, 16 bp, M. musculus
cacagcagagagaaaa

SEQ ID NO: 375456 - DNA, 16 bp, M. musculus
cacagcagaggactgc

SEQ ID NO: 375457 - DNA, 16 bp, M. musculus
cacagcagaggccagc

SEQ ID NO: 375458 - DNA, 16 bp, M. musculus
cacagcagatttcctg

SEQ ID NO: 375459 - DNA, 16 bp, M. musculus
cacagcagcaacagca

SEQ ID NO: 375460 - DNA, 16 bp, M. musculus
cacagcagcagaaatg

SEQ ID NO: 375461 - DNA, 16 bp, M. musculus
cacagcagcagcagag

SEQ ID NO: 375462 - DNA, 16 bp, M. musculus
cacagcagcagcagcc

SEQ ID NO: 375463 - DNA, 16 bp, M. musculus
cacagcagcagcggtt

SEQ ID NO: 375464 - DNA, 16 bp, M. musculus
cacagcagcaggagtg

SEQ ID NO: 375465 - DNA, 16 bp, M. musculus
cacagcaggcagagag

SEQ ID NO: 375466 - DNA, 16 bp, M. musculus
cacagcagggtcttta

SEQ ID NO: 375467 - DNA, 16 bp, M. musculus
cacagcaggtgattat

SEQ ID NO: 375468 - DNA, 16 bp, M. musculus
cacagcagtagaaaag

SEQ ID NO: 375469 - DNA, 16 bp, M. musculus
cacagcagtagaacag

SEQ ID NO: 375470 - DNA, 16 bp, M. musculus
cacagcagtagtaacc

SEQ ID NO: 375471 - DNA, 16 bp, M. musculus
cacagcagtgaacaaa

SEQ ID NO: 375472 - DNA, 16 bp, M. musculus
cacagcatacacacat

SEQ ID NO: 375473 - DNA, 16 bp, M. musculus
cacagcatgagaaact

SEQ ID NO: 375474 - DNA, 16 bp, M. musculus
cacagccaagaacttc

SEQ ID NO: 375475 - DNA, 16 bp, M. musculus
cacagccacagccaca

SEQ ID NO: 375476 - DNA, 16 bp, M. musculus
cacagccacagcctca

SEQ ID NO: 375477 - DNA, 16 bp, M. musculus
cacagccagagctaca

SEQ ID NO: 375478 - DNA, 16 bp, M. musculus
cacagccagatgctca

SEQ ID NO: 375479 - DNA, 16 bp, M. musculus
cacagccagccttgct

SEQ ID NO: 375480 - DNA, 16 bp, M. musculus
cacagccatccactgg

SEQ ID NO: 375481 - DNA, 16 bp, M. musculus
cacagccatcctcctg

SEQ ID NO: 375482 - DNA, 16 bp, M. musculus
cacagccatctgcaac

SEQ ID NO: 375483 - DNA, 16 bp, M. musculus
cacagccatctgtaac

SEQ ID NO: 375484 - DNA, 16 bp, M. musculus
cacagccatctgtaag

SEQ ID NO: 375485 - DNA, 16 bp, M. musculus
cacagcccagcacaca

SEQ ID NO: 375486 - DNA, 16 bp, M. musculus
cacagcccaggctggc

SEQ ID NO: 375487 - DNA, 16 bp, M. musculus
cacagcccatttagcc

SEQ ID NO: 375488 - DNA, 16 bp, M. musculus
cacagcccccacagaa

SEQ ID NO: 375489 - DNA, 16 bp, M. musculus
cacagcccccacagga

SEQ ID NO: 375490 - DNA, 16 bp, M. musculus
cacagccctcagacat

SEQ ID NO: 375491 - DNA, 16 bp, M. musculus
cacagccctggacaga

SEQ ID NO: 375492 - DNA, 16 bp, M. musculus
cacagcctaaggacac

SEQ ID NO: 375493 - DNA, 16 bp, M. musculus
cacagcctcaacccca

SEQ ID NO: 375494 - DNA, 16 bp, M. musculus
cacagcctccacttcc

SEQ ID NO: 375495 - DNA, 16 bp, M. musculus
cacagcctcctcctcc

SEQ ID NO: 375496 - DNA, 16 bp, M. musculus
cacagcgccagcccca

SEQ ID NO: 375497 - DNA, 16 bp, M. musculus
cacagcgtctgctcca

SEQ ID NO: 375498 - DNA, 16 bp, M. musculus
cacagctacacagaga

SEQ ID NO: 375499 - DNA, 16 bp, M. musculus
cacagctagctctata

SEQ ID NO: 375500 - DNA, 16 bp, M. musculus
cacagctattctttgg

SEQ ID NO: 375501 - DNA, 16 bp, M. musculus
cacagctcactgcccc

SEQ ID NO: 375502 - DNA, 16 bp, M. musculus
cacagctcagcacagc

SEQ ID NO: 375503 - DNA, 16 bp, M. musculus
cacagctccttctcca

SEQ ID NO: 375504 - DNA, 16 bp, M. musculus
cacagctctgggggct

SEQ ID NO: 375505 - DNA, 16 bp, M. musculus
cacagctctttttttt

SEQ ID NO: 375506 - DNA, 16 bp, M. musculus
cacagctgcaatccca

SEQ ID NO: 375507 - DNA, 16 bp, M. musculus
cacagctgccaaagaa

SEQ ID NO: 375508 - DNA, 16 bp, M. musculus
cacagctgctgagagt

SEQ ID NO: 375509 - DNA, 16 bp, M. musculus
cacagctgctgctgtt

SEQ ID NO: 375510 - DNA, 16 bp, M. musculus
cacagctgctgtgaat

SEQ ID NO: 375511 - DNA, 16 bp, M. musculus
cacagctggagaagcc

SEQ ID NO: 375512 - DNA, 16 bp, M. musculus
cacagctggagcctgg

SEQ ID NO: 375513 - DNA, 16 bp, M. musculus
cacagctgtacctgta

SEQ ID NO: 375514 - DNA, 16 bp, M. musculus
cacagcttctggaaca

SEQ ID NO: 375515 - DNA, 16 bp, M. musculus
cacaggaaaaaaatct

SEQ ID NO: 375516 - DNA, 16 bp, M. musculus
cacaggaacaagatcc

SEQ ID NO: 375517 - DNA, 16 bp, M. musculus
cacaggaagaccaaca

SEQ ID NO: 375518 - DNA, 16 bp, M. musculus
cacaggaagaccaagc

SEQ ID NO: 375519 - DNA, 16 bp, M. musculus
cacaggaagaccctgt

SEQ ID NO: 375520 - DNA, 16 bp, M. musculus
cacaggaagagctgag

SEQ ID NO: 375521 - DNA, 16 bp, M. musculus
cacaggaagagggcat

SEQ ID NO: 375522 - DNA, 16 bp, M. musculus
cacaggaagatggaga

SEQ ID NO: 375523 - DNA, 16 bp, M. musculus
cacaggaagcagagaa

SEQ ID NO: 375524 - DNA, 16 bp, M. musculus
cacaggaagctcaaga

SEQ ID NO: 375525 - DNA, 16 bp, M. musculus
cacaggaaggccttcc

SEQ ID NO: 375526 - DNA, 16 bp, M. musculus
cacaggaagtagaaag

SEQ ID NO: 375527 - DNA, 16 bp, M. musculus
cacaggaatttagcat

SEQ ID NO: 375528 - DNA, 16 bp, M. musculus
cacaggacaacaacag

SEQ ID NO: 375529 - DNA, 16 bp, M. musculus
cacaggacacagagaa

SEQ ID NO: 375530 - DNA, 16 bp, M. musculus
cacaggacagcacagc

SEQ ID NO: 375531 - DNA, 16 bp, M. musculus
cacaggagacaactat

SEQ ID NO: 375532 - DNA, 16 bp, M. musculus
cacaggagacagtgga

SEQ ID NO: 375533 - DNA, 16 bp, M. musculus
cacaggagataaagga

SEQ ID NO: 375534 - DNA, 16 bp, M. musculus
cacaggagcctggaat

SEQ ID NO: 375535 - DNA, 16 bp, M. musculus
cacaggagctcacaga

SEQ ID NO: 375536 - DNA, 16 bp, M. musculus
cacaggaggaacaaac

SEQ ID NO: 375537 - DNA, 16 bp, M. musculus
cacaggaggaacatca

SEQ ID NO: 375538 - DNA, 17 bp, M. musculus
cacaggaggaccaagct

SEQ ID NO: 375539 - DNA, 16 bp, M. musculus
cacaggaggagctgag

SEQ ID NO: 375540 - DNA, 16 bp, M. musculus
cacaggaggcactgga

SEQ ID NO: 375541 - DNA, 16 bp, M. musculus
cacaggagtttgagaa

SEQ ID NO: 375542 - DNA, 16 bp, M. musculus
cacaggatggctcaca

SEQ ID NO: 375543 - DNA, 16 bp, M. musculus
cacaggcacacacatc

SEQ ID NO: 375544 - DNA, 16 bp, M. musculus
cacaggcacacacgtg

SEQ ID NO: 375545 - DNA, 16 bp, M. musculus
cacaggcacacatgca

SEQ ID NO: 375546 - DNA, 16 bp, M. musculus
cacaggcacaggcaca

SEQ ID NO: 375547 - DNA, 16 bp, M. musculus
cacaggcacaggcaga

SEQ ID NO: 375548 - DNA, 16 bp, M. musculus
cacaggcacaggtgtg

SEQ ID NO: 375549 - DNA, 16 bp, M. musculus
cacaggcagacacaga

SEQ ID NO: 375550 - DNA, 16 bp, M. musculus
cacaggcagacagaca

SEQ ID NO: 375551 - DNA, 16 bp, M. musculus
cacaggcagcacatgt

SEQ ID NO: 375552 - DNA, 16 bp, M. musculus
cacaggcagcaggaag

SEQ ID NO: 375553 - DNA, 16 bp, M. musculus
cacaggcaggcagatt

SEQ ID NO: 375554 - DNA, 16 bp, M. musculus
cacaggcatgcatgca

SEQ ID NO: 375555 - DNA, 16 bp, M. musculus
cacaggcatgcccaga

SEQ ID NO: 375556 - DNA, 16 bp, M. musculus
cacaggcatgctcaca

SEQ ID NO: 375557 - DNA, 16 bp, M. musculus
cacaggccacaggcca

SEQ ID NO: 375558 - DNA, 16 bp, M. musculus
cacaggctaatctgat

SEQ ID NO: 375559 - DNA, 16 bp, M. musculus
cacaggctcctcctcc

SEQ ID NO: 375560 - DNA, 16 bp, M. musculus
cacaggctgaatggct

SEQ ID NO: 375561 - DNA, 16 bp, M. musculus
cacaggctgagaaaca

SEQ ID NO: 375562 - DNA, 16 bp, M. musculus
cacaggctggccctct

SEQ ID NO: 375563 - DNA, 16 bp, M. musculus
cacagggaaagcatcc

SEQ ID NO: 375564 - DNA, 16 bp, M. musculus
cacagggaaatttttc

SEQ ID NO: 375565 - DNA, 16 bp, M. musculus
cacagggaagcaggaa

SEQ ID NO: 375566 - DNA, 16 bp, M. musculus
cacagggacaaaatcc

SEQ ID NO: 375567 - DNA, 16 bp, M. musculus
cacagggaccccaaag

SEQ ID NO: 375568 - DNA, 16 bp, M. musculus
cacagggagagagaaa

SEQ ID NO: 375569 - DNA, 16 bp, M. musculus
cacagggagcaagcca

SEQ ID NO: 375570 - DNA, 16 bp, M. musculus
cacagggagccaggca

SEQ ID NO: 375571 - DNA, 16 bp, M. musculus
cacagggagggacctt

SEQ ID NO: 375572 - DNA, 16 bp, M. musculus
cacagggagtggggag

SEQ ID NO: 375573 - DNA, 16 bp, M. musculus
cacagggatctgcctg

SEQ ID NO: 375574 - DNA, 16 bp, M. musculus
cacagggcaacaacag

SEQ ID NO: 375575 - DNA, 16 bp, M. musculus
cacagggcacagggca

SEQ ID NO: 375576 - DNA, 16 bp, M. musculus
cacagggcaggaagca

SEQ ID NO: 375577 - DNA, 16 bp, M. musculus
cacagggccaccaatg

SEQ ID NO: 375578 - DNA, 16 bp, M. musculus
cacagggcctgcacag

SEQ ID NO: 375579 - DNA, 16 bp, M. musculus
cacaggggaccagagg

SEQ ID NO: 375580 - DNA, 17 bp, M. musculus
cacaggggcaactggat

SEQ ID NO: 375581 - DNA, 16 bp, M. musculus
cacaggggtccctggc

SEQ ID NO: 375582 - DNA, 16 bp, M. musculus
cacagggtgctgcctc

SEQ ID NO: 375583 - DNA, 16 bp, M. musculus
cacagggtttctctgt

SEQ ID NO: 375584 - DNA, 16 bp, M. musculus
cacaggtaaacaggta

SEQ ID NO: 375585 - DNA, 16 bp, M. musculus
cacaggtacaggcaca

SEQ ID NO: 375586 - DNA, 16 bp, M. musculus
cacaggtagaggacat

SEQ ID NO: 375587 - DNA, 16 bp, M. musculus
cacaggtatgcatgca

SEQ ID NO: 375588 - DNA, 16 bp, M. musculus
cacaggtggaggtcag

SEQ ID NO: 375589 - DNA, 16 bp, M. musculus
cacaggtgtgtgcagg

SEQ ID NO: 375590 - DNA, 16 bp, M. musculus
cacaggttgagaacta

SEQ ID NO: 375591 - DNA, 16 bp, M. musculus
cacagtaagtttcagg

SEQ ID NO: 375592 - DNA, 16 bp, M. musculus
cacagtacaggaacac

SEQ ID NO: 375593 - DNA, 16 bp, M. musculus
cacagtcaagaacaga

SEQ ID NO: 375594 - DNA, 16 bp, M. musculus
cacagtcaaggctgag

SEQ ID NO: 375595 - DNA, 16 bp, M. musculus
cacagtcacaaaagaa

SEQ ID NO: 375596 - DNA, 16 bp, M. musculus
cacagtcacagccaca

SEQ ID NO: 375597 - DNA, 16 bp, M. musculus
cacagtcatccccctg

SEQ ID NO: 375598 - DNA, 16 bp, M. musculus
cacagtcatctgttgg

SEQ ID NO: 375599 - DNA, 16 bp, M. musculus
cacagtccccttctgc

SEQ ID NO: 375600 - DNA, 16 bp, M. musculus
cacagtctcctgctgc

SEQ ID NO: 375601 - DNA, 16 bp, M. musculus
cacagtctgaggaccg

SEQ ID NO: 375602 - DNA, 16 bp, M. musculus
cacagtctgtcactga

SEQ ID NO: 375603 - DNA, 16 bp, M. musculus
cacagtgaaactctgt

SEQ ID NO: 375604 - DNA, 16 bp, M. musculus
cacagtgaactccagg

SEQ ID NO: 375605 - DNA, 16 bp, M. musculus
cacagtgaagaattga

SEQ ID NO: 375606 - DNA, 16 bp, M. musculus
cacagtgaattccaga

SEQ ID NO: 375607 - DNA, 16 bp, M. musculus
cacagtgaattctagg

SEQ ID NO: 375608 - DNA, 16 bp, M. musculus
cacagtgacacacctc

SEQ ID NO: 375609 - DNA, 16 bp, M. musculus
cacagtgacacacttc

SEQ ID NO: 375610 - DNA, 16 bp, M. musculus
cacagtgacagacaga

SEQ ID NO: 375611 - DNA, 16 bp, M. musculus
cacagtgacagtatcc

SEQ ID NO: 375612 - DNA, 16 bp, M. musculus
cacagtgactcacttc

SEQ ID NO: 375613 - DNA, 16 bp, M. musculus
cacagtgagcaggagg

SEQ ID NO: 375614 - DNA, 16 bp, M. musculus
cacagtgagttcctgg

SEQ ID NO: 375615 - DNA, 16 bp, M. musculus
cacagtgatggactgt

SEQ ID NO: 375616 - DNA, 16 bp, M. musculus
cacagtgcacaagaga

SEQ ID NO: 375617 - DNA, 16 bp, M. musculus
cacagtgcacacaggg

SEQ ID NO: 375618 - DNA, 16 bp, M. musculus
cacagtgcaggaggag

SEQ ID NO: 375619 - DNA, 16 bp, M. musculus
cacagtgccgagcctc

SEQ ID NO: 375620 - DNA, 16 bp, M. musculus
cacagtgcctccaatg

SEQ ID NO: 375621 - DNA, 16 bp, M. musculus
cacagtgctcagggga

SEQ ID NO: 375622 - DNA, 16 bp, M. musculus
cacagtgctgagcctc

SEQ ID NO: 375623 - DNA, 16 bp, M. musculus
cacagtggaagaagag

SEQ ID NO: 375624 - DNA, 16 bp, M. musculus
cacagtggaagcagag

SEQ ID NO: 375625 - DNA, 16 bp, M. musculus
cacagtggactgggcc

SEQ ID NO: 375626 - DNA, 16 bp, M. musculus
cacagtggagctggct

SEQ ID NO: 375627 - DNA, 16 bp, M. musculus
cacagtggcagctgcc

SEQ ID NO: 375628 - DNA, 16 bp, M. musculus
cacagtgggatgggcc

SEQ ID NO: 375629 - DNA, 16 bp, M. musculus
cacagtgggctgtgcc

SEQ ID NO: 375630 - DNA, 16 bp, M. musculus
cacagtggtaccctcc

SEQ ID NO: 375631 - DNA, 16 bp, M. musculus
cacagtgtgtctcaca

SEQ ID NO: 375632 - DNA, 16 bp, M. musculus
cacagttacctggcaa

SEQ ID NO: 375633 - DNA, 16 bp, M. musculus
cacagttataaagtag

SEQ ID NO: 375634 - DNA, 16 bp, M. musculus
cacagttccaggagac

SEQ ID NO: 375635 - DNA, 16 bp, M. musculus
cacagttgcagacaga

SEQ ID NO: 375636 - DNA, 16 bp, M. musculus
cacagttggaccttaa

SEQ ID NO: 375637 - DNA, 16 bp, M. musculus
cacagtttctctgtgt

SEQ ID NO: 375638 - DNA, 16 bp, M. musculus
cacagtttttatcaca

SEQ ID NO: 375639 - DNA, 16 bp, M. musculus
cacataaaagccaagc

SEQ ID NO: 375640 - DNA, 16 bp, M. musculus
cacataaaataaatct

SEQ ID NO: 375641 - DNA, 16 bp, M. musculus
cacataaaatgaattt

SEQ ID NO: 375642 - DNA, 16 bp, M. musculus
cacataaacatggaag

SEQ ID NO: 375643 - DNA, 16 bp, M. musculus
cacataaataaatgta

SEQ ID NO: 375644 - DNA, 16 bp, M. musculus
cacataaataatttta

SEQ ID NO: 375645 - DNA, 16 bp, M. musculus
cacataagacactgag

SEQ ID NO: 375646 - DNA, 16 bp, M. musculus
cacataagagaaaaca

SEQ ID NO: 375647 - DNA, 16 bp, M. musculus
cacataagataaaaat

SEQ ID NO: 375648 - DNA, 16 bp, M. musculus
cacatacaaacacatg

SEQ ID NO: 375649 - DNA, 16 bp, M. musculus
cacatacaaacatgtg

SEQ ID NO: 375650 - DNA, 16 bp, M. musculus
cacatacaaataatta

SEQ ID NO: 375651 - DNA, 16 bp, M. musculus
cacatacacaaaggaa

SEQ ID NO: 375652 - DNA, 16 bp, M. musculus
cacatacacacaagaa

SEQ ID NO: 375653 - DNA, 16 bp, M. musculus
cacatacacacacaga

SEQ ID NO: 375654 - DNA, 16 bp, M. musculus
cacatacacacacata

SEQ ID NO: 375655 - DNA, 16 bp, M. musculus
cacatacacacacctg

SEQ ID NO: 375656 - DNA, 16 bp, M. musculus
cacatacacacagaga

SEQ ID NO: 375657 - DNA, 16 bp, M. musculus
cacatacacactacac

SEQ ID NO: 375658 - DNA, 16 bp, M. musculus
cacatacacactcaga

SEQ ID NO: 375659 - DNA, 16 bp, M. musculus
cacatacacataatac

SEQ ID NO: 375660 - DNA, 16 bp, M. musculus
cacatacacataatat

SEQ ID NO: 375661 - DNA, 16 bp, M. musculus
cacatacacatacaca

SEQ ID NO: 375662 - DNA, 16 bp, M. musculus
cacatacacatataca

SEQ ID NO: 375663 - DNA, 16 bp, M. musculus
cacatacactcacaca

SEQ ID NO: 375664 - DNA, 16 bp, M. musculus
cacatacactcataca

SEQ ID NO: 375665 - DNA, 16 bp, M. musculus
cacatacagaaacaca

SEQ ID NO: 375666 - DNA, 16 bp, M. musculus
cacatacagacaagca

SEQ ID NO: 375667 - DNA, 16 bp, M. musculus
cacatacagagagaca

SEQ ID NO: 375668 - DNA, 16 bp, M. musculus
cacatacatacacaca

SEQ ID NO: 375669 - DNA, 16 bp, M. musculus
cacatacatacataaa

SEQ ID NO: 375670 - DNA, 16 bp, M. musculus
cacatacatacataca

SEQ ID NO: 375671 - DNA, 17 bp, M. musculus
cacatacatacatacac

SEQ ID NO: 375672 - DNA, 16 bp, M. musculus
cacatacatatacaga

SEQ ID NO: 375673 - DNA, 16 bp, M. musculus
cacatacatatgtgca

SEQ ID NO: 375674 - DNA, 16 bp, M. musculus
cacatacatatttgca

SEQ ID NO: 375675 - DNA, 16 bp, M. musculus
cacatacatccatgca

SEQ ID NO: 375676 - DNA, 16 bp, M. musculus
cacatacatgcagata

SEQ ID NO: 375677 - DNA, 16 bp, M. musculus
cacatacatgcataaa

SEQ ID NO: 375678 - DNA, 16 bp, M. musculus
cacatacatgcatgca

SEQ ID NO: 375679 - DNA, 16 bp, M. musculus
cacatacatgcctggt

SEQ ID NO: 375680 - DNA, 16 bp, M. musculus
cacatacccaaaggat

SEQ ID NO: 375681 - DNA, 16 bp, M. musculus
cacatacccactcaca

SEQ ID NO: 375682 - DNA, 16 bp, M. musculus
cacatacgtgtgcaca

SEQ ID NO: 375683 - DNA, 16 bp, M. musculus
cacatactacatacat

SEQ ID NO: 375684 - DNA, 16 bp, M. musculus
cacatactctcacata

SEQ ID NO: 375685 - DNA, 16 bp, M. musculus
cacatacttgcacata

SEQ ID NO: 375686 - DNA, 16 bp, M. musculus
cacatagacacataca

SEQ ID NO: 375687 - DNA, 16 bp, M. musculus
cacatagcaagaccct

SEQ ID NO: 375688 - DNA, 16 bp, M. musculus
cacatagcagctcaca

SEQ ID NO: 375689 - DNA, 16 bp, M. musculus
cacatagcagcttaca

SEQ ID NO: 375690 - DNA, 16 bp, M. musculus
cacatagcagtactct

SEQ ID NO: 375691 - DNA, 16 bp, M. musculus
cacatagcccaggctg

SEQ ID NO: 375692 - DNA, 16 bp, M. musculus
cacataggcacacata

SEQ ID NO: 375693 - DNA, 16 bp, M. musculus
cacatagtacttttta

SEQ ID NO: 375694 - DNA, 16 bp, M. musculus
cacatagtgagaccct

SEQ ID NO: 375695 - DNA, 16 bp, M. musculus
cacatataagcataca

SEQ ID NO: 375696 - DNA, 16 bp, M. musculus
cacatatacacagaca

SEQ ID NO: 375697 - DNA, 16 bp, M. musculus
cacatatacacttaca

SEQ ID NO: 375698 - DNA, 16 bp, M. musculus
cacatatacatataat

SEQ ID NO: 375699 - DNA, 16 bp, M. musculus
cacatatatacataca

SEQ ID NO: 375700 - DNA, 16 bp, M. musculus
cacatatatacatgca

SEQ ID NO: 375701 - DNA, 16 bp, M. musculus
cacatatatatacaca

SEQ ID NO: 375702 - DNA, 16 bp, M. musculus
cacatatatatatatg

SEQ ID NO: 375703 - DNA, 16 bp, M. musculus
cacatatatatttata

SEQ ID NO: 375704 - DNA, 16 bp, M. musculus
cacatatatgcacata

SEQ ID NO: 375705 - DNA, 17 bp, M. musculus
cacatatatgtatatac

SEQ ID NO: 375706 - DNA, 16 bp, M. musculus
cacatatcacatatca

SEQ ID NO: 375707 - DNA, 16 bp, M. musculus
cacatatgaactcatg

SEQ ID NO: 375708 - DNA, 16 bp, M. musculus
cacatatgaatgcaca

SEQ ID NO: 375709 - DNA, 16 bp, M. musculus
cacatatggagcagag

SEQ ID NO: 375710 - DNA, 16 bp, M. musculus
cacatatgtgcctggt

SEQ ID NO: 375711 - DNA, 16 bp, M. musculus
cacatatgtgtatatg

SEQ ID NO: 375712 - DNA, 16 bp, M. musculus
cacatatgttcacaca

SEQ ID NO: 375713 - DNA, 16 bp, M. musculus
cacatatgtttatata

SEQ ID NO: 375714 - DNA, 16 bp, M. musculus
cacatattcacataca

SEQ ID NO: 375715 - DNA, 16 bp, M. musculus
cacatcaaaagaatca

SEQ ID NO: 375716 - DNA, 16 bp, M. musculus
cacatcaaaatcatca

SEQ ID NO: 375717 - DNA, 16 bp, M. musculus
cacatcaaaccagaga

SEQ ID NO: 375718 - DNA, 16 bp, M. musculus
cacatcagatatcctg

SEQ ID NO: 375719 - DNA, 16 bp, M. musculus
cacatcaggcaaaccc

SEQ ID NO: 375720 - DNA, 16 bp, M. musculus
cacatcaggcagctca

SEQ ID NO: 375721 - DNA, 16 bp, M. musculus
cacatcaggctgttcc

SEQ ID NO: 375722 - DNA, 16 bp, M. musculus
cacatccacatataca

SEQ ID NO: 375723 - DNA, 16 bp, M. musculus
cacatccatttgccaa

SEQ ID NO: 375724 - DNA, 16 bp, M. musculus
cacatcccacacctct

SEQ ID NO: 375725 - DNA, 16 bp, M. musculus
cacatccgatagaggg

SEQ ID NO: 375726 - DNA, 16 bp, M. musculus
cacatcctagccagca

SEQ ID NO: 375727 - DNA, 16 bp, M. musculus
cacatcctcaccatca

SEQ ID NO: 375728 - DNA, 16 bp, M. musculus
cacatcctgagtgctg

SEQ ID NO: 375729 - DNA, 16 bp, M. musculus
cacatccttgtcaaca

SEQ ID NO: 375730 - DNA, 16 bp, M. musculus
cacatctaaaagatct

SEQ ID NO: 375731 - DNA, 16 bp, M. musculus
cacatctagaagctct

SEQ ID NO: 375732 - DNA, 16 bp, M. musculus
cacatctataatcaca

SEQ ID NO: 375733 - DNA, 16 bp, M. musculus
cacatctctgagttca

SEQ ID NO: 375734 - DNA, 16 bp, M. musculus
cacatctgtaaaacaa

SEQ ID NO: 375735 - DNA, 16 bp, M. musculus
cacatctgtaacctca

SEQ ID NO: 375736 - DNA, 16 bp, M. musculus
cacatctgtaatctca

SEQ ID NO: 375737 - DNA, 16 bp, M. musculus
cacatctgtaatttca

SEQ ID NO: 375738 - DNA, 16 bp, M. musculus
cacatctgtctgtctg

SEQ ID NO: 375739 - DNA, 16 bp, M. musculus
cacatcttcatttgca

SEQ ID NO: 375740 - DNA, 16 bp, M. musculus
cacatcttccccagca

SEQ ID NO: 375741 - DNA, 16 bp, M. musculus
cacatcttcctgggtg

SEQ ID NO: 375742 - DNA, 16 bp, M. musculus
cacatcttgaactgca

SEQ ID NO: 375743 - DNA, 16 bp, M. musculus
cacatcttgcctggca

SEQ ID NO: 375744 - DNA, 16 bp, M. musculus
cacatctttaatctca

SEQ ID NO: 375745 - DNA, 16 bp, M. musculus
cacatgaaaacacaca

SEQ ID NO: 375746 - DNA, 17 bp, M. musculus
cacatgaaactcaagaa

SEQ ID NO: 375747 - DNA, 16 bp, M. musculus
cacatgaaactcaagg

SEQ ID NO: 375748 - DNA, 16 bp, M. musculus
cacatgaaagtcaaga

SEQ ID NO: 375749 - DNA, 16 bp, M. musculus
cacatgaacacacaca

SEQ ID NO: 375750 - DNA, 16 bp, M. musculus
cacatgaactcacaga

SEQ ID NO: 375751 - DNA, 16 bp, M. musculus
cacatgaagaccatgc

SEQ ID NO: 375752 - DNA, 16 bp, M. musculus
cacatgaagactcaca

SEQ ID NO: 375753 - DNA, 16 bp, M. musculus
cacatgaagctcaaga

SEQ ID NO: 375754 - DNA, 16 bp, M. musculus
cacatgaatgtgcaca

SEQ ID NO: 375755 - DNA, 16 bp, M. musculus
cacatgaccacacaca

SEQ ID NO: 375756 - DNA, 16 bp, M. musculus
cacatgagaacacaca

SEQ ID NO: 375757 - DNA, 16 bp, M. musculus
cacatgagcatgcaca

SEQ ID NO: 375758 - DNA, 16 bp, M. musculus
cacatgaggaggtcag

SEQ ID NO: 375759 - DNA, 16 bp, M. musculus
cacatgagtcgtatta

SEQ ID NO: 375760 - DNA, 16 bp, M. musculus
cacatgatcatctcgg

SEQ ID NO: 375761 - DNA, 16 bp, M. musculus
cacatgatggaactca

SEQ ID NO: 375762 - DNA, 16 bp, M. musculus
cacatgattaaaaata

SEQ ID NO: 375763 - DNA, 16 bp, M. musculus
cacatgcaaaataaat

SEQ ID NO: 375764 - DNA, 16 bp, M. musculus
cacatgcaaacacaca

SEQ ID NO: 375765 - DNA, 16 bp, M. musculus
cacatgcacacacaga

SEQ ID NO: 375766 - DNA, 16 bp, M. musculus
cacatgcacacacagg

SEQ ID NO: 375767 - DNA, 16 bp, M. musculus
cacatgcacacacata

SEQ ID NO: 375768 - DNA, 16 bp, M. musculus
cacatgcacacaccac

SEQ ID NO: 375769 - DNA, 16 bp, M. musculus
cacatgcacacactca

SEQ ID NO: 375770 - DNA, 16 bp, M. musculus
cacatgcacacatttg

SEQ ID NO: 375771 - DNA, 16 bp, M. musculus
cacatgcacacccaca

SEQ ID NO: 375772 - DNA, 16 bp, M. musculus
cacatgcacactcaca

SEQ ID NO: 375773 - DNA, 16 bp, M. musculus
cacatgcacactgtgg

SEQ ID NO: 375774 - DNA, 16 bp, M. musculus
cacatgcacatacaca

SEQ ID NO: 375775 - DNA, 16 bp, M. musculus
cacatgcacatatata

SEQ ID NO: 375776 - DNA, 16 bp, M. musculus
cacatgcacatgcagg

SEQ ID NO: 375777 - DNA, 16 bp, M. musculus
cacatgcaccatggca

SEQ ID NO: 375778 - DNA, 16 bp, M. musculus
cacatgcacctgcaca

SEQ ID NO: 375779 - DNA, 16 bp, M. musculus
cacatgcacgcacatg

SEQ ID NO: 375780 - DNA, 16 bp, M. musculus
cacatgcacgtgcaca

SEQ ID NO: 375781 - DNA, 16 bp, M. musculus
cacatgcacgtgtgca

SEQ ID NO: 375782 - DNA, 16 bp, M. musculus
cacatgcactcatgtg

SEQ ID NO: 375783 - DNA, 16 bp, M. musculus
cacatgcagacacaca

SEQ ID NO: 375784 - DNA, 16 bp, M. musculus
cacatgcatacaggca

SEQ ID NO: 375785 - DNA, 16 bp, M. musculus
cacatgcatacatgca

SEQ ID NO: 375786 - DNA, 16 bp, M. musculus
cacatgcatacattca

SEQ ID NO: 375787 - DNA, 16 bp, M. musculus
cacatgcatatatatg

SEQ ID NO: 375788 - DNA, 16 bp, M. musculus
cacatgcatgcacaca

SEQ ID NO: 375789 - DNA, 16 bp, M. musculus
cacatgcatgcacagg

SEQ ID NO: 375790 - DNA, 16 bp, M. musculus
cacatgcatgcacata

SEQ ID NO: 375791 - DNA, 16 bp, M. musculus
cacatgcatgcatgtg

SEQ ID NO: 375792 - DNA, 16 bp, M. musculus
cacatgcatgtccaca

SEQ ID NO: 375793 - DNA, 16 bp, M. musculus
cacatgcatgtctgtg

SEQ ID NO: 375794 - DNA, 17 bp, M. musculus
cacatgcatgtgcacac

SEQ ID NO: 375795 - DNA, 16 bp, M. musculus
cacatgcatttgcaca

SEQ ID NO: 375796 - DNA, 16 bp, M. musculus
cacatgccacatgcca

SEQ ID NO: 375797 - DNA, 16 bp, M. musculus
cacatgcctctcttgt

SEQ ID NO: 375798 - DNA, 16 bp, M. musculus
cacatgcctgtaatct

SEQ ID NO: 375799 - DNA, 16 bp, M. musculus
cacatgccttcagtcc

SEQ ID NO: 375800 - DNA, 16 bp, M. musculus
cacatgccttgcctca

SEQ ID NO: 375801 - DNA, 16 bp, M. musculus
cacatgcgcacacaca

SEQ ID NO: 375802 - DNA, 16 bp, M. musculus
cacatgcgcacatgca

SEQ ID NO: 375803 - DNA, 16 bp, M. musculus
cacatgctagacaagt

SEQ ID NO: 375804 - DNA, 16 bp, M. musculus
cacatgctcatggcca

SEQ ID NO: 375805 - DNA, 16 bp, M. musculus
cacatgctctcttcac

SEQ ID NO: 375806 - DNA, 16 bp, M. musculus
cacatgctctctttta

SEQ ID NO: 375807 - DNA, 16 bp, M. musculus
cacatgctgacacaca

SEQ ID NO: 375808 - DNA, 16 bp, M. musculus
cacatgctggccagga

SEQ ID NO: 375809 - DNA, 16 bp, M. musculus
cacatgcttacacaca

SEQ ID NO: 375810 - DNA, 16 bp, M. musculus
cacatgcttccccacc

SEQ ID NO: 375811 - DNA, 16 bp, M. musculus
cacatgcttgtgtgtg

SEQ ID NO: 375812 - DNA, 16 bp, M. musculus
cacatggaactgtttg

SEQ ID NO: 375813 - DNA, 16 bp, M. musculus
cacatggactcacaca

SEQ ID NO: 375814 - DNA, 16 bp, M. musculus
cacatggagaaaccca

SEQ ID NO: 375815 - DNA, 16 bp, M. musculus
cacatggagaccagag

SEQ ID NO: 375816 - DNA, 16 bp, M. musculus
cacatggagagaccca

SEQ ID NO: 375817 - DNA, 16 bp, M. musculus
cacatggagagactca

SEQ ID NO: 375818 - DNA, 16 bp, M. musculus
cacatggagatcagag

SEQ ID NO: 375819 - DNA, 16 bp, M. musculus
cacatggagtgactca

SEQ ID NO: 375820 - DNA, 16 bp, M. musculus
cacatggatgccccca

SEQ ID NO: 375821 - DNA, 16 bp, M. musculus
cacatggcagcccaca

SEQ ID NO: 375822 - DNA, 16 bp, M. musculus
cacatggcagctcaca

SEQ ID NO: 375823 - DNA, 16 bp, M. musculus
cacatggcagttcaca

SEQ ID NO: 375824 - DNA, 16 bp, M. musculus
cacatggcccccagtg

SEQ ID NO: 375825 - DNA, 16 bp, M. musculus
cacatggctactcaca

SEQ ID NO: 375826 - DNA, 16 bp, M. musculus
cacatggctgctcaca

SEQ ID NO: 375827 - DNA, 16 bp, M. musculus
cacatgggcacagagg

SEQ ID NO: 375828 - DNA, 16 bp, M. musculus
cacatgggggctcaca

SEQ ID NO: 375829 - DNA, 16 bp, M. musculus
cacatggtcacctgca

SEQ ID NO: 375830 - DNA, 16 bp, M. musculus
cacatggtgacacaca

SEQ ID NO: 375831 - DNA, 16 bp, M. musculus
cacatggtgactaaca

SEQ ID NO: 375832 - DNA, 16 bp, M. musculus
cacatggtggctcact

SEQ ID NO: 375833 - DNA, 16 bp, M. musculus
cacatggtggctcaga

SEQ ID NO: 375834 - DNA, 16 bp, M. musculus
cacatggtggctcatg

SEQ ID NO: 375835 - DNA, 16 bp, M. musculus
cacatggtggctcgaa

SEQ ID NO: 375836 - DNA, 16 bp, M. musculus
cacatggtggttcaaa

SEQ ID NO: 375837 - DNA, 16 bp, M. musculus
cacatggtggttcaca

SEQ ID NO: 375838 - DNA, 16 bp, M. musculus
cacatggtgtctcaca

SEQ ID NO: 375839 - DNA, 16 bp, M. musculus
cacatggttgctcaca

SEQ ID NO: 375840 - DNA, 16 bp, M. musculus
cacatggtttctggtg

SEQ ID NO: 375841 - DNA, 16 bp, M. musculus
cacatggtttgcagga

SEQ ID NO: 375842 - DNA, 16 bp, M. musculus
cacatgtaaacacaca

SEQ ID NO: 375843 - DNA, 16 bp, M. musculus
cacatgtacacatgtg

SEQ ID NO: 375844 - DNA, 16 bp, M. musculus
cacatgtacacgcaca

SEQ ID NO: 375845 - DNA, 16 bp, M. musculus
cacatgtacactcaca

SEQ ID NO: 375846 - DNA, 16 bp, M. musculus
cacatgtacattcaca

SEQ ID NO: 375847 - DNA, 16 bp, M. musculus
cacatgtactctttgg

SEQ ID NO: 375848 - DNA, 16 bp, M. musculus
cacatgtatacacaca

SEQ ID NO: 375849 - DNA, 16 bp, M. musculus
cacatgtatacactca

SEQ ID NO: 375850 - DNA, 16 bp, M. musculus
cacatgtatatacata

SEQ ID NO: 375851 - DNA, 16 bp, M. musculus
cacatgtatgaaaatg

SEQ ID NO: 375852 - DNA, 16 bp, M. musculus
cacatgtatgcacata

SEQ ID NO: 375853 - DNA, 16 bp, M. musculus
cacatgtccttgtggt

SEQ ID NO: 375854 - DNA, 16 bp, M. musculus
cacatgtcttgcctca

SEQ ID NO: 375855 - DNA, 16 bp, M. musculus
cacatgtgaattcaca

SEQ ID NO: 375856 - DNA, 16 bp, M. musculus
cacatgtgactcttaa

SEQ ID NO: 375857 - DNA, 16 bp, M. musculus
cacatgtgcacaagca

SEQ ID NO: 375858 - DNA, 16 bp, M. musculus
cacatgtgcacacaca

SEQ ID NO: 375859 - DNA, 16 bp, M. musculus
cacatgtgcacacgtg

SEQ ID NO: 375860 - DNA, 16 bp, M. musculus
cacatgtgcacatgca

SEQ ID NO: 375861 - DNA, 16 bp, M. musculus
cacatgtgcactcaca

SEQ ID NO: 375862 - DNA, 16 bp, M. musculus
cacatgtgcatgcatg

SEQ ID NO: 375863 - DNA, 16 bp, M. musculus
cacatgtgcatgtttg

SEQ ID NO: 375864 - DNA, 16 bp, M. musculus
cacatgtgccatgaca

SEQ ID NO: 375865 - DNA, 16 bp, M. musculus
cacatgtggtggtcag

SEQ ID NO: 375866 - DNA, 16 bp, M. musculus
cacatgtgtacacatg

SEQ ID NO: 375867 - DNA, 16 bp, M. musculus
cacatgtgtacctggt

SEQ ID NO: 375868 - DNA, 16 bp, M. musculus
cacatgtgtgcacaca

SEQ ID NO: 375869 - DNA, 16 bp, M. musculus
cacatgtgtgcagatg

SEQ ID NO: 375870 - DNA, 16 bp, M. musculus
cacatgtgtgcagtac

SEQ ID NO: 375871 - DNA, 16 bp, M. musculus
cacatgtgtgcctggt

SEQ ID NO: 375872 - DNA, 16 bp, M. musculus
cacatgtgtgctggtg

SEQ ID NO: 375873 - DNA, 16 bp, M. musculus
cacatgtgtgctgtgc

SEQ ID NO: 375874 - DNA, 16 bp, M. musculus
cacatgtgtgtagtgc

SEQ ID NO: 375875 - DNA, 16 bp, M. musculus
cacatgtgtgtctggt

SEQ ID NO: 375876 - DNA, 16 bp, M. musculus
cacatgtgtgtctgtg

SEQ ID NO: 375877 - DNA, 16 bp, M. musculus
cacatgttaaaaagtt

SEQ ID NO: 375878 - DNA, 16 bp, M. musculus
cacatgttcacataca

SEQ ID NO: 375879 - DNA, 16 bp, M. musculus
cacatgttccactatg

SEQ ID NO: 375880 - DNA, 16 bp, M. musculus
cacattaacttatttt

SEQ ID NO: 375881 - DNA, 16 bp, M. musculus
cacattatggctcaca

SEQ ID NO: 375882 - DNA, 16 bp, M. musculus
cacattcacacataca

SEQ ID NO: 375883 - DNA, 16 bp, M. musculus
cacattcacatgcata

SEQ ID NO: 375884 - DNA, 16 bp, M. musculus
cacattcatacataca

SEQ ID NO: 375885 - DNA, 17 bp, M. musculus
cacattcattaaggaaa

SEQ ID NO: 375886 - DNA, 16 bp, M. musculus
cacattctttcaaaca

SEQ ID NO: 375887 - DNA, 16 bp, M. musculus
cacattcttttctatt

SEQ ID NO: 375888 - DNA, 16 bp, M. musculus
cacattgaagaaaaga

SEQ ID NO: 375889 - DNA, 16 bp, M. musculus
cacattgtcctctgac

SEQ ID NO: 375890 - DNA, 16 bp, M. musculus
cacattgttgttcctc

SEQ ID NO: 375891 - DNA, 16 bp, M. musculus
cacattgtttacattc

SEQ ID NO: 375892 - DNA, 16 bp, M. musculus
cacatttagaatgtct

SEQ ID NO: 375893 - DNA, 16 bp, M. musculus
cacatttatttaaaaa

SEQ ID NO: 375894 - DNA, 16 bp, M. musculus
cacatttctctctctc

SEQ ID NO: 375895 - DNA, 16 bp, M. musculus
cacattttcatttcca

SEQ ID NO: 375896 - DNA, 16 bp, M. musculus
cacattttctatatct

SEQ ID NO: 375897 - DNA, 16 bp, M. musculus
cacattttctgaatct

SEQ ID NO: 375898 - DNA, 16 bp, M. musculus
cacattttcttcattc

SEQ ID NO: 375899 - DNA, 16 bp, M. musculus
cacattttcttccttc

SEQ ID NO: 375900 - DNA, 16 bp, M. musculus
cacatttttaaaagat

SEQ ID NO: 375901 - DNA, 16 bp, M. musculus
cacatttttcttaaca

SEQ ID NO: 375902 - DNA, 16 bp, M. musculus
cacatttttgtttatt

SEQ ID NO: 375903 - DNA, 16 bp, M. musculus
caccaaaaaacttctg

SEQ ID NO: 375904 - DNA, 16 bp, M. musculus
caccaaaaccagatac

SEQ ID NO: 375905 - DNA, 16 bp, M. musculus
caccaaaatgatttcc

SEQ ID NO: 375906 - DNA, 16 bp, M. musculus
caccaaagaactcaca

SEQ ID NO: 375907 - DNA, 16 bp, M. musculus
caccaaagaggagaag

SEQ ID NO: 375908 - DNA, 17 bp, M. musculus
caccaaagctgacctgg

SEQ ID NO: 375909 - DNA, 16 bp, M. musculus
caccaaatagatttga

SEQ ID NO: 375910 - DNA, 16 bp, M. musculus
caccaaatgcaggcac

SEQ ID NO: 375911 - DNA, 16 bp, M. musculus
caccaaatgcattaaa

SEQ ID NO: 375912 - DNA, 16 bp, M. musculus
caccaaccaagcagca

SEQ ID NO: 375913 - DNA, 16 bp, M. musculus
caccaaccagaaggaa

SEQ ID NO: 375914 - DNA, 16 bp, M. musculus
caccaaccagccagca

SEQ ID NO: 375915 - DNA, 16 bp, M. musculus
caccaacccagccact

SEQ ID NO: 375916 - DNA, 16 bp, M. musculus
caccaactcctacttc

SEQ ID NO: 375917 - DNA, 16 bp, M. musculus
caccaactgaagagca

SEQ ID NO: 375918 - DNA, 16 bp, M. musculus
caccaactgaagagta

SEQ ID NO: 375919 - DNA, 16 bp, M. musculus
caccaagaacagcagc

SEQ ID NO: 375920 - DNA, 16 bp, M. musculus
caccaagaactgcagc

SEQ ID NO: 375921 - DNA, 16 bp, M. musculus
caccaagagcagcagt

SEQ ID NO: 375922 - DNA, 16 bp, M. musculus
caccaagaggaactct

SEQ ID NO: 375923 - DNA, 16 bp, M. musculus
caccaagatggctcag

SEQ ID NO: 375924 - DNA, 16 bp, M. musculus
caccaagcaccatggg

SEQ ID NO: 375925 - DNA, 16 bp, M. musculus
caccaagcctgacgac

SEQ ID NO: 375926 - DNA, 16 bp, M. musculus
caccaagcctgatgac

SEQ ID NO: 375927 - DNA, 16 bp, M. musculus
caccaaggagctgatt

SEQ ID NO: 375928 - DNA, 16 bp, M. musculus
caccaaggccaagaag

SEQ ID NO: 375929 - DNA, 16 bp, M. musculus
caccaaggccagctct

SEQ ID NO: 375930 - DNA, 17 bp, M. musculus
caccaagtcagatgtgt

SEQ ID NO: 375931 - DNA, 16 bp, M. musculus
caccaagtgctgggat

SEQ ID NO: 375932 - DNA, 16 bp, M. musculus
caccaagttggacttc

SEQ ID NO: 375933 - DNA, 16 bp, M. musculus
caccaatcaggaggaa

SEQ ID NO: 375934 - DNA, 16 bp, M. musculus
caccaatggacatgcc

SEQ ID NO: 375935 - DNA, 16 bp, M. musculus
caccaatggagagatc

SEQ ID NO: 375936 - DNA, 16 bp, M. musculus
caccaatggctcagac

SEQ ID NO: 375937 - DNA, 16 bp, M. musculus
caccaatgtatttgaa

SEQ ID NO: 375938 - DNA, 16 bp, M. musculus
caccacaccagaaaag

SEQ ID NO: 375939 - DNA, 16 bp, M. musculus
caccacacccagcaat

SEQ ID NO: 375940 - DNA, 16 bp, M. musculus
caccacacccagctat

SEQ ID NO: 375941 - DNA, 16 bp, M. musculus
caccacacccagctga

SEQ ID NO: 375942 - DNA, 16 bp, M. musculus
caccacacccagctta

SEQ ID NO: 375943 - DNA, 16 bp, M. musculus
caccacacctgacctc

SEQ ID NO: 375944 - DNA, 16 bp, M. musculus
caccacacctggccct

SEQ ID NO: 375945 - DNA, 16 bp, M. musculus
caccacacctggctag

SEQ ID NO: 375946 - DNA, 16 bp, M. musculus
caccacagatgaaggc

SEQ ID NO: 375947 - DNA, 16 bp, M. musculus
caccacagcaccacag

SEQ ID NO: 375948 - DNA, 16 bp, M. musculus
caccacagcatgaaga

SEQ ID NO: 375949 - DNA, 16 bp, M. musculus
caccacagcctggcct

SEQ ID NO: 375950 - DNA, 16 bp, M. musculus
caccacagcctggctt

SEQ ID NO: 375951 - DNA, 16 bp, M. musculus
caccacatatgtgcag

SEQ ID NO: 375952 - DNA, 16 bp, M. musculus
caccacatgcatgcac

SEQ ID NO: 375953 - DNA, 16 bp, M. musculus
caccaccaagcccggc

SEQ ID NO: 375954 - DNA, 16 bp, M. musculus
caccaccaagttcctg

SEQ ID NO: 375955 - DNA, 16 bp, M. musculus
caccaccacaactggc

SEQ ID NO: 375956 - DNA, 16 bp, M. musculus
caccaccacaccctgc

SEQ ID NO: 375957 - DNA, 16 bp, M. musculus
caccaccaccaccctg

SEQ ID NO: 375958 - DNA, 16 bp, M. musculus
caccaccaccacctgg

SEQ ID NO: 375959 - DNA, 16 bp, M. musculus
caccaccaccactgcc

SEQ ID NO: 375960 - DNA, 16 bp, M. musculus
caccaccaccactggg

SEQ ID NO: 375961 - DNA, 16 bp, M. musculus
caccaccaccactgtc

SEQ ID NO: 375962 - DNA, 16 bp, M. musculus
caccaccaccaggctc

SEQ ID NO: 375963 - DNA, 16 bp, M. musculus
caccaccaccatcgtc

SEQ ID NO: 375964 - DNA, 16 bp, M. musculus
caccaccacccctggc

SEQ ID NO: 375965 - DNA, 16 bp, M. musculus
caccaccacctcctgg

SEQ ID NO: 375966 - DNA, 16 bp, M. musculus
caccaccacctggcat

SEQ ID NO: 375967 - DNA, 16 bp, M. musculus
caccaccacctggcca

SEQ ID NO: 375968 - DNA, 16 bp, M. musculus
caccaccacctggctg

SEQ ID NO: 375969 - DNA, 16 bp, M. musculus
caccaccacctggttt

SEQ ID NO: 375970 - DNA, 16 bp, M. musculus
caccaccactaccagc

SEQ ID NO: 375971 - DNA, 16 bp, M. musculus
caccaccactactact

SEQ ID NO: 375972 - DNA, 16 bp, M. musculus
caccaccactcccagc

SEQ ID NO: 375973 - DNA, 16 bp, M. musculus
caccaccactggccag

SEQ ID NO: 375974 - DNA, 16 bp, M. musculus
caccaccactgtccgg

SEQ ID NO: 375975 - DNA, 16 bp, M. musculus
caccaccagcaccatc

SEQ ID NO: 375976 - DNA, 16 bp, M. musculus
caccaccagcatcacc

SEQ ID NO: 375977 - DNA, 16 bp, M. musculus
caccaccaggcccagc

SEQ ID NO: 375978 - DNA, 16 bp, M. musculus
caccaccatcacccag

SEQ ID NO: 375979 - DNA, 16 bp, M. musculus
caccaccatcactgcc

SEQ ID NO: 375980 - DNA, 16 bp, M. musculus
caccaccatcagcacc

SEQ ID NO: 375981 - DNA, 16 bp, M. musculus
caccaccatcatcatc

SEQ ID NO: 375982 - DNA, 16 bp, M. musculus
caccaccatctggcta

SEQ ID NO: 375983 - DNA, 16 bp, M. musculus
caccaccatgccctgc

SEQ ID NO: 375984 - DNA, 16 bp, M. musculus
caccaccatgcctggc

SEQ ID NO: 375985 - DNA, 16 bp, M. musculus
caccaccatgtccagc

SEQ ID NO: 375986 - DNA, 16 bp, M. musculus
caccaccatgtccagt

SEQ ID NO: 375987 - DNA, 16 bp, M. musculus
caccacccacaagggt

SEQ ID NO: 375988 - DNA, 16 bp, M. musculus
caccacccagcttttt

SEQ ID NO: 375989 - DNA, 16 bp, M. musculus
caccacccctgcatct

SEQ ID NO: 375990 - DNA, 16 bp, M. musculus
caccaccgcccagcct

SEQ ID NO: 375991 - DNA, 16 bp, M. musculus
caccacgcccagctag

SEQ ID NO: 375992 - DNA, 16 bp, M. musculus
caccacgcccagcttg

SEQ ID NO: 375993 - DNA, 16 bp, M. musculus
caccacggtcctctac

SEQ ID NO: 375994 - DNA, 16 bp, M. musculus
caccactcctggctca

SEQ ID NO: 375995 - DNA, 16 bp, M. musculus
caccactgagctacac

SEQ ID NO: 375996 - DNA, 16 bp, M. musculus
caccactgcactgctg

SEQ ID NO: 375997 - DNA, 16 bp, M. musculus
caccactgcccagata

SEQ ID NO: 375998 - DNA, 16 bp, M. musculus
caccactgcccagcat

SEQ ID NO: 375999 - DNA, 16 bp, M. musculus
caccactgcccagctg

SEQ ID NO: 376000 - DNA, 17 bp, M. musculus
caccactgcccggctta

SEQ ID NO: 376001 - DNA, 16 bp, M. musculus
caccactgcctgactt

SEQ ID NO: 376002 - DNA, 16 bp, M. musculus
caccactgcctggcaa

SEQ ID NO: 376003 - DNA, 17 bp, M. musculus
caccactgcctggccag

SEQ ID NO: 376004 - DNA, 16 bp, M. musculus
caccactgcgcaggcg

SEQ ID NO: 376005 - DNA, 16 bp, M. musculus
caccactgctcagctt

SEQ ID NO: 376006 - DNA, 16 bp, M. musculus
caccactgctgctgct

SEQ ID NO: 376007 - DNA, 16 bp, M. musculus
caccactgcttggcaa

SEQ ID NO: 376008 - DNA, 16 bp, M. musculus
caccactggggaggca

SEQ ID NO: 376009 - DNA, 16 bp, M. musculus
caccactgtcaccacc

SEQ ID NO: 376010 - DNA, 16 bp, M. musculus
caccagaaaagcaagg

SEQ ID NO: 376011 - DNA, 16 bp, M. musculus
caccagaagaggccat

SEQ ID NO: 376012 - DNA, 16 bp, M. musculus
caccagaagagggaat

SEQ ID NO: 376013 - DNA, 16 bp, M. musculus
caccagaaggtttttg

SEQ ID NO: 376014 - DNA, 16 bp, M. musculus
caccagaagttctttg

SEQ ID NO: 376015 - DNA, 16 bp, M. musculus
caccagaagttttttt

SEQ ID NO: 376016 - DNA, 16 bp, M. musculus
caccagacacacatat

SEQ ID NO: 376017 - DNA, 16 bp, M. musculus
caccagacagacagca

SEQ ID NO: 376018 - DNA, 16 bp, M. musculus
caccagagaactcata

SEQ ID NO: 376019 - DNA, 16 bp, M. musculus
caccagagaagactac

SEQ ID NO: 376020 - DNA, 16 bp, M. musculus
caccagagaagactgc

SEQ ID NO: 376021 - DNA, 16 bp, M. musculus
caccagagacaaccag

SEQ ID NO: 376022 - DNA, 16 bp, M. musculus
caccagagacctcaaa

SEQ ID NO: 376023 - DNA, 16 bp, M. musculus
caccagagaccttgga

SEQ ID NO: 376024 - DNA, 16 bp, M. musculus
caccagagcccagcta

SEQ ID NO: 376025 - DNA, 16 bp, M. musculus
caccagagctgggcag

SEQ ID NO: 376026 - DNA, 16 bp, M. musculus
caccagaggtttttta

SEQ ID NO: 376027 - DNA, 16 bp, M. musculus
caccagagttttacct

SEQ ID NO: 376028 - DNA, 16 bp, M. musculus
caccagatctcattac

SEQ ID NO: 376029 - DNA, 16 bp, M. musculus
caccagcaacagagga

SEQ ID NO: 376030 - DNA, 16 bp, M. musculus
caccagcaagtcccag

SEQ ID NO: 376031 - DNA, 16 bp, M. musculus
caccagcaatgcagga

SEQ ID NO: 376032 - DNA, 16 bp, M. musculus
caccagcaatggagga

SEQ ID NO: 376033 - DNA, 16 bp, M. musculus
caccagcaccagcagc

SEQ ID NO: 376034 - DNA, 16 bp, M. musculus
caccagcacctgctgt

SEQ ID NO: 376035 - DNA, 16 bp, M. musculus
caccagcactggggca

SEQ ID NO: 376036 - DNA, 16 bp, M. musculus
caccagcagagggcat

SEQ ID NO: 376037 - DNA, 16 bp, M. musculus
caccagcagcaccagg

SEQ ID NO: 376038 - DNA, 16 bp, M. musculus
caccagcagcagcagc

SEQ ID NO: 376039 - DNA, 16 bp, M. musculus
caccagcagctgactg

SEQ ID NO: 376040 - DNA, 16 bp, M. musculus
caccagcccagagatg

SEQ ID NO: 376041 - DNA, 16 bp, M. musculus
caccagcccagggctg

SEQ ID NO: 376042 - DNA, 16 bp, M. musculus
caccagcccagggttg

SEQ ID NO: 376043 - DNA, 16 bp, M. musculus
caccagcctcagcctc

SEQ ID NO: 376044 - DNA, 16 bp, M. musculus
caccagcctctgcctc

SEQ ID NO: 376045 - DNA, 16 bp, M. musculus
caccagctcagaggag

SEQ ID NO: 376046 - DNA, 16 bp, M. musculus
caccagctcctgcctc

SEQ ID NO: 376047 - DNA, 16 bp, M. musculus
caccaggaaataatca

SEQ ID NO: 376048 - DNA, 16 bp, M. musculus
caccaggaacctccag

SEQ ID NO: 376049 - DNA, 16 bp, M. musculus
caccaggatctcagga

SEQ ID NO: 376050 - DNA, 16 bp, M. musculus
caccaggcacaaacca

SEQ ID NO: 376051 - DNA, 16 bp, M. musculus
caccaggcaccaggca

SEQ ID NO: 376052 - DNA, 16 bp, M. musculus
caccaggcagcacttc

SEQ ID NO: 376053 - DNA, 16 bp, M. musculus
caccaggcagtggtgg

SEQ ID NO: 376054 - DNA, 16 bp, M. musculus
caccaggcctccccac

SEQ ID NO: 376055 - DNA, 16 bp, M. musculus
caccaggcggtggtgg

SEQ ID NO: 376056 - DNA, 16 bp, M. musculus
caccagggtgagctct

SEQ ID NO: 376057 - DNA, 16 bp, M. musculus
caccaggtcctctgta

SEQ ID NO: 376058 - DNA, 16 bp, M. musculus
caccagtcaagaaaat

SEQ ID NO: 376059 - DNA, 16 bp, M. musculus
caccagtccagcctca

SEQ ID NO: 376060 - DNA, 16 bp, M. musculus
caccagtgatctcaag

SEQ ID NO: 376061 - DNA, 16 bp, M. musculus
caccagtggctcaggc

SEQ ID NO: 376062 - DNA, 16 bp, M. musculus
caccagtgggaagaga

SEQ ID NO: 376063 - DNA, 16 bp, M. musculus
caccagtgggaggaga

SEQ ID NO: 376064 - DNA, 16 bp, M. musculus
caccagtggttctttt

SEQ ID NO: 376065 - DNA, 16 bp, M. musculus
caccagtgttccaatg

SEQ ID NO: 376066 - DNA, 16 bp, M. musculus
caccagttgttgaaaa

SEQ ID NO: 376067 - DNA, 16 bp, M. musculus
caccagtttccaggct

SEQ ID NO: 376068 - DNA, 16 bp, M. musculus
caccataaccaaagca

SEQ ID NO: 376069 - DNA, 16 bp, M. musculus
caccatacacatacca

SEQ ID NO: 376070 - DNA, 16 bp, M. musculus
caccatacccagctca

SEQ ID NO: 376071 - DNA, 16 bp, M. musculus
caccatagctgtcttc

SEQ ID NO: 376072 - DNA, 16 bp, M. musculus
caccatcaatctgcca

SEQ ID NO: 376073 - DNA, 16 bp, M. musculus
caccatcacacccagc

SEQ ID NO: 376074 - DNA, 16 bp, M. musculus
caccatcaccaacatc

SEQ ID NO: 376075 - DNA, 16 bp, M. musculus
caccatcaccagcatc

SEQ ID NO: 376076 - DNA, 16 bp, M. musculus
caccatcaccatcaca

SEQ ID NO: 376077 - DNA, 16 bp, M. musculus
caccatcaccatcact

SEQ ID NO: 376078 - DNA, 16 bp, M. musculus
caccatcagcaccacc

SEQ ID NO: 376079 - DNA, 16 bp, M. musculus
caccatcatcaccact

SEQ ID NO: 376080 - DNA, 16 bp, M. musculus
caccatcatcaccatc

SEQ ID NO: 376081 - DNA, 16 bp, M. musculus
caccatcatcagaaag

SEQ ID NO: 376082 - DNA, 16 bp, M. musculus
caccatcatcatcatc

SEQ ID NO: 376083 - DNA, 16 bp, M. musculus
caccatcatcatcttc

SEQ ID NO: 376084 - DNA, 16 bp, M. musculus
caccatcatcttcatc

SEQ ID NO: 376085 - DNA, 16 bp, M. musculus
caccatcattaccacc

SEQ ID NO: 376086 - DNA, 16 bp, M. musculus
caccatcattattatt

SEQ ID NO: 376087 - DNA, 17 bp, M. musculus
caccatccatccatcca

SEQ ID NO: 376088 - DNA, 16 bp, M. musculus
caccatcgtcatcatc

SEQ ID NO: 376089 - DNA, 16 bp, M. musculus
caccatctcctggaat

SEQ ID NO: 376090 - DNA, 16 bp, M. musculus
caccatctctccagcc

SEQ ID NO: 376091 - DNA, 16 bp, M. musculus
caccatcttctggcct

SEQ ID NO: 376092 - DNA, 16 bp, M. musculus
caccatgaagaaagcc

SEQ ID NO: 376093 - DNA, 16 bp, M. musculus
caccatgaagagagcc

SEQ ID NO: 376094 - DNA, 16 bp, M. musculus
caccatgaccaaaagg

SEQ ID NO: 376095 - DNA, 16 bp, M. musculus
caccatgaccaaagag

SEQ ID NO: 376096 - DNA, 16 bp, M. musculus
caccatgaccagggca

SEQ ID NO: 376097 - DNA, 16 bp, M. musculus
caccatgatgggctgt

SEQ ID NO: 376098 - DNA, 16 bp, M. musculus
caccatgcacacacat

SEQ ID NO: 376099 - DNA, 16 bp, M. musculus
caccatgcccagcagg

SEQ ID NO: 376100 - DNA, 16 bp, M. musculus
caccatgcccagcatt

SEQ ID NO: 376101 - DNA, 16 bp, M. musculus
caccatgcccagctcc

SEQ ID NO: 376102 - DNA, 16 bp, M. musculus
caccatgcccagctct

SEQ ID NO: 376103 - DNA, 16 bp, M. musculus
caccatgcccggcatc

SEQ ID NO: 376104 - DNA, 16 bp, M. musculus
caccatgcccggccca

SEQ ID NO: 376105 - DNA, 16 bp, M. musculus
caccatgccctgctct

SEQ ID NO: 376106 - DNA, 16 bp, M. musculus
caccatgcctgcctcc

SEQ ID NO: 376107 - DNA, 16 bp, M. musculus
caccatgcctggctaa

SEQ ID NO: 376108 - DNA, 16 bp, M. musculus
caccatgcctggctct

SEQ ID NO: 376109 - DNA, 16 bp, M. musculus
caccatgcctggctgt

SEQ ID NO: 376110 - DNA, 16 bp, M. musculus
caccatgcctggcttc

SEQ ID NO: 376111 - DNA, 16 bp, M. musculus
caccatgcctggcttg

SEQ ID NO: 376112 - DNA, 16 bp, M. musculus
caccatgcctggcttt

SEQ ID NO: 376113 - DNA, 16 bp, M. musculus
caccatgccttcccca

SEQ ID NO: 376114 - DNA, 16 bp, M. musculus
caccatgctacagggg

SEQ ID NO: 376115 - DNA, 16 bp, M. musculus
caccatggacagctcc

SEQ ID NO: 376116 - DNA, 16 bp, M. musculus
caccatggcatgtgtg

SEQ ID NO: 376117 - DNA, 16 bp, M. musculus
caccatggccaagaag

SEQ ID NO: 376118 - DNA, 16 bp, M. musculus
caccatggccccaggt

SEQ ID NO: 376119 - DNA, 16 bp, M. musculus
caccatgggtccctcc

SEQ ID NO: 376120 - DNA, 16 bp, M. musculus
caccatgtcacctgat

SEQ ID NO: 376121 - DNA, 16 bp, M. musculus
caccatgtctagcttt

SEQ ID NO: 376122 - DNA, 16 bp, M. musculus
caccatgtctgacctc

SEQ ID NO: 376123 - DNA, 16 bp, M. musculus
caccatgtctgcctgc

SEQ ID NO: 376124 - DNA, 16 bp, M. musculus
caccatgtctgcctgt

SEQ ID NO: 376125 - DNA, 16 bp, M. musculus
caccatgtctgcttgg

SEQ ID NO: 376126 - DNA, 16 bp, M. musculus
caccatgtctgtctgt

SEQ ID NO: 376127 - DNA, 16 bp, M. musculus
caccatgtgcatgcag

SEQ ID NO: 376128 - DNA, 16 bp, M. musculus
caccatgtgggagctg

SEQ ID NO: 376129 - DNA, 16 bp, M. musculus
caccatgtgggtgcta

SEQ ID NO: 376130 - DNA, 20 bp, M. musculus
caccatgtggttactgggat

SEQ ID NO: 376131 - DNA, 16 bp, M. musculus
caccatgttgttgctg

SEQ ID NO: 376132 - DNA, 16 bp, M. musculus
caccattccctggctg

SEQ ID NO: 376133 - DNA, 16 bp, M. musculus
caccattcctcagctg

SEQ ID NO: 376134 - DNA, 16 bp, M. musculus
caccatttgcagatga

SEQ ID NO: 376135 - DNA, 16 bp, M. musculus
caccatttgttaaaga

SEQ ID NO: 376136 - DNA, 16 bp, M. musculus
caccatttgttgaaag

SEQ ID NO: 376137 - DNA, 16 bp, M. musculus
caccatttgttgatgc

SEQ ID NO: 376138 - DNA, 16 bp, M. musculus
caccatttttgaaaat

SEQ ID NO: 376139 - DNA, 16 bp, M. musculus
cacccaagaactgctc

SEQ ID NO: 376140 - DNA, 17 bp, M. musculus
cacccacaaggggccct

SEQ ID NO: 376141 - DNA, 16 bp, M. musculus
cacccacacagagaca

SEQ ID NO: 376142 - DNA, 16 bp, M. musculus
cacccacacctgcctc

SEQ ID NO: 376143 - DNA, 16 bp, M. musculus
cacccacactctcctg

SEQ ID NO: 376144 - DNA, 16 bp, M. musculus
cacccacagtgggctg

SEQ ID NO: 376145 - DNA, 16 bp, M. musculus
cacccacatacacatg

SEQ ID NO: 376146 - DNA, 16 bp, M. musculus
cacccacatatataca

SEQ ID NO: 376147 - DNA, 16 bp, M. musculus
cacccacatggtgact

SEQ ID NO: 376148 - DNA, 16 bp, M. musculus
cacccaccagaggtag

SEQ ID NO: 376149 - DNA, 16 bp, M. musculus
cacccacctggtggct

SEQ ID NO: 376150 - DNA, 16 bp, M. musculus
cacccactccaacttc

SEQ ID NO: 376151 - DNA, 16 bp, M. musculus
cacccactccagattc

SEQ ID NO: 376152 - DNA, 16 bp, M. musculus
cacccactcctattcc

SEQ ID NO: 376153 - DNA, 16 bp, M. musculus
cacccactgccacttc

SEQ ID NO: 376154 - DNA, 16 bp, M. musculus
cacccactggcaacag

SEQ ID NO: 376155 - DNA, 16 bp, M. musculus
cacccagaagagaaga

SEQ ID NO: 376156 - DNA, 16 bp, M. musculus
cacccagacccagatc

SEQ ID NO: 376157 - DNA, 16 bp, M. musculus
cacccagagacacaca

SEQ ID NO: 376158 - DNA, 17 bp, M. musculus
cacccagagaggtcttg

SEQ ID NO: 376159 - DNA, 16 bp, M. musculus
cacccagagccatcag

SEQ ID NO: 376160 - DNA, 16 bp, M. musculus
cacccagagctacaca

SEQ ID NO: 376161 - DNA, 16 bp, M. musculus
cacccagagctcctag

SEQ ID NO: 376162 - DNA, 16 bp, M. musculus
cacccagaggcagagg

SEQ ID NO: 376163 - DNA, 16 bp, M. musculus
cacccagcagctgact

SEQ ID NO: 376164 - DNA, 16 bp, M. musculus
cacccagcagttgact

SEQ ID NO: 376165 - DNA, 16 bp, M. musculus
cacccagcatttatgt

SEQ ID NO: 376166 - DNA, 16 bp, M. musculus
cacccagccatctctc

SEQ ID NO: 376167 - DNA, 16 bp, M. musculus
cacccagcccaggagg

SEQ ID NO: 376168 - DNA, 16 bp, M. musculus
cacccagctgaccttc

SEQ ID NO: 376169 - DNA, 16 bp, M. musculus
cacccaggaaatccag

SEQ ID NO: 376170 - DNA, 16 bp, M. musculus
cacccaggaagcagag

SEQ ID NO: 376171 - DNA, 16 bp, M. musculus
cacccaggaccacctg

SEQ ID NO: 376172 - DNA, 16 bp, M. musculus
cacccaggagacagag

SEQ ID NO: 376173 - DNA, 16 bp, M. musculus
cacccaggaggtggag

SEQ ID NO: 376174 - DNA, 16 bp, M. musculus
cacccaggcagataat

SEQ ID NO: 376175 - DNA, 16 bp, M. musculus
cacccaggtcccttcc

SEQ ID NO: 376176 - DNA, 16 bp, M. musculus
cacccagttccccatc

SEQ ID NO: 376177 - DNA, 16 bp, M. musculus
cacccatataaaaagc

SEQ ID NO: 376178 - DNA, 16 bp, M. musculus
cacccatccatcatcc

SEQ ID NO: 376179 - DNA, 16 bp, M. musculus
cacccatccatgataa

SEQ ID NO: 376180 - DNA, 16 bp, M. musculus
cacccatggtaggagt

SEQ ID NO: 376181 - DNA, 16 bp, M. musculus
cacccatgtgtgtgtg

SEQ ID NO: 376182 - DNA, 16 bp, M. musculus
cacccatgtttgaaag

SEQ ID NO: 376183 - DNA, 16 bp, M. musculus
caccccaacacatctg

SEQ ID NO: 376184 - DNA, 16 bp, M. musculus
caccccacaacttact

SEQ ID NO: 376185 - DNA, 16 bp, M. musculus
caccccacccctgtct

SEQ ID NO: 376186 - DNA, 16 bp, M. musculus
caccccactgtcacca

SEQ ID NO: 376187 - DNA, 16 bp, M. musculus
caccccacttgacctc

SEQ ID NO: 376188 - DNA, 16 bp, M. musculus
caccccagaagagggc

SEQ ID NO: 376189 - DNA, 16 bp, M. musculus
caccccagcaaggaca

SEQ ID NO: 376190 - DNA, 16 bp, M. musculus
caccccagctgagtta

SEQ ID NO: 376191 - DNA, 16 bp, M. musculus
caccccaggaccacct

SEQ ID NO: 376192 - DNA, 16 bp, M. musculus
caccccaggtctctgg

SEQ ID NO: 376193 - DNA, 16 bp, M. musculus
cacccccaccccatga

SEQ ID NO: 376194 - DNA, 16 bp, M. musculus
cacccccacccctggg

SEQ ID NO: 376195 - DNA, 16 bp, M. musculus
cacccccacctcagca

SEQ ID NO: 376196 - DNA, 16 bp, M. musculus
cacccccagagcttgt

SEQ ID NO: 376197 - DNA, 16 bp, M. musculus
caccccctcctctctg

SEQ ID NO: 376198 - DNA, 16 bp, M. musculus
cacccctacagtgaca

SEQ ID NO: 376199 - DNA, 16 bp, M. musculus
cacccctgccctgctc

SEQ ID NO: 376200 - DNA, 16 bp, M. musculus
cacccctgggcaggtg

SEQ ID NO: 376201 - DNA, 16 bp, M. musculus
cacccgactgctctcc

SEQ ID NO: 376202 - DNA, 16 bp, M. musculus
cacccgagtttttgat

SEQ ID NO: 376203 - DNA, 16 bp, M. musculus
caccctcaaaacctat

SEQ ID NO: 376204 - DNA, 16 bp, M. musculus
caccctcaaactgtga

SEQ ID NO: 376205 - DNA, 16 bp, M. musculus
caccctcacacagaca

SEQ ID NO: 376206 - DNA, 16 bp, M. musculus
caccctcacacaggca

SEQ ID NO: 376207 - DNA, 17 bp, M. musculus
caccctcactggactca

SEQ ID NO: 376208 - DNA, 16 bp, M. musculus
caccctcagagaggca

SEQ ID NO: 376209 - DNA, 16 bp, M. musculus
caccctcagctacaca

SEQ ID NO: 376210 - DNA, 16 bp, M. musculus
caccctcagctacata

SEQ ID NO: 376211 - DNA, 16 bp, M. musculus
caccctcagctccttc

SEQ ID NO: 376212 - DNA, 16 bp, M. musculus
caccctcagtgacaca

SEQ ID NO: 376213 - DNA, 16 bp, M. musculus
caccctcgtagaagca

SEQ ID NO: 376214 - DNA, 16 bp, M. musculus
caccctctaactgttc

SEQ ID NO: 376215 - DNA, 16 bp, M. musculus
caccctctacttctct

SEQ ID NO: 376216 - DNA, 16 bp, M. musculus
caccctctcctggtgt

SEQ ID NO: 376217 - DNA, 16 bp, M. musculus
caccctctgactgctc

SEQ ID NO: 376218 - DNA, 16 bp, M. musculus
caccctctgctacata

SEQ ID NO: 376219 - DNA, 16 bp, M. musculus
caccctctgctcttcc

SEQ ID NO: 376220 - DNA, 16 bp, M. musculus
caccctctgtgtgtgt

SEQ ID NO: 376221 - DNA, 16 bp, M. musculus
caccctcttctgacct

SEQ ID NO: 376222 - DNA, 16 bp, M. musculus
caccctcttctgccct

SEQ ID NO: 376223 - DNA, 16 bp, M. musculus
caccctcttctggctt

SEQ ID NO: 376224 - DNA, 16 bp, M. musculus
caccctgagaagtggg

SEQ ID NO: 376225 - DNA, 16 bp, M. musculus
caccctgctcccctat

SEQ ID NO: 376226 - DNA, 16 bp, M. musculus
caccctgctttcttat

SEQ ID NO: 376227 - DNA, 16 bp, M. musculus
caccctggaaatcagt

SEQ ID NO: 376228 - DNA, 16 bp, M. musculus
caccctggcattcctc

SEQ ID NO: 376229 - DNA, 16 bp, M. musculus
caccctgggctggtgg

SEQ ID NO: 376230 - DNA, 16 bp, M. musculus
caccctgtagccccag

SEQ ID NO: 376231 - DNA, 16 bp, M. musculus
caccctgtagccctgg

SEQ ID NO: 376232 - DNA, 16 bp, M. musculus
cacccttacaagtccc

SEQ ID NO: 376233 - DNA, 16 bp, M. musculus
cacccttacacagaca

SEQ ID NO: 376234 - DNA, 16 bp, M. musculus
cacccttggtgggccg

SEQ ID NO: 376235 - DNA, 16 bp, M. musculus
caccctttaatacagt

SEQ ID NO: 376236 - DNA, 16 bp, M. musculus
cacccttttgtctcag

SEQ ID NO: 376237 - DNA, 16 bp, M. musculus
caccgactggttgtgg

SEQ ID NO: 376238 - DNA, 16 bp, M. musculus
caccggcctctgcctc

SEQ ID NO: 376239 - DNA, 16 bp, M. musculus
caccgggaagcaggaa

SEQ ID NO: 376240 - DNA, 16 bp, M. musculus
caccgtgcccagcttt

SEQ ID NO: 376241 - DNA, 16 bp, M. musculus
cacctaaagaaatgtt

SEQ ID NO: 376242 - DNA, 16 bp, M. musculus
cacctaagaccatctg

SEQ ID NO: 376243 - DNA, 16 bp, M. musculus
cacctaaggccatggt

SEQ ID NO: 376244 - DNA, 16 bp, M. musculus
cacctacaaggcagct

SEQ ID NO: 376245 - DNA, 16 bp, M. musculus
cacctacatgcacaca

SEQ ID NO: 376246 - DNA, 16 bp, M. musculus
cacctacctctgcctc

SEQ ID NO: 376247 - DNA, 16 bp, M. musculus
cacctacctctgtctc

SEQ ID NO: 376248 - DNA, 16 bp, M. musculus
cacctactccaagacc

SEQ ID NO: 376249 - DNA, 16 bp, M. musculus
cacctactccatcaag

SEQ ID NO: 376250 - DNA, 16 bp, M. musculus
cacctatatggcagct

SEQ ID NO: 376251 - DNA, 16 bp, M. musculus
cacctcacaaccatct

SEQ ID NO: 376252 - DNA, 16 bp, M. musculus
cacctcacaccggtca

SEQ ID NO: 376253 - DNA, 16 bp, M. musculus
cacctcacacctgtca

SEQ ID NO: 376254 - DNA, 16 bp, M. musculus
cacctcacagcagtca

SEQ ID NO: 376255 - DNA, 16 bp, M. musculus
cacctcaccaggcatg

SEQ ID NO: 376256 - DNA, 16 bp, M. musculus
cacctcaccgccctgg

SEQ ID NO: 376257 - DNA, 16 bp, M. musculus
cacctcagcatcccca

SEQ ID NO: 376258 - DNA, 16 bp, M. musculus
cacctcagcctcagaa

SEQ ID NO: 376259 - DNA, 16 bp, M. musculus
cacctcagcctcctga

SEQ ID NO: 376260 - DNA, 16 bp, M. musculus
cacctcagtgttggga

SEQ ID NO: 376261 - DNA, 16 bp, M. musculus
cacctcatccagtcct

SEQ ID NO: 376262 - DNA, 16 bp, M. musculus
cacctcatggatcctt

SEQ ID NO: 376263 - DNA, 16 bp, M. musculus
cacctcatgggacctt

SEQ ID NO: 376264 - DNA, 16 bp, M. musculus
cacctccatcaggaag

SEQ ID NO: 376265 - DNA, 16 bp, M. musculus
cacctccatggcctct

SEQ ID NO: 376266 - DNA, 16 bp, M. musculus
cacctcccaagagctg

SEQ ID NO: 376267 - DNA, 16 bp, M. musculus
cacctcccaggactct

SEQ ID NO: 376268 - DNA, 16 bp, M. musculus
cacctcccaggcctct

SEQ ID NO: 376269 - DNA, 16 bp, M. musculus
cacctcccaggtctcc

SEQ ID NO: 376270 - DNA, 16 bp, M. musculus
cacctccccacccttg

SEQ ID NO: 376271 - DNA, 16 bp, M. musculus
cacctccccttccttg

SEQ ID NO: 376272 - DNA, 16 bp, M. musculus
cacctccctctgcttc

SEQ ID NO: 376273 - DNA, 16 bp, M. musculus
cacctccctgccctgg

SEQ ID NO: 376274 - DNA, 16 bp, M. musculus
cacctccctgctccct

SEQ ID NO: 376275 - DNA, 16 bp, M. musculus
cacctcccttatccca

SEQ ID NO: 376276 - DNA, 16 bp, M. musculus
cacctcctaaagtttc

SEQ ID NO: 376277 - DNA, 16 bp, M. musculus
cacctcctacctcctg

SEQ ID NO: 376278 - DNA, 16 bp, M. musculus
cacctcctccagcaag

SEQ ID NO: 376279 - DNA, 16 bp, M. musculus
cacctcctccaggaag

SEQ ID NO: 376280 - DNA, 16 bp, M. musculus
cacctcctctcctgcc

SEQ ID NO: 376281 - DNA, 16 bp, M. musculus
cacctccttcaacaaa

SEQ ID NO: 376282 - DNA, 16 bp, M. musculus
cacctctcagggccct

SEQ ID NO: 376283 - DNA, 16 bp, M. musculus
cacctctccagccttc

SEQ ID NO: 376284 - DNA, 16 bp, M. musculus
cacctctccagctcca

SEQ ID NO: 376285 - DNA, 16 bp, M. musculus
cacctctccagctccc

SEQ ID NO: 376286 - DNA, 16 bp, M. musculus
cacctctccagctctc

SEQ ID NO: 376287 - DNA, 16 bp, M. musculus
cacctctccatggcct

SEQ ID NO: 376288 - DNA, 16 bp, M. musculus
cacctctcctttggca

SEQ ID NO: 376289 - DNA, 16 bp, M. musculus
cacctctctgtctctg

SEQ ID NO: 376290 - DNA, 16 bp, M. musculus
cacctctgcatcctct

SEQ ID NO: 376291 - DNA, 16 bp, M. musculus
cacctctggctcttac

SEQ ID NO: 376292 - DNA, 16 bp, M. musculus
cacctctgtctcctgc

SEQ ID NO: 376293 - DNA, 16 bp, M. musculus
cacctctgtctgccct

SEQ ID NO: 376294 - DNA, 16 bp, M. musculus
cacctctgtttgcttt

SEQ ID NO: 376295 - DNA, 16 bp, M. musculus
cacctctttctttagg

SEQ ID NO: 376296 - DNA, 16 bp, M. musculus
cacctgaaaaaaaaat

SEQ ID NO: 376297 - DNA, 16 bp, M. musculus
cacctgaaaagctaga

SEQ ID NO: 376298 - DNA, 16 bp, M. musculus
cacctgaagtccttcc

SEQ ID NO: 376299 - DNA, 17 bp, M. musculus
cacctgaatcctggtac

SEQ ID NO: 376300 - DNA, 16 bp, M. musculus
cacctgacagagataa

SEQ ID NO: 376301 - DNA, 16 bp, M. musculus
cacctgactctgcctc

SEQ ID NO: 376302 - DNA, 16 bp, M. musculus
cacctgactctgggaa

SEQ ID NO: 376303 - DNA, 17 bp, M. musculus
cacctgactggccttcc

SEQ ID NO: 376304 - DNA, 42 bp, M. musculus
cacctgacttcctcatataagacacaaacatcttgagtgctg

SEQ ID NO: 376305 - DNA, 16 bp, M. musculus
cacctgaggaacaaga

SEQ ID NO: 376306 - DNA, 16 bp, M. musculus
cacctgatgtaggtgc

SEQ ID NO: 376307 - DNA, 16 bp, M. musculus
cacctgatgtcaacct

SEQ ID NO: 376308 - DNA, 16 bp, M. musculus
cacctgcacacatgtg

SEQ ID NO: 376309 - DNA, 16 bp, M. musculus
cacctgcacagttctc

SEQ ID NO: 376310 - DNA, 16 bp, M. musculus
cacctgcagctggact

SEQ ID NO: 376311 - DNA, 16 bp, M. musculus
cacctgcatgtacaca

SEQ ID NO: 376312 - DNA, 16 bp, M. musculus
cacctgccaataaaaa

SEQ ID NO: 376313 - DNA, 16 bp, M. musculus
cacctgcccacctgcc

SEQ ID NO: 376314 - DNA, 16 bp, M. musculus
cacctgcccaggagtg

SEQ ID NO: 376315 - DNA, 16 bp, M. musculus
cacctgcctccacctc

SEQ ID NO: 376316 - DNA, 16 bp, M. musculus
cacctgcctctacctc

SEQ ID NO: 376317 - DNA, 16 bp, M. musculus
cacctgcctctccttc

SEQ ID NO: 376318 - DNA, 16 bp, M. musculus
cacctgcctctgccac

SEQ ID NO: 376319 - DNA, 16 bp, M. musculus
cacctgcctctgcccc

SEQ ID NO: 376320 - DNA, 16 bp, M. musculus
cacctgcctctgccct

SEQ ID NO: 376321 - DNA, 16 bp, M. musculus
cacctgctcaccaacc

SEQ ID NO: 376322 - DNA, 16 bp, M. musculus
cacctgctccccaacc

SEQ ID NO: 376323 - DNA, 16 bp, M. musculus
cacctgctcctcacac

SEQ ID NO: 376324 - DNA, 16 bp, M. musculus
cacctgctcctcacat

SEQ ID NO: 376325 - DNA, 16 bp, M. musculus
cacctgctcctgcctc

SEQ ID NO: 376326 - DNA, 16 bp, M. musculus
cacctgctctctctct

SEQ ID NO: 376327 - DNA, 16 bp, M. musculus
cacctgctgcagcact

SEQ ID NO: 376328 - DNA, 16 bp, M. musculus
cacctgctgcccttcc

SEQ ID NO: 376329 - DNA, 16 bp, M. musculus
cacctgctgctcttcc

SEQ ID NO: 376330 - DNA, 16 bp, M. musculus
cacctgctgctgcctc

SEQ ID NO: 376331 - DNA, 16 bp, M. musculus
cacctgcttttgcctc

SEQ ID NO: 376332 - DNA, 16 bp, M. musculus
cacctggaagagaaga

SEQ ID NO: 376333 - DNA, 16 bp, M. musculus
cacctggaagagaatg

SEQ ID NO: 376334 - DNA, 16 bp, M. musculus
cacctggatttgaacc

SEQ ID NO: 376335 - DNA, 16 bp, M. musculus
cacctggcagtggtgg

SEQ ID NO: 376336 - DNA, 16 bp, M. musculus
cacctggcccctccca

SEQ ID NO: 376337 - DNA, 16 bp, M. musculus
cacctggctcctgtga

SEQ ID NO: 376338 - DNA, 16 bp, M. musculus
cacctggcttccctgc

SEQ ID NO: 376339 - DNA, 16 bp, M. musculus
cacctgggaagaggaa

SEQ ID NO: 376340 - DNA, 16 bp, M. musculus
cacctgggagacagag

SEQ ID NO: 376341 - DNA, 16 bp, M. musculus
cacctgggaggctgag

SEQ ID NO: 376342 - DNA, 16 bp, M. musculus
cacctgggaggtggag

SEQ ID NO: 376343 - DNA, 16 bp, M. musculus
cacctgggcaccttcc

SEQ ID NO: 376344 - DNA, 17 bp, M. musculus
cacctggggagattgtg

SEQ ID NO: 376345 - DNA, 16 bp, M. musculus
cacctggggatccatc

SEQ ID NO: 376346 - DNA, 16 bp, M. musculus
cacctggggccaagtg

SEQ ID NO: 376347 - DNA, 16 bp, M. musculus
cacctgtaaccagaac

SEQ ID NO: 376348 - DNA, 16 bp, M. musculus
cacctgtaatcccagt

SEQ ID NO: 376349 - DNA, 16 bp, M. musculus
cacctgtaatgagacc

SEQ ID NO: 376350 - DNA, 16 bp, M. musculus
cacctgtagttccagc

SEQ ID NO: 376351 - DNA, 16 bp, M. musculus
cacctgtcaattaaaa

SEQ ID NO: 376352 - DNA, 16 bp, M. musculus
cacctgtcctctggtc

SEQ ID NO: 376353 - DNA, 16 bp, M. musculus
cacctgtctctgcttc

SEQ ID NO: 376354 - DNA, 16 bp, M. musculus
cacctgtctcttcctc

SEQ ID NO: 376355 - DNA, 16 bp, M. musculus
cacctgtctgcaagca

SEQ ID NO: 376356 - DNA, 16 bp, M. musculus
cacctgtctgtctgtc

SEQ ID NO: 376357 - DNA, 16 bp, M. musculus
cacctgtgagggattt

SEQ ID NO: 376358 - DNA, 16 bp, M. musculus
cacctgtgcctgtgcc

SEQ ID NO: 376359 - DNA, 16 bp, M. musculus
cacctgtggggccttc

SEQ ID NO: 376360 - DNA, 16 bp, M. musculus
cacctgtgtatgtgtg

SEQ ID NO: 376361 - DNA, 16 bp, M. musculus
cacctgtgtccctggt

SEQ ID NO: 376362 - DNA, 16 bp, M. musculus
cacctgtgtgcacaca

SEQ ID NO: 376363 - DNA, 16 bp, M. musculus
cacctgtgtgggaacc

SEQ ID NO: 376364 - DNA, 16 bp, M. musculus
cacctgtgtgtcccag

SEQ ID NO: 376365 - DNA, 16 bp, M. musculus
cacctgttacaccgtg

SEQ ID NO: 376366 - DNA, 16 bp, M. musculus
cacctgttccaacaag

SEQ ID NO: 376367 - DNA, 16 bp, M. musculus
caccttacacatgcac

SEQ ID NO: 376368 - DNA, 16 bp, M. musculus
caccttcaccaatgcc

SEQ ID NO: 376369 - DNA, 16 bp, M. musculus
caccttcagagcacag

SEQ ID NO: 376370 - DNA, 16 bp, M. musculus
caccttcagctccctg

SEQ ID NO: 376371 - DNA, 16 bp, M. musculus
caccttcctcctccgc

SEQ ID NO: 376372 - DNA, 16 bp, M. musculus
caccttcctgctgtgt

SEQ ID NO: 376373 - DNA, 16 bp, M. musculus
caccttcctggtagat

SEQ ID NO: 376374 - DNA, 16 bp, M. musculus
caccttcctttgcctc

SEQ ID NO: 376375 - DNA, 16 bp, M. musculus
caccttctaacagtgc

SEQ ID NO: 376376 - DNA, 16 bp, M. musculus
caccttctccaaaatc

SEQ ID NO: 376377 - DNA, 16 bp, M. musculus
caccttctggcctctg

SEQ ID NO: 376378 - DNA, 16 bp, M. musculus
caccttgactgggcag

SEQ ID NO: 376379 - DNA, 16 bp, M. musculus
caccttgatgataacg

SEQ ID NO: 376380 - DNA, 16 bp, M. musculus
caccttgcacaaaact

SEQ ID NO: 376381 - DNA, 17 bp, M. musculus
caccttggtggagaaca

SEQ ID NO: 376382 - DNA, 18 bp, M. musculus
caccttgtcacctgatga

SEQ ID NO: 376383 - DNA, 16 bp, M. musculus
cacctttaacaacaaa

SEQ ID NO: 376384 - DNA, 17 bp, M. musculus
cacctttaatcccagcc

SEQ ID NO: 376385 - DNA, 16 bp, M. musculus
cacctttaatctgggc

SEQ ID NO: 376386 - DNA, 16 bp, M. musculus
cacctttaatgccaac

SEQ ID NO: 376387 - DNA, 16 bp, M. musculus
cacctttaccagctga

SEQ ID NO: 376388 - DNA, 49 bp, M. musculus
cacctttctactggaccagagattattcggcgggaatcgggtcccctcc

SEQ ID NO: 376389 - DNA, 16 bp, M. musculus
cacctttgcctgctga

SEQ ID NO: 376390 - DNA, 16 bp, M. musculus
cacctttgtttctcaa

SEQ ID NO: 376391 - DNA, 16 bp, M. musculus
caccttttgttgaaaa

SEQ ID NO: 376392 - DNA, 16 bp, M. musculus
cacgaaagaactcaca

SEQ ID NO: 376393 - DNA, 17 bp, M. musculus
cacgaataactgaatcc

SEQ ID NO: 376394 - DNA, 17 bp, M. musculus
cacgactttaatcccag

SEQ ID NO: 376395 - DNA, 17 bp, M. musculus
cacgagatcctaagacc

SEQ ID NO: 376396 - DNA, 16 bp, M. musculus
cacgaggagcaagcca

SEQ ID NO: 376397 - DNA, 16 bp, M. musculus
cacgcacacacaccct

SEQ ID NO: 376398 - DNA, 16 bp, M. musculus
cacgcacagagagaga

SEQ ID NO: 376399 - DNA, 16 bp, M. musculus
cacgcacatacacaca

SEQ ID NO: 376400 - DNA, 16 bp, M. musculus
cacgcacatgcacaca

SEQ ID NO: 376401 - DNA, 16 bp, M. musculus
cacgcacatgtgcaca

SEQ ID NO: 376402 - DNA, 16 bp, M. musculus
cacgcacgcacacacg

SEQ ID NO: 376403 - DNA, 16 bp, M. musculus
cacgcacgcacatgca

SEQ ID NO: 376404 - DNA, 18 bp, M. musculus
cacgcacgcacgcacact

SEQ ID NO: 376405 - DNA, 17 bp, M. musculus
cacgcacgcacgcacat

SEQ ID NO: 376406 - DNA, 17 bp, M. musculus
cacgcacgcacgcacgc

SEQ ID NO: 376407 - DNA, 17 bp, M. musculus
cacgcactcacgcacgc

SEQ ID NO: 376408 - DNA, 16 bp, M. musculus
cacgcatacacataca

SEQ ID NO: 376409 - DNA, 16 bp, M. musculus
cacgcatgcacacgca

SEQ ID NO: 376410 - DNA, 16 bp, M. musculus
cacgcatgcacgcaca

SEQ ID NO: 376411 - DNA, 16 bp, M. musculus
cacgcatgcacgcatg

SEQ ID NO: 376412 - DNA, 16 bp, M. musculus
cacgcccactgcagtc

SEQ ID NO: 376413 - DNA, 16 bp, M. musculus
cacgccttgaatccca

SEQ ID NO: 376414 - DNA, 16 bp, M. musculus
cacgcctttaatccct

SEQ ID NO: 376415 - DNA, 16 bp, M. musculus
cacgctcacctgcaca

SEQ ID NO: 376416 - DNA, 18 bp, M. musculus
cacgctgctaaccagaca

SEQ ID NO: 376417 - DNA, 16 bp, M. musculus
cacgggaaaaattcct

SEQ ID NO: 376418 - DNA, 16 bp, M. musculus
cacgggtgaccatgtg

SEQ ID NO: 376419 - DNA, 16 bp, M. musculus
cacgggtgctgggaac

SEQ ID NO: 376420 - DNA, 16 bp, M. musculus
cacgtcctagaaaaaa

SEQ ID NO: 376421 - DNA, 16 bp, M. musculus
cacgtcctagaaaaag

SEQ ID NO: 376422 - DNA, 16 bp, M. musculus
cacgtctttagtccca

SEQ ID NO: 376423 - DNA, 16 bp, M. musculus
cacgtgcacacacaca

SEQ ID NO: 376424 - DNA, 16 bp, M. musculus
cacgtgcatgcacatg

SEQ ID NO: 376425 - DNA, 16 bp, M. musculus
cacgtgcatgcatgtg

SEQ ID NO: 376426 - DNA, 16 bp, M. musculus
cacgtgcatgtgcatg

SEQ ID NO: 376427 - DNA, 16 bp, M. musculus
cacgtgcgtgcgtgtg

SEQ ID NO: 376428 - DNA, 16 bp, M. musculus
cacgtggagttttgct

SEQ ID NO: 376429 - DNA, 16 bp, M. musculus
cacgtggcagctcaca

SEQ ID NO: 376430 - DNA, 16 bp, M. musculus
cacgtggtcaccctgc

SEQ ID NO: 376431 - DNA, 16 bp, M. musculus
cacgtggtcacctgaa

SEQ ID NO: 376432 - DNA, 16 bp, M. musculus
cacgtggtggctcaca

SEQ ID NO: 376433 - DNA, 16 bp, M. musculus
cacgtgtgaacacaca

SEQ ID NO: 376434 - DNA, 16 bp, M. musculus
cacgtgtgcacacaca

SEQ ID NO: 376435 - DNA, 16 bp, M. musculus
cacgtgtgcgtgtgtg

SEQ ID NO: 376436 - DNA, 16 bp, M. musculus
cacgtgtggaagtcag

SEQ ID NO: 376437 - DNA, 16 bp, M. musculus
cacgtgtgtacacaca

SEQ ID NO: 376438 - DNA, 17 bp, M. musculus
cacgtttttgttgggtt

SEQ ID NO: 376439 - DNA, 16 bp, M. musculus
cactaaaaaaagatag

SEQ ID NO: 376440 - DNA, 16 bp, M. musculus
cactaaaacagtttct

SEQ ID NO: 376441 - DNA, 16 bp, M. musculus
cactaaacccatcagg

SEQ ID NO: 376442 - DNA, 16 bp, M. musculus
cactaaataagaaaat

SEQ ID NO: 376443 - DNA, 16 bp, M. musculus
cactaacatacacaca

SEQ ID NO: 376444 - DNA, 17 bp, M. musculus
cactaacatgaccttat

SEQ ID NO: 376445 - DNA, 16 bp, M. musculus
cactaactgctcttca

SEQ ID NO: 376446 - DNA, 16 bp, M. musculus
cactaagataaacaat

SEQ ID NO: 376447 - DNA, 16 bp, M. musculus
cactaaggaagaaaga

SEQ ID NO: 376448 - DNA, 16 bp, M. musculus
cactacaacatccttt

SEQ ID NO: 376449 - DNA, 16 bp, M. musculus
cactacagaggaacac

SEQ ID NO: 376450 - DNA, 16 bp, M. musculus
cactaccaccagcagc

SEQ ID NO: 376451 - DNA, 16 bp, M. musculus
cactaccacctggcta

SEQ ID NO: 376452 - DNA, 16 bp, M. musculus
cactacccttgagtct

SEQ ID NO: 376453 - DNA, 16 bp, M. musculus
cactacctcagagaga

SEQ ID NO: 376454 - DNA, 16 bp, M. musculus
cactacctgctgagag

SEQ ID NO: 376455 - DNA, 16 bp, M. musculus
cactactacccagaag

SEQ ID NO: 376456 - DNA, 16 bp, M. musculus
cactactgctgatgcc

SEQ ID NO: 376457 - DNA, 16 bp, M. musculus
cactacttggaggtgt

SEQ ID NO: 376458 - DNA, 16 bp, M. musculus
cactagaggagctgag

SEQ ID NO: 376459 - DNA, 16 bp, M. musculus
cactagcaatgaagga

SEQ ID NO: 376460 - DNA, 16 bp, M. musculus
cactagccattgctgt

SEQ ID NO: 376461 - DNA, 16 bp, M. musculus
cactaggctcctgaca

SEQ ID NO: 376462 - DNA, 16 bp, M. musculus
cactatagaaacaaac

SEQ ID NO: 376463 - DNA, 16 bp, M. musculus
cactatgcccagctta

SEQ ID NO: 376464 - DNA, 16 bp, M. musculus
cactatgcctggcttg

SEQ ID NO: 376465 - DNA, 16 bp, M. musculus
cactatggattaaagc

SEQ ID NO: 376466 - DNA, 16 bp, M. musculus
cactatgtagaccaag

SEQ ID NO: 376467 - DNA, 16 bp, M. musculus
cactatgtagccaaga

SEQ ID NO: 376468 - DNA, 16 bp, M. musculus
cactatgtctgcctgc

SEQ ID NO: 376469 - DNA, 16 bp, M. musculus
cactatgtgcagatga

SEQ ID NO: 376470 - DNA, 16 bp, M. musculus
cactattccctaggca

SEQ ID NO: 376471 - DNA, 16 bp, M. musculus
cactattcctcaagat

SEQ ID NO: 376472 - DNA, 16 bp, M. musculus
cactattgcagatgct

SEQ ID NO: 376473 - DNA, 16 bp, M. musculus
cactattgtgcatgcc

SEQ ID NO: 376474 - DNA, 16 bp, M. musculus
cactatttgcagatga

SEQ ID NO: 376475 - DNA, 16 bp, M. musculus
cactatttgttgaaaa

SEQ ID NO: 376476 - DNA, 16 bp, M. musculus
cactcaaaaggaaccc

SEQ ID NO: 376477 - DNA, 16 bp, M. musculus
cactcaagaaacagag

SEQ ID NO: 376478 - DNA, 16 bp, M. musculus
cactcaagcacttgtg

SEQ ID NO: 376479 - DNA, 16 bp, M. musculus
cactcaataaatgttt

SEQ ID NO: 376480 - DNA, 16 bp, M. musculus
cactcacaaaggaact

SEQ ID NO: 376481 - DNA, 16 bp, M. musculus
cactcacacacacact

SEQ ID NO: 376482 - DNA, 16 bp, M. musculus
cactcacacacactct

SEQ ID NO: 376483 - DNA, 16 bp, M. musculus
cactcacacagacaca

SEQ ID NO: 376484 - DNA, 16 bp, M. musculus
cactcacacatacaca

SEQ ID NO: 376485 - DNA, 16 bp, M. musculus
cactcacatacacaca

SEQ ID NO: 376486 - DNA, 16 bp, M. musculus
cactcacatggcaact

SEQ ID NO: 376487 - DNA, 16 bp, M. musculus
cactcaccatcagcag

SEQ ID NO: 376488 - DNA, 17 bp, M. musculus
cactcaccattatcaga

SEQ ID NO: 376489 - DNA, 16 bp, M. musculus
cactcacgaggcagag

SEQ ID NO: 376490 - DNA, 16 bp, M. musculus
cactcacgcacgcacg

SEQ ID NO: 376491 - DNA, 16 bp, M. musculus
cactcactcactcact

SEQ ID NO: 376492 - DNA, 16 bp, M. musculus
cactcactctgccatc

SEQ ID NO: 376493 - DNA, 16 bp, M. musculus
cactcagaaacacaca

SEQ ID NO: 376494 - DNA, 19 bp, M. musculus
cactcagaaatctgcctgc

SEQ ID NO: 376495 - DNA, 16 bp, M. musculus
cactcagaagacagaa

SEQ ID NO: 376496 - DNA, 16 bp, M. musculus
cactcagaagaggaaa

SEQ ID NO: 376497 - DNA, 16 bp, M. musculus
cactcagaaggcaaag

SEQ ID NO: 376498 - DNA, 16 bp, M. musculus
cactcagaaggcagag

SEQ ID NO: 376499 - DNA, 16 bp, M. musculus
cactcagaaggcaggg

SEQ ID NO: 376500 - DNA, 16 bp, M. musculus
cactcagagaccctgg

SEQ ID NO: 376501 - DNA, 16 bp, M. musculus
cactcagaggcagaag

SEQ ID NO: 376502 - DNA, 16 bp, M. musculus
cactcagaggcagagg

SEQ ID NO: 376503 - DNA, 16 bp, M. musculus
cactcagatccttctg

SEQ ID NO: 376504 - DNA, 16 bp, M. musculus
cactcagatttgacct

SEQ ID NO: 376505 - DNA, 16 bp, M. musculus
cactcagcaagctcac

SEQ ID NO: 376506 - DNA, 16 bp, M. musculus
cactcagctcctcctg

SEQ ID NO: 376507 - DNA, 16 bp, M. musculus
cactcagcttctccct

SEQ ID NO: 376508 - DNA, 16 bp, M. musculus
cactcaggaaaaaaaa

SEQ ID NO: 376509 - DNA, 16 bp, M. musculus
cactcaggaaatggag

SEQ ID NO: 376510 - DNA, 16 bp, M. musculus
cactcaggaagaagag

SEQ ID NO: 376511 - DNA, 18 bp, M. musculus
cactcaggaatgaccaag

SEQ ID NO: 376512 - DNA, 16 bp, M. musculus
cactcaggagaaagag

SEQ ID NO: 376513 - DNA, 16 bp, M. musculus
cactcaggagcctgag

SEQ ID NO: 376514 - DNA, 18 bp, M. musculus
cactcaggaggcagaggt

SEQ ID NO: 376515 - DNA, 16 bp, M. musculus
cactcaggaggcagat

SEQ ID NO: 376516 - DNA, 16 bp, M. musculus
cactcaggaggtgaag

SEQ ID NO: 376517 - DNA, 16 bp, M. musculus
cactcaggatggtatc

SEQ ID NO: 376518 - DNA, 16 bp, M. musculus
cactcagggaaagctg

SEQ ID NO: 376519 - DNA, 16 bp, M. musculus
cactcagggtgatgcc

SEQ ID NO: 376520 - DNA, 16 bp, M. musculus
cactcaggtgtaccct

SEQ ID NO: 376521 - DNA, 16 bp, M. musculus
cactcagtgcctcatc

SEQ ID NO: 376522 - DNA, 16 bp, M. musculus
cactcagtgctatgaa

SEQ ID NO: 376523 - DNA, 16 bp, M. musculus
cactcataaacacata

SEQ ID NO: 376524 - DNA, 16 bp, M. musculus
cactcatacacagata

SEQ ID NO: 376525 - DNA, 16 bp, M. musculus
cactcatacatacaaa

SEQ ID NO: 376526 - DNA, 16 bp, M. musculus
cactcatcagaatggc

SEQ ID NO: 376527 - DNA, 16 bp, M. musculus
cactcatcttccctga

SEQ ID NO: 376528 - DNA, 16 bp, M. musculus
cactcatgcaggcaca

SEQ ID NO: 376529 - DNA, 16 bp, M. musculus
cactcatgtgtacaca

SEQ ID NO: 376530 - DNA, 16 bp, M. musculus
cactccagaagaggac

SEQ ID NO: 376531 - DNA, 16 bp, M. musculus
cactccagaagaggag

SEQ ID NO: 376532 - DNA, 16 bp, M. musculus
cactccagtgaagtct

SEQ ID NO: 376533 - DNA, 16 bp, M. musculus
cactccatgagatgaa

SEQ ID NO: 376534 - DNA, 16 bp, M. musculus
cactcccacaatttct

SEQ ID NO: 376535 - DNA, 16 bp, M. musculus
cactcccaccagcaat

SEQ ID NO: 376536 - DNA, 16 bp, M. musculus
cactcccaccagcagt

SEQ ID NO: 376537 - DNA, 16 bp, M. musculus
cactcccacctcagcg

SEQ ID NO: 376538 - DNA, 16 bp, M. musculus
cactcccacttcctgt

SEQ ID NO: 376539 - DNA, 16 bp, M. musculus
cactcccagcattcct

SEQ ID NO: 376540 - DNA, 16 bp, M. musculus
cactcccagtgacaca

SEQ ID NO: 376541 - DNA, 16 bp, M. musculus
cactcccagttcctgg

SEQ ID NO: 376542 - DNA, 19 bp, M. musculus
cactcccgcttcttggccc

SEQ ID NO: 376543 - DNA, 16 bp, M. musculus
cactccctcttcctgg

SEQ ID NO: 376544 - DNA, 16 bp, M. musculus
cactccctgaaccaag

SEQ ID NO: 376545 - DNA, 16 bp, M. musculus
cactccctgggcctag

SEQ ID NO: 376546 - DNA, 16 bp, M. musculus
cactccctggtctgag

SEQ ID NO: 376547 - DNA, 16 bp, M. musculus
cactccctgtcctgct

SEQ ID NO: 376548 - DNA, 16 bp, M. musculus
cactcctctgtgtgtg

SEQ ID NO: 376549 - DNA, 16 bp, M. musculus
cactcctgcctcacct

SEQ ID NO: 376550 - DNA, 16 bp, M. musculus
cactcctgcctcagca

SEQ ID NO: 376551 - DNA, 16 bp, M. musculus
cactcctgcctcccta

SEQ ID NO: 376552 - DNA, 16 bp, M. musculus
cactcctgcttcttgg

SEQ ID NO: 376553 - DNA, 16 bp, M. musculus
cactcctgtgtgtgtg

SEQ ID NO: 376554 - DNA, 16 bp, M. musculus
cactccttcactggca

SEQ ID NO: 376555 - DNA, 16 bp, M. musculus
cactccttctgtgtct

SEQ ID NO: 376556 - DNA, 16 bp, M. musculus
cactcctttattgttg

SEQ ID NO: 376557 - DNA, 16 bp, M. musculus
cactctagtctcagga

SEQ ID NO: 376558 - DNA, 16 bp, M. musculus
cactctcacctgctca

SEQ ID NO: 376559 - DNA, 16 bp, M. musculus
cactctcactctctct

SEQ ID NO: 376560 - DNA, 16 bp, M. musculus
cactctcatatacaca

SEQ ID NO: 376561 - DNA, 16 bp, M. musculus
cactctcatcaaagga

SEQ ID NO: 376562 - DNA, 16 bp, M. musculus
cactctcatcaatgga

SEQ ID NO: 376563 - DNA, 16 bp, M. musculus
cactctccagaggtct

SEQ ID NO: 376564 - DNA, 16 bp, M. musculus
cactctctccttatct

SEQ ID NO: 376565 - DNA, 16 bp, M. musculus
cactctctgggccaag

SEQ ID NO: 376566 - DNA, 16 bp, M. musculus
cactctcttctgacct

SEQ ID NO: 376567 - DNA, 16 bp, M. musculus
cactctcttctggcct

SEQ ID NO: 376568 - DNA, 16 bp, M. musculus
cactctgcagccctgg

SEQ ID NO: 376569 - DNA, 16 bp, M. musculus
cactctgccaactgag

SEQ ID NO: 376570 - DNA, 16 bp, M. musculus
cactctgccatgcttc

SEQ ID NO: 376571 - DNA, 16 bp, M. musculus
cactctgctcctgctg

SEQ ID NO: 376572 - DNA, 20 bp, M. musculus
cactctggaaatcagtctgg

SEQ ID NO: 376573 - DNA, 16 bp, M. musculus
cactctggagacagag

SEQ ID NO: 376574 - DNA, 16 bp, M. musculus
cactctggagccagag

SEQ ID NO: 376575 - DNA, 16 bp, M. musculus
cactctggaggctgag

SEQ ID NO: 376576 - DNA, 16 bp, M. musculus
cactctggaggtggag

SEQ ID NO: 376577 - DNA, 16 bp, M. musculus
cactctggtcttcctg

SEQ ID NO: 376578 - DNA, 16 bp, M. musculus
cactctgtaaaccaga

SEQ ID NO: 376579 - DNA, 16 bp, M. musculus
cactctgtagcccaga

SEQ ID NO: 376580 - DNA, 16 bp, M. musculus
cactctgtatcccagg

SEQ ID NO: 376581 - DNA, 16 bp, M. musculus
cactctgtcaactgag

SEQ ID NO: 376582 - DNA, 16 bp, M. musculus
cactctgttctcagct

SEQ ID NO: 376583 - DNA, 16 bp, M. musculus
cactctgttctgttcc

SEQ ID NO: 376584 - DNA, 16 bp, M. musculus
cactcttaaccactga

SEQ ID NO: 376585 - DNA, 16 bp, M. musculus
cactcttaactgctga

SEQ ID NO: 376586 - DNA, 16 bp, M. musculus
cactcttaattgctga

SEQ ID NO: 376587 - DNA, 16 bp, M. musculus
cactcttacctgtgca

SEQ ID NO: 376588 - DNA, 16 bp, M. musculus
cactcttattcaaacc

SEQ ID NO: 376589 - DNA, 16 bp, M. musculus
cactcttcagacacac

SEQ ID NO: 376590 - DNA, 16 bp, M. musculus
cactcttctcaggcat

SEQ ID NO: 376591 - DNA, 16 bp, M. musculus
cactcttctggtgtgt

SEQ ID NO: 376592 - DNA, 16 bp, M. musculus
cactcttgctttcttg

SEQ ID NO: 376593 - DNA, 16 bp, M. musculus
cactctttaatggatg

SEQ ID NO: 376594 - DNA, 16 bp, M. musculus
cactctttcctccatg

SEQ ID NO: 376595 - DNA, 18 bp, M. musculus
cactctttggtcttcgtt

SEQ ID NO: 376596 - DNA, 19 bp, M. musculus
cactctttttgcactccta

SEQ ID NO: 376597 - DNA, 16 bp, M. musculus
cactgaaagatttaaa

SEQ ID NO: 376598 - DNA, 16 bp, M. musculus
cactgaaaggacccag

SEQ ID NO: 376599 - DNA, 16 bp, M. musculus
cactgaaatttataga

SEQ ID NO: 376600 - DNA, 16 bp, M. musculus
cactgaacacagagct

SEQ ID NO: 376601 - DNA, 16 bp, M. musculus
cactgaacccggagct

SEQ ID NO: 376602 - DNA, 16 bp, M. musculus
cactgaacctgacaga

SEQ ID NO: 376603 - DNA, 16 bp, M. musculus
cactgaacttggaact

SEQ ID NO: 376604 - DNA, 16 bp, M. musculus
cactgaagaaaatgac

SEQ ID NO: 376605 - DNA, 16 bp, M. musculus
cactgaagaaaatgat

SEQ ID NO: 376606 - DNA, 16 bp, M. musculus
cactgaagaagtgtgc

SEQ ID NO: 376607 - DNA, 16 bp, M. musculus
cactgaaggacctgga

SEQ ID NO: 376608 - DNA, 16 bp, M. musculus
cactgaaggagctgaa

SEQ ID NO: 376609 - DNA, 16 bp, M. musculus
cactgaattttaaaat

SEQ ID NO: 376610 - DNA, 16 bp, M. musculus
cactgaattttttttt

SEQ ID NO: 376611 - DNA, 16 bp, M. musculus
cactgacacacacaga

SEQ ID NO: 376612 - DNA, 16 bp, M. musculus
cactgacacagacaca

SEQ ID NO: 376613 - DNA, 16 bp, M. musculus
cactgacaccattgcc

SEQ ID NO: 376614 - DNA, 16 bp, M. musculus
cactgacatacacaca

SEQ ID NO: 376615 - DNA, 16 bp, M. musculus
cactgaccactcttcc

SEQ ID NO: 376616 - DNA, 16 bp, M. musculus
cactgaccccacatgg

SEQ ID NO: 376617 - DNA, 16 bp, M. musculus
cactgactactcttcc

SEQ ID NO: 376618 - DNA, 45 bp, M. musculus
cactgactcatgggctgtagccaatggattggctggatggtcagg

SEQ ID NO: 376619 - DNA, 16 bp, M. musculus
cactgactgctttccc

SEQ ID NO: 376620 - DNA, 16 bp, M. musculus
cactgactgtccttcc

SEQ ID NO: 376621 - DNA, 16 bp, M. musculus
cactgactgttcttcc

SEQ ID NO: 376622 - DNA, 16 bp, M. musculus
cactgacttttcttcc

SEQ ID NO: 376623 - DNA, 16 bp, M. musculus
cactgagacacacaca

SEQ ID NO: 376624 - DNA, 16 bp, M. musculus
cactgagactcagaag

SEQ ID NO: 376625 - DNA, 16 bp, M. musculus
cactgagatcagctga

SEQ ID NO: 376626 - DNA, 16 bp, M. musculus
cactgagatcctcctg

SEQ ID NO: 376627 - DNA, 16 bp, M. musculus
cactgagatttgacct

SEQ ID NO: 376628 - DNA, 16 bp, M. musculus
cactgagcacacagca

SEQ ID NO: 376629 - DNA, 16 bp, M. musculus
cactgagccacacacc

SEQ ID NO: 376630 - DNA, 16 bp, M. musculus
cactgagccacacccc

SEQ ID NO: 376631 - DNA, 16 bp, M. musculus
cactgagccaccaaca

SEQ ID NO: 376632 - DNA, 16 bp, M. musculus
cactgagccactgagc

SEQ ID NO: 376633 - DNA, 16 bp, M. musculus
cactgagccatcctgc

SEQ ID NO: 376634 - DNA, 16 bp, M. musculus
cactgagccatttcct

SEQ ID NO: 376635 - DNA, 16 bp, M. musculus
cactgagccatttctc

SEQ ID NO: 376636 - DNA, 16 bp, M. musculus
cactgagccctctcac

SEQ ID NO: 376637 - DNA, 16 bp, M. musculus
cactgagccttggttt

SEQ ID NO: 376638 - DNA, 16 bp, M. musculus
cactgagctaaatccc

SEQ ID NO: 376639 - DNA, 16 bp, M. musculus
cactgagctaaatcct

SEQ ID NO: 376640 - DNA, 16 bp, M. musculus
cactgagctacatccc

SEQ ID NO: 376641 - DNA, 16 bp, M. musculus
cactgagctatctctc

SEQ ID NO: 376642 - DNA, 16 bp, M. musculus
cactgaggaagctgag

SEQ ID NO: 376643 - DNA, 16 bp, M. musculus
cactgaggaggcagag

SEQ ID NO: 376644 - DNA, 16 bp, M. musculus
cactgaggaggctgag

SEQ ID NO: 376645 - DNA, 16 bp, M. musculus
cactgaggtgaaatct

SEQ ID NO: 376646 - DNA, 19 bp, M. musculus
cactgaggtggggccacct

SEQ ID NO: 376647 - DNA, 16 bp, M. musculus
cactgaggtgtgtttt

SEQ ID NO: 376648 - DNA, 16 bp, M. musculus
cactgagtctggagct

SEQ ID NO: 376649 - DNA, 16 bp, M. musculus
cactgagtgcatacca

SEQ ID NO: 376650 - DNA, 16 bp, M. musculus
cactgagtgtcttcct

SEQ ID NO: 376651 - DNA, 16 bp, M. musculus
cactgagttagaaatg

SEQ ID NO: 376652 - DNA, 17 bp, M. musculus
cactgatcaagctaaat

SEQ ID NO: 376653 - DNA, 16 bp, M. musculus
cactgatggctcttcc

SEQ ID NO: 376654 - DNA, 16 bp, M. musculus
cactgatttttttgag

SEQ ID NO: 376655 - DNA, 16 bp, M. musculus
cactgcaacaggatcc

SEQ ID NO: 376656 - DNA, 16 bp, M. musculus
cactgcactgcactgc

SEQ ID NO: 376657 - DNA, 16 bp, M. musculus
cactgcactgctgtcc

SEQ ID NO: 376658 - DNA, 16 bp, M. musculus
cactgcagaagagctg

SEQ ID NO: 376659 - DNA, 17 bp, M. musculus
cactgcagagcatgggt

SEQ ID NO: 376660 - DNA, 16 bp, M. musculus
cactgcagcaccgtgg

SEQ ID NO: 376661 - DNA, 16 bp, M. musculus
cactgcaggcacccta

SEQ ID NO: 376662 - DNA, 17 bp, M. musculus
cactgcagtcagaacca

SEQ ID NO: 376663 - DNA, 16 bp, M. musculus
cactgcataaaccagg

SEQ ID NO: 376664 - DNA, 16 bp, M. musculus
cactgccaaactcatt

SEQ ID NO: 376665 - DNA, 16 bp, M. musculus
cactgcccaagcccca

SEQ ID NO: 376666 - DNA, 16 bp, M. musculus
cactgcccacagtgga

SEQ ID NO: 376667 - DNA, 16 bp, M. musculus
cactgcccagctgaaa

SEQ ID NO: 376668 - DNA, 16 bp, M. musculus
cactgcccagcttcag

SEQ ID NO: 376669 - DNA, 16 bp, M. musculus
cactgccccacactgc

SEQ ID NO: 376670 - DNA, 16 bp, M. musculus
cactgccccctggtgg

SEQ ID NO: 376671 - DNA, 17 bp, M. musculus
cactgccgccatggtgg

SEQ ID NO: 376672 - DNA, 16 bp, M. musculus
cactgcctctggctct

SEQ ID NO: 376673 - DNA, 16 bp, M. musculus
cactgcctggcacaca

SEQ ID NO: 376674 - DNA, 16 bp, M. musculus
cactgcctggcccagg

SEQ ID NO: 376675 - DNA, 16 bp, M. musculus
cactgcctggctcagc

SEQ ID NO: 376676 - DNA, 16 bp, M. musculus
cactgcctggctccat

SEQ ID NO: 376677 - DNA, 16 bp, M. musculus
cactgcctggctcctc

SEQ ID NO: 376678 - DNA, 16 bp, M. musculus
cactgcctggctttat

SEQ ID NO: 376679 - DNA, 16 bp, M. musculus
cactgcctggctttga

SEQ ID NO: 376680 - DNA, 16 bp, M. musculus
cactgcctgggaagag

SEQ ID NO: 376681 - DNA, 16 bp, M. musculus
cactgcctgggccaag

SEQ ID NO: 376682 - DNA, 16 bp, M. musculus
cactgctctgtgtgtg

SEQ ID NO: 376683 - DNA, 16 bp, M. musculus
cactgctgctcagagg

SEQ ID NO: 376684 - DNA, 16 bp, M. musculus
cactgctgctgattca

SEQ ID NO: 376685 - DNA, 16 bp, M. musculus
cactgctgctgttcct

SEQ ID NO: 376686 - DNA, 16 bp, M. musculus
cactgctgcttcctgg

SEQ ID NO: 376687 - DNA, 17 bp, M. musculus
cactgctggaacctgag

SEQ ID NO: 376688 - DNA, 16 bp, M. musculus
cactgctggcttcctt

SEQ ID NO: 376689 - DNA, 16 bp, M. musculus
cactgctgtgaaacac

SEQ ID NO: 376690 - DNA, 16 bp, M. musculus
cactgctgtgtttgct

SEQ ID NO: 376691 - DNA, 16 bp, M. musculus
cactgctgtttgtact

SEQ ID NO: 376692 - DNA, 16 bp, M. musculus
cactggaaaaaagaca

SEQ ID NO: 376693 - DNA, 16 bp, M. musculus
cactggaaagagagcc

SEQ ID NO: 376694 - DNA, 16 bp, M. musculus
cactggaagaaggcag

SEQ ID NO: 376695 - DNA, 16 bp, M. musculus
cactggaattacaggc

SEQ ID NO: 376696 - DNA, 16 bp, M. musculus
cactggacagccagcc

SEQ ID NO: 376697 - DNA, 16 bp, M. musculus
cactggacaggcaaac

SEQ ID NO: 376698 - DNA, 16 bp, M. musculus
cactggactttctttt

SEQ ID NO: 376699 - DNA, 16 bp, M. musculus
cactggagaagctgag

SEQ ID NO: 376700 - DNA, 16 bp, M. musculus
cactggagagaaaatg

SEQ ID NO: 376701 - DNA, 16 bp, M. musculus
cactggagcagtagct

SEQ ID NO: 376702 - DNA, 16 bp, M. musculus
cactggagcatctatc

SEQ ID NO: 376703 - DNA, 16 bp, M. musculus
cactggagctggagag

SEQ ID NO: 376704 - DNA, 16 bp, M. musculus
cactggagctgtcttc

SEQ ID NO: 376705 - DNA, 16 bp, M. musculus
cactggaggagctgag

SEQ ID NO: 376706 - DNA, 16 bp, M. musculus
cactggagttcctaca

SEQ ID NO: 376707 - DNA, 16 bp, M. musculus
cactggatcattttag

SEQ ID NO: 376708 - DNA, 16 bp, M. musculus
cactggatgaatttaa

SEQ ID NO: 376709 - DNA, 16 bp, M. musculus
cactggatgacagcca

SEQ ID NO: 376710 - DNA, 16 bp, M. musculus
cactggatggtttaag

SEQ ID NO: 376711 - DNA, 16 bp, M. musculus
cactggcaactttatt

SEQ ID NO: 376712 - DNA, 16 bp, M. musculus
cactggcagagcctct

SEQ ID NO: 376713 - DNA, 16 bp, M. musculus
cactggcatggcctga

SEQ ID NO: 376714 - DNA, 16 bp, M. musculus
cactggccagcaagcc

SEQ ID NO: 376715 - DNA, 16 bp, M. musculus
cactggccagccagcc

SEQ ID NO: 376716 - DNA, 16 bp, M. musculus
cactggccagccaggc

SEQ ID NO: 376717 - DNA, 16 bp, M. musculus
cactggcccagggatg

SEQ ID NO: 376718 - DNA, 16 bp, M. musculus
cactggccccaaggac

SEQ ID NO: 376719 - DNA, 16 bp, M. musculus
cactggcctggaactc

SEQ ID NO: 376720 - DNA, 16 bp, M. musculus
cactggcctggagctt

SEQ ID NO: 376721 - DNA, 16 bp, M. musculus
cactggctaccactgg

SEQ ID NO: 376722 - DNA, 16 bp, M. musculus
cactggctgaaattgc

SEQ ID NO: 376723 - DNA, 16 bp, M. musculus
cactggctgctgctct

SEQ ID NO: 376724 - DNA, 16 bp, M. musculus
cactggctggcctgga

SEQ ID NO: 376725 - DNA, 16 bp, M. musculus
cactggcttctcttcc

SEQ ID NO: 376726 - DNA, 16 bp, M. musculus
cactgggaagcagaga

SEQ ID NO: 376727 - DNA, 16 bp, M. musculus
cactgggaagggaggc

SEQ ID NO: 376728 - DNA, 16 bp, M. musculus
cactgggaattgaacc

SEQ ID NO: 376729 - DNA, 16 bp, M. musculus
cactgggacacacaca

SEQ ID NO: 376730 - DNA, 16 bp, M. musculus
cactgggaccctggaa

SEQ ID NO: 376731 - DNA, 16 bp, M. musculus
cactgggacctggagc

SEQ ID NO: 376732 - DNA, 16 bp, M. musculus
cactgggagcaggctt

SEQ ID NO: 376733 - DNA, 16 bp, M. musculus
cactgggatcaaaggt

SEQ ID NO: 376734 - DNA, 17 bp, M. musculus
cactgggattaaaggca

SEQ ID NO: 376735 - DNA, 16 bp, M. musculus
cactgggcagccagcc

SEQ ID NO: 376736 - DNA, 16 bp, M. musculus
cactgggcagctcaca

SEQ ID NO: 376737 - DNA, 16 bp, M. musculus
cactgggcatcatcag

SEQ ID NO: 376738 - DNA, 16 bp, M. musculus
cactgggcatggtggt

SEQ ID NO: 376739 - DNA, 16 bp, M. musculus
cactgggcctggctta

SEQ ID NO: 376740 - DNA, 16 bp, M. musculus
cactgggctatgcaca

SEQ ID NO: 376741 - DNA, 16 bp, M. musculus
cactggggaagctgag

SEQ ID NO: 376742 - DNA, 16 bp, M. musculus
cactggggaccctgtg

SEQ ID NO: 376743 - DNA, 16 bp, M. musculus
cactggggagactgag

SEQ ID NO: 376744 - DNA, 16 bp, M. musculus
cactggggaggaagag

SEQ ID NO: 376745 - DNA, 16 bp, M. musculus
cactggggcacacaca

SEQ ID NO: 376746 - DNA, 16 bp, M. musculus
cactggggcacagagc

SEQ ID NO: 376747 - DNA, 16 bp, M. musculus
cactggggctcactgg

SEQ ID NO: 376748 - DNA, 16 bp, M. musculus
cactggggcttgctgg

SEQ ID NO: 376749 - DNA, 16 bp, M. musculus
cactgggggtaggctt

SEQ ID NO: 376750 - DNA, 16 bp, M. musculus
cactggggtcatccca

SEQ ID NO: 376751 - DNA, 16 bp, M. musculus
cactggggttacagat

SEQ ID NO: 376752 - DNA, 16 bp, M. musculus
cactgggtcctgggaa

SEQ ID NO: 376753 - DNA, 16 bp, M. musculus
cactgggtgtatcaac

SEQ ID NO: 376754 - DNA, 16 bp, M. musculus
cactgggtgtcttcct

SEQ ID NO: 376755 - DNA, 16 bp, M. musculus
cactggtcagaaacaa

SEQ ID NO: 376756 - DNA, 16 bp, M. musculus
cactggtcagccagcc

SEQ ID NO: 376757 - DNA, 16 bp, M. musculus
cactggtcttccctct

SEQ ID NO: 376758 - DNA, 17 bp, M. musculus
cactgtactgaggcata

SEQ ID NO: 376759 - DNA, 16 bp, M. musculus
cactgtagaccaagct

SEQ ID NO: 376760 - DNA, 16 bp, M. musculus
cactgtagcagtctct

SEQ ID NO: 376761 - DNA, 16 bp, M. musculus
cactgtagctgacttt

SEQ ID NO: 376762 - DNA, 16 bp, M. musculus
cactgtagctgttcag

SEQ ID NO: 376763 - DNA, 16 bp, M. musculus
cactgtagctttcttc

SEQ ID NO: 376764 - DNA, 16 bp, M. musculus
cactgtcactgttcct

SEQ ID NO: 376765 - DNA, 16 bp, M. musculus
cactgtcagtaagaca

SEQ ID NO: 376766 - DNA, 16 bp, M. musculus
cactgtcattctcttc

SEQ ID NO: 376767 - DNA, 16 bp, M. musculus
cactgtccccagagga

SEQ ID NO: 376768 - DNA, 16 bp, M. musculus
cactgtccttcctgca

SEQ ID NO: 376769 - DNA, 16 bp, M. musculus
cactgtctctctcttt

SEQ ID NO: 376770 - DNA, 16 bp, M. musculus
cactgtcttaaatgat

SEQ ID NO: 376771 - DNA, 16 bp, M. musculus
cactgtcttttttcca

SEQ ID NO: 376772 - DNA, 16 bp, M. musculus
cactgtgaaaatcagt

SEQ ID NO: 376773 - DNA, 16 bp, M. musculus
cactgtgaaccccaag

SEQ ID NO: 376774 - DNA, 16 bp, M. musculus
cactgtgacacacaca

SEQ ID NO: 376775 - DNA, 16 bp, M. musculus
cactgtgacaccacag

SEQ ID NO: 376776 - DNA, 16 bp, M. musculus
cactgtgacattttca

SEQ ID NO: 376777 - DNA, 16 bp, M. musculus
cactgtgaccaaggta

SEQ ID NO: 376778 - DNA, 16 bp, M. musculus
cactgtgagtggtgcc

SEQ ID NO: 376779 - DNA, 16 bp, M. musculus
cactgtgcacacacat

SEQ ID NO: 376780 - DNA, 16 bp, M. musculus
cactgtgcagaggatg

SEQ ID NO: 376781 - DNA, 17 bp, M. musculus
cactgtgccaagcctca

SEQ ID NO: 376782 - DNA, 16 bp, M. musculus
cactgtgccccttctt

SEQ ID NO: 376783 - DNA, 16 bp, M. musculus
cactgtgctctgtcca

SEQ ID NO: 376784 - DNA, 16 bp, M. musculus
cactgtggaaatcagt

SEQ ID NO: 376785 - DNA, 16 bp, M. musculus
cactgtggaagaggag

SEQ ID NO: 376786 - DNA, 16 bp, M. musculus
cactgtggactgtgag

SEQ ID NO: 376787 - DNA, 16 bp, M. musculus
cactgtggccaaggca

SEQ ID NO: 376788 - DNA, 16 bp, M. musculus
cactgtggctgtgcag

SEQ ID NO: 376789 - DNA, 16 bp, M. musculus
cactgtgggcatgagc

SEQ ID NO: 376790 - DNA, 16 bp, M. musculus
cactgtgggcggtgct

SEQ ID NO: 376791 - DNA, 16 bp, M. musculus
cactgtgggtggcact

SEQ ID NO: 376792 - DNA, 16 bp, M. musculus
cactgtgggtgtggcc

SEQ ID NO: 376793 - DNA, 16 bp, M. musculus
cactgtgggttccagg

SEQ ID NO: 376794 - DNA, 16 bp, M. musculus
cactgtggtaaagcct

SEQ ID NO: 376795 - DNA, 16 bp, M. musculus
cactgtggttttaatt

SEQ ID NO: 376796 - DNA, 16 bp, M. musculus
cactgtgtagatgtgt

SEQ ID NO: 376797 - DNA, 16 bp, M. musculus
cactgtgtagccaaga

SEQ ID NO: 376798 - DNA, 16 bp, M. musculus
cactgtgtagcccaag

SEQ ID NO: 376799 - DNA, 16 bp, M. musculus
cactgtgtagcccttg

SEQ ID NO: 376800 - DNA, 16 bp, M. musculus
cactgtgtagtcttgg

SEQ ID NO: 376801 - DNA, 16 bp, M. musculus
cactgtgtccatgttt

SEQ ID NO: 376802 - DNA, 16 bp, M. musculus
cactgtgtctcctttc

SEQ ID NO: 376803 - DNA, 16 bp, M. musculus
cactgtgtggctgctg

SEQ ID NO: 376804 - DNA, 16 bp, M. musculus
cactgtgtgggtcctg

SEQ ID NO: 376805 - DNA, 16 bp, M. musculus
cactgtgtggttgctg

SEQ ID NO: 376806 - DNA, 16 bp, M. musculus
cactgtgtgtgtgtgt

SEQ ID NO: 376807 - DNA, 16 bp, M. musculus
cactgttcctcaagat

SEQ ID NO: 376808 - DNA, 16 bp, M. musculus
cactgttgctcttcct

SEQ ID NO: 376809 - DNA, 16 bp, M. musculus
cactgttgctcttgca

SEQ ID NO: 376810 - DNA, 19 bp, M. musculus
cactgttgctgtcttcaga

SEQ ID NO: 376811 - DNA, 16 bp, M. musculus
cactgttggtcttcca

SEQ ID NO: 376812 - DNA, 16 bp, M. musculus
cactgttgtgaatgcc

SEQ ID NO: 376813 - DNA, 16 bp, M. musculus
cactgtttaaaaaaaa

SEQ ID NO: 376814 - DNA, 16 bp, M. musculus
cactgtttctggtttt

SEQ ID NO: 376815 - DNA, 16 bp, M. musculus
cactgtttgagaagga

SEQ ID NO: 376816 - DNA, 16 bp, M. musculus
cactgtttgcagatga

SEQ ID NO: 376817 - DNA, 16 bp, M. musculus
cactgtttttctgttt

SEQ ID NO: 376818 - DNA, 16 bp, M. musculus
cactgttttttgtttg

SEQ ID NO: 376819 - DNA, 16 bp, M. musculus
cacttaaaaatattta

SEQ ID NO: 376820 - DNA, 16 bp, M. musculus
cacttaataaatattt

SEQ ID NO: 376821 - DNA, 16 bp, M. musculus
cacttacacacacaca

SEQ ID NO: 376822 - DNA, 16 bp, M. musculus
cacttacatggtggct

SEQ ID NO: 376823 - DNA, 16 bp, M. musculus
cacttagaagacagag

SEQ ID NO: 376824 - DNA, 16 bp, M. musculus
cacttagacttgagga

SEQ ID NO: 376825 - DNA, 16 bp, M. musculus
cacttataaatgagta

SEQ ID NO: 376826 - DNA, 16 bp, M. musculus
cacttatcagtcagtg

SEQ ID NO: 376827 - DNA, 16 bp, M. musculus
cacttatgaagtagca

SEQ ID NO: 376828 - DNA, 16 bp, M. musculus
cacttatgcatgcaca

SEQ ID NO: 376829 - DNA, 16 bp, M. musculus
cacttattcatttatt

SEQ ID NO: 376830 - DNA, 16 bp, M. musculus
cacttcaccaggcacg

SEQ ID NO: 376831 - DNA, 16 bp, M. musculus
cacttcagtattcatt

SEQ ID NO: 376832 - DNA, 34 bp, M. musculus
cacttcatcttccagattactgtaggtaacttga

SEQ ID NO: 376833 - DNA, 16 bp, M. musculus
cacttccacaatgctg

SEQ ID NO: 376834 - DNA, 16 bp, M. musculus
cacttccactttgctg

SEQ ID NO: 376835 - DNA, 16 bp, M. musculus
cacttccatattgctg

SEQ ID NO: 376836 - DNA, 16 bp, M. musculus
cacttcccaaatgctg

SEQ ID NO: 376837 - DNA, 16 bp, M. musculus
cacttcccagaagact

SEQ ID NO: 376838 - DNA, 16 bp, M. musculus
cacttcccagaagatg

SEQ ID NO: 376839 - DNA, 16 bp, M. musculus
cacttcccagatttca

SEQ ID NO: 376840 - DNA, 16 bp, M. musculus
cacttcccagcaccca

SEQ ID NO: 376841 - DNA, 16 bp, M. musculus
cacttcccaggactgt

SEQ ID NO: 376842 - DNA, 16 bp, M. musculus
cacttcctaacctcca

SEQ ID NO: 376843 - DNA, 16 bp, M. musculus
cacttcctagaaaaag

SEQ ID NO: 376844 - DNA, 16 bp, M. musculus
cacttcctccaagaag

SEQ ID NO: 376845 - DNA, 16 bp, M. musculus
cacttcctccaggaag

SEQ ID NO: 376846 - DNA, 16 bp, M. musculus
cacttcctcccacaag

SEQ ID NO: 376847 - DNA, 16 bp, M. musculus
cacttcctcttccact

SEQ ID NO: 376848 - DNA, 16 bp, M. musculus
cacttcctgctcttgc

SEQ ID NO: 376849 - DNA, 16 bp, M. musculus
cacttcctggccctgt

SEQ ID NO: 376850 - DNA, 16 bp, M. musculus
cacttcctggctctgg

SEQ ID NO: 376851 - DNA, 16 bp, M. musculus
cacttcctgtctgctc

SEQ ID NO: 376852 - DNA, 16 bp, M. musculus
cacttcctgttcactc

SEQ ID NO: 376853 - DNA, 16 bp, M. musculus
cacttccttcaacaag

SEQ ID NO: 376854 - DNA, 16 bp, M. musculus
cacttccttgggactc

SEQ ID NO: 376855 - DNA, 16 bp, M. musculus
cacttctaagaggaaa

SEQ ID NO: 376856 - DNA, 16 bp, M. musculus
cacttctcatgacaat

SEQ ID NO: 376857 - DNA, 16 bp, M. musculus
cacttctgagagggtg

SEQ ID NO: 376858 - DNA, 16 bp, M. musculus
cacttctgcctcccca

SEQ ID NO: 376859 - DNA, 16 bp, M. musculus
cacttctgcctgtccc

SEQ ID NO: 376860 - DNA, 16 bp, M. musculus
cacttctgtgtttacc

SEQ ID NO: 376861 - DNA, 16 bp, M. musculus
cacttcttcctcctgg

SEQ ID NO: 376862 - DNA, 16 bp, M. musculus
cacttcttggccctga

SEQ ID NO: 376863 - DNA, 16 bp, M. musculus
cacttcttggccctgg

SEQ ID NO: 376864 - DNA, 16 bp, M. musculus
cacttgacctttgaca

SEQ ID NO: 376865 - DNA, 16 bp, M. musculus
cacttgagaggctgag

SEQ ID NO: 376866 - DNA, 16 bp, M. musculus
cacttgatgctctgtc

SEQ ID NO: 376867 - DNA, 16 bp, M. musculus
cacttgcaaggcaagc

SEQ ID NO: 376868 - DNA, 16 bp, M. musculus
cacttgcacacacaaa

SEQ ID NO: 376869 - DNA, 16 bp, M. musculus
cacttgcagagcctct

SEQ ID NO: 376870 - DNA, 16 bp, M. musculus
cacttgcctagggatg

SEQ ID NO: 376871 - DNA, 16 bp, M. musculus
cacttgccttttgcca

SEQ ID NO: 376872 - DNA, 16 bp, M. musculus
cacttgctatgtagac

SEQ ID NO: 376873 - DNA, 16 bp, M. musculus
cacttgctgcccttgc

SEQ ID NO: 376874 - DNA, 16 bp, M. musculus
cacttgctgctcttgc

SEQ ID NO: 376875 - DNA, 16 bp, M. musculus
cacttgcttagcatgt

SEQ ID NO: 376876 - DNA, 16 bp, M. musculus
cacttggaaggtggag

SEQ ID NO: 376877 - DNA, 16 bp, M. musculus
cacttggagggcagag

SEQ ID NO: 376878 - DNA, 16 bp, M. musculus
cacttggaggtgaaat

SEQ ID NO: 376879 - DNA, 16 bp, M. musculus
cacttggaggtggagg

SEQ ID NO: 376880 - DNA, 16 bp, M. musculus
cacttggatgatttca

SEQ ID NO: 376881 - DNA, 16 bp, M. musculus
cacttgggagacagac

SEQ ID NO: 376882 - DNA, 16 bp, M. musculus
cacttgggagagaaaa

SEQ ID NO: 376883 - DNA, 16 bp, M. musculus
cacttgggagagagaa

SEQ ID NO: 376884 - DNA, 16 bp, M. musculus
cacttgggaggcaggg

SEQ ID NO: 376885 - DNA, 16 bp, M. musculus
cacttgggccattcag

SEQ ID NO: 376886 - DNA, 16 bp, M. musculus
cacttgtaattccagc

SEQ ID NO: 376887 - DNA, 16 bp, M. musculus
cacttgtagtcccagc

SEQ ID NO: 376888 - DNA, 16 bp, M. musculus
cacttgtcaccaagcc

SEQ ID NO: 376889 - DNA, 16 bp, M. musculus
cacttgtgcacacaca

SEQ ID NO: 376890 - DNA, 16 bp, M. musculus
cacttgtggccattga

SEQ ID NO: 376891 - DNA, 16 bp, M. musculus
cacttgtgtgcacaca

SEQ ID NO: 376892 - DNA, 16 bp, M. musculus
cacttgttattctctt

SEQ ID NO: 376893 - DNA, 16 bp, M. musculus
cacttgttggcatcag

SEQ ID NO: 376894 - DNA, 16 bp, M. musculus
cacttgttggcatctg

SEQ ID NO: 376895 - DNA, 16 bp, M. musculus
cacttgtttggttgtg

SEQ ID NO: 376896 - DNA, 16 bp, M. musculus
cactttacagatgagg

SEQ ID NO: 376897 - DNA, 16 bp, M. musculus
cactttacatccctct

SEQ ID NO: 376898 - DNA, 16 bp, M. musculus
cactttacatcctaat

SEQ ID NO: 376899 - DNA, 16 bp, M. musculus
cactttacatcctgac

SEQ ID NO: 376900 - DNA, 16 bp, M. musculus
cactttctcagggcag

SEQ ID NO: 376901 - DNA, 16 bp, M. musculus
cactttctccagcaag

SEQ ID NO: 376902 - DNA, 16 bp, M. musculus
cactttctccctacat

SEQ ID NO: 376903 - DNA, 16 bp, M. musculus
cactttctctctgtct

SEQ ID NO: 376904 - DNA, 16 bp, M. musculus
cactttctggccctgg

SEQ ID NO: 376905 - DNA, 16 bp, M. musculus
cactttcttcaatgga

SEQ ID NO: 376906 - DNA, 16 bp, M. musculus
cactttcttcagtttt

SEQ ID NO: 376907 - DNA, 16 bp, M. musculus
cactttgaaggcagag

SEQ ID NO: 376908 - DNA, 16 bp, M. musculus
cactttgaccagttgt

SEQ ID NO: 376909 - DNA, 16 bp, M. musculus
cactttgacttcttcc

SEQ ID NO: 376910 - DNA, 16 bp, M. musculus
cactttgattttcctt

SEQ ID NO: 376911 - DNA, 16 bp, M. musculus
cactttgcatcctgat

SEQ ID NO: 376912 - DNA, 16 bp, M. musculus
cactttggaggcagaa

SEQ ID NO: 376913 - DNA, 16 bp, M. musculus
cactttggagggagaa

SEQ ID NO: 376914 - DNA, 16 bp, M. musculus
cactttggcctttctt

SEQ ID NO: 376915 - DNA, 16 bp, M. musculus
cactttgggcctgtag

SEQ ID NO: 376916 - DNA, 16 bp, M. musculus
cactttgggttttctt

SEQ ID NO: 376917 - DNA, 16 bp, M. musculus
cactttgtaaatcaat

SEQ ID NO: 376918 - DNA, 16 bp, M. musculus
cactttgtcatttgct

SEQ ID NO: 376919 - DNA, 16 bp, M. musculus
cactttgtggccctgg

SEQ ID NO: 376920 - DNA, 16 bp, M. musculus
cactttgtttccatat

SEQ ID NO: 376921 - DNA, 16 bp, M. musculus
cacttttaaaatattt

SEQ ID NO: 376922 - DNA, 16 bp, M. musculus
cacttttactttgaaa

SEQ ID NO: 376923 - DNA, 16 bp, M. musculus
cacttttcccttactg

SEQ ID NO: 376924 - DNA, 16 bp, M. musculus
cacttttctgtccctt

SEQ ID NO: 376925 - DNA, 16 bp, M. musculus
cacttttggccctggc

SEQ ID NO: 376926 - DNA, 16 bp, M. musculus
cactttttaaaaaaag

SEQ ID NO: 376927 - DNA, 16 bp, M. musculus
cactttttgcagatgg

SEQ ID NO: 376928 - DNA, 16 bp, M. musculus
cactttttggcactgg

SEQ ID NO: 376929 - DNA, 17 bp, M. musculus
cactttttggccctggt

SEQ ID NO: 376930 - DNA, 16 bp, M. musculus
cactttttgtccctgt

SEQ ID NO: 376931 - DNA, 16 bp, M. musculus
cactttttttttaatg

SEQ ID NO: 376932 - DNA, 16 bp, M. musculus
cacttttttttttgag

SEQ ID NO: 376933 - DNA, 16 bp, M. musculus
cagaaaaaaaaattct

SEQ ID NO: 376934 - DNA, 16 bp, M. musculus
cagaaaaaaatgttca

SEQ ID NO: 376935 - DNA, 16 bp, M. musculus
cagaaaaaaatgtttt

SEQ ID NO: 376936 - DNA, 16 bp, M. musculus
cagaaaaaagcatttg

SEQ ID NO: 376937 - DNA, 16 bp, M. musculus
cagaaaaacaaatact

SEQ ID NO: 376938 - DNA, 16 bp, M. musculus
cagaaaaataaatatt

SEQ ID NO: 376939 - DNA, 16 bp, M. musculus
cagaaaaatgctggag

SEQ ID NO: 376940 - DNA, 16 bp, M. musculus
cagaaaaatggagaaa

SEQ ID NO: 376941 - DNA, 16 bp, M. musculus
cagaaaaattctcaat

SEQ ID NO: 376942 - DNA, 16 bp, M. musculus
cagaaaacaaaggggt

SEQ ID NO: 376943 - DNA, 16 bp, M. musculus
cagaaaacaaggtgga

SEQ ID NO: 376944 - DNA, 16 bp, M. musculus
cagaaaacacttccca

SEQ ID NO: 376945 - DNA, 16 bp, M. musculus
cagaaaacagataatg

SEQ ID NO: 376946 - DNA, 16 bp, M. musculus
cagaaaacatcttggg

SEQ ID NO: 376947 - DNA, 16 bp, M. musculus
cagaaaacatgaaaat

SEQ ID NO: 376948 - DNA, 16 bp, M. musculus
cagaaaacattttaaa

SEQ ID NO: 376949 - DNA, 16 bp, M. musculus
cagaaaaccagagaca

SEQ ID NO: 376950 - DNA, 16 bp, M. musculus
cagaaaacccaagata

SEQ ID NO: 376951 - DNA, 16 bp, M. musculus
cagaaaacccagtctg

SEQ ID NO: 376952 - DNA, 16 bp, M. musculus
cagaaaacctacaaac

SEQ ID NO: 376953 - DNA, 16 bp, M. musculus
cagaaaactgaaaata

SEQ ID NO: 376954 - DNA, 16 bp, M. musculus
cagaaaagaaaattcc

SEQ ID NO: 376955 - DNA, 16 bp, M. musculus
cagaaaagaaagtctt

SEQ ID NO: 376956 - DNA, 16 bp, M. musculus
cagaaaagaaattact

SEQ ID NO: 376957 - DNA, 16 bp, M. musculus
cagaaaagacctttga

SEQ ID NO: 376958 - DNA, 16 bp, M. musculus
cagaaaagacttccca

SEQ ID NO: 376959 - DNA, 16 bp, M. musculus
cagaaaagaggaggcc

SEQ ID NO: 376960 - DNA, 16 bp, M. musculus
cagaaaagagggtcct

SEQ ID NO: 376961 - DNA, 16 bp, M. musculus
cagaaaaggaaactga

SEQ ID NO: 376962 - DNA, 16 bp, M. musculus
cagaaaaggcctttga

SEQ ID NO: 376963 - DNA, 16 bp, M. musculus
cagaaaagggcatcaa

SEQ ID NO: 376964 - DNA, 16 bp, M. musculus
cagaaaaggggaagcc

SEQ ID NO: 376965 - DNA, 16 bp, M. musculus
cagaaaataaaaatgt

SEQ ID NO: 376966 - DNA, 16 bp, M. musculus
cagaaaataaagtttt

SEQ ID NO: 376967 - DNA, 16 bp, M. musculus
cagaaaataatttcaa

SEQ ID NO: 376968 - DNA, 16 bp, M. musculus
cagaaaatatggcaca

SEQ ID NO: 376969 - DNA, 16 bp, M. musculus
cagaaaatatttccaa

SEQ ID NO: 376970 - DNA, 16 bp, M. musculus
cagaaaatattttcaa

SEQ ID NO: 376971 - DNA, 16 bp, M. musculus
cagaaaatatttttaa

SEQ ID NO: 376972 - DNA, 16 bp, M. musculus
cagaaaatccaagaca

SEQ ID NO: 376973 - DNA, 16 bp, M. musculus
cagaaaatctgcccaa

SEQ ID NO: 376974 - DNA, 16 bp, M. musculus
cagaaaatgaaataac

SEQ ID NO: 376975 - DNA, 16 bp, M. musculus
cagaaaatgaaccatt

SEQ ID NO: 376976 - DNA, 16 bp, M. musculus
cagaaaatgaagagat

SEQ ID NO: 376977 - DNA, 16 bp, M. musculus
cagaaaatgaaggaaa

SEQ ID NO: 376978 - DNA, 16 bp, M. musculus
cagaaaatggaaacaa

SEQ ID NO: 376979 - DNA, 16 bp, M. musculus
cagaaaatggaaagaa

SEQ ID NO: 376980 - DNA, 16 bp, M. musculus
cagaaaatgtggtttc

SEQ ID NO: 376981 - DNA, 16 bp, M. musculus
cagaaaattagaaata

SEQ ID NO: 376982 - DNA, 16 bp, M. musculus
cagaaaattgagaata

SEQ ID NO: 376983 - DNA, 16 bp, M. musculus
cagaaacaaaaccagg

SEQ ID NO: 376984 - DNA, 16 bp, M. musculus
cagaaacaacacagct

SEQ ID NO: 376985 - DNA, 16 bp, M. musculus
cagaaacaagacaagg

SEQ ID NO: 376986 - DNA, 16 bp, M. musculus
cagaaacaataaaatt

SEQ ID NO: 376987 - DNA, 16 bp, M. musculus
cagaaacacacagaga

SEQ ID NO: 376988 - DNA, 16 bp, M. musculus
cagaaacacacataca

SEQ ID NO: 376989 - DNA, 16 bp, M. musculus
cagaaacagaataccc

SEQ ID NO: 376990 - DNA, 16 bp, M. musculus
cagaaacagacacata

SEQ ID NO: 376991 - DNA, 16 bp, M. musculus
cagaaacagagagata

SEQ ID NO: 376992 - DNA, 16 bp, M. musculus
cagaaacagaggaaat

SEQ ID NO: 376993 - DNA, 16 bp, M. musculus
cagaaacagatgcaga

SEQ ID NO: 376994 - DNA, 16 bp, M. musculus
cagaaacagcaaggct

SEQ ID NO: 376995 - DNA, 16 bp, M. musculus
cagaaacaggagaatc

SEQ ID NO: 376996 - DNA, 16 bp, M. musculus
cagaaacataaaacac

SEQ ID NO: 376997 - DNA, 16 bp, M. musculus
cagaaacatcagaaag

SEQ ID NO: 376998 - DNA, 16 bp, M. musculus
cagaaaccaaacagag

SEQ ID NO: 376999 - DNA, 16 bp, M. musculus
cagaaaccaaggaaca

SEQ ID NO: 377000 - DNA, 16 bp, M. musculus
cagaaaccacagagct

SEQ ID NO: 377001 - DNA, 16 bp, M. musculus
cagaaaccatggagga

SEQ ID NO: 377002 - DNA, 19 bp, M. musculus
cagaaacccacctgcctct

SEQ ID NO: 377003 - DNA, 16 bp, M. musculus
cagaaaccctgcctca

SEQ ID NO: 377004 - DNA, 16 bp, M. musculus
cagaaaccctgtctca

SEQ ID NO: 377005 - DNA, 16 bp, M. musculus
cagaaacctggaggga

SEQ ID NO: 377006 - DNA, 16 bp, M. musculus
cagaaactaaacagaa

SEQ ID NO: 377007 - DNA, 16 bp, M. musculus
cagaaactcaaggcca

SEQ ID NO: 377008 - DNA, 16 bp, M. musculus
cagaaactctctgcag

SEQ ID NO: 377009 - DNA, 16 bp, M. musculus
cagaaactgaaacaga

SEQ ID NO: 377010 - DNA, 16 bp, M. musculus
cagaaactgaagaaaa

SEQ ID NO: 377011 - DNA, 16 bp, M. musculus
cagaaactgaagaaat

SEQ ID NO: 377012 - DNA, 16 bp, M. musculus
cagaaactgaagcaaa

SEQ ID NO: 377013 - DNA, 16 bp, M. musculus
cagaaactgaagcaga

SEQ ID NO: 377014 - DNA, 16 bp, M. musculus
cagaaactgaggaaaa

SEQ ID NO: 377015 - DNA, 16 bp, M. musculus
cagaaactgaggacat

SEQ ID NO: 377016 - DNA, 16 bp, M. musculus
cagaaactgaggcagg

SEQ ID NO: 377017 - DNA, 16 bp, M. musculus
cagaaactgatgcaga

SEQ ID NO: 377018 - DNA, 16 bp, M. musculus
cagaaactggaaacaa

SEQ ID NO: 377019 - DNA, 16 bp, M. musculus
cagaaactggaaagaa

SEQ ID NO: 377020 - DNA, 16 bp, M. musculus
cagaaactggaagcaa

SEQ ID NO: 377021 - DNA, 16 bp, M. musculus
cagaaactggggagac

SEQ ID NO: 377022 - DNA, 16 bp, M. musculus
cagaaacttctacttc

SEQ ID NO: 377023 - DNA, 16 bp, M. musculus
cagaaacttctggaaa

SEQ ID NO: 377024 - DNA, 16 bp, M. musculus
cagaaagaaaggctgg

SEQ ID NO: 377025 - DNA, 16 bp, M. musculus
cagaaagaaatagcaa

SEQ ID NO: 377026 - DNA, 16 bp, M. musculus
cagaaagaaatcaaag

SEQ ID NO: 377027 - DNA, 16 bp, M. musculus
cagaaagaacccagat

SEQ ID NO: 377028 - DNA, 16 bp, M. musculus
cagaaagaactagaaa

SEQ ID NO: 377029 - DNA, 16 bp, M. musculus
cagaaagaactagaag

SEQ ID NO: 377030 - DNA, 16 bp, M. musculus
cagaaagaagaaaatg

SEQ ID NO: 377031 - DNA, 16 bp, M. musculus
cagaaagaagaaatga

SEQ ID NO: 377032 - DNA, 16 bp, M. musculus
cagaaagacagacaga

SEQ ID NO: 377033 - DNA, 16 bp, M. musculus
cagaaagacagagaca

SEQ ID NO: 377034 - DNA, 16 bp, M. musculus
cagaaagacatgcatg

SEQ ID NO: 377035 - DNA, 16 bp, M. musculus
cagaaagacccaataa

SEQ ID NO: 377036 - DNA, 16 bp, M. musculus
cagaaagacctagaaa

SEQ ID NO: 377037 - DNA, 16 bp, M. musculus
cagaaagagaaaaatg

SEQ ID NO: 377038 - DNA, 16 bp, M. musculus
cagaaagagacacaga

SEQ ID NO: 377039 - DNA, 16 bp, M. musculus
cagaaagagcacaaat

SEQ ID NO: 377040 - DNA, 16 bp, M. musculus
cagaaagagctagaaa

SEQ ID NO: 377041 - DNA, 16 bp, M. musculus
cagaaagagtcagaga

SEQ ID NO: 377042 - DNA, 16 bp, M. musculus
cagaaagatggagaga

SEQ ID NO: 377043 - DNA, 16 bp, M. musculus
cagaaagatggtaaga

SEQ ID NO: 377044 - DNA, 16 bp, M. musculus
cagaaagattataaga

SEQ ID NO: 377045 - DNA, 16 bp, M. musculus
cagaaagatttttttt

SEQ ID NO: 377046 - DNA, 16 bp, M. musculus
cagaaagcaaaggcag

SEQ ID NO: 377047 - DNA, 16 bp, M. musculus
cagaaagcagaagctg

SEQ ID NO: 377048 - DNA, 16 bp, M. musculus
cagaaagcagagagag

SEQ ID NO: 377049 - DNA, 16 bp, M. musculus
cagaaagcagagaggg

SEQ ID NO: 377050 - DNA, 16 bp, M. musculus
cagaaagcaggagatg

SEQ ID NO: 377051 - DNA, 16 bp, M. musculus
cagaaagcaggagttg

SEQ ID NO: 377052 - DNA, 16 bp, M. musculus
cagaaagcagtactct

SEQ ID NO: 377053 - DNA, 16 bp, M. musculus
cagaaagcagttggtt

SEQ ID NO: 377054 - DNA, 16 bp, M. musculus
cagaaagcatggcagc

SEQ ID NO: 377055 - DNA, 16 bp, M. musculus
cagaaagctagcagaa

SEQ ID NO: 377056 - DNA, 16 bp, M. musculus
cagaaagctgagacag

SEQ ID NO: 377057 - DNA, 16 bp, M. musculus
cagaaaggcagaaagg

SEQ ID NO: 377058 - DNA, 16 bp, M. musculus
cagaaaggcctcacct

SEQ ID NO: 377059 - DNA, 16 bp, M. musculus
cagaaaggctgcagct

SEQ ID NO: 377060 - DNA, 16 bp, M. musculus
cagaaaggctgtaaga

SEQ ID NO: 377061 - DNA, 16 bp, M. musculus
cagaaaggcttacagc

SEQ ID NO: 377062 - DNA, 16 bp, M. musculus
cagaaaggggcattgg

SEQ ID NO: 377063 - DNA, 16 bp, M. musculus
cagaaagggggaagtg

SEQ ID NO: 377064 - DNA, 16 bp, M. musculus
cagaaaggttgtaaga

SEQ ID NO: 377065 - DNA, 16 bp, M. musculus
cagaaagtaaacaact

SEQ ID NO: 377066 - DNA, 16 bp, M. musculus
cagaaagtagaagaaa

SEQ ID NO: 377067 - DNA, 16 bp, M. musculus
cagaaagtattttgat

SEQ ID NO: 377068 - DNA, 16 bp, M. musculus
cagaaagtcttttcct

SEQ ID NO: 377069 - DNA, 16 bp, M. musculus
cagaaagtgctaatct

SEQ ID NO: 377070 - DNA, 16 bp, M. musculus
cagaaagttccaggac

SEQ ID NO: 377071 - DNA, 16 bp, M. musculus
cagaaagttgtcttct

SEQ ID NO: 377072 - DNA, 16 bp, M. musculus
cagaaagtttattcaa

SEQ ID NO: 377073 - DNA, 16 bp, M. musculus
cagaaataaaatattt

SEQ ID NO: 377074 - DNA, 16 bp, M. musculus
cagaaataagcccaca

SEQ ID NO: 377075 - DNA, 16 bp, M. musculus
cagaaatacacacaca

SEQ ID NO: 377076 - DNA, 16 bp, M. musculus
cagaaatacctggttc

SEQ ID NO: 377077 - DNA, 16 bp, M. musculus
cagaaatagaggaaat

SEQ ID NO: 377078 - DNA, 16 bp, M. musculus
cagaaatattgaaatt

SEQ ID NO: 377079 - DNA, 16 bp, M. musculus
cagaaatcaaaaccac

SEQ ID NO: 377080 - DNA, 16 bp, M. musculus
cagaaatcaaaaggga

SEQ ID NO: 377081 - DNA, 16 bp, M. musculus
cagaaatcagcaccta

SEQ ID NO: 377082 - DNA, 16 bp, M. musculus
cagaaatccacatgcc

SEQ ID NO: 377083 - DNA, 17 bp, M. musculus
cagaaatccaccagcct

SEQ ID NO: 377084 - DNA, 16 bp, M. musculus
cagaaatccgactgcc

SEQ ID NO: 377085 - DNA, 16 bp, M. musculus
cagaaatctgcctgct

SEQ ID NO: 377086 - DNA, 16 bp, M. musculus
cagaaatgaaaccaga

SEQ ID NO: 377087 - DNA, 16 bp, M. musculus
cagaaatgaacccata

SEQ ID NO: 377088 - DNA, 16 bp, M. musculus
cagaaatgagagaaaa

SEQ ID NO: 377089 - DNA, 16 bp, M. musculus
cagaaatgcaaaggga

SEQ ID NO: 377090 - DNA, 16 bp, M. musculus
cagaaatgcaaatcaa

SEQ ID NO: 377091 - DNA, 16 bp, M. musculus
cagaaatgcaggtacc

SEQ ID NO: 377092 - DNA, 16 bp, M. musculus
cagaaatgccaaaaag

SEQ ID NO: 377093 - DNA, 16 bp, M. musculus
cagaaatggaaggaaa

SEQ ID NO: 377094 - DNA, 16 bp, M. musculus
cagaaatggccctgaa

SEQ ID NO: 377095 - DNA, 16 bp, M. musculus
cagaaattatgaacca

SEQ ID NO: 377096 - DNA, 16 bp, M. musculus
cagaaattggaaatag

SEQ ID NO: 377097 - DNA, 16 bp, M. musculus
cagaaattggaagcaa

SEQ ID NO: 377098 - DNA, 16 bp, M. musculus
cagaaattgggcagga

SEQ ID NO: 377099 - DNA, 16 bp, M. musculus
cagaaattgttggaaa

SEQ ID NO: 377100 - DNA, 16 bp, M. musculus
cagaaatttgatatct

SEQ ID NO: 377101 - DNA, 16 bp, M. musculus
cagaacaaaaccaaat

SEQ ID NO: 377102 - DNA, 16 bp, M. musculus
cagaacaaagaattct

SEQ ID NO: 377103 - DNA, 16 bp, M. musculus
cagaacaacaaccctc

SEQ ID NO: 377104 - DNA, 16 bp, M. musculus
cagaacaaccagagct

SEQ ID NO: 377105 - DNA, 16 bp, M. musculus
cagaacaagatgtaga

SEQ ID NO: 377106 - DNA, 16 bp, M. musculus
cagaacaagatgttga

SEQ ID NO: 377107 - DNA, 16 bp, M. musculus
cagaacaagccagaaa

SEQ ID NO: 377108 - DNA, 16 bp, M. musculus
cagaacaagttccaag

SEQ ID NO: 377109 - DNA, 16 bp, M. musculus
cagaacaattagacaa

SEQ ID NO: 377110 - DNA, 16 bp, M. musculus
cagaacacaagagatg

SEQ ID NO: 377111 - DNA, 16 bp, M. musculus
cagaacaccaatggca

SEQ ID NO: 377112 - DNA, 16 bp, M. musculus
cagaacagaacagaac

SEQ ID NO: 377113 - DNA, 16 bp, M. musculus
cagaacagtcaaggct

SEQ ID NO: 377114 - DNA, 16 bp, M. musculus
cagaacatagacagag

SEQ ID NO: 377115 - DNA, 16 bp, M. musculus
cagaacatcaagatca

SEQ ID NO: 377116 - DNA, 16 bp, M. musculus
cagaacattactttct

SEQ ID NO: 377117 - DNA, 16 bp, M. musculus
cagaacattctggaaa

SEQ ID NO: 377118 - DNA, 16 bp, M. musculus
cagaaccaagaagtgg

SEQ ID NO: 377119 - DNA, 16 bp, M. musculus
cagaaccaagatgtct

SEQ ID NO: 377120 - DNA, 16 bp, M. musculus
cagaaccaagttctcc

SEQ ID NO: 377121 - DNA, 16 bp, M. musculus
cagaaccagggcctgc

SEQ ID NO: 377122 - DNA, 16 bp, M. musculus
cagaaccatcaggaca

SEQ ID NO: 377123 - DNA, 16 bp, M. musculus
cagaacccacaaggca

SEQ ID NO: 377124 - DNA, 16 bp, M. musculus
cagaacccacacagca

SEQ ID NO: 377125 - DNA, 16 bp, M. musculus
cagaacccacactggg

SEQ ID NO: 377126 - DNA, 16 bp, M. musculus
cagaacccagcactct

SEQ ID NO: 377127 - DNA, 16 bp, M. musculus
cagaacccatgtgaag

SEQ ID NO: 377128 - DNA, 16 bp, M. musculus
cagaaccccccagagc

SEQ ID NO: 377129 - DNA, 16 bp, M. musculus
cagaaccccttgaatg

SEQ ID NO: 377130 - DNA, 16 bp, M. musculus
cagaacctaaggaaat

SEQ ID NO: 377131 - DNA, 16 bp, M. musculus
cagaacctccagaaga

SEQ ID NO: 377132 - DNA, 16 bp, M. musculus
cagaacctctggaaga

SEQ ID NO: 377133 - DNA, 16 bp, M. musculus
cagaactcaaagggag

SEQ ID NO: 377134 - DNA, 16 bp, M. musculus
cagaactcaacaaaaa

SEQ ID NO: 377135 - DNA, 16 bp, M. musculus
cagaactcacataaaa

SEQ ID NO: 377136 - DNA, 16 bp, M. musculus
cagaactcagaaagaa

SEQ ID NO: 377137 - DNA, 16 bp, M. musculus
cagaactcaggagtca

SEQ ID NO: 377138 - DNA, 16 bp, M. musculus
cagaactccacctgcc

SEQ ID NO: 377139 - DNA, 16 bp, M. musculus
cagaactccctagtga

SEQ ID NO: 377140 - DNA, 16 bp, M. musculus
cagaactctcagttcc

SEQ ID NO: 377141 - DNA, 16 bp, M. musculus
cagaactctgaactca

SEQ ID NO: 377142 - DNA, 16 bp, M. musculus
cagaactctggaggca

SEQ ID NO: 377143 - DNA, 16 bp, M. musculus
cagaactctgtgagtt

SEQ ID NO: 377144 - DNA, 16 bp, M. musculus
cagaactgaaaagaga

SEQ ID NO: 377145 - DNA, 16 bp, M. musculus
cagaactgctcctgtc

SEQ ID NO: 377146 - DNA, 17 bp, M. musculus
cagaactggcactgctt

SEQ ID NO: 377147 - DNA, 16 bp, M. musculus
cagaactgggacctga

SEQ ID NO: 377148 - DNA, 16 bp, M. musculus
cagaactgtctgaagg

SEQ ID NO: 377149 - DNA, 16 bp, M. musculus
cagaactgtgggtcac

SEQ ID NO: 377150 - DNA, 16 bp, M. musculus
cagaacttgaaggagc

SEQ ID NO: 377151 - DNA, 16 bp, M. musculus
cagaactttctgcagt

SEQ ID NO: 377152 - DNA, 16 bp, M. musculus
cagaactttgtctctg

SEQ ID NO: 377153 - DNA, 22 bp, M. musculus
cagaacttttcagctggggaac

SEQ ID NO: 377154 - DNA, 16 bp, M. musculus
cagaagaaaaagagcc

SEQ ID NO: 377155 - DNA, 16 bp, M. musculus
cagaagaaaacttccc

SEQ ID NO: 377156 - DNA, 16 bp, M. musculus
cagaagaaaatcaaga

SEQ ID NO: 377157 - DNA, 16 bp, M. musculus
cagaagaaaatgagaa

SEQ ID NO: 377158 - DNA, 16 bp, M. musculus
cagaagaaactgcaag

SEQ ID NO: 377159 - DNA, 16 bp, M. musculus
cagaagaaagaatgga

SEQ ID NO: 377160 - DNA, 16 bp, M. musculus
cagaagaaagcattta

SEQ ID NO: 377161 - DNA, 16 bp, M. musculus
cagaagaacaaatgca

SEQ ID NO: 377162 - DNA, 16 bp, M. musculus
cagaagaagcaagcca

SEQ ID NO: 377163 - DNA, 16 bp, M. musculus
cagaagaagccatcag

SEQ ID NO: 377164 - DNA, 16 bp, M. musculus
cagaagaagctgaccc

SEQ ID NO: 377165 - DNA, 16 bp, M. musculus
cagaagaaggcaacag

SEQ ID NO: 377166 - DNA, 16 bp, M. musculus
cagaagaaggcactgg

SEQ ID NO: 377167 - DNA, 16 bp, M. musculus
cagaagaaggtgtcag

SEQ ID NO: 377168 - DNA, 16 bp, M. musculus
cagaagaaggtgttga

SEQ ID NO: 377169 - DNA, 16 bp, M. musculus
cagaagaaggtgttgg

SEQ ID NO: 377170 - DNA, 16 bp, M. musculus
cagaagaatcacaagt

SEQ ID NO: 377171 - DNA, 16 bp, M. musculus
cagaagaattaataaa

SEQ ID NO: 377172 - DNA, 16 bp, M. musculus
cagaagacaacttgga

SEQ ID NO: 377173 - DNA, 16 bp, M. musculus
cagaagacactatttc

SEQ ID NO: 377174 - DNA, 16 bp, M. musculus
cagaagacagaagagg

SEQ ID NO: 377175 - DNA, 16 bp, M. musculus
cagaagacagaggcag

SEQ ID NO: 377176 - DNA, 16 bp, M. musculus
cagaagacagaggcct

SEQ ID NO: 377177 - DNA, 16 bp, M. musculus
cagaagacagcatcag

SEQ ID NO: 377178 - DNA, 16 bp, M. musculus
cagaagacagctacag

SEQ ID NO: 377179 - DNA, 16 bp, M. musculus
cagaagacagcttgca

SEQ ID NO: 377180 - DNA, 16 bp, M. musculus
cagaagacccaggctc

SEQ ID NO: 377181 - DNA, 16 bp, M. musculus
cagaagacctgggaga

SEQ ID NO: 377182 - DNA, 16 bp, M. musculus
cagaagacctgggttt

SEQ ID NO: 377183 - DNA, 16 bp, M. musculus
cagaagactctccaca

SEQ ID NO: 377184 - DNA, 16 bp, M. musculus
cagaagactgcctggt

SEQ ID NO: 377185 - DNA, 16 bp, M. musculus
cagaagactgtggatg

SEQ ID NO: 377186 - DNA, 16 bp, M. musculus
cagaagagaaaatgaa

SEQ ID NO: 377187 - DNA, 16 bp, M. musculus
cagaagagaaagtcag

SEQ ID NO: 377188 - DNA, 16 bp, M. musculus
cagaagagaagcccag

SEQ ID NO: 377189 - DNA, 16 bp, M. musculus
cagaagagacctgact

SEQ ID NO: 377190 - DNA, 16 bp, M. musculus
cagaagagactttaaa

SEQ ID NO: 377191 - DNA, 16 bp, M. musculus
cagaagagagcactgg

SEQ ID NO: 377192 - DNA, 16 bp, M. musculus
cagaagagagcagcag

SEQ ID NO: 377193 - DNA, 16 bp, M. musculus
cagaagagagcattgg

SEQ ID NO: 377194 - DNA, 16 bp, M. musculus
cagaagagagtgaaga

SEQ ID NO: 377195 - DNA, 16 bp, M. musculus
cagaagagcagttggc

SEQ ID NO: 377196 - DNA, 16 bp, M. musculus
cagaagagcatggaca

SEQ ID NO: 377197 - DNA, 16 bp, M. musculus
cagaagagctgagaat

SEQ ID NO: 377198 - DNA, 16 bp, M. musculus
cagaagaggaaactga

SEQ ID NO: 377199 - DNA, 16 bp, M. musculus
cagaagaggaagcaga

SEQ ID NO: 377200 - DNA, 16 bp, M. musculus
cagaagaggaagtgga

SEQ ID NO: 377201 - DNA, 16 bp, M. musculus
cagaagaggacagcag

SEQ ID NO: 377202 - DNA, 16 bp, M. musculus
cagaagaggacatcag

SEQ ID NO: 377203 - DNA, 16 bp, M. musculus
cagaagaggacctcag

SEQ ID NO: 377204 - DNA, 16 bp, M. musculus
cagaagaggaggtgga

SEQ ID NO: 377205 - DNA, 16 bp, M. musculus
cagaagaggatgctgg

SEQ ID NO: 377206 - DNA, 16 bp, M. musculus
cagaagaggatgtctg

SEQ ID NO: 377207 - DNA, 16 bp, M. musculus
cagaagaggccactgg

SEQ ID NO: 377208 - DNA, 16 bp, M. musculus
cagaagaggccatcag

SEQ ID NO: 377209 - DNA, 16 bp, M. musculus
cagaagagggaatcaa

SEQ ID NO: 377210 - DNA, 16 bp, M. musculus
cagaagagggcacaga

SEQ ID NO: 377211 - DNA, 16 bp, M. musculus
cagaagagggcaccag

SEQ ID NO: 377212 - DNA, 16 bp, M. musculus
cagaagagggcaccgg

SEQ ID NO: 377213 - DNA, 16 bp, M. musculus
cagaagagggcactgg

SEQ ID NO: 377214 - DNA, 16 bp, M. musculus
cagaagagggcagcag

SEQ ID NO: 377215 - DNA, 17 bp, M. musculus
cagaagagggcatcaga

SEQ ID NO: 377216 - DNA, 16 bp, M. musculus
cagaagagggcattag

SEQ ID NO: 377217 - DNA, 16 bp, M. musculus
cagaagagggcattgg

SEQ ID NO: 377218 - DNA, 16 bp, M. musculus
cagaagagggcctcag

SEQ ID NO: 377219 - DNA, 16 bp, M. musculus
cagaagagggccttgg

SEQ ID NO: 377220 - DNA, 18 bp, M. musculus
cagaagagggcgtcagat

SEQ ID NO: 377221 - DNA, 16 bp, M. musculus
cagaagagggctttgg

SEQ ID NO: 377222 - DNA, 16 bp, M. musculus
cagaagagggtactgg

SEQ ID NO: 377223 - DNA, 16 bp, M. musculus
cagaagagggtattgg

SEQ ID NO: 377224 - DNA, 16 bp, M. musculus
cagaagagggtgctga

SEQ ID NO: 377225 - DNA, 16 bp, M. musculus
cagaagagggtgtcag

SEQ ID NO: 377226 - DNA, 16 bp, M. musculus
cagaagagggtgttgg

SEQ ID NO: 377227 - DNA, 16 bp, M. musculus
cagaagaggtcatcag

SEQ ID NO: 377228 - DNA, 16 bp, M. musculus
cagaagaggttgtcag

SEQ ID NO: 377229 - DNA, 16 bp, M. musculus
cagaagagtgcatcag

SEQ ID NO: 377230 - DNA, 16 bp, M. musculus
cagaagatactggaca

SEQ ID NO: 377231 - DNA, 16 bp, M. musculus
cagaagatagaaagaa

SEQ ID NO: 377232 - DNA, 16 bp, M. musculus
cagaagatccagctat

SEQ ID NO: 377233 - DNA, 16 bp, M. musculus
cagaagatccattcag

SEQ ID NO: 377234 - DNA, 16 bp, M. musculus
cagaagatcctgagca

SEQ ID NO: 377235 - DNA, 16 bp, M. musculus
cagaagatctgacacc

SEQ ID NO: 377236 - DNA, 16 bp, M. musculus
cagaagatgaaaagtt

SEQ ID NO: 377237 - DNA, 16 bp, M. musculus
cagaagatgaaggccg

SEQ ID NO: 377238 - DNA, 16 bp, M. musculus
cagaagatgcaaagat

SEQ ID NO: 377239 - DNA, 16 bp, M. musculus
cagaagatgctccaaa

SEQ ID NO: 377240 - DNA, 16 bp, M. musculus
cagaagatgctggaga

SEQ ID NO: 377241 - DNA, 16 bp, M. musculus
cagaagatggaaagac

SEQ ID NO: 377242 - DNA, 16 bp, M. musculus
cagaagatggaagcct

SEQ ID NO: 377243 - DNA, 16 bp, M. musculus
cagaagatggcatcag

SEQ ID NO: 377244 - DNA, 16 bp, M. musculus
cagaagatggccaagt

SEQ ID NO: 377245 - DNA, 16 bp, M. musculus
cagaagatggcctagt

SEQ ID NO: 377246 - DNA, 16 bp, M. musculus
cagaagatgggaagat

SEQ ID NO: 377247 - DNA, 16 bp, M. musculus
cagaagatgtggccca

SEQ ID NO: 377248 - DNA, 16 bp, M. musculus
cagaagatgttaaaac

SEQ ID NO: 377249 - DNA, 16 bp, M. musculus
cagaagatgttccaat

SEQ ID NO: 377250 - DNA, 16 bp, M. musculus
cagaagattccacaga

SEQ ID NO: 377251 - DNA, 16 bp, M. musculus
cagaagcaaagggaag

SEQ ID NO: 377252 - DNA, 16 bp, M. musculus
cagaagcaacactgct

SEQ ID NO: 377253 - DNA, 16 bp, M. musculus
cagaagcaacagaaag

SEQ ID NO: 377254 - DNA, 16 bp, M. musculus
cagaagcaacttaagg

SEQ ID NO: 377255 - DNA, 16 bp, M. musculus
cagaagcaatagaaac

SEQ ID NO: 377256 - DNA, 16 bp, M. musculus
cagaagcacaagccca

SEQ ID NO: 377257 - DNA, 16 bp, M. musculus
cagaagcacagagccg

SEQ ID NO: 377258 - DNA, 16 bp, M. musculus
cagaagcacatggctt

SEQ ID NO: 377259 - DNA, 16 bp, M. musculus
cagaagcaccagaaga

SEQ ID NO: 377260 - DNA, 16 bp, M. musculus
cagaagcagaaagcta

SEQ ID NO: 377261 - DNA, 16 bp, M. musculus
cagaagcagagaagag

SEQ ID NO: 377262 - DNA, 16 bp, M. musculus
cagaagcagatgcttg

SEQ ID NO: 377263 - DNA, 16 bp, M. musculus
cagaagcagcagaaac

SEQ ID NO: 377264 - DNA, 16 bp, M. musculus
cagaagcagccactgt

SEQ ID NO: 377265 - DNA, 16 bp, M. musculus
cagaagcaggaagatc

SEQ ID NO: 377266 - DNA, 16 bp, M. musculus
cagaagcaggaagctg

SEQ ID NO: 377267 - DNA, 16 bp, M. musculus
cagaagcaggagctga

SEQ ID NO: 377268 - DNA, 16 bp, M. musculus
cagaagcaggaggagg

SEQ ID NO: 377269 - DNA, 16 bp, M. musculus
cagaagccaaaaagca

SEQ ID NO: 377270 - DNA, 16 bp, M. musculus
cagaagccaaaagcaa

SEQ ID NO: 377271 - DNA, 16 bp, M. musculus
cagaagccaagaaaag

SEQ ID NO: 377272 - DNA, 16 bp, M. musculus
cagaagccacacagct

SEQ ID NO: 377273 - DNA, 16 bp, M. musculus
cagaagccacagaaaa

SEQ ID NO: 377274 - DNA, 16 bp, M. musculus
cagaagccacagagga

SEQ ID NO: 377275 - DNA, 16 bp, M. musculus
cagaagccacagctgg

SEQ ID NO: 377276 - DNA, 16 bp, M. musculus
cagaagccagaaagaa

SEQ ID NO: 377277 - DNA, 16 bp, M. musculus
cagaagccagaggaag

SEQ ID NO: 377278 - DNA, 16 bp, M. musculus
cagaagccagaggcct

SEQ ID NO: 377279 - DNA, 16 bp, M. musculus
cagaagccagaggctt

SEQ ID NO: 377280 - DNA, 16 bp, M. musculus
cagaagccagaggtct

SEQ ID NO: 377281 - DNA, 16 bp, M. musculus
cagaagccaggtgtgg

SEQ ID NO: 377282 - DNA, 16 bp, M. musculus
cagaagccatcaactg

SEQ ID NO: 377283 - DNA, 16 bp, M. musculus
cagaagccatggagaa

SEQ ID NO: 377284 - DNA, 16 bp, M. musculus
cagaagcctggaggca

SEQ ID NO: 377285 - DNA, 16 bp, M. musculus
cagaagcctttgtttc

SEQ ID NO: 377286 - DNA, 16 bp, M. musculus
cagaagctcaagccag

SEQ ID NO: 377287 - DNA, 16 bp, M. musculus
cagaagctcaaggtca

SEQ ID NO: 377288 - DNA, 16 bp, M. musculus
cagaagctcagaatac

SEQ ID NO: 377289 - DNA, 16 bp, M. musculus
cagaagctcagagaag

SEQ ID NO: 377290 - DNA, 16 bp, M. musculus
cagaagctgaagcaga

SEQ ID NO: 377291 - DNA, 16 bp, M. musculus
cagaagctgaaggaaa

SEQ ID NO: 377292 - DNA, 16 bp, M. musculus
cagaagctgagagaag

SEQ ID NO: 377293 - DNA, 16 bp, M. musculus
cagaagctgatgcaga

SEQ ID NO: 377294 - DNA, 16 bp, M. musculus
cagaagctgccctgcc

SEQ ID NO: 377295 - DNA, 16 bp, M. musculus
cagaagctgctctgag

SEQ ID NO: 377296 - DNA, 16 bp, M. musculus
cagaagctgctgagcc

SEQ ID NO: 377297 - DNA, 16 bp, M. musculus
cagaagctgctggcct

SEQ ID NO: 377298 - DNA, 16 bp, M. musculus
cagaagctggaaacaa

SEQ ID NO: 377299 - DNA, 16 bp, M. musculus
cagaagctggaagagg

SEQ ID NO: 377300 - DNA, 16 bp, M. musculus
cagaagctggaagcaa

SEQ ID NO: 377301 - DNA, 16 bp, M. musculus
cagaagctggcagatc

SEQ ID NO: 377302 - DNA, 16 bp, M. musculus
cagaagctgtcagttt

SEQ ID NO: 377303 - DNA, 16 bp, M. musculus
cagaagctgtgtgtgt

SEQ ID NO: 377304 - DNA, 17 bp, M. musculus
cagaagctgtgttgctt

SEQ ID NO: 377305 - DNA, 18 bp, M. musculus
cagaagctgttaatttca

SEQ ID NO: 377306 - DNA, 16 bp, M. musculus
cagaagctgttccaac

SEQ ID NO: 377307 - DNA, 16 bp, M. musculus
cagaaggaaaaacttt

SEQ ID NO: 377308 - DNA, 16 bp, M. musculus
cagaaggaacactaca

SEQ ID NO: 377309 - DNA, 16 bp, M. musculus
cagaaggaagacagga

SEQ ID NO: 377310 - DNA, 16 bp, M. musculus
cagaaggaagaggcag

SEQ ID NO: 377311 - DNA, 16 bp, M. musculus
cagaaggaagcagaga

SEQ ID NO: 377312 - DNA, 16 bp, M. musculus
cagaaggaagggctct

SEQ ID NO: 377313 - DNA, 16 bp, M. musculus
cagaaggacagaagga

SEQ ID NO: 377314 - DNA, 16 bp, M. musculus
cagaaggaccaggagt

SEQ ID NO: 377315 - DNA, 16 bp, M. musculus
cagaaggagagaacag

SEQ ID NO: 377316 - DNA, 16 bp, M. musculus
cagaaggagagaactg

SEQ ID NO: 377317 - DNA, 16 bp, M. musculus
cagaaggagatcaagg

SEQ ID NO: 377318 - DNA, 16 bp, M. musculus
cagaaggagcaggcag

SEQ ID NO: 377319 - DNA, 16 bp, M. musculus
cagaaggatcagaagt

SEQ ID NO: 377320 - DNA, 16 bp, M. musculus
cagaaggatcctgtag

SEQ ID NO: 377321 - DNA, 16 bp, M. musculus
cagaaggcagaaacag

SEQ ID NO: 377322 - DNA, 16 bp, M. musculus
cagaaggcagaagcag

SEQ ID NO: 377323 - DNA, 16 bp, M. musculus
cagaaggcagagacag

SEQ ID NO: 377324 - DNA, 16 bp, M. musculus
cagaaggcagagactg

SEQ ID NO: 377325 - DNA, 16 bp, M. musculus
cagaaggcagagagag

SEQ ID NO: 377326 - DNA, 16 bp, M. musculus
cagaaggcagagctga

SEQ ID NO: 377327 - DNA, 16 bp, M. musculus
cagaaggcagaggaaa

SEQ ID NO: 377328 - DNA, 16 bp, M. musculus
cagaaggcagaggaag

SEQ ID NO: 377329 - DNA, 16 bp, M. musculus
cagaaggcaggagctg

SEQ ID NO: 377330 - DNA, 16 bp, M. musculus
cagaaggccatcctgt

SEQ ID NO: 377331 - DNA, 16 bp, M. musculus
cagaaggctccacccc

SEQ ID NO: 377332 - DNA, 16 bp, M. musculus
cagaaggctccaccct

SEQ ID NO: 377333 - DNA, 16 bp, M. musculus
cagaaggctggggcag

SEQ ID NO: 377334 - DNA, 16 bp, M. musculus
cagaagggaaaataaa

SEQ ID NO: 377335 - DNA, 16 bp, M. musculus
cagaagggcaggagat

SEQ ID NO: 377336 - DNA, 16 bp, M. musculus
cagaaggtcaggaaat

SEQ ID NO: 377337 - DNA, 16 bp, M. musculus
cagaaggtccaagaat

SEQ ID NO: 377338 - DNA, 16 bp, M. musculus
cagaaggtggagacag

SEQ ID NO: 377339 - DNA, 16 bp, M. musculus
cagaaggtgggagaga

SEQ ID NO: 377340 - DNA, 16 bp, M. musculus
cagaagtagatgatca

SEQ ID NO: 377341 - DNA, 16 bp, M. musculus
cagaagtcaatgctca

SEQ ID NO: 377342 - DNA, 16 bp, M. musculus
cagaagtcatgcagac

SEQ ID NO: 377343 - DNA, 16 bp, M. musculus
cagaagtcatggagga

SEQ ID NO: 377344 - DNA, 16 bp, M. musculus
cagaagtccaaggtca

SEQ ID NO: 377345 - DNA, 16 bp, M. musculus
cagaagtccttaaaga

SEQ ID NO: 377346 - DNA, 16 bp, M. musculus
cagaagtgactgagac

SEQ ID NO: 377347 - DNA, 16 bp, M. musculus
cagaagtgctgacaga

SEQ ID NO: 377348 - DNA, 16 bp, M. musculus
cagaagtggcagagca

SEQ ID NO: 377349 - DNA, 16 bp, M. musculus
cagaagtgggtgttca

SEQ ID NO: 377350 - DNA, 16 bp, M. musculus
cagaagttcaaggaca

SEQ ID NO: 377351 - DNA, 16 bp, M. musculus
cagaagttcaaggcca

SEQ ID NO: 377352 - DNA, 16 bp, M. musculus
cagaagttcaagggca

SEQ ID NO: 377353 - DNA, 16 bp, M. musculus
cagaagttcaaggtca

SEQ ID NO: 377354 - DNA, 16 bp, M. musculus
cagaagttcagtccat

SEQ ID NO: 377355 - DNA, 16 bp, M. musculus
cagaagttcatggtca

SEQ ID NO: 377356 - DNA, 16 bp, M. musculus
cagaagttggtaccag

SEQ ID NO: 377357 - DNA, 16 bp, M. musculus
cagaagttgttccaac

SEQ ID NO: 377358 - DNA, 17 bp, M. musculus
cagaagtttggacagtg

SEQ ID NO: 377359 - DNA, 16 bp, M. musculus
cagaagttttttgttt

SEQ ID NO: 377360 - DNA, 16 bp, M. musculus
cagaatacaaaattaa

SEQ ID NO: 377361 - DNA, 16 bp, M. musculus
cagaataccagaactg

SEQ ID NO: 377362 - DNA, 16 bp, M. musculus
cagaataccagtggct

SEQ ID NO: 377363 - DNA, 16 bp, M. musculus
cagaatagccagggct

SEQ ID NO: 377364 - DNA, 16 bp, M. musculus
cagaatatgcaatcaa

SEQ ID NO: 377365 - DNA, 16 bp, M. musculus
cagaatattaatattt

SEQ ID NO: 377366 - DNA, 16 bp, M. musculus
cagaatattttatttt

SEQ ID NO: 377367 - DNA, 16 bp, M. musculus
cagaatatttttttct

SEQ ID NO: 377368 - DNA, 16 bp, M. musculus
cagaatcacagagaaa

SEQ ID NO: 377369 - DNA, 16 bp, M. musculus
cagaatcagagacagc

SEQ ID NO: 377370 - DNA, 16 bp, M. musculus
cagaatcaggtgcctg

SEQ ID NO: 377371 - DNA, 16 bp, M. musculus
cagaatcagtaagctg

SEQ ID NO: 377372 - DNA, 16 bp, M. musculus
cagaatcatctctcca

SEQ ID NO: 377373 - DNA, 16 bp, M. musculus
cagaatcatgaaagga

SEQ ID NO: 377374 - DNA, 16 bp, M. musculus
cagaatccagttctcc

SEQ ID NO: 377375 - DNA, 16 bp, M. musculus
cagaatccatgtaaaa

SEQ ID NO: 377376 - DNA, 16 bp, M. musculus
cagaatcctgtcttgg

SEQ ID NO: 377377 - DNA, 16 bp, M. musculus
cagaatctagaaagaa

SEQ ID NO: 377378 - DNA, 16 bp, M. musculus
cagaatcttctgtggc

SEQ ID NO: 377379 - DNA, 16 bp, M. musculus
cagaatgaaagactgg

SEQ ID NO: 377380 - DNA, 16 bp, M. musculus
cagaatgaaccagaga

SEQ ID NO: 377381 - DNA, 16 bp, M. musculus
cagaatgagaaaagat

SEQ ID NO: 377382 - DNA, 16 bp, M. musculus
cagaatgagccagaga

SEQ ID NO: 377383 - DNA, 16 bp, M. musculus
cagaatgagttcaaga

SEQ ID NO: 377384 - DNA, 16 bp, M. musculus
cagaatgcaaaggaaa

SEQ ID NO: 377385 - DNA, 16 bp, M. musculus
cagaatggttgtataa

SEQ ID NO: 377386 - DNA, 16 bp, M. musculus
cagaatgtattatata

SEQ ID NO: 377387 - DNA, 16 bp, M. musculus
cagaatgtgtccccac

SEQ ID NO: 377388 - DNA, 17 bp, M. musculus
cagaattagcaaagcct

SEQ ID NO: 377389 - DNA, 16 bp, M. musculus
cagaattcagcagctt

SEQ ID NO: 377390 - DNA, 16 bp, M. musculus
cagaattccaacacaa

SEQ ID NO: 377391 - DNA, 16 bp, M. musculus
cagaattccagaggca

SEQ ID NO: 377392 - DNA, 16 bp, M. musculus
cagaattctcaacaaa

SEQ ID NO: 377393 - DNA, 16 bp, M. musculus
cagaattctgagtttg

SEQ ID NO: 377394 - DNA, 16 bp, M. musculus
cagaattgagagtttt

SEQ ID NO: 377395 - DNA, 16 bp, M. musculus
cagaattgtcactaca

SEQ ID NO: 377396 - DNA, 16 bp, M. musculus
cagaatttacaaagaa

SEQ ID NO: 377397 - DNA, 16 bp, M. musculus
cagaatttggagtttg

SEQ ID NO: 377398 - DNA, 16 bp, M. musculus
cagaattttttttttc

SEQ ID NO: 377399 - DNA, 16 bp, M. musculus
cagacaaaatgcctcc

SEQ ID NO: 377400 - DNA, 16 bp, M. musculus
cagacaaagcagcagc

SEQ ID NO: 377401 - DNA, 16 bp, M. musculus
cagacaaaggtcacca

SEQ ID NO: 377402 - DNA, 16 bp, M. musculus
cagacaacacacacat

SEQ ID NO: 377403 - DNA, 16 bp, M. musculus
cagacaaccacagctg

SEQ ID NO: 377404 - DNA, 16 bp, M. musculus
cagacaaccccaaggt

SEQ ID NO: 377405 - DNA, 16 bp, M. musculus
cagacaactgtgagct

SEQ ID NO: 377406 - DNA, 16 bp, M. musculus
cagacaaggcagctct

SEQ ID NO: 377407 - DNA, 16 bp, M. musculus
cagacaaggcagttca

SEQ ID NO: 377408 - DNA, 16 bp, M. musculus
cagacaaggccatctt

SEQ ID NO: 377409 - DNA, 16 bp, M. musculus
cagacacacaaataca

SEQ ID NO: 377410 - DNA, 16 bp, M. musculus
cagacacacacacact

SEQ ID NO: 377411 - DNA, 16 bp, M. musculus
cagacacacaccagaa

SEQ ID NO: 377412 - DNA, 16 bp, M. musculus
cagacacacagagata

SEQ ID NO: 377413 - DNA, 16 bp, M. musculus
cagacacacaggcaga

SEQ ID NO: 377414 - DNA, 16 bp, M. musculus
cagacacacatagaaa

SEQ ID NO: 377415 - DNA, 16 bp, M. musculus
cagacacacatgtata

SEQ ID NO: 377416 - DNA, 16 bp, M. musculus
cagacacacccagagg

SEQ ID NO: 377417 - DNA, 16 bp, M. musculus
cagacacacccttctc

SEQ ID NO: 377418 - DNA, 16 bp, M. musculus
cagacacacctgaaga

SEQ ID NO: 377419 - DNA, 16 bp, M. musculus
cagacacactgaacct

SEQ ID NO: 377420 - DNA, 16 bp, M. musculus
cagacacagaaagaga

SEQ ID NO: 377421 - DNA, 16 bp, M. musculus
cagacacagaaagata

SEQ ID NO: 377422 - DNA, 16 bp, M. musculus
cagacacagaagtgga

SEQ ID NO: 377423 - DNA, 16 bp, M. musculus
cagacacagacacaga

SEQ ID NO: 377424 - DNA, 16 bp, M. musculus
cagacacagacacagc

SEQ ID NO: 377425 - DNA, 16 bp, M. musculus
cagacacagacacagg

SEQ ID NO: 377426 - DNA, 16 bp, M. musculus
cagacacagacagaca

SEQ ID NO: 377427 - DNA, 16 bp, M. musculus
cagacacagacataca

SEQ ID NO: 377428 - DNA, 16 bp, M. musculus
cagacacagagacaga

SEQ ID NO: 377429 - DNA, 16 bp, M. musculus
cagacacagaggcaga

SEQ ID NO: 377430 - DNA, 16 bp, M. musculus
cagacacagatgcaca

SEQ ID NO: 377431 - DNA, 16 bp, M. musculus
cagacacagatgcaga

SEQ ID NO: 377432 - DNA, 16 bp, M. musculus
cagacacagcagggca

SEQ ID NO: 377433 - DNA, 16 bp, M. musculus
cagacacaggaggatc

SEQ ID NO: 377434 - DNA, 16 bp, M. musculus
cagacacagggacaga

SEQ ID NO: 377435 - DNA, 16 bp, M. musculus
cagacacaggtgaatc

SEQ ID NO: 377436 - DNA, 16 bp, M. musculus
cagacacatacatata

SEQ ID NO: 377437 - DNA, 16 bp, M. musculus
cagacacatatacata

SEQ ID NO: 377438 - DNA, 16 bp, M. musculus
cagacacatgcacata

SEQ ID NO: 377439 - DNA, 16 bp, M. musculus
cagacaccaaggaaat

SEQ ID NO: 377440 - DNA, 16 bp, M. musculus
cagacaccacctcaga

SEQ ID NO: 377441 - DNA, 16 bp, M. musculus
cagacaccaggcacga

SEQ ID NO: 377442 - DNA, 16 bp, M. musculus
cagacaccagggatgt

SEQ ID NO: 377443 - DNA, 16 bp, M. musculus
cagacaccatgactaa

SEQ ID NO: 377444 - DNA, 16 bp, M. musculus
cagacacccacacaga

SEQ ID NO: 377445 - DNA, 16 bp, M. musculus
cagacacccatagcca

SEQ ID NO: 377446 - DNA, 16 bp, M. musculus
cagacaccccagaaga

SEQ ID NO: 377447 - DNA, 16 bp, M. musculus
cagacaccccagagct

SEQ ID NO: 377448 - DNA, 16 bp, M. musculus
cagacaccccagagga

SEQ ID NO: 377449 - DNA, 16 bp, M. musculus
cagacacctacacaca

SEQ ID NO: 377450 - DNA, 16 bp, M. musculus
cagacacctcagaaga

SEQ ID NO: 377451 - DNA, 16 bp, M. musculus
cagacacctcttctct

SEQ ID NO: 377452 - DNA, 16 bp, M. musculus
cagacactacagaaga

SEQ ID NO: 377453 - DNA, 16 bp, M. musculus
cagacactacctcaaa

SEQ ID NO: 377454 - DNA, 16 bp, M. musculus
cagacactattataga

SEQ ID NO: 377455 - DNA, 16 bp, M. musculus
cagacactcagaacag

SEQ ID NO: 377456 - DNA, 16 bp, M. musculus
cagacactctgggccc

SEQ ID NO: 377457 - DNA, 16 bp, M. musculus
cagacactgaagcaga

SEQ ID NO: 377458 - DNA, 16 bp, M. musculus
cagacactggacagtt

SEQ ID NO: 377459 - DNA, 16 bp, M. musculus
cagacactggcatagc

SEQ ID NO: 377460 - DNA, 16 bp, M. musculus
cagacactgtggagca

SEQ ID NO: 377461 - DNA, 16 bp, M. musculus
cagacactgttgcaga

SEQ ID NO: 377462 - DNA, 16 bp, M. musculus
cagacagaagagggca

SEQ ID NO: 377463 - DNA, 16 bp, M. musculus
cagacagaagtctagc

SEQ ID NO: 377464 - DNA, 16 bp, M. musculus
cagacagacaaactga

SEQ ID NO: 377465 - DNA, 16 bp, M. musculus
cagacagacaagcaaa

SEQ ID NO: 377466 - DNA, 16 bp, M. musculus
cagacagacaagcaga

SEQ ID NO: 377467 - DNA, 16 bp, M. musculus
cagacagacaagcagg

SEQ ID NO: 377468 - DNA, 16 bp, M. musculus
cagacagacacacaga

SEQ ID NO: 377469 - DNA, 16 bp, M. musculus
cagacagacacagagg

SEQ ID NO: 377470 - DNA, 16 bp, M. musculus
cagacagacagacaaa

SEQ ID NO: 377471 - DNA, 19 bp, M. musculus
cagacagacagacagagag

SEQ ID NO: 377472 - DNA, 16 bp, M. musculus
cagacagacagacagg

SEQ ID NO: 377473 - DNA, 16 bp, M. musculus
cagacagacagagaac

SEQ ID NO: 377474 - DNA, 16 bp, M. musculus
cagacagacagagagc

SEQ ID NO: 377475 - DNA, 16 bp, M. musculus
cagacagacagaggca

SEQ ID NO: 377476 - DNA, 16 bp, M. musculus
cagacagacagagtga

SEQ ID NO: 377477 - DNA, 16 bp, M. musculus
cagacagacagatgac

SEQ ID NO: 377478 - DNA, 16 bp, M. musculus
cagacagacagatgga

SEQ ID NO: 377479 - DNA, 16 bp, M. musculus
cagacagacaggagga

SEQ ID NO: 377480 - DNA, 16 bp, M. musculus
cagacagacaggcaag

SEQ ID NO: 377481 - DNA, 16 bp, M. musculus
cagacagacagggaag

SEQ ID NO: 377482 - DNA, 16 bp, M. musculus
cagacagacatgcaga

SEQ ID NO: 377483 - DNA, 16 bp, M. musculus
cagacagaccacacca

SEQ ID NO: 377484 - DNA, 16 bp, M. musculus
cagacagacctacaga

SEQ ID NO: 377485 - DNA, 16 bp, M. musculus
cagacagactgacaga

SEQ ID NO: 377486 - DNA, 16 bp, M. musculus
cagacagactgacagg

SEQ ID NO: 377487 - DNA, 26 bp, M. musculus
cagacagagaaacagtgggacagtcc

SEQ ID NO: 377488 - DNA, 16 bp, M. musculus
cagacagagagacaaa

SEQ ID NO: 377489 - DNA, 16 bp, M. musculus
cagacagagagagaga

SEQ ID NO: 377490 - DNA, 16 bp, M. musculus
cagacagagagatgga

SEQ ID NO: 377491 - DNA, 16 bp, M. musculus
cagacagaggcagaaa

SEQ ID NO: 377492 - DNA, 16 bp, M. musculus
cagacagaggcagtaa

SEQ ID NO: 377493 - DNA, 16 bp, M. musculus
cagacagagggagagg

SEQ ID NO: 377494 - DNA, 16 bp, M. musculus
cagacagataaataga

SEQ ID NO: 377495 - DNA, 16 bp, M. musculus
cagacagatacacaca

SEQ ID NO: 377496 - DNA, 16 bp, M. musculus
cagacagatgcagaca

SEQ ID NO: 377497 - DNA, 16 bp, M. musculus
cagacagatggacaca

SEQ ID NO: 377498 - DNA, 16 bp, M. musculus
cagacagatggacgga

SEQ ID NO: 377499 - DNA, 16 bp, M. musculus
cagacagatggagaga

SEQ ID NO: 377500 - DNA, 16 bp, M. musculus
cagacagcagacagca

SEQ ID NO: 377501 - DNA, 16 bp, M. musculus
cagacagcaggaagag

SEQ ID NO: 377502 - DNA, 16 bp, M. musculus
cagacagcaggcagca

SEQ ID NO: 377503 - DNA, 16 bp, M. musculus
cagacagcatacacca

SEQ ID NO: 377504 - DNA, 16 bp, M. musculus
cagacagcctggtcta

SEQ ID NO: 377505 - DNA, 16 bp, M. musculus
cagacaggaaacagag

SEQ ID NO: 377506 - DNA, 16 bp, M. musculus
cagacaggcacacaga

SEQ ID NO: 377507 - DNA, 16 bp, M. musculus
cagacagggagagaca

SEQ ID NO: 377508 - DNA, 16 bp, M. musculus
cagacaggtctctgtg

SEQ ID NO: 377509 - DNA, 16 bp, M. musculus
cagacaggtgaaagaa

SEQ ID NO: 377510 - DNA, 16 bp, M. musculus
cagacaggtgctctct

SEQ ID NO: 377511 - DNA, 16 bp, M. musculus
cagacagtaagagaac

SEQ ID NO: 377512 - DNA, 16 bp, M. musculus
cagacagtgagacagt

SEQ ID NO: 377513 - DNA, 16 bp, M. musculus
cagacagtgctcttaa

SEQ ID NO: 377514 - DNA, 16 bp, M. musculus
cagacagtgctggaga

SEQ ID NO: 377515 - DNA, 16 bp, M. musculus
cagacagtgtgagctg

SEQ ID NO: 377516 - DNA, 30 bp, M. musculus
cagacataaaacaattagggctctcccctg

SEQ ID NO: 377517 - DNA, 16 bp, M. musculus
cagacataaattgaca

SEQ ID NO: 377518 - DNA, 16 bp, M. musculus
cagacatacacaggca

SEQ ID NO: 377519 - DNA, 16 bp, M. musculus
cagacatacatgcaga

SEQ ID NO: 377520 - DNA, 16 bp, M. musculus
cagacatacatgcagt

SEQ ID NO: 377521 - DNA, 16 bp, M. musculus
cagacatcagaagagg

SEQ ID NO: 377522 - DNA, 16 bp, M. musculus
cagacatcagagatga

SEQ ID NO: 377523 - DNA, 16 bp, M. musculus
cagacatccaggcact

SEQ ID NO: 377524 - DNA, 16 bp, M. musculus
cagacatcccagaaga

SEQ ID NO: 377525 - DNA, 16 bp, M. musculus
cagacatcctgagttc

SEQ ID NO: 377526 - DNA, 16 bp, M. musculus
cagacatgagagccac

SEQ ID NO: 377527 - DNA, 16 bp, M. musculus
cagacatgcaagcaaa

SEQ ID NO: 377528 - DNA, 16 bp, M. musculus
cagacatgcagacaaa

SEQ ID NO: 377529 - DNA, 16 bp, M. musculus
cagacatggaagtcct

SEQ ID NO: 377530 - DNA, 16 bp, M. musculus
cagacatggcagtcct

SEQ ID NO: 377531 - DNA, 16 bp, M. musculus
cagacatggtggcaca

SEQ ID NO: 377532 - DNA, 16 bp, M. musculus
cagacatgtgaaagaa

SEQ ID NO: 377533 - DNA, 163 bp, M. musculus
cagacattaccagaccttagatttcaagttgataaaagagttaaaggcggctgttgtgcaatatggcccttcagccccattcactcaagcattactggacacagttgtggagtcacacttaacccctttagattggaagactctttctaaggctaccctgtca

SEQ ID NO: 377534 - DNA, 16 bp, M. musculus
cagacattcaaggcca

SEQ ID NO: 377535 - DNA, 16 bp, M. musculus
cagacattcaggcaaa

SEQ ID NO: 377536 - DNA, 16 bp, M. musculus
cagacattgacacaga

SEQ ID NO: 377537 - DNA, 16 bp, M. musculus
cagacattggatggtt

SEQ ID NO: 377538 - DNA, 16 bp, M. musculus
cagacatttatttatt

SEQ ID NO: 377539 - DNA, 17 bp, M. musculus
cagacatttcaccagag

SEQ ID NO: 377540 - DNA, 16 bp, M. musculus
cagaccaaaagcccag

SEQ ID NO: 377541 - DNA, 16 bp, M. musculus
cagaccaatcagaatt

SEQ ID NO: 377542 - DNA, 16 bp, M. musculus
cagaccaatgagagac

SEQ ID NO: 377543 - DNA, 16 bp, M. musculus
cagaccacatggagct

SEQ ID NO: 377544 - DNA, 16 bp, M. musculus
cagaccaccatggact

SEQ ID NO: 377545 - DNA, 16 bp, M. musculus
cagaccagaccaagga

SEQ ID NO: 377546 - DNA, 16 bp, M. musculus
cagaccagagctctgg

SEQ ID NO: 377547 - DNA, 16 bp, M. musculus
cagaccagccaggact

SEQ ID NO: 377548 - DNA, 16 bp, M. musculus
cagaccagccagggct

SEQ ID NO: 377549 - DNA, 16 bp, M. musculus
cagaccagcctggact

SEQ ID NO: 377550 - DNA, 16 bp, M. musculus
cagaccagcttggtct

SEQ ID NO: 377551 - DNA, 16 bp, M. musculus
cagaccaggctgacct

SEQ ID NO: 377552 - DNA, 16 bp, M. musculus
cagaccaggctggcct

SEQ ID NO: 377553 - DNA, 16 bp, M. musculus
cagaccaggctggctt

SEQ ID NO: 377554 - DNA, 16 bp, M. musculus
cagaccaggttggcct

SEQ ID NO: 377555 - DNA, 16 bp, M. musculus
cagacccaaaagcaca

SEQ ID NO: 377556 - DNA, 16 bp, M. musculus
cagacccaaagaagca

SEQ ID NO: 377557 - DNA, 16 bp, M. musculus
cagacccacacttgtg

SEQ ID NO: 377558 - DNA, 16 bp, M. musculus
cagacccaccagagct

SEQ ID NO: 377559 - DNA, 16 bp, M. musculus
cagacccagagaagct

SEQ ID NO: 377560 - DNA, 16 bp, M. musculus
cagacccagatccagg

SEQ ID NO: 377561 - DNA, 16 bp, M. musculus
cagacccagggctctg

SEQ ID NO: 377562 - DNA, 16 bp, M. musculus
cagaccccattacaga

SEQ ID NO: 377563 - DNA, 16 bp, M. musculus
cagacccctgggcacc

SEQ ID NO: 377564 - DNA, 16 bp, M. musculus
cagacccgaaggagag

SEQ ID NO: 377565 - DNA, 16 bp, M. musculus
cagaccctctctccca

SEQ ID NO: 377566 - DNA, 16 bp, M. musculus
cagaccctcttgggtc

SEQ ID NO: 377567 - DNA, 16 bp, M. musculus
cagaccctgaagaaat

SEQ ID NO: 377568 - DNA, 16 bp, M. musculus
cagaccctgactgcag

SEQ ID NO: 377569 - DNA, 17 bp, M. musculus
cagaccctgtgcagacc

SEQ ID NO: 377570 - DNA, 16 bp, M. musculus
cagaccctgtttcagg

SEQ ID NO: 377571 - DNA, 16 bp, M. musculus
cagacctcaagggccc

SEQ ID NO: 377572 - DNA, 16 bp, M. musculus
cagacctcacccaaat

SEQ ID NO: 377573 - DNA, 16 bp, M. musculus
cagacctcccagagca

SEQ ID NO: 377574 - DNA, 16 bp, M. musculus
cagacctccctcctgg

SEQ ID NO: 377575 - DNA, 16 bp, M. musculus
cagacctgaaggaaga

SEQ ID NO: 377576 - DNA, 16 bp, M. musculus
cagacctgacctccag

SEQ ID NO: 377577 - DNA, 16 bp, M. musculus
cagacctgccctccag

SEQ ID NO: 377578 - DNA, 16 bp, M. musculus
cagacctggcttccag

SEQ ID NO: 377579 - DNA, 16 bp, M. musculus
cagacctgtaatccca

SEQ ID NO: 377580 - DNA, 16 bp, M. musculus
cagaccttatcatgaa

SEQ ID NO: 377581 - DNA, 17 bp, M. musculus
cagaccttcaaagaaga

SEQ ID NO: 377582 - DNA, 16 bp, M. musculus
cagacgctgtgttcca

SEQ ID NO: 377583 - DNA, 16 bp, M. musculus
cagacggacggatgga

SEQ ID NO: 377584 - DNA, 16 bp, M. musculus
cagactaaccagagag

SEQ ID NO: 377585 - DNA, 31 bp, M. musculus
cagactaagaattttgctttgcacaattttt

SEQ ID NO: 377586 - DNA, 16 bp, M. musculus
cagactaagttccagg

SEQ ID NO: 377587 - DNA, 16 bp, M. musculus
cagactaatctctgtg

SEQ ID NO: 377588 - DNA, 16 bp, M. musculus
cagactacacagagaa

SEQ ID NO: 377589 - DNA, 16 bp, M. musculus
cagactaccagccctg

SEQ ID NO: 377590 - DNA, 16 bp, M. musculus
cagactagccagaggg

SEQ ID NO: 377591 - DNA, 16 bp, M. musculus
cagactcaaagcaaaa

SEQ ID NO: 377592 - DNA, 16 bp, M. musculus
cagactcacagagatc

SEQ ID NO: 377593 - DNA, 16 bp, M. musculus
cagactcagaaatccg

SEQ ID NO: 377594 - DNA, 16 bp, M. musculus
cagactcagactcaga

SEQ ID NO: 377595 - DNA, 16 bp, M. musculus
cagactcaggagctga

SEQ ID NO: 377596 - DNA, 16 bp, M. musculus
cagactcaggtcctct

SEQ ID NO: 377597 - DNA, 16 bp, M. musculus
cagactccaggtcttg

SEQ ID NO: 377598 - DNA, 16 bp, M. musculus
cagactcctatcagca

SEQ ID NO: 377599 - DNA, 16 bp, M. musculus
cagactcctgaaagtt

SEQ ID NO: 377600 - DNA, 16 bp, M. musculus
cagactcctgccaagc

SEQ ID NO: 377601 - DNA, 16 bp, M. musculus
cagactctttcagctg

SEQ ID NO: 377602 - DNA, 16 bp, M. musculus
cagactgaattccaga

SEQ ID NO: 377603 - DNA, 16 bp, M. musculus
cagactgacctcaaac

SEQ ID NO: 377604 - DNA, 16 bp, M. musculus
cagactgagcaagcct

SEQ ID NO: 377605 - DNA, 16 bp, M. musculus
cagactgatttcctga

SEQ ID NO: 377606 - DNA, 16 bp, M. musculus
cagactgcagaagtga

SEQ ID NO: 377607 - DNA, 16 bp, M. musculus
cagactgctgggatta

SEQ ID NO: 377608 - DNA, 16 bp, M. musculus
cagactggaaaaagat

SEQ ID NO: 377609 - DNA, 16 bp, M. musculus
cagactggcctggaac

SEQ ID NO: 377610 - DNA, 21 bp, M. musculus
cagactggccttgaactcaga

SEQ ID NO: 377611 - DNA, 16 bp, M. musculus
cagactggctatataa

SEQ ID NO: 377612 - DNA, 16 bp, M. musculus
cagactggctttgaat

SEQ ID NO: 377613 - DNA, 17 bp, M. musculus
cagactgggaggaagaa

SEQ ID NO: 377614 - DNA, 16 bp, M. musculus
cagacttccaggagga

SEQ ID NO: 377615 - DNA, 16 bp, M. musculus
cagacttcccagagct

SEQ ID NO: 377616 - DNA, 16 bp, M. musculus
cagacttctgtcagca

SEQ ID NO: 377617 - DNA, 16 bp, M. musculus
cagacttgcacagcaa

SEQ ID NO: 377618 - DNA, 16 bp, M. musculus
cagacttggaggagga

SEQ ID NO: 377619 - DNA, 16 bp, M. musculus
cagacttgggagctga

SEQ ID NO: 377620 - DNA, 16 bp, M. musculus
cagacttgggaggcag

SEQ ID NO: 377621 - DNA, 16 bp, M. musculus
cagacttggtgctgga

SEQ ID NO: 377622 - DNA, 16 bp, M. musculus
cagactttcaaaaaag

SEQ ID NO: 377623 - DNA, 16 bp, M. musculus
cagagaaaaagaagcc

SEQ ID NO: 377624 - DNA, 16 bp, M. musculus
cagagaaaatgcaaaa

SEQ ID NO: 377625 - DNA, 16 bp, M. musculus
cagagaaacacagaga

SEQ ID NO: 377626 - DNA, 16 bp, M. musculus
cagagaaacactgact

SEQ ID NO: 377627 - DNA, 16 bp, M. musculus
cagagaaaccctgtca

SEQ ID NO: 377628 - DNA, 16 bp, M. musculus
cagagaaacgctgtct

SEQ ID NO: 377629 - DNA, 16 bp, M. musculus
cagagaaagaaaccct

SEQ ID NO: 377630 - DNA, 16 bp, M. musculus
cagagaaagaaatcag

SEQ ID NO: 377631 - DNA, 16 bp, M. musculus
cagagaaagaagcttc

SEQ ID NO: 377632 - DNA, 16 bp, M. musculus
cagagaaagacacaca

SEQ ID NO: 377633 - DNA, 16 bp, M. musculus
cagagaaagatccagg

SEQ ID NO: 377634 - DNA, 16 bp, M. musculus
cagagaaagatgaatg

SEQ ID NO: 377635 - DNA, 16 bp, M. musculus
cagagaaagcagaaca

SEQ ID NO: 377636 - DNA, 16 bp, M. musculus
cagagaaagcagagag

SEQ ID NO: 377637 - DNA, 16 bp, M. musculus
cagagaaagcctgtct

SEQ ID NO: 377638 - DNA, 16 bp, M. musculus
cagagaaaggagtttc

SEQ ID NO: 377639 - DNA, 16 bp, M. musculus
cagagaaaggcagatc

SEQ ID NO: 377640 - DNA, 16 bp, M. musculus
cagagaaagttccagg

SEQ ID NO: 377641 - DNA, 21 bp, M. musculus
cagagaaataatggcttaaca

SEQ ID NO: 377642 - DNA, 16 bp, M. musculus
cagagaaatcctgtca

SEQ ID NO: 377643 - DNA, 16 bp, M. musculus
cagagaaatgaaagca

SEQ ID NO: 377644 - DNA, 16 bp, M. musculus
cagagaaatgcaaaac

SEQ ID NO: 377645 - DNA, 16 bp, M. musculus
cagagaaattcaacaa

SEQ ID NO: 377646 - DNA, 16 bp, M. musculus
cagagaaattctgtct

SEQ ID NO: 377647 - DNA, 16 bp, M. musculus
cagagaaattgtggct

SEQ ID NO: 377648 - DNA, 16 bp, M. musculus
cagagaaatttgacaa

SEQ ID NO: 377649 - DNA, 16 bp, M. musculus
cagagaacaacctgag

SEQ ID NO: 377650 - DNA, 16 bp, M. musculus
cagagaacagcttgtg

SEQ ID NO: 377651 - DNA, 16 bp, M. musculus
cagagaacagtctaga

SEQ ID NO: 377652 - DNA, 16 bp, M. musculus
cagagaacattgtgga

SEQ ID NO: 377653 - DNA, 16 bp, M. musculus
cagagaacccaggctc

SEQ ID NO: 377654 - DNA, 16 bp, M. musculus
cagagaaccctgtctt

SEQ ID NO: 377655 - DNA, 16 bp, M. musculus
cagagaactcaaaaag

SEQ ID NO: 377656 - DNA, 16 bp, M. musculus
cagagaacttctatag

SEQ ID NO: 377657 - DNA, 16 bp, M. musculus
cagagaagaaaaatga

SEQ ID NO: 377658 - DNA, 16 bp, M. musculus
cagagaagaaaatgga

SEQ ID NO: 377659 - DNA, 16 bp, M. musculus
cagagaagagcacacc

SEQ ID NO: 377660 - DNA, 16 bp, M. musculus
cagagaagaggaaacc

SEQ ID NO: 377661 - DNA, 16 bp, M. musculus
cagagaagaggaggcc

SEQ ID NO: 377662 - DNA, 16 bp, M. musculus
cagagaagagggatgc

SEQ ID NO: 377663 - DNA, 16 bp, M. musculus
cagagaagcacagaga

SEQ ID NO: 377664 - DNA, 16 bp, M. musculus
cagagaagcagagagg

SEQ ID NO: 377665 - DNA, 16 bp, M. musculus
cagagaagccagaaga

SEQ ID NO: 377666 - DNA, 16 bp, M. musculus
cagagaagcttcattt

SEQ ID NO: 377667 - DNA, 16 bp, M. musculus
cagagaaggaaacact

SEQ ID NO: 377668 - DNA, 16 bp, M. musculus
cagagaaggaagctga

SEQ ID NO: 377669 - DNA, 16 bp, M. musculus
cagagaaggtgcacag

SEQ ID NO: 377670 - DNA, 16 bp, M. musculus
cagagaagtttcttct

SEQ ID NO: 377671 - DNA, 16 bp, M. musculus
cagagaagtttctttg

SEQ ID NO: 377672 - DNA, 16 bp, M. musculus
cagagaataaggagcc

SEQ ID NO: 377673 - DNA, 16 bp, M. musculus
cagagaatcaaccaat

SEQ ID NO: 377674 - DNA, 16 bp, M. musculus
cagagaatcagtgcac

SEQ ID NO: 377675 - DNA, 16 bp, M. musculus
cagagaatgagaagga

SEQ ID NO: 377676 - DNA, 16 bp, M. musculus
cagagaatgagagact

SEQ ID NO: 377677 - DNA, 16 bp, M. musculus
cagagaatgaggagga

SEQ ID NO: 377678 - DNA, 16 bp, M. musculus
cagagaattaaataac

SEQ ID NO: 377679 - DNA, 16 bp, M. musculus
cagagacaaaaatgga

SEQ ID NO: 377680 - DNA, 16 bp, M. musculus
cagagacaaaaattgt

SEQ ID NO: 377681 - DNA, 16 bp, M. musculus
cagagacaaagacagg

SEQ ID NO: 377682 - DNA, 16 bp, M. musculus
cagagacaaagatcag

SEQ ID NO: 377683 - DNA, 16 bp, M. musculus
cagagacaactgaaga

SEQ ID NO: 377684 - DNA, 16 bp, M. musculus
cagagacaagaagatc

SEQ ID NO: 377685 - DNA, 16 bp, M. musculus
cagagacaagagagtc

SEQ ID NO: 377686 - DNA, 16 bp, M. musculus
cagagacaagaggacc

SEQ ID NO: 377687 - DNA, 16 bp, M. musculus
cagagacaagaggatt

SEQ ID NO: 377688 - DNA, 16 bp, M. musculus
cagagacaagcagagc

SEQ ID NO: 377689 - DNA, 16 bp, M. musculus
cagagacaagcaggta

SEQ ID NO: 377690 - DNA, 16 bp, M. musculus
cagagacaataaaaat

SEQ ID NO: 377691 - DNA, 16 bp, M. musculus
cagagacacacaaata

SEQ ID NO: 377692 - DNA, 16 bp, M. musculus
cagagacacacagaca

SEQ ID NO: 377693 - DNA, 16 bp, M. musculus
cagagacacagagaca

SEQ ID NO: 377694 - DNA, 16 bp, M. musculus
cagagacacccaggcc

SEQ ID NO: 377695 - DNA, 16 bp, M. musculus
cagagacacctgaaga

SEQ ID NO: 377696 - DNA, 16 bp, M. musculus
cagagacacctgcaca

SEQ ID NO: 377697 - DNA, 16 bp, M. musculus
cagagacactgaacct

SEQ ID NO: 377698 - DNA, 16 bp, M. musculus
cagagacactgtgaaa

SEQ ID NO: 377699 - DNA, 16 bp, M. musculus
cagagacagaaacaga

SEQ ID NO: 377700 - DNA, 16 bp, M. musculus
cagagacagaaagacc

SEQ ID NO: 377701 - DNA, 16 bp, M. musculus
cagagacagaagcaga

SEQ ID NO: 377702 - DNA, 16 bp, M. musculus
cagagacagacactga

SEQ ID NO: 377703 - DNA, 16 bp, M. musculus
cagagacagacagaca

SEQ ID NO: 377704 - DNA, 16 bp, M. musculus
cagagacagacagcat

SEQ ID NO: 377705 - DNA, 16 bp, M. musculus
cagagacagagaagga

SEQ ID NO: 377706 - DNA, 16 bp, M. musculus
cagagacagagaatga

SEQ ID NO: 377707 - DNA, 16 bp, M. musculus
cagagacagagacaga

SEQ ID NO: 377708 - DNA, 16 bp, M. musculus
cagagacagagacagc

SEQ ID NO: 377709 - DNA, 16 bp, M. musculus
cagagacagagaccaa

SEQ ID NO: 377710 - DNA, 16 bp, M. musculus
cagagacagagaggag

SEQ ID NO: 377711 - DNA, 16 bp, M. musculus
cagagacagaggaagg

SEQ ID NO: 377712 - DNA, 16 bp, M. musculus
cagagacagaggatcc

SEQ ID NO: 377713 - DNA, 16 bp, M. musculus
cagagacagagtaaca

SEQ ID NO: 377714 - DNA, 16 bp, M. musculus
cagagacagagtcaga

SEQ ID NO: 377715 - DNA, 16 bp, M. musculus
cagagacagatgcaca

SEQ ID NO: 377716 - DNA, 16 bp, M. musculus
cagagacagatggaga

SEQ ID NO: 377717 - DNA, 16 bp, M. musculus
cagagacagcaagacc

SEQ ID NO: 377718 - DNA, 16 bp, M. musculus
cagagacagccaaggt

SEQ ID NO: 377719 - DNA, 16 bp, M. musculus
cagagacaggaaaatc

SEQ ID NO: 377720 - DNA, 16 bp, M. musculus
cagagacaggaagaca

SEQ ID NO: 377721 - DNA, 16 bp, M. musculus
cagagacaggaagcag

SEQ ID NO: 377722 - DNA, 16 bp, M. musculus
cagagacaggaggacc

SEQ ID NO: 377723 - DNA, 16 bp, M. musculus
cagagacaggcagaca

SEQ ID NO: 377724 - DNA, 16 bp, M. musculus
cagagacaggcagagc

SEQ ID NO: 377725 - DNA, 17 bp, M. musculus
cagagacaggcggattt

SEQ ID NO: 377726 - DNA, 16 bp, M. musculus
cagagacagggacagg

SEQ ID NO: 377727 - DNA, 16 bp, M. musculus
cagagacagggagaag

SEQ ID NO: 377728 - DNA, 16 bp, M. musculus
cagagacagggagaga

SEQ ID NO: 377729 - DNA, 16 bp, M. musculus
cagagacagggagcat

SEQ ID NO: 377730 - DNA, 16 bp, M. musculus
cagagacagggtttct

SEQ ID NO: 377731 - DNA, 16 bp, M. musculus
cagagacatacatcaa

SEQ ID NO: 377732 - DNA, 16 bp, M. musculus
cagagacatggaggag

SEQ ID NO: 377733 - DNA, 16 bp, M. musculus
cagagacatggtgaaa

SEQ ID NO: 377734 - DNA, 16 bp, M. musculus
cagagacattgaaact

SEQ ID NO: 377735 - DNA, 16 bp, M. musculus
cagagaccaagagcaa

SEQ ID NO: 377736 - DNA, 16 bp, M. musculus
cagagaccacacacac

SEQ ID NO: 377737 - DNA, 16 bp, M. musculus
cagagaccagaaaagg

SEQ ID NO: 377738 - DNA, 16 bp, M. musculus
cagagaccagaagatg

SEQ ID NO: 377739 - DNA, 16 bp, M. musculus
cagagaccagagtcag

SEQ ID NO: 377740 - DNA, 16 bp, M. musculus
cagagaccagtctgtg

SEQ ID NO: 377741 - DNA, 16 bp, M. musculus
cagagaccatggagga

SEQ ID NO: 377742 - DNA, 16 bp, M. musculus
cagagaccatggaggg

SEQ ID NO: 377743 - DNA, 16 bp, M. musculus
cagagacccacacaca

SEQ ID NO: 377744 - DNA, 16 bp, M. musculus
cagagacccacagcaa

SEQ ID NO: 377745 - DNA, 16 bp, M. musculus
cagagacccacagcca

SEQ ID NO: 377746 - DNA, 16 bp, M. musculus
cagagacccacttatt

SEQ ID NO: 377747 - DNA, 16 bp, M. musculus
cagagacccaggttca

SEQ ID NO: 377748 - DNA, 16 bp, M. musculus
cagagacccatctgcc

SEQ ID NO: 377749 - DNA, 16 bp, M. musculus
cagagacccattccac

SEQ ID NO: 377750 - DNA, 16 bp, M. musculus
cagagaccctgtctcc

SEQ ID NO: 377751 - DNA, 16 bp, M. musculus
cagagacctcaaagca

SEQ ID NO: 377752 - DNA, 16 bp, M. musculus
cagagacctgagttca

SEQ ID NO: 377753 - DNA, 16 bp, M. musculus
cagagacctgcagcca

SEQ ID NO: 377754 - DNA, 16 bp, M. musculus
cagagacctgcctgcc

SEQ ID NO: 377755 - DNA, 16 bp, M. musculus
cagagacctggaaggt

SEQ ID NO: 377756 - DNA, 16 bp, M. musculus
cagagacctggagaaa

SEQ ID NO: 377757 - DNA, 16 bp, M. musculus
cagagacctgggacag

SEQ ID NO: 377758 - DNA, 16 bp, M. musculus
cagagacctgtgaggt

SEQ ID NO: 377759 - DNA, 16 bp, M. musculus
cagagaccttttaata

SEQ ID NO: 377760 - DNA, 16 bp, M. musculus
cagagactccagaaga

SEQ ID NO: 377761 - DNA, 16 bp, M. musculus
cagagactgaaacagc

SEQ ID NO: 377762 - DNA, 16 bp, M. musculus
cagagactgaaccagc

SEQ ID NO: 377763 - DNA, 16 bp, M. musculus
cagagactgaaggaag

SEQ ID NO: 377764 - DNA, 16 bp, M. musculus
cagagactgaaggagt

SEQ ID NO: 377765 - DNA, 16 bp, M. musculus
cagagactgagaacct

SEQ ID NO: 377766 - DNA, 16 bp, M. musculus
cagagactgagactga

SEQ ID NO: 377767 - DNA, 16 bp, M. musculus
cagagactgagagact

SEQ ID NO: 377768 - DNA, 16 bp, M. musculus
cagagactgcagtttc

SEQ ID NO: 377769 - DNA, 16 bp, M. musculus
cagagactgtatattc

SEQ ID NO: 377770 - DNA, 16 bp, M. musculus
cagagactgtggcagc

SEQ ID NO: 377771 - DNA, 16 bp, M. musculus
cagagactgtgggaat

SEQ ID NO: 377772 - DNA, 16 bp, M. musculus
cagagactgtgtgtgt

SEQ ID NO: 377773 - DNA, 16 bp, M. musculus
cagagactttgtctcc

SEQ ID NO: 377774 - DNA, 16 bp, M. musculus
cagagagaaaatattt

SEQ ID NO: 377775 - DNA, 16 bp, M. musculus
cagagagaaaatggag

SEQ ID NO: 377776 - DNA, 16 bp, M. musculus
cagagagaaaggcaga

SEQ ID NO: 377777 - DNA, 16 bp, M. musculus
cagagagaaaggctgg

SEQ ID NO: 377778 - DNA, 16 bp, M. musculus
cagagagaaatagaaa

SEQ ID NO: 377779 - DNA, 16 bp, M. musculus
cagagagaacaaagca

SEQ ID NO: 377780 - DNA, 16 bp, M. musculus
cagagagaagaaaatg

SEQ ID NO: 377781 - DNA, 16 bp, M. musculus
cagagagaagcagaga

SEQ ID NO: 377782 - DNA, 16 bp, M. musculus
cagagagacaagacag

SEQ ID NO: 377783 - DNA, 16 bp, M. musculus
cagagagacacagaga

SEQ ID NO: 377784 - DNA, 16 bp, M. musculus
cagagagacagacaga

SEQ ID NO: 377785 - DNA, 19 bp, M. musculus
cagagagacagacagagac

SEQ ID NO: 377786 - DNA, 16 bp, M. musculus
cagagagacagagaca

SEQ ID NO: 377787 - DNA, 16 bp, M. musculus
cagagagacagagagg

SEQ ID NO: 377788 - DNA, 16 bp, M. musculus
cagagagacagagata

SEQ ID NO: 377789 - DNA, 16 bp, M. musculus
cagagagacagtgaaa

SEQ ID NO: 377790 - DNA, 16 bp, M. musculus
cagagagacagtgaga

SEQ ID NO: 377791 - DNA, 16 bp, M. musculus
cagagagaccagagag

SEQ ID NO: 377792 - DNA, 16 bp, M. musculus
cagagagaccttgatg

SEQ ID NO: 377793 - DNA, 16 bp, M. musculus
cagagagagaagccag

SEQ ID NO: 377794 - DNA, 16 bp, M. musculus
cagagagagaatgaga

SEQ ID NO: 377795 - DNA, 16 bp, M. musculus
cagagagagacacaga

SEQ ID NO: 377796 - DNA, 17 bp, M. musculus
cagagagagacagagat

SEQ ID NO: 377797 - DNA, 16 bp, M. musculus
cagagagagagacaga

SEQ ID NO: 377798 - DNA, 16 bp, M. musculus
cagagagagagactga

SEQ ID NO: 377799 - DNA, 16 bp, M. musculus
cagagagagagagaca

SEQ ID NO: 377800 - DNA, 16 bp, M. musculus
cagagagagaggcaga

SEQ ID NO: 377801 - DNA, 16 bp, M. musculus
cagagagagcagagag

SEQ ID NO: 377802 - DNA, 16 bp, M. musculus
cagagagagctgtgtg

SEQ ID NO: 377803 - DNA, 16 bp, M. musculus
cagagagaggcaggag

SEQ ID NO: 377804 - DNA, 16 bp, M. musculus
cagagagagttccaga

SEQ ID NO: 377805 - DNA, 16 bp, M. musculus
cagagagatacagaaa

SEQ ID NO: 377806 - DNA, 16 bp, M. musculus
cagagagatcaaggac

SEQ ID NO: 377807 - DNA, 16 bp, M. musculus
cagagagatggagaca

SEQ ID NO: 377808 - DNA, 16 bp, M. musculus
cagagagcaacagaga

SEQ ID NO: 377809 - DNA, 19 bp, M. musculus
cagagagcaagagcaagag

SEQ ID NO: 377810 - DNA, 16 bp, M. musculus
cagagagcagaaggag

SEQ ID NO: 377811 - DNA, 16 bp, M. musculus
cagagagcagagagca

SEQ ID NO: 377812 - DNA, 16 bp, M. musculus
cagagagcagagctgg

SEQ ID NO: 377813 - DNA, 16 bp, M. musculus
cagagagcagaggaag

SEQ ID NO: 377814 - DNA, 16 bp, M. musculus
cagagagcagaggcag

SEQ ID NO: 377815 - DNA, 16 bp, M. musculus
cagagagcagcaggag

SEQ ID NO: 377816 - DNA, 16 bp, M. musculus
cagagagccaaacaga

SEQ ID NO: 377817 - DNA, 16 bp, M. musculus
cagagagccacagcca

SEQ ID NO: 377818 - DNA, 16 bp, M. musculus
cagagagccccaggga

SEQ ID NO: 377819 - DNA, 16 bp, M. musculus
cagagagctctgggga

SEQ ID NO: 377820 - DNA, 16 bp, M. musculus
cagagagctctggggt

SEQ ID NO: 377821 - DNA, 16 bp, M. musculus
cagagaggaaacagga

SEQ ID NO: 377822 - DNA, 16 bp, M. musculus
cagagaggaaactgag

SEQ ID NO: 377823 - DNA, 16 bp, M. musculus
cagagaggacattcct

SEQ ID NO: 377824 - DNA, 16 bp, M. musculus
cagagaggagacagag

SEQ ID NO: 377825 - DNA, 16 bp, M. musculus
cagagaggagcagaga

SEQ ID NO: 377826 - DNA, 16 bp, M. musculus
cagagaggagggagct

SEQ ID NO: 377827 - DNA, 16 bp, M. musculus
cagagaggcagagaga

SEQ ID NO: 377828 - DNA, 16 bp, M. musculus
cagagaggccagaaga

SEQ ID NO: 377829 - DNA, 16 bp, M. musculus
cagagaggccccttgg

SEQ ID NO: 377830 - DNA, 16 bp, M. musculus
cagagaggctggcaga

SEQ ID NO: 377831 - DNA, 16 bp, M. musculus
cagagaggcttctggc

SEQ ID NO: 377832 - DNA, 16 bp, M. musculus
cagagaggttaagcaa

SEQ ID NO: 377833 - DNA, 16 bp, M. musculus
cagagagtcctggata

SEQ ID NO: 377834 - DNA, 16 bp, M. musculus
cagagagtgagacaga

SEQ ID NO: 377835 - DNA, 16 bp, M. musculus
cagagagtgaggagag

SEQ ID NO: 377836 - DNA, 16 bp, M. musculus
cagagagtgcactgac

SEQ ID NO: 377837 - DNA, 16 bp, M. musculus
cagagagttggctcag

SEQ ID NO: 377838 - DNA, 16 bp, M. musculus
cagagataaagatgga

SEQ ID NO: 377839 - DNA, 16 bp, M. musculus
cagagataaccagatg

SEQ ID NO: 377840 - DNA, 16 bp, M. musculus
cagagatacacagaga

SEQ ID NO: 377841 - DNA, 16 bp, M. musculus
cagagatacttgctca

SEQ ID NO: 377842 - DNA, 16 bp, M. musculus
cagagatagagacaaa

SEQ ID NO: 377843 - DNA, 16 bp, M. musculus
cagagataggaggatc

SEQ ID NO: 377844 - DNA, 16 bp, M. musculus
cagagatcagaagagg

SEQ ID NO: 377845 - DNA, 16 bp, M. musculus
cagagatcagcttgcc

SEQ ID NO: 377846 - DNA, 16 bp, M. musculus
cagagatccacagaat

SEQ ID NO: 377847 - DNA, 16 bp, M. musculus
cagagatccacctact

SEQ ID NO: 377848 - DNA, 16 bp, M. musculus
cagagatccagctgcc

SEQ ID NO: 377849 - DNA, 16 bp, M. musculus
cagagatcccaaaggc

SEQ ID NO: 377850 - DNA, 16 bp, M. musculus
cagagatctacctggc

SEQ ID NO: 377851 - DNA, 16 bp, M. musculus
cagagatctctgtgga

SEQ ID NO: 377852 - DNA, 16 bp, M. musculus
cagagatctgcctccc

SEQ ID NO: 377853 - DNA, 21 bp, M. musculus
cagagatctgcctgcctctgt

SEQ ID NO: 377854 - DNA, 16 bp, M. musculus
cagagatcttcctgcc

SEQ ID NO: 377855 - DNA, 16 bp, M. musculus
cagagatgaaaggaaa

SEQ ID NO: 377856 - DNA, 16 bp, M. musculus
cagagatgaatccaca

SEQ ID NO: 377857 - DNA, 16 bp, M. musculus
cagagatgcagtgaaa

SEQ ID NO: 377858 - DNA, 16 bp, M. musculus
cagagatgctgaactg

SEQ ID NO: 377859 - DNA, 16 bp, M. musculus
cagagatggacagaga

SEQ ID NO: 377860 - DNA, 16 bp, M. musculus
cagagatggagacaga

SEQ ID NO: 377861 - DNA, 16 bp, M. musculus
cagagatggagagagg

SEQ ID NO: 377862 - DNA, 16 bp, M. musculus
cagagatggagagatg

SEQ ID NO: 377863 - DNA, 16 bp, M. musculus
cagagatggagcagag

SEQ ID NO: 377864 - DNA, 16 bp, M. musculus
cagagatggatgctct

SEQ ID NO: 377865 - DNA, 16 bp, M. musculus
cagagatgtctgccaa

SEQ ID NO: 377866 - DNA, 16 bp, M. musculus
cagagattagcagatg

SEQ ID NO: 377867 - DNA, 16 bp, M. musculus
cagagattattctctt

SEQ ID NO: 377868 - DNA, 16 bp, M. musculus
cagagattcacctgtc

SEQ ID NO: 377869 - DNA, 16 bp, M. musculus
cagagattcatctgct

SEQ ID NO: 377870 - DNA, 16 bp, M. musculus
cagagattctcaacct

SEQ ID NO: 377871 - DNA, 16 bp, M. musculus
cagagatttacattat

SEQ ID NO: 377872 - DNA, 16 bp, M. musculus
cagagcaaaacagaga

SEQ ID NO: 377873 - DNA, 16 bp, M. musculus
cagagcaacaggaaag

SEQ ID NO: 377874 - DNA, 16 bp, M. musculus
cagagcaacatagtga

SEQ ID NO: 377875 - DNA, 16 bp, M. musculus
cagagcaagaacctgg

SEQ ID NO: 377876 - DNA, 16 bp, M. musculus
cagagcaagagcaaga

SEQ ID NO: 377877 - DNA, 16 bp, M. musculus
cagagcaagcagagac

SEQ ID NO: 377878 - DNA, 16 bp, M. musculus
cagagcaagctccagg

SEQ ID NO: 377879 - DNA, 16 bp, M. musculus
cagagcaagctggcca

SEQ ID NO: 377880 - DNA, 16 bp, M. musculus
cagagcaagtttgagg

SEQ ID NO: 377881 - DNA, 16 bp, M. musculus
cagagcaattaaaaaa

SEQ ID NO: 377882 - DNA, 16 bp, M. musculus
cagagcaattgttata

SEQ ID NO: 377883 - DNA, 16 bp, M. musculus
cagagcacactcacag

SEQ ID NO: 377884 - DNA, 16 bp, M. musculus
cagagcacagcctcca

SEQ ID NO: 377885 - DNA, 16 bp, M. musculus
cagagcacatccccca

SEQ ID NO: 377886 - DNA, 16 bp, M. musculus
cagagcactgtgcacc

SEQ ID NO: 377887 - DNA, 16 bp, M. musculus
cagagcacttgcctag

SEQ ID NO: 377888 - DNA, 16 bp, M. musculus
cagagcagagcagagg

SEQ ID NO: 377889 - DNA, 16 bp, M. musculus
cagagcagagcagagt

SEQ ID NO: 377890 - DNA, 16 bp, M. musculus
cagagcagcagcagca

SEQ ID NO: 377891 - DNA, 16 bp, M. musculus
cagagcagcagccacg

SEQ ID NO: 377892 - DNA, 16 bp, M. musculus
cagagcagccagagct

SEQ ID NO: 377893 - DNA, 16 bp, M. musculus
cagagcagctgaagct

SEQ ID NO: 377894 - DNA, 16 bp, M. musculus
cagagcagctgcctgg

SEQ ID NO: 377895 - DNA, 16 bp, M. musculus
cagagcaggaagcagg

SEQ ID NO: 377896 - DNA, 16 bp, M. musculus
cagagcaggaagctgg

SEQ ID NO: 377897 - DNA, 16 bp, M. musculus
cagagcagggcagggg

SEQ ID NO: 377898 - DNA, 16 bp, M. musculus
cagagcagtagctgag

SEQ ID NO: 377899 - DNA, 16 bp, M. musculus
cagagcatgctgggaa

SEQ ID NO: 377900 - DNA, 16 bp, M. musculus
cagagcattataaaca

SEQ ID NO: 377901 - DNA, 16 bp, M. musculus
cagagccaagaattgg

SEQ ID NO: 377902 - DNA, 16 bp, M. musculus
cagagccaatagtgct

SEQ ID NO: 377903 - DNA, 16 bp, M. musculus
cagagccacacagaga

SEQ ID NO: 377904 - DNA, 16 bp, M. musculus
cagagccacatggcca

SEQ ID NO: 377905 - DNA, 16 bp, M. musculus
cagagccaccaaccaa

SEQ ID NO: 377906 - DNA, 16 bp, M. musculus
cagagccaccaaccag

SEQ ID NO: 377907 - DNA, 16 bp, M. musculus
cagagccagagccagg

SEQ ID NO: 377908 - DNA, 16 bp, M. musculus
cagagccagaggcaga

SEQ ID NO: 377909 - DNA, 76 bp, M. musculus
cagagccagataggcccaatgagatggttaaatggaaaaatgtccttgataataaatggtatggcccggatcctat

SEQ ID NO: 377910 - DNA, 16 bp, M. musculus
cagagccagatggttt

SEQ ID NO: 377911 - DNA, 16 bp, M. musculus
cagagccagctctcca

SEQ ID NO: 377912 - DNA, 16 bp, M. musculus
cagagccagctcttct

SEQ ID NO: 377913 - DNA, 16 bp, M. musculus
cagagccaggaatggg

SEQ ID NO: 377914 - DNA, 16 bp, M. musculus
cagagccatctcccca

SEQ ID NO: 377915 - DNA, 16 bp, M. musculus
cagagccatgagggca

SEQ ID NO: 377916 - DNA, 16 bp, M. musculus
cagagcccagagccca

SEQ ID NO: 377917 - DNA, 16 bp, M. musculus
cagagcccagcagctg

SEQ ID NO: 377918 - DNA, 16 bp, M. musculus
cagagcccatggagga

SEQ ID NO: 377919 - DNA, 16 bp, M. musculus
cagagcccccaactcc

SEQ ID NO: 377920 - DNA, 16 bp, M. musculus
cagagcccctgcctag

SEQ ID NO: 377921 - DNA, 16 bp, M. musculus
cagagccctccctgga

SEQ ID NO: 377922 - DNA, 16 bp, M. musculus
cagagcctagaagaaa

SEQ ID NO: 377923 - DNA, 16 bp, M. musculus
cagagcctcaggagac

SEQ ID NO: 377924 - DNA, 16 bp, M. musculus
cagagcctgaaaaata

SEQ ID NO: 377925 - DNA, 16 bp, M. musculus
cagagcctgaagcagc

SEQ ID NO: 377926 - DNA, 16 bp, M. musculus
cagagcctgcagctcc

SEQ ID NO: 377927 - DNA, 16 bp, M. musculus
cagagcctgggccctg

SEQ ID NO: 377928 - DNA, 16 bp, M. musculus
cagagccttgcaaata

SEQ ID NO: 377929 - DNA, 16 bp, M. musculus
cagagctaaacaagaa

SEQ ID NO: 377930 - DNA, 16 bp, M. musculus
cagagctaaacagaaa

SEQ ID NO: 377931 - DNA, 16 bp, M. musculus
cagagctaaacagata

SEQ ID NO: 377932 - DNA, 16 bp, M. musculus
cagagctaaatgaaga

SEQ ID NO: 377933 - DNA, 16 bp, M. musculus
cagagctacacagaga

SEQ ID NO: 377934 - DNA, 16 bp, M. musculus
cagagctacacagtga

SEQ ID NO: 377935 - DNA, 16 bp, M. musculus
cagagctacatcccca

SEQ ID NO: 377936 - DNA, 16 bp, M. musculus
cagagctacctgggac

SEQ ID NO: 377937 - DNA, 16 bp, M. musculus
cagagctcagagctct

SEQ ID NO: 377938 - DNA, 16 bp, M. musculus
cagagctcatgtttct

SEQ ID NO: 377939 - DNA, 16 bp, M. musculus
cagagctccacctgtc

SEQ ID NO: 377940 - DNA, 16 bp, M. musculus
cagagctccctgtgac

SEQ ID NO: 377941 - DNA, 16 bp, M. musculus
cagagctcctgtctct

SEQ ID NO: 377942 - DNA, 16 bp, M. musculus
cagagctcctgtttct

SEQ ID NO: 377943 - DNA, 16 bp, M. musculus
cagagctctcagagac

SEQ ID NO: 377944 - DNA, 16 bp, M. musculus
cagagctctctctctc

SEQ ID NO: 377945 - DNA, 16 bp, M. musculus
cagagctctctctgct

SEQ ID NO: 377946 - DNA, 19 bp, M. musculus
cagagctctggggtcgaaa

SEQ ID NO: 377947 - DNA, 16 bp, M. musculus
cagagctctgtgagct

SEQ ID NO: 377948 - DNA, 16 bp, M. musculus
cagagctcttttctct

SEQ ID NO: 377949 - DNA, 18 bp, M. musculus
cagagctgaacaaagaat

SEQ ID NO: 377950 - DNA, 16 bp, M. musculus
cagagctgaagaagtg

SEQ ID NO: 377951 - DNA, 16 bp, M. musculus
cagagctgaccaccag

SEQ ID NO: 377952 - DNA, 16 bp, M. musculus
cagagctgagagttct

SEQ ID NO: 377953 - DNA, 16 bp, M. musculus
cagagctgagatccag

SEQ ID NO: 377954 - DNA, 16 bp, M. musculus
cagagctgcacagtga

SEQ ID NO: 377955 - DNA, 16 bp, M. musculus
cagagctgctgaggca

SEQ ID NO: 377956 - DNA, 16 bp, M. musculus
cagagctgctgctggg

SEQ ID NO: 377957 - DNA, 16 bp, M. musculus
cagagctggagaactg

SEQ ID NO: 377958 - DNA, 16 bp, M. musculus
cagagctggagaggtg

SEQ ID NO: 377959 - DNA, 16 bp, M. musculus
cagagctggagatgtg

SEQ ID NO: 377960 - DNA, 16 bp, M. musculus
cagagctgggaagatg

SEQ ID NO: 377961 - DNA, 16 bp, M. musculus
cagagctgggcagtgg

SEQ ID NO: 377962 - DNA, 16 bp, M. musculus
cagagctgggcatggt

SEQ ID NO: 377963 - DNA, 16 bp, M. musculus
cagagctgggggaggg

SEQ ID NO: 377964 - DNA, 16 bp, M. musculus
cagagctggggtgggg

SEQ ID NO: 377965 - DNA, 16 bp, M. musculus
cagagctgtgtgtgtg

SEQ ID NO: 377966 - DNA, 16 bp, M. musculus
cagagctgttagaaaa

SEQ ID NO: 377967 - DNA, 16 bp, M. musculus
cagagcttcagaggca

SEQ ID NO: 377968 - DNA, 16 bp, M. musculus
cagagcttccagagac

SEQ ID NO: 377969 - DNA, 16 bp, M. musculus
cagagcttctcagaag

SEQ ID NO: 377970 - DNA, 16 bp, M. musculus
cagagcttctcagagg

SEQ ID NO: 377971 - DNA, 16 bp, M. musculus
cagagcttctgcaagg

SEQ ID NO: 377972 - DNA, 16 bp, M. musculus
cagagcttgggaggca

SEQ ID NO: 377973 - DNA, 16 bp, M. musculus
cagagcttgtttctct

SEQ ID NO: 377974 - DNA, 16 bp, M. musculus
cagagctttgagtttt

SEQ ID NO: 377975 - DNA, 16 bp, M. musculus
cagaggaaaagcagag

SEQ ID NO: 377976 - DNA, 16 bp, M. musculus
cagaggaaaataaaat

SEQ ID NO: 377977 - DNA, 16 bp, M. musculus
cagaggaaaccctgtc

SEQ ID NO: 377978 - DNA, 16 bp, M. musculus
cagaggaaagggctgg

SEQ ID NO: 377979 - DNA, 16 bp, M. musculus
cagaggaaaggggtcc

SEQ ID NO: 377980 - DNA, 16 bp, M. musculus
cagaggaaatccaggt

SEQ ID NO: 377981 - DNA, 16 bp, M. musculus
cagaggaacagagggt

SEQ ID NO: 377982 - DNA, 16 bp, M. musculus
cagaggaagacacctg

SEQ ID NO: 377983 - DNA, 16 bp, M. musculus
cagaggaagacagtga

SEQ ID NO: 377984 - DNA, 16 bp, M. musculus
cagaggaagaggcagg

SEQ ID NO: 377985 - DNA, 16 bp, M. musculus
cagaggaagcaagcca

SEQ ID NO: 377986 - DNA, 16 bp, M. musculus
cagaggaagccagaag

SEQ ID NO: 377987 - DNA, 16 bp, M. musculus
cagaggaagcctctct

SEQ ID NO: 377988 - DNA, 16 bp, M. musculus
cagaggaatagcataa

SEQ ID NO: 377989 - DNA, 16 bp, M. musculus
cagaggaatattttta

SEQ ID NO: 377990 - DNA, 16 bp, M. musculus
cagaggaatgccagga

SEQ ID NO: 377991 - DNA, 16 bp, M. musculus
cagaggaatttctttt

SEQ ID NO: 377992 - DNA, 16 bp, M. musculus
cagaggacaacctcag

SEQ ID NO: 377993 - DNA, 16 bp, M. musculus
cagaggacaacttcaa

SEQ ID NO: 377994 - DNA, 16 bp, M. musculus
cagaggacaagaagga

SEQ ID NO: 377995 - DNA, 16 bp, M. musculus
cagaggacaagctcag

SEQ ID NO: 377996 - DNA, 16 bp, M. musculus
cagaggacacagagga

SEQ ID NO: 377997 - DNA, 16 bp, M. musculus
cagaggacacaggttc

SEQ ID NO: 377998 - DNA, 16 bp, M. musculus
cagaggacacaggttt

SEQ ID NO: 377999 - DNA, 16 bp, M. musculus
cagaggacagaaaagg

SEQ ID NO: 378000 - DNA, 16 bp, M. musculus
cagaggacagaagaag

SEQ ID NO: 378001 - DNA, 16 bp, M. musculus
cagaggacagaggaca

SEQ ID NO: 378002 - DNA, 16 bp, M. musculus
cagaggacagcagtgc

SEQ ID NO: 378003 - DNA, 16 bp, M. musculus
cagaggacagcctgtg

SEQ ID NO: 378004 - DNA, 16 bp, M. musculus
cagaggacagcttgta

SEQ ID NO: 378005 - DNA, 16 bp, M. musculus
cagaggacagctttgt

SEQ ID NO: 378006 - DNA, 16 bp, M. musculus
cagaggacagtcatgc

SEQ ID NO: 378007 - DNA, 16 bp, M. musculus
cagaggacagtgtgca

SEQ ID NO: 378008 - DNA, 16 bp, M. musculus
cagaggaccacttgtg

SEQ ID NO: 378009 - DNA, 16 bp, M. musculus
cagaggaccagagttt

SEQ ID NO: 378010 - DNA, 16 bp, M. musculus
cagaggaccaggaagt

SEQ ID NO: 378011 - DNA, 16 bp, M. musculus
cagaggaccaggacat

SEQ ID NO: 378012 - DNA, 16 bp, M. musculus
cagaggaccaggatgt

SEQ ID NO: 378013 - DNA, 16 bp, M. musculus
cagaggacccaaattc

SEQ ID NO: 378014 - DNA, 16 bp, M. musculus
cagaggacccaagttc

SEQ ID NO: 378015 - DNA, 16 bp, M. musculus
cagaggacccaggctt

SEQ ID NO: 378016 - DNA, 16 bp, M. musculus
cagaggacccagggtc

SEQ ID NO: 378017 - DNA, 16 bp, M. musculus
cagaggaccctggctc

SEQ ID NO: 378018 - DNA, 16 bp, M. musculus
cagaggaccctggttc

SEQ ID NO: 378019 - DNA, 16 bp, M. musculus
cagaggacctcagttc

SEQ ID NO: 378020 - DNA, 16 bp, M. musculus
cagaggacctggattc

SEQ ID NO: 378021 - DNA, 16 bp, M. musculus
cagaggacctgggatt

SEQ ID NO: 378022 - DNA, 16 bp, M. musculus
cagaggacctgggctt

SEQ ID NO: 378023 - DNA, 16 bp, M. musculus
cagaggacctgggttc

SEQ ID NO: 378024 - DNA, 16 bp, M. musculus
cagaggactgccttgt

SEQ ID NO: 378025 - DNA, 16 bp, M. musculus
cagaggactgggtttg

SEQ ID NO: 378026 - DNA, 16 bp, M. musculus
cagaggacttcctggt

SEQ ID NO: 378027 - DNA, 16 bp, M. musculus
cagaggacttggattc

SEQ ID NO: 378028 - DNA, 16 bp, M. musculus
cagaggagaagcagca

SEQ ID NO: 378029 - DNA, 17 bp, M. musculus
cagaggagagagctagt

SEQ ID NO: 378030 - DNA, 16 bp, M. musculus
cagaggagagagtctg

SEQ ID NO: 378031 - DNA, 16 bp, M. musculus
cagaggagagcagagg

SEQ ID NO: 378032 - DNA, 16 bp, M. musculus
cagaggagatggaaga

SEQ ID NO: 378033 - DNA, 16 bp, M. musculus
cagaggagatggagga

SEQ ID NO: 378034 - DNA, 16 bp, M. musculus
cagaggagatttcaaa

SEQ ID NO: 378035 - DNA, 16 bp, M. musculus
cagaggagcagtcaag

SEQ ID NO: 378036 - DNA, 16 bp, M. musculus
cagaggagccagagga

SEQ ID NO: 378037 - DNA, 16 bp, M. musculus
cagaggaggaagctga

SEQ ID NO: 378038 - DNA, 16 bp, M. musculus
cagaggaggaagtgga

SEQ ID NO: 378039 - DNA, 16 bp, M. musculus
cagaggaggcctgtga

SEQ ID NO: 378040 - DNA, 16 bp, M. musculus
cagaggagggcattgg

SEQ ID NO: 378041 - DNA, 16 bp, M. musculus
cagaggagtggagcgg

SEQ ID NO: 378042 - DNA, 16 bp, M. musculus
cagaggataactttgt

SEQ ID NO: 378043 - DNA, 16 bp, M. musculus
cagaggataataacag

SEQ ID NO: 378044 - DNA, 16 bp, M. musculus
cagaggatctgagttc

SEQ ID NO: 378045 - DNA, 16 bp, M. musculus
cagaggatgaccttga

SEQ ID NO: 378046 - DNA, 16 bp, M. musculus
cagaggatgactttgt

SEQ ID NO: 378047 - DNA, 16 bp, M. musculus
cagaggatggatacag

SEQ ID NO: 378048 - DNA, 16 bp, M. musculus
cagaggatggccaagt

SEQ ID NO: 378049 - DNA, 16 bp, M. musculus
cagaggatggccctgt

SEQ ID NO: 378050 - DNA, 16 bp, M. musculus
cagaggatggcctaga

SEQ ID NO: 378051 - DNA, 16 bp, M. musculus
cagaggattgcctagt

SEQ ID NO: 378052 - DNA, 16 bp, M. musculus
cagaggcaaagggaag

SEQ ID NO: 378053 - DNA, 16 bp, M. musculus
cagaggcaagaggatt

SEQ ID NO: 378054 - DNA, 16 bp, M. musculus
cagaggcaagcaaatt

SEQ ID NO: 378055 - DNA, 16 bp, M. musculus
cagaggcaagcagacc

SEQ ID NO: 378056 - DNA, 16 bp, M. musculus
cagaggcaagctgatt

SEQ ID NO: 378057 - DNA, 16 bp, M. musculus
cagaggcacacagaga

SEQ ID NO: 378058 - DNA, 16 bp, M. musculus
cagaggcacaggcaga

SEQ ID NO: 378059 - DNA, 16 bp, M. musculus
cagaggcactgcaggg

SEQ ID NO: 378060 - DNA, 16 bp, M. musculus
cagaggcagaaagatc

SEQ ID NO: 378061 - DNA, 16 bp, M. musculus
cagaggcagaagcaga

SEQ ID NO: 378062 - DNA, 16 bp, M. musculus
cagaggcagaagctca

SEQ ID NO: 378063 - DNA, 16 bp, M. musculus
cagaggcagaaggatc

SEQ ID NO: 378064 - DNA, 16 bp, M. musculus
cagaggcagacagaca

SEQ ID NO: 378065 - DNA, 16 bp, M. musculus
cagaggcagacggatt

SEQ ID NO: 378066 - DNA, 16 bp, M. musculus
cagaggcagagacaga

SEQ ID NO: 378067 - DNA, 16 bp, M. musculus
cagaggcagagagaaa

SEQ ID NO: 378068 - DNA, 16 bp, M. musculus
cagaggcagaggaggc

SEQ ID NO: 378069 - DNA, 17 bp, M. musculus
cagaggcagaggcaggc

SEQ ID NO: 378070 - DNA, 17 bp, M. musculus
cagaggcagaggcaggt

SEQ ID NO: 378071 - DNA, 16 bp, M. musculus
cagaggcagaggcggc

SEQ ID NO: 378072 - DNA, 16 bp, M. musculus
cagaggcagaggctga

SEQ ID NO: 378073 - DNA, 16 bp, M. musculus
cagaggcagatggagg

SEQ ID NO: 378074 - DNA, 16 bp, M. musculus
cagaggcagatgtttg

SEQ ID NO: 378075 - DNA, 16 bp, M. musculus
cagaggcagcagagca

SEQ ID NO: 378076 - DNA, 16 bp, M. musculus
cagaggcagccaccct

SEQ ID NO: 378077 - DNA, 16 bp, M. musculus
cagaggcagcctctgt

SEQ ID NO: 378078 - DNA, 16 bp, M. musculus
cagaggcagctgaagc

SEQ ID NO: 378079 - DNA, 16 bp, M. musculus
cagaggcaggaagctg

SEQ ID NO: 378080 - DNA, 16 bp, M. musculus
cagaggcaggaaggtc

SEQ ID NO: 378081 - DNA, 16 bp, M. musculus
cagaggcaggagcatg

SEQ ID NO: 378082 - DNA, 16 bp, M. musculus
cagaggcaggaggata

SEQ ID NO: 378083 - DNA, 16 bp, M. musculus
cagaggcaggaggcag

SEQ ID NO: 378084 - DNA, 16 bp, M. musculus
cagaggcaggaggtgg

SEQ ID NO: 378085 - DNA, 16 bp, M. musculus
cagaggcaggagtatt

SEQ ID NO: 378086 - DNA, 16 bp, M. musculus
cagaggcaggcacagc

SEQ ID NO: 378087 - DNA, 16 bp, M. musculus
cagaggcaggcagaag

SEQ ID NO: 378088 - DNA, 16 bp, M. musculus
cagaggcaggcagata

SEQ ID NO: 378089 - DNA, 16 bp, M. musculus
cagaggcaggcaggag

SEQ ID NO: 378090 - DNA, 16 bp, M. musculus
cagaggcaggcagggt

SEQ ID NO: 378091 - DNA, 16 bp, M. musculus
cagaggcaggctggtc

SEQ ID NO: 378092 - DNA, 16 bp, M. musculus
cagaggcaggtaggtc

SEQ ID NO: 378093 - DNA, 16 bp, M. musculus
cagaggcaggtcgatt

SEQ ID NO: 378094 - DNA, 16 bp, M. musculus
cagaggcaggtggagg

SEQ ID NO: 378095 - DNA, 16 bp, M. musculus
cagaggcaggtggatg

SEQ ID NO: 378096 - DNA, 18 bp, M. musculus
cagaggcaggtggatttt

SEQ ID NO: 378097 - DNA, 16 bp, M. musculus
cagaggcaggtggcag

SEQ ID NO: 378098 - DNA, 16 bp, M. musculus
cagaggcagtggaaaa

SEQ ID NO: 378099 - DNA, 16 bp, M. musculus
cagaggcagtggaaag

SEQ ID NO: 378100 - DNA, 16 bp, M. musculus
cagaggcagtggattt

SEQ ID NO: 378101 - DNA, 16 bp, M. musculus
cagaggcagtgggaaa

SEQ ID NO: 378102 - DNA, 16 bp, M. musculus
cagaggcagttgaagc

SEQ ID NO: 378103 - DNA, 16 bp, M. musculus
cagaggccaaaagagg

SEQ ID NO: 378104 - DNA, 16 bp, M. musculus
cagaggccaagagaga

SEQ ID NO: 378105 - DNA, 16 bp, M. musculus
cagaggccaaggagga

SEQ ID NO: 378106 - DNA, 16 bp, M. musculus
cagaggccaaggcagg

SEQ ID NO: 378107 - DNA, 16 bp, M. musculus
cagaggccacaagagg

SEQ ID NO: 378108 - DNA, 16 bp, M. musculus
cagaggccacagagaa

SEQ ID NO: 378109 - DNA, 16 bp, M. musculus
cagaggccacagagga

SEQ ID NO: 378110 - DNA, 16 bp, M. musculus
cagaggccacagaggg

SEQ ID NO: 378111 - DNA, 16 bp, M. musculus
cagaggccagaagaca

SEQ ID NO: 378112 - DNA, 16 bp, M. musculus
cagaggccagaagaga

SEQ ID NO: 378113 - DNA, 16 bp, M. musculus
cagaggccagacaaag

SEQ ID NO: 378114 - DNA, 16 bp, M. musculus
cagaggccagagaaga

SEQ ID NO: 378115 - DNA, 16 bp, M. musculus
cagaggccagagaagg

SEQ ID NO: 378116 - DNA, 16 bp, M. musculus
cagaggccagagagag

SEQ ID NO: 378117 - DNA, 16 bp, M. musculus
cagaggccagagagga

SEQ ID NO: 378118 - DNA, 16 bp, M. musculus
cagaggccagagaggg

SEQ ID NO: 378119 - DNA, 16 bp, M. musculus
cagaggccagaggcca

SEQ ID NO: 378120 - DNA, 16 bp, M. musculus
cagaggccagaggctt

SEQ ID NO: 378121 - DNA, 16 bp, M. musculus
cagaggccagagggca

SEQ ID NO: 378122 - DNA, 16 bp, M. musculus
cagaggccagatgagg

SEQ ID NO: 378123 - DNA, 16 bp, M. musculus
cagaggccagcagagg

SEQ ID NO: 378124 - DNA, 16 bp, M. musculus
cagaggccagcagatt

SEQ ID NO: 378125 - DNA, 16 bp, M. musculus
cagaggccagcctggt

SEQ ID NO: 378126 - DNA, 16 bp, M. musculus
cagaggccaggagaga

SEQ ID NO: 378127 - DNA, 16 bp, M. musculus
cagaggccaggagagg

SEQ ID NO: 378128 - DNA, 16 bp, M. musculus
cagaggccagggagat

SEQ ID NO: 378129 - DNA, 16 bp, M. musculus
cagaggccatagaagg

SEQ ID NO: 378130 - DNA, 16 bp, M. musculus
cagaggccatgaagga

SEQ ID NO: 378131 - DNA, 16 bp, M. musculus
cagaggccatgaaggg

SEQ ID NO: 378132 - DNA, 16 bp, M. musculus
cagaggccatggaaga

SEQ ID NO: 378133 - DNA, 16 bp, M. musculus
cagaggccatggggag

SEQ ID NO: 378134 - DNA, 16 bp, M. musculus
cagaggcccagagttc

SEQ ID NO: 378135 - DNA, 16 bp, M. musculus
cagaggccctggaggg

SEQ ID NO: 378136 - DNA, 16 bp, M. musculus
cagaggccggaagagg

SEQ ID NO: 378137 - DNA, 16 bp, M. musculus
cagaggcctgcctgcc

SEQ ID NO: 378138 - DNA, 16 bp, M. musculus
cagaggctagaagagg

SEQ ID NO: 378139 - DNA, 16 bp, M. musculus
cagaggctattctgat

SEQ ID NO: 378140 - DNA, 16 bp, M. musculus
cagaggctcagagagg

SEQ ID NO: 378141 - DNA, 16 bp, M. musculus
cagaggctctgtgctt

SEQ ID NO: 378142 - DNA, 16 bp, M. musculus
cagaggctgaaggaag

SEQ ID NO: 378143 - DNA, 16 bp, M. musculus
cagaggctgagtccat

SEQ ID NO: 378144 - DNA, 16 bp, M. musculus
cagaggctggaaagaa

SEQ ID NO: 378145 - DNA, 16 bp, M. musculus
cagaggctgggatcca

SEQ ID NO: 378146 - DNA, 16 bp, M. musculus
cagagggaagaggcag

SEQ ID NO: 378147 - DNA, 16 bp, M. musculus
cagagggaagcaaaga

SEQ ID NO: 378148 - DNA, 16 bp, M. musculus
cagagggaagtttaaa

SEQ ID NO: 378149 - DNA, 16 bp, M. musculus
cagagggaatggagaa

SEQ ID NO: 378150 - DNA, 16 bp, M. musculus
cagagggacacagagg

SEQ ID NO: 378151 - DNA, 16 bp, M. musculus
cagagggacagacaga

SEQ ID NO: 378152 - DNA, 16 bp, M. musculus
cagagggacccatggc

SEQ ID NO: 378153 - DNA, 16 bp, M. musculus
cagagggagacagagg

SEQ ID NO: 378154 - DNA, 16 bp, M. musculus
cagagggagaccagga

SEQ ID NO: 378155 - DNA, 16 bp, M. musculus
cagagggagagatgga

SEQ ID NO: 378156 - DNA, 16 bp, M. musculus
cagagggaggagggat

SEQ ID NO: 378157 - DNA, 16 bp, M. musculus
cagagggaggtggatc

SEQ ID NO: 378158 - DNA, 16 bp, M. musculus
cagagggagttccaga

SEQ ID NO: 378159 - DNA, 16 bp, M. musculus
cagagggcacagagac

SEQ ID NO: 378160 - DNA, 16 bp, M. musculus
cagagggcagccatgg

SEQ ID NO: 378161 - DNA, 16 bp, M. musculus
cagagggcaggctgca

SEQ ID NO: 378162 - DNA, 16 bp, M. musculus
cagagggcagggctgg

SEQ ID NO: 378163 - DNA, 16 bp, M. musculus
cagagggccagaagaa

SEQ ID NO: 378164 - DNA, 16 bp, M. musculus
cagagggcccaggttc

SEQ ID NO: 378165 - DNA, 16 bp, M. musculus
cagagggcctctcctc

SEQ ID NO: 378166 - DNA, 16 bp, M. musculus
cagagggctctggaac

SEQ ID NO: 378167 - DNA, 16 bp, M. musculus
cagagggctgcctggt

SEQ ID NO: 378168 - DNA, 16 bp, M. musculus
cagagggctggagaga

SEQ ID NO: 378169 - DNA, 16 bp, M. musculus
cagagggctgggatta

SEQ ID NO: 378170 - DNA, 16 bp, M. musculus
cagaggggaaacagga

SEQ ID NO: 378171 - DNA, 16 bp, M. musculus
cagagggtacagagac

SEQ ID NO: 378172 - DNA, 16 bp, M. musculus
cagagggtggacctgg

SEQ ID NO: 378173 - DNA, 16 bp, M. musculus
cagagggtggatgagg

SEQ ID NO: 378174 - DNA, 16 bp, M. musculus
cagaggtacatgccaa

SEQ ID NO: 378175 - DNA, 16 bp, M. musculus
cagaggtacttttatt

SEQ ID NO: 378176 - DNA, 16 bp, M. musculus
cagaggtcaactttgg

SEQ ID NO: 378177 - DNA, 16 bp, M. musculus
cagaggtcacagagac

SEQ ID NO: 378178 - DNA, 16 bp, M. musculus
cagaggtcagaagatg

SEQ ID NO: 378179 - DNA, 16 bp, M. musculus
cagaggtcagaggatg

SEQ ID NO: 378180 - DNA, 16 bp, M. musculus
cagaggtcagcctcag

SEQ ID NO: 378181 - DNA, 16 bp, M. musculus
cagaggtcagccttgg

SEQ ID NO: 378182 - DNA, 16 bp, M. musculus
cagaggtcaggggaca

SEQ ID NO: 378183 - DNA, 16 bp, M. musculus
cagaggtcatggagaa

SEQ ID NO: 378184 - DNA, 16 bp, M. musculus
cagaggtccacctgct

SEQ ID NO: 378185 - DNA, 16 bp, M. musculus
cagaggtcccaaattc

SEQ ID NO: 378186 - DNA, 16 bp, M. musculus
cagaggtcctaaatac

SEQ ID NO: 378187 - DNA, 16 bp, M. musculus
cagaggtcctgggttt

SEQ ID NO: 378188 - DNA, 16 bp, M. musculus
cagaggtctgcctgct

SEQ ID NO: 378189 - DNA, 16 bp, M. musculus
cagaggtgaagagcac

SEQ ID NO: 378190 - DNA, 16 bp, M. musculus
cagaggtgatggagga

SEQ ID NO: 378191 - DNA, 16 bp, M. musculus
cagaggtggccaaggt

SEQ ID NO: 378192 - DNA, 16 bp, M. musculus
cagaggtgtcagatcc

SEQ ID NO: 378193 - DNA, 16 bp, M. musculus
cagaggtgtgactgtg

SEQ ID NO: 378194 - DNA, 16 bp, M. musculus
cagaggtgtgtgggtt

SEQ ID NO: 378195 - DNA, 16 bp, M. musculus
cagaggttaaaagcac

SEQ ID NO: 378196 - DNA, 16 bp, M. musculus
cagaggttaagaggac

SEQ ID NO: 378197 - DNA, 16 bp, M. musculus
cagaggttcaaggcca

SEQ ID NO: 378198 - DNA, 16 bp, M. musculus
cagaggttctcaacct

SEQ ID NO: 378199 - DNA, 16 bp, M. musculus
cagaggttctcaactt

SEQ ID NO: 378200 - DNA, 16 bp, M. musculus
cagaggttgacatcag

SEQ ID NO: 378201 - DNA, 16 bp, M. musculus
cagaggtttcatccat

SEQ ID NO: 378202 - DNA, 16 bp, M. musculus
cagagtacctgggttc

SEQ ID NO: 378203 - DNA, 16 bp, M. musculus
cagagtactaggatta

SEQ ID NO: 378204 - DNA, 16 bp, M. musculus
cagagtatcatcaata

SEQ ID NO: 378205 - DNA, 18 bp, M. musculus
cagagtcaaagtttggag

SEQ ID NO: 378206 - DNA, 16 bp, M. musculus
cagagtcacacagaca

SEQ ID NO: 378207 - DNA, 17 bp, M. musculus
cagagtcacctgaggaa

SEQ ID NO: 378208 - DNA, 16 bp, M. musculus
cagagtcactgaaact

SEQ ID NO: 378209 - DNA, 16 bp, M. musculus
cagagtcacttgggaa

SEQ ID NO: 378210 - DNA, 16 bp, M. musculus
cagagtcagaatcaga

SEQ ID NO: 378211 - DNA, 16 bp, M. musculus
cagagtcagcacaagt

SEQ ID NO: 378212 - DNA, 16 bp, M. musculus
cagagtcaggaggatc

SEQ ID NO: 378213 - DNA, 16 bp, M. musculus
cagagtcagttccagg

SEQ ID NO: 378214 - DNA, 16 bp, M. musculus
cagagtcatccttggc

SEQ ID NO: 378215 - DNA, 16 bp, M. musculus
cagagtccaggcaggc

SEQ ID NO: 378216 - DNA, 16 bp, M. musculus
cagagtccccagtgaa

SEQ ID NO: 378217 - DNA, 16 bp, M. musculus
cagagtcctatcagac

SEQ ID NO: 378218 - DNA, 16 bp, M. musculus
cagagtctcagaggaa

SEQ ID NO: 378219 - DNA, 16 bp, M. musculus
cagagtctctctatgt

SEQ ID NO: 378220 - DNA, 16 bp, M. musculus
cagagtctctggtgag

SEQ ID NO: 378221 - DNA, 16 bp, M. musculus
cagagtctgagacagc

SEQ ID NO: 378222 - DNA, 16 bp, M. musculus
cagagtctgcagacac

SEQ ID NO: 378223 - DNA, 16 bp, M. musculus
cagagtgaaaggctgg

SEQ ID NO: 378224 - DNA, 16 bp, M. musculus
cagagtgaagagacag

SEQ ID NO: 378225 - DNA, 16 bp, M. musculus
cagagtgaatcccagg

SEQ ID NO: 378226 - DNA, 16 bp, M. musculus
cagagtgagagacaga

SEQ ID NO: 378227 - DNA, 16 bp, M. musculus
cagagtgagcttcagg

SEQ ID NO: 378228 - DNA, 16 bp, M. musculus
cagagtgaggtccaag

SEQ ID NO: 378229 - DNA, 16 bp, M. musculus
cagagtgaggtccagg

SEQ ID NO: 378230 - DNA, 16 bp, M. musculus
cagagtgagttctaag

SEQ ID NO: 378231 - DNA, 16 bp, M. musculus
cagagtgagttctaga

SEQ ID NO: 378232 - DNA, 16 bp, M. musculus
cagagtgatgtcagct

SEQ ID NO: 378233 - DNA, 16 bp, M. musculus
cagagtggatgtacca

SEQ ID NO: 378234 - DNA, 16 bp, M. musculus
cagagtggattccagg

SEQ ID NO: 378235 - DNA, 16 bp, M. musculus
cagagtggtgataatt

SEQ ID NO: 378236 - DNA, 16 bp, M. musculus
cagagtggttgtccca

SEQ ID NO: 378237 - DNA, 16 bp, M. musculus
cagagtgtgacctgtg

SEQ ID NO: 378238 - DNA, 16 bp, M. musculus
cagagttacagagaca

SEQ ID NO: 378239 - DNA, 16 bp, M. musculus
cagagttacaggcagt

SEQ ID NO: 378240 - DNA, 16 bp, M. musculus
cagagttagttccagg

SEQ ID NO: 378241 - DNA, 16 bp, M. musculus
cagagttcaaggccag

SEQ ID NO: 378242 - DNA, 16 bp, M. musculus
cagagttcagctccca

SEQ ID NO: 378243 - DNA, 16 bp, M. musculus
cagagttccaggacag

SEQ ID NO: 378244 - DNA, 16 bp, M. musculus
cagagttccagggcag

SEQ ID NO: 378245 - DNA, 16 bp, M. musculus
cagagttcccaggaac

SEQ ID NO: 378246 - DNA, 16 bp, M. musculus
cagagttctgcctgct

SEQ ID NO: 378247 - DNA, 16 bp, M. musculus
cagagttcttccccca

SEQ ID NO: 378248 - DNA, 16 bp, M. musculus
cagagttggttctttg

SEQ ID NO: 378249 - DNA, 16 bp, M. musculus
cagagttgtctccatt

SEQ ID NO: 378250 - DNA, 16 bp, M. musculus
cagagtttaattccca

SEQ ID NO: 378251 - DNA, 16 bp, M. musculus
cagagtttcactatgt

SEQ ID NO: 378252 - DNA, 16 bp, M. musculus
cagagtttctctctct

SEQ ID NO: 378253 - DNA, 16 bp, M. musculus
cagagtttggagctga

SEQ ID NO: 378254 - DNA, 16 bp, M. musculus
cagagtttgtggaaga

SEQ ID NO: 378255 - DNA, 16 bp, M. musculus
cagagtttttccttgt

SEQ ID NO: 378256 - DNA, 16 bp, M. musculus
cagagtttttgactgt

SEQ ID NO: 378257 - DNA, 16 bp, M. musculus
cagataaaattcaaca

SEQ ID NO: 378258 - DNA, 16 bp, M. musculus
cagataaagaaaatgt

SEQ ID NO: 378259 - DNA, 16 bp, M. musculus
cagataaatttgcaaa

SEQ ID NO: 378260 - DNA, 16 bp, M. musculus
cagatacacagatgca

SEQ ID NO: 378261 - DNA, 16 bp, M. musculus
cagatacactgaaatt

SEQ ID NO: 378262 - DNA, 16 bp, M. musculus
cagatacagaaaatgt

SEQ ID NO: 378263 - DNA, 16 bp, M. musculus
cagatacagacagaga

SEQ ID NO: 378264 - DNA, 16 bp, M. musculus
cagatacagaggtgga

SEQ ID NO: 378265 - DNA, 16 bp, M. musculus
cagatacatcagaaga

SEQ ID NO: 378266 - DNA, 16 bp, M. musculus
cagatacatccatttg

SEQ ID NO: 378267 - DNA, 16 bp, M. musculus
cagatacctggtgttc

SEQ ID NO: 378268 - DNA, 16 bp, M. musculus
cagatagaagaacata

SEQ ID NO: 378269 - DNA, 16 bp, M. musculus
cagataggcaggcagg

SEQ ID NO: 378270 - DNA, 16 bp, M. musculus
cagatatatatatata

SEQ ID NO: 378271 - DNA, 16 bp, M. musculus
cagatatccacctgcc

SEQ ID NO: 378272 - DNA, 16 bp, M. musculus
cagatatctggttttc

SEQ ID NO: 378273 - DNA, 16 bp, M. musculus
cagatatggtgctaga

SEQ ID NO: 378274 - DNA, 16 bp, M. musculus
cagatattggttggtt

SEQ ID NO: 378275 - DNA, 16 bp, M. musculus
cagatatttacattac

SEQ ID NO: 378276 - DNA, 16 bp, M. musculus
cagatatttacattag

SEQ ID NO: 378277 - DNA, 16 bp, M. musculus
cagatatttatttaca

SEQ ID NO: 378278 - DNA, 16 bp, M. musculus
cagatattttcatttt

SEQ ID NO: 378279 - DNA, 16 bp, M. musculus
cagatattttttttta

SEQ ID NO: 378280 - DNA, 16 bp, M. musculus
cagatcacagaaacag

SEQ ID NO: 378281 - DNA, 16 bp, M. musculus
cagatcacaggtctgg

SEQ ID NO: 378282 - DNA, 16 bp, M. musculus
cagatcacctggaaca

SEQ ID NO: 378283 - DNA, 16 bp, M. musculus
cagatcagaggacaac

SEQ ID NO: 378284 - DNA, 16 bp, M. musculus
cagatcagcagcttct

SEQ ID NO: 378285 - DNA, 16 bp, M. musculus
cagatccaaattttgt

SEQ ID NO: 378286 - DNA, 16 bp, M. musculus
cagatccagaaagaca

SEQ ID NO: 378287 - DNA, 16 bp, M. musculus
cagatccagagatatg

SEQ ID NO: 378288 - DNA, 16 bp, M. musculus
cagatccagatgcaga

SEQ ID NO: 378289 - DNA, 16 bp, M. musculus
cagatccagggctttg

SEQ ID NO: 378290 - DNA, 16 bp, M. musculus
cagatccagggttttg

SEQ ID NO: 378291 - DNA, 16 bp, M. musculus
cagatcccagggagct

SEQ ID NO: 378292 - DNA, 16 bp, M. musculus
cagatccccaacaccc

SEQ ID NO: 378293 - DNA, 16 bp, M. musculus
cagatccccagaaacc

SEQ ID NO: 378294 - DNA, 16 bp, M. musculus
cagatccccagaaact

SEQ ID NO: 378295 - DNA, 16 bp, M. musculus
cagatccccttagctc

SEQ ID NO: 378296 - DNA, 16 bp, M. musculus
cagatccccttataga

SEQ ID NO: 378297 - DNA, 16 bp, M. musculus
cagatccccttgaact

SEQ ID NO: 378298 - DNA, 16 bp, M. musculus
cagatccctgagttca

SEQ ID NO: 378299 - DNA, 16 bp, M. musculus
cagatccgtttagctc

SEQ ID NO: 378300 - DNA, 16 bp, M. musculus
cagatcctcagctgcc

SEQ ID NO: 378301 - DNA, 16 bp, M. musculus
cagatcctctggaact

SEQ ID NO: 378302 - DNA, 44 bp, M. musculus
cagatcctgaaccttaatgggaccagagtggaaccagtgaccct

SEQ ID NO: 378303 - DNA, 16 bp, M. musculus
cagatcctgaggcaaa

SEQ ID NO: 378304 - DNA, 16 bp, M. musculus
cagatcctggaaatgg

SEQ ID NO: 378305 - DNA, 16 bp, M. musculus
cagatctacccagatg

SEQ ID NO: 378306 - DNA, 16 bp, M. musculus
cagatctcattataga

SEQ ID NO: 378307 - DNA, 16 bp, M. musculus
cagatctccaactctt

SEQ ID NO: 378308 - DNA, 16 bp, M. musculus
cagatctccagctcct

SEQ ID NO: 378309 - DNA, 16 bp, M. musculus
cagatctctaaattca

SEQ ID NO: 378310 - DNA, 16 bp, M. musculus
cagatctctctctccc

SEQ ID NO: 378311 - DNA, 16 bp, M. musculus
cagatctctgaattca

SEQ ID NO: 378312 - DNA, 16 bp, M. musculus
cagatctctgagttaa

SEQ ID NO: 378313 - DNA, 16 bp, M. musculus
cagatctctgagttca

SEQ ID NO: 378314 - DNA, 16 bp, M. musculus
cagatctctgagtttg

SEQ ID NO: 378315 - DNA, 16 bp, M. musculus
cagatctctgtgagct

SEQ ID NO: 378316 - DNA, 16 bp, M. musculus
cagatctctgtgaggt

SEQ ID NO: 378317 - DNA, 16 bp, M. musculus
cagatctctgtgtttg

SEQ ID NO: 378318 - DNA, 16 bp, M. musculus
cagatctcttgagttt

SEQ ID NO: 378319 - DNA, 16 bp, M. musculus
cagatctgcctgcttc

SEQ ID NO: 378320 - DNA, 16 bp, M. musculus
cagatctggatgtaga

SEQ ID NO: 378321 - DNA, 16 bp, M. musculus
cagatcttgttaggga

SEQ ID NO: 378322 - DNA, 16 bp, M. musculus
cagatgaagaaaatga

SEQ ID NO: 378323 - DNA, 16 bp, M. musculus
cagatgaagaaacaga

SEQ ID NO: 378324 - DNA, 16 bp, M. musculus
cagatgaagaaatgaa

SEQ ID NO: 378325 - DNA, 16 bp, M. musculus
cagatgaagaagtaga

SEQ ID NO: 378326 - DNA, 16 bp, M. musculus
cagatgaagatattta

SEQ ID NO: 378327 - DNA, 16 bp, M. musculus
cagatgaagatgcaga

SEQ ID NO: 378328 - DNA, 16 bp, M. musculus
cagatgaagatgttga

SEQ ID NO: 378329 - DNA, 16 bp, M. musculus
cagatgaaggaaatga

SEQ ID NO: 378330 - DNA, 16 bp, M. musculus
cagatgaaggagttag

SEQ ID NO: 378331 - DNA, 16 bp, M. musculus
cagatgaatttgaaga

SEQ ID NO: 378332 - DNA, 16 bp, M. musculus
cagatgaatttgcata

SEQ ID NO: 378333 - DNA, 16 bp, M. musculus
cagatgaatttgtaga

SEQ ID NO: 378334 - DNA, 16 bp, M. musculus
cagatgactcagacag

SEQ ID NO: 378335 - DNA, 16 bp, M. musculus
cagatgagaaagaaca

SEQ ID NO: 378336 - DNA, 16 bp, M. musculus
cagatgaggaaacaga

SEQ ID NO: 378337 - DNA, 16 bp, M. musculus
cagatgaggaagcaga

SEQ ID NO: 378338 - DNA, 16 bp, M. musculus
cagatgaggcaagcca

SEQ ID NO: 378339 - DNA, 17 bp, M. musculus
cagatgatgatgatgat

SEQ ID NO: 378340 - DNA, 16 bp, M. musculus
cagatgattgtgagct

SEQ ID NO: 378341 - DNA, 16 bp, M. musculus
cagatgcacatacaca

SEQ ID NO: 378342 - DNA, 16 bp, M. musculus
cagatgcaccaaaaga

SEQ ID NO: 378343 - DNA, 16 bp, M. musculus
cagatgcagagaacca

SEQ ID NO: 378344 - DNA, 16 bp, M. musculus
cagatgcagagatcca

SEQ ID NO: 378345 - DNA, 16 bp, M. musculus
cagatgcagagattca

SEQ ID NO: 378346 - DNA, 16 bp, M. musculus
cagatgcagatactta

SEQ ID NO: 378347 - DNA, 16 bp, M. musculus
cagatgcagatatttg

SEQ ID NO: 378348 - DNA, 16 bp, M. musculus
cagatgcagatgcaga

SEQ ID NO: 378349 - DNA, 16 bp, M. musculus
cagatgccatggaggg

SEQ ID NO: 378350 - DNA, 16 bp, M. musculus
cagatgcccacagagg

SEQ ID NO: 378351 - DNA, 16 bp, M. musculus
cagatgccccagagct

SEQ ID NO: 378352 - DNA, 16 bp, M. musculus
cagatgcccctgaaca

SEQ ID NO: 378353 - DNA, 16 bp, M. musculus
cagatgccctcaacag

SEQ ID NO: 378354 - DNA, 16 bp, M. musculus
cagatgccctcttctg

SEQ ID NO: 378355 - DNA, 16 bp, M. musculus
cagatgccctgaaact

SEQ ID NO: 378356 - DNA, 16 bp, M. musculus
cagatgcctctggctg

SEQ ID NO: 378357 - DNA, 16 bp, M. musculus
cagatgctattaattc

SEQ ID NO: 378358 - DNA, 16 bp, M. musculus
cagatgctcacagcca

SEQ ID NO: 378359 - DNA, 16 bp, M. musculus
cagatgctcatagcca

SEQ ID NO: 378360 - DNA, 16 bp, M. musculus
cagatgctgaagaaat

SEQ ID NO: 378361 - DNA, 16 bp, M. musculus
cagatgctgaagagga

SEQ ID NO: 378362 - DNA, 16 bp, M. musculus
cagatgctgagttctg

SEQ ID NO: 378363 - DNA, 16 bp, M. musculus
cagatgctgatgagga

SEQ ID NO: 378364 - DNA, 16 bp, M. musculus
cagatgctgctggatg

SEQ ID NO: 378365 - DNA, 16 bp, M. musculus
cagatgctggagaaga

SEQ ID NO: 378366 - DNA, 16 bp, M. musculus
cagatgctggccagga

SEQ ID NO: 378367 - DNA, 16 bp, M. musculus
cagatgctggcttgga

SEQ ID NO: 378368 - DNA, 16 bp, M. musculus
cagatgctggggaaga

SEQ ID NO: 378369 - DNA, 16 bp, M. musculus
cagatgctggggtgga

SEQ ID NO: 378370 - DNA, 16 bp, M. musculus
cagatgctggtgtgga

SEQ ID NO: 378371 - DNA, 16 bp, M. musculus
cagatgctgtggtgaa

SEQ ID NO: 378372 - DNA, 16 bp, M. musculus
cagatgcttgtagcca

SEQ ID NO: 378373 - DNA, 16 bp, M. musculus
cagatgcttttcagtt

SEQ ID NO: 378374 - DNA, 16 bp, M. musculus
cagatggaaaacacca

SEQ ID NO: 378375 - DNA, 16 bp, M. musculus
cagatggaaagaaaga

SEQ ID NO: 378376 - DNA, 16 bp, M. musculus
cagatggacagatgga

SEQ ID NO: 378377 - DNA, 16 bp, M. musculus
cagatggagaaacaaa

SEQ ID NO: 378378 - DNA, 16 bp, M. musculus
cagatggagaaactaa

SEQ ID NO: 378379 - DNA, 16 bp, M. musculus
cagatggaggaagaga

SEQ ID NO: 378380 - DNA, 16 bp, M. musculus
cagatggaggcagatg

SEQ ID NO: 378381 - DNA, 16 bp, M. musculus
cagatggataaagaaa

SEQ ID NO: 378382 - DNA, 17 bp, M. musculus
cagatggatccaaaaca

SEQ ID NO: 378383 - DNA, 16 bp, M. musculus
cagatggatgcagaga

SEQ ID NO: 378384 - DNA, 17 bp, M. musculus
cagatggcagcagcaaa

SEQ ID NO: 378385 - DNA, 17 bp, M. musculus
cagatggcagccctggt

SEQ ID NO: 378386 - DNA, 16 bp, M. musculus
cagatggcagctcctt

SEQ ID NO: 378387 - DNA, 16 bp, M. musculus
cagatggcaggaaata

SEQ ID NO: 378388 - DNA, 16 bp, M. musculus
cagatggctcagcagg

SEQ ID NO: 378389 - DNA, 16 bp, M. musculus
cagatggctcagtggt

SEQ ID NO: 378390 - DNA, 16 bp, M. musculus
cagatggctccacaga

SEQ ID NO: 378391 - DNA, 16 bp, M. musculus
cagatgggaacagatg

SEQ ID NO: 378392 - DNA, 16 bp, M. musculus
cagatgggagttgctc

SEQ ID NO: 378393 - DNA, 16 bp, M. musculus
cagatgggcaaagagt

SEQ ID NO: 378394 - DNA, 16 bp, M. musculus
cagatgggtctctgag

SEQ ID NO: 378395 - DNA, 16 bp, M. musculus
cagatggtcctgagcc

SEQ ID NO: 378396 - DNA, 16 bp, M. musculus
cagatggtcctgggtt

SEQ ID NO: 378397 - DNA, 18 bp, M. musculus
cagatggtctcttggcct

SEQ ID NO: 378398 - DNA, 16 bp, M. musculus
cagatggtgaaaagca

SEQ ID NO: 378399 - DNA, 16 bp, M. musculus
cagatggtgaaaggca

SEQ ID NO: 378400 - DNA, 16 bp, M. musculus
cagatggttccacaga

SEQ ID NO: 378401 - DNA, 16 bp, M. musculus
cagatggttctaaaac

SEQ ID NO: 378402 - DNA, 16 bp, M. musculus
cagatggttgtgagac

SEQ ID NO: 378403 - DNA, 16 bp, M. musculus
cagatggttgtgagct

SEQ ID NO: 378404 - DNA, 16 bp, M. musculus
cagatggttgtgatct

SEQ ID NO: 378405 - DNA, 16 bp, M. musculus
cagatgtaaactctca

SEQ ID NO: 378406 - DNA, 16 bp, M. musculus
cagatgtacatgcaga

SEQ ID NO: 378407 - DNA, 16 bp, M. musculus
cagatgtacgattata

SEQ ID NO: 378408 - DNA, 16 bp, M. musculus
cagatgtaggtttggt

SEQ ID NO: 378409 - DNA, 16 bp, M. musculus
cagatgtcaacctctg

SEQ ID NO: 378410 - DNA, 16 bp, M. musculus
cagatgtcaggaggca

SEQ ID NO: 378411 - DNA, 16 bp, M. musculus
cagatgtcattacaga

SEQ ID NO: 378412 - DNA, 16 bp, M. musculus
cagatgtcctgacctc

SEQ ID NO: 378413 - DNA, 16 bp, M. musculus
cagatgtgcacacaca

SEQ ID NO: 378414 - DNA, 16 bp, M. musculus
cagatgtggatgtaca

SEQ ID NO: 378415 - DNA, 16 bp, M. musculus
cagatgtgggagggct

SEQ ID NO: 378416 - DNA, 16 bp, M. musculus
cagatgtgggtgtgct

SEQ ID NO: 378417 - DNA, 16 bp, M. musculus
cagatgtggtgctgga

SEQ ID NO: 378418 - DNA, 16 bp, M. musculus
cagatgtggtggcaca

SEQ ID NO: 378419 - DNA, 16 bp, M. musculus
cagatgtggtggtaca

SEQ ID NO: 378420 - DNA, 16 bp, M. musculus
cagatgtgtgctgctg

SEQ ID NO: 378421 - DNA, 16 bp, M. musculus
cagatgttcagtccat

SEQ ID NO: 378422 - DNA, 16 bp, M. musculus
cagatgttgaacattt

SEQ ID NO: 378423 - DNA, 16 bp, M. musculus
cagatgttgatgtcaa

SEQ ID NO: 378424 - DNA, 16 bp, M. musculus
cagatgttggcgagga

SEQ ID NO: 378425 - DNA, 16 bp, M. musculus
cagattaagggagtgg

SEQ ID NO: 378426 - DNA, 16 bp, M. musculus
cagattcaattcccag

SEQ ID NO: 378427 - DNA, 16 bp, M. musculus
cagattcagtgaaaga

SEQ ID NO: 378428 - DNA, 16 bp, M. musculus
cagattcattcattcc

SEQ ID NO: 378429 - DNA, 16 bp, M. musculus
cagattccattcccag

SEQ ID NO: 378430 - DNA, 16 bp, M. musculus
cagattcccctctccc

SEQ ID NO: 378431 - DNA, 16 bp, M. musculus
cagattcctgccaagc

SEQ ID NO: 378432 - DNA, 16 bp, M. musculus
cagattcctgcctgaa

SEQ ID NO: 378433 - DNA, 16 bp, M. musculus
cagattctatctcccc

SEQ ID NO: 378434 - DNA, 16 bp, M. musculus
cagattctatttcctt

SEQ ID NO: 378435 - DNA, 16 bp, M. musculus
cagattcttctcaaca

SEQ ID NO: 378436 - DNA, 16 bp, M. musculus
cagattgagaaaaaaa

SEQ ID NO: 378437 - DNA, 16 bp, M. musculus
cagattgggaaagtat

SEQ ID NO: 378438 - DNA, 17 bp, M. musculus
cagattgtggccaagaa

SEQ ID NO: 378439 - DNA, 16 bp, M. musculus
cagattgtttcttcag

SEQ ID NO: 378440 - DNA, 16 bp, M. musculus
cagattgttttccaga

SEQ ID NO: 378441 - DNA, 16 bp, M. musculus
cagatttattttttaa

SEQ ID NO: 378442 - DNA, 16 bp, M. musculus
cagatttcattatgga

SEQ ID NO: 378443 - DNA, 17 bp, M. musculus
cagatttccagttcagt

SEQ ID NO: 378444 - DNA, 16 bp, M. musculus
cagatttccattcatt

SEQ ID NO: 378445 - DNA, 16 bp, M. musculus
cagatttctaagttca

SEQ ID NO: 378446 - DNA, 16 bp, M. musculus
cagatttctgaattct

SEQ ID NO: 378447 - DNA, 16 bp, M. musculus
cagatttctgagttca

SEQ ID NO: 378448 - DNA, 16 bp, M. musculus
cagatttctgagttcc

SEQ ID NO: 378449 - DNA, 16 bp, M. musculus
cagatttctgagttcg

SEQ ID NO: 378450 - DNA, 16 bp, M. musculus
cagatttctgagttgg

SEQ ID NO: 378451 - DNA, 16 bp, M. musculus
cagatttctgagtttg

SEQ ID NO: 378452 - DNA, 16 bp, M. musculus
cagatttctttcatag

SEQ ID NO: 378453 - DNA, 16 bp, M. musculus
cagatttgaattctct

SEQ ID NO: 378454 - DNA, 16 bp, M. musculus
cagatttgggggtggg

SEQ ID NO: 378455 - DNA, 16 bp, M. musculus
cagattttatccccct

SEQ ID NO: 378456 - DNA, 16 bp, M. musculus
cagattttcttttctt

SEQ ID NO: 378457 - DNA, 16 bp, M. musculus
cagatttttacagttc

SEQ ID NO: 378458 - DNA, 16 bp, M. musculus
cagatttttgagtttg

SEQ ID NO: 378459 - DNA, 16 bp, M. musculus
cagatttttttctttg

SEQ ID NO: 378460 - DNA, 16 bp, M. musculus
cagattttttttcaga

SEQ ID NO: 378461 - DNA, 16 bp, M. musculus
cagatttttttttctc

SEQ ID NO: 378462 - DNA, 16 bp, M. musculus
cagcaaaaacttgcta

SEQ ID NO: 378463 - DNA, 16 bp, M. musculus
cagcaaaaacttgctg

SEQ ID NO: 378464 - DNA, 16 bp, M. musculus
cagcaaaacattcttt

SEQ ID NO: 378465 - DNA, 16 bp, M. musculus
cagcaaaagccattgc

SEQ ID NO: 378466 - DNA, 16 bp, M. musculus
cagcaaaataatagaa

SEQ ID NO: 378467 - DNA, 16 bp, M. musculus
cagcaaaatgatggat

SEQ ID NO: 378468 - DNA, 16 bp, M. musculus
cagcaaaatggctgga

SEQ ID NO: 378469 - DNA, 16 bp, M. musculus
cagcaaacagccattt

SEQ ID NO: 378470 - DNA, 16 bp, M. musculus
cagcaaacctgggaga

SEQ ID NO: 378471 - DNA, 16 bp, M. musculus
cagcaaactccaggct

SEQ ID NO: 378472 - DNA, 16 bp, M. musculus
cagcaaactgatttcc

SEQ ID NO: 378473 - DNA, 16 bp, M. musculus
cagcaaagcaccatcc

SEQ ID NO: 378474 - DNA, 16 bp, M. musculus
cagcaaagcatgggtt

SEQ ID NO: 378475 - DNA, 16 bp, M. musculus
cagcaaaggcaggcag

SEQ ID NO: 378476 - DNA, 16 bp, M. musculus
cagcaaagtatctgga

SEQ ID NO: 378477 - DNA, 16 bp, M. musculus
cagcaaagtggaagtg

SEQ ID NO: 378478 - DNA, 16 bp, M. musculus
cagcaaatgctggcaa

SEQ ID NO: 378479 - DNA, 16 bp, M. musculus
cagcaaatgtcttcaa

SEQ ID NO: 378480 - DNA, 16 bp, M. musculus
cagcaaatgttgggtc

SEQ ID NO: 378481 - DNA, 16 bp, M. musculus
cagcaacaaagacaga

SEQ ID NO: 378482 - DNA, 16 bp, M. musculus
cagcaacagagaagca

SEQ ID NO: 378483 - DNA, 16 bp, M. musculus
cagcaacagcaacaga

SEQ ID NO: 378484 - DNA, 16 bp, M. musculus
cagcaacagcagcaag

SEQ ID NO: 378485 - DNA, 16 bp, M. musculus
cagcaacagcagcaga

SEQ ID NO: 378486 - DNA, 16 bp, M. musculus
cagcaacaggaaagga

SEQ ID NO: 378487 - DNA, 16 bp, M. musculus
cagcaacaggaaatga

SEQ ID NO: 378488 - DNA, 16 bp, M. musculus
cagcaacatggcttct

SEQ ID NO: 378489 - DNA, 16 bp, M. musculus
cagcaacattttgctg

SEQ ID NO: 378490 - DNA, 16 bp, M. musculus
cagcaaccacagggtg

SEQ ID NO: 378491 - DNA, 17 bp, M. musculus
cagcaaccacagggtgg

SEQ ID NO: 378492 - DNA, 16 bp, M. musculus
cagcaaccacatggtc

SEQ ID NO: 378493 - DNA, 16 bp, M. musculus
cagcaaccacttggtg

SEQ ID NO: 378494 - DNA, 16 bp, M. musculus
cagcaaccccatggtg

SEQ ID NO: 378495 - DNA, 16 bp, M. musculus
cagcaacctacagaat

SEQ ID NO: 378496 - DNA, 16 bp, M. musculus
cagcaacgacatggtg

SEQ ID NO: 378497 - DNA, 16 bp, M. musculus
cagcaactcctataaa

SEQ ID NO: 378498 - DNA, 16 bp, M. musculus
cagcaacttgggaggc

SEQ ID NO: 378499 - DNA, 16 bp, M. musculus
cagcaagaacttgttg

SEQ ID NO: 378500 - DNA, 16 bp, M. musculus
cagcaagaagcagctg

SEQ ID NO: 378501 - DNA, 16 bp, M. musculus
cagcaagaagccacag

SEQ ID NO: 378502 - DNA, 16 bp, M. musculus
cagcaagaatttgctg

SEQ ID NO: 378503 - DNA, 16 bp, M. musculus
cagcaagacagctcag

SEQ ID NO: 378504 - DNA, 16 bp, M. musculus
cagcaagaccaaacct

SEQ ID NO: 378505 - DNA, 16 bp, M. musculus
cagcaagactgtctca

SEQ ID NO: 378506 - DNA, 16 bp, M. musculus
cagcaagagcagcagc

SEQ ID NO: 378507 - DNA, 16 bp, M. musculus
cagcaagaggagagct

SEQ ID NO: 378508 - DNA, 40 bp, M. musculus
cagcaagaggctttattgggaacacgggtacccgggcgac

SEQ ID NO: 378509 - DNA, 16 bp, M. musculus
cagcaagataaaatgt

SEQ ID NO: 378510 - DNA, 16 bp, M. musculus
cagcaagatggagaag

SEQ ID NO: 378511 - DNA, 16 bp, M. musculus
cagcaagatggccatt

SEQ ID NO: 378512 - DNA, 16 bp, M. musculus
cagcaagatggctcaa

SEQ ID NO: 378513 - DNA, 16 bp, M. musculus
cagcaagatggctcag

SEQ ID NO: 378514 - DNA, 16 bp, M. musculus
cagcaagattttgcta

SEQ ID NO: 378515 - DNA, 17 bp, M. musculus
cagcaagattttgctga

SEQ ID NO: 378516 - DNA, 16 bp, M. musculus
cagcaagcacctctac

SEQ ID NO: 378517 - DNA, 16 bp, M. musculus
cagcaagcactttatc

SEQ ID NO: 378518 - DNA, 16 bp, M. musculus
cagcaagcactttgcc

SEQ ID NO: 378519 - DNA, 16 bp, M. musculus
cagcaagcagaggcag

SEQ ID NO: 378520 - DNA, 16 bp, M. musculus
cagcaagccccaggaa

SEQ ID NO: 378521 - DNA, 16 bp, M. musculus
cagcaagccccaggga

SEQ ID NO: 378522 - DNA, 16 bp, M. musculus
cagcaagctccaggaa

SEQ ID NO: 378523 - DNA, 16 bp, M. musculus
cagcaagctccaggga

SEQ ID NO: 378524 - DNA, 16 bp, M. musculus
cagcaaggaggagact

SEQ ID NO: 378525 - DNA, 16 bp, M. musculus
cagcaaggccatatct

SEQ ID NO: 378526 - DNA, 95 bp, M. musculus
cagcaagggaaattcataccttatgtgctcccactcccggttaacctctggggaagggatattatgcagcatttgggccttattttgtccaatga

SEQ ID NO: 378527 - DNA, 16 bp, M. musculus
cagcaagggctaaact

SEQ ID NO: 378528 - DNA, 16 bp, M. musculus
cagcaaggtcaaggtc

SEQ ID NO: 378529 - DNA, 16 bp, M. musculus
cagcaaggtggctcag

SEQ ID NO: 378530 - DNA, 16 bp, M. musculus
cagcaagtcccagatg

SEQ ID NO: 378531 - DNA, 16 bp, M. musculus
cagcaagtgttcttca

SEQ ID NO: 378532 - DNA, 32 bp, M. musculus
cagcaagttaggaatgcttcagaattggacct

SEQ ID NO: 378533 - DNA, 16 bp, M. musculus
cagcaagttcaaggcc

SEQ ID NO: 378534 - DNA, 16 bp, M. musculus
cagcaagttccaggcc

SEQ ID NO: 378535 - DNA, 16 bp, M. musculus
cagcaataaaagaact

SEQ ID NO: 378536 - DNA, 16 bp, M. musculus
cagcaatagaaagcct

SEQ ID NO: 378537 - DNA, 16 bp, M. musculus
cagcaatatggaagta

SEQ ID NO: 378538 - DNA, 16 bp, M. musculus
cagcaatccccctgcc

SEQ ID NO: 378539 - DNA, 16 bp, M. musculus
cagcaatcctcctgca

SEQ ID NO: 378540 - DNA, 16 bp, M. musculus
cagcaatgaacatggt

SEQ ID NO: 378541 - DNA, 16 bp, M. musculus
cagcaatgaacccaca

SEQ ID NO: 378542 - DNA, 16 bp, M. musculus
cagcaatgagaaaaat

SEQ ID NO: 378543 - DNA, 16 bp, M. musculus
cagcaatggacagatc

SEQ ID NO: 378544 - DNA, 16 bp, M. musculus
cagcaatggcctgtgc

SEQ ID NO: 378545 - DNA, 16 bp, M. musculus
cagcaatggcttgtgt

SEQ ID NO: 378546 - DNA, 16 bp, M. musculus
cagcaatttctttaat

SEQ ID NO: 378547 - DNA, 16 bp, M. musculus
cagcacaagccgttgc

SEQ ID NO: 378548 - DNA, 16 bp, M. musculus
cagcacacacatggca

SEQ ID NO: 378549 - DNA, 16 bp, M. musculus
cagcacacacctttaa

SEQ ID NO: 378550 - DNA, 16 bp, M. musculus
cagcacacagacacac

SEQ ID NO: 378551 - DNA, 16 bp, M. musculus
cagcacacagcacaca

SEQ ID NO: 378552 - DNA, 16 bp, M. musculus
cagcacacagcacagc

SEQ ID NO: 378553 - DNA, 16 bp, M. musculus
cagcacacatgtgcac

SEQ ID NO: 378554 - DNA, 16 bp, M. musculus
cagcacacatgtggag

SEQ ID NO: 378555 - DNA, 16 bp, M. musculus
cagcacacccaaaaag

SEQ ID NO: 378556 - DNA, 16 bp, M. musculus
cagcacacctagaaac

SEQ ID NO: 378557 - DNA, 16 bp, M. musculus
cagcacactgtgggtg

SEQ ID NO: 378558 - DNA, 16 bp, M. musculus
cagcacagacagacac

SEQ ID NO: 378559 - DNA, 16 bp, M. musculus
cagcacagaccacaga

SEQ ID NO: 378560 - DNA, 17 bp, M. musculus
cagcacagcacagcaca

SEQ ID NO: 378561 - DNA, 16 bp, M. musculus
cagcacagcacagccc

SEQ ID NO: 378562 - DNA, 16 bp, M. musculus
cagcacagcacagctc

SEQ ID NO: 378563 - DNA, 16 bp, M. musculus
cagcacagcccagccc

SEQ ID NO: 378564 - DNA, 16 bp, M. musculus
cagcacaggaggagga

SEQ ID NO: 378565 - DNA, 16 bp, M. musculus
cagcacagtgccctcg

SEQ ID NO: 378566 - DNA, 16 bp, M. musculus
cagcacagtgcctggc

SEQ ID NO: 378567 - DNA, 16 bp, M. musculus
cagcacatatactaaa

SEQ ID NO: 378568 - DNA, 16 bp, M. musculus
cagcacatatgtaaca

SEQ ID NO: 378569 - DNA, 16 bp, M. musculus
cagcacatctgtccag

SEQ ID NO: 378570 - DNA, 16 bp, M. musculus
cagcacatgggagaca

SEQ ID NO: 378571 - DNA, 16 bp, M. musculus
cagcacatgttggcaa

SEQ ID NO: 378572 - DNA, 16 bp, M. musculus
cagcaccaactgttgc

SEQ ID NO: 378573 - DNA, 16 bp, M. musculus
cagcaccacacctgcc

SEQ ID NO: 378574 - DNA, 16 bp, M. musculus
cagcaccacagaaacc

SEQ ID NO: 378575 - DNA, 16 bp, M. musculus
cagcaccacatctgcc

SEQ ID NO: 378576 - DNA, 16 bp, M. musculus
cagcaccaccagcagc

SEQ ID NO: 378577 - DNA, 16 bp, M. musculus
cagcaccacggacagc

SEQ ID NO: 378578 - DNA, 16 bp, M. musculus
cagcaccagggcacct

SEQ ID NO: 378579 - DNA, 16 bp, M. musculus
cagcaccagggttcct

SEQ ID NO: 378580 - DNA, 17 bp, M. musculus
cagcaccatcagcacca

SEQ ID NO: 378581 - DNA, 16 bp, M. musculus
cagcaccatgcctacc

SEQ ID NO: 378582 - DNA, 16 bp, M. musculus
cagcaccatgtctggc

SEQ ID NO: 378583 - DNA, 16 bp, M. musculus
cagcaccattttcctt

SEQ ID NO: 378584 - DNA, 16 bp, M. musculus
cagcacccacaaagca

SEQ ID NO: 378585 - DNA, 16 bp, M. musculus
cagcacccacactgag

SEQ ID NO: 378586 - DNA, 16 bp, M. musculus
cagcacccacactgca

SEQ ID NO: 378587 - DNA, 16 bp, M. musculus
cagcacccacagaaaa

SEQ ID NO: 378588 - DNA, 16 bp, M. musculus
cagcacccacatcagc

SEQ ID NO: 378589 - DNA, 16 bp, M. musculus
cagcacccacatgaca

SEQ ID NO: 378590 - DNA, 16 bp, M. musculus
cagcacccacatgact

SEQ ID NO: 378591 - DNA, 16 bp, M. musculus
cagcacccacatgatg

SEQ ID NO: 378592 - DNA, 16 bp, M. musculus
cagcacccacattggt

SEQ ID NO: 378593 - DNA, 16 bp, M. musculus
cagcacccaggaccac

SEQ ID NO: 378594 - DNA, 18 bp, M. musculus
cagcacccaggccaagaa

SEQ ID NO: 378595 - DNA, 16 bp, M. musculus
cagcacccatgtaaaa

SEQ ID NO: 378596 - DNA, 16 bp, M. musculus
cagcacccatgtctgg

SEQ ID NO: 378597 - DNA, 16 bp, M. musculus
cagcacccatgtggag

SEQ ID NO: 378598 - DNA, 16 bp, M. musculus
cagcaccctccatggc

SEQ ID NO: 378599 - DNA, 16 bp, M. musculus
cagcaccctggaggca

SEQ ID NO: 378600 - DNA, 16 bp, M. musculus
cagcaccgggtcacct

SEQ ID NO: 378601 - DNA, 16 bp, M. musculus
cagcacctacatggct

SEQ ID NO: 378602 - DNA, 16 bp, M. musculus
cagcacctgggaggtg

SEQ ID NO: 378603 - DNA, 16 bp, M. musculus
cagcacgtgctcttaa

SEQ ID NO: 378604 - DNA, 16 bp, M. musculus
cagcactaagaaggca

SEQ ID NO: 378605 - DNA, 16 bp, M. musculus
cagcactaaggaggca

SEQ ID NO: 378606 - DNA, 16 bp, M. musculus
cagcactacagaggat

SEQ ID NO: 378607 - DNA, 16 bp, M. musculus
cagcactatgaaagct

SEQ ID NO: 378608 - DNA, 16 bp, M. musculus
cagcactcagaagtca

SEQ ID NO: 378609 - DNA, 16 bp, M. musculus
cagcactcaggaaact

SEQ ID NO: 378610 - DNA, 16 bp, M. musculus
cagcactcaggaagcc

SEQ ID NO: 378611 - DNA, 16 bp, M. musculus
cagcactcaggaagct

SEQ ID NO: 378612 - DNA, 16 bp, M. musculus
cagcactcaggagaga

SEQ ID NO: 378613 - DNA, 16 bp, M. musculus
cagcactcaggagagt

SEQ ID NO: 378614 - DNA, 18 bp, M. musculus
cagcactcaggaggcagg

SEQ ID NO: 378615 - DNA, 16 bp, M. musculus
cagcactcaggagtca

SEQ ID NO: 378616 - DNA, 16 bp, M. musculus
cagcactcccacctca

SEQ ID NO: 378617 - DNA, 16 bp, M. musculus
cagcactcctccacag

SEQ ID NO: 378618 - DNA, 16 bp, M. musculus
cagcactcctccacgg

SEQ ID NO: 378619 - DNA, 16 bp, M. musculus
cagcactcctgtgaga

SEQ ID NO: 378620 - DNA, 16 bp, M. musculus
cagcactctggaggca

SEQ ID NO: 378621 - DNA, 16 bp, M. musculus
cagcactgaaaacaaa

SEQ ID NO: 378622 - DNA, 16 bp, M. musculus
cagcactgactgacag

SEQ ID NO: 378623 - DNA, 16 bp, M. musculus
cagcactgactgttct

SEQ ID NO: 378624 - DNA, 16 bp, M. musculus
cagcactgccccagct

SEQ ID NO: 378625 - DNA, 16 bp, M. musculus
cagcactggagaggct

SEQ ID NO: 378626 - DNA, 16 bp, M. musculus
cagcactggctgtcct

SEQ ID NO: 378627 - DNA, 16 bp, M. musculus
cagcactgggaagaaa

SEQ ID NO: 378628 - DNA, 16 bp, M. musculus
cagcactgggaaggtt

SEQ ID NO: 378629 - DNA, 16 bp, M. musculus
cagcactgggattata

SEQ ID NO: 378630 - DNA, 16 bp, M. musculus
cagcactggggaggcg

SEQ ID NO: 378631 - DNA, 16 bp, M. musculus
cagcactggggcacct

SEQ ID NO: 378632 - DNA, 16 bp, M. musculus
cagcactggggtgcct

SEQ ID NO: 378633 - DNA, 16 bp, M. musculus
cagcactgtgcctgcc

SEQ ID NO: 378634 - DNA, 16 bp, M. musculus
cagcactgtgtctgcc

SEQ ID NO: 378635 - DNA, 16 bp, M. musculus
cagcacttggaatgca

SEQ ID NO: 378636 - DNA, 17 bp, M. musculus
cagcacttgggaggcca

SEQ ID NO: 378637 - DNA, 16 bp, M. musculus
cagcacttgggaggtg

SEQ ID NO: 378638 - DNA, 16 bp, M. musculus
cagcacttggggaagc

SEQ ID NO: 378639 - DNA, 16 bp, M. musculus
cagcacttggtaggca

SEQ ID NO: 378640 - DNA, 16 bp, M. musculus
cagcactttgggaggc

SEQ ID NO: 378641 - DNA, 16 bp, M. musculus
cagcagaaacaagaga

SEQ ID NO: 378642 - DNA, 16 bp, M. musculus
cagcagaaagaacaga

SEQ ID NO: 378643 - DNA, 16 bp, M. musculus
cagcagaaagaaggga

SEQ ID NO: 378644 - DNA, 16 bp, M. musculus
cagcagaaaggactgg

SEQ ID NO: 378645 - DNA, 16 bp, M. musculus
cagcagaactctgcag

SEQ ID NO: 378646 - DNA, 16 bp, M. musculus
cagcagaagagctgag

SEQ ID NO: 378647 - DNA, 16 bp, M. musculus
cagcagaagaggacat

SEQ ID NO: 378648 - DNA, 16 bp, M. musculus
cagcagaagcagcagg

SEQ ID NO: 378649 - DNA, 16 bp, M. musculus
cagcagaagctggcaa

SEQ ID NO: 378650 - DNA, 16 bp, M. musculus
cagcagaagctggtga

SEQ ID NO: 378651 - DNA, 16 bp, M. musculus
cagcagaaggaggagg

SEQ ID NO: 378652 - DNA, 16 bp, M. musculus
cagcagaaggtggagc

SEQ ID NO: 378653 - DNA, 16 bp, M. musculus
cagcagaatggaagtg

SEQ ID NO: 378654 - DNA, 16 bp, M. musculus
cagcagacaagacaga

SEQ ID NO: 378655 - DNA, 16 bp, M. musculus
cagcagacagccccat

SEQ ID NO: 378656 - DNA, 16 bp, M. musculus
cagcagaccagggaga

SEQ ID NO: 378657 - DNA, 16 bp, M. musculus
cagcagaccctggaga

SEQ ID NO: 378658 - DNA, 16 bp, M. musculus
cagcagacctgagaga

SEQ ID NO: 378659 - DNA, 16 bp, M. musculus
cagcagacctgggaaa

SEQ ID NO: 378660 - DNA, 16 bp, M. musculus
cagcagagatggaaga

SEQ ID NO: 378661 - DNA, 16 bp, M. musculus
cagcagagcacagcac

SEQ ID NO: 378662 - DNA, 16 bp, M. musculus
cagcagagcagctggg

SEQ ID NO: 378663 - DNA, 16 bp, M. musculus
cagcagagccaggaga

SEQ ID NO: 378664 - DNA, 16 bp, M. musculus
cagcagaggaaagaga

SEQ ID NO: 378665 - DNA, 16 bp, M. musculus
cagcagaggaagagag

SEQ ID NO: 378666 - DNA, 16 bp, M. musculus
cagcagaggcagaagc

SEQ ID NO: 378667 - DNA, 16 bp, M. musculus
cagcagaggcagacag

SEQ ID NO: 378668 - DNA, 16 bp, M. musculus
cagcagaggcagaggc

SEQ ID NO: 378669 - DNA, 16 bp, M. musculus
cagcagaggcagcagc

SEQ ID NO: 378670 - DNA, 16 bp, M. musculus
cagcagaggcagctga

SEQ ID NO: 378671 - DNA, 16 bp, M. musculus
cagcagaggcagctgg

SEQ ID NO: 378672 - DNA, 16 bp, M. musculus
cagcagaggcaggcag

SEQ ID NO: 378673 - DNA, 16 bp, M. musculus
cagcagaggcagtgga

SEQ ID NO: 378674 - DNA, 16 bp, M. musculus
cagcagaggctgagag

SEQ ID NO: 378675 - DNA, 16 bp, M. musculus
cagcagagggcagcag

SEQ ID NO: 378676 - DNA, 16 bp, M. musculus
cagcagaggtcctaaa

SEQ ID NO: 378677 - DNA, 16 bp, M. musculus
cagcagatagtttctg

SEQ ID NO: 378678 - DNA, 16 bp, M. musculus
cagcagatgatggtga

SEQ ID NO: 378679 - DNA, 16 bp, M. musculus
cagcagatgctgctga

SEQ ID NO: 378680 - DNA, 16 bp, M. musculus
cagcagatgctggagt

SEQ ID NO: 378681 - DNA, 16 bp, M. musculus
cagcagatgctggcat

SEQ ID NO: 378682 - DNA, 16 bp, M. musculus
cagcagatgctggcct

SEQ ID NO: 378683 - DNA, 16 bp, M. musculus
cagcagatgctggctt

SEQ ID NO: 378684 - DNA, 16 bp, M. musculus
cagcagatggaaacag

SEQ ID NO: 378685 - DNA, 16 bp, M. musculus
cagcagatggacatca

SEQ ID NO: 378686 - DNA, 16 bp, M. musculus
cagcagatggcagcac

SEQ ID NO: 378687 - DNA, 16 bp, M. musculus
cagcagatggcagcag

SEQ ID NO: 378688 - DNA, 16 bp, M. musculus
cagcagatgtggagaa

SEQ ID NO: 378689 - DNA, 16 bp, M. musculus
cagcagattgggaaag

SEQ ID NO: 378690 - DNA, 16 bp, M. musculus
cagcagcaaaacccta

SEQ ID NO: 378691 - DNA, 16 bp, M. musculus
cagcagcaacaacaat

SEQ ID NO: 378692 - DNA, 16 bp, M. musculus
cagcagcaacaacatc

SEQ ID NO: 378693 - DNA, 16 bp, M. musculus
cagcagcaacaataaa

SEQ ID NO: 378694 - DNA, 16 bp, M. musculus
cagcagcaacagcaat

SEQ ID NO: 378695 - DNA, 16 bp, M. musculus
cagcagcaacagcagg

SEQ ID NO: 378696 - DNA, 16 bp, M. musculus
cagcagcaacagcagt

SEQ ID NO: 378697 - DNA, 16 bp, M. musculus
cagcagcacacagcag

SEQ ID NO: 378698 - DNA, 16 bp, M. musculus
cagcagcacacagcca

SEQ ID NO: 378699 - DNA, 16 bp, M. musculus
cagcagcaccagcagc

SEQ ID NO: 378700 - DNA, 16 bp, M. musculus
cagcagcacccaggcc

SEQ ID NO: 378701 - DNA, 16 bp, M. musculus
cagcagcacctggaat

SEQ ID NO: 378702 - DNA, 16 bp, M. musculus
cagcagcagaaagcaa

SEQ ID NO: 378703 - DNA, 16 bp, M. musculus
cagcagcagcaacaat

SEQ ID NO: 378704 - DNA, 16 bp, M. musculus
cagcagcagcaacaca

SEQ ID NO: 378705 - DNA, 16 bp, M. musculus
cagcagcagcaacaga

SEQ ID NO: 378706 - DNA, 16 bp, M. musculus
cagcagcagcaacagg

SEQ ID NO: 378707 - DNA, 16 bp, M. musculus
cagcagcagcaacatc

SEQ ID NO: 378708 - DNA, 16 bp, M. musculus
cagcagcagcaccagc

SEQ ID NO: 378709 - DNA, 16 bp, M. musculus
cagcagcagcagagga

SEQ ID NO: 378710 - DNA, 16 bp, M. musculus
cagcagcagcagcaat

SEQ ID NO: 378711 - DNA, 16 bp, M. musculus
cagcagcagcagcagc

SEQ ID NO: 378712 - DNA, 16 bp, M. musculus
cagcagcagcagcatg

SEQ ID NO: 378713 - DNA, 16 bp, M. musculus
cagcagcagcagccac

SEQ ID NO: 378714 - DNA, 16 bp, M. musculus
cagcagcagcagcctg

SEQ ID NO: 378715 - DNA, 16 bp, M. musculus
cagcagcagcagcctt

SEQ ID NO: 378716 - DNA, 16 bp, M. musculus
cagcagcagcagcttc

SEQ ID NO: 378717 - DNA, 16 bp, M. musculus
cagcagcagcagcttg

SEQ ID NO: 378718 - DNA, 16 bp, M. musculus
cagcagcagcaggctg

SEQ ID NO: 378719 - DNA, 16 bp, M. musculus
cagcagcagcagtgga

SEQ ID NO: 378720 - DNA, 16 bp, M. musculus
cagcagcagcagtggg

SEQ ID NO: 378721 - DNA, 16 bp, M. musculus
cagcagcagcagtggt

SEQ ID NO: 378722 - DNA, 16 bp, M. musculus
cagcagcagcattagc

SEQ ID NO: 378723 - DNA, 16 bp, M. musculus
cagcagcagcggcagc

SEQ ID NO: 378724 - DNA, 16 bp, M. musculus
cagcagcagctccatc

SEQ ID NO: 378725 - DNA, 16 bp, M. musculus
cagcagcagctgtgga

SEQ ID NO: 378726 - DNA, 16 bp, M. musculus
cagcagcaggagcagg

SEQ ID NO: 378727 - DNA, 16 bp, M. musculus
cagcagcaggaggtga

SEQ ID NO: 378728 - DNA, 17 bp, M. musculus
cagcagcagtggcagca

SEQ ID NO: 378729 - DNA, 16 bp, M. musculus
cagcagcataagacag

SEQ ID NO: 378730 - DNA, 16 bp, M. musculus
cagcagcatcaccatc

SEQ ID NO: 378731 - DNA, 16 bp, M. musculus
cagcagccaatggaaa

SEQ ID NO: 378732 - DNA, 16 bp, M. musculus
cagcagccacctgtag

SEQ ID NO: 378733 - DNA, 16 bp, M. musculus
cagcagccagcagcag

SEQ ID NO: 378734 - DNA, 16 bp, M. musculus
cagcagccagcagctg

SEQ ID NO: 378735 - DNA, 16 bp, M. musculus
cagcagccatcagttg

SEQ ID NO: 378736 - DNA, 16 bp, M. musculus
cagcagcccagttcag

SEQ ID NO: 378737 - DNA, 16 bp, M. musculus
cagcagccgcagcagc

SEQ ID NO: 378738 - DNA, 16 bp, M. musculus
cagcagcctcctcctc

SEQ ID NO: 378739 - DNA, 16 bp, M. musculus
cagcagctaactcaga

SEQ ID NO: 378740 - DNA, 16 bp, M. musculus
cagcagctaagagcat

SEQ ID NO: 378741 - DNA, 16 bp, M. musculus
cagcagctctcaacct

SEQ ID NO: 378742 - DNA, 16 bp, M. musculus
cagcagctctctagga

SEQ ID NO: 378743 - DNA, 16 bp, M. musculus
cagcagctgagagaca

SEQ ID NO: 378744 - DNA, 16 bp, M. musculus
cagcagctgagagcac

SEQ ID NO: 378745 - DNA, 16 bp, M. musculus
cagcagctgatgaaaa

SEQ ID NO: 378746 - DNA, 16 bp, M. musculus
cagcagctgatggaga

SEQ ID NO: 378747 - DNA, 16 bp, M. musculus
cagcagctgattgaga

SEQ ID NO: 378748 - DNA, 16 bp, M. musculus
cagcagctgcagctgc

SEQ ID NO: 378749 - DNA, 16 bp, M. musculus
cagcagctgcagctgg

SEQ ID NO: 378750 - DNA, 16 bp, M. musculus
cagcagctgccaggag

SEQ ID NO: 378751 - DNA, 16 bp, M. musculus
cagcagctgctgctgt

SEQ ID NO: 378752 - DNA, 16 bp, M. musculus
cagcagctgctgcttc

SEQ ID NO: 378753 - DNA, 16 bp, M. musculus
cagcagctgctgtcac

SEQ ID NO: 378754 - DNA, 16 bp, M. musculus
cagcagctggacacac

SEQ ID NO: 378755 - DNA, 16 bp, M. musculus
cagcagctgtggctac

SEQ ID NO: 378756 - DNA, 16 bp, M. musculus
cagcagcttctggaac

SEQ ID NO: 378757 - DNA, 16 bp, M. musculus
cagcagcttctggacc

SEQ ID NO: 378758 - DNA, 16 bp, M. musculus
cagcagcttttacagg

SEQ ID NO: 378759 - DNA, 16 bp, M. musculus
cagcaggaaaagagag

SEQ ID NO: 378760 - DNA, 16 bp, M. musculus
cagcaggaaacaatca

SEQ ID NO: 378761 - DNA, 16 bp, M. musculus
cagcaggaacagctga

SEQ ID NO: 378762 - DNA, 16 bp, M. musculus
cagcaggaacagggaa

SEQ ID NO: 378763 - DNA, 16 bp, M. musculus
cagcaggaacctggag

SEQ ID NO: 378764 - DNA, 16 bp, M. musculus
cagcaggaactgctgg

SEQ ID NO: 378765 - DNA, 16 bp, M. musculus
cagcaggaagaaagag

SEQ ID NO: 378766 - DNA, 16 bp, M. musculus
cagcaggaagacaagg

SEQ ID NO: 378767 - DNA, 16 bp, M. musculus
cagcaggaagaggcag

SEQ ID NO: 378768 - DNA, 16 bp, M. musculus
cagcaggaaggtggag

SEQ ID NO: 378769 - DNA, 16 bp, M. musculus
cagcaggaatgttttc

SEQ ID NO: 378770 - DNA, 16 bp, M. musculus
cagcaggactaagcac

SEQ ID NO: 378771 - DNA, 16 bp, M. musculus
cagcaggagactgtgt

SEQ ID NO: 378772 - DNA, 16 bp, M. musculus
cagcaggagcagcagg

SEQ ID NO: 378773 - DNA, 16 bp, M. musculus
cagcaggagcaggaag

SEQ ID NO: 378774 - DNA, 16 bp, M. musculus
cagcaggagcaggggc

SEQ ID NO: 378775 - DNA, 16 bp, M. musculus
cagcaggagccaccac

SEQ ID NO: 378776 - DNA, 16 bp, M. musculus
cagcaggaggaactgt

SEQ ID NO: 378777 - DNA, 16 bp, M. musculus
cagcaggaggaagagg

SEQ ID NO: 378778 - DNA, 16 bp, M. musculus
cagcaggaggagcagc

SEQ ID NO: 378779 - DNA, 16 bp, M. musculus
cagcaggaggagcagg

SEQ ID NO: 378780 - DNA, 16 bp, M. musculus
cagcaggaggcagagg

SEQ ID NO: 378781 - DNA, 16 bp, M. musculus
cagcaggagtgtgagg

SEQ ID NO: 378782 - DNA, 16 bp, M. musculus
cagcaggcaaagtaca

SEQ ID NO: 378783 - DNA, 16 bp, M. musculus
cagcaggcacacatgt

SEQ ID NO: 378784 - DNA, 16 bp, M. musculus
cagcaggcagcagaaa

SEQ ID NO: 378785 - DNA, 16 bp, M. musculus
cagcaggcagcaggca

SEQ ID NO: 378786 - DNA, 16 bp, M. musculus
cagcagggagacagag

SEQ ID NO: 378787 - DNA, 16 bp, M. musculus
cagcagggccagctct

SEQ ID NO: 378788 - DNA, 16 bp, M. musculus
cagcagggcttcctct

SEQ ID NO: 378789 - DNA, 16 bp, M. musculus
cagcaggtaaagacac

SEQ ID NO: 378790 - DNA, 16 bp, M. musculus
cagcaggtaaaggtgt

SEQ ID NO: 378791 - DNA, 16 bp, M. musculus
cagcaggtacctctca

SEQ ID NO: 378792 - DNA, 16 bp, M. musculus
cagcaggtggcgctgt

SEQ ID NO: 378793 - DNA, 16 bp, M. musculus
cagcagtagccagcac

SEQ ID NO: 378794 - DNA, 16 bp, M. musculus
cagcagtatggtggtg

SEQ ID NO: 378795 - DNA, 16 bp, M. musculus
cagcagtcaggagaca

SEQ ID NO: 378796 - DNA, 16 bp, M. musculus
cagcagtctcaggttc

SEQ ID NO: 378797 - DNA, 16 bp, M. musculus
cagcagtctttttttt

SEQ ID NO: 378798 - DNA, 16 bp, M. musculus
cagcagtgaaaacttg

SEQ ID NO: 378799 - DNA, 32 bp, M. musculus
cagcagtgaaagcttggaaagcattgcctaat

SEQ ID NO: 378800 - DNA, 16 bp, M. musculus
cagcagtgaacatggt

SEQ ID NO: 378801 - DNA, 16 bp, M. musculus
cagcagtgaggagctg

SEQ ID NO: 378802 - DNA, 16 bp, M. musculus
cagcagtgaggaggag

SEQ ID NO: 378803 - DNA, 16 bp, M. musculus
cagcagtgatgtgtgt

SEQ ID NO: 378804 - DNA, 16 bp, M. musculus
cagcagtggaaaccct

SEQ ID NO: 378805 - DNA, 16 bp, M. musculus
cagcagtggcagctca

SEQ ID NO: 378806 - DNA, 16 bp, M. musculus
cagcagtgggagtggc

SEQ ID NO: 378807 - DNA, 16 bp, M. musculus
cagcagtgggtgtggc

SEQ ID NO: 378808 - DNA, 16 bp, M. musculus
cagcagtgtatgcttc

SEQ ID NO: 378809 - DNA, 16 bp, M. musculus
cagcagtgtgtacagg

SEQ ID NO: 378810 - DNA, 16 bp, M. musculus
cagcagtgtgtgtgtg

SEQ ID NO: 378811 - DNA, 16 bp, M. musculus
cagcagtgtttggaga

SEQ ID NO: 378812 - DNA, 16 bp, M. musculus
cagcagttaagaacag

SEQ ID NO: 378813 - DNA, 16 bp, M. musculus
cagcagttaagaacat

SEQ ID NO: 378814 - DNA, 16 bp, M. musculus
cagcagttaagagcat

SEQ ID NO: 378815 - DNA, 16 bp, M. musculus
cagcagttctcaacct

SEQ ID NO: 378816 - DNA, 16 bp, M. musculus
cagcagttctcagcct

SEQ ID NO: 378817 - DNA, 16 bp, M. musculus
cagcagttcttaacct

SEQ ID NO: 378818 - DNA, 16 bp, M. musculus
cagcagtttctccaga

SEQ ID NO: 378819 - DNA, 16 bp, M. musculus
cagcatcagcaacagc

SEQ ID NO: 378820 - DNA, 16 bp, M. musculus
cagcatcagcaccacc

SEQ ID NO: 378821 - DNA, 16 bp, M. musculus
cagcatcagcaccagc

SEQ ID NO: 378822 - DNA, 16 bp, M. musculus
cagcatcagcagcatc

SEQ ID NO: 378823 - DNA, 16 bp, M. musculus
cagcatcagcatcagc

SEQ ID NO: 378824 - DNA, 16 bp, M. musculus
cagcatcaggaaggtt

SEQ ID NO: 378825 - DNA, 16 bp, M. musculus
cagcatcatcaccatc

SEQ ID NO: 378826 - DNA, 16 bp, M. musculus
cagcatccacacagca

SEQ ID NO: 378827 - DNA, 16 bp, M. musculus
cagcatccacactggg

SEQ ID NO: 378828 - DNA, 16 bp, M. musculus
cagcatcccagacctc

SEQ ID NO: 378829 - DNA, 16 bp, M. musculus
cagcatcccagcatcc

SEQ ID NO: 378830 - DNA, 16 bp, M. musculus
cagcatccccagctct

SEQ ID NO: 378831 - DNA, 16 bp, M. musculus
cagcatccctgacctc

SEQ ID NO: 378832 - DNA, 16 bp, M. musculus
cagcatcctcttctgg

SEQ ID NO: 378833 - DNA, 16 bp, M. musculus
cagcatccttccatgg

SEQ ID NO: 378834 - DNA, 16 bp, M. musculus
cagcatctctctctct

SEQ ID NO: 378835 - DNA, 16 bp, M. musculus
cagcatctgctctcat

SEQ ID NO: 378836 - DNA, 16 bp, M. musculus
cagcatctgctgacac

SEQ ID NO: 378837 - DNA, 41 bp, M. musculus
cagcatctgctgtcacctgaatttttgatcttagccattct

SEQ ID NO: 378838 - DNA, 16 bp, M. musculus
cagcatctgctgtgac

SEQ ID NO: 378839 - DNA, 16 bp, M. musculus
cagcatctgttccaaa

SEQ ID NO: 378840 - DNA, 16 bp, M. musculus
cagcatcttcagcaaa

SEQ ID NO: 378841 - DNA, 16 bp, M. musculus
cagcatcttctccatc

SEQ ID NO: 378842 - DNA, 16 bp, M. musculus
cagcatcttgtcaagt

SEQ ID NO: 378843 - DNA, 16 bp, M. musculus
cagcatgaggtacaac

SEQ ID NO: 378844 - DNA, 16 bp, M. musculus
cagcatgcaagcagac

SEQ ID NO: 378845 - DNA, 16 bp, M. musculus
cagcatgcacagggcc

SEQ ID NO: 378846 - DNA, 16 bp, M. musculus
cagcatgcaccagctg

SEQ ID NO: 378847 - DNA, 16 bp, M. musculus
cagcatgcaggggtca

SEQ ID NO: 378848 - DNA, 16 bp, M. musculus
cagcatgcataagacc

SEQ ID NO: 378849 - DNA, 16 bp, M. musculus
cagcatgcctgcctgg

SEQ ID NO: 378850 - DNA, 16 bp, M. musculus
cagcatggagggctgg

SEQ ID NO: 378851 - DNA, 16 bp, M. musculus
cagcatgggcctgctg

SEQ ID NO: 378852 - DNA, 16 bp, M. musculus
cagcatgtctcaccaa

SEQ ID NO: 378853 - DNA, 16 bp, M. musculus
cagcattaggaaggct

SEQ ID NO: 378854 - DNA, 16 bp, M. musculus
cagcattaggaaggtt

SEQ ID NO: 378855 - DNA, 16 bp, M. musculus
cagcattcaggaaaca

SEQ ID NO: 378856 - DNA, 16 bp, M. musculus
cagcattcatgtggaa

SEQ ID NO: 378857 - DNA, 16 bp, M. musculus
cagcattccagcatgg

SEQ ID NO: 378858 - DNA, 16 bp, M. musculus
cagcattctcaacaaa

SEQ ID NO: 378859 - DNA, 16 bp, M. musculus
cagcattgggaggcag

SEQ ID NO: 378860 - DNA, 16 bp, M. musculus
cagcatttaatgagat

SEQ ID NO: 378861 - DNA, 16 bp, M. musculus
cagcatttagaagaat

SEQ ID NO: 378862 - DNA, 16 bp, M. musculus
cagcatttattttatt

SEQ ID NO: 378863 - DNA, 16 bp, M. musculus
cagcatttccaacaaa

SEQ ID NO: 378864 - DNA, 16 bp, M. musculus
cagcatttctctgagt

SEQ ID NO: 378865 - DNA, 16 bp, M. musculus
cagcatttgaaagctg

SEQ ID NO: 378866 - DNA, 16 bp, M. musculus
cagcatttggaagcta

SEQ ID NO: 378867 - DNA, 16 bp, M. musculus
cagcatttggaggcag

SEQ ID NO: 378868 - DNA, 16 bp, M. musculus
cagcatttgggaagct

SEQ ID NO: 378869 - DNA, 16 bp, M. musculus
cagcatttgggagctg

SEQ ID NO: 378870 - DNA, 16 bp, M. musculus
cagcattttactctga

SEQ ID NO: 378871 - DNA, 16 bp, M. musculus
cagcattttggagatg

SEQ ID NO: 378872 - DNA, 16 bp, M. musculus
cagccaaacaggacaa

SEQ ID NO: 378873 - DNA, 16 bp, M. musculus
cagccaaacattggat

SEQ ID NO: 378874 - DNA, 16 bp, M. musculus
cagccaaagctacata

SEQ ID NO: 378875 - DNA, 16 bp, M. musculus
cagccaaagctatata

SEQ ID NO: 378876 - DNA, 16 bp, M. musculus
cagccaaccaaccagc

SEQ ID NO: 378877 - DNA, 16 bp, M. musculus
cagccaaccataggac

SEQ ID NO: 378878 - DNA, 16 bp, M. musculus
cagccaaccattggac

SEQ ID NO: 378879 - DNA, 16 bp, M. musculus
cagccaagaagcagag

SEQ ID NO: 378880 - DNA, 16 bp, M. musculus
cagccaagctctcctc

SEQ ID NO: 378881 - DNA, 16 bp, M. musculus
cagccaaggatgacct

SEQ ID NO: 378882 - DNA, 16 bp, M. musculus
cagccaaggccacaca

SEQ ID NO: 378883 - DNA, 16 bp, M. musculus
cagccaaggctacata

SEQ ID NO: 378884 - DNA, 16 bp, M. musculus
cagccaaggctatata

SEQ ID NO: 378885 - DNA, 16 bp, M. musculus
cagccaaggctgcaca

SEQ ID NO: 378886 - DNA, 16 bp, M. musculus
cagccaagttacactc

SEQ ID NO: 378887 - DNA, 16 bp, M. musculus
cagccaatcagaaact

SEQ ID NO: 378888 - DNA, 16 bp, M. musculus
cagccaatcaggagct

SEQ ID NO: 378889 - DNA, 16 bp, M. musculus
cagccaatcccagtgg

SEQ ID NO: 378890 - DNA, 16 bp, M. musculus
cagccaatgacctttg

SEQ ID NO: 378891 - DNA, 16 bp, M. musculus
cagccacaagaaaaga

SEQ ID NO: 378892 - DNA, 16 bp, M. musculus
cagccacacacagcca

SEQ ID NO: 378893 - DNA, 16 bp, M. musculus
cagccacacagccaca

SEQ ID NO: 378894 - DNA, 16 bp, M. musculus
cagccacaccagaaga

SEQ ID NO: 378895 - DNA, 16 bp, M. musculus
cagccacagaaaggaa

SEQ ID NO: 378896 - DNA, 16 bp, M. musculus
cagccacagctacaca

SEQ ID NO: 378897 - DNA, 18 bp, M. musculus
cagccacaggaacatcca

SEQ ID NO: 378898 - DNA, 16 bp, M. musculus
cagccacagtgcagct

SEQ ID NO: 378899 - DNA, 16 bp, M. musculus
cagccacatacacaca

SEQ ID NO: 378900 - DNA, 16 bp, M. musculus
cagccacataggagga

SEQ ID NO: 378901 - DNA, 16 bp, M. musculus
cagccaccaaacacag

SEQ ID NO: 378902 - DNA, 17 bp, M. musculus
cagccaccaaacccaga

SEQ ID NO: 378903 - DNA, 16 bp, M. musculus
cagccaccacactctc

SEQ ID NO: 378904 - DNA, 16 bp, M. musculus
cagccaccataactcc

SEQ ID NO: 378905 - DNA, 16 bp, M. musculus
cagccaccatcagaga

SEQ ID NO: 378906 - DNA, 16 bp, M. musculus
cagccaccatgtggtt

SEQ ID NO: 378907 - DNA, 16 bp, M. musculus
cagccaccgtctggac

SEQ ID NO: 378908 - DNA, 18 bp, M. musculus
cagccacctataggtgga

SEQ ID NO: 378909 - DNA, 16 bp, M. musculus
cagccacctctccagc

SEQ ID NO: 378910 - DNA, 16 bp, M. musculus
cagccacctgcccagg

SEQ ID NO: 378911 - DNA, 16 bp, M. musculus
cagccaccttcctggc

SEQ ID NO: 378912 - DNA, 16 bp, M. musculus
cagccactccagcttc

SEQ ID NO: 378913 - DNA, 16 bp, M. musculus
cagccactgcagctgt

SEQ ID NO: 378914 - DNA, 16 bp, M. musculus
cagccactgccactgt

SEQ ID NO: 378915 - DNA, 16 bp, M. musculus
cagccactgctgctgt

SEQ ID NO: 378916 - DNA, 16 bp, M. musculus
cagccacttctgtgtt

SEQ ID NO: 378917 - DNA, 16 bp, M. musculus
cagccactttgttgaa

SEQ ID NO: 378918 - DNA, 16 bp, M. musculus
cagccagacatggtgg

SEQ ID NO: 378919 - DNA, 16 bp, M. musculus
cagccagacctacata

SEQ ID NO: 378920 - DNA, 16 bp, M. musculus
cagccagagaagtgtg

SEQ ID NO: 378921 - DNA, 16 bp, M. musculus
cagccagagctaaaca

SEQ ID NO: 378922 - DNA, 16 bp, M. musculus
cagccagagctacata

SEQ ID NO: 378923 - DNA, 16 bp, M. musculus
cagccagaggaattaa

SEQ ID NO: 378924 - DNA, 16 bp, M. musculus
cagccagagtcacaca

SEQ ID NO: 378925 - DNA, 16 bp, M. musculus
cagccagagttacaga

SEQ ID NO: 378926 - DNA, 16 bp, M. musculus
cagccagatggctcag

SEQ ID NO: 378927 - DNA, 16 bp, M. musculus
cagccagcaagcctca

SEQ ID NO: 378928 - DNA, 16 bp, M. musculus
cagccagcaagtccca

SEQ ID NO: 378929 - DNA, 16 bp, M. musculus
cagccagcagcagcag

SEQ ID NO: 378930 - DNA, 16 bp, M. musculus
cagccagccagccagg

SEQ ID NO: 378931 - DNA, 16 bp, M. musculus
cagccagccagccagt

SEQ ID NO: 378932 - DNA, 16 bp, M. musculus
cagccagccagccatc

SEQ ID NO: 378933 - DNA, 16 bp, M. musculus
cagccagccagcctag

SEQ ID NO: 378934 - DNA, 16 bp, M. musculus
cagccagccccaggga

SEQ ID NO: 378935 - DNA, 16 bp, M. musculus
cagccagcctcctgct

SEQ ID NO: 378936 - DNA, 16 bp, M. musculus
cagccaggaagagact

SEQ ID NO: 378937 - DNA, 16 bp, M. musculus
cagccaggaagcagag

SEQ ID NO: 378938 - DNA, 16 bp, M. musculus
cagccaggaagcagga

SEQ ID NO: 378939 - DNA, 16 bp, M. musculus
cagccaggacacagag

SEQ ID NO: 378940 - DNA, 16 bp, M. musculus
cagccaggactgcaga

SEQ ID NO: 378941 - DNA, 16 bp, M. musculus
cagccaggagaggact

SEQ ID NO: 378942 - DNA, 16 bp, M. musculus
cagccaggaggaagag

SEQ ID NO: 378943 - DNA, 16 bp, M. musculus
cagccaggaggaaggt

SEQ ID NO: 378944 - DNA, 16 bp, M. musculus
cagccaggaggaggag

SEQ ID NO: 378945 - DNA, 16 bp, M. musculus
cagccaggaggaggct

SEQ ID NO: 378946 - DNA, 16 bp, M. musculus
cagccaggaggaggtc

SEQ ID NO: 378947 - DNA, 16 bp, M. musculus
cagccaggaggaggtt

SEQ ID NO: 378948 - DNA, 16 bp, M. musculus
cagccaggaggcagaa

SEQ ID NO: 378949 - DNA, 16 bp, M. musculus
cagccaggaggcagag

SEQ ID NO: 378950 - DNA, 16 bp, M. musculus
cagccaggaggctgag

SEQ ID NO: 378951 - DNA, 16 bp, M. musculus
cagccaggagtggtgg

SEQ ID NO: 378952 - DNA, 16 bp, M. musculus
cagccaggcatagtgg

SEQ ID NO: 378953 - DNA, 16 bp, M. musculus
cagccaggccccacct

SEQ ID NO: 378954 - DNA, 16 bp, M. musculus
cagccaggccctttgt

SEQ ID NO: 378955 - DNA, 16 bp, M. musculus
cagccaggctacacag

SEQ ID NO: 378956 - DNA, 16 bp, M. musculus
cagccagggatacata

SEQ ID NO: 378957 - DNA, 16 bp, M. musculus
cagccagggatatgca

SEQ ID NO: 378958 - DNA, 16 bp, M. musculus
cagccagggcagagaa

SEQ ID NO: 378959 - DNA, 16 bp, M. musculus
cagccagggctatacg

SEQ ID NO: 378960 - DNA, 16 bp, M. musculus
cagccagggctgcaca

SEQ ID NO: 378961 - DNA, 16 bp, M. musculus
cagccagggctgcaga

SEQ ID NO: 378962 - DNA, 16 bp, M. musculus
cagccagggctgcata

SEQ ID NO: 378963 - DNA, 16 bp, M. musculus
cagccagggctgtgca

SEQ ID NO: 378964 - DNA, 16 bp, M. musculus
cagccagggcttcata

SEQ ID NO: 378965 - DNA, 16 bp, M. musculus
cagccagggttacaaa

SEQ ID NO: 378966 - DNA, 16 bp, M. musculus
cagccagggttacata

SEQ ID NO: 378967 - DNA, 16 bp, M. musculus
cagccagggttatgta

SEQ ID NO: 378968 - DNA, 16 bp, M. musculus
cagccaggtaggcctg

SEQ ID NO: 378969 - DNA, 16 bp, M. musculus
cagccaggtctataga

SEQ ID NO: 378970 - DNA, 16 bp, M. musculus
cagccagtcagccagc

SEQ ID NO: 378971 - DNA, 16 bp, M. musculus
cagccagtcccacagc

SEQ ID NO: 378972 - DNA, 16 bp, M. musculus
cagccagtctagcaaa

SEQ ID NO: 378973 - DNA, 16 bp, M. musculus
cagccagtgtagctga

SEQ ID NO: 378974 - DNA, 16 bp, M. musculus
cagccagtgtgctctt

SEQ ID NO: 378975 - DNA, 16 bp, M. musculus
cagccagttctcttaa

SEQ ID NO: 378976 - DNA, 16 bp, M. musculus
cagccagttgagccag

SEQ ID NO: 378977 - DNA, 16 bp, M. musculus
cagccatagtcaaact

SEQ ID NO: 378978 - DNA, 16 bp, M. musculus
cagccatcactgaaaa

SEQ ID NO: 378979 - DNA, 16 bp, M. musculus
cagccatcatcaaaga

SEQ ID NO: 378980 - DNA, 16 bp, M. musculus
cagccatcattgggaa

SEQ ID NO: 378981 - DNA, 16 bp, M. musculus
cagccatcctcctgcc

SEQ ID NO: 378982 - DNA, 16 bp, M. musculus
cagccatcctgtctgt

SEQ ID NO: 378983 - DNA, 16 bp, M. musculus
cagccatcttctgtaa

SEQ ID NO: 378984 - DNA, 16 bp, M. musculus
cagccatcttggaagt

SEQ ID NO: 378985 - DNA, 16 bp, M. musculus
cagccatggtgctgga

SEQ ID NO: 378986 - DNA, 16 bp, M. musculus
cagccatgttcactgc

SEQ ID NO: 378987 - DNA, 16 bp, M. musculus
cagccattctcaaccc

SEQ ID NO: 378988 - DNA, 16 bp, M. musculus
cagccattctcaacct

SEQ ID NO: 378989 - DNA, 16 bp, M. musculus
cagccattctgattgg

SEQ ID NO: 378990 - DNA, 16 bp, M. musculus
cagccattctggaaat

SEQ ID NO: 378991 - DNA, 16 bp, M. musculus
cagccattgtctctgc

SEQ ID NO: 378992 - DNA, 16 bp, M. musculus
cagccattgttgaact

SEQ ID NO: 378993 - DNA, 16 bp, M. musculus
cagccattgttggact

SEQ ID NO: 378994 - DNA, 16 bp, M. musculus
cagccattttcttttt

SEQ ID NO: 378995 - DNA, 16 bp, M. musculus
cagcccaagaaaaaga

SEQ ID NO: 378996 - DNA, 16 bp, M. musculus
cagcccaagccagacc

SEQ ID NO: 378997 - DNA, 16 bp, M. musculus
cagcccacagtgggca

SEQ ID NO: 378998 - DNA, 16 bp, M. musculus
cagcccacctgggatg

SEQ ID NO: 378999 - DNA, 16 bp, M. musculus
cagcccactgtgggca

SEQ ID NO: 379000 - DNA, 16 bp, M. musculus
cagcccactttcttat

SEQ ID NO: 379001 - DNA, 16 bp, M. musculus
cagcccagacttctat

SEQ ID NO: 379002 - DNA, 16 bp, M. musculus
cagcccagcagcccag

SEQ ID NO: 379003 - DNA, 16 bp, M. musculus
cagcccagcccagcca

SEQ ID NO: 379004 - DNA, 16 bp, M. musculus
cagcccagcccagcct

SEQ ID NO: 379005 - DNA, 16 bp, M. musculus
cagcccagccctgccc

SEQ ID NO: 379006 - DNA, 16 bp, M. musculus
cagcccagccttctca

SEQ ID NO: 379007 - DNA, 16 bp, M. musculus
cagcccagctggaaga

SEQ ID NO: 379008 - DNA, 16 bp, M. musculus
cagcccaggaccccag

SEQ ID NO: 379009 - DNA, 16 bp, M. musculus
cagcccaggatggcct

SEQ ID NO: 379010 - DNA, 16 bp, M. musculus
cagcccaggcatcact

SEQ ID NO: 379011 - DNA, 16 bp, M. musculus
cagcccaggccagccc

SEQ ID NO: 379012 - DNA, 16 bp, M. musculus
cagcccaggctacaga

SEQ ID NO: 379013 - DNA, 20 bp, M. musculus
cagcccaggctactataccc

SEQ ID NO: 379014 - DNA, 16 bp, M. musculus
cagcccaggctagcct

SEQ ID NO: 379015 - DNA, 16 bp, M. musculus
cagcccagggatgtca

SEQ ID NO: 379016 - DNA, 16 bp, M. musculus
cagcccaggggcctct

SEQ ID NO: 379017 - DNA, 16 bp, M. musculus
cagcccaggggtggca

SEQ ID NO: 379018 - DNA, 16 bp, M. musculus
cagcccaggttggcct

SEQ ID NO: 379019 - DNA, 16 bp, M. musculus
cagcccatcactgagg

SEQ ID NO: 379020 - DNA, 16 bp, M. musculus
cagcccatcatggcag

SEQ ID NO: 379021 - DNA, 16 bp, M. musculus
cagcccatggtgggtg

SEQ ID NO: 379022 - DNA, 16 bp, M. musculus
cagccccaaactttgt

SEQ ID NO: 379023 - DNA, 16 bp, M. musculus
cagccccaagtaaatg

SEQ ID NO: 379024 - DNA, 16 bp, M. musculus
cagccccacctcctgg

SEQ ID NO: 379025 - DNA, 16 bp, M. musculus
cagccccactccagcc

SEQ ID NO: 379026 - DNA, 16 bp, M. musculus
cagccccacttcctgt

SEQ ID NO: 379027 - DNA, 16 bp, M. musculus
cagccccacttgctcc

SEQ ID NO: 379028 - DNA, 16 bp, M. musculus
cagccccagcaaacag

SEQ ID NO: 379029 - DNA, 16 bp, M. musculus
cagccccagcagcagc

SEQ ID NO: 379030 - DNA, 16 bp, M. musculus
cagccccagcccctgc

SEQ ID NO: 379031 - DNA, 16 bp, M. musculus
cagccccagcttgcct

SEQ ID NO: 379032 - DNA, 16 bp, M. musculus
cagccccatgcttcaa

SEQ ID NO: 379033 - DNA, 16 bp, M. musculus
cagcccccacaggaga

SEQ ID NO: 379034 - DNA, 16 bp, M. musculus
cagcccctcacaggct

SEQ ID NO: 379035 - DNA, 16 bp, M. musculus
cagcccctcagcccct

SEQ ID NO: 379036 - DNA, 16 bp, M. musculus
cagcccctcccaggag

SEQ ID NO: 379037 - DNA, 16 bp, M. musculus
cagcccctccctattt

SEQ ID NO: 379038 - DNA, 16 bp, M. musculus
cagcccctgctccact

SEQ ID NO: 379039 - DNA, 16 bp, M. musculus
cagcccctgcttgctc

SEQ ID NO: 379040 - DNA, 16 bp, M. musculus
cagccccttactgggg

SEQ ID NO: 379041 - DNA, 16 bp, M. musculus
cagccccttctccaac

SEQ ID NO: 379042 - DNA, 16 bp, M. musculus
cagccccttttatagt

SEQ ID NO: 379043 - DNA, 17 bp, M. musculus
cagcccgagagagttgc

SEQ ID NO: 379044 - DNA, 16 bp, M. musculus
cagccctacacaaaga

SEQ ID NO: 379045 - DNA, 16 bp, M. musculus
cagccctacagaagat

SEQ ID NO: 379046 - DNA, 16 bp, M. musculus
cagccctagagctggg

SEQ ID NO: 379047 - DNA, 16 bp, M. musculus
cagccctccaagctca

SEQ ID NO: 379048 - DNA, 16 bp, M. musculus
cagccctcctctcctc

SEQ ID NO: 379049 - DNA, 16 bp, M. musculus
cagccctgaaaacaca

SEQ ID NO: 379050 - DNA, 16 bp, M. musculus
cagccctgagtttgaa

SEQ ID NO: 379051 - DNA, 16 bp, M. musculus
cagccctgcacagaga

SEQ ID NO: 379052 - DNA, 16 bp, M. musculus
cagccctgcaccaggc

SEQ ID NO: 379053 - DNA, 16 bp, M. musculus
cagccctgccacacag

SEQ ID NO: 379054 - DNA, 16 bp, M. musculus
cagccctgccatcttc

SEQ ID NO: 379055 - DNA, 16 bp, M. musculus
cagccctgcctaggat

SEQ ID NO: 379056 - DNA, 16 bp, M. musculus
cagccctggagagacc

SEQ ID NO: 379057 - DNA, 16 bp, M. musculus
cagccctggagttaga

SEQ ID NO: 379058 - DNA, 16 bp, M. musculus
cagccctggctggcct

SEQ ID NO: 379059 - DNA, 17 bp, M. musculus
cagccctggctgtccta

SEQ ID NO: 379060 - DNA, 16 bp, M. musculus
cagccctgggtgtcct

SEQ ID NO: 379061 - DNA, 16 bp, M. musculus
cagccctgtgccacct

SEQ ID NO: 379062 - DNA, 16 bp, M. musculus
cagccgcagcagcagc

SEQ ID NO: 379063 - DNA, 16 bp, M. musculus
cagccgcagccgcagc

SEQ ID NO: 379064 - DNA, 16 bp, M. musculus
cagccgggcagtggtg

SEQ ID NO: 379065 - DNA, 16 bp, M. musculus
cagccgggcatggtgg

SEQ ID NO: 379066 - DNA, 16 bp, M. musculus
cagcctacagagtgag

SEQ ID NO: 379067 - DNA, 16 bp, M. musculus
cagcctactccagtga

SEQ ID NO: 379068 - DNA, 16 bp, M. musculus
cagcctagactacata

SEQ ID NO: 379069 - DNA, 16 bp, M. musculus
cagcctagcccctggg

SEQ ID NO: 379070 - DNA, 16 bp, M. musculus
cagcctagcctaactg

SEQ ID NO: 379071 - DNA, 16 bp, M. musculus
cagcctaggctatgta

SEQ ID NO: 379072 - DNA, 16 bp, M. musculus
cagcctaggttacata

SEQ ID NO: 379073 - DNA, 16 bp, M. musculus
cagcctagtccacaga

SEQ ID NO: 379074 - DNA, 18 bp, M. musculus
cagcctagtctacagagc

SEQ ID NO: 379075 - DNA, 16 bp, M. musculus
cagcctagtctgcata

SEQ ID NO: 379076 - DNA, 16 bp, M. musculus
cagcctcaagatctgg

SEQ ID NO: 379077 - DNA, 16 bp, M. musculus
cagcctcacaagtgct

SEQ ID NO: 379078 - DNA, 16 bp, M. musculus
cagcctcagcagcaga

SEQ ID NO: 379079 - DNA, 16 bp, M. musculus
cagcctcagcagcagc

SEQ ID NO: 379080 - DNA, 16 bp, M. musculus
cagcctcagccacagc

SEQ ID NO: 379081 - DNA, 16 bp, M. musculus
cagcctcagcctcacc

SEQ ID NO: 379082 - DNA, 16 bp, M. musculus
cagcctcagcctcagc

SEQ ID NO: 379083 - DNA, 20 bp, M. musculus
cagcctcagcctcagcctca

SEQ ID NO: 379084 - DNA, 16 bp, M. musculus
cagcctcagcctcagg

SEQ ID NO: 379085 - DNA, 16 bp, M. musculus
cagcctcagcctccag

SEQ ID NO: 379086 - DNA, 16 bp, M. musculus
cagcctcagctacata

SEQ ID NO: 379087 - DNA, 16 bp, M. musculus
cagcctcagctcctgg

SEQ ID NO: 379088 - DNA, 16 bp, M. musculus
cagcctcagcttccca

SEQ ID NO: 379089 - DNA, 16 bp, M. musculus
cagcctcaggagcagc

SEQ ID NO: 379090 - DNA, 16 bp, M. musculus
cagcctcaggcaggtg

SEQ ID NO: 379091 - DNA, 16 bp, M. musculus
cagcctcagtttcccc

SEQ ID NO: 379092 - DNA, 16 bp, M. musculus
cagcctcagtttctcc

SEQ ID NO: 379093 - DNA, 16 bp, M. musculus
cagcctccactgtgca

SEQ ID NO: 379094 - DNA, 16 bp, M. musculus
cagcctccacttccag

SEQ ID NO: 379095 - DNA, 16 bp, M. musculus
cagcctccagggaggg

SEQ ID NO: 379096 - DNA, 16 bp, M. musculus
cagcctcccaaatagc

SEQ ID NO: 379097 - DNA, 16 bp, M. musculus
cagcctcccaggtgct

SEQ ID NO: 379098 - DNA, 16 bp, M. musculus
cagcctcccatgtgct

SEQ ID NO: 379099 - DNA, 16 bp, M. musculus
cagcctccctaaaggg

SEQ ID NO: 379100 - DNA, 16 bp, M. musculus
cagcctcccttccctc

SEQ ID NO: 379101 - DNA, 16 bp, M. musculus
cagcctcccttcctcc

SEQ ID NO: 379102 - DNA, 16 bp, M. musculus
cagcctcctaaatgct

SEQ ID NO: 379103 - DNA, 16 bp, M. musculus
cagcctcctcctcctc

SEQ ID NO: 379104 - DNA, 16 bp, M. musculus
cagcctcctcctggct

SEQ ID NO: 379105 - DNA, 16 bp, M. musculus
cagcctcctgagtgtg

SEQ ID NO: 379106 - DNA, 16 bp, M. musculus
cagcctcctgagttct

SEQ ID NO: 379107 - DNA, 16 bp, M. musculus
cagcctcctgcctctg

SEQ ID NO: 379108 - DNA, 16 bp, M. musculus
cagcctctccctctct

SEQ ID NO: 379109 - DNA, 16 bp, M. musculus
cagcctctctcctctc

SEQ ID NO: 379110 - DNA, 16 bp, M. musculus
cagcctctgcctccag

SEQ ID NO: 379111 - DNA, 16 bp, M. musculus
cagcctctgctccaca

SEQ ID NO: 379112 - DNA, 16 bp, M. musculus
cagcctctgcttcagt

SEQ ID NO: 379113 - DNA, 16 bp, M. musculus
cagcctctgcttctct

SEQ ID NO: 379114 - DNA, 16 bp, M. musculus
cagcctctggagtgct

SEQ ID NO: 379115 - DNA, 16 bp, M. musculus
cagcctcttcctctct

SEQ ID NO: 379116 - DNA, 16 bp, M. musculus
cagcctcttgagggtt

SEQ ID NO: 379117 - DNA, 16 bp, M. musculus
cagcctctttttctct

SEQ ID NO: 379118 - DNA, 24 bp, M. musculus
cagcctgaaacctgtttgctcagg

SEQ ID NO: 379119 - DNA, 16 bp, M. musculus
cagcctgaactacaca

SEQ ID NO: 379120 - DNA, 16 bp, M. musculus
cagcctgaagagactg

SEQ ID NO: 379121 - DNA, 16 bp, M. musculus
cagcctgaagcaggct

SEQ ID NO: 379122 - DNA, 16 bp, M. musculus
cagcctgacatctgag

SEQ ID NO: 379123 - DNA, 16 bp, M. musculus
cagcctgagctacaaa

SEQ ID NO: 379124 - DNA, 16 bp, M. musculus
cagcctgagtgctggg

SEQ ID NO: 379125 - DNA, 16 bp, M. musculus
cagcctgagttacata

SEQ ID NO: 379126 - DNA, 16 bp, M. musculus
cagcctgagttccagg

SEQ ID NO: 379127 - DNA, 17 bp, M. musculus
cagcctgatctacttcc

SEQ ID NO: 379128 - DNA, 16 bp, M. musculus
cagcctgatcttatga

SEQ ID NO: 379129 - DNA, 16 bp, M. musculus
cagcctgatttttttt

SEQ ID NO: 379130 - DNA, 16 bp, M. musculus
cagcctgcacagcagc

SEQ ID NO: 379131 - DNA, 16 bp, M. musculus
cagcctgcagcaggag

SEQ ID NO: 379132 - DNA, 16 bp, M. musculus
cagcctgcagcctgca

SEQ ID NO: 379133 - DNA, 16 bp, M. musculus
cagcctgccaccttcc

SEQ ID NO: 379134 - DNA, 16 bp, M. musculus
cagcctgcctctgtct

SEQ ID NO: 379135 - DNA, 16 bp, M. musculus
cagcctgcctgccttc

SEQ ID NO: 379136 - DNA, 16 bp, M. musculus
cagcctgcctgtctcc

SEQ ID NO: 379137 - DNA, 16 bp, M. musculus
cagcctgctcaaggct

SEQ ID NO: 379138 - DNA, 16 bp, M. musculus
cagcctgcttcaggct

SEQ ID NO: 379139 - DNA, 16 bp, M. musculus
cagcctgcttttttat

SEQ ID NO: 379140 - DNA, 16 bp, M. musculus
cagcctggacaactta

SEQ ID NO: 379141 - DNA, 16 bp, M. musculus
cagcctggactacatg

SEQ ID NO: 379142 - DNA, 16 bp, M. musculus
cagcctggactatgta

SEQ ID NO: 379143 - DNA, 16 bp, M. musculus
cagcctggagtacaca

SEQ ID NO: 379144 - DNA, 16 bp, M. musculus
cagcctggattcagaa

SEQ ID NO: 379145 - DNA, 16 bp, M. musculus
cagcctggcagcctgg

SEQ ID NO: 379146 - DNA, 16 bp, M. musculus
cagcctggcctacata

SEQ ID NO: 379147 - DNA, 16 bp, M. musculus
cagcctggcctggcct

SEQ ID NO: 379148 - DNA, 16 bp, M. musculus
cagcctggccttgagc

SEQ ID NO: 379149 - DNA, 16 bp, M. musculus
cagcctgggacagagg

SEQ ID NO: 379150 - DNA, 16 bp, M. musculus
cagcctgggacaggag

SEQ ID NO: 379151 - DNA, 16 bp, M. musculus
cagcctgggacaggat

SEQ ID NO: 379152 - DNA, 16 bp, M. musculus
cagcctgggcaattta

SEQ ID NO: 379153 - DNA, 16 bp, M. musculus
cagcctgggctatgaa

SEQ ID NO: 379154 - DNA, 16 bp, M. musculus
cagcctgggctccaca

SEQ ID NO: 379155 - DNA, 16 bp, M. musculus
cagcctgggctccaga

SEQ ID NO: 379156 - DNA, 16 bp, M. musculus
cagcctgggctgcata

SEQ ID NO: 379157 - DNA, 16 bp, M. musculus
cagcctgggctggcat

SEQ ID NO: 379158 - DNA, 16 bp, M. musculus
cagcctgggcttcaca

SEQ ID NO: 379159 - DNA, 16 bp, M. musculus
cagcctgggcttcatg

SEQ ID NO: 379160 - DNA, 16 bp, M. musculus
cagcctggggtacaca

SEQ ID NO: 379161 - DNA, 16 bp, M. musculus
cagcctggtccaggac

SEQ ID NO: 379162 - DNA, 23 bp, M. musculus
cagcctggtctacaaagtgagtt

SEQ ID NO: 379163 - DNA, 16 bp, M. musculus
cagcctggtctacata

SEQ ID NO: 379164 - DNA, 16 bp, M. musculus
cagcctggtctagaaa

SEQ ID NO: 379165 - DNA, 16 bp, M. musculus
cagcctggtctccatg

SEQ ID NO: 379166 - DNA, 16 bp, M. musculus
cagcctggtctgcata

SEQ ID NO: 379167 - DNA, 16 bp, M. musculus
cagcctggtctggtct

SEQ ID NO: 379168 - DNA, 16 bp, M. musculus
cagcctggtgaccaag

SEQ ID NO: 379169 - DNA, 16 bp, M. musculus
cagcctggttctacag

SEQ ID NO: 379170 - DNA, 16 bp, M. musculus
cagcctggtttacata

SEQ ID NO: 379171 - DNA, 16 bp, M. musculus
cagcctggtttatgta

SEQ ID NO: 379172 - DNA, 16 bp, M. musculus
cagcctggtttctggt

SEQ ID NO: 379173 - DNA, 16 bp, M. musculus
cagcctgtaattccag

SEQ ID NO: 379174 - DNA, 16 bp, M. musculus
cagcctgtcctacaga

SEQ ID NO: 379175 - DNA, 16 bp, M. musculus
cagcctgtggtcctcc

SEQ ID NO: 379176 - DNA, 16 bp, M. musculus
cagcctgttaaattaa

SEQ ID NO: 379177 - DNA, 16 bp, M. musculus
cagccttatgttgtgg

SEQ ID NO: 379178 - DNA, 16 bp, M. musculus
cagccttcagaatgct

SEQ ID NO: 379179 - DNA, 16 bp, M. musculus
cagccttccaagtgtt

SEQ ID NO: 379180 - DNA, 16 bp, M. musculus
cagccttcctgtctcc

SEQ ID NO: 379181 - DNA, 16 bp, M. musculus
cagccttctaagtgct

SEQ ID NO: 379182 - DNA, 16 bp, M. musculus
cagccttctcaggacc

SEQ ID NO: 379183 - DNA, 16 bp, M. musculus
cagccttctgatgaag

SEQ ID NO: 379184 - DNA, 16 bp, M. musculus
cagccttctgggcaga

SEQ ID NO: 379185 - DNA, 16 bp, M. musculus
cagccttctgggtaga

SEQ ID NO: 379186 - DNA, 16 bp, M. musculus
cagccttgaagcaggc

SEQ ID NO: 379187 - DNA, 16 bp, M. musculus
cagccttgcctacaga

SEQ ID NO: 379188 - DNA, 16 bp, M. musculus
cagccttggcagcagg

SEQ ID NO: 379189 - DNA, 16 bp, M. musculus
cagccttggcattgcc

SEQ ID NO: 379190 - DNA, 16 bp, M. musculus
cagccttggctacata

SEQ ID NO: 379191 - DNA, 16 bp, M. musculus
cagccttggctggcct

SEQ ID NO: 379192 - DNA, 16 bp, M. musculus
cagccttggtctacag

SEQ ID NO: 379193 - DNA, 25 bp, M. musculus
cagccttgtctagtccctgatttta

SEQ ID NO: 379194 - DNA, 16 bp, M. musculus
cagcctttggaggctg

SEQ ID NO: 379195 - DNA, 16 bp, M. musculus
cagcctttgttctttg

SEQ ID NO: 379196 - DNA, 16 bp, M. musculus
cagccttttactgtga

SEQ ID NO: 379197 - DNA, 22 bp, M. musculus
cagcgagaccacgattcggatg

SEQ ID NO: 379198 - DNA, 16 bp, M. musculus
cagcgagaccctgtct

SEQ ID NO: 379199 - DNA, 16 bp, M. musculus
cagcgatgctgggctg

SEQ ID NO: 379200 - DNA, 16 bp, M. musculus
cagcgcagcgcagcgc

SEQ ID NO: 379201 - DNA, 16 bp, M. musculus
cagcgccatttctggg

SEQ ID NO: 379202 - DNA, 16 bp, M. musculus
cagcgcctgcctccag

SEQ ID NO: 379203 - DNA, 16 bp, M. musculus
cagcggttctcaacct

SEQ ID NO: 379204 - DNA, 19 bp, M. musculus
cagcgtactgttcaacctc

SEQ ID NO: 379205 - DNA, 19 bp, M. musculus
cagcgttgcctcgctttgg

SEQ ID NO: 379206 - DNA, 16 bp, M. musculus
cagcgtttctctgtgt

SEQ ID NO: 379207 - DNA, 16 bp, M. musculus
cagctaacatccacat

SEQ ID NO: 379208 - DNA, 17 bp, M. musculus
cagctacagtgtactta

SEQ ID NO: 379209 - DNA, 16 bp, M. musculus
cagctacctctccagc

SEQ ID NO: 379210 - DNA, 18 bp, M. musculus
cagctactcggggcgcca

SEQ ID NO: 379211 - DNA, 16 bp, M. musculus
cagctactctctgagc

SEQ ID NO: 379212 - DNA, 16 bp, M. musculus
cagctactgctccaga

SEQ ID NO: 379213 - DNA, 16 bp, M. musculus
cagctactggatggat

SEQ ID NO: 379214 - DNA, 17 bp, M. musculus
cagctactgtgcccaca

SEQ ID NO: 379215 - DNA, 16 bp, M. musculus
cagctacttcactaaa

SEQ ID NO: 379216 - DNA, 16 bp, M. musculus
cagctacttcagtgaa

SEQ ID NO: 379217 - DNA, 16 bp, M. musculus
cagctacttcctcagc

SEQ ID NO: 379218 - DNA, 16 bp, M. musculus
cagctagaaacaggag

SEQ ID NO: 379219 - DNA, 16 bp, M. musculus
cagctagaaatatgag

SEQ ID NO: 379220 - DNA, 16 bp, M. musculus
cagctagagccctgag

SEQ ID NO: 379221 - DNA, 16 bp, M. musculus
cagctagaggagtggg

SEQ ID NO: 379222 - DNA, 16 bp, M. musculus
cagctagcagaagact

SEQ ID NO: 379223 - DNA, 18 bp, M. musculus
cagctagccctgttgcct

SEQ ID NO: 379224 - DNA, 16 bp, M. musculus
cagctagctcccaaat

SEQ ID NO: 379225 - DNA, 16 bp, M. musculus
cagctagtgctcttaa

SEQ ID NO: 379226 - DNA, 16 bp, M. musculus
cagctatctcctgaga

SEQ ID NO: 379227 - DNA, 16 bp, M. musculus
cagctatctgtaactc

SEQ ID NO: 379228 - DNA, 16 bp, M. musculus
cagctatgaaaaagaa

SEQ ID NO: 379229 - DNA, 16 bp, M. musculus
cagctatgaacatagt

SEQ ID NO: 379230 - DNA, 16 bp, M. musculus
cagctatgaagtagca

SEQ ID NO: 379231 - DNA, 16 bp, M. musculus
cagctatgtcaagttg

SEQ ID NO: 379232 - DNA, 16 bp, M. musculus
cagctattaaaaacaa

SEQ ID NO: 379233 - DNA, 30 bp, M. musculus
cagctattgattaatgcaatgtagtgtcaa

SEQ ID NO: 379234 - DNA, 16 bp, M. musculus
cagctattggaaggaa

SEQ ID NO: 379235 - DNA, 16 bp, M. musculus
cagctcaaactctcag

SEQ ID NO: 379236 - DNA, 16 bp, M. musculus
cagctcacaaccattt

SEQ ID NO: 379237 - DNA, 16 bp, M. musculus
cagctcacaactgtaa

SEQ ID NO: 379238 - DNA, 16 bp, M. musculus
cagctcacaactgttg

SEQ ID NO: 379239 - DNA, 16 bp, M. musculus
cagctcacagagctgg

SEQ ID NO: 379240 - DNA, 16 bp, M. musculus
cagctcacagctgtct

SEQ ID NO: 379241 - DNA, 16 bp, M. musculus
cagctcacagttgcct

SEQ ID NO: 379242 - DNA, 16 bp, M. musculus
cagctcaccccagctc

SEQ ID NO: 379243 - DNA, 16 bp, M. musculus
cagctcactttctctt

SEQ ID NO: 379244 - DNA, 16 bp, M. musculus
cagctcagagccccat

SEQ ID NO: 379245 - DNA, 16 bp, M. musculus
cagctcagaggagaag

SEQ ID NO: 379246 - DNA, 16 bp, M. musculus
cagctcagcccctggg

SEQ ID NO: 379247 - DNA, 16 bp, M. musculus
cagctcagctgttctg

SEQ ID NO: 379248 - DNA, 16 bp, M. musculus
cagctcaggctggcct

SEQ ID NO: 379249 - DNA, 16 bp, M. musculus
cagctcataactgtct

SEQ ID NO: 379250 - DNA, 16 bp, M. musculus
cagctcattgtgggtg

SEQ ID NO: 379251 - DNA, 16 bp, M. musculus
cagctcattttttttt

SEQ ID NO: 379252 - DNA, 16 bp, M. musculus
cagctccaaacttttg

SEQ ID NO: 379253 - DNA, 16 bp, M. musculus
cagctccaaagaatca

SEQ ID NO: 379254 - DNA, 16 bp, M. musculus
cagctccaagatgcct

SEQ ID NO: 379255 - DNA, 16 bp, M. musculus
cagctccacctgccct

SEQ ID NO: 379256 - DNA, 16 bp, M. musculus
cagctccacgctcctc

SEQ ID NO: 379257 - DNA, 16 bp, M. musculus
cagctccagcccaggc

SEQ ID NO: 379258 - DNA, 16 bp, M. musculus
cagctccagctgtccc

SEQ ID NO: 379259 - DNA, 16 bp, M. musculus
cagctccaggagatct

SEQ ID NO: 379260 - DNA, 16 bp, M. musculus
cagctccaggggctcc

SEQ ID NO: 379261 - DNA, 16 bp, M. musculus
cagctccaggttcagt

SEQ ID NO: 379262 - DNA, 16 bp, M. musculus
cagctccagtgaaatg

SEQ ID NO: 379263 - DNA, 16 bp, M. musculus
cagctccagtttcagg

SEQ ID NO: 379264 - DNA, 16 bp, M. musculus
cagctccatcttcctc

SEQ ID NO: 379265 - DNA, 16 bp, M. musculus
cagctccatgtggagg

SEQ ID NO: 379266 - DNA, 16 bp, M. musculus
cagctcccagaaccca

SEQ ID NO: 379267 - DNA, 16 bp, M. musculus
cagctccccctgcacc

SEQ ID NO: 379268 - DNA, 16 bp, M. musculus
cagctccctcttctgg

SEQ ID NO: 379269 - DNA, 16 bp, M. musculus
cagctcctacagtcct

SEQ ID NO: 379270 - DNA, 16 bp, M. musculus
cagctcctcagtcctt

SEQ ID NO: 379271 - DNA, 16 bp, M. musculus
cagctcctccagcacc

SEQ ID NO: 379272 - DNA, 16 bp, M. musculus
cagctcctccagccct

SEQ ID NO: 379273 - DNA, 16 bp, M. musculus
cagctcctcccagctc

SEQ ID NO: 379274 - DNA, 16 bp, M. musculus
cagctcctccctgggg

SEQ ID NO: 379275 - DNA, 16 bp, M. musculus
cagctcctcctccagc

SEQ ID NO: 379276 - DNA, 16 bp, M. musculus
cagctcctcctgcagc

SEQ ID NO: 379277 - DNA, 16 bp, M. musculus
cagctcctcctgcccc

SEQ ID NO: 379278 - DNA, 16 bp, M. musculus
cagctcctcctgtgcc

SEQ ID NO: 379279 - DNA, 16 bp, M. musculus
cagctcctgcctcaag

SEQ ID NO: 379280 - DNA, 16 bp, M. musculus
cagctcctgcctccag

SEQ ID NO: 379281 - DNA, 16 bp, M. musculus
cagctcctgctcccac

SEQ ID NO: 379282 - DNA, 16 bp, M. musculus
cagctcctgctcctgc

SEQ ID NO: 379283 - DNA, 16 bp, M. musculus
cagctcctgctctctg

SEQ ID NO: 379284 - DNA, 16 bp, M. musculus
cagctcctgcttcccg

SEQ ID NO: 379285 - DNA, 16 bp, M. musculus
cagctcctgctttggt

SEQ ID NO: 379286 - DNA, 16 bp, M. musculus
cagctcctgggaaaga

SEQ ID NO: 379287 - DNA, 16 bp, M. musculus
cagctcctgggacagg

SEQ ID NO: 379288 - DNA, 16 bp, M. musculus
cagctcctgggtgcag

SEQ ID NO: 379289 - DNA, 16 bp, M. musculus
cagctccttcagcacc

SEQ ID NO: 379290 - DNA, 16 bp, M. musculus
cagctccttcaggcct

SEQ ID NO: 379291 - DNA, 16 bp, M. musculus
cagctccttcagtccc

SEQ ID NO: 379292 - DNA, 16 bp, M. musculus
cagctccttccagctt

SEQ ID NO: 379293 - DNA, 16 bp, M. musculus
cagctccttccccagc

SEQ ID NO: 379294 - DNA, 16 bp, M. musculus
cagctccttctctagc

SEQ ID NO: 379295 - DNA, 16 bp, M. musculus
cagctccttcttcctg

SEQ ID NO: 379296 - DNA, 16 bp, M. musculus
cagctcctttagtcct

SEQ ID NO: 379297 - DNA, 16 bp, M. musculus
cagctctacagaagat

SEQ ID NO: 379298 - DNA, 16 bp, M. musculus
cagctctagggaatcc

SEQ ID NO: 379299 - DNA, 16 bp, M. musculus
cagctctcaactgtct

SEQ ID NO: 379300 - DNA, 16 bp, M. musculus
cagctctcaagaggca

SEQ ID NO: 379301 - DNA, 16 bp, M. musculus
cagctctcacgatgga

SEQ ID NO: 379302 - DNA, 16 bp, M. musculus
cagctctcccatgctc

SEQ ID NO: 379303 - DNA, 16 bp, M. musculus
cagctctcctcagaga

SEQ ID NO: 379304 - DNA, 16 bp, M. musculus
cagctctcctcagcag

SEQ ID NO: 379305 - DNA, 16 bp, M. musculus
cagctctcctcagctc

SEQ ID NO: 379306 - DNA, 16 bp, M. musculus
cagctctcctgactac

SEQ ID NO: 379307 - DNA, 16 bp, M. musculus
cagctctcctgactgc

SEQ ID NO: 379308 - DNA, 16 bp, M. musculus
cagctctcctgccctc

SEQ ID NO: 379309 - DNA, 16 bp, M. musculus
cagctctcctgctctc

SEQ ID NO: 379310 - DNA, 16 bp, M. musculus
cagctctctccttcct

SEQ ID NO: 379311 - DNA, 16 bp, M. musculus
cagctctctgtggcca

SEQ ID NO: 379312 - DNA, 16 bp, M. musculus
cagctctgaaaaaaaa

SEQ ID NO: 379313 - DNA, 16 bp, M. musculus
cagctctgaactttat

SEQ ID NO: 379314 - DNA, 16 bp, M. musculus
cagctctgagagatga

SEQ ID NO: 379315 - DNA, 16 bp, M. musculus
cagctctgagattaca

SEQ ID NO: 379316 - DNA, 16 bp, M. musculus
cagctctgccctttgt

SEQ ID NO: 379317 - DNA, 16 bp, M. musculus
cagctctgcctccagg

SEQ ID NO: 379318 - DNA, 16 bp, M. musculus
cagctctgcctgcact

SEQ ID NO: 379319 - DNA, 16 bp, M. musculus
cagctctgcctgcctc

SEQ ID NO: 379320 - DNA, 16 bp, M. musculus
cagctctgcctgcctt

SEQ ID NO: 379321 - DNA, 16 bp, M. musculus
cagctctgcctgtgtc

SEQ ID NO: 379322 - DNA, 16 bp, M. musculus
cagctctgctcttctg

SEQ ID NO: 379323 - DNA, 16 bp, M. musculus
cagctctggaaaaatt

SEQ ID NO: 379324 - DNA, 16 bp, M. musculus
cagctctggcctccca

SEQ ID NO: 379325 - DNA, 16 bp, M. musculus
cagctctgggccacct

SEQ ID NO: 379326 - DNA, 16 bp, M. musculus
cagctctggggagaca

SEQ ID NO: 379327 - DNA, 16 bp, M. musculus
cagctctggggaggca

SEQ ID NO: 379328 - DNA, 16 bp, M. musculus
cagctctgggtgctgt

SEQ ID NO: 379329 - DNA, 16 bp, M. musculus
cagctcttataaaaga

SEQ ID NO: 379330 - DNA, 16 bp, M. musculus
cagctcttctgcaaga

SEQ ID NO: 379331 - DNA, 16 bp, M. musculus
cagctcttgaaagctg

SEQ ID NO: 379332 - DNA, 17 bp, M. musculus
cagctcttggacaatga

SEQ ID NO: 379333 - DNA, 16 bp, M. musculus
cagctcttgggaagca

SEQ ID NO: 379334 - DNA, 16 bp, M. musculus
cagctgaagaatggat

SEQ ID NO: 379335 - DNA, 19 bp, M. musculus
cagctgaagagttctgaat

SEQ ID NO: 379336 - DNA, 16 bp, M. musculus
cagctgaagccagaga

SEQ ID NO: 379337 - DNA, 16 bp, M. musculus
cagctgaaggagtcag

SEQ ID NO: 379338 - DNA, 16 bp, M. musculus
cagctgacccctgtgg

SEQ ID NO: 379339 - DNA, 16 bp, M. musculus
cagctgagacagactc

SEQ ID NO: 379340 - DNA, 16 bp, M. musculus
cagctgagagacactg

SEQ ID NO: 379341 - DNA, 16 bp, M. musculus
cagctgagccacatcc

SEQ ID NO: 379342 - DNA, 16 bp, M. musculus
cagctgagctgcctgg

SEQ ID NO: 379343 - DNA, 16 bp, M. musculus
cagctgaggcaggagg

SEQ ID NO: 379344 - DNA, 16 bp, M. musculus
cagctgagtcttggca

SEQ ID NO: 379345 - DNA, 16 bp, M. musculus
cagctgatgctcttaa

SEQ ID NO: 379346 - DNA, 16 bp, M. musculus
cagctgatgctggcaa

SEQ ID NO: 379347 - DNA, 16 bp, M. musculus
cagctgatggtgctgt

SEQ ID NO: 379348 - DNA, 16 bp, M. musculus
cagctgcaaataccaa

SEQ ID NO: 379349 - DNA, 16 bp, M. musculus
cagctgcactgtgagc

SEQ ID NO: 379350 - DNA, 16 bp, M. musculus
cagctgcagacatctt

SEQ ID NO: 379351 - DNA, 16 bp, M. musculus
cagctgcagagcacag

SEQ ID NO: 379352 - DNA, 16 bp, M. musculus
cagctgcagatagctt

SEQ ID NO: 379353 - DNA, 16 bp, M. musculus
cagctgcagcacgagg

SEQ ID NO: 379354 - DNA, 17 bp, M. musculus
cagctgcagcacgaggt

SEQ ID NO: 379355 - DNA, 16 bp, M. musculus
cagctgcagcaggacc

SEQ ID NO: 379356 - DNA, 16 bp, M. musculus
cagctgcagcaggagg

SEQ ID NO: 379357 - DNA, 16 bp, M. musculus
cagctgcagcatgagg

SEQ ID NO: 379358 - DNA, 16 bp, M. musculus
cagctgcagcattaca

SEQ ID NO: 379359 - DNA, 16 bp, M. musculus
cagctgcagctgcagc

SEQ ID NO: 379360 - DNA, 16 bp, M. musculus
cagctgcaggtgacaa

SEQ ID NO: 379361 - DNA, 16 bp, M. musculus
cagctgccacccaggc

SEQ ID NO: 379362 - DNA, 16 bp, M. musculus
cagctgccagaataca

SEQ ID NO: 379363 - DNA, 16 bp, M. musculus
cagctgccagctgcca

SEQ ID NO: 379364 - DNA, 18 bp, M. musculus
cagctgccattccttatg

SEQ ID NO: 379365 - DNA, 16 bp, M. musculus
cagctgccccaccaca

SEQ ID NO: 379366 - DNA, 16 bp, M. musculus
cagctgccctggaact

SEQ ID NO: 379367 - DNA, 16 bp, M. musculus
cagctgcctggaggag

SEQ ID NO: 379368 - DNA, 16 bp, M. musculus
cagctgccttctcttc

SEQ ID NO: 379369 - DNA, 16 bp, M. musculus
cagctgctcctgattg

SEQ ID NO: 379370 - DNA, 16 bp, M. musculus
cagctgctctgcatga

SEQ ID NO: 379371 - DNA, 16 bp, M. musculus
cagctgctgcagacag

SEQ ID NO: 379372 - DNA, 16 bp, M. musculus
cagctgctgcaggagg

SEQ ID NO: 379373 - DNA, 16 bp, M. musculus
cagctgctgcctccag

SEQ ID NO: 379374 - DNA, 16 bp, M. musculus
cagctgctgctccagc

SEQ ID NO: 379375 - DNA, 16 bp, M. musculus
cagctgctgctcctgc

SEQ ID NO: 379376 - DNA, 16 bp, M. musculus
cagctgctggaggaag

SEQ ID NO: 379377 - DNA, 16 bp, M. musculus
cagctgctggatgaag

SEQ ID NO: 379378 - DNA, 16 bp, M. musculus
cagctgctggcagagc

SEQ ID NO: 379379 - DNA, 16 bp, M. musculus
cagctgctggctgctg

SEQ ID NO: 379380 - DNA, 16 bp, M. musculus
cagctgctgtaccaga

SEQ ID NO: 379381 - DNA, 16 bp, M. musculus
cagctgctgtgtggag

SEQ ID NO: 379382 - DNA, 16 bp, M. musculus
cagctgcttattgggt

SEQ ID NO: 379383 - DNA, 16 bp, M. musculus
cagctgcttgggtttt

SEQ ID NO: 379384 - DNA, 16 bp, M. musculus
cagctggaacatcttc

SEQ ID NO: 379385 - DNA, 16 bp, M. musculus
cagctggacacacagc

SEQ ID NO: 379386 - DNA, 16 bp, M. musculus
cagctggagaccaagt

SEQ ID NO: 379387 - DNA, 16 bp, M. musculus
cagctggagccacagc

SEQ ID NO: 379388 - DNA, 16 bp, M. musculus
cagctggagccacagg

SEQ ID NO: 379389 - DNA, 16 bp, M. musculus
cagctggagccaggag

SEQ ID NO: 379390 - DNA, 16 bp, M. musculus
cagctggagcctgggt

SEQ ID NO: 379391 - DNA, 16 bp, M. musculus
cagctggatctcctgg

SEQ ID NO: 379392 - DNA, 16 bp, M. musculus
cagctggcctggaact

SEQ ID NO: 379393 - DNA, 16 bp, M. musculus
cagctggcttcaaact

SEQ ID NO: 379394 - DNA, 16 bp, M. musculus
cagctggcttctttac

SEQ ID NO: 379395 - DNA, 16 bp, M. musculus
cagctgggcagtggtg

SEQ ID NO: 379396 - DNA, 16 bp, M. musculus
cagctgggctacacag

SEQ ID NO: 379397 - DNA, 16 bp, M. musculus
cagctgggctggctgg

SEQ ID NO: 379398 - DNA, 16 bp, M. musculus
cagctggggtgggggt

SEQ ID NO: 379399 - DNA, 16 bp, M. musculus
cagctgggtgtagtgg

SEQ ID NO: 379400 - DNA, 16 bp, M. musculus
cagctggtcacatggc

SEQ ID NO: 379401 - DNA, 16 bp, M. musculus
cagctggtgcatgctg

SEQ ID NO: 379402 - DNA, 16 bp, M. musculus
cagctggtggcgctgt

SEQ ID NO: 379403 - DNA, 16 bp, M. musculus
cagctggtggttatca

SEQ ID NO: 379404 - DNA, 16 bp, M. musculus
cagctggtgtttgctg

SEQ ID NO: 379405 - DNA, 16 bp, M. musculus
cagctgtaaggtgttt

SEQ ID NO: 379406 - DNA, 16 bp, M. musculus
cagctgtatttcttta

SEQ ID NO: 379407 - DNA, 16 bp, M. musculus
cagctgtcattcctca

SEQ ID NO: 379408 - DNA, 16 bp, M. musculus
cagctgtcccctgaga

SEQ ID NO: 379409 - DNA, 16 bp, M. musculus
cagctgtcctggctca

SEQ ID NO: 379410 - DNA, 16 bp, M. musculus
cagctgtctcctgaga

SEQ ID NO: 379411 - DNA, 16 bp, M. musculus
cagctgtctgggaaca

SEQ ID NO: 379412 - DNA, 16 bp, M. musculus
cagctgtctggggccc

SEQ ID NO: 379413 - DNA, 16 bp, M. musculus
cagctgtctgtgactc

SEQ ID NO: 379414 - DNA, 16 bp, M. musculus
cagctgtgagctacca

SEQ ID NO: 379415 - DNA, 16 bp, M. musculus
cagctgtgagctgcct

SEQ ID NO: 379416 - DNA, 16 bp, M. musculus
cagctgtgattccaaa

SEQ ID NO: 379417 - DNA, 16 bp, M. musculus
cagctgtgctggcttc

SEQ ID NO: 379418 - DNA, 16 bp, M. musculus
cagctgtggtcacctg

SEQ ID NO: 379419 - DNA, 16 bp, M. musculus
cagctgtggtgcttca

SEQ ID NO: 379420 - DNA, 16 bp, M. musculus
cagctgtggtggtttg

SEQ ID NO: 379421 - DNA, 16 bp, M. musculus
cagctgtgtctctagt

SEQ ID NO: 379422 - DNA, 16 bp, M. musculus
cagctgtgtgaccttg

SEQ ID NO: 379423 - DNA, 16 bp, M. musculus
cagctgttaagaatga

SEQ ID NO: 379424 - DNA, 16 bp, M. musculus
cagcttacagctgtct

SEQ ID NO: 379425 - DNA, 16 bp, M. musculus
cagcttacatttccat

SEQ ID NO: 379426 - DNA, 23 bp, M. musculus
cagcttatacgaagataattgtt

SEQ ID NO: 379427 - DNA, 19 bp, M. musculus
cagcttatggggccatgaa

SEQ ID NO: 379428 - DNA, 16 bp, M. musculus
cagcttcaaggatttt

SEQ ID NO: 379429 - DNA, 16 bp, M. musculus
cagcttcagagaactg

SEQ ID NO: 379430 - DNA, 16 bp, M. musculus
cagcttcagccacatg

SEQ ID NO: 379431 - DNA, 16 bp, M. musculus
cagcttcagtgatgta

SEQ ID NO: 379432 - DNA, 16 bp, M. musculus
cagcttccacagtgag

SEQ ID NO: 379433 - DNA, 16 bp, M. musculus
cagcttccagaaaaat

SEQ ID NO: 379434 - DNA, 16 bp, M. musculus
cagcttccagcttcca

SEQ ID NO: 379435 - DNA, 16 bp, M. musculus
cagcttcctcctcctg

SEQ ID NO: 379436 - DNA, 16 bp, M. musculus
cagcttcctggcccag

SEQ ID NO: 379437 - DNA, 16 bp, M. musculus
cagcttcctggccctg

SEQ ID NO: 379438 - DNA, 16 bp, M. musculus
cagcttcctttttttt

SEQ ID NO: 379439 - DNA, 16 bp, M. musculus
cagcttcggggacagg

SEQ ID NO: 379440 - DNA, 16 bp, M. musculus
cagcttctcaagttct

SEQ ID NO: 379441 - DNA, 16 bp, M. musculus
cagcttctcactgaat

SEQ ID NO: 379442 - DNA, 16 bp, M. musculus
cagcttctctgcccct

SEQ ID NO: 379443 - DNA, 16 bp, M. musculus
cagcttctctttccta

SEQ ID NO: 379444 - DNA, 16 bp, M. musculus
cagcttctgagacaga

SEQ ID NO: 379445 - DNA, 16 bp, M. musculus
cagcttctgagacagg

SEQ ID NO: 379446 - DNA, 16 bp, M. musculus
cagcttctgcagactc

SEQ ID NO: 379447 - DNA, 16 bp, M. musculus
cagcttctggcaagca

SEQ ID NO: 379448 - DNA, 16 bp, M. musculus
cagcttctgggaaagg

SEQ ID NO: 379449 - DNA, 16 bp, M. musculus
cagcttctgggacctg

SEQ ID NO: 379450 - DNA, 16 bp, M. musculus
cagcttcttcattttg

SEQ ID NO: 379451 - DNA, 16 bp, M. musculus
cagcttcttccagatt

SEQ ID NO: 379452 - DNA, 16 bp, M. musculus
cagcttcttctccagc

SEQ ID NO: 379453 - DNA, 16 bp, M. musculus
cagcttcttctttcag

SEQ ID NO: 379454 - DNA, 16 bp, M. musculus
cagcttcttgagctct

SEQ ID NO: 379455 - DNA, 16 bp, M. musculus
cagcttcttgggtcct

SEQ ID NO: 379456 - DNA, 16 bp, M. musculus
cagcttcttgggtgct

SEQ ID NO: 379457 - DNA, 16 bp, M. musculus
cagcttctttcttcag

SEQ ID NO: 379458 - DNA, 16 bp, M. musculus
cagcttgacacagctg

SEQ ID NO: 379459 - DNA, 16 bp, M. musculus
cagcttgaggactcag

SEQ ID NO: 379460 - DNA, 16 bp, M. musculus
cagcttgcaggagtca

SEQ ID NO: 379461 - DNA, 16 bp, M. musculus
cagcttgcagtcctac

SEQ ID NO: 379462 - DNA, 16 bp, M. musculus
cagcttgcagtttgat

SEQ ID NO: 379463 - DNA, 16 bp, M. musculus
cagcttgctcttcatg

SEQ ID NO: 379464 - DNA, 16 bp, M. musculus
cagcttgctttcttgt

SEQ ID NO: 379465 - DNA, 16 bp, M. musculus
cagcttggactacaca

SEQ ID NO: 379466 - DNA, 16 bp, M. musculus
cagcttgggaaggaaa

SEQ ID NO: 379467 - DNA, 16 bp, M. musculus
cagcttgggctataca

SEQ ID NO: 379468 - DNA, 16 bp, M. musculus
cagcttggtctacata

SEQ ID NO: 379469 - DNA, 16 bp, M. musculus
cagcttggtctccagt

SEQ ID NO: 379470 - DNA, 16 bp, M. musculus
cagcttggtcttcatg

SEQ ID NO: 379471 - DNA, 16 bp, M. musculus
cagcttggtttacaga

SEQ ID NO: 379472 - DNA, 16 bp, M. musculus
cagcttgtgtatgctg

SEQ ID NO: 379473 - DNA, 16 bp, M. musculus
cagcttgtgtcaagct

SEQ ID NO: 379474 - DNA, 16 bp, M. musculus
cagcttgttaataaaa

SEQ ID NO: 379475 - DNA, 16 bp, M. musculus
cagctttaaaaacaaa

SEQ ID NO: 379476 - DNA, 16 bp, M. musculus
cagctttaatcccagt

SEQ ID NO: 379477 - DNA, 16 bp, M. musculus
cagctttcaggaggca

SEQ ID NO: 379478 - DNA, 16 bp, M. musculus
cagctttccctgagtg

SEQ ID NO: 379479 - DNA, 16 bp, M. musculus
cagctttccctgtctt

SEQ ID NO: 379480 - DNA, 16 bp, M. musculus
cagctttctctgtgat

SEQ ID NO: 379481 - DNA, 16 bp, M. musculus
cagctttctgttttct

SEQ ID NO: 379482 - DNA, 16 bp, M. musculus
cagctttcttcagcag

SEQ ID NO: 379483 - DNA, 16 bp, M. musculus
cagctttgcctcactt

SEQ ID NO: 379484 - DNA, 16 bp, M. musculus
cagctttgctttgaaa

SEQ ID NO: 379485 - DNA, 16 bp, M. musculus
cagctttggctacatg

SEQ ID NO: 379486 - DNA, 16 bp, M. musculus
cagctttgtgagctgt

SEQ ID NO: 379487 - DNA, 16 bp, M. musculus
cagctttgtggagtca

SEQ ID NO: 379488 - DNA, 16 bp, M. musculus
cagctttgtgtgtgtg

SEQ ID NO: 379489 - DNA, 16 bp, M. musculus
cagcttttccctaatt

SEQ ID NO: 379490 - DNA, 16 bp, M. musculus
cagcttttctcagcag

SEQ ID NO: 379491 - DNA, 16 bp, M. musculus
cagcttttgctacaag

SEQ ID NO: 379492 - DNA, 16 bp, M. musculus
cagcttttgggacagc

SEQ ID NO: 379493 - DNA, 16 bp, M. musculus
cagctttttgtttgtt

SEQ ID NO: 379494 - DNA, 16 bp, M. musculus
caggaaaaaaaaatct

SEQ ID NO: 379495 - DNA, 16 bp, M. musculus
caggaaaaacaccaat

SEQ ID NO: 379496 - DNA, 16 bp, M. musculus
caggaaaacaaagcca

SEQ ID NO: 379497 - DNA, 16 bp, M. musculus
caggaaaacacattca

SEQ ID NO: 379498 - DNA, 16 bp, M. musculus
caggaaaacacttctt

SEQ ID NO: 379499 - DNA, 16 bp, M. musculus
caggaaaacatttaat

SEQ ID NO: 379500 - DNA, 16 bp, M. musculus
caggaaaaccaggaca

SEQ ID NO: 379501 - DNA, 16 bp, M. musculus
caggaaaaccctaaga

SEQ ID NO: 379502 - DNA, 16 bp, M. musculus
caggaaaagaagtttg

SEQ ID NO: 379503 - DNA, 16 bp, M. musculus
caggaaaagagccaag

SEQ ID NO: 379504 - DNA, 16 bp, M. musculus
caggaaaagtcacaca

SEQ ID NO: 379505 - DNA, 16 bp, M. musculus
caggaaaatacatcca

SEQ ID NO: 379506 - DNA, 16 bp, M. musculus
caggaaaatacatttt

SEQ ID NO: 379507 - DNA, 16 bp, M. musculus
caggaaaatcttgcta

SEQ ID NO: 379508 - DNA, 16 bp, M. musculus
caggaaaatgtaaatc

SEQ ID NO: 379509 - DNA, 16 bp, M. musculus
caggaaacagagaagg

SEQ ID NO: 379510 - DNA, 16 bp, M. musculus
caggaaacagattcag

SEQ ID NO: 379511 - DNA, 16 bp, M. musculus
caggaaacagctacca

SEQ ID NO: 379512 - DNA, 16 bp, M. musculus
caggaaaccagctggg

SEQ ID NO: 379513 - DNA, 16 bp, M. musculus
caggaaacccatcaca

SEQ ID NO: 379514 - DNA, 16 bp, M. musculus
caggaaaccttgggag

SEQ ID NO: 379515 - DNA, 16 bp, M. musculus
caggaaactgaagcag

SEQ ID NO: 379516 - DNA, 16 bp, M. musculus
caggaaacttggtaag

SEQ ID NO: 379517 - DNA, 16 bp, M. musculus
caggaaagacacagca

SEQ ID NO: 379518 - DNA, 16 bp, M. musculus
caggaaagccaggact

SEQ ID NO: 379519 - DNA, 29 bp, M. musculus
caggaaagctgcaggttactttgagacag

SEQ ID NO: 379520 - DNA, 16 bp, M. musculus
caggaaagggcattgg

SEQ ID NO: 379521 - DNA, 16 bp, M. musculus
caggaaatcaaggccc

SEQ ID NO: 379522 - DNA, 16 bp, M. musculus
caggaaatccaggaga

SEQ ID NO: 379523 - DNA, 16 bp, M. musculus
caggaaatccgggaca

SEQ ID NO: 379524 - DNA, 16 bp, M. musculus
caggaaatcctggaca

SEQ ID NO: 379525 - DNA, 16 bp, M. musculus
caggaaatgaagcaga

SEQ ID NO: 379526 - DNA, 16 bp, M. musculus
caggaaatggaagaga

SEQ ID NO: 379527 - DNA, 16 bp, M. musculus
caggaaatgtgggaca

SEQ ID NO: 379528 - DNA, 16 bp, M. musculus
caggaaattgaacaaa

SEQ ID NO: 379529 - DNA, 16 bp, M. musculus
caggaacaaagatgga

SEQ ID NO: 379530 - DNA, 16 bp, M. musculus
caggaacaaggacact

SEQ ID NO: 379531 - DNA, 16 bp, M. musculus
caggaacacacacaca

SEQ ID NO: 379532 - DNA, 16 bp, M. musculus
caggaacacatacaca

SEQ ID NO: 379533 - DNA, 16 bp, M. musculus
caggaacagaatgcca

SEQ ID NO: 379534 - DNA, 16 bp, M. musculus
caggaacagaggcagg

SEQ ID NO: 379535 - DNA, 16 bp, M. musculus
caggaacagatgcaga

SEQ ID NO: 379536 - DNA, 16 bp, M. musculus
caggaacagcagcagc

SEQ ID NO: 379537 - DNA, 16 bp, M. musculus
caggaacagctgagag

SEQ ID NO: 379538 - DNA, 16 bp, M. musculus
caggaacaggaacaaa

SEQ ID NO: 379539 - DNA, 16 bp, M. musculus
caggaacatgaggcag

SEQ ID NO: 379540 - DNA, 16 bp, M. musculus
caggaacatggcagca

SEQ ID NO: 379541 - DNA, 16 bp, M. musculus
caggaacatttctgtg

SEQ ID NO: 379542 - DNA, 16 bp, M. musculus
caggaaccaagaaaca

SEQ ID NO: 379543 - DNA, 16 bp, M. musculus
caggaaccaagaccac

SEQ ID NO: 379544 - DNA, 16 bp, M. musculus
caggaaccaaggaaga

SEQ ID NO: 379545 - DNA, 16 bp, M. musculus
caggaaccagcagcag

SEQ ID NO: 379546 - DNA, 16 bp, M. musculus
caggaacccaaacagg

SEQ ID NO: 379547 - DNA, 16 bp, M. musculus
caggaacccaagcagg

SEQ ID NO: 379548 - DNA, 16 bp, M. musculus
caggaacctggaagca

SEQ ID NO: 379549 - DNA, 16 bp, M. musculus
caggaacctggagcca

SEQ ID NO: 379550 - DNA, 16 bp, M. musculus
caggaacctggaggaa

SEQ ID NO: 379551 - DNA, 16 bp, M. musculus
caggaactaaactacc

SEQ ID NO: 379552 - DNA, 16 bp, M. musculus
caggaactatagatgc

SEQ ID NO: 379553 - DNA, 16 bp, M. musculus
caggaactcaaaacag

SEQ ID NO: 379554 - DNA, 16 bp, M. musculus
caggaactcacacaga

SEQ ID NO: 379555 - DNA, 16 bp, M. musculus
caggaactcacagaga

SEQ ID NO: 379556 - DNA, 16 bp, M. musculus
caggaactcactgtgt

SEQ ID NO: 379557 - DNA, 16 bp, M. musculus
caggaactccaacagg

SEQ ID NO: 379558 - DNA, 16 bp, M. musculus
caggaactccagcagg

SEQ ID NO: 379559 - DNA, 16 bp, M. musculus
caggaactccaggcag

SEQ ID NO: 379560 - DNA, 16 bp, M. musculus
caggaactctggctgg

SEQ ID NO: 379561 - DNA, 16 bp, M. musculus
caggaactgaactcag

SEQ ID NO: 379562 - DNA, 16 bp, M. musculus
caggaactgaagcaaa

SEQ ID NO: 379563 - DNA, 16 bp, M. musculus
caggaactgaagcaga

SEQ ID NO: 379564 - DNA, 16 bp, M. musculus
caggaactgaagcagc

SEQ ID NO: 379565 - DNA, 16 bp, M. musculus
caggaactgaatcaga

SEQ ID NO: 379566 - DNA, 16 bp, M. musculus
caggaactgaggcaga

SEQ ID NO: 379567 - DNA, 16 bp, M. musculus
caggaactgcagcaga

SEQ ID NO: 379568 - DNA, 16 bp, M. musculus
caggaactgcttttct

SEQ ID NO: 379569 - DNA, 16 bp, M. musculus
caggaactggaaagaa

SEQ ID NO: 379570 - DNA, 16 bp, M. musculus
caggaactggaggaga

SEQ ID NO: 379571 - DNA, 16 bp, M. musculus
caggaactggcagagc

SEQ ID NO: 379572 - DNA, 16 bp, M. musculus
caggaacttttttttt

SEQ ID NO: 379573 - DNA, 16 bp, M. musculus
caggaagaaaatgaga

SEQ ID NO: 379574 - DNA, 16 bp, M. musculus
caggaagaaacaatca

SEQ ID NO: 379575 - DNA, 16 bp, M. musculus
caggaagaagacagag

SEQ ID NO: 379576 - DNA, 16 bp, M. musculus
caggaagaagcaggaa

SEQ ID NO: 379577 - DNA, 16 bp, M. musculus
caggaagaagccatgg

SEQ ID NO: 379578 - DNA, 16 bp, M. musculus
caggaagaatctgagt

SEQ ID NO: 379579 - DNA, 16 bp, M. musculus
caggaagacaggaaga

SEQ ID NO: 379580 - DNA, 16 bp, M. musculus
caggaagacaggaagg

SEQ ID NO: 379581 - DNA, 16 bp, M. musculus
caggaagaccaaaaga

SEQ ID NO: 379582 - DNA, 16 bp, M. musculus
caggaagaccaacaat

SEQ ID NO: 379583 - DNA, 16 bp, M. musculus
caggaagaccaagaga

SEQ ID NO: 379584 - DNA, 16 bp, M. musculus
caggaagaccaagctg

SEQ ID NO: 379585 - DNA, 16 bp, M. musculus
caggaagaccagagtg

SEQ ID NO: 379586 - DNA, 16 bp, M. musculus
caggaagactgtgagt

SEQ ID NO: 379587 - DNA, 16 bp, M. musculus
caggaagagaaagcag

SEQ ID NO: 379588 - DNA, 16 bp, M. musculus
caggaagagagaatga

SEQ ID NO: 379589 - DNA, 16 bp, M. musculus
caggaagagagagact

SEQ ID NO: 379590 - DNA, 16 bp, M. musculus
caggaagagagagcaa

SEQ ID NO: 379591 - DNA, 16 bp, M. musculus
caggaagagagagtca

SEQ ID NO: 379592 - DNA, 16 bp, M. musculus
caggaagagatggaga

SEQ ID NO: 379593 - DNA, 16 bp, M. musculus
caggaagagcagacag

SEQ ID NO: 379594 - DNA, 16 bp, M. musculus
caggaagagcaggaag

SEQ ID NO: 379595 - DNA, 16 bp, M. musculus
caggaagagcagtcag

SEQ ID NO: 379596 - DNA, 16 bp, M. musculus
caggaagagcctgcag

SEQ ID NO: 379597 - DNA, 16 bp, M. musculus
caggaagaggaaggca

SEQ ID NO: 379598 - DNA, 16 bp, M. musculus
caggaagaggaggcag

SEQ ID NO: 379599 - DNA, 16 bp, M. musculus
caggaagagggcatca

SEQ ID NO: 379600 - DNA, 16 bp, M. musculus
caggaagataccctcc

SEQ ID NO: 379601 - DNA, 16 bp, M. musculus
caggaagatcaaaagt

SEQ ID NO: 379602 - DNA, 16 bp, M. musculus
caggaagatcagaatt

SEQ ID NO: 379603 - DNA, 16 bp, M. musculus
caggaagatctctgag

SEQ ID NO: 379604 - DNA, 16 bp, M. musculus
caggaagatgagaagt

SEQ ID NO: 379605 - DNA, 16 bp, M. musculus
caggaagatggagaca

SEQ ID NO: 379606 - DNA, 16 bp, M. musculus
caggaagatttcttct

SEQ ID NO: 379607 - DNA, 16 bp, M. musculus
caggaagcagaaagga

SEQ ID NO: 379608 - DNA, 16 bp, M. musculus
caggaagcagaaagtg

SEQ ID NO: 379609 - DNA, 16 bp, M. musculus
caggaagcagaagcag

SEQ ID NO: 379610 - DNA, 16 bp, M. musculus
caggaagcagaaggaa

SEQ ID NO: 379611 - DNA, 16 bp, M. musculus
caggaagcagagaaag

SEQ ID NO: 379612 - DNA, 16 bp, M. musculus
caggaagcagagagag

SEQ ID NO: 379613 - DNA, 16 bp, M. musculus
caggaagcagagagca

SEQ ID NO: 379614 - DNA, 16 bp, M. musculus
caggaagcagagagga

SEQ ID NO: 379615 - DNA, 16 bp, M. musculus
caggaagcagagaggg

SEQ ID NO: 379616 - DNA, 16 bp, M. musculus
caggaagcagagatga

SEQ ID NO: 379617 - DNA, 16 bp, M. musculus
caggaagcagagccag

SEQ ID NO: 379618 - DNA, 16 bp, M. musculus
caggaagcagaggcag

SEQ ID NO: 379619 - DNA, 16 bp, M. musculus
caggaagcagagtgag

SEQ ID NO: 379620 - DNA, 16 bp, M. musculus
caggaagcagccagag

SEQ ID NO: 379621 - DNA, 16 bp, M. musculus
caggaagcaggagagg

SEQ ID NO: 379622 - DNA, 16 bp, M. musculus
caggaagcaggagtgt

SEQ ID NO: 379623 - DNA, 16 bp, M. musculus
caggaagcagtggtct

SEQ ID NO: 379624 - DNA, 16 bp, M. musculus
caggaagctaaggcag

SEQ ID NO: 379625 - DNA, 16 bp, M. musculus
caggaagctctggggg

SEQ ID NO: 379626 - DNA, 16 bp, M. musculus
caggaagctgagagac

SEQ ID NO: 379627 - DNA, 16 bp, M. musculus
caggaagctgagagct

SEQ ID NO: 379628 - DNA, 16 bp, M. musculus
caggaagctgcagagg

SEQ ID NO: 379629 - DNA, 16 bp, M. musculus
caggaagctgcttcca

SEQ ID NO: 379630 - DNA, 16 bp, M. musculus
caggaagctggaaaga

SEQ ID NO: 379631 - DNA, 16 bp, M. musculus
caggaagctggagcag

SEQ ID NO: 379632 - DNA, 16 bp, M. musculus
caggaagctggagctg

SEQ ID NO: 379633 - DNA, 16 bp, M. musculus
caggaagctggggcag

SEQ ID NO: 379634 - DNA, 16 bp, M. musculus
caggaaggcaggagtg

SEQ ID NO: 379635 - DNA, 16 bp, M. musculus
caggaaggccttctga

SEQ ID NO: 379636 - DNA, 16 bp, M. musculus
caggaaggctactgat

SEQ ID NO: 379637 - DNA, 16 bp, M. musculus
caggaagtaatcaaac

SEQ ID NO: 379638 - DNA, 16 bp, M. musculus
caggaagtagcaacta

SEQ ID NO: 379639 - DNA, 16 bp, M. musculus
caggaagtccctgaaa

SEQ ID NO: 379640 - DNA, 16 bp, M. musculus
caggaagtccctgaag

SEQ ID NO: 379641 - DNA, 16 bp, M. musculus
caggaagtgcaatgga

SEQ ID NO: 379642 - DNA, 16 bp, M. musculus
caggaagtgcttgctg

SEQ ID NO: 379643 - DNA, 16 bp, M. musculus
caggaagtggagacag

SEQ ID NO: 379644 - DNA, 16 bp, M. musculus
caggaagtgggaggtg

SEQ ID NO: 379645 - DNA, 16 bp, M. musculus
caggaagtggggccag

SEQ ID NO: 379646 - DNA, 16 bp, M. musculus
caggaagtgtaatgga

SEQ ID NO: 379647 - DNA, 16 bp, M. musculus
caggaagtttgagatc

SEQ ID NO: 379648 - DNA, 16 bp, M. musculus
caggaatatggcagca

SEQ ID NO: 379649 - DNA, 16 bp, M. musculus
caggaatcaaactcag

SEQ ID NO: 379650 - DNA, 16 bp, M. musculus
caggaatccagttctt

SEQ ID NO: 379651 - DNA, 16 bp, M. musculus
caggaatcccataaaa

SEQ ID NO: 379652 - DNA, 16 bp, M. musculus
caggaatccgcctgcc

SEQ ID NO: 379653 - DNA, 16 bp, M. musculus
caggaatctggagaca

SEQ ID NO: 379654 - DNA, 16 bp, M. musculus
caggaatgagagagag

SEQ ID NO: 379655 - DNA, 20 bp, M. musculus
caggaatgcagatcagcaat

SEQ ID NO: 379656 - DNA, 16 bp, M. musculus
caggaatggaagcaga

SEQ ID NO: 379657 - DNA, 16 bp, M. musculus
caggaatgggaatggg

SEQ ID NO: 379658 - DNA, 16 bp, M. musculus
caggaatgggagagga

SEQ ID NO: 379659 - DNA, 16 bp, M. musculus
caggaatggtggcaca

SEQ ID NO: 379660 - DNA, 16 bp, M. musculus
caggaattcaaggaca

SEQ ID NO: 379661 - DNA, 16 bp, M. musculus
caggaatttcataaat

SEQ ID NO: 379662 - DNA, 16 bp, M. musculus
caggaatttgaagcag

SEQ ID NO: 379663 - DNA, 16 bp, M. musculus
caggaatttgagcaaa

SEQ ID NO: 379664 - DNA, 16 bp, M. musculus
caggaatttttccccg

SEQ ID NO: 379665 - DNA, 16 bp, M. musculus
caggaatttttttccc

SEQ ID NO: 379666 - DNA, 16 bp, M. musculus
caggacaaattttggg

SEQ ID NO: 379667 - DNA, 16 bp, M. musculus
caggacaacaaatgca

SEQ ID NO: 379668 - DNA, 16 bp, M. musculus
caggacaaccagagct

SEQ ID NO: 379669 - DNA, 16 bp, M. musculus
caggacaaccagtgct

SEQ ID NO: 379670 - DNA, 16 bp, M. musculus
caggacaacctgggct

SEQ ID NO: 379671 - DNA, 16 bp, M. musculus
caggacaatctcctca

SEQ ID NO: 379672 - DNA, 16 bp, M. musculus
caggacacaatgaaaa

SEQ ID NO: 379673 - DNA, 16 bp, M. musculus
caggacacacatacac

SEQ ID NO: 379674 - DNA, 16 bp, M. musculus
caggacacactcagca

SEQ ID NO: 379675 - DNA, 17 bp, M. musculus
caggacacactcggatc

SEQ ID NO: 379676 - DNA, 16 bp, M. musculus
caggacacaggaactg

SEQ ID NO: 379677 - DNA, 16 bp, M. musculus
caggacacagtgaaaa

SEQ ID NO: 379678 - DNA, 16 bp, M. musculus
caggacaccagcccag

SEQ ID NO: 379679 - DNA, 16 bp, M. musculus
caggacagagaagcag

SEQ ID NO: 379680 - DNA, 16 bp, M. musculus
caggacagcaggacag

SEQ ID NO: 379681 - DNA, 16 bp, M. musculus
caggacagcaggggct

SEQ ID NO: 379682 - DNA, 16 bp, M. musculus
caggacagccaaggta

SEQ ID NO: 379683 - DNA, 16 bp, M. musculus
caggacagccaatgct

SEQ ID NO: 379684 - DNA, 16 bp, M. musculus
caggacagccacggct

SEQ ID NO: 379685 - DNA, 16 bp, M. musculus
caggacagccagcagg

SEQ ID NO: 379686 - DNA, 16 bp, M. musculus
caggacagccaggaag

SEQ ID NO: 379687 - DNA, 16 bp, M. musculus
caggacagccaggacc

SEQ ID NO: 379688 - DNA, 16 bp, M. musculus
caggacagccaggaga

SEQ ID NO: 379689 - DNA, 16 bp, M. musculus
caggacagccaggatt

SEQ ID NO: 379690 - DNA, 16 bp, M. musculus
caggacagccaggcag

SEQ ID NO: 379691 - DNA, 16 bp, M. musculus
caggacagccatgact

SEQ ID NO: 379692 - DNA, 16 bp, M. musculus
caggacagcccgggct

SEQ ID NO: 379693 - DNA, 19 bp, M. musculus
caggacagccggggctata

SEQ ID NO: 379694 - DNA, 16 bp, M. musculus
caggacagctgggact

SEQ ID NO: 379695 - DNA, 16 bp, M. musculus
caggacaggaagggaa

SEQ ID NO: 379696 - DNA, 16 bp, M. musculus
caggacaggacaggac

SEQ ID NO: 379697 - DNA, 16 bp, M. musculus
caggacagggaagcag

SEQ ID NO: 379698 - DNA, 16 bp, M. musculus
caggacagggaggcag

SEQ ID NO: 379699 - DNA, 16 bp, M. musculus
caggacagtcatggct

SEQ ID NO: 379700 - DNA, 16 bp, M. musculus
caggacatccagggct

SEQ ID NO: 379701 - DNA, 16 bp, M. musculus
caggacatctgatatg

SEQ ID NO: 379702 - DNA, 21 bp, M. musculus
caggacatgcctgggcaggcc

SEQ ID NO: 379703 - DNA, 16 bp, M. musculus
caggacattcagaaag

SEQ ID NO: 379704 - DNA, 16 bp, M. musculus
caggaccaaaaaatgg

SEQ ID NO: 379705 - DNA, 16 bp, M. musculus
caggaccaaaagcctc

SEQ ID NO: 379706 - DNA, 16 bp, M. musculus
caggaccaaaggcctc

SEQ ID NO: 379707 - DNA, 16 bp, M. musculus
caggaccaaagggctc

SEQ ID NO: 379708 - DNA, 17 bp, M. musculus
caggaccaagggcctcc

SEQ ID NO: 379709 - DNA, 16 bp, M. musculus
caggaccaagggcctt

SEQ ID NO: 379710 - DNA, 16 bp, M. musculus
caggaccaaggggctt

SEQ ID NO: 379711 - DNA, 16 bp, M. musculus
caggaccaccagccca

SEQ ID NO: 379712 - DNA, 16 bp, M. musculus
caggaccaccagccta

SEQ ID NO: 379713 - DNA, 16 bp, M. musculus
caggaccacctgccca

SEQ ID NO: 379714 - DNA, 16 bp, M. musculus
caggaccagaaagcag

SEQ ID NO: 379715 - DNA, 16 bp, M. musculus
caggaccagatggatt

SEQ ID NO: 379716 - DNA, 16 bp, M. musculus
caggaccagccccttc

SEQ ID NO: 379717 - DNA, 16 bp, M. musculus
caggaccaggaagagg

SEQ ID NO: 379718 - DNA, 16 bp, M. musculus
caggaccaggaccagg

SEQ ID NO: 379719 - DNA, 16 bp, M. musculus
caggacccaacaagga

SEQ ID NO: 379720 - DNA, 16 bp, M. musculus
caggacccaacatgga

SEQ ID NO: 379721 - DNA, 16 bp, M. musculus
caggacccaacattgt

SEQ ID NO: 379722 - DNA, 16 bp, M. musculus
caggacccacatcagg

SEQ ID NO: 379723 - DNA, 17 bp, M. musculus
caggacccaggaagcag

SEQ ID NO: 379724 - DNA, 16 bp, M. musculus
caggaccctgacatag

SEQ ID NO: 379725 - DNA, 16 bp, M. musculus
caggacctaaaaatgg

SEQ ID NO: 379726 - DNA, 16 bp, M. musculus
caggacctagggtctc

SEQ ID NO: 379727 - DNA, 16 bp, M. musculus
caggacctcaagaaga

SEQ ID NO: 379728 - DNA, 16 bp, M. musculus
caggacctctggaaga

SEQ ID NO: 379729 - DNA, 16 bp, M. musculus
caggacctctggcaga

SEQ ID NO: 379730 - DNA, 16 bp, M. musculus
caggacctcttggaag

SEQ ID NO: 379731 - DNA, 16 bp, M. musculus
caggacctgaagcaga

SEQ ID NO: 379732 - DNA, 16 bp, M. musculus
caggacctgtggaaga

SEQ ID NO: 379733 - DNA, 16 bp, M. musculus
caggaccttcggaagg

SEQ ID NO: 379734 - DNA, 16 bp, M. musculus
caggaccttgtgcatg

SEQ ID NO: 379735 - DNA, 16 bp, M. musculus
caggacctttggaaaa

SEQ ID NO: 379736 - DNA, 16 bp, M. musculus
caggacctttgggaaa

SEQ ID NO: 379737 - DNA, 16 bp, M. musculus
caggactacataatga

SEQ ID NO: 379738 - DNA, 16 bp, M. musculus
caggactcaaactcag

SEQ ID NO: 379739 - DNA, 16 bp, M. musculus
caggactcaggaggtg

SEQ ID NO: 379740 - DNA, 16 bp, M. musculus
caggactccctggagc

SEQ ID NO: 379741 - DNA, 16 bp, M. musculus
caggactcctggaaga

SEQ ID NO: 379742 - DNA, 16 bp, M. musculus
caggactctgacatag

SEQ ID NO: 379743 - DNA, 16 bp, M. musculus
caggactgaagccctg

SEQ ID NO: 379744 - DNA, 16 bp, M. musculus
caggactgccagccca

SEQ ID NO: 379745 - DNA, 16 bp, M. musculus
caggactgccaggact

SEQ ID NO: 379746 - DNA, 25 bp, M. musculus
caggactggaactcaagcaggtcag

SEQ ID NO: 379747 - DNA, 16 bp, M. musculus
caggactggggctctg

SEQ ID NO: 379748 - DNA, 16 bp, M. musculus
caggacttccaggtcc

SEQ ID NO: 379749 - DNA, 16 bp, M. musculus
caggacttccgggttg

SEQ ID NO: 379750 - DNA, 16 bp, M. musculus
caggacttgggaggtg

SEQ ID NO: 379751 - DNA, 16 bp, M. musculus
caggactttgcacatg

SEQ ID NO: 379752 - DNA, 16 bp, M. musculus
caggagaaaagcccag

SEQ ID NO: 379753 - DNA, 16 bp, M. musculus
caggagaaacaagcca

SEQ ID NO: 379754 - DNA, 16 bp, M. musculus
caggagaaacaagctt

SEQ ID NO: 379755 - DNA, 16 bp, M. musculus
caggagaaagccaggg

SEQ ID NO: 379756 - DNA, 16 bp, M. musculus
caggagaaaggaagtt

SEQ ID NO: 379757 - DNA, 16 bp, M. musculus
caggagaaatagtctt

SEQ ID NO: 379758 - DNA, 16 bp, M. musculus
caggagaacacaggca

SEQ ID NO: 379759 - DNA, 16 bp, M. musculus
caggagaacatggctc

SEQ ID NO: 379760 - DNA, 16 bp, M. musculus
caggagaagctgaaag

SEQ ID NO: 379761 - DNA, 16 bp, M. musculus
caggagaaggagcagg

SEQ ID NO: 379762 - DNA, 16 bp, M. musculus
caggagaagttctctg

SEQ ID NO: 379763 - DNA, 16 bp, M. musculus
caggagaatccctgga

SEQ ID NO: 379764 - DNA, 16 bp, M. musculus
caggagaatgaggcag

SEQ ID NO: 379765 - DNA, 16 bp, M. musculus
caggagaatgccagga

SEQ ID NO: 379766 - DNA, 17 bp, M. musculus
caggagacacatctcag

SEQ ID NO: 379767 - DNA, 16 bp, M. musculus
caggagacagaagcag

SEQ ID NO: 379768 - DNA, 16 bp, M. musculus
caggagacagagacaa

SEQ ID NO: 379769 - DNA, 16 bp, M. musculus
caggagacagaggaaa

SEQ ID NO: 379770 - DNA, 16 bp, M. musculus
caggagacagaggaag

SEQ ID NO: 379771 - DNA, 16 bp, M. musculus
caggagacagaggaga

SEQ ID NO: 379772 - DNA, 16 bp, M. musculus
caggagacagaggcaa

SEQ ID NO: 379773 - DNA, 16 bp, M. musculus
caggagacagaggcag

SEQ ID NO: 379774 - DNA, 16 bp, M. musculus
caggagacagcagatg

SEQ ID NO: 379775 - DNA, 16 bp, M. musculus
caggagaccaagaaga

SEQ ID NO: 379776 - DNA, 16 bp, M. musculus
caggagaccctgtctt

SEQ ID NO: 379777 - DNA, 16 bp, M. musculus
caggagactgaggcaa

SEQ ID NO: 379778 - DNA, 16 bp, M. musculus
caggagagaaagccaa

SEQ ID NO: 379779 - DNA, 16 bp, M. musculus
caggagagaagcccag

SEQ ID NO: 379780 - DNA, 16 bp, M. musculus
caggagagaagccctg

SEQ ID NO: 379781 - DNA, 16 bp, M. musculus
caggagagacagacag

SEQ ID NO: 379782 - DNA, 16 bp, M. musculus
caggagagacagagcc

SEQ ID NO: 379783 - DNA, 16 bp, M. musculus
caggagagagctggac

SEQ ID NO: 379784 - DNA, 16 bp, M. musculus
caggagagcacaggcc

SEQ ID NO: 379785 - DNA, 16 bp, M. musculus
caggagagctggctct

SEQ ID NO: 379786 - DNA, 18 bp, M. musculus
caggagaggcaccccaga

SEQ ID NO: 379787 - DNA, 16 bp, M. musculus
caggagagggaagcag

SEQ ID NO: 379788 - DNA, 16 bp, M. musculus
caggagagggcactgg

SEQ ID NO: 379789 - DNA, 16 bp, M. musculus
caggagataacagatg

SEQ ID NO: 379790 - DNA, 16 bp, M. musculus
caggagatccaatgcc

SEQ ID NO: 379791 - DNA, 16 bp, M. musculus
caggagatccactgca

SEQ ID NO: 379792 - DNA, 16 bp, M. musculus
caggagatctactgca

SEQ ID NO: 379793 - DNA, 16 bp, M. musculus
caggagatggaggcag

SEQ ID NO: 379794 - DNA, 16 bp, M. musculus
caggagatggctatat

SEQ ID NO: 379795 - DNA, 16 bp, M. musculus
caggagcaagaggatc

SEQ ID NO: 379796 - DNA, 16 bp, M. musculus
caggagcaattctggg

SEQ ID NO: 379797 - DNA, 16 bp, M. musculus
caggagcagaagcaga

SEQ ID NO: 379798 - DNA, 16 bp, M. musculus
caggagcagactggct

SEQ ID NO: 379799 - DNA, 16 bp, M. musculus
caggagcagaggcaga

SEQ ID NO: 379800 - DNA, 16 bp, M. musculus
caggagcagcagcaac

SEQ ID NO: 379801 - DNA, 16 bp, M. musculus
caggagcagcaggcag

SEQ ID NO: 379802 - DNA, 16 bp, M. musculus
caggagcagccagtgc

SEQ ID NO: 379803 - DNA, 16 bp, M. musculus
caggagcaggaagctg

SEQ ID NO: 379804 - DNA, 16 bp, M. musculus
caggagcaggagcagc

SEQ ID NO: 379805 - DNA, 16 bp, M. musculus
caggagcaggaggaag

SEQ ID NO: 379806 - DNA, 16 bp, M. musculus
caggagcagggactgt

SEQ ID NO: 379807 - DNA, 16 bp, M. musculus
caggagcaggggcagg

SEQ ID NO: 379808 - DNA, 16 bp, M. musculus
caggagcagtgtgtgc

SEQ ID NO: 379809 - DNA, 16 bp, M. musculus
caggagcatggcagta

SEQ ID NO: 379810 - DNA, 16 bp, M. musculus
caggagccaacatcaa

SEQ ID NO: 379811 - DNA, 16 bp, M. musculus
caggagccacagtgga

SEQ ID NO: 379812 - DNA, 16 bp, M. musculus
caggagccagaagcag

SEQ ID NO: 379813 - DNA, 16 bp, M. musculus
caggagccagagagca

SEQ ID NO: 379814 - DNA, 16 bp, M. musculus
caggagccagaggaag

SEQ ID NO: 379815 - DNA, 16 bp, M. musculus
caggagccagaggcag

SEQ ID NO: 379816 - DNA, 16 bp, M. musculus
caggagcccagcatgg

SEQ ID NO: 379817 - DNA, 16 bp, M. musculus
caggagcccatggagg

SEQ ID NO: 379818 - DNA, 16 bp, M. musculus
caggagcctgaagcag

SEQ ID NO: 379819 - DNA, 16 bp, M. musculus
caggagcctgaaggca

SEQ ID NO: 379820 - DNA, 16 bp, M. musculus
caggagcctggagaca

SEQ ID NO: 379821 - DNA, 16 bp, M. musculus
caggagcctggcatga

SEQ ID NO: 379822 - DNA, 16 bp, M. musculus
caggagcctggtacag

SEQ ID NO: 379823 - DNA, 16 bp, M. musculus
caggagcctggtgtgg

SEQ ID NO: 379824 - DNA, 16 bp, M. musculus
caggagcggatgcaga

SEQ ID NO: 379825 - DNA, 16 bp, M. musculus
caggagctaaagcaga

SEQ ID NO: 379826 - DNA, 16 bp, M. musculus
caggagctcaaagcag

SEQ ID NO: 379827 - DNA, 16 bp, M. musculus
caggagctcaagcagg

SEQ ID NO: 379828 - DNA, 16 bp, M. musculus
caggagctcagacaca

SEQ ID NO: 379829 - DNA, 16 bp, M. musculus
caggagctccgggggt

SEQ ID NO: 379830 - DNA, 16 bp, M. musculus
caggagctctggggag

SEQ ID NO: 379831 - DNA, 16 bp, M. musculus
caggagctgaagcaga

SEQ ID NO: 379832 - DNA, 16 bp, M. musculus
caggagctgacacaga

SEQ ID NO: 379833 - DNA, 16 bp, M. musculus
caggagctgacatgtc

SEQ ID NO: 379834 - DNA, 16 bp, M. musculus
caggagctgaggcaga

SEQ ID NO: 379835 - DNA, 16 bp, M. musculus
caggagctgatataga

SEQ ID NO: 379836 - DNA, 16 bp, M. musculus
caggagctgatgaaga

SEQ ID NO: 379837 - DNA, 16 bp, M. musculus
caggagctgatgcaag

SEQ ID NO: 379838 - DNA, 16 bp, M. musculus
caggagctgatgcaga

SEQ ID NO: 379839 - DNA, 16 bp, M. musculus
caggagctgatgctga

SEQ ID NO: 379840 - DNA, 16 bp, M. musculus
caggagctgatggaga

SEQ ID NO: 379841 - DNA, 16 bp, M. musculus
caggagctgatggagg

SEQ ID NO: 379842 - DNA, 16 bp, M. musculus
caggagctgattcaga

SEQ ID NO: 379843 - DNA, 16 bp, M. musculus
caggagctgctgcaga

SEQ ID NO: 379844 - DNA, 16 bp, M. musculus
caggagctggaaagaa

SEQ ID NO: 379845 - DNA, 16 bp, M. musculus
caggagctggaacatg

SEQ ID NO: 379846 - DNA, 16 bp, M. musculus
caggagctggagaaat

SEQ ID NO: 379847 - DNA, 16 bp, M. musculus
caggagctggaggcag

SEQ ID NO: 379848 - DNA, 16 bp, M. musculus
caggagctgggggtgg

SEQ ID NO: 379849 - DNA, 16 bp, M. musculus
caggagctggtctgag

SEQ ID NO: 379850 - DNA, 16 bp, M. musculus
caggagctgtccacag

SEQ ID NO: 379851 - DNA, 16 bp, M. musculus
caggagctgtctctga

SEQ ID NO: 379852 - DNA, 16 bp, M. musculus
caggagctttgcaatt

SEQ ID NO: 379853 - DNA, 16 bp, M. musculus
caggaggaacaggctc

SEQ ID NO: 379854 - DNA, 16 bp, M. musculus
caggaggaagaggcaa

SEQ ID NO: 379855 - DNA, 16 bp, M. musculus
caggaggaagaggcag

SEQ ID NO: 379856 - DNA, 16 bp, M. musculus
caggaggaagcctctc

SEQ ID NO: 379857 - DNA, 16 bp, M. musculus
caggaggaatgccagg

SEQ ID NO: 379858 - DNA, 16 bp, M. musculus
caggaggaccaagagt

SEQ ID NO: 379859 - DNA, 16 bp, M. musculus
caggaggaccactgcc

SEQ ID NO: 379860 - DNA, 16 bp, M. musculus
caggaggaccaggagt

SEQ ID NO: 379861 - DNA, 16 bp, M. musculus
caggaggactgctgtg

SEQ ID NO: 379862 - DNA, 16 bp, M. musculus
caggaggagaagcagg

SEQ ID NO: 379863 - DNA, 16 bp, M. musculus
caggaggagagagctc

SEQ ID NO: 379864 - DNA, 16 bp, M. musculus
caggaggagaggccct

SEQ ID NO: 379865 - DNA, 16 bp, M. musculus
caggaggagatgagag

SEQ ID NO: 379866 - DNA, 16 bp, M. musculus
caggaggagcaagcca

SEQ ID NO: 379867 - DNA, 16 bp, M. musculus
caggaggagctctgtg

SEQ ID NO: 379868 - DNA, 16 bp, M. musculus
caggaggagctgacag

SEQ ID NO: 379869 - DNA, 16 bp, M. musculus
caggaggagctgaggg

SEQ ID NO: 379870 - DNA, 16 bp, M. musculus
caggaggagctgggag

SEQ ID NO: 379871 - DNA, 16 bp, M. musculus
caggaggagcttagag

SEQ ID NO: 379872 - DNA, 16 bp, M. musculus
caggaggaggaagaca

SEQ ID NO: 379873 - DNA, 16 bp, M. musculus
caggaggaggaagtgg

SEQ ID NO: 379874 - DNA, 16 bp, M. musculus
caggaggatcacaagt

SEQ ID NO: 379875 - DNA, 16 bp, M. musculus
caggaggatcaggaac

SEQ ID NO: 379876 - DNA, 18 bp, M. musculus
caggaggatcatgagttc

SEQ ID NO: 379877 - DNA, 16 bp, M. musculus
caggaggatccagcaa

SEQ ID NO: 379878 - DNA, 16 bp, M. musculus
caggaggatctcagag

SEQ ID NO: 379879 - DNA, 16 bp, M. musculus
caggaggatctcagtg

SEQ ID NO: 379880 - DNA, 16 bp, M. musculus
caggaggatctggaat

SEQ ID NO: 379881 - DNA, 16 bp, M. musculus
caggaggatgaggagt

SEQ ID NO: 379882 - DNA, 16 bp, M. musculus
caggaggatggagagt

SEQ ID NO: 379883 - DNA, 16 bp, M. musculus
caggaggattgaaagt

SEQ ID NO: 379884 - DNA, 16 bp, M. musculus
caggaggattgtaaat

SEQ ID NO: 379885 - DNA, 16 bp, M. musculus
caggaggcaaagctga

SEQ ID NO: 379886 - DNA, 16 bp, M. musculus
caggaggcaaaggcag

SEQ ID NO: 379887 - DNA, 16 bp, M. musculus
caggaggcacaggagg

SEQ ID NO: 379888 - DNA, 16 bp, M. musculus
caggaggcagaaacag

SEQ ID NO: 379889 - DNA, 16 bp, M. musculus
caggaggcagaaagga

SEQ ID NO: 379890 - DNA, 16 bp, M. musculus
caggaggcagaagaag

SEQ ID NO: 379891 - DNA, 16 bp, M. musculus
caggaggcagaaggca

SEQ ID NO: 379892 - DNA, 16 bp, M. musculus
caggaggcagacagag

SEQ ID NO: 379893 - DNA, 16 bp, M. musculus
caggaggcagagaaag

SEQ ID NO: 379894 - DNA, 16 bp, M. musculus
caggaggcagagaaca

SEQ ID NO: 379895 - DNA, 16 bp, M. musculus
caggaggcagagaagg

SEQ ID NO: 379896 - DNA, 16 bp, M. musculus
caggaggcagagagtg

SEQ ID NO: 379897 - DNA, 16 bp, M. musculus
caggaggcagagcaag

SEQ ID NO: 379898 - DNA, 16 bp, M. musculus
caggaggcagagcaga

SEQ ID NO: 379899 - DNA, 16 bp, M. musculus
caggaggcagagcagg

SEQ ID NO: 379900 - DNA, 16 bp, M. musculus
caggaggcagagctga

SEQ ID NO: 379901 - DNA, 16 bp, M. musculus
caggaggcagaggcag

SEQ ID NO: 379902 - DNA, 16 bp, M. musculus
caggaggcagagtcag

SEQ ID NO: 379903 - DNA, 16 bp, M. musculus
caggaggcagagttag

SEQ ID NO: 379904 - DNA, 16 bp, M. musculus
caggaggcaggaggct

SEQ ID NO: 379905 - DNA, 16 bp, M. musculus
caggaggcagggctgg

SEQ ID NO: 379906 - DNA, 16 bp, M. musculus
caggaggcaggggcag

SEQ ID NO: 379907 - DNA, 16 bp, M. musculus
caggaggcagtggcag

SEQ ID NO: 379908 - DNA, 16 bp, M. musculus
caggaggccactgccc

SEQ ID NO: 379909 - DNA, 16 bp, M. musculus
caggaggccagcctgg

SEQ ID NO: 379910 - DNA, 16 bp, M. musculus
caggaggcggaggcag

SEQ ID NO: 379911 - DNA, 16 bp, M. musculus
caggaggctcacaacc

SEQ ID NO: 379912 - DNA, 16 bp, M. musculus
caggaggctgaaacag

SEQ ID NO: 379913 - DNA, 16 bp, M. musculus
caggaggctgaagcag

SEQ ID NO: 379914 - DNA, 16 bp, M. musculus
caggaggctgagctga

SEQ ID NO: 379915 - DNA, 16 bp, M. musculus
caggaggctgaggcag

SEQ ID NO: 379916 - DNA, 16 bp, M. musculus
caggaggctgaggtag

SEQ ID NO: 379917 - DNA, 16 bp, M. musculus
caggaggctggagact

SEQ ID NO: 379918 - DNA, 16 bp, M. musculus
caggaggctggggaga

SEQ ID NO: 379919 - DNA, 16 bp, M. musculus
caggaggctggggcag

SEQ ID NO: 379920 - DNA, 16 bp, M. musculus
caggagggacaagcca

SEQ ID NO: 379921 - DNA, 16 bp, M. musculus
caggagggagagacag

SEQ ID NO: 379922 - DNA, 16 bp, M. musculus
caggagggaggtctga

SEQ ID NO: 379923 - DNA, 16 bp, M. musculus
caggagggccaagatg

SEQ ID NO: 379924 - DNA, 16 bp, M. musculus
caggaggggaggccct

SEQ ID NO: 379925 - DNA, 16 bp, M. musculus
caggagggtccctgct

SEQ ID NO: 379926 - DNA, 16 bp, M. musculus
caggaggtagaagcag

SEQ ID NO: 379927 - DNA, 16 bp, M. musculus
caggaggtagagggtg

SEQ ID NO: 379928 - DNA, 16 bp, M. musculus
caggaggtcctgggtg

SEQ ID NO: 379929 - DNA, 16 bp, M. musculus
caggaggtgatgcaga

SEQ ID NO: 379930 - DNA, 16 bp, M. musculus
caggaggtggaagcag

SEQ ID NO: 379931 - DNA, 16 bp, M. musculus
caggaggtggaggcag

SEQ ID NO: 379932 - DNA, 16 bp, M. musculus
caggaggtggcctctt

SEQ ID NO: 379933 - DNA, 16 bp, M. musculus
caggaggttgagtttc

SEQ ID NO: 379934 - DNA, 16 bp, M. musculus
caggagtagctggcca

SEQ ID NO: 379935 - DNA, 16 bp, M. musculus
caggagtcaatacagt

SEQ ID NO: 379936 - DNA, 16 bp, M. musculus
caggagtcagaagcag

SEQ ID NO: 379937 - DNA, 16 bp, M. musculus
caggagtcagcaggag

SEQ ID NO: 379938 - DNA, 16 bp, M. musculus
caggagtcaggtctct

SEQ ID NO: 379939 - DNA, 35 bp, M. musculus
caggagtcattctcagattttgtggccagaatgac

SEQ ID NO: 379940 - DNA, 16 bp, M. musculus
caggagtccaggagac

SEQ ID NO: 379941 - DNA, 16 bp, M. musculus
caggagtctaacatgg

SEQ ID NO: 379942 - DNA, 16 bp, M. musculus
caggagtctgaggcag

SEQ ID NO: 379943 - DNA, 16 bp, M. musculus
caggagtctgccttag

SEQ ID NO: 379944 - DNA, 16 bp, M. musculus
caggagtgatatagct

SEQ ID NO: 379945 - DNA, 16 bp, M. musculus
caggagtgcatgctgg

SEQ ID NO: 379946 - DNA, 16 bp, M. musculus
caggagtgggtgaatg

SEQ ID NO: 379947 - DNA, 16 bp, M. musculus
caggagtgtgtgtgtg

SEQ ID NO: 379948 - DNA, 16 bp, M. musculus
caggagttaagaacac

SEQ ID NO: 379949 - DNA, 16 bp, M. musculus
caggagttcaagacca

SEQ ID NO: 379950 - DNA, 16 bp, M. musculus
caggagttcaagatca

SEQ ID NO: 379951 - DNA, 16 bp, M. musculus
caggagttcaaggcta

SEQ ID NO: 379952 - DNA, 16 bp, M. musculus
caggagttggaggcca

SEQ ID NO: 379953 - DNA, 16 bp, M. musculus
caggagtttgaaaagc

SEQ ID NO: 379954 - DNA, 16 bp, M. musculus
caggataacactgcta

SEQ ID NO: 379955 - DNA, 16 bp, M. musculus
caggataagtatacct

SEQ ID NO: 379956 - DNA, 16 bp, M. musculus
caggatacagctatat

SEQ ID NO: 379957 - DNA, 16 bp, M. musculus
caggatacaggagctg

SEQ ID NO: 379958 - DNA, 16 bp, M. musculus
caggataggcagggct

SEQ ID NO: 379959 - DNA, 16 bp, M. musculus
caggatagggaagcag

SEQ ID NO: 379960 - DNA, 16 bp, M. musculus
caggatataatccaca

SEQ ID NO: 379961 - DNA, 16 bp, M. musculus
caggatatattgtgtg

SEQ ID NO: 379962 - DNA, 16 bp, M. musculus
caggatatccacctgt

SEQ ID NO: 379963 - DNA, 16 bp, M. musculus
caggatatggtggcac

SEQ ID NO: 379964 - DNA, 16 bp, M. musculus
caggatatttgatcat

SEQ ID NO: 379965 - DNA, 16 bp, M. musculus
caggatcagaggatca

SEQ ID NO: 379966 - DNA, 16 bp, M. musculus
caggatcagataaaca

SEQ ID NO: 379967 - DNA, 16 bp, M. musculus
caggatcatccaggat

SEQ ID NO: 379968 - DNA, 16 bp, M. musculus
caggatccagggacac

SEQ ID NO: 379969 - DNA, 16 bp, M. musculus
caggatccatgggtcc

SEQ ID NO: 379970 - DNA, 16 bp, M. musculus
caggatcccagaatca

SEQ ID NO: 379971 - DNA, 16 bp, M. musculus
caggatcccagccagg

SEQ ID NO: 379972 - DNA, 16 bp, M. musculus
caggatccccaatgga

SEQ ID NO: 379973 - DNA, 16 bp, M. musculus
caggatcctgccctgc

SEQ ID NO: 379974 - DNA, 16 bp, M. musculus
caggatcgttttgatt

SEQ ID NO: 379975 - DNA, 16 bp, M. musculus
caggatctcaggatca

SEQ ID NO: 379976 - DNA, 16 bp, M. musculus
caggatctcatggagg

SEQ ID NO: 379977 - DNA, 16 bp, M. musculus
caggatctcccttctc

SEQ ID NO: 379978 - DNA, 16 bp, M. musculus
caggatctcctggctt

SEQ ID NO: 379979 - DNA, 16 bp, M. musculus
caggatctctcactgg

SEQ ID NO: 379980 - DNA, 16 bp, M. musculus
caggatctggcagaac

SEQ ID NO: 379981 - DNA, 16 bp, M. musculus
caggatctgtcctttg

SEQ ID NO: 379982 - DNA, 16 bp, M. musculus
caggatcttgttgctt

SEQ ID NO: 379983 - DNA, 16 bp, M. musculus
caggatctttattttc

SEQ ID NO: 379984 - DNA, 17 bp, M. musculus
caggatcttttagcttt

SEQ ID NO: 379985 - DNA, 16 bp, M. musculus
caggatgaagatgctc

SEQ ID NO: 379986 - DNA, 16 bp, M. musculus
caggatgacctggaac

SEQ ID NO: 379987 - DNA, 16 bp, M. musculus
caggatgactgtggcc

SEQ ID NO: 379988 - DNA, 16 bp, M. musculus
caggatgagcttttaa

SEQ ID NO: 379989 - DNA, 16 bp, M. musculus
caggatgatattttca

SEQ ID NO: 379990 - DNA, 16 bp, M. musculus
caggatgatggggaat

SEQ ID NO: 379991 - DNA, 16 bp, M. musculus
caggatgcaggagtgg

SEQ ID NO: 379992 - DNA, 16 bp, M. musculus
caggatgcaggatgca

SEQ ID NO: 379993 - DNA, 16 bp, M. musculus
caggatgcattgctga

SEQ ID NO: 379994 - DNA, 19 bp, M. musculus
caggatgctcccttggaaa

SEQ ID NO: 379995 - DNA, 16 bp, M. musculus
caggatgctgaggcag

SEQ ID NO: 379996 - DNA, 16 bp, M. musculus
caggatggaaggagag

SEQ ID NO: 379997 - DNA, 16 bp, M. musculus
caggatggggaagcag

SEQ ID NO: 379998 - DNA, 16 bp, M. musculus
caggattaggaaggtt

SEQ ID NO: 379999 - DNA, 16 bp, M. musculus
caggattcacaggcag

SEQ ID NO: 380000 - DNA, 16 bp, M. musculus
caggattgcatttgaa

SEQ ID NO: 380001 - DNA, 16 bp, M. musculus
caggattgggttacat

SEQ ID NO: 380002 - DNA, 16 bp, M. musculus
caggatttaaacccag

SEQ ID NO: 380003 - DNA, 16 bp, M. musculus
caggatttaaccccaa

SEQ ID NO: 380004 - DNA, 16 bp, M. musculus
caggatttcaaggccc

SEQ ID NO: 380005 - DNA, 16 bp, M. musculus
caggatttcaaggtca

SEQ ID NO: 380006 - DNA, 16 bp, M. musculus
caggatttccagtttt

SEQ ID NO: 380007 - DNA, 16 bp, M. musculus
caggatttctttttgc

SEQ ID NO: 380008 - DNA, 16 bp, M. musculus
caggatttgcttttgt

SEQ ID NO: 380009 - DNA, 16 bp, M. musculus
caggatttgtctgtgt

SEQ ID NO: 380010 - DNA, 16 bp, M. musculus
caggatttttttttcc

SEQ ID NO: 380011 - DNA, 16 bp, M. musculus
caggcaaaacaccagt

SEQ ID NO: 380012 - DNA, 16 bp, M. musculus
caggcaaaacattcat

SEQ ID NO: 380013 - DNA, 16 bp, M. musculus
caggcaaaagactcag

SEQ ID NO: 380014 - DNA, 16 bp, M. musculus
caggcaaacattcaca

SEQ ID NO: 380015 - DNA, 16 bp, M. musculus
caggcaagcactcctc

SEQ ID NO: 380016 - DNA, 16 bp, M. musculus
caggcaagcaggcaag

SEQ ID NO: 380017 - DNA, 16 bp, M. musculus
caggcaaggcagtcct

SEQ ID NO: 380018 - DNA, 16 bp, M. musculus
caggcaaggtggcaca

SEQ ID NO: 380019 - DNA, 16 bp, M. musculus
caggcacaagctcagg

SEQ ID NO: 380020 - DNA, 16 bp, M. musculus
caggcacacacagaag

SEQ ID NO: 380021 - DNA, 16 bp, M. musculus
caggcacacacattca

SEQ ID NO: 380022 - DNA, 16 bp, M. musculus
caggcacacctgcaca

SEQ ID NO: 380023 - DNA, 16 bp, M. musculus
caggcacagacacaga

SEQ ID NO: 380024 - DNA, 16 bp, M. musculus
caggcacagacagaaa

SEQ ID NO: 380025 - DNA, 16 bp, M. musculus
caggcacagacaggca

SEQ ID NO: 380026 - DNA, 16 bp, M. musculus
caggcacagagagaaa

SEQ ID NO: 380027 - DNA, 16 bp, M. musculus
caggcacagcaggcac

SEQ ID NO: 380028 - DNA, 16 bp, M. musculus
caggcacagggaacag

SEQ ID NO: 380029 - DNA, 16 bp, M. musculus
caggcaccaagaatgg

SEQ ID NO: 380030 - DNA, 16 bp, M. musculus
caggcaccaccagcac

SEQ ID NO: 380031 - DNA, 16 bp, M. musculus
caggcaccaggcacca

SEQ ID NO: 380032 - DNA, 16 bp, M. musculus
caggcaccaggcatgc

SEQ ID NO: 380033 - DNA, 16 bp, M. musculus
caggcaccagtcagac

SEQ ID NO: 380034 - DNA, 16 bp, M. musculus
caggcaccggcagagc

SEQ ID NO: 380035 - DNA, 16 bp, M. musculus
caggcacctgcatagc

SEQ ID NO: 380036 - DNA, 16 bp, M. musculus
caggcaccttccccgc

SEQ ID NO: 380037 - DNA, 16 bp, M. musculus
caggcactggcagaac

SEQ ID NO: 380038 - DNA, 16 bp, M. musculus
caggcactggcagagg

SEQ ID NO: 380039 - DNA, 16 bp, M. musculus
caggcactggcattgc

SEQ ID NO: 380040 - DNA, 16 bp, M. musculus
caggcactggtagagc

SEQ ID NO: 380041 - DNA, 16 bp, M. musculus
caggcactggtagagt

SEQ ID NO: 380042 - DNA, 16 bp, M. musculus
caggcactgtgctgag

SEQ ID NO: 380043 - DNA, 16 bp, M. musculus
caggcacttgcagagc

SEQ ID NO: 380044 - DNA, 16 bp, M. musculus
caggcacttttagcca

SEQ ID NO: 380045 - DNA, 16 bp, M. musculus
caggcagaacacaggc

SEQ ID NO: 380046 - DNA, 16 bp, M. musculus
caggcagaactcccag

SEQ ID NO: 380047 - DNA, 16 bp, M. musculus
caggcagaagagctgg

SEQ ID NO: 380048 - DNA, 16 bp, M. musculus
caggcagaagaggctg

SEQ ID NO: 380049 - DNA, 16 bp, M. musculus
caggcagaagagtcag

SEQ ID NO: 380050 - DNA, 16 bp, M. musculus
caggcagaagctgaga

SEQ ID NO: 380051 - DNA, 16 bp, M. musculus
caggcagacaacagag

SEQ ID NO: 380052 - DNA, 16 bp, M. musculus
caggcagacagacaca

SEQ ID NO: 380053 - DNA, 16 bp, M. musculus
caggcagacagacaga

SEQ ID NO: 380054 - DNA, 16 bp, M. musculus
caggcagacagacagc

SEQ ID NO: 380055 - DNA, 16 bp, M. musculus
caggcagacctggtgc

SEQ ID NO: 380056 - DNA, 16 bp, M. musculus
caggcagagacagaca

SEQ ID NO: 380057 - DNA, 16 bp, M. musculus
caggcagagacaggca

SEQ ID NO: 380058 - DNA, 16 bp, M. musculus
caggcagagccaggca

SEQ ID NO: 380059 - DNA, 16 bp, M. musculus
caggcagagctaagag

SEQ ID NO: 380060 - DNA, 16 bp, M. musculus
caggcagagctctctg

SEQ ID NO: 380061 - DNA, 16 bp, M. musculus
caggcagagctctgag

SEQ ID NO: 380062 - DNA, 16 bp, M. musculus
caggcagaggcagagg

SEQ ID NO: 380063 - DNA, 16 bp, M. musculus
caggcagatctctgct

SEQ ID NO: 380064 - DNA, 16 bp, M. musculus
caggcagatttctcag

SEQ ID NO: 380065 - DNA, 16 bp, M. musculus
caggcagatttctgat

SEQ ID NO: 380066 - DNA, 16 bp, M. musculus
caggcagatttctgtg

SEQ ID NO: 380067 - DNA, 16 bp, M. musculus
caggcagcaaacacca

SEQ ID NO: 380068 - DNA, 16 bp, M. musculus
caggcagcaagaagag

SEQ ID NO: 380069 - DNA, 16 bp, M. musculus
caggcagcacacacag

SEQ ID NO: 380070 - DNA, 16 bp, M. musculus
caggcagcagagagag

SEQ ID NO: 380071 - DNA, 16 bp, M. musculus
caggcagcagagctgg

SEQ ID NO: 380072 - DNA, 16 bp, M. musculus
caggcagcagcagcag

SEQ ID NO: 380073 - DNA, 16 bp, M. musculus
caggcagcagcagctc

SEQ ID NO: 380074 - DNA, 16 bp, M. musculus
caggcagcagcagtgg

SEQ ID NO: 380075 - DNA, 16 bp, M. musculus
caggcagcaggaaaag

SEQ ID NO: 380076 - DNA, 16 bp, M. musculus
caggcagcaggaagag

SEQ ID NO: 380077 - DNA, 16 bp, M. musculus
caggcagcaggaggat

SEQ ID NO: 380078 - DNA, 16 bp, M. musculus
caggcagcaggcacac

SEQ ID NO: 380079 - DNA, 16 bp, M. musculus
caggcagcaggcacag

SEQ ID NO: 380080 - DNA, 16 bp, M. musculus
caggcagccagaagga

SEQ ID NO: 380081 - DNA, 16 bp, M. musculus
caggcagccaggcagc

SEQ ID NO: 380082 - DNA, 16 bp, M. musculus
caggcagcccagctag

SEQ ID NO: 380083 - DNA, 16 bp, M. musculus
caggcagcggcagtgg

SEQ ID NO: 380084 - DNA, 16 bp, M. musculus
caggcagctaagagga

SEQ ID NO: 380085 - DNA, 16 bp, M. musculus
caggcagctagatgag

SEQ ID NO: 380086 - DNA, 16 bp, M. musculus
caggcagctcacaaac

SEQ ID NO: 380087 - DNA, 16 bp, M. musculus
caggcagctggagcag

SEQ ID NO: 380088 - DNA, 16 bp, M. musculus
caggcagctggggtaa

SEQ ID NO: 380089 - DNA, 16 bp, M. musculus
caggcaggaaacagag

SEQ ID NO: 380090 - DNA, 16 bp, M. musculus
caggcaggacttccag

SEQ ID NO: 380091 - DNA, 16 bp, M. musculus
caggcaggagagctgg

SEQ ID NO: 380092 - DNA, 16 bp, M. musculus
caggcaggaggcagag

SEQ ID NO: 380093 - DNA, 16 bp, M. musculus
caggcaggcagacagt

SEQ ID NO: 380094 - DNA, 16 bp, M. musculus
caggcaggcaggaggg

SEQ ID NO: 380095 - DNA, 16 bp, M. musculus
caggcaggcaggcaga

SEQ ID NO: 380096 - DNA, 16 bp, M. musculus
caggcaggcaggccag

SEQ ID NO: 380097 - DNA, 16 bp, M. musculus
caggcaggcaggcggg

SEQ ID NO: 380098 - DNA, 16 bp, M. musculus
caggcaggcaggctgc

SEQ ID NO: 380099 - DNA, 16 bp, M. musculus
caggcaggcagggtgc

SEQ ID NO: 380100 - DNA, 16 bp, M. musculus
caggcaggcatgatgc

SEQ ID NO: 380101 - DNA, 16 bp, M. musculus
caggcaggcatgcatg

SEQ ID NO: 380102 - DNA, 16 bp, M. musculus
caggcaggcatggagc

SEQ ID NO: 380103 - DNA, 16 bp, M. musculus
caggcaggcctagaac

SEQ ID NO: 380104 - DNA, 16 bp, M. musculus
caggcaggccttgaac

SEQ ID NO: 380105 - DNA, 16 bp, M. musculus
caggcagggatggtgc

SEQ ID NO: 380106 - DNA, 16 bp, M. musculus
caggcagggcaggaag

SEQ ID NO: 380107 - DNA, 16 bp, M. musculus
caggcagggctgcccc

SEQ ID NO: 380108 - DNA, 16 bp, M. musculus
caggcagggctggaga

SEQ ID NO: 380109 - DNA, 16 bp, M. musculus
caggcaggtagcaggt

SEQ ID NO: 380110 - DNA, 16 bp, M. musculus
caggcaggtctctggg

SEQ ID NO: 380111 - DNA, 16 bp, M. musculus
caggcagtcatggtgc

SEQ ID NO: 380112 - DNA, 16 bp, M. musculus
caggcagtcccctgct

SEQ ID NO: 380113 - DNA, 16 bp, M. musculus
caggcagtgctggtgc

SEQ ID NO: 380114 - DNA, 16 bp, M. musculus
caggcagtgctgtctc

SEQ ID NO: 380115 - DNA, 16 bp, M. musculus
caggcagtggcagctc

SEQ ID NO: 380116 - DNA, 16 bp, M. musculus
caggcagtggtagcgc

SEQ ID NO: 380117 - DNA, 16 bp, M. musculus
caggcagtggtgctgc

SEQ ID NO: 380118 - DNA, 16 bp, M. musculus
caggcagtgtctttgc

SEQ ID NO: 380119 - DNA, 16 bp, M. musculus
caggcagttctctgtg

SEQ ID NO: 380120 - DNA, 16 bp, M. musculus
caggcagttgtgaact

SEQ ID NO: 380121 - DNA, 16 bp, M. musculus
caggcatacatgcagt

SEQ ID NO: 380122 - DNA, 16 bp, M. musculus
caggcatacattcagg

SEQ ID NO: 380123 - DNA, 16 bp, M. musculus
caggcatagtggctca

SEQ ID NO: 380124 - DNA, 16 bp, M. musculus
caggcatatatacata

SEQ ID NO: 380125 - DNA, 17 bp, M. musculus
caggcatctccaagtca

SEQ ID NO: 380126 - DNA, 16 bp, M. musculus
caggcatctgcactca

SEQ ID NO: 380127 - DNA, 16 bp, M. musculus
caggcatgaacatggt

SEQ ID NO: 380128 - DNA, 16 bp, M. musculus
caggcatgagccagca

SEQ ID NO: 380129 - DNA, 16 bp, M. musculus
caggcatgagctacca

SEQ ID NO: 380130 - DNA, 16 bp, M. musculus
caggcatgatgctaga

SEQ ID NO: 380131 - DNA, 16 bp, M. musculus
caggcatgcagggatg

SEQ ID NO: 380132 - DNA, 16 bp, M. musculus
caggcatgcatatggt

SEQ ID NO: 380133 - DNA, 16 bp, M. musculus
caggcatgcatgtgtg

SEQ ID NO: 380134 - DNA, 16 bp, M. musculus
caggcatgcccacagg

SEQ ID NO: 380135 - DNA, 16 bp, M. musculus
caggcatgctgcagga

SEQ ID NO: 380136 - DNA, 16 bp, M. musculus
caggcatgctggcaca

SEQ ID NO: 380137 - DNA, 16 bp, M. musculus
caggcatggagcaggc

SEQ ID NO: 380138 - DNA, 16 bp, M. musculus
caggcatggggctgga

SEQ ID NO: 380139 - DNA, 16 bp, M. musculus
caggcatgggggcaca

SEQ ID NO: 380140 - DNA, 16 bp, M. musculus
caggcatggtagcgca

SEQ ID NO: 380141 - DNA, 16 bp, M. musculus
caggcatggtagtgca

SEQ ID NO: 380142 - DNA, 16 bp, M. musculus
caggcatggtgacaca

SEQ ID NO: 380143 - DNA, 16 bp, M. musculus
caggcatggtggccag

SEQ ID NO: 380144 - DNA, 16 bp, M. musculus
caggcatggtggcctg

SEQ ID NO: 380145 - DNA, 16 bp, M. musculus
caggcatggtgggaca

SEQ ID NO: 380146 - DNA, 16 bp, M. musculus
caggcatggtggtgca

SEQ ID NO: 380147 - DNA, 16 bp, M. musculus
caggcatgtccaacct

SEQ ID NO: 380148 - DNA, 16 bp, M. musculus
caggcatgtgccacca

SEQ ID NO: 380149 - DNA, 16 bp, M. musculus
caggcatgtgccatca

SEQ ID NO: 380150 - DNA, 16 bp, M. musculus
caggcatgtgttacca

SEQ ID NO: 380151 - DNA, 16 bp, M. musculus
caggcattttcttgat

SEQ ID NO: 380152 - DNA, 16 bp, M. musculus
caggccaacctgggct

SEQ ID NO: 380153 - DNA, 16 bp, M. musculus
caggccaaggctgatc

SEQ ID NO: 380154 - DNA, 16 bp, M. musculus
caggccaatgaaagac

SEQ ID NO: 380155 - DNA, 16 bp, M. musculus
caggccaatgagagag

SEQ ID NO: 380156 - DNA, 16 bp, M. musculus
caggccaattggcaga

SEQ ID NO: 380157 - DNA, 16 bp, M. musculus
caggccacagacatca

SEQ ID NO: 380158 - DNA, 16 bp, M. musculus
caggccacatattcag

SEQ ID NO: 380159 - DNA, 16 bp, M. musculus
caggccaccaagtcca

SEQ ID NO: 380160 - DNA, 16 bp, M. musculus
caggccacccagggct

SEQ ID NO: 380161 - DNA, 16 bp, M. musculus
caggccaccctgggct

SEQ ID NO: 380162 - DNA, 16 bp, M. musculus
caggccagccagaact

SEQ ID NO: 380163 - DNA, 16 bp, M. musculus
caggccagccagcctg

SEQ ID NO: 380164 - DNA, 16 bp, M. musculus
caggccagccaggact

SEQ ID NO: 380165 - DNA, 16 bp, M. musculus
caggccagccaggcta

SEQ ID NO: 380166 - DNA, 17 bp, M. musculus
caggccagccagggctg

SEQ ID NO: 380167 - DNA, 16 bp, M. musculus
caggccagccaggtct

SEQ ID NO: 380168 - DNA, 16 bp, M. musculus
caggccagccccaaca

SEQ ID NO: 380169 - DNA, 16 bp, M. musculus
caggccagcctggcct

SEQ ID NO: 380170 - DNA, 16 bp, M. musculus
caggccagcctgggca

SEQ ID NO: 380171 - DNA, 17 bp, M. musculus
caggccagcctggtcta

SEQ ID NO: 380172 - DNA, 16 bp, M. musculus
caggccaggcagtggt

SEQ ID NO: 380173 - DNA, 16 bp, M. musculus
caggccagggagcagg

SEQ ID NO: 380174 - DNA, 16 bp, M. musculus
caggccaggtggcagg

SEQ ID NO: 380175 - DNA, 16 bp, M. musculus
caggccaggtggctgg

SEQ ID NO: 380176 - DNA, 16 bp, M. musculus
caggccagtctgatct

SEQ ID NO: 380177 - DNA, 16 bp, M. musculus
caggccagtgagatgg

SEQ ID NO: 380178 - DNA, 16 bp, M. musculus
caggccatccagagct

SEQ ID NO: 380179 - DNA, 16 bp, M. musculus
caggccatctctccag

SEQ ID NO: 380180 - DNA, 16 bp, M. musculus
caggcccagacccagg

SEQ ID NO: 380181 - DNA, 16 bp, M. musculus
caggcccagattcagg

SEQ ID NO: 380182 - DNA, 16 bp, M. musculus
caggcccagccccagc

SEQ ID NO: 380183 - DNA, 16 bp, M. musculus
caggcccaggaagcag

SEQ ID NO: 380184 - DNA, 16 bp, M. musculus
caggcccagggacccc

SEQ ID NO: 380185 - DNA, 16 bp, M. musculus
caggcccaggtccagg

SEQ ID NO: 380186 - DNA, 16 bp, M. musculus
caggccccaaagggga

SEQ ID NO: 380187 - DNA, 16 bp, M. musculus
caggcccccagacctt

SEQ ID NO: 380188 - DNA, 16 bp, M. musculus
caggccccggccggag

SEQ ID NO: 380189 - DNA, 92 bp, M. musculus
caggcccgaacaaacgcagctgctttgactccagagcagagagattggacttttgacttgttaacgggtcagggagcttattctgctgatca

SEQ ID NO: 380190 - DNA, 16 bp, M. musculus
caggccctgctcctga

SEQ ID NO: 380191 - DNA, 16 bp, M. musculus
caggcctacatctgca

SEQ ID NO: 380192 - DNA, 16 bp, M. musculus
caggcctaccaggaga

SEQ ID NO: 380193 - DNA, 16 bp, M. musculus
caggcctcaggacaat

SEQ ID NO: 380194 - DNA, 16 bp, M. musculus
caggcctcctgctgcc

SEQ ID NO: 380195 - DNA, 16 bp, M. musculus
caggcctctgcctcct

SEQ ID NO: 380196 - DNA, 16 bp, M. musculus
caggcctctggcttct

SEQ ID NO: 380197 - DNA, 16 bp, M. musculus
caggcctggcagcaag

SEQ ID NO: 380198 - DNA, 16 bp, M. musculus
caggcctggggacccc

SEQ ID NO: 380199 - DNA, 16 bp, M. musculus
caggcctggtgctgga

SEQ ID NO: 380200 - DNA, 16 bp, M. musculus
caggcctggtggcaca

SEQ ID NO: 380201 - DNA, 16 bp, M. musculus
caggcctggtggtaca

SEQ ID NO: 380202 - DNA, 16 bp, M. musculus
caggcctgtaatccta

SEQ ID NO: 380203 - DNA, 16 bp, M. musculus
caggcctgtcatccca

SEQ ID NO: 380204 - DNA, 16 bp, M. musculus
caggcctgtgccacca

SEQ ID NO: 380205 - DNA, 16 bp, M. musculus
caggcctgtgccactg

SEQ ID NO: 380206 - DNA, 16 bp, M. musculus
caggcctgtgctacca

SEQ ID NO: 380207 - DNA, 16 bp, M. musculus
caggccttcatgcttg

SEQ ID NO: 380208 - DNA, 16 bp, M. musculus
caggccttgcccttct

SEQ ID NO: 380209 - DNA, 16 bp, M. musculus
caggccttgtgcttct

SEQ ID NO: 380210 - DNA, 17 bp, M. musculus
caggcgcagcctctata

SEQ ID NO: 380211 - DNA, 20 bp, M. musculus
caggcggatttttgagttcg

SEQ ID NO: 380212 - DNA, 16 bp, M. musculus
caggcgtagtggtgca

SEQ ID NO: 380213 - DNA, 16 bp, M. musculus
caggcgtggtggcaca

SEQ ID NO: 380214 - DNA, 16 bp, M. musculus
caggctaaccttgaac

SEQ ID NO: 380215 - DNA, 16 bp, M. musculus
caggctaagaaaggaa

SEQ ID NO: 380216 - DNA, 16 bp, M. musculus
caggctaagccagaac

SEQ ID NO: 380217 - DNA, 16 bp, M. musculus
caggctagcctcaaat

SEQ ID NO: 380218 - DNA, 16 bp, M. musculus
caggctagcctggact

SEQ ID NO: 380219 - DNA, 16 bp, M. musculus
caggctatacagagaa

SEQ ID NO: 380220 - DNA, 16 bp, M. musculus
caggctatccttaaac

SEQ ID NO: 380221 - DNA, 16 bp, M. musculus
caggctcacaggatca

SEQ ID NO: 380222 - DNA, 16 bp, M. musculus
caggctcagaaagaca

SEQ ID NO: 380223 - DNA, 16 bp, M. musculus
caggctcagatccagg

SEQ ID NO: 380224 - DNA, 16 bp, M. musculus
caggctcagcagcaag

SEQ ID NO: 380225 - DNA, 16 bp, M. musculus
caggctcaggctcagg

SEQ ID NO: 380226 - DNA, 16 bp, M. musculus
caggctcatatatttg

SEQ ID NO: 380227 - DNA, 17 bp, M. musculus
caggctccaaggatgaa

SEQ ID NO: 380228 - DNA, 16 bp, M. musculus
caggctccaccctagg

SEQ ID NO: 380229 - DNA, 16 bp, M. musculus
caggctccagcagtgg

SEQ ID NO: 380230 - DNA, 16 bp, M. musculus
caggctccagtcagac

SEQ ID NO: 380231 - DNA, 16 bp, M. musculus
caggctcctgccacca

SEQ ID NO: 380232 - DNA, 16 bp, M. musculus
caggctcctgtcagca

SEQ ID NO: 380233 - DNA, 16 bp, M. musculus
caggctctctcactgg

SEQ ID NO: 380234 - DNA, 16 bp, M. musculus
caggctctctcctctg

SEQ ID NO: 380235 - DNA, 16 bp, M. musculus
caggctctgctccaaa

SEQ ID NO: 380236 - DNA, 16 bp, M. musculus
caggctctggaagaac

SEQ ID NO: 380237 - DNA, 16 bp, M. musculus
caggctctggaagagc

SEQ ID NO: 380238 - DNA, 16 bp, M. musculus
caggctctggatacct

SEQ ID NO: 380239 - DNA, 16 bp, M. musculus
caggctctggcagagg

SEQ ID NO: 380240 - DNA, 16 bp, M. musculus
caggctctgtgagttc

SEQ ID NO: 380241 - DNA, 16 bp, M. musculus
caggctcttctggctt

SEQ ID NO: 380242 - DNA, 16 bp, M. musculus
caggctcttgagggtt

SEQ ID NO: 380243 - DNA, 16 bp, M. musculus
caggctcttgcagcca

SEQ ID NO: 380244 - DNA, 16 bp, M. musculus
caggctgacctggagc

SEQ ID NO: 380245 - DNA, 16 bp, M. musculus
caggctgacctgtgag

SEQ ID NO: 380246 - DNA, 16 bp, M. musculus
caggctgactctgaac

SEQ ID NO: 380247 - DNA, 16 bp, M. musculus
caggctgactggccag

SEQ ID NO: 380248 - DNA, 16 bp, M. musculus
caggctgagaatgaaa

SEQ ID NO: 380249 - DNA, 16 bp, M. musculus
caggctgagaggcctg

SEQ ID NO: 380250 - DNA, 16 bp, M. musculus
caggctgagcaaccca

SEQ ID NO: 380251 - DNA, 16 bp, M. musculus
caggctgaggctgagg

SEQ ID NO: 380252 - DNA, 16 bp, M. musculus
caggctgaggtgggag

SEQ ID NO: 380253 - DNA, 16 bp, M. musculus
caggctgagtaagcca

SEQ ID NO: 380254 - DNA, 16 bp, M. musculus
caggctgcagaagcaa

SEQ ID NO: 380255 - DNA, 16 bp, M. musculus
caggctgccagggcag

SEQ ID NO: 380256 - DNA, 16 bp, M. musculus
caggctgccctcagac

SEQ ID NO: 380257 - DNA, 16 bp, M. musculus
caggctgccctccaac

SEQ ID NO: 380258 - DNA, 16 bp, M. musculus
caggctgccctggaac

SEQ ID NO: 380259 - DNA, 16 bp, M. musculus
caggctgcctctgcct

SEQ ID NO: 380260 - DNA, 16 bp, M. musculus
caggctgctcttgcag

SEQ ID NO: 380261 - DNA, 16 bp, M. musculus
caggctgctttctgct

SEQ ID NO: 380262 - DNA, 16 bp, M. musculus
caggctggagagctgg

SEQ ID NO: 380263 - DNA, 16 bp, M. musculus
caggctggagaggtgg

SEQ ID NO: 380264 - DNA, 16 bp, M. musculus
caggctggccagccag

SEQ ID NO: 380265 - DNA, 16 bp, M. musculus
caggctggccagtgag

SEQ ID NO: 380266 - DNA, 16 bp, M. musculus
caggctggccccaaca

SEQ ID NO: 380267 - DNA, 16 bp, M. musculus
caggctggcctcaagc

SEQ ID NO: 380268 - DNA, 16 bp, M. musculus
caggctggcctcagct

SEQ ID NO: 380269 - DNA, 16 bp, M. musculus
caggctggcctcatac

SEQ ID NO: 380270 - DNA, 16 bp, M. musculus
caggctggcctccaac

SEQ ID NO: 380271 - DNA, 37 bp, M. musculus
caggctggcctcgaactcagaaatccgcctgcctctg

SEQ ID NO: 380272 - DNA, 16 bp, M. musculus
caggctggcctcgaag

SEQ ID NO: 380273 - DNA, 17 bp, M. musculus
caggctggcctggaaca

SEQ ID NO: 380274 - DNA, 25 bp, M. musculus
caggctggccttgaactcagaaatt

SEQ ID NO: 380275 - DNA, 19 bp, M. musculus
caggctggccttgaactcg

SEQ ID NO: 380276 - DNA, 16 bp, M. musculus
caggctggccttggcc

SEQ ID NO: 380277 - DNA, 16 bp, M. musculus
caggctggcgagatgg

SEQ ID NO: 380278 - DNA, 16 bp, M. musculus
caggctggctcaaact

SEQ ID NO: 380279 - DNA, 16 bp, M. musculus
caggctggctttaaac

SEQ ID NO: 380280 - DNA, 16 bp, M. musculus
caggctgggcagcagg

SEQ ID NO: 380281 - DNA, 16 bp, M. musculus
caggctgggctacata

SEQ ID NO: 380282 - DNA, 16 bp, M. musculus
caggctgggtgtggtg

SEQ ID NO: 380283 - DNA, 16 bp, M. musculus
caggctggtctctgtg

SEQ ID NO: 380284 - DNA, 16 bp, M. musculus
caggctggtctggaac

SEQ ID NO: 380285 - DNA, 16 bp, M. musculus
caggctggtcttgaag

SEQ ID NO: 380286 - DNA, 16 bp, M. musculus
caggctggtgtcaaac

SEQ ID NO: 380287 - DNA, 16 bp, M. musculus
caggctggtgtgtgtg

SEQ ID NO: 380288 - DNA, 16 bp, M. musculus
caggctggtttcgaac

SEQ ID NO: 380289 - DNA, 18 bp, M. musculus
caggctgtgctagatgga

SEQ ID NO: 380290 - DNA, 16 bp, M. musculus
caggctgtggcagagc

SEQ ID NO: 380291 - DNA, 16 bp, M. musculus
caggctgtggcctctg

SEQ ID NO: 380292 - DNA, 16 bp, M. musculus
caggctgtggtctagc

SEQ ID NO: 380293 - DNA, 16 bp, M. musculus
caggctgtttattctt

SEQ ID NO: 380294 - DNA, 16 bp, M. musculus
caggcttccctgtagg

SEQ ID NO: 380295 - DNA, 16 bp, M. musculus
caggcttctgggacct

SEQ ID NO: 380296 - DNA, 16 bp, M. musculus
caggcttgcccacagc

SEQ ID NO: 380297 - DNA, 16 bp, M. musculus
caggcttgcctacaac

SEQ ID NO: 380298 - DNA, 16 bp, M. musculus
caggcttgcctcaaac

SEQ ID NO: 380299 - DNA, 16 bp, M. musculus
caggcttgcctgcagc

SEQ ID NO: 380300 - DNA, 16 bp, M. musculus
caggcttgcttggcaa

SEQ ID NO: 380301 - DNA, 16 bp, M. musculus
caggcttggcagcaag

SEQ ID NO: 380302 - DNA, 16 bp, M. musculus
caggcttggccacaag

SEQ ID NO: 380303 - DNA, 16 bp, M. musculus
caggcttggtgacaca

SEQ ID NO: 380304 - DNA, 16 bp, M. musculus
caggcttggtgacagg

SEQ ID NO: 380305 - DNA, 16 bp, M. musculus
caggcttggtgcagga

SEQ ID NO: 380306 - DNA, 16 bp, M. musculus
caggcttgtctgcact

SEQ ID NO: 380307 - DNA, 16 bp, M. musculus
caggctttaaaggaaa

SEQ ID NO: 380308 - DNA, 16 bp, M. musculus
caggctttgagagttt

SEQ ID NO: 380309 - DNA, 16 bp, M. musculus
caggctttgaggtttc

SEQ ID NO: 380310 - DNA, 16 bp, M. musculus
caggctttggcagagc

SEQ ID NO: 380311 - DNA, 16 bp, M. musculus
caggcttttccctact

SEQ ID NO: 380312 - DNA, 16 bp, M. musculus
caggcttttgaagtaa

SEQ ID NO: 380313 - DNA, 16 bp, M. musculus
cagggaaaaagatgga

SEQ ID NO: 380314 - DNA, 16 bp, M. musculus
cagggaaacagtgaaa

SEQ ID NO: 380315 - DNA, 16 bp, M. musculus
cagggaaaccttgtct

SEQ ID NO: 380316 - DNA, 16 bp, M. musculus
cagggaaatgaaaata

SEQ ID NO: 380317 - DNA, 16 bp, M. musculus
cagggaaattcaaatc

SEQ ID NO: 380318 - DNA, 16 bp, M. musculus
cagggaaccctgtgga

SEQ ID NO: 380319 - DNA, 16 bp, M. musculus
cagggaacctggtggg

SEQ ID NO: 380320 - DNA, 16 bp, M. musculus
cagggaactccaggga

SEQ ID NO: 380321 - DNA, 16 bp, M. musculus
cagggaagcaaacaca

SEQ ID NO: 380322 - DNA, 16 bp, M. musculus
cagggaagcagagaca

SEQ ID NO: 380323 - DNA, 16 bp, M. musculus
cagggaagcctgtgct

SEQ ID NO: 380324 - DNA, 16 bp, M. musculus
cagggaaggaaggcag

SEQ ID NO: 380325 - DNA, 16 bp, M. musculus
cagggaaggcttcctg

SEQ ID NO: 380326 - DNA, 16 bp, M. musculus
cagggaaggtgcacag

SEQ ID NO: 380327 - DNA, 16 bp, M. musculus
cagggaaggtgcagag

SEQ ID NO: 380328 - DNA, 16 bp, M. musculus
cagggaagtcaaggca

SEQ ID NO: 380329 - DNA, 16 bp, M. musculus
cagggaagtgggaatg

SEQ ID NO: 380330 - DNA, 16 bp, M. musculus
cagggaagttgcccag

SEQ ID NO: 380331 - DNA, 16 bp, M. musculus
cagggaatctggtgcc

SEQ ID NO: 380332 - DNA, 16 bp, M. musculus
cagggacaaaaccacc

SEQ ID NO: 380333 - DNA, 16 bp, M. musculus
cagggacaaagagcag

SEQ ID NO: 380334 - DNA, 16 bp, M. musculus
cagggacaaagatgga

SEQ ID NO: 380335 - DNA, 16 bp, M. musculus
cagggacaagacaaag

SEQ ID NO: 380336 - DNA, 16 bp, M. musculus
cagggacacagggaaa

SEQ ID NO: 380337 - DNA, 16 bp, M. musculus
cagggacacagggaca

SEQ ID NO: 380338 - DNA, 16 bp, M. musculus
cagggacacagtggaa

SEQ ID NO: 380339 - DNA, 16 bp, M. musculus
cagggacagacagaca

SEQ ID NO: 380340 - DNA, 16 bp, M. musculus
cagggacagagacaga

SEQ ID NO: 380341 - DNA, 16 bp, M. musculus
cagggacagcccctgc

SEQ ID NO: 380342 - DNA, 16 bp, M. musculus
cagggacagccggcca

SEQ ID NO: 380343 - DNA, 16 bp, M. musculus
cagggacatcaaccaa

SEQ ID NO: 380344 - DNA, 16 bp, M. musculus
cagggacatcttctcc

SEQ ID NO: 380345 - DNA, 16 bp, M. musculus
cagggaccaaggagac

SEQ ID NO: 380346 - DNA, 16 bp, M. musculus
cagggacccaagttca

SEQ ID NO: 380347 - DNA, 16 bp, M. musculus
cagggacccacatggt

SEQ ID NO: 380348 - DNA, 16 bp, M. musculus
cagggaccccagaacc

SEQ ID NO: 380349 - DNA, 16 bp, M. musculus
cagggaccctcagcat

SEQ ID NO: 380350 - DNA, 16 bp, M. musculus
cagggaccctcctgcc

SEQ ID NO: 380351 - DNA, 16 bp, M. musculus
cagggacctcaggaat

SEQ ID NO: 380352 - DNA, 16 bp, M. musculus
cagggacctgcctgtc

SEQ ID NO: 380353 - DNA, 16 bp, M. musculus
cagggacgcagggatg

SEQ ID NO: 380354 - DNA, 16 bp, M. musculus
cagggactaaacctcc

SEQ ID NO: 380355 - DNA, 16 bp, M. musculus
cagggagaaaaatgga

SEQ ID NO: 380356 - DNA, 16 bp, M. musculus
cagggagaagaaagca

SEQ ID NO: 380357 - DNA, 16 bp, M. musculus
cagggagaaggcagag

SEQ ID NO: 380358 - DNA, 16 bp, M. musculus
cagggagacagagaaa

SEQ ID NO: 380359 - DNA, 16 bp, M. musculus
cagggagacagagaca

SEQ ID NO: 380360 - DNA, 16 bp, M. musculus
cagggagacccctctg

SEQ ID NO: 380361 - DNA, 16 bp, M. musculus
cagggagaggaatgtg

SEQ ID NO: 380362 - DNA, 16 bp, M. musculus
cagggagatggctcag

SEQ ID NO: 380363 - DNA, 16 bp, M. musculus
cagggagccaagcaag

SEQ ID NO: 380364 - DNA, 16 bp, M. musculus
cagggagcccttacct

SEQ ID NO: 380365 - DNA, 16 bp, M. musculus
cagggagctctggggc

SEQ ID NO: 380366 - DNA, 16 bp, M. musculus
cagggagctctgggtg

SEQ ID NO: 380367 - DNA, 16 bp, M. musculus
cagggagctgaaggtg

SEQ ID NO: 380368 - DNA, 16 bp, M. musculus
cagggagctggaacag

SEQ ID NO: 380369 - DNA, 16 bp, M. musculus
cagggagtatggagag

SEQ ID NO: 380370 - DNA, 16 bp, M. musculus
cagggagtgaaatgtg

SEQ ID NO: 380371 - DNA, 16 bp, M. musculus
cagggagtgctggagg

SEQ ID NO: 380372 - DNA, 16 bp, M. musculus
cagggagtggaaacag

SEQ ID NO: 380373 - DNA, 16 bp, M. musculus
cagggagtggaaccaa

SEQ ID NO: 380374 - DNA, 16 bp, M. musculus
cagggatcaaattcag

SEQ ID NO: 380375 - DNA, 16 bp, M. musculus
cagggatcagactcag

SEQ ID NO: 380376 - DNA, 16 bp, M. musculus
cagggatcgaactcag

SEQ ID NO: 380377 - DNA, 16 bp, M. musculus
cagggatctctggagg

SEQ ID NO: 380378 - DNA, 16 bp, M. musculus
cagggatgaaaatgga

SEQ ID NO: 380379 - DNA, 16 bp, M. musculus
cagggatgcaggagtg

SEQ ID NO: 380380 - DNA, 16 bp, M. musculus
cagggatggagagatg

SEQ ID NO: 380381 - DNA, 16 bp, M. musculus
cagggatggagggatg

SEQ ID NO: 380382 - DNA, 16 bp, M. musculus
cagggatgggaatgga

SEQ ID NO: 380383 - DNA, 16 bp, M. musculus
cagggatgtggggatg

SEQ ID NO: 380384 - DNA, 16 bp, M. musculus
cagggattctctgtgc

SEQ ID NO: 380385 - DNA, 16 bp, M. musculus
cagggcaacacagaga

SEQ ID NO: 380386 - DNA, 16 bp, M. musculus
cagggcaactgggcaa

SEQ ID NO: 380387 - DNA, 16 bp, M. musculus
cagggcaaggaagcag

SEQ ID NO: 380388 - DNA, 16 bp, M. musculus
cagggcacagagacag

SEQ ID NO: 380389 - DNA, 16 bp, M. musculus
cagggcacaggcaaca

SEQ ID NO: 380390 - DNA, 16 bp, M. musculus
cagggcacagggaggg

SEQ ID NO: 380391 - DNA, 16 bp, M. musculus
cagggcagaaattcaa

SEQ ID NO: 380392 - DNA, 25 bp, M. musculus
cagggcagagatatcatgagcctct

SEQ ID NO: 380393 - DNA, 16 bp, M. musculus
cagggcagaggcagag

SEQ ID NO: 380394 - DNA, 16 bp, M. musculus
cagggcagcagaggca

SEQ ID NO: 380395 - DNA, 16 bp, M. musculus
cagggcagcatccagg

SEQ ID NO: 380396 - DNA, 16 bp, M. musculus
cagggcagccagggca

SEQ ID NO: 380397 - DNA, 16 bp, M. musculus
cagggcagcccagcta

SEQ ID NO: 380398 - DNA, 16 bp, M. musculus
cagggcagctagggct

SEQ ID NO: 380399 - DNA, 16 bp, M. musculus
cagggcaggaagacag

SEQ ID NO: 380400 - DNA, 16 bp, M. musculus
cagggcaggaagcagg

SEQ ID NO: 380401 - DNA, 16 bp, M. musculus
cagggcaggaaggtgg

SEQ ID NO: 380402 - DNA, 16 bp, M. musculus
cagggcaggagctcaa

SEQ ID NO: 380403 - DNA, 16 bp, M. musculus
cagggcagggcagagg

SEQ ID NO: 380404 - DNA, 16 bp, M. musculus
cagggcagggcagggt

SEQ ID NO: 380405 - DNA, 16 bp, M. musculus
cagggcagggctggag

SEQ ID NO: 380406 - DNA, 16 bp, M. musculus
cagggcatatttggga

SEQ ID NO: 380407 - DNA, 16 bp, M. musculus
cagggcatctgacacc

SEQ ID NO: 380408 - DNA, 16 bp, M. musculus
cagggcatggctggca

SEQ ID NO: 380409 - DNA, 16 bp, M. musculus
cagggcatttaaaaaa

SEQ ID NO: 380410 - DNA, 16 bp, M. musculus
cagggccaaaaaaggg

SEQ ID NO: 380411 - DNA, 16 bp, M. musculus
cagggccaacaggaac

SEQ ID NO: 380412 - DNA, 16 bp, M. musculus
cagggccaactggagc

SEQ ID NO: 380413 - DNA, 16 bp, M. musculus
cagggccaagaaatag

SEQ ID NO: 380414 - DNA, 16 bp, M. musculus
cagggccaagggcctc

SEQ ID NO: 380415 - DNA, 16 bp, M. musculus
cagggccacacagaca

SEQ ID NO: 380416 - DNA, 16 bp, M. musculus
cagggccagatggctt

SEQ ID NO: 380417 - DNA, 16 bp, M. musculus
cagggccagcaagatg

SEQ ID NO: 380418 - DNA, 16 bp, M. musculus
cagggccagcctggga

SEQ ID NO: 380419 - DNA, 16 bp, M. musculus
cagggccagcctgggc

SEQ ID NO: 380420 - DNA, 16 bp, M. musculus
cagggccagcctggtt

SEQ ID NO: 380421 - DNA, 16 bp, M. musculus
cagggccagctctcca

SEQ ID NO: 380422 - DNA, 16 bp, M. musculus
cagggccagctctgct

SEQ ID NO: 380423 - DNA, 16 bp, M. musculus
cagggccagctcttcc

SEQ ID NO: 380424 - DNA, 16 bp, M. musculus
cagggccaggaactgg

SEQ ID NO: 380425 - DNA, 16 bp, M. musculus
cagggccaggaagatg

SEQ ID NO: 380426 - DNA, 16 bp, M. musculus
cagggccaggaagctg

SEQ ID NO: 380427 - DNA, 16 bp, M. musculus
cagggccaggaatcgg

SEQ ID NO: 380428 - DNA, 16 bp, M. musculus
cagggccaggaggcag

SEQ ID NO: 380429 - DNA, 16 bp, M. musculus
cagggccaggaggtgg

SEQ ID NO: 380430 - DNA, 16 bp, M. musculus
cagggccagggagcag

SEQ ID NO: 380431 - DNA, 16 bp, M. musculus
cagggccagggccagg

SEQ ID NO: 380432 - DNA, 16 bp, M. musculus
cagggcccaggctctg

SEQ ID NO: 380433 - DNA, 16 bp, M. musculus
cagggccctcctggct

SEQ ID NO: 380434 - DNA, 16 bp, M. musculus
cagggcctaccttccc

SEQ ID NO: 380435 - DNA, 16 bp, M. musculus
cagggcctcttgcatg

SEQ ID NO: 380436 - DNA, 16 bp, M. musculus
cagggccttaagcatg

SEQ ID NO: 380437 - DNA, 16 bp, M. musculus
cagggccttcagaaga

SEQ ID NO: 380438 - DNA, 16 bp, M. musculus
cagggccttcagtcct

SEQ ID NO: 380439 - DNA, 16 bp, M. musculus
cagggccttgcacatg

SEQ ID NO: 380440 - DNA, 16 bp, M. musculus
cagggccttgggcttg

SEQ ID NO: 380441 - DNA, 16 bp, M. musculus
cagggcctttgcacat

SEQ ID NO: 380442 - DNA, 16 bp, M. musculus
cagggcgggggctccg

SEQ ID NO: 380443 - DNA, 16 bp, M. musculus
cagggcgtggtggtgc

SEQ ID NO: 380444 - DNA, 16 bp, M. musculus
cagggctacacagtga

SEQ ID NO: 380445 - DNA, 16 bp, M. musculus
cagggctacaccaaga

SEQ ID NO: 380446 - DNA, 17 bp, M. musculus
cagggctacaccgagaa

SEQ ID NO: 380447 - DNA, 16 bp, M. musculus
cagggctacagagtga

SEQ ID NO: 380448 - DNA, 16 bp, M. musculus
cagggctacccagaga

SEQ ID NO: 380449 - DNA, 16 bp, M. musculus
cagggctagcctgggc

SEQ ID NO: 380450 - DNA, 16 bp, M. musculus
cagggctaggattaca

SEQ ID NO: 380451 - DNA, 16 bp, M. musculus
cagggctatacaggga

SEQ ID NO: 380452 - DNA, 16 bp, M. musculus
cagggctatgcagaga

SEQ ID NO: 380453 - DNA, 16 bp, M. musculus
cagggctcagggctca

SEQ ID NO: 380454 - DNA, 16 bp, M. musculus
cagggctcagggctgg

SEQ ID NO: 380455 - DNA, 16 bp, M. musculus
cagggctccataccca

SEQ ID NO: 380456 - DNA, 16 bp, M. musculus
cagggctgaaatcagc

SEQ ID NO: 380457 - DNA, 16 bp, M. musculus
cagggctgagggaggg

SEQ ID NO: 380458 - DNA, 16 bp, M. musculus
cagggctgcacagaaa

SEQ ID NO: 380459 - DNA, 16 bp, M. musculus
cagggctgcagagaga

SEQ ID NO: 380460 - DNA, 16 bp, M. musculus
cagggctggaacctgg

SEQ ID NO: 380461 - DNA, 16 bp, M. musculus
cagggctggaactcag

SEQ ID NO: 380462 - DNA, 16 bp, M. musculus
cagggctggaagatgg

SEQ ID NO: 380463 - DNA, 16 bp, M. musculus
cagggctggagatggc

SEQ ID NO: 380464 - DNA, 16 bp, M. musculus
cagggctggctgctgc

SEQ ID NO: 380465 - DNA, 16 bp, M. musculus
cagggctgggaagcag

SEQ ID NO: 380466 - DNA, 16 bp, M. musculus
cagggctgggagaggg

SEQ ID NO: 380467 - DNA, 16 bp, M. musculus
cagggctggggagctg

SEQ ID NO: 380468 - DNA, 16 bp, M. musculus
cagggctggggatgga

SEQ ID NO: 380469 - DNA, 16 bp, M. musculus
cagggctggggctggg

SEQ ID NO: 380470 - DNA, 16 bp, M. musculus
cagggctgggggaagg

SEQ ID NO: 380471 - DNA, 16 bp, M. musculus
cagggctgtggggcag

SEQ ID NO: 380472 - DNA, 16 bp, M. musculus
cagggctgttatacag

SEQ ID NO: 380473 - DNA, 16 bp, M. musculus
cagggctgttgctatt

SEQ ID NO: 380474 - DNA, 16 bp, M. musculus
cagggctgttgttaag

SEQ ID NO: 380475 - DNA, 16 bp, M. musculus
cagggcttctctgtat

SEQ ID NO: 380476 - DNA, 16 bp, M. musculus
cagggctttagtcctt

SEQ ID NO: 380477 - DNA, 16 bp, M. musculus
cagggctttttttttt

SEQ ID NO: 380478 - DNA, 19 bp, M. musculus
caggggaaaaattcctgaa

SEQ ID NO: 380479 - DNA, 16 bp, M. musculus
caggggaaaattttct

SEQ ID NO: 380480 - DNA, 16 bp, M. musculus
caggggaagaattcct

SEQ ID NO: 380481 - DNA, 16 bp, M. musculus
caggggaagcaagcca

SEQ ID NO: 380482 - DNA, 16 bp, M. musculus
caggggaatgctgggg

SEQ ID NO: 380483 - DNA, 16 bp, M. musculus
caggggaattgttaat

SEQ ID NO: 380484 - DNA, 16 bp, M. musculus
caggggaatttcaggg

SEQ ID NO: 380485 - DNA, 16 bp, M. musculus
caggggacaggggaca

SEQ ID NO: 380486 - DNA, 16 bp, M. musculus
caggggacccagtgcc

SEQ ID NO: 380487 - DNA, 16 bp, M. musculus
caggggacctgatgcc

SEQ ID NO: 380488 - DNA, 16 bp, M. musculus
caggggactggagaga

SEQ ID NO: 380489 - DNA, 16 bp, M. musculus
caggggagtgggagtg

SEQ ID NO: 380490 - DNA, 16 bp, M. musculus
caggggatccaaagcc

SEQ ID NO: 380491 - DNA, 16 bp, M. musculus
caggggatccagcacc

SEQ ID NO: 380492 - DNA, 16 bp, M. musculus
caggggatcccatgcc

SEQ ID NO: 380493 - DNA, 16 bp, M. musculus
caggggatctgatgcc

SEQ ID NO: 380494 - DNA, 16 bp, M. musculus
caggggatctggcacc

SEQ ID NO: 380495 - DNA, 16 bp, M. musculus
caggggatttgacacc

SEQ ID NO: 380496 - DNA, 16 bp, M. musculus
caggggattttcagag

SEQ ID NO: 380497 - DNA, 16 bp, M. musculus
caggggcagatgtggg

SEQ ID NO: 380498 - DNA, 16 bp, M. musculus
caggggcagggacagg

SEQ ID NO: 380499 - DNA, 16 bp, M. musculus
caggggcaggggcaga

SEQ ID NO: 380500 - DNA, 16 bp, M. musculus
caggggccacaccctt

SEQ ID NO: 380501 - DNA, 16 bp, M. musculus
caggggctacatgcat

SEQ ID NO: 380502 - DNA, 16 bp, M. musculus
caggggctgaggcagg

SEQ ID NO: 380503 - DNA, 16 bp, M. musculus
caggggctgcctctga

SEQ ID NO: 380504 - DNA, 16 bp, M. musculus
caggggctggagatgg

SEQ ID NO: 380505 - DNA, 16 bp, M. musculus
caggggctgggcttcc

SEQ ID NO: 380506 - DNA, 16 bp, M. musculus
cagggggacaccttgg

SEQ ID NO: 380507 - DNA, 16 bp, M. musculus
caggggggccctctgg

SEQ ID NO: 380508 - DNA, 16 bp, M. musculus
caggggtcagctgttt

SEQ ID NO: 380509 - DNA, 16 bp, M. musculus
caggggtgcagggatg

SEQ ID NO: 380510 - DNA, 16 bp, M. musculus
caggggtgcaggggtg

SEQ ID NO: 380511 - DNA, 16 bp, M. musculus
caggggtggcatcacc

SEQ ID NO: 380512 - DNA, 16 bp, M. musculus
caggggttctgagttc

SEQ ID NO: 380513 - DNA, 16 bp, M. musculus
cagggtagagctggcc

SEQ ID NO: 380514 - DNA, 16 bp, M. musculus
cagggtagcctgggct

SEQ ID NO: 380515 - DNA, 16 bp, M. musculus
cagggtattttattac

SEQ ID NO: 380516 - DNA, 16 bp, M. musculus
cagggtcagagtcgga

SEQ ID NO: 380517 - DNA, 16 bp, M. musculus
cagggtcagcttgtgt

SEQ ID NO: 380518 - DNA, 16 bp, M. musculus
cagggtcaggagcccc

SEQ ID NO: 380519 - DNA, 16 bp, M. musculus
cagggtccccaacaac

SEQ ID NO: 380520 - DNA, 16 bp, M. musculus
cagggtcctctgaaag

SEQ ID NO: 380521 - DNA, 16 bp, M. musculus
cagggtcctgatgagc

SEQ ID NO: 380522 - DNA, 16 bp, M. musculus
cagggtcctgtcagaa

SEQ ID NO: 380523 - DNA, 16 bp, M. musculus
cagggtctcaagggag

SEQ ID NO: 380524 - DNA, 16 bp, M. musculus
cagggtctcactattt

SEQ ID NO: 380525 - DNA, 16 bp, M. musculus
cagggtctcccactgg

SEQ ID NO: 380526 - DNA, 16 bp, M. musculus
cagggtctcgctgtgt

SEQ ID NO: 380527 - DNA, 16 bp, M. musculus
cagggtctctcactgg

SEQ ID NO: 380528 - DNA, 16 bp, M. musculus
cagggtctctctatat

SEQ ID NO: 380529 - DNA, 16 bp, M. musculus
cagggtctctggggct

SEQ ID NO: 380530 - DNA, 16 bp, M. musculus
cagggtctgagctatg

SEQ ID NO: 380531 - DNA, 16 bp, M. musculus
cagggtctgtgctatg

SEQ ID NO: 380532 - DNA, 16 bp, M. musculus
cagggtcttaatatgt

SEQ ID NO: 380533 - DNA, 16 bp, M. musculus
cagggtcttgctctgt

SEQ ID NO: 380534 - DNA, 16 bp, M. musculus
cagggtctttctatgt

SEQ ID NO: 380535 - DNA, 16 bp, M. musculus
cagggtggaaggagag

SEQ ID NO: 380536 - DNA, 16 bp, M. musculus
cagggtggccttgaac

SEQ ID NO: 380537 - DNA, 16 bp, M. musculus
cagggtgggaggacag

SEQ ID NO: 380538 - DNA, 16 bp, M. musculus
cagggtgggggatacc

SEQ ID NO: 380539 - DNA, 16 bp, M. musculus
cagggtggtgctggct

SEQ ID NO: 380540 - DNA, 16 bp, M. musculus
cagggtgtctctgtgt

SEQ ID NO: 380541 - DNA, 16 bp, M. musculus
cagggtgtggtcagga

SEQ ID NO: 380542 - DNA, 16 bp, M. musculus
cagggtgttttgtttt

SEQ ID NO: 380543 - DNA, 16 bp, M. musculus
cagggttacacagaga

SEQ ID NO: 380544 - DNA, 16 bp, M. musculus
cagggttatacaaaga

SEQ ID NO: 380545 - DNA, 16 bp, M. musculus
cagggttgctctcctc

SEQ ID NO: 380546 - DNA, 16 bp, M. musculus
cagggttgggggagga

SEQ ID NO: 380547 - DNA, 17 bp, M. musculus
cagggttgttttaattt

SEQ ID NO: 380548 - DNA, 16 bp, M. musculus
cagggtttccagtttt

SEQ ID NO: 380549 - DNA, 16 bp, M. musculus
cagggtttctatatat

SEQ ID NO: 380550 - DNA, 16 bp, M. musculus
cagggtttctctgggc

SEQ ID NO: 380551 - DNA, 16 bp, M. musculus
cagggtttctctgtcc

SEQ ID NO: 380552 - DNA, 16 bp, M. musculus
cagggtttctcttcct

SEQ ID NO: 380553 - DNA, 16 bp, M. musculus
cagggtttctctttgc

SEQ ID NO: 380554 - DNA, 16 bp, M. musculus
cagggtttctttgtgt

SEQ ID NO: 380555 - DNA, 16 bp, M. musculus
cagggtttgattccca

SEQ ID NO: 380556 - DNA, 16 bp, M. musculus
cagggtttggaggctg

SEQ ID NO: 380557 - DNA, 16 bp, M. musculus
cagggtttgttgttat

SEQ ID NO: 380558 - DNA, 16 bp, M. musculus
cagggtttgtttgttt

SEQ ID NO: 380559 - DNA, 16 bp, M. musculus
cagggttttgttgttt

SEQ ID NO: 380560 - DNA, 16 bp, M. musculus
cagggttttttgtttt

SEQ ID NO: 380561 - DNA, 16 bp, M. musculus
cagggtttttttgtgt

SEQ ID NO: 380562 - DNA, 16 bp, M. musculus
caggtaaagaaaacaa

SEQ ID NO: 380563 - DNA, 16 bp, M. musculus
caggtaaagatgcttg

SEQ ID NO: 380564 - DNA, 16 bp, M. musculus
caggtaactctagctt

SEQ ID NO: 380565 - DNA, 16 bp, M. musculus
caggtaagaacacttg

SEQ ID NO: 380566 - DNA, 16 bp, M. musculus
caggtaatcccagcag

SEQ ID NO: 380567 - DNA, 16 bp, M. musculus
caggtacacacacaca

SEQ ID NO: 380568 - DNA, 16 bp, M. musculus
caggtacctggagctg

SEQ ID NO: 380569 - DNA, 16 bp, M. musculus
caggtactggcatagc

SEQ ID NO: 380570 - DNA, 16 bp, M. musculus
caggtactttaccaac

SEQ ID NO: 380571 - DNA, 16 bp, M. musculus
caggtagaagaacata

SEQ ID NO: 380572 - DNA, 17 bp, M. musculus
caggtagatctctgagt

SEQ ID NO: 380573 - DNA, 16 bp, M. musculus
caggtagatgaatgga

SEQ ID NO: 380574 - DNA, 16 bp, M. musculus
caggtagatgtctgag

SEQ ID NO: 380575 - DNA, 16 bp, M. musculus
caggtagtgtgtggca

SEQ ID NO: 380576 - DNA, 16 bp, M. musculus
caggtatagctgtctc

SEQ ID NO: 380577 - DNA, 16 bp, M. musculus
caggtatgggatatgg

SEQ ID NO: 380578 - DNA, 16 bp, M. musculus
caggtatgggggaggg

SEQ ID NO: 380579 - DNA, 16 bp, M. musculus
caggtatggtggcaca

SEQ ID NO: 380580 - DNA, 16 bp, M. musculus
caggtatggtggtaca

SEQ ID NO: 380581 - DNA, 16 bp, M. musculus
caggtattttattata

SEQ ID NO: 380582 - DNA, 16 bp, M. musculus
caggtattttgtcaca

SEQ ID NO: 380583 - DNA, 16 bp, M. musculus
caggtcaaatggactc

SEQ ID NO: 380584 - DNA, 16 bp, M. musculus
caggtcaaccagggct

SEQ ID NO: 380585 - DNA, 16 bp, M. musculus
caggtcaagaagcagg

SEQ ID NO: 380586 - DNA, 16 bp, M. musculus
caggtcactgcaggac

SEQ ID NO: 380587 - DNA, 16 bp, M. musculus
caggtcagaaaattct

SEQ ID NO: 380588 - DNA, 16 bp, M. musculus
caggtcagtcagggct

SEQ ID NO: 380589 - DNA, 16 bp, M. musculus
caggtcagtctgggct

SEQ ID NO: 380590 - DNA, 16 bp, M. musculus
caggtcatcaaacttg

SEQ ID NO: 380591 - DNA, 16 bp, M. musculus
caggtcatgtgcttct

SEQ ID NO: 380592 - DNA, 16 bp, M. musculus
caggtccaaagattta

SEQ ID NO: 380593 - DNA, 16 bp, M. musculus
caggtccacatcctcc

SEQ ID NO: 380594 - DNA, 16 bp, M. musculus
caggtccactttggta

SEQ ID NO: 380595 - DNA, 16 bp, M. musculus
caggtccagatccagg

SEQ ID NO: 380596 - DNA, 16 bp, M. musculus
caggtccaggtccagg

SEQ ID NO: 380597 - DNA, 16 bp, M. musculus
caggtcccaggtccca

SEQ ID NO: 380598 - DNA, 16 bp, M. musculus
caggtccccagaaccc

SEQ ID NO: 380599 - DNA, 16 bp, M. musculus
caggtccccatgcttg

SEQ ID NO: 380600 - DNA, 16 bp, M. musculus
caggtcccctggaaga

SEQ ID NO: 380601 - DNA, 16 bp, M. musculus
caggtccctccttcct

SEQ ID NO: 380602 - DNA, 16 bp, M. musculus
caggtcctcagcaaga

SEQ ID NO: 380603 - DNA, 16 bp, M. musculus
caggtcctcaggcttc

SEQ ID NO: 380604 - DNA, 16 bp, M. musculus
caggtcctctacaaga

SEQ ID NO: 380605 - DNA, 16 bp, M. musculus
caggtcctctccaaga

SEQ ID NO: 380606 - DNA, 16 bp, M. musculus
caggtcctctgaaaaa

SEQ ID NO: 380607 - DNA, 16 bp, M. musculus
caggtcctctgaagag

SEQ ID NO: 380608 - DNA, 16 bp, M. musculus
caggtcctctggaaga

SEQ ID NO: 380609 - DNA, 16 bp, M. musculus
caggtcctctggaata

SEQ ID NO: 380610 - DNA, 16 bp, M. musculus
caggtcctgagttcaa

SEQ ID NO: 380611 - DNA, 16 bp, M. musculus
caggtcctgcctccag

SEQ ID NO: 380612 - DNA, 16 bp, M. musculus
caggtcctgtgcaaga

SEQ ID NO: 380613 - DNA, 16 bp, M. musculus
caggtccttctgcttg

SEQ ID NO: 380614 - DNA, 16 bp, M. musculus
caggtctacacagtga

SEQ ID NO: 380615 - DNA, 16 bp, M. musculus
caggtctcagggctca

SEQ ID NO: 380616 - DNA, 17 bp, M. musculus
caggtctcccctccaga

SEQ ID NO: 380617 - DNA, 16 bp, M. musculus
caggtctgctaataga

SEQ ID NO: 380618 - DNA, 16 bp, M. musculus
caggtcttcatgcttg

SEQ ID NO: 380619 - DNA, 16 bp, M. musculus
caggtcttcccacctc

SEQ ID NO: 380620 - DNA, 16 bp, M. musculus
caggtcttctcgtccc

SEQ ID NO: 380621 - DNA, 16 bp, M. musculus
caggtcttctgcaaga

SEQ ID NO: 380622 - DNA, 16 bp, M. musculus
caggtcttgcacagtt

SEQ ID NO: 380623 - DNA, 16 bp, M. musculus
caggtcttgtgcaggt

SEQ ID NO: 380624 - DNA, 16 bp, M. musculus
caggtcttgtgcatgc

SEQ ID NO: 380625 - DNA, 16 bp, M. musculus
caggtgaaagaactga

SEQ ID NO: 380626 - DNA, 16 bp, M. musculus
caggtgaagaaactga

SEQ ID NO: 380627 - DNA, 16 bp, M. musculus
caggtgaagaagagag

SEQ ID NO: 380628 - DNA, 16 bp, M. musculus
caggtgaatcataaag

SEQ ID NO: 380629 - DNA, 16 bp, M. musculus
caggtgaatgctctga

SEQ ID NO: 380630 - DNA, 16 bp, M. musculus
caggtgacagcagaag

SEQ ID NO: 380631 - DNA, 16 bp, M. musculus
caggtgacagtacatg

SEQ ID NO: 380632 - DNA, 16 bp, M. musculus
caggtgaccgcagatg

SEQ ID NO: 380633 - DNA, 16 bp, M. musculus
caggtgagaaatgctg

SEQ ID NO: 380634 - DNA, 16 bp, M. musculus
caggtgagactgtgga

SEQ ID NO: 380635 - DNA, 18 bp, M. musculus
caggtgagccctcattaa

SEQ ID NO: 380636 - DNA, 16 bp, M. musculus
caggtgaggatgtgga

SEQ ID NO: 380637 - DNA, 16 bp, M. musculus
caggtgagggagccat

SEQ ID NO: 380638 - DNA, 16 bp, M. musculus
caggtgaggggcaggg

SEQ ID NO: 380639 - DNA, 16 bp, M. musculus
caggtgaggggccagc

SEQ ID NO: 380640 - DNA, 16 bp, M. musculus
caggtgatcatcctga

SEQ ID NO: 380641 - DNA, 16 bp, M. musculus
caggtgatggtgtgca

SEQ ID NO: 380642 - DNA, 16 bp, M. musculus
caggtgatgttgaaaa

SEQ ID NO: 380643 - DNA, 16 bp, M. musculus
caggtgcacacatgca

SEQ ID NO: 380644 - DNA, 16 bp, M. musculus
caggtgcccacagagg

SEQ ID NO: 380645 - DNA, 16 bp, M. musculus
caggtgcccgcctggc

SEQ ID NO: 380646 - DNA, 16 bp, M. musculus
caggtgcctgcagaag

SEQ ID NO: 380647 - DNA, 16 bp, M. musculus
caggtgcctgtggaga

SEQ ID NO: 380648 - DNA, 16 bp, M. musculus
caggtgctaatctcta

SEQ ID NO: 380649 - DNA, 16 bp, M. musculus
caggtgctcaggcttg

SEQ ID NO: 380650 - DNA, 16 bp, M. musculus
caggtgctgctggaca

SEQ ID NO: 380651 - DNA, 16 bp, M. musculus
caggtgctgtcacctg

SEQ ID NO: 380652 - DNA, 17 bp, M. musculus
caggtggacagaaagga

SEQ ID NO: 380653 - DNA, 16 bp, M. musculus
caggtggaccagaaga

SEQ ID NO: 380654 - DNA, 16 bp, M. musculus
caggtggagaagattc

SEQ ID NO: 380655 - DNA, 16 bp, M. musculus
caggtggagctcaggg

SEQ ID NO: 380656 - DNA, 16 bp, M. musculus
caggtggaggaggagg

SEQ ID NO: 380657 - DNA, 16 bp, M. musculus
caggtggagttcctgg

SEQ ID NO: 380658 - DNA, 16 bp, M. musculus
caggtggatctatgag

SEQ ID NO: 380659 - DNA, 16 bp, M. musculus
caggtggatgtctgtg

SEQ ID NO: 380660 - DNA, 16 bp, M. musculus
caggtggatttctgta

SEQ ID NO: 380661 - DNA, 16 bp, M. musculus
caggtggcagcccaga

SEQ ID NO: 380662 - DNA, 16 bp, M. musculus
caggtggcagtgcagg

SEQ ID NO: 380663 - DNA, 16 bp, M. musculus
caggtggctgctgagg

SEQ ID NO: 380664 - DNA, 16 bp, M. musculus
caggtgggacccaggt

SEQ ID NO: 380665 - DNA, 16 bp, M. musculus
caggtgggcatggtgg

SEQ ID NO: 380666 - DNA, 16 bp, M. musculus
caggtggggatgggaa

SEQ ID NO: 380667 - DNA, 16 bp, M. musculus
caggtggggcagtgtc

SEQ ID NO: 380668 - DNA, 16 bp, M. musculus
caggtggggtagtctt

SEQ ID NO: 380669 - DNA, 16 bp, M. musculus
caggtggtggaaaagg

SEQ ID NO: 380670 - DNA, 16 bp, M. musculus
caggtggtggacaagg

SEQ ID NO: 380671 - DNA, 16 bp, M. musculus
caggtggttcccatta

SEQ ID NO: 380672 - DNA, 16 bp, M. musculus
caggtggttgtgaacc

SEQ ID NO: 380673 - DNA, 18 bp, M. musculus
caggtgtaccaggatacc

SEQ ID NO: 380674 - DNA, 16 bp, M. musculus
caggtgtaccctgtcc

SEQ ID NO: 380675 - DNA, 16 bp, M. musculus
caggtgtacttttaaa

SEQ ID NO: 380676 - DNA, 16 bp, M. musculus
caggtgtatatgtgtg

SEQ ID NO: 380677 - DNA, 16 bp, M. musculus
caggtgtccacagagg

SEQ ID NO: 380678 - DNA, 16 bp, M. musculus
caggtgtctgcagagg

SEQ ID NO: 380679 - DNA, 16 bp, M. musculus
caggtgtcttcctcag

SEQ ID NO: 380680 - DNA, 16 bp, M. musculus
caggtgtgaaccacca

SEQ ID NO: 380681 - DNA, 16 bp, M. musculus
caggtgtgagccacca

SEQ ID NO: 380682 - DNA, 16 bp, M. musculus
caggtgtgatggcaca

SEQ ID NO: 380683 - DNA, 16 bp, M. musculus
caggtgtgatggtgca

SEQ ID NO: 380684 - DNA, 16 bp, M. musculus
caggtgtgcatccctg

SEQ ID NO: 380685 - DNA, 16 bp, M. musculus
caggtgtggaagtcag

SEQ ID NO: 380686 - DNA, 16 bp, M. musculus
caggtgtggcagtgca

SEQ ID NO: 380687 - DNA, 16 bp, M. musculus
caggtgtggctgctgt

SEQ ID NO: 380688 - DNA, 16 bp, M. musculus
caggtgtggggagaga

SEQ ID NO: 380689 - DNA, 16 bp, M. musculus
caggtgtggtgacaca

SEQ ID NO: 380690 - DNA, 16 bp, M. musculus
caggtgtggtggccca

SEQ ID NO: 380691 - DNA, 16 bp, M. musculus
caggtgtggtggctca

SEQ ID NO: 380692 - DNA, 16 bp, M. musculus
caggtgtggtggtgca

SEQ ID NO: 380693 - DNA, 16 bp, M. musculus
caggtgtgtcctccat

SEQ ID NO: 380694 - DNA, 16 bp, M. musculus
caggtgtgtctgtgtg

SEQ ID NO: 380695 - DNA, 16 bp, M. musculus
caggtgtgtgcacaca

SEQ ID NO: 380696 - DNA, 16 bp, M. musculus
caggtgtgtgtgtttg

SEQ ID NO: 380697 - DNA, 16 bp, M. musculus
caggtgtgttaggata

SEQ ID NO: 380698 - DNA, 16 bp, M. musculus
caggtgttcaaggcca

SEQ ID NO: 380699 - DNA, 16 bp, M. musculus
caggtgttcctgcaag

SEQ ID NO: 380700 - DNA, 16 bp, M. musculus
caggttagcaggcagt

SEQ ID NO: 380701 - DNA, 16 bp, M. musculus
caggttagctgactct

SEQ ID NO: 380702 - DNA, 16 bp, M. musculus
caggttagctttgaac

SEQ ID NO: 380703 - DNA, 16 bp, M. musculus
caggttatcaggcttg

SEQ ID NO: 380704 - DNA, 16 bp, M. musculus
caggttcaaggtcagc

SEQ ID NO: 380705 - DNA, 16 bp, M. musculus
caggttcaattctcag

SEQ ID NO: 380706 - DNA, 16 bp, M. musculus
caggttcactgagaga

SEQ ID NO: 380707 - DNA, 16 bp, M. musculus
caggttcagaggtcca

SEQ ID NO: 380708 - DNA, 16 bp, M. musculus
caggttcagtgaaaga

SEQ ID NO: 380709 - DNA, 16 bp, M. musculus
caggttcagttcccac

SEQ ID NO: 380710 - DNA, 16 bp, M. musculus
caggttcccaggcagc

SEQ ID NO: 380711 - DNA, 16 bp, M. musculus
caggttcccctcttcc

SEQ ID NO: 380712 - DNA, 16 bp, M. musculus
caggttcctgacagca

SEQ ID NO: 380713 - DNA, 16 bp, M. musculus
caggttcctgccccat

SEQ ID NO: 380714 - DNA, 16 bp, M. musculus
caggttcctgccttaa

SEQ ID NO: 380715 - DNA, 16 bp, M. musculus
caggttcgattcccag

SEQ ID NO: 380716 - DNA, 16 bp, M. musculus
caggttctccagggca

SEQ ID NO: 380717 - DNA, 16 bp, M. musculus
caggttctcctctccc

SEQ ID NO: 380718 - DNA, 16 bp, M. musculus
caggttctctctccct

SEQ ID NO: 380719 - DNA, 16 bp, M. musculus
caggttctctctcctc

SEQ ID NO: 380720 - DNA, 16 bp, M. musculus
caggttctctggaaga

SEQ ID NO: 380721 - DNA, 16 bp, M. musculus
caggttcttggtcact

SEQ ID NO: 380722 - DNA, 16 bp, M. musculus
caggttcttgtgcttg

SEQ ID NO: 380723 - DNA, 16 bp, M. musculus
caggttggtctcaaac

SEQ ID NO: 380724 - DNA, 16 bp, M. musculus
caggttgtcacaggaa

SEQ ID NO: 380725 - DNA, 16 bp, M. musculus
caggttgtcaggctta

SEQ ID NO: 380726 - DNA, 16 bp, M. musculus
caggttgtcatgcttg

SEQ ID NO: 380727 - DNA, 16 bp, M. musculus
caggttgtcctctgac

SEQ ID NO: 380728 - DNA, 16 bp, M. musculus
caggtttagttcccag

SEQ ID NO: 380729 - DNA, 16 bp, M. musculus
caggtttattgggaaa

SEQ ID NO: 380730 - DNA, 16 bp, M. musculus
caggtttcagctgctg

SEQ ID NO: 380731 - DNA, 16 bp, M. musculus
caggtttcccctctgg

SEQ ID NO: 380732 - DNA, 16 bp, M. musculus
caggtttctctgtgta

SEQ ID NO: 380733 - DNA, 16 bp, M. musculus
caggtttctgccctgc

SEQ ID NO: 380734 - DNA, 16 bp, M. musculus
caggtttctgcttgaa

SEQ ID NO: 380735 - DNA, 16 bp, M. musculus
caggtttctttctttc

SEQ ID NO: 380736 - DNA, 16 bp, M. musculus
caggtttgactcccag

SEQ ID NO: 380737 - DNA, 16 bp, M. musculus
caggtttgcatggcaa

SEQ ID NO: 380738 - DNA, 16 bp, M. musculus
caggtttgcctccatt

SEQ ID NO: 380739 - DNA, 16 bp, M. musculus
caggtttggttcccag

SEQ ID NO: 380740 - DNA, 16 bp, M. musculus
caggtttgtaccacca

SEQ ID NO: 380741 - DNA, 18 bp, M. musculus
caggtttgtggtccccct

SEQ ID NO: 380742 - DNA, 16 bp, M. musculus
caggttttgctgaatt

SEQ ID NO: 380743 - DNA, 16 bp, M. musculus
cagtaaagaaagccat

SEQ ID NO: 380744 - DNA, 16 bp, M. musculus
cagtaaagcatttgcc

SEQ ID NO: 380745 - DNA, 16 bp, M. musculus
cagtaaagcatttgtc

SEQ ID NO: 380746 - DNA, 16 bp, M. musculus
cagtaacaaagtcttc

SEQ ID NO: 380747 - DNA, 16 bp, M. musculus
cagtaacaaggaactg

SEQ ID NO: 380748 - DNA, 16 bp, M. musculus
cagtaacagcagcagc

SEQ ID NO: 380749 - DNA, 16 bp, M. musculus
cagtaacattcaaaat

SEQ ID NO: 380750 - DNA, 16 bp, M. musculus
cagtaaccaaacccag

SEQ ID NO: 380751 - DNA, 16 bp, M. musculus
cagtaacccaatcaca

SEQ ID NO: 380752 - DNA, 16 bp, M. musculus
cagtaacccagagctc

SEQ ID NO: 380753 - DNA, 16 bp, M. musculus
cagtaaccccaaagct

SEQ ID NO: 380754 - DNA, 16 bp, M. musculus
cagtaactccagttcc

SEQ ID NO: 380755 - DNA, 16 bp, M. musculus
cagtaacttagacagg

SEQ ID NO: 380756 - DNA, 16 bp, M. musculus
cagtaagagacagcaa

SEQ ID NO: 380757 - DNA, 16 bp, M. musculus
cagtaagagcaaaatt

SEQ ID NO: 380758 - DNA, 16 bp, M. musculus
cagtaagcaccattcc

SEQ ID NO: 380759 - DNA, 16 bp, M. musculus
cagtaagcactcttaa

SEQ ID NO: 380760 - DNA, 16 bp, M. musculus
cagtaagcagcactca

SEQ ID NO: 380761 - DNA, 16 bp, M. musculus
cagtaaggactttgga

SEQ ID NO: 380762 - DNA, 16 bp, M. musculus
cagtaagtggatcctt

SEQ ID NO: 380763 - DNA, 16 bp, M. musculus
cagtaagttccaggcc

SEQ ID NO: 380764 - DNA, 16 bp, M. musculus
cagtacaagggaaagc

SEQ ID NO: 380765 - DNA, 16 bp, M. musculus
cagtacacctgaaagc

SEQ ID NO: 380766 - DNA, 16 bp, M. musculus
cagtacagagaaatgc

SEQ ID NO: 380767 - DNA, 16 bp, M. musculus
cagtacaggaactcaa

SEQ ID NO: 380768 - DNA, 16 bp, M. musculus
cagtaccacataaact

SEQ ID NO: 380769 - DNA, 16 bp, M. musculus
cagtaccatgtctacc

SEQ ID NO: 380770 - DNA, 16 bp, M. musculus
cagtaccatgtctgct

SEQ ID NO: 380771 - DNA, 16 bp, M. musculus
cagtaccccaccccca

SEQ ID NO: 380772 - DNA, 16 bp, M. musculus
cagtacctcagagctc

SEQ ID NO: 380773 - DNA, 16 bp, M. musculus
cagtacctcatggaac

SEQ ID NO: 380774 - DNA, 16 bp, M. musculus
cagtacctcctgagct

SEQ ID NO: 380775 - DNA, 16 bp, M. musculus
cagtacctgtggctcc

SEQ ID NO: 380776 - DNA, 16 bp, M. musculus
cagtactacacagaga

SEQ ID NO: 380777 - DNA, 16 bp, M. musculus
cagtactactcagcta

SEQ ID NO: 380778 - DNA, 16 bp, M. musculus
cagtactctggaggca

SEQ ID NO: 380779 - DNA, 16 bp, M. musculus
cagtactcttaaccat

SEQ ID NO: 380780 - DNA, 16 bp, M. musculus
cagtactcttcaaact

SEQ ID NO: 380781 - DNA, 16 bp, M. musculus
cagtactgaaaaaaaa

SEQ ID NO: 380782 - DNA, 16 bp, M. musculus
cagtactgaatgtctt

SEQ ID NO: 380783 - DNA, 16 bp, M. musculus
cagtacttaggaggca

SEQ ID NO: 380784 - DNA, 16 bp, M. musculus
cagtagaaagacagag

SEQ ID NO: 380785 - DNA, 16 bp, M. musculus
cagtagaatagaattg

SEQ ID NO: 380786 - DNA, 16 bp, M. musculus
cagtagagctggcctt

SEQ ID NO: 380787 - DNA, 16 bp, M. musculus
cagtagataggcatgg

SEQ ID NO: 380788 - DNA, 16 bp, M. musculus
cagtagccagtgccac

SEQ ID NO: 380789 - DNA, 16 bp, M. musculus
cagtagcccccagagc

SEQ ID NO: 380790 - DNA, 16 bp, M. musculus
cagtagctctgtggct

SEQ ID NO: 380791 - DNA, 16 bp, M. musculus
cagtagctttcctcta

SEQ ID NO: 380792 - DNA, 16 bp, M. musculus
cagtaggaggaaaggg

SEQ ID NO: 380793 - DNA, 16 bp, M. musculus
cagtaggcaacatcaa

SEQ ID NO: 380794 - DNA, 16 bp, M. musculus
cagtagggggctttta

SEQ ID NO: 380795 - DNA, 16 bp, M. musculus
cagtaggtgcttaata

SEQ ID NO: 380796 - DNA, 16 bp, M. musculus
cagtagtagcagcagc

SEQ ID NO: 380797 - DNA, 16 bp, M. musculus
cagtagtagtagtagt

SEQ ID NO: 380798 - DNA, 16 bp, M. musculus
cagtagttgggaggca

SEQ ID NO: 380799 - DNA, 17 bp, M. musculus
cagtatacacacacaca

SEQ ID NO: 380800 - DNA, 16 bp, M. musculus
cagtatacccttttgt

SEQ ID NO: 380801 - DNA, 16 bp, M. musculus
cagtatatataaagaa

SEQ ID NO: 380802 - DNA, 16 bp, M. musculus
cagtatatattttggt

SEQ ID NO: 380803 - DNA, 16 bp, M. musculus
cagtatattttgtact

SEQ ID NO: 380804 - DNA, 16 bp, M. musculus
cagtatcactggagag

SEQ ID NO: 380805 - DNA, 16 bp, M. musculus
cagtatccccagaact

SEQ ID NO: 380806 - DNA, 16 bp, M. musculus
cagtatcctggtgcac

SEQ ID NO: 380807 - DNA, 17 bp, M. musculus
cagtatgcacttcttgg

SEQ ID NO: 380808 - DNA, 16 bp, M. musculus
cagtatgcagctgctg

SEQ ID NO: 380809 - DNA, 16 bp, M. musculus
cagtatgggcaccagc

SEQ ID NO: 380810 - DNA, 16 bp, M. musculus
cagtatgggtgctggg

SEQ ID NO: 380811 - DNA, 16 bp, M. musculus
cagtattcccagaaga

SEQ ID NO: 380812 - DNA, 16 bp, M. musculus
cagtattgttttgtta

SEQ ID NO: 380813 - DNA, 16 bp, M. musculus
cagtatttatttattt

SEQ ID NO: 380814 - DNA, 16 bp, M. musculus
cagtattttattttta

SEQ ID NO: 380815 - DNA, 16 bp, M. musculus
cagtcaactgctggta

SEQ ID NO: 380816 - DNA, 16 bp, M. musculus
cagtcaagaaacagag

SEQ ID NO: 380817 - DNA, 16 bp, M. musculus
cagtcaagactggaga

SEQ ID NO: 380818 - DNA, 16 bp, M. musculus
cagtcacaaaagaaca

SEQ ID NO: 380819 - DNA, 16 bp, M. musculus
cagtcacaattagaaa

SEQ ID NO: 380820 - DNA, 16 bp, M. musculus
cagtcacacagacaaa

SEQ ID NO: 380821 - DNA, 16 bp, M. musculus
cagtcaccatctcctt

SEQ ID NO: 380822 - DNA, 16 bp, M. musculus
cagtcacccagaccaa

SEQ ID NO: 380823 - DNA, 16 bp, M. musculus
cagtcagagaagatgc

SEQ ID NO: 380824 - DNA, 16 bp, M. musculus
cagtcagagctataca

SEQ ID NO: 380825 - DNA, 16 bp, M. musculus
cagtcagagctcttaa

SEQ ID NO: 380826 - DNA, 16 bp, M. musculus
cagtcagcagcagact

SEQ ID NO: 380827 - DNA, 16 bp, M. musculus
cagtcagcaggaggga

SEQ ID NO: 380828 - DNA, 16 bp, M. musculus
cagtcagctaatggat

SEQ ID NO: 380829 - DNA, 16 bp, M. musculus
cagtcagcttgaagag

SEQ ID NO: 380830 - DNA, 16 bp, M. musculus
cagtcaggaaacagaa

SEQ ID NO: 380831 - DNA, 16 bp, M. musculus
cagtcaggaagcaaag

SEQ ID NO: 380832 - DNA, 16 bp, M. musculus
cagtcaggaagcagaa

SEQ ID NO: 380833 - DNA, 16 bp, M. musculus
cagtcaggaagcagag

SEQ ID NO: 380834 - DNA, 16 bp, M. musculus
cagtcaggaagcaggg

SEQ ID NO: 380835 - DNA, 16 bp, M. musculus
cagtcaggaagctgag

SEQ ID NO: 380836 - DNA, 16 bp, M. musculus
cagtcaggaaggagag

SEQ ID NO: 380837 - DNA, 16 bp, M. musculus
cagtcaggagagctgg

SEQ ID NO: 380838 - DNA, 16 bp, M. musculus
cagtcaggaggacctg

SEQ ID NO: 380839 - DNA, 16 bp, M. musculus
cagtcaggaggctgag

SEQ ID NO: 380840 - DNA, 16 bp, M. musculus
cagtcaggatgtaaaa

SEQ ID NO: 380841 - DNA, 16 bp, M. musculus
cagtcaggctgaaggg

SEQ ID NO: 380842 - DNA, 16 bp, M. musculus
cagtcagggctatata

SEQ ID NO: 380843 - DNA, 16 bp, M. musculus
cagtcagtcaatcagt

SEQ ID NO: 380844 - DNA, 16 bp, M. musculus
cagtcagtgcaggcag

SEQ ID NO: 380845 - DNA, 16 bp, M. musculus
cagtcagtgcagtcag

SEQ ID NO: 380846 - DNA, 16 bp, M. musculus
cagtcagtgccagcac

SEQ ID NO: 380847 - DNA, 16 bp, M. musculus
cagtcagtgctcataa

SEQ ID NO: 380848 - DNA, 16 bp, M. musculus
cagtcagtgctctaaa

SEQ ID NO: 380849 - DNA, 16 bp, M. musculus
cagtcagtgtccttaa

SEQ ID NO: 380850 - DNA, 16 bp, M. musculus
cagtcatcattagaga

SEQ ID NO: 380851 - DNA, 16 bp, M. musculus
cagtcatgtgccacca

SEQ ID NO: 380852 - DNA, 16 bp, M. musculus
cagtccacacaggaga

SEQ ID NO: 380853 - DNA, 16 bp, M. musculus
cagtccaccactgagg

SEQ ID NO: 380854 - DNA, 16 bp, M. musculus
cagtccactggttggc

SEQ ID NO: 380855 - DNA, 16 bp, M. musculus
cagtccactgtgggtg

SEQ ID NO: 380856 - DNA, 16 bp, M. musculus
cagtccaggacctcag

SEQ ID NO: 380857 - DNA, 16 bp, M. musculus
cagtccaggctggcct

SEQ ID NO: 380858 - DNA, 16 bp, M. musculus
cagtccagtcctctca

SEQ ID NO: 380859 - DNA, 16 bp, M. musculus
cagtccagtggatggc

SEQ ID NO: 380860 - DNA, 16 bp, M. musculus
cagtccatcacagagg

SEQ ID NO: 380861 - DNA, 16 bp, M. musculus
cagtccatcatccagg

SEQ ID NO: 380862 - DNA, 16 bp, M. musculus
cagtccatcattgtgg

SEQ ID NO: 380863 - DNA, 16 bp, M. musculus
cagtcccaccctcaca

SEQ ID NO: 380864 - DNA, 16 bp, M. musculus
cagtcccacttggaag

SEQ ID NO: 380865 - DNA, 16 bp, M. musculus
cagtccccaaaggaca

SEQ ID NO: 380866 - DNA, 16 bp, M. musculus
cagtccccagcaccca

SEQ ID NO: 380867 - DNA, 16 bp, M. musculus
cagtcccccaaaactt

SEQ ID NO: 380868 - DNA, 16 bp, M. musculus
cagtcccctggagctc

SEQ ID NO: 380869 - DNA, 16 bp, M. musculus
cagtcccttctctaac

SEQ ID NO: 380870 - DNA, 16 bp, M. musculus
cagtcctaaatgggac

SEQ ID NO: 380871 - DNA, 16 bp, M. musculus
cagtcctaactcctgg

SEQ ID NO: 380872 - DNA, 16 bp, M. musculus
cagtcctacatcccct

SEQ ID NO: 380873 - DNA, 16 bp, M. musculus
cagtcctataacccct

SEQ ID NO: 380874 - DNA, 16 bp, M. musculus
cagtcctcagcaccac

SEQ ID NO: 380875 - DNA, 16 bp, M. musculus
cagtcctcagctctga

SEQ ID NO: 380876 - DNA, 16 bp, M. musculus
cagtcctcagctctgg

SEQ ID NO: 380877 - DNA, 16 bp, M. musculus
cagtcctcctgtctca

SEQ ID NO: 380878 - DNA, 16 bp, M. musculus
cagtcctcttgcctca

SEQ ID NO: 380879 - DNA, 16 bp, M. musculus
cagtcctcttgcctct

SEQ ID NO: 380880 - DNA, 16 bp, M. musculus
cagtcctcttgcttca

SEQ ID NO: 380881 - DNA, 16 bp, M. musculus
cagtcctgacatcctt

SEQ ID NO: 380882 - DNA, 16 bp, M. musculus
cagtcctgacttcctg

SEQ ID NO: 380883 - DNA, 16 bp, M. musculus
cagtcctgagaggaaa

SEQ ID NO: 380884 - DNA, 16 bp, M. musculus
cagtcctgcttcctgg

SEQ ID NO: 380885 - DNA, 16 bp, M. musculus
cagtcctggaactcat

SEQ ID NO: 380886 - DNA, 16 bp, M. musculus
cagtcctggcttcctt

SEQ ID NO: 380887 - DNA, 16 bp, M. musculus
cagtcctgggcacctc

SEQ ID NO: 380888 - DNA, 17 bp, M. musculus
cagtcctgtttcttctt

SEQ ID NO: 380889 - DNA, 16 bp, M. musculus
cagtccttctgcctca

SEQ ID NO: 380890 - DNA, 16 bp, M. musculus
cagtcctttcccctca

SEQ ID NO: 380891 - DNA, 17 bp, M. musculus
cagtcctttctctaact

SEQ ID NO: 380892 - DNA, 16 bp, M. musculus
cagtctacttacatat

SEQ ID NO: 380893 - DNA, 16 bp, M. musculus
cagtctaggctacata

SEQ ID NO: 380894 - DNA, 16 bp, M. musculus
cagtctcagctccaaa

SEQ ID NO: 380895 - DNA, 16 bp, M. musculus
cagtctcaggcaccag

SEQ ID NO: 380896 - DNA, 16 bp, M. musculus
cagtctcccaccctaa

SEQ ID NO: 380897 - DNA, 16 bp, M. musculus
cagtctccctctccct

SEQ ID NO: 380898 - DNA, 16 bp, M. musculus
cagtctcctccttgct

SEQ ID NO: 380899 - DNA, 16 bp, M. musculus
cagtctcctcttggct

SEQ ID NO: 380900 - DNA, 16 bp, M. musculus
cagtctcctgagtgct

SEQ ID NO: 380901 - DNA, 16 bp, M. musculus
cagtctcctgcctcag

SEQ ID NO: 380902 - DNA, 16 bp, M. musculus
cagtctcctgtctctg

SEQ ID NO: 380903 - DNA, 16 bp, M. musculus
cagtctctactccatc

SEQ ID NO: 380904 - DNA, 16 bp, M. musculus
cagtctctagatagcc

SEQ ID NO: 380905 - DNA, 16 bp, M. musculus
cagtctctccctctcc

SEQ ID NO: 380906 - DNA, 16 bp, M. musculus
cagtctctcctccatt

SEQ ID NO: 380907 - DNA, 16 bp, M. musculus
cagtctctctctgtgt

SEQ ID NO: 380908 - DNA, 16 bp, M. musculus
cagtctctctcttcct

SEQ ID NO: 380909 - DNA, 16 bp, M. musculus
cagtctctctgtttct

SEQ ID NO: 380910 - DNA, 16 bp, M. musculus
cagtctctgcctctct

SEQ ID NO: 380911 - DNA, 16 bp, M. musculus
cagtctctgctcagaa

SEQ ID NO: 380912 - DNA, 16 bp, M. musculus
cagtctctgctccctc

SEQ ID NO: 380913 - DNA, 16 bp, M. musculus
cagtctctgcttcaca

SEQ ID NO: 380914 - DNA, 16 bp, M. musculus
cagtctctgcttcctg

SEQ ID NO: 380915 - DNA, 16 bp, M. musculus
cagtctctggaaccca

SEQ ID NO: 380916 - DNA, 16 bp, M. musculus
cagtctctgtatggtc

SEQ ID NO: 380917 - DNA, 16 bp, M. musculus
cagtctcttgaaggtt

SEQ ID NO: 380918 - DNA, 16 bp, M. musculus
cagtctgaactacata

SEQ ID NO: 380919 - DNA, 16 bp, M. musculus
cagtctgatggaagca

SEQ ID NO: 380920 - DNA, 16 bp, M. musculus
cagtctgatggaggca

SEQ ID NO: 380921 - DNA, 16 bp, M. musculus
cagtctgcaggcagct

SEQ ID NO: 380922 - DNA, 16 bp, M. musculus
cagtctggaagcagag

SEQ ID NO: 380923 - DNA, 16 bp, M. musculus
cagtctggactacaga

SEQ ID NO: 380924 - DNA, 18 bp, M. musculus
cagtctggaggttcctca

SEQ ID NO: 380925 - DNA, 16 bp, M. musculus
cagtctggcacttcct

SEQ ID NO: 380926 - DNA, 16 bp, M. musculus
cagtctggcagttcct

SEQ ID NO: 380927 - DNA, 16 bp, M. musculus
cagtctggcctggaac

SEQ ID NO: 380928 - DNA, 16 bp, M. musculus
cagtctggtgcttcct

SEQ ID NO: 380929 - DNA, 16 bp, M. musculus
cagtctggtggaggca

SEQ ID NO: 380930 - DNA, 16 bp, M. musculus
cagtctggtgtacaga

SEQ ID NO: 380931 - DNA, 16 bp, M. musculus
cagtctgtataatgtt

SEQ ID NO: 380932 - DNA, 16 bp, M. musculus
cagtctgtcatggtgg

SEQ ID NO: 380933 - DNA, 16 bp, M. musculus
cagtctgtcccatgac

SEQ ID NO: 380934 - DNA, 16 bp, M. musculus
cagtctgtctgtcttc

SEQ ID NO: 380935 - DNA, 16 bp, M. musculus
cagtctgtgagtctat

SEQ ID NO: 380936 - DNA, 16 bp, M. musculus
cagtctgtgtatgttc

SEQ ID NO: 380937 - DNA, 16 bp, M. musculus
cagtctgtgtgtgtgt

SEQ ID NO: 380938 - DNA, 16 bp, M. musculus
cagtcttcagttgagg

SEQ ID NO: 380939 - DNA, 16 bp, M. musculus
cagtcttcattttctt

SEQ ID NO: 380940 - DNA, 17 bp, M. musculus
cagtctttatgccacat

SEQ ID NO: 380941 - DNA, 16 bp, M. musculus
cagtctttattcaaga

SEQ ID NO: 380942 - DNA, 16 bp, M. musculus
cagtgaaaaagacaga

SEQ ID NO: 380943 - DNA, 16 bp, M. musculus
cagtgaaaccctgtct

SEQ ID NO: 380944 - DNA, 16 bp, M. musculus
cagtgaaacttacaga

SEQ ID NO: 380945 - DNA, 16 bp, M. musculus
cagtgaaagacagcag

SEQ ID NO: 380946 - DNA, 16 bp, M. musculus
cagtgaaagactctgt

SEQ ID NO: 380947 - DNA, 16 bp, M. musculus
cagtgaaagactgtct

SEQ ID NO: 380948 - DNA, 16 bp, M. musculus
cagtgaaagcctgtct

SEQ ID NO: 380949 - DNA, 16 bp, M. musculus
cagtgaaatcctgtct

SEQ ID NO: 380950 - DNA, 16 bp, M. musculus
cagtgaaccatctctc

SEQ ID NO: 380951 - DNA, 16 bp, M. musculus
cagtgaacctgtggag

SEQ ID NO: 380952 - DNA, 16 bp, M. musculus
cagtgaaggagctgga

SEQ ID NO: 380953 - DNA, 16 bp, M. musculus
cagtgaaggagttaga

SEQ ID NO: 380954 - DNA, 16 bp, M. musculus
cagtgaagtaggtgga

SEQ ID NO: 380955 - DNA, 16 bp, M. musculus
cagtgaatgctcttaa

SEQ ID NO: 380956 - DNA, 16 bp, M. musculus
cagtgaattccatgat

SEQ ID NO: 380957 - DNA, 16 bp, M. musculus
cagtgaattttttttt

SEQ ID NO: 380958 - DNA, 16 bp, M. musculus
cagtgacaccctgtct

SEQ ID NO: 380959 - DNA, 16 bp, M. musculus
cagtgacagaggctga

SEQ ID NO: 380960 - DNA, 16 bp, M. musculus
cagtgacagtgacagg

SEQ ID NO: 380961 - DNA, 16 bp, M. musculus
cagtgacagtgaggat

SEQ ID NO: 380962 - DNA, 16 bp, M. musculus
cagtgaccagaagagg

SEQ ID NO: 380963 - DNA, 16 bp, M. musculus
cagtgacccactttct

SEQ ID NO: 380964 - DNA, 16 bp, M. musculus
cagtgacgcacttcct

SEQ ID NO: 380965 - DNA, 16 bp, M. musculus
cagtgactgctcttcc

SEQ ID NO: 380966 - DNA, 16 bp, M. musculus
cagtgactggcaggca

SEQ ID NO: 380967 - DNA, 16 bp, M. musculus
cagtgactgtaaaaca

SEQ ID NO: 380968 - DNA, 16 bp, M. musculus
cagtgactgttcttcc

SEQ ID NO: 380969 - DNA, 16 bp, M. musculus
cagtgacttcatgaaa

SEQ ID NO: 380970 - DNA, 16 bp, M. musculus
cagtgactttctctga

SEQ ID NO: 380971 - DNA, 16 bp, M. musculus
cagtgagaaaccctgc

SEQ ID NO: 380972 - DNA, 16 bp, M. musculus
cagtgagaagctgaga

SEQ ID NO: 380973 - DNA, 16 bp, M. musculus
cagtgagacagacaga

SEQ ID NO: 380974 - DNA, 16 bp, M. musculus
cagtgagaccctggct

SEQ ID NO: 380975 - DNA, 16 bp, M. musculus
cagtgagactcccttg

SEQ ID NO: 380976 - DNA, 16 bp, M. musculus
cagtgagagaagattc

SEQ ID NO: 380977 - DNA, 16 bp, M. musculus
cagtgagagactctga

SEQ ID NO: 380978 - DNA, 16 bp, M. musculus
cagtgagagagagaga

SEQ ID NO: 380979 - DNA, 16 bp, M. musculus
cagtgagagatcctgt

SEQ ID NO: 380980 - DNA, 16 bp, M. musculus
cagtgagatcctgttt

SEQ ID NO: 380981 - DNA, 16 bp, M. musculus
cagtgagatggctcag

SEQ ID NO: 380982 - DNA, 16 bp, M. musculus
cagtgagcaggatgca

SEQ ID NO: 380983 - DNA, 16 bp, M. musculus
cagtgagctctaggga

SEQ ID NO: 380984 - DNA, 16 bp, M. musculus
cagtgaggaaactgag

SEQ ID NO: 380985 - DNA, 16 bp, M. musculus
cagtgaggagctgggg

SEQ ID NO: 380986 - DNA, 16 bp, M. musculus
cagtgaggaggaggag

SEQ ID NO: 380987 - DNA, 16 bp, M. musculus
cagtgaggccctgtct

SEQ ID NO: 380988 - DNA, 16 bp, M. musculus
cagtgagggagagaga

SEQ ID NO: 380989 - DNA, 16 bp, M. musculus
cagtgaggggttgggg

SEQ ID NO: 380990 - DNA, 16 bp, M. musculus
cagtgagggtgaggaa

SEQ ID NO: 380991 - DNA, 16 bp, M. musculus
cagtgagtcccaggga

SEQ ID NO: 380992 - DNA, 16 bp, M. musculus
cagtgagtgcttttaa

SEQ ID NO: 380993 - DNA, 16 bp, M. musculus
cagtgagttcaaagct

SEQ ID NO: 380994 - DNA, 16 bp, M. musculus
cagtgagtttattgga

SEQ ID NO: 380995 - DNA, 16 bp, M. musculus
cagtgagtttgaagcc

SEQ ID NO: 380996 - DNA, 16 bp, M. musculus
cagtgatccctgagcc

SEQ ID NO: 380997 - DNA, 16 bp, M. musculus
cagtgatccttctgcc

SEQ ID NO: 380998 - DNA, 16 bp, M. musculus
cagtgatgaagagcac

SEQ ID NO: 380999 - DNA, 16 bp, M. musculus
cagtgatgctggtctt

SEQ ID NO: 381000 - DNA, 16 bp, M. musculus
cagtgatggacagaaa

SEQ ID NO: 381001 - DNA, 16 bp, M. musculus
cagtgatggactacaa

SEQ ID NO: 381002 - DNA, 16 bp, M. musculus
cagtgatggccaacta

SEQ ID NO: 381003 - DNA, 20 bp, M. musculus
cagtgatggccgactaggcc

SEQ ID NO: 381004 - DNA, 17 bp, M. musculus
cagtgatggccgattag

SEQ ID NO: 381005 - DNA, 16 bp, M. musculus
cagtgatggtcaacta

SEQ ID NO: 381006 - DNA, 16 bp, M. musculus
cagtgatgtgaaaatt

SEQ ID NO: 381007 - DNA, 16 bp, M. musculus
cagtgatgtgtttgtg

SEQ ID NO: 381008 - DNA, 16 bp, M. musculus
cagtgatgttggtctc

SEQ ID NO: 381009 - DNA, 16 bp, M. musculus
cagtgattctcaacct

SEQ ID NO: 381010 - DNA, 16 bp, M. musculus
cagtgcactggaacaa

SEQ ID NO: 381011 - DNA, 16 bp, M. musculus
cagtgcagaagacaga

SEQ ID NO: 381012 - DNA, 18 bp, M. musculus
cagtgcagaagatggagg

SEQ ID NO: 381013 - DNA, 16 bp, M. musculus
cagtgcagagttctat

SEQ ID NO: 381014 - DNA, 16 bp, M. musculus
cagtgcagccatctct

SEQ ID NO: 381015 - DNA, 16 bp, M. musculus
cagtgcagcctctggc

SEQ ID NO: 381016 - DNA, 16 bp, M. musculus
cagtgcaggtggctgg

SEQ ID NO: 381017 - DNA, 16 bp, M. musculus
cagtgcagtgcagtgg

SEQ ID NO: 381018 - DNA, 16 bp, M. musculus
cagtgcatgctgggaa

SEQ ID NO: 381019 - DNA, 17 bp, M. musculus
cagtgcatggccggcca

SEQ ID NO: 381020 - DNA, 16 bp, M. musculus
cagtgcattatcatca

SEQ ID NO: 381021 - DNA, 16 bp, M. musculus
cagtgccaccagctgg

SEQ ID NO: 381022 - DNA, 16 bp, M. musculus
cagtgccaccctgcaa

SEQ ID NO: 381023 - DNA, 16 bp, M. musculus
cagtgccatgcagttt

SEQ ID NO: 381024 - DNA, 16 bp, M. musculus
cagtgcccacataaaa

SEQ ID NO: 381025 - DNA, 16 bp, M. musculus
cagtgcccccttctgg

SEQ ID NO: 381026 - DNA, 16 bp, M. musculus
cagtgccctctgctgg

SEQ ID NO: 381027 - DNA, 16 bp, M. musculus
cagtgccctttgcctt

SEQ ID NO: 381028 - DNA, 16 bp, M. musculus
cagtgcctctgcacca

SEQ ID NO: 381029 - DNA, 16 bp, M. musculus
cagtgcctgactaata

SEQ ID NO: 381030 - DNA, 16 bp, M. musculus
cagtgcctgcagaggt

SEQ ID NO: 381031 - DNA, 16 bp, M. musculus
cagtgcctgcctccag

SEQ ID NO: 381032 - DNA, 16 bp, M. musculus
cagtgcctggaagtgg

SEQ ID NO: 381033 - DNA, 16 bp, M. musculus
cagtgcctggcagata

SEQ ID NO: 381034 - DNA, 16 bp, M. musculus
cagtgcctgtggagac

SEQ ID NO: 381035 - DNA, 16 bp, M. musculus
cagtgctaagaggaaa

SEQ ID NO: 381036 - DNA, 16 bp, M. musculus
cagtgctaagagggaa

SEQ ID NO: 381037 - DNA, 16 bp, M. musculus
cagtgctagggatgga

SEQ ID NO: 381038 - DNA, 16 bp, M. musculus
cagtgctatgagtttc

SEQ ID NO: 381039 - DNA, 16 bp, M. musculus
cagtgctccataccca

SEQ ID NO: 381040 - DNA, 16 bp, M. musculus
cagtgctcctaacagc

SEQ ID NO: 381041 - DNA, 16 bp, M. musculus
cagtgctctcaaccat

SEQ ID NO: 381042 - DNA, 16 bp, M. musculus
cagtgctctcctgtat

SEQ ID NO: 381043 - DNA, 16 bp, M. musculus
cagtgctctgggcagg

SEQ ID NO: 381044 - DNA, 16 bp, M. musculus
cagtgctcttaaccat

SEQ ID NO: 381045 - DNA, 16 bp, M. musculus
cagtgctcttaagctc

SEQ ID NO: 381046 - DNA, 16 bp, M. musculus
cagtgctcttagccac

SEQ ID NO: 381047 - DNA, 16 bp, M. musculus
cagtgctcttgcagag

SEQ ID NO: 381048 - DNA, 16 bp, M. musculus
cagtgctggaattgca

SEQ ID NO: 381049 - DNA, 16 bp, M. musculus
cagtgctggagactga

SEQ ID NO: 381050 - DNA, 16 bp, M. musculus
cagtgctggagatgga

SEQ ID NO: 381051 - DNA, 16 bp, M. musculus
cagtgctgggacccca

SEQ ID NO: 381052 - DNA, 16 bp, M. musculus
cagtgctgggattaga

SEQ ID NO: 381053 - DNA, 16 bp, M. musculus
cagtgctggggactga

SEQ ID NO: 381054 - DNA, 16 bp, M. musculus
cagtgctggggagatg

SEQ ID NO: 381055 - DNA, 16 bp, M. musculus
cagtgctgtacaggtt

SEQ ID NO: 381056 - DNA, 16 bp, M. musculus
cagtgcttcttagaag

SEQ ID NO: 381057 - DNA, 16 bp, M. musculus
cagtgcttgagaggca

SEQ ID NO: 381058 - DNA, 16 bp, M. musculus
cagtgcttgcctggca

SEQ ID NO: 381059 - DNA, 16 bp, M. musculus
cagtgcttggaaggca

SEQ ID NO: 381060 - DNA, 16 bp, M. musculus
cagtggaaaacagaca

SEQ ID NO: 381061 - DNA, 16 bp, M. musculus
cagtggaaaaggaagg

SEQ ID NO: 381062 - DNA, 16 bp, M. musculus
cagtggaaaatttcct

SEQ ID NO: 381063 - DNA, 16 bp, M. musculus
cagtggaaacagaggc

SEQ ID NO: 381064 - DNA, 16 bp, M. musculus
cagtggaaagacaggc

SEQ ID NO: 381065 - DNA, 16 bp, M. musculus
cagtggaaagagaagc

SEQ ID NO: 381066 - DNA, 16 bp, M. musculus
cagtggaaagagagtc

SEQ ID NO: 381067 - DNA, 16 bp, M. musculus
cagtggaagaaagaga

SEQ ID NO: 381068 - DNA, 19 bp, M. musculus
cagtggaagccagcaccat

SEQ ID NO: 381069 - DNA, 16 bp, M. musculus
cagtggaaggaaatga

SEQ ID NO: 381070 - DNA, 16 bp, M. musculus
cagtggaaggagagag

SEQ ID NO: 381071 - DNA, 16 bp, M. musculus
cagtggaatgctttaa

SEQ ID NO: 381072 - DNA, 22 bp, M. musculus
cagtggacagatcatggaaaca

SEQ ID NO: 381073 - DNA, 16 bp, M. musculus
cagtggaccatgccag

SEQ ID NO: 381074 - DNA, 16 bp, M. musculus
cagtggacctgagttc

SEQ ID NO: 381075 - DNA, 16 bp, M. musculus
cagtggactgggcctt

SEQ ID NO: 381076 - DNA, 16 bp, M. musculus
cagtggagaagttagg

SEQ ID NO: 381077 - DNA, 16 bp, M. musculus
cagtggagaccagaag

SEQ ID NO: 381078 - DNA, 16 bp, M. musculus
cagtggagctgaccct

SEQ ID NO: 381079 - DNA, 16 bp, M. musculus
cagtggagctggccct

SEQ ID NO: 381080 - DNA, 16 bp, M. musculus
cagtggaggaaatgcc

SEQ ID NO: 381081 - DNA, 16 bp, M. musculus
cagtggaggaggagga

SEQ ID NO: 381082 - DNA, 16 bp, M. musculus
cagtggaggggaaagg

SEQ ID NO: 381083 - DNA, 16 bp, M. musculus
cagtggagtccaggca

SEQ ID NO: 381084 - DNA, 16 bp, M. musculus
cagtggagtggagtca

SEQ ID NO: 381085 - DNA, 16 bp, M. musculus
cagtggatggccccat

SEQ ID NO: 381086 - DNA, 16 bp, M. musculus
cagtggatggtgatga

SEQ ID NO: 381087 - DNA, 16 bp, M. musculus
cagtggattctgggaa

SEQ ID NO: 381088 - DNA, 16 bp, M. musculus
cagtggcagcagcagc

SEQ ID NO: 381089 - DNA, 16 bp, M. musculus
cagtggcaggtggcag

SEQ ID NO: 381090 - DNA, 16 bp, M. musculus
cagtggcagtggagtg

SEQ ID NO: 381091 - DNA, 16 bp, M. musculus
cagtggcagtggctga

SEQ ID NO: 381092 - DNA, 16 bp, M. musculus
cagtggccagccagtc

SEQ ID NO: 381093 - DNA, 16 bp, M. musculus
cagtggcctcttctgg

SEQ ID NO: 381094 - DNA, 16 bp, M. musculus
cagtggcctgggccct

SEQ ID NO: 381095 - DNA, 16 bp, M. musculus
cagtggcctggtcccc

SEQ ID NO: 381096 - DNA, 16 bp, M. musculus
cagtggctctcaactt

SEQ ID NO: 381097 - DNA, 16 bp, M. musculus
cagtggctggagagat

SEQ ID NO: 381098 - DNA, 16 bp, M. musculus
cagtggcttcccctgc

SEQ ID NO: 381099 - DNA, 16 bp, M. musculus
cagtggctttaactgg

SEQ ID NO: 381100 - DNA, 16 bp, M. musculus
cagtggctttcaacct

SEQ ID NO: 381101 - DNA, 16 bp, M. musculus
cagtgggaagagaggc

SEQ ID NO: 381102 - DNA, 16 bp, M. musculus
cagtgggaagagatga

SEQ ID NO: 381103 - DNA, 16 bp, M. musculus
cagtgggacagcaggt

SEQ ID NO: 381104 - DNA, 16 bp, M. musculus
cagtgggagaagacat

SEQ ID NO: 381105 - DNA, 16 bp, M. musculus
cagtgggagaggaaac

SEQ ID NO: 381106 - DNA, 16 bp, M. musculus
cagtgggaggaatggc

SEQ ID NO: 381107 - DNA, 16 bp, M. musculus
cagtgggaggagagaa

SEQ ID NO: 381108 - DNA, 16 bp, M. musculus
cagtgggaggagcagc

SEQ ID NO: 381109 - DNA, 16 bp, M. musculus
cagtgggagggaggga

SEQ ID NO: 381110 - DNA, 16 bp, M. musculus
cagtgggcaaaggcac

SEQ ID NO: 381111 - DNA, 16 bp, M. musculus
cagtgggccatgttct

SEQ ID NO: 381112 - DNA, 16 bp, M. musculus
cagtgggctgcacaca

SEQ ID NO: 381113 - DNA, 16 bp, M. musculus
cagtgggctgggctct

SEQ ID NO: 381114 - DNA, 16 bp, M. musculus
cagtgggctgggtcct

SEQ ID NO: 381115 - DNA, 16 bp, M. musculus
cagtggggaccctgtg

SEQ ID NO: 381116 - DNA, 16 bp, M. musculus
cagtggggagagagaa

SEQ ID NO: 381117 - DNA, 16 bp, M. musculus
cagtggggagatagaa

SEQ ID NO: 381118 - DNA, 16 bp, M. musculus
cagtgggggaggggca

SEQ ID NO: 381119 - DNA, 16 bp, M. musculus
cagtgggggatgggaa

SEQ ID NO: 381120 - DNA, 16 bp, M. musculus
cagtggggtgtgtgtg

SEQ ID NO: 381121 - DNA, 16 bp, M. musculus
cagtgggtaaaggcat

SEQ ID NO: 381122 - DNA, 16 bp, M. musculus
cagtggtagcacacgc

SEQ ID NO: 381123 - DNA, 16 bp, M. musculus
cagtggtcaagaacac

SEQ ID NO: 381124 - DNA, 17 bp, M. musculus
cagtggtcagagcactc

SEQ ID NO: 381125 - DNA, 16 bp, M. musculus
cagtggtcagcagcag

SEQ ID NO: 381126 - DNA, 16 bp, M. musculus
cagtggtgcacatctg

SEQ ID NO: 381127 - DNA, 16 bp, M. musculus
cagtggtggagcatgc

SEQ ID NO: 381128 - DNA, 16 bp, M. musculus
cagtggtggagtgttt

SEQ ID NO: 381129 - DNA, 16 bp, M. musculus
cagtggtggcccacgc

SEQ ID NO: 381130 - DNA, 16 bp, M. musculus
cagtggtgttggaaca

SEQ ID NO: 381131 - DNA, 16 bp, M. musculus
cagtggttaagggtgc

SEQ ID NO: 381132 - DNA, 16 bp, M. musculus
cagtggttcagaacac

SEQ ID NO: 381133 - DNA, 16 bp, M. musculus
cagtggttctcaaact

SEQ ID NO: 381134 - DNA, 16 bp, M. musculus
cagtggttctcaacat

SEQ ID NO: 381135 - DNA, 16 bp, M. musculus
cagtggttctcaacct

SEQ ID NO: 381136 - DNA, 16 bp, M. musculus
cagtggttctcaactt

SEQ ID NO: 381137 - DNA, 16 bp, M. musculus
cagtggttctcagcct

SEQ ID NO: 381138 - DNA, 16 bp, M. musculus
cagtggttcttaacct

SEQ ID NO: 381139 - DNA, 16 bp, M. musculus
cagtggttttcaaact

SEQ ID NO: 381140 - DNA, 16 bp, M. musculus
cagtggttttcaactt

SEQ ID NO: 381141 - DNA, 16 bp, M. musculus
cagtgtattggagatg

SEQ ID NO: 381142 - DNA, 16 bp, M. musculus
cagtgtcaaccagcca

SEQ ID NO: 381143 - DNA, 16 bp, M. musculus
cagtgtcaataagaca

SEQ ID NO: 381144 - DNA, 16 bp, M. musculus
cagtgtcaggcatggg

SEQ ID NO: 381145 - DNA, 16 bp, M. musculus
cagtgtcaggtatggg

SEQ ID NO: 381146 - DNA, 16 bp, M. musculus
cagtgtccaagaggaa

SEQ ID NO: 381147 - DNA, 16 bp, M. musculus
cagtgtccttagcctt

SEQ ID NO: 381148 - DNA, 16 bp, M. musculus
cagtgtctctctctgc

SEQ ID NO: 381149 - DNA, 16 bp, M. musculus
cagtgtctctggttgt

SEQ ID NO: 381150 - DNA, 16 bp, M. musculus
cagtgtctgtgagttc

SEQ ID NO: 381151 - DNA, 16 bp, M. musculus
cagtgtcttaaagttt

SEQ ID NO: 381152 - DNA, 16 bp, M. musculus
cagtgtcttctggaca

SEQ ID NO: 381153 - DNA, 16 bp, M. musculus
cagtgtcttcttctgg

SEQ ID NO: 381154 - DNA, 16 bp, M. musculus
cagtgtcttgaaggag

SEQ ID NO: 381155 - DNA, 16 bp, M. musculus
cagtgtcttgctcagc

SEQ ID NO: 381156 - DNA, 17 bp, M. musculus
cagtgtcttggagaaga

SEQ ID NO: 381157 - DNA, 16 bp, M. musculus
cagtgtctttttcctt

SEQ ID NO: 381158 - DNA, 16 bp, M. musculus
cagtgtgacttgtcct

SEQ ID NO: 381159 - DNA, 16 bp, M. musculus
cagtgtgagctccagg

SEQ ID NO: 381160 - DNA, 16 bp, M. musculus
cagtgtgcctccctca

SEQ ID NO: 381161 - DNA, 16 bp, M. musculus
cagtgtgctttgcctt

SEQ ID NO: 381162 - DNA, 16 bp, M. musculus
cagtgtggaagagacc

SEQ ID NO: 381163 - DNA, 16 bp, M. musculus
cagtgtggcacagtct

SEQ ID NO: 381164 - DNA, 16 bp, M. musculus
cagtgtggccagctgc

SEQ ID NO: 381165 - DNA, 16 bp, M. musculus
cagtgtggtacacagt

SEQ ID NO: 381166 - DNA, 16 bp, M. musculus
cagtgtgtgcagaaaa

SEQ ID NO: 381167 - DNA, 16 bp, M. musculus
cagtgtgtgctcttaa

SEQ ID NO: 381168 - DNA, 16 bp, M. musculus
cagtgttatcaggtga

SEQ ID NO: 381169 - DNA, 16 bp, M. musculus
cagtgttattcataat

SEQ ID NO: 381170 - DNA, 16 bp, M. musculus
cagtgttccagaagcc

SEQ ID NO: 381171 - DNA, 16 bp, M. musculus
cagtgttctcaacctt

SEQ ID NO: 381172 - DNA, 16 bp, M. musculus
cagtgttggggattga

SEQ ID NO: 381173 - DNA, 16 bp, M. musculus
cagtgtttctcaacct

SEQ ID NO: 381174 - DNA, 16 bp, M. musculus
cagtgtttctctttgt

SEQ ID NO: 381175 - DNA, 16 bp, M. musculus
cagtgtttctttttct

SEQ ID NO: 381176 - DNA, 16 bp, M. musculus
cagtgtttgaaagatc

SEQ ID NO: 381177 - DNA, 16 bp, M. musculus
cagtgtttggctgtgg

SEQ ID NO: 381178 - DNA, 16 bp, M. musculus
cagtgttttattgctg

SEQ ID NO: 381179 - DNA, 16 bp, M. musculus
cagtgttttgcctgca

SEQ ID NO: 381180 - DNA, 16 bp, M. musculus
cagttaaaagcactga

SEQ ID NO: 381181 - DNA, 16 bp, M. musculus
cagttaaatgtttttt

SEQ ID NO: 381182 - DNA, 16 bp, M. musculus
cagttaacaaagataa

SEQ ID NO: 381183 - DNA, 16 bp, M. musculus
cagttaagaacacttg

SEQ ID NO: 381184 - DNA, 16 bp, M. musculus
cagttaagagcacctg

SEQ ID NO: 381185 - DNA, 16 bp, M. musculus
cagttaagagcagttg

SEQ ID NO: 381186 - DNA, 16 bp, M. musculus
cagttaagatcacttg

SEQ ID NO: 381187 - DNA, 16 bp, M. musculus
cagttaagggcactga

SEQ ID NO: 381188 - DNA, 16 bp, M. musculus
cagttaagggcactgg

SEQ ID NO: 381189 - DNA, 16 bp, M. musculus
cagttaatttgtgtct

SEQ ID NO: 381190 - DNA, 16 bp, M. musculus
cagttacagcagaaag

SEQ ID NO: 381191 - DNA, 16 bp, M. musculus
cagttacctagcaaca

SEQ ID NO: 381192 - DNA, 16 bp, M. musculus
cagttagaccagcacc

SEQ ID NO: 381193 - DNA, 16 bp, M. musculus
cagttaggaaacagga

SEQ ID NO: 381194 - DNA, 16 bp, M. musculus
cagttaggggaaaagg

SEQ ID NO: 381195 - DNA, 16 bp, M. musculus
cagttaggggaaaggg

SEQ ID NO: 381196 - DNA, 16 bp, M. musculus
cagttagtgcttttaa

SEQ ID NO: 381197 - DNA, 16 bp, M. musculus
cagttataccactcct

SEQ ID NO: 381198 - DNA, 17 bp, M. musculus
cagttattcagtctcac

SEQ ID NO: 381199 - DNA, 16 bp, M. musculus
cagttattcgtgggtg

SEQ ID NO: 381200 - DNA, 16 bp, M. musculus
cagttcaaagcactgg

SEQ ID NO: 381201 - DNA, 16 bp, M. musculus
cagttcaaagccagcc

SEQ ID NO: 381202 - DNA, 16 bp, M. musculus
cagttcaaatcccagc

SEQ ID NO: 381203 - DNA, 16 bp, M. musculus
cagttcaaattactct

SEQ ID NO: 381204 - DNA, 16 bp, M. musculus
cagttcaagaccagcc

SEQ ID NO: 381205 - DNA, 16 bp, M. musculus
cagttcacagcagtaa

SEQ ID NO: 381206 - DNA, 16 bp, M. musculus
cagttcacagccatct

SEQ ID NO: 381207 - DNA, 16 bp, M. musculus
cagttcagagcactgg

SEQ ID NO: 381208 - DNA, 16 bp, M. musculus
cagttcagctcacagg

SEQ ID NO: 381209 - DNA, 16 bp, M. musculus
cagttcagcttacctt

SEQ ID NO: 381210 - DNA, 16 bp, M. musculus
cagttcaggaagcagg

SEQ ID NO: 381211 - DNA, 16 bp, M. musculus
cagttcagttcacagg

SEQ ID NO: 381212 - DNA, 16 bp, M. musculus
cagttcagtttgtgga

SEQ ID NO: 381213 - DNA, 16 bp, M. musculus
cagttcattatcatca

SEQ ID NO: 381214 - DNA, 16 bp, M. musculus
cagttcattgtgggtg

SEQ ID NO: 381215 - DNA, 16 bp, M. musculus
cagttccaagggatcc

SEQ ID NO: 381216 - DNA, 18 bp, M. musculus
cagttccagaatgtataa

SEQ ID NO: 381217 - DNA, 16 bp, M. musculus
cagttccagagaatcc

SEQ ID NO: 381218 - DNA, 16 bp, M. musculus
cagttccagagatctg

SEQ ID NO: 381219 - DNA, 16 bp, M. musculus
cagttccagagcatct

SEQ ID NO: 381220 - DNA, 16 bp, M. musculus
cagttccaggaaacct

SEQ ID NO: 381221 - DNA, 16 bp, M. musculus
cagttccaggacagcc

SEQ ID NO: 381222 - DNA, 19 bp, M. musculus
cagttccaggacagccagg

SEQ ID NO: 381223 - DNA, 16 bp, M. musculus
cagttccaggacatcc

SEQ ID NO: 381224 - DNA, 16 bp, M. musculus
cagttccaggagagct

SEQ ID NO: 381225 - DNA, 16 bp, M. musculus
cagttccaggagatct

SEQ ID NO: 381226 - DNA, 16 bp, M. musculus
cagttccaggggatcc

SEQ ID NO: 381227 - DNA, 16 bp, M. musculus
cagttcccagcacctg

SEQ ID NO: 381228 - DNA, 16 bp, M. musculus
cagttcccagcacctt

SEQ ID NO: 381229 - DNA, 16 bp, M. musculus
cagttcccagcagcca

SEQ ID NO: 381230 - DNA, 16 bp, M. musculus
cagttcccagcatcct

SEQ ID NO: 381231 - DNA, 16 bp, M. musculus
cagttccctccttcca

SEQ ID NO: 381232 - DNA, 16 bp, M. musculus
cagttcctaagaaaat

SEQ ID NO: 381233 - DNA, 16 bp, M. musculus
cagttcctacctccag

SEQ ID NO: 381234 - DNA, 16 bp, M. musculus
cagttcctagcactca

SEQ ID NO: 381235 - DNA, 16 bp, M. musculus
cagttcctcaattgag

SEQ ID NO: 381236 - DNA, 16 bp, M. musculus
cagttcctcatgttat

SEQ ID NO: 381237 - DNA, 16 bp, M. musculus
cagttcctgcctccag

SEQ ID NO: 381238 - DNA, 16 bp, M. musculus
cagttcctgcctccgg

SEQ ID NO: 381239 - DNA, 16 bp, M. musculus
cagttcctgcttcctg

SEQ ID NO: 381240 - DNA, 16 bp, M. musculus
cagttccttcccacct

SEQ ID NO: 381241 - DNA, 16 bp, M. musculus
cagttccttctccagc

SEQ ID NO: 381242 - DNA, 21 bp, M. musculus
cagttcggaccggtggtagcc

SEQ ID NO: 381243 - DNA, 16 bp, M. musculus
cagttctaagggatct

SEQ ID NO: 381244 - DNA, 16 bp, M. musculus
cagttctattaggatt

SEQ ID NO: 381245 - DNA, 16 bp, M. musculus
cagttctcagcaccac

SEQ ID NO: 381246 - DNA, 16 bp, M. musculus
cagttctcaggaccca

SEQ ID NO: 381247 - DNA, 16 bp, M. musculus
cagttctccaaccaca

SEQ ID NO: 381248 - DNA, 16 bp, M. musculus
cagttctcctgcctca

SEQ ID NO: 381249 - DNA, 16 bp, M. musculus
cagttctctctcccag

SEQ ID NO: 381250 - DNA, 16 bp, M. musculus
cagttctctctctctc

SEQ ID NO: 381251 - DNA, 16 bp, M. musculus
cagttctctgagttca

SEQ ID NO: 381252 - DNA, 16 bp, M. musculus
cagttctctgtggctg

SEQ ID NO: 381253 - DNA, 16 bp, M. musculus
cagttctcttctacct

SEQ ID NO: 381254 - DNA, 16 bp, M. musculus
cagttctgagccacca

SEQ ID NO: 381255 - DNA, 16 bp, M. musculus
cagttctgagccccat

SEQ ID NO: 381256 - DNA, 23 bp, M. musculus
cagttctgccgtcagatggacgt

SEQ ID NO: 381257 - DNA, 16 bp, M. musculus
cagttctggaaagaga

SEQ ID NO: 381258 - DNA, 16 bp, M. musculus
cagttctgttcccagc

SEQ ID NO: 381259 - DNA, 16 bp, M. musculus
cagttcttcagaaaac

SEQ ID NO: 381260 - DNA, 16 bp, M. musculus
cagttcttgggtgagt

SEQ ID NO: 381261 - DNA, 16 bp, M. musculus
cagttctttccttctg

SEQ ID NO: 381262 - DNA, 16 bp, M. musculus
cagttctttgagaaaa

SEQ ID NO: 381263 - DNA, 16 bp, M. musculus
cagttgaagaaagaca

SEQ ID NO: 381264 - DNA, 16 bp, M. musculus
cagttgagagcacttg

SEQ ID NO: 381265 - DNA, 16 bp, M. musculus
cagttgagattttttt

SEQ ID NO: 381266 - DNA, 16 bp, M. musculus
cagttgaggaaatgct

SEQ ID NO: 381267 - DNA, 16 bp, M. musculus
cagttgatggtttctg

SEQ ID NO: 381268 - DNA, 16 bp, M. musculus
cagttgccctgtgtgc

SEQ ID NO: 381269 - DNA, 16 bp, M. musculus
cagttgctgggatttg

SEQ ID NO: 381270 - DNA, 16 bp, M. musculus
cagttgcttctcagcc

SEQ ID NO: 381271 - DNA, 16 bp, M. musculus
cagttggagttaagag

SEQ ID NO: 381272 - DNA, 16 bp, M. musculus
cagttggatctcattg

SEQ ID NO: 381273 - DNA, 16 bp, M. musculus
cagttgggagccacca

SEQ ID NO: 381274 - DNA, 16 bp, M. musculus
cagttggggaaactga

SEQ ID NO: 381275 - DNA, 16 bp, M. musculus
cagttgtgaatctctg

SEQ ID NO: 381276 - DNA, 16 bp, M. musculus
cagttgtgagctgtca

SEQ ID NO: 381277 - DNA, 16 bp, M. musculus
cagttgtggaactctt

SEQ ID NO: 381278 - DNA, 16 bp, M. musculus
cagttgtggttctctg

SEQ ID NO: 381279 - DNA, 16 bp, M. musculus
cagttgttcaatttca

SEQ ID NO: 381280 - DNA, 16 bp, M. musculus
cagttgttctcaacct

SEQ ID NO: 381281 - DNA, 16 bp, M. musculus
cagtttagagcactga

SEQ ID NO: 381282 - DNA, 16 bp, M. musculus
cagtttattagtctat

SEQ ID NO: 381283 - DNA, 16 bp, M. musculus
cagtttcagaggctca

SEQ ID NO: 381284 - DNA, 16 bp, M. musculus
cagtttcaggaagagg

SEQ ID NO: 381285 - DNA, 16 bp, M. musculus
cagtttcaggtgacca

SEQ ID NO: 381286 - DNA, 16 bp, M. musculus
cagtttcagtgtatct

SEQ ID NO: 381287 - DNA, 16 bp, M. musculus
cagtttcatccatttg

SEQ ID NO: 381288 - DNA, 16 bp, M. musculus
cagtttcatgtggtcc

SEQ ID NO: 381289 - DNA, 16 bp, M. musculus
cagtttccagacttcc

SEQ ID NO: 381290 - DNA, 16 bp, M. musculus
cagtttccatcccaga

SEQ ID NO: 381291 - DNA, 16 bp, M. musculus
cagtttccattttctt

SEQ ID NO: 381292 - DNA, 16 bp, M. musculus
cagtttcccctccctc

SEQ ID NO: 381293 - DNA, 16 bp, M. musculus
cagtttcccctctgga

SEQ ID NO: 381294 - DNA, 16 bp, M. musculus
cagtttccttccttta

SEQ ID NO: 381295 - DNA, 16 bp, M. musculus
cagtttctcatgtggt

SEQ ID NO: 381296 - DNA, 16 bp, M. musculus
cagtttctcttactgg

SEQ ID NO: 381297 - DNA, 16 bp, M. musculus
cagtttctgccttgag

SEQ ID NO: 381298 - DNA, 16 bp, M. musculus
cagtttctgctggatt

SEQ ID NO: 381299 - DNA, 16 bp, M. musculus
cagtttctggatgaag

SEQ ID NO: 381300 - DNA, 16 bp, M. musculus
cagtttctggatggcc

SEQ ID NO: 381301 - DNA, 16 bp, M. musculus
cagtttctgttccact

SEQ ID NO: 381302 - DNA, 16 bp, M. musculus
cagtttctgttgtttt

SEQ ID NO: 381303 - DNA, 16 bp, M. musculus
cagtttcttactgaat

SEQ ID NO: 381304 - DNA, 16 bp, M. musculus
cagtttcttcttggag

SEQ ID NO: 381305 - DNA, 16 bp, M. musculus
cagtttcttttctatt

SEQ ID NO: 381306 - DNA, 16 bp, M. musculus
cagtttgactcccagg

SEQ ID NO: 381307 - DNA, 16 bp, M. musculus
cagtttgagggtacag

SEQ ID NO: 381308 - DNA, 16 bp, M. musculus
cagtttgcacagcaga

SEQ ID NO: 381309 - DNA, 16 bp, M. musculus
cagtttgcacagtgga

SEQ ID NO: 381310 - DNA, 16 bp, M. musculus
cagtttgcactcccac

SEQ ID NO: 381311 - DNA, 16 bp, M. musculus
cagtttggggacaagt

SEQ ID NO: 381312 - DNA, 16 bp, M. musculus
cagtttgtttctttgt

SEQ ID NO: 381313 - DNA, 16 bp, M. musculus
cagtttgtttggaaga

SEQ ID NO: 381314 - DNA, 16 bp, M. musculus
cagttttaaaaaatta

SEQ ID NO: 381315 - DNA, 16 bp, M. musculus
cagttttagaagttta

SEQ ID NO: 381316 - DNA, 16 bp, M. musculus
cagttttatgagttcc

SEQ ID NO: 381317 - DNA, 16 bp, M. musculus
cagttttatttcttct

SEQ ID NO: 381318 - DNA, 16 bp, M. musculus
cagttttccctccctc

SEQ ID NO: 381319 - DNA, 16 bp, M. musculus
cagttttctttcacaa

SEQ ID NO: 381320 - DNA, 16 bp, M. musculus
cagttttggagaagat

SEQ ID NO: 381321 - DNA, 16 bp, M. musculus
cagttttggagagggt

SEQ ID NO: 381322 - DNA, 16 bp, M. musculus
cagttttgtaaacctt

SEQ ID NO: 381323 - DNA, 17 bp, M. musculus
cagttttgtggcagaat

SEQ ID NO: 381324 - DNA, 16 bp, M. musculus
cagttttgtggttcct

SEQ ID NO: 381325 - DNA, 16 bp, M. musculus
cagtttttatagttgt

SEQ ID NO: 381326 - DNA, 16 bp, M. musculus
cagtttttatgactat

SEQ ID NO: 381327 - DNA, 16 bp, M. musculus
cagtttttgagcttgt

SEQ ID NO: 381328 - DNA, 16 bp, M. musculus
cataaaaacaacattc

SEQ ID NO: 381329 - DNA, 16 bp, M. musculus
cataaaaccaaagaca

SEQ ID NO: 381330 - DNA, 16 bp, M. musculus
cataaaaccagagatg

SEQ ID NO: 381331 - DNA, 16 bp, M. musculus
cataaaaccagataca

SEQ ID NO: 381332 - DNA, 16 bp, M. musculus
cataaaaccagattca

SEQ ID NO: 381333 - DNA, 16 bp, M. musculus
cataaaaccagccagc

SEQ ID NO: 381334 - DNA, 16 bp, M. musculus
cataaaagaaaatttt

SEQ ID NO: 381335 - DNA, 16 bp, M. musculus
cataaaagaaacacta

SEQ ID NO: 381336 - DNA, 16 bp, M. musculus
cataaaagaaatgtta

SEQ ID NO: 381337 - DNA, 16 bp, M. musculus
cataaaagaaattcct

SEQ ID NO: 381338 - DNA, 16 bp, M. musculus
cataaaagaaatttta

SEQ ID NO: 381339 - DNA, 16 bp, M. musculus
cataaaagaacacaca

SEQ ID NO: 381340 - DNA, 16 bp, M. musculus
cataaaagaactcaca

SEQ ID NO: 381341 - DNA, 16 bp, M. musculus
cataaaagatcacata

SEQ ID NO: 381342 - DNA, 16 bp, M. musculus
cataaaataaagaatt

SEQ ID NO: 381343 - DNA, 16 bp, M. musculus
cataaaataacatttt

SEQ ID NO: 381344 - DNA, 16 bp, M. musculus
cataaaataagtgaat

SEQ ID NO: 381345 - DNA, 16 bp, M. musculus
cataaaatacatttta

SEQ ID NO: 381346 - DNA, 16 bp, M. musculus
cataaaatatattttg

SEQ ID NO: 381347 - DNA, 16 bp, M. musculus
cataaaatgaaaatat

SEQ ID NO: 381348 - DNA, 16 bp, M. musculus
cataaaattgttttgt

SEQ ID NO: 381349 - DNA, 16 bp, M. musculus
cataaaattgtttttg

SEQ ID NO: 381350 - DNA, 16 bp, M. musculus
cataaacacacatgca

SEQ ID NO: 381351 - DNA, 16 bp, M. musculus
cataaacaggctgaga

SEQ ID NO: 381352 - DNA, 16 bp, M. musculus
cataaacataattcca

SEQ ID NO: 381353 - DNA, 16 bp, M. musculus
cataaacatatgcaca

SEQ ID NO: 381354 - DNA, 16 bp, M. musculus
cataaactgggcatgg

SEQ ID NO: 381355 - DNA, 16 bp, M. musculus
cataaagacattggaa

SEQ ID NO: 381356 - DNA, 16 bp, M. musculus
cataaagatttattaa

SEQ ID NO: 381357 - DNA, 16 bp, M. musculus
cataaagccttcacag

SEQ ID NO: 381358 - DNA, 16 bp, M. musculus
cataaagtcactgttt

SEQ ID NO: 381359 - DNA, 16 bp, M. musculus
cataaagttattttct

SEQ ID NO: 381360 - DNA, 21 bp, M. musculus
cataaataatggaaagccaac

SEQ ID NO: 381361 - DNA, 16 bp, M. musculus
cataaatacatataca

SEQ ID NO: 381362 - DNA, 16 bp, M. musculus
cataaatatgtatttt

SEQ ID NO: 381363 - DNA, 16 bp, M. musculus
cataaatgtcctctga

SEQ ID NO: 381364 - DNA, 16 bp, M. musculus
cataaatgtgtgtgtg

SEQ ID NO: 381365 - DNA, 16 bp, M. musculus
cataaattcattcatt

SEQ ID NO: 381366 - DNA, 16 bp, M. musculus
cataaattcattctct

SEQ ID NO: 381367 - DNA, 16 bp, M. musculus
cataaattcatttatt

SEQ ID NO: 381368 - DNA, 16 bp, M. musculus
cataaatttatttttg

SEQ ID NO: 381369 - DNA, 16 bp, M. musculus
cataaatttgaaggag

SEQ ID NO: 381370 - DNA, 16 bp, M. musculus
cataacaacagaaaca

SEQ ID NO: 381371 - DNA, 16 bp, M. musculus
cataacaataatggac

SEQ ID NO: 381372 - DNA, 16 bp, M. musculus
cataacacacacatac

SEQ ID NO: 381373 - DNA, 17 bp, M. musculus
cataacagcagattcct

SEQ ID NO: 381374 - DNA, 16 bp, M. musculus
cataacagtagaaaat

SEQ ID NO: 381375 - DNA, 16 bp, M. musculus
cataaccaaacaggtg

SEQ ID NO: 381376 - DNA, 16 bp, M. musculus
cataaccaaggcaatt

SEQ ID NO: 381377 - DNA, 16 bp, M. musculus
cataaccactatgcct

SEQ ID NO: 381378 - DNA, 16 bp, M. musculus
cataaccagaataagt

SEQ ID NO: 381379 - DNA, 16 bp, M. musculus
cataactattactatt

SEQ ID NO: 381380 - DNA, 16 bp, M. musculus
cataactgccctctga

SEQ ID NO: 381381 - DNA, 16 bp, M. musculus
cataagcacacacaca

SEQ ID NO: 381382 - DNA, 16 bp, M. musculus
cataagcacacacata

SEQ ID NO: 381383 - DNA, 16 bp, M. musculus
cataagccaaaataaa

SEQ ID NO: 381384 - DNA, 16 bp, M. musculus
cataagccaggcatgg

SEQ ID NO: 381385 - DNA, 19 bp, M. musculus
cataagcgaacacatacag

SEQ ID NO: 381386 - DNA, 16 bp, M. musculus
cataagctttgcagtt

SEQ ID NO: 381387 - DNA, 16 bp, M. musculus
cataaggagttccagg

SEQ ID NO: 381388 - DNA, 16 bp, M. musculus
cataagggctcacaga

SEQ ID NO: 381389 - DNA, 16 bp, M. musculus
cataagtacactgtag

SEQ ID NO: 381390 - DNA, 16 bp, M. musculus
cataagtcaaaataaa

SEQ ID NO: 381391 - DNA, 16 bp, M. musculus
cataagtgtgaagaaa

SEQ ID NO: 381392 - DNA, 16 bp, M. musculus
cataagtgtgtgggtt

SEQ ID NO: 381393 - DNA, 16 bp, M. musculus
cataataagttccagg

SEQ ID NO: 381394 - DNA, 16 bp, M. musculus
cataatactcagaaca

SEQ ID NO: 381395 - DNA, 16 bp, M. musculus
cataatcagaacaaca

SEQ ID NO: 381396 - DNA, 16 bp, M. musculus
cataatcaggatatat

SEQ ID NO: 381397 - DNA, 16 bp, M. musculus
cataatcattatttat

SEQ ID NO: 381398 - DNA, 16 bp, M. musculus
cataatcccagcactt

SEQ ID NO: 381399 - DNA, 16 bp, M. musculus
cataatgaattttgca

SEQ ID NO: 381400 - DNA, 16 bp, M. musculus
cataatgagctccagg

SEQ ID NO: 381401 - DNA, 16 bp, M. musculus
cataatgagtttcagg

SEQ ID NO: 381402 - DNA, 16 bp, M. musculus
cataatgcaaaaatgc

SEQ ID NO: 381403 - DNA, 16 bp, M. musculus
cataatgtaaatgttt

SEQ ID NO: 381404 - DNA, 16 bp, M. musculus
cataattaaatgtttt

SEQ ID NO: 381405 - DNA, 16 bp, M. musculus
cataattataattttg

SEQ ID NO: 381406 - DNA, 18 bp, M. musculus
cataattcttgtagaggc

SEQ ID NO: 381407 - DNA, 16 bp, M. musculus
cataatttaaaaagta

SEQ ID NO: 381408 - DNA, 16 bp, M. musculus
cataattttaaaaaga

SEQ ID NO: 381409 - DNA, 16 bp, M. musculus
cataattttcaaaaat

SEQ ID NO: 381410 - DNA, 16 bp, M. musculus
cataatttttaaagaa

SEQ ID NO: 381411 - DNA, 16 bp, M. musculus
catacaaaatattctt

SEQ ID NO: 381412 - DNA, 16 bp, M. musculus
catacaaacaagcaga

SEQ ID NO: 381413 - DNA, 16 bp, M. musculus
catacaaacactcaca

SEQ ID NO: 381414 - DNA, 16 bp, M. musculus
catacaaacagcacca

SEQ ID NO: 381415 - DNA, 16 bp, M. musculus
catacaaagacacaca

SEQ ID NO: 381416 - DNA, 16 bp, M. musculus
catacaaatgtgcaca

SEQ ID NO: 381417 - DNA, 16 bp, M. musculus
catacaagaagccaac

SEQ ID NO: 381418 - DNA, 31 bp, M. musculus
catacaagaagcctacagaactccaaataga

SEQ ID NO: 381419 - DNA, 16 bp, M. musculus
catacaagcacataca

SEQ ID NO: 381420 - DNA, 16 bp, M. musculus
catacaagcatacaca

SEQ ID NO: 381421 - DNA, 16 bp, M. musculus
catacacaaaaatatt

SEQ ID NO: 381422 - DNA, 16 bp, M. musculus
catacacaaatacatg

SEQ ID NO: 381423 - DNA, 16 bp, M. musculus
catacacacacacacg

SEQ ID NO: 381424 - DNA, 16 bp, M. musculus
catacacacacacact

SEQ ID NO: 381425 - DNA, 16 bp, M. musculus
catacacacacacctc

SEQ ID NO: 381426 - DNA, 16 bp, M. musculus
catacacacacagaaa

SEQ ID NO: 381427 - DNA, 16 bp, M. musculus
catacacacacagtgg

SEQ ID NO: 381428 - DNA, 16 bp, M. musculus
catacacacacatacc

SEQ ID NO: 381429 - DNA, 17 bp, M. musculus
catacacacacatatac

SEQ ID NO: 381430 - DNA, 16 bp, M. musculus
catacacacacatgca

SEQ ID NO: 381431 - DNA, 16 bp, M. musculus
catacacacacatgta

SEQ ID NO: 381432 - DNA, 16 bp, M. musculus
catacacacagacact

SEQ ID NO: 381433 - DNA, 16 bp, M. musculus
catacacacagagaga

SEQ ID NO: 381434 - DNA, 16 bp, M. musculus
catacacacatacaca

SEQ ID NO: 381435 - DNA, 16 bp, M. musculus
catacacacatacttt

SEQ ID NO: 381436 - DNA, 16 bp, M. musculus
catacacacatagaca

SEQ ID NO: 381437 - DNA, 16 bp, M. musculus
catacacacatgaaaa

SEQ ID NO: 381438 - DNA, 16 bp, M. musculus
catacacacatgcaca

SEQ ID NO: 381439 - DNA, 16 bp, M. musculus
catacacacatgcagg

SEQ ID NO: 381440 - DNA, 16 bp, M. musculus
catacacacatggaca

SEQ ID NO: 381441 - DNA, 16 bp, M. musculus
catacacactcacaca

SEQ ID NO: 381442 - DNA, 16 bp, M. musculus
catacacaggctggac

SEQ ID NO: 381443 - DNA, 16 bp, M. musculus
catacacataaaagaa

SEQ ID NO: 381444 - DNA, 16 bp, M. musculus
catacacataaacata

SEQ ID NO: 381445 - DNA, 16 bp, M. musculus
catacacataaataca

SEQ ID NO: 381446 - DNA, 16 bp, M. musculus
catacacataacattt

SEQ ID NO: 381447 - DNA, 16 bp, M. musculus
catacacatacacaca

SEQ ID NO: 381448 - DNA, 16 bp, M. musculus
catacacatagaataa

SEQ ID NO: 381449 - DNA, 16 bp, M. musculus
catacacatatacata

SEQ ID NO: 381450 - DNA, 16 bp, M. musculus
catacacatatattca

SEQ ID NO: 381451 - DNA, 16 bp, M. musculus
catacacatatgcaca

SEQ ID NO: 381452 - DNA, 16 bp, M. musculus
catacacatgcacaca

SEQ ID NO: 381453 - DNA, 16 bp, M. musculus
catacacattcacaca

SEQ ID NO: 381454 - DNA, 16 bp, M. musculus
catacaccacacatac

SEQ ID NO: 381455 - DNA, 16 bp, M. musculus
catacacctgctgata

SEQ ID NO: 381456 - DNA, 16 bp, M. musculus
catacacgcacacaca

SEQ ID NO: 381457 - DNA, 16 bp, M. musculus
catacactcactgata

SEQ ID NO: 381458 - DNA, 16 bp, M. musculus
catacactcagacaca

SEQ ID NO: 381459 - DNA, 16 bp, M. musculus
catacagaaacacaaa

SEQ ID NO: 381460 - DNA, 16 bp, M. musculus
catacagaaacacata

SEQ ID NO: 381461 - DNA, 16 bp, M. musculus
catacagactgagcag

SEQ ID NO: 381462 - DNA, 16 bp, M. musculus
catacagagagagagg

SEQ ID NO: 381463 - DNA, 16 bp, M. musculus
catacagcccaggctg

SEQ ID NO: 381464 - DNA, 16 bp, M. musculus
catacaggcaatagct

SEQ ID NO: 381465 - DNA, 16 bp, M. musculus
catacaggtgcacaca

SEQ ID NO: 381466 - DNA, 16 bp, M. musculus
catacataaatacata

SEQ ID NO: 381467 - DNA, 16 bp, M. musculus
catacataagcacaca

SEQ ID NO: 381468 - DNA, 16 bp, M. musculus
catacataattttaaa

SEQ ID NO: 381469 - DNA, 16 bp, M. musculus
catacatacacactca

SEQ ID NO: 381470 - DNA, 16 bp, M. musculus
catacatacacatatt

SEQ ID NO: 381471 - DNA, 16 bp, M. musculus
catacatacagggaaa

SEQ ID NO: 381472 - DNA, 16 bp, M. musculus
catacatacatacatc

SEQ ID NO: 381473 - DNA, 16 bp, M. musculus
catacatacataccag

SEQ ID NO: 381474 - DNA, 17 bp, M. musculus
catacatacatatatac

SEQ ID NO: 381475 - DNA, 16 bp, M. musculus
catacatacatatgca

SEQ ID NO: 381476 - DNA, 16 bp, M. musculus
catacatacatgcaaa

SEQ ID NO: 381477 - DNA, 17 bp, M. musculus
catacatacatgcatat

SEQ ID NO: 381478 - DNA, 16 bp, M. musculus
catacataccatacat

SEQ ID NO: 381479 - DNA, 16 bp, M. musculus
catacatatacacaca

SEQ ID NO: 381480 - DNA, 16 bp, M. musculus
catacatatataatac

SEQ ID NO: 381481 - DNA, 18 bp, M. musculus
catacatatatatataca

SEQ ID NO: 381482 - DNA, 19 bp, M. musculus
catacatatatatgtatac

SEQ ID NO: 381483 - DNA, 16 bp, M. musculus
catacatatgtacata

SEQ ID NO: 381484 - DNA, 16 bp, M. musculus
catacatatgtattca

SEQ ID NO: 381485 - DNA, 16 bp, M. musculus
catacatgaaggcaaa

SEQ ID NO: 381486 - DNA, 16 bp, M. musculus
catacatgcagggaaa

SEQ ID NO: 381487 - DNA, 16 bp, M. musculus
catacatgcatacatg

SEQ ID NO: 381488 - DNA, 16 bp, M. musculus
catacatgtacataca

SEQ ID NO: 381489 - DNA, 16 bp, M. musculus
catacatgtcatttta

SEQ ID NO: 381490 - DNA, 16 bp, M. musculus
catacatgtgaaataa

SEQ ID NO: 381491 - DNA, 16 bp, M. musculus
catacatgtgcacaga

SEQ ID NO: 381492 - DNA, 16 bp, M. musculus
catacatgtgtgtgaa

SEQ ID NO: 381493 - DNA, 16 bp, M. musculus
catacattatattttg

SEQ ID NO: 381494 - DNA, 16 bp, M. musculus
catacatttttataaa

SEQ ID NO: 381495 - DNA, 16 bp, M. musculus
cataccaaagtggacc

SEQ ID NO: 381496 - DNA, 16 bp, M. musculus
cataccacacacatac

SEQ ID NO: 381497 - DNA, 16 bp, M. musculus
cataccaggaagtgaa

SEQ ID NO: 381498 - DNA, 16 bp, M. musculus
cataccataatcagct

SEQ ID NO: 381499 - DNA, 16 bp, M. musculus
cataccatctgcaaat

SEQ ID NO: 381500 - DNA, 16 bp, M. musculus
catacccaaacttgtg

SEQ ID NO: 381501 - DNA, 16 bp, M. musculus
catacccaataactta

SEQ ID NO: 381502 - DNA, 16 bp, M. musculus
catacccacatacaca

SEQ ID NO: 381503 - DNA, 16 bp, M. musculus
catacccatacccata

SEQ ID NO: 381504 - DNA, 16 bp, M. musculus
catacccatgcacata

SEQ ID NO: 381505 - DNA, 16 bp, M. musculus
catacccatggaaact

SEQ ID NO: 381506 - DNA, 16 bp, M. musculus
catacctacacacaca

SEQ ID NO: 381507 - DNA, 16 bp, M. musculus
catacctcctaatagt

SEQ ID NO: 381508 - DNA, 16 bp, M. musculus
catacctcctgcccac

SEQ ID NO: 381509 - DNA, 16 bp, M. musculus
catacctgtgtgcaca

SEQ ID NO: 381510 - DNA, 16 bp, M. musculus
catacctttgatccta

SEQ ID NO: 381511 - DNA, 16 bp, M. musculus
catacgcacacgcaca

SEQ ID NO: 381512 - DNA, 16 bp, M. musculus
catactacacacacac

SEQ ID NO: 381513 - DNA, 16 bp, M. musculus
catactatatatatat

SEQ ID NO: 381514 - DNA, 16 bp, M. musculus
catactcagacacaaa

SEQ ID NO: 381515 - DNA, 16 bp, M. musculus
catactcatataaata

SEQ ID NO: 381516 - DNA, 16 bp, M. musculus
catactgatgttcctc

SEQ ID NO: 381517 - DNA, 16 bp, M. musculus
catactgttcttgcag

SEQ ID NO: 381518 - DNA, 16 bp, M. musculus
catacttactagaaga

SEQ ID NO: 381519 - DNA, 16 bp, M. musculus
catacttatcaaaggt

SEQ ID NO: 381520 - DNA, 16 bp, M. musculus
catagaaaaataaatt

SEQ ID NO: 381521 - DNA, 16 bp, M. musculus
catagaaagatccaac

SEQ ID NO: 381522 - DNA, 16 bp, M. musculus
catagaaataacaata

SEQ ID NO: 381523 - DNA, 16 bp, M. musculus
catagaagaaatggtt

SEQ ID NO: 381524 - DNA, 16 bp, M. musculus
catagaagagcatgtg

SEQ ID NO: 381525 - DNA, 16 bp, M. musculus
catagaagggtgctgc

SEQ ID NO: 381526 - DNA, 16 bp, M. musculus
catagaatacccaaga

SEQ ID NO: 381527 - DNA, 16 bp, M. musculus
catagaatatattttg

SEQ ID NO: 381528 - DNA, 16 bp, M. musculus
catagacaaagttaga

SEQ ID NO: 381529 - DNA, 16 bp, M. musculus
catagacacagaaaca

SEQ ID NO: 381530 - DNA, 16 bp, M. musculus
catagacacagacaca

SEQ ID NO: 381531 - DNA, 16 bp, M. musculus
catagacataaaataa

SEQ ID NO: 381532 - DNA, 16 bp, M. musculus
catagacatacaggca

SEQ ID NO: 381533 - DNA, 16 bp, M. musculus
catagacccaagtgat

SEQ ID NO: 381534 - DNA, 16 bp, M. musculus
catagactcataggga

SEQ ID NO: 381535 - DNA, 16 bp, M. musculus
catagagaaagaagct

SEQ ID NO: 381536 - DNA, 16 bp, M. musculus
catagagaacatggaa

SEQ ID NO: 381537 - DNA, 16 bp, M. musculus
catagagacagacaca

SEQ ID NO: 381538 - DNA, 16 bp, M. musculus
catagagagttccaag

SEQ ID NO: 381539 - DNA, 16 bp, M. musculus
catagagagttccaga

SEQ ID NO: 381540 - DNA, 16 bp, M. musculus
catagagggactcatg

SEQ ID NO: 381541 - DNA, 16 bp, M. musculus
catagatacaagcatc

SEQ ID NO: 381542 - DNA, 16 bp, M. musculus
catagatacatacatg

SEQ ID NO: 381543 - DNA, 16 bp, M. musculus
catagatattctgaat

SEQ ID NO: 381544 - DNA, 16 bp, M. musculus
catagatgaataaata

SEQ ID NO: 381545 - DNA, 16 bp, M. musculus
catagcaaaaccctgt

SEQ ID NO: 381546 - DNA, 16 bp, M. musculus
catagcaaaattacag

SEQ ID NO: 381547 - DNA, 16 bp, M. musculus
catagcaaattcaagg

SEQ ID NO: 381548 - DNA, 16 bp, M. musculus
catagcaagttcctgg

SEQ ID NO: 381549 - DNA, 16 bp, M. musculus
catagcaagttctaga

SEQ ID NO: 381550 - DNA, 16 bp, M. musculus
catagcaagtttgaga

SEQ ID NO: 381551 - DNA, 16 bp, M. musculus
catagcactccagagg

SEQ ID NO: 381552 - DNA, 16 bp, M. musculus
catagccctgactgtc

SEQ ID NO: 381553 - DNA, 16 bp, M. musculus
catagcctctgcttca

SEQ ID NO: 381554 - DNA, 16 bp, M. musculus
catagccttggctgtc

SEQ ID NO: 381555 - DNA, 16 bp, M. musculus
catagctctggctgtc

SEQ ID NO: 381556 - DNA, 16 bp, M. musculus
catagctgcttccttc

SEQ ID NO: 381557 - DNA, 16 bp, M. musculus
catagctgcttctggg

SEQ ID NO: 381558 - DNA, 16 bp, M. musculus
catagcttctggaaca

SEQ ID NO: 381559 - DNA, 16 bp, M. musculus
catagcttctgttagt

SEQ ID NO: 381560 - DNA, 16 bp, M. musculus
catagcttcttggaca

SEQ ID NO: 381561 - DNA, 16 bp, M. musculus
cataggaacacacaca

SEQ ID NO: 381562 - DNA, 16 bp, M. musculus
cataggaagaacagca

SEQ ID NO: 381563 - DNA, 16 bp, M. musculus
cataggcacagacaca

SEQ ID NO: 381564 - DNA, 16 bp, M. musculus
cataggcacaggcaca

SEQ ID NO: 381565 - DNA, 16 bp, M. musculus
cataggcatacatgca

SEQ ID NO: 381566 - DNA, 21 bp, M. musculus
catagggacacacgactaagc

SEQ ID NO: 381567 - DNA, 16 bp, M. musculus
catagggagggacctt

SEQ ID NO: 381568 - DNA, 16 bp, M. musculus
cataggggctggagag

SEQ ID NO: 381569 - DNA, 16 bp, M. musculus
cataggggtcacatat

SEQ ID NO: 381570 - DNA, 16 bp, M. musculus
cataggggtccctgac

SEQ ID NO: 381571 - DNA, 16 bp, M. musculus
catagtatgtattcac

SEQ ID NO: 381572 - DNA, 16 bp, M. musculus
catagtgaaaccctgt

SEQ ID NO: 381573 - DNA, 16 bp, M. musculus
catagtgaattctaag

SEQ ID NO: 381574 - DNA, 16 bp, M. musculus
catagtgagacactgt

SEQ ID NO: 381575 - DNA, 16 bp, M. musculus
catagtgagactgtct

SEQ ID NO: 381576 - DNA, 16 bp, M. musculus
catagtgaggccctgt

SEQ ID NO: 381577 - DNA, 16 bp, M. musculus
catagtgagttcaaag

SEQ ID NO: 381578 - DNA, 16 bp, M. musculus
catagtgagttccaag

SEQ ID NO: 381579 - DNA, 16 bp, M. musculus
catagtgagttcctgg

SEQ ID NO: 381580 - DNA, 16 bp, M. musculus
catagtgagttctaga

SEQ ID NO: 381581 - DNA, 16 bp, M. musculus
catagtgagttctagg

SEQ ID NO: 381582 - DNA, 16 bp, M. musculus
catagtgcagctgcct

SEQ ID NO: 381583 - DNA, 16 bp, M. musculus
catagtggggcatgtg

SEQ ID NO: 381584 - DNA, 16 bp, M. musculus
catagtggtacatacc

SEQ ID NO: 381585 - DNA, 18 bp, M. musculus
catagtgttgtatacctg

SEQ ID NO: 381586 - DNA, 16 bp, M. musculus
catagttcatcactga

SEQ ID NO: 381587 - DNA, 16 bp, M. musculus
catagttttaattttt

SEQ ID NO: 381588 - DNA, 16 bp, M. musculus
catataaaaacttgcc

SEQ ID NO: 381589 - DNA, 16 bp, M. musculus
catataaaacatattt

SEQ ID NO: 381590 - DNA, 16 bp, M. musculus
catataaacatacaca

SEQ ID NO: 381591 - DNA, 18 bp, M. musculus
catataaagtttgcaaga

SEQ ID NO: 381592 - DNA, 16 bp, M. musculus
catataaatacacata

SEQ ID NO: 381593 - DNA, 16 bp, M. musculus
catataaatacataca

SEQ ID NO: 381594 - DNA, 16 bp, M. musculus
catataaatacatgca

SEQ ID NO: 381595 - DNA, 16 bp, M. musculus
catataaatgtgtgtg

SEQ ID NO: 381596 - DNA, 16 bp, M. musculus
catataatatatatac

SEQ ID NO: 381597 - DNA, 16 bp, M. musculus
catataattggccaca

SEQ ID NO: 381598 - DNA, 16 bp, M. musculus
catatacaaaaatact

SEQ ID NO: 381599 - DNA, 16 bp, M. musculus
catatacaaaccatca

SEQ ID NO: 381600 - DNA, 16 bp, M. musculus
catatacacaaaacat

SEQ ID NO: 381601 - DNA, 16 bp, M. musculus
catatacacacacaga

SEQ ID NO: 381602 - DNA, 16 bp, M. musculus
catatacacacacagt

SEQ ID NO: 381603 - DNA, 16 bp, M. musculus
catatacacacactgc

SEQ ID NO: 381604 - DNA, 16 bp, M. musculus
catatacacatatcta

SEQ ID NO: 381605 - DNA, 16 bp, M. musculus
catatacagaaacaca

SEQ ID NO: 381606 - DNA, 16 bp, M. musculus
catatacagacacata

SEQ ID NO: 381607 - DNA, 17 bp, M. musculus
catatacagtttgcatg

SEQ ID NO: 381608 - DNA, 16 bp, M. musculus
catatacatccacata

SEQ ID NO: 381609 - DNA, 16 bp, M. musculus
catatacatgcacaca

SEQ ID NO: 381610 - DNA, 16 bp, M. musculus
catatacatggatgat

SEQ ID NO: 381611 - DNA, 16 bp, M. musculus
catatacatttattta

SEQ ID NO: 381612 - DNA, 17 bp, M. musculus
catataccaaaatccac

SEQ ID NO: 381613 - DNA, 16 bp, M. musculus
catatacccaaaagat

SEQ ID NO: 381614 - DNA, 16 bp, M. musculus
catatacccagaaaat

SEQ ID NO: 381615 - DNA, 16 bp, M. musculus
catatacccagaatat

SEQ ID NO: 381616 - DNA, 16 bp, M. musculus
catatactttttaaaa

SEQ ID NO: 381617 - DNA, 16 bp, M. musculus
catatagacacacaga

SEQ ID NO: 381618 - DNA, 16 bp, M. musculus
catatataaaacacat

SEQ ID NO: 381619 - DNA, 16 bp, M. musculus
catatataaaattctc

SEQ ID NO: 381620 - DNA, 16 bp, M. musculus
catatataacagaaga

SEQ ID NO: 381621 - DNA, 16 bp, M. musculus
catatataatgtatat

SEQ ID NO: 381622 - DNA, 16 bp, M. musculus
catatatacatacatg

SEQ ID NO: 381623 - DNA, 16 bp, M. musculus
catatatacatatatc

SEQ ID NO: 381624 - DNA, 16 bp, M. musculus
catatatagccaccaa

SEQ ID NO: 381625 - DNA, 16 bp, M. musculus
catatatataatatgt

SEQ ID NO: 381626 - DNA, 18 bp, M. musculus
catatatatacatatgta

SEQ ID NO: 381627 - DNA, 18 bp, M. musculus
catatatatatacacaca

SEQ ID NO: 381628 - DNA, 22 bp, M. musculus
catatatatatacacacacaca

SEQ ID NO: 381629 - DNA, 16 bp, M. musculus
catatatatatacata

SEQ ID NO: 381630 - DNA, 16 bp, M. musculus
catatatatatatcaa

SEQ ID NO: 381631 - DNA, 16 bp, M. musculus
catatatatatatgta

SEQ ID NO: 381632 - DNA, 16 bp, M. musculus
catatatatatgatat

SEQ ID NO: 381633 - DNA, 16 bp, M. musculus
catatatatatgcata

SEQ ID NO: 381634 - DNA, 16 bp, M. musculus
catatatatatgtatg

SEQ ID NO: 381635 - DNA, 16 bp, M. musculus
catatatatgatttta

SEQ ID NO: 381636 - DNA, 16 bp, M. musculus
catatatatgcacata

SEQ ID NO: 381637 - DNA, 16 bp, M. musculus
catatatatgcatatg

SEQ ID NO: 381638 - DNA, 16 bp, M. musculus
catatatatgtatata

SEQ ID NO: 381639 - DNA, 16 bp, M. musculus
catatatatttcaaat

SEQ ID NO: 381640 - DNA, 16 bp, M. musculus
catatatccagaatat

SEQ ID NO: 381641 - DNA, 16 bp, M. musculus
catatatgaaataaaa

SEQ ID NO: 381642 - DNA, 16 bp, M. musculus
catatatgaatataca

SEQ ID NO: 381643 - DNA, 16 bp, M. musculus
catatatgcaaacaca

SEQ ID NO: 381644 - DNA, 16 bp, M. musculus
catatatgcacataca

SEQ ID NO: 381645 - DNA, 16 bp, M. musculus
catatatgcagacaaa

SEQ ID NO: 381646 - DNA, 16 bp, M. musculus
catatatgcaggtaaa

SEQ ID NO: 381647 - DNA, 16 bp, M. musculus
catatatgtatataca

SEQ ID NO: 381648 - DNA, 16 bp, M. musculus
catatatgtgcatata

SEQ ID NO: 381649 - DNA, 17 bp, M. musculus
catatatgtgtatatac

SEQ ID NO: 381650 - DNA, 16 bp, M. musculus
catatatgtgtgcata

SEQ ID NO: 381651 - DNA, 16 bp, M. musculus
catatattgtcccata

SEQ ID NO: 381652 - DNA, 16 bp, M. musculus
catatatttatgtata

SEQ ID NO: 381653 - DNA, 16 bp, M. musculus
catatatttgtatatg

SEQ ID NO: 381654 - DNA, 16 bp, M. musculus
catatattttcaagga

SEQ ID NO: 381655 - DNA, 16 bp, M. musculus
catatcaaaattagct

SEQ ID NO: 381656 - DNA, 16 bp, M. musculus
catatcagatatcctg

SEQ ID NO: 381657 - DNA, 16 bp, M. musculus
catatcaggaaactga

SEQ ID NO: 381658 - DNA, 16 bp, M. musculus
catatccagagaaaat

SEQ ID NO: 381659 - DNA, 16 bp, M. musculus
catatcccacacctgg

SEQ ID NO: 381660 - DNA, 16 bp, M. musculus
catatcccacagacag

SEQ ID NO: 381661 - DNA, 16 bp, M. musculus
catatcctaatcaatt

SEQ ID NO: 381662 - DNA, 16 bp, M. musculus
catatctaaacagaga

SEQ ID NO: 381663 - DNA, 16 bp, M. musculus
catatctctgtgtgtg

SEQ ID NO: 381664 - DNA, 16 bp, M. musculus
catatctgggactcag

SEQ ID NO: 381665 - DNA, 16 bp, M. musculus
catatgaactcacaca

SEQ ID NO: 381666 - DNA, 16 bp, M. musculus
catatgaatcagaaga

SEQ ID NO: 381667 - DNA, 16 bp, M. musculus
catatgaatgtaacca

SEQ ID NO: 381668 - DNA, 16 bp, M. musculus
catatgaatttgcaaa

SEQ ID NO: 381669 - DNA, 16 bp, M. musculus
catatgaggctggagc

SEQ ID NO: 381670 - DNA, 16 bp, M. musculus
catatgatctttgcaa

SEQ ID NO: 381671 - DNA, 16 bp, M. musculus
catatgcaactagaaa

SEQ ID NO: 381672 - DNA, 16 bp, M. musculus
catatgcaagtgtctg

SEQ ID NO: 381673 - DNA, 16 bp, M. musculus
catatgcacaaataaa

SEQ ID NO: 381674 - DNA, 16 bp, M. musculus
catatgcacacaccca

SEQ ID NO: 381675 - DNA, 16 bp, M. musculus
catatgcacacactca

SEQ ID NO: 381676 - DNA, 16 bp, M. musculus
catatgcacacataaa

SEQ ID NO: 381677 - DNA, 16 bp, M. musculus
catatgcacaggcaca

SEQ ID NO: 381678 - DNA, 16 bp, M. musculus
catatgcatacatgca

SEQ ID NO: 381679 - DNA, 16 bp, M. musculus
catatgcatatatata

SEQ ID NO: 381680 - DNA, 16 bp, M. musculus
catatgctcacacaca

SEQ ID NO: 381681 - DNA, 16 bp, M. musculus
catatggaaacctatt

SEQ ID NO: 381682 - DNA, 16 bp, M. musculus
catatggaattatttt

SEQ ID NO: 381683 - DNA, 16 bp, M. musculus
catatggagatcagag

SEQ ID NO: 381684 - DNA, 16 bp, M. musculus
catatggaggacagag

SEQ ID NO: 381685 - DNA, 16 bp, M. musculus
catatggaggctcaca

SEQ ID NO: 381686 - DNA, 16 bp, M. musculus
catatggcagctcaca

SEQ ID NO: 381687 - DNA, 16 bp, M. musculus
catatggcggctcaca

SEQ ID NO: 381688 - DNA, 16 bp, M. musculus
catatggctgctggga

SEQ ID NO: 381689 - DNA, 16 bp, M. musculus
catatggttgctggga

SEQ ID NO: 381690 - DNA, 16 bp, M. musculus
catatgtaacagatgt

SEQ ID NO: 381691 - DNA, 16 bp, M. musculus
catatgtacacacaaa

SEQ ID NO: 381692 - DNA, 16 bp, M. musculus
catatgtacatacata

SEQ ID NO: 381693 - DNA, 16 bp, M. musculus
catatgtataaaataa

SEQ ID NO: 381694 - DNA, 16 bp, M. musculus
catatgtatatgtata

SEQ ID NO: 381695 - DNA, 16 bp, M. musculus
catatgtatgtatgta

SEQ ID NO: 381696 - DNA, 16 bp, M. musculus
catatgtatgtgtgca

SEQ ID NO: 381697 - DNA, 16 bp, M. musculus
catatgtatgtttatg

SEQ ID NO: 381698 - DNA, 16 bp, M. musculus
catatgtgcaggtaaa

SEQ ID NO: 381699 - DNA, 16 bp, M. musculus
catatgtgcatgtata

SEQ ID NO: 381700 - DNA, 16 bp, M. musculus
catatgtgtatgcata

SEQ ID NO: 381701 - DNA, 16 bp, M. musculus
catatgtgtgtctatg

SEQ ID NO: 381702 - DNA, 16 bp, M. musculus
catatgtgtgtgtata

SEQ ID NO: 381703 - DNA, 16 bp, M. musculus
catatgtgtgtgtgtg

SEQ ID NO: 381704 - DNA, 16 bp, M. musculus
catatgtgtgtgtttg

SEQ ID NO: 381705 - DNA, 16 bp, M. musculus
catatgtgttctctta

SEQ ID NO: 381706 - DNA, 16 bp, M. musculus
catattagaactaaaa

SEQ ID NO: 381707 - DNA, 16 bp, M. musculus
catattcaaaccacag

SEQ ID NO: 381708 - DNA, 16 bp, M. musculus
catattcaaaccacca

SEQ ID NO: 381709 - DNA, 16 bp, M. musculus
catattcaaagcacca

SEQ ID NO: 381710 - DNA, 16 bp, M. musculus
catattcatgcacaca

SEQ ID NO: 381711 - DNA, 16 bp, M. musculus
catattctttcccttc

SEQ ID NO: 381712 - DNA, 16 bp, M. musculus
catattctttctcctc

SEQ ID NO: 381713 - DNA, 16 bp, M. musculus
catattgtttttatta

SEQ ID NO: 381714 - DNA, 16 bp, M. musculus
catatttacatatgca

SEQ ID NO: 381715 - DNA, 16 bp, M. musculus
catatttatatgtgtg

SEQ ID NO: 381716 - DNA, 16 bp, M. musculus
catatttatcaaaaga

SEQ ID NO: 381717 - DNA, 16 bp, M. musculus
catatttattatatgt

SEQ ID NO: 381718 - DNA, 16 bp, M. musculus
catatttcctgactcc

SEQ ID NO: 381719 - DNA, 16 bp, M. musculus
catatttgaaaataaa

SEQ ID NO: 381720 - DNA, 16 bp, M. musculus
catatttgctcctgtg

SEQ ID NO: 381721 - DNA, 16 bp, M. musculus
catatttgttgttgtt

SEQ ID NO: 381722 - DNA, 16 bp, M. musculus
catattttaaatgttt

SEQ ID NO: 381723 - DNA, 16 bp, M. musculus
catattttatatatca

SEQ ID NO: 381724 - DNA, 16 bp, M. musculus
catattttatgtattt

SEQ ID NO: 381725 - DNA, 16 bp, M. musculus
catattttattaatac

SEQ ID NO: 381726 - DNA, 16 bp, M. musculus
catcaaaaagacaagg

SEQ ID NO: 381727 - DNA, 16 bp, M. musculus
catcaaaaccatcatc

SEQ ID NO: 381728 - DNA, 16 bp, M. musculus
catcaaaactatcatc

SEQ ID NO: 381729 - DNA, 16 bp, M. musculus
catcaaaatacattgt

SEQ ID NO: 381730 - DNA, 16 bp, M. musculus
catcaaacatggagaa

SEQ ID NO: 381731 - DNA, 16 bp, M. musculus
catcaaacgcagacac

SEQ ID NO: 381732 - DNA, 16 bp, M. musculus
catcaaactcacagag

SEQ ID NO: 381733 - DNA, 16 bp, M. musculus
catcaaaggtggcctt

SEQ ID NO: 381734 - DNA, 16 bp, M. musculus
catcaaatctctctcc

SEQ ID NO: 381735 - DNA, 16 bp, M. musculus
catcaacccagccaca

SEQ ID NO: 381736 - DNA, 16 bp, M. musculus
catcaactcctgcctc

SEQ ID NO: 381737 - DNA, 16 bp, M. musculus
catcaagaaaatcaag

SEQ ID NO: 381738 - DNA, 16 bp, M. musculus
catcaagaaggacatt

SEQ ID NO: 381739 - DNA, 16 bp, M. musculus
catcaagacggacttt

SEQ ID NO: 381740 - DNA, 16 bp, M. musculus
catcaagcctgacaac

SEQ ID NO: 381741 - DNA, 16 bp, M. musculus
catcaaggaaatgaaa

SEQ ID NO: 381742 - DNA, 16 bp, M. musculus
catcaaggaaggagca

SEQ ID NO: 381743 - DNA, 16 bp, M. musculus
catcaaggaagtcagg

SEQ ID NO: 381744 - DNA, 16 bp, M. musculus
catcaaggaattcact

SEQ ID NO: 381745 - DNA, 16 bp, M. musculus
catcaaggcctgccat

SEQ ID NO: 381746 - DNA, 16 bp, M. musculus
catcaagtggaaagat

SEQ ID NO: 381747 - DNA, 16 bp, M. musculus
catcaatacctctcct

SEQ ID NO: 381748 - DNA, 16 bp, M. musculus
catcaatgagagaaga

SEQ ID NO: 381749 - DNA, 16 bp, M. musculus
catcaatggacagatg

SEQ ID NO: 381750 - DNA, 16 bp, M. musculus
catcaatggacccaat

SEQ ID NO: 381751 - DNA, 16 bp, M. musculus
catcaatgggaggaga

SEQ ID NO: 381752 - DNA, 16 bp, M. musculus
catcaatggtaggaga

SEQ ID NO: 381753 - DNA, 16 bp, M. musculus
catcacaaacatgaca

SEQ ID NO: 381754 - DNA, 16 bp, M. musculus
catcacaccaaaaaag

SEQ ID NO: 381755 - DNA, 16 bp, M. musculus
catcacagaagagaag

SEQ ID NO: 381756 - DNA, 16 bp, M. musculus
catcacagagggaagt

SEQ ID NO: 381757 - DNA, 16 bp, M. musculus
catcacagcaatagca

SEQ ID NO: 381758 - DNA, 17 bp, M. musculus
catcacagtacatttca

SEQ ID NO: 381759 - DNA, 16 bp, M. musculus
catcacatccacagtc

SEQ ID NO: 381760 - DNA, 16 bp, M. musculus
catcaccacctccatc

SEQ ID NO: 381761 - DNA, 16 bp, M. musculus
catcaccactaccatc

SEQ ID NO: 381762 - DNA, 16 bp, M. musculus
catcaccagctttctg

SEQ ID NO: 381763 - DNA, 16 bp, M. musculus
catcaccatcctcatc

SEQ ID NO: 381764 - DNA, 16 bp, M. musculus
catcaccatcttccag

SEQ ID NO: 381765 - DNA, 16 bp, M. musculus
catcaccatggcaaca

SEQ ID NO: 381766 - DNA, 16 bp, M. musculus
catcaccatgtctgcc

SEQ ID NO: 381767 - DNA, 16 bp, M. musculus
catcacccaccagagg

SEQ ID NO: 381768 - DNA, 16 bp, M. musculus
catcacccatgctggg

SEQ ID NO: 381769 - DNA, 16 bp, M. musculus
catcaccccactctca

SEQ ID NO: 381770 - DNA, 16 bp, M. musculus
catcacctcctgcctc

SEQ ID NO: 381771 - DNA, 16 bp, M. musculus
catcacctctttctaa

SEQ ID NO: 381772 - DNA, 16 bp, M. musculus
catcacctgcagctgg

SEQ ID NO: 381773 - DNA, 16 bp, M. musculus
catcaccttcatcatc

SEQ ID NO: 381774 - DNA, 16 bp, M. musculus
catcactaaaagaagt

SEQ ID NO: 381775 - DNA, 16 bp, M. musculus
catcactaacatctca

SEQ ID NO: 381776 - DNA, 16 bp, M. musculus
catcactcacaatggg

SEQ ID NO: 381777 - DNA, 16 bp, M. musculus
catcactccagcccct

SEQ ID NO: 381778 - DNA, 16 bp, M. musculus
catcactctgccagtc

SEQ ID NO: 381779 - DNA, 16 bp, M. musculus
catcactgaagaaagt

SEQ ID NO: 381780 - DNA, 16 bp, M. musculus
catcactgcaaataga

SEQ ID NO: 381781 - DNA, 16 bp, M. musculus
catcactgccaccacc

SEQ ID NO: 381782 - DNA, 16 bp, M. musculus
catcactgcccagcaa

SEQ ID NO: 381783 - DNA, 16 bp, M. musculus
catcactgcctggcct

SEQ ID NO: 381784 - DNA, 16 bp, M. musculus
catcactgtaattctt

SEQ ID NO: 381785 - DNA, 16 bp, M. musculus
catcagaaaacacata

SEQ ID NO: 381786 - DNA, 16 bp, M. musculus
catcagaaaacagaga

SEQ ID NO: 381787 - DNA, 16 bp, M. musculus
catcagaaaattcata

SEQ ID NO: 381788 - DNA, 16 bp, M. musculus
catcagaaaccagcac

SEQ ID NO: 381789 - DNA, 16 bp, M. musculus
catcagaagttttttg

SEQ ID NO: 381790 - DNA, 16 bp, M. musculus
catcagagaaatgcaa

SEQ ID NO: 381791 - DNA, 16 bp, M. musculus
catcagagaagtttcc

SEQ ID NO: 381792 - DNA, 16 bp, M. musculus
catcagagaattcata

SEQ ID NO: 381793 - DNA, 16 bp, M. musculus
catcagagacctgaaa

SEQ ID NO: 381794 - DNA, 16 bp, M. musculus
catcagagacctgaga

SEQ ID NO: 381795 - DNA, 16 bp, M. musculus
catcagagagaaagga

SEQ ID NO: 381796 - DNA, 16 bp, M. musculus
catcagagggaaaaga

SEQ ID NO: 381797 - DNA, 17 bp, M. musculus
catcagatcccctggag

SEQ ID NO: 381798 - DNA, 16 bp, M. musculus
catcagatccctggag

SEQ ID NO: 381799 - DNA, 16 bp, M. musculus
catcagatcttattaa

SEQ ID NO: 381800 - DNA, 16 bp, M. musculus
catcagatcttctgga

SEQ ID NO: 381801 - DNA, 16 bp, M. musculus
catcagatgccctgaa

SEQ ID NO: 381802 - DNA, 16 bp, M. musculus
catcagatgctgaaaa

SEQ ID NO: 381803 - DNA, 46 bp, M. musculus
catcagattacttttgtggtaaatggacatgtgaaacgacagggga

SEQ ID NO: 381804 - DNA, 16 bp, M. musculus
catcagatttttgtta

SEQ ID NO: 381805 - DNA, 16 bp, M. musculus
catcagcaacagaaaa

SEQ ID NO: 381806 - DNA, 16 bp, M. musculus
catcagcaagcacttc

SEQ ID NO: 381807 - DNA, 16 bp, M. musculus
catcagcaatagtgcc

SEQ ID NO: 381808 - DNA, 16 bp, M. musculus
catcagcaattgtgtc

SEQ ID NO: 381809 - DNA, 16 bp, M. musculus
catcagcaccatcacc

SEQ ID NO: 381810 - DNA, 16 bp, M. musculus
catcagcagacctggg

SEQ ID NO: 381811 - DNA, 16 bp, M. musculus
catcagcagcagcagc

SEQ ID NO: 381812 - DNA, 16 bp, M. musculus
catcagcatcactgtg

SEQ ID NO: 381813 - DNA, 16 bp, M. musculus
catcagcatcatcatc

SEQ ID NO: 381814 - DNA, 16 bp, M. musculus
catcagcccaccctat

SEQ ID NO: 381815 - DNA, 16 bp, M. musculus
catcagcccagtccac

SEQ ID NO: 381816 - DNA, 16 bp, M. musculus
catcagcccctgcctc

SEQ ID NO: 381817 - DNA, 16 bp, M. musculus
catcagctccagcctc

SEQ ID NO: 381818 - DNA, 16 bp, M. musculus
catcagctcctgattt

SEQ ID NO: 381819 - DNA, 16 bp, M. musculus
catcagctcctgcctc

SEQ ID NO: 381820 - DNA, 16 bp, M. musculus
catcagctcctgcttg

SEQ ID NO: 381821 - DNA, 16 bp, M. musculus
catcagctcctgcttt

SEQ ID NO: 381822 - DNA, 16 bp, M. musculus
catcagctgatggaca

SEQ ID NO: 381823 - DNA, 16 bp, M. musculus
catcagctgcagacat

SEQ ID NO: 381824 - DNA, 16 bp, M. musculus
catcagctgctgggtg

SEQ ID NO: 381825 - DNA, 16 bp, M. musculus
catcaggacacaggaa

SEQ ID NO: 381826 - DNA, 16 bp, M. musculus
catcaggcagctcaca

SEQ ID NO: 381827 - DNA, 16 bp, M. musculus
catcaggccattacag

SEQ ID NO: 381828 - DNA, 16 bp, M. musculus
catcaggccctgtgta

SEQ ID NO: 381829 - DNA, 16 bp, M. musculus
catcaggctcctgtca

SEQ ID NO: 381830 - DNA, 16 bp, M. musculus
catcaggcttggtgac

SEQ ID NO: 381831 - DNA, 17 bp, M. musculus
catcagggaaatgcaaa

SEQ ID NO: 381832 - DNA, 16 bp, M. musculus
catcagggaaatggaa

SEQ ID NO: 381833 - DNA, 16 bp, M. musculus
catcagggaatgcaaa

SEQ ID NO: 381834 - DNA, 16 bp, M. musculus
catcagggctggagag

SEQ ID NO: 381835 - DNA, 16 bp, M. musculus
catcagtaaaaatcaa

SEQ ID NO: 381836 - DNA, 16 bp, M. musculus
catcagtaacaagatc

SEQ ID NO: 381837 - DNA, 16 bp, M. musculus
catcagtaattattct

SEQ ID NO: 381838 - DNA, 16 bp, M. musculus
catcagtcttcagcct

SEQ ID NO: 381839 - DNA, 16 bp, M. musculus
catcagtgcacacaca

SEQ ID NO: 381840 - DNA, 16 bp, M. musculus
catcagtgggaagaga

SEQ ID NO: 381841 - DNA, 16 bp, M. musculus
catcagtgtgtgtgtg

SEQ ID NO: 381842 - DNA, 16 bp, M. musculus
catcataaccaaggca

SEQ ID NO: 381843 - DNA, 16 bp, M. musculus
catcatatacataaaa

SEQ ID NO: 381844 - DNA, 16 bp, M. musculus
catcatatatatacat

SEQ ID NO: 381845 - DNA, 16 bp, M. musculus
catcatcaacatcatc

SEQ ID NO: 381846 - DNA, 16 bp, M. musculus
catcatcaccagcatc

SEQ ID NO: 381847 - DNA, 16 bp, M. musculus
catcatcaccatcgtc

SEQ ID NO: 381848 - DNA, 16 bp, M. musculus
catcatcagaaaagct

SEQ ID NO: 381849 - DNA, 16 bp, M. musculus
catcatcagaaaggct

SEQ ID NO: 381850 - DNA, 16 bp, M. musculus
catcatcagaacccag

SEQ ID NO: 381851 - DNA, 16 bp, M. musculus
catcatcagcatcagc

SEQ ID NO: 381852 - DNA, 16 bp, M. musculus
catcatcagcatcatc

SEQ ID NO: 381853 - DNA, 16 bp, M. musculus
catcatcatcaacatc

SEQ ID NO: 381854 - DNA, 16 bp, M. musculus
catcatcatcaaggtg

SEQ ID NO: 381855 - DNA, 16 bp, M. musculus
catcatcatcaatcat

SEQ ID NO: 381856 - DNA, 16 bp, M. musculus
catcatcatcatcccc

SEQ ID NO: 381857 - DNA, 16 bp, M. musculus
catcatcatcatcgcc

SEQ ID NO: 381858 - DNA, 16 bp, M. musculus
catcatcattattatt

SEQ ID NO: 381859 - DNA, 16 bp, M. musculus
catcatcattgttatt

SEQ ID NO: 381860 - DNA, 16 bp, M. musculus
catcatccatccatct

SEQ ID NO: 381861 - DNA, 16 bp, M. musculus
catcatcctgactgag

SEQ ID NO: 381862 - DNA, 16 bp, M. musculus
catcatcctgagcaag

SEQ ID NO: 381863 - DNA, 16 bp, M. musculus
catcatcctgagtgtg

SEQ ID NO: 381864 - DNA, 16 bp, M. musculus
catcatcgtcatcacc

SEQ ID NO: 381865 - DNA, 16 bp, M. musculus
catcatctccatcatc

SEQ ID NO: 381866 - DNA, 16 bp, M. musculus
catcatcttcatcacc

SEQ ID NO: 381867 - DNA, 16 bp, M. musculus
catcatcttcatcttc

SEQ ID NO: 381868 - DNA, 16 bp, M. musculus
catcatcttcttcctc

SEQ ID NO: 381869 - DNA, 16 bp, M. musculus
catcatctttgagatc

SEQ ID NO: 381870 - DNA, 17 bp, M. musculus
catcatgaccaagaagc

SEQ ID NO: 381871 - DNA, 16 bp, M. musculus
catcatgaccaaggag

SEQ ID NO: 381872 - DNA, 16 bp, M. musculus
catcatgaccgagaag

SEQ ID NO: 381873 - DNA, 16 bp, M. musculus
catcatgcccagcttt

SEQ ID NO: 381874 - DNA, 16 bp, M. musculus
catcatgcctgcctgg

SEQ ID NO: 381875 - DNA, 16 bp, M. musculus
catcatgcttctgcag

SEQ ID NO: 381876 - DNA, 16 bp, M. musculus
catcatggaaatgcaa

SEQ ID NO: 381877 - DNA, 16 bp, M. musculus
catcatggaaggagag

SEQ ID NO: 381878 - DNA, 16 bp, M. musculus
catcatggattctaac

SEQ ID NO: 381879 - DNA, 16 bp, M. musculus
catcatggcaggaagg

SEQ ID NO: 381880 - DNA, 16 bp, M. musculus
catcatggccaagaaa

SEQ ID NO: 381881 - DNA, 39 bp, M. musculus
catcatggtctggaccagtgtctccatggtacttctcct

SEQ ID NO: 381882 - DNA, 16 bp, M. musculus
catcatggtgggaagc

SEQ ID NO: 381883 - DNA, 16 bp, M. musculus
catcatggtgggaagt

SEQ ID NO: 381884 - DNA, 16 bp, M. musculus
catcatgtctgcctgt

SEQ ID NO: 381885 - DNA, 16 bp, M. musculus
catcatgtgggttctg

SEQ ID NO: 381886 - DNA, 16 bp, M. musculus
catcattaggaggaga

SEQ ID NO: 381887 - DNA, 16 bp, M. musculus
catcattatcaccatc

SEQ ID NO: 381888 - DNA, 16 bp, M. musculus
catcattattattatc

SEQ ID NO: 381889 - DNA, 16 bp, M. musculus
catcattgaagacaga

SEQ ID NO: 381890 - DNA, 16 bp, M. musculus
catcattgactacttc

SEQ ID NO: 381891 - DNA, 16 bp, M. musculus
catcattggaggaagt

SEQ ID NO: 381892 - DNA, 16 bp, M. musculus
catcattgtcatcatc

SEQ ID NO: 381893 - DNA, 16 bp, M. musculus
catcattgtgctgaca

SEQ ID NO: 381894 - DNA, 16 bp, M. musculus
catcatttactttgat

SEQ ID NO: 381895 - DNA, 16 bp, M. musculus
catcatttgtataaag

SEQ ID NO: 381896 - DNA, 16 bp, M. musculus
catcatttgttgaaga

SEQ ID NO: 381897 - DNA, 16 bp, M. musculus
catcattttcaacaaa

SEQ ID NO: 381898 - DNA, 16 bp, M. musculus
catccaaagactgtcc

SEQ ID NO: 381899 - DNA, 16 bp, M. musculus
catccaacaaaggctt

SEQ ID NO: 381900 - DNA, 16 bp, M. musculus
catccaacagagggct

SEQ ID NO: 381901 - DNA, 16 bp, M. musculus
catccaagacctaaaa

SEQ ID NO: 381902 - DNA, 16 bp, M. musculus
catccaaggacatgag

SEQ ID NO: 381903 - DNA, 16 bp, M. musculus
catccaaggagctgaa

SEQ ID NO: 381904 - DNA, 16 bp, M. musculus
catccacaataatgtc

SEQ ID NO: 381905 - DNA, 16 bp, M. musculus
catccacacactcaca

SEQ ID NO: 381906 - DNA, 16 bp, M. musculus
catccacacatccatc

SEQ ID NO: 381907 - DNA, 16 bp, M. musculus
catccacagccaggag

SEQ ID NO: 381908 - DNA, 16 bp, M. musculus
catccaccatgatcaa

SEQ ID NO: 381909 - DNA, 16 bp, M. musculus
catccacgtggagatg

SEQ ID NO: 381910 - DNA, 16 bp, M. musculus
catccacgtggcagct

SEQ ID NO: 381911 - DNA, 20 bp, M. musculus
catccactcacagcaggcca

SEQ ID NO: 381912 - DNA, 16 bp, M. musculus
catccactcctgcctc

SEQ ID NO: 381913 - DNA, 16 bp, M. musculus
catccactcctgcttc

SEQ ID NO: 381914 - DNA, 16 bp, M. musculus
catccactggacagag

SEQ ID NO: 381915 - DNA, 16 bp, M. musculus
catccactggagcatg

SEQ ID NO: 381916 - DNA, 17 bp, M. musculus
catccacttatcagtga

SEQ ID NO: 381917 - DNA, 16 bp, M. musculus
catccacttatgtatt

SEQ ID NO: 381918 - DNA, 16 bp, M. musculus
catccacttattagtg

SEQ ID NO: 381919 - DNA, 16 bp, M. musculus
catccacttttgtgtt

SEQ ID NO: 381920 - DNA, 16 bp, M. musculus
catccagagaatgtcc

SEQ ID NO: 381921 - DNA, 16 bp, M. musculus
catccagagactctcc

SEQ ID NO: 381922 - DNA, 16 bp, M. musculus
catccagagactgtcc

SEQ ID NO: 381923 - DNA, 16 bp, M. musculus
catccagagctcccag

SEQ ID NO: 381924 - DNA, 16 bp, M. musculus
catccagatcagcagg

SEQ ID NO: 381925 - DNA, 16 bp, M. musculus
catccagattggcagg

SEQ ID NO: 381926 - DNA, 16 bp, M. musculus
catccagccaccttcc

SEQ ID NO: 381927 - DNA, 16 bp, M. musculus
catccagccagccagc

SEQ ID NO: 381928 - DNA, 16 bp, M. musculus
catccaggaaatatgg

SEQ ID NO: 381929 - DNA, 16 bp, M. musculus
catccaggaagcagag

SEQ ID NO: 381930 - DNA, 16 bp, M. musculus
catccaggaggctgag

SEQ ID NO: 381931 - DNA, 16 bp, M. musculus
catccaggatctgaaa

SEQ ID NO: 381932 - DNA, 16 bp, M. musculus
catccaggcagtcatg

SEQ ID NO: 381933 - DNA, 16 bp, M. musculus
catccagggttacata

SEQ ID NO: 381934 - DNA, 17 bp, M. musculus
catccaggtaatccagg

SEQ ID NO: 381935 - DNA, 16 bp, M. musculus
catccagtgactggcc

SEQ ID NO: 381936 - DNA, 16 bp, M. musculus
catccagtggaaaaaa

SEQ ID NO: 381937 - DNA, 16 bp, M. musculus
catccagtggcaaaaa

SEQ ID NO: 381938 - DNA, 16 bp, M. musculus
catccagtgggaaaaa

SEQ ID NO: 381939 - DNA, 16 bp, M. musculus
catccagtttctccag

SEQ ID NO: 381940 - DNA, 16 bp, M. musculus
catccatagtgagatc

SEQ ID NO: 381941 - DNA, 16 bp, M. musculus
catccatatctgtatt

SEQ ID NO: 381942 - DNA, 16 bp, M. musculus
catccatcatctatcc

SEQ ID NO: 381943 - DNA, 16 bp, M. musculus
catccatcatgaacaa

SEQ ID NO: 381944 - DNA, 16 bp, M. musculus
catccatccacacatc

SEQ ID NO: 381945 - DNA, 16 bp, M. musculus
catccatccacctgtc

SEQ ID NO: 381946 - DNA, 16 bp, M. musculus
catccatccatccaca

SEQ ID NO: 381947 - DNA, 16 bp, M. musculus
catccatccatccaga

SEQ ID NO: 381948 - DNA, 16 bp, M. musculus
catccatccatccttc

SEQ ID NO: 381949 - DNA, 16 bp, M. musculus
catccatccatctacc

SEQ ID NO: 381950 - DNA, 16 bp, M. musculus
catccatccatctgtg

SEQ ID NO: 381951 - DNA, 16 bp, M. musculus
catccatccctccatc

SEQ ID NO: 381952 - DNA, 16 bp, M. musculus
catccatctatccacc

SEQ ID NO: 381953 - DNA, 16 bp, M. musculus
catccatctatccatc

SEQ ID NO: 381954 - DNA, 16 bp, M. musculus
catccatctgcctgca

SEQ ID NO: 381955 - DNA, 16 bp, M. musculus
catccatgctggaatg

SEQ ID NO: 381956 - DNA, 16 bp, M. musculus
catccatgtggcagct

SEQ ID NO: 381957 - DNA, 16 bp, M. musculus
catccatgtgtatgtg

SEQ ID NO: 381958 - DNA, 16 bp, M. musculus
catccattcactcatt

SEQ ID NO: 381959 - DNA, 16 bp, M. musculus
catccattcatccatc

SEQ ID NO: 381960 - DNA, 16 bp, M. musculus
catccattcattcatt

SEQ ID NO: 381961 - DNA, 16 bp, M. musculus
catccatttatttatt

SEQ ID NO: 381962 - DNA, 16 bp, M. musculus
catccatttgccaaat

SEQ ID NO: 381963 - DNA, 16 bp, M. musculus
catcccaaccaggtca

SEQ ID NO: 381964 - DNA, 16 bp, M. musculus
catcccaagtactggg

SEQ ID NO: 381965 - DNA, 16 bp, M. musculus
catcccacacttcctc

SEQ ID NO: 381966 - DNA, 16 bp, M. musculus
catcccacagagactg

SEQ ID NO: 381967 - DNA, 16 bp, M. musculus
catcccagaaaatcct

SEQ ID NO: 381968 - DNA, 16 bp, M. musculus
catcccagaaatgcag

SEQ ID NO: 381969 - DNA, 16 bp, M. musculus
catcccagaagatctg

SEQ ID NO: 381970 - DNA, 16 bp, M. musculus
catcccagaagctgtc

SEQ ID NO: 381971 - DNA, 16 bp, M. musculus
catcccagacaccact

SEQ ID NO: 381972 - DNA, 16 bp, M. musculus
catcccagacaccgct

SEQ ID NO: 381973 - DNA, 16 bp, M. musculus
catcccagacctcaag

SEQ ID NO: 381974 - DNA, 16 bp, M. musculus
catcccagagatgcaa

SEQ ID NO: 381975 - DNA, 16 bp, M. musculus
catcccagcatgggtg

SEQ ID NO: 381976 - DNA, 16 bp, M. musculus
catcccagccacctgc

SEQ ID NO: 381977 - DNA, 16 bp, M. musculus
catcccaggctactat

SEQ ID NO: 381978 - DNA, 16 bp, M. musculus
catcccagggaagcag

SEQ ID NO: 381979 - DNA, 16 bp, M. musculus
catcccagggatacag

SEQ ID NO: 381980 - DNA, 19 bp, M. musculus
catcccagggctctcatcc

SEQ ID NO: 381981 - DNA, 16 bp, M. musculus
catcccaggtctctgg

SEQ ID NO: 381982 - DNA, 16 bp, M. musculus
catcccaggtctctgt

SEQ ID NO: 381983 - DNA, 16 bp, M. musculus
catcccaggtttctgg

SEQ ID NO: 381984 - DNA, 16 bp, M. musculus
catcccatatacagtt

SEQ ID NO: 381985 - DNA, 16 bp, M. musculus
catccccaagatctca

SEQ ID NO: 381986 - DNA, 16 bp, M. musculus
catccccaaggtccct

SEQ ID NO: 381987 - DNA, 16 bp, M. musculus
catccccaataccaca

SEQ ID NO: 381988 - DNA, 16 bp, M. musculus
catccccacagtgaca

SEQ ID NO: 381989 - DNA, 16 bp, M. musculus
catccccaccagcatc

SEQ ID NO: 381990 - DNA, 16 bp, M. musculus
catccccagagctctg

SEQ ID NO: 381991 - DNA, 16 bp, M. musculus
catccccagcactgca

SEQ ID NO: 381992 - DNA, 16 bp, M. musculus
catccccagctctcct

SEQ ID NO: 381993 - DNA, 16 bp, M. musculus
catccccctgcctcac

SEQ ID NO: 381994 - DNA, 16 bp, M. musculus
catccccctgcctcag

SEQ ID NO: 381995 - DNA, 16 bp, M. musculus
catccccctgcctctg

SEQ ID NO: 381996 - DNA, 16 bp, M. musculus
catccccgccagcatc

SEQ ID NO: 381997 - DNA, 16 bp, M. musculus
catccccgcccccaag

SEQ ID NO: 381998 - DNA, 16 bp, M. musculus
catcccctcctgcctc

SEQ ID NO: 381999 - DNA, 16 bp, M. musculus
catccccttcagttcc

SEQ ID NO: 382000 - DNA, 16 bp, M. musculus
catccctacatccctg

SEQ ID NO: 382001 - DNA, 16 bp, M. musculus
catccctacattcctg

SEQ ID NO: 382002 - DNA, 16 bp, M. musculus
catccctcatcacagg

SEQ ID NO: 382003 - DNA, 16 bp, M. musculus
catccctccacagcct

SEQ ID NO: 382004 - DNA, 16 bp, M. musculus
catccctccagcccct

SEQ ID NO: 382005 - DNA, 16 bp, M. musculus
catccctccagcccta

SEQ ID NO: 382006 - DNA, 16 bp, M. musculus
catccctccatgccct

SEQ ID NO: 382007 - DNA, 16 bp, M. musculus
catccctctgcctcag

SEQ ID NO: 382008 - DNA, 16 bp, M. musculus
catccctgcatcactg

SEQ ID NO: 382009 - DNA, 17 bp, M. musculus
catccctgcatccctga

SEQ ID NO: 382010 - DNA, 16 bp, M. musculus
catccctgcatccttg

SEQ ID NO: 382011 - DNA, 16 bp, M. musculus
catccctgcattcctg

SEQ ID NO: 382012 - DNA, 16 bp, M. musculus
catccctgcctgacag

SEQ ID NO: 382013 - DNA, 16 bp, M. musculus
catccctggaacaaaa

SEQ ID NO: 382014 - DNA, 16 bp, M. musculus
catccctgggatggtg

SEQ ID NO: 382015 - DNA, 16 bp, M. musculus
catccctgtcattgct

SEQ ID NO: 382016 - DNA, 16 bp, M. musculus
catccctgtgatgaaa

SEQ ID NO: 382017 - DNA, 16 bp, M. musculus
catcccttacttgatg

SEQ ID NO: 382018 - DNA, 16 bp, M. musculus
catcctagctgcagag

SEQ ID NO: 382019 - DNA, 16 bp, M. musculus
catcctagctgcctgc

SEQ ID NO: 382020 - DNA, 16 bp, M. musculus
catcctataaatgact

SEQ ID NO: 382021 - DNA, 16 bp, M. musculus
catcctcacacagaca

SEQ ID NO: 382022 - DNA, 16 bp, M. musculus
catcctcaccatcatc

SEQ ID NO: 382023 - DNA, 16 bp, M. musculus
catcctcagccagaag

SEQ ID NO: 382024 - DNA, 16 bp, M. musculus
catcctcagccaggag

SEQ ID NO: 382025 - DNA, 16 bp, M. musculus
catcctcagctacatg

SEQ ID NO: 382026 - DNA, 16 bp, M. musculus
catcctccaagcacag

SEQ ID NO: 382027 - DNA, 16 bp, M. musculus
catcctcctgcagcag

SEQ ID NO: 382028 - DNA, 16 bp, M. musculus
catcctcctgcatcag

SEQ ID NO: 382029 - DNA, 16 bp, M. musculus
catcctcctgccccag

SEQ ID NO: 382030 - DNA, 16 bp, M. musculus
catcctcctgccctgg

SEQ ID NO: 382031 - DNA, 16 bp, M. musculus
catcctcctgcctctg

SEQ ID NO: 382032 - DNA, 16 bp, M. musculus
catcctcgtggagatg

SEQ ID NO: 382033 - DNA, 16 bp, M. musculus
catcctctactacata

SEQ ID NO: 382034 - DNA, 16 bp, M. musculus
catcctctccagcatc

SEQ ID NO: 382035 - DNA, 16 bp, M. musculus
catcctctccagtatc

SEQ ID NO: 382036 - DNA, 16 bp, M. musculus
catcctctcccactga

SEQ ID NO: 382037 - DNA, 16 bp, M. musculus
catcctctcctggcct

SEQ ID NO: 382038 - DNA, 16 bp, M. musculus
catcctctctagcatc

SEQ ID NO: 382039 - DNA, 16 bp, M. musculus
catcctctctcctgta

SEQ ID NO: 382040 - DNA, 16 bp, M. musculus
catcctctgccacaca

SEQ ID NO: 382041 - DNA, 16 bp, M. musculus
catcctctgctcccca

SEQ ID NO: 382042 - DNA, 16 bp, M. musculus
catcctcttctactga

SEQ ID NO: 382043 - DNA, 16 bp, M. musculus
catcctcttgcctcag

SEQ ID NO: 382044 - DNA, 16 bp, M. musculus
catcctgaaattcttt

SEQ ID NO: 382045 - DNA, 16 bp, M. musculus
catcctgaagaaatcc

SEQ ID NO: 382046 - DNA, 17 bp, M. musculus
catcctgaagcagctgg

SEQ ID NO: 382047 - DNA, 16 bp, M. musculus
catcctgaccaagaag

SEQ ID NO: 382048 - DNA, 16 bp, M. musculus
catcctgaccaagtag

SEQ ID NO: 382049 - DNA, 16 bp, M. musculus
catcctgagtgacgta

SEQ ID NO: 382050 - DNA, 16 bp, M. musculus
catcctgagtgaggga

SEQ ID NO: 382051 - DNA, 16 bp, M. musculus
catcctgagtgctagg

SEQ ID NO: 382052 - DNA, 16 bp, M. musculus
catcctgagtgctgag

SEQ ID NO: 382053 - DNA, 16 bp, M. musculus
catcctgagtttttca

SEQ ID NO: 382054 - DNA, 16 bp, M. musculus
catcctgcacccttcc

SEQ ID NO: 382055 - DNA, 16 bp, M. musculus
catcctgcctcagctt

SEQ ID NO: 382056 - DNA, 16 bp, M. musculus
catcctgctctcttat

SEQ ID NO: 382057 - DNA, 16 bp, M. musculus
catcctggacctcaag

SEQ ID NO: 382058 - DNA, 16 bp, M. musculus
catcctggagatgctc

SEQ ID NO: 382059 - DNA, 16 bp, M. musculus
catcctggccagcatg

SEQ ID NO: 382060 - DNA, 16 bp, M. musculus
catcctggccctcctg

SEQ ID NO: 382061 - DNA, 16 bp, M. musculus
catcctgggacttgag

SEQ ID NO: 382062 - DNA, 16 bp, M. musculus
catcctggtctatata

SEQ ID NO: 382063 - DNA, 16 bp, M. musculus
catcctgtgctccagc

SEQ ID NO: 382064 - DNA, 16 bp, M. musculus
catccttagctacata

SEQ ID NO: 382065 - DNA, 16 bp, M. musculus
catccttagtcaccag

SEQ ID NO: 382066 - DNA, 16 bp, M. musculus
catccttcctgctcca

SEQ ID NO: 382067 - DNA, 16 bp, M. musculus
catccttctgcctcag

SEQ ID NO: 382068 - DNA, 16 bp, M. musculus
catccttctgcctcca

SEQ ID NO: 382069 - DNA, 16 bp, M. musculus
catccttctgtttctc

SEQ ID NO: 382070 - DNA, 16 bp, M. musculus
catccttgccaacatt

SEQ ID NO: 382071 - DNA, 17 bp, M. musculus
catccttgccagcgtct

SEQ ID NO: 382072 - DNA, 17 bp, M. musculus
catccttgcccctggga

SEQ ID NO: 382073 - DNA, 16 bp, M. musculus
catccttgcctgcatc

SEQ ID NO: 382074 - DNA, 17 bp, M. musculus
catccttggctacataa

SEQ ID NO: 382075 - DNA, 16 bp, M. musculus
catccttgtacttctg

SEQ ID NO: 382076 - DNA, 16 bp, M. musculus
catcctttcatgtgtc

SEQ ID NO: 382077 - DNA, 16 bp, M. musculus
catcctttgctacata

SEQ ID NO: 382078 - DNA, 16 bp, M. musculus
catcctttgtgcttgt

SEQ ID NO: 382079 - DNA, 16 bp, M. musculus
catccttttggagatg

SEQ ID NO: 382080 - DNA, 16 bp, M. musculus
catcgtttttaatagc

SEQ ID NO: 382081 - DNA, 16 bp, M. musculus
catctaacaccagaga

SEQ ID NO: 382082 - DNA, 16 bp, M. musculus
catctaatcctcttgg

SEQ ID NO: 382083 - DNA, 16 bp, M. musculus
catctacatcaaaaag

SEQ ID NO: 382084 - DNA, 16 bp, M. musculus
catctacctcccaagt

SEQ ID NO: 382085 - DNA, 16 bp, M. musculus
catctactcccacttc

SEQ ID NO: 382086 - DNA, 16 bp, M. musculus
catctactgcaagagg

SEQ ID NO: 382087 - DNA, 16 bp, M. musculus
catctacttctgcctc

SEQ ID NO: 382088 - DNA, 16 bp, M. musculus
catctactttccacca

SEQ ID NO: 382089 - DNA, 16 bp, M. musculus
catctagagactgtca

SEQ ID NO: 382090 - DNA, 16 bp, M. musculus
catctatatacatata

SEQ ID NO: 382091 - DNA, 16 bp, M. musculus
catctatatatctata

SEQ ID NO: 382092 - DNA, 16 bp, M. musculus
catctatcattaatca

SEQ ID NO: 382093 - DNA, 16 bp, M. musculus
catctatccagccttc

SEQ ID NO: 382094 - DNA, 16 bp, M. musculus
catctatccatctgtc

SEQ ID NO: 382095 - DNA, 19 bp, M. musculus
catctatctatctatctat

SEQ ID NO: 382096 - DNA, 24 bp, M. musculus
catctatctatctatctatctatc

SEQ ID NO: 382097 - DNA, 16 bp, M. musculus
catctatctgcctctg

SEQ ID NO: 382098 - DNA, 16 bp, M. musculus
catctatgaactgctg

SEQ ID NO: 382099 - DNA, 16 bp, M. musculus
catctatggtgattaa

SEQ ID NO: 382100 - DNA, 16 bp, M. musculus
catctcaaggacaact

SEQ ID NO: 382101 - DNA, 16 bp, M. musculus
catctcaccaacccaa

SEQ ID NO: 382102 - DNA, 16 bp, M. musculus
catctcaccagcaccc

SEQ ID NO: 382103 - DNA, 18 bp, M. musculus
catctcaccagccccctt

SEQ ID NO: 382104 - DNA, 16 bp, M. musculus
catctcaccagccccg

SEQ ID NO: 382105 - DNA, 16 bp, M. musculus
catctcactggcccag

SEQ ID NO: 382106 - DNA, 16 bp, M. musculus
catctcagaccaagac

SEQ ID NO: 382107 - DNA, 17 bp, M. musculus
catctcagagaaaaaga

SEQ ID NO: 382108 - DNA, 16 bp, M. musculus
catctcagaggagaag

SEQ ID NO: 382109 - DNA, 16 bp, M. musculus
catctcagatatcctg

SEQ ID NO: 382110 - DNA, 16 bp, M. musculus
catctcagcagcccct

SEQ ID NO: 382111 - DNA, 16 bp, M. musculus
catctcagctccaatc

SEQ ID NO: 382112 - DNA, 16 bp, M. musculus
catctcaggagacagt

SEQ ID NO: 382113 - DNA, 16 bp, M. musculus
catctcaggggaaaaa

SEQ ID NO: 382114 - DNA, 16 bp, M. musculus
catctccaaatacata

SEQ ID NO: 382115 - DNA, 16 bp, M. musculus
catctccacagctgca

SEQ ID NO: 382116 - DNA, 16 bp, M. musculus
catctccagcaggaag

SEQ ID NO: 382117 - DNA, 16 bp, M. musculus
catctccagcctcccc

SEQ ID NO: 382118 - DNA, 16 bp, M. musculus
catctccatctccatc

SEQ ID NO: 382119 - DNA, 16 bp, M. musculus
catctccatgtctgat

SEQ ID NO: 382120 - DNA, 16 bp, M. musculus
catctcccaagtgctg

SEQ ID NO: 382121 - DNA, 16 bp, M. musculus
catctccccagcccag

SEQ ID NO: 382122 - DNA, 16 bp, M. musculus
catctccccagcccta

SEQ ID NO: 382123 - DNA, 16 bp, M. musculus
catctccccagcctct

SEQ ID NO: 382124 - DNA, 16 bp, M. musculus
catctccccagccttg

SEQ ID NO: 382125 - DNA, 16 bp, M. musculus
catctccccagccttt

SEQ ID NO: 382126 - DNA, 16 bp, M. musculus
catctccccattcctt

SEQ ID NO: 382127 - DNA, 16 bp, M. musculus
catctccctcctcctg

SEQ ID NO: 382128 - DNA, 16 bp, M. musculus
catctccctggcccag

SEQ ID NO: 382129 - DNA, 16 bp, M. musculus
catctccctggccctg

SEQ ID NO: 382130 - DNA, 16 bp, M. musculus
catctcccttctctgg

SEQ ID NO: 382131 - DNA, 16 bp, M. musculus
catctcctcagcctct

SEQ ID NO: 382132 - DNA, 16 bp, M. musculus
catctcctcagctccc

SEQ ID NO: 382133 - DNA, 16 bp, M. musculus
catctcctccctgtta

SEQ ID NO: 382134 - DNA, 16 bp, M. musculus
catctcctgagtgctg

SEQ ID NO: 382135 - DNA, 17 bp, M. musculus
catctcctgtagctcct

SEQ ID NO: 382136 - DNA, 16 bp, M. musculus
catctccttcctcttg

SEQ ID NO: 382137 - DNA, 16 bp, M. musculus
catctctaaaaacaaa

SEQ ID NO: 382138 - DNA, 16 bp, M. musculus
catctctatatctcta

SEQ ID NO: 382139 - DNA, 16 bp, M. musculus
catctctcatctctct

SEQ ID NO: 382140 - DNA, 16 bp, M. musculus
catctctccaacacca

SEQ ID NO: 382141 - DNA, 16 bp, M. musculus
catctctccaacccag

SEQ ID NO: 382142 - DNA, 16 bp, M. musculus
catctctccaacccct

SEQ ID NO: 382143 - DNA, 16 bp, M. musculus
catctctccaacctca

SEQ ID NO: 382144 - DNA, 16 bp, M. musculus
catctctccaacctga

SEQ ID NO: 382145 - DNA, 16 bp, M. musculus
catctctccaaccttc

SEQ ID NO: 382146 - DNA, 16 bp, M. musculus
catctctccaactcct

SEQ ID NO: 382147 - DNA, 16 bp, M. musculus
catctctccaatccct

SEQ ID NO: 382148 - DNA, 16 bp, M. musculus
catctctccacttgat

SEQ ID NO: 382149 - DNA, 16 bp, M. musculus
catctctccagcctcc

SEQ ID NO: 382150 - DNA, 16 bp, M. musculus
catctctccagcctct

SEQ ID NO: 382151 - DNA, 16 bp, M. musculus
catctctccagccttt

SEQ ID NO: 382152 - DNA, 16 bp, M. musculus
catctctccagctccc

SEQ ID NO: 382153 - DNA, 16 bp, M. musculus
catctctccagctctg

SEQ ID NO: 382154 - DNA, 16 bp, M. musculus
catctctccagtccct

SEQ ID NO: 382155 - DNA, 16 bp, M. musculus
catctctccagtctgg

SEQ ID NO: 382156 - DNA, 16 bp, M. musculus
catctctccattttct

SEQ ID NO: 382157 - DNA, 16 bp, M. musculus
catctctcctgctctt

SEQ ID NO: 382158 - DNA, 16 bp, M. musculus
catctctctagcccaa

SEQ ID NO: 382159 - DNA, 16 bp, M. musculus
catctctctagcccag

SEQ ID NO: 382160 - DNA, 16 bp, M. musculus
catctctctagcccct

SEQ ID NO: 382161 - DNA, 16 bp, M. musculus
catctctctagcctca

SEQ ID NO: 382162 - DNA, 16 bp, M. musculus
catctctctagtccca

SEQ ID NO: 382163 - DNA, 16 bp, M. musculus
catctctctcacttca

SEQ ID NO: 382164 - DNA, 16 bp, M. musculus
catctctctctgcttc

SEQ ID NO: 382165 - DNA, 16 bp, M. musculus
catctctctgagcctc

SEQ ID NO: 382166 - DNA, 16 bp, M. musculus
catctctctggctcca

SEQ ID NO: 382167 - DNA, 16 bp, M. musculus
catctctctgtttcct

SEQ ID NO: 382168 - DNA, 16 bp, M. musculus
catctctgaatgaaca

SEQ ID NO: 382169 - DNA, 16 bp, M. musculus
catctctgaccctctt

SEQ ID NO: 382170 - DNA, 16 bp, M. musculus
catctctgcagcctct

SEQ ID NO: 382171 - DNA, 16 bp, M. musculus
catctctgcagcctgc

SEQ ID NO: 382172 - DNA, 16 bp, M. musculus
catctctgcagctccc

SEQ ID NO: 382173 - DNA, 16 bp, M. musculus
catctctgcatccctg

SEQ ID NO: 382174 - DNA, 16 bp, M. musculus
catctctgccacaatg

SEQ ID NO: 382175 - DNA, 16 bp, M. musculus
catctctgcctctctg

SEQ ID NO: 382176 - DNA, 16 bp, M. musculus
catctctgctacccca

SEQ ID NO: 382177 - DNA, 16 bp, M. musculus
catctctgctcatcaa

SEQ ID NO: 382178 - DNA, 16 bp, M. musculus
catctctgcttagatt

SEQ ID NO: 382179 - DNA, 16 bp, M. musculus
catctctggatcttca

SEQ ID NO: 382180 - DNA, 16 bp, M. musculus
catctctggcctccac

SEQ ID NO: 382181 - DNA, 16 bp, M. musculus
catctctggctgtaag

SEQ ID NO: 382182 - DNA, 16 bp, M. musculus
catctctgggctggtg

SEQ ID NO: 382183 - DNA, 16 bp, M. musculus
catctctgtcaccatc

SEQ ID NO: 382184 - DNA, 16 bp, M. musculus
catctctgtctttctg

SEQ ID NO: 382185 - DNA, 16 bp, M. musculus
catctctgtgtttctg

SEQ ID NO: 382186 - DNA, 16 bp, M. musculus
catctctgtttctctc

SEQ ID NO: 382187 - DNA, 16 bp, M. musculus
catctcttcagcccca

SEQ ID NO: 382188 - DNA, 16 bp, M. musculus
catctcttcagcctca

SEQ ID NO: 382189 - DNA, 16 bp, M. musculus
catctcttcagtcccc

SEQ ID NO: 382190 - DNA, 16 bp, M. musculus
catctcttcctttagg

SEQ ID NO: 382191 - DNA, 16 bp, M. musculus
catctctttcttcagg

SEQ ID NO: 382192 - DNA, 16 bp, M. musculus
catctcttttttaggt

SEQ ID NO: 382193 - DNA, 16 bp, M. musculus
catctgaaaaacatcc

SEQ ID NO: 382194 - DNA, 16 bp, M. musculus
catctgaacacacaca

SEQ ID NO: 382195 - DNA, 16 bp, M. musculus
catctgaaggctgctt

SEQ ID NO: 382196 - DNA, 16 bp, M. musculus
catctgaattgtttcc

SEQ ID NO: 382197 - DNA, 16 bp, M. musculus
catctgaatttttgat

SEQ ID NO: 382198 - DNA, 16 bp, M. musculus
catctgactcttccag

SEQ ID NO: 382199 - DNA, 16 bp, M. musculus
catctgaggttgtcct

SEQ ID NO: 382200 - DNA, 17 bp, M. musculus
catctgagttctctgct

SEQ ID NO: 382201 - DNA, 16 bp, M. musculus
catctgagtttattga

SEQ ID NO: 382202 - DNA, 16 bp, M. musculus
catctgatagatgact

SEQ ID NO: 382203 - DNA, 29 bp, M. musculus
catctgatatgacctgacaatgttcccca

SEQ ID NO: 382204 - DNA, 16 bp, M. musculus
catctgatcagaagcc

SEQ ID NO: 382205 - DNA, 16 bp, M. musculus
catctgcaaaaagtgc

SEQ ID NO: 382206 - DNA, 16 bp, M. musculus
catctgcaaatggtga

SEQ ID NO: 382207 - DNA, 16 bp, M. musculus
catctgcacctggagc

SEQ ID NO: 382208 - DNA, 16 bp, M. musculus
catctgccagagacat

SEQ ID NO: 382209 - DNA, 16 bp, M. musculus
catctgccaggaggca

SEQ ID NO: 382210 - DNA, 16 bp, M. musculus
catctgcccacccaga

SEQ ID NO: 382211 - DNA, 16 bp, M. musculus
catctgccctctcccc

SEQ ID NO: 382212 - DNA, 16 bp, M. musculus
catctgcctcatctgc

SEQ ID NO: 382213 - DNA, 16 bp, M. musculus
catctgcctctgcctt

SEQ ID NO: 382214 - DNA, 16 bp, M. musculus
catctgcctggatgct

SEQ ID NO: 382215 - DNA, 16 bp, M. musculus
catctgcctggccttt

SEQ ID NO: 382216 - DNA, 16 bp, M. musculus
catctgctacatatat

SEQ ID NO: 382217 - DNA, 16 bp, M. musculus
catctgctacatatgt

SEQ ID NO: 382218 - DNA, 16 bp, M. musculus
catctgctgacaccaa

SEQ ID NO: 382219 - DNA, 16 bp, M. musculus
catctgctgctgggca

SEQ ID NO: 382220 - DNA, 16 bp, M. musculus
catctgctgtcccctg

SEQ ID NO: 382221 - DNA, 16 bp, M. musculus
catctgcttcagagct

SEQ ID NO: 382222 - DNA, 16 bp, M. musculus
catctgcttccatcag

SEQ ID NO: 382223 - DNA, 16 bp, M. musculus
catctgcttctgcttc

SEQ ID NO: 382224 - DNA, 16 bp, M. musculus
catctgctttgatatg

SEQ ID NO: 382225 - DNA, 16 bp, M. musculus
catctggaaaatgcaa

SEQ ID NO: 382226 - DNA, 19 bp, M. musculus
catctggaacttggtcagg

SEQ ID NO: 382227 - DNA, 16 bp, M. musculus
catctggattctttcc

SEQ ID NO: 382228 - DNA, 16 bp, M. musculus
catctggccagagttc

SEQ ID NO: 382229 - DNA, 16 bp, M. musculus
catctgggaagaagaa

SEQ ID NO: 382230 - DNA, 16 bp, M. musculus
catctgggagagtcca

SEQ ID NO: 382231 - DNA, 16 bp, M. musculus
catctggggctggaga

SEQ ID NO: 382232 - DNA, 16 bp, M. musculus
catctgggggtggggg

SEQ ID NO: 382233 - DNA, 16 bp, M. musculus
catctgggtccttttg

SEQ ID NO: 382234 - DNA, 19 bp, M. musculus
catctgggttccttccagc

SEQ ID NO: 382235 - DNA, 18 bp, M. musculus
catctggtattctctgga

SEQ ID NO: 382236 - DNA, 16 bp, M. musculus
catctggttctgggct

SEQ ID NO: 382237 - DNA, 16 bp, M. musculus
catctgtaaaatggga

SEQ ID NO: 382238 - DNA, 17 bp, M. musculus
catctgtaacaagatcc

SEQ ID NO: 382239 - DNA, 16 bp, M. musculus
catctgtaactccagt

SEQ ID NO: 382240 - DNA, 16 bp, M. musculus
catctgtaatagtgtc

SEQ ID NO: 382241 - DNA, 16 bp, M. musculus
catctgtaatcccagt

SEQ ID NO: 382242 - DNA, 16 bp, M. musculus
catctgtaatgacatc

SEQ ID NO: 382243 - DNA, 16 bp, M. musculus
catctgtaatgggata

SEQ ID NO: 382244 - DNA, 18 bp, M. musculus
catctgtaatgggattca

SEQ ID NO: 382245 - DNA, 16 bp, M. musculus
catctgtagtcaggaa

SEQ ID NO: 382246 - DNA, 16 bp, M. musculus
catctgtattgaacat

SEQ ID NO: 382247 - DNA, 16 bp, M. musculus
catctgtattggtcag

SEQ ID NO: 382248 - DNA, 16 bp, M. musculus
catctgtattttcctt

SEQ ID NO: 382249 - DNA, 16 bp, M. musculus
catctgtcaattaaaa

SEQ ID NO: 382250 - DNA, 16 bp, M. musculus
catctgtcatcccagc

SEQ ID NO: 382251 - DNA, 16 bp, M. musculus
catctgtccatccatc

SEQ ID NO: 382252 - DNA, 16 bp, M. musculus
catctgtctcctgaga

SEQ ID NO: 382253 - DNA, 16 bp, M. musculus
catctgtctctctctc

SEQ ID NO: 382254 - DNA, 16 bp, M. musculus
catctgtctctgagtc

SEQ ID NO: 382255 - DNA, 16 bp, M. musculus
catctgtctcttcctc

SEQ ID NO: 382256 - DNA, 16 bp, M. musculus
catctgtctgtgtgtg

SEQ ID NO: 382257 - DNA, 16 bp, M. musculus
catctgtgaaatgggc

SEQ ID NO: 382258 - DNA, 16 bp, M. musculus
catctgtgactcctgt

SEQ ID NO: 382259 - DNA, 16 bp, M. musculus
catctgtgatcccagc

SEQ ID NO: 382260 - DNA, 16 bp, M. musculus
catctgtgcaatgcag

SEQ ID NO: 382261 - DNA, 16 bp, M. musculus
catctgtgccaactcc

SEQ ID NO: 382262 - DNA, 16 bp, M. musculus
catctgtgctgggcag

SEQ ID NO: 382263 - DNA, 16 bp, M. musculus
catctgtgtatgtgtg

SEQ ID NO: 382264 - DNA, 16 bp, M. musculus
catctgtgtctgtgag

SEQ ID NO: 382265 - DNA, 16 bp, M. musculus
catctgtgtgtgtgtg

SEQ ID NO: 382266 - DNA, 16 bp, M. musculus
catctgttactccagt

SEQ ID NO: 382267 - DNA, 32 bp, M. musculus
catctgttcttggccctgagccggggcccagg

SEQ ID NO: 382268 - DNA, 16 bp, M. musculus
catctgtttccattgg

SEQ ID NO: 382269 - DNA, 16 bp, M. musculus
catcttaccagcccct

SEQ ID NO: 382270 - DNA, 16 bp, M. musculus
catcttagctgcctgg

SEQ ID NO: 382271 - DNA, 16 bp, M. musculus
catcttagttagggtt

SEQ ID NO: 382272 - DNA, 16 bp, M. musculus
catcttagtttctttt

SEQ ID NO: 382273 - DNA, 17 bp, M. musculus
catcttcaaagacactg

SEQ ID NO: 382274 - DNA, 16 bp, M. musculus
catcttcaaatttttt

SEQ ID NO: 382275 - DNA, 16 bp, M. musculus
catcttcaataagtgg

SEQ ID NO: 382276 - DNA, 16 bp, M. musculus
catcttcagtttcctc

SEQ ID NO: 382277 - DNA, 16 bp, M. musculus
catcttcatcaccatc

SEQ ID NO: 382278 - DNA, 16 bp, M. musculus
catcttcatcatcttc

SEQ ID NO: 382279 - DNA, 16 bp, M. musculus
catcttcatccaggag

SEQ ID NO: 382280 - DNA, 16 bp, M. musculus
catcttcatctaaagg

SEQ ID NO: 382281 - DNA, 16 bp, M. musculus
catcttcatcttcatc

SEQ ID NO: 382282 - DNA, 16 bp, M. musculus
catcttcatggagaca

SEQ ID NO: 382283 - DNA, 16 bp, M. musculus
catcttcccagccctc

SEQ ID NO: 382284 - DNA, 16 bp, M. musculus
catcttcctagccctt

SEQ ID NO: 382285 - DNA, 16 bp, M. musculus
catcttcctgcttcag

SEQ ID NO: 382286 - DNA, 16 bp, M. musculus
catcttctacatctat

SEQ ID NO: 382287 - DNA, 16 bp, M. musculus
catcttctagtgtctt

SEQ ID NO: 382288 - DNA, 16 bp, M. musculus
catcttctatgcctga

SEQ ID NO: 382289 - DNA, 16 bp, M. musculus
catcttctccatctcc

SEQ ID NO: 382290 - DNA, 16 bp, M. musculus
catcttctgagatctc

SEQ ID NO: 382291 - DNA, 16 bp, M. musculus
catcttctgatacaca

SEQ ID NO: 382292 - DNA, 16 bp, M. musculus
catcttctgatatctc

SEQ ID NO: 382293 - DNA, 16 bp, M. musculus
catcttctgcaccatc

SEQ ID NO: 382294 - DNA, 16 bp, M. musculus
catcttctgctactta

SEQ ID NO: 382295 - DNA, 16 bp, M. musculus
catcttctgctccata

SEQ ID NO: 382296 - DNA, 16 bp, M. musculus
catcttctgggtacat

SEQ ID NO: 382297 - DNA, 16 bp, M. musculus
catcttctggtctcca

SEQ ID NO: 382298 - DNA, 16 bp, M. musculus
catcttcttcatcttc

SEQ ID NO: 382299 - DNA, 16 bp, M. musculus
catcttcttggagatg

SEQ ID NO: 382300 - DNA, 21 bp, M. musculus
catcttcttgtgcagtgccag

SEQ ID NO: 382301 - DNA, 16 bp, M. musculus
catcttctttgactga

SEQ ID NO: 382302 - DNA, 16 bp, M. musculus
catcttggagaagagc

SEQ ID NO: 382303 - DNA, 16 bp, M. musculus
catcttggagacaggg

SEQ ID NO: 382304 - DNA, 16 bp, M. musculus
catcttggatcccaga

SEQ ID NO: 382305 - DNA, 16 bp, M. musculus
catcttggccaagctt

SEQ ID NO: 382306 - DNA, 16 bp, M. musculus
catcttgggactactg

SEQ ID NO: 382307 - DNA, 16 bp, M. musculus
catcttggttctcctc

SEQ ID NO: 382308 - DNA, 16 bp, M. musculus
catcttgtattcttgc

SEQ ID NO: 382309 - DNA, 16 bp, M. musculus
catcttgtggtcagga

SEQ ID NO: 382310 - DNA, 16 bp, M. musculus
catctttaaaaacaaa

SEQ ID NO: 382311 - DNA, 16 bp, M. musculus
catctttatctgaaga

SEQ ID NO: 382312 - DNA, 16 bp, M. musculus
catctttccacgaatc

SEQ ID NO: 382313 - DNA, 16 bp, M. musculus
catctttccacttgat

SEQ ID NO: 382314 - DNA, 16 bp, M. musculus
catctttccagccccc

SEQ ID NO: 382315 - DNA, 16 bp, M. musculus
catctttctctgtcag

SEQ ID NO: 382316 - DNA, 16 bp, M. musculus
catctttctgtctgtc

SEQ ID NO: 382317 - DNA, 16 bp, M. musculus
catctttctgtttctc

SEQ ID NO: 382318 - DNA, 16 bp, M. musculus
catctttgaaggtctg

SEQ ID NO: 382319 - DNA, 16 bp, M. musculus
catctttgccagcatc

SEQ ID NO: 382320 - DNA, 16 bp, M. musculus
catctttgccagcatg

SEQ ID NO: 382321 - DNA, 16 bp, M. musculus
catctttgctccaaac

SEQ ID NO: 382322 - DNA, 16 bp, M. musculus
catctttggccaggag

SEQ ID NO: 382323 - DNA, 16 bp, M. musculus
catcttttcccactga

SEQ ID NO: 382324 - DNA, 16 bp, M. musculus
catcttttgacaaatg

SEQ ID NO: 382325 - DNA, 16 bp, M. musculus
catcttttgaggtctt

SEQ ID NO: 382326 - DNA, 16 bp, M. musculus
catcttttgtagccag

SEQ ID NO: 382327 - DNA, 16 bp, M. musculus
catgaaaaaagtcttg

SEQ ID NO: 382328 - DNA, 16 bp, M. musculus
catgaaaaaattcaca

SEQ ID NO: 382329 - DNA, 16 bp, M. musculus
catgaaaaatgctttt

SEQ ID NO: 382330 - DNA, 16 bp, M. musculus
catgaaaatatttaaa

SEQ ID NO: 382331 - DNA, 16 bp, M. musculus
catgaaaatgaatgaa

SEQ ID NO: 382332 - DNA, 16 bp, M. musculus
catgaaactcaggaag

SEQ ID NO: 382333 - DNA, 16 bp, M. musculus
catgaaactctgtctc

SEQ ID NO: 382334 - DNA, 16 bp, M. musculus
catgaaagaacacaca

SEQ ID NO: 382335 - DNA, 16 bp, M. musculus
catgaaagaacacata

SEQ ID NO: 382336 - DNA, 16 bp, M. musculus
catgaaatagaaacag

SEQ ID NO: 382337 - DNA, 16 bp, M. musculus
catgaaatttcaacaa

SEQ ID NO: 382338 - DNA, 16 bp, M. musculus
catgaaatttttagac

SEQ ID NO: 382339 - DNA, 16 bp, M. musculus
catgaacacacacaca

SEQ ID NO: 382340 - DNA, 16 bp, M. musculus
catgaacacacacata

SEQ ID NO: 382341 - DNA, 16 bp, M. musculus
catgaacacatacatg

SEQ ID NO: 382342 - DNA, 16 bp, M. musculus
catgaacacatcaaaa

SEQ ID NO: 382343 - DNA, 16 bp, M. musculus
catgaacacatgtgca

SEQ ID NO: 382344 - DNA, 16 bp, M. musculus
catgaacaccaagctg

SEQ ID NO: 382345 - DNA, 16 bp, M. musculus
catgaacacgcacaca

SEQ ID NO: 382346 - DNA, 16 bp, M. musculus
catgaacatttaaaaa

SEQ ID NO: 382347 - DNA, 16 bp, M. musculus
catgaaccccaaaaga

SEQ ID NO: 382348 - DNA, 16 bp, M. musculus
catgaaccgggtattt

SEQ ID NO: 382349 - DNA, 16 bp, M. musculus
catgaagaactgcatt

SEQ ID NO: 382350 - DNA, 16 bp, M. musculus
catgaagaactgtact

SEQ ID NO: 382351 - DNA, 16 bp, M. musculus
catgaagaactgtatt

SEQ ID NO: 382352 - DNA, 16 bp, M. musculus
catgaagaagaatgca

SEQ ID NO: 382353 - DNA, 16 bp, M. musculus
catgaagaaggccttc

SEQ ID NO: 382354 - DNA, 16 bp, M. musculus
catgaagacaaagctg

SEQ ID NO: 382355 - DNA, 16 bp, M. musculus
catgaagaccaagctg

SEQ ID NO: 382356 - DNA, 16 bp, M. musculus
catgaagacccaagtt

SEQ ID NO: 382357 - DNA, 16 bp, M. musculus
catgaagacttgagtt

SEQ ID NO: 382358 - DNA, 16 bp, M. musculus
catgaagagcaagcca

SEQ ID NO: 382359 - DNA, 16 bp, M. musculus
catgaagatcaagaag

SEQ ID NO: 382360 - DNA, 16 bp, M. musculus
catgaagcagctggtc

SEQ ID NO: 382361 - DNA, 16 bp, M. musculus
catgaagcaggagctg

SEQ ID NO: 382362 - DNA, 16 bp, M. musculus
catgaagcccaggctg

SEQ ID NO: 382363 - DNA, 16 bp, M. musculus
catgaagccctgggct

SEQ ID NO: 382364 - DNA, 16 bp, M. musculus
catgaaggagctagag

SEQ ID NO: 382365 - DNA, 16 bp, M. musculus
catgaaggagggagtg

SEQ ID NO: 382366 - DNA, 16 bp, M. musculus
catgaaggcagacatg

SEQ ID NO: 382367 - DNA, 16 bp, M. musculus
catgaaggccaagctg

SEQ ID NO: 382368 - DNA, 16 bp, M. musculus
catgaaggccagaaga

SEQ ID NO: 382369 - DNA, 16 bp, M. musculus
catgaaggtcagaaga

SEQ ID NO: 382370 - DNA, 23 bp, M. musculus
catgaaggttcagtgtcctagtt

SEQ ID NO: 382371 - DNA, 16 bp, M. musculus
catgaagtggtgttgg

SEQ ID NO: 382372 - DNA, 16 bp, M. musculus
catgaatatatgtatg

SEQ ID NO: 382373 - DNA, 16 bp, M. musculus
catgaatgaagctgaa

SEQ ID NO: 382374 - DNA, 16 bp, M. musculus
catgaatgttggtttt

SEQ ID NO: 382375 - DNA, 16 bp, M. musculus
catgaattcacagcag

SEQ ID NO: 382376 - DNA, 16 bp, M. musculus
catgaattcttttttt

SEQ ID NO: 382377 - DNA, 16 bp, M. musculus
catgaatttgaggaca

SEQ ID NO: 382378 - DNA, 16 bp, M. musculus
catgaatttttaaaat

SEQ ID NO: 382379 - DNA, 16 bp, M. musculus
catgaatttttcaggc

SEQ ID NO: 382380 - DNA, 16 bp, M. musculus
catgacaaaaaagcaa

SEQ ID NO: 382381 - DNA, 16 bp, M. musculus
catgacaaaataaaat

SEQ ID NO: 382382 - DNA, 16 bp, M. musculus
catgacaaatacagaa

SEQ ID NO: 382383 - DNA, 16 bp, M. musculus
catgacaaccagtcac

SEQ ID NO: 382384 - DNA, 16 bp, M. musculus
catgacagcctggatg

SEQ ID NO: 382385 - DNA, 16 bp, M. musculus
catgaccaaaaagaaa

SEQ ID NO: 382386 - DNA, 16 bp, M. musculus
catgaccaaaaatcaa

SEQ ID NO: 382387 - DNA, 16 bp, M. musculus
catgaccaagaaacag

SEQ ID NO: 382388 - DNA, 20 bp, M. musculus
catgaccaagaagcaagttg

SEQ ID NO: 382389 - DNA, 16 bp, M. musculus
catgaccaagaagcag

SEQ ID NO: 382390 - DNA, 16 bp, M. musculus
catgaccaaggcaaat

SEQ ID NO: 382391 - DNA, 16 bp, M. musculus
catgaccaatgcaact

SEQ ID NO: 382392 - DNA, 16 bp, M. musculus
catgactgtcctctga

SEQ ID NO: 382393 - DNA, 16 bp, M. musculus
catgagaaatggtctt

SEQ ID NO: 382394 - DNA, 16 bp, M. musculus
catgagaacctaagtt

SEQ ID NO: 382395 - DNA, 16 bp, M. musculus
catgagaacctgtctc

SEQ ID NO: 382396 - DNA, 16 bp, M. musculus
catgagaccctgggtt

SEQ ID NO: 382397 - DNA, 16 bp, M. musculus
catgagagtaaaccag

SEQ ID NO: 382398 - DNA, 16 bp, M. musculus
catgagagtctttatt

SEQ ID NO: 382399 - DNA, 16 bp, M. musculus
catgagatgatcacca

SEQ ID NO: 382400 - DNA, 16 bp, M. musculus
catgagatggaagaga

SEQ ID NO: 382401 - DNA, 16 bp, M. musculus
catgagatgtgctttt

SEQ ID NO: 382402 - DNA, 16 bp, M. musculus
catgagcaaaagcaag

SEQ ID NO: 382403 - DNA, 16 bp, M. musculus
catgagcacatggaga

SEQ ID NO: 382404 - DNA, 16 bp, M. musculus
catgagcctccactgt

SEQ ID NO: 382405 - DNA, 16 bp, M. musculus
catgagctccaactgt

SEQ ID NO: 382406 - DNA, 16 bp, M. musculus
catgagctcttggggt

SEQ ID NO: 382407 - DNA, 16 bp, M. musculus
catgagctgagcaagg

SEQ ID NO: 382408 - DNA, 16 bp, M. musculus
catgaggaactgtgtt

SEQ ID NO: 382409 - DNA, 16 bp, M. musculus
catgaggaaggctgag

SEQ ID NO: 382410 - DNA, 16 bp, M. musculus
catgaggacctgagtt

SEQ ID NO: 382411 - DNA, 16 bp, M. musculus
catgaggagcaagcca

SEQ ID NO: 382412 - DNA, 16 bp, M. musculus
catgaggaggaggagg

SEQ ID NO: 382413 - DNA, 16 bp, M. musculus
catgaggccctgggct

SEQ ID NO: 382414 - DNA, 16 bp, M. musculus
catgaggctttatttg

SEQ ID NO: 382415 - DNA, 16 bp, M. musculus
catgagttcaaattcc

SEQ ID NO: 382416 - DNA, 16 bp, M. musculus
catgagttctaccatg

SEQ ID NO: 382417 - DNA, 16 bp, M. musculus
catgagttctggggac

SEQ ID NO: 382418 - DNA, 16 bp, M. musculus
catgagtttgaagcta

SEQ ID NO: 382419 - DNA, 16 bp, M. musculus
catgataaaagccatc

SEQ ID NO: 382420 - DNA, 16 bp, M. musculus
catgataaggaagtaa

SEQ ID NO: 382421 - DNA, 16 bp, M. musculus
catgatagaagcaatc

SEQ ID NO: 382422 - DNA, 16 bp, M. musculus
catgatagaaggagag

SEQ ID NO: 382423 - DNA, 16 bp, M. musculus
catgatagaagtagaa

SEQ ID NO: 382424 - DNA, 16 bp, M. musculus
catgatagacacacac

SEQ ID NO: 382425 - DNA, 16 bp, M. musculus
catgatatgtccattg

SEQ ID NO: 382426 - DNA, 16 bp, M. musculus
catgatcaaagctcat

SEQ ID NO: 382427 - DNA, 16 bp, M. musculus
catgatcatcccatta

SEQ ID NO: 382428 - DNA, 16 bp, M. musculus
catgatgactaaggat

SEQ ID NO: 382429 - DNA, 16 bp, M. musculus
catgatgataatggac

SEQ ID NO: 382430 - DNA, 16 bp, M. musculus
catgatgatgatgaag

SEQ ID NO: 382431 - DNA, 16 bp, M. musculus
catgatgatgatgatg

SEQ ID NO: 382432 - DNA, 16 bp, M. musculus
catgatgatggcagag

SEQ ID NO: 382433 - DNA, 16 bp, M. musculus
catgatgatggtggag

SEQ ID NO: 382434 - DNA, 16 bp, M. musculus
catgatgcagttttta

SEQ ID NO: 382435 - DNA, 16 bp, M. musculus
catgatgctggagaag

SEQ ID NO: 382436 - DNA, 16 bp, M. musculus
catgatgctggagcag

SEQ ID NO: 382437 - DNA, 16 bp, M. musculus
catgatgctggaggag

SEQ ID NO: 382438 - DNA, 16 bp, M. musculus
catgatggactgtgtc

SEQ ID NO: 382439 - DNA, 16 bp, M. musculus
catgatggagggagag

SEQ ID NO: 382440 - DNA, 16 bp, M. musculus
catgatgggaagcatg

SEQ ID NO: 382441 - DNA, 42 bp, M. musculus
catgatgggatgtttcaaccatatgtgcttgagctgcccatt

SEQ ID NO: 382442 - DNA, 16 bp, M. musculus
catgatggtgcatgcc

SEQ ID NO: 382443 - DNA, 16 bp, M. musculus
catgatgtcttcagca

SEQ ID NO: 382444 - DNA, 16 bp, M. musculus
catgatgtttgtgcag

SEQ ID NO: 382445 - DNA, 16 bp, M. musculus
catgattattgtgttt

SEQ ID NO: 382446 - DNA, 16 bp, M. musculus
catgatttcatttttt

SEQ ID NO: 382447 - DNA, 16 bp, M. musculus
catgatttccttcctg

SEQ ID NO: 382448 - DNA, 16 bp, M. musculus
catgatttctttctca

SEQ ID NO: 382449 - DNA, 16 bp, M. musculus
catgattttttaaaat

SEQ ID NO: 382450 - DNA, 16 bp, M. musculus
catgcaaacatataca

SEQ ID NO: 382451 - DNA, 16 bp, M. musculus
catgcaaacatgcaaa

SEQ ID NO: 382452 - DNA, 43 bp, M. musculus
catgcaaaggtaaatactgcaaccccctacttataaagttcac

SEQ ID NO: 382453 - DNA, 16 bp, M. musculus
catgcaaatgaagcat

SEQ ID NO: 382454 - DNA, 16 bp, M. musculus
catgcaaatgaggcat

SEQ ID NO: 382455 - DNA, 16 bp, M. musculus
catgcaagaggccctg

SEQ ID NO: 382456 - DNA, 16 bp, M. musculus
catgcaagcaggaatc

SEQ ID NO: 382457 - DNA, 16 bp, M. musculus
catgcaagtgtacatg

SEQ ID NO: 382458 - DNA, 16 bp, M. musculus
catgcaatggcctctc

SEQ ID NO: 382459 - DNA, 16 bp, M. musculus
catgcacaaagcccca

SEQ ID NO: 382460 - DNA, 16 bp, M. musculus
catgcacaaggtcctg

SEQ ID NO: 382461 - DNA, 16 bp, M. musculus
catgcacacaaaaaca

SEQ ID NO: 382462 - DNA, 16 bp, M. musculus
catgcacacaaatgta

SEQ ID NO: 382463 - DNA, 16 bp, M. musculus
catgcacacacaaatg

SEQ ID NO: 382464 - DNA, 16 bp, M. musculus
catgcacacactcatg

SEQ ID NO: 382465 - DNA, 16 bp, M. musculus
catgcacacacttgtg

SEQ ID NO: 382466 - DNA, 16 bp, M. musculus
catgcacacagaaaca

SEQ ID NO: 382467 - DNA, 16 bp, M. musculus
catgcacacataaata

SEQ ID NO: 382468 - DNA, 16 bp, M. musculus
catgcacacatacaca

SEQ ID NO: 382469 - DNA, 16 bp, M. musculus
catgcacacataggca

SEQ ID NO: 382470 - DNA, 16 bp, M. musculus
catgcacacatctaca

SEQ ID NO: 382471 - DNA, 16 bp, M. musculus
catgcacacatgcaca

SEQ ID NO: 382472 - DNA, 16 bp, M. musculus
catgcacacatgtaca

SEQ ID NO: 382473 - DNA, 16 bp, M. musculus
catgcacacctttaat

SEQ ID NO: 382474 - DNA, 16 bp, M. musculus
catgcacacgcacaca

SEQ ID NO: 382475 - DNA, 16 bp, M. musculus
catgcacactcatgca

SEQ ID NO: 382476 - DNA, 16 bp, M. musculus
catgcacactgctgct

SEQ ID NO: 382477 - DNA, 16 bp, M. musculus
catgcacatacacaca

SEQ ID NO: 382478 - DNA, 16 bp, M. musculus
catgcacatgcgcaca

SEQ ID NO: 382479 - DNA, 16 bp, M. musculus
catgcacatggtacat

SEQ ID NO: 382480 - DNA, 16 bp, M. musculus
catgcacatgtacaca

SEQ ID NO: 382481 - DNA, 16 bp, M. musculus
catgcacatgtgcaca

SEQ ID NO: 382482 - DNA, 16 bp, M. musculus
catgcacatgtgcact

SEQ ID NO: 382483 - DNA, 16 bp, M. musculus
catgcacatgtgtgtg

SEQ ID NO: 382484 - DNA, 16 bp, M. musculus
catgcaccaccacacc

SEQ ID NO: 382485 - DNA, 16 bp, M. musculus
catgcaccaccacact

SEQ ID NO: 382486 - DNA, 16 bp, M. musculus
catgcaccaccacctc

SEQ ID NO: 382487 - DNA, 16 bp, M. musculus
catgcacctgtgtgtg

SEQ ID NO: 382488 - DNA, 16 bp, M. musculus
catgcacgaagccctg

SEQ ID NO: 382489 - DNA, 16 bp, M. musculus
catgcacgcatgcatg

SEQ ID NO: 382490 - DNA, 16 bp, M. musculus
catgcacgtgcatgca

SEQ ID NO: 382491 - DNA, 16 bp, M. musculus
catgcactaccaccac

SEQ ID NO: 382492 - DNA, 16 bp, M. musculus
catgcactcacataca

SEQ ID NO: 382493 - DNA, 16 bp, M. musculus
catgcactcatgcatg

SEQ ID NO: 382494 - DNA, 16 bp, M. musculus
catgcactcccacttc

SEQ ID NO: 382495 - DNA, 16 bp, M. musculus
catgcacttgtacaca

SEQ ID NO: 382496 - DNA, 16 bp, M. musculus
catgcagaagtcagaa

SEQ ID NO: 382497 - DNA, 16 bp, M. musculus
catgcagacaaaatat

SEQ ID NO: 382498 - DNA, 16 bp, M. musculus
catgcagacacagaca

SEQ ID NO: 382499 - DNA, 16 bp, M. musculus
catgcagaggccagag

SEQ ID NO: 382500 - DNA, 16 bp, M. musculus
catgcagaggtcagag

SEQ ID NO: 382501 - DNA, 16 bp, M. musculus
catgcagataaaacac

SEQ ID NO: 382502 - DNA, 16 bp, M. musculus
catgcagatacacata

SEQ ID NO: 382503 - DNA, 16 bp, M. musculus
catgcagatgtccctg

SEQ ID NO: 382504 - DNA, 16 bp, M. musculus
catgcagcaccacacc

SEQ ID NO: 382505 - DNA, 16 bp, M. musculus
catgcagcccaagcct

SEQ ID NO: 382506 - DNA, 16 bp, M. musculus
catgcaggaagacatg

SEQ ID NO: 382507 - DNA, 16 bp, M. musculus
catgcaggaggctgag

SEQ ID NO: 382508 - DNA, 16 bp, M. musculus
catgcaggatctaaaa

SEQ ID NO: 382509 - DNA, 16 bp, M. musculus
catgcaggcagaatac

SEQ ID NO: 382510 - DNA, 16 bp, M. musculus
catgcaggcatgcatg

SEQ ID NO: 382511 - DNA, 16 bp, M. musculus
catgcaggtaaaacat

SEQ ID NO: 382512 - DNA, 16 bp, M. musculus
catgcaggtgcctctg

SEQ ID NO: 382513 - DNA, 16 bp, M. musculus
catgcagtacctgtgg

SEQ ID NO: 382514 - DNA, 16 bp, M. musculus
catgcagtgcacacac

SEQ ID NO: 382515 - DNA, 16 bp, M. musculus
catgcagtttttgtct

SEQ ID NO: 382516 - DNA, 16 bp, M. musculus
catgcataaaaataaa

SEQ ID NO: 382517 - DNA, 16 bp, M. musculus
catgcataaacataca

SEQ ID NO: 382518 - DNA, 16 bp, M. musculus
catgcatacacataca

SEQ ID NO: 382519 - DNA, 16 bp, M. musculus
catgcatacacatatg

SEQ ID NO: 382520 - DNA, 16 bp, M. musculus
catgcatacatgcaca

SEQ ID NO: 382521 - DNA, 16 bp, M. musculus
catgcatacatgcatg

SEQ ID NO: 382522 - DNA, 16 bp, M. musculus
catgcatatacacata

SEQ ID NO: 382523 - DNA, 16 bp, M. musculus
catgcatatatgcaca

SEQ ID NO: 382524 - DNA, 16 bp, M. musculus
catgcatatttttaaa

SEQ ID NO: 382525 - DNA, 16 bp, M. musculus
catgcatgcaagcaca

SEQ ID NO: 382526 - DNA, 16 bp, M. musculus
catgcatgcatatgta

SEQ ID NO: 382527 - DNA, 16 bp, M. musculus
catgcatgcatgcatg

SEQ ID NO: 382528 - DNA, 16 bp, M. musculus
catgcatgccacacac

SEQ ID NO: 382529 - DNA, 16 bp, M. musculus
catgcatgccacagca

SEQ ID NO: 382530 - DNA, 16 bp, M. musculus
catgcatgcctgcctg

SEQ ID NO: 382531 - DNA, 16 bp, M. musculus
catgcatgctggcaaa

SEQ ID NO: 382532 - DNA, 16 bp, M. musculus
catgcatgtgtgtgta

SEQ ID NO: 382533 - DNA, 16 bp, M. musculus
catgcatgttaggcaa

SEQ ID NO: 382534 - DNA, 16 bp, M. musculus
catgccaagagcaaat

SEQ ID NO: 382535 - DNA, 16 bp, M. musculus
catgccacagtacaca

SEQ ID NO: 382536 - DNA, 16 bp, M. musculus
catgccacagtgcaca

SEQ ID NO: 382537 - DNA, 16 bp, M. musculus
catgccaccatgttcc

SEQ ID NO: 382538 - DNA, 16 bp, M. musculus
catgccagcctggatg

SEQ ID NO: 382539 - DNA, 16 bp, M. musculus
catgccaggcaagcac

SEQ ID NO: 382540 - DNA, 16 bp, M. musculus
catgccagtgcctggc

SEQ ID NO: 382541 - DNA, 16 bp, M. musculus
catgcccaacactgcc

SEQ ID NO: 382542 - DNA, 16 bp, M. musculus
catgcccaagatgacc

SEQ ID NO: 382543 - DNA, 16 bp, M. musculus
catgcccacactcaca

SEQ ID NO: 382544 - DNA, 16 bp, M. musculus
catgcccacagtgaca

SEQ ID NO: 382545 - DNA, 16 bp, M. musculus
catgcccagaggcttg

SEQ ID NO: 382546 - DNA, 16 bp, M. musculus
catgcccagcttttac

SEQ ID NO: 382547 - DNA, 16 bp, M. musculus
catgcccagttttatg

SEQ ID NO: 382548 - DNA, 16 bp, M. musculus
catgcccctgtggtat

SEQ ID NO: 382549 - DNA, 16 bp, M. musculus
catgccctccctcagc

SEQ ID NO: 382550 - DNA, 16 bp, M. musculus
catgcctataacctca

SEQ ID NO: 382551 - DNA, 16 bp, M. musculus
catgcctataatctca

SEQ ID NO: 382552 - DNA, 16 bp, M. musculus
catgcctataatgcca

SEQ ID NO: 382553 - DNA, 16 bp, M. musculus
catgcctatgatccca

SEQ ID NO: 382554 - DNA, 16 bp, M. musculus
catgcctcctgccatg

SEQ ID NO: 382555 - DNA, 16 bp, M. musculus
catgcctctaatccca

SEQ ID NO: 382556 - DNA, 16 bp, M. musculus
catgcctctagctgca

SEQ ID NO: 382557 - DNA, 16 bp, M. musculus
catgcctctgcctccc

SEQ ID NO: 382558 - DNA, 16 bp, M. musculus
catgcctctgtctccc

SEQ ID NO: 382559 - DNA, 16 bp, M. musculus
catgcctctgttgagg

SEQ ID NO: 382560 - DNA, 16 bp, M. musculus
catgcctgaagcctac

SEQ ID NO: 382561 - DNA, 16 bp, M. musculus
catgcctgacataaag

SEQ ID NO: 382562 - DNA, 16 bp, M. musculus
catgcctgcaacccca

SEQ ID NO: 382563 - DNA, 16 bp, M. musculus
catgcctgcacacaca

SEQ ID NO: 382564 - DNA, 16 bp, M. musculus
catgcctgccatccca

SEQ ID NO: 382565 - DNA, 16 bp, M. musculus
catgcctgcctgtctg

SEQ ID NO: 382566 - DNA, 16 bp, M. musculus
catgcctgctgcctgc

SEQ ID NO: 382567 - DNA, 16 bp, M. musculus
catgcctggcttcctt

SEQ ID NO: 382568 - DNA, 16 bp, M. musculus
catgcctggcttttga

SEQ ID NO: 382569 - DNA, 16 bp, M. musculus
catgcctgggcctaag

SEQ ID NO: 382570 - DNA, 16 bp, M. musculus
catgcctggtgtctgc

SEQ ID NO: 382571 - DNA, 16 bp, M. musculus
catgcctgtaatccag

SEQ ID NO: 382572 - DNA, 16 bp, M. musculus
catgcctgtctgcttc

SEQ ID NO: 382573 - DNA, 16 bp, M. musculus
catgcctgtgtgcatg

SEQ ID NO: 382574 - DNA, 16 bp, M. musculus
catgccttaatcccag

SEQ ID NO: 382575 - DNA, 16 bp, M. musculus
catgccttcaaggaaa

SEQ ID NO: 382576 - DNA, 16 bp, M. musculus
catgccttcaatctca

SEQ ID NO: 382577 - DNA, 16 bp, M. musculus
catgccttccctgcca

SEQ ID NO: 382578 - DNA, 16 bp, M. musculus
catgccttcctcacca

SEQ ID NO: 382579 - DNA, 16 bp, M. musculus
catgccttcctcctcc

SEQ ID NO: 382580 - DNA, 16 bp, M. musculus
catgcctttaatctta

SEQ ID NO: 382581 - DNA, 16 bp, M. musculus
catgcctttactccca

SEQ ID NO: 382582 - DNA, 16 bp, M. musculus
catgcgcacacacaca

SEQ ID NO: 382583 - DNA, 16 bp, M. musculus
catgcgcacacgcaca

SEQ ID NO: 382584 - DNA, 23 bp, M. musculus
catgcgccaccactgcctggctt

SEQ ID NO: 382585 - DNA, 16 bp, M. musculus
catgctaggcaagcat

SEQ ID NO: 382586 - DNA, 16 bp, M. musculus
catgctaggcaagggc

SEQ ID NO: 382587 - DNA, 16 bp, M. musculus
catgctcactgctgct

SEQ ID NO: 382588 - DNA, 16 bp, M. musculus
catgctcagtctgatg

SEQ ID NO: 382589 - DNA, 16 bp, M. musculus
catgctcatggattgg

SEQ ID NO: 382590 - DNA, 16 bp, M. musculus
catgctccaccacacc

SEQ ID NO: 382591 - DNA, 16 bp, M. musculus
catgctcccagccatg

SEQ ID NO: 382592 - DNA, 16 bp, M. musculus
catgctccctgccatg

SEQ ID NO: 382593 - DNA, 16 bp, M. musculus
catgctcctgctgcca

SEQ ID NO: 382594 - DNA, 16 bp, M. musculus
catgctcctgtaaata

SEQ ID NO: 382595 - DNA, 16 bp, M. musculus
catgctcttctggctt

SEQ ID NO: 382596 - DNA, 16 bp, M. musculus
catgctgacctcaaac

SEQ ID NO: 382597 - DNA, 16 bp, M. musculus
catgctgactggtgtg

SEQ ID NO: 382598 - DNA, 16 bp, M. musculus
catgctgagaccctca

SEQ ID NO: 382599 - DNA, 16 bp, M. musculus
catgctgatgctggga

SEQ ID NO: 382600 - DNA, 16 bp, M. musculus
catgctgcacatctgc

SEQ ID NO: 382601 - DNA, 16 bp, M. musculus
catgctgggagaagga

SEQ ID NO: 382602 - DNA, 16 bp, M. musculus
catgctgggatcacag

SEQ ID NO: 382603 - DNA, 16 bp, M. musculus
catgctgggcaagtgc

SEQ ID NO: 382604 - DNA, 16 bp, M. musculus
catgctgggcgtggtg

SEQ ID NO: 382605 - DNA, 16 bp, M. musculus
catgctgggctcctgt

SEQ ID NO: 382606 - DNA, 16 bp, M. musculus
catgctgtttttatta

SEQ ID NO: 382607 - DNA, 16 bp, M. musculus
catgcttcctctaaca

SEQ ID NO: 382608 - DNA, 16 bp, M. musculus
catgcttcctggccct

SEQ ID NO: 382609 - DNA, 16 bp, M. musculus
catgcttctcttgtgg

SEQ ID NO: 382610 - DNA, 16 bp, M. musculus
catgcttctgcagtgt

SEQ ID NO: 382611 - DNA, 16 bp, M. musculus
catgcttctgtctcct

SEQ ID NO: 382612 - DNA, 16 bp, M. musculus
catgcttgcatgcatg

SEQ ID NO: 382613 - DNA, 16 bp, M. musculus
catgcttgcatggcaa

SEQ ID NO: 382614 - DNA, 16 bp, M. musculus
catgcttgctttcttt

SEQ ID NO: 382615 - DNA, 16 bp, M. musculus
catgcttgtaatccca

SEQ ID NO: 382616 - DNA, 16 bp, M. musculus
catgcttgtaattcca

SEQ ID NO: 382617 - DNA, 16 bp, M. musculus
catgcttgtgtctgct

SEQ ID NO: 382618 - DNA, 16 bp, M. musculus
catgcttgtttgtttg

SEQ ID NO: 382619 - DNA, 16 bp, M. musculus
catgcttttaatctca

SEQ ID NO: 382620 - DNA, 16 bp, M. musculus
catgcttttgtatctt

SEQ ID NO: 382621 - DNA, 16 bp, M. musculus
catgctttttaaaaat

SEQ ID NO: 382622 - DNA, 16 bp, M. musculus
catggaaaaatattgt

SEQ ID NO: 382623 - DNA, 16 bp, M. musculus
catggaaacagaaaca

SEQ ID NO: 382624 - DNA, 16 bp, M. musculus
catggaaacaggaact

SEQ ID NO: 382625 - DNA, 16 bp, M. musculus
catggaaataaataaa

SEQ ID NO: 382626 - DNA, 16 bp, M. musculus
catggaaatccccaaa

SEQ ID NO: 382627 - DNA, 16 bp, M. musculus
catggaactggtatag

SEQ ID NO: 382628 - DNA, 16 bp, M. musculus
catggaagaaattaaa

SEQ ID NO: 382629 - DNA, 16 bp, M. musculus
catggaagaaggaaag

SEQ ID NO: 382630 - DNA, 16 bp, M. musculus
catggaagaggaggag

SEQ ID NO: 382631 - DNA, 16 bp, M. musculus
catggaagccagaaga

SEQ ID NO: 382632 - DNA, 16 bp, M. musculus
catggaagctgaacaa

SEQ ID NO: 382633 - DNA, 16 bp, M. musculus
catggaaggaagccag

SEQ ID NO: 382634 - DNA, 16 bp, M. musculus
catggaatatcttggt

SEQ ID NO: 382635 - DNA, 16 bp, M. musculus
catggaatatgttctt

SEQ ID NO: 382636 - DNA, 16 bp, M. musculus
catggacaccaggcat

SEQ ID NO: 382637 - DNA, 16 bp, M. musculus
catggacagtgactaa

SEQ ID NO: 382638 - DNA, 16 bp, M. musculus
catggacccttccttg

SEQ ID NO: 382639 - DNA, 16 bp, M. musculus
catggacctgaccaag

SEQ ID NO: 382640 - DNA, 16 bp, M. musculus
catggactaaggcaga

SEQ ID NO: 382641 - DNA, 16 bp, M. musculus
catggactctaaccct

SEQ ID NO: 382642 - DNA, 16 bp, M. musculus
catggactggaaggga

SEQ ID NO: 382643 - DNA, 16 bp, M. musculus
catggactggaccaag

SEQ ID NO: 382644 - DNA, 16 bp, M. musculus
catggacttccactca

SEQ ID NO: 382645 - DNA, 16 bp, M. musculus
catggagaaacccatg

SEQ ID NO: 382646 - DNA, 16 bp, M. musculus
catggagaaattggat

SEQ ID NO: 382647 - DNA, 16 bp, M. musculus
catggagacattttct

SEQ ID NO: 382648 - DNA, 16 bp, M. musculus
catggagaccaagctg

SEQ ID NO: 382649 - DNA, 16 bp, M. musculus
catggagaccagaagg

SEQ ID NO: 382650 - DNA, 16 bp, M. musculus
catggagaccagaggt

SEQ ID NO: 382651 - DNA, 16 bp, M. musculus
catggagagaaagaga

SEQ ID NO: 382652 - DNA, 16 bp, M. musculus
catggagagaagttga

SEQ ID NO: 382653 - DNA, 16 bp, M. musculus
catggagagagaaaga

SEQ ID NO: 382654 - DNA, 16 bp, M. musculus
catggagaggtcagag

SEQ ID NO: 382655 - DNA, 16 bp, M. musculus
catggagatcctgcag

SEQ ID NO: 382656 - DNA, 16 bp, M. musculus
catggagattcagagt

SEQ ID NO: 382657 - DNA, 16 bp, M. musculus
catggagccatttctc

SEQ ID NO: 382658 - DNA, 16 bp, M. musculus
catggagctctggggg

SEQ ID NO: 382659 - DNA, 16 bp, M. musculus
catggagctggagaag

SEQ ID NO: 382660 - DNA, 16 bp, M. musculus
catggagctgggagga

SEQ ID NO: 382661 - DNA, 16 bp, M. musculus
catggaggaggaggtg

SEQ ID NO: 382662 - DNA, 16 bp, M. musculus
catggaggaggcagag

SEQ ID NO: 382663 - DNA, 16 bp, M. musculus
catggaggcagaacac

SEQ ID NO: 382664 - DNA, 16 bp, M. musculus
catggaggcagagcac

SEQ ID NO: 382665 - DNA, 16 bp, M. musculus
catggaggccagaaga

SEQ ID NO: 382666 - DNA, 16 bp, M. musculus
catggaggccagaagc

SEQ ID NO: 382667 - DNA, 16 bp, M. musculus
catggaggccagggac

SEQ ID NO: 382668 - DNA, 16 bp, M. musculus
catggagggtgctgct

SEQ ID NO: 382669 - DNA, 16 bp, M. musculus
catggaggtcagagaa

SEQ ID NO: 382670 - DNA, 16 bp, M. musculus
catggaggttagaaga

SEQ ID NO: 382671 - DNA, 16 bp, M. musculus
catggagtcagcctgg

SEQ ID NO: 382672 - DNA, 16 bp, M. musculus
catggagttagaaaga

SEQ ID NO: 382673 - DNA, 16 bp, M. musculus
catggagttggtacag

SEQ ID NO: 382674 - DNA, 16 bp, M. musculus
catggatacacacatg

SEQ ID NO: 382675 - DNA, 16 bp, M. musculus
catggatattttgttt

SEQ ID NO: 382676 - DNA, 16 bp, M. musculus
catggatcagtagaat

SEQ ID NO: 382677 - DNA, 16 bp, M. musculus
catggatctccctgga

SEQ ID NO: 382678 - DNA, 16 bp, M. musculus
catggatgaactgggt

SEQ ID NO: 382679 - DNA, 16 bp, M. musculus
catggatgggtgctgc

SEQ ID NO: 382680 - DNA, 16 bp, M. musculus
catggatgtctgtgtg

SEQ ID NO: 382681 - DNA, 16 bp, M. musculus
catggatgtgtgcatg

SEQ ID NO: 382682 - DNA, 16 bp, M. musculus
catggattctgaggat

SEQ ID NO: 382683 - DNA, 16 bp, M. musculus
catggcaaacatggct

SEQ ID NO: 382684 - DNA, 16 bp, M. musculus
catggcaaatacagaa

SEQ ID NO: 382685 - DNA, 17 bp, M. musculus
catggcaatcctcctgc

SEQ ID NO: 382686 - DNA, 16 bp, M. musculus
catggcaatgtccagg

SEQ ID NO: 382687 - DNA, 16 bp, M. musculus
catggcaattctcctg

SEQ ID NO: 382688 - DNA, 16 bp, M. musculus
catggcacaggcagag

SEQ ID NO: 382689 - DNA, 16 bp, M. musculus
catggcacatcaagtc

SEQ ID NO: 382690 - DNA, 16 bp, M. musculus
catggcacatgccttt

SEQ ID NO: 382691 - DNA, 16 bp, M. musculus
catggcactggagaag

SEQ ID NO: 382692 - DNA, 16 bp, M. musculus
catggcagagaagcag

SEQ ID NO: 382693 - DNA, 16 bp, M. musculus
catggcagagagttgt

SEQ ID NO: 382694 - DNA, 16 bp, M. musculus
catggcagcacccagg

SEQ ID NO: 382695 - DNA, 16 bp, M. musculus
catggcagcaggcaga

SEQ ID NO: 382696 - DNA, 16 bp, M. musculus
catggcagcaggcagc

SEQ ID NO: 382697 - DNA, 16 bp, M. musculus
catggcagcaggcagg

SEQ ID NO: 382698 - DNA, 16 bp, M. musculus
catggcagcatccagg

SEQ ID NO: 382699 - DNA, 16 bp, M. musculus
catggcagccaggaag

SEQ ID NO: 382700 - DNA, 16 bp, M. musculus
catggcagcttacaaa

SEQ ID NO: 382701 - DNA, 16 bp, M. musculus
catggcaggaaaactg

SEQ ID NO: 382702 - DNA, 16 bp, M. musculus
catggcaggaagcctg

SEQ ID NO: 382703 - DNA, 16 bp, M. musculus
catggcagggaacatg

SEQ ID NO: 382704 - DNA, 16 bp, M. musculus
catggcagggaagtca

SEQ ID NO: 382705 - DNA, 16 bp, M. musculus
catggcagggagcatg

SEQ ID NO: 382706 - DNA, 16 bp, M. musculus
catggcagtattcagg

SEQ ID NO: 382707 - DNA, 16 bp, M. musculus
catggcagtgggcagg

SEQ ID NO: 382708 - DNA, 16 bp, M. musculus
catggcagtgtgtgtg

SEQ ID NO: 382709 - DNA, 16 bp, M. musculus
catggcagtttccagg

SEQ ID NO: 382710 - DNA, 16 bp, M. musculus
catggccaaaagcaat

SEQ ID NO: 382711 - DNA, 16 bp, M. musculus
catggccaagaggaga

SEQ ID NO: 382712 - DNA, 16 bp, M. musculus
catggccaaggcagct

SEQ ID NO: 382713 - DNA, 16 bp, M. musculus
catggccaagtccaag

SEQ ID NO: 382714 - DNA, 16 bp, M. musculus
catggccagccaggct

SEQ ID NO: 382715 - DNA, 16 bp, M. musculus
catggccagcctcttc

SEQ ID NO: 382716 - DNA, 16 bp, M. musculus
catggccatcatggtg

SEQ ID NO: 382717 - DNA, 16 bp, M. musculus
catggccatggccatg

SEQ ID NO: 382718 - DNA, 16 bp, M. musculus
catggcccatgttacc

SEQ ID NO: 382719 - DNA, 16 bp, M. musculus
catggccctcagcagc

SEQ ID NO: 382720 - DNA, 16 bp, M. musculus
catggccctggtgttc

SEQ ID NO: 382721 - DNA, 16 bp, M. musculus
catggcctaatgtaca

SEQ ID NO: 382722 - DNA, 16 bp, M. musculus
catggcctcaggtggc

SEQ ID NO: 382723 - DNA, 16 bp, M. musculus
catggcctctctctct

SEQ ID NO: 382724 - DNA, 16 bp, M. musculus
catggcctctgctcag

SEQ ID NO: 382725 - DNA, 16 bp, M. musculus
catggcctctggtggc

SEQ ID NO: 382726 - DNA, 16 bp, M. musculus
catggcctctgtttca

SEQ ID NO: 382727 - DNA, 16 bp, M. musculus
catggcctgaagaaac

SEQ ID NO: 382728 - DNA, 16 bp, M. musculus
catggcgcacgccttt

SEQ ID NO: 382729 - DNA, 16 bp, M. musculus
catggctatcctggaa

SEQ ID NO: 382730 - DNA, 16 bp, M. musculus
catggctcactgttct

SEQ ID NO: 382731 - DNA, 16 bp, M. musculus
catggctcagtggtta

SEQ ID NO: 382732 - DNA, 16 bp, M. musculus
catggctccaactgca

SEQ ID NO: 382733 - DNA, 16 bp, M. musculus
catggctccagatgca

SEQ ID NO: 382734 - DNA, 16 bp, M. musculus
catggctccagcccca

SEQ ID NO: 382735 - DNA, 16 bp, M. musculus
catggctcctgctgca

SEQ ID NO: 382736 - DNA, 17 bp, M. musculus
catggctctagctggat

SEQ ID NO: 382737 - DNA, 16 bp, M. musculus
catggctctcctctga

SEQ ID NO: 382738 - DNA, 16 bp, M. musculus
catggctctggaggag

SEQ ID NO: 382739 - DNA, 16 bp, M. musculus
catggctctgtctcct

SEQ ID NO: 382740 - DNA, 16 bp, M. musculus
catggctgacctggaa

SEQ ID NO: 382741 - DNA, 16 bp, M. musculus
catggctgaggccatg

SEQ ID NO: 382742 - DNA, 16 bp, M. musculus
catggctgcccacttt

SEQ ID NO: 382743 - DNA, 16 bp, M. musculus
catggctgctgctctc

SEQ ID NO: 382744 - DNA, 16 bp, M. musculus
catggctgctgggggc

SEQ ID NO: 382745 - DNA, 16 bp, M. musculus
catggctggcctagaa

SEQ ID NO: 382746 - DNA, 16 bp, M. musculus
catggctggctggctg

SEQ ID NO: 382747 - DNA, 16 bp, M. musculus
catggcttcagctgca

SEQ ID NO: 382748 - DNA, 16 bp, M. musculus
catggcttcctcagcc

SEQ ID NO: 382749 - DNA, 16 bp, M. musculus
catggcttctgcatcc

SEQ ID NO: 382750 - DNA, 16 bp, M. musculus
catggcttgaaactaa

SEQ ID NO: 382751 - DNA, 16 bp, M. musculus
catggcttgctctgcc

SEQ ID NO: 382752 - DNA, 16 bp, M. musculus
catggctttggcatct

SEQ ID NO: 382753 - DNA, 16 bp, M. musculus
catgggaaatccaagg

SEQ ID NO: 382754 - DNA, 16 bp, M. musculus
catgggaacagccctg

SEQ ID NO: 382755 - DNA, 16 bp, M. musculus
catgggaatgccaggg

SEQ ID NO: 382756 - DNA, 16 bp, M. musculus
catgggacactttcaa

SEQ ID NO: 382757 - DNA, 16 bp, M. musculus
catgggactgagcaac

SEQ ID NO: 382758 - DNA, 16 bp, M. musculus
catgggactggaggag

SEQ ID NO: 382759 - DNA, 16 bp, M. musculus
catgggagaagataca

SEQ ID NO: 382760 - DNA, 16 bp, M. musculus
catgggagaagggggg

SEQ ID NO: 382761 - DNA, 16 bp, M. musculus
catgggaggaacaaca

SEQ ID NO: 382762 - DNA, 16 bp, M. musculus
catgggatggttctca

SEQ ID NO: 382763 - DNA, 16 bp, M. musculus
catgggcacatacaca

SEQ ID NO: 382764 - DNA, 16 bp, M. musculus
catgggcacctgcact

SEQ ID NO: 382765 - DNA, 16 bp, M. musculus
catgggccaagatggc

SEQ ID NO: 382766 - DNA, 16 bp, M. musculus
catgggcccaccgagg

SEQ ID NO: 382767 - DNA, 16 bp, M. musculus
catgggctgcagcaag

SEQ ID NO: 382768 - DNA, 16 bp, M. musculus
catgggcttttgaaac

SEQ ID NO: 382769 - DNA, 16 bp, M. musculus
catggggaagcaggaa

SEQ ID NO: 382770 - DNA, 16 bp, M. musculus
catggggacacacaca

SEQ ID NO: 382771 - DNA, 16 bp, M. musculus
catggggaccccagtg

SEQ ID NO: 382772 - DNA, 16 bp, M. musculus
catggggctggcatgg

SEQ ID NO: 382773 - DNA, 16 bp, M. musculus
catggggctggggaga

SEQ ID NO: 382774 - DNA, 16 bp, M. musculus
catggggtctcttcac

SEQ ID NO: 382775 - DNA, 16 bp, M. musculus
catggggtggagaaat

SEQ ID NO: 382776 - DNA, 16 bp, M. musculus
catgggtattctgaac

SEQ ID NO: 382777 - DNA, 16 bp, M. musculus
catgggtattttgttc

SEQ ID NO: 382778 - DNA, 16 bp, M. musculus
catgggtcctggggat

SEQ ID NO: 382779 - DNA, 16 bp, M. musculus
catgggtctgcaccag

SEQ ID NO: 382780 - DNA, 16 bp, M. musculus
catgggtcttgcctca

SEQ ID NO: 382781 - DNA, 16 bp, M. musculus
catgggtgctgggatc

SEQ ID NO: 382782 - DNA, 16 bp, M. musculus
catgggtggatggatg

SEQ ID NO: 382783 - DNA, 16 bp, M. musculus
catgggtgtgtgtgtg

SEQ ID NO: 382784 - DNA, 16 bp, M. musculus
catgggttctggggat

SEQ ID NO: 382785 - DNA, 16 bp, M. musculus
catgggttctggggct

SEQ ID NO: 382786 - DNA, 16 bp, M. musculus
catgggttttctgacc

SEQ ID NO: 382787 - DNA, 16 bp, M. musculus
catggtagcatccagg

SEQ ID NO: 382788 - DNA, 16 bp, M. musculus
catggtaggactcatg

SEQ ID NO: 382789 - DNA, 16 bp, M. musculus
catggtaggagagaat

SEQ ID NO: 382790 - DNA, 16 bp, M. musculus
catggtatggactcac

SEQ ID NO: 382791 - DNA, 16 bp, M. musculus
catggtattttattat

SEQ ID NO: 382792 - DNA, 16 bp, M. musculus
catggtcaattttgga

SEQ ID NO: 382793 - DNA, 16 bp, M. musculus
catggtcatggtcatg

SEQ ID NO: 382794 - DNA, 16 bp, M. musculus
catggtcatggtgtct

SEQ ID NO: 382795 - DNA, 16 bp, M. musculus
catggtccaggaggag

SEQ ID NO: 382796 - DNA, 16 bp, M. musculus
catggtccataaaatg

SEQ ID NO: 382797 - DNA, 16 bp, M. musculus
catggtctacagagct

SEQ ID NO: 382798 - DNA, 16 bp, M. musculus
catggtctcactctgt

SEQ ID NO: 382799 - DNA, 16 bp, M. musculus
catggtgacacacatc

SEQ ID NO: 382800 - DNA, 16 bp, M. musculus
catggtgacaggaaca

SEQ ID NO: 382801 - DNA, 16 bp, M. musculus
catggtgacgcatgcc

SEQ ID NO: 382802 - DNA, 16 bp, M. musculus
catggtgactgttcac

SEQ ID NO: 382803 - DNA, 16 bp, M. musculus
catggtgacttacaac

SEQ ID NO: 382804 - DNA, 16 bp, M. musculus
catggtgatctgatag

SEQ ID NO: 382805 - DNA, 16 bp, M. musculus
catggtgatgcacatc

SEQ ID NO: 382806 - DNA, 16 bp, M. musculus
catggtgattccacag

SEQ ID NO: 382807 - DNA, 16 bp, M. musculus
catggtgcacctgcac

SEQ ID NO: 382808 - DNA, 16 bp, M. musculus
catggtgcagacagag

SEQ ID NO: 382809 - DNA, 16 bp, M. musculus
catggtgcaggagagg

SEQ ID NO: 382810 - DNA, 16 bp, M. musculus
catggtgctgaagaag

SEQ ID NO: 382811 - DNA, 16 bp, M. musculus
catggtgctggaaatg

SEQ ID NO: 382812 - DNA, 16 bp, M. musculus
catggtgctggagagg

SEQ ID NO: 382813 - DNA, 16 bp, M. musculus
catggtgctggagatg

SEQ ID NO: 382814 - DNA, 16 bp, M. musculus
catggtgctggaggat

SEQ ID NO: 382815 - DNA, 16 bp, M. musculus
catggtgctggagggg

SEQ ID NO: 382816 - DNA, 16 bp, M. musculus
catggtgctggccaca

SEQ ID NO: 382817 - DNA, 16 bp, M. musculus
catggtgctggggaag

SEQ ID NO: 382818 - DNA, 16 bp, M. musculus
catggtgctggggcag

SEQ ID NO: 382819 - DNA, 16 bp, M. musculus
catggtggaaaatgga

SEQ ID NO: 382820 - DNA, 16 bp, M. musculus
catggtggaagaagaa

SEQ ID NO: 382821 - DNA, 16 bp, M. musculus
catggtggaaggagaa

SEQ ID NO: 382822 - DNA, 16 bp, M. musculus
catggtggaaggagag

SEQ ID NO: 382823 - DNA, 16 bp, M. musculus
catggtggcacacaca

SEQ ID NO: 382824 - DNA, 16 bp, M. musculus
catggtggcacacact

SEQ ID NO: 382825 - DNA, 16 bp, M. musculus
catggtggcatttcct

SEQ ID NO: 382826 - DNA, 16 bp, M. musculus
catggtggcccacagc

SEQ ID NO: 382827 - DNA, 16 bp, M. musculus
catggtggctcacacc

SEQ ID NO: 382828 - DNA, 16 bp, M. musculus
catggtggcttctcct

SEQ ID NO: 382829 - DNA, 16 bp, M. musculus
catggtgggaaccatg

SEQ ID NO: 382830 - DNA, 16 bp, M. musculus
catggtggggaatctt

SEQ ID NO: 382831 - DNA, 16 bp, M. musculus
catggtggtgaacacc

SEQ ID NO: 382832 - DNA, 16 bp, M. musculus
catggtggtgcacaac

SEQ ID NO: 382833 - DNA, 16 bp, M. musculus
catggtggtgcaggcc

SEQ ID NO: 382834 - DNA, 16 bp, M. musculus
catggtggttcataac

SEQ ID NO: 382835 - DNA, 16 bp, M. musculus
catggtgtccacactt

SEQ ID NO: 382836 - DNA, 16 bp, M. musculus
catggtgtctcctgga

SEQ ID NO: 382837 - DNA, 16 bp, M. musculus
catggtgtgtgtgtgt

SEQ ID NO: 382838 - DNA, 16 bp, M. musculus
catggtgttagagaag

SEQ ID NO: 382839 - DNA, 16 bp, M. musculus
catggtgttggagcag

SEQ ID NO: 382840 - DNA, 16 bp, M. musculus
catggtgttttaccac

SEQ ID NO: 382841 - DNA, 16 bp, M. musculus
catggttccagctgca

SEQ ID NO: 382842 - DNA, 16 bp, M. musculus
catggttcttcaaagg

SEQ ID NO: 382843 - DNA, 16 bp, M. musculus
catggtttcactttta

SEQ ID NO: 382844 - DNA, 16 bp, M. musculus
catggtttccctcttg

SEQ ID NO: 382845 - DNA, 16 bp, M. musculus
catgtaacccagactg

SEQ ID NO: 382846 - DNA, 16 bp, M. musculus
catgtaactccagttc

SEQ ID NO: 382847 - DNA, 16 bp, M. musculus
catgtacaagtgtgtg

SEQ ID NO: 382848 - DNA, 16 bp, M. musculus
catgtacacaatggaa

SEQ ID NO: 382849 - DNA, 16 bp, M. musculus
catgtacacacaggca

SEQ ID NO: 382850 - DNA, 16 bp, M. musculus
catgtacacactcatg

SEQ ID NO: 382851 - DNA, 16 bp, M. musculus
catgtacacaggcaca

SEQ ID NO: 382852 - DNA, 16 bp, M. musculus
catgtacacatgtatg

SEQ ID NO: 382853 - DNA, 16 bp, M. musculus
catgtacacattcaca

SEQ ID NO: 382854 - DNA, 16 bp, M. musculus
catgtacacgcacaca

SEQ ID NO: 382855 - DNA, 16 bp, M. musculus
catgtacactcacaca

SEQ ID NO: 382856 - DNA, 16 bp, M. musculus
catgtacagacacata

SEQ ID NO: 382857 - DNA, 16 bp, M. musculus
catgtacatacacaca

SEQ ID NO: 382858 - DNA, 16 bp, M. musculus
catgtacatatataca

SEQ ID NO: 382859 - DNA, 16 bp, M. musculus
catgtacatatgcaca

SEQ ID NO: 382860 - DNA, 16 bp, M. musculus
catgtacatgcacaca

SEQ ID NO: 382861 - DNA, 16 bp, M. musculus
catgtacatgtatatg

SEQ ID NO: 382862 - DNA, 16 bp, M. musculus
catgtaccaccaggcc

SEQ ID NO: 382863 - DNA, 16 bp, M. musculus
catgtaccactacacc

SEQ ID NO: 382864 - DNA, 16 bp, M. musculus
catgtacctgtacaca

SEQ ID NO: 382865 - DNA, 16 bp, M. musculus
catgtagaagaaagca

SEQ ID NO: 382866 - DNA, 16 bp, M. musculus
catgtagaagccagaa

SEQ ID NO: 382867 - DNA, 16 bp, M. musculus
catgtagagattgcca

SEQ ID NO: 382868 - DNA, 16 bp, M. musculus
catgtagccatggctg

SEQ ID NO: 382869 - DNA, 17 bp, M. musculus
catgtagcccaggctga

SEQ ID NO: 382870 - DNA, 16 bp, M. musculus
catgtagccctggctg

SEQ ID NO: 382871 - DNA, 16 bp, M. musculus
catgtaggacaccaga

SEQ ID NO: 382872 - DNA, 16 bp, M. musculus
catgtagtgattgcca

SEQ ID NO: 382873 - DNA, 16 bp, M. musculus
catgtagttgttggga

SEQ ID NO: 382874 - DNA, 16 bp, M. musculus
catgtatactcacaca

SEQ ID NO: 382875 - DNA, 16 bp, M. musculus
catgtatactctttgt

SEQ ID NO: 382876 - DNA, 16 bp, M. musculus
catgtatataatatgt

SEQ ID NO: 382877 - DNA, 16 bp, M. musculus
catgtatatatgtttg

SEQ ID NO: 382878 - DNA, 16 bp, M. musculus
catgtatatctgtatg

SEQ ID NO: 382879 - DNA, 16 bp, M. musculus
catgtatatgtatgta

SEQ ID NO: 382880 - DNA, 16 bp, M. musculus
catgtatatgtgtatt

SEQ ID NO: 382881 - DNA, 16 bp, M. musculus
catgtatatgtgtgtg

SEQ ID NO: 382882 - DNA, 16 bp, M. musculus
catgtatatttttaaa

SEQ ID NO: 382883 - DNA, 16 bp, M. musculus
catgtatgaagccctg

SEQ ID NO: 382884 - DNA, 16 bp, M. musculus
catgtatgagtgtttt

SEQ ID NO: 382885 - DNA, 16 bp, M. musculus
catgtatgcacatgca

SEQ ID NO: 382886 - DNA, 16 bp, M. musculus
catgtatgcacatgtg

SEQ ID NO: 382887 - DNA, 16 bp, M. musculus
catgtatgcatatgta

SEQ ID NO: 382888 - DNA, 16 bp, M. musculus
catgtatgcatgtgta

SEQ ID NO: 382889 - DNA, 16 bp, M. musculus
catgtatgcctgtgta

SEQ ID NO: 382890 - DNA, 16 bp, M. musculus
catgtatgcttgtgta

SEQ ID NO: 382891 - DNA, 16 bp, M. musculus
catgtatgcttgtgtg

SEQ ID NO: 382892 - DNA, 16 bp, M. musculus
catgtatgtacacaca

SEQ ID NO: 382893 - DNA, 17 bp, M. musculus
catgtatgtatatatgt

SEQ ID NO: 382894 - DNA, 16 bp, M. musculus
catgtatgtatgtgca

SEQ ID NO: 382895 - DNA, 16 bp, M. musculus
catgtatgtctataca

SEQ ID NO: 382896 - DNA, 16 bp, M. musculus
catgtatgtctgtgtg

SEQ ID NO: 382897 - DNA, 16 bp, M. musculus
catgtatgtctttctg

SEQ ID NO: 382898 - DNA, 16 bp, M. musculus
catgtatgtgcaccat

SEQ ID NO: 382899 - DNA, 16 bp, M. musculus
catgtatgtgcccaca

SEQ ID NO: 382900 - DNA, 16 bp, M. musculus
catgtatgtgtatatt

SEQ ID NO: 382901 - DNA, 16 bp, M. musculus
catgtatgtgtgaatg

SEQ ID NO: 382902 - DNA, 16 bp, M. musculus
catgtatgttatggtt

SEQ ID NO: 382903 - DNA, 16 bp, M. musculus
catgtatgttttctgt

SEQ ID NO: 382904 - DNA, 16 bp, M. musculus
catgtattctgaaaga

SEQ ID NO: 382905 - DNA, 16 bp, M. musculus
catgtatttatttgtg

SEQ ID NO: 382906 - DNA, 16 bp, M. musculus
catgtatttatttgtt

SEQ ID NO: 382907 - DNA, 16 bp, M. musculus
catgtccacacacaca

SEQ ID NO: 382908 - DNA, 16 bp, M. musculus
catgtccagcaagcac

SEQ ID NO: 382909 - DNA, 16 bp, M. musculus
catgtccagtgggcct

SEQ ID NO: 382910 - DNA, 16 bp, M. musculus
catgtcccagaagctg

SEQ ID NO: 382911 - DNA, 16 bp, M. musculus
catgtccctccctccc

SEQ ID NO: 382912 - DNA, 16 bp, M. musculus
catgtccgtgtgtgtg

SEQ ID NO: 382913 - DNA, 16 bp, M. musculus
catgtctacacacaca

SEQ ID NO: 382914 - DNA, 16 bp, M. musculus
catgtctatgtgtgtg

SEQ ID NO: 382915 - DNA, 16 bp, M. musculus
catgtctccagccaca

SEQ ID NO: 382916 - DNA, 16 bp, M. musculus
catgtctccagcccct

SEQ ID NO: 382917 - DNA, 16 bp, M. musculus
catgtctccatttggt

SEQ ID NO: 382918 - DNA, 16 bp, M. musculus
catgtctcctggaccc

SEQ ID NO: 382919 - DNA, 16 bp, M. musculus
catgtctgaaaaaaaa

SEQ ID NO: 382920 - DNA, 16 bp, M. musculus
catgtctgcattccag

SEQ ID NO: 382921 - DNA, 16 bp, M. musculus
catgtctgcctgcaca

SEQ ID NO: 382922 - DNA, 16 bp, M. musculus
catgtctgggtccatg

SEQ ID NO: 382923 - DNA, 16 bp, M. musculus
catgtctgtctcctct

SEQ ID NO: 382924 - DNA, 16 bp, M. musculus
catgtctgtctgtctg

SEQ ID NO: 382925 - DNA, 16 bp, M. musculus
catgtctgtgtctgtg

SEQ ID NO: 382926 - DNA, 16 bp, M. musculus
catgtctgtgtgaagg

SEQ ID NO: 382927 - DNA, 16 bp, M. musculus
catgtctgtgtgtgca

SEQ ID NO: 382928 - DNA, 16 bp, M. musculus
catgtcttctgtgaca

SEQ ID NO: 382929 - DNA, 16 bp, M. musculus
catgtctttaatccca

SEQ ID NO: 382930 - DNA, 16 bp, M. musculus
catgtctttagtccca

SEQ ID NO: 382931 - DNA, 16 bp, M. musculus
catgtctttctttctg

SEQ ID NO: 382932 - DNA, 16 bp, M. musculus
catgtctttgaagaat

SEQ ID NO: 382933 - DNA, 16 bp, M. musculus
catgtgaaaggacaca

SEQ ID NO: 382934 - DNA, 16 bp, M. musculus
catgtgaacacacaga

SEQ ID NO: 382935 - DNA, 16 bp, M. musculus
catgtgacacaactga

SEQ ID NO: 382936 - DNA, 16 bp, M. musculus
catgtgacatgtgaca

SEQ ID NO: 382937 - DNA, 16 bp, M. musculus
catgtgaccagctgcc

SEQ ID NO: 382938 - DNA, 16 bp, M. musculus
catgtgagaccctgtc

SEQ ID NO: 382939 - DNA, 16 bp, M. musculus
catgtgagtgcaggtg

SEQ ID NO: 382940 - DNA, 16 bp, M. musculus
catgtgagtgctgaga

SEQ ID NO: 382941 - DNA, 16 bp, M. musculus
catgtgagttccaggg

SEQ ID NO: 382942 - DNA, 16 bp, M. musculus
catgtgatgctgggaa

SEQ ID NO: 382943 - DNA, 16 bp, M. musculus
catgtgatgtttgtct

SEQ ID NO: 382944 - DNA, 16 bp, M. musculus
catgtgattttttttc

SEQ ID NO: 382945 - DNA, 16 bp, M. musculus
catgtgcacacacaaa

SEQ ID NO: 382946 - DNA, 16 bp, M. musculus
catgtgcacacaccac

SEQ ID NO: 382947 - DNA, 16 bp, M. musculus
catgtgcacacacttg

SEQ ID NO: 382948 - DNA, 16 bp, M. musculus
catgtgcacacagaga

SEQ ID NO: 382949 - DNA, 16 bp, M. musculus
catgtgcacacatcca

SEQ ID NO: 382950 - DNA, 16 bp, M. musculus
catgtgcacatacaca

SEQ ID NO: 382951 - DNA, 16 bp, M. musculus
catgtgcacctgcaca

SEQ ID NO: 382952 - DNA, 16 bp, M. musculus
catgtgcacgcacatg

SEQ ID NO: 382953 - DNA, 16 bp, M. musculus
catgtgcacgtgtgtg

SEQ ID NO: 382954 - DNA, 16 bp, M. musculus
catgtgcaggtgtgtg

SEQ ID NO: 382955 - DNA, 16 bp, M. musculus
catgtgcatcacacac

SEQ ID NO: 382956 - DNA, 16 bp, M. musculus
catgtgcatctgtgtg

SEQ ID NO: 382957 - DNA, 16 bp, M. musculus
catgtgcatgcacaca

SEQ ID NO: 382958 - DNA, 16 bp, M. musculus
catgtgcatgcacatg

SEQ ID NO: 382959 - DNA, 16 bp, M. musculus
catgtgcatgcttggt

SEQ ID NO: 382960 - DNA, 16 bp, M. musculus
catgtgcatgtgggtg

SEQ ID NO: 382961 - DNA, 16 bp, M. musculus
catgtgcatgttcatg

SEQ ID NO: 382962 - DNA, 16 bp, M. musculus
catgtgccacagcatg

SEQ ID NO: 382963 - DNA, 16 bp, M. musculus
catgtgccaccacacc

SEQ ID NO: 382964 - DNA, 16 bp, M. musculus
catgtgccaccactgc

SEQ ID NO: 382965 - DNA, 16 bp, M. musculus
catgtgccaccatatc

SEQ ID NO: 382966 - DNA, 16 bp, M. musculus
catgtgccaccatgcc

SEQ ID NO: 382967 - DNA, 16 bp, M. musculus
catgtgccaggccctg

SEQ ID NO: 382968 - DNA, 16 bp, M. musculus
catgtgcgagtgtgtg

SEQ ID NO: 382969 - DNA, 16 bp, M. musculus
catgtgctcatggcca

SEQ ID NO: 382970 - DNA, 16 bp, M. musculus
catgtgctctcctgtg

SEQ ID NO: 382971 - DNA, 16 bp, M. musculus
catgtgctctgccttt

SEQ ID NO: 382972 - DNA, 16 bp, M. musculus
catgtgctgtcacttg

SEQ ID NO: 382973 - DNA, 16 bp, M. musculus
catgtgcttgctggga

SEQ ID NO: 382974 - DNA, 16 bp, M. musculus
catgtgcttgtatgtg

SEQ ID NO: 382975 - DNA, 16 bp, M. musculus
catgtggaagaatgca

SEQ ID NO: 382976 - DNA, 16 bp, M. musculus
catgtggaagccagag

SEQ ID NO: 382977 - DNA, 16 bp, M. musculus
catgtggagagagagg

SEQ ID NO: 382978 - DNA, 16 bp, M. musculus
catgtggagagtcctc

SEQ ID NO: 382979 - DNA, 16 bp, M. musculus
catgtggaggcccaag

SEQ ID NO: 382980 - DNA, 16 bp, M. musculus
catgtggaggctggag

SEQ ID NO: 382981 - DNA, 16 bp, M. musculus
catgtggaggtcagag

SEQ ID NO: 382982 - DNA, 16 bp, M. musculus
catgtggaggtcaggg

SEQ ID NO: 382983 - DNA, 16 bp, M. musculus
catgtggagttccttg

SEQ ID NO: 382984 - DNA, 16 bp, M. musculus
catgtggatgctggga

SEQ ID NO: 382985 - DNA, 16 bp, M. musculus
catgtggcagcttaca

SEQ ID NO: 382986 - DNA, 16 bp, M. musculus
catgtggctgaagctg

SEQ ID NO: 382987 - DNA, 16 bp, M. musculus
catgtggctgctggga

SEQ ID NO: 382988 - DNA, 16 bp, M. musculus
catgtgggcacagggg

SEQ ID NO: 382989 - DNA, 16 bp, M. musculus
catgtgggccctgggg

SEQ ID NO: 382990 - DNA, 16 bp, M. musculus
catgtgggtgctagga

SEQ ID NO: 382991 - DNA, 16 bp, M. musculus
catgtgggtgttggga

SEQ ID NO: 382992 - DNA, 16 bp, M. musculus
catgtgggttttttct

SEQ ID NO: 382993 - DNA, 16 bp, M. musculus
catgtggtcactggga

SEQ ID NO: 382994 - DNA, 16 bp, M. musculus
catgtggtctctgaat

SEQ ID NO: 382995 - DNA, 16 bp, M. musculus
catgtggtctgtgaat

SEQ ID NO: 382996 - DNA, 16 bp, M. musculus
catgtggtggaagaag

SEQ ID NO: 382997 - DNA, 16 bp, M. musculus
catgtggtggctcaca

SEQ ID NO: 382998 - DNA, 16 bp, M. musculus
catgtggtgtgtgtat

SEQ ID NO: 382999 - DNA, 16 bp, M. musculus
catgtggttgctagga

SEQ ID NO: 383000 - DNA, 16 bp, M. musculus
catgtggttgctggaa

SEQ ID NO: 383001 - DNA, 26 bp, M. musculus
catgtggttgctgggatttgaactca

SEQ ID NO: 383002 - DNA, 16 bp, M. musculus
catgtggttgctgggc

SEQ ID NO: 383003 - DNA, 16 bp, M. musculus
catgtggttgctgggt

SEQ ID NO: 383004 - DNA, 16 bp, M. musculus
catgtggttgttgaga

SEQ ID NO: 383005 - DNA, 16 bp, M. musculus
catgtggttgttggga

SEQ ID NO: 383006 - DNA, 16 bp, M. musculus
catgtgtacacatatg

SEQ ID NO: 383007 - DNA, 16 bp, M. musculus
catgtgtatacacaca

SEQ ID NO: 383008 - DNA, 16 bp, M. musculus
catgtgtatatatgca

SEQ ID NO: 383009 - DNA, 16 bp, M. musculus
catgtgtatctgtgtg

SEQ ID NO: 383010 - DNA, 16 bp, M. musculus
catgtgtatgcatgca

SEQ ID NO: 383011 - DNA, 16 bp, M. musculus
catgtgtatgtacata

SEQ ID NO: 383012 - DNA, 16 bp, M. musculus
catgtgtatgtataca

SEQ ID NO: 383013 - DNA, 16 bp, M. musculus
catgtgtatgtgagct

SEQ ID NO: 383014 - DNA, 16 bp, M. musculus
catgtgtatgtgagtg

SEQ ID NO: 383015 - DNA, 16 bp, M. musculus
catgtgtatgtgcctg

SEQ ID NO: 383016 - DNA, 16 bp, M. musculus
catgtgtatgtgtgca

SEQ ID NO: 383017 - DNA, 16 bp, M. musculus
catgtgtatgtgtttg

SEQ ID NO: 383018 - DNA, 16 bp, M. musculus
catgtgtccacacaca

SEQ ID NO: 383019 - DNA, 16 bp, M. musculus
catgtgtcctggttat

SEQ ID NO: 383020 - DNA, 16 bp, M. musculus
catgtgtgaatgtatg

SEQ ID NO: 383021 - DNA, 16 bp, M. musculus
catgtgtgagcatgag

SEQ ID NO: 383022 - DNA, 16 bp, M. musculus
catgtgtgagtgtttg

SEQ ID NO: 383023 - DNA, 16 bp, M. musculus
catgtgtgcacacgtg

SEQ ID NO: 383024 - DNA, 16 bp, M. musculus
catgtgtgcatacaca

SEQ ID NO: 383025 - DNA, 16 bp, M. musculus
catgtgtgcataccca

SEQ ID NO: 383026 - DNA, 16 bp, M. musculus
catgtgtgcatatgga

SEQ ID NO: 383027 - DNA, 16 bp, M. musculus
catgtgtgcatgtgca

SEQ ID NO: 383028 - DNA, 17 bp, M. musculus
catgtgtgcatgtgtgt

SEQ ID NO: 383029 - DNA, 19 bp, M. musculus
catgtgtgcattactccca

SEQ ID NO: 383030 - DNA, 16 bp, M. musculus
catgtgtgccatggca

SEQ ID NO: 383031 - DNA, 16 bp, M. musculus
catgtgtgccatgtgt

SEQ ID NO: 383032 - DNA, 16 bp, M. musculus
catgtgtgcctgcatg

SEQ ID NO: 383033 - DNA, 16 bp, M. musculus
catgtgtgcctggatg

SEQ ID NO: 383034 - DNA, 16 bp, M. musculus
catgtgtgcctggtgc

SEQ ID NO: 383035 - DNA, 16 bp, M. musculus
catgtgtgcgtgcgtg

SEQ ID NO: 383036 - DNA, 16 bp, M. musculus
catgtgtgctgtgaca

SEQ ID NO: 383037 - DNA, 16 bp, M. musculus
catgtgtgctgtggca

SEQ ID NO: 383038 - DNA, 16 bp, M. musculus
catgtgtgcttctgtg

SEQ ID NO: 383039 - DNA, 16 bp, M. musculus
catgtgtgggcacaca

SEQ ID NO: 383040 - DNA, 16 bp, M. musculus
catgtgtgggctgcct

SEQ ID NO: 383041 - DNA, 16 bp, M. musculus
catgtgtgggttttac

SEQ ID NO: 383042 - DNA, 16 bp, M. musculus
catgtgtgtatatatg

SEQ ID NO: 383043 - DNA, 16 bp, M. musculus
catgtgtgtatgcaca

SEQ ID NO: 383044 - DNA, 16 bp, M. musculus
catgtgtgtatgtgta

SEQ ID NO: 383045 - DNA, 16 bp, M. musculus
catgtgtgtctttctg

SEQ ID NO: 383046 - DNA, 16 bp, M. musculus
catgtgtgtgactgtg

SEQ ID NO: 383047 - DNA, 16 bp, M. musculus
catgtgtgtgcaggag

SEQ ID NO: 383048 - DNA, 16 bp, M. musculus
catgtgtgtgcagtgt

SEQ ID NO: 383049 - DNA, 27 bp, M. musculus
catgtgtgtgcccactgatgaagccca

SEQ ID NO: 383050 - DNA, 16 bp, M. musculus
catgtgtgtgctggtg

SEQ ID NO: 383051 - DNA, 16 bp, M. musculus
catgtgtgtggctgtg

SEQ ID NO: 383052 - DNA, 16 bp, M. musculus
catgtgtgtgtacctg

SEQ ID NO: 383053 - DNA, 16 bp, M. musculus
catgtgtgtgtatata

SEQ ID NO: 383054 - DNA, 16 bp, M. musculus
catgtgtgtgtctgag

SEQ ID NO: 383055 - DNA, 16 bp, M. musculus
catgtgtgtgtgcaca

SEQ ID NO: 383056 - DNA, 17 bp, M. musculus
catgtgtgtgtgtgcac

SEQ ID NO: 383057 - DNA, 17 bp, M. musculus
catgtgtgtgtgtgtgc

SEQ ID NO: 383058 - DNA, 16 bp, M. musculus
catgtgtgttcacaca

SEQ ID NO: 383059 - DNA, 16 bp, M. musculus
catgtgtgttcttgtg

SEQ ID NO: 383060 - DNA, 16 bp, M. musculus
catgtgtgttttgtgt

SEQ ID NO: 383061 - DNA, 16 bp, M. musculus
catgtgttcttctgtg

SEQ ID NO: 383062 - DNA, 16 bp, M. musculus
catgtgtttgaacatt

SEQ ID NO: 383063 - DNA, 16 bp, M. musculus
catgtgtttgcatgtg

SEQ ID NO: 383064 - DNA, 16 bp, M. musculus
catgtgtttgtgtgtg

SEQ ID NO: 383065 - DNA, 16 bp, M. musculus
catgtgttttacatat

SEQ ID NO: 383066 - DNA, 16 bp, M. musculus
catgtgttttgtgatt

SEQ ID NO: 383067 - DNA, 16 bp, M. musculus
catgtgtttttcttac

SEQ ID NO: 383068 - DNA, 16 bp, M. musculus
catgttattttatcat

SEQ ID NO: 383069 - DNA, 16 bp, M. musculus
catgttcactgctgct

SEQ ID NO: 383070 - DNA, 16 bp, M. musculus
catgttcataaaagaa

SEQ ID NO: 383071 - DNA, 16 bp, M. musculus
catgttcatagcagcc

SEQ ID NO: 383072 - DNA, 16 bp, M. musculus
catgttccagcctcag

SEQ ID NO: 383073 - DNA, 16 bp, M. musculus
catgttcccatcttga

SEQ ID NO: 383074 - DNA, 16 bp, M. musculus
catgttcctgccttga

SEQ ID NO: 383075 - DNA, 16 bp, M. musculus
catgttcctggtagcc

SEQ ID NO: 383076 - DNA, 16 bp, M. musculus
catgttctacagtgtg

SEQ ID NO: 383077 - DNA, 16 bp, M. musculus
catgttcttaactgct

SEQ ID NO: 383078 - DNA, 16 bp, M. musculus
catgttgaaaaaataa

SEQ ID NO: 383079 - DNA, 16 bp, M. musculus
catgttgatgctggga

SEQ ID NO: 383080 - DNA, 16 bp, M. musculus
catgttggctgtctct

SEQ ID NO: 383081 - DNA, 16 bp, M. musculus
catgttggtactggga

SEQ ID NO: 383082 - DNA, 16 bp, M. musculus
catgttgtagtgaccc

SEQ ID NO: 383083 - DNA, 16 bp, M. musculus
catgtttacaactgag

SEQ ID NO: 383084 - DNA, 16 bp, M. musculus
catgtttatgtatggg

SEQ ID NO: 383085 - DNA, 16 bp, M. musculus
catgtttatgtgtgtg

SEQ ID NO: 383086 - DNA, 16 bp, M. musculus
catgtttattttttaa

SEQ ID NO: 383087 - DNA, 16 bp, M. musculus
catgtttcccgccatg

SEQ ID NO: 383088 - DNA, 16 bp, M. musculus
catgtttctctttctg

SEQ ID NO: 383089 - DNA, 16 bp, M. musculus
catgtttgaggccagc

SEQ ID NO: 383090 - DNA, 16 bp, M. musculus
catgtttgatttcctg

SEQ ID NO: 383091 - DNA, 16 bp, M. musculus
catgtttgctatccca

SEQ ID NO: 383092 - DNA, 16 bp, M. musculus
catgtttgtaatccca

SEQ ID NO: 383093 - DNA, 16 bp, M. musculus
catgtttgtgatggtg

SEQ ID NO: 383094 - DNA, 16 bp, M. musculus
catgttttctgtttct

SEQ ID NO: 383095 - DNA, 16 bp, M. musculus
catgtttttaaagaaa

SEQ ID NO: 383096 - DNA, 16 bp, M. musculus
cattaaaaaatgaggt

SEQ ID NO: 383097 - DNA, 16 bp, M. musculus
cattaaaaacacttta

SEQ ID NO: 383098 - DNA, 16 bp, M. musculus
cattaaaaatatttca

SEQ ID NO: 383099 - DNA, 16 bp, M. musculus
cattaaaaatggggta

SEQ ID NO: 383100 - DNA, 16 bp, M. musculus
cattaaaaatttgaac

SEQ ID NO: 383101 - DNA, 16 bp, M. musculus
cattaaaatacaagca

SEQ ID NO: 383102 - DNA, 16 bp, M. musculus
cattaaaattattttg

SEQ ID NO: 383103 - DNA, 17 bp, M. musculus
cattaaactacctcatg

SEQ ID NO: 383104 - DNA, 16 bp, M. musculus
cattaaactctaaagt

SEQ ID NO: 383105 - DNA, 16 bp, M. musculus
cattaaactcttaaaa

SEQ ID NO: 383106 - DNA, 16 bp, M. musculus
cattaaagaaaactga

SEQ ID NO: 383107 - DNA, 16 bp, M. musculus
cattaaagaggaaaca

SEQ ID NO: 383108 - DNA, 16 bp, M. musculus
cattaaagtggacaca

SEQ ID NO: 383109 - DNA, 16 bp, M. musculus
cattaaagttgagtct

SEQ ID NO: 383110 - DNA, 16 bp, M. musculus
cattaaattctcaaaa

SEQ ID NO: 383111 - DNA, 16 bp, M. musculus
cattaacagtctccca

SEQ ID NO: 383112 - DNA, 16 bp, M. musculus
cattaaccccagcact

SEQ ID NO: 383113 - DNA, 16 bp, M. musculus
cattaagaaaatgaaa

SEQ ID NO: 383114 - DNA, 16 bp, M. musculus
cattaagaaaatgttt

SEQ ID NO: 383115 - DNA, 16 bp, M. musculus
cattaagattcataac

SEQ ID NO: 383116 - DNA, 16 bp, M. musculus
cattaaggaaatgcaa

SEQ ID NO: 383117 - DNA, 16 bp, M. musculus
cattaatcaagaaaat

SEQ ID NO: 383118 - DNA, 16 bp, M. musculus
cattaatcaaggaaat

SEQ ID NO: 383119 - DNA, 16 bp, M. musculus
cattaatcccagcact

SEQ ID NO: 383120 - DNA, 16 bp, M. musculus
cattaatcctagcact

SEQ ID NO: 383121 - DNA, 22 bp, M. musculus
cattaatggcaaatacatcagt

SEQ ID NO: 383122 - DNA, 16 bp, M. musculus
cattaatgggagaaga

SEQ ID NO: 383123 - DNA, 16 bp, M. musculus
cattaatttcctttta

SEQ ID NO: 383124 - DNA, 16 bp, M. musculus
cattacagatggttgc

SEQ ID NO: 383125 - DNA, 16 bp, M. musculus
cattacagatggttgt

SEQ ID NO: 383126 - DNA, 16 bp, M. musculus
cattacagatggtttt

SEQ ID NO: 383127 - DNA, 16 bp, M. musculus
cattacagattgttgt

SEQ ID NO: 383128 - DNA, 16 bp, M. musculus
cattaccatcaccacc

SEQ ID NO: 383129 - DNA, 16 bp, M. musculus
cattactattccaaaa

SEQ ID NO: 383130 - DNA, 16 bp, M. musculus
cattagaattactgca

SEQ ID NO: 383131 - DNA, 16 bp, M. musculus
cattagactctaaaaa

SEQ ID NO: 383132 - DNA, 16 bp, M. musculus
cattagaggaactgta

SEQ ID NO: 383133 - DNA, 16 bp, M. musculus
cattagatgttgaaaa

SEQ ID NO: 383134 - DNA, 16 bp, M. musculus
cattagctcctgcctc

SEQ ID NO: 383135 - DNA, 16 bp, M. musculus
cattaggtcccatttg

SEQ ID NO: 383136 - DNA, 16 bp, M. musculus
cattagttaataaaat

SEQ ID NO: 383137 - DNA, 16 bp, M. musculus
cattataaactaacca

SEQ ID NO: 383138 - DNA, 16 bp, M. musculus
cattatagaaaaccac

SEQ ID NO: 383139 - DNA, 16 bp, M. musculus
cattatatagatgata

SEQ ID NO: 383140 - DNA, 16 bp, M. musculus
cattatatgctgaaaa

SEQ ID NO: 383141 - DNA, 16 bp, M. musculus
cattatcacagagaaa

SEQ ID NO: 383142 - DNA, 16 bp, M. musculus
cattatcatcaaggag

SEQ ID NO: 383143 - DNA, 16 bp, M. musculus
cattatctgtctttaa

SEQ ID NO: 383144 - DNA, 16 bp, M. musculus
cattatcttctaagct

SEQ ID NO: 383145 - DNA, 16 bp, M. musculus
cattatgaacatagtg

SEQ ID NO: 383146 - DNA, 16 bp, M. musculus
cattatgatgagaaaa

SEQ ID NO: 383147 - DNA, 19 bp, M. musculus
cattatgattcataacagc

SEQ ID NO: 383148 - DNA, 16 bp, M. musculus
cattattccctcattt

SEQ ID NO: 383149 - DNA, 16 bp, M. musculus
cattattgtaaagtca

SEQ ID NO: 383150 - DNA, 16 bp, M. musculus
cattcaaaccaccaca

SEQ ID NO: 383151 - DNA, 16 bp, M. musculus
cattcaaactactaca

SEQ ID NO: 383152 - DNA, 16 bp, M. musculus
cattcaaagaaaatca

SEQ ID NO: 383153 - DNA, 16 bp, M. musculus
cattcaaagatgatgc

SEQ ID NO: 383154 - DNA, 16 bp, M. musculus
cattcaaatttttcca

SEQ ID NO: 383155 - DNA, 16 bp, M. musculus
cattcaacccccaaag

SEQ ID NO: 383156 - DNA, 16 bp, M. musculus
cattcaactcccaaag

SEQ ID NO: 383157 - DNA, 16 bp, M. musculus
cattcaataaagaaac

SEQ ID NO: 383158 - DNA, 16 bp, M. musculus
cattcaatgaagccaa

SEQ ID NO: 383159 - DNA, 16 bp, M. musculus
cattcacacacactct

SEQ ID NO: 383160 - DNA, 16 bp, M. musculus
cattcacagtcaagag

SEQ ID NO: 383161 - DNA, 16 bp, M. musculus
cattcacatacacata

SEQ ID NO: 383162 - DNA, 16 bp, M. musculus
cattcacatgcatgca

SEQ ID NO: 383163 - DNA, 16 bp, M. musculus
cattcacatgtgcaca

SEQ ID NO: 383164 - DNA, 16 bp, M. musculus
cattcacattcaaacc

SEQ ID NO: 383165 - DNA, 16 bp, M. musculus
cattcaccactacacc

SEQ ID NO: 383166 - DNA, 16 bp, M. musculus
cattcactcactcact

SEQ ID NO: 383167 - DNA, 16 bp, M. musculus
cattcactcctgcttc

SEQ ID NO: 383168 - DNA, 16 bp, M. musculus
cattcagacttgcctc

SEQ ID NO: 383169 - DNA, 16 bp, M. musculus
cattcagagtgggtct

SEQ ID NO: 383170 - DNA, 16 bp, M. musculus
cattcaggcagggacc

SEQ ID NO: 383171 - DNA, 16 bp, M. musculus
cattcagtattccaca

SEQ ID NO: 383172 - DNA, 16 bp, M. musculus
cattcatacacagaaa

SEQ ID NO: 383173 - DNA, 16 bp, M. musculus
cattcatacacataaa

SEQ ID NO: 383174 - DNA, 16 bp, M. musculus
cattcatacacatatg

SEQ ID NO: 383175 - DNA, 16 bp, M. musculus
cattcatagctatcct

SEQ ID NO: 383176 - DNA, 16 bp, M. musculus
cattcatattgttgtt

SEQ ID NO: 383177 - DNA, 16 bp, M. musculus
cattcatcatcatcat

SEQ ID NO: 383178 - DNA, 16 bp, M. musculus
cattcatctctctctc

SEQ ID NO: 383179 - DNA, 16 bp, M. musculus
cattcatggcctctgc

SEQ ID NO: 383180 - DNA, 16 bp, M. musculus
cattcatgtgtacata

SEQ ID NO: 383181 - DNA, 16 bp, M. musculus
cattcattcactcatt

SEQ ID NO: 383182 - DNA, 16 bp, M. musculus
cattcattcattcaaa

SEQ ID NO: 383183 - DNA, 16 bp, M. musculus
cattcattcattcttt

SEQ ID NO: 383184 - DNA, 16 bp, M. musculus
cattcattccaaaaga

SEQ ID NO: 383185 - DNA, 16 bp, M. musculus
cattcattcgttcatt

SEQ ID NO: 383186 - DNA, 16 bp, M. musculus
cattcattgaagatgc

SEQ ID NO: 383187 - DNA, 16 bp, M. musculus
cattcatttacatttc

SEQ ID NO: 383188 - DNA, 16 bp, M. musculus
cattcatttgtatttt

SEQ ID NO: 383189 - DNA, 16 bp, M. musculus
cattcattttttaaaa

SEQ ID NO: 383190 - DNA, 16 bp, M. musculus
cattccacttcctggc

SEQ ID NO: 383191 - DNA, 16 bp, M. musculus
cattccagaggcagag

SEQ ID NO: 383192 - DNA, 16 bp, M. musculus
cattccagattttatt

SEQ ID NO: 383193 - DNA, 16 bp, M. musculus
cattccatccaggttt

SEQ ID NO: 383194 - DNA, 16 bp, M. musculus
cattcccagcctccct

SEQ ID NO: 383195 - DNA, 16 bp, M. musculus
cattccccactgctac

SEQ ID NO: 383196 - DNA, 16 bp, M. musculus
cattccccagctgaag

SEQ ID NO: 383197 - DNA, 16 bp, M. musculus
cattccccctgtactg

SEQ ID NO: 383198 - DNA, 16 bp, M. musculus
cattcccctactctgg

SEQ ID NO: 383199 - DNA, 16 bp, M. musculus
cattcccctgtattga

SEQ ID NO: 383200 - DNA, 17 bp, M. musculus
cattcccgccaattcat

SEQ ID NO: 383201 - DNA, 16 bp, M. musculus
cattccctggaactgg

SEQ ID NO: 383202 - DNA, 16 bp, M. musculus
cattccctggccccca

SEQ ID NO: 383203 - DNA, 20 bp, M. musculus
cattcctaagaacagcttga

SEQ ID NO: 383204 - DNA, 16 bp, M. musculus
cattcctaagagaaaa

SEQ ID NO: 383205 - DNA, 16 bp, M. musculus
cattcctaagtgtcag

SEQ ID NO: 383206 - DNA, 16 bp, M. musculus
cattcctaatgctgtg

SEQ ID NO: 383207 - DNA, 16 bp, M. musculus
cattcctacttcctgg

SEQ ID NO: 383208 - DNA, 16 bp, M. musculus
cattcctcaggagcca

SEQ ID NO: 383209 - DNA, 16 bp, M. musculus
cattcctctgatgagg

SEQ ID NO: 383210 - DNA, 16 bp, M. musculus
cattcctctgtggagg

SEQ ID NO: 383211 - DNA, 53 bp, M. musculus
cattcctctgttgaggggcatctgggttctttccagcttctggctattataaa

SEQ ID NO: 383212 - DNA, 16 bp, M. musculus
cattcctgacctaaag

SEQ ID NO: 383213 - DNA, 16 bp, M. musculus
cattcctgcatccctg

SEQ ID NO: 383214 - DNA, 16 bp, M. musculus
cattcctgggctggtg

SEQ ID NO: 383215 - DNA, 16 bp, M. musculus
cattcctgggtcttca

SEQ ID NO: 383216 - DNA, 16 bp, M. musculus
cattccttcagtttct

SEQ ID NO: 383217 - DNA, 16 bp, M. musculus
cattccttcttagaag

SEQ ID NO: 383218 - DNA, 16 bp, M. musculus
cattccttgttcacaa

SEQ ID NO: 383219 - DNA, 16 bp, M. musculus
cattccttgtttgcaa

SEQ ID NO: 383220 - DNA, 16 bp, M. musculus
cattcctttaatccta

SEQ ID NO: 383221 - DNA, 16 bp, M. musculus
cattctaacacagacc

SEQ ID NO: 383222 - DNA, 16 bp, M. musculus
cattctcatggccatc

SEQ ID NO: 383223 - DNA, 16 bp, M. musculus
cattctcattcaaacc

SEQ ID NO: 383224 - DNA, 16 bp, M. musculus
cattctcccaccttga

SEQ ID NO: 383225 - DNA, 16 bp, M. musculus
cattctcctggccttc

SEQ ID NO: 383226 - DNA, 16 bp, M. musculus
cattctcctgtccctc

SEQ ID NO: 383227 - DNA, 16 bp, M. musculus
cattctcctgtctctg

SEQ ID NO: 383228 - DNA, 16 bp, M. musculus
cattctctccttccac

SEQ ID NO: 383229 - DNA, 16 bp, M. musculus
cattctctccttctac

SEQ ID NO: 383230 - DNA, 17 bp, M. musculus
cattctctctgccaaaa

SEQ ID NO: 383231 - DNA, 16 bp, M. musculus
cattctctctgctctt

SEQ ID NO: 383232 - DNA, 16 bp, M. musculus
cattctctcttctatc

SEQ ID NO: 383233 - DNA, 16 bp, M. musculus
cattctctgctacaaa

SEQ ID NO: 383234 - DNA, 16 bp, M. musculus
cattctctgctatata

SEQ ID NO: 383235 - DNA, 16 bp, M. musculus
cattctctgcttcctg

SEQ ID NO: 383236 - DNA, 16 bp, M. musculus
cattctctgtctgtct

SEQ ID NO: 383237 - DNA, 16 bp, M. musculus
cattctcttcctgctg

SEQ ID NO: 383238 - DNA, 16 bp, M. musculus
cattctctttctgaca

SEQ ID NO: 383239 - DNA, 16 bp, M. musculus
cattctgaagggtccc

SEQ ID NO: 383240 - DNA, 17 bp, M. musculus
cattctgactagtgtga

SEQ ID NO: 383241 - DNA, 16 bp, M. musculus
cattctgattgctgta

SEQ ID NO: 383242 - DNA, 16 bp, M. musculus
cattctgattggtgga

SEQ ID NO: 383243 - DNA, 16 bp, M. musculus
cattctggaaatcatt

SEQ ID NO: 383244 - DNA, 16 bp, M. musculus
cattctggaacattct

SEQ ID NO: 383245 - DNA, 16 bp, M. musculus
cattctggccttcctg

SEQ ID NO: 383246 - DNA, 16 bp, M. musculus
cattctgtaaatgtat

SEQ ID NO: 383247 - DNA, 16 bp, M. musculus
cattctgtgttaagaa

SEQ ID NO: 383248 - DNA, 16 bp, M. musculus
cattctgttggtttcc

SEQ ID NO: 383249 - DNA, 16 bp, M. musculus
cattcttatatttctg

SEQ ID NO: 383250 - DNA, 16 bp, M. musculus
cattcttattgaaacc

SEQ ID NO: 383251 - DNA, 16 bp, M. musculus
cattcttctaaacaaa

SEQ ID NO: 383252 - DNA, 20 bp, M. musculus
cattcttctacacgataaca

SEQ ID NO: 383253 - DNA, 16 bp, M. musculus
cattcttctgctttta

SEQ ID NO: 383254 - DNA, 16 bp, M. musculus
cattcttctgttgagg

SEQ ID NO: 383255 - DNA, 16 bp, M. musculus
cattcttcttcacctt

SEQ ID NO: 383256 - DNA, 16 bp, M. musculus
cattcttcttgggttt

SEQ ID NO: 383257 - DNA, 16 bp, M. musculus
cattcttgagtaaaaa

SEQ ID NO: 383258 - DNA, 16 bp, M. musculus
cattcttttgttgttg

SEQ ID NO: 383259 - DNA, 16 bp, M. musculus
cattctttttagtagc

SEQ ID NO: 383260 - DNA, 16 bp, M. musculus
cattgaaaatgagaaa

SEQ ID NO: 383261 - DNA, 16 bp, M. musculus
cattgaaagagcccat

SEQ ID NO: 383262 - DNA, 16 bp, M. musculus
cattgaacacagagaa

SEQ ID NO: 383263 - DNA, 16 bp, M. musculus
cattgaacctggagtt

SEQ ID NO: 383264 - DNA, 16 bp, M. musculus
cattgaagacccagaa

SEQ ID NO: 383265 - DNA, 16 bp, M. musculus
cattgaaggaagccag

SEQ ID NO: 383266 - DNA, 16 bp, M. musculus
cattgaatcctgggag

SEQ ID NO: 383267 - DNA, 16 bp, M. musculus
cattgaattctagaaa

SEQ ID NO: 383268 - DNA, 16 bp, M. musculus
cattgacaaaggaaat

SEQ ID NO: 383269 - DNA, 16 bp, M. musculus
cattgacacaatggag

SEQ ID NO: 383270 - DNA, 16 bp, M. musculus
cattgacctctggctt

SEQ ID NO: 383271 - DNA, 16 bp, M. musculus
cattgactcctgggag

SEQ ID NO: 383272 - DNA, 16 bp, M. musculus
cattgactcgtttgag

SEQ ID NO: 383273 - DNA, 16 bp, M. musculus
cattgagaaccactgc

SEQ ID NO: 383274 - DNA, 16 bp, M. musculus
cattgagaagtgtgtt

SEQ ID NO: 383275 - DNA, 16 bp, M. musculus
cattgaggtgacatct

SEQ ID NO: 383276 - DNA, 16 bp, M. musculus
cattgagtgcatattc

SEQ ID NO: 383277 - DNA, 16 bp, M. musculus
cattgatattttgatt

SEQ ID NO: 383278 - DNA, 16 bp, M. musculus
cattgatgaattggct

SEQ ID NO: 383279 - DNA, 16 bp, M. musculus
cattgatgaatttctg

SEQ ID NO: 383280 - DNA, 16 bp, M. musculus
cattgatgaccaagta

SEQ ID NO: 383281 - DNA, 16 bp, M. musculus
cattgatgacccacta

SEQ ID NO: 383282 - DNA, 16 bp, M. musculus
cattgatgcctgaaaa

SEQ ID NO: 383283 - DNA, 16 bp, M. musculus
cattgatgtgagcatc

SEQ ID NO: 383284 - DNA, 16 bp, M. musculus
cattgattccatattt

SEQ ID NO: 383285 - DNA, 16 bp, M. musculus
cattgatttaaaaaaa

SEQ ID NO: 383286 - DNA, 16 bp, M. musculus
cattgcagaagaggaa

SEQ ID NO: 383287 - DNA, 16 bp, M. musculus
cattgcagatggctgt

SEQ ID NO: 383288 - DNA, 16 bp, M. musculus
cattgcagctgtcttc

SEQ ID NO: 383289 - DNA, 16 bp, M. musculus
cattgcagtgagtcat

SEQ ID NO: 383290 - DNA, 16 bp, M. musculus
cattgcatgaagctgt

SEQ ID NO: 383291 - DNA, 16 bp, M. musculus
cattgccctatgtgac

SEQ ID NO: 383292 - DNA, 22 bp, M. musculus
cattgctaaatttagtgagatg

SEQ ID NO: 383293 - DNA, 16 bp, M. musculus
cattgctacacaactc

SEQ ID NO: 383294 - DNA, 16 bp, M. musculus
cattgctattctgttt

SEQ ID NO: 383295 - DNA, 16 bp, M. musculus
cattgctctctgctct

SEQ ID NO: 383296 - DNA, 16 bp, M. musculus
cattgctgggaagaga

SEQ ID NO: 383297 - DNA, 16 bp, M. musculus
cattgctggtaggact

SEQ ID NO: 383298 - DNA, 16 bp, M. musculus
cattgctggtgggctt

SEQ ID NO: 383299 - DNA, 16 bp, M. musculus
cattgctgtgaagaga

SEQ ID NO: 383300 - DNA, 16 bp, M. musculus
cattgctgtgaccaaa

SEQ ID NO: 383301 - DNA, 16 bp, M. musculus
cattgctgtgataaaa

SEQ ID NO: 383302 - DNA, 16 bp, M. musculus
cattgctgttcttttc

SEQ ID NO: 383303 - DNA, 16 bp, M. musculus
cattggaagaagtcag

SEQ ID NO: 383304 - DNA, 16 bp, M. musculus
cattggacagaggtca

SEQ ID NO: 383305 - DNA, 16 bp, M. musculus
cattggagcctggtgg

SEQ ID NO: 383306 - DNA, 16 bp, M. musculus
cattggaggccctgtg

SEQ ID NO: 383307 - DNA, 16 bp, M. musculus
cattggcaggaggcag

SEQ ID NO: 383308 - DNA, 16 bp, M. musculus
cattggccacagccat

SEQ ID NO: 383309 - DNA, 16 bp, M. musculus
cattgggaaacacaga

SEQ ID NO: 383310 - DNA, 16 bp, M. musculus
cattgggaatgtaaat

SEQ ID NO: 383311 - DNA, 16 bp, M. musculus
cattgggagccatgtg

SEQ ID NO: 383312 - DNA, 16 bp, M. musculus
cattgggagctctgtg

SEQ ID NO: 383313 - DNA, 16 bp, M. musculus
cattgggagtggaaat

SEQ ID NO: 383314 - DNA, 16 bp, M. musculus
cattgggcagagcttg

SEQ ID NO: 383315 - DNA, 16 bp, M. musculus
cattgggctggagaga

SEQ ID NO: 383316 - DNA, 16 bp, M. musculus
cattgggctttgctga

SEQ ID NO: 383317 - DNA, 16 bp, M. musculus
cattggggacactgtg

SEQ ID NO: 383318 - DNA, 16 bp, M. musculus
cattggggactccatg

SEQ ID NO: 383319 - DNA, 16 bp, M. musculus
cattgggggccctctg

SEQ ID NO: 383320 - DNA, 16 bp, M. musculus
cattgggggccctgag

SEQ ID NO: 383321 - DNA, 16 bp, M. musculus
cattgggggccgtgtg

SEQ ID NO: 383322 - DNA, 16 bp, M. musculus
cattggtataaatttc

SEQ ID NO: 383323 - DNA, 16 bp, M. musculus
cattggtctacttgtt

SEQ ID NO: 383324 - DNA, 16 bp, M. musculus
cattggtctatttgtc

SEQ ID NO: 383325 - DNA, 16 bp, M. musculus
cattggtctggttcaa

SEQ ID NO: 383326 - DNA, 16 bp, M. musculus
cattggtgtttggcct

SEQ ID NO: 383327 - DNA, 16 bp, M. musculus
cattggttcaccttgc

SEQ ID NO: 383328 - DNA, 16 bp, M. musculus
cattggttctcaacct

SEQ ID NO: 383329 - DNA, 16 bp, M. musculus
cattgtaaatacatgt

SEQ ID NO: 383330 - DNA, 16 bp, M. musculus
cattgtacagctagct

SEQ ID NO: 383331 - DNA, 16 bp, M. musculus
cattgtatatttttgt

SEQ ID NO: 383332 - DNA, 16 bp, M. musculus
cattgtattttatatt

SEQ ID NO: 383333 - DNA, 17 bp, M. musculus
cattgtccatgcctttc

SEQ ID NO: 383334 - DNA, 16 bp, M. musculus
cattgtcctttgcctt

SEQ ID NO: 383335 - DNA, 16 bp, M. musculus
cattgtcgtcgtcgtc

SEQ ID NO: 383336 - DNA, 16 bp, M. musculus
cattgtctacgtgact

SEQ ID NO: 383337 - DNA, 16 bp, M. musculus
cattgtctctctggag

SEQ ID NO: 383338 - DNA, 16 bp, M. musculus
cattgtctctgctcct

SEQ ID NO: 383339 - DNA, 16 bp, M. musculus
cattgtctgtgtgact

SEQ ID NO: 383340 - DNA, 16 bp, M. musculus
cattgtgcaggaggag

SEQ ID NO: 383341 - DNA, 16 bp, M. musculus
cattgtgctgcataca

SEQ ID NO: 383342 - DNA, 16 bp, M. musculus
cattgtgctggagaag

SEQ ID NO: 383343 - DNA, 16 bp, M. musculus
cattgtggaaaatgga

SEQ ID NO: 383344 - DNA, 16 bp, M. musculus
cattgtgggcagtgcc

SEQ ID NO: 383345 - DNA, 16 bp, M. musculus
cattgtgggcatgggc

SEQ ID NO: 383346 - DNA, 16 bp, M. musculus
cattgtgtgcttataa

SEQ ID NO: 383347 - DNA, 16 bp, M. musculus
cattgttatgtctccc

SEQ ID NO: 383348 - DNA, 16 bp, M. musculus
cattgttcttcctatg

SEQ ID NO: 383349 - DNA, 16 bp, M. musculus
cattgttgaaagtggt

SEQ ID NO: 383350 - DNA, 16 bp, M. musculus
cattgttggactagct

SEQ ID NO: 383351 - DNA, 16 bp, M. musculus
cattgttggagggatt

SEQ ID NO: 383352 - DNA, 17 bp, M. musculus
cattgttggtggaattg

SEQ ID NO: 383353 - DNA, 16 bp, M. musculus
cattgttgtgataaaa

SEQ ID NO: 383354 - DNA, 16 bp, M. musculus
cattgttgtggatcca

SEQ ID NO: 383355 - DNA, 16 bp, M. musculus
cattgtttcctgaatt

SEQ ID NO: 383356 - DNA, 16 bp, M. musculus
cattgtttctctgtgt

SEQ ID NO: 383357 - DNA, 16 bp, M. musculus
cattgtttctgagcta

SEQ ID NO: 383358 - DNA, 16 bp, M. musculus
cattgtttttctattc

SEQ ID NO: 383359 - DNA, 16 bp, M. musculus
catttaaaaaaaaatg

SEQ ID NO: 383360 - DNA, 16 bp, M. musculus
catttaaaaataaatg

SEQ ID NO: 383361 - DNA, 16 bp, M. musculus
catttaaaagaaagaa

SEQ ID NO: 383362 - DNA, 16 bp, M. musculus
catttaaaatatgaaa

SEQ ID NO: 383363 - DNA, 16 bp, M. musculus
catttaaaatcatttc

SEQ ID NO: 383364 - DNA, 16 bp, M. musculus
catttaaaatgaaaat

SEQ ID NO: 383365 - DNA, 16 bp, M. musculus
catttaaaatgtaaat

SEQ ID NO: 383366 - DNA, 16 bp, M. musculus
catttaaaccaccaca

SEQ ID NO: 383367 - DNA, 16 bp, M. musculus
catttaaagaaataaa

SEQ ID NO: 383368 - DNA, 16 bp, M. musculus
catttaactggggatg

SEQ ID NO: 383369 - DNA, 16 bp, M. musculus
catttaatcatttaat

SEQ ID NO: 383370 - DNA, 16 bp, M. musculus
catttaattaggggct

SEQ ID NO: 383371 - DNA, 16 bp, M. musculus
catttaattgggactg

SEQ ID NO: 383372 - DNA, 16 bp, M. musculus
catttaattggggctg

SEQ ID NO: 383373 - DNA, 16 bp, M. musculus
catttaattgtgactg

SEQ ID NO: 383374 - DNA, 16 bp, M. musculus
catttaatttggttat

SEQ ID NO: 383375 - DNA, 16 bp, M. musculus
catttaattttgaaaa

SEQ ID NO: 383376 - DNA, 16 bp, M. musculus
catttacacagtagaa

SEQ ID NO: 383377 - DNA, 16 bp, M. musculus
catttacagaacattt

SEQ ID NO: 383378 - DNA, 16 bp, M. musculus
catttacataatagaa

SEQ ID NO: 383379 - DNA, 16 bp, M. musculus
catttacatacacaca

SEQ ID NO: 383380 - DNA, 16 bp, M. musculus
catttactttgatctt

SEQ ID NO: 383381 - DNA, 16 bp, M. musculus
catttagatttttaaa

SEQ ID NO: 383382 - DNA, 16 bp, M. musculus
catttagcaataaaag

SEQ ID NO: 383383 - DNA, 16 bp, M. musculus
catttagttggggctg

SEQ ID NO: 383384 - DNA, 16 bp, M. musculus
catttataaagaaaaa

SEQ ID NO: 383385 - DNA, 16 bp, M. musculus
catttataagaggaaa

SEQ ID NO: 383386 - DNA, 16 bp, M. musculus
catttataattttgtt

SEQ ID NO: 383387 - DNA, 16 bp, M. musculus
catttatatttcaaat

SEQ ID NO: 383388 - DNA, 16 bp, M. musculus
catttatctacctgcc

SEQ ID NO: 383389 - DNA, 16 bp, M. musculus
catttatctgtgaatt

SEQ ID NO: 383390 - DNA, 16 bp, M. musculus
catttatgtatatttt

SEQ ID NO: 383391 - DNA, 16 bp, M. musculus
catttattaaagaaat

SEQ ID NO: 383392 - DNA, 16 bp, M. musculus
catttattaagtgcct

SEQ ID NO: 383393 - DNA, 16 bp, M. musculus
catttattctattcta

SEQ ID NO: 383394 - DNA, 16 bp, M. musculus
catttattgagtgcct

SEQ ID NO: 383395 - DNA, 18 bp, M. musculus
catttattgattcttgat

SEQ ID NO: 383396 - DNA, 16 bp, M. musculus
catttatttactcatt

SEQ ID NO: 383397 - DNA, 16 bp, M. musculus
catttatttatctgtt

SEQ ID NO: 383398 - DNA, 16 bp, M. musculus
catttatttctttgtg

SEQ ID NO: 383399 - DNA, 16 bp, M. musculus
catttatttgcttatt

SEQ ID NO: 383400 - DNA, 16 bp, M. musculus
catttatttggtgttc

SEQ ID NO: 383401 - DNA, 16 bp, M. musculus
catttattttaaccta

SEQ ID NO: 383402 - DNA, 16 bp, M. musculus
catttcaaaattattt

SEQ ID NO: 383403 - DNA, 16 bp, M. musculus
catttcaaatgctgtt

SEQ ID NO: 383404 - DNA, 16 bp, M. musculus
catttcaaatgtaaat

SEQ ID NO: 383405 - DNA, 16 bp, M. musculus
catttcaaatgttata

SEQ ID NO: 383406 - DNA, 16 bp, M. musculus
catttcaaatgttctt

SEQ ID NO: 383407 - DNA, 16 bp, M. musculus
catttcaaatgtttat

SEQ ID NO: 383408 - DNA, 16 bp, M. musculus
catttcacactcaaac

SEQ ID NO: 383409 - DNA, 16 bp, M. musculus
catttcacagatgaag

SEQ ID NO: 383410 - DNA, 16 bp, M. musculus
catttcacagatggag

SEQ ID NO: 383411 - DNA, 16 bp, M. musculus
catttcagaaaaaaaa

SEQ ID NO: 383412 - DNA, 16 bp, M. musculus
catttcagaatacctg

SEQ ID NO: 383413 - DNA, 16 bp, M. musculus
catttcagatggttgt

SEQ ID NO: 383414 - DNA, 16 bp, M. musculus
catttcagtgtctctg

SEQ ID NO: 383415 - DNA, 16 bp, M. musculus
catttcatccacattt

SEQ ID NO: 383416 - DNA, 16 bp, M. musculus
catttcatctaaggtc

SEQ ID NO: 383417 - DNA, 16 bp, M. musculus
catttcatgtgtgtgt

SEQ ID NO: 383418 - DNA, 16 bp, M. musculus
catttcattgaggctg

SEQ ID NO: 383419 - DNA, 16 bp, M. musculus
catttcattttaaaat

SEQ ID NO: 383420 - DNA, 16 bp, M. musculus
catttccaatgctacc

SEQ ID NO: 383421 - DNA, 16 bp, M. musculus
catttccacaactgaa

SEQ ID NO: 383422 - DNA, 16 bp, M. musculus
catttccacatcactg

SEQ ID NO: 383423 - DNA, 16 bp, M. musculus
catttccatacctgta

SEQ ID NO: 383424 - DNA, 16 bp, M. musculus
catttccatccttgta

SEQ ID NO: 383425 - DNA, 16 bp, M. musculus
catttccatttccatt

SEQ ID NO: 383426 - DNA, 16 bp, M. musculus
catttccctgattgct

SEQ ID NO: 383427 - DNA, 16 bp, M. musculus
catttcctcaaggaag

SEQ ID NO: 383428 - DNA, 16 bp, M. musculus
catttcctccaacaag

SEQ ID NO: 383429 - DNA, 16 bp, M. musculus
catttcctccctccaa

SEQ ID NO: 383430 - DNA, 16 bp, M. musculus
catttcctctcccact

SEQ ID NO: 383431 - DNA, 16 bp, M. musculus
catttcctggggcctc

SEQ ID NO: 383432 - DNA, 16 bp, M. musculus
catttcctgtgtgtgt

SEQ ID NO: 383433 - DNA, 16 bp, M. musculus
catttcctgtttcctt

SEQ ID NO: 383434 - DNA, 16 bp, M. musculus
catttccttccaggtt

SEQ ID NO: 383435 - DNA, 16 bp, M. musculus
catttccttgatgact

SEQ ID NO: 383436 - DNA, 16 bp, M. musculus
catttcctttgatgtt

SEQ ID NO: 383437 - DNA, 16 bp, M. musculus
catttccttttctgtt

SEQ ID NO: 383438 - DNA, 17 bp, M. musculus
catttcgttagatgcag

SEQ ID NO: 383439 - DNA, 16 bp, M. musculus
catttctaataaaaat

SEQ ID NO: 383440 - DNA, 16 bp, M. musculus
catttctccaccactt

SEQ ID NO: 383441 - DNA, 16 bp, M. musculus
catttctccagcacca

SEQ ID NO: 383442 - DNA, 16 bp, M. musculus
catttctccagcccct

SEQ ID NO: 383443 - DNA, 16 bp, M. musculus
catttctccagcctga

SEQ ID NO: 383444 - DNA, 16 bp, M. musculus
catttctccagctctg

SEQ ID NO: 383445 - DNA, 16 bp, M. musculus
catttctcttcttcca

SEQ ID NO: 383446 - DNA, 16 bp, M. musculus
catttctgattttact

SEQ ID NO: 383447 - DNA, 16 bp, M. musculus
catttctgcacaaact

SEQ ID NO: 383448 - DNA, 16 bp, M. musculus
catttctggaaaaaaa

SEQ ID NO: 383449 - DNA, 16 bp, M. musculus
catttctgtgtttgcc

SEQ ID NO: 383450 - DNA, 16 bp, M. musculus
catttctgttgctgtt

SEQ ID NO: 383451 - DNA, 16 bp, M. musculus
catttcttccaacaag

SEQ ID NO: 383452 - DNA, 16 bp, M. musculus
catttcttcttacaaa

SEQ ID NO: 383453 - DNA, 16 bp, M. musculus
catttcttctttctgt

SEQ ID NO: 383454 - DNA, 16 bp, M. musculus
catttcttgaccctgg

SEQ ID NO: 383455 - DNA, 16 bp, M. musculus
catttcttgagttctt

SEQ ID NO: 383456 - DNA, 16 bp, M. musculus
catttcttggccctgg

SEQ ID NO: 383457 - DNA, 16 bp, M. musculus
catttctttaaaagca

SEQ ID NO: 383458 - DNA, 16 bp, M. musculus
catttctttctatgga

SEQ ID NO: 383459 - DNA, 16 bp, M. musculus
catttctttggtctgt

SEQ ID NO: 383460 - DNA, 16 bp, M. musculus
catttctttgttgagg

SEQ ID NO: 383461 - DNA, 16 bp, M. musculus
catttcttttaaaata

SEQ ID NO: 383462 - DNA, 16 bp, M. musculus
catttctttttaaaga

SEQ ID NO: 383463 - DNA, 16 bp, M. musculus
catttgaaaacaaaac

SEQ ID NO: 383464 - DNA, 16 bp, M. musculus
catttgaaaagagatt

SEQ ID NO: 383465 - DNA, 16 bp, M. musculus
catttgaaaagtaaat

SEQ ID NO: 383466 - DNA, 16 bp, M. musculus
catttgaaatataaat

SEQ ID NO: 383467 - DNA, 16 bp, M. musculus
catttgaaatatgaat

SEQ ID NO: 383468 - DNA, 16 bp, M. musculus
catttgaaatgaaaat

SEQ ID NO: 383469 - DNA, 16 bp, M. musculus
catttgaaatgtaaat

SEQ ID NO: 383470 - DNA, 16 bp, M. musculus
catttgaaatttaaaa

SEQ ID NO: 383471 - DNA, 16 bp, M. musculus
catttgactttttaaa

SEQ ID NO: 383472 - DNA, 16 bp, M. musculus
catttgagagagagag

SEQ ID NO: 383473 - DNA, 16 bp, M. musculus
catttgatgaagatgc

SEQ ID NO: 383474 - DNA, 16 bp, M. musculus
catttgattcataact

SEQ ID NO: 383475 - DNA, 16 bp, M. musculus
catttgcaaaacaaaa

SEQ ID NO: 383476 - DNA, 16 bp, M. musculus
catttgcaaatgaaaa

SEQ ID NO: 383477 - DNA, 16 bp, M. musculus
catttgcacaatggag

SEQ ID NO: 383478 - DNA, 16 bp, M. musculus
catttgcatgcacaca

SEQ ID NO: 383479 - DNA, 16 bp, M. musculus
catttgcatttcttct

SEQ ID NO: 383480 - DNA, 16 bp, M. musculus
catttgccaccatgcc

SEQ ID NO: 383481 - DNA, 16 bp, M. musculus
catttgccagcaaaat

SEQ ID NO: 383482 - DNA, 16 bp, M. musculus
catttgcctgaaaatt

SEQ ID NO: 383483 - DNA, 16 bp, M. musculus
catttgccttgcagaa

SEQ ID NO: 383484 - DNA, 16 bp, M. musculus
catttgctgcttttgc

SEQ ID NO: 383485 - DNA, 16 bp, M. musculus
catttgcttgaaaaaa

SEQ ID NO: 383486 - DNA, 16 bp, M. musculus
catttgcttgcttgtt

SEQ ID NO: 383487 - DNA, 16 bp, M. musculus
catttgctttctgttt

SEQ ID NO: 383488 - DNA, 16 bp, M. musculus
catttggaaaaaaaat

SEQ ID NO: 383489 - DNA, 16 bp, M. musculus
catttggaagaagcac

SEQ ID NO: 383490 - DNA, 16 bp, M. musculus
catttggaaggctggt

SEQ ID NO: 383491 - DNA, 16 bp, M. musculus
catttggaatataaat

SEQ ID NO: 383492 - DNA, 16 bp, M. musculus
catttggacataagga

SEQ ID NO: 383493 - DNA, 16 bp, M. musculus
catttggacttgagct

SEQ ID NO: 383494 - DNA, 16 bp, M. musculus
catttggagcataggt

SEQ ID NO: 383495 - DNA, 16 bp, M. musculus
catttggagcatagtt

SEQ ID NO: 383496 - DNA, 16 bp, M. musculus
catttggagtcatttt

SEQ ID NO: 383497 - DNA, 16 bp, M. musculus
catttggatttgcatt

SEQ ID NO: 383498 - DNA, 16 bp, M. musculus
catttggctctgaaat

SEQ ID NO: 383499 - DNA, 16 bp, M. musculus
catttggcttattagg

SEQ ID NO: 383500 - DNA, 16 bp, M. musculus
catttgggagggagaa

SEQ ID NO: 383501 - DNA, 17 bp, M. musculus
catttggtattcctcag

SEQ ID NO: 383502 - DNA, 16 bp, M. musculus
catttggtgcctggga

SEQ ID NO: 383503 - DNA, 16 bp, M. musculus
catttggttaataact

SEQ ID NO: 383504 - DNA, 16 bp, M. musculus
catttgtaaaagaaat

SEQ ID NO: 383505 - DNA, 16 bp, M. musculus
catttgtataaaggat

SEQ ID NO: 383506 - DNA, 16 bp, M. musculus
catttgtcatttgtat

SEQ ID NO: 383507 - DNA, 16 bp, M. musculus
catttgtgacaaaata

SEQ ID NO: 383508 - DNA, 16 bp, M. musculus
catttgtgatttaaaa

SEQ ID NO: 383509 - DNA, 16 bp, M. musculus
catttgtggctgagca

SEQ ID NO: 383510 - DNA, 16 bp, M. musculus
catttgtgtatttatt

SEQ ID NO: 383511 - DNA, 16 bp, M. musculus
catttgtgtgatattt

SEQ ID NO: 383512 - DNA, 16 bp, M. musculus
catttgtgttctttcc

SEQ ID NO: 383513 - DNA, 16 bp, M. musculus
catttgtgttcttttg

SEQ ID NO: 383514 - DNA, 16 bp, M. musculus
catttgtgtttttaaa

SEQ ID NO: 383515 - DNA, 16 bp, M. musculus
catttgttattttaaa

SEQ ID NO: 383516 - DNA, 17 bp, M. musculus
catttgttgtaaatgct

SEQ ID NO: 383517 - DNA, 16 bp, M. musculus
catttgtttgagaatt

SEQ ID NO: 383518 - DNA, 16 bp, M. musculus
catttgtttgggtttt

SEQ ID NO: 383519 - DNA, 16 bp, M. musculus
catttgttttagattg

SEQ ID NO: 383520 - DNA, 16 bp, M. musculus
catttgttttcaaatt

SEQ ID NO: 383521 - DNA, 16 bp, M. musculus
cattttaaaaagtgtt

SEQ ID NO: 383522 - DNA, 16 bp, M. musculus
cattttaaaaatagtt

SEQ ID NO: 383523 - DNA, 16 bp, M. musculus
cattttaaaaatgcaa

SEQ ID NO: 383524 - DNA, 16 bp, M. musculus
cattttaaaacagaaa

SEQ ID NO: 383525 - DNA, 16 bp, M. musculus
cattttaaaacatcat

SEQ ID NO: 383526 - DNA, 16 bp, M. musculus
cattttaaaactttta

SEQ ID NO: 383527 - DNA, 16 bp, M. musculus
cattttaaaagaaaag

SEQ ID NO: 383528 - DNA, 16 bp, M. musculus
cattttaaaagaattt

SEQ ID NO: 383529 - DNA, 16 bp, M. musculus
cattttaaaagtaatt

SEQ ID NO: 383530 - DNA, 16 bp, M. musculus
cattttaaaatgagaa

SEQ ID NO: 383531 - DNA, 16 bp, M. musculus
cattttaaaattctgt

SEQ ID NO: 383532 - DNA, 16 bp, M. musculus
cattttaaaattgatt

SEQ ID NO: 383533 - DNA, 16 bp, M. musculus
cattttaaagaacaaa

SEQ ID NO: 383534 - DNA, 16 bp, M. musculus
cattttaaagatgtat

SEQ ID NO: 383535 - DNA, 16 bp, M. musculus
cattttaaagttattt

SEQ ID NO: 383536 - DNA, 16 bp, M. musculus
cattttaaatgtaaat

SEQ ID NO: 383537 - DNA, 16 bp, M. musculus
cattttaaatgttata

SEQ ID NO: 383538 - DNA, 16 bp, M. musculus
cattttaataaaatga

SEQ ID NO: 383539 - DNA, 16 bp, M. musculus
cattttaatgataaaa

SEQ ID NO: 383540 - DNA, 16 bp, M. musculus
cattttacagatgggg

SEQ ID NO: 383541 - DNA, 16 bp, M. musculus
cattttacagatgtgg

SEQ ID NO: 383542 - DNA, 16 bp, M. musculus
cattttacaggtgaga

SEQ ID NO: 383543 - DNA, 16 bp, M. musculus
cattttactttcttga

SEQ ID NO: 383544 - DNA, 16 bp, M. musculus
cattttataaatgaga

SEQ ID NO: 383545 - DNA, 16 bp, M. musculus
cattttatataagaga

SEQ ID NO: 383546 - DNA, 16 bp, M. musculus
cattttatgtcatttt

SEQ ID NO: 383547 - DNA, 16 bp, M. musculus
cattttatgtgtatgt

SEQ ID NO: 383548 - DNA, 16 bp, M. musculus
cattttatgttttaaa

SEQ ID NO: 383549 - DNA, 16 bp, M. musculus
cattttatttcaaaat

SEQ ID NO: 383550 - DNA, 16 bp, M. musculus
cattttatttcagttt

SEQ ID NO: 383551 - DNA, 16 bp, M. musculus
cattttatttctatgt

SEQ ID NO: 383552 - DNA, 16 bp, M. musculus
cattttatttgtatgt

SEQ ID NO: 383553 - DNA, 16 bp, M. musculus
cattttcaaagaaaaa

SEQ ID NO: 383554 - DNA, 16 bp, M. musculus
cattttcaacaaaagg

SEQ ID NO: 383555 - DNA, 16 bp, M. musculus
cattttcaacatttgg

SEQ ID NO: 383556 - DNA, 16 bp, M. musculus
cattttcaggttttaa

SEQ ID NO: 383557 - DNA, 16 bp, M. musculus
cattttcatctgaaga

SEQ ID NO: 383558 - DNA, 16 bp, M. musculus
cattttcatctttgtt

SEQ ID NO: 383559 - DNA, 16 bp, M. musculus
cattttcattaaactt

SEQ ID NO: 383560 - DNA, 16 bp, M. musculus
cattttcattaaatgt

SEQ ID NO: 383561 - DNA, 16 bp, M. musculus
cattttcattataaaa

SEQ ID NO: 383562 - DNA, 16 bp, M. musculus
cattttcatttaaacc

SEQ ID NO: 383563 - DNA, 16 bp, M. musculus
cattttccatgtgaat

SEQ ID NO: 383564 - DNA, 16 bp, M. musculus
cattttcccagtttgg

SEQ ID NO: 383565 - DNA, 16 bp, M. musculus
cattttcctaattagt

SEQ ID NO: 383566 - DNA, 16 bp, M. musculus
cattttccttcaaacc

SEQ ID NO: 383567 - DNA, 16 bp, M. musculus
cattttccttcagaaa

SEQ ID NO: 383568 - DNA, 16 bp, M. musculus
cattttccttccacct

SEQ ID NO: 383569 - DNA, 16 bp, M. musculus
cattttccttctctgt

SEQ ID NO: 383570 - DNA, 16 bp, M. musculus
cattttctcaattaat

SEQ ID NO: 383571 - DNA, 16 bp, M. musculus
cattttctcagttgag

SEQ ID NO: 383572 - DNA, 16 bp, M. musculus
cattttctctccagtg

SEQ ID NO: 383573 - DNA, 16 bp, M. musculus
cattttctctcctgtg

SEQ ID NO: 383574 - DNA, 16 bp, M. musculus
cattttctgaaatctt

SEQ ID NO: 383575 - DNA, 16 bp, M. musculus
cattttctgaattagt

SEQ ID NO: 383576 - DNA, 16 bp, M. musculus
cattttctgtattctt

SEQ ID NO: 383577 - DNA, 16 bp, M. musculus
cattttctgttctctc

SEQ ID NO: 383578 - DNA, 16 bp, M. musculus
cattttcttaaaaaat

SEQ ID NO: 383579 - DNA, 16 bp, M. musculus
cattttcttaactaat

SEQ ID NO: 383580 - DNA, 16 bp, M. musculus
cattttcttaattgct

SEQ ID NO: 383581 - DNA, 16 bp, M. musculus
cattttcttgatggct

SEQ ID NO: 383582 - DNA, 16 bp, M. musculus
cattttcttggttgct

SEQ ID NO: 383583 - DNA, 16 bp, M. musculus
cattttcttgtttaat

SEQ ID NO: 383584 - DNA, 16 bp, M. musculus
cattttctttcagaaa

SEQ ID NO: 383585 - DNA, 16 bp, M. musculus
cattttctttcattgt

SEQ ID NO: 383586 - DNA, 16 bp, M. musculus
cattttctttcctgtt

SEQ ID NO: 383587 - DNA, 16 bp, M. musculus
cattttctttgaattc

SEQ ID NO: 383588 - DNA, 16 bp, M. musculus
cattttctttgactat

SEQ ID NO: 383589 - DNA, 16 bp, M. musculus
cattttctttgtgtgt

SEQ ID NO: 383590 - DNA, 16 bp, M. musculus
cattttctttttaaga

SEQ ID NO: 383591 - DNA, 16 bp, M. musculus
cattttgaaaaaaaaa

SEQ ID NO: 383592 - DNA, 16 bp, M. musculus
cattttgaaatatttt

SEQ ID NO: 383593 - DNA, 16 bp, M. musculus
cattttgaataaaact

SEQ ID NO: 383594 - DNA, 16 bp, M. musculus
cattttgaatatttaa

SEQ ID NO: 383595 - DNA, 16 bp, M. musculus
cattttgcagctgatt

SEQ ID NO: 383596 - DNA, 16 bp, M. musculus
cattttgcattttgca

SEQ ID NO: 383597 - DNA, 16 bp, M. musculus
cattttgctgagacat

SEQ ID NO: 383598 - DNA, 16 bp, M. musculus
cattttggtggagaca

SEQ ID NO: 383599 - DNA, 16 bp, M. musculus
cattttgtagaccaga

SEQ ID NO: 383600 - DNA, 16 bp, M. musculus
cattttgtcacagcaa

SEQ ID NO: 383601 - DNA, 16 bp, M. musculus
cattttgtgggttgag

SEQ ID NO: 383602 - DNA, 16 bp, M. musculus
cattttgttccctgga

SEQ ID NO: 383603 - DNA, 16 bp, M. musculus
catttttaaaaatgaa

SEQ ID NO: 383604 - DNA, 16 bp, M. musculus
catttttaaaagccag

SEQ ID NO: 383605 - DNA, 16 bp, M. musculus
catttttaaagcattt

SEQ ID NO: 383606 - DNA, 16 bp, M. musculus
catttttaaatgtaat

SEQ ID NO: 383607 - DNA, 16 bp, M. musculus
catttttaagagctga

SEQ ID NO: 383608 - DNA, 16 bp, M. musculus
catttttaataaggtt

SEQ ID NO: 383609 - DNA, 16 bp, M. musculus
catttttaatagctgt

SEQ ID NO: 383610 - DNA, 16 bp, M. musculus
catttttaatgaaaaa

SEQ ID NO: 383611 - DNA, 16 bp, M. musculus
catttttacatgggtt

SEQ ID NO: 383612 - DNA, 16 bp, M. musculus
catttttactataata

SEQ ID NO: 383613 - DNA, 16 bp, M. musculus
catttttatcacaatt

SEQ ID NO: 383614 - DNA, 16 bp, M. musculus
catttttatccctgca

SEQ ID NO: 383615 - DNA, 16 bp, M. musculus
catttttatttgatat

SEQ ID NO: 383616 - DNA, 16 bp, M. musculus
catttttattttcctg

SEQ ID NO: 383617 - DNA, 16 bp, M. musculus
catttttcaaaaatat

SEQ ID NO: 383618 - DNA, 16 bp, M. musculus
catttttcatttgtat

SEQ ID NO: 383619 - DNA, 16 bp, M. musculus
catttttccttttagt

SEQ ID NO: 383620 - DNA, 16 bp, M. musculus
catttttctcatcctc

SEQ ID NO: 383621 - DNA, 16 bp, M. musculus
catttttctgttgaag

SEQ ID NO: 383622 - DNA, 16 bp, M. musculus
catttttcttaagaaa

SEQ ID NO: 383623 - DNA, 16 bp, M. musculus
catttttcttcagttt

SEQ ID NO: 383624 - DNA, 16 bp, M. musculus
catttttgcttaattt

SEQ ID NO: 383625 - DNA, 16 bp, M. musculus
catttttgtccctgtt

SEQ ID NO: 383626 - DNA, 16 bp, M. musculus
catttttgtgagtgct

SEQ ID NO: 383627 - DNA, 16 bp, M. musculus
catttttgtgtttcct

SEQ ID NO: 383628 - DNA, 16 bp, M. musculus
cattttttaaaaagaa

SEQ ID NO: 383629 - DNA, 16 bp, M. musculus
cattttttaaaagcaa

SEQ ID NO: 383630 - DNA, 16 bp, M. musculus
cattttttaaaagtta

SEQ ID NO: 383631 - DNA, 16 bp, M. musculus
cattttttaaattagt

SEQ ID NO: 383632 - DNA, 16 bp, M. musculus
cattttttcatgtgct

SEQ ID NO: 383633 - DNA, 16 bp, M. musculus
catttttttgtgtgtg

SEQ ID NO: 383634 - DNA, 16 bp, M. musculus
cattttttttcaagtg

SEQ ID NO: 383635 - DNA, 16 bp, M. musculus
catttttttttctgaa

SEQ ID NO: 383636 - DNA, 16 bp, M. musculus
ccaaaaacatccagga

SEQ ID NO: 383637 - DNA, 16 bp, M. musculus
ccaaaaacctaggata

SEQ ID NO: 383638 - DNA, 16 bp, M. musculus
ccaaaaagctagaccc

SEQ ID NO: 383639 - DNA, 16 bp, M. musculus
ccaaaaaggaactaga

SEQ ID NO: 383640 - DNA, 16 bp, M. musculus
ccaaaaaggcagacct

SEQ ID NO: 383641 - DNA, 16 bp, M. musculus
ccaaaaatacagaata

SEQ ID NO: 383642 - DNA, 16 bp, M. musculus
ccaaaaatataagagt

SEQ ID NO: 383643 - DNA, 16 bp, M. musculus
ccaaaaatatctttct

SEQ ID NO: 383644 - DNA, 16 bp, M. musculus
ccaaaacaaaatgagc

SEQ ID NO: 383645 - DNA, 16 bp, M. musculus
ccaaaacaattcttta

SEQ ID NO: 383646 - DNA, 16 bp, M. musculus
ccaaaacattataaac

SEQ ID NO: 383647 - DNA, 16 bp, M. musculus
ccaaaaccatgaacct

SEQ ID NO: 383648 - DNA, 16 bp, M. musculus
ccaaaacctcacaaag

SEQ ID NO: 383649 - DNA, 16 bp, M. musculus
ccaaaactccaggagg

SEQ ID NO: 383650 - DNA, 16 bp, M. musculus
ccaaaactgtatataa

SEQ ID NO: 383651 - DNA, 16 bp, M. musculus
ccaaaagaaacccttc

SEQ ID NO: 383652 - DNA, 16 bp, M. musculus
ccaaaagaaagaattt

SEQ ID NO: 383653 - DNA, 16 bp, M. musculus
ccaaaagaaatgaaat

SEQ ID NO: 383654 - DNA, 16 bp, M. musculus
ccaaaagaacacacat

SEQ ID NO: 383655 - DNA, 16 bp, M. musculus
ccaaaagaagacagcc

SEQ ID NO: 383656 - DNA, 16 bp, M. musculus
ccaaaagacatcattc

SEQ ID NO: 383657 - DNA, 16 bp, M. musculus
ccaaaagcaacttgag

SEQ ID NO: 383658 - DNA, 16 bp, M. musculus
ccaaaagcagtctaca

SEQ ID NO: 383659 - DNA, 16 bp, M. musculus
ccaaaagctccaaata

SEQ ID NO: 383660 - DNA, 16 bp, M. musculus
ccaaaagctctagaac

SEQ ID NO: 383661 - DNA, 16 bp, M. musculus
ccaaaagctgctgcct

SEQ ID NO: 383662 - DNA, 16 bp, M. musculus
ccaaaaggaaatgcat

SEQ ID NO: 383663 - DNA, 16 bp, M. musculus
ccaaaaggagagaatc

SEQ ID NO: 383664 - DNA, 16 bp, M. musculus
ccaaaagtcccccata

SEQ ID NO: 383665 - DNA, 16 bp, M. musculus
ccaaaagtccccccaa

SEQ ID NO: 383666 - DNA, 16 bp, M. musculus
ccaaaagtccccccat

SEQ ID NO: 383667 - DNA, 19 bp, M. musculus
ccaaaataaagtgagctct

SEQ ID NO: 383668 - DNA, 16 bp, M. musculus
ccaaaatatttacatt

SEQ ID NO: 383669 - DNA, 16 bp, M. musculus
ccaaaatcagcctcca

SEQ ID NO: 383670 - DNA, 16 bp, M. musculus
ccaaaatgcccaacac

SEQ ID NO: 383671 - DNA, 16 bp, M. musculus
ccaaaatgtataaaga

SEQ ID NO: 383672 - DNA, 16 bp, M. musculus
ccaaaattccaccaaa

SEQ ID NO: 383673 - DNA, 16 bp, M. musculus
ccaaaatttatcttgt

SEQ ID NO: 383674 - DNA, 16 bp, M. musculus
ccaaaattttaaagct

SEQ ID NO: 383675 - DNA, 16 bp, M. musculus
ccaaaattttaccaga

SEQ ID NO: 383676 - DNA, 16 bp, M. musculus
ccaaacaaaagaatat

SEQ ID NO: 383677 - DNA, 16 bp, M. musculus
ccaaacaaatgaataa

SEQ ID NO: 383678 - DNA, 16 bp, M. musculus
ccaaacaaggaaaatg

SEQ ID NO: 383679 - DNA, 16 bp, M. musculus
ccaaacacatgagcct

SEQ ID NO: 383680 - DNA, 16 bp, M. musculus
ccaaacaccagataac

SEQ ID NO: 383681 - DNA, 16 bp, M. musculus
ccaaacagcactacca

SEQ ID NO: 383682 - DNA, 16 bp, M. musculus
ccaaacaggcctcagc

SEQ ID NO: 383683 - DNA, 37 bp, M. musculus
ccaaacaggtgatggaaatgaacaaaaccatactaga

SEQ ID NO: 383684 - DNA, 16 bp, M. musculus
ccaaacagttccacca

SEQ ID NO: 383685 - DNA, 16 bp, M. musculus
ccaaaccaaaatgaaa

SEQ ID NO: 383686 - DNA, 16 bp, M. musculus
ccaaaccaaagtcatc

SEQ ID NO: 383687 - DNA, 16 bp, M. musculus
ccaaaccaggaatgtg

SEQ ID NO: 383688 - DNA, 16 bp, M. musculus
ccaaacccagacaata

SEQ ID NO: 383689 - DNA, 16 bp, M. musculus
ccaaacccaggtcctc

SEQ ID NO: 383690 - DNA, 16 bp, M. musculus
ccaaacctaaggaaag

SEQ ID NO: 383691 - DNA, 16 bp, M. musculus
ccaaacctgaggacct

SEQ ID NO: 383692 - DNA, 16 bp, M. musculus
ccaaacgaacaccaga

SEQ ID NO: 383693 - DNA, 16 bp, M. musculus
ccaaactcaggtcttc

SEQ ID NO: 383694 - DNA, 16 bp, M. musculus
ccaaactggcctcaga

SEQ ID NO: 383695 - DNA, 16 bp, M. musculus
ccaaagaaaagtgact

SEQ ID NO: 383696 - DNA, 16 bp, M. musculus
ccaaagaaacaaactg

SEQ ID NO: 383697 - DNA, 16 bp, M. musculus
ccaaagaaacaagctg

SEQ ID NO: 383698 - DNA, 16 bp, M. musculus
ccaaagaaagacagga

SEQ ID NO: 383699 - DNA, 16 bp, M. musculus
ccaaagaaagcccagg

SEQ ID NO: 383700 - DNA, 16 bp, M. musculus
ccaaagaacagcctgg

SEQ ID NO: 383701 - DNA, 16 bp, M. musculus
ccaaagaacccttaaa

SEQ ID NO: 383702 - DNA, 16 bp, M. musculus
ccaaagaagacaccca

SEQ ID NO: 383703 - DNA, 16 bp, M. musculus
ccaaagaagatagcca

SEQ ID NO: 383704 - DNA, 16 bp, M. musculus
ccaaagaatatacaca

SEQ ID NO: 383705 - DNA, 16 bp, M. musculus
ccaaagacaactataa

SEQ ID NO: 383706 - DNA, 16 bp, M. musculus
ccaaagacattgagaa

SEQ ID NO: 383707 - DNA, 16 bp, M. musculus
ccaaagactgccccac

SEQ ID NO: 383708 - DNA, 16 bp, M. musculus
ccaaagagaccagaag

SEQ ID NO: 383709 - DNA, 16 bp, M. musculus
ccaaagagggcatcag

SEQ ID NO: 383710 - DNA, 16 bp, M. musculus
ccaaagaggtgaagga

SEQ ID NO: 383711 - DNA, 16 bp, M. musculus
ccaaagagtacatatg

SEQ ID NO: 383712 - DNA, 16 bp, M. musculus
ccaaagataagactct

SEQ ID NO: 383713 - DNA, 16 bp, M. musculus
ccaaagatctccctgt

SEQ ID NO: 383714 - DNA, 16 bp, M. musculus
ccaaagatgctgttga

SEQ ID NO: 383715 - DNA, 16 bp, M. musculus
ccaaagatggccgact

SEQ ID NO: 383716 - DNA, 16 bp, M. musculus
ccaaagattttttttt

SEQ ID NO: 383717 - DNA, 16 bp, M. musculus
ccaaagcatccaggaa

SEQ ID NO: 383718 - DNA, 16 bp, M. musculus
ccaaagccacacagca

SEQ ID NO: 383719 - DNA, 16 bp, M. musculus
ccaaagctgaccttga

SEQ ID NO: 383720 - DNA, 16 bp, M. musculus
ccaaagctttatttat

SEQ ID NO: 383721 - DNA, 16 bp, M. musculus
ccaaaggaagacaact

SEQ ID NO: 383722 - DNA, 16 bp, M. musculus
ccaaaggaggaaatat

SEQ ID NO: 383723 - DNA, 16 bp, M. musculus
ccaaaggcagacagaa

SEQ ID NO: 383724 - DNA, 16 bp, M. musculus
ccaaaggcagggtaga

SEQ ID NO: 383725 - DNA, 16 bp, M. musculus
ccaaaggccatgtgga

SEQ ID NO: 383726 - DNA, 16 bp, M. musculus
ccaaagggcacagaga

SEQ ID NO: 383727 - DNA, 16 bp, M. musculus
ccaaagtacccacact

SEQ ID NO: 383728 - DNA, 16 bp, M. musculus
ccaaagtcccaaagtc

SEQ ID NO: 383729 - DNA, 16 bp, M. musculus
ccaaagttcctgagtt

SEQ ID NO: 383730 - DNA, 16 bp, M. musculus
ccaaagttgtcttctg

SEQ ID NO: 383731 - DNA, 16 bp, M. musculus
ccaaataaaagacaga

SEQ ID NO: 383732 - DNA, 16 bp, M. musculus
ccaaataaacacttcc

SEQ ID NO: 383733 - DNA, 16 bp, M. musculus
ccaaataaaccttttt

SEQ ID NO: 383734 - DNA, 16 bp, M. musculus
ccaaataaactctttc

SEQ ID NO: 383735 - DNA, 16 bp, M. musculus
ccaaataaagatagaa

SEQ ID NO: 383736 - DNA, 16 bp, M. musculus
ccaaataaagccttcc

SEQ ID NO: 383737 - DNA, 16 bp, M. musculus
ccaaataaatcatttc

SEQ ID NO: 383738 - DNA, 16 bp, M. musculus
ccaaataaatctttcc

SEQ ID NO: 383739 - DNA, 16 bp, M. musculus
ccaaatattttctttc

SEQ ID NO: 383740 - DNA, 16 bp, M. musculus
ccaaatcacaaaagaa

SEQ ID NO: 383741 - DNA, 17 bp, M. musculus
ccaaatcaccatcagat

SEQ ID NO: 383742 - DNA, 16 bp, M. musculus
ccaaatccaaagtctc

SEQ ID NO: 383743 - DNA, 16 bp, M. musculus
ccaaatccaaatccaa

SEQ ID NO: 383744 - DNA, 16 bp, M. musculus
ccaaatcctcgccagc

SEQ ID NO: 383745 - DNA, 16 bp, M. musculus
ccaaatcttcatcatt

SEQ ID NO: 383746 - DNA, 16 bp, M. musculus
ccaaatgaatgtgcaa

SEQ ID NO: 383747 - DNA, 17 bp, M. musculus
ccaaatgaggagttggt

SEQ ID NO: 383748 - DNA, 16 bp, M. musculus
ccaaatgcaaaggcag

SEQ ID NO: 383749 - DNA, 16 bp, M. musculus
ccaaatgcaaggtcag

SEQ ID NO: 383750 - DNA, 16 bp, M. musculus
ccaaatgcaatggcag

SEQ ID NO: 383751 - DNA, 16 bp, M. musculus
ccaaatgcagaaaaca

SEQ ID NO: 383752 - DNA, 16 bp, M. musculus
ccaaatgctagaatta

SEQ ID NO: 383753 - DNA, 16 bp, M. musculus
ccaaatgctaggatta

SEQ ID NO: 383754 - DNA, 16 bp, M. musculus
ccaaatgctggaatta

SEQ ID NO: 383755 - DNA, 16 bp, M. musculus
ccaaatgctggggtta

SEQ ID NO: 383756 - DNA, 16 bp, M. musculus
ccaaatggcagagaag

SEQ ID NO: 383757 - DNA, 16 bp, M. musculus
ccaaatggcttagaag

SEQ ID NO: 383758 - DNA, 16 bp, M. musculus
ccaaatggtcagccct

SEQ ID NO: 383759 - DNA, 16 bp, M. musculus
ccaaatggtgggatta

SEQ ID NO: 383760 - DNA, 16 bp, M. musculus
ccaaatgtggatgctt

SEQ ID NO: 383761 - DNA, 16 bp, M. musculus
ccaaatgttcttttat

SEQ ID NO: 383762 - DNA, 16 bp, M. musculus
ccaaatgttgacacca

SEQ ID NO: 383763 - DNA, 16 bp, M. musculus
ccaaattctaagaagg

SEQ ID NO: 383764 - DNA, 16 bp, M. musculus
ccaaattctcagcaca

SEQ ID NO: 383765 - DNA, 16 bp, M. musculus
ccaaattctgctgctt

SEQ ID NO: 383766 - DNA, 16 bp, M. musculus
ccaaattgatttccaa

SEQ ID NO: 383767 - DNA, 16 bp, M. musculus
ccaaattgtcctctga

SEQ ID NO: 383768 - DNA, 16 bp, M. musculus
ccaaattttgcaatgt

SEQ ID NO: 383769 - DNA, 16 bp, M. musculus
ccaacaaagagagaga

SEQ ID NO: 383770 - DNA, 16 bp, M. musculus
ccaacaaattggaaaa

SEQ ID NO: 383771 - DNA, 16 bp, M. musculus
ccaacaacctcttctg

SEQ ID NO: 383772 - DNA, 16 bp, M. musculus
ccaacaactggagcaa

SEQ ID NO: 383773 - DNA, 16 bp, M. musculus
ccaacaactggagcag

SEQ ID NO: 383774 - DNA, 16 bp, M. musculus
ccaacaagaagctgaa

SEQ ID NO: 383775 - DNA, 16 bp, M. musculus
ccaacaaggacacact

SEQ ID NO: 383776 - DNA, 16 bp, M. musculus
ccaacaaggccacact

SEQ ID NO: 383777 - DNA, 16 bp, M. musculus
ccaacaatttgctgct

SEQ ID NO: 383778 - DNA, 16 bp, M. musculus
ccaacaattttttttt

SEQ ID NO: 383779 - DNA, 16 bp, M. musculus
ccaacacaactcttca

SEQ ID NO: 383780 - DNA, 16 bp, M. musculus
ccaacacacacatgca

SEQ ID NO: 383781 - DNA, 16 bp, M. musculus
ccaacacacctgtgag

SEQ ID NO: 383782 - DNA, 16 bp, M. musculus
ccaacacatccgaaaa

SEQ ID NO: 383783 - DNA, 16 bp, M. musculus
ccaacacatctgaaaa

SEQ ID NO: 383784 - DNA, 16 bp, M. musculus
ccaacaccatcttctg

SEQ ID NO: 383785 - DNA, 16 bp, M. musculus
ccaacaccctcctctg

SEQ ID NO: 383786 - DNA, 16 bp, M. musculus
ccaacaccttcttctg

SEQ ID NO: 383787 - DNA, 22 bp, M. musculus
ccaacactgagcatctccctca

SEQ ID NO: 383788 - DNA, 16 bp, M. musculus
ccaacactggaggagt

SEQ ID NO: 383789 - DNA, 16 bp, M. musculus
ccaacactgggaaggc

SEQ ID NO: 383790 - DNA, 16 bp, M. musculus
ccaacacttgaaaggc

SEQ ID NO: 383791 - DNA, 18 bp, M. musculus
ccaacagaggaatggata

SEQ ID NO: 383792 - DNA, 16 bp, M. musculus
ccaacagattgggata

SEQ ID NO: 383793 - DNA, 16 bp, M. musculus
ccaacagatttggaaa

SEQ ID NO: 383794 - DNA, 16 bp, M. musculus
ccaacagcttgggaaa

SEQ ID NO: 383795 - DNA, 17 bp, M. musculus
ccaacagcttttgaaaa

SEQ ID NO: 383796 - DNA, 16 bp, M. musculus
ccaacaggaatgccag

SEQ ID NO: 383797 - DNA, 16 bp, M. musculus
ccaacagtcctagaaa

SEQ ID NO: 383798 - DNA, 16 bp, M. musculus
ccaacagtggctgtct

SEQ ID NO: 383799 - DNA, 16 bp, M. musculus
ccaacatcaaataaat

SEQ ID NO: 383800 - DNA, 16 bp, M. musculus
ccaacatcctagaaaa

SEQ ID NO: 383801 - DNA, 16 bp, M. musculus
ccaacatgaaaacaca

SEQ ID NO: 383802 - DNA, 16 bp, M. musculus
ccaacatggtggctca

SEQ ID NO: 383803 - DNA, 18 bp, M. musculus
ccaacattattggggaca

SEQ ID NO: 383804 - DNA, 16 bp, M. musculus
ccaaccaaaaagagcc

SEQ ID NO: 383805 - DNA, 16 bp, M. musculus
ccaaccaatgtctaaa

SEQ ID NO: 383806 - DNA, 16 bp, M. musculus
ccaaccagacccctca

SEQ ID NO: 383807 - DNA, 16 bp, M. musculus
ccaaccagccaaccag

SEQ ID NO: 383808 - DNA, 16 bp, M. musculus
ccaaccagccagccaa

SEQ ID NO: 383809 - DNA, 16 bp, M. musculus
ccaaccagggctacat

SEQ ID NO: 383810 - DNA, 18 bp, M. musculus
ccaaccagtaagaaggac

SEQ ID NO: 383811 - DNA, 16 bp, M. musculus
ccaaccataaaattac

SEQ ID NO: 383812 - DNA, 16 bp, M. musculus
ccaaccatctgtaatg

SEQ ID NO: 383813 - DNA, 16 bp, M. musculus
ccaaccattggactga

SEQ ID NO: 383814 - DNA, 16 bp, M. musculus
ccaacccagggatcca

SEQ ID NO: 383815 - DNA, 16 bp, M. musculus
ccaaccccaaagctaa

SEQ ID NO: 383816 - DNA, 16 bp, M. musculus
ccaacccctaacacta

SEQ ID NO: 383817 - DNA, 16 bp, M. musculus
ccaacccctcccatgt

SEQ ID NO: 383818 - DNA, 16 bp, M. musculus
ccaaccctgggcctct

SEQ ID NO: 383819 - DNA, 16 bp, M. musculus
ccaacccttacaacct

SEQ ID NO: 383820 - DNA, 16 bp, M. musculus
ccaacctagactacat

SEQ ID NO: 383821 - DNA, 16 bp, M. musculus
ccaacctctgcctccc

SEQ ID NO: 383822 - DNA, 16 bp, M. musculus
ccaacctctggcctcc

SEQ ID NO: 383823 - DNA, 16 bp, M. musculus
ccaacctgcctgaggc

SEQ ID NO: 383824 - DNA, 16 bp, M. musculus
ccaacctggaagtcct

SEQ ID NO: 383825 - DNA, 16 bp, M. musculus
ccaacctgggctacat

SEQ ID NO: 383826 - DNA, 16 bp, M. musculus
ccaacctgggctacct

SEQ ID NO: 383827 - DNA, 16 bp, M. musculus
ccaacctgggctatgt

SEQ ID NO: 383828 - DNA, 16 bp, M. musculus
ccaacctgggtcctct

SEQ ID NO: 383829 - DNA, 16 bp, M. musculus
ccaactaagctacatc

SEQ ID NO: 383830 - DNA, 16 bp, M. musculus
ccaactataaaattac

SEQ ID NO: 383831 - DNA, 16 bp, M. musculus
ccaactataccactct

SEQ ID NO: 383832 - DNA, 16 bp, M. musculus
ccaactcacagagatc

SEQ ID NO: 383833 - DNA, 16 bp, M. musculus
ccaactcagaaatcca

SEQ ID NO: 383834 - DNA, 16 bp, M. musculus
ccaactcagaaatccg

SEQ ID NO: 383835 - DNA, 16 bp, M. musculus
ccaactcagagatcct

SEQ ID NO: 383836 - DNA, 16 bp, M. musculus
ccaactcatccactcc

SEQ ID NO: 383837 - DNA, 16 bp, M. musculus
ccaactccagcaggca

SEQ ID NO: 383838 - DNA, 16 bp, M. musculus
ccaactccagctccag

SEQ ID NO: 383839 - DNA, 16 bp, M. musculus
ccaactcctcatttgg

SEQ ID NO: 383840 - DNA, 16 bp, M. musculus
ccaactcctggtacca

SEQ ID NO: 383841 - DNA, 16 bp, M. musculus
ccaactccttccagct

SEQ ID NO: 383842 - DNA, 16 bp, M. musculus
ccaactctccagcctc

SEQ ID NO: 383843 - DNA, 16 bp, M. musculus
ccaactctcccaccat

SEQ ID NO: 383844 - DNA, 16 bp, M. musculus
ccaactcttccacaag

SEQ ID NO: 383845 - DNA, 16 bp, M. musculus
ccaactgaaaggcatt

SEQ ID NO: 383846 - DNA, 16 bp, M. musculus
ccaactgatttccaga

SEQ ID NO: 383847 - DNA, 16 bp, M. musculus
ccaactgcaacaacaa

SEQ ID NO: 383848 - DNA, 17 bp, M. musculus
ccaactgctcttccaaa

SEQ ID NO: 383849 - DNA, 16 bp, M. musculus
ccaactgctcttctga

SEQ ID NO: 383850 - DNA, 16 bp, M. musculus
ccaactggaaggcatt

SEQ ID NO: 383851 - DNA, 16 bp, M. musculus
ccaactgggatgacat

SEQ ID NO: 383852 - DNA, 17 bp, M. musculus
ccaactggtaagaaaga

SEQ ID NO: 383853 - DNA, 18 bp, M. musculus
ccaactggtaagaaggac

SEQ ID NO: 383854 - DNA, 22 bp, M. musculus
ccaactggtaagaaggacacat

SEQ ID NO: 383855 - DNA, 16 bp, M. musculus
ccaactgtggcaaaca

SEQ ID NO: 383856 - DNA, 16 bp, M. musculus
ccaacttcagtccatt

SEQ ID NO: 383857 - DNA, 16 bp, M. musculus
ccaacttcatgtcctt

SEQ ID NO: 383858 - DNA, 16 bp, M. musculus
ccaacttcatgttctc

SEQ ID NO: 383859 - DNA, 16 bp, M. musculus
ccaacttccagaagcc

SEQ ID NO: 383860 - DNA, 16 bp, M. musculus
ccaacttcctggccct

SEQ ID NO: 383861 - DNA, 16 bp, M. musculus
ccaacttcttgagctc

SEQ ID NO: 383862 - DNA, 16 bp, M. musculus
ccaacttgtcagaaag

SEQ ID NO: 383863 - DNA, 16 bp, M. musculus
ccaagaaaacacagga

SEQ ID NO: 383864 - DNA, 16 bp, M. musculus
ccaagaaaatcaagaa

SEQ ID NO: 383865 - DNA, 16 bp, M. musculus
ccaagaaacaaggtgg

SEQ ID NO: 383866 - DNA, 16 bp, M. musculus
ccaagaaacatataaa

SEQ ID NO: 383867 - DNA, 16 bp, M. musculus
ccaagaaactaaaggg

SEQ ID NO: 383868 - DNA, 16 bp, M. musculus
ccaagaaagtgaaaga

SEQ ID NO: 383869 - DNA, 16 bp, M. musculus
ccaagaacaaatcaaa

SEQ ID NO: 383870 - DNA, 16 bp, M. musculus
ccaagaacagcagcaa

SEQ ID NO: 383871 - DNA, 18 bp, M. musculus
ccaagaagaaactggaga

SEQ ID NO: 383872 - DNA, 17 bp, M. musculus
ccaagaagaaatgggag

SEQ ID NO: 383873 - DNA, 16 bp, M. musculus
ccaagaagaactctct

SEQ ID NO: 383874 - DNA, 16 bp, M. musculus
ccaagaagagggcatc

SEQ ID NO: 383875 - DNA, 16 bp, M. musculus
ccaagaagagtgttct

SEQ ID NO: 383876 - DNA, 16 bp, M. musculus
ccaagaagatctcaga

SEQ ID NO: 383877 - DNA, 16 bp, M. musculus
ccaagaagcaaggtgg

SEQ ID NO: 383878 - DNA, 16 bp, M. musculus
ccaagaagcaagtggg

SEQ ID NO: 383879 - DNA, 16 bp, M. musculus
ccaagaagcagagaaa

SEQ ID NO: 383880 - DNA, 16 bp, M. musculus
ccaagaagcaggaatg

SEQ ID NO: 383881 - DNA, 16 bp, M. musculus
ccaagaagctatttgt

SEQ ID NO: 383882 - DNA, 16 bp, M. musculus
ccaagaaggccagaag

SEQ ID NO: 383883 - DNA, 16 bp, M. musculus
ccaagaaggctacatc

SEQ ID NO: 383884 - DNA, 16 bp, M. musculus
ccaagaagtggaagtg

SEQ ID NO: 383885 - DNA, 16 bp, M. musculus
ccaagaagtgggactg

SEQ ID NO: 383886 - DNA, 16 bp, M. musculus
ccaagaagtgggagta

SEQ ID NO: 383887 - DNA, 16 bp, M. musculus
ccaagaatcaaactca

SEQ ID NO: 383888 - DNA, 16 bp, M. musculus
ccaagaatcaatgagg

SEQ ID NO: 383889 - DNA, 16 bp, M. musculus
ccaagaatggagtcat

SEQ ID NO: 383890 - DNA, 16 bp, M. musculus
ccaagaatgggagtgg

SEQ ID NO: 383891 - DNA, 16 bp, M. musculus
ccaagaattctcttac

SEQ ID NO: 383892 - DNA, 16 bp, M. musculus
ccaagaattgttcctg

SEQ ID NO: 383893 - DNA, 16 bp, M. musculus
ccaagacaaggctctg

SEQ ID NO: 383894 - DNA, 16 bp, M. musculus
ccaagacacaaggtgg

SEQ ID NO: 383895 - DNA, 16 bp, M. musculus
ccaagacagaacaaag

SEQ ID NO: 383896 - DNA, 16 bp, M. musculus
ccaagacagatttctg

SEQ ID NO: 383897 - DNA, 16 bp, M. musculus
ccaagacatccaggaa

SEQ ID NO: 383898 - DNA, 19 bp, M. musculus
ccaagacatgattctgttc

SEQ ID NO: 383899 - DNA, 16 bp, M. musculus
ccaagaccactcacaa

SEQ ID NO: 383900 - DNA, 16 bp, M. musculus
ccaagaccagatgggt

SEQ ID NO: 383901 - DNA, 16 bp, M. musculus
ccaagacctccctggg

SEQ ID NO: 383902 - DNA, 18 bp, M. musculus
ccaagactaccagcccaa

SEQ ID NO: 383903 - DNA, 18 bp, M. musculus
ccaagactaccagcccag

SEQ ID NO: 383904 - DNA, 16 bp, M. musculus
ccaagactgagaacct

SEQ ID NO: 383905 - DNA, 16 bp, M. musculus
ccaagagagaagccag

SEQ ID NO: 383906 - DNA, 16 bp, M. musculus
ccaagagaggtattgt

SEQ ID NO: 383907 - DNA, 16 bp, M. musculus
ccaagagatccaagat

SEQ ID NO: 383908 - DNA, 16 bp, M. musculus
ccaagagcacatcaaa

SEQ ID NO: 383909 - DNA, 16 bp, M. musculus
ccaagagcctcttctc

SEQ ID NO: 383910 - DNA, 16 bp, M. musculus
ccaagagcctttcctc

SEQ ID NO: 383911 - DNA, 16 bp, M. musculus
ccaagagctctggatt

SEQ ID NO: 383912 - DNA, 16 bp, M. musculus
ccaagaggaagaggaa

SEQ ID NO: 383913 - DNA, 16 bp, M. musculus
ccaagaggagagaagg

SEQ ID NO: 383914 - DNA, 16 bp, M. musculus
ccaagaggagcccctc

SEQ ID NO: 383915 - DNA, 16 bp, M. musculus
ccaagaggatgtcctc

SEQ ID NO: 383916 - DNA, 16 bp, M. musculus
ccaagaggccaagaga

SEQ ID NO: 383917 - DNA, 16 bp, M. musculus
ccaagaggcttctgcc

SEQ ID NO: 383918 - DNA, 16 bp, M. musculus
ccaagagggacccacc

SEQ ID NO: 383919 - DNA, 16 bp, M. musculus
ccaagagttcaaggcc

SEQ ID NO: 383920 - DNA, 16 bp, M. musculus
ccaagagttttatcat

SEQ ID NO: 383921 - DNA, 16 bp, M. musculus
ccaagataaacctttc

SEQ ID NO: 383922 - DNA, 16 bp, M. musculus
ccaagataaagtccac

SEQ ID NO: 383923 - DNA, 16 bp, M. musculus
ccaagatataatttgc

SEQ ID NO: 383924 - DNA, 16 bp, M. musculus
ccaagatccatgactt

SEQ ID NO: 383925 - DNA, 16 bp, M. musculus
ccaagatctctcagat

SEQ ID NO: 383926 - DNA, 16 bp, M. musculus
ccaagatctgacacta

SEQ ID NO: 383927 - DNA, 16 bp, M. musculus
ccaagatctggtctct

SEQ ID NO: 383928 - DNA, 16 bp, M. musculus
ccaagatcttccagag

SEQ ID NO: 383929 - DNA, 16 bp, M. musculus
ccaagatgctgaaggg

SEQ ID NO: 383930 - DNA, 16 bp, M. musculus
ccaagatggaggcaga

SEQ ID NO: 383931 - DNA, 16 bp, M. musculus
ccaagatggaggcagg

SEQ ID NO: 383932 - DNA, 16 bp, M. musculus
ccaagatggctcagca

SEQ ID NO: 383933 - DNA, 16 bp, M. musculus
ccaagatgtctgctgc

SEQ ID NO: 383934 - DNA, 16 bp, M. musculus
ccaagcaagcaagcaa

SEQ ID NO: 383935 - DNA, 16 bp, M. musculus
ccaagcaatggacaga

SEQ ID NO: 383936 - DNA, 16 bp, M. musculus
ccaagcactggcaaag

SEQ ID NO: 383937 - DNA, 16 bp, M. musculus
ccaagcacttgagagg

SEQ ID NO: 383938 - DNA, 16 bp, M. musculus
ccaagcagaagagaga

SEQ ID NO: 383939 - DNA, 16 bp, M. musculus
ccaagcagcagcagca

SEQ ID NO: 383940 - DNA, 16 bp, M. musculus
ccaagcagctcctttt

SEQ ID NO: 383941 - DNA, 16 bp, M. musculus
ccaagcatattcagac

SEQ ID NO: 383942 - DNA, 16 bp, M. musculus
ccaagcatggtggctc

SEQ ID NO: 383943 - DNA, 16 bp, M. musculus
ccaagccaaaccaagc

SEQ ID NO: 383944 - DNA, 16 bp, M. musculus
ccaagccaaggactct

SEQ ID NO: 383945 - DNA, 16 bp, M. musculus
ccaagccagccagggc

SEQ ID NO: 383946 - DNA, 16 bp, M. musculus
ccaagccagctccagc

SEQ ID NO: 383947 - DNA, 16 bp, M. musculus
ccaagccaggagctgg

SEQ ID NO: 383948 - DNA, 16 bp, M. musculus
ccaagccatctctcca

SEQ ID NO: 383949 - DNA, 16 bp, M. musculus
ccaagccatcttccca

SEQ ID NO: 383950 - DNA, 16 bp, M. musculus
ccaagcccagggttgg

SEQ ID NO: 383951 - DNA, 16 bp, M. musculus
ccaagcccagtgacct

SEQ ID NO: 383952 - DNA, 16 bp, M. musculus
ccaagccccttgctga

SEQ ID NO: 383953 - DNA, 16 bp, M. musculus
ccaagccctgctcccc

SEQ ID NO: 383954 - DNA, 16 bp, M. musculus
ccaagcccttagagga

SEQ ID NO: 383955 - DNA, 16 bp, M. musculus
ccaagcccttgatctt

SEQ ID NO: 383956 - DNA, 16 bp, M. musculus
ccaagcctcaactctt

SEQ ID NO: 383957 - DNA, 16 bp, M. musculus
ccaagcctcagctgct

SEQ ID NO: 383958 - DNA, 16 bp, M. musculus
ccaagcctggtctaca

SEQ ID NO: 383959 - DNA, 16 bp, M. musculus
ccaagcgatgacacca

SEQ ID NO: 383960 - DNA, 16 bp, M. musculus
ccaagcgtgtggagtt

SEQ ID NO: 383961 - DNA, 16 bp, M. musculus
ccaagctagccttgaa

SEQ ID NO: 383962 - DNA, 16 bp, M. musculus
ccaagctcccacagaa

SEQ ID NO: 383963 - DNA, 16 bp, M. musculus
ccaagctgacctcaaa

SEQ ID NO: 383964 - DNA, 16 bp, M. musculus
ccaagctgactgactc

SEQ ID NO: 383965 - DNA, 16 bp, M. musculus
ccaagctgcttttggt

SEQ ID NO: 383966 - DNA, 16 bp, M. musculus
ccaagctggcctcaga

SEQ ID NO: 383967 - DNA, 16 bp, M. musculus
ccaagctggcctccaa

SEQ ID NO: 383968 - DNA, 16 bp, M. musculus
ccaagctggcctggaa

SEQ ID NO: 383969 - DNA, 16 bp, M. musculus
ccaagctgggctcaaa

SEQ ID NO: 383970 - DNA, 16 bp, M. musculus
ccaagcttctgatctt

SEQ ID NO: 383971 - DNA, 16 bp, M. musculus
ccaagcttctggcatt

SEQ ID NO: 383972 - DNA, 16 bp, M. musculus
ccaagcttctggcctt

SEQ ID NO: 383973 - DNA, 16 bp, M. musculus
ccaaggaaacaggtct

SEQ ID NO: 383974 - DNA, 16 bp, M. musculus
ccaaggaactgaagga

SEQ ID NO: 383975 - DNA, 16 bp, M. musculus
ccaaggaagccagaag

SEQ ID NO: 383976 - DNA, 16 bp, M. musculus
ccaaggaaggaggcca

SEQ ID NO: 383977 - DNA, 16 bp, M. musculus
ccaaggacaaggaagt

SEQ ID NO: 383978 - DNA, 16 bp, M. musculus
ccaaggacacacagct

SEQ ID NO: 383979 - DNA, 16 bp, M. musculus
ccaaggacatctcctc

SEQ ID NO: 383980 - DNA, 16 bp, M. musculus
ccaaggacctttcctc

SEQ ID NO: 383981 - DNA, 16 bp, M. musculus
ccaaggagctaaaggg

SEQ ID NO: 383982 - DNA, 16 bp, M. musculus
ccaaggagctctggag

SEQ ID NO: 383983 - DNA, 16 bp, M. musculus
ccaaggagctctgggg

SEQ ID NO: 383984 - DNA, 16 bp, M. musculus
ccaaggagctgaagca

SEQ ID NO: 383985 - DNA, 16 bp, M. musculus
ccaaggagctgagggg

SEQ ID NO: 383986 - DNA, 16 bp, M. musculus
ccaaggagctggggag

SEQ ID NO: 383987 - DNA, 16 bp, M. musculus
ccaaggagttgaagga

SEQ ID NO: 383988 - DNA, 16 bp, M. musculus
ccaaggatgactttga

SEQ ID NO: 383989 - DNA, 16 bp, M. musculus
ccaaggatgcagggat

SEQ ID NO: 383990 - DNA, 16 bp, M. musculus
ccaaggcaactcttaa

SEQ ID NO: 383991 - DNA, 16 bp, M. musculus
ccaaggcaagtctttt

SEQ ID NO: 383992 - DNA, 16 bp, M. musculus
ccaaggcagccagagc

SEQ ID NO: 383993 - DNA, 16 bp, M. musculus
ccaaggcattttaaaa

SEQ ID NO: 383994 - DNA, 16 bp, M. musculus
ccaaggccaagaagtg

SEQ ID NO: 383995 - DNA, 16 bp, M. musculus
ccaaggccagacacta

SEQ ID NO: 383996 - DNA, 16 bp, M. musculus
ccaaggccagcctgga

SEQ ID NO: 383997 - DNA, 16 bp, M. musculus
ccaaggccatgctgga

SEQ ID NO: 383998 - DNA, 16 bp, M. musculus
ccaaggccttgagcat

SEQ ID NO: 383999 - DNA, 16 bp, M. musculus
ccaaggctacatagta

SEQ ID NO: 384000 - DNA, 16 bp, M. musculus
ccaaggctagccttgg

SEQ ID NO: 384001 - DNA, 16 bp, M. musculus
ccaaggctgaccttga

SEQ ID NO: 384002 - DNA, 16 bp, M. musculus
ccaaggctggaagagg

SEQ ID NO: 384003 - DNA, 16 bp, M. musculus
ccaaggctggcctcaa

SEQ ID NO: 384004 - DNA, 16 bp, M. musculus
ccaaggctgtctgaat

SEQ ID NO: 384005 - DNA, 16 bp, M. musculus
ccaaggctttgagttg

SEQ ID NO: 384006 - DNA, 16 bp, M. musculus
ccaagggagtggcact

SEQ ID NO: 384007 - DNA, 16 bp, M. musculus
ccaagggcagccacat

SEQ ID NO: 384008 - DNA, 16 bp, M. musculus
ccaagggcctctcctc

SEQ ID NO: 384009 - DNA, 16 bp, M. musculus
ccaagggctggagaga

SEQ ID NO: 384010 - DNA, 16 bp, M. musculus
ccaagggctgggatca

SEQ ID NO: 384011 - DNA, 16 bp, M. musculus
ccaagggctgtgcaga

SEQ ID NO: 384012 - DNA, 16 bp, M. musculus
ccaagggcttctcttc

SEQ ID NO: 384013 - DNA, 16 bp, M. musculus
ccaaggggcctctctt

SEQ ID NO: 384014 - DNA, 16 bp, M. musculus
ccaaggggctgaaggg

SEQ ID NO: 384015 - DNA, 16 bp, M. musculus
ccaagggtccagttta

SEQ ID NO: 384016 - DNA, 16 bp, M. musculus
ccaagggtgaccctgg

SEQ ID NO: 384017 - DNA, 17 bp, M. musculus
ccaaggtaaatgctgat

SEQ ID NO: 384018 - DNA, 16 bp, M. musculus
ccaaggtatcaatgag

SEQ ID NO: 384019 - DNA, 16 bp, M. musculus
ccaaggtatcatggag

SEQ ID NO: 384020 - DNA, 16 bp, M. musculus
ccaaggtcaccaaaag

SEQ ID NO: 384021 - DNA, 16 bp, M. musculus
ccaaggtcctctcctc

SEQ ID NO: 384022 - DNA, 16 bp, M. musculus
ccaaggtcctgaccct

SEQ ID NO: 384023 - DNA, 16 bp, M. musculus
ccaaggtctctgcttc

SEQ ID NO: 384024 - DNA, 16 bp, M. musculus
ccaaggtgacccggtg

SEQ ID NO: 384025 - DNA, 16 bp, M. musculus
ccaaggtggcccccac

SEQ ID NO: 384026 - DNA, 16 bp, M. musculus
ccaaggtggcctcaaa

SEQ ID NO: 384027 - DNA, 16 bp, M. musculus
ccaaggttgacctctg

SEQ ID NO: 384028 - DNA, 16 bp, M. musculus
ccaaggttgttctctg

SEQ ID NO: 384029 - DNA, 16 bp, M. musculus
ccaaggtttaaatgca

SEQ ID NO: 384030 - DNA, 16 bp, M. musculus
ccaaggtttttgtttt

SEQ ID NO: 384031 - DNA, 16 bp, M. musculus
ccaagtactggaatta

SEQ ID NO: 384032 - DNA, 16 bp, M. musculus
ccaagtactgggattc

SEQ ID NO: 384033 - DNA, 16 bp, M. musculus
ccaagtactgggattg

SEQ ID NO: 384034 - DNA, 16 bp, M. musculus
ccaagtagctgggatt

SEQ ID NO: 384035 - DNA, 16 bp, M. musculus
ccaagtccttccctcc

SEQ ID NO: 384036 - DNA, 16 bp, M. musculus
ccaagtctgacaacct

SEQ ID NO: 384037 - DNA, 16 bp, M. musculus
ccaagtctgatgacct

SEQ ID NO: 384038 - DNA, 16 bp, M. musculus
ccaagtctgatgactt

SEQ ID NO: 384039 - DNA, 16 bp, M. musculus
ccaagtctgtttcttc

SEQ ID NO: 384040 - DNA, 16 bp, M. musculus
ccaagtcttttttttt

SEQ ID NO: 384041 - DNA, 16 bp, M. musculus
ccaagtgactcagaaa

SEQ ID NO: 384042 - DNA, 16 bp, M. musculus
ccaagtgcaagggcag

SEQ ID NO: 384043 - DNA, 16 bp, M. musculus
ccaagtgctaagatta

SEQ ID NO: 384044 - DNA, 16 bp, M. musculus
ccaagtgctagaatta

SEQ ID NO: 384045 - DNA, 16 bp, M. musculus
ccaagtgctatgatta

SEQ ID NO: 384046 - DNA, 16 bp, M. musculus
ccaagtgctgggaatt

SEQ ID NO: 384047 - DNA, 16 bp, M. musculus
ccaagtgctgggatca

SEQ ID NO: 384048 - DNA, 16 bp, M. musculus
ccaagtgctgggattc

SEQ ID NO: 384049 - DNA, 16 bp, M. musculus
ccaagtgctgtgacta

SEQ ID NO: 384050 - DNA, 16 bp, M. musculus
ccaagtgctgttatta

SEQ ID NO: 384051 - DNA, 16 bp, M. musculus
ccaagtggaagcaaaa

SEQ ID NO: 384052 - DNA, 16 bp, M. musculus
ccaagtgggactgagg

SEQ ID NO: 384053 - DNA, 16 bp, M. musculus
ccaagtgttgggataa

SEQ ID NO: 384054 - DNA, 16 bp, M. musculus
ccaagttcaaggccag

SEQ ID NO: 384055 - DNA, 16 bp, M. musculus
ccaagttcaaggctag

SEQ ID NO: 384056 - DNA, 16 bp, M. musculus
ccaagttcagctccca

SEQ ID NO: 384057 - DNA, 16 bp, M. musculus
ccaagttcatttccca

SEQ ID NO: 384058 - DNA, 16 bp, M. musculus
ccaagttccatccact

SEQ ID NO: 384059 - DNA, 16 bp, M. musculus
ccaagttcctcccacc

SEQ ID NO: 384060 - DNA, 16 bp, M. musculus
ccaagttctgctgcca

SEQ ID NO: 384061 - DNA, 16 bp, M. musculus
ccaagttctgctgttt

SEQ ID NO: 384062 - DNA, 16 bp, M. musculus
ccaagttctggaatta

SEQ ID NO: 384063 - DNA, 16 bp, M. musculus
ccaagttgcttttagt

SEQ ID NO: 384064 - DNA, 16 bp, M. musculus
ccaagtttctgaggaa

SEQ ID NO: 384065 - DNA, 16 bp, M. musculus
ccaagtttgaggctag

SEQ ID NO: 384066 - DNA, 16 bp, M. musculus
ccaataaaaatggaaa

SEQ ID NO: 384067 - DNA, 16 bp, M. musculus
ccaataaaatagactt

SEQ ID NO: 384068 - DNA, 16 bp, M. musculus
ccaataaaatgacata

SEQ ID NO: 384069 - DNA, 16 bp, M. musculus
ccaataaaatgttttc

SEQ ID NO: 384070 - DNA, 16 bp, M. musculus
ccaataagcagcattc

SEQ ID NO: 384071 - DNA, 16 bp, M. musculus
ccaataccctcttctg

SEQ ID NO: 384072 - DNA, 16 bp, M. musculus
ccaatacttttaaaat

SEQ ID NO: 384073 - DNA, 16 bp, M. musculus
ccaatagggttgcaga

SEQ ID NO: 384074 - DNA, 16 bp, M. musculus
ccaatatattcaaaga

SEQ ID NO: 384075 - DNA, 16 bp, M. musculus
ccaatatcctgctttt

SEQ ID NO: 384076 - DNA, 16 bp, M. musculus
ccaatatctaccccat

SEQ ID NO: 384077 - DNA, 16 bp, M. musculus
ccaatatttttttaaa

SEQ ID NO: 384078 - DNA, 16 bp, M. musculus
ccaatcaaaattccaa

SEQ ID NO: 384079 - DNA, 16 bp, M. musculus
ccaatcacaaaagaac

SEQ ID NO: 384080 - DNA, 16 bp, M. musculus
ccaatcacaaagaact

SEQ ID NO: 384081 - DNA, 16 bp, M. musculus
ccaatcacaaatgaac

SEQ ID NO: 384082 - DNA, 16 bp, M. musculus
ccaatcaccaaagaag

SEQ ID NO: 384083 - DNA, 16 bp, M. musculus
ccaatcagaaagcagt

SEQ ID NO: 384084 - DNA, 16 bp, M. musculus
ccaatcagcccgagtc

SEQ ID NO: 384085 - DNA, 17 bp, M. musculus
ccaatccatgagcatgg

SEQ ID NO: 384086 - DNA, 16 bp, M. musculus
ccaatcccaaatttct

SEQ ID NO: 384087 - DNA, 16 bp, M. musculus
ccaatccctaacatta

SEQ ID NO: 384088 - DNA, 16 bp, M. musculus
ccaatcctgatgacct

SEQ ID NO: 384089 - DNA, 16 bp, M. musculus
ccaatctcttctctat

SEQ ID NO: 384090 - DNA, 16 bp, M. musculus
ccaatgacaaaccaaa

SEQ ID NO: 384091 - DNA, 16 bp, M. musculus
ccaatgacctaacttc

SEQ ID NO: 384092 - DNA, 16 bp, M. musculus
ccaatgactgccccaa

SEQ ID NO: 384093 - DNA, 16 bp, M. musculus
ccaatgagctgaggca

SEQ ID NO: 384094 - DNA, 16 bp, M. musculus
ccaatgaggatgacat

SEQ ID NO: 384095 - DNA, 17 bp, M. musculus
ccaatgcaccaaatgaa

SEQ ID NO: 384096 - DNA, 16 bp, M. musculus
ccaatgccctcttctg

SEQ ID NO: 384097 - DNA, 16 bp, M. musculus
ccaatgctctggattc

SEQ ID NO: 384098 - DNA, 16 bp, M. musculus
ccaatggaagagctag

SEQ ID NO: 384099 - DNA, 16 bp, M. musculus
ccaatggacaagtcat

SEQ ID NO: 384100 - DNA, 16 bp, M. musculus
ccaatggacagaagat

SEQ ID NO: 384101 - DNA, 16 bp, M. musculus
ccaatggactgaagtc

SEQ ID NO: 384102 - DNA, 25 bp, M. musculus
ccaatggaggagctagagaaagtag

SEQ ID NO: 384103 - DNA, 16 bp, M. musculus
ccaatggatagctgtg

SEQ ID NO: 384104 - DNA, 16 bp, M. musculus
ccaatggcaaagctct

SEQ ID NO: 384105 - DNA, 16 bp, M. musculus
ccaatggcagagaagc

SEQ ID NO: 384106 - DNA, 16 bp, M. musculus
ccaatggcttatgctc

SEQ ID NO: 384107 - DNA, 17 bp, M. musculus
ccaatgggcctctcttt

SEQ ID NO: 384108 - DNA, 16 bp, M. musculus
ccaatgggcctctttt

SEQ ID NO: 384109 - DNA, 16 bp, M. musculus
ccaatgggtaagaagg

SEQ ID NO: 384110 - DNA, 16 bp, M. musculus
ccaatggttgactgta

SEQ ID NO: 384111 - DNA, 16 bp, M. musculus
ccaatgtaacaattat

SEQ ID NO: 384112 - DNA, 16 bp, M. musculus
ccaatgtcctcttctg

SEQ ID NO: 384113 - DNA, 16 bp, M. musculus
ccaatgtctctggcct

SEQ ID NO: 384114 - DNA, 16 bp, M. musculus
ccaatgtgcataaaat

SEQ ID NO: 384115 - DNA, 16 bp, M. musculus
ccaattaaatgtcctt

SEQ ID NO: 384116 - DNA, 16 bp, M. musculus
ccaattaatatcacct

SEQ ID NO: 384117 - DNA, 16 bp, M. musculus
ccaattatctgaggaa

SEQ ID NO: 384118 - DNA, 62 bp, M. musculus
ccaattcagcatgtagggctgccctgagaggtaaaaccaagagtttagatataaatggtatg

SEQ ID NO: 384119 - DNA, 16 bp, M. musculus
ccaattcattctataa

SEQ ID NO: 384120 - DNA, 16 bp, M. musculus
ccaattccatccattt

SEQ ID NO: 384121 - DNA, 16 bp, M. musculus
ccaattggtgtgttct

SEQ ID NO: 384122 - DNA, 16 bp, M. musculus
ccaattgtgaccagcc

SEQ ID NO: 384123 - DNA, 16 bp, M. musculus
ccaatttaaaaagaaa

SEQ ID NO: 384124 - DNA, 16 bp, M. musculus
ccaatttcccctccac

SEQ ID NO: 384125 - DNA, 16 bp, M. musculus
ccaatttcccttatgt

SEQ ID NO: 384126 - DNA, 16 bp, M. musculus
ccaatttctgaggaac

SEQ ID NO: 384127 - DNA, 16 bp, M. musculus
ccaatttctttaacat

SEQ ID NO: 384128 - DNA, 16 bp, M. musculus
ccaatttcttttatga

SEQ ID NO: 384129 - DNA, 16 bp, M. musculus
ccaattttctgagaaa

SEQ ID NO: 384130 - DNA, 16 bp, M. musculus
ccaattttctgaggaa

SEQ ID NO: 384131 - DNA, 16 bp, M. musculus
ccaatttttaaaaaag

SEQ ID NO: 384132 - DNA, 16 bp, M. musculus
ccacaaaattattttc

SEQ ID NO: 384133 - DNA, 16 bp, M. musculus
ccacaaagaacagcag

SEQ ID NO: 384134 - DNA, 16 bp, M. musculus
ccacaaagcagctcac

SEQ ID NO: 384135 - DNA, 16 bp, M. musculus
ccacaaagccttcaac

SEQ ID NO: 384136 - DNA, 16 bp, M. musculus
ccacaaagctgcttcc

SEQ ID NO: 384137 - DNA, 16 bp, M. musculus
ccacaaagctgtcctc

SEQ ID NO: 384138 - DNA, 16 bp, M. musculus
ccacaaatagaaacag

SEQ ID NO: 384139 - DNA, 16 bp, M. musculus
ccacaaatcaagccct

SEQ ID NO: 384140 - DNA, 16 bp, M. musculus
ccacaacagccagggc

SEQ ID NO: 384141 - DNA, 16 bp, M. musculus
ccacaacaggatggag

SEQ ID NO: 384142 - DNA, 16 bp, M. musculus
ccacaacatgagggac

SEQ ID NO: 384143 - DNA, 16 bp, M. musculus
ccacaaccaaggcaac

SEQ ID NO: 384144 - DNA, 16 bp, M. musculus
ccacaaccacagtgac

SEQ ID NO: 384145 - DNA, 16 bp, M. musculus
ccacaaccatctataa

SEQ ID NO: 384146 - DNA, 16 bp, M. musculus
ccacaactgaagaatg

SEQ ID NO: 384147 - DNA, 16 bp, M. musculus
ccacaactggtcaaaa

SEQ ID NO: 384148 - DNA, 16 bp, M. musculus
ccacaagaacagaatc

SEQ ID NO: 384149 - DNA, 16 bp, M. musculus
ccacaagaccatcctc

SEQ ID NO: 384150 - DNA, 16 bp, M. musculus
ccacaaggcagagaga

SEQ ID NO: 384151 - DNA, 16 bp, M. musculus
ccacaaggccattctc

SEQ ID NO: 384152 - DNA, 16 bp, M. musculus
ccacaagtggaaaatt

SEQ ID NO: 384153 - DNA, 16 bp, M. musculus
ccacaatatacccaaa

SEQ ID NO: 384154 - DNA, 16 bp, M. musculus
ccacaatgcccagctt

SEQ ID NO: 384155 - DNA, 16 bp, M. musculus
ccacaatgggctggac

SEQ ID NO: 384156 - DNA, 16 bp, M. musculus
ccacaatttgtctcca

SEQ ID NO: 384157 - DNA, 16 bp, M. musculus
ccacacacacacactt

SEQ ID NO: 384158 - DNA, 16 bp, M. musculus
ccacacacagacacag

SEQ ID NO: 384159 - DNA, 16 bp, M. musculus
ccacacacaggcacac

SEQ ID NO: 384160 - DNA, 16 bp, M. musculus
ccacacacatgtacac

SEQ ID NO: 384161 - DNA, 16 bp, M. musculus
ccacacacctctcctg

SEQ ID NO: 384162 - DNA, 16 bp, M. musculus
ccacacagaaaatcct

SEQ ID NO: 384163 - DNA, 16 bp, M. musculus
ccacacagagaaaacc

SEQ ID NO: 384164 - DNA, 16 bp, M. musculus
ccacacagcaagcagg

SEQ ID NO: 384165 - DNA, 16 bp, M. musculus
ccacacaggccagaag

SEQ ID NO: 384166 - DNA, 16 bp, M. musculus
ccacacagtaatagtg

SEQ ID NO: 384167 - DNA, 16 bp, M. musculus
ccacacatatacatgc

SEQ ID NO: 384168 - DNA, 16 bp, M. musculus
ccacacatccaagaat

SEQ ID NO: 384169 - DNA, 16 bp, M. musculus
ccacacatggtggctc

SEQ ID NO: 384170 - DNA, 16 bp, M. musculus
ccacacatgtacacac

SEQ ID NO: 384171 - DNA, 16 bp, M. musculus
ccacaccaggttcctg

SEQ ID NO: 384172 - DNA, 16 bp, M. musculus
ccacacccacagtgac

SEQ ID NO: 384173 - DNA, 16 bp, M. musculus
ccacacccagcttcta

SEQ ID NO: 384174 - DNA, 16 bp, M. musculus
ccacacccagcttttt

SEQ ID NO: 384175 - DNA, 16 bp, M. musculus
ccacaccccagctcct

SEQ ID NO: 384176 - DNA, 16 bp, M. musculus
ccacacctcataatag

SEQ ID NO: 384177 - DNA, 16 bp, M. musculus
ccacacctgctcccca

SEQ ID NO: 384178 - DNA, 18 bp, M. musculus
ccacacctgctcctcaca

SEQ ID NO: 384179 - DNA, 16 bp, M. musculus
ccacactctgacccac

SEQ ID NO: 384180 - DNA, 16 bp, M. musculus
ccacactggcctcaaa

SEQ ID NO: 384181 - DNA, 16 bp, M. musculus
ccacactggcctggaa

SEQ ID NO: 384182 - DNA, 22 bp, M. musculus
ccacactggccttgaactcaga

SEQ ID NO: 384183 - DNA, 16 bp, M. musculus
ccacactgggcagctc

SEQ ID NO: 384184 - DNA, 16 bp, M. musculus
ccacactgtggtcttc

SEQ ID NO: 384185 - DNA, 16 bp, M. musculus
ccacactttatctctg

SEQ ID NO: 384186 - DNA, 16 bp, M. musculus
ccacactttgtcccca

SEQ ID NO: 384187 - DNA, 16 bp, M. musculus
ccacactttgtctatg

SEQ ID NO: 384188 - DNA, 16 bp, M. musculus
ccacactttgtctttg

SEQ ID NO: 384189 - DNA, 16 bp, M. musculus
ccacactttgtttcca

SEQ ID NO: 384190 - DNA, 16 bp, M. musculus
ccacagaaatgaaact

SEQ ID NO: 384191 - DNA, 16 bp, M. musculus
ccacagaaccatctct

SEQ ID NO: 384192 - DNA, 16 bp, M. musculus
ccacagaactcaaaag

SEQ ID NO: 384193 - DNA, 16 bp, M. musculus
ccacagaagagctgct

SEQ ID NO: 384194 - DNA, 16 bp, M. musculus
ccacagaagattctgg

SEQ ID NO: 384195 - DNA, 16 bp, M. musculus
ccacagaagctgacag

SEQ ID NO: 384196 - DNA, 16 bp, M. musculus
ccacagaaggcctctc

SEQ ID NO: 384197 - DNA, 16 bp, M. musculus
ccacagacacacagac

SEQ ID NO: 384198 - DNA, 16 bp, M. musculus
ccacagacacagacac

SEQ ID NO: 384199 - DNA, 16 bp, M. musculus
ccacagacaccaacat

SEQ ID NO: 384200 - DNA, 16 bp, M. musculus
ccacagacactctggg

SEQ ID NO: 384201 - DNA, 16 bp, M. musculus
ccacagacaggaaaca

SEQ ID NO: 384202 - DNA, 16 bp, M. musculus
ccacagaccaatctga

SEQ ID NO: 384203 - DNA, 16 bp, M. musculus
ccacagaccctcttgg

SEQ ID NO: 384204 - DNA, 16 bp, M. musculus
ccacagaccctggaca

SEQ ID NO: 384205 - DNA, 16 bp, M. musculus
ccacagaccttctgag

SEQ ID NO: 384206 - DNA, 16 bp, M. musculus
ccacagactcagacat

SEQ ID NO: 384207 - DNA, 16 bp, M. musculus
ccacagacttgcctgc

SEQ ID NO: 384208 - DNA, 16 bp, M. musculus
ccacagagacaagaac

SEQ ID NO: 384209 - DNA, 16 bp, M. musculus
ccacagagaccaaaag

SEQ ID NO: 384210 - DNA, 16 bp, M. musculus
ccacagagaccagagg

SEQ ID NO: 384211 - DNA, 16 bp, M. musculus
ccacagagagaccctg

SEQ ID NO: 384212 - DNA, 16 bp, M. musculus
ccacagagatccacct

SEQ ID NO: 384213 - DNA, 16 bp, M. musculus
ccacagagccaaagaa

SEQ ID NO: 384214 - DNA, 16 bp, M. musculus
ccacagagccacgccc

SEQ ID NO: 384215 - DNA, 16 bp, M. musculus
ccacagagccatttct

SEQ ID NO: 384216 - DNA, 16 bp, M. musculus
ccacagagctccttgg

SEQ ID NO: 384217 - DNA, 16 bp, M. musculus
ccacagagctggagtt

SEQ ID NO: 384218 - DNA, 16 bp, M. musculus
ccacagaggaacctga

SEQ ID NO: 384219 - DNA, 16 bp, M. musculus
ccacagaggccagagg

SEQ ID NO: 384220 - DNA, 16 bp, M. musculus
ccacagagtccagaag

SEQ ID NO: 384221 - DNA, 16 bp, M. musculus
ccacagagtggaagga

SEQ ID NO: 384222 - DNA, 16 bp, M. musculus
ccacagatcctgaaga

SEQ ID NO: 384223 - DNA, 16 bp, M. musculus
ccacagatggttccac

SEQ ID NO: 384224 - DNA, 16 bp, M. musculus
ccacagcaactctcat

SEQ ID NO: 384225 - DNA, 16 bp, M. musculus
ccacagcaagccctga

SEQ ID NO: 384226 - DNA, 16 bp, M. musculus
ccacagcaaggaaagg

SEQ ID NO: 384227 - DNA, 16 bp, M. musculus
ccacagcacacatgtg

SEQ ID NO: 384228 - DNA, 16 bp, M. musculus
ccacagcagccagcag

SEQ ID NO: 384229 - DNA, 16 bp, M. musculus
ccacagcatctggctc

SEQ ID NO: 384230 - DNA, 16 bp, M. musculus
ccacagcatgagaaac

SEQ ID NO: 384231 - DNA, 16 bp, M. musculus
ccacagcattaggaag

SEQ ID NO: 384232 - DNA, 16 bp, M. musculus
ccacagccacagccat

SEQ ID NO: 384233 - DNA, 16 bp, M. musculus
ccacagccacagtgac

SEQ ID NO: 384234 - DNA, 16 bp, M. musculus
ccacagccaggaaaca

SEQ ID NO: 384235 - DNA, 16 bp, M. musculus
ccacagcccaacacag

SEQ ID NO: 384236 - DNA, 16 bp, M. musculus
ccacagcccagccaat

SEQ ID NO: 384237 - DNA, 16 bp, M. musculus
ccacagcctcagccac

SEQ ID NO: 384238 - DNA, 16 bp, M. musculus
ccacagcctttgtggt

SEQ ID NO: 384239 - DNA, 16 bp, M. musculus
ccacagctaaacatta

SEQ ID NO: 384240 - DNA, 16 bp, M. musculus
ccacagctccctggga

SEQ ID NO: 384241 - DNA, 16 bp, M. musculus
ccacagctgccacagc

SEQ ID NO: 384242 - DNA, 16 bp, M. musculus
ccacagctgctgtgag

SEQ ID NO: 384243 - DNA, 16 bp, M. musculus
ccacagctggagccac

SEQ ID NO: 384244 - DNA, 16 bp, M. musculus
ccacagctggcctgga

SEQ ID NO: 384245 - DNA, 16 bp, M. musculus
ccacagcttccagaag

SEQ ID NO: 384246 - DNA, 16 bp, M. musculus
ccacagcttctcctgt

SEQ ID NO: 384247 - DNA, 16 bp, M. musculus
ccacaggaaacccaga

SEQ ID NO: 384248 - DNA, 16 bp, M. musculus
ccacaggaaaggctag

SEQ ID NO: 384249 - DNA, 16 bp, M. musculus
ccacaggaacaccaag

SEQ ID NO: 384250 - DNA, 16 bp, M. musculus
ccacaggaccaagtgc

SEQ ID NO: 384251 - DNA, 16 bp, M. musculus
ccacaggagaagcgtg

SEQ ID NO: 384252 - DNA, 16 bp, M. musculus
ccacaggatcccagga

SEQ ID NO: 384253 - DNA, 16 bp, M. musculus
ccacaggcaccaggca

SEQ ID NO: 384254 - DNA, 16 bp, M. musculus
ccacaggcagcaagga

SEQ ID NO: 384255 - DNA, 16 bp, M. musculus
ccacaggcagcagcag

SEQ ID NO: 384256 - DNA, 16 bp, M. musculus
ccacaggcagcaggca

SEQ ID NO: 384257 - DNA, 16 bp, M. musculus
ccacaggccaatctgg

SEQ ID NO: 384258 - DNA, 16 bp, M. musculus
ccacaggccagcctga

SEQ ID NO: 384259 - DNA, 16 bp, M. musculus
ccacaggctgagaact

SEQ ID NO: 384260 - DNA, 16 bp, M. musculus
ccacaggctgagaatc

SEQ ID NO: 384261 - DNA, 16 bp, M. musculus
ccacagggcaagcagg

SEQ ID NO: 384262 - DNA, 16 bp, M. musculus
ccacagggccacaggg

SEQ ID NO: 384263 - DNA, 16 bp, M. musculus
ccacaggtcagggaac

SEQ ID NO: 384264 - DNA, 16 bp, M. musculus
ccacaggtggtcagtg

SEQ ID NO: 384265 - DNA, 16 bp, M. musculus
ccacaggttcttttat

SEQ ID NO: 384266 - DNA, 16 bp, M. musculus
ccacagtcaggaagct

SEQ ID NO: 384267 - DNA, 16 bp, M. musculus
ccacagtgacactcct

SEQ ID NO: 384268 - DNA, 16 bp, M. musculus
ccacagtgagaccctg

SEQ ID NO: 384269 - DNA, 16 bp, M. musculus
ccacagtgcacatgtg

SEQ ID NO: 384270 - DNA, 16 bp, M. musculus
ccacagtgccacacct

SEQ ID NO: 384271 - DNA, 16 bp, M. musculus
ccacagtgccctgcag

SEQ ID NO: 384272 - DNA, 16 bp, M. musculus
ccacagtgctgtgtga

SEQ ID NO: 384273 - DNA, 16 bp, M. musculus
ccacagtggccagaag

SEQ ID NO: 384274 - DNA, 16 bp, M. musculus
ccacagtggctatgaa

SEQ ID NO: 384275 - DNA, 16 bp, M. musculus
ccacagtgggctgggc

SEQ ID NO: 384276 - DNA, 16 bp, M. musculus
ccacagtgggtggggc

SEQ ID NO: 384277 - DNA, 16 bp, M. musculus
ccacagtgtatgtgtg

SEQ ID NO: 384278 - DNA, 16 bp, M. musculus
ccacagtgtggatgct

SEQ ID NO: 384279 - DNA, 16 bp, M. musculus
ccacagtgtgtatgtg

SEQ ID NO: 384280 - DNA, 18 bp, M. musculus
ccacagttaagagacttt

SEQ ID NO: 384281 - DNA, 16 bp, M. musculus
ccacagttcctcatca

SEQ ID NO: 384282 - DNA, 16 bp, M. musculus
ccacagttcctcatcc

SEQ ID NO: 384283 - DNA, 16 bp, M. musculus
ccacagttcctggcag

SEQ ID NO: 384284 - DNA, 16 bp, M. musculus
ccacagttcttcatcc

SEQ ID NO: 384285 - DNA, 16 bp, M. musculus
ccacataaaactgaaa

SEQ ID NO: 384286 - DNA, 16 bp, M. musculus
ccacataaagaaccaa

SEQ ID NO: 384287 - DNA, 16 bp, M. musculus
ccacataaaggtgaaa

SEQ ID NO: 384288 - DNA, 16 bp, M. musculus
ccacatacagtgtgtg

SEQ ID NO: 384289 - DNA, 16 bp, M. musculus
ccacatacataaaata

SEQ ID NO: 384290 - DNA, 16 bp, M. musculus
ccacatacatgtatgt

SEQ ID NO: 384291 - DNA, 16 bp, M. musculus
ccacatacccaaactt

SEQ ID NO: 384292 - DNA, 16 bp, M. musculus
ccacatagaagcaggg

SEQ ID NO: 384293 - DNA, 16 bp, M. musculus
ccacatatatgtatgt

SEQ ID NO: 384294 - DNA, 16 bp, M. musculus
ccacatatgcactgtg

SEQ ID NO: 384295 - DNA, 16 bp, M. musculus
ccacatatgtgcctgt

SEQ ID NO: 384296 - DNA, 16 bp, M. musculus
ccacatatgtggccag

SEQ ID NO: 384297 - DNA, 16 bp, M. musculus
ccacatattcagagac

SEQ ID NO: 384298 - DNA, 16 bp, M. musculus
ccacatcaaaattcca

SEQ ID NO: 384299 - DNA, 16 bp, M. musculus
ccacatcacagttcat

SEQ ID NO: 384300 - DNA, 16 bp, M. musculus
ccacatcactgtgctc

SEQ ID NO: 384301 - DNA, 16 bp, M. musculus
ccacatcaggaagctc

SEQ ID NO: 384302 - DNA, 16 bp, M. musculus
ccacatccagcaggaa

SEQ ID NO: 384303 - DNA, 16 bp, M. musculus
ccacatccccaccagc

SEQ ID NO: 384304 - DNA, 16 bp, M. musculus
ccacatcctcaacagc

SEQ ID NO: 384305 - DNA, 16 bp, M. musculus
ccacatcctcgccatc

SEQ ID NO: 384306 - DNA, 16 bp, M. musculus
ccacatcctcgcctgc

SEQ ID NO: 384307 - DNA, 16 bp, M. musculus
ccacatcctggccagc

SEQ ID NO: 384308 - DNA, 16 bp, M. musculus
ccacatccttctgttt

SEQ ID NO: 384309 - DNA, 16 bp, M. musculus
ccacatctcctaacag

SEQ ID NO: 384310 - DNA, 16 bp, M. musculus
ccacatctgacagaag

SEQ ID NO: 384311 - DNA, 16 bp, M. musculus
ccacatctgatagaag

SEQ ID NO: 384312 - DNA, 16 bp, M. musculus
ccacatctggattttt

SEQ ID NO: 384313 - DNA, 16 bp, M. musculus
ccacatctgtgctgtg

SEQ ID NO: 384314 - DNA, 16 bp, M. musculus
ccacatgaagacagag

SEQ ID NO: 384315 - DNA, 16 bp, M. musculus
ccacatgaaggtcaag

SEQ ID NO: 384316 - DNA, 16 bp, M. musculus
ccacatgaataccaag

SEQ ID NO: 384317 - DNA, 16 bp, M. musculus
ccacatgcaaataaag

SEQ ID NO: 384318 - DNA, 16 bp, M. musculus
ccacatgcacacacat

SEQ ID NO: 384319 - DNA, 16 bp, M. musculus
ccacatgctggcttac

SEQ ID NO: 384320 - DNA, 16 bp, M. musculus
ccacatggaggctcac

SEQ ID NO: 384321 - DNA, 16 bp, M. musculus
ccacatggcagctcat

SEQ ID NO: 384322 - DNA, 16 bp, M. musculus
ccacatggcagctcgc

SEQ ID NO: 384323 - DNA, 16 bp, M. musculus
ccacatgggtgctgag

SEQ ID NO: 384324 - DNA, 16 bp, M. musculus
ccacatggtagaagga

SEQ ID NO: 384325 - DNA, 16 bp, M. musculus
ccacatggtagctcag

SEQ ID NO: 384326 - DNA, 16 bp, M. musculus
ccacatggtggaaaaa

SEQ ID NO: 384327 - DNA, 17 bp, M. musculus
ccacatggtggtttaca

SEQ ID NO: 384328 - DNA, 16 bp, M. musculus
ccacatgtacacatac

SEQ ID NO: 384329 - DNA, 16 bp, M. musculus
ccacatgtgcactgtg

SEQ ID NO: 384330 - DNA, 16 bp, M. musculus
ccacatgtgtacagtg

SEQ ID NO: 384331 - DNA, 16 bp, M. musculus
ccacatgtgtgctgtg

SEQ ID NO: 384332 - DNA, 16 bp, M. musculus
ccacattaaaccagat

SEQ ID NO: 384333 - DNA, 16 bp, M. musculus
ccacattccactccct

SEQ ID NO: 384334 - DNA, 16 bp, M. musculus
ccacattcccagagtc

SEQ ID NO: 384335 - DNA, 16 bp, M. musculus
ccacattcctgccttg

SEQ ID NO: 384336 - DNA, 16 bp, M. musculus
ccacattctttcaaat

SEQ ID NO: 384337 - DNA, 40 bp, M. musculus
ccacattggaaactaaacagtcatcccaggctagacacat

SEQ ID NO: 384338 - DNA, 16 bp, M. musculus
ccacattgtagaagga

SEQ ID NO: 384339 - DNA, 16 bp, M. musculus
ccacattttgtccctg

SEQ ID NO: 384340 - DNA, 16 bp, M. musculus
ccaccaaacaaggagt

SEQ ID NO: 384341 - DNA, 16 bp, M. musculus
ccaccaacaatgtagg

SEQ ID NO: 384342 - DNA, 16 bp, M. musculus
ccaccaaccaggctgc

SEQ ID NO: 384343 - DNA, 16 bp, M. musculus
ccaccaaccagggagc

SEQ ID NO: 384344 - DNA, 16 bp, M. musculus
ccaccaactcctgcct

SEQ ID NO: 384345 - DNA, 16 bp, M. musculus
ccaccaagcctgacaa

SEQ ID NO: 384346 - DNA, 16 bp, M. musculus
ccaccaagcctgacta

SEQ ID NO: 384347 - DNA, 17 bp, M. musculus
ccaccaagggtgctgcc

SEQ ID NO: 384348 - DNA, 16 bp, M. musculus
ccaccaagtcatctct

SEQ ID NO: 384349 - DNA, 16 bp, M. musculus
ccaccaatccagccct

SEQ ID NO: 384350 - DNA, 16 bp, M. musculus
ccaccaatgcagaggg

SEQ ID NO: 384351 - DNA, 16 bp, M. musculus
ccaccaatgggaggag

SEQ ID NO: 384352 - DNA, 16 bp, M. musculus
ccaccacacacacctg

SEQ ID NO: 384353 - DNA, 16 bp, M. musculus
ccaccacacccagcta

SEQ ID NO: 384354 - DNA, 16 bp, M. musculus
ccaccacacccagctg

SEQ ID NO: 384355 - DNA, 16 bp, M. musculus
ccaccacacccagctt

SEQ ID NO: 384356 - DNA, 16 bp, M. musculus
ccaccacacccggctt

SEQ ID NO: 384357 - DNA, 16 bp, M. musculus
ccaccacacctggctc

SEQ ID NO: 384358 - DNA, 16 bp, M. musculus
ccaccacacctggttt

SEQ ID NO: 384359 - DNA, 16 bp, M. musculus
ccaccacacctttaat

SEQ ID NO: 384360 - DNA, 16 bp, M. musculus
ccaccacagcaaatcc

SEQ ID NO: 384361 - DNA, 16 bp, M. musculus
ccaccacagccagtcc

SEQ ID NO: 384362 - DNA, 16 bp, M. musculus
ccaccacagcccagct

SEQ ID NO: 384363 - DNA, 16 bp, M. musculus
ccaccaccaccacagt

SEQ ID NO: 384364 - DNA, 17 bp, M. musculus
ccaccaccaccacctgg

SEQ ID NO: 384365 - DNA, 16 bp, M. musculus
ccaccaccaccattat

SEQ ID NO: 384366 - DNA, 16 bp, M. musculus
ccaccaccacccagct

SEQ ID NO: 384367 - DNA, 16 bp, M. musculus
ccaccaccaccgctgc

SEQ ID NO: 384368 - DNA, 16 bp, M. musculus
ccaccaccacctagct

SEQ ID NO: 384369 - DNA, 16 bp, M. musculus
ccaccaccacctgcct

SEQ ID NO: 384370 - DNA, 16 bp, M. musculus
ccaccaccactgccat

SEQ ID NO: 384371 - DNA, 16 bp, M. musculus
ccaccaccactgctgc

SEQ ID NO: 384372 - DNA, 16 bp, M. musculus
ccaccaccagcagcaa

SEQ ID NO: 384373 - DNA, 16 bp, M. musculus
ccaccaccgccaggct

SEQ ID NO: 384374 - DNA, 16 bp, M. musculus
ccaccacctaccagag

SEQ ID NO: 384375 - DNA, 16 bp, M. musculus
ccaccacctcccaggc

SEQ ID NO: 384376 - DNA, 16 bp, M. musculus
ccaccacctcccggct

SEQ ID NO: 384377 - DNA, 16 bp, M. musculus
ccaccacctctggtgg

SEQ ID NO: 384378 - DNA, 16 bp, M. musculus
ccaccacctggcctga

SEQ ID NO: 384379 - DNA, 16 bp, M. musculus
ccaccacctggctcag

SEQ ID NO: 384380 - DNA, 16 bp, M. musculus
ccaccacctggggacc

SEQ ID NO: 384381 - DNA, 16 bp, M. musculus
ccaccacgcccagctg

SEQ ID NO: 384382 - DNA, 17 bp, M. musculus
ccaccacgcccggctca

SEQ ID NO: 384383 - DNA, 16 bp, M. musculus
ccaccacgccctgctg

SEQ ID NO: 384384 - DNA, 16 bp, M. musculus
ccaccacgcctggcac

SEQ ID NO: 384385 - DNA, 16 bp, M. musculus
ccaccacgtccagctt

SEQ ID NO: 384386 - DNA, 16 bp, M. musculus
ccaccactacccagca

SEQ ID NO: 384387 - DNA, 16 bp, M. musculus
ccaccactacccagcc

SEQ ID NO: 384388 - DNA, 16 bp, M. musculus
ccaccactcctggttt

SEQ ID NO: 384389 - DNA, 16 bp, M. musculus
ccaccactgagctaca

SEQ ID NO: 384390 - DNA, 16 bp, M. musculus
ccaccactgcactgct

SEQ ID NO: 384391 - DNA, 16 bp, M. musculus
ccaccactgccagact

SEQ ID NO: 384392 - DNA, 16 bp, M. musculus
ccaccactgcccagaa

SEQ ID NO: 384393 - DNA, 16 bp, M. musculus
ccaccactgcccagcg

SEQ ID NO: 384394 - DNA, 16 bp, M. musculus
ccaccactgcccaggt

SEQ ID NO: 384395 - DNA, 16 bp, M. musculus
ccaccactgcccagta

SEQ ID NO: 384396 - DNA, 16 bp, M. musculus
ccaccactgcccatct

SEQ ID NO: 384397 - DNA, 16 bp, M. musculus
ccaccactgcccggca

SEQ ID NO: 384398 - DNA, 17 bp, M. musculus
ccaccactgcccggcta

SEQ ID NO: 384399 - DNA, 16 bp, M. musculus
ccaccactgcctgcct

SEQ ID NO: 384400 - DNA, 16 bp, M. musculus
ccaccactgctgccac

SEQ ID NO: 384401 - DNA, 16 bp, M. musculus
ccaccactgctgcccc

SEQ ID NO: 384402 - DNA, 16 bp, M. musculus
ccaccactgtctggct

SEQ ID NO: 384403 - DNA, 16 bp, M. musculus
ccaccacttctgctca

SEQ ID NO: 384404 - DNA, 16 bp, M. musculus
ccaccagaagagggca

SEQ ID NO: 384405 - DNA, 16 bp, M. musculus
ccaccagaagttctct

SEQ ID NO: 384406 - DNA, 16 bp, M. musculus
ccaccagacagaaaac

SEQ ID NO: 384407 - DNA, 16 bp, M. musculus
ccaccagagcaggtga

SEQ ID NO: 384408 - DNA, 16 bp, M. musculus
ccaccagagcccagct

SEQ ID NO: 384409 - DNA, 16 bp, M. musculus
ccaccagaggtttttt

SEQ ID NO: 384410 - DNA, 16 bp, M. musculus
ccaccagcaatgaaag

SEQ ID NO: 384411 - DNA, 16 bp, M. musculus
ccaccagcaatgagga

SEQ ID NO: 384412 - DNA, 16 bp, M. musculus
ccaccagcagcaccag

SEQ ID NO: 384413 - DNA, 16 bp, M. musculus
ccaccagcagctgact

SEQ ID NO: 384414 - DNA, 16 bp, M. musculus
ccaccagccaaagagt

SEQ ID NO: 384415 - DNA, 16 bp, M. musculus
ccaccagccaagggat

SEQ ID NO: 384416 - DNA, 16 bp, M. musculus
ccaccagcccaggagt

SEQ ID NO: 384417 - DNA, 16 bp, M. musculus
ccaccagcccaggatg

SEQ ID NO: 384418 - DNA, 16 bp, M. musculus
ccaccagcccagggat

SEQ ID NO: 384419 - DNA, 16 bp, M. musculus
ccaccagctctgcatc

SEQ ID NO: 384420 - DNA, 16 bp, M. musculus
ccaccagctgaggacc

SEQ ID NO: 384421 - DNA, 16 bp, M. musculus
ccaccagctgtgccag

SEQ ID NO: 384422 - DNA, 16 bp, M. musculus
ccaccagcttagccag

SEQ ID NO: 384423 - DNA, 16 bp, M. musculus
ccaccaggccagggat

SEQ ID NO: 384424 - DNA, 16 bp, M. musculus
ccaccaggcctggcct

SEQ ID NO: 384425 - DNA, 16 bp, M. musculus
ccaccaggcctggctc

SEQ ID NO: 384426 - DNA, 16 bp, M. musculus
ccaccagtaactccag

SEQ ID NO: 384427 - DNA, 16 bp, M. musculus
ccaccagtgcccagct

SEQ ID NO: 384428 - DNA, 16 bp, M. musculus
ccaccagtgcccggct

SEQ ID NO: 384429 - DNA, 16 bp, M. musculus
ccaccagtgcctggct

SEQ ID NO: 384430 - DNA, 16 bp, M. musculus
ccaccatacctggcta

SEQ ID NO: 384431 - DNA, 16 bp, M. musculus
ccaccatacctggctt

SEQ ID NO: 384432 - DNA, 16 bp, M. musculus
ccaccatacctggttt

SEQ ID NO: 384433 - DNA, 16 bp, M. musculus
ccaccatacttggctt

SEQ ID NO: 384434 - DNA, 16 bp, M. musculus
ccaccatataagcaaa

SEQ ID NO: 384435 - DNA, 16 bp, M. musculus
ccaccatatggctgct

SEQ ID NO: 384436 - DNA, 16 bp, M. musculus
ccaccatcaaggactt

SEQ ID NO: 384437 - DNA, 16 bp, M. musculus
ccaccatcaccatcaa

SEQ ID NO: 384438 - DNA, 16 bp, M. musculus
ccaccatcactgccac

SEQ ID NO: 384439 - DNA, 16 bp, M. musculus
ccaccatccctggctt

SEQ ID NO: 384440 - DNA, 16 bp, M. musculus
ccaccatcctgaagca

SEQ ID NO: 384441 - DNA, 16 bp, M. musculus
ccaccatcttctgcat

SEQ ID NO: 384442 - DNA, 16 bp, M. musculus
ccaccatgaagataat

SEQ ID NO: 384443 - DNA, 16 bp, M. musculus
ccaccatgatgttctg

SEQ ID NO: 384444 - DNA, 16 bp, M. musculus
ccaccatgccaggatc

SEQ ID NO: 384445 - DNA, 16 bp, M. musculus
ccaccatgcccagcac

SEQ ID NO: 384446 - DNA, 16 bp, M. musculus
ccaccatgcccagcag

SEQ ID NO: 384447 - DNA, 17 bp, M. musculus
ccaccatgcccggctct

SEQ ID NO: 384448 - DNA, 16 bp, M. musculus
ccaccatgccctgccc

SEQ ID NO: 384449 - DNA, 16 bp, M. musculus
ccaccatgcctgacct

SEQ ID NO: 384450 - DNA, 16 bp, M. musculus
ccaccatgcctgccct

SEQ ID NO: 384451 - DNA, 16 bp, M. musculus
ccaccatgcctggact

SEQ ID NO: 384452 - DNA, 16 bp, M. musculus
ccaccatgccttcccc

SEQ ID NO: 384453 - DNA, 16 bp, M. musculus
ccaccatgccttccct

SEQ ID NO: 384454 - DNA, 16 bp, M. musculus
ccaccatgctcagcct

SEQ ID NO: 384455 - DNA, 16 bp, M. musculus
ccaccatggctggctt

SEQ ID NO: 384456 - DNA, 16 bp, M. musculus
ccaccatgtccagctt

SEQ ID NO: 384457 - DNA, 16 bp, M. musculus
ccaccatgtctggctg

SEQ ID NO: 384458 - DNA, 16 bp, M. musculus
ccaccatgtggatgct

SEQ ID NO: 384459 - DNA, 16 bp, M. musculus
ccaccatgtggctact

SEQ ID NO: 384460 - DNA, 16 bp, M. musculus
ccaccatgtgggttct

SEQ ID NO: 384461 - DNA, 16 bp, M. musculus
ccaccatgtggttggt

SEQ ID NO: 384462 - DNA, 16 bp, M. musculus
ccaccatgtgtgtccc

SEQ ID NO: 384463 - DNA, 16 bp, M. musculus
ccaccatttgggtgct

SEQ ID NO: 384464 - DNA, 23 bp, M. musculus
ccacccacaaggggcctttcccc

SEQ ID NO: 384465 - DNA, 16 bp, M. musculus
ccacccacaatgggcc

SEQ ID NO: 384466 - DNA, 16 bp, M. musculus
ccacccacagtgggtg

SEQ ID NO: 384467 - DNA, 16 bp, M. musculus
ccacccacccactgct

SEQ ID NO: 384468 - DNA, 16 bp, M. musculus
ccacccacccatctgt

SEQ ID NO: 384469 - DNA, 16 bp, M. musculus
ccacccactcccgctt

SEQ ID NO: 384470 - DNA, 16 bp, M. musculus
ccacccactcctgcca

SEQ ID NO: 384471 - DNA, 16 bp, M. musculus
ccacccactttttttt

SEQ ID NO: 384472 - DNA, 16 bp, M. musculus
ccacccagagaagcac

SEQ ID NO: 384473 - DNA, 16 bp, M. musculus
ccacccagagacagct

SEQ ID NO: 384474 - DNA, 16 bp, M. musculus
ccacccagcagctgat

SEQ ID NO: 384475 - DNA, 16 bp, M. musculus
ccacccagcttccctt

SEQ ID NO: 384476 - DNA, 16 bp, M. musculus
ccacccagggatgagt

SEQ ID NO: 384477 - DNA, 16 bp, M. musculus
ccacccaggtccctct

SEQ ID NO: 384478 - DNA, 16 bp, M. musculus
ccacccagtgccccct

SEQ ID NO: 384479 - DNA, 16 bp, M. musculus
ccacccagtgtgtgtg

SEQ ID NO: 384480 - DNA, 16 bp, M. musculus
ccacccatccatccat

SEQ ID NO: 384481 - DNA, 16 bp, M. musculus
ccacccattcctacct

SEQ ID NO: 384482 - DNA, 16 bp, M. musculus
ccacccatttctgcct

SEQ ID NO: 384483 - DNA, 16 bp, M. musculus
ccacccatttgcctgc

SEQ ID NO: 384484 - DNA, 16 bp, M. musculus
ccaccccaaaatcagc

SEQ ID NO: 384485 - DNA, 16 bp, M. musculus
ccaccccaccccaggt

SEQ ID NO: 384486 - DNA, 16 bp, M. musculus
ccacccccagtgctgg

SEQ ID NO: 384487 - DNA, 16 bp, M. musculus
ccacccccatcccagg

SEQ ID NO: 384488 - DNA, 16 bp, M. musculus
ccaccccctgtctcca

SEQ ID NO: 384489 - DNA, 16 bp, M. musculus
ccacccctacagtgac

SEQ ID NO: 384490 - DNA, 16 bp, M. musculus
ccacccctttgcctct

SEQ ID NO: 384491 - DNA, 16 bp, M. musculus
ccacccgagactagag

SEQ ID NO: 384492 - DNA, 16 bp, M. musculus
ccaccctcccactgtt

SEQ ID NO: 384493 - DNA, 16 bp, M. musculus
ccaccctgagaaggtg

SEQ ID NO: 384494 - DNA, 16 bp, M. musculus
ccaccctgcactgagt

SEQ ID NO: 384495 - DNA, 16 bp, M. musculus
ccaccctgcccaggag

SEQ ID NO: 384496 - DNA, 16 bp, M. musculus
ccaccctgccctgctc

SEQ ID NO: 384497 - DNA, 16 bp, M. musculus
ccaccctgccctggga

SEQ ID NO: 384498 - DNA, 16 bp, M. musculus
ccaccctgctccccaa

SEQ ID NO: 384499 - DNA, 16 bp, M. musculus
ccaccctggaaatcag

SEQ ID NO: 384500 - DNA, 16 bp, M. musculus
ccaccctgggcaactt

SEQ ID NO: 384501 - DNA, 16 bp, M. musculus
ccaccctgtgggtccc

SEQ ID NO: 384502 - DNA, 16 bp, M. musculus
ccacccttacaaatcc

SEQ ID NO: 384503 - DNA, 16 bp, M. musculus
ccaccgcccggcttca

SEQ ID NO: 384504 - DNA, 16 bp, M. musculus
ccacctacccactcat

SEQ ID NO: 384505 - DNA, 16 bp, M. musculus
ccacctataatgagat

SEQ ID NO: 384506 - DNA, 16 bp, M. musculus
ccacctatctctgcct

SEQ ID NO: 384507 - DNA, 16 bp, M. musculus
ccacctcacacctgtc

SEQ ID NO: 384508 - DNA, 19 bp, M. musculus
ccacctcatccaatcagaa

SEQ ID NO: 384509 - DNA, 16 bp, M. musculus
ccacctcatccagtcc

SEQ ID NO: 384510 - DNA, 16 bp, M. musculus
ccacctccaggaagcc

SEQ ID NO: 384511 - DNA, 16 bp, M. musculus
ccacctccatctctgc

SEQ ID NO: 384512 - DNA, 16 bp, M. musculus
ccacctcccaggtgct

SEQ ID NO: 384513 - DNA, 16 bp, M. musculus
ccacctccctgccctg

SEQ ID NO: 384514 - DNA, 16 bp, M. musculus
ccacctcctggccctg

SEQ ID NO: 384515 - DNA, 16 bp, M. musculus
ccacctcctgtgggag

SEQ ID NO: 384516 - DNA, 16 bp, M. musculus
ccacctcggccggcaa

SEQ ID NO: 384517 - DNA, 16 bp, M. musculus
ccacctctccagccct

SEQ ID NO: 384518 - DNA, 16 bp, M. musculus
ccacctctccagcctc

SEQ ID NO: 384519 - DNA, 16 bp, M. musculus
ccacctctccagctcc

SEQ ID NO: 384520 - DNA, 16 bp, M. musculus
ccacctctctagctcc

SEQ ID NO: 384521 - DNA, 16 bp, M. musculus
ccacctctctgccctc

SEQ ID NO: 384522 - DNA, 16 bp, M. musculus
ccacctctgcccagct

SEQ ID NO: 384523 - DNA, 16 bp, M. musculus
ccacctctgcctccca

SEQ ID NO: 384524 - DNA, 16 bp, M. musculus
ccacctctgcctctca

SEQ ID NO: 384525 - DNA, 16 bp, M. musculus
ccacctctgggcaggt

SEQ ID NO: 384526 - DNA, 16 bp, M. musculus
ccacctctgtatttat

SEQ ID NO: 384527 - DNA, 16 bp, M. musculus
ccacctctgtcttcct

SEQ ID NO: 384528 - DNA, 16 bp, M. musculus
ccacctgaaggccaag

SEQ ID NO: 384529 - DNA, 16 bp, M. musculus
ccacctgactctacct

SEQ ID NO: 384530 - DNA, 16 bp, M. musculus
ccacctgactctgctt

SEQ ID NO: 384531 - DNA, 16 bp, M. musculus
ccacctgagaatccat

SEQ ID NO: 384532 - DNA, 16 bp, M. musculus
ccacctgcaccagaga

SEQ ID NO: 384533 - DNA, 16 bp, M. musculus
ccacctgcatctgcct

SEQ ID NO: 384534 - DNA, 16 bp, M. musculus
ccacctgccacctgcc

SEQ ID NO: 384535 - DNA, 16 bp, M. musculus
ccacctgcccagagca

SEQ ID NO: 384536 - DNA, 16 bp, M. musculus
ccacctgccctgaatt

SEQ ID NO: 384537 - DNA, 16 bp, M. musculus
ccacctgcctatgcct

SEQ ID NO: 384538 - DNA, 16 bp, M. musculus
ccacctgcctccacct

SEQ ID NO: 384539 - DNA, 16 bp, M. musculus
ccacctgcctcctgag

SEQ ID NO: 384540 - DNA, 16 bp, M. musculus
ccacctgcctctctct

SEQ ID NO: 384541 - DNA, 16 bp, M. musculus
ccacctgcctctgctc

SEQ ID NO: 384542 - DNA, 16 bp, M. musculus
ccacctgcctctgctt

SEQ ID NO: 384543 - DNA, 16 bp, M. musculus
ccacctgcctctggga

SEQ ID NO: 384544 - DNA, 16 bp, M. musculus
ccacctgcctctgtcc

SEQ ID NO: 384545 - DNA, 16 bp, M. musculus
ccacctgcctctgtct

SEQ ID NO: 384546 - DNA, 16 bp, M. musculus
ccacctgcctcttcct

SEQ ID NO: 384547 - DNA, 16 bp, M. musculus
ccacctgcctgtctcc

SEQ ID NO: 384548 - DNA, 16 bp, M. musculus
ccacctgcctgtgcct

SEQ ID NO: 384549 - DNA, 16 bp, M. musculus
ccacctgccttagcct

SEQ ID NO: 384550 - DNA, 16 bp, M. musculus
ccacctgctcaccaac

SEQ ID NO: 384551 - DNA, 16 bp, M. musculus
ccacctgctcagagaa

SEQ ID NO: 384552 - DNA, 16 bp, M. musculus
ccacctgctcagagga

SEQ ID NO: 384553 - DNA, 16 bp, M. musculus
ccacctgctcccactt

SEQ ID NO: 384554 - DNA, 16 bp, M. musculus
ccacctgctcctgcct

SEQ ID NO: 384555 - DNA, 16 bp, M. musculus
ccacctgctgtcctca

SEQ ID NO: 384556 - DNA, 16 bp, M. musculus
ccacctgcttctatga

SEQ ID NO: 384557 - DNA, 16 bp, M. musculus
ccacctgcttctccct

SEQ ID NO: 384558 - DNA, 16 bp, M. musculus
ccacctgcttctgact

SEQ ID NO: 384559 - DNA, 16 bp, M. musculus
ccacctggaactccag

SEQ ID NO: 384560 - DNA, 16 bp, M. musculus
ccacctggaactggtg

SEQ ID NO: 384561 - DNA, 16 bp, M. musculus
ccacctggaatcccat

SEQ ID NO: 384562 - DNA, 16 bp, M. musculus
ccacctggagatccat

SEQ ID NO: 384563 - DNA, 16 bp, M. musculus
ccacctggggatccaa

SEQ ID NO: 384564 - DNA, 16 bp, M. musculus
ccacctgggtgctggg

SEQ ID NO: 384565 - DNA, 16 bp, M. musculus
ccacctgtctctgtct

SEQ ID NO: 384566 - DNA, 16 bp, M. musculus
ccacctgtgactccag

SEQ ID NO: 384567 - DNA, 16 bp, M. musculus
ccacctgtgtccactt

SEQ ID NO: 384568 - DNA, 16 bp, M. musculus
ccacctgttccagaag

SEQ ID NO: 384569 - DNA, 16 bp, M. musculus
ccaccttattttttga

SEQ ID NO: 384570 - DNA, 16 bp, M. musculus
ccaccttcctctgcct

SEQ ID NO: 384571 - DNA, 16 bp, M. musculus
ccaccttcctgacaac

SEQ ID NO: 384572 - DNA, 16 bp, M. musculus
ccaccttcctgctgtg

SEQ ID NO: 384573 - DNA, 16 bp, M. musculus
ccaccttcctggtcag

SEQ ID NO: 384574 - DNA, 16 bp, M. musculus
ccaccttctcaccatt

SEQ ID NO: 384575 - DNA, 16 bp, M. musculus
ccaccttctcctctat

SEQ ID NO: 384576 - DNA, 16 bp, M. musculus
ccaccttcttctgcct

SEQ ID NO: 384577 - DNA, 16 bp, M. musculus
ccaccttggttctggg

SEQ ID NO: 384578 - DNA, 16 bp, M. musculus
ccacctttgatgctgg

SEQ ID NO: 384579 - DNA, 16 bp, M. musculus
ccaccttttctttatc

SEQ ID NO: 384580 - DNA, 18 bp, M. musculus
ccacgcaggggtagagga

SEQ ID NO: 384581 - DNA, 16 bp, M. musculus
ccacgcccggctctat

SEQ ID NO: 384582 - DNA, 16 bp, M. musculus
ccacgcctggcttttt

SEQ ID NO: 384583 - DNA, 16 bp, M. musculus
ccacggaagagctgag

SEQ ID NO: 384584 - DNA, 16 bp, M. musculus
ccacgggacaaaaatc

SEQ ID NO: 384585 - DNA, 16 bp, M. musculus
ccacggtccccagagg

SEQ ID NO: 384586 - DNA, 16 bp, M. musculus
ccacgtccagccagag

SEQ ID NO: 384587 - DNA, 16 bp, M. musculus
ccacgtctgcctgccc

SEQ ID NO: 384588 - DNA, 16 bp, M. musculus
ccacgtgctggaatta

SEQ ID NO: 384589 - DNA, 16 bp, M. musculus
ccacgtggaaactgaa

SEQ ID NO: 384590 - DNA, 16 bp, M. musculus
ccacgtggagctggga

SEQ ID NO: 384591 - DNA, 16 bp, M. musculus
ccactaacctactttc

SEQ ID NO: 384592 - DNA, 16 bp, M. musculus
ccactaagccatatct

SEQ ID NO: 384593 - DNA, 16 bp, M. musculus
ccactacataaagaaa

SEQ ID NO: 384594 - DNA, 16 bp, M. musculus
ccactacctctagtgg

SEQ ID NO: 384595 - DNA, 16 bp, M. musculus
ccactactgctgctgt

SEQ ID NO: 384596 - DNA, 16 bp, M. musculus
ccactagggggcagca

SEQ ID NO: 384597 - DNA, 16 bp, M. musculus
ccactatgcctggctg

SEQ ID NO: 384598 - DNA, 16 bp, M. musculus
ccactatgtgggtgct

SEQ ID NO: 384599 - DNA, 16 bp, M. musculus
ccactatgttcatagt

SEQ ID NO: 384600 - DNA, 16 bp, M. musculus
ccactatttaaacaaa

SEQ ID NO: 384601 - DNA, 16 bp, M. musculus
ccactcacagaggtct

SEQ ID NO: 384602 - DNA, 17 bp, M. musculus
ccactcaccaaagctga

SEQ ID NO: 384603 - DNA, 16 bp, M. musculus
ccactcagccatctcc

SEQ ID NO: 384604 - DNA, 16 bp, M. musculus
ccactcagttccctcc

SEQ ID NO: 384605 - DNA, 16 bp, M. musculus
ccactccaggaccttt

SEQ ID NO: 384606 - DNA, 16 bp, M. musculus
ccactccaggtgatct

SEQ ID NO: 384607 - DNA, 16 bp, M. musculus
ccactccagtagtgac

SEQ ID NO: 384608 - DNA, 16 bp, M. musculus
ccactccagtgaagac

SEQ ID NO: 384609 - DNA, 16 bp, M. musculus
ccactcccacagcctc

SEQ ID NO: 384610 - DNA, 18 bp, M. musculus
ccactcccactatttggc

SEQ ID NO: 384611 - DNA, 16 bp, M. musculus
ccactcccactgccgc

SEQ ID NO: 384612 - DNA, 16 bp, M. musculus
ccactcccaggtgctc

SEQ ID NO: 384613 - DNA, 16 bp, M. musculus
ccactcccagttcctg

SEQ ID NO: 384614 - DNA, 16 bp, M. musculus
ccactccctgaggcct

SEQ ID NO: 384615 - DNA, 16 bp, M. musculus
ccactccctgggccag

SEQ ID NO: 384616 - DNA, 16 bp, M. musculus
ccactccctgtggcca

SEQ ID NO: 384617 - DNA, 16 bp, M. musculus
ccactcctcagatgat

SEQ ID NO: 384618 - DNA, 16 bp, M. musculus
ccactcctccttcctg

SEQ ID NO: 384619 - DNA, 16 bp, M. musculus
ccactcctgccttcca

SEQ ID NO: 384620 - DNA, 16 bp, M. musculus
ccactcctgccttccc

SEQ ID NO: 384621 - DNA, 16 bp, M. musculus
ccactcctgccttgta

SEQ ID NO: 384622 - DNA, 16 bp, M. musculus
ccactcctgcttccag

SEQ ID NO: 384623 - DNA, 16 bp, M. musculus
ccactcctgggcatct

SEQ ID NO: 384624 - DNA, 16 bp, M. musculus
ccactcctggtaccaa

SEQ ID NO: 384625 - DNA, 16 bp, M. musculus
ccactcctggtaccag

SEQ ID NO: 384626 - DNA, 16 bp, M. musculus
ccactcctgtctcacc

SEQ ID NO: 384627 - DNA, 16 bp, M. musculus
ccactctccatcatca

SEQ ID NO: 384628 - DNA, 16 bp, M. musculus
ccactctgattggtgt

SEQ ID NO: 384629 - DNA, 16 bp, M. musculus
ccactctgcaaatcag

SEQ ID NO: 384630 - DNA, 16 bp, M. musculus
ccactctgccacaggg

SEQ ID NO: 384631 - DNA, 16 bp, M. musculus
ccactcttgggcattt

SEQ ID NO: 384632 - DNA, 16 bp, M. musculus
ccactgaaccacaccc

SEQ ID NO: 384633 - DNA, 16 bp, M. musculus
ccactgaaccacctct

SEQ ID NO: 384634 - DNA, 16 bp, M. musculus
ccactgaagaaaatgt

SEQ ID NO: 384635 - DNA, 16 bp, M. musculus
ccactgactcatctct

SEQ ID NO: 384636 - DNA, 16 bp, M. musculus
ccactgacttcaggtt

SEQ ID NO: 384637 - DNA, 16 bp, M. musculus
ccactgagatcagaca

SEQ ID NO: 384638 - DNA, 16 bp, M. musculus
ccactgagccacttct

SEQ ID NO: 384639 - DNA, 16 bp, M. musculus
ccactgagccagctcc

SEQ ID NO: 384640 - DNA, 21 bp, M. musculus
ccactgagccatctcgccagc

SEQ ID NO: 384641 - DNA, 16 bp, M. musculus
ccactgagctaaatct

SEQ ID NO: 384642 - DNA, 16 bp, M. musculus
ccactgagctacatcc

SEQ ID NO: 384643 - DNA, 16 bp, M. musculus
ccactgagctagctct

SEQ ID NO: 384644 - DNA, 16 bp, M. musculus
ccactgagctatctct

SEQ ID NO: 384645 - DNA, 16 bp, M. musculus
ccactgagctctgtcc

SEQ ID NO: 384646 - DNA, 16 bp, M. musculus
ccactgagctgcagcc

SEQ ID NO: 384647 - DNA, 16 bp, M. musculus
ccactgagctgtctcc

SEQ ID NO: 384648 - DNA, 16 bp, M. musculus
ccactgaggcagagcc

SEQ ID NO: 384649 - DNA, 16 bp, M. musculus
ccactgaggccaaacc

SEQ ID NO: 384650 - DNA, 16 bp, M. musculus
ccactgagggaagcca

SEQ ID NO: 384651 - DNA, 16 bp, M. musculus
ccactgagggcagaca

SEQ ID NO: 384652 - DNA, 18 bp, M. musculus
ccactgatggccgaccag

SEQ ID NO: 384653 - DNA, 16 bp, M. musculus
ccactgccaccaccac

SEQ ID NO: 384654 - DNA, 16 bp, M. musculus
ccactgcccagcaaaa

SEQ ID NO: 384655 - DNA, 16 bp, M. musculus
ccactgcccagcaaat

SEQ ID NO: 384656 - DNA, 16 bp, M. musculus
ccactgcccagcaaga

SEQ ID NO: 384657 - DNA, 16 bp, M. musculus
ccactgcccagcaata

SEQ ID NO: 384658 - DNA, 16 bp, M. musculus
ccactgcccagcagaa

SEQ ID NO: 384659 - DNA, 16 bp, M. musculus
ccactgcccagcagga

SEQ ID NO: 384660 - DNA, 16 bp, M. musculus
ccactgcccagccaga

SEQ ID NO: 384661 - DNA, 16 bp, M. musculus
ccactgcccagccata

SEQ ID NO: 384662 - DNA, 16 bp, M. musculus
ccactgcccagcccct

SEQ ID NO: 384663 - DNA, 16 bp, M. musculus
ccactgcccagccctg

SEQ ID NO: 384664 - DNA, 16 bp, M. musculus
ccactgcccagcctca

SEQ ID NO: 384665 - DNA, 16 bp, M. musculus
ccactgcccagcctgg

SEQ ID NO: 384666 - DNA, 16 bp, M. musculus
ccactgcccagcctgt

SEQ ID NO: 384667 - DNA, 16 bp, M. musculus
ccactgcccagctact

SEQ ID NO: 384668 - DNA, 16 bp, M. musculus
ccactgcccagctcag

SEQ ID NO: 384669 - DNA, 16 bp, M. musculus
ccactgcccagctcca

SEQ ID NO: 384670 - DNA, 16 bp, M. musculus
ccactgcccagctgat

SEQ ID NO: 384671 - DNA, 16 bp, M. musculus
ccactgcccggccatt

SEQ ID NO: 384672 - DNA, 16 bp, M. musculus
ccactgcccggctcca

SEQ ID NO: 384673 - DNA, 16 bp, M. musculus
ccactgcccggctcct

SEQ ID NO: 384674 - DNA, 16 bp, M. musculus
ccactgcccggctggg

SEQ ID NO: 384675 - DNA, 16 bp, M. musculus
ccactgccgctgctgc

SEQ ID NO: 384676 - DNA, 16 bp, M. musculus
ccactgcctctgcctc

SEQ ID NO: 384677 - DNA, 16 bp, M. musculus
ccactgcctctgcttc

SEQ ID NO: 384678 - DNA, 16 bp, M. musculus
ccactgcctctgttcc

SEQ ID NO: 384679 - DNA, 16 bp, M. musculus
ccactgcctggcaact

SEQ ID NO: 384680 - DNA, 16 bp, M. musculus
ccactgcctggccagt

SEQ ID NO: 384681 - DNA, 16 bp, M. musculus
ccactgcctggccctg

SEQ ID NO: 384682 - DNA, 16 bp, M. musculus
ccactgcctggcctca

SEQ ID NO: 384683 - DNA, 16 bp, M. musculus
ccactgcctggctaca

SEQ ID NO: 384684 - DNA, 16 bp, M. musculus
ccactgcctggctaga

SEQ ID NO: 384685 - DNA, 16 bp, M. musculus
ccactgcctggctgag

SEQ ID NO: 384686 - DNA, 16 bp, M. musculus
ccactgctacacacct

SEQ ID NO: 384687 - DNA, 16 bp, M. musculus
ccactgctgccaccac

SEQ ID NO: 384688 - DNA, 16 bp, M. musculus
ccactgctgctgcctg

SEQ ID NO: 384689 - DNA, 16 bp, M. musculus
ccactgctgctgctct

SEQ ID NO: 384690 - DNA, 16 bp, M. musculus
ccactgctgctgttgt

SEQ ID NO: 384691 - DNA, 16 bp, M. musculus
ccactgctgcttcctg

SEQ ID NO: 384692 - DNA, 16 bp, M. musculus
ccactgctggaacctg

SEQ ID NO: 384693 - DNA, 16 bp, M. musculus
ccactgctgtcaaaga

SEQ ID NO: 384694 - DNA, 16 bp, M. musculus
ccactgctgttgctgt

SEQ ID NO: 384695 - DNA, 16 bp, M. musculus
ccactggaagagcaac

SEQ ID NO: 384696 - DNA, 16 bp, M. musculus
ccactggacaggcata

SEQ ID NO: 384697 - DNA, 16 bp, M. musculus
ccactggagttcctgc

SEQ ID NO: 384698 - DNA, 16 bp, M. musculus
ccactggcaaacactt

SEQ ID NO: 384699 - DNA, 16 bp, M. musculus
ccactggccagccagc

SEQ ID NO: 384700 - DNA, 16 bp, M. musculus
ccactggccttttcca

SEQ ID NO: 384701 - DNA, 16 bp, M. musculus
ccactggctgttcttc

SEQ ID NO: 384702 - DNA, 16 bp, M. musculus
ccactgggatgtctcc

SEQ ID NO: 384703 - DNA, 16 bp, M. musculus
ccactgggcagaaatt

SEQ ID NO: 384704 - DNA, 16 bp, M. musculus
ccactgtaaaggcaga

SEQ ID NO: 384705 - DNA, 16 bp, M. musculus
ccactgtctccaagag

SEQ ID NO: 384706 - DNA, 16 bp, M. musculus
ccactgtctctgcctc

SEQ ID NO: 384707 - DNA, 16 bp, M. musculus
ccactgtgacccgctg

SEQ ID NO: 384708 - DNA, 16 bp, M. musculus
ccactgtggctcaaga

SEQ ID NO: 384709 - DNA, 16 bp, M. musculus
ccactgttgaggggca

SEQ ID NO: 384710 - DNA, 16 bp, M. musculus
ccacttcacacacaca

SEQ ID NO: 384711 - DNA, 16 bp, M. musculus
ccacttccaggcactg

SEQ ID NO: 384712 - DNA, 16 bp, M. musculus
ccacttcccaggactt

SEQ ID NO: 384713 - DNA, 16 bp, M. musculus
ccacttcctcctcctg

SEQ ID NO: 384714 - DNA, 16 bp, M. musculus
ccacttcctcttcctg

SEQ ID NO: 384715 - DNA, 16 bp, M. musculus
ccacttctaatccaga

SEQ ID NO: 384716 - DNA, 16 bp, M. musculus
ccacttctatgcttgc

SEQ ID NO: 384717 - DNA, 16 bp, M. musculus
ccacttctctatttgc

SEQ ID NO: 384718 - DNA, 16 bp, M. musculus
ccacttctgtgttagc

SEQ ID NO: 384719 - DNA, 16 bp, M. musculus
ccacttcttcctcctg

SEQ ID NO: 384720 - DNA, 16 bp, M. musculus
ccacttgaaaaaaaaa

SEQ ID NO: 384721 - DNA, 16 bp, M. musculus
ccacttgcctcttcct

SEQ ID NO: 384722 - DNA, 16 bp, M. musculus
ccacttgctctggccc

SEQ ID NO: 384723 - DNA, 16 bp, M. musculus
ccacttgggaggcaga

SEQ ID NO: 384724 - DNA, 16 bp, M. musculus
ccacttgggaggctga

SEQ ID NO: 384725 - DNA, 16 bp, M. musculus
ccacttgtaactccag

SEQ ID NO: 384726 - DNA, 16 bp, M. musculus
ccactttcattaatgg

SEQ ID NO: 384727 - DNA, 16 bp, M. musculus
ccactttccctcccag

SEQ ID NO: 384728 - DNA, 16 bp, M. musculus
ccactttcctctgcct

SEQ ID NO: 384729 - DNA, 17 bp, M. musculus
ccactttcctgactttt

SEQ ID NO: 384730 - DNA, 16 bp, M. musculus
ccactttctccttacc

SEQ ID NO: 384731 - DNA, 16 bp, M. musculus
ccactttctgctctat

SEQ ID NO: 384732 - DNA, 16 bp, M. musculus
ccactttctggccctg

SEQ ID NO: 384733 - DNA, 16 bp, M. musculus
ccactttgggtctgtt

SEQ ID NO: 384734 - DNA, 16 bp, M. musculus
ccactttgggttccga

SEQ ID NO: 384735 - DNA, 16 bp, M. musculus
ccactttgtgtgtgtg

SEQ ID NO: 384736 - DNA, 47 bp, M. musculus
ccactttgttcatgtgcccattgagcaatgacagggatggctgggga

SEQ ID NO: 384737 - DNA, 16 bp, M. musculus
ccacttttggccctgg

SEQ ID NO: 384738 - DNA, 16 bp, M. musculus
ccactttttcttctgt

SEQ ID NO: 384739 - DNA, 16 bp, M. musculus
ccagaaaacaaattcc

SEQ ID NO: 384740 - DNA, 16 bp, M. musculus
ccagaaaagaaatccc

SEQ ID NO: 384741 - DNA, 16 bp, M. musculus
ccagaaaagaagttcc

SEQ ID NO: 384742 - DNA, 16 bp, M. musculus
ccagaaaagaatttcc

SEQ ID NO: 384743 - DNA, 16 bp, M. musculus
ccagaaaagccagggc

SEQ ID NO: 384744 - DNA, 16 bp, M. musculus
ccagaaaagcctggac

SEQ ID NO: 384745 - DNA, 16 bp, M. musculus
ccagaaaaggatgttg

SEQ ID NO: 384746 - DNA, 16 bp, M. musculus
ccagaaaagggcactg

SEQ ID NO: 384747 - DNA, 16 bp, M. musculus
ccagaaaataaacctc

SEQ ID NO: 384748 - DNA, 16 bp, M. musculus
ccagaaaatccaggac

SEQ ID NO: 384749 - DNA, 16 bp, M. musculus
ccagaaacacaaacat

SEQ ID NO: 384750 - DNA, 16 bp, M. musculus
ccagaaacacatttta

SEQ ID NO: 384751 - DNA, 16 bp, M. musculus
ccagaaaccacatggc

SEQ ID NO: 384752 - DNA, 16 bp, M. musculus
ccagaaaccagaaacc

SEQ ID NO: 384753 - DNA, 16 bp, M. musculus
ccagaaaccctgtctc

SEQ ID NO: 384754 - DNA, 16 bp, M. musculus
ccagaaagacagacat

SEQ ID NO: 384755 - DNA, 16 bp, M. musculus
ccagaaagactttgct

SEQ ID NO: 384756 - DNA, 16 bp, M. musculus
ccagaaagataaacat

SEQ ID NO: 384757 - DNA, 16 bp, M. musculus
ccagaaagataaatat

SEQ ID NO: 384758 - DNA, 16 bp, M. musculus
ccagaaagcagcagaa

SEQ ID NO: 384759 - DNA, 16 bp, M. musculus
ccagaaagtagaaaca

SEQ ID NO: 384760 - DNA, 16 bp, M. musculus
ccagaaagttccagat

SEQ ID NO: 384761 - DNA, 16 bp, M. musculus
ccagaaagtttttgct

SEQ ID NO: 384762 - DNA, 16 bp, M. musculus
ccagaaataaacacac

SEQ ID NO: 384763 - DNA, 16 bp, M. musculus
ccagaaatacacacac

SEQ ID NO: 384764 - DNA, 16 bp, M. musculus
ccagaaatcctgagtt

SEQ ID NO: 384765 - DNA, 16 bp, M. musculus
ccagaaatgaattcac

SEQ ID NO: 384766 - DNA, 16 bp, M. musculus
ccagaaatggagagca

SEQ ID NO: 384767 - DNA, 16 bp, M. musculus
ccagaaatggtcccac

SEQ ID NO: 384768 - DNA, 16 bp, M. musculus
ccagaaattgtaaaca

SEQ ID NO: 384769 - DNA, 16 bp, M. musculus
ccagaacaaaaggaag

SEQ ID NO: 384770 - DNA, 16 bp, M. musculus
ccagaacacaatgaga

SEQ ID NO: 384771 - DNA, 16 bp, M. musculus
ccagaacagccagagc

SEQ ID NO: 384772 - DNA, 16 bp, M. musculus
ccagaaccaaagggaa

SEQ ID NO: 384773 - DNA, 16 bp, M. musculus
ccagaaccacaggatc

SEQ ID NO: 384774 - DNA, 16 bp, M. musculus
ccagaaccatgtggct

SEQ ID NO: 384775 - DNA, 16 bp, M. musculus
ccagaacccacataaa

SEQ ID NO: 384776 - DNA, 16 bp, M. musculus
ccagaacccatataaa

SEQ ID NO: 384777 - DNA, 16 bp, M. musculus
ccagaacccccagagc

SEQ ID NO: 384778 - DNA, 16 bp, M. musculus
ccagaacctatgtaaa

SEQ ID NO: 384779 - DNA, 16 bp, M. musculus
ccagaacctggaaata

SEQ ID NO: 384780 - DNA, 16 bp, M. musculus
ccagaactcccagagc

SEQ ID NO: 384781 - DNA, 16 bp, M. musculus
ccagaactgaccctgt

SEQ ID NO: 384782 - DNA, 16 bp, M. musculus
ccagaactgatcaaaa

SEQ ID NO: 384783 - DNA, 16 bp, M. musculus
ccagaactggctcttc

SEQ ID NO: 384784 - DNA, 16 bp, M. musculus
ccagaactggggaggc

SEQ ID NO: 384785 - DNA, 16 bp, M. musculus
ccagaactgtgagaaa

SEQ ID NO: 384786 - DNA, 16 bp, M. musculus
ccagaacttgctctgt

SEQ ID NO: 384787 - DNA, 16 bp, M. musculus
ccagaactttaaagct

SEQ ID NO: 384788 - DNA, 16 bp, M. musculus
ccagaagaacagaatg

SEQ ID NO: 384789 - DNA, 16 bp, M. musculus
ccagaagaatgaatga

SEQ ID NO: 384790 - DNA, 16 bp, M. musculus
ccagaagacaaccttg

SEQ ID NO: 384791 - DNA, 16 bp, M. musculus
ccagaagacccagatt

SEQ ID NO: 384792 - DNA, 16 bp, M. musculus
ccagaagagaagaact

SEQ ID NO: 384793 - DNA, 16 bp, M. musculus
ccagaagagaatatca

SEQ ID NO: 384794 - DNA, 16 bp, M. musculus
ccagaagagagcattg

SEQ ID NO: 384795 - DNA, 16 bp, M. musculus
ccagaagagagtgctg

SEQ ID NO: 384796 - DNA, 16 bp, M. musculus
ccagaagagcagccag

SEQ ID NO: 384797 - DNA, 16 bp, M. musculus
ccagaagagcctgaac

SEQ ID NO: 384798 - DNA, 16 bp, M. musculus
ccagaagagcctggag

SEQ ID NO: 384799 - DNA, 16 bp, M. musculus
ccagaagaggaggcag

SEQ ID NO: 384800 - DNA, 16 bp, M. musculus
ccagaagaggaggctg

SEQ ID NO: 384801 - DNA, 16 bp, M. musculus
ccagaagaggagtcag

SEQ ID NO: 384802 - DNA, 16 bp, M. musculus
ccagaagaggccgtca

SEQ ID NO: 384803 - DNA, 16 bp, M. musculus
ccagaagagggagctg

SEQ ID NO: 384804 - DNA, 20 bp, M. musculus
ccagaagagggagtcagatc

SEQ ID NO: 384805 - DNA, 21 bp, M. musculus
ccagaagagggagtcagatct

SEQ ID NO: 384806 - DNA, 16 bp, M. musculus
ccagaagagggcagca

SEQ ID NO: 384807 - DNA, 16 bp, M. musculus
ccagaagagggcatcc

SEQ ID NO: 384808 - DNA, 16 bp, M. musculus
ccagaagagggcatgg

SEQ ID NO: 384809 - DNA, 16 bp, M. musculus
ccagaagagggcccca

SEQ ID NO: 384810 - DNA, 16 bp, M. musculus
ccagaagagggcgtct

SEQ ID NO: 384811 - DNA, 16 bp, M. musculus
ccagaagagggtactg

SEQ ID NO: 384812 - DNA, 16 bp, M. musculus
ccagaagagggttttg

SEQ ID NO: 384813 - DNA, 16 bp, M. musculus
ccagaagagtgtgtta

SEQ ID NO: 384814 - DNA, 16 bp, M. musculus
ccagaagatgttccaa

SEQ ID NO: 384815 - DNA, 16 bp, M. musculus
ccagaagatgttgcaa

SEQ ID NO: 384816 - DNA, 16 bp, M. musculus
ccagaagattagaaca

SEQ ID NO: 384817 - DNA, 16 bp, M. musculus
ccagaagattctggac

SEQ ID NO: 384818 - DNA, 16 bp, M. musculus
ccagaagatttcactt

SEQ ID NO: 384819 - DNA, 16 bp, M. musculus
ccagaagcaggagctg

SEQ ID NO: 384820 - DNA, 16 bp, M. musculus
ccagaagctgaaagaa

SEQ ID NO: 384821 - DNA, 16 bp, M. musculus
ccagaagctggaagaa

SEQ ID NO: 384822 - DNA, 16 bp, M. musculus
ccagaagctggagaga

SEQ ID NO: 384823 - DNA, 16 bp, M. musculus
ccagaagctggcaaga

SEQ ID NO: 384824 - DNA, 16 bp, M. musculus
ccagaagctgggaaca

SEQ ID NO: 384825 - DNA, 16 bp, M. musculus
ccagaagctgtcaggt

SEQ ID NO: 384826 - DNA, 16 bp, M. musculus
ccagaagctgtcagtt

SEQ ID NO: 384827 - DNA, 16 bp, M. musculus
ccagaagctgtccagt

SEQ ID NO: 384828 - DNA, 16 bp, M. musculus
ccagaagctgtctcca

SEQ ID NO: 384829 - DNA, 16 bp, M. musculus
ccagaagcttggtcac

SEQ ID NO: 384830 - DNA, 16 bp, M. musculus
ccagaaggaagatgga

SEQ ID NO: 384831 - DNA, 16 bp, M. musculus
ccagaaggagactgtc

SEQ ID NO: 384832 - DNA, 16 bp, M. musculus
ccagaaggaggcatca

SEQ ID NO: 384833 - DNA, 16 bp, M. musculus
ccagaaggagtcagat

SEQ ID NO: 384834 - DNA, 16 bp, M. musculus
ccagaaggcacagaga

SEQ ID NO: 384835 - DNA, 16 bp, M. musculus
ccagaaggccttcctg

SEQ ID NO: 384836 - DNA, 16 bp, M. musculus
ccagaagggcctgggc

SEQ ID NO: 384837 - DNA, 16 bp, M. musculus
ccagaaggggaataaa

SEQ ID NO: 384838 - DNA, 16 bp, M. musculus
ccagaagggggcactg

SEQ ID NO: 384839 - DNA, 16 bp, M. musculus
ccagaagggggcatca

SEQ ID NO: 384840 - DNA, 16 bp, M. musculus
ccagaagggtcaagga

SEQ ID NO: 384841 - DNA, 16 bp, M. musculus
ccagaaggtggcactg

SEQ ID NO: 384842 - DNA, 16 bp, M. musculus
ccagaagtagtggaaa

SEQ ID NO: 384843 - DNA, 16 bp, M. musculus
ccagaagtcccacctt

SEQ ID NO: 384844 - DNA, 16 bp, M. musculus
ccagaagttagaaaca

SEQ ID NO: 384845 - DNA, 16 bp, M. musculus
ccagaagttctttatt

SEQ ID NO: 384846 - DNA, 16 bp, M. musculus
ccagaataccaggagc

SEQ ID NO: 384847 - DNA, 16 bp, M. musculus
ccagaatcctgaagaa

SEQ ID NO: 384848 - DNA, 16 bp, M. musculus
ccagaatccttggaag

SEQ ID NO: 384849 - DNA, 16 bp, M. musculus
ccagaatcctttctgc

SEQ ID NO: 384850 - DNA, 16 bp, M. musculus
ccagaatcttctgcag

SEQ ID NO: 384851 - DNA, 16 bp, M. musculus
ccagaatgcaccagag

SEQ ID NO: 384852 - DNA, 16 bp, M. musculus
ccagaatggctgacca

SEQ ID NO: 384853 - DNA, 16 bp, M. musculus
ccagaattccaaaagt

SEQ ID NO: 384854 - DNA, 16 bp, M. musculus
ccagaattccaaacat

SEQ ID NO: 384855 - DNA, 16 bp, M. musculus
ccagaattccaaatgt

SEQ ID NO: 384856 - DNA, 16 bp, M. musculus
ccagaattttttttaa

SEQ ID NO: 384857 - DNA, 16 bp, M. musculus
ccagacaaaaactggg

SEQ ID NO: 384858 - DNA, 16 bp, M. musculus
ccagacaaggtttctc

SEQ ID NO: 384859 - DNA, 16 bp, M. musculus
ccagacaatgccatcc

SEQ ID NO: 384860 - DNA, 16 bp, M. musculus
ccagacacaggcaagg

SEQ ID NO: 384861 - DNA, 16 bp, M. musculus
ccagacaccattgtgg

SEQ ID NO: 384862 - DNA, 16 bp, M. musculus
ccagacaccccagagc

SEQ ID NO: 384863 - DNA, 16 bp, M. musculus
ccagacactgccccac

SEQ ID NO: 384864 - DNA, 16 bp, M. musculus
ccagacagacagacac

SEQ ID NO: 384865 - DNA, 16 bp, M. musculus
ccagacagagccaagg

SEQ ID NO: 384866 - DNA, 16 bp, M. musculus
ccagacagccccacag

SEQ ID NO: 384867 - DNA, 16 bp, M. musculus
ccagacagggcttctc

SEQ ID NO: 384868 - DNA, 16 bp, M. musculus
ccagacatctggccac

SEQ ID NO: 384869 - DNA, 16 bp, M. musculus
ccagacatgagagccg

SEQ ID NO: 384870 - DNA, 16 bp, M. musculus
ccagaccaatgactca

SEQ ID NO: 384871 - DNA, 16 bp, M. musculus
ccagaccagccaggga

SEQ ID NO: 384872 - DNA, 16 bp, M. musculus
ccagaccagctagggc

SEQ ID NO: 384873 - DNA, 16 bp, M. musculus
ccagacccagacccag

SEQ ID NO: 384874 - DNA, 16 bp, M. musculus
ccagacccagcagtcc

SEQ ID NO: 384875 - DNA, 16 bp, M. musculus
ccagacccagggcttt

SEQ ID NO: 384876 - DNA, 16 bp, M. musculus
ccagacccttcagagc

SEQ ID NO: 384877 - DNA, 16 bp, M. musculus
ccagacctccccattc

SEQ ID NO: 384878 - DNA, 16 bp, M. musculus
ccagaccttcaaagaa

SEQ ID NO: 384879 - DNA, 16 bp, M. musculus
ccagacctttgctcaa

SEQ ID NO: 384880 - DNA, 16 bp, M. musculus
ccagactagccttaaa

SEQ ID NO: 384881 - DNA, 16 bp, M. musculus
ccagactcactggagg

SEQ ID NO: 384882 - DNA, 16 bp, M. musculus
ccagactcagaaaggc

SEQ ID NO: 384883 - DNA, 16 bp, M. musculus
ccagactgacctcaga

SEQ ID NO: 384884 - DNA, 16 bp, M. musculus
ccagactgacttcaaa

SEQ ID NO: 384885 - DNA, 16 bp, M. musculus
ccagactgacttccag

SEQ ID NO: 384886 - DNA, 16 bp, M. musculus
ccagactgatttgcag

SEQ ID NO: 384887 - DNA, 16 bp, M. musculus
ccagactgcccttgaa

SEQ ID NO: 384888 - DNA, 16 bp, M. musculus
ccagactgctgcagct

SEQ ID NO: 384889 - DNA, 16 bp, M. musculus
ccagactggcattgaa

SEQ ID NO: 384890 - DNA, 16 bp, M. musculus
ccagactggcctcaaa

SEQ ID NO: 384891 - DNA, 16 bp, M. musculus
ccagactggcctggaa

SEQ ID NO: 384892 - DNA, 16 bp, M. musculus
ccagactggtcttgaa

SEQ ID NO: 384893 - DNA, 16 bp, M. musculus
ccagactgtcctcaaa

SEQ ID NO: 384894 - DNA, 16 bp, M. musculus
ccagacttcttaacag

SEQ ID NO: 384895 - DNA, 16 bp, M. musculus
ccagactttttttttt

SEQ ID NO: 384896 - DNA, 17 bp, M. musculus
ccagagaaactctgtct

SEQ ID NO: 384897 - DNA, 16 bp, M. musculus
ccagagaaactgaaac

SEQ ID NO: 384898 - DNA, 16 bp, M. musculus
ccagagaaattcaaca

SEQ ID NO: 384899 - DNA, 16 bp, M. musculus
ccagagaacacacaca

SEQ ID NO: 384900 - DNA, 16 bp, M. musculus
ccagagaacagagtct

SEQ ID NO: 384901 - DNA, 16 bp, M. musculus
ccagagaactaaataa

SEQ ID NO: 384902 - DNA, 16 bp, M. musculus
ccagagaagcaaataa

SEQ ID NO: 384903 - DNA, 16 bp, M. musculus
ccagagaagcacactt

SEQ ID NO: 384904 - DNA, 16 bp, M. musculus
ccagagaattccaaat

SEQ ID NO: 384905 - DNA, 16 bp, M. musculus
ccagagacacaggagg

SEQ ID NO: 384906 - DNA, 16 bp, M. musculus
ccagagacagccaagg

SEQ ID NO: 384907 - DNA, 16 bp, M. musculus
ccagagacagctgaac

SEQ ID NO: 384908 - DNA, 16 bp, M. musculus
ccagagacaggtgcct

SEQ ID NO: 384909 - DNA, 16 bp, M. musculus
ccagagacagtatcca

SEQ ID NO: 384910 - DNA, 16 bp, M. musculus
ccagagacagtgaaac

SEQ ID NO: 384911 - DNA, 16 bp, M. musculus
ccagagacctcaggag

SEQ ID NO: 384912 - DNA, 16 bp, M. musculus
ccagagacctcctaaa

SEQ ID NO: 384913 - DNA, 16 bp, M. musculus
ccagagactacaaaag

SEQ ID NO: 384914 - DNA, 16 bp, M. musculus
ccagagactagaccac

SEQ ID NO: 384915 - DNA, 16 bp, M. musculus
ccagagactgatgact

SEQ ID NO: 384916 - DNA, 16 bp, M. musculus
ccagagactgcctgac

SEQ ID NO: 384917 - DNA, 16 bp, M. musculus
ccagagacttccccac

SEQ ID NO: 384918 - DNA, 16 bp, M. musculus
ccagagagagctggtc

SEQ ID NO: 384919 - DNA, 16 bp, M. musculus
ccagagagccaggaga

SEQ ID NO: 384920 - DNA, 16 bp, M. musculus
ccagagagctcctaca

SEQ ID NO: 384921 - DNA, 16 bp, M. musculus
ccagagaggcagagaa

SEQ ID NO: 384922 - DNA, 16 bp, M. musculus
ccagagaggcagagag

SEQ ID NO: 384923 - DNA, 16 bp, M. musculus
ccagagaggcagcagc

SEQ ID NO: 384924 - DNA, 16 bp, M. musculus
ccagagaggctccacc

SEQ ID NO: 384925 - DNA, 16 bp, M. musculus
ccagagagggaaggta

SEQ ID NO: 384926 - DNA, 16 bp, M. musculus
ccagagagggtgttgg

SEQ ID NO: 384927 - DNA, 16 bp, M. musculus
ccagagagtgaggagg

SEQ ID NO: 384928 - DNA, 16 bp, M. musculus
ccagagagtggcatta

SEQ ID NO: 384929 - DNA, 16 bp, M. musculus
ccagagataacaggtt

SEQ ID NO: 384930 - DNA, 16 bp, M. musculus
ccagagatactgccca

SEQ ID NO: 384931 - DNA, 19 bp, M. musculus
ccagagatcctgagttcaa

SEQ ID NO: 384932 - DNA, 16 bp, M. musculus
ccagagatctatccca

SEQ ID NO: 384933 - DNA, 16 bp, M. musculus
ccagagatgaccttga

SEQ ID NO: 384934 - DNA, 16 bp, M. musculus
ccagagatgcaataat

SEQ ID NO: 384935 - DNA, 16 bp, M. musculus
ccagagatggccaagg

SEQ ID NO: 384936 - DNA, 16 bp, M. musculus
ccagagatggctcccc

SEQ ID NO: 384937 - DNA, 16 bp, M. musculus
ccagagattccaggga

SEQ ID NO: 384938 - DNA, 16 bp, M. musculus
ccagagcagtcatgtt

SEQ ID NO: 384939 - DNA, 16 bp, M. musculus
ccagagcatgaacaca

SEQ ID NO: 384940 - DNA, 16 bp, M. musculus
ccagagccacatggcc

SEQ ID NO: 384941 - DNA, 16 bp, M. musculus
ccagagccaggaagag

SEQ ID NO: 384942 - DNA, 16 bp, M. musculus
ccagagccaggcagtg

SEQ ID NO: 384943 - DNA, 16 bp, M. musculus
ccagagccatgcctgc

SEQ ID NO: 384944 - DNA, 16 bp, M. musculus
ccagagccatgggtcc

SEQ ID NO: 384945 - DNA, 16 bp, M. musculus
ccagagcccacataaa

SEQ ID NO: 384946 - DNA, 16 bp, M. musculus
ccagagcccccagagc

SEQ ID NO: 384947 - DNA, 16 bp, M. musculus
ccagagcctaaccaat

SEQ ID NO: 384948 - DNA, 16 bp, M. musculus
ccagagctactttgct

SEQ ID NO: 384949 - DNA, 16 bp, M. musculus
ccagagctcaccaata

SEQ ID NO: 384950 - DNA, 16 bp, M. musculus
ccagagctcctgagtt

SEQ ID NO: 384951 - DNA, 16 bp, M. musculus
ccagagctctgtctct

SEQ ID NO: 384952 - DNA, 16 bp, M. musculus
ccagagctcttaacca

SEQ ID NO: 384953 - DNA, 16 bp, M. musculus
ccagagctgaccctgt

SEQ ID NO: 384954 - DNA, 16 bp, M. musculus
ccagagctgatcctgt

SEQ ID NO: 384955 - DNA, 16 bp, M. musculus
ccagagctgatgcaga

SEQ ID NO: 384956 - DNA, 16 bp, M. musculus
ccagagctgccaggga

SEQ ID NO: 384957 - DNA, 16 bp, M. musculus
ccagagctggggaggc

SEQ ID NO: 384958 - DNA, 16 bp, M. musculus
ccagagctgggttctc

SEQ ID NO: 384959 - DNA, 16 bp, M. musculus
ccagagcttcatgcat

SEQ ID NO: 384960 - DNA, 16 bp, M. musculus
ccagagcttccaagga

SEQ ID NO: 384961 - DNA, 16 bp, M. musculus
ccagagcttcctggga

SEQ ID NO: 384962 - DNA, 16 bp, M. musculus
ccagaggaactgagtt

SEQ ID NO: 384963 - DNA, 16 bp, M. musculus
ccagaggaaggcatca

SEQ ID NO: 384964 - DNA, 16 bp, M. musculus
ccagaggaccaggaag

SEQ ID NO: 384965 - DNA, 16 bp, M. musculus
ccagaggacccaaatt

SEQ ID NO: 384966 - DNA, 16 bp, M. musculus
ccagaggacccaagtc

SEQ ID NO: 384967 - DNA, 16 bp, M. musculus
ccagaggacccaagtt

SEQ ID NO: 384968 - DNA, 16 bp, M. musculus
ccagaggacccatgtt

SEQ ID NO: 384969 - DNA, 17 bp, M. musculus
ccagaggacctgggttt

SEQ ID NO: 384970 - DNA, 16 bp, M. musculus
ccagaggactctccac

SEQ ID NO: 384971 - DNA, 16 bp, M. musculus
ccagaggactgcctgg

SEQ ID NO: 384972 - DNA, 16 bp, M. musculus
ccagaggactgggatt

SEQ ID NO: 384973 - DNA, 16 bp, M. musculus
ccagaggagaaaagta

SEQ ID NO: 384974 - DNA, 16 bp, M. musculus
ccagaggagagcatca

SEQ ID NO: 384975 - DNA, 16 bp, M. musculus
ccagaggagaggtgtc

SEQ ID NO: 384976 - DNA, 16 bp, M. musculus
ccagaggaggacattg

SEQ ID NO: 384977 - DNA, 16 bp, M. musculus
ccagaggaggcaagct

SEQ ID NO: 384978 - DNA, 16 bp, M. musculus
ccagaggagggaatca

SEQ ID NO: 384979 - DNA, 16 bp, M. musculus
ccagaggagggcatct

SEQ ID NO: 384980 - DNA, 16 bp, M. musculus
ccagaggcaaaggcag

SEQ ID NO: 384981 - DNA, 16 bp, M. musculus
ccagaggcagagccag

SEQ ID NO: 384982 - DNA, 16 bp, M. musculus
ccagaggcaggagctg

SEQ ID NO: 384983 - DNA, 16 bp, M. musculus
ccagaggcagtccttt

SEQ ID NO: 384984 - DNA, 16 bp, M. musculus
ccagaggccaagctga

SEQ ID NO: 384985 - DNA, 16 bp, M. musculus
ccagaggcctgtctcc

SEQ ID NO: 384986 - DNA, 16 bp, M. musculus
ccagaggctgaggcag

SEQ ID NO: 384987 - DNA, 16 bp, M. musculus
ccagaggctgctgctg

SEQ ID NO: 384988 - DNA, 16 bp, M. musculus
ccagaggctggggaga

SEQ ID NO: 384989 - DNA, 16 bp, M. musculus
ccagaggctggggagg

SEQ ID NO: 384990 - DNA, 16 bp, M. musculus
ccagagggagcagagg

SEQ ID NO: 384991 - DNA, 16 bp, M. musculus
ccagagggcccccctg

SEQ ID NO: 384992 - DNA, 16 bp, M. musculus
ccagagggggaaaaaa

SEQ ID NO: 384993 - DNA, 16 bp, M. musculus
ccagagggtcttgtgc

SEQ ID NO: 384994 - DNA, 16 bp, M. musculus
ccagaggtagagacag

SEQ ID NO: 384995 - DNA, 16 bp, M. musculus
ccagaggtcctgagtc

SEQ ID NO: 384996 - DNA, 16 bp, M. musculus
ccagaggtctgagttc

SEQ ID NO: 384997 - DNA, 16 bp, M. musculus
ccagaggtcttgaatt

SEQ ID NO: 384998 - DNA, 16 bp, M. musculus
ccagaggttcttttta

SEQ ID NO: 384999 - DNA, 16 bp, M. musculus
ccagagtgctgggatg

SEQ ID NO: 385000 - DNA, 16 bp, M. musculus
ccagagtgctgggttt

SEQ ID NO: 385001 - DNA, 16 bp, M. musculus
ccagagtggcatgctg

SEQ ID NO: 385002 - DNA, 16 bp, M. musculus
ccagagtggttgtagc

SEQ ID NO: 385003 - DNA, 16 bp, M. musculus
ccagagttaatgacac

SEQ ID NO: 385004 - DNA, 16 bp, M. musculus
ccagagttcctgtgct

SEQ ID NO: 385005 - DNA, 16 bp, M. musculus
ccagagttctcaccag

SEQ ID NO: 385006 - DNA, 16 bp, M. musculus
ccagagttctgggatt

SEQ ID NO: 385007 - DNA, 16 bp, M. musculus
ccagagtttctgagtt

SEQ ID NO: 385008 - DNA, 16 bp, M. musculus
ccagagttttcaccag

SEQ ID NO: 385009 - DNA, 16 bp, M. musculus
ccagataactcaatgg

SEQ ID NO: 385010 - DNA, 16 bp, M. musculus
ccagatacaatgaaac

SEQ ID NO: 385011 - DNA, 16 bp, M. musculus
ccagatacacacacac

SEQ ID NO: 385012 - DNA, 16 bp, M. musculus
ccagatacttcactga

SEQ ID NO: 385013 - DNA, 18 bp, M. musculus
ccagatagcagcaaggag

SEQ ID NO: 385014 - DNA, 16 bp, M. musculus
ccagatataactgtct

SEQ ID NO: 385015 - DNA, 16 bp, M. musculus
ccagatcaccagaaag

SEQ ID NO: 385016 - DNA, 16 bp, M. musculus
ccagatcagcaggcag

SEQ ID NO: 385017 - DNA, 16 bp, M. musculus
ccagatccagggaatc

SEQ ID NO: 385018 - DNA, 16 bp, M. musculus
ccagatccagggcatc

SEQ ID NO: 385019 - DNA, 16 bp, M. musculus
ccagatcccccaaagc

SEQ ID NO: 385020 - DNA, 16 bp, M. musculus
ccagatcccccagaac

SEQ ID NO: 385021 - DNA, 16 bp, M. musculus
ccagatcccctggagc

SEQ ID NO: 385022 - DNA, 16 bp, M. musculus
ccagatcccctgggac

SEQ ID NO: 385023 - DNA, 16 bp, M. musculus
ccagatcctccctacc

SEQ ID NO: 385024 - DNA, 16 bp, M. musculus
ccagatccttctcagc

SEQ ID NO: 385025 - DNA, 16 bp, M. musculus
ccagatctcagctgcc

SEQ ID NO: 385026 - DNA, 16 bp, M. musculus
ccagatctgcctgcct

SEQ ID NO: 385027 - DNA, 16 bp, M. musculus
ccagatctgtgtctct

SEQ ID NO: 385028 - DNA, 16 bp, M. musculus
ccagatgaatctgctg

SEQ ID NO: 385029 - DNA, 16 bp, M. musculus
ccagatgacaaaaggc

SEQ ID NO: 385030 - DNA, 16 bp, M. musculus
ccagatgatgagaggc

SEQ ID NO: 385031 - DNA, 16 bp, M. musculus
ccagatgctgggatta

SEQ ID NO: 385032 - DNA, 16 bp, M. musculus
ccagatggagaaaggc

SEQ ID NO: 385033 - DNA, 16 bp, M. musculus
ccagatggggaaaggc

SEQ ID NO: 385034 - DNA, 16 bp, M. musculus
ccagatggtggtggtg

SEQ ID NO: 385035 - DNA, 16 bp, M. musculus
ccagatgtaaaactct

SEQ ID NO: 385036 - DNA, 16 bp, M. musculus
ccagatgtccttcaac

SEQ ID NO: 385037 - DNA, 16 bp, M. musculus
ccagatgtctcacaac

SEQ ID NO: 385038 - DNA, 16 bp, M. musculus
ccagatgtctctggct

SEQ ID NO: 385039 - DNA, 16 bp, M. musculus
ccagattcctccctcc

SEQ ID NO: 385040 - DNA, 16 bp, M. musculus
ccagattctctccctc

SEQ ID NO: 385041 - DNA, 16 bp, M. musculus
ccagattggctttgaa

SEQ ID NO: 385042 - DNA, 16 bp, M. musculus
ccagatttctgaggaa

SEQ ID NO: 385043 - DNA, 16 bp, M. musculus
ccagcaaacacatggt

SEQ ID NO: 385044 - DNA, 16 bp, M. musculus
ccagcaaacaccaggg

SEQ ID NO: 385045 - DNA, 16 bp, M. musculus
ccagcaaatacagaag

SEQ ID NO: 385046 - DNA, 16 bp, M. musculus
ccagcaacatttgttg

SEQ ID NO: 385047 - DNA, 16 bp, M. musculus
ccagcaaccacaatgg

SEQ ID NO: 385048 - DNA, 16 bp, M. musculus
ccagcaaccacagagt

SEQ ID NO: 385049 - DNA, 16 bp, M. musculus
ccagcaaccacagccg

SEQ ID NO: 385050 - DNA, 16 bp, M. musculus
ccagcaaccacagcct

SEQ ID NO: 385051 - DNA, 16 bp, M. musculus
ccagcaaccacatgga

SEQ ID NO: 385052 - DNA, 16 bp, M. musculus
ccagcaaccacatggc

SEQ ID NO: 385053 - DNA, 26 bp, M. musculus
ccagcaaccacatggtggctcacaat

SEQ ID NO: 385054 - DNA, 26 bp, M. musculus
ccagcaaccacatggtggctcataac

SEQ ID NO: 385055 - DNA, 16 bp, M. musculus
ccagcaactacatggt

SEQ ID NO: 385056 - DNA, 16 bp, M. musculus
ccagcaactctctgcc

SEQ ID NO: 385057 - DNA, 16 bp, M. musculus
ccagcaactgatggga

SEQ ID NO: 385058 - DNA, 16 bp, M. musculus
ccagcaactggagcag

SEQ ID NO: 385059 - DNA, 16 bp, M. musculus
ccagcaagacagctca

SEQ ID NO: 385060 - DNA, 16 bp, M. musculus
ccagcaagaggagagc

SEQ ID NO: 385061 - DNA, 16 bp, M. musculus
ccagcaagatggttca

SEQ ID NO: 385062 - DNA, 16 bp, M. musculus
ccagcaagcagcaccc

SEQ ID NO: 385063 - DNA, 16 bp, M. musculus
ccagcaagcagcagaa

SEQ ID NO: 385064 - DNA, 16 bp, M. musculus
ccagcaagcccagcag

SEQ ID NO: 385065 - DNA, 16 bp, M. musculus
ccagcaagccccagca

SEQ ID NO: 385066 - DNA, 16 bp, M. musculus
ccagcaagctcccagg

SEQ ID NO: 385067 - DNA, 16 bp, M. musculus
ccagcaaggacactga

SEQ ID NO: 385068 - DNA, 16 bp, M. musculus
ccagcaaggccacact

SEQ ID NO: 385069 - DNA, 16 bp, M. musculus
ccagcaaggccaccag

SEQ ID NO: 385070 - DNA, 16 bp, M. musculus
ccagcaaggccacgcc

SEQ ID NO: 385071 - DNA, 16 bp, M. musculus
ccagcaaggggcagag

SEQ ID NO: 385072 - DNA, 16 bp, M. musculus
ccagcaagtgcttgct

SEQ ID NO: 385073 - DNA, 16 bp, M. musculus
ccagcaataccactct

SEQ ID NO: 385074 - DNA, 16 bp, M. musculus
ccagcaatacctgtcc

SEQ ID NO: 385075 - DNA, 16 bp, M. musculus
ccagcaatcaaaagcc

SEQ ID NO: 385076 - DNA, 16 bp, M. musculus
ccagcaatccagcaat

SEQ ID NO: 385077 - DNA, 16 bp, M. musculus
ccagcaatgaactcac

SEQ ID NO: 385078 - DNA, 16 bp, M. musculus
ccagcaatggagaagt

SEQ ID NO: 385079 - DNA, 16 bp, M. musculus
ccagcaattgggaggt

SEQ ID NO: 385080 - DNA, 16 bp, M. musculus
ccagcacacacatcag

SEQ ID NO: 385081 - DNA, 16 bp, M. musculus
ccagcacacacatgca

SEQ ID NO: 385082 - DNA, 16 bp, M. musculus
ccagcacacctgaaaa

SEQ ID NO: 385083 - DNA, 16 bp, M. musculus
ccagcacagacacaag

SEQ ID NO: 385084 - DNA, 16 bp, M. musculus
ccagcacagccaggac

SEQ ID NO: 385085 - DNA, 16 bp, M. musculus
ccagcacaggaggcag

SEQ ID NO: 385086 - DNA, 16 bp, M. musculus
ccagcacatacacaca

SEQ ID NO: 385087 - DNA, 16 bp, M. musculus
ccagcaccacataaaa

SEQ ID NO: 385088 - DNA, 16 bp, M. musculus
ccagcaccagcagcag

SEQ ID NO: 385089 - DNA, 16 bp, M. musculus
ccagcaccatcaacac

SEQ ID NO: 385090 - DNA, 16 bp, M. musculus
ccagcaccatgtctgg

SEQ ID NO: 385091 - DNA, 16 bp, M. musculus
ccagcaccatgtctgt

SEQ ID NO: 385092 - DNA, 16 bp, M. musculus
ccagcacccaagaggc

SEQ ID NO: 385093 - DNA, 16 bp, M. musculus
ccagcacccacaacag

SEQ ID NO: 385094 - DNA, 16 bp, M. musculus
ccagcacccacatcac

SEQ ID NO: 385095 - DNA, 16 bp, M. musculus
ccagcacccacattga

SEQ ID NO: 385096 - DNA, 16 bp, M. musculus
ccagcacccagatggt

SEQ ID NO: 385097 - DNA, 16 bp, M. musculus
ccagcacccaggaggt

SEQ ID NO: 385098 - DNA, 16 bp, M. musculus
ccagcacccatatcag

SEQ ID NO: 385099 - DNA, 16 bp, M. musculus
ccagcacccatatggc

SEQ ID NO: 385100 - DNA, 16 bp, M. musculus
ccagcacccatgacag

SEQ ID NO: 385101 - DNA, 16 bp, M. musculus
ccagcacccatgtaaa

SEQ ID NO: 385102 - DNA, 16 bp, M. musculus
ccagcaccctcagcac

SEQ ID NO: 385103 - DNA, 16 bp, M. musculus
ccagcaccggggttcc

SEQ ID NO: 385104 - DNA, 16 bp, M. musculus
ccagcacctaggaggt

SEQ ID NO: 385105 - DNA, 16 bp, M. musculus
ccagcacctatgtaaa

SEQ ID NO: 385106 - DNA, 16 bp, M. musculus
ccagcacctgctgtca

SEQ ID NO: 385107 - DNA, 23 bp, M. musculus
ccagcacctgggaggcagaggca

SEQ ID NO: 385108 - DNA, 16 bp, M. musculus
ccagcacgtgggaggt

SEQ ID NO: 385109 - DNA, 16 bp, M. musculus
ccagcactaaggaagc

SEQ ID NO: 385110 - DNA, 16 bp, M. musculus
ccagcactagggaggt

SEQ ID NO: 385111 - DNA, 16 bp, M. musculus
ccagcactatgtctgc

SEQ ID NO: 385112 - DNA, 16 bp, M. musculus
ccagcactcaagaggc

SEQ ID NO: 385113 - DNA, 16 bp, M. musculus
ccagcactcacatggt

SEQ ID NO: 385114 - DNA, 16 bp, M. musculus
ccagcactcaggaaat

SEQ ID NO: 385115 - DNA, 16 bp, M. musculus
ccagcactcaggacag

SEQ ID NO: 385116 - DNA, 16 bp, M. musculus
ccagcactcaggagga

SEQ ID NO: 385117 - DNA, 16 bp, M. musculus
ccagcactcaggtgac

SEQ ID NO: 385118 - DNA, 16 bp, M. musculus
ccagcactcatgtcag

SEQ ID NO: 385119 - DNA, 16 bp, M. musculus
ccagcactccaaaggc

SEQ ID NO: 385120 - DNA, 16 bp, M. musculus
ccagcactcccacatc

SEQ ID NO: 385121 - DNA, 16 bp, M. musculus
ccagcactctggaggc

SEQ ID NO: 385122 - DNA, 16 bp, M. musculus
ccagcactgcacaaac

SEQ ID NO: 385123 - DNA, 16 bp, M. musculus
ccagcactgcagaggc

SEQ ID NO: 385124 - DNA, 16 bp, M. musculus
ccagcactgcataaaa

SEQ ID NO: 385125 - DNA, 16 bp, M. musculus
ccagcactggggagca

SEQ ID NO: 385126 - DNA, 16 bp, M. musculus
ccagcactgggggtgg

SEQ ID NO: 385127 - DNA, 16 bp, M. musculus
ccagcactgtgaaagc

SEQ ID NO: 385128 - DNA, 16 bp, M. musculus
ccagcacttgggagat

SEQ ID NO: 385129 - DNA, 16 bp, M. musculus
ccagcacttgggagga

SEQ ID NO: 385130 - DNA, 16 bp, M. musculus
ccagcacttgggagtt

SEQ ID NO: 385131 - DNA, 16 bp, M. musculus
ccagcactttgaaggc

SEQ ID NO: 385132 - DNA, 16 bp, M. musculus
ccagcagaaagaatga

SEQ ID NO: 385133 - DNA, 16 bp, M. musculus
ccagcagaaggtgtgg

SEQ ID NO: 385134 - DNA, 16 bp, M. musculus
ccagcagagacagcca

SEQ ID NO: 385135 - DNA, 16 bp, M. musculus
ccagcagaggaggcag

SEQ ID NO: 385136 - DNA, 16 bp, M. musculus
ccagcagaggcagagg

SEQ ID NO: 385137 - DNA, 16 bp, M. musculus
ccagcagaggcaggag

SEQ ID NO: 385138 - DNA, 16 bp, M. musculus
ccagcagaggcagtgg

SEQ ID NO: 385139 - DNA, 16 bp, M. musculus
ccagcagagggcagca

SEQ ID NO: 385140 - DNA, 16 bp, M. musculus
ccagcagagggcagta

SEQ ID NO: 385141 - DNA, 16 bp, M. musculus
ccagcagagggcagtg

SEQ ID NO: 385142 - DNA, 16 bp, M. musculus
ccagcagatggcagca

SEQ ID NO: 385143 - DNA, 16 bp, M. musculus
ccagcagcacctggaa

SEQ ID NO: 385144 - DNA, 16 bp, M. musculus
ccagcagcagcaacaa

SEQ ID NO: 385145 - DNA, 17 bp, M. musculus
ccagcagcagcagcaac

SEQ ID NO: 385146 - DNA, 17 bp, M. musculus
ccagcagcagcagcagg

SEQ ID NO: 385147 - DNA, 17 bp, M. musculus
ccagcagcagcagcagt

SEQ ID NO: 385148 - DNA, 16 bp, M. musculus
ccagcagcagccagca

SEQ ID NO: 385149 - DNA, 16 bp, M. musculus
ccagcagccagcagcc

SEQ ID NO: 385150 - DNA, 16 bp, M. musculus
ccagcagcccagcagc

SEQ ID NO: 385151 - DNA, 16 bp, M. musculus
ccagcagcctcttctt

SEQ ID NO: 385152 - DNA, 16 bp, M. musculus
ccagcagctgacagaa

SEQ ID NO: 385153 - DNA, 16 bp, M. musculus
ccagcagctgatagaa

SEQ ID NO: 385154 - DNA, 16 bp, M. musculus
ccagcagctgatggaa

SEQ ID NO: 385155 - DNA, 16 bp, M. musculus
ccagcagctggctgag

SEQ ID NO: 385156 - DNA, 16 bp, M. musculus
ccagcagcttcaagtg

SEQ ID NO: 385157 - DNA, 16 bp, M. musculus
ccagcagcttctgcag

SEQ ID NO: 385158 - DNA, 16 bp, M. musculus
ccagcaggaagacagt

SEQ ID NO: 385159 - DNA, 16 bp, M. musculus
ccagcaggatccaggg

SEQ ID NO: 385160 - DNA, 16 bp, M. musculus
ccagcagggccacacc

SEQ ID NO: 385161 - DNA, 16 bp, M. musculus
ccagcagggccagctc

SEQ ID NO: 385162 - DNA, 16 bp, M. musculus
ccagcagggggcgctg

SEQ ID NO: 385163 - DNA, 16 bp, M. musculus
ccagcaggtggcagta

SEQ ID NO: 385164 - DNA, 16 bp, M. musculus
ccagcaggtgttcctg

SEQ ID NO: 385165 - DNA, 16 bp, M. musculus
ccagcagtcaggagga

SEQ ID NO: 385166 - DNA, 16 bp, M. musculus
ccagcagtcgggaggc

SEQ ID NO: 385167 - DNA, 16 bp, M. musculus
ccagcagtctggagct

SEQ ID NO: 385168 - DNA, 16 bp, M. musculus
ccagcagtctggaggc

SEQ ID NO: 385169 - DNA, 16 bp, M. musculus
ccagcagtgcccaaga

SEQ ID NO: 385170 - DNA, 16 bp, M. musculus
ccagcagtggatggag

SEQ ID NO: 385171 - DNA, 16 bp, M. musculus
ccagcagtggggaggc

SEQ ID NO: 385172 - DNA, 16 bp, M. musculus
ccagcagtgggtgtgg

SEQ ID NO: 385173 - DNA, 16 bp, M. musculus
ccagcagttcccagca

SEQ ID NO: 385174 - DNA, 16 bp, M. musculus
ccagcagttcctgctg

SEQ ID NO: 385175 - DNA, 16 bp, M. musculus
ccagcagttctcagcc

SEQ ID NO: 385176 - DNA, 16 bp, M. musculus
ccagcataagaacata

SEQ ID NO: 385177 - DNA, 16 bp, M. musculus
ccagcatcaacatggt

SEQ ID NO: 385178 - DNA, 16 bp, M. musculus
ccagcatcaatgggag

SEQ ID NO: 385179 - DNA, 16 bp, M. musculus
ccagcatcactgaggc

SEQ ID NO: 385180 - DNA, 16 bp, M. musculus
ccagcatcagcaaagc

SEQ ID NO: 385181 - DNA, 16 bp, M. musculus
ccagcatcatgtctgc

SEQ ID NO: 385182 - DNA, 16 bp, M. musculus
ccagcatcattgagat

SEQ ID NO: 385183 - DNA, 16 bp, M. musculus
ccagcatccacatggt

SEQ ID NO: 385184 - DNA, 16 bp, M. musculus
ccagcatccacctggt

SEQ ID NO: 385185 - DNA, 16 bp, M. musculus
ccagcatcccccagca

SEQ ID NO: 385186 - DNA, 16 bp, M. musculus
ccagcatcctcttctg

SEQ ID NO: 385187 - DNA, 16 bp, M. musculus
ccagcatctcctgtca

SEQ ID NO: 385188 - DNA, 16 bp, M. musculus
ccagcatctgcctctg

SEQ ID NO: 385189 - DNA, 16 bp, M. musculus
ccagcatctgctgcca

SEQ ID NO: 385190 - DNA, 16 bp, M. musculus
ccagcatctgggaggc

SEQ ID NO: 385191 - DNA, 16 bp, M. musculus
ccagcatgctggggtc

SEQ ID NO: 385192 - DNA, 16 bp, M. musculus
ccagcatggatgggga

SEQ ID NO: 385193 - DNA, 16 bp, M. musculus
ccagcatggcattgct

SEQ ID NO: 385194 - DNA, 16 bp, M. musculus
ccagcatggtggtgca

SEQ ID NO: 385195 - DNA, 16 bp, M. musculus
ccagcatgtggttgct

SEQ ID NO: 385196 - DNA, 16 bp, M. musculus
ccagcattaaaaaaaa

SEQ ID NO: 385197 - DNA, 16 bp, M. musculus
ccagcattcaagagac

SEQ ID NO: 385198 - DNA, 16 bp, M. musculus
ccagcattcatctctc

SEQ ID NO: 385199 - DNA, 16 bp, M. musculus
ccagcattccagaggc

SEQ ID NO: 385200 - DNA, 16 bp, M. musculus
ccagcattccaggaag

SEQ ID NO: 385201 - DNA, 16 bp, M. musculus
ccagcatttgggagtc

SEQ ID NO: 385202 - DNA, 16 bp, M. musculus
ccagccaaactctcaa

SEQ ID NO: 385203 - DNA, 16 bp, M. musculus
ccagccaaagagaaag

SEQ ID NO: 385204 - DNA, 16 bp, M. musculus
ccagccaaccagccaa

SEQ ID NO: 385205 - DNA, 16 bp, M. musculus
ccagccaaggctacta

SEQ ID NO: 385206 - DNA, 16 bp, M. musculus
ccagccaatcaggagc

SEQ ID NO: 385207 - DNA, 16 bp, M. musculus
ccagccaatctagcca

SEQ ID NO: 385208 - DNA, 16 bp, M. musculus
ccagccacagccacag

SEQ ID NO: 385209 - DNA, 16 bp, M. musculus
ccagccacatggcaga

SEQ ID NO: 385210 - DNA, 16 bp, M. musculus
ccagccagaatgccag

SEQ ID NO: 385211 - DNA, 16 bp, M. musculus
ccagccagagacacct

SEQ ID NO: 385212 - DNA, 16 bp, M. musculus
ccagccagagacagct

SEQ ID NO: 385213 - DNA, 16 bp, M. musculus
ccagccagagcagcca

SEQ ID NO: 385214 - DNA, 16 bp, M. musculus
ccagccagagctacag

SEQ ID NO: 385215 - DNA, 16 bp, M. musculus
ccagccagaggaagga

SEQ ID NO: 385216 - DNA, 16 bp, M. musculus
ccagccagagttcagg

SEQ ID NO: 385217 - DNA, 16 bp, M. musculus
ccagccagagttcctg

SEQ ID NO: 385218 - DNA, 16 bp, M. musculus
ccagccagccagccag

SEQ ID NO: 385219 - DNA, 16 bp, M. musculus
ccagccagccagccca

SEQ ID NO: 385220 - DNA, 16 bp, M. musculus
ccagccagcccagcca

SEQ ID NO: 385221 - DNA, 16 bp, M. musculus
ccagccagcccagcct

SEQ ID NO: 385222 - DNA, 16 bp, M. musculus
ccagccagcctggcca

SEQ ID NO: 385223 - DNA, 16 bp, M. musculus
ccagccagcctggcct

SEQ ID NO: 385224 - DNA, 16 bp, M. musculus
ccagccagctagccag

SEQ ID NO: 385225 - DNA, 16 bp, M. musculus
ccagccagcttagcct

SEQ ID NO: 385226 - DNA, 16 bp, M. musculus
ccagccagggctacac

SEQ ID NO: 385227 - DNA, 16 bp, M. musculus
ccagccagggctccat

SEQ ID NO: 385228 - DNA, 17 bp, M. musculus
ccagccaggtctacaca

SEQ ID NO: 385229 - DNA, 16 bp, M. musculus
ccagccagtacagaca

SEQ ID NO: 385230 - DNA, 16 bp, M. musculus
ccagccagtacaggag

SEQ ID NO: 385231 - DNA, 16 bp, M. musculus
ccagccagtcagccag

SEQ ID NO: 385232 - DNA, 16 bp, M. musculus
ccagccagtcagtcag

SEQ ID NO: 385233 - DNA, 16 bp, M. musculus
ccagccataccctgta

SEQ ID NO: 385234 - DNA, 16 bp, M. musculus
ccagccatgccctttg

SEQ ID NO: 385235 - DNA, 16 bp, M. musculus
ccagccattttggtta

SEQ ID NO: 385236 - DNA, 16 bp, M. musculus
ccagcccaagctacta

SEQ ID NO: 385237 - DNA, 16 bp, M. musculus
ccagcccacaggatgg

SEQ ID NO: 385238 - DNA, 16 bp, M. musculus
ccagcccactgtggac

SEQ ID NO: 385239 - DNA, 16 bp, M. musculus
ccagcccactgtgggc

SEQ ID NO: 385240 - DNA, 16 bp, M. musculus
ccagcccagaagaaag

SEQ ID NO: 385241 - DNA, 16 bp, M. musculus
ccagcccagagatgat

SEQ ID NO: 385242 - DNA, 16 bp, M. musculus
ccagcccagcccagct

SEQ ID NO: 385243 - DNA, 16 bp, M. musculus
ccagcccagggatgcc

SEQ ID NO: 385244 - DNA, 16 bp, M. musculus
ccagcccaggtcctct

SEQ ID NO: 385245 - DNA, 16 bp, M. musculus
ccagccccaatgaaat

SEQ ID NO: 385246 - DNA, 16 bp, M. musculus
ccagccccagaaagca

SEQ ID NO: 385247 - DNA, 16 bp, M. musculus
ccagccccagcaagca

SEQ ID NO: 385248 - DNA, 16 bp, M. musculus
ccagccccagcccctg

SEQ ID NO: 385249 - DNA, 16 bp, M. musculus
ccagccccagccctat

SEQ ID NO: 385250 - DNA, 16 bp, M. musculus
ccagccccagggcatc

SEQ ID NO: 385251 - DNA, 16 bp, M. musculus
ccagcccccctttcag

SEQ ID NO: 385252 - DNA, 16 bp, M. musculus
ccagcccctcactggg

SEQ ID NO: 385253 - DNA, 16 bp, M. musculus
ccagcccctcttctct

SEQ ID NO: 385254 - DNA, 16 bp, M. musculus
ccagcccctgtatgct

SEQ ID NO: 385255 - DNA, 16 bp, M. musculus
ccagccctaagtcatc

SEQ ID NO: 385256 - DNA, 16 bp, M. musculus
ccagccctacagaaga

SEQ ID NO: 385257 - DNA, 16 bp, M. musculus
ccagccctataaagga

SEQ ID NO: 385258 - DNA, 16 bp, M. musculus
ccagccctccagaggc

SEQ ID NO: 385259 - DNA, 16 bp, M. musculus
ccagccctctttttac

SEQ ID NO: 385260 - DNA, 16 bp, M. musculus
ccagccctgagccctg

SEQ ID NO: 385261 - DNA, 16 bp, M. musculus
ccagccctgcaaagga

SEQ ID NO: 385262 - DNA, 16 bp, M. musculus
ccagccctggagaggc

SEQ ID NO: 385263 - DNA, 16 bp, M. musculus
ccagccctggcattcc

SEQ ID NO: 385264 - DNA, 16 bp, M. musculus
ccagccctgggatggc

SEQ ID NO: 385265 - DNA, 16 bp, M. musculus
ccagccctggggaggc

SEQ ID NO: 385266 - DNA, 16 bp, M. musculus
ccagccctggggaggt

SEQ ID NO: 385267 - DNA, 16 bp, M. musculus
ccagcccttgggaggt

SEQ ID NO: 385268 - DNA, 16 bp, M. musculus
ccagcctagaatacat

SEQ ID NO: 385269 - DNA, 16 bp, M. musculus
ccagcctagcctacat

SEQ ID NO: 385270 - DNA, 16 bp, M. musculus
ccagcctaggctacag

SEQ ID NO: 385271 - DNA, 16 bp, M. musculus
ccagcctaggctacat

SEQ ID NO: 385272 - DNA, 16 bp, M. musculus
ccagcctaggggatgg

SEQ ID NO: 385273 - DNA, 16 bp, M. musculus
ccagcctcagcctccc

SEQ ID NO: 385274 - DNA, 16 bp, M. musculus
ccagcctcagccttct

SEQ ID NO: 385275 - DNA, 16 bp, M. musculus
ccagcctcaggtacct

SEQ ID NO: 385276 - DNA, 16 bp, M. musculus
ccagcctcagtgagag

SEQ ID NO: 385277 - DNA, 16 bp, M. musculus
ccagcctcagtttccc

SEQ ID NO: 385278 - DNA, 16 bp, M. musculus
ccagcctccagcctcc

SEQ ID NO: 385279 - DNA, 16 bp, M. musculus
ccagcctccagcctct

SEQ ID NO: 385280 - DNA, 16 bp, M. musculus
ccagcctccatcactg

SEQ ID NO: 385281 - DNA, 16 bp, M. musculus
ccagcctcctccctca

SEQ ID NO: 385282 - DNA, 16 bp, M. musculus
ccagcctctacctcct

SEQ ID NO: 385283 - DNA, 16 bp, M. musculus
ccagcctctgagactt

SEQ ID NO: 385284 - DNA, 16 bp, M. musculus
ccagcctctgcctccc

SEQ ID NO: 385285 - DNA, 16 bp, M. musculus
ccagcctctgcctctg

SEQ ID NO: 385286 - DNA, 16 bp, M. musculus
ccagcctctgccttct

SEQ ID NO: 385287 - DNA, 16 bp, M. musculus
ccagcctctggctcct

SEQ ID NO: 385288 - DNA, 16 bp, M. musculus
ccagcctctgtgggca

SEQ ID NO: 385289 - DNA, 16 bp, M. musculus
ccagcctcttctggct

SEQ ID NO: 385290 - DNA, 16 bp, M. musculus
ccagcctgagctacac

SEQ ID NO: 385291 - DNA, 16 bp, M. musculus
ccagcctgagctgcag

SEQ ID NO: 385292 - DNA, 16 bp, M. musculus
ccagcctgccagcctg

SEQ ID NO: 385293 - DNA, 16 bp, M. musculus
ccagcctgcctccatc

SEQ ID NO: 385294 - DNA, 16 bp, M. musculus
ccagcctgcctgcctg

SEQ ID NO: 385295 - DNA, 16 bp, M. musculus
ccagcctgctttctct

SEQ ID NO: 385296 - DNA, 16 bp, M. musculus
ccagcctggactgcag

SEQ ID NO: 385297 - DNA, 16 bp, M. musculus
ccagcctggagtacat

SEQ ID NO: 385298 - DNA, 16 bp, M. musculus
ccagcctggcagcctg

SEQ ID NO: 385299 - DNA, 16 bp, M. musculus
ccagcctggcctcaga

SEQ ID NO: 385300 - DNA, 16 bp, M. musculus
ccagcctgggacaaag

SEQ ID NO: 385301 - DNA, 16 bp, M. musculus
ccagcctgggcaacag

SEQ ID NO: 385302 - DNA, 16 bp, M. musculus
ccagcctgggctacag

SEQ ID NO: 385303 - DNA, 16 bp, M. musculus
ccagcctgggctacca

SEQ ID NO: 385304 - DNA, 16 bp, M. musculus
ccagcctgggctctat

SEQ ID NO: 385305 - DNA, 16 bp, M. musculus
ccagcctgggctctgt

SEQ ID NO: 385306 - DNA, 16 bp, M. musculus
ccagcctgggctgcct

SEQ ID NO: 385307 - DNA, 16 bp, M. musculus
ccagcctggggtacat

SEQ ID NO: 385308 - DNA, 16 bp, M. musculus
ccagcctgggtgacat

SEQ ID NO: 385309 - DNA, 16 bp, M. musculus
ccagcctgggttacag

SEQ ID NO: 385310 - DNA, 16 bp, M. musculus
ccagcctggtcacaga

SEQ ID NO: 385311 - DNA, 16 bp, M. musculus
ccagcctggtccagga

SEQ ID NO: 385312 - DNA, 16 bp, M. musculus
ccagcctggtcctcag

SEQ ID NO: 385313 - DNA, 17 bp, M. musculus
ccagcctggtctactga

SEQ ID NO: 385314 - DNA, 16 bp, M. musculus
ccagcctggtctagag

SEQ ID NO: 385315 - DNA, 16 bp, M. musculus
ccagcctggtctcaaa

SEQ ID NO: 385316 - DNA, 16 bp, M. musculus
ccagcctggtctgcat

SEQ ID NO: 385317 - DNA, 16 bp, M. musculus
ccagcctggtctgtat

SEQ ID NO: 385318 - DNA, 16 bp, M. musculus
ccagcctggtgagttc

SEQ ID NO: 385319 - DNA, 16 bp, M. musculus
ccagcctggtgtgcag

SEQ ID NO: 385320 - DNA, 16 bp, M. musculus
ccagcctgtctacata

SEQ ID NO: 385321 - DNA, 16 bp, M. musculus
ccagcctgtgtgtgct

SEQ ID NO: 385322 - DNA, 16 bp, M. musculus
ccagcctgttctcatc

SEQ ID NO: 385323 - DNA, 16 bp, M. musculus
ccagccttaggccatg

SEQ ID NO: 385324 - DNA, 16 bp, M. musculus
ccagccttcatcttca

SEQ ID NO: 385325 - DNA, 16 bp, M. musculus
ccagcctttcactctg

SEQ ID NO: 385326 - DNA, 16 bp, M. musculus
ccagcctttgcctccc

SEQ ID NO: 385327 - DNA, 16 bp, M. musculus
ccagcgtgggatgctg

SEQ ID NO: 385328 - DNA, 16 bp, M. musculus
ccagcgttcaggaggc

SEQ ID NO: 385329 - DNA, 16 bp, M. musculus
ccagcgttgtctcact

SEQ ID NO: 385330 - DNA, 16 bp, M. musculus
ccagctaaccaacatc

SEQ ID NO: 385331 - DNA, 16 bp, M. musculus
ccagctaaccagaacc

SEQ ID NO: 385332 - DNA, 16 bp, M. musculus
ccagctacaaaagttt

SEQ ID NO: 385333 - DNA, 16 bp, M. musculus
ccagctacttcactga

SEQ ID NO: 385334 - DNA, 16 bp, M. musculus
ccagctactttgctaa

SEQ ID NO: 385335 - DNA, 16 bp, M. musculus
ccagctcaacttctct

SEQ ID NO: 385336 - DNA, 16 bp, M. musculus
ccagctcacctgcacc

SEQ ID NO: 385337 - DNA, 16 bp, M. musculus
ccagctcagctcagct

SEQ ID NO: 385338 - DNA, 16 bp, M. musculus
ccagctcagggggagg

SEQ ID NO: 385339 - DNA, 16 bp, M. musculus
ccagctccagctgtcc

SEQ ID NO: 385340 - DNA, 16 bp, M. musculus
ccagctccaggaacag

SEQ ID NO: 385341 - DNA, 16 bp, M. musculus
ccagctccagggagat

SEQ ID NO: 385342 - DNA, 16 bp, M. musculus
ccagctccagggtatc

SEQ ID NO: 385343 - DNA, 16 bp, M. musculus
ccagctccccagccct

SEQ ID NO: 385344 - DNA, 16 bp, M. musculus
ccagctccccagcctc

SEQ ID NO: 385345 - DNA, 16 bp, M. musculus
ccagctccccagctcc

SEQ ID NO: 385346 - DNA, 16 bp, M. musculus
ccagctcctcagcccc

SEQ ID NO: 385347 - DNA, 16 bp, M. musculus
ccagctcctccattgg

SEQ ID NO: 385348 - DNA, 16 bp, M. musculus
ccagctcctcccagat

SEQ ID NO: 385349 - DNA, 16 bp, M. musculus
ccagctcctccctggg

SEQ ID NO: 385350 - DNA, 16 bp, M. musculus
ccagctcctcctttgg

SEQ ID NO: 385351 - DNA, 16 bp, M. musculus
ccagctcctcctttgt

SEQ ID NO: 385352 - DNA, 16 bp, M. musculus
ccagctcctgtgacca

SEQ ID NO: 385353 - DNA, 16 bp, M. musculus
ccagctctccagccca

SEQ ID NO: 385354 - DNA, 16 bp, M. musculus
ccagctctccagcccc

SEQ ID NO: 385355 - DNA, 16 bp, M. musculus
ccagctctccagctct

SEQ ID NO: 385356 - DNA, 16 bp, M. musculus
ccagctctcccaagtg

SEQ ID NO: 385357 - DNA, 16 bp, M. musculus
ccagctctcccaccac

SEQ ID NO: 385358 - DNA, 16 bp, M. musculus
ccagctctctcctcag

SEQ ID NO: 385359 - DNA, 16 bp, M. musculus
ccagctctctcctgag

SEQ ID NO: 385360 - DNA, 16 bp, M. musculus
ccagctctctggaggc

SEQ ID NO: 385361 - DNA, 16 bp, M. musculus
ccagctctgccttctg

SEQ ID NO: 385362 - DNA, 16 bp, M. musculus
ccagctctgctctgct

SEQ ID NO: 385363 - DNA, 16 bp, M. musculus
ccagctctgctgcctg

SEQ ID NO: 385364 - DNA, 16 bp, M. musculus
ccagctctggggaagc

SEQ ID NO: 385365 - DNA, 16 bp, M. musculus
ccagctctggtacttt

SEQ ID NO: 385366 - DNA, 16 bp, M. musculus
ccagctcttccacaag

SEQ ID NO: 385367 - DNA, 16 bp, M. musculus
ccagctcttgggaagc

SEQ ID NO: 385368 - DNA, 16 bp, M. musculus
ccagctgaaaggcatt

SEQ ID NO: 385369 - DNA, 16 bp, M. musculus
ccagctgaaccagcac

SEQ ID NO: 385370 - DNA, 16 bp, M. musculus
ccagctgcagcacgag

SEQ ID NO: 385371 - DNA, 16 bp, M. musculus
ccagctgcagctgctg

SEQ ID NO: 385372 - DNA, 16 bp, M. musculus
ccagctgcagcttccc

SEQ ID NO: 385373 - DNA, 16 bp, M. musculus
ccagctgcaggtgatg

SEQ ID NO: 385374 - DNA, 16 bp, M. musculus
ccagctgccatgcctg

SEQ ID NO: 385375 - DNA, 16 bp, M. musculus
ccagctgcctctggct

SEQ ID NO: 385376 - DNA, 16 bp, M. musculus
ccagctgctctgccac

SEQ ID NO: 385377 - DNA, 16 bp, M. musculus
ccagctgctgcaggcc

SEQ ID NO: 385378 - DNA, 16 bp, M. musculus
ccagctgctgctgctg

SEQ ID NO: 385379 - DNA, 16 bp, M. musculus
ccagctgctgtggaca

SEQ ID NO: 385380 - DNA, 17 bp, M. musculus
ccagctgcttcaggatg

SEQ ID NO: 385381 - DNA, 16 bp, M. musculus
ccagctgcttctgcct

SEQ ID NO: 385382 - DNA, 16 bp, M. musculus
ccagctgcttctgtcc

SEQ ID NO: 385383 - DNA, 16 bp, M. musculus
ccagctggaatgcaga

SEQ ID NO: 385384 - DNA, 16 bp, M. musculus
ccagctggagctctct

SEQ ID NO: 385385 - DNA, 16 bp, M. musculus
ccagctgggcatggtg

SEQ ID NO: 385386 - DNA, 16 bp, M. musculus
ccagctggggaggcgg

SEQ ID NO: 385387 - DNA, 16 bp, M. musculus
ccagctggtcaggagt

SEQ ID NO: 385388 - DNA, 16 bp, M. musculus
ccagctggtggcactg

SEQ ID NO: 385389 - DNA, 16 bp, M. musculus
ccagctggtggtgctg

SEQ ID NO: 385390 - DNA, 16 bp, M. musculus
ccagctggttttcagt

SEQ ID NO: 385391 - DNA, 16 bp, M. musculus
ccagctgtgaaccctg

SEQ ID NO: 385392 - DNA, 16 bp, M. musculus
ccagctgtgagacttg

SEQ ID NO: 385393 - DNA, 16 bp, M. musculus
ccagctgtgaggcatt

SEQ ID NO: 385394 - DNA, 16 bp, M. musculus
ccagctgtggagcatt

SEQ ID NO: 385395 - DNA, 16 bp, M. musculus
ccagctgtggttgctg

SEQ ID NO: 385396 - DNA, 16 bp, M. musculus
ccagctgtttctggga

SEQ ID NO: 385397 - DNA, 16 bp, M. musculus
ccagcttagccagagc

SEQ ID NO: 385398 - DNA, 16 bp, M. musculus
ccagcttcagaggatc

SEQ ID NO: 385399 - DNA, 16 bp, M. musculus
ccagcttcctggtcct

SEQ ID NO: 385400 - DNA, 16 bp, M. musculus
ccagcttctgcctcct

SEQ ID NO: 385401 - DNA, 16 bp, M. musculus
ccagcttctggctgct

SEQ ID NO: 385402 - DNA, 16 bp, M. musculus
ccagcttgactcccaa

SEQ ID NO: 385403 - DNA, 16 bp, M. musculus
ccagcttggactacag

SEQ ID NO: 385404 - DNA, 16 bp, M. musculus
ccagcttggtctacac

SEQ ID NO: 385405 - DNA, 16 bp, M. musculus
ccagcttgtgtccagt

SEQ ID NO: 385406 - DNA, 16 bp, M. musculus
ccagctttatgtgggt

SEQ ID NO: 385407 - DNA, 16 bp, M. musculus
ccagctttctgttctc

SEQ ID NO: 385408 - DNA, 16 bp, M. musculus
ccagctttgtctacaa

SEQ ID NO: 385409 - DNA, 16 bp, M. musculus
ccagcttttgatgttg

SEQ ID NO: 385410 - DNA, 16 bp, M. musculus
ccagcttttgtgagct

SEQ ID NO: 385411 - DNA, 16 bp, M. musculus
ccaggaaaaccaggac

SEQ ID NO: 385412 - DNA, 16 bp, M. musculus
ccaggaaaatggccag

SEQ ID NO: 385413 - DNA, 16 bp, M. musculus
ccaggaaacttctaca

SEQ ID NO: 385414 - DNA, 16 bp, M. musculus
ccaggaaagagaaagg

SEQ ID NO: 385415 - DNA, 16 bp, M. musculus
ccaggaaagccaggaa

SEQ ID NO: 385416 - DNA, 16 bp, M. musculus
ccaggaaagccaggga

SEQ ID NO: 385417 - DNA, 16 bp, M. musculus
ccaggaaatttcatca

SEQ ID NO: 385418 - DNA, 16 bp, M. musculus
ccaggaactcactatg

SEQ ID NO: 385419 - DNA, 16 bp, M. musculus
ccaggaacttctggct

SEQ ID NO: 385420 - DNA, 16 bp, M. musculus
ccaggaagaatcagaa

SEQ ID NO: 385421 - DNA, 16 bp, M. musculus
ccaggaagaatctgag

SEQ ID NO: 385422 - DNA, 16 bp, M. musculus
ccaggaagagggaatg

SEQ ID NO: 385423 - DNA, 16 bp, M. musculus
ccaggaagcaaagttt

SEQ ID NO: 385424 - DNA, 16 bp, M. musculus
ccaggaagcagaaagg

SEQ ID NO: 385425 - DNA, 16 bp, M. musculus
ccaggaagcagcagaa

SEQ ID NO: 385426 - DNA, 16 bp, M. musculus
ccaggaagcagcagca

SEQ ID NO: 385427 - DNA, 16 bp, M. musculus
ccaggaagcagcagtg

SEQ ID NO: 385428 - DNA, 16 bp, M. musculus
ccaggaagcagtgttc

SEQ ID NO: 385429 - DNA, 16 bp, M. musculus
ccaggaagccagagag

SEQ ID NO: 385430 - DNA, 16 bp, M. musculus
ccaggaagccctgggc

SEQ ID NO: 385431 - DNA, 16 bp, M. musculus
ccaggaagctggagtg

SEQ ID NO: 385432 - DNA, 16 bp, M. musculus
ccaggaagctggtggg

SEQ ID NO: 385433 - DNA, 16 bp, M. musculus
ccaggaaggaggacaa

SEQ ID NO: 385434 - DNA, 16 bp, M. musculus
ccaggaaggcatggtg

SEQ ID NO: 385435 - DNA, 16 bp, M. musculus
ccaggaaggggggcaa

SEQ ID NO: 385436 - DNA, 16 bp, M. musculus
ccaggaagtctttaat

SEQ ID NO: 385437 - DNA, 16 bp, M. musculus
ccaggaagtgggagtg

SEQ ID NO: 385438 - DNA, 16 bp, M. musculus
ccaggaagttcctgaa

SEQ ID NO: 385439 - DNA, 16 bp, M. musculus
ccaggaatccagccct

SEQ ID NO: 385440 - DNA, 16 bp, M. musculus
ccaggaatctatgaag

SEQ ID NO: 385441 - DNA, 16 bp, M. musculus
ccaggaatcttcctgt

SEQ ID NO: 385442 - DNA, 17 bp, M. musculus
ccaggaatgcagggatg

SEQ ID NO: 385443 - DNA, 16 bp, M. musculus
ccaggaatgttaaaca

SEQ ID NO: 385444 - DNA, 16 bp, M. musculus
ccaggaattgaactca

SEQ ID NO: 385445 - DNA, 16 bp, M. musculus
ccaggacaaccaggac

SEQ ID NO: 385446 - DNA, 16 bp, M. musculus
ccaggacaaccagggt

SEQ ID NO: 385447 - DNA, 16 bp, M. musculus
ccaggacagcaagggc

SEQ ID NO: 385448 - DNA, 16 bp, M. musculus
ccaggacagccaagaa

SEQ ID NO: 385449 - DNA, 16 bp, M. musculus
ccaggacagccacagc

SEQ ID NO: 385450 - DNA, 16 bp, M. musculus
ccaggacagccagaaa

SEQ ID NO: 385451 - DNA, 16 bp, M. musculus
ccaggacagccagcta

SEQ ID NO: 385452 - DNA, 16 bp, M. musculus
ccaggacagccaggaa

SEQ ID NO: 385453 - DNA, 16 bp, M. musculus
ccaggacagccaggcc

SEQ ID NO: 385454 - DNA, 16 bp, M. musculus
ccaggacagcgagggc

SEQ ID NO: 385455 - DNA, 16 bp, M. musculus
ccaggacagggaagag

SEQ ID NO: 385456 - DNA, 16 bp, M. musculus
ccaggacagggaaggg

SEQ ID NO: 385457 - DNA, 16 bp, M. musculus
ccaggacagtcaggct

SEQ ID NO: 385458 - DNA, 16 bp, M. musculus
ccaggacagtctgggc

SEQ ID NO: 385459 - DNA, 16 bp, M. musculus
ccaggacagtgagggc

SEQ ID NO: 385460 - DNA, 16 bp, M. musculus
ccaggacatccaggac

SEQ ID NO: 385461 - DNA, 16 bp, M. musculus
ccaggaccaaaaagca

SEQ ID NO: 385462 - DNA, 16 bp, M. musculus
ccaggaccaccagcca

SEQ ID NO: 385463 - DNA, 16 bp, M. musculus
ccaggaccaccaggga

SEQ ID NO: 385464 - DNA, 16 bp, M. musculus
ccaggaccaccttccc

SEQ ID NO: 385465 - DNA, 16 bp, M. musculus
ccaggaccaggaagca

SEQ ID NO: 385466 - DNA, 16 bp, M. musculus
ccaggaccccagccca

SEQ ID NO: 385467 - DNA, 16 bp, M. musculus
ccaggaccctttaggc

SEQ ID NO: 385468 - DNA, 16 bp, M. musculus
ccaggaccgccagggc

SEQ ID NO: 385469 - DNA, 16 bp, M. musculus
ccaggacggccagggc

SEQ ID NO: 385470 - DNA, 16 bp, M. musculus
ccaggactacatagtg

SEQ ID NO: 385471 - DNA, 16 bp, M. musculus
ccaggactacctgcct

SEQ ID NO: 385472 - DNA, 16 bp, M. musculus
ccaggactatccacaa

SEQ ID NO: 385473 - DNA, 16 bp, M. musculus
ccaggactcactgtgg

SEQ ID NO: 385474 - DNA, 16 bp, M. musculus
ccaggactgagggggt

SEQ ID NO: 385475 - DNA, 16 bp, M. musculus
ccaggactgcatagag

SEQ ID NO: 385476 - DNA, 16 bp, M. musculus
ccaggactgccagggc

SEQ ID NO: 385477 - DNA, 16 bp, M. musculus
ccaggactggatgagg

SEQ ID NO: 385478 - DNA, 16 bp, M. musculus
ccaggactggctgagg

SEQ ID NO: 385479 - DNA, 16 bp, M. musculus
ccaggagaaacagcaa

SEQ ID NO: 385480 - DNA, 19 bp, M. musculus
ccaggagaaagcagtttgt

SEQ ID NO: 385481 - DNA, 16 bp, M. musculus
ccaggagaacaaggcc

SEQ ID NO: 385482 - DNA, 16 bp, M. musculus
ccaggagaagcaagtc

SEQ ID NO: 385483 - DNA, 16 bp, M. musculus
ccaggagacatgatca

SEQ ID NO: 385484 - DNA, 16 bp, M. musculus
ccaggagagagctgtt

SEQ ID NO: 385485 - DNA, 16 bp, M. musculus
ccaggagagccaggga

SEQ ID NO: 385486 - DNA, 16 bp, M. musculus
ccaggagagccagggc

SEQ ID NO: 385487 - DNA, 16 bp, M. musculus
ccaggagaggcacccc

SEQ ID NO: 385488 - DNA, 16 bp, M. musculus
ccaggagaggccattg

SEQ ID NO: 385489 - DNA, 16 bp, M. musculus
ccaggagatccaacac

SEQ ID NO: 385490 - DNA, 16 bp, M. musculus
ccaggagccaaagcag

SEQ ID NO: 385491 - DNA, 16 bp, M. musculus
ccaggagccacatggt

SEQ ID NO: 385492 - DNA, 16 bp, M. musculus
ccaggagccagaggct

SEQ ID NO: 385493 - DNA, 16 bp, M. musculus
ccaggagccaggagcc

SEQ ID NO: 385494 - DNA, 16 bp, M. musculus
ccaggagctcctgggg

SEQ ID NO: 385495 - DNA, 16 bp, M. musculus
ccaggagctgactcag

SEQ ID NO: 385496 - DNA, 16 bp, M. musculus
ccaggagctggaaaaa

SEQ ID NO: 385497 - DNA, 16 bp, M. musculus
ccaggagctggagaga

SEQ ID NO: 385498 - DNA, 16 bp, M. musculus
ccaggagctggggctg

SEQ ID NO: 385499 - DNA, 16 bp, M. musculus
ccaggaggaagagaag

SEQ ID NO: 385500 - DNA, 16 bp, M. musculus
ccaggaggaggagaag

SEQ ID NO: 385501 - DNA, 16 bp, M. musculus
ccaggaggaggcccaa

SEQ ID NO: 385502 - DNA, 16 bp, M. musculus
ccaggaggcaaaggtg

SEQ ID NO: 385503 - DNA, 16 bp, M. musculus
ccaggaggcagagcag

SEQ ID NO: 385504 - DNA, 16 bp, M. musculus
ccaggaggcagaggca

SEQ ID NO: 385505 - DNA, 16 bp, M. musculus
ccaggaggcaggagtg

SEQ ID NO: 385506 - DNA, 16 bp, M. musculus
ccaggaggcaggtttg

SEQ ID NO: 385507 - DNA, 16 bp, M. musculus
ccaggaggccaggagg

SEQ ID NO: 385508 - DNA, 16 bp, M. musculus
ccaggaggcctccccc

SEQ ID NO: 385509 - DNA, 16 bp, M. musculus
ccaggaggcctccttc

SEQ ID NO: 385510 - DNA, 17 bp, M. musculus
ccaggaggctgaggcag

SEQ ID NO: 385511 - DNA, 16 bp, M. musculus
ccaggaggctgagttt

SEQ ID NO: 385512 - DNA, 16 bp, M. musculus
ccaggaggctggagag

SEQ ID NO: 385513 - DNA, 16 bp, M. musculus
ccaggagggctctgcc

SEQ ID NO: 385514 - DNA, 16 bp, M. musculus
ccaggaggggaggggt

SEQ ID NO: 385515 - DNA, 16 bp, M. musculus
ccaggaggggcagtct

SEQ ID NO: 385516 - DNA, 16 bp, M. musculus
ccaggaggtggatctg

SEQ ID NO: 385517 - DNA, 16 bp, M. musculus
ccaggaggtggggctg

SEQ ID NO: 385518 - DNA, 16 bp, M. musculus
ccaggaggtggtggtg

SEQ ID NO: 385519 - DNA, 16 bp, M. musculus
ccaggagtcagaggca

SEQ ID NO: 385520 - DNA, 16 bp, M. musculus
ccaggagtggtatggc

SEQ ID NO: 385521 - DNA, 16 bp, M. musculus
ccaggagtttccaatt

SEQ ID NO: 385522 - DNA, 16 bp, M. musculus
ccaggagtttgagaac

SEQ ID NO: 385523 - DNA, 16 bp, M. musculus
ccaggatagtgaaaac

SEQ ID NO: 385524 - DNA, 16 bp, M. musculus
ccaggatcacaggtga

SEQ ID NO: 385525 - DNA, 16 bp, M. musculus
ccaggatcaccgacaa

SEQ ID NO: 385526 - DNA, 16 bp, M. musculus
ccaggatcccagccag

SEQ ID NO: 385527 - DNA, 16 bp, M. musculus
ccaggatcccagccca

SEQ ID NO: 385528 - DNA, 16 bp, M. musculus
ccaggatcccaggagc

SEQ ID NO: 385529 - DNA, 16 bp, M. musculus
ccaggatctcaaggtc

SEQ ID NO: 385530 - DNA, 16 bp, M. musculus
ccaggatgatcttgaa

SEQ ID NO: 385531 - DNA, 16 bp, M. musculus
ccaggatgcaggagtg

SEQ ID NO: 385532 - DNA, 16 bp, M. musculus
ccaggatggccagggc

SEQ ID NO: 385533 - DNA, 16 bp, M. musculus
ccaggatggccttgaa

SEQ ID NO: 385534 - DNA, 16 bp, M. musculus
ccaggatgttaattaa

SEQ ID NO: 385535 - DNA, 16 bp, M. musculus
ccaggattcaaaggga

SEQ ID NO: 385536 - DNA, 16 bp, M. musculus
ccaggattctcctgtc

SEQ ID NO: 385537 - DNA, 16 bp, M. musculus
ccaggattgtattgaa

SEQ ID NO: 385538 - DNA, 16 bp, M. musculus
ccaggatttccagttt

SEQ ID NO: 385539 - DNA, 16 bp, M. musculus
ccaggcaaatacagaa

SEQ ID NO: 385540 - DNA, 16 bp, M. musculus
ccaggcaacagccagg

SEQ ID NO: 385541 - DNA, 16 bp, M. musculus
ccaggcaagcactcca

SEQ ID NO: 385542 - DNA, 16 bp, M. musculus
ccaggcaagccagggc

SEQ ID NO: 385543 - DNA, 16 bp, M. musculus
ccaggcaagcctgggc

SEQ ID NO: 385544 - DNA, 16 bp, M. musculus
ccaggcaagcctggtc

SEQ ID NO: 385545 - DNA, 16 bp, M. musculus
ccaggcaagctctcct

SEQ ID NO: 385546 - DNA, 16 bp, M. musculus
ccaggcaagtccaggc

SEQ ID NO: 385547 - DNA, 16 bp, M. musculus
ccaggcacacaagtga

SEQ ID NO: 385548 - DNA, 16 bp, M. musculus
ccaggcacacagtagg

SEQ ID NO: 385549 - DNA, 16 bp, M. musculus
ccaggcaccactggga

SEQ ID NO: 385550 - DNA, 16 bp, M. musculus
ccaggcacccacatgg

SEQ ID NO: 385551 - DNA, 16 bp, M. musculus
ccaggcacccagggag

SEQ ID NO: 385552 - DNA, 16 bp, M. musculus
ccaggcactgctggga

SEQ ID NO: 385553 - DNA, 16 bp, M. musculus
ccaggcactggaagag

SEQ ID NO: 385554 - DNA, 16 bp, M. musculus
ccaggcactgtggcac

SEQ ID NO: 385555 - DNA, 16 bp, M. musculus
ccaggcagaagaggag

SEQ ID NO: 385556 - DNA, 16 bp, M. musculus
ccaggcagacctcaaa

SEQ ID NO: 385557 - DNA, 16 bp, M. musculus
ccaggcagaggcagag

SEQ ID NO: 385558 - DNA, 16 bp, M. musculus
ccaggcagatgtccct

SEQ ID NO: 385559 - DNA, 16 bp, M. musculus
ccaggcagccagagct

SEQ ID NO: 385560 - DNA, 16 bp, M. musculus
ccaggcagctctgctg

SEQ ID NO: 385561 - DNA, 16 bp, M. musculus
ccaggcagctgctctg

SEQ ID NO: 385562 - DNA, 16 bp, M. musculus
ccaggcagctgctgct

SEQ ID NO: 385563 - DNA, 16 bp, M. musculus
ccaggcagctgtgagc

SEQ ID NO: 385564 - DNA, 16 bp, M. musculus
ccaggcaggcaaggca

SEQ ID NO: 385565 - DNA, 16 bp, M. musculus
ccaggcaggcacagtg

SEQ ID NO: 385566 - DNA, 16 bp, M. musculus
ccaggcaggcctggaa

SEQ ID NO: 385567 - DNA, 16 bp, M. musculus
ccaggcagggatggtg

SEQ ID NO: 385568 - DNA, 16 bp, M. musculus
ccaggcagggctacat

SEQ ID NO: 385569 - DNA, 16 bp, M. musculus
ccaggcaggggtggtg

SEQ ID NO: 385570 - DNA, 16 bp, M. musculus
ccaggcaggtgtggtg

SEQ ID NO: 385571 - DNA, 16 bp, M. musculus
ccaggcagtgactctg

SEQ ID NO: 385572 - DNA, 16 bp, M. musculus
ccaggcagtggtggcc

SEQ ID NO: 385573 - DNA, 16 bp, M. musculus
ccaggcagtggtgtca

SEQ ID NO: 385574 - DNA, 16 bp, M. musculus
ccaggcagtgtttaca

SEQ ID NO: 385575 - DNA, 16 bp, M. musculus
ccaggcatcctcctgt

SEQ ID NO: 385576 - DNA, 16 bp, M. musculus
ccaggcatgatggcat

SEQ ID NO: 385577 - DNA, 16 bp, M. musculus
ccaggcatgcagcttc

SEQ ID NO: 385578 - DNA, 16 bp, M. musculus
ccaggcatgcatgcag

SEQ ID NO: 385579 - DNA, 16 bp, M. musculus
ccaggcatggtggcac

SEQ ID NO: 385580 - DNA, 16 bp, M. musculus
ccaggccaccctggtc

SEQ ID NO: 385581 - DNA, 16 bp, M. musculus
ccaggccaccttgggc

SEQ ID NO: 385582 - DNA, 16 bp, M. musculus
ccaggccagccaggac

SEQ ID NO: 385583 - DNA, 16 bp, M. musculus
ccaggccagccaggat

SEQ ID NO: 385584 - DNA, 16 bp, M. musculus
ccaggccagcctcaaa

SEQ ID NO: 385585 - DNA, 16 bp, M. musculus
ccaggccagcctgaac

SEQ ID NO: 385586 - DNA, 16 bp, M. musculus
ccaggccagcctgggc

SEQ ID NO: 385587 - DNA, 16 bp, M. musculus
ccaggccagcctgggg

SEQ ID NO: 385588 - DNA, 16 bp, M. musculus
ccaggccagcctgtgc

SEQ ID NO: 385589 - DNA, 16 bp, M. musculus
ccaggccaggctgggc

SEQ ID NO: 385590 - DNA, 16 bp, M. musculus
ccaggccatcaagggt

SEQ ID NO: 385591 - DNA, 16 bp, M. musculus
ccaggccatcctgggc

SEQ ID NO: 385592 - DNA, 16 bp, M. musculus
ccaggccatgtgtttc

SEQ ID NO: 385593 - DNA, 16 bp, M. musculus
ccaggcccacctgccc

SEQ ID NO: 385594 - DNA, 16 bp, M. musculus
ccaggcccagatctag

SEQ ID NO: 385595 - DNA, 16 bp, M. musculus
ccaggcccaggaagtg

SEQ ID NO: 385596 - DNA, 16 bp, M. musculus
ccaggcccaggcccag

SEQ ID NO: 385597 - DNA, 16 bp, M. musculus
ccaggcccagtgtctc

SEQ ID NO: 385598 - DNA, 16 bp, M. musculus
ccaggcctacacagag

SEQ ID NO: 385599 - DNA, 16 bp, M. musculus
ccaggcctcagcctcc

SEQ ID NO: 385600 - DNA, 16 bp, M. musculus
ccaggcctgatcaggg

SEQ ID NO: 385601 - DNA, 16 bp, M. musculus
ccaggcctggtggctc

SEQ ID NO: 385602 - DNA, 16 bp, M. musculus
ccaggccttgtgcatg

SEQ ID NO: 385603 - DNA, 16 bp, M. musculus
ccaggcctttctggct

SEQ ID NO: 385604 - DNA, 16 bp, M. musculus
ccaggcgctgtccagg

SEQ ID NO: 385605 - DNA, 18 bp, M. musculus
ccaggcgtggtggcgcac

SEQ ID NO: 385606 - DNA, 16 bp, M. musculus
ccaggctagatacccc

SEQ ID NO: 385607 - DNA, 16 bp, M. musculus
ccaggctagcctcaac

SEQ ID NO: 385608 - DNA, 16 bp, M. musculus
ccaggctagcctggac

SEQ ID NO: 385609 - DNA, 16 bp, M. musculus
ccaggctagcctttaa

SEQ ID NO: 385610 - DNA, 16 bp, M. musculus
ccaggctagctttgaa

SEQ ID NO: 385611 - DNA, 16 bp, M. musculus
ccaggctagtctcgaa

SEQ ID NO: 385612 - DNA, 16 bp, M. musculus
ccaggctatgtgcttc

SEQ ID NO: 385613 - DNA, 16 bp, M. musculus
ccaggctcagttccca

SEQ ID NO: 385614 - DNA, 16 bp, M. musculus
ccaggctccaagaatg

SEQ ID NO: 385615 - DNA, 16 bp, M. musculus
ccaggctccatcccca

SEQ ID NO: 385616 - DNA, 16 bp, M. musculus
ccaggctcccatctgt

SEQ ID NO: 385617 - DNA, 16 bp, M. musculus
ccaggctcctctccat

SEQ ID NO: 385618 - DNA, 16 bp, M. musculus
ccaggctcctgtctac

SEQ ID NO: 385619 - DNA, 16 bp, M. musculus
ccaggctctgacccta

SEQ ID NO: 385620 - DNA, 16 bp, M. musculus
ccaggctctgcctcct

SEQ ID NO: 385621 - DNA, 16 bp, M. musculus
ccaggctctgctccct

SEQ ID NO: 385622 - DNA, 16 bp, M. musculus
ccaggctgacttccaa

SEQ ID NO: 385623 - DNA, 16 bp, M. musculus
ccaggctgcccccaaa

SEQ ID NO: 385624 - DNA, 16 bp, M. musculus
ccaggctgccctcaga

SEQ ID NO: 385625 - DNA, 16 bp, M. musculus
ccaggctgccttggaa

SEQ ID NO: 385626 - DNA, 16 bp, M. musculus
ccaggctgctgtgcag

SEQ ID NO: 385627 - DNA, 16 bp, M. musculus
ccaggctggagaggtg

SEQ ID NO: 385628 - DNA, 16 bp, M. musculus
ccaggctggcccctaa

SEQ ID NO: 385629 - DNA, 16 bp, M. musculus
ccaggctggcctaaaa

SEQ ID NO: 385630 - DNA, 16 bp, M. musculus
ccaggctggcctccag

SEQ ID NO: 385631 - DNA, 16 bp, M. musculus
ccaggctggcctgcag

SEQ ID NO: 385632 - DNA, 16 bp, M. musculus
ccaggctggcctggag

SEQ ID NO: 385633 - DNA, 16 bp, M. musculus
ccaggctggctggctg

SEQ ID NO: 385634 - DNA, 16 bp, M. musculus
ccaggctggctggctt

SEQ ID NO: 385635 - DNA, 16 bp, M. musculus
ccaggctgggattaaa

SEQ ID NO: 385636 - DNA, 16 bp, M. musculus
ccaggctgggcagaca

SEQ ID NO: 385637 - DNA, 16 bp, M. musculus
ccaggctggtgtggaa

SEQ ID NO: 385638 - DNA, 16 bp, M. musculus
ccaggctgtcctcaaa

SEQ ID NO: 385639 - DNA, 16 bp, M. musculus
ccaggctgtcctcaga

SEQ ID NO: 385640 - DNA, 16 bp, M. musculus
ccaggctgtggtggcg

SEQ ID NO: 385641 - DNA, 16 bp, M. musculus
ccaggcttccccagca

SEQ ID NO: 385642 - DNA, 16 bp, M. musculus
ccaggcttcctggcca

SEQ ID NO: 385643 - DNA, 16 bp, M. musculus
ccaggcttctaggcag

SEQ ID NO: 385644 - DNA, 16 bp, M. musculus
ccaggcttgctggcca

SEQ ID NO: 385645 - DNA, 16 bp, M. musculus
ccaggcttggcctcaa

SEQ ID NO: 385646 - DNA, 16 bp, M. musculus
ccaggcttgtgcagca

SEQ ID NO: 385647 - DNA, 16 bp, M. musculus
ccagggaaaccaggaa

SEQ ID NO: 385648 - DNA, 16 bp, M. musculus
ccagggaaatggctca

SEQ ID NO: 385649 - DNA, 16 bp, M. musculus
ccagggaactgaaggg

SEQ ID NO: 385650 - DNA, 16 bp, M. musculus
ccagggaagcaggtag

SEQ ID NO: 385651 - DNA, 16 bp, M. musculus
ccagggaagccagggc

SEQ ID NO: 385652 - DNA, 16 bp, M. musculus
ccagggaatccaacac

SEQ ID NO: 385653 - DNA, 16 bp, M. musculus
ccagggacaagatgga

SEQ ID NO: 385654 - DNA, 16 bp, M. musculus
ccagggaccccagaac

SEQ ID NO: 385655 - DNA, 16 bp, M. musculus
ccagggaccccctgag

SEQ ID NO: 385656 - DNA, 16 bp, M. musculus
ccagggacccctgtgg

SEQ ID NO: 385657 - DNA, 16 bp, M. musculus
ccagggaccctcctgt

SEQ ID NO: 385658 - DNA, 16 bp, M. musculus
ccagggacctgggagg

SEQ ID NO: 385659 - DNA, 16 bp, M. musculus
ccagggactgaattca

SEQ ID NO: 385660 - DNA, 16 bp, M. musculus
ccagggagctctgaag

SEQ ID NO: 385661 - DNA, 16 bp, M. musculus
ccagggagctgaaagg

SEQ ID NO: 385662 - DNA, 16 bp, M. musculus
ccagggagctggagag

SEQ ID NO: 385663 - DNA, 16 bp, M. musculus
ccagggaggagctggg

SEQ ID NO: 385664 - DNA, 16 bp, M. musculus
ccagggaggtggagac

SEQ ID NO: 385665 - DNA, 16 bp, M. musculus
ccagggaggtggctca

SEQ ID NO: 385666 - DNA, 16 bp, M. musculus
ccagggagtagaatgt

SEQ ID NO: 385667 - DNA, 16 bp, M. musculus
ccagggagtggaagaa

SEQ ID NO: 385668 - DNA, 17 bp, M. musculus
ccagggagtggcaccat

SEQ ID NO: 385669 - DNA, 16 bp, M. musculus
ccagggagttgggagg

SEQ ID NO: 385670 - DNA, 16 bp, M. musculus
ccagggatgagccccc

SEQ ID NO: 385671 - DNA, 16 bp, M. musculus
ccagggatgcaaagat

SEQ ID NO: 385672 - DNA, 16 bp, M. musculus
ccagggatggcaccac

SEQ ID NO: 385673 - DNA, 16 bp, M. musculus
ccagggcagccagaga

SEQ ID NO: 385674 - DNA, 18 bp, M. musculus
ccagggccaaaaaggggc

SEQ ID NO: 385675 - DNA, 19 bp, M. musculus
ccagggccaaaaagtggga

SEQ ID NO: 385676 - DNA, 16 bp, M. musculus
ccagggccacagcctg

SEQ ID NO: 385677 - DNA, 16 bp, M. musculus
ccagggccacaggcct

SEQ ID NO: 385678 - DNA, 16 bp, M. musculus
ccagggccagatgggt

SEQ ID NO: 385679 - DNA, 16 bp, M. musculus
ccagggccagctcttc

SEQ ID NO: 385680 - DNA, 16 bp, M. musculus
ccagggccaggaaaca

SEQ ID NO: 385681 - DNA, 16 bp, M. musculus
ccagggccaggaagag

SEQ ID NO: 385682 - DNA, 16 bp, M. musculus
ccagggccccctcaag

SEQ ID NO: 385683 - DNA, 16 bp, M. musculus
ccagggcccctattct

SEQ ID NO: 385684 - DNA, 16 bp, M. musculus
ccagggccgggaagtg

SEQ ID NO: 385685 - DNA, 16 bp, M. musculus
ccagggcctcacacac

SEQ ID NO: 385686 - DNA, 16 bp, M. musculus
ccagggcctcacagag

SEQ ID NO: 385687 - DNA, 16 bp, M. musculus
ccagggcctcatgcat

SEQ ID NO: 385688 - DNA, 16 bp, M. musculus
ccagggcctctggaag

SEQ ID NO: 385689 - DNA, 16 bp, M. musculus
ccagggccttgtacat

SEQ ID NO: 385690 - DNA, 16 bp, M. musculus
ccagggccttgtgcat

SEQ ID NO: 385691 - DNA, 19 bp, M. musculus
ccagggctacaaagagaaa

SEQ ID NO: 385692 - DNA, 16 bp, M. musculus
ccagggctacacaatg

SEQ ID NO: 385693 - DNA, 16 bp, M. musculus
ccagggctacacagac

SEQ ID NO: 385694 - DNA, 16 bp, M. musculus
ccagggctacacagat

SEQ ID NO: 385695 - DNA, 16 bp, M. musculus
ccagggctacactgaa

SEQ ID NO: 385696 - DNA, 16 bp, M. musculus
ccagggctacatagtc

SEQ ID NO: 385697 - DNA, 16 bp, M. musculus
ccagggctacatggtg

SEQ ID NO: 385698 - DNA, 16 bp, M. musculus
ccagggctacgcagaa

SEQ ID NO: 385699 - DNA, 16 bp, M. musculus
ccagggctcactgtgg

SEQ ID NO: 385700 - DNA, 16 bp, M. musculus
ccagggctcaggaggc

SEQ ID NO: 385701 - DNA, 16 bp, M. musculus
ccagggctccagctgc

SEQ ID NO: 385702 - DNA, 16 bp, M. musculus
ccagggctgtgcagag

SEQ ID NO: 385703 - DNA, 16 bp, M. musculus
ccagggctgtgtgcag

SEQ ID NO: 385704 - DNA, 16 bp, M. musculus
ccagggcttcatgcac

SEQ ID NO: 385705 - DNA, 16 bp, M. musculus
ccagggcttcatgcat

SEQ ID NO: 385706 - DNA, 16 bp, M. musculus
ccagggcttcctgcat

SEQ ID NO: 385707 - DNA, 16 bp, M. musculus
ccagggcttcttgcat

SEQ ID NO: 385708 - DNA, 16 bp, M. musculus
ccagggctttgtgcat

SEQ ID NO: 385709 - DNA, 16 bp, M. musculus
ccaggggaagaaagcc

SEQ ID NO: 385710 - DNA, 16 bp, M. musculus
ccaggggaaggaagcc

SEQ ID NO: 385711 - DNA, 16 bp, M. musculus
ccaggggagagctggt

SEQ ID NO: 385712 - DNA, 16 bp, M. musculus
ccaggggctctgacac

SEQ ID NO: 385713 - DNA, 16 bp, M. musculus
ccaggggctggagaga

SEQ ID NO: 385714 - DNA, 16 bp, M. musculus
ccaggggctgggcttc

SEQ ID NO: 385715 - DNA, 16 bp, M. musculus
ccaggggctggtgaga

SEQ ID NO: 385716 - DNA, 16 bp, M. musculus
ccaggggctgtgccta

SEQ ID NO: 385717 - DNA, 16 bp, M. musculus
ccaggggctttacctt

SEQ ID NO: 385718 - DNA, 16 bp, M. musculus
ccagggtagcctcaaa

SEQ ID NO: 385719 - DNA, 16 bp, M. musculus
ccagggtcagagccct

SEQ ID NO: 385720 - DNA, 16 bp, M. musculus
ccagggtccaggttag

SEQ ID NO: 385721 - DNA, 16 bp, M. musculus
ccagggtgacacagag

SEQ ID NO: 385722 - DNA, 16 bp, M. musculus
ccagggtggcctagaa

SEQ ID NO: 385723 - DNA, 16 bp, M. musculus
ccagggtggcttcaaa

SEQ ID NO: 385724 - DNA, 16 bp, M. musculus
ccagggttatctccct

SEQ ID NO: 385725 - DNA, 16 bp, M. musculus
ccagggttcaagacct

SEQ ID NO: 385726 - DNA, 16 bp, M. musculus
ccagggtttctctgtg

SEQ ID NO: 385727 - DNA, 16 bp, M. musculus
ccagggtttgctgtgg

SEQ ID NO: 385728 - DNA, 16 bp, M. musculus
ccaggtagcccaggct

SEQ ID NO: 385729 - DNA, 16 bp, M. musculus
ccaggtatggtggctc

SEQ ID NO: 385730 - DNA, 16 bp, M. musculus
ccaggtcagaaatttg

SEQ ID NO: 385731 - DNA, 16 bp, M. musculus
ccaggtcaggtggctc

SEQ ID NO: 385732 - DNA, 16 bp, M. musculus
ccaggtcccggggttc

SEQ ID NO: 385733 - DNA, 16 bp, M. musculus
ccaggtccctgagcac

SEQ ID NO: 385734 - DNA, 16 bp, M. musculus
ccaggtcctctgcgag

SEQ ID NO: 385735 - DNA, 16 bp, M. musculus
ccaggtctacacagaa

SEQ ID NO: 385736 - DNA, 16 bp, M. musculus
ccaggtctagcttttc

SEQ ID NO: 385737 - DNA, 16 bp, M. musculus
ccaggtctctggtaca

SEQ ID NO: 385738 - DNA, 16 bp, M. musculus
ccaggtcttctgaaag

SEQ ID NO: 385739 - DNA, 16 bp, M. musculus
ccaggtgaaaggtctg

SEQ ID NO: 385740 - DNA, 16 bp, M. musculus
ccaggtgcagaactat

SEQ ID NO: 385741 - DNA, 16 bp, M. musculus
ccaggtgctgggatta

SEQ ID NO: 385742 - DNA, 16 bp, M. musculus
ccaggtggcagggctg

SEQ ID NO: 385743 - DNA, 16 bp, M. musculus
ccaggtggctcagtgt

SEQ ID NO: 385744 - DNA, 16 bp, M. musculus
ccaggtggtgatggtg

SEQ ID NO: 385745 - DNA, 16 bp, M. musculus
ccaggtggtggggcag

SEQ ID NO: 385746 - DNA, 16 bp, M. musculus
ccaggtggtggtggca

SEQ ID NO: 385747 - DNA, 16 bp, M. musculus
ccaggtgtgccaggtg

SEQ ID NO: 385748 - DNA, 16 bp, M. musculus
ccaggtgtggcagtgc

SEQ ID NO: 385749 - DNA, 16 bp, M. musculus
ccaggtgttggtggca

SEQ ID NO: 385750 - DNA, 16 bp, M. musculus
ccaggttagttgattc

SEQ ID NO: 385751 - DNA, 16 bp, M. musculus
ccaggttcaatcccag

SEQ ID NO: 385752 - DNA, 16 bp, M. musculus
ccaggttcactgagag

SEQ ID NO: 385753 - DNA, 16 bp, M. musculus
ccaggttccatttcca

SEQ ID NO: 385754 - DNA, 16 bp, M. musculus
ccaggttcctgccctg

SEQ ID NO: 385755 - DNA, 16 bp, M. musculus
ccaggttcctgccttg

SEQ ID NO: 385756 - DNA, 16 bp, M. musculus
ccaggttcctgttctg

SEQ ID NO: 385757 - DNA, 16 bp, M. musculus
ccaggttctgtgagag

SEQ ID NO: 385758 - DNA, 16 bp, M. musculus
ccaggttggcatcaaa

SEQ ID NO: 385759 - DNA, 16 bp, M. musculus
ccaggttggccatgaa

SEQ ID NO: 385760 - DNA, 16 bp, M. musculus
ccaggttggccccaaa

SEQ ID NO: 385761 - DNA, 16 bp, M. musculus
ccaggttggcttcaaa

SEQ ID NO: 385762 - DNA, 16 bp, M. musculus
ccaggttggctttgaa

SEQ ID NO: 385763 - DNA, 16 bp, M. musculus
ccaggtttctctttct

SEQ ID NO: 385764 - DNA, 16 bp, M. musculus
ccaggttttctgcttt

SEQ ID NO: 385765 - DNA, 16 bp, M. musculus
ccagtaaacacacaca

SEQ ID NO: 385766 - DNA, 16 bp, M. musculus
ccagtaacaccccccc

SEQ ID NO: 385767 - DNA, 16 bp, M. musculus
ccagtaaccagaaaaa

SEQ ID NO: 385768 - DNA, 16 bp, M. musculus
ccagtaagcagtgttt

SEQ ID NO: 385769 - DNA, 16 bp, M. musculus
ccagtaatggtcagca

SEQ ID NO: 385770 - DNA, 16 bp, M. musculus
ccagtaccaggaatgg

SEQ ID NO: 385771 - DNA, 16 bp, M. musculus
ccagtaccagggagct

SEQ ID NO: 385772 - DNA, 16 bp, M. musculus
ccagtacccacagagc

SEQ ID NO: 385773 - DNA, 16 bp, M. musculus
ccagtaccccacagaa

SEQ ID NO: 385774 - DNA, 16 bp, M. musculus
ccagtaccctggagct

SEQ ID NO: 385775 - DNA, 16 bp, M. musculus
ccagtaccttcagagc

SEQ ID NO: 385776 - DNA, 16 bp, M. musculus
ccagtactcaggaagc

SEQ ID NO: 385777 - DNA, 16 bp, M. musculus
ccagtactcccccaga

SEQ ID NO: 385778 - DNA, 16 bp, M. musculus
ccagtactggggcata

SEQ ID NO: 385779 - DNA, 16 bp, M. musculus
ccagtacttaggaagc

SEQ ID NO: 385780 - DNA, 16 bp, M. musculus
ccagtacttggaggca

SEQ ID NO: 385781 - DNA, 17 bp, M. musculus
ccagtagccaacctcaa

SEQ ID NO: 385782 - DNA, 16 bp, M. musculus
ccagtagccagcatca

SEQ ID NO: 385783 - DNA, 16 bp, M. musculus
ccagtagctgactgtg

SEQ ID NO: 385784 - DNA, 16 bp, M. musculus
ccagtatatatatata

SEQ ID NO: 385785 - DNA, 16 bp, M. musculus
ccagtatgaatttcct

SEQ ID NO: 385786 - DNA, 16 bp, M. musculus
ccagtatgcaaagaag

SEQ ID NO: 385787 - DNA, 17 bp, M. musculus
ccagtattctgctagca

SEQ ID NO: 385788 - DNA, 16 bp, M. musculus
ccagtcaaaatggcta

SEQ ID NO: 385789 - DNA, 16 bp, M. musculus
ccagtcaaccccactc

SEQ ID NO: 385790 - DNA, 16 bp, M. musculus
ccagtcacagaagaac

SEQ ID NO: 385791 - DNA, 16 bp, M. musculus
ccagtcactggacagc

SEQ ID NO: 385792 - DNA, 16 bp, M. musculus
ccagtcagaatggctg

SEQ ID NO: 385793 - DNA, 16 bp, M. musculus
ccagtcagggctacac

SEQ ID NO: 385794 - DNA, 16 bp, M. musculus
ccagtcaggtgagtga

SEQ ID NO: 385795 - DNA, 16 bp, M. musculus
ccagtcagtctagctg

SEQ ID NO: 385796 - DNA, 16 bp, M. musculus
ccagtcatgccaagtt

SEQ ID NO: 385797 - DNA, 16 bp, M. musculus
ccagtcatggtggcac

SEQ ID NO: 385798 - DNA, 16 bp, M. musculus
ccagtccagggatggt

SEQ ID NO: 385799 - DNA, 16 bp, M. musculus
ccagtccattgtgggt

SEQ ID NO: 385800 - DNA, 16 bp, M. musculus
ccagtcccaggagatc

SEQ ID NO: 385801 - DNA, 16 bp, M. musculus
ccagtcccaggggatc

SEQ ID NO: 385802 - DNA, 16 bp, M. musculus
ccagtccctttcaccc

SEQ ID NO: 385803 - DNA, 16 bp, M. musculus
ccagtctcagggaatc

SEQ ID NO: 385804 - DNA, 16 bp, M. musculus
ccagtctcaggggatc

SEQ ID NO: 385805 - DNA, 16 bp, M. musculus
ccagtctccaaaaact

SEQ ID NO: 385806 - DNA, 16 bp, M. musculus
ccagtctctcctcctc

SEQ ID NO: 385807 - DNA, 16 bp, M. musculus
ccagtctctgcagcat

SEQ ID NO: 385808 - DNA, 16 bp, M. musculus
ccagtctctgcctccc

SEQ ID NO: 385809 - DNA, 16 bp, M. musculus
ccagtctctgcctctg

SEQ ID NO: 385810 - DNA, 16 bp, M. musculus
ccagtctggctttgaa

SEQ ID NO: 385811 - DNA, 16 bp, M. musculus
ccagtctgggatacat

SEQ ID NO: 385812 - DNA, 16 bp, M. musculus
ccagtcttctcaccag

SEQ ID NO: 385813 - DNA, 26 bp, M. musculus
ccagtcttgactggttctaaacagag

SEQ ID NO: 385814 - DNA, 16 bp, M. musculus
ccagtgaagggatgga

SEQ ID NO: 385815 - DNA, 16 bp, M. musculus
ccagtgacacacttcc

SEQ ID NO: 385816 - DNA, 16 bp, M. musculus
ccagtgacaggcccaa

SEQ ID NO: 385817 - DNA, 16 bp, M. musculus
ccagtgacatacctcc

SEQ ID NO: 385818 - DNA, 16 bp, M. musculus
ccagtgacatacttcc

SEQ ID NO: 385819 - DNA, 16 bp, M. musculus
ccagtgacatcatgga

SEQ ID NO: 385820 - DNA, 16 bp, M. musculus
ccagtgacctcttctg

SEQ ID NO: 385821 - DNA, 16 bp, M. musculus
ccagtgacctgagttt

SEQ ID NO: 385822 - DNA, 16 bp, M. musculus
ccagtgagacagctca

SEQ ID NO: 385823 - DNA, 16 bp, M. musculus
ccagtgagagaccctg

SEQ ID NO: 385824 - DNA, 16 bp, M. musculus
ccagtgagccccaggg

SEQ ID NO: 385825 - DNA, 16 bp, M. musculus
ccagtgagctacatcc

SEQ ID NO: 385826 - DNA, 16 bp, M. musculus
ccagtgaggggctggg

SEQ ID NO: 385827 - DNA, 16 bp, M. musculus
ccagtgagtgctctta

SEQ ID NO: 385828 - DNA, 16 bp, M. musculus
ccagtgatggccagct

SEQ ID NO: 385829 - DNA, 16 bp, M. musculus
ccagtgattggcttct

SEQ ID NO: 385830 - DNA, 16 bp, M. musculus
ccagtgattgttattt

SEQ ID NO: 385831 - DNA, 16 bp, M. musculus
ccagtgattttttttt

SEQ ID NO: 385832 - DNA, 16 bp, M. musculus
ccagtgcatgctggga

SEQ ID NO: 385833 - DNA, 16 bp, M. musculus
ccagtgccaggaagca

SEQ ID NO: 385834 - DNA, 16 bp, M. musculus
ccagtgcccaggaggc

SEQ ID NO: 385835 - DNA, 16 bp, M. musculus
ccagtgcccatggagg

SEQ ID NO: 385836 - DNA, 16 bp, M. musculus
ccagtgccccccagag

SEQ ID NO: 385837 - DNA, 16 bp, M. musculus
ccagtgccccggagct

SEQ ID NO: 385838 - DNA, 16 bp, M. musculus
ccagtgctcagaaggc

SEQ ID NO: 385839 - DNA, 16 bp, M. musculus
ccagtgctcaggaggc

SEQ ID NO: 385840 - DNA, 16 bp, M. musculus
ccagtgctcttaacct

SEQ ID NO: 385841 - DNA, 16 bp, M. musculus
ccagtgctcttaactg

SEQ ID NO: 385842 - DNA, 16 bp, M. musculus
ccagtgctcttcactg

SEQ ID NO: 385843 - DNA, 16 bp, M. musculus
ccagtgctgagagggg

SEQ ID NO: 385844 - DNA, 16 bp, M. musculus
ccagtgctggggaagt

SEQ ID NO: 385845 - DNA, 16 bp, M. musculus
ccagtgctggtgctga

SEQ ID NO: 385846 - DNA, 16 bp, M. musculus
ccagtggaaaaaagag

SEQ ID NO: 385847 - DNA, 16 bp, M. musculus
ccagtggaaggccaca

SEQ ID NO: 385848 - DNA, 16 bp, M. musculus
ccagtggaataaagac

SEQ ID NO: 385849 - DNA, 16 bp, M. musculus
ccagtggaggagttgg

SEQ ID NO: 385850 - DNA, 16 bp, M. musculus
ccagtggcagcatgga

SEQ ID NO: 385851 - DNA, 16 bp, M. musculus
ccagtggcctctcctg

SEQ ID NO: 385852 - DNA, 16 bp, M. musculus
ccagtggctcaggctc

SEQ ID NO: 385853 - DNA, 16 bp, M. musculus
ccagtgggaaaaaaag

SEQ ID NO: 385854 - DNA, 16 bp, M. musculus
ccagtgggaaaaaaga

SEQ ID NO: 385855 - DNA, 16 bp, M. musculus
ccagtggggggaaaaa

SEQ ID NO: 385856 - DNA, 16 bp, M. musculus
ccagtggtgcctgggt

SEQ ID NO: 385857 - DNA, 16 bp, M. musculus
ccagtggtggtggcac

SEQ ID NO: 385858 - DNA, 16 bp, M. musculus
ccagtggtgtctggga

SEQ ID NO: 385859 - DNA, 16 bp, M. musculus
ccagtggttaagagta

SEQ ID NO: 385860 - DNA, 16 bp, M. musculus
ccagtggttcccaacc

SEQ ID NO: 385861 - DNA, 16 bp, M. musculus
ccagtggttcttttat

SEQ ID NO: 385862 - DNA, 16 bp, M. musculus
ccagtgtagtctgctt

SEQ ID NO: 385863 - DNA, 16 bp, M. musculus
ccagtgtccaagagga

SEQ ID NO: 385864 - DNA, 16 bp, M. musculus
ccagtgtcctatgctg

SEQ ID NO: 385865 - DNA, 16 bp, M. musculus
ccagtgtctctctaag

SEQ ID NO: 385866 - DNA, 16 bp, M. musculus
ccagtgtctctgaagc

SEQ ID NO: 385867 - DNA, 16 bp, M. musculus
ccagtgtctgtctgtc

SEQ ID NO: 385868 - DNA, 16 bp, M. musculus
ccagtgtgaagacaga

SEQ ID NO: 385869 - DNA, 16 bp, M. musculus
ccagtgtggatcctgg

SEQ ID NO: 385870 - DNA, 16 bp, M. musculus
ccagtgtggtacacag

SEQ ID NO: 385871 - DNA, 16 bp, M. musculus
ccagtgtggtggctca

SEQ ID NO: 385872 - DNA, 16 bp, M. musculus
ccagtgttcttaacca

SEQ ID NO: 385873 - DNA, 16 bp, M. musculus
ccagtgttgcctcatt

SEQ ID NO: 385874 - DNA, 16 bp, M. musculus
ccagtgttttgttttg

SEQ ID NO: 385875 - DNA, 16 bp, M. musculus
ccagttaggggaaagg

SEQ ID NO: 385876 - DNA, 16 bp, M. musculus
ccagttccagaagatc

SEQ ID NO: 385877 - DNA, 16 bp, M. musculus
ccagttccagccagag

SEQ ID NO: 385878 - DNA, 16 bp, M. musculus
ccagttccaggagact

SEQ ID NO: 385879 - DNA, 16 bp, M. musculus
ccagttccaggagatt

SEQ ID NO: 385880 - DNA, 16 bp, M. musculus
ccagttccaggggatc

SEQ ID NO: 385881 - DNA, 16 bp, M. musculus
ccagttccaggggatt

SEQ ID NO: 385882 - DNA, 16 bp, M. musculus
ccagttccaggggttc

SEQ ID NO: 385883 - DNA, 16 bp, M. musculus
ccagttcccaggagct

SEQ ID NO: 385884 - DNA, 16 bp, M. musculus
ccagttcccagggatc

SEQ ID NO: 385885 - DNA, 16 bp, M. musculus
ccagttcccccagagc

SEQ ID NO: 385886 - DNA, 16 bp, M. musculus
ccagttcctctgcaag

SEQ ID NO: 385887 - DNA, 16 bp, M. musculus
ccagttcctgaataat

SEQ ID NO: 385888 - DNA, 16 bp, M. musculus
ccagttcctggccctg

SEQ ID NO: 385889 - DNA, 16 bp, M. musculus
ccagttctacctctct

SEQ ID NO: 385890 - DNA, 16 bp, M. musculus
ccagttctaggggatc

SEQ ID NO: 385891 - DNA, 16 bp, M. musculus
ccagttctctgaggaa

SEQ ID NO: 385892 - DNA, 16 bp, M. musculus
ccagttctctgtggct

SEQ ID NO: 385893 - DNA, 16 bp, M. musculus
ccagttctgggatttt

SEQ ID NO: 385894 - DNA, 16 bp, M. musculus
ccagttcttccaccac

SEQ ID NO: 385895 - DNA, 16 bp, M. musculus
ccagttcttctaccac

SEQ ID NO: 385896 - DNA, 16 bp, M. musculus
ccagttgagaactctg

SEQ ID NO: 385897 - DNA, 16 bp, M. musculus
ccagttgagccaacac

SEQ ID NO: 385898 - DNA, 16 bp, M. musculus
ccagttgcccctgtgg

SEQ ID NO: 385899 - DNA, 16 bp, M. musculus
ccagttggtggcgctg

SEQ ID NO: 385900 - DNA, 16 bp, M. musculus
ccagttgtcccagcac

SEQ ID NO: 385901 - DNA, 16 bp, M. musculus
ccagttgtccctcaac

SEQ ID NO: 385902 - DNA, 18 bp, M. musculus
ccagttgtgccagcacca

SEQ ID NO: 385903 - DNA, 16 bp, M. musculus
ccagtttcattcattt

SEQ ID NO: 385904 - DNA, 16 bp, M. musculus
ccagtttctggccatt

SEQ ID NO: 385905 - DNA, 16 bp, M. musculus
ccagtttctggctatg

SEQ ID NO: 385906 - DNA, 16 bp, M. musculus
ccagtttcttttttgg

SEQ ID NO: 385907 - DNA, 16 bp, M. musculus
ccagtttgcttttggt

SEQ ID NO: 385908 - DNA, 16 bp, M. musculus
ccagtttggccttgaa

SEQ ID NO: 385909 - DNA, 16 bp, M. musculus
ccagtttgtactccca

SEQ ID NO: 385910 - DNA, 16 bp, M. musculus
ccagttttcagaggaa

SEQ ID NO: 385911 - DNA, 16 bp, M. musculus
ccagttttttatttac

SEQ ID NO: 385912 - DNA, 16 bp, M. musculus
ccataaaataagtaaa

SEQ ID NO: 385913 - DNA, 16 bp, M. musculus
ccataaaattatttct

SEQ ID NO: 385914 - DNA, 16 bp, M. musculus
ccataaagaagaataa

SEQ ID NO: 385915 - DNA, 16 bp, M. musculus
ccataaagataaagag

SEQ ID NO: 385916 - DNA, 16 bp, M. musculus
ccataaatatgtacaa

SEQ ID NO: 385917 - DNA, 16 bp, M. musculus
ccataaccttcccaaa

SEQ ID NO: 385918 - DNA, 16 bp, M. musculus
ccataagggtagaaag

SEQ ID NO: 385919 - DNA, 16 bp, M. musculus
ccataatatctcttaa

SEQ ID NO: 385920 - DNA, 16 bp, M. musculus
ccataattgttcctat

SEQ ID NO: 385921 - DNA, 16 bp, M. musculus
ccatacaattattttt

SEQ ID NO: 385922 - DNA, 16 bp, M. musculus
ccatacaccagactaa

SEQ ID NO: 385923 - DNA, 16 bp, M. musculus
ccatacatatatatat

SEQ ID NO: 385924 - DNA, 16 bp, M. musculus
ccatacattttatatt

SEQ ID NO: 385925 - DNA, 16 bp, M. musculus
ccatactcatctcctt

SEQ ID NO: 385926 - DNA, 18 bp, M. musculus
ccatactggagagaaacc

SEQ ID NO: 385927 - DNA, 16 bp, M. musculus
ccatactgtgagaaag

SEQ ID NO: 385928 - DNA, 16 bp, M. musculus
ccatacttcctctttg

SEQ ID NO: 385929 - DNA, 17 bp, M. musculus
ccatacttgggggctaa

SEQ ID NO: 385930 - DNA, 16 bp, M. musculus
ccatactttctgctgg

SEQ ID NO: 385931 - DNA, 16 bp, M. musculus
ccatactttggttttc

SEQ ID NO: 385932 - DNA, 16 bp, M. musculus
ccatagaaaacattga

SEQ ID NO: 385933 - DNA, 16 bp, M. musculus
ccatagactcctggga

SEQ ID NO: 385934 - DNA, 16 bp, M. musculus
ccatagagaacatgga

SEQ ID NO: 385935 - DNA, 16 bp, M. musculus
ccataggtgtgtgggt

SEQ ID NO: 385936 - DNA, 16 bp, M. musculus
ccatagtgacacacct

SEQ ID NO: 385937 - DNA, 16 bp, M. musculus
ccatagtttcccctcc

SEQ ID NO: 385938 - DNA, 16 bp, M. musculus
ccatatacagacatca

SEQ ID NO: 385939 - DNA, 16 bp, M. musculus
ccatatatatatatat

SEQ ID NO: 385940 - DNA, 16 bp, M. musculus
ccatatatatgtatat

SEQ ID NO: 385941 - DNA, 16 bp, M. musculus
ccatatcccttaaaga

SEQ ID NO: 385942 - DNA, 16 bp, M. musculus
ccatatctccagccct

SEQ ID NO: 385943 - DNA, 16 bp, M. musculus
ccatatctccagctcc

SEQ ID NO: 385944 - DNA, 16 bp, M. musculus
ccatatgacccagcta

SEQ ID NO: 385945 - DNA, 16 bp, M. musculus
ccatatgatggctcac

SEQ ID NO: 385946 - DNA, 16 bp, M. musculus
ccatattcattgctgc

SEQ ID NO: 385947 - DNA, 16 bp, M. musculus
ccatatttcctctttg

SEQ ID NO: 385948 - DNA, 16 bp, M. musculus
ccatcaaaatcccaat

SEQ ID NO: 385949 - DNA, 16 bp, M. musculus
ccatcaaaatgccaac

SEQ ID NO: 385950 - DNA, 16 bp, M. musculus
ccatcaaacacagaca

SEQ ID NO: 385951 - DNA, 16 bp, M. musculus
ccatcaactgtggaga

SEQ ID NO: 385952 - DNA, 16 bp, M. musculus
ccatcaagagactgcc

SEQ ID NO: 385953 - DNA, 16 bp, M. musculus
ccatcaagcagctgaa

SEQ ID NO: 385954 - DNA, 16 bp, M. musculus
ccatcaagttctggag

SEQ ID NO: 385955 - DNA, 16 bp, M. musculus
ccatcaatgtaaacca

SEQ ID NO: 385956 - DNA, 16 bp, M. musculus
ccatcacacctgaaaa

SEQ ID NO: 385957 - DNA, 16 bp, M. musculus
ccatcacagcagggaa

SEQ ID NO: 385958 - DNA, 16 bp, M. musculus
ccatcaccaaggaaga

SEQ ID NO: 385959 - DNA, 16 bp, M. musculus
ccatcaccaaggcaac

SEQ ID NO: 385960 - DNA, 16 bp, M. musculus
ccatcaccacccagct

SEQ ID NO: 385961 - DNA, 16 bp, M. musculus
ccatcacctctttgga

SEQ ID NO: 385962 - DNA, 16 bp, M. musculus
ccatcaccttcagtaa

SEQ ID NO: 385963 - DNA, 16 bp, M. musculus
ccatcactaaggaaga

SEQ ID NO: 385964 - DNA, 16 bp, M. musculus
ccatcactcaggaggc

SEQ ID NO: 385965 - DNA, 16 bp, M. musculus
ccatcactccagccct

SEQ ID NO: 385966 - DNA, 16 bp, M. musculus
ccatcactgaaaagag

SEQ ID NO: 385967 - DNA, 16 bp, M. musculus
ccatcactgcccagct

SEQ ID NO: 385968 - DNA, 16 bp, M. musculus
ccatcactgcctggct

SEQ ID NO: 385969 - DNA, 16 bp, M. musculus
ccatcactggcaagag

SEQ ID NO: 385970 - DNA, 16 bp, M. musculus
ccatcagagatctgag

SEQ ID NO: 385971 - DNA, 16 bp, M. musculus
ccatcagcaaaatctt

SEQ ID NO: 385972 - DNA, 16 bp, M. musculus
ccatcagcaccatcag

SEQ ID NO: 385973 - DNA, 16 bp, M. musculus
ccatcagcccagatga

SEQ ID NO: 385974 - DNA, 16 bp, M. musculus
ccatcagcccagttgt

SEQ ID NO: 385975 - DNA, 16 bp, M. musculus
ccatcagctgcaggag

SEQ ID NO: 385976 - DNA, 16 bp, M. musculus
ccatcagctggggacc

SEQ ID NO: 385977 - DNA, 16 bp, M. musculus
ccatcaggaaaatgca

SEQ ID NO: 385978 - DNA, 16 bp, M. musculus
ccatcagtaaaccagg

SEQ ID NO: 385979 - DNA, 16 bp, M. musculus
ccatcataaaattatt

SEQ ID NO: 385980 - DNA, 16 bp, M. musculus
ccatcataccagaaaa

SEQ ID NO: 385981 - DNA, 16 bp, M. musculus
ccatcatcaagggaag

SEQ ID NO: 385982 - DNA, 16 bp, M. musculus
ccatcatcaccaccat

SEQ ID NO: 385983 - DNA, 16 bp, M. musculus
ccatcatcactatcat

SEQ ID NO: 385984 - DNA, 29 bp, M. musculus
ccatcatcagaacccagcactcccacttt

SEQ ID NO: 385985 - DNA, 16 bp, M. musculus
ccatcatcatcatctc

SEQ ID NO: 385986 - DNA, 16 bp, M. musculus
ccatcatcctggccag

SEQ ID NO: 385987 - DNA, 16 bp, M. musculus
ccatcatctatctacc

SEQ ID NO: 385988 - DNA, 16 bp, M. musculus
ccatcatgcccttcct

SEQ ID NO: 385989 - DNA, 16 bp, M. musculus
ccatcatggaaatgca

SEQ ID NO: 385990 - DNA, 16 bp, M. musculus
ccatcatggtggagaa

SEQ ID NO: 385991 - DNA, 16 bp, M. musculus
ccatcatggtgggaaa

SEQ ID NO: 385992 - DNA, 16 bp, M. musculus
ccatcatggtggggag

SEQ ID NO: 385993 - DNA, 16 bp, M. musculus
ccatcatgtgcttgct

SEQ ID NO: 385994 - DNA, 16 bp, M. musculus
ccatcattatcaagta

SEQ ID NO: 385995 - DNA, 16 bp, M. musculus
ccatcattcagacaaa

SEQ ID NO: 385996 - DNA, 16 bp, M. musculus
ccatcattgttggcaa

SEQ ID NO: 385997 - DNA, 16 bp, M. musculus
ccatccaagagatgac

SEQ ID NO: 385998 - DNA, 16 bp, M. musculus
ccatccacagcacaca

SEQ ID NO: 385999 - DNA, 16 bp, M. musculus
ccatccacccatcatc

SEQ ID NO: 386000 - DNA, 16 bp, M. musculus
ccatccactggagcac

SEQ ID NO: 386001 - DNA, 16 bp, M. musculus
ccatccagagaatgcc

SEQ ID NO: 386002 - DNA, 16 bp, M. musculus
ccatccagagactaca

SEQ ID NO: 386003 - DNA, 16 bp, M. musculus
ccatccagagactgcc

SEQ ID NO: 386004 - DNA, 16 bp, M. musculus
ccatccagagactggg

SEQ ID NO: 386005 - DNA, 16 bp, M. musculus
ccatccagagattacc

SEQ ID NO: 386006 - DNA, 16 bp, M. musculus
ccatccagagtctgcc

SEQ ID NO: 386007 - DNA, 17 bp, M. musculus
ccatccagcaggtccag

SEQ ID NO: 386008 - DNA, 16 bp, M. musculus
ccatccaggcagtgtc

SEQ ID NO: 386009 - DNA, 16 bp, M. musculus
ccatccagtttgacca

SEQ ID NO: 386010 - DNA, 16 bp, M. musculus
ccatccatcacccatc

SEQ ID NO: 386011 - DNA, 16 bp, M. musculus
ccatccatccaaccaa

SEQ ID NO: 386012 - DNA, 16 bp, M. musculus
ccatccatccataaat

SEQ ID NO: 386013 - DNA, 16 bp, M. musculus
ccatccatccatccag

SEQ ID NO: 386014 - DNA, 16 bp, M. musculus
ccatccatccatcctt

SEQ ID NO: 386015 - DNA, 16 bp, M. musculus
ccatccatccccagct

SEQ ID NO: 386016 - DNA, 16 bp, M. musculus
ccatccatcccttcat

SEQ ID NO: 386017 - DNA, 16 bp, M. musculus
ccatccatctgcctgc

SEQ ID NO: 386018 - DNA, 16 bp, M. musculus
ccatccatgacctcaa

SEQ ID NO: 386019 - DNA, 16 bp, M. musculus
ccatccatgcatccat

SEQ ID NO: 386020 - DNA, 16 bp, M. musculus
ccatccattcatttat

SEQ ID NO: 386021 - DNA, 16 bp, M. musculus
ccatccatttatttat

SEQ ID NO: 386022 - DNA, 16 bp, M. musculus
ccatccatttgcatgc

SEQ ID NO: 386023 - DNA, 16 bp, M. musculus
ccatcccagagatggc

SEQ ID NO: 386024 - DNA, 16 bp, M. musculus
ccatcccatatacaga

SEQ ID NO: 386025 - DNA, 16 bp, M. musculus
ccatcccatgggtggg

SEQ ID NO: 386026 - DNA, 16 bp, M. musculus
ccatccccaacaagat

SEQ ID NO: 386027 - DNA, 16 bp, M. musculus
ccatccccacagttac

SEQ ID NO: 386028 - DNA, 16 bp, M. musculus
ccatccccagcaccat

SEQ ID NO: 386029 - DNA, 16 bp, M. musculus
ccatccccagcaccca

SEQ ID NO: 386030 - DNA, 16 bp, M. musculus
ccatcccccagggcac

SEQ ID NO: 386031 - DNA, 16 bp, M. musculus
ccatccccctgcctca

SEQ ID NO: 386032 - DNA, 16 bp, M. musculus
ccatccctacatccct

SEQ ID NO: 386033 - DNA, 16 bp, M. musculus
ccatccctatctcctt

SEQ ID NO: 386034 - DNA, 16 bp, M. musculus
ccatccctcatttgat

SEQ ID NO: 386035 - DNA, 17 bp, M. musculus
ccatccctccatggcct

SEQ ID NO: 386036 - DNA, 16 bp, M. musculus
ccatccctcctcttga

SEQ ID NO: 386037 - DNA, 16 bp, M. musculus
ccatccgtctgtccgt

SEQ ID NO: 386038 - DNA, 16 bp, M. musculus
ccatcctagaggacct

SEQ ID NO: 386039 - DNA, 16 bp, M. musculus
ccatcctatagatgac

SEQ ID NO: 386040 - DNA, 16 bp, M. musculus
ccatcctcagcaccca

SEQ ID NO: 386041 - DNA, 16 bp, M. musculus
ccatcctcagctgcat

SEQ ID NO: 386042 - DNA, 16 bp, M. musculus
ccatcctcctgtctcc

SEQ ID NO: 386043 - DNA, 16 bp, M. musculus
ccatcctctgccatat

SEQ ID NO: 386044 - DNA, 16 bp, M. musculus
ccatcctctgctccat

SEQ ID NO: 386045 - DNA, 16 bp, M. musculus
ccatcctgcagggaag

SEQ ID NO: 386046 - DNA, 16 bp, M. musculus
ccatcctgctcagccc

SEQ ID NO: 386047 - DNA, 16 bp, M. musculus
ccatcctggtctacag

SEQ ID NO: 386048 - DNA, 16 bp, M. musculus
ccatcctgtggaagaa

SEQ ID NO: 386049 - DNA, 16 bp, M. musculus
ccatccttaaggagat

SEQ ID NO: 386050 - DNA, 16 bp, M. musculus
ccatccttaccaagta

SEQ ID NO: 386051 - DNA, 16 bp, M. musculus
ccatccttatctcctt

SEQ ID NO: 386052 - DNA, 16 bp, M. musculus
ccatccttgttggctt

SEQ ID NO: 386053 - DNA, 16 bp, M. musculus
ccatcctttcctctta

SEQ ID NO: 386054 - DNA, 16 bp, M. musculus
ccatcctttctgctgg

SEQ ID NO: 386055 - DNA, 16 bp, M. musculus
ccatctacagacacca

SEQ ID NO: 386056 - DNA, 16 bp, M. musculus
ccatctaccccagtct

SEQ ID NO: 386057 - DNA, 16 bp, M. musculus
ccatctataatggaat

SEQ ID NO: 386058 - DNA, 16 bp, M. musculus
ccatctatcatctatc

SEQ ID NO: 386059 - DNA, 16 bp, M. musculus
ccatctatctatctat

SEQ ID NO: 386060 - DNA, 16 bp, M. musculus
ccatctatctttctct

SEQ ID NO: 386061 - DNA, 16 bp, M. musculus
ccatctattggacaga

SEQ ID NO: 386062 - DNA, 16 bp, M. musculus
ccatctcaaaagcaaa

SEQ ID NO: 386063 - DNA, 16 bp, M. musculus
ccatctcacagtcaaa

SEQ ID NO: 386064 - DNA, 18 bp, M. musculus
ccatctcaccagcccccc

SEQ ID NO: 386065 - DNA, 16 bp, M. musculus
ccatctcaccagccct

SEQ ID NO: 386066 - DNA, 17 bp, M. musculus
ccatctcaccagcccta

SEQ ID NO: 386067 - DNA, 16 bp, M. musculus
ccatctcaccagcctt

SEQ ID NO: 386068 - DNA, 16 bp, M. musculus
ccatctcaccagctct

SEQ ID NO: 386069 - DNA, 16 bp, M. musculus
ccatctcacctgccct

SEQ ID NO: 386070 - DNA, 16 bp, M. musculus
ccatctcactggcccc

SEQ ID NO: 386071 - DNA, 16 bp, M. musculus
ccatctcactggccta

SEQ ID NO: 386072 - DNA, 16 bp, M. musculus
ccatctcagggaaaag

SEQ ID NO: 386073 - DNA, 16 bp, M. musculus
ccatctcatatacaat

SEQ ID NO: 386074 - DNA, 16 bp, M. musculus
ccatctccaaaaggat

SEQ ID NO: 386075 - DNA, 16 bp, M. musculus
ccatctccacagctgc

SEQ ID NO: 386076 - DNA, 16 bp, M. musculus
ccatctccacctgggt

SEQ ID NO: 386077 - DNA, 16 bp, M. musculus
ccatctccagcaccat

SEQ ID NO: 386078 - DNA, 16 bp, M. musculus
ccatctccagtggatc

SEQ ID NO: 386079 - DNA, 16 bp, M. musculus
ccatctcccagcccct

SEQ ID NO: 386080 - DNA, 16 bp, M. musculus
ccatctccccagcact

SEQ ID NO: 386081 - DNA, 16 bp, M. musculus
ccatctccccagcctg

SEQ ID NO: 386082 - DNA, 16 bp, M. musculus
ccatctccccagcttt

SEQ ID NO: 386083 - DNA, 16 bp, M. musculus
ccatctccctagctct

SEQ ID NO: 386084 - DNA, 16 bp, M. musculus
ccatctccctgcttct

SEQ ID NO: 386085 - DNA, 16 bp, M. musculus
ccatctccctggccct

SEQ ID NO: 386086 - DNA, 16 bp, M. musculus
ccatctcctcagcctc

SEQ ID NO: 386087 - DNA, 16 bp, M. musculus
ccatctccttagaact

SEQ ID NO: 386088 - DNA, 16 bp, M. musculus
ccatctcgccagcctg

SEQ ID NO: 386089 - DNA, 16 bp, M. musculus
ccatctcgctggccct

SEQ ID NO: 386090 - DNA, 16 bp, M. musculus
ccatctctacagccca

SEQ ID NO: 386091 - DNA, 16 bp, M. musculus
ccatctctacctccca

SEQ ID NO: 386092 - DNA, 16 bp, M. musculus
ccatctctatctctat

SEQ ID NO: 386093 - DNA, 16 bp, M. musculus
ccatctctccaactct

SEQ ID NO: 386094 - DNA, 16 bp, M. musculus
ccatctctccaagccc

SEQ ID NO: 386095 - DNA, 16 bp, M. musculus
ccatctctccagaccc

SEQ ID NO: 386096 - DNA, 16 bp, M. musculus
ccatctctccagcaac

SEQ ID NO: 386097 - DNA, 16 bp, M. musculus
ccatctctccagccct

SEQ ID NO: 386098 - DNA, 16 bp, M. musculus
ccatctctccagctcg

SEQ ID NO: 386099 - DNA, 16 bp, M. musculus
ccatctctccagctgg

SEQ ID NO: 386100 - DNA, 16 bp, M. musculus
ccatctctccagcttt

SEQ ID NO: 386101 - DNA, 16 bp, M. musculus
ccatctctctagccca

SEQ ID NO: 386102 - DNA, 16 bp, M. musculus
ccatctctctagtctg

SEQ ID NO: 386103 - DNA, 16 bp, M. musculus
ccatctctctagtgcc

SEQ ID NO: 386104 - DNA, 16 bp, M. musculus
ccatctctgacctcaa

SEQ ID NO: 386105 - DNA, 16 bp, M. musculus
ccatctctgcagcctc

SEQ ID NO: 386106 - DNA, 16 bp, M. musculus
ccatctctgcatccct

SEQ ID NO: 386107 - DNA, 16 bp, M. musculus
ccatctctgctcatca

SEQ ID NO: 386108 - DNA, 16 bp, M. musculus
ccatctctgtctccct

SEQ ID NO: 386109 - DNA, 16 bp, M. musculus
ccatctctgtgctggt

SEQ ID NO: 386110 - DNA, 16 bp, M. musculus
ccatctctgtgtttct

SEQ ID NO: 386111 - DNA, 16 bp, M. musculus
ccatctcttcagccta

SEQ ID NO: 386112 - DNA, 16 bp, M. musculus
ccatctcttctgcccc

SEQ ID NO: 386113 - DNA, 16 bp, M. musculus
ccatctcttctgtcct

SEQ ID NO: 386114 - DNA, 16 bp, M. musculus
ccatctcttgtcacca

SEQ ID NO: 386115 - DNA, 16 bp, M. musculus
ccatctgattcccttt

SEQ ID NO: 386116 - DNA, 16 bp, M. musculus
ccatctgattttcttt

SEQ ID NO: 386117 - DNA, 16 bp, M. musculus
ccatctgcaattccag

SEQ ID NO: 386118 - DNA, 16 bp, M. musculus
ccatctgcacctggag

SEQ ID NO: 386119 - DNA, 16 bp, M. musculus
ccatctgcagacacta

SEQ ID NO: 386120 - DNA, 16 bp, M. musculus
ccatctgcctctgcca

SEQ ID NO: 386121 - DNA, 16 bp, M. musculus
ccatctggagatccat

SEQ ID NO: 386122 - DNA, 16 bp, M. musculus
ccatctggccagccct

SEQ ID NO: 386123 - DNA, 16 bp, M. musculus
ccatctgggaagaaga

SEQ ID NO: 386124 - DNA, 16 bp, M. musculus
ccatctgggcagctct

SEQ ID NO: 386125 - DNA, 16 bp, M. musculus
ccatctgggtctgata

SEQ ID NO: 386126 - DNA, 16 bp, M. musculus
ccatctgggtgactct

SEQ ID NO: 386127 - DNA, 16 bp, M. musculus
ccatctgggttctggg

SEQ ID NO: 386128 - DNA, 16 bp, M. musculus
ccatctggtcttgggc

SEQ ID NO: 386129 - DNA, 16 bp, M. musculus
ccatctggtgatctct

SEQ ID NO: 386130 - DNA, 16 bp, M. musculus
ccatctggtggctcac

SEQ ID NO: 386131 - DNA, 16 bp, M. musculus
ccatctggttatctct

SEQ ID NO: 386132 - DNA, 16 bp, M. musculus
ccatctgtaaatccag

SEQ ID NO: 386133 - DNA, 16 bp, M. musculus
ccatctgtaatgaaat

SEQ ID NO: 386134 - DNA, 16 bp, M. musculus
ccatctgtaatgagaa

SEQ ID NO: 386135 - DNA, 18 bp, M. musculus
ccatctgtaatggaatcc

SEQ ID NO: 386136 - DNA, 16 bp, M. musculus
ccatctgtaatgggaa

SEQ ID NO: 386137 - DNA, 16 bp, M. musculus
ccatctgtaatggggt

SEQ ID NO: 386138 - DNA, 16 bp, M. musculus
ccatctgtaattggat

SEQ ID NO: 386139 - DNA, 16 bp, M. musculus
ccatctgtctgtccac

SEQ ID NO: 386140 - DNA, 16 bp, M. musculus
ccatctgtttctgcct

SEQ ID NO: 386141 - DNA, 16 bp, M. musculus
ccatcttaaaaacaaa

SEQ ID NO: 386142 - DNA, 16 bp, M. musculus
ccatcttcatcatcat

SEQ ID NO: 386143 - DNA, 16 bp, M. musculus
ccatcttcccagctcc

SEQ ID NO: 386144 - DNA, 16 bp, M. musculus
ccatcttcccagtcct

SEQ ID NO: 386145 - DNA, 16 bp, M. musculus
ccatcttcctgaggaa

SEQ ID NO: 386146 - DNA, 16 bp, M. musculus
ccatcttcctgtctct

SEQ ID NO: 386147 - DNA, 16 bp, M. musculus
ccatcttctcagcacc

SEQ ID NO: 386148 - DNA, 16 bp, M. musculus
ccatcttctcagccct

SEQ ID NO: 386149 - DNA, 16 bp, M. musculus
ccatcttctgaagtct

SEQ ID NO: 386150 - DNA, 16 bp, M. musculus
ccatcttctgagttct

SEQ ID NO: 386151 - DNA, 16 bp, M. musculus
ccatcttctggcttcc

SEQ ID NO: 386152 - DNA, 16 bp, M. musculus
ccatcttctgggatct

SEQ ID NO: 386153 - DNA, 16 bp, M. musculus
ccatcttgaaaaacca

SEQ ID NO: 386154 - DNA, 16 bp, M. musculus
ccatcttgatgtaaaa

SEQ ID NO: 386155 - DNA, 16 bp, M. musculus
ccatcttgatgtaatt

SEQ ID NO: 386156 - DNA, 16 bp, M. musculus
ccatcttgccagcccc

SEQ ID NO: 386157 - DNA, 16 bp, M. musculus
ccatcttgcctgccct

SEQ ID NO: 386158 - DNA, 16 bp, M. musculus
ccatcttgctgaccct

SEQ ID NO: 386159 - DNA, 16 bp, M. musculus
ccatcttggctgctct

SEQ ID NO: 386160 - DNA, 16 bp, M. musculus
ccatcttgtaatggcg

SEQ ID NO: 386161 - DNA, 17 bp, M. musculus
ccatctttggcatcata

SEQ ID NO: 386162 - DNA, 17 bp, M. musculus
ccatcttttttgctggt

SEQ ID NO: 386163 - DNA, 16 bp, M. musculus
ccatgaagaaaataaa

SEQ ID NO: 386164 - DNA, 16 bp, M. musculus
ccatgaagctggagtt

SEQ ID NO: 386165 - DNA, 16 bp, M. musculus
ccatgaaggaagtggt

SEQ ID NO: 386166 - DNA, 17 bp, M. musculus
ccatgaatcctggctat

SEQ ID NO: 386167 - DNA, 16 bp, M. musculus
ccatgacaaagccaaa

SEQ ID NO: 386168 - DNA, 16 bp, M. musculus
ccatgacacagagcaa

SEQ ID NO: 386169 - DNA, 16 bp, M. musculus
ccatgaccaaggacaa

SEQ ID NO: 386170 - DNA, 16 bp, M. musculus
ccatgaccaaggccac

SEQ ID NO: 386171 - DNA, 16 bp, M. musculus
ccatgaccaaggtaac

SEQ ID NO: 386172 - DNA, 16 bp, M. musculus
ccatgaccaatgcaag

SEQ ID NO: 386173 - DNA, 16 bp, M. musculus
ccatgaccataatgga

SEQ ID NO: 386174 - DNA, 16 bp, M. musculus
ccatgaccatggcaag

SEQ ID NO: 386175 - DNA, 16 bp, M. musculus
ccatgactaaaagcaa

SEQ ID NO: 386176 - DNA, 16 bp, M. musculus
ccatgactccagccac

SEQ ID NO: 386177 - DNA, 16 bp, M. musculus
ccatgacttctgcatc

SEQ ID NO: 386178 - DNA, 16 bp, M. musculus
ccatgagaagaccaaa

SEQ ID NO: 386179 - DNA, 16 bp, M. musculus
ccatgagcagaggatg

SEQ ID NO: 386180 - DNA, 16 bp, M. musculus
ccatgagcatccactt

SEQ ID NO: 386181 - DNA, 16 bp, M. musculus
ccatgagcctctcctg

SEQ ID NO: 386182 - DNA, 16 bp, M. musculus
ccatgagcctgggaga

SEQ ID NO: 386183 - DNA, 16 bp, M. musculus
ccatgataaaaccaaa

SEQ ID NO: 386184 - DNA, 16 bp, M. musculus
ccatgatctatccatt

SEQ ID NO: 386185 - DNA, 16 bp, M. musculus
ccatgatgaaaatgaa

SEQ ID NO: 386186 - DNA, 16 bp, M. musculus
ccatgatgataatgga

SEQ ID NO: 386187 - DNA, 16 bp, M. musculus
ccatgatgatagtgaa

SEQ ID NO: 386188 - DNA, 16 bp, M. musculus
ccatgatgcttctgat

SEQ ID NO: 386189 - DNA, 16 bp, M. musculus
ccatgatggactgtac

SEQ ID NO: 386190 - DNA, 16 bp, M. musculus
ccatgatgttctgcct

SEQ ID NO: 386191 - DNA, 16 bp, M. musculus
ccatgattctcaccat

SEQ ID NO: 386192 - DNA, 16 bp, M. musculus
ccatgcaaatcccctt

SEQ ID NO: 386193 - DNA, 16 bp, M. musculus
ccatgcagtggtggca

SEQ ID NO: 386194 - DNA, 23 bp, M. musculus
ccatgcagtttttatcacaattg

SEQ ID NO: 386195 - DNA, 16 bp, M. musculus
ccatgcattctatcag

SEQ ID NO: 386196 - DNA, 16 bp, M. musculus
ccatgccacctcacca

SEQ ID NO: 386197 - DNA, 17 bp, M. musculus
ccatgccagacctaaag

SEQ ID NO: 386198 - DNA, 16 bp, M. musculus
ccatgccaggaaagga

SEQ ID NO: 386199 - DNA, 16 bp, M. musculus
ccatgccaggctcctg

SEQ ID NO: 386200 - DNA, 16 bp, M. musculus
ccatgccaggtggctc

SEQ ID NO: 386201 - DNA, 16 bp, M. musculus
ccatgccatgtccaga

SEQ ID NO: 386202 - DNA, 16 bp, M. musculus
ccatgcccaacttttt

SEQ ID NO: 386203 - DNA, 16 bp, M. musculus
ccatgcccagcagcag

SEQ ID NO: 386204 - DNA, 16 bp, M. musculus
ccatgcccagcttttt

SEQ ID NO: 386205 - DNA, 16 bp, M. musculus
ccatgccctgctggct

SEQ ID NO: 386206 - DNA, 16 bp, M. musculus
ccatgcctacctggat

SEQ ID NO: 386207 - DNA, 16 bp, M. musculus
ccatgcctcaattttt

SEQ ID NO: 386208 - DNA, 16 bp, M. musculus
ccatgcctcagtttcc

SEQ ID NO: 386209 - DNA, 16 bp, M. musculus
ccatgcctgactggat

SEQ ID NO: 386210 - DNA, 16 bp, M. musculus
ccatgcctgcctgctg

SEQ ID NO: 386211 - DNA, 16 bp, M. musculus
ccatgcctgcctggat

SEQ ID NO: 386212 - DNA, 16 bp, M. musculus
ccatgcctgctgcttg

SEQ ID NO: 386213 - DNA, 16 bp, M. musculus
ccatgcctggctccta

SEQ ID NO: 386214 - DNA, 16 bp, M. musculus
ccatgcctggctcctt

SEQ ID NO: 386215 - DNA, 16 bp, M. musculus
ccatgcctggctctgg

SEQ ID NO: 386216 - DNA, 16 bp, M. musculus
ccatgcctggctgtgt

SEQ ID NO: 386217 - DNA, 16 bp, M. musculus
ccatgcctggcttcag

SEQ ID NO: 386218 - DNA, 16 bp, M. musculus
ccatgcctggcttctt

SEQ ID NO: 386219 - DNA, 16 bp, M. musculus
ccatgccttccctacc

SEQ ID NO: 386220 - DNA, 16 bp, M. musculus
ccatgccttccctgct

SEQ ID NO: 386221 - DNA, 16 bp, M. musculus
ccatgctcatggactg

SEQ ID NO: 386222 - DNA, 16 bp, M. musculus
ccatgctcccaccctg

SEQ ID NO: 386223 - DNA, 16 bp, M. musculus
ccatgctcctaccttg

SEQ ID NO: 386224 - DNA, 16 bp, M. musculus
ccatgctctctctctc

SEQ ID NO: 386225 - DNA, 16 bp, M. musculus
ccatgctcttgccttg

SEQ ID NO: 386226 - DNA, 16 bp, M. musculus
ccatgctgagacatcc

SEQ ID NO: 386227 - DNA, 16 bp, M. musculus
ccatgctggccttgaa

SEQ ID NO: 386228 - DNA, 16 bp, M. musculus
ccatgctggcttcaaa

SEQ ID NO: 386229 - DNA, 16 bp, M. musculus
ccatgctgggcagctc

SEQ ID NO: 386230 - DNA, 16 bp, M. musculus
ccatgcttcccaccag

SEQ ID NO: 386231 - DNA, 16 bp, M. musculus
ccatgcttcctgccac

SEQ ID NO: 386232 - DNA, 16 bp, M. musculus
ccatgcttcctgccct

SEQ ID NO: 386233 - DNA, 16 bp, M. musculus
ccatgcttgcctgcct

SEQ ID NO: 386234 - DNA, 16 bp, M. musculus
ccatgctttaaaaaaa

SEQ ID NO: 386235 - DNA, 16 bp, M. musculus
ccatgcttttgtctca

SEQ ID NO: 386236 - DNA, 16 bp, M. musculus
ccatggaaaaagtaaa

SEQ ID NO: 386237 - DNA, 16 bp, M. musculus
ccatggaaacccccaa

SEQ ID NO: 386238 - DNA, 16 bp, M. musculus
ccatggaaaggtgctg

SEQ ID NO: 386239 - DNA, 16 bp, M. musculus
ccatggaaggagcaac

SEQ ID NO: 386240 - DNA, 16 bp, M. musculus
ccatggaaggagttag

SEQ ID NO: 386241 - DNA, 16 bp, M. musculus
ccatggaatggtgctg

SEQ ID NO: 386242 - DNA, 16 bp, M. musculus
ccatggacaggcaaca

SEQ ID NO: 386243 - DNA, 16 bp, M. musculus
ccatggacccaggtta

SEQ ID NO: 386244 - DNA, 16 bp, M. musculus
ccatggagagatgctg

SEQ ID NO: 386245 - DNA, 16 bp, M. musculus
ccatggagaggtgctg

SEQ ID NO: 386246 - DNA, 16 bp, M. musculus
ccatggagatgcagag

SEQ ID NO: 386247 - DNA, 17 bp, M. musculus
ccatggagatgcagagt

SEQ ID NO: 386248 - DNA, 16 bp, M. musculus
ccatggagccatctct

SEQ ID NO: 386249 - DNA, 16 bp, M. musculus
ccatggaggaaggctg

SEQ ID NO: 386250 - DNA, 16 bp, M. musculus
ccatggaggagtgctg

SEQ ID NO: 386251 - DNA, 16 bp, M. musculus
ccatggaggccagagg

SEQ ID NO: 386252 - DNA, 16 bp, M. musculus
ccatggagggatgttg

SEQ ID NO: 386253 - DNA, 16 bp, M. musculus
ccatggatggcaccac

SEQ ID NO: 386254 - DNA, 16 bp, M. musculus
ccatggcactggcatc

SEQ ID NO: 386255 - DNA, 16 bp, M. musculus
ccatggccaagaagag

SEQ ID NO: 386256 - DNA, 16 bp, M. musculus
ccatggccaagtggag

SEQ ID NO: 386257 - DNA, 16 bp, M. musculus
ccatggccatgtggag

SEQ ID NO: 386258 - DNA, 16 bp, M. musculus
ccatggcctctgcctc

SEQ ID NO: 386259 - DNA, 16 bp, M. musculus
ccatggcctgctcagc

SEQ ID NO: 386260 - DNA, 16 bp, M. musculus
ccatggcctttgtggt

SEQ ID NO: 386261 - DNA, 16 bp, M. musculus
ccatggctccagcagc

SEQ ID NO: 386262 - DNA, 16 bp, M. musculus
ccatggctcctgcttc

SEQ ID NO: 386263 - DNA, 16 bp, M. musculus
ccatggctgccctgga

SEQ ID NO: 386264 - DNA, 16 bp, M. musculus
ccatggctgtcctgga

SEQ ID NO: 386265 - DNA, 16 bp, M. musculus
ccatggctgttctgga

SEQ ID NO: 386266 - DNA, 16 bp, M. musculus
ccatggctgttttgtt

SEQ ID NO: 386267 - DNA, 16 bp, M. musculus
ccatggcttcttcctg

SEQ ID NO: 386268 - DNA, 16 bp, M. musculus
ccatggcttctttact

SEQ ID NO: 386269 - DNA, 16 bp, M. musculus
ccatgggatgggtctc

SEQ ID NO: 386270 - DNA, 16 bp, M. musculus
ccatgggcaagaacta

SEQ ID NO: 386271 - DNA, 16 bp, M. musculus
ccatgggcaagtacca

SEQ ID NO: 386272 - DNA, 16 bp, M. musculus
ccatgggcacacacac

SEQ ID NO: 386273 - DNA, 16 bp, M. musculus
ccatgggcaccaagca

SEQ ID NO: 386274 - DNA, 16 bp, M. musculus
ccatgggcacctgcat

SEQ ID NO: 386275 - DNA, 16 bp, M. musculus
ccatgggctgcagcca

SEQ ID NO: 386276 - DNA, 16 bp, M. musculus
ccatgggctggggtcc

SEQ ID NO: 386277 - DNA, 16 bp, M. musculus
ccatgggggttttgtt

SEQ ID NO: 386278 - DNA, 16 bp, M. musculus
ccatgggtattttatt

SEQ ID NO: 386279 - DNA, 16 bp, M. musculus
ccatgggtgtattgtt

SEQ ID NO: 386280 - DNA, 16 bp, M. musculus
ccatggtaacactgag

SEQ ID NO: 386281 - DNA, 16 bp, M. musculus
ccatggtcactgctgc

SEQ ID NO: 386282 - DNA, 16 bp, M. musculus
ccatggtctcaggtgg

SEQ ID NO: 386283 - DNA, 16 bp, M. musculus
ccatggtctctgctcc

SEQ ID NO: 386284 - DNA, 16 bp, M. musculus
ccatggtggcttcctc

SEQ ID NO: 386285 - DNA, 16 bp, M. musculus
ccatggttcctgccat

SEQ ID NO: 386286 - DNA, 16 bp, M. musculus
ccatggtttctgcttc

SEQ ID NO: 386287 - DNA, 16 bp, M. musculus
ccatgtaatttataag

SEQ ID NO: 386288 - DNA, 16 bp, M. musculus
ccatgtacttcttcct

SEQ ID NO: 386289 - DNA, 16 bp, M. musculus
ccatgtaggagctggg

SEQ ID NO: 386290 - DNA, 16 bp, M. musculus
ccatgtaggttctggg

SEQ ID NO: 386291 - DNA, 16 bp, M. musculus
ccatgtatgctttttg

SEQ ID NO: 386292 - DNA, 16 bp, M. musculus
ccatgtcaccagcccc

SEQ ID NO: 386293 - DNA, 16 bp, M. musculus
ccatgtccacagtgac

SEQ ID NO: 386294 - DNA, 16 bp, M. musculus
ccatgtccccagccct

SEQ ID NO: 386295 - DNA, 16 bp, M. musculus
ccatgtcctctgcatc

SEQ ID NO: 386296 - DNA, 16 bp, M. musculus
ccatgtctcagaaaaa

SEQ ID NO: 386297 - DNA, 16 bp, M. musculus
ccatgtctccagctct

SEQ ID NO: 386298 - DNA, 16 bp, M. musculus
ccatgtctgcctacat

SEQ ID NO: 386299 - DNA, 16 bp, M. musculus
ccatgtctgcttgcat

SEQ ID NO: 386300 - DNA, 16 bp, M. musculus
ccatgtctgtatttgt

SEQ ID NO: 386301 - DNA, 16 bp, M. musculus
ccatgtgactctggct

SEQ ID NO: 386302 - DNA, 16 bp, M. musculus
ccatgtgatccagctg

SEQ ID NO: 386303 - DNA, 16 bp, M. musculus
ccatgtgctccaggct

SEQ ID NO: 386304 - DNA, 16 bp, M. musculus
ccatgtgctctgcctt

SEQ ID NO: 386305 - DNA, 16 bp, M. musculus
ccatgtggagacaggg

SEQ ID NO: 386306 - DNA, 16 bp, M. musculus
ccatgtggagatgggg

SEQ ID NO: 386307 - DNA, 16 bp, M. musculus
ccatgtggagattgca

SEQ ID NO: 386308 - DNA, 16 bp, M. musculus
ccatgtggaggttctg

SEQ ID NO: 386309 - DNA, 16 bp, M. musculus
ccatgtggatgccccc

SEQ ID NO: 386310 - DNA, 16 bp, M. musculus
ccatgtggatgcccct

SEQ ID NO: 386311 - DNA, 16 bp, M. musculus
ccatgtggctctggct

SEQ ID NO: 386312 - DNA, 16 bp, M. musculus
ccatgtggctgctgag

SEQ ID NO: 386313 - DNA, 16 bp, M. musculus
ccatgtggctgctggg

SEQ ID NO: 386314 - DNA, 16 bp, M. musculus
ccatgtgggacagtct

SEQ ID NO: 386315 - DNA, 16 bp, M. musculus
ccatgtgggccctggg

SEQ ID NO: 386316 - DNA, 16 bp, M. musculus
ccatgtgggtcctggg

SEQ ID NO: 386317 - DNA, 16 bp, M. musculus
ccatgtggtgctggga

SEQ ID NO: 386318 - DNA, 16 bp, M. musculus
ccatgtggttctggga

SEQ ID NO: 386319 - DNA, 16 bp, M. musculus
ccatgtgtactctttg

SEQ ID NO: 386320 - DNA, 16 bp, M. musculus
ccatgtgtatgcagta

SEQ ID NO: 386321 - DNA, 16 bp, M. musculus
ccatgtgtcttgcctc

SEQ ID NO: 386322 - DNA, 16 bp, M. musculus
ccatgtgtggtggtgc

SEQ ID NO: 386323 - DNA, 16 bp, M. musculus
ccatgtgttccatcct

SEQ ID NO: 386324 - DNA, 18 bp, M. musculus
ccatgtgttctgcctttc

SEQ ID NO: 386325 - DNA, 16 bp, M. musculus
ccatgtgttttccttg

SEQ ID NO: 386326 - DNA, 16 bp, M. musculus
ccatgttagacagaat

SEQ ID NO: 386327 - DNA, 16 bp, M. musculus
ccatgttccaacatgg

SEQ ID NO: 386328 - DNA, 16 bp, M. musculus
ccatgttccccatcat

SEQ ID NO: 386329 - DNA, 16 bp, M. musculus
ccatgttctctgtgga

SEQ ID NO: 386330 - DNA, 16 bp, M. musculus
ccatgttgtggtgacc

SEQ ID NO: 386331 - DNA, 16 bp, M. musculus
ccatgtttgaaagtga

SEQ ID NO: 386332 - DNA, 16 bp, M. musculus
ccatgtttgtgatggg

SEQ ID NO: 386333 - DNA, 16 bp, M. musculus
ccatgtttttatggct

SEQ ID NO: 386334 - DNA, 16 bp, M. musculus
ccattaaaaatgtggt

SEQ ID NO: 386335 - DNA, 19 bp, M. musculus
ccattacaagatggcgctg

SEQ ID NO: 386336 - DNA, 16 bp, M. musculus
ccattacaagatggtg

SEQ ID NO: 386337 - DNA, 16 bp, M. musculus
ccattagcaatggagg

SEQ ID NO: 386338 - DNA, 16 bp, M. musculus
ccattagcagcctttg

SEQ ID NO: 386339 - DNA, 16 bp, M. musculus
ccattagttgaaaatg

SEQ ID NO: 386340 - DNA, 16 bp, M. musculus
ccattatcaaggcagg

SEQ ID NO: 386341 - DNA, 16 bp, M. musculus
ccattatcaccaaggc

SEQ ID NO: 386342 - DNA, 16 bp, M. musculus
ccattatcatcaaagt

SEQ ID NO: 386343 - DNA, 16 bp, M. musculus
ccattatcatggtggg

SEQ ID NO: 386344 - DNA, 16 bp, M. musculus
ccattatgaccaagta

SEQ ID NO: 386345 - DNA, 16 bp, M. musculus
ccattcacaaacactt

SEQ ID NO: 386346 - DNA, 16 bp, M. musculus
ccattcacagctacta

SEQ ID NO: 386347 - DNA, 16 bp, M. musculus
ccattcagagccttat

SEQ ID NO: 386348 - DNA, 16 bp, M. musculus
ccattcagtgtgtgtg

SEQ ID NO: 386349 - DNA, 16 bp, M. musculus
ccattcattttcctga

SEQ ID NO: 386350 - DNA, 16 bp, M. musculus
ccattccagactccct

SEQ ID NO: 386351 - DNA, 16 bp, M. musculus
ccattccagttgttgg

SEQ ID NO: 386352 - DNA, 16 bp, M. musculus
ccattcccagtcctgg

SEQ ID NO: 386353 - DNA, 16 bp, M. musculus
ccattccctgccccct

SEQ ID NO: 386354 - DNA, 16 bp, M. musculus
ccattcctctgttaag

SEQ ID NO: 386355 - DNA, 16 bp, M. musculus
ccattcctgacctaaa

SEQ ID NO: 386356 - DNA, 16 bp, M. musculus
ccattcctggtttccc

SEQ ID NO: 386357 - DNA, 16 bp, M. musculus
ccattccttcctggtg

SEQ ID NO: 386358 - DNA, 16 bp, M. musculus
ccattcctttaggtgt

SEQ ID NO: 386359 - DNA, 16 bp, M. musculus
ccattctaacatcaaa

SEQ ID NO: 386360 - DNA, 16 bp, M. musculus
ccattctcagcaccca

SEQ ID NO: 386361 - DNA, 16 bp, M. musculus
ccattctcagcattcc

SEQ ID NO: 386362 - DNA, 16 bp, M. musculus
ccattctcatttaaac

SEQ ID NO: 386363 - DNA, 16 bp, M. musculus
ccattctcattttttg

SEQ ID NO: 386364 - DNA, 16 bp, M. musculus
ccattctctactacat

SEQ ID NO: 386365 - DNA, 16 bp, M. musculus
ccattctgatggatgt

SEQ ID NO: 386366 - DNA, 16 bp, M. musculus
ccattctgattagtgt

SEQ ID NO: 386367 - DNA, 16 bp, M. musculus
ccattctgtaggctgt

SEQ ID NO: 386368 - DNA, 16 bp, M. musculus
ccattctgtttggtgt

SEQ ID NO: 386369 - DNA, 16 bp, M. musculus
ccattcttctgttgaa

SEQ ID NO: 386370 - DNA, 16 bp, M. musculus
ccattgaacagagcac

SEQ ID NO: 386371 - DNA, 16 bp, M. musculus
ccattgacttttttga

SEQ ID NO: 386372 - DNA, 16 bp, M. musculus
ccattgagccatctca

SEQ ID NO: 386373 - DNA, 16 bp, M. musculus
ccattgatgccagaga

SEQ ID NO: 386374 - DNA, 16 bp, M. musculus
ccattgatggcagata

SEQ ID NO: 386375 - DNA, 16 bp, M. musculus
ccattgctgagagtgg

SEQ ID NO: 386376 - DNA, 16 bp, M. musculus
ccattgctgatgggaa

SEQ ID NO: 386377 - DNA, 16 bp, M. musculus
ccattgctgttatgtt

SEQ ID NO: 386378 - DNA, 16 bp, M. musculus
ccattgcttttaatag

SEQ ID NO: 386379 - DNA, 16 bp, M. musculus
ccattggacaaagcac

SEQ ID NO: 386380 - DNA, 16 bp, M. musculus
ccattggatcccctgg

SEQ ID NO: 386381 - DNA, 16 bp, M. musculus
ccattgggtctgctgg

SEQ ID NO: 386382 - DNA, 16 bp, M. musculus
ccattggtcttccctc

SEQ ID NO: 386383 - DNA, 16 bp, M. musculus
ccattgtcatcatgac

SEQ ID NO: 386384 - DNA, 16 bp, M. musculus
ccattgtccttgcctc

SEQ ID NO: 386385 - DNA, 16 bp, M. musculus
ccattgtgcaaatgaa

SEQ ID NO: 386386 - DNA, 16 bp, M. musculus
ccattgtggaccctgt

SEQ ID NO: 386387 - DNA, 16 bp, M. musculus
ccattgtgggtgggac

SEQ ID NO: 386388 - DNA, 16 bp, M. musculus
ccattgtgtcctggga

SEQ ID NO: 386389 - DNA, 16 bp, M. musculus
ccattgtttttgttgg

SEQ ID NO: 386390 - DNA, 16 bp, M. musculus
ccatttaggactgagt

SEQ ID NO: 386391 - DNA, 16 bp, M. musculus
ccatttagggctgagt

SEQ ID NO: 386392 - DNA, 16 bp, M. musculus
ccatttattctcctgg

SEQ ID NO: 386393 - DNA, 16 bp, M. musculus
ccatttattgaatatg

SEQ ID NO: 386394 - DNA, 16 bp, M. musculus
ccatttcaaaaataaa

SEQ ID NO: 386395 - DNA, 16 bp, M. musculus
ccatttcactggccca

SEQ ID NO: 386396 - DNA, 16 bp, M. musculus
ccatttcatccaggat

SEQ ID NO: 386397 - DNA, 16 bp, M. musculus
ccatttcatttttgtt

SEQ ID NO: 386398 - DNA, 16 bp, M. musculus
ccatttcccttcagaa

SEQ ID NO: 386399 - DNA, 16 bp, M. musculus
ccatttctccagcccc

SEQ ID NO: 386400 - DNA, 16 bp, M. musculus
ccatttctccagtccc

SEQ ID NO: 386401 - DNA, 16 bp, M. musculus
ccatttctccatctct

SEQ ID NO: 386402 - DNA, 16 bp, M. musculus
ccatttctgcttcctg

SEQ ID NO: 386403 - DNA, 16 bp, M. musculus
ccatttctgtgtcttc

SEQ ID NO: 386404 - DNA, 16 bp, M. musculus
ccatttctgttctgtt

SEQ ID NO: 386405 - DNA, 16 bp, M. musculus
ccatttcttcagcccc

SEQ ID NO: 386406 - DNA, 16 bp, M. musculus
ccatttcttcagctcc

SEQ ID NO: 386407 - DNA, 16 bp, M. musculus
ccatttgatttataac

SEQ ID NO: 386408 - DNA, 16 bp, M. musculus
ccatttgcaaatgaaa

SEQ ID NO: 386409 - DNA, 16 bp, M. musculus
ccatttgcaactccag

SEQ ID NO: 386410 - DNA, 32 bp, M. musculus
ccatttgcttggaaaattgttttccagccttt

SEQ ID NO: 386411 - DNA, 16 bp, M. musculus
ccatttgtaaattctt

SEQ ID NO: 386412 - DNA, 16 bp, M. musculus
ccatttgtcagaagaa

SEQ ID NO: 386413 - DNA, 16 bp, M. musculus
ccatttgtcatttgtt

SEQ ID NO: 386414 - DNA, 16 bp, M. musculus
ccatttgtctatgaat

SEQ ID NO: 386415 - DNA, 16 bp, M. musculus
ccatttgtcttgcaaa

SEQ ID NO: 386416 - DNA, 16 bp, M. musculus
ccatttgttgaaactg

SEQ ID NO: 386417 - DNA, 16 bp, M. musculus
ccattttacagatgag

SEQ ID NO: 386418 - DNA, 16 bp, M. musculus
ccattttacagatggg

SEQ ID NO: 386419 - DNA, 16 bp, M. musculus
ccattttccacaatga

SEQ ID NO: 386420 - DNA, 16 bp, M. musculus
ccattttcctggccag

SEQ ID NO: 386421 - DNA, 16 bp, M. musculus
ccattttctccatctt

SEQ ID NO: 386422 - DNA, 16 bp, M. musculus
ccattttctgaaatct

SEQ ID NO: 386423 - DNA, 16 bp, M. musculus
ccattttcttcctgtg

SEQ ID NO: 386424 - DNA, 16 bp, M. musculus
ccattttcttgaaaaa

SEQ ID NO: 386425 - DNA, 16 bp, M. musculus
ccattttgtcctattg

SEQ ID NO: 386426 - DNA, 16 bp, M. musculus
ccatttttaaaattta

SEQ ID NO: 386427 - DNA, 16 bp, M. musculus
ccatttttaataaggt

SEQ ID NO: 386428 - DNA, 16 bp, M. musculus
ccatttttaatagggt

SEQ ID NO: 386429 - DNA, 16 bp, M. musculus
ccatttttacatcctg

SEQ ID NO: 386430 - DNA, 16 bp, M. musculus
ccatttttactttgtt

SEQ ID NO: 386431 - DNA, 16 bp, M. musculus
ccatttttaggtcctg

SEQ ID NO: 386432 - DNA, 16 bp, M. musculus
ccatttttgtcccttc

SEQ ID NO: 386433 - DNA, 16 bp, M. musculus
ccatttttgtggttat

SEQ ID NO: 386434 - DNA, 16 bp, M. musculus
ccattttttaaaaata

SEQ ID NO: 386435 - DNA, 16 bp, M. musculus
ccattttttcctattg

SEQ ID NO: 386436 - DNA, 16 bp, M. musculus
cccaaaaaattctacc

SEQ ID NO: 386437 - DNA, 16 bp, M. musculus
cccaaaaattctatca

SEQ ID NO: 386438 - DNA, 16 bp, M. musculus
cccaaaacagggtctg

SEQ ID NO: 386439 - DNA, 16 bp, M. musculus
cccaaaacttcagtaa

SEQ ID NO: 386440 - DNA, 16 bp, M. musculus
cccaaaacttccacca

SEQ ID NO: 386441 - DNA, 16 bp, M. musculus
cccaaaagcttggaca

SEQ ID NO: 386442 - DNA, 16 bp, M. musculus
cccaaaaggagtagaa

SEQ ID NO: 386443 - DNA, 16 bp, M. musculus
cccaaaagtacagaat

SEQ ID NO: 386444 - DNA, 16 bp, M. musculus
cccaaaagtacatgca

SEQ ID NO: 386445 - DNA, 16 bp, M. musculus
cccaaaagtcccccag

SEQ ID NO: 386446 - DNA, 16 bp, M. musculus
cccaaaagtccctcat

SEQ ID NO: 386447 - DNA, 16 bp, M. musculus
cccaaaatgaccaggg

SEQ ID NO: 386448 - DNA, 16 bp, M. musculus
cccaaaattgtcctct

SEQ ID NO: 386449 - DNA, 16 bp, M. musculus
cccaaacaccatggga

SEQ ID NO: 386450 - DNA, 16 bp, M. musculus
cccaaacacccagtgt

SEQ ID NO: 386451 - DNA, 16 bp, M. musculus
cccaaacagtgccatc

SEQ ID NO: 386452 - DNA, 16 bp, M. musculus
cccaaacagtgtcacc

SEQ ID NO: 386453 - DNA, 16 bp, M. musculus
cccaaacatcatgacc

SEQ ID NO: 386454 - DNA, 17 bp, M. musculus
cccaaacatttgggaca

SEQ ID NO: 386455 - DNA, 16 bp, M. musculus
cccaaaccactttgaa

SEQ ID NO: 386456 - DNA, 16 bp, M. musculus
cccaaaccagggccaa

SEQ ID NO: 386457 - DNA, 16 bp, M. musculus
cccaaacccggaaaat

SEQ ID NO: 386458 - DNA, 16 bp, M. musculus
cccaaactcacagaga

SEQ ID NO: 386459 - DNA, 16 bp, M. musculus
cccaaactcactatgt

SEQ ID NO: 386460 - DNA, 16 bp, M. musculus
cccaaactcagaaaga

SEQ ID NO: 386461 - DNA, 16 bp, M. musculus
cccaaagagaggcaac

SEQ ID NO: 386462 - DNA, 16 bp, M. musculus
cccaaagatttgttta

SEQ ID NO: 386463 - DNA, 16 bp, M. musculus
cccaaagcaaggcaac

SEQ ID NO: 386464 - DNA, 16 bp, M. musculus
cccaaagcaaggcagg

SEQ ID NO: 386465 - DNA, 16 bp, M. musculus
cccaaagccacacagc

SEQ ID NO: 386466 - DNA, 16 bp, M. musculus
cccaaagctaagaatg

SEQ ID NO: 386467 - DNA, 16 bp, M. musculus
cccaaagctccctggg

SEQ ID NO: 386468 - DNA, 16 bp, M. musculus
cccaaaggcaggcaac

SEQ ID NO: 386469 - DNA, 16 bp, M. musculus
cccaaaggggataaga

SEQ ID NO: 386470 - DNA, 16 bp, M. musculus
cccaaaggtgcccagg

SEQ ID NO: 386471 - DNA, 16 bp, M. musculus
cccaaagtcacacagc

SEQ ID NO: 386472 - DNA, 16 bp, M. musculus
cccaaagtggtatcca

SEQ ID NO: 386473 - DNA, 16 bp, M. musculus
cccaaagttttcaaaa

SEQ ID NO: 386474 - DNA, 16 bp, M. musculus
cccaaatacagtcacc

SEQ ID NO: 386475 - DNA, 16 bp, M. musculus
cccaaatgatgggatt

SEQ ID NO: 386476 - DNA, 16 bp, M. musculus
cccaaatggctgggca

SEQ ID NO: 386477 - DNA, 16 bp, M. musculus
cccaaatgtccatcaa

SEQ ID NO: 386478 - DNA, 16 bp, M. musculus
cccaaatgtgagctga

SEQ ID NO: 386479 - DNA, 16 bp, M. musculus
cccaaattaacattag

SEQ ID NO: 386480 - DNA, 16 bp, M. musculus
cccaaattgtcctctg

SEQ ID NO: 386481 - DNA, 16 bp, M. musculus
cccaacaaaattccaa

SEQ ID NO: 386482 - DNA, 16 bp, M. musculus
cccaacaagcagctga

SEQ ID NO: 386483 - DNA, 16 bp, M. musculus
cccaacaatgaaaaca

SEQ ID NO: 386484 - DNA, 16 bp, M. musculus
cccaacaatggtcagc

SEQ ID NO: 386485 - DNA, 16 bp, M. musculus
cccaacaccctcttct

SEQ ID NO: 386486 - DNA, 16 bp, M. musculus
cccaacaccttcttct

SEQ ID NO: 386487 - DNA, 16 bp, M. musculus
cccaacactggagagg

SEQ ID NO: 386488 - DNA, 16 bp, M. musculus
cccaacactgggagta

SEQ ID NO: 386489 - DNA, 16 bp, M. musculus
cccaacacttggtagg

SEQ ID NO: 386490 - DNA, 16 bp, M. musculus
cccaacagattgggaa

SEQ ID NO: 386491 - DNA, 16 bp, M. musculus
cccaacagcacttcct

SEQ ID NO: 386492 - DNA, 16 bp, M. musculus
cccaacaggcaggaag

SEQ ID NO: 386493 - DNA, 16 bp, M. musculus
cccaacataagagaga

SEQ ID NO: 386494 - DNA, 16 bp, M. musculus
cccaacatgttggaac

SEQ ID NO: 386495 - DNA, 16 bp, M. musculus
cccaaccattcccact

SEQ ID NO: 386496 - DNA, 16 bp, M. musculus
cccaacccatccactt

SEQ ID NO: 386497 - DNA, 16 bp, M. musculus
cccaactcattttata

SEQ ID NO: 386498 - DNA, 16 bp, M. musculus
cccaactcctctcaga

SEQ ID NO: 386499 - DNA, 16 bp, M. musculus
cccaactgggatgaca

SEQ ID NO: 386500 - DNA, 16 bp, M. musculus
cccaactgggccaact

SEQ ID NO: 386501 - DNA, 16 bp, M. musculus
cccaagaactcccagg

SEQ ID NO: 386502 - DNA, 16 bp, M. musculus
cccaagaagctgaagg

SEQ ID NO: 386503 - DNA, 16 bp, M. musculus
cccaagacacaagatg

SEQ ID NO: 386504 - DNA, 16 bp, M. musculus
cccaagacctccctgg

SEQ ID NO: 386505 - DNA, 16 bp, M. musculus
cccaagactaccagca

SEQ ID NO: 386506 - DNA, 16 bp, M. musculus
cccaagagaaagaagt

SEQ ID NO: 386507 - DNA, 16 bp, M. musculus
cccaagagaagacaca

SEQ ID NO: 386508 - DNA, 16 bp, M. musculus
cccaagagaatgaagt

SEQ ID NO: 386509 - DNA, 16 bp, M. musculus
cccaagagcagcttcc

SEQ ID NO: 386510 - DNA, 16 bp, M. musculus
cccaagaggagcagaa

SEQ ID NO: 386511 - DNA, 16 bp, M. musculus
cccaagaggagcagat

SEQ ID NO: 386512 - DNA, 16 bp, M. musculus
cccaagaggagtacat

SEQ ID NO: 386513 - DNA, 16 bp, M. musculus
cccaagagtgctatag

SEQ ID NO: 386514 - DNA, 16 bp, M. musculus
cccaagagttgggatt

SEQ ID NO: 386515 - DNA, 16 bp, M. musculus
cccaagatggaggcag

SEQ ID NO: 386516 - DNA, 16 bp, M. musculus
cccaagattaccagcc

SEQ ID NO: 386517 - DNA, 16 bp, M. musculus
cccaagccaggcccag

SEQ ID NO: 386518 - DNA, 16 bp, M. musculus
cccaagccatgtattc

SEQ ID NO: 386519 - DNA, 16 bp, M. musculus
cccaagcccctccaca

SEQ ID NO: 386520 - DNA, 16 bp, M. musculus
cccaagcctgacaacc

SEQ ID NO: 386521 - DNA, 16 bp, M. musculus
cccaagcctgggaacc

SEQ ID NO: 386522 - DNA, 16 bp, M. musculus
cccaagctctgtctaa

SEQ ID NO: 386523 - DNA, 23 bp, M. musculus
cccaagcttgttttccctgatct

SEQ ID NO: 386524 - DNA, 16 bp, M. musculus
cccaaggacctaaagg

SEQ ID NO: 386525 - DNA, 16 bp, M. musculus
cccaaggagcagaagg

SEQ ID NO: 386526 - DNA, 16 bp, M. musculus
cccaaggagctagagg

SEQ ID NO: 386527 - DNA, 16 bp, M. musculus
cccaaggagctgaaga

SEQ ID NO: 386528 - DNA, 16 bp, M. musculus
cccaaggagctgaagt

SEQ ID NO: 386529 - DNA, 16 bp, M. musculus
cccaaggaggccagaa

SEQ ID NO: 386530 - DNA, 16 bp, M. musculus
cccaaggatcctcctg

SEQ ID NO: 386531 - DNA, 16 bp, M. musculus
cccaaggatctgaagg

SEQ ID NO: 386532 - DNA, 16 bp, M. musculus
cccaaggcctgatact

SEQ ID NO: 386533 - DNA, 16 bp, M. musculus
cccaaggcttcctgca

SEQ ID NO: 386534 - DNA, 16 bp, M. musculus
cccaaggggggaaaaa

SEQ ID NO: 386535 - DNA, 16 bp, M. musculus
cccaagggtccatgtt

SEQ ID NO: 386536 - DNA, 16 bp, M. musculus
cccaaggtcccaagag

SEQ ID NO: 386537 - DNA, 16 bp, M. musculus
cccaagtaaatgcttt

SEQ ID NO: 386538 - DNA, 16 bp, M. musculus
cccaagtctctggtgc

SEQ ID NO: 386539 - DNA, 16 bp, M. musculus
cccaagtgacacacct

SEQ ID NO: 386540 - DNA, 16 bp, M. musculus
cccaagtgcaaggatt

SEQ ID NO: 386541 - DNA, 16 bp, M. musculus
cccaagtgcaccacca

SEQ ID NO: 386542 - DNA, 16 bp, M. musculus
cccaagtgctgagact

SEQ ID NO: 386543 - DNA, 16 bp, M. musculus
cccaagtgctgcgatt

SEQ ID NO: 386544 - DNA, 16 bp, M. musculus
cccaagtgctggaaat

SEQ ID NO: 386545 - DNA, 16 bp, M. musculus
cccaagtgctggcact

SEQ ID NO: 386546 - DNA, 16 bp, M. musculus
cccaagtggggcagtt

SEQ ID NO: 386547 - DNA, 16 bp, M. musculus
cccaagtggtaagaag

SEQ ID NO: 386548 - DNA, 16 bp, M. musculus
cccaagtgtggacact

SEQ ID NO: 386549 - DNA, 16 bp, M. musculus
cccaagttcagatctc

SEQ ID NO: 386550 - DNA, 16 bp, M. musculus
cccaagttcctgagga

SEQ ID NO: 386551 - DNA, 16 bp, M. musculus
cccaagttttgggatt

SEQ ID NO: 386552 - DNA, 16 bp, M. musculus
cccaataaaaagacac

SEQ ID NO: 386553 - DNA, 16 bp, M. musculus
cccaataaaaagatat

SEQ ID NO: 386554 - DNA, 16 bp, M. musculus
cccaataaacgtgtgt

SEQ ID NO: 386555 - DNA, 16 bp, M. musculus
cccaatagagaaatct

SEQ ID NO: 386556 - DNA, 16 bp, M. musculus
cccaatcaaaaaatgg

SEQ ID NO: 386557 - DNA, 16 bp, M. musculus
cccaatcacaaagaaa

SEQ ID NO: 386558 - DNA, 16 bp, M. musculus
cccaatcataaaggaa

SEQ ID NO: 386559 - DNA, 16 bp, M. musculus
cccaatcccattcatc

SEQ ID NO: 386560 - DNA, 16 bp, M. musculus
cccaatccttcctaaa

SEQ ID NO: 386561 - DNA, 16 bp, M. musculus
cccaatctaggcttac

SEQ ID NO: 386562 - DNA, 16 bp, M. musculus
cccaatctcactcatc

SEQ ID NO: 386563 - DNA, 16 bp, M. musculus
cccaatctcctacctc

SEQ ID NO: 386564 - DNA, 16 bp, M. musculus
cccaatgaaggagtta

SEQ ID NO: 386565 - DNA, 16 bp, M. musculus
cccaatgacacacttc

SEQ ID NO: 386566 - DNA, 16 bp, M. musculus
cccaatgaggggctgg

SEQ ID NO: 386567 - DNA, 16 bp, M. musculus
cccaatgccctcttct

SEQ ID NO: 386568 - DNA, 16 bp, M. musculus
cccaatggagaagctg

SEQ ID NO: 386569 - DNA, 22 bp, M. musculus
cccaatggaggagctagagaaa

SEQ ID NO: 386570 - DNA, 17 bp, M. musculus
cccaattaaatgttgtt

SEQ ID NO: 386571 - DNA, 16 bp, M. musculus
cccaattaaatgtttt

SEQ ID NO: 386572 - DNA, 16 bp, M. musculus
cccaattagatgttgt

SEQ ID NO: 386573 - DNA, 16 bp, M. musculus
cccaatttcaagttgt

SEQ ID NO: 386574 - DNA, 16 bp, M. musculus
cccaattttaaacaat

SEQ ID NO: 386575 - DNA, 16 bp, M. musculus
cccacaaagccatcct

SEQ ID NO: 386576 - DNA, 16 bp, M. musculus
cccacaaaggccagag

SEQ ID NO: 386577 - DNA, 16 bp, M. musculus
cccacaacagcaagtc

SEQ ID NO: 386578 - DNA, 16 bp, M. musculus
cccacaacatgaggaa

SEQ ID NO: 386579 - DNA, 16 bp, M. musculus
cccacaagaacactaa

SEQ ID NO: 386580 - DNA, 16 bp, M. musculus
cccacaagggcccttt

SEQ ID NO: 386581 - DNA, 16 bp, M. musculus
cccacaaggggacctc

SEQ ID NO: 386582 - DNA, 16 bp, M. musculus
cccacaaggtggctca

SEQ ID NO: 386583 - DNA, 16 bp, M. musculus
cccacaagttgttctc

SEQ ID NO: 386584 - DNA, 16 bp, M. musculus
cccacaatcaaaggat

SEQ ID NO: 386585 - DNA, 16 bp, M. musculus
cccacaatgggcaggg

SEQ ID NO: 386586 - DNA, 16 bp, M. musculus
cccacacacatgcaaa

SEQ ID NO: 386587 - DNA, 16 bp, M. musculus
cccacacatacacata

SEQ ID NO: 386588 - DNA, 16 bp, M. musculus
cccacacatacacatg

SEQ ID NO: 386589 - DNA, 16 bp, M. musculus
cccacaccaacactgg

SEQ ID NO: 386590 - DNA, 16 bp, M. musculus
cccacaccaggagctc

SEQ ID NO: 386591 - DNA, 16 bp, M. musculus
cccacacccacagtgg

SEQ ID NO: 386592 - DNA, 16 bp, M. musculus
cccacaccctcagtga

SEQ ID NO: 386593 - DNA, 16 bp, M. musculus
cccacacctgatcctg

SEQ ID NO: 386594 - DNA, 16 bp, M. musculus
cccacacctgattctg

SEQ ID NO: 386595 - DNA, 16 bp, M. musculus
cccacacctgggatta

SEQ ID NO: 386596 - DNA, 16 bp, M. musculus
cccacacctgtgccca

SEQ ID NO: 386597 - DNA, 16 bp, M. musculus
cccacactatcactta

SEQ ID NO: 386598 - DNA, 16 bp, M. musculus
cccacactgatggagg

SEQ ID NO: 386599 - DNA, 16 bp, M. musculus
cccacagaagccagga

SEQ ID NO: 386600 - DNA, 16 bp, M. musculus
cccacagactcatgtt

SEQ ID NO: 386601 - DNA, 16 bp, M. musculus
cccacagagactgaac

SEQ ID NO: 386602 - DNA, 16 bp, M. musculus
cccacagagcagctca

SEQ ID NO: 386603 - DNA, 16 bp, M. musculus
cccacagagccacctc

SEQ ID NO: 386604 - DNA, 16 bp, M. musculus
cccacagagctcatgt

SEQ ID NO: 386605 - DNA, 16 bp, M. musculus
cccacagagctcccag

SEQ ID NO: 386606 - DNA, 16 bp, M. musculus
cccacagaggtcagaa

SEQ ID NO: 386607 - DNA, 16 bp, M. musculus
cccacagagtggctca

SEQ ID NO: 386608 - DNA, 31 bp, M. musculus
cccacagatatcagacccagatggatctctg

SEQ ID NO: 386609 - DNA, 16 bp, M. musculus
cccacagcagatggca

SEQ ID NO: 386610 - DNA, 16 bp, M. musculus
cccacagcagccagca

SEQ ID NO: 386611 - DNA, 16 bp, M. musculus
cccacagcaggcagct

SEQ ID NO: 386612 - DNA, 16 bp, M. musculus
cccacagccacagtga

SEQ ID NO: 386613 - DNA, 16 bp, M. musculus
cccacagccagacact

SEQ ID NO: 386614 - DNA, 16 bp, M. musculus
cccacagccctgcctg

SEQ ID NO: 386615 - DNA, 16 bp, M. musculus
cccacagcgacacact

SEQ ID NO: 386616 - DNA, 16 bp, M. musculus
cccacagctcccacaa

SEQ ID NO: 386617 - DNA, 16 bp, M. musculus
cccacagctctgacat

SEQ ID NO: 386618 - DNA, 16 bp, M. musculus
cccacaggactctcca

SEQ ID NO: 386619 - DNA, 16 bp, M. musculus
cccacaggaggaacaa

SEQ ID NO: 386620 - DNA, 16 bp, M. musculus
cccacaggctgagagc

SEQ ID NO: 386621 - DNA, 16 bp, M. musculus
cccacaggtcaatctg

SEQ ID NO: 386622 - DNA, 16 bp, M. musculus
cccacagtaggctggg

SEQ ID NO: 386623 - DNA, 16 bp, M. musculus
cccacagtgaactggg

SEQ ID NO: 386624 - DNA, 16 bp, M. musculus
cccacagtgacaaact

SEQ ID NO: 386625 - DNA, 16 bp, M. musculus
cccacagtgacacacc

SEQ ID NO: 386626 - DNA, 16 bp, M. musculus
cccacagtggcacacc

SEQ ID NO: 386627 - DNA, 16 bp, M. musculus
cccacagtggccagaa

SEQ ID NO: 386628 - DNA, 16 bp, M. musculus
cccacagtggcctggg

SEQ ID NO: 386629 - DNA, 16 bp, M. musculus
cccacagtgtgctggg

SEQ ID NO: 386630 - DNA, 16 bp, M. musculus
cccacatctgcccctg

SEQ ID NO: 386631 - DNA, 16 bp, M. musculus
cccacatctggccaga

SEQ ID NO: 386632 - DNA, 16 bp, M. musculus
cccacatgaagatcaa

SEQ ID NO: 386633 - DNA, 16 bp, M. musculus
cccacatgctggaagg

SEQ ID NO: 386634 - DNA, 16 bp, M. musculus
cccacatggcacctca

SEQ ID NO: 386635 - DNA, 18 bp, M. musculus
cccacatggtggctcaca

SEQ ID NO: 386636 - DNA, 17 bp, M. musculus
cccacatggtggctcat

SEQ ID NO: 386637 - DNA, 16 bp, M. musculus
cccacatggtggctcc

SEQ ID NO: 386638 - DNA, 16 bp, M. musculus
cccaccagaaatgaag

SEQ ID NO: 386639 - DNA, 16 bp, M. musculus
cccaccagatctcccc

SEQ ID NO: 386640 - DNA, 16 bp, M. musculus
cccaccagcaccaggg

SEQ ID NO: 386641 - DNA, 16 bp, M. musculus
cccaccagctctccca

SEQ ID NO: 386642 - DNA, 16 bp, M. musculus
cccaccagcttcctgg

SEQ ID NO: 386643 - DNA, 16 bp, M. musculus
cccaccatccaccaga

SEQ ID NO: 386644 - DNA, 16 bp, M. musculus
cccaccatgatgataa

SEQ ID NO: 386645 - DNA, 16 bp, M. musculus
cccaccatgatggtca

SEQ ID NO: 386646 - DNA, 16 bp, M. musculus
cccaccatggcctctg

SEQ ID NO: 386647 - DNA, 21 bp, M. musculus
cccaccatgtggttgctggga

SEQ ID NO: 386648 - DNA, 16 bp, M. musculus
cccacccacaaaatct

SEQ ID NO: 386649 - DNA, 16 bp, M. musculus
cccacccacacagtga

SEQ ID NO: 386650 - DNA, 16 bp, M. musculus
cccacccacccatgct

SEQ ID NO: 386651 - DNA, 16 bp, M. musculus
cccacccactcctgtc

SEQ ID NO: 386652 - DNA, 16 bp, M. musculus
cccacccactctggct

SEQ ID NO: 386653 - DNA, 16 bp, M. musculus
cccacccacttcctgg

SEQ ID NO: 386654 - DNA, 16 bp, M. musculus
cccacccaggaatcca

SEQ ID NO: 386655 - DNA, 16 bp, M. musculus
cccacccagggatcca

SEQ ID NO: 386656 - DNA, 16 bp, M. musculus
cccacccaggttccct

SEQ ID NO: 386657 - DNA, 16 bp, M. musculus
cccacccagtgctggg

SEQ ID NO: 386658 - DNA, 16 bp, M. musculus
cccacccagttctctc

SEQ ID NO: 386659 - DNA, 16 bp, M. musculus
cccaccccagtgacac

SEQ ID NO: 386660 - DNA, 16 bp, M. musculus
cccacccccactgctg

SEQ ID NO: 386661 - DNA, 16 bp, M. musculus
cccacccccagcactg

SEQ ID NO: 386662 - DNA, 16 bp, M. musculus
cccacccccattcctg

SEQ ID NO: 386663 - DNA, 16 bp, M. musculus
cccacccccccagtga

SEQ ID NO: 386664 - DNA, 16 bp, M. musculus
cccaccccctttctgg

SEQ ID NO: 386665 - DNA, 16 bp, M. musculus
cccacccctgccctgt

SEQ ID NO: 386666 - DNA, 16 bp, M. musculus
cccacccctgctctct

SEQ ID NO: 386667 - DNA, 16 bp, M. musculus
cccacccctggagcag

SEQ ID NO: 386668 - DNA, 16 bp, M. musculus
cccaccctgatcccct

SEQ ID NO: 386669 - DNA, 16 bp, M. musculus
cccaccctgctccaca

SEQ ID NO: 386670 - DNA, 16 bp, M. musculus
cccaccctgctcctca

SEQ ID NO: 386671 - DNA, 16 bp, M. musculus
cccaccctggcacctc

SEQ ID NO: 386672 - DNA, 16 bp, M. musculus
cccacctcactgccct

SEQ ID NO: 386673 - DNA, 16 bp, M. musculus
cccacctcagccattc

SEQ ID NO: 386674 - DNA, 16 bp, M. musculus
cccacctcagggaaaa

SEQ ID NO: 386675 - DNA, 16 bp, M. musculus
cccacctcatccagtc

SEQ ID NO: 386676 - DNA, 16 bp, M. musculus
cccacctccctgtctc

SEQ ID NO: 386677 - DNA, 16 bp, M. musculus
cccacctcctcctgct

SEQ ID NO: 386678 - DNA, 19 bp, M. musculus
cccacctccttgagttgtg

SEQ ID NO: 386679 - DNA, 16 bp, M. musculus
cccacctccttgccct

SEQ ID NO: 386680 - DNA, 16 bp, M. musculus
cccacctctgcctcct

SEQ ID NO: 386681 - DNA, 16 bp, M. musculus
cccacctctgccttcc

SEQ ID NO: 386682 - DNA, 16 bp, M. musculus
cccacctgaccagagg

SEQ ID NO: 386683 - DNA, 16 bp, M. musculus
cccacctgcccaagga

SEQ ID NO: 386684 - DNA, 16 bp, M. musculus
cccacctgcccaggga

SEQ ID NO: 386685 - DNA, 16 bp, M. musculus
cccacctggagatcta

SEQ ID NO: 386686 - DNA, 16 bp, M. musculus
cccacctgtaactgga

SEQ ID NO: 386687 - DNA, 16 bp, M. musculus
cccaccttgccttcac

SEQ ID NO: 386688 - DNA, 16 bp, M. musculus
cccacctttacctgtg

SEQ ID NO: 386689 - DNA, 16 bp, M. musculus
cccacgtggtggctca

SEQ ID NO: 386690 - DNA, 16 bp, M. musculus
cccactacctctggtg

SEQ ID NO: 386691 - DNA, 16 bp, M. musculus
cccactatctcttcta

SEQ ID NO: 386692 - DNA, 16 bp, M. musculus
cccactatgatgataa

SEQ ID NO: 386693 - DNA, 17 bp, M. musculus
cccactcaccctttttg

SEQ ID NO: 386694 - DNA, 16 bp, M. musculus
cccactcactgcccca

SEQ ID NO: 386695 - DNA, 16 bp, M. musculus
cccactcagccatctc

SEQ ID NO: 386696 - DNA, 16 bp, M. musculus
cccactccaacatcta

SEQ ID NO: 386697 - DNA, 16 bp, M. musculus
cccactccagcctcac

SEQ ID NO: 386698 - DNA, 16 bp, M. musculus
cccactcccaattctt

SEQ ID NO: 386699 - DNA, 16 bp, M. musculus
cccactcctgcctcca

SEQ ID NO: 386700 - DNA, 16 bp, M. musculus
cccactcctgccttac

SEQ ID NO: 386701 - DNA, 16 bp, M. musculus
cccactcctgcttcag

SEQ ID NO: 386702 - DNA, 18 bp, M. musculus
cccactcctgcttcctga

SEQ ID NO: 386703 - DNA, 16 bp, M. musculus
cccactcctggttcct

SEQ ID NO: 386704 - DNA, 16 bp, M. musculus
cccactcctttgttcc

SEQ ID NO: 386705 - DNA, 16 bp, M. musculus
cccactctctcactat

SEQ ID NO: 386706 - DNA, 16 bp, M. musculus
cccactctgctaccca

SEQ ID NO: 386707 - DNA, 16 bp, M. musculus
cccactcttgcctcag

SEQ ID NO: 386708 - DNA, 16 bp, M. musculus
cccactgaagggcatc

SEQ ID NO: 386709 - DNA, 16 bp, M. musculus
cccactgagaggacca

SEQ ID NO: 386710 - DNA, 16 bp, M. musculus
cccactgagcaatctc

SEQ ID NO: 386711 - DNA, 16 bp, M. musculus
cccactgagcatctcc

SEQ ID NO: 386712 - DNA, 17 bp, M. musculus
cccactgagccatctcc

SEQ ID NO: 386713 - DNA, 16 bp, M. musculus
cccactgagctctctc

SEQ ID NO: 386714 - DNA, 16 bp, M. musculus
cccactgatgagccct

SEQ ID NO: 386715 - DNA, 16 bp, M. musculus
cccactgatgtctgac

SEQ ID NO: 386716 - DNA, 17 bp, M. musculus
cccactgccctccctaa

SEQ ID NO: 386717 - DNA, 16 bp, M. musculus
cccactgctgctgcct

SEQ ID NO: 386718 - DNA, 16 bp, M. musculus
cccactgctgtcaaag

SEQ ID NO: 386719 - DNA, 16 bp, M. musculus
cccactggatggcttt

SEQ ID NO: 386720 - DNA, 16 bp, M. musculus
cccactgggccatctt

SEQ ID NO: 386721 - DNA, 16 bp, M. musculus
cccactggggaccaag

SEQ ID NO: 386722 - DNA, 16 bp, M. musculus
cccactgtgggcagtg

SEQ ID NO: 386723 - DNA, 16 bp, M. musculus
cccactgtgggtggag

SEQ ID NO: 386724 - DNA, 16 bp, M. musculus
cccacttactcctcta

SEQ ID NO: 386725 - DNA, 16 bp, M. musculus
cccacttccatttctt

SEQ ID NO: 386726 - DNA, 16 bp, M. musculus
cccacttcccagtttc

SEQ ID NO: 386727 - DNA, 16 bp, M. musculus
cccacttccctgccca

SEQ ID NO: 386728 - DNA, 16 bp, M. musculus
cccacttccctgccct

SEQ ID NO: 386729 - DNA, 16 bp, M. musculus
cccacttcctccagct

SEQ ID NO: 386730 - DNA, 16 bp, M. musculus
cccacttcctggtcct

SEQ ID NO: 386731 - DNA, 16 bp, M. musculus
cccacttcctgtccct

SEQ ID NO: 386732 - DNA, 16 bp, M. musculus
cccacttctggcctcc

SEQ ID NO: 386733 - DNA, 16 bp, M. musculus
cccacttctggggtta

SEQ ID NO: 386734 - DNA, 16 bp, M. musculus
cccacttctgtgtttg

SEQ ID NO: 386735 - DNA, 16 bp, M. musculus
cccacttgaagggtgg

SEQ ID NO: 386736 - DNA, 16 bp, M. musculus
cccacttgcctctgcc

SEQ ID NO: 386737 - DNA, 16 bp, M. musculus
cccacttgggggccaa

SEQ ID NO: 386738 - DNA, 16 bp, M. musculus
cccactttaaaaaaaa

SEQ ID NO: 386739 - DNA, 16 bp, M. musculus
cccactttcccttcta

SEQ ID NO: 386740 - DNA, 16 bp, M. musculus
cccactttctcctata

SEQ ID NO: 386741 - DNA, 16 bp, M. musculus
cccactttttaaaaaa

SEQ ID NO: 386742 - DNA, 16 bp, M. musculus
cccactttttcttcta

SEQ ID NO: 386743 - DNA, 16 bp, M. musculus
cccagaaaaacaaata

SEQ ID NO: 386744 - DNA, 17 bp, M. musculus
cccagaaaagctgtttt

SEQ ID NO: 386745 - DNA, 16 bp, M. musculus
cccagaaaatgagact

SEQ ID NO: 386746 - DNA, 16 bp, M. musculus
cccagaaacaaagcga

SEQ ID NO: 386747 - DNA, 16 bp, M. musculus
cccagaaagctgaact

SEQ ID NO: 386748 - DNA, 16 bp, M. musculus
cccagaaataaaccac

SEQ ID NO: 386749 - DNA, 16 bp, M. musculus
cccagaaatgaatgca

SEQ ID NO: 386750 - DNA, 16 bp, M. musculus
cccagaacccacagtg

SEQ ID NO: 386751 - DNA, 16 bp, M. musculus
cccagaacccacatgg

SEQ ID NO: 386752 - DNA, 16 bp, M. musculus
cccagaacccagatgg

SEQ ID NO: 386753 - DNA, 16 bp, M. musculus
cccagaacccatgtaa

SEQ ID NO: 386754 - DNA, 16 bp, M. musculus
cccagaacccttgtaa

SEQ ID NO: 386755 - DNA, 16 bp, M. musculus
cccagaacctacacag

SEQ ID NO: 386756 - DNA, 16 bp, M. musculus
cccagaacctctggaa

SEQ ID NO: 386757 - DNA, 16 bp, M. musculus
cccagaacctgtgtaa

SEQ ID NO: 386758 - DNA, 16 bp, M. musculus
cccagaactcactctg

SEQ ID NO: 386759 - DNA, 16 bp, M. musculus
cccagaactcagccta

SEQ ID NO: 386760 - DNA, 19 bp, M. musculus
cccagaactcaggaggcag

SEQ ID NO: 386761 - DNA, 16 bp, M. musculus
cccagaactcttgtct

SEQ ID NO: 386762 - DNA, 19 bp, M. musculus
cccagaactggtgctgctt

SEQ ID NO: 386763 - DNA, 16 bp, M. musculus
cccagaagatcatgta

SEQ ID NO: 386764 - DNA, 16 bp, M. musculus
cccagaagattctcca

SEQ ID NO: 386765 - DNA, 16 bp, M. musculus
cccagaagctcagaat

SEQ ID NO: 386766 - DNA, 16 bp, M. musculus
cccagaagctctgaat

SEQ ID NO: 386767 - DNA, 16 bp, M. musculus
cccagaagctgtccag

SEQ ID NO: 386768 - DNA, 16 bp, M. musculus
cccagaagctgtgctg

SEQ ID NO: 386769 - DNA, 16 bp, M. musculus
cccagaagctgttagt

SEQ ID NO: 386770 - DNA, 16 bp, M. musculus
cccagaagctgttttg

SEQ ID NO: 386771 - DNA, 16 bp, M. musculus
cccagaaggctgggag

SEQ ID NO: 386772 - DNA, 16 bp, M. musculus
cccagaagtaaatcca

SEQ ID NO: 386773 - DNA, 16 bp, M. musculus
cccagaagtgttcctg

SEQ ID NO: 386774 - DNA, 16 bp, M. musculus
cccagaatcacttatt

SEQ ID NO: 386775 - DNA, 16 bp, M. musculus
cccagaatccctcagt

SEQ ID NO: 386776 - DNA, 16 bp, M. musculus
cccagaatctctgtga

SEQ ID NO: 386777 - DNA, 16 bp, M. musculus
cccagaattgcttctg

SEQ ID NO: 386778 - DNA, 16 bp, M. musculus
cccagacacacacata

SEQ ID NO: 386779 - DNA, 16 bp, M. musculus
cccagacaccagagaa

SEQ ID NO: 386780 - DNA, 16 bp, M. musculus
cccagacaccaggctc

SEQ ID NO: 386781 - DNA, 16 bp, M. musculus
cccagacagacagaca

SEQ ID NO: 386782 - DNA, 16 bp, M. musculus
cccagacatgcccaca

SEQ ID NO: 386783 - DNA, 22 bp, M. musculus
cccagacattggacagttggag

SEQ ID NO: 386784 - DNA, 16 bp, M. musculus
cccagacccagaaaga

SEQ ID NO: 386785 - DNA, 16 bp, M. musculus
cccagacccagatcca

SEQ ID NO: 386786 - DNA, 16 bp, M. musculus
cccagaccctcaagcc

SEQ ID NO: 386787 - DNA, 16 bp, M. musculus
cccagacctagtccag

SEQ ID NO: 386788 - DNA, 16 bp, M. musculus
cccagacctcccaggg

SEQ ID NO: 386789 - DNA, 16 bp, M. musculus
cccagacctccctggg

SEQ ID NO: 386790 - DNA, 16 bp, M. musculus
cccagacctgcagccc

SEQ ID NO: 386791 - DNA, 16 bp, M. musculus
cccagaccttagcaca

SEQ ID NO: 386792 - DNA, 16 bp, M. musculus
cccagactcacagaga

SEQ ID NO: 386793 - DNA, 16 bp, M. musculus
cccagactcttcctcc

SEQ ID NO: 386794 - DNA, 16 bp, M. musculus
cccagactgatggagg

SEQ ID NO: 386795 - DNA, 16 bp, M. musculus
cccagactggccttga

SEQ ID NO: 386796 - DNA, 16 bp, M. musculus
cccagactgtcctgga

SEQ ID NO: 386797 - DNA, 16 bp, M. musculus
cccagagaagctgcag

SEQ ID NO: 386798 - DNA, 16 bp, M. musculus
cccagagacacacaca

SEQ ID NO: 386799 - DNA, 16 bp, M. musculus
cccagagacagctgga

SEQ ID NO: 386800 - DNA, 16 bp, M. musculus
cccagagaccaagcca

SEQ ID NO: 386801 - DNA, 16 bp, M. musculus
cccagagaccagaaga

SEQ ID NO: 386802 - DNA, 16 bp, M. musculus
cccagagacccagcag

SEQ ID NO: 386803 - DNA, 16 bp, M. musculus
cccagagagaacaaag

SEQ ID NO: 386804 - DNA, 16 bp, M. musculus
cccagagatcattgag

SEQ ID NO: 386805 - DNA, 16 bp, M. musculus
cccagagatccacctg

SEQ ID NO: 386806 - DNA, 16 bp, M. musculus
cccagagatccctggg

SEQ ID NO: 386807 - DNA, 16 bp, M. musculus
cccagagatggtcaca

SEQ ID NO: 386808 - DNA, 16 bp, M. musculus
cccagagcaaacagaa

SEQ ID NO: 386809 - DNA, 16 bp, M. musculus
cccagagcaccagaac

SEQ ID NO: 386810 - DNA, 16 bp, M. musculus
cccagagcaggaaggg

SEQ ID NO: 386811 - DNA, 16 bp, M. musculus
cccagagcccacagga

SEQ ID NO: 386812 - DNA, 16 bp, M. musculus
cccagagccccagtcc

SEQ ID NO: 386813 - DNA, 17 bp, M. musculus
cccagagcctcatcacc

SEQ ID NO: 386814 - DNA, 16 bp, M. musculus
cccagagcctgtgtct

SEQ ID NO: 386815 - DNA, 16 bp, M. musculus
cccagagccttgtgca

SEQ ID NO: 386816 - DNA, 16 bp, M. musculus
cccagagctaaacaaa

SEQ ID NO: 386817 - DNA, 16 bp, M. musculus
cccagagctcaccaat

SEQ ID NO: 386818 - DNA, 16 bp, M. musculus
cccagagctcactgat

SEQ ID NO: 386819 - DNA, 16 bp, M. musculus
cccagagctcctgaaa

SEQ ID NO: 386820 - DNA, 16 bp, M. musculus
cccagagctctgtgct

SEQ ID NO: 386821 - DNA, 16 bp, M. musculus
cccagagctcttgtct

SEQ ID NO: 386822 - DNA, 16 bp, M. musculus
cccagagctgaccctg

SEQ ID NO: 386823 - DNA, 16 bp, M. musculus
cccagagctgctgctg

SEQ ID NO: 386824 - DNA, 16 bp, M. musculus
cccagagctttgtgca

SEQ ID NO: 386825 - DNA, 16 bp, M. musculus
cccagaggaagaacaa

SEQ ID NO: 386826 - DNA, 16 bp, M. musculus
cccagaggagacacca

SEQ ID NO: 386827 - DNA, 16 bp, M. musculus
cccagaggcagctcca

SEQ ID NO: 386828 - DNA, 16 bp, M. musculus
cccagaggccagagga

SEQ ID NO: 386829 - DNA, 16 bp, M. musculus
cccagaggcctgtctc

SEQ ID NO: 386830 - DNA, 16 bp, M. musculus
cccagaggctcctccc

SEQ ID NO: 386831 - DNA, 16 bp, M. musculus
cccagaggctgggctg

SEQ ID NO: 386832 - DNA, 16 bp, M. musculus
cccagaggcttctggg

SEQ ID NO: 386833 - DNA, 16 bp, M. musculus
cccagagggaaggcag

SEQ ID NO: 386834 - DNA, 16 bp, M. musculus
cccagaggggtcctgg

SEQ ID NO: 386835 - DNA, 16 bp, M. musculus
cccagagttcaggcta

SEQ ID NO: 386836 - DNA, 16 bp, M. musculus
cccagagttcctgtct

SEQ ID NO: 386837 - DNA, 16 bp, M. musculus
cccagagttcttcacc

SEQ ID NO: 386838 - DNA, 16 bp, M. musculus
cccagagttcttgact

SEQ ID NO: 386839 - DNA, 16 bp, M. musculus
cccagagttgtcctct

SEQ ID NO: 386840 - DNA, 16 bp, M. musculus
cccagatatctggtgt

SEQ ID NO: 386841 - DNA, 16 bp, M. musculus
cccagatcagattggc

SEQ ID NO: 386842 - DNA, 16 bp, M. musculus
cccagatccactcctc

SEQ ID NO: 386843 - DNA, 16 bp, M. musculus
cccagatccactcctt

SEQ ID NO: 386844 - DNA, 16 bp, M. musculus
cccagatccagaaaga

SEQ ID NO: 386845 - DNA, 16 bp, M. musculus
cccagatccagggttt

SEQ ID NO: 386846 - DNA, 16 bp, M. musculus
cccagatccctctctc

SEQ ID NO: 386847 - DNA, 16 bp, M. musculus
cccagatccttcccac

SEQ ID NO: 386848 - DNA, 16 bp, M. musculus
cccagatgcccctcaa

SEQ ID NO: 386849 - DNA, 16 bp, M. musculus
cccagatgctattgtg

SEQ ID NO: 386850 - DNA, 16 bp, M. musculus
cccagatgtctctcaa

SEQ ID NO: 386851 - DNA, 16 bp, M. musculus
cccagatgtctggagt

SEQ ID NO: 386852 - DNA, 16 bp, M. musculus
cccagcaaaacaccat

SEQ ID NO: 386853 - DNA, 16 bp, M. musculus
cccagcaaccacagag

SEQ ID NO: 386854 - DNA, 16 bp, M. musculus
cccagcaactacgtgg

SEQ ID NO: 386855 - DNA, 16 bp, M. musculus
cccagcaactacttgg

SEQ ID NO: 386856 - DNA, 16 bp, M. musculus
cccagcaactatgtgg

SEQ ID NO: 386857 - DNA, 16 bp, M. musculus
cccagcaaggagaatc

SEQ ID NO: 386858 - DNA, 16 bp, M. musculus
cccagcaagtttccag

SEQ ID NO: 386859 - DNA, 16 bp, M. musculus
cccagcacacaggaag

SEQ ID NO: 386860 - DNA, 16 bp, M. musculus
cccagcacaggaggca

SEQ ID NO: 386861 - DNA, 16 bp, M. musculus
cccagcaccacagaaa

SEQ ID NO: 386862 - DNA, 16 bp, M. musculus
cccagcaccatttgtt

SEQ ID NO: 386863 - DNA, 16 bp, M. musculus
cccagcacccacatca

SEQ ID NO: 386864 - DNA, 16 bp, M. musculus
cccagcacccacatga

SEQ ID NO: 386865 - DNA, 16 bp, M. musculus
cccagcacccacatgg

SEQ ID NO: 386866 - DNA, 16 bp, M. musculus
cccagcacccaggagg

SEQ ID NO: 386867 - DNA, 16 bp, M. musculus
cccagcacccaggagt

SEQ ID NO: 386868 - DNA, 16 bp, M. musculus
cccagcacccatgtca

SEQ ID NO: 386869 - DNA, 16 bp, M. musculus
cccagcacctacgtgg

SEQ ID NO: 386870 - DNA, 16 bp, M. musculus
cccagcacctgcatgg

SEQ ID NO: 386871 - DNA, 16 bp, M. musculus
cccagcactagggaga

SEQ ID NO: 386872 - DNA, 16 bp, M. musculus
cccagcactcacatag

SEQ ID NO: 386873 - DNA, 16 bp, M. musculus
cccagcactcacgagg

SEQ ID NO: 386874 - DNA, 16 bp, M. musculus
cccagcactcaggagc

SEQ ID NO: 386875 - DNA, 16 bp, M. musculus
cccagcactcccacct

SEQ ID NO: 386876 - DNA, 29 bp, M. musculus
cccagcactcccacttcgcccagtccagg

SEQ ID NO: 386877 - DNA, 16 bp, M. musculus
cccagcactctgaaga

SEQ ID NO: 386878 - DNA, 16 bp, M. musculus
cccagcactctggatg

SEQ ID NO: 386879 - DNA, 16 bp, M. musculus
cccagcactgaaaaga

SEQ ID NO: 386880 - DNA, 16 bp, M. musculus
cccagcactgaagagg

SEQ ID NO: 386881 - DNA, 16 bp, M. musculus
cccagcactggaaagg

SEQ ID NO: 386882 - DNA, 16 bp, M. musculus
cccagcactggaaggc

SEQ ID NO: 386883 - DNA, 16 bp, M. musculus
cccagcactgggaaag

SEQ ID NO: 386884 - DNA, 16 bp, M. musculus
cccagcactgggtggg

SEQ ID NO: 386885 - DNA, 16 bp, M. musculus
cccagcacttccacct

SEQ ID NO: 386886 - DNA, 16 bp, M. musculus
cccagcacttgagaga

SEQ ID NO: 386887 - DNA, 16 bp, M. musculus
cccagcacttggaggc

SEQ ID NO: 386888 - DNA, 16 bp, M. musculus
cccagcacttggcaga

SEQ ID NO: 386889 - DNA, 16 bp, M. musculus
cccagcacttgggaac

SEQ ID NO: 386890 - DNA, 16 bp, M. musculus
cccagcacttgggaga

SEQ ID NO: 386891 - DNA, 16 bp, M. musculus
cccagcactttggagg

SEQ ID NO: 386892 - DNA, 16 bp, M. musculus
cccagcagcacttcct

SEQ ID NO: 386893 - DNA, 16 bp, M. musculus
cccagcagcagctctg

SEQ ID NO: 386894 - DNA, 16 bp, M. musculus
cccagcagcctcttct

SEQ ID NO: 386895 - DNA, 16 bp, M. musculus
cccagcagctgactca

SEQ ID NO: 386896 - DNA, 16 bp, M. musculus
cccagcaggaggaaaa

SEQ ID NO: 386897 - DNA, 16 bp, M. musculus
cccagcagtcaggaag

SEQ ID NO: 386898 - DNA, 16 bp, M. musculus
cccagcagtcctctgt

SEQ ID NO: 386899 - DNA, 16 bp, M. musculus
cccagcagttggaagg

SEQ ID NO: 386900 - DNA, 16 bp, M. musculus
cccagcatccacagca

SEQ ID NO: 386901 - DNA, 16 bp, M. musculus
cccagcatccacctgg

SEQ ID NO: 386902 - DNA, 16 bp, M. musculus
cccagcatccaggagg

SEQ ID NO: 386903 - DNA, 16 bp, M. musculus
cccagcatccatatca

SEQ ID NO: 386904 - DNA, 16 bp, M. musculus
cccagcatccccagca

SEQ ID NO: 386905 - DNA, 16 bp, M. musculus
cccagcatcccccagc

SEQ ID NO: 386906 - DNA, 16 bp, M. musculus
cccagcatcctctctg

SEQ ID NO: 386907 - DNA, 16 bp, M. musculus
cccagcatcctcttct

SEQ ID NO: 386908 - DNA, 16 bp, M. musculus
cccagcatccttactt

SEQ ID NO: 386909 - DNA, 16 bp, M. musculus
cccagcatctgggagg

SEQ ID NO: 386910 - DNA, 16 bp, M. musculus
cccagcatgcacaggg

SEQ ID NO: 386911 - DNA, 16 bp, M. musculus
cccagcatggaggagg

SEQ ID NO: 386912 - DNA, 16 bp, M. musculus
cccagcatggatgatg

SEQ ID NO: 386913 - DNA, 16 bp, M. musculus
cccagcattcaggaaa

SEQ ID NO: 386914 - DNA, 16 bp, M. musculus
cccagcatttaggaag

SEQ ID NO: 386915 - DNA, 16 bp, M. musculus
cccagcatttgagaag

SEQ ID NO: 386916 - DNA, 16 bp, M. musculus
cccagcatttggcagg

SEQ ID NO: 386917 - DNA, 16 bp, M. musculus
cccagcatttgggaag

SEQ ID NO: 386918 - DNA, 16 bp, M. musculus
cccagcatttgggaga

SEQ ID NO: 386919 - DNA, 16 bp, M. musculus
cccagcattttggaga

SEQ ID NO: 386920 - DNA, 16 bp, M. musculus
cccagccagaggagag

SEQ ID NO: 386921 - DNA, 16 bp, M. musculus
cccagccaggcagtgg

SEQ ID NO: 386922 - DNA, 16 bp, M. musculus
cccagccattgagtta

SEQ ID NO: 386923 - DNA, 16 bp, M. musculus
cccagcccaccatggg

SEQ ID NO: 386924 - DNA, 16 bp, M. musculus
cccagcccactgtggg

SEQ ID NO: 386925 - DNA, 16 bp, M. musculus
cccagcccagagatgg

SEQ ID NO: 386926 - DNA, 16 bp, M. musculus
cccagcccagcccagt

SEQ ID NO: 386927 - DNA, 16 bp, M. musculus
cccagcccatgaaatg

SEQ ID NO: 386928 - DNA, 16 bp, M. musculus
cccagcccatggaatg

SEQ ID NO: 386929 - DNA, 16 bp, M. musculus
cccagcccattgtgag

SEQ ID NO: 386930 - DNA, 16 bp, M. musculus
cccagccccagcccta

SEQ ID NO: 386931 - DNA, 16 bp, M. musculus
cccagccccagccctg

SEQ ID NO: 386932 - DNA, 16 bp, M. musculus
cccagccccagccctt

SEQ ID NO: 386933 - DNA, 16 bp, M. musculus
cccagcccctgggctg

SEQ ID NO: 386934 - DNA, 16 bp, M. musculus
cccagccccttttcta

SEQ ID NO: 386935 - DNA, 16 bp, M. musculus
cccagccctgctctcc

SEQ ID NO: 386936 - DNA, 16 bp, M. musculus
cccagccctgggaggc

SEQ ID NO: 386937 - DNA, 16 bp, M. musculus
cccagcctactatacc

SEQ ID NO: 386938 - DNA, 16 bp, M. musculus
cccagcctcaagatca

SEQ ID NO: 386939 - DNA, 16 bp, M. musculus
cccagcctcagcccca

SEQ ID NO: 386940 - DNA, 16 bp, M. musculus
cccagcctcagtttcc

SEQ ID NO: 386941 - DNA, 16 bp, M. musculus
cccagcctccaacacc

SEQ ID NO: 386942 - DNA, 16 bp, M. musculus
cccagcctcctcctct

SEQ ID NO: 386943 - DNA, 16 bp, M. musculus
cccagcctctgggctg

SEQ ID NO: 386944 - DNA, 16 bp, M. musculus
cccagcctgaagccac

SEQ ID NO: 386945 - DNA, 16 bp, M. musculus
cccagcctgaccccca

SEQ ID NO: 386946 - DNA, 16 bp, M. musculus
cccagcctgggaggcc

SEQ ID NO: 386947 - DNA, 16 bp, M. musculus
cccagcctggtctaca

SEQ ID NO: 386948 - DNA, 16 bp, M. musculus
cccagccttctgggtg

SEQ ID NO: 386949 - DNA, 16 bp, M. musculus
cccagcctttgagtta

SEQ ID NO: 386950 - DNA, 16 bp, M. musculus
cccagctagaagaaca

SEQ ID NO: 386951 - DNA, 16 bp, M. musculus
cccagctcagcccagc

SEQ ID NO: 386952 - DNA, 16 bp, M. musculus
cccagctcagctcagc

SEQ ID NO: 386953 - DNA, 16 bp, M. musculus
cccagctccagcccca

SEQ ID NO: 386954 - DNA, 16 bp, M. musculus
cccagctccagctcca

SEQ ID NO: 386955 - DNA, 16 bp, M. musculus
cccagctcccagggac

SEQ ID NO: 386956 - DNA, 16 bp, M. musculus
cccagctccctgccag

SEQ ID NO: 386957 - DNA, 16 bp, M. musculus
cccagctcctcagccc

SEQ ID NO: 386958 - DNA, 16 bp, M. musculus
cccagctcctccctgg

SEQ ID NO: 386959 - DNA, 16 bp, M. musculus
cccagctcctcctcct

SEQ ID NO: 386960 - DNA, 16 bp, M. musculus
cccagctcctcctgca

SEQ ID NO: 386961 - DNA, 16 bp, M. musculus
cccagctcctgcctcc

SEQ ID NO: 386962 - DNA, 16 bp, M. musculus
cccagctctcaggagg

SEQ ID NO: 386963 - DNA, 16 bp, M. musculus
cccagctctgaagaaa

SEQ ID NO: 386964 - DNA, 16 bp, M. musculus
cccagctctgggaagg

SEQ ID NO: 386965 - DNA, 16 bp, M. musculus
cccagctctggggaga

SEQ ID NO: 386966 - DNA, 16 bp, M. musculus
cccagctctggggagg

SEQ ID NO: 386967 - DNA, 16 bp, M. musculus
cccagctctggtactt

SEQ ID NO: 386968 - DNA, 16 bp, M. musculus
cccagctctgtcccct

SEQ ID NO: 386969 - DNA, 16 bp, M. musculus
cccagctgagttattt

SEQ ID NO: 386970 - DNA, 16 bp, M. musculus
cccagctgcagcagga

SEQ ID NO: 386971 - DNA, 16 bp, M. musculus
cccagctgcaggtgac

SEQ ID NO: 386972 - DNA, 16 bp, M. musculus
cccagctgccattcct

SEQ ID NO: 386973 - DNA, 16 bp, M. musculus
cccagctgcctgcact

SEQ ID NO: 386974 - DNA, 16 bp, M. musculus
cccagctgctcaggag

SEQ ID NO: 386975 - DNA, 16 bp, M. musculus
cccagctgctccactg

SEQ ID NO: 386976 - DNA, 16 bp, M. musculus
cccagctgcttcagga

SEQ ID NO: 386977 - DNA, 16 bp, M. musculus
cccagctggcctagaa

SEQ ID NO: 386978 - DNA, 16 bp, M. musculus
cccagctggggcagtc

SEQ ID NO: 386979 - DNA, 16 bp, M. musculus
cccagctgtcagcctc

SEQ ID NO: 386980 - DNA, 16 bp, M. musculus
cccagctgtcttggaa

SEQ ID NO: 386981 - DNA, 16 bp, M. musculus
cccagctgtggttgct

SEQ ID NO: 386982 - DNA, 16 bp, M. musculus
cccagcttcctcaagg

SEQ ID NO: 386983 - DNA, 16 bp, M. musculus
cccagcttctgtccat

SEQ ID NO: 386984 - DNA, 16 bp, M. musculus
cccagcttgagaccca

SEQ ID NO: 386985 - DNA, 16 bp, M. musculus
cccaggaaaaacggca

SEQ ID NO: 386986 - DNA, 16 bp, M. musculus
cccaggaaacagaggc

SEQ ID NO: 386987 - DNA, 16 bp, M. musculus
cccaggaaactgaggc

SEQ ID NO: 386988 - DNA, 16 bp, M. musculus
cccaggaaatccagga

SEQ ID NO: 386989 - DNA, 16 bp, M. musculus
cccaggaacacacaca

SEQ ID NO: 386990 - DNA, 16 bp, M. musculus
cccaggaagcaggagt

SEQ ID NO: 386991 - DNA, 16 bp, M. musculus
cccaggaagtgcagga

SEQ ID NO: 386992 - DNA, 16 bp, M. musculus
cccaggaatcaatggg

SEQ ID NO: 386993 - DNA, 16 bp, M. musculus
cccaggaatccacctg

SEQ ID NO: 386994 - DNA, 16 bp, M. musculus
cccaggacacaacagg

SEQ ID NO: 386995 - DNA, 16 bp, M. musculus
cccaggacatcagaag

SEQ ID NO: 386996 - DNA, 22 bp, M. musculus
cccaggacatcagtgaggcctt

SEQ ID NO: 386997 - DNA, 16 bp, M. musculus
cccaggaccaccagac

SEQ ID NO: 386998 - DNA, 16 bp, M. musculus
cccaggaccaccagca

SEQ ID NO: 386999 - DNA, 16 bp, M. musculus
cccaggaccaccaggc

SEQ ID NO: 387000 - DNA, 16 bp, M. musculus
cccaggaccaccttcc

SEQ ID NO: 387001 - DNA, 16 bp, M. musculus
cccaggaccagacgga

SEQ ID NO: 387002 - DNA, 16 bp, M. musculus
cccaggacccaacaga

SEQ ID NO: 387003 - DNA, 16 bp, M. musculus
cccaggacccacagag

SEQ ID NO: 387004 - DNA, 16 bp, M. musculus
cccaggacccacatga

SEQ ID NO: 387005 - DNA, 16 bp, M. musculus
cccaggacccacatgg

SEQ ID NO: 387006 - DNA, 16 bp, M. musculus
cccaggacccagtggg

SEQ ID NO: 387007 - DNA, 16 bp, M. musculus
cccaggacccagtggt

SEQ ID NO: 387008 - DNA, 16 bp, M. musculus
cccaggacccatatgg

SEQ ID NO: 387009 - DNA, 16 bp, M. musculus
cccaggaccccacagg

SEQ ID NO: 387010 - DNA, 16 bp, M. musculus
cccaggacctacatgg

SEQ ID NO: 387011 - DNA, 16 bp, M. musculus
cccaggaccttgcaca

SEQ ID NO: 387012 - DNA, 16 bp, M. musculus
cccaggactcaaagga

SEQ ID NO: 387013 - DNA, 16 bp, M. musculus
cccaggactgggtggg

SEQ ID NO: 387014 - DNA, 16 bp, M. musculus
cccaggactgtgtggt

SEQ ID NO: 387015 - DNA, 16 bp, M. musculus
cccaggagacagagac

SEQ ID NO: 387016 - DNA, 16 bp, M. musculus
cccaggagacagaggc

SEQ ID NO: 387017 - DNA, 23 bp, M. musculus
cccaggagaggtattgctggatc

SEQ ID NO: 387018 - DNA, 16 bp, M. musculus
cccaggagataaagcc

SEQ ID NO: 387019 - DNA, 16 bp, M. musculus
cccaggagcactggag

SEQ ID NO: 387020 - DNA, 16 bp, M. musculus
cccaggagctcccagg

SEQ ID NO: 387021 - DNA, 16 bp, M. musculus
cccaggaggaaaagga

SEQ ID NO: 387022 - DNA, 16 bp, M. musculus
cccaggaggaggaaga

SEQ ID NO: 387023 - DNA, 16 bp, M. musculus
cccaggaggcaaaggc

SEQ ID NO: 387024 - DNA, 16 bp, M. musculus
cccaggaggccagaag

SEQ ID NO: 387025 - DNA, 16 bp, M. musculus
cccaggaggctgaggc

SEQ ID NO: 387026 - DNA, 17 bp, M. musculus
cccaggaggcttttgcc

SEQ ID NO: 387027 - DNA, 16 bp, M. musculus
cccaggagttgtatag

SEQ ID NO: 387028 - DNA, 36 bp, M. musculus
cccaggagtttgggaaggacctcggataaaatagag

SEQ ID NO: 387029 - DNA, 16 bp, M. musculus
cccaggagtttggtca

SEQ ID NO: 387030 - DNA, 16 bp, M. musculus
cccaggatcaaactca

SEQ ID NO: 387031 - DNA, 16 bp, M. musculus
cccaggatcttgagat

SEQ ID NO: 387032 - DNA, 16 bp, M. musculus
cccaggatgctgaggt

SEQ ID NO: 387033 - DNA, 16 bp, M. musculus
cccaggattgttttaa

SEQ ID NO: 387034 - DNA, 16 bp, M. musculus
cccaggcagcacagtg

SEQ ID NO: 387035 - DNA, 16 bp, M. musculus
cccaggccaccctgga

SEQ ID NO: 387036 - DNA, 16 bp, M. musculus
cccaggccagcctgga

SEQ ID NO: 387037 - DNA, 16 bp, M. musculus
cccaggccaggcagtg

SEQ ID NO: 387038 - DNA, 16 bp, M. musculus
cccaggccagtgagag

SEQ ID NO: 387039 - DNA, 16 bp, M. musculus
cccaggccctctggaa

SEQ ID NO: 387040 - DNA, 16 bp, M. musculus
cccaggcctctgctgc

SEQ ID NO: 387041 - DNA, 16 bp, M. musculus
cccaggcctggggaaa

SEQ ID NO: 387042 - DNA, 18 bp, M. musculus
cccaggctagcctggaac

SEQ ID NO: 387043 - DNA, 18 bp, M. musculus
cccaggctagccttgaac

SEQ ID NO: 387044 - DNA, 16 bp, M. musculus
cccaggctcccaggct

SEQ ID NO: 387045 - DNA, 16 bp, M. musculus
cccaggctgaacttga

SEQ ID NO: 387046 - DNA, 16 bp, M. musculus
cccaggctgacctcca

SEQ ID NO: 387047 - DNA, 16 bp, M. musculus
cccaggctgaccttca

SEQ ID NO: 387048 - DNA, 16 bp, M. musculus
cccaggctgccctgga

SEQ ID NO: 387049 - DNA, 16 bp, M. musculus
cccaggctgcctttga

SEQ ID NO: 387050 - DNA, 16 bp, M. musculus
cccaggctgctgcctc

SEQ ID NO: 387051 - DNA, 16 bp, M. musculus
cccaggctggagagat

SEQ ID NO: 387052 - DNA, 16 bp, M. musculus
cccaggctggcattga

SEQ ID NO: 387053 - DNA, 16 bp, M. musculus
cccaggctggccagga

SEQ ID NO: 387054 - DNA, 16 bp, M. musculus
cccaggctggccccca

SEQ ID NO: 387055 - DNA, 16 bp, M. musculus
cccaggctggcctgga

SEQ ID NO: 387056 - DNA, 16 bp, M. musculus
cccaggctggctatga

SEQ ID NO: 387057 - DNA, 16 bp, M. musculus
cccaggctggctcaga

SEQ ID NO: 387058 - DNA, 16 bp, M. musculus
cccaggctggctctga

SEQ ID NO: 387059 - DNA, 16 bp, M. musculus
cccaggctggctttga

SEQ ID NO: 387060 - DNA, 16 bp, M. musculus
cccaggctggtctcag

SEQ ID NO: 387061 - DNA, 16 bp, M. musculus
cccaggctgtccttga

SEQ ID NO: 387062 - DNA, 16 bp, M. musculus
cccaggcttctcagcc

SEQ ID NO: 387063 - DNA, 16 bp, M. musculus
cccagggaactctgga

SEQ ID NO: 387064 - DNA, 16 bp, M. musculus
cccagggaagagcaca

SEQ ID NO: 387065 - DNA, 16 bp, M. musculus
cccagggaaggcacca

SEQ ID NO: 387066 - DNA, 16 bp, M. musculus
cccagggaatggcact

SEQ ID NO: 387067 - DNA, 16 bp, M. musculus
cccagggacaaaagag

SEQ ID NO: 387068 - DNA, 16 bp, M. musculus
cccagggacagagaga

SEQ ID NO: 387069 - DNA, 16 bp, M. musculus
cccagggacagcacca

SEQ ID NO: 387070 - DNA, 16 bp, M. musculus
cccagggagccctggg

SEQ ID NO: 387071 - DNA, 16 bp, M. musculus
cccagggagcctcctg

SEQ ID NO: 387072 - DNA, 16 bp, M. musculus
cccagggagctccagg

SEQ ID NO: 387073 - DNA, 16 bp, M. musculus
cccagggagcttccag

SEQ ID NO: 387074 - DNA, 16 bp, M. musculus
cccagggaggcagagg

SEQ ID NO: 387075 - DNA, 16 bp, M. musculus
cccagggaggccagaa

SEQ ID NO: 387076 - DNA, 16 bp, M. musculus
cccagggaggggctgg

SEQ ID NO: 387077 - DNA, 16 bp, M. musculus
cccagggagtgaggag

SEQ ID NO: 387078 - DNA, 16 bp, M. musculus
cccagggagtggccct

SEQ ID NO: 387079 - DNA, 16 bp, M. musculus
cccagggatgaagcct

SEQ ID NO: 387080 - DNA, 16 bp, M. musculus
cccagggatgaaggga

SEQ ID NO: 387081 - DNA, 16 bp, M. musculus
cccagggatggcaccg

SEQ ID NO: 387082 - DNA, 16 bp, M. musculus
cccagggcagcatctg

SEQ ID NO: 387083 - DNA, 16 bp, M. musculus
cccagggccacctgcc

SEQ ID NO: 387084 - DNA, 16 bp, M. musculus
cccagggccccccttt

SEQ ID NO: 387085 - DNA, 16 bp, M. musculus
cccagggcctcatgca

SEQ ID NO: 387086 - DNA, 16 bp, M. musculus
cccagggcctccccag

SEQ ID NO: 387087 - DNA, 16 bp, M. musculus
cccagggcctgacact

SEQ ID NO: 387088 - DNA, 16 bp, M. musculus
cccagggcctgtgcat

SEQ ID NO: 387089 - DNA, 16 bp, M. musculus
cccagggctaccagcc

SEQ ID NO: 387090 - DNA, 16 bp, M. musculus
cccagggctcaggagg

SEQ ID NO: 387091 - DNA, 16 bp, M. musculus
cccagggctcccaggg

SEQ ID NO: 387092 - DNA, 16 bp, M. musculus
cccagggctctcatcc

SEQ ID NO: 387093 - DNA, 16 bp, M. musculus
cccagggcttcatgaa

SEQ ID NO: 387094 - DNA, 16 bp, M. musculus
cccagggcttcctggc

SEQ ID NO: 387095 - DNA, 16 bp, M. musculus
cccaggggatctgaca

SEQ ID NO: 387096 - DNA, 16 bp, M. musculus
cccaggggcttgatgg

SEQ ID NO: 387097 - DNA, 16 bp, M. musculus
cccaggggtcagagca

SEQ ID NO: 387098 - DNA, 16 bp, M. musculus
cccagggtcttgcaca

SEQ ID NO: 387099 - DNA, 16 bp, M. musculus
cccagggtggcctgga

SEQ ID NO: 387100 - DNA, 16 bp, M. musculus
cccagggttccatccc

SEQ ID NO: 387101 - DNA, 16 bp, M. musculus
cccaggtcaggctggg

SEQ ID NO: 387102 - DNA, 16 bp, M. musculus
cccaggtcctccccac

SEQ ID NO: 387103 - DNA, 16 bp, M. musculus
cccaggtcctctggaa

SEQ ID NO: 387104 - DNA, 16 bp, M. musculus
cccaggtctctgttgc

SEQ ID NO: 387105 - DNA, 17 bp, M. musculus
cccaggtctgctgagag

SEQ ID NO: 387106 - DNA, 16 bp, M. musculus
cccaggtgcatgctgt

SEQ ID NO: 387107 - DNA, 16 bp, M. musculus
cccaggtgctggcatt

SEQ ID NO: 387108 - DNA, 16 bp, M. musculus
cccaggtgctgggatg

SEQ ID NO: 387109 - DNA, 16 bp, M. musculus
cccaggtggcagccca

SEQ ID NO: 387110 - DNA, 16 bp, M. musculus
cccaggtggccacctc

SEQ ID NO: 387111 - DNA, 16 bp, M. musculus
cccaggtggtactgat

SEQ ID NO: 387112 - DNA, 16 bp, M. musculus
cccaggtgtggtggca

SEQ ID NO: 387113 - DNA, 16 bp, M. musculus
cccaggttagttgact

SEQ ID NO: 387114 - DNA, 16 bp, M. musculus
cccaggttcagttcct

SEQ ID NO: 387115 - DNA, 16 bp, M. musculus
cccaggttctgggatt

SEQ ID NO: 387116 - DNA, 16 bp, M. musculus
cccaggttgctttggt

SEQ ID NO: 387117 - DNA, 16 bp, M. musculus
cccaggttggcctcaa

SEQ ID NO: 387118 - DNA, 16 bp, M. musculus
cccaggtttggttcct

SEQ ID NO: 387119 - DNA, 16 bp, M. musculus
cccagtacaggggaaa

SEQ ID NO: 387120 - DNA, 16 bp, M. musculus
cccagtaccacataaa

SEQ ID NO: 387121 - DNA, 16 bp, M. musculus
cccagtacccacataa

SEQ ID NO: 387122 - DNA, 16 bp, M. musculus
cccagtacccacattg

SEQ ID NO: 387123 - DNA, 16 bp, M. musculus
cccagtactcatgagg

SEQ ID NO: 387124 - DNA, 16 bp, M. musculus
cccagtactgaagaga

SEQ ID NO: 387125 - DNA, 16 bp, M. musculus
cccagtactgcaaaaa

SEQ ID NO: 387126 - DNA, 16 bp, M. musculus
cccagtaggaaactct

SEQ ID NO: 387127 - DNA, 16 bp, M. musculus
cccagtatttggaagg

SEQ ID NO: 387128 - DNA, 16 bp, M. musculus
cccagtcacctcctcc

SEQ ID NO: 387129 - DNA, 16 bp, M. musculus
cccagtcagaatgact

SEQ ID NO: 387130 - DNA, 16 bp, M. musculus
cccagtcaggaagcag

SEQ ID NO: 387131 - DNA, 16 bp, M. musculus
cccagtccagggcacc

SEQ ID NO: 387132 - DNA, 16 bp, M. musculus
cccagtcccagtccca

SEQ ID NO: 387133 - DNA, 16 bp, M. musculus
cccagtcctgctcccc

SEQ ID NO: 387134 - DNA, 16 bp, M. musculus
cccagtctctcctccc

SEQ ID NO: 387135 - DNA, 16 bp, M. musculus
cccagtctggcctcag

SEQ ID NO: 387136 - DNA, 16 bp, M. musculus
cccagtctggccttga

SEQ ID NO: 387137 - DNA, 16 bp, M. musculus
cccagtgaaccatctc

SEQ ID NO: 387138 - DNA, 16 bp, M. musculus
cccagtgacacagttc

SEQ ID NO: 387139 - DNA, 16 bp, M. musculus
cccagtgacatgcctc

SEQ ID NO: 387140 - DNA, 16 bp, M. musculus
cccagtgagaggctgg

SEQ ID NO: 387141 - DNA, 16 bp, M. musculus
cccagtgatccatcca

SEQ ID NO: 387142 - DNA, 16 bp, M. musculus
cccagtgatcctcctg

SEQ ID NO: 387143 - DNA, 16 bp, M. musculus
cccagtgcccagtgcc

SEQ ID NO: 387144 - DNA, 16 bp, M. musculus
cccagtgccctcttct

SEQ ID NO: 387145 - DNA, 16 bp, M. musculus
cccagtgctggagtgg

SEQ ID NO: 387146 - DNA, 16 bp, M. musculus
cccagtgctggggaga

SEQ ID NO: 387147 - DNA, 16 bp, M. musculus
cccagtgctggggagg

SEQ ID NO: 387148 - DNA, 16 bp, M. musculus
cccagtgctggggctg

SEQ ID NO: 387149 - DNA, 16 bp, M. musculus
cccagtgctggggtga

SEQ ID NO: 387150 - DNA, 16 bp, M. musculus
cccagtgcttggaagg

SEQ ID NO: 387151 - DNA, 16 bp, M. musculus
cccagtgcttgtgtca

SEQ ID NO: 387152 - DNA, 16 bp, M. musculus
cccagtggccacacct

SEQ ID NO: 387153 - DNA, 16 bp, M. musculus
cccagtgtagggcaat

SEQ ID NO: 387154 - DNA, 16 bp, M. musculus
cccagtgtaggggaat

SEQ ID NO: 387155 - DNA, 16 bp, M. musculus
cccagtgtgaaacaca

SEQ ID NO: 387156 - DNA, 16 bp, M. musculus
cccagtgtgggtgctg

SEQ ID NO: 387157 - DNA, 16 bp, M. musculus
cccagtgtgggttctg

SEQ ID NO: 387158 - DNA, 16 bp, M. musculus
cccagtgttgggatta

SEQ ID NO: 387159 - DNA, 16 bp, M. musculus
cccagtgtttgagaga

SEQ ID NO: 387160 - DNA, 16 bp, M. musculus
cccagttaagtgtttt

SEQ ID NO: 387161 - DNA, 16 bp, M. musculus
cccagttccccatccc

SEQ ID NO: 387162 - DNA, 16 bp, M. musculus
cccagttccctccctc

SEQ ID NO: 387163 - DNA, 16 bp, M. musculus
cccagttcctcctccc

SEQ ID NO: 387164 - DNA, 16 bp, M. musculus
cccagttcctggccct

SEQ ID NO: 387165 - DNA, 16 bp, M. musculus
cccagttccttccttc

SEQ ID NO: 387166 - DNA, 16 bp, M. musculus
cccagtttatgtggtg

SEQ ID NO: 387167 - DNA, 16 bp, M. musculus
cccagtttgagttcct

SEQ ID NO: 387168 - DNA, 16 bp, M. musculus
cccagtttggggacaa

SEQ ID NO: 387169 - DNA, 16 bp, M. musculus
cccagtttgtggtttt

SEQ ID NO: 387170 - DNA, 16 bp, M. musculus
cccagttttgttttgt

SEQ ID NO: 387171 - DNA, 16 bp, M. musculus
cccagtttttaatagg

SEQ ID NO: 387172 - DNA, 19 bp, M. musculus
cccataatcagcctccaaa

SEQ ID NO: 387173 - DNA, 19 bp, M. musculus
cccataatcagcttccaaa

SEQ ID NO: 387174 - DNA, 16 bp, M. musculus
cccatacacacatgta

SEQ ID NO: 387175 - DNA, 16 bp, M. musculus
cccatacacataaaat

SEQ ID NO: 387176 - DNA, 16 bp, M. musculus
cccatacctgatcctg

SEQ ID NO: 387177 - DNA, 16 bp, M. musculus
cccatacctggcactg

SEQ ID NO: 387178 - DNA, 16 bp, M. musculus
cccatagaaagaacat

SEQ ID NO: 387179 - DNA, 16 bp, M. musculus
cccataggaagaacaa

SEQ ID NO: 387180 - DNA, 16 bp, M. musculus
cccataggaagaccag

SEQ ID NO: 387181 - DNA, 16 bp, M. musculus
cccataggaagagcag

SEQ ID NO: 387182 - DNA, 16 bp, M. musculus
cccatagtcagtttgt

SEQ ID NO: 387183 - DNA, 16 bp, M. musculus
cccatagtgggctgct

SEQ ID NO: 387184 - DNA, 16 bp, M. musculus
cccatatcaggtagct

SEQ ID NO: 387185 - DNA, 16 bp, M. musculus
cccatatcctgcttct

SEQ ID NO: 387186 - DNA, 16 bp, M. musculus
cccatatgtaaacata

SEQ ID NO: 387187 - DNA, 16 bp, M. musculus
cccatattcctgtaag

SEQ ID NO: 387188 - DNA, 16 bp, M. musculus
cccatcaaaattccag

SEQ ID NO: 387189 - DNA, 16 bp, M. musculus
cccatccactcacagc

SEQ ID NO: 387190 - DNA, 16 bp, M. musculus
cccatccattcatcca

SEQ ID NO: 387191 - DNA, 16 bp, M. musculus
cccatcccacatctgc

SEQ ID NO: 387192 - DNA, 16 bp, M. musculus
cccatcccactgtggg

SEQ ID NO: 387193 - DNA, 16 bp, M. musculus
cccatccccatccctg

SEQ ID NO: 387194 - DNA, 16 bp, M. musculus
cccatcccctctgcct

SEQ ID NO: 387195 - DNA, 16 bp, M. musculus
cccatccctcaaccag

SEQ ID NO: 387196 - DNA, 16 bp, M. musculus
cccatccctcattgct

SEQ ID NO: 387197 - DNA, 16 bp, M. musculus
cccatccctgcttcct

SEQ ID NO: 387198 - DNA, 16 bp, M. musculus
cccatcctaaatcaga

SEQ ID NO: 387199 - DNA, 16 bp, M. musculus
cccatcctttgtttca

SEQ ID NO: 387200 - DNA, 16 bp, M. musculus
cccatctcaaaacaaa

SEQ ID NO: 387201 - DNA, 16 bp, M. musculus
cccatctccaagagga

SEQ ID NO: 387202 - DNA, 16 bp, M. musculus
cccatctccacagtga

SEQ ID NO: 387203 - DNA, 16 bp, M. musculus
cccatctccccctgct

SEQ ID NO: 387204 - DNA, 16 bp, M. musculus
cccatctctccatcac

SEQ ID NO: 387205 - DNA, 16 bp, M. musculus
cccatctctgtctctc

SEQ ID NO: 387206 - DNA, 16 bp, M. musculus
cccatctgctgcagga

SEQ ID NO: 387207 - DNA, 16 bp, M. musculus
cccatctgggaatcca

SEQ ID NO: 387208 - DNA, 16 bp, M. musculus
cccatctggtcctggc

SEQ ID NO: 387209 - DNA, 16 bp, M. musculus
cccatctgtggggtta

SEQ ID NO: 387210 - DNA, 16 bp, M. musculus
cccatctgtgttgtct

SEQ ID NO: 387211 - DNA, 16 bp, M. musculus
cccatcttcagactaa

SEQ ID NO: 387212 - DNA, 16 bp, M. musculus
cccatgaaagccagaa

SEQ ID NO: 387213 - DNA, 16 bp, M. musculus
cccatgacactattaa

SEQ ID NO: 387214 - DNA, 16 bp, M. musculus
cccatgataaaactca

SEQ ID NO: 387215 - DNA, 16 bp, M. musculus
cccatgcacacacaca

SEQ ID NO: 387216 - DNA, 16 bp, M. musculus
cccatgcagcctgccc

SEQ ID NO: 387217 - DNA, 16 bp, M. musculus
cccatgcaggctctgt

SEQ ID NO: 387218 - DNA, 16 bp, M. musculus
cccatgcatgctctct

SEQ ID NO: 387219 - DNA, 16 bp, M. musculus
cccatgccaggcagct

SEQ ID NO: 387220 - DNA, 16 bp, M. musculus
cccatgcctccagagc

SEQ ID NO: 387221 - DNA, 16 bp, M. musculus
cccatgctcactcttt

SEQ ID NO: 387222 - DNA, 16 bp, M. musculus
cccatgctccagtaga

SEQ ID NO: 387223 - DNA, 16 bp, M. musculus
cccatgctggatttcc

SEQ ID NO: 387224 - DNA, 16 bp, M. musculus
cccatggagaccagaa

SEQ ID NO: 387225 - DNA, 16 bp, M. musculus
cccatggctcaagctg

SEQ ID NO: 387226 - DNA, 16 bp, M. musculus
cccatggctccagcta

SEQ ID NO: 387227 - DNA, 16 bp, M. musculus
cccatggctcctgctg

SEQ ID NO: 387228 - DNA, 16 bp, M. musculus
cccatggctctggctg

SEQ ID NO: 387229 - DNA, 16 bp, M. musculus
cccatggcttgcccag

SEQ ID NO: 387230 - DNA, 16 bp, M. musculus
cccatgggaaatggca

SEQ ID NO: 387231 - DNA, 16 bp, M. musculus
cccatgggaagaacaa

SEQ ID NO: 387232 - DNA, 16 bp, M. musculus
cccatgggggatcctg

SEQ ID NO: 387233 - DNA, 16 bp, M. musculus
cccatgggtaccaacc

SEQ ID NO: 387234 - DNA, 16 bp, M. musculus
cccatgtactggggca

SEQ ID NO: 387235 - DNA, 16 bp, M. musculus
cccatgtggtggctca

SEQ ID NO: 387236 - DNA, 16 bp, M. musculus
cccatgtggttgctgg

SEQ ID NO: 387237 - DNA, 16 bp, M. musculus
cccatgtgtgcacatg

SEQ ID NO: 387238 - DNA, 16 bp, M. musculus
cccatgtgtgtgtgtg

SEQ ID NO: 387239 - DNA, 16 bp, M. musculus
cccatgtgttcgagac

SEQ ID NO: 387240 - DNA, 16 bp, M. musculus
cccatgttcccagaaa

SEQ ID NO: 387241 - DNA, 17 bp, M. musculus
cccattaaggatgcagt

SEQ ID NO: 387242 - DNA, 16 bp, M. musculus
cccattagaaaatggg

SEQ ID NO: 387243 - DNA, 16 bp, M. musculus
cccattcacagctgcc

SEQ ID NO: 387244 - DNA, 16 bp, M. musculus
cccattcatctatagt

SEQ ID NO: 387245 - DNA, 16 bp, M. musculus
cccattccatgagatg

SEQ ID NO: 387246 - DNA, 16 bp, M. musculus
cccattccccactgct

SEQ ID NO: 387247 - DNA, 16 bp, M. musculus
cccattcctaaacatg

SEQ ID NO: 387248 - DNA, 16 bp, M. musculus
cccattcctgatcctg

SEQ ID NO: 387249 - DNA, 16 bp, M. musculus
cccattcctgcctccc

SEQ ID NO: 387250 - DNA, 16 bp, M. musculus
cccattcctggccctg

SEQ ID NO: 387251 - DNA, 16 bp, M. musculus
cccattcctggctctg

SEQ ID NO: 387252 - DNA, 16 bp, M. musculus
cccattcctggttctg

SEQ ID NO: 387253 - DNA, 16 bp, M. musculus
cccattgctccagctg

SEQ ID NO: 387254 - DNA, 16 bp, M. musculus
cccattgtgagtggta

SEQ ID NO: 387255 - DNA, 16 bp, M. musculus
cccattgtgggtgggg

SEQ ID NO: 387256 - DNA, 16 bp, M. musculus
cccattgtgtcctgga

SEQ ID NO: 387257 - DNA, 16 bp, M. musculus
cccattgtgtgtgtgt

SEQ ID NO: 387258 - DNA, 16 bp, M. musculus
cccatttaaaaatggg

SEQ ID NO: 387259 - DNA, 16 bp, M. musculus
cccatttcacagagga

SEQ ID NO: 387260 - DNA, 16 bp, M. musculus
cccatttcttggccct

SEQ ID NO: 387261 - DNA, 16 bp, M. musculus
cccatttgtcaatcct

SEQ ID NO: 387262 - DNA, 16 bp, M. musculus
cccattttacagagaa

SEQ ID NO: 387263 - DNA, 16 bp, M. musculus
cccattttacagataa

SEQ ID NO: 387264 - DNA, 16 bp, M. musculus
cccattttcttccagg

SEQ ID NO: 387265 - DNA, 16 bp, M. musculus
cccattttttaatgag

SEQ ID NO: 387266 - DNA, 16 bp, M. musculus
ccccaaaatcaaaggc

SEQ ID NO: 387267 - DNA, 16 bp, M. musculus
ccccaaacatggtcag

SEQ ID NO: 387268 - DNA, 17 bp, M. musculus
ccccaaaccaggaacct

SEQ ID NO: 387269 - DNA, 16 bp, M. musculus
ccccaaagatgctcca

SEQ ID NO: 387270 - DNA, 16 bp, M. musculus
ccccaaagctcagaat

SEQ ID NO: 387271 - DNA, 16 bp, M. musculus
ccccaaagctgttgcc

SEQ ID NO: 387272 - DNA, 16 bp, M. musculus
ccccaaaggaagaaca

SEQ ID NO: 387273 - DNA, 16 bp, M. musculus
ccccaaaggggttgtg

SEQ ID NO: 387274 - DNA, 16 bp, M. musculus
ccccaaagtcccccag

SEQ ID NO: 387275 - DNA, 16 bp, M. musculus
ccccaaatgcaagggc

SEQ ID NO: 387276 - DNA, 16 bp, M. musculus
ccccaacaaacctgca

SEQ ID NO: 387277 - DNA, 16 bp, M. musculus
ccccaacatctaccct

SEQ ID NO: 387278 - DNA, 16 bp, M. musculus
ccccaaccctgcttcc

SEQ ID NO: 387279 - DNA, 16 bp, M. musculus
ccccaacctcaagctg

SEQ ID NO: 387280 - DNA, 18 bp, M. musculus
ccccaacctgaagtcagt

SEQ ID NO: 387281 - DNA, 16 bp, M. musculus
ccccaaccttcagctc

SEQ ID NO: 387282 - DNA, 16 bp, M. musculus
ccccaactcctcccag

SEQ ID NO: 387283 - DNA, 16 bp, M. musculus
ccccaactctaacaac

SEQ ID NO: 387284 - DNA, 16 bp, M. musculus
ccccaacttctcccag

SEQ ID NO: 387285 - DNA, 16 bp, M. musculus
ccccaagagcaggaag

SEQ ID NO: 387286 - DNA, 16 bp, M. musculus
ccccaagagctctttc

SEQ ID NO: 387287 - DNA, 16 bp, M. musculus
ccccaagattgtgttg

SEQ ID NO: 387288 - DNA, 16 bp, M. musculus
ccccaaggaaggagct

SEQ ID NO: 387289 - DNA, 16 bp, M. musculus
ccccaagggccagcag

SEQ ID NO: 387290 - DNA, 16 bp, M. musculus
ccccaagtgctggaat

SEQ ID NO: 387291 - DNA, 16 bp, M. musculus
ccccaatagccctgag

SEQ ID NO: 387292 - DNA, 16 bp, M. musculus
ccccaatggagtagct

SEQ ID NO: 387293 - DNA, 16 bp, M. musculus
ccccacagacttgcct

SEQ ID NO: 387294 - DNA, 16 bp, M. musculus
ccccacagccatgccc

SEQ ID NO: 387295 - DNA, 16 bp, M. musculus
ccccacagcctttgtg

SEQ ID NO: 387296 - DNA, 16 bp, M. musculus
ccccacaggaagacca

SEQ ID NO: 387297 - DNA, 16 bp, M. musculus
ccccacaggagaggct

SEQ ID NO: 387298 - DNA, 16 bp, M. musculus
ccccacagtgacacac

SEQ ID NO: 387299 - DNA, 16 bp, M. musculus
ccccacatgctctccc

SEQ ID NO: 387300 - DNA, 16 bp, M. musculus
ccccaccaaggaccag

SEQ ID NO: 387301 - DNA, 16 bp, M. musculus
ccccaccaccaccagt

SEQ ID NO: 387302 - DNA, 16 bp, M. musculus
ccccaccagacttccc

SEQ ID NO: 387303 - DNA, 16 bp, M. musculus
ccccaccagcatccct

SEQ ID NO: 387304 - DNA, 16 bp, M. musculus
ccccaccaggttccct

SEQ ID NO: 387305 - DNA, 16 bp, M. musculus
ccccaccatgccacag

SEQ ID NO: 387306 - DNA, 16 bp, M. musculus
ccccaccccagctctg

SEQ ID NO: 387307 - DNA, 16 bp, M. musculus
ccccaccccaggatcc

SEQ ID NO: 387308 - DNA, 16 bp, M. musculus
ccccacccccagatct

SEQ ID NO: 387309 - DNA, 16 bp, M. musculus
ccccacccccatgctg

SEQ ID NO: 387310 - DNA, 16 bp, M. musculus
ccccaccccgggatcc

SEQ ID NO: 387311 - DNA, 16 bp, M. musculus
ccccacccctgtgtgt

SEQ ID NO: 387312 - DNA, 16 bp, M. musculus
ccccaccctgctttcc

SEQ ID NO: 387313 - DNA, 16 bp, M. musculus
ccccacctcaccagac

SEQ ID NO: 387314 - DNA, 16 bp, M. musculus
ccccacctcctgtctc

SEQ ID NO: 387315 - DNA, 16 bp, M. musculus
ccccacctgaggaagt

SEQ ID NO: 387316 - DNA, 16 bp, M. musculus
ccccacctggagatct

SEQ ID NO: 387317 - DNA, 16 bp, M. musculus
ccccacctgggaattc

SEQ ID NO: 387318 - DNA, 16 bp, M. musculus
ccccacctggggattc

SEQ ID NO: 387319 - DNA, 22 bp, M. musculus
ccccacgggagattgtgcaggg

SEQ ID NO: 387320 - DNA, 16 bp, M. musculus
ccccactccaccagac

SEQ ID NO: 387321 - DNA, 16 bp, M. musculus
ccccactcctcctgct

SEQ ID NO: 387322 - DNA, 16 bp, M. musculus
ccccactctagttgtt

SEQ ID NO: 387323 - DNA, 16 bp, M. musculus
ccccactctggcacat

SEQ ID NO: 387324 - DNA, 16 bp, M. musculus
ccccactgcagggcat

SEQ ID NO: 387325 - DNA, 16 bp, M. musculus
ccccactggaggagct

SEQ ID NO: 387326 - DNA, 16 bp, M. musculus
ccccagaaaattcaga

SEQ ID NO: 387327 - DNA, 16 bp, M. musculus
ccccagaacccacagt

SEQ ID NO: 387328 - DNA, 16 bp, M. musculus
ccccagaacccacgtg

SEQ ID NO: 387329 - DNA, 16 bp, M. musculus
ccccagaacctgagac

SEQ ID NO: 387330 - DNA, 16 bp, M. musculus
ccccagaactcatgtc

SEQ ID NO: 387331 - DNA, 16 bp, M. musculus
ccccagaactcctagg

SEQ ID NO: 387332 - DNA, 16 bp, M. musculus
ccccagaagctctgtg

SEQ ID NO: 387333 - DNA, 16 bp, M. musculus
ccccagaagctgatga

SEQ ID NO: 387334 - DNA, 16 bp, M. musculus
ccccagaatccacata

SEQ ID NO: 387335 - DNA, 16 bp, M. musculus
ccccagagacttcatc

SEQ ID NO: 387336 - DNA, 16 bp, M. musculus
ccccagagcacccagg

SEQ ID NO: 387337 - DNA, 16 bp, M. musculus
ccccagagctatgtct

SEQ ID NO: 387338 - DNA, 16 bp, M. musculus
ccccagagctcactgg

SEQ ID NO: 387339 - DNA, 16 bp, M. musculus
ccccagagctcccagg

SEQ ID NO: 387340 - DNA, 16 bp, M. musculus
ccccagagctcctgtc

SEQ ID NO: 387341 - DNA, 16 bp, M. musculus
ccccagagctgaccct

SEQ ID NO: 387342 - DNA, 16 bp, M. musculus
ccccagagctgtgcct

SEQ ID NO: 387343 - DNA, 16 bp, M. musculus
ccccagagcttcttgg

SEQ ID NO: 387344 - DNA, 16 bp, M. musculus
ccccagaggactctct

SEQ ID NO: 387345 - DNA, 16 bp, M. musculus
ccccagagtttccagg

SEQ ID NO: 387346 - DNA, 16 bp, M. musculus
ccccagatcaggcctg

SEQ ID NO: 387347 - DNA, 16 bp, M. musculus
ccccagatgctgtggc

SEQ ID NO: 387348 - DNA, 16 bp, M. musculus
ccccagcaacagtttc

SEQ ID NO: 387349 - DNA, 16 bp, M. musculus
ccccagcaaccacatg

SEQ ID NO: 387350 - DNA, 16 bp, M. musculus
ccccagcacaggggaa

SEQ ID NO: 387351 - DNA, 16 bp, M. musculus
ccccagcaccaggtca

SEQ ID NO: 387352 - DNA, 16 bp, M. musculus
ccccagcacccacgtg

SEQ ID NO: 387353 - DNA, 16 bp, M. musculus
ccccagcactcgggag

SEQ ID NO: 387354 - DNA, 16 bp, M. musculus
ccccagcactgaggaa

SEQ ID NO: 387355 - DNA, 16 bp, M. musculus
ccccagcactgtggag

SEQ ID NO: 387356 - DNA, 16 bp, M. musculus
ccccagcagcaaggac

SEQ ID NO: 387357 - DNA, 16 bp, M. musculus
ccccagcagccatcaa

SEQ ID NO: 387358 - DNA, 16 bp, M. musculus
ccccagcagcctgcat

SEQ ID NO: 387359 - DNA, 16 bp, M. musculus
ccccagcagttctttt

SEQ ID NO: 387360 - DNA, 16 bp, M. musculus
ccccagcatcaaaggt

SEQ ID NO: 387361 - DNA, 16 bp, M. musculus
ccccagcatcccccag

SEQ ID NO: 387362 - DNA, 16 bp, M. musculus
ccccagcattcccctg

SEQ ID NO: 387363 - DNA, 16 bp, M. musculus
ccccagccaatgacct

SEQ ID NO: 387364 - DNA, 16 bp, M. musculus
ccccagccactggttg

SEQ ID NO: 387365 - DNA, 16 bp, M. musculus
ccccagcccacagctc

SEQ ID NO: 387366 - DNA, 16 bp, M. musculus
ccccagccccagctca

SEQ ID NO: 387367 - DNA, 16 bp, M. musculus
ccccagcccctgctct

SEQ ID NO: 387368 - DNA, 16 bp, M. musculus
ccccagccccttcctg

SEQ ID NO: 387369 - DNA, 16 bp, M. musculus
ccccagccctgggaag

SEQ ID NO: 387370 - DNA, 16 bp, M. musculus
ccccagcccttccctg

SEQ ID NO: 387371 - DNA, 16 bp, M. musculus
ccccagcctcccaaat

SEQ ID NO: 387372 - DNA, 16 bp, M. musculus
ccccagcctcccaagc

SEQ ID NO: 387373 - DNA, 16 bp, M. musculus
ccccagcgcctctgtg

SEQ ID NO: 387374 - DNA, 16 bp, M. musculus
ccccagctatcctgga

SEQ ID NO: 387375 - DNA, 16 bp, M. musculus
ccccagctcctcacct

SEQ ID NO: 387376 - DNA, 16 bp, M. musculus
ccccagctcctgggtg

SEQ ID NO: 387377 - DNA, 16 bp, M. musculus
ccccagctggtggtgc

SEQ ID NO: 387378 - DNA, 16 bp, M. musculus
ccccagcttcagggga

SEQ ID NO: 387379 - DNA, 16 bp, M. musculus
ccccagcttccttcct

SEQ ID NO: 387380 - DNA, 16 bp, M. musculus
ccccagcttctctttc

SEQ ID NO: 387381 - DNA, 16 bp, M. musculus
ccccaggaagtgcagg

SEQ ID NO: 387382 - DNA, 16 bp, M. musculus
ccccaggagctccagg

SEQ ID NO: 387383 - DNA, 16 bp, M. musculus
ccccaggagctcctgg

SEQ ID NO: 387384 - DNA, 16 bp, M. musculus
ccccaggagtttggga

SEQ ID NO: 387385 - DNA, 16 bp, M. musculus
ccccaggatccacctg

SEQ ID NO: 387386 - DNA, 16 bp, M. musculus
ccccaggccaagtcaa

SEQ ID NO: 387387 - DNA, 16 bp, M. musculus
ccccaggctcagtcca

SEQ ID NO: 387388 - DNA, 16 bp, M. musculus
ccccaggctgacctca

SEQ ID NO: 387389 - DNA, 16 bp, M. musculus
ccccaggctggcctgg

SEQ ID NO: 387390 - DNA, 16 bp, M. musculus
ccccagggacctgcct

SEQ ID NO: 387391 - DNA, 16 bp, M. musculus
ccccagggacctttcc

SEQ ID NO: 387392 - DNA, 16 bp, M. musculus
ccccagggaggagctg

SEQ ID NO: 387393 - DNA, 16 bp, M. musculus
ccccagggatcctcct

SEQ ID NO: 387394 - DNA, 16 bp, M. musculus
ccccagggccaaaggg

SEQ ID NO: 387395 - DNA, 16 bp, M. musculus
ccccagggcctttgca

SEQ ID NO: 387396 - DNA, 16 bp, M. musculus
ccccaggtatttttcc

SEQ ID NO: 387397 - DNA, 16 bp, M. musculus
ccccaggtcaggcccc

SEQ ID NO: 387398 - DNA, 16 bp, M. musculus
ccccagtacaggggaa

SEQ ID NO: 387399 - DNA, 16 bp, M. musculus
ccccagtccaccctct

SEQ ID NO: 387400 - DNA, 16 bp, M. musculus
ccccagtcccagaaaa

SEQ ID NO: 387401 - DNA, 16 bp, M. musculus
ccccagtctctgcctc

SEQ ID NO: 387402 - DNA, 16 bp, M. musculus
ccccagtcttcccagg

SEQ ID NO: 387403 - DNA, 16 bp, M. musculus
ccccagtgaaggagct

SEQ ID NO: 387404 - DNA, 16 bp, M. musculus
ccccagtgaagggctg

SEQ ID NO: 387405 - DNA, 16 bp, M. musculus
ccccagtggggcagtc

SEQ ID NO: 387406 - DNA, 16 bp, M. musculus
ccccagttctgggatt

SEQ ID NO: 387407 - DNA, 16 bp, M. musculus
ccccatatcctttctt

SEQ ID NO: 387408 - DNA, 16 bp, M. musculus
ccccatatgaggaaca

SEQ ID NO: 387409 - DNA, 16 bp, M. musculus
ccccatcaaaattaca

SEQ ID NO: 387410 - DNA, 16 bp, M. musculus
ccccatcaccccagtc

SEQ ID NO: 387411 - DNA, 16 bp, M. musculus
ccccatcagaggagag

SEQ ID NO: 387412 - DNA, 16 bp, M. musculus
ccccatcccacatctg

SEQ ID NO: 387413 - DNA, 16 bp, M. musculus
ccccatcccacctgac

SEQ ID NO: 387414 - DNA, 16 bp, M. musculus
ccccatccctgcctct

SEQ ID NO: 387415 - DNA, 16 bp, M. musculus
ccccatccttgccagc

SEQ ID NO: 387416 - DNA, 16 bp, M. musculus
ccccatctatgaactg

SEQ ID NO: 387417 - DNA, 17 bp, M. musculus
ccccatctgtgtgtgtg

SEQ ID NO: 387418 - DNA, 16 bp, M. musculus
ccccatgccctcttct

SEQ ID NO: 387419 - DNA, 16 bp, M. musculus
ccccatgctcaatcca

SEQ ID NO: 387420 - DNA, 16 bp, M. musculus
ccccatgctcccagaa

SEQ ID NO: 387421 - DNA, 16 bp, M. musculus
ccccatggagtttaga

SEQ ID NO: 387422 - DNA, 16 bp, M. musculus
ccccatggatgtgtgc

SEQ ID NO: 387423 - DNA, 16 bp, M. musculus
ccccatggggctgcaa

SEQ ID NO: 387424 - DNA, 19 bp, M. musculus
ccccattacagatggttgt

SEQ ID NO: 387425 - DNA, 18 bp, M. musculus
ccccattggcccaagtta

SEQ ID NO: 387426 - DNA, 16 bp, M. musculus
ccccattttatagatg

SEQ ID NO: 387427 - DNA, 16 bp, M. musculus
ccccatttttaaatag

SEQ ID NO: 387428 - DNA, 16 bp, M. musculus
ccccatttttaatagc

SEQ ID NO: 387429 - DNA, 16 bp, M. musculus
ccccatttttgatagg

SEQ ID NO: 387430 - DNA, 16 bp, M. musculus
cccccaaaaaaaagat

SEQ ID NO: 387431 - DNA, 16 bp, M. musculus
cccccaaaacatggtc

SEQ ID NO: 387432 - DNA, 16 bp, M. musculus
cccccaaagggagacc

SEQ ID NO: 387433 - DNA, 16 bp, M. musculus
cccccaacaactggag

SEQ ID NO: 387434 - DNA, 16 bp, M. musculus
cccccaaccataagat

SEQ ID NO: 387435 - DNA, 16 bp, M. musculus
cccccaacttgctttt

SEQ ID NO: 387436 - DNA, 16 bp, M. musculus
cccccaagctcccagg

SEQ ID NO: 387437 - DNA, 16 bp, M. musculus
cccccaaggctgtcaa

SEQ ID NO: 387438 - DNA, 16 bp, M. musculus
cccccaagggtccagg

SEQ ID NO: 387439 - DNA, 16 bp, M. musculus
cccccaatcataaaat

SEQ ID NO: 387440 - DNA, 17 bp, M. musculus
cccccaatgaggggctg

SEQ ID NO: 387441 - DNA, 24 bp, M. musculus
cccccaatgttggctcaacatgct

SEQ ID NO: 387442 - DNA, 16 bp, M. musculus
cccccacccccaggat

SEQ ID NO: 387443 - DNA, 16 bp, M. musculus
cccccacccccaggtt

SEQ ID NO: 387444 - DNA, 16 bp, M. musculus
cccccacccccgtttt

SEQ ID NO: 387445 - DNA, 16 bp, M. musculus
cccccagaattcccag

SEQ ID NO: 387446 - DNA, 16 bp, M. musculus
cccccagactgatgga

SEQ ID NO: 387447 - DNA, 16 bp, M. musculus
cccccagagctcacag

SEQ ID NO: 387448 - DNA, 16 bp, M. musculus
cccccagagctccttg

SEQ ID NO: 387449 - DNA, 16 bp, M. musculus
cccccagagctcgtgt

SEQ ID NO: 387450 - DNA, 16 bp, M. musculus
cccccagagctctttg

SEQ ID NO: 387451 - DNA, 16 bp, M. musculus
cccccagcctgaagcg

SEQ ID NO: 387452 - DNA, 16 bp, M. musculus
cccccagctccttgga

SEQ ID NO: 387453 - DNA, 16 bp, M. musculus
cccccagctctgctcc

SEQ ID NO: 387454 - DNA, 16 bp, M. musculus
cccccagctggctttg

SEQ ID NO: 387455 - DNA, 16 bp, M. musculus
cccccaggcatgccag

SEQ ID NO: 387456 - DNA, 16 bp, M. musculus
cccccaggccctcact

SEQ ID NO: 387457 - DNA, 16 bp, M. musculus
cccccagggccagctc

SEQ ID NO: 387458 - DNA, 16 bp, M. musculus
cccccagggctcccag

SEQ ID NO: 387459 - DNA, 16 bp, M. musculus
cccccagggcttcagt

SEQ ID NO: 387460 - DNA, 16 bp, M. musculus
cccccaggtgctcctg

SEQ ID NO: 387461 - DNA, 16 bp, M. musculus
cccccagtgaagggct

SEQ ID NO: 387462 - DNA, 16 bp, M. musculus
cccccagttaagaaca

SEQ ID NO: 387463 - DNA, 16 bp, M. musculus
cccccataggctcata

SEQ ID NO: 387464 - DNA, 16 bp, M. musculus
cccccatatacacaca

SEQ ID NO: 387465 - DNA, 16 bp, M. musculus
cccccatatctggttg

SEQ ID NO: 387466 - DNA, 16 bp, M. musculus
cccccatctgtctgta

SEQ ID NO: 387467 - DNA, 16 bp, M. musculus
cccccatgcacacaca

SEQ ID NO: 387468 - DNA, 16 bp, M. musculus
cccccatgggtccagg

SEQ ID NO: 387469 - DNA, 18 bp, M. musculus
cccccatgtcagcagatg

SEQ ID NO: 387470 - DNA, 16 bp, M. musculus
cccccatgtgtgtgtg

SEQ ID NO: 387471 - DNA, 16 bp, M. musculus
ccccccaaaaaaaagt

SEQ ID NO: 387472 - DNA, 16 bp, M. musculus
ccccccacacacactg

SEQ ID NO: 387473 - DNA, 16 bp, M. musculus
ccccccagagctcatg

SEQ ID NO: 387474 - DNA, 16 bp, M. musculus
ccccccagagctggtg

SEQ ID NO: 387475 - DNA, 16 bp, M. musculus
ccccccccatgtgtgt

SEQ ID NO: 387476 - DNA, 16 bp, M. musculus
cccccccccaaggctg

SEQ ID NO: 387477 - DNA, 16 bp, M. musculus
cccccccccagggttt

SEQ ID NO: 387478 - DNA, 16 bp, M. musculus
ccccccccccagagtt

SEQ ID NO: 387479 - DNA, 16 bp, M. musculus
ccccccccccaggttg

SEQ ID NO: 387480 - DNA, 16 bp, M. musculus
ccccccccccatttga

SEQ ID NO: 387481 - DNA, 16 bp, M. musculus
cccccctaagtttgac

SEQ ID NO: 387482 - DNA, 16 bp, M. musculus
cccccctttggccctg

SEQ ID NO: 387483 - DNA, 16 bp, M. musculus
cccccgggccagggac

SEQ ID NO: 387484 - DNA, 16 bp, M. musculus
ccccctaccctgcttc

SEQ ID NO: 387485 - DNA, 16 bp, M. musculus
ccccctcagctccttc

SEQ ID NO: 387486 - DNA, 16 bp, M. musculus
ccccctcccagagctc

SEQ ID NO: 387487 - DNA, 16 bp, M. musculus
ccccctcccattctgc

SEQ ID NO: 387488 - DNA, 16 bp, M. musculus
ccccctccctcacttg

SEQ ID NO: 387489 - DNA, 16 bp, M. musculus
ccccctcctctgtgtg

SEQ ID NO: 387490 - DNA, 52 bp, M. musculus
ccccctgaggagcggtgtgtcccaaatgggatagggagcacatatgggtgtt

SEQ ID NO: 387491 - DNA, 16 bp, M. musculus
ccccctgcctcagcct

SEQ ID NO: 387492 - DNA, 16 bp, M. musculus
ccccctgcctcagctc

SEQ ID NO: 387493 - DNA, 16 bp, M. musculus
ccccctgcctcagctt

SEQ ID NO: 387494 - DNA, 16 bp, M. musculus
ccccctgtaactccag

SEQ ID NO: 387495 - DNA, 16 bp, M. musculus
ccccctgtgtactctt

SEQ ID NO: 387496 - DNA, 16 bp, M. musculus
cccccttaccccttgc

SEQ ID NO: 387497 - DNA, 16 bp, M. musculus
cccccttcccagtctc

SEQ ID NO: 387498 - DNA, 16 bp, M. musculus
cccccttccctgaggc

SEQ ID NO: 387499 - DNA, 16 bp, M. musculus
cccccttctaagaggg

SEQ ID NO: 387500 - DNA, 16 bp, M. musculus
cccccttctagcccac

SEQ ID NO: 387501 - DNA, 16 bp, M. musculus
ccccctttttgtttta

SEQ ID NO: 387502 - DNA, 16 bp, M. musculus
ccccgagctcttgtct

SEQ ID NO: 387503 - DNA, 16 bp, M. musculus
ccccgcccaggagggc

SEQ ID NO: 387504 - DNA, 16 bp, M. musculus
ccccgtgttagtctgg

SEQ ID NO: 387505 - DNA, 16 bp, M. musculus
cccctaacactagata

SEQ ID NO: 387506 - DNA, 16 bp, M. musculus
cccctacacccacagc

SEQ ID NO: 387507 - DNA, 16 bp, M. musculus
cccctacccactcatt

SEQ ID NO: 387508 - DNA, 16 bp, M. musculus
cccctaccctggcact

SEQ ID NO: 387509 - DNA, 16 bp, M. musculus
cccctagaactggagt

SEQ ID NO: 387510 - DNA, 16 bp, M. musculus
cccctagagctgtgtc

SEQ ID NO: 387511 - DNA, 16 bp, M. musculus
cccctagttccctgag

SEQ ID NO: 387512 - DNA, 16 bp, M. musculus
cccctatgccctctcc

SEQ ID NO: 387513 - DNA, 16 bp, M. musculus
cccctatggaggagtt

SEQ ID NO: 387514 - DNA, 16 bp, M. musculus
cccctattttcgttgt

SEQ ID NO: 387515 - DNA, 48 bp, M. musculus
cccctcaacagaggaatggatacagaaaatgtggtacatttacacaac

SEQ ID NO: 387516 - DNA, 16 bp, M. musculus
cccctcactggctgca

SEQ ID NO: 387517 - DNA, 16 bp, M. musculus
cccctcagtcctgggc

SEQ ID NO: 387518 - DNA, 16 bp, M. musculus
cccctcagtgacacac

SEQ ID NO: 387519 - DNA, 16 bp, M. musculus
cccctccacaagtccc

SEQ ID NO: 387520 - DNA, 16 bp, M. musculus
cccctccactggggca

SEQ ID NO: 387521 - DNA, 16 bp, M. musculus
cccctccagctccttc

SEQ ID NO: 387522 - DNA, 16 bp, M. musculus
cccctccaggtccacc

SEQ ID NO: 387523 - DNA, 16 bp, M. musculus
cccctccatggcccct

SEQ ID NO: 387524 - DNA, 16 bp, M. musculus
cccctccatggcctct

SEQ ID NO: 387525 - DNA, 16 bp, M. musculus
cccctcccagttcctc

SEQ ID NO: 387526 - DNA, 16 bp, M. musculus
cccctccccaaaagac

SEQ ID NO: 387527 - DNA, 16 bp, M. musculus
cccctccccaaaagat

SEQ ID NO: 387528 - DNA, 16 bp, M. musculus
cccctcccccactgtg

SEQ ID NO: 387529 - DNA, 16 bp, M. musculus
cccctcccctctggaa

SEQ ID NO: 387530 - DNA, 16 bp, M. musculus
cccctcccttcaaaaa

SEQ ID NO: 387531 - DNA, 16 bp, M. musculus
cccctcctccagcctg

SEQ ID NO: 387532 - DNA, 16 bp, M. musculus
cccctcctcccaaggc

SEQ ID NO: 387533 - DNA, 16 bp, M. musculus
cccctcctcccagtct

SEQ ID NO: 387534 - DNA, 16 bp, M. musculus
cccctcctcccattga

SEQ ID NO: 387535 - DNA, 16 bp, M. musculus
cccctcctgacctcta

SEQ ID NO: 387536 - DNA, 16 bp, M. musculus
cccctcctggtcaccc

SEQ ID NO: 387537 - DNA, 16 bp, M. musculus
cccctcctgtgtgtgt

SEQ ID NO: 387538 - DNA, 16 bp, M. musculus
cccctctcctccagat

SEQ ID NO: 387539 - DNA, 16 bp, M. musculus
cccctctcctctgaga

SEQ ID NO: 387540 - DNA, 16 bp, M. musculus
cccctctgaaagtccc

SEQ ID NO: 387541 - DNA, 16 bp, M. musculus
cccctctgaagacccc

SEQ ID NO: 387542 - DNA, 16 bp, M. musculus
cccctctgactcctac

SEQ ID NO: 387543 - DNA, 16 bp, M. musculus
cccctctgcaaaccct

SEQ ID NO: 387544 - DNA, 16 bp, M. musculus
cccctctgtccacaca

SEQ ID NO: 387545 - DNA, 16 bp, M. musculus
cccctctgtgcttctg

SEQ ID NO: 387546 - DNA, 16 bp, M. musculus
cccctcttctacccag

SEQ ID NO: 387547 - DNA, 16 bp, M. musculus
cccctgaaaatcccct

SEQ ID NO: 387548 - DNA, 16 bp, M. musculus
cccctgaaactggagt

SEQ ID NO: 387549 - DNA, 16 bp, M. musculus
cccctgaaagagcagc

SEQ ID NO: 387550 - DNA, 16 bp, M. musculus
cccctgactcttccac

SEQ ID NO: 387551 - DNA, 16 bp, M. musculus
cccctgagaagctctg

SEQ ID NO: 387552 - DNA, 16 bp, M. musculus
cccctgagacatctct

SEQ ID NO: 387553 - DNA, 16 bp, M. musculus
cccctgaggggcctgc

SEQ ID NO: 387554 - DNA, 16 bp, M. musculus
cccctgcatctccaca

SEQ ID NO: 387555 - DNA, 16 bp, M. musculus
cccctgcatctttcaa

SEQ ID NO: 387556 - DNA, 16 bp, M. musculus
cccctgccatcctcaa

SEQ ID NO: 387557 - DNA, 16 bp, M. musculus
cccctgccctgcacag

SEQ ID NO: 387558 - DNA, 16 bp, M. musculus
cccctgccctgctcac

SEQ ID NO: 387559 - DNA, 16 bp, M. musculus
cccctgcctacccact

SEQ ID NO: 387560 - DNA, 16 bp, M. musculus
cccctgcctcagcctc

SEQ ID NO: 387561 - DNA, 16 bp, M. musculus
cccctgcctcagctcc

SEQ ID NO: 387562 - DNA, 16 bp, M. musculus
cccctgcctcagcttc

SEQ ID NO: 387563 - DNA, 16 bp, M. musculus
cccctgcctcagtctc

SEQ ID NO: 387564 - DNA, 16 bp, M. musculus
cccctgcctccaggtt

SEQ ID NO: 387565 - DNA, 16 bp, M. musculus
cccctgcctccccagt

SEQ ID NO: 387566 - DNA, 16 bp, M. musculus
cccctgcctcctgtgt

SEQ ID NO: 387567 - DNA, 16 bp, M. musculus
cccctgctccagctgt

SEQ ID NO: 387568 - DNA, 16 bp, M. musculus
cccctgctccagttgt

SEQ ID NO: 387569 - DNA, 16 bp, M. musculus
cccctgctccccaatc

SEQ ID NO: 387570 - DNA, 16 bp, M. musculus
cccctgctgctgctgc

SEQ ID NO: 387571 - DNA, 16 bp, M. musculus
cccctgctgctgctgg

SEQ ID NO: 387572 - DNA, 16 bp, M. musculus
cccctgctggcctctg

SEQ ID NO: 387573 - DNA, 16 bp, M. musculus
cccctgcttccatgag

SEQ ID NO: 387574 - DNA, 16 bp, M. musculus
cccctgcttctgcttc

SEQ ID NO: 387575 - DNA, 16 bp, M. musculus
cccctggaaactgtat

SEQ ID NO: 387576 - DNA, 16 bp, M. musculus
cccctggaactggaat

SEQ ID NO: 387577 - DNA, 16 bp, M. musculus
cccctggaactgggtt

SEQ ID NO: 387578 - DNA, 16 bp, M. musculus
cccctggacctggaat

SEQ ID NO: 387579 - DNA, 16 bp, M. musculus
cccctggagctcctgt

SEQ ID NO: 387580 - DNA, 16 bp, M. musculus
cccctggagctgaagt

SEQ ID NO: 387581 - DNA, 16 bp, M. musculus
cccctggagctggagg

SEQ ID NO: 387582 - DNA, 16 bp, M. musculus
cccctggagctggggt

SEQ ID NO: 387583 - DNA, 16 bp, M. musculus
cccctggctgtcttgg

SEQ ID NO: 387584 - DNA, 16 bp, M. musculus
cccctggcttgcccag

SEQ ID NO: 387585 - DNA, 16 bp, M. musculus
cccctgggctggagag

SEQ ID NO: 387586 - DNA, 16 bp, M. musculus
cccctggtcattttgg

SEQ ID NO: 387587 - DNA, 16 bp, M. musculus
cccctggtgggcatct

SEQ ID NO: 387588 - DNA, 16 bp, M. musculus
cccctggtggggcagt

SEQ ID NO: 387589 - DNA, 16 bp, M. musculus
cccctgtctcctccca

SEQ ID NO: 387590 - DNA, 16 bp, M. musculus
cccctgtgccaatgtg

SEQ ID NO: 387591 - DNA, 16 bp, M. musculus
cccctgtgcccatgta

SEQ ID NO: 387592 - DNA, 16 bp, M. musculus
cccctgtggaagggtc

SEQ ID NO: 387593 - DNA, 16 bp, M. musculus
ccccttactctgcttc

SEQ ID NO: 387594 - DNA, 18 bp, M. musculus
ccccttatccacagcctc

SEQ ID NO: 387595 - DNA, 16 bp, M. musculus
ccccttcaactctttc

SEQ ID NO: 387596 - DNA, 16 bp, M. musculus
ccccttcagccccttc

SEQ ID NO: 387597 - DNA, 16 bp, M. musculus
ccccttcagctcctgc

SEQ ID NO: 387598 - DNA, 16 bp, M. musculus
ccccttcagtccttcc

SEQ ID NO: 387599 - DNA, 16 bp, M. musculus
ccccttcatgttaaag

SEQ ID NO: 387600 - DNA, 16 bp, M. musculus
ccccttcccctgctca

SEQ ID NO: 387601 - DNA, 16 bp, M. musculus
ccccttcctagtttcc

SEQ ID NO: 387602 - DNA, 16 bp, M. musculus
ccccttcctgcctggc

SEQ ID NO: 387603 - DNA, 16 bp, M. musculus
ccccttctaagaatga

SEQ ID NO: 387604 - DNA, 16 bp, M. musculus
ccccttctcagaagag

SEQ ID NO: 387605 - DNA, 16 bp, M. musculus
ccccttctcctcccag

SEQ ID NO: 387606 - DNA, 16 bp, M. musculus
ccccttctcctctcag

SEQ ID NO: 387607 - DNA, 16 bp, M. musculus
ccccttctcctctgag

SEQ ID NO: 387608 - DNA, 16 bp, M. musculus
ccccttctcctgtgag

SEQ ID NO: 387609 - DNA, 16 bp, M. musculus
ccccttctcctttgag

SEQ ID NO: 387610 - DNA, 16 bp, M. musculus
ccccttctctcagaac

SEQ ID NO: 387611 - DNA, 16 bp, M. musculus
ccccttctgctgcctg

SEQ ID NO: 387612 - DNA, 16 bp, M. musculus
ccccttgagctccttt

SEQ ID NO: 387613 - DNA, 16 bp, M. musculus
ccccttgatcagtaat

SEQ ID NO: 387614 - DNA, 16 bp, M. musculus
ccccttgatgaatatg

SEQ ID NO: 387615 - DNA, 16 bp, M. musculus
ccccttggaactggag

SEQ ID NO: 387616 - DNA, 16 bp, M. musculus
ccccttggagctcgtg

SEQ ID NO: 387617 - DNA, 16 bp, M. musculus
cccctttacccactga

SEQ ID NO: 387618 - DNA, 16 bp, M. musculus
cccctttcccacccag

SEQ ID NO: 387619 - DNA, 16 bp, M. musculus
cccctttcccagtctc

SEQ ID NO: 387620 - DNA, 16 bp, M. musculus
cccctttcctggtttg

SEQ ID NO: 387621 - DNA, 16 bp, M. musculus
cccctttgcctctctg

SEQ ID NO: 387622 - DNA, 16 bp, M. musculus
cccctttggcaaacct

SEQ ID NO: 387623 - DNA, 16 bp, M. musculus
cccctttgtctctgag

SEQ ID NO: 387624 - DNA, 16 bp, M. musculus
ccccttttctttataa

SEQ ID NO: 387625 - DNA, 16 bp, M. musculus
cccgacacccgcaagg

SEQ ID NO: 387626 - DNA, 16 bp, M. musculus
cccgagagctcccagg

SEQ ID NO: 387627 - DNA, 16 bp, M. musculus
cccgagctcgtgtctc

SEQ ID NO: 387628 - DNA, 16 bp, M. musculus
cccgaggagctgaagg

SEQ ID NO: 387629 - DNA, 16 bp, M. musculus
cccgaggctcctctca

SEQ ID NO: 387630 - DNA, 16 bp, M. musculus
cccgaggggcattttc

SEQ ID NO: 387631 - DNA, 16 bp, M. musculus
cccgattcctgccaaa

SEQ ID NO: 387632 - DNA, 16 bp, M. musculus
cccgattgctcttcca

SEQ ID NO: 387633 - DNA, 16 bp, M. musculus
cccgccagaggagagg

SEQ ID NO: 387634 - DNA, 16 bp, M. musculus
cccgccatcttttgat

SEQ ID NO: 387635 - DNA, 16 bp, M. musculus
cccgctgagccatctc

SEQ ID NO: 387636 - DNA, 16 bp, M. musculus
cccgctttctcctcta

SEQ ID NO: 387637 - DNA, 16 bp, M. musculus
cccggaagtcccacct

SEQ ID NO: 387638 - DNA, 16 bp, M. musculus
cccggaagtcctgcct

SEQ ID NO: 387639 - DNA, 18 bp, M. musculus
cccggacacatcctgtgg

SEQ ID NO: 387640 - DNA, 16 bp, M. musculus
cccgggagctggagtt

SEQ ID NO: 387641 - DNA, 16 bp, M. musculus
cccgggaggcagaggc

SEQ ID NO: 387642 - DNA, 16 bp, M. musculus
cccggggccatgtgga

SEQ ID NO: 387643 - DNA, 16 bp, M. musculus
cccggtttgcctccca

SEQ ID NO: 387644 - DNA, 16 bp, M. musculus
ccctaaaaattccacc

SEQ ID NO: 387645 - DNA, 16 bp, M. musculus
ccctaaacttctccag

SEQ ID NO: 387646 - DNA, 29 bp, M. musculus
ccctaaattcggccatcagtctcatgcca

SEQ ID NO: 387647 - DNA, 16 bp, M. musculus
ccctaacaactggagt

SEQ ID NO: 387648 - DNA, 39 bp, M. musculus
ccctaaccaagattatacaagggccccaagagtcctatg

SEQ ID NO: 387649 - DNA, 16 bp, M. musculus
ccctaactaagacact

SEQ ID NO: 387650 - DNA, 16 bp, M. musculus
ccctaaggactccctg

SEQ ID NO: 387651 - DNA, 16 bp, M. musculus
ccctaatggaagagtt

SEQ ID NO: 387652 - DNA, 16 bp, M. musculus
ccctaatggaggagtt

SEQ ID NO: 387653 - DNA, 16 bp, M. musculus
ccctacagaaaatact

SEQ ID NO: 387654 - DNA, 16 bp, M. musculus
ccctaccatgcttcct

SEQ ID NO: 387655 - DNA, 16 bp, M. musculus
ccctacccacttactc

SEQ ID NO: 387656 - DNA, 16 bp, M. musculus
ccctaccctgaactct

SEQ ID NO: 387657 - DNA, 16 bp, M. musculus
ccctagaaaaagcaaa

SEQ ID NO: 387658 - DNA, 16 bp, M. musculus
ccctagagaaacatcc

SEQ ID NO: 387659 - DNA, 16 bp, M. musculus
ccctagcaagcagcag

SEQ ID NO: 387660 - DNA, 16 bp, M. musculus
ccctagcactcaggag

SEQ ID NO: 387661 - DNA, 16 bp, M. musculus
ccctagccctagccct

SEQ ID NO: 387662 - DNA, 16 bp, M. musculus
ccctagctacctggaa

SEQ ID NO: 387663 - DNA, 16 bp, M. musculus
ccctagctggcctgga

SEQ ID NO: 387664 - DNA, 16 bp, M. musculus
ccctagctggccttga

SEQ ID NO: 387665 - DNA, 16 bp, M. musculus
ccctagctgtcctggc

SEQ ID NO: 387666 - DNA, 16 bp, M. musculus
ccctagtctcaaccat

SEQ ID NO: 387667 - DNA, 16 bp, M. musculus
ccctataaccctcagg

SEQ ID NO: 387668 - DNA, 16 bp, M. musculus
ccctataaccttcccc

SEQ ID NO: 387669 - DNA, 16 bp, M. musculus
ccctatagatggaaca

SEQ ID NO: 387670 - DNA, 16 bp, M. musculus
ccctatatatatatat

SEQ ID NO: 387671 - DNA, 16 bp, M. musculus
ccctatcccaactcgg

SEQ ID NO: 387672 - DNA, 19 bp, M. musculus
ccctatcggtggaacaaca

SEQ ID NO: 387673 - DNA, 16 bp, M. musculus
ccctatgcagaggtgt

SEQ ID NO: 387674 - DNA, 16 bp, M. musculus
ccctatggaagagtta

SEQ ID NO: 387675 - DNA, 16 bp, M. musculus
ccctattaaaagtagg

SEQ ID NO: 387676 - DNA, 16 bp, M. musculus
ccctatttcaaaataa

SEQ ID NO: 387677 - DNA, 16 bp, M. musculus
ccctcaaagagaagtg

SEQ ID NO: 387678 - DNA, 16 bp, M. musculus
ccctcaaagctcagga

SEQ ID NO: 387679 - DNA, 16 bp, M. musculus
ccctcaaataactgga

SEQ ID NO: 387680 - DNA, 16 bp, M. musculus
ccctcaaatattttca

SEQ ID NO: 387681 - DNA, 16 bp, M. musculus
ccctcaacagaaaatg

SEQ ID NO: 387682 - DNA, 16 bp, M. musculus
ccctcaacagagaatg

SEQ ID NO: 387683 - DNA, 38 bp, M. musculus
ccctcaacagaggaatggatacagaaaatgtggtacat

SEQ ID NO: 387684 - DNA, 16 bp, M. musculus
ccctcaacagaggcat

SEQ ID NO: 387685 - DNA, 16 bp, M. musculus
ccctcaactccttcag

SEQ ID NO: 387686 - DNA, 28 bp, M. musculus
ccctcaatcccacaatccacttggctca

SEQ ID NO: 387687 - DNA, 16 bp, M. musculus
ccctcaatgggaggag

SEQ ID NO: 387688 - DNA, 16 bp, M. musculus
ccctcaatgtgtactc

SEQ ID NO: 387689 - DNA, 16 bp, M. musculus
ccctcaatttctgttc

SEQ ID NO: 387690 - DNA, 16 bp, M. musculus
ccctcacacagatcct

SEQ ID NO: 387691 - DNA, 16 bp, M. musculus
ccctcactggctgcag

SEQ ID NO: 387692 - DNA, 16 bp, M. musculus
ccctcagaagttcttt

SEQ ID NO: 387693 - DNA, 16 bp, M. musculus
ccctcagagctcagga

SEQ ID NO: 387694 - DNA, 16 bp, M. musculus
ccctcagaggacagcc

SEQ ID NO: 387695 - DNA, 16 bp, M. musculus
ccctcagattccacct

SEQ ID NO: 387696 - DNA, 16 bp, M. musculus
ccctcagcccccacag

SEQ ID NO: 387697 - DNA, 16 bp, M. musculus
ccctcagccctcagcc

SEQ ID NO: 387698 - DNA, 16 bp, M. musculus
ccctcagctccctcag

SEQ ID NO: 387699 - DNA, 16 bp, M. musculus
ccctcagctcctccca

SEQ ID NO: 387700 - DNA, 16 bp, M. musculus
ccctcagctccttcag

SEQ ID NO: 387701 - DNA, 16 bp, M. musculus
ccctcagctctttcag

SEQ ID NO: 387702 - DNA, 16 bp, M. musculus
ccctcagcttcctgct

SEQ ID NO: 387703 - DNA, 16 bp, M. musculus
ccctcaggacttcagt

SEQ ID NO: 387704 - DNA, 16 bp, M. musculus
ccctcaggcccaagag

SEQ ID NO: 387705 - DNA, 16 bp, M. musculus
ccctcagggcttcact

SEQ ID NO: 387706 - DNA, 16 bp, M. musculus
ccctcagtccctgcct

SEQ ID NO: 387707 - DNA, 16 bp, M. musculus
ccctcagtccttccct

SEQ ID NO: 387708 - DNA, 16 bp, M. musculus
ccctcagtcttttctc

SEQ ID NO: 387709 - DNA, 16 bp, M. musculus
ccctcagtttgtgttt

SEQ ID NO: 387710 - DNA, 16 bp, M. musculus
ccctcatatacacaca

SEQ ID NO: 387711 - DNA, 16 bp, M. musculus
ccctcatcaaagaagc

SEQ ID NO: 387712 - DNA, 16 bp, M. musculus
ccctcatcaagaaaac

SEQ ID NO: 387713 - DNA, 16 bp, M. musculus
ccctcatttaaaaaaa

SEQ ID NO: 387714 - DNA, 16 bp, M. musculus
ccctccaaccataaaa

SEQ ID NO: 387715 - DNA, 16 bp, M. musculus
ccctccaagaggccca

SEQ ID NO: 387716 - DNA, 16 bp, M. musculus
ccctccacaaagcccc

SEQ ID NO: 387717 - DNA, 16 bp, M. musculus
ccctccaccctgcttc

SEQ ID NO: 387718 - DNA, 16 bp, M. musculus
ccctccaccctgttcc

SEQ ID NO: 387719 - DNA, 16 bp, M. musculus
ccctccactcctccag

SEQ ID NO: 387720 - DNA, 16 bp, M. musculus
ccctccagagctcgtg

SEQ ID NO: 387721 - DNA, 16 bp, M. musculus
ccctccagatccattc

SEQ ID NO: 387722 - DNA, 16 bp, M. musculus
ccctccagatctatcc

SEQ ID NO: 387723 - DNA, 16 bp, M. musculus
ccctccagctccatcc

SEQ ID NO: 387724 - DNA, 16 bp, M. musculus
ccctccagctccttca

SEQ ID NO: 387725 - DNA, 16 bp, M. musculus
ccctccaggaccatcc

SEQ ID NO: 387726 - DNA, 16 bp, M. musculus
ccctccagggcctctg

SEQ ID NO: 387727 - DNA, 16 bp, M. musculus
ccctccaggtccaccc

SEQ ID NO: 387728 - DNA, 16 bp, M. musculus
ccctccaggtccagcc

SEQ ID NO: 387729 - DNA, 17 bp, M. musculus
ccctccaggtccatcca

SEQ ID NO: 387730 - DNA, 16 bp, M. musculus
ccctccaggttcctca

SEQ ID NO: 387731 - DNA, 16 bp, M. musculus
ccctccatggccactg

SEQ ID NO: 387732 - DNA, 16 bp, M. musculus
ccctccatggcttttg

SEQ ID NO: 387733 - DNA, 16 bp, M. musculus
ccctccatttcccaag

SEQ ID NO: 387734 - DNA, 16 bp, M. musculus
ccctcccaactaaaaa

SEQ ID NO: 387735 - DNA, 16 bp, M. musculus
ccctcccacagtccct

SEQ ID NO: 387736 - DNA, 16 bp, M. musculus
ccctcccagagctccc

SEQ ID NO: 387737 - DNA, 16 bp, M. musculus
ccctcccagcagtgtg

SEQ ID NO: 387738 - DNA, 16 bp, M. musculus
ccctcccaggtggtca

SEQ ID NO: 387739 - DNA, 16 bp, M. musculus
ccctcccagtgctggg

SEQ ID NO: 387740 - DNA, 16 bp, M. musculus
ccctccccatacctga

SEQ ID NO: 387741 - DNA, 16 bp, M. musculus
ccctcccccaataaaa

SEQ ID NO: 387742 - DNA, 16 bp, M. musculus
ccctcccccagcagct

SEQ ID NO: 387743 - DNA, 16 bp, M. musculus
ccctcccccagctgct

SEQ ID NO: 387744 - DNA, 16 bp, M. musculus
ccctccccctgactct

SEQ ID NO: 387745 - DNA, 16 bp, M. musculus
ccctcccctgggagct

SEQ ID NO: 387746 - DNA, 16 bp, M. musculus
ccctcccctgtgtgtg

SEQ ID NO: 387747 - DNA, 16 bp, M. musculus
ccctccctcagcagcc

SEQ ID NO: 387748 - DNA, 16 bp, M. musculus
ccctccctccactgga

SEQ ID NO: 387749 - DNA, 16 bp, M. musculus
ccctccctccatctgt

SEQ ID NO: 387750 - DNA, 16 bp, M. musculus
ccctccctccatgcct

SEQ ID NO: 387751 - DNA, 16 bp, M. musculus
ccctccctctaccctg

SEQ ID NO: 387752 - DNA, 16 bp, M. musculus
ccctccctgcagacac

SEQ ID NO: 387753 - DNA, 16 bp, M. musculus
ccctccctggaggcca

SEQ ID NO: 387754 - DNA, 16 bp, M. musculus
ccctccctggcctctg

SEQ ID NO: 387755 - DNA, 18 bp, M. musculus
ccctccggacaacggatt

SEQ ID NO: 387756 - DNA, 16 bp, M. musculus
ccctcctacctctgcc

SEQ ID NO: 387757 - DNA, 16 bp, M. musculus
ccctcctcatagaata

SEQ ID NO: 387758 - DNA, 16 bp, M. musculus
ccctcctccagccctg

SEQ ID NO: 387759 - DNA, 16 bp, M. musculus
ccctcctcccactgtg

SEQ ID NO: 387760 - DNA, 16 bp, M. musculus
ccctcctccctcagac

SEQ ID NO: 387761 - DNA, 16 bp, M. musculus
ccctcctcctcagttt

SEQ ID NO: 387762 - DNA, 16 bp, M. musculus
ccctcctctagcctct

SEQ ID NO: 387763 - DNA, 16 bp, M. musculus
ccctcctcttcagctt

SEQ ID NO: 387764 - DNA, 16 bp, M. musculus
ccctcctcttggccat

SEQ ID NO: 387765 - DNA, 16 bp, M. musculus
ccctcctgctgtgtgc

SEQ ID NO: 387766 - DNA, 16 bp, M. musculus
ccctcctggaagagaa

SEQ ID NO: 387767 - DNA, 16 bp, M. musculus
ccctcctggctgaaga

SEQ ID NO: 387768 - DNA, 16 bp, M. musculus
ccctcctggtctgccc

SEQ ID NO: 387769 - DNA, 16 bp, M. musculus
ccctccttcattgcct

SEQ ID NO: 387770 - DNA, 16 bp, M. musculus
ccctccttctatgagg

SEQ ID NO: 387771 - DNA, 16 bp, M. musculus
ccctcgcaccaggcct

SEQ ID NO: 387772 - DNA, 16 bp, M. musculus
ccctcgggaatcctgg

SEQ ID NO: 387773 - DNA, 16 bp, M. musculus
ccctctacttcctgtg

SEQ ID NO: 387774 - DNA, 16 bp, M. musculus
ccctctcagaagcaaa

SEQ ID NO: 387775 - DNA, 16 bp, M. musculus
ccctctccagagtccc

SEQ ID NO: 387776 - DNA, 16 bp, M. musculus
ccctctcccacccaag

SEQ ID NO: 387777 - DNA, 16 bp, M. musculus
ccctctccctactgta

SEQ ID NO: 387778 - DNA, 16 bp, M. musculus
ccctctcctcagagct

SEQ ID NO: 387779 - DNA, 16 bp, M. musculus
ccctctcctcccactg

SEQ ID NO: 387780 - DNA, 16 bp, M. musculus
ccctctcctggtctct

SEQ ID NO: 387781 - DNA, 16 bp, M. musculus
ccctctcctttgatgt

SEQ ID NO: 387782 - DNA, 16 bp, M. musculus
ccctctctctctgtgt

SEQ ID NO: 387783 - DNA, 16 bp, M. musculus
ccctctctgacctcca

SEQ ID NO: 387784 - DNA, 16 bp, M. musculus
ccctctctgcttcctg

SEQ ID NO: 387785 - DNA, 16 bp, M. musculus
ccctctctggaggcca

SEQ ID NO: 387786 - DNA, 16 bp, M. musculus
ccctctctggcctctg

SEQ ID NO: 387787 - DNA, 16 bp, M. musculus
ccctctctggcttcca

SEQ ID NO: 387788 - DNA, 16 bp, M. musculus
ccctctcttcctgctg

SEQ ID NO: 387789 - DNA, 16 bp, M. musculus
ccctctgaaaacccct

SEQ ID NO: 387790 - DNA, 16 bp, M. musculus
ccctctgacctacaca

SEQ ID NO: 387791 - DNA, 16 bp, M. musculus
ccctctgagccatctc

SEQ ID NO: 387792 - DNA, 16 bp, M. musculus
ccctctgagtggagat

SEQ ID NO: 387793 - DNA, 16 bp, M. musculus
ccctctgatgtgagca

SEQ ID NO: 387794 - DNA, 16 bp, M. musculus
ccctctgcctctgagt

SEQ ID NO: 387795 - DNA, 16 bp, M. musculus
ccctctgcctctgtct

SEQ ID NO: 387796 - DNA, 16 bp, M. musculus
ccctctgcttcctgct

SEQ ID NO: 387797 - DNA, 16 bp, M. musculus
ccctctggctgaaata

SEQ ID NO: 387798 - DNA, 16 bp, M. musculus
ccctctgtatgtgtgt

SEQ ID NO: 387799 - DNA, 16 bp, M. musculus
ccctctgtctgcctct

SEQ ID NO: 387800 - DNA, 16 bp, M. musculus
ccctctgtgtgacatg

SEQ ID NO: 387801 - DNA, 16 bp, M. musculus
ccctcttcagacctcc

SEQ ID NO: 387802 - DNA, 16 bp, M. musculus
ccctcttcctcagttt

SEQ ID NO: 387803 - DNA, 16 bp, M. musculus
ccctcttcctggcctt

SEQ ID NO: 387804 - DNA, 16 bp, M. musculus
ccctcttctagcccct

SEQ ID NO: 387805 - DNA, 16 bp, M. musculus
ccctcttctagtctct

SEQ ID NO: 387806 - DNA, 16 bp, M. musculus
ccctcttctgaccttt

SEQ ID NO: 387807 - DNA, 16 bp, M. musculus
ccctcttctgatgtgc

SEQ ID NO: 387808 - DNA, 20 bp, M. musculus
ccctcttctggagtgtctga

SEQ ID NO: 387809 - DNA, 16 bp, M. musculus
ccctcttctggccacc

SEQ ID NO: 387810 - DNA, 16 bp, M. musculus
ccctcttctggcctct

SEQ ID NO: 387811 - DNA, 16 bp, M. musculus
ccctcttctggctctg

SEQ ID NO: 387812 - DNA, 16 bp, M. musculus
ccctcttctgtggggt

SEQ ID NO: 387813 - DNA, 16 bp, M. musculus
ccctcttctgttttaa

SEQ ID NO: 387814 - DNA, 16 bp, M. musculus
ccctcttgaattcttt

SEQ ID NO: 387815 - DNA, 16 bp, M. musculus
ccctcttgtggcctcc

SEQ ID NO: 387816 - DNA, 16 bp, M. musculus
ccctcttttggcttct

SEQ ID NO: 387817 - DNA, 16 bp, M. musculus
ccctgaaaaaatgttc

SEQ ID NO: 387818 - DNA, 16 bp, M. musculus
ccctgaaactgatcag

SEQ ID NO: 387819 - DNA, 16 bp, M. musculus
ccctgaacaaaactca

SEQ ID NO: 387820 - DNA, 16 bp, M. musculus
ccctgaacctggagtt

SEQ ID NO: 387821 - DNA, 16 bp, M. musculus
ccctgaactatcaatc

SEQ ID NO: 387822 - DNA, 16 bp, M. musculus
ccctgaactcacagag

SEQ ID NO: 387823 - DNA, 16 bp, M. musculus
ccctgaagctggggtt

SEQ ID NO: 387824 - DNA, 16 bp, M. musculus
ccctgaaggcaaggag

SEQ ID NO: 387825 - DNA, 16 bp, M. musculus
ccctgaaggcagggag

SEQ ID NO: 387826 - DNA, 16 bp, M. musculus
ccctgaaggccagaag

SEQ ID NO: 387827 - DNA, 16 bp, M. musculus
ccctgaagttgcttct

SEQ ID NO: 387828 - DNA, 16 bp, M. musculus
ccctgacacagcagga

SEQ ID NO: 387829 - DNA, 16 bp, M. musculus
ccctgacaccaccaag

SEQ ID NO: 387830 - DNA, 16 bp, M. musculus
ccctgacacttcaagt

SEQ ID NO: 387831 - DNA, 16 bp, M. musculus
ccctgaccaagaagct

SEQ ID NO: 387832 - DNA, 16 bp, M. musculus
ccctgaccaaggaaag

SEQ ID NO: 387833 - DNA, 16 bp, M. musculus
ccctgaccagcaggaa

SEQ ID NO: 387834 - DNA, 16 bp, M. musculus
ccctgacctaaagaaa

SEQ ID NO: 387835 - DNA, 16 bp, M. musculus
ccctgactaagacaca

SEQ ID NO: 387836 - DNA, 16 bp, M. musculus
ccctgactggctgctc

SEQ ID NO: 387837 - DNA, 16 bp, M. musculus
ccctgacttgaaaaac

SEQ ID NO: 387838 - DNA, 16 bp, M. musculus
ccctgacttgctcagc

SEQ ID NO: 387839 - DNA, 16 bp, M. musculus
ccctgagaagcaggag

SEQ ID NO: 387840 - DNA, 16 bp, M. musculus
ccctgagaagtcagtg

SEQ ID NO: 387841 - DNA, 17 bp, M. musculus
ccctgagaagtcagtgg

SEQ ID NO: 387842 - DNA, 16 bp, M. musculus
ccctgagaccatcaga

SEQ ID NO: 387843 - DNA, 16 bp, M. musculus
ccctgagatcctggtg

SEQ ID NO: 387844 - DNA, 16 bp, M. musculus
ccctgagatcttggtg

SEQ ID NO: 387845 - DNA, 25 bp, M. musculus
ccctgagattccacctcacaccagt

SEQ ID NO: 387846 - DNA, 16 bp, M. musculus
ccctgagccacctctc

SEQ ID NO: 387847 - DNA, 16 bp, M. musculus
ccctgagcccagaaat

SEQ ID NO: 387848 - DNA, 17 bp, M. musculus
ccctgagcccagaactg

SEQ ID NO: 387849 - DNA, 16 bp, M. musculus
ccctgagccccagaaa

SEQ ID NO: 387850 - DNA, 16 bp, M. musculus
ccctgagcctcaggtg

SEQ ID NO: 387851 - DNA, 16 bp, M. musculus
ccctgagccttgggag

SEQ ID NO: 387852 - DNA, 16 bp, M. musculus
ccctgagcctttctca

SEQ ID NO: 387853 - DNA, 16 bp, M. musculus
ccctgaggaccagcag

SEQ ID NO: 387854 - DNA, 16 bp, M. musculus
ccctgaggctagcaga

SEQ ID NO: 387855 - DNA, 16 bp, M. musculus
ccctgagggaagtcag

SEQ ID NO: 387856 - DNA, 16 bp, M. musculus
ccctgagggccaacag

SEQ ID NO: 387857 - DNA, 16 bp, M. musculus
ccctgagggcctgcag

SEQ ID NO: 387858 - DNA, 16 bp, M. musculus
ccctgagtagctgggt

SEQ ID NO: 387859 - DNA, 16 bp, M. musculus
ccctgagttcgaggcc

SEQ ID NO: 387860 - DNA, 16 bp, M. musculus
ccctgagtttgattat

SEQ ID NO: 387861 - DNA, 16 bp, M. musculus
ccctgatcctctggct

SEQ ID NO: 387862 - DNA, 16 bp, M. musculus
ccctgatctcaagctg

SEQ ID NO: 387863 - DNA, 16 bp, M. musculus
ccctgatgaagctgct

SEQ ID NO: 387864 - DNA, 16 bp, M. musculus
ccctgatgaataagga

SEQ ID NO: 387865 - DNA, 16 bp, M. musculus
ccctgatgataaagga

SEQ ID NO: 387866 - DNA, 16 bp, M. musculus
ccctgcaatacttagt

SEQ ID NO: 387867 - DNA, 16 bp, M. musculus
ccctgcacaatctccc

SEQ ID NO: 387868 - DNA, 16 bp, M. musculus
ccctgcacacacatgg

SEQ ID NO: 387869 - DNA, 16 bp, M. musculus
ccctgcacacagtagg

SEQ ID NO: 387870 - DNA, 17 bp, M. musculus
ccctgcacagggctaca

SEQ ID NO: 387871 - DNA, 16 bp, M. musculus
ccctgcacccggctct

SEQ ID NO: 387872 - DNA, 16 bp, M. musculus
ccctgcactcaggagg

SEQ ID NO: 387873 - DNA, 16 bp, M. musculus
ccctgcactcgggagg

SEQ ID NO: 387874 - DNA, 16 bp, M. musculus
ccctgcactggggagg

SEQ ID NO: 387875 - DNA, 16 bp, M. musculus
ccctgcaggaggacca

SEQ ID NO: 387876 - DNA, 16 bp, M. musculus
ccctgcaggaggagag

SEQ ID NO: 387877 - DNA, 16 bp, M. musculus
ccctgcagtgcctctg

SEQ ID NO: 387878 - DNA, 16 bp, M. musculus
ccctgcatcctatctg

SEQ ID NO: 387879 - DNA, 18 bp, M. musculus
ccctgcatctccacaagt

SEQ ID NO: 387880 - DNA, 19 bp, M. musculus
ccctgcatgggatatgagt

SEQ ID NO: 387881 - DNA, 16 bp, M. musculus
ccctgcatttgggagg

SEQ ID NO: 387882 - DNA, 16 bp, M. musculus
ccctgccaaaggagag

SEQ ID NO: 387883 - DNA, 18 bp, M. musculus
ccctgccaatcccagttg

SEQ ID NO: 387884 - DNA, 16 bp, M. musculus
ccctgccacctgaggc

SEQ ID NO: 387885 - DNA, 16 bp, M. musculus
ccctgccacttgtctg

SEQ ID NO: 387886 - DNA, 16 bp, M. musculus
ccctgccagaagccat

SEQ ID NO: 387887 - DNA, 16 bp, M. musculus
ccctgccagcaagatg

SEQ ID NO: 387888 - DNA, 16 bp, M. musculus
ccctgcccagccattg

SEQ ID NO: 387889 - DNA, 16 bp, M. musculus
ccctgcccagcccagc

SEQ ID NO: 387890 - DNA, 16 bp, M. musculus
ccctgcccagccctgc

SEQ ID NO: 387891 - DNA, 16 bp, M. musculus
ccctgcccaggcctct

SEQ ID NO: 387892 - DNA, 16 bp, M. musculus
ccctgcccagtccttt

SEQ ID NO: 387893 - DNA, 16 bp, M. musculus
ccctgccccagctcct

SEQ ID NO: 387894 - DNA, 16 bp, M. musculus
ccctgcccccaacaca

SEQ ID NO: 387895 - DNA, 16 bp, M. musculus
ccctgcccctgagggt

SEQ ID NO: 387896 - DNA, 16 bp, M. musculus
ccctgccctcagttcc

SEQ ID NO: 387897 - DNA, 16 bp, M. musculus
ccctgccctccctgca

SEQ ID NO: 387898 - DNA, 16 bp, M. musculus
ccctgccctgcccagc

SEQ ID NO: 387899 - DNA, 16 bp, M. musculus
ccctgccctgccctgg

SEQ ID NO: 387900 - DNA, 16 bp, M. musculus
ccctgccctgccctgt

SEQ ID NO: 387901 - DNA, 16 bp, M. musculus
ccctgccctgctccca

SEQ ID NO: 387902 - DNA, 16 bp, M. musculus
ccctgccctggaacag

SEQ ID NO: 387903 - DNA, 16 bp, M. musculus
ccctgccctggagggc

SEQ ID NO: 387904 - DNA, 16 bp, M. musculus
ccctgccctggcactc

SEQ ID NO: 387905 - DNA, 16 bp, M. musculus
ccctgccctggcttct

SEQ ID NO: 387906 - DNA, 16 bp, M. musculus
ccctgccctgtcctgc

SEQ ID NO: 387907 - DNA, 16 bp, M. musculus
ccctgcccttgaattc

SEQ ID NO: 387908 - DNA, 16 bp, M. musculus
ccctgcctcaaaaagg

SEQ ID NO: 387909 - DNA, 16 bp, M. musculus
ccctgcctcaaaatat

SEQ ID NO: 387910 - DNA, 16 bp, M. musculus
ccctgcctcaaacaca

SEQ ID NO: 387911 - DNA, 16 bp, M. musculus
ccctgcctcaaaggaa

SEQ ID NO: 387912 - DNA, 16 bp, M. musculus
ccctgcctcagcttcc

SEQ ID NO: 387913 - DNA, 16 bp, M. musculus
ccctgcctccacagtg

SEQ ID NO: 387914 - DNA, 16 bp, M. musculus
ccctgcctctaccttc

SEQ ID NO: 387915 - DNA, 16 bp, M. musculus
ccctgcctctgcccca

SEQ ID NO: 387916 - DNA, 16 bp, M. musculus
ccctgcctctgctgcc

SEQ ID NO: 387917 - DNA, 16 bp, M. musculus
ccctgcctgctgcctg

SEQ ID NO: 387918 - DNA, 16 bp, M. musculus
ccctgcctgctgctgc

SEQ ID NO: 387919 - DNA, 16 bp, M. musculus
ccctgccttgctcagc

SEQ ID NO: 387920 - DNA, 16 bp, M. musculus
ccctgctagaggagag

SEQ ID NO: 387921 - DNA, 16 bp, M. musculus
ccctgctcaccagccc

SEQ ID NO: 387922 - DNA, 16 bp, M. musculus
ccctgctcagccattg

SEQ ID NO: 387923 - DNA, 16 bp, M. musculus
ccctgctcaggctggg

SEQ ID NO: 387924 - DNA, 16 bp, M. musculus
ccctgctccccaagcc

SEQ ID NO: 387925 - DNA, 16 bp, M. musculus
ccctgctcccctagcc

SEQ ID NO: 387926 - DNA, 16 bp, M. musculus
ccctgctccctctgtt

SEQ ID NO: 387927 - DNA, 16 bp, M. musculus
ccctgctccctgccag

SEQ ID NO: 387928 - DNA, 16 bp, M. musculus
ccctgctcgggagagc

SEQ ID NO: 387929 - DNA, 16 bp, M. musculus
ccctgctctctgaaac

SEQ ID NO: 387930 - DNA, 16 bp, M. musculus
ccctgctctgcctctg

SEQ ID NO: 387931 - DNA, 16 bp, M. musculus
ccctgctctggcattc

SEQ ID NO: 387932 - DNA, 16 bp, M. musculus
ccctgctgcacctgct

SEQ ID NO: 387933 - DNA, 16 bp, M. musculus
ccctgctgctgcaggg

SEQ ID NO: 387934 - DNA, 16 bp, M. musculus
ccctgctgctgctgcc

SEQ ID NO: 387935 - DNA, 16 bp, M. musculus
ccctgctggaggaagt

SEQ ID NO: 387936 - DNA, 16 bp, M. musculus
ccctgctggctctgct

SEQ ID NO: 387937 - DNA, 16 bp, M. musculus
ccctgctggctgtcct

SEQ ID NO: 387938 - DNA, 16 bp, M. musculus
ccctgctggtcctggt

SEQ ID NO: 387939 - DNA, 16 bp, M. musculus
ccctgctgtccctgct

SEQ ID NO: 387940 - DNA, 16 bp, M. musculus
ccctgctgtcctggaa

SEQ ID NO: 387941 - DNA, 16 bp, M. musculus
ccctgctgttgggagg

SEQ ID NO: 387942 - DNA, 16 bp, M. musculus
ccctgcttcctgacct

SEQ ID NO: 387943 - DNA, 16 bp, M. musculus
ccctgcttcctggctg

SEQ ID NO: 387944 - DNA, 16 bp, M. musculus
ccctgcttctgtctcc

SEQ ID NO: 387945 - DNA, 16 bp, M. musculus
ccctggaacccacaag

SEQ ID NO: 387946 - DNA, 16 bp, M. musculus
ccctggaacccacaca

SEQ ID NO: 387947 - DNA, 16 bp, M. musculus
ccctggaactcaagtt

SEQ ID NO: 387948 - DNA, 16 bp, M. musculus
ccctggaactcactat

SEQ ID NO: 387949 - DNA, 19 bp, M. musculus
ccctggaactcactttgta

SEQ ID NO: 387950 - DNA, 16 bp, M. musculus
ccctggaactcatgtc

SEQ ID NO: 387951 - DNA, 16 bp, M. musculus
ccctggaactgaagtt

SEQ ID NO: 387952 - DNA, 16 bp, M. musculus
ccctggaactgcagct

SEQ ID NO: 387953 - DNA, 16 bp, M. musculus
ccctggaactggactt

SEQ ID NO: 387954 - DNA, 16 bp, M. musculus
ccctggaactggaggt

SEQ ID NO: 387955 - DNA, 16 bp, M. musculus
ccctggaagagacctg

SEQ ID NO: 387956 - DNA, 16 bp, M. musculus
ccctggaagctctagg

SEQ ID NO: 387957 - DNA, 16 bp, M. musculus
ccctggaattagagtt

SEQ ID NO: 387958 - DNA, 16 bp, M. musculus
ccctggacatcaccaa

SEQ ID NO: 387959 - DNA, 16 bp, M. musculus
ccctggacctggagtt

SEQ ID NO: 387960 - DNA, 16 bp, M. musculus
ccctggagaaaactga

SEQ ID NO: 387961 - DNA, 16 bp, M. musculus
ccctggagaacctgtt

SEQ ID NO: 387962 - DNA, 16 bp, M. musculus
ccctggagaccagaag

SEQ ID NO: 387963 - DNA, 16 bp, M. musculus
ccctggagatggagtt

SEQ ID NO: 387964 - DNA, 16 bp, M. musculus
ccctggagccctggag

SEQ ID NO: 387965 - DNA, 16 bp, M. musculus
ccctggagcctccagt

SEQ ID NO: 387966 - DNA, 16 bp, M. musculus
ccctggagctacagtt

SEQ ID NO: 387967 - DNA, 16 bp, M. musculus
ccctggagctccaggg

SEQ ID NO: 387968 - DNA, 16 bp, M. musculus
ccctggagctcctggg

SEQ ID NO: 387969 - DNA, 16 bp, M. musculus
ccctggagctggagat

SEQ ID NO: 387970 - DNA, 16 bp, M. musculus
ccctggagctggagtt

SEQ ID NO: 387971 - DNA, 16 bp, M. musculus
ccctggagctggattt

SEQ ID NO: 387972 - DNA, 16 bp, M. musculus
ccctggagtttgctgg

SEQ ID NO: 387973 - DNA, 16 bp, M. musculus
ccctggatatcctgga

SEQ ID NO: 387974 - DNA, 16 bp, M. musculus
ccctggatcccactgg

SEQ ID NO: 387975 - DNA, 16 bp, M. musculus
ccctggatctggaatt

SEQ ID NO: 387976 - DNA, 16 bp, M. musculus
ccctggatctgggcct

SEQ ID NO: 387977 - DNA, 16 bp, M. musculus
ccctggatgccctgga

SEQ ID NO: 387978 - DNA, 16 bp, M. musculus
ccctggatgttctgga

SEQ ID NO: 387979 - DNA, 16 bp, M. musculus
ccctggattcaatccc

SEQ ID NO: 387980 - DNA, 16 bp, M. musculus
ccctggatttgggcct

SEQ ID NO: 387981 - DNA, 16 bp, M. musculus
ccctggcatctttatt

SEQ ID NO: 387982 - DNA, 16 bp, M. musculus
ccctggcattcccatg

SEQ ID NO: 387983 - DNA, 16 bp, M. musculus
ccctggcattccccta

SEQ ID NO: 387984 - DNA, 16 bp, M. musculus
ccctggcattctgctg

SEQ ID NO: 387985 - DNA, 16 bp, M. musculus
ccctggccaaagcaac

SEQ ID NO: 387986 - DNA, 16 bp, M. musculus
ccctggccaagcatat

SEQ ID NO: 387987 - DNA, 16 bp, M. musculus
ccctggccaccaagtc

SEQ ID NO: 387988 - DNA, 16 bp, M. musculus
ccctggccatcctaga

SEQ ID NO: 387989 - DNA, 16 bp, M. musculus
ccctggccatcctgaa

SEQ ID NO: 387990 - DNA, 21 bp, M. musculus
ccctggccatcctggaactca

SEQ ID NO: 387991 - DNA, 16 bp, M. musculus
ccctggcccggggagt

SEQ ID NO: 387992 - DNA, 16 bp, M. musculus
ccctggcctgctcagc

SEQ ID NO: 387993 - DNA, 16 bp, M. musculus
ccctggccttcctgct

SEQ ID NO: 387994 - DNA, 16 bp, M. musculus
ccctggctaacctgga

SEQ ID NO: 387995 - DNA, 16 bp, M. musculus
ccctggctagcctgga

SEQ ID NO: 387996 - DNA, 16 bp, M. musculus
ccctggctatcctaga

SEQ ID NO: 387997 - DNA, 16 bp, M. musculus
ccctggctatgctgga

SEQ ID NO: 387998 - DNA, 16 bp, M. musculus
ccctggctccctgtgt

SEQ ID NO: 387999 - DNA, 16 bp, M. musculus
ccctggctccttctgg

SEQ ID NO: 388000 - DNA, 16 bp, M. musculus
ccctggctgacctggc

SEQ ID NO: 388001 - DNA, 16 bp, M. musculus
ccctggctgccctgaa

SEQ ID NO: 388002 - DNA, 16 bp, M. musculus
ccctggctgccctgga

SEQ ID NO: 388003 - DNA, 16 bp, M. musculus
ccctggctgctctttc

SEQ ID NO: 388004 - DNA, 16 bp, M. musculus
ccctggctgctgctgc

SEQ ID NO: 388005 - DNA, 16 bp, M. musculus
ccctggctggactgga

SEQ ID NO: 388006 - DNA, 16 bp, M. musculus
ccctggctggcttgga

SEQ ID NO: 388007 - DNA, 16 bp, M. musculus
ccctggctggtctgaa

SEQ ID NO: 388008 - DNA, 16 bp, M. musculus
ccctggctggtctgga

SEQ ID NO: 388009 - DNA, 16 bp, M. musculus
ccctggctgtcccaga

SEQ ID NO: 388010 - DNA, 16 bp, M. musculus
ccctggctgtcctgca

SEQ ID NO: 388011 - DNA, 16 bp, M. musculus
ccctggctgtctggaa

SEQ ID NO: 388012 - DNA, 16 bp, M. musculus
ccctggctgtcttgga

SEQ ID NO: 388013 - DNA, 16 bp, M. musculus
ccctggctgtgctaga

SEQ ID NO: 388014 - DNA, 16 bp, M. musculus
ccctggctgtgctgga

SEQ ID NO: 388015 - DNA, 16 bp, M. musculus
ccctggcttactcagc

SEQ ID NO: 388016 - DNA, 16 bp, M. musculus
ccctggcttccttcag

SEQ ID NO: 388017 - DNA, 16 bp, M. musculus
ccctggcttgcctgga

SEQ ID NO: 388018 - DNA, 16 bp, M. musculus
ccctggcttgttcagc

SEQ ID NO: 388019 - DNA, 16 bp, M. musculus
ccctggctttcccttg

SEQ ID NO: 388020 - DNA, 16 bp, M. musculus
ccctggctttcctctg

SEQ ID NO: 388021 - DNA, 16 bp, M. musculus
ccctggctttctcagc

SEQ ID NO: 388022 - DNA, 16 bp, M. musculus
ccctggcttttccctg

SEQ ID NO: 388023 - DNA, 16 bp, M. musculus
ccctgggaactcccag

SEQ ID NO: 388024 - DNA, 16 bp, M. musculus
ccctgggaactctggg

SEQ ID NO: 388025 - DNA, 16 bp, M. musculus
ccctgggaagggaaaa

SEQ ID NO: 388026 - DNA, 16 bp, M. musculus
ccctgggactcaggag

SEQ ID NO: 388027 - DNA, 16 bp, M. musculus
ccctgggactcaggtg

SEQ ID NO: 388028 - DNA, 16 bp, M. musculus
ccctgggactgcagtt

SEQ ID NO: 388029 - DNA, 16 bp, M. musculus
ccctgggactggagct

SEQ ID NO: 388030 - DNA, 16 bp, M. musculus
ccctgggacttggggg

SEQ ID NO: 388031 - DNA, 16 bp, M. musculus
ccctgggagaggctaa

SEQ ID NO: 388032 - DNA, 16 bp, M. musculus
ccctgggagctcccag

SEQ ID NO: 388033 - DNA, 16 bp, M. musculus
ccctgggagctctggg

SEQ ID NO: 388034 - DNA, 16 bp, M. musculus
ccctgggagctcttgg

SEQ ID NO: 388035 - DNA, 16 bp, M. musculus
ccctgggagctttgtg

SEQ ID NO: 388036 - DNA, 16 bp, M. musculus
ccctgggaggcctgtt

SEQ ID NO: 388037 - DNA, 16 bp, M. musculus
ccctgggagttcccag

SEQ ID NO: 388038 - DNA, 16 bp, M. musculus
ccctgggatgaagcca

SEQ ID NO: 388039 - DNA, 16 bp, M. musculus
ccctgggattctacct

SEQ ID NO: 388040 - DNA, 16 bp, M. musculus
ccctgggattggagtt

SEQ ID NO: 388041 - DNA, 16 bp, M. musculus
ccctgggcacccaggg

SEQ ID NO: 388042 - DNA, 16 bp, M. musculus
ccctgggccagggacc

SEQ ID NO: 388043 - DNA, 16 bp, M. musculus
ccctgggccatcaagt

SEQ ID NO: 388044 - DNA, 16 bp, M. musculus
ccctgggccttgctgg

SEQ ID NO: 388045 - DNA, 16 bp, M. musculus
ccctgggctcaatcct

SEQ ID NO: 388046 - DNA, 16 bp, M. musculus
ccctgggctcagtccc

SEQ ID NO: 388047 - DNA, 16 bp, M. musculus
ccctgggctcagtcct

SEQ ID NO: 388048 - DNA, 16 bp, M. musculus
ccctgggctcagtctg

SEQ ID NO: 388049 - DNA, 16 bp, M. musculus
ccctgggctcttcccc

SEQ ID NO: 388050 - DNA, 16 bp, M. musculus
ccctgggctggaaagt

SEQ ID NO: 388051 - DNA, 16 bp, M. musculus
ccctgggctggagaag

SEQ ID NO: 388052 - DNA, 16 bp, M. musculus
ccctggggagcaagcc

SEQ ID NO: 388053 - DNA, 16 bp, M. musculus
ccctggggaggaccac

SEQ ID NO: 388054 - DNA, 16 bp, M. musculus
ccctggggaggcagag

SEQ ID NO: 388055 - DNA, 16 bp, M. musculus
ccctggggccagctct

SEQ ID NO: 388056 - DNA, 16 bp, M. musculus
ccctggggcccccagg

SEQ ID NO: 388057 - DNA, 16 bp, M. musculus
ccctggggcctccagg

SEQ ID NO: 388058 - DNA, 16 bp, M. musculus
ccctggggcctctagt

SEQ ID NO: 388059 - DNA, 16 bp, M. musculus
ccctggggccttcagt

SEQ ID NO: 388060 - DNA, 16 bp, M. musculus
ccctgggggctcccag

SEQ ID NO: 388061 - DNA, 16 bp, M. musculus
ccctggggttatagga

SEQ ID NO: 388062 - DNA, 16 bp, M. musculus
ccctgggtatcctccc

SEQ ID NO: 388063 - DNA, 16 bp, M. musculus
ccctgggtccaatccc

SEQ ID NO: 388064 - DNA, 16 bp, M. musculus
ccctgggtcccatccc

SEQ ID NO: 388065 - DNA, 16 bp, M. musculus
ccctgggtcctccagt

SEQ ID NO: 388066 - DNA, 16 bp, M. musculus
ccctgggtgctctggg

SEQ ID NO: 388067 - DNA, 16 bp, M. musculus
ccctgggtgctgggaa

SEQ ID NO: 388068 - DNA, 16 bp, M. musculus
ccctgggtggcctgga

SEQ ID NO: 388069 - DNA, 16 bp, M. musculus
ccctgggttcaatcct

SEQ ID NO: 388070 - DNA, 16 bp, M. musculus
ccctgggttcaattcc

SEQ ID NO: 388071 - DNA, 16 bp, M. musculus
ccctgggttcagttct

SEQ ID NO: 388072 - DNA, 16 bp, M. musculus
ccctgggttccatcca

SEQ ID NO: 388073 - DNA, 16 bp, M. musculus
ccctgggttccatcct

SEQ ID NO: 388074 - DNA, 17 bp, M. musculus
ccctgggttctataaga

SEQ ID NO: 388075 - DNA, 16 bp, M. musculus
ccctgggtttgatccc

SEQ ID NO: 388076 - DNA, 24 bp, M. musculus
ccctggtcatgtcatgtggtgagg

SEQ ID NO: 388077 - DNA, 16 bp, M. musculus
ccctggtccctcctgc

SEQ ID NO: 388078 - DNA, 16 bp, M. musculus
ccctggtcttccctgg

SEQ ID NO: 388079 - DNA, 16 bp, M. musculus
ccctggtgcctttggg

SEQ ID NO: 388080 - DNA, 16 bp, M. musculus
ccctggtgctgcagtg

SEQ ID NO: 388081 - DNA, 16 bp, M. musculus
ccctggtggtgtggat

SEQ ID NO: 388082 - DNA, 16 bp, M. musculus
ccctggtggtgtgggt

SEQ ID NO: 388083 - DNA, 16 bp, M. musculus
ccctggttcttccctc

SEQ ID NO: 388084 - DNA, 16 bp, M. musculus
ccctggttcttgtggg

SEQ ID NO: 388085 - DNA, 16 bp, M. musculus
ccctggtttgtttgtt

SEQ ID NO: 388086 - DNA, 16 bp, M. musculus
ccctggttttcctgga

SEQ ID NO: 388087 - DNA, 16 bp, M. musculus
ccctgtaaattccttt

SEQ ID NO: 388088 - DNA, 16 bp, M. musculus
ccctgtactccatcca

SEQ ID NO: 388089 - DNA, 16 bp, M. musculus
ccctgtagccctgggg

SEQ ID NO: 388090 - DNA, 16 bp, M. musculus
ccctgtatccctggga

SEQ ID NO: 388091 - DNA, 16 bp, M. musculus
ccctgtattggggtat

SEQ ID NO: 388092 - DNA, 16 bp, M. musculus
ccctgtattttcttta

SEQ ID NO: 388093 - DNA, 16 bp, M. musculus
ccctgtcatgatggac

SEQ ID NO: 388094 - DNA, 16 bp, M. musculus
ccctgtccatgtgagc

SEQ ID NO: 388095 - DNA, 16 bp, M. musculus
ccctgtcctcagtcca

SEQ ID NO: 388096 - DNA, 16 bp, M. musculus
ccctgtcctggagaaa

SEQ ID NO: 388097 - DNA, 16 bp, M. musculus
ccctgtctagtccctg

SEQ ID NO: 388098 - DNA, 16 bp, M. musculus
ccctgtctatctacta

SEQ ID NO: 388099 - DNA, 16 bp, M. musculus
ccctgtctcaaaagac

SEQ ID NO: 388100 - DNA, 16 bp, M. musculus
ccctgtctcaaaatat

SEQ ID NO: 388101 - DNA, 16 bp, M. musculus
ccctgtctcaaaccaa

SEQ ID NO: 388102 - DNA, 16 bp, M. musculus
ccctgtctcaagaaaa

SEQ ID NO: 388103 - DNA, 16 bp, M. musculus
ccctgtctccagaaac

SEQ ID NO: 388104 - DNA, 16 bp, M. musculus
ccctgtctccatgtgg

SEQ ID NO: 388105 - DNA, 16 bp, M. musculus
ccctgtctctctgtct

SEQ ID NO: 388106 - DNA, 16 bp, M. musculus
ccctgtctctgtctct

SEQ ID NO: 388107 - DNA, 16 bp, M. musculus
ccctgtctctgtttct

SEQ ID NO: 388108 - DNA, 16 bp, M. musculus
ccctgtctgggaaaaa

SEQ ID NO: 388109 - DNA, 16 bp, M. musculus
ccctgtcttcttagat

SEQ ID NO: 388110 - DNA, 16 bp, M. musculus
ccctgtcttgagaaac

SEQ ID NO: 388111 - DNA, 16 bp, M. musculus
ccctgtcttggagaaa

SEQ ID NO: 388112 - DNA, 16 bp, M. musculus
ccctgtgaaggcccca

SEQ ID NO: 388113 - DNA, 16 bp, M. musculus
ccctgtgactgtgctc

SEQ ID NO: 388114 - DNA, 16 bp, M. musculus
ccctgtgagccctgct

SEQ ID NO: 388115 - DNA, 16 bp, M. musculus
ccctgtgatccgtcca

SEQ ID NO: 388116 - DNA, 16 bp, M. musculus
ccctgtgatctatcca

SEQ ID NO: 388117 - DNA, 17 bp, M. musculus
ccctgtgcactcaccag

SEQ ID NO: 388118 - DNA, 16 bp, M. musculus
ccctgtgcagagaggc

SEQ ID NO: 388119 - DNA, 16 bp, M. musculus
ccctgtgccacagctc

SEQ ID NO: 388120 - DNA, 16 bp, M. musculus
ccctgtgccctgtagt

SEQ ID NO: 388121 - DNA, 16 bp, M. musculus
ccctgtgccctgtgcc

SEQ ID NO: 388122 - DNA, 16 bp, M. musculus
ccctgtgctttctgct

SEQ ID NO: 388123 - DNA, 16 bp, M. musculus
ccctgtggcaatgccc

SEQ ID NO: 388124 - DNA, 16 bp, M. musculus
ccctgtggcagagcag

SEQ ID NO: 388125 - DNA, 16 bp, M. musculus
ccctgtgggtgctgag

SEQ ID NO: 388126 - DNA, 16 bp, M. musculus
ccctgtggtctgagga

SEQ ID NO: 388127 - DNA, 16 bp, M. musculus
ccctgtgtagtttctg

SEQ ID NO: 388128 - DNA, 16 bp, M. musculus
ccctgtgtctctctgt

SEQ ID NO: 388129 - DNA, 16 bp, M. musculus
ccctgtgtgagctcct

SEQ ID NO: 388130 - DNA, 16 bp, M. musculus
ccctgtgtgagttctt

SEQ ID NO: 388131 - DNA, 16 bp, M. musculus
ccctgttacagatggt

SEQ ID NO: 388132 - DNA, 16 bp, M. musculus
ccctgttcccactgtt

SEQ ID NO: 388133 - DNA, 17 bp, M. musculus
ccctgttcctcctggga

SEQ ID NO: 388134 - DNA, 16 bp, M. musculus
ccctgttctagttgtt

SEQ ID NO: 388135 - DNA, 16 bp, M. musculus
ccctgttggtcttcct

SEQ ID NO: 388136 - DNA, 16 bp, M. musculus
ccctgtttcaagaaaa

SEQ ID NO: 388137 - DNA, 16 bp, M. musculus
ccctgtttccaagagg

SEQ ID NO: 388138 - DNA, 16 bp, M. musculus
cccttaaagaaataca

SEQ ID NO: 388139 - DNA, 16 bp, M. musculus
cccttaaagaagaaac

SEQ ID NO: 388140 - DNA, 16 bp, M. musculus
cccttaaagagttaca

SEQ ID NO: 388141 - DNA, 16 bp, M. musculus
cccttaatcactgagc

SEQ ID NO: 388142 - DNA, 17 bp, M. musculus
cccttagttctcaggca

SEQ ID NO: 388143 - DNA, 16 bp, M. musculus
cccttcaaagaaggac

SEQ ID NO: 388144 - DNA, 16 bp, M. musculus
cccttcacaatctcct

SEQ ID NO: 388145 - DNA, 16 bp, M. musculus
cccttcacccttgcaa

SEQ ID NO: 388146 - DNA, 16 bp, M. musculus
cccttcagctccttaa

SEQ ID NO: 388147 - DNA, 16 bp, M. musculus
cccttcagctcttggg

SEQ ID NO: 388148 - DNA, 16 bp, M. musculus
cccttcagggaggctg

SEQ ID NO: 388149 - DNA, 16 bp, M. musculus
cccttcaggtccttca

SEQ ID NO: 388150 - DNA, 16 bp, M. musculus
cccttcataataaaag

SEQ ID NO: 388151 - DNA, 16 bp, M. musculus
cccttccacacacata

SEQ ID NO: 388152 - DNA, 16 bp, M. musculus
cccttccactgcccag

SEQ ID NO: 388153 - DNA, 16 bp, M. musculus
cccttccagcccactg

SEQ ID NO: 388154 - DNA, 16 bp, M. musculus
cccttccatggtggca

SEQ ID NO: 388155 - DNA, 16 bp, M. musculus
cccttcccagtcttcc

SEQ ID NO: 388156 - DNA, 16 bp, M. musculus
cccttccccagccctg

SEQ ID NO: 388157 - DNA, 16 bp, M. musculus
cccttccccatatctg

SEQ ID NO: 388158 - DNA, 16 bp, M. musculus
cccttcccctctgaag

SEQ ID NO: 388159 - DNA, 16 bp, M. musculus
cccttccctccccaag

SEQ ID NO: 388160 - DNA, 16 bp, M. musculus
cccttccctgctgagc

SEQ ID NO: 388161 - DNA, 16 bp, M. musculus
cccttcctgccttcaa

SEQ ID NO: 388162 - DNA, 16 bp, M. musculus
cccttcctggcacctg

SEQ ID NO: 388163 - DNA, 16 bp, M. musculus
cccttcctgggcatcc

SEQ ID NO: 388164 - DNA, 16 bp, M. musculus
cccttcctggtctcct

SEQ ID NO: 388165 - DNA, 16 bp, M. musculus
cccttcctggtcttcc

SEQ ID NO: 388166 - DNA, 16 bp, M. musculus
cccttctaagatggat

SEQ ID NO: 388167 - DNA, 16 bp, M. musculus
cccttctcagaggaga

SEQ ID NO: 388168 - DNA, 16 bp, M. musculus
cccttctcctcagttt

SEQ ID NO: 388169 - DNA, 16 bp, M. musculus
cccttctcctctgaga

SEQ ID NO: 388170 - DNA, 16 bp, M. musculus
cccttctgtctgtctg

SEQ ID NO: 388171 - DNA, 16 bp, M. musculus
cccttcttaaaatcct

SEQ ID NO: 388172 - DNA, 16 bp, M. musculus
cccttcttcaactcct

SEQ ID NO: 388173 - DNA, 16 bp, M. musculus
cccttcttcctcctgg

SEQ ID NO: 388174 - DNA, 16 bp, M. musculus
cccttctttaaaaaaa

SEQ ID NO: 388175 - DNA, 16 bp, M. musculus
cccttgagtgctggga

SEQ ID NO: 388176 - DNA, 16 bp, M. musculus
cccttgatctcctctt

SEQ ID NO: 388177 - DNA, 16 bp, M. musculus
cccttgatctcctttc

SEQ ID NO: 388178 - DNA, 16 bp, M. musculus
cccttgcaacctcccc

SEQ ID NO: 388179 - DNA, 16 bp, M. musculus
cccttgcaatctcccc

SEQ ID NO: 388180 - DNA, 16 bp, M. musculus
cccttgcatttggagc

SEQ ID NO: 388181 - DNA, 16 bp, M. musculus
cccttgccagagcagt

SEQ ID NO: 388182 - DNA, 16 bp, M. musculus
cccttgccagctgcag

SEQ ID NO: 388183 - DNA, 16 bp, M. musculus
cccttgccccaacagc

SEQ ID NO: 388184 - DNA, 53 bp, M. musculus
cccttgcgggtgttgggcaagactctgctggcaaggtagcccggggctcgagt

SEQ ID NO: 388185 - DNA, 17 bp, M. musculus
cccttgctgtccttcag

SEQ ID NO: 388186 - DNA, 16 bp, M. musculus
cccttggagcctcctc

SEQ ID NO: 388187 - DNA, 16 bp, M. musculus
cccttggcagcctctg

SEQ ID NO: 388188 - DNA, 16 bp, M. musculus
cccttggtcttctgaa

SEQ ID NO: 388189 - DNA, 16 bp, M. musculus
cccttgtccctgtcca

SEQ ID NO: 388190 - DNA, 20 bp, M. musculus
cccttgtgggtgggaccatc

SEQ ID NO: 388191 - DNA, 16 bp, M. musculus
cccttgtgggtgggat

SEQ ID NO: 388192 - DNA, 16 bp, M. musculus
cccttgtgggtgtcag

SEQ ID NO: 388193 - DNA, 16 bp, M. musculus
cccttgtttctgagag

SEQ ID NO: 388194 - DNA, 16 bp, M. musculus
ccctttaagtcctgag

SEQ ID NO: 388195 - DNA, 16 bp, M. musculus
ccctttaagttgtgaa

SEQ ID NO: 388196 - DNA, 16 bp, M. musculus
ccctttaccctgcttc

SEQ ID NO: 388197 - DNA, 16 bp, M. musculus
ccctttagctccttgg

SEQ ID NO: 388198 - DNA, 16 bp, M. musculus
ccctttagtacagttc

SEQ ID NO: 388199 - DNA, 16 bp, M. musculus
ccctttccaaacatca

SEQ ID NO: 388200 - DNA, 16 bp, M. musculus
ccctttccaccccaag

SEQ ID NO: 388201 - DNA, 16 bp, M. musculus
ccctttccaggcagct

SEQ ID NO: 388202 - DNA, 16 bp, M. musculus
ccctttcccctgctca

SEQ ID NO: 388203 - DNA, 16 bp, M. musculus
ccctttcctccccatg

SEQ ID NO: 388204 - DNA, 16 bp, M. musculus
ccctttcctggtctcc

SEQ ID NO: 388205 - DNA, 16 bp, M. musculus
ccctttccttgctgtg

SEQ ID NO: 388206 - DNA, 16 bp, M. musculus
ccctttctcctctata

SEQ ID NO: 388207 - DNA, 16 bp, M. musculus
ccctttctgaaccttc

SEQ ID NO: 388208 - DNA, 16 bp, M. musculus
ccctttctgaagagaa

SEQ ID NO: 388209 - DNA, 16 bp, M. musculus
ccctttctgacctcca

SEQ ID NO: 388210 - DNA, 16 bp, M. musculus
ccctttcttaaaaaaa

SEQ ID NO: 388211 - DNA, 16 bp, M. musculus
ccctttcttccccagc

SEQ ID NO: 388212 - DNA, 16 bp, M. musculus
ccctttcttcctcaac

SEQ ID NO: 388213 - DNA, 16 bp, M. musculus
ccctttcttctcagag

SEQ ID NO: 388214 - DNA, 16 bp, M. musculus
ccctttgaaaaccccc

SEQ ID NO: 388215 - DNA, 16 bp, M. musculus
ccctttggccctgggg

SEQ ID NO: 388216 - DNA, 16 bp, M. musculus
ccctttggggcctgca

SEQ ID NO: 388217 - DNA, 16 bp, M. musculus
ccctttgtcctgtgga

SEQ ID NO: 388218 - DNA, 16 bp, M. musculus
ccctttgtgacttctt

SEQ ID NO: 388219 - DNA, 16 bp, M. musculus
ccctttgtgggcagtg

SEQ ID NO: 388220 - DNA, 16 bp, M. musculus
cccttttaggtcttgg

SEQ ID NO: 388221 - DNA, 16 bp, M. musculus
cccttttcctcagctt

SEQ ID NO: 388222 - DNA, 16 bp, M. musculus
cccttttcctctgaga

SEQ ID NO: 388223 - DNA, 16 bp, M. musculus
cccttttcgggctcca

SEQ ID NO: 388224 - DNA, 16 bp, M. musculus
cccttttctggagtat

SEQ ID NO: 388225 - DNA, 16 bp, M. musculus
cccttttgcttgtgca

SEQ ID NO: 388226 - DNA, 16 bp, M. musculus
cccttttgtccacaca

SEQ ID NO: 388227 - DNA, 16 bp, M. musculus
ccctttttaaaaaata

SEQ ID NO: 388228 - DNA, 16 bp, M. musculus
ccctttttatggtctt

SEQ ID NO: 388229 - DNA, 17 bp, M. musculus
ccctttttttggccctg

SEQ ID NO: 388230 - DNA, 18 bp, M. musculus
ccgaaaaaattcaatggc

SEQ ID NO: 388231 - DNA, 16 bp, M. musculus
ccgaaagagcagtcag

SEQ ID NO: 388232 - DNA, 16 bp, M. musculus
ccgaaagtcccctata

SEQ ID NO: 388233 - DNA, 16 bp, M. musculus
ccgaagctggaaagaa

SEQ ID NO: 388234 - DNA, 16 bp, M. musculus
ccgaaggtcagaagtt

SEQ ID NO: 388235 - DNA, 16 bp, M. musculus
ccgacaaatgcagctc

SEQ ID NO: 388236 - DNA, 16 bp, M. musculus
ccgacaggaccctgat

SEQ ID NO: 388237 - DNA, 16 bp, M. musculus
ccgacctctctcggcc

SEQ ID NO: 388238 - DNA, 16 bp, M. musculus
ccgactagtccatcct

SEQ ID NO: 388239 - DNA, 16 bp, M. musculus
ccgactgctctcccga

SEQ ID NO: 388240 - DNA, 16 bp, M. musculus
ccgactgctcttccaa

SEQ ID NO: 388241 - DNA, 16 bp, M. musculus
ccgactgctcttccga

SEQ ID NO: 388242 - DNA, 80 bp, M. musculus
ccgagagagggctactgtggcaaatggggctgtgagaccactggacaggcatactggaagccatcatcatcatgggacct

SEQ ID NO: 388243 - DNA, 16 bp, M. musculus
ccgagcatgcgcagtg

SEQ ID NO: 388244 - DNA, 16 bp, M. musculus
ccgagccatctcacca

SEQ ID NO: 388245 - DNA, 16 bp, M. musculus
ccgagtactgggatta

SEQ ID NO: 388246 - DNA, 16 bp, M. musculus
ccgagtcactgcctgg

SEQ ID NO: 388247 - DNA, 16 bp, M. musculus
ccgagtcctctggaag

SEQ ID NO: 388248 - DNA, 16 bp, M. musculus
ccgagtggggcagtct

SEQ ID NO: 388249 - DNA, 16 bp, M. musculus
ccgagttcaatccctg

SEQ ID NO: 388250 - DNA, 16 bp, M. musculus
ccgatgccctcttctg

SEQ ID NO: 388251 - DNA, 16 bp, M. musculus
ccgatgcccttttctg

SEQ ID NO: 388252 - DNA, 16 bp, M. musculus
ccgatttctgagttcg

SEQ ID NO: 388253 - DNA, 17 bp, M. musculus
ccgcacgattggattgg

SEQ ID NO: 388254 - DNA, 29 bp, M. musculus
ccgcagttctggttccggaatgagggatc

SEQ ID NO: 388255 - DNA, 16 bp, M. musculus
ccgccaagttcctgct

SEQ ID NO: 388256 - DNA, 16 bp, M. musculus
ccgccagcctctgcct

SEQ ID NO: 388257 - DNA, 16 bp, M. musculus
ccgcccacagtgggct

SEQ ID NO: 388258 - DNA, 17 bp, M. musculus
ccgcctaggacgtatta

SEQ ID NO: 388259 - DNA, 16 bp, M. musculus
ccgcctctgcctcctg

SEQ ID NO: 388260 - DNA, 16 bp, M. musculus
ccgcctctgcctctca

SEQ ID NO: 388261 - DNA, 16 bp, M. musculus
ccgcctggctcaggag

SEQ ID NO: 388262 - DNA, 16 bp, M. musculus
ccgcctggctcggaag

SEQ ID NO: 388263 - DNA, 16 bp, M. musculus
ccgcgagatgggcagt

SEQ ID NO: 388264 - DNA, 17 bp, M. musculus
ccgcgatgtatgcttta

SEQ ID NO: 388265 - DNA, 16 bp, M. musculus
ccgctaacccggcccc

SEQ ID NO: 388266 - DNA, 16 bp, M. musculus
ccgctcagccatctct

SEQ ID NO: 388267 - DNA, 16 bp, M. musculus
ccgctgccgctgctgc

SEQ ID NO: 388268 - DNA, 16 bp, M. musculus
ccgctgcctggtgcct

SEQ ID NO: 388269 - DNA, 16 bp, M. musculus
ccgctgctgctgaggc

SEQ ID NO: 388270 - DNA, 16 bp, M. musculus
ccgcttcatcaccctc

SEQ ID NO: 388271 - DNA, 16 bp, M. musculus
ccgcttcctgaccctg

SEQ ID NO: 388272 - DNA, 16 bp, M. musculus
ccgcttcctgggttca

SEQ ID NO: 388273 - DNA, 16 bp, M. musculus
ccgcttcttggccctg

SEQ ID NO: 388274 - DNA, 16 bp, M. musculus
ccgcttgctcagtccc

SEQ ID NO: 388275 - DNA, 16 bp, M. musculus
ccggaaagatggctca

SEQ ID NO: 388276 - DNA, 16 bp, M. musculus
ccggaaccaagatggt

SEQ ID NO: 388277 - DNA, 16 bp, M. musculus
ccggaaccaggatggc

SEQ ID NO: 388278 - DNA, 16 bp, M. musculus
ccggaagatcctgcaa

SEQ ID NO: 388279 - DNA, 45 bp, M. musculus
ccggagccggagccggagccggagccggagccggagccggagccg

SEQ ID NO: 388280 - DNA, 16 bp, M. musculus
ccggaggacccagcaa

SEQ ID NO: 388281 - DNA, 16 bp, M. musculus
ccggaggcaggaactg

SEQ ID NO: 388282 - DNA, 16 bp, M. musculus
ccggatgtctggagcc

SEQ ID NO: 388283 - DNA, 17 bp, M. musculus
ccggcaagaacacactc

SEQ ID NO: 388284 - DNA, 16 bp, M. musculus
ccggcaagaacacgct

SEQ ID NO: 388285 - DNA, 21 bp, M. musculus
ccggccaggaaagacgcaaca

SEQ ID NO: 388286 - DNA, 17 bp, M. musculus
ccggccaggaagaacac

SEQ ID NO: 388287 - DNA, 16 bp, M. musculus
ccggcctcaaactcag

SEQ ID NO: 388288 - DNA, 16 bp, M. musculus
ccggcctgacacccaa

SEQ ID NO: 388289 - DNA, 16 bp, M. musculus
ccggcctgcagctctc

SEQ ID NO: 388290 - DNA, 20 bp, M. musculus
ccggctccggctccggctcc

SEQ ID NO: 388291 - DNA, 16 bp, M. musculus
ccggctgttctggaac

SEQ ID NO: 388292 - DNA, 16 bp, M. musculus
ccggcttgttttgttt

SEQ ID NO: 388293 - DNA, 16 bp, M. musculus
ccgggacacaagatgg

SEQ ID NO: 388294 - DNA, 16 bp, M. musculus
ccgggaggcctttgcc

SEQ ID NO: 388295 - DNA, 16 bp, M. musculus
ccgggcatggtggcac

SEQ ID NO: 388296 - DNA, 17 bp, M. musculus
ccgggcctctgtgagcc

SEQ ID NO: 388297 - DNA, 16 bp, M. musculus
ccggggcctccagtct

SEQ ID NO: 388298 - DNA, 16 bp, M. musculus
ccggggcctgaggcag

SEQ ID NO: 388299 - DNA, 19 bp, M. musculus
ccggggctacacagagaaa

SEQ ID NO: 388300 - DNA, 16 bp, M. musculus
ccggggttccagacct

SEQ ID NO: 388301 - DNA, 16 bp, M. musculus
ccggggttccatccca

SEQ ID NO: 388302 - DNA, 16 bp, M. musculus
ccgggtggtggtggca

SEQ ID NO: 388303 - DNA, 16 bp, M. musculus
ccggttaatggagaag

SEQ ID NO: 388304 - DNA, 16 bp, M. musculus
ccgtccaatgtctggg

SEQ ID NO: 388305 - DNA, 16 bp, M. musculus
ccgtccctgcatccct

SEQ ID NO: 388306 - DNA, 16 bp, M. musculus
ccgtccgattgggcag

SEQ ID NO: 388307 - DNA, 16 bp, M. musculus
ccgtccgtccgtctgt

SEQ ID NO: 388308 - DNA, 16 bp, M. musculus
ccgtccgtctgtccgt

SEQ ID NO: 388309 - DNA, 16 bp, M. musculus
ccgtccgtctgtctgt

SEQ ID NO: 388310 - DNA, 17 bp, M. musculus
ccgtccttgggagacaa

SEQ ID NO: 388311 - DNA, 16 bp, M. musculus
ccgtctcaaaaaacca

SEQ ID NO: 388312 - DNA, 16 bp, M. musculus
ccgtctcaaaaacaaa

SEQ ID NO: 388313 - DNA, 16 bp, M. musculus
ccgtctgtaatgagat

SEQ ID NO: 388314 - DNA, 16 bp, M. musculus
ccgtgctcagtccaat

SEQ ID NO: 388315 - DNA, 16 bp, M. musculus
ccgtggtgatgaacag

SEQ ID NO: 388316 - DNA, 16 bp, M. musculus
ccgtggtggcgcacgc

SEQ ID NO: 388317 - DNA, 16 bp, M. musculus
ccgtgtcatttttcct

SEQ ID NO: 388318 - DNA, 16 bp, M. musculus
ccgtgtgggtgctgag

SEQ ID NO: 388319 - DNA, 16 bp, M. musculus
ccgtgtggttgctgga

SEQ ID NO: 388320 - DNA, 16 bp, M. musculus
cctaaaaaaagcaaga

SEQ ID NO: 388321 - DNA, 16 bp, M. musculus
cctaaaaaggataata

SEQ ID NO: 388322 - DNA, 16 bp, M. musculus
cctaaaaattttacca

SEQ ID NO: 388323 - DNA, 16 bp, M. musculus
cctaaaacaaaagggt

SEQ ID NO: 388324 - DNA, 16 bp, M. musculus
cctaaaacaggagcca

SEQ ID NO: 388325 - DNA, 16 bp, M. musculus
cctaaaagaagacagc

SEQ ID NO: 388326 - DNA, 16 bp, M. musculus
cctaaaagcactagaa

SEQ ID NO: 388327 - DNA, 16 bp, M. musculus
cctaaaagctccagaa

SEQ ID NO: 388328 - DNA, 16 bp, M. musculus
cctaaaatttctacca

SEQ ID NO: 388329 - DNA, 16 bp, M. musculus
cctaaacaagacctgc

SEQ ID NO: 388330 - DNA, 16 bp, M. musculus
cctaaacagagcagca

SEQ ID NO: 388331 - DNA, 16 bp, M. musculus
cctaaaccacagaaaa

SEQ ID NO: 388332 - DNA, 16 bp, M. musculus
cctaaaccagagaaag

SEQ ID NO: 388333 - DNA, 16 bp, M. musculus
cctaaagaaatagagg

SEQ ID NO: 388334 - DNA, 16 bp, M. musculus
cctaaagaactagaag

SEQ ID NO: 388335 - DNA, 16 bp, M. musculus
cctaaagaatgagatg

SEQ ID NO: 388336 - DNA, 16 bp, M. musculus
cctaaagacatgttca

SEQ ID NO: 388337 - DNA, 16 bp, M. musculus
cctaaagctattgcct

SEQ ID NO: 388338 - DNA, 16 bp, M. musculus
cctaaagctgttgcct

SEQ ID NO: 388339 - DNA, 16 bp, M. musculus
cctaaaggaagagatg

SEQ ID NO: 388340 - DNA, 16 bp, M. musculus
cctaaaggctctagaa

SEQ ID NO: 388341 - DNA, 16 bp, M. musculus
cctaaatcacagaaag

SEQ ID NO: 388342 - DNA, 16 bp, M. musculus
cctaaatgggagaaag

SEQ ID NO: 388343 - DNA, 16 bp, M. musculus
cctaaattcaaggtca

SEQ ID NO: 388344 - DNA, 40 bp, M. musculus
cctaacacacctgaaaaggtagacctggatttaaaagcat

SEQ ID NO: 388345 - DNA, 16 bp, M. musculus
cctaacacagcttcca

SEQ ID NO: 388346 - DNA, 16 bp, M. musculus
cctaacagcaggaaca

SEQ ID NO: 388347 - DNA, 16 bp, M. musculus
cctaacatctgtgcca

SEQ ID NO: 388348 - DNA, 16 bp, M. musculus
cctaaccctcaagaga

SEQ ID NO: 388349 - DNA, 16 bp, M. musculus
cctaacccttctcaaa

SEQ ID NO: 388350 - DNA, 16 bp, M. musculus
cctaactaagacagtt

SEQ ID NO: 388351 - DNA, 18 bp, M. musculus
cctaactagtaaacaagc

SEQ ID NO: 388352 - DNA, 16 bp, M. musculus
cctaactcagtgaaga

SEQ ID NO: 388353 - DNA, 16 bp, M. musculus
cctaagaccatcggaa

SEQ ID NO: 388354 - DNA, 17 bp, M. musculus
cctaagagaacacaaat

SEQ ID NO: 388355 - DNA, 16 bp, M. musculus
cctaagagctctagaa

SEQ ID NO: 388356 - DNA, 16 bp, M. musculus
cctaagatcattggaa

SEQ ID NO: 388357 - DNA, 16 bp, M. musculus
cctaagattctgggca

SEQ ID NO: 388358 - DNA, 16 bp, M. musculus
cctaagatttctatct

SEQ ID NO: 388359 - DNA, 16 bp, M. musculus
cctaagattttttttt

SEQ ID NO: 388360 - DNA, 16 bp, M. musculus
cctaagcactgagcca

SEQ ID NO: 388361 - DNA, 31 bp, M. musculus
cctaagccacagcagcagcggtcgccatctt

SEQ ID NO: 388362 - DNA, 16 bp, M. musculus
cctaaggaaatagaag

SEQ ID NO: 388363 - DNA, 16 bp, M. musculus
cctaaggtcacacagc

SEQ ID NO: 388364 - DNA, 16 bp, M. musculus
cctaagtgctggaatt

SEQ ID NO: 388365 - DNA, 16 bp, M. musculus
cctaagtgctgggatc

SEQ ID NO: 388366 - DNA, 16 bp, M. musculus
cctaagttcaatccct

SEQ ID NO: 388367 - DNA, 16 bp, M. musculus
cctaagtttggggcta

SEQ ID NO: 388368 - DNA, 16 bp, M. musculus
cctaatatgggtgctg

SEQ ID NO: 388369 - DNA, 16 bp, M. musculus
cctaatcactgtgtgt

SEQ ID NO: 388370 - DNA, 16 bp, M. musculus
cctaatctgaaaaatg

SEQ ID NO: 388371 - DNA, 16 bp, M. musculus
cctaatcttgtaagcc

SEQ ID NO: 388372 - DNA, 16 bp, M. musculus
cctaatgactaagaat

SEQ ID NO: 388373 - DNA, 16 bp, M. musculus
cctaatgctgcaacct

SEQ ID NO: 388374 - DNA, 16 bp, M. musculus
cctaatgctgcttgta

SEQ ID NO: 388375 - DNA, 16 bp, M. musculus
cctaattcaaccacag

SEQ ID NO: 388376 - DNA, 16 bp, M. musculus
cctaattctaccacag

SEQ ID NO: 388377 - DNA, 16 bp, M. musculus
cctaattcttcctaaa

SEQ ID NO: 388378 - DNA, 16 bp, M. musculus
cctaattggttcttga

SEQ ID NO: 388379 - DNA, 16 bp, M. musculus
cctaattgttctcctg

SEQ ID NO: 388380 - DNA, 16 bp, M. musculus
cctaatttatttctca

SEQ ID NO: 388381 - DNA, 16 bp, M. musculus
cctaatttctttccca

SEQ ID NO: 388382 - DNA, 16 bp, M. musculus
cctaatttttttaaaa

SEQ ID NO: 388383 - DNA, 16 bp, M. musculus
cctacaaaatttgttt

SEQ ID NO: 388384 - DNA, 16 bp, M. musculus
cctacaaatttcataa

SEQ ID NO: 388385 - DNA, 16 bp, M. musculus
cctacaacaaaaggat

SEQ ID NO: 388386 - DNA, 16 bp, M. musculus
cctacaactggagtta

SEQ ID NO: 388387 - DNA, 16 bp, M. musculus
cctacacaacatccca

SEQ ID NO: 388388 - DNA, 16 bp, M. musculus
cctacagaaagagatg

SEQ ID NO: 388389 - DNA, 16 bp, M. musculus
cctacagaggacccag

SEQ ID NO: 388390 - DNA, 16 bp, M. musculus
cctacagaggataata

SEQ ID NO: 388391 - DNA, 16 bp, M. musculus
cctacagatgaagatg

SEQ ID NO: 388392 - DNA, 16 bp, M. musculus
cctacagcaagatggg

SEQ ID NO: 388393 - DNA, 16 bp, M. musculus
cctacagcctatagct

SEQ ID NO: 388394 - DNA, 16 bp, M. musculus
cctacaggaaactcat

SEQ ID NO: 388395 - DNA, 16 bp, M. musculus
cctacaggagtttttg

SEQ ID NO: 388396 - DNA, 16 bp, M. musculus
cctacaggccaatctg

SEQ ID NO: 388397 - DNA, 41 bp, M. musculus
cctacaggggcctgccagaggctccaaacagcatctctatc

SEQ ID NO: 388398 - DNA, 16 bp, M. musculus
cctacagtggggcatc

SEQ ID NO: 388399 - DNA, 16 bp, M. musculus
cctacagtgtggtaaa

SEQ ID NO: 388400 - DNA, 16 bp, M. musculus
cctacatacatacata

SEQ ID NO: 388401 - DNA, 16 bp, M. musculus
cctacatcatgcctgc

SEQ ID NO: 388402 - DNA, 16 bp, M. musculus
cctacatcctatagag

SEQ ID NO: 388403 - DNA, 16 bp, M. musculus
cctacatgagaccctg

SEQ ID NO: 388404 - DNA, 16 bp, M. musculus
cctacatggtggaaga

SEQ ID NO: 388405 - DNA, 16 bp, M. musculus
cctacatggtggaagg

SEQ ID NO: 388406 - DNA, 16 bp, M. musculus
cctacatgtatgcctg

SEQ ID NO: 388407 - DNA, 16 bp, M. musculus
cctacattggggagag

SEQ ID NO: 388408 - DNA, 16 bp, M. musculus
cctaccactcaggagg

SEQ ID NO: 388409 - DNA, 16 bp, M. musculus
cctacccacactggat

SEQ ID NO: 388410 - DNA, 16 bp, M. musculus
cctacccacccaactt

SEQ ID NO: 388411 - DNA, 16 bp, M. musculus
cctacccactccagct

SEQ ID NO: 388412 - DNA, 16 bp, M. musculus
cctacccccagtgaca

SEQ ID NO: 388413 - DNA, 16 bp, M. musculus
cctaccctgctcccca

SEQ ID NO: 388414 - DNA, 16 bp, M. musculus
cctaccctgctcccct

SEQ ID NO: 388415 - DNA, 16 bp, M. musculus
cctaccctggaattcc

SEQ ID NO: 388416 - DNA, 16 bp, M. musculus
cctacctacaagatgt

SEQ ID NO: 388417 - DNA, 16 bp, M. musculus
cctacctacctacctg

SEQ ID NO: 388418 - DNA, 16 bp, M. musculus
cctacctacctctgcc

SEQ ID NO: 388419 - DNA, 16 bp, M. musculus
cctacctcactgccct

SEQ ID NO: 388420 - DNA, 16 bp, M. musculus
cctacctcagcctcca

SEQ ID NO: 388421 - DNA, 16 bp, M. musculus
cctacctcagcctctc

SEQ ID NO: 388422 - DNA, 16 bp, M. musculus
cctacctccagcagaa

SEQ ID NO: 388423 - DNA, 16 bp, M. musculus
cctacctccaggctcc

SEQ ID NO: 388424 - DNA, 16 bp, M. musculus
cctacctctaccagga

SEQ ID NO: 388425 - DNA, 16 bp, M. musculus
cctacctctgcctccc

SEQ ID NO: 388426 - DNA, 16 bp, M. musculus
cctacctctgcctctg

SEQ ID NO: 388427 - DNA, 16 bp, M. musculus
cctacctctgccttcc

SEQ ID NO: 388428 - DNA, 16 bp, M. musculus
cctacctctgctttcc

SEQ ID NO: 388429 - DNA, 16 bp, M. musculus
cctacctgcaacagga

SEQ ID NO: 388430 - DNA, 16 bp, M. musculus
cctacctggctgttgc

SEQ ID NO: 388431 - DNA, 16 bp, M. musculus
cctaccttggcttccc

SEQ ID NO: 388432 - DNA, 16 bp, M. musculus
cctactataagagcct

SEQ ID NO: 388433 - DNA, 16 bp, M. musculus
cctactcagactgggt

SEQ ID NO: 388434 - DNA, 16 bp, M. musculus
cctactcagtgcaggg

SEQ ID NO: 388435 - DNA, 16 bp, M. musculus
cctactcatcactgcg

SEQ ID NO: 388436 - DNA, 16 bp, M. musculus
cctactccaacaaggc

SEQ ID NO: 388437 - DNA, 16 bp, M. musculus
cctactccagtgattg

SEQ ID NO: 388438 - DNA, 16 bp, M. musculus
cctactcctggtacca

SEQ ID NO: 388439 - DNA, 16 bp, M. musculus
cctactgaactccaaa

SEQ ID NO: 388440 - DNA, 16 bp, M. musculus
cctactgacaggagcc

SEQ ID NO: 388441 - DNA, 16 bp, M. musculus
cctactgagccacctt

SEQ ID NO: 388442 - DNA, 16 bp, M. musculus
cctactgccaatggaa

SEQ ID NO: 388443 - DNA, 16 bp, M. musculus
cctactgtgtactcag

SEQ ID NO: 388444 - DNA, 16 bp, M. musculus
cctactgtgtgcagca

SEQ ID NO: 388445 - DNA, 16 bp, M. musculus
cctactgtgtgccagg

SEQ ID NO: 388446 - DNA, 16 bp, M. musculus
cctactgtgtgctagg

SEQ ID NO: 388447 - DNA, 16 bp, M. musculus
cctacttcctccagca

SEQ ID NO: 388448 - DNA, 16 bp, M. musculus
cctacttcctggccct

SEQ ID NO: 388449 - DNA, 16 bp, M. musculus
cctacttccttgtcct

SEQ ID NO: 388450 - DNA, 16 bp, M. musculus
cctagaaaaggcaaga

SEQ ID NO: 388451 - DNA, 16 bp, M. musculus
cctagaaagacaacct

SEQ ID NO: 388452 - DNA, 16 bp, M. musculus
cctagaaatgttcctg

SEQ ID NO: 388453 - DNA, 16 bp, M. musculus
cctagaactccctctg

SEQ ID NO: 388454 - DNA, 16 bp, M. musculus
cctagaactctatgta

SEQ ID NO: 388455 - DNA, 16 bp, M. musculus
cctagaactggagtta

SEQ ID NO: 388456 - DNA, 16 bp, M. musculus
cctagaagacagcttc

SEQ ID NO: 388457 - DNA, 16 bp, M. musculus
cctagacaaagaacta

SEQ ID NO: 388458 - DNA, 16 bp, M. musculus
cctagagatgcaggga

SEQ ID NO: 388459 - DNA, 16 bp, M. musculus
cctagagcagtgcttc

SEQ ID NO: 388460 - DNA, 16 bp, M. musculus
cctagagctgcagtta

SEQ ID NO: 388461 - DNA, 16 bp, M. musculus
cctagagctggagtta

SEQ ID NO: 388462 - DNA, 16 bp, M. musculus
cctagaggatgatgtg

SEQ ID NO: 388463 - DNA, 16 bp, M. musculus
cctagaggccagaaga

SEQ ID NO: 388464 - DNA, 16 bp, M. musculus
cctagataaagaacta

SEQ ID NO: 388465 - DNA, 16 bp, M. musculus
cctagatgctgccctg

SEQ ID NO: 388466 - DNA, 16 bp, M. musculus
cctagattgggcagat

SEQ ID NO: 388467 - DNA, 16 bp, M. musculus
cctagcacacagtagg

SEQ ID NO: 388468 - DNA, 16 bp, M. musculus
cctagcacacccagga

SEQ ID NO: 388469 - DNA, 16 bp, M. musculus
cctagcacctacatga

SEQ ID NO: 388470 - DNA, 16 bp, M. musculus
cctagcacctgggagg

SEQ ID NO: 388471 - DNA, 16 bp, M. musculus
cctagcacgtgggagg

SEQ ID NO: 388472 - DNA, 16 bp, M. musculus
cctagcactggggaag

SEQ ID NO: 388473 - DNA, 16 bp, M. musculus
cctagcacttgggaaa

SEQ ID NO: 388474 - DNA, 16 bp, M. musculus
cctagcacttgggaga

SEQ ID NO: 388475 - DNA, 16 bp, M. musculus
cctagcacttggggag

SEQ ID NO: 388476 - DNA, 16 bp, M. musculus
cctagcatagcaaaaa

SEQ ID NO: 388477 - DNA, 16 bp, M. musculus
cctagcatgcaggagg

SEQ ID NO: 388478 - DNA, 16 bp, M. musculus
cctagcatgcatgagg

SEQ ID NO: 388479 - DNA, 16 bp, M. musculus
cctagcatggctgtcc

SEQ ID NO: 388480 - DNA, 16 bp, M. musculus
cctagcctggaactca

SEQ ID NO: 388481 - DNA, 16 bp, M. musculus
cctagctacaggaggt

SEQ ID NO: 388482 - DNA, 16 bp, M. musculus
cctagctacctggaag

SEQ ID NO: 388483 - DNA, 16 bp, M. musculus
cctagctccaaatctt

SEQ ID NO: 388484 - DNA, 16 bp, M. musculus
cctagctgaggagcta

SEQ ID NO: 388485 - DNA, 16 bp, M. musculus
cctagctgcctgcaag

SEQ ID NO: 388486 - DNA, 16 bp, M. musculus
cctagctgcctggaag

SEQ ID NO: 388487 - DNA, 16 bp, M. musculus
cctagctgcctggagg

SEQ ID NO: 388488 - DNA, 16 bp, M. musculus
cctagctgggctgcct

SEQ ID NO: 388489 - DNA, 16 bp, M. musculus
cctaggaactggagtt

SEQ ID NO: 388490 - DNA, 16 bp, M. musculus
cctaggagaacacaaa

SEQ ID NO: 388491 - DNA, 16 bp, M. musculus
cctaggaggtgagaga

SEQ ID NO: 388492 - DNA, 16 bp, M. musculus
cctaggagtgaaaagt

SEQ ID NO: 388493 - DNA, 16 bp, M. musculus
cctaggcaggactgct

SEQ ID NO: 388494 - DNA, 16 bp, M. musculus
cctaggcagggctgct

SEQ ID NO: 388495 - DNA, 16 bp, M. musculus
cctaggccacagcagc

SEQ ID NO: 388496 - DNA, 16 bp, M. musculus
cctaggccttcctgca

SEQ ID NO: 388497 - DNA, 16 bp, M. musculus
cctaggctccctcttt

SEQ ID NO: 388498 - DNA, 16 bp, M. musculus
cctaggctctctgcac

SEQ ID NO: 388499 - DNA, 16 bp, M. musculus
cctaggctggcctcaa

SEQ ID NO: 388500 - DNA, 16 bp, M. musculus
cctagggagtttagag

SEQ ID NO: 388501 - DNA, 16 bp, M. musculus
cctagggctggagaga

SEQ ID NO: 388502 - DNA, 16 bp, M. musculus
cctagggtttgtatct

SEQ ID NO: 388503 - DNA, 16 bp, M. musculus
cctaggtacagagaac

SEQ ID NO: 388504 - DNA, 16 bp, M. musculus
cctaggtcctctggaa

SEQ ID NO: 388505 - DNA, 16 bp, M. musculus
cctaggtgtgtgtgtg

SEQ ID NO: 388506 - DNA, 16 bp, M. musculus
cctaggttggcctcaa

SEQ ID NO: 388507 - DNA, 16 bp, M. musculus
cctaggtttggtcttc

SEQ ID NO: 388508 - DNA, 16 bp, M. musculus
cctaggttttctttct

SEQ ID NO: 388509 - DNA, 16 bp, M. musculus
cctaggtttttcgtta

SEQ ID NO: 388510 - DNA, 16 bp, M. musculus
cctagtaacatcagaa

SEQ ID NO: 388511 - DNA, 16 bp, M. musculus
cctagtacccacagag

SEQ ID NO: 388512 - DNA, 18 bp, M. musculus
cctagtagagccatgctg

SEQ ID NO: 388513 - DNA, 16 bp, M. musculus
cctagtccagcctcat

SEQ ID NO: 388514 - DNA, 16 bp, M. musculus
cctagtcggccatcat

SEQ ID NO: 388515 - DNA, 16 bp, M. musculus
cctagtgaaaaacctg

SEQ ID NO: 388516 - DNA, 16 bp, M. musculus
cctagtgaggactcct

SEQ ID NO: 388517 - DNA, 16 bp, M. musculus
cctagtgcctgtggag

SEQ ID NO: 388518 - DNA, 16 bp, M. musculus
cctagtgctggaatta

SEQ ID NO: 388519 - DNA, 16 bp, M. musculus
cctagtttaaaaaaaa

SEQ ID NO: 388520 - DNA, 16 bp, M. musculus
cctagtttctcctctg

SEQ ID NO: 388521 - DNA, 16 bp, M. musculus
cctagtttctttgcaa

SEQ ID NO: 388522 - DNA, 16 bp, M. musculus
cctataaccctagcac

SEQ ID NO: 388523 - DNA, 16 bp, M. musculus
cctataactccagctc

SEQ ID NO: 388524 - DNA, 16 bp, M. musculus
cctataagaagaacaa

SEQ ID NO: 388525 - DNA, 16 bp, M. musculus
cctataatcccaatac

SEQ ID NO: 388526 - DNA, 16 bp, M. musculus
cctataatcccagtac

SEQ ID NO: 388527 - DNA, 16 bp, M. musculus
cctataggaggagcaa

SEQ ID NO: 388528 - DNA, 16 bp, M. musculus
cctatagtggggagag

SEQ ID NO: 388529 - DNA, 16 bp, M. musculus
cctatataaatgcagt

SEQ ID NO: 388530 - DNA, 16 bp, M. musculus
cctatcactgtaccaa

SEQ ID NO: 388531 - DNA, 16 bp, M. musculus
cctatcagaacaccat

SEQ ID NO: 388532 - DNA, 17 bp, M. musculus
cctatcagatcaccatg

SEQ ID NO: 388533 - DNA, 16 bp, M. musculus
cctatcagatttacac

SEQ ID NO: 388534 - DNA, 55 bp, M. musculus
cctatcctctgaaaaactagaagctgtgattcaactggtagaggaacaattaaaa

SEQ ID NO: 388535 - DNA, 16 bp, M. musculus
cctatcctctggccgg

SEQ ID NO: 388536 - DNA, 16 bp, M. musculus
cctatctagtgatagg

SEQ ID NO: 388537 - DNA, 16 bp, M. musculus
cctatctcaaagaaaa

SEQ ID NO: 388538 - DNA, 16 bp, M. musculus
cctatctcaataaata

SEQ ID NO: 388539 - DNA, 16 bp, M. musculus
cctatctcagcctcct

SEQ ID NO: 388540 - DNA, 16 bp, M. musculus
cctatctccttggact

SEQ ID NO: 388541 - DNA, 16 bp, M. musculus
cctatctgtcactgta

SEQ ID NO: 388542 - DNA, 16 bp, M. musculus
cctatgaccccagcag

SEQ ID NO: 388543 - DNA, 16 bp, M. musculus
cctatgaggttgccat

SEQ ID NO: 388544 - DNA, 16 bp, M. musculus
cctatggaagtcagaa

SEQ ID NO: 388545 - DNA, 16 bp, M. musculus
cctatggagctgaagg

SEQ ID NO: 388546 - DNA, 16 bp, M. musculus
cctatggagctgtaaa

SEQ ID NO: 388547 - DNA, 16 bp, M. musculus
cctatggccaagcatt

SEQ ID NO: 388548 - DNA, 16 bp, M. musculus
cctatgggattgccat

SEQ ID NO: 388549 - DNA, 16 bp, M. musculus
cctatgtacaccatct

SEQ ID NO: 388550 - DNA, 16 bp, M. musculus
cctatgtcctcttctg

SEQ ID NO: 388551 - DNA, 16 bp, M. musculus
cctatgtgacttctag

SEQ ID NO: 388552 - DNA, 16 bp, M. musculus
cctatgttcatagcag

SEQ ID NO: 388553 - DNA, 16 bp, M. musculus
cctattaaaaagtgga

SEQ ID NO: 388554 - DNA, 16 bp, M. musculus
cctattacacacacac

SEQ ID NO: 388555 - DNA, 18 bp, M. musculus
cctattactctgggctca

SEQ ID NO: 388556 - DNA, 16 bp, M. musculus
cctattataaaatggg

SEQ ID NO: 388557 - DNA, 17 bp, M. musculus
cctattctagggagaca

SEQ ID NO: 388558 - DNA, 16 bp, M. musculus
cctattctattatttc

SEQ ID NO: 388559 - DNA, 16 bp, M. musculus
cctattgctgtgatga

SEQ ID NO: 388560 - DNA, 16 bp, M. musculus
cctatttcctaggcct

SEQ ID NO: 388561 - DNA, 16 bp, M. musculus
cctatttctgcctccc

SEQ ID NO: 388562 - DNA, 16 bp, M. musculus
cctcaaaaaagaaact

SEQ ID NO: 388563 - DNA, 16 bp, M. musculus
cctcaaaagaacacaa

SEQ ID NO: 388564 - DNA, 16 bp, M. musculus
cctcaaaagcacatga

SEQ ID NO: 388565 - DNA, 16 bp, M. musculus
cctcaaaatcacagag

SEQ ID NO: 388566 - DNA, 16 bp, M. musculus
cctcaaaccagtcaga

SEQ ID NO: 388567 - DNA, 16 bp, M. musculus
cctcaaactcacaaga

SEQ ID NO: 388568 - DNA, 16 bp, M. musculus
cctcaaactcacagaa

SEQ ID NO: 388569 - DNA, 16 bp, M. musculus
cctcaaactcactctg

SEQ ID NO: 388570 - DNA, 16 bp, M. musculus
cctcaaactcctgatc

SEQ ID NO: 388571 - DNA, 16 bp, M. musculus
cctcaaactgtttgct

SEQ ID NO: 388572 - DNA, 16 bp, M. musculus
cctcaaagaaaataaa

SEQ ID NO: 388573 - DNA, 16 bp, M. musculus
cctcaaagcccaccac

SEQ ID NO: 388574 - DNA, 16 bp, M. musculus
cctcaaagcctgccct

SEQ ID NO: 388575 - DNA, 16 bp, M. musculus
cctcaaagctcccagg

SEQ ID NO: 388576 - DNA, 16 bp, M. musculus
cctcaaagtccactcc

SEQ ID NO: 388577 - DNA, 16 bp, M. musculus
cctcaaagtgaaaggc

SEQ ID NO: 388578 - DNA, 16 bp, M. musculus
cctcaaattctctatg

SEQ ID NO: 388579 - DNA, 16 bp, M. musculus
cctcaacaaacttaaa

SEQ ID NO: 388580 - DNA, 16 bp, M. musculus
cctcaacaggtacaag

SEQ ID NO: 388581 - DNA, 16 bp, M. musculus
cctcaaccctacacaa

SEQ ID NO: 388582 - DNA, 16 bp, M. musculus
cctcaactcttccaca

SEQ ID NO: 388583 - DNA, 16 bp, M. musculus
cctcaactgagaaaat

SEQ ID NO: 388584 - DNA, 16 bp, M. musculus
cctcaagaaccagcta

SEQ ID NO: 388585 - DNA, 16 bp, M. musculus
cctcaagacactggag

SEQ ID NO: 388586 - DNA, 16 bp, M. musculus
cctcaagacccatcta

SEQ ID NO: 388587 - DNA, 16 bp, M. musculus
cctcaagagactagag

SEQ ID NO: 388588 - DNA, 16 bp, M. musculus
cctcaagagacttaag

SEQ ID NO: 388589 - DNA, 16 bp, M. musculus
cctcaagaggctggag

SEQ ID NO: 388590 - DNA, 16 bp, M. musculus
cctcaagcagctgtga

SEQ ID NO: 388591 - DNA, 16 bp, M. musculus
cctcaagctcctgcct

SEQ ID NO: 388592 - DNA, 16 bp, M. musculus
cctcaagcttgctatg

SEQ ID NO: 388593 - DNA, 16 bp, M. musculus
cctcaaggacacactt

SEQ ID NO: 388594 - DNA, 16 bp, M. musculus
cctcaaggacagacaa

SEQ ID NO: 388595 - DNA, 16 bp, M. musculus
cctcaaggctcaggga

SEQ ID NO: 388596 - DNA, 16 bp, M. musculus
cctcaagggactggag

SEQ ID NO: 388597 - DNA, 16 bp, M. musculus
cctcaaggttcctgcc

SEQ ID NO: 388598 - DNA, 16 bp, M. musculus
cctcaagtctcttgag

SEQ ID NO: 388599 - DNA, 16 bp, M. musculus
cctcaagttcctgctg

SEQ ID NO: 388600 - DNA, 16 bp, M. musculus
cctcaagttggaccag

SEQ ID NO: 388601 - DNA, 16 bp, M. musculus
cctcaatatatctgat

SEQ ID NO: 388602 - DNA, 16 bp, M. musculus
cctcaatcccagcact

SEQ ID NO: 388603 - DNA, 16 bp, M. musculus
cctcaatgaaggagtt

SEQ ID NO: 388604 - DNA, 16 bp, M. musculus
cctcaatgagagaaga

SEQ ID NO: 388605 - DNA, 16 bp, M. musculus
cctcaattaacagcag

SEQ ID NO: 388606 - DNA, 41 bp, M. musculus
cctcacacaataatagtgggagacttcaacacaccactttc

SEQ ID NO: 388607 - DNA, 16 bp, M. musculus
cctcacacagacacac

SEQ ID NO: 388608 - DNA, 16 bp, M. musculus
cctcacacatacatac

SEQ ID NO: 388609 - DNA, 16 bp, M. musculus
cctcacaccaggcctg

SEQ ID NO: 388610 - DNA, 16 bp, M. musculus
cctcacagacatggcc

SEQ ID NO: 388611 - DNA, 16 bp, M. musculus
cctcacaggaggcagc

SEQ ID NO: 388612 - DNA, 16 bp, M. musculus
cctcacagggttggtg

SEQ ID NO: 388613 - DNA, 16 bp, M. musculus
cctcacaggtgtaccc

SEQ ID NO: 388614 - DNA, 16 bp, M. musculus
cctcacaggtgtgcct

SEQ ID NO: 388615 - DNA, 16 bp, M. musculus
cctcacaggtgtgctc

SEQ ID NO: 388616 - DNA, 16 bp, M. musculus
cctcacatcagctggt

SEQ ID NO: 388617 - DNA, 16 bp, M. musculus
cctcacattgtggtga

SEQ ID NO: 388618 - DNA, 16 bp, M. musculus
cctcaccaagttgctt

SEQ ID NO: 388619 - DNA, 16 bp, M. musculus
cctcaccacctgcagc

SEQ ID NO: 388620 - DNA, 16 bp, M. musculus
cctcaccaggcacgca

SEQ ID NO: 388621 - DNA, 16 bp, M. musculus
cctcaccagtgctggg

SEQ ID NO: 388622 - DNA, 16 bp, M. musculus
cctcacccactgaggc

SEQ ID NO: 388623 - DNA, 16 bp, M. musculus
cctcacccagtaccag

SEQ ID NO: 388624 - DNA, 16 bp, M. musculus
cctcacccagtcctgg

SEQ ID NO: 388625 - DNA, 16 bp, M. musculus
cctcacccatattcct

SEQ ID NO: 388626 - DNA, 16 bp, M. musculus
cctcacctgctgcagc

SEQ ID NO: 388627 - DNA, 16 bp, M. musculus
cctcacctgtgatcct

SEQ ID NO: 388628 - DNA, 16 bp, M. musculus
cctcactcacccctgc

SEQ ID NO: 388629 - DNA, 16 bp, M. musculus
cctcactcactcccag

SEQ ID NO: 388630 - DNA, 16 bp, M. musculus
cctcactgtcctagca

SEQ ID NO: 388631 - DNA, 16 bp, M. musculus
cctcacttgggaattc

SEQ ID NO: 388632 - DNA, 16 bp, M. musculus
cctcactttgtggttt

SEQ ID NO: 388633 - DNA, 16 bp, M. musculus
cctcagaaagagcagc

SEQ ID NO: 388634 - DNA, 16 bp, M. musculus
cctcagaaagagcagt

SEQ ID NO: 388635 - DNA, 16 bp, M. musculus
cctcagaacccacaca

SEQ ID NO: 388636 - DNA, 16 bp, M. musculus
cctcagaagacagagg

SEQ ID NO: 388637 - DNA, 16 bp, M. musculus
cctcagaagtcagaag

SEQ ID NO: 388638 - DNA, 16 bp, M. musculus
cctcagaattagcaaa

SEQ ID NO: 388639 - DNA, 16 bp, M. musculus
cctcagacaccagaag

SEQ ID NO: 388640 - DNA, 16 bp, M. musculus
cctcagaccagctcat

SEQ ID NO: 388641 - DNA, 16 bp, M. musculus
cctcagacccaagggc

SEQ ID NO: 388642 - DNA, 16 bp, M. musculus
cctcagaccccaagcc

SEQ ID NO: 388643 - DNA, 16 bp, M. musculus
cctcagactgtgctcc

SEQ ID NO: 388644 - DNA, 16 bp, M. musculus
cctcagagcagaagtg

SEQ ID NO: 388645 - DNA, 16 bp, M. musculus
cctcagagcccacccc

SEQ ID NO: 388646 - DNA, 16 bp, M. musculus
cctcagagcccacctc

SEQ ID NO: 388647 - DNA, 16 bp, M. musculus
cctcagagctctcagg

SEQ ID NO: 388648 - DNA, 16 bp, M. musculus
cctcagagctggggtt

SEQ ID NO: 388649 - DNA, 16 bp, M. musculus
cctcagaggaaaaaaa

SEQ ID NO: 388650 - DNA, 16 bp, M. musculus
cctcagaggccagaaa

SEQ ID NO: 388651 - DNA, 16 bp, M. musculus
cctcagaggttctttt

SEQ ID NO: 388652 - DNA, 16 bp, M. musculus
cctcagagtaaaagtt

SEQ ID NO: 388653 - DNA, 16 bp, M. musculus
cctcagagtatattat

SEQ ID NO: 388654 - DNA, 16 bp, M. musculus
cctcagatctcattac

SEQ ID NO: 388655 - DNA, 16 bp, M. musculus
cctcagcaccaatgtc

SEQ ID NO: 388656 - DNA, 16 bp, M. musculus
cctcagcactggctgg

SEQ ID NO: 388657 - DNA, 16 bp, M. musculus
cctcagcactgggatc

SEQ ID NO: 388658 - DNA, 16 bp, M. musculus
cctcagcagcagcagt

SEQ ID NO: 388659 - DNA, 16 bp, M. musculus
cctcagcatcctggga

SEQ ID NO: 388660 - DNA, 16 bp, M. musculus
cctcagccacttgtcc

SEQ ID NO: 388661 - DNA, 16 bp, M. musculus
cctcagccaggaggca

SEQ ID NO: 388662 - DNA, 16 bp, M. musculus
cctcagccatctctcc

SEQ ID NO: 388663 - DNA, 16 bp, M. musculus
cctcagcccctcagcc

SEQ ID NO: 388664 - DNA, 16 bp, M. musculus
cctcagccctctgtgc

SEQ ID NO: 388665 - DNA, 16 bp, M. musculus
cctcagccctgctccc

SEQ ID NO: 388666 - DNA, 16 bp, M. musculus
cctcagcctcagcaca

SEQ ID NO: 388667 - DNA, 16 bp, M. musculus
cctcagcctcagcagc

SEQ ID NO: 388668 - DNA, 18 bp, M. musculus
cctcagcctcagcagcag

SEQ ID NO: 388669 - DNA, 16 bp, M. musculus
cctcagcctcagccac

SEQ ID NO: 388670 - DNA, 16 bp, M. musculus
cctcagcctcagcctc

SEQ ID NO: 388671 - DNA, 16 bp, M. musculus
cctcagcctcagcctg

SEQ ID NO: 388672 - DNA, 16 bp, M. musculus
cctcagcctcagctcc

SEQ ID NO: 388673 - DNA, 16 bp, M. musculus
cctcagcctcagcttg

SEQ ID NO: 388674 - DNA, 16 bp, M. musculus
cctcagcctcccaagt

SEQ ID NO: 388675 - DNA, 17 bp, M. musculus
cctcagcctcccaagta

SEQ ID NO: 388676 - DNA, 16 bp, M. musculus
cctcagcctcccagag

SEQ ID NO: 388677 - DNA, 16 bp, M. musculus
cctcagcctcccagat

SEQ ID NO: 388678 - DNA, 16 bp, M. musculus
cctcagcctcccagtg

SEQ ID NO: 388679 - DNA, 16 bp, M. musculus
cctcagcctccccagg

SEQ ID NO: 388680 - DNA, 16 bp, M. musculus
cctcagcctccctagt

SEQ ID NO: 388681 - DNA, 16 bp, M. musculus
cctcagcctcctaggt

SEQ ID NO: 388682 - DNA, 16 bp, M. musculus
cctcagcctcctcagc

SEQ ID NO: 388683 - DNA, 17 bp, M. musculus
cctcagcctcctgagtg

SEQ ID NO: 388684 - DNA, 16 bp, M. musculus
cctcagcctcctgcct

SEQ ID NO: 388685 - DNA, 16 bp, M. musculus
cctcagcctcctggat

SEQ ID NO: 388686 - DNA, 16 bp, M. musculus
cctcagcctcctggct

SEQ ID NO: 388687 - DNA, 16 bp, M. musculus
cctcagcctcctggga

SEQ ID NO: 388688 - DNA, 16 bp, M. musculus
cctcagcctcctgtgt

SEQ ID NO: 388689 - DNA, 16 bp, M. musculus
cctcagcctctcagcc

SEQ ID NO: 388690 - DNA, 16 bp, M. musculus
cctcagcctctccagt

SEQ ID NO: 388691 - DNA, 16 bp, M. musculus
cctcagcctctggaat

SEQ ID NO: 388692 - DNA, 16 bp, M. musculus
cctcagcctcttccag

SEQ ID NO: 388693 - DNA, 16 bp, M. musculus
cctcagccttctgaat

SEQ ID NO: 388694 - DNA, 16 bp, M. musculus
cctcagccttctgagt

SEQ ID NO: 388695 - DNA, 16 bp, M. musculus
cctcagccttctgtgt

SEQ ID NO: 388696 - DNA, 16 bp, M. musculus
cctcagccttggctca

SEQ ID NO: 388697 - DNA, 16 bp, M. musculus
cctcagctacatagga

SEQ ID NO: 388698 - DNA, 16 bp, M. musculus
cctcagctccctcagc

SEQ ID NO: 388699 - DNA, 16 bp, M. musculus
cctcagctcctcccag

SEQ ID NO: 388700 - DNA, 16 bp, M. musculus
cctcagctcctgcttc

SEQ ID NO: 388701 - DNA, 16 bp, M. musculus
cctcagctccttcaaa

SEQ ID NO: 388702 - DNA, 16 bp, M. musculus
cctcagctcctttcag

SEQ ID NO: 388703 - DNA, 16 bp, M. musculus
cctcagctctcctcag

SEQ ID NO: 388704 - DNA, 16 bp, M. musculus
cctcagctgcttgtcc

SEQ ID NO: 388705 - DNA, 16 bp, M. musculus
cctcagctgctttgtg

SEQ ID NO: 388706 - DNA, 16 bp, M. musculus
cctcagcttcttccaa

SEQ ID NO: 388707 - DNA, 16 bp, M. musculus
cctcaggaaactggaa

SEQ ID NO: 388708 - DNA, 16 bp, M. musculus
cctcaggaagaacagc

SEQ ID NO: 388709 - DNA, 16 bp, M. musculus
cctcaggaagagcaac

SEQ ID NO: 388710 - DNA, 16 bp, M. musculus
cctcaggacacaggaa

SEQ ID NO: 388711 - DNA, 16 bp, M. musculus
cctcaggaccaagaaa

SEQ ID NO: 388712 - DNA, 16 bp, M. musculus
cctcaggacccagcta

SEQ ID NO: 388713 - DNA, 16 bp, M. musculus
cctcaggacctctgga

SEQ ID NO: 388714 - DNA, 16 bp, M. musculus
cctcaggaggcagagg

SEQ ID NO: 388715 - DNA, 16 bp, M. musculus
cctcaggaggtggagg

SEQ ID NO: 388716 - DNA, 16 bp, M. musculus
cctcaggcaccaggca

SEQ ID NO: 388717 - DNA, 16 bp, M. musculus
cctcaggcccaagggc

SEQ ID NO: 388718 - DNA, 16 bp, M. musculus
cctcaggccccaaccc

SEQ ID NO: 388719 - DNA, 16 bp, M. musculus
cctcaggctcttctct

SEQ ID NO: 388720 - DNA, 16 bp, M. musculus
cctcaggcttcagaga

SEQ ID NO: 388721 - DNA, 16 bp, M. musculus
cctcagggagcagagg

SEQ ID NO: 388722 - DNA, 17 bp, M. musculus
cctcaggggtgactcct

SEQ ID NO: 388723 - DNA, 47 bp, M. musculus
cctcagggttaatgttagtgaatcagagagtggatattttacaacat

SEQ ID NO: 388724 - DNA, 16 bp, M. musculus
cctcaggtggcagcac

SEQ ID NO: 388725 - DNA, 16 bp, M. musculus
cctcaggttccagcag

SEQ ID NO: 388726 - DNA, 16 bp, M. musculus
cctcagtataagggaa

SEQ ID NO: 388727 - DNA, 16 bp, M. musculus
cctcagtcaaagaaaa

SEQ ID NO: 388728 - DNA, 16 bp, M. musculus
cctcagtcccacttgg

SEQ ID NO: 388729 - DNA, 16 bp, M. musculus
cctcagtcccagctgc

SEQ ID NO: 388730 - DNA, 16 bp, M. musculus
cctcagtccttcctct

SEQ ID NO: 388731 - DNA, 16 bp, M. musculus
cctcagtccttggggc

SEQ ID NO: 388732 - DNA, 16 bp, M. musculus
cctcagtctcctcatc

SEQ ID NO: 388733 - DNA, 16 bp, M. musculus
cctcagtctcctctcc

SEQ ID NO: 388734 - DNA, 16 bp, M. musculus
cctcagtctctgcccc

SEQ ID NO: 388735 - DNA, 16 bp, M. musculus
cctcagtctctgctct

SEQ ID NO: 388736 - DNA, 16 bp, M. musculus
cctcagtctctgcttc

SEQ ID NO: 388737 - DNA, 16 bp, M. musculus
cctcagtctctgcttt

SEQ ID NO: 388738 - DNA, 16 bp, M. musculus
cctcagtctcttctct

SEQ ID NO: 388739 - DNA, 16 bp, M. musculus
cctcagtgaaagagga

SEQ ID NO: 388740 - DNA, 16 bp, M. musculus
cctcagtgacacactt

SEQ ID NO: 388741 - DNA, 16 bp, M. musculus
cctcagtgagagaaga

SEQ ID NO: 388742 - DNA, 16 bp, M. musculus
cctcagtgaggtaaca

SEQ ID NO: 388743 - DNA, 16 bp, M. musculus
cctcagtgcaggggaa

SEQ ID NO: 388744 - DNA, 16 bp, M. musculus
cctcagtggctctctg

SEQ ID NO: 388745 - DNA, 16 bp, M. musculus
cctcagtggctctgtg

SEQ ID NO: 388746 - DNA, 16 bp, M. musculus
cctcagtggctttcct

SEQ ID NO: 388747 - DNA, 16 bp, M. musculus
cctcagtgggaaagga

SEQ ID NO: 388748 - DNA, 16 bp, M. musculus
cctcagtgggagggga

SEQ ID NO: 388749 - DNA, 16 bp, M. musculus
cctcagtggtagagga

SEQ ID NO: 388750 - DNA, 16 bp, M. musculus
cctcagtggttaagag

SEQ ID NO: 388751 - DNA, 16 bp, M. musculus
cctcagtgtaacagaa

SEQ ID NO: 388752 - DNA, 16 bp, M. musculus
cctcagtgtcccaagt

SEQ ID NO: 388753 - DNA, 16 bp, M. musculus
cctcagttaaatgttg

SEQ ID NO: 388754 - DNA, 16 bp, M. musculus
cctcagttggagaaga

SEQ ID NO: 388755 - DNA, 16 bp, M. musculus
cctcagtttcccctcc

SEQ ID NO: 388756 - DNA, 16 bp, M. musculus
cctcagtttccccttc

SEQ ID NO: 388757 - DNA, 16 bp, M. musculus
cctcagtttccccttt

SEQ ID NO: 388758 - DNA, 16 bp, M. musculus
cctcagtttcctcttc

SEQ ID NO: 388759 - DNA, 16 bp, M. musculus
cctcagtttcttcctg

SEQ ID NO: 388760 - DNA, 16 bp, M. musculus
cctcataagtgctggg

SEQ ID NO: 388761 - DNA, 16 bp, M. musculus
cctcatagaagaaggg

SEQ ID NO: 388762 - DNA, 16 bp, M. musculus
cctcatagaggcaaag

SEQ ID NO: 388763 - DNA, 16 bp, M. musculus
cctcatcatcatcatc

SEQ ID NO: 388764 - DNA, 16 bp, M. musculus
cctcatccagtcctgg

SEQ ID NO: 388765 - DNA, 16 bp, M. musculus
cctcatcctcctgcct

SEQ ID NO: 388766 - DNA, 16 bp, M. musculus
cctcatcctctatctc

SEQ ID NO: 388767 - DNA, 16 bp, M. musculus
cctcatctccttcagt

SEQ ID NO: 388768 - DNA, 16 bp, M. musculus
cctcatctggcctctg

SEQ ID NO: 388769 - DNA, 16 bp, M. musculus
cctcatctgtaaaatg

SEQ ID NO: 388770 - DNA, 16 bp, M. musculus
cctcatcttcctgcct

SEQ ID NO: 388771 - DNA, 16 bp, M. musculus
cctcatcttttttgat

SEQ ID NO: 388772 - DNA, 16 bp, M. musculus
cctcatgaaactgaaa

SEQ ID NO: 388773 - DNA, 16 bp, M. musculus
cctcatgaaactggaa

SEQ ID NO: 388774 - DNA, 16 bp, M. musculus
cctcatgaatgctggg

SEQ ID NO: 388775 - DNA, 16 bp, M. musculus
cctcatgctatccctg

SEQ ID NO: 388776 - DNA, 16 bp, M. musculus
cctcatgctgtgaccc

SEQ ID NO: 388777 - DNA, 16 bp, M. musculus
cctcatgctgtggtga

SEQ ID NO: 388778 - DNA, 16 bp, M. musculus
cctcatggaggccaga

SEQ ID NO: 388779 - DNA, 16 bp, M. musculus
cctcatggtgtggtga

SEQ ID NO: 388780 - DNA, 18 bp, M. musculus
cctcatgtaattacatca

SEQ ID NO: 388781 - DNA, 16 bp, M. musculus
cctcatgtctcctgga

SEQ ID NO: 388782 - DNA, 16 bp, M. musculus
cctcatgttgtggtga

SEQ ID NO: 388783 - DNA, 45 bp, M. musculus
cctcattatcatacctcatttgcatgtctcacatctgattggtta

SEQ ID NO: 388784 - DNA, 16 bp, M. musculus
cctcattgcctctctg

SEQ ID NO: 388785 - DNA, 16 bp, M. musculus
cctcattgggttggag

SEQ ID NO: 388786 - DNA, 16 bp, M. musculus
cctcatttacaattcc

SEQ ID NO: 388787 - DNA, 25 bp, M. musculus
cctcatttgcatgttcctcatctga

SEQ ID NO: 388788 - DNA, 16 bp, M. musculus
cctccaaaaagaaagt

SEQ ID NO: 388789 - DNA, 16 bp, M. musculus
cctccaaacatcatgt

SEQ ID NO: 388790 - DNA, 16 bp, M. musculus
cctccaaagcatggca

SEQ ID NO: 388791 - DNA, 16 bp, M. musculus
cctccaaagcatggtg

SEQ ID NO: 388792 - DNA, 16 bp, M. musculus
cctccaaaggcaccag

SEQ ID NO: 388793 - DNA, 16 bp, M. musculus
cctccaaataaaacca

SEQ ID NO: 388794 - DNA, 16 bp, M. musculus
cctccaaatacatcca

SEQ ID NO: 388795 - DNA, 16 bp, M. musculus
cctccaacagaaagac

SEQ ID NO: 388796 - DNA, 16 bp, M. musculus
cctccaaccataaaat

SEQ ID NO: 388797 - DNA, 16 bp, M. musculus
cctccaactcagaaat

SEQ ID NO: 388798 - DNA, 16 bp, M. musculus
cctccaagagacaaca

SEQ ID NO: 388799 - DNA, 16 bp, M. musculus
cctccaagaggaaccc

SEQ ID NO: 388800 - DNA, 16 bp, M. musculus
cctccaagatctctca

SEQ ID NO: 388801 - DNA, 16 bp, M. musculus
cctccaagatgccact

SEQ ID NO: 388802 - DNA, 16 bp, M. musculus
cctccaagggcttgga

SEQ ID NO: 388803 - DNA, 18 bp, M. musculus
cctccaagggcttgggtc

SEQ ID NO: 388804 - DNA, 16 bp, M. musculus
cctccacaaagaaact

SEQ ID NO: 388805 - DNA, 16 bp, M. musculus
cctccacacctggctt

SEQ ID NO: 388806 - DNA, 16 bp, M. musculus
cctccacagacatgcc

SEQ ID NO: 388807 - DNA, 16 bp, M. musculus
cctccacagatacaaa

SEQ ID NO: 388808 - DNA, 16 bp, M. musculus
cctccacagcctctgc

SEQ ID NO: 388809 - DNA, 16 bp, M. musculus
cctccacaggcactga

SEQ ID NO: 388810 - DNA, 16 bp, M. musculus
cctccacaggcagcag

SEQ ID NO: 388811 - DNA, 16 bp, M. musculus
cctccacagggccaag

SEQ ID NO: 388812 - DNA, 16 bp, M. musculus
cctccacagtgacaca

SEQ ID NO: 388813 - DNA, 16 bp, M. musculus
cctccacattcttgtt

SEQ ID NO: 388814 - DNA, 16 bp, M. musculus
cctccaccaaggccac

SEQ ID NO: 388815 - DNA, 16 bp, M. musculus
cctccaccctatgctg

SEQ ID NO: 388816 - DNA, 16 bp, M. musculus
cctccaccctggcaca

SEQ ID NO: 388817 - DNA, 16 bp, M. musculus
cctccacctcagctct

SEQ ID NO: 388818 - DNA, 16 bp, M. musculus
cctccacctccaagtg

SEQ ID NO: 388819 - DNA, 16 bp, M. musculus
cctccacctccagagt

SEQ ID NO: 388820 - DNA, 16 bp, M. musculus
cctccacctcccaagc

SEQ ID NO: 388821 - DNA, 16 bp, M. musculus
cctccacctccccagg

SEQ ID NO: 388822 - DNA, 16 bp, M. musculus
cctccacctccccagt

SEQ ID NO: 388823 - DNA, 16 bp, M. musculus
cctccacctccctagt

SEQ ID NO: 388824 - DNA, 16 bp, M. musculus
cctccacctcctgagt

SEQ ID NO: 388825 - DNA, 16 bp, M. musculus
cctccacctctgcctc

SEQ ID NO: 388826 - DNA, 16 bp, M. musculus
cctccacggcttctgc

SEQ ID NO: 388827 - DNA, 16 bp, M. musculus
cctccactcctcccag

SEQ ID NO: 388828 - DNA, 16 bp, M. musculus
cctccactccttccag

SEQ ID NO: 388829 - DNA, 16 bp, M. musculus
cctccactgctgttgg

SEQ ID NO: 388830 - DNA, 16 bp, M. musculus
cctccactggcttgct

SEQ ID NO: 388831 - DNA, 16 bp, M. musculus
cctccactgggggcca

SEQ ID NO: 388832 - DNA, 16 bp, M. musculus
cctccagacacatcca

SEQ ID NO: 388833 - DNA, 16 bp, M. musculus
cctccagagccagctc

SEQ ID NO: 388834 - DNA, 16 bp, M. musculus
cctccagagctcccag

SEQ ID NO: 388835 - DNA, 16 bp, M. musculus
cctccagagctgtgtc

SEQ ID NO: 388836 - DNA, 16 bp, M. musculus
cctccagaggcagagg

SEQ ID NO: 388837 - DNA, 16 bp, M. musculus
cctccagcaagactcc

SEQ ID NO: 388838 - DNA, 16 bp, M. musculus
cctccagcaaggctcc

SEQ ID NO: 388839 - DNA, 16 bp, M. musculus
cctccagcagaaagac

SEQ ID NO: 388840 - DNA, 16 bp, M. musculus
cctccagcagaaagtc

SEQ ID NO: 388841 - DNA, 16 bp, M. musculus
cctccagcaggaagaa

SEQ ID NO: 388842 - DNA, 16 bp, M. musculus
cctccagcaggaagag

SEQ ID NO: 388843 - DNA, 16 bp, M. musculus
cctccagcaggaaggc

SEQ ID NO: 388844 - DNA, 16 bp, M. musculus
cctccagccccacctt

SEQ ID NO: 388845 - DNA, 16 bp, M. musculus
cctccagccccatgcc

SEQ ID NO: 388846 - DNA, 16 bp, M. musculus
cctccagcccctcact

SEQ ID NO: 388847 - DNA, 16 bp, M. musculus
cctccagcccctccag

SEQ ID NO: 388848 - DNA, 16 bp, M. musculus
cctccagccctgctcc

SEQ ID NO: 388849 - DNA, 16 bp, M. musculus
cctccagcctccagcc

SEQ ID NO: 388850 - DNA, 16 bp, M. musculus
cctccagcctctgcag

SEQ ID NO: 388851 - DNA, 16 bp, M. musculus
cctccagctcctcctc

SEQ ID NO: 388852 - DNA, 16 bp, M. musculus
cctccagctcctgcct

SEQ ID NO: 388853 - DNA, 16 bp, M. musculus
cctccagctccttcag

SEQ ID NO: 388854 - DNA, 16 bp, M. musculus
cctccaggaaggccac

SEQ ID NO: 388855 - DNA, 16 bp, M. musculus
cctccaggaaggcctc

SEQ ID NO: 388856 - DNA, 16 bp, M. musculus
cctccaggagatccag

SEQ ID NO: 388857 - DNA, 16 bp, M. musculus
cctccaggtccctcct

SEQ ID NO: 388858 - DNA, 16 bp, M. musculus
cctccaggtccctgcc

SEQ ID NO: 388859 - DNA, 16 bp, M. musculus
cctccaggtgaggctg

SEQ ID NO: 388860 - DNA, 16 bp, M. musculus
cctccaggttcatcca

SEQ ID NO: 388861 - DNA, 16 bp, M. musculus
cctccaggttcctcct

SEQ ID NO: 388862 - DNA, 16 bp, M. musculus
cctccagtacctgata

SEQ ID NO: 388863 - DNA, 16 bp, M. musculus
cctccagtcccacctt

SEQ ID NO: 388864 - DNA, 16 bp, M. musculus
cctccagtccttcccc

SEQ ID NO: 388865 - DNA, 16 bp, M. musculus
cctccagtctcctgag

SEQ ID NO: 388866 - DNA, 16 bp, M. musculus
cctccagtgacacacc

SEQ ID NO: 388867 - DNA, 16 bp, M. musculus
cctccagtgcctcctg

SEQ ID NO: 388868 - DNA, 16 bp, M. musculus
cctccagttcctgccc

SEQ ID NO: 388869 - DNA, 16 bp, M. musculus
cctccatagcctctgc

SEQ ID NO: 388870 - DNA, 16 bp, M. musculus
cctccataggaccaag

SEQ ID NO: 388871 - DNA, 16 bp, M. musculus
cctccatcaacctgtg

SEQ ID NO: 388872 - DNA, 16 bp, M. musculus
cctccatcagactggc

SEQ ID NO: 388873 - DNA, 16 bp, M. musculus
cctccatcagattggc

SEQ ID NO: 388874 - DNA, 16 bp, M. musculus
cctccatcatcaccat

SEQ ID NO: 388875 - DNA, 16 bp, M. musculus
cctccatcatcatcat

SEQ ID NO: 388876 - DNA, 16 bp, M. musculus
cctccatccatccatc

SEQ ID NO: 388877 - DNA, 16 bp, M. musculus
cctccatcccctctga

SEQ ID NO: 388878 - DNA, 16 bp, M. musculus
cctccatcccctctgg

SEQ ID NO: 388879 - DNA, 16 bp, M. musculus
cctccatccctctgcc

SEQ ID NO: 388880 - DNA, 16 bp, M. musculus
cctccatctctgctgt

SEQ ID NO: 388881 - DNA, 16 bp, M. musculus
cctccatctgccttcc

SEQ ID NO: 388882 - DNA, 16 bp, M. musculus
cctccatcttctctgt

SEQ ID NO: 388883 - DNA, 16 bp, M. musculus
cctccatcttctgcac

SEQ ID NO: 388884 - DNA, 16 bp, M. musculus
cctccatgagcactgc

SEQ ID NO: 388885 - DNA, 16 bp, M. musculus
cctccatgagctccag

SEQ ID NO: 388886 - DNA, 16 bp, M. musculus
cctccatgaggacttc

SEQ ID NO: 388887 - DNA, 16 bp, M. musculus
cctccatgatgataat

SEQ ID NO: 388888 - DNA, 16 bp, M. musculus
cctccatggagctgca

SEQ ID NO: 388889 - DNA, 16 bp, M. musculus
cctccatggcctctcc

SEQ ID NO: 388890 - DNA, 16 bp, M. musculus
cctccatggcctctgt

SEQ ID NO: 388891 - DNA, 16 bp, M. musculus
cctccatggcctttgc

SEQ ID NO: 388892 - DNA, 16 bp, M. musculus
cctccatggctcctgc

SEQ ID NO: 388893 - DNA, 16 bp, M. musculus
cctccatggcttctgc

SEQ ID NO: 388894 - DNA, 16 bp, M. musculus
cctccatgggctcctg

SEQ ID NO: 388895 - DNA, 16 bp, M. musculus
cctccatggtgtctgc

SEQ ID NO: 388896 - DNA, 16 bp, M. musculus
cctccattgggggcct

SEQ ID NO: 388897 - DNA, 16 bp, M. musculus
cctccattggtgaccc

SEQ ID NO: 388898 - DNA, 16 bp, M. musculus
cctccattggtggtgg

SEQ ID NO: 388899 - DNA, 16 bp, M. musculus
cctccatttgtgtttt

SEQ ID NO: 388900 - DNA, 16 bp, M. musculus
cctcccaaaggctggg

SEQ ID NO: 388901 - DNA, 16 bp, M. musculus
cctcccaaatgctgag

SEQ ID NO: 388902 - DNA, 16 bp, M. musculus
cctcccaaatgctgga

SEQ ID NO: 388903 - DNA, 16 bp, M. musculus
cctcccaaattctggg

SEQ ID NO: 388904 - DNA, 16 bp, M. musculus
cctcccaactaaagac

SEQ ID NO: 388905 - DNA, 16 bp, M. musculus
cctcccaagagctgag

SEQ ID NO: 388906 - DNA, 16 bp, M. musculus
cctcccaagcactggg

SEQ ID NO: 388907 - DNA, 16 bp, M. musculus
cctcccaaggctcagg

SEQ ID NO: 388908 - DNA, 16 bp, M. musculus
cctcccaagtactgga

SEQ ID NO: 388909 - DNA, 16 bp, M. musculus
cctcccaagtgccaga

SEQ ID NO: 388910 - DNA, 16 bp, M. musculus
cctcccaagtgctaag

SEQ ID NO: 388911 - DNA, 16 bp, M. musculus
cctcccaagtgtgggg

SEQ ID NO: 388912 - DNA, 16 bp, M. musculus
cctcccaatttcatgt

SEQ ID NO: 388913 - DNA, 16 bp, M. musculus
cctcccacagttcctc

SEQ ID NO: 388914 - DNA, 16 bp, M. musculus
cctcccacatcaatca

SEQ ID NO: 388915 - DNA, 16 bp, M. musculus
cctcccacatcagtca

SEQ ID NO: 388916 - DNA, 16 bp, M. musculus
cctcccacattaatca

SEQ ID NO: 388917 - DNA, 16 bp, M. musculus
cctcccaccctgctct

SEQ ID NO: 388918 - DNA, 16 bp, M. musculus
cctcccacctcagcct

SEQ ID NO: 388919 - DNA, 16 bp, M. musculus
cctcccacctctgctt

SEQ ID NO: 388920 - DNA, 16 bp, M. musculus
cctcccagatccctcc

SEQ ID NO: 388921 - DNA, 16 bp, M. musculus
cctcccagattcctcc

SEQ ID NO: 388922 - DNA, 16 bp, M. musculus
cctcccagcactggga

SEQ ID NO: 388923 - DNA, 16 bp, M. musculus
cctcccagcctcccag

SEQ ID NO: 388924 - DNA, 16 bp, M. musculus
cctcccagctcctcca

SEQ ID NO: 388925 - DNA, 16 bp, M. musculus
cctcccaggagctggg

SEQ ID NO: 388926 - DNA, 16 bp, M. musculus
cctcccagtcccttcc

SEQ ID NO: 388927 - DNA, 16 bp, M. musculus
cctcccagtgatgtcc

SEQ ID NO: 388928 - DNA, 16 bp, M. musculus
cctcccagtgcctccc

SEQ ID NO: 388929 - DNA, 16 bp, M. musculus
cctcccagtgctgggg

SEQ ID NO: 388930 - DNA, 16 bp, M. musculus
cctcccagttccccct

SEQ ID NO: 388931 - DNA, 16 bp, M. musculus
cctcccagttcttccc

SEQ ID NO: 388932 - DNA, 16 bp, M. musculus
cctcccatacctgatt

SEQ ID NO: 388933 - DNA, 16 bp, M. musculus
cctcccatatcaatca

SEQ ID NO: 388934 - DNA, 16 bp, M. musculus
cctcccatctcactgt

SEQ ID NO: 388935 - DNA, 16 bp, M. musculus
cctcccatctcagcct

SEQ ID NO: 388936 - DNA, 16 bp, M. musculus
cctcccatggcctctg

SEQ ID NO: 388937 - DNA, 16 bp, M. musculus
cctccccactgccctg

SEQ ID NO: 388938 - DNA, 16 bp, M. musculus
cctccccacttccctg

SEQ ID NO: 388939 - DNA, 16 bp, M. musculus
cctccccagagctgga

SEQ ID NO: 388940 - DNA, 16 bp, M. musculus
cctccccagcacctgt

SEQ ID NO: 388941 - DNA, 16 bp, M. musculus
cctccccagcactggg

SEQ ID NO: 388942 - DNA, 18 bp, M. musculus
cctccccagccgggcggg

SEQ ID NO: 388943 - DNA, 16 bp, M. musculus
cctccccagcctctgg

SEQ ID NO: 388944 - DNA, 16 bp, M. musculus
cctccccagcctgcct

SEQ ID NO: 388945 - DNA, 16 bp, M. musculus
cctccccagctctggg

SEQ ID NO: 388946 - DNA, 17 bp, M. musculus
cctccccagctgggtgg

SEQ ID NO: 388947 - DNA, 16 bp, M. musculus
cctccccagtgctgtg

SEQ ID NO: 388948 - DNA, 16 bp, M. musculus
cctccccatcccctgt

SEQ ID NO: 388949 - DNA, 16 bp, M. musculus
cctcccccaacaaggc

SEQ ID NO: 388950 - DNA, 16 bp, M. musculus
cctcccccagcagcca

SEQ ID NO: 388951 - DNA, 16 bp, M. musculus
cctcccccatacctga

SEQ ID NO: 388952 - DNA, 16 bp, M. musculus
cctcccccatcaatta

SEQ ID NO: 388953 - DNA, 16 bp, M. musculus
cctcccccatgccctg

SEQ ID NO: 388954 - DNA, 16 bp, M. musculus
cctccccccaaaaaag

SEQ ID NO: 388955 - DNA, 16 bp, M. musculus
cctccccctgtctcca

SEQ ID NO: 388956 - DNA, 16 bp, M. musculus
cctcccccttttgagg

SEQ ID NO: 388957 - DNA, 16 bp, M. musculus
cctcccctcagggctc

SEQ ID NO: 388958 - DNA, 16 bp, M. musculus
cctcccctcccattgc

SEQ ID NO: 388959 - DNA, 17 bp, M. musculus
cctcccctgaaatttgg

SEQ ID NO: 388960 - DNA, 16 bp, M. musculus
cctccccttgagttgg

SEQ ID NO: 388961 - DNA, 16 bp, M. musculus
cctcccgagttctggg

SEQ ID NO: 388962 - DNA, 16 bp, M. musculus
cctccctcactggaac

SEQ ID NO: 388963 - DNA, 16 bp, M. musculus
cctccctcagcagcca

SEQ ID NO: 388964 - DNA, 16 bp, M. musculus
cctccctcagcctcct

SEQ ID NO: 388965 - DNA, 16 bp, M. musculus
cctccctcagcctgaa

SEQ ID NO: 388966 - DNA, 16 bp, M. musculus
cctccctccaagccct

SEQ ID NO: 388967 - DNA, 16 bp, M. musculus
cctccctccagcttct

SEQ ID NO: 388968 - DNA, 16 bp, M. musculus
cctccctccatggtgc

SEQ ID NO: 388969 - DNA, 16 bp, M. musculus
cctccctcccaagtgc

SEQ ID NO: 388970 - DNA, 16 bp, M. musculus
cctccctccctacttg

SEQ ID NO: 388971 - DNA, 16 bp, M. musculus
cctccctccctccatg

SEQ ID NO: 388972 - DNA, 16 bp, M. musculus
cctccctcctcagcct

SEQ ID NO: 388973 - DNA, 16 bp, M. musculus
cctccctcctgacctt

SEQ ID NO: 388974 - DNA, 16 bp, M. musculus
cctccctctgtacata

SEQ ID NO: 388975 - DNA, 16 bp, M. musculus
cctccctgcctgcact

SEQ ID NO: 388976 - DNA, 16 bp, M. musculus
cctccctggaggccga

SEQ ID NO: 388977 - DNA, 16 bp, M. musculus
cctccctgggaccaag

SEQ ID NO: 388978 - DNA, 16 bp, M. musculus
cctccctgggatcctc

SEQ ID NO: 388979 - DNA, 16 bp, M. musculus
cctccctgggtgcccg

SEQ ID NO: 388980 - DNA, 16 bp, M. musculus
cctccctgtgaggagg

SEQ ID NO: 388981 - DNA, 16 bp, M. musculus
cctccctgtgctccag

SEQ ID NO: 388982 - DNA, 16 bp, M. musculus
cctcccttcagtctct

SEQ ID NO: 388983 - DNA, 16 bp, M. musculus
cctcccttgggggccc

SEQ ID NO: 388984 - DNA, 16 bp, M. musculus
cctccctttgagacct

SEQ ID NO: 388985 - DNA, 16 bp, M. musculus
cctcccttttggaatg

SEQ ID NO: 388986 - DNA, 16 bp, M. musculus
cctccgacctccacac

SEQ ID NO: 388987 - DNA, 16 bp, M. musculus
cctccgtgggcaccag

SEQ ID NO: 388988 - DNA, 16 bp, M. musculus
cctcctaaaggttcca

SEQ ID NO: 388989 - DNA, 16 bp, M. musculus
cctcctaataatacca

SEQ ID NO: 388990 - DNA, 16 bp, M. musculus
cctcctaattcttccc

SEQ ID NO: 388991 - DNA, 16 bp, M. musculus
cctcctacagttcctc

SEQ ID NO: 388992 - DNA, 16 bp, M. musculus
cctcctacatcaatta

SEQ ID NO: 388993 - DNA, 16 bp, M. musculus
cctcctacctcagcct

SEQ ID NO: 388994 - DNA, 16 bp, M. musculus
cctcctagctgcctgt

SEQ ID NO: 388995 - DNA, 16 bp, M. musculus
cctcctagtccttccc

SEQ ID NO: 388996 - DNA, 16 bp, M. musculus
cctcctcacaccagtc

SEQ ID NO: 388997 - DNA, 16 bp, M. musculus
cctcctcactctctgg

SEQ ID NO: 388998 - DNA, 16 bp, M. musculus
cctcctcagcagaggc

SEQ ID NO: 388999 - DNA, 16 bp, M. musculus
cctcctcagccttccc

SEQ ID NO: 389000 - DNA, 16 bp, M. musculus
cctcctcaggcaccag

SEQ ID NO: 389001 - DNA, 16 bp, M. musculus
cctcctcagggctggg

SEQ ID NO: 389002 - DNA, 16 bp, M. musculus
cctcctcagtttcttc

SEQ ID NO: 389003 - DNA, 16 bp, M. musculus
cctcctcatcttcatc

SEQ ID NO: 389004 - DNA, 16 bp, M. musculus
cctcctccacagacct

SEQ ID NO: 389005 - DNA, 16 bp, M. musculus
cctcctccaccatgcc

SEQ ID NO: 389006 - DNA, 16 bp, M. musculus
cctcctccacctgctc

SEQ ID NO: 389007 - DNA, 16 bp, M. musculus
cctcctccagccctgc

SEQ ID NO: 389008 - DNA, 16 bp, M. musculus
cctcctccagcctcct

SEQ ID NO: 389009 - DNA, 16 bp, M. musculus
cctcctccaggaagtc

SEQ ID NO: 389010 - DNA, 16 bp, M. musculus
cctcctccatggtctc

SEQ ID NO: 389011 - DNA, 16 bp, M. musculus
cctcctccatgtcctc

SEQ ID NO: 389012 - DNA, 16 bp, M. musculus
cctcctcccaagtgct

SEQ ID NO: 389013 - DNA, 16 bp, M. musculus
cctcctcccagttcct

SEQ ID NO: 389014 - DNA, 16 bp, M. musculus
cctcctccctcagact

SEQ ID NO: 389015 - DNA, 16 bp, M. musculus
cctcctccctgagaac

SEQ ID NO: 389016 - DNA, 16 bp, M. musculus
cctcctcctcagcctc

SEQ ID NO: 389017 - DNA, 16 bp, M. musculus
cctcctcctcagcttc

SEQ ID NO: 389018 - DNA, 16 bp, M. musculus
cctcctcctcctcagc

SEQ ID NO: 389019 - DNA, 16 bp, M. musculus
cctcctcctcctcagt

SEQ ID NO: 389020 - DNA, 16 bp, M. musculus
cctcctcctcttctga

SEQ ID NO: 389021 - DNA, 16 bp, M. musculus
cctcctcctggtcacc

SEQ ID NO: 389022 - DNA, 16 bp, M. musculus
cctcctcctgtgtgtg

SEQ ID NO: 389023 - DNA, 16 bp, M. musculus
cctcctccttcagcct

SEQ ID NO: 389024 - DNA, 16 bp, M. musculus
cctcctccttccaaag

SEQ ID NO: 389025 - DNA, 16 bp, M. musculus
cctcctccttctgctg

SEQ ID NO: 389026 - DNA, 16 bp, M. musculus
cctcctctcagatgac

SEQ ID NO: 389027 - DNA, 16 bp, M. musculus
cctcctctcccactga

SEQ ID NO: 389028 - DNA, 16 bp, M. musculus
cctcctctcctctcag

SEQ ID NO: 389029 - DNA, 16 bp, M. musculus
cctcctctctcactga

SEQ ID NO: 389030 - DNA, 16 bp, M. musculus
cctcctctctgtgtgt

SEQ ID NO: 389031 - DNA, 16 bp, M. musculus
cctcctctgcattctc

SEQ ID NO: 389032 - DNA, 16 bp, M. musculus
cctcctctgcctccca

SEQ ID NO: 389033 - DNA, 16 bp, M. musculus
cctcctctggcctcca

SEQ ID NO: 389034 - DNA, 16 bp, M. musculus
cctcctctggcctctg

SEQ ID NO: 389035 - DNA, 16 bp, M. musculus
cctcctctggcctctt

SEQ ID NO: 389036 - DNA, 16 bp, M. musculus
cctcctctggcctttg

SEQ ID NO: 389037 - DNA, 16 bp, M. musculus
cctcctctggtattcc

SEQ ID NO: 389038 - DNA, 16 bp, M. musculus
cctcctctggtctcca

SEQ ID NO: 389039 - DNA, 16 bp, M. musculus
cctcctctgtgggctg

SEQ ID NO: 389040 - DNA, 16 bp, M. musculus
cctcctctgtgtcctc

SEQ ID NO: 389041 - DNA, 16 bp, M. musculus
cctcctcttccccagg

SEQ ID NO: 389042 - DNA, 16 bp, M. musculus
cctcctcttctctcag

SEQ ID NO: 389043 - DNA, 16 bp, M. musculus
cctcctcttctgtggg

SEQ ID NO: 389044 - DNA, 16 bp, M. musculus
cctcctcttgcttatg

SEQ ID NO: 389045 - DNA, 16 bp, M. musculus
cctcctgactccctct

SEQ ID NO: 389046 - DNA, 16 bp, M. musculus
cctcctgactgctggg

SEQ ID NO: 389047 - DNA, 16 bp, M. musculus
cctcctgagcaggtgc

SEQ ID NO: 389048 - DNA, 16 bp, M. musculus
cctcctgagtgctaag

SEQ ID NO: 389049 - DNA, 18 bp, M. musculus
cctcctgagtgctgggac

SEQ ID NO: 389050 - DNA, 16 bp, M. musculus
cctcctgagttctggg

SEQ ID NO: 389051 - DNA, 16 bp, M. musculus
cctcctgatcctcctg

SEQ ID NO: 389052 - DNA, 16 bp, M. musculus
cctcctgatgctggga

SEQ ID NO: 389053 - DNA, 16 bp, M. musculus
cctcctgcagcagaca

SEQ ID NO: 389054 - DNA, 16 bp, M. musculus
cctcctgcagcagctg

SEQ ID NO: 389055 - DNA, 16 bp, M. musculus
cctcctgcatcagcct

SEQ ID NO: 389056 - DNA, 16 bp, M. musculus
cctcctgcatcctcct

SEQ ID NO: 389057 - DNA, 16 bp, M. musculus
cctcctgcccctgctg

SEQ ID NO: 389058 - DNA, 16 bp, M. musculus
cctcctgcctcaccct

SEQ ID NO: 389059 - DNA, 16 bp, M. musculus
cctcctgcctcagcat

SEQ ID NO: 389060 - DNA, 16 bp, M. musculus
cctcctgcctcagcct

SEQ ID NO: 389061 - DNA, 16 bp, M. musculus
cctcctgcctccacag

SEQ ID NO: 389062 - DNA, 16 bp, M. musculus
cctcctgcctctgcat

SEQ ID NO: 389063 - DNA, 16 bp, M. musculus
cctcctgcctctggct

SEQ ID NO: 389064 - DNA, 16 bp, M. musculus
cctcctgcctgagcct

SEQ ID NO: 389065 - DNA, 16 bp, M. musculus
cctcctgcctgcctgc

SEQ ID NO: 389066 - DNA, 16 bp, M. musculus
cctcctgcctggggtc

SEQ ID NO: 389067 - DNA, 16 bp, M. musculus
cctcctgccttcatct

SEQ ID NO: 389068 - DNA, 16 bp, M. musculus
cctcctgcctttacct

SEQ ID NO: 389069 - DNA, 16 bp, M. musculus
cctcctgctcctgctg

SEQ ID NO: 389070 - DNA, 16 bp, M. musculus
cctcctgctctagcag

SEQ ID NO: 389071 - DNA, 16 bp, M. musculus
cctcctgctgcagcct

SEQ ID NO: 389072 - DNA, 16 bp, M. musculus
cctcctgctgctcctg

SEQ ID NO: 389073 - DNA, 16 bp, M. musculus
cctcctgcttcagctt

SEQ ID NO: 389074 - DNA, 16 bp, M. musculus
cctcctgcttctgtct

SEQ ID NO: 389075 - DNA, 16 bp, M. musculus
cctcctggaagaagtt

SEQ ID NO: 389076 - DNA, 16 bp, M. musculus
cctcctggatgctggg

SEQ ID NO: 389077 - DNA, 16 bp, M. musculus
cctcctggcagaaaat

SEQ ID NO: 389078 - DNA, 16 bp, M. musculus
cctcctggccctggca

SEQ ID NO: 389079 - DNA, 16 bp, M. musculus
cctcctggcctcttgg

SEQ ID NO: 389080 - DNA, 16 bp, M. musculus
cctcctggctgaggat

SEQ ID NO: 389081 - DNA, 16 bp, M. musculus
cctcctggctgcagat

SEQ ID NO: 389082 - DNA, 16 bp, M. musculus
cctcctgggaaagcag

SEQ ID NO: 389083 - DNA, 16 bp, M. musculus
cctcctgtaccatgct

SEQ ID NO: 389084 - DNA, 16 bp, M. musculus
cctcctgtagccaggc

SEQ ID NO: 389085 - DNA, 16 bp, M. musculus
cctcctgtcccagaag

SEQ ID NO: 389086 - DNA, 16 bp, M. musculus
cctcctgtctcaccct

SEQ ID NO: 389087 - DNA, 16 bp, M. musculus
cctcctgtctctggct

SEQ ID NO: 389088 - DNA, 16 bp, M. musculus
cctcctgtctgtctcc

SEQ ID NO: 389089 - DNA, 16 bp, M. musculus
cctcctgtctgtctct

SEQ ID NO: 389090 - DNA, 16 bp, M. musculus
cctcctgtgcctcctg

SEQ ID NO: 389091 - DNA, 16 bp, M. musculus
cctcctgtggccaggc

SEQ ID NO: 389092 - DNA, 16 bp, M. musculus
cctcctgtgggtgctg

SEQ ID NO: 389093 - DNA, 16 bp, M. musculus
cctcctgtgtctgcct

SEQ ID NO: 389094 - DNA, 16 bp, M. musculus
cctcctgtgtgctgag

SEQ ID NO: 389095 - DNA, 16 bp, M. musculus
cctcctgtgtgctggg

SEQ ID NO: 389096 - DNA, 16 bp, M. musculus
cctcctgttcccattc

SEQ ID NO: 389097 - DNA, 16 bp, M. musculus
cctccttattacttag

SEQ ID NO: 389098 - DNA, 16 bp, M. musculus
cctccttcataactga

SEQ ID NO: 389099 - DNA, 16 bp, M. musculus
cctccttcctggtttc

SEQ ID NO: 389100 - DNA, 16 bp, M. musculus
cctccttggtgctggg

SEQ ID NO: 389101 - DNA, 16 bp, M. musculus
cctccttgtgtgtgtg

SEQ ID NO: 389102 - DNA, 16 bp, M. musculus
cctcctttcctcccag

SEQ ID NO: 389103 - DNA, 16 bp, M. musculus
cctcctttggaatgaa

SEQ ID NO: 389104 - DNA, 16 bp, M. musculus
cctccttttaaaaaat

SEQ ID NO: 389105 - DNA, 16 bp, M. musculus
cctccttttcaggaaa

SEQ ID NO: 389106 - DNA, 16 bp, M. musculus
cctccttttgttgcct

SEQ ID NO: 389107 - DNA, 16 bp, M. musculus
cctcgaactcacaaag

SEQ ID NO: 389108 - DNA, 16 bp, M. musculus
cctcgaactcacagag

SEQ ID NO: 389109 - DNA, 16 bp, M. musculus
cctcgaactcagaaac

SEQ ID NO: 389110 - DNA, 16 bp, M. musculus
cctcgaactcagagag

SEQ ID NO: 389111 - DNA, 16 bp, M. musculus
cctcgaagatatgggt

SEQ ID NO: 389112 - DNA, 16 bp, M. musculus
cctcgccagcatctgg

SEQ ID NO: 389113 - DNA, 16 bp, M. musculus
cctcgcccagtcctgg

SEQ ID NO: 389114 - DNA, 16 bp, M. musculus
cctcggcctcggcctc

SEQ ID NO: 389115 - DNA, 16 bp, M. musculus
cctcggggctggagag

SEQ ID NO: 389116 - DNA, 16 bp, M. musculus
cctcgggtggggcagt

SEQ ID NO: 389117 - DNA, 16 bp, M. musculus
cctctaactccagctc

SEQ ID NO: 389118 - DNA, 16 bp, M. musculus
cctctaactcctgagt

SEQ ID NO: 389119 - DNA, 16 bp, M. musculus
cctctaatcccagcac

SEQ ID NO: 389120 - DNA, 16 bp, M. musculus
cctctaattcagagat

SEQ ID NO: 389121 - DNA, 16 bp, M. musculus
cctctacaaaagcagc

SEQ ID NO: 389122 - DNA, 16 bp, M. musculus
cctctacacacatgca

SEQ ID NO: 389123 - DNA, 16 bp, M. musculus
cctctacacacccact

SEQ ID NO: 389124 - DNA, 16 bp, M. musculus
cctctaccagcagacc

SEQ ID NO: 389125 - DNA, 16 bp, M. musculus
cctctacctccaaagt

SEQ ID NO: 389126 - DNA, 20 bp, M. musculus
cctctacctcccaagtgctg

SEQ ID NO: 389127 - DNA, 16 bp, M. musculus
cctctacctcccaggt

SEQ ID NO: 389128 - DNA, 16 bp, M. musculus
cctctacctcccatgt

SEQ ID NO: 389129 - DNA, 16 bp, M. musculus
cctctacctcctaagt

SEQ ID NO: 389130 - DNA, 16 bp, M. musculus
cctctactaccctctt

SEQ ID NO: 389131 - DNA, 16 bp, M. musculus
cctctactaccctttt

SEQ ID NO: 389132 - DNA, 16 bp, M. musculus
cctctactccttccag

SEQ ID NO: 389133 - DNA, 16 bp, M. musculus
cctctagaaaaagaaa

SEQ ID NO: 389134 - DNA, 16 bp, M. musculus
cctctagaatgtacca

SEQ ID NO: 389135 - DNA, 16 bp, M. musculus
cctctagtgactctgg

SEQ ID NO: 389136 - DNA, 16 bp, M. musculus
cctctatcatctttat

SEQ ID NO: 389137 - DNA, 16 bp, M. musculus
cctctatcattttcat

SEQ ID NO: 389138 - DNA, 16 bp, M. musculus
cctctatctccaaaaa

SEQ ID NO: 389139 - DNA, 16 bp, M. musculus
cctctatctctgtctc

SEQ ID NO: 389140 - DNA, 17 bp, M. musculus
cctctatttattataca

SEQ ID NO: 389141 - DNA, 16 bp, M. musculus
cctctatttcctgcct

SEQ ID NO: 389142 - DNA, 16 bp, M. musculus
cctctattttatcaga

SEQ ID NO: 389143 - DNA, 16 bp, M. musculus
cctctcaaagagcagc

SEQ ID NO: 389144 - DNA, 16 bp, M. musculus
cctctcaccctgctcc

SEQ ID NO: 389145 - DNA, 16 bp, M. musculus
cctctcacctcccagg

SEQ ID NO: 389146 - DNA, 16 bp, M. musculus
cctctcactgggggat

SEQ ID NO: 389147 - DNA, 16 bp, M. musculus
cctctcagaaatgctt

SEQ ID NO: 389148 - DNA, 16 bp, M. musculus
cctctcagaagtgaag

SEQ ID NO: 389149 - DNA, 16 bp, M. musculus
cctctcagaggcaaag

SEQ ID NO: 389150 - DNA, 16 bp, M. musculus
cctctcaggaaacagc

SEQ ID NO: 389151 - DNA, 16 bp, M. musculus
cctctcaggaaatagc

SEQ ID NO: 389152 - DNA, 16 bp, M. musculus
cctctcaggagacagt

SEQ ID NO: 389153 - DNA, 16 bp, M. musculus
cctctcaggagcctgc

SEQ ID NO: 389154 - DNA, 16 bp, M. musculus
cctctcaggaggcagc

SEQ ID NO: 389155 - DNA, 16 bp, M. musculus
cctctcagtggacagc

SEQ ID NO: 389156 - DNA, 16 bp, M. musculus
cctctcagtttcttct

SEQ ID NO: 389157 - DNA, 16 bp, M. musculus
cctctccaagctgact

SEQ ID NO: 389158 - DNA, 16 bp, M. musculus
cctctccacctgccct

SEQ ID NO: 389159 - DNA, 19 bp, M. musculus
cctctccagattctctccc

SEQ ID NO: 389160 - DNA, 16 bp, M. musculus
cctctccatctctgtc

SEQ ID NO: 389161 - DNA, 16 bp, M. musculus
cctctccatgcaaatg

SEQ ID NO: 389162 - DNA, 16 bp, M. musculus
cctctcccagaagcca

SEQ ID NO: 389163 - DNA, 16 bp, M. musculus
cctctcccagaagctg

SEQ ID NO: 389164 - DNA, 16 bp, M. musculus
cctctcccatcaatca

SEQ ID NO: 389165 - DNA, 16 bp, M. musculus
cctctccccatcccag

SEQ ID NO: 389166 - DNA, 16 bp, M. musculus
cctctccccttgatca

SEQ ID NO: 389167 - DNA, 16 bp, M. musculus
cctctcctactgtcac

SEQ ID NO: 389168 - DNA, 16 bp, M. musculus
cctctcctaggcctat

SEQ ID NO: 389169 - DNA, 16 bp, M. musculus
cctctcctcacatggc

SEQ ID NO: 389170 - DNA, 16 bp, M. musculus
cctctcctcccagtga

SEQ ID NO: 389171 - DNA, 16 bp, M. musculus
cctctcctcccataga

SEQ ID NO: 389172 - DNA, 16 bp, M. musculus
cctctcctcctattga

SEQ ID NO: 389173 - DNA, 16 bp, M. musculus
cctctcctcctcactg

SEQ ID NO: 389174 - DNA, 17 bp, M. musculus
cctctcctgagtcagaa

SEQ ID NO: 389175 - DNA, 16 bp, M. musculus
cctctccttcagtcct

SEQ ID NO: 389176 - DNA, 16 bp, M. musculus
cctctccttctattga

SEQ ID NO: 389177 - DNA, 16 bp, M. musculus
cctctctcaaaaaaaa

SEQ ID NO: 389178 - DNA, 16 bp, M. musculus
cctctctcaggtcttg

SEQ ID NO: 389179 - DNA, 16 bp, M. musculus
cctctctccacaaggt

SEQ ID NO: 389180 - DNA, 16 bp, M. musculus
cctctctccagcctcc

SEQ ID NO: 389181 - DNA, 16 bp, M. musculus
cctctctcccataacc

SEQ ID NO: 389182 - DNA, 16 bp, M. musculus
cctctctccctcccag

SEQ ID NO: 389183 - DNA, 16 bp, M. musculus
cctctctcctgtgtct

SEQ ID NO: 389184 - DNA, 16 bp, M. musculus
cctctctctgcctctg

SEQ ID NO: 389185 - DNA, 16 bp, M. musculus
cctctctctggtctct

SEQ ID NO: 389186 - DNA, 16 bp, M. musculus
cctctctcttccagga

SEQ ID NO: 389187 - DNA, 16 bp, M. musculus
cctctctgagcctcag

SEQ ID NO: 389188 - DNA, 16 bp, M. musculus
cctctctgagtctgtg

SEQ ID NO: 389189 - DNA, 16 bp, M. musculus
cctctctgatgatgat

SEQ ID NO: 389190 - DNA, 16 bp, M. musculus
cctctctgatggctct

SEQ ID NO: 389191 - DNA, 16 bp, M. musculus
cctctctgccactctc

SEQ ID NO: 389192 - DNA, 16 bp, M. musculus
cctctctgcctctgag

SEQ ID NO: 389193 - DNA, 16 bp, M. musculus
cctctctgctctgctc

SEQ ID NO: 389194 - DNA, 16 bp, M. musculus
cctctctgctgctgct

SEQ ID NO: 389195 - DNA, 16 bp, M. musculus
cctctctgcttcctgt

SEQ ID NO: 389196 - DNA, 16 bp, M. musculus
cctctctggaggctga

SEQ ID NO: 389197 - DNA, 16 bp, M. musculus
cctctctggcctccat

SEQ ID NO: 389198 - DNA, 16 bp, M. musculus
cctctctggcctctct

SEQ ID NO: 389199 - DNA, 16 bp, M. musculus
cctctctggctctttc

SEQ ID NO: 389200 - DNA, 16 bp, M. musculus
cctctctggcttctgc

SEQ ID NO: 389201 - DNA, 16 bp, M. musculus
cctctctgggcaccag

SEQ ID NO: 389202 - DNA, 16 bp, M. musculus
cctctctgggcctcca

SEQ ID NO: 389203 - DNA, 16 bp, M. musculus
cctctctgtgctgctc

SEQ ID NO: 389204 - DNA, 16 bp, M. musculus
cctctctgtgcttcag

SEQ ID NO: 389205 - DNA, 16 bp, M. musculus
cctctcttcacaatga

SEQ ID NO: 389206 - DNA, 16 bp, M. musculus
cctctcttcagcccca

SEQ ID NO: 389207 - DNA, 16 bp, M. musculus
cctctcttccctttga

SEQ ID NO: 389208 - DNA, 16 bp, M. musculus
cctctcttcctcccag

SEQ ID NO: 389209 - DNA, 16 bp, M. musculus
cctctcttctggcagg

SEQ ID NO: 389210 - DNA, 16 bp, M. musculus
cctctcttcttcccag

SEQ ID NO: 389211 - DNA, 16 bp, M. musculus
cctctcttggtctcct

SEQ ID NO: 389212 - DNA, 16 bp, M. musculus
cctctctttcctgtgt

SEQ ID NO: 389213 - DNA, 16 bp, M. musculus
cctctgaaaagtctcc

SEQ ID NO: 389214 - DNA, 16 bp, M. musculus
cctctgaacctgcaaa

SEQ ID NO: 389215 - DNA, 16 bp, M. musculus
cctctgaactgtgagc

SEQ ID NO: 389216 - DNA, 16 bp, M. musculus
cctctgaagaaacaga

SEQ ID NO: 389217 - DNA, 16 bp, M. musculus
cctctgaagagcagca

SEQ ID NO: 389218 - DNA, 16 bp, M. musculus
cctctgaaggcactgc

SEQ ID NO: 389219 - DNA, 16 bp, M. musculus
cctctgaatggagccc

SEQ ID NO: 389220 - DNA, 16 bp, M. musculus
cctctgacagttcttc

SEQ ID NO: 389221 - DNA, 16 bp, M. musculus
cctctgaccacacaca

SEQ ID NO: 389222 - DNA, 16 bp, M. musculus
cctctgaccaggctct

SEQ ID NO: 389223 - DNA, 16 bp, M. musculus
cctctgacccactctt

SEQ ID NO: 389224 - DNA, 16 bp, M. musculus
cctctgaccccaagcc

SEQ ID NO: 389225 - DNA, 16 bp, M. musculus
cctctgaccctcacat

SEQ ID NO: 389226 - DNA, 16 bp, M. musculus
cctctgacctccacgt

SEQ ID NO: 389227 - DNA, 16 bp, M. musculus
cctctgacctcctcat

SEQ ID NO: 389228 - DNA, 16 bp, M. musculus
cctctgacctctaccc

SEQ ID NO: 389229 - DNA, 16 bp, M. musculus
cctctgacctctgcat

SEQ ID NO: 389230 - DNA, 16 bp, M. musculus
cctctgacctctggcc

SEQ ID NO: 389231 - DNA, 16 bp, M. musculus
cctctgacttccatat

SEQ ID NO: 389232 - DNA, 16 bp, M. musculus
cctctgacttttttct

SEQ ID NO: 389233 - DNA, 16 bp, M. musculus
cctctgagaagctcca

SEQ ID NO: 389234 - DNA, 16 bp, M. musculus
cctctgagaaggagga

SEQ ID NO: 389235 - DNA, 16 bp, M. musculus
cctctgagaaggggga

SEQ ID NO: 389236 - DNA, 16 bp, M. musculus
cctctgagactagtct

SEQ ID NO: 389237 - DNA, 16 bp, M. musculus
cctctgagactggagt

SEQ ID NO: 389238 - DNA, 16 bp, M. musculus
cctctgagcagcagtg

SEQ ID NO: 389239 - DNA, 16 bp, M. musculus
cctctgagcatctctc

SEQ ID NO: 389240 - DNA, 16 bp, M. musculus
cctctgagccacaccc

SEQ ID NO: 389241 - DNA, 16 bp, M. musculus
cctctgagcctgtaag

SEQ ID NO: 389242 - DNA, 16 bp, M. musculus
cctctgagctccacat

SEQ ID NO: 389243 - DNA, 16 bp, M. musculus
cctctgaggacaccag

SEQ ID NO: 389244 - DNA, 16 bp, M. musculus
cctctgaggggcagca

SEQ ID NO: 389245 - DNA, 16 bp, M. musculus
cctctgagtagagatt

SEQ ID NO: 389246 - DNA, 16 bp, M. musculus
cctctgagtgttgtgg

SEQ ID NO: 389247 - DNA, 16 bp, M. musculus
cctctgatcatttctg

SEQ ID NO: 389248 - DNA, 16 bp, M. musculus
cctctgatctctacat

SEQ ID NO: 389249 - DNA, 16 bp, M. musculus
cctctgatcttcacat

SEQ ID NO: 389250 - DNA, 16 bp, M. musculus
cctctgattctttcct

SEQ ID NO: 389251 - DNA, 16 bp, M. musculus
cctctgcaacccccct

SEQ ID NO: 389252 - DNA, 16 bp, M. musculus
cctctgcaagagcaac

SEQ ID NO: 389253 - DNA, 16 bp, M. musculus
cctctgcaagagcaga

SEQ ID NO: 389254 - DNA, 16 bp, M. musculus
cctctgcaagagccac

SEQ ID NO: 389255 - DNA, 16 bp, M. musculus
cctctgcaagagcggt

SEQ ID NO: 389256 - DNA, 16 bp, M. musculus
cctctgcaagcaccag

SEQ ID NO: 389257 - DNA, 21 bp, M. musculus
cctctgcaatcaagctctccc

SEQ ID NO: 389258 - DNA, 16 bp, M. musculus
cctctgcaccatctct

SEQ ID NO: 389259 - DNA, 16 bp, M. musculus
cctctgcagacacctg

SEQ ID NO: 389260 - DNA, 16 bp, M. musculus
cctctgcaggagcagc

SEQ ID NO: 389261 - DNA, 16 bp, M. musculus
cctctgcagtgctggg

SEQ ID NO: 389262 - DNA, 16 bp, M. musculus
cctctgcataagctcc

SEQ ID NO: 389263 - DNA, 16 bp, M. musculus
cctctgcatcagcacc

SEQ ID NO: 389264 - DNA, 16 bp, M. musculus
cctctgcatcagcccc

SEQ ID NO: 389265 - DNA, 16 bp, M. musculus
cctctgcatcctctcc

SEQ ID NO: 389266 - DNA, 16 bp, M. musculus
cctctgcatgtatgtt

SEQ ID NO: 389267 - DNA, 16 bp, M. musculus
cctctgcattggtggt

SEQ ID NO: 389268 - DNA, 16 bp, M. musculus
cctctgccagtgcctg

SEQ ID NO: 389269 - DNA, 16 bp, M. musculus
cctctgccccatccct

SEQ ID NO: 389270 - DNA, 16 bp, M. musculus
cctctgcccctgagtg

SEQ ID NO: 389271 - DNA, 16 bp, M. musculus
cctctgccctctgctt

SEQ ID NO: 389272 - DNA, 16 bp, M. musculus
cctctgccgcctctgc

SEQ ID NO: 389273 - DNA, 16 bp, M. musculus
cctctgcctcacaagt

SEQ ID NO: 389274 - DNA, 16 bp, M. musculus
cctctgcctccacctc

SEQ ID NO: 389275 - DNA, 16 bp, M. musculus
cctctgcctccagccc

SEQ ID NO: 389276 - DNA, 16 bp, M. musculus
cctctgcctccagtga

SEQ ID NO: 389277 - DNA, 16 bp, M. musculus
cctctgcctccagtgc

SEQ ID NO: 389278 - DNA, 16 bp, M. musculus
cctctgcctcccaagg

SEQ ID NO: 389279 - DNA, 16 bp, M. musculus
cctctgcctcccacac

SEQ ID NO: 389280 - DNA, 16 bp, M. musculus
cctctgcctcccacct

SEQ ID NO: 389281 - DNA, 16 bp, M. musculus
cctctgcctcccagag

SEQ ID NO: 389282 - DNA, 16 bp, M. musculus
cctctgcctcccatct

SEQ ID NO: 389283 - DNA, 16 bp, M. musculus
cctctgcctcccatga

SEQ ID NO: 389284 - DNA, 16 bp, M. musculus
cctctgcctcctaagg

SEQ ID NO: 389285 - DNA, 16 bp, M. musculus
cctctgcctcctgaaa

SEQ ID NO: 389286 - DNA, 16 bp, M. musculus
cctctgcctcctggag

SEQ ID NO: 389287 - DNA, 16 bp, M. musculus
cctctgcctcctgggc

SEQ ID NO: 389288 - DNA, 16 bp, M. musculus
cctctgcctcctgggg

SEQ ID NO: 389289 - DNA, 16 bp, M. musculus
cctctgcctcctgtgc

SEQ ID NO: 389290 - DNA, 16 bp, M. musculus
cctctgcctctccagc

SEQ ID NO: 389291 - DNA, 16 bp, M. musculus
cctctgcctctgcaca

SEQ ID NO: 389292 - DNA, 16 bp, M. musculus
cctctgcctctgcagc

SEQ ID NO: 389293 - DNA, 16 bp, M. musculus
cctctgcctctgccac

SEQ ID NO: 389294 - DNA, 16 bp, M. musculus
cctctgcctctgctga

SEQ ID NO: 389295 - DNA, 16 bp, M. musculus
cctctgcctctggctc

SEQ ID NO: 389296 - DNA, 16 bp, M. musculus
cctctgcctctggggt

SEQ ID NO: 389297 - DNA, 16 bp, M. musculus
cctctgcctcttgatt

SEQ ID NO: 389298 - DNA, 16 bp, M. musculus
cctctgcctgcacaca

SEQ ID NO: 389299 - DNA, 16 bp, M. musculus
cctctgcctgctgagc

SEQ ID NO: 389300 - DNA, 16 bp, M. musculus
cctctgcctgctgctg

SEQ ID NO: 389301 - DNA, 16 bp, M. musculus
cctctgcctggccctc

SEQ ID NO: 389302 - DNA, 16 bp, M. musculus
cctctgcctgggatta

SEQ ID NO: 389303 - DNA, 16 bp, M. musculus
cctctgcctgtgcctg

SEQ ID NO: 389304 - DNA, 16 bp, M. musculus
cctctgccttccacat

SEQ ID NO: 389305 - DNA, 16 bp, M. musculus
cctctgccttgagtgc

SEQ ID NO: 389306 - DNA, 16 bp, M. musculus
cctctgccttgctaaa

SEQ ID NO: 389307 - DNA, 16 bp, M. musculus
cctctgcctttcaagt

SEQ ID NO: 389308 - DNA, 16 bp, M. musculus
cctctgctacatctgt

SEQ ID NO: 389309 - DNA, 16 bp, M. musculus
cctctgctccccaacc

SEQ ID NO: 389310 - DNA, 16 bp, M. musculus
cctctgctccccaagt

SEQ ID NO: 389311 - DNA, 16 bp, M. musculus
cctctgctcctgagtg

SEQ ID NO: 389312 - DNA, 16 bp, M. musculus
cctctgctcgctccag

SEQ ID NO: 389313 - DNA, 16 bp, M. musculus
cctctgctctcctctg

SEQ ID NO: 389314 - DNA, 16 bp, M. musculus
cctctgctctctccag

SEQ ID NO: 389315 - DNA, 16 bp, M. musculus
cctctgctctctctgg

SEQ ID NO: 389316 - DNA, 16 bp, M. musculus
cctctgctctgctctg

SEQ ID NO: 389317 - DNA, 16 bp, M. musculus
cctctgctgacctctg

SEQ ID NO: 389318 - DNA, 16 bp, M. musculus
cctctgctgccaccac

SEQ ID NO: 389319 - DNA, 16 bp, M. musculus
cctctgctgcccaggg

SEQ ID NO: 389320 - DNA, 16 bp, M. musculus
cctctgctgcccctgc

SEQ ID NO: 389321 - DNA, 16 bp, M. musculus
cctctgctgtgtgtgt

SEQ ID NO: 389322 - DNA, 16 bp, M. musculus
cctctgcttccagagt

SEQ ID NO: 389323 - DNA, 16 bp, M. musculus
cctctgcttcccaact

SEQ ID NO: 389324 - DNA, 16 bp, M. musculus
cctctgcttcccaagg

SEQ ID NO: 389325 - DNA, 16 bp, M. musculus
cctctgcttcctgcct

SEQ ID NO: 389326 - DNA, 16 bp, M. musculus
cctctggaaaccctct

SEQ ID NO: 389327 - DNA, 16 bp, M. musculus
cctctggaaagagcag

SEQ ID NO: 389328 - DNA, 16 bp, M. musculus
cctctggaaagctgtg

SEQ ID NO: 389329 - DNA, 16 bp, M. musculus
cctctggaaccacaag

SEQ ID NO: 389330 - DNA, 16 bp, M. musculus
cctctggaagaacaga

SEQ ID NO: 389331 - DNA, 16 bp, M. musculus
cctctggaagaacagc

SEQ ID NO: 389332 - DNA, 16 bp, M. musculus
cctctggaagaccagc

SEQ ID NO: 389333 - DNA, 16 bp, M. musculus
cctctggaagaccagt

SEQ ID NO: 389334 - DNA, 16 bp, M. musculus
cctctggaagagcaaa

SEQ ID NO: 389335 - DNA, 16 bp, M. musculus
cctctggaagagcaag

SEQ ID NO: 389336 - DNA, 16 bp, M. musculus
cctctggaagagcaga

SEQ ID NO: 389337 - DNA, 16 bp, M. musculus
cctctggaagagcagc

SEQ ID NO: 389338 - DNA, 16 bp, M. musculus
cctctggaagagcggc

SEQ ID NO: 389339 - DNA, 16 bp, M. musculus
cctctggaagagctgc

SEQ ID NO: 389340 - DNA, 16 bp, M. musculus
cctctggaagaggaac

SEQ ID NO: 389341 - DNA, 16 bp, M. musculus
cctctggaagagtggt

SEQ ID NO: 389342 - DNA, 16 bp, M. musculus
cctctggaagggagag

SEQ ID NO: 389343 - DNA, 16 bp, M. musculus
cctctggaagtactat

SEQ ID NO: 389344 - DNA, 16 bp, M. musculus
cctctggagtgctatg

SEQ ID NO: 389345 - DNA, 16 bp, M. musculus
cctctggattttttgg

SEQ ID NO: 389346 - DNA, 16 bp, M. musculus
cctctggccgggaagg

SEQ ID NO: 389347 - DNA, 16 bp, M. musculus
cctctggcctccaagg

SEQ ID NO: 389348 - DNA, 16 bp, M. musculus
cctctggcctccacac

SEQ ID NO: 389349 - DNA, 16 bp, M. musculus
cctctggcctctgcct

SEQ ID NO: 389350 - DNA, 16 bp, M. musculus
cctctggctccagagt

SEQ ID NO: 389351 - DNA, 16 bp, M. musculus
cctctggctccctcaa

SEQ ID NO: 389352 - DNA, 16 bp, M. musculus
cctctggcttccacat

SEQ ID NO: 389353 - DNA, 16 bp, M. musculus
cctctggcttccatgg

SEQ ID NO: 389354 - DNA, 16 bp, M. musculus
cctctggcttctacta

SEQ ID NO: 389355 - DNA, 16 bp, M. musculus
cctctggcttctgcct

SEQ ID NO: 389356 - DNA, 16 bp, M. musculus
cctctggcttttagag

SEQ ID NO: 389357 - DNA, 16 bp, M. musculus
cctctggcttttcacc

SEQ ID NO: 389358 - DNA, 16 bp, M. musculus
cctctgggaaagcagc

SEQ ID NO: 389359 - DNA, 16 bp, M. musculus
cctctgggagagcagt

SEQ ID NO: 389360 - DNA, 16 bp, M. musculus
cctctgggctctgagc

SEQ ID NO: 389361 - DNA, 16 bp, M. musculus
cctctgggcttctctt

SEQ ID NO: 389362 - DNA, 16 bp, M. musculus
cctctgggtattgtgg

SEQ ID NO: 389363 - DNA, 16 bp, M. musculus
cctctggtcaggcagg

SEQ ID NO: 389364 - DNA, 16 bp, M. musculus
cctctggtctccatga

SEQ ID NO: 389365 - DNA, 16 bp, M. musculus
cctctggttagtctgg

SEQ ID NO: 389366 - DNA, 16 bp, M. musculus
cctctggttcctggtc

SEQ ID NO: 389367 - DNA, 16 bp, M. musculus
cctctgtacatctctt

SEQ ID NO: 389368 - DNA, 16 bp, M. musculus
cctctgtactggggca

SEQ ID NO: 389369 - DNA, 16 bp, M. musculus
cctctgtagtgctggg

SEQ ID NO: 389370 - DNA, 16 bp, M. musculus
cctctgtcacatatgc

SEQ ID NO: 389371 - DNA, 16 bp, M. musculus
cctctgtcctccatct

SEQ ID NO: 389372 - DNA, 16 bp, M. musculus
cctctgtctcccaagg

SEQ ID NO: 389373 - DNA, 16 bp, M. musculus
cctctgtctccctctg

SEQ ID NO: 389374 - DNA, 16 bp, M. musculus
cctctgtctcctgagc

SEQ ID NO: 389375 - DNA, 16 bp, M. musculus
cctctgtctctacctc

SEQ ID NO: 389376 - DNA, 16 bp, M. musculus
cctctgtctctctctg

SEQ ID NO: 389377 - DNA, 16 bp, M. musculus
cctctgtctctgtctt

SEQ ID NO: 389378 - DNA, 16 bp, M. musculus
cctctgtctgcttcag

SEQ ID NO: 389379 - DNA, 16 bp, M. musculus
cctctgtctgcttcct

SEQ ID NO: 389380 - DNA, 16 bp, M. musculus
cctctgtctgtgtctg

SEQ ID NO: 389381 - DNA, 16 bp, M. musculus
cctctgtcttcagagt

SEQ ID NO: 389382 - DNA, 16 bp, M. musculus
cctctgtgaatttgag

SEQ ID NO: 389383 - DNA, 16 bp, M. musculus
cctctgtgcccatgtg

SEQ ID NO: 389384 - DNA, 16 bp, M. musculus
cctctgtgcctctgcc

SEQ ID NO: 389385 - DNA, 16 bp, M. musculus
cctctgtgctctctct

SEQ ID NO: 389386 - DNA, 16 bp, M. musculus
cctctgtggacaccag

SEQ ID NO: 389387 - DNA, 22 bp, M. musculus
cctctgtggacttggtggcctg

SEQ ID NO: 389388 - DNA, 16 bp, M. musculus
cctctgtggcctctgc

SEQ ID NO: 389389 - DNA, 16 bp, M. musculus
cctctgtggcttcctg

SEQ ID NO: 389390 - DNA, 16 bp, M. musculus
cctctgtgggcactgt

SEQ ID NO: 389391 - DNA, 16 bp, M. musculus
cctctgtgggcagtgc

SEQ ID NO: 389392 - DNA, 16 bp, M. musculus
cctctgtgggctcctg

SEQ ID NO: 389393 - DNA, 16 bp, M. musculus
cctctgtgtagccctg

SEQ ID NO: 389394 - DNA, 16 bp, M. musculus
cctctgtgtatatgtt

SEQ ID NO: 389395 - DNA, 16 bp, M. musculus
cctctgtgtctctgtc

SEQ ID NO: 389396 - DNA, 16 bp, M. musculus
cctctgtgtgtctgtc

SEQ ID NO: 389397 - DNA, 16 bp, M. musculus
cctctgtgtgtgtgca

SEQ ID NO: 389398 - DNA, 16 bp, M. musculus
cctctgttgaagaaca

SEQ ID NO: 389399 - DNA, 16 bp, M. musculus
cctctgttttccaagt

SEQ ID NO: 389400 - DNA, 16 bp, M. musculus
cctctgttttctgagt

SEQ ID NO: 389401 - DNA, 21 bp, M. musculus
cctcttagaaatgctttcatt

SEQ ID NO: 389402 - DNA, 16 bp, M. musculus
cctcttcagcaccatg

SEQ ID NO: 389403 - DNA, 16 bp, M. musculus
cctcttccagcctctg

SEQ ID NO: 389404 - DNA, 16 bp, M. musculus
cctcttccaggcagct

SEQ ID NO: 389405 - DNA, 16 bp, M. musculus
cctcttccataaagat

SEQ ID NO: 389406 - DNA, 16 bp, M. musculus
cctcttccccagggcc

SEQ ID NO: 389407 - DNA, 16 bp, M. musculus
cctcttccctcagcct

SEQ ID NO: 389408 - DNA, 16 bp, M. musculus
cctcttcctcagcttc

SEQ ID NO: 389409 - DNA, 16 bp, M. musculus
cctcttcctcctcagc

SEQ ID NO: 389410 - DNA, 16 bp, M. musculus
cctcttcctcctggga

SEQ ID NO: 389411 - DNA, 16 bp, M. musculus
cctcttcctctgtgtg

SEQ ID NO: 389412 - DNA, 16 bp, M. musculus
cctcttcctgctgcct

SEQ ID NO: 389413 - DNA, 16 bp, M. musculus
cctcttcctggtctcc

SEQ ID NO: 389414 - DNA, 16 bp, M. musculus
cctcttcctttccaat

SEQ ID NO: 389415 - DNA, 16 bp, M. musculus
cctcttctcccagtcc

SEQ ID NO: 389416 - DNA, 16 bp, M. musculus
cctcttctctggggca

SEQ ID NO: 389417 - DNA, 16 bp, M. musculus
cctcttctgacctcta

SEQ ID NO: 389418 - DNA, 16 bp, M. musculus
cctcttctgcctcctg

SEQ ID NO: 389419 - DNA, 16 bp, M. musculus
cctcttctgctttgaa

SEQ ID NO: 389420 - DNA, 16 bp, M. musculus
cctcttctggacttca

SEQ ID NO: 389421 - DNA, 16 bp, M. musculus
cctcttctggccccca

SEQ ID NO: 389422 - DNA, 16 bp, M. musculus
cctcttctggcctgca

SEQ ID NO: 389423 - DNA, 16 bp, M. musculus
cctcttctggccttca

SEQ ID NO: 389424 - DNA, 16 bp, M. musculus
cctcttctggcctttt

SEQ ID NO: 389425 - DNA, 16 bp, M. musculus
cctcttctggctgctg

SEQ ID NO: 389426 - DNA, 16 bp, M. musculus
cctcttctggcttcca

SEQ ID NO: 389427 - DNA, 16 bp, M. musculus
cctcttctggcttcct

SEQ ID NO: 389428 - DNA, 16 bp, M. musculus
cctcttctggctttca

SEQ ID NO: 389429 - DNA, 16 bp, M. musculus
cctcttctggggtttc

SEQ ID NO: 389430 - DNA, 16 bp, M. musculus
cctcttctggtctctt

SEQ ID NO: 389431 - DNA, 16 bp, M. musculus
cctcttctggtctgtc

SEQ ID NO: 389432 - DNA, 16 bp, M. musculus
cctcttctggtgtgta

SEQ ID NO: 389433 - DNA, 16 bp, M. musculus
cctcttctgtccttca

SEQ ID NO: 389434 - DNA, 16 bp, M. musculus
cctcttctgtcttcca

SEQ ID NO: 389435 - DNA, 16 bp, M. musculus
cctcttcttctctgag

SEQ ID NO: 389436 - DNA, 16 bp, M. musculus
cctcttcttgagcttc

SEQ ID NO: 389437 - DNA, 16 bp, M. musculus
cctcttgatctccttt

SEQ ID NO: 389438 - DNA, 16 bp, M. musculus
cctcttgattcaaaca

SEQ ID NO: 389439 - DNA, 16 bp, M. musculus
cctcttgcagcagatg

SEQ ID NO: 389440 - DNA, 16 bp, M. musculus
cctcttgcagtttgca

SEQ ID NO: 389441 - DNA, 16 bp, M. musculus
cctcttgcatccctgg

SEQ ID NO: 389442 - DNA, 16 bp, M. musculus
cctcttgcctctgtct

SEQ ID NO: 389443 - DNA, 16 bp, M. musculus
cctcttgcctcttgcc

SEQ ID NO: 389444 - DNA, 16 bp, M. musculus
cctcttgcctgaagca

SEQ ID NO: 389445 - DNA, 16 bp, M. musculus
cctcttgctcctgctc

SEQ ID NO: 389446 - DNA, 16 bp, M. musculus
cctcttggagacagag

SEQ ID NO: 389447 - DNA, 16 bp, M. musculus
cctcttggagacaggg

SEQ ID NO: 389448 - DNA, 16 bp, M. musculus
cctcttggagtatttt

SEQ ID NO: 389449 - DNA, 16 bp, M. musculus
cctcttggcactgctt

SEQ ID NO: 389450 - DNA, 16 bp, M. musculus
cctcttgggtttggag

SEQ ID NO: 389451 - DNA, 16 bp, M. musculus
cctcttgtggcctctg

SEQ ID NO: 389452 - DNA, 16 bp, M. musculus
cctctttaatccttaa

SEQ ID NO: 389453 - DNA, 16 bp, M. musculus
cctctttagaattggg

SEQ ID NO: 389454 - DNA, 16 bp, M. musculus
cctctttaggtcttaa

SEQ ID NO: 389455 - DNA, 16 bp, M. musculus
cctctttccccatatc

SEQ ID NO: 389456 - DNA, 16 bp, M. musculus
cctctttcccctcaag

SEQ ID NO: 389457 - DNA, 16 bp, M. musculus
cctctttcctaggttt

SEQ ID NO: 389458 - DNA, 16 bp, M. musculus
cctctttcctgtgtct

SEQ ID NO: 389459 - DNA, 16 bp, M. musculus
cctctttctctgccca

SEQ ID NO: 389460 - DNA, 16 bp, M. musculus
cctctttgggttccag

SEQ ID NO: 389461 - DNA, 16 bp, M. musculus
cctcttttagggaagg

SEQ ID NO: 389462 - DNA, 16 bp, M. musculus
cctcttttccaatttg

SEQ ID NO: 389463 - DNA, 16 bp, M. musculus
cctcttttctaggttt

SEQ ID NO: 389464 - DNA, 16 bp, M. musculus
cctcttttctccacat

SEQ ID NO: 389465 - DNA, 16 bp, M. musculus
cctcttttgacctcca

SEQ ID NO: 389466 - DNA, 16 bp, M. musculus
cctgaaaaaaaaaatg

SEQ ID NO: 389467 - DNA, 16 bp, M. musculus
cctgaaaaacaaaaca

SEQ ID NO: 389468 - DNA, 16 bp, M. musculus
cctgaaaaacaggaaa

SEQ ID NO: 389469 - DNA, 16 bp, M. musculus
cctgaaaactccttcc

SEQ ID NO: 389470 - DNA, 16 bp, M. musculus
cctgaaaatattttca

SEQ ID NO: 389471 - DNA, 16 bp, M. musculus
cctgaaacaactcctg

SEQ ID NO: 389472 - DNA, 16 bp, M. musculus
cctgaaacacactctg

SEQ ID NO: 389473 - DNA, 16 bp, M. musculus
cctgaaaccacagagc

SEQ ID NO: 389474 - DNA, 16 bp, M. musculus
cctgaaactcacagag

SEQ ID NO: 389475 - DNA, 16 bp, M. musculus
cctgaaactcactatg

SEQ ID NO: 389476 - DNA, 16 bp, M. musculus
cctgaaactgcattaa

SEQ ID NO: 389477 - DNA, 16 bp, M. musculus
cctgaaactggagtta

SEQ ID NO: 389478 - DNA, 16 bp, M. musculus
cctgaaactggagttg

SEQ ID NO: 389479 - DNA, 16 bp, M. musculus
cctgaaagaggagagc

SEQ ID NO: 389480 - DNA, 16 bp, M. musculus
cctgaaagctttagaa

SEQ ID NO: 389481 - DNA, 16 bp, M. musculus
cctgaaaggaccctga

SEQ ID NO: 389482 - DNA, 16 bp, M. musculus
cctgaaagtcacctat

SEQ ID NO: 389483 - DNA, 16 bp, M. musculus
cctgaaatcccagcac

SEQ ID NO: 389484 - DNA, 16 bp, M. musculus
cctgaaatcctagcac

SEQ ID NO: 389485 - DNA, 16 bp, M. musculus
cctgaaattctttaag

SEQ ID NO: 389486 - DNA, 16 bp, M. musculus
cctgaaattctttttt

SEQ ID NO: 389487 - DNA, 16 bp, M. musculus
cctgaacagaacacca

SEQ ID NO: 389488 - DNA, 16 bp, M. musculus
cctgaactcactgtgt

SEQ ID NO: 389489 - DNA, 16 bp, M. musculus
cctgaactgcttgagt

SEQ ID NO: 389490 - DNA, 16 bp, M. musculus
cctgaacttgctatgt

SEQ ID NO: 389491 - DNA, 16 bp, M. musculus
cctgaagaaatacaaa

SEQ ID NO: 389492 - DNA, 16 bp, M. musculus
cctgaagaaatccaaa

SEQ ID NO: 389493 - DNA, 16 bp, M. musculus
cctgaagaaatgcaaa

SEQ ID NO: 389494 - DNA, 16 bp, M. musculus
cctgaagaagaaagta

SEQ ID NO: 389495 - DNA, 16 bp, M. musculus
cctgaagaagcaggct

SEQ ID NO: 389496 - DNA, 16 bp, M. musculus
cctgaagaagctgaag

SEQ ID NO: 389497 - DNA, 16 bp, M. musculus
cctgaagacccagata

SEQ ID NO: 389498 - DNA, 16 bp, M. musculus
cctgaagacctgagtt

SEQ ID NO: 389499 - DNA, 16 bp, M. musculus
cctgaagactcagcta

SEQ ID NO: 389500 - DNA, 16 bp, M. musculus
cctgaagagaacagca

SEQ ID NO: 389501 - DNA, 16 bp, M. musculus
cctgaagagatggctc

SEQ ID NO: 389502 - DNA, 16 bp, M. musculus
cctgaagaggacaggg

SEQ ID NO: 389503 - DNA, 16 bp, M. musculus
cctgaagcaatcccac

SEQ ID NO: 389504 - DNA, 16 bp, M. musculus
cctgaagccctgggtt

SEQ ID NO: 389505 - DNA, 16 bp, M. musculus
cctgaagctggagtta

SEQ ID NO: 389506 - DNA, 17 bp, M. musculus
cctgaagctggctgagc

SEQ ID NO: 389507 - DNA, 16 bp, M. musculus
cctgaagctgtactac

SEQ ID NO: 389508 - DNA, 16 bp, M. musculus
cctgaaggagaggcag

SEQ ID NO: 389509 - DNA, 16 bp, M. musculus
cctgaaggcaggagct

SEQ ID NO: 389510 - DNA, 16 bp, M. musculus
cctgaaggggatagga

SEQ ID NO: 389511 - DNA, 16 bp, M. musculus
cctgaaggtcagaaac

SEQ ID NO: 389512 - DNA, 16 bp, M. musculus
cctgaatcctgggatt

SEQ ID NO: 389513 - DNA, 16 bp, M. musculus
cctgaatggggcttgg

SEQ ID NO: 389514 - DNA, 16 bp, M. musculus
cctgaatgtcctggaa

SEQ ID NO: 389515 - DNA, 16 bp, M. musculus
cctgaattcaaggcca

SEQ ID NO: 389516 - DNA, 16 bp, M. musculus
cctgaatttctgatcc

SEQ ID NO: 389517 - DNA, 16 bp, M. musculus
cctgaatttgatccct

SEQ ID NO: 389518 - DNA, 16 bp, M. musculus
cctgacaacccgagtt

SEQ ID NO: 389519 - DNA, 16 bp, M. musculus
cctgacaacctgactt

SEQ ID NO: 389520 - DNA, 16 bp, M. musculus
cctgacaactggagtt

SEQ ID NO: 389521 - DNA, 16 bp, M. musculus
cctgacacacagtagg

SEQ ID NO: 389522 - DNA, 16 bp, M. musculus
cctgacactatcactg

SEQ ID NO: 389523 - DNA, 16 bp, M. musculus
cctgacagcctgagtt

SEQ ID NO: 389524 - DNA, 16 bp, M. musculus
cctgacatctgggact

SEQ ID NO: 389525 - DNA, 17 bp, M. musculus
cctgacatctgtaagtt

SEQ ID NO: 389526 - DNA, 16 bp, M. musculus
cctgacatggctgtct

SEQ ID NO: 389527 - DNA, 16 bp, M. musculus
cctgaccaaagcaact

SEQ ID NO: 389528 - DNA, 16 bp, M. musculus
cctgaccacctgagtt

SEQ ID NO: 389529 - DNA, 16 bp, M. musculus
cctgaccagaggctca

SEQ ID NO: 389530 - DNA, 30 bp, M. musculus
cctgaccatccagccaatccattggctaca

SEQ ID NO: 389531 - DNA, 16 bp, M. musculus
cctgaccccaagctgt

SEQ ID NO: 389532 - DNA, 16 bp, M. musculus
cctgacccccaaggct

SEQ ID NO: 389533 - DNA, 16 bp, M. musculus
cctgacccctgacccc

SEQ ID NO: 389534 - DNA, 16 bp, M. musculus
cctgaccctgacctcc

SEQ ID NO: 389535 - DNA, 16 bp, M. musculus
cctgaccctgctcccc

SEQ ID NO: 389536 - DNA, 16 bp, M. musculus
cctgaccctggcattt

SEQ ID NO: 389537 - DNA, 16 bp, M. musculus
cctgacctaaagttgt

SEQ ID NO: 389538 - DNA, 16 bp, M. musculus
cctgacctcatgctgt

SEQ ID NO: 389539 - DNA, 16 bp, M. musculus
cctgacctctgacctc

SEQ ID NO: 389540 - DNA, 16 bp, M. musculus
cctgacctgcttgagt

SEQ ID NO: 389541 - DNA, 16 bp, M. musculus
cctgaccttaactttt

SEQ ID NO: 389542 - DNA, 16 bp, M. musculus
cctgaccttcagagag

SEQ ID NO: 389543 - DNA, 16 bp, M. musculus
cctgactaagacactg

SEQ ID NO: 389544 - DNA, 16 bp, M. musculus
cctgactaatacattt

SEQ ID NO: 389545 - DNA, 16 bp, M. musculus
cctgactcaagccatt

SEQ ID NO: 389546 - DNA, 16 bp, M. musculus
cctgactcagcttccc

SEQ ID NO: 389547 - DNA, 16 bp, M. musculus
cctgactcagttcaga

SEQ ID NO: 389548 - DNA, 16 bp, M. musculus
cctgactcagtttccc

SEQ ID NO: 389549 - DNA, 16 bp, M. musculus
cctgactcctggcaga

SEQ ID NO: 389550 - DNA, 16 bp, M. musculus
cctgactctacctccc

SEQ ID NO: 389551 - DNA, 16 bp, M. musculus
cctgactctcctggaa

SEQ ID NO: 389552 - DNA, 16 bp, M. musculus
cctgactctgcctccc

SEQ ID NO: 389553 - DNA, 16 bp, M. musculus
cctgactgcagcaggc

SEQ ID NO: 389554 - DNA, 16 bp, M. musculus
cctgactgcagtttct

SEQ ID NO: 389555 - DNA, 16 bp, M. musculus
cctgactggacttccg

SEQ ID NO: 389556 - DNA, 16 bp, M. musculus
cctgactgtcctagaa

SEQ ID NO: 389557 - DNA, 16 bp, M. musculus
cctgacttcagccccc

SEQ ID NO: 389558 - DNA, 16 bp, M. musculus
cctgacttccctggtg

SEQ ID NO: 389559 - DNA, 16 bp, M. musculus
cctgacttccttcagc

SEQ ID NO: 389560 - DNA, 16 bp, M. musculus
cctgacttcttcagtg

SEQ ID NO: 389561 - DNA, 16 bp, M. musculus
cctgagaaacaagcaa

SEQ ID NO: 389562 - DNA, 16 bp, M. musculus
cctgagaaccaaataa

SEQ ID NO: 389563 - DNA, 16 bp, M. musculus
cctgagaatctgagtt

SEQ ID NO: 389564 - DNA, 16 bp, M. musculus
cctgagacagacagac

SEQ ID NO: 389565 - DNA, 16 bp, M. musculus
cctgagacctcaaagc

SEQ ID NO: 389566 - DNA, 16 bp, M. musculus
cctgagactggagtta

SEQ ID NO: 389567 - DNA, 16 bp, M. musculus
cctgagactgggggta

SEQ ID NO: 389568 - DNA, 16 bp, M. musculus
cctgagagaggcagaa

SEQ ID NO: 389569 - DNA, 16 bp, M. musculus
cctgagagatggctca

SEQ ID NO: 389570 - DNA, 16 bp, M. musculus
cctgagagccagcaga

SEQ ID NO: 389571 - DNA, 16 bp, M. musculus
cctgagagctctgagg

SEQ ID NO: 389572 - DNA, 16 bp, M. musculus
cctgagaggctcttcc

SEQ ID NO: 389573 - DNA, 16 bp, M. musculus
cctgagagtctctctt

SEQ ID NO: 389574 - DNA, 16 bp, M. musculus
cctgagataaagaaga

SEQ ID NO: 389575 - DNA, 16 bp, M. musculus
cctgagatcctgttgt

SEQ ID NO: 389576 - DNA, 16 bp, M. musculus
cctgagatggcctgtg

SEQ ID NO: 389577 - DNA, 16 bp, M. musculus
cctgagatggctgcag

SEQ ID NO: 389578 - DNA, 16 bp, M. musculus
cctgagatgggcagtg

SEQ ID NO: 389579 - DNA, 16 bp, M. musculus
cctgagatgtaagcaa

SEQ ID NO: 389580 - DNA, 16 bp, M. musculus
cctgagattatacctc

SEQ ID NO: 389581 - DNA, 16 bp, M. musculus
cctgagatttctcaaa

SEQ ID NO: 389582 - DNA, 16 bp, M. musculus
cctgagcacaggtaat

SEQ ID NO: 389583 - DNA, 16 bp, M. musculus
cctgagcactgtgtgt

SEQ ID NO: 389584 - DNA, 18 bp, M. musculus
cctgagcatcggcagcag

SEQ ID NO: 389585 - DNA, 16 bp, M. musculus
cctgagccacctcccc

SEQ ID NO: 389586 - DNA, 16 bp, M. musculus
cctgagccacctctcc

SEQ ID NO: 389587 - DNA, 16 bp, M. musculus
cctgagccactggtgt

SEQ ID NO: 389588 - DNA, 16 bp, M. musculus
cctgagccatccctcc

SEQ ID NO: 389589 - DNA, 16 bp, M. musculus
cctgagccatctttct

SEQ ID NO: 389590 - DNA, 16 bp, M. musculus
cctgagcccagcactg

SEQ ID NO: 389591 - DNA, 16 bp, M. musculus
cctgagccgtctctcc

SEQ ID NO: 389592 - DNA, 34 bp, M. musculus
cctgagcctgagcctgagcctgagcctgagcctg

SEQ ID NO: 389593 - DNA, 16 bp, M. musculus
cctgagctacatgaga

SEQ ID NO: 389594 - DNA, 16 bp, M. musculus
cctgagctccacctaa

SEQ ID NO: 389595 - DNA, 16 bp, M. musculus
cctgagctccatctaa

SEQ ID NO: 389596 - DNA, 16 bp, M. musculus
cctgagctcctgtctc

SEQ ID NO: 389597 - DNA, 16 bp, M. musculus
cctgagctgagcctgg

SEQ ID NO: 389598 - DNA, 16 bp, M. musculus
cctgagctttctagct

SEQ ID NO: 389599 - DNA, 16 bp, M. musculus
cctgagcttttgtccc

SEQ ID NO: 389600 - DNA, 16 bp, M. musculus
cctgaggaacaacacc

SEQ ID NO: 389601 - DNA, 16 bp, M. musculus
cctgaggaagaggagg

SEQ ID NO: 389602 - DNA, 16 bp, M. musculus
cctgaggaagccagaa

SEQ ID NO: 389603 - DNA, 16 bp, M. musculus
cctgaggaatgacacc

SEQ ID NO: 389604 - DNA, 16 bp, M. musculus
cctgaggaatgctgaa

SEQ ID NO: 389605 - DNA, 16 bp, M. musculus
cctgaggaatgctggc

SEQ ID NO: 389606 - DNA, 16 bp, M. musculus
cctgaggaatgtcaca

SEQ ID NO: 389607 - DNA, 16 bp, M. musculus
cctgaggaggccagaa

SEQ ID NO: 389608 - DNA, 16 bp, M. musculus
cctgaggcacagccag

SEQ ID NO: 389609 - DNA, 16 bp, M. musculus
cctgaggctgaggcct

SEQ ID NO: 389610 - DNA, 16 bp, M. musculus
cctgagggccagaaga

SEQ ID NO: 389611 - DNA, 16 bp, M. musculus
cctgagggcttagcca

SEQ ID NO: 389612 - DNA, 16 bp, M. musculus
cctgaggggctggaga

SEQ ID NO: 389613 - DNA, 16 bp, M. musculus
cctgaggttttctttt

SEQ ID NO: 389614 - DNA, 16 bp, M. musculus
cctgagtacaaggaga

SEQ ID NO: 389615 - DNA, 16 bp, M. musculus
cctgagtagctgggac

SEQ ID NO: 389616 - DNA, 16 bp, M. musculus
cctgagtccaatccct

SEQ ID NO: 389617 - DNA, 16 bp, M. musculus
cctgagtctgaggaag

SEQ ID NO: 389618 - DNA, 16 bp, M. musculus
cctgagtctgtggaag

SEQ ID NO: 389619 - DNA, 16 bp, M. musculus
cctgagtctgttgcct

SEQ ID NO: 389620 - DNA, 16 bp, M. musculus
cctgagtgagggtctc

SEQ ID NO: 389621 - DNA, 16 bp, M. musculus
cctgagtgctaggaat

SEQ ID NO: 389622 - DNA, 16 bp, M. musculus
cctgagtgctaggact

SEQ ID NO: 389623 - DNA, 16 bp, M. musculus
cctgagtgctgagagt

SEQ ID NO: 389624 - DNA, 16 bp, M. musculus
cctgagtgctggaatc

SEQ ID NO: 389625 - DNA, 16 bp, M. musculus
cctgagtgctgggaac

SEQ ID NO: 389626 - DNA, 16 bp, M. musculus
cctgagtgctgggata

SEQ ID NO: 389627 - DNA, 16 bp, M. musculus
cctgagtgctgggatc

SEQ ID NO: 389628 - DNA, 16 bp, M. musculus
cctgagtgctggggct

SEQ ID NO: 389629 - DNA, 16 bp, M. musculus
cctgagtgctgggttt

SEQ ID NO: 389630 - DNA, 16 bp, M. musculus
cctgagtgtcctgctc

SEQ ID NO: 389631 - DNA, 16 bp, M. musculus
cctgagttagatccca

SEQ ID NO: 389632 - DNA, 16 bp, M. musculus
cctgagttcaaggcca

SEQ ID NO: 389633 - DNA, 16 bp, M. musculus
cctgagttcaaggtca

SEQ ID NO: 389634 - DNA, 16 bp, M. musculus
cctgagttcaattctt

SEQ ID NO: 389635 - DNA, 16 bp, M. musculus
cctgagttcacttccc

SEQ ID NO: 389636 - DNA, 16 bp, M. musculus
cctgagttcagatccc

SEQ ID NO: 389637 - DNA, 16 bp, M. musculus
cctgagttcagattcc

SEQ ID NO: 389638 - DNA, 16 bp, M. musculus
cctgagttcagtccct

SEQ ID NO: 389639 - DNA, 16 bp, M. musculus
cctgagttcagtctga

SEQ ID NO: 389640 - DNA, 16 bp, M. musculus
cctgagttcagttctc

SEQ ID NO: 389641 - DNA, 16 bp, M. musculus
cctgagttccagtcct

SEQ ID NO: 389642 - DNA, 17 bp, M. musculus
cctgagttcccatgaca

SEQ ID NO: 389643 - DNA, 16 bp, M. musculus
cctgagttctctggaa

SEQ ID NO: 389644 - DNA, 16 bp, M. musculus
cctgagttggatccca

SEQ ID NO: 389645 - DNA, 16 bp, M. musculus
cctgagtttaatctct

SEQ ID NO: 389646 - DNA, 16 bp, M. musculus
cctgagtttagttctc

SEQ ID NO: 389647 - DNA, 16 bp, M. musculus
cctgagtttctgggct

SEQ ID NO: 389648 - DNA, 16 bp, M. musculus
cctgagtttgagacca

SEQ ID NO: 389649 - DNA, 16 bp, M. musculus
cctgagtttgagccct

SEQ ID NO: 389650 - DNA, 16 bp, M. musculus
cctgagtttgatcttt

SEQ ID NO: 389651 - DNA, 16 bp, M. musculus
cctgagtttgattccc

SEQ ID NO: 389652 - DNA, 16 bp, M. musculus
cctgagtttgattgtt

SEQ ID NO: 389653 - DNA, 16 bp, M. musculus
cctgagttttatccct

SEQ ID NO: 389654 - DNA, 16 bp, M. musculus
cctgagttttattttt

SEQ ID NO: 389655 - DNA, 16 bp, M. musculus
cctgataaacaactta

SEQ ID NO: 389656 - DNA, 16 bp, M. musculus
cctgatagcataattg

SEQ ID NO: 389657 - DNA, 16 bp, M. musculus
cctgatatggatgctg

SEQ ID NO: 389658 - DNA, 16 bp, M. musculus
cctgatcctgccccca

SEQ ID NO: 389659 - DNA, 16 bp, M. musculus
cctgatcctgcccctc

SEQ ID NO: 389660 - DNA, 16 bp, M. musculus
cctgatcctgcctccc

SEQ ID NO: 389661 - DNA, 16 bp, M. musculus
cctgatctggtactgg

SEQ ID NO: 389662 - DNA, 16 bp, M. musculus
cctgatctttctgcct

SEQ ID NO: 389663 - DNA, 16 bp, M. musculus
cctgatgaacatagat

SEQ ID NO: 389664 - DNA, 16 bp, M. musculus
cctgatgacccaagtt

SEQ ID NO: 389665 - DNA, 16 bp, M. musculus
cctgatgacttgagtt

SEQ ID NO: 389666 - DNA, 19 bp, M. musculus
cctgatgccctcttctggt

SEQ ID NO: 389667 - DNA, 16 bp, M. musculus
cctgatgccctgagtt

SEQ ID NO: 389668 - DNA, 16 bp, M. musculus
cctgatgctgccatgc

SEQ ID NO: 389669 - DNA, 16 bp, M. musculus
cctgatggaggagatg

SEQ ID NO: 389670 - DNA, 16 bp, M. musculus
cctgatgtgggtgctg

SEQ ID NO: 389671 - DNA, 16 bp, M. musculus
cctgattctgttgcct

SEQ ID NO: 389672 - DNA, 21 bp, M. musculus
cctgattggctgcagcccatt

SEQ ID NO: 389673 - DNA, 16 bp, M. musculus
cctgatttatttattt

SEQ ID NO: 389674 - DNA, 16 bp, M. musculus
cctgattttagtggta

SEQ ID NO: 389675 - DNA, 16 bp, M. musculus
cctgattttttataaa

SEQ ID NO: 389676 - DNA, 16 bp, M. musculus
cctgcaaaaagtattt

SEQ ID NO: 389677 - DNA, 16 bp, M. musculus
cctgcaaagggtgctg

SEQ ID NO: 389678 - DNA, 16 bp, M. musculus
cctgcaaatttaatga

SEQ ID NO: 389679 - DNA, 16 bp, M. musculus
cctgcaacctctccag

SEQ ID NO: 389680 - DNA, 16 bp, M. musculus
cctgcaactccagctc

SEQ ID NO: 389681 - DNA, 16 bp, M. musculus
cctgcaagaggagaga

SEQ ID NO: 389682 - DNA, 16 bp, M. musculus
cctgcaagcctgtatg

SEQ ID NO: 389683 - DNA, 16 bp, M. musculus
cctgcaaggcttctgg

SEQ ID NO: 389684 - DNA, 16 bp, M. musculus
cctgcaattccagctc

SEQ ID NO: 389685 - DNA, 16 bp, M. musculus
cctgcacacacacaca

SEQ ID NO: 389686 - DNA, 16 bp, M. musculus
cctgcacacacatgca

SEQ ID NO: 389687 - DNA, 16 bp, M. musculus
cctgcacacactgcac

SEQ ID NO: 389688 - DNA, 16 bp, M. musculus
cctgcacacatgtgca

SEQ ID NO: 389689 - DNA, 16 bp, M. musculus
cctgcacacctgtgcc

SEQ ID NO: 389690 - DNA, 16 bp, M. musculus
cctgcacagacatctt

SEQ ID NO: 389691 - DNA, 16 bp, M. musculus
cctgcacaggaccaag

SEQ ID NO: 389692 - DNA, 16 bp, M. musculus
cctgcacaggcagctg

SEQ ID NO: 389693 - DNA, 16 bp, M. musculus
cctgcacaggtgagag

SEQ ID NO: 389694 - DNA, 16 bp, M. musculus
cctgcacatacatgta

SEQ ID NO: 389695 - DNA, 16 bp, M. musculus
cctgcacattttgtag

SEQ ID NO: 389696 - DNA, 16 bp, M. musculus
cctgcaccacacacac

SEQ ID NO: 389697 - DNA, 16 bp, M. musculus
cctgcaccaccaactg

SEQ ID NO: 389698 - DNA, 16 bp, M. musculus
cctgcaccatgcctcc

SEQ ID NO: 389699 - DNA, 16 bp, M. musculus
cctgcacccccaggtt

SEQ ID NO: 389700 - DNA, 16 bp, M. musculus
cctgcaccctgcaccc

SEQ ID NO: 389701 - DNA, 16 bp, M. musculus
cctgcacctgcacctg

SEQ ID NO: 389702 - DNA, 16 bp, M. musculus
cctgcacctgtgtata

SEQ ID NO: 389703 - DNA, 16 bp, M. musculus
cctgcactgcctgcct

SEQ ID NO: 389704 - DNA, 16 bp, M. musculus
cctgcagacatacatg

SEQ ID NO: 389705 - DNA, 16 bp, M. musculus
cctgcagagactgctc

SEQ ID NO: 389706 - DNA, 17 bp, M. musculus
cctgcagagagtactct

SEQ ID NO: 389707 - DNA, 16 bp, M. musculus
cctgcagagcccagaa

SEQ ID NO: 389708 - DNA, 16 bp, M. musculus
cctgcagaggacccag

SEQ ID NO: 389709 - DNA, 16 bp, M. musculus
cctgcagcacactctg

SEQ ID NO: 389710 - DNA, 16 bp, M. musculus
cctgcagcagggacag

SEQ ID NO: 389711 - DNA, 16 bp, M. musculus
cctgcagcccaggctg

SEQ ID NO: 389712 - DNA, 16 bp, M. musculus
cctgcagccctcctgg

SEQ ID NO: 389713 - DNA, 16 bp, M. musculus
cctgcagcctgcagcc

SEQ ID NO: 389714 - DNA, 16 bp, M. musculus
cctgcagctccagctc

SEQ ID NO: 389715 - DNA, 16 bp, M. musculus
cctgcagctctcatgt

SEQ ID NO: 389716 - DNA, 16 bp, M. musculus
cctgcagctggcaaaa

SEQ ID NO: 389717 - DNA, 16 bp, M. musculus
cctgcagctgtagcag

SEQ ID NO: 389718 - DNA, 16 bp, M. musculus
cctgcagcttctcaca

SEQ ID NO: 389719 - DNA, 16 bp, M. musculus
cctgcagctttgaatc

SEQ ID NO: 389720 - DNA, 16 bp, M. musculus
cctgcaggaaagctcc

SEQ ID NO: 389721 - DNA, 17 bp, M. musculus
cctgcagggcatcatcc

SEQ ID NO: 389722 - DNA, 16 bp, M. musculus
cctgcagtcctctgct

SEQ ID NO: 389723 - DNA, 16 bp, M. musculus
cctgcagtgtggagag

SEQ ID NO: 389724 - DNA, 16 bp, M. musculus
cctgcatatcagatat

SEQ ID NO: 389725 - DNA, 16 bp, M. musculus
cctgcatctgcctccc

SEQ ID NO: 389726 - DNA, 16 bp, M. musculus
cctgcatctgctgtca

SEQ ID NO: 389727 - DNA, 16 bp, M. musculus
cctgcatctgtttcca

SEQ ID NO: 389728 - DNA, 16 bp, M. musculus
cctgcatgccagaaaa

SEQ ID NO: 389729 - DNA, 16 bp, M. musculus
cctgcatgttctttgg

SEQ ID NO: 389730 - DNA, 16 bp, M. musculus
cctgccaaattcctag

SEQ ID NO: 389731 - DNA, 16 bp, M. musculus
cctgccaagggtgctg

SEQ ID NO: 389732 - DNA, 16 bp, M. musculus
cctgccacacagtgcc

SEQ ID NO: 389733 - DNA, 16 bp, M. musculus
cctgccaccatgctcc

SEQ ID NO: 389734 - DNA, 16 bp, M. musculus
cctgccacctgccctg

SEQ ID NO: 389735 - DNA, 16 bp, M. musculus
cctgccacctgcctga

SEQ ID NO: 389736 - DNA, 16 bp, M. musculus
cctgccacctgctgcc

SEQ ID NO: 389737 - DNA, 16 bp, M. musculus
cctgccactttgctgt

SEQ ID NO: 389738 - DNA, 16 bp, M. musculus
cctgccagaagagagg

SEQ ID NO: 389739 - DNA, 16 bp, M. musculus
cctgccagactcctga

SEQ ID NO: 389740 - DNA, 16 bp, M. musculus
cctgccagagcacgag

SEQ ID NO: 389741 - DNA, 16 bp, M. musculus
cctgccagagccatgc

SEQ ID NO: 389742 - DNA, 16 bp, M. musculus
cctgccagaggagaga

SEQ ID NO: 389743 - DNA, 16 bp, M. musculus
cctgccagaggagagt

SEQ ID NO: 389744 - DNA, 16 bp, M. musculus
cctgccagccagccag

SEQ ID NO: 389745 - DNA, 16 bp, M. musculus
cctgccaggcagtggt

SEQ ID NO: 389746 - DNA, 16 bp, M. musculus
cctgccagtccccctg

SEQ ID NO: 389747 - DNA, 16 bp, M. musculus
cctgccagtcctttgt

SEQ ID NO: 389748 - DNA, 16 bp, M. musculus
cctgccatccactcct

SEQ ID NO: 389749 - DNA, 16 bp, M. musculus
cctgccatctattcct

SEQ ID NO: 389750 - DNA, 16 bp, M. musculus
cctgcccaacaagagg

SEQ ID NO: 389751 - DNA, 16 bp, M. musculus
cctgcccaacttggga

SEQ ID NO: 389752 - DNA, 16 bp, M. musculus
cctgcccaatcatcag

SEQ ID NO: 389753 - DNA, 16 bp, M. musculus
cctgcccacagaccct

SEQ ID NO: 389754 - DNA, 16 bp, M. musculus
cctgcccactgccatg

SEQ ID NO: 389755 - DNA, 16 bp, M. musculus
cctgcccactgtgggc

SEQ ID NO: 389756 - DNA, 16 bp, M. musculus
cctgccccactatctt

SEQ ID NO: 389757 - DNA, 16 bp, M. musculus
cctgccccactgctcc

SEQ ID NO: 389758 - DNA, 16 bp, M. musculus
cctgccccagagaccc

SEQ ID NO: 389759 - DNA, 16 bp, M. musculus
cctgcccccagccctg

SEQ ID NO: 389760 - DNA, 16 bp, M. musculus
cctgcccccatctcca

SEQ ID NO: 389761 - DNA, 16 bp, M. musculus
cctgccccccaaaaaa

SEQ ID NO: 389762 - DNA, 16 bp, M. musculus
cctgcccctcaccagc

SEQ ID NO: 389763 - DNA, 16 bp, M. musculus
cctgcccctgcctcta

SEQ ID NO: 389764 - DNA, 18 bp, M. musculus
cctgcccctgcctctgcc

SEQ ID NO: 389765 - DNA, 16 bp, M. musculus
cctgcccgcctgcctg

SEQ ID NO: 389766 - DNA, 16 bp, M. musculus
cctgccctcctcagtg

SEQ ID NO: 389767 - DNA, 16 bp, M. musculus
cctgccctgacatcct

SEQ ID NO: 389768 - DNA, 16 bp, M. musculus
cctgccctgacttcct

SEQ ID NO: 389769 - DNA, 16 bp, M. musculus
cctgccctgcccacct

SEQ ID NO: 389770 - DNA, 16 bp, M. musculus
cctgccctgccctgct

SEQ ID NO: 389771 - DNA, 16 bp, M. musculus
cctgccctgccctgtc

SEQ ID NO: 389772 - DNA, 16 bp, M. musculus
cctgccctgcctgagt

SEQ ID NO: 389773 - DNA, 16 bp, M. musculus
cctgccctgccttgcc

SEQ ID NO: 389774 - DNA, 16 bp, M. musculus
cctgccctgctcacct

SEQ ID NO: 389775 - DNA, 16 bp, M. musculus
cctgccctgctcccca

SEQ ID NO: 389776 - DNA, 16 bp, M. musculus
cctgccctgctcctgc

SEQ ID NO: 389777 - DNA, 16 bp, M. musculus
cctgccctgctttcct

SEQ ID NO: 389778 - DNA, 16 bp, M. musculus
cctgccctggcttcct

SEQ ID NO: 389779 - DNA, 16 bp, M. musculus
cctgccctggcttctc

SEQ ID NO: 389780 - DNA, 19 bp, M. musculus
cctgcctagaatcccccag

SEQ ID NO: 389781 - DNA, 16 bp, M. musculus
cctgcctaggctgaag

SEQ ID NO: 389782 - DNA, 16 bp, M. musculus
cctgcctagggatggt

SEQ ID NO: 389783 - DNA, 16 bp, M. musculus
cctgcctaggggtggc

SEQ ID NO: 389784 - DNA, 16 bp, M. musculus
cctgcctagggtcagc

SEQ ID NO: 389785 - DNA, 16 bp, M. musculus
cctgcctcaaaaaaac

SEQ ID NO: 389786 - DNA, 16 bp, M. musculus
cctgcctcaaaaacaa

SEQ ID NO: 389787 - DNA, 16 bp, M. musculus
cctgcctcaaaaccaa

SEQ ID NO: 389788 - DNA, 16 bp, M. musculus
cctgcctcaacttcct

SEQ ID NO: 389789 - DNA, 16 bp, M. musculus
cctgcctcaccatcct

SEQ ID NO: 389790 - DNA, 16 bp, M. musculus
cctgcctcactcctct

SEQ ID NO: 389791 - DNA, 16 bp, M. musculus
cctgcctcactgccct

SEQ ID NO: 389792 - DNA, 16 bp, M. musculus
cctgcctcagactccc

SEQ ID NO: 389793 - DNA, 16 bp, M. musculus
cctgcctcagactctc

SEQ ID NO: 389794 - DNA, 16 bp, M. musculus
cctgcctcagcaccct

SEQ ID NO: 389795 - DNA, 16 bp, M. musculus
cctgcctcagccaccc

SEQ ID NO: 389796 - DNA, 16 bp, M. musculus
cctgcctcagccctcc

SEQ ID NO: 389797 - DNA, 16 bp, M. musculus
cctgcctcagcctcca

SEQ ID NO: 389798 - DNA, 16 bp, M. musculus
cctgcctcagcctctg

SEQ ID NO: 389799 - DNA, 16 bp, M. musculus
cctgcctcagcctgag

SEQ ID NO: 389800 - DNA, 16 bp, M. musculus
cctgcctcagcctgtg

SEQ ID NO: 389801 - DNA, 16 bp, M. musculus
cctgcctcagccttct

SEQ ID NO: 389802 - DNA, 16 bp, M. musculus
cctgcctcagctcctg

SEQ ID NO: 389803 - DNA, 16 bp, M. musculus
cctgcctcagcttctg

SEQ ID NO: 389804 - DNA, 16 bp, M. musculus
cctgcctcaggacctt

SEQ ID NO: 389805 - DNA, 16 bp, M. musculus
cctgcctcaggctctc

SEQ ID NO: 389806 - DNA, 16 bp, M. musculus
cctgcctcagtctacc

SEQ ID NO: 389807 - DNA, 16 bp, M. musculus
cctgcctcagtctccc

SEQ ID NO: 389808 - DNA, 16 bp, M. musculus
cctgcctcagtctcct

SEQ ID NO: 389809 - DNA, 16 bp, M. musculus
cctgcctcagtgccct

SEQ ID NO: 389810 - DNA, 16 bp, M. musculus
cctgcctcagtgtccc

SEQ ID NO: 389811 - DNA, 16 bp, M. musculus
cctgcctcagtgtctc

SEQ ID NO: 389812 - DNA, 16 bp, M. musculus
cctgcctcagtttccc

SEQ ID NO: 389813 - DNA, 16 bp, M. musculus
cctgcctcatcctccc

SEQ ID NO: 389814 - DNA, 16 bp, M. musculus
cctgcctcatcttcct

SEQ ID NO: 389815 - DNA, 16 bp, M. musculus
cctgcctccaaaaaaa

SEQ ID NO: 389816 - DNA, 16 bp, M. musculus
cctgcctccaccacct

SEQ ID NO: 389817 - DNA, 16 bp, M. musculus
cctgcctccacctcag

SEQ ID NO: 389818 - DNA, 16 bp, M. musculus
cctgcctccacctcca

SEQ ID NO: 389819 - DNA, 16 bp, M. musculus
cctgcctccaccttca

SEQ ID NO: 389820 - DNA, 16 bp, M. musculus
cctgcctccaggtcct

SEQ ID NO: 389821 - DNA, 16 bp, M. musculus
cctgcctccaggtgcc

SEQ ID NO: 389822 - DNA, 16 bp, M. musculus
cctgcctccatcccct

SEQ ID NO: 389823 - DNA, 16 bp, M. musculus
cctgcctcccagccct

SEQ ID NO: 389824 - DNA, 16 bp, M. musculus
cctgcctccctaccct

SEQ ID NO: 389825 - DNA, 16 bp, M. musculus
cctgcctccctcccag

SEQ ID NO: 389826 - DNA, 16 bp, M. musculus
cctgcctcctcaccct

SEQ ID NO: 389827 - DNA, 16 bp, M. musculus
cctgcctcctctccca

SEQ ID NO: 389828 - DNA, 16 bp, M. musculus
cctgcctcctgccctg

SEQ ID NO: 389829 - DNA, 16 bp, M. musculus
cctgcctcctgcctgg

SEQ ID NO: 389830 - DNA, 16 bp, M. musculus
cctgcctcctgctcag

SEQ ID NO: 389831 - DNA, 16 bp, M. musculus
cctgcctcctggaaga

SEQ ID NO: 389832 - DNA, 16 bp, M. musculus
cctgcctcctggcaga

SEQ ID NO: 389833 - DNA, 16 bp, M. musculus
cctgcctcggtctccc

SEQ ID NO: 389834 - DNA, 16 bp, M. musculus
cctgcctctacctccc

SEQ ID NO: 389835 - DNA, 16 bp, M. musculus
cctgcctctacctctg

SEQ ID NO: 389836 - DNA, 16 bp, M. musculus
cctgcctctaccttcc

SEQ ID NO: 389837 - DNA, 16 bp, M. musculus
cctgcctctactcccc

SEQ ID NO: 389838 - DNA, 16 bp, M. musculus
cctgcctctacttccc

SEQ ID NO: 389839 - DNA, 16 bp, M. musculus
cctgcctctacttcct

SEQ ID NO: 389840 - DNA, 16 bp, M. musculus
cctgcctctacttctg

SEQ ID NO: 389841 - DNA, 16 bp, M. musculus
cctgcctctatctccc

SEQ ID NO: 389842 - DNA, 16 bp, M. musculus
cctgcctctctgccac

SEQ ID NO: 389843 - DNA, 16 bp, M. musculus
cctgcctctctgttca

SEQ ID NO: 389844 - DNA, 16 bp, M. musculus
cctgcctctgactccc

SEQ ID NO: 389845 - DNA, 16 bp, M. musculus
cctgcctctgcacccc

SEQ ID NO: 389846 - DNA, 16 bp, M. musculus
cctgcctctgcatccc

SEQ ID NO: 389847 - DNA, 16 bp, M. musculus
cctgcctctgccaccc

SEQ ID NO: 389848 - DNA, 16 bp, M. musculus
cctgcctctgccactc

SEQ ID NO: 389849 - DNA, 16 bp, M. musculus
cctgcctctgcctcac

SEQ ID NO: 389850 - DNA, 16 bp, M. musculus
cctgcctctgcctcca

SEQ ID NO: 389851 - DNA, 16 bp, M. musculus
cctgcctctgcctcta

SEQ ID NO: 389852 - DNA, 16 bp, M. musculus
cctgcctctgcctctg

SEQ ID NO: 389853 - DNA, 16 bp, M. musculus
cctgcctctgcctctt

SEQ ID NO: 389854 - DNA, 16 bp, M. musculus
cctgcctctgcctgcc

SEQ ID NO: 389855 - DNA, 16 bp, M. musculus
cctgcctctgccttct

SEQ ID NO: 389856 - DNA, 16 bp, M. musculus
cctgcctctgcctttc

SEQ ID NO: 389857 - DNA, 16 bp, M. musculus
cctgcctctgctctca

SEQ ID NO: 389858 - DNA, 16 bp, M. musculus
cctgcctctgctggga

SEQ ID NO: 389859 - DNA, 16 bp, M. musculus
cctgcctctgcttacc

SEQ ID NO: 389860 - DNA, 16 bp, M. musculus
cctgcctctgcttctc

SEQ ID NO: 389861 - DNA, 16 bp, M. musculus
cctgcctctgcttctg

SEQ ID NO: 389862 - DNA, 16 bp, M. musculus
cctgcctctgctttcc

SEQ ID NO: 389863 - DNA, 16 bp, M. musculus
cctgcctctggctccc

SEQ ID NO: 389864 - DNA, 16 bp, M. musculus
cctgcctctggctctc

SEQ ID NO: 389865 - DNA, 16 bp, M. musculus
cctgcctctggctctg

SEQ ID NO: 389866 - DNA, 16 bp, M. musculus
cctgcctctggctctt

SEQ ID NO: 389867 - DNA, 16 bp, M. musculus
cctgcctctgtcacct

SEQ ID NO: 389868 - DNA, 16 bp, M. musculus
cctgcctctgtcctca

SEQ ID NO: 389869 - DNA, 16 bp, M. musculus
cctgcctctgtcctct

SEQ ID NO: 389870 - DNA, 16 bp, M. musculus
cctgcctctgtcttct

SEQ ID NO: 389871 - DNA, 16 bp, M. musculus
cctgcctctgtgtcct

SEQ ID NO: 389872 - DNA, 16 bp, M. musculus
cctgcctctgtgtctt

SEQ ID NO: 389873 - DNA, 16 bp, M. musculus
cctgcctctgtgttct

SEQ ID NO: 389874 - DNA, 16 bp, M. musculus
cctgcctctgtttccc

SEQ ID NO: 389875 - DNA, 16 bp, M. musculus
cctgcctcttcctctg

SEQ ID NO: 389876 - DNA, 16 bp, M. musculus
cctgcctcttgtctcc

SEQ ID NO: 389877 - DNA, 16 bp, M. musculus
cctgcctgaccagcag

SEQ ID NO: 389878 - DNA, 16 bp, M. musculus
cctgcctgaccctcca

SEQ ID NO: 389879 - DNA, 16 bp, M. musculus
cctgcctgaggcccaa

SEQ ID NO: 389880 - DNA, 16 bp, M. musculus
cctgcctgcaaaatat

SEQ ID NO: 389881 - DNA, 16 bp, M. musculus
cctgcctgcatgccac

SEQ ID NO: 389882 - DNA, 16 bp, M. musculus
cctgcctgcccacctg

SEQ ID NO: 389883 - DNA, 16 bp, M. musculus
cctgcctgcccagagc

SEQ ID NO: 389884 - DNA, 16 bp, M. musculus
cctgcctgccgccatg

SEQ ID NO: 389885 - DNA, 16 bp, M. musculus
cctgcctgcctaccta

SEQ ID NO: 389886 - DNA, 16 bp, M. musculus
cctgcctgcctacctg

SEQ ID NO: 389887 - DNA, 16 bp, M. musculus
cctgcctgcctctctg

SEQ ID NO: 389888 - DNA, 16 bp, M. musculus
cctgcctgcctctgcc

SEQ ID NO: 389889 - DNA, 16 bp, M. musculus
cctgcctgcctgcatg

SEQ ID NO: 389890 - DNA, 16 bp, M. musculus
cctgcctgcctgccag

SEQ ID NO: 389891 - DNA, 16 bp, M. musculus
cctgcctgcctgccca

SEQ ID NO: 389892 - DNA, 16 bp, M. musculus
cctgcctgcctgccta

SEQ ID NO: 389893 - DNA, 16 bp, M. musculus
cctgcctgcctgcctc

SEQ ID NO: 389894 - DNA, 16 bp, M. musculus
cctgcctgcctgcctt

SEQ ID NO: 389895 - DNA, 16 bp, M. musculus
cctgcctgcctgctcc

SEQ ID NO: 389896 - DNA, 16 bp, M. musculus
cctgcctgcctggctg

SEQ ID NO: 389897 - DNA, 16 bp, M. musculus
cctgcctgcctgtctc

SEQ ID NO: 389898 - DNA, 16 bp, M. musculus
cctgcctgcctgtgcc

SEQ ID NO: 389899 - DNA, 16 bp, M. musculus
cctgcctgcctttctg

SEQ ID NO: 389900 - DNA, 16 bp, M. musculus
cctgcctgctcttctc

SEQ ID NO: 389901 - DNA, 16 bp, M. musculus
cctgcctgctgcctgc

SEQ ID NO: 389902 - DNA, 16 bp, M. musculus
cctgcctgctgctatg

SEQ ID NO: 389903 - DNA, 16 bp, M. musculus
cctgcctgctgtcatg

SEQ ID NO: 389904 - DNA, 16 bp, M. musculus
cctgcctgcttctctc

SEQ ID NO: 389905 - DNA, 16 bp, M. musculus
cctgcctgcttctgct

SEQ ID NO: 389906 - DNA, 16 bp, M. musculus
cctgcctggacattgc

SEQ ID NO: 389907 - DNA, 16 bp, M. musculus
cctgcctggcctggaa

SEQ ID NO: 389908 - DNA, 16 bp, M. musculus
cctgcctggctacagg

SEQ ID NO: 389909 - DNA, 16 bp, M. musculus
cctgcctggctccagg

SEQ ID NO: 389910 - DNA, 16 bp, M. musculus
cctgcctggctgtcct

SEQ ID NO: 389911 - DNA, 16 bp, M. musculus
cctgcctgtatatgtt

SEQ ID NO: 389912 - DNA, 16 bp, M. musculus
cctgcctgtctctgct

SEQ ID NO: 389913 - DNA, 16 bp, M. musculus
cctgcctgtgcctccc

SEQ ID NO: 389914 - DNA, 16 bp, M. musculus
cctgcctgtgcctctg

SEQ ID NO: 389915 - DNA, 16 bp, M. musculus
cctgcctgtgctttgc

SEQ ID NO: 389916 - DNA, 16 bp, M. musculus
cctgcctgtgtctcct

SEQ ID NO: 389917 - DNA, 16 bp, M. musculus
cctgccttagctttcc

SEQ ID NO: 389918 - DNA, 16 bp, M. musculus
cctgccttcatctccc

SEQ ID NO: 389919 - DNA, 16 bp, M. musculus
cctgccttcctgcctg

SEQ ID NO: 389920 - DNA, 16 bp, M. musculus
cctgccttcctgctgg

SEQ ID NO: 389921 - DNA, 16 bp, M. musculus
cctgccttccttcagt

SEQ ID NO: 389922 - DNA, 16 bp, M. musculus
cctgccttccttcctg

SEQ ID NO: 389923 - DNA, 16 bp, M. musculus
cctgccttctgctcct

SEQ ID NO: 389924 - DNA, 16 bp, M. musculus
cctgccttgaaaacaa

SEQ ID NO: 389925 - DNA, 16 bp, M. musculus
cctgccttgcctgcct

SEQ ID NO: 389926 - DNA, 16 bp, M. musculus
cctgccttggcctcct

SEQ ID NO: 389927 - DNA, 16 bp, M. musculus
cctgccttggcttctc

SEQ ID NO: 389928 - DNA, 16 bp, M. musculus
cctgccttggcttctg

SEQ ID NO: 389929 - DNA, 16 bp, M. musculus
cctgccttggtctccc

SEQ ID NO: 389930 - DNA, 16 bp, M. musculus
cctgcctttgcctacc

SEQ ID NO: 389931 - DNA, 16 bp, M. musculus
cctgcctttgcctcct

SEQ ID NO: 389932 - DNA, 16 bp, M. musculus
cctgcctttgcctctg

SEQ ID NO: 389933 - DNA, 16 bp, M. musculus
cctgcctttgcttcct

SEQ ID NO: 389934 - DNA, 16 bp, M. musculus
cctgcctttgctttct

SEQ ID NO: 389935 - DNA, 16 bp, M. musculus
cctgcctttgtctcca

SEQ ID NO: 389936 - DNA, 16 bp, M. musculus
cctgcctttgtctccc

SEQ ID NO: 389937 - DNA, 16 bp, M. musculus
cctgcctttgtttccc

SEQ ID NO: 389938 - DNA, 16 bp, M. musculus
cctgcgatcccagcac

SEQ ID NO: 389939 - DNA, 16 bp, M. musculus
cctgctactcttcctg

SEQ ID NO: 389940 - DNA, 16 bp, M. musculus
cctgctagccttagcc

SEQ ID NO: 389941 - DNA, 16 bp, M. musculus
cctgctaggcaagcac

SEQ ID NO: 389942 - DNA, 16 bp, M. musculus
cctgctatgtcttcac

SEQ ID NO: 389943 - DNA, 16 bp, M. musculus
cctgctcaagttcctg

SEQ ID NO: 389944 - DNA, 16 bp, M. musculus
cctgctcacccaccca

SEQ ID NO: 389945 - DNA, 16 bp, M. musculus
cctgctcactcaggcc

SEQ ID NO: 389946 - DNA, 16 bp, M. musculus
cctgctcagcctgctc

SEQ ID NO: 389947 - DNA, 16 bp, M. musculus
cctgctccagctccag

SEQ ID NO: 389948 - DNA, 16 bp, M. musculus
cctgctccattgctct

SEQ ID NO: 389949 - DNA, 16 bp, M. musculus
cctgctcccagtgaca

SEQ ID NO: 389950 - DNA, 16 bp, M. musculus
cctgctccccaacaca

SEQ ID NO: 389951 - DNA, 16 bp, M. musculus
cctgctccccagccca

SEQ ID NO: 389952 - DNA, 16 bp, M. musculus
cctgctccctctggcc

SEQ ID NO: 389953 - DNA, 16 bp, M. musculus
cctgctccctgccctg

SEQ ID NO: 389954 - DNA, 16 bp, M. musculus
cctgctcccttcccca

SEQ ID NO: 389955 - DNA, 16 bp, M. musculus
cctgctcctcctgctg

SEQ ID NO: 389956 - DNA, 16 bp, M. musculus
cctgctcctctcacct

SEQ ID NO: 389957 - DNA, 16 bp, M. musculus
cctgctcctgccacca

SEQ ID NO: 389958 - DNA, 16 bp, M. musculus
cctgctcctgcccctg

SEQ ID NO: 389959 - DNA, 16 bp, M. musculus
cctgctcctgcctctg

SEQ ID NO: 389960 - DNA, 16 bp, M. musculus
cctgctcctgctcttc

SEQ ID NO: 389961 - DNA, 16 bp, M. musculus
cctgctcctgctgctg

SEQ ID NO: 389962 - DNA, 16 bp, M. musculus
cctgctcctggaaata

SEQ ID NO: 389963 - DNA, 16 bp, M. musculus
cctgctccttctcctg

SEQ ID NO: 389964 - DNA, 16 bp, M. musculus
cctgctccttgccctg

SEQ ID NO: 389965 - DNA, 16 bp, M. musculus
cctgctctacacagtg

SEQ ID NO: 389966 - DNA, 16 bp, M. musculus
cctgctctacagagtt

SEQ ID NO: 389967 - DNA, 16 bp, M. musculus
cctgctctcctgctct

SEQ ID NO: 389968 - DNA, 16 bp, M. musculus
cctgctctctctggcc

SEQ ID NO: 389969 - DNA, 16 bp, M. musculus
cctgctctctgacctg

SEQ ID NO: 389970 - DNA, 16 bp, M. musculus
cctgctctctgtactc

SEQ ID NO: 389971 - DNA, 16 bp, M. musculus
cctgctctgcctccca

SEQ ID NO: 389972 - DNA, 16 bp, M. musculus
cctgctctgcctcctg

SEQ ID NO: 389973 - DNA, 16 bp, M. musculus
cctgctctgccttctg

SEQ ID NO: 389974 - DNA, 16 bp, M. musculus
cctgctctgcttcctg

SEQ ID NO: 389975 - DNA, 16 bp, M. musculus
cctgctctggcagagc

SEQ ID NO: 389976 - DNA, 16 bp, M. musculus
cctgctctggcctcag

SEQ ID NO: 389977 - DNA, 16 bp, M. musculus
cctgctctgtcccagg

SEQ ID NO: 389978 - DNA, 16 bp, M. musculus
cctgctctgtcctctt

SEQ ID NO: 389979 - DNA, 16 bp, M. musculus
cctgctctgtctctct

SEQ ID NO: 389980 - DNA, 16 bp, M. musculus
cctgctctgtgtgagt

SEQ ID NO: 389981 - DNA, 16 bp, M. musculus
cctgctcttcaaccca

SEQ ID NO: 389982 - DNA, 16 bp, M. musculus
cctgctcttccagagg

SEQ ID NO: 389983 - DNA, 16 bp, M. musculus
cctgctcttcctcctg

SEQ ID NO: 389984 - DNA, 16 bp, M. musculus
cctgctcttctctgag

SEQ ID NO: 389985 - DNA, 16 bp, M. musculus
cctgctctttctgctt

SEQ ID NO: 389986 - DNA, 16 bp, M. musculus
cctgctgactttgggg

SEQ ID NO: 389987 - DNA, 16 bp, M. musculus
cctgctgagactagtc

SEQ ID NO: 389988 - DNA, 16 bp, M. musculus
cctgctgagaggctga

SEQ ID NO: 389989 - DNA, 16 bp, M. musculus
cctgctgagccagctt

SEQ ID NO: 389990 - DNA, 16 bp, M. musculus
cctgctgagccatctc

SEQ ID NO: 389991 - DNA, 16 bp, M. musculus
cctgctgagccatttc

SEQ ID NO: 389992 - DNA, 16 bp, M. musculus
cctgctgagtcatttc

SEQ ID NO: 389993 - DNA, 16 bp, M. musculus
cctgctgagtgctggg

SEQ ID NO: 389994 - DNA, 16 bp, M. musculus
cctgctgcaccaggaa

SEQ ID NO: 389995 - DNA, 16 bp, M. musculus
cctgctgcagcaggac

SEQ ID NO: 389996 - DNA, 16 bp, M. musculus
cctgctgcagcctccc

SEQ ID NO: 389997 - DNA, 16 bp, M. musculus
cctgctgcagcctcct

SEQ ID NO: 389998 - DNA, 16 bp, M. musculus
cctgctgcagtgggct

SEQ ID NO: 389999 - DNA, 16 bp, M. musculus
cctgctgccaaggctg

SEQ ID NO: 390000 - DNA, 16 bp, M. musculus
cctgctgccatgcctg

SEQ ID NO: 390001 - DNA, 16 bp, M. musculus
cctgctgccatgtctt

SEQ ID NO: 390002 - DNA, 16 bp, M. musculus
cctgctgcccaaccca

SEQ ID NO: 390003 - DNA, 16 bp, M. musculus
cctgctgcccacagag

SEQ ID NO: 390004 - DNA, 16 bp, M. musculus
cctgctgcctccacct

SEQ ID NO: 390005 - DNA, 16 bp, M. musculus
cctgctgcctcctgcc

SEQ ID NO: 390006 - DNA, 16 bp, M. musculus
cctgctgcctctgcct

SEQ ID NO: 390007 - DNA, 16 bp, M. musculus
cctgctgcctctgtca

SEQ ID NO: 390008 - DNA, 16 bp, M. musculus
cctgctgcctgcagat

SEQ ID NO: 390009 - DNA, 16 bp, M. musculus
cctgctgcctgctgcc

SEQ ID NO: 390010 - DNA, 16 bp, M. musculus
cctgctgcctgctgct

SEQ ID NO: 390011 - DNA, 16 bp, M. musculus
cctgctgcctgtggat

SEQ ID NO: 390012 - DNA, 16 bp, M. musculus
cctgctgcctgtggta

SEQ ID NO: 390013 - DNA, 16 bp, M. musculus
cctgctgcctttggat

SEQ ID NO: 390014 - DNA, 16 bp, M. musculus
cctgctgctcctgagg

SEQ ID NO: 390015 - DNA, 16 bp, M. musculus
cctgctgctcctgctg

SEQ ID NO: 390016 - DNA, 16 bp, M. musculus
cctgctgctcttcctg

SEQ ID NO: 390017 - DNA, 16 bp, M. musculus
cctgctgctgagcctg

SEQ ID NO: 390018 - DNA, 16 bp, M. musculus
cctgctgctgcctccc

SEQ ID NO: 390019 - DNA, 16 bp, M. musculus
cctgctgctgcctcct

SEQ ID NO: 390020 - DNA, 16 bp, M. musculus
cctgctgctgcctctg

SEQ ID NO: 390021 - DNA, 16 bp, M. musculus
cctgctgctgcctttg

SEQ ID NO: 390022 - DNA, 18 bp, M. musculus
cctgctgctgctcctgct

SEQ ID NO: 390023 - DNA, 16 bp, M. musculus
cctgctgctgctgctc

SEQ ID NO: 390024 - DNA, 16 bp, M. musculus
cctgctgctgctggtt

SEQ ID NO: 390025 - DNA, 16 bp, M. musculus
cctgctgctgcttctc

SEQ ID NO: 390026 - DNA, 16 bp, M. musculus
cctgctgctgcttttg

SEQ ID NO: 390027 - DNA, 16 bp, M. musculus
cctgctgctggctcag

SEQ ID NO: 390028 - DNA, 16 bp, M. musculus
cctgctgcttctatga

SEQ ID NO: 390029 - DNA, 16 bp, M. musculus
cctgctggacgggaca

SEQ ID NO: 390030 - DNA, 16 bp, M. musculus
cctgctggagagatgg

SEQ ID NO: 390031 - DNA, 16 bp, M. musculus
cctgctggaggtggtc

SEQ ID NO: 390032 - DNA, 16 bp, M. musculus
cctgctggagttcctg

SEQ ID NO: 390033 - DNA, 16 bp, M. musculus
cctgctggagttgggc

SEQ ID NO: 390034 - DNA, 16 bp, M. musculus
cctgctggcacaggcc

SEQ ID NO: 390035 - DNA, 16 bp, M. musculus
cctgctggccagccag

SEQ ID NO: 390036 - DNA, 16 bp, M. musculus
cctgctggccccaggc

SEQ ID NO: 390037 - DNA, 16 bp, M. musculus
cctgctggctctgctc

SEQ ID NO: 390038 - DNA, 16 bp, M. musculus
cctgctggctggaaac

SEQ ID NO: 390039 - DNA, 16 bp, M. musculus
cctgctgggaaatggg

SEQ ID NO: 390040 - DNA, 16 bp, M. musculus
cctgctgggccatctt

SEQ ID NO: 390041 - DNA, 16 bp, M. musculus
cctgctgggtctccag

SEQ ID NO: 390042 - DNA, 16 bp, M. musculus
cctgctgtccctcctg

SEQ ID NO: 390043 - DNA, 16 bp, M. musculus
cctgctgtccctgctg

SEQ ID NO: 390044 - DNA, 16 bp, M. musculus
cctgctgtgagtggat

SEQ ID NO: 390045 - DNA, 16 bp, M. musculus
cctgctgtgctgctct

SEQ ID NO: 390046 - DNA, 16 bp, M. musculus
cctgctgtgctgtgct

SEQ ID NO: 390047 - DNA, 16 bp, M. musculus
cctgctgtggtaggat

SEQ ID NO: 390048 - DNA, 16 bp, M. musculus
cctgctgtgtggcttc

SEQ ID NO: 390049 - DNA, 16 bp, M. musculus
cctgcttcaaaacaaa

SEQ ID NO: 390050 - DNA, 16 bp, M. musculus
cctgcttcacagaaaa

SEQ ID NO: 390051 - DNA, 16 bp, M. musculus
cctgcttcagcctcca

SEQ ID NO: 390052 - DNA, 16 bp, M. musculus
cctgcttcagcctccc

SEQ ID NO: 390053 - DNA, 16 bp, M. musculus
cctgcttcagcctctg

SEQ ID NO: 390054 - DNA, 16 bp, M. musculus
cctgcttcagcttccc

SEQ ID NO: 390055 - DNA, 16 bp, M. musculus
cctgcttcagcttctc

SEQ ID NO: 390056 - DNA, 16 bp, M. musculus
cctgcttcaggctgtg

SEQ ID NO: 390057 - DNA, 16 bp, M. musculus
cctgcttcagtctctt

SEQ ID NO: 390058 - DNA, 16 bp, M. musculus
cctgcttcagtttccc

SEQ ID NO: 390059 - DNA, 16 bp, M. musculus
cctgcttccacctctc

SEQ ID NO: 390060 - DNA, 16 bp, M. musculus
cctgcttccacttcct

SEQ ID NO: 390061 - DNA, 16 bp, M. musculus
cctgcttccaggccct

SEQ ID NO: 390062 - DNA, 16 bp, M. musculus
cctgcttccaggctcc

SEQ ID NO: 390063 - DNA, 16 bp, M. musculus
cctgcttcccagccct

SEQ ID NO: 390064 - DNA, 16 bp, M. musculus
cctgcttccccaccca

SEQ ID NO: 390065 - DNA, 16 bp, M. musculus
cctgcttcctctctgg

SEQ ID NO: 390066 - DNA, 18 bp, M. musculus
cctgcttcctgacctgcc

SEQ ID NO: 390067 - DNA, 16 bp, M. musculus
cctgcttcctgacctt

SEQ ID NO: 390068 - DNA, 16 bp, M. musculus
cctgcttcctggcaga

SEQ ID NO: 390069 - DNA, 16 bp, M. musculus
cctgcttcctggccct

SEQ ID NO: 390070 - DNA, 16 bp, M. musculus
cctgcttcctggttct

SEQ ID NO: 390071 - DNA, 16 bp, M. musculus
cctgcttcctgtccct

SEQ ID NO: 390072 - DNA, 16 bp, M. musculus
cctgcttcggcctccc

SEQ ID NO: 390073 - DNA, 16 bp, M. musculus
cctgcttctaccttct

SEQ ID NO: 390074 - DNA, 16 bp, M. musculus
cctgcttctccacagc

SEQ ID NO: 390075 - DNA, 16 bp, M. musculus
cctgcttctcctgcct

SEQ ID NO: 390076 - DNA, 16 bp, M. musculus
cctgcttctcctggct

SEQ ID NO: 390077 - DNA, 16 bp, M. musculus
cctgcttctctgcctc

SEQ ID NO: 390078 - DNA, 16 bp, M. musculus
cctgcttctgagctct

SEQ ID NO: 390079 - DNA, 16 bp, M. musculus
cctgcttctgcctcca

SEQ ID NO: 390080 - DNA, 16 bp, M. musculus
cctgcttctgcctcct

SEQ ID NO: 390081 - DNA, 16 bp, M. musculus
cctgcttctgcctctt

SEQ ID NO: 390082 - DNA, 16 bp, M. musculus
cctgcttctgcttcct

SEQ ID NO: 390083 - DNA, 16 bp, M. musculus
cctgcttctgtctctc

SEQ ID NO: 390084 - DNA, 16 bp, M. musculus
cctgcttctgtttctc

SEQ ID NO: 390085 - DNA, 16 bp, M. musculus
cctgcttgaaaaacaa

SEQ ID NO: 390086 - DNA, 16 bp, M. musculus
cctgcttgaaagacaa

SEQ ID NO: 390087 - DNA, 17 bp, M. musculus
cctgcttgagagctgca

SEQ ID NO: 390088 - DNA, 16 bp, M. musculus
cctgcttgagttccat

SEQ ID NO: 390089 - DNA, 16 bp, M. musculus
cctgcttgagttcctg

SEQ ID NO: 390090 - DNA, 16 bp, M. musculus
cctgcttgccctgtgg

SEQ ID NO: 390091 - DNA, 16 bp, M. musculus
cctgcttgctcggggt

SEQ ID NO: 390092 - DNA, 16 bp, M. musculus
cctgcttgctgcttac

SEQ ID NO: 390093 - DNA, 16 bp, M. musculus
cctgcttgtttccttg

SEQ ID NO: 390094 - DNA, 16 bp, M. musculus
cctgcttgtttcttgg

SEQ ID NO: 390095 - DNA, 16 bp, M. musculus
cctgcttgtttgtttg

SEQ ID NO: 390096 - DNA, 16 bp, M. musculus
cctgctttaaaaaaaa

SEQ ID NO: 390097 - DNA, 16 bp, M. musculus
cctgctttaactttgg

SEQ ID NO: 390098 - DNA, 16 bp, M. musculus
cctgctttctgacctg

SEQ ID NO: 390099 - DNA, 16 bp, M. musculus
cctgctttcttacaca

SEQ ID NO: 390100 - DNA, 16 bp, M. musculus
cctgctttcttacaga

SEQ ID NO: 390101 - DNA, 16 bp, M. musculus
cctgctttcttgtaca

SEQ ID NO: 390102 - DNA, 16 bp, M. musculus
cctgctttgacttcct

SEQ ID NO: 390103 - DNA, 16 bp, M. musculus
cctgctttggcctccc

SEQ ID NO: 390104 - DNA, 16 bp, M. musculus
cctgcttttctgtaag

SEQ ID NO: 390105 - DNA, 16 bp, M. musculus
cctggaaaacctggac

SEQ ID NO: 390106 - DNA, 16 bp, M. musculus
cctggaaaagcatgcc

SEQ ID NO: 390107 - DNA, 16 bp, M. musculus
cctggaaactctggtc

SEQ ID NO: 390108 - DNA, 16 bp, M. musculus
cctggaaactgaacaa

SEQ ID NO: 390109 - DNA, 16 bp, M. musculus
cctggaaactgccatg

SEQ ID NO: 390110 - DNA, 16 bp, M. musculus
cctggaaagaagctgt

SEQ ID NO: 390111 - DNA, 16 bp, M. musculus
cctggaacagagcaag

SEQ ID NO: 390112 - DNA, 16 bp, M. musculus
cctggaacaggagttg

SEQ ID NO: 390113 - DNA, 16 bp, M. musculus
cctggaaccagagtta

SEQ ID NO: 390114 - DNA, 16 bp, M. musculus
cctggaaccccagcac

SEQ ID NO: 390115 - DNA, 16 bp, M. musculus
cctggaaccggagtta

SEQ ID NO: 390116 - DNA, 16 bp, M. musculus
cctggaactaactcac

SEQ ID NO: 390117 - DNA, 16 bp, M. musculus
cctggaactcaatata

SEQ ID NO: 390118 - DNA, 16 bp, M. musculus
cctggaactcaatgtg

SEQ ID NO: 390119 - DNA, 16 bp, M. musculus
cctggaactcacagag

SEQ ID NO: 390120 - DNA, 16 bp, M. musculus
cctggaactcactata

SEQ ID NO: 390121 - DNA, 16 bp, M. musculus
cctggaactcactgtc

SEQ ID NO: 390122 - DNA, 16 bp, M. musculus
cctggaactcagaaat

SEQ ID NO: 390123 - DNA, 16 bp, M. musculus
cctggaactcagagac

SEQ ID NO: 390124 - DNA, 16 bp, M. musculus
cctggaactccctatg

SEQ ID NO: 390125 - DNA, 16 bp, M. musculus
cctggaactctcagag

SEQ ID NO: 390126 - DNA, 16 bp, M. musculus
cctggaactctctctg

SEQ ID NO: 390127 - DNA, 16 bp, M. musculus
cctggaactgaactta

SEQ ID NO: 390128 - DNA, 16 bp, M. musculus
cctggaactgagttac

SEQ ID NO: 390129 - DNA, 16 bp, M. musculus
cctggaactggaatta

SEQ ID NO: 390130 - DNA, 16 bp, M. musculus
cctggaactggagcta

SEQ ID NO: 390131 - DNA, 16 bp, M. musculus
cctggaactggagtca

SEQ ID NO: 390132 - DNA, 16 bp, M. musculus
cctggaactggagtgg

SEQ ID NO: 390133 - DNA, 16 bp, M. musculus
cctggaactggagtta

SEQ ID NO: 390134 - DNA, 16 bp, M. musculus
cctggaactggattta

SEQ ID NO: 390135 - DNA, 16 bp, M. musculus
cctggaactggctgtg

SEQ ID NO: 390136 - DNA, 16 bp, M. musculus
cctggaacttgccctg

SEQ ID NO: 390137 - DNA, 16 bp, M. musculus
cctggaacttgctgat

SEQ ID NO: 390138 - DNA, 16 bp, M. musculus
cctggaactttctgtg

SEQ ID NO: 390139 - DNA, 16 bp, M. musculus
cctggaagaacagcca

SEQ ID NO: 390140 - DNA, 16 bp, M. musculus
cctggaagagcagtca

SEQ ID NO: 390141 - DNA, 16 bp, M. musculus
cctggaagaggagagc

SEQ ID NO: 390142 - DNA, 16 bp, M. musculus
cctggaagcagaagct

SEQ ID NO: 390143 - DNA, 16 bp, M. musculus
cctggaagccacatgg

SEQ ID NO: 390144 - DNA, 16 bp, M. musculus
cctggaagccagcatt

SEQ ID NO: 390145 - DNA, 16 bp, M. musculus
cctggaagctgccatg

SEQ ID NO: 390146 - DNA, 16 bp, M. musculus
cctggaaggaaggaag

SEQ ID NO: 390147 - DNA, 16 bp, M. musculus
cctggaagtcagtgtt

SEQ ID NO: 390148 - DNA, 16 bp, M. musculus
cctggaagtgagtctt

SEQ ID NO: 390149 - DNA, 16 bp, M. musculus
cctggaagtgggagtg

SEQ ID NO: 390150 - DNA, 16 bp, M. musculus
cctggaagtggtgtct

SEQ ID NO: 390151 - DNA, 16 bp, M. musculus
cctggaatccatccca

SEQ ID NO: 390152 - DNA, 16 bp, M. musculus
cctggaatcccagccc

SEQ ID NO: 390153 - DNA, 16 bp, M. musculus
cctggaatgctggggg

SEQ ID NO: 390154 - DNA, 16 bp, M. musculus
cctggaattacaaatg

SEQ ID NO: 390155 - DNA, 16 bp, M. musculus
cctggaattcactgtg

SEQ ID NO: 390156 - DNA, 16 bp, M. musculus
cctggaattccctctg

SEQ ID NO: 390157 - DNA, 16 bp, M. musculus
cctggaattggagtca

SEQ ID NO: 390158 - DNA, 16 bp, M. musculus
cctggaattggagtta

SEQ ID NO: 390159 - DNA, 16 bp, M. musculus
cctggaattggagttc

SEQ ID NO: 390160 - DNA, 16 bp, M. musculus
cctggaattggagttg

SEQ ID NO: 390161 - DNA, 16 bp, M. musculus
cctggaatttgctgtg

SEQ ID NO: 390162 - DNA, 16 bp, M. musculus
cctggacaaaatggac

SEQ ID NO: 390163 - DNA, 16 bp, M. musculus
cctggacagatgttct

SEQ ID NO: 390164 - DNA, 16 bp, M. musculus
cctggacagcacagca

SEQ ID NO: 390165 - DNA, 16 bp, M. musculus
cctggacagccaggac

SEQ ID NO: 390166 - DNA, 16 bp, M. musculus
cctggacattgccatg

SEQ ID NO: 390167 - DNA, 17 bp, M. musculus
cctggaccagactccca

SEQ ID NO: 390168 - DNA, 16 bp, M. musculus
cctggaccaggctggc

SEQ ID NO: 390169 - DNA, 16 bp, M. musculus
cctggacccttgggac

SEQ ID NO: 390170 - DNA, 16 bp, M. musculus
cctggacctcaagctg

SEQ ID NO: 390171 - DNA, 16 bp, M. musculus
cctggacctctggctc

SEQ ID NO: 390172 - DNA, 16 bp, M. musculus
cctggacctgctggca

SEQ ID NO: 390173 - DNA, 16 bp, M. musculus
cctggacctggacctg

SEQ ID NO: 390174 - DNA, 16 bp, M. musculus
cctggactacacagtg

SEQ ID NO: 390175 - DNA, 16 bp, M. musculus
cctggactacagagca

SEQ ID NO: 390176 - DNA, 16 bp, M. musculus
cctggactacatgaaa

SEQ ID NO: 390177 - DNA, 16 bp, M. musculus
cctggactacatgaga

SEQ ID NO: 390178 - DNA, 16 bp, M. musculus
cctggactacatggtg

SEQ ID NO: 390179 - DNA, 16 bp, M. musculus
cctggactgaggcata

SEQ ID NO: 390180 - DNA, 20 bp, M. musculus
cctggactgggcgaagtggg

SEQ ID NO: 390181 - DNA, 16 bp, M. musculus
cctggagaaacctgcc

SEQ ID NO: 390182 - DNA, 16 bp, M. musculus
cctggagaaggagctg

SEQ ID NO: 390183 - DNA, 16 bp, M. musculus
cctggagaatcctgtg

SEQ ID NO: 390184 - DNA, 16 bp, M. musculus
cctggagaccaggctg

SEQ ID NO: 390185 - DNA, 16 bp, M. musculus
cctggagaccctgaag

SEQ ID NO: 390186 - DNA, 16 bp, M. musculus
cctggagactgttgct

SEQ ID NO: 390187 - DNA, 16 bp, M. musculus
cctggagagatggctt

SEQ ID NO: 390188 - DNA, 16 bp, M. musculus
cctggagagctgctgg

SEQ ID NO: 390189 - DNA, 16 bp, M. musculus
cctggagatgccccca

SEQ ID NO: 390190 - DNA, 16 bp, M. musculus
cctggagcaggagctg

SEQ ID NO: 390191 - DNA, 16 bp, M. musculus
cctggagccacagaca

SEQ ID NO: 390192 - DNA, 16 bp, M. musculus
cctggagccaggagct

SEQ ID NO: 390193 - DNA, 16 bp, M. musculus
cctggagccatgggtc

SEQ ID NO: 390194 - DNA, 30 bp, M. musculus
cctggagctaactcacaattgtcacttaca

SEQ ID NO: 390195 - DNA, 16 bp, M. musculus
cctggagctaagctgg

SEQ ID NO: 390196 - DNA, 16 bp, M. musculus
cctggagctagagtta

SEQ ID NO: 390197 - DNA, 20 bp, M. musculus
cctggagctcactttgtaga

SEQ ID NO: 390198 - DNA, 16 bp, M. musculus
cctggagctcatcaat

SEQ ID NO: 390199 - DNA, 16 bp, M. musculus
cctggagctcgtgtct

SEQ ID NO: 390200 - DNA, 16 bp, M. musculus
cctggagctctctgca

SEQ ID NO: 390201 - DNA, 16 bp, M. musculus
cctggagctggactta

SEQ ID NO: 390202 - DNA, 16 bp, M. musculus
cctggagctggagatg

SEQ ID NO: 390203 - DNA, 16 bp, M. musculus
cctggagctggagcta

SEQ ID NO: 390204 - DNA, 16 bp, M. musculus
cctggagctggagctg

SEQ ID NO: 390205 - DNA, 16 bp, M. musculus
cctggagctggagtca

SEQ ID NO: 390206 - DNA, 16 bp, M. musculus
cctggagctggagtga

SEQ ID NO: 390207 - DNA, 16 bp, M. musculus
cctggagctggctggc

SEQ ID NO: 390208 - DNA, 16 bp, M. musculus
cctggagctggtgtct

SEQ ID NO: 390209 - DNA, 16 bp, M. musculus
cctggaggcagagctg

SEQ ID NO: 390210 - DNA, 16 bp, M. musculus
cctggaggcagcagct

SEQ ID NO: 390211 - DNA, 16 bp, M. musculus
cctggaggccaactct

SEQ ID NO: 390212 - DNA, 16 bp, M. musculus
cctggaggccccaggg

SEQ ID NO: 390213 - DNA, 16 bp, M. musculus
cctggaggctggagag

SEQ ID NO: 390214 - DNA, 16 bp, M. musculus
cctggagtcaggaact

SEQ ID NO: 390215 - DNA, 16 bp, M. musculus
cctggagtgtgtgtga

SEQ ID NO: 390216 - DNA, 16 bp, M. musculus
cctggagttacagatg

SEQ ID NO: 390217 - DNA, 16 bp, M. musculus
cctggagtttccctgt

SEQ ID NO: 390218 - DNA, 16 bp, M. musculus
cctggatactaccatg

SEQ ID NO: 390219 - DNA, 16 bp, M. musculus
cctggatcctctacaa

SEQ ID NO: 390220 - DNA, 16 bp, M. musculus
cctggatctggagtta

SEQ ID NO: 390221 - DNA, 16 bp, M. musculus
cctggatcttatcaag

SEQ ID NO: 390222 - DNA, 16 bp, M. musculus
cctggatgacctggaa

SEQ ID NO: 390223 - DNA, 16 bp, M. musculus
cctggatgccaccatg

SEQ ID NO: 390224 - DNA, 16 bp, M. musculus
cctggatgctgccaag

SEQ ID NO: 390225 - DNA, 16 bp, M. musculus
cctggatgctgccaca

SEQ ID NO: 390226 - DNA, 16 bp, M. musculus
cctggatgtcctggac

SEQ ID NO: 390227 - DNA, 16 bp, M. musculus
cctggatgtctagagc

SEQ ID NO: 390228 - DNA, 16 bp, M. musculus
cctggatgtggagaaa

SEQ ID NO: 390229 - DNA, 16 bp, M. musculus
cctggatgtgtcagag

SEQ ID NO: 390230 - DNA, 16 bp, M. musculus
cctggatgtttggggt

SEQ ID NO: 390231 - DNA, 16 bp, M. musculus
cctggatgttttggct

SEQ ID NO: 390232 - DNA, 16 bp, M. musculus
cctggattccctggat

SEQ ID NO: 390233 - DNA, 16 bp, M. musculus
cctggatttttgtttt

SEQ ID NO: 390234 - DNA, 17 bp, M. musculus
cctggcaacagcaaggt

SEQ ID NO: 390235 - DNA, 16 bp, M. musculus
cctggcaagatggctt

SEQ ID NO: 390236 - DNA, 16 bp, M. musculus
cctggcacacagcagg

SEQ ID NO: 390237 - DNA, 16 bp, M. musculus
cctggcacacagtggg

SEQ ID NO: 390238 - DNA, 16 bp, M. musculus
cctggcacacctggca

SEQ ID NO: 390239 - DNA, 16 bp, M. musculus
cctggcacagatttct

SEQ ID NO: 390240 - DNA, 16 bp, M. musculus
cctggcacttaggagg

SEQ ID NO: 390241 - DNA, 16 bp, M. musculus
cctggcagaaaatgaa

SEQ ID NO: 390242 - DNA, 16 bp, M. musculus
cctggcagagacttga

SEQ ID NO: 390243 - DNA, 16 bp, M. musculus
cctggcagcaggcagg

SEQ ID NO: 390244 - DNA, 16 bp, M. musculus
cctggcagtggtgaca

SEQ ID NO: 390245 - DNA, 16 bp, M. musculus
cctggcatccctgctg

SEQ ID NO: 390246 - DNA, 16 bp, M. musculus
cctggcatcctggaac

SEQ ID NO: 390247 - DNA, 16 bp, M. musculus
cctggcatctggaact

SEQ ID NO: 390248 - DNA, 16 bp, M. musculus
cctggcatgaagccta

SEQ ID NO: 390249 - DNA, 16 bp, M. musculus
cctggcatggtggctc

SEQ ID NO: 390250 - DNA, 16 bp, M. musculus
cctggccaaagaagaa

SEQ ID NO: 390251 - DNA, 16 bp, M. musculus
cctggccaacaactca

SEQ ID NO: 390252 - DNA, 17 bp, M. musculus
cctggccaccccttcat

SEQ ID NO: 390253 - DNA, 16 bp, M. musculus
cctggccacctgagtt

SEQ ID NO: 390254 - DNA, 16 bp, M. musculus
cctggccagccagccc

SEQ ID NO: 390255 - DNA, 16 bp, M. musculus
cctggcccactataaa

SEQ ID NO: 390256 - DNA, 16 bp, M. musculus
cctggcccagggagtc

SEQ ID NO: 390257 - DNA, 16 bp, M. musculus
cctggcccaggtattc

SEQ ID NO: 390258 - DNA, 18 bp, M. musculus
cctggccccccatgcagt

SEQ ID NO: 390259 - DNA, 16 bp, M. musculus
cctggccctccaggca

SEQ ID NO: 390260 - DNA, 16 bp, M. musculus
cctggccctgcctcct

SEQ ID NO: 390261 - DNA, 16 bp, M. musculus
cctggccctggccctg

SEQ ID NO: 390262 - DNA, 16 bp, M. musculus
cctggcccttgttacc

SEQ ID NO: 390263 - DNA, 16 bp, M. musculus
cctggcctacagagag

SEQ ID NO: 390264 - DNA, 16 bp, M. musculus
cctggcctcaaactca

SEQ ID NO: 390265 - DNA, 16 bp, M. musculus
cctggcctccaagttc

SEQ ID NO: 390266 - DNA, 16 bp, M. musculus
cctggcctccaggttc

SEQ ID NO: 390267 - DNA, 16 bp, M. musculus
cctggcctcctggcct

SEQ ID NO: 390268 - DNA, 16 bp, M. musculus
cctggcctccttcctt

SEQ ID NO: 390269 - DNA, 16 bp, M. musculus
cctggcctctgagggc

SEQ ID NO: 390270 - DNA, 16 bp, M. musculus
cctggcctctgcctgt

SEQ ID NO: 390271 - DNA, 16 bp, M. musculus
cctggcctgatcaggg

SEQ ID NO: 390272 - DNA, 16 bp, M. musculus
cctggcctggagctcc

SEQ ID NO: 390273 - DNA, 16 bp, M. musculus
cctggcctggcctgga

SEQ ID NO: 390274 - DNA, 16 bp, M. musculus
cctggctacatagcaa

SEQ ID NO: 390275 - DNA, 16 bp, M. musculus
cctggctagccagcta

SEQ ID NO: 390276 - DNA, 16 bp, M. musculus
cctggctagcctggag

SEQ ID NO: 390277 - DNA, 16 bp, M. musculus
cctggctatcctggac

SEQ ID NO: 390278 - DNA, 16 bp, M. musculus
cctggctatgggggaa

SEQ ID NO: 390279 - DNA, 16 bp, M. musculus
cctggctcaaaaacaa

SEQ ID NO: 390280 - DNA, 16 bp, M. musculus
cctggctcagaaggcc

SEQ ID NO: 390281 - DNA, 16 bp, M. musculus
cctggctcctggaact

SEQ ID NO: 390282 - DNA, 16 bp, M. musculus
cctggctcctggctcc

SEQ ID NO: 390283 - DNA, 16 bp, M. musculus
cctggctctgcctccc

SEQ ID NO: 390284 - DNA, 16 bp, M. musculus
cctggctctgcctcct

SEQ ID NO: 390285 - DNA, 16 bp, M. musculus
cctggctctgcctctg

SEQ ID NO: 390286 - DNA, 16 bp, M. musculus
cctggctctgcttccc

SEQ ID NO: 390287 - DNA, 16 bp, M. musculus
cctggctctggctctg

SEQ ID NO: 390288 - DNA, 16 bp, M. musculus
cctggctctgtctccc

SEQ ID NO: 390289 - DNA, 16 bp, M. musculus
cctggctctgtgtgtg

SEQ ID NO: 390290 - DNA, 16 bp, M. musculus
cctggctcttgccagg

SEQ ID NO: 390291 - DNA, 16 bp, M. musculus
cctggctctttctgca

SEQ ID NO: 390292 - DNA, 16 bp, M. musculus
cctggctgaactggaa

SEQ ID NO: 390293 - DNA, 16 bp, M. musculus
cctggctgaagaagaa

SEQ ID NO: 390294 - DNA, 16 bp, M. musculus
cctggctgacctcaaa

SEQ ID NO: 390295 - DNA, 16 bp, M. musculus
cctggctgaccttgaa

SEQ ID NO: 390296 - DNA, 16 bp, M. musculus
cctggctgcccaggaa

SEQ ID NO: 390297 - DNA, 16 bp, M. musculus
cctggctgccctagaa

SEQ ID NO: 390298 - DNA, 16 bp, M. musculus
cctggctgccctggaa

SEQ ID NO: 390299 - DNA, 16 bp, M. musculus
cctggctgccctggga

SEQ ID NO: 390300 - DNA, 16 bp, M. musculus
cctggctgcctcccca

SEQ ID NO: 390301 - DNA, 16 bp, M. musculus
cctggctgccttggaa

SEQ ID NO: 390302 - DNA, 16 bp, M. musculus
cctggctgctcaggct

SEQ ID NO: 390303 - DNA, 16 bp, M. musculus
cctggctgctgccatg

SEQ ID NO: 390304 - DNA, 16 bp, M. musculus
cctggctggatgctgc

SEQ ID NO: 390305 - DNA, 16 bp, M. musculus
cctggctggcccagaa

SEQ ID NO: 390306 - DNA, 16 bp, M. musculus
cctggctggcctgaaa

SEQ ID NO: 390307 - DNA, 16 bp, M. musculus
cctggctggcctggag

SEQ ID NO: 390308 - DNA, 16 bp, M. musculus
cctggctgggatcctg

SEQ ID NO: 390309 - DNA, 16 bp, M. musculus
cctggctggtctgaaa

SEQ ID NO: 390310 - DNA, 16 bp, M. musculus
cctggctgtagcagac

SEQ ID NO: 390311 - DNA, 16 bp, M. musculus
cctggctgtccaggag

SEQ ID NO: 390312 - DNA, 16 bp, M. musculus
cctggctgtcctcact

SEQ ID NO: 390313 - DNA, 16 bp, M. musculus
cctggctgtcctctga

SEQ ID NO: 390314 - DNA, 16 bp, M. musculus
cctggctgtcctgact

SEQ ID NO: 390315 - DNA, 18 bp, M. musculus
cctggctgtcctggaatc

SEQ ID NO: 390316 - DNA, 16 bp, M. musculus
cctggctgtcctggac

SEQ ID NO: 390317 - DNA, 16 bp, M. musculus
cctggctgtcctggag

SEQ ID NO: 390318 - DNA, 16 bp, M. musculus
cctggctgtctctgtt

SEQ ID NO: 390319 - DNA, 16 bp, M. musculus
cctggctgtcttgaaa

SEQ ID NO: 390320 - DNA, 16 bp, M. musculus
cctggctgtctttgga

SEQ ID NO: 390321 - DNA, 16 bp, M. musculus
cctggctgttctggga

SEQ ID NO: 390322 - DNA, 16 bp, M. musculus
cctggctgttcttgaa

SEQ ID NO: 390323 - DNA, 16 bp, M. musculus
cctggctgttgccaag

SEQ ID NO: 390324 - DNA, 16 bp, M. musculus
cctggctgttgctagg

SEQ ID NO: 390325 - DNA, 16 bp, M. musculus
cctggctgtttctgct

SEQ ID NO: 390326 - DNA, 16 bp, M. musculus
cctggcttaacttctg

SEQ ID NO: 390327 - DNA, 16 bp, M. musculus
cctggcttccctgcag

SEQ ID NO: 390328 - DNA, 16 bp, M. musculus
cctggcttccttggtg

SEQ ID NO: 390329 - DNA, 16 bp, M. musculus
cctggcttcctttctt

SEQ ID NO: 390330 - DNA, 16 bp, M. musculus
cctggcttctccagtg

SEQ ID NO: 390331 - DNA, 16 bp, M. musculus
cctggcttctgggact

SEQ ID NO: 390332 - DNA, 16 bp, M. musculus
cctggcttctgtccat

SEQ ID NO: 390333 - DNA, 16 bp, M. musculus
cctggcttgctttctt

SEQ ID NO: 390334 - DNA, 16 bp, M. musculus
cctggcttgggcttct

SEQ ID NO: 390335 - DNA, 20 bp, M. musculus
cctggctttcgaccttgttg

SEQ ID NO: 390336 - DNA, 16 bp, M. musculus
cctgggaaaccagctc

SEQ ID NO: 390337 - DNA, 16 bp, M. musculus
cctgggaaattggagt

SEQ ID NO: 390338 - DNA, 16 bp, M. musculus
cctgggaagacagagc

SEQ ID NO: 390339 - DNA, 16 bp, M. musculus
cctgggaagatggctc

SEQ ID NO: 390340 - DNA, 16 bp, M. musculus
cctgggacaaaacaag

SEQ ID NO: 390341 - DNA, 16 bp, M. musculus
cctgggacccacatgg

SEQ ID NO: 390342 - DNA, 16 bp, M. musculus
cctgggacctctggat

SEQ ID NO: 390343 - DNA, 16 bp, M. musculus
cctgggacctggaagt

SEQ ID NO: 390344 - DNA, 16 bp, M. musculus
cctgggactcacagag

SEQ ID NO: 390345 - DNA, 16 bp, M. musculus
cctgggactgcagtta

SEQ ID NO: 390346 - DNA, 16 bp, M. musculus
cctgggactggagtta

SEQ ID NO: 390347 - DNA, 16 bp, M. musculus
cctgggactggagttg

SEQ ID NO: 390348 - DNA, 16 bp, M. musculus
cctgggagacagaggc

SEQ ID NO: 390349 - DNA, 16 bp, M. musculus
cctgggagaccaactc

SEQ ID NO: 390350 - DNA, 16 bp, M. musculus
cctgggagccctgggg

SEQ ID NO: 390351 - DNA, 16 bp, M. musculus
cctgggagcctccccc

SEQ ID NO: 390352 - DNA, 16 bp, M. musculus
cctgggagcctccctc

SEQ ID NO: 390353 - DNA, 16 bp, M. musculus
cctgggagctcctggg

SEQ ID NO: 390354 - DNA, 16 bp, M. musculus
cctgggagctctgaag

SEQ ID NO: 390355 - DNA, 16 bp, M. musculus
cctgggagctctggaa

SEQ ID NO: 390356 - DNA, 16 bp, M. musculus
cctgggagctctggtg

SEQ ID NO: 390357 - DNA, 16 bp, M. musculus
cctgggagctttggga

SEQ ID NO: 390358 - DNA, 16 bp, M. musculus
cctgggaggcagcctg

SEQ ID NO: 390359 - DNA, 16 bp, M. musculus
cctgggaggccagctc

SEQ ID NO: 390360 - DNA, 16 bp, M. musculus
cctgggagggaaagag

SEQ ID NO: 390361 - DNA, 16 bp, M. musculus
cctgggaggtgacaga

SEQ ID NO: 390362 - DNA, 16 bp, M. musculus
cctgggaggtgagaaa

SEQ ID NO: 390363 - DNA, 16 bp, M. musculus
cctgggagtcaagctt

SEQ ID NO: 390364 - DNA, 16 bp, M. musculus
cctgggagtgggaagg

SEQ ID NO: 390365 - DNA, 16 bp, M. musculus
cctgggagttgagaga

SEQ ID NO: 390366 - DNA, 16 bp, M. musculus
cctgggagttgagctt

SEQ ID NO: 390367 - DNA, 16 bp, M. musculus
cctgggagttttcagc

SEQ ID NO: 390368 - DNA, 16 bp, M. musculus
cctgggatacaggaga

SEQ ID NO: 390369 - DNA, 16 bp, M. musculus
cctgggatgatgccta

SEQ ID NO: 390370 - DNA, 16 bp, M. musculus
cctgggatgtgagaga

SEQ ID NO: 390371 - DNA, 16 bp, M. musculus
cctgggattaaaggca

SEQ ID NO: 390372 - DNA, 16 bp, M. musculus
cctgggattcctggag

SEQ ID NO: 390373 - DNA, 16 bp, M. musculus
cctgggcaatgaaaac

SEQ ID NO: 390374 - DNA, 16 bp, M. musculus
cctgggcacagagtca

SEQ ID NO: 390375 - DNA, 16 bp, M. musculus
cctgggcacttcctcc

SEQ ID NO: 390376 - DNA, 16 bp, M. musculus
cctgggcagggcagac

SEQ ID NO: 390377 - DNA, 16 bp, M. musculus
cctgggcaggtggttc

SEQ ID NO: 390378 - DNA, 16 bp, M. musculus
cctgggcatcccttcc

SEQ ID NO: 390379 - DNA, 16 bp, M. musculus
cctgggcatgctaggg

SEQ ID NO: 390380 - DNA, 16 bp, M. musculus
cctgggcatgtcacca

SEQ ID NO: 390381 - DNA, 16 bp, M. musculus
cctgggcattgtggga

SEQ ID NO: 390382 - DNA, 16 bp, M. musculus
cctgggccacacagca

SEQ ID NO: 390383 - DNA, 16 bp, M. musculus
cctgggccaggaagct

SEQ ID NO: 390384 - DNA, 16 bp, M. musculus
cctgggccaggcagtg

SEQ ID NO: 390385 - DNA, 16 bp, M. musculus
cctgggcccagcatat

SEQ ID NO: 390386 - DNA, 16 bp, M. musculus
cctgggcctgatctgg

SEQ ID NO: 390387 - DNA, 16 bp, M. musculus
cctgggctaagcatat

SEQ ID NO: 390388 - DNA, 16 bp, M. musculus
cctgggctacacagta

SEQ ID NO: 390389 - DNA, 16 bp, M. musculus
cctgggctacagcatg

SEQ ID NO: 390390 - DNA, 16 bp, M. musculus
cctgggctacatgaaa

SEQ ID NO: 390391 - DNA, 16 bp, M. musculus
cctgggctacgtgaga

SEQ ID NO: 390392 - DNA, 31 bp, M. musculus
cctgggctatgcaaagagcccagacataagt

SEQ ID NO: 390393 - DNA, 16 bp, M. musculus
cctgggctcagtcctc

SEQ ID NO: 390394 - DNA, 16 bp, M. musculus
cctgggctccatccct

SEQ ID NO: 390395 - DNA, 16 bp, M. musculus
cctgggctccatctcc

SEQ ID NO: 390396 - DNA, 16 bp, M. musculus
cctgggctcctgggct

SEQ ID NO: 390397 - DNA, 16 bp, M. musculus
cctgggctggaagtct

SEQ ID NO: 390398 - DNA, 16 bp, M. musculus
cctgggctggcagtct

SEQ ID NO: 390399 - DNA, 16 bp, M. musculus
cctgggctgggctggg

SEQ ID NO: 390400 - DNA, 17 bp, M. musculus
cctgggctggtagtctt

SEQ ID NO: 390401 - DNA, 16 bp, M. musculus
cctgggcttgctggcc

SEQ ID NO: 390402 - DNA, 16 bp, M. musculus
cctggggaagaaaggg

SEQ ID NO: 390403 - DNA, 16 bp, M. musculus
cctggggaagaagggg

SEQ ID NO: 390404 - DNA, 16 bp, M. musculus
cctggggactccagtc

SEQ ID NO: 390405 - DNA, 16 bp, M. musculus
cctggggaggcagagg

SEQ ID NO: 390406 - DNA, 16 bp, M. musculus
cctggggaggctgagg

SEQ ID NO: 390407 - DNA, 16 bp, M. musculus
cctggggaggtggagg

SEQ ID NO: 390408 - DNA, 16 bp, M. musculus
cctggggcaagggctt

SEQ ID NO: 390409 - DNA, 17 bp, M. musculus
cctggggccccaagtct

SEQ ID NO: 390410 - DNA, 16 bp, M. musculus
cctggggctaaatgtg

SEQ ID NO: 390411 - DNA, 16 bp, M. musculus
cctggggctcactggt

SEQ ID NO: 390412 - DNA, 16 bp, M. musculus
cctggggctgagaaaa

SEQ ID NO: 390413 - DNA, 16 bp, M. musculus
cctggggctggagtta

SEQ ID NO: 390414 - DNA, 16 bp, M. musculus
cctggggctggctggc

SEQ ID NO: 390415 - DNA, 16 bp, M. musculus
cctggggctggtgaga

SEQ ID NO: 390416 - DNA, 16 bp, M. musculus
cctggggcttgctgga

SEQ ID NO: 390417 - DNA, 16 bp, M. musculus
cctgggggaaaaaaaa

SEQ ID NO: 390418 - DNA, 16 bp, M. musculus
cctgggggagtcatct

SEQ ID NO: 390419 - DNA, 16 bp, M. musculus
cctgggggcaggagct

SEQ ID NO: 390420 - DNA, 16 bp, M. musculus
cctgggggcttgctgg

SEQ ID NO: 390421 - DNA, 16 bp, M. musculus
cctgggggtccaggtt

SEQ ID NO: 390422 - DNA, 16 bp, M. musculus
cctggggtctccagtc

SEQ ID NO: 390423 - DNA, 16 bp, M. musculus
cctggggttacaggtg

SEQ ID NO: 390424 - DNA, 16 bp, M. musculus
cctgggtcctatggaa

SEQ ID NO: 390425 - DNA, 16 bp, M. musculus
cctgggtcctcagaaa

SEQ ID NO: 390426 - DNA, 16 bp, M. musculus
cctgggtcctctgtaa

SEQ ID NO: 390427 - DNA, 16 bp, M. musculus
cctgggtctcctggaa

SEQ ID NO: 390428 - DNA, 16 bp, M. musculus
cctgggtctgggcctg

SEQ ID NO: 390429 - DNA, 16 bp, M. musculus
cctgggtgctgggatg

SEQ ID NO: 390430 - DNA, 16 bp, M. musculus
cctgggtgctggggtt

SEQ ID NO: 390431 - DNA, 16 bp, M. musculus
cctgggtggaagaggg

SEQ ID NO: 390432 - DNA, 16 bp, M. musculus
cctgggtggcctggaa

SEQ ID NO: 390433 - DNA, 16 bp, M. musculus
cctgggtgtgagtggg

SEQ ID NO: 390434 - DNA, 16 bp, M. musculus
cctgggtgtgctagga

SEQ ID NO: 390435 - DNA, 16 bp, M. musculus
cctgggttatatgaga

SEQ ID NO: 390436 - DNA, 16 bp, M. musculus
cctgggttcaaatcct

SEQ ID NO: 390437 - DNA, 16 bp, M. musculus
cctgggttcaaatctc

SEQ ID NO: 390438 - DNA, 16 bp, M. musculus
cctgggttcaactctc

SEQ ID NO: 390439 - DNA, 16 bp, M. musculus
cctgggttcagtccca

SEQ ID NO: 390440 - DNA, 16 bp, M. musculus
cctgggttcagtcccc

SEQ ID NO: 390441 - DNA, 16 bp, M. musculus
cctgggttccatccca

SEQ ID NO: 390442 - DNA, 16 bp, M. musculus
cctgggttccatccct

SEQ ID NO: 390443 - DNA, 16 bp, M. musculus
cctgggttccattccc

SEQ ID NO: 390444 - DNA, 16 bp, M. musculus
cctgggttcgatccct

SEQ ID NO: 390445 - DNA, 16 bp, M. musculus
cctgggttctattccc

SEQ ID NO: 390446 - DNA, 16 bp, M. musculus
cctgggttctgtccct

SEQ ID NO: 390447 - DNA, 16 bp, M. musculus
cctgggtttgatctcc

SEQ ID NO: 390448 - DNA, 16 bp, M. musculus
cctgggtttgatcttc

SEQ ID NO: 390449 - DNA, 16 bp, M. musculus
cctgggtttgcaacac

SEQ ID NO: 390450 - DNA, 16 bp, M. musculus
cctggtaacagccagg

SEQ ID NO: 390451 - DNA, 16 bp, M. musculus
cctggtacaaagctca

SEQ ID NO: 390452 - DNA, 17 bp, M. musculus
cctggtacacctgcaca

SEQ ID NO: 390453 - DNA, 16 bp, M. musculus
cctggtacccagggag

SEQ ID NO: 390454 - DNA, 16 bp, M. musculus
cctggtacccatggaa

SEQ ID NO: 390455 - DNA, 16 bp, M. musculus
cctggtacctgaagag

SEQ ID NO: 390456 - DNA, 16 bp, M. musculus
cctggtaggaaattct

SEQ ID NO: 390457 - DNA, 16 bp, M. musculus
cctggtatttttgttg

SEQ ID NO: 390458 - DNA, 16 bp, M. musculus
cctggtcactctcctg

SEQ ID NO: 390459 - DNA, 16 bp, M. musculus
cctggtcagatgttat

SEQ ID NO: 390460 - DNA, 16 bp, M. musculus
cctggtcagccatcag

SEQ ID NO: 390461 - DNA, 16 bp, M. musculus
cctggtccacagagca

SEQ ID NO: 390462 - DNA, 16 bp, M. musculus
cctggtccccatagac

SEQ ID NO: 390463 - DNA, 16 bp, M. musculus
cctggtcctctgactc

SEQ ID NO: 390464 - DNA, 16 bp, M. musculus
cctggtcctggtcctg

SEQ ID NO: 390465 - DNA, 16 bp, M. musculus
cctggtcctgtgaagg

SEQ ID NO: 390466 - DNA, 16 bp, M. musculus
cctggtctacacaggg

SEQ ID NO: 390467 - DNA, 16 bp, M. musculus
cctggtctacacagta

SEQ ID NO: 390468 - DNA, 16 bp, M. musculus
cctggtctacagcctg

SEQ ID NO: 390469 - DNA, 16 bp, M. musculus
cctggtctacagtgca

SEQ ID NO: 390470 - DNA, 16 bp, M. musculus
cctggtctacataggg

SEQ ID NO: 390471 - DNA, 16 bp, M. musculus
cctggtctggcttcag

SEQ ID NO: 390472 - DNA, 16 bp, M. musculus
cctggtctggtctcag

SEQ ID NO: 390473 - DNA, 16 bp, M. musculus
cctggtcttcaaagtg

SEQ ID NO: 390474 - DNA, 16 bp, M. musculus
cctggtcttcacagtg

SEQ ID NO: 390475 - DNA, 16 bp, M. musculus
cctggtcttcagagca

SEQ ID NO: 390476 - DNA, 16 bp, M. musculus
cctggtcttcagagtg

SEQ ID NO: 390477 - DNA, 17 bp, M. musculus
cctggtcttcgttcctc

SEQ ID NO: 390478 - DNA, 16 bp, M. musculus
cctggtgatggccatg

SEQ ID NO: 390479 - DNA, 16 bp, M. musculus
cctggtgcccagagag

SEQ ID NO: 390480 - DNA, 16 bp, M. musculus
cctggtgcccatggaa

SEQ ID NO: 390481 - DNA, 16 bp, M. musculus
cctggtgcccatggag

SEQ ID NO: 390482 - DNA, 16 bp, M. musculus
cctggtgcctgtggag

SEQ ID NO: 390483 - DNA, 16 bp, M. musculus
cctggtgctgcagtgg

SEQ ID NO: 390484 - DNA, 16 bp, M. musculus
cctggtgctgctggtg

SEQ ID NO: 390485 - DNA, 16 bp, M. musculus
cctggtgctggaatta

SEQ ID NO: 390486 - DNA, 16 bp, M. musculus
cctggtgctggagaag

SEQ ID NO: 390487 - DNA, 16 bp, M. musculus
cctggtgctggtgctg

SEQ ID NO: 390488 - DNA, 16 bp, M. musculus
cctggtggaaggagag

SEQ ID NO: 390489 - DNA, 16 bp, M. musculus
cctggtggactcagga

SEQ ID NO: 390490 - DNA, 16 bp, M. musculus
cctggtggcacaagcc

SEQ ID NO: 390491 - DNA, 16 bp, M. musculus
cctggtggcagcacag

SEQ ID NO: 390492 - DNA, 16 bp, M. musculus
cctggtgggagccatg

SEQ ID NO: 390493 - DNA, 16 bp, M. musculus
cctggtgggcatcatc

SEQ ID NO: 390494 - DNA, 16 bp, M. musculus
cctggtgtccttcatc

SEQ ID NO: 390495 - DNA, 16 bp, M. musculus
cctggtgtggatgctg

SEQ ID NO: 390496 - DNA, 16 bp, M. musculus
cctggtgtggctgttc

SEQ ID NO: 390497 - DNA, 16 bp, M. musculus
cctggttatatgttgg

SEQ ID NO: 390498 - DNA, 16 bp, M. musculus
cctggttattgttttc

SEQ ID NO: 390499 - DNA, 16 bp, M. musculus
cctggttcagttccta

SEQ ID NO: 390500 - DNA, 16 bp, M. musculus
cctggttcctagtata

SEQ ID NO: 390501 - DNA, 16 bp, M. musculus
cctggttcctgcagag

SEQ ID NO: 390502 - DNA, 16 bp, M. musculus
cctggttcctggccct

SEQ ID NO: 390503 - DNA, 16 bp, M. musculus
cctggttcctggttga

SEQ ID NO: 390504 - DNA, 16 bp, M. musculus
cctggttcttgacagt

SEQ ID NO: 390505 - DNA, 16 bp, M. musculus
cctggttggtcctcag

SEQ ID NO: 390506 - DNA, 16 bp, M. musculus
cctggttgtcttggaa

SEQ ID NO: 390507 - DNA, 16 bp, M. musculus
cctggtttatctttct

SEQ ID NO: 390508 - DNA, 16 bp, M. musculus
cctgtaaaataaaata

SEQ ID NO: 390509 - DNA, 16 bp, M. musculus
cctgtaaccccagcat

SEQ ID NO: 390510 - DNA, 16 bp, M. musculus
cctgtaaccccagctc

SEQ ID NO: 390511 - DNA, 16 bp, M. musculus
cctgtaaccccagggc

SEQ ID NO: 390512 - DNA, 16 bp, M. musculus
cctgtaaccctgtggg

SEQ ID NO: 390513 - DNA, 16 bp, M. musculus
cctgtaactccagctc

SEQ ID NO: 390514 - DNA, 16 bp, M. musculus
cctgtaactccagctg

SEQ ID NO: 390515 - DNA, 16 bp, M. musculus
cctgtaactccagttc

SEQ ID NO: 390516 - DNA, 16 bp, M. musculus
cctgtaactcctgttc

SEQ ID NO: 390517 - DNA, 16 bp, M. musculus
cctgtaactctagttc

SEQ ID NO: 390518 - DNA, 16 bp, M. musculus
cctgtaagcaggagaa

SEQ ID NO: 390519 - DNA, 16 bp, M. musculus
cctgtaagccagcctc

SEQ ID NO: 390520 - DNA, 16 bp, M. musculus
cctgtaagccagttcc

SEQ ID NO: 390521 - DNA, 16 bp, M. musculus
cctgtaagtgagcttg

SEQ ID NO: 390522 - DNA, 16 bp, M. musculus
cctgtaatcccagtac

SEQ ID NO: 390523 - DNA, 16 bp, M. musculus
cctgtaatctcagccc

SEQ ID NO: 390524 - DNA, 17 bp, M. musculus
cctgtaatgagatctga

SEQ ID NO: 390525 - DNA, 16 bp, M. musculus
cctgtaatgccagtac

SEQ ID NO: 390526 - DNA, 16 bp, M. musculus
cctgtaattctttgag

SEQ ID NO: 390527 - DNA, 16 bp, M. musculus
cctgtacacactgctg

SEQ ID NO: 390528 - DNA, 16 bp, M. musculus
cctgtagactaggctg

SEQ ID NO: 390529 - DNA, 16 bp, M. musculus
cctgtagatggcccca

SEQ ID NO: 390530 - DNA, 16 bp, M. musculus
cctgtagctcctactt

SEQ ID NO: 390531 - DNA, 16 bp, M. musculus
cctgtagctggagtta

SEQ ID NO: 390532 - DNA, 16 bp, M. musculus
cctgtagctgggcaga

SEQ ID NO: 390533 - DNA, 16 bp, M. musculus
cctgtatgagttcctg

SEQ ID NO: 390534 - DNA, 16 bp, M. musculus
cctgtatttctttctt

SEQ ID NO: 390535 - DNA, 16 bp, M. musculus
cctgtcaataaccctg

SEQ ID NO: 390536 - DNA, 16 bp, M. musculus
cctgtcacctgtcacc

SEQ ID NO: 390537 - DNA, 16 bp, M. musculus
cctgtcagaaatccaa

SEQ ID NO: 390538 - DNA, 16 bp, M. musculus
cctgtcagcaaattct

SEQ ID NO: 390539 - DNA, 16 bp, M. musculus
cctgtcaggaggagat

SEQ ID NO: 390540 - DNA, 16 bp, M. musculus
cctgtcatcccagcac

SEQ ID NO: 390541 - DNA, 16 bp, M. musculus
cctgtcatcccagcat

SEQ ID NO: 390542 - DNA, 16 bp, M. musculus
cctgtcatcctagcac

SEQ ID NO: 390543 - DNA, 16 bp, M. musculus
cctgtcattaagctga

SEQ ID NO: 390544 - DNA, 16 bp, M. musculus
cctgtcattcccctgt

SEQ ID NO: 390545 - DNA, 16 bp, M. musculus
cctgtccaaaaaaaaa

SEQ ID NO: 390546 - DNA, 16 bp, M. musculus
cctgtccaagaagttc

SEQ ID NO: 390547 - DNA, 16 bp, M. musculus
cctgtccaatcacatt

SEQ ID NO: 390548 - DNA, 16 bp, M. musculus
cctgtccagacagagc

SEQ ID NO: 390549 - DNA, 16 bp, M. musculus
cctgtccatctgtctg

SEQ ID NO: 390550 - DNA, 16 bp, M. musculus
cctgtccatcttcatc

SEQ ID NO: 390551 - DNA, 16 bp, M. musculus
cctgtcccagatgctg

SEQ ID NO: 390552 - DNA, 16 bp, M. musculus
cctgtcccagctgctc

SEQ ID NO: 390553 - DNA, 16 bp, M. musculus
cctgtcccaggtctcc

SEQ ID NO: 390554 - DNA, 16 bp, M. musculus
cctgtccccactccca

SEQ ID NO: 390555 - DNA, 16 bp, M. musculus
cctgtccccagttggt

SEQ ID NO: 390556 - DNA, 16 bp, M. musculus
cctgtccccatatctt

SEQ ID NO: 390557 - DNA, 16 bp, M. musculus
cctgtccctaggagag

SEQ ID NO: 390558 - DNA, 16 bp, M. musculus
cctgtccctccactgg

SEQ ID NO: 390559 - DNA, 16 bp, M. musculus
cctgtcctcctgtcct

SEQ ID NO: 390560 - DNA, 16 bp, M. musculus
cctgtcctctcctgtc

SEQ ID NO: 390561 - DNA, 16 bp, M. musculus
cctgtcctctggcccc

SEQ ID NO: 390562 - DNA, 16 bp, M. musculus
cctgtcctctggcctg

SEQ ID NO: 390563 - DNA, 17 bp, M. musculus
cctgtcctctggtccag

SEQ ID NO: 390564 - DNA, 16 bp, M. musculus
cctgtcctgagctttg

SEQ ID NO: 390565 - DNA, 16 bp, M. musculus
cctgtcctgccctgcc

SEQ ID NO: 390566 - DNA, 16 bp, M. musculus
cctgtcctggaactca

SEQ ID NO: 390567 - DNA, 16 bp, M. musculus
cctgtcctggaacttg

SEQ ID NO: 390568 - DNA, 16 bp, M. musculus
cctgtcctgtcctgtc

SEQ ID NO: 390569 - DNA, 16 bp, M. musculus
cctgtcgctggacctc

SEQ ID NO: 390570 - DNA, 16 bp, M. musculus
cctgtctaaaggaaaa

SEQ ID NO: 390571 - DNA, 16 bp, M. musculus
cctgtctagaaaaacc

SEQ ID NO: 390572 - DNA, 16 bp, M. musculus
cctgtctatctgtctg

SEQ ID NO: 390573 - DNA, 16 bp, M. musculus
cctgtctcaaaaaaaa

SEQ ID NO: 390574 - DNA, 16 bp, M. musculus
cctgtctcaaaaaata

SEQ ID NO: 390575 - DNA, 16 bp, M. musculus
cctgtctcaaaaaatg

SEQ ID NO: 390576 - DNA, 16 bp, M. musculus
cctgtctcaaaaatca

SEQ ID NO: 390577 - DNA, 16 bp, M. musculus
cctgtctcaaaagaaa

SEQ ID NO: 390578 - DNA, 16 bp, M. musculus
cctgtctcaaaagaag

SEQ ID NO: 390579 - DNA, 16 bp, M. musculus
cctgtctcaaaataac

SEQ ID NO: 390580 - DNA, 16 bp, M. musculus
cctgtctcaaaatcaa

SEQ ID NO: 390581 - DNA, 16 bp, M. musculus
cctgtctcaaacaaac

SEQ ID NO: 390582 - DNA, 16 bp, M. musculus
cctgtctcaaacaaca

SEQ ID NO: 390583 - DNA, 16 bp, M. musculus
cctgtctcaaagaaaa

SEQ ID NO: 390584 - DNA, 16 bp, M. musculus
cctgtctcaaatatat

SEQ ID NO: 390585 - DNA, 16 bp, M. musculus
cctgtctcaacaacaa

SEQ ID NO: 390586 - DNA, 16 bp, M. musculus
cctgtctcaagaaaaa

SEQ ID NO: 390587 - DNA, 16 bp, M. musculus
cctgtctcacacacac

SEQ ID NO: 390588 - DNA, 16 bp, M. musculus
cctgtctcagcttccc

SEQ ID NO: 390589 - DNA, 16 bp, M. musculus
cctgtctcagtttccc

SEQ ID NO: 390590 - DNA, 16 bp, M. musculus
cctgtctccaaagcaa

SEQ ID NO: 390591 - DNA, 16 bp, M. musculus
cctgtctccaccttct

SEQ ID NO: 390592 - DNA, 16 bp, M. musculus
cctgtctccaggctcc

SEQ ID NO: 390593 - DNA, 16 bp, M. musculus
cctgtctccatccccc

SEQ ID NO: 390594 - DNA, 16 bp, M. musculus
cctgtctccatcctca

SEQ ID NO: 390595 - DNA, 16 bp, M. musculus
cctgtctccccaccct

SEQ ID NO: 390596 - DNA, 16 bp, M. musculus
cctgtctccctcccag

SEQ ID NO: 390597 - DNA, 16 bp, M. musculus
cctgtctcctgagtgc

SEQ ID NO: 390598 - DNA, 16 bp, M. musculus
cctgtctcggaagaaa

SEQ ID NO: 390599 - DNA, 16 bp, M. musculus
cctgtctctaaaacaa

SEQ ID NO: 390600 - DNA, 16 bp, M. musculus
cctgtctctacctccc

SEQ ID NO: 390601 - DNA, 16 bp, M. musculus
cctgtctctctccaca

SEQ ID NO: 390602 - DNA, 16 bp, M. musculus
cctgtctctctgtttc

SEQ ID NO: 390603 - DNA, 16 bp, M. musculus
cctgtctctgcctcct

SEQ ID NO: 390604 - DNA, 16 bp, M. musculus
cctgtctctgcctgct

SEQ ID NO: 390605 - DNA, 16 bp, M. musculus
cctgtctctgcctgtc

SEQ ID NO: 390606 - DNA, 16 bp, M. musculus
cctgtctctgccttcc

SEQ ID NO: 390607 - DNA, 16 bp, M. musculus
cctgtctctgctcctc

SEQ ID NO: 390608 - DNA, 16 bp, M. musculus
cctgtctctgctggga

SEQ ID NO: 390609 - DNA, 16 bp, M. musculus
cctgtctctgcttccc

SEQ ID NO: 390610 - DNA, 16 bp, M. musculus
cctgtctctgcttcct

SEQ ID NO: 390611 - DNA, 16 bp, M. musculus
cctgtctctgcttctc

SEQ ID NO: 390612 - DNA, 16 bp, M. musculus
cctgtctctgctttcc

SEQ ID NO: 390613 - DNA, 16 bp, M. musculus
cctgtctctggctcct

SEQ ID NO: 390614 - DNA, 16 bp, M. musculus
cctgtctctgtctccc

SEQ ID NO: 390615 - DNA, 16 bp, M. musculus
cctgtctctgtctgtc

SEQ ID NO: 390616 - DNA, 16 bp, M. musculus
cctgtctgcaagccta

SEQ ID NO: 390617 - DNA, 16 bp, M. musculus
cctgtctgcctgtcta

SEQ ID NO: 390618 - DNA, 16 bp, M. musculus
cctgtctggaaaaaaa

SEQ ID NO: 390619 - DNA, 16 bp, M. musculus
cctgtctggaaacaaa

SEQ ID NO: 390620 - DNA, 16 bp, M. musculus
cctgtctgtctatctg

SEQ ID NO: 390621 - DNA, 16 bp, M. musculus
cctgtctgtctgcctg

SEQ ID NO: 390622 - DNA, 16 bp, M. musculus
cctgtctgtctgtcct

SEQ ID NO: 390623 - DNA, 16 bp, M. musculus
cctgtctgtcttggaa

SEQ ID NO: 390624 - DNA, 16 bp, M. musculus
cctgtctgtgcctccc

SEQ ID NO: 390625 - DNA, 16 bp, M. musculus
cctgtctgtgcctgtg

SEQ ID NO: 390626 - DNA, 16 bp, M. musculus
cctgtctgtttgagga

SEQ ID NO: 390627 - DNA, 16 bp, M. musculus
cctgtcttaaaaaaag

SEQ ID NO: 390628 - DNA, 16 bp, M. musculus
cctgtcttcagacaca

SEQ ID NO: 390629 - DNA, 16 bp, M. musculus
cctgtcttgaaaaact

SEQ ID NO: 390630 - DNA, 16 bp, M. musculus
cctgtcttgaaacaca

SEQ ID NO: 390631 - DNA, 16 bp, M. musculus
cctgtcttgacttcct

SEQ ID NO: 390632 - DNA, 16 bp, M. musculus
cctgtcttgagctcct

SEQ ID NO: 390633 - DNA, 16 bp, M. musculus
cctgtctttctgtctg

SEQ ID NO: 390634 - DNA, 16 bp, M. musculus
cctgtctttgccttcc

SEQ ID NO: 390635 - DNA, 16 bp, M. musculus
cctgtgaaagggctgt

SEQ ID NO: 390636 - DNA, 16 bp, M. musculus
cctgtgaactgagctg

SEQ ID NO: 390637 - DNA, 16 bp, M. musculus
cctgtgacagcaggag

SEQ ID NO: 390638 - DNA, 16 bp, M. musculus
cctgtgaccccagcac

SEQ ID NO: 390639 - DNA, 16 bp, M. musculus
cctgtgactccagctt

SEQ ID NO: 390640 - DNA, 16 bp, M. musculus
cctgtgactgtgctcc

SEQ ID NO: 390641 - DNA, 16 bp, M. musculus
cctgtgagtttgaggc

SEQ ID NO: 390642 - DNA, 18 bp, M. musculus
cctgtgatccatctaata

SEQ ID NO: 390643 - DNA, 16 bp, M. musculus
cctgtgatcccaacac

SEQ ID NO: 390644 - DNA, 16 bp, M. musculus
cctgtgatcccagccc

SEQ ID NO: 390645 - DNA, 16 bp, M. musculus
cctgtgatcccgaggt

SEQ ID NO: 390646 - DNA, 16 bp, M. musculus
cctgtgatctcagcac

SEQ ID NO: 390647 - DNA, 16 bp, M. musculus
cctgtgatctgctggc

SEQ ID NO: 390648 - DNA, 16 bp, M. musculus
cctgtgatgcctgtga

SEQ ID NO: 390649 - DNA, 16 bp, M. musculus
cctgtgcagcaagcac

SEQ ID NO: 390650 - DNA, 16 bp, M. musculus
cctgtgcagcagtata

SEQ ID NO: 390651 - DNA, 16 bp, M. musculus
cctgtgcagcctgccc

SEQ ID NO: 390652 - DNA, 16 bp, M. musculus
cctgtgcagctctcac

SEQ ID NO: 390653 - DNA, 16 bp, M. musculus
cctgtgcatgcatgtg

SEQ ID NO: 390654 - DNA, 16 bp, M. musculus
cctgtgccaaggacac

SEQ ID NO: 390655 - DNA, 16 bp, M. musculus
cctgtgccaatgagtt

SEQ ID NO: 390656 - DNA, 16 bp, M. musculus
cctgtgccagcagcag

SEQ ID NO: 390657 - DNA, 16 bp, M. musculus
cctgtgccagcaggag

SEQ ID NO: 390658 - DNA, 16 bp, M. musculus
cctgtgccctctagag

SEQ ID NO: 390659 - DNA, 16 bp, M. musculus
cctgtgcctatgtgtt

SEQ ID NO: 390660 - DNA, 16 bp, M. musculus
cctgtgctcactccaa

SEQ ID NO: 390661 - DNA, 16 bp, M. musculus
cctgtgctcatatctt

SEQ ID NO: 390662 - DNA, 16 bp, M. musculus
cctgtgctccatccaa

SEQ ID NO: 390663 - DNA, 16 bp, M. musculus
cctgtgctccatccag

SEQ ID NO: 390664 - DNA, 16 bp, M. musculus
cctgtgctctctgcct

SEQ ID NO: 390665 - DNA, 16 bp, M. musculus
cctgtgctctgaagaa

SEQ ID NO: 390666 - DNA, 16 bp, M. musculus
cctgtgctgctgctgc

SEQ ID NO: 390667 - DNA, 16 bp, M. musculus
cctgtgctgggctctg

SEQ ID NO: 390668 - DNA, 25 bp, M. musculus
cctgtgctggggtgcatataagcag

SEQ ID NO: 390669 - DNA, 16 bp, M. musculus
cctgtgctgtgctgtg

SEQ ID NO: 390670 - DNA, 16 bp, M. musculus
cctgtgcttgtgcagc

SEQ ID NO: 390671 - DNA, 16 bp, M. musculus
cctgtgctttgccctg

SEQ ID NO: 390672 - DNA, 16 bp, M. musculus
cctgtggaaaaaagac

SEQ ID NO: 390673 - DNA, 16 bp, M. musculus
cctgtggaagaacagc

SEQ ID NO: 390674 - DNA, 16 bp, M. musculus
cctgtggaagaggggg

SEQ ID NO: 390675 - DNA, 16 bp, M. musculus
cctgtggaatcctgtg

SEQ ID NO: 390676 - DNA, 19 bp, M. musculus
cctgtggacagtttggtaa

SEQ ID NO: 390677 - DNA, 16 bp, M. musculus
cctgtggagactcaat

SEQ ID NO: 390678 - DNA, 16 bp, M. musculus
cctgtggaggccagaa

SEQ ID NO: 390679 - DNA, 16 bp, M. musculus
cctgtggaggccaggg

SEQ ID NO: 390680 - DNA, 16 bp, M. musculus
cctgtggatgctggga

SEQ ID NO: 390681 - DNA, 16 bp, M. musculus
cctgtggccacactaa

SEQ ID NO: 390682 - DNA, 16 bp, M. musculus
cctgtggccaccagag

SEQ ID NO: 390683 - DNA, 16 bp, M. musculus
cctgtggccaggcagg

SEQ ID NO: 390684 - DNA, 16 bp, M. musculus
cctgtggccatgtctg

SEQ ID NO: 390685 - DNA, 16 bp, M. musculus
cctgtggcctgtggcc

SEQ ID NO: 390686 - DNA, 16 bp, M. musculus
cctgtggcttctcaca

SEQ ID NO: 390687 - DNA, 16 bp, M. musculus
cctgtgggctgggggc

SEQ ID NO: 390688 - DNA, 16 bp, M. musculus
cctgtggggcattggg

SEQ ID NO: 390689 - DNA, 16 bp, M. musculus
cctgtgggtcaccacc

SEQ ID NO: 390690 - DNA, 16 bp, M. musculus
cctgtgggtctcgacc

SEQ ID NO: 390691 - DNA, 16 bp, M. musculus
cctgtgggtgggacca

SEQ ID NO: 390692 - DNA, 16 bp, M. musculus
cctgtgggttacaacc

SEQ ID NO: 390693 - DNA, 16 bp, M. musculus
cctgtgggttgcaacc

SEQ ID NO: 390694 - DNA, 16 bp, M. musculus
cctgtggtcaggcagt

SEQ ID NO: 390695 - DNA, 16 bp, M. musculus
cctgtggtgagcttaa

SEQ ID NO: 390696 - DNA, 16 bp, M. musculus
cctgtggtgatgaaca

SEQ ID NO: 390697 - DNA, 16 bp, M. musculus
cctgtgtagctgccaa

SEQ ID NO: 390698 - DNA, 16 bp, M. musculus
cctgtgtatgggagtg

SEQ ID NO: 390699 - DNA, 16 bp, M. musculus
cctgtgtatgtgtgtg

SEQ ID NO: 390700 - DNA, 16 bp, M. musculus
cctgtgtcctcctgta

SEQ ID NO: 390701 - DNA, 16 bp, M. musculus
cctgtgtcctctccct

SEQ ID NO: 390702 - DNA, 16 bp, M. musculus
cctgtgtcctctggaa

SEQ ID NO: 390703 - DNA, 16 bp, M. musculus
cctgtgtcctggagat

SEQ ID NO: 390704 - DNA, 16 bp, M. musculus
cctgtgtctctgtgtc

SEQ ID NO: 390705 - DNA, 16 bp, M. musculus
cctgtgtctgcctccc

SEQ ID NO: 390706 - DNA, 16 bp, M. musculus
cctgtgtctgcctcct

SEQ ID NO: 390707 - DNA, 16 bp, M. musculus
cctgtgtctgccttct

SEQ ID NO: 390708 - DNA, 16 bp, M. musculus
cctgtgtctgctctgc

SEQ ID NO: 390709 - DNA, 16 bp, M. musculus
cctgtgtctgcttcaa

SEQ ID NO: 390710 - DNA, 16 bp, M. musculus
cctgtgtctgcttcag

SEQ ID NO: 390711 - DNA, 16 bp, M. musculus
cctgtgtctgtctctg

SEQ ID NO: 390712 - DNA, 16 bp, M. musculus
cctgtgtctgtctgtg

SEQ ID NO: 390713 - DNA, 16 bp, M. musculus
cctgtgtctgtgctcc

SEQ ID NO: 390714 - DNA, 16 bp, M. musculus
cctgtgtctgtgtgga

SEQ ID NO: 390715 - DNA, 16 bp, M. musculus
cctgtgtctgtttctg

SEQ ID NO: 390716 - DNA, 16 bp, M. musculus
cctgtgtcttctggaa

SEQ ID NO: 390717 - DNA, 16 bp, M. musculus
cctgtgtgcctgtgcc

SEQ ID NO: 390718 - DNA, 16 bp, M. musculus
cctgtgtgctcctggc

SEQ ID NO: 390719 - DNA, 16 bp, M. musculus
cctgtgtgctctcctg

SEQ ID NO: 390720 - DNA, 16 bp, M. musculus
cctgtgtggccactcc

SEQ ID NO: 390721 - DNA, 16 bp, M. musculus
cctgtgtgtatgtatg

SEQ ID NO: 390722 - DNA, 16 bp, M. musculus
cctgtgtgtattttgt

SEQ ID NO: 390723 - DNA, 17 bp, M. musculus
cctgtgtgtccatctgg

SEQ ID NO: 390724 - DNA, 16 bp, M. musculus
cctgtgtgtcctgtgt

SEQ ID NO: 390725 - DNA, 16 bp, M. musculus
cctgtgtgtgtgtgcg

SEQ ID NO: 390726 - DNA, 16 bp, M. musculus
cctgtgtgtgtgtgtg

SEQ ID NO: 390727 - DNA, 16 bp, M. musculus
cctgtgttcacaggtg

SEQ ID NO: 390728 - DNA, 16 bp, M. musculus
cctgtgttctcctgtg

SEQ ID NO: 390729 - DNA, 16 bp, M. musculus
cctgtgtttgcttcag

SEQ ID NO: 390730 - DNA, 16 bp, M. musculus
cctgttaccaagacaa

SEQ ID NO: 390731 - DNA, 16 bp, M. musculus
cctgttatatttgttt

SEQ ID NO: 390732 - DNA, 16 bp, M. musculus
cctgttccccaaccta

SEQ ID NO: 390733 - DNA, 16 bp, M. musculus
cctgttccctctccca

SEQ ID NO: 390734 - DNA, 16 bp, M. musculus
cctgttcctctaactg

SEQ ID NO: 390735 - DNA, 16 bp, M. musculus
cctgttcctgccacca

SEQ ID NO: 390736 - DNA, 16 bp, M. musculus
cctgttcctgccccag

SEQ ID NO: 390737 - DNA, 16 bp, M. musculus
cctgttcctgctcctc

SEQ ID NO: 390738 - DNA, 16 bp, M. musculus
cctgttcctgtccctg

SEQ ID NO: 390739 - DNA, 16 bp, M. musculus
cctgttctacaaagtg

SEQ ID NO: 390740 - DNA, 16 bp, M. musculus
cctgttgaagagcctt

SEQ ID NO: 390741 - DNA, 16 bp, M. musculus
cctgttgcctgccttg

SEQ ID NO: 390742 - DNA, 16 bp, M. musculus
cctgttggagcatctt

SEQ ID NO: 390743 - DNA, 16 bp, M. musculus
cctgttggagttcctg

SEQ ID NO: 390744 - DNA, 16 bp, M. musculus
cctgttgtccctggcc

SEQ ID NO: 390745 - DNA, 16 bp, M. musculus
cctgttgttggacctt

SEQ ID NO: 390746 - DNA, 16 bp, M. musculus
cctgtttaaaaaacaa

SEQ ID NO: 390747 - DNA, 16 bp, M. musculus
cctgtttacattcttt

SEQ ID NO: 390748 - DNA, 16 bp, M. musculus
cctgtttacctgtgtt

SEQ ID NO: 390749 - DNA, 16 bp, M. musculus
cctgtttatcagtgtt

SEQ ID NO: 390750 - DNA, 16 bp, M. musculus
cctgtttcaaaaacaa

SEQ ID NO: 390751 - DNA, 16 bp, M. musculus
cctgtttccttctggg

SEQ ID NO: 390752 - DNA, 16 bp, M. musculus
cctgtttctctgtctc

SEQ ID NO: 390753 - DNA, 16 bp, M. musculus
cctgtttctgcctcca

SEQ ID NO: 390754 - DNA, 16 bp, M. musculus
cctgtttctgcctccc

SEQ ID NO: 390755 - DNA, 16 bp, M. musculus
cctgtttctgccttct

SEQ ID NO: 390756 - DNA, 16 bp, M. musculus
cctgtttgagttcttg

SEQ ID NO: 390757 - DNA, 16 bp, M. musculus
cctgtttgatttcttg

SEQ ID NO: 390758 - DNA, 16 bp, M. musculus
cctgtttgattttgtt

SEQ ID NO: 390759 - DNA, 16 bp, M. musculus
cctgtttgcctttgaa

SEQ ID NO: 390760 - DNA, 16 bp, M. musculus
cctgtttgtcctttga

SEQ ID NO: 390761 - DNA, 16 bp, M. musculus
cctgtttgtcttcaga

SEQ ID NO: 390762 - DNA, 16 bp, M. musculus
cctgttttctttctca

SEQ ID NO: 390763 - DNA, 17 bp, M. musculus
cctgttttgtggccaat

SEQ ID NO: 390764 - DNA, 16 bp, M. musculus
cctgtttttatcttgt

SEQ ID NO: 390765 - DNA, 16 bp, M. musculus
cctgtttttcctttag

SEQ ID NO: 390766 - DNA, 17 bp, M. musculus
cctgtttttctttaatg

SEQ ID NO: 390767 - DNA, 16 bp, M. musculus
cctgtttttctttcag

SEQ ID NO: 390768 - DNA, 16 bp, M. musculus
ccttaaaaagaaagaa

SEQ ID NO: 390769 - DNA, 16 bp, M. musculus
ccttaaacagcagcag

SEQ ID NO: 390770 - DNA, 16 bp, M. musculus
ccttaaaccaaaaggc

SEQ ID NO: 390771 - DNA, 16 bp, M. musculus
ccttaaactcacagca

SEQ ID NO: 390772 - DNA, 16 bp, M. musculus
ccttaaagaaggagga

SEQ ID NO: 390773 - DNA, 16 bp, M. musculus
ccttaaagacaaaaca

SEQ ID NO: 390774 - DNA, 16 bp, M. musculus
ccttaaagagaaaaca

SEQ ID NO: 390775 - DNA, 16 bp, M. musculus
ccttaaagaggaaaaa

SEQ ID NO: 390776 - DNA, 16 bp, M. musculus
ccttaaagaggaaaca

SEQ ID NO: 390777 - DNA, 16 bp, M. musculus
ccttaaaggaaaacag

SEQ ID NO: 390778 - DNA, 16 bp, M. musculus
ccttaacaaaagaaaa

SEQ ID NO: 390779 - DNA, 16 bp, M. musculus
ccttaagtttccactt

SEQ ID NO: 390780 - DNA, 16 bp, M. musculus
ccttaagtttccattt

SEQ ID NO: 390781 - DNA, 16 bp, M. musculus
ccttaataaaattctc

SEQ ID NO: 390782 - DNA, 16 bp, M. musculus
ccttaatacagttcct

SEQ ID NO: 390783 - DNA, 16 bp, M. musculus
ccttaatacagttctt

SEQ ID NO: 390784 - DNA, 16 bp, M. musculus
ccttaatatctcttta

SEQ ID NO: 390785 - DNA, 16 bp, M. musculus
ccttaatcccagcact

SEQ ID NO: 390786 - DNA, 33 bp, M. musculus
ccttaatccctgattggctgagcaagcctgcct

SEQ ID NO: 390787 - DNA, 16 bp, M. musculus
ccttaatcctagcact

SEQ ID NO: 390788 - DNA, 16 bp, M. musculus
ccttaatgctgggatt

SEQ ID NO: 390789 - DNA, 16 bp, M. musculus
ccttaatgtctcttaa

SEQ ID NO: 390790 - DNA, 16 bp, M. musculus
ccttaatttgtatatt

SEQ ID NO: 390791 - DNA, 16 bp, M. musculus
ccttacagaagccttt

SEQ ID NO: 390792 - DNA, 16 bp, M. musculus
ccttacagaagctttt

SEQ ID NO: 390793 - DNA, 16 bp, M. musculus
ccttactatgtagccc

SEQ ID NO: 390794 - DNA, 16 bp, M. musculus
ccttacttacttcctt

SEQ ID NO: 390795 - DNA, 16 bp, M. musculus
ccttagaagcctgttt

SEQ ID NO: 390796 - DNA, 16 bp, M. musculus
ccttagacacagagaa

SEQ ID NO: 390797 - DNA, 16 bp, M. musculus
ccttagacacggcctc

SEQ ID NO: 390798 - DNA, 16 bp, M. musculus
ccttagagaggccatc

SEQ ID NO: 390799 - DNA, 16 bp, M. musculus
ccttagaggactctcc

SEQ ID NO: 390800 - DNA, 16 bp, M. musculus
ccttagcacttgggag

SEQ ID NO: 390801 - DNA, 16 bp, M. musculus
ccttagccatcagaga

SEQ ID NO: 390802 - DNA, 16 bp, M. musculus
ccttaggacaaggaga

SEQ ID NO: 390803 - DNA, 16 bp, M. musculus
ccttagggctggagag

SEQ ID NO: 390804 - DNA, 16 bp, M. musculus
ccttaggtggggctgt

SEQ ID NO: 390805 - DNA, 16 bp, M. musculus
ccttaggtttggactt

SEQ ID NO: 390806 - DNA, 16 bp, M. musculus
ccttaggttttgtttt

SEQ ID NO: 390807 - DNA, 16 bp, M. musculus
ccttagtcccagcact

SEQ ID NO: 390808 - DNA, 16 bp, M. musculus
ccttagtgggagagga

SEQ ID NO: 390809 - DNA, 16 bp, M. musculus
ccttagttgagaaaat

SEQ ID NO: 390810 - DNA, 16 bp, M. musculus
ccttatctctttccta

SEQ ID NO: 390811 - DNA, 16 bp, M. musculus
ccttatggcttgctca

SEQ ID NO: 390812 - DNA, 16 bp, M. musculus
ccttatgggacataga

SEQ ID NO: 390813 - DNA, 16 bp, M. musculus
ccttatgtgtgtgtgt

SEQ ID NO: 390814 - DNA, 35 bp, M. musculus
ccttatttataatagccagaagctggaaggaaccc

SEQ ID NO: 390815 - DNA, 16 bp, M. musculus
ccttatttggccactt

SEQ ID NO: 390816 - DNA, 16 bp, M. musculus
ccttattttcttctgt

SEQ ID NO: 390817 - DNA, 16 bp, M. musculus
ccttcaactcaaagac

SEQ ID NO: 390818 - DNA, 16 bp, M. musculus
ccttcaatcccagaac

SEQ ID NO: 390819 - DNA, 16 bp, M. musculus
ccttcaatcccagccc

SEQ ID NO: 390820 - DNA, 17 bp, M. musculus
ccttcaatctcagaacc

SEQ ID NO: 390821 - DNA, 16 bp, M. musculus
ccttcacaattgtcac

SEQ ID NO: 390822 - DNA, 16 bp, M. musculus
ccttcacagcaccaag

SEQ ID NO: 390823 - DNA, 16 bp, M. musculus
ccttcacatgtttgcc

SEQ ID NO: 390824 - DNA, 16 bp, M. musculus
ccttcacccactgagc

SEQ ID NO: 390825 - DNA, 16 bp, M. musculus
ccttcacctccttggg

SEQ ID NO: 390826 - DNA, 16 bp, M. musculus
ccttcacctctgagaa

SEQ ID NO: 390827 - DNA, 16 bp, M. musculus
ccttcagaactccaaa

SEQ ID NO: 390828 - DNA, 17 bp, M. musculus
ccttcagacacaccaga

SEQ ID NO: 390829 - DNA, 16 bp, M. musculus
ccttcagagaagatct

SEQ ID NO: 390830 - DNA, 16 bp, M. musculus
ccttcagaggtcctga

SEQ ID NO: 390831 - DNA, 16 bp, M. musculus
ccttcagatcaagatg

SEQ ID NO: 390832 - DNA, 16 bp, M. musculus
ccttcagatgaaggtg

SEQ ID NO: 390833 - DNA, 16 bp, M. musculus
ccttcagcaaatccta

SEQ ID NO: 390834 - DNA, 16 bp, M. musculus
ccttcagcctcagcct

SEQ ID NO: 390835 - DNA, 16 bp, M. musculus
ccttcagctacttcag

SEQ ID NO: 390836 - DNA, 16 bp, M. musculus
ccttcagctccctcag

SEQ ID NO: 390837 - DNA, 16 bp, M. musculus
ccttcagctcccttgg

SEQ ID NO: 390838 - DNA, 16 bp, M. musculus
ccttcagctcctcctg

SEQ ID NO: 390839 - DNA, 16 bp, M. musculus
ccttcagctcctgcag

SEQ ID NO: 390840 - DNA, 16 bp, M. musculus
ccttcagctccttgtg

SEQ ID NO: 390841 - DNA, 16 bp, M. musculus
ccttcagctgcttcag

SEQ ID NO: 390842 - DNA, 16 bp, M. musculus
ccttcagcttcctggg

SEQ ID NO: 390843 - DNA, 16 bp, M. musculus
ccttcagggcccacaa

SEQ ID NO: 390844 - DNA, 16 bp, M. musculus
ccttcaggttccttcc

SEQ ID NO: 390845 - DNA, 16 bp, M. musculus
ccttcagtaaaatctt

SEQ ID NO: 390846 - DNA, 16 bp, M. musculus
ccttcagtactgctgt

SEQ ID NO: 390847 - DNA, 16 bp, M. musculus
ccttcagtcctctctc

SEQ ID NO: 390848 - DNA, 16 bp, M. musculus
ccttcagtctctggtc

SEQ ID NO: 390849 - DNA, 16 bp, M. musculus
ccttcagtctctgttt

SEQ ID NO: 390850 - DNA, 16 bp, M. musculus
ccttcagtctttcccc

SEQ ID NO: 390851 - DNA, 16 bp, M. musculus
ccttcagtctttgctt

SEQ ID NO: 390852 - DNA, 16 bp, M. musculus
ccttcagtgtttggac

SEQ ID NO: 390853 - DNA, 16 bp, M. musculus
ccttcatagaagcagg

SEQ ID NO: 390854 - DNA, 16 bp, M. musculus
ccttcatcaaaatctt

SEQ ID NO: 390855 - DNA, 16 bp, M. musculus
ccttcatcttcaacca

SEQ ID NO: 390856 - DNA, 17 bp, M. musculus
ccttcatcttcggccag

SEQ ID NO: 390857 - DNA, 16 bp, M. musculus
ccttcatgtgattgtt

SEQ ID NO: 390858 - DNA, 16 bp, M. musculus
ccttcatgtgctccag

SEQ ID NO: 390859 - DNA, 16 bp, M. musculus
ccttcatgtgtattct

SEQ ID NO: 390860 - DNA, 16 bp, M. musculus
ccttcattggagacct

SEQ ID NO: 390861 - DNA, 16 bp, M. musculus
ccttcatttctggtgg

SEQ ID NO: 390862 - DNA, 16 bp, M. musculus
ccttccaaagagcagt

SEQ ID NO: 390863 - DNA, 16 bp, M. musculus
ccttccaagagctggg

SEQ ID NO: 390864 - DNA, 16 bp, M. musculus
ccttccaagcgctggg

SEQ ID NO: 390865 - DNA, 16 bp, M. musculus
ccttccaagtgctggg

SEQ ID NO: 390866 - DNA, 16 bp, M. musculus
ccttccaccatgtgag

SEQ ID NO: 390867 - DNA, 16 bp, M. musculus
ccttccaccgtgtggg

SEQ ID NO: 390868 - DNA, 16 bp, M. musculus
ccttccagaaccttct

SEQ ID NO: 390869 - DNA, 16 bp, M. musculus
ccttccagcatgtggg

SEQ ID NO: 390870 - DNA, 16 bp, M. musculus
ccttccagctcctccc

SEQ ID NO: 390871 - DNA, 16 bp, M. musculus
ccttccaggatcctct

SEQ ID NO: 390872 - DNA, 16 bp, M. musculus
ccttccagtcccaccc

SEQ ID NO: 390873 - DNA, 16 bp, M. musculus
ccttccatcccatgta

SEQ ID NO: 390874 - DNA, 16 bp, M. musculus
ccttccatcctgtggg

SEQ ID NO: 390875 - DNA, 16 bp, M. musculus
ccttccatctctgctt

SEQ ID NO: 390876 - DNA, 16 bp, M. musculus
ccttccatgccctctc

SEQ ID NO: 390877 - DNA, 16 bp, M. musculus
ccttccatgggtgtgt

SEQ ID NO: 390878 - DNA, 16 bp, M. musculus
ccttcccaaacagttt

SEQ ID NO: 390879 - DNA, 17 bp, M. musculus
ccttcccaaactcctgg

SEQ ID NO: 390880 - DNA, 16 bp, M. musculus
ccttcccaccctggca

SEQ ID NO: 390881 - DNA, 16 bp, M. musculus
ccttcccacctagatg

SEQ ID NO: 390882 - DNA, 16 bp, M. musculus
ccttcccactccctgg

SEQ ID NO: 390883 - DNA, 16 bp, M. musculus
ccttcccagaattcct

SEQ ID NO: 390884 - DNA, 16 bp, M. musculus
ccttcccagacagttc

SEQ ID NO: 390885 - DNA, 16 bp, M. musculus
ccttcccagagcacag

SEQ ID NO: 390886 - DNA, 16 bp, M. musculus
ccttcccagagttcct

SEQ ID NO: 390887 - DNA, 16 bp, M. musculus
ccttcccagagttctt

SEQ ID NO: 390888 - DNA, 16 bp, M. musculus
ccttcccagctcctgc

SEQ ID NO: 390889 - DNA, 16 bp, M. musculus
ccttcccagcttcctg

SEQ ID NO: 390890 - DNA, 16 bp, M. musculus
ccttcccagtccttcc

SEQ ID NO: 390891 - DNA, 16 bp, M. musculus
ccttcccagtctctcc

SEQ ID NO: 390892 - DNA, 16 bp, M. musculus
ccttccccaccatgat

SEQ ID NO: 390893 - DNA, 16 bp, M. musculus
ccttccccactgagcc

SEQ ID NO: 390894 - DNA, 16 bp, M. musculus
ccttccccagcaccat

SEQ ID NO: 390895 - DNA, 16 bp, M. musculus
ccttcccccagccctg

SEQ ID NO: 390896 - DNA, 16 bp, M. musculus
ccttcccccagctctt

SEQ ID NO: 390897 - DNA, 17 bp, M. musculus
ccttcccccaggaaaaa

SEQ ID NO: 390898 - DNA, 16 bp, M. musculus
ccttccccgtgacgtc

SEQ ID NO: 390899 - DNA, 16 bp, M. musculus
ccttcccctcagtctc

SEQ ID NO: 390900 - DNA, 16 bp, M. musculus
ccttccctcagcctga

SEQ ID NO: 390901 - DNA, 16 bp, M. musculus
ccttccctcctcttgg

SEQ ID NO: 390902 - DNA, 16 bp, M. musculus
ccttccctgacttccc

SEQ ID NO: 390903 - DNA, 16 bp, M. musculus
ccttccctgtgactgt

SEQ ID NO: 390904 - DNA, 16 bp, M. musculus
ccttcccttttatctg

SEQ ID NO: 390905 - DNA, 16 bp, M. musculus
ccttcctcagcctccc

SEQ ID NO: 390906 - DNA, 16 bp, M. musculus
ccttcctcagcctcct

SEQ ID NO: 390907 - DNA, 16 bp, M. musculus
ccttcctccaggaagc

SEQ ID NO: 390908 - DNA, 16 bp, M. musculus
ccttcctccccagctt

SEQ ID NO: 390909 - DNA, 16 bp, M. musculus
ccttcctcccttaagt

SEQ ID NO: 390910 - DNA, 16 bp, M. musculus
ccttcctcctcagcct

SEQ ID NO: 390911 - DNA, 16 bp, M. musculus
ccttcctcctgaggga

SEQ ID NO: 390912 - DNA, 16 bp, M. musculus
ccttcctctggctggc

SEQ ID NO: 390913 - DNA, 16 bp, M. musculus
ccttcctcttcccaaa

SEQ ID NO: 390914 - DNA, 16 bp, M. musculus
ccttcctgagcctcag

SEQ ID NO: 390915 - DNA, 16 bp, M. musculus
ccttcctgagttcttt

SEQ ID NO: 390916 - DNA, 16 bp, M. musculus
ccttcctgatgctgtg

SEQ ID NO: 390917 - DNA, 16 bp, M. musculus
ccttcctgcaaaggct

SEQ ID NO: 390918 - DNA, 16 bp, M. musculus
ccttcctgccctggca

SEQ ID NO: 390919 - DNA, 16 bp, M. musculus
ccttcctgcgctccag

SEQ ID NO: 390920 - DNA, 16 bp, M. musculus
ccttcctgctgtgtca

SEQ ID NO: 390921 - DNA, 16 bp, M. musculus
ccttcctgcttcctgc

SEQ ID NO: 390922 - DNA, 16 bp, M. musculus
ccttcctggaggaagc

SEQ ID NO: 390923 - DNA, 16 bp, M. musculus
ccttcctgggcatccc

SEQ ID NO: 390924 - DNA, 16 bp, M. musculus
ccttcctggtgagtgc

SEQ ID NO: 390925 - DNA, 16 bp, M. musculus
ccttcctgtctctgtc

SEQ ID NO: 390926 - DNA, 16 bp, M. musculus
ccttcctgtgctccag

SEQ ID NO: 390927 - DNA, 16 bp, M. musculus
ccttcctgtgcttcag

SEQ ID NO: 390928 - DNA, 16 bp, M. musculus
ccttccttcctatcta

SEQ ID NO: 390929 - DNA, 16 bp, M. musculus
ccttccttcctgttta

SEQ ID NO: 390930 - DNA, 16 bp, M. musculus
ccttccttgagttcct

SEQ ID NO: 390931 - DNA, 16 bp, M. musculus
ccttcctttcttaagt

SEQ ID NO: 390932 - DNA, 16 bp, M. musculus
ccttcctttttaaaga

SEQ ID NO: 390933 - DNA, 18 bp, M. musculus
ccttcgggaattgagact

SEQ ID NO: 390934 - DNA, 16 bp, M. musculus
ccttctaaaaaggatt

SEQ ID NO: 390935 - DNA, 19 bp, M. musculus
ccttctaaaatactaaaca

SEQ ID NO: 390936 - DNA, 16 bp, M. musculus
ccttctaagaaagatc

SEQ ID NO: 390937 - DNA, 16 bp, M. musculus
ccttctaagaaggact

SEQ ID NO: 390938 - DNA, 16 bp, M. musculus
ccttctaatcccagca

SEQ ID NO: 390939 - DNA, 16 bp, M. musculus
ccttctacaaaggcta

SEQ ID NO: 390940 - DNA, 16 bp, M. musculus
ccttctacctcccaag

SEQ ID NO: 390941 - DNA, 16 bp, M. musculus
ccttctagaacattct

SEQ ID NO: 390942 - DNA, 16 bp, M. musculus
ccttctattctggact

SEQ ID NO: 390943 - DNA, 16 bp, M. musculus
ccttctccaacaccat

SEQ ID NO: 390944 - DNA, 16 bp, M. musculus
ccttctccagcatcat

SEQ ID NO: 390945 - DNA, 16 bp, M. musculus
ccttctccatcaatca

SEQ ID NO: 390946 - DNA, 16 bp, M. musculus
ccttctccccactgta

SEQ ID NO: 390947 - DNA, 16 bp, M. musculus
ccttctcctagaagcc

SEQ ID NO: 390948 - DNA, 16 bp, M. musculus
ccttctcctcagcttc

SEQ ID NO: 390949 - DNA, 16 bp, M. musculus
ccttctctaagttgcc

SEQ ID NO: 390950 - DNA, 16 bp, M. musculus
ccttctctagtccctg

SEQ ID NO: 390951 - DNA, 16 bp, M. musculus
ccttctctgagaagaa

SEQ ID NO: 390952 - DNA, 16 bp, M. musculus
ccttctctgcctcctg

SEQ ID NO: 390953 - DNA, 16 bp, M. musculus
ccttctctgcttcctg

SEQ ID NO: 390954 - DNA, 16 bp, M. musculus
ccttctctggagcatc

SEQ ID NO: 390955 - DNA, 16 bp, M. musculus
ccttctctggcctctg

SEQ ID NO: 390956 - DNA, 16 bp, M. musculus
ccttctctggcttctc

SEQ ID NO: 390957 - DNA, 16 bp, M. musculus
ccttctctgggtctcc

SEQ ID NO: 390958 - DNA, 16 bp, M. musculus
ccttctcttcagcttc

SEQ ID NO: 390959 - DNA, 16 bp, M. musculus
ccttctgaaagaccca

SEQ ID NO: 390960 - DNA, 16 bp, M. musculus
ccttctgaaggtcctg

SEQ ID NO: 390961 - DNA, 16 bp, M. musculus
ccttctgaatgagatt

SEQ ID NO: 390962 - DNA, 16 bp, M. musculus
ccttctgacctccaca

SEQ ID NO: 390963 - DNA, 16 bp, M. musculus
ccttctgacctccatg

SEQ ID NO: 390964 - DNA, 16 bp, M. musculus
ccttctgagcccagca

SEQ ID NO: 390965 - DNA, 16 bp, M. musculus
ccttctgagcctcagt

SEQ ID NO: 390966 - DNA, 16 bp, M. musculus
ccttctgagtgagatt

SEQ ID NO: 390967 - DNA, 16 bp, M. musculus
ccttctgagtgctgag

SEQ ID NO: 390968 - DNA, 16 bp, M. musculus
ccttctgcaaggccag

SEQ ID NO: 390969 - DNA, 16 bp, M. musculus
ccttctgcacctgaga

SEQ ID NO: 390970 - DNA, 16 bp, M. musculus
ccttctgcatgctagg

SEQ ID NO: 390971 - DNA, 16 bp, M. musculus
ccttctgcctccatct

SEQ ID NO: 390972 - DNA, 16 bp, M. musculus
ccttctgcctcccatg

SEQ ID NO: 390973 - DNA, 16 bp, M. musculus
ccttctgcctctgtct

SEQ ID NO: 390974 - DNA, 16 bp, M. musculus
ccttctgcctctgtgt

SEQ ID NO: 390975 - DNA, 16 bp, M. musculus
ccttctgctgcctgct

SEQ ID NO: 390976 - DNA, 16 bp, M. musculus
ccttctgctggaagtc

SEQ ID NO: 390977 - DNA, 16 bp, M. musculus
ccttctgctggaggcc

SEQ ID NO: 390978 - DNA, 16 bp, M. musculus
ccttctgctggccaac

SEQ ID NO: 390979 - DNA, 16 bp, M. musculus
ccttctgcttctacct

SEQ ID NO: 390980 - DNA, 16 bp, M. musculus
ccttctgcttctattt

SEQ ID NO: 390981 - DNA, 16 bp, M. musculus
ccttctggagctgctt

SEQ ID NO: 390982 - DNA, 16 bp, M. musculus
ccttctggcccagaat

SEQ ID NO: 390983 - DNA, 16 bp, M. musculus
ccttctggcttctgtg

SEQ ID NO: 390984 - DNA, 16 bp, M. musculus
ccttctgggcagccct

SEQ ID NO: 390985 - DNA, 16 bp, M. musculus
ccttctgtcccttgca

SEQ ID NO: 390986 - DNA, 16 bp, M. musculus
ccttctgtcctaagag

SEQ ID NO: 390987 - DNA, 16 bp, M. musculus
ccttctgtcctctgtg

SEQ ID NO: 390988 - DNA, 16 bp, M. musculus
ccttctgtctgtctgt

SEQ ID NO: 390989 - DNA, 16 bp, M. musculus
ccttctgttttcatgt

SEQ ID NO: 390990 - DNA, 16 bp, M. musculus
ccttcttaaagtcttc

SEQ ID NO: 390991 - DNA, 16 bp, M. musculus
ccttcttaccgtttgg

SEQ ID NO: 390992 - DNA, 16 bp, M. musculus
ccttcttagaatgggt

SEQ ID NO: 390993 - DNA, 16 bp, M. musculus
ccttcttcatgagctt

SEQ ID NO: 390994 - DNA, 16 bp, M. musculus
ccttcttccaaagtcc

SEQ ID NO: 390995 - DNA, 16 bp, M. musculus
ccttcttccaatgccc

SEQ ID NO: 390996 - DNA, 16 bp, M. musculus
ccttcttctggcctct

SEQ ID NO: 390997 - DNA, 16 bp, M. musculus
ccttcttctggcttct

SEQ ID NO: 390998 - DNA, 16 bp, M. musculus
ccttcttcttgaattt

SEQ ID NO: 390999 - DNA, 16 bp, M. musculus
ccttcttcttgatctt

SEQ ID NO: 391000 - DNA, 16 bp, M. musculus
ccttcttgagatcttt

SEQ ID NO: 391001 - DNA, 16 bp, M. musculus
ccttcttggcacaatt

SEQ ID NO: 391002 - DNA, 16 bp, M. musculus
ccttcttgtatgttca

SEQ ID NO: 391003 - DNA, 16 bp, M. musculus
ccttctttgtcttaca

SEQ ID NO: 391004 - DNA, 16 bp, M. musculus
ccttgaaactgaagtc

SEQ ID NO: 391005 - DNA, 16 bp, M. musculus
ccttgaaataatgcct

SEQ ID NO: 391006 - DNA, 16 bp, M. musculus
ccttgaaatcattggc

SEQ ID NO: 391007 - DNA, 16 bp, M. musculus
ccttgaacacagagat

SEQ ID NO: 391008 - DNA, 16 bp, M. musculus
ccttgaactcactcta

SEQ ID NO: 391009 - DNA, 16 bp, M. musculus
ccttgaactcagaaat

SEQ ID NO: 391010 - DNA, 16 bp, M. musculus
ccttgaactcagagaa

SEQ ID NO: 391011 - DNA, 16 bp, M. musculus
ccttgaactcagagac

SEQ ID NO: 391012 - DNA, 16 bp, M. musculus
ccttgaactcagagat

SEQ ID NO: 391013 - DNA, 16 bp, M. musculus
ccttgaactcccagtc

SEQ ID NO: 391014 - DNA, 16 bp, M. musculus
ccttgaactcctgacc

SEQ ID NO: 391015 - DNA, 16 bp, M. musculus
ccttgaactcctgagc

SEQ ID NO: 391016 - DNA, 16 bp, M. musculus
ccttgaactccttatc

SEQ ID NO: 391017 - DNA, 16 bp, M. musculus
ccttgaactcgtgatc

SEQ ID NO: 391018 - DNA, 16 bp, M. musculus
ccttgaacttctcatc

SEQ ID NO: 391019 - DNA, 16 bp, M. musculus
ccttgaacttctgacc

SEQ ID NO: 391020 - DNA, 16 bp, M. musculus
ccttgaacttctgatc

SEQ ID NO: 391021 - DNA, 16 bp, M. musculus
ccttgaacttgctgtg

SEQ ID NO: 391022 - DNA, 16 bp, M. musculus
ccttgaacttgtgagc

SEQ ID NO: 391023 - DNA, 16 bp, M. musculus
ccttgaactttctgtg

SEQ ID NO: 391024 - DNA, 16 bp, M. musculus
ccttgaagaggcctgg

SEQ ID NO: 391025 - DNA, 16 bp, M. musculus
ccttgaagtcctgatc

SEQ ID NO: 391026 - DNA, 16 bp, M. musculus
ccttgaatgcctgatc

SEQ ID NO: 391027 - DNA, 16 bp, M. musculus
ccttgaccactaattg

SEQ ID NO: 391028 - DNA, 16 bp, M. musculus
ccttgacctctctggc

SEQ ID NO: 391029 - DNA, 16 bp, M. musculus
ccttgactgattcctt

SEQ ID NO: 391030 - DNA, 16 bp, M. musculus
ccttgactggcctgga

SEQ ID NO: 391031 - DNA, 16 bp, M. musculus
ccttgacttcctgatc

SEQ ID NO: 391032 - DNA, 16 bp, M. musculus
ccttgagaagaatttt

SEQ ID NO: 391033 - DNA, 16 bp, M. musculus
ccttgagatgaagatg

SEQ ID NO: 391034 - DNA, 16 bp, M. musculus
ccttgagcctcagttt

SEQ ID NO: 391035 - DNA, 16 bp, M. musculus
ccttgagctgaccctg

SEQ ID NO: 391036 - DNA, 16 bp, M. musculus
ccttgagctgccagag

SEQ ID NO: 391037 - DNA, 16 bp, M. musculus
ccttgagcttgtgatc

SEQ ID NO: 391038 - DNA, 16 bp, M. musculus
ccttgaggaagctggg

SEQ ID NO: 391039 - DNA, 16 bp, M. musculus
ccttgaggctctcaga

SEQ ID NO: 391040 - DNA, 16 bp, M. musculus
ccttgagttgtggttt

SEQ ID NO: 391041 - DNA, 16 bp, M. musculus
ccttgatagaggaagt

SEQ ID NO: 391042 - DNA, 16 bp, M. musculus
ccttgatcatggtgtc

SEQ ID NO: 391043 - DNA, 16 bp, M. musculus
ccttgatgatcagaga

SEQ ID NO: 391044 - DNA, 16 bp, M. musculus
ccttgatgatgatgga

SEQ ID NO: 391045 - DNA, 16 bp, M. musculus
ccttgatggagcagag

SEQ ID NO: 391046 - DNA, 16 bp, M. musculus
ccttgatggcctctgc

SEQ ID NO: 391047 - DNA, 16 bp, M. musculus
ccttgatgtaaaaaca

SEQ ID NO: 391048 - DNA, 16 bp, M. musculus
ccttgatttcctggat

SEQ ID NO: 391049 - DNA, 16 bp, M. musculus
ccttgcaactggagtt

SEQ ID NO: 391050 - DNA, 16 bp, M. musculus
ccttgcacattgctga

SEQ ID NO: 391051 - DNA, 16 bp, M. musculus
ccttgcagaagacctg

SEQ ID NO: 391052 - DNA, 16 bp, M. musculus
ccttgcagagttcttc

SEQ ID NO: 391053 - DNA, 16 bp, M. musculus
ccttgcatactttaaa

SEQ ID NO: 391054 - DNA, 16 bp, M. musculus
ccttgcatccctggaa

SEQ ID NO: 391055 - DNA, 16 bp, M. musculus
ccttgcattcctggaa

SEQ ID NO: 391056 - DNA, 17 bp, M. musculus
ccttgccacacttagag

SEQ ID NO: 391057 - DNA, 16 bp, M. musculus
ccttgccacctcattc

SEQ ID NO: 391058 - DNA, 16 bp, M. musculus
ccttgccagcatctga

SEQ ID NO: 391059 - DNA, 16 bp, M. musculus
ccttgccagcctctgc

SEQ ID NO: 391060 - DNA, 16 bp, M. musculus
ccttgccatcagtttg

SEQ ID NO: 391061 - DNA, 16 bp, M. musculus
ccttgcccacctgaat

SEQ ID NO: 391062 - DNA, 16 bp, M. musculus
ccttgcccacctgagt

SEQ ID NO: 391063 - DNA, 16 bp, M. musculus
ccttgcccagtcctgg

SEQ ID NO: 391064 - DNA, 16 bp, M. musculus
ccttgcccttgccctt

SEQ ID NO: 391065 - DNA, 16 bp, M. musculus
ccttgccctttacagt

SEQ ID NO: 391066 - DNA, 16 bp, M. musculus
ccttgcctcaaaacaa

SEQ ID NO: 391067 - DNA, 16 bp, M. musculus
ccttgcctcaaaagaa

SEQ ID NO: 391068 - DNA, 16 bp, M. musculus
ccttgcctcaaacaaa

SEQ ID NO: 391069 - DNA, 16 bp, M. musculus
ccttgcctctgcctct

SEQ ID NO: 391070 - DNA, 16 bp, M. musculus
ccttgcctcttgccat

SEQ ID NO: 391071 - DNA, 16 bp, M. musculus
ccttgcctgcggagtc

SEQ ID NO: 391072 - DNA, 16 bp, M. musculus
ccttgcctggcctgga

SEQ ID NO: 391073 - DNA, 16 bp, M. musculus
ccttgccttgcctttc

SEQ ID NO: 391074 - DNA, 16 bp, M. musculus
ccttgctagcacatcc

SEQ ID NO: 391075 - DNA, 16 bp, M. musculus
ccttgctcagccatca

SEQ ID NO: 391076 - DNA, 16 bp, M. musculus
ccttgctcagctcatg

SEQ ID NO: 391077 - DNA, 16 bp, M. musculus
ccttgctccagttgtt

SEQ ID NO: 391078 - DNA, 16 bp, M. musculus
ccttgctctcttgctc

SEQ ID NO: 391079 - DNA, 16 bp, M. musculus
ccttgctctcttttaa

SEQ ID NO: 391080 - DNA, 16 bp, M. musculus
ccttgctgaaggaagt

SEQ ID NO: 391081 - DNA, 16 bp, M. musculus
ccttgctggagaaagt

SEQ ID NO: 391082 - DNA, 16 bp, M. musculus
ccttgctggagaaggt

SEQ ID NO: 391083 - DNA, 16 bp, M. musculus
ccttgctggaggaagt

SEQ ID NO: 391084 - DNA, 16 bp, M. musculus
ccttgctggcctggaa

SEQ ID NO: 391085 - DNA, 16 bp, M. musculus
ccttgctggctgcagc

SEQ ID NO: 391086 - DNA, 16 bp, M. musculus
ccttgcttcctgcctt

SEQ ID NO: 391087 - DNA, 16 bp, M. musculus
ccttgctttttggctt

SEQ ID NO: 391088 - DNA, 16 bp, M. musculus
ccttggaactagagtt

SEQ ID NO: 391089 - DNA, 16 bp, M. musculus
ccttggaagtcagaag

SEQ ID NO: 391090 - DNA, 16 bp, M. musculus
ccttggacctggagtt

SEQ ID NO: 391091 - DNA, 16 bp, M. musculus
ccttggactcacagag

SEQ ID NO: 391092 - DNA, 16 bp, M. musculus
ccttggagaagctttg

SEQ ID NO: 391093 - DNA, 16 bp, M. musculus
ccttggagcctctcct

SEQ ID NO: 391094 - DNA, 16 bp, M. musculus
ccttggagctcactgg

SEQ ID NO: 391095 - DNA, 16 bp, M. musculus
ccttggaggaatgctg

SEQ ID NO: 391096 - DNA, 16 bp, M. musculus
ccttggaggacagaag

SEQ ID NO: 391097 - DNA, 16 bp, M. musculus
ccttggagtcctggga

SEQ ID NO: 391098 - DNA, 16 bp, M. musculus
ccttggatactttatc

SEQ ID NO: 391099 - DNA, 16 bp, M. musculus
ccttggatcagggagt

SEQ ID NO: 391100 - DNA, 16 bp, M. musculus
ccttggatctgaccta

SEQ ID NO: 391101 - DNA, 16 bp, M. musculus
ccttggcagagaggac

SEQ ID NO: 391102 - DNA, 16 bp, M. musculus
ccttggcatgggcctg

SEQ ID NO: 391103 - DNA, 16 bp, M. musculus
ccttggccaagttatc

SEQ ID NO: 391104 - DNA, 16 bp, M. musculus
ccttggccatcctgga

SEQ ID NO: 391105 - DNA, 16 bp, M. musculus
ccttggcctctgcctc

SEQ ID NO: 391106 - DNA, 16 bp, M. musculus
ccttggccttggcctt

SEQ ID NO: 391107 - DNA, 16 bp, M. musculus
ccttggctctctctgg

SEQ ID NO: 391108 - DNA, 16 bp, M. musculus
ccttggctggcctcag

SEQ ID NO: 391109 - DNA, 16 bp, M. musculus
ccttggctggcctgga

SEQ ID NO: 391110 - DNA, 16 bp, M. musculus
ccttggctggcttgga

SEQ ID NO: 391111 - DNA, 16 bp, M. musculus
ccttgggaactttctc

SEQ ID NO: 391112 - DNA, 16 bp, M. musculus
ccttgggaagagcagc

SEQ ID NO: 391113 - DNA, 16 bp, M. musculus
ccttgggaccagtgaa

SEQ ID NO: 391114 - DNA, 16 bp, M. musculus
ccttgggcaagtcact

SEQ ID NO: 391115 - DNA, 16 bp, M. musculus
ccttgggcatttcaaa

SEQ ID NO: 391116 - DNA, 16 bp, M. musculus
ccttgggcatttcaga

SEQ ID NO: 391117 - DNA, 16 bp, M. musculus
ccttgggcctgtgaag

SEQ ID NO: 391118 - DNA, 16 bp, M. musculus
ccttgggcctttaata

SEQ ID NO: 391119 - DNA, 16 bp, M. musculus
ccttgggctgagcata

SEQ ID NO: 391120 - DNA, 16 bp, M. musculus
ccttggggcaagtcca

SEQ ID NO: 391121 - DNA, 16 bp, M. musculus
ccttggggccagctct

SEQ ID NO: 391122 - DNA, 16 bp, M. musculus
ccttggggggaaaaaa

SEQ ID NO: 391123 - DNA, 16 bp, M. musculus
ccttgggtacttctct

SEQ ID NO: 391124 - DNA, 16 bp, M. musculus
ccttgggtgttttctc

SEQ ID NO: 391125 - DNA, 16 bp, M. musculus
ccttgggttccatccc

SEQ ID NO: 391126 - DNA, 16 bp, M. musculus
ccttggtcctctgaag

SEQ ID NO: 391127 - DNA, 16 bp, M. musculus
ccttggtcctggggag

SEQ ID NO: 391128 - DNA, 16 bp, M. musculus
ccttggtcctgtgaag

SEQ ID NO: 391129 - DNA, 16 bp, M. musculus
ccttggtcctgtggag

SEQ ID NO: 391130 - DNA, 16 bp, M. musculus
ccttggtcttgcaaag

SEQ ID NO: 391131 - DNA, 16 bp, M. musculus
ccttggtgctctcaga

SEQ ID NO: 391132 - DNA, 16 bp, M. musculus
ccttggttatcctgga

SEQ ID NO: 391133 - DNA, 16 bp, M. musculus
ccttggttccgagacc

SEQ ID NO: 391134 - DNA, 16 bp, M. musculus
ccttggttctatggag

SEQ ID NO: 391135 - DNA, 16 bp, M. musculus
ccttgtactatggagc

SEQ ID NO: 391136 - DNA, 16 bp, M. musculus
ccttgtatgctctttg

SEQ ID NO: 391137 - DNA, 16 bp, M. musculus
ccttgtatttggagaa

SEQ ID NO: 391138 - DNA, 16 bp, M. musculus
ccttgtcaaaatcaag

SEQ ID NO: 391139 - DNA, 16 bp, M. musculus
ccttgtcaaagaccaa

SEQ ID NO: 391140 - DNA, 16 bp, M. musculus
ccttgtcaaagatcga

SEQ ID NO: 391141 - DNA, 16 bp, M. musculus
ccttgtcagacatcaa

SEQ ID NO: 391142 - DNA, 16 bp, M. musculus
ccttgtcctgtccctg

SEQ ID NO: 391143 - DNA, 16 bp, M. musculus
ccttgtctactccctg

SEQ ID NO: 391144 - DNA, 17 bp, M. musculus
ccttgtctattccctga

SEQ ID NO: 391145 - DNA, 16 bp, M. musculus
ccttgtctcaaaaaag

SEQ ID NO: 391146 - DNA, 16 bp, M. musculus
ccttgtctcaaaagaa

SEQ ID NO: 391147 - DNA, 16 bp, M. musculus
ccttgtctcgaaaaac

SEQ ID NO: 391148 - DNA, 16 bp, M. musculus
ccttgtctgcctgcat

SEQ ID NO: 391149 - DNA, 16 bp, M. musculus
ccttgtcttaaaataa

SEQ ID NO: 391150 - DNA, 16 bp, M. musculus
ccttgtcttcctgctg

SEQ ID NO: 391151 - DNA, 16 bp, M. musculus
ccttgtgcccatgtgt

SEQ ID NO: 391152 - DNA, 16 bp, M. musculus
ccttgtgctctggctg

SEQ ID NO: 391153 - DNA, 16 bp, M. musculus
ccttgtgggtgctgag

SEQ ID NO: 391154 - DNA, 16 bp, M. musculus
ccttgtggttctcctc

SEQ ID NO: 391155 - DNA, 16 bp, M. musculus
ccttgtgtcaaaaaaa

SEQ ID NO: 391156 - DNA, 16 bp, M. musculus
ccttgtgttgtagtga

SEQ ID NO: 391157 - DNA, 16 bp, M. musculus
ccttgttagaggaggt

SEQ ID NO: 391158 - DNA, 16 bp, M. musculus
ccttgttatttgactt

SEQ ID NO: 391159 - DNA, 16 bp, M. musculus
ccttgttcagctgtat

SEQ ID NO: 391160 - DNA, 16 bp, M. musculus
ccttgttggaaaaagt

SEQ ID NO: 391161 - DNA, 16 bp, M. musculus
ccttgttggaagaagt

SEQ ID NO: 391162 - DNA, 16 bp, M. musculus
ccttgttggagtgtgt

SEQ ID NO: 391163 - DNA, 16 bp, M. musculus
ccttgttgggcatcaa

SEQ ID NO: 391164 - DNA, 16 bp, M. musculus
ccttgttggggtaggt

SEQ ID NO: 391165 - DNA, 16 bp, M. musculus
ccttgtttccctccca

SEQ ID NO: 391166 - DNA, 16 bp, M. musculus
ccttgttttttgagac

SEQ ID NO: 391167 - DNA, 16 bp, M. musculus
cctttaaaacaaaaca

SEQ ID NO: 391168 - DNA, 16 bp, M. musculus
cctttaaaataattgg

SEQ ID NO: 391169 - DNA, 16 bp, M. musculus
cctttaaaatagtcac

SEQ ID NO: 391170 - DNA, 16 bp, M. musculus
cctttaaagaggacat

SEQ ID NO: 391171 - DNA, 17 bp, M. musculus
cctttaaaggcatcaaa

SEQ ID NO: 391172 - DNA, 17 bp, M. musculus
cctttaaataatgctct

SEQ ID NO: 391173 - DNA, 16 bp, M. musculus
cctttaaccacagcac

SEQ ID NO: 391174 - DNA, 16 bp, M. musculus
cctttaagaaaaaaaa

SEQ ID NO: 391175 - DNA, 16 bp, M. musculus
cctttaagttgggagt

SEQ ID NO: 391176 - DNA, 16 bp, M. musculus
cctttaatcccaccac

SEQ ID NO: 391177 - DNA, 17 bp, M. musculus
cctttaatcccagatga

SEQ ID NO: 391178 - DNA, 16 bp, M. musculus
cctttaatcccagcag

SEQ ID NO: 391179 - DNA, 16 bp, M. musculus
cctttaatcccagcgt

SEQ ID NO: 391180 - DNA, 16 bp, M. musculus
cctttaatcccaggca

SEQ ID NO: 391181 - DNA, 16 bp, M. musculus
cctttaatcccatgag

SEQ ID NO: 391182 - DNA, 16 bp, M. musculus
cctttaatcctaccac

SEQ ID NO: 391183 - DNA, 16 bp, M. musculus
cctttaattccagcag

SEQ ID NO: 391184 - DNA, 16 bp, M. musculus
cctttaattccagccc

SEQ ID NO: 391185 - DNA, 16 bp, M. musculus
cctttaattccagtgc

SEQ ID NO: 391186 - DNA, 16 bp, M. musculus
cctttaattctagcac

SEQ ID NO: 391187 - DNA, 16 bp, M. musculus
cctttacaagagcagc

SEQ ID NO: 391188 - DNA, 16 bp, M. musculus
cctttacccaatgagc

SEQ ID NO: 391189 - DNA, 16 bp, M. musculus
cctttacccactgagc

SEQ ID NO: 391190 - DNA, 16 bp, M. musculus
cctttaccccagcaca

SEQ ID NO: 391191 - DNA, 16 bp, M. musculus
cctttacctctatgag

SEQ ID NO: 391192 - DNA, 16 bp, M. musculus
cctttacctgcagagc

SEQ ID NO: 391193 - DNA, 16 bp, M. musculus
cctttacctgctgagc

SEQ ID NO: 391194 - DNA, 16 bp, M. musculus
cctttacctgtttgat

SEQ ID NO: 391195 - DNA, 16 bp, M. musculus
cctttagaagagcagc

SEQ ID NO: 391196 - DNA, 16 bp, M. musculus
cctttagcatttggac

SEQ ID NO: 391197 - DNA, 16 bp, M. musculus
cctttagctcctcggg

SEQ ID NO: 391198 - DNA, 16 bp, M. musculus
cctttagtcccagaac

SEQ ID NO: 391199 - DNA, 16 bp, M. musculus
cctttagttccagaac

SEQ ID NO: 391200 - DNA, 16 bp, M. musculus
cctttagttctagagt

SEQ ID NO: 391201 - DNA, 16 bp, M. musculus
cctttataagagttgc

SEQ ID NO: 391202 - DNA, 16 bp, M. musculus
cctttataatcctgat

SEQ ID NO: 391203 - DNA, 23 bp, M. musculus
cctttatatgttacttgaccttt

SEQ ID NO: 391204 - DNA, 16 bp, M. musculus
cctttatgaatatcaa

SEQ ID NO: 391205 - DNA, 16 bp, M. musculus
cctttattttttgcaa

SEQ ID NO: 391206 - DNA, 16 bp, M. musculus
cctttcaccctctatt

SEQ ID NO: 391207 - DNA, 16 bp, M. musculus
cctttcactgtgataa

SEQ ID NO: 391208 - DNA, 16 bp, M. musculus
cctttcagaggagaag

SEQ ID NO: 391209 - DNA, 16 bp, M. musculus
cctttcatcatagctc

SEQ ID NO: 391210 - DNA, 16 bp, M. musculus
cctttcattctgaagt

SEQ ID NO: 391211 - DNA, 16 bp, M. musculus
cctttcatttggagca

SEQ ID NO: 391212 - DNA, 16 bp, M. musculus
cctttccaatttgttt

SEQ ID NO: 391213 - DNA, 16 bp, M. musculus
cctttccaggtctccc

SEQ ID NO: 391214 - DNA, 16 bp, M. musculus
cctttcccaatctttt

SEQ ID NO: 391215 - DNA, 16 bp, M. musculus
cctttcccaatttccc

SEQ ID NO: 391216 - DNA, 16 bp, M. musculus
cctttcctcaccaact

SEQ ID NO: 391217 - DNA, 16 bp, M. musculus
cctttcctcccagtcc

SEQ ID NO: 391218 - DNA, 16 bp, M. musculus
cctttcctccccaggt

SEQ ID NO: 391219 - DNA, 16 bp, M. musculus
cctttcctcctactgg

SEQ ID NO: 391220 - DNA, 16 bp, M. musculus
cctttcctgacttcct

SEQ ID NO: 391221 - DNA, 16 bp, M. musculus
cctttcctgcccaagt

SEQ ID NO: 391222 - DNA, 16 bp, M. musculus
cctttcctgctgagcc

SEQ ID NO: 391223 - DNA, 16 bp, M. musculus
cctttcctggcttccc

SEQ ID NO: 391224 - DNA, 16 bp, M. musculus
cctttcctgtgtgtgt

SEQ ID NO: 391225 - DNA, 16 bp, M. musculus
cctttccttcagtctt

SEQ ID NO: 391226 - DNA, 16 bp, M. musculus
cctttccttcccaagt

SEQ ID NO: 391227 - DNA, 16 bp, M. musculus
cctttccttcctccag

SEQ ID NO: 391228 - DNA, 18 bp, M. musculus
cctttcgccatctggtaa

SEQ ID NO: 391229 - DNA, 16 bp, M. musculus
cctttctaagaaggac

SEQ ID NO: 391230 - DNA, 16 bp, M. musculus
cctttctaagaaggat

SEQ ID NO: 391231 - DNA, 16 bp, M. musculus
cctttctactgcagtg

SEQ ID NO: 391232 - DNA, 16 bp, M. musculus
cctttctacttcctgt

SEQ ID NO: 391233 - DNA, 16 bp, M. musculus
cctttctagcctcagg

SEQ ID NO: 391234 - DNA, 16 bp, M. musculus
cctttctagccttaat

SEQ ID NO: 391235 - DNA, 16 bp, M. musculus
cctttctcaacacaaa

SEQ ID NO: 391236 - DNA, 16 bp, M. musculus
cctttctcaggaccct

SEQ ID NO: 391237 - DNA, 16 bp, M. musculus
cctttctcagtgagat

SEQ ID NO: 391238 - DNA, 16 bp, M. musculus
cctttctcctcagctt

SEQ ID NO: 391239 - DNA, 16 bp, M. musculus
cctttctctgcctcta

SEQ ID NO: 391240 - DNA, 16 bp, M. musculus
cctttctctggcttct

SEQ ID NO: 391241 - DNA, 16 bp, M. musculus
cctttctctgtgctaa

SEQ ID NO: 391242 - DNA, 16 bp, M. musculus
cctttctgaacttcat

SEQ ID NO: 391243 - DNA, 16 bp, M. musculus
cctttctgctggaggt

SEQ ID NO: 391244 - DNA, 16 bp, M. musculus
cctttctgtgattctc

SEQ ID NO: 391245 - DNA, 16 bp, M. musculus
cctttctttcagtttt

SEQ ID NO: 391246 - DNA, 16 bp, M. musculus
cctttctttctgaggt

SEQ ID NO: 391247 - DNA, 16 bp, M. musculus
cctttgaaaccttcaa

SEQ ID NO: 391248 - DNA, 16 bp, M. musculus
cctttgaaggaagcag

SEQ ID NO: 391249 - DNA, 16 bp, M. musculus
cctttgaaggccaaga

SEQ ID NO: 391250 - DNA, 16 bp, M. musculus
cctttgaaggcctgga

SEQ ID NO: 391251 - DNA, 16 bp, M. musculus
cctttgacaaaataca

SEQ ID NO: 391252 - DNA, 16 bp, M. musculus
cctttgacaaacctct

SEQ ID NO: 391253 - DNA, 16 bp, M. musculus
cctttgacaagtatga

SEQ ID NO: 391254 - DNA, 16 bp, M. musculus
cctttgacctccatgt

SEQ ID NO: 391255 - DNA, 16 bp, M. musculus
cctttgacctcctttt

SEQ ID NO: 391256 - DNA, 16 bp, M. musculus
cctttgagtggagaga

SEQ ID NO: 391257 - DNA, 16 bp, M. musculus
cctttgagttcatttt

SEQ ID NO: 391258 - DNA, 16 bp, M. musculus
cctttgatcccagtac

SEQ ID NO: 391259 - DNA, 16 bp, M. musculus
cctttgatctacaatg

SEQ ID NO: 391260 - DNA, 16 bp, M. musculus
cctttgatctcctttt

SEQ ID NO: 391261 - DNA, 16 bp, M. musculus
cctttgatgagcatga

SEQ ID NO: 391262 - DNA, 16 bp, M. musculus
cctttgatgagtatgt

SEQ ID NO: 391263 - DNA, 16 bp, M. musculus
cctttgatgggctgga

SEQ ID NO: 391264 - DNA, 16 bp, M. musculus
cctttgcaaaagcagt

SEQ ID NO: 391265 - DNA, 16 bp, M. musculus
cctttgcaagagcagg

SEQ ID NO: 391266 - DNA, 16 bp, M. musculus
cctttgcccatttgga

SEQ ID NO: 391267 - DNA, 16 bp, M. musculus
cctttgcctgcttgct

SEQ ID NO: 391268 - DNA, 16 bp, M. musculus
cctttgcctttcagaa

SEQ ID NO: 391269 - DNA, 16 bp, M. musculus
cctttgctccccaagt

SEQ ID NO: 391270 - DNA, 16 bp, M. musculus
cctttgctcttataca

SEQ ID NO: 391271 - DNA, 16 bp, M. musculus
cctttgcttcccaagt

SEQ ID NO: 391272 - DNA, 16 bp, M. musculus
cctttgcttctgagag

SEQ ID NO: 391273 - DNA, 16 bp, M. musculus
cctttgctttgctttg

SEQ ID NO: 391274 - DNA, 16 bp, M. musculus
cctttggaaaattcca

SEQ ID NO: 391275 - DNA, 16 bp, M. musculus
cctttggaagagctgt

SEQ ID NO: 391276 - DNA, 20 bp, M. musculus
cctttggacaccaagtcagt

SEQ ID NO: 391277 - DNA, 16 bp, M. musculus
cctttggaccctgcat

SEQ ID NO: 391278 - DNA, 16 bp, M. musculus
cctttggaggagcagt

SEQ ID NO: 391279 - DNA, 16 bp, M. musculus
cctttggaggccaaga

SEQ ID NO: 391280 - DNA, 16 bp, M. musculus
cctttggaggccagag

SEQ ID NO: 391281 - DNA, 16 bp, M. musculus
cctttggaggtcagaa

SEQ ID NO: 391282 - DNA, 16 bp, M. musculus
cctttggatcaagata

SEQ ID NO: 391283 - DNA, 16 bp, M. musculus
cctttggattttcttt

SEQ ID NO: 391284 - DNA, 16 bp, M. musculus
cctttggccctggtgt

SEQ ID NO: 391285 - DNA, 16 bp, M. musculus
cctttgggtgtgtctg

SEQ ID NO: 391286 - DNA, 16 bp, M. musculus
cctttggtcaacaact

SEQ ID NO: 391287 - DNA, 16 bp, M. musculus
cctttggtcccagcac

SEQ ID NO: 391288 - DNA, 16 bp, M. musculus
cctttgtcaaggaaga

SEQ ID NO: 391289 - DNA, 16 bp, M. musculus
cctttgtcactgaggt

SEQ ID NO: 391290 - DNA, 16 bp, M. musculus
cctttgtcatcaggga

SEQ ID NO: 391291 - DNA, 16 bp, M. musculus
cctttgtccctctggg

SEQ ID NO: 391292 - DNA, 16 bp, M. musculus
cctttgtgagtgtgtt

SEQ ID NO: 391293 - DNA, 16 bp, M. musculus
cctttgtgattccttt

SEQ ID NO: 391294 - DNA, 16 bp, M. musculus
cctttgtgatttattt

SEQ ID NO: 391295 - DNA, 16 bp, M. musculus
cctttgtgtaaaggaa

SEQ ID NO: 391296 - DNA, 16 bp, M. musculus
cctttgttgagtatga

SEQ ID NO: 391297 - DNA, 16 bp, M. musculus
cctttgttggttattt

SEQ ID NO: 391298 - DNA, 16 bp, M. musculus
ccttttaaaaaaatat

SEQ ID NO: 391299 - DNA, 16 bp, M. musculus
ccttttaaaagaaaaa

SEQ ID NO: 391300 - DNA, 16 bp, M. musculus
ccttttaaacaactgt

SEQ ID NO: 391301 - DNA, 16 bp, M. musculus
ccttttaccatgtgga

SEQ ID NO: 391302 - DNA, 16 bp, M. musculus
ccttttatactctctc

SEQ ID NO: 391303 - DNA, 16 bp, M. musculus
ccttttcatttgattc

SEQ ID NO: 391304 - DNA, 16 bp, M. musculus
ccttttccccaaatca

SEQ ID NO: 391305 - DNA, 16 bp, M. musculus
ccttttccccttgctg

SEQ ID NO: 391306 - DNA, 16 bp, M. musculus
ccttttcctccccaag

SEQ ID NO: 391307 - DNA, 16 bp, M. musculus
ccttttcctgttgctg

SEQ ID NO: 391308 - DNA, 16 bp, M. musculus
ccttttctaccttttg

SEQ ID NO: 391309 - DNA, 16 bp, M. musculus
ccttttctccctccaa

SEQ ID NO: 391310 - DNA, 16 bp, M. musculus
ccttttctctgtgtgt

SEQ ID NO: 391311 - DNA, 16 bp, M. musculus
ccttttctgaggagaa

SEQ ID NO: 391312 - DNA, 16 bp, M. musculus
ccttttctggaatgtc

SEQ ID NO: 391313 - DNA, 16 bp, M. musculus
ccttttctggcctcca

SEQ ID NO: 391314 - DNA, 16 bp, M. musculus
ccttttctggcttcct

SEQ ID NO: 391315 - DNA, 16 bp, M. musculus
ccttttctggggtgtc

SEQ ID NO: 391316 - DNA, 16 bp, M. musculus
ccttttcttcctccag

SEQ ID NO: 391317 - DNA, 16 bp, M. musculus
ccttttctttccacta

SEQ ID NO: 391318 - DNA, 16 bp, M. musculus
ccttttgcaaaataat

SEQ ID NO: 391319 - DNA, 16 bp, M. musculus
ccttttgcagcacaca

SEQ ID NO: 391320 - DNA, 16 bp, M. musculus
ccttttgcaggaagga

SEQ ID NO: 391321 - DNA, 16 bp, M. musculus
ccttttgcattttctt

SEQ ID NO: 391322 - DNA, 16 bp, M. musculus
ccttttgcctgtatga

SEQ ID NO: 391323 - DNA, 16 bp, M. musculus
ccttttgcttctctgc

SEQ ID NO: 391324 - DNA, 16 bp, M. musculus
ccttttggagatgggg

SEQ ID NO: 391325 - DNA, 16 bp, M. musculus
ccttttggagtttggg

SEQ ID NO: 391326 - DNA, 16 bp, M. musculus
ccttttgggggtcaaa

SEQ ID NO: 391327 - DNA, 16 bp, M. musculus
ccttttgtgtctggct

SEQ ID NO: 391328 - DNA, 16 bp, M. musculus
ccttttgttttcaaat

SEQ ID NO: 391329 - DNA, 16 bp, M. musculus
ccttttgtttttaaat

SEQ ID NO: 391330 - DNA, 16 bp, M. musculus
cctttttaaagaaaaa

SEQ ID NO: 391331 - DNA, 16 bp, M. musculus
cctttttaaaggcaca

SEQ ID NO: 391332 - DNA, 16 bp, M. musculus
cctttttaaagtttgc

SEQ ID NO: 391333 - DNA, 16 bp, M. musculus
cctttttcacttactg

SEQ ID NO: 391334 - DNA, 16 bp, M. musculus
cctttttccatctggt

SEQ ID NO: 391335 - DNA, 16 bp, M. musculus
cctttttccctcactg

SEQ ID NO: 391336 - DNA, 16 bp, M. musculus
cctttttctgaagaga

SEQ ID NO: 391337 - DNA, 16 bp, M. musculus
cctttttctttaattg

SEQ ID NO: 391338 - DNA, 16 bp, M. musculus
cctttttgaccctggc

SEQ ID NO: 391339 - DNA, 17 bp, M. musculus
ccttttttatttcagga

SEQ ID NO: 391340 - DNA, 16 bp, M. musculus
cctttttttcctagag

SEQ ID NO: 391341 - DNA, 16 bp, M. musculus
cgaaatcagaaatcca

SEQ ID NO: 391342 - DNA, 16 bp, M. musculus
cgaaattcctaggcaa

SEQ ID NO: 391343 - DNA, 16 bp, M. musculus
cgaacaccttctgtcc

SEQ ID NO: 391344 - DNA, 16 bp, M. musculus
cgaactcacagagatt

SEQ ID NO: 391345 - DNA, 16 bp, M. musculus
cgaactcacagaggtc

SEQ ID NO: 391346 - DNA, 16 bp, M. musculus
cgaactcagaaatcag

SEQ ID NO: 391347 - DNA, 16 bp, M. musculus
cgaactcagaaatcca

SEQ ID NO: 391348 - DNA, 16 bp, M. musculus
cgaactcagaaatccg

SEQ ID NO: 391349 - DNA, 16 bp, M. musculus
cgaactcagaaatcgg

SEQ ID NO: 391350 - DNA, 16 bp, M. musculus
cgaactcagaaatctg

SEQ ID NO: 391351 - DNA, 16 bp, M. musculus
cgaactcagaaattca

SEQ ID NO: 391352 - DNA, 16 bp, M. musculus
cgaactcagaaattcg

SEQ ID NO: 391353 - DNA, 16 bp, M. musculus
cgaactcagaaatttg

SEQ ID NO: 391354 - DNA, 16 bp, M. musculus
cgaactcagagatcca

SEQ ID NO: 391355 - DNA, 16 bp, M. musculus
cgaactcagagatccg

SEQ ID NO: 391356 - DNA, 16 bp, M. musculus
cgaactcaggaatctg

SEQ ID NO: 391357 - DNA, 16 bp, M. musculus
cgaactctgcagccag

SEQ ID NO: 391358 - DNA, 16 bp, M. musculus
cgaagatcctgagttc

SEQ ID NO: 391359 - DNA, 16 bp, M. musculus
cgaaggccagcttgct

SEQ ID NO: 391360 - DNA, 16 bp, M. musculus
cgaagtcaggctccag

SEQ ID NO: 391361 - DNA, 16 bp, M. musculus
cgaatgcaagaacaca

SEQ ID NO: 391362 - DNA, 16 bp, M. musculus
cgaattcagaaatcca

SEQ ID NO: 391363 - DNA, 16 bp, M. musculus
cgaatttctgagttca

SEQ ID NO: 391364 - DNA, 17 bp, M. musculus
cgacaaaaccaagttca

SEQ ID NO: 391365 - DNA, 16 bp, M. musculus
cgacacagacacagac

SEQ ID NO: 391366 - DNA, 17 bp, M. musculus
cgacattcctccaccca

SEQ ID NO: 391367 - DNA, 16 bp, M. musculus
cgacgacgacgacaac

SEQ ID NO: 391368 - DNA, 16 bp, M. musculus
cgactctgctggcaag

SEQ ID NO: 391369 - DNA, 16 bp, M. musculus
cgactgctctcccaga

SEQ ID NO: 391370 - DNA, 16 bp, M. musculus
cgacttgccagcaagt

SEQ ID NO: 391371 - DNA, 16 bp, M. musculus
cgagaacagattggtg

SEQ ID NO: 391372 - DNA, 16 bp, M. musculus
cgagaagcagaggcag

SEQ ID NO: 391373 - DNA, 16 bp, M. musculus
cgagaggcagaggcag

SEQ ID NO: 391374 - DNA, 16 bp, M. musculus
cgagaggcctggaagc

SEQ ID NO: 391375 - DNA, 16 bp, M. musculus
cgagatgaagatggag

SEQ ID NO: 391376 - DNA, 20 bp, M. musculus
cgagcaggtgaaaccactgg

SEQ ID NO: 391377 - DNA, 16 bp, M. musculus
cgagccccagaaatgg

SEQ ID NO: 391378 - DNA, 16 bp, M. musculus
cgagcgcacacacaca

SEQ ID NO: 391379 - DNA, 16 bp, M. musculus
cgagctcccagggact

SEQ ID NO: 391380 - DNA, 16 bp, M. musculus
cgaggaggcagaggca

SEQ ID NO: 391381 - DNA, 16 bp, M. musculus
cgaggaggtggagaaa

SEQ ID NO: 391382 - DNA, 16 bp, M. musculus
cgaggccagtctgggc

SEQ ID NO: 391383 - DNA, 16 bp, M. musculus
cgaggctaagcactgc

SEQ ID NO: 391384 - DNA, 53 bp, M. musculus
cgagtaagaggacatcgaccaggcacccattgggaaattgactttactgaagt

SEQ ID NO: 391385 - DNA, 16 bp, M. musculus
cgagtgagttccagga

SEQ ID NO: 391386 - DNA, 16 bp, M. musculus
cgagtgctgggaataa

SEQ ID NO: 391387 - DNA, 17 bp, M. musculus
cgagtgctgggattaat

SEQ ID NO: 391388 - DNA, 16 bp, M. musculus
cgagtgtctgaagaca

SEQ ID NO: 391389 - DNA, 16 bp, M. musculus
cgagttcaaggtcatc

SEQ ID NO: 391390 - DNA, 16 bp, M. musculus
cgagttccaggacagc

SEQ ID NO: 391391 - DNA, 16 bp, M. musculus
cgataatggactaaac

SEQ ID NO: 391392 - DNA, 16 bp, M. musculus
cgatagatagatagat

SEQ ID NO: 391393 - DNA, 16 bp, M. musculus
cgatgagcatgttcaa

SEQ ID NO: 391394 - DNA, 16 bp, M. musculus
cgatgatgagaaaaaa

SEQ ID NO: 391395 - DNA, 16 bp, M. musculus
cgatgcagaggccatg

SEQ ID NO: 391396 - DNA, 16 bp, M. musculus
cgatgtgtgtgtgtgt

SEQ ID NO: 391397 - DNA, 17 bp, M. musculus
cgatttctgagtttgag

SEQ ID NO: 391398 - DNA, 16 bp, M. musculus
cgcaaggaaccacaca

SEQ ID NO: 391399 - DNA, 17 bp, M. musculus
cgcacacctttaatcct

SEQ ID NO: 391400 - DNA, 16 bp, M. musculus
cgcacacgcgcacaca

SEQ ID NO: 391401 - DNA, 16 bp, M. musculus
cgcaccagaagagggt

SEQ ID NO: 391402 - DNA, 16 bp, M. musculus
cgcacgcacacacaca

SEQ ID NO: 391403 - DNA, 16 bp, M. musculus
cgcacgcacgtgcaca

SEQ ID NO: 391404 - DNA, 16 bp, M. musculus
cgcactgactgctctt

SEQ ID NO: 391405 - DNA, 16 bp, M. musculus
cgcagacaccattgca

SEQ ID NO: 391406 - DNA, 16 bp, M. musculus
cgcagagcagctgagg

SEQ ID NO: 391407 - DNA, 16 bp, M. musculus
cgcagaggcaggtgga

SEQ ID NO: 391408 - DNA, 16 bp, M. musculus
cgcagcactcccacct

SEQ ID NO: 391409 - DNA, 16 bp, M. musculus
cgcagcagcagcagca

SEQ ID NO: 391410 - DNA, 16 bp, M. musculus
cgcagcccagcccctc

SEQ ID NO: 391411 - DNA, 16 bp, M. musculus
cgcaggccagccccaa

SEQ ID NO: 391412 - DNA, 16 bp, M. musculus
cgcagttctggttctg

SEQ ID NO: 391413 - DNA, 16 bp, M. musculus
cgcatacacacacaca

SEQ ID NO: 391414 - DNA, 20 bp, M. musculus
cgcatgacccactatcaggc

SEQ ID NO: 391415 - DNA, 16 bp, M. musculus
cgcatgcacacacaca

SEQ ID NO: 391416 - DNA, 16 bp, M. musculus
cgcatgcgcacctcct

SEQ ID NO: 391417 - DNA, 16 bp, M. musculus
cgcatgtgcacacaca

SEQ ID NO: 391418 - DNA, 16 bp, M. musculus
cgccaattcttcccct

SEQ ID NO: 391419 - DNA, 16 bp, M. musculus
cgccaccaccaccagg

SEQ ID NO: 391420 - DNA, 16 bp, M. musculus
cgccagatctcattac

SEQ ID NO: 391421 - DNA, 17 bp, M. musculus
cgccagcctggtctaca

SEQ ID NO: 391422 - DNA, 16 bp, M. musculus
cgccaggcgtggtggc

SEQ ID NO: 391423 - DNA, 16 bp, M. musculus
cgccaggtccaagaag

SEQ ID NO: 391424 - DNA, 17 bp, M. musculus
cgccatcttggtcccgg

SEQ ID NO: 391425 - DNA, 16 bp, M. musculus
cgccatcttggttccg

SEQ ID NO: 391426 - DNA, 16 bp, M. musculus
cgcccactgctggaac

SEQ ID NO: 391427 - DNA, 16 bp, M. musculus
cgcccagcccgagagg

SEQ ID NO: 391428 - DNA, 16 bp, M. musculus
cgcccagcccgggagg

SEQ ID NO: 391429 - DNA, 16 bp, M. musculus
cgcccctggccaaggt

SEQ ID NO: 391430 - DNA, 16 bp, M. musculus
cgccctctgctggcca

SEQ ID NO: 391431 - DNA, 16 bp, M. musculus
cgccctgagtagctgg

SEQ ID NO: 391432 - DNA, 16 bp, M. musculus
cgcctaggacgtgtca

SEQ ID NO: 391433 - DNA, 16 bp, M. musculus
cgcctgccactgcctc

SEQ ID NO: 391434 - DNA, 16 bp, M. musculus
cgcctgcctctacctc

SEQ ID NO: 391435 - DNA, 16 bp, M. musculus
cgcctgcctctacttc

SEQ ID NO: 391436 - DNA, 16 bp, M. musculus
cgcctgcctctgcatc

SEQ ID NO: 391437 - DNA, 16 bp, M. musculus
cgcctgcctctgccta

SEQ ID NO: 391438 - DNA, 16 bp, M. musculus
cgcctggctcgggagg

SEQ ID NO: 391439 - DNA, 16 bp, M. musculus
cgcctgggagtggagc

SEQ ID NO: 391440 - DNA, 16 bp, M. musculus
cgcctgtctctgcctc

SEQ ID NO: 391441 - DNA, 16 bp, M. musculus
cgcgagtgtgtgtgtg

SEQ ID NO: 391442 - DNA, 16 bp, M. musculus
cgcgcacacacacaga

SEQ ID NO: 391443 - DNA, 16 bp, M. musculus
cgcgcgcacacacacc

SEQ ID NO: 391444 - DNA, 16 bp, M. musculus
cgcgcgcacacgcacg

SEQ ID NO: 391445 - DNA, 16 bp, M. musculus
cgcgcgcacgcgtgtg

SEQ ID NO: 391446 - DNA, 16 bp, M. musculus
cgcgcgcgcatgcgca

SEQ ID NO: 391447 - DNA, 16 bp, M. musculus
cgcgcgcgcgcgcact

SEQ ID NO: 391448 - DNA, 16 bp, M. musculus
cgcgcgcgcgcgcatg

SEQ ID NO: 391449 - DNA, 16 bp, M. musculus
cgcgcgcgtgcgcgtg

SEQ ID NO: 391450 - DNA, 16 bp, M. musculus
cgcgcgtgtgtgtgcg

SEQ ID NO: 391451 - DNA, 16 bp, M. musculus
cgcgctcaactggcca

SEQ ID NO: 391452 - DNA, 24 bp, M. musculus
cgcgttctcacgaccggccaggaa

SEQ ID NO: 391453 - DNA, 16 bp, M. musculus
cgctccatcttcatct

SEQ ID NO: 391454 - DNA, 16 bp, M. musculus
cgctcctctctcacct

SEQ ID NO: 391455 - DNA, 16 bp, M. musculus
cgctcgcgcacacaca

SEQ ID NO: 391456 - DNA, 16 bp, M. musculus
cgctcttaaccactaa

SEQ ID NO: 391457 - DNA, 16 bp, M. musculus
cgctcttgctcttgct

SEQ ID NO: 391458 - DNA, 16 bp, M. musculus
cgctgagccacctcac

SEQ ID NO: 391459 - DNA, 16 bp, M. musculus
cgctgccaccaccacc

SEQ ID NO: 391460 - DNA, 16 bp, M. musculus
cgctgccccagaagct

SEQ ID NO: 391461 - DNA, 16 bp, M. musculus
cgctgctgattcatgt

SEQ ID NO: 391462 - DNA, 16 bp, M. musculus
cgctggctgtcctgga

SEQ ID NO: 391463 - DNA, 16 bp, M. musculus
cgctgtgctgtgctgt

SEQ ID NO: 391464 - DNA, 16 bp, M. musculus
cgcttgcctagcaagc

SEQ ID NO: 391465 - DNA, 16 bp, M. musculus
cggaaccaaggtggct

SEQ ID NO: 391466 - DNA, 17 bp, M. musculus
cggaaccgccagataca

SEQ ID NO: 391467 - DNA, 18 bp, M. musculus
cggaagagcagtcagtgt

SEQ ID NO: 391468 - DNA, 16 bp, M. musculus
cggaagagcagttagt

SEQ ID NO: 391469 - DNA, 16 bp, M. musculus
cggaagagcagttggt

SEQ ID NO: 391470 - DNA, 16 bp, M. musculus
cggaaggagttacaga

SEQ ID NO: 391471 - DNA, 16 bp, M. musculus
cggacacccccaaggt

SEQ ID NO: 391472 - DNA, 44 bp, M. musculus
cggaccttcagaagagcagtcgggtgctcttacccactgagcca

SEQ ID NO: 391473 - DNA, 16 bp, M. musculus
cggacggacacacaca

SEQ ID NO: 391474 - DNA, 16 bp, M. musculus
cggagcagaagcacat

SEQ ID NO: 391475 - DNA, 16 bp, M. musculus
cggagccttaaggtat

SEQ ID NO: 391476 - DNA, 16 bp, M. musculus
cggaggaggaaggtga

SEQ ID NO: 391477 - DNA, 16 bp, M. musculus
cggaggcagaggcaga

SEQ ID NO: 391478 - DNA, 16 bp, M. musculus
cggaggcagaggcagg

SEQ ID NO: 391479 - DNA, 16 bp, M. musculus
cggaggctagaagctt

SEQ ID NO: 391480 - DNA, 16 bp, M. musculus
cggaggggagacctgg

SEQ ID NO: 391481 - DNA, 16 bp, M. musculus
cggagtctgcagacac

SEQ ID NO: 391482 - DNA, 16 bp, M. musculus
cggatacaccagcagt

SEQ ID NO: 391483 - DNA, 16 bp, M. musculus
cggatctctgagttcg

SEQ ID NO: 391484 - DNA, 16 bp, M. musculus
cggatgccttcttctg

SEQ ID NO: 391485 - DNA, 16 bp, M. musculus
cggatgctctcttctg

SEQ ID NO: 391486 - DNA, 17 bp, M. musculus
cggatttaaaagcatat

SEQ ID NO: 391487 - DNA, 16 bp, M. musculus
cggatttctaagttcg

SEQ ID NO: 391488 - DNA, 16 bp, M. musculus
cggatttctgagtctg

SEQ ID NO: 391489 - DNA, 16 bp, M. musculus
cggatttctgagttca

SEQ ID NO: 391490 - DNA, 16 bp, M. musculus
cggatttctgagttcc

SEQ ID NO: 391491 - DNA, 16 bp, M. musculus
cggatttctgagttcg

SEQ ID NO: 391492 - DNA, 19 bp, M. musculus
cggatttctgagttcgagg

SEQ ID NO: 391493 - DNA, 16 bp, M. musculus
cggatttctgagttct

SEQ ID NO: 391494 - DNA, 16 bp, M. musculus
cggatttctgagtttg

SEQ ID NO: 391495 - DNA, 18 bp, M. musculus
cggatttttgagttcaag

SEQ ID NO: 391496 - DNA, 16 bp, M. musculus
cggcagcagcagcagg

SEQ ID NO: 391497 - DNA, 16 bp, M. musculus
cggcagcttcagccat

SEQ ID NO: 391498 - DNA, 16 bp, M. musculus
cggcagggtaagttca

SEQ ID NO: 391499 - DNA, 16 bp, M. musculus
cggccatcagtgaaaa

SEQ ID NO: 391500 - DNA, 16 bp, M. musculus
cggccatggccacgtg

SEQ ID NO: 391501 - DNA, 16 bp, M. musculus
cggcccctgtcccagt

SEQ ID NO: 391502 - DNA, 16 bp, M. musculus
cggcccggagctccgt

SEQ ID NO: 391503 - DNA, 16 bp, M. musculus
cggcctcagcctcagc

SEQ ID NO: 391504 - DNA, 16 bp, M. musculus
cggcctctactcctct

SEQ ID NO: 391505 - DNA, 27 bp, M. musculus
cggcgaatgtgggggcggctcccaaca

SEQ ID NO: 391506 - DNA, 16 bp, M. musculus
cggcggcgggagcctc

SEQ ID NO: 391507 - DNA, 16 bp, M. musculus
cggctccagacaacag

SEQ ID NO: 391508 - DNA, 16 bp, M. musculus
cggctccgagtccccc

SEQ ID NO: 391509 - DNA, 16 bp, M. musculus
cggctctgtgcttctg

SEQ ID NO: 391510 - DNA, 16 bp, M. musculus
cggctgctgctgctgc

SEQ ID NO: 391511 - DNA, 16 bp, M. musculus
cggctggctggctggc

SEQ ID NO: 391512 - DNA, 16 bp, M. musculus
cggctgtcctggaact

SEQ ID NO: 391513 - DNA, 17 bp, M. musculus
cggctttgggacaagtt

SEQ ID NO: 391514 - DNA, 16 bp, M. musculus
cgggaaagaacccaga

SEQ ID NO: 391515 - DNA, 16 bp, M. musculus
cgggaagcaggagctg

SEQ ID NO: 391516 - DNA, 16 bp, M. musculus
cgggacagtgcccagg

SEQ ID NO: 391517 - DNA, 16 bp, M. musculus
cgggagcaggtcaggg

SEQ ID NO: 391518 - DNA, 16 bp, M. musculus
cgggaggcagagacaa

SEQ ID NO: 391519 - DNA, 16 bp, M. musculus
cgggaggcagagacag

SEQ ID NO: 391520 - DNA, 16 bp, M. musculus
cgggaggcagaggtgg

SEQ ID NO: 391521 - DNA, 16 bp, M. musculus
cgggaggctgaagcag

SEQ ID NO: 391522 - DNA, 16 bp, M. musculus
cgggatgagctggcca

SEQ ID NO: 391523 - DNA, 16 bp, M. musculus
cgggcagtggtggctc

SEQ ID NO: 391524 - DNA, 24 bp, M. musculus
cgggcagtggtggtgcatgccttt

SEQ ID NO: 391525 - DNA, 16 bp, M. musculus
cgggccaccaattgtc

SEQ ID NO: 391526 - DNA, 16 bp, M. musculus
cgggcgccaccttggt

SEQ ID NO: 391527 - DNA, 16 bp, M. musculus
cgggcggtggtggcac

SEQ ID NO: 391528 - DNA, 16 bp, M. musculus
cgggcgtggtggctca

SEQ ID NO: 391529 - DNA, 16 bp, M. musculus
cgggctcctgtcagca

SEQ ID NO: 391530 - DNA, 16 bp, M. musculus
cgggctggcctcaaac

SEQ ID NO: 391531 - DNA, 16 bp, M. musculus
cgggctgggcggaccc

SEQ ID NO: 391532 - DNA, 16 bp, M. musculus
cggggaaccatcccat

SEQ ID NO: 391533 - DNA, 16 bp, M. musculus
cggggccaggaagcag

SEQ ID NO: 391534 - DNA, 16 bp, M. musculus
cggggcctgaggcagg

SEQ ID NO: 391535 - DNA, 16 bp, M. musculus
cggggctacacagaaa

SEQ ID NO: 391536 - DNA, 16 bp, M. musculus
cggggctcagaccccc

SEQ ID NO: 391537 - DNA, 16 bp, M. musculus
cgggggatgggcctcc

SEQ ID NO: 391538 - DNA, 16 bp, M. musculus
cggggtactggtttgt

SEQ ID NO: 391539 - DNA, 16 bp, M. musculus
cggggtggcatggctg

SEQ ID NO: 391540 - DNA, 16 bp, M. musculus
cgggtcaagtggcgcc

SEQ ID NO: 391541 - DNA, 16 bp, M. musculus
cggtagaaggagagaa

SEQ ID NO: 391542 - DNA, 16 bp, M. musculus
cggtcctgagttcaaa

SEQ ID NO: 391543 - DNA, 16 bp, M. musculus
cggtgagatggctcag

SEQ ID NO: 391544 - DNA, 16 bp, M. musculus
cggtggagtcccagaa

SEQ ID NO: 391545 - DNA, 16 bp, M. musculus
cggtggcagcagcagc

SEQ ID NO: 391546 - DNA, 16 bp, M. musculus
cggtgtgtctgaagac

SEQ ID NO: 391547 - DNA, 16 bp, M. musculus
cggtgttttatcacag

SEQ ID NO: 391548 - DNA, 16 bp, M. musculus
cggttaagagaactga

SEQ ID NO: 391549 - DNA, 16 bp, M. musculus
cggttaagagcactga

SEQ ID NO: 391550 - DNA, 17 bp, M. musculus
cggttaagagcactgat

SEQ ID NO: 391551 - DNA, 16 bp, M. musculus
cggttacctggcaaca

SEQ ID NO: 391552 - DNA, 16 bp, M. musculus
cggttgtctggagacg

SEQ ID NO: 391553 - DNA, 16 bp, M. musculus
cggttgtgagccacca

SEQ ID NO: 391554 - DNA, 16 bp, M. musculus
cggtttctctgtgtag

SEQ ID NO: 391555 - DNA, 16 bp, M. musculus
cgtagaccaggctggc

SEQ ID NO: 391556 - DNA, 16 bp, M. musculus
cgtatttatttattta

SEQ ID NO: 391557 - DNA, 16 bp, M. musculus
cgtcaagtggacacag

SEQ ID NO: 391558 - DNA, 16 bp, M. musculus
cgtcaccatcatcatc

SEQ ID NO: 391559 - DNA, 23 bp, M. musculus
cgtcacccgtgcagcctgccctc

SEQ ID NO: 391560 - DNA, 16 bp, M. musculus
cgtcactgtcttcaga

SEQ ID NO: 391561 - DNA, 16 bp, M. musculus
cgtcatcaccatcatc

SEQ ID NO: 391562 - DNA, 16 bp, M. musculus
cgtccgtccgtctgtc

SEQ ID NO: 391563 - DNA, 16 bp, M. musculus
cgtcctggaactcact

SEQ ID NO: 391564 - DNA, 16 bp, M. musculus
cgtctctcagcagacc

SEQ ID NO: 391565 - DNA, 16 bp, M. musculus
cgtctgtccgtctgtc

SEQ ID NO: 391566 - DNA, 16 bp, M. musculus
cgtctttcttgctggt

SEQ ID NO: 391567 - DNA, 17 bp, M. musculus
cgtgagcagactctgca

SEQ ID NO: 391568 - DNA, 16 bp, M. musculus
cgtgagttccaggaca

SEQ ID NO: 391569 - DNA, 18 bp, M. musculus
cgtgatgacaactgggcc

SEQ ID NO: 391570 - DNA, 16 bp, M. musculus
cgtgcacacacatgtg

SEQ ID NO: 391571 - DNA, 16 bp, M. musculus
cgtgcaccactatgcc

SEQ ID NO: 391572 - DNA, 16 bp, M. musculus
cgtgcatccctgggat

SEQ ID NO: 391573 - DNA, 16 bp, M. musculus
cgtgccgtgccgtgcc

SEQ ID NO: 391574 - DNA, 16 bp, M. musculus
cgtgcgcgcgcgtgca

SEQ ID NO: 391575 - DNA, 16 bp, M. musculus
cgtgcgcgcgtgcgtg

SEQ ID NO: 391576 - DNA, 16 bp, M. musculus
cgtgcgtgccgtgagc

SEQ ID NO: 391577 - DNA, 17 bp, M. musculus
cgtgcgtgtgtgcgtgc

SEQ ID NO: 391578 - DNA, 16 bp, M. musculus
cgtgctctctttcaat

SEQ ID NO: 391579 - DNA, 16 bp, M. musculus
cgtgctgggattaaag

SEQ ID NO: 391580 - DNA, 16 bp, M. musculus
cgtgctgggattacag

SEQ ID NO: 391581 - DNA, 16 bp, M. musculus
cgtgcttgctttagca

SEQ ID NO: 391582 - DNA, 16 bp, M. musculus
cgtggcagcaggcagg

SEQ ID NO: 391583 - DNA, 16 bp, M. musculus
cgtggcagcatccagg

SEQ ID NO: 391584 - DNA, 16 bp, M. musculus
cgtggccttgctggag

SEQ ID NO: 391585 - DNA, 16 bp, M. musculus
cgtggcggcgcacgcc

SEQ ID NO: 391586 - DNA, 16 bp, M. musculus
cgtggctggaatttaa

SEQ ID NO: 391587 - DNA, 16 bp, M. musculus
cgtggtggccagcggt

SEQ ID NO: 391588 - DNA, 22 bp, M. musculus
cgtggtggtgcacacctttaat

SEQ ID NO: 391589 - DNA, 16 bp, M. musculus
cgtgtaccaccactgc

SEQ ID NO: 391590 - DNA, 16 bp, M. musculus
cgtgtagcccaggctg

SEQ ID NO: 391591 - DNA, 16 bp, M. musculus
cgtgtatgtgtgtgtg

SEQ ID NO: 391592 - DNA, 16 bp, M. musculus
cgtgtctgtgtgtctg

SEQ ID NO: 391593 - DNA, 16 bp, M. musculus
cgtgtgccaccacatc

SEQ ID NO: 391594 - DNA, 16 bp, M. musculus
cgtgtgccaccaccac

SEQ ID NO: 391595 - DNA, 16 bp, M. musculus
cgtgtgtgcacatgtg

SEQ ID NO: 391596 - DNA, 16 bp, M. musculus
cgtgtgtgcacgtgtg

SEQ ID NO: 391597 - DNA, 16 bp, M. musculus
cgtgtgtgtatgtgtg

SEQ ID NO: 391598 - DNA, 16 bp, M. musculus
cgtgtgtgtctgtgtg

SEQ ID NO: 391599 - DNA, 16 bp, M. musculus
cgtgtgtgtgagtgtg

SEQ ID NO: 391600 - DNA, 16 bp, M. musculus
cgtgtgtgtgcctgtg

SEQ ID NO: 391601 - DNA, 16 bp, M. musculus
cgtgtgtgtgcgcgcg

SEQ ID NO: 391602 - DNA, 16 bp, M. musculus
cgtgtgtgtgcgtgcg

SEQ ID NO: 391603 - DNA, 16 bp, M. musculus
cgtgtgtgtgtgagtg

SEQ ID NO: 391604 - DNA, 16 bp, M. musculus
cgtgtgtgtgtgcgcg

SEQ ID NO: 391605 - DNA, 16 bp, M. musculus
cgtgtgtgtgtgtgcg

SEQ ID NO: 391606 - DNA, 16 bp, M. musculus
cgtgtgtgtgtgtgta

SEQ ID NO: 391607 - DNA, 16 bp, M. musculus
cgtgtgttcttgctgg

SEQ ID NO: 391608 - DNA, 62 bp, M. musculus
cgttatgcaggcaccacccagaagtggacagctgcagcattacaacccctttctgggacaac

SEQ ID NO: 391609 - DNA, 16 bp, M. musculus
cgttcaaggccagcct

SEQ ID NO: 391610 - DNA, 30 bp, M. musculus
cgttccccagctgatgagttctgaattcgg

SEQ ID NO: 391611 - DNA, 16 bp, M. musculus
cgttcccctgaactgg

SEQ ID NO: 391612 - DNA, 16 bp, M. musculus
cgttcgttcgttcgtt

SEQ ID NO: 391613 - DNA, 16 bp, M. musculus
cgttgctgctgctgct

SEQ ID NO: 391614 - DNA, 16 bp, M. musculus
cgttgtgggtctttca

SEQ ID NO: 391615 - DNA, 16 bp, M. musculus
cgtttctcagccccac

SEQ ID NO: 391616 - DNA, 16 bp, M. musculus
ctaaaaaaatgttcaa

SEQ ID NO: 391617 - DNA, 16 bp, M. musculus
ctaaaaaatccaccag

SEQ ID NO: 391618 - DNA, 16 bp, M. musculus
ctaaaaacaagcaaac

SEQ ID NO: 391619 - DNA, 16 bp, M. musculus
ctaaaaacagggacta

SEQ ID NO: 391620 - DNA, 16 bp, M. musculus
ctaaaaagaaactaga

SEQ ID NO: 391621 - DNA, 16 bp, M. musculus
ctaaaaagggaagtag

SEQ ID NO: 391622 - DNA, 16 bp, M. musculus
ctaaaaatgataaaag

SEQ ID NO: 391623 - DNA, 16 bp, M. musculus
ctaaaacaaacaagca

SEQ ID NO: 391624 - DNA, 16 bp, M. musculus
ctaaaaccatctgtcc

SEQ ID NO: 391625 - DNA, 16 bp, M. musculus
ctaaaactaatagaaa

SEQ ID NO: 391626 - DNA, 16 bp, M. musculus
ctaaaactccagttcc

SEQ ID NO: 391627 - DNA, 16 bp, M. musculus
ctaaaagaaatgttca

SEQ ID NO: 391628 - DNA, 16 bp, M. musculus
ctaaaagaagagaaag

SEQ ID NO: 391629 - DNA, 28 bp, M. musculus
ctaaaagcagcaatcacccactttgggc

SEQ ID NO: 391630 - DNA, 16 bp, M. musculus
ctaaaagccctagaaa

SEQ ID NO: 391631 - DNA, 16 bp, M. musculus
ctaaaataaacctttc

SEQ ID NO: 391632 - DNA, 16 bp, M. musculus
ctaaaataacttctca

SEQ ID NO: 391633 - DNA, 16 bp, M. musculus
ctaaaatcctaaatat

SEQ ID NO: 391634 - DNA, 16 bp, M. musculus
ctaaaatctcagcact

SEQ ID NO: 391635 - DNA, 16 bp, M. musculus
ctaaaatgaattctct

SEQ ID NO: 391636 - DNA, 16 bp, M. musculus
ctaaaatgtgtgtgtg

SEQ ID NO: 391637 - DNA, 16 bp, M. musculus
ctaaaattatatcagt

SEQ ID NO: 391638 - DNA, 16 bp, M. musculus
ctaaaattattttcat

SEQ ID NO: 391639 - DNA, 16 bp, M. musculus
ctaaaattgaaaataa

SEQ ID NO: 391640 - DNA, 16 bp, M. musculus
ctaaaattgaataaaa

SEQ ID NO: 391641 - DNA, 16 bp, M. musculus
ctaaaatttctaccag

SEQ ID NO: 391642 - DNA, 16 bp, M. musculus
ctaaacaactggagca

SEQ ID NO: 391643 - DNA, 16 bp, M. musculus
ctaaaccagagaacaa

SEQ ID NO: 391644 - DNA, 16 bp, M. musculus
ctaaaccatcaaccaa

SEQ ID NO: 391645 - DNA, 16 bp, M. musculus
ctaaaccttctaatat

SEQ ID NO: 391646 - DNA, 16 bp, M. musculus
ctaaactacataaaga

SEQ ID NO: 391647 - DNA, 16 bp, M. musculus
ctaaagaaactccaaa

SEQ ID NO: 391648 - DNA, 16 bp, M. musculus
ctaaagaaatggctca

SEQ ID NO: 391649 - DNA, 16 bp, M. musculus
ctaaagaaatgttgaa

SEQ ID NO: 391650 - DNA, 16 bp, M. musculus
ctaaagagaaaccaga

SEQ ID NO: 391651 - DNA, 16 bp, M. musculus
ctaaagagaaagaaag

SEQ ID NO: 391652 - DNA, 16 bp, M. musculus
ctaaagagatctgcaa

SEQ ID NO: 391653 - DNA, 19 bp, M. musculus
ctaaagaggcagccttcat

SEQ ID NO: 391654 - DNA, 16 bp, M. musculus
ctaaagatgtgtgcca

SEQ ID NO: 391655 - DNA, 16 bp, M. musculus
ctaaagatttattttt

SEQ ID NO: 391656 - DNA, 16 bp, M. musculus
ctaaagcagcagatga

SEQ ID NO: 391657 - DNA, 16 bp, M. musculus
ctaaagcaggagcagg

SEQ ID NO: 391658 - DNA, 16 bp, M. musculus
ctaaagcagtactaca

SEQ ID NO: 391659 - DNA, 16 bp, M. musculus
ctaaaggaaatgcagg

SEQ ID NO: 391660 - DNA, 16 bp, M. musculus
ctaaaggaagccagaa

SEQ ID NO: 391661 - DNA, 16 bp, M. musculus
ctaaaggaagcctgtc

SEQ ID NO: 391662 - DNA, 16 bp, M. musculus
ctaaaggagctgaaga

SEQ ID NO: 391663 - DNA, 16 bp, M. musculus
ctaaaggagctgaagg

SEQ ID NO: 391664 - DNA, 16 bp, M. musculus
ctaaaggcaaacagga

SEQ ID NO: 391665 - DNA, 16 bp, M. musculus
ctaaaggggtctgcca

SEQ ID NO: 391666 - DNA, 16 bp, M. musculus
ctaaaggtttctaagt

SEQ ID NO: 391667 - DNA, 16 bp, M. musculus
ctaaagtcatctaaga

SEQ ID NO: 391668 - DNA, 16 bp, M. musculus
ctaaagtcatctgaga

SEQ ID NO: 391669 - DNA, 16 bp, M. musculus
ctaaagttttcttttt

SEQ ID NO: 391670 - DNA, 16 bp, M. musculus
ctaaataaagaatttt

SEQ ID NO: 391671 - DNA, 16 bp, M. musculus
ctaaataactttaaac

SEQ ID NO: 391672 - DNA, 16 bp, M. musculus
ctaaatccccaaccct

SEQ ID NO: 391673 - DNA, 16 bp, M. musculus
ctaaatctaaatctaa

SEQ ID NO: 391674 - DNA, 16 bp, M. musculus
ctaaatgggatgtctt

SEQ ID NO: 391675 - DNA, 16 bp, M. musculus
ctaaattcaatcccca

SEQ ID NO: 391676 - DNA, 16 bp, M. musculus
ctaaattcagtcccca

SEQ ID NO: 391677 - DNA, 16 bp, M. musculus
ctaaattcagttccca

SEQ ID NO: 391678 - DNA, 16 bp, M. musculus
ctaaattctttctcag

SEQ ID NO: 391679 - DNA, 16 bp, M. musculus
ctaaatttattcttaa

SEQ ID NO: 391680 - DNA, 16 bp, M. musculus
ctaaatttcatgtaaa

SEQ ID NO: 391681 - DNA, 16 bp, M. musculus
ctaacaaatgtgacca

SEQ ID NO: 391682 - DNA, 16 bp, M. musculus
ctaacaaggccacact

SEQ ID NO: 391683 - DNA, 16 bp, M. musculus
ctaacacagccagatg

SEQ ID NO: 391684 - DNA, 16 bp, M. musculus
ctaacacatacacaca

SEQ ID NO: 391685 - DNA, 16 bp, M. musculus
ctaacagaaggaaaag

SEQ ID NO: 391686 - DNA, 16 bp, M. musculus
ctaacagagtcacctg

SEQ ID NO: 391687 - DNA, 16 bp, M. musculus
ctaacatgcatgaagc

SEQ ID NO: 391688 - DNA, 18 bp, M. musculus
ctaacatgggaagagagc

SEQ ID NO: 391689 - DNA, 18 bp, M. musculus
ctaacattgcacactggg

SEQ ID NO: 391690 - DNA, 16 bp, M. musculus
ctaaccaaactattaa

SEQ ID NO: 391691 - DNA, 16 bp, M. musculus
ctaaccctcgagagac

SEQ ID NO: 391692 - DNA, 16 bp, M. musculus
ctaaccctctagagac

SEQ ID NO: 391693 - DNA, 16 bp, M. musculus
ctaacctagaactcac

SEQ ID NO: 391694 - DNA, 16 bp, M. musculus
ctaacctggatccctg

SEQ ID NO: 391695 - DNA, 16 bp, M. musculus
ctaacctggtctacat

SEQ ID NO: 391696 - DNA, 16 bp, M. musculus
ctaactaagacagtga

SEQ ID NO: 391697 - DNA, 16 bp, M. musculus
ctaactatgggacagc

SEQ ID NO: 391698 - DNA, 16 bp, M. musculus
ctaactcagaaatccg

SEQ ID NO: 391699 - DNA, 16 bp, M. musculus
ctaactccagcttcag

SEQ ID NO: 391700 - DNA, 16 bp, M. musculus
ctaactcctccattgg

SEQ ID NO: 391701 - DNA, 16 bp, M. musculus
ctaactcctgaaagtt

SEQ ID NO: 391702 - DNA, 16 bp, M. musculus
ctaactctgttgcctg

SEQ ID NO: 391703 - DNA, 16 bp, M. musculus
ctaactcttccattag

SEQ ID NO: 391704 - DNA, 16 bp, M. musculus
ctaactcttcccagat

SEQ ID NO: 391705 - DNA, 16 bp, M. musculus
ctaactgaagagaaag

SEQ ID NO: 391706 - DNA, 16 bp, M. musculus
ctaacttgggatccat

SEQ ID NO: 391707 - DNA, 16 bp, M. musculus
ctaagaaccagagagg

SEQ ID NO: 391708 - DNA, 16 bp, M. musculus
ctaagaagaaaattca

SEQ ID NO: 391709 - DNA, 16 bp, M. musculus
ctaagaagaaagtata

SEQ ID NO: 391710 - DNA, 16 bp, M. musculus
ctaagaatacatcaaa

SEQ ID NO: 391711 - DNA, 16 bp, M. musculus
ctaagaatttcttgaa

SEQ ID NO: 391712 - DNA, 16 bp, M. musculus
ctaagacaaaattctg

SEQ ID NO: 391713 - DNA, 19 bp, M. musculus
ctaagacacagacatgtgg

SEQ ID NO: 391714 - DNA, 16 bp, M. musculus
ctaagacagaagcaga

SEQ ID NO: 391715 - DNA, 16 bp, M. musculus
ctaagacaggcattct

SEQ ID NO: 391716 - DNA, 16 bp, M. musculus
ctaagaccaccagaaa

SEQ ID NO: 391717 - DNA, 16 bp, M. musculus
ctaagaccattggaaa

SEQ ID NO: 391718 - DNA, 16 bp, M. musculus
ctaagaccattgggaa

SEQ ID NO: 391719 - DNA, 16 bp, M. musculus
ctaagacctctgatga

SEQ ID NO: 391720 - DNA, 16 bp, M. musculus
ctaagagaaaaattca

SEQ ID NO: 391721 - DNA, 16 bp, M. musculus
ctaagagagagagaga

SEQ ID NO: 391722 - DNA, 16 bp, M. musculus
ctaagaggctgcagac

SEQ ID NO: 391723 - DNA, 16 bp, M. musculus
ctaagagttgcagaga

SEQ ID NO: 391724 - DNA, 16 bp, M. musculus
ctaagatcaaaaccac

SEQ ID NO: 391725 - DNA, 16 bp, M. musculus
ctaagatcctgggtgt

SEQ ID NO: 391726 - DNA, 16 bp, M. musculus
ctaagattatttgaat

SEQ ID NO: 391727 - DNA, 16 bp, M. musculus
ctaagcaagcactgta

SEQ ID NO: 391728 - DNA, 16 bp, M. musculus
ctaagccatctcctca

SEQ ID NO: 391729 - DNA, 17 bp, M. musculus
ctaagccccttacccca

SEQ ID NO: 391730 - DNA, 16 bp, M. musculus
ctaagcctaagcctaa

SEQ ID NO: 391731 - DNA, 16 bp, M. musculus
ctaagcctctgaccca

SEQ ID NO: 391732 - DNA, 16 bp, M. musculus
ctaagcctgatgactt

SEQ ID NO: 391733 - DNA, 16 bp, M. musculus
ctaaggaagaaggaag

SEQ ID NO: 391734 - DNA, 16 bp, M. musculus
ctaaggactttgaaca

SEQ ID NO: 391735 - DNA, 16 bp, M. musculus
ctaaggagctgaagag

SEQ ID NO: 391736 - DNA, 16 bp, M. musculus
ctaaggaggaccaaag

SEQ ID NO: 391737 - DNA, 16 bp, M. musculus
ctaaggatccagggac

SEQ ID NO: 391738 - DNA, 16 bp, M. musculus
ctaaggatgaccctga

SEQ ID NO: 391739 - DNA, 16 bp, M. musculus
ctaaggatgatcttga

SEQ ID NO: 391740 - DNA, 16 bp, M. musculus
ctaaggattgattttt

SEQ ID NO: 391741 - DNA, 16 bp, M. musculus
ctaaggatttttctaa

SEQ ID NO: 391742 - DNA, 16 bp, M. musculus
ctaagggttaatctat

SEQ ID NO: 391743 - DNA, 16 bp, M. musculus
ctaaggtgaagagatt

SEQ ID NO: 391744 - DNA, 16 bp, M. musculus
ctaagtaagattcaag

SEQ ID NO: 391745 - DNA, 16 bp, M. musculus
ctaagtagccaaggat

SEQ ID NO: 391746 - DNA, 16 bp, M. musculus
ctaagtaggactaaag

SEQ ID NO: 391747 - DNA, 16 bp, M. musculus
ctaagtatttactatg

SEQ ID NO: 391748 - DNA, 16 bp, M. musculus
ctaagtgctgagatta

SEQ ID NO: 391749 - DNA, 16 bp, M. musculus
ctaagtgctgggatta

SEQ ID NO: 391750 - DNA, 16 bp, M. musculus
ctaagtggatcatgga

SEQ ID NO: 391751 - DNA, 16 bp, M. musculus
ctaagtgttgagatta

SEQ ID NO: 391752 - DNA, 16 bp, M. musculus
ctaagttataagtgaa

SEQ ID NO: 391753 - DNA, 16 bp, M. musculus
ctaagttcaattccca

SEQ ID NO: 391754 - DNA, 16 bp, M. musculus
ctaataaaaaagaagt

SEQ ID NO: 391755 - DNA, 16 bp, M. musculus
ctaataaaaatgaatt

SEQ ID NO: 391756 - DNA, 16 bp, M. musculus
ctaataaaaattggaa

SEQ ID NO: 391757 - DNA, 16 bp, M. musculus
ctaataaaatgcctta

SEQ ID NO: 391758 - DNA, 16 bp, M. musculus
ctaataaaatggaaaa

SEQ ID NO: 391759 - DNA, 16 bp, M. musculus
ctaataatagtaataa

SEQ ID NO: 391760 - DNA, 16 bp, M. musculus
ctaatagagaagaaag

SEQ ID NO: 391761 - DNA, 16 bp, M. musculus
ctaatagtgcctctcc

SEQ ID NO: 391762 - DNA, 16 bp, M. musculus
ctaatatgggtgctgg

SEQ ID NO: 391763 - DNA, 16 bp, M. musculus
ctaatatggttttgtt

SEQ ID NO: 391764 - DNA, 16 bp, M. musculus
ctaatatttgaaattt

SEQ ID NO: 391765 - DNA, 16 bp, M. musculus
ctaatattttaatgta

SEQ ID NO: 391766 - DNA, 16 bp, M. musculus
ctaatcctctggctcc

SEQ ID NO: 391767 - DNA, 16 bp, M. musculus
ctaatctcccatcaga

SEQ ID NO: 391768 - DNA, 16 bp, M. musculus
ctaatctccctggggc

SEQ ID NO: 391769 - DNA, 16 bp, M. musculus
ctaatgaccaagcatt

SEQ ID NO: 391770 - DNA, 16 bp, M. musculus
ctaatgattttttgaa

SEQ ID NO: 391771 - DNA, 16 bp, M. musculus
ctaatgctactgcagg

SEQ ID NO: 391772 - DNA, 16 bp, M. musculus
ctaattaaatgttgtc

SEQ ID NO: 391773 - DNA, 16 bp, M. musculus
ctaattaagaaaatca

SEQ ID NO: 391774 - DNA, 16 bp, M. musculus
ctaattaagcattaca

SEQ ID NO: 391775 - DNA, 17 bp, M. musculus
ctaattcattaagaaaa

SEQ ID NO: 391776 - DNA, 16 bp, M. musculus
ctaattctgtaacata

SEQ ID NO: 391777 - DNA, 16 bp, M. musculus
ctaattgagaaaatga

SEQ ID NO: 391778 - DNA, 16 bp, M. musculus
ctaattggaaaaaaaa

SEQ ID NO: 391779 - DNA, 16 bp, M. musculus
ctaattttccctctga

SEQ ID NO: 391780 - DNA, 16 bp, M. musculus
ctaattttgttaattt

SEQ ID NO: 391781 - DNA, 16 bp, M. musculus
ctacaaaacttttgac

SEQ ID NO: 391782 - DNA, 16 bp, M. musculus
ctacaaaaggctgtac

SEQ ID NO: 391783 - DNA, 16 bp, M. musculus
ctacaaagcaagaccc

SEQ ID NO: 391784 - DNA, 16 bp, M. musculus
ctacaaaggaagatcc

SEQ ID NO: 391785 - DNA, 16 bp, M. musculus
ctacaaagtaagttct

SEQ ID NO: 391786 - DNA, 16 bp, M. musculus
ctacaaagtcaactaa

SEQ ID NO: 391787 - DNA, 16 bp, M. musculus
ctacaaagttcatgct

SEQ ID NO: 391788 - DNA, 16 bp, M. musculus
ctacaagaacagcaag

SEQ ID NO: 391789 - DNA, 16 bp, M. musculus
ctacaagatgtgcaga

SEQ ID NO: 391790 - DNA, 17 bp, M. musculus
ctacaagcttccctgga

SEQ ID NO: 391791 - DNA, 16 bp, M. musculus
ctacaaggcattttct

SEQ ID NO: 391792 - DNA, 17 bp, M. musculus
ctacaaggggcatggct

SEQ ID NO: 391793 - DNA, 16 bp, M. musculus
ctacaataaaaacctt

SEQ ID NO: 391794 - DNA, 16 bp, M. musculus
ctacaatgacagagag

SEQ ID NO: 391795 - DNA, 16 bp, M. musculus
ctacaatggggcatca

SEQ ID NO: 391796 - DNA, 16 bp, M. musculus
ctacaatgtcacccag

SEQ ID NO: 391797 - DNA, 16 bp, M. musculus
ctacaattcattcctt

SEQ ID NO: 391798 - DNA, 16 bp, M. musculus
ctacacaactcactga

SEQ ID NO: 391799 - DNA, 16 bp, M. musculus
ctacacaagcatgagg

SEQ ID NO: 391800 - DNA, 16 bp, M. musculus
ctacacacagacacac

SEQ ID NO: 391801 - DNA, 16 bp, M. musculus
ctacacagaaaaactg

SEQ ID NO: 391802 - DNA, 16 bp, M. musculus
ctacacagagaaacag

SEQ ID NO: 391803 - DNA, 16 bp, M. musculus
ctacacagagaaactt

SEQ ID NO: 391804 - DNA, 16 bp, M. musculus
ctacacagagaaatcc

SEQ ID NO: 391805 - DNA, 16 bp, M. musculus
ctacacagagagatct

SEQ ID NO: 391806 - DNA, 16 bp, M. musculus
ctacacagagagctcc

SEQ ID NO: 391807 - DNA, 16 bp, M. musculus
ctacacagagccttca

SEQ ID NO: 391808 - DNA, 16 bp, M. musculus
ctacacagaggaaccc

SEQ ID NO: 391809 - DNA, 16 bp, M. musculus
ctacacagccctggct

SEQ ID NO: 391810 - DNA, 16 bp, M. musculus
ctacacatacatacat

SEQ ID NO: 391811 - DNA, 16 bp, M. musculus
ctacacatatgtagca

SEQ ID NO: 391812 - DNA, 16 bp, M. musculus
ctacaccaatgagaac

SEQ ID NO: 391813 - DNA, 16 bp, M. musculus
ctacacggtggctcac

SEQ ID NO: 391814 - DNA, 17 bp, M. musculus
ctacactacactacact

SEQ ID NO: 391815 - DNA, 16 bp, M. musculus
ctacactcccagcccc

SEQ ID NO: 391816 - DNA, 16 bp, M. musculus
ctacactgggcagctc

SEQ ID NO: 391817 - DNA, 16 bp, M. musculus
ctacactgggtcatcg

SEQ ID NO: 391818 - DNA, 16 bp, M. musculus
ctacacttctatgaaa

SEQ ID NO: 391819 - DNA, 16 bp, M. musculus
ctacacttgtttaaaa

SEQ ID NO: 391820 - DNA, 16 bp, M. musculus
ctacagaaaactacaa

SEQ ID NO: 391821 - DNA, 16 bp, M. musculus
ctacagaaacaggacc

SEQ ID NO: 391822 - DNA, 16 bp, M. musculus
ctacagaaaccaggaa

SEQ ID NO: 391823 - DNA, 16 bp, M. musculus
ctacagaaagaccaac

SEQ ID NO: 391824 - DNA, 16 bp, M. musculus
ctacagaaagagatgc

SEQ ID NO: 391825 - DNA, 16 bp, M. musculus
ctacagaacattttat

SEQ ID NO: 391826 - DNA, 16 bp, M. musculus
ctacagaatgagttca

SEQ ID NO: 391827 - DNA, 16 bp, M. musculus
ctacagaatggaaaaa

SEQ ID NO: 391828 - DNA, 16 bp, M. musculus
ctacagacactaagag

SEQ ID NO: 391829 - DNA, 16 bp, M. musculus
ctacagacagttgtga

SEQ ID NO: 391830 - DNA, 16 bp, M. musculus
ctacagagaaaacctg

SEQ ID NO: 391831 - DNA, 16 bp, M. musculus
ctacagagaaagttcc

SEQ ID NO: 391832 - DNA, 16 bp, M. musculus
ctacagagaacagcag

SEQ ID NO: 391833 - DNA, 16 bp, M. musculus
ctacagagatggctca

SEQ ID NO: 391834 - DNA, 16 bp, M. musculus
ctacagagcaagaccc

SEQ ID NO: 391835 - DNA, 16 bp, M. musculus
ctacagaggatcctgg

SEQ ID NO: 391836 - DNA, 16 bp, M. musculus
ctacagagtgagaacc

SEQ ID NO: 391837 - DNA, 16 bp, M. musculus
ctacagagtgagatcc

SEQ ID NO: 391838 - DNA, 16 bp, M. musculus
ctacagagtgtgttct

SEQ ID NO: 391839 - DNA, 16 bp, M. musculus
ctacagcaacataaca

SEQ ID NO: 391840 - DNA, 16 bp, M. musculus
ctacagcaatgggata

SEQ ID NO: 391841 - DNA, 16 bp, M. musculus
ctacagcaccatgtct

SEQ ID NO: 391842 - DNA, 16 bp, M. musculus
ctacagccatgagtcc

SEQ ID NO: 391843 - DNA, 18 bp, M. musculus
ctacagcccatgagtcag

SEQ ID NO: 391844 - DNA, 16 bp, M. musculus
ctacagccccagccct

SEQ ID NO: 391845 - DNA, 16 bp, M. musculus
ctacagcctcccacag

SEQ ID NO: 391846 - DNA, 16 bp, M. musculus
ctacagctacagctac

SEQ ID NO: 391847 - DNA, 16 bp, M. musculus
ctacagctggatctta

SEQ ID NO: 391848 - DNA, 16 bp, M. musculus
ctacagcttgatctta

SEQ ID NO: 391849 - DNA, 16 bp, M. musculus
ctacaggccagtctga

SEQ ID NO: 391850 - DNA, 16 bp, M. musculus
ctacaggccagtctta

SEQ ID NO: 391851 - DNA, 16 bp, M. musculus
ctacagggcacaggga

SEQ ID NO: 391852 - DNA, 16 bp, M. musculus
ctacaggttgtcctct

SEQ ID NO: 391853 - DNA, 26 bp, M. musculus
ctacagtctaggtgtagggggacatg

SEQ ID NO: 391854 - DNA, 16 bp, M. musculus
ctacagtgagaaagat

SEQ ID NO: 391855 - DNA, 16 bp, M. musculus
ctacagtggggagagg

SEQ ID NO: 391856 - DNA, 24 bp, M. musculus
ctacagtgtacttacatagaataa

SEQ ID NO: 391857 - DNA, 16 bp, M. musculus
ctacagtgtgcttata

SEQ ID NO: 391858 - DNA, 16 bp, M. musculus
ctacagttccaaggga

SEQ ID NO: 391859 - DNA, 16 bp, M. musculus
ctacagttcttttcaa

SEQ ID NO: 391860 - DNA, 16 bp, M. musculus
ctacataggcctggct

SEQ ID NO: 391861 - DNA, 16 bp, M. musculus
ctacatagtgagacct

SEQ ID NO: 391862 - DNA, 16 bp, M. musculus
ctacatagtgagatcc

SEQ ID NO: 391863 - DNA, 16 bp, M. musculus
ctacatagtgagttct

SEQ ID NO: 391864 - DNA, 16 bp, M. musculus
ctacatatacaaatac

SEQ ID NO: 391865 - DNA, 16 bp, M. musculus
ctacatatagaagaat

SEQ ID NO: 391866 - DNA, 16 bp, M. musculus
ctacatatatgtatat

SEQ ID NO: 391867 - DNA, 16 bp, M. musculus
ctacatatgcaagtag

SEQ ID NO: 391868 - DNA, 16 bp, M. musculus
ctacatcaaaaagcat

SEQ ID NO: 391869 - DNA, 16 bp, M. musculus
ctacatcactgaagct

SEQ ID NO: 391870 - DNA, 16 bp, M. musculus
ctacatcctcaccaac

SEQ ID NO: 391871 - DNA, 16 bp, M. musculus
ctacatctccagcccc

SEQ ID NO: 391872 - DNA, 16 bp, M. musculus
ctacatctgataaaca

SEQ ID NO: 391873 - DNA, 16 bp, M. musculus
ctacatctgcagccag

SEQ ID NO: 391874 - DNA, 16 bp, M. musculus
ctacatctgctttgcc

SEQ ID NO: 391875 - DNA, 16 bp, M. musculus
ctacatcttattccaa

SEQ ID NO: 391876 - DNA, 17 bp, M. musculus
ctacatgagaccctgtt

SEQ ID NO: 391877 - DNA, 16 bp, M. musculus
ctacatgcatgtggta

SEQ ID NO: 391878 - DNA, 16 bp, M. musculus
ctacatggagagaccc

SEQ ID NO: 391879 - DNA, 16 bp, M. musculus
ctacatgtgtgcagtg

SEQ ID NO: 391880 - DNA, 16 bp, M. musculus
ctacatttcccccttt

SEQ ID NO: 391881 - DNA, 16 bp, M. musculus
ctacattttggaagat

SEQ ID NO: 391882 - DNA, 16 bp, M. musculus
ctaccaagtgctggga

SEQ ID NO: 391883 - DNA, 16 bp, M. musculus
ctaccacacctggctt

SEQ ID NO: 391884 - DNA, 16 bp, M. musculus
ctaccacagctttaga

SEQ ID NO: 391885 - DNA, 16 bp, M. musculus
ctaccacatctggctt

SEQ ID NO: 391886 - DNA, 16 bp, M. musculus
ctaccaccaccaccag

SEQ ID NO: 391887 - DNA, 16 bp, M. musculus
ctaccaccacccagca

SEQ ID NO: 391888 - DNA, 16 bp, M. musculus
ctaccaccagcagcag

SEQ ID NO: 391889 - DNA, 16 bp, M. musculus
ctaccaccgcagctcc

SEQ ID NO: 391890 - DNA, 16 bp, M. musculus
ctaccactgaactaca

SEQ ID NO: 391891 - DNA, 16 bp, M. musculus
ctaccagcagcagcag

SEQ ID NO: 391892 - DNA, 16 bp, M. musculus
ctaccaggagccacac

SEQ ID NO: 391893 - DNA, 16 bp, M. musculus
ctaccagtgcctgaca

SEQ ID NO: 391894 - DNA, 16 bp, M. musculus
ctaccatcatcaccac

SEQ ID NO: 391895 - DNA, 16 bp, M. musculus
ctaccatccatccatc

SEQ ID NO: 391896 - DNA, 16 bp, M. musculus
ctaccatcctgtccct

SEQ ID NO: 391897 - DNA, 16 bp, M. musculus
ctaccatgcccagttt

SEQ ID NO: 391898 - DNA, 16 bp, M. musculus
ctaccatgcttcccac

SEQ ID NO: 391899 - DNA, 16 bp, M. musculus
ctaccatgtgttttct

SEQ ID NO: 391900 - DNA, 16 bp, M. musculus
ctaccatgttcccacc

SEQ ID NO: 391901 - DNA, 16 bp, M. musculus
ctacccacccatctca

SEQ ID NO: 391902 - DNA, 16 bp, M. musculus
ctacccacctgcttcc

SEQ ID NO: 391903 - DNA, 16 bp, M. musculus
ctacccactcctgctt

SEQ ID NO: 391904 - DNA, 16 bp, M. musculus
ctacccatccattccc

SEQ ID NO: 391905 - DNA, 16 bp, M. musculus
ctaccccagttcccca

SEQ ID NO: 391906 - DNA, 16 bp, M. musculus
ctaccccataggaaga

SEQ ID NO: 391907 - DNA, 16 bp, M. musculus
ctaccccatctatgaa

SEQ ID NO: 391908 - DNA, 16 bp, M. musculus
ctaccctctaagctat

SEQ ID NO: 391909 - DNA, 16 bp, M. musculus
ctaccctgctctcctt

SEQ ID NO: 391910 - DNA, 16 bp, M. musculus
ctaccctggaattccc

SEQ ID NO: 391911 - DNA, 16 bp, M. musculus
ctaccctgggatccat

SEQ ID NO: 391912 - DNA, 19 bp, M. musculus
ctacctacctacctaccta

SEQ ID NO: 391913 - DNA, 17 bp, M. musculus
ctacctagttgggaaaa

SEQ ID NO: 391914 - DNA, 16 bp, M. musculus
ctacctatccatccat

SEQ ID NO: 391915 - DNA, 16 bp, M. musculus
ctacctatctacctat

SEQ ID NO: 391916 - DNA, 16 bp, M. musculus
ctacctcagcctctca

SEQ ID NO: 391917 - DNA, 16 bp, M. musculus
ctacctcatctctgta

SEQ ID NO: 391918 - DNA, 16 bp, M. musculus
ctacctccagctaccc

SEQ ID NO: 391919 - DNA, 16 bp, M. musculus
ctacctcccaagtcct

SEQ ID NO: 391920 - DNA, 16 bp, M. musculus
ctacctcccaccagtc

SEQ ID NO: 391921 - DNA, 16 bp, M. musculus
ctacctcctgagtgtt

SEQ ID NO: 391922 - DNA, 16 bp, M. musculus
ctacctctacctctct

SEQ ID NO: 391923 - DNA, 16 bp, M. musculus
ctacctctccagctcc

SEQ ID NO: 391924 - DNA, 16 bp, M. musculus
ctacctctccagctct

SEQ ID NO: 391925 - DNA, 16 bp, M. musculus
ctacctctctctgcct

SEQ ID NO: 391926 - DNA, 16 bp, M. musculus
ctacctctgcctcctg

SEQ ID NO: 391927 - DNA, 16 bp, M. musculus
ctacctctggtggatg

SEQ ID NO: 391928 - DNA, 16 bp, M. musculus
ctacctgaagaaccag

SEQ ID NO: 391929 - DNA, 16 bp, M. musculus
ctacctgaagaccaag

SEQ ID NO: 391930 - DNA, 16 bp, M. musculus
ctacctgaagacccag

SEQ ID NO: 391931 - DNA, 16 bp, M. musculus
ctacctgaatacccag

SEQ ID NO: 391932 - DNA, 16 bp, M. musculus
ctacctgcccacccac

SEQ ID NO: 391933 - DNA, 16 bp, M. musculus
ctacctgcctctgcca

SEQ ID NO: 391934 - DNA, 16 bp, M. musculus
ctacctgcctctgcct

SEQ ID NO: 391935 - DNA, 16 bp, M. musculus
ctacctgcctgcctgc

SEQ ID NO: 391936 - DNA, 16 bp, M. musculus
ctacctgcctttgcct

SEQ ID NO: 391937 - DNA, 16 bp, M. musculus
ctacctgctgagccat

SEQ ID NO: 391938 - DNA, 16 bp, M. musculus
ctacctgctgctgctt

SEQ ID NO: 391939 - DNA, 16 bp, M. musculus
ctacctggactgcctg

SEQ ID NO: 391940 - DNA, 16 bp, M. musculus
ctacctgtctgtttct

SEQ ID NO: 391941 - DNA, 16 bp, M. musculus
ctacctgttctccctg

SEQ ID NO: 391942 - DNA, 16 bp, M. musculus
ctaccttcaaaatttt

SEQ ID NO: 391943 - DNA, 16 bp, M. musculus
ctaccttccactcatc

SEQ ID NO: 391944 - DNA, 16 bp, M. musculus
ctaccttgccaggccc

SEQ ID NO: 391945 - DNA, 16 bp, M. musculus
ctaccttgtcatgtag

SEQ ID NO: 391946 - DNA, 16 bp, M. musculus
ctacctttaatcccag

SEQ ID NO: 391947 - DNA, 16 bp, M. musculus
ctacctttctctgcct

SEQ ID NO: 391948 - DNA, 16 bp, M. musculus
ctacgactacgactac

SEQ ID NO: 391949 - DNA, 16 bp, M. musculus
ctacggaatcttctgc

SEQ ID NO: 391950 - DNA, 35 bp, M. musculus
ctacggatggtagcagccattgccgttctgacaaa

SEQ ID NO: 391951 - DNA, 16 bp, M. musculus
ctactacacccagcaa

SEQ ID NO: 391952 - DNA, 16 bp, M. musculus
ctactacataaacaaa

SEQ ID NO: 391953 - DNA, 16 bp, M. musculus
ctactactactactga

SEQ ID NO: 391954 - DNA, 16 bp, M. musculus
ctactactactattct

SEQ ID NO: 391955 - DNA, 16 bp, M. musculus
ctactacttcttcttc

SEQ ID NO: 391956 - DNA, 16 bp, M. musculus
ctactataaccagcca

SEQ ID NO: 391957 - DNA, 16 bp, M. musculus
ctactatgtgccaggt

SEQ ID NO: 391958 - DNA, 16 bp, M. musculus
ctactattactactac

SEQ ID NO: 391959 - DNA, 16 bp, M. musculus
ctactcacccattccc

SEQ ID NO: 391960 - DNA, 16 bp, M. musculus
ctactcagaggagaag

SEQ ID NO: 391961 - DNA, 16 bp, M. musculus
ctactcaggagactga

SEQ ID NO: 391962 - DNA, 16 bp, M. musculus
ctactcaggaggctga

SEQ ID NO: 391963 - DNA, 16 bp, M. musculus
ctactccacatcccac

SEQ ID NO: 391964 - DNA, 16 bp, M. musculus
ctactccctatgggcc

SEQ ID NO: 391965 - DNA, 16 bp, M. musculus
ctactccctggccccc

SEQ ID NO: 391966 - DNA, 16 bp, M. musculus
ctactcctattacaac

SEQ ID NO: 391967 - DNA, 16 bp, M. musculus
ctactcctcctgggtg

SEQ ID NO: 391968 - DNA, 17 bp, M. musculus
ctactcctgcttgtttc

SEQ ID NO: 391969 - DNA, 16 bp, M. musculus
ctactcggccatcact

SEQ ID NO: 391970 - DNA, 17 bp, M. musculus
ctactcggccatcattg

SEQ ID NO: 391971 - DNA, 16 bp, M. musculus
ctactctagaaatcag

SEQ ID NO: 391972 - DNA, 16 bp, M. musculus
ctactctgtgactcca

SEQ ID NO: 391973 - DNA, 16 bp, M. musculus
ctactcttacaaagga

SEQ ID NO: 391974 - DNA, 17 bp, M. musculus
ctactcttccagaggac

SEQ ID NO: 391975 - DNA, 16 bp, M. musculus
ctactcttgcagaaga

SEQ ID NO: 391976 - DNA, 16 bp, M. musculus
ctactgaaagatccag

SEQ ID NO: 391977 - DNA, 16 bp, M. musculus
ctactgacactttgga

SEQ ID NO: 391978 - DNA, 16 bp, M. musculus
ctactgacttctattg

SEQ ID NO: 391979 - DNA, 16 bp, M. musculus
ctactgagccatttct

SEQ ID NO: 391980 - DNA, 16 bp, M. musculus
ctactgagtgctggga

SEQ ID NO: 391981 - DNA, 16 bp, M. musculus
ctactgattgggaaaa

SEQ ID NO: 391982 - DNA, 16 bp, M. musculus
ctactgctactgctac

SEQ ID NO: 391983 - DNA, 16 bp, M. musculus
ctactgctgctactac

SEQ ID NO: 391984 - DNA, 16 bp, M. musculus
ctactgctgctgctac

SEQ ID NO: 391985 - DNA, 16 bp, M. musculus
ctactgctgctgctgc

SEQ ID NO: 391986 - DNA, 16 bp, M. musculus
ctactgctgctgttct

SEQ ID NO: 391987 - DNA, 16 bp, M. musculus
ctactgctggtctgag

SEQ ID NO: 391988 - DNA, 16 bp, M. musculus
ctactggaagacccag

SEQ ID NO: 391989 - DNA, 16 bp, M. musculus
ctactggaggaatgct

SEQ ID NO: 391990 - DNA, 20 bp, M. musculus
ctactggaggatccagcaat

SEQ ID NO: 391991 - DNA, 16 bp, M. musculus
ctactgggctggagag

SEQ ID NO: 391992 - DNA, 16 bp, M. musculus
ctactggtttgctttt

SEQ ID NO: 391993 - DNA, 16 bp, M. musculus
ctactgtgagttcatg

SEQ ID NO: 391994 - DNA, 16 bp, M. musculus
ctactgtgctgaagct

SEQ ID NO: 391995 - DNA, 16 bp, M. musculus
ctactgtgtcacctca

SEQ ID NO: 391996 - DNA, 16 bp, M. musculus
ctactgttgggtattt

SEQ ID NO: 391997 - DNA, 16 bp, M. musculus
ctacttagtgagttcc

SEQ ID NO: 391998 - DNA, 16 bp, M. musculus
ctacttcaagctcctg

SEQ ID NO: 391999 - DNA, 16 bp, M. musculus
ctacttcaagttcctg

SEQ ID NO: 392000 - DNA, 16 bp, M. musculus
ctacttcctgctgatg

SEQ ID NO: 392001 - DNA, 16 bp, M. musculus
ctacttcctgtgtgtc

SEQ ID NO: 392002 - DNA, 16 bp, M. musculus
ctacttctaaacaggc

SEQ ID NO: 392003 - DNA, 16 bp, M. musculus
ctacttctgcctctca

SEQ ID NO: 392004 - DNA, 16 bp, M. musculus
ctacttctgtatttgt

SEQ ID NO: 392005 - DNA, 16 bp, M. musculus
ctacttctgtttcttt

SEQ ID NO: 392006 - DNA, 16 bp, M. musculus
ctacttctttgggatt

SEQ ID NO: 392007 - DNA, 16 bp, M. musculus
ctacttgcttctgcct

SEQ ID NO: 392008 - DNA, 16 bp, M. musculus
ctacttggccatcagt

SEQ ID NO: 392009 - DNA, 16 bp, M. musculus
ctacttggtggctcac

SEQ ID NO: 392010 - DNA, 16 bp, M. musculus
ctacttgtgtgtgtgt

SEQ ID NO: 392011 - DNA, 16 bp, M. musculus
ctactttaataagggt

SEQ ID NO: 392012 - DNA, 16 bp, M. musculus
ctactttccctcccag

SEQ ID NO: 392013 - DNA, 16 bp, M. musculus
ctactttcctctctga

SEQ ID NO: 392014 - DNA, 16 bp, M. musculus
ctactttctcactgtc

SEQ ID NO: 392015 - DNA, 16 bp, M. musculus
ctactttctctctctg

SEQ ID NO: 392016 - DNA, 16 bp, M. musculus
ctactttgtaactgca

SEQ ID NO: 392017 - DNA, 16 bp, M. musculus
ctactttttaaaaaag

SEQ ID NO: 392018 - DNA, 16 bp, M. musculus
ctagaaaaaaatcatt

SEQ ID NO: 392019 - DNA, 16 bp, M. musculus
ctagaaaaagaggaag

SEQ ID NO: 392020 - DNA, 16 bp, M. musculus
ctagaaaaatcaagaa

SEQ ID NO: 392021 - DNA, 16 bp, M. musculus
ctagaaaagcaagaaa

SEQ ID NO: 392022 - DNA, 65 bp, M. musculus
ctagaaaaggttgtgagtcaggctcgtgggaaaggacagaatatgtctaatacgctagcctttcc

SEQ ID NO: 392023 - DNA, 16 bp, M. musculus
ctagaaaatcaaataa

SEQ ID NO: 392024 - DNA, 16 bp, M. musculus
ctagaaatgacaggga

SEQ ID NO: 392025 - DNA, 16 bp, M. musculus
ctagaacaagaagaag

SEQ ID NO: 392026 - DNA, 16 bp, M. musculus
ctagaactccagctcc

SEQ ID NO: 392027 - DNA, 16 bp, M. musculus
ctagaacttcaagtat

SEQ ID NO: 392028 - DNA, 16 bp, M. musculus
ctagaacttgctttgt

SEQ ID NO: 392029 - DNA, 16 bp, M. musculus
ctagaagaaaaggaag

SEQ ID NO: 392030 - DNA, 16 bp, M. musculus
ctagaagaaactattg

SEQ ID NO: 392031 - DNA, 16 bp, M. musculus
ctagaagaagaagaag

SEQ ID NO: 392032 - DNA, 16 bp, M. musculus
ctagaagacaatgtgt

SEQ ID NO: 392033 - DNA, 16 bp, M. musculus
ctagaagacagcttct

SEQ ID NO: 392034 - DNA, 16 bp, M. musculus
ctagaagagcaacaag

SEQ ID NO: 392035 - DNA, 16 bp, M. musculus
ctagaagagggtgtca

SEQ ID NO: 392036 - DNA, 16 bp, M. musculus
ctagaagatgggtcag

SEQ ID NO: 392037 - DNA, 16 bp, M. musculus
ctagaatattttcagc

SEQ ID NO: 392038 - DNA, 16 bp, M. musculus
ctagaatcaccaggga

SEQ ID NO: 392039 - DNA, 16 bp, M. musculus
ctagaatcacctgaga

SEQ ID NO: 392040 - DNA, 16 bp, M. musculus
ctagaatcacctggga

SEQ ID NO: 392041 - DNA, 16 bp, M. musculus
ctagaatgaaaggaag

SEQ ID NO: 392042 - DNA, 16 bp, M. musculus
ctagaatgagggtctt

SEQ ID NO: 392043 - DNA, 16 bp, M. musculus
ctagaattcctgatct

SEQ ID NO: 392044 - DNA, 16 bp, M. musculus
ctagaccagctggcca

SEQ ID NO: 392045 - DNA, 17 bp, M. musculus
ctagaccaggctggcct

SEQ ID NO: 392046 - DNA, 16 bp, M. musculus
ctagactggctggcca

SEQ ID NO: 392047 - DNA, 16 bp, M. musculus
ctagacttcaataaaa

SEQ ID NO: 392048 - DNA, 16 bp, M. musculus
ctagacttggtaatgt

SEQ ID NO: 392049 - DNA, 16 bp, M. musculus
ctagactttaaaaaaa

SEQ ID NO: 392050 - DNA, 16 bp, M. musculus
ctagagaaacgagctc

SEQ ID NO: 392051 - DNA, 16 bp, M. musculus
ctagagaaagtaaaca

SEQ ID NO: 392052 - DNA, 16 bp, M. musculus
ctagagaaattaccca

SEQ ID NO: 392053 - DNA, 16 bp, M. musculus
ctagagaaccctgaca

SEQ ID NO: 392054 - DNA, 16 bp, M. musculus
ctagagaagtacccaa

SEQ ID NO: 392055 - DNA, 16 bp, M. musculus
ctagagacaggagttc

SEQ ID NO: 392056 - DNA, 16 bp, M. musculus
ctagagagagagagag

SEQ ID NO: 392057 - DNA, 16 bp, M. musculus
ctagagagatggctta

SEQ ID NO: 392058 - DNA, 16 bp, M. musculus
ctagagatggagcaag

SEQ ID NO: 392059 - DNA, 16 bp, M. musculus
ctagagcagtgggtct

SEQ ID NO: 392060 - DNA, 16 bp, M. musculus
ctagagcctctcctcc

SEQ ID NO: 392061 - DNA, 16 bp, M. musculus
ctagagcgatggctca

SEQ ID NO: 392062 - DNA, 16 bp, M. musculus
ctagagctaggcagat

SEQ ID NO: 392063 - DNA, 16 bp, M. musculus
ctagagctatctgaaa

SEQ ID NO: 392064 - DNA, 16 bp, M. musculus
ctagagctgaccctgt

SEQ ID NO: 392065 - DNA, 16 bp, M. musculus
ctagagctggaattac

SEQ ID NO: 392066 - DNA, 16 bp, M. musculus
ctagaggaaaagctgt

SEQ ID NO: 392067 - DNA, 16 bp, M. musculus
ctagaggcaggagctg

SEQ ID NO: 392068 - DNA, 16 bp, M. musculus
ctagaggctgaggcag

SEQ ID NO: 392069 - DNA, 16 bp, M. musculus
ctagagggcattatcc

SEQ ID NO: 392070 - DNA, 16 bp, M. musculus
ctagagtcaagggctc

SEQ ID NO: 392071 - DNA, 16 bp, M. musculus
ctagagtcctctgaga

SEQ ID NO: 392072 - DNA, 28 bp, M. musculus
ctagagttaagaatggaaggaactactg

SEQ ID NO: 392073 - DNA, 16 bp, M. musculus
ctagagttatctgaaa

SEQ ID NO: 392074 - DNA, 16 bp, M. musculus
ctagagttatctgaga

SEQ ID NO: 392075 - DNA, 16 bp, M. musculus
ctagatataaaattaa

SEQ ID NO: 392076 - DNA, 16 bp, M. musculus
ctagatatcaacaaac

SEQ ID NO: 392077 - DNA, 16 bp, M. musculus
ctagatattttatatt

SEQ ID NO: 392078 - DNA, 16 bp, M. musculus
ctagatcataactaaa

SEQ ID NO: 392079 - DNA, 16 bp, M. musculus
ctagatctctccttag

SEQ ID NO: 392080 - DNA, 18 bp, M. musculus
ctagatggtccatccttt

SEQ ID NO: 392081 - DNA, 20 bp, M. musculus
ctagatgtcctgacagctaa

SEQ ID NO: 392082 - DNA, 16 bp, M. musculus
ctagattcttggactt

SEQ ID NO: 392083 - DNA, 16 bp, M. musculus
ctagattgtgtgtgtg

SEQ ID NO: 392084 - DNA, 16 bp, M. musculus
ctagcaaacacataat

SEQ ID NO: 392085 - DNA, 16 bp, M. musculus
ctagcaagctgggtgg

SEQ ID NO: 392086 - DNA, 16 bp, M. musculus
ctagcacgtgggaggc

SEQ ID NO: 392087 - DNA, 16 bp, M. musculus
ctagcacttggaaggt

SEQ ID NO: 392088 - DNA, 16 bp, M. musculus
ctagcacttgggaagt

SEQ ID NO: 392089 - DNA, 16 bp, M. musculus
ctagcagattgacagc

SEQ ID NO: 392090 - DNA, 16 bp, M. musculus
ctagcagtctgacagc

SEQ ID NO: 392091 - DNA, 16 bp, M. musculus
ctagcatcctccttct

SEQ ID NO: 392092 - DNA, 16 bp, M. musculus
ctagcatttgggaagc

SEQ ID NO: 392093 - DNA, 16 bp, M. musculus
ctagccagtacagctg

SEQ ID NO: 392094 - DNA, 16 bp, M. musculus
ctagccatggaggcag

SEQ ID NO: 392095 - DNA, 16 bp, M. musculus
ctagcccaaagtcaaa

SEQ ID NO: 392096 - DNA, 16 bp, M. musculus
ctagccctggaagctt

SEQ ID NO: 392097 - DNA, 16 bp, M. musculus
ctagcctcaaactcat

SEQ ID NO: 392098 - DNA, 16 bp, M. musculus
ctagcctccaactcac

SEQ ID NO: 392099 - DNA, 16 bp, M. musculus
ctagcctccaagggca

SEQ ID NO: 392100 - DNA, 16 bp, M. musculus
ctagcctctcagagac

SEQ ID NO: 392101 - DNA, 16 bp, M. musculus
ctagcctgagctacct

SEQ ID NO: 392102 - DNA, 16 bp, M. musculus
ctagcctgctctacaa

SEQ ID NO: 392103 - DNA, 16 bp, M. musculus
ctagcctggagctcac

SEQ ID NO: 392104 - DNA, 16 bp, M. musculus
ctagcctggattacat

SEQ ID NO: 392105 - DNA, 16 bp, M. musculus
ctagcctggtcttcag

SEQ ID NO: 392106 - DNA, 16 bp, M. musculus
ctagccttccttctct

SEQ ID NO: 392107 - DNA, 16 bp, M. musculus
ctagccttgaactcta

SEQ ID NO: 392108 - DNA, 16 bp, M. musculus
ctagccttgaatttgc

SEQ ID NO: 392109 - DNA, 16 bp, M. musculus
ctagctatcctgaaac

SEQ ID NO: 392110 - DNA, 16 bp, M. musculus
ctagctctactgtgct

SEQ ID NO: 392111 - DNA, 16 bp, M. musculus
ctagctctagtctcta

SEQ ID NO: 392112 - DNA, 16 bp, M. musculus
ctagctgaatcaatga

SEQ ID NO: 392113 - DNA, 16 bp, M. musculus
ctagctgagactccta

SEQ ID NO: 392114 - DNA, 16 bp, M. musculus
ctagctgaggacaaag

SEQ ID NO: 392115 - DNA, 16 bp, M. musculus
ctagctgcctagaagt

SEQ ID NO: 392116 - DNA, 16 bp, M. musculus
ctagctgcctgaggat

SEQ ID NO: 392117 - DNA, 16 bp, M. musculus
ctagctgcctggaagg

SEQ ID NO: 392118 - DNA, 16 bp, M. musculus
ctagctggccagtgag

SEQ ID NO: 392119 - DNA, 16 bp, M. musculus
ctagctgggctgcctt

SEQ ID NO: 392120 - DNA, 16 bp, M. musculus
ctagctgtgcaacact

SEQ ID NO: 392121 - DNA, 16 bp, M. musculus
ctagctgttataaata

SEQ ID NO: 392122 - DNA, 16 bp, M. musculus
ctagcttcaaggaccc

SEQ ID NO: 392123 - DNA, 16 bp, M. musculus
ctagcttcaggttcag

SEQ ID NO: 392124 - DNA, 16 bp, M. musculus
ctagcttcccttcaag

SEQ ID NO: 392125 - DNA, 16 bp, M. musculus
ctagcttgggctacat

SEQ ID NO: 392126 - DNA, 16 bp, M. musculus
ctaggaaaaaaggaag

SEQ ID NO: 392127 - DNA, 16 bp, M. musculus
ctaggaaaatggatgg

SEQ ID NO: 392128 - DNA, 16 bp, M. musculus
ctaggaaagaaaactg

SEQ ID NO: 392129 - DNA, 16 bp, M. musculus
ctaggaaagatcagga

SEQ ID NO: 392130 - DNA, 23 bp, M. musculus
ctaggaaattggagtcatgatct

SEQ ID NO: 392131 - DNA, 16 bp, M. musculus
ctaggaatcattttat

SEQ ID NO: 392132 - DNA, 16 bp, M. musculus
ctaggaatgtggctca

SEQ ID NO: 392133 - DNA, 16 bp, M. musculus
ctaggaattaaaccca

SEQ ID NO: 392134 - DNA, 16 bp, M. musculus
ctaggacagccagaga

SEQ ID NO: 392135 - DNA, 16 bp, M. musculus
ctaggacaggcagaag

SEQ ID NO: 392136 - DNA, 16 bp, M. musculus
ctaggacattggaaca

SEQ ID NO: 392137 - DNA, 16 bp, M. musculus
ctaggacccacatggt

SEQ ID NO: 392138 - DNA, 16 bp, M. musculus
ctaggactatacagag

SEQ ID NO: 392139 - DNA, 16 bp, M. musculus
ctaggagaatgaatgg

SEQ ID NO: 392140 - DNA, 16 bp, M. musculus
ctaggagatatttatt

SEQ ID NO: 392141 - DNA, 16 bp, M. musculus
ctaggagtcttagcta

SEQ ID NO: 392142 - DNA, 16 bp, M. musculus
ctaggagtgggctttg

SEQ ID NO: 392143 - DNA, 16 bp, M. musculus
ctaggatgtagctcag

SEQ ID NO: 392144 - DNA, 16 bp, M. musculus
ctaggattaaaggtgt

SEQ ID NO: 392145 - DNA, 16 bp, M. musculus
ctaggcaagcgttcta

SEQ ID NO: 392146 - DNA, 16 bp, M. musculus
ctaggcaagtactcta

SEQ ID NO: 392147 - DNA, 16 bp, M. musculus
ctaggcagcttccctt

SEQ ID NO: 392148 - DNA, 16 bp, M. musculus
ctaggcaggctggcca

SEQ ID NO: 392149 - DNA, 16 bp, M. musculus
ctaggcaggtgatcct

SEQ ID NO: 392150 - DNA, 16 bp, M. musculus
ctaggcccctccctcc

SEQ ID NO: 392151 - DNA, 19 bp, M. musculus
ctaggcctttaggcccagg

SEQ ID NO: 392152 - DNA, 16 bp, M. musculus
ctaggctaaccttgaa

SEQ ID NO: 392153 - DNA, 16 bp, M. musculus
ctaggctacagagtaa

SEQ ID NO: 392154 - DNA, 16 bp, M. musculus
ctaggctacatagcaa

SEQ ID NO: 392155 - DNA, 16 bp, M. musculus
ctaggctagccttgaa

SEQ ID NO: 392156 - DNA, 16 bp, M. musculus
ctaggctagctttgaa

SEQ ID NO: 392157 - DNA, 16 bp, M. musculus
ctaggctattgtaaat

SEQ ID NO: 392158 - DNA, 16 bp, M. musculus
ctaggctccacctctt

SEQ ID NO: 392159 - DNA, 16 bp, M. musculus
ctaggctggccttgaa

SEQ ID NO: 392160 - DNA, 16 bp, M. musculus
ctaggctggtcttgaa

SEQ ID NO: 392161 - DNA, 16 bp, M. musculus
ctagggaccttgggag

SEQ ID NO: 392162 - DNA, 16 bp, M. musculus
ctagggagactgaggc

SEQ ID NO: 392163 - DNA, 16 bp, M. musculus
ctagggccttgtgcat

SEQ ID NO: 392164 - DNA, 16 bp, M. musculus
ctagggctttgtgcat

SEQ ID NO: 392165 - DNA, 16 bp, M. musculus
ctaggggaaaaaaaaa

SEQ ID NO: 392166 - DNA, 19 bp, M. musculus
ctaggggctggtgagatgg

SEQ ID NO: 392167 - DNA, 16 bp, M. musculus
ctagggtccttccccc

SEQ ID NO: 392168 - DNA, 16 bp, M. musculus
ctaggtagctctggct

SEQ ID NO: 392169 - DNA, 16 bp, M. musculus
ctaggtccagcctgtg

SEQ ID NO: 392170 - DNA, 16 bp, M. musculus
ctaggtgctgggatta

SEQ ID NO: 392171 - DNA, 16 bp, M. musculus
ctaggttcagttccca

SEQ ID NO: 392172 - DNA, 16 bp, M. musculus
ctagtagctacatctt

SEQ ID NO: 392173 - DNA, 16 bp, M. musculus
ctagtatcttctgtag

SEQ ID NO: 392174 - DNA, 16 bp, M. musculus
ctagtatgtgctttct

SEQ ID NO: 392175 - DNA, 16 bp, M. musculus
ctagtcactgcccatt

SEQ ID NO: 392176 - DNA, 16 bp, M. musculus
ctagtcatcttcctgg

SEQ ID NO: 392177 - DNA, 16 bp, M. musculus
ctagtcctctggaaga

SEQ ID NO: 392178 - DNA, 16 bp, M. musculus
ctagtcggccatcatc

SEQ ID NO: 392179 - DNA, 16 bp, M. musculus
ctagtctacacagaga

SEQ ID NO: 392180 - DNA, 16 bp, M. musculus
ctagtctggctggcca

SEQ ID NO: 392181 - DNA, 16 bp, M. musculus
ctagtgaagaaacctg

SEQ ID NO: 392182 - DNA, 16 bp, M. musculus
ctagtgagatgactca

SEQ ID NO: 392183 - DNA, 16 bp, M. musculus
ctagtgtcacagcctt

SEQ ID NO: 392184 - DNA, 16 bp, M. musculus
ctagtgtgtctgaaga

SEQ ID NO: 392185 - DNA, 16 bp, M. musculus
ctagttcaacaaagta

SEQ ID NO: 392186 - DNA, 16 bp, M. musculus
ctagttccatcccttt

SEQ ID NO: 392187 - DNA, 16 bp, M. musculus
ctagttccatctgttt

SEQ ID NO: 392188 - DNA, 16 bp, M. musculus
ctagttcctgccagtc

SEQ ID NO: 392189 - DNA, 16 bp, M. musculus
ctagttctattcattt

SEQ ID NO: 392190 - DNA, 17 bp, M. musculus
ctagttggccatcattg

SEQ ID NO: 392191 - DNA, 16 bp, M. musculus
ctataaaatgaaataa

SEQ ID NO: 392192 - DNA, 16 bp, M. musculus
ctataaacactataaa

SEQ ID NO: 392193 - DNA, 16 bp, M. musculus
ctataaattttcctct

SEQ ID NO: 392194 - DNA, 16 bp, M. musculus
ctataacaaaatacct

SEQ ID NO: 392195 - DNA, 17 bp, M. musculus
ctataacagtcaagtat

SEQ ID NO: 392196 - DNA, 16 bp, M. musculus
ctataaccagactcaa

SEQ ID NO: 392197 - DNA, 16 bp, M. musculus
ctataaccccagcact

SEQ ID NO: 392198 - DNA, 16 bp, M. musculus
ctataagagcagaaaa

SEQ ID NO: 392199 - DNA, 16 bp, M. musculus
ctataagccagctcca

SEQ ID NO: 392200 - DNA, 16 bp, M. musculus
ctataagtgctctgac

SEQ ID NO: 392201 - DNA, 16 bp, M. musculus
ctataatcacagcact

SEQ ID NO: 392202 - DNA, 16 bp, M. musculus
ctataatccagaaatg

SEQ ID NO: 392203 - DNA, 16 bp, M. musculus
ctataatcccagcact

SEQ ID NO: 392204 - DNA, 16 bp, M. musculus
ctataatcctagcact

SEQ ID NO: 392205 - DNA, 16 bp, M. musculus
ctataatctcagcact

SEQ ID NO: 392206 - DNA, 16 bp, M. musculus
ctataatctcagtact

SEQ ID NO: 392207 - DNA, 16 bp, M. musculus
ctataattaaaagcag

SEQ ID NO: 392208 - DNA, 16 bp, M. musculus
ctataattctagcact

SEQ ID NO: 392209 - DNA, 16 bp, M. musculus
ctataatttttgaaga

SEQ ID NO: 392210 - DNA, 16 bp, M. musculus
ctataccactcctgga

SEQ ID NO: 392211 - DNA, 16 bp, M. musculus
ctatacctgcttataa

SEQ ID NO: 392212 - DNA, 16 bp, M. musculus
ctatacggagaaaccc

SEQ ID NO: 392213 - DNA, 16 bp, M. musculus
ctatactcaaccaaac

SEQ ID NO: 392214 - DNA, 16 bp, M. musculus
ctatactccattttta

SEQ ID NO: 392215 - DNA, 16 bp, M. musculus
ctatagagaccagaag

SEQ ID NO: 392216 - DNA, 16 bp, M. musculus
ctataggaagaccagc

SEQ ID NO: 392217 - DNA, 16 bp, M. musculus
ctatagtgtatttaca

SEQ ID NO: 392218 - DNA, 16 bp, M. musculus
ctatagttcctttaaa

SEQ ID NO: 392219 - DNA, 16 bp, M. musculus
ctatagttctgcctga

SEQ ID NO: 392220 - DNA, 16 bp, M. musculus
ctatatactcatcaaa

SEQ ID NO: 392221 - DNA, 16 bp, M. musculus
ctatatcaaggtcctt

SEQ ID NO: 392222 - DNA, 17 bp, M. musculus
ctatatcagggccctgt

SEQ ID NO: 392223 - DNA, 16 bp, M. musculus
ctatatccattccttt

SEQ ID NO: 392224 - DNA, 16 bp, M. musculus
ctatatggtgagttcc

SEQ ID NO: 392225 - DNA, 16 bp, M. musculus
ctatatgtatgtatgt

SEQ ID NO: 392226 - DNA, 16 bp, M. musculus
ctatatgtcaaaaatt

SEQ ID NO: 392227 - DNA, 16 bp, M. musculus
ctatatgtgtgtctgt

SEQ ID NO: 392228 - DNA, 16 bp, M. musculus
ctatattactatatta

SEQ ID NO: 392229 - DNA, 16 bp, M. musculus
ctatattcctttagca

SEQ ID NO: 392230 - DNA, 16 bp, M. musculus
ctatcacagtcccaca

SEQ ID NO: 392231 - DNA, 16 bp, M. musculus
ctatcacctccccact

SEQ ID NO: 392232 - DNA, 16 bp, M. musculus
ctatcactctccacct

SEQ ID NO: 392233 - DNA, 16 bp, M. musculus
ctatcacttgagtttt

SEQ ID NO: 392234 - DNA, 16 bp, M. musculus
ctatcatctacctacc

SEQ ID NO: 392235 - DNA, 16 bp, M. musculus
ctatcatgactgctct

SEQ ID NO: 392236 - DNA, 16 bp, M. musculus
ctatcatgtccagaag

SEQ ID NO: 392237 - DNA, 16 bp, M. musculus
ctatcattctatctat

SEQ ID NO: 392238 - DNA, 16 bp, M. musculus
ctatccactcctgctt

SEQ ID NO: 392239 - DNA, 16 bp, M. musculus
ctatccatccacccac

SEQ ID NO: 392240 - DNA, 16 bp, M. musculus
ctatccctctgtctct

SEQ ID NO: 392241 - DNA, 16 bp, M. musculus
ctatcctaatttcttg

SEQ ID NO: 392242 - DNA, 16 bp, M. musculus
ctatcctctgagaggc

SEQ ID NO: 392243 - DNA, 16 bp, M. musculus
ctatcctgaaagtccc

SEQ ID NO: 392244 - DNA, 16 bp, M. musculus
ctatcctgagctacat

SEQ ID NO: 392245 - DNA, 16 bp, M. musculus
ctatcctggatttttt

SEQ ID NO: 392246 - DNA, 16 bp, M. musculus
ctatctacctgtctgt

SEQ ID NO: 392247 - DNA, 16 bp, M. musculus
ctatctatcatctatt

SEQ ID NO: 392248 - DNA, 16 bp, M. musculus
ctatctatctatccat

SEQ ID NO: 392249 - DNA, 21 bp, M. musculus
ctatctatctatctatctact

SEQ ID NO: 392250 - DNA, 23 bp, M. musculus
ctatctatctatctatctatcaa

SEQ ID NO: 392251 - DNA, 28 bp, M. musculus
ctatctatctatctatctatctatctag

SEQ ID NO: 392252 - DNA, 20 bp, M. musculus
ctatctatctatctatctga

SEQ ID NO: 392253 - DNA, 16 bp, M. musculus
ctatctatctgtctct

SEQ ID NO: 392254 - DNA, 18 bp, M. musculus
ctatctatctgtctgtct

SEQ ID NO: 392255 - DNA, 16 bp, M. musculus
ctatctcagaataaaa

SEQ ID NO: 392256 - DNA, 16 bp, M. musculus
ctatctcagcctccca

SEQ ID NO: 392257 - DNA, 16 bp, M. musculus
ctatctcagcctcctg

SEQ ID NO: 392258 - DNA, 16 bp, M. musculus
ctatctccccagtgct

SEQ ID NO: 392259 - DNA, 16 bp, M. musculus
ctatctctagaaccca

SEQ ID NO: 392260 - DNA, 16 bp, M. musculus
ctatctctatctatct

SEQ ID NO: 392261 - DNA, 16 bp, M. musculus
ctatctctctatctat

SEQ ID NO: 392262 - DNA, 16 bp, M. musculus
ctatctctctgcctct

SEQ ID NO: 392263 - DNA, 16 bp, M. musculus
ctatctctgactcagt

SEQ ID NO: 392264 - DNA, 16 bp, M. musculus
ctatctctgtgtctct

SEQ ID NO: 392265 - DNA, 16 bp, M. musculus
ctatctgaaagtttat

SEQ ID NO: 392266 - DNA, 16 bp, M. musculus
ctatctgatcaccatg

SEQ ID NO: 392267 - DNA, 16 bp, M. musculus
ctatctgcctctgact

SEQ ID NO: 392268 - DNA, 16 bp, M. musculus
ctatctggaaaaaaaa

SEQ ID NO: 392269 - DNA, 16 bp, M. musculus
ctatcttcagacacca

SEQ ID NO: 392270 - DNA, 16 bp, M. musculus
ctatcttcagatacac

SEQ ID NO: 392271 - DNA, 17 bp, M. musculus
ctatcttcatccattaa

SEQ ID NO: 392272 - DNA, 16 bp, M. musculus
ctatcttcatttagtg

SEQ ID NO: 392273 - DNA, 16 bp, M. musculus
ctatcttccaaaaatg

SEQ ID NO: 392274 - DNA, 16 bp, M. musculus
ctatcttctttcagct

SEQ ID NO: 392275 - DNA, 16 bp, M. musculus
ctatcttggaacttgc

SEQ ID NO: 392276 - DNA, 16 bp, M. musculus
ctatcttttgtattct

SEQ ID NO: 392277 - DNA, 16 bp, M. musculus
ctatgaaaacacaaac

SEQ ID NO: 392278 - DNA, 16 bp, M. musculus
ctatgaaaagatcaaa

SEQ ID NO: 392279 - DNA, 16 bp, M. musculus
ctatgaacatactgga

SEQ ID NO: 392280 - DNA, 16 bp, M. musculus
ctatgaagaccaggct

SEQ ID NO: 392281 - DNA, 16 bp, M. musculus
ctatgaagacttgatg

SEQ ID NO: 392282 - DNA, 16 bp, M. musculus
ctatgaaggagctaga

SEQ ID NO: 392283 - DNA, 16 bp, M. musculus
ctatgaaggcatgatg

SEQ ID NO: 392284 - DNA, 16 bp, M. musculus
ctatgacaacctgacc

SEQ ID NO: 392285 - DNA, 16 bp, M. musculus
ctatgaccaaaagcaa

SEQ ID NO: 392286 - DNA, 17 bp, M. musculus
ctatgacgccaaagatg

SEQ ID NO: 392287 - DNA, 16 bp, M. musculus
ctatgagatccagctg

SEQ ID NO: 392288 - DNA, 16 bp, M. musculus
ctatgagggccattct

SEQ ID NO: 392289 - DNA, 16 bp, M. musculus
ctatgagggtgactct

SEQ ID NO: 392290 - DNA, 16 bp, M. musculus
ctatgaggttgcaaac

SEQ ID NO: 392291 - DNA, 16 bp, M. musculus
ctatgaggttgccctc

SEQ ID NO: 392292 - DNA, 16 bp, M. musculus
ctatgagtatagcaga

SEQ ID NO: 392293 - DNA, 16 bp, M. musculus
ctatgagtgtagcaga

SEQ ID NO: 392294 - DNA, 16 bp, M. musculus
ctatgagttctcctct

SEQ ID NO: 392295 - DNA, 16 bp, M. musculus
ctatgatctcagcact

SEQ ID NO: 392296 - DNA, 16 bp, M. musculus
ctatgattttttttaa

SEQ ID NO: 392297 - DNA, 16 bp, M. musculus
ctatgcaaaccaacca

SEQ ID NO: 392298 - DNA, 16 bp, M. musculus
ctatgcaaaccaggct

SEQ ID NO: 392299 - DNA, 16 bp, M. musculus
ctatgcaatgtaaggt

SEQ ID NO: 392300 - DNA, 16 bp, M. musculus
ctatgccagtgactgg

SEQ ID NO: 392301 - DNA, 16 bp, M. musculus
ctatgccccaaataca

SEQ ID NO: 392302 - DNA, 16 bp, M. musculus
ctatgccctgctggga

SEQ ID NO: 392303 - DNA, 21 bp, M. musculus
ctatgccggggcctagcaaac

SEQ ID NO: 392304 - DNA, 16 bp, M. musculus
ctatgcctgcctggat

SEQ ID NO: 392305 - DNA, 16 bp, M. musculus
ctatgcctgggcctgg

SEQ ID NO: 392306 - DNA, 16 bp, M. musculus
ctatgctgcccaggtg

SEQ ID NO: 392307 - DNA, 16 bp, M. musculus
ctatgcttaagctctg

SEQ ID NO: 392308 - DNA, 16 bp, M. musculus
ctatgcttgcagagag

SEQ ID NO: 392309 - DNA, 16 bp, M. musculus
ctatggactcttctgc

SEQ ID NO: 392310 - DNA, 16 bp, M. musculus
ctatggactttgatgg

SEQ ID NO: 392311 - DNA, 16 bp, M. musculus
ctatggagatggctca

SEQ ID NO: 392312 - DNA, 16 bp, M. musculus
ctatggagcttcagac

SEQ ID NO: 392313 - DNA, 16 bp, M. musculus
ctatggaggcagaggc

SEQ ID NO: 392314 - DNA, 16 bp, M. musculus
ctatggagtgttcaca

SEQ ID NO: 392315 - DNA, 16 bp, M. musculus
ctatggatggcctttc

SEQ ID NO: 392316 - DNA, 16 bp, M. musculus
ctatggattcttctgc

SEQ ID NO: 392317 - DNA, 16 bp, M. musculus
ctatgggagccatttt

SEQ ID NO: 392318 - DNA, 16 bp, M. musculus
ctatgggatggatccc

SEQ ID NO: 392319 - DNA, 16 bp, M. musculus
ctatgggcagaccttc

SEQ ID NO: 392320 - DNA, 16 bp, M. musculus
ctatgggctcaggtta

SEQ ID NO: 392321 - DNA, 16 bp, M. musculus
ctatggggccattctt

SEQ ID NO: 392322 - DNA, 16 bp, M. musculus
ctatggggttgaaaac

SEQ ID NO: 392323 - DNA, 18 bp, M. musculus
ctatggtcacttgatctt

SEQ ID NO: 392324 - DNA, 16 bp, M. musculus
ctatgtacctcagtct

SEQ ID NO: 392325 - DNA, 16 bp, M. musculus
ctatgtagccaaggct

SEQ ID NO: 392326 - DNA, 16 bp, M. musculus
ctatgtagccctggat

SEQ ID NO: 392327 - DNA, 16 bp, M. musculus
ctatgtagcgctggct

SEQ ID NO: 392328 - DNA, 16 bp, M. musculus
ctatgtagctaaagat

SEQ ID NO: 392329 - DNA, 16 bp, M. musculus
ctatgtagctcaggtt

SEQ ID NO: 392330 - DNA, 16 bp, M. musculus
ctatgtagctgaggct

SEQ ID NO: 392331 - DNA, 16 bp, M. musculus
ctatgtagtactggct

SEQ ID NO: 392332 - DNA, 16 bp, M. musculus
ctatgtagtcctggct

SEQ ID NO: 392333 - DNA, 16 bp, M. musculus
ctatgtagttgaggat

SEQ ID NO: 392334 - DNA, 16 bp, M. musculus
ctatgtatatatgtat

SEQ ID NO: 392335 - DNA, 16 bp, M. musculus
ctatgtatgtgtgtct

SEQ ID NO: 392336 - DNA, 16 bp, M. musculus
ctatgtatttttattg

SEQ ID NO: 392337 - DNA, 16 bp, M. musculus
ctatgtctatctatat

SEQ ID NO: 392338 - DNA, 16 bp, M. musculus
ctatgtctgcgtggaa

SEQ ID NO: 392339 - DNA, 16 bp, M. musculus
ctatgtctttatattg

SEQ ID NO: 392340 - DNA, 16 bp, M. musculus
ctatgtgaagtaatct

SEQ ID NO: 392341 - DNA, 16 bp, M. musculus
ctatgtggccaaggat

SEQ ID NO: 392342 - DNA, 16 bp, M. musculus
ctatgtggtcctggct

SEQ ID NO: 392343 - DNA, 16 bp, M. musculus
ctatgtgtgtatctgt

SEQ ID NO: 392344 - DNA, 16 bp, M. musculus
ctatgtgtgtctgtct

SEQ ID NO: 392345 - DNA, 16 bp, M. musculus
ctatgtgtgtgagtgt

SEQ ID NO: 392346 - DNA, 16 bp, M. musculus
ctatgtgtttgctggg

SEQ ID NO: 392347 - DNA, 16 bp, M. musculus
ctatgttctgctggag

SEQ ID NO: 392348 - DNA, 16 bp, M. musculus
ctatgttctttgcctt

SEQ ID NO: 392349 - DNA, 16 bp, M. musculus
ctatgttttctttagc

SEQ ID NO: 392350 - DNA, 16 bp, M. musculus
ctattaaaaagcatga

SEQ ID NO: 392351 - DNA, 16 bp, M. musculus
ctattaaaaatgggga

SEQ ID NO: 392352 - DNA, 16 bp, M. musculus
ctattaacaacaatga

SEQ ID NO: 392353 - DNA, 16 bp, M. musculus
ctattaatgaggctat

SEQ ID NO: 392354 - DNA, 16 bp, M. musculus
ctattacagagaaacc

SEQ ID NO: 392355 - DNA, 16 bp, M. musculus
ctattagtaggattgt

SEQ ID NO: 392356 - DNA, 16 bp, M. musculus
ctattataaaaaaggc

SEQ ID NO: 392357 - DNA, 18 bp, M. musculus
ctattatagtgtgcagtg

SEQ ID NO: 392358 - DNA, 16 bp, M. musculus
ctattatcatcatggc

SEQ ID NO: 392359 - DNA, 16 bp, M. musculus
ctattatccaatatat

SEQ ID NO: 392360 - DNA, 20 bp, M. musculus
ctattatctgtaggtttggt

SEQ ID NO: 392361 - DNA, 16 bp, M. musculus
ctattatgaattgtaa

SEQ ID NO: 392362 - DNA, 16 bp, M. musculus
ctattattattggcac

SEQ ID NO: 392363 - DNA, 16 bp, M. musculus
ctattattgttattat

SEQ ID NO: 392364 - DNA, 16 bp, M. musculus
ctattcaaaacaatga

SEQ ID NO: 392365 - DNA, 16 bp, M. musculus
ctattcacaggagcca

SEQ ID NO: 392366 - DNA, 16 bp, M. musculus
ctattccagatgaatt

SEQ ID NO: 392367 - DNA, 16 bp, M. musculus
ctattcggccatcatt

SEQ ID NO: 392368 - DNA, 16 bp, M. musculus
ctattctccctttgaa

SEQ ID NO: 392369 - DNA, 16 bp, M. musculus
ctattcttccagagaa

SEQ ID NO: 392370 - DNA, 16 bp, M. musculus
ctattctttctgctgg

SEQ ID NO: 392371 - DNA, 16 bp, M. musculus
ctattgataccttttc

SEQ ID NO: 392372 - DNA, 16 bp, M. musculus
ctattgatgaaagtgg

SEQ ID NO: 392373 - DNA, 16 bp, M. musculus
ctattgcaaagagaaa

SEQ ID NO: 392374 - DNA, 16 bp, M. musculus
ctattgcagcagtagc

SEQ ID NO: 392375 - DNA, 16 bp, M. musculus
ctattgcctatgccag

SEQ ID NO: 392376 - DNA, 16 bp, M. musculus
ctattgctacaagaga

SEQ ID NO: 392377 - DNA, 16 bp, M. musculus
ctattgctgaagacac

SEQ ID NO: 392378 - DNA, 16 bp, M. musculus
ctattgctgatgctca

SEQ ID NO: 392379 - DNA, 16 bp, M. musculus
ctattggatggatcat

SEQ ID NO: 392380 - DNA, 16 bp, M. musculus
ctattgggctttgatg

SEQ ID NO: 392381 - DNA, 16 bp, M. musculus
ctattgtgaataatgc

SEQ ID NO: 392382 - DNA, 16 bp, M. musculus
ctattgtggatgctaa

SEQ ID NO: 392383 - DNA, 16 bp, M. musculus
ctattgttgaagacac

SEQ ID NO: 392384 - DNA, 16 bp, M. musculus
ctattgttgatgccaa

SEQ ID NO: 392385 - DNA, 16 bp, M. musculus
ctatttaaagcttact

SEQ ID NO: 392386 - DNA, 16 bp, M. musculus
ctatttatcctttgag

SEQ ID NO: 392387 - DNA, 16 bp, M. musculus
ctatttatctgtctgt

SEQ ID NO: 392388 - DNA, 16 bp, M. musculus
ctatttatgtatttat

SEQ ID NO: 392389 - DNA, 16 bp, M. musculus
ctatttattaattgtt

SEQ ID NO: 392390 - DNA, 16 bp, M. musculus
ctatttattcattcat

SEQ ID NO: 392391 - DNA, 16 bp, M. musculus
ctatttatttatgtat

SEQ ID NO: 392392 - DNA, 16 bp, M. musculus
ctatttcctgccttct

SEQ ID NO: 392393 - DNA, 16 bp, M. musculus
ctatttctccagccca

SEQ ID NO: 392394 - DNA, 16 bp, M. musculus
ctatttgatggatcac

SEQ ID NO: 392395 - DNA, 16 bp, M. musculus
ctatttgcaactgata

SEQ ID NO: 392396 - DNA, 16 bp, M. musculus
ctatttgcagtcttct

SEQ ID NO: 392397 - DNA, 16 bp, M. musculus
ctatttgcattctttt

SEQ ID NO: 392398 - DNA, 16 bp, M. musculus
ctatttggtgttctct

SEQ ID NO: 392399 - DNA, 16 bp, M. musculus
ctatttgtgttttccc

SEQ ID NO: 392400 - DNA, 16 bp, M. musculus
ctatttgttgaaaatg

SEQ ID NO: 392401 - DNA, 16 bp, M. musculus
ctattttaaggtcttt

SEQ ID NO: 392402 - DNA, 16 bp, M. musculus
ctattttatctccttg

SEQ ID NO: 392403 - DNA, 16 bp, M. musculus
ctattttatggaacag

SEQ ID NO: 392404 - DNA, 16 bp, M. musculus
ctattttcaataaagg

SEQ ID NO: 392405 - DNA, 16 bp, M. musculus
ctattttcaataagag

SEQ ID NO: 392406 - DNA, 16 bp, M. musculus
ctattttcattttcag

SEQ ID NO: 392407 - DNA, 16 bp, M. musculus
ctattttgaaattttt

SEQ ID NO: 392408 - DNA, 17 bp, M. musculus
ctattttgtggaatatt

SEQ ID NO: 392409 - DNA, 16 bp, M. musculus
ctattttgtggaattg

SEQ ID NO: 392410 - DNA, 16 bp, M. musculus
ctcaaaaaagcaaaac

SEQ ID NO: 392411 - DNA, 16 bp, M. musculus
ctcaaaaaattttttt

SEQ ID NO: 392412 - DNA, 16 bp, M. musculus
ctcaaaaataaaatga

SEQ ID NO: 392413 - DNA, 16 bp, M. musculus
ctcaaaaataagcaaa

SEQ ID NO: 392414 - DNA, 16 bp, M. musculus
ctcaaaaatatttgtt

SEQ ID NO: 392415 - DNA, 16 bp, M. musculus
ctcaaaacaaaacaga

SEQ ID NO: 392416 - DNA, 16 bp, M. musculus
ctcaaaacacacattg

SEQ ID NO: 392417 - DNA, 16 bp, M. musculus
ctcaaaacagaaaaca

SEQ ID NO: 392418 - DNA, 16 bp, M. musculus
ctcaaaagacaaggtg

SEQ ID NO: 392419 - DNA, 16 bp, M. musculus
ctcaaaagaggaaata

SEQ ID NO: 392420 - DNA, 16 bp, M. musculus
ctcaaaagatgaaaca

SEQ ID NO: 392421 - DNA, 16 bp, M. musculus
ctcaaaatattggaca

SEQ ID NO: 392422 - DNA, 16 bp, M. musculus
ctcaaaatcctagcca

SEQ ID NO: 392423 - DNA, 16 bp, M. musculus
ctcaaaatgaaccagg

SEQ ID NO: 392424 - DNA, 16 bp, M. musculus
ctcaaaattatttaaa

SEQ ID NO: 392425 - DNA, 16 bp, M. musculus
ctcaaacaaaacagaa

SEQ ID NO: 392426 - DNA, 16 bp, M. musculus
ctcaaacaagtcagtg

SEQ ID NO: 392427 - DNA, 16 bp, M. musculus
ctcaaacacaaaagaa

SEQ ID NO: 392428 - DNA, 16 bp, M. musculus
ctcaaacaccaggtca

SEQ ID NO: 392429 - DNA, 16 bp, M. musculus
ctcaaacccaggtcct

SEQ ID NO: 392430 - DNA, 16 bp, M. musculus
ctcaaactaatattta

SEQ ID NO: 392431 - DNA, 16 bp, M. musculus
ctcaaactcaaaaaga

SEQ ID NO: 392432 - DNA, 17 bp, M. musculus
ctcaaactcagaaatcg

SEQ ID NO: 392433 - DNA, 16 bp, M. musculus
ctcaaactcagagaac

SEQ ID NO: 392434 - DNA, 16 bp, M. musculus
ctcaaactcagagacc

SEQ ID NO: 392435 - DNA, 16 bp, M. musculus
ctcaaactctcagaga

SEQ ID NO: 392436 - DNA, 16 bp, M. musculus
ctcaaactctgagatc

SEQ ID NO: 392437 - DNA, 16 bp, M. musculus
ctcaaacttctctcca

SEQ ID NO: 392438 - DNA, 16 bp, M. musculus
ctcaaagaaacaaaac

SEQ ID NO: 392439 - DNA, 16 bp, M. musculus
ctcaaagaagaagaaa

SEQ ID NO: 392440 - DNA, 16 bp, M. musculus
ctcaaagaagaatgtt

SEQ ID NO: 392441 - DNA, 16 bp, M. musculus
ctcaaagaatcagatg

SEQ ID NO: 392442 - DNA, 16 bp, M. musculus
ctcaaagacaaaaact

SEQ ID NO: 392443 - DNA, 16 bp, M. musculus
ctcaaagacaaaaatg

SEQ ID NO: 392444 - DNA, 16 bp, M. musculus
ctcaaagacaaaagcc

SEQ ID NO: 392445 - DNA, 16 bp, M. musculus
ctcaaagagatctacc

SEQ ID NO: 392446 - DNA, 16 bp, M. musculus
ctcaaagcaaacaaac

SEQ ID NO: 392447 - DNA, 16 bp, M. musculus
ctcaaagcatccagga

SEQ ID NO: 392448 - DNA, 16 bp, M. musculus
ctcaaagcccacccca

SEQ ID NO: 392449 - DNA, 16 bp, M. musculus
ctcaaagccctgaatc

SEQ ID NO: 392450 - DNA, 16 bp, M. musculus
ctcaaagcctacctcc

SEQ ID NO: 392451 - DNA, 16 bp, M. musculus
ctcaaaggacaaacag

SEQ ID NO: 392452 - DNA, 16 bp, M. musculus
ctcaaaggaccagaaa

SEQ ID NO: 392453 - DNA, 16 bp, M. musculus
ctcaaaggacctgaaa

SEQ ID NO: 392454 - DNA, 16 bp, M. musculus
ctcaaaggaggaaata

SEQ ID NO: 392455 - DNA, 16 bp, M. musculus
ctcaaaggcccagaaa

SEQ ID NO: 392456 - DNA, 16 bp, M. musculus
ctcaaagggggaaaaa

SEQ ID NO: 392457 - DNA, 16 bp, M. musculus
ctcaaagtcacagaaa

SEQ ID NO: 392458 - DNA, 16 bp, M. musculus
ctcaaagtccaccccc

SEQ ID NO: 392459 - DNA, 16 bp, M. musculus
ctcaaataaaatattt

SEQ ID NO: 392460 - DNA, 16 bp, M. musculus
ctcaaataaacccttt

SEQ ID NO: 392461 - DNA, 16 bp, M. musculus
ctcaaataaatcaatg

SEQ ID NO: 392462 - DNA, 16 bp, M. musculus
ctcaaatcccagcaac

SEQ ID NO: 392463 - DNA, 16 bp, M. musculus
ctcaaatcctattttt

SEQ ID NO: 392464 - DNA, 16 bp, M. musculus
ctcaaatggacatgca

SEQ ID NO: 392465 - DNA, 16 bp, M. musculus
ctcaaatgtaaatatt

SEQ ID NO: 392466 - DNA, 16 bp, M. musculus
ctcaaattcagagatc

SEQ ID NO: 392467 - DNA, 16 bp, M. musculus
ctcaaattctgctcca

SEQ ID NO: 392468 - DNA, 16 bp, M. musculus
ctcaacaaaacaaagc

SEQ ID NO: 392469 - DNA, 16 bp, M. musculus
ctcaacaaaggaaaaa

SEQ ID NO: 392470 - DNA, 16 bp, M. musculus
ctcaacaagcagctga

SEQ ID NO: 392471 - DNA, 16 bp, M. musculus
ctcaacaaggccacac

SEQ ID NO: 392472 - DNA, 39 bp, M. musculus
ctcaacacattggcctgcagcctggcccttacagcccac

SEQ ID NO: 392473 - DNA, 16 bp, M. musculus
ctcaacaccatggtgt

SEQ ID NO: 392474 - DNA, 16 bp, M. musculus
ctcaacagaggcatgg

SEQ ID NO: 392475 - DNA, 16 bp, M. musculus
ctcaacaggagggaaa

SEQ ID NO: 392476 - DNA, 16 bp, M. musculus
ctcaacaggcaggcag

SEQ ID NO: 392477 - DNA, 16 bp, M. musculus
ctcaacatccacttcc

SEQ ID NO: 392478 - DNA, 16 bp, M. musculus
ctcaacatcctcacca

SEQ ID NO: 392479 - DNA, 17 bp, M. musculus
ctcaacatgtttaccag

SEQ ID NO: 392480 - DNA, 16 bp, M. musculus
ctcaaccctacacaaa

SEQ ID NO: 392481 - DNA, 17 bp, M. musculus
ctcaacctcaccagtcc

SEQ ID NO: 392482 - DNA, 16 bp, M. musculus
ctcaaccttcatcaga

SEQ ID NO: 392483 - DNA, 16 bp, M. musculus
ctcaaccttggtcaga

SEQ ID NO: 392484 - DNA, 16 bp, M. musculus
ctcaactacacagtgt

SEQ ID NO: 392485 - DNA, 16 bp, M. musculus
ctcaactactgctcca

SEQ ID NO: 392486 - DNA, 16 bp, M. musculus
ctcaactagtgatcaa

SEQ ID NO: 392487 - DNA, 16 bp, M. musculus
ctcaactcctttgcat

SEQ ID NO: 392488 - DNA, 16 bp, M. musculus
ctcaactctctctctc

SEQ ID NO: 392489 - DNA, 16 bp, M. musculus
ctcaactgaagaaact

SEQ ID NO: 392490 - DNA, 16 bp, M. musculus
ctcaactgaggttccc

SEQ ID NO: 392491 - DNA, 16 bp, M. musculus
ctcaactgctcaactg

SEQ ID NO: 392492 - DNA, 16 bp, M. musculus
ctcaactggaagcagg

SEQ ID NO: 392493 - DNA, 16 bp, M. musculus
ctcaacttcctgagtg

SEQ ID NO: 392494 - DNA, 16 bp, M. musculus
ctcaacttctttcagc

SEQ ID NO: 392495 - DNA, 16 bp, M. musculus
ctcaagaaaaagcaag

SEQ ID NO: 392496 - DNA, 16 bp, M. musculus
ctcaagaaaatggact

SEQ ID NO: 392497 - DNA, 16 bp, M. musculus
ctcaagaaacaaggtg

SEQ ID NO: 392498 - DNA, 16 bp, M. musculus
ctcaagaaattaaata

SEQ ID NO: 392499 - DNA, 16 bp, M. musculus
ctcaagaacgtggact

SEQ ID NO: 392500 - DNA, 16 bp, M. musculus
ctcaagaagaagaaga

SEQ ID NO: 392501 - DNA, 16 bp, M. musculus
ctcaagaagctgaagg

SEQ ID NO: 392502 - DNA, 16 bp, M. musculus
ctcaagaaggtggatt

SEQ ID NO: 392503 - DNA, 16 bp, M. musculus
ctcaagaaggtggcct

SEQ ID NO: 392504 - DNA, 16 bp, M. musculus
ctcaagaagttggact

SEQ ID NO: 392505 - DNA, 16 bp, M. musculus
ctcaagaataaggaag

SEQ ID NO: 392506 - DNA, 16 bp, M. musculus
ctcaagaataatgaag

SEQ ID NO: 392507 - DNA, 16 bp, M. musculus
ctcaagaccagcctgg

SEQ ID NO: 392508 - DNA, 16 bp, M. musculus
ctcaagacccaggtat

SEQ ID NO: 392509 - DNA, 16 bp, M. musculus
ctcaagagaatgaaga

SEQ ID NO: 392510 - DNA, 16 bp, M. musculus
ctcaagagactggaga

SEQ ID NO: 392511 - DNA, 16 bp, M. musculus
ctcaagagactggtgg

SEQ ID NO: 392512 - DNA, 16 bp, M. musculus
ctcaagagaggctcct

SEQ ID NO: 392513 - DNA, 16 bp, M. musculus
ctcaagagatggctca

SEQ ID NO: 392514 - DNA, 16 bp, M. musculus
ctcaagaggaagaaag

SEQ ID NO: 392515 - DNA, 16 bp, M. musculus
ctcaagaggctgaagc

SEQ ID NO: 392516 - DNA, 16 bp, M. musculus
ctcaagagtctggagg

SEQ ID NO: 392517 - DNA, 16 bp, M. musculus
ctcaagatctggatca

SEQ ID NO: 392518 - DNA, 16 bp, M. musculus
ctcaagatggaccagt

SEQ ID NO: 392519 - DNA, 34 bp, M. musculus
ctcaagatgtttgtggcttatatgaggaagtcag

SEQ ID NO: 392520 - DNA, 16 bp, M. musculus
ctcaagcaagtcagaa

SEQ ID NO: 392521 - DNA, 16 bp, M. musculus
ctcaagccagacaaaa

SEQ ID NO: 392522 - DNA, 16 bp, M. musculus
ctcaagccaggctcag

SEQ ID NO: 392523 - DNA, 16 bp, M. musculus
ctcaagcctaagtgga

SEQ ID NO: 392524 - DNA, 16 bp, M. musculus
ctcaagctatgcccaa

SEQ ID NO: 392525 - DNA, 16 bp, M. musculus
ctcaagctcctttctc

SEQ ID NO: 392526 - DNA, 17 bp, M. musculus
ctcaaggaattatagga

SEQ ID NO: 392527 - DNA, 16 bp, M. musculus
ctcaaggacaaaagaa

SEQ ID NO: 392528 - DNA, 16 bp, M. musculus
ctcaaggataaatgaa

SEQ ID NO: 392529 - DNA, 16 bp, M. musculus
ctcaaggatagaagaa

SEQ ID NO: 392530 - DNA, 16 bp, M. musculus
ctcaaggatcaaagaa

SEQ ID NO: 392531 - DNA, 16 bp, M. musculus
ctcaaggattggcagg

SEQ ID NO: 392532 - DNA, 16 bp, M. musculus
ctcaaggcaggagctt

SEQ ID NO: 392533 - DNA, 16 bp, M. musculus
ctcaaggccaagtgga

SEQ ID NO: 392534 - DNA, 16 bp, M. musculus
ctcaaggggaggccca

SEQ ID NO: 392535 - DNA, 16 bp, M. musculus
ctcaaggtcacacagc

SEQ ID NO: 392536 - DNA, 16 bp, M. musculus
ctcaaggttcaatttt

SEQ ID NO: 392537 - DNA, 16 bp, M. musculus
ctcaagtacacacaca

SEQ ID NO: 392538 - DNA, 19 bp, M. musculus
ctcaagtcccgggatgagc

SEQ ID NO: 392539 - DNA, 16 bp, M. musculus
ctcaagtccctccctc

SEQ ID NO: 392540 - DNA, 16 bp, M. musculus
ctcaagtctaattgga

SEQ ID NO: 392541 - DNA, 16 bp, M. musculus
ctcaagtctctagagg

SEQ ID NO: 392542 - DNA, 16 bp, M. musculus
ctcaagtggtaaaatg

SEQ ID NO: 392543 - DNA, 16 bp, M. musculus
ctcaagttccagagga

SEQ ID NO: 392544 - DNA, 16 bp, M. musculus
ctcaagttctatccat

SEQ ID NO: 392545 - DNA, 16 bp, M. musculus
ctcaagttgtggtgac

SEQ ID NO: 392546 - DNA, 16 bp, M. musculus
ctcaagttgtttatca

SEQ ID NO: 392547 - DNA, 16 bp, M. musculus
ctcaataaaacacttg

SEQ ID NO: 392548 - DNA, 16 bp, M. musculus
ctcaataaaactcatt

SEQ ID NO: 392549 - DNA, 16 bp, M. musculus
ctcaataaaatttttg

SEQ ID NO: 392550 - DNA, 16 bp, M. musculus
ctcaatatgtagacca

SEQ ID NO: 392551 - DNA, 16 bp, M. musculus
ctcaatcacaaaataa

SEQ ID NO: 392552 - DNA, 16 bp, M. musculus
ctcaatcctcctgtct

SEQ ID NO: 392553 - DNA, 16 bp, M. musculus
ctcaatcctttctttc

SEQ ID NO: 392554 - DNA, 16 bp, M. musculus
ctcaatcctttgatct

SEQ ID NO: 392555 - DNA, 16 bp, M. musculus
ctcaatcttgtcagaa

SEQ ID NO: 392556 - DNA, 16 bp, M. musculus
ctcaatctttctccca

SEQ ID NO: 392557 - DNA, 16 bp, M. musculus
ctcaatgaagaaaatg

SEQ ID NO: 392558 - DNA, 16 bp, M. musculus
ctcaatgacaaagaca

SEQ ID NO: 392559 - DNA, 16 bp, M. musculus
ctcaatggcatctttg

SEQ ID NO: 392560 - DNA, 16 bp, M. musculus
ctcaattaaatatgtc

SEQ ID NO: 392561 - DNA, 16 bp, M. musculus
ctcaattagatatcac

SEQ ID NO: 392562 - DNA, 16 bp, M. musculus
ctcaattcagaacatc

SEQ ID NO: 392563 - DNA, 16 bp, M. musculus
ctcaattcccagcacc

SEQ ID NO: 392564 - DNA, 16 bp, M. musculus
ctcaattcttcaagaa

SEQ ID NO: 392565 - DNA, 16 bp, M. musculus
ctcaattgagaaaata

SEQ ID NO: 392566 - DNA, 16 bp, M. musculus
ctcaattgagaaaatg

SEQ ID NO: 392567 - DNA, 16 bp, M. musculus
ctcaatttactttgat

SEQ ID NO: 392568 - DNA, 16 bp, M. musculus
ctcaatttttttaaaa

SEQ ID NO: 392569 - DNA, 16 bp, M. musculus
ctcacaaaagaaagca

SEQ ID NO: 392570 - DNA, 16 bp, M. musculus
ctcacaaacatctata

SEQ ID NO: 392571 - DNA, 16 bp, M. musculus
ctcacaaacatctgca

SEQ ID NO: 392572 - DNA, 16 bp, M. musculus
ctcacaacaatctata

SEQ ID NO: 392573 - DNA, 16 bp, M. musculus
ctcacaaccacctaca

SEQ ID NO: 392574 - DNA, 16 bp, M. musculus
ctcacaaccagctata

SEQ ID NO: 392575 - DNA, 16 bp, M. musculus
ctcacaaccagctgta

SEQ ID NO: 392576 - DNA, 16 bp, M. musculus
ctcacaaccatccaat

SEQ ID NO: 392577 - DNA, 16 bp, M. musculus
ctcacaaccatctcta

SEQ ID NO: 392578 - DNA, 16 bp, M. musculus
ctcacaaccatctctc

SEQ ID NO: 392579 - DNA, 16 bp, M. musculus
ctcacaaccatctgta

SEQ ID NO: 392580 - DNA, 20 bp, M. musculus
ctcacaaccatctgtaaagg

SEQ ID NO: 392581 - DNA, 16 bp, M. musculus
ctcacaaccatttgta

SEQ ID NO: 392582 - DNA, 16 bp, M. musculus
ctcacaaccatttgtg

SEQ ID NO: 392583 - DNA, 16 bp, M. musculus
ctcacaaccccctgta

SEQ ID NO: 392584 - DNA, 16 bp, M. musculus
ctcacaactacccata

SEQ ID NO: 392585 - DNA, 16 bp, M. musculus
ctcacaactgcttgta

SEQ ID NO: 392586 - DNA, 17 bp, M. musculus
ctcacaagagacagcta

SEQ ID NO: 392587 - DNA, 16 bp, M. musculus
ctcacaagcatctata

SEQ ID NO: 392588 - DNA, 16 bp, M. musculus
ctcacaaggccatcct

SEQ ID NO: 392589 - DNA, 16 bp, M. musculus
ctcacaaggccccacc

SEQ ID NO: 392590 - DNA, 16 bp, M. musculus
ctcacaagtatctgta

SEQ ID NO: 392591 - DNA, 16 bp, M. musculus
ctcacacaaggcagga

SEQ ID NO: 392592 - DNA, 17 bp, M. musculus
ctcacacaagtcaatgg

SEQ ID NO: 392593 - DNA, 19 bp, M. musculus
ctcacacaataatagtggg

SEQ ID NO: 392594 - DNA, 16 bp, M. musculus
ctcacacacacacaga

SEQ ID NO: 392595 - DNA, 16 bp, M. musculus
ctcacacacacactca

SEQ ID NO: 392596 - DNA, 16 bp, M. musculus
ctcacacacacataca

SEQ ID NO: 392597 - DNA, 16 bp, M. musculus
ctcacacacactcaca

SEQ ID NO: 392598 - DNA, 16 bp, M. musculus
ctcacacacagacaca

SEQ ID NO: 392599 - DNA, 16 bp, M. musculus
ctcacacacatgcaca

SEQ ID NO: 392600 - DNA, 16 bp, M. musculus
ctcacacagcccctcc

SEQ ID NO: 392601 - DNA, 16 bp, M. musculus
ctcacacagggaagga

SEQ ID NO: 392602 - DNA, 16 bp, M. musculus
ctcacacaggtcagga

SEQ ID NO: 392603 - DNA, 16 bp, M. musculus
ctcacacatacaaaca

SEQ ID NO: 392604 - DNA, 16 bp, M. musculus
ctcacacatacacata

SEQ ID NO: 392605 - DNA, 16 bp, M. musculus
ctcacacatgcacatg

SEQ ID NO: 392606 - DNA, 16 bp, M. musculus
ctcacaccatctgtaa

SEQ ID NO: 392607 - DNA, 16 bp, M. musculus
ctcacacccacagtga

SEQ ID NO: 392608 - DNA, 16 bp, M. musculus
ctcacacccttggggc

SEQ ID NO: 392609 - DNA, 16 bp, M. musculus
ctcacacctgcttcct

SEQ ID NO: 392610 - DNA, 16 bp, M. musculus
ctcacacctttagtcc

SEQ ID NO: 392611 - DNA, 16 bp, M. musculus
ctcacactcctgctgc

SEQ ID NO: 392612 - DNA, 16 bp, M. musculus
ctcacagaaaacagct

SEQ ID NO: 392613 - DNA, 16 bp, M. musculus
ctcacagaaatctacc

SEQ ID NO: 392614 - DNA, 16 bp, M. musculus
ctcacagaagaagagg

SEQ ID NO: 392615 - DNA, 16 bp, M. musculus
ctcacagaagagaaaa

SEQ ID NO: 392616 - DNA, 16 bp, M. musculus
ctcacagaagccagaa

SEQ ID NO: 392617 - DNA, 16 bp, M. musculus
ctcacagaagccagag

SEQ ID NO: 392618 - DNA, 16 bp, M. musculus
ctcacagacagacaga

SEQ ID NO: 392619 - DNA, 16 bp, M. musculus
ctcacagacaggagcc

SEQ ID NO: 392620 - DNA, 16 bp, M. musculus
ctcacagagagccacc

SEQ ID NO: 392621 - DNA, 16 bp, M. musculus
ctcacagagatccgcc

SEQ ID NO: 392622 - DNA, 16 bp, M. musculus
ctcacagagctccatc

SEQ ID NO: 392623 - DNA, 16 bp, M. musculus
ctcacagagctctgct

SEQ ID NO: 392624 - DNA, 16 bp, M. musculus
ctcacagaggacctgg

SEQ ID NO: 392625 - DNA, 16 bp, M. musculus
ctcacagataagtgga

SEQ ID NO: 392626 - DNA, 16 bp, M. musculus
ctcacagccaaacagt

SEQ ID NO: 392627 - DNA, 16 bp, M. musculus
ctcacagccagccatt

SEQ ID NO: 392628 - DNA, 16 bp, M. musculus
ctcacagccatccatg

SEQ ID NO: 392629 - DNA, 16 bp, M. musculus
ctcacagctctgagtg

SEQ ID NO: 392630 - DNA, 16 bp, M. musculus
ctcacagctggatctc

SEQ ID NO: 392631 - DNA, 16 bp, M. musculus
ctcacaggagaatgga

SEQ ID NO: 392632 - DNA, 16 bp, M. musculus
ctcacaggcatgcaca

SEQ ID NO: 392633 - DNA, 16 bp, M. musculus
ctcacagggaggacag

SEQ ID NO: 392634 - DNA, 16 bp, M. musculus
ctcacaggtcagcctg

SEQ ID NO: 392635 - DNA, 16 bp, M. musculus
ctcacagtcatgtatt

SEQ ID NO: 392636 - DNA, 16 bp, M. musculus
ctcacagtcctcctgc

SEQ ID NO: 392637 - DNA, 16 bp, M. musculus
ctcacagttctggaag

SEQ ID NO: 392638 - DNA, 16 bp, M. musculus
ctcacagttttagaga

SEQ ID NO: 392639 - DNA, 16 bp, M. musculus
ctcacataacaggaga

SEQ ID NO: 392640 - DNA, 16 bp, M. musculus
ctcacatacatactca

SEQ ID NO: 392641 - DNA, 16 bp, M. musculus
ctcacatatacacaca

SEQ ID NO: 392642 - DNA, 16 bp, M. musculus
ctcacatatacacaga

SEQ ID NO: 392643 - DNA, 16 bp, M. musculus
ctcacatatcagatat

SEQ ID NO: 392644 - DNA, 16 bp, M. musculus
ctcacatcatcaaact

SEQ ID NO: 392645 - DNA, 16 bp, M. musculus
ctcacatctcctccca

SEQ ID NO: 392646 - DNA, 16 bp, M. musculus
ctcacatggcccagct

SEQ ID NO: 392647 - DNA, 16 bp, M. musculus
ctcacatgtctgcttc

SEQ ID NO: 392648 - DNA, 16 bp, M. musculus
ctcacattgtgggtct

SEQ ID NO: 392649 - DNA, 16 bp, M. musculus
ctcaccaccatctgct

SEQ ID NO: 392650 - DNA, 16 bp, M. musculus
ctcaccagcatcagct

SEQ ID NO: 392651 - DNA, 16 bp, M. musculus
ctcaccagcatctgct

SEQ ID NO: 392652 - DNA, 16 bp, M. musculus
ctcaccagcccagcac

SEQ ID NO: 392653 - DNA, 16 bp, M. musculus
ctcaccagcccccctg

SEQ ID NO: 392654 - DNA, 16 bp, M. musculus
ctcaccagccccgaca

SEQ ID NO: 392655 - DNA, 16 bp, M. musculus
ctcaccagcccctctc

SEQ ID NO: 392656 - DNA, 16 bp, M. musculus
ctcaccagcccctgac

SEQ ID NO: 392657 - DNA, 16 bp, M. musculus
ctcaccagccccttcc

SEQ ID NO: 392658 - DNA, 16 bp, M. musculus
ctcaccagccctcagc

SEQ ID NO: 392659 - DNA, 16 bp, M. musculus
ctcaccagccctccac

SEQ ID NO: 392660 - DNA, 16 bp, M. musculus
ctcaccagccctcttc

SEQ ID NO: 392661 - DNA, 16 bp, M. musculus
ctcaccagccctggaa

SEQ ID NO: 392662 - DNA, 16 bp, M. musculus
ctcaccatcttctggg

SEQ ID NO: 392663 - DNA, 16 bp, M. musculus
ctcaccatgtagccca

SEQ ID NO: 392664 - DNA, 16 bp, M. musculus
ctcaccatttattttg

SEQ ID NO: 392665 - DNA, 16 bp, M. musculus
ctcacccacttctgct

SEQ ID NO: 392666 - DNA, 16 bp, M. musculus
ctcacccaggatgatg

SEQ ID NO: 392667 - DNA, 16 bp, M. musculus
ctcacccagtgagctc

SEQ ID NO: 392668 - DNA, 16 bp, M. musculus
ctcaccctgccctgga

SEQ ID NO: 392669 - DNA, 16 bp, M. musculus
ctcaccctggaaatct

SEQ ID NO: 392670 - DNA, 16 bp, M. musculus
ctcacccttcctaatg

SEQ ID NO: 392671 - DNA, 16 bp, M. musculus
ctcaccctttcttgtt

SEQ ID NO: 392672 - DNA, 16 bp, M. musculus
ctcaccggttaagagc

SEQ ID NO: 392673 - DNA, 16 bp, M. musculus
ctcacctacccactca

SEQ ID NO: 392674 - DNA, 16 bp, M. musculus
ctcacctaccccatgg

SEQ ID NO: 392675 - DNA, 16 bp, M. musculus
ctcacctactcaccca

SEQ ID NO: 392676 - DNA, 16 bp, M. musculus
ctcacctatgtctcct

SEQ ID NO: 392677 - DNA, 16 bp, M. musculus
ctcacctctgccttcc

SEQ ID NO: 392678 - DNA, 16 bp, M. musculus
ctcacctgctcagact

SEQ ID NO: 392679 - DNA, 16 bp, M. musculus
ctcacctgctcagagg

SEQ ID NO: 392680 - DNA, 16 bp, M. musculus
ctcacctggtgatcca

SEQ ID NO: 392681 - DNA, 16 bp, M. musculus
ctcacctgtcagcttg

SEQ ID NO: 392682 - DNA, 16 bp, M. musculus
ctcacctgtgaagact

SEQ ID NO: 392683 - DNA, 16 bp, M. musculus
ctcacctgtgagcctg

SEQ ID NO: 392684 - DNA, 16 bp, M. musculus
ctcacctgtgggaatg

SEQ ID NO: 392685 - DNA, 16 bp, M. musculus
ctcacctgttcagact

SEQ ID NO: 392686 - DNA, 16 bp, M. musculus
ctcacctttaacccca

SEQ ID NO: 392687 - DNA, 16 bp, M. musculus
ctcacgtgtgtgtgtg

SEQ ID NO: 392688 - DNA, 16 bp, M. musculus
ctcactaagttaccca

SEQ ID NO: 392689 - DNA, 16 bp, M. musculus
ctcactatgctggtac

SEQ ID NO: 392690 - DNA, 16 bp, M. musculus
ctcactatggagacca

SEQ ID NO: 392691 - DNA, 16 bp, M. musculus
ctcactatgtaatcct

SEQ ID NO: 392692 - DNA, 16 bp, M. musculus
ctcactatgtagatga

SEQ ID NO: 392693 - DNA, 16 bp, M. musculus
ctcactatgtaggcca

SEQ ID NO: 392694 - DNA, 16 bp, M. musculus
ctcactatgtaggtca

SEQ ID NO: 392695 - DNA, 16 bp, M. musculus
ctcactcacagcccca

SEQ ID NO: 392696 - DNA, 16 bp, M. musculus
ctcactcacccactca

SEQ ID NO: 392697 - DNA, 16 bp, M. musculus
ctcactcagaaggaga

SEQ ID NO: 392698 - DNA, 16 bp, M. musculus
ctcactcaggatgaat

SEQ ID NO: 392699 - DNA, 16 bp, M. musculus
ctcactcaggatgata

SEQ ID NO: 392700 - DNA, 16 bp, M. musculus
ctcactcctatctgct

SEQ ID NO: 392701 - DNA, 16 bp, M. musculus
ctcactctctcgctct

SEQ ID NO: 392702 - DNA, 16 bp, M. musculus
ctcactctcttctata

SEQ ID NO: 392703 - DNA, 16 bp, M. musculus
ctcactctggctggcc

SEQ ID NO: 392704 - DNA, 16 bp, M. musculus
ctcactctgtagaata

SEQ ID NO: 392705 - DNA, 16 bp, M. musculus
ctcactctgtagcaca

SEQ ID NO: 392706 - DNA, 16 bp, M. musculus
ctcactctgtagctct

SEQ ID NO: 392707 - DNA, 16 bp, M. musculus
ctcactctgtaggcca

SEQ ID NO: 392708 - DNA, 16 bp, M. musculus
ctcactgaacacagag

SEQ ID NO: 392709 - DNA, 16 bp, M. musculus
ctcactgagcctgaag

SEQ ID NO: 392710 - DNA, 16 bp, M. musculus
ctcactgaggccagag

SEQ ID NO: 392711 - DNA, 16 bp, M. musculus
ctcactgaggctggac

SEQ ID NO: 392712 - DNA, 16 bp, M. musculus
ctcactgcccagccag

SEQ ID NO: 392713 - DNA, 16 bp, M. musculus
ctcactgcctctctgc

SEQ ID NO: 392714 - DNA, 16 bp, M. musculus
ctcactggaggaaata

SEQ ID NO: 392715 - DNA, 16 bp, M. musculus
ctcactggcaagccag

SEQ ID NO: 392716 - DNA, 16 bp, M. musculus
ctcactggcacaggaa

SEQ ID NO: 392717 - DNA, 16 bp, M. musculus
ctcactggcatggcct

SEQ ID NO: 392718 - DNA, 16 bp, M. musculus
ctcactggccagccac

SEQ ID NO: 392719 - DNA, 16 bp, M. musculus
ctcactggccagccag

SEQ ID NO: 392720 - DNA, 16 bp, M. musculus
ctcactggcctgaagc

SEQ ID NO: 392721 - DNA, 16 bp, M. musculus
ctcactgggagattct

SEQ ID NO: 392722 - DNA, 16 bp, M. musculus
ctcactggtcagccag

SEQ ID NO: 392723 - DNA, 16 bp, M. musculus
ctcactgtaggcatgg

SEQ ID NO: 392724 - DNA, 16 bp, M. musculus
ctcactgtctcttcct

SEQ ID NO: 392725 - DNA, 16 bp, M. musculus
ctcactgtgcagctca

SEQ ID NO: 392726 - DNA, 16 bp, M. musculus
ctcactgtgggcagtg

SEQ ID NO: 392727 - DNA, 16 bp, M. musculus
ctcactgtggtggttt

SEQ ID NO: 392728 - DNA, 16 bp, M. musculus
ctcacttataagtgta

SEQ ID NO: 392729 - DNA, 16 bp, M. musculus
ctcacttgggcacttt

SEQ ID NO: 392730 - DNA, 16 bp, M. musculus
ctcactttgcttgccc

SEQ ID NO: 392731 - DNA, 16 bp, M. musculus
ctcactttgtgggtct

SEQ ID NO: 392732 - DNA, 16 bp, M. musculus
ctcagaaaaacaaaca

SEQ ID NO: 392733 - DNA, 16 bp, M. musculus
ctcagaaaaagaaaga

SEQ ID NO: 392734 - DNA, 16 bp, M. musculus
ctcagaaaaaggaaag

SEQ ID NO: 392735 - DNA, 16 bp, M. musculus
ctcagaaaacaaaaca

SEQ ID NO: 392736 - DNA, 16 bp, M. musculus
ctcagaaaacaagatg

SEQ ID NO: 392737 - DNA, 16 bp, M. musculus
ctcagaaaaccaaaac

SEQ ID NO: 392738 - DNA, 16 bp, M. musculus
ctcagaaaaccaaaag

SEQ ID NO: 392739 - DNA, 16 bp, M. musculus
ctcagaaaagcccagc

SEQ ID NO: 392740 - DNA, 16 bp, M. musculus
ctcagaaaataaaaca

SEQ ID NO: 392741 - DNA, 16 bp, M. musculus
ctcagaaaatggaaaa

SEQ ID NO: 392742 - DNA, 16 bp, M. musculus
ctcagaaaattggaaa

SEQ ID NO: 392743 - DNA, 16 bp, M. musculus
ctcagaaacaaaataa

SEQ ID NO: 392744 - DNA, 16 bp, M. musculus
ctcagaaacacctaaa

SEQ ID NO: 392745 - DNA, 16 bp, M. musculus
ctcagaaagagcagcc

SEQ ID NO: 392746 - DNA, 16 bp, M. musculus
ctcagaaagtgtgtgg

SEQ ID NO: 392747 - DNA, 16 bp, M. musculus
ctcagaaatccacatg

SEQ ID NO: 392748 - DNA, 16 bp, M. musculus
ctcagaaatccctctg

SEQ ID NO: 392749 - DNA, 17 bp, M. musculus
ctcagaaatccgcctgt

SEQ ID NO: 392750 - DNA, 16 bp, M. musculus
ctcagaaatctatctg

SEQ ID NO: 392751 - DNA, 16 bp, M. musculus
ctcagaaatctgtctg

SEQ ID NO: 392752 - DNA, 16 bp, M. musculus
ctcagaaattctcctg

SEQ ID NO: 392753 - DNA, 16 bp, M. musculus
ctcagaaccaagggcc

SEQ ID NO: 392754 - DNA, 16 bp, M. musculus
ctcagaacctcatgga

SEQ ID NO: 392755 - DNA, 16 bp, M. musculus
ctcagaactcccagag

SEQ ID NO: 392756 - DNA, 17 bp, M. musculus
ctcagaactgaaaaaag

SEQ ID NO: 392757 - DNA, 16 bp, M. musculus
ctcagaagaagaagaa

SEQ ID NO: 392758 - DNA, 16 bp, M. musculus
ctcagaagaagttcca

SEQ ID NO: 392759 - DNA, 16 bp, M. musculus
ctcagaagagacttta

SEQ ID NO: 392760 - DNA, 16 bp, M. musculus
ctcagaagatggcaag

SEQ ID NO: 392761 - DNA, 16 bp, M. musculus
ctcagaagcagcaaga

SEQ ID NO: 392762 - DNA, 16 bp, M. musculus
ctcagaagcctgaggc

SEQ ID NO: 392763 - DNA, 16 bp, M. musculus
ctcagaagctctatgg

SEQ ID NO: 392764 - DNA, 16 bp, M. musculus
ctcagaagctctgtgt

SEQ ID NO: 392765 - DNA, 16 bp, M. musculus
ctcagaagctgtcctc

SEQ ID NO: 392766 - DNA, 16 bp, M. musculus
ctcagaaggaagaggc

SEQ ID NO: 392767 - DNA, 16 bp, M. musculus
ctcagaaggcaaagac

SEQ ID NO: 392768 - DNA, 16 bp, M. musculus
ctcagaaggcagagag

SEQ ID NO: 392769 - DNA, 16 bp, M. musculus
ctcagaaggcagaggc

SEQ ID NO: 392770 - DNA, 16 bp, M. musculus
ctcagaaggcagaggt

SEQ ID NO: 392771 - DNA, 16 bp, M. musculus
ctcagaaggcaggggc

SEQ ID NO: 392772 - DNA, 16 bp, M. musculus
ctcagaagtcagaaga

SEQ ID NO: 392773 - DNA, 16 bp, M. musculus
ctcagaataaaagact

SEQ ID NO: 392774 - DNA, 16 bp, M. musculus
ctcagacactccagtc

SEQ ID NO: 392775 - DNA, 16 bp, M. musculus
ctcagacactgagcca

SEQ ID NO: 392776 - DNA, 16 bp, M. musculus
ctcagacatcaacaca

SEQ ID NO: 392777 - DNA, 16 bp, M. musculus
ctcagacatcaagctt

SEQ ID NO: 392778 - DNA, 16 bp, M. musculus
ctcagacatccgcctg

SEQ ID NO: 392779 - DNA, 16 bp, M. musculus
ctcagaccaagccaat

SEQ ID NO: 392780 - DNA, 16 bp, M. musculus
ctcagacccaaaagca

SEQ ID NO: 392781 - DNA, 16 bp, M. musculus
ctcagacccatgggaa

SEQ ID NO: 392782 - DNA, 16 bp, M. musculus
ctcagaccccaagccc

SEQ ID NO: 392783 - DNA, 16 bp, M. musculus
ctcagacctgttctgc

SEQ ID NO: 392784 - DNA, 16 bp, M. musculus
ctcagactctgagcca

SEQ ID NO: 392785 - DNA, 16 bp, M. musculus
ctcagactcttctcca

SEQ ID NO: 392786 - DNA, 16 bp, M. musculus
ctcagactgaaaggct

SEQ ID NO: 392787 - DNA, 16 bp, M. musculus
ctcagactggcctcaa

SEQ ID NO: 392788 - DNA, 16 bp, M. musculus
ctcagactgtgcttcc

SEQ ID NO: 392789 - DNA, 16 bp, M. musculus
ctcagacttttttttt

SEQ ID NO: 392790 - DNA, 16 bp, M. musculus
ctcagagaacacaaat

SEQ ID NO: 392791 - DNA, 16 bp, M. musculus
ctcagagaagagagct

SEQ ID NO: 392792 - DNA, 16 bp, M. musculus
ctcagagaagaggagg

SEQ ID NO: 392793 - DNA, 16 bp, M. musculus
ctcagagaaggagaag

SEQ ID NO: 392794 - DNA, 16 bp, M. musculus
ctcagagacaaagaca

SEQ ID NO: 392795 - DNA, 16 bp, M. musculus
ctcagagaccagcctg

SEQ ID NO: 392796 - DNA, 16 bp, M. musculus
ctcagagaccagtctg

SEQ ID NO: 392797 - DNA, 16 bp, M. musculus
ctcagagactgaacca

SEQ ID NO: 392798 - DNA, 16 bp, M. musculus
ctcagagactgaagca

SEQ ID NO: 392799 - DNA, 16 bp, M. musculus
ctcagagactgtgact

SEQ ID NO: 392800 - DNA, 16 bp, M. musculus
ctcagagacttactgc

SEQ ID NO: 392801 - DNA, 16 bp, M. musculus
ctcagagagaaaggct

SEQ ID NO: 392802 - DNA, 16 bp, M. musculus
ctcagagagagagaga

SEQ ID NO: 392803 - DNA, 16 bp, M. musculus
ctcagagaggctaagt

SEQ ID NO: 392804 - DNA, 16 bp, M. musculus
ctcagagagggagaga

SEQ ID NO: 392805 - DNA, 16 bp, M. musculus
ctcagagaggtggaag

SEQ ID NO: 392806 - DNA, 16 bp, M. musculus
ctcagagatccacatg

SEQ ID NO: 392807 - DNA, 16 bp, M. musculus
ctcagagatctgcatg

SEQ ID NO: 392808 - DNA, 16 bp, M. musculus
ctcagagatctgctta

SEQ ID NO: 392809 - DNA, 16 bp, M. musculus
ctcagagatggcacca

SEQ ID NO: 392810 - DNA, 16 bp, M. musculus
ctcagagattagcctg

SEQ ID NO: 392811 - DNA, 16 bp, M. musculus
ctcagagcacagccat

SEQ ID NO: 392812 - DNA, 16 bp, M. musculus
ctcagagcagaagtgg

SEQ ID NO: 392813 - DNA, 16 bp, M. musculus
ctcagagcagcctctg

SEQ ID NO: 392814 - DNA, 16 bp, M. musculus
ctcagagcagttgaga

SEQ ID NO: 392815 - DNA, 16 bp, M. musculus
ctcagagcccacccca

SEQ ID NO: 392816 - DNA, 16 bp, M. musculus
ctcagagccccatttt

SEQ ID NO: 392817 - DNA, 16 bp, M. musculus
ctcagagccctccccc

SEQ ID NO: 392818 - DNA, 16 bp, M. musculus
ctcagagctcaggaaa

SEQ ID NO: 392819 - DNA, 16 bp, M. musculus
ctcagagctcccaggg

SEQ ID NO: 392820 - DNA, 16 bp, M. musculus
ctcagagctctgcctc

SEQ ID NO: 392821 - DNA, 16 bp, M. musculus
ctcagagcttgtggga

SEQ ID NO: 392822 - DNA, 16 bp, M. musculus
ctcagaggaactcaga

SEQ ID NO: 392823 - DNA, 16 bp, M. musculus
ctcagaggagagaact

SEQ ID NO: 392824 - DNA, 16 bp, M. musculus
ctcagaggaggattct

SEQ ID NO: 392825 - DNA, 16 bp, M. musculus
ctcagaggaggcagag

SEQ ID NO: 392826 - DNA, 16 bp, M. musculus
ctcagaggcaaaggca

SEQ ID NO: 392827 - DNA, 16 bp, M. musculus
ctcagaggcaggtgga

SEQ ID NO: 392828 - DNA, 16 bp, M. musculus
ctcagaggccaaaaga

SEQ ID NO: 392829 - DNA, 16 bp, M. musculus
ctcagaggcttactgc

SEQ ID NO: 392830 - DNA, 16 bp, M. musculus
ctcagaggtcagaaga

SEQ ID NO: 392831 - DNA, 16 bp, M. musculus
ctcagaggtctccctg

SEQ ID NO: 392832 - DNA, 16 bp, M. musculus
ctcagagtccagcttt

SEQ ID NO: 392833 - DNA, 16 bp, M. musculus
ctcagagtctgagcca

SEQ ID NO: 392834 - DNA, 16 bp, M. musculus
ctcagagtgaaagcct

SEQ ID NO: 392835 - DNA, 16 bp, M. musculus
ctcagagttcagcttt

SEQ ID NO: 392836 - DNA, 16 bp, M. musculus
ctcagagttgtcctct

SEQ ID NO: 392837 - DNA, 16 bp, M. musculus
ctcagatccccacccc

SEQ ID NO: 392838 - DNA, 16 bp, M. musculus
ctcagatctcagctgc

SEQ ID NO: 392839 - DNA, 16 bp, M. musculus
ctcagatctctctctc

SEQ ID NO: 392840 - DNA, 16 bp, M. musculus
ctcagatctgcctgct

SEQ ID NO: 392841 - DNA, 16 bp, M. musculus
ctcagatgacagcaca

SEQ ID NO: 392842 - DNA, 16 bp, M. musculus
ctcagatgatctcatt

SEQ ID NO: 392843 - DNA, 16 bp, M. musculus
ctcagatgcatgtgtt

SEQ ID NO: 392844 - DNA, 16 bp, M. musculus
ctcagatgctgggatt

SEQ ID NO: 392845 - DNA, 16 bp, M. musculus
ctcagattcacaggag

SEQ ID NO: 392846 - DNA, 16 bp, M. musculus
ctcagcaaaactggaa

SEQ ID NO: 392847 - DNA, 16 bp, M. musculus
ctcagcaactcatggt

SEQ ID NO: 392848 - DNA, 16 bp, M. musculus
ctcagcaactcctgca

SEQ ID NO: 392849 - DNA, 16 bp, M. musculus
ctcagcaaggcttgtg

SEQ ID NO: 392850 - DNA, 16 bp, M. musculus
ctcagcaatgggcaga

SEQ ID NO: 392851 - DNA, 16 bp, M. musculus
ctcagcacacaggcca

SEQ ID NO: 392852 - DNA, 16 bp, M. musculus
ctcagcacagaggaga

SEQ ID NO: 392853 - DNA, 16 bp, M. musculus
ctcagcacccacacag

SEQ ID NO: 392854 - DNA, 17 bp, M. musculus
ctcagcacccacatggc

SEQ ID NO: 392855 - DNA, 16 bp, M. musculus
ctcagcacccacgtgg

SEQ ID NO: 392856 - DNA, 16 bp, M. musculus
ctcagcacctcatggt

SEQ ID NO: 392857 - DNA, 16 bp, M. musculus
ctcagcaccttgccac

SEQ ID NO: 392858 - DNA, 16 bp, M. musculus
ctcagcactcaagaga

SEQ ID NO: 392859 - DNA, 16 bp, M. musculus
ctcagcactcacatgg

SEQ ID NO: 392860 - DNA, 16 bp, M. musculus
ctcagcactcaggaga

SEQ ID NO: 392861 - DNA, 16 bp, M. musculus
ctcagcactggagaga

SEQ ID NO: 392862 - DNA, 16 bp, M. musculus
ctcagcacttcatgga

SEQ ID NO: 392863 - DNA, 16 bp, M. musculus
ctcagcacttgggaga

SEQ ID NO: 392864 - DNA, 16 bp, M. musculus
ctcagcagacagctat

SEQ ID NO: 392865 - DNA, 16 bp, M. musculus
ctcagcagatacaaaa

SEQ ID NO: 392866 - DNA, 16 bp, M. musculus
ctcagcagctgcagac

SEQ ID NO: 392867 - DNA, 16 bp, M. musculus
ctcagcagctgtggct

SEQ ID NO: 392868 - DNA, 16 bp, M. musculus
ctcagcagcttcagcc

SEQ ID NO: 392869 - DNA, 16 bp, M. musculus
ctcagcaggtaaaggg

SEQ ID NO: 392870 - DNA, 16 bp, M. musculus
ctcagcaggtagcaga

SEQ ID NO: 392871 - DNA, 16 bp, M. musculus
ctcagcagtcaagagc

SEQ ID NO: 392872 - DNA, 16 bp, M. musculus
ctcagcagttaaaggt

SEQ ID NO: 392873 - DNA, 16 bp, M. musculus
ctcagcagttaagaga

SEQ ID NO: 392874 - DNA, 16 bp, M. musculus
ctcagcagttaagagt

SEQ ID NO: 392875 - DNA, 16 bp, M. musculus
ctcagcatcagcacca

SEQ ID NO: 392876 - DNA, 16 bp, M. musculus
ctcagcatcagcatca

SEQ ID NO: 392877 - DNA, 17 bp, M. musculus
ctcagcatgctgattcc

SEQ ID NO: 392878 - DNA, 16 bp, M. musculus
ctcagcattcctcagt

SEQ ID NO: 392879 - DNA, 16 bp, M. musculus
ctcagcattggggagg

SEQ ID NO: 392880 - DNA, 17 bp, M. musculus
ctcagcatttgggaggt

SEQ ID NO: 392881 - DNA, 16 bp, M. musculus
ctcagccaatgggctg

SEQ ID NO: 392882 - DNA, 16 bp, M. musculus
ctcagccactgagcca

SEQ ID NO: 392883 - DNA, 16 bp, M. musculus
ctcagccagacctggg

SEQ ID NO: 392884 - DNA, 16 bp, M. musculus
ctcagccagtttatca

SEQ ID NO: 392885 - DNA, 16 bp, M. musculus
ctcagccatctctctg

SEQ ID NO: 392886 - DNA, 16 bp, M. musculus
ctcagccatttggcat

SEQ ID NO: 392887 - DNA, 16 bp, M. musculus
ctcagcccaaggagtg

SEQ ID NO: 392888 - DNA, 16 bp, M. musculus
ctcagcccactgtggg

SEQ ID NO: 392889 - DNA, 16 bp, M. musculus
ctcagcccagcccagc

SEQ ID NO: 392890 - DNA, 16 bp, M. musculus
ctcagcccccagctcc

SEQ ID NO: 392891 - DNA, 16 bp, M. musculus
ctcagcccctccagca

SEQ ID NO: 392892 - DNA, 16 bp, M. musculus
ctcagcccctcctgca

SEQ ID NO: 392893 - DNA, 16 bp, M. musculus
ctcagcccctgggctg

SEQ ID NO: 392894 - DNA, 16 bp, M. musculus
ctcagccccttctcca

SEQ ID NO: 392895 - DNA, 16 bp, M. musculus
ctcagccctcagccct

SEQ ID NO: 392896 - DNA, 16 bp, M. musculus
ctcagccctgaaaaca

SEQ ID NO: 392897 - DNA, 16 bp, M. musculus
ctcagcctcacctcag

SEQ ID NO: 392898 - DNA, 16 bp, M. musculus
ctcagcctcagcctcc

SEQ ID NO: 392899 - DNA, 16 bp, M. musculus
ctcagcctcagcctct

SEQ ID NO: 392900 - DNA, 16 bp, M. musculus
ctcagcctcagctcct

SEQ ID NO: 392901 - DNA, 16 bp, M. musculus
ctcagcctcagtttcc

SEQ ID NO: 392902 - DNA, 16 bp, M. musculus
ctcagcctccacttcc

SEQ ID NO: 392903 - DNA, 16 bp, M. musculus
ctcagcctccagagtt

SEQ ID NO: 392904 - DNA, 16 bp, M. musculus
ctcagcctcccaagga

SEQ ID NO: 392905 - DNA, 16 bp, M. musculus
ctcagcctcctctcca

SEQ ID NO: 392906 - DNA, 16 bp, M. musculus
ctcagcctcctgagtg

SEQ ID NO: 392907 - DNA, 16 bp, M. musculus
ctcagcctcctggctg

SEQ ID NO: 392908 - DNA, 16 bp, M. musculus
ctcagcctctccagtg

SEQ ID NO: 392909 - DNA, 16 bp, M. musculus
ctcagcctctgctcca

SEQ ID NO: 392910 - DNA, 16 bp, M. musculus
ctcagcctctggcatc

SEQ ID NO: 392911 - DNA, 16 bp, M. musculus
ctcagcctcttctcca

SEQ ID NO: 392912 - DNA, 16 bp, M. musculus
ctcagcctctttcagc

SEQ ID NO: 392913 - DNA, 16 bp, M. musculus
ctcagcctgcctctgc

SEQ ID NO: 392914 - DNA, 17 bp, M. musculus
ctcagcctgctctcttg

SEQ ID NO: 392915 - DNA, 16 bp, M. musculus
ctcagcctgctttctt

SEQ ID NO: 392916 - DNA, 16 bp, M. musculus
ctcagcctgggagaca

SEQ ID NO: 392917 - DNA, 16 bp, M. musculus
ctcagccttctaagta

SEQ ID NO: 392918 - DNA, 16 bp, M. musculus
ctcagccttctctctc

SEQ ID NO: 392919 - DNA, 16 bp, M. musculus
ctcagctacaaagtga

SEQ ID NO: 392920 - DNA, 16 bp, M. musculus
ctcagctacagagtga

SEQ ID NO: 392921 - DNA, 16 bp, M. musculus
ctcagctacataggga

SEQ ID NO: 392922 - DNA, 16 bp, M. musculus
ctcagctacctcccag

SEQ ID NO: 392923 - DNA, 16 bp, M. musculus
ctcagctacctttcca

SEQ ID NO: 392924 - DNA, 16 bp, M. musculus
ctcagctactaagaat

SEQ ID NO: 392925 - DNA, 16 bp, M. musculus
ctcagctacttctcca

SEQ ID NO: 392926 - DNA, 16 bp, M. musculus
ctcagctacttgggag

SEQ ID NO: 392927 - DNA, 16 bp, M. musculus
ctcagctcactttctc

SEQ ID NO: 392928 - DNA, 16 bp, M. musculus
ctcagctcagctgggg

SEQ ID NO: 392929 - DNA, 16 bp, M. musculus
ctcagctcagcttctc

SEQ ID NO: 392930 - DNA, 16 bp, M. musculus
ctcagctccagctcca

SEQ ID NO: 392931 - DNA, 16 bp, M. musculus
ctcagctccatctcca

SEQ ID NO: 392932 - DNA, 16 bp, M. musculus
ctcagctcctcagctc

SEQ ID NO: 392933 - DNA, 16 bp, M. musculus
ctcagctcctccagcc

SEQ ID NO: 392934 - DNA, 16 bp, M. musculus
ctcagctcctcctata

SEQ ID NO: 392935 - DNA, 16 bp, M. musculus
ctcagctcctcctcca

SEQ ID NO: 392936 - DNA, 16 bp, M. musculus
ctcagctcctcctcct

SEQ ID NO: 392937 - DNA, 16 bp, M. musculus
ctcagctcctctccag

SEQ ID NO: 392938 - DNA, 16 bp, M. musculus
ctcagctccttcagca

SEQ ID NO: 392939 - DNA, 16 bp, M. musculus
ctcagctccttctgtg

SEQ ID NO: 392940 - DNA, 16 bp, M. musculus
ctcagctctacctgcg

SEQ ID NO: 392941 - DNA, 16 bp, M. musculus
ctcagctctcaggagg

SEQ ID NO: 392942 - DNA, 16 bp, M. musculus
ctcagctctctgctgg

SEQ ID NO: 392943 - DNA, 16 bp, M. musculus
ctcagctctgaaattt

SEQ ID NO: 392944 - DNA, 16 bp, M. musculus
ctcagctctgcctcct

SEQ ID NO: 392945 - DNA, 16 bp, M. musculus
ctcagctctgcctctg

SEQ ID NO: 392946 - DNA, 16 bp, M. musculus
ctcagctctgcttccc

SEQ ID NO: 392947 - DNA, 16 bp, M. musculus
ctcagctctgcttgca

SEQ ID NO: 392948 - DNA, 16 bp, M. musculus
ctcagctcttccacaa

SEQ ID NO: 392949 - DNA, 16 bp, M. musculus
ctcagctcttcctgca

SEQ ID NO: 392950 - DNA, 16 bp, M. musculus
ctcagctgaggaaatg

SEQ ID NO: 392951 - DNA, 16 bp, M. musculus
ctcagctgaggctcct

SEQ ID NO: 392952 - DNA, 16 bp, M. musculus
ctcagctgccacccag

SEQ ID NO: 392953 - DNA, 16 bp, M. musculus
ctcagctgctctcaga

SEQ ID NO: 392954 - DNA, 16 bp, M. musculus
ctcagctgctctgctc

SEQ ID NO: 392955 - DNA, 16 bp, M. musculus
ctcagctggcatcact

SEQ ID NO: 392956 - DNA, 16 bp, M. musculus
ctcagctggtttcctg

SEQ ID NO: 392957 - DNA, 16 bp, M. musculus
ctcagctgtaaagaaa

SEQ ID NO: 392958 - DNA, 16 bp, M. musculus
ctcagctgttcaggct

SEQ ID NO: 392959 - DNA, 16 bp, M. musculus
ctcagctgttcctgct

SEQ ID NO: 392960 - DNA, 16 bp, M. musculus
ctcagcttacacttcc

SEQ ID NO: 392961 - DNA, 16 bp, M. musculus
ctcagcttcctgctct

SEQ ID NO: 392962 - DNA, 16 bp, M. musculus
ctcagcttcctggctg

SEQ ID NO: 392963 - DNA, 16 bp, M. musculus
ctcagcttcctgtcct

SEQ ID NO: 392964 - DNA, 16 bp, M. musculus
ctcagcttctcattga

SEQ ID NO: 392965 - DNA, 16 bp, M. musculus
ctcagcttctcctgca

SEQ ID NO: 392966 - DNA, 16 bp, M. musculus
ctcagcttcttcatct

SEQ ID NO: 392967 - DNA, 16 bp, M. musculus
ctcagctttccaagtg

SEQ ID NO: 392968 - DNA, 16 bp, M. musculus
ctcagctttgctggaa

SEQ ID NO: 392969 - DNA, 16 bp, M. musculus
ctcaggaaaaaaaaat

SEQ ID NO: 392970 - DNA, 16 bp, M. musculus
ctcaggaaaaaaagaa

SEQ ID NO: 392971 - DNA, 16 bp, M. musculus
ctcaggaaacagagac

SEQ ID NO: 392972 - DNA, 16 bp, M. musculus
ctcaggaaacagctgt

SEQ ID NO: 392973 - DNA, 16 bp, M. musculus
ctcaggaaacagcttt

SEQ ID NO: 392974 - DNA, 16 bp, M. musculus
ctcaggaaatcagttt

SEQ ID NO: 392975 - DNA, 16 bp, M. musculus
ctcaggaacaaagaca

SEQ ID NO: 392976 - DNA, 16 bp, M. musculus
ctcaggaagaaaacaa

SEQ ID NO: 392977 - DNA, 16 bp, M. musculus
ctcaggaagaagagtc

SEQ ID NO: 392978 - DNA, 16 bp, M. musculus
ctcaggaagcagaagc

SEQ ID NO: 392979 - DNA, 16 bp, M. musculus
ctcaggaatctacctg

SEQ ID NO: 392980 - DNA, 16 bp, M. musculus
ctcaggaatttctcag

SEQ ID NO: 392981 - DNA, 16 bp, M. musculus
ctcaggacacagaggc

SEQ ID NO: 392982 - DNA, 16 bp, M. musculus
ctcaggacacagctat

SEQ ID NO: 392983 - DNA, 16 bp, M. musculus
ctcaggacacaggaac

SEQ ID NO: 392984 - DNA, 16 bp, M. musculus
ctcaggaccaccagcc

SEQ ID NO: 392985 - DNA, 16 bp, M. musculus
ctcaggacccccaaga

SEQ ID NO: 392986 - DNA, 18 bp, M. musculus
ctcaggacctccagaaga

SEQ ID NO: 392987 - DNA, 16 bp, M. musculus
ctcaggacctggaaga

SEQ ID NO: 392988 - DNA, 16 bp, M. musculus
ctcaggactgtggcca

SEQ ID NO: 392989 - DNA, 16 bp, M. musculus
ctcaggagaaagaggc

SEQ ID NO: 392990 - DNA, 16 bp, M. musculus
ctcaggagaagagaga

SEQ ID NO: 392991 - DNA, 16 bp, M. musculus
ctcaggagacagagaa

SEQ ID NO: 392992 - DNA, 16 bp, M. musculus
ctcaggagacagatgc

SEQ ID NO: 392993 - DNA, 16 bp, M. musculus
ctcaggagacagctct

SEQ ID NO: 392994 - DNA, 16 bp, M. musculus
ctcaggagactaacca

SEQ ID NO: 392995 - DNA, 16 bp, M. musculus
ctcaggagagcacagg

SEQ ID NO: 392996 - DNA, 16 bp, M. musculus
ctcaggagagcaggcc

SEQ ID NO: 392997 - DNA, 16 bp, M. musculus
ctcaggagagtgggcc

SEQ ID NO: 392998 - DNA, 16 bp, M. musculus
ctcaggagcagcaggc

SEQ ID NO: 392999 - DNA, 16 bp, M. musculus
ctcaggaggaagaccc

SEQ ID NO: 393000 - DNA, 16 bp, M. musculus
ctcaggaggaagagga

SEQ ID NO: 393001 - DNA, 16 bp, M. musculus
ctcaggaggagctgag

SEQ ID NO: 393002 - DNA, 16 bp, M. musculus
ctcaggaggaggaagt

SEQ ID NO: 393003 - DNA, 16 bp, M. musculus
ctcaggaggcaaagag

SEQ ID NO: 393004 - DNA, 16 bp, M. musculus
ctcaggaggcagaaga

SEQ ID NO: 393005 - DNA, 16 bp, M. musculus
ctcaggaggcagaagt

SEQ ID NO: 393006 - DNA, 16 bp, M. musculus
ctcaggaggcaggcag

SEQ ID NO: 393007 - DNA, 16 bp, M. musculus
ctcaggaggctgagga

SEQ ID NO: 393008 - DNA, 16 bp, M. musculus
ctcaggaggctggaga

SEQ ID NO: 393009 - DNA, 16 bp, M. musculus
ctcaggagggagaagc

SEQ ID NO: 393010 - DNA, 16 bp, M. musculus
ctcaggaggtggaggc

SEQ ID NO: 393011 - DNA, 16 bp, M. musculus
ctcaggagtctgaggc

SEQ ID NO: 393012 - DNA, 16 bp, M. musculus
ctcaggatagtatttt

SEQ ID NO: 393013 - DNA, 16 bp, M. musculus
ctcaggatatcctcat

SEQ ID NO: 393014 - DNA, 16 bp, M. musculus
ctcaggatcctcctgc

SEQ ID NO: 393015 - DNA, 16 bp, M. musculus
ctcaggatctcaggat

SEQ ID NO: 393016 - DNA, 16 bp, M. musculus
ctcaggatcttcagaa

SEQ ID NO: 393017 - DNA, 16 bp, M. musculus
ctcaggatgcagaagc

SEQ ID NO: 393018 - DNA, 16 bp, M. musculus
ctcaggcaccacagac

SEQ ID NO: 393019 - DNA, 16 bp, M. musculus
ctcaggcaggaatcta

SEQ ID NO: 393020 - DNA, 16 bp, M. musculus
ctcaggcaggccttga

SEQ ID NO: 393021 - DNA, 16 bp, M. musculus
ctcaggcccagatcca

SEQ ID NO: 393022 - DNA, 16 bp, M. musculus
ctcaggctcctctcca

SEQ ID NO: 393023 - DNA, 16 bp, M. musculus
ctcaggctgccaggct

SEQ ID NO: 393024 - DNA, 16 bp, M. musculus
ctcaggctggccccaa

SEQ ID NO: 393025 - DNA, 16 bp, M. musculus
ctcaggctggtcttaa

SEQ ID NO: 393026 - DNA, 16 bp, M. musculus
ctcagggaaaaataca

SEQ ID NO: 393027 - DNA, 16 bp, M. musculus
ctcagggaaagctgtg

SEQ ID NO: 393028 - DNA, 16 bp, M. musculus
ctcagggaaaggggag

SEQ ID NO: 393029 - DNA, 16 bp, M. musculus
ctcagggacattttga

SEQ ID NO: 393030 - DNA, 16 bp, M. musculus
ctcagggaccccaatg

SEQ ID NO: 393031 - DNA, 16 bp, M. musculus
ctcagggactgtccct

SEQ ID NO: 393032 - DNA, 16 bp, M. musculus
ctcagggagtcttgtg

SEQ ID NO: 393033 - DNA, 16 bp, M. musculus
ctcagggatcctcctg

SEQ ID NO: 393034 - DNA, 16 bp, M. musculus
ctcagggatgcagaga

SEQ ID NO: 393035 - DNA, 16 bp, M. musculus
ctcagggccagatggt

SEQ ID NO: 393036 - DNA, 16 bp, M. musculus
ctcagggcctttggaa

SEQ ID NO: 393037 - DNA, 16 bp, M. musculus
ctcagggcttcactcc

SEQ ID NO: 393038 - DNA, 41 bp, M. musculus
ctcaggggcatcctctatctagtaaagactctcaaggatat

SEQ ID NO: 393039 - DNA, 16 bp, M. musculus
ctcaggggcttctcag

SEQ ID NO: 393040 - DNA, 16 bp, M. musculus
ctcaggggttactggt

SEQ ID NO: 393041 - DNA, 16 bp, M. musculus
ctcagggtgtcaggct

SEQ ID NO: 393042 - DNA, 16 bp, M. musculus
ctcagggttgttttgg

SEQ ID NO: 393043 - DNA, 16 bp, M. musculus
ctcaggtcaccaagct

SEQ ID NO: 393044 - DNA, 16 bp, M. musculus
ctcaggtccctgtgct

SEQ ID NO: 393045 - DNA, 16 bp, M. musculus
ctcaggtcctctggac

SEQ ID NO: 393046 - DNA, 16 bp, M. musculus
ctcaggtcctctggag

SEQ ID NO: 393047 - DNA, 16 bp, M. musculus
ctcaggtcctctgtga

SEQ ID NO: 393048 - DNA, 16 bp, M. musculus
ctcaggtcgccaggct

SEQ ID NO: 393049 - DNA, 16 bp, M. musculus
ctcaggtcttctgaaa

SEQ ID NO: 393050 - DNA, 16 bp, M. musculus
ctcaggtgaaattgat

SEQ ID NO: 393051 - DNA, 16 bp, M. musculus
ctcaggtgacagcata

SEQ ID NO: 393052 - DNA, 16 bp, M. musculus
ctcaggtgactgcaga

SEQ ID NO: 393053 - DNA, 16 bp, M. musculus
ctcaggtggcagccca

SEQ ID NO: 393054 - DNA, 16 bp, M. musculus
ctcaggtggccaagaa

SEQ ID NO: 393055 - DNA, 16 bp, M. musculus
ctcaggtgtaccctgt

SEQ ID NO: 393056 - DNA, 16 bp, M. musculus
ctcaggtgtgtgccca

SEQ ID NO: 393057 - DNA, 16 bp, M. musculus
ctcaggttcctgccct

SEQ ID NO: 393058 - DNA, 16 bp, M. musculus
ctcaggttctctgaaa

SEQ ID NO: 393059 - DNA, 16 bp, M. musculus
ctcaggttctcttgtt

SEQ ID NO: 393060 - DNA, 16 bp, M. musculus
ctcaggttcttggcca

SEQ ID NO: 393061 - DNA, 16 bp, M. musculus
ctcaggtttcactgtt

SEQ ID NO: 393062 - DNA, 16 bp, M. musculus
ctcaggtttcagtgtt

SEQ ID NO: 393063 - DNA, 16 bp, M. musculus
ctcagtaaaatggtaa

SEQ ID NO: 393064 - DNA, 16 bp, M. musculus
ctcagtacagaggaac

SEQ ID NO: 393065 - DNA, 16 bp, M. musculus
ctcagtactcaggaga

SEQ ID NO: 393066 - DNA, 16 bp, M. musculus
ctcagtactcagtact

SEQ ID NO: 393067 - DNA, 16 bp, M. musculus
ctcagtagtagagtgc

SEQ ID NO: 393068 - DNA, 16 bp, M. musculus
ctcagtagtgaagagc

SEQ ID NO: 393069 - DNA, 16 bp, M. musculus
ctcagtatatctgatt

SEQ ID NO: 393070 - DNA, 16 bp, M. musculus
ctcagtattttgtaaa

SEQ ID NO: 393071 - DNA, 16 bp, M. musculus
ctcagtcagctgtttg

SEQ ID NO: 393072 - DNA, 16 bp, M. musculus
ctcagtcaggaagcag

SEQ ID NO: 393073 - DNA, 16 bp, M. musculus
ctcagtccaatggctg

SEQ ID NO: 393074 - DNA, 16 bp, M. musculus
ctcagtccagtggttg

SEQ ID NO: 393075 - DNA, 16 bp, M. musculus
ctcagtcccacaaagc

SEQ ID NO: 393076 - DNA, 16 bp, M. musculus
ctcagtcccacaaggc

SEQ ID NO: 393077 - DNA, 16 bp, M. musculus
ctcagtccctaagacc

SEQ ID NO: 393078 - DNA, 16 bp, M. musculus
ctcagtcctctgcaag

SEQ ID NO: 393079 - DNA, 16 bp, M. musculus
ctcagtctcacagaga

SEQ ID NO: 393080 - DNA, 16 bp, M. musculus
ctcagtctccccagtg

SEQ ID NO: 393081 - DNA, 16 bp, M. musculus
ctcagtctccttggaa

SEQ ID NO: 393082 - DNA, 16 bp, M. musculus
ctcagtctctacctgg

SEQ ID NO: 393083 - DNA, 16 bp, M. musculus
ctcagtctctccctct

SEQ ID NO: 393084 - DNA, 16 bp, M. musculus
ctcagtctctctgtgt

SEQ ID NO: 393085 - DNA, 16 bp, M. musculus
ctcagtctctgtgagt

SEQ ID NO: 393086 - DNA, 16 bp, M. musculus
ctcagtctcttcctct

SEQ ID NO: 393087 - DNA, 16 bp, M. musculus
ctcagtctcttctcca

SEQ ID NO: 393088 - DNA, 16 bp, M. musculus
ctcagtctctttctct

SEQ ID NO: 393089 - DNA, 16 bp, M. musculus
ctcagtctgctttctc

SEQ ID NO: 393090 - DNA, 16 bp, M. musculus
ctcagtctgtctctgt

SEQ ID NO: 393091 - DNA, 16 bp, M. musculus
ctcagtcttcctaatg

SEQ ID NO: 393092 - DNA, 16 bp, M. musculus
ctcagtcttctttctt

SEQ ID NO: 393093 - DNA, 16 bp, M. musculus
ctcagtgacacatttc

SEQ ID NO: 393094 - DNA, 16 bp, M. musculus
ctcagtgcagggtggc

SEQ ID NO: 393095 - DNA, 16 bp, M. musculus
ctcagtgccctgactg

SEQ ID NO: 393096 - DNA, 16 bp, M. musculus
ctcagtgctcccagcc

SEQ ID NO: 393097 - DNA, 16 bp, M. musculus
ctcagtgctgggatta

SEQ ID NO: 393098 - DNA, 16 bp, M. musculus
ctcagtgcttcagtcc

SEQ ID NO: 393099 - DNA, 16 bp, M. musculus
ctcagtggataaaagg

SEQ ID NO: 393100 - DNA, 16 bp, M. musculus
ctcagtggataaagat

SEQ ID NO: 393101 - DNA, 16 bp, M. musculus
ctcagtggataaagca

SEQ ID NO: 393102 - DNA, 16 bp, M. musculus
ctcagtggataaaggc

SEQ ID NO: 393103 - DNA, 16 bp, M. musculus
ctcagtggcaaaacaa

SEQ ID NO: 393104 - DNA, 16 bp, M. musculus
ctcagtggctaagagt

SEQ ID NO: 393105 - DNA, 16 bp, M. musculus
ctcagtggctttcctt

SEQ ID NO: 393106 - DNA, 16 bp, M. musculus
ctcagtgggcagaggc

SEQ ID NO: 393107 - DNA, 16 bp, M. musculus
ctcagtgggcccatgc

SEQ ID NO: 393108 - DNA, 16 bp, M. musculus
ctcagtgggtaaagtc

SEQ ID NO: 393109 - DNA, 16 bp, M. musculus
ctcagtgggtaagagt

SEQ ID NO: 393110 - DNA, 16 bp, M. musculus
ctcagtgggtaagtgc

SEQ ID NO: 393111 - DNA, 16 bp, M. musculus
ctcagtggtaaagagc

SEQ ID NO: 393112 - DNA, 16 bp, M. musculus
ctcagtggtagagctt

SEQ ID NO: 393113 - DNA, 16 bp, M. musculus
ctcagtggtgtgtgtg

SEQ ID NO: 393114 - DNA, 16 bp, M. musculus
ctcagtggttaagaga

SEQ ID NO: 393115 - DNA, 16 bp, M. musculus
ctcagtgtcctcatct

SEQ ID NO: 393116 - DNA, 16 bp, M. musculus
ctcagtgtctgagtga

SEQ ID NO: 393117 - DNA, 16 bp, M. musculus
ctcagtgtcttatgtg

SEQ ID NO: 393118 - DNA, 16 bp, M. musculus
ctcagtgtgctcacag

SEQ ID NO: 393119 - DNA, 16 bp, M. musculus
ctcagtgtgtttctaa

SEQ ID NO: 393120 - DNA, 16 bp, M. musculus
ctcagttccaggggat

SEQ ID NO: 393121 - DNA, 16 bp, M. musculus
ctcagttccctccctc

SEQ ID NO: 393122 - DNA, 16 bp, M. musculus
ctcagttcctccagtg

SEQ ID NO: 393123 - DNA, 16 bp, M. musculus
ctcagttcctgcttgc

SEQ ID NO: 393124 - DNA, 16 bp, M. musculus
ctcagttccttctcta

SEQ ID NO: 393125 - DNA, 16 bp, M. musculus
ctcagttctgcctcct

SEQ ID NO: 393126 - DNA, 16 bp, M. musculus
ctcagttcttcacaga

SEQ ID NO: 393127 - DNA, 16 bp, M. musculus
ctcagttcttggtgaa

SEQ ID NO: 393128 - DNA, 16 bp, M. musculus
ctcagttgacagcaga

SEQ ID NO: 393129 - DNA, 16 bp, M. musculus
ctcagttgataattct

SEQ ID NO: 393130 - DNA, 16 bp, M. musculus
ctcagttgctgaggag

SEQ ID NO: 393131 - DNA, 16 bp, M. musculus
ctcagtttcccaagtg

SEQ ID NO: 393132 - DNA, 16 bp, M. musculus
ctcagtttccccaaat

SEQ ID NO: 393133 - DNA, 16 bp, M. musculus
ctcagtttccctgtct

SEQ ID NO: 393134 - DNA, 16 bp, M. musculus
ctcagtttcctcatct

SEQ ID NO: 393135 - DNA, 16 bp, M. musculus
ctcagtttcctgagtg

SEQ ID NO: 393136 - DNA, 16 bp, M. musculus
ctcagtttccttgtct

SEQ ID NO: 393137 - DNA, 16 bp, M. musculus
ctcagtttctcctgaa

SEQ ID NO: 393138 - DNA, 16 bp, M. musculus
ctcagtttctctttct

SEQ ID NO: 393139 - DNA, 16 bp, M. musculus
ctcagtttcttcattt

SEQ ID NO: 393140 - DNA, 16 bp, M. musculus
ctcagtttcttcttct

SEQ ID NO: 393141 - DNA, 16 bp, M. musculus
ctcagtttgctcatct

SEQ ID NO: 393142 - DNA, 16 bp, M. musculus
ctcagttttcctatct

SEQ ID NO: 393143 - DNA, 16 bp, M. musculus
ctcagttttctcatct

SEQ ID NO: 393144 - DNA, 16 bp, M. musculus
ctcataaccacctgta

SEQ ID NO: 393145 - DNA, 16 bp, M. musculus
ctcataagggccctct

SEQ ID NO: 393146 - DNA, 16 bp, M. musculus
ctcatacacacacaca

SEQ ID NO: 393147 - DNA, 16 bp, M. musculus
ctcatacacacacaga

SEQ ID NO: 393148 - DNA, 16 bp, M. musculus
ctcatacataaaataa

SEQ ID NO: 393149 - DNA, 16 bp, M. musculus
ctcatacatttaaaaa

SEQ ID NO: 393150 - DNA, 16 bp, M. musculus
ctcatagaaccttctc

SEQ ID NO: 393151 - DNA, 16 bp, M. musculus
ctcatagaaggaacaa

SEQ ID NO: 393152 - DNA, 16 bp, M. musculus
ctcatagaggagaaag

SEQ ID NO: 393153 - DNA, 16 bp, M. musculus
ctcataggctcatagg

SEQ ID NO: 393154 - DNA, 16 bp, M. musculus
ctcatatacttgaata

SEQ ID NO: 393155 - DNA, 16 bp, M. musculus
ctcatatagataaaat

SEQ ID NO: 393156 - DNA, 16 bp, M. musculus
ctcatatatatatata

SEQ ID NO: 393157 - DNA, 16 bp, M. musculus
ctcatatatttgaatg

SEQ ID NO: 393158 - DNA, 16 bp, M. musculus
ctcatatgaagaccaa

SEQ ID NO: 393159 - DNA, 17 bp, M. musculus
ctcatatgagacagtta

SEQ ID NO: 393160 - DNA, 16 bp, M. musculus
ctcatcaaggcccact

SEQ ID NO: 393161 - DNA, 16 bp, M. musculus
ctcatcagaggaatgg

SEQ ID NO: 393162 - DNA, 16 bp, M. musculus
ctcatcagaggtctta

SEQ ID NO: 393163 - DNA, 16 bp, M. musculus
ctcatcagcatggaga

SEQ ID NO: 393164 - DNA, 16 bp, M. musculus
ctcatcagcatgtgct

SEQ ID NO: 393165 - DNA, 16 bp, M. musculus
ctcatcagtataatca

SEQ ID NO: 393166 - DNA, 16 bp, M. musculus
ctcatcagtgctgtgc

SEQ ID NO: 393167 - DNA, 16 bp, M. musculus
ctcatcataatgcaat

SEQ ID NO: 393168 - DNA, 16 bp, M. musculus
ctcatcatcatcatca

SEQ ID NO: 393169 - DNA, 16 bp, M. musculus
ctcatcattgtgctga

SEQ ID NO: 393170 - DNA, 16 bp, M. musculus
ctcatccccatctctg

SEQ ID NO: 393171 - DNA, 16 bp, M. musculus
ctcatccctgccccca

SEQ ID NO: 393172 - DNA, 16 bp, M. musculus
ctcatcctggctgcct

SEQ ID NO: 393173 - DNA, 16 bp, M. musculus
ctcatctatacctata

SEQ ID NO: 393174 - DNA, 16 bp, M. musculus
ctcatctatgcctatt

SEQ ID NO: 393175 - DNA, 16 bp, M. musculus
ctcatctcatctcatc

SEQ ID NO: 393176 - DNA, 16 bp, M. musculus
ctcatctccaaattct

SEQ ID NO: 393177 - DNA, 16 bp, M. musculus
ctcatctccttctcca

SEQ ID NO: 393178 - DNA, 16 bp, M. musculus
ctcatctctctctgct

SEQ ID NO: 393179 - DNA, 16 bp, M. musculus
ctcatctctgtctctg

SEQ ID NO: 393180 - DNA, 16 bp, M. musculus
ctcatctgtaaaatgg

SEQ ID NO: 393181 - DNA, 16 bp, M. musculus
ctcatctgtgcagact

SEQ ID NO: 393182 - DNA, 16 bp, M. musculus
ctcatcttctatgttt

SEQ ID NO: 393183 - DNA, 16 bp, M. musculus
ctcatgaacacacaca

SEQ ID NO: 393184 - DNA, 16 bp, M. musculus
ctcatgaagaacattt

SEQ ID NO: 393185 - DNA, 16 bp, M. musculus
ctcatgaagaccaagc

SEQ ID NO: 393186 - DNA, 16 bp, M. musculus
ctcatgaagctcaaga

SEQ ID NO: 393187 - DNA, 16 bp, M. musculus
ctcatgaccacctgta

SEQ ID NO: 393188 - DNA, 16 bp, M. musculus
ctcatgacttagaaca

SEQ ID NO: 393189 - DNA, 16 bp, M. musculus
ctcatgaggcagaggt

SEQ ID NO: 393190 - DNA, 16 bp, M. musculus
ctcatgatcttcctgc

SEQ ID NO: 393191 - DNA, 16 bp, M. musculus
ctcatgatgatggaag

SEQ ID NO: 393192 - DNA, 16 bp, M. musculus
ctcatgatgcagtttt

SEQ ID NO: 393193 - DNA, 16 bp, M. musculus
ctcatgcaggatgata

SEQ ID NO: 393194 - DNA, 16 bp, M. musculus
ctcatgcccagcagta

SEQ ID NO: 393195 - DNA, 16 bp, M. musculus
ctcatgctcctctcca

SEQ ID NO: 393196 - DNA, 16 bp, M. musculus
ctcatggaaactaaac

SEQ ID NO: 393197 - DNA, 30 bp, M. musculus
ctcatggaataagctaggaagggaccttga

SEQ ID NO: 393198 - DNA, 16 bp, M. musculus
ctcatggactgaacaa

SEQ ID NO: 393199 - DNA, 16 bp, M. musculus
ctcatggagatctacc

SEQ ID NO: 393200 - DNA, 16 bp, M. musculus
ctcatggagtgggcct

SEQ ID NO: 393201 - DNA, 16 bp, M. musculus
ctcatggctccagcca

SEQ ID NO: 393202 - DNA, 16 bp, M. musculus
ctcatggctctggctg

SEQ ID NO: 393203 - DNA, 16 bp, M. musculus
ctcatgggaaaaaaaa

SEQ ID NO: 393204 - DNA, 16 bp, M. musculus
ctcatgggaggagata

SEQ ID NO: 393205 - DNA, 16 bp, M. musculus
ctcatgggggcaatgg

SEQ ID NO: 393206 - DNA, 16 bp, M. musculus
ctcatgggttggcagg

SEQ ID NO: 393207 - DNA, 16 bp, M. musculus
ctcatggtggcttcct

SEQ ID NO: 393208 - DNA, 16 bp, M. musculus
ctcatggtgggactca

SEQ ID NO: 393209 - DNA, 16 bp, M. musculus
ctcatgtagcccagga

SEQ ID NO: 393210 - DNA, 16 bp, M. musculus
ctcatgtcactcaaga

SEQ ID NO: 393211 - DNA, 18 bp, M. musculus
ctcatgtctctaactgca

SEQ ID NO: 393212 - DNA, 16 bp, M. musculus
ctcatgtgtatacaca

SEQ ID NO: 393213 - DNA, 16 bp, M. musculus
ctcatgtgtgtgtgtt

SEQ ID NO: 393214 - DNA, 16 bp, M. musculus
ctcattaatatgtgtc

SEQ ID NO: 393215 - DNA, 16 bp, M. musculus
ctcattagaaaaaaaa

SEQ ID NO: 393216 - DNA, 16 bp, M. musculus
ctcattagaatggaga

SEQ ID NO: 393217 - DNA, 16 bp, M. musculus
ctcattatgtagccaa

SEQ ID NO: 393218 - DNA, 16 bp, M. musculus
ctcattcattcattca

SEQ ID NO: 393219 - DNA, 16 bp, M. musculus
ctcattctcagtggca

SEQ ID NO: 393220 - DNA, 16 bp, M. musculus
ctcattctctctctca

SEQ ID NO: 393221 - DNA, 16 bp, M. musculus
ctcattctgaagacca

SEQ ID NO: 393222 - DNA, 16 bp, M. musculus
ctcattctgtagccca

SEQ ID NO: 393223 - DNA, 36 bp, M. musculus
ctcattgaccttctcacagaggaccccccgccgtac

SEQ ID NO: 393224 - DNA, 16 bp, M. musculus
ctcattgagcatggag

SEQ ID NO: 393225 - DNA, 32 bp, M. musculus
ctcattgcaagcgatagagtgatcatgatttc

SEQ ID NO: 393226 - DNA, 16 bp, M. musculus
ctcattgcaatgagca

SEQ ID NO: 393227 - DNA, 16 bp, M. musculus
ctcattgcatgtgata

SEQ ID NO: 393228 - DNA, 16 bp, M. musculus
ctcattggttcaccaa

SEQ ID NO: 393229 - DNA, 16 bp, M. musculus
ctcattgtcttagtca

SEQ ID NO: 393230 - DNA, 16 bp, M. musculus
ctcatttagataatgt

SEQ ID NO: 393231 - DNA, 16 bp, M. musculus
ctcatttataatagct

SEQ ID NO: 393232 - DNA, 16 bp, M. musculus
ctcatttctctctgct

SEQ ID NO: 393233 - DNA, 16 bp, M. musculus
ctcatttgaccttttc

SEQ ID NO: 393234 - DNA, 16 bp, M. musculus
ctcatttgattggtta

SEQ ID NO: 393235 - DNA, 16 bp, M. musculus
ctcattttacagatga

SEQ ID NO: 393236 - DNA, 16 bp, M. musculus
ctcattttataaatga

SEQ ID NO: 393237 - DNA, 16 bp, M. musculus
ctcattttatttatgt

SEQ ID NO: 393238 - DNA, 16 bp, M. musculus
ctcattttctggctca

SEQ ID NO: 393239 - DNA, 16 bp, M. musculus
ctcattttcttctgtt

SEQ ID NO: 393240 - DNA, 16 bp, M. musculus
ctcattttgaaaaaaa

SEQ ID NO: 393241 - DNA, 16 bp, M. musculus
ctcattttgagttttc

SEQ ID NO: 393242 - DNA, 16 bp, M. musculus
ctcatttttaaattgg

SEQ ID NO: 393243 - DNA, 16 bp, M. musculus
ctcatttttattgtta

SEQ ID NO: 393244 - DNA, 16 bp, M. musculus
ctccaaaaaccaaaag

SEQ ID NO: 393245 - DNA, 16 bp, M. musculus
ctccaaaaagaagcta

SEQ ID NO: 393246 - DNA, 16 bp, M. musculus
ctccaaaaatccccta

SEQ ID NO: 393247 - DNA, 16 bp, M. musculus
ctccaaaacactgctg

SEQ ID NO: 393248 - DNA, 16 bp, M. musculus
ctccaaaagggccaca

SEQ ID NO: 393249 - DNA, 16 bp, M. musculus
ctccaaacgcaagggc

SEQ ID NO: 393250 - DNA, 16 bp, M. musculus
ctccaaactcagacac

SEQ ID NO: 393251 - DNA, 17 bp, M. musculus
ctccaaactttgtctcc

SEQ ID NO: 393252 - DNA, 16 bp, M. musculus
ctccaaagaaatagaa

SEQ ID NO: 393253 - DNA, 16 bp, M. musculus
ctccaaagttctggga

SEQ ID NO: 393254 - DNA, 16 bp, M. musculus
ctccaaatactcaaga

SEQ ID NO: 393255 - DNA, 16 bp, M. musculus
ctccaaatactgacac

SEQ ID NO: 393256 - DNA, 16 bp, M. musculus
ctccaaatagactggg

SEQ ID NO: 393257 - DNA, 16 bp, M. musculus
ctccaaatatataaag

SEQ ID NO: 393258 - DNA, 16 bp, M. musculus
ctccaaatgaaagaac

SEQ ID NO: 393259 - DNA, 16 bp, M. musculus
ctccaaattcagtgag

SEQ ID NO: 393260 - DNA, 16 bp, M. musculus
ctccaacaaagctaca

SEQ ID NO: 393261 - DNA, 16 bp, M. musculus
ctccaacaactggagt

SEQ ID NO: 393262 - DNA, 16 bp, M. musculus
ctccaacaagaccact

SEQ ID NO: 393263 - DNA, 16 bp, M. musculus
ctccaacaagcccaca

SEQ ID NO: 393264 - DNA, 16 bp, M. musculus
ctccaacacagccaca

SEQ ID NO: 393265 - DNA, 16 bp, M. musculus
ctccaacagggacaca

SEQ ID NO: 393266 - DNA, 16 bp, M. musculus
ctccaacagtgccaca

SEQ ID NO: 393267 - DNA, 16 bp, M. musculus
ctccaacatctacccc

SEQ ID NO: 393268 - DNA, 16 bp, M. musculus
ctccaacatgtgctgt

SEQ ID NO: 393269 - DNA, 16 bp, M. musculus
ctccaaccaggccaca

SEQ ID NO: 393270 - DNA, 16 bp, M. musculus
ctccaacccaatgagg

SEQ ID NO: 393271 - DNA, 16 bp, M. musculus
ctccaaccctgagttc

SEQ ID NO: 393272 - DNA, 16 bp, M. musculus
ctccaacctgctgagc

SEQ ID NO: 393273 - DNA, 16 bp, M. musculus
ctccaactcagagaga

SEQ ID NO: 393274 - DNA, 16 bp, M. musculus
ctccaactcagagatt

SEQ ID NO: 393275 - DNA, 16 bp, M. musculus
ctccaactgataaaca

SEQ ID NO: 393276 - DNA, 16 bp, M. musculus
ctccaacttctcccag

SEQ ID NO: 393277 - DNA, 16 bp, M. musculus
ctccaagaaccagctc

SEQ ID NO: 393278 - DNA, 16 bp, M. musculus
ctccaagaggaactct

SEQ ID NO: 393279 - DNA, 16 bp, M. musculus
ctccaagagttcttca

SEQ ID NO: 393280 - DNA, 16 bp, M. musculus
ctccaaggacaattta

SEQ ID NO: 393281 - DNA, 17 bp, M. musculus
ctccaaggatgatttgg

SEQ ID NO: 393282 - DNA, 16 bp, M. musculus
ctccaagggcatcagg

SEQ ID NO: 393283 - DNA, 16 bp, M. musculus
ctccaagtctctcaag

SEQ ID NO: 393284 - DNA, 16 bp, M. musculus
ctccaagtggatgccc

SEQ ID NO: 393285 - DNA, 16 bp, M. musculus
ctccaagttcctcccc

SEQ ID NO: 393286 - DNA, 16 bp, M. musculus
ctccaataaggccatg

SEQ ID NO: 393287 - DNA, 16 bp, M. musculus
ctccaatgccagtgaa

SEQ ID NO: 393288 - DNA, 16 bp, M. musculus
ctccaattaaatattt

SEQ ID NO: 393289 - DNA, 16 bp, M. musculus
ctccaatttcagagga

SEQ ID NO: 393290 - DNA, 16 bp, M. musculus
ctccacaaacaggacc

SEQ ID NO: 393291 - DNA, 16 bp, M. musculus
ctccacaatgacacac

SEQ ID NO: 393292 - DNA, 16 bp, M. musculus
ctccacaccacaggac

SEQ ID NO: 393293 - DNA, 16 bp, M. musculus
ctccacagccagtccc

SEQ ID NO: 393294 - DNA, 16 bp, M. musculus
ctccacaggaagacaa

SEQ ID NO: 393295 - DNA, 16 bp, M. musculus
ctccacaggcacacag

SEQ ID NO: 393296 - DNA, 16 bp, M. musculus
ctccacaggcagaagt

SEQ ID NO: 393297 - DNA, 16 bp, M. musculus
ctccacaggtagagga

SEQ ID NO: 393298 - DNA, 16 bp, M. musculus
ctccacagtgctggga

SEQ ID NO: 393299 - DNA, 16 bp, M. musculus
ctccacatctgcactg

SEQ ID NO: 393300 - DNA, 16 bp, M. musculus
ctccacatcttctcca

SEQ ID NO: 393301 - DNA, 16 bp, M. musculus
ctccacatgccttgcc

SEQ ID NO: 393302 - DNA, 16 bp, M. musculus
ctccacatggatgtcc

SEQ ID NO: 393303 - DNA, 16 bp, M. musculus
ctccacatggccatgg

SEQ ID NO: 393304 - DNA, 16 bp, M. musculus
ctccacatgggtgctg

SEQ ID NO: 393305 - DNA, 16 bp, M. musculus
ctccacatgttcctgg

SEQ ID NO: 393306 - DNA, 16 bp, M. musculus
ctccaccaactgagct

SEQ ID NO: 393307 - DNA, 16 bp, M. musculus
ctccaccacagcctgg

SEQ ID NO: 393308 - DNA, 16 bp, M. musculus
ctccaccacctcccag

SEQ ID NO: 393309 - DNA, 16 bp, M. musculus
ctccaccactgagcta

SEQ ID NO: 393310 - DNA, 16 bp, M. musculus
ctccaccatgccacag

SEQ ID NO: 393311 - DNA, 16 bp, M. musculus
ctccaccattgggagc

SEQ ID NO: 393312 - DNA, 16 bp, M. musculus
ctccacccaccttcat

SEQ ID NO: 393313 - DNA, 16 bp, M. musculus
ctccacccagaagctg

SEQ ID NO: 393314 - DNA, 16 bp, M. musculus
ctccacccagcagcca

SEQ ID NO: 393315 - DNA, 16 bp, M. musculus
ctccacccagcagctg

SEQ ID NO: 393316 - DNA, 16 bp, M. musculus
ctccacccagcttgct

SEQ ID NO: 393317 - DNA, 27 bp, M. musculus
ctccaccccaccagtcagcctctcttc

SEQ ID NO: 393318 - DNA, 16 bp, M. musculus
ctccacctccccagct

SEQ ID NO: 393319 - DNA, 16 bp, M. musculus
ctccacctcctcccag

SEQ ID NO: 393320 - DNA, 16 bp, M. musculus
ctccacctcctggctg

SEQ ID NO: 393321 - DNA, 16 bp, M. musculus
ctccacctctctgccc

SEQ ID NO: 393322 - DNA, 16 bp, M. musculus
ctccacctgcatatgt

SEQ ID NO: 393323 - DNA, 16 bp, M. musculus
ctccacctgcttctgc

SEQ ID NO: 393324 - DNA, 16 bp, M. musculus
ctccaccttcccagca

SEQ ID NO: 393325 - DNA, 16 bp, M. musculus
ctccactatttttata

SEQ ID NO: 393326 - DNA, 16 bp, M. musculus
ctccactcagcagctg

SEQ ID NO: 393327 - DNA, 16 bp, M. musculus
ctccactcccagagaa

SEQ ID NO: 393328 - DNA, 16 bp, M. musculus
ctccactcgagcccag

SEQ ID NO: 393329 - DNA, 16 bp, M. musculus
ctccactttgttctca

SEQ ID NO: 393330 - DNA, 16 bp, M. musculus
ctccagaaaactaaat

SEQ ID NO: 393331 - DNA, 16 bp, M. musculus
ctccagaaaatcaaac

SEQ ID NO: 393332 - DNA, 16 bp, M. musculus
ctccagaacaaaagga

SEQ ID NO: 393333 - DNA, 16 bp, M. musculus
ctccagaacccacaca

SEQ ID NO: 393334 - DNA, 16 bp, M. musculus
ctccagaagatggcat

SEQ ID NO: 393335 - DNA, 16 bp, M. musculus
ctccagaagggagggg

SEQ ID NO: 393336 - DNA, 16 bp, M. musculus
ctccagacaaacagaa

SEQ ID NO: 393337 - DNA, 16 bp, M. musculus
ctccagacaaccgacc

SEQ ID NO: 393338 - DNA, 16 bp, M. musculus
ctccagacagctcatc

SEQ ID NO: 393339 - DNA, 16 bp, M. musculus
ctccagacatctgtgc

SEQ ID NO: 393340 - DNA, 16 bp, M. musculus
ctccagacttctgtgt

SEQ ID NO: 393341 - DNA, 16 bp, M. musculus
ctccagagaacctgac

SEQ ID NO: 393342 - DNA, 16 bp, M. musculus
ctccagagaagcaaat

SEQ ID NO: 393343 - DNA, 16 bp, M. musculus
ctccagagaataccag

SEQ ID NO: 393344 - DNA, 16 bp, M. musculus
ctccagagccagctct

SEQ ID NO: 393345 - DNA, 16 bp, M. musculus
ctccagagcgctggga

SEQ ID NO: 393346 - DNA, 16 bp, M. musculus
ctccagagctcacctt

SEQ ID NO: 393347 - DNA, 16 bp, M. musculus
ctccagagcttccagg

SEQ ID NO: 393348 - DNA, 16 bp, M. musculus
ctccagaggcagagac

SEQ ID NO: 393349 - DNA, 16 bp, M. musculus
ctccagagtcctggga

SEQ ID NO: 393350 - DNA, 16 bp, M. musculus
ctccagagtgcaggga

SEQ ID NO: 393351 - DNA, 16 bp, M. musculus
ctccagagtgctgaga

SEQ ID NO: 393352 - DNA, 16 bp, M. musculus
ctccagagtgcttgga

SEQ ID NO: 393353 - DNA, 16 bp, M. musculus
ctccagagttctgaga

SEQ ID NO: 393354 - DNA, 16 bp, M. musculus
ctccagatatccaggc

SEQ ID NO: 393355 - DNA, 16 bp, M. musculus
ctccagatccagagga

SEQ ID NO: 393356 - DNA, 16 bp, M. musculus
ctccagatccatccaa

SEQ ID NO: 393357 - DNA, 16 bp, M. musculus
ctccagattttatctc

SEQ ID NO: 393358 - DNA, 16 bp, M. musculus
ctccagcaaggacaca

SEQ ID NO: 393359 - DNA, 16 bp, M. musculus
ctccagcaaggtcaca

SEQ ID NO: 393360 - DNA, 16 bp, M. musculus
ctccagcaagttgtct

SEQ ID NO: 393361 - DNA, 16 bp, M. musculus
ctccagcaccatgcct

SEQ ID NO: 393362 - DNA, 16 bp, M. musculus
ctccagcaccatgctt

SEQ ID NO: 393363 - DNA, 16 bp, M. musculus
ctccagcaccctgtct

SEQ ID NO: 393364 - DNA, 16 bp, M. musculus
ctccagcagaaagaca

SEQ ID NO: 393365 - DNA, 16 bp, M. musculus
ctccagcagcatgtct

SEQ ID NO: 393366 - DNA, 16 bp, M. musculus
ctccagcagggccaca

SEQ ID NO: 393367 - DNA, 16 bp, M. musculus
ctccagcatcatgtct

SEQ ID NO: 393368 - DNA, 16 bp, M. musculus
ctccagcatcttctgt

SEQ ID NO: 393369 - DNA, 16 bp, M. musculus
ctccagcatgtgtcaa

SEQ ID NO: 393370 - DNA, 16 bp, M. musculus
ctccagcatgtttctt

SEQ ID NO: 393371 - DNA, 16 bp, M. musculus
ctccagcatttctctg

SEQ ID NO: 393372 - DNA, 16 bp, M. musculus
ctccagcatttgctgt

SEQ ID NO: 393373 - DNA, 16 bp, M. musculus
ctccagccacagacag

SEQ ID NO: 393374 - DNA, 16 bp, M. musculus
ctccagccagagagag

SEQ ID NO: 393375 - DNA, 16 bp, M. musculus
ctccagccaggccaca

SEQ ID NO: 393376 - DNA, 16 bp, M. musculus
ctccagccagggaagc

SEQ ID NO: 393377 - DNA, 16 bp, M. musculus
ctccagccatggacca

SEQ ID NO: 393378 - DNA, 16 bp, M. musculus
ctccagcccatttttt

SEQ ID NO: 393379 - DNA, 16 bp, M. musculus
ctccagccccaaaaca

SEQ ID NO: 393380 - DNA, 16 bp, M. musculus
ctccagccccaagaac

SEQ ID NO: 393381 - DNA, 16 bp, M. musculus
ctccagccccaagaag

SEQ ID NO: 393382 - DNA, 16 bp, M. musculus
ctccagccccaagctt

SEQ ID NO: 393383 - DNA, 16 bp, M. musculus
ctccagccccaaggga

SEQ ID NO: 393384 - DNA, 16 bp, M. musculus
ctccagccccacatct

SEQ ID NO: 393385 - DNA, 16 bp, M. musculus
ctccagccccacctgt

SEQ ID NO: 393386 - DNA, 16 bp, M. musculus
ctccagccccacttct

SEQ ID NO: 393387 - DNA, 16 bp, M. musculus
ctccagccccagaaac

SEQ ID NO: 393388 - DNA, 16 bp, M. musculus
ctccagccccagagaa

SEQ ID NO: 393389 - DNA, 16 bp, M. musculus
ctccagccccagcctc

SEQ ID NO: 393390 - DNA, 16 bp, M. musculus
ctccagccccagctct

SEQ ID NO: 393391 - DNA, 16 bp, M. musculus
ctccagccccagcttc

SEQ ID NO: 393392 - DNA, 16 bp, M. musculus
ctccagccccagggaa

SEQ ID NO: 393393 - DNA, 16 bp, M. musculus
ctccagccccagggga

SEQ ID NO: 393394 - DNA, 16 bp, M. musculus
ctccagccccaggtct

SEQ ID NO: 393395 - DNA, 16 bp, M. musculus
ctccagccccattttt

SEQ ID NO: 393396 - DNA, 16 bp, M. musculus
ctccagcccccaagaa

SEQ ID NO: 393397 - DNA, 16 bp, M. musculus
ctccagcccccacagc

SEQ ID NO: 393398 - DNA, 16 bp, M. musculus
ctccagcccccagctc

SEQ ID NO: 393399 - DNA, 16 bp, M. musculus
ctccagcccccattta

SEQ ID NO: 393400 - DNA, 16 bp, M. musculus
ctccagccccctcttt

SEQ ID NO: 393401 - DNA, 16 bp, M. musculus
ctccagccccctgcct

SEQ ID NO: 393402 - DNA, 16 bp, M. musculus
ctccagcccctctctt

SEQ ID NO: 393403 - DNA, 16 bp, M. musculus
ctccagcccctcttct

SEQ ID NO: 393404 - DNA, 16 bp, M. musculus
ctccagcccctgaact

SEQ ID NO: 393405 - DNA, 16 bp, M. musculus
ctccagcccctgaagt

SEQ ID NO: 393406 - DNA, 16 bp, M. musculus
ctccagcccctggaga

SEQ ID NO: 393407 - DNA, 16 bp, M. musculus
ctccagcccctgtttg

SEQ ID NO: 393408 - DNA, 16 bp, M. musculus
ctccagccccttctct

SEQ ID NO: 393409 - DNA, 16 bp, M. musculus
ctccagccctcttctt

SEQ ID NO: 393410 - DNA, 16 bp, M. musculus
ctccagccctggcttt

SEQ ID NO: 393411 - DNA, 16 bp, M. musculus
ctccagccctgtgtct

SEQ ID NO: 393412 - DNA, 16 bp, M. musculus
ctccagccgtatatgt

SEQ ID NO: 393413 - DNA, 16 bp, M. musculus
ctccagcctcacccct

SEQ ID NO: 393414 - DNA, 16 bp, M. musculus
ctccagcctcagcctc

SEQ ID NO: 393415 - DNA, 16 bp, M. musculus
ctccagcctcagcttc

SEQ ID NO: 393416 - DNA, 16 bp, M. musculus
ctccagcctccagcct

SEQ ID NO: 393417 - DNA, 16 bp, M. musculus
ctccagctcacagaga

SEQ ID NO: 393418 - DNA, 16 bp, M. musculus
ctccagctccaagaaa

SEQ ID NO: 393419 - DNA, 16 bp, M. musculus
ctccagctccagagaa

SEQ ID NO: 393420 - DNA, 16 bp, M. musculus
ctccagctccagaggc

SEQ ID NO: 393421 - DNA, 16 bp, M. musculus
ctccagctccagctcc

SEQ ID NO: 393422 - DNA, 16 bp, M. musculus
ctccagctccaggaaa

SEQ ID NO: 393423 - DNA, 16 bp, M. musculus
ctccagctccaggagg

SEQ ID NO: 393424 - DNA, 16 bp, M. musculus
ctccagctccaggcaa

SEQ ID NO: 393425 - DNA, 16 bp, M. musculus
ctccagctccagggac

SEQ ID NO: 393426 - DNA, 16 bp, M. musculus
ctccagctccagggct

SEQ ID NO: 393427 - DNA, 16 bp, M. musculus
ctccagctccaggtga

SEQ ID NO: 393428 - DNA, 16 bp, M. musculus
ctccagctcccaagtg

SEQ ID NO: 393429 - DNA, 16 bp, M. musculus
ctccagctcctcccag

SEQ ID NO: 393430 - DNA, 16 bp, M. musculus
ctccagctcctcctct

SEQ ID NO: 393431 - DNA, 16 bp, M. musculus
ctccagctcctgggct

SEQ ID NO: 393432 - DNA, 16 bp, M. musculus
ctccagctcctgggga

SEQ ID NO: 393433 - DNA, 16 bp, M. musculus
ctccagctcctgtttt

SEQ ID NO: 393434 - DNA, 16 bp, M. musculus
ctccagctccttgggt

SEQ ID NO: 393435 - DNA, 16 bp, M. musculus
ctccagctctggggga

SEQ ID NO: 393436 - DNA, 16 bp, M. musculus
ctccagctcttccctc

SEQ ID NO: 393437 - DNA, 16 bp, M. musculus
ctccagctgcaggaga

SEQ ID NO: 393438 - DNA, 16 bp, M. musculus
ctccagctgcatttgt

SEQ ID NO: 393439 - DNA, 16 bp, M. musculus
ctccagctgcctgctg

SEQ ID NO: 393440 - DNA, 16 bp, M. musculus
ctccagctgcctgtac

SEQ ID NO: 393441 - DNA, 16 bp, M. musculus
ctccagctggtttctt

SEQ ID NO: 393442 - DNA, 16 bp, M. musculus
ctccagctgtgccaag

SEQ ID NO: 393443 - DNA, 16 bp, M. musculus
ctccagctgtgtatgt

SEQ ID NO: 393444 - DNA, 16 bp, M. musculus
ctccagcttcagcctc

SEQ ID NO: 393445 - DNA, 16 bp, M. musculus
ctccagcttcaggaga

SEQ ID NO: 393446 - DNA, 16 bp, M. musculus
ctccagcttcctggcc

SEQ ID NO: 393447 - DNA, 16 bp, M. musculus
ctccagcttccttcct

SEQ ID NO: 393448 - DNA, 16 bp, M. musculus
ctccagcttctcccag

SEQ ID NO: 393449 - DNA, 16 bp, M. musculus
ctccaggaagtccctg

SEQ ID NO: 393450 - DNA, 16 bp, M. musculus
ctccaggacagtcagg

SEQ ID NO: 393451 - DNA, 16 bp, M. musculus
ctccaggagcaggtga

SEQ ID NO: 393452 - DNA, 16 bp, M. musculus
ctccaggaggagagct

SEQ ID NO: 393453 - DNA, 16 bp, M. musculus
ctccaggaggcagagg

SEQ ID NO: 393454 - DNA, 16 bp, M. musculus
ctccaggaggtgagct

SEQ ID NO: 393455 - DNA, 16 bp, M. musculus
ctccaggcatccctgg

SEQ ID NO: 393456 - DNA, 16 bp, M. musculus
ctccaggccagccagg

SEQ ID NO: 393457 - DNA, 16 bp, M. musculus
ctccaggcccagggga

SEQ ID NO: 393458 - DNA, 16 bp, M. musculus
ctccaggctcagctca

SEQ ID NO: 393459 - DNA, 16 bp, M. musculus
ctccaggctccaggct

SEQ ID NO: 393460 - DNA, 16 bp, M. musculus
ctccaggctcccagct

SEQ ID NO: 393461 - DNA, 16 bp, M. musculus
ctccaggctggcctgg

SEQ ID NO: 393462 - DNA, 16 bp, M. musculus
ctccaggctggccttg

SEQ ID NO: 393463 - DNA, 16 bp, M. musculus
ctccagggagcagcca

SEQ ID NO: 393464 - DNA, 16 bp, M. musculus
ctccagggaggctttc

SEQ ID NO: 393465 - DNA, 16 bp, M. musculus
ctccagggagtctatg

SEQ ID NO: 393466 - DNA, 16 bp, M. musculus
ctccagggatgcaggg

SEQ ID NO: 393467 - DNA, 16 bp, M. musculus
ctccagggggcactgg

SEQ ID NO: 393468 - DNA, 16 bp, M. musculus
ctccagggtggactac

SEQ ID NO: 393469 - DNA, 16 bp, M. musculus
ctccagggttctggcc

SEQ ID NO: 393470 - DNA, 16 bp, M. musculus
ctccagggttctggct

SEQ ID NO: 393471 - DNA, 16 bp, M. musculus
ctccagggttgtctcc

SEQ ID NO: 393472 - DNA, 16 bp, M. musculus
ctccagggttgtcttc

SEQ ID NO: 393473 - DNA, 16 bp, M. musculus
ctccaggtccagagga

SEQ ID NO: 393474 - DNA, 19 bp, M. musculus
ctccaggtccatccatttg

SEQ ID NO: 393475 - DNA, 16 bp, M. musculus
ctccaggtctctgtcc

SEQ ID NO: 393476 - DNA, 16 bp, M. musculus
ctccaggtctgccctc

SEQ ID NO: 393477 - DNA, 16 bp, M. musculus
ctccaggttcagtgaa

SEQ ID NO: 393478 - DNA, 16 bp, M. musculus
ctccaggttcagtgag

SEQ ID NO: 393479 - DNA, 16 bp, M. musculus
ctccaggttcccaccc

SEQ ID NO: 393480 - DNA, 16 bp, M. musculus
ctccaggttcttccag

SEQ ID NO: 393481 - DNA, 16 bp, M. musculus
ctccaggttgctgccc

SEQ ID NO: 393482 - DNA, 16 bp, M. musculus
ctccaggtttctgctc

SEQ ID NO: 393483 - DNA, 16 bp, M. musculus
ctccagtacctgatac

SEQ ID NO: 393484 - DNA, 16 bp, M. musculus
ctccagtcagagacaa

SEQ ID NO: 393485 - DNA, 16 bp, M. musculus
ctccagtcagcaggag

SEQ ID NO: 393486 - DNA, 16 bp, M. musculus
ctccagtcccaggaaa

SEQ ID NO: 393487 - DNA, 16 bp, M. musculus
ctccagtcccttctcc

SEQ ID NO: 393488 - DNA, 16 bp, M. musculus
ctccagtctcctgagg

SEQ ID NO: 393489 - DNA, 16 bp, M. musculus
ctccagtctctagagg

SEQ ID NO: 393490 - DNA, 16 bp, M. musculus
ctccagtctgcaagca

SEQ ID NO: 393491 - DNA, 16 bp, M. musculus
ctccagtgactcagag

SEQ ID NO: 393492 - DNA, 16 bp, M. musculus
ctccagtgaggccaca

SEQ ID NO: 393493 - DNA, 16 bp, M. musculus
ctccagtgccatgctt

SEQ ID NO: 393494 - DNA, 16 bp, M. musculus
ctccagtgccctcttc

SEQ ID NO: 393495 - DNA, 16 bp, M. musculus
ctccagtggaaggcca

SEQ ID NO: 393496 - DNA, 16 bp, M. musculus
ctccagtgtccttgct

SEQ ID NO: 393497 - DNA, 16 bp, M. musculus
ctccagtgtgtgtgtg

SEQ ID NO: 393498 - DNA, 16 bp, M. musculus
ctccagttacaggaga

SEQ ID NO: 393499 - DNA, 16 bp, M. musculus
ctccagttcaagggga

SEQ ID NO: 393500 - DNA, 16 bp, M. musculus
ctccagttccaagaaa

SEQ ID NO: 393501 - DNA, 16 bp, M. musculus
ctccagttccacagga

SEQ ID NO: 393502 - DNA, 16 bp, M. musculus
ctccagttccagaaga

SEQ ID NO: 393503 - DNA, 16 bp, M. musculus
ctccagttccagaggc

SEQ ID NO: 393504 - DNA, 16 bp, M. musculus
ctccagttccaggaca

SEQ ID NO: 393505 - DNA, 16 bp, M. musculus
ctccagttccaggaga

SEQ ID NO: 393506 - DNA, 16 bp, M. musculus
ctccagttccagggga

SEQ ID NO: 393507 - DNA, 16 bp, M. musculus
ctccagttccaggggc

SEQ ID NO: 393508 - DNA, 16 bp, M. musculus
ctccagttccaggggt

SEQ ID NO: 393509 - DNA, 16 bp, M. musculus
ctccagttccatctct

SEQ ID NO: 393510 - DNA, 16 bp, M. musculus
ctccagttccatggga

SEQ ID NO: 393511 - DNA, 16 bp, M. musculus
ctccagttcctgagga

SEQ ID NO: 393512 - DNA, 16 bp, M. musculus
ctccagttcctggggg

SEQ ID NO: 393513 - DNA, 16 bp, M. musculus
ctccagttctaaggaa

SEQ ID NO: 393514 - DNA, 16 bp, M. musculus
ctccagttctagaaga

SEQ ID NO: 393515 - DNA, 16 bp, M. musculus
ctccagttctcagcac

SEQ ID NO: 393516 - DNA, 16 bp, M. musculus
ctccagttctgggatt

SEQ ID NO: 393517 - DNA, 16 bp, M. musculus
ctccagttgagctgag

SEQ ID NO: 393518 - DNA, 16 bp, M. musculus
ctccagtttcagagaa

SEQ ID NO: 393519 - DNA, 16 bp, M. musculus
ctccagtttgtgtcaa

SEQ ID NO: 393520 - DNA, 16 bp, M. musculus
ctccataattctgtgg

SEQ ID NO: 393521 - DNA, 16 bp, M. musculus
ctccatagttggtggg

SEQ ID NO: 393522 - DNA, 16 bp, M. musculus
ctccatataataaaca

SEQ ID NO: 393523 - DNA, 16 bp, M. musculus
ctccatattccattcc

SEQ ID NO: 393524 - DNA, 16 bp, M. musculus
ctccatcactgagaga

SEQ ID NO: 393525 - DNA, 16 bp, M. musculus
ctccatcactgtctgt

SEQ ID NO: 393526 - DNA, 16 bp, M. musculus
ctccatcagctcctgc

SEQ ID NO: 393527 - DNA, 16 bp, M. musculus
ctccatcatcaccatg

SEQ ID NO: 393528 - DNA, 16 bp, M. musculus
ctccatccacttctga

SEQ ID NO: 393529 - DNA, 16 bp, M. musculus
ctccatccccagcacc

SEQ ID NO: 393530 - DNA, 16 bp, M. musculus
ctccatcccctgtgcc

SEQ ID NO: 393531 - DNA, 16 bp, M. musculus
ctccatcctctctggc

SEQ ID NO: 393532 - DNA, 16 bp, M. musculus
ctccatcctgagcaca

SEQ ID NO: 393533 - DNA, 16 bp, M. musculus
ctccatctcatggagt

SEQ ID NO: 393534 - DNA, 16 bp, M. musculus
ctccatctccagagga

SEQ ID NO: 393535 - DNA, 16 bp, M. musculus
ctccatctcctctcat

SEQ ID NO: 393536 - DNA, 16 bp, M. musculus
ctccatctctctgtct

SEQ ID NO: 393537 - DNA, 16 bp, M. musculus
ctccatctctgccctc

SEQ ID NO: 393538 - DNA, 16 bp, M. musculus
ctccatctgtctgtct

SEQ ID NO: 393539 - DNA, 16 bp, M. musculus
ctccatcttctacact

SEQ ID NO: 393540 - DNA, 16 bp, M. musculus
ctccatcttggcttct

SEQ ID NO: 393541 - DNA, 16 bp, M. musculus
ctccatcttgggttca

SEQ ID NO: 393542 - DNA, 16 bp, M. musculus
ctccatctttgtcctt

SEQ ID NO: 393543 - DNA, 16 bp, M. musculus
ctccatctttgtctct

SEQ ID NO: 393544 - DNA, 16 bp, M. musculus
ctccatctttgttggg

SEQ ID NO: 393545 - DNA, 16 bp, M. musculus
ctccatgaagaaatgg

SEQ ID NO: 393546 - DNA, 19 bp, M. musculus
ctccatgagatacaactgt

SEQ ID NO: 393547 - DNA, 16 bp, M. musculus
ctccatgataactcca

SEQ ID NO: 393548 - DNA, 16 bp, M. musculus
ctccatgatctctgct

SEQ ID NO: 393549 - DNA, 16 bp, M. musculus
ctccatgatggaagtg

SEQ ID NO: 393550 - DNA, 16 bp, M. musculus
ctccatgcacactgct

SEQ ID NO: 393551 - DNA, 16 bp, M. musculus
ctccatgcagggacac

SEQ ID NO: 393552 - DNA, 16 bp, M. musculus
ctccatgctgggattt

SEQ ID NO: 393553 - DNA, 16 bp, M. musculus
ctccatggaagaagaa

SEQ ID NO: 393554 - DNA, 16 bp, M. musculus
ctccatggctggtggg

SEQ ID NO: 393555 - DNA, 16 bp, M. musculus
ctccatggcttgttca

SEQ ID NO: 393556 - DNA, 16 bp, M. musculus
ctccatgggcaccagg

SEQ ID NO: 393557 - DNA, 16 bp, M. musculus
ctccatgggggccctg

SEQ ID NO: 393558 - DNA, 16 bp, M. musculus
ctccatggtgtctgct

SEQ ID NO: 393559 - DNA, 16 bp, M. musculus
ctccatgtctccatgt

SEQ ID NO: 393560 - DNA, 16 bp, M. musculus
ctccatgtctgtctgt

SEQ ID NO: 393561 - DNA, 16 bp, M. musculus
ctccatgtgctctgcc

SEQ ID NO: 393562 - DNA, 16 bp, M. musculus
ctccatgtggatgcct

SEQ ID NO: 393563 - DNA, 16 bp, M. musculus
ctccatgtggatgctc

SEQ ID NO: 393564 - DNA, 16 bp, M. musculus
ctccatgtggctgctg

SEQ ID NO: 393565 - DNA, 16 bp, M. musculus
ctccatgtggttgctg

SEQ ID NO: 393566 - DNA, 16 bp, M. musculus
ctccatgttctctgtc

SEQ ID NO: 393567 - DNA, 16 bp, M. musculus
ctccatgtttgatgtc

SEQ ID NO: 393568 - DNA, 16 bp, M. musculus
ctccattctcagctct

SEQ ID NO: 393569 - DNA, 16 bp, M. musculus
ctccattgaggacccc

SEQ ID NO: 393570 - DNA, 16 bp, M. musculus
ctccattgctgggggg

SEQ ID NO: 393571 - DNA, 16 bp, M. musculus
ctccattgggagacct

SEQ ID NO: 393572 - DNA, 19 bp, M. musculus
ctccattgggggccctgtg

SEQ ID NO: 393573 - DNA, 16 bp, M. musculus
ctccattggggtcccc

SEQ ID NO: 393574 - DNA, 16 bp, M. musculus
ctccattggttgggtg

SEQ ID NO: 393575 - DNA, 16 bp, M. musculus
ctccatttactttgat

SEQ ID NO: 393576 - DNA, 16 bp, M. musculus
ctccatttcccttcaa

SEQ ID NO: 393577 - DNA, 16 bp, M. musculus
ctccatttctctctcg

SEQ ID NO: 393578 - DNA, 16 bp, M. musculus
ctccatttggggccct

SEQ ID NO: 393579 - DNA, 16 bp, M. musculus
ctccattttaaaaaaa

SEQ ID NO: 393580 - DNA, 16 bp, M. musculus
ctccattttaatgagg

SEQ ID NO: 393581 - DNA, 16 bp, M. musculus
ctccattttacagatg

SEQ ID NO: 393582 - DNA, 16 bp, M. musculus
ctccattttgcaccaa

SEQ ID NO: 393583 - DNA, 16 bp, M. musculus
ctcccaaacctgataa

SEQ ID NO: 393584 - DNA, 18 bp, M. musculus
ctcccaaagtgctgggat

SEQ ID NO: 393585 - DNA, 16 bp, M. musculus
ctcccaaatgctggga

SEQ ID NO: 393586 - DNA, 16 bp, M. musculus
ctcccaacacacatac

SEQ ID NO: 393587 - DNA, 16 bp, M. musculus
ctcccaaccatctgta

SEQ ID NO: 393588 - DNA, 16 bp, M. musculus
ctcccaactcagccag

SEQ ID NO: 393589 - DNA, 16 bp, M. musculus
ctcccaagtacttgga

SEQ ID NO: 393590 - DNA, 16 bp, M. musculus
ctcccaagtccctctc

SEQ ID NO: 393591 - DNA, 16 bp, M. musculus
ctcccaagtccttccc

SEQ ID NO: 393592 - DNA, 16 bp, M. musculus
ctcccaagtctctccc

SEQ ID NO: 393593 - DNA, 16 bp, M. musculus
ctcccaagtctgctga

SEQ ID NO: 393594 - DNA, 16 bp, M. musculus
ctcccaagtgctggag

SEQ ID NO: 393595 - DNA, 16 bp, M. musculus
ctcccaagtgctggat

SEQ ID NO: 393596 - DNA, 16 bp, M. musculus
ctcccaagtgctggca

SEQ ID NO: 393597 - DNA, 16 bp, M. musculus
ctcccaagtgctgggc

SEQ ID NO: 393598 - DNA, 16 bp, M. musculus
ctcccaagtgttgaga

SEQ ID NO: 393599 - DNA, 16 bp, M. musculus
ctcccaattaccatag

SEQ ID NO: 393600 - DNA, 16 bp, M. musculus
ctcccacactggggca

SEQ ID NO: 393601 - DNA, 16 bp, M. musculus
ctcccacatggcagct

SEQ ID NO: 393602 - DNA, 16 bp, M. musculus
ctcccaccacagcaag

SEQ ID NO: 393603 - DNA, 16 bp, M. musculus
ctcccaccacagtgag

SEQ ID NO: 393604 - DNA, 16 bp, M. musculus
ctcccaccaggccatc

SEQ ID NO: 393605 - DNA, 16 bp, M. musculus
ctcccacccttctgac

SEQ ID NO: 393606 - DNA, 16 bp, M. musculus
ctcccacctcaccata

SEQ ID NO: 393607 - DNA, 16 bp, M. musculus
ctcccacctcactgct

SEQ ID NO: 393608 - DNA, 16 bp, M. musculus
ctcccacctcctggcc

SEQ ID NO: 393609 - DNA, 16 bp, M. musculus
ctcccacctcgcccag

SEQ ID NO: 393610 - DNA, 16 bp, M. musculus
ctcccacctctgcctc

SEQ ID NO: 393611 - DNA, 16 bp, M. musculus
ctcccaccttctgctc

SEQ ID NO: 393612 - DNA, 16 bp, M. musculus
ctcccactaatgtcca

SEQ ID NO: 393613 - DNA, 16 bp, M. musculus
ctcccactacttggcc

SEQ ID NO: 393614 - DNA, 16 bp, M. musculus
ctcccactcttccaca

SEQ ID NO: 393615 - DNA, 16 bp, M. musculus
ctcccactgatgacca

SEQ ID NO: 393616 - DNA, 16 bp, M. musculus
ctcccactggggccag

SEQ ID NO: 393617 - DNA, 17 bp, M. musculus
ctcccacttcacccagt

SEQ ID NO: 393618 - DNA, 16 bp, M. musculus
ctcccacttcctagcc

SEQ ID NO: 393619 - DNA, 16 bp, M. musculus
ctcccacttctcccag

SEQ ID NO: 393620 - DNA, 16 bp, M. musculus
ctcccacttctgggcc

SEQ ID NO: 393621 - DNA, 16 bp, M. musculus
ctcccagaaaaaaaaa

SEQ ID NO: 393622 - DNA, 16 bp, M. musculus
ctcccagaaactaagc

SEQ ID NO: 393623 - DNA, 16 bp, M. musculus
ctcccagacaccaggc

SEQ ID NO: 393624 - DNA, 16 bp, M. musculus
ctcccagagactgaag

SEQ ID NO: 393625 - DNA, 16 bp, M. musculus
ctcccagagagagctg

SEQ ID NO: 393626 - DNA, 16 bp, M. musculus
ctcccagaggaccaga

SEQ ID NO: 393627 - DNA, 16 bp, M. musculus
ctcccagatatcttac

SEQ ID NO: 393628 - DNA, 16 bp, M. musculus
ctcccagatcctctcc

SEQ ID NO: 393629 - DNA, 16 bp, M. musculus
ctcccagatgtccctg

SEQ ID NO: 393630 - DNA, 16 bp, M. musculus
ctcccagcacccacat

SEQ ID NO: 393631 - DNA, 16 bp, M. musculus
ctcccagcagcaatgg

SEQ ID NO: 393632 - DNA, 16 bp, M. musculus
ctcccagcagctgtca

SEQ ID NO: 393633 - DNA, 16 bp, M. musculus
ctcccagcatcatcca

SEQ ID NO: 393634 - DNA, 16 bp, M. musculus
ctcccagcatcctcca

SEQ ID NO: 393635 - DNA, 16 bp, M. musculus
ctcccagccaaaagaa

SEQ ID NO: 393636 - DNA, 16 bp, M. musculus
ctcccagccacagtgc

SEQ ID NO: 393637 - DNA, 16 bp, M. musculus
ctcccagccctgctcc

SEQ ID NO: 393638 - DNA, 16 bp, M. musculus
ctcccagccctggcat

SEQ ID NO: 393639 - DNA, 16 bp, M. musculus
ctcccagctcccagcc

SEQ ID NO: 393640 - DNA, 16 bp, M. musculus
ctcccagctccttctc

SEQ ID NO: 393641 - DNA, 16 bp, M. musculus
ctcccagctctcccag

SEQ ID NO: 393642 - DNA, 16 bp, M. musculus
ctcccagctctctcag

SEQ ID NO: 393643 - DNA, 16 bp, M. musculus
ctcccagctgctggga

SEQ ID NO: 393644 - DNA, 16 bp, M. musculus
ctcccagcttctctcc

SEQ ID NO: 393645 - DNA, 16 bp, M. musculus
ctcccaggaatgctga

SEQ ID NO: 393646 - DNA, 16 bp, M. musculus
ctcccaggactgctga

SEQ ID NO: 393647 - DNA, 16 bp, M. musculus
ctcccaggactgtgtg

SEQ ID NO: 393648 - DNA, 16 bp, M. musculus
ctcccaggagacagct

SEQ ID NO: 393649 - DNA, 16 bp, M. musculus
ctcccaggaggcaggt

SEQ ID NO: 393650 - DNA, 16 bp, M. musculus
ctcccaggcaactagg

SEQ ID NO: 393651 - DNA, 16 bp, M. musculus
ctcccaggctgggcag

SEQ ID NO: 393652 - DNA, 16 bp, M. musculus
ctcccaggtccctggt

SEQ ID NO: 393653 - DNA, 16 bp, M. musculus
ctcccaggtctctgct

SEQ ID NO: 393654 - DNA, 16 bp, M. musculus
ctcccaggtctcttgt

SEQ ID NO: 393655 - DNA, 16 bp, M. musculus
ctcccaggtgccagga

SEQ ID NO: 393656 - DNA, 16 bp, M. musculus
ctcccaggtgctggaa

SEQ ID NO: 393657 - DNA, 16 bp, M. musculus
ctcccagtaaatctct

SEQ ID NO: 393658 - DNA, 16 bp, M. musculus
ctcccagtacctcctc

SEQ ID NO: 393659 - DNA, 16 bp, M. musculus
ctcccagtgaggccag

SEQ ID NO: 393660 - DNA, 16 bp, M. musculus
ctcccagtggtacaca

SEQ ID NO: 393661 - DNA, 16 bp, M. musculus
ctcccagttcctcctc

SEQ ID NO: 393662 - DNA, 16 bp, M. musculus
ctcccagttccttctc

SEQ ID NO: 393663 - DNA, 16 bp, M. musculus
ctcccagttcttcccc

SEQ ID NO: 393664 - DNA, 16 bp, M. musculus
ctcccataaccctggg

SEQ ID NO: 393665 - DNA, 16 bp, M. musculus
ctcccataagctttgt

SEQ ID NO: 393666 - DNA, 16 bp, M. musculus
ctcccatagaaggcct

SEQ ID NO: 393667 - DNA, 16 bp, M. musculus
ctcccatcctcatgga

SEQ ID NO: 393668 - DNA, 16 bp, M. musculus
ctcccatctccctgcc

SEQ ID NO: 393669 - DNA, 16 bp, M. musculus
ctcccatctcggctcc

SEQ ID NO: 393670 - DNA, 16 bp, M. musculus
ctcccatctctgcctc

SEQ ID NO: 393671 - DNA, 16 bp, M. musculus
ctcccatgacttccaa

SEQ ID NO: 393672 - DNA, 16 bp, M. musculus
ctcccatgagcctctg

SEQ ID NO: 393673 - DNA, 16 bp, M. musculus
ctcccatgattatttt

SEQ ID NO: 393674 - DNA, 16 bp, M. musculus
ctcccatgctcacacc

SEQ ID NO: 393675 - DNA, 16 bp, M. musculus
ctcccatgtgtatttt

SEQ ID NO: 393676 - DNA, 16 bp, M. musculus
ctcccattctgtgggc

SEQ ID NO: 393677 - DNA, 17 bp, M. musculus
ctcccattgatgtccca

SEQ ID NO: 393678 - DNA, 16 bp, M. musculus
ctcccattggtatttt

SEQ ID NO: 393679 - DNA, 16 bp, M. musculus
ctccccaataaaaaga

SEQ ID NO: 393680 - DNA, 16 bp, M. musculus
ctccccacccccagat

SEQ ID NO: 393681 - DNA, 16 bp, M. musculus
ctccccacctcctgtc

SEQ ID NO: 393682 - DNA, 16 bp, M. musculus
ctccccacctctgcct

SEQ ID NO: 393683 - DNA, 16 bp, M. musculus
ctccccactcctgcct

SEQ ID NO: 393684 - DNA, 16 bp, M. musculus
ctccccactctgcctc

SEQ ID NO: 393685 - DNA, 16 bp, M. musculus
ctccccagagctcctg

SEQ ID NO: 393686 - DNA, 16 bp, M. musculus
ctccccagagcttcca

SEQ ID NO: 393687 - DNA, 16 bp, M. musculus
ctccccagagcttgtg

SEQ ID NO: 393688 - DNA, 16 bp, M. musculus
ctccccagagttccca

SEQ ID NO: 393689 - DNA, 16 bp, M. musculus
ctccccagcaccagga

SEQ ID NO: 393690 - DNA, 16 bp, M. musculus
ctccccagccccagct

SEQ ID NO: 393691 - DNA, 16 bp, M. musculus
ctccccagctccccag

SEQ ID NO: 393692 - DNA, 16 bp, M. musculus
ctccccagggctgaga

SEQ ID NO: 393693 - DNA, 16 bp, M. musculus
ctccccagtgctcaga

SEQ ID NO: 393694 - DNA, 16 bp, M. musculus
ctccccagtgctgggg

SEQ ID NO: 393695 - DNA, 16 bp, M. musculus
ctccccatcctcgcca

SEQ ID NO: 393696 - DNA, 16 bp, M. musculus
ctccccatcctctggc

SEQ ID NO: 393697 - DNA, 16 bp, M. musculus
ctccccatcttgcttt

SEQ ID NO: 393698 - DNA, 16 bp, M. musculus
ctcccccaaccctgct

SEQ ID NO: 393699 - DNA, 16 bp, M. musculus
ctcccccaccccaagt

SEQ ID NO: 393700 - DNA, 16 bp, M. musculus
ctcccccagcctgaaa

SEQ ID NO: 393701 - DNA, 16 bp, M. musculus
ctcccccagcctgaag

SEQ ID NO: 393702 - DNA, 16 bp, M. musculus
ctcccccaggtgctcc

SEQ ID NO: 393703 - DNA, 16 bp, M. musculus
ctcccccatcctcctg

SEQ ID NO: 393704 - DNA, 16 bp, M. musculus
ctccccctgccatgct

SEQ ID NO: 393705 - DNA, 16 bp, M. musculus
ctccccctgcttctgt

SEQ ID NO: 393706 - DNA, 16 bp, M. musculus
ctcccccttccctggg

SEQ ID NO: 393707 - DNA, 16 bp, M. musculus
ctccccgctctacctc

SEQ ID NO: 393708 - DNA, 16 bp, M. musculus
ctcccctaactaccca

SEQ ID NO: 393709 - DNA, 16 bp, M. musculus
ctcccctcccatcctg

SEQ ID NO: 393710 - DNA, 16 bp, M. musculus
ctcccctccctttgat

SEQ ID NO: 393711 - DNA, 16 bp, M. musculus
ctcccctctctccatg

SEQ ID NO: 393712 - DNA, 16 bp, M. musculus
ctcccctctgcaaacc

SEQ ID NO: 393713 - DNA, 16 bp, M. musculus
ctcccctgctccccaa

SEQ ID NO: 393714 - DNA, 16 bp, M. musculus
ctcccctggaatctgt

SEQ ID NO: 393715 - DNA, 16 bp, M. musculus
ctcccctggcttgttc

SEQ ID NO: 393716 - DNA, 16 bp, M. musculus
ctcccctgggcatata

SEQ ID NO: 393717 - DNA, 16 bp, M. musculus
ctcccctgtccaccca

SEQ ID NO: 393718 - DNA, 16 bp, M. musculus
ctccccttcagctgga

SEQ ID NO: 393719 - DNA, 16 bp, M. musculus
ctcccctttgttgggt

SEQ ID NO: 393720 - DNA, 16 bp, M. musculus
ctcccgccggagcctg

SEQ ID NO: 393721 - DNA, 16 bp, M. musculus
ctcccgcttcctggct

SEQ ID NO: 393722 - DNA, 16 bp, M. musculus
ctcccgggccgggcag

SEQ ID NO: 393723 - DNA, 16 bp, M. musculus
ctccctaaatctaaga

SEQ ID NO: 393724 - DNA, 16 bp, M. musculus
ctccctatgcctcctc

SEQ ID NO: 393725 - DNA, 16 bp, M. musculus
ctccctcaatgttcct

SEQ ID NO: 393726 - DNA, 16 bp, M. musculus
ctccctcagcccctct

SEQ ID NO: 393727 - DNA, 16 bp, M. musculus
ctccctcagctccctc

SEQ ID NO: 393728 - DNA, 16 bp, M. musculus
ctccctcaggcagtga

SEQ ID NO: 393729 - DNA, 16 bp, M. musculus
ctccctcagtcctttc

SEQ ID NO: 393730 - DNA, 16 bp, M. musculus
ctccctccaccatgtg

SEQ ID NO: 393731 - DNA, 16 bp, M. musculus
ctccctcccaagtgag

SEQ ID NO: 393732 - DNA, 16 bp, M. musculus
ctccctcccagatcct

SEQ ID NO: 393733 - DNA, 16 bp, M. musculus
ctccctcccaggaagt

SEQ ID NO: 393734 - DNA, 16 bp, M. musculus
ctccctccctccactg

SEQ ID NO: 393735 - DNA, 16 bp, M. musculus
ctccctccctccagct

SEQ ID NO: 393736 - DNA, 16 bp, M. musculus
ctccctccctggagaa

SEQ ID NO: 393737 - DNA, 16 bp, M. musculus
ctccctcctccagctc

SEQ ID NO: 393738 - DNA, 16 bp, M. musculus
ctccctctatctcctg

SEQ ID NO: 393739 - DNA, 16 bp, M. musculus
ctccctctctgtgtct

SEQ ID NO: 393740 - DNA, 16 bp, M. musculus
ctccctctgccctgtt

SEQ ID NO: 393741 - DNA, 16 bp, M. musculus
ctccctctgctgcctg

SEQ ID NO: 393742 - DNA, 16 bp, M. musculus
ctccctctgcttctgt

SEQ ID NO: 393743 - DNA, 16 bp, M. musculus
ctccctctgtgtctct

SEQ ID NO: 393744 - DNA, 16 bp, M. musculus
ctccctctgtgtgtct

SEQ ID NO: 393745 - DNA, 16 bp, M. musculus
ctccctcttctggtct

SEQ ID NO: 393746 - DNA, 16 bp, M. musculus
ctccctgaagctggag

SEQ ID NO: 393747 - DNA, 16 bp, M. musculus
ctccctgacccaccca

SEQ ID NO: 393748 - DNA, 16 bp, M. musculus
ctccctgacctgtttg

SEQ ID NO: 393749 - DNA, 23 bp, M. musculus
ctccctgattggctgcagcccat

SEQ ID NO: 393750 - DNA, 16 bp, M. musculus
ctccctgccagactcc

SEQ ID NO: 393751 - DNA, 16 bp, M. musculus
ctccctgcccacctgt

SEQ ID NO: 393752 - DNA, 16 bp, M. musculus
ctccctgcctcagttt

SEQ ID NO: 393753 - DNA, 16 bp, M. musculus
ctccctgcctctacct

SEQ ID NO: 393754 - DNA, 16 bp, M. musculus
ctccctgctgcctctg

SEQ ID NO: 393755 - DNA, 16 bp, M. musculus
ctccctgctgcctgtg

SEQ ID NO: 393756 - DNA, 16 bp, M. musculus
ctccctgctggaggtg

SEQ ID NO: 393757 - DNA, 16 bp, M. musculus
ctccctgcttcctgct

SEQ ID NO: 393758 - DNA, 16 bp, M. musculus
ctccctgcttctctgc

SEQ ID NO: 393759 - DNA, 16 bp, M. musculus
ctccctggaggccaac

SEQ ID NO: 393760 - DNA, 16 bp, M. musculus
ctccctggagttggag

SEQ ID NO: 393761 - DNA, 16 bp, M. musculus
ctccctggccctggca

SEQ ID NO: 393762 - DNA, 16 bp, M. musculus
ctccctgggcctccag

SEQ ID NO: 393763 - DNA, 16 bp, M. musculus
ctccctgggtcaaaca

SEQ ID NO: 393764 - DNA, 16 bp, M. musculus
ctccctgggtgcccag

SEQ ID NO: 393765 - DNA, 16 bp, M. musculus
ctccctggtctgctga

SEQ ID NO: 393766 - DNA, 16 bp, M. musculus
ctccctggtcttctat

SEQ ID NO: 393767 - DNA, 16 bp, M. musculus
ctccctgtagaccagg

SEQ ID NO: 393768 - DNA, 16 bp, M. musculus
ctccctgtctgaatgt

SEQ ID NO: 393769 - DNA, 20 bp, M. musculus
ctccctgtcttaatcttctg

SEQ ID NO: 393770 - DNA, 16 bp, M. musculus
ctccctgtctttgtct

SEQ ID NO: 393771 - DNA, 16 bp, M. musculus
ctccctgttcctctgg

SEQ ID NO: 393772 - DNA, 16 bp, M. musculus
ctcccttcccaggtga

SEQ ID NO: 393773 - DNA, 16 bp, M. musculus
ctcccttctaagtggg

SEQ ID NO: 393774 - DNA, 16 bp, M. musculus
ctcccttctcagagaa

SEQ ID NO: 393775 - DNA, 16 bp, M. musculus
ctcccttctggagggg

SEQ ID NO: 393776 - DNA, 16 bp, M. musculus
ctcccttcttccccag

SEQ ID NO: 393777 - DNA, 16 bp, M. musculus
ctcccttgattatttt

SEQ ID NO: 393778 - DNA, 16 bp, M. musculus
ctcccttgccaaagat

SEQ ID NO: 393779 - DNA, 16 bp, M. musculus
ctcccttgggcctcca

SEQ ID NO: 393780 - DNA, 20 bp, M. musculus
ctcccttgtcgaagatcaag

SEQ ID NO: 393781 - DNA, 16 bp, M. musculus
ctcccttgtctggcct

SEQ ID NO: 393782 - DNA, 16 bp, M. musculus
ctccctttgcctccca

SEQ ID NO: 393783 - DNA, 16 bp, M. musculus
ctccctttgtagacca

SEQ ID NO: 393784 - DNA, 16 bp, M. musculus
ctcccttttcctggcc

SEQ ID NO: 393785 - DNA, 16 bp, M. musculus
ctcccttttgcctgta

SEQ ID NO: 393786 - DNA, 16 bp, M. musculus
ctccggaagagcagca

SEQ ID NO: 393787 - DNA, 16 bp, M. musculus
ctccggaagcagaggc

SEQ ID NO: 393788 - DNA, 16 bp, M. musculus
ctccggagtgctggga

SEQ ID NO: 393789 - DNA, 16 bp, M. musculus
ctccggcctagtctca

SEQ ID NO: 393790 - DNA, 16 bp, M. musculus
ctccggggtgtactgg

SEQ ID NO: 393791 - DNA, 29 bp, M. musculus
ctccgtgtcaccttcactgaaccagggaa

SEQ ID NO: 393792 - DNA, 16 bp, M. musculus
ctcctaaagcaggagc

SEQ ID NO: 393793 - DNA, 16 bp, M. musculus
ctcctaaagtttccag

SEQ ID NO: 393794 - DNA, 16 bp, M. musculus
ctcctaacccaaaaca

SEQ ID NO: 393795 - DNA, 16 bp, M. musculus
ctcctaagagctggga

SEQ ID NO: 393796 - DNA, 16 bp, M. musculus
ctcctaagagtgccac

SEQ ID NO: 393797 - DNA, 16 bp, M. musculus
ctcctaagtactggaa

SEQ ID NO: 393798 - DNA, 16 bp, M. musculus
ctcctacaaggttgcc

SEQ ID NO: 393799 - DNA, 16 bp, M. musculus
ctcctacagaatctcc

SEQ ID NO: 393800 - DNA, 16 bp, M. musculus
ctcctacaggatctcc

SEQ ID NO: 393801 - DNA, 16 bp, M. musculus
ctcctacatcaatcat

SEQ ID NO: 393802 - DNA, 16 bp, M. musculus
ctcctacatcatctta

SEQ ID NO: 393803 - DNA, 16 bp, M. musculus
ctcctacccctgcctc

SEQ ID NO: 393804 - DNA, 16 bp, M. musculus
ctcctacctcagcctc

SEQ ID NO: 393805 - DNA, 16 bp, M. musculus
ctcctacctcagcttc

SEQ ID NO: 393806 - DNA, 16 bp, M. musculus
ctcctacctctgcttc

SEQ ID NO: 393807 - DNA, 16 bp, M. musculus
ctcctacctctggctc

SEQ ID NO: 393808 - DNA, 16 bp, M. musculus
ctcctacctgctgagc

SEQ ID NO: 393809 - DNA, 16 bp, M. musculus
ctcctactcagagcac

SEQ ID NO: 393810 - DNA, 16 bp, M. musculus
ctcctactgatgtcca

SEQ ID NO: 393811 - DNA, 16 bp, M. musculus
ctcctagaactggagt

SEQ ID NO: 393812 - DNA, 16 bp, M. musculus
ctcctagctctgcctc

SEQ ID NO: 393813 - DNA, 16 bp, M. musculus
ctcctaggactcaaag

SEQ ID NO: 393814 - DNA, 16 bp, M. musculus
ctcctagtccttctca

SEQ ID NO: 393815 - DNA, 16 bp, M. musculus
ctcctataaccccagg

SEQ ID NO: 393816 - DNA, 16 bp, M. musculus
ctcctatctcagcctc

SEQ ID NO: 393817 - DNA, 16 bp, M. musculus
ctcctatctcagtctc

SEQ ID NO: 393818 - DNA, 16 bp, M. musculus
ctcctcaaaggagaca

SEQ ID NO: 393819 - DNA, 16 bp, M. musculus
ctcctcaacagccttg

SEQ ID NO: 393820 - DNA, 16 bp, M. musculus
ctcctcagagaaggag

SEQ ID NO: 393821 - DNA, 16 bp, M. musculus
ctcctcagcctcagct

SEQ ID NO: 393822 - DNA, 16 bp, M. musculus
ctcctcagctcctcag

SEQ ID NO: 393823 - DNA, 16 bp, M. musculus
ctcctcagcttcctcc

SEQ ID NO: 393824 - DNA, 16 bp, M. musculus
ctcctcagtctctggg

SEQ ID NO: 393825 - DNA, 16 bp, M. musculus
ctcctcagtgctggaa

SEQ ID NO: 393826 - DNA, 16 bp, M. musculus
ctcctcatctgtaaaa

SEQ ID NO: 393827 - DNA, 16 bp, M. musculus
ctcctcatcttcctgc

SEQ ID NO: 393828 - DNA, 16 bp, M. musculus
ctcctccaaccaggtc

SEQ ID NO: 393829 - DNA, 16 bp, M. musculus
ctcctccagcaagacc

SEQ ID NO: 393830 - DNA, 16 bp, M. musculus
ctcctccagcaccaag

SEQ ID NO: 393831 - DNA, 16 bp, M. musculus
ctcctccagccccatg

SEQ ID NO: 393832 - DNA, 16 bp, M. musculus
ctcctccagctccatg

SEQ ID NO: 393833 - DNA, 16 bp, M. musculus
ctcctccagtgctggt

SEQ ID NO: 393834 - DNA, 16 bp, M. musculus
ctcctccatcaaggcc

SEQ ID NO: 393835 - DNA, 16 bp, M. musculus
ctcctccatgtcctcc

SEQ ID NO: 393836 - DNA, 16 bp, M. musculus
ctcctccatgtctctg

SEQ ID NO: 393837 - DNA, 16 bp, M. musculus
ctcctcccaatgatgc

SEQ ID NO: 393838 - DNA, 16 bp, M. musculus
ctcctcccacaatcct

SEQ ID NO: 393839 - DNA, 16 bp, M. musculus
ctcctcccaccctgct

SEQ ID NO: 393840 - DNA, 16 bp, M. musculus
ctcctcccagcagctg

SEQ ID NO: 393841 - DNA, 16 bp, M. musculus
ctcctcccagccctgc

SEQ ID NO: 393842 - DNA, 16 bp, M. musculus
ctcctcccagctctcc

SEQ ID NO: 393843 - DNA, 16 bp, M. musculus
ctcctcccagtcccac

SEQ ID NO: 393844 - DNA, 16 bp, M. musculus
ctcctcccagtcccct

SEQ ID NO: 393845 - DNA, 16 bp, M. musculus
ctcctcccagtccctc

SEQ ID NO: 393846 - DNA, 16 bp, M. musculus
ctcctcccagtcctgc

SEQ ID NO: 393847 - DNA, 16 bp, M. musculus
ctcctcccagttacct

SEQ ID NO: 393848 - DNA, 16 bp, M. musculus
ctcctcccagttccac

SEQ ID NO: 393849 - DNA, 16 bp, M. musculus
ctcctccccagccctg

SEQ ID NO: 393850 - DNA, 16 bp, M. musculus
ctcctccctcagaccc

SEQ ID NO: 393851 - DNA, 16 bp, M. musculus
ctcctccctcagcctc

SEQ ID NO: 393852 - DNA, 16 bp, M. musculus
ctcctccctcagctcc

SEQ ID NO: 393853 - DNA, 16 bp, M. musculus
ctcctccctgaggact

SEQ ID NO: 393854 - DNA, 16 bp, M. musculus
ctcctcccttggggac

SEQ ID NO: 393855 - DNA, 16 bp, M. musculus
ctcctcctcaggttct

SEQ ID NO: 393856 - DNA, 16 bp, M. musculus
ctcctcctccaacaag

SEQ ID NO: 393857 - DNA, 16 bp, M. musculus
ctcctcctccagcact

SEQ ID NO: 393858 - DNA, 16 bp, M. musculus
ctcctcctccagctcc

SEQ ID NO: 393859 - DNA, 16 bp, M. musculus
ctcctcctcctccagg

SEQ ID NO: 393860 - DNA, 16 bp, M. musculus
ctcctcctcctcttgg

SEQ ID NO: 393861 - DNA, 16 bp, M. musculus
ctcctcctcggctgaa

SEQ ID NO: 393862 - DNA, 16 bp, M. musculus
ctcctcctgaggctga

SEQ ID NO: 393863 - DNA, 27 bp, M. musculus
ctcctcctgcaccatgcctgcctggac

SEQ ID NO: 393864 - DNA, 16 bp, M. musculus
ctcctcctgccttagc

SEQ ID NO: 393865 - DNA, 16 bp, M. musculus
ctcctcctgctcccca

SEQ ID NO: 393866 - DNA, 16 bp, M. musculus
ctcctcctgctgcctg

SEQ ID NO: 393867 - DNA, 16 bp, M. musculus
ctcctcctgctgcttc

SEQ ID NO: 393868 - DNA, 16 bp, M. musculus
ctcctcctggaccatg

SEQ ID NO: 393869 - DNA, 16 bp, M. musculus
ctcctcctggttgcct

SEQ ID NO: 393870 - DNA, 16 bp, M. musculus
ctcctcctgtctctgc

SEQ ID NO: 393871 - DNA, 16 bp, M. musculus
ctcctcctgtctgcct

SEQ ID NO: 393872 - DNA, 16 bp, M. musculus
ctcctccttcaccatg

SEQ ID NO: 393873 - DNA, 16 bp, M. musculus
ctcctccttttctgtg

SEQ ID NO: 393874 - DNA, 16 bp, M. musculus
ctcctcgggcaccagg

SEQ ID NO: 393875 - DNA, 16 bp, M. musculus
ctcctcggtgctggga

SEQ ID NO: 393876 - DNA, 16 bp, M. musculus
ctcctctattaggcaa

SEQ ID NO: 393877 - DNA, 16 bp, M. musculus
ctcctctcaatttcca

SEQ ID NO: 393878 - DNA, 16 bp, M. musculus
ctcctctcagatgtct

SEQ ID NO: 393879 - DNA, 16 bp, M. musculus
ctcctctccagcacca

SEQ ID NO: 393880 - DNA, 16 bp, M. musculus
ctcctctccagcctcc

SEQ ID NO: 393881 - DNA, 16 bp, M. musculus
ctcctctccctgctca

SEQ ID NO: 393882 - DNA, 16 bp, M. musculus
ctcctctcctccaaat

SEQ ID NO: 393883 - DNA, 16 bp, M. musculus
ctcctctctgatgact

SEQ ID NO: 393884 - DNA, 16 bp, M. musculus
ctcctctctggcttct

SEQ ID NO: 393885 - DNA, 16 bp, M. musculus
ctcctctcttacctga

SEQ ID NO: 393886 - DNA, 16 bp, M. musculus
ctcctctcttcccagt

SEQ ID NO: 393887 - DNA, 16 bp, M. musculus
ctcctctgaccccaag

SEQ ID NO: 393888 - DNA, 16 bp, M. musculus
ctcctctgacctctgc

SEQ ID NO: 393889 - DNA, 16 bp, M. musculus
ctcctctgagaaggtg

SEQ ID NO: 393890 - DNA, 16 bp, M. musculus
ctcctctgagagggtg

SEQ ID NO: 393891 - DNA, 65 bp, M. musculus
ctcctctgaggaaacagactgggaggaagaagcagcccattaccagccagctaattggtcaagaa

SEQ ID NO: 393892 - DNA, 16 bp, M. musculus
ctcctctgaggaagag

SEQ ID NO: 393893 - DNA, 16 bp, M. musculus
ctcctctgcccaccca

SEQ ID NO: 393894 - DNA, 16 bp, M. musculus
ctcctctgcctctgtc

SEQ ID NO: 393895 - DNA, 16 bp, M. musculus
ctcctctggctgggaa

SEQ ID NO: 393896 - DNA, 16 bp, M. musculus
ctcctctggggactgt

SEQ ID NO: 393897 - DNA, 16 bp, M. musculus
ctcctctggtgacccc

SEQ ID NO: 393898 - DNA, 16 bp, M. musculus
ctcctctgtctcctgc

SEQ ID NO: 393899 - DNA, 16 bp, M. musculus
ctcctctgtctctgcc

SEQ ID NO: 393900 - DNA, 16 bp, M. musculus
ctcctctgtctgtctg

SEQ ID NO: 393901 - DNA, 16 bp, M. musculus
ctcctctgtggcctct

SEQ ID NO: 393902 - DNA, 16 bp, M. musculus
ctcctctgttgaagga

SEQ ID NO: 393903 - DNA, 16 bp, M. musculus
ctcctctgttgctggt

SEQ ID NO: 393904 - DNA, 16 bp, M. musculus
ctcctcttcaagctga

SEQ ID NO: 393905 - DNA, 16 bp, M. musculus
ctcctcttccagcctc

SEQ ID NO: 393906 - DNA, 16 bp, M. musculus
ctcctcttccagcctt

SEQ ID NO: 393907 - DNA, 16 bp, M. musculus
ctcctcttcctcagct

SEQ ID NO: 393908 - DNA, 16 bp, M. musculus
ctcctcttgcaaggaa

SEQ ID NO: 393909 - DNA, 16 bp, M. musculus
ctcctcttgcagagaa

SEQ ID NO: 393910 - DNA, 16 bp, M. musculus
ctcctcttgcagggca

SEQ ID NO: 393911 - DNA, 16 bp, M. musculus
ctcctcttgcctgcat

SEQ ID NO: 393912 - DNA, 16 bp, M. musculus
ctcctgaaaagattca

SEQ ID NO: 393913 - DNA, 16 bp, M. musculus
ctcctgaaaggccctg

SEQ ID NO: 393914 - DNA, 16 bp, M. musculus
ctcctgaagcagatgg

SEQ ID NO: 393915 - DNA, 17 bp, M. musculus
ctcctgacagaagttgt

SEQ ID NO: 393916 - DNA, 16 bp, M. musculus
ctcctgaccactgagc

SEQ ID NO: 393917 - DNA, 16 bp, M. musculus
ctcctgaccctgcctc

SEQ ID NO: 393918 - DNA, 16 bp, M. musculus
ctcctgactccacctc

SEQ ID NO: 393919 - DNA, 16 bp, M. musculus
ctcctgactctacctc

SEQ ID NO: 393920 - DNA, 16 bp, M. musculus
ctcctgactctgcctc

SEQ ID NO: 393921 - DNA, 16 bp, M. musculus
ctcctgacttcctcat

SEQ ID NO: 393922 - DNA, 16 bp, M. musculus
ctcctgagaactgaga

SEQ ID NO: 393923 - DNA, 16 bp, M. musculus
ctcctgagagctgggc

SEQ ID NO: 393924 - DNA, 16 bp, M. musculus
ctcctgagatacagag

SEQ ID NO: 393925 - DNA, 16 bp, M. musculus
ctcctgagcactgaga

SEQ ID NO: 393926 - DNA, 16 bp, M. musculus
ctcctgaggactggga

SEQ ID NO: 393927 - DNA, 16 bp, M. musculus
ctcctgagggcctttg

SEQ ID NO: 393928 - DNA, 30 bp, M. musculus
ctcctgagtcagaacgtgggggagtcctca

SEQ ID NO: 393929 - DNA, 16 bp, M. musculus
ctcctgagtgctagaa

SEQ ID NO: 393930 - DNA, 16 bp, M. musculus
ctcctgagtgctgcca

SEQ ID NO: 393931 - DNA, 16 bp, M. musculus
ctcctgagtgctgggg

SEQ ID NO: 393932 - DNA, 16 bp, M. musculus
ctcctgagtgtgtgaa

SEQ ID NO: 393933 - DNA, 16 bp, M. musculus
ctcctgagttccagtg

SEQ ID NO: 393934 - DNA, 16 bp, M. musculus
ctcctgatccttctgt

SEQ ID NO: 393935 - DNA, 16 bp, M. musculus
ctcctgatcttcctga

SEQ ID NO: 393936 - DNA, 16 bp, M. musculus
ctcctgatcttccttc

SEQ ID NO: 393937 - DNA, 17 bp, M. musculus
ctcctgatgattgagac

SEQ ID NO: 393938 - DNA, 16 bp, M. musculus
ctcctgcaatgaggac

SEQ ID NO: 393939 - DNA, 16 bp, M. musculus
ctcctgcactgtgcct

SEQ ID NO: 393940 - DNA, 16 bp, M. musculus
ctcctgcagcagatga

SEQ ID NO: 393941 - DNA, 16 bp, M. musculus
ctcctgcagcccaggc

SEQ ID NO: 393942 - DNA, 16 bp, M. musculus
ctcctgcatccacctc

SEQ ID NO: 393943 - DNA, 16 bp, M. musculus
ctcctgccagaaggcc

SEQ ID NO: 393944 - DNA, 16 bp, M. musculus
ctcctgccagacacag

SEQ ID NO: 393945 - DNA, 16 bp, M. musculus
ctcctgccccactgct

SEQ ID NO: 393946 - DNA, 16 bp, M. musculus
ctcctgccccatgcct

SEQ ID NO: 393947 - DNA, 16 bp, M. musculus
ctcctgccctgacttt

SEQ ID NO: 393948 - DNA, 16 bp, M. musculus
ctcctgccctgggtcc

SEQ ID NO: 393949 - DNA, 16 bp, M. musculus
ctcctgcccttagtga

SEQ ID NO: 393950 - DNA, 16 bp, M. musculus
ctcctgcctcacagcc

SEQ ID NO: 393951 - DNA, 16 bp, M. musculus
ctcctgcctcaccacc

SEQ ID NO: 393952 - DNA, 16 bp, M. musculus
ctcctgcctcacctcc

SEQ ID NO: 393953 - DNA, 16 bp, M. musculus
ctcctgcctcactgtc

SEQ ID NO: 393954 - DNA, 16 bp, M. musculus
ctcctgcctcacttcc

SEQ ID NO: 393955 - DNA, 16 bp, M. musculus
ctcctgcctcagattc

SEQ ID NO: 393956 - DNA, 16 bp, M. musculus
ctcctgcctcagcaca

SEQ ID NO: 393957 - DNA, 16 bp, M. musculus
ctcctgcctcagcatc

SEQ ID NO: 393958 - DNA, 16 bp, M. musculus
ctcctgcctcagccct

SEQ ID NO: 393959 - DNA, 16 bp, M. musculus
ctcctgcctcagcttg

SEQ ID NO: 393960 - DNA, 16 bp, M. musculus
ctcctgcctcaggacc

SEQ ID NO: 393961 - DNA, 16 bp, M. musculus
ctcctgcctcagtgcc

SEQ ID NO: 393962 - DNA, 16 bp, M. musculus
ctcctgcctcatcttc

SEQ ID NO: 393963 - DNA, 16 bp, M. musculus
ctcctgcctccagcct

SEQ ID NO: 393964 - DNA, 16 bp, M. musculus
ctcctgcctccagctt

SEQ ID NO: 393965 - DNA, 16 bp, M. musculus
ctcctgcctccaggtc

SEQ ID NO: 393966 - DNA, 16 bp, M. musculus
ctcctgcctccccaca

SEQ ID NO: 393967 - DNA, 16 bp, M. musculus
ctcctgcctccctacc

SEQ ID NO: 393968 - DNA, 16 bp, M. musculus
ctcctgcctcctgacc

SEQ ID NO: 393969 - DNA, 16 bp, M. musculus
ctcctgcctcggcctc

SEQ ID NO: 393970 - DNA, 16 bp, M. musculus
ctcctgcctctccacc

SEQ ID NO: 393971 - DNA, 16 bp, M. musculus
ctcctgcctctcctgt

SEQ ID NO: 393972 - DNA, 16 bp, M. musculus
ctcctgcctctgccac

SEQ ID NO: 393973 - DNA, 16 bp, M. musculus
ctcctgcctctgcctg

SEQ ID NO: 393974 - DNA, 16 bp, M. musculus
ctcctgcctctgtgcc

SEQ ID NO: 393975 - DNA, 16 bp, M. musculus
ctcctgcctctgtgtc

SEQ ID NO: 393976 - DNA, 16 bp, M. musculus
ctcctgcctgagcctc

SEQ ID NO: 393977 - DNA, 16 bp, M. musculus
ctcctgcctggaaaag

SEQ ID NO: 393978 - DNA, 16 bp, M. musculus
ctcctgcctttgcctc

SEQ ID NO: 393979 - DNA, 16 bp, M. musculus
ctcctgctcaccaatc

SEQ ID NO: 393980 - DNA, 16 bp, M. musculus
ctcctgctcagcttct

SEQ ID NO: 393981 - DNA, 16 bp, M. musculus
ctcctgctccagcttc

SEQ ID NO: 393982 - DNA, 16 bp, M. musculus
ctcctgctcctgcctg

SEQ ID NO: 393983 - DNA, 16 bp, M. musculus
ctcctgctcctgctgc

SEQ ID NO: 393984 - DNA, 16 bp, M. musculus
ctcctgctctcctgct

SEQ ID NO: 393985 - DNA, 16 bp, M. musculus
ctcctgctctctgcct

SEQ ID NO: 393986 - DNA, 16 bp, M. musculus
ctcctgctctgatgac

SEQ ID NO: 393987 - DNA, 16 bp, M. musculus
ctcctgctgactggag

SEQ ID NO: 393988 - DNA, 16 bp, M. musculus
ctcctgctgcagctgt

SEQ ID NO: 393989 - DNA, 16 bp, M. musculus
ctcctgctgccctgat

SEQ ID NO: 393990 - DNA, 16 bp, M. musculus
ctcctgctgcctgcag

SEQ ID NO: 393991 - DNA, 16 bp, M. musculus
ctcctgctgctgcctg

SEQ ID NO: 393992 - DNA, 16 bp, M. musculus
ctcctgctgctgctcc

SEQ ID NO: 393993 - DNA, 16 bp, M. musculus
ctcctgctgctgctgc

SEQ ID NO: 393994 - DNA, 16 bp, M. musculus
ctcctgctgctgctgt

SEQ ID NO: 393995 - DNA, 16 bp, M. musculus
ctcctgctgctgcttc

SEQ ID NO: 393996 - DNA, 16 bp, M. musculus
ctcctgctgctgtgtg

SEQ ID NO: 393997 - DNA, 16 bp, M. musculus
ctcctgctggccccag

SEQ ID NO: 393998 - DNA, 16 bp, M. musculus
ctcctgctgtgtgatg

SEQ ID NO: 393999 - DNA, 16 bp, M. musculus
ctcctgcttcaacctc

SEQ ID NO: 394000 - DNA, 16 bp, M. musculus
ctcctgcttcagcccc

SEQ ID NO: 394001 - DNA, 16 bp, M. musculus
ctcctgcttcagcctc

SEQ ID NO: 394002 - DNA, 16 bp, M. musculus
ctcctgcttccatctc

SEQ ID NO: 394003 - DNA, 16 bp, M. musculus
ctcctgcttcctgagc

SEQ ID NO: 394004 - DNA, 16 bp, M. musculus
ctcctgcttctcaggg

SEQ ID NO: 394005 - DNA, 16 bp, M. musculus
ctcctgcttctgctcc

SEQ ID NO: 394006 - DNA, 16 bp, M. musculus
ctcctgctttcctgtc

SEQ ID NO: 394007 - DNA, 16 bp, M. musculus
ctcctgctttctgccc

SEQ ID NO: 394008 - DNA, 16 bp, M. musculus
ctcctggaaccctggc

SEQ ID NO: 394009 - DNA, 16 bp, M. musculus
ctcctggaagaagatg

SEQ ID NO: 394010 - DNA, 16 bp, M. musculus
ctcctggaagaagttg

SEQ ID NO: 394011 - DNA, 16 bp, M. musculus
ctcctggaagaccagc

SEQ ID NO: 394012 - DNA, 16 bp, M. musculus
ctcctggaagagaaag

SEQ ID NO: 394013 - DNA, 16 bp, M. musculus
ctcctggaagagacag

SEQ ID NO: 394014 - DNA, 16 bp, M. musculus
ctcctggaagagagag

SEQ ID NO: 394015 - DNA, 16 bp, M. musculus
ctcctggaaggcaggc

SEQ ID NO: 394016 - DNA, 16 bp, M. musculus
ctcctggaagtggagt

SEQ ID NO: 394017 - DNA, 16 bp, M. musculus
ctcctggaatcctggg

SEQ ID NO: 394018 - DNA, 16 bp, M. musculus
ctcctggacagccagg

SEQ ID NO: 394019 - DNA, 16 bp, M. musculus
ctcctggactcatgct

SEQ ID NO: 394020 - DNA, 16 bp, M. musculus
ctcctggagcaggagt

SEQ ID NO: 394021 - DNA, 16 bp, M. musculus
ctcctggagctggagc

SEQ ID NO: 394022 - DNA, 16 bp, M. musculus
ctcctggaggcatttc

SEQ ID NO: 394023 - DNA, 16 bp, M. musculus
ctcctggagtctagcg

SEQ ID NO: 394024 - DNA, 16 bp, M. musculus
ctcctggagtgtctga

SEQ ID NO: 394025 - DNA, 16 bp, M. musculus
ctcctggatcaccaat

SEQ ID NO: 394026 - DNA, 16 bp, M. musculus
ctcctggcagaaattg

SEQ ID NO: 394027 - DNA, 18 bp, M. musculus
ctcctggcagaagttgtg

SEQ ID NO: 394028 - DNA, 16 bp, M. musculus
ctcctggcagccttca

SEQ ID NO: 394029 - DNA, 16 bp, M. musculus
ctcctggccctcaggg

SEQ ID NO: 394030 - DNA, 16 bp, M. musculus
ctcctggcctctgtgg

SEQ ID NO: 394031 - DNA, 16 bp, M. musculus
ctcctggctaaggatg

SEQ ID NO: 394032 - DNA, 16 bp, M. musculus
ctcctggctccttctc

SEQ ID NO: 394033 - DNA, 16 bp, M. musculus
ctcctggctctgctgt

SEQ ID NO: 394034 - DNA, 16 bp, M. musculus
ctcctggctgaagaag

SEQ ID NO: 394035 - DNA, 16 bp, M. musculus
ctcctggctgaggatg

SEQ ID NO: 394036 - DNA, 16 bp, M. musculus
ctcctggctgcctgga

SEQ ID NO: 394037 - DNA, 16 bp, M. musculus
ctcctggctgcctttg

SEQ ID NO: 394038 - DNA, 16 bp, M. musculus
ctcctggctggcctgg

SEQ ID NO: 394039 - DNA, 16 bp, M. musculus
ctcctggctgtcctgg

SEQ ID NO: 394040 - DNA, 16 bp, M. musculus
ctcctggcttcctttg

SEQ ID NO: 394041 - DNA, 16 bp, M. musculus
ctcctgggaagactgg

SEQ ID NO: 394042 - DNA, 16 bp, M. musculus
ctcctgggacccagaa

SEQ ID NO: 394043 - DNA, 16 bp, M. musculus
ctcctgggagaccagg

SEQ ID NO: 394044 - DNA, 16 bp, M. musculus
ctcctgggagctggga

SEQ ID NO: 394045 - DNA, 16 bp, M. musculus
ctcctgggattcatag

SEQ ID NO: 394046 - DNA, 16 bp, M. musculus
ctcctgggcatagacc

SEQ ID NO: 394047 - DNA, 16 bp, M. musculus
ctcctgggccaggcag

SEQ ID NO: 394048 - DNA, 16 bp, M. musculus
ctcctgggccgggcgg

SEQ ID NO: 394049 - DNA, 16 bp, M. musculus
ctcctggtagaagatg

SEQ ID NO: 394050 - DNA, 16 bp, M. musculus
ctcctggtccactctc

SEQ ID NO: 394051 - DNA, 16 bp, M. musculus
ctcctggtcctctggg

SEQ ID NO: 394052 - DNA, 16 bp, M. musculus
ctcctggtcctggcat

SEQ ID NO: 394053 - DNA, 16 bp, M. musculus
ctcctggtctctttcc

SEQ ID NO: 394054 - DNA, 16 bp, M. musculus
ctcctggtctgccctc

SEQ ID NO: 394055 - DNA, 16 bp, M. musculus
ctcctggtcttcctgc

SEQ ID NO: 394056 - DNA, 16 bp, M. musculus
ctcctggtgtcctcca

SEQ ID NO: 394057 - DNA, 16 bp, M. musculus
ctcctggtgttcctcc

SEQ ID NO: 394058 - DNA, 16 bp, M. musculus
ctcctgtaagtaacct

SEQ ID NO: 394059 - DNA, 16 bp, M. musculus
ctcctgtaccatacct

SEQ ID NO: 394060 - DNA, 16 bp, M. musculus
ctcctgtagccaggca

SEQ ID NO: 394061 - DNA, 16 bp, M. musculus
ctcctgtagccaggtg

SEQ ID NO: 394062 - DNA, 16 bp, M. musculus
ctcctgtaggaaattg

SEQ ID NO: 394063 - DNA, 16 bp, M. musculus
ctcctgtatcctttct

SEQ ID NO: 394064 - DNA, 16 bp, M. musculus
ctcctgtcagtaagta

SEQ ID NO: 394065 - DNA, 16 bp, M. musculus
ctcctgtcatcaagct

SEQ ID NO: 394066 - DNA, 16 bp, M. musculus
ctcctgtccacaagca

SEQ ID NO: 394067 - DNA, 16 bp, M. musculus
ctcctgtcccagcctc

SEQ ID NO: 394068 - DNA, 16 bp, M. musculus
ctcctgtcccaggctg

SEQ ID NO: 394069 - DNA, 16 bp, M. musculus
ctcctgtcccagggga

SEQ ID NO: 394070 - DNA, 16 bp, M. musculus
ctcctgtctcaacttc

SEQ ID NO: 394071 - DNA, 16 bp, M. musculus
ctcctgtctcagcctt

SEQ ID NO: 394072 - DNA, 16 bp, M. musculus
ctcctgtctcagtgtt

SEQ ID NO: 394073 - DNA, 16 bp, M. musculus
ctcctgtctccacatc

SEQ ID NO: 394074 - DNA, 16 bp, M. musculus
ctcctgtctccaccca

SEQ ID NO: 394075 - DNA, 16 bp, M. musculus
ctcctgtctccactcc

SEQ ID NO: 394076 - DNA, 16 bp, M. musculus
ctcctgtctccatctc

SEQ ID NO: 394077 - DNA, 16 bp, M. musculus
ctcctgtctcctgtct

SEQ ID NO: 394078 - DNA, 16 bp, M. musculus
ctcctgtctccttcca

SEQ ID NO: 394079 - DNA, 16 bp, M. musculus
ctcctgtctctacctc

SEQ ID NO: 394080 - DNA, 16 bp, M. musculus
ctcctgtctctcccta

SEQ ID NO: 394081 - DNA, 16 bp, M. musculus
ctcctgtctctgccct

SEQ ID NO: 394082 - DNA, 16 bp, M. musculus
ctcctgtctctgcctc

SEQ ID NO: 394083 - DNA, 16 bp, M. musculus
ctcctgtctctgtctg

SEQ ID NO: 394084 - DNA, 16 bp, M. musculus
ctcctgtctgcaagca

SEQ ID NO: 394085 - DNA, 16 bp, M. musculus
ctcctgtctgcatgca

SEQ ID NO: 394086 - DNA, 16 bp, M. musculus
ctcctgtctgtaagca

SEQ ID NO: 394087 - DNA, 16 bp, M. musculus
ctcctgtctgtgagca

SEQ ID NO: 394088 - DNA, 16 bp, M. musculus
ctcctgtcttcacctc

SEQ ID NO: 394089 - DNA, 16 bp, M. musculus
ctcctgtcttctccca

SEQ ID NO: 394090 - DNA, 16 bp, M. musculus
ctcctgtcttggcctc

SEQ ID NO: 394091 - DNA, 16 bp, M. musculus
ctcctgtgagcaagca

SEQ ID NO: 394092 - DNA, 16 bp, M. musculus
ctcctgtgaggccttc

SEQ ID NO: 394093 - DNA, 16 bp, M. musculus
ctcctgtgcaccctgg

SEQ ID NO: 394094 - DNA, 16 bp, M. musculus
ctcctgtgctcaagct

SEQ ID NO: 394095 - DNA, 16 bp, M. musculus
ctcctgtgctctctgc

SEQ ID NO: 394096 - DNA, 16 bp, M. musculus
ctcctgtgggggctgt

SEQ ID NO: 394097 - DNA, 16 bp, M. musculus
ctcctgtgtctgcctc

SEQ ID NO: 394098 - DNA, 16 bp, M. musculus
ctcctgtgtctgcttt

SEQ ID NO: 394099 - DNA, 16 bp, M. musculus
ctcctgtgtgtgtgtg

SEQ ID NO: 394100 - DNA, 16 bp, M. musculus
ctcctgttccaggccc

SEQ ID NO: 394101 - DNA, 16 bp, M. musculus
ctcctgttcctgctcc

SEQ ID NO: 394102 - DNA, 16 bp, M. musculus
ctcctgttgtggtgac

SEQ ID NO: 394103 - DNA, 16 bp, M. musculus
ctcctgtttctccatg

SEQ ID NO: 394104 - DNA, 16 bp, M. musculus
ctcctgtttctcttca

SEQ ID NO: 394105 - DNA, 16 bp, M. musculus
ctcctgtttgccttct

SEQ ID NO: 394106 - DNA, 16 bp, M. musculus
ctccttacaggaaacc

SEQ ID NO: 394107 - DNA, 16 bp, M. musculus
ctccttagtgatctta

SEQ ID NO: 394108 - DNA, 16 bp, M. musculus
ctccttagtggcagca

SEQ ID NO: 394109 - DNA, 16 bp, M. musculus
ctccttcaaggaatgt

SEQ ID NO: 394110 - DNA, 16 bp, M. musculus
ctccttcagccagcac

SEQ ID NO: 394111 - DNA, 16 bp, M. musculus
ctccttcagcccttcc

SEQ ID NO: 394112 - DNA, 16 bp, M. musculus
ctccttcagctgataa

SEQ ID NO: 394113 - DNA, 16 bp, M. musculus
ctccttcagtcctccc

SEQ ID NO: 394114 - DNA, 16 bp, M. musculus
ctccttcagtcctcct

SEQ ID NO: 394115 - DNA, 16 bp, M. musculus
ctccttcagtccttcc

SEQ ID NO: 394116 - DNA, 16 bp, M. musculus
ctccttcagtctttcc

SEQ ID NO: 394117 - DNA, 16 bp, M. musculus
ctccttcagttccttc

SEQ ID NO: 394118 - DNA, 16 bp, M. musculus
ctccttcatgataaaa

SEQ ID NO: 394119 - DNA, 16 bp, M. musculus
ctccttcattgggaac

SEQ ID NO: 394120 - DNA, 16 bp, M. musculus
ctccttccaccatgta

SEQ ID NO: 394121 - DNA, 16 bp, M. musculus
ctccttccatggggct

SEQ ID NO: 394122 - DNA, 16 bp, M. musculus
ctccttccatgggggt

SEQ ID NO: 394123 - DNA, 16 bp, M. musculus
ctccttcccagggaga

SEQ ID NO: 394124 - DNA, 16 bp, M. musculus
ctccttcctcagcttc

SEQ ID NO: 394125 - DNA, 16 bp, M. musculus
ctccttcctgccccag

SEQ ID NO: 394126 - DNA, 16 bp, M. musculus
ctccttcctggccctg

SEQ ID NO: 394127 - DNA, 16 bp, M. musculus
ctccttctaccttgtg

SEQ ID NO: 394128 - DNA, 16 bp, M. musculus
ctccttctccagcccc

SEQ ID NO: 394129 - DNA, 16 bp, M. musculus
ctccttctcctgcacc

SEQ ID NO: 394130 - DNA, 16 bp, M. musculus
ctccttctctgaggag

SEQ ID NO: 394131 - DNA, 16 bp, M. musculus
ctccttctctggggca

SEQ ID NO: 394132 - DNA, 16 bp, M. musculus
ctccttctgcctccca

SEQ ID NO: 394133 - DNA, 16 bp, M. musculus
ctccttctgcctcctg

SEQ ID NO: 394134 - DNA, 16 bp, M. musculus
ctccttctgcctgcct

SEQ ID NO: 394135 - DNA, 16 bp, M. musculus
ctccttctgctacctg

SEQ ID NO: 394136 - DNA, 16 bp, M. musculus
ctccttctgctctggt

SEQ ID NO: 394137 - DNA, 16 bp, M. musculus
ctccttctgctgcctg

SEQ ID NO: 394138 - DNA, 16 bp, M. musculus
ctccttctggctgcct

SEQ ID NO: 394139 - DNA, 23 bp, M. musculus
ctccttgagcaggcagaaaaggg

SEQ ID NO: 394140 - DNA, 16 bp, M. musculus
ctccttgcccacctgc

SEQ ID NO: 394141 - DNA, 16 bp, M. musculus
ctccttgcctctgtct

SEQ ID NO: 394142 - DNA, 16 bp, M. musculus
ctccttgcttgcctgt

SEQ ID NO: 394143 - DNA, 16 bp, M. musculus
ctccttggctggtggt

SEQ ID NO: 394144 - DNA, 16 bp, M. musculus
ctccttgggccacctg

SEQ ID NO: 394145 - DNA, 16 bp, M. musculus
ctccttggggcctcca

SEQ ID NO: 394146 - DNA, 16 bp, M. musculus
ctccttggtggtcttt

SEQ ID NO: 394147 - DNA, 16 bp, M. musculus
ctccttggttgatttc

SEQ ID NO: 394148 - DNA, 20 bp, M. musculus
ctccttggtttgcccccact

SEQ ID NO: 394149 - DNA, 16 bp, M. musculus
ctccttgtacaaggct

SEQ ID NO: 394150 - DNA, 16 bp, M. musculus
ctccttgttgggtctt

SEQ ID NO: 394151 - DNA, 16 bp, M. musculus
ctcctttacccactga

SEQ ID NO: 394152 - DNA, 16 bp, M. musculus
ctcctttataaagcgt

SEQ ID NO: 394153 - DNA, 17 bp, M. musculus
ctcctttccaaggacat

SEQ ID NO: 394154 - DNA, 16 bp, M. musculus
ctcctttccctaatcc

SEQ ID NO: 394155 - DNA, 16 bp, M. musculus
ctcctttctgtgtgat

SEQ ID NO: 394156 - DNA, 16 bp, M. musculus
ctcctttgcctctaag

SEQ ID NO: 394157 - DNA, 16 bp, M. musculus
ctcctttgcctgcttg

SEQ ID NO: 394158 - DNA, 16 bp, M. musculus
ctcctttggagaaaac

SEQ ID NO: 394159 - DNA, 17 bp, M. musculus
ctcctttgtggcttgct

SEQ ID NO: 394160 - DNA, 16 bp, M. musculus
ctccttttcaggacaa

SEQ ID NO: 394161 - DNA, 16 bp, M. musculus
ctccttttcatttctg

SEQ ID NO: 394162 - DNA, 16 bp, M. musculus
ctccttttgtgtgtgt

SEQ ID NO: 394163 - DNA, 16 bp, M. musculus
ctcgaattcacagaga

SEQ ID NO: 394164 - DNA, 16 bp, M. musculus
ctcgaattcccctaca

SEQ ID NO: 394165 - DNA, 16 bp, M. musculus
ctcgacactgtgagag

SEQ ID NO: 394166 - DNA, 18 bp, M. musculus
ctcgaccagcaagaacga

SEQ ID NO: 394167 - DNA, 16 bp, M. musculus
ctcgactggagaccag

SEQ ID NO: 394168 - DNA, 16 bp, M. musculus
ctcgagagaaaaccac

SEQ ID NO: 394169 - DNA, 26 bp, M. musculus
ctcgagctgtaagagaggaatctaga

SEQ ID NO: 394170 - DNA, 19 bp, M. musculus
ctcgagtcgagcggaaggg

SEQ ID NO: 394171 - DNA, 16 bp, M. musculus
ctcgagtgtctgaaga

SEQ ID NO: 394172 - DNA, 16 bp, M. musculus
ctcgcgcgcacacaca

SEQ ID NO: 394173 - DNA, 16 bp, M. musculus
ctcggaaaaacaaaac

SEQ ID NO: 394174 - DNA, 16 bp, M. musculus
ctcggcactcctgtgt

SEQ ID NO: 394175 - DNA, 16 bp, M. musculus
ctcggccatgggctgc

SEQ ID NO: 394176 - DNA, 16 bp, M. musculus
ctcgggaggcaaaggc

SEQ ID NO: 394177 - DNA, 16 bp, M. musculus
ctcgggaggcagagga

SEQ ID NO: 394178 - DNA, 16 bp, M. musculus
ctcgggcatcccagac

SEQ ID NO: 394179 - DNA, 16 bp, M. musculus
ctcgggtcaccaggct

SEQ ID NO: 394180 - DNA, 16 bp, M. musculus
ctcgggtcatcaggct

SEQ ID NO: 394181 - DNA, 16 bp, M. musculus
ctcgggtcctcaggct

SEQ ID NO: 394182 - DNA, 16 bp, M. musculus
ctcgggtcttcaggct

SEQ ID NO: 394183 - DNA, 16 bp, M. musculus
ctcggtgggtggtgga

SEQ ID NO: 394184 - DNA, 17 bp, M. musculus
ctcgtccctctctaccc

SEQ ID NO: 394185 - DNA, 16 bp, M. musculus
ctcgtgtctctatctg

SEQ ID NO: 394186 - DNA, 16 bp, M. musculus
ctcgtgtgtctgaaga

SEQ ID NO: 394187 - DNA, 16 bp, M. musculus
ctctaaaaggtcttta

SEQ ID NO: 394188 - DNA, 16 bp, M. musculus
ctctaaagaaataatg

SEQ ID NO: 394189 - DNA, 16 bp, M. musculus
ctctaacaacaaaata

SEQ ID NO: 394190 - DNA, 16 bp, M. musculus
ctctaacactgagcta

SEQ ID NO: 394191 - DNA, 16 bp, M. musculus
ctctaacaggcagcaa

SEQ ID NO: 394192 - DNA, 16 bp, M. musculus
ctctaacagggccaca

SEQ ID NO: 394193 - DNA, 16 bp, M. musculus
ctctaacatcaaaaat

SEQ ID NO: 394194 - DNA, 16 bp, M. musculus
ctctaacatgctcagg

SEQ ID NO: 394195 - DNA, 16 bp, M. musculus
ctctaactccagatcc

SEQ ID NO: 394196 - DNA, 16 bp, M. musculus
ctctaactgccactct

SEQ ID NO: 394197 - DNA, 16 bp, M. musculus
ctctaacttgtaataa

SEQ ID NO: 394198 - DNA, 16 bp, M. musculus
ctctaagaccaagaat

SEQ ID NO: 394199 - DNA, 16 bp, M. musculus
ctctaagtcctccatt

SEQ ID NO: 394200 - DNA, 16 bp, M. musculus
ctctaatgagatctga

SEQ ID NO: 394201 - DNA, 16 bp, M. musculus
ctctacaagaagacca

SEQ ID NO: 394202 - DNA, 16 bp, M. musculus
ctctacacaaaggaca

SEQ ID NO: 394203 - DNA, 16 bp, M. musculus
ctctaccaactgagcc

SEQ ID NO: 394204 - DNA, 16 bp, M. musculus
ctctaccaccaagcta

SEQ ID NO: 394205 - DNA, 16 bp, M. musculus
ctctaccaccgagcta

SEQ ID NO: 394206 - DNA, 16 bp, M. musculus
ctctaccactaagcta

SEQ ID NO: 394207 - DNA, 16 bp, M. musculus
ctctaccactgaacca

SEQ ID NO: 394208 - DNA, 16 bp, M. musculus
ctctaccactgaacta

SEQ ID NO: 394209 - DNA, 16 bp, M. musculus
ctctaccactgagcca

SEQ ID NO: 394210 - DNA, 16 bp, M. musculus
ctctaccactgagcta

SEQ ID NO: 394211 - DNA, 16 bp, M. musculus
ctctaccactgagctg

SEQ ID NO: 394212 - DNA, 16 bp, M. musculus
ctctaccactgatcta

SEQ ID NO: 394213 - DNA, 16 bp, M. musculus
ctctaccactgggcta

SEQ ID NO: 394214 - DNA, 16 bp, M. musculus
ctctaccacttggacc

SEQ ID NO: 394215 - DNA, 16 bp, M. musculus
ctctaccagaatcatg

SEQ ID NO: 394216 - DNA, 16 bp, M. musculus
ctctaccagtgagcta

SEQ ID NO: 394217 - DNA, 16 bp, M. musculus
ctctaccattgaacta

SEQ ID NO: 394218 - DNA, 16 bp, M. musculus
ctctacccactgagtc

SEQ ID NO: 394219 - DNA, 16 bp, M. musculus
ctctacccagcagcag

SEQ ID NO: 394220 - DNA, 16 bp, M. musculus
ctctacccagcagcca

SEQ ID NO: 394221 - DNA, 16 bp, M. musculus
ctctacctcccaggtg

SEQ ID NO: 394222 - DNA, 16 bp, M. musculus
ctctacctcccagtgc

SEQ ID NO: 394223 - DNA, 16 bp, M. musculus
ctctacctccccaatg

SEQ ID NO: 394224 - DNA, 16 bp, M. musculus
ctctacctcctgagtg

SEQ ID NO: 394225 - DNA, 16 bp, M. musculus
ctctacctcctggctg

SEQ ID NO: 394226 - DNA, 16 bp, M. musculus
ctctactgctgctgct

SEQ ID NO: 394227 - DNA, 16 bp, M. musculus
ctctactggaaggctt

SEQ ID NO: 394228 - DNA, 16 bp, M. musculus
ctctacttccctactc

SEQ ID NO: 394229 - DNA, 16 bp, M. musculus
ctctacttcctaagtg

SEQ ID NO: 394230 - DNA, 16 bp, M. musculus
ctctacttcctgagtg

SEQ ID NO: 394231 - DNA, 16 bp, M. musculus
ctctacttcctgttct

SEQ ID NO: 394232 - DNA, 16 bp, M. musculus
ctctacttctcttgat

SEQ ID NO: 394233 - DNA, 16 bp, M. musculus
ctctagaaaaaacaag

SEQ ID NO: 394234 - DNA, 16 bp, M. musculus
ctctagaagaaaagga

SEQ ID NO: 394235 - DNA, 16 bp, M. musculus
ctctagaagagcagaa

SEQ ID NO: 394236 - DNA, 16 bp, M. musculus
ctctagagaaacagaa

SEQ ID NO: 394237 - DNA, 16 bp, M. musculus
ctctagagaatcctga

SEQ ID NO: 394238 - DNA, 16 bp, M. musculus
ctctagagcagcagtt

SEQ ID NO: 394239 - DNA, 16 bp, M. musculus
ctctagagccaggctt

SEQ ID NO: 394240 - DNA, 16 bp, M. musculus
ctctagagttacagaa

SEQ ID NO: 394241 - DNA, 16 bp, M. musculus
ctctagcaccaagtct

SEQ ID NO: 394242 - DNA, 16 bp, M. musculus
ctctagcagaaggtgt

SEQ ID NO: 394243 - DNA, 16 bp, M. musculus
ctctagctccagagga

SEQ ID NO: 394244 - DNA, 16 bp, M. musculus
ctctagctccagggga

SEQ ID NO: 394245 - DNA, 16 bp, M. musculus
ctctagctcccaagtg

SEQ ID NO: 394246 - DNA, 16 bp, M. musculus
ctctagctcctcccct

SEQ ID NO: 394247 - DNA, 16 bp, M. musculus
ctctagctctagctct

SEQ ID NO: 394248 - DNA, 16 bp, M. musculus
ctctagctctccattg

SEQ ID NO: 394249 - DNA, 17 bp, M. musculus
ctctagctgcatatgta

SEQ ID NO: 394250 - DNA, 16 bp, M. musculus
ctctagctgtcctgga

SEQ ID NO: 394251 - DNA, 16 bp, M. musculus
ctctagcttctgtcaa

SEQ ID NO: 394252 - DNA, 16 bp, M. musculus
ctctaggaaaaaaaaa

SEQ ID NO: 394253 - DNA, 16 bp, M. musculus
ctctaggaagtcccag

SEQ ID NO: 394254 - DNA, 16 bp, M. musculus
ctctagtcccaaggga

SEQ ID NO: 394255 - DNA, 16 bp, M. musculus
ctctagtgaaatagaa

SEQ ID NO: 394256 - DNA, 16 bp, M. musculus
ctctagttccagagaa

SEQ ID NO: 394257 - DNA, 16 bp, M. musculus
ctctagttccagggat

SEQ ID NO: 394258 - DNA, 16 bp, M. musculus
ctctagttcctttttg

SEQ ID NO: 394259 - DNA, 16 bp, M. musculus
ctctagtttgtgttaa

SEQ ID NO: 394260 - DNA, 16 bp, M. musculus
ctctatcactaagcta

SEQ ID NO: 394261 - DNA, 16 bp, M. musculus
ctctatccctctatcc

SEQ ID NO: 394262 - DNA, 16 bp, M. musculus
ctctatctcaaaaaaa

SEQ ID NO: 394263 - DNA, 16 bp, M. musculus
ctctatctctacctct

SEQ ID NO: 394264 - DNA, 16 bp, M. musculus
ctctatctctgtctct

SEQ ID NO: 394265 - DNA, 16 bp, M. musculus
ctctatgagtctgagg

SEQ ID NO: 394266 - DNA, 16 bp, M. musculus
ctctatgatgaagaca

SEQ ID NO: 394267 - DNA, 16 bp, M. musculus
ctctatgcagaccagg

SEQ ID NO: 394268 - DNA, 16 bp, M. musculus
ctctatgcagtcctgg

SEQ ID NO: 394269 - DNA, 16 bp, M. musculus
ctctatggaccaggct

SEQ ID NO: 394270 - DNA, 16 bp, M. musculus
ctctatgtctatctct

SEQ ID NO: 394271 - DNA, 16 bp, M. musculus
ctctatgtcttttatt

SEQ ID NO: 394272 - DNA, 16 bp, M. musculus
ctctattgaaaattct

SEQ ID NO: 394273 - DNA, 16 bp, M. musculus
ctctattgctgatgcc

SEQ ID NO: 394274 - DNA, 16 bp, M. musculus
ctctatttctgtttct

SEQ ID NO: 394275 - DNA, 16 bp, M. musculus
ctctatttcttccttg

SEQ ID NO: 394276 - DNA, 16 bp, M. musculus
ctctcaaagcctcatt

SEQ ID NO: 394277 - DNA, 16 bp, M. musculus
ctctcaaatctgttct

SEQ ID NO: 394278 - DNA, 16 bp, M. musculus
ctctcaacatcaatga

SEQ ID NO: 394279 - DNA, 16 bp, M. musculus
ctctcaacatcaatgg

SEQ ID NO: 394280 - DNA, 16 bp, M. musculus
ctctcaactgctgagc

SEQ ID NO: 394281 - DNA, 16 bp, M. musculus
ctctcaagatgtttgt

SEQ ID NO: 394282 - DNA, 16 bp, M. musculus
ctctcaagcatccact

SEQ ID NO: 394283 - DNA, 16 bp, M. musculus
ctctcaagtgctaggg

SEQ ID NO: 394284 - DNA, 16 bp, M. musculus
ctctcacaagaacaga

SEQ ID NO: 394285 - DNA, 16 bp, M. musculus
ctctcacacaaacaca

SEQ ID NO: 394286 - DNA, 16 bp, M. musculus
ctctcacacacacaga

SEQ ID NO: 394287 - DNA, 16 bp, M. musculus
ctctcacacacacatg

SEQ ID NO: 394288 - DNA, 16 bp, M. musculus
ctctcacacacactca

SEQ ID NO: 394289 - DNA, 16 bp, M. musculus
ctctcacagttcctca

SEQ ID NO: 394290 - DNA, 16 bp, M. musculus
ctctcacctccacaca

SEQ ID NO: 394291 - DNA, 16 bp, M. musculus
ctctcacctcctgggt

SEQ ID NO: 394292 - DNA, 16 bp, M. musculus
ctctcacctctgcaga

SEQ ID NO: 394293 - DNA, 16 bp, M. musculus
ctctcactctgcacat

SEQ ID NO: 394294 - DNA, 16 bp, M. musculus
ctctcactctgtgtgt

SEQ ID NO: 394295 - DNA, 16 bp, M. musculus
ctctcactgaacccaa

SEQ ID NO: 394296 - DNA, 16 bp, M. musculus
ctctcactgaacctgg

SEQ ID NO: 394297 - DNA, 16 bp, M. musculus
ctctcactgaagccag

SEQ ID NO: 394298 - DNA, 16 bp, M. musculus
ctctcactgatgccag

SEQ ID NO: 394299 - DNA, 16 bp, M. musculus
ctctcactgtcctgga

SEQ ID NO: 394300 - DNA, 16 bp, M. musculus
ctctcagaacccctct

SEQ ID NO: 394301 - DNA, 16 bp, M. musculus
ctctcagaagacagcc

SEQ ID NO: 394302 - DNA, 16 bp, M. musculus
ctctcagacactgaat

SEQ ID NO: 394303 - DNA, 16 bp, M. musculus
ctctcagacactgagt

SEQ ID NO: 394304 - DNA, 16 bp, M. musculus
ctctcagagcagttga

SEQ ID NO: 394305 - DNA, 16 bp, M. musculus
ctctcagaggacagac

SEQ ID NO: 394306 - DNA, 16 bp, M. musculus
ctctcagaggacagct

SEQ ID NO: 394307 - DNA, 16 bp, M. musculus
ctctcagaggactgct

SEQ ID NO: 394308 - DNA, 16 bp, M. musculus
ctctcagaggcgaagg

SEQ ID NO: 394309 - DNA, 16 bp, M. musculus
ctctcagagggcagct

SEQ ID NO: 394310 - DNA, 16 bp, M. musculus
ctctcagagggctgct

SEQ ID NO: 394311 - DNA, 16 bp, M. musculus
ctctcagagtgccaag

SEQ ID NO: 394312 - DNA, 16 bp, M. musculus
ctctcagatgactcta

SEQ ID NO: 394313 - DNA, 16 bp, M. musculus
ctctcagatgattcta

SEQ ID NO: 394314 - DNA, 16 bp, M. musculus
ctctcagcaatgggca

SEQ ID NO: 394315 - DNA, 16 bp, M. musculus
ctctcagccactgagc

SEQ ID NO: 394316 - DNA, 16 bp, M. musculus
ctctcagcccctccag

SEQ ID NO: 394317 - DNA, 16 bp, M. musculus
ctctcagccttcctaa

SEQ ID NO: 394318 - DNA, 16 bp, M. musculus
ctctcagctcagttct

SEQ ID NO: 394319 - DNA, 16 bp, M. musculus
ctctcagctcctcctg

SEQ ID NO: 394320 - DNA, 16 bp, M. musculus
ctctcagctcctgctc

SEQ ID NO: 394321 - DNA, 16 bp, M. musculus
ctctcagctccttctt

SEQ ID NO: 394322 - DNA, 16 bp, M. musculus
ctctcagctctgccag

SEQ ID NO: 394323 - DNA, 16 bp, M. musculus
ctctcagctgtccctg

SEQ ID NO: 394324 - DNA, 16 bp, M. musculus
ctctcagctgttcctg

SEQ ID NO: 394325 - DNA, 16 bp, M. musculus
ctctcagcttcctctc

SEQ ID NO: 394326 - DNA, 16 bp, M. musculus
ctctcagcttcctgtt

SEQ ID NO: 394327 - DNA, 16 bp, M. musculus
ctctcagcttctctag

SEQ ID NO: 394328 - DNA, 16 bp, M. musculus
ctctcagcttctcttg

SEQ ID NO: 394329 - DNA, 16 bp, M. musculus
ctctcagctttctgct

SEQ ID NO: 394330 - DNA, 16 bp, M. musculus
ctctcaggactcagag

SEQ ID NO: 394331 - DNA, 16 bp, M. musculus
ctctcaggagacagaa

SEQ ID NO: 394332 - DNA, 16 bp, M. musculus
ctctcaggagacagtc

SEQ ID NO: 394333 - DNA, 16 bp, M. musculus
ctctcaggagagagcc

SEQ ID NO: 394334 - DNA, 16 bp, M. musculus
ctctcaggaggcagct

SEQ ID NO: 394335 - DNA, 16 bp, M. musculus
ctctcaggagtactga

SEQ ID NO: 394336 - DNA, 16 bp, M. musculus
ctctcagggaacagct

SEQ ID NO: 394337 - DNA, 16 bp, M. musculus
ctctcagggcctcaag

SEQ ID NO: 394338 - DNA, 16 bp, M. musculus
ctctcaggtagtgtct

SEQ ID NO: 394339 - DNA, 16 bp, M. musculus
ctctcagtctctgtct

SEQ ID NO: 394340 - DNA, 16 bp, M. musculus
ctctcagtggcctgga

SEQ ID NO: 394341 - DNA, 16 bp, M. musculus
ctctcagtgtctctct

SEQ ID NO: 394342 - DNA, 16 bp, M. musculus
ctctcagttcttcctg

SEQ ID NO: 394343 - DNA, 16 bp, M. musculus
ctctcagtttcttctg

SEQ ID NO: 394344 - DNA, 16 bp, M. musculus
ctctcagtttgcacaa

SEQ ID NO: 394345 - DNA, 16 bp, M. musculus
ctctcatatgcaagaa

SEQ ID NO: 394346 - DNA, 16 bp, M. musculus
ctctcatccatccatc

SEQ ID NO: 394347 - DNA, 16 bp, M. musculus
ctctcatctcatccct

SEQ ID NO: 394348 - DNA, 16 bp, M. musculus
ctctcatctgcacaga

SEQ ID NO: 394349 - DNA, 16 bp, M. musculus
ctctcatgcaatacat

SEQ ID NO: 394350 - DNA, 16 bp, M. musculus
ctctcatgcacacaca

SEQ ID NO: 394351 - DNA, 16 bp, M. musculus
ctctcatgctcttctc

SEQ ID NO: 394352 - DNA, 16 bp, M. musculus
ctctcatgtctcctgg

SEQ ID NO: 394353 - DNA, 16 bp, M. musculus
ctctccaaaagaccca

SEQ ID NO: 394354 - DNA, 16 bp, M. musculus
ctctccaactgcttct

SEQ ID NO: 394355 - DNA, 16 bp, M. musculus
ctctccaagtggccat

SEQ ID NO: 394356 - DNA, 16 bp, M. musculus
ctctccaagttacttt

SEQ ID NO: 394357 - DNA, 16 bp, M. musculus
ctctccacactgcagg

SEQ ID NO: 394358 - DNA, 16 bp, M. musculus
ctctccacccagctca

SEQ ID NO: 394359 - DNA, 16 bp, M. musculus
ctctccacccagctct

SEQ ID NO: 394360 - DNA, 16 bp, M. musculus
ctctccaccttctgct

SEQ ID NO: 394361 - DNA, 16 bp, M. musculus
ctctccactctgcagg

SEQ ID NO: 394362 - DNA, 16 bp, M. musculus
ctctccacttggccat

SEQ ID NO: 394363 - DNA, 16 bp, M. musculus
ctctccagagacagct

SEQ ID NO: 394364 - DNA, 16 bp, M. musculus
ctctccagagctggga

SEQ ID NO: 394365 - DNA, 16 bp, M. musculus
ctctccagcacccaca

SEQ ID NO: 394366 - DNA, 16 bp, M. musculus
ctctccagcaccccca

SEQ ID NO: 394367 - DNA, 16 bp, M. musculus
ctctccagcccaagta

SEQ ID NO: 394368 - DNA, 16 bp, M. musculus
ctctccagcccacagt

SEQ ID NO: 394369 - DNA, 16 bp, M. musculus
ctctccagcccagaag

SEQ ID NO: 394370 - DNA, 16 bp, M. musculus
ctctccagcccagact

SEQ ID NO: 394371 - DNA, 16 bp, M. musculus
ctctccagcccagagt

SEQ ID NO: 394372 - DNA, 16 bp, M. musculus
ctctccagcccagatt

SEQ ID NO: 394373 - DNA, 16 bp, M. musculus
ctctccagcccagtat

SEQ ID NO: 394374 - DNA, 16 bp, M. musculus
ctctccagcccagtct

SEQ ID NO: 394375 - DNA, 16 bp, M. musculus
ctctccagcccatgga

SEQ ID NO: 394376 - DNA, 16 bp, M. musculus
ctctccagcccattgt

SEQ ID NO: 394377 - DNA, 16 bp, M. musculus
ctctccagccccaaac

SEQ ID NO: 394378 - DNA, 16 bp, M. musculus
ctctccagccccacag

SEQ ID NO: 394379 - DNA, 16 bp, M. musculus
ctctccagccccacat

SEQ ID NO: 394380 - DNA, 16 bp, M. musculus
ctctccagccccacct

SEQ ID NO: 394381 - DNA, 16 bp, M. musculus
ctctccagccccactg

SEQ ID NO: 394382 - DNA, 16 bp, M. musculus
ctctccagccccactt

SEQ ID NO: 394383 - DNA, 16 bp, M. musculus
ctctccagccccagaa

SEQ ID NO: 394384 - DNA, 16 bp, M. musculus
ctctccagccccagcc

SEQ ID NO: 394385 - DNA, 16 bp, M. musculus
ctctccagccccagtc

SEQ ID NO: 394386 - DNA, 16 bp, M. musculus
ctctccagccccatga

SEQ ID NO: 394387 - DNA, 16 bp, M. musculus
ctctccagcccccact

SEQ ID NO: 394388 - DNA, 16 bp, M. musculus
ctctccagccccccaa

SEQ ID NO: 394389 - DNA, 16 bp, M. musculus
ctctccagcccccgtg

SEQ ID NO: 394390 - DNA, 16 bp, M. musculus
ctctccagccccctac

SEQ ID NO: 394391 - DNA, 16 bp, M. musculus
ctctccagccccctct

SEQ ID NO: 394392 - DNA, 16 bp, M. musculus
ctctccagccccctgc

SEQ ID NO: 394393 - DNA, 16 bp, M. musculus
ctctccagccccctgt

SEQ ID NO: 394394 - DNA, 16 bp, M. musculus
ctctccagcccctacc

SEQ ID NO: 394395 - DNA, 16 bp, M. musculus
ctctccagcccctatg

SEQ ID NO: 394396 - DNA, 16 bp, M. musculus
ctctccagcccctcac

SEQ ID NO: 394397 - DNA, 16 bp, M. musculus
ctctccagcccctctg

SEQ ID NO: 394398 - DNA, 16 bp, M. musculus
ctctccagcccctggc

SEQ ID NO: 394399 - DNA, 16 bp, M. musculus
ctctccagcccctgta

SEQ ID NO: 394400 - DNA, 16 bp, M. musculus
ctctccagccccttct

SEQ ID NO: 394401 - DNA, 16 bp, M. musculus
ctctccagccctaaat

SEQ ID NO: 394402 - DNA, 16 bp, M. musculus
ctctccagccctaaca

SEQ ID NO: 394403 - DNA, 16 bp, M. musculus
ctctccagccctaata

SEQ ID NO: 394404 - DNA, 16 bp, M. musculus
ctctccagccctacca

SEQ ID NO: 394405 - DNA, 16 bp, M. musculus
ctctccagccctcact

SEQ ID NO: 394406 - DNA, 16 bp, M. musculus
ctctccagccctccac

SEQ ID NO: 394407 - DNA, 16 bp, M. musculus
ctctccagccctcttc

SEQ ID NO: 394408 - DNA, 16 bp, M. musculus
ctctccagccctgcag

SEQ ID NO: 394409 - DNA, 16 bp, M. musculus
ctctccagccctggaa

SEQ ID NO: 394410 - DNA, 16 bp, M. musculus
ctctccagccctggat

SEQ ID NO: 394411 - DNA, 16 bp, M. musculus
ctctccagccctgtgc

SEQ ID NO: 394412 - DNA, 16 bp, M. musculus
ctctccagccctgtgg

SEQ ID NO: 394413 - DNA, 16 bp, M. musculus
ctctccagcccttccc

SEQ ID NO: 394414 - DNA, 16 bp, M. musculus
ctctccagccctttgc

SEQ ID NO: 394415 - DNA, 16 bp, M. musculus
ctctccagcctcaaaa

SEQ ID NO: 394416 - DNA, 16 bp, M. musculus
ctctccagcctcagaa

SEQ ID NO: 394417 - DNA, 16 bp, M. musculus
ctctccagcctcccag

SEQ ID NO: 394418 - DNA, 16 bp, M. musculus
ctctccagcctcttct

SEQ ID NO: 394419 - DNA, 17 bp, M. musculus
ctctccagcctcttttt

SEQ ID NO: 394420 - DNA, 16 bp, M. musculus
ctctccagctccaccc

SEQ ID NO: 394421 - DNA, 16 bp, M. musculus
ctctccagctccagaa

SEQ ID NO: 394422 - DNA, 16 bp, M. musculus
ctctccagctccagtg

SEQ ID NO: 394423 - DNA, 16 bp, M. musculus
ctctccagctcccaag

SEQ ID NO: 394424 - DNA, 16 bp, M. musculus
ctctccagctcccatt

SEQ ID NO: 394425 - DNA, 16 bp, M. musculus
ctctccagctcccttc

SEQ ID NO: 394426 - DNA, 16 bp, M. musculus
ctctccagctcctcca

SEQ ID NO: 394427 - DNA, 16 bp, M. musculus
ctctccagctcctcct

SEQ ID NO: 394428 - DNA, 16 bp, M. musculus
ctctccagctcctctc

SEQ ID NO: 394429 - DNA, 16 bp, M. musculus
ctctccagctctccag

SEQ ID NO: 394430 - DNA, 16 bp, M. musculus
ctctccagcttgccct

SEQ ID NO: 394431 - DNA, 16 bp, M. musculus
ctctccaggaatccag

SEQ ID NO: 394432 - DNA, 16 bp, M. musculus
ctctccaggaatcttc

SEQ ID NO: 394433 - DNA, 16 bp, M. musculus
ctctccaggatcttct

SEQ ID NO: 394434 - DNA, 16 bp, M. musculus
ctctccaggccctgtc

SEQ ID NO: 394435 - DNA, 16 bp, M. musculus
ctctccaggcccttct

SEQ ID NO: 394436 - DNA, 16 bp, M. musculus
ctctccagtccagaaa

SEQ ID NO: 394437 - DNA, 16 bp, M. musculus
ctctccagtcccacaa

SEQ ID NO: 394438 - DNA, 16 bp, M. musculus
ctctccagtcccccag

SEQ ID NO: 394439 - DNA, 16 bp, M. musculus
ctctccagtccctcca

SEQ ID NO: 394440 - DNA, 16 bp, M. musculus
ctctccagtccctgct

SEQ ID NO: 394441 - DNA, 16 bp, M. musculus
ctctccagtgctggga

SEQ ID NO: 394442 - DNA, 16 bp, M. musculus
ctctccagtttcttta

SEQ ID NO: 394443 - DNA, 16 bp, M. musculus
ctctccatccatctct

SEQ ID NO: 394444 - DNA, 16 bp, M. musculus
ctctccatctgtctct

SEQ ID NO: 394445 - DNA, 16 bp, M. musculus
ctctccatctgtctgt

SEQ ID NO: 394446 - DNA, 16 bp, M. musculus
ctctccatggtctctg

SEQ ID NO: 394447 - DNA, 16 bp, M. musculus
ctctccatggtttgct

SEQ ID NO: 394448 - DNA, 16 bp, M. musculus
ctctccattctgaaca

SEQ ID NO: 394449 - DNA, 16 bp, M. musculus
ctctccattctgtcat

SEQ ID NO: 394450 - DNA, 16 bp, M. musculus
ctctccatttattttg

SEQ ID NO: 394451 - DNA, 16 bp, M. musculus
ctctccattttcatcc

SEQ ID NO: 394452 - DNA, 16 bp, M. musculus
ctctcccaataaacct

SEQ ID NO: 394453 - DNA, 16 bp, M. musculus
ctctcccaatctcatg

SEQ ID NO: 394454 - DNA, 16 bp, M. musculus
ctctcccacccgagag

SEQ ID NO: 394455 - DNA, 16 bp, M. musculus
ctctcccagcagctga

SEQ ID NO: 394456 - DNA, 16 bp, M. musculus
ctctcccagcctctct

SEQ ID NO: 394457 - DNA, 16 bp, M. musculus
ctctcccagctgactg

SEQ ID NO: 394458 - DNA, 16 bp, M. musculus
ctctcccagggatgag

SEQ ID NO: 394459 - DNA, 16 bp, M. musculus
ctctcccaggttctct

SEQ ID NO: 394460 - DNA, 16 bp, M. musculus
ctctcccagtctctct

SEQ ID NO: 394461 - DNA, 16 bp, M. musculus
ctctcccatccagttc

SEQ ID NO: 394462 - DNA, 16 bp, M. musculus
ctctcccatctgtcca

SEQ ID NO: 394463 - DNA, 16 bp, M. musculus
ctctcccattctcatg

SEQ ID NO: 394464 - DNA, 16 bp, M. musculus
ctctcccccagccctg

SEQ ID NO: 394465 - DNA, 16 bp, M. musculus
ctctcccctggcaggg

SEQ ID NO: 394466 - DNA, 16 bp, M. musculus
ctctcccctttctggg

SEQ ID NO: 394467 - DNA, 16 bp, M. musculus
ctctccctactgtctg

SEQ ID NO: 394468 - DNA, 16 bp, M. musculus
ctctccctcacccctg

SEQ ID NO: 394469 - DNA, 16 bp, M. musculus
ctctccctcagccctc

SEQ ID NO: 394470 - DNA, 16 bp, M. musculus
ctctccctccaccctg

SEQ ID NO: 394471 - DNA, 16 bp, M. musculus
ctctccctccccagtg

SEQ ID NO: 394472 - DNA, 16 bp, M. musculus
ctctccctcctgggag

SEQ ID NO: 394473 - DNA, 16 bp, M. musculus
ctctccctctgtctgt

SEQ ID NO: 394474 - DNA, 16 bp, M. musculus
ctctccctgcacctct

SEQ ID NO: 394475 - DNA, 16 bp, M. musculus
ctctccctgcccccat

SEQ ID NO: 394476 - DNA, 16 bp, M. musculus
ctctccctgctgcctg

SEQ ID NO: 394477 - DNA, 16 bp, M. musculus
ctctccctggcctgga

SEQ ID NO: 394478 - DNA, 16 bp, M. musculus
ctctcccttccctggg

SEQ ID NO: 394479 - DNA, 16 bp, M. musculus
ctctcccttctggagg

SEQ ID NO: 394480 - DNA, 16 bp, M. musculus
ctctcccttctggcct

SEQ ID NO: 394481 - DNA, 16 bp, M. musculus
ctctcctacacacaca

SEQ ID NO: 394482 - DNA, 16 bp, M. musculus
ctctcctaccatagca

SEQ ID NO: 394483 - DNA, 16 bp, M. musculus
ctctcctcactgttgg

SEQ ID NO: 394484 - DNA, 16 bp, M. musculus
ctctcctcagtctctg

SEQ ID NO: 394485 - DNA, 16 bp, M. musculus
ctctcctcagtttcag

SEQ ID NO: 394486 - DNA, 16 bp, M. musculus
ctctcctccattgttg

SEQ ID NO: 394487 - DNA, 16 bp, M. musculus
ctctcctcccactgat

SEQ ID NO: 394488 - DNA, 16 bp, M. musculus
ctctcctcccagccct

SEQ ID NO: 394489 - DNA, 16 bp, M. musculus
ctctcctcccagtcct

SEQ ID NO: 394490 - DNA, 16 bp, M. musculus
ctctcctcccagtgcc

SEQ ID NO: 394491 - DNA, 16 bp, M. musculus
ctctcctctctcaggg

SEQ ID NO: 394492 - DNA, 16 bp, M. musculus
ctctcctctgacaagg

SEQ ID NO: 394493 - DNA, 16 bp, M. musculus
ctctcctctgcctctg

SEQ ID NO: 394494 - DNA, 16 bp, M. musculus
ctctcctctggaaggg

SEQ ID NO: 394495 - DNA, 16 bp, M. musculus
ctctcctgagtcccag

SEQ ID NO: 394496 - DNA, 16 bp, M. musculus
ctctcctgccacctct

SEQ ID NO: 394497 - DNA, 16 bp, M. musculus
ctctcctgcctcagct

SEQ ID NO: 394498 - DNA, 16 bp, M. musculus
ctctcctgctgctgct

SEQ ID NO: 394499 - DNA, 16 bp, M. musculus
ctctcctggagtgtct

SEQ ID NO: 394500 - DNA, 16 bp, M. musculus
ctctcctggatatata

SEQ ID NO: 394501 - DNA, 16 bp, M. musculus
ctctcctggcttactc

SEQ ID NO: 394502 - DNA, 16 bp, M. musculus
ctctcctggcttctca

SEQ ID NO: 394503 - DNA, 16 bp, M. musculus
ctctcctggtccaccc

SEQ ID NO: 394504 - DNA, 16 bp, M. musculus
ctctcctgtctctcca

SEQ ID NO: 394505 - DNA, 16 bp, M. musculus
ctctcctgtctctgcc

SEQ ID NO: 394506 - DNA, 16 bp, M. musculus
ctctcctgtgcctgtg

SEQ ID NO: 394507 - DNA, 16 bp, M. musculus
ctctcctgtgtgctct

SEQ ID NO: 394508 - DNA, 16 bp, M. musculus
ctctccttccaccctg

SEQ ID NO: 394509 - DNA, 16 bp, M. musculus
ctctccttccatcaca

SEQ ID NO: 394510 - DNA, 16 bp, M. musculus
ctctccttcctgactg

SEQ ID NO: 394511 - DNA, 16 bp, M. musculus
ctctccttctaccact

SEQ ID NO: 394512 - DNA, 16 bp, M. musculus
ctctccttgctgtagc

SEQ ID NO: 394513 - DNA, 16 bp, M. musculus
ctctcctttcactgtg

SEQ ID NO: 394514 - DNA, 16 bp, M. musculus
ctctcctttgcctgct

SEQ ID NO: 394515 - DNA, 16 bp, M. musculus
ctctcctttgggtgca

SEQ ID NO: 394516 - DNA, 16 bp, M. musculus
ctctcgctcactctct

SEQ ID NO: 394517 - DNA, 16 bp, M. musculus
ctctcggctcctccag

SEQ ID NO: 394518 - DNA, 18 bp, M. musculus
ctctcgggccgggcagac

SEQ ID NO: 394519 - DNA, 16 bp, M. musculus
ctctctaagaagggag

SEQ ID NO: 394520 - DNA, 16 bp, M. musculus
ctctctactgtcaggc

SEQ ID NO: 394521 - DNA, 16 bp, M. musculus
ctctctacttcctgac

SEQ ID NO: 394522 - DNA, 16 bp, M. musculus
ctctctagccctcctc

SEQ ID NO: 394523 - DNA, 16 bp, M. musculus
ctctctagtttctttt

SEQ ID NO: 394524 - DNA, 16 bp, M. musculus
ctctctatatagccct

SEQ ID NO: 394525 - DNA, 17 bp, M. musculus
ctctctatgtagccctg

SEQ ID NO: 394526 - DNA, 16 bp, M. musculus
ctctctcacacagaga

SEQ ID NO: 394527 - DNA, 16 bp, M. musculus
ctctctcactctcact

SEQ ID NO: 394528 - DNA, 16 bp, M. musculus
ctctctcactctctca

SEQ ID NO: 394529 - DNA, 16 bp, M. musculus
ctctctcactctctgt

SEQ ID NO: 394530 - DNA, 16 bp, M. musculus
ctctctcagaagcaaa

SEQ ID NO: 394531 - DNA, 16 bp, M. musculus
ctctctcagaggaccc

SEQ ID NO: 394532 - DNA, 16 bp, M. musculus
ctctctcagaggagaa

SEQ ID NO: 394533 - DNA, 16 bp, M. musculus
ctctctcagcagacct

SEQ ID NO: 394534 - DNA, 16 bp, M. musculus
ctctctcagcctcctg

SEQ ID NO: 394535 - DNA, 16 bp, M. musculus
ctctctcagcctctga

SEQ ID NO: 394536 - DNA, 16 bp, M. musculus
ctctctcaggctgctg

SEQ ID NO: 394537 - DNA, 16 bp, M. musculus
ctctctcatgtctgtg

SEQ ID NO: 394538 - DNA, 16 bp, M. musculus
ctctctccacatggtc

SEQ ID NO: 394539 - DNA, 16 bp, M. musculus
ctctctccatgtctct

SEQ ID NO: 394540 - DNA, 16 bp, M. musculus
ctctctcccagaggaa

SEQ ID NO: 394541 - DNA, 16 bp, M. musculus
ctctctcccagcccct

SEQ ID NO: 394542 - DNA, 16 bp, M. musculus
ctctctccccacttgt

SEQ ID NO: 394543 - DNA, 16 bp, M. musculus
ctctctccctcccaag

SEQ ID NO: 394544 - DNA, 16 bp, M. musculus
ctctctcctgagttcc

SEQ ID NO: 394545 - DNA, 16 bp, M. musculus
ctctctcctgctgcct

SEQ ID NO: 394546 - DNA, 16 bp, M. musculus
ctctctcctggcctct

SEQ ID NO: 394547 - DNA, 16 bp, M. musculus
ctctctcctggtggga

SEQ ID NO: 394548 - DNA, 16 bp, M. musculus
ctctctccttcagctt

SEQ ID NO: 394549 - DNA, 16 bp, M. musculus
ctctctccttcccaga

SEQ ID NO: 394550 - DNA, 16 bp, M. musculus
ctctctctatatatgt

SEQ ID NO: 394551 - DNA, 16 bp, M. musculus
ctctctctcacagaca

SEQ ID NO: 394552 - DNA, 16 bp, M. musculus
ctctctctcagtacct

SEQ ID NO: 394553 - DNA, 16 bp, M. musculus
ctctctctcatacata

SEQ ID NO: 394554 - DNA, 16 bp, M. musculus
ctctctctcatgctct

SEQ ID NO: 394555 - DNA, 16 bp, M. musculus
ctctctctcatttgtg

SEQ ID NO: 394556 - DNA, 16 bp, M. musculus
ctctctctccagcccc

SEQ ID NO: 394557 - DNA, 16 bp, M. musculus
ctctctctccatcctg

SEQ ID NO: 394558 - DNA, 16 bp, M. musculus
ctctctctcctcaggg

SEQ ID NO: 394559 - DNA, 16 bp, M. musculus
ctctctctcctcccag

SEQ ID NO: 394560 - DNA, 16 bp, M. musculus
ctctctctcctcctga

SEQ ID NO: 394561 - DNA, 16 bp, M. musculus
ctctctctcctcctgg

SEQ ID NO: 394562 - DNA, 16 bp, M. musculus
ctctctctcgctcgct

SEQ ID NO: 394563 - DNA, 16 bp, M. musculus
ctctctctctcaagct

SEQ ID NO: 394564 - DNA, 16 bp, M. musculus
ctctctctctcagaga

SEQ ID NO: 394565 - DNA, 16 bp, M. musculus
ctctctctctcatctg

SEQ ID NO: 394566 - DNA, 16 bp, M. musculus
ctctctctctccaagg

SEQ ID NO: 394567 - DNA, 16 bp, M. musculus
ctctctctctccagtt

SEQ ID NO: 394568 - DNA, 16 bp, M. musculus
ctctctctctcctaga

SEQ ID NO: 394569 - DNA, 16 bp, M. musculus
ctctctctctcgctca

SEQ ID NO: 394570 - DNA, 16 bp, M. musculus
ctctctctctctccag

SEQ ID NO: 394571 - DNA, 16 bp, M. musculus
ctctctctctctcggg

SEQ ID NO: 394572 - DNA, 16 bp, M. musculus
ctctctctctctctaa

SEQ ID NO: 394573 - DNA, 16 bp, M. musculus
ctctctctctctgaat

SEQ ID NO: 394574 - DNA, 16 bp, M. musculus
ctctctctctctgctg

SEQ ID NO: 394575 - DNA, 17 bp, M. musculus
ctctctctctctgtatt

SEQ ID NO: 394576 - DNA, 16 bp, M. musculus
ctctctctctgcccag

SEQ ID NO: 394577 - DNA, 16 bp, M. musculus
ctctctctctgcctgc

SEQ ID NO: 394578 - DNA, 16 bp, M. musculus
ctctctctctgctctg

SEQ ID NO: 394579 - DNA, 16 bp, M. musculus
ctctctctctgtgaga

SEQ ID NO: 394580 - DNA, 16 bp, M. musculus
ctctctctctgtgtat

SEQ ID NO: 394581 - DNA, 16 bp, M. musculus
ctctctctctgtgttg

SEQ ID NO: 394582 - DNA, 16 bp, M. musculus
ctctctctcttcacac

SEQ ID NO: 394583 - DNA, 16 bp, M. musculus
ctctctctctttcatg

SEQ ID NO: 394584 - DNA, 16 bp, M. musculus
ctctctctgactgtct

SEQ ID NO: 394585 - DNA, 16 bp, M. musculus
ctctctctgctctgct

SEQ ID NO: 394586 - DNA, 16 bp, M. musculus
ctctctctgcttcctg

SEQ ID NO: 394587 - DNA, 16 bp, M. musculus
ctctctctgctttgtg

SEQ ID NO: 394588 - DNA, 16 bp, M. musculus
ctctctctggcctctc

SEQ ID NO: 394589 - DNA, 16 bp, M. musculus
ctctctctggcttctg

SEQ ID NO: 394590 - DNA, 16 bp, M. musculus
ctctctctggttttat

SEQ ID NO: 394591 - DNA, 16 bp, M. musculus
ctctctctgtatttat

SEQ ID NO: 394592 - DNA, 16 bp, M. musculus
ctctctctgtctgtct

SEQ ID NO: 394593 - DNA, 16 bp, M. musculus
ctctctctgtgactct

SEQ ID NO: 394594 - DNA, 16 bp, M. musculus
ctctctctgtgtcctt

SEQ ID NO: 394595 - DNA, 16 bp, M. musculus
ctctctctgtgtctct

SEQ ID NO: 394596 - DNA, 16 bp, M. musculus
ctctctcttcctgtgt

SEQ ID NO: 394597 - DNA, 16 bp, M. musculus
ctctctcttgcttgct

SEQ ID NO: 394598 - DNA, 16 bp, M. musculus
ctctctctttgtgtgt

SEQ ID NO: 394599 - DNA, 16 bp, M. musculus
ctctctgaacccagag

SEQ ID NO: 394600 - DNA, 16 bp, M. musculus
ctctctgaagaattga

SEQ ID NO: 394601 - DNA, 16 bp, M. musculus
ctctctgactctcttt

SEQ ID NO: 394602 - DNA, 16 bp, M. musculus
ctctctgagcacttct

SEQ ID NO: 394603 - DNA, 16 bp, M. musculus
ctctctgagccaagca

SEQ ID NO: 394604 - DNA, 16 bp, M. musculus
ctctctgagttggagg

SEQ ID NO: 394605 - DNA, 16 bp, M. musculus
ctctctgatgatgatt

SEQ ID NO: 394606 - DNA, 16 bp, M. musculus
ctctctgcaactctta

SEQ ID NO: 394607 - DNA, 16 bp, M. musculus
ctctctgcactgcccc

SEQ ID NO: 394608 - DNA, 16 bp, M. musculus
ctctctgcagcatctt

SEQ ID NO: 394609 - DNA, 16 bp, M. musculus
ctctctgcagccctgg

SEQ ID NO: 394610 - DNA, 16 bp, M. musculus
ctctctgcatgtctct

SEQ ID NO: 394611 - DNA, 16 bp, M. musculus
ctctctgccccatctc

SEQ ID NO: 394612 - DNA, 16 bp, M. musculus
ctctctgcctcagcct

SEQ ID NO: 394613 - DNA, 16 bp, M. musculus
ctctctgcctcatgct

SEQ ID NO: 394614 - DNA, 16 bp, M. musculus
ctctctgcctcctgct

SEQ ID NO: 394615 - DNA, 16 bp, M. musculus
ctctctgcctctgctt

SEQ ID NO: 394616 - DNA, 16 bp, M. musculus
ctctctgcctgctgct

SEQ ID NO: 394617 - DNA, 16 bp, M. musculus
ctctctgcctgtctct

SEQ ID NO: 394618 - DNA, 16 bp, M. musculus
ctctctgcctgtggat

SEQ ID NO: 394619 - DNA, 16 bp, M. musculus
ctctctgccttattct

SEQ ID NO: 394620 - DNA, 16 bp, M. musculus
ctctctgccttctgcc

SEQ ID NO: 394621 - DNA, 16 bp, M. musculus
ctctctgctccactct

SEQ ID NO: 394622 - DNA, 16 bp, M. musculus
ctctctgctctctgct

SEQ ID NO: 394623 - DNA, 16 bp, M. musculus
ctctctgctgctgctg

SEQ ID NO: 394624 - DNA, 16 bp, M. musculus
ctctctgctggtacag

SEQ ID NO: 394625 - DNA, 16 bp, M. musculus
ctctctgcttcctgat

SEQ ID NO: 394626 - DNA, 16 bp, M. musculus
ctctctgcttcttgct

SEQ ID NO: 394627 - DNA, 16 bp, M. musculus
ctctctggagctggag

SEQ ID NO: 394628 - DNA, 16 bp, M. musculus
ctctctggcagccacc

SEQ ID NO: 394629 - DNA, 16 bp, M. musculus
ctctctggcctccatg

SEQ ID NO: 394630 - DNA, 16 bp, M. musculus
ctctctggctctgcgc

SEQ ID NO: 394631 - DNA, 16 bp, M. musculus
ctctctggctttctgt

SEQ ID NO: 394632 - DNA, 16 bp, M. musculus
ctctctgggcctcagt

SEQ ID NO: 394633 - DNA, 16 bp, M. musculus
ctctctgggcttctct

SEQ ID NO: 394634 - DNA, 16 bp, M. musculus
ctctctgggtctgtgg

SEQ ID NO: 394635 - DNA, 16 bp, M. musculus
ctctctggtctctctg

SEQ ID NO: 394636 - DNA, 16 bp, M. musculus
ctctctgtaactcctt

SEQ ID NO: 394637 - DNA, 16 bp, M. musculus
ctctctgtagccctgg

SEQ ID NO: 394638 - DNA, 16 bp, M. musculus
ctctctgtatatatgt

SEQ ID NO: 394639 - DNA, 16 bp, M. musculus
ctctctgtatttctgt

SEQ ID NO: 394640 - DNA, 16 bp, M. musculus
ctctctgtccctgcaa

SEQ ID NO: 394641 - DNA, 16 bp, M. musculus
ctctctgtctcatctc

SEQ ID NO: 394642 - DNA, 16 bp, M. musculus
ctctctgtctctatct

SEQ ID NO: 394643 - DNA, 16 bp, M. musculus
ctctctgtctctcctg

SEQ ID NO: 394644 - DNA, 16 bp, M. musculus
ctctctgtctctctgt

SEQ ID NO: 394645 - DNA, 16 bp, M. musculus
ctctctgtctctgccc

SEQ ID NO: 394646 - DNA, 16 bp, M. musculus
ctctctgtctctgcct

SEQ ID NO: 394647 - DNA, 16 bp, M. musculus
ctctctgtctctttga

SEQ ID NO: 394648 - DNA, 16 bp, M. musculus
ctctctgtctgtctct

SEQ ID NO: 394649 - DNA, 16 bp, M. musculus
ctctctgtcttttagt

SEQ ID NO: 394650 - DNA, 16 bp, M. musculus
ctctctgtgactctgt

SEQ ID NO: 394651 - DNA, 16 bp, M. musculus
ctctctgtgactggtt

SEQ ID NO: 394652 - DNA, 16 bp, M. musculus
ctctctgtgcagccct

SEQ ID NO: 394653 - DNA, 16 bp, M. musculus
ctctctgtgctctctg

SEQ ID NO: 394654 - DNA, 16 bp, M. musculus
ctctctgtggtttagg

SEQ ID NO: 394655 - DNA, 17 bp, M. musculus
ctctctgtgtagctctg

SEQ ID NO: 394656 - DNA, 16 bp, M. musculus
ctctctgtgtatcttt

SEQ ID NO: 394657 - DNA, 17 bp, M. musculus
ctctctgtgtgtctctc

SEQ ID NO: 394658 - DNA, 16 bp, M. musculus
ctctctgtttatgtgt

SEQ ID NO: 394659 - DNA, 16 bp, M. musculus
ctctctgtttggaaga

SEQ ID NO: 394660 - DNA, 16 bp, M. musculus
ctctctgtttgtgtgt

SEQ ID NO: 394661 - DNA, 16 bp, M. musculus
ctctctgttttctaca

SEQ ID NO: 394662 - DNA, 16 bp, M. musculus
ctctcttaaaacaaaa

SEQ ID NO: 394663 - DNA, 16 bp, M. musculus
ctctcttactcttgct

SEQ ID NO: 394664 - DNA, 16 bp, M. musculus
ctctcttacttcttac

SEQ ID NO: 394665 - DNA, 16 bp, M. musculus
ctctcttatagggaag

SEQ ID NO: 394666 - DNA, 16 bp, M. musculus
ctctcttcagacacac

SEQ ID NO: 394667 - DNA, 18 bp, M. musculus
ctctcttcccagtgatgg

SEQ ID NO: 394668 - DNA, 16 bp, M. musculus
ctctcttcccattgtt

SEQ ID NO: 394669 - DNA, 16 bp, M. musculus
ctctcttcctaggtga

SEQ ID NO: 394670 - DNA, 16 bp, M. musculus
ctctcttcctgcctgc

SEQ ID NO: 394671 - DNA, 16 bp, M. musculus
ctctcttcctgctgct

SEQ ID NO: 394672 - DNA, 16 bp, M. musculus
ctctcttctagcctct

SEQ ID NO: 394673 - DNA, 16 bp, M. musculus
ctctcttctctctgat

SEQ ID NO: 394674 - DNA, 16 bp, M. musculus
ctctcttctctctgtg

SEQ ID NO: 394675 - DNA, 16 bp, M. musculus
ctctcttctgcagctc

SEQ ID NO: 394676 - DNA, 16 bp, M. musculus
ctctcttctggcctgc

SEQ ID NO: 394677 - DNA, 16 bp, M. musculus
ctctcttcttgcaagg

SEQ ID NO: 394678 - DNA, 16 bp, M. musculus
ctctcttgctattcta

SEQ ID NO: 394679 - DNA, 16 bp, M. musculus
ctctcttgctctcctg

SEQ ID NO: 394680 - DNA, 16 bp, M. musculus
ctctcttgcttcttgc

SEQ ID NO: 394681 - DNA, 16 bp, M. musculus
ctctcttggtctcttg

SEQ ID NO: 394682 - DNA, 16 bp, M. musculus
ctctctttagaaaaca

SEQ ID NO: 394683 - DNA, 16 bp, M. musculus
ctctctttcccctgca

SEQ ID NO: 394684 - DNA, 16 bp, M. musculus
ctctctttctcagtct

SEQ ID NO: 394685 - DNA, 16 bp, M. musculus
ctctctttctctcaca

SEQ ID NO: 394686 - DNA, 16 bp, M. musculus
ctctctttgcaacaga

SEQ ID NO: 394687 - DNA, 16 bp, M. musculus
ctctctttgcttcctg

SEQ ID NO: 394688 - DNA, 16 bp, M. musculus
ctctcttttcctgaag

SEQ ID NO: 394689 - DNA, 16 bp, M. musculus
ctctctttttaaaaat

SEQ ID NO: 394690 - DNA, 16 bp, M. musculus
ctctgaaaacaaaaat

SEQ ID NO: 394691 - DNA, 16 bp, M. musculus
ctctgaaaatctccta

SEQ ID NO: 394692 - DNA, 16 bp, M. musculus
ctctgaaacaaaacaa

SEQ ID NO: 394693 - DNA, 16 bp, M. musculus
ctctgaaactctttgc

SEQ ID NO: 394694 - DNA, 16 bp, M. musculus
ctctgaaactgtaagc

SEQ ID NO: 394695 - DNA, 16 bp, M. musculus
ctctgaaagaggagag

SEQ ID NO: 394696 - DNA, 16 bp, M. musculus
ctctgaaagtattttt

SEQ ID NO: 394697 - DNA, 16 bp, M. musculus
ctctgaaagtcctcta

SEQ ID NO: 394698 - DNA, 16 bp, M. musculus
ctctgaacccagagct

SEQ ID NO: 394699 - DNA, 16 bp, M. musculus
ctctgaaccccatttt

SEQ ID NO: 394700 - DNA, 16 bp, M. musculus
ctctgaagaaagaatt

SEQ ID NO: 394701 - DNA, 16 bp, M. musculus
ctctgaagaaagacat

SEQ ID NO: 394702 - DNA, 16 bp, M. musculus
ctctgaagaagaaaaa

SEQ ID NO: 394703 - DNA, 16 bp, M. musculus
ctctgaagaattgagt

SEQ ID NO: 394704 - DNA, 16 bp, M. musculus
ctctgaagacaccaca

SEQ ID NO: 394705 - DNA, 16 bp, M. musculus
ctctgaagatcaacag

SEQ ID NO: 394706 - DNA, 16 bp, M. musculus
ctctgaagctgtaagc

SEQ ID NO: 394707 - DNA, 16 bp, M. musculus
ctctgaagggactttc

SEQ ID NO: 394708 - DNA, 16 bp, M. musculus
ctctgaagtgctggga

SEQ ID NO: 394709 - DNA, 16 bp, M. musculus
ctctgaatctctctct

SEQ ID NO: 394710 - DNA, 16 bp, M. musculus
ctctgaatgtgtaagc

SEQ ID NO: 394711 - DNA, 16 bp, M. musculus
ctctgaatttttaaaa

SEQ ID NO: 394712 - DNA, 16 bp, M. musculus
ctctgacaaatccctc

SEQ ID NO: 394713 - DNA, 16 bp, M. musculus
ctctgacacagcagga

SEQ ID NO: 394714 - DNA, 16 bp, M. musculus
ctctgacaccaggact

SEQ ID NO: 394715 - DNA, 16 bp, M. musculus
ctctgacagagcctga

SEQ ID NO: 394716 - DNA, 16 bp, M. musculus
ctctgacatccacata

SEQ ID NO: 394717 - DNA, 16 bp, M. musculus
ctctgacattcacaca

SEQ ID NO: 394718 - DNA, 16 bp, M. musculus
ctctgacccagaactg

SEQ ID NO: 394719 - DNA, 16 bp, M. musculus
ctctgaccccaagcct

SEQ ID NO: 394720 - DNA, 16 bp, M. musculus
ctctgaccccaggaat

SEQ ID NO: 394721 - DNA, 16 bp, M. musculus
ctctgacctacacaca

SEQ ID NO: 394722 - DNA, 16 bp, M. musculus
ctctgacctccacatt

SEQ ID NO: 394723 - DNA, 16 bp, M. musculus
ctctgacctccatgca

SEQ ID NO: 394724 - DNA, 16 bp, M. musculus
ctctgacctccatggg

SEQ ID NO: 394725 - DNA, 16 bp, M. musculus
ctctgacctccgcatg

SEQ ID NO: 394726 - DNA, 16 bp, M. musculus
ctctgacctcctcatg

SEQ ID NO: 394727 - DNA, 16 bp, M. musculus
ctctgacctctacctg

SEQ ID NO: 394728 - DNA, 16 bp, M. musculus
ctctgacctgcacctc

SEQ ID NO: 394729 - DNA, 16 bp, M. musculus
ctctgacctgtaagcc

SEQ ID NO: 394730 - DNA, 16 bp, M. musculus
ctctgactcagagctc

SEQ ID NO: 394731 - DNA, 16 bp, M. musculus
ctctgactcctacagt

SEQ ID NO: 394732 - DNA, 16 bp, M. musculus
ctctgactctctctct

SEQ ID NO: 394733 - DNA, 16 bp, M. musculus
ctctgactctgactct

SEQ ID NO: 394734 - DNA, 16 bp, M. musculus
ctctgactctgcctct

SEQ ID NO: 394735 - DNA, 16 bp, M. musculus
ctctgactctgttgct

SEQ ID NO: 394736 - DNA, 16 bp, M. musculus
ctctgactcttgcctg

SEQ ID NO: 394737 - DNA, 16 bp, M. musculus
ctctgactgtgacttg

SEQ ID NO: 394738 - DNA, 16 bp, M. musculus
ctctgacttccacact

SEQ ID NO: 394739 - DNA, 16 bp, M. musculus
ctctgagaaaggggag

SEQ ID NO: 394740 - DNA, 16 bp, M. musculus
ctctgagaagaaggag

SEQ ID NO: 394741 - DNA, 16 bp, M. musculus
ctctgagactctgaga

SEQ ID NO: 394742 - DNA, 16 bp, M. musculus
ctctgagagacccaag

SEQ ID NO: 394743 - DNA, 16 bp, M. musculus
ctctgagagactctgc

SEQ ID NO: 394744 - DNA, 16 bp, M. musculus
ctctgagagccccaag

SEQ ID NO: 394745 - DNA, 16 bp, M. musculus
ctctgagagccccagg

SEQ ID NO: 394746 - DNA, 16 bp, M. musculus
ctctgagagcctccaa

SEQ ID NO: 394747 - DNA, 16 bp, M. musculus
ctctgagagctcccag

SEQ ID NO: 394748 - DNA, 16 bp, M. musculus
ctctgagagctgccaa

SEQ ID NO: 394749 - DNA, 16 bp, M. musculus
ctctgagagggcagtg

SEQ ID NO: 394750 - DNA, 16 bp, M. musculus
ctctgagagggtggag

SEQ ID NO: 394751 - DNA, 16 bp, M. musculus
ctctgagagggtgttc

SEQ ID NO: 394752 - DNA, 16 bp, M. musculus
ctctgagatcctgaga

SEQ ID NO: 394753 - DNA, 16 bp, M. musculus
ctctgagatcctggtg

SEQ ID NO: 394754 - DNA, 16 bp, M. musculus
ctctgagattccattt

SEQ ID NO: 394755 - DNA, 16 bp, M. musculus
ctctgagcagatgggg

SEQ ID NO: 394756 - DNA, 16 bp, M. musculus
ctctgagccacatttt

SEQ ID NO: 394757 - DNA, 16 bp, M. musculus
ctctgagcctcagttt

SEQ ID NO: 394758 - DNA, 16 bp, M. musculus
ctctgagccttgtctc

SEQ ID NO: 394759 - DNA, 16 bp, M. musculus
ctctgagctccacaca

SEQ ID NO: 394760 - DNA, 16 bp, M. musculus
ctctgagctccacatg

SEQ ID NO: 394761 - DNA, 16 bp, M. musculus
ctctgagctccaggcc

SEQ ID NO: 394762 - DNA, 16 bp, M. musculus
ctctgagctctgaagt

SEQ ID NO: 394763 - DNA, 16 bp, M. musculus
ctctgagctctgagct

SEQ ID NO: 394764 - DNA, 16 bp, M. musculus
ctctgagctctgaggg

SEQ ID NO: 394765 - DNA, 16 bp, M. musculus
ctctgagctctgcctg

SEQ ID NO: 394766 - DNA, 16 bp, M. musculus
ctctgagctctgcctt

SEQ ID NO: 394767 - DNA, 16 bp, M. musculus
ctctgaggaaaaaaaa

SEQ ID NO: 394768 - DNA, 16 bp, M. musculus
ctctgaggagacagac

SEQ ID NO: 394769 - DNA, 16 bp, M. musculus
ctctgaggagacagct

SEQ ID NO: 394770 - DNA, 16 bp, M. musculus
ctctgaggagagccat

SEQ ID NO: 394771 - DNA, 16 bp, M. musculus
ctctgaggagtcctga

SEQ ID NO: 394772 - DNA, 16 bp, M. musculus
ctctgaggcagcaccc

SEQ ID NO: 394773 - DNA, 16 bp, M. musculus
ctctgaggcagggtct

SEQ ID NO: 394774 - DNA, 16 bp, M. musculus
ctctgaggctgagact

SEQ ID NO: 394775 - DNA, 16 bp, M. musculus
ctctgagggacccagg

SEQ ID NO: 394776 - DNA, 16 bp, M. musculus
ctctgaggtgggacag

SEQ ID NO: 394777 - DNA, 16 bp, M. musculus
ctctgagtacaaggcc

SEQ ID NO: 394778 - DNA, 16 bp, M. musculus
ctctgagtcagagagc

SEQ ID NO: 394779 - DNA, 16 bp, M. musculus
ctctgagtccctccaa

SEQ ID NO: 394780 - DNA, 16 bp, M. musculus
ctctgagtctgaagcc

SEQ ID NO: 394781 - DNA, 16 bp, M. musculus
ctctgagtggtccagt

SEQ ID NO: 394782 - DNA, 16 bp, M. musculus
ctctgagttcaagtct

SEQ ID NO: 394783 - DNA, 17 bp, M. musculus
ctctgagttcagggcca

SEQ ID NO: 394784 - DNA, 16 bp, M. musculus
ctctgagttcattgtg

SEQ ID NO: 394785 - DNA, 16 bp, M. musculus
ctctgataaatggagg

SEQ ID NO: 394786 - DNA, 16 bp, M. musculus
ctctgataactctagc

SEQ ID NO: 394787 - DNA, 16 bp, M. musculus
ctctgatcctgggcat

SEQ ID NO: 394788 - DNA, 16 bp, M. musculus
ctctgatctccacaca

SEQ ID NO: 394789 - DNA, 16 bp, M. musculus
ctctgatctgctttct

SEQ ID NO: 394790 - DNA, 16 bp, M. musculus
ctctgatgatgactgg

SEQ ID NO: 394791 - DNA, 16 bp, M. musculus
ctctgatgtagaaaat

SEQ ID NO: 394792 - DNA, 16 bp, M. musculus
ctctgattcagttcct

SEQ ID NO: 394793 - DNA, 16 bp, M. musculus
ctctgattctctgtct

SEQ ID NO: 394794 - DNA, 16 bp, M. musculus
ctctgattctgactct

SEQ ID NO: 394795 - DNA, 16 bp, M. musculus
ctctgatttcaaggtc

SEQ ID NO: 394796 - DNA, 16 bp, M. musculus
ctctgcaaaaacaagt

SEQ ID NO: 394797 - DNA, 16 bp, M. musculus
ctctgcaaaaacagta

SEQ ID NO: 394798 - DNA, 16 bp, M. musculus
ctctgcaaaagcagcc

SEQ ID NO: 394799 - DNA, 16 bp, M. musculus
ctctgcaaacccccat

SEQ ID NO: 394800 - DNA, 16 bp, M. musculus
ctctgcaagaagagca

SEQ ID NO: 394801 - DNA, 16 bp, M. musculus
ctctgcaagagcacta

SEQ ID NO: 394802 - DNA, 16 bp, M. musculus
ctctgcaagagcagga

SEQ ID NO: 394803 - DNA, 16 bp, M. musculus
ctctgcaagagcagta

SEQ ID NO: 394804 - DNA, 16 bp, M. musculus
ctctgcaagaggagag

SEQ ID NO: 394805 - DNA, 16 bp, M. musculus
ctctgcaagcactgca

SEQ ID NO: 394806 - DNA, 16 bp, M. musculus
ctctgcacagccctgg

SEQ ID NO: 394807 - DNA, 16 bp, M. musculus
ctctgcacccaggtga

SEQ ID NO: 394808 - DNA, 16 bp, M. musculus
ctctgcagacactgca

SEQ ID NO: 394809 - DNA, 16 bp, M. musculus
ctctgcagaccagcct

SEQ ID NO: 394810 - DNA, 16 bp, M. musculus
ctctgcagatccacaa

SEQ ID NO: 394811 - DNA, 16 bp, M. musculus
ctctgcagcagctcct

SEQ ID NO: 394812 - DNA, 16 bp, M. musculus
ctctgcagcccaggct

SEQ ID NO: 394813 - DNA, 16 bp, M. musculus
ctctgcagccctggct

SEQ ID NO: 394814 - DNA, 16 bp, M. musculus
ctctgcagtctgcatg

SEQ ID NO: 394815 - DNA, 16 bp, M. musculus
ctctgcatcagctcca

SEQ ID NO: 394816 - DNA, 16 bp, M. musculus
ctctgcatcagtttct

SEQ ID NO: 394817 - DNA, 16 bp, M. musculus
ctctgcatccctggga

SEQ ID NO: 394818 - DNA, 16 bp, M. musculus
ctctgcatcctcacca

SEQ ID NO: 394819 - DNA, 16 bp, M. musculus
ctctgcatcctctgct

SEQ ID NO: 394820 - DNA, 16 bp, M. musculus
ctctgcatcttcatgt

SEQ ID NO: 394821 - DNA, 16 bp, M. musculus
ctctgcatctttggga

SEQ ID NO: 394822 - DNA, 16 bp, M. musculus
ctctgcatggcctttc

SEQ ID NO: 394823 - DNA, 16 bp, M. musculus
ctctgcatggtccttc

SEQ ID NO: 394824 - DNA, 16 bp, M. musculus
ctctgcatttgctccc

SEQ ID NO: 394825 - DNA, 16 bp, M. musculus
ctctgccaccagagtg

SEQ ID NO: 394826 - DNA, 16 bp, M. musculus
ctctgccacccaagtg

SEQ ID NO: 394827 - DNA, 16 bp, M. musculus
ctctgccacccaccca

SEQ ID NO: 394828 - DNA, 16 bp, M. musculus
ctctgccagaggctga

SEQ ID NO: 394829 - DNA, 16 bp, M. musculus
ctctgccaggcaacag

SEQ ID NO: 394830 - DNA, 16 bp, M. musculus
ctctgcccagtgcaga

SEQ ID NO: 394831 - DNA, 16 bp, M. musculus
ctctgccccagcagcc

SEQ ID NO: 394832 - DNA, 16 bp, M. musculus
ctctgcccctcaagtg

SEQ ID NO: 394833 - DNA, 16 bp, M. musculus
ctctgcccctgagtgc

SEQ ID NO: 394834 - DNA, 16 bp, M. musculus
ctctgccctcatggct

SEQ ID NO: 394835 - DNA, 16 bp, M. musculus
ctctgccctccaagtg

SEQ ID NO: 394836 - DNA, 16 bp, M. musculus
ctctgccctctgctct

SEQ ID NO: 394837 - DNA, 16 bp, M. musculus
ctctgccctgctctgc

SEQ ID NO: 394838 - DNA, 16 bp, M. musculus
ctctgccctggcagcc

SEQ ID NO: 394839 - DNA, 16 bp, M. musculus
ctctgccctggctgtc

SEQ ID NO: 394840 - DNA, 16 bp, M. musculus
ctctgcccttccccca

SEQ ID NO: 394841 - DNA, 16 bp, M. musculus
ctctgcctagggaatg

SEQ ID NO: 394842 - DNA, 16 bp, M. musculus
ctctgcctcaaaggaa

SEQ ID NO: 394843 - DNA, 16 bp, M. musculus
ctctgcctcagaagtg

SEQ ID NO: 394844 - DNA, 16 bp, M. musculus
ctctgcctcagctcct

SEQ ID NO: 394845 - DNA, 16 bp, M. musculus
ctctgcctcaggagca

SEQ ID NO: 394846 - DNA, 16 bp, M. musculus
ctctgcctcaggagtg

SEQ ID NO: 394847 - DNA, 16 bp, M. musculus
ctctgcctccaacttg

SEQ ID NO: 394848 - DNA, 16 bp, M. musculus
ctctgcctccaagtac

SEQ ID NO: 394849 - DNA, 16 bp, M. musculus
ctctgcctcccacctg

SEQ ID NO: 394850 - DNA, 16 bp, M. musculus
ctctgcctcccaggct

SEQ ID NO: 394851 - DNA, 16 bp, M. musculus
ctctgcctccccagcc

SEQ ID NO: 394852 - DNA, 16 bp, M. musculus
ctctgcctcccgggtg

SEQ ID NO: 394853 - DNA, 16 bp, M. musculus
ctctgcctccgaagtg

SEQ ID NO: 394854 - DNA, 16 bp, M. musculus
ctctgcctcctaagca

SEQ ID NO: 394855 - DNA, 16 bp, M. musculus
ctctgcctcctaagta

SEQ ID NO: 394856 - DNA, 16 bp, M. musculus
ctctgcctcctcagag

SEQ ID NO: 394857 - DNA, 16 bp, M. musculus
ctctgcctcctcagca

SEQ ID NO: 394858 - DNA, 16 bp, M. musculus
ctctgcctcctcctca

SEQ ID NO: 394859 - DNA, 16 bp, M. musculus
ctctgcctcctctgtc

SEQ ID NO: 394860 - DNA, 16 bp, M. musculus
ctctgcctcctgaatg

SEQ ID NO: 394861 - DNA, 17 bp, M. musculus
ctctgcctcctgaatgc

SEQ ID NO: 394862 - DNA, 16 bp, M. musculus
ctctgcctcctgagcc

SEQ ID NO: 394863 - DNA, 16 bp, M. musculus
ctctgcctcctgagta

SEQ ID NO: 394864 - DNA, 16 bp, M. musculus
ctctgcctcctgctct

SEQ ID NO: 394865 - DNA, 16 bp, M. musculus
ctctgcctcctgctgg

SEQ ID NO: 394866 - DNA, 16 bp, M. musculus
ctctgcctcgtgagtg

SEQ ID NO: 394867 - DNA, 16 bp, M. musculus
ctctgcctctccagtc

SEQ ID NO: 394868 - DNA, 18 bp, M. musculus
ctctgcctctctgcctct

SEQ ID NO: 394869 - DNA, 16 bp, M. musculus
ctctgcctctctgctg

SEQ ID NO: 394870 - DNA, 16 bp, M. musculus
ctctgcctctctgtgc

SEQ ID NO: 394871 - DNA, 16 bp, M. musculus
ctctgcctctgagcac

SEQ ID NO: 394872 - DNA, 16 bp, M. musculus
ctctgcctctgagtgc

SEQ ID NO: 394873 - DNA, 16 bp, M. musculus
ctctgcctctgccacc

SEQ ID NO: 394874 - DNA, 16 bp, M. musculus
ctctgcctctgctgct

SEQ ID NO: 394875 - DNA, 20 bp, M. musculus
ctctgcctcttgagtgctgg

SEQ ID NO: 394876 - DNA, 16 bp, M. musculus
ctctgcctgcatcatg

SEQ ID NO: 394877 - DNA, 16 bp, M. musculus
ctctgcctgcatctgc

SEQ ID NO: 394878 - DNA, 16 bp, M. musculus
ctctgcctgcccagtg

SEQ ID NO: 394879 - DNA, 16 bp, M. musculus
ctctgcctgcctccac

SEQ ID NO: 394880 - DNA, 16 bp, M. musculus
ctctgcctgcctgctg

SEQ ID NO: 394881 - DNA, 16 bp, M. musculus
ctctgcctgctgcctg

SEQ ID NO: 394882 - DNA, 16 bp, M. musculus
ctctgcctgctgtctg

SEQ ID NO: 394883 - DNA, 16 bp, M. musculus
ctctgcctggctggtt

SEQ ID NO: 394884 - DNA, 16 bp, M. musculus
ctctgcctgtctctgt

SEQ ID NO: 394885 - DNA, 16 bp, M. musculus
ctctgcctgtctttct

SEQ ID NO: 394886 - DNA, 16 bp, M. musculus
ctctgcctgtgcctgt

SEQ ID NO: 394887 - DNA, 16 bp, M. musculus
ctctgccttccaagtt

SEQ ID NO: 394888 - DNA, 16 bp, M. musculus
ctctgccttccctgtg

SEQ ID NO: 394889 - DNA, 16 bp, M. musculus
ctctgccttcctcgtg

SEQ ID NO: 394890 - DNA, 16 bp, M. musculus
ctctgccttcctctgc

SEQ ID NO: 394891 - DNA, 16 bp, M. musculus
ctctgccttctgagtc

SEQ ID NO: 394892 - DNA, 16 bp, M. musculus
ctctgccttctgcctg

SEQ ID NO: 394893 - DNA, 16 bp, M. musculus
ctctgccttctggctg

SEQ ID NO: 394894 - DNA, 16 bp, M. musculus
ctctgccttctgtcct

SEQ ID NO: 394895 - DNA, 16 bp, M. musculus
ctctgccttcttccca

SEQ ID NO: 394896 - DNA, 16 bp, M. musculus
ctctgccttgtgtttg

SEQ ID NO: 394897 - DNA, 16 bp, M. musculus
ctctgcctttcctgtg

SEQ ID NO: 394898 - DNA, 16 bp, M. musculus
ctctgcctttctcagg

SEQ ID NO: 394899 - DNA, 16 bp, M. musculus
ctctgcctttctctat

SEQ ID NO: 394900 - DNA, 16 bp, M. musculus
ctctgcggagtcctgg

SEQ ID NO: 394901 - DNA, 16 bp, M. musculus
ctctgctacataaaca

SEQ ID NO: 394902 - DNA, 16 bp, M. musculus
ctctgctcactcagtc

SEQ ID NO: 394903 - DNA, 16 bp, M. musculus
ctctgctccacttttg

SEQ ID NO: 394904 - DNA, 16 bp, M. musculus
ctctgctccatcccca

SEQ ID NO: 394905 - DNA, 16 bp, M. musculus
ctctgctccatcctcc

SEQ ID NO: 394906 - DNA, 16 bp, M. musculus
ctctgctccatctctg

SEQ ID NO: 394907 - DNA, 16 bp, M. musculus
ctctgctccatgcttt

SEQ ID NO: 394908 - DNA, 16 bp, M. musculus
ctctgctccattcttt

SEQ ID NO: 394909 - DNA, 16 bp, M. musculus
ctctgctcccactgcc

SEQ ID NO: 394910 - DNA, 16 bp, M. musculus
ctctgctcccagctcc

SEQ ID NO: 394911 - DNA, 16 bp, M. musculus
ctctgctccctccagt

SEQ ID NO: 394912 - DNA, 16 bp, M. musculus
ctctgctcctcccacc

SEQ ID NO: 394913 - DNA, 16 bp, M. musculus
ctctgctctccacaca

SEQ ID NO: 394914 - DNA, 16 bp, M. musculus
ctctgctctctgtctc

SEQ ID NO: 394915 - DNA, 16 bp, M. musculus
ctctgctctgctcctg

SEQ ID NO: 394916 - DNA, 16 bp, M. musculus
ctctgctctgctctct

SEQ ID NO: 394917 - DNA, 16 bp, M. musculus
ctctgctctgctctgg

SEQ ID NO: 394918 - DNA, 16 bp, M. musculus
ctctgctctggagtca

SEQ ID NO: 394919 - DNA, 16 bp, M. musculus
ctctgctcttggctgt

SEQ ID NO: 394920 - DNA, 16 bp, M. musculus
ctctgctgcctctgtc

SEQ ID NO: 394921 - DNA, 16 bp, M. musculus
ctctgctgcctgtgga

SEQ ID NO: 394922 - DNA, 16 bp, M. musculus
ctctgctgctgctcct

SEQ ID NO: 394923 - DNA, 16 bp, M. musculus
ctctgctgctgctgct

SEQ ID NO: 394924 - DNA, 16 bp, M. musculus
ctctgctgcttctgag

SEQ ID NO: 394925 - DNA, 16 bp, M. musculus
ctctgctggacttttt

SEQ ID NO: 394926 - DNA, 17 bp, M. musculus
ctctgctggcaagctct

SEQ ID NO: 394927 - DNA, 16 bp, M. musculus
ctctgctggtgtgtct

SEQ ID NO: 394928 - DNA, 16 bp, M. musculus
ctctgctgtatgtgtt

SEQ ID NO: 394929 - DNA, 16 bp, M. musculus
ctctgctgtcctctgc

SEQ ID NO: 394930 - DNA, 16 bp, M. musculus
ctctgctgtgccttcc

SEQ ID NO: 394931 - DNA, 16 bp, M. musculus
ctctgctgtgcctttc

SEQ ID NO: 394932 - DNA, 16 bp, M. musculus
ctctgctgttctcatg

SEQ ID NO: 394933 - DNA, 16 bp, M. musculus
ctctgcttcagctcct

SEQ ID NO: 394934 - DNA, 16 bp, M. musculus
ctctgcttcagtttct

SEQ ID NO: 394935 - DNA, 16 bp, M. musculus
ctctgcttccagactg

SEQ ID NO: 394936 - DNA, 16 bp, M. musculus
ctctgcttcccagatg

SEQ ID NO: 394937 - DNA, 16 bp, M. musculus
ctctgcttcccatctc

SEQ ID NO: 394938 - DNA, 16 bp, M. musculus
ctctgcttccccagca

SEQ ID NO: 394939 - DNA, 16 bp, M. musculus
ctctgcttcctaactg

SEQ ID NO: 394940 - DNA, 16 bp, M. musculus
ctctgcttcctgaggg

SEQ ID NO: 394941 - DNA, 16 bp, M. musculus
ctctgcttcctgagta

SEQ ID NO: 394942 - DNA, 16 bp, M. musculus
ctctgcttcctgcatg

SEQ ID NO: 394943 - DNA, 16 bp, M. musculus
ctctgcttcctgctgc

SEQ ID NO: 394944 - DNA, 16 bp, M. musculus
ctctgcttcctgctgt

SEQ ID NO: 394945 - DNA, 16 bp, M. musculus
ctctgcttcctgtctg

SEQ ID NO: 394946 - DNA, 16 bp, M. musculus
ctctgcttctcaagtg

SEQ ID NO: 394947 - DNA, 16 bp, M. musculus
ctctgcttctggagtg

SEQ ID NO: 394948 - DNA, 16 bp, M. musculus
ctctgcttgctgccct

SEQ ID NO: 394949 - DNA, 16 bp, M. musculus
ctctgcttggaaagac

SEQ ID NO: 394950 - DNA, 16 bp, M. musculus
ctctgctttaaaaaaa

SEQ ID NO: 394951 - DNA, 16 bp, M. musculus
ctctgctttattttct

SEQ ID NO: 394952 - DNA, 16 bp, M. musculus
ctctgctttccccgtg

SEQ ID NO: 394953 - DNA, 16 bp, M. musculus
ctctgctttctctgct

SEQ ID NO: 394954 - DNA, 16 bp, M. musculus
ctctgctttctctgtg

SEQ ID NO: 394955 - DNA, 16 bp, M. musculus
ctctgctttctgagtg

SEQ ID NO: 394956 - DNA, 16 bp, M. musculus
ctctgctttctgtgtg

SEQ ID NO: 394957 - DNA, 16 bp, M. musculus
ctctggaaagagactg

SEQ ID NO: 394958 - DNA, 16 bp, M. musculus
ctctggaaatcaatat

SEQ ID NO: 394959 - DNA, 16 bp, M. musculus
ctctggaaatcaatcc

SEQ ID NO: 394960 - DNA, 16 bp, M. musculus
ctctggaaatcaggct

SEQ ID NO: 394961 - DNA, 16 bp, M. musculus
ctctggaacaaaaaga

SEQ ID NO: 394962 - DNA, 16 bp, M. musculus
ctctggaacaaaagga

SEQ ID NO: 394963 - DNA, 16 bp, M. musculus
ctctggaaccagaagc

SEQ ID NO: 394964 - DNA, 16 bp, M. musculus
ctctggaactcactat

SEQ ID NO: 394965 - DNA, 16 bp, M. musculus
ctctggaagaacagct

SEQ ID NO: 394966 - DNA, 16 bp, M. musculus
ctctggaagagaagct

SEQ ID NO: 394967 - DNA, 16 bp, M. musculus
ctctggaagagcagca

SEQ ID NO: 394968 - DNA, 16 bp, M. musculus
ctctggaagctcccag

SEQ ID NO: 394969 - DNA, 18 bp, M. musculus
ctctggaagtcagtctgg

SEQ ID NO: 394970 - DNA, 16 bp, M. musculus
ctctggaagtggaggc

SEQ ID NO: 394971 - DNA, 16 bp, M. musculus
ctctggaccgacatgc

SEQ ID NO: 394972 - DNA, 16 bp, M. musculus
ctctggaccttctttt

SEQ ID NO: 394973 - DNA, 16 bp, M. musculus
ctctggagaaacagaa

SEQ ID NO: 394974 - DNA, 16 bp, M. musculus
ctctggagaaccctga

SEQ ID NO: 394975 - DNA, 16 bp, M. musculus
ctctggagaccaggct

SEQ ID NO: 394976 - DNA, 16 bp, M. musculus
ctctggagaggcagag

SEQ ID NO: 394977 - DNA, 16 bp, M. musculus
ctctggagagtggaac

SEQ ID NO: 394978 - DNA, 16 bp, M. musculus
ctctggagctgaagtt

SEQ ID NO: 394979 - DNA, 16 bp, M. musculus
ctctggagctgcagtt

SEQ ID NO: 394980 - DNA, 16 bp, M. musculus
ctctggagctggagtt

SEQ ID NO: 394981 - DNA, 16 bp, M. musculus
ctctggagctggggtt

SEQ ID NO: 394982 - DNA, 16 bp, M. musculus
ctctggaggaaaaaaa

SEQ ID NO: 394983 - DNA, 16 bp, M. musculus
ctctggaggcagaagc

SEQ ID NO: 394984 - DNA, 16 bp, M. musculus
ctctggaggtactggt

SEQ ID NO: 394985 - DNA, 16 bp, M. musculus
ctctggagtgctgaga

SEQ ID NO: 394986 - DNA, 16 bp, M. musculus
ctctggatggtccatc

SEQ ID NO: 394987 - DNA, 16 bp, M. musculus
ctctggatgtcctgga

SEQ ID NO: 394988 - DNA, 16 bp, M. musculus
ctctggcagagcctgt

SEQ ID NO: 394989 - DNA, 16 bp, M. musculus
ctctggcagctcaagg

SEQ ID NO: 394990 - DNA, 16 bp, M. musculus
ctctggcagggtgtgg

SEQ ID NO: 394991 - DNA, 16 bp, M. musculus
ctctggccaggacttc

SEQ ID NO: 394992 - DNA, 16 bp, M. musculus
ctctggccaggcctgg

SEQ ID NO: 394993 - DNA, 16 bp, M. musculus
ctctggccatcctgga

SEQ ID NO: 394994 - DNA, 16 bp, M. musculus
ctctggccgggaaaat

SEQ ID NO: 394995 - DNA, 16 bp, M. musculus
ctctggcctcagcctc

SEQ ID NO: 394996 - DNA, 16 bp, M. musculus
ctctggcctccacaca

SEQ ID NO: 394997 - DNA, 16 bp, M. musculus
ctctggcctccacaga

SEQ ID NO: 394998 - DNA, 16 bp, M. musculus
ctctggcctccccatg

SEQ ID NO: 394999 - DNA, 16 bp, M. musculus
ctctggcctccgtgag

SEQ ID NO: 395000 - DNA, 16 bp, M. musculus
ctctggcctccttggg

SEQ ID NO: 395001 - DNA, 16 bp, M. musculus
ctctggcctctacaca

SEQ ID NO: 395002 - DNA, 16 bp, M. musculus
ctctggcctctccaca

SEQ ID NO: 395003 - DNA, 16 bp, M. musculus
ctctggcctctgagag

SEQ ID NO: 395004 - DNA, 16 bp, M. musculus
ctctggcctctgagtg

SEQ ID NO: 395005 - DNA, 16 bp, M. musculus
ctctggcctctgcagg

SEQ ID NO: 395006 - DNA, 16 bp, M. musculus
ctctggcctggaactt

SEQ ID NO: 395007 - DNA, 16 bp, M. musculus
ctctggcctgggtgga

SEQ ID NO: 395008 - DNA, 16 bp, M. musculus
ctctggcctggtagtc

SEQ ID NO: 395009 - DNA, 16 bp, M. musculus
ctctggccttcacaca

SEQ ID NO: 395010 - DNA, 16 bp, M. musculus
ctctggctaagctggt

SEQ ID NO: 395011 - DNA, 16 bp, M. musculus
ctctggctcctactgg

SEQ ID NO: 395012 - DNA, 16 bp, M. musculus
ctctggctcctatgga

SEQ ID NO: 395013 - DNA, 16 bp, M. musculus
ctctggctcctccatt

SEQ ID NO: 395014 - DNA, 16 bp, M. musculus
ctctggctcctgccta

SEQ ID NO: 395015 - DNA, 16 bp, M. musculus
ctctggctctcacact

SEQ ID NO: 395016 - DNA, 16 bp, M. musculus
ctctggctctcttgct

SEQ ID NO: 395017 - DNA, 16 bp, M. musculus
ctctggctctgactgt

SEQ ID NO: 395018 - DNA, 16 bp, M. musculus
ctctggctctggctct

SEQ ID NO: 395019 - DNA, 16 bp, M. musculus
ctctggctctgtctct

SEQ ID NO: 395020 - DNA, 16 bp, M. musculus
ctctggctgccacaca

SEQ ID NO: 395021 - DNA, 16 bp, M. musculus
ctctggctggaactgg

SEQ ID NO: 395022 - DNA, 16 bp, M. musculus
ctctggctggagagat

SEQ ID NO: 395023 - DNA, 16 bp, M. musculus
ctctggctggcctgga

SEQ ID NO: 395024 - DNA, 16 bp, M. musculus
ctctggctgtagcttg

SEQ ID NO: 395025 - DNA, 16 bp, M. musculus
ctctggctgtcctcga

SEQ ID NO: 395026 - DNA, 16 bp, M. musculus
ctctggctgtcctgta

SEQ ID NO: 395027 - DNA, 16 bp, M. musculus
ctctggctgtgaagtg

SEQ ID NO: 395028 - DNA, 16 bp, M. musculus
ctctggctgtgaggtc

SEQ ID NO: 395029 - DNA, 16 bp, M. musculus
ctctggctgttctctc

SEQ ID NO: 395030 - DNA, 16 bp, M. musculus
ctctggctgttctgaa

SEQ ID NO: 395031 - DNA, 16 bp, M. musculus
ctctggcttccacatc

SEQ ID NO: 395032 - DNA, 16 bp, M. musculus
ctctggcttccacgtg

SEQ ID NO: 395033 - DNA, 16 bp, M. musculus
ctctggcttctacaca

SEQ ID NO: 395034 - DNA, 16 bp, M. musculus
ctctggcttctacaga

SEQ ID NO: 395035 - DNA, 16 bp, M. musculus
ctctggcttctccatt

SEQ ID NO: 395036 - DNA, 16 bp, M. musculus
ctctggcttctgtgag

SEQ ID NO: 395037 - DNA, 16 bp, M. musculus
ctctggctttccctga

SEQ ID NO: 395038 - DNA, 16 bp, M. musculus
ctctggctttcctgga

SEQ ID NO: 395039 - DNA, 16 bp, M. musculus
ctctgggaaaaaaaaa

SEQ ID NO: 395040 - DNA, 16 bp, M. musculus
ctctgggaactctggg

SEQ ID NO: 395041 - DNA, 16 bp, M. musculus
ctctgggaactgtggg

SEQ ID NO: 395042 - DNA, 16 bp, M. musculus
ctctgggaagtctggt

SEQ ID NO: 395043 - DNA, 16 bp, M. musculus
ctctgggagctccagg

SEQ ID NO: 395044 - DNA, 16 bp, M. musculus
ctctgggagctctgga

SEQ ID NO: 395045 - DNA, 16 bp, M. musculus
ctctgggaggcagagg

SEQ ID NO: 395046 - DNA, 16 bp, M. musculus
ctctgggatcctggga

SEQ ID NO: 395047 - DNA, 16 bp, M. musculus
ctctgggatcctgtga

SEQ ID NO: 395048 - DNA, 16 bp, M. musculus
ctctgggatgagctag

SEQ ID NO: 395049 - DNA, 16 bp, M. musculus
ctctgggattaaaggc

SEQ ID NO: 395050 - DNA, 16 bp, M. musculus
ctctgggcaggcagaa

SEQ ID NO: 395051 - DNA, 16 bp, M. musculus
ctctgggcaggtagtc

SEQ ID NO: 395052 - DNA, 16 bp, M. musculus
ctctgggccatctctc

SEQ ID NO: 395053 - DNA, 16 bp, M. musculus
ctctgggcctcacaga

SEQ ID NO: 395054 - DNA, 16 bp, M. musculus
ctctgggcctcagctt

SEQ ID NO: 395055 - DNA, 16 bp, M. musculus
ctctgggctcagtgag

SEQ ID NO: 395056 - DNA, 16 bp, M. musculus
ctctgggctctgagct

SEQ ID NO: 395057 - DNA, 16 bp, M. musculus
ctctgggctctgggct

SEQ ID NO: 395058 - DNA, 16 bp, M. musculus
ctctgggctgaaatca

SEQ ID NO: 395059 - DNA, 16 bp, M. musculus
ctctgggctggagaga

SEQ ID NO: 395060 - DNA, 16 bp, M. musculus
ctctggggaagaattg

SEQ ID NO: 395061 - DNA, 16 bp, M. musculus
ctctggggaccttggg

SEQ ID NO: 395062 - DNA, 16 bp, M. musculus
ctctggggagaagtct

SEQ ID NO: 395063 - DNA, 16 bp, M. musculus
ctctggggaggcagaa

SEQ ID NO: 395064 - DNA, 16 bp, M. musculus
ctctggggcccacagt

SEQ ID NO: 395065 - DNA, 16 bp, M. musculus
ctctggggctgagcag

SEQ ID NO: 395066 - DNA, 16 bp, M. musculus
ctctggggctggagag

SEQ ID NO: 395067 - DNA, 16 bp, M. musculus
ctctgggggaagggca

SEQ ID NO: 395068 - DNA, 16 bp, M. musculus
ctctgggggttctgat

SEQ ID NO: 395069 - DNA, 16 bp, M. musculus
ctctggggtctgtatg

SEQ ID NO: 395070 - DNA, 16 bp, M. musculus
ctctggggtgtctggt

SEQ ID NO: 395071 - DNA, 16 bp, M. musculus
ctctgggtccctccat

SEQ ID NO: 395072 - DNA, 16 bp, M. musculus
ctctgggtggagcttg

SEQ ID NO: 395073 - DNA, 16 bp, M. musculus
ctctgggtggcctgga

SEQ ID NO: 395074 - DNA, 16 bp, M. musculus
ctctgggtggcctttt

SEQ ID NO: 395075 - DNA, 16 bp, M. musculus
ctctgggtgtgtttgt

SEQ ID NO: 395076 - DNA, 16 bp, M. musculus
ctctgggtgttttaag

SEQ ID NO: 395077 - DNA, 16 bp, M. musculus
ctctgggttcagtcct

SEQ ID NO: 395078 - DNA, 16 bp, M. musculus
ctctgggtttggtggc

SEQ ID NO: 395079 - DNA, 16 bp, M. musculus
ctctggtcaactccac

SEQ ID NO: 395080 - DNA, 16 bp, M. musculus
ctctggtccaaagatt

SEQ ID NO: 395081 - DNA, 16 bp, M. musculus
ctctggtcctcatgct

SEQ ID NO: 395082 - DNA, 16 bp, M. musculus
ctctggtcctctgcaa

SEQ ID NO: 395083 - DNA, 16 bp, M. musculus
ctctggtcttcctggg

SEQ ID NO: 395084 - DNA, 16 bp, M. musculus
ctctggtcttccttct

SEQ ID NO: 395085 - DNA, 16 bp, M. musculus
ctctggtgcaccctct

SEQ ID NO: 395086 - DNA, 16 bp, M. musculus
ctctggtggaaaatct

SEQ ID NO: 395087 - DNA, 16 bp, M. musculus
ctctggtggccaaact

SEQ ID NO: 395088 - DNA, 16 bp, M. musculus
ctctggttccaggaga

SEQ ID NO: 395089 - DNA, 16 bp, M. musculus
ctctggttctctctct

SEQ ID NO: 395090 - DNA, 16 bp, M. musculus
ctctggttcttacact

SEQ ID NO: 395091 - DNA, 16 bp, M. musculus
ctctggttgtcttgga

SEQ ID NO: 395092 - DNA, 16 bp, M. musculus
ctctgtaaaccaggct

SEQ ID NO: 395093 - DNA, 16 bp, M. musculus
ctctgtaaaccatgct

SEQ ID NO: 395094 - DNA, 16 bp, M. musculus
ctctgtaacccaggct

SEQ ID NO: 395095 - DNA, 16 bp, M. musculus
ctctgtaacccatttt

SEQ ID NO: 395096 - DNA, 17 bp, M. musculus
ctctgtaactccagttc

SEQ ID NO: 395097 - DNA, 16 bp, M. musculus
ctctgtaagttccagg

SEQ ID NO: 395098 - DNA, 16 bp, M. musculus
ctctgtaatacagctt

SEQ ID NO: 395099 - DNA, 16 bp, M. musculus
ctctgtacagctctgg

SEQ ID NO: 395100 - DNA, 16 bp, M. musculus
ctctgtacagtcctgg

SEQ ID NO: 395101 - DNA, 16 bp, M. musculus
ctctgtacatgtgtgt

SEQ ID NO: 395102 - DNA, 16 bp, M. musculus
ctctgtacctcacaga

SEQ ID NO: 395103 - DNA, 16 bp, M. musculus
ctctgtactttgtctc

SEQ ID NO: 395104 - DNA, 16 bp, M. musculus
ctctgtagaccaagtt

SEQ ID NO: 395105 - DNA, 18 bp, M. musculus
ctctgtagaccaggctat

SEQ ID NO: 395106 - DNA, 16 bp, M. musculus
ctctgtagacgaggct

SEQ ID NO: 395107 - DNA, 16 bp, M. musculus
ctctgtagagcagact

SEQ ID NO: 395108 - DNA, 16 bp, M. musculus
ctctgtagagccctgg

SEQ ID NO: 395109 - DNA, 16 bp, M. musculus
ctctgtagcccaagct

SEQ ID NO: 395110 - DNA, 16 bp, M. musculus
ctctgtagcccaggcc

SEQ ID NO: 395111 - DNA, 16 bp, M. musculus
ctctgtagcccaggct

SEQ ID NO: 395112 - DNA, 16 bp, M. musculus
ctctgtagctccagtt

SEQ ID NO: 395113 - DNA, 16 bp, M. musculus
ctctgtatgtcttctt

SEQ ID NO: 395114 - DNA, 16 bp, M. musculus
ctctgtatgtgtctct

SEQ ID NO: 395115 - DNA, 16 bp, M. musculus
ctctgtattttctcct

SEQ ID NO: 395116 - DNA, 16 bp, M. musculus
ctctgtcaacactcct

SEQ ID NO: 395117 - DNA, 16 bp, M. musculus
ctctgtcactgagctg

SEQ ID NO: 395118 - DNA, 16 bp, M. musculus
ctctgtcatctatcct

SEQ ID NO: 395119 - DNA, 16 bp, M. musculus
ctctgtccaatgtttg

SEQ ID NO: 395120 - DNA, 16 bp, M. musculus
ctctgtccatctctct

SEQ ID NO: 395121 - DNA, 16 bp, M. musculus
ctctgtcccagaggaa

SEQ ID NO: 395122 - DNA, 16 bp, M. musculus
ctctgtcccctctgtc

SEQ ID NO: 395123 - DNA, 16 bp, M. musculus
ctctgtccctctgtcc

SEQ ID NO: 395124 - DNA, 16 bp, M. musculus
ctctgtccctctgttt

SEQ ID NO: 395125 - DNA, 16 bp, M. musculus
ctctgtcctcacagag

SEQ ID NO: 395126 - DNA, 16 bp, M. musculus
ctctgtcctctgcctc

SEQ ID NO: 395127 - DNA, 16 bp, M. musculus
ctctgtcctctgtggg

SEQ ID NO: 395128 - DNA, 16 bp, M. musculus
ctctgtccttctgtcc

SEQ ID NO: 395129 - DNA, 16 bp, M. musculus
ctctgtcctttgcctc

SEQ ID NO: 395130 - DNA, 16 bp, M. musculus
ctctgtctagccctgg

SEQ ID NO: 395131 - DNA, 16 bp, M. musculus
ctctgtctcaaaaaac

SEQ ID NO: 395132 - DNA, 16 bp, M. musculus
ctctgtctcagagaaa

SEQ ID NO: 395133 - DNA, 16 bp, M. musculus
ctctgtctccagagtg

SEQ ID NO: 395134 - DNA, 16 bp, M. musculus
ctctgtctcccaagtt

SEQ ID NO: 395135 - DNA, 16 bp, M. musculus
ctctgtctccctagtg

SEQ ID NO: 395136 - DNA, 16 bp, M. musculus
ctctgtctccgtctcc

SEQ ID NO: 395137 - DNA, 16 bp, M. musculus
ctctgtctcctgggat

SEQ ID NO: 395138 - DNA, 16 bp, M. musculus
ctctgtctcctgtggg

SEQ ID NO: 395139 - DNA, 16 bp, M. musculus
ctctgtctcctgtgtg

SEQ ID NO: 395140 - DNA, 16 bp, M. musculus
ctctgtctctatctct

SEQ ID NO: 395141 - DNA, 16 bp, M. musculus
ctctgtctctgccact

SEQ ID NO: 395142 - DNA, 16 bp, M. musculus
ctctgtctctgcctct

SEQ ID NO: 395143 - DNA, 16 bp, M. musculus
ctctgtctctgctctg

SEQ ID NO: 395144 - DNA, 16 bp, M. musculus
ctctgtctctgtcccc

SEQ ID NO: 395145 - DNA, 16 bp, M. musculus
ctctgtctctgtccct

SEQ ID NO: 395146 - DNA, 16 bp, M. musculus
ctctgtctctgtctcc

SEQ ID NO: 395147 - DNA, 16 bp, M. musculus
ctctgtctctgtgtcc

SEQ ID NO: 395148 - DNA, 16 bp, M. musculus
ctctgtctctgtgtct

SEQ ID NO: 395149 - DNA, 16 bp, M. musculus
ctctgtctcttacaat

SEQ ID NO: 395150 - DNA, 16 bp, M. musculus
ctctgtctcttctcca

SEQ ID NO: 395151 - DNA, 16 bp, M. musculus
ctctgtctgcatcagc

SEQ ID NO: 395152 - DNA, 16 bp, M. musculus
ctctgtctggagcctg

SEQ ID NO: 395153 - DNA, 16 bp, M. musculus
ctctgtctgtctatgt

SEQ ID NO: 395154 - DNA, 16 bp, M. musculus
ctctgtctgtctccct

SEQ ID NO: 395155 - DNA, 16 bp, M. musculus
ctctgtctgtctctcc

SEQ ID NO: 395156 - DNA, 16 bp, M. musculus
ctctgtctgtctctgt

SEQ ID NO: 395157 - DNA, 16 bp, M. musculus
ctctgtctgtctgcct

SEQ ID NO: 395158 - DNA, 16 bp, M. musculus
ctctgtcttaaaaata

SEQ ID NO: 395159 - DNA, 16 bp, M. musculus
ctctgtcttcctgtct

SEQ ID NO: 395160 - DNA, 16 bp, M. musculus
ctctgtcttctgaatg

SEQ ID NO: 395161 - DNA, 16 bp, M. musculus
ctctgtcttgaaaaga

SEQ ID NO: 395162 - DNA, 16 bp, M. musculus
ctctgtcttgctctgt

SEQ ID NO: 395163 - DNA, 16 bp, M. musculus
ctctgtctttgttccc

SEQ ID NO: 395164 - DNA, 16 bp, M. musculus
ctctgtgaaccaggct

SEQ ID NO: 395165 - DNA, 16 bp, M. musculus
ctctgtgaacccctat

SEQ ID NO: 395166 - DNA, 16 bp, M. musculus
ctctgtgaagctaggc

SEQ ID NO: 395167 - DNA, 16 bp, M. musculus
ctctgtgaagctctgg

SEQ ID NO: 395168 - DNA, 16 bp, M. musculus
ctctgtgaatttgaag

SEQ ID NO: 395169 - DNA, 16 bp, M. musculus
ctctgtgaatttgaga

SEQ ID NO: 395170 - DNA, 16 bp, M. musculus
ctctgtgagatgttgt

SEQ ID NO: 395171 - DNA, 16 bp, M. musculus
ctctgtgagcttgaag

SEQ ID NO: 395172 - DNA, 16 bp, M. musculus
ctctgtgagtccctgt

SEQ ID NO: 395173 - DNA, 16 bp, M. musculus
ctctgtgagttcgagg

SEQ ID NO: 395174 - DNA, 16 bp, M. musculus
ctctgtgagtttgtgg

SEQ ID NO: 395175 - DNA, 16 bp, M. musculus
ctctgtgatttcttta

SEQ ID NO: 395176 - DNA, 16 bp, M. musculus
ctctgtgcccaggtga

SEQ ID NO: 395177 - DNA, 16 bp, M. musculus
ctctgtgccctctggt

SEQ ID NO: 395178 - DNA, 16 bp, M. musculus
ctctgtgcctcatttt

SEQ ID NO: 395179 - DNA, 16 bp, M. musculus
ctctgtgcctctctct

SEQ ID NO: 395180 - DNA, 16 bp, M. musculus
ctctgtgcctctctgt

SEQ ID NO: 395181 - DNA, 16 bp, M. musculus
ctctgtgcctctgtgt

SEQ ID NO: 395182 - DNA, 16 bp, M. musculus
ctctgtgcctgcctct

SEQ ID NO: 395183 - DNA, 16 bp, M. musculus
ctctgtgccttggttt

SEQ ID NO: 395184 - DNA, 16 bp, M. musculus
ctctgtgcctttctct

SEQ ID NO: 395185 - DNA, 16 bp, M. musculus
ctctgtgctcccagcc

SEQ ID NO: 395186 - DNA, 16 bp, M. musculus
ctctgtgctctctgct

SEQ ID NO: 395187 - DNA, 16 bp, M. musculus
ctctgtgcttcagttt

SEQ ID NO: 395188 - DNA, 16 bp, M. musculus
ctctgtgcttccacct

SEQ ID NO: 395189 - DNA, 16 bp, M. musculus
ctctgtgcttctctct

SEQ ID NO: 395190 - DNA, 16 bp, M. musculus
ctctgtgcttctgttt

SEQ ID NO: 395191 - DNA, 16 bp, M. musculus
ctctgtggacagcagc

SEQ ID NO: 395192 - DNA, 16 bp, M. musculus
ctctgtggccctggct

SEQ ID NO: 395193 - DNA, 16 bp, M. musculus
ctctgtggctccctcc

SEQ ID NO: 395194 - DNA, 16 bp, M. musculus
ctctgtggctgctgga

SEQ ID NO: 395195 - DNA, 16 bp, M. musculus
ctctgtggcttgctca

SEQ ID NO: 395196 - DNA, 16 bp, M. musculus
ctctgtgggatgttgt

SEQ ID NO: 395197 - DNA, 16 bp, M. musculus
ctctgtggggtgtgtg

SEQ ID NO: 395198 - DNA, 16 bp, M. musculus
ctctgtgggtgctggg

SEQ ID NO: 395199 - DNA, 16 bp, M. musculus
ctctgtggtctttgtg

SEQ ID NO: 395200 - DNA, 16 bp, M. musculus
ctctgtggtgatctga

SEQ ID NO: 395201 - DNA, 16 bp, M. musculus
ctctgtgtaactctga

SEQ ID NO: 395202 - DNA, 16 bp, M. musculus
ctctgtgtagactagg

SEQ ID NO: 395203 - DNA, 16 bp, M. musculus
ctctgtgtagccctcc

SEQ ID NO: 395204 - DNA, 16 bp, M. musculus
ctctgtgtatatctct

SEQ ID NO: 395205 - DNA, 16 bp, M. musculus
ctctgtgtccctctct

SEQ ID NO: 395206 - DNA, 16 bp, M. musculus
ctctgtgtccctgtct

SEQ ID NO: 395207 - DNA, 16 bp, M. musculus
ctctgtgtcctgctct

SEQ ID NO: 395208 - DNA, 16 bp, M. musculus
ctctgtgtcctgtgtc

SEQ ID NO: 395209 - DNA, 16 bp, M. musculus
ctctgtgtctccctgg

SEQ ID NO: 395210 - DNA, 16 bp, M. musculus
ctctgtgtctctcccc

SEQ ID NO: 395211 - DNA, 16 bp, M. musculus
ctctgtgtctctgtcc

SEQ ID NO: 395212 - DNA, 16 bp, M. musculus
ctctgtgtctctgtct

SEQ ID NO: 395213 - DNA, 16 bp, M. musculus
ctctgtgtctcttctc

SEQ ID NO: 395214 - DNA, 16 bp, M. musculus
ctctgtgtctgtatgt

SEQ ID NO: 395215 - DNA, 16 bp, M. musculus
ctctgtgtctgtctcc

SEQ ID NO: 395216 - DNA, 16 bp, M. musculus
ctctgtgtctgtcttt

SEQ ID NO: 395217 - DNA, 16 bp, M. musculus
ctctgtgtgagtgtgt

SEQ ID NO: 395218 - DNA, 16 bp, M. musculus
ctctgtgtgcgtgtgt

SEQ ID NO: 395219 - DNA, 16 bp, M. musculus
ctctgtgtggccctgg

SEQ ID NO: 395220 - DNA, 16 bp, M. musculus
ctctgtgtggttattg

SEQ ID NO: 395221 - DNA, 16 bp, M. musculus
ctctgtgtgtccctgg

SEQ ID NO: 395222 - DNA, 16 bp, M. musculus
ctctgtgtgtctctgg

SEQ ID NO: 395223 - DNA, 16 bp, M. musculus
ctctgtgtgtctgtct

SEQ ID NO: 395224 - DNA, 16 bp, M. musculus
ctctgtgtgtctgtgt

SEQ ID NO: 395225 - DNA, 16 bp, M. musculus
ctctgtgtgtgtgcgt

SEQ ID NO: 395226 - DNA, 16 bp, M. musculus
ctctgtgtgtgtgtct

SEQ ID NO: 395227 - DNA, 16 bp, M. musculus
ctctgtgtgtgtgtgg

SEQ ID NO: 395228 - DNA, 16 bp, M. musculus
ctctgtgtgttcaagg

SEQ ID NO: 395229 - DNA, 16 bp, M. musculus
ctctgtgttcagtgag

SEQ ID NO: 395230 - DNA, 16 bp, M. musculus
ctctgtgttgtcctgg

SEQ ID NO: 395231 - DNA, 16 bp, M. musculus
ctctgtgtttctgtct

SEQ ID NO: 395232 - DNA, 16 bp, M. musculus
ctctgtgtttgtaagg

SEQ ID NO: 395233 - DNA, 16 bp, M. musculus
ctctgttcaagtaaat

SEQ ID NO: 395234 - DNA, 16 bp, M. musculus
ctctgttccactcacc

SEQ ID NO: 395235 - DNA, 16 bp, M. musculus
ctctgttccatttttt

SEQ ID NO: 395236 - DNA, 16 bp, M. musculus
ctctgttcctcttcaa

SEQ ID NO: 395237 - DNA, 16 bp, M. musculus
ctctgttcctgctggc

SEQ ID NO: 395238 - DNA, 16 bp, M. musculus
ctctgttgaagaacat

SEQ ID NO: 395239 - DNA, 16 bp, M. musculus
ctctgttgaccaggtt

SEQ ID NO: 395240 - DNA, 16 bp, M. musculus
ctctgttgaggacatc

SEQ ID NO: 395241 - DNA, 16 bp, M. musculus
ctctgttgagggaaat

SEQ ID NO: 395242 - DNA, 16 bp, M. musculus
ctctgttgagggacct

SEQ ID NO: 395243 - DNA, 16 bp, M. musculus
ctctgttgcttctgtt

SEQ ID NO: 395244 - DNA, 16 bp, M. musculus
ctctgttggtcttctg

SEQ ID NO: 395245 - DNA, 16 bp, M. musculus
ctctgtttccagtgat

SEQ ID NO: 395246 - DNA, 16 bp, M. musculus
ctctgtttcccaagtg

SEQ ID NO: 395247 - DNA, 16 bp, M. musculus
ctctgtttcctgagtg

SEQ ID NO: 395248 - DNA, 16 bp, M. musculus
ctctgtttcctgtctg

SEQ ID NO: 395249 - DNA, 16 bp, M. musculus
ctctgtttctatttct

SEQ ID NO: 395250 - DNA, 16 bp, M. musculus
ctctgtttctgcctct

SEQ ID NO: 395251 - DNA, 16 bp, M. musculus
ctcttaaaatatttct

SEQ ID NO: 395252 - DNA, 16 bp, M. musculus
ctcttaaactctgagc

SEQ ID NO: 395253 - DNA, 16 bp, M. musculus
ctcttaaatgttgagc

SEQ ID NO: 395254 - DNA, 16 bp, M. musculus
ctcttaacactgcttt

SEQ ID NO: 395255 - DNA, 16 bp, M. musculus
ctcttaaccgctgagc

SEQ ID NO: 395256 - DNA, 16 bp, M. musculus
ctcttaacctcagagc

SEQ ID NO: 395257 - DNA, 16 bp, M. musculus
ctcttaactccaactg

SEQ ID NO: 395258 - DNA, 16 bp, M. musculus
ctcttaactgatgagc

SEQ ID NO: 395259 - DNA, 16 bp, M. musculus
ctcttaatcactgaac

SEQ ID NO: 395260 - DNA, 16 bp, M. musculus
ctcttacactaataag

SEQ ID NO: 395261 - DNA, 16 bp, M. musculus
ctcttaccactgtttt

SEQ ID NO: 395262 - DNA, 16 bp, M. musculus
ctcttactatgtagcc

SEQ ID NO: 395263 - DNA, 16 bp, M. musculus
ctcttactctctgcac

SEQ ID NO: 395264 - DNA, 16 bp, M. musculus
ctcttagaaatgcatt

SEQ ID NO: 395265 - DNA, 16 bp, M. musculus
ctcttagaatctttct

SEQ ID NO: 395266 - DNA, 16 bp, M. musculus
ctcttagagtctgcaa

SEQ ID NO: 395267 - DNA, 16 bp, M. musculus
ctcttagcacagcttt

SEQ ID NO: 395268 - DNA, 16 bp, M. musculus
ctcttagctacttctc

SEQ ID NO: 395269 - DNA, 16 bp, M. musculus
ctcttagctctgcttt

SEQ ID NO: 395270 - DNA, 16 bp, M. musculus
ctcttataaaggaaaa

SEQ ID NO: 395271 - DNA, 16 bp, M. musculus
ctcttataaagggcaa

SEQ ID NO: 395272 - DNA, 16 bp, M. musculus
ctcttatagggaaggt

SEQ ID NO: 395273 - DNA, 16 bp, M. musculus
ctcttatgcttttgct

SEQ ID NO: 395274 - DNA, 16 bp, M. musculus
ctcttattctctgccc

SEQ ID NO: 395275 - DNA, 16 bp, M. musculus
ctcttcaaattcctgg

SEQ ID NO: 395276 - DNA, 16 bp, M. musculus
ctcttcaagaggacct

SEQ ID NO: 395277 - DNA, 16 bp, M. musculus
ctcttcacagcaagaa

SEQ ID NO: 395278 - DNA, 16 bp, M. musculus
ctcttcacagcaatgg

SEQ ID NO: 395279 - DNA, 17 bp, M. musculus
ctcttcacctctgcaat

SEQ ID NO: 395280 - DNA, 16 bp, M. musculus
ctcttcagaaagacca

SEQ ID NO: 395281 - DNA, 16 bp, M. musculus
ctcttcagagcaatgg

SEQ ID NO: 395282 - DNA, 16 bp, M. musculus
ctcttcagaggaccca

SEQ ID NO: 395283 - DNA, 16 bp, M. musculus
ctcttcagatctccag

SEQ ID NO: 395284 - DNA, 16 bp, M. musculus
ctcttcagctcctctt

SEQ ID NO: 395285 - DNA, 16 bp, M. musculus
ctcttcagggactcca

SEQ ID NO: 395286 - DNA, 16 bp, M. musculus
ctcttcatctacctga

SEQ ID NO: 395287 - DNA, 16 bp, M. musculus
ctcttcatctttcagc

SEQ ID NO: 395288 - DNA, 16 bp, M. musculus
ctcttcattgtcagga

SEQ ID NO: 395289 - DNA, 16 bp, M. musculus
ctcttccaaaatgact

SEQ ID NO: 395290 - DNA, 16 bp, M. musculus
ctcttccaaaattgac

SEQ ID NO: 395291 - DNA, 16 bp, M. musculus
ctcttccactacctct

SEQ ID NO: 395292 - DNA, 16 bp, M. musculus
ctcttccagaagactc

SEQ ID NO: 395293 - DNA, 16 bp, M. musculus
ctcttccagagaagcc

SEQ ID NO: 395294 - DNA, 16 bp, M. musculus
ctcttccagaggatgc

SEQ ID NO: 395295 - DNA, 16 bp, M. musculus
ctcttccagctcttgt

SEQ ID NO: 395296 - DNA, 16 bp, M. musculus
ctcttccagcttttcc

SEQ ID NO: 395297 - DNA, 16 bp, M. musculus
ctcttccatctcatgt

SEQ ID NO: 395298 - DNA, 16 bp, M. musculus
ctcttcccagaggtcc

SEQ ID NO: 395299 - DNA, 16 bp, M. musculus
ctcttcccagatccac

SEQ ID NO: 395300 - DNA, 16 bp, M. musculus
ctcttcccagtcccac

SEQ ID NO: 395301 - DNA, 16 bp, M. musculus
ctcttcccagtgatag

SEQ ID NO: 395302 - DNA, 16 bp, M. musculus
ctcttcccagttccat

SEQ ID NO: 395303 - DNA, 16 bp, M. musculus
ctcttccccagatcca

SEQ ID NO: 395304 - DNA, 16 bp, M. musculus
ctcttccccagcagcc

SEQ ID NO: 395305 - DNA, 16 bp, M. musculus
ctcttccccagcagct

SEQ ID NO: 395306 - DNA, 16 bp, M. musculus
ctcttccccctgctca

SEQ ID NO: 395307 - DNA, 16 bp, M. musculus
ctcttcccttcagctt

SEQ ID NO: 395308 - DNA, 16 bp, M. musculus
ctcttccgaaagtccg

SEQ ID NO: 395309 - DNA, 16 bp, M. musculus
ctcttcctcagtttct

SEQ ID NO: 395310 - DNA, 16 bp, M. musculus
ctcttcctcctgaatg

SEQ ID NO: 395311 - DNA, 16 bp, M. musculus
ctcttcctcctggctg

SEQ ID NO: 395312 - DNA, 16 bp, M. musculus
ctcttcctcctgggac

SEQ ID NO: 395313 - DNA, 16 bp, M. musculus
ctcttcctctcaagtg

SEQ ID NO: 395314 - DNA, 16 bp, M. musculus
ctcttcctgcaccatg

SEQ ID NO: 395315 - DNA, 16 bp, M. musculus
ctcttcctgcctcagc

SEQ ID NO: 395316 - DNA, 16 bp, M. musculus
ctcttcctgcctccat

SEQ ID NO: 395317 - DNA, 16 bp, M. musculus
ctcttcctgcctctgc

SEQ ID NO: 395318 - DNA, 16 bp, M. musculus
ctcttcctgctgcctg

SEQ ID NO: 395319 - DNA, 16 bp, M. musculus
ctcttcctggagatgc

SEQ ID NO: 395320 - DNA, 16 bp, M. musculus
ctcttcctggctgcct

SEQ ID NO: 395321 - DNA, 16 bp, M. musculus
ctcttccttctgcctg

SEQ ID NO: 395322 - DNA, 16 bp, M. musculus
ctcttctcaaatgact

SEQ ID NO: 395323 - DNA, 16 bp, M. musculus
ctcttctcaatgataa

SEQ ID NO: 395324 - DNA, 16 bp, M. musculus
ctcttctcagagaaga

SEQ ID NO: 395325 - DNA, 16 bp, M. musculus
ctcttctcagtgatgg

SEQ ID NO: 395326 - DNA, 16 bp, M. musculus
ctcttctcatgagagt

SEQ ID NO: 395327 - DNA, 16 bp, M. musculus
ctcttctccaattttg

SEQ ID NO: 395328 - DNA, 16 bp, M. musculus
ctcttctccagttttg

SEQ ID NO: 395329 - DNA, 16 bp, M. musculus
ctcttctccatctctg

SEQ ID NO: 395330 - DNA, 16 bp, M. musculus
ctcttctcctttgaga

SEQ ID NO: 395331 - DNA, 16 bp, M. musculus
ctcttctctgaggaga

SEQ ID NO: 395332 - DNA, 16 bp, M. musculus
ctcttctctgtctgtc

SEQ ID NO: 395333 - DNA, 16 bp, M. musculus
ctcttctgacctcagc

SEQ ID NO: 395334 - DNA, 16 bp, M. musculus
ctcttctgagctctgt

SEQ ID NO: 395335 - DNA, 16 bp, M. musculus
ctcttctgcagtgtct

SEQ ID NO: 395336 - DNA, 16 bp, M. musculus
ctcttctgccatgcag

SEQ ID NO: 395337 - DNA, 16 bp, M. musculus
ctcttctgccctccac

SEQ ID NO: 395338 - DNA, 16 bp, M. musculus
ctcttctgcctcagtg

SEQ ID NO: 395339 - DNA, 16 bp, M. musculus
ctcttctggacagcta

SEQ ID NO: 395340 - DNA, 16 bp, M. musculus
ctcttctggactccat

SEQ ID NO: 395341 - DNA, 16 bp, M. musculus
ctcttctggactctgc

SEQ ID NO: 395342 - DNA, 16 bp, M. musculus
ctcttctggagggtct

SEQ ID NO: 395343 - DNA, 16 bp, M. musculus
ctcttctggcacacag

SEQ ID NO: 395344 - DNA, 16 bp, M. musculus
ctcttctggcccccaa

SEQ ID NO: 395345 - DNA, 16 bp, M. musculus
ctcttctggcccccat

SEQ ID NO: 395346 - DNA, 16 bp, M. musculus
ctcttctggcccctga

SEQ ID NO: 395347 - DNA, 16 bp, M. musculus
ctcttctggcctctga

SEQ ID NO: 395348 - DNA, 16 bp, M. musculus
ctcttctggccttcag

SEQ ID NO: 395349 - DNA, 16 bp, M. musculus
ctcttctggcctttga

SEQ ID NO: 395350 - DNA, 16 bp, M. musculus
ctcttctggcctttgt

SEQ ID NO: 395351 - DNA, 16 bp, M. musculus
ctcttctggcttttgc

SEQ ID NO: 395352 - DNA, 16 bp, M. musculus
ctcttctggtctgtct

SEQ ID NO: 395353 - DNA, 16 bp, M. musculus
ctcttctggtgtacat

SEQ ID NO: 395354 - DNA, 16 bp, M. musculus
ctcttctggtgtgtca

SEQ ID NO: 395355 - DNA, 16 bp, M. musculus
ctcttctgtagtgtct

SEQ ID NO: 395356 - DNA, 16 bp, M. musculus
ctcttctgtcctccac

SEQ ID NO: 395357 - DNA, 16 bp, M. musculus
ctcttctgtcctctgt

SEQ ID NO: 395358 - DNA, 16 bp, M. musculus
ctcttctgtcttccat

SEQ ID NO: 395359 - DNA, 16 bp, M. musculus
ctcttctgtgtgtctg

SEQ ID NO: 395360 - DNA, 16 bp, M. musculus
ctcttctgttgctgtg

SEQ ID NO: 395361 - DNA, 17 bp, M. musculus
ctcttcttcgcctgctt

SEQ ID NO: 395362 - DNA, 16 bp, M. musculus
ctcttcttgcctctgt

SEQ ID NO: 395363 - DNA, 16 bp, M. musculus
ctcttcttgggtgaat

SEQ ID NO: 395364 - DNA, 16 bp, M. musculus
ctcttcttgggtgtgt

SEQ ID NO: 395365 - DNA, 16 bp, M. musculus
ctcttctttcagagga

SEQ ID NO: 395366 - DNA, 34 bp, M. musculus
ctcttgaaaacgccaattcagcatgtagggctgc

SEQ ID NO: 395367 - DNA, 16 bp, M. musculus
ctcttgaacaaaagga

SEQ ID NO: 395368 - DNA, 16 bp, M. musculus
ctcttgaagaagacct

SEQ ID NO: 395369 - DNA, 21 bp, M. musculus
ctcttgaataccatcaataaa

SEQ ID NO: 395370 - DNA, 16 bp, M. musculus
ctcttgagctggatcc

SEQ ID NO: 395371 - DNA, 16 bp, M. musculus
ctcttgaggccctgag

SEQ ID NO: 395372 - DNA, 16 bp, M. musculus
ctcttgagggacatct

SEQ ID NO: 395373 - DNA, 16 bp, M. musculus
ctcttgagtactagga

SEQ ID NO: 395374 - DNA, 16 bp, M. musculus
ctcttgagtactggga

SEQ ID NO: 395375 - DNA, 16 bp, M. musculus
ctcttgagtctagctg

SEQ ID NO: 395376 - DNA, 16 bp, M. musculus
ctcttgagtgttaggt

SEQ ID NO: 395377 - DNA, 16 bp, M. musculus
ctcttgcaaaggactc

SEQ ID NO: 395378 - DNA, 18 bp, M. musculus
ctcttgcactccacggca

SEQ ID NO: 395379 - DNA, 16 bp, M. musculus
ctcttgcagaagatcc

SEQ ID NO: 395380 - DNA, 16 bp, M. musculus
ctcttgcagaggacat

SEQ ID NO: 395381 - DNA, 16 bp, M. musculus
ctcttgcagagggctg

SEQ ID NO: 395382 - DNA, 16 bp, M. musculus
ctcttgcccactgagc

SEQ ID NO: 395383 - DNA, 16 bp, M. musculus
ctcttgcctcagcctc

SEQ ID NO: 395384 - DNA, 16 bp, M. musculus
ctcttgcctcagcttc

SEQ ID NO: 395385 - DNA, 16 bp, M. musculus
ctcttgcctcaggctc

SEQ ID NO: 395386 - DNA, 16 bp, M. musculus
ctcttgcctctgcctc

SEQ ID NO: 395387 - DNA, 16 bp, M. musculus
ctcttgcctcttgcct

SEQ ID NO: 395388 - DNA, 16 bp, M. musculus
ctcttgcctgcctttg

SEQ ID NO: 395389 - DNA, 16 bp, M. musculus
ctcttgcctgtgtgct

SEQ ID NO: 395390 - DNA, 16 bp, M. musculus
ctcttgccttcctgct

SEQ ID NO: 395391 - DNA, 16 bp, M. musculus
ctcttgctccaggcct

SEQ ID NO: 395392 - DNA, 16 bp, M. musculus
ctcttgctcctccatt

SEQ ID NO: 395393 - DNA, 16 bp, M. musculus
ctcttgctcctgctcc

SEQ ID NO: 395394 - DNA, 16 bp, M. musculus
ctcttgctctctcttg

SEQ ID NO: 395395 - DNA, 16 bp, M. musculus
ctcttgctctcttgct

SEQ ID NO: 395396 - DNA, 16 bp, M. musculus
ctcttgctctgggatc

SEQ ID NO: 395397 - DNA, 16 bp, M. musculus
ctcttgctcttgctct

SEQ ID NO: 395398 - DNA, 16 bp, M. musculus
ctcttgctgatgctca

SEQ ID NO: 395399 - DNA, 16 bp, M. musculus
ctcttgctgtcttcag

SEQ ID NO: 395400 - DNA, 16 bp, M. musculus
ctcttgcttctgctta

SEQ ID NO: 395401 - DNA, 16 bp, M. musculus
ctcttgcttctggctc

SEQ ID NO: 395402 - DNA, 18 bp, M. musculus
ctcttgcttcttgcactc

SEQ ID NO: 395403 - DNA, 16 bp, M. musculus
ctcttggagaagatga

SEQ ID NO: 395404 - DNA, 16 bp, M. musculus
ctcttggagacagggg

SEQ ID NO: 395405 - DNA, 16 bp, M. musculus
ctcttggagtttttca

SEQ ID NO: 395406 - DNA, 16 bp, M. musculus
ctcttggctcttccag

SEQ ID NO: 395407 - DNA, 16 bp, M. musculus
ctcttgggccaggtct

SEQ ID NO: 395408 - DNA, 16 bp, M. musculus
ctcttggggctggaga

SEQ ID NO: 395409 - DNA, 16 bp, M. musculus
ctcttggggtactggt

SEQ ID NO: 395410 - DNA, 16 bp, M. musculus
ctcttgggtgaaattg

SEQ ID NO: 395411 - DNA, 16 bp, M. musculus
ctcttgggtgaattta

SEQ ID NO: 395412 - DNA, 16 bp, M. musculus
ctcttggtggattttc

SEQ ID NO: 395413 - DNA, 16 bp, M. musculus
ctcttggttgatttca

SEQ ID NO: 395414 - DNA, 16 bp, M. musculus
ctcttgtattctgttc

SEQ ID NO: 395415 - DNA, 16 bp, M. musculus
ctcttgtgattgcttt

SEQ ID NO: 395416 - DNA, 16 bp, M. musculus
ctcttgtgcaccttga

SEQ ID NO: 395417 - DNA, 16 bp, M. musculus
ctcttgtgcactgtgt

SEQ ID NO: 395418 - DNA, 16 bp, M. musculus
ctctttaagctgcttg

SEQ ID NO: 395419 - DNA, 16 bp, M. musculus
ctctttaatgtcttct

SEQ ID NO: 395420 - DNA, 18 bp, M. musculus
ctctttagcagtgttctt

SEQ ID NO: 395421 - DNA, 16 bp, M. musculus
ctctttatcctcagca

SEQ ID NO: 395422 - DNA, 16 bp, M. musculus
ctctttatctgtctct

SEQ ID NO: 395423 - DNA, 16 bp, M. musculus
ctctttattaaagcat

SEQ ID NO: 395424 - DNA, 16 bp, M. musculus
ctctttcacatacaca

SEQ ID NO: 395425 - DNA, 16 bp, M. musculus
ctctttcaccatcagg

SEQ ID NO: 395426 - DNA, 22 bp, M. musculus
ctctttcagctaaaacatctgg

SEQ ID NO: 395427 - DNA, 16 bp, M. musculus
ctctttcagctccttg

SEQ ID NO: 395428 - DNA, 17 bp, M. musculus
ctctttcagggaaggtg

SEQ ID NO: 395429 - DNA, 16 bp, M. musculus
ctctttcagtcctttc

SEQ ID NO: 395430 - DNA, 16 bp, M. musculus
ctctttccacatggcc

SEQ ID NO: 395431 - DNA, 16 bp, M. musculus
ctctttccactgtggg

SEQ ID NO: 395432 - DNA, 16 bp, M. musculus
ctctttccatgtggcc

SEQ ID NO: 395433 - DNA, 16 bp, M. musculus
ctctttccatttttgt

SEQ ID NO: 395434 - DNA, 16 bp, M. musculus
ctctttcccactgtct

SEQ ID NO: 395435 - DNA, 16 bp, M. musculus
ctctttcccctcgagg

SEQ ID NO: 395436 - DNA, 16 bp, M. musculus
ctctttcctcccaagt

SEQ ID NO: 395437 - DNA, 16 bp, M. musculus
ctctttcctctccaaa

SEQ ID NO: 395438 - DNA, 16 bp, M. musculus
ctctttccttgttggg

SEQ ID NO: 395439 - DNA, 16 bp, M. musculus
ctctttctagtgatgg

SEQ ID NO: 395440 - DNA, 16 bp, M. musculus
ctctttctcacataca

SEQ ID NO: 395441 - DNA, 16 bp, M. musculus
ctctttctcagtctct

SEQ ID NO: 395442 - DNA, 16 bp, M. musculus
ctctttctccacaacc

SEQ ID NO: 395443 - DNA, 16 bp, M. musculus
ctctttctccacatcc

SEQ ID NO: 395444 - DNA, 16 bp, M. musculus
ctctttctctgtatgt

SEQ ID NO: 395445 - DNA, 16 bp, M. musculus
ctctttctctgtattt

SEQ ID NO: 395446 - DNA, 16 bp, M. musculus
ctctttctgaattctg

SEQ ID NO: 395447 - DNA, 16 bp, M. musculus
ctctttctgctgcttg

SEQ ID NO: 395448 - DNA, 16 bp, M. musculus
ctctttctgcttcctg

SEQ ID NO: 395449 - DNA, 16 bp, M. musculus
ctctttgaaaggatta

SEQ ID NO: 395450 - DNA, 16 bp, M. musculus
ctctttgcaacagatg

SEQ ID NO: 395451 - DNA, 16 bp, M. musculus
ctctttgcactgatgg

SEQ ID NO: 395452 - DNA, 16 bp, M. musculus
ctctttgcctgagaaa

SEQ ID NO: 395453 - DNA, 16 bp, M. musculus
ctctttgcctgtttgc

SEQ ID NO: 395454 - DNA, 16 bp, M. musculus
ctctttgcttggtctt

SEQ ID NO: 395455 - DNA, 16 bp, M. musculus
ctctttgcttttgcat

SEQ ID NO: 395456 - DNA, 16 bp, M. musculus
ctctttggcctctgtg

SEQ ID NO: 395457 - DNA, 16 bp, M. musculus
ctctttgggaccttgc

SEQ ID NO: 395458 - DNA, 16 bp, M. musculus
ctctttgggggtcaaa

SEQ ID NO: 395459 - DNA, 16 bp, M. musculus
ctctttggtggtggtt

SEQ ID NO: 395460 - DNA, 16 bp, M. musculus
ctctttggttggtaat

SEQ ID NO: 395461 - DNA, 16 bp, M. musculus
ctctttgtatctctct

SEQ ID NO: 395462 - DNA, 16 bp, M. musculus
ctctttgtctctgtgt

SEQ ID NO: 395463 - DNA, 16 bp, M. musculus
ctctttgtgtagcctt

SEQ ID NO: 395464 - DNA, 16 bp, M. musculus
ctctttgttttattga

SEQ ID NO: 395465 - DNA, 16 bp, M. musculus
ctcttttcagagccac

SEQ ID NO: 395466 - DNA, 16 bp, M. musculus
ctcttttcagagccat

SEQ ID NO: 395467 - DNA, 16 bp, M. musculus
ctcttttgagattcat

SEQ ID NO: 395468 - DNA, 16 bp, M. musculus
ctcttttgatgacttt

SEQ ID NO: 395469 - DNA, 16 bp, M. musculus
ctcttttggcctcctt

SEQ ID NO: 395470 - DNA, 16 bp, M. musculus
ctctttttaaaaaaaa

SEQ ID NO: 395471 - DNA, 16 bp, M. musculus
ctctttttaaaagttt

SEQ ID NO: 395472 - DNA, 16 bp, M. musculus
ctctttttaattaaaa

SEQ ID NO: 395473 - DNA, 16 bp, M. musculus
ctctttttattattga

SEQ ID NO: 395474 - DNA, 16 bp, M. musculus
ctctttttgcagtgat

SEQ ID NO: 395475 - DNA, 16 bp, M. musculus
ctctttttttttaaag

SEQ ID NO: 395476 - DNA, 16 bp, M. musculus
ctgaaaaaaaaaatgg

SEQ ID NO: 395477 - DNA, 16 bp, M. musculus
ctgaaaaaaaaaatgt

SEQ ID NO: 395478 - DNA, 16 bp, M. musculus
ctgaaaaaaaatttaa

SEQ ID NO: 395479 - DNA, 16 bp, M. musculus
ctgaaaaagctgaagg

SEQ ID NO: 395480 - DNA, 16 bp, M. musculus
ctgaaaacaacaacaa

SEQ ID NO: 395481 - DNA, 16 bp, M. musculus
ctgaaaaccaaaacca

SEQ ID NO: 395482 - DNA, 16 bp, M. musculus
ctgaaaaccagctggg

SEQ ID NO: 395483 - DNA, 16 bp, M. musculus
ctgaaaactatgggca

SEQ ID NO: 395484 - DNA, 16 bp, M. musculus
ctgaaaagaacaccaa

SEQ ID NO: 395485 - DNA, 16 bp, M. musculus
ctgaaaagatgctcca

SEQ ID NO: 395486 - DNA, 16 bp, M. musculus
ctgaaaagcttcttta

SEQ ID NO: 395487 - DNA, 16 bp, M. musculus
ctgaaaagtccccaga

SEQ ID NO: 395488 - DNA, 16 bp, M. musculus
ctgaaaagtttggggg

SEQ ID NO: 395489 - DNA, 16 bp, M. musculus
ctgaaaatagaaatag

SEQ ID NO: 395490 - DNA, 16 bp, M. musculus
ctgaaaatcaggaagc

SEQ ID NO: 395491 - DNA, 16 bp, M. musculus
ctgaaaatgtaagcca

SEQ ID NO: 395492 - DNA, 16 bp, M. musculus
ctgaaacaaaagaata

SEQ ID NO: 395493 - DNA, 16 bp, M. musculus
ctgaaacaaagccatg

SEQ ID NO: 395494 - DNA, 16 bp, M. musculus
ctgaaacaacaacaac

SEQ ID NO: 395495 - DNA, 16 bp, M. musculus
ctgaaacacagcctct

SEQ ID NO: 395496 - DNA, 16 bp, M. musculus
ctgaaacacccagaat

SEQ ID NO: 395497 - DNA, 16 bp, M. musculus
ctgaaacactggacca

SEQ ID NO: 395498 - DNA, 16 bp, M. musculus
ctgaaacagaaggaag

SEQ ID NO: 395499 - DNA, 16 bp, M. musculus
ctgaaacagggtctgc

SEQ ID NO: 395500 - DNA, 16 bp, M. musculus
ctgaaaccccaaagcc

SEQ ID NO: 395501 - DNA, 16 bp, M. musculus
ctgaaactataagtaa

SEQ ID NO: 395502 - DNA, 16 bp, M. musculus
ctgaaactccagtccc

SEQ ID NO: 395503 - DNA, 16 bp, M. musculus
ctgaaactgctgagga

SEQ ID NO: 395504 - DNA, 16 bp, M. musculus
ctgaaactgtaaccaa

SEQ ID NO: 395505 - DNA, 16 bp, M. musculus
ctgaaactgtatgcca

SEQ ID NO: 395506 - DNA, 16 bp, M. musculus
ctgaaactgtgaacca

SEQ ID NO: 395507 - DNA, 16 bp, M. musculus
ctgaaacttacagagg

SEQ ID NO: 395508 - DNA, 16 bp, M. musculus
ctgaaagaaaaaaatc

SEQ ID NO: 395509 - DNA, 16 bp, M. musculus
ctgaaagaaacccttt

SEQ ID NO: 395510 - DNA, 16 bp, M. musculus
ctgaaagaaagaaaga

SEQ ID NO: 395511 - DNA, 16 bp, M. musculus
ctgaaagaaagaagaa

SEQ ID NO: 395512 - DNA, 16 bp, M. musculus
ctgaaagaacagccag

SEQ ID NO: 395513 - DNA, 16 bp, M. musculus
ctgaaagaactgcaag

SEQ ID NO: 395514 - DNA, 16 bp, M. musculus
ctgaaagaattacaga

SEQ ID NO: 395515 - DNA, 16 bp, M. musculus
ctgaaagagagcacat

SEQ ID NO: 395516 - DNA, 16 bp, M. musculus
ctgaaagagcagctgg

SEQ ID NO: 395517 - DNA, 16 bp, M. musculus
ctgaaagaggagagat

SEQ ID NO: 395518 - DNA, 16 bp, M. musculus
ctgaaagatcctgaca

SEQ ID NO: 395519 - DNA, 16 bp, M. musculus
ctgaaagcaatctaca

SEQ ID NO: 395520 - DNA, 16 bp, M. musculus
ctgaaagccagcccca

SEQ ID NO: 395521 - DNA, 16 bp, M. musculus
ctgaaagggataggaa

SEQ ID NO: 395522 - DNA, 16 bp, M. musculus
ctgaaagggtcagatg

SEQ ID NO: 395523 - DNA, 16 bp, M. musculus
ctgaaagtatttatca

SEQ ID NO: 395524 - DNA, 16 bp, M. musculus
ctgaaagttagagctg

SEQ ID NO: 395525 - DNA, 16 bp, M. musculus
ctgaaagttgtcctct

SEQ ID NO: 395526 - DNA, 16 bp, M. musculus
ctgaaataaaatgaaa

SEQ ID NO: 395527 - DNA, 16 bp, M. musculus
ctgaaataaactcttt

SEQ ID NO: 395528 - DNA, 16 bp, M. musculus
ctgaaatcaataaaat

SEQ ID NO: 395529 - DNA, 16 bp, M. musculus
ctgaaatcccagaact

SEQ ID NO: 395530 - DNA, 16 bp, M. musculus
ctgaaatgaactacaa

SEQ ID NO: 395531 - DNA, 16 bp, M. musculus
ctgaaatggacacagg

SEQ ID NO: 395532 - DNA, 16 bp, M. musculus
ctgaaattataagcaa

SEQ ID NO: 395533 - DNA, 16 bp, M. musculus
ctgaaattattgtgtg

SEQ ID NO: 395534 - DNA, 16 bp, M. musculus
ctgaaattcaaattta

SEQ ID NO: 395535 - DNA, 16 bp, M. musculus
ctgaaattccacctca

SEQ ID NO: 395536 - DNA, 16 bp, M. musculus
ctgaaattccagcact

SEQ ID NO: 395537 - DNA, 16 bp, M. musculus
ctgaaattggagttgc

SEQ ID NO: 395538 - DNA, 16 bp, M. musculus
ctgaaatttctagaac

SEQ ID NO: 395539 - DNA, 16 bp, M. musculus
ctgaaattttattttt

SEQ ID NO: 395540 - DNA, 16 bp, M. musculus
ctgaaattttcatttt

SEQ ID NO: 395541 - DNA, 16 bp, M. musculus
ctgaacaactctcttc

SEQ ID NO: 395542 - DNA, 17 bp, M. musculus
ctgaacaagaagggttt

SEQ ID NO: 395543 - DNA, 16 bp, M. musculus
ctgaacaaggaaaatg

SEQ ID NO: 395544 - DNA, 16 bp, M. musculus
ctgaacacagagctca

SEQ ID NO: 395545 - DNA, 16 bp, M. musculus
ctgaacacagctacag

SEQ ID NO: 395546 - DNA, 16 bp, M. musculus
ctgaacacagggtccc

SEQ ID NO: 395547 - DNA, 16 bp, M. musculus
ctgaacagatacaaaa

SEQ ID NO: 395548 - DNA, 16 bp, M. musculus
ctgaacagatggctca

SEQ ID NO: 395549 - DNA, 16 bp, M. musculus
ctgaacatttttcagg

SEQ ID NO: 395550 - DNA, 16 bp, M. musculus
ctgaaccaggagctca

SEQ ID NO: 395551 - DNA, 16 bp, M. musculus
ctgaaccatcatctct

SEQ ID NO: 395552 - DNA, 16 bp, M. musculus
ctgaaccatctctcca

SEQ ID NO: 395553 - DNA, 16 bp, M. musculus
ctgaacccagagttca

SEQ ID NO: 395554 - DNA, 16 bp, M. musculus
ctgaacccaggtcctc

SEQ ID NO: 395555 - DNA, 16 bp, M. musculus
ctgaaccccaggaccc

SEQ ID NO: 395556 - DNA, 16 bp, M. musculus
ctgaaccccattttaa

SEQ ID NO: 395557 - DNA, 16 bp, M. musculus
ctgaacccctgaaact

SEQ ID NO: 395558 - DNA, 16 bp, M. musculus
ctgaacctctgagact

SEQ ID NO: 395559 - DNA, 16 bp, M. musculus
ctgaacctctggaaga

SEQ ID NO: 395560 - DNA, 16 bp, M. musculus
ctgaacctggaattca

SEQ ID NO: 395561 - DNA, 16 bp, M. musculus
ctgaacctgggacctc

SEQ ID NO: 395562 - DNA, 17 bp, M. musculus
ctgaacctgtaagccat

SEQ ID NO: 395563 - DNA, 16 bp, M. musculus
ctgaacctgttttcct

SEQ ID NO: 395564 - DNA, 16 bp, M. musculus
ctgaactacagcccca

SEQ ID NO: 395565 - DNA, 16 bp, M. musculus
ctgaactacatcccag

SEQ ID NO: 395566 - DNA, 16 bp, M. musculus
ctgaactaccaaccaa

SEQ ID NO: 395567 - DNA, 16 bp, M. musculus
ctgaactcaagctgta

SEQ ID NO: 395568 - DNA, 16 bp, M. musculus
ctgaactcaggacctc

SEQ ID NO: 395569 - DNA, 16 bp, M. musculus
ctgaactcaggtcctc

SEQ ID NO: 395570 - DNA, 16 bp, M. musculus
ctgaactctgttcctc

SEQ ID NO: 395571 - DNA, 16 bp, M. musculus
ctgaactggacttctg

SEQ ID NO: 395572 - DNA, 16 bp, M. musculus
ctgaactgggctgctg

SEQ ID NO: 395573 - DNA, 16 bp, M. musculus
ctgaactgtgagccag

SEQ ID NO: 395574 - DNA, 16 bp, M. musculus
ctgaacttataagcca

SEQ ID NO: 395575 - DNA, 16 bp, M. musculus
ctgaagaaaaaaatca

SEQ ID NO: 395576 - DNA, 16 bp, M. musculus
ctgaagaaaagagaaa

SEQ ID NO: 395577 - DNA, 16 bp, M. musculus
ctgaagaaaccacaag

SEQ ID NO: 395578 - DNA, 16 bp, M. musculus
ctgaagaaactgaagg

SEQ ID NO: 395579 - DNA, 16 bp, M. musculus
ctgaagaaactgcaag

SEQ ID NO: 395580 - DNA, 16 bp, M. musculus
ctgaagaaagaaagca

SEQ ID NO: 395581 - DNA, 16 bp, M. musculus
ctgaagaaagaaatca

SEQ ID NO: 395582 - DNA, 16 bp, M. musculus
ctgaagaaagaagtta

SEQ ID NO: 395583 - DNA, 16 bp, M. musculus
ctgaagaaatagaagc

SEQ ID NO: 395584 - DNA, 16 bp, M. musculus
ctgaagaaattaaaaa

SEQ ID NO: 395585 - DNA, 16 bp, M. musculus
ctgaagaaattgaaga

SEQ ID NO: 395586 - DNA, 16 bp, M. musculus
ctgaagaagaaacaga

SEQ ID NO: 395587 - DNA, 16 bp, M. musculus
ctgaagaagaaagaag

SEQ ID NO: 395588 - DNA, 16 bp, M. musculus
ctgaagaagaagaaaa

SEQ ID NO: 395589 - DNA, 16 bp, M. musculus
ctgaagaagaaggaaa

SEQ ID NO: 395590 - DNA, 16 bp, M. musculus
ctgaagaagaaggaag

SEQ ID NO: 395591 - DNA, 16 bp, M. musculus
ctgaagaagaggagga

SEQ ID NO: 395592 - DNA, 16 bp, M. musculus
ctgaagaagctgaaag

SEQ ID NO: 395593 - DNA, 16 bp, M. musculus
ctgaagaagctgaggg

SEQ ID NO: 395594 - DNA, 16 bp, M. musculus
ctgaagaaggaaatca

SEQ ID NO: 395595 - DNA, 16 bp, M. musculus
ctgaagaaggtagact

SEQ ID NO: 395596 - DNA, 16 bp, M. musculus
ctgaagaagtttgcag

SEQ ID NO: 395597 - DNA, 16 bp, M. musculus
ctgaagaataaagata

SEQ ID NO: 395598 - DNA, 16 bp, M. musculus
ctgaagacaacatcta

SEQ ID NO: 395599 - DNA, 16 bp, M. musculus
ctgaagacaccacagc

SEQ ID NO: 395600 - DNA, 16 bp, M. musculus
ctgaagacaccatata

SEQ ID NO: 395601 - DNA, 16 bp, M. musculus
ctgaagacagcacaca

SEQ ID NO: 395602 - DNA, 16 bp, M. musculus
ctgaagacagctacca

SEQ ID NO: 395603 - DNA, 16 bp, M. musculus
ctgaagacagtgacag

SEQ ID NO: 395604 - DNA, 16 bp, M. musculus
ctgaagacagtgatgg

SEQ ID NO: 395605 - DNA, 16 bp, M. musculus
ctgaagacccaaaaat

SEQ ID NO: 395606 - DNA, 16 bp, M. musculus
ctgaagacccagagat

SEQ ID NO: 395607 - DNA, 16 bp, M. musculus
ctgaagagaaaagaaa

SEQ ID NO: 395608 - DNA, 16 bp, M. musculus
ctgaagagaaaccaga

SEQ ID NO: 395609 - DNA, 16 bp, M. musculus
ctgaagagaagggtga

SEQ ID NO: 395610 - DNA, 16 bp, M. musculus
ctgaagagacggctca

SEQ ID NO: 395611 - DNA, 16 bp, M. musculus
ctgaagagagagacag

SEQ ID NO: 395612 - DNA, 16 bp, M. musculus
ctgaagagagcaactg

SEQ ID NO: 395613 - DNA, 16 bp, M. musculus
ctgaagagagcagtgg

SEQ ID NO: 395614 - DNA, 16 bp, M. musculus
ctgaagagatagctca

SEQ ID NO: 395615 - DNA, 16 bp, M. musculus
ctgaagagcataaagg

SEQ ID NO: 395616 - DNA, 16 bp, M. musculus
ctgaagagcctttgcc

SEQ ID NO: 395617 - DNA, 16 bp, M. musculus
ctgaagaggaggaaga

SEQ ID NO: 395618 - DNA, 16 bp, M. musculus
ctgaagaggagggtga

SEQ ID NO: 395619 - DNA, 16 bp, M. musculus
ctgaagaggcagaggc

SEQ ID NO: 395620 - DNA, 16 bp, M. musculus
ctgaagaggtagctga

SEQ ID NO: 395621 - DNA, 16 bp, M. musculus
ctgaagaggtttgcag

SEQ ID NO: 395622 - DNA, 16 bp, M. musculus
ctgaagatagtgacag

SEQ ID NO: 395623 - DNA, 16 bp, M. musculus
ctgaagatcttggtaa

SEQ ID NO: 395624 - DNA, 16 bp, M. musculus
ctgaagatgaccctga

SEQ ID NO: 395625 - DNA, 16 bp, M. musculus
ctgaagatgcagctca

SEQ ID NO: 395626 - DNA, 16 bp, M. musculus
ctgaagatggccttga

SEQ ID NO: 395627 - DNA, 16 bp, M. musculus
ctgaagatgggaaagg

SEQ ID NO: 395628 - DNA, 16 bp, M. musculus
ctgaagcacaagaaaa

SEQ ID NO: 395629 - DNA, 16 bp, M. musculus
ctgaagcagacacagg

SEQ ID NO: 395630 - DNA, 16 bp, M. musculus
ctgaagcagagactat

SEQ ID NO: 395631 - DNA, 16 bp, M. musculus
ctgaagcagagagcat

SEQ ID NO: 395632 - DNA, 16 bp, M. musculus
ctgaagcagaggtcat

SEQ ID NO: 395633 - DNA, 16 bp, M. musculus
ctgaagcagatgggaa

SEQ ID NO: 395634 - DNA, 16 bp, M. musculus
ctgaagcagctcttga

SEQ ID NO: 395635 - DNA, 16 bp, M. musculus
ctgaagcagctgggct

SEQ ID NO: 395636 - DNA, 16 bp, M. musculus
ctgaagcaggaagact

SEQ ID NO: 395637 - DNA, 16 bp, M. musculus
ctgaagcaggaggatc

SEQ ID NO: 395638 - DNA, 16 bp, M. musculus
ctgaagcaggagggtc

SEQ ID NO: 395639 - DNA, 16 bp, M. musculus
ctgaagcaggcagaaa

SEQ ID NO: 395640 - DNA, 16 bp, M. musculus
ctgaagcatctctcca

SEQ ID NO: 395641 - DNA, 16 bp, M. musculus
ctgaagccagacaaag

SEQ ID NO: 395642 - DNA, 16 bp, M. musculus
ctgaagccagacaaga

SEQ ID NO: 395643 - DNA, 16 bp, M. musculus
ctgaagccagagaata

SEQ ID NO: 395644 - DNA, 16 bp, M. musculus
ctgaagccaggcagtg

SEQ ID NO: 395645 - DNA, 16 bp, M. musculus
ctgaagcccaaccagg

SEQ ID NO: 395646 - DNA, 16 bp, M. musculus
ctgaagcccaggctgg

SEQ ID NO: 395647 - DNA, 16 bp, M. musculus
ctgaagccctgaggac

SEQ ID NO: 395648 - DNA, 16 bp, M. musculus
ctgaagccctgaggtc

SEQ ID NO: 395649 - DNA, 16 bp, M. musculus
ctgaagcctgaggcag

SEQ ID NO: 395650 - DNA, 16 bp, M. musculus
ctgaagctaaggtgaa

SEQ ID NO: 395651 - DNA, 16 bp, M. musculus
ctgaagctagacaagg

SEQ ID NO: 395652 - DNA, 16 bp, M. musculus
ctgaagctcaagaaga

SEQ ID NO: 395653 - DNA, 16 bp, M. musculus
ctgaagctctcttctg

SEQ ID NO: 395654 - DNA, 16 bp, M. musculus
ctgaagctggaaacaa

SEQ ID NO: 395655 - DNA, 16 bp, M. musculus
ctgaagctgggcatgg

SEQ ID NO: 395656 - DNA, 16 bp, M. musculus
ctgaagctgttcatca

SEQ ID NO: 395657 - DNA, 16 bp, M. musculus
ctgaagcttacaagaa

SEQ ID NO: 395658 - DNA, 16 bp, M. musculus
ctgaaggaaaatgaga

SEQ ID NO: 395659 - DNA, 16 bp, M. musculus
ctgaaggaaaggacat

SEQ ID NO: 395660 - DNA, 16 bp, M. musculus
ctgaaggaaaggcctt

SEQ ID NO: 395661 - DNA, 16 bp, M. musculus
ctgaaggaactgaaga

SEQ ID NO: 395662 - DNA, 16 bp, M. musculus
ctgaaggaactgaggg

SEQ ID NO: 395663 - DNA, 16 bp, M. musculus
ctgaaggaactgcagg

SEQ ID NO: 395664 - DNA, 16 bp, M. musculus
ctgaaggaagccaagg

SEQ ID NO: 395665 - DNA, 16 bp, M. musculus
ctgaaggaagccagaa

SEQ ID NO: 395666 - DNA, 16 bp, M. musculus
ctgaaggaagctgaga

SEQ ID NO: 395667 - DNA, 16 bp, M. musculus
ctgaaggaatttgcaa

SEQ ID NO: 395668 - DNA, 16 bp, M. musculus
ctgaaggacctgaagg

SEQ ID NO: 395669 - DNA, 16 bp, M. musculus
ctgaaggagactgaag

SEQ ID NO: 395670 - DNA, 16 bp, M. musculus
ctgaaggagaggcagc

SEQ ID NO: 395671 - DNA, 16 bp, M. musculus
ctgaaggagataaagg

SEQ ID NO: 395672 - DNA, 16 bp, M. musculus
ctgaaggagataggaa

SEQ ID NO: 395673 - DNA, 16 bp, M. musculus
ctgaaggagatggcaa

SEQ ID NO: 395674 - DNA, 16 bp, M. musculus
ctgaaggagcagaagg

SEQ ID NO: 395675 - DNA, 16 bp, M. musculus
ctgaaggagctgaaga

SEQ ID NO: 395676 - DNA, 16 bp, M. musculus
ctgaaggagctgaagc

SEQ ID NO: 395677 - DNA, 16 bp, M. musculus
ctgaaggagctgagag

SEQ ID NO: 395678 - DNA, 16 bp, M. musculus
ctgaaggagctgaggg

SEQ ID NO: 395679 - DNA, 16 bp, M. musculus
ctgaaggagctgaggt

SEQ ID NO: 395680 - DNA, 16 bp, M. musculus
ctgaaggagctggagg

SEQ ID NO: 395681 - DNA, 16 bp, M. musculus
ctgaaggagctgtagg

SEQ ID NO: 395682 - DNA, 16 bp, M. musculus
ctgaaggaggaagctt

SEQ ID NO: 395683 - DNA, 16 bp, M. musculus
ctgaaggatcagatca

SEQ ID NO: 395684 - DNA, 16 bp, M. musculus
ctgaaggcagagacag

SEQ ID NO: 395685 - DNA, 16 bp, M. musculus
ctgaaggcagtgacag

SEQ ID NO: 395686 - DNA, 16 bp, M. musculus
ctgaaggccaaggctg

SEQ ID NO: 395687 - DNA, 16 bp, M. musculus
ctgaaggccagaagaa

SEQ ID NO: 395688 - DNA, 16 bp, M. musculus
ctgaaggccctgaagg

SEQ ID NO: 395689 - DNA, 16 bp, M. musculus
ctgaaggcctggagga

SEQ ID NO: 395690 - DNA, 16 bp, M. musculus
ctgaagggaaaaaaaa

SEQ ID NO: 395691 - DNA, 16 bp, M. musculus
ctgaagggaaacagaa

SEQ ID NO: 395692 - DNA, 16 bp, M. musculus
ctgaagggaaacagga

SEQ ID NO: 395693 - DNA, 16 bp, M. musculus
ctgaagggagaccctc

SEQ ID NO: 395694 - DNA, 28 bp, M. musculus
ctgaaggggaactggtcgcaggagctgg

SEQ ID NO: 395695 - DNA, 16 bp, M. musculus
ctgaaggggagagtga

SEQ ID NO: 395696 - DNA, 16 bp, M. musculus
ctgaaggggcctgcaa

SEQ ID NO: 395697 - DNA, 16 bp, M. musculus
ctgaaggggctggaga

SEQ ID NO: 395698 - DNA, 16 bp, M. musculus
ctgaaggggcttgcag

SEQ ID NO: 395699 - DNA, 16 bp, M. musculus
ctgaaggggcttgtgc

SEQ ID NO: 395700 - DNA, 16 bp, M. musculus
ctgaaggtcagaaact

SEQ ID NO: 395701 - DNA, 16 bp, M. musculus
ctgaaggtcctgagct

SEQ ID NO: 395702 - DNA, 16 bp, M. musculus
ctgaaggtgggctcta

SEQ ID NO: 395703 - DNA, 16 bp, M. musculus
ctgaagtaggaggatt

SEQ ID NO: 395704 - DNA, 16 bp, M. musculus
ctgaagtatcctcact

SEQ ID NO: 395705 - DNA, 16 bp, M. musculus
ctgaagtcagaggaca

SEQ ID NO: 395706 - DNA, 16 bp, M. musculus
ctgaagtgctgggact

SEQ ID NO: 395707 - DNA, 16 bp, M. musculus
ctgaagtggccacctc

SEQ ID NO: 395708 - DNA, 16 bp, M. musculus
ctgaagtgtggactct

SEQ ID NO: 395709 - DNA, 16 bp, M. musculus
ctgaagtgtgtgtgtg

SEQ ID NO: 395710 - DNA, 16 bp, M. musculus
ctgaagttacagatgg

SEQ ID NO: 395711 - DNA, 16 bp, M. musculus
ctgaagttcagtccat

SEQ ID NO: 395712 - DNA, 16 bp, M. musculus
ctgaagttcttctcca

SEQ ID NO: 395713 - DNA, 16 bp, M. musculus
ctgaagttgttaatca

SEQ ID NO: 395714 - DNA, 16 bp, M. musculus
ctgaataaactattct

SEQ ID NO: 395715 - DNA, 16 bp, M. musculus
ctgaataaactccatt

SEQ ID NO: 395716 - DNA, 22 bp, M. musculus
ctgaataaactgctgttagaag

SEQ ID NO: 395717 - DNA, 16 bp, M. musculus
ctgaatacctaataaa

SEQ ID NO: 395718 - DNA, 16 bp, M. musculus
ctgaatagaacagaaa

SEQ ID NO: 395719 - DNA, 16 bp, M. musculus
ctgaatagtgttccat

SEQ ID NO: 395720 - DNA, 16 bp, M. musculus
ctgaatatatatatat

SEQ ID NO: 395721 - DNA, 16 bp, M. musculus
ctgaatatcagggcaa

SEQ ID NO: 395722 - DNA, 21 bp, M. musculus
ctgaatatctatgctccaaat

SEQ ID NO: 395723 - DNA, 16 bp, M. musculus
ctgaatatttttattt

SEQ ID NO: 395724 - DNA, 16 bp, M. musculus
ctgaatcagatgaaga

SEQ ID NO: 395725 - DNA, 17 bp, M. musculus
ctgaatcagcctgcttc

SEQ ID NO: 395726 - DNA, 20 bp, M. musculus
ctgaatcaggtgagagagga

SEQ ID NO: 395727 - DNA, 16 bp, M. musculus
ctgaatccacgagatc

SEQ ID NO: 395728 - DNA, 16 bp, M. musculus
ctgaatccaggctgga

SEQ ID NO: 395729 - DNA, 16 bp, M. musculus
ctgaatccaggtcctc

SEQ ID NO: 395730 - DNA, 16 bp, M. musculus
ctgaatgccagaagag

SEQ ID NO: 395731 - DNA, 16 bp, M. musculus
ctgaatgctgttttct

SEQ ID NO: 395732 - DNA, 16 bp, M. musculus
ctgaatgtccctccct

SEQ ID NO: 395733 - DNA, 16 bp, M. musculus
ctgaatgtgggcagca

SEQ ID NO: 395734 - DNA, 16 bp, M. musculus
ctgaatgtgggtggca

SEQ ID NO: 395735 - DNA, 16 bp, M. musculus
ctgaatgtgtaagcca

SEQ ID NO: 395736 - DNA, 17 bp, M. musculus
ctgaatgtgtgtgtgtg

SEQ ID NO: 395737 - DNA, 16 bp, M. musculus
ctgaatgtttttcttt

SEQ ID NO: 395738 - DNA, 16 bp, M. musculus
ctgaattagcatcaaa

SEQ ID NO: 395739 - DNA, 16 bp, M. musculus
ctgaattcaaggtcag

SEQ ID NO: 395740 - DNA, 16 bp, M. musculus
ctgaattcaattccta

SEQ ID NO: 395741 - DNA, 16 bp, M. musculus
ctgaattcaggtcctc

SEQ ID NO: 395742 - DNA, 16 bp, M. musculus
ctgaattctgtgttca

SEQ ID NO: 395743 - DNA, 16 bp, M. musculus
ctgaattctttctcag

SEQ ID NO: 395744 - DNA, 16 bp, M. musculus
ctgaattcttttgcaa

SEQ ID NO: 395745 - DNA, 16 bp, M. musculus
ctgaattgaaccagcc

SEQ ID NO: 395746 - DNA, 16 bp, M. musculus
ctgaatttatgaaatt

SEQ ID NO: 395747 - DNA, 16 bp, M. musculus
ctgaatttcagtggtc

SEQ ID NO: 395748 - DNA, 16 bp, M. musculus
ctgaatttgattcctg

SEQ ID NO: 395749 - DNA, 16 bp, M. musculus
ctgaatttgatttcca

SEQ ID NO: 395750 - DNA, 16 bp, M. musculus
ctgaatttgttgaaaa

SEQ ID NO: 395751 - DNA, 16 bp, M. musculus
ctgacaaaaagcaact

SEQ ID NO: 395752 - DNA, 16 bp, M. musculus
ctgacaaactgactat

SEQ ID NO: 395753 - DNA, 16 bp, M. musculus
ctgacaaaggcaactt

SEQ ID NO: 395754 - DNA, 16 bp, M. musculus
ctgacaaatacagaag

SEQ ID NO: 395755 - DNA, 16 bp, M. musculus
ctgacaaatggagatt

SEQ ID NO: 395756 - DNA, 16 bp, M. musculus
ctgacaaatggagctc

SEQ ID NO: 395757 - DNA, 16 bp, M. musculus
ctgacaacctgagttc

SEQ ID NO: 395758 - DNA, 16 bp, M. musculus
ctgacaacctgtgttt

SEQ ID NO: 395759 - DNA, 16 bp, M. musculus
ctgacaagaagcagct

SEQ ID NO: 395760 - DNA, 16 bp, M. musculus
ctgacaagatagctca

SEQ ID NO: 395761 - DNA, 16 bp, M. musculus
ctgacaagtacagagg

SEQ ID NO: 395762 - DNA, 16 bp, M. musculus
ctgacaatcatcccaa

SEQ ID NO: 395763 - DNA, 16 bp, M. musculus
ctgacaccagcactga

SEQ ID NO: 395764 - DNA, 16 bp, M. musculus
ctgacaccattacata

SEQ ID NO: 395765 - DNA, 16 bp, M. musculus
ctgacaccattgccta

SEQ ID NO: 395766 - DNA, 16 bp, M. musculus
ctgacaccattgctta

SEQ ID NO: 395767 - DNA, 16 bp, M. musculus
ctgacaccctcttctg

SEQ ID NO: 395768 - DNA, 16 bp, M. musculus
ctgacacctctgctct

SEQ ID NO: 395769 - DNA, 16 bp, M. musculus
ctgacaccttcacaca

SEQ ID NO: 395770 - DNA, 16 bp, M. musculus
ctgacaccttcctctg

SEQ ID NO: 395771 - DNA, 16 bp, M. musculus
ctgacactattactta

SEQ ID NO: 395772 - DNA, 16 bp, M. musculus
ctgacactggagttac

SEQ ID NO: 395773 - DNA, 16 bp, M. musculus
ctgacagaagagaaag

SEQ ID NO: 395774 - DNA, 18 bp, M. musculus
ctgacagaccagagaata

SEQ ID NO: 395775 - DNA, 16 bp, M. musculus
ctgacagacttttctg

SEQ ID NO: 395776 - DNA, 16 bp, M. musculus
ctgacagaggacctgg

SEQ ID NO: 395777 - DNA, 16 bp, M. musculus
ctgacagatttttttt

SEQ ID NO: 395778 - DNA, 16 bp, M. musculus
ctgacagcagcctgat

SEQ ID NO: 395779 - DNA, 16 bp, M. musculus
ctgacagcctgtgttc

SEQ ID NO: 395780 - DNA, 16 bp, M. musculus
ctgacagctgtgtggt

SEQ ID NO: 395781 - DNA, 30 bp, M. musculus
ctgacagctgtgttctaagtggtaaacata

SEQ ID NO: 395782 - DNA, 16 bp, M. musculus
ctgacagcttctgtga

SEQ ID NO: 395783 - DNA, 16 bp, M. musculus
ctgacaggagtctggt

SEQ ID NO: 395784 - DNA, 16 bp, M. musculus
ctgacagtctgttgat

SEQ ID NO: 395785 - DNA, 16 bp, M. musculus
ctgacagtgaagatca

SEQ ID NO: 395786 - DNA, 19 bp, M. musculus
ctgacagtgagagacccgg

SEQ ID NO: 395787 - DNA, 16 bp, M. musculus
ctgacatcagcctctg

SEQ ID NO: 395788 - DNA, 16 bp, M. musculus
ctgacatcatcttctg

SEQ ID NO: 395789 - DNA, 16 bp, M. musculus
ctgacatcctacttgg

SEQ ID NO: 395790 - DNA, 16 bp, M. musculus
ctgacatctactgaaa

SEQ ID NO: 395791 - DNA, 16 bp, M. musculus
ctgacatctctctctc

SEQ ID NO: 395792 - DNA, 16 bp, M. musculus
ctgacatgcacacaca

SEQ ID NO: 395793 - DNA, 16 bp, M. musculus
ctgacattgacctctg

SEQ ID NO: 395794 - DNA, 16 bp, M. musculus
ctgaccaaggactctt

SEQ ID NO: 395795 - DNA, 16 bp, M. musculus
ctgaccaagttccaga

SEQ ID NO: 395796 - DNA, 16 bp, M. musculus
ctgaccaatgggcctc

SEQ ID NO: 395797 - DNA, 16 bp, M. musculus
ctgaccacagttttcc

SEQ ID NO: 395798 - DNA, 16 bp, M. musculus
ctgaccaccacacaca

SEQ ID NO: 395799 - DNA, 16 bp, M. musculus
ctgaccaccaggcagc

SEQ ID NO: 395800 - DNA, 16 bp, M. musculus
ctgaccacccagagct

SEQ ID NO: 395801 - DNA, 16 bp, M. musculus
ctgaccactttgtatt

SEQ ID NO: 395802 - DNA, 16 bp, M. musculus
ctgaccagaagcaact

SEQ ID NO: 395803 - DNA, 16 bp, M. musculus
ctgaccagctcagcta

SEQ ID NO: 395804 - DNA, 16 bp, M. musculus
ctgaccatgtttgggg

SEQ ID NO: 395805 - DNA, 16 bp, M. musculus
ctgacccacagtccat

SEQ ID NO: 395806 - DNA, 16 bp, M. musculus
ctgacccagaaagaca

SEQ ID NO: 395807 - DNA, 16 bp, M. musculus
ctgacccagaactcag

SEQ ID NO: 395808 - DNA, 16 bp, M. musculus
ctgacccaggaactca

SEQ ID NO: 395809 - DNA, 16 bp, M. musculus
ctgacccatgattgtt

SEQ ID NO: 395810 - DNA, 16 bp, M. musculus
ctgaccccaagcccag

SEQ ID NO: 395811 - DNA, 16 bp, M. musculus
ctgacccctgacctct

SEQ ID NO: 395812 - DNA, 16 bp, M. musculus
ctgaccctgaccctga

SEQ ID NO: 395813 - DNA, 16 bp, M. musculus
ctgaccctgcctcctg

SEQ ID NO: 395814 - DNA, 16 bp, M. musculus
ctgacctaaaggtgta

SEQ ID NO: 395815 - DNA, 16 bp, M. musculus
ctgacctacagagtga

SEQ ID NO: 395816 - DNA, 23 bp, M. musculus
ctgacctagaagaagaggcagct

SEQ ID NO: 395817 - DNA, 16 bp, M. musculus
ctgacctcaaacccac

SEQ ID NO: 395818 - DNA, 16 bp, M. musculus
ctgacctcaaactcac

SEQ ID NO: 395819 - DNA, 16 bp, M. musculus
ctgacctcaaactcta

SEQ ID NO: 395820 - DNA, 16 bp, M. musculus
ctgacctcaacacaca

SEQ ID NO: 395821 - DNA, 16 bp, M. musculus
ctgacctcagtccaat

SEQ ID NO: 395822 - DNA, 16 bp, M. musculus
ctgacctccacaaaca

SEQ ID NO: 395823 - DNA, 16 bp, M. musculus
ctgacctccacacaca

SEQ ID NO: 395824 - DNA, 16 bp, M. musculus
ctgacctccatagaca

SEQ ID NO: 395825 - DNA, 16 bp, M. musculus
ctgacctccatgagca

SEQ ID NO: 395826 - DNA, 16 bp, M. musculus
ctgacctccatggaca

SEQ ID NO: 395827 - DNA, 16 bp, M. musculus
ctgacctccatgtgtg

SEQ ID NO: 395828 - DNA, 16 bp, M. musculus
ctgacctccctgggca

SEQ ID NO: 395829 - DNA, 16 bp, M. musculus
ctgacctcctcaggca

SEQ ID NO: 395830 - DNA, 16 bp, M. musculus
ctgacctctatgctat

SEQ ID NO: 395831 - DNA, 16 bp, M. musculus
ctgacctctatgggca

SEQ ID NO: 395832 - DNA, 16 bp, M. musculus
ctgacctctgacctct

SEQ ID NO: 395833 - DNA, 16 bp, M. musculus
ctgacctctggtcctc

SEQ ID NO: 395834 - DNA, 16 bp, M. musculus
ctgacctctgtgtgtg

SEQ ID NO: 395835 - DNA, 16 bp, M. musculus
ctgacctgagttcaat

SEQ ID NO: 395836 - DNA, 16 bp, M. musculus
ctgacctgcctcctgt

SEQ ID NO: 395837 - DNA, 25 bp, M. musculus
ctgacctgcttgagttccagtcctg

SEQ ID NO: 395838 - DNA, 16 bp, M. musculus
ctgacctggaacttac

SEQ ID NO: 395839 - DNA, 16 bp, M. musculus
ctgacctggagctcac

SEQ ID NO: 395840 - DNA, 16 bp, M. musculus
ctgacctgtaactcac

SEQ ID NO: 395841 - DNA, 16 bp, M. musculus
ctgacctgtgtgtgtg

SEQ ID NO: 395842 - DNA, 21 bp, M. musculus
ctgacctgtttgagttccagt

SEQ ID NO: 395843 - DNA, 16 bp, M. musculus
ctgaccttcacaggca

SEQ ID NO: 395844 - DNA, 16 bp, M. musculus
ctgaccttgaactcac

SEQ ID NO: 395845 - DNA, 16 bp, M. musculus
ctgaccttgaattcat

SEQ ID NO: 395846 - DNA, 16 bp, M. musculus
ctgacctttgacctcc

SEQ ID NO: 395847 - DNA, 16 bp, M. musculus
ctgacctttgacctct

SEQ ID NO: 395848 - DNA, 16 bp, M. musculus
ctgacgccctctcctg

SEQ ID NO: 395849 - DNA, 16 bp, M. musculus
ctgacgccttcttctg

SEQ ID NO: 395850 - DNA, 16 bp, M. musculus
ctgactaagacacaat

SEQ ID NO: 395851 - DNA, 16 bp, M. musculus
ctgactaagacatatg

SEQ ID NO: 395852 - DNA, 16 bp, M. musculus
ctgactacaggaggtg

SEQ ID NO: 395853 - DNA, 16 bp, M. musculus
ctgactaccaaggtcc

SEQ ID NO: 395854 - DNA, 17 bp, M. musculus
ctgactaccgccagcta

SEQ ID NO: 395855 - DNA, 17 bp, M. musculus
ctgactatcctggaact

SEQ ID NO: 395856 - DNA, 16 bp, M. musculus
ctgactatgatttgct

SEQ ID NO: 395857 - DNA, 16 bp, M. musculus
ctgactcaaaagcaaa

SEQ ID NO: 395858 - DNA, 16 bp, M. musculus
ctgactcaagccattt

SEQ ID NO: 395859 - DNA, 16 bp, M. musculus
ctgactcagccagttg

SEQ ID NO: 395860 - DNA, 16 bp, M. musculus
ctgactcagcctccca

SEQ ID NO: 395861 - DNA, 16 bp, M. musculus
ctgactcagcctcctg

SEQ ID NO: 395862 - DNA, 17 bp, M. musculus
ctgactcaggagaggtg

SEQ ID NO: 395863 - DNA, 16 bp, M. musculus
ctgactcagttgcctg

SEQ ID NO: 395864 - DNA, 16 bp, M. musculus
ctgactccacctccca

SEQ ID NO: 395865 - DNA, 16 bp, M. musculus
ctgactcccaagtgct

SEQ ID NO: 395866 - DNA, 16 bp, M. musculus
ctgactcctgtgaact

SEQ ID NO: 395867 - DNA, 16 bp, M. musculus
ctgactctccctctcc

SEQ ID NO: 395868 - DNA, 16 bp, M. musculus
ctgactctcctgcctc

SEQ ID NO: 395869 - DNA, 16 bp, M. musculus
ctgactctgaaagatg

SEQ ID NO: 395870 - DNA, 17 bp, M. musculus
ctgactctgactctgac

SEQ ID NO: 395871 - DNA, 16 bp, M. musculus
ctgactctgcctccta

SEQ ID NO: 395872 - DNA, 16 bp, M. musculus
ctgactctgccttctg

SEQ ID NO: 395873 - DNA, 16 bp, M. musculus
ctgactctgtggcctg

SEQ ID NO: 395874 - DNA, 16 bp, M. musculus
ctgactctgttgcctg

SEQ ID NO: 395875 - DNA, 16 bp, M. musculus
ctgactcttccacact

SEQ ID NO: 395876 - DNA, 16 bp, M. musculus
ctgactcttccccagc

SEQ ID NO: 395877 - DNA, 16 bp, M. musculus
ctgactgaattgctct

SEQ ID NO: 395878 - DNA, 16 bp, M. musculus
ctgactgaatttctct

SEQ ID NO: 395879 - DNA, 16 bp, M. musculus
ctgactgaatttgttg

SEQ ID NO: 395880 - DNA, 16 bp, M. musculus
ctgactgactgactgg

SEQ ID NO: 395881 - DNA, 16 bp, M. musculus
ctgactgagctatctt

SEQ ID NO: 395882 - DNA, 16 bp, M. musculus
ctgactgcagtgggcg

SEQ ID NO: 395883 - DNA, 16 bp, M. musculus
ctgactgcccttccaa

SEQ ID NO: 395884 - DNA, 16 bp, M. musculus
ctgactgccttcagat

SEQ ID NO: 395885 - DNA, 18 bp, M. musculus
ctgactgctcttccgaag

SEQ ID NO: 395886 - DNA, 16 bp, M. musculus
ctgactgcttttctga

SEQ ID NO: 395887 - DNA, 16 bp, M. musculus
ctgactggccagccag

SEQ ID NO: 395888 - DNA, 16 bp, M. musculus
ctgactggcgtgaggt

SEQ ID NO: 395889 - DNA, 16 bp, M. musculus
ctgactggcttgatct

SEQ ID NO: 395890 - DNA, 16 bp, M. musculus
ctgactggcttgctct

SEQ ID NO: 395891 - DNA, 16 bp, M. musculus
ctgactgtactatcta

SEQ ID NO: 395892 - DNA, 16 bp, M. musculus
ctgactgtggacacaa

SEQ ID NO: 395893 - DNA, 16 bp, M. musculus
ctgactgttcctccag

SEQ ID NO: 395894 - DNA, 16 bp, M. musculus
ctgacttcaaactcac

SEQ ID NO: 395895 - DNA, 16 bp, M. musculus
ctgacttcaaacttgt

SEQ ID NO: 395896 - DNA, 16 bp, M. musculus
ctgacttcagcaagct

SEQ ID NO: 395897 - DNA, 16 bp, M. musculus
ctgacttccctggtga

SEQ ID NO: 395898 - DNA, 16 bp, M. musculus
ctgacttcccttcctg

SEQ ID NO: 395899 - DNA, 16 bp, M. musculus
ctgacttcccttggtg

SEQ ID NO: 395900 - DNA, 21 bp, M. musculus
ctgacttcctcattatctcag

SEQ ID NO: 395901 - DNA, 17 bp, M. musculus
ctgacttccttagtgat

SEQ ID NO: 395902 - DNA, 16 bp, M. musculus
ctgacttccttggtgg

SEQ ID NO: 395903 - DNA, 16 bp, M. musculus
ctgacttcctttgata

SEQ ID NO: 395904 - DNA, 16 bp, M. musculus
ctgacttctttcagtg

SEQ ID NO: 395905 - DNA, 19 bp, M. musculus
ctgacttctttcagtgatg

SEQ ID NO: 395906 - DNA, 16 bp, M. musculus
ctgactttcagagtgg

SEQ ID NO: 395907 - DNA, 16 bp, M. musculus
ctgactttcagctgct

SEQ ID NO: 395908 - DNA, 16 bp, M. musculus
ctgactttccaaagaa

SEQ ID NO: 395909 - DNA, 16 bp, M. musculus
ctgactttctaaagaa

SEQ ID NO: 395910 - DNA, 16 bp, M. musculus
ctgactttgaactcac

SEQ ID NO: 395911 - DNA, 16 bp, M. musculus
ctgactttgaactcct

SEQ ID NO: 395912 - DNA, 16 bp, M. musculus
ctgacttttctttctt

SEQ ID NO: 395913 - DNA, 16 bp, M. musculus
ctgacttttttgtttg

SEQ ID NO: 395914 - DNA, 16 bp, M. musculus
ctgagaaaacaccaaa

SEQ ID NO: 395915 - DNA, 16 bp, M. musculus
ctgagaaaagacaaga

SEQ ID NO: 395916 - DNA, 16 bp, M. musculus
ctgagaaaatgcttcc

SEQ ID NO: 395917 - DNA, 16 bp, M. musculus
ctgagaaacaaagaaa

SEQ ID NO: 395918 - DNA, 16 bp, M. musculus
ctgagaaacagagaca

SEQ ID NO: 395919 - DNA, 16 bp, M. musculus
ctgagaaacctccaga

SEQ ID NO: 395920 - DNA, 16 bp, M. musculus
ctgagaaactactaga

SEQ ID NO: 395921 - DNA, 16 bp, M. musculus
ctgagaaactgagaaa

SEQ ID NO: 395922 - DNA, 16 bp, M. musculus
ctgagaaagaaattga

SEQ ID NO: 395923 - DNA, 16 bp, M. musculus
ctgagaaagaggaaat

SEQ ID NO: 395924 - DNA, 16 bp, M. musculus
ctgagaaaggagcttt

SEQ ID NO: 395925 - DNA, 16 bp, M. musculus
ctgagaaaggcaggaa

SEQ ID NO: 395926 - DNA, 16 bp, M. musculus
ctgagaaagtggggta

SEQ ID NO: 395927 - DNA, 16 bp, M. musculus
ctgagaaataaattag

SEQ ID NO: 395928 - DNA, 16 bp, M. musculus
ctgagaaatggaaata

SEQ ID NO: 395929 - DNA, 16 bp, M. musculus
ctgagaacaaagcaga

SEQ ID NO: 395930 - DNA, 16 bp, M. musculus
ctgagaacacagagag

SEQ ID NO: 395931 - DNA, 16 bp, M. musculus
ctgagaacagaatggg

SEQ ID NO: 395932 - DNA, 16 bp, M. musculus
ctgagaacaggagaaa

SEQ ID NO: 395933 - DNA, 20 bp, M. musculus
ctgagaacatagcagaacag

SEQ ID NO: 395934 - DNA, 16 bp, M. musculus
ctgagaaccaaacttg

SEQ ID NO: 395935 - DNA, 16 bp, M. musculus
ctgagaaccactgctg

SEQ ID NO: 395936 - DNA, 16 bp, M. musculus
ctgagaactgaaccca

SEQ ID NO: 395937 - DNA, 16 bp, M. musculus
ctgagaagaagaagaa

SEQ ID NO: 395938 - DNA, 16 bp, M. musculus
ctgagaagaaggttta

SEQ ID NO: 395939 - DNA, 16 bp, M. musculus
ctgagaagacagctca

SEQ ID NO: 395940 - DNA, 16 bp, M. musculus
ctgagaagcacttgaa

SEQ ID NO: 395941 - DNA, 16 bp, M. musculus
ctgagaagcagagaca

SEQ ID NO: 395942 - DNA, 16 bp, M. musculus
ctgagaagcagcatca

SEQ ID NO: 395943 - DNA, 16 bp, M. musculus
ctgagaaggagggtga

SEQ ID NO: 395944 - DNA, 16 bp, M. musculus
ctgagaattctacata

SEQ ID NO: 395945 - DNA, 16 bp, M. musculus
ctgagaattctacatt

SEQ ID NO: 395946 - DNA, 16 bp, M. musculus
ctgagaattctttgtt

SEQ ID NO: 395947 - DNA, 16 bp, M. musculus
ctgagaattgaactca

SEQ ID NO: 395948 - DNA, 16 bp, M. musculus
ctgagaattttgaatc

SEQ ID NO: 395949 - DNA, 16 bp, M. musculus
ctgagacacccagcct

SEQ ID NO: 395950 - DNA, 16 bp, M. musculus
ctgagacagactcaca

SEQ ID NO: 395951 - DNA, 16 bp, M. musculus
ctgagacagagcaagt

SEQ ID NO: 395952 - DNA, 16 bp, M. musculus
ctgagacagatacaga

SEQ ID NO: 395953 - DNA, 16 bp, M. musculus
ctgagacagatgaaga

SEQ ID NO: 395954 - DNA, 16 bp, M. musculus
ctgagacagatgcaca

SEQ ID NO: 395955 - DNA, 16 bp, M. musculus
ctgagacagctacagt

SEQ ID NO: 395956 - DNA, 16 bp, M. musculus
ctgagacaggaggatc

SEQ ID NO: 395957 - DNA, 16 bp, M. musculus
ctgagacaggcagatc

SEQ ID NO: 395958 - DNA, 16 bp, M. musculus
ctgagacagggggatt

SEQ ID NO: 395959 - DNA, 16 bp, M. musculus
ctgagacagggttttt

SEQ ID NO: 395960 - DNA, 16 bp, M. musculus
ctgagacatccagcct

SEQ ID NO: 395961 - DNA, 16 bp, M. musculus
ctgagacatctctcca

SEQ ID NO: 395962 - DNA, 16 bp, M. musculus
ctgagaccagtctgtg

SEQ ID NO: 395963 - DNA, 16 bp, M. musculus
ctgagacctgggaaag

SEQ ID NO: 395964 - DNA, 16 bp, M. musculus
ctgagactccattgta

SEQ ID NO: 395965 - DNA, 16 bp, M. musculus
ctgagactgcaggcat

SEQ ID NO: 395966 - DNA, 16 bp, M. musculus
ctgagactgggtctca

SEQ ID NO: 395967 - DNA, 16 bp, M. musculus
ctgagacttgctgctg

SEQ ID NO: 395968 - DNA, 16 bp, M. musculus
ctgagagaagcagagg

SEQ ID NO: 395969 - DNA, 16 bp, M. musculus
ctgagagaagtcaaca

SEQ ID NO: 395970 - DNA, 16 bp, M. musculus
ctgagagaattttggg

SEQ ID NO: 395971 - DNA, 16 bp, M. musculus
ctgagagacagagaca

SEQ ID NO: 395972 - DNA, 16 bp, M. musculus
ctgagagaccctgtct

SEQ ID NO: 395973 - DNA, 16 bp, M. musculus
ctgagagactctgtct

SEQ ID NO: 395974 - DNA, 16 bp, M. musculus
ctgagagactcttcca

SEQ ID NO: 395975 - DNA, 16 bp, M. musculus
ctgagagactgaggca

SEQ ID NO: 395976 - DNA, 16 bp, M. musculus
ctgagagagagagaga

SEQ ID NO: 395977 - DNA, 16 bp, M. musculus
ctgagagagcagcaag

SEQ ID NO: 395978 - DNA, 16 bp, M. musculus
ctgagagatgctgaga

SEQ ID NO: 395979 - DNA, 16 bp, M. musculus
ctgagagcaagagaga

SEQ ID NO: 395980 - DNA, 16 bp, M. musculus
ctgagagcatctgcct

SEQ ID NO: 395981 - DNA, 16 bp, M. musculus
ctgagagcatgagtgt

SEQ ID NO: 395982 - DNA, 16 bp, M. musculus
ctgagagcctctgcca

SEQ ID NO: 395983 - DNA, 16 bp, M. musculus
ctgagagctggagaga

SEQ ID NO: 395984 - DNA, 16 bp, M. musculus
ctgagaggaaggagcc

SEQ ID NO: 395985 - DNA, 16 bp, M. musculus
ctgagaggagagaacc

SEQ ID NO: 395986 - DNA, 16 bp, M. musculus
ctgagaggagagagga

SEQ ID NO: 395987 - DNA, 16 bp, M. musculus
ctgagaggagggattt

SEQ ID NO: 395988 - DNA, 16 bp, M. musculus
ctgagaggcctggaag

SEQ ID NO: 395989 - DNA, 16 bp, M. musculus
ctgagaggctccagcc

SEQ ID NO: 395990 - DNA, 16 bp, M. musculus
ctgagaggctcttcca

SEQ ID NO: 395991 - DNA, 16 bp, M. musculus
ctgagaggctggagag

SEQ ID NO: 395992 - DNA, 16 bp, M. musculus
ctgagagggagaggga

SEQ ID NO: 395993 - DNA, 16 bp, M. musculus
ctgagagggtgctccc

SEQ ID NO: 395994 - DNA, 16 bp, M. musculus
ctgagaggttctaccc

SEQ ID NO: 395995 - DNA, 16 bp, M. musculus
ctgagagtggaagaaa

SEQ ID NO: 395996 - DNA, 16 bp, M. musculus
ctgagagttgggcata

SEQ ID NO: 395997 - DNA, 16 bp, M. musculus
ctgagatcatcttcaa

SEQ ID NO: 395998 - DNA, 16 bp, M. musculus
ctgagatccagtgaag

SEQ ID NO: 395999 - DNA, 16 bp, M. musculus
ctgagatcccagcact

SEQ ID NO: 396000 - DNA, 16 bp, M. musculus
ctgagatcctgggtgt

SEQ ID NO: 396001 - DNA, 16 bp, M. musculus
ctgagatcctggtttg

SEQ ID NO: 396002 - DNA, 16 bp, M. musculus
ctgagatcttcctgcc

SEQ ID NO: 396003 - DNA, 16 bp, M. musculus
ctgagatcttctttta

SEQ ID NO: 396004 - DNA, 16 bp, M. musculus
ctgagatgagagagac

SEQ ID NO: 396005 - DNA, 16 bp, M. musculus
ctgagattaaaggagt

SEQ ID NO: 396006 - DNA, 17 bp, M. musculus
ctgagattaaagggtgg

SEQ ID NO: 396007 - DNA, 16 bp, M. musculus
ctgagattaaaggtgt

SEQ ID NO: 396008 - DNA, 16 bp, M. musculus
ctgagattacagccat

SEQ ID NO: 396009 - DNA, 16 bp, M. musculus
ctgagattacagctgt

SEQ ID NO: 396010 - DNA, 16 bp, M. musculus
ctgagattacaggctt

SEQ ID NO: 396011 - DNA, 16 bp, M. musculus
ctgagattccccctca

SEQ ID NO: 396012 - DNA, 16 bp, M. musculus
ctgagattctacctca

SEQ ID NO: 396013 - DNA, 16 bp, M. musculus
ctgagattctgggtat

SEQ ID NO: 396014 - DNA, 16 bp, M. musculus
ctgagattctgggtgt

SEQ ID NO: 396015 - DNA, 16 bp, M. musculus
ctgagattgaaggtgt

SEQ ID NO: 396016 - DNA, 16 bp, M. musculus
ctgagatttttctttt

SEQ ID NO: 396017 - DNA, 16 bp, M. musculus
ctgagcaaccacatgg

SEQ ID NO: 396018 - DNA, 16 bp, M. musculus
ctgagcaagcagaggt

SEQ ID NO: 396019 - DNA, 16 bp, M. musculus
ctgagcaagccaagag

SEQ ID NO: 396020 - DNA, 16 bp, M. musculus
ctgagcaagccagggg

SEQ ID NO: 396021 - DNA, 16 bp, M. musculus
ctgagcaagccatgag

SEQ ID NO: 396022 - DNA, 16 bp, M. musculus
ctgagcaagccatggg

SEQ ID NO: 396023 - DNA, 16 bp, M. musculus
ctgagcaagtgtcttt

SEQ ID NO: 396024 - DNA, 16 bp, M. musculus
ctgagcaatctctcca

SEQ ID NO: 396025 - DNA, 16 bp, M. musculus
ctgagcagatgtcata

SEQ ID NO: 396026 - DNA, 16 bp, M. musculus
ctgagcagcacagtag

SEQ ID NO: 396027 - DNA, 16 bp, M. musculus
ctgagcaggtggtcct

SEQ ID NO: 396028 - DNA, 16 bp, M. musculus
ctgagcagtctcattt

SEQ ID NO: 396029 - DNA, 16 bp, M. musculus
ctgagcatattcaaac

SEQ ID NO: 396030 - DNA, 17 bp, M. musculus
ctgagcatccacttctg

SEQ ID NO: 396031 - DNA, 16 bp, M. musculus
ctgagcatctttgagt

SEQ ID NO: 396032 - DNA, 16 bp, M. musculus
ctgagcatgctcagtg

SEQ ID NO: 396033 - DNA, 16 bp, M. musculus
ctgagcatggggttcc

SEQ ID NO: 396034 - DNA, 16 bp, M. musculus
ctgagcatggtggtgc

SEQ ID NO: 396035 - DNA, 16 bp, M. musculus
ctgagcattttttttt

SEQ ID NO: 396036 - DNA, 16 bp, M. musculus
ctgagccaactttcca

SEQ ID NO: 396037 - DNA, 16 bp, M. musculus
ctgagccacacccaca

SEQ ID NO: 396038 - DNA, 16 bp, M. musculus
ctgagccacaccccaa

SEQ ID NO: 396039 - DNA, 16 bp, M. musculus
ctgagccacacctcca

SEQ ID NO: 396040 - DNA, 16 bp, M. musculus
ctgagccacagctcca

SEQ ID NO: 396041 - DNA, 16 bp, M. musculus
ctgagccacatctcta

SEQ ID NO: 396042 - DNA, 16 bp, M. musculus
ctgagccacctcccaa

SEQ ID NO: 396043 - DNA, 16 bp, M. musculus
ctgagccacctcccta

SEQ ID NO: 396044 - DNA, 16 bp, M. musculus
ctgagccacctcgcca

SEQ ID NO: 396045 - DNA, 16 bp, M. musculus
ctgagccacctctcca

SEQ ID NO: 396046 - DNA, 16 bp, M. musculus
ctgagccacctggtgc

SEQ ID NO: 396047 - DNA, 16 bp, M. musculus
ctgagccacgccccta

SEQ ID NO: 396048 - DNA, 16 bp, M. musculus
ctgagccacttctcca

SEQ ID NO: 396049 - DNA, 16 bp, M. musculus
ctgagccagcctgggc

SEQ ID NO: 396050 - DNA, 16 bp, M. musculus
ctgagccagctcccca

SEQ ID NO: 396051 - DNA, 16 bp, M. musculus
ctgagccagctctcca

SEQ ID NO: 396052 - DNA, 16 bp, M. musculus
ctgagccagctttcca

SEQ ID NO: 396053 - DNA, 16 bp, M. musculus
ctgagccaggtctcca

SEQ ID NO: 396054 - DNA, 16 bp, M. musculus
ctgagccaggtggaca

SEQ ID NO: 396055 - DNA, 16 bp, M. musculus
ctgagccatatctcca

SEQ ID NO: 396056 - DNA, 16 bp, M. musculus
ctgagccatccctcag

SEQ ID NO: 396057 - DNA, 16 bp, M. musculus
ctgagccatccctcca

SEQ ID NO: 396058 - DNA, 16 bp, M. musculus
ctgagccatcctccca

SEQ ID NO: 396059 - DNA, 16 bp, M. musculus
ctgagccatcctgcca

SEQ ID NO: 396060 - DNA, 16 bp, M. musculus
ctgagccatctcaaca

SEQ ID NO: 396061 - DNA, 20 bp, M. musculus
ctgagccatctcaccagccc

SEQ ID NO: 396062 - DNA, 16 bp, M. musculus
ctgagccatctcactg

SEQ ID NO: 396063 - DNA, 16 bp, M. musculus
ctgagccatctccaca

SEQ ID NO: 396064 - DNA, 16 bp, M. musculus
ctgagccatctcctca

SEQ ID NO: 396065 - DNA, 16 bp, M. musculus
ctgagccatctctagc

SEQ ID NO: 396066 - DNA, 16 bp, M. musculus
ctgagccatctctcaa

SEQ ID NO: 396067 - DNA, 16 bp, M. musculus
ctgagccatctctcca

SEQ ID NO: 396068 - DNA, 16 bp, M. musculus
ctgagccatctctccc

SEQ ID NO: 396069 - DNA, 16 bp, M. musculus
ctgagccatctctcta

SEQ ID NO: 396070 - DNA, 16 bp, M. musculus
ctgagccatctctctg

SEQ ID NO: 396071 - DNA, 16 bp, M. musculus
ctgagccatctcttca

SEQ ID NO: 396072 - DNA, 16 bp, M. musculus
ctgagccatctggtca

SEQ ID NO: 396073 - DNA, 16 bp, M. musculus
ctgagccatcttgcca

SEQ ID NO: 396074 - DNA, 16 bp, M. musculus
ctgagccatcttgctg

SEQ ID NO: 396075 - DNA, 16 bp, M. musculus
ctgagccatctttcca

SEQ ID NO: 396076 - DNA, 16 bp, M. musculus
ctgagccatctttcta

SEQ ID NO: 396077 - DNA, 16 bp, M. musculus
ctgagccatgtcccca

SEQ ID NO: 396078 - DNA, 16 bp, M. musculus
ctgagccattctccag

SEQ ID NO: 396079 - DNA, 16 bp, M. musculus
ctgagccatttctcca

SEQ ID NO: 396080 - DNA, 16 bp, M. musculus
ctgagccattttgcca

SEQ ID NO: 396081 - DNA, 16 bp, M. musculus
ctgagccatttttcta

SEQ ID NO: 396082 - DNA, 16 bp, M. musculus
ctgagcccactgagcc

SEQ ID NO: 396083 - DNA, 16 bp, M. musculus
ctgagcccagcttgac

SEQ ID NO: 396084 - DNA, 16 bp, M. musculus
ctgagcccagtgacaa

SEQ ID NO: 396085 - DNA, 16 bp, M. musculus
ctgagccccacttttt

SEQ ID NO: 396086 - DNA, 16 bp, M. musculus
ctgagccccagcccca

SEQ ID NO: 396087 - DNA, 16 bp, M. musculus
ctgagccccgacttcc

SEQ ID NO: 396088 - DNA, 16 bp, M. musculus
ctgagccccttcccca

SEQ ID NO: 396089 - DNA, 16 bp, M. musculus
ctgagccctcccctga

SEQ ID NO: 396090 - DNA, 16 bp, M. musculus
ctgagccctctctcca

SEQ ID NO: 396091 - DNA, 16 bp, M. musculus
ctgagccctctctctc

SEQ ID NO: 396092 - DNA, 16 bp, M. musculus
ctgagccctctctctg

SEQ ID NO: 396093 - DNA, 16 bp, M. musculus
ctgagccgtctcccca

SEQ ID NO: 396094 - DNA, 16 bp, M. musculus
ctgagccgtctctcca

SEQ ID NO: 396095 - DNA, 16 bp, M. musculus
ctgagccgtctcttca

SEQ ID NO: 396096 - DNA, 16 bp, M. musculus
ctgagcctcagctgct

SEQ ID NO: 396097 - DNA, 16 bp, M. musculus
ctgagcctcagtgtcc

SEQ ID NO: 396098 - DNA, 16 bp, M. musculus
ctgagcctcagtttcc

SEQ ID NO: 396099 - DNA, 16 bp, M. musculus
ctgagcctcctgcttc

SEQ ID NO: 396100 - DNA, 16 bp, M. musculus
ctgagcctggcctgac

SEQ ID NO: 396101 - DNA, 16 bp, M. musculus
ctgagccttccctcca

SEQ ID NO: 396102 - DNA, 16 bp, M. musculus
ctgagccttcttccca

SEQ ID NO: 396103 - DNA, 16 bp, M. musculus
ctgagcgagcagaggt

SEQ ID NO: 396104 - DNA, 16 bp, M. musculus
ctgagctacaaaggaa

SEQ ID NO: 396105 - DNA, 16 bp, M. musculus
ctgagctacaacccca

SEQ ID NO: 396106 - DNA, 16 bp, M. musculus
ctgagctacagagaga

SEQ ID NO: 396107 - DNA, 16 bp, M. musculus
ctgagctacagagtga

SEQ ID NO: 396108 - DNA, 16 bp, M. musculus
ctgagctacagccctg

SEQ ID NO: 396109 - DNA, 16 bp, M. musculus
ctgagctacatcccta

SEQ ID NO: 396110 - DNA, 16 bp, M. musculus
ctgagctacatctcca

SEQ ID NO: 396111 - DNA, 16 bp, M. musculus
ctgagctacatctgca

SEQ ID NO: 396112 - DNA, 16 bp, M. musculus
ctgagctacatgagat

SEQ ID NO: 396113 - DNA, 16 bp, M. musculus
ctgagctacctcccca

SEQ ID NO: 396114 - DNA, 16 bp, M. musculus
ctgagctacctcttca

SEQ ID NO: 396115 - DNA, 16 bp, M. musculus
ctgagctaggtcctct

SEQ ID NO: 396116 - DNA, 16 bp, M. musculus
ctgagctataacccca

SEQ ID NO: 396117 - DNA, 16 bp, M. musculus
ctgagctatagcccca

SEQ ID NO: 396118 - DNA, 16 bp, M. musculus
ctgagctatatcccca

SEQ ID NO: 396119 - DNA, 16 bp, M. musculus
ctgagctatctcccca

SEQ ID NO: 396120 - DNA, 16 bp, M. musculus
ctgagctatctctcca

SEQ ID NO: 396121 - DNA, 16 bp, M. musculus
ctgagctatcttgcca

SEQ ID NO: 396122 - DNA, 16 bp, M. musculus
ctgagctatgtcccca

SEQ ID NO: 396123 - DNA, 16 bp, M. musculus
ctgagctcagctcctc

SEQ ID NO: 396124 - DNA, 16 bp, M. musculus
ctgagctcatgtctct

SEQ ID NO: 396125 - DNA, 16 bp, M. musculus
ctgagctccaaacttt

SEQ ID NO: 396126 - DNA, 16 bp, M. musculus
ctgagctccagcccca

SEQ ID NO: 396127 - DNA, 16 bp, M. musculus
ctgagctccatcccca

SEQ ID NO: 396128 - DNA, 16 bp, M. musculus
ctgagctccctgggac

SEQ ID NO: 396129 - DNA, 16 bp, M. musculus
ctgagctcctcagctc

SEQ ID NO: 396130 - DNA, 16 bp, M. musculus
ctgagctcctggaagt

SEQ ID NO: 396131 - DNA, 17 bp, M. musculus
ctgagctcgtgcctgga

SEQ ID NO: 396132 - DNA, 16 bp, M. musculus
ctgagctctctctctc

SEQ ID NO: 396133 - DNA, 16 bp, M. musculus
ctgagctctgagctct

SEQ ID NO: 396134 - DNA, 16 bp, M. musculus
ctgagctctgagggga

SEQ ID NO: 396135 - DNA, 16 bp, M. musculus
ctgagctctggctggc

SEQ ID NO: 396136 - DNA, 16 bp, M. musculus
ctgagctcttgactct

SEQ ID NO: 396137 - DNA, 16 bp, M. musculus
ctgagctcttgtctct

SEQ ID NO: 396138 - DNA, 16 bp, M. musculus
ctgagctgacctcttc

SEQ ID NO: 396139 - DNA, 16 bp, M. musculus
ctgagctgcacagtga

SEQ ID NO: 396140 - DNA, 16 bp, M. musculus
ctgagctgcagcccag

SEQ ID NO: 396141 - DNA, 16 bp, M. musculus
ctgagctgcccttccc

SEQ ID NO: 396142 - DNA, 16 bp, M. musculus
ctgagctgcctctcca

SEQ ID NO: 396143 - DNA, 16 bp, M. musculus
ctgagctgcctgcaag

SEQ ID NO: 396144 - DNA, 16 bp, M. musculus
ctgagctgcctggaag

SEQ ID NO: 396145 - DNA, 16 bp, M. musculus
ctgagctgctgaagag

SEQ ID NO: 396146 - DNA, 16 bp, M. musculus
ctgagctgctgctgct

SEQ ID NO: 396147 - DNA, 16 bp, M. musculus
ctgagctggccttgaa

SEQ ID NO: 396148 - DNA, 16 bp, M. musculus
ctgagctgggtggtgg

SEQ ID NO: 396149 - DNA, 16 bp, M. musculus
ctgagctgtctcactg

SEQ ID NO: 396150 - DNA, 16 bp, M. musculus
ctgagctgtgtcccca

SEQ ID NO: 396151 - DNA, 16 bp, M. musculus
ctgagctgtgtctcta

SEQ ID NO: 396152 - DNA, 16 bp, M. musculus
ctgagcttggcacaaa

SEQ ID NO: 396153 - DNA, 16 bp, M. musculus
ctgaggaaaaaaaaag

SEQ ID NO: 396154 - DNA, 16 bp, M. musculus
ctgaggaaaagaaggt

SEQ ID NO: 396155 - DNA, 16 bp, M. musculus
ctgaggaaacacaaac

SEQ ID NO: 396156 - DNA, 16 bp, M. musculus
ctgaggaaacagactt

SEQ ID NO: 396157 - DNA, 16 bp, M. musculus
ctgaggaaagaaattg

SEQ ID NO: 396158 - DNA, 16 bp, M. musculus
ctgaggaaatcctgga

SEQ ID NO: 396159 - DNA, 16 bp, M. musculus
ctgaggaaccaccaga

SEQ ID NO: 396160 - DNA, 16 bp, M. musculus
ctgaggaacctgcaga

SEQ ID NO: 396161 - DNA, 16 bp, M. musculus
ctgaggaaccttcaga

SEQ ID NO: 396162 - DNA, 16 bp, M. musculus
ctgaggaactgcaaga

SEQ ID NO: 396163 - DNA, 16 bp, M. musculus
ctgaggaagaagaaaa

SEQ ID NO: 396164 - DNA, 16 bp, M. musculus
ctgaggaagagctgag

SEQ ID NO: 396165 - DNA, 16 bp, M. musculus
ctgaggaagatatcag

SEQ ID NO: 396166 - DNA, 16 bp, M. musculus
ctgaggaagctccaga

SEQ ID NO: 396167 - DNA, 16 bp, M. musculus
ctgaggaaggagctga

SEQ ID NO: 396168 - DNA, 16 bp, M. musculus
ctgaggaaggaggatt

SEQ ID NO: 396169 - DNA, 16 bp, M. musculus
ctgaggaagtgctctg

SEQ ID NO: 396170 - DNA, 16 bp, M. musculus
ctgaggaatactgaat

SEQ ID NO: 396171 - DNA, 16 bp, M. musculus
ctgaggaatgctggga

SEQ ID NO: 396172 - DNA, 16 bp, M. musculus
ctgaggacaaagagaa

SEQ ID NO: 396173 - DNA, 16 bp, M. musculus
ctgaggacaccaagaa

SEQ ID NO: 396174 - DNA, 16 bp, M. musculus
ctgaggacaccaggca

SEQ ID NO: 396175 - DNA, 16 bp, M. musculus
ctgaggacatagctca

SEQ ID NO: 396176 - DNA, 16 bp, M. musculus
ctgaggacctgagttc

SEQ ID NO: 396177 - DNA, 16 bp, M. musculus
ctgaggactcagctat

SEQ ID NO: 396178 - DNA, 16 bp, M. musculus
ctgaggagacagaggc

SEQ ID NO: 396179 - DNA, 16 bp, M. musculus
ctgaggagagagagca

SEQ ID NO: 396180 - DNA, 16 bp, M. musculus
ctgaggagagagctgg

SEQ ID NO: 396181 - DNA, 16 bp, M. musculus
ctgaggagagctgtgt

SEQ ID NO: 396182 - DNA, 17 bp, M. musculus
ctgaggagcccatcttc

SEQ ID NO: 396183 - DNA, 16 bp, M. musculus
ctgaggagcctccaga

SEQ ID NO: 396184 - DNA, 16 bp, M. musculus
ctgaggagctgccaga

SEQ ID NO: 396185 - DNA, 16 bp, M. musculus
ctgaggagctggagag

SEQ ID NO: 396186 - DNA, 16 bp, M. musculus
ctgaggaggaaagggt

SEQ ID NO: 396187 - DNA, 16 bp, M. musculus
ctgaggaggaatgaag

SEQ ID NO: 396188 - DNA, 16 bp, M. musculus
ctgaggaggagagcaa

SEQ ID NO: 396189 - DNA, 16 bp, M. musculus
ctgaggaggaggaaga

SEQ ID NO: 396190 - DNA, 16 bp, M. musculus
ctgaggaggagggcaa

SEQ ID NO: 396191 - DNA, 16 bp, M. musculus
ctgaggaggagggcag

SEQ ID NO: 396192 - DNA, 16 bp, M. musculus
ctgaggaggagttcaa

SEQ ID NO: 396193 - DNA, 16 bp, M. musculus
ctgaggaggcagaagc

SEQ ID NO: 396194 - DNA, 16 bp, M. musculus
ctgaggaggccagatg

SEQ ID NO: 396195 - DNA, 16 bp, M. musculus
ctgaggagggcaggag

SEQ ID NO: 396196 - DNA, 16 bp, M. musculus
ctgaggataaccttga

SEQ ID NO: 396197 - DNA, 16 bp, M. musculus
ctgaggatcaaaccca

SEQ ID NO: 396198 - DNA, 16 bp, M. musculus
ctgaggatccaactca

SEQ ID NO: 396199 - DNA, 16 bp, M. musculus
ctgaggatgaaactca

SEQ ID NO: 396200 - DNA, 16 bp, M. musculus
ctgaggatgatgccct

SEQ ID NO: 396201 - DNA, 16 bp, M. musculus
ctgaggatgctgagga

SEQ ID NO: 396202 - DNA, 16 bp, M. musculus
ctgaggatggctttga

SEQ ID NO: 396203 - DNA, 16 bp, M. musculus
ctgaggatgtggagaa

SEQ ID NO: 396204 - DNA, 16 bp, M. musculus
ctgaggattaaactca

SEQ ID NO: 396205 - DNA, 16 bp, M. musculus
ctgaggcaagaggaca

SEQ ID NO: 396206 - DNA, 16 bp, M. musculus
ctgaggcaagaggatc

SEQ ID NO: 396207 - DNA, 16 bp, M. musculus
ctgaggcaagggcaat

SEQ ID NO: 396208 - DNA, 16 bp, M. musculus
ctgaggcaagtggatc

SEQ ID NO: 396209 - DNA, 16 bp, M. musculus
ctgaggcacatcccca

SEQ ID NO: 396210 - DNA, 16 bp, M. musculus
ctgaggcagaaggatc

SEQ ID NO: 396211 - DNA, 16 bp, M. musculus
ctgaggcagaccctgt

SEQ ID NO: 396212 - DNA, 16 bp, M. musculus
ctgaggcagaggcaga

SEQ ID NO: 396213 - DNA, 16 bp, M. musculus
ctgaggcagaggcagg

SEQ ID NO: 396214 - DNA, 16 bp, M. musculus
ctgaggcagaggtcag

SEQ ID NO: 396215 - DNA, 16 bp, M. musculus
ctgaggcaggaagaca

SEQ ID NO: 396216 - DNA, 16 bp, M. musculus
ctgaggcaggaagatc

SEQ ID NO: 396217 - DNA, 16 bp, M. musculus
ctgaggcaggaagatg

SEQ ID NO: 396218 - DNA, 16 bp, M. musculus
ctgaggcaggagaact

SEQ ID NO: 396219 - DNA, 16 bp, M. musculus
ctgaggcaggagaagg

SEQ ID NO: 396220 - DNA, 16 bp, M. musculus
ctgaggcaggagaatt

SEQ ID NO: 396221 - DNA, 16 bp, M. musculus
ctgaggcaggagactc

SEQ ID NO: 396222 - DNA, 16 bp, M. musculus
ctgaggcaggagactg

SEQ ID NO: 396223 - DNA, 16 bp, M. musculus
ctgaggcaggaggaga

SEQ ID NO: 396224 - DNA, 16 bp, M. musculus
ctgaggcaggaggagc

SEQ ID NO: 396225 - DNA, 16 bp, M. musculus
ctgaggcaggaggagg

SEQ ID NO: 396226 - DNA, 16 bp, M. musculus
ctgaggcaggagggtt

SEQ ID NO: 396227 - DNA, 16 bp, M. musculus
ctgaggcaggcagcca

SEQ ID NO: 396228 - DNA, 16 bp, M. musculus
ctgaggcaggggagtg

SEQ ID NO: 396229 - DNA, 16 bp, M. musculus
ctgaggcagggtctcc

SEQ ID NO: 396230 - DNA, 16 bp, M. musculus
ctgaggcatataatct

SEQ ID NO: 396231 - DNA, 16 bp, M. musculus
ctgaggcatatgaagt

SEQ ID NO: 396232 - DNA, 16 bp, M. musculus
ctgaggccagaagagg

SEQ ID NO: 396233 - DNA, 16 bp, M. musculus
ctgaggccagacaagg

SEQ ID NO: 396234 - DNA, 16 bp, M. musculus
ctgaggccagagaagg

SEQ ID NO: 396235 - DNA, 16 bp, M. musculus
ctgaggccagaggagg

SEQ ID NO: 396236 - DNA, 16 bp, M. musculus
ctgaggccagcctgga

SEQ ID NO: 396237 - DNA, 16 bp, M. musculus
ctgaggcccagagaga

SEQ ID NO: 396238 - DNA, 16 bp, M. musculus
ctgaggcccagagagg

SEQ ID NO: 396239 - DNA, 16 bp, M. musculus
ctgaggccccaaatat

SEQ ID NO: 396240 - DNA, 16 bp, M. musculus
ctgaggcccccagcac

SEQ ID NO: 396241 - DNA, 16 bp, M. musculus
ctgaggcccctgacac

SEQ ID NO: 396242 - DNA, 16 bp, M. musculus
ctgaggcctctctcct

SEQ ID NO: 396243 - DNA, 16 bp, M. musculus
ctgaggcctgagcgag

SEQ ID NO: 396244 - DNA, 16 bp, M. musculus
ctgaggcctgagtgag

SEQ ID NO: 396245 - DNA, 16 bp, M. musculus
ctgaggcctggctgtt

SEQ ID NO: 396246 - DNA, 20 bp, M. musculus
ctgaggctaaggtgaagaga

SEQ ID NO: 396247 - DNA, 16 bp, M. musculus
ctgaggctagaccagg

SEQ ID NO: 396248 - DNA, 16 bp, M. musculus
ctgaggctatggaatg

SEQ ID NO: 396249 - DNA, 16 bp, M. musculus
ctgaggctcagagaaa

SEQ ID NO: 396250 - DNA, 16 bp, M. musculus
ctgaggctgaagcagg

SEQ ID NO: 396251 - DNA, 16 bp, M. musculus
ctgaggctgacaaagt

SEQ ID NO: 396252 - DNA, 16 bp, M. musculus
ctgaggctgaccttga

SEQ ID NO: 396253 - DNA, 16 bp, M. musculus
ctgaggctgaggcagg

SEQ ID NO: 396254 - DNA, 16 bp, M. musculus
ctgaggctgaggcctg

SEQ ID NO: 396255 - DNA, 16 bp, M. musculus
ctgaggctgcatcttc

SEQ ID NO: 396256 - DNA, 16 bp, M. musculus
ctgaggctggacaagg

SEQ ID NO: 396257 - DNA, 16 bp, M. musculus
ctgaggctggaggatt

SEQ ID NO: 396258 - DNA, 16 bp, M. musculus
ctgaggctgtggagca

SEQ ID NO: 396259 - DNA, 16 bp, M. musculus
ctgaggcttggaagct

SEQ ID NO: 396260 - DNA, 16 bp, M. musculus
ctgaggcttggcacca

SEQ ID NO: 396261 - DNA, 16 bp, M. musculus
ctgagggaagtcaggg

SEQ ID NO: 396262 - DNA, 16 bp, M. musculus
ctgagggaccagccac

SEQ ID NO: 396263 - DNA, 16 bp, M. musculus
ctgagggactctgcca

SEQ ID NO: 396264 - DNA, 16 bp, M. musculus
ctgagggagactcatt

SEQ ID NO: 396265 - DNA, 16 bp, M. musculus
ctgagggagctgaagg

SEQ ID NO: 396266 - DNA, 16 bp, M. musculus
ctgagggaggaggctg

SEQ ID NO: 396267 - DNA, 16 bp, M. musculus
ctgagggatgctggga

SEQ ID NO: 396268 - DNA, 16 bp, M. musculus
ctgagggatggggcca

SEQ ID NO: 396269 - DNA, 16 bp, M. musculus
ctgagggcagaccagg

SEQ ID NO: 396270 - DNA, 16 bp, M. musculus
ctgagggccagcaaaa

SEQ ID NO: 396271 - DNA, 16 bp, M. musculus
ctgagggccagcagga

SEQ ID NO: 396272 - DNA, 16 bp, M. musculus
ctgagggcctgcagaa

SEQ ID NO: 396273 - DNA, 16 bp, M. musculus
ctgaggggctggtgag

SEQ ID NO: 396274 - DNA, 16 bp, M. musculus
ctgaggggtctgggtt

SEQ ID NO: 396275 - DNA, 16 bp, M. musculus
ctgagggtcctgggcc

SEQ ID NO: 396276 - DNA, 16 bp, M. musculus
ctgagggtcttaaagc

SEQ ID NO: 396277 - DNA, 16 bp, M. musculus
ctgagggtgactttga

SEQ ID NO: 396278 - DNA, 16 bp, M. musculus
ctgagggtgatttgaa

SEQ ID NO: 396279 - DNA, 16 bp, M. musculus
ctgagggtggccttga

SEQ ID NO: 396280 - DNA, 16 bp, M. musculus
ctgaggtaggaagatc

SEQ ID NO: 396281 - DNA, 16 bp, M. musculus
ctgaggtccttcccaa

SEQ ID NO: 396282 - DNA, 16 bp, M. musculus
ctgaggtctctcaaac

SEQ ID NO: 396283 - DNA, 16 bp, M. musculus
ctgaggtcttcttcaa

SEQ ID NO: 396284 - DNA, 18 bp, M. musculus
ctgaggtgactgccctgc

SEQ ID NO: 396285 - DNA, 16 bp, M. musculus
ctgaggtgagcaggtg

SEQ ID NO: 396286 - DNA, 16 bp, M. musculus
ctgaggtgcatatttt

SEQ ID NO: 396287 - DNA, 16 bp, M. musculus
ctgaggtgctgggaat

SEQ ID NO: 396288 - DNA, 16 bp, M. musculus
ctgaggtggaggagga

SEQ ID NO: 396289 - DNA, 16 bp, M. musculus
ctgaggtggaggcagg

SEQ ID NO: 396290 - DNA, 16 bp, M. musculus
ctgaggtgggagtact

SEQ ID NO: 396291 - DNA, 16 bp, M. musculus
ctgaggtgggagtggg

SEQ ID NO: 396292 - DNA, 16 bp, M. musculus
ctgaggtgtctgaaga

SEQ ID NO: 396293 - DNA, 16 bp, M. musculus
ctgaggtgtggctcag

SEQ ID NO: 396294 - DNA, 16 bp, M. musculus
ctgaggttcagagagg

SEQ ID NO: 396295 - DNA, 16 bp, M. musculus
ctgaggttcctcttcc

SEQ ID NO: 396296 - DNA, 16 bp, M. musculus
ctgaggttgcctgttt

SEQ ID NO: 396297 - DNA, 17 bp, M. musculus
ctgaggtttcctcattg

SEQ ID NO: 396298 - DNA, 16 bp, M. musculus
ctgaggttttggtctt

SEQ ID NO: 396299 - DNA, 16 bp, M. musculus
ctgagtaagaacctct

SEQ ID NO: 396300 - DNA, 16 bp, M. musculus
ctgagtagcagcttgt

SEQ ID NO: 396301 - DNA, 16 bp, M. musculus
ctgagtaggtagagat

SEQ ID NO: 396302 - DNA, 16 bp, M. musculus
ctgagtatatctatcc

SEQ ID NO: 396303 - DNA, 16 bp, M. musculus
ctgagtatatttttat

SEQ ID NO: 396304 - DNA, 16 bp, M. musculus
ctgagtattgggatta

SEQ ID NO: 396305 - DNA, 16 bp, M. musculus
ctgagtcaaatgactt

SEQ ID NO: 396306 - DNA, 16 bp, M. musculus
ctgagtcactgagcca

SEQ ID NO: 396307 - DNA, 16 bp, M. musculus
ctgagtcagagagtct

SEQ ID NO: 396308 - DNA, 16 bp, M. musculus
ctgagtcagctcctgg

SEQ ID NO: 396309 - DNA, 16 bp, M. musculus
ctgagtcagggtttct

SEQ ID NO: 396310 - DNA, 16 bp, M. musculus
ctgagtcatctcactg

SEQ ID NO: 396311 - DNA, 16 bp, M. musculus
ctgagtcatctcctca

SEQ ID NO: 396312 - DNA, 16 bp, M. musculus
ctgagtcatctctcca

SEQ ID NO: 396313 - DNA, 16 bp, M. musculus
ctgagtcatctctccg

SEQ ID NO: 396314 - DNA, 16 bp, M. musculus
ctgagtcatctctctg

SEQ ID NO: 396315 - DNA, 16 bp, M. musculus
ctgagtcatcttgcca

SEQ ID NO: 396316 - DNA, 16 bp, M. musculus
ctgagtcatctttcta

SEQ ID NO: 396317 - DNA, 16 bp, M. musculus
ctgagtccaggaacca

SEQ ID NO: 396318 - DNA, 16 bp, M. musculus
ctgagtcccagtgatc

SEQ ID NO: 396319 - DNA, 16 bp, M. musculus
ctgagtcctgagagtc

SEQ ID NO: 396320 - DNA, 16 bp, M. musculus
ctgagtcctttcaata

SEQ ID NO: 396321 - DNA, 16 bp, M. musculus
ctgagtccttttttag

SEQ ID NO: 396322 - DNA, 16 bp, M. musculus
ctgagtctcagtttct

SEQ ID NO: 396323 - DNA, 16 bp, M. musculus
ctgagtctggggtctt

SEQ ID NO: 396324 - DNA, 16 bp, M. musculus
ctgagtcttcaggtag

SEQ ID NO: 396325 - DNA, 16 bp, M. musculus
ctgagtgaatgaatga

SEQ ID NO: 396326 - DNA, 16 bp, M. musculus
ctgagtgaggtaagcc

SEQ ID NO: 396327 - DNA, 16 bp, M. musculus
ctgagtgagtgagtga

SEQ ID NO: 396328 - DNA, 16 bp, M. musculus
ctgagtgcagctgatc

SEQ ID NO: 396329 - DNA, 16 bp, M. musculus
ctgagtgccaagatta

SEQ ID NO: 396330 - DNA, 16 bp, M. musculus
ctgagtgccctgacag

SEQ ID NO: 396331 - DNA, 16 bp, M. musculus
ctgagtgctaggattg

SEQ ID NO: 396332 - DNA, 16 bp, M. musculus
ctgagtgctggcatta

SEQ ID NO: 396333 - DNA, 16 bp, M. musculus
ctgagtgctgggactt

SEQ ID NO: 396334 - DNA, 16 bp, M. musculus
ctgagtgctgggatta

SEQ ID NO: 396335 - DNA, 17 bp, M. musculus
ctgagtgctgggattat

SEQ ID NO: 396336 - DNA, 16 bp, M. musculus
ctgagtggagattcta

SEQ ID NO: 396337 - DNA, 16 bp, M. musculus
ctgagtgggaaagggg

SEQ ID NO: 396338 - DNA, 16 bp, M. musculus
ctgagtgggaggccag

SEQ ID NO: 396339 - DNA, 16 bp, M. musculus
ctgagtgtaaaaagac

SEQ ID NO: 396340 - DNA, 16 bp, M. musculus
ctgagttacatcccca

SEQ ID NO: 396341 - DNA, 16 bp, M. musculus
ctgagttcaaaaccca

SEQ ID NO: 396342 - DNA, 16 bp, M. musculus
ctgagttcaaagacag

SEQ ID NO: 396343 - DNA, 16 bp, M. musculus
ctgagttcaaagtcag

SEQ ID NO: 396344 - DNA, 16 bp, M. musculus
ctgagttcaaatgcca

SEQ ID NO: 396345 - DNA, 16 bp, M. musculus
ctgagttcaaattccc

SEQ ID NO: 396346 - DNA, 16 bp, M. musculus
ctgagttcaagcccca

SEQ ID NO: 396347 - DNA, 16 bp, M. musculus
ctgagttcaagggcag

SEQ ID NO: 396348 - DNA, 16 bp, M. musculus
ctgagttcaattcctg

SEQ ID NO: 396349 - DNA, 16 bp, M. musculus
ctgagttcagacccca

SEQ ID NO: 396350 - DNA, 16 bp, M. musculus
ctgagttccaagccag

SEQ ID NO: 396351 - DNA, 16 bp, M. musculus
ctgagttccaccccca

SEQ ID NO: 396352 - DNA, 16 bp, M. musculus
ctgagttccaggacag

SEQ ID NO: 396353 - DNA, 18 bp, M. musculus
ctgagttccaggccagct

SEQ ID NO: 396354 - DNA, 16 bp, M. musculus
ctgagttccatccaat

SEQ ID NO: 396355 - DNA, 16 bp, M. musculus
ctgagttccatttcca

SEQ ID NO: 396356 - DNA, 16 bp, M. musculus
ctgagttcctgccttg

SEQ ID NO: 396357 - DNA, 16 bp, M. musculus
ctgagttctagaccag

SEQ ID NO: 396358 - DNA, 16 bp, M. musculus
ctgagttctagcccca

SEQ ID NO: 396359 - DNA, 16 bp, M. musculus
ctgagttctgagttca

SEQ ID NO: 396360 - DNA, 16 bp, M. musculus
ctgagttcttcttcaa

SEQ ID NO: 396361 - DNA, 16 bp, M. musculus
ctgagttgcaggccag

SEQ ID NO: 396362 - DNA, 16 bp, M. musculus
ctgagttggattccca

SEQ ID NO: 396363 - DNA, 16 bp, M. musculus
ctgagttgtattccat

SEQ ID NO: 396364 - DNA, 16 bp, M. musculus
ctgagttgtatttggt

SEQ ID NO: 396365 - DNA, 16 bp, M. musculus
ctgagtttaaaaaaaa

SEQ ID NO: 396366 - DNA, 16 bp, M. musculus
ctgagtttaaggccag

SEQ ID NO: 396367 - DNA, 16 bp, M. musculus
ctgagtttaataccca

SEQ ID NO: 396368 - DNA, 16 bp, M. musculus
ctgagtttcagtggtc

SEQ ID NO: 396369 - DNA, 16 bp, M. musculus
ctgagtttctgccctg

SEQ ID NO: 396370 - DNA, 16 bp, M. musculus
ctgagtttgaatccag

SEQ ID NO: 396371 - DNA, 16 bp, M. musculus
ctgagtttgaatccct

SEQ ID NO: 396372 - DNA, 16 bp, M. musculus
ctgagtttgacccctg

SEQ ID NO: 396373 - DNA, 16 bp, M. musculus
ctgagtttgagaccac

SEQ ID NO: 396374 - DNA, 16 bp, M. musculus
ctgagtttgaggacag

SEQ ID NO: 396375 - DNA, 21 bp, M. musculus
ctgagtttgaggctagcctgg

SEQ ID NO: 396376 - DNA, 16 bp, M. musculus
ctgagtttgaggtcag

SEQ ID NO: 396377 - DNA, 16 bp, M. musculus
ctgagtttgagtccag

SEQ ID NO: 396378 - DNA, 16 bp, M. musculus
ctgagtttgatcccaa

SEQ ID NO: 396379 - DNA, 16 bp, M. musculus
ctgagtttgatctcca

SEQ ID NO: 396380 - DNA, 16 bp, M. musculus
ctgagtttgatcttca

SEQ ID NO: 396381 - DNA, 16 bp, M. musculus
ctgagtttgatgccca

SEQ ID NO: 396382 - DNA, 16 bp, M. musculus
ctgagtttggtttcca

SEQ ID NO: 396383 - DNA, 16 bp, M. musculus
ctgataaaatagaggt

SEQ ID NO: 396384 - DNA, 16 bp, M. musculus
ctgataaacaagttca

SEQ ID NO: 396385 - DNA, 23 bp, M. musculus
ctgataagtatctgtacttcccc

SEQ ID NO: 396386 - DNA, 16 bp, M. musculus
ctgatacagctttctc

SEQ ID NO: 396387 - DNA, 16 bp, M. musculus
ctgataccaattttcc

SEQ ID NO: 396388 - DNA, 16 bp, M. musculus
ctgatagccaacatca

SEQ ID NO: 396389 - DNA, 16 bp, M. musculus
ctgatatcctcttctg

SEQ ID NO: 396390 - DNA, 16 bp, M. musculus
ctgatatcttcctcaa

SEQ ID NO: 396391 - DNA, 16 bp, M. musculus
ctgatatgtgacccct

SEQ ID NO: 396392 - DNA, 16 bp, M. musculus
ctgatattctctcttc

SEQ ID NO: 396393 - DNA, 17 bp, M. musculus
ctgatcaaagctcaaat

SEQ ID NO: 396394 - DNA, 16 bp, M. musculus
ctgatcacactcactt

SEQ ID NO: 396395 - DNA, 16 bp, M. musculus
ctgatcagcctgagtt

SEQ ID NO: 396396 - DNA, 18 bp, M. musculus
ctgatcagtcagaaccca

SEQ ID NO: 396397 - DNA, 16 bp, M. musculus
ctgatcatcctgcctc

SEQ ID NO: 396398 - DNA, 16 bp, M. musculus
ctgatccacaggcagg

SEQ ID NO: 396399 - DNA, 16 bp, M. musculus
ctgatcccaggagatc

SEQ ID NO: 396400 - DNA, 16 bp, M. musculus
ctgatcctcagacctc

SEQ ID NO: 396401 - DNA, 16 bp, M. musculus
ctgatcctcagtcctc

SEQ ID NO: 396402 - DNA, 16 bp, M. musculus
ctgatcctcctgcccc

SEQ ID NO: 396403 - DNA, 16 bp, M. musculus
ctgatcctcctgctcc

SEQ ID NO: 396404 - DNA, 16 bp, M. musculus
ctgatcctcctgcttc

SEQ ID NO: 396405 - DNA, 16 bp, M. musculus
ctgatcctcctgtctc

SEQ ID NO: 396406 - DNA, 16 bp, M. musculus
ctgatcctctgaaaga

SEQ ID NO: 396407 - DNA, 16 bp, M. musculus
ctgatccttctgcctc

SEQ ID NO: 396408 - DNA, 16 bp, M. musculus
ctgatctacagaatga

SEQ ID NO: 396409 - DNA, 16 bp, M. musculus
ctgatctccatacatg

SEQ ID NO: 396410 - DNA, 16 bp, M. musculus
ctgatctctacacaca

SEQ ID NO: 396411 - DNA, 16 bp, M. musculus
ctgatctgcaataaca

SEQ ID NO: 396412 - DNA, 16 bp, M. musculus
ctgatctgcaggcagc

SEQ ID NO: 396413 - DNA, 16 bp, M. musculus
ctgatcttcaataaaa

SEQ ID NO: 396414 - DNA, 17 bp, M. musculus
ctgatcttcaataacaa

SEQ ID NO: 396415 - DNA, 16 bp, M. musculus
ctgatcttccagagaa

SEQ ID NO: 396416 - DNA, 16 bp, M. musculus
ctgatcttcctgcttc

SEQ ID NO: 396417 - DNA, 16 bp, M. musculus
ctgatcttcctgtctc

SEQ ID NO: 396418 - DNA, 16 bp, M. musculus
ctgatcttcttgcttc

SEQ ID NO: 396419 - DNA, 16 bp, M. musculus
ctgatcttgaacttgt

SEQ ID NO: 396420 - DNA, 16 bp, M. musculus
ctgatcttggttgtca

SEQ ID NO: 396421 - DNA, 16 bp, M. musculus
ctgatgacctcttttg

SEQ ID NO: 396422 - DNA, 16 bp, M. musculus
ctgatgacctgagttg

SEQ ID NO: 396423 - DNA, 16 bp, M. musculus
ctgatgacctgggttc

SEQ ID NO: 396424 - DNA, 16 bp, M. musculus
ctgatgactaagaact

SEQ ID NO: 396425 - DNA, 16 bp, M. musculus
ctgatgagaagtctgg

SEQ ID NO: 396426 - DNA, 16 bp, M. musculus
ctgatgagccatcttg

SEQ ID NO: 396427 - DNA, 16 bp, M. musculus
ctgatgatgatgagtg

SEQ ID NO: 396428 - DNA, 29 bp, M. musculus
ctgatgattaaggatgttgaacatttttt

SEQ ID NO: 396429 - DNA, 16 bp, M. musculus
ctgatgcagaagccat

SEQ ID NO: 396430 - DNA, 16 bp, M. musculus
ctgatgccaagaaaca

SEQ ID NO: 396431 - DNA, 16 bp, M. musculus
ctgatgccaagaagcg

SEQ ID NO: 396432 - DNA, 16 bp, M. musculus
ctgatgccatcttctg

SEQ ID NO: 396433 - DNA, 16 bp, M. musculus
ctgatgcccaggaatc

SEQ ID NO: 396434 - DNA, 16 bp, M. musculus
ctgatgcccctccaca

SEQ ID NO: 396435 - DNA, 16 bp, M. musculus
ctgatgccctctctgg

SEQ ID NO: 396436 - DNA, 16 bp, M. musculus
ctgatgccctcttcta

SEQ ID NO: 396437 - DNA, 16 bp, M. musculus
ctgatgccctcttctc

SEQ ID NO: 396438 - DNA, 16 bp, M. musculus
ctgatgccctcttctt

SEQ ID NO: 396439 - DNA, 16 bp, M. musculus
ctgatgctcctttctc

SEQ ID NO: 396440 - DNA, 16 bp, M. musculus
ctgatgctctattctg

SEQ ID NO: 396441 - DNA, 16 bp, M. musculus
ctgatgctcttttctg

SEQ ID NO: 396442 - DNA, 16 bp, M. musculus
ctgatgctggtgctgg

SEQ ID NO: 396443 - DNA, 16 bp, M. musculus
ctgatgctttcttctg

SEQ ID NO: 396444 - DNA, 16 bp, M. musculus
ctgatggaaactgatg

SEQ ID NO: 396445 - DNA, 16 bp, M. musculus
ctgatggaaagagatg

SEQ ID NO: 396446 - DNA, 16 bp, M. musculus
ctgatggaagagcaaa

SEQ ID NO: 396447 - DNA, 16 bp, M. musculus
ctgatggaatttttag

SEQ ID NO: 396448 - DNA, 16 bp, M. musculus
ctgatggaggcaattt

SEQ ID NO: 396449 - DNA, 16 bp, M. musculus
ctgatggccacacacc

SEQ ID NO: 396450 - DNA, 16 bp, M. musculus
ctgatggcctcttctg

SEQ ID NO: 396451 - DNA, 16 bp, M. musculus
ctgatggctctgggca

SEQ ID NO: 396452 - DNA, 16 bp, M. musculus
ctgatggcttctggaa

SEQ ID NO: 396453 - DNA, 16 bp, M. musculus
ctgatggcttcttctg

SEQ ID NO: 396454 - DNA, 16 bp, M. musculus
ctgatgtagaaaatct

SEQ ID NO: 396455 - DNA, 16 bp, M. musculus
ctgatgtcccacaagg

SEQ ID NO: 396456 - DNA, 17 bp, M. musculus
ctgatgtcctctaccat

SEQ ID NO: 396457 - DNA, 16 bp, M. musculus
ctgatgtcctctcctg

SEQ ID NO: 396458 - DNA, 16 bp, M. musculus
ctgatgtcctcttctg

SEQ ID NO: 396459 - DNA, 16 bp, M. musculus
ctgatgtcctcttctt

SEQ ID NO: 396460 - DNA, 16 bp, M. musculus
ctgatgtcctgaccac

SEQ ID NO: 396461 - DNA, 16 bp, M. musculus
ctgatgtctggagcct

SEQ ID NO: 396462 - DNA, 16 bp, M. musculus
ctgatgtctttttctg

SEQ ID NO: 396463 - DNA, 16 bp, M. musculus
ctgatgtgcctgaaga

SEQ ID NO: 396464 - DNA, 16 bp, M. musculus
ctgatgtgcctttcct

SEQ ID NO: 396465 - DNA, 16 bp, M. musculus
ctgatgtgggtgctgg

SEQ ID NO: 396466 - DNA, 16 bp, M. musculus
ctgatgtgggtgcttg

SEQ ID NO: 396467 - DNA, 16 bp, M. musculus
ctgatgttctctttct

SEQ ID NO: 396468 - DNA, 16 bp, M. musculus
ctgatgttctcttttg

SEQ ID NO: 396469 - DNA, 16 bp, M. musculus
ctgatgtttggctatg

SEQ ID NO: 396470 - DNA, 16 bp, M. musculus
ctgatgtttggttgtg

SEQ ID NO: 396471 - DNA, 16 bp, M. musculus
ctgattaaaaaaaaat

SEQ ID NO: 396472 - DNA, 16 bp, M. musculus
ctgattaaaaaaataa

SEQ ID NO: 396473 - DNA, 16 bp, M. musculus
ctgattaataaatata

SEQ ID NO: 396474 - DNA, 16 bp, M. musculus
ctgattatcttggttt

SEQ ID NO: 396475 - DNA, 16 bp, M. musculus
ctgattatggtgtgga

SEQ ID NO: 396476 - DNA, 16 bp, M. musculus
ctgattcatgtttgct

SEQ ID NO: 396477 - DNA, 16 bp, M. musculus
ctgattccacttaggg

SEQ ID NO: 396478 - DNA, 16 bp, M. musculus
ctgattccagtttcta

SEQ ID NO: 396479 - DNA, 16 bp, M. musculus
ctgattccctcttctg

SEQ ID NO: 396480 - DNA, 16 bp, M. musculus
ctgattcctgtttgct

SEQ ID NO: 396481 - DNA, 16 bp, M. musculus
ctgattctcctgcctc

SEQ ID NO: 396482 - DNA, 16 bp, M. musculus
ctgattctctcttctg

SEQ ID NO: 396483 - DNA, 16 bp, M. musculus
ctgattctcttgcctc

SEQ ID NO: 396484 - DNA, 16 bp, M. musculus
ctgattcttacaatct

SEQ ID NO: 396485 - DNA, 23 bp, M. musculus
ctgattcttcagccccagctaac

SEQ ID NO: 396486 - DNA, 16 bp, M. musculus
ctgattcttcagccct

SEQ ID NO: 396487 - DNA, 16 bp, M. musculus
ctgattcttctgcctc

SEQ ID NO: 396488 - DNA, 16 bp, M. musculus
ctgattcttcttcttc

SEQ ID NO: 396489 - DNA, 16 bp, M. musculus
ctgattgccaccatct

SEQ ID NO: 396490 - DNA, 16 bp, M. musculus
ctgattggctgctctc

SEQ ID NO: 396491 - DNA, 16 bp, M. musculus
ctgattggtggctcag

SEQ ID NO: 396492 - DNA, 16 bp, M. musculus
ctgatttaaaaaaaaa

SEQ ID NO: 396493 - DNA, 16 bp, M. musculus
ctgatttaaaatcaca

SEQ ID NO: 396494 - DNA, 16 bp, M. musculus
ctgatttagaaaaata

SEQ ID NO: 396495 - DNA, 16 bp, M. musculus
ctgatttccacagtgg

SEQ ID NO: 396496 - DNA, 16 bp, M. musculus
ctgatttctgagtttg

SEQ ID NO: 396497 - DNA, 16 bp, M. musculus
ctgattttatgttgag

SEQ ID NO: 396498 - DNA, 16 bp, M. musculus
ctgattttattaattt

SEQ ID NO: 396499 - DNA, 16 bp, M. musculus
ctgattttctcaaaga

SEQ ID NO: 396500 - DNA, 16 bp, M. musculus
ctgattttgtgaatta

SEQ ID NO: 396501 - DNA, 16 bp, M. musculus
ctgcaaaacaaacaaa

SEQ ID NO: 396502 - DNA, 16 bp, M. musculus
ctgcaaaactcagaat

SEQ ID NO: 396503 - DNA, 16 bp, M. musculus
ctgcaaaagcaggaag

SEQ ID NO: 396504 - DNA, 16 bp, M. musculus
ctgcaaacaggttttt

SEQ ID NO: 396505 - DNA, 16 bp, M. musculus
ctgcaaacatgaggac

SEQ ID NO: 396506 - DNA, 16 bp, M. musculus
ctgcaaacccagcact

SEQ ID NO: 396507 - DNA, 16 bp, M. musculus
ctgcaaaccccttcat

SEQ ID NO: 396508 - DNA, 16 bp, M. musculus
ctgcaaagcaaaagac

SEQ ID NO: 396509 - DNA, 16 bp, M. musculus
ctgcaaagcaaaagat

SEQ ID NO: 396510 - DNA, 16 bp, M. musculus
ctgcaaagcccttcag

SEQ ID NO: 396511 - DNA, 16 bp, M. musculus
ctgcaaatagtcatat

SEQ ID NO: 396512 - DNA, 16 bp, M. musculus
ctgcaaatgaatgctc

SEQ ID NO: 396513 - DNA, 16 bp, M. musculus
ctgcaaattcaaggcc

SEQ ID NO: 396514 - DNA, 16 bp, M. musculus
ctgcaaatttcataaa

SEQ ID NO: 396515 - DNA, 16 bp, M. musculus
ctgcaacaacaaaaat

SEQ ID NO: 396516 - DNA, 16 bp, M. musculus
ctgcaacaacaacaac

SEQ ID NO: 396517 - DNA, 17 bp, M. musculus
ctgcaacaggatccttc

SEQ ID NO: 396518 - DNA, 25 bp, M. musculus
ctgcaaccctataggtggaacaaca

SEQ ID NO: 396519 - DNA, 16 bp, M. musculus
ctgcaaccctgcaggt

SEQ ID NO: 396520 - DNA, 16 bp, M. musculus
ctgcaacctgtctctg

SEQ ID NO: 396521 - DNA, 16 bp, M. musculus
ctgcaactccagtttc

SEQ ID NO: 396522 - DNA, 16 bp, M. musculus
ctgcaactgccactct

SEQ ID NO: 396523 - DNA, 16 bp, M. musculus
ctgcaactgtcttttc

SEQ ID NO: 396524 - DNA, 16 bp, M. musculus
ctgcaagaaattttca

SEQ ID NO: 396525 - DNA, 16 bp, M. musculus
ctgcaagaacaggaag

SEQ ID NO: 396526 - DNA, 16 bp, M. musculus
ctgcaagaagaagctt

SEQ ID NO: 396527 - DNA, 16 bp, M. musculus
ctgcaagagaagcaag

SEQ ID NO: 396528 - DNA, 16 bp, M. musculus
ctgcaagagcaacgag

SEQ ID NO: 396529 - DNA, 16 bp, M. musculus
ctgcaagagcagaaag

SEQ ID NO: 396530 - DNA, 16 bp, M. musculus
ctgcaagagcagcaac

SEQ ID NO: 396531 - DNA, 16 bp, M. musculus
ctgcaagagcagtaag

SEQ ID NO: 396532 - DNA, 16 bp, M. musculus
ctgcaagagcagtatg

SEQ ID NO: 396533 - DNA, 16 bp, M. musculus
ctgcaagagcatccag

SEQ ID NO: 396534 - DNA, 16 bp, M. musculus
ctgcaagaggagagct

SEQ ID NO: 396535 - DNA, 16 bp, M. musculus
ctgcaagcagcagaat

SEQ ID NO: 396536 - DNA, 16 bp, M. musculus
ctgcaagccagcccca

SEQ ID NO: 396537 - DNA, 16 bp, M. musculus
ctgcaagctcacttgg

SEQ ID NO: 396538 - DNA, 16 bp, M. musculus
ctgcaagctcagaacc

SEQ ID NO: 396539 - DNA, 16 bp, M. musculus
ctgcaaggaacccctc

SEQ ID NO: 396540 - DNA, 16 bp, M. musculus
ctgcaagtacaacatg

SEQ ID NO: 396541 - DNA, 16 bp, M. musculus
ctgcaagtctgtgtgt

SEQ ID NO: 396542 - DNA, 16 bp, M. musculus
ctgcaataaataaata

SEQ ID NO: 396543 - DNA, 16 bp, M. musculus
ctgcaatcccagcacc

SEQ ID NO: 396544 - DNA, 16 bp, M. musculus
ctgcaatccccattgc

SEQ ID NO: 396545 - DNA, 16 bp, M. musculus
ctgcaatcctagcact

SEQ ID NO: 396546 - DNA, 25 bp, M. musculus
ctgcaatcctataggtggaacaaca

SEQ ID NO: 396547 - DNA, 16 bp, M. musculus
ctgcaatctcagcatt

SEQ ID NO: 396548 - DNA, 16 bp, M. musculus
ctgcaatgccagcact

SEQ ID NO: 396549 - DNA, 16 bp, M. musculus
ctgcaattttgtgatt

SEQ ID NO: 396550 - DNA, 16 bp, M. musculus
ctgcacaagggaactg

SEQ ID NO: 396551 - DNA, 16 bp, M. musculus
ctgcacacaaacacac

SEQ ID NO: 396552 - DNA, 16 bp, M. musculus
ctgcacacacacaagc

SEQ ID NO: 396553 - DNA, 16 bp, M. musculus
ctgcacacatgtggtg

SEQ ID NO: 396554 - DNA, 16 bp, M. musculus
ctgcacaccacacaca

SEQ ID NO: 396555 - DNA, 16 bp, M. musculus
ctgcacactttgtctc

SEQ ID NO: 396556 - DNA, 16 bp, M. musculus
ctgcacagacatcttg

SEQ ID NO: 396557 - DNA, 16 bp, M. musculus
ctgcacagatcagctc

SEQ ID NO: 396558 - DNA, 16 bp, M. musculus
ctgcacagcagcctgg

SEQ ID NO: 396559 - DNA, 16 bp, M. musculus
ctgcacagccacagtg

SEQ ID NO: 396560 - DNA, 16 bp, M. musculus
ctgcacagccctggct

SEQ ID NO: 396561 - DNA, 16 bp, M. musculus
ctgcacatatataaca

SEQ ID NO: 396562 - DNA, 16 bp, M. musculus
ctgcacatatgtagca

SEQ ID NO: 396563 - DNA, 16 bp, M. musculus
ctgcacatatgttaca

SEQ ID NO: 396564 - DNA, 16 bp, M. musculus
ctgcacatcatcacct

SEQ ID NO: 396565 - DNA, 16 bp, M. musculus
ctgcaccaaacccatc

SEQ ID NO: 396566 - DNA, 16 bp, M. musculus
ctgcaccaggcctgcc

SEQ ID NO: 396567 - DNA, 16 bp, M. musculus
ctgcacccaaggctca

SEQ ID NO: 396568 - DNA, 16 bp, M. musculus
ctgcacccatcagctg

SEQ ID NO: 396569 - DNA, 16 bp, M. musculus
ctgcacccctgggatg

SEQ ID NO: 396570 - DNA, 16 bp, M. musculus
ctgcacctggagctga

SEQ ID NO: 396571 - DNA, 16 bp, M. musculus
ctgcacctgtttccat

SEQ ID NO: 396572 - DNA, 16 bp, M. musculus
ctgcaccttttttttt

SEQ ID NO: 396573 - DNA, 16 bp, M. musculus
ctgcactcaagtgcac

SEQ ID NO: 396574 - DNA, 16 bp, M. musculus
ctgcactccagccaca

SEQ ID NO: 396575 - DNA, 16 bp, M. musculus
ctgcactgccacctga

SEQ ID NO: 396576 - DNA, 16 bp, M. musculus
ctgcactgctctctct

SEQ ID NO: 396577 - DNA, 16 bp, M. musculus
ctgcactgggcagagc

SEQ ID NO: 396578 - DNA, 16 bp, M. musculus
ctgcacttcttgtaga

SEQ ID NO: 396579 - DNA, 16 bp, M. musculus
ctgcacttttctctgt

SEQ ID NO: 396580 - DNA, 16 bp, M. musculus
ctgcagaaaatcaaat

SEQ ID NO: 396581 - DNA, 16 bp, M. musculus
ctgcagaaatccaggt

SEQ ID NO: 396582 - DNA, 16 bp, M. musculus
ctgcagaagaatctgg

SEQ ID NO: 396583 - DNA, 16 bp, M. musculus
ctgcagaagagaaagc

SEQ ID NO: 396584 - DNA, 16 bp, M. musculus
ctgcagaagccagcag

SEQ ID NO: 396585 - DNA, 16 bp, M. musculus
ctgcagaagctgctgg

SEQ ID NO: 396586 - DNA, 16 bp, M. musculus
ctgcagaaggagctga

SEQ ID NO: 396587 - DNA, 16 bp, M. musculus
ctgcagaaggatctgg

SEQ ID NO: 396588 - DNA, 16 bp, M. musculus
ctgcagaatctccatg

SEQ ID NO: 396589 - DNA, 16 bp, M. musculus
ctgcagaattctatca

SEQ ID NO: 396590 - DNA, 16 bp, M. musculus
ctgcagacaaaatact

SEQ ID NO: 396591 - DNA, 16 bp, M. musculus
ctgcagacatgatgga

SEQ ID NO: 396592 - DNA, 16 bp, M. musculus
ctgcagacctgggaga

SEQ ID NO: 396593 - DNA, 16 bp, M. musculus
ctgcagactggccctt

SEQ ID NO: 396594 - DNA, 16 bp, M. musculus
ctgcagagaaggctca

SEQ ID NO: 396595 - DNA, 16 bp, M. musculus
ctgcagagaatattct

SEQ ID NO: 396596 - DNA, 16 bp, M. musculus
ctgcagagactgcctg

SEQ ID NO: 396597 - DNA, 16 bp, M. musculus
ctgcagagagagcaga

SEQ ID NO: 396598 - DNA, 16 bp, M. musculus
ctgcagagagggctca

SEQ ID NO: 396599 - DNA, 16 bp, M. musculus
ctgcagagaggtgtgt

SEQ ID NO: 396600 - DNA, 16 bp, M. musculus
ctgcagagcacagctc

SEQ ID NO: 396601 - DNA, 16 bp, M. musculus
ctgcagagcaggctgg

SEQ ID NO: 396602 - DNA, 16 bp, M. musculus
ctgcagagctcccagg

SEQ ID NO: 396603 - DNA, 16 bp, M. musculus
ctgcagaggaccagag

SEQ ID NO: 396604 - DNA, 16 bp, M. musculus
ctgcagaggacctgag

SEQ ID NO: 396605 - DNA, 16 bp, M. musculus
ctgcagaggactcagg

SEQ ID NO: 396606 - DNA, 16 bp, M. musculus
ctgcagaggcagaggc

SEQ ID NO: 396607 - DNA, 16 bp, M. musculus
ctgcagaggcaggcag

SEQ ID NO: 396608 - DNA, 16 bp, M. musculus
ctgcagaggccagaag

SEQ ID NO: 396609 - DNA, 16 bp, M. musculus
ctgcagaggccagaga

SEQ ID NO: 396610 - DNA, 16 bp, M. musculus
ctgcagaggccagagg

SEQ ID NO: 396611 - DNA, 16 bp, M. musculus
ctgcagaggccagatg

SEQ ID NO: 396612 - DNA, 16 bp, M. musculus
ctgcagaggctgaggc

SEQ ID NO: 396613 - DNA, 16 bp, M. musculus
ctgcagagtccagaag

SEQ ID NO: 396614 - DNA, 16 bp, M. musculus
ctgcagagtgagtttc

SEQ ID NO: 396615 - DNA, 16 bp, M. musculus
ctgcagagttctgctg

SEQ ID NO: 396616 - DNA, 16 bp, M. musculus
ctgcagagtttgcacc

SEQ ID NO: 396617 - DNA, 16 bp, M. musculus
ctgcagatcaggctgg

SEQ ID NO: 396618 - DNA, 16 bp, M. musculus
ctgcagatccaaagct

SEQ ID NO: 396619 - DNA, 16 bp, M. musculus
ctgcagatgtggcaga

SEQ ID NO: 396620 - DNA, 16 bp, M. musculus
ctgcagattgaccttg

SEQ ID NO: 396621 - DNA, 16 bp, M. musculus
ctgcagattgtcctct

SEQ ID NO: 396622 - DNA, 16 bp, M. musculus
ctgcagcaaatgggaa

SEQ ID NO: 396623 - DNA, 16 bp, M. musculus
ctgcagcacacacagc

SEQ ID NO: 396624 - DNA, 16 bp, M. musculus
ctgcagcactcaggaa

SEQ ID NO: 396625 - DNA, 16 bp, M. musculus
ctgcagcactctggag

SEQ ID NO: 396626 - DNA, 16 bp, M. musculus
ctgcagcagacaggaa

SEQ ID NO: 396627 - DNA, 16 bp, M. musculus
ctgcagcagcagaagc

SEQ ID NO: 396628 - DNA, 16 bp, M. musculus
ctgcagcagctgctgc

SEQ ID NO: 396629 - DNA, 16 bp, M. musculus
ctgcagcaggagccac

SEQ ID NO: 396630 - DNA, 16 bp, M. musculus
ctgcagcaggcaggag

SEQ ID NO: 396631 - DNA, 16 bp, M. musculus
ctgcagcagggacagc

SEQ ID NO: 396632 - DNA, 16 bp, M. musculus
ctgcagccaggagaga

SEQ ID NO: 396633 - DNA, 16 bp, M. musculus
ctgcagcccatcagcc

SEQ ID NO: 396634 - DNA, 16 bp, M. musculus
ctgcagccctgcagcc

SEQ ID NO: 396635 - DNA, 16 bp, M. musculus
ctgcagccctggctgt

SEQ ID NO: 396636 - DNA, 16 bp, M. musculus
ctgcagcctcagcctc

SEQ ID NO: 396637 - DNA, 16 bp, M. musculus
ctgcagcctgccctcc

SEQ ID NO: 396638 - DNA, 16 bp, M. musculus
ctgcagcctggccctt

SEQ ID NO: 396639 - DNA, 16 bp, M. musculus
ctgcagccttccttcc

SEQ ID NO: 396640 - DNA, 16 bp, M. musculus
ctgcagctcaggctgg

SEQ ID NO: 396641 - DNA, 16 bp, M. musculus
ctgcagctccaggaga

SEQ ID NO: 396642 - DNA, 16 bp, M. musculus
ctgcagctccaggcct

SEQ ID NO: 396643 - DNA, 16 bp, M. musculus
ctgcagctcctcctgc

SEQ ID NO: 396644 - DNA, 16 bp, M. musculus
ctgcagctgaacccaa

SEQ ID NO: 396645 - DNA, 16 bp, M. musculus
ctgcagctgaacttgg

SEQ ID NO: 396646 - DNA, 16 bp, M. musculus
ctgcagctgctgaatc

SEQ ID NO: 396647 - DNA, 16 bp, M. musculus
ctgcagctgctgagtc

SEQ ID NO: 396648 - DNA, 16 bp, M. musculus
ctgcagctgctgcttc

SEQ ID NO: 396649 - DNA, 16 bp, M. musculus
ctgcagctgctgggag

SEQ ID NO: 396650 - DNA, 16 bp, M. musculus
ctgcagctggccttca

SEQ ID NO: 396651 - DNA, 16 bp, M. musculus
ctgcagctggtgaggg

SEQ ID NO: 396652 - DNA, 17 bp, M. musculus
ctgcagctgtccacttc

SEQ ID NO: 396653 - DNA, 37 bp, M. musculus
ctgcagctgtccacttctgggtggtgcctgcataacg

SEQ ID NO: 396654 - DNA, 16 bp, M. musculus
ctgcagcttcgtctgc

SEQ ID NO: 396655 - DNA, 16 bp, M. musculus
ctgcagcttcttgctg

SEQ ID NO: 396656 - DNA, 16 bp, M. musculus
ctgcaggagcagcaaa

SEQ ID NO: 396657 - DNA, 16 bp, M. musculus
ctgcaggagcagccag

SEQ ID NO: 396658 - DNA, 16 bp, M. musculus
ctgcaggaggatgcag

SEQ ID NO: 396659 - DNA, 16 bp, M. musculus
ctgcaggcaagctctc

SEQ ID NO: 396660 - DNA, 16 bp, M. musculus
ctgcaggcactgcaca

SEQ ID NO: 396661 - DNA, 16 bp, M. musculus
ctgcaggcagcaagga

SEQ ID NO: 396662 - DNA, 16 bp, M. musculus
ctgcaggcagcagcag

SEQ ID NO: 396663 - DNA, 16 bp, M. musculus
ctgcaggcaggaggca

SEQ ID NO: 396664 - DNA, 16 bp, M. musculus
ctgcaggcaggcaggc

SEQ ID NO: 396665 - DNA, 16 bp, M. musculus
ctgcaggcatcaggaa

SEQ ID NO: 396666 - DNA, 16 bp, M. musculus
ctgcaggccacgcccc

SEQ ID NO: 396667 - DNA, 16 bp, M. musculus
ctgcaggccagctctc

SEQ ID NO: 396668 - DNA, 16 bp, M. musculus
ctgcaggccaggctgg

SEQ ID NO: 396669 - DNA, 16 bp, M. musculus
ctgcaggctgagaatg

SEQ ID NO: 396670 - DNA, 16 bp, M. musculus
ctgcaggctggctcca

SEQ ID NO: 396671 - DNA, 16 bp, M. musculus
ctgcaggctgtgcagt

SEQ ID NO: 396672 - DNA, 16 bp, M. musculus
ctgcagggaagccagg

SEQ ID NO: 396673 - DNA, 16 bp, M. musculus
ctgcagggccacagac

SEQ ID NO: 396674 - DNA, 16 bp, M. musculus
ctgcagggcttcccaa

SEQ ID NO: 396675 - DNA, 16 bp, M. musculus
ctgcaggggctgtggg

SEQ ID NO: 396676 - DNA, 16 bp, M. musculus
ctgcagggtctgggtt

SEQ ID NO: 396677 - DNA, 16 bp, M. musculus
ctgcaggtgctgtcac

SEQ ID NO: 396678 - DNA, 16 bp, M. musculus
ctgcaggtggccccac

SEQ ID NO: 396679 - DNA, 16 bp, M. musculus
ctgcaggttcccaggc

SEQ ID NO: 396680 - DNA, 16 bp, M. musculus
ctgcagtacaccacca

SEQ ID NO: 396681 - DNA, 16 bp, M. musculus
ctgcagtagccattct

SEQ ID NO: 396682 - DNA, 16 bp, M. musculus
ctgcagtcttccccag

SEQ ID NO: 396683 - DNA, 16 bp, M. musculus
ctgcagtgacttgagg

SEQ ID NO: 396684 - DNA, 16 bp, M. musculus
ctgcagtgacttgatg

SEQ ID NO: 396685 - DNA, 16 bp, M. musculus
ctgcagtgcagctttc

SEQ ID NO: 396686 - DNA, 16 bp, M. musculus
ctgcagtgctgtgtga

SEQ ID NO: 396687 - DNA, 16 bp, M. musculus
ctgcagtgggacttgg

SEQ ID NO: 396688 - DNA, 16 bp, M. musculus
ctgcagtgtgtgtgtg

SEQ ID NO: 396689 - DNA, 16 bp, M. musculus
ctgcagttccaggaga

SEQ ID NO: 396690 - DNA, 16 bp, M. musculus
ctgcagttccagggga

SEQ ID NO: 396691 - DNA, 16 bp, M. musculus
ctgcagttctttttga

SEQ ID NO: 396692 - DNA, 16 bp, M. musculus
ctgcatagtgagaccc

SEQ ID NO: 396693 - DNA, 16 bp, M. musculus
ctgcatataaagtttg

SEQ ID NO: 396694 - DNA, 16 bp, M. musculus
ctgcatatatatatat

SEQ ID NO: 396695 - DNA, 16 bp, M. musculus
ctgcatatcagatatt

SEQ ID NO: 396696 - DNA, 17 bp, M. musculus
ctgcatatgaatcagaa

SEQ ID NO: 396697 - DNA, 16 bp, M. musculus
ctgcatatgtatccaa

SEQ ID NO: 396698 - DNA, 16 bp, M. musculus
ctgcatatgtgcaggg

SEQ ID NO: 396699 - DNA, 16 bp, M. musculus
ctgcatattagatatt

SEQ ID NO: 396700 - DNA, 16 bp, M. musculus
ctgcatcaactcctgc

SEQ ID NO: 396701 - DNA, 16 bp, M. musculus
ctgcatcagctcctgg

SEQ ID NO: 396702 - DNA, 16 bp, M. musculus
ctgcatcagcttctac

SEQ ID NO: 396703 - DNA, 16 bp, M. musculus
ctgcatcagcttctgc

SEQ ID NO: 396704 - DNA, 16 bp, M. musculus
ctgcatcaggtgggag

SEQ ID NO: 396705 - DNA, 16 bp, M. musculus
ctgcatccccagccct

SEQ ID NO: 396706 - DNA, 16 bp, M. musculus
ctgcatccctactgtg

SEQ ID NO: 396707 - DNA, 16 bp, M. musculus
ctgcatccctggaatg

SEQ ID NO: 396708 - DNA, 16 bp, M. musculus
ctgcatccctggatga

SEQ ID NO: 396709 - DNA, 16 bp, M. musculus
ctgcatcctgcaccct

SEQ ID NO: 396710 - DNA, 16 bp, M. musculus
ctgcatcctggccctg

SEQ ID NO: 396711 - DNA, 16 bp, M. musculus
ctgcatctatttcttt

SEQ ID NO: 396712 - DNA, 16 bp, M. musculus
ctgcatctcaagtgct

SEQ ID NO: 396713 - DNA, 16 bp, M. musculus
ctgcatctcagtgtct

SEQ ID NO: 396714 - DNA, 16 bp, M. musculus
ctgcatctctctctct

SEQ ID NO: 396715 - DNA, 16 bp, M. musculus
ctgcatctgagtcttt

SEQ ID NO: 396716 - DNA, 16 bp, M. musculus
ctgcatctgcttcctg

SEQ ID NO: 396717 - DNA, 16 bp, M. musculus
ctgcatctgttgccat

SEQ ID NO: 396718 - DNA, 16 bp, M. musculus
ctgcatcttcatgtct

SEQ ID NO: 396719 - DNA, 16 bp, M. musculus
ctgcatgaaatggaca

SEQ ID NO: 396720 - DNA, 16 bp, M. musculus
ctgcatgacctctgtc

SEQ ID NO: 396721 - DNA, 16 bp, M. musculus
ctgcatgactgatagt

SEQ ID NO: 396722 - DNA, 16 bp, M. musculus
ctgcatgccaaaagag

SEQ ID NO: 396723 - DNA, 16 bp, M. musculus
ctgcatgccaccatgc

SEQ ID NO: 396724 - DNA, 16 bp, M. musculus
ctgcatgccaggcaag

SEQ ID NO: 396725 - DNA, 16 bp, M. musculus
ctgcatgtaagtctgt

SEQ ID NO: 396726 - DNA, 16 bp, M. musculus
ctgcatgtatgtacat

SEQ ID NO: 396727 - DNA, 16 bp, M. musculus
ctgcatgtatgtatgt

SEQ ID NO: 396728 - DNA, 16 bp, M. musculus
ctgcatgtcacctgca

SEQ ID NO: 396729 - DNA, 16 bp, M. musculus
ctgcatgtgcacacac

SEQ ID NO: 396730 - DNA, 16 bp, M. musculus
ctgcatgtggaggtca

SEQ ID NO: 396731 - DNA, 16 bp, M. musculus
ctgcatgtgtgtctgt

SEQ ID NO: 396732 - DNA, 16 bp, M. musculus
ctgcattccatccaga

SEQ ID NO: 396733 - DNA, 16 bp, M. musculus
ctgcattcttttcttt

SEQ ID NO: 396734 - DNA, 16 bp, M. musculus
ctgcatttatgtctgt

SEQ ID NO: 396735 - DNA, 16 bp, M. musculus
ctgcatttcctggatg

SEQ ID NO: 396736 - DNA, 16 bp, M. musculus
ctgcatttcttttata

SEQ ID NO: 396737 - DNA, 16 bp, M. musculus
ctgcatttctttttct

SEQ ID NO: 396738 - DNA, 16 bp, M. musculus
ctgcatttggaagctg

SEQ ID NO: 396739 - DNA, 16 bp, M. musculus
ctgcattttattttta

SEQ ID NO: 396740 - DNA, 16 bp, M. musculus
ctgcattttctctctc

SEQ ID NO: 396741 - DNA, 16 bp, M. musculus
ctgcatttttttttaa

SEQ ID NO: 396742 - DNA, 16 bp, M. musculus
ctgccaaattcattct

SEQ ID NO: 396743 - DNA, 16 bp, M. musculus
ctgccaacagcagaga

SEQ ID NO: 396744 - DNA, 16 bp, M. musculus
ctgccaagcctgagga

SEQ ID NO: 396745 - DNA, 16 bp, M. musculus
ctgccaagcctggcaa

SEQ ID NO: 396746 - DNA, 16 bp, M. musculus
ctgccaaggagagctg

SEQ ID NO: 396747 - DNA, 16 bp, M. musculus
ctgccaaggatgtgga

SEQ ID NO: 396748 - DNA, 16 bp, M. musculus
ctgccaagtctgatga

SEQ ID NO: 396749 - DNA, 16 bp, M. musculus
ctgccaagttctactg

SEQ ID NO: 396750 - DNA, 16 bp, M. musculus
ctgccaatcctgatga

SEQ ID NO: 396751 - DNA, 16 bp, M. musculus
ctgccacacccagcct

SEQ ID NO: 396752 - DNA, 16 bp, M. musculus
ctgccacacctggcct

SEQ ID NO: 396753 - DNA, 16 bp, M. musculus
ctgccacagctgccac

SEQ ID NO: 396754 - DNA, 16 bp, M. musculus
ctgccacatatgcagc

SEQ ID NO: 396755 - DNA, 16 bp, M. musculus
ctgccacatatgtgcc

SEQ ID NO: 396756 - DNA, 16 bp, M. musculus
ctgccaccaagcctaa

SEQ ID NO: 396757 - DNA, 16 bp, M. musculus
ctgccaccaccaccac

SEQ ID NO: 396758 - DNA, 16 bp, M. musculus
ctgccaccaccactgc

SEQ ID NO: 396759 - DNA, 16 bp, M. musculus
ctgccaccaccatcac

SEQ ID NO: 396760 - DNA, 16 bp, M. musculus
ctgccaccagggccag

SEQ ID NO: 396761 - DNA, 16 bp, M. musculus
ctgccacctcctcctc

SEQ ID NO: 396762 - DNA, 16 bp, M. musculus
ctgccacctctgcctc

SEQ ID NO: 396763 - DNA, 16 bp, M. musculus
ctgccacctgctggcc

SEQ ID NO: 396764 - DNA, 16 bp, M. musculus
ctgccacctggcctga

SEQ ID NO: 396765 - DNA, 16 bp, M. musculus
ctgccacgtggatgct

SEQ ID NO: 396766 - DNA, 16 bp, M. musculus
ctgccactcccactgc

SEQ ID NO: 396767 - DNA, 16 bp, M. musculus
ctgccactgaggccag

SEQ ID NO: 396768 - DNA, 16 bp, M. musculus
ctgccactgccaccac

SEQ ID NO: 396769 - DNA, 16 bp, M. musculus
ctgccactgccactgc

SEQ ID NO: 396770 - DNA, 16 bp, M. musculus
ctgccactgcccagct

SEQ ID NO: 396771 - DNA, 16 bp, M. musculus
ctgccactgcctcctg

SEQ ID NO: 396772 - DNA, 16 bp, M. musculus
ctgccactgcctctgc

SEQ ID NO: 396773 - DNA, 16 bp, M. musculus
ctgccactgcctggct

SEQ ID NO: 396774 - DNA, 16 bp, M. musculus
ctgccactgctgccac

SEQ ID NO: 396775 - DNA, 16 bp, M. musculus
ctgccactgctgctac

SEQ ID NO: 396776 - DNA, 16 bp, M. musculus
ctgccactggagaaga

SEQ ID NO: 396777 - DNA, 16 bp, M. musculus
ctgccactttcctaaa

SEQ ID NO: 396778 - DNA, 16 bp, M. musculus
ctgccagaaggccttc

SEQ ID NO: 396779 - DNA, 16 bp, M. musculus
ctgccagaatgtcagc

SEQ ID NO: 396780 - DNA, 16 bp, M. musculus
ctgccagagactgaca

SEQ ID NO: 396781 - DNA, 16 bp, M. musculus
ctgccagagcatgaca

SEQ ID NO: 396782 - DNA, 16 bp, M. musculus
ctgccagagcctgact

SEQ ID NO: 396783 - DNA, 16 bp, M. musculus
ctgccagagcctgtca

SEQ ID NO: 396784 - DNA, 16 bp, M. musculus
ctgccagagcttgacc

SEQ ID NO: 396785 - DNA, 16 bp, M. musculus
ctgccagagttccagt

SEQ ID NO: 396786 - DNA, 16 bp, M. musculus
ctgccagcacatctgt

SEQ ID NO: 396787 - DNA, 16 bp, M. musculus
ctgccagcagccttca

SEQ ID NO: 396788 - DNA, 16 bp, M. musculus
ctgccagcagcttctg

SEQ ID NO: 396789 - DNA, 16 bp, M. musculus
ctgccagcctctgcct

SEQ ID NO: 396790 - DNA, 16 bp, M. musculus
ctgccagcctctgctt

SEQ ID NO: 396791 - DNA, 16 bp, M. musculus
ctgccagctcccccac

SEQ ID NO: 396792 - DNA, 16 bp, M. musculus
ctgccagctgcagatt

SEQ ID NO: 396793 - DNA, 16 bp, M. musculus
ctgccaggaggtaggt

SEQ ID NO: 396794 - DNA, 16 bp, M. musculus
ctgccaggagtccagt

SEQ ID NO: 396795 - DNA, 16 bp, M. musculus
ctgccagggctacaca

SEQ ID NO: 396796 - DNA, 20 bp, M. musculus
ctgccagtcagaagaggagg

SEQ ID NO: 396797 - DNA, 16 bp, M. musculus
ctgccagtctctctgt

SEQ ID NO: 396798 - DNA, 16 bp, M. musculus
ctgccagttatgccag

SEQ ID NO: 396799 - DNA, 20 bp, M. musculus
ctgccatacccagggatcca

SEQ ID NO: 396800 - DNA, 16 bp, M. musculus
ctgccatacctggaga

SEQ ID NO: 396801 - DNA, 16 bp, M. musculus
ctgccatatctgggaa

SEQ ID NO: 396802 - DNA, 16 bp, M. musculus
ctgccatcaccaccac

SEQ ID NO: 396803 - DNA, 16 bp, M. musculus
ctgccatcccagcact

SEQ ID NO: 396804 - DNA, 16 bp, M. musculus
ctgccatccctgggct

SEQ ID NO: 396805 - DNA, 16 bp, M. musculus
ctgccatccttcctgc

SEQ ID NO: 396806 - DNA, 16 bp, M. musculus
ctgccatctgctctgc

SEQ ID NO: 396807 - DNA, 16 bp, M. musculus
ctgccatgatgacagt

SEQ ID NO: 396808 - DNA, 16 bp, M. musculus
ctgccatgatgataat

SEQ ID NO: 396809 - DNA, 16 bp, M. musculus
ctgccatgcccagcct

SEQ ID NO: 396810 - DNA, 16 bp, M. musculus
ctgccatgcccccacc

SEQ ID NO: 396811 - DNA, 16 bp, M. musculus
ctgccatgcctcctgc

SEQ ID NO: 396812 - DNA, 16 bp, M. musculus
ctgccatgccttctct

SEQ ID NO: 396813 - DNA, 17 bp, M. musculus
ctgccatgctcccacct

SEQ ID NO: 396814 - DNA, 19 bp, M. musculus
ctgccatgctcccaccttt

SEQ ID NO: 396815 - DNA, 16 bp, M. musculus
ctgccatgcttcctgc

SEQ ID NO: 396816 - DNA, 16 bp, M. musculus
ctgccatggctgctgg

SEQ ID NO: 396817 - DNA, 16 bp, M. musculus
ctgccatgggagatgc

SEQ ID NO: 396818 - DNA, 16 bp, M. musculus
ctgccatggtcatggt

SEQ ID NO: 396819 - DNA, 16 bp, M. musculus
ctgccatggtcccacc

SEQ ID NO: 396820 - DNA, 16 bp, M. musculus
ctgccatgtgggtgcc

SEQ ID NO: 396821 - DNA, 16 bp, M. musculus
ctgccatgtgggtgct

SEQ ID NO: 396822 - DNA, 16 bp, M. musculus
ctgccatgttttctgc

SEQ ID NO: 396823 - DNA, 16 bp, M. musculus
ctgccattaaaaattt

SEQ ID NO: 396824 - DNA, 16 bp, M. musculus
ctgccatttgatttcc

SEQ ID NO: 396825 - DNA, 16 bp, M. musculus
ctgccattttgtgctg

SEQ ID NO: 396826 - DNA, 16 bp, M. musculus
ctgcccaactattggc

SEQ ID NO: 396827 - DNA, 16 bp, M. musculus
ctgcccacagtgaact

SEQ ID NO: 396828 - DNA, 16 bp, M. musculus
ctgcccacagtgagct

SEQ ID NO: 396829 - DNA, 16 bp, M. musculus
ctgcccacagtggcct

SEQ ID NO: 396830 - DNA, 16 bp, M. musculus
ctgcccacctctgcct

SEQ ID NO: 396831 - DNA, 16 bp, M. musculus
ctgcccacctgcccac

SEQ ID NO: 396832 - DNA, 16 bp, M. musculus
ctgcccactctctcac

SEQ ID NO: 396833 - DNA, 16 bp, M. musculus
ctgcccactgcaaaaa

SEQ ID NO: 396834 - DNA, 16 bp, M. musculus
ctgcccacttgcctct

SEQ ID NO: 396835 - DNA, 16 bp, M. musculus
ctgcccactttccccc

SEQ ID NO: 396836 - DNA, 16 bp, M. musculus
ctgcccagaacatcat

SEQ ID NO: 396837 - DNA, 16 bp, M. musculus
ctgcccagaaggctgg

SEQ ID NO: 396838 - DNA, 16 bp, M. musculus
ctgcccagagccatgt

SEQ ID NO: 396839 - DNA, 16 bp, M. musculus
ctgcccagattgtggc

SEQ ID NO: 396840 - DNA, 16 bp, M. musculus
ctgcccagccattggc

SEQ ID NO: 396841 - DNA, 16 bp, M. musculus
ctgcccagcccagccc

SEQ ID NO: 396842 - DNA, 16 bp, M. musculus
ctgcccaggaccttct

SEQ ID NO: 396843 - DNA, 16 bp, M. musculus
ctgcccaggctactat

SEQ ID NO: 396844 - DNA, 16 bp, M. musculus
ctgcccagggatggca

SEQ ID NO: 396845 - DNA, 16 bp, M. musculus
ctgcccagtcattggc

SEQ ID NO: 396846 - DNA, 16 bp, M. musculus
ctgcccagtgctggga

SEQ ID NO: 396847 - DNA, 16 bp, M. musculus
ctgccccaacttcctt

SEQ ID NO: 396848 - DNA, 16 bp, M. musculus
ctgccccacagccctg

SEQ ID NO: 396849 - DNA, 16 bp, M. musculus
ctgccccaccacaggg

SEQ ID NO: 396850 - DNA, 16 bp, M. musculus
ctgccccacctgcaga

SEQ ID NO: 396851 - DNA, 16 bp, M. musculus
ctgccccacctggaaa

SEQ ID NO: 396852 - DNA, 16 bp, M. musculus
ctgccccacctgggga

SEQ ID NO: 396853 - DNA, 16 bp, M. musculus
ctgccccagccccagc

SEQ ID NO: 396854 - DNA, 16 bp, M. musculus
ctgccccagccctggg

SEQ ID NO: 396855 - DNA, 16 bp, M. musculus
ctgccccagcctccct

SEQ ID NO: 396856 - DNA, 16 bp, M. musculus
ctgccccagcctcctg

SEQ ID NO: 396857 - DNA, 16 bp, M. musculus
ctgccccagctgcccc

SEQ ID NO: 396858 - DNA, 16 bp, M. musculus
ctgccccagctgggga

SEQ ID NO: 396859 - DNA, 16 bp, M. musculus
ctgccccagcttcctg

SEQ ID NO: 396860 - DNA, 16 bp, M. musculus
ctgccccatccctcct

SEQ ID NO: 396861 - DNA, 16 bp, M. musculus
ctgccccatcctcctt

SEQ ID NO: 396862 - DNA, 16 bp, M. musculus
ctgcccccaggttcct

SEQ ID NO: 396863 - DNA, 16 bp, M. musculus
ctgcccccagtgacac

SEQ ID NO: 396864 - DNA, 16 bp, M. musculus
ctgccccccacacaca

SEQ ID NO: 396865 - DNA, 16 bp, M. musculus
ctgccccctggtggcc

SEQ ID NO: 396866 - DNA, 17 bp, M. musculus
ctgccccggccaccaaa

SEQ ID NO: 396867 - DNA, 16 bp, M. musculus
ctgcccctcccccaaa

SEQ ID NO: 396868 - DNA, 16 bp, M. musculus
ctgcccctctgacaag

SEQ ID NO: 396869 - DNA, 16 bp, M. musculus
ctgcccctctggagtg

SEQ ID NO: 396870 - DNA, 16 bp, M. musculus
ctgcccctgatgcttc

SEQ ID NO: 396871 - DNA, 16 bp, M. musculus
ctgcccctgcatgtgt

SEQ ID NO: 396872 - DNA, 16 bp, M. musculus
ctgcccctgccttctg

SEQ ID NO: 396873 - DNA, 16 bp, M. musculus
ctgcccctgcgtctgc

SEQ ID NO: 396874 - DNA, 16 bp, M. musculus
ctgcccctgctcacca

SEQ ID NO: 396875 - DNA, 16 bp, M. musculus
ctgcccctggagcaga

SEQ ID NO: 396876 - DNA, 16 bp, M. musculus
ctgcccctgggacagg

SEQ ID NO: 396877 - DNA, 16 bp, M. musculus
ctgcccctgtgccctc

SEQ ID NO: 396878 - DNA, 16 bp, M. musculus
ctgccccttgttcacc

SEQ ID NO: 396879 - DNA, 16 bp, M. musculus
ctgcccgcctgcctgc

SEQ ID NO: 396880 - DNA, 16 bp, M. musculus
ctgcccggatgctgcc

SEQ ID NO: 396881 - DNA, 16 bp, M. musculus
ctgcccggcgcgggag

SEQ ID NO: 396882 - DNA, 16 bp, M. musculus
ctgcccgtctctgcct

SEQ ID NO: 396883 - DNA, 16 bp, M. musculus
ctgccctcacttccct

SEQ ID NO: 396884 - DNA, 16 bp, M. musculus
ctgccctcagaaagac

SEQ ID NO: 396885 - DNA, 16 bp, M. musculus
ctgccctcagtgggag

SEQ ID NO: 396886 - DNA, 16 bp, M. musculus
ctgccctcagttcccc

SEQ ID NO: 396887 - DNA, 16 bp, M. musculus
ctgccctcatggctct

SEQ ID NO: 396888 - DNA, 16 bp, M. musculus
ctgccctccctgcaga

SEQ ID NO: 396889 - DNA, 16 bp, M. musculus
ctgccctcgaattccc

SEQ ID NO: 396890 - DNA, 16 bp, M. musculus
ctgccctctcagagaa

SEQ ID NO: 396891 - DNA, 16 bp, M. musculus
ctgccctctgactgtt

SEQ ID NO: 396892 - DNA, 16 bp, M. musculus
ctgccctctgcggagt

SEQ ID NO: 396893 - DNA, 16 bp, M. musculus
ctgccctctgctcctg

SEQ ID NO: 396894 - DNA, 16 bp, M. musculus
ctgccctctgctctct

SEQ ID NO: 396895 - DNA, 16 bp, M. musculus
ctgccctctgctggcc

SEQ ID NO: 396896 - DNA, 16 bp, M. musculus
ctgccctctgtctctc

SEQ ID NO: 396897 - DNA, 16 bp, M. musculus
ctgccctcttctggcc

SEQ ID NO: 396898 - DNA, 16 bp, M. musculus
ctgccctgaaagagga

SEQ ID NO: 396899 - DNA, 16 bp, M. musculus
ctgccctgactgccct

SEQ ID NO: 396900 - DNA, 16 bp, M. musculus
ctgccctgacttccct

SEQ ID NO: 396901 - DNA, 16 bp, M. musculus
ctgccctgccctgcca

SEQ ID NO: 396902 - DNA, 16 bp, M. musculus
ctgccctgccctgcct

SEQ ID NO: 396903 - DNA, 16 bp, M. musculus
ctgccctgctcccata

SEQ ID NO: 396904 - DNA, 16 bp, M. musculus
ctgccctgctccctgc

SEQ ID NO: 396905 - DNA, 16 bp, M. musculus
ctgccctgctcctcta

SEQ ID NO: 396906 - DNA, 16 bp, M. musculus
ctgccctgctcctgcc

SEQ ID NO: 396907 - DNA, 16 bp, M. musculus
ctgccctgctcttctc

SEQ ID NO: 396908 - DNA, 16 bp, M. musculus
ctgccctgctcttctg

SEQ ID NO: 396909 - DNA, 16 bp, M. musculus
ctgccctgcttccttc

SEQ ID NO: 396910 - DNA, 16 bp, M. musculus
ctgccctggctttcct

SEQ ID NO: 396911 - DNA, 16 bp, M. musculus
ctgccctgtcctgtcc

SEQ ID NO: 396912 - DNA, 16 bp, M. musculus
ctgccctgtcttccct

SEQ ID NO: 396913 - DNA, 16 bp, M. musculus
ctgcccttccagagaa

SEQ ID NO: 396914 - DNA, 16 bp, M. musculus
ctgcccttgcacttgg

SEQ ID NO: 396915 - DNA, 16 bp, M. musculus
ctgcccttgcattccc

SEQ ID NO: 396916 - DNA, 16 bp, M. musculus
ctgcccttgttttgtt

SEQ ID NO: 396917 - DNA, 16 bp, M. musculus
ctgccgccaccaccac

SEQ ID NO: 396918 - DNA, 16 bp, M. musculus
ctgccgctgccgctgc

SEQ ID NO: 396919 - DNA, 16 bp, M. musculus
ctgccgtgctcccacc

SEQ ID NO: 396920 - DNA, 16 bp, M. musculus
ctgcctaagaaatccc

SEQ ID NO: 396921 - DNA, 16 bp, M. musculus
ctgcctaagaccatca

SEQ ID NO: 396922 - DNA, 16 bp, M. musculus
ctgcctaccaagtact

SEQ ID NO: 396923 - DNA, 16 bp, M. musculus
ctgcctacctctgcct

SEQ ID NO: 396924 - DNA, 16 bp, M. musculus
ctgcctacctgcctac

SEQ ID NO: 396925 - DNA, 16 bp, M. musculus
ctgcctagccattggc

SEQ ID NO: 396926 - DNA, 16 bp, M. musculus
ctgcctataactccag

SEQ ID NO: 396927 - DNA, 16 bp, M. musculus
ctgcctatgttttctt

SEQ ID NO: 396928 - DNA, 16 bp, M. musculus
ctgcctcaaaaaccaa

SEQ ID NO: 396929 - DNA, 16 bp, M. musculus
ctgcctcaaaatcaaa

SEQ ID NO: 396930 - DNA, 16 bp, M. musculus
ctgcctcaacaaggtg

SEQ ID NO: 396931 - DNA, 16 bp, M. musculus
ctgcctcaagctcctg

SEQ ID NO: 396932 - DNA, 16 bp, M. musculus
ctgcctcactgcccta

SEQ ID NO: 396933 - DNA, 16 bp, M. musculus
ctgcctcagaagctct

SEQ ID NO: 396934 - DNA, 16 bp, M. musculus
ctgcctcagactccag

SEQ ID NO: 396935 - DNA, 16 bp, M. musculus
ctgcctcagcatccag

SEQ ID NO: 396936 - DNA, 16 bp, M. musculus
ctgcctcagcccctct

SEQ ID NO: 396937 - DNA, 16 bp, M. musculus
ctgcctcagcctcaga

SEQ ID NO: 396938 - DNA, 16 bp, M. musculus
ctgcctcagcctctga

SEQ ID NO: 396939 - DNA, 16 bp, M. musculus
ctgcctcagcctctgg

SEQ ID NO: 396940 - DNA, 16 bp, M. musculus
ctgcctcagccttcca

SEQ ID NO: 396941 - DNA, 16 bp, M. musculus
ctgcctcagcggctct

SEQ ID NO: 396942 - DNA, 16 bp, M. musculus
ctgcctcagctcattg

SEQ ID NO: 396943 - DNA, 16 bp, M. musculus
ctgcctcagctgccca

SEQ ID NO: 396944 - DNA, 16 bp, M. musculus
ctgcctcagctgctct

SEQ ID NO: 396945 - DNA, 16 bp, M. musculus
ctgcctcagcttctgc

SEQ ID NO: 396946 - DNA, 16 bp, M. musculus
ctgcctcagctttctc

SEQ ID NO: 396947 - DNA, 16 bp, M. musculus
ctgcctcaggagctct

SEQ ID NO: 396948 - DNA, 16 bp, M. musculus
ctgcctcaggctccgg

SEQ ID NO: 396949 - DNA, 16 bp, M. musculus
ctgcctcagtaaataa

SEQ ID NO: 396950 - DNA, 16 bp, M. musculus
ctgcctcagtctcctg

SEQ ID NO: 396951 - DNA, 16 bp, M. musculus
ctgcctcagtggctct

SEQ ID NO: 396952 - DNA, 16 bp, M. musculus
ctgcctcagtgtcctg

SEQ ID NO: 396953 - DNA, 16 bp, M. musculus
ctgcctcagtttccct

SEQ ID NO: 396954 - DNA, 16 bp, M. musculus
ctgcctcagtttcctg

SEQ ID NO: 396955 - DNA, 16 bp, M. musculus
ctgcctcagtttctcc

SEQ ID NO: 396956 - DNA, 16 bp, M. musculus
ctgcctcatcctcctg

SEQ ID NO: 396957 - DNA, 16 bp, M. musculus
ctgcctcatctggcct

SEQ ID NO: 396958 - DNA, 16 bp, M. musculus
ctgcctcattaatctt

SEQ ID NO: 396959 - DNA, 16 bp, M. musculus
ctgcctccaaaatgct

SEQ ID NO: 396960 - DNA, 16 bp, M. musculus
ctgcctccaaagagct

SEQ ID NO: 396961 - DNA, 16 bp, M. musculus
ctgcctccaaattcct

SEQ ID NO: 396962 - DNA, 16 bp, M. musculus
ctgcctccaaggaggc

SEQ ID NO: 396963 - DNA, 16 bp, M. musculus
ctgcctccaagtgttg

SEQ ID NO: 396964 - DNA, 16 bp, M. musculus
ctgcctccaagttcct

SEQ ID NO: 396965 - DNA, 16 bp, M. musculus
ctgcctccacattcct

SEQ ID NO: 396966 - DNA, 16 bp, M. musculus
ctgcctccacccccag

SEQ ID NO: 396967 - DNA, 16 bp, M. musculus
ctgcctccacctcctc

SEQ ID NO: 396968 - DNA, 16 bp, M. musculus
ctgcctccacctcctg

SEQ ID NO: 396969 - DNA, 16 bp, M. musculus
ctgcctccacctctgc

SEQ ID NO: 396970 - DNA, 16 bp, M. musculus
ctgcctccactgcctc

SEQ ID NO: 396971 - DNA, 16 bp, M. musculus
ctgcctccagagggct

SEQ ID NO: 396972 - DNA, 16 bp, M. musculus
ctgcctccaggattct

SEQ ID NO: 396973 - DNA, 16 bp, M. musculus
ctgcctccaggctcct

SEQ ID NO: 396974 - DNA, 16 bp, M. musculus
ctgcctccaggcttct

SEQ ID NO: 396975 - DNA, 16 bp, M. musculus
ctgcctccaggttccc

SEQ ID NO: 396976 - DNA, 16 bp, M. musculus
ctgcctccaggttctg

SEQ ID NO: 396977 - DNA, 16 bp, M. musculus
ctgcctccaggtttct

SEQ ID NO: 396978 - DNA, 16 bp, M. musculus
ctgcctccagttcctg

SEQ ID NO: 396979 - DNA, 16 bp, M. musculus
ctgcctccagtttcct

SEQ ID NO: 396980 - DNA, 16 bp, M. musculus
ctgcctccatcagact

SEQ ID NO: 396981 - DNA, 16 bp, M. musculus
ctgcctccatctctcc

SEQ ID NO: 396982 - DNA, 16 bp, M. musculus
ctgcctccatgttggc

SEQ ID NO: 396983 - DNA, 16 bp, M. musculus
ctgcctcccaagcact

SEQ ID NO: 396984 - DNA, 16 bp, M. musculus
ctgcctcccaaggcat

SEQ ID NO: 396985 - DNA, 16 bp, M. musculus
ctgcctcccaagtatt

SEQ ID NO: 396986 - DNA, 16 bp, M. musculus
ctgcctcccactgcct

SEQ ID NO: 396987 - DNA, 16 bp, M. musculus
ctgcctcccagatgtc

SEQ ID NO: 396988 - DNA, 16 bp, M. musculus
ctgcctcccagcccca

SEQ ID NO: 396989 - DNA, 16 bp, M. musculus
ctgcctcccaggagct

SEQ ID NO: 396990 - DNA, 16 bp, M. musculus
ctgcctcccagggctg

SEQ ID NO: 396991 - DNA, 16 bp, M. musculus
ctgcctcccaggtcct

SEQ ID NO: 396992 - DNA, 16 bp, M. musculus
ctgcctccccagcacc

SEQ ID NO: 396993 - DNA, 16 bp, M. musculus
ctgcctccccagccct

SEQ ID NO: 396994 - DNA, 16 bp, M. musculus
ctgcctccccagctct

SEQ ID NO: 396995 - DNA, 16 bp, M. musculus
ctgcctccccagggct

SEQ ID NO: 396996 - DNA, 16 bp, M. musculus
ctgcctccccagtgat

SEQ ID NO: 396997 - DNA, 16 bp, M. musculus
ctgcctccccatcctc

SEQ ID NO: 396998 - DNA, 16 bp, M. musculus
ctgcctcccccatctc

SEQ ID NO: 396999 - DNA, 19 bp, M. musculus
ctgcctcccgagtgctgga

SEQ ID NO: 397000 - DNA, 17 bp, M. musculus
ctgcctcccgcgtgctg

SEQ ID NO: 397001 - DNA, 16 bp, M. musculus
ctgcctccctgcctgc

SEQ ID NO: 397002 - DNA, 16 bp, M. musculus
ctgcctccctggtgct

SEQ ID NO: 397003 - DNA, 16 bp, M. musculus
ctgcctcccttcccca

SEQ ID NO: 397004 - DNA, 16 bp, M. musculus
ctgcctccgagtgctg

SEQ ID NO: 397005 - DNA, 16 bp, M. musculus
ctgcctcctcctccag

SEQ ID NO: 397006 - DNA, 16 bp, M. musculus
ctgcctcctcttcagc

SEQ ID NO: 397007 - DNA, 16 bp, M. musculus
ctgcctcctcttccag

SEQ ID NO: 397008 - DNA, 16 bp, M. musculus
ctgcctcctcttctac

SEQ ID NO: 397009 - DNA, 16 bp, M. musculus
ctgcctcctcttctgc

SEQ ID NO: 397010 - DNA, 16 bp, M. musculus
ctgcctcctgaacact

SEQ ID NO: 397011 - DNA, 20 bp, M. musculus
ctgcctcctgaatgctgggg

SEQ ID NO: 397012 - DNA, 16 bp, M. musculus
ctgcctcctgactact

SEQ ID NO: 397013 - DNA, 16 bp, M. musculus
ctgcctcctgactgct

SEQ ID NO: 397014 - DNA, 16 bp, M. musculus
ctgcctcctgagagca

SEQ ID NO: 397015 - DNA, 16 bp, M. musculus
ctgcctcctgaggact

SEQ ID NO: 397016 - DNA, 16 bp, M. musculus
ctgcctcctgaggctg

SEQ ID NO: 397017 - DNA, 16 bp, M. musculus
ctgcctcctgagtgcc

SEQ ID NO: 397018 - DNA, 16 bp, M. musculus
ctgcctcctgagtgta

SEQ ID NO: 397019 - DNA, 16 bp, M. musculus
ctgcctcctgagtgtg

SEQ ID NO: 397020 - DNA, 16 bp, M. musculus
ctgcctcctgagtgtt

SEQ ID NO: 397021 - DNA, 16 bp, M. musculus
ctgcctcctgagtttt

SEQ ID NO: 397022 - DNA, 16 bp, M. musculus
ctgcctcctgccatgc

SEQ ID NO: 397023 - DNA, 16 bp, M. musculus
ctgcctcctgccccag

SEQ ID NO: 397024 - DNA, 16 bp, M. musculus
ctgcctcctgctggga

SEQ ID NO: 397025 - DNA, 16 bp, M. musculus
ctgcctcctgcttcct

SEQ ID NO: 397026 - DNA, 16 bp, M. musculus
ctgcctcctggcagaa

SEQ ID NO: 397027 - DNA, 16 bp, M. musculus
ctgcctcctggcagag

SEQ ID NO: 397028 - DNA, 16 bp, M. musculus
ctgcctcctggctgtg

SEQ ID NO: 397029 - DNA, 16 bp, M. musculus
ctgcctcctgggagct

SEQ ID NO: 397030 - DNA, 16 bp, M. musculus
ctgcctcctgggtgct

SEQ ID NO: 397031 - DNA, 16 bp, M. musculus
ctgcctcctggtcctg

SEQ ID NO: 397032 - DNA, 16 bp, M. musculus
ctgcctcctgtggcca

SEQ ID NO: 397033 - DNA, 16 bp, M. musculus
ctgcctccttgccctg

SEQ ID NO: 397034 - DNA, 16 bp, M. musculus
ctgcctctacatccca

SEQ ID NO: 397035 - DNA, 16 bp, M. musculus
ctgcctctacctcctc

SEQ ID NO: 397036 - DNA, 16 bp, M. musculus
ctgcctctacctcctg

SEQ ID NO: 397037 - DNA, 16 bp, M. musculus
ctgcctctacctcctt

SEQ ID NO: 397038 - DNA, 16 bp, M. musculus
ctgcctctacctgcca

SEQ ID NO: 397039 - DNA, 16 bp, M. musculus
ctgcctctagctccca

SEQ ID NO: 397040 - DNA, 16 bp, M. musculus
ctgcctctatcccttc

SEQ ID NO: 397041 - DNA, 16 bp, M. musculus
ctgcctctatctccca

SEQ ID NO: 397042 - DNA, 16 bp, M. musculus
ctgcctctatgagtgt

SEQ ID NO: 397043 - DNA, 16 bp, M. musculus
ctgcctctatttccca

SEQ ID NO: 397044 - DNA, 16 bp, M. musculus
ctgcctctcaagagct

SEQ ID NO: 397045 - DNA, 16 bp, M. musculus
ctgcctctcaattgct

SEQ ID NO: 397046 - DNA, 16 bp, M. musculus
ctgcctctcacatgct

SEQ ID NO: 397047 - DNA, 16 bp, M. musculus
ctgcctctcagcctct

SEQ ID NO: 397048 - DNA, 16 bp, M. musculus
ctgcctctccagtgct

SEQ ID NO: 397049 - DNA, 16 bp, M. musculus
ctgcctctccctctca

SEQ ID NO: 397050 - DNA, 16 bp, M. musculus
ctgcctctcctctctg

SEQ ID NO: 397051 - DNA, 16 bp, M. musculus
ctgcctctccttcctg

SEQ ID NO: 397052 - DNA, 16 bp, M. musculus
ctgcctctctctacct

SEQ ID NO: 397053 - DNA, 16 bp, M. musculus
ctgcctctctctccca

SEQ ID NO: 397054 - DNA, 16 bp, M. musculus
ctgcctctctctgcct

SEQ ID NO: 397055 - DNA, 16 bp, M. musculus
ctgcctctctgcctgt

SEQ ID NO: 397056 - DNA, 16 bp, M. musculus
ctgcctctctgtctcc

SEQ ID NO: 397057 - DNA, 16 bp, M. musculus
ctgcctctgactccca

SEQ ID NO: 397058 - DNA, 16 bp, M. musculus
ctgcctctgagtgctg

SEQ ID NO: 397059 - DNA, 16 bp, M. musculus
ctgcctctgcagtgct

SEQ ID NO: 397060 - DNA, 16 bp, M. musculus
ctgcctctgcatccag

SEQ ID NO: 397061 - DNA, 16 bp, M. musculus
ctgcctctgcatctct

SEQ ID NO: 397062 - DNA, 16 bp, M. musculus
ctgcctctgccaccct

SEQ ID NO: 397063 - DNA, 16 bp, M. musculus
ctgcctctgcccacca

SEQ ID NO: 397064 - DNA, 16 bp, M. musculus
ctgcctctgcccccca

SEQ ID NO: 397065 - DNA, 16 bp, M. musculus
ctgcctctgccctctg

SEQ ID NO: 397066 - DNA, 16 bp, M. musculus
ctgcctctgccctgcc

SEQ ID NO: 397067 - DNA, 16 bp, M. musculus
ctgcctctgcccttct

SEQ ID NO: 397068 - DNA, 19 bp, M. musculus
ctgcctctgcctccggagt

SEQ ID NO: 397069 - DNA, 16 bp, M. musculus
ctgcctctgcctctca

SEQ ID NO: 397070 - DNA, 16 bp, M. musculus
ctgcctctgcctctga

SEQ ID NO: 397071 - DNA, 16 bp, M. musculus
ctgcctctgcctctgg

SEQ ID NO: 397072 - DNA, 16 bp, M. musculus
ctgcctctgcctgcct

SEQ ID NO: 397073 - DNA, 16 bp, M. musculus
ctgcctctgcctgctg

SEQ ID NO: 397074 - DNA, 16 bp, M. musculus
ctgcctctgcctggct

SEQ ID NO: 397075 - DNA, 16 bp, M. musculus
ctgcctctgccttctc

SEQ ID NO: 397076 - DNA, 16 bp, M. musculus
ctgcctctgccttggg

SEQ ID NO: 397077 - DNA, 16 bp, M. musculus
ctgcctctgccttttg

SEQ ID NO: 397078 - DNA, 16 bp, M. musculus
ctgcctctgctatgcc

SEQ ID NO: 397079 - DNA, 16 bp, M. musculus
ctgcctctgctcccag

SEQ ID NO: 397080 - DNA, 16 bp, M. musculus
ctgcctctgctcccca

SEQ ID NO: 397081 - DNA, 16 bp, M. musculus
ctgcctctgctccctg

SEQ ID NO: 397082 - DNA, 16 bp, M. musculus
ctgcctctgctgacct

SEQ ID NO: 397083 - DNA, 16 bp, M. musculus
ctgcctctgctgccct

SEQ ID NO: 397084 - DNA, 16 bp, M. musculus
ctgcctctgctgcctg

SEQ ID NO: 397085 - DNA, 16 bp, M. musculus
ctgcctctgctggaat

SEQ ID NO: 397086 - DNA, 16 bp, M. musculus
ctgcctctgctgtctg

SEQ ID NO: 397087 - DNA, 16 bp, M. musculus
ctgcctctgcttcccg

SEQ ID NO: 397088 - DNA, 16 bp, M. musculus
ctgcctctgcttccta

SEQ ID NO: 397089 - DNA, 16 bp, M. musculus
ctgcctctgcttctgg

SEQ ID NO: 397090 - DNA, 16 bp, M. musculus
ctgcctctgctttctc

SEQ ID NO: 397091 - DNA, 16 bp, M. musculus
ctgcctctggagtgct

SEQ ID NO: 397092 - DNA, 16 bp, M. musculus
ctgcctctggcctcct

SEQ ID NO: 397093 - DNA, 16 bp, M. musculus
ctgcctctggcctctg

SEQ ID NO: 397094 - DNA, 16 bp, M. musculus
ctgcctctggctcctg

SEQ ID NO: 397095 - DNA, 16 bp, M. musculus
ctgcctctggctctta

SEQ ID NO: 397096 - DNA, 16 bp, M. musculus
ctgcctctggctggag

SEQ ID NO: 397097 - DNA, 16 bp, M. musculus
ctgcctctgggtttct

SEQ ID NO: 397098 - DNA, 16 bp, M. musculus
ctgcctctgtatcctg

SEQ ID NO: 397099 - DNA, 16 bp, M. musculus
ctgcctctgtattttt

SEQ ID NO: 397100 - DNA, 16 bp, M. musculus
ctgcctctgtcccctg

SEQ ID NO: 397101 - DNA, 16 bp, M. musculus
ctgcctctgtcctcca

SEQ ID NO: 397102 - DNA, 16 bp, M. musculus
ctgcctctgtctactg

SEQ ID NO: 397103 - DNA, 16 bp, M. musculus
ctgcctctgtctccaa

SEQ ID NO: 397104 - DNA, 16 bp, M. musculus
ctgcctctgtctctca

SEQ ID NO: 397105 - DNA, 16 bp, M. musculus
ctgcctctgtgacttc

SEQ ID NO: 397106 - DNA, 16 bp, M. musculus
ctgcctctgtgcctct

SEQ ID NO: 397107 - DNA, 16 bp, M. musculus
ctgcctctgtgtcctg

SEQ ID NO: 397108 - DNA, 16 bp, M. musculus
ctgcctctgtttccca

SEQ ID NO: 397109 - DNA, 16 bp, M. musculus
ctgcctctgtttctca

SEQ ID NO: 397110 - DNA, 16 bp, M. musculus
ctgcctcttccagaag

SEQ ID NO: 397111 - DNA, 16 bp, M. musculus
ctgcctcttcctccag

SEQ ID NO: 397112 - DNA, 16 bp, M. musculus
ctgcctcttcctcctg

SEQ ID NO: 397113 - DNA, 16 bp, M. musculus
ctgcctcttctcatca

SEQ ID NO: 397114 - DNA, 16 bp, M. musculus
ctgcctctttctcctg

SEQ ID NO: 397115 - DNA, 16 bp, M. musculus
ctgcctctttgctgtt

SEQ ID NO: 397116 - DNA, 16 bp, M. musculus
ctgcctgaagacccag

SEQ ID NO: 397117 - DNA, 16 bp, M. musculus
ctgcctgaccagaggc

SEQ ID NO: 397118 - DNA, 16 bp, M. musculus
ctgcctgaccagcagc

SEQ ID NO: 397119 - DNA, 16 bp, M. musculus
ctgcctgaccctgacc

SEQ ID NO: 397120 - DNA, 16 bp, M. musculus
ctgcctgacctgggtg

SEQ ID NO: 397121 - DNA, 16 bp, M. musculus
ctgcctgatgcagttt

SEQ ID NO: 397122 - DNA, 16 bp, M. musculus
ctgcctgcaaatttca

SEQ ID NO: 397123 - DNA, 16 bp, M. musculus
ctgcctgcaaccccag

SEQ ID NO: 397124 - DNA, 16 bp, M. musculus
ctgcctgcaacttcag

SEQ ID NO: 397125 - DNA, 16 bp, M. musculus
ctgcctgcacaccacc

SEQ ID NO: 397126 - DNA, 16 bp, M. musculus
ctgcctgcacgctgcc

SEQ ID NO: 397127 - DNA, 16 bp, M. musculus
ctgcctgcagatccag

SEQ ID NO: 397128 - DNA, 16 bp, M. musculus
ctgcctgcaggttcct

SEQ ID NO: 397129 - DNA, 16 bp, M. musculus
ctgcctgcatctgtct

SEQ ID NO: 397130 - DNA, 16 bp, M. musculus
ctgcctgcatgtacac

SEQ ID NO: 397131 - DNA, 16 bp, M. musculus
ctgcctgccaccatgt

SEQ ID NO: 397132 - DNA, 16 bp, M. musculus
ctgcctgccagcctgc

SEQ ID NO: 397133 - DNA, 16 bp, M. musculus
ctgcctgcccagagca

SEQ ID NO: 397134 - DNA, 16 bp, M. musculus
ctgcctgcccctctgc

SEQ ID NO: 397135 - DNA, 16 bp, M. musculus
ctgcctgccctgccct

SEQ ID NO: 397136 - DNA, 16 bp, M. musculus
ctgcctgccctgcctc

SEQ ID NO: 397137 - DNA, 16 bp, M. musculus
ctgcctgccctgcctg

SEQ ID NO: 397138 - DNA, 16 bp, M. musculus
ctgcctgccctggaac

SEQ ID NO: 397139 - DNA, 16 bp, M. musculus
ctgcctgcctatgcct

SEQ ID NO: 397140 - DNA, 16 bp, M. musculus
ctgcctgcctccacct

SEQ ID NO: 397141 - DNA, 16 bp, M. musculus
ctgcctgcctccatct

SEQ ID NO: 397142 - DNA, 16 bp, M. musculus
ctgcctgcctcccaag

SEQ ID NO: 397143 - DNA, 16 bp, M. musculus
ctgcctgcctccccag

SEQ ID NO: 397144 - DNA, 16 bp, M. musculus
ctgcctgcctccgcct

SEQ ID NO: 397145 - DNA, 16 bp, M. musculus
ctgcctgcctcctctg

SEQ ID NO: 397146 - DNA, 16 bp, M. musculus
ctgcctgcctcctgcc

SEQ ID NO: 397147 - DNA, 16 bp, M. musculus
ctgcctgcctctactt

SEQ ID NO: 397148 - DNA, 16 bp, M. musculus
ctgcctgcctctccac

SEQ ID NO: 397149 - DNA, 16 bp, M. musculus
ctgcctgcctctgcac

SEQ ID NO: 397150 - DNA, 16 bp, M. musculus
ctgcctgcctctgccc

SEQ ID NO: 397151 - DNA, 16 bp, M. musculus
ctgcctgcctctgcta

SEQ ID NO: 397152 - DNA, 16 bp, M. musculus
ctgcctgcctctgctc

SEQ ID NO: 397153 - DNA, 16 bp, M. musculus
ctgcctgcctcttcct

SEQ ID NO: 397154 - DNA, 16 bp, M. musculus
ctgcctgcctgcagcc

SEQ ID NO: 397155 - DNA, 16 bp, M. musculus
ctgcctgcctgccacc

SEQ ID NO: 397156 - DNA, 16 bp, M. musculus
ctgcctgcctgccagc

SEQ ID NO: 397157 - DNA, 16 bp, M. musculus
ctgcctgcctgcccgc

SEQ ID NO: 397158 - DNA, 16 bp, M. musculus
ctgcctgcctgccctc

SEQ ID NO: 397159 - DNA, 16 bp, M. musculus
ctgcctgcctgcctcc

SEQ ID NO: 397160 - DNA, 16 bp, M. musculus
ctgcctgcctgctgcc

SEQ ID NO: 397161 - DNA, 16 bp, M. musculus
ctgcctgcctgcttcc

SEQ ID NO: 397162 - DNA, 16 bp, M. musculus
ctgcctgcctgcttct

SEQ ID NO: 397163 - DNA, 16 bp, M. musculus
ctgcctgcctggtgct

SEQ ID NO: 397164 - DNA, 16 bp, M. musculus
ctgcctgccttcctgc

SEQ ID NO: 397165 - DNA, 16 bp, M. musculus
ctgcctgccttctgcc

SEQ ID NO: 397166 - DNA, 16 bp, M. musculus
ctgcctgccttctttc

SEQ ID NO: 397167 - DNA, 16 bp, M. musculus
ctgcctgcctttgctg

SEQ ID NO: 397168 - DNA, 16 bp, M. musculus
ctgcctgccttttcct

SEQ ID NO: 397169 - DNA, 16 bp, M. musculus
ctgcctgctacctgcc

SEQ ID NO: 397170 - DNA, 16 bp, M. musculus
ctgcctgctccttctg

SEQ ID NO: 397171 - DNA, 16 bp, M. musculus
ctgcctgctgccctgc

SEQ ID NO: 397172 - DNA, 16 bp, M. musculus
ctgcctgctgcctctg

SEQ ID NO: 397173 - DNA, 16 bp, M. musculus
ctgcctgctgcctgtg

SEQ ID NO: 397174 - DNA, 16 bp, M. musculus
ctgcctgctgctcctg

SEQ ID NO: 397175 - DNA, 16 bp, M. musculus
ctgcctgctgctgcac

SEQ ID NO: 397176 - DNA, 16 bp, M. musculus
ctgcctgctgctgcca

SEQ ID NO: 397177 - DNA, 16 bp, M. musculus
ctgcctgctgctgcct

SEQ ID NO: 397178 - DNA, 16 bp, M. musculus
ctgcctgctgctgctt

SEQ ID NO: 397179 - DNA, 16 bp, M. musculus
ctgcctgctgctgtgc

SEQ ID NO: 397180 - DNA, 16 bp, M. musculus
ctgcctgctgcttctg

SEQ ID NO: 397181 - DNA, 16 bp, M. musculus
ctgcctgcttcctgct

SEQ ID NO: 397182 - DNA, 16 bp, M. musculus
ctgcctgcttctgact

SEQ ID NO: 397183 - DNA, 16 bp, M. musculus
ctgcctgcttctgccc

SEQ ID NO: 397184 - DNA, 16 bp, M. musculus
ctgcctgcttctgctt

SEQ ID NO: 397185 - DNA, 16 bp, M. musculus
ctgcctgcttcttccc

SEQ ID NO: 397186 - DNA, 16 bp, M. musculus
ctgcctgctttcttat

SEQ ID NO: 397187 - DNA, 16 bp, M. musculus
ctgcctgcttttgcct

SEQ ID NO: 397188 - DNA, 16 bp, M. musculus
ctgcctggaagcaagt

SEQ ID NO: 397189 - DNA, 16 bp, M. musculus
ctgcctggaagccagc

SEQ ID NO: 397190 - DNA, 16 bp, M. musculus
ctgcctggaagtcaat

SEQ ID NO: 397191 - DNA, 16 bp, M. musculus
ctgcctggacactgcc

SEQ ID NO: 397192 - DNA, 16 bp, M. musculus
ctgcctggagctcctg

SEQ ID NO: 397193 - DNA, 16 bp, M. musculus
ctgcctggagctgctc

SEQ ID NO: 397194 - DNA, 16 bp, M. musculus
ctgcctggagttcctg

SEQ ID NO: 397195 - DNA, 16 bp, M. musculus
ctgcctggatgccacc

SEQ ID NO: 397196 - DNA, 16 bp, M. musculus
ctgcctggatgctgcc

SEQ ID NO: 397197 - DNA, 16 bp, M. musculus
ctgcctggatgctgct

SEQ ID NO: 397198 - DNA, 16 bp, M. musculus
ctgcctggatgctgtc

SEQ ID NO: 397199 - DNA, 16 bp, M. musculus
ctgcctggcagctttg

SEQ ID NO: 397200 - DNA, 16 bp, M. musculus
ctgcctggccagcaag

SEQ ID NO: 397201 - DNA, 16 bp, M. musculus
ctgcctggcccaggag

SEQ ID NO: 397202 - DNA, 16 bp, M. musculus
ctgcctggccctcctc

SEQ ID NO: 397203 - DNA, 16 bp, M. musculus
ctgcctggccctgcct

SEQ ID NO: 397204 - DNA, 16 bp, M. musculus
ctgcctggcctggaac

SEQ ID NO: 397205 - DNA, 16 bp, M. musculus
ctgcctggcctggcct

SEQ ID NO: 397206 - DNA, 16 bp, M. musculus
ctgcctggcctgggag

SEQ ID NO: 397207 - DNA, 16 bp, M. musculus
ctgcctggctacagga

SEQ ID NO: 397208 - DNA, 16 bp, M. musculus
ctgcctggctacaggg

SEQ ID NO: 397209 - DNA, 16 bp, M. musculus
ctgcctggctgcagga

SEQ ID NO: 397210 - DNA, 16 bp, M. musculus
ctgcctggctggtggc

SEQ ID NO: 397211 - DNA, 16 bp, M. musculus
ctgcctggctgtcctg

SEQ ID NO: 397212 - DNA, 16 bp, M. musculus
ctgcctggcttttctt

SEQ ID NO: 397213 - DNA, 16 bp, M. musculus
ctgcctgggaattatg

SEQ ID NO: 397214 - DNA, 16 bp, M. musculus
ctgcctggggctgagg

SEQ ID NO: 397215 - DNA, 16 bp, M. musculus
ctgcctggtccttgct

SEQ ID NO: 397216 - DNA, 16 bp, M. musculus
ctgcctggtctggact

SEQ ID NO: 397217 - DNA, 16 bp, M. musculus
ctgcctggtctggctt

SEQ ID NO: 397218 - DNA, 16 bp, M. musculus
ctgcctggtgtgactc

SEQ ID NO: 397219 - DNA, 16 bp, M. musculus
ctgcctggttgcctgt

SEQ ID NO: 397220 - DNA, 16 bp, M. musculus
ctgcctggttgctggc

SEQ ID NO: 397221 - DNA, 16 bp, M. musculus
ctgcctggttggtgac

SEQ ID NO: 397222 - DNA, 16 bp, M. musculus
ctgcctggttgttggc

SEQ ID NO: 397223 - DNA, 16 bp, M. musculus
ctgcctgtagaagaat

SEQ ID NO: 397224 - DNA, 16 bp, M. musculus
ctgcctgtagagttag

SEQ ID NO: 397225 - DNA, 16 bp, M. musculus
ctgcctgtagctccag

SEQ ID NO: 397226 - DNA, 16 bp, M. musculus
ctgcctgtatgccacc

SEQ ID NO: 397227 - DNA, 16 bp, M. musculus
ctgcctgtccctgcct

SEQ ID NO: 397228 - DNA, 16 bp, M. musculus
ctgcctgtctcccagg

SEQ ID NO: 397229 - DNA, 16 bp, M. musculus
ctgcctgtctgctgcc

SEQ ID NO: 397230 - DNA, 16 bp, M. musculus
ctgcctgtctgcttgc

SEQ ID NO: 397231 - DNA, 16 bp, M. musculus
ctgcctgtctgtctgc

SEQ ID NO: 397232 - DNA, 16 bp, M. musculus
ctgcctgtgattccag

SEQ ID NO: 397233 - DNA, 16 bp, M. musculus
ctgcctgtgccatgcc

SEQ ID NO: 397234 - DNA, 16 bp, M. musculus
ctgcctgtgcctgcct

SEQ ID NO: 397235 - DNA, 16 bp, M. musculus
ctgcctgtggatcaag

SEQ ID NO: 397236 - DNA, 16 bp, M. musculus
ctgcctgtggatccca

SEQ ID NO: 397237 - DNA, 16 bp, M. musculus
ctgcctgtgtcatgcc

SEQ ID NO: 397238 - DNA, 16 bp, M. musculus
ctgcctgtgtgctgcc

SEQ ID NO: 397239 - DNA, 16 bp, M. musculus
ctgcctgttcttccag

SEQ ID NO: 397240 - DNA, 16 bp, M. musculus
ctgcctgtttcccaag

SEQ ID NO: 397241 - DNA, 16 bp, M. musculus
ctgccttagcctccca

SEQ ID NO: 397242 - DNA, 16 bp, M. musculus
ctgccttagcctcctg

SEQ ID NO: 397243 - DNA, 16 bp, M. musculus
ctgccttagcctttca

SEQ ID NO: 397244 - DNA, 16 bp, M. musculus
ctgccttagtctttca

SEQ ID NO: 397245 - DNA, 16 bp, M. musculus
ctgccttcacctctca

SEQ ID NO: 397246 - DNA, 16 bp, M. musculus
ctgccttcaggtccct

SEQ ID NO: 397247 - DNA, 16 bp, M. musculus
ctgccttcattgtgtc

SEQ ID NO: 397248 - DNA, 16 bp, M. musculus
ctgccttcattttttt

SEQ ID NO: 397249 - DNA, 16 bp, M. musculus
ctgccttccaaatgtt

SEQ ID NO: 397250 - DNA, 16 bp, M. musculus
ctgccttccaagtgcc

SEQ ID NO: 397251 - DNA, 16 bp, M. musculus
ctgccttccagccctg

SEQ ID NO: 397252 - DNA, 16 bp, M. musculus
ctgccttcccaccctg

SEQ ID NO: 397253 - DNA, 16 bp, M. musculus
ctgccttcccagagca

SEQ ID NO: 397254 - DNA, 16 bp, M. musculus
ctgccttcccagtact

SEQ ID NO: 397255 - DNA, 16 bp, M. musculus
ctgccttcctctgact

SEQ ID NO: 397256 - DNA, 16 bp, M. musculus
ctgccttcctctgtct

SEQ ID NO: 397257 - DNA, 16 bp, M. musculus
ctgccttcctgcctgc

SEQ ID NO: 397258 - DNA, 16 bp, M. musculus
ctgccttcctggtgct

SEQ ID NO: 397259 - DNA, 16 bp, M. musculus
ctgccttccttcccca

SEQ ID NO: 397260 - DNA, 16 bp, M. musculus
ctgccttctcacagga

SEQ ID NO: 397261 - DNA, 16 bp, M. musculus
ctgccttctcttccac

SEQ ID NO: 397262 - DNA, 16 bp, M. musculus
ctgccttctgagaggc

SEQ ID NO: 397263 - DNA, 16 bp, M. musculus
ctgccttctgcccttg

SEQ ID NO: 397264 - DNA, 16 bp, M. musculus
ctgccttctgcctctg

SEQ ID NO: 397265 - DNA, 16 bp, M. musculus
ctgccttctgcttcct

SEQ ID NO: 397266 - DNA, 16 bp, M. musculus
ctgccttctggcctcc

SEQ ID NO: 397267 - DNA, 16 bp, M. musculus
ctgccttctggctgaa

SEQ ID NO: 397268 - DNA, 16 bp, M. musculus
ctgccttctgtcctct

SEQ ID NO: 397269 - DNA, 16 bp, M. musculus
ctgccttctttattga

SEQ ID NO: 397270 - DNA, 16 bp, M. musculus
ctgccttgagttcctg

SEQ ID NO: 397271 - DNA, 16 bp, M. musculus
ctgccttgatgataat

SEQ ID NO: 397272 - DNA, 16 bp, M. musculus
ctgccttgcctggctt

SEQ ID NO: 397273 - DNA, 16 bp, M. musculus
ctgccttggccatggt

SEQ ID NO: 397274 - DNA, 16 bp, M. musculus
ctgccttggcctccca

SEQ ID NO: 397275 - DNA, 16 bp, M. musculus
ctgccttggtttcccc

SEQ ID NO: 397276 - DNA, 16 bp, M. musculus
ctgccttgtggatgct

SEQ ID NO: 397277 - DNA, 16 bp, M. musculus
ctgccttgtgtgtgtg

SEQ ID NO: 397278 - DNA, 16 bp, M. musculus
ctgcctttattatgtt

SEQ ID NO: 397279 - DNA, 16 bp, M. musculus
ctgcctttccagagga

SEQ ID NO: 397280 - DNA, 16 bp, M. musculus
ctgcctttccctcagt

SEQ ID NO: 397281 - DNA, 18 bp, M. musculus
ctgcctttctacaataaa

SEQ ID NO: 397282 - DNA, 16 bp, M. musculus
ctgcctttgcagagga

SEQ ID NO: 397283 - DNA, 16 bp, M. musculus
ctgcctttgcctctgc

SEQ ID NO: 397284 - DNA, 16 bp, M. musculus
ctgcctttgccttcca

SEQ ID NO: 397285 - DNA, 16 bp, M. musculus
ctgcctttgccttctg

SEQ ID NO: 397286 - DNA, 16 bp, M. musculus
ctgcctttggaaccct

SEQ ID NO: 397287 - DNA, 16 bp, M. musculus
ctgcctttgtatcttt

SEQ ID NO: 397288 - DNA, 16 bp, M. musculus
ctgcctttgtcactga

SEQ ID NO: 397289 - DNA, 16 bp, M. musculus
ctgcctttgtccctga

SEQ ID NO: 397290 - DNA, 16 bp, M. musculus
ctgcctttgtctcctg

SEQ ID NO: 397291 - DNA, 16 bp, M. musculus
ctgcctttgtctctta

SEQ ID NO: 397292 - DNA, 16 bp, M. musculus
ctgccttttctggcct

SEQ ID NO: 397293 - DNA, 16 bp, M. musculus
ctgcctttttctgaag

SEQ ID NO: 397294 - DNA, 16 bp, M. musculus
ctgcctttttttaaaa

SEQ ID NO: 397295 - DNA, 16 bp, M. musculus
ctgcgaagagacacca

SEQ ID NO: 397296 - DNA, 16 bp, M. musculus
ctgcgaatccatgagc

SEQ ID NO: 397297 - DNA, 16 bp, M. musculus
ctgcgaccctttaata

SEQ ID NO: 397298 - DNA, 16 bp, M. musculus
ctgcgaccttttaata

SEQ ID NO: 397299 - DNA, 16 bp, M. musculus
ctgcgaggctctgcca

SEQ ID NO: 397300 - DNA, 16 bp, M. musculus
ctgcgccaccaccgcc

SEQ ID NO: 397301 - DNA, 16 bp, M. musculus
ctgcgcctgtgcagcc

SEQ ID NO: 397302 - DNA, 16 bp, M. musculus
ctgcgctgcgctgcgc

SEQ ID NO: 397303 - DNA, 17 bp, M. musculus
ctgcggcccgcaaaggg

SEQ ID NO: 397304 - DNA, 16 bp, M. musculus
ctgcggctgcggctgc

SEQ ID NO: 397305 - DNA, 16 bp, M. musculus
ctgcggctgctgctgc

SEQ ID NO: 397306 - DNA, 16 bp, M. musculus
ctgcggtccagggaaa

SEQ ID NO: 397307 - DNA, 16 bp, M. musculus
ctgcgttcttcctggc

SEQ ID NO: 397308 - DNA, 16 bp, M. musculus
ctgctaacatccacct

SEQ ID NO: 397309 - DNA, 16 bp, M. musculus
ctgctaagccatctca

SEQ ID NO: 397310 - DNA, 16 bp, M. musculus
ctgctacagcaagccc

SEQ ID NO: 397311 - DNA, 16 bp, M. musculus
ctgctacatatgcaga

SEQ ID NO: 397312 - DNA, 16 bp, M. musculus
ctgctaccaccaccac

SEQ ID NO: 397313 - DNA, 16 bp, M. musculus
ctgctacctgctgaga

SEQ ID NO: 397314 - DNA, 16 bp, M. musculus
ctgctactcttcctgc

SEQ ID NO: 397315 - DNA, 17 bp, M. musculus
ctgctactgctactgct

SEQ ID NO: 397316 - DNA, 16 bp, M. musculus
ctgctactgctgctac

SEQ ID NO: 397317 - DNA, 16 bp, M. musculus
ctgctactgctgctgt

SEQ ID NO: 397318 - DNA, 16 bp, M. musculus
ctgctactgttcttgg

SEQ ID NO: 397319 - DNA, 16 bp, M. musculus
ctgctagagcatgagg

SEQ ID NO: 397320 - DNA, 16 bp, M. musculus
ctgctagccctcaggg

SEQ ID NO: 397321 - DNA, 16 bp, M. musculus
ctgctagtgtgtgtgt

SEQ ID NO: 397322 - DNA, 16 bp, M. musculus
ctgctatgaacatgtg

SEQ ID NO: 397323 - DNA, 16 bp, M. musculus
ctgctcaaccttacca

SEQ ID NO: 397324 - DNA, 16 bp, M. musculus
ctgctcacaggaaacc

SEQ ID NO: 397325 - DNA, 16 bp, M. musculus
ctgctcaccaatccac

SEQ ID NO: 397326 - DNA, 16 bp, M. musculus
ctgctcacctgcctgc

SEQ ID NO: 397327 - DNA, 16 bp, M. musculus
ctgctcactccagccc

SEQ ID NO: 397328 - DNA, 16 bp, M. musculus
ctgctcactccggccc

SEQ ID NO: 397329 - DNA, 16 bp, M. musculus
ctgctcactctggccc

SEQ ID NO: 397330 - DNA, 16 bp, M. musculus
ctgctcactgcccccc

SEQ ID NO: 397331 - DNA, 16 bp, M. musculus
ctgctcactgctgtgg

SEQ ID NO: 397332 - DNA, 16 bp, M. musculus
ctgctcactggcttgt

SEQ ID NO: 397333 - DNA, 16 bp, M. musculus
ctgctcactgtccccc

SEQ ID NO: 397334 - DNA, 16 bp, M. musculus
ctgctcagccatctcc

SEQ ID NO: 397335 - DNA, 16 bp, M. musculus
ctgctcatcatcaaag

SEQ ID NO: 397336 - DNA, 16 bp, M. musculus
ctgctccaacaccatg

SEQ ID NO: 397337 - DNA, 16 bp, M. musculus
ctgctccaattttgtc

SEQ ID NO: 397338 - DNA, 16 bp, M. musculus
ctgctccacactttga

SEQ ID NO: 397339 - DNA, 16 bp, M. musculus
ctgctccaccttctct

SEQ ID NO: 397340 - DNA, 16 bp, M. musculus
ctgctccagcactatg

SEQ ID NO: 397341 - DNA, 16 bp, M. musculus
ctgctccagcctcctg

SEQ ID NO: 397342 - DNA, 16 bp, M. musculus
ctgctccagcgccatg

SEQ ID NO: 397343 - DNA, 16 bp, M. musculus
ctgctccagctcctgc

SEQ ID NO: 397344 - DNA, 16 bp, M. musculus
ctgctccagctgcctg

SEQ ID NO: 397345 - DNA, 16 bp, M. musculus
ctgctccagctgctcc

SEQ ID NO: 397346 - DNA, 16 bp, M. musculus
ctgctccaggtcctct

SEQ ID NO: 397347 - DNA, 16 bp, M. musculus
ctgctccaggttcctg

SEQ ID NO: 397348 - DNA, 16 bp, M. musculus
ctgctccagtaccatg

SEQ ID NO: 397349 - DNA, 16 bp, M. musculus
ctgctccagtgaagac

SEQ ID NO: 397350 - DNA, 16 bp, M. musculus
ctgctccatccaccaa

SEQ ID NO: 397351 - DNA, 16 bp, M. musculus
ctgctccatcccccat

SEQ ID NO: 397352 - DNA, 16 bp, M. musculus
ctgctccatcttcctt

SEQ ID NO: 397353 - DNA, 16 bp, M. musculus
ctgctccattctttgt

SEQ ID NO: 397354 - DNA, 16 bp, M. musculus
ctgctcccactgttag

SEQ ID NO: 397355 - DNA, 16 bp, M. musculus
ctgctcccattggttg

SEQ ID NO: 397356 - DNA, 16 bp, M. musculus
ctgctcccctaccacc

SEQ ID NO: 397357 - DNA, 16 bp, M. musculus
ctgctccctctccacc

SEQ ID NO: 397358 - DNA, 16 bp, M. musculus
ctgctccctctgccca

SEQ ID NO: 397359 - DNA, 18 bp, M. musculus
ctgctccctgacctgctt

SEQ ID NO: 397360 - DNA, 16 bp, M. musculus
ctgctccctgccccca

SEQ ID NO: 397361 - DNA, 16 bp, M. musculus
ctgctccctggccctg

SEQ ID NO: 397362 - DNA, 16 bp, M. musculus
ctgctcctagctgcag

SEQ ID NO: 397363 - DNA, 16 bp, M. musculus
ctgctcctatcagttg

SEQ ID NO: 397364 - DNA, 16 bp, M. musculus
ctgctcctcactttgt

SEQ ID NO: 397365 - DNA, 16 bp, M. musculus
ctgctcctcagttcct

SEQ ID NO: 397366 - DNA, 16 bp, M. musculus
ctgctcctccagaaga

SEQ ID NO: 397367 - DNA, 16 bp, M. musculus
ctgctcctcctcctca

SEQ ID NO: 397368 - DNA, 16 bp, M. musculus
ctgctcctcctgctgc

SEQ ID NO: 397369 - DNA, 16 bp, M. musculus
ctgctcctcctgcttc

SEQ ID NO: 397370 - DNA, 16 bp, M. musculus
ctgctcctctctctgc

SEQ ID NO: 397371 - DNA, 16 bp, M. musculus
ctgctcctctggctct

SEQ ID NO: 397372 - DNA, 16 bp, M. musculus
ctgctcctcttcctgc

SEQ ID NO: 397373 - DNA, 16 bp, M. musculus
ctgctcctgacagctt

SEQ ID NO: 397374 - DNA, 16 bp, M. musculus
ctgctcctgagattct

SEQ ID NO: 397375 - DNA, 16 bp, M. musculus
ctgctcctgagtgctg

SEQ ID NO: 397376 - DNA, 16 bp, M. musculus
ctgctcctgcccctgc

SEQ ID NO: 397377 - DNA, 16 bp, M. musculus
ctgctcctgcctctgg

SEQ ID NO: 397378 - DNA, 16 bp, M. musculus
ctgctcctgctcctgt

SEQ ID NO: 397379 - DNA, 16 bp, M. musculus
ctgctcctgctccttc

SEQ ID NO: 397380 - DNA, 16 bp, M. musculus
ctgctcctgctgctcc

SEQ ID NO: 397381 - DNA, 16 bp, M. musculus
ctgctcctgctggccc

SEQ ID NO: 397382 - DNA, 16 bp, M. musculus
ctgctcctgctttctg

SEQ ID NO: 397383 - DNA, 16 bp, M. musculus
ctgctcctgtaaataa

SEQ ID NO: 397384 - DNA, 16 bp, M. musculus
ctgctccttcctctat

SEQ ID NO: 397385 - DNA, 16 bp, M. musculus
ctgctcgctctggccc

SEQ ID NO: 397386 - DNA, 16 bp, M. musculus
ctgctcgctctggggg

SEQ ID NO: 397387 - DNA, 16 bp, M. musculus
ctgctctacagagcaa

SEQ ID NO: 397388 - DNA, 16 bp, M. musculus
ctgctctaccactgag

SEQ ID NO: 397389 - DNA, 16 bp, M. musculus
ctgctctagcagacct

SEQ ID NO: 397390 - DNA, 16 bp, M. musculus
ctgctctcacagaaga

SEQ ID NO: 397391 - DNA, 16 bp, M. musculus
ctgctctcacctgagt

SEQ ID NO: 397392 - DNA, 16 bp, M. musculus
ctgctctcccaaagga

SEQ ID NO: 397393 - DNA, 16 bp, M. musculus
ctgctctcctctgcct

SEQ ID NO: 397394 - DNA, 16 bp, M. musculus
ctgctctctgcagctt

SEQ ID NO: 397395 - DNA, 16 bp, M. musculus
ctgctctctgcctctt

SEQ ID NO: 397396 - DNA, 16 bp, M. musculus
ctgctctctgctttct

SEQ ID NO: 397397 - DNA, 16 bp, M. musculus
ctgctctcttaaagaa

SEQ ID NO: 397398 - DNA, 16 bp, M. musculus
ctgctctcttaagtag

SEQ ID NO: 397399 - DNA, 16 bp, M. musculus
ctgctctgaattttgt

SEQ ID NO: 397400 - DNA, 16 bp, M. musculus
ctgctctgagttcctg

SEQ ID NO: 397401 - DNA, 16 bp, M. musculus
ctgctctgcccctgac

SEQ ID NO: 397402 - DNA, 16 bp, M. musculus
ctgctctgcctgcctt

SEQ ID NO: 397403 - DNA, 16 bp, M. musculus
ctgctctgctccttca

SEQ ID NO: 397404 - DNA, 16 bp, M. musculus
ctgctctgctctcctc

SEQ ID NO: 397405 - DNA, 16 bp, M. musculus
ctgctctgctcttcct

SEQ ID NO: 397406 - DNA, 16 bp, M. musculus
ctgctctgctcttctc

SEQ ID NO: 397407 - DNA, 16 bp, M. musculus
ctgctctgctgcttct

SEQ ID NO: 397408 - DNA, 16 bp, M. musculus
ctgctctgctgtgctc

SEQ ID NO: 397409 - DNA, 16 bp, M. musculus
ctgctctggaacatgt

SEQ ID NO: 397410 - DNA, 16 bp, M. musculus
ctgctcttacagggga

SEQ ID NO: 397411 - DNA, 16 bp, M. musculus
ctgctcttactgagga

SEQ ID NO: 397412 - DNA, 16 bp, M. musculus
ctgctcttcatcacca

SEQ ID NO: 397413 - DNA, 16 bp, M. musculus
ctgctcttccaagggt

SEQ ID NO: 397414 - DNA, 16 bp, M. musculus
ctgctcttccacaaga

SEQ ID NO: 397415 - DNA, 16 bp, M. musculus
ctgctcttccagaaga

SEQ ID NO: 397416 - DNA, 16 bp, M. musculus
ctgctcttccagacaa

SEQ ID NO: 397417 - DNA, 16 bp, M. musculus
ctgctcttccagactg

SEQ ID NO: 397418 - DNA, 16 bp, M. musculus
ctgctcttccagagga

SEQ ID NO: 397419 - DNA, 16 bp, M. musculus
ctgctcttccagatga

SEQ ID NO: 397420 - DNA, 16 bp, M. musculus
ctgctcttccgaagga

SEQ ID NO: 397421 - DNA, 16 bp, M. musculus
ctgctcttccggagga

SEQ ID NO: 397422 - DNA, 16 bp, M. musculus
ctgctcttcctgcctc

SEQ ID NO: 397423 - DNA, 16 bp, M. musculus
ctgctcttctgaagtt

SEQ ID NO: 397424 - DNA, 16 bp, M. musculus
ctgctcttgactgtga

SEQ ID NO: 397425 - DNA, 16 bp, M. musculus
ctgctcttggaactct

SEQ ID NO: 397426 - DNA, 16 bp, M. musculus
ctgctcttgtagaaga

SEQ ID NO: 397427 - DNA, 16 bp, M. musculus
ctgctctttctgctct

SEQ ID NO: 397428 - DNA, 16 bp, M. musculus
ctgctcttttagaaga

SEQ ID NO: 397429 - DNA, 16 bp, M. musculus
ctgctcttttatagaa

SEQ ID NO: 397430 - DNA, 16 bp, M. musculus
ctgctcttttctgaaa

SEQ ID NO: 397431 - DNA, 16 bp, M. musculus
ctgctcttttctgaag

SEQ ID NO: 397432 - DNA, 16 bp, M. musculus
ctgctgaaccatttct

SEQ ID NO: 397433 - DNA, 16 bp, M. musculus
ctgctgaaccttctct

SEQ ID NO: 397434 - DNA, 16 bp, M. musculus
ctgctgaataagctca

SEQ ID NO: 397435 - DNA, 16 bp, M. musculus
ctgctgaatcatctct

SEQ ID NO: 397436 - DNA, 16 bp, M. musculus
ctgctgaccactgtgg

SEQ ID NO: 397437 - DNA, 16 bp, M. musculus
ctgctgaccaggaagt

SEQ ID NO: 397438 - DNA, 16 bp, M. musculus
ctgctgacctctgtgg

SEQ ID NO: 397439 - DNA, 16 bp, M. musculus
ctgctgactcctgtga

SEQ ID NO: 397440 - DNA, 16 bp, M. musculus
ctgctgactggaacct

SEQ ID NO: 397441 - DNA, 16 bp, M. musculus
ctgctgagagagaaag

SEQ ID NO: 397442 - DNA, 16 bp, M. musculus
ctgctgagatgagaac

SEQ ID NO: 397443 - DNA, 16 bp, M. musculus
ctgctgagccacctct

SEQ ID NO: 397444 - DNA, 16 bp, M. musculus
ctgctgagccagctct

SEQ ID NO: 397445 - DNA, 16 bp, M. musculus
ctgctgagccagttct

SEQ ID NO: 397446 - DNA, 16 bp, M. musculus
ctgctgagccatctct

SEQ ID NO: 397447 - DNA, 16 bp, M. musculus
ctgctgagccatctta

SEQ ID NO: 397448 - DNA, 16 bp, M. musculus
ctgctgagccatcttg

SEQ ID NO: 397449 - DNA, 16 bp, M. musculus
ctgctgagccatcttt

SEQ ID NO: 397450 - DNA, 16 bp, M. musculus
ctgctgagccctcccc

SEQ ID NO: 397451 - DNA, 16 bp, M. musculus
ctgctgagccctgtgg

SEQ ID NO: 397452 - DNA, 16 bp, M. musculus
ctgctgagccgcctct

SEQ ID NO: 397453 - DNA, 16 bp, M. musculus
ctgctgagccttctca

SEQ ID NO: 397454 - DNA, 16 bp, M. musculus
ctgctgagctgtctca

SEQ ID NO: 397455 - DNA, 16 bp, M. musculus
ctgctgaggaatgctg

SEQ ID NO: 397456 - DNA, 16 bp, M. musculus
ctgctgagggacatct

SEQ ID NO: 397457 - DNA, 16 bp, M. musculus
ctgctgagggagggag

SEQ ID NO: 397458 - DNA, 16 bp, M. musculus
ctgctgagttctctct

SEQ ID NO: 397459 - DNA, 16 bp, M. musculus
ctgctgagtttgtgcc

SEQ ID NO: 397460 - DNA, 16 bp, M. musculus
ctgctgattaggggca

SEQ ID NO: 397461 - DNA, 16 bp, M. musculus
ctgctgcaagaagaga

SEQ ID NO: 397462 - DNA, 16 bp, M. musculus
ctgctgcaagaggaag

SEQ ID NO: 397463 - DNA, 16 bp, M. musculus
ctgctgcaagttcaag

SEQ ID NO: 397464 - DNA, 16 bp, M. musculus
ctgctgcacctggttc

SEQ ID NO: 397465 - DNA, 16 bp, M. musculus
ctgctgcagaaggaag

SEQ ID NO: 397466 - DNA, 16 bp, M. musculus
ctgctgcagagctggg

SEQ ID NO: 397467 - DNA, 16 bp, M. musculus
ctgctgcagaggtgtg

SEQ ID NO: 397468 - DNA, 16 bp, M. musculus
ctgctgcagatgctca

SEQ ID NO: 397469 - DNA, 16 bp, M. musculus
ctgctgcagcctccct

SEQ ID NO: 397470 - DNA, 16 bp, M. musculus
ctgctgcagcttctga

SEQ ID NO: 397471 - DNA, 16 bp, M. musculus
ctgctgcaggagaaag

SEQ ID NO: 397472 - DNA, 16 bp, M. musculus
ctgctgcaggaggaaa

SEQ ID NO: 397473 - DNA, 16 bp, M. musculus
ctgctgcaggaggaag

SEQ ID NO: 397474 - DNA, 16 bp, M. musculus
ctgctgcaggaggagg

SEQ ID NO: 397475 - DNA, 16 bp, M. musculus
ctgctgcagggccatg

SEQ ID NO: 397476 - DNA, 16 bp, M. musculus
ctgctgcaggtgggct

SEQ ID NO: 397477 - DNA, 16 bp, M. musculus
ctgctgcagttcctgc

SEQ ID NO: 397478 - DNA, 16 bp, M. musculus
ctgctgcatgtacacc

SEQ ID NO: 397479 - DNA, 16 bp, M. musculus
ctgctgccaaacctga

SEQ ID NO: 397480 - DNA, 16 bp, M. musculus
ctgctgccaagcctaa

SEQ ID NO: 397481 - DNA, 16 bp, M. musculus
ctgctgccaagcctga

SEQ ID NO: 397482 - DNA, 16 bp, M. musculus
ctgctgccactgccac

SEQ ID NO: 397483 - DNA, 16 bp, M. musculus
ctgctgccactgctgc

SEQ ID NO: 397484 - DNA, 16 bp, M. musculus
ctgctgccagaggaag

SEQ ID NO: 397485 - DNA, 16 bp, M. musculus
ctgctgccaggaactg

SEQ ID NO: 397486 - DNA, 16 bp, M. musculus
ctgctgccatactccc

SEQ ID NO: 397487 - DNA, 16 bp, M. musculus
ctgctgccatctgctg

SEQ ID NO: 397488 - DNA, 16 bp, M. musculus
ctgctgccatgctcct

SEQ ID NO: 397489 - DNA, 16 bp, M. musculus
ctgctgcccaagaaga

SEQ ID NO: 397490 - DNA, 16 bp, M. musculus
ctgctgcccagggctt

SEQ ID NO: 397491 - DNA, 16 bp, M. musculus
ctgctgccccagccct

SEQ ID NO: 397492 - DNA, 16 bp, M. musculus
ctgctgccccctggtg

SEQ ID NO: 397493 - DNA, 16 bp, M. musculus
ctgctgcccctgctgc

SEQ ID NO: 397494 - DNA, 16 bp, M. musculus
ctgctgccctctcctg

SEQ ID NO: 397495 - DNA, 16 bp, M. musculus
ctgctgccctctgctg

SEQ ID NO: 397496 - DNA, 16 bp, M. musculus
ctgctgccgccccagc

SEQ ID NO: 397497 - DNA, 16 bp, M. musculus
ctgctgccgccgccac

SEQ ID NO: 397498 - DNA, 16 bp, M. musculus
ctgctgcctcagtctc

SEQ ID NO: 397499 - DNA, 16 bp, M. musculus
ctgctgcctctgctgc

SEQ ID NO: 397500 - DNA, 17 bp, M. musculus
ctgctgcctctgctgcc

SEQ ID NO: 397501 - DNA, 16 bp, M. musculus
ctgctgcctgccctgc

SEQ ID NO: 397502 - DNA, 16 bp, M. musculus
ctgctgcctgcctgtg

SEQ ID NO: 397503 - DNA, 16 bp, M. musculus
ctgctgcctgctgcca

SEQ ID NO: 397504 - DNA, 16 bp, M. musculus
ctgctgcctgctgcct

SEQ ID NO: 397505 - DNA, 16 bp, M. musculus
ctgctgcctggccctg

SEQ ID NO: 397506 - DNA, 16 bp, M. musculus
ctgctgcctgtctgtg

SEQ ID NO: 397507 - DNA, 16 bp, M. musculus
ctgctgccttcagatc

SEQ ID NO: 397508 - DNA, 16 bp, M. musculus
ctgctgccttcctgcc

SEQ ID NO: 397509 - DNA, 16 bp, M. musculus
ctgctgccttttgtct

SEQ ID NO: 397510 - DNA, 16 bp, M. musculus
ctgctgctactgctac

SEQ ID NO: 397511 - DNA, 16 bp, M. musculus
ctgctgctactgttgt

SEQ ID NO: 397512 - DNA, 16 bp, M. musculus
ctgctgctatcctgac

SEQ ID NO: 397513 - DNA, 16 bp, M. musculus
ctgctgctcactggct

SEQ ID NO: 397514 - DNA, 16 bp, M. musculus
ctgctgctccctgctg

SEQ ID NO: 397515 - DNA, 16 bp, M. musculus
ctgctgctcctcctgc

SEQ ID NO: 397516 - DNA, 17 bp, M. musculus
ctgctgctcctgctcct

SEQ ID NO: 397517 - DNA, 16 bp, M. musculus
ctgctgctcctgctgt

SEQ ID NO: 397518 - DNA, 16 bp, M. musculus
ctgctgctccttctcc

SEQ ID NO: 397519 - DNA, 16 bp, M. musculus
ctgctgctctcccaga

SEQ ID NO: 397520 - DNA, 16 bp, M. musculus
ctgctgctctctggga

SEQ ID NO: 397521 - DNA, 16 bp, M. musculus
ctgctgctcttcctcc

SEQ ID NO: 397522 - DNA, 16 bp, M. musculus
ctgctgctcttctctg

SEQ ID NO: 397523 - DNA, 16 bp, M. musculus
ctgctgctcttggtga

SEQ ID NO: 397524 - DNA, 16 bp, M. musculus
ctgctgctgacctgtg

SEQ ID NO: 397525 - DNA, 16 bp, M. musculus
ctgctgctgatgctca

SEQ ID NO: 397526 - DNA, 16 bp, M. musculus
ctgctgctgcagagga

SEQ ID NO: 397527 - DNA, 16 bp, M. musculus
ctgctgctgcagcagc

SEQ ID NO: 397528 - DNA, 16 bp, M. musculus
ctgctgctgcagggcc

SEQ ID NO: 397529 - DNA, 16 bp, M. musculus
ctgctgctgcagttgg

SEQ ID NO: 397530 - DNA, 16 bp, M. musculus
ctgctgctgccactgc

SEQ ID NO: 397531 - DNA, 16 bp, M. musculus
ctgctgctgccgccgc

SEQ ID NO: 397532 - DNA, 16 bp, M. musculus
ctgctgctgccgctgc

SEQ ID NO: 397533 - DNA, 16 bp, M. musculus
ctgctgctgcctcctg

SEQ ID NO: 397534 - DNA, 16 bp, M. musculus
ctgctgctgcctgcag

SEQ ID NO: 397535 - DNA, 16 bp, M. musculus
ctgctgctgcctgtgg

SEQ ID NO: 397536 - DNA, 16 bp, M. musculus
ctgctgctgcggctgc

SEQ ID NO: 397537 - DNA, 16 bp, M. musculus
ctgctgctgctacctg

SEQ ID NO: 397538 - DNA, 16 bp, M. musculus
ctgctgctgctactgt

SEQ ID NO: 397539 - DNA, 16 bp, M. musculus
ctgctgctgctcccct

SEQ ID NO: 397540 - DNA, 16 bp, M. musculus
ctgctgctgctcctcc

SEQ ID NO: 397541 - DNA, 16 bp, M. musculus
ctgctgctgctcctgc

SEQ ID NO: 397542 - DNA, 16 bp, M. musculus
ctgctgctgctccttc

SEQ ID NO: 397543 - DNA, 16 bp, M. musculus
ctgctgctgctcttcc

SEQ ID NO: 397544 - DNA, 16 bp, M. musculus
ctgctgctgctcttct

SEQ ID NO: 397545 - DNA, 16 bp, M. musculus
ctgctgctgctgacca

SEQ ID NO: 397546 - DNA, 16 bp, M. musculus
ctgctgctgctgagag

SEQ ID NO: 397547 - DNA, 16 bp, M. musculus
ctgctgctgctgaggc

SEQ ID NO: 397548 - DNA, 16 bp, M. musculus
ctgctgctgctgatgg

SEQ ID NO: 397549 - DNA, 16 bp, M. musculus
ctgctgctgctgcaat

SEQ ID NO: 397550 - DNA, 16 bp, M. musculus
ctgctgctgctgcagc

SEQ ID NO: 397551 - DNA, 16 bp, M. musculus
ctgctgctgctgcagg

SEQ ID NO: 397552 - DNA, 16 bp, M. musculus
ctgctgctgctgcagt

SEQ ID NO: 397553 - DNA, 16 bp, M. musculus
ctgctgctgctgcatc

SEQ ID NO: 397554 - DNA, 16 bp, M. musculus
ctgctgctgctgccat

SEQ ID NO: 397555 - DNA, 16 bp, M. musculus
ctgctgctgctgcctt

SEQ ID NO: 397556 - DNA, 16 bp, M. musculus
ctgctgctgctgctat

SEQ ID NO: 397557 - DNA, 16 bp, M. musculus
ctgctgctgctgctct

SEQ ID NO: 397558 - DNA, 16 bp, M. musculus
ctgctgctgctgctga

SEQ ID NO: 397559 - DNA, 16 bp, M. musculus
ctgctgctgctgctta

SEQ ID NO: 397560 - DNA, 16 bp, M. musculus
ctgctgctgctgcttg

SEQ ID NO: 397561 - DNA, 16 bp, M. musculus
ctgctgctgctgggat

SEQ ID NO: 397562 - DNA, 16 bp, M. musculus
ctgctgctgctggtga

SEQ ID NO: 397563 - DNA, 16 bp, M. musculus
ctgctgctgctggtgt

SEQ ID NO: 397564 - DNA, 16 bp, M. musculus
ctgctgctgctgtcct

SEQ ID NO: 397565 - DNA, 16 bp, M. musculus
ctgctgctgctgtggc

SEQ ID NO: 397566 - DNA, 16 bp, M. musculus
ctgctgctgctgtggt

SEQ ID NO: 397567 - DNA, 16 bp, M. musculus
ctgctgctgctgtgtg

SEQ ID NO: 397568 - DNA, 16 bp, M. musculus
ctgctgctgctgttgg

SEQ ID NO: 397569 - DNA, 16 bp, M. musculus
ctgctgctgctgttgt

SEQ ID NO: 397570 - DNA, 16 bp, M. musculus
ctgctgctgcttctcc

SEQ ID NO: 397571 - DNA, 16 bp, M. musculus
ctgctgctgcttttct

SEQ ID NO: 397572 - DNA, 16 bp, M. musculus
ctgctgctggaggaag

SEQ ID NO: 397573 - DNA, 16 bp, M. musculus
ctgctgctgggttgag

SEQ ID NO: 397574 - DNA, 16 bp, M. musculus
ctgctgctggtgctgc

SEQ ID NO: 397575 - DNA, 16 bp, M. musculus
ctgctgctggtggtgt

SEQ ID NO: 397576 - DNA, 16 bp, M. musculus
ctgctgctggttcctg

SEQ ID NO: 397577 - DNA, 16 bp, M. musculus
ctgctgctgtgacttc

SEQ ID NO: 397578 - DNA, 16 bp, M. musculus
ctgctgctgtgctgct

SEQ ID NO: 397579 - DNA, 16 bp, M. musculus
ctgctgctgtggagct

SEQ ID NO: 397580 - DNA, 16 bp, M. musculus
ctgctgctgtgtgctc

SEQ ID NO: 397581 - DNA, 16 bp, M. musculus
ctgctgctgttcctcc

SEQ ID NO: 397582 - DNA, 16 bp, M. musculus
ctgctgctgttctttg

SEQ ID NO: 397583 - DNA, 16 bp, M. musculus
ctgctgctgttgctct

SEQ ID NO: 397584 - DNA, 17 bp, M. musculus
ctgctgctgttgctgct

SEQ ID NO: 397585 - DNA, 16 bp, M. musculus
ctgctgcttagaggaa

SEQ ID NO: 397586 - DNA, 16 bp, M. musculus
ctgctgcttattggct

SEQ ID NO: 397587 - DNA, 16 bp, M. musculus
ctgctgcttcagcctc

SEQ ID NO: 397588 - DNA, 16 bp, M. musculus
ctgctgcttcctgacc

SEQ ID NO: 397589 - DNA, 16 bp, M. musculus
ctgctgcttcctgggg

SEQ ID NO: 397590 - DNA, 16 bp, M. musculus
ctgctgcttctgcctc

SEQ ID NO: 397591 - DNA, 17 bp, M. musculus
ctgctgctttgactcca

SEQ ID NO: 397592 - DNA, 16 bp, M. musculus
ctgctggagcacatga

SEQ ID NO: 397593 - DNA, 16 bp, M. musculus
ctgctggagcctgctg

SEQ ID NO: 397594 - DNA, 16 bp, M. musculus
ctgctggaggtgggct

SEQ ID NO: 397595 - DNA, 16 bp, M. musculus
ctgctggagtacatga

SEQ ID NO: 397596 - DNA, 16 bp, M. musculus
ctgctggcactcaggg

SEQ ID NO: 397597 - DNA, 16 bp, M. musculus
ctgctggcagcctata

SEQ ID NO: 397598 - DNA, 16 bp, M. musculus
ctgctggccaccatgc

SEQ ID NO: 397599 - DNA, 16 bp, M. musculus
ctgctggccatcaggg

SEQ ID NO: 397600 - DNA, 16 bp, M. musculus
ctgctggccctcaggg

SEQ ID NO: 397601 - DNA, 16 bp, M. musculus
ctgctggccctcatgg

SEQ ID NO: 397602 - DNA, 16 bp, M. musculus
ctgctggcccttgggg

SEQ ID NO: 397603 - DNA, 16 bp, M. musculus
ctgctggcctctgagc

SEQ ID NO: 397604 - DNA, 16 bp, M. musculus
ctgctggcctctgcag

SEQ ID NO: 397605 - DNA, 16 bp, M. musculus
ctgctggcctctgcct

SEQ ID NO: 397606 - DNA, 16 bp, M. musculus
ctgctggcctctgctc

SEQ ID NO: 397607 - DNA, 16 bp, M. musculus
ctgctggcctctgctg

SEQ ID NO: 397608 - DNA, 16 bp, M. musculus
ctgctggcctggctgc

SEQ ID NO: 397609 - DNA, 16 bp, M. musculus
ctgctggctctcaggg

SEQ ID NO: 397610 - DNA, 16 bp, M. musculus
ctgctggctgctgctg

SEQ ID NO: 397611 - DNA, 16 bp, M. musculus
ctgctggctgtcctgg

SEQ ID NO: 397612 - DNA, 17 bp, M. musculus
ctgctggcttttgtaga

SEQ ID NO: 397613 - DNA, 16 bp, M. musculus
ctgctgggattaaagg

SEQ ID NO: 397614 - DNA, 16 bp, M. musculus
ctgctgggcagtggtg

SEQ ID NO: 397615 - DNA, 16 bp, M. musculus
ctgctgggcatgcagc

SEQ ID NO: 397616 - DNA, 16 bp, M. musculus
ctgctgggcttgctgg

SEQ ID NO: 397617 - DNA, 16 bp, M. musculus
ctgctggggcagactc

SEQ ID NO: 397618 - DNA, 16 bp, M. musculus
ctgctggggctgctgg

SEQ ID NO: 397619 - DNA, 16 bp, M. musculus
ctgctgggtagaacct

SEQ ID NO: 397620 - DNA, 16 bp, M. musculus
ctgctgggtgaagcct

SEQ ID NO: 397621 - DNA, 16 bp, M. musculus
ctgctggtcatgatgg

SEQ ID NO: 397622 - DNA, 16 bp, M. musculus
ctgctggtccctttaa

SEQ ID NO: 397623 - DNA, 16 bp, M. musculus
ctgctggtcctcaggg

SEQ ID NO: 397624 - DNA, 16 bp, M. musculus
ctgctggtcctccaac

SEQ ID NO: 397625 - DNA, 16 bp, M. musculus
ctgctggtcttcctac

SEQ ID NO: 397626 - DNA, 16 bp, M. musculus
ctgctggtctttctac

SEQ ID NO: 397627 - DNA, 16 bp, M. musculus
ctgctggtctttctat

SEQ ID NO: 397628 - DNA, 16 bp, M. musculus
ctgctggtgatggtgg

SEQ ID NO: 397629 - DNA, 16 bp, M. musculus
ctgctggtgctggtgc

SEQ ID NO: 397630 - DNA, 16 bp, M. musculus
ctgctggtggtggtgt

SEQ ID NO: 397631 - DNA, 16 bp, M. musculus
ctgctggtgtatctgt

SEQ ID NO: 397632 - DNA, 16 bp, M. musculus
ctgctggtgtgtgtgt

SEQ ID NO: 397633 - DNA, 16 bp, M. musculus
ctgctgtactggggca

SEQ ID NO: 397634 - DNA, 16 bp, M. musculus
ctgctgtcacatgaat

SEQ ID NO: 397635 - DNA, 16 bp, M. musculus
ctgctgtcacctgagg

SEQ ID NO: 397636 - DNA, 16 bp, M. musculus
ctgctgtcagacccca

SEQ ID NO: 397637 - DNA, 16 bp, M. musculus
ctgctgtcagtgtaga

SEQ ID NO: 397638 - DNA, 16 bp, M. musculus
ctgctgtccactcctc

SEQ ID NO: 397639 - DNA, 16 bp, M. musculus
ctgctgtcctactgtg

SEQ ID NO: 397640 - DNA, 16 bp, M. musculus
ctgctgtcctctgtgt

SEQ ID NO: 397641 - DNA, 16 bp, M. musculus
ctgctgtcctggaact

SEQ ID NO: 397642 - DNA, 16 bp, M. musculus
ctgctgtctactcctc

SEQ ID NO: 397643 - DNA, 16 bp, M. musculus
ctgctgtctctgtcct

SEQ ID NO: 397644 - DNA, 16 bp, M. musculus
ctgctgtctgcctgcc

SEQ ID NO: 397645 - DNA, 16 bp, M. musculus
ctgctgtctgctgtct

SEQ ID NO: 397646 - DNA, 16 bp, M. musculus
ctgctgtctgtctgtc

SEQ ID NO: 397647 - DNA, 16 bp, M. musculus
ctgctgtctgtggatc

SEQ ID NO: 397648 - DNA, 16 bp, M. musculus
ctgctgtcttccttct

SEQ ID NO: 397649 - DNA, 16 bp, M. musculus
ctgctgtgaacagtca

SEQ ID NO: 397650 - DNA, 16 bp, M. musculus
ctgctgtgaagagaaa

SEQ ID NO: 397651 - DNA, 16 bp, M. musculus
ctgctgtgaagggaca

SEQ ID NO: 397652 - DNA, 16 bp, M. musculus
ctgctgtgataaaaca

SEQ ID NO: 397653 - DNA, 16 bp, M. musculus
ctgctgtgcatggatg

SEQ ID NO: 397654 - DNA, 16 bp, M. musculus
ctgctgtgccatctct

SEQ ID NO: 397655 - DNA, 16 bp, M. musculus
ctgctgtgcctgctgc

SEQ ID NO: 397656 - DNA, 16 bp, M. musculus
ctgctgtgcttcctgc

SEQ ID NO: 397657 - DNA, 16 bp, M. musculus
ctgctgtggacagtct

SEQ ID NO: 397658 - DNA, 16 bp, M. musculus
ctgctgtggacttgtg

SEQ ID NO: 397659 - DNA, 16 bp, M. musculus
ctgctgtggcattgcc

SEQ ID NO: 397660 - DNA, 16 bp, M. musculus
ctgctgtggcccctgt

SEQ ID NO: 397661 - DNA, 16 bp, M. musculus
ctgctgtggctgctgt

SEQ ID NO: 397662 - DNA, 16 bp, M. musculus
ctgctgtgggtgctgg

SEQ ID NO: 397663 - DNA, 16 bp, M. musculus
ctgctgtgtcagtgtc

SEQ ID NO: 397664 - DNA, 16 bp, M. musculus
ctgctgtgtctggaaa

SEQ ID NO: 397665 - DNA, 16 bp, M. musculus
ctgctgtgtgacaaaa

SEQ ID NO: 397666 - DNA, 16 bp, M. musculus
ctgctgtgtgccaggc

SEQ ID NO: 397667 - DNA, 16 bp, M. musculus
ctgctgtgtgtgtcag

SEQ ID NO: 397668 - DNA, 16 bp, M. musculus
ctgctgtgttttctga

SEQ ID NO: 397669 - DNA, 16 bp, M. musculus
ctgctgttcaccacca

SEQ ID NO: 397670 - DNA, 16 bp, M. musculus
ctgctgttcatcagca

SEQ ID NO: 397671 - DNA, 16 bp, M. musculus
ctgctgttcatcatca

SEQ ID NO: 397672 - DNA, 16 bp, M. musculus
ctgctgttccaaagct

SEQ ID NO: 397673 - DNA, 16 bp, M. musculus
ctgctgttcctgctgc

SEQ ID NO: 397674 - DNA, 16 bp, M. musculus
ctgctgttcttgatgg

SEQ ID NO: 397675 - DNA, 16 bp, M. musculus
ctgctgttcttggtga

SEQ ID NO: 397676 - DNA, 16 bp, M. musculus
ctgctgttgcagactg

SEQ ID NO: 397677 - DNA, 16 bp, M. musculus
ctgctgttgctgctgt

SEQ ID NO: 397678 - DNA, 16 bp, M. musculus
ctgctgttgttccttt

SEQ ID NO: 397679 - DNA, 16 bp, M. musculus
ctgctgtttcagagga

SEQ ID NO: 397680 - DNA, 16 bp, M. musculus
ctgcttaaaaacaaaa

SEQ ID NO: 397681 - DNA, 16 bp, M. musculus
ctgcttacctctgcct

SEQ ID NO: 397682 - DNA, 16 bp, M. musculus
ctgcttatcctttgag

SEQ ID NO: 397683 - DNA, 16 bp, M. musculus
ctgcttatgttttgct

SEQ ID NO: 397684 - DNA, 16 bp, M. musculus
ctgcttcaagaaaaca

SEQ ID NO: 397685 - DNA, 16 bp, M. musculus
ctgcttcaagttcctg

SEQ ID NO: 397686 - DNA, 16 bp, M. musculus
ctgcttcaccatcacc

SEQ ID NO: 397687 - DNA, 16 bp, M. musculus
ctgcttcacttcctgc

SEQ ID NO: 397688 - DNA, 16 bp, M. musculus
ctgcttcagccaaaca

SEQ ID NO: 397689 - DNA, 16 bp, M. musculus
ctgcttcagcctccta

SEQ ID NO: 397690 - DNA, 16 bp, M. musculus
ctgcttcagcctcctg

SEQ ID NO: 397691 - DNA, 16 bp, M. musculus
ctgcttcagcctctgg

SEQ ID NO: 397692 - DNA, 16 bp, M. musculus
ctgcttcagccttcca

SEQ ID NO: 397693 - DNA, 16 bp, M. musculus
ctgcttcagctcctgc

SEQ ID NO: 397694 - DNA, 16 bp, M. musculus
ctgcttcagcttccca

SEQ ID NO: 397695 - DNA, 16 bp, M. musculus
ctgcttcagcttctgc

SEQ ID NO: 397696 - DNA, 16 bp, M. musculus
ctgcttcagttccttc

SEQ ID NO: 397697 - DNA, 16 bp, M. musculus
ctgcttcagtttctgc

SEQ ID NO: 397698 - DNA, 16 bp, M. musculus
ctgcttcagtttttgc

SEQ ID NO: 397699 - DNA, 16 bp, M. musculus
ctgcttcatcaccctc

SEQ ID NO: 397700 - DNA, 16 bp, M. musculus
ctgcttcatgcttgtg

SEQ ID NO: 397701 - DNA, 16 bp, M. musculus
ctgcttcatttggttc

SEQ ID NO: 397702 - DNA, 16 bp, M. musculus
ctgcttccaagttcct

SEQ ID NO: 397703 - DNA, 16 bp, M. musculus
ctgcttccacctctca

SEQ ID NO: 397704 - DNA, 16 bp, M. musculus
ctgcttccaggatcct

SEQ ID NO: 397705 - DNA, 16 bp, M. musculus
ctgcttccaggctttt

SEQ ID NO: 397706 - DNA, 16 bp, M. musculus
ctgcttccatcagttg

SEQ ID NO: 397707 - DNA, 16 bp, M. musculus
ctgcttcccaagtact

SEQ ID NO: 397708 - DNA, 16 bp, M. musculus
ctgcttcccaagtcct

SEQ ID NO: 397709 - DNA, 16 bp, M. musculus
ctgcttcccagccctg

SEQ ID NO: 397710 - DNA, 16 bp, M. musculus
ctgcttccccatcatg

SEQ ID NO: 397711 - DNA, 16 bp, M. musculus
ctgcttccctagttac

SEQ ID NO: 397712 - DNA, 16 bp, M. musculus
ctgcttccctatcctg

SEQ ID NO: 397713 - DNA, 16 bp, M. musculus
ctgcttccctctgcat

SEQ ID NO: 397714 - DNA, 16 bp, M. musculus
ctgcttccctgccctg

SEQ ID NO: 397715 - DNA, 16 bp, M. musculus
ctgcttccctgtcctt

SEQ ID NO: 397716 - DNA, 16 bp, M. musculus
ctgcttccctgttctg

SEQ ID NO: 397717 - DNA, 16 bp, M. musculus
ctgcttcctcacctgc

SEQ ID NO: 397718 - DNA, 16 bp, M. musculus
ctgcttcctctctggc

SEQ ID NO: 397719 - DNA, 16 bp, M. musculus
ctgcttcctctgcctc

SEQ ID NO: 397720 - DNA, 16 bp, M. musculus
ctgcttcctcttctga

SEQ ID NO: 397721 - DNA, 16 bp, M. musculus
ctgcttcctgaccaca

SEQ ID NO: 397722 - DNA, 16 bp, M. musculus
ctgcttcctgaccatg

SEQ ID NO: 397723 - DNA, 16 bp, M. musculus
ctgcttcctgacctgg

SEQ ID NO: 397724 - DNA, 16 bp, M. musculus
ctgcttcctgactgag

SEQ ID NO: 397725 - DNA, 16 bp, M. musculus
ctgcttcctgagttct

SEQ ID NO: 397726 - DNA, 16 bp, M. musculus
ctgcttcctgcagatc

SEQ ID NO: 397727 - DNA, 16 bp, M. musculus
ctgcttcctgcttcct

SEQ ID NO: 397728 - DNA, 16 bp, M. musculus
ctgcttcctggcaact

SEQ ID NO: 397729 - DNA, 16 bp, M. musculus
ctgcttcctggcactg

SEQ ID NO: 397730 - DNA, 16 bp, M. musculus
ctgcttcctggcctgg

SEQ ID NO: 397731 - DNA, 16 bp, M. musculus
ctgcttcctggcttgc

SEQ ID NO: 397732 - DNA, 16 bp, M. musculus
ctgcttcctgggtgct

SEQ ID NO: 397733 - DNA, 16 bp, M. musculus
ctgcttcctggtcatg

SEQ ID NO: 397734 - DNA, 16 bp, M. musculus
ctgcttcctggtccac

SEQ ID NO: 397735 - DNA, 16 bp, M. musculus
ctgcttcctgtcctgc

SEQ ID NO: 397736 - DNA, 16 bp, M. musculus
ctgcttcctgttcctg

SEQ ID NO: 397737 - DNA, 17 bp, M. musculus
ctgcttccttaattaat

SEQ ID NO: 397738 - DNA, 16 bp, M. musculus
ctgcttccttctctgt

SEQ ID NO: 397739 - DNA, 16 bp, M. musculus
ctgcttccttgccctg

SEQ ID NO: 397740 - DNA, 16 bp, M. musculus
ctgcttcctttcctca

SEQ ID NO: 397741 - DNA, 16 bp, M. musculus
ctgcttctaattatca

SEQ ID NO: 397742 - DNA, 16 bp, M. musculus
ctgcttctatgagggt

SEQ ID NO: 397743 - DNA, 16 bp, M. musculus
ctgcttctattttttg

SEQ ID NO: 397744 - DNA, 16 bp, M. musculus
ctgcttctcaagtgct

SEQ ID NO: 397745 - DNA, 16 bp, M. musculus
ctgcttctcaagtgtt

SEQ ID NO: 397746 - DNA, 16 bp, M. musculus
ctgcttctccagagga

SEQ ID NO: 397747 - DNA, 16 bp, M. musculus
ctgcttctccagtgct

SEQ ID NO: 397748 - DNA, 16 bp, M. musculus
ctgcttctcctcctgc

SEQ ID NO: 397749 - DNA, 16 bp, M. musculus
ctgcttctcctgcctc

SEQ ID NO: 397750 - DNA, 16 bp, M. musculus
ctgcttctctaatgct

SEQ ID NO: 397751 - DNA, 16 bp, M. musculus
ctgcttctctgtctcc

SEQ ID NO: 397752 - DNA, 16 bp, M. musculus
ctgcttctctgtctgt

SEQ ID NO: 397753 - DNA, 16 bp, M. musculus
ctgcttctgagtgctg

SEQ ID NO: 397754 - DNA, 16 bp, M. musculus
ctgcttctgcatcctg

SEQ ID NO: 397755 - DNA, 16 bp, M. musculus
ctgcttctgcctcaca

SEQ ID NO: 397756 - DNA, 16 bp, M. musculus
ctgcttctgcctccgg

SEQ ID NO: 397757 - DNA, 16 bp, M. musculus
ctgcttctgcctccta

SEQ ID NO: 397758 - DNA, 16 bp, M. musculus
ctgcttctgcctctgc

SEQ ID NO: 397759 - DNA, 16 bp, M. musculus
ctgcttctgctcctgc

SEQ ID NO: 397760 - DNA, 16 bp, M. musculus
ctgcttctgctcctgt

SEQ ID NO: 397761 - DNA, 16 bp, M. musculus
ctgcttctgctctctg

SEQ ID NO: 397762 - DNA, 16 bp, M. musculus
ctgcttctgcttccca

SEQ ID NO: 397763 - DNA, 16 bp, M. musculus
ctgcttctgcttctca

SEQ ID NO: 397764 - DNA, 16 bp, M. musculus
ctgcttctgcttctga

SEQ ID NO: 397765 - DNA, 16 bp, M. musculus
ctgcttctgcttctgc

SEQ ID NO: 397766 - DNA, 17 bp, M. musculus
ctgcttctgcttctgct

SEQ ID NO: 397767 - DNA, 16 bp, M. musculus
ctgcttctgcttctgg

SEQ ID NO: 397768 - DNA, 16 bp, M. musculus
ctgcttctggcctctg

SEQ ID NO: 397769 - DNA, 16 bp, M. musculus
ctgcttctgtctgtct

SEQ ID NO: 397770 - DNA, 16 bp, M. musculus
ctgcttctgtgtctgt

SEQ ID NO: 397771 - DNA, 16 bp, M. musculus
ctgcttctgtttccca

SEQ ID NO: 397772 - DNA, 16 bp, M. musculus
ctgcttctgtttctgc

SEQ ID NO: 397773 - DNA, 16 bp, M. musculus
ctgcttcttccaggca

SEQ ID NO: 397774 - DNA, 16 bp, M. musculus
ctgcttcttggctgtg

SEQ ID NO: 397775 - DNA, 16 bp, M. musculus
ctgcttcttggtcatg

SEQ ID NO: 397776 - DNA, 16 bp, M. musculus
ctgcttcttggtcctg

SEQ ID NO: 397777 - DNA, 16 bp, M. musculus
ctgcttcttgtccctg

SEQ ID NO: 397778 - DNA, 16 bp, M. musculus
ctgcttgaattcctgt

SEQ ID NO: 397779 - DNA, 16 bp, M. musculus
ctgcttgagttccagg

SEQ ID NO: 397780 - DNA, 16 bp, M. musculus
ctgcttgagtttctgt

SEQ ID NO: 397781 - DNA, 16 bp, M. musculus
ctgcttgcccctgcct

SEQ ID NO: 397782 - DNA, 16 bp, M. musculus
ctgcttgctcttctag

SEQ ID NO: 397783 - DNA, 16 bp, M. musculus
ctgcttggcccctcct

SEQ ID NO: 397784 - DNA, 16 bp, M. musculus
ctgcttggtggctcag

SEQ ID NO: 397785 - DNA, 16 bp, M. musculus
ctgcttgtcaccaggc

SEQ ID NO: 397786 - DNA, 16 bp, M. musculus
ctgcttgtctgtcact

SEQ ID NO: 397787 - DNA, 16 bp, M. musculus
ctgcttgtcttcctat

SEQ ID NO: 397788 - DNA, 16 bp, M. musculus
ctgcttgttcttccag

SEQ ID NO: 397789 - DNA, 16 bp, M. musculus
ctgctttcaatattct

SEQ ID NO: 397790 - DNA, 16 bp, M. musculus
ctgctttcactttaag

SEQ ID NO: 397791 - DNA, 16 bp, M. musculus
ctgctttcaggctggg

SEQ ID NO: 397792 - DNA, 16 bp, M. musculus
ctgctttcagttcatg

SEQ ID NO: 397793 - DNA, 16 bp, M. musculus
ctgctttccaccttaa

SEQ ID NO: 397794 - DNA, 16 bp, M. musculus
ctgctttcctaactaa

SEQ ID NO: 397795 - DNA, 16 bp, M. musculus
ctgctttcctgagtgc

SEQ ID NO: 397796 - DNA, 16 bp, M. musculus
ctgctttctcctgggc

SEQ ID NO: 397797 - DNA, 16 bp, M. musculus
ctgctttcttatacac

SEQ ID NO: 397798 - DNA, 16 bp, M. musculus
ctgctttgaacttact

SEQ ID NO: 397799 - DNA, 16 bp, M. musculus
ctgctttgaaggtctg

SEQ ID NO: 397800 - DNA, 16 bp, M. musculus
ctgctttggcagtagt

SEQ ID NO: 397801 - DNA, 16 bp, M. musculus
ctgcttttcatattct

SEQ ID NO: 397802 - DNA, 16 bp, M. musculus
ctgcttttcatttcct

SEQ ID NO: 397803 - DNA, 16 bp, M. musculus
ctgcttttccagagaa

SEQ ID NO: 397804 - DNA, 16 bp, M. musculus
ctgcttttccagggga

SEQ ID NO: 397805 - DNA, 16 bp, M. musculus
ctgcttttctagtcca

SEQ ID NO: 397806 - DNA, 16 bp, M. musculus
ctgcttttctggagga

SEQ ID NO: 397807 - DNA, 16 bp, M. musculus
ctgcttttgatgatga

SEQ ID NO: 397808 - DNA, 16 bp, M. musculus
ctgcttttgcagaaga

SEQ ID NO: 397809 - DNA, 16 bp, M. musculus
ctgcttttgcctccca

SEQ ID NO: 397810 - DNA, 16 bp, M. musculus
ctgcttttgttaatta

SEQ ID NO: 397811 - DNA, 16 bp, M. musculus
ctgctttttaaacaag

SEQ ID NO: 397812 - DNA, 16 bp, M. musculus
ctgctttttgcccttg

SEQ ID NO: 397813 - DNA, 16 bp, M. musculus
ctggaaaaaggaaaga

SEQ ID NO: 397814 - DNA, 16 bp, M. musculus
ctggaaaaataaaaat

SEQ ID NO: 397815 - DNA, 16 bp, M. musculus
ctggaaaacaacaaca

SEQ ID NO: 397816 - DNA, 16 bp, M. musculus
ctggaaaagagaaccc

SEQ ID NO: 397817 - DNA, 16 bp, M. musculus
ctggaaaagcaagact

SEQ ID NO: 397818 - DNA, 16 bp, M. musculus
ctggaaaagcagccaa

SEQ ID NO: 397819 - DNA, 16 bp, M. musculus
ctggaaaagcagtcag

SEQ ID NO: 397820 - DNA, 16 bp, M. musculus
ctggaaaagccattga

SEQ ID NO: 397821 - DNA, 16 bp, M. musculus
ctggaaaaggagctga

SEQ ID NO: 397822 - DNA, 16 bp, M. musculus
ctggaaaatctggatg

SEQ ID NO: 397823 - DNA, 18 bp, M. musculus
ctggaaaatggtatggcc

SEQ ID NO: 397824 - DNA, 16 bp, M. musculus
ctggaaacaaccaaga

SEQ ID NO: 397825 - DNA, 16 bp, M. musculus
ctggaaacaggagctg

SEQ ID NO: 397826 - DNA, 16 bp, M. musculus
ctggaaaccaaacttg

SEQ ID NO: 397827 - DNA, 16 bp, M. musculus
ctggaaactgctgctg

SEQ ID NO: 397828 - DNA, 16 bp, M. musculus
ctggaaactgttgctg

SEQ ID NO: 397829 - DNA, 16 bp, M. musculus
ctggaaactttttttt

SEQ ID NO: 397830 - DNA, 16 bp, M. musculus
ctggaaagaaaaacaa

SEQ ID NO: 397831 - DNA, 18 bp, M. musculus
ctggaaagaacccagatg

SEQ ID NO: 397832 - DNA, 16 bp, M. musculus
ctggaaagaactcaga

SEQ ID NO: 397833 - DNA, 16 bp, M. musculus
ctggaaagagagaccc

SEQ ID NO: 397834 - DNA, 16 bp, M. musculus
ctggaaagatggttca

SEQ ID NO: 397835 - DNA, 16 bp, M. musculus
ctggaaatcctcctgc

SEQ ID NO: 397836 - DNA, 16 bp, M. musculus
ctggaaatctgtctgg

SEQ ID NO: 397837 - DNA, 16 bp, M. musculus
ctggaaatgaaaaaga

SEQ ID NO: 397838 - DNA, 16 bp, M. musculus
ctggaacaagaagctg

SEQ ID NO: 397839 - DNA, 16 bp, M. musculus
ctggaacacacatggt

SEQ ID NO: 397840 - DNA, 16 bp, M. musculus
ctggaacagatagtgt

SEQ ID NO: 397841 - DNA, 16 bp, M. musculus
ctggaacagggaaaac

SEQ ID NO: 397842 - DNA, 16 bp, M. musculus
ctggaacatgtgacca

SEQ ID NO: 397843 - DNA, 16 bp, M. musculus
ctggaaccaggctggc

SEQ ID NO: 397844 - DNA, 16 bp, M. musculus
ctggaaccatagatgc

SEQ ID NO: 397845 - DNA, 16 bp, M. musculus
ctggaaccctgagatc

SEQ ID NO: 397846 - DNA, 16 bp, M. musculus
ctggaactaactatgt

SEQ ID NO: 397847 - DNA, 16 bp, M. musculus
ctggaactacaggtgt

SEQ ID NO: 397848 - DNA, 16 bp, M. musculus
ctggaactagagttac

SEQ ID NO: 397849 - DNA, 16 bp, M. musculus
ctggaactcaatttgt

SEQ ID NO: 397850 - DNA, 16 bp, M. musculus
ctggaactcacagtga

SEQ ID NO: 397851 - DNA, 16 bp, M. musculus
ctggaactcactaagt

SEQ ID NO: 397852 - DNA, 28 bp, M. musculus
ctggaactcagaaatccgcctgcctctg

SEQ ID NO: 397853 - DNA, 16 bp, M. musculus
ctggaactccagcagg

SEQ ID NO: 397854 - DNA, 16 bp, M. musculus
ctggaactgactttgt

SEQ ID NO: 397855 - DNA, 16 bp, M. musculus
ctggaactggagagat

SEQ ID NO: 397856 - DNA, 16 bp, M. musculus
ctggaactggagctgt

SEQ ID NO: 397857 - DNA, 16 bp, M. musculus
ctggaactttctctgt

SEQ ID NO: 397858 - DNA, 16 bp, M. musculus
ctggaagaaaacaaaa

SEQ ID NO: 397859 - DNA, 16 bp, M. musculus
ctggaagaacaagcag

SEQ ID NO: 397860 - DNA, 16 bp, M. musculus
ctggaagaacacccag

SEQ ID NO: 397861 - DNA, 16 bp, M. musculus
ctggaagaacagctgg

SEQ ID NO: 397862 - DNA, 16 bp, M. musculus
ctggaagaagagcaag

SEQ ID NO: 397863 - DNA, 16 bp, M. musculus
ctggaagaagaggaag

SEQ ID NO: 397864 - DNA, 16 bp, M. musculus
ctggaagaagatgagg

SEQ ID NO: 397865 - DNA, 16 bp, M. musculus
ctggaagaagcagaaa

SEQ ID NO: 397866 - DNA, 16 bp, M. musculus
ctggaagaagcagagg

SEQ ID NO: 397867 - DNA, 16 bp, M. musculus
ctggaagaagttgaag

SEQ ID NO: 397868 - DNA, 16 bp, M. musculus
ctggaagacagtcttc

SEQ ID NO: 397869 - DNA, 16 bp, M. musculus
ctggaagaccagttct

SEQ ID NO: 397870 - DNA, 16 bp, M. musculus
ctggaagagaagacag

SEQ ID NO: 397871 - DNA, 16 bp, M. musculus
ctggaagagaagaggg

SEQ ID NO: 397872 - DNA, 16 bp, M. musculus
ctggaagagaagtcag

SEQ ID NO: 397873 - DNA, 16 bp, M. musculus
ctggaagagcaacaaa

SEQ ID NO: 397874 - DNA, 16 bp, M. musculus
ctggaagagcaacaag

SEQ ID NO: 397875 - DNA, 16 bp, M. musculus
ctggaagagcactcag

SEQ ID NO: 397876 - DNA, 16 bp, M. musculus
ctggaagagcagagag

SEQ ID NO: 397877 - DNA, 16 bp, M. musculus
ctggaagagcagcaaa

SEQ ID NO: 397878 - DNA, 16 bp, M. musculus
ctggaagagcagcaga

SEQ ID NO: 397879 - DNA, 16 bp, M. musculus
ctggaagagcagccca

SEQ ID NO: 397880 - DNA, 16 bp, M. musculus
ctggaagagcagctga

SEQ ID NO: 397881 - DNA, 16 bp, M. musculus
ctggaagagcagctgg

SEQ ID NO: 397882 - DNA, 16 bp, M. musculus
ctggaagagcaggaaa

SEQ ID NO: 397883 - DNA, 16 bp, M. musculus
ctggaagagcagtctg

SEQ ID NO: 397884 - DNA, 16 bp, M. musculus
ctggaagagcagtgag

SEQ ID NO: 397885 - DNA, 16 bp, M. musculus
ctggaagagccaagag

SEQ ID NO: 397886 - DNA, 16 bp, M. musculus
ctggaagagctgagag

SEQ ID NO: 397887 - DNA, 16 bp, M. musculus
ctggaagaggagccag

SEQ ID NO: 397888 - DNA, 16 bp, M. musculus
ctggaagaggtttaga

SEQ ID NO: 397889 - DNA, 16 bp, M. musculus
ctggaagagtcagatg

SEQ ID NO: 397890 - DNA, 16 bp, M. musculus
ctggaagatcagcaag

SEQ ID NO: 397891 - DNA, 16 bp, M. musculus
ctggaagatcctgcaa

SEQ ID NO: 397892 - DNA, 16 bp, M. musculus
ctggaagatcttggag

SEQ ID NO: 397893 - DNA, 16 bp, M. musculus
ctggaagatgctgagg

SEQ ID NO: 397894 - DNA, 16 bp, M. musculus
ctggaagcagaaactg

SEQ ID NO: 397895 - DNA, 16 bp, M. musculus
ctggaagcagaagctg

SEQ ID NO: 397896 - DNA, 16 bp, M. musculus
ctggaagcagagagaa

SEQ ID NO: 397897 - DNA, 16 bp, M. musculus
ctggaagcagagagag

SEQ ID NO: 397898 - DNA, 16 bp, M. musculus
ctggaagcagcctgga

SEQ ID NO: 397899 - DNA, 16 bp, M. musculus
ctggaagcaggaactg

SEQ ID NO: 397900 - DNA, 16 bp, M. musculus
ctggaagccagcctgg

SEQ ID NO: 397901 - DNA, 16 bp, M. musculus
ctggaagccagtcttc

SEQ ID NO: 397902 - DNA, 16 bp, M. musculus
ctggaagccccaggga

SEQ ID NO: 397903 - DNA, 18 bp, M. musculus
ctggaagccctcctcgag

SEQ ID NO: 397904 - DNA, 16 bp, M. musculus
ctggaagctcacaggc

SEQ ID NO: 397905 - DNA, 16 bp, M. musculus
ctggaagctctggagg

SEQ ID NO: 397906 - DNA, 16 bp, M. musculus
ctggaagctctgggtg

SEQ ID NO: 397907 - DNA, 16 bp, M. musculus
ctggaaggaaaggaag

SEQ ID NO: 397908 - DNA, 16 bp, M. musculus
ctggaaggcatcatcc

SEQ ID NO: 397909 - DNA, 16 bp, M. musculus
ctggaaggctggtggt

SEQ ID NO: 397910 - DNA, 16 bp, M. musculus
ctggaagtaacacctc

SEQ ID NO: 397911 - DNA, 16 bp, M. musculus
ctggaagtcagtctcc

SEQ ID NO: 397912 - DNA, 16 bp, M. musculus
ctggaagtcagtcttc

SEQ ID NO: 397913 - DNA, 16 bp, M. musculus
ctggaagtcagtcttt

SEQ ID NO: 397914 - DNA, 16 bp, M. musculus
ctggaagtcctgcctt

SEQ ID NO: 397915 - DNA, 16 bp, M. musculus
ctggaagttgtcctct

SEQ ID NO: 397916 - DNA, 16 bp, M. musculus
ctggaagtttccattg

SEQ ID NO: 397917 - DNA, 16 bp, M. musculus
ctggaataaaacttac

SEQ ID NO: 397918 - DNA, 16 bp, M. musculus
ctggaatacaccactt

SEQ ID NO: 397919 - DNA, 16 bp, M. musculus
ctggaatatctcaaga

SEQ ID NO: 397920 - DNA, 16 bp, M. musculus
ctggaatccaccttct

SEQ ID NO: 397921 - DNA, 16 bp, M. musculus
ctggaatcccaggact

SEQ ID NO: 397922 - DNA, 16 bp, M. musculus
ctggaatcctaaagaa

SEQ ID NO: 397923 - DNA, 16 bp, M. musculus
ctggaatggcttccca

SEQ ID NO: 397924 - DNA, 16 bp, M. musculus
ctggaattaaagacag

SEQ ID NO: 397925 - DNA, 16 bp, M. musculus
ctggaattaaaggagt

SEQ ID NO: 397926 - DNA, 16 bp, M. musculus
ctggaattaaaggcat

SEQ ID NO: 397927 - DNA, 16 bp, M. musculus
ctggaattaaagttgt

SEQ ID NO: 397928 - DNA, 16 bp, M. musculus
ctggaattacaggcat

SEQ ID NO: 397929 - DNA, 16 bp, M. musculus
ctggaattagatcttt

SEQ ID NO: 397930 - DNA, 16 bp, M. musculus
ctggaattcactatga

SEQ ID NO: 397931 - DNA, 16 bp, M. musculus
ctggaattctctctct

SEQ ID NO: 397932 - DNA, 16 bp, M. musculus
ctggaattggagttat

SEQ ID NO: 397933 - DNA, 16 bp, M. musculus
ctggaattgtggaaag

SEQ ID NO: 397934 - DNA, 16 bp, M. musculus
ctggacaaccaattgg

SEQ ID NO: 397935 - DNA, 16 bp, M. musculus
ctggacacctgagatc

SEQ ID NO: 397936 - DNA, 16 bp, M. musculus
ctggacactgaactca

SEQ ID NO: 397937 - DNA, 16 bp, M. musculus
ctggacactgccatga

SEQ ID NO: 397938 - DNA, 16 bp, M. musculus
ctggacagacagacag

SEQ ID NO: 397939 - DNA, 16 bp, M. musculus
ctggacagacattata

SEQ ID NO: 397940 - DNA, 16 bp, M. musculus
ctggacagagacctgg

SEQ ID NO: 397941 - DNA, 16 bp, M. musculus
ctggacagatggctta

SEQ ID NO: 397942 - DNA, 16 bp, M. musculus
ctggacagtgtgcaga

SEQ ID NO: 397943 - DNA, 16 bp, M. musculus
ctggacatggtggtgt

SEQ ID NO: 397944 - DNA, 16 bp, M. musculus
ctggacattggcctgg

SEQ ID NO: 397945 - DNA, 28 bp, M. musculus
ctggacattttgctagagaatgccctac

SEQ ID NO: 397946 - DNA, 16 bp, M. musculus
ctggaccacagcttct

SEQ ID NO: 397947 - DNA, 16 bp, M. musculus
ctggaccaccagccag

SEQ ID NO: 397948 - DNA, 16 bp, M. musculus
ctggaccagagaagaa

SEQ ID NO: 397949 - DNA, 16 bp, M. musculus
ctggaccataccttct

SEQ ID NO: 397950 - DNA, 16 bp, M. musculus
ctggacctaaactttt

SEQ ID NO: 397951 - DNA, 16 bp, M. musculus
ctggacctcagtttcc

SEQ ID NO: 397952 - DNA, 16 bp, M. musculus
ctggacctcccaggat

SEQ ID NO: 397953 - DNA, 16 bp, M. musculus
ctggacctcctttctc

SEQ ID NO: 397954 - DNA, 16 bp, M. musculus
ctggacctgagacagc

SEQ ID NO: 397955 - DNA, 16 bp, M. musculus
ctggacctgctggaca

SEQ ID NO: 397956 - DNA, 16 bp, M. musculus
ctggaccttcggaaga

SEQ ID NO: 397957 - DNA, 16 bp, M. musculus
ctggaccttctgaaga

SEQ ID NO: 397958 - DNA, 16 bp, M. musculus
ctggactacatagtga

SEQ ID NO: 397959 - DNA, 16 bp, M. musculus
ctggactacatggtga

SEQ ID NO: 397960 - DNA, 16 bp, M. musculus
ctggactatatgagac

SEQ ID NO: 397961 - DNA, 16 bp, M. musculus
ctggactccaaggatg

SEQ ID NO: 397962 - DNA, 16 bp, M. musculus
ctggactcccaggact

SEQ ID NO: 397963 - DNA, 16 bp, M. musculus
ctggactcctccaaag

SEQ ID NO: 397964 - DNA, 16 bp, M. musculus
ctggactcctgggagc

SEQ ID NO: 397965 - DNA, 16 bp, M. musculus
ctggactctaccccca

SEQ ID NO: 397966 - DNA, 16 bp, M. musculus
ctggactctgaggaat

SEQ ID NO: 397967 - DNA, 16 bp, M. musculus
ctggactggcatctgt

SEQ ID NO: 397968 - DNA, 16 bp, M. musculus
ctggactgtaaaaaaa

SEQ ID NO: 397969 - DNA, 16 bp, M. musculus
ctggactgtgtaagaa

SEQ ID NO: 397970 - DNA, 16 bp, M. musculus
ctggactgttctctgt

SEQ ID NO: 397971 - DNA, 16 bp, M. musculus
ctggacttcaacaaca

SEQ ID NO: 397972 - DNA, 16 bp, M. musculus
ctggacttcctggttg

SEQ ID NO: 397973 - DNA, 16 bp, M. musculus
ctggacttgaactcag

SEQ ID NO: 397974 - DNA, 16 bp, M. musculus
ctggacttgaactctg

SEQ ID NO: 397975 - DNA, 16 bp, M. musculus
ctggacttgagttttg

SEQ ID NO: 397976 - DNA, 16 bp, M. musculus
ctggacttgctttgta

SEQ ID NO: 397977 - DNA, 16 bp, M. musculus
ctggagaaaaacaaaa

SEQ ID NO: 397978 - DNA, 16 bp, M. musculus
ctggagaaacagcaag

SEQ ID NO: 397979 - DNA, 16 bp, M. musculus
ctggagaaacggctca

SEQ ID NO: 397980 - DNA, 16 bp, M. musculus
ctggagaaactggatg

SEQ ID NO: 397981 - DNA, 16 bp, M. musculus
ctggagaaagaaaacc

SEQ ID NO: 397982 - DNA, 16 bp, M. musculus
ctggagaaagaactga

SEQ ID NO: 397983 - DNA, 16 bp, M. musculus
ctggagaaagggctca

SEQ ID NO: 397984 - DNA, 16 bp, M. musculus
ctggagaaatgaatga

SEQ ID NO: 397985 - DNA, 16 bp, M. musculus
ctggagaaatgcctca

SEQ ID NO: 397986 - DNA, 16 bp, M. musculus
ctggagaaatggttca

SEQ ID NO: 397987 - DNA, 16 bp, M. musculus
ctggagaacaattttc

SEQ ID NO: 397988 - DNA, 16 bp, M. musculus
ctggagaacctggaag

SEQ ID NO: 397989 - DNA, 16 bp, M. musculus
ctggagaacttggatg

SEQ ID NO: 397990 - DNA, 16 bp, M. musculus
ctggagaagaaattta

SEQ ID NO: 397991 - DNA, 16 bp, M. musculus
ctggagaagaagctga

SEQ ID NO: 397992 - DNA, 16 bp, M. musculus
ctggagaagagctgag

SEQ ID NO: 397993 - DNA, 16 bp, M. musculus
ctggagaagatggctc

SEQ ID NO: 397994 - DNA, 16 bp, M. musculus
ctggagaagcagctga

SEQ ID NO: 397995 - DNA, 16 bp, M. musculus
ctggagaagctgcaag

SEQ ID NO: 397996 - DNA, 16 bp, M. musculus
ctggagaaggacctga

SEQ ID NO: 397997 - DNA, 16 bp, M. musculus
ctggagaaggagcaga

SEQ ID NO: 397998 - DNA, 16 bp, M. musculus
ctggagaaggagctca

SEQ ID NO: 397999 - DNA, 16 bp, M. musculus
ctggagaaggagctga

SEQ ID NO: 398000 - DNA, 16 bp, M. musculus
ctggagaaggatctga

SEQ ID NO: 398001 - DNA, 16 bp, M. musculus
ctggagaaggtgaagc

SEQ ID NO: 398002 - DNA, 16 bp, M. musculus
ctggagaagtggctca

SEQ ID NO: 398003 - DNA, 16 bp, M. musculus
ctggagaagtggctga

SEQ ID NO: 398004 - DNA, 16 bp, M. musculus
ctggagacactggtct

SEQ ID NO: 398005 - DNA, 16 bp, M. musculus
ctggagacagagctca

SEQ ID NO: 398006 - DNA, 16 bp, M. musculus
ctggagaccaagctgt

SEQ ID NO: 398007 - DNA, 16 bp, M. musculus
ctggagactgaactca

SEQ ID NO: 398008 - DNA, 16 bp, M. musculus
ctggagagaagattct

SEQ ID NO: 398009 - DNA, 16 bp, M. musculus
ctggagagaaggctta

SEQ ID NO: 398010 - DNA, 16 bp, M. musculus
ctggagagacagctct

SEQ ID NO: 398011 - DNA, 16 bp, M. musculus
ctggagagagaagaaa

SEQ ID NO: 398012 - DNA, 16 bp, M. musculus
ctggagagagacagag

SEQ ID NO: 398013 - DNA, 16 bp, M. musculus
ctggagagagcaaaca

SEQ ID NO: 398014 - DNA, 16 bp, M. musculus
ctggagagagcagagg

SEQ ID NO: 398015 - DNA, 16 bp, M. musculus
ctggagagagcataca

SEQ ID NO: 398016 - DNA, 16 bp, M. musculus
ctggagagatagccca

SEQ ID NO: 398017 - DNA, 16 bp, M. musculus
ctggagagatgactga

SEQ ID NO: 398018 - DNA, 16 bp, M. musculus
ctggagagatgctcag

SEQ ID NO: 398019 - DNA, 16 bp, M. musculus
ctggagagatggctcc

SEQ ID NO: 398020 - DNA, 16 bp, M. musculus
ctggagagatggctcg

SEQ ID NO: 398021 - DNA, 16 bp, M. musculus
ctggagagatggctct

SEQ ID NO: 398022 - DNA, 16 bp, M. musculus
ctggagagatggtggc

SEQ ID NO: 398023 - DNA, 16 bp, M. musculus
ctggagagcagccagt

SEQ ID NO: 398024 - DNA, 16 bp, M. musculus
ctggagagctggctcc

SEQ ID NO: 398025 - DNA, 16 bp, M. musculus
ctggagagctgggatt

SEQ ID NO: 398026 - DNA, 16 bp, M. musculus
ctggagaggctgagaa

SEQ ID NO: 398027 - DNA, 16 bp, M. musculus
ctggagagggagctga

SEQ ID NO: 398028 - DNA, 16 bp, M. musculus
ctggagagggagggag

SEQ ID NO: 398029 - DNA, 16 bp, M. musculus
ctggagaggtagagac

SEQ ID NO: 398030 - DNA, 16 bp, M. musculus
ctggagaggtggagac

SEQ ID NO: 398031 - DNA, 16 bp, M. musculus
ctggagagtcagctca

SEQ ID NO: 398032 - DNA, 16 bp, M. musculus
ctggagagttggccca

SEQ ID NO: 398033 - DNA, 16 bp, M. musculus
ctggagatagaaaacc

SEQ ID NO: 398034 - DNA, 16 bp, M. musculus
ctggagatctctcaaa

SEQ ID NO: 398035 - DNA, 16 bp, M. musculus
ctggagatgcagctca

SEQ ID NO: 398036 - DNA, 16 bp, M. musculus
ctggagatggaaccca

SEQ ID NO: 398037 - DNA, 16 bp, M. musculus
ctggagatggagctga

SEQ ID NO: 398038 - DNA, 16 bp, M. musculus
ctggagatggggcatg

SEQ ID NO: 398039 - DNA, 16 bp, M. musculus
ctggagatgtagttca

SEQ ID NO: 398040 - DNA, 16 bp, M. musculus
ctggagatgtgactca

SEQ ID NO: 398041 - DNA, 16 bp, M. musculus
ctggagatgtggctca

SEQ ID NO: 398042 - DNA, 16 bp, M. musculus
ctggagcaaataaatc

SEQ ID NO: 398043 - DNA, 16 bp, M. musculus
ctggagcaagagtgag

SEQ ID NO: 398044 - DNA, 16 bp, M. musculus
ctggagcaagcagagg

SEQ ID NO: 398045 - DNA, 16 bp, M. musculus
ctggagcaagcaggga

SEQ ID NO: 398046 - DNA, 16 bp, M. musculus
ctggagcaagctggct

SEQ ID NO: 398047 - DNA, 16 bp, M. musculus
ctggagcacagcttct

SEQ ID NO: 398048 - DNA, 16 bp, M. musculus
ctggagcacaggaagg

SEQ ID NO: 398049 - DNA, 16 bp, M. musculus
ctggagcacctggggg

SEQ ID NO: 398050 - DNA, 16 bp, M. musculus
ctggagcagaagctga

SEQ ID NO: 398051 - DNA, 16 bp, M. musculus
ctggagcagagccagc

SEQ ID NO: 398052 - DNA, 16 bp, M. musculus
ctggagcagaggcagg

SEQ ID NO: 398053 - DNA, 16 bp, M. musculus
ctggagcagaggctct

SEQ ID NO: 398054 - DNA, 16 bp, M. musculus
ctggagcagaggctgt

SEQ ID NO: 398055 - DNA, 16 bp, M. musculus
ctggagcagcagcagc

SEQ ID NO: 398056 - DNA, 16 bp, M. musculus
ctggagcagcagctga

SEQ ID NO: 398057 - DNA, 16 bp, M. musculus
ctggagcagtgctgga

SEQ ID NO: 398058 - DNA, 16 bp, M. musculus
ctggagcagttgctga

SEQ ID NO: 398059 - DNA, 16 bp, M. musculus
ctggagccaagaaggc

SEQ ID NO: 398060 - DNA, 16 bp, M. musculus
ctggagccagaggcag

SEQ ID NO: 398061 - DNA, 16 bp, M. musculus
ctggagccaggagctg

SEQ ID NO: 398062 - DNA, 16 bp, M. musculus
ctggagccatctctcc

SEQ ID NO: 398063 - DNA, 16 bp, M. musculus
ctggagccatgggtat

SEQ ID NO: 398064 - DNA, 16 bp, M. musculus
ctggagccatgtgtct

SEQ ID NO: 398065 - DNA, 16 bp, M. musculus
ctggagcccaggctgg

SEQ ID NO: 398066 - DNA, 16 bp, M. musculus
ctggagcccttagcag

SEQ ID NO: 398067 - DNA, 16 bp, M. musculus
ctggagcctactggga

SEQ ID NO: 398068 - DNA, 16 bp, M. musculus
ctggagcctgcctcct

SEQ ID NO: 398069 - DNA, 16 bp, M. musculus
ctggagcctgtccctc

SEQ ID NO: 398070 - DNA, 16 bp, M. musculus
ctggagctacagatgg

SEQ ID NO: 398071 - DNA, 16 bp, M. musculus
ctggagctaggctcag

SEQ ID NO: 398072 - DNA, 16 bp, M. musculus
ctggagctaggcttgg

SEQ ID NO: 398073 - DNA, 16 bp, M. musculus
ctggagctcaagcagg

SEQ ID NO: 398074 - DNA, 16 bp, M. musculus
ctggagctgaaaatgg

SEQ ID NO: 398075 - DNA, 16 bp, M. musculus
ctggagctgaaagaga

SEQ ID NO: 398076 - DNA, 16 bp, M. musculus
ctggagctgaagaatc

SEQ ID NO: 398077 - DNA, 16 bp, M. musculus
ctggagctgaagtcac

SEQ ID NO: 398078 - DNA, 16 bp, M. musculus
ctggagctgaggatgg

SEQ ID NO: 398079 - DNA, 16 bp, M. musculus
ctggagctgaggctga

SEQ ID NO: 398080 - DNA, 16 bp, M. musculus
ctggagctgcagacag

SEQ ID NO: 398081 - DNA, 16 bp, M. musculus
ctggagctgcagatgg

SEQ ID NO: 398082 - DNA, 16 bp, M. musculus
ctggagctggaattat

SEQ ID NO: 398083 - DNA, 16 bp, M. musculus
ctggagctggacttag

SEQ ID NO: 398084 - DNA, 16 bp, M. musculus
ctggagctggagctgg

SEQ ID NO: 398085 - DNA, 16 bp, M. musculus
ctggagctggagtttt

SEQ ID NO: 398086 - DNA, 16 bp, M. musculus
ctggagctggctcagg

SEQ ID NO: 398087 - DNA, 16 bp, M. musculus
ctggagctggggctgg

SEQ ID NO: 398088 - DNA, 16 bp, M. musculus
ctggagctgtggctca

SEQ ID NO: 398089 - DNA, 16 bp, M. musculus
ctggagctgtgtgtgt

SEQ ID NO: 398090 - DNA, 16 bp, M. musculus
ctggagctgttggttt

SEQ ID NO: 398091 - DNA, 16 bp, M. musculus
ctggagcttgctggct

SEQ ID NO: 398092 - DNA, 16 bp, M. musculus
ctggagcttgctggtc

SEQ ID NO: 398093 - DNA, 16 bp, M. musculus
ctggaggaagtggatc

SEQ ID NO: 398094 - DNA, 16 bp, M. musculus
ctggaggagaaactgg

SEQ ID NO: 398095 - DNA, 16 bp, M. musculus
ctggaggagatgtgag

SEQ ID NO: 398096 - DNA, 16 bp, M. musculus
ctggaggagcagccag

SEQ ID NO: 398097 - DNA, 16 bp, M. musculus
ctggaggagctgaaag

SEQ ID NO: 398098 - DNA, 16 bp, M. musculus
ctggaggagctgagag

SEQ ID NO: 398099 - DNA, 16 bp, M. musculus
ctggaggaggaagctg

SEQ ID NO: 398100 - DNA, 16 bp, M. musculus
ctggaggcaagagctg

SEQ ID NO: 398101 - DNA, 16 bp, M. musculus
ctggaggcactggagg

SEQ ID NO: 398102 - DNA, 16 bp, M. musculus
ctggaggcagaaacag

SEQ ID NO: 398103 - DNA, 16 bp, M. musculus
ctggaggcagaaacca

SEQ ID NO: 398104 - DNA, 16 bp, M. musculus
ctggaggcagaagctg

SEQ ID NO: 398105 - DNA, 16 bp, M. musculus
ctggaggcagatgcag

SEQ ID NO: 398106 - DNA, 16 bp, M. musculus
ctggaggcagcagctg

SEQ ID NO: 398107 - DNA, 16 bp, M. musculus
ctggaggcaggaattg

SEQ ID NO: 398108 - DNA, 16 bp, M. musculus
ctggaggcaggggctg

SEQ ID NO: 398109 - DNA, 16 bp, M. musculus
ctggaggcattgcaga

SEQ ID NO: 398110 - DNA, 16 bp, M. musculus
ctggaggccacaggga

SEQ ID NO: 398111 - DNA, 16 bp, M. musculus
ctggaggcccagggag

SEQ ID NO: 398112 - DNA, 16 bp, M. musculus
ctggaggctagcctgg

SEQ ID NO: 398113 - DNA, 16 bp, M. musculus
ctggaggctgaggctg

SEQ ID NO: 398114 - DNA, 16 bp, M. musculus
ctggaggctggggaga

SEQ ID NO: 398115 - DNA, 16 bp, M. musculus
ctggagggaaggctca

SEQ ID NO: 398116 - DNA, 16 bp, M. musculus
ctggagggatggctcc

SEQ ID NO: 398117 - DNA, 17 bp, M. musculus
ctggagggcatcatcct

SEQ ID NO: 398118 - DNA, 16 bp, M. musculus
ctggagggcatgtggg

SEQ ID NO: 398119 - DNA, 16 bp, M. musculus
ctggaggggctggaga

SEQ ID NO: 398120 - DNA, 16 bp, M. musculus
ctggaggggctggagg

SEQ ID NO: 398121 - DNA, 16 bp, M. musculus
ctggaggtcctgggtt

SEQ ID NO: 398122 - DNA, 16 bp, M. musculus
ctggaggtggagttac

SEQ ID NO: 398123 - DNA, 16 bp, M. musculus
ctggaggtgggctctg

SEQ ID NO: 398124 - DNA, 16 bp, M. musculus
ctggaggttatcatcc

SEQ ID NO: 398125 - DNA, 16 bp, M. musculus
ctggaggttcctggtg

SEQ ID NO: 398126 - DNA, 16 bp, M. musculus
ctggaggtttcatttg

SEQ ID NO: 398127 - DNA, 16 bp, M. musculus
ctggagtcaagagctc

SEQ ID NO: 398128 - DNA, 16 bp, M. musculus
ctggagtcacagatga

SEQ ID NO: 398129 - DNA, 16 bp, M. musculus
ctggagtccagcctct

SEQ ID NO: 398130 - DNA, 16 bp, M. musculus
ctggagtccagcttct

SEQ ID NO: 398131 - DNA, 16 bp, M. musculus
ctggagtctctgaaga

SEQ ID NO: 398132 - DNA, 16 bp, M. musculus
ctggagtctgaggcag

SEQ ID NO: 398133 - DNA, 16 bp, M. musculus
ctggagtgacagctca

SEQ ID NO: 398134 - DNA, 16 bp, M. musculus
ctggagtgagcagggc

SEQ ID NO: 398135 - DNA, 16 bp, M. musculus
ctggagtgcctgaaga

SEQ ID NO: 398136 - DNA, 16 bp, M. musculus
ctggagtggctgaaga

SEQ ID NO: 398137 - DNA, 16 bp, M. musculus
ctggagtgtcagaaga

SEQ ID NO: 398138 - DNA, 16 bp, M. musculus
ctggagtgtctgaaga

SEQ ID NO: 398139 - DNA, 16 bp, M. musculus
ctggagttacacatgg

SEQ ID NO: 398140 - DNA, 16 bp, M. musculus
ctggagttacagatag

SEQ ID NO: 398141 - DNA, 16 bp, M. musculus
ctggagttacaggagc

SEQ ID NO: 398142 - DNA, 16 bp, M. musculus
ctggagttagagatgg

SEQ ID NO: 398143 - DNA, 16 bp, M. musculus
ctggagttatagataa

SEQ ID NO: 398144 - DNA, 16 bp, M. musculus
ctggagttatagatag

SEQ ID NO: 398145 - DNA, 23 bp, M. musculus
ctggagttatcacagagaaagga

SEQ ID NO: 398146 - DNA, 16 bp, M. musculus
ctggagttatcagaga

SEQ ID NO: 398147 - DNA, 16 bp, M. musculus
ctggagttatctcaga

SEQ ID NO: 398148 - DNA, 16 bp, M. musculus
ctggagttcagtttct

SEQ ID NO: 398149 - DNA, 16 bp, M. musculus
ctggagttccaggagc

SEQ ID NO: 398150 - DNA, 16 bp, M. musculus
ctggagttggaggcag

SEQ ID NO: 398151 - DNA, 16 bp, M. musculus
ctggagttgtgagctg

SEQ ID NO: 398152 - DNA, 16 bp, M. musculus
ctggagtttgaggcca

SEQ ID NO: 398153 - DNA, 16 bp, M. musculus
ctggatattgaactca

SEQ ID NO: 398154 - DNA, 16 bp, M. musculus
ctggatattgtctcta

SEQ ID NO: 398155 - DNA, 16 bp, M. musculus
ctggatcaaagcaaga

SEQ ID NO: 398156 - DNA, 16 bp, M. musculus
ctggatcacaagtgtg

SEQ ID NO: 398157 - DNA, 16 bp, M. musculus
ctggatccacagacag

SEQ ID NO: 398158 - DNA, 16 bp, M. musculus
ctggatcccactttgg

SEQ ID NO: 398159 - DNA, 16 bp, M. musculus
ctggatcctctgaaag

SEQ ID NO: 398160 - DNA, 16 bp, M. musculus
ctggatctacaggcag

SEQ ID NO: 398161 - DNA, 16 bp, M. musculus
ctggatctcatggaga

SEQ ID NO: 398162 - DNA, 16 bp, M. musculus
ctggatctcctttccc

SEQ ID NO: 398163 - DNA, 16 bp, M. musculus
ctggatctgctgaagg

SEQ ID NO: 398164 - DNA, 16 bp, M. musculus
ctggatctgggacttg

SEQ ID NO: 398165 - DNA, 16 bp, M. musculus
ctggatctgggtctga

SEQ ID NO: 398166 - DNA, 25 bp, M. musculus
ctggatcttggtatggagatcttga

SEQ ID NO: 398167 - DNA, 16 bp, M. musculus
ctggatgaaatgaaca

SEQ ID NO: 398168 - DNA, 16 bp, M. musculus
ctggatgaaatgtaca

SEQ ID NO: 398169 - DNA, 16 bp, M. musculus
ctggatgaaatttcaa

SEQ ID NO: 398170 - DNA, 16 bp, M. musculus
ctggatgaagactctc

SEQ ID NO: 398171 - DNA, 16 bp, M. musculus
ctggatgaagcctctc

SEQ ID NO: 398172 - DNA, 16 bp, M. musculus
ctggatgaagttcagg

SEQ ID NO: 398173 - DNA, 16 bp, M. musculus
ctggatgaatctcaga

SEQ ID NO: 398174 - DNA, 16 bp, M. musculus
ctggatgacctggaac

SEQ ID NO: 398175 - DNA, 16 bp, M. musculus
ctggatgagatggaca

SEQ ID NO: 398176 - DNA, 16 bp, M. musculus
ctggatgccagtggtg

SEQ ID NO: 398177 - DNA, 16 bp, M. musculus
ctggatgccccaggga

SEQ ID NO: 398178 - DNA, 16 bp, M. musculus
ctggatgccctcttct

SEQ ID NO: 398179 - DNA, 16 bp, M. musculus
ctggatgccctggaac

SEQ ID NO: 398180 - DNA, 16 bp, M. musculus
ctggatgctcccttct

SEQ ID NO: 398181 - DNA, 16 bp, M. musculus
ctggatgctttccact

SEQ ID NO: 398182 - DNA, 16 bp, M. musculus
ctggatggcctggaac

SEQ ID NO: 398183 - DNA, 16 bp, M. musculus
ctggatggctttgttc

SEQ ID NO: 398184 - DNA, 16 bp, M. musculus
ctggatgggaaagggg

SEQ ID NO: 398185 - DNA, 16 bp, M. musculus
ctggatggtcactcct

SEQ ID NO: 398186 - DNA, 17 bp, M. musculus
ctggatggttttcgctc

SEQ ID NO: 398187 - DNA, 16 bp, M. musculus
ctggatgtctgcatgt

SEQ ID NO: 398188 - DNA, 16 bp, M. musculus
ctggatgtctggagcc

SEQ ID NO: 398189 - DNA, 16 bp, M. musculus
ctggatgtggtggcgc

SEQ ID NO: 398190 - DNA, 16 bp, M. musculus
ctggattcagttctca

SEQ ID NO: 398191 - DNA, 16 bp, M. musculus
ctggattcatgaatga

SEQ ID NO: 398192 - DNA, 16 bp, M. musculus
ctggattccaccttct

SEQ ID NO: 398193 - DNA, 16 bp, M. musculus
ctggattccagcttct

SEQ ID NO: 398194 - DNA, 16 bp, M. musculus
ctggattctgaggagt

SEQ ID NO: 398195 - DNA, 16 bp, M. musculus
ctggattctgtaagaa

SEQ ID NO: 398196 - DNA, 16 bp, M. musculus
ctggattcttagactt

SEQ ID NO: 398197 - DNA, 19 bp, M. musculus
ctggattgctggattgctg

SEQ ID NO: 398198 - DNA, 16 bp, M. musculus
ctggattgggattaaa

SEQ ID NO: 398199 - DNA, 16 bp, M. musculus
ctggatttaaaggtgt

SEQ ID NO: 398200 - DNA, 16 bp, M. musculus
ctggatttacagacag

SEQ ID NO: 398201 - DNA, 16 bp, M. musculus
ctggatttcctggagg

SEQ ID NO: 398202 - DNA, 16 bp, M. musculus
ctggatttgggcctgg

SEQ ID NO: 398203 - DNA, 16 bp, M. musculus
ctggattttgttttgt

SEQ ID NO: 398204 - DNA, 16 bp, M. musculus
ctggatttttatgtgg

SEQ ID NO: 398205 - DNA, 16 bp, M. musculus
ctggcaaaaacagaag

SEQ ID NO: 398206 - DNA, 16 bp, M. musculus
ctggcaaaactggttg

SEQ ID NO: 398207 - DNA, 16 bp, M. musculus
ctggcaaaagatgaag

SEQ ID NO: 398208 - DNA, 16 bp, M. musculus
ctggcaaaatcatgcc

SEQ ID NO: 398209 - DNA, 16 bp, M. musculus
ctggcaaacccacact

SEQ ID NO: 398210 - DNA, 16 bp, M. musculus
ctggcaaagggaaaat

SEQ ID NO: 398211 - DNA, 16 bp, M. musculus
ctggcaacagccagat

SEQ ID NO: 398212 - DNA, 16 bp, M. musculus
ctggcaagaacacact

SEQ ID NO: 398213 - DNA, 16 bp, M. musculus
ctggcaagaagcaact

SEQ ID NO: 398214 - DNA, 16 bp, M. musculus
ctggcaagatggttca

SEQ ID NO: 398215 - DNA, 16 bp, M. musculus
ctggcaagctctcctc

SEQ ID NO: 398216 - DNA, 17 bp, M. musculus
ctggcaaggtaccctgg

SEQ ID NO: 398217 - DNA, 16 bp, M. musculus
ctggcaagtgaccctg

SEQ ID NO: 398218 - DNA, 16 bp, M. musculus
ctggcaataagacaaa

SEQ ID NO: 398219 - DNA, 16 bp, M. musculus
ctggcaatatggctca

SEQ ID NO: 398220 - DNA, 16 bp, M. musculus
ctggcaatgatgtgga

SEQ ID NO: 398221 - DNA, 16 bp, M. musculus
ctggcaatgggcaaag

SEQ ID NO: 398222 - DNA, 16 bp, M. musculus
ctggcacagcctctca

SEQ ID NO: 398223 - DNA, 16 bp, M. musculus
ctggcacatgccttta

SEQ ID NO: 398224 - DNA, 16 bp, M. musculus
ctggcaccacccacag

SEQ ID NO: 398225 - DNA, 16 bp, M. musculus
ctggcaccctcttctg

SEQ ID NO: 398226 - DNA, 16 bp, M. musculus
ctggcactgaccagaa

SEQ ID NO: 398227 - DNA, 16 bp, M. musculus
ctggcactgggctttt

SEQ ID NO: 398228 - DNA, 16 bp, M. musculus
ctggcagaagaaactg

SEQ ID NO: 398229 - DNA, 16 bp, M. musculus
ctggcagaaggaactc

SEQ ID NO: 398230 - DNA, 16 bp, M. musculus
ctggcagaaggaaggg

SEQ ID NO: 398231 - DNA, 16 bp, M. musculus
ctggcagaaggactgg

SEQ ID NO: 398232 - DNA, 16 bp, M. musculus
ctggcagaagttgttt

SEQ ID NO: 398233 - DNA, 16 bp, M. musculus
ctggcagagaagaaag

SEQ ID NO: 398234 - DNA, 16 bp, M. musculus
ctggcagagacagaga

SEQ ID NO: 398235 - DNA, 16 bp, M. musculus
ctggcagagagacaga

SEQ ID NO: 398236 - DNA, 16 bp, M. musculus
ctggcagagcttctca

SEQ ID NO: 398237 - DNA, 16 bp, M. musculus
ctggcagaggaggaag

SEQ ID NO: 398238 - DNA, 16 bp, M. musculus
ctggcagaggcaggtg

SEQ ID NO: 398239 - DNA, 16 bp, M. musculus
ctggcagcagaacttg

SEQ ID NO: 398240 - DNA, 16 bp, M. musculus
ctggcagcaggaagag

SEQ ID NO: 398241 - DNA, 16 bp, M. musculus
ctggcagcatcagtaa

SEQ ID NO: 398242 - DNA, 16 bp, M. musculus
ctggcagccagcaagc

SEQ ID NO: 398243 - DNA, 16 bp, M. musculus
ctggcagctcacaact

SEQ ID NO: 398244 - DNA, 16 bp, M. musculus
ctggcagctcccttgt

SEQ ID NO: 398245 - DNA, 16 bp, M. musculus
ctggcagctctgcctg

SEQ ID NO: 398246 - DNA, 16 bp, M. musculus
ctggcagctttgccca

SEQ ID NO: 398247 - DNA, 16 bp, M. musculus
ctggcaggaaccaggc

SEQ ID NO: 398248 - DNA, 16 bp, M. musculus
ctggcaggacacaggt

SEQ ID NO: 398249 - DNA, 16 bp, M. musculus
ctggcaggcaatggcc

SEQ ID NO: 398250 - DNA, 16 bp, M. musculus
ctggcagggtgtgggg

SEQ ID NO: 398251 - DNA, 16 bp, M. musculus
ctggcagtcctgggtt

SEQ ID NO: 398252 - DNA, 16 bp, M. musculus
ctggcagttatcttgt

SEQ ID NO: 398253 - DNA, 16 bp, M. musculus
ctggcagttcctgaga

SEQ ID NO: 398254 - DNA, 16 bp, M. musculus
ctggcagttctctgct

SEQ ID NO: 398255 - DNA, 16 bp, M. musculus
ctggcatagaactcac

SEQ ID NO: 398256 - DNA, 16 bp, M. musculus
ctggcatcaatgggag

SEQ ID NO: 398257 - DNA, 16 bp, M. musculus
ctggcatcacttttcc

SEQ ID NO: 398258 - DNA, 16 bp, M. musculus
ctggcatcctcaggca

SEQ ID NO: 398259 - DNA, 16 bp, M. musculus
ctggcatctctaacat

SEQ ID NO: 398260 - DNA, 16 bp, M. musculus
ctggcatctgggactt

SEQ ID NO: 398261 - DNA, 16 bp, M. musculus
ctggcatctgtggtct

SEQ ID NO: 398262 - DNA, 16 bp, M. musculus
ctggcatctttattta

SEQ ID NO: 398263 - DNA, 16 bp, M. musculus
ctggcatgcacaaagc

SEQ ID NO: 398264 - DNA, 16 bp, M. musculus
ctggcattcctctaca

SEQ ID NO: 398265 - DNA, 16 bp, M. musculus
ctggcattttgttctc

SEQ ID NO: 398266 - DNA, 16 bp, M. musculus
ctggcatttttgttct

SEQ ID NO: 398267 - DNA, 16 bp, M. musculus
ctggccaaagatgaag

SEQ ID NO: 398268 - DNA, 16 bp, M. musculus
ctggccaacaagcccc

SEQ ID NO: 398269 - DNA, 16 bp, M. musculus
ctggccaaggacaagc

SEQ ID NO: 398270 - DNA, 16 bp, M. musculus
ctggccaaggtcatcc

SEQ ID NO: 398271 - DNA, 16 bp, M. musculus
ctggccacaggaggca

SEQ ID NO: 398272 - DNA, 16 bp, M. musculus
ctggccactctctccc

SEQ ID NO: 398273 - DNA, 16 bp, M. musculus
ctggccactgggtcca

SEQ ID NO: 398274 - DNA, 16 bp, M. musculus
ctggccagagagcccc

SEQ ID NO: 398275 - DNA, 16 bp, M. musculus
ctggccagagttcctc

SEQ ID NO: 398276 - DNA, 16 bp, M. musculus
ctggccagcaaactcc

SEQ ID NO: 398277 - DNA, 16 bp, M. musculus
ctggccagccagcctg

SEQ ID NO: 398278 - DNA, 16 bp, M. musculus
ctggccagccagtgag

SEQ ID NO: 398279 - DNA, 16 bp, M. musculus
ctggccagcctgtcta

SEQ ID NO: 398280 - DNA, 16 bp, M. musculus
ctggccagcggagttg

SEQ ID NO: 398281 - DNA, 16 bp, M. musculus
ctggccaggaaggtgc

SEQ ID NO: 398282 - DNA, 16 bp, M. musculus
ctggccagtgagcccc

SEQ ID NO: 398283 - DNA, 16 bp, M. musculus
ctggccagtgagctgc

SEQ ID NO: 398284 - DNA, 16 bp, M. musculus
ctggccagtgcagaag

SEQ ID NO: 398285 - DNA, 16 bp, M. musculus
ctggccatcttggaac

SEQ ID NO: 398286 - DNA, 16 bp, M. musculus
ctggcccaacctgaga

SEQ ID NO: 398287 - DNA, 16 bp, M. musculus
ctggcccaactagaga

SEQ ID NO: 398288 - DNA, 16 bp, M. musculus
ctggcccactgcagca

SEQ ID NO: 398289 - DNA, 16 bp, M. musculus
ctggcccagaaaagaa

SEQ ID NO: 398290 - DNA, 16 bp, M. musculus
ctggcccagaagctgt

SEQ ID NO: 398291 - DNA, 16 bp, M. musculus
ctggcccaggctggcc

SEQ ID NO: 398292 - DNA, 16 bp, M. musculus
ctggcccattgccagg

SEQ ID NO: 398293 - DNA, 16 bp, M. musculus
ctggccccacccctca

SEQ ID NO: 398294 - DNA, 16 bp, M. musculus
ctggcccctggcccct

SEQ ID NO: 398295 - DNA, 16 bp, M. musculus
ctggccctgaactcaa

SEQ ID NO: 398296 - DNA, 16 bp, M. musculus
ctggccctggcatccc

SEQ ID NO: 398297 - DNA, 16 bp, M. musculus
ctggccctggccctgc

SEQ ID NO: 398298 - DNA, 16 bp, M. musculus
ctggccctggctttcc

SEQ ID NO: 398299 - DNA, 16 bp, M. musculus
ctggccctggtggtgt

SEQ ID NO: 398300 - DNA, 16 bp, M. musculus
ctggccctgttggaag

SEQ ID NO: 398301 - DNA, 16 bp, M. musculus
ctggccctttaggttg

SEQ ID NO: 398302 - DNA, 20 bp, M. musculus
ctggccgccacttctgagct

SEQ ID NO: 398303 - DNA, 16 bp, M. musculus
ctggccgctcttccag

SEQ ID NO: 398304 - DNA, 23 bp, M. musculus
ctggccgctgcctatcaggacca

SEQ ID NO: 398305 - DNA, 16 bp, M. musculus
ctggccgggcagtggt

SEQ ID NO: 398306 - DNA, 16 bp, M. musculus
ctggcctcaaactatg

SEQ ID NO: 398307 - DNA, 16 bp, M. musculus
ctggcctcaaactctg

SEQ ID NO: 398308 - DNA, 16 bp, M. musculus
ctggcctcaactcaga

SEQ ID NO: 398309 - DNA, 16 bp, M. musculus
ctggcctcaagctcac

SEQ ID NO: 398310 - DNA, 16 bp, M. musculus
ctggcctcacactcag

SEQ ID NO: 398311 - DNA, 16 bp, M. musculus
ctggcctcagaaatct

SEQ ID NO: 398312 - DNA, 16 bp, M. musculus
ctggcctcagactcac

SEQ ID NO: 398313 - DNA, 16 bp, M. musculus
ctggcctcagagggag

SEQ ID NO: 398314 - DNA, 16 bp, M. musculus
ctggcctcagtgagaa

SEQ ID NO: 398315 - DNA, 16 bp, M. musculus
ctggcctcagtggaga

SEQ ID NO: 398316 - DNA, 16 bp, M. musculus
ctggcctccaacttac

SEQ ID NO: 398317 - DNA, 16 bp, M. musculus
ctggcctccaaggaca

SEQ ID NO: 398318 - DNA, 16 bp, M. musculus
ctggcctccaagggca

SEQ ID NO: 398319 - DNA, 16 bp, M. musculus
ctggcctccacaggca

SEQ ID NO: 398320 - DNA, 16 bp, M. musculus
ctggcctccacattca

SEQ ID NO: 398321 - DNA, 16 bp, M. musculus
ctggcctccagctcac

SEQ ID NO: 398322 - DNA, 16 bp, M. musculus
ctggcctccaggctcc

SEQ ID NO: 398323 - DNA, 16 bp, M. musculus
ctggcctccatacatg

SEQ ID NO: 398324 - DNA, 16 bp, M. musculus
ctggcctccatggaca

SEQ ID NO: 398325 - DNA, 16 bp, M. musculus
ctggcctccatgggca

SEQ ID NO: 398326 - DNA, 16 bp, M. musculus
ctggcctccatgtgtg

SEQ ID NO: 398327 - DNA, 16 bp, M. musculus
ctggcctccctgggca

SEQ ID NO: 398328 - DNA, 16 bp, M. musculus
ctggcctcctcaagca

SEQ ID NO: 398329 - DNA, 16 bp, M. musculus
ctggcctcctggcctc

SEQ ID NO: 398330 - DNA, 16 bp, M. musculus
ctggcctcctggggca

SEQ ID NO: 398331 - DNA, 16 bp, M. musculus
ctggcctcgaacttac

SEQ ID NO: 398332 - DNA, 16 bp, M. musculus
ctggcctctaactcac

SEQ ID NO: 398333 - DNA, 16 bp, M. musculus
ctggcctctaagggca

SEQ ID NO: 398334 - DNA, 16 bp, M. musculus
ctggcctctctgggca

SEQ ID NO: 398335 - DNA, 16 bp, M. musculus
ctggcctctgaacaca

SEQ ID NO: 398336 - DNA, 16 bp, M. musculus
ctggcctctgcacaca

SEQ ID NO: 398337 - DNA, 16 bp, M. musculus
ctggcctctgcagata

SEQ ID NO: 398338 - DNA, 16 bp, M. musculus
ctggcctctgcaggga

SEQ ID NO: 398339 - DNA, 16 bp, M. musculus
ctggcctctgcaggta

SEQ ID NO: 398340 - DNA, 16 bp, M. musculus
ctggcctctgcctccc

SEQ ID NO: 398341 - DNA, 16 bp, M. musculus
ctggcctctgccttcc

SEQ ID NO: 398342 - DNA, 16 bp, M. musculus
ctggcctctggcctct

SEQ ID NO: 398343 - DNA, 16 bp, M. musculus
ctggcctctggcttcc

SEQ ID NO: 398344 - DNA, 16 bp, M. musculus
ctggcctctggctttt

SEQ ID NO: 398345 - DNA, 16 bp, M. musculus
ctggcctctgtgagca

SEQ ID NO: 398346 - DNA, 16 bp, M. musculus
ctggcctctgtgcaca

SEQ ID NO: 398347 - DNA, 16 bp, M. musculus
ctggcctctgtgggaa

SEQ ID NO: 398348 - DNA, 16 bp, M. musculus
ctggcctctgtgggct

SEQ ID NO: 398349 - DNA, 16 bp, M. musculus
ctggcctctgtgggta

SEQ ID NO: 398350 - DNA, 16 bp, M. musculus
ctggcctctgtgggtg

SEQ ID NO: 398351 - DNA, 16 bp, M. musculus
ctggcctgaagcaagg

SEQ ID NO: 398352 - DNA, 16 bp, M. musculus
ctggcctgaagtatgt

SEQ ID NO: 398353 - DNA, 16 bp, M. musculus
ctggcctgacttcctt

SEQ ID NO: 398354 - DNA, 16 bp, M. musculus
ctggcctgaggcaaaa

SEQ ID NO: 398355 - DNA, 16 bp, M. musculus
ctggcctgagggggga

SEQ ID NO: 398356 - DNA, 16 bp, M. musculus
ctggcctgccagccta

SEQ ID NO: 398357 - DNA, 16 bp, M. musculus
ctggcctgcctctgcc

SEQ ID NO: 398358 - DNA, 16 bp, M. musculus
ctggcctggaacccac

SEQ ID NO: 398359 - DNA, 16 bp, M. musculus
ctggcctggaacccag

SEQ ID NO: 398360 - DNA, 16 bp, M. musculus
ctggcctggaactcaa

SEQ ID NO: 398361 - DNA, 16 bp, M. musculus
ctggcctggaactcac

SEQ ID NO: 398362 - DNA, 16 bp, M. musculus
ctggcctggaactccc

SEQ ID NO: 398363 - DNA, 17 bp, M. musculus
ctggcctggagctcaca

SEQ ID NO: 398364 - DNA, 16 bp, M. musculus
ctggcctggagcttgc

SEQ ID NO: 398365 - DNA, 16 bp, M. musculus
ctggcctggagtttgc

SEQ ID NO: 398366 - DNA, 16 bp, M. musculus
ctggcctggatctcac

SEQ ID NO: 398367 - DNA, 16 bp, M. musculus
ctggcctggctacctc

SEQ ID NO: 398368 - DNA, 16 bp, M. musculus
ctggcctgggactcac

SEQ ID NO: 398369 - DNA, 16 bp, M. musculus
ctggcctgtgggcatg

SEQ ID NO: 398370 - DNA, 16 bp, M. musculus
ctggcctgtgtgctga

SEQ ID NO: 398371 - DNA, 16 bp, M. musculus
ctggccttaagctcac

SEQ ID NO: 398372 - DNA, 16 bp, M. musculus
ctggccttagactcag

SEQ ID NO: 398373 - DNA, 16 bp, M. musculus
ctggccttcacagaca

SEQ ID NO: 398374 - DNA, 16 bp, M. musculus
ctggccttcacaggca

SEQ ID NO: 398375 - DNA, 16 bp, M. musculus
ctggccttcaccagcc

SEQ ID NO: 398376 - DNA, 16 bp, M. musculus
ctggccttcaggactt

SEQ ID NO: 398377 - DNA, 16 bp, M. musculus
ctggccttcatcctca

SEQ ID NO: 398378 - DNA, 16 bp, M. musculus
ctggccttcctggaac

SEQ ID NO: 398379 - DNA, 16 bp, M. musculus
ctggccttcctggccc

SEQ ID NO: 398380 - DNA, 16 bp, M. musculus
ctggccttcctgggca

SEQ ID NO: 398381 - DNA, 16 bp, M. musculus
ctggccttctgggctt

SEQ ID NO: 398382 - DNA, 16 bp, M. musculus
ctggccttgaacctct

SEQ ID NO: 398383 - DNA, 16 bp, M. musculus
ctggccttgaacctgc

SEQ ID NO: 398384 - DNA, 17 bp, M. musculus
ctggccttgaactcagt

SEQ ID NO: 398385 - DNA, 16 bp, M. musculus
ctggccttgaactccc

SEQ ID NO: 398386 - DNA, 16 bp, M. musculus
ctggccttgaactctt

SEQ ID NO: 398387 - DNA, 16 bp, M. musculus
ctggccttgaactttc

SEQ ID NO: 398388 - DNA, 16 bp, M. musculus
ctggccttgaagtcac

SEQ ID NO: 398389 - DNA, 16 bp, M. musculus
ctggccttgaccttgc

SEQ ID NO: 398390 - DNA, 16 bp, M. musculus
ctggcctttgtgagca

SEQ ID NO: 398391 - DNA, 16 bp, M. musculus
ctggcgaaggccagca

SEQ ID NO: 398392 - DNA, 16 bp, M. musculus
ctggcgaaggccagtt

SEQ ID NO: 398393 - DNA, 17 bp, M. musculus
ctggcgagatggctcag

SEQ ID NO: 398394 - DNA, 16 bp, M. musculus
ctggctaactgttctt

SEQ ID NO: 398395 - DNA, 16 bp, M. musculus
ctggctacagaaggtg

SEQ ID NO: 398396 - DNA, 16 bp, M. musculus
ctggctaccctggaac

SEQ ID NO: 398397 - DNA, 16 bp, M. musculus
ctggctactgctgctg

SEQ ID NO: 398398 - DNA, 16 bp, M. musculus
ctggctacttccccag

SEQ ID NO: 398399 - DNA, 16 bp, M. musculus
ctggctagaggaggtg

SEQ ID NO: 398400 - DNA, 16 bp, M. musculus
ctggctagccagccta

SEQ ID NO: 398401 - DNA, 16 bp, M. musculus
ctggctaggatttcaa

SEQ ID NO: 398402 - DNA, 16 bp, M. musculus
ctggctaggtttgtgt

SEQ ID NO: 398403 - DNA, 16 bp, M. musculus
ctggctagttttatat

SEQ ID NO: 398404 - DNA, 16 bp, M. musculus
ctggctcaacatctcc

SEQ ID NO: 398405 - DNA, 16 bp, M. musculus
ctggctcaattggcag

SEQ ID NO: 398406 - DNA, 16 bp, M. musculus
ctggctcagaccttgt

SEQ ID NO: 398407 - DNA, 16 bp, M. musculus
ctggctcagcctccca

SEQ ID NO: 398408 - DNA, 16 bp, M. musculus
ctggctcatagtgcag

SEQ ID NO: 398409 - DNA, 16 bp, M. musculus
ctggctccacttcctg

SEQ ID NO: 398410 - DNA, 16 bp, M. musculus
ctggctccatcttttg

SEQ ID NO: 398411 - DNA, 16 bp, M. musculus
ctggctcctacaatct

SEQ ID NO: 398412 - DNA, 16 bp, M. musculus
ctggctcctctccatt

SEQ ID NO: 398413 - DNA, 16 bp, M. musculus
ctggctcctgtcaaag

SEQ ID NO: 398414 - DNA, 16 bp, M. musculus
ctggctcctgtgggca

SEQ ID NO: 398415 - DNA, 16 bp, M. musculus
ctggctccttgagctc

SEQ ID NO: 398416 - DNA, 16 bp, M. musculus
ctggctctctctgctc

SEQ ID NO: 398417 - DNA, 16 bp, M. musculus
ctggctctctgggctt

SEQ ID NO: 398418 - DNA, 16 bp, M. musculus
ctggctctgcacttgg

SEQ ID NO: 398419 - DNA, 16 bp, M. musculus
ctggctctgcctctgg

SEQ ID NO: 398420 - DNA, 16 bp, M. musculus
ctggctctgccttctg

SEQ ID NO: 398421 - DNA, 16 bp, M. musculus
ctggctctggcattcc

SEQ ID NO: 398422 - DNA, 16 bp, M. musculus
ctggctctggctctgg

SEQ ID NO: 398423 - DNA, 16 bp, M. musculus
ctggctcttgcttctg

SEQ ID NO: 398424 - DNA, 16 bp, M. musculus
ctggctgaagtgtagc

SEQ ID NO: 398425 - DNA, 16 bp, M. musculus
ctggctgaccagcaag

SEQ ID NO: 398426 - DNA, 16 bp, M. musculus
ctggctgactggctgg

SEQ ID NO: 398427 - DNA, 16 bp, M. musculus
ctggctgagatgggag

SEQ ID NO: 398428 - DNA, 17 bp, M. musculus
ctggctgagccagacct

SEQ ID NO: 398429 - DNA, 16 bp, M. musculus
ctggctgagccatctc

SEQ ID NO: 398430 - DNA, 16 bp, M. musculus
ctggctgaggatgaag

SEQ ID NO: 398431 - DNA, 16 bp, M. musculus
ctggctgaggcaggag

SEQ ID NO: 398432 - DNA, 16 bp, M. musculus
ctggctgaggtggaag

SEQ ID NO: 398433 - DNA, 16 bp, M. musculus
ctggctgatcctggaa

SEQ ID NO: 398434 - DNA, 16 bp, M. musculus
ctggctgcagagttca

SEQ ID NO: 398435 - DNA, 16 bp, M. musculus
ctggctgcagagttcg

SEQ ID NO: 398436 - DNA, 16 bp, M. musculus
ctggctgccaccctgg

SEQ ID NO: 398437 - DNA, 16 bp, M. musculus
ctggctgcccaggaac

SEQ ID NO: 398438 - DNA, 16 bp, M. musculus
ctggctgccctggaag

SEQ ID NO: 398439 - DNA, 16 bp, M. musculus
ctggctgcccttctag

SEQ ID NO: 398440 - DNA, 16 bp, M. musculus
ctggctgcccttgcag

SEQ ID NO: 398441 - DNA, 16 bp, M. musculus
ctggctgctcctccaa

SEQ ID NO: 398442 - DNA, 16 bp, M. musculus
ctggctgctctggcag

SEQ ID NO: 398443 - DNA, 16 bp, M. musculus
ctggctgctcttacag

SEQ ID NO: 398444 - DNA, 16 bp, M. musculus
ctggctgctcttcagg

SEQ ID NO: 398445 - DNA, 16 bp, M. musculus
ctggctgctcttctga

SEQ ID NO: 398446 - DNA, 16 bp, M. musculus
ctggctgctcttgcag

SEQ ID NO: 398447 - DNA, 16 bp, M. musculus
ctggctgctcttgctg

SEQ ID NO: 398448 - DNA, 16 bp, M. musculus
ctggctgctgccaggt

SEQ ID NO: 398449 - DNA, 16 bp, M. musculus
ctggctgctgctgctg

SEQ ID NO: 398450 - DNA, 16 bp, M. musculus
ctggctgctgctggct

SEQ ID NO: 398451 - DNA, 16 bp, M. musculus
ctggctgcttctgctg

SEQ ID NO: 398452 - DNA, 16 bp, M. musculus
ctggctgcttttggat

SEQ ID NO: 398453 - DNA, 16 bp, M. musculus
ctggctgctttttcag

SEQ ID NO: 398454 - DNA, 16 bp, M. musculus
ctggctggacacaaca

SEQ ID NO: 398455 - DNA, 16 bp, M. musculus
ctggctggagcttgtc

SEQ ID NO: 398456 - DNA, 16 bp, M. musculus
ctggctggagtttgtt

SEQ ID NO: 398457 - DNA, 16 bp, M. musculus
ctggctggatgctgcc

SEQ ID NO: 398458 - DNA, 16 bp, M. musculus
ctggctggccagccag

SEQ ID NO: 398459 - DNA, 16 bp, M. musculus
ctggctggccagcgag

SEQ ID NO: 398460 - DNA, 16 bp, M. musculus
ctggctggccagtcag

SEQ ID NO: 398461 - DNA, 16 bp, M. musculus
ctggctggccagtgag

SEQ ID NO: 398462 - DNA, 16 bp, M. musculus
ctggctggccctgaac

SEQ ID NO: 398463 - DNA, 16 bp, M. musculus
ctggctggcctggaaa

SEQ ID NO: 398464 - DNA, 16 bp, M. musculus
ctggctggccttgctc

SEQ ID NO: 398465 - DNA, 16 bp, M. musculus
ctggctggctggctgg

SEQ ID NO: 398466 - DNA, 16 bp, M. musculus
ctggctggctggctgt

SEQ ID NO: 398467 - DNA, 16 bp, M. musculus
ctggctggctgtcctg

SEQ ID NO: 398468 - DNA, 16 bp, M. musculus
ctggctgggaaagtgg

SEQ ID NO: 398469 - DNA, 16 bp, M. musculus
ctggctgggctggctg

SEQ ID NO: 398470 - DNA, 16 bp, M. musculus
ctggctggggtcatgc

SEQ ID NO: 398471 - DNA, 16 bp, M. musculus
ctggctggtttgtgtg

SEQ ID NO: 398472 - DNA, 16 bp, M. musculus
ctggctgtccaagaac

SEQ ID NO: 398473 - DNA, 16 bp, M. musculus
ctggctgtcctagaaa

SEQ ID NO: 398474 - DNA, 16 bp, M. musculus
ctggctgtcctgaact

SEQ ID NO: 398475 - DNA, 16 bp, M. musculus
ctggctgtcctggaaa

SEQ ID NO: 398476 - DNA, 16 bp, M. musculus
ctggctgtcctggaag

SEQ ID NO: 398477 - DNA, 16 bp, M. musculus
ctggctgtcctgtcct

SEQ ID NO: 398478 - DNA, 16 bp, M. musculus
ctggctgtctctgcta

SEQ ID NO: 398479 - DNA, 16 bp, M. musculus
ctggctgtctctgctc

SEQ ID NO: 398480 - DNA, 16 bp, M. musculus
ctggctgtctggaact

SEQ ID NO: 398481 - DNA, 16 bp, M. musculus
ctggctgtcttggaat

SEQ ID NO: 398482 - DNA, 16 bp, M. musculus
ctggctgtgctctccc

SEQ ID NO: 398483 - DNA, 16 bp, M. musculus
ctggctgtggctctct

SEQ ID NO: 398484 - DNA, 16 bp, M. musculus
ctggctgtggtggtgc

SEQ ID NO: 398485 - DNA, 16 bp, M. musculus
ctggctgttctgaact

SEQ ID NO: 398486 - DNA, 16 bp, M. musculus
ctggctgttctggagc

SEQ ID NO: 398487 - DNA, 16 bp, M. musculus
ctggcttactataaaa

SEQ ID NO: 398488 - DNA, 16 bp, M. musculus
ctggcttcaaactcat

SEQ ID NO: 398489 - DNA, 16 bp, M. musculus
ctggcttcatggagaa

SEQ ID NO: 398490 - DNA, 16 bp, M. musculus
ctggcttccactgtgc

SEQ ID NO: 398491 - DNA, 16 bp, M. musculus
ctggcttccagcctag

SEQ ID NO: 398492 - DNA, 16 bp, M. musculus
ctggcttccaggttca

SEQ ID NO: 398493 - DNA, 16 bp, M. musculus
ctggcttccagtcagc

SEQ ID NO: 398494 - DNA, 16 bp, M. musculus
ctggcttccctcagtg

SEQ ID NO: 398495 - DNA, 16 bp, M. musculus
ctggcttcctgtttct

SEQ ID NO: 398496 - DNA, 16 bp, M. musculus
ctggcttctaagacta

SEQ ID NO: 398497 - DNA, 16 bp, M. musculus
ctggcttctacatgca

SEQ ID NO: 398498 - DNA, 16 bp, M. musculus
ctggcttctataagaa

SEQ ID NO: 398499 - DNA, 16 bp, M. musculus
ctggcttctctctcag

SEQ ID NO: 398500 - DNA, 16 bp, M. musculus
ctggcttctctcttgg

SEQ ID NO: 398501 - DNA, 16 bp, M. musculus
ctggcttctctggaag

SEQ ID NO: 398502 - DNA, 16 bp, M. musculus
ctggcttctctgggca

SEQ ID NO: 398503 - DNA, 16 bp, M. musculus
ctggcttctgcagaca

SEQ ID NO: 398504 - DNA, 16 bp, M. musculus
ctggcttctgcaggca

SEQ ID NO: 398505 - DNA, 16 bp, M. musculus
ctggcttctgccacac

SEQ ID NO: 398506 - DNA, 16 bp, M. musculus
ctggcttctgctggca

SEQ ID NO: 398507 - DNA, 16 bp, M. musculus
ctggcttctggcttct

SEQ ID NO: 398508 - DNA, 16 bp, M. musculus
ctggcttctgtgggta

SEQ ID NO: 398509 - DNA, 16 bp, M. musculus
ctggcttctttcactt

SEQ ID NO: 398510 - DNA, 16 bp, M. musculus
ctggcttctttccagc

SEQ ID NO: 398511 - DNA, 16 bp, M. musculus
ctggcttctttgtcaa

SEQ ID NO: 398512 - DNA, 16 bp, M. musculus
ctggcttgatcttgtg

SEQ ID NO: 398513 - DNA, 17 bp, M. musculus
ctggcttgcctcccctg

SEQ ID NO: 398514 - DNA, 16 bp, M. musculus
ctggcttgctcatcat

SEQ ID NO: 398515 - DNA, 16 bp, M. musculus
ctggcttgctctctct

SEQ ID NO: 398516 - DNA, 16 bp, M. musculus
ctggcttgcttcccat

SEQ ID NO: 398517 - DNA, 16 bp, M. musculus
ctggcttgcttcttct

SEQ ID NO: 398518 - DNA, 16 bp, M. musculus
ctggcttgtcctggaa

SEQ ID NO: 398519 - DNA, 16 bp, M. musculus
ctggcttgtgctgtaa

SEQ ID NO: 398520 - DNA, 16 bp, M. musculus
ctggctttatttattt

SEQ ID NO: 398521 - DNA, 16 bp, M. musculus
ctggctttcctcagtg

SEQ ID NO: 398522 - DNA, 16 bp, M. musculus
ctggctttcctggcct

SEQ ID NO: 398523 - DNA, 16 bp, M. musculus
ctggctttctcctcat

SEQ ID NO: 398524 - DNA, 16 bp, M. musculus
ctggctttgaactcaa

SEQ ID NO: 398525 - DNA, 16 bp, M. musculus
ctggctttgaactcat

SEQ ID NO: 398526 - DNA, 16 bp, M. musculus
ctggctttgaactctc

SEQ ID NO: 398527 - DNA, 16 bp, M. musculus
ctggcttttaaaatat

SEQ ID NO: 398528 - DNA, 16 bp, M. musculus
ctggctttttaaaaat

SEQ ID NO: 398529 - DNA, 16 bp, M. musculus
ctgggaaaagaaacat

SEQ ID NO: 398530 - DNA, 16 bp, M. musculus
ctgggaaaagaggaag

SEQ ID NO: 398531 - DNA, 16 bp, M. musculus
ctgggaaacagaaact

SEQ ID NO: 398532 - DNA, 16 bp, M. musculus
ctgggaaagaaattag

SEQ ID NO: 398533 - DNA, 16 bp, M. musculus
ctgggaaagagagaga

SEQ ID NO: 398534 - DNA, 16 bp, M. musculus
ctgggaaaggaaaaat

SEQ ID NO: 398535 - DNA, 16 bp, M. musculus
ctgggaaagggaaaat

SEQ ID NO: 398536 - DNA, 16 bp, M. musculus
ctgggaaatgtagtcc

SEQ ID NO: 398537 - DNA, 16 bp, M. musculus
ctgggaaatgtagtct

SEQ ID NO: 398538 - DNA, 16 bp, M. musculus
ctgggaaatgtagttt

SEQ ID NO: 398539 - DNA, 16 bp, M. musculus
ctgggaaatgttttct

SEQ ID NO: 398540 - DNA, 16 bp, M. musculus
ctgggaacattttttt

SEQ ID NO: 398541 - DNA, 16 bp, M. musculus
ctgggaaccaaattca

SEQ ID NO: 398542 - DNA, 16 bp, M. musculus
ctgggaacccctgtgg

SEQ ID NO: 398543 - DNA, 16 bp, M. musculus
ctgggaaccctgtgct

SEQ ID NO: 398544 - DNA, 16 bp, M. musculus
ctgggaacctggagca

SEQ ID NO: 398545 - DNA, 16 bp, M. musculus
ctgggaactctgaggg

SEQ ID NO: 398546 - DNA, 16 bp, M. musculus
ctgggaactgaaccct

SEQ ID NO: 398547 - DNA, 16 bp, M. musculus
ctgggaactgaacctg

SEQ ID NO: 398548 - DNA, 16 bp, M. musculus
ctgggaactgaactca

SEQ ID NO: 398549 - DNA, 16 bp, M. musculus
ctgggaactgaacttg

SEQ ID NO: 398550 - DNA, 16 bp, M. musculus
ctgggaactgaatcca

SEQ ID NO: 398551 - DNA, 16 bp, M. musculus
ctgggaactgaattca

SEQ ID NO: 398552 - DNA, 16 bp, M. musculus
ctgggaagaagaaacc

SEQ ID NO: 398553 - DNA, 16 bp, M. musculus
ctgggaagacagaggc

SEQ ID NO: 398554 - DNA, 16 bp, M. musculus
ctgggaagagaagctt

SEQ ID NO: 398555 - DNA, 16 bp, M. musculus
ctgggaagagacacca

SEQ ID NO: 398556 - DNA, 16 bp, M. musculus
ctgggaagaggaacct

SEQ ID NO: 398557 - DNA, 16 bp, M. musculus
ctgggaagagggaccc

SEQ ID NO: 398558 - DNA, 16 bp, M. musculus
ctgggaagagttgggg

SEQ ID NO: 398559 - DNA, 16 bp, M. musculus
ctgggaagatggagac

SEQ ID NO: 398560 - DNA, 16 bp, M. musculus
ctgggaagatggccca

SEQ ID NO: 398561 - DNA, 16 bp, M. musculus
ctgggaagatggctca

SEQ ID NO: 398562 - DNA, 16 bp, M. musculus
ctgggaaggagagagg

SEQ ID NO: 398563 - DNA, 16 bp, M. musculus
ctgggaaggaggagga

SEQ ID NO: 398564 - DNA, 16 bp, M. musculus
ctgggaaggattctga

SEQ ID NO: 398565 - DNA, 16 bp, M. musculus
ctgggaaggtggctgg

SEQ ID NO: 398566 - DNA, 16 bp, M. musculus
ctgggaagtggaggca

SEQ ID NO: 398567 - DNA, 16 bp, M. musculus
ctgggaagtggtggtg

SEQ ID NO: 398568 - DNA, 16 bp, M. musculus
ctgggaagtgtagtct

SEQ ID NO: 398569 - DNA, 16 bp, M. musculus
ctgggaagtgtttgct

SEQ ID NO: 398570 - DNA, 16 bp, M. musculus
ctgggaataagctgaa

SEQ ID NO: 398571 - DNA, 16 bp, M. musculus
ctgggaatatactcaa

SEQ ID NO: 398572 - DNA, 16 bp, M. musculus
ctgggaatatatccag

SEQ ID NO: 398573 - DNA, 16 bp, M. musculus
ctgggaatcaaacctg

SEQ ID NO: 398574 - DNA, 16 bp, M. musculus
ctgggaatcaaagcca

SEQ ID NO: 398575 - DNA, 16 bp, M. musculus
ctgggaatcaaatttg

SEQ ID NO: 398576 - DNA, 16 bp, M. musculus
ctgggaatcaagccca

SEQ ID NO: 398577 - DNA, 16 bp, M. musculus
ctgggaatccaactca

SEQ ID NO: 398578 - DNA, 16 bp, M. musculus
ctgggaatggaaccag

SEQ ID NO: 398579 - DNA, 16 bp, M. musculus
ctgggaatggaacctg

SEQ ID NO: 398580 - DNA, 16 bp, M. musculus
ctgggaatggagctca

SEQ ID NO: 398581 - DNA, 16 bp, M. musculus
ctgggaatggcagagg

SEQ ID NO: 398582 - DNA, 16 bp, M. musculus
ctgggaatgtagctca

SEQ ID NO: 398583 - DNA, 16 bp, M. musculus
ctgggaatgtagctta

SEQ ID NO: 398584 - DNA, 16 bp, M. musculus
ctgggaatgtagttca

SEQ ID NO: 398585 - DNA, 16 bp, M. musculus
ctgggaattctgggaa

SEQ ID NO: 398586 - DNA, 16 bp, M. musculus
ctgggaattgaaccta

SEQ ID NO: 398587 - DNA, 16 bp, M. musculus
ctgggaattgaacctc

SEQ ID NO: 398588 - DNA, 16 bp, M. musculus
ctgggaattgaagctg

SEQ ID NO: 398589 - DNA, 16 bp, M. musculus
ctgggaattgagccca

SEQ ID NO: 398590 - DNA, 16 bp, M. musculus
ctgggacaaagcaggt

SEQ ID NO: 398591 - DNA, 16 bp, M. musculus
ctgggacaagccagag

SEQ ID NO: 398592 - DNA, 16 bp, M. musculus
ctgggacaggcactgt

SEQ ID NO: 398593 - DNA, 19 bp, M. musculus
ctgggacaggcgagagcca

SEQ ID NO: 398594 - DNA, 16 bp, M. musculus
ctgggacatccagtcc

SEQ ID NO: 398595 - DNA, 16 bp, M. musculus
ctgggacattggaaca

SEQ ID NO: 398596 - DNA, 16 bp, M. musculus
ctgggaccaagtgttc

SEQ ID NO: 398597 - DNA, 16 bp, M. musculus
ctgggacccacacagt

SEQ ID NO: 398598 - DNA, 16 bp, M. musculus
ctgggacccacatggt

SEQ ID NO: 398599 - DNA, 16 bp, M. musculus
ctgggaccccagccca

SEQ ID NO: 398600 - DNA, 16 bp, M. musculus
ctgggacccctttccc

SEQ ID NO: 398601 - DNA, 16 bp, M. musculus
ctgggactaaagacat

SEQ ID NO: 398602 - DNA, 16 bp, M. musculus
ctgggactacagatgt

SEQ ID NO: 398603 - DNA, 16 bp, M. musculus
ctgggactacaggtgt

SEQ ID NO: 398604 - DNA, 16 bp, M. musculus
ctgggactcaaaccca

SEQ ID NO: 398605 - DNA, 16 bp, M. musculus
ctgggactcaagagag

SEQ ID NO: 398606 - DNA, 16 bp, M. musculus
ctgggactgcaggtgt

SEQ ID NO: 398607 - DNA, 16 bp, M. musculus
ctgggactggagttac

SEQ ID NO: 398608 - DNA, 16 bp, M. musculus
ctgggacttcaccatg

SEQ ID NO: 398609 - DNA, 16 bp, M. musculus
ctgggacttgaactca

SEQ ID NO: 398610 - DNA, 16 bp, M. musculus
ctgggacttgaactcg

SEQ ID NO: 398611 - DNA, 16 bp, M. musculus
ctgggagaacagcaag

SEQ ID NO: 398612 - DNA, 16 bp, M. musculus
ctgggagaacagccag

SEQ ID NO: 398613 - DNA, 16 bp, M. musculus
ctgggagaacagctct

SEQ ID NO: 398614 - DNA, 16 bp, M. musculus
ctgggagaacctgaag

SEQ ID NO: 398615 - DNA, 16 bp, M. musculus
ctgggagaagaagagg

SEQ ID NO: 398616 - DNA, 16 bp, M. musculus
ctgggagaagaggccc

SEQ ID NO: 398617 - DNA, 16 bp, M. musculus
ctgggagaaggagaat

SEQ ID NO: 398618 - DNA, 16 bp, M. musculus
ctgggagaccctgtct

SEQ ID NO: 398619 - DNA, 16 bp, M. musculus
ctgggagactgagaca

SEQ ID NO: 398620 - DNA, 16 bp, M. musculus
ctgggagagatgactg

SEQ ID NO: 398621 - DNA, 16 bp, M. musculus
ctgggagagcagcaag

SEQ ID NO: 398622 - DNA, 16 bp, M. musculus
ctgggagagctgggag

SEQ ID NO: 398623 - DNA, 16 bp, M. musculus
ctgggagagtaggcag

SEQ ID NO: 398624 - DNA, 16 bp, M. musculus
ctgggagcagcaaaaa

SEQ ID NO: 398625 - DNA, 16 bp, M. musculus
ctgggagcatggctca

SEQ ID NO: 398626 - DNA, 16 bp, M. musculus
ctgggagcatggggct

SEQ ID NO: 398627 - DNA, 16 bp, M. musculus
ctgggagctcagagag

SEQ ID NO: 398628 - DNA, 16 bp, M. musculus
ctgggagctcctgggg

SEQ ID NO: 398629 - DNA, 16 bp, M. musculus
ctgggagctctggagg

SEQ ID NO: 398630 - DNA, 16 bp, M. musculus
ctgggagctctggggt

SEQ ID NO: 398631 - DNA, 16 bp, M. musculus
ctgggagctgaggcag

SEQ ID NO: 398632 - DNA, 16 bp, M. musculus
ctgggagctgggatta

SEQ ID NO: 398633 - DNA, 16 bp, M. musculus
ctgggagctggtgaga

SEQ ID NO: 398634 - DNA, 16 bp, M. musculus
ctgggaggaaaggaag

SEQ ID NO: 398635 - DNA, 16 bp, M. musculus
ctgggaggaagagagg

SEQ ID NO: 398636 - DNA, 16 bp, M. musculus
ctgggaggaagcctac

SEQ ID NO: 398637 - DNA, 16 bp, M. musculus
ctgggaggaaggaagg

SEQ ID NO: 398638 - DNA, 16 bp, M. musculus
ctgggaggagaaggag

SEQ ID NO: 398639 - DNA, 16 bp, M. musculus
ctgggaggagaggaaa

SEQ ID NO: 398640 - DNA, 16 bp, M. musculus
ctgggaggagaggaag

SEQ ID NO: 398641 - DNA, 16 bp, M. musculus
ctgggaggaggggcag

SEQ ID NO: 398642 - DNA, 16 bp, M. musculus
ctgggaggcagaaaga

SEQ ID NO: 398643 - DNA, 16 bp, M. musculus
ctgggaggcagacaca

SEQ ID NO: 398644 - DNA, 16 bp, M. musculus
ctgggaggcaggcagg

SEQ ID NO: 398645 - DNA, 16 bp, M. musculus
ctgggaggcaggctgg

SEQ ID NO: 398646 - DNA, 16 bp, M. musculus
ctgggaggccttcctg

SEQ ID NO: 398647 - DNA, 16 bp, M. musculus
ctgggagggaggaagg

SEQ ID NO: 398648 - DNA, 16 bp, M. musculus
ctgggagggaggggaa

SEQ ID NO: 398649 - DNA, 16 bp, M. musculus
ctgggaggggaggccc

SEQ ID NO: 398650 - DNA, 16 bp, M. musculus
ctgggagggtagctct

SEQ ID NO: 398651 - DNA, 16 bp, M. musculus
ctgggaggtggtggag

SEQ ID NO: 398652 - DNA, 16 bp, M. musculus
ctgggaggtggtggtg

SEQ ID NO: 398653 - DNA, 16 bp, M. musculus
ctgggagtgagctttg

SEQ ID NO: 398654 - DNA, 16 bp, M. musculus
ctgggagtgctgagag

SEQ ID NO: 398655 - DNA, 16 bp, M. musculus
ctgggagtggagctgc

SEQ ID NO: 398656 - DNA, 16 bp, M. musculus
ctgggagtggtggctc

SEQ ID NO: 398657 - DNA, 16 bp, M. musculus
ctgggagttcaagacc

SEQ ID NO: 398658 - DNA, 16 bp, M. musculus
ctgggagttccaggcc

SEQ ID NO: 398659 - DNA, 16 bp, M. musculus
ctgggagttcccagag

SEQ ID NO: 398660 - DNA, 16 bp, M. musculus
ctgggagttctgcctg

SEQ ID NO: 398661 - DNA, 16 bp, M. musculus
ctgggagttgaactct

SEQ ID NO: 398662 - DNA, 16 bp, M. musculus
ctgggagttgaattca

SEQ ID NO: 398663 - DNA, 16 bp, M. musculus
ctgggagttgtagttc

SEQ ID NO: 398664 - DNA, 16 bp, M. musculus
ctgggagtttgaccat

SEQ ID NO: 398665 - DNA, 16 bp, M. musculus
ctgggagtttgaggct

SEQ ID NO: 398666 - DNA, 16 bp, M. musculus
ctgggataacaggtgt

SEQ ID NO: 398667 - DNA, 16 bp, M. musculus
ctgggatagcaggctg

SEQ ID NO: 398668 - DNA, 16 bp, M. musculus
ctgggatcaaaagtgt

SEQ ID NO: 398669 - DNA, 16 bp, M. musculus
ctgggatcagaggtgt

SEQ ID NO: 398670 - DNA, 16 bp, M. musculus
ctgggatcctgaacac

SEQ ID NO: 398671 - DNA, 16 bp, M. musculus
ctgggatcctgggatc

SEQ ID NO: 398672 - DNA, 16 bp, M. musculus
ctgggatcctgggcat

SEQ ID NO: 398673 - DNA, 16 bp, M. musculus
ctgggatcctggggtc

SEQ ID NO: 398674 - DNA, 16 bp, M. musculus
ctgggatgacaggtgt

SEQ ID NO: 398675 - DNA, 16 bp, M. musculus
ctgggatgagctagaa

SEQ ID NO: 398676 - DNA, 16 bp, M. musculus
ctgggatgccttcaag

SEQ ID NO: 398677 - DNA, 16 bp, M. musculus
ctgggatggctcagga

SEQ ID NO: 398678 - DNA, 16 bp, M. musculus
ctgggatgggagaggc

SEQ ID NO: 398679 - DNA, 16 bp, M. musculus
ctgggattaaaagcat

SEQ ID NO: 398680 - DNA, 16 bp, M. musculus
ctgggattaaaagtgt

SEQ ID NO: 398681 - DNA, 21 bp, M. musculus
ctgggattaaagacgtgcgcc

SEQ ID NO: 398682 - DNA, 17 bp, M. musculus
ctgggattaaagtcgtg

SEQ ID NO: 398683 - DNA, 16 bp, M. musculus
ctgggattaaagttat

SEQ ID NO: 398684 - DNA, 16 bp, M. musculus
ctgggattaaagttct

SEQ ID NO: 398685 - DNA, 16 bp, M. musculus
ctgggattaaagttgt

SEQ ID NO: 398686 - DNA, 16 bp, M. musculus
ctgggattaaatgcgt

SEQ ID NO: 398687 - DNA, 17 bp, M. musculus
ctgggattaagggcgtg

SEQ ID NO: 398688 - DNA, 16 bp, M. musculus
ctgggattacaagcat

SEQ ID NO: 398689 - DNA, 16 bp, M. musculus
ctgggattacagaaat

SEQ ID NO: 398690 - DNA, 16 bp, M. musculus
ctgggattacagattt

SEQ ID NO: 398691 - DNA, 16 bp, M. musculus
ctgggattacaggcct

SEQ ID NO: 398692 - DNA, 16 bp, M. musculus
ctgggattataggcac

SEQ ID NO: 398693 - DNA, 16 bp, M. musculus
ctgggattccaggcct

SEQ ID NO: 398694 - DNA, 16 bp, M. musculus
ctgggattccaggtgt

SEQ ID NO: 398695 - DNA, 16 bp, M. musculus
ctgggattctgggatt

SEQ ID NO: 398696 - DNA, 16 bp, M. musculus
ctgggattcttttttt

SEQ ID NO: 398697 - DNA, 16 bp, M. musculus
ctgggattgaagatgt

SEQ ID NO: 398698 - DNA, 16 bp, M. musculus
ctgggattgaaggcgt

SEQ ID NO: 398699 - DNA, 16 bp, M. musculus
ctgggattgcagacac

SEQ ID NO: 398700 - DNA, 16 bp, M. musculus
ctgggattgcagacat

SEQ ID NO: 398701 - DNA, 16 bp, M. musculus
ctgggattgcagatgt

SEQ ID NO: 398702 - DNA, 16 bp, M. musculus
ctgggattggaggcat

SEQ ID NO: 398703 - DNA, 16 bp, M. musculus
ctgggattgtaggcat

SEQ ID NO: 398704 - DNA, 16 bp, M. musculus
ctgggattgtaggtgt

SEQ ID NO: 398705 - DNA, 17 bp, M. musculus
ctgggatttgaactcac

SEQ ID NO: 398706 - DNA, 17 bp, M. musculus
ctgggatttgaactcga

SEQ ID NO: 398707 - DNA, 16 bp, M. musculus
ctgggcaacacagtga

SEQ ID NO: 398708 - DNA, 16 bp, M. musculus
ctgggcaacataatga

SEQ ID NO: 398709 - DNA, 16 bp, M. musculus
ctgggcaacatagtga

SEQ ID NO: 398710 - DNA, 16 bp, M. musculus
ctgggcaacatgagac

SEQ ID NO: 398711 - DNA, 16 bp, M. musculus
ctgggcacagtgacac

SEQ ID NO: 398712 - DNA, 16 bp, M. musculus
ctgggcaccttccctg

SEQ ID NO: 398713 - DNA, 16 bp, M. musculus
ctgggcactgaaccca

SEQ ID NO: 398714 - DNA, 16 bp, M. musculus
ctgggcagatggctca

SEQ ID NO: 398715 - DNA, 16 bp, M. musculus
ctgggcagccagggct

SEQ ID NO: 398716 - DNA, 16 bp, M. musculus
ctgggcagccccagag

SEQ ID NO: 398717 - DNA, 16 bp, M. musculus
ctgggcagccctatct

SEQ ID NO: 398718 - DNA, 16 bp, M. musculus
ctgggcagggcagaca

SEQ ID NO: 398719 - DNA, 16 bp, M. musculus
ctgggcagggcagggc

SEQ ID NO: 398720 - DNA, 16 bp, M. musculus
ctgggcaggtggacac

SEQ ID NO: 398721 - DNA, 16 bp, M. musculus
ctgggcaggttctgag

SEQ ID NO: 398722 - DNA, 16 bp, M. musculus
ctgggcagtggcagca

SEQ ID NO: 398723 - DNA, 16 bp, M. musculus
ctgggcagtggtggta

SEQ ID NO: 398724 - DNA, 16 bp, M. musculus
ctgggcagtggtggtg

SEQ ID NO: 398725 - DNA, 16 bp, M. musculus
ctgggcatacatccag

SEQ ID NO: 398726 - DNA, 16 bp, M. musculus
ctgggcatgctcagtg

SEQ ID NO: 398727 - DNA, 16 bp, M. musculus
ctgggcatggtagcat

SEQ ID NO: 398728 - DNA, 16 bp, M. musculus
ctgggcattggtggtg

SEQ ID NO: 398729 - DNA, 16 bp, M. musculus
ctgggcattgtgggag

SEQ ID NO: 398730 - DNA, 16 bp, M. musculus
ctgggccaagcaaata

SEQ ID NO: 398731 - DNA, 16 bp, M. musculus
ctgggccaagcattca

SEQ ID NO: 398732 - DNA, 16 bp, M. musculus
ctgggccacaccttct

SEQ ID NO: 398733 - DNA, 16 bp, M. musculus
ctgggccagcctgggc

SEQ ID NO: 398734 - DNA, 16 bp, M. musculus
ctgggccaggaagctg

SEQ ID NO: 398735 - DNA, 16 bp, M. musculus
ctgggcccaggtcctc

SEQ ID NO: 398736 - DNA, 16 bp, M. musculus
ctgggccctcccacat

SEQ ID NO: 398737 - DNA, 16 bp, M. musculus
ctgggccctccccatc

SEQ ID NO: 398738 - DNA, 16 bp, M. musculus
ctgggccctgggccct

SEQ ID NO: 398739 - DNA, 16 bp, M. musculus
ctgggccctgtgtctg

SEQ ID NO: 398740 - DNA, 16 bp, M. musculus
ctgggcctcagggcaa

SEQ ID NO: 398741 - DNA, 16 bp, M. musculus
ctgggcctcagtttcc

SEQ ID NO: 398742 - DNA, 16 bp, M. musculus
ctgggcctgacctggg

SEQ ID NO: 398743 - DNA, 16 bp, M. musculus
ctgggcctggaacagt

SEQ ID NO: 398744 - DNA, 16 bp, M. musculus
ctgggcctggcttgag

SEQ ID NO: 398745 - DNA, 16 bp, M. musculus
ctgggcctgggaggta

SEQ ID NO: 398746 - DNA, 16 bp, M. musculus
ctgggcctgggcctgg

SEQ ID NO: 398747 - DNA, 16 bp, M. musculus
ctgggccttcccacac

SEQ ID NO: 398748 - DNA, 16 bp, M. musculus
ctgggccttcctacat

SEQ ID NO: 398749 - DNA, 16 bp, M. musculus
ctgggctaatatttac

SEQ ID NO: 398750 - DNA, 16 bp, M. musculus
ctgggctacacagtga

SEQ ID NO: 398751 - DNA, 16 bp, M. musculus
ctgggctacagagcaa

SEQ ID NO: 398752 - DNA, 16 bp, M. musculus
ctgggctacatagaga

SEQ ID NO: 398753 - DNA, 16 bp, M. musculus
ctgggctacatagcaa

SEQ ID NO: 398754 - DNA, 16 bp, M. musculus
ctgggctatataagaa

SEQ ID NO: 398755 - DNA, 16 bp, M. musculus
ctgggctatgcagtga

SEQ ID NO: 398756 - DNA, 16 bp, M. musculus
ctgggctcctgtctgc

SEQ ID NO: 398757 - DNA, 16 bp, M. musculus
ctgggctctgatgatg

SEQ ID NO: 398758 - DNA, 16 bp, M. musculus
ctgggctctgctgggc

SEQ ID NO: 398759 - DNA, 16 bp, M. musculus
ctgggctctgggctct

SEQ ID NO: 398760 - DNA, 16 bp, M. musculus
ctgggctctgtgggca

SEQ ID NO: 398761 - DNA, 16 bp, M. musculus
ctgggctgaaatttgt

SEQ ID NO: 398762 - DNA, 16 bp, M. musculus
ctgggctgcagagtga

SEQ ID NO: 398763 - DNA, 16 bp, M. musculus
ctgggctgcccttcct

SEQ ID NO: 398764 - DNA, 16 bp, M. musculus
ctgggctgccttgtct

SEQ ID NO: 398765 - DNA, 16 bp, M. musculus
ctgggctggaaagttc

SEQ ID NO: 398766 - DNA, 16 bp, M. musculus
ctgggctggaagtctt

SEQ ID NO: 398767 - DNA, 16 bp, M. musculus
ctgggctggagggatg

SEQ ID NO: 398768 - DNA, 16 bp, M. musculus
ctgggctggaggtcct

SEQ ID NO: 398769 - DNA, 16 bp, M. musculus
ctgggctggagtggag

SEQ ID NO: 398770 - DNA, 18 bp, M. musculus
ctgggctggtagtcttgg

SEQ ID NO: 398771 - DNA, 16 bp, M. musculus
ctgggctggtgaaatg

SEQ ID NO: 398772 - DNA, 16 bp, M. musculus
ctgggctggtgattct

SEQ ID NO: 398773 - DNA, 16 bp, M. musculus
ctgggctggtggtctt

SEQ ID NO: 398774 - DNA, 16 bp, M. musculus
ctgggctggtgttcct

SEQ ID NO: 398775 - DNA, 16 bp, M. musculus
ctgggctgtcttgtct

SEQ ID NO: 398776 - DNA, 16 bp, M. musculus
ctgggcttacaggtgt

SEQ ID NO: 398777 - DNA, 16 bp, M. musculus
ctgggcttccttgtct

SEQ ID NO: 398778 - DNA, 16 bp, M. musculus
ctgggcttctcttctg

SEQ ID NO: 398779 - DNA, 16 bp, M. musculus
ctgggcttggtgtctg

SEQ ID NO: 398780 - DNA, 16 bp, M. musculus
ctgggctttggggctg

SEQ ID NO: 398781 - DNA, 16 bp, M. musculus
ctgggcttttttttta

SEQ ID NO: 398782 - DNA, 16 bp, M. musculus
ctggggaaatggctca

SEQ ID NO: 398783 - DNA, 16 bp, M. musculus
ctggggaaatggttca

SEQ ID NO: 398784 - DNA, 16 bp, M. musculus
ctggggaagaatggaa

SEQ ID NO: 398785 - DNA, 16 bp, M. musculus
ctggggaagactgcag

SEQ ID NO: 398786 - DNA, 16 bp, M. musculus
ctggggaagaggagga

SEQ ID NO: 398787 - DNA, 16 bp, M. musculus
ctggggaaggaaggag

SEQ ID NO: 398788 - DNA, 16 bp, M. musculus
ctggggaaggaattgg

SEQ ID NO: 398789 - DNA, 16 bp, M. musculus
ctggggaaggaggagg

SEQ ID NO: 398790 - DNA, 16 bp, M. musculus
ctggggacagcataca

SEQ ID NO: 398791 - DNA, 16 bp, M. musculus
ctggggacattgggga

SEQ ID NO: 398792 - DNA, 16 bp, M. musculus
ctggggaccatgggac

SEQ ID NO: 398793 - DNA, 16 bp, M. musculus
ctggggaccccatgct

SEQ ID NO: 398794 - DNA, 16 bp, M. musculus
ctggggactaagtatt

SEQ ID NO: 398795 - DNA, 16 bp, M. musculus
ctggggactcttcaga

SEQ ID NO: 398796 - DNA, 16 bp, M. musculus
ctggggactgaacaca

SEQ ID NO: 398797 - DNA, 16 bp, M. musculus
ctggggactgaaccag

SEQ ID NO: 398798 - DNA, 16 bp, M. musculus
ctggggactgagccca

SEQ ID NO: 398799 - DNA, 16 bp, M. musculus
ctggggagaagagaga

SEQ ID NO: 398800 - DNA, 16 bp, M. musculus
ctggggagacagaagc

SEQ ID NO: 398801 - DNA, 16 bp, M. musculus
ctggggagatgactca

SEQ ID NO: 398802 - DNA, 16 bp, M. musculus
ctggggagatggagac

SEQ ID NO: 398803 - DNA, 16 bp, M. musculus
ctggggagcagaggca

SEQ ID NO: 398804 - DNA, 16 bp, M. musculus
ctggggaggaaaaaaa

SEQ ID NO: 398805 - DNA, 16 bp, M. musculus
ctggggaggaggtgtg

SEQ ID NO: 398806 - DNA, 16 bp, M. musculus
ctggggaggcagaagc

SEQ ID NO: 398807 - DNA, 16 bp, M. musculus
ctggggaggcagagcc

SEQ ID NO: 398808 - DNA, 16 bp, M. musculus
ctggggaggcagccag

SEQ ID NO: 398809 - DNA, 16 bp, M. musculus
ctggggaggcaggggc

SEQ ID NO: 398810 - DNA, 16 bp, M. musculus
ctggggaggctgaagc

SEQ ID NO: 398811 - DNA, 16 bp, M. musculus
ctggggaggggagccc

SEQ ID NO: 398812 - DNA, 16 bp, M. musculus
ctggggaggggaggtt

SEQ ID NO: 398813 - DNA, 16 bp, M. musculus
ctggggaggtggctca

SEQ ID NO: 398814 - DNA, 16 bp, M. musculus
ctggggatagccactg

SEQ ID NO: 398815 - DNA, 16 bp, M. musculus
ctggggatatatccag

SEQ ID NO: 398816 - DNA, 16 bp, M. musculus
ctggggatattggtta

SEQ ID NO: 398817 - DNA, 16 bp, M. musculus
ctggggatccatccct

SEQ ID NO: 398818 - DNA, 16 bp, M. musculus
ctggggatctatccca

SEQ ID NO: 398819 - DNA, 16 bp, M. musculus
ctggggatctgagctc

SEQ ID NO: 398820 - DNA, 16 bp, M. musculus
ctggggatgatcctgt

SEQ ID NO: 398821 - DNA, 16 bp, M. musculus
ctggggatggaaccta

SEQ ID NO: 398822 - DNA, 16 bp, M. musculus
ctggggatggagctca

SEQ ID NO: 398823 - DNA, 16 bp, M. musculus
ctggggatgtgactca

SEQ ID NO: 398824 - DNA, 16 bp, M. musculus
ctggggattgaaccca

SEQ ID NO: 398825 - DNA, 16 bp, M. musculus
ctggggattgaacctg

SEQ ID NO: 398826 - DNA, 16 bp, M. musculus
ctggggattgaactca

SEQ ID NO: 398827 - DNA, 16 bp, M. musculus
ctggggcaagagaaag

SEQ ID NO: 398828 - DNA, 52 bp, M. musculus
ctggggcacccctgattattatatgcctcaattaacagcagttaacacaggt

SEQ ID NO: 398829 - DNA, 16 bp, M. musculus
ctggggcaggaacagg

SEQ ID NO: 398830 - DNA, 16 bp, M. musculus
ctggggcaggaggatg

SEQ ID NO: 398831 - DNA, 16 bp, M. musculus
ctggggcaggggctgg

SEQ ID NO: 398832 - DNA, 16 bp, M. musculus
ctggggcatcaaacct

SEQ ID NO: 398833 - DNA, 16 bp, M. musculus
ctggggcatcaagcct

SEQ ID NO: 398834 - DNA, 16 bp, M. musculus
ctggggccagaagagg

SEQ ID NO: 398835 - DNA, 16 bp, M. musculus
ctggggccagcaggag

SEQ ID NO: 398836 - DNA, 16 bp, M. musculus
ctggggccagtgagat

SEQ ID NO: 398837 - DNA, 16 bp, M. musculus
ctggggcccttcacaa

SEQ ID NO: 398838 - DNA, 33 bp, M. musculus
ctggggcctaagattgtatcaagataactatga

SEQ ID NO: 398839 - DNA, 19 bp, M. musculus
ctggggcctagcaaacaca

SEQ ID NO: 398840 - DNA, 16 bp, M. musculus
ctggggcctcatgtct

SEQ ID NO: 398841 - DNA, 16 bp, M. musculus
ctggggcctccagtct

SEQ ID NO: 398842 - DNA, 16 bp, M. musculus
ctggggctgaggctgg

SEQ ID NO: 398843 - DNA, 16 bp, M. musculus
ctggggctgctcttcc

SEQ ID NO: 398844 - DNA, 16 bp, M. musculus
ctggggctggagagat

SEQ ID NO: 398845 - DNA, 16 bp, M. musculus
ctggggctggagctgg

SEQ ID NO: 398846 - DNA, 16 bp, M. musculus
ctggggctggaggagg

SEQ ID NO: 398847 - DNA, 16 bp, M. musculus
ctggggctgggactgg

SEQ ID NO: 398848 - DNA, 16 bp, M. musculus
ctggggctgggctttg

SEQ ID NO: 398849 - DNA, 16 bp, M. musculus
ctggggctggggctga

SEQ ID NO: 398850 - DNA, 18 bp, M. musculus
ctggggctggtgagatgg

SEQ ID NO: 398851 - DNA, 16 bp, M. musculus
ctgggggaaaaaaaaa

SEQ ID NO: 398852 - DNA, 16 bp, M. musculus
ctgggggagagaggag

SEQ ID NO: 398853 - DNA, 16 bp, M. musculus
ctgggggaggggcaga

SEQ ID NO: 398854 - DNA, 16 bp, M. musculus
ctgggggatgctgggg

SEQ ID NO: 398855 - DNA, 16 bp, M. musculus
ctgggggcaggaactg

SEQ ID NO: 398856 - DNA, 106 bp, M. musculus
ctgggggctttaacctatccccagggtgcatgaggatcatgggtgttgctaccagtcctagtttagacacgtcaccaaaagtatttaagccacacactttctgagc

SEQ ID NO: 398857 - DNA, 16 bp, M. musculus
ctgggggtctttgctg

SEQ ID NO: 398858 - DNA, 16 bp, M. musculus
ctgggggtgagctttg

SEQ ID NO: 398859 - DNA, 16 bp, M. musculus
ctgggggtgctggtta

SEQ ID NO: 398860 - DNA, 16 bp, M. musculus
ctggggtatagctcag

SEQ ID NO: 398861 - DNA, 16 bp, M. musculus
ctggggtcatgctaca

SEQ ID NO: 398862 - DNA, 16 bp, M. musculus
ctggggtgacaggtgt

SEQ ID NO: 398863 - DNA, 16 bp, M. musculus
ctggggtgagatggaa

SEQ ID NO: 398864 - DNA, 16 bp, M. musculus
ctggggtgcagacaga

SEQ ID NO: 398865 - DNA, 16 bp, M. musculus
ctggggtgcagctcag

SEQ ID NO: 398866 - DNA, 16 bp, M. musculus
ctggggtgcccaggac

SEQ ID NO: 398867 - DNA, 16 bp, M. musculus
ctggggtggattcagg

SEQ ID NO: 398868 - DNA, 16 bp, M. musculus
ctggggttaaaacaaa

SEQ ID NO: 398869 - DNA, 16 bp, M. musculus
ctggggttacaggtat

SEQ ID NO: 398870 - DNA, 16 bp, M. musculus
ctggggtttcaggcat

SEQ ID NO: 398871 - DNA, 16 bp, M. musculus
ctgggtaagaccattg

SEQ ID NO: 398872 - DNA, 16 bp, M. musculus
ctgggtaataaggagg

SEQ ID NO: 398873 - DNA, 16 bp, M. musculus
ctgggtacatgcccag

SEQ ID NO: 398874 - DNA, 16 bp, M. musculus
ctgggtagaacttcaa

SEQ ID NO: 398875 - DNA, 16 bp, M. musculus
ctgggtaggatcttgc

SEQ ID NO: 398876 - DNA, 16 bp, M. musculus
ctgggtagtagtggca

SEQ ID NO: 398877 - DNA, 16 bp, M. musculus
ctgggtatggtggcac

SEQ ID NO: 398878 - DNA, 16 bp, M. musculus
ctgggtcagaaatttt

SEQ ID NO: 398879 - DNA, 16 bp, M. musculus
ctgggtcagagaagaa

SEQ ID NO: 398880 - DNA, 17 bp, M. musculus
ctgggtcatatggtcca

SEQ ID NO: 398881 - DNA, 16 bp, M. musculus
ctgggtcccagggttc

SEQ ID NO: 398882 - DNA, 16 bp, M. musculus
ctgggtcccttcagca

SEQ ID NO: 398883 - DNA, 16 bp, M. musculus
ctgggtcctcaagtct

SEQ ID NO: 398884 - DNA, 16 bp, M. musculus
ctgggtcctcagatag

SEQ ID NO: 398885 - DNA, 16 bp, M. musculus
ctgggtcctccacaag

SEQ ID NO: 398886 - DNA, 16 bp, M. musculus
ctgggtcctgggagcc

SEQ ID NO: 398887 - DNA, 16 bp, M. musculus
ctgggtcctggggttc

SEQ ID NO: 398888 - DNA, 16 bp, M. musculus
ctgggtcctgtgaagg

SEQ ID NO: 398889 - DNA, 17 bp, M. musculus
ctgggtcctttcagcga

SEQ ID NO: 398890 - DNA, 16 bp, M. musculus
ctgggtcctttcagta

SEQ ID NO: 398891 - DNA, 16 bp, M. musculus
ctgggtcctttcagtg

SEQ ID NO: 398892 - DNA, 16 bp, M. musculus
ctgggtcctttgtaag

SEQ ID NO: 398893 - DNA, 16 bp, M. musculus
ctgggtcgcctctctg

SEQ ID NO: 398894 - DNA, 16 bp, M. musculus
ctgggtctcactgtgt

SEQ ID NO: 398895 - DNA, 16 bp, M. musculus
ctgggtctgagttact

SEQ ID NO: 398896 - DNA, 16 bp, M. musculus
ctgggtcttcaagtag

SEQ ID NO: 398897 - DNA, 16 bp, M. musculus
ctgggtcttcaattca

SEQ ID NO: 398898 - DNA, 16 bp, M. musculus
ctgggtctttgtgtgg

SEQ ID NO: 398899 - DNA, 16 bp, M. musculus
ctgggtgatggtggtg

SEQ ID NO: 398900 - DNA, 16 bp, M. musculus
ctgggtgcaacaacta

SEQ ID NO: 398901 - DNA, 16 bp, M. musculus
ctgggtgctctggggg

SEQ ID NO: 398902 - DNA, 16 bp, M. musculus
ctgggtgctgggtgct

SEQ ID NO: 398903 - DNA, 16 bp, M. musculus
ctgggtggaagagagg

SEQ ID NO: 398904 - DNA, 16 bp, M. musculus
ctgggtgggatcttgc

SEQ ID NO: 398905 - DNA, 16 bp, M. musculus
ctgggtggtggtggca

SEQ ID NO: 398906 - DNA, 16 bp, M. musculus
ctgggtggttcccacg

SEQ ID NO: 398907 - DNA, 16 bp, M. musculus
ctgggtgtagtgacac

SEQ ID NO: 398908 - DNA, 16 bp, M. musculus
ctgggtgtagtggcac

SEQ ID NO: 398909 - DNA, 16 bp, M. musculus
ctgggtgtcctggaat

SEQ ID NO: 398910 - DNA, 16 bp, M. musculus
ctgggtgtcctggagc

SEQ ID NO: 398911 - DNA, 16 bp, M. musculus
ctgggtgtctgggtgt

SEQ ID NO: 398912 - DNA, 16 bp, M. musculus
ctgggtgtgctggcac

SEQ ID NO: 398913 - DNA, 16 bp, M. musculus
ctgggtgtggtggcac

SEQ ID NO: 398914 - DNA, 16 bp, M. musculus
ctgggtgtggtggccc

SEQ ID NO: 398915 - DNA, 16 bp, M. musculus
ctgggtgtggtgtctg

SEQ ID NO: 398916 - DNA, 16 bp, M. musculus
ctgggttcaaagagtg

SEQ ID NO: 398917 - DNA, 16 bp, M. musculus
ctgggttcaaagccag

SEQ ID NO: 398918 - DNA, 16 bp, M. musculus
ctgggttcaaatccag

SEQ ID NO: 398919 - DNA, 16 bp, M. musculus
ctgggttcaagagaga

SEQ ID NO: 398920 - DNA, 16 bp, M. musculus
ctgggttcatgcctag

SEQ ID NO: 398921 - DNA, 16 bp, M. musculus
ctgggttccatcccca

SEQ ID NO: 398922 - DNA, 16 bp, M. musculus
ctgggttccatcctca

SEQ ID NO: 398923 - DNA, 16 bp, M. musculus
ctgggttccctctgga

SEQ ID NO: 398924 - DNA, 16 bp, M. musculus
ctgggttcgatcccca

SEQ ID NO: 398925 - DNA, 16 bp, M. musculus
ctgggttctaatgatg

SEQ ID NO: 398926 - DNA, 16 bp, M. musculus
ctgggttctctaagaa

SEQ ID NO: 398927 - DNA, 16 bp, M. musculus
ctgggttctctggaag

SEQ ID NO: 398928 - DNA, 16 bp, M. musculus
ctgggttctgatgatg

SEQ ID NO: 398929 - DNA, 16 bp, M. musculus
ctgggttctgcagact

SEQ ID NO: 398930 - DNA, 16 bp, M. musculus
ctgggttctgtgagaa

SEQ ID NO: 398931 - DNA, 16 bp, M. musculus
ctgggttctgtttcca

SEQ ID NO: 398932 - DNA, 16 bp, M. musculus
ctgggttcttgccagc

SEQ ID NO: 398933 - DNA, 16 bp, M. musculus
ctgggttctttccagg

SEQ ID NO: 398934 - DNA, 16 bp, M. musculus
ctgggttgcctcatcc

SEQ ID NO: 398935 - DNA, 16 bp, M. musculus
ctgggttggtagtctt

SEQ ID NO: 398936 - DNA, 16 bp, M. musculus
ctgggttggtgtttat

SEQ ID NO: 398937 - DNA, 16 bp, M. musculus
ctgggttgtttaagaa

SEQ ID NO: 398938 - DNA, 16 bp, M. musculus
ctgggttgtttccaat

SEQ ID NO: 398939 - DNA, 16 bp, M. musculus
ctgggtttaaaagcat

SEQ ID NO: 398940 - DNA, 16 bp, M. musculus
ctgggtttcatcccca

SEQ ID NO: 398941 - DNA, 16 bp, M. musculus
ctgggtttgaacccca

SEQ ID NO: 398942 - DNA, 16 bp, M. musculus
ctgggtttgagcccca

SEQ ID NO: 398943 - DNA, 16 bp, M. musculus
ctgggtttgatcccag

SEQ ID NO: 398944 - DNA, 16 bp, M. musculus
ctgggtttgatcccca

SEQ ID NO: 398945 - DNA, 16 bp, M. musculus
ctgggtttgattcccc

SEQ ID NO: 398946 - DNA, 16 bp, M. musculus
ctgggtttggtagctg

SEQ ID NO: 398947 - DNA, 16 bp, M. musculus
ctgggtttggtggctc

SEQ ID NO: 398948 - DNA, 16 bp, M. musculus
ctgggttttatcccca

SEQ ID NO: 398949 - DNA, 16 bp, M. musculus
ctgggttttcagttct

SEQ ID NO: 398950 - DNA, 16 bp, M. musculus
ctgggttttgaactca

SEQ ID NO: 398951 - DNA, 16 bp, M. musculus
ctgggtttttttccag

SEQ ID NO: 398952 - DNA, 16 bp, M. musculus
ctggtaaaatggctca

SEQ ID NO: 398953 - DNA, 16 bp, M. musculus
ctggtaaaggtgagca

SEQ ID NO: 398954 - DNA, 16 bp, M. musculus
ctggtaaatggaaaga

SEQ ID NO: 398955 - DNA, 16 bp, M. musculus
ctggtaactcagggtt

SEQ ID NO: 398956 - DNA, 16 bp, M. musculus
ctggtaaggatgtgaa

SEQ ID NO: 398957 - DNA, 16 bp, M. musculus
ctggtacagaccttgt

SEQ ID NO: 398958 - DNA, 16 bp, M. musculus
ctggtacagctacaga

SEQ ID NO: 398959 - DNA, 16 bp, M. musculus
ctggtacccaaggagg

SEQ ID NO: 398960 - DNA, 16 bp, M. musculus
ctggtacccttttctc

SEQ ID NO: 398961 - DNA, 16 bp, M. musculus
ctggtacctgtggagg

SEQ ID NO: 398962 - DNA, 16 bp, M. musculus
ctggtactataaacct

SEQ ID NO: 398963 - DNA, 16 bp, M. musculus
ctggtagaggtaggct

SEQ ID NO: 398964 - DNA, 16 bp, M. musculus
ctggtagatggagcct

SEQ ID NO: 398965 - DNA, 16 bp, M. musculus
ctggtaggaatctcag

SEQ ID NO: 398966 - DNA, 16 bp, M. musculus
ctggtaggaatgtaaa

SEQ ID NO: 398967 - DNA, 16 bp, M. musculus
ctggtagtggtggtgg

SEQ ID NO: 398968 - DNA, 16 bp, M. musculus
ctggtataattttgat

SEQ ID NO: 398969 - DNA, 16 bp, M. musculus
ctggtatccaaaatgg

SEQ ID NO: 398970 - DNA, 19 bp, M. musculus
ctggtatccttatggttaa

SEQ ID NO: 398971 - DNA, 16 bp, M. musculus
ctggtattaaaggcat

SEQ ID NO: 398972 - DNA, 16 bp, M. musculus
ctggtcaacagagcaa

SEQ ID NO: 398973 - DNA, 16 bp, M. musculus
ctggtcaccagggctg

SEQ ID NO: 398974 - DNA, 16 bp, M. musculus
ctggtcagcccaccag

SEQ ID NO: 398975 - DNA, 16 bp, M. musculus
ctggtcagctggagct

SEQ ID NO: 398976 - DNA, 16 bp, M. musculus
ctggtcaggcagagtt

SEQ ID NO: 398977 - DNA, 16 bp, M. musculus
ctggtcatgatgtttg

SEQ ID NO: 398978 - DNA, 16 bp, M. musculus
ctggtcattgctgtgg

SEQ ID NO: 398979 - DNA, 16 bp, M. musculus
ctggtccaatccattt

SEQ ID NO: 398980 - DNA, 16 bp, M. musculus
ctggtccccctgcctc

SEQ ID NO: 398981 - DNA, 16 bp, M. musculus
ctggtccctggtccct

SEQ ID NO: 398982 - DNA, 16 bp, M. musculus
ctggtcccttgtgcct

SEQ ID NO: 398983 - DNA, 16 bp, M. musculus
ctggtcctcctgcctc

SEQ ID NO: 398984 - DNA, 16 bp, M. musculus
ctggtcctctgcaaga

SEQ ID NO: 398985 - DNA, 16 bp, M. musculus
ctggtcctctggaaga

SEQ ID NO: 398986 - DNA, 16 bp, M. musculus
ctggtcctggaattcc

SEQ ID NO: 398987 - DNA, 16 bp, M. musculus
ctggtcctggtcctgg

SEQ ID NO: 398988 - DNA, 17 bp, M. musculus
ctggtcctgtggaaaca

SEQ ID NO: 398989 - DNA, 16 bp, M. musculus
ctggtccttattacag

SEQ ID NO: 398990 - DNA, 16 bp, M. musculus
ctggtccttgctgctg

SEQ ID NO: 398991 - DNA, 16 bp, M. musculus
ctggtcgagagcagac

SEQ ID NO: 398992 - DNA, 26 bp, M. musculus
ctggtctacaaagtgagttccaggat

SEQ ID NO: 398993 - DNA, 16 bp, M. musculus
ctggtctacacacaca

SEQ ID NO: 398994 - DNA, 22 bp, M. musculus
ctggtctacagagcaagttcca

SEQ ID NO: 398995 - DNA, 17 bp, M. musculus
ctggtctacagcatgag

SEQ ID NO: 398996 - DNA, 16 bp, M. musculus
ctggtctatacaatga

SEQ ID NO: 398997 - DNA, 16 bp, M. musculus
ctggtctcaaactcac

SEQ ID NO: 398998 - DNA, 16 bp, M. musculus
ctggtctcaaactcat

SEQ ID NO: 398999 - DNA, 16 bp, M. musculus
ctggtctccatggaca

SEQ ID NO: 399000 - DNA, 16 bp, M. musculus
ctggtctcccaggaga

SEQ ID NO: 399001 - DNA, 16 bp, M. musculus
ctggtctcccaggagt

SEQ ID NO: 399002 - DNA, 16 bp, M. musculus
ctggtctcccaggtct

SEQ ID NO: 399003 - DNA, 16 bp, M. musculus
ctggtctctgagagac

SEQ ID NO: 399004 - DNA, 16 bp, M. musculus
ctggtctctgtgggta

SEQ ID NO: 399005 - DNA, 16 bp, M. musculus
ctggtctgcaaagtga

SEQ ID NO: 399006 - DNA, 16 bp, M. musculus
ctggtctgcacagtga

SEQ ID NO: 399007 - DNA, 16 bp, M. musculus
ctggtctgcagctgct

SEQ ID NO: 399008 - DNA, 16 bp, M. musculus
ctggtctggaactcac

SEQ ID NO: 399009 - DNA, 16 bp, M. musculus
ctggtctggaactcat

SEQ ID NO: 399010 - DNA, 16 bp, M. musculus
ctggtctggagctcac

SEQ ID NO: 399011 - DNA, 16 bp, M. musculus
ctggtctgtggaaagg

SEQ ID NO: 399012 - DNA, 16 bp, M. musculus
ctggtctgtggctgga

SEQ ID NO: 399013 - DNA, 16 bp, M. musculus
ctggtctgttgtgttc

SEQ ID NO: 399014 - DNA, 16 bp, M. musculus
ctggtcttacagagtg

SEQ ID NO: 399015 - DNA, 16 bp, M. musculus
ctggtcttcaataaaa

SEQ ID NO: 399016 - DNA, 16 bp, M. musculus
ctggtcttcagtctac

SEQ ID NO: 399017 - DNA, 17 bp, M. musculus
ctggtcttcctggacct

SEQ ID NO: 399018 - DNA, 16 bp, M. musculus
ctggtcttcctgtgga

SEQ ID NO: 399019 - DNA, 16 bp, M. musculus
ctggtcttgaactcag

SEQ ID NO: 399020 - DNA, 16 bp, M. musculus
ctggtgaaagggcatg

SEQ ID NO: 399021 - DNA, 16 bp, M. musculus
ctggtgacacacaggt

SEQ ID NO: 399022 - DNA, 16 bp, M. musculus
ctggtgacaggcatca

SEQ ID NO: 399023 - DNA, 16 bp, M. musculus
ctggtgacccctgtgg

SEQ ID NO: 399024 - DNA, 16 bp, M. musculus
ctggtgagaagcctgg

SEQ ID NO: 399025 - DNA, 16 bp, M. musculus
ctggtgagaagtctgt

SEQ ID NO: 399026 - DNA, 16 bp, M. musculus
ctggtgagaagtttgg

SEQ ID NO: 399027 - DNA, 16 bp, M. musculus
ctggtgagatagttca

SEQ ID NO: 399028 - DNA, 16 bp, M. musculus
ctggtgaggttgtgga

SEQ ID NO: 399029 - DNA, 16 bp, M. musculus
ctggtgcagaggccat

SEQ ID NO: 399030 - DNA, 16 bp, M. musculus
ctggtgcagcaggcct

SEQ ID NO: 399031 - DNA, 16 bp, M. musculus
ctggtgcaggtgcagg

SEQ ID NO: 399032 - DNA, 16 bp, M. musculus
ctggtgccagccagag

SEQ ID NO: 399033 - DNA, 16 bp, M. musculus
ctggtgccatgggtcc

SEQ ID NO: 399034 - DNA, 16 bp, M. musculus
ctggtgcccaaggaga

SEQ ID NO: 399035 - DNA, 16 bp, M. musculus
ctggtgcccacagagg

SEQ ID NO: 399036 - DNA, 16 bp, M. musculus
ctggtgcccgaggagg

SEQ ID NO: 399037 - DNA, 16 bp, M. musculus
ctggtgccctcagagg

SEQ ID NO: 399038 - DNA, 16 bp, M. musculus
ctggtgccctctgctg

SEQ ID NO: 399039 - DNA, 16 bp, M. musculus
ctggtgccctcttctg

SEQ ID NO: 399040 - DNA, 16 bp, M. musculus
ctggtgcccttggagg

SEQ ID NO: 399041 - DNA, 16 bp, M. musculus
ctggtgcctctgaaga

SEQ ID NO: 399042 - DNA, 16 bp, M. musculus
ctggtgcctgctgagg

SEQ ID NO: 399043 - DNA, 16 bp, M. musculus
ctggtgcctgctgtct

SEQ ID NO: 399044 - DNA, 16 bp, M. musculus
ctggtgcctgtgaagg

SEQ ID NO: 399045 - DNA, 16 bp, M. musculus
ctggtgccttcttggg

SEQ ID NO: 399046 - DNA, 16 bp, M. musculus
ctggtgctctgggcgg

SEQ ID NO: 399047 - DNA, 16 bp, M. musculus
ctggtgctgggattac

SEQ ID NO: 399048 - DNA, 16 bp, M. musculus
ctggtgctggtgtgga

SEQ ID NO: 399049 - DNA, 16 bp, M. musculus
ctggtgcttgtggagg

SEQ ID NO: 399050 - DNA, 16 bp, M. musculus
ctggtggaactgcaag

SEQ ID NO: 399051 - DNA, 16 bp, M. musculus
ctggtggaaggactgg

SEQ ID NO: 399052 - DNA, 16 bp, M. musculus
ctggtggcacacacct

SEQ ID NO: 399053 - DNA, 16 bp, M. musculus
ctggtggcaggagctg

SEQ ID NO: 399054 - DNA, 16 bp, M. musculus
ctggtggccacagggc

SEQ ID NO: 399055 - DNA, 16 bp, M. musculus
ctggtggccctgggtt

SEQ ID NO: 399056 - DNA, 16 bp, M. musculus
ctggtggctctagctg

SEQ ID NO: 399057 - DNA, 16 bp, M. musculus
ctggtggctgattatg

SEQ ID NO: 399058 - DNA, 16 bp, M. musculus
ctggtggctggagaga

SEQ ID NO: 399059 - DNA, 16 bp, M. musculus
ctggtggctggtggct

SEQ ID NO: 399060 - DNA, 16 bp, M. musculus
ctggtgggaggtggaa

SEQ ID NO: 399061 - DNA, 16 bp, M. musculus
ctggtgggtgatgagg

SEQ ID NO: 399062 - DNA, 16 bp, M. musculus
ctggtggtcatcatgt

SEQ ID NO: 399063 - DNA, 16 bp, M. musculus
ctggtggtcatctcag

SEQ ID NO: 399064 - DNA, 16 bp, M. musculus
ctggtggttactcaga

SEQ ID NO: 399065 - DNA, 16 bp, M. musculus
ctggtgtaattgtgat

SEQ ID NO: 399066 - DNA, 16 bp, M. musculus
ctggtgtactggctgg

SEQ ID NO: 399067 - DNA, 16 bp, M. musculus
ctggtgtccacagagg

SEQ ID NO: 399068 - DNA, 16 bp, M. musculus
ctggtgtctgaagaca

SEQ ID NO: 399069 - DNA, 16 bp, M. musculus
ctggtgtctgtggagg

SEQ ID NO: 399070 - DNA, 16 bp, M. musculus
ctggtgtgatggtgca

SEQ ID NO: 399071 - DNA, 16 bp, M. musculus
ctggtgtgctggtgtg

SEQ ID NO: 399072 - DNA, 16 bp, M. musculus
ctggtgtgggggaggt

SEQ ID NO: 399073 - DNA, 16 bp, M. musculus
ctggtgtgtgaagaca

SEQ ID NO: 399074 - DNA, 16 bp, M. musculus
ctggtgttcctcctgg

SEQ ID NO: 399075 - DNA, 16 bp, M. musculus
ctggtgttcctctgta

SEQ ID NO: 399076 - DNA, 16 bp, M. musculus
ctggtgttcctgttgg

SEQ ID NO: 399077 - DNA, 16 bp, M. musculus
ctggtgttggaggctg

SEQ ID NO: 399078 - DNA, 16 bp, M. musculus
ctggtgtttgaacctg

SEQ ID NO: 399079 - DNA, 16 bp, M. musculus
ctggtgtttgtggaca

SEQ ID NO: 399080 - DNA, 16 bp, M. musculus
ctggttaaaaaaaaaa

SEQ ID NO: 399081 - DNA, 16 bp, M. musculus
ctggttaaagaaaaag

SEQ ID NO: 399082 - DNA, 16 bp, M. musculus
ctggttacccttccac

SEQ ID NO: 399083 - DNA, 16 bp, M. musculus
ctggttagaacttgtt

SEQ ID NO: 399084 - DNA, 16 bp, M. musculus
ctggttagagcaggcc

SEQ ID NO: 399085 - DNA, 16 bp, M. musculus
ctggttagttgattct

SEQ ID NO: 399086 - DNA, 16 bp, M. musculus
ctggttattgtgaata

SEQ ID NO: 399087 - DNA, 16 bp, M. musculus
ctggttcaactagcag

SEQ ID NO: 399088 - DNA, 16 bp, M. musculus
ctggttcaaggtttct

SEQ ID NO: 399089 - DNA, 16 bp, M. musculus
ctggttcaattcagct

SEQ ID NO: 399090 - DNA, 16 bp, M. musculus
ctggttccaggggatc

SEQ ID NO: 399091 - DNA, 16 bp, M. musculus
ctggttcctgcaaatt

SEQ ID NO: 399092 - DNA, 16 bp, M. musculus
ctggttccttctcatt

SEQ ID NO: 399093 - DNA, 16 bp, M. musculus
ctggttctcaaccttc

SEQ ID NO: 399094 - DNA, 16 bp, M. musculus
ctggttgaggtgggag

SEQ ID NO: 399095 - DNA, 16 bp, M. musculus
ctggttgcccttccag

SEQ ID NO: 399096 - DNA, 16 bp, M. musculus
ctggttgctcctgctg

SEQ ID NO: 399097 - DNA, 16 bp, M. musculus
ctggttggcctggaac

SEQ ID NO: 399098 - DNA, 16 bp, M. musculus
ctggttggctttctct

SEQ ID NO: 399099 - DNA, 16 bp, M. musculus
ctggttggtgacccag

SEQ ID NO: 399100 - DNA, 16 bp, M. musculus
ctggttggtgactcag

SEQ ID NO: 399101 - DNA, 16 bp, M. musculus
ctggttggtggcccag

SEQ ID NO: 399102 - DNA, 16 bp, M. musculus
ctggttggtgtttcag

SEQ ID NO: 399103 - DNA, 16 bp, M. musculus
ctggttggttgattgg

SEQ ID NO: 399104 - DNA, 16 bp, M. musculus
ctggttgtcctagaac

SEQ ID NO: 399105 - DNA, 18 bp, M. musculus
ctggttgttgggaattga

SEQ ID NO: 399106 - DNA, 16 bp, M. musculus
ctggttgtttgatatt

SEQ ID NO: 399107 - DNA, 16 bp, M. musculus
ctggtttatttcattt

SEQ ID NO: 399108 - DNA, 16 bp, M. musculus
ctggtttccacatgca

SEQ ID NO: 399109 - DNA, 16 bp, M. musculus
ctggtttccaggcagc

SEQ ID NO: 399110 - DNA, 16 bp, M. musculus
ctggtttccatctgtg

SEQ ID NO: 399111 - DNA, 16 bp, M. musculus
ctggtttccatggtga

SEQ ID NO: 399112 - DNA, 16 bp, M. musculus
ctggtttcctctctga

SEQ ID NO: 399113 - DNA, 16 bp, M. musculus
ctggtttctctggaga

SEQ ID NO: 399114 - DNA, 16 bp, M. musculus
ctggtttctttcactt

SEQ ID NO: 399115 - DNA, 16 bp, M. musculus
ctggtttctttcctag

SEQ ID NO: 399116 - DNA, 16 bp, M. musculus
ctggtttgctgtctct

SEQ ID NO: 399117 - DNA, 16 bp, M. musculus
ctggtttgtttggaaa

SEQ ID NO: 399118 - DNA, 16 bp, M. musculus
ctggttttcaaaacat

SEQ ID NO: 399119 - DNA, 16 bp, M. musculus
ctggttttgaactcac

SEQ ID NO: 399120 - DNA, 16 bp, M. musculus
ctggttttgggtgtca

SEQ ID NO: 399121 - DNA, 16 bp, M. musculus
ctggttttgttaatta

SEQ ID NO: 399122 - DNA, 16 bp, M. musculus
ctgtaaaaaacaaaac

SEQ ID NO: 399123 - DNA, 16 bp, M. musculus
ctgtaaaactcagcac

SEQ ID NO: 399124 - DNA, 16 bp, M. musculus
ctgtaaaagtaacttt

SEQ ID NO: 399125 - DNA, 16 bp, M. musculus
ctgtaaaatgggtata

SEQ ID NO: 399126 - DNA, 16 bp, M. musculus
ctgtaaacattacctg

SEQ ID NO: 399127 - DNA, 16 bp, M. musculus
ctgtaaaccccttcaa

SEQ ID NO: 399128 - DNA, 16 bp, M. musculus
ctgtaaagaaaaataa

SEQ ID NO: 399129 - DNA, 16 bp, M. musculus
ctgtaaataggacaaa

SEQ ID NO: 399130 - DNA, 16 bp, M. musculus
ctgtaaatcaggctgg

SEQ ID NO: 399131 - DNA, 16 bp, M. musculus
ctgtaaatctcagcag

SEQ ID NO: 399132 - DNA, 17 bp, M. musculus
ctgtaaatttgaggcca

SEQ ID NO: 399133 - DNA, 16 bp, M. musculus
ctgtaacaaaatacct

SEQ ID NO: 399134 - DNA, 16 bp, M. musculus
ctgtaaccaggctggc

SEQ ID NO: 399135 - DNA, 16 bp, M. musculus
ctgtaacccagactgg

SEQ ID NO: 399136 - DNA, 16 bp, M. musculus
ctgtaaccccagaact

SEQ ID NO: 399137 - DNA, 16 bp, M. musculus
ctgtaaccccagcaca

SEQ ID NO: 399138 - DNA, 16 bp, M. musculus
ctgtaaccccagcact

SEQ ID NO: 399139 - DNA, 16 bp, M. musculus
ctgtaaccccagcatt

SEQ ID NO: 399140 - DNA, 16 bp, M. musculus
ctgtaaccccagccct

SEQ ID NO: 399141 - DNA, 16 bp, M. musculus
ctgtaaccccagctct

SEQ ID NO: 399142 - DNA, 16 bp, M. musculus
ctgtaaccccagggct

SEQ ID NO: 399143 - DNA, 16 bp, M. musculus
ctgtaaccccttactc

SEQ ID NO: 399144 - DNA, 16 bp, M. musculus
ctgtaaccctagcact

SEQ ID NO: 399145 - DNA, 16 bp, M. musculus
ctgtaaccctagcatt

SEQ ID NO: 399146 - DNA, 16 bp, M. musculus
ctgtaaccctatagga

SEQ ID NO: 399147 - DNA, 16 bp, M. musculus
ctgtaaccttagcact

SEQ ID NO: 399148 - DNA, 16 bp, M. musculus
ctgtaactcactgtgt

SEQ ID NO: 399149 - DNA, 16 bp, M. musculus
ctgtaactctagttgc

SEQ ID NO: 399150 - DNA, 16 bp, M. musculus
ctgtaagaaagcagac

SEQ ID NO: 399151 - DNA, 16 bp, M. musculus
ctgtaagaattattag

SEQ ID NO: 399152 - DNA, 16 bp, M. musculus
ctgtaagattggatgc

SEQ ID NO: 399153 - DNA, 16 bp, M. musculus
ctgtaagcaagcctgt

SEQ ID NO: 399154 - DNA, 16 bp, M. musculus
ctgtaagcaggaaaat

SEQ ID NO: 399155 - DNA, 16 bp, M. musculus
ctgtaagcatcagaat

SEQ ID NO: 399156 - DNA, 16 bp, M. musculus
ctgtaagccaaaggac

SEQ ID NO: 399157 - DNA, 16 bp, M. musculus
ctgtaagccagactca

SEQ ID NO: 399158 - DNA, 16 bp, M. musculus
ctgtaagccagcccca

SEQ ID NO: 399159 - DNA, 16 bp, M. musculus
ctgtaagccagccccg

SEQ ID NO: 399160 - DNA, 16 bp, M. musculus
ctgtaagccagctcca

SEQ ID NO: 399161 - DNA, 16 bp, M. musculus
ctgtaagccagcttca

SEQ ID NO: 399162 - DNA, 16 bp, M. musculus
ctgtaagccagtccca

SEQ ID NO: 399163 - DNA, 16 bp, M. musculus
ctgtaagccattttct

SEQ ID NO: 399164 - DNA, 16 bp, M. musculus
ctgtaagcccagcact

SEQ ID NO: 399165 - DNA, 16 bp, M. musculus
ctgtaagttctgtgac

SEQ ID NO: 399166 - DNA, 16 bp, M. musculus
ctgtaataataataat

SEQ ID NO: 399167 - DNA, 16 bp, M. musculus
ctgtaataccagcact

SEQ ID NO: 399168 - DNA, 16 bp, M. musculus
ctgtaatactagcact

SEQ ID NO: 399169 - DNA, 16 bp, M. musculus
ctgtaataggatctaa

SEQ ID NO: 399170 - DNA, 16 bp, M. musculus
ctgtaatatcagcact

SEQ ID NO: 399171 - DNA, 16 bp, M. musculus
ctgtaatcacacatgc

SEQ ID NO: 399172 - DNA, 16 bp, M. musculus
ctgtaatcccaacacc

SEQ ID NO: 399173 - DNA, 17 bp, M. musculus
ctgtaatcccaacactt

SEQ ID NO: 399174 - DNA, 16 bp, M. musculus
ctgtaatcccagaact

SEQ ID NO: 399175 - DNA, 16 bp, M. musculus
ctgtaatcccagagct

SEQ ID NO: 399176 - DNA, 16 bp, M. musculus
ctgtaatcccagcacc

SEQ ID NO: 399177 - DNA, 16 bp, M. musculus
ctgtaatcccagcact

SEQ ID NO: 399178 - DNA, 16 bp, M. musculus
ctgtaatcccagcatt

SEQ ID NO: 399179 - DNA, 16 bp, M. musculus
ctgtaatcccagctct

SEQ ID NO: 399180 - DNA, 16 bp, M. musculus
ctgtaatcccaggatt

SEQ ID NO: 399181 - DNA, 16 bp, M. musculus
ctgtaatccctgcact

SEQ ID NO: 399182 - DNA, 16 bp, M. musculus
ctgtaatcctagcaca

SEQ ID NO: 399183 - DNA, 16 bp, M. musculus
ctgtaatcctagcact

SEQ ID NO: 399184 - DNA, 16 bp, M. musculus
ctgtaatcctagctct

SEQ ID NO: 399185 - DNA, 16 bp, M. musculus
ctgtaatcctagtgct

SEQ ID NO: 399186 - DNA, 16 bp, M. musculus
ctgtaatctcagaact

SEQ ID NO: 399187 - DNA, 16 bp, M. musculus
ctgtaatctcagcact

SEQ ID NO: 399188 - DNA, 16 bp, M. musculus
ctgtaatctcagcatt

SEQ ID NO: 399189 - DNA, 16 bp, M. musculus
ctgtaatctcagtact

SEQ ID NO: 399190 - DNA, 16 bp, M. musculus
ctgtaatgctgggatt

SEQ ID NO: 399191 - DNA, 18 bp, M. musculus
ctgtaatgggatccgata

SEQ ID NO: 399192 - DNA, 16 bp, M. musculus
ctgtaattccagcact

SEQ ID NO: 399193 - DNA, 16 bp, M. musculus
ctgtaattccagcatt

SEQ ID NO: 399194 - DNA, 16 bp, M. musculus
ctgtaattccagcctt

SEQ ID NO: 399195 - DNA, 16 bp, M. musculus
ctgtaattccagtatt

SEQ ID NO: 399196 - DNA, 16 bp, M. musculus
ctgtaattccagtgct

SEQ ID NO: 399197 - DNA, 16 bp, M. musculus
ctgtaattctaacact

SEQ ID NO: 399198 - DNA, 16 bp, M. musculus
ctgtaattctagcact

SEQ ID NO: 399199 - DNA, 16 bp, M. musculus
ctgtaattctagcatt

SEQ ID NO: 399200 - DNA, 16 bp, M. musculus
ctgtaattttctttct

SEQ ID NO: 399201 - DNA, 16 bp, M. musculus
ctgtaattttgatact

SEQ ID NO: 399202 - DNA, 16 bp, M. musculus
ctgtaattttgctagt

SEQ ID NO: 399203 - DNA, 16 bp, M. musculus
ctgtaattttttaaaa

SEQ ID NO: 399204 - DNA, 16 bp, M. musculus
ctgtacaaacatcatg

SEQ ID NO: 399205 - DNA, 16 bp, M. musculus
ctgtacagccttggct

SEQ ID NO: 399206 - DNA, 16 bp, M. musculus
ctgtacatctactacc

SEQ ID NO: 399207 - DNA, 16 bp, M. musculus
ctgtaccagcaagcca

SEQ ID NO: 399208 - DNA, 16 bp, M. musculus
ctgtaccaggctcctg

SEQ ID NO: 399209 - DNA, 16 bp, M. musculus
ctgtaccagtaccatg

SEQ ID NO: 399210 - DNA, 16 bp, M. musculus
ctgtaccccatatttt

SEQ ID NO: 399211 - DNA, 16 bp, M. musculus
ctgtacctcattttta

SEQ ID NO: 399212 - DNA, 16 bp, M. musculus
ctgtacctccagctcc

SEQ ID NO: 399213 - DNA, 16 bp, M. musculus
ctgtactacagaaaaa

SEQ ID NO: 399214 - DNA, 16 bp, M. musculus
ctgtactggctagttt

SEQ ID NO: 399215 - DNA, 16 bp, M. musculus
ctgtactggcttgcct

SEQ ID NO: 399216 - DNA, 16 bp, M. musculus
ctgtactggggcatag

SEQ ID NO: 399217 - DNA, 16 bp, M. musculus
ctgtagaacatttcat

SEQ ID NO: 399218 - DNA, 16 bp, M. musculus
ctgtagaacattttct

SEQ ID NO: 399219 - DNA, 16 bp, M. musculus
ctgtagaagaatgtga

SEQ ID NO: 399220 - DNA, 16 bp, M. musculus
ctgtagactgggctgg

SEQ ID NO: 399221 - DNA, 16 bp, M. musculus
ctgtagaggggcatct

SEQ ID NO: 399222 - DNA, 16 bp, M. musculus
ctgtagaggtcagaag

SEQ ID NO: 399223 - DNA, 16 bp, M. musculus
ctgtagaggtcagaga

SEQ ID NO: 399224 - DNA, 16 bp, M. musculus
ctgtagatcaagctgg

SEQ ID NO: 399225 - DNA, 16 bp, M. musculus
ctgtagatcaggctga

SEQ ID NO: 399226 - DNA, 16 bp, M. musculus
ctgtagatgtagctca

SEQ ID NO: 399227 - DNA, 16 bp, M. musculus
ctgtagattgttttat

SEQ ID NO: 399228 - DNA, 16 bp, M. musculus
ctgtagcagtcttcag

SEQ ID NO: 399229 - DNA, 16 bp, M. musculus
ctgtagccaggcagga

SEQ ID NO: 399230 - DNA, 16 bp, M. musculus
ctgtagcccagactga

SEQ ID NO: 399231 - DNA, 16 bp, M. musculus
ctgtagcccaggatgg

SEQ ID NO: 399232 - DNA, 16 bp, M. musculus
ctgtagccctggctgg

SEQ ID NO: 399233 - DNA, 16 bp, M. musculus
ctgtagctcaggctaa

SEQ ID NO: 399234 - DNA, 16 bp, M. musculus
ctgtagcttcagttcc

SEQ ID NO: 399235 - DNA, 16 bp, M. musculus
ctgtaggaacactaag

SEQ ID NO: 399236 - DNA, 16 bp, M. musculus
ctgtaggcaagcctgt

SEQ ID NO: 399237 - DNA, 16 bp, M. musculus
ctgtaggcatgcctgt

SEQ ID NO: 399238 - DNA, 16 bp, M. musculus
ctgtaggcatgtctgt

SEQ ID NO: 399239 - DNA, 16 bp, M. musculus
ctgtagggaattttct

SEQ ID NO: 399240 - DNA, 16 bp, M. musculus
ctgtaggtaccaggca

SEQ ID NO: 399241 - DNA, 16 bp, M. musculus
ctgtaggtatgtctgt

SEQ ID NO: 399242 - DNA, 16 bp, M. musculus
ctgtaggtcattttct

SEQ ID NO: 399243 - DNA, 16 bp, M. musculus
ctgtagtacagattta

SEQ ID NO: 399244 - DNA, 16 bp, M. musculus
ctgtagtacagcttca

SEQ ID NO: 399245 - DNA, 16 bp, M. musculus
ctgtagtcccagcact

SEQ ID NO: 399246 - DNA, 16 bp, M. musculus
ctgtagttctgtttct

SEQ ID NO: 399247 - DNA, 16 bp, M. musculus
ctgtataagcagaaaa

SEQ ID NO: 399248 - DNA, 16 bp, M. musculus
ctgtataatgttactt

SEQ ID NO: 399249 - DNA, 16 bp, M. musculus
ctgtatagctctggat

SEQ ID NO: 399250 - DNA, 16 bp, M. musculus
ctgtatatagaaaaat

SEQ ID NO: 399251 - DNA, 16 bp, M. musculus
ctgtatatatgtgtat

SEQ ID NO: 399252 - DNA, 16 bp, M. musculus
ctgtatatctatatat

SEQ ID NO: 399253 - DNA, 16 bp, M. musculus
ctgtatatgtatatat

SEQ ID NO: 399254 - DNA, 16 bp, M. musculus
ctgtatatgtgctggg

SEQ ID NO: 399255 - DNA, 16 bp, M. musculus
ctgtatattcctttta

SEQ ID NO: 399256 - DNA, 16 bp, M. musculus
ctgtatcccattttaa

SEQ ID NO: 399257 - DNA, 16 bp, M. musculus
ctgtatccccagcact

SEQ ID NO: 399258 - DNA, 16 bp, M. musculus
ctgtatcccttcctct

SEQ ID NO: 399259 - DNA, 16 bp, M. musculus
ctgtatctcaggctgg

SEQ ID NO: 399260 - DNA, 16 bp, M. musculus
ctgtatctccatggaa

SEQ ID NO: 399261 - DNA, 16 bp, M. musculus
ctgtatctgtgtgtct

SEQ ID NO: 399262 - DNA, 16 bp, M. musculus
ctgtatcttggttatt

SEQ ID NO: 399263 - DNA, 16 bp, M. musculus
ctgtatcttgtaatat

SEQ ID NO: 399264 - DNA, 16 bp, M. musculus
ctgtatcttgttttgt

SEQ ID NO: 399265 - DNA, 16 bp, M. musculus
ctgtatgacaagaagt

SEQ ID NO: 399266 - DNA, 16 bp, M. musculus
ctgtatggaatcttct

SEQ ID NO: 399267 - DNA, 16 bp, M. musculus
ctgtatggcaagaact

SEQ ID NO: 399268 - DNA, 16 bp, M. musculus
ctgtatggcatctgcc

SEQ ID NO: 399269 - DNA, 16 bp, M. musculus
ctgtatgtatgtgtgt

SEQ ID NO: 399270 - DNA, 16 bp, M. musculus
ctgtatgtgtgcacat

SEQ ID NO: 399271 - DNA, 16 bp, M. musculus
ctgtatgtgtgctgtg

SEQ ID NO: 399272 - DNA, 16 bp, M. musculus
ctgtatgtgtgtatgt

SEQ ID NO: 399273 - DNA, 16 bp, M. musculus
ctgtatgtgtgtgtgt

SEQ ID NO: 399274 - DNA, 16 bp, M. musculus
ctgtatgtgttccttt

SEQ ID NO: 399275 - DNA, 16 bp, M. musculus
ctgtatgtgttctttt

SEQ ID NO: 399276 - DNA, 16 bp, M. musculus
ctgtatgtttgtctgt

SEQ ID NO: 399277 - DNA, 16 bp, M. musculus
ctgtattaaagagttg

SEQ ID NO: 399278 - DNA, 17 bp, M. musculus
ctgtattagtcagggtt

SEQ ID NO: 399279 - DNA, 16 bp, M. musculus
ctgtattccagccaga

SEQ ID NO: 399280 - DNA, 16 bp, M. musculus
ctgtattctcagcact

SEQ ID NO: 399281 - DNA, 16 bp, M. musculus
ctgtattgtcctggct

SEQ ID NO: 399282 - DNA, 16 bp, M. musculus
ctgtatttataatagc

SEQ ID NO: 399283 - DNA, 16 bp, M. musculus
ctgtatttatctccct

SEQ ID NO: 399284 - DNA, 16 bp, M. musculus
ctgtatttccttcaga

SEQ ID NO: 399285 - DNA, 16 bp, M. musculus
ctgtatttcctttaga

SEQ ID NO: 399286 - DNA, 16 bp, M. musculus
ctgtatttctttaaga

SEQ ID NO: 399287 - DNA, 16 bp, M. musculus
ctgtatttgccatgca

SEQ ID NO: 399288 - DNA, 16 bp, M. musculus
ctgtatttgtcaggga

SEQ ID NO: 399289 - DNA, 16 bp, M. musculus
ctgtatttttaaattt

SEQ ID NO: 399290 - DNA, 16 bp, M. musculus
ctgtcaaaaagaaatg

SEQ ID NO: 399291 - DNA, 16 bp, M. musculus
ctgtcaaatccttctc

SEQ ID NO: 399292 - DNA, 16 bp, M. musculus
ctgtcaaattgccttc

SEQ ID NO: 399293 - DNA, 16 bp, M. musculus
ctgtcaacttgacaca

SEQ ID NO: 399294 - DNA, 16 bp, M. musculus
ctgtcaagctgctcat

SEQ ID NO: 399295 - DNA, 16 bp, M. musculus
ctgtcaagttgacaat

SEQ ID NO: 399296 - DNA, 16 bp, M. musculus
ctgtcaataaccccaa

SEQ ID NO: 399297 - DNA, 16 bp, M. musculus
ctgtcaatagctcctc

SEQ ID NO: 399298 - DNA, 16 bp, M. musculus
ctgtcacaagaacttc

SEQ ID NO: 399299 - DNA, 16 bp, M. musculus
ctgtcacacagagaaa

SEQ ID NO: 399300 - DNA, 16 bp, M. musculus
ctgtcacatagcactg

SEQ ID NO: 399301 - DNA, 16 bp, M. musculus
ctgtcaccacagctct

SEQ ID NO: 399302 - DNA, 16 bp, M. musculus
ctgtcaccccagcact

SEQ ID NO: 399303 - DNA, 16 bp, M. musculus
ctgtcaccctcttctg

SEQ ID NO: 399304 - DNA, 16 bp, M. musculus
ctgtcacctgcctctg

SEQ ID NO: 399305 - DNA, 16 bp, M. musculus
ctgtcacctgctgctg

SEQ ID NO: 399306 - DNA, 16 bp, M. musculus
ctgtcacctggaggag

SEQ ID NO: 399307 - DNA, 16 bp, M. musculus
ctgtcacctgtcacct

SEQ ID NO: 399308 - DNA, 16 bp, M. musculus
ctgtcactctctctgt

SEQ ID NO: 399309 - DNA, 16 bp, M. musculus
ctgtcactgaaccttc

SEQ ID NO: 399310 - DNA, 16 bp, M. musculus
ctgtcactgccttcag

SEQ ID NO: 399311 - DNA, 16 bp, M. musculus
ctgtcactgtaccagc

SEQ ID NO: 399312 - DNA, 16 bp, M. musculus
ctgtcactgtcctcag

SEQ ID NO: 399313 - DNA, 16 bp, M. musculus
ctgtcactgtctctct

SEQ ID NO: 399314 - DNA, 16 bp, M. musculus
ctgtcactgtcttcat

SEQ ID NO: 399315 - DNA, 16 bp, M. musculus
ctgtcagaaaaagaaa

SEQ ID NO: 399316 - DNA, 16 bp, M. musculus
ctgtcagatcctctgg

SEQ ID NO: 399317 - DNA, 16 bp, M. musculus
ctgtcagatttttttt

SEQ ID NO: 399318 - DNA, 16 bp, M. musculus
ctgtcagcaagcactt

SEQ ID NO: 399319 - DNA, 16 bp, M. musculus
ctgtcagcaatccaaa

SEQ ID NO: 399320 - DNA, 16 bp, M. musculus
ctgtcagcatttggaa

SEQ ID NO: 399321 - DNA, 18 bp, M. musculus
ctgtcagcctatctgtga

SEQ ID NO: 399322 - DNA, 16 bp, M. musculus
ctgtcagctgtcattt

SEQ ID NO: 399323 - DNA, 16 bp, M. musculus
ctgtcaggagagagct

SEQ ID NO: 399324 - DNA, 16 bp, M. musculus
ctgtcagtcagtgctg

SEQ ID NO: 399325 - DNA, 16 bp, M. musculus
ctgtcagtgtaaatgt

SEQ ID NO: 399326 - DNA, 16 bp, M. musculus
ctgtcatcaatggaca

SEQ ID NO: 399327 - DNA, 16 bp, M. musculus
ctgtcatcaatgggaa

SEQ ID NO: 399328 - DNA, 16 bp, M. musculus
ctgtcatcaccatcac

SEQ ID NO: 399329 - DNA, 16 bp, M. musculus
ctgtcatcccagcact

SEQ ID NO: 399330 - DNA, 16 bp, M. musculus
ctgtcatggagtcagc

SEQ ID NO: 399331 - DNA, 16 bp, M. musculus
ctgtcattattattat

SEQ ID NO: 399332 - DNA, 16 bp, M. musculus
ctgtccaaaaccaaaa

SEQ ID NO: 399333 - DNA, 16 bp, M. musculus
ctgtccaaaagaaaga

SEQ ID NO: 399334 - DNA, 16 bp, M. musculus
ctgtccaaagaaagga

SEQ ID NO: 399335 - DNA, 16 bp, M. musculus
ctgtccaattgtcttc

SEQ ID NO: 399336 - DNA, 16 bp, M. musculus
ctgtccacagtggcag

SEQ ID NO: 399337 - DNA, 16 bp, M. musculus
ctgtccagaaaggaca

SEQ ID NO: 399338 - DNA, 16 bp, M. musculus
ctgtccagcagccatg

SEQ ID NO: 399339 - DNA, 16 bp, M. musculus
ctgtccaggaactcat

SEQ ID NO: 399340 - DNA, 16 bp, M. musculus
ctgtccaggatcttct

SEQ ID NO: 399341 - DNA, 16 bp, M. musculus
ctgtccaggcccttct

SEQ ID NO: 399342 - DNA, 16 bp, M. musculus
ctgtccagggcacagg

SEQ ID NO: 399343 - DNA, 16 bp, M. musculus
ctgtccagggcctggg

SEQ ID NO: 399344 - DNA, 16 bp, M. musculus
ctgtccagtgctctag

SEQ ID NO: 399345 - DNA, 16 bp, M. musculus
ctgtccatccatccat

SEQ ID NO: 399346 - DNA, 16 bp, M. musculus
ctgtccatccatcctt

SEQ ID NO: 399347 - DNA, 16 bp, M. musculus
ctgtccatccctccct

SEQ ID NO: 399348 - DNA, 16 bp, M. musculus
ctgtccatctatctat

SEQ ID NO: 399349 - DNA, 16 bp, M. musculus
ctgtccatggtgctga

SEQ ID NO: 399350 - DNA, 16 bp, M. musculus
ctgtccattactgaga

SEQ ID NO: 399351 - DNA, 16 bp, M. musculus
ctgtccattggttgga

SEQ ID NO: 399352 - DNA, 16 bp, M. musculus
ctgtcccaaaagctgt

SEQ ID NO: 399353 - DNA, 16 bp, M. musculus
ctgtcccaaacaaaca

SEQ ID NO: 399354 - DNA, 16 bp, M. musculus
ctgtcccagaagctgt

SEQ ID NO: 399355 - DNA, 16 bp, M. musculus
ctgtcccagcagctgt

SEQ ID NO: 399356 - DNA, 16 bp, M. musculus
ctgtcccagctgctcc

SEQ ID NO: 399357 - DNA, 16 bp, M. musculus
ctgtcccaggctgacc

SEQ ID NO: 399358 - DNA, 16 bp, M. musculus
ctgtcccaggctgctt

SEQ ID NO: 399359 - DNA, 16 bp, M. musculus
ctgtccccaaaacaaa

SEQ ID NO: 399360 - DNA, 16 bp, M. musculus
ctgtccccacctccct

SEQ ID NO: 399361 - DNA, 16 bp, M. musculus
ctgtcccctgacctcc

SEQ ID NO: 399362 - DNA, 16 bp, M. musculus
ctgtccctcaccctgg

SEQ ID NO: 399363 - DNA, 16 bp, M. musculus
ctgtccctctctctgt

SEQ ID NO: 399364 - DNA, 16 bp, M. musculus
ctgtccctctgtccct

SEQ ID NO: 399365 - DNA, 16 bp, M. musculus
ctgtccctgcccctca

SEQ ID NO: 399366 - DNA, 16 bp, M. musculus
ctgtccctgcccctgc

SEQ ID NO: 399367 - DNA, 16 bp, M. musculus
ctgtccctgcctctca

SEQ ID NO: 399368 - DNA, 16 bp, M. musculus
ctgtccctgctgcagg

SEQ ID NO: 399369 - DNA, 16 bp, M. musculus
ctgtccctgctgtccc

SEQ ID NO: 399370 - DNA, 16 bp, M. musculus
ctgtccctgtccctct

SEQ ID NO: 399371 - DNA, 16 bp, M. musculus
ctgtccctgtgtgttg

SEQ ID NO: 399372 - DNA, 16 bp, M. musculus
ctgtccctgttcctgc

SEQ ID NO: 399373 - DNA, 16 bp, M. musculus
ctgtccgtggtgctga

SEQ ID NO: 399374 - DNA, 16 bp, M. musculus
ctgtcctacctgggga

SEQ ID NO: 399375 - DNA, 16 bp, M. musculus
ctgtcctagaactcaa

SEQ ID NO: 399376 - DNA, 16 bp, M. musculus
ctgtcctataactcac

SEQ ID NO: 399377 - DNA, 16 bp, M. musculus
ctgtcctcaaactcac

SEQ ID NO: 399378 - DNA, 16 bp, M. musculus
ctgtcctccgacctcc

SEQ ID NO: 399379 - DNA, 16 bp, M. musculus
ctgtcctcctgccctg

SEQ ID NO: 399380 - DNA, 16 bp, M. musculus
ctgtcctcctgcctct

SEQ ID NO: 399381 - DNA, 16 bp, M. musculus
ctgtcctctcacctcc

SEQ ID NO: 399382 - DNA, 16 bp, M. musculus
ctgtcctctgaccacc

SEQ ID NO: 399383 - DNA, 16 bp, M. musculus
ctgtcctctgagaagc

SEQ ID NO: 399384 - DNA, 16 bp, M. musculus
ctgtcctctgagagtc

SEQ ID NO: 399385 - DNA, 16 bp, M. musculus
ctgtcctgactaccat

SEQ ID NO: 399386 - DNA, 16 bp, M. musculus
ctgtcctgacttctct

SEQ ID NO: 399387 - DNA, 16 bp, M. musculus
ctgtcctgagaggctc

SEQ ID NO: 399388 - DNA, 16 bp, M. musculus
ctgtcctgcactcttc

SEQ ID NO: 399389 - DNA, 16 bp, M. musculus
ctgtcctgctgtgtca

SEQ ID NO: 399390 - DNA, 16 bp, M. musculus
ctgtcctggaacctac

SEQ ID NO: 399391 - DNA, 23 bp, M. musculus
ctgtcctggaactcactttgtaa

SEQ ID NO: 399392 - DNA, 16 bp, M. musculus
ctgtcctggaattctc

SEQ ID NO: 399393 - DNA, 16 bp, M. musculus
ctgtcctggacctcac

SEQ ID NO: 399394 - DNA, 16 bp, M. musculus
ctgtcctggagcttgt

SEQ ID NO: 399395 - DNA, 16 bp, M. musculus
ctgtcctggcacttgc

SEQ ID NO: 399396 - DNA, 16 bp, M. musculus
ctgtcctggctcttct

SEQ ID NO: 399397 - DNA, 16 bp, M. musculus
ctgtcctggctgtcct

SEQ ID NO: 399398 - DNA, 16 bp, M. musculus
ctgtcctgggacatct

SEQ ID NO: 399399 - DNA, 16 bp, M. musculus
ctgtcctgtctgtctg

SEQ ID NO: 399400 - DNA, 16 bp, M. musculus
ctgtcctgtcttcctt

SEQ ID NO: 399401 - DNA, 16 bp, M. musculus
ctgtcctgtgtctttg

SEQ ID NO: 399402 - DNA, 16 bp, M. musculus
ctgtccttccttgcct

SEQ ID NO: 399403 - DNA, 16 bp, M. musculus
ctgtccttgaactcac

SEQ ID NO: 399404 - DNA, 16 bp, M. musculus
ctgtcctttctgtaat

SEQ ID NO: 399405 - DNA, 16 bp, M. musculus
ctgtcctttgacctct

SEQ ID NO: 399406 - DNA, 16 bp, M. musculus
ctgtcctttgagaggc

SEQ ID NO: 399407 - DNA, 16 bp, M. musculus
ctgtcctttgggtttt

SEQ ID NO: 399408 - DNA, 16 bp, M. musculus
ctgtcctttgtccctg

SEQ ID NO: 399409 - DNA, 16 bp, M. musculus
ctgtcgctgtctctgt

SEQ ID NO: 399410 - DNA, 16 bp, M. musculus
ctgtcgctgtgataaa

SEQ ID NO: 399411 - DNA, 16 bp, M. musculus
ctgtctaaaaaaataa

SEQ ID NO: 399412 - DNA, 16 bp, M. musculus
ctgtctaccaatggaa

SEQ ID NO: 399413 - DNA, 16 bp, M. musculus
ctgtctacccttctgt

SEQ ID NO: 399414 - DNA, 16 bp, M. musculus
ctgtctagatgctgcc

SEQ ID NO: 399415 - DNA, 16 bp, M. musculus
ctgtctataactccag

SEQ ID NO: 399416 - DNA, 16 bp, M. musculus
ctgtctatgtctgtgt

SEQ ID NO: 399417 - DNA, 16 bp, M. musculus
ctgtctcaaaaaaacc

SEQ ID NO: 399418 - DNA, 16 bp, M. musculus
ctgtctcaaaaaaagg

SEQ ID NO: 399419 - DNA, 16 bp, M. musculus
ctgtctcaaaaaacag

SEQ ID NO: 399420 - DNA, 16 bp, M. musculus
ctgtctcaaaaaataa

SEQ ID NO: 399421 - DNA, 16 bp, M. musculus
ctgtctcaaaaaccac

SEQ ID NO: 399422 - DNA, 16 bp, M. musculus
ctgtctcaaaaagaaa

SEQ ID NO: 399423 - DNA, 16 bp, M. musculus
ctgtctcaaaacaaaa

SEQ ID NO: 399424 - DNA, 16 bp, M. musculus
ctgtctcaaaaccaaa

SEQ ID NO: 399425 - DNA, 16 bp, M. musculus
ctgtctcaaaagcaaa

SEQ ID NO: 399426 - DNA, 16 bp, M. musculus
ctgtctcaaaagtcaa

SEQ ID NO: 399427 - DNA, 16 bp, M. musculus
ctgtctcaaagaagga

SEQ ID NO: 399428 - DNA, 16 bp, M. musculus
ctgtctcaaagacaaa

SEQ ID NO: 399429 - DNA, 16 bp, M. musculus
ctgtctcaaataacca

SEQ ID NO: 399430 - DNA, 16 bp, M. musculus
ctgtctcaaatttaaa

SEQ ID NO: 399431 - DNA, 16 bp, M. musculus
ctgtctcaacaaacag

SEQ ID NO: 399432 - DNA, 16 bp, M. musculus
ctgtctcaagaaacaa

SEQ ID NO: 399433 - DNA, 16 bp, M. musculus
ctgtctcaagaaataa

SEQ ID NO: 399434 - DNA, 16 bp, M. musculus
ctgtctcaagaacaaa

SEQ ID NO: 399435 - DNA, 16 bp, M. musculus
ctgtctcaagacaaac

SEQ ID NO: 399436 - DNA, 16 bp, M. musculus
ctgtctcaagagaata

SEQ ID NO: 399437 - DNA, 16 bp, M. musculus
ctgtctcaagcaaaaa

SEQ ID NO: 399438 - DNA, 16 bp, M. musculus
ctgtctcagaaaacca

SEQ ID NO: 399439 - DNA, 16 bp, M. musculus
ctgtctcagaaacaag

SEQ ID NO: 399440 - DNA, 16 bp, M. musculus
ctgtctcagcctccca

SEQ ID NO: 399441 - DNA, 16 bp, M. musculus
ctgtctcagcctcccc

SEQ ID NO: 399442 - DNA, 16 bp, M. musculus
ctgtctcagcctcctg

SEQ ID NO: 399443 - DNA, 16 bp, M. musculus
ctgtctcagcctctcc

SEQ ID NO: 399444 - DNA, 16 bp, M. musculus
ctgtctcagctgctgg

SEQ ID NO: 399445 - DNA, 16 bp, M. musculus
ctgtctcagggaaaaa

SEQ ID NO: 399446 - DNA, 16 bp, M. musculus
ctgtctcagggtttct

SEQ ID NO: 399447 - DNA, 16 bp, M. musculus
ctgtctcagtcactgt

SEQ ID NO: 399448 - DNA, 16 bp, M. musculus
ctgtctcataaaacaa

SEQ ID NO: 399449 - DNA, 16 bp, M. musculus
ctgtctccaaaacaca

SEQ ID NO: 399450 - DNA, 16 bp, M. musculus
ctgtctccaaaagaaa

SEQ ID NO: 399451 - DNA, 16 bp, M. musculus
ctgtctccaacaacaa

SEQ ID NO: 399452 - DNA, 16 bp, M. musculus
ctgtctccaagatgat

SEQ ID NO: 399453 - DNA, 16 bp, M. musculus
ctgtctccacagtgct

SEQ ID NO: 399454 - DNA, 16 bp, M. musculus
ctgtctccacctcccc

SEQ ID NO: 399455 - DNA, 16 bp, M. musculus
ctgtctccacctctga

SEQ ID NO: 399456 - DNA, 16 bp, M. musculus
ctgtctccaccttcca

SEQ ID NO: 399457 - DNA, 16 bp, M. musculus
ctgtctccactttcca

SEQ ID NO: 399458 - DNA, 16 bp, M. musculus
ctgtctccatggaaac

SEQ ID NO: 399459 - DNA, 16 bp, M. musculus
ctgtctccattcctct

SEQ ID NO: 399460 - DNA, 16 bp, M. musculus
ctgtctccatttcccc

SEQ ID NO: 399461 - DNA, 16 bp, M. musculus
ctgtctcccaagggct

SEQ ID NO: 399462 - DNA, 16 bp, M. musculus
ctgtctccccagctcc

SEQ ID NO: 399463 - DNA, 16 bp, M. musculus
ctgtctccccagggct

SEQ ID NO: 399464 - DNA, 16 bp, M. musculus
ctgtctccccagtgct

SEQ ID NO: 399465 - DNA, 16 bp, M. musculus
ctgtctccctagtgct

SEQ ID NO: 399466 - DNA, 16 bp, M. musculus
ctgtctccctatctct

SEQ ID NO: 399467 - DNA, 16 bp, M. musculus
ctgtctccctgcctct

SEQ ID NO: 399468 - DNA, 16 bp, M. musculus
ctgtctccctgtctct

SEQ ID NO: 399469 - DNA, 16 bp, M. musculus
ctgtctcctcagcccc

SEQ ID NO: 399470 - DNA, 16 bp, M. musculus
ctgtctcctcttccac

SEQ ID NO: 399471 - DNA, 16 bp, M. musculus
ctgtctcctcttctgt

SEQ ID NO: 399472 - DNA, 16 bp, M. musculus
ctgtctcctgaaaggc

SEQ ID NO: 399473 - DNA, 16 bp, M. musculus
ctgtctcctgagagct

SEQ ID NO: 399474 - DNA, 16 bp, M. musculus
ctgtctcctgagggct

SEQ ID NO: 399475 - DNA, 16 bp, M. musculus
ctgtctcctgcagagc

SEQ ID NO: 399476 - DNA, 16 bp, M. musculus
ctgtctcctgcaggag

SEQ ID NO: 399477 - DNA, 16 bp, M. musculus
ctgtctcctgtctcct

SEQ ID NO: 399478 - DNA, 16 bp, M. musculus
ctgtctcctgtgccaa

SEQ ID NO: 399479 - DNA, 16 bp, M. musculus
ctgtctccttgtctct

SEQ ID NO: 399480 - DNA, 18 bp, M. musculus
ctgtctcgaaaacaaaaa

SEQ ID NO: 399481 - DNA, 16 bp, M. musculus
ctgtctcgctgtctct

SEQ ID NO: 399482 - DNA, 16 bp, M. musculus
ctgtctctaccttcct

SEQ ID NO: 399483 - DNA, 16 bp, M. musculus
ctgtctctaccttctg

SEQ ID NO: 399484 - DNA, 16 bp, M. musculus
ctgtctctacttccta

SEQ ID NO: 399485 - DNA, 16 bp, M. musculus
ctgtctctatctcctg

SEQ ID NO: 399486 - DNA, 16 bp, M. musculus
ctgtctctcacacaca

SEQ ID NO: 399487 - DNA, 16 bp, M. musculus
ctgtctctcatctctc

SEQ ID NO: 399488 - DNA, 16 bp, M. musculus
ctgtctctccactgga

SEQ ID NO: 399489 - DNA, 16 bp, M. musculus
ctgtctctccatctgt

SEQ ID NO: 399490 - DNA, 16 bp, M. musculus
ctgtctctccccacac

SEQ ID NO: 399491 - DNA, 16 bp, M. musculus
ctgtctctcctgtctt

SEQ ID NO: 399492 - DNA, 16 bp, M. musculus
ctgtctctctatgtct

SEQ ID NO: 399493 - DNA, 16 bp, M. musculus
ctgtctctctccatcc

SEQ ID NO: 399494 - DNA, 16 bp, M. musculus
ctgtctctctctgcct

SEQ ID NO: 399495 - DNA, 16 bp, M. musculus
ctgtctctctgccttt

SEQ ID NO: 399496 - DNA, 16 bp, M. musculus
ctgtctctctgtatct

SEQ ID NO: 399497 - DNA, 16 bp, M. musculus
ctgtctctctgtcccc

SEQ ID NO: 399498 - DNA, 16 bp, M. musculus
ctgtctctctgtttcc

SEQ ID NO: 399499 - DNA, 16 bp, M. musculus
ctgtctctgaccagca

SEQ ID NO: 399500 - DNA, 16 bp, M. musculus
ctgtctctgactcttt

SEQ ID NO: 399501 - DNA, 16 bp, M. musculus
ctgtctctgactgtct

SEQ ID NO: 399502 - DNA, 16 bp, M. musculus
ctgtctctgagtgctg

SEQ ID NO: 399503 - DNA, 16 bp, M. musculus
ctgtctctgcctcatg

SEQ ID NO: 399504 - DNA, 18 bp, M. musculus
ctgtctctgcctcccaca

SEQ ID NO: 399505 - DNA, 16 bp, M. musculus
ctgtctctgctcctga

SEQ ID NO: 399506 - DNA, 16 bp, M. musculus
ctgtctctgctctgaa

SEQ ID NO: 399507 - DNA, 16 bp, M. musculus
ctgtctctgctgtctg

SEQ ID NO: 399508 - DNA, 16 bp, M. musculus
ctgtctctgcttccca

SEQ ID NO: 399509 - DNA, 16 bp, M. musculus
ctgtctctgcttcctg

SEQ ID NO: 399510 - DNA, 16 bp, M. musculus
ctgtctctggagtgct

SEQ ID NO: 399511 - DNA, 16 bp, M. musculus
ctgtctctgtaaaact

SEQ ID NO: 399512 - DNA, 16 bp, M. musculus
ctgtctctgtaccaac

SEQ ID NO: 399513 - DNA, 16 bp, M. musculus
ctgtctctgtctccta

SEQ ID NO: 399514 - DNA, 16 bp, M. musculus
ctgtctctgtctcctg

SEQ ID NO: 399515 - DNA, 16 bp, M. musculus
ctgtctctgtctctgc

SEQ ID NO: 399516 - DNA, 16 bp, M. musculus
ctgtctctgtgccttt

SEQ ID NO: 399517 - DNA, 16 bp, M. musculus
ctgtctctgtgtccct

SEQ ID NO: 399518 - DNA, 16 bp, M. musculus
ctgtctctgtgtcctc

SEQ ID NO: 399519 - DNA, 16 bp, M. musculus
ctgtctctgtgtcctg

SEQ ID NO: 399520 - DNA, 16 bp, M. musculus
ctgtctctgtgtctcc

SEQ ID NO: 399521 - DNA, 16 bp, M. musculus
ctgtctctgtgtctgt

SEQ ID NO: 399522 - DNA, 16 bp, M. musculus
ctgtctctgtgttcct

SEQ ID NO: 399523 - DNA, 16 bp, M. musculus
ctgtctctgtttctca

SEQ ID NO: 399524 - DNA, 16 bp, M. musculus
ctgtctctgtttctgt

SEQ ID NO: 399525 - DNA, 16 bp, M. musculus
ctgtctcttccacaaa

SEQ ID NO: 399526 - DNA, 16 bp, M. musculus
ctgtctcttggtctct

SEQ ID NO: 399527 - DNA, 16 bp, M. musculus
ctgtctctttctgtgt

SEQ ID NO: 399528 - DNA, 16 bp, M. musculus
ctgtctctttgtatct

SEQ ID NO: 399529 - DNA, 16 bp, M. musculus
ctgtctcttttgatta

SEQ ID NO: 399530 - DNA, 16 bp, M. musculus
ctgtctgaaaaacaaa

SEQ ID NO: 399531 - DNA, 16 bp, M. musculus
ctgtctgaagatgaag

SEQ ID NO: 399532 - DNA, 16 bp, M. musculus
ctgtctgacctggaac

SEQ ID NO: 399533 - DNA, 16 bp, M. musculus
ctgtctgaggctaagg

SEQ ID NO: 399534 - DNA, 16 bp, M. musculus
ctgtctgcctctcttt

SEQ ID NO: 399535 - DNA, 16 bp, M. musculus
ctgtctgcctgcctgc

SEQ ID NO: 399536 - DNA, 16 bp, M. musculus
ctgtctgcctgcctgt

SEQ ID NO: 399537 - DNA, 16 bp, M. musculus
ctgtctgcctgtctct

SEQ ID NO: 399538 - DNA, 16 bp, M. musculus
ctgtctgccttcctgc

SEQ ID NO: 399539 - DNA, 16 bp, M. musculus
ctgtctgctgtctgct

SEQ ID NO: 399540 - DNA, 16 bp, M. musculus
ctgtctgcttctgtct

SEQ ID NO: 399541 - DNA, 16 bp, M. musculus
ctgtctgcttgcctgt

SEQ ID NO: 399542 - DNA, 16 bp, M. musculus
ctgtctgcttttccag

SEQ ID NO: 399543 - DNA, 16 bp, M. musculus
ctgtctggaaaaccaa

SEQ ID NO: 399544 - DNA, 16 bp, M. musculus
ctgtctggacaggtcc

SEQ ID NO: 399545 - DNA, 16 bp, M. musculus
ctgtctggccagtgag

SEQ ID NO: 399546 - DNA, 16 bp, M. musculus
ctgtctggtggtccag

SEQ ID NO: 399547 - DNA, 16 bp, M. musculus
ctgtctgtaaaatggg

SEQ ID NO: 399548 - DNA, 16 bp, M. musculus
ctgtctgtaacaccag

SEQ ID NO: 399549 - DNA, 16 bp, M. musculus
ctgtctgtaactccaa

SEQ ID NO: 399550 - DNA, 16 bp, M. musculus
ctgtctgtatgtctgt

SEQ ID NO: 399551 - DNA, 16 bp, M. musculus
ctgtctgtccatccac

SEQ ID NO: 399552 - DNA, 16 bp, M. musculus
ctgtctgtcctgtctg

SEQ ID NO: 399553 - DNA, 16 bp, M. musculus
ctgtctgtccttcctg

SEQ ID NO: 399554 - DNA, 16 bp, M. musculus
ctgtctgtctatatct

SEQ ID NO: 399555 - DNA, 16 bp, M. musculus
ctgtctgtctatgtct

SEQ ID NO: 399556 - DNA, 16 bp, M. musculus
ctgtctgtctcccaag

SEQ ID NO: 399557 - DNA, 16 bp, M. musculus
ctgtctgtctctctat

SEQ ID NO: 399558 - DNA, 16 bp, M. musculus
ctgtctgtctctctcc

SEQ ID NO: 399559 - DNA, 16 bp, M. musculus
ctgtctgtctctgcat

SEQ ID NO: 399560 - DNA, 16 bp, M. musculus
ctgtctgtctctgctc

SEQ ID NO: 399561 - DNA, 16 bp, M. musculus
ctgtctgtctctgctg

SEQ ID NO: 399562 - DNA, 17 bp, M. musculus
ctgtctgtctctgtgtg

SEQ ID NO: 399563 - DNA, 16 bp, M. musculus
ctgtctgtctggctgt

SEQ ID NO: 399564 - DNA, 16 bp, M. musculus
ctgtctgtctgtatgc

SEQ ID NO: 399565 - DNA, 16 bp, M. musculus
ctgtctgtctgtcact

SEQ ID NO: 399566 - DNA, 16 bp, M. musculus
ctgtctgtctgtccac

SEQ ID NO: 399567 - DNA, 16 bp, M. musculus
ctgtctgtctgtcctt

SEQ ID NO: 399568 - DNA, 16 bp, M. musculus
ctgtctgtctgtcggt

SEQ ID NO: 399569 - DNA, 16 bp, M. musculus
ctgtctgtctgtctag

SEQ ID NO: 399570 - DNA, 16 bp, M. musculus
ctgtctgtctgtctat

SEQ ID NO: 399571 - DNA, 16 bp, M. musculus
ctgtctgtctgtctgt

SEQ ID NO: 399572 - DNA, 16 bp, M. musculus
ctgtctgtctgtcttc

SEQ ID NO: 399573 - DNA, 16 bp, M. musculus
ctgtctgtctgtgggt

SEQ ID NO: 399574 - DNA, 16 bp, M. musculus
ctgtctgtctgtgtct

SEQ ID NO: 399575 - DNA, 16 bp, M. musculus
ctgtctgtctgtgtga

SEQ ID NO: 399576 - DNA, 16 bp, M. musculus
ctgtctgtctgttttg

SEQ ID NO: 399577 - DNA, 16 bp, M. musculus
ctgtctgtgactccag

SEQ ID NO: 399578 - DNA, 16 bp, M. musculus
ctgtctgtgcctcctg

SEQ ID NO: 399579 - DNA, 16 bp, M. musculus
ctgtctgtgcctgtgt

SEQ ID NO: 399580 - DNA, 16 bp, M. musculus
ctgtctgtgtctcttt

SEQ ID NO: 399581 - DNA, 16 bp, M. musculus
ctgtctgtgtctgtct

SEQ ID NO: 399582 - DNA, 16 bp, M. musculus
ctgtctgtgtgcagcc

SEQ ID NO: 399583 - DNA, 16 bp, M. musculus
ctgtctgtttgcctgc

SEQ ID NO: 399584 - DNA, 16 bp, M. musculus
ctgtcttaaaaaaaaa

SEQ ID NO: 399585 - DNA, 16 bp, M. musculus
ctgtcttaaaaaacaa

SEQ ID NO: 399586 - DNA, 16 bp, M. musculus
ctgtcttaaaaacaaa

SEQ ID NO: 399587 - DNA, 16 bp, M. musculus
ctgtcttagaaaaaca

SEQ ID NO: 399588 - DNA, 16 bp, M. musculus
ctgtcttcacacacac

SEQ ID NO: 399589 - DNA, 16 bp, M. musculus
ctgtcttcagactcac

SEQ ID NO: 399590 - DNA, 16 bp, M. musculus
ctgtcttcagagacac

SEQ ID NO: 399591 - DNA, 16 bp, M. musculus
ctgtcttcagagactc

SEQ ID NO: 399592 - DNA, 16 bp, M. musculus
ctgtcttcagatgctc

SEQ ID NO: 399593 - DNA, 16 bp, M. musculus
ctgtcttcagtcacac

SEQ ID NO: 399594 - DNA, 16 bp, M. musculus
ctgtcttccatttctt

SEQ ID NO: 399595 - DNA, 16 bp, M. musculus
ctgtcttcctcagtca

SEQ ID NO: 399596 - DNA, 16 bp, M. musculus
ctgtcttcctctgcct

SEQ ID NO: 399597 - DNA, 16 bp, M. musculus
ctgtcttcctgccctg

SEQ ID NO: 399598 - DNA, 16 bp, M. musculus
ctgtcttcctgctgcc

SEQ ID NO: 399599 - DNA, 16 bp, M. musculus
ctgtcttcctgctgga

SEQ ID NO: 399600 - DNA, 16 bp, M. musculus
ctgtcttcctgctggg

SEQ ID NO: 399601 - DNA, 16 bp, M. musculus
ctgtcttctggtttct

SEQ ID NO: 399602 - DNA, 16 bp, M. musculus
ctgtcttgaaaaaacc

SEQ ID NO: 399603 - DNA, 16 bp, M. musculus
ctgtcttgaaaaaaga

SEQ ID NO: 399604 - DNA, 16 bp, M. musculus
ctgtcttgaaaacaca

SEQ ID NO: 399605 - DNA, 16 bp, M. musculus
ctgtcttgaaataaaa

SEQ ID NO: 399606 - DNA, 16 bp, M. musculus
ctgtcttgaaattctt

SEQ ID NO: 399607 - DNA, 16 bp, M. musculus
ctgtcttgaagaaaca

SEQ ID NO: 399608 - DNA, 16 bp, M. musculus
ctgtcttgctttggag

SEQ ID NO: 399609 - DNA, 16 bp, M. musculus
ctgtcttggaattcat

SEQ ID NO: 399610 - DNA, 16 bp, M. musculus
ctgtcttggactcact

SEQ ID NO: 399611 - DNA, 16 bp, M. musculus
ctgtcttggcagagct

SEQ ID NO: 399612 - DNA, 16 bp, M. musculus
ctgtcttggcattccc

SEQ ID NO: 399613 - DNA, 16 bp, M. musculus
ctgtctttaaaaacaa

SEQ ID NO: 399614 - DNA, 16 bp, M. musculus
ctgtctttagacacac

SEQ ID NO: 399615 - DNA, 16 bp, M. musculus
ctgtctttccccacac

SEQ ID NO: 399616 - DNA, 16 bp, M. musculus
ctgtctttctactgga

SEQ ID NO: 399617 - DNA, 16 bp, M. musculus
ctgtctttctccctga

SEQ ID NO: 399618 - DNA, 16 bp, M. musculus
ctgtctttgcctccca

SEQ ID NO: 399619 - DNA, 16 bp, M. musculus
ctgtctttgtcactga

SEQ ID NO: 399620 - DNA, 16 bp, M. musculus
ctgtctttgtcctgga

SEQ ID NO: 399621 - DNA, 16 bp, M. musculus
ctgtctttgtctctgt

SEQ ID NO: 399622 - DNA, 16 bp, M. musculus
ctgtctttgttctcag

SEQ ID NO: 399623 - DNA, 16 bp, M. musculus
ctgtctttgttctgtg

SEQ ID NO: 399624 - DNA, 16 bp, M. musculus
ctgtctttgtttttaa

SEQ ID NO: 399625 - DNA, 16 bp, M. musculus
ctgtcttttgtccact

SEQ ID NO: 399626 - DNA, 16 bp, M. musculus
ctgtgaaaaggaacag

SEQ ID NO: 399627 - DNA, 16 bp, M. musculus
ctgtgaaaccctggct

SEQ ID NO: 399628 - DNA, 16 bp, M. musculus
ctgtgaaactcttctg

SEQ ID NO: 399629 - DNA, 16 bp, M. musculus
ctgtgaaagagcaaga

SEQ ID NO: 399630 - DNA, 16 bp, M. musculus
ctgtgaaagggtcatt

SEQ ID NO: 399631 - DNA, 16 bp, M. musculus
ctgtgaaagggttgtt

SEQ ID NO: 399632 - DNA, 16 bp, M. musculus
ctgtgaaatggggaca

SEQ ID NO: 399633 - DNA, 16 bp, M. musculus
ctgtgaacagacaccg

SEQ ID NO: 399634 - DNA, 16 bp, M. musculus
ctgtgaaccaggctgg

SEQ ID NO: 399635 - DNA, 16 bp, M. musculus
ctgtgaactacaataa

SEQ ID NO: 399636 - DNA, 16 bp, M. musculus
ctgtgaactgaactgc

SEQ ID NO: 399637 - DNA, 16 bp, M. musculus
ctgtgaagaaatacca

SEQ ID NO: 399638 - DNA, 16 bp, M. musculus
ctgtgaagagacaaca

SEQ ID NO: 399639 - DNA, 16 bp, M. musculus
ctgtgaagctctggct

SEQ ID NO: 399640 - DNA, 16 bp, M. musculus
ctgtgaaggctagatg

SEQ ID NO: 399641 - DNA, 16 bp, M. musculus
ctgtgaaggctctgtg

SEQ ID NO: 399642 - DNA, 16 bp, M. musculus
ctgtgaaggcttggtg

SEQ ID NO: 399643 - DNA, 16 bp, M. musculus
ctgtgaaggtgaagcc

SEQ ID NO: 399644 - DNA, 16 bp, M. musculus
ctgtgaatattttgtt

SEQ ID NO: 399645 - DNA, 16 bp, M. musculus
ctgtgaatctgaagcc

SEQ ID NO: 399646 - DNA, 16 bp, M. musculus
ctgtgaatgaaataaa

SEQ ID NO: 399647 - DNA, 16 bp, M. musculus
ctgtgaatgggaagtc

SEQ ID NO: 399648 - DNA, 16 bp, M. musculus
ctgtgaatgtctgtgt

SEQ ID NO: 399649 - DNA, 16 bp, M. musculus
ctgtgaattgaactca

SEQ ID NO: 399650 - DNA, 16 bp, M. musculus
ctgtgacaaaataccc

SEQ ID NO: 399651 - DNA, 16 bp, M. musculus
ctgtgacaaagcacca

SEQ ID NO: 399652 - DNA, 16 bp, M. musculus
ctgtgacagcacactc

SEQ ID NO: 399653 - DNA, 16 bp, M. musculus
ctgtgacagcacaggc

SEQ ID NO: 399654 - DNA, 16 bp, M. musculus
ctgtgacaggtgatgg

SEQ ID NO: 399655 - DNA, 16 bp, M. musculus
ctgtgaccaaaatacc

SEQ ID NO: 399656 - DNA, 16 bp, M. musculus
ctgtgaccaacctgag

SEQ ID NO: 399657 - DNA, 16 bp, M. musculus
ctgtgaccatccactt

SEQ ID NO: 399658 - DNA, 16 bp, M. musculus
ctgtgaccccagctcc

SEQ ID NO: 399659 - DNA, 16 bp, M. musculus
ctgtgaccctgtgacc

SEQ ID NO: 399660 - DNA, 16 bp, M. musculus
ctgtgaccctttaaga

SEQ ID NO: 399661 - DNA, 16 bp, M. musculus
ctgtgaccctttaata

SEQ ID NO: 399662 - DNA, 16 bp, M. musculus
ctgtgacctcagcact

SEQ ID NO: 399663 - DNA, 16 bp, M. musculus
ctgtgactcagtttcc

SEQ ID NO: 399664 - DNA, 16 bp, M. musculus
ctgtgactccagagaa

SEQ ID NO: 399665 - DNA, 18 bp, M. musculus
ctgtgactctagagaaca

SEQ ID NO: 399666 - DNA, 16 bp, M. musculus
ctgtgactgtcctgga

SEQ ID NO: 399667 - DNA, 16 bp, M. musculus
ctgtgactgtcttcag

SEQ ID NO: 399668 - DNA, 16 bp, M. musculus
ctgtgactgtgccctg

SEQ ID NO: 399669 - DNA, 16 bp, M. musculus
ctgtgagaagccacag

SEQ ID NO: 399670 - DNA, 16 bp, M. musculus
ctgtgagagatttttt

SEQ ID NO: 399671 - DNA, 16 bp, M. musculus
ctgtgagagcagcaag

SEQ ID NO: 399672 - DNA, 16 bp, M. musculus
ctgtgagaggaagcct

SEQ ID NO: 399673 - DNA, 16 bp, M. musculus
ctgtgagatcaagaat

SEQ ID NO: 399674 - DNA, 16 bp, M. musculus
ctgtgagatcaaggcc

SEQ ID NO: 399675 - DNA, 16 bp, M. musculus
ctgtgagattgtatct

SEQ ID NO: 399676 - DNA, 16 bp, M. musculus
ctgtgagcacaggtaa

SEQ ID NO: 399677 - DNA, 16 bp, M. musculus
ctgtgagcagacacca

SEQ ID NO: 399678 - DNA, 16 bp, M. musculus
ctgtgagcatctgcct

SEQ ID NO: 399679 - DNA, 16 bp, M. musculus
ctgtgagccaccatgt

SEQ ID NO: 399680 - DNA, 16 bp, M. musculus
ctgtgagccacctgac

SEQ ID NO: 399681 - DNA, 16 bp, M. musculus
ctgtgagccacctgat

SEQ ID NO: 399682 - DNA, 16 bp, M. musculus
ctgtgagccagaacaa

SEQ ID NO: 399683 - DNA, 16 bp, M. musculus
ctgtgagcccatgtga

SEQ ID NO: 399684 - DNA, 16 bp, M. musculus
ctgtgagcctgtgtgt

SEQ ID NO: 399685 - DNA, 16 bp, M. musculus
ctgtgagctaaataaa

SEQ ID NO: 399686 - DNA, 16 bp, M. musculus
ctgtgagctccaggct

SEQ ID NO: 399687 - DNA, 16 bp, M. musculus
ctgtgagctgccgtgt

SEQ ID NO: 399688 - DNA, 16 bp, M. musculus
ctgtgagcttccactt

SEQ ID NO: 399689 - DNA, 16 bp, M. musculus
ctgtgagcttcctcct

SEQ ID NO: 399690 - DNA, 16 bp, M. musculus
ctgtgagcttgaggcc

SEQ ID NO: 399691 - DNA, 16 bp, M. musculus
ctgtgagggtgttcct

SEQ ID NO: 399692 - DNA, 16 bp, M. musculus
ctgtgaggtttttaaa

SEQ ID NO: 399693 - DNA, 16 bp, M. musculus
ctgtgagtatctgcat

SEQ ID NO: 399694 - DNA, 16 bp, M. musculus
ctgtgagtcctgggga

SEQ ID NO: 399695 - DNA, 16 bp, M. musculus
ctgtgagtctgtgatc

SEQ ID NO: 399696 - DNA, 16 bp, M. musculus
ctgtgagtctgtgtgt

SEQ ID NO: 399697 - DNA, 16 bp, M. musculus
ctgtgagtggaacaca

SEQ ID NO: 399698 - DNA, 16 bp, M. musculus
ctgtgagtgtctgcat

SEQ ID NO: 399699 - DNA, 16 bp, M. musculus
ctgtgagtgtgctctg

SEQ ID NO: 399700 - DNA, 16 bp, M. musculus
ctgtgagtgtgggctt

SEQ ID NO: 399701 - DNA, 16 bp, M. musculus
ctgtgagttcaagatc

SEQ ID NO: 399702 - DNA, 16 bp, M. musculus
ctgtgagttcaaggct

SEQ ID NO: 399703 - DNA, 16 bp, M. musculus
ctgtgagttcatatgt

SEQ ID NO: 399704 - DNA, 16 bp, M. musculus
ctgtgagttcatggcc

SEQ ID NO: 399705 - DNA, 16 bp, M. musculus
ctgtgagttggaggcc

SEQ ID NO: 399706 - DNA, 16 bp, M. musculus
ctgtgagttttcctct

SEQ ID NO: 399707 - DNA, 16 bp, M. musculus
ctgtgataaaaacacc

SEQ ID NO: 399708 - DNA, 16 bp, M. musculus
ctgtgataaaactcca

SEQ ID NO: 399709 - DNA, 16 bp, M. musculus
ctgtgataaaatattc

SEQ ID NO: 399710 - DNA, 16 bp, M. musculus
ctgtgataaacaccac

SEQ ID NO: 399711 - DNA, 16 bp, M. musculus
ctgtgataactccaga

SEQ ID NO: 399712 - DNA, 16 bp, M. musculus
ctgtgatcccaacact

SEQ ID NO: 399713 - DNA, 16 bp, M. musculus
ctgtgatcccagcact

SEQ ID NO: 399714 - DNA, 16 bp, M. musculus
ctgtgatcccagcagt

SEQ ID NO: 399715 - DNA, 16 bp, M. musculus
ctgtgatcccagtgct

SEQ ID NO: 399716 - DNA, 16 bp, M. musculus
ctgtgatcctggctgt

SEQ ID NO: 399717 - DNA, 16 bp, M. musculus
ctgtgatcctggttat

SEQ ID NO: 399718 - DNA, 16 bp, M. musculus
ctgtgatcctgtggtc

SEQ ID NO: 399719 - DNA, 16 bp, M. musculus
ctgtgatgactaagga

SEQ ID NO: 399720 - DNA, 16 bp, M. musculus
ctgtgatgccagcact

SEQ ID NO: 399721 - DNA, 16 bp, M. musculus
ctgtgatggggcagcc

SEQ ID NO: 399722 - DNA, 16 bp, M. musculus
ctgtgatggtttgtat

SEQ ID NO: 399723 - DNA, 16 bp, M. musculus
ctgtgattaaaggcat

SEQ ID NO: 399724 - DNA, 16 bp, M. musculus
ctgtgattaaaggtgt

SEQ ID NO: 399725 - DNA, 16 bp, M. musculus
ctgtgattcttttagc

SEQ ID NO: 399726 - DNA, 16 bp, M. musculus
ctgtgcaaccctggct

SEQ ID NO: 399727 - DNA, 16 bp, M. musculus
ctgtgcaagcatgaag

SEQ ID NO: 399728 - DNA, 16 bp, M. musculus
ctgtgcacacagggaa

SEQ ID NO: 399729 - DNA, 16 bp, M. musculus
ctgtgcacagacacca

SEQ ID NO: 399730 - DNA, 16 bp, M. musculus
ctgtgcacaggatgct

SEQ ID NO: 399731 - DNA, 16 bp, M. musculus
ctgtgcacagtgggag

SEQ ID NO: 399732 - DNA, 16 bp, M. musculus
ctgtgcacatgagtgc

SEQ ID NO: 399733 - DNA, 16 bp, M. musculus
ctgtgcaccttcactg

SEQ ID NO: 399734 - DNA, 16 bp, M. musculus
ctgtgcacgtgtgtgt

SEQ ID NO: 399735 - DNA, 16 bp, M. musculus
ctgtgcactacatgca

SEQ ID NO: 399736 - DNA, 16 bp, M. musculus
ctgtgcactggtcttg

SEQ ID NO: 399737 - DNA, 16 bp, M. musculus
ctgtgcagcctgccct

SEQ ID NO: 399738 - DNA, 16 bp, M. musculus
ctgtgcaggagagcac

SEQ ID NO: 399739 - DNA, 16 bp, M. musculus
ctgtgcaggatacact

SEQ ID NO: 399740 - DNA, 16 bp, M. musculus
ctgtgcaggcatgagg

SEQ ID NO: 399741 - DNA, 16 bp, M. musculus
ctgtgcatgccaggca

SEQ ID NO: 399742 - DNA, 16 bp, M. musculus
ctgtgcatgctagaca

SEQ ID NO: 399743 - DNA, 16 bp, M. musculus
ctgtgcatgctaggca

SEQ ID NO: 399744 - DNA, 16 bp, M. musculus
ctgtgcatgtgtctgt

SEQ ID NO: 399745 - DNA, 16 bp, M. musculus
ctgtgccaattcttcc

SEQ ID NO: 399746 - DNA, 16 bp, M. musculus
ctgtgccaccactgcc

SEQ ID NO: 399747 - DNA, 16 bp, M. musculus
ctgtgccagtgcctgg

SEQ ID NO: 399748 - DNA, 16 bp, M. musculus
ctgtgccatctcccca

SEQ ID NO: 399749 - DNA, 16 bp, M. musculus
ctgtgccatcttctcc

SEQ ID NO: 399750 - DNA, 16 bp, M. musculus
ctgtgcccacagcaat

SEQ ID NO: 399751 - DNA, 16 bp, M. musculus
ctgtgcccatgtcttc

SEQ ID NO: 399752 - DNA, 17 bp, M. musculus
ctgtgccctccagtgag

SEQ ID NO: 399753 - DNA, 16 bp, M. musculus
ctgtgccctggacagc

SEQ ID NO: 399754 - DNA, 16 bp, M. musculus
ctgtgcccttccccca

SEQ ID NO: 399755 - DNA, 16 bp, M. musculus
ctgtgcctcagtttac

SEQ ID NO: 399756 - DNA, 16 bp, M. musculus
ctgtgcctcagtttcc

SEQ ID NO: 399757 - DNA, 16 bp, M. musculus
ctgtgcctcggtttcc

SEQ ID NO: 399758 - DNA, 16 bp, M. musculus
ctgtgcctctgtctct

SEQ ID NO: 399759 - DNA, 16 bp, M. musculus
ctgtgcctctgtgcct

SEQ ID NO: 399760 - DNA, 16 bp, M. musculus
ctgtgcctgagcccag

SEQ ID NO: 399761 - DNA, 16 bp, M. musculus
ctgtgcctgcctgcct

SEQ ID NO: 399762 - DNA, 16 bp, M. musculus
ctgtgcctgtgcctct

SEQ ID NO: 399763 - DNA, 16 bp, M. musculus
ctgtgcctgtgtctgt

SEQ ID NO: 399764 - DNA, 16 bp, M. musculus
ctgtgcctgtgtgtct

SEQ ID NO: 399765 - DNA, 16 bp, M. musculus
ctgtgccttctccaga

SEQ ID NO: 399766 - DNA, 16 bp, M. musculus
ctgtgcgtgtgtgtgt

SEQ ID NO: 399767 - DNA, 16 bp, M. musculus
ctgtgctcccagcctg

SEQ ID NO: 399768 - DNA, 16 bp, M. musculus
ctgtgctctgacctgg

SEQ ID NO: 399769 - DNA, 16 bp, M. musculus
ctgtgctctgcagctg

SEQ ID NO: 399770 - DNA, 16 bp, M. musculus
ctgtgctctgctctgc

SEQ ID NO: 399771 - DNA, 16 bp, M. musculus
ctgtgctgactagttt

SEQ ID NO: 399772 - DNA, 16 bp, M. musculus
ctgtgctgagctgtgc

SEQ ID NO: 399773 - DNA, 16 bp, M. musculus
ctgtgctgcccaggta

SEQ ID NO: 399774 - DNA, 16 bp, M. musculus
ctgtgctgctcactgt

SEQ ID NO: 399775 - DNA, 16 bp, M. musculus
ctgtgctgctctctct

SEQ ID NO: 399776 - DNA, 16 bp, M. musculus
ctgtgctggctgctct

SEQ ID NO: 399777 - DNA, 16 bp, M. musculus
ctgtgctggggatgga

SEQ ID NO: 399778 - DNA, 16 bp, M. musculus
ctgtgctgtcagtgtg

SEQ ID NO: 399779 - DNA, 16 bp, M. musculus
ctgtgctgtccaggca

SEQ ID NO: 399780 - DNA, 17 bp, M. musculus
ctgtgctgtcctgtgct

SEQ ID NO: 399781 - DNA, 16 bp, M. musculus
ctgtgctgtgagacaa

SEQ ID NO: 399782 - DNA, 16 bp, M. musculus
ctgtgctgtgctggtg

SEQ ID NO: 399783 - DNA, 16 bp, M. musculus
ctgtgcttccacctgt

SEQ ID NO: 399784 - DNA, 16 bp, M. musculus
ctgtgcttcctgcttc

SEQ ID NO: 399785 - DNA, 16 bp, M. musculus
ctgtgcttgcagacag

SEQ ID NO: 399786 - DNA, 16 bp, M. musculus
ctgtgcttgctgcttc

SEQ ID NO: 399787 - DNA, 16 bp, M. musculus
ctgtgcttggaggatg

SEQ ID NO: 399788 - DNA, 16 bp, M. musculus
ctgtggaacagcccca

SEQ ID NO: 399789 - DNA, 16 bp, M. musculus
ctgtggaagactccat

SEQ ID NO: 399790 - DNA, 16 bp, M. musculus
ctgtggaagagcagtc

SEQ ID NO: 399791 - DNA, 16 bp, M. musculus
ctgtggaagctcaatg

SEQ ID NO: 399792 - DNA, 16 bp, M. musculus
ctgtggacaagcagga

SEQ ID NO: 399793 - DNA, 16 bp, M. musculus
ctgtggacaatcagcc

SEQ ID NO: 399794 - DNA, 16 bp, M. musculus
ctgtggacatgtctgt

SEQ ID NO: 399795 - DNA, 16 bp, M. musculus
ctgtggacttggactg

SEQ ID NO: 399796 - DNA, 16 bp, M. musculus
ctgtggagaccagagg

SEQ ID NO: 399797 - DNA, 16 bp, M. musculus
ctgtggagagcagagg

SEQ ID NO: 399798 - DNA, 16 bp, M. musculus
ctgtggagatcaagaa

SEQ ID NO: 399799 - DNA, 16 bp, M. musculus
ctgtggagatggctca

SEQ ID NO: 399800 - DNA, 16 bp, M. musculus
ctgtggagatgggaca

SEQ ID NO: 399801 - DNA, 16 bp, M. musculus
ctgtggagatttgatg

SEQ ID NO: 399802 - DNA, 16 bp, M. musculus
ctgtggagcagagact

SEQ ID NO: 399803 - DNA, 16 bp, M. musculus
ctgtggagcattttct

SEQ ID NO: 399804 - DNA, 16 bp, M. musculus
ctgtggagccacacac

SEQ ID NO: 399805 - DNA, 16 bp, M. musculus
ctgtggagctgtgaca

SEQ ID NO: 399806 - DNA, 16 bp, M. musculus
ctgtggaggaggagga

SEQ ID NO: 399807 - DNA, 16 bp, M. musculus
ctgtggaggcggggct

SEQ ID NO: 399808 - DNA, 16 bp, M. musculus
ctgtggaggctgaggc

SEQ ID NO: 399809 - DNA, 16 bp, M. musculus
ctgtggagggatgctg

SEQ ID NO: 399810 - DNA, 16 bp, M. musculus
ctgtggaggggacccc

SEQ ID NO: 399811 - DNA, 16 bp, M. musculus
ctgtggaggggcttgg

SEQ ID NO: 399812 - DNA, 16 bp, M. musculus
ctgtggaggggtgctg

SEQ ID NO: 399813 - DNA, 16 bp, M. musculus
ctgtggatcagaatgt

SEQ ID NO: 399814 - DNA, 16 bp, M. musculus
ctgtggatgccaagaa

SEQ ID NO: 399815 - DNA, 16 bp, M. musculus
ctgtggatgctgggga

SEQ ID NO: 399816 - DNA, 16 bp, M. musculus
ctgtggatggcaccat

SEQ ID NO: 399817 - DNA, 16 bp, M. musculus
ctgtggatggggctgg

SEQ ID NO: 399818 - DNA, 16 bp, M. musculus
ctgtggatgtagctca

SEQ ID NO: 399819 - DNA, 17 bp, M. musculus
ctgtggattatagggca

SEQ ID NO: 399820 - DNA, 16 bp, M. musculus
ctgtggcaaagccctc

SEQ ID NO: 399821 - DNA, 16 bp, M. musculus
ctgtggcaaatttctt

SEQ ID NO: 399822 - DNA, 16 bp, M. musculus
ctgtggcacaggatca

SEQ ID NO: 399823 - DNA, 16 bp, M. musculus
ctgtggcacatgcatg

SEQ ID NO: 399824 - DNA, 16 bp, M. musculus
ctgtggcacatgcctc

SEQ ID NO: 399825 - DNA, 16 bp, M. musculus
ctgtggcagctgctgc

SEQ ID NO: 399826 - DNA, 16 bp, M. musculus
ctgtggcagctgtggc

SEQ ID NO: 399827 - DNA, 16 bp, M. musculus
ctgtggcatggagagt

SEQ ID NO: 399828 - DNA, 16 bp, M. musculus
ctgtggcatggcaacc

SEQ ID NO: 399829 - DNA, 16 bp, M. musculus
ctgtggcatgtgcaca

SEQ ID NO: 399830 - DNA, 16 bp, M. musculus
ctgtggcatgtgtgtg

SEQ ID NO: 399831 - DNA, 16 bp, M. musculus
ctgtggcattgagcct

SEQ ID NO: 399832 - DNA, 16 bp, M. musculus
ctgtggccatgtctgt

SEQ ID NO: 399833 - DNA, 16 bp, M. musculus
ctgtggcccatgttac

SEQ ID NO: 399834 - DNA, 16 bp, M. musculus
ctgtggccctggctgt

SEQ ID NO: 399835 - DNA, 16 bp, M. musculus
ctgtggccctttaata

SEQ ID NO: 399836 - DNA, 16 bp, M. musculus
ctgtggcgagaggctg

SEQ ID NO: 399837 - DNA, 16 bp, M. musculus
ctgtggctaccacata

SEQ ID NO: 399838 - DNA, 16 bp, M. musculus
ctgtggctatttaaaa

SEQ ID NO: 399839 - DNA, 16 bp, M. musculus
ctgtggctccagcctg

SEQ ID NO: 399840 - DNA, 16 bp, M. musculus
ctgtggctcccacctg

SEQ ID NO: 399841 - DNA, 16 bp, M. musculus
ctgtggctctctctct

SEQ ID NO: 399842 - DNA, 16 bp, M. musculus
ctgtggctctgcctgt

SEQ ID NO: 399843 - DNA, 16 bp, M. musculus
ctgtggctctggctgt

SEQ ID NO: 399844 - DNA, 16 bp, M. musculus
ctgtggctctgtggct

SEQ ID NO: 399845 - DNA, 16 bp, M. musculus
ctgtggctgcctgcac

SEQ ID NO: 399846 - DNA, 16 bp, M. musculus
ctgtggctgctgctgt

SEQ ID NO: 399847 - DNA, 16 bp, M. musculus
ctgtggctgtccttgg

SEQ ID NO: 399848 - DNA, 16 bp, M. musculus
ctgtggctgtggctga

SEQ ID NO: 399849 - DNA, 16 bp, M. musculus
ctgtggctgtggctgg

SEQ ID NO: 399850 - DNA, 16 bp, M. musculus
ctgtggctgtgggctt

SEQ ID NO: 399851 - DNA, 16 bp, M. musculus
ctgtggcttcattttc

SEQ ID NO: 399852 - DNA, 16 bp, M. musculus
ctgtggcttctgcctg

SEQ ID NO: 399853 - DNA, 16 bp, M. musculus
ctgtgggaagccactg

SEQ ID NO: 399854 - DNA, 16 bp, M. musculus
ctgtgggacacactgg

SEQ ID NO: 399855 - DNA, 16 bp, M. musculus
ctgtgggactctgcat

SEQ ID NO: 399856 - DNA, 16 bp, M. musculus
ctgtgggaggcaccat

SEQ ID NO: 399857 - DNA, 16 bp, M. musculus
ctgtgggatacctgcc

SEQ ID NO: 399858 - DNA, 16 bp, M. musculus
ctgtgggattcttaaa

SEQ ID NO: 399859 - DNA, 16 bp, M. musculus
ctgtgggcaagcctgt

SEQ ID NO: 399860 - DNA, 16 bp, M. musculus
ctgtgggcaaggaacc

SEQ ID NO: 399861 - DNA, 16 bp, M. musculus
ctgtgggcaccagaca

SEQ ID NO: 399862 - DNA, 16 bp, M. musculus
ctgtgggcacctgtac

SEQ ID NO: 399863 - DNA, 16 bp, M. musculus
ctgtgggcacttgcac

SEQ ID NO: 399864 - DNA, 16 bp, M. musculus
ctgtgggcagcaggca

SEQ ID NO: 399865 - DNA, 16 bp, M. musculus
ctgtgggcataaggct

SEQ ID NO: 399866 - DNA, 16 bp, M. musculus
ctgtgggcatgtgtgt

SEQ ID NO: 399867 - DNA, 16 bp, M. musculus
ctgtgggcattttctt

SEQ ID NO: 399868 - DNA, 16 bp, M. musculus
ctgtgggctcctgtaa

SEQ ID NO: 399869 - DNA, 16 bp, M. musculus
ctgtgggctctgggga

SEQ ID NO: 399870 - DNA, 16 bp, M. musculus
ctgtgggctggagaga

SEQ ID NO: 399871 - DNA, 16 bp, M. musculus
ctgtgggctggggaga

SEQ ID NO: 399872 - DNA, 16 bp, M. musculus
ctgtgggcttcctctt

SEQ ID NO: 399873 - DNA, 16 bp, M. musculus
ctgtggggaaaaaaaa

SEQ ID NO: 399874 - DNA, 16 bp, M. musculus
ctgtggggaggagcat

SEQ ID NO: 399875 - DNA, 16 bp, M. musculus
ctgtggggatgtccca

SEQ ID NO: 399876 - DNA, 16 bp, M. musculus
ctgtggggcattttct

SEQ ID NO: 399877 - DNA, 16 bp, M. musculus
ctgtgggggaaaaaaa

SEQ ID NO: 399878 - DNA, 16 bp, M. musculus
ctgtgggggccattcc

SEQ ID NO: 399879 - DNA, 16 bp, M. musculus
ctgtgggggctggaga

SEQ ID NO: 399880 - DNA, 16 bp, M. musculus
ctgtgggggtggcctt

SEQ ID NO: 399881 - DNA, 18 bp, M. musculus
ctgtgggtcagagtgtgg

SEQ ID NO: 399882 - DNA, 16 bp, M. musculus
ctgtgggtcccaggga

SEQ ID NO: 399883 - DNA, 16 bp, M. musculus
ctgtgggtcgtgaccc

SEQ ID NO: 399884 - DNA, 16 bp, M. musculus
ctgtgggtctcaaccc

SEQ ID NO: 399885 - DNA, 16 bp, M. musculus
ctgtgggtgatgccat

SEQ ID NO: 399886 - DNA, 16 bp, M. musculus
ctgtgggtgctgggaa

SEQ ID NO: 399887 - DNA, 16 bp, M. musculus
ctgtgggtgtagggga

SEQ ID NO: 399888 - DNA, 16 bp, M. musculus
ctgtgggttccaggga

SEQ ID NO: 399889 - DNA, 16 bp, M. musculus
ctgtgggttgcaatcc

SEQ ID NO: 399890 - DNA, 16 bp, M. musculus
ctgtgggtttgaggcc

SEQ ID NO: 399891 - DNA, 16 bp, M. musculus
ctgtggtaaagccttt

SEQ ID NO: 399892 - DNA, 16 bp, M. musculus
ctgtggtccacactct

SEQ ID NO: 399893 - DNA, 16 bp, M. musculus
ctgtggtccagcctca

SEQ ID NO: 399894 - DNA, 16 bp, M. musculus
ctgtggtccataccac

SEQ ID NO: 399895 - DNA, 16 bp, M. musculus
ctgtggtcctcctgcc

SEQ ID NO: 399896 - DNA, 16 bp, M. musculus
ctgtggtgatcttata

SEQ ID NO: 399897 - DNA, 16 bp, M. musculus
ctgtggtgcaccctct

SEQ ID NO: 399898 - DNA, 16 bp, M. musculus
ctgtggtggctgctgc

SEQ ID NO: 399899 - DNA, 16 bp, M. musculus
ctgtggtgggtttcct

SEQ ID NO: 399900 - DNA, 16 bp, M. musculus
ctgtggtggtttgtat

SEQ ID NO: 399901 - DNA, 16 bp, M. musculus
ctgtggtgtccccaga

SEQ ID NO: 399902 - DNA, 16 bp, M. musculus
ctgtggtgtggagagt

SEQ ID NO: 399903 - DNA, 16 bp, M. musculus
ctgtggttatgtctcc

SEQ ID NO: 399904 - DNA, 16 bp, M. musculus
ctgtggttattttatt

SEQ ID NO: 399905 - DNA, 16 bp, M. musculus
ctgtggttctctgcat

SEQ ID NO: 399906 - DNA, 16 bp, M. musculus
ctgtggttgaattggg

SEQ ID NO: 399907 - DNA, 16 bp, M. musculus
ctgtggttgttcttgg

SEQ ID NO: 399908 - DNA, 16 bp, M. musculus
ctgtggttgttgcttc

SEQ ID NO: 399909 - DNA, 16 bp, M. musculus
ctgtggtttctgcttt

SEQ ID NO: 399910 - DNA, 16 bp, M. musculus
ctgtgtaaagattatc

SEQ ID NO: 399911 - DNA, 16 bp, M. musculus
ctgtgtaaccctggct

SEQ ID NO: 399912 - DNA, 16 bp, M. musculus
ctgtgtaatcttggct

SEQ ID NO: 399913 - DNA, 16 bp, M. musculus
ctgtgtacaccaggct

SEQ ID NO: 399914 - DNA, 16 bp, M. musculus
ctgtgtacactgagga

SEQ ID NO: 399915 - DNA, 16 bp, M. musculus
ctgtgtacactgtcag

SEQ ID NO: 399916 - DNA, 16 bp, M. musculus
ctgtgtaccacttgca

SEQ ID NO: 399917 - DNA, 16 bp, M. musculus
ctgtgtaccatgtgca

SEQ ID NO: 399918 - DNA, 16 bp, M. musculus
ctgtgtacctctggct

SEQ ID NO: 399919 - DNA, 16 bp, M. musculus
ctgtgtacctgtgtgt

SEQ ID NO: 399920 - DNA, 16 bp, M. musculus
ctgtgtagaccaggcc

SEQ ID NO: 399921 - DNA, 16 bp, M. musculus
ctgtgtagacctggct

SEQ ID NO: 399922 - DNA, 16 bp, M. musculus
ctgtgtagagcaggct

SEQ ID NO: 399923 - DNA, 16 bp, M. musculus
ctgtgtagccaaggat

SEQ ID NO: 399924 - DNA, 16 bp, M. musculus
ctgtgtagcccgggct

SEQ ID NO: 399925 - DNA, 17 bp, M. musculus
ctgtgtagccctggctc

SEQ ID NO: 399926 - DNA, 16 bp, M. musculus
ctgtgtagccctgtgt

SEQ ID NO: 399927 - DNA, 17 bp, M. musculus
ctgtgtagccttggcta

SEQ ID NO: 399928 - DNA, 16 bp, M. musculus
ctgtgtagctcaggct

SEQ ID NO: 399929 - DNA, 16 bp, M. musculus
ctgtgtagtcaaggat

SEQ ID NO: 399930 - DNA, 16 bp, M. musculus
ctgtgtagtgctggct

SEQ ID NO: 399931 - DNA, 16 bp, M. musculus
ctgtgtagttttggct

SEQ ID NO: 399932 - DNA, 16 bp, M. musculus
ctgtgtatatatgtgt

SEQ ID NO: 399933 - DNA, 16 bp, M. musculus
ctgtgtatctctgact

SEQ ID NO: 399934 - DNA, 16 bp, M. musculus
ctgtgtatctctggct

SEQ ID NO: 399935 - DNA, 16 bp, M. musculus
ctgtgtatctctgtgt

SEQ ID NO: 399936 - DNA, 16 bp, M. musculus
ctgtgtatctgtatgt

SEQ ID NO: 399937 - DNA, 16 bp, M. musculus
ctgtgtatgtatgtgt

SEQ ID NO: 399938 - DNA, 16 bp, M. musculus
ctgtgtatgtctgttt

SEQ ID NO: 399939 - DNA, 16 bp, M. musculus
ctgtgtatgtgtgact

SEQ ID NO: 399940 - DNA, 16 bp, M. musculus
ctgtgtatgtgtggtg

SEQ ID NO: 399941 - DNA, 16 bp, M. musculus
ctgtgtatgtgtgtgt

SEQ ID NO: 399942 - DNA, 16 bp, M. musculus
ctgtgtattgctttta

SEQ ID NO: 399943 - DNA, 16 bp, M. musculus
ctgtgtcaagtttaca

SEQ ID NO: 399944 - DNA, 16 bp, M. musculus
ctgtgtcagtgtctgt

SEQ ID NO: 399945 - DNA, 16 bp, M. musculus
ctgtgtcatggagacc

SEQ ID NO: 399946 - DNA, 16 bp, M. musculus
ctgtgtccacttcagc

SEQ ID NO: 399947 - DNA, 16 bp, M. musculus
ctgtgtccctgtctct

SEQ ID NO: 399948 - DNA, 16 bp, M. musculus
ctgtgtcctctgcaaa

SEQ ID NO: 399949 - DNA, 16 bp, M. musculus
ctgtgtcctgaggctt

SEQ ID NO: 399950 - DNA, 16 bp, M. musculus
ctgtgtcctgagggtt

SEQ ID NO: 399951 - DNA, 16 bp, M. musculus
ctgtgtcctgatgact

SEQ ID NO: 399952 - DNA, 16 bp, M. musculus
ctgtgtcctgccagct

SEQ ID NO: 399953 - DNA, 16 bp, M. musculus
ctgtgtcctgtgtcct

SEQ ID NO: 399954 - DNA, 16 bp, M. musculus
ctgtgtcctttgcctt

SEQ ID NO: 399955 - DNA, 16 bp, M. musculus
ctgtgtctagcttgtt

SEQ ID NO: 399956 - DNA, 16 bp, M. musculus
ctgtgtctcagctctg

SEQ ID NO: 399957 - DNA, 16 bp, M. musculus
ctgtgtctcagtttcc

SEQ ID NO: 399958 - DNA, 16 bp, M. musculus
ctgtgtctccagctcc

SEQ ID NO: 399959 - DNA, 16 bp, M. musculus
ctgtgtctctctctct

SEQ ID NO: 399960 - DNA, 16 bp, M. musculus
ctgtgtctctctgtct

SEQ ID NO: 399961 - DNA, 16 bp, M. musculus
ctgtgtctctggttgc

SEQ ID NO: 399962 - DNA, 16 bp, M. musculus
ctgtgtctctgtcact

SEQ ID NO: 399963 - DNA, 16 bp, M. musculus
ctgtgtctctgtctca

SEQ ID NO: 399964 - DNA, 16 bp, M. musculus
ctgtgtctctgtctcc

SEQ ID NO: 399965 - DNA, 16 bp, M. musculus
ctgtgtctctgtctct

SEQ ID NO: 399966 - DNA, 16 bp, M. musculus
ctgtgtctctgtgtct

SEQ ID NO: 399967 - DNA, 16 bp, M. musculus
ctgtgtctcttccttc

SEQ ID NO: 399968 - DNA, 16 bp, M. musculus
ctgtgtctgaagagag

SEQ ID NO: 399969 - DNA, 16 bp, M. musculus
ctgtgtctgcctcctg

SEQ ID NO: 399970 - DNA, 16 bp, M. musculus
ctgtgtctgcctgtgt

SEQ ID NO: 399971 - DNA, 16 bp, M. musculus
ctgtgtctgcgtggaa

SEQ ID NO: 399972 - DNA, 16 bp, M. musculus
ctgtgtctgcttcaag

SEQ ID NO: 399973 - DNA, 16 bp, M. musculus
ctgtgtctgcttcagc

SEQ ID NO: 399974 - DNA, 16 bp, M. musculus
ctgtgtctgtctctcc

SEQ ID NO: 399975 - DNA, 16 bp, M. musculus
ctgtgtctgtctcttt

SEQ ID NO: 399976 - DNA, 16 bp, M. musculus
ctgtgtctgtgtgtct

SEQ ID NO: 399977 - DNA, 16 bp, M. musculus
ctgtgtctgtgtgtgt

SEQ ID NO: 399978 - DNA, 16 bp, M. musculus
ctgtgtctgttgctgg

SEQ ID NO: 399979 - DNA, 16 bp, M. musculus
ctgtgtctttgaagtt

SEQ ID NO: 399980 - DNA, 16 bp, M. musculus
ctgtgtcttttctcat

SEQ ID NO: 399981 - DNA, 16 bp, M. musculus
ctgtgtgaatgtatgt

SEQ ID NO: 399982 - DNA, 16 bp, M. musculus
ctgtgtgacacactgt

SEQ ID NO: 399983 - DNA, 17 bp, M. musculus
ctgtgtgacagtaactg

SEQ ID NO: 399984 - DNA, 16 bp, M. musculus
ctgtgtgaccctgggc

SEQ ID NO: 399985 - DNA, 16 bp, M. musculus
ctgtgtgactctgtgt

SEQ ID NO: 399986 - DNA, 16 bp, M. musculus
ctgtgtgcaggtgtgt

SEQ ID NO: 399987 - DNA, 16 bp, M. musculus
ctgtgtgcatctgtgt

SEQ ID NO: 399988 - DNA, 16 bp, M. musculus
ctgtgtgcatgcctgg

SEQ ID NO: 399989 - DNA, 16 bp, M. musculus
ctgtgtgccaggcaca

SEQ ID NO: 399990 - DNA, 16 bp, M. musculus
ctgtgtgccaggctct

SEQ ID NO: 399991 - DNA, 16 bp, M. musculus
ctgtgtgccctgtgtg

SEQ ID NO: 399992 - DNA, 16 bp, M. musculus
ctgtgtgctgagaggg

SEQ ID NO: 399993 - DNA, 16 bp, M. musculus
ctgtgtgctgagatta

SEQ ID NO: 399994 - DNA, 16 bp, M. musculus
ctgtgtgctggctagt

SEQ ID NO: 399995 - DNA, 16 bp, M. musculus
ctgtgtgctttccctt

SEQ ID NO: 399996 - DNA, 16 bp, M. musculus
ctgtgtggagcctctc

SEQ ID NO: 399997 - DNA, 16 bp, M. musculus
ctgtgtggcagggctg

SEQ ID NO: 399998 - DNA, 16 bp, M. musculus
ctgtgtggccctggct

SEQ ID NO: 399999 - DNA, 16 bp, M. musculus
ctgtgtggctgctggg

SEQ ID NO: 400000 - DNA, 16 bp, M. musculus
ctgtgtggctgtgtgg

SEQ ID NO: 400001 - DNA, 16 bp, M. musculus
ctgtgtggctgtgtgt

SEQ ID NO: 400002 - DNA, 16 bp, M. musculus
ctgtgtgggcccttgg

SEQ ID NO: 400003 - DNA, 16 bp, M. musculus
ctgtgtggtccaggct

SEQ ID NO: 400004 - DNA, 16 bp, M. musculus
ctgtgtggtgctggga

SEQ ID NO: 400005 - DNA, 16 bp, M. musculus
ctgtgtggtgtatgac

SEQ ID NO: 400006 - DNA, 16 bp, M. musculus
ctgtgtgtaagaatag

SEQ ID NO: 400007 - DNA, 16 bp, M. musculus
ctgtgtgtacatgtgt

SEQ ID NO: 400008 - DNA, 16 bp, M. musculus
ctgtgtgtatctctgt

SEQ ID NO: 400009 - DNA, 16 bp, M. musculus
ctgtgtgtatgtatgt

SEQ ID NO: 400010 - DNA, 16 bp, M. musculus
ctgtgtgtatgtctgt

SEQ ID NO: 400011 - DNA, 16 bp, M. musculus
ctgtgtgtatgtgtat

SEQ ID NO: 400012 - DNA, 16 bp, M. musculus
ctgtgtgtatgtgtgt

SEQ ID NO: 400013 - DNA, 16 bp, M. musculus
ctgtgtgtatttgtgt

SEQ ID NO: 400014 - DNA, 16 bp, M. musculus
ctgtgtgtcacactgg

SEQ ID NO: 400015 - DNA, 16 bp, M. musculus
ctgtgtgtccatgtgt

SEQ ID NO: 400016 - DNA, 16 bp, M. musculus
ctgtgtgtcctttcct

SEQ ID NO: 400017 - DNA, 16 bp, M. musculus
ctgtgtgtctgtccct

SEQ ID NO: 400018 - DNA, 16 bp, M. musculus
ctgtgtgtctgtgtga

SEQ ID NO: 400019 - DNA, 17 bp, M. musculus
ctgtgtgtctgtgtgta

SEQ ID NO: 400020 - DNA, 16 bp, M. musculus
ctgtgtgtgcagtgtg

SEQ ID NO: 400021 - DNA, 16 bp, M. musculus
ctgtgtgtgcgtgtgt

SEQ ID NO: 400022 - DNA, 16 bp, M. musculus
ctgtgtgtgctctttg

SEQ ID NO: 400023 - DNA, 16 bp, M. musculus
ctgtgtgtggatgtgt

SEQ ID NO: 400024 - DNA, 16 bp, M. musculus
ctgtgtgtgtacatat

SEQ ID NO: 400025 - DNA, 16 bp, M. musculus
ctgtgtgtgtatgtgt

SEQ ID NO: 400026 - DNA, 16 bp, M. musculus
ctgtgtgtgtctctag

SEQ ID NO: 400027 - DNA, 16 bp, M. musculus
ctgtgtgtgtctctgt

SEQ ID NO: 400028 - DNA, 16 bp, M. musculus
ctgtgtgtgtctgtct

SEQ ID NO: 400029 - DNA, 16 bp, M. musculus
ctgtgtgtgtctgtgt

SEQ ID NO: 400030 - DNA, 16 bp, M. musculus
ctgtgtgtgtctttca

SEQ ID NO: 400031 - DNA, 16 bp, M. musculus
ctgtgtgtgtgagtgt

SEQ ID NO: 400032 - DNA, 16 bp, M. musculus
ctgtgtgtgtgcacat

SEQ ID NO: 400033 - DNA, 16 bp, M. musculus
ctgtgtgtgtgcctgg

SEQ ID NO: 400034 - DNA, 16 bp, M. musculus
ctgtgtgtgtgcctgt

SEQ ID NO: 400035 - DNA, 16 bp, M. musculus
ctgtgtgtgtgtctgt

SEQ ID NO: 400036 - DNA, 16 bp, M. musculus
ctgtgtgtgtgtgtct

SEQ ID NO: 400037 - DNA, 16 bp, M. musculus
ctgtgtgtgtttatgt

SEQ ID NO: 400038 - DNA, 16 bp, M. musculus
ctgtgtgtttatctgt

SEQ ID NO: 400039 - DNA, 16 bp, M. musculus
ctgtgtgtttccacag

SEQ ID NO: 400040 - DNA, 16 bp, M. musculus
ctgtgtgtttgtgtat

SEQ ID NO: 400041 - DNA, 16 bp, M. musculus
ctgtgttcaaatccca

SEQ ID NO: 400042 - DNA, 16 bp, M. musculus
ctgtgttcagtgagag

SEQ ID NO: 400043 - DNA, 16 bp, M. musculus
ctgtgttcattcagaa

SEQ ID NO: 400044 - DNA, 16 bp, M. musculus
ctgtgttccagagatg

SEQ ID NO: 400045 - DNA, 16 bp, M. musculus
ctgtgttccatcccca

SEQ ID NO: 400046 - DNA, 40 bp, M. musculus
ctgtgttctaagtggtaaacaaataatctgcgcatgtgcc

SEQ ID NO: 400047 - DNA, 16 bp, M. musculus
ctgtgttctcctggtg

SEQ ID NO: 400048 - DNA, 16 bp, M. musculus
ctgtgttctctgatgg

SEQ ID NO: 400049 - DNA, 16 bp, M. musculus
ctgtgttctgatgatg

SEQ ID NO: 400050 - DNA, 16 bp, M. musculus
ctgtgttcttaaccac

SEQ ID NO: 400051 - DNA, 16 bp, M. musculus
ctgtgttgtgttttca

SEQ ID NO: 400052 - DNA, 16 bp, M. musculus
ctgtgtttaaaaaaaa

SEQ ID NO: 400053 - DNA, 16 bp, M. musculus
ctgtgtttagtcagag

SEQ ID NO: 400054 - DNA, 16 bp, M. musculus
ctgtgtttcctaggcc

SEQ ID NO: 400055 - DNA, 16 bp, M. musculus
ctgtgtttcctgatgg

SEQ ID NO: 400056 - DNA, 16 bp, M. musculus
ctgtgtttctctgtct

SEQ ID NO: 400057 - DNA, 16 bp, M. musculus
ctgtgtttggtgactg

SEQ ID NO: 400058 - DNA, 16 bp, M. musculus
ctgtgtttgtatctgt

SEQ ID NO: 400059 - DNA, 16 bp, M. musculus
ctgtgtttgtatgtct

SEQ ID NO: 400060 - DNA, 16 bp, M. musculus
ctgtgtttgtgtctct

SEQ ID NO: 400061 - DNA, 16 bp, M. musculus
ctgtgttttaaaacaa

SEQ ID NO: 400062 - DNA, 16 bp, M. musculus
ctgtgtttttaaaaga

SEQ ID NO: 400063 - DNA, 16 bp, M. musculus
ctgttaaggcatggaa

SEQ ID NO: 400064 - DNA, 16 bp, M. musculus
ctgttaatcaccaagg

SEQ ID NO: 400065 - DNA, 16 bp, M. musculus
ctgttaccaatgtaac

SEQ ID NO: 400066 - DNA, 16 bp, M. musculus
ctgttactatgataaa

SEQ ID NO: 400067 - DNA, 16 bp, M. musculus
ctgttactctgtctct

SEQ ID NO: 400068 - DNA, 16 bp, M. musculus
ctgttactctttctcc

SEQ ID NO: 400069 - DNA, 16 bp, M. musculus
ctgttacttgaatttt

SEQ ID NO: 400070 - DNA, 16 bp, M. musculus
ctgttagcagctctcc

SEQ ID NO: 400071 - DNA, 16 bp, M. musculus
ctgttaggaggtatgg

SEQ ID NO: 400072 - DNA, 16 bp, M. musculus
ctgttagtaaaattct

SEQ ID NO: 400073 - DNA, 16 bp, M. musculus
ctgttataaaggaaaa

SEQ ID NO: 400074 - DNA, 16 bp, M. musculus
ctgttatatctgtctc

SEQ ID NO: 400075 - DNA, 16 bp, M. musculus
ctgttatatgtctcca

SEQ ID NO: 400076 - DNA, 16 bp, M. musculus
ctgttatctcagcact

SEQ ID NO: 400077 - DNA, 16 bp, M. musculus
ctgttattgtggctgt

SEQ ID NO: 400078 - DNA, 16 bp, M. musculus
ctgttatttgtggaaa

SEQ ID NO: 400079 - DNA, 16 bp, M. musculus
ctgttatttttgctgt

SEQ ID NO: 400080 - DNA, 16 bp, M. musculus
ctgttcaagaaatttt

SEQ ID NO: 400081 - DNA, 16 bp, M. musculus
ctgttcagaaaaattt

SEQ ID NO: 400082 - DNA, 16 bp, M. musculus
ctgttcatggcagtaa

SEQ ID NO: 400083 - DNA, 16 bp, M. musculus
ctgttcattattgaag

SEQ ID NO: 400084 - DNA, 16 bp, M. musculus
ctgttcatttccatca

SEQ ID NO: 400085 - DNA, 16 bp, M. musculus
ctgttccagaggctgt

SEQ ID NO: 400086 - DNA, 16 bp, M. musculus
ctgttccagctccctg

SEQ ID NO: 400087 - DNA, 16 bp, M. musculus
ctgttccagttgttgg

SEQ ID NO: 400088 - DNA, 16 bp, M. musculus
ctgttccagttgtttg

SEQ ID NO: 400089 - DNA, 16 bp, M. musculus
ctgttcccagcaggcc

SEQ ID NO: 400090 - DNA, 16 bp, M. musculus
ctgttcccattgttct

SEQ ID NO: 400091 - DNA, 16 bp, M. musculus
ctgttcccatttccct

SEQ ID NO: 400092 - DNA, 16 bp, M. musculus
ctgttcccctaactga

SEQ ID NO: 400093 - DNA, 16 bp, M. musculus
ctgttccctgcctgtc

SEQ ID NO: 400094 - DNA, 16 bp, M. musculus
ctgttcctccagagaa

SEQ ID NO: 400095 - DNA, 16 bp, M. musculus
ctgttcctctctgtct

SEQ ID NO: 400096 - DNA, 16 bp, M. musculus
ctgttcctgccccagg

SEQ ID NO: 400097 - DNA, 16 bp, M. musculus
ctgttcctgcctcctg

SEQ ID NO: 400098 - DNA, 16 bp, M. musculus
ctgttcctgctggccc

SEQ ID NO: 400099 - DNA, 16 bp, M. musculus
ctgttcctggagctgg

SEQ ID NO: 400100 - DNA, 16 bp, M. musculus
ctgttcctttgggcct

SEQ ID NO: 400101 - DNA, 16 bp, M. musculus
ctgttctacaaagcaa

SEQ ID NO: 400102 - DNA, 16 bp, M. musculus
ctgttctatggaactg

SEQ ID NO: 400103 - DNA, 16 bp, M. musculus
ctgttctattcaggat

SEQ ID NO: 400104 - DNA, 16 bp, M. musculus
ctgttctcaacattat

SEQ ID NO: 400105 - DNA, 16 bp, M. musculus
ctgttctcagcttctc

SEQ ID NO: 400106 - DNA, 16 bp, M. musculus
ctgttctcctgacact

SEQ ID NO: 400107 - DNA, 16 bp, M. musculus
ctgttctgctctgctc

SEQ ID NO: 400108 - DNA, 16 bp, M. musculus
ctgttctggctcaaaa

SEQ ID NO: 400109 - DNA, 16 bp, M. musculus
ctgttcttccaaagga

SEQ ID NO: 400110 - DNA, 16 bp, M. musculus
ctgttcttccagaaga

SEQ ID NO: 400111 - DNA, 16 bp, M. musculus
ctgttcttccagaagt

SEQ ID NO: 400112 - DNA, 16 bp, M. musculus
ctgttcttccagagga

SEQ ID NO: 400113 - DNA, 16 bp, M. musculus
ctgttcttccatagga

SEQ ID NO: 400114 - DNA, 16 bp, M. musculus
ctgttcttgcagagga

SEQ ID NO: 400115 - DNA, 16 bp, M. musculus
ctgttcttgttgctgt

SEQ ID NO: 400116 - DNA, 16 bp, M. musculus
ctgttcttttcttcca

SEQ ID NO: 400117 - DNA, 16 bp, M. musculus
ctgttcttttgaaggt

SEQ ID NO: 400118 - DNA, 16 bp, M. musculus
ctgttgaaggacatct

SEQ ID NO: 400119 - DNA, 16 bp, M. musculus
ctgttgagaagaatct

SEQ ID NO: 400120 - DNA, 16 bp, M. musculus
ctgttgagaattttct

SEQ ID NO: 400121 - DNA, 16 bp, M. musculus
ctgttgatgtgataaa

SEQ ID NO: 400122 - DNA, 16 bp, M. musculus
ctgttgattttctcaa

SEQ ID NO: 400123 - DNA, 16 bp, M. musculus
ctgttgcaaagagaaa

SEQ ID NO: 400124 - DNA, 16 bp, M. musculus
ctgttgcagaggctca

SEQ ID NO: 400125 - DNA, 16 bp, M. musculus
ctgttgccaaggacca

SEQ ID NO: 400126 - DNA, 16 bp, M. musculus
ctgttgccaggtaact

SEQ ID NO: 400127 - DNA, 16 bp, M. musculus
ctgttgccatggcaac

SEQ ID NO: 400128 - DNA, 16 bp, M. musculus
ctgttgccctctctgg

SEQ ID NO: 400129 - DNA, 16 bp, M. musculus
ctgttgccctcttctg

SEQ ID NO: 400130 - DNA, 16 bp, M. musculus
ctgttgcggtaaatct

SEQ ID NO: 400131 - DNA, 16 bp, M. musculus
ctgttgctaagtaact

SEQ ID NO: 400132 - DNA, 16 bp, M. musculus
ctgttgctatgacaac

SEQ ID NO: 400133 - DNA, 16 bp, M. musculus
ctgttgctatgataaa

SEQ ID NO: 400134 - DNA, 16 bp, M. musculus
ctgttgctatggcaac

SEQ ID NO: 400135 - DNA, 16 bp, M. musculus
ctgttgctctgtcttc

SEQ ID NO: 400136 - DNA, 16 bp, M. musculus
ctgttgctcttcctgt

SEQ ID NO: 400137 - DNA, 16 bp, M. musculus
ctgttgctgaggaagt

SEQ ID NO: 400138 - DNA, 16 bp, M. musculus
ctgttgctgaggctga

SEQ ID NO: 400139 - DNA, 16 bp, M. musculus
ctgttgctgctgctac

SEQ ID NO: 400140 - DNA, 16 bp, M. musculus
ctgttgctgctgctcc

SEQ ID NO: 400141 - DNA, 16 bp, M. musculus
ctgttgctgctgctgt

SEQ ID NO: 400142 - DNA, 16 bp, M. musculus
ctgttgctgctgttct

SEQ ID NO: 400143 - DNA, 16 bp, M. musculus
ctgttgctgggataaa

SEQ ID NO: 400144 - DNA, 24 bp, M. musculus
ctgttgctggttccgctttatctg

SEQ ID NO: 400145 - DNA, 16 bp, M. musculus
ctgttgctgtggtaaa

SEQ ID NO: 400146 - DNA, 16 bp, M. musculus
ctgttgctgtggtgaa

SEQ ID NO: 400147 - DNA, 16 bp, M. musculus
ctgttgctgttgcttt

SEQ ID NO: 400148 - DNA, 16 bp, M. musculus
ctgttgctgttgttgc

SEQ ID NO: 400149 - DNA, 16 bp, M. musculus
ctgttgcttttgcaga

SEQ ID NO: 400150 - DNA, 16 bp, M. musculus
ctgttggatcctggga

SEQ ID NO: 400151 - DNA, 16 bp, M. musculus
ctgttgggatagcatt

SEQ ID NO: 400152 - DNA, 31 bp, M. musculus
ctgttggggcatcttctggatatatgcccag

SEQ ID NO: 400153 - DNA, 16 bp, M. musculus
ctgttgggttctggga

SEQ ID NO: 400154 - DNA, 16 bp, M. musculus
ctgttggtgatgcctg

SEQ ID NO: 400155 - DNA, 16 bp, M. musculus
ctgttgtagtttccca

SEQ ID NO: 400156 - DNA, 16 bp, M. musculus
ctgttgtatatgtgtt

SEQ ID NO: 400157 - DNA, 16 bp, M. musculus
ctgttgtctgtatcat

SEQ ID NO: 400158 - DNA, 16 bp, M. musculus
ctgttgtctgtctgtc

SEQ ID NO: 400159 - DNA, 16 bp, M. musculus
ctgttgtctgtctgtg

SEQ ID NO: 400160 - DNA, 16 bp, M. musculus
ctgttgtgaattctca

SEQ ID NO: 400161 - DNA, 16 bp, M. musculus
ctgttgtgaattttct

SEQ ID NO: 400162 - DNA, 16 bp, M. musculus
ctgttgtgtccatgtt

SEQ ID NO: 400163 - DNA, 16 bp, M. musculus
ctgttgtgtctggcca

SEQ ID NO: 400164 - DNA, 16 bp, M. musculus
ctgttgttactaaatt

SEQ ID NO: 400165 - DNA, 16 bp, M. musculus
ctgttgttcttcctat

SEQ ID NO: 400166 - DNA, 16 bp, M. musculus
ctgttgttgtgataaa

SEQ ID NO: 400167 - DNA, 16 bp, M. musculus
ctgttgttgtgtctcc

SEQ ID NO: 400168 - DNA, 16 bp, M. musculus
ctgtttaaaagaactg

SEQ ID NO: 400169 - DNA, 16 bp, M. musculus
ctgtttagatatttta

SEQ ID NO: 400170 - DNA, 16 bp, M. musculus
ctgtttagctgtgttc

SEQ ID NO: 400171 - DNA, 16 bp, M. musculus
ctgtttagtgtctgtt

SEQ ID NO: 400172 - DNA, 16 bp, M. musculus
ctgtttatcagtgagt

SEQ ID NO: 400173 - DNA, 16 bp, M. musculus
ctgtttatcctttgag

SEQ ID NO: 400174 - DNA, 16 bp, M. musculus
ctgtttatgtggttaa

SEQ ID NO: 400175 - DNA, 16 bp, M. musculus
ctgtttattttaaaca

SEQ ID NO: 400176 - DNA, 16 bp, M. musculus
ctgtttcaaaacaaag

SEQ ID NO: 400177 - DNA, 16 bp, M. musculus
ctgtttcaaacaaaca

SEQ ID NO: 400178 - DNA, 16 bp, M. musculus
ctgtttcaacttagcc

SEQ ID NO: 400179 - DNA, 16 bp, M. musculus
ctgtttcagtcaactg

SEQ ID NO: 400180 - DNA, 16 bp, M. musculus
ctgtttccaagatctg

SEQ ID NO: 400181 - DNA, 16 bp, M. musculus
ctgtttccagcaccca

SEQ ID NO: 400182 - DNA, 16 bp, M. musculus
ctgtttccagctctgg

SEQ ID NO: 400183 - DNA, 16 bp, M. musculus
ctgtttccagcttctg

SEQ ID NO: 400184 - DNA, 16 bp, M. musculus
ctgtttcctgactgtg

SEQ ID NO: 400185 - DNA, 16 bp, M. musculus
ctgtttcctgagaggc

SEQ ID NO: 400186 - DNA, 16 bp, M. musculus
ctgtttcctgccatga

SEQ ID NO: 400187 - DNA, 16 bp, M. musculus
ctgtttcctgcctcag

SEQ ID NO: 400188 - DNA, 16 bp, M. musculus
ctgtttcctggccttg

SEQ ID NO: 400189 - DNA, 16 bp, M. musculus
ctgtttcctggttgaa

SEQ ID NO: 400190 - DNA, 16 bp, M. musculus
ctgtttcctgtccctg

SEQ ID NO: 400191 - DNA, 16 bp, M. musculus
ctgtttccttgctgtc

SEQ ID NO: 400192 - DNA, 16 bp, M. musculus
ctgtttctaattgtgg

SEQ ID NO: 400193 - DNA, 16 bp, M. musculus
ctgtttctatttgtgg

SEQ ID NO: 400194 - DNA, 16 bp, M. musculus
ctgtttctcctgctct

SEQ ID NO: 400195 - DNA, 16 bp, M. musculus
ctgtttctctctgtat

SEQ ID NO: 400196 - DNA, 16 bp, M. musculus
ctgtttctgactgtgg

SEQ ID NO: 400197 - DNA, 16 bp, M. musculus
ctgtttctgccttcca

SEQ ID NO: 400198 - DNA, 16 bp, M. musculus
ctgtttctgtaaaact

SEQ ID NO: 400199 - DNA, 16 bp, M. musculus
ctgtttctgtctccct

SEQ ID NO: 400200 - DNA, 16 bp, M. musculus
ctgtttctgttcctgt

SEQ ID NO: 400201 - DNA, 16 bp, M. musculus
ctgtttctttagggga

SEQ ID NO: 400202 - DNA, 16 bp, M. musculus
ctgtttgaaaggatta

SEQ ID NO: 400203 - DNA, 16 bp, M. musculus
ctgtttgaataccctt

SEQ ID NO: 400204 - DNA, 16 bp, M. musculus
ctgtttgaggagcctg

SEQ ID NO: 400205 - DNA, 16 bp, M. musculus
ctgtttgagttcttgt

SEQ ID NO: 400206 - DNA, 16 bp, M. musculus
ctgtttgcaaaataaa

SEQ ID NO: 400207 - DNA, 16 bp, M. musculus
ctgtttgcatattcat

SEQ ID NO: 400208 - DNA, 16 bp, M. musculus
ctgtttggaagacaga

SEQ ID NO: 400209 - DNA, 16 bp, M. musculus
ctgtttggcccctcct

SEQ ID NO: 400210 - DNA, 16 bp, M. musculus
ctgtttggctgtgggt

SEQ ID NO: 400211 - DNA, 16 bp, M. musculus
ctgtttggttgatatt

SEQ ID NO: 400212 - DNA, 16 bp, M. musculus
ctgtttgtatatgtgt

SEQ ID NO: 400213 - DNA, 16 bp, M. musculus
ctgtttgtcacttttc

SEQ ID NO: 400214 - DNA, 16 bp, M. musculus
ctgtttgtctgcctgt

SEQ ID NO: 400215 - DNA, 16 bp, M. musculus
ctgttttaaaaataaa

SEQ ID NO: 400216 - DNA, 16 bp, M. musculus
ctgttttcaaacacac

SEQ ID NO: 400217 - DNA, 16 bp, M. musculus
ctgttttcatttttag

SEQ ID NO: 400218 - DNA, 16 bp, M. musculus
ctgttttccacccaga

SEQ ID NO: 400219 - DNA, 16 bp, M. musculus
ctgttttccagagtgg

SEQ ID NO: 400220 - DNA, 16 bp, M. musculus
ctgttttctgcactgg

SEQ ID NO: 400221 - DNA, 16 bp, M. musculus
ctgttttctgttgcta

SEQ ID NO: 400222 - DNA, 16 bp, M. musculus
ctgttttctttttaaa

SEQ ID NO: 400223 - DNA, 16 bp, M. musculus
ctgttttgaaaacaaa

SEQ ID NO: 400224 - DNA, 16 bp, M. musculus
ctgttttgaagtttct

SEQ ID NO: 400225 - DNA, 18 bp, M. musculus
ctgttttgatttgcattt

SEQ ID NO: 400226 - DNA, 16 bp, M. musculus
ctgttttgggaggttg

SEQ ID NO: 400227 - DNA, 16 bp, M. musculus
ctgttttgtaaccaat

SEQ ID NO: 400228 - DNA, 16 bp, M. musculus
ctgttttgtcagatat

SEQ ID NO: 400229 - DNA, 16 bp, M. musculus
ctgtttttaaaaacaa

SEQ ID NO: 400230 - DNA, 16 bp, M. musculus
ctgtttttatatcatt

SEQ ID NO: 400231 - DNA, 16 bp, M. musculus
ctgtttttattgctat

SEQ ID NO: 400232 - DNA, 16 bp, M. musculus
ctgtttttcatttgta

SEQ ID NO: 400233 - DNA, 16 bp, M. musculus
ctgtttttctttcagt

SEQ ID NO: 400234 - DNA, 16 bp, M. musculus
ctgtttttgccaggca

SEQ ID NO: 400235 - DNA, 16 bp, M. musculus
ctgtttttggaaaagg

SEQ ID NO: 400236 - DNA, 16 bp, M. musculus
ctgttttttaaaagat

SEQ ID NO: 400237 - DNA, 16 bp, M. musculus
ctgtttttttgtggag

SEQ ID NO: 400238 - DNA, 16 bp, M. musculus
ctgtttttttttaaaa

SEQ ID NO: 400239 - DNA, 16 bp, M. musculus
cttaaaaaaaaatccc

SEQ ID NO: 400240 - DNA, 16 bp, M. musculus
cttaaaaaggaagcac

SEQ ID NO: 400241 - DNA, 16 bp, M. musculus
cttaaaacacacattg

SEQ ID NO: 400242 - DNA, 16 bp, M. musculus
cttaaaacccacaccc

SEQ ID NO: 400243 - DNA, 16 bp, M. musculus
cttaaaagcaaaaaca

SEQ ID NO: 400244 - DNA, 16 bp, M. musculus
cttaaaaggggaaaca

SEQ ID NO: 400245 - DNA, 16 bp, M. musculus
cttaaacatctcagat

SEQ ID NO: 400246 - DNA, 16 bp, M. musculus
cttaaacctttgttag

SEQ ID NO: 400247 - DNA, 16 bp, M. musculus
cttaaacttgtgatcc

SEQ ID NO: 400248 - DNA, 16 bp, M. musculus
cttaaagaaaaccaac

SEQ ID NO: 400249 - DNA, 16 bp, M. musculus
cttaaagaaagacatg

SEQ ID NO: 400250 - DNA, 22 bp, M. musculus
cttaaagaaatacaggagaaca

SEQ ID NO: 400251 - DNA, 16 bp, M. musculus
cttaaagaaatacatg

SEQ ID NO: 400252 - DNA, 16 bp, M. musculus
cttaaagaaatagaaa

SEQ ID NO: 400253 - DNA, 16 bp, M. musculus
cttaaagaaatagaag

SEQ ID NO: 400254 - DNA, 16 bp, M. musculus
cttaaagaactctatt

SEQ ID NO: 400255 - DNA, 17 bp, M. musculus
cttaaagaattacagga

SEQ ID NO: 400256 - DNA, 16 bp, M. musculus
cttaaagacaaacaaa

SEQ ID NO: 400257 - DNA, 16 bp, M. musculus
cttaaagaggaaacat

SEQ ID NO: 400258 - DNA, 16 bp, M. musculus
cttaaagattttattt

SEQ ID NO: 400259 - DNA, 16 bp, M. musculus
cttaaaggagaaaaat

SEQ ID NO: 400260 - DNA, 16 bp, M. musculus
cttaaaggcaggttaa

SEQ ID NO: 400261 - DNA, 16 bp, M. musculus
cttaaagttgaaaatc

SEQ ID NO: 400262 - DNA, 16 bp, M. musculus
cttaaagttgtcctct

SEQ ID NO: 400263 - DNA, 16 bp, M. musculus
cttaaatggaaagaaa

SEQ ID NO: 400264 - DNA, 16 bp, M. musculus
cttaaattattccaca

SEQ ID NO: 400265 - DNA, 16 bp, M. musculus
cttaaattctgttcca

SEQ ID NO: 400266 - DNA, 16 bp, M. musculus
cttaaatttccacttc

SEQ ID NO: 400267 - DNA, 16 bp, M. musculus
cttaacaacagatgga

SEQ ID NO: 400268 - DNA, 16 bp, M. musculus
cttaacaccaatggac

SEQ ID NO: 400269 - DNA, 16 bp, M. musculus
cttaacagatacaaga

SEQ ID NO: 400270 - DNA, 16 bp, M. musculus
cttaacagcaataaaa

SEQ ID NO: 400271 - DNA, 16 bp, M. musculus
cttaaccaagaagcta

SEQ ID NO: 400272 - DNA, 16 bp, M. musculus
cttaaccacggagcca

SEQ ID NO: 400273 - DNA, 16 bp, M. musculus
cttaacctattcagta

SEQ ID NO: 400274 - DNA, 16 bp, M. musculus
cttaacctctgagaca

SEQ ID NO: 400275 - DNA, 16 bp, M. musculus
cttaactctgagtctc

SEQ ID NO: 400276 - DNA, 16 bp, M. musculus
cttaactgttaagcca

SEQ ID NO: 400277 - DNA, 16 bp, M. musculus
cttaagaaatataaaa

SEQ ID NO: 400278 - DNA, 16 bp, M. musculus
cttaagaccctcatcc

SEQ ID NO: 400279 - DNA, 16 bp, M. musculus
cttaagctcaccacag

SEQ ID NO: 400280 - DNA, 16 bp, M. musculus
cttaagctctgagcca

SEQ ID NO: 400281 - DNA, 16 bp, M. musculus
cttaagctttattgtg

SEQ ID NO: 400282 - DNA, 16 bp, M. musculus
cttaaggaagaaagag

SEQ ID NO: 400283 - DNA, 16 bp, M. musculus
cttaaggacagaagcc

SEQ ID NO: 400284 - DNA, 16 bp, M. musculus
cttaagggaaaaaaaa

SEQ ID NO: 400285 - DNA, 16 bp, M. musculus
cttaagtagcttccct

SEQ ID NO: 400286 - DNA, 16 bp, M. musculus
cttaagtcttaagtga

SEQ ID NO: 400287 - DNA, 16 bp, M. musculus
cttaagtttgaggcca

SEQ ID NO: 400288 - DNA, 16 bp, M. musculus
cttaatagttttaaaa

SEQ ID NO: 400289 - DNA, 16 bp, M. musculus
cttaatcactgagcaa

SEQ ID NO: 400290 - DNA, 32 bp, M. musculus
cttaatgagtttgctaattcattcaagcagaa

SEQ ID NO: 400291 - DNA, 16 bp, M. musculus
cttaatgataaaagaa

SEQ ID NO: 400292 - DNA, 16 bp, M. musculus
cttaatgattttcaaa

SEQ ID NO: 400293 - DNA, 16 bp, M. musculus
cttaattcagacagcc

SEQ ID NO: 400294 - DNA, 16 bp, M. musculus
cttaattgaagttccc

SEQ ID NO: 400295 - DNA, 16 bp, M. musculus
cttaatttaaaactac

SEQ ID NO: 400296 - DNA, 16 bp, M. musculus
cttaatttctgagcca

SEQ ID NO: 400297 - DNA, 16 bp, M. musculus
cttaatttgtatcttt

SEQ ID NO: 400298 - DNA, 16 bp, M. musculus
cttaattttaaaacaa

SEQ ID NO: 400299 - DNA, 16 bp, M. musculus
cttacaaaccaaatcc

SEQ ID NO: 400300 - DNA, 16 bp, M. musculus
cttacaaatgctttca

SEQ ID NO: 400301 - DNA, 16 bp, M. musculus
cttacaaccatccata

SEQ ID NO: 400302 - DNA, 16 bp, M. musculus
cttacaaccatcttta

SEQ ID NO: 400303 - DNA, 16 bp, M. musculus
cttacaactgcttgta

SEQ ID NO: 400304 - DNA, 16 bp, M. musculus
cttacaagtggatatt

SEQ ID NO: 400305 - DNA, 16 bp, M. musculus
cttacaagttggaaca

SEQ ID NO: 400306 - DNA, 16 bp, M. musculus
cttacaattccaggtt

SEQ ID NO: 400307 - DNA, 16 bp, M. musculus
cttacacacatacaca

SEQ ID NO: 400308 - DNA, 16 bp, M. musculus
cttacacagttcagga

SEQ ID NO: 400309 - DNA, 16 bp, M. musculus
cttacaccaataagaa

SEQ ID NO: 400310 - DNA, 16 bp, M. musculus
cttacactctttctgt

SEQ ID NO: 400311 - DNA, 16 bp, M. musculus
cttacagaaactttgc

SEQ ID NO: 400312 - DNA, 16 bp, M. musculus
cttacagaacccagga

SEQ ID NO: 400313 - DNA, 16 bp, M. musculus
cttacagaagaaaaca

SEQ ID NO: 400314 - DNA, 16 bp, M. musculus
cttacagaagccttgc

SEQ ID NO: 400315 - DNA, 16 bp, M. musculus
cttacagaggacctgg

SEQ ID NO: 400316 - DNA, 17 bp, M. musculus
cttacagatggttgtga

SEQ ID NO: 400317 - DNA, 16 bp, M. musculus
cttacagctggatcta

SEQ ID NO: 400318 - DNA, 16 bp, M. musculus
cttacaggaaacccac

SEQ ID NO: 400319 - DNA, 16 bp, M. musculus
cttacagtctgcagcc

SEQ ID NO: 400320 - DNA, 16 bp, M. musculus
cttacagtctttccat

SEQ ID NO: 400321 - DNA, 16 bp, M. musculus
cttacagttctagagg

SEQ ID NO: 400322 - DNA, 16 bp, M. musculus
cttacagtttcagagg

SEQ ID NO: 400323 - DNA, 16 bp, M. musculus
cttacatataattaat

SEQ ID NO: 400324 - DNA, 16 bp, M. musculus
cttacatatataaaat

SEQ ID NO: 400325 - DNA, 16 bp, M. musculus
cttacatatttcaaaa

SEQ ID NO: 400326 - DNA, 17 bp, M. musculus
cttacatcttcaggagc

SEQ ID NO: 400327 - DNA, 16 bp, M. musculus
cttacatgtatgtgtg

SEQ ID NO: 400328 - DNA, 16 bp, M. musculus
cttacattttcacatt

SEQ ID NO: 400329 - DNA, 16 bp, M. musculus
cttacatttttaaaaa

SEQ ID NO: 400330 - DNA, 16 bp, M. musculus
cttacatttttaaaat

SEQ ID NO: 400331 - DNA, 16 bp, M. musculus
cttaccaacatgactg

SEQ ID NO: 400332 - DNA, 16 bp, M. musculus
cttaccaatttattat

SEQ ID NO: 400333 - DNA, 16 bp, M. musculus
cttacccaaggtcaca

SEQ ID NO: 400334 - DNA, 16 bp, M. musculus
cttacccactgagtca

SEQ ID NO: 400335 - DNA, 16 bp, M. musculus
cttaccccatgaaaaa

SEQ ID NO: 400336 - DNA, 16 bp, M. musculus
cttacctaatggaaac

SEQ ID NO: 400337 - DNA, 16 bp, M. musculus
cttacctagcatgcat

SEQ ID NO: 400338 - DNA, 16 bp, M. musculus
cttacctcactcagga

SEQ ID NO: 400339 - DNA, 16 bp, M. musculus
cttacctctgcctccc

SEQ ID NO: 400340 - DNA, 16 bp, M. musculus
cttacctctggcagaa

SEQ ID NO: 400341 - DNA, 16 bp, M. musculus
cttacctgatgagcca

SEQ ID NO: 400342 - DNA, 16 bp, M. musculus
cttacctggctgttgc

SEQ ID NO: 400343 - DNA, 16 bp, M. musculus
cttaccttcttcccta

SEQ ID NO: 400344 - DNA, 16 bp, M. musculus
cttacgggacacaatg

SEQ ID NO: 400345 - DNA, 16 bp, M. musculus
cttactaacagaaaca

SEQ ID NO: 400346 - DNA, 16 bp, M. musculus
cttactaaggaagtga

SEQ ID NO: 400347 - DNA, 23 bp, M. musculus
cttactaatgctggattggcagc

SEQ ID NO: 400348 - DNA, 16 bp, M. musculus
cttactacatagccca

SEQ ID NO: 400349 - DNA, 17 bp, M. musculus
cttactatgtagaccag

SEQ ID NO: 400350 - DNA, 16 bp, M. musculus
cttactcactttacat

SEQ ID NO: 400351 - DNA, 17 bp, M. musculus
cttactcctggatcttt

SEQ ID NO: 400352 - DNA, 16 bp, M. musculus
cttactctagctcctc

SEQ ID NO: 400353 - DNA, 16 bp, M. musculus
cttactgatgatgtct

SEQ ID NO: 400354 - DNA, 16 bp, M. musculus
cttactgctcttgcaa

SEQ ID NO: 400355 - DNA, 16 bp, M. musculus
cttactggcttccttc

SEQ ID NO: 400356 - DNA, 16 bp, M. musculus
cttactggcttgttca

SEQ ID NO: 400357 - DNA, 16 bp, M. musculus
cttactgtctctttac

SEQ ID NO: 400358 - DNA, 16 bp, M. musculus
cttagaaaattatttt

SEQ ID NO: 400359 - DNA, 16 bp, M. musculus
cttagaaatgtgaaca

SEQ ID NO: 400360 - DNA, 16 bp, M. musculus
cttagaactgaagtta

SEQ ID NO: 400361 - DNA, 16 bp, M. musculus
cttagaagagttgcct

SEQ ID NO: 400362 - DNA, 16 bp, M. musculus
cttagaagcctgctct

SEQ ID NO: 400363 - DNA, 16 bp, M. musculus
cttagaaggcagaggc

SEQ ID NO: 400364 - DNA, 16 bp, M. musculus
cttagaattgcacaca

SEQ ID NO: 400365 - DNA, 17 bp, M. musculus
cttagaattggaaacaa

SEQ ID NO: 400366 - DNA, 19 bp, M. musculus
cttagaattgggaacaaaa

SEQ ID NO: 400367 - DNA, 17 bp, M. musculus
cttagacatggcctcac

SEQ ID NO: 400368 - DNA, 16 bp, M. musculus
cttagagaaggaagag

SEQ ID NO: 400369 - DNA, 16 bp, M. musculus
cttagatcctgagcca

SEQ ID NO: 400370 - DNA, 16 bp, M. musculus
cttagcaaaactccac

SEQ ID NO: 400371 - DNA, 16 bp, M. musculus
cttagcaaaggatgcc

SEQ ID NO: 400372 - DNA, 16 bp, M. musculus
cttagcacagggtccc

SEQ ID NO: 400373 - DNA, 16 bp, M. musculus
cttagcatgcaggagg

SEQ ID NO: 400374 - DNA, 16 bp, M. musculus
cttagccaataagctt

SEQ ID NO: 400375 - DNA, 16 bp, M. musculus
cttagccacatcccag

SEQ ID NO: 400376 - DNA, 16 bp, M. musculus
cttagccagagttcca

SEQ ID NO: 400377 - DNA, 16 bp, M. musculus
cttagccaggcagtgg

SEQ ID NO: 400378 - DNA, 16 bp, M. musculus
cttagccattctgaca

SEQ ID NO: 400379 - DNA, 16 bp, M. musculus
cttagcctcctgagtg

SEQ ID NO: 400380 - DNA, 16 bp, M. musculus
cttagctacatagtaa

SEQ ID NO: 400381 - DNA, 16 bp, M. musculus
cttagctgaaatgcct

SEQ ID NO: 400382 - DNA, 16 bp, M. musculus
cttagctgagatgcct

SEQ ID NO: 400383 - DNA, 16 bp, M. musculus
cttagctgctgagtca

SEQ ID NO: 400384 - DNA, 16 bp, M. musculus
cttagcttctttgtgt

SEQ ID NO: 400385 - DNA, 16 bp, M. musculus
cttaggaaaaaaaata

SEQ ID NO: 400386 - DNA, 16 bp, M. musculus
cttaggaagctgaagc

SEQ ID NO: 400387 - DNA, 16 bp, M. musculus
cttaggaagtgaaaga

SEQ ID NO: 400388 - DNA, 16 bp, M. musculus
cttaggagagttggct

SEQ ID NO: 400389 - DNA, 16 bp, M. musculus
cttaggagatggctca

SEQ ID NO: 400390 - DNA, 16 bp, M. musculus
cttaggaggcagagtc

SEQ ID NO: 400391 - DNA, 16 bp, M. musculus
cttaggatacacaaga

SEQ ID NO: 400392 - DNA, 16 bp, M. musculus
cttaggcaggaaatag

SEQ ID NO: 400393 - DNA, 16 bp, M. musculus
cttagggcaagggcta

SEQ ID NO: 400394 - DNA, 16 bp, M. musculus
cttaggggacacaatg

SEQ ID NO: 400395 - DNA, 16 bp, M. musculus
cttagggtttcttttg

SEQ ID NO: 400396 - DNA, 16 bp, M. musculus
cttaggtgtaggagtt

SEQ ID NO: 400397 - DNA, 16 bp, M. musculus
cttaggtttccacttc

SEQ ID NO: 400398 - DNA, 16 bp, M. musculus
cttagtaaatacctaa

SEQ ID NO: 400399 - DNA, 16 bp, M. musculus
cttagtcatcatgaaa

SEQ ID NO: 400400 - DNA, 16 bp, M. musculus
cttagtctgtgatgat

SEQ ID NO: 400401 - DNA, 16 bp, M. musculus
cttagtcttcttgtgg

SEQ ID NO: 400402 - DNA, 16 bp, M. musculus
cttagtgagagaccct

SEQ ID NO: 400403 - DNA, 16 bp, M. musculus
cttagtgagatcctgt

SEQ ID NO: 400404 - DNA, 16 bp, M. musculus
cttagtgagttccaga

SEQ ID NO: 400405 - DNA, 16 bp, M. musculus
cttagtgatcttatgt

SEQ ID NO: 400406 - DNA, 16 bp, M. musculus
cttagtgattgatgtg

SEQ ID NO: 400407 - DNA, 28 bp, M. musculus
cttagtgcaggctatggcagccttggaa

SEQ ID NO: 400408 - DNA, 16 bp, M. musculus
cttagttcctcaggct

SEQ ID NO: 400409 - DNA, 16 bp, M. musculus
cttagtttagaatcaa

SEQ ID NO: 400410 - DNA, 16 bp, M. musculus
cttagtttcttcatct

SEQ ID NO: 400411 - DNA, 16 bp, M. musculus
cttagtttgggttttg

SEQ ID NO: 400412 - DNA, 16 bp, M. musculus
cttataaaacaaagca

SEQ ID NO: 400413 - DNA, 16 bp, M. musculus
cttataaactttatat

SEQ ID NO: 400414 - DNA, 16 bp, M. musculus
cttataaagcaaaaga

SEQ ID NO: 400415 - DNA, 16 bp, M. musculus
cttataaaggaaagca

SEQ ID NO: 400416 - DNA, 16 bp, M. musculus
cttataaaggaaggca

SEQ ID NO: 400417 - DNA, 16 bp, M. musculus
cttataaatggacatt

SEQ ID NO: 400418 - DNA, 16 bp, M. musculus
cttataatagccagaa

SEQ ID NO: 400419 - DNA, 16 bp, M. musculus
cttatacacaggtgca

SEQ ID NO: 400420 - DNA, 16 bp, M. musculus
cttatacatacacaca

SEQ ID NO: 400421 - DNA, 16 bp, M. musculus
cttatacatgtaagca

SEQ ID NO: 400422 - DNA, 16 bp, M. musculus
cttataccatccagga

SEQ ID NO: 400423 - DNA, 16 bp, M. musculus
cttatagaagaaaaaa

SEQ ID NO: 400424 - DNA, 16 bp, M. musculus
cttatatacatgtata

SEQ ID NO: 400425 - DNA, 16 bp, M. musculus
cttatatagccctcag

SEQ ID NO: 400426 - DNA, 16 bp, M. musculus
cttatatatgaatgca

SEQ ID NO: 400427 - DNA, 16 bp, M. musculus
cttatatcagctggtg

SEQ ID NO: 400428 - DNA, 16 bp, M. musculus
cttatatcttggaaat

SEQ ID NO: 400429 - DNA, 16 bp, M. musculus
cttatatttggtcttt

SEQ ID NO: 400430 - DNA, 16 bp, M. musculus
cttatattttcagagg

SEQ ID NO: 400431 - DNA, 16 bp, M. musculus
cttatcattaacaaaa

SEQ ID NO: 400432 - DNA, 16 bp, M. musculus
cttatccattgctggt

SEQ ID NO: 400433 - DNA, 16 bp, M. musculus
cttatctcaaaacaac

SEQ ID NO: 400434 - DNA, 16 bp, M. musculus
cttatctcagaaaaaa

SEQ ID NO: 400435 - DNA, 16 bp, M. musculus
cttatctgtgagcaca

SEQ ID NO: 400436 - DNA, 16 bp, M. musculus
cttatcttttggataa

SEQ ID NO: 400437 - DNA, 16 bp, M. musculus
cttatgaaactggaaa

SEQ ID NO: 400438 - DNA, 16 bp, M. musculus
cttatgaaggctctat

SEQ ID NO: 400439 - DNA, 16 bp, M. musculus
cttatgcaggtcttgt

SEQ ID NO: 400440 - DNA, 17 bp, M. musculus
cttatgcccacacccac

SEQ ID NO: 400441 - DNA, 16 bp, M. musculus
cttatggaaacagatg

SEQ ID NO: 400442 - DNA, 16 bp, M. musculus
cttatggaagaaaagg

SEQ ID NO: 400443 - DNA, 16 bp, M. musculus
cttatggaggcatttc

SEQ ID NO: 400444 - DNA, 16 bp, M. musculus
cttatggttccagagg

SEQ ID NO: 400445 - DNA, 16 bp, M. musculus
cttatgtatactatca

SEQ ID NO: 400446 - DNA, 16 bp, M. musculus
cttatgtatactgtca

SEQ ID NO: 400447 - DNA, 16 bp, M. musculus
cttatgtgtttgcaag

SEQ ID NO: 400448 - DNA, 16 bp, M. musculus
cttattaaaatctgat

SEQ ID NO: 400449 - DNA, 16 bp, M. musculus
cttattacccagtttc

SEQ ID NO: 400450 - DNA, 16 bp, M. musculus
cttattcacaccacca

SEQ ID NO: 400451 - DNA, 16 bp, M. musculus
cttattctctgcattt

SEQ ID NO: 400452 - DNA, 17 bp, M. musculus
cttattgaatttgcaaa

SEQ ID NO: 400453 - DNA, 16 bp, M. musculus
cttattgactatgttc

SEQ ID NO: 400454 - DNA, 16 bp, M. musculus
cttattgactgtgtct

SEQ ID NO: 400455 - DNA, 16 bp, M. musculus
cttattgtttgtgctt

SEQ ID NO: 400456 - DNA, 16 bp, M. musculus
cttatttaaaagaaaa

SEQ ID NO: 400457 - DNA, 16 bp, M. musculus
cttatttcacttagca

SEQ ID NO: 400458 - DNA, 16 bp, M. musculus
cttatttcagaaggca

SEQ ID NO: 400459 - DNA, 16 bp, M. musculus
cttattttagaaaatt

SEQ ID NO: 400460 - DNA, 16 bp, M. musculus
cttattttgtgtgtgt

SEQ ID NO: 400461 - DNA, 16 bp, M. musculus
cttatttttaaaaatg

SEQ ID NO: 400462 - DNA, 16 bp, M. musculus
cttatttttaatatgc

SEQ ID NO: 400463 - DNA, 16 bp, M. musculus
cttatttttatgtatg

SEQ ID NO: 400464 - DNA, 16 bp, M. musculus
cttattttttaagaca

SEQ ID NO: 400465 - DNA, 16 bp, M. musculus
cttattttttgagaca

SEQ ID NO: 400466 - DNA, 16 bp, M. musculus
cttcaaaaacatcaga

SEQ ID NO: 400467 - DNA, 16 bp, M. musculus
cttcaaaaactgggaa

SEQ ID NO: 400468 - DNA, 16 bp, M. musculus
cttcaaaagagaaaaa

SEQ ID NO: 400469 - DNA, 16 bp, M. musculus
cttcaaaagtctccat

SEQ ID NO: 400470 - DNA, 16 bp, M. musculus
cttcaaaattctgcat

SEQ ID NO: 400471 - DNA, 16 bp, M. musculus
cttcaaaattgataca

SEQ ID NO: 400472 - DNA, 16 bp, M. musculus
cttcaaaccaagcaga

SEQ ID NO: 400473 - DNA, 16 bp, M. musculus
cttcaaacgcaccaga

SEQ ID NO: 400474 - DNA, 16 bp, M. musculus
cttcaaactcacagaa

SEQ ID NO: 400475 - DNA, 16 bp, M. musculus
cttcaaactctgcatc

SEQ ID NO: 400476 - DNA, 16 bp, M. musculus
cttcaaagaaaacaaa

SEQ ID NO: 400477 - DNA, 16 bp, M. musculus
cttcaaagaagaatta

SEQ ID NO: 400478 - DNA, 16 bp, M. musculus
cttcaaagacacagaa

SEQ ID NO: 400479 - DNA, 16 bp, M. musculus
cttcaaagaccagaaa

SEQ ID NO: 400480 - DNA, 16 bp, M. musculus
cttcaaagagtttttg

SEQ ID NO: 400481 - DNA, 16 bp, M. musculus
cttcaaagcaatagaa

SEQ ID NO: 400482 - DNA, 16 bp, M. musculus
cttcaaagcccaccct

SEQ ID NO: 400483 - DNA, 16 bp, M. musculus
cttcaaatcaagaaaa

SEQ ID NO: 400484 - DNA, 16 bp, M. musculus
cttcaaatcccccacg

SEQ ID NO: 400485 - DNA, 16 bp, M. musculus
cttcaaatctctgaaa

SEQ ID NO: 400486 - DNA, 16 bp, M. musculus
cttcaaattcatggtc

SEQ ID NO: 400487 - DNA, 16 bp, M. musculus
cttcaacaaaccagaa

SEQ ID NO: 400488 - DNA, 16 bp, M. musculus
cttcaacaagactccc

SEQ ID NO: 400489 - DNA, 16 bp, M. musculus
cttcaacactccattc

SEQ ID NO: 400490 - DNA, 16 bp, M. musculus
cttcaaccccagcact

SEQ ID NO: 400491 - DNA, 16 bp, M. musculus
cttcaactccttcaat

SEQ ID NO: 400492 - DNA, 16 bp, M. musculus
cttcaactgttccaca

SEQ ID NO: 400493 - DNA, 16 bp, M. musculus
cttcaagaactatatt

SEQ ID NO: 400494 - DNA, 16 bp, M. musculus
cttcaagaaggccaca

SEQ ID NO: 400495 - DNA, 17 bp, M. musculus
cttcaagatactgctac

SEQ ID NO: 400496 - DNA, 16 bp, M. musculus
cttcaagatggctcag

SEQ ID NO: 400497 - DNA, 16 bp, M. musculus
cttcaagctcacagag

SEQ ID NO: 400498 - DNA, 16 bp, M. musculus
cttcaagctcctgcct

SEQ ID NO: 400499 - DNA, 16 bp, M. musculus
cttcaagcttctctcc

SEQ ID NO: 400500 - DNA, 16 bp, M. musculus
cttcaaggcctttccc

SEQ ID NO: 400501 - DNA, 16 bp, M. musculus
cttcaaggctttcccc

SEQ ID NO: 400502 - DNA, 16 bp, M. musculus
cttcaagtctctgatg

SEQ ID NO: 400503 - DNA, 16 bp, M. musculus
cttcaagttcaaggcc

SEQ ID NO: 400504 - DNA, 16 bp, M. musculus
cttcaagttgaaaatc

SEQ ID NO: 400505 - DNA, 16 bp, M. musculus
cttcaagttgtggatt

SEQ ID NO: 400506 - DNA, 16 bp, M. musculus
cttcaagtttctctct

SEQ ID NO: 400507 - DNA, 16 bp, M. musculus
cttcaataaaatcata

SEQ ID NO: 400508 - DNA, 16 bp, M. musculus
cttcaataaggtcaca

SEQ ID NO: 400509 - DNA, 16 bp, M. musculus
cttcaatattttgata

SEQ ID NO: 400510 - DNA, 16 bp, M. musculus
cttcaatcccaacact

SEQ ID NO: 400511 - DNA, 16 bp, M. musculus
cttcaatcccagaact

SEQ ID NO: 400512 - DNA, 16 bp, M. musculus
cttcaatcccagcact

SEQ ID NO: 400513 - DNA, 16 bp, M. musculus
cttcaatcccagctct

SEQ ID NO: 400514 - DNA, 16 bp, M. musculus
cttcaatcctgggcct

SEQ ID NO: 400515 - DNA, 16 bp, M. musculus
cttcaatctcagcatt

SEQ ID NO: 400516 - DNA, 16 bp, M. musculus
cttcaatgcagttatg

SEQ ID NO: 400517 - DNA, 16 bp, M. musculus
cttcaattattttgtt

SEQ ID NO: 400518 - DNA, 16 bp, M. musculus
cttcaattccatcacc

SEQ ID NO: 400519 - DNA, 16 bp, M. musculus
cttcacaaagttgtcc

SEQ ID NO: 400520 - DNA, 21 bp, M. musculus
cttcacaagcagtaccacctg

SEQ ID NO: 400521 - DNA, 16 bp, M. musculus
cttcacaataggcaca

SEQ ID NO: 400522 - DNA, 16 bp, M. musculus
cttcacacagccagac

SEQ ID NO: 400523 - DNA, 16 bp, M. musculus
cttcacaccagtcaga

SEQ ID NO: 400524 - DNA, 16 bp, M. musculus
cttcacagagacttga

SEQ ID NO: 400525 - DNA, 16 bp, M. musculus
cttcacagcaacagcc

SEQ ID NO: 400526 - DNA, 16 bp, M. musculus
cttcacagcagtaaaa

SEQ ID NO: 400527 - DNA, 16 bp, M. musculus
cttcacagcttcttgt

SEQ ID NO: 400528 - DNA, 16 bp, M. musculus
cttcacaggaccaagg

SEQ ID NO: 400529 - DNA, 16 bp, M. musculus
cttcacaggaccaagt

SEQ ID NO: 400530 - DNA, 16 bp, M. musculus
cttcaccaacagcctc

SEQ ID NO: 400531 - DNA, 16 bp, M. musculus
cttcaccaatggcttt

SEQ ID NO: 400532 - DNA, 16 bp, M. musculus
cttcaccaatgtccta

SEQ ID NO: 400533 - DNA, 16 bp, M. musculus
cttcacccatgaggct

SEQ ID NO: 400534 - DNA, 16 bp, M. musculus
cttcacctgctgagcc

SEQ ID NO: 400535 - DNA, 16 bp, M. musculus
cttcacctgcttgatt

SEQ ID NO: 400536 - DNA, 16 bp, M. musculus
cttcaccttccacctt

SEQ ID NO: 400537 - DNA, 16 bp, M. musculus
cttcactgatgatgct

SEQ ID NO: 400538 - DNA, 16 bp, M. musculus
cttcactggaccaagg

SEQ ID NO: 400539 - DNA, 16 bp, M. musculus
cttcactggcatcaga

SEQ ID NO: 400540 - DNA, 16 bp, M. musculus
cttcactggcattaga

SEQ ID NO: 400541 - DNA, 16 bp, M. musculus
cttcactgggggccct

SEQ ID NO: 400542 - DNA, 16 bp, M. musculus
cttcactggtattaga

SEQ ID NO: 400543 - DNA, 16 bp, M. musculus
cttcacttacatttca

SEQ ID NO: 400544 - DNA, 16 bp, M. musculus
cttcagaaaaaggcag

SEQ ID NO: 400545 - DNA, 16 bp, M. musculus
cttcagaaaaatcttt

SEQ ID NO: 400546 - DNA, 16 bp, M. musculus
cttcagaaaagagtag

SEQ ID NO: 400547 - DNA, 16 bp, M. musculus
cttcagaaaaggacag

SEQ ID NO: 400548 - DNA, 16 bp, M. musculus
cttcagaaaagggcag

SEQ ID NO: 400549 - DNA, 16 bp, M. musculus
cttcagaaaagtggct

SEQ ID NO: 400550 - DNA, 16 bp, M. musculus
cttcagaaaataaaat

SEQ ID NO: 400551 - DNA, 17 bp, M. musculus
cttcagaaaatcaaata

SEQ ID NO: 400552 - DNA, 16 bp, M. musculus
cttcagaagaacagtt

SEQ ID NO: 400553 - DNA, 16 bp, M. musculus
cttcagaagaagatgt

SEQ ID NO: 400554 - DNA, 16 bp, M. musculus
cttcagacaccagaaa

SEQ ID NO: 400555 - DNA, 16 bp, M. musculus
cttcagacaccttcag

SEQ ID NO: 400556 - DNA, 16 bp, M. musculus
cttcagacactctgga

SEQ ID NO: 400557 - DNA, 16 bp, M. musculus
cttcagacatatcaga

SEQ ID NO: 400558 - DNA, 16 bp, M. musculus
cttcagacatcccaga

SEQ ID NO: 400559 - DNA, 16 bp, M. musculus
cttcagacatgccaga

SEQ ID NO: 400560 - DNA, 16 bp, M. musculus
cttcagaccagaagag

SEQ ID NO: 400561 - DNA, 17 bp, M. musculus
cttcagaccatttgctt

SEQ ID NO: 400562 - DNA, 16 bp, M. musculus
cttcagacccatttcc

SEQ ID NO: 400563 - DNA, 16 bp, M. musculus
cttcagactcaccaga

SEQ ID NO: 400564 - DNA, 16 bp, M. musculus
cttcagactgtccaca

SEQ ID NO: 400565 - DNA, 16 bp, M. musculus
cttcagactgttgggt

SEQ ID NO: 400566 - DNA, 16 bp, M. musculus
cttcagagaaccaaat

SEQ ID NO: 400567 - DNA, 16 bp, M. musculus
cttcagagaactggtt

SEQ ID NO: 400568 - DNA, 16 bp, M. musculus
cttcagagaagagcag

SEQ ID NO: 400569 - DNA, 16 bp, M. musculus
cttcagagattttttt

SEQ ID NO: 400570 - DNA, 16 bp, M. musculus
cttcagagcaagttcc

SEQ ID NO: 400571 - DNA, 16 bp, M. musculus
cttcagagcacaggct

SEQ ID NO: 400572 - DNA, 16 bp, M. musculus
cttcagagggggaagg

SEQ ID NO: 400573 - DNA, 16 bp, M. musculus
cttcagagtcttgaag

SEQ ID NO: 400574 - DNA, 16 bp, M. musculus
cttcagagtgagttct

SEQ ID NO: 400575 - DNA, 16 bp, M. musculus
cttcagatcaagatat

SEQ ID NO: 400576 - DNA, 16 bp, M. musculus
cttcagatcattttga

SEQ ID NO: 400577 - DNA, 16 bp, M. musculus
cttcagatccttcagt

SEQ ID NO: 400578 - DNA, 16 bp, M. musculus
cttcagatctccagct

SEQ ID NO: 400579 - DNA, 16 bp, M. musculus
cttcagatgaagatgt

SEQ ID NO: 400580 - DNA, 16 bp, M. musculus
cttcagatgaggaaat

SEQ ID NO: 400581 - DNA, 16 bp, M. musculus
cttcagatgtaccaga

SEQ ID NO: 400582 - DNA, 16 bp, M. musculus
cttcagcaaagtgggt

SEQ ID NO: 400583 - DNA, 16 bp, M. musculus
cttcagcaccatgcct

SEQ ID NO: 400584 - DNA, 16 bp, M. musculus
cttcagcagcagcagc

SEQ ID NO: 400585 - DNA, 16 bp, M. musculus
cttcagcagcctgaga

SEQ ID NO: 400586 - DNA, 16 bp, M. musculus
cttcagcatccttatc

SEQ ID NO: 400587 - DNA, 16 bp, M. musculus
cttcagccaggagaca

SEQ ID NO: 400588 - DNA, 16 bp, M. musculus
cttcagccaggaggaa

SEQ ID NO: 400589 - DNA, 16 bp, M. musculus
cttcagccaggaggag

SEQ ID NO: 400590 - DNA, 16 bp, M. musculus
cttcagccctttctct

SEQ ID NO: 400591 - DNA, 16 bp, M. musculus
cttcagccttttcctt

SEQ ID NO: 400592 - DNA, 16 bp, M. musculus
cttcagctcacagaga

SEQ ID NO: 400593 - DNA, 16 bp, M. musculus
cttcagctccatgggt

SEQ ID NO: 400594 - DNA, 16 bp, M. musculus
cttcagctccctgggt

SEQ ID NO: 400595 - DNA, 16 bp, M. musculus
cttcagctcctgcagt

SEQ ID NO: 400596 - DNA, 16 bp, M. musculus
cttcagcttattgacc

SEQ ID NO: 400597 - DNA, 16 bp, M. musculus
cttcagcttccacgtg

SEQ ID NO: 400598 - DNA, 16 bp, M. musculus
cttcagcttccagcct

SEQ ID NO: 400599 - DNA, 16 bp, M. musculus
cttcagcttcctaagt

SEQ ID NO: 400600 - DNA, 16 bp, M. musculus
cttcaggaaagagcag

SEQ ID NO: 400601 - DNA, 16 bp, M. musculus
cttcaggaagaccccg

SEQ ID NO: 400602 - DNA, 16 bp, M. musculus
cttcaggaagagcagt

SEQ ID NO: 400603 - DNA, 16 bp, M. musculus
cttcaggagcaggagc

SEQ ID NO: 400604 - DNA, 16 bp, M. musculus
cttcaggatctgtggt

SEQ ID NO: 400605 - DNA, 16 bp, M. musculus
cttcaggatctgttgc

SEQ ID NO: 400606 - DNA, 16 bp, M. musculus
cttcaggattccaaca

SEQ ID NO: 400607 - DNA, 16 bp, M. musculus
cttcaggcaccaggca

SEQ ID NO: 400608 - DNA, 17 bp, M. musculus
cttcaggcctctagcag

SEQ ID NO: 400609 - DNA, 16 bp, M. musculus
cttcaggccttcccct

SEQ ID NO: 400610 - DNA, 16 bp, M. musculus
cttcaggctcctgccc

SEQ ID NO: 400611 - DNA, 16 bp, M. musculus
cttcagggacaaaaat

SEQ ID NO: 400612 - DNA, 16 bp, M. musculus
cttcagggctgaccac

SEQ ID NO: 400613 - DNA, 16 bp, M. musculus
cttcaggggtctttca

SEQ ID NO: 400614 - DNA, 16 bp, M. musculus
cttcaggtagaaatat

SEQ ID NO: 400615 - DNA, 16 bp, M. musculus
cttcaggtccttcagt

SEQ ID NO: 400616 - DNA, 16 bp, M. musculus
cttcaggttcctctcc

SEQ ID NO: 400617 - DNA, 16 bp, M. musculus
cttcagtcccagcact

SEQ ID NO: 400618 - DNA, 16 bp, M. musculus
cttcagtctcagaatt

SEQ ID NO: 400619 - DNA, 16 bp, M. musculus
cttcagtctctgcacc

SEQ ID NO: 400620 - DNA, 16 bp, M. musculus
cttcagtctctgctca

SEQ ID NO: 400621 - DNA, 16 bp, M. musculus
cttcagtctctgcttt

SEQ ID NO: 400622 - DNA, 16 bp, M. musculus
cttcagtctctgttct

SEQ ID NO: 400623 - DNA, 16 bp, M. musculus
cttcagtctttcccct

SEQ ID NO: 400624 - DNA, 16 bp, M. musculus
cttcagtgaaacattc

SEQ ID NO: 400625 - DNA, 16 bp, M. musculus
cttcagtgagacagct

SEQ ID NO: 400626 - DNA, 16 bp, M. musculus
cttcagtggaagaaga

SEQ ID NO: 400627 - DNA, 16 bp, M. musculus
cttcagtggcccctag

SEQ ID NO: 400628 - DNA, 16 bp, M. musculus
cttcagtggcttcctg

SEQ ID NO: 400629 - DNA, 16 bp, M. musculus
cttcagttccagagga

SEQ ID NO: 400630 - DNA, 16 bp, M. musculus
cttcagttcccagcac

SEQ ID NO: 400631 - DNA, 16 bp, M. musculus
cttcagttcctacctc

SEQ ID NO: 400632 - DNA, 16 bp, M. musculus
cttcagttcctgcctc

SEQ ID NO: 400633 - DNA, 16 bp, M. musculus
cttcagttgagaaaaa

SEQ ID NO: 400634 - DNA, 16 bp, M. musculus
cttcagtttaaaaaaa

SEQ ID NO: 400635 - DNA, 16 bp, M. musculus
cttcagtttctgctcc

SEQ ID NO: 400636 - DNA, 16 bp, M. musculus
cttcagtttcttcagt

SEQ ID NO: 400637 - DNA, 16 bp, M. musculus
cttcataaagaaattg

SEQ ID NO: 400638 - DNA, 16 bp, M. musculus
cttcataactgtcatt

SEQ ID NO: 400639 - DNA, 16 bp, M. musculus
cttcataatgctcaaa

SEQ ID NO: 400640 - DNA, 16 bp, M. musculus
cttcataatttcattt

SEQ ID NO: 400641 - DNA, 16 bp, M. musculus
cttcatagattttttt

SEQ ID NO: 400642 - DNA, 16 bp, M. musculus
cttcataggaccaagg

SEQ ID NO: 400643 - DNA, 16 bp, M. musculus
cttcatatttgctcct

SEQ ID NO: 400644 - DNA, 16 bp, M. musculus
cttcatcaaaattaaa

SEQ ID NO: 400645 - DNA, 17 bp, M. musculus
cttcatcaccctcgtct

SEQ ID NO: 400646 - DNA, 16 bp, M. musculus
cttcatcatcacagga

SEQ ID NO: 400647 - DNA, 16 bp, M. musculus
cttcatcatcaccatc

SEQ ID NO: 400648 - DNA, 16 bp, M. musculus
cttcatcatcatcatt

SEQ ID NO: 400649 - DNA, 16 bp, M. musculus
cttcatcatcatgaaa

SEQ ID NO: 400650 - DNA, 16 bp, M. musculus
cttcatccacaggcag

SEQ ID NO: 400651 - DNA, 16 bp, M. musculus
cttcatccagcacctg

SEQ ID NO: 400652 - DNA, 16 bp, M. musculus
cttcatccagcagctg

SEQ ID NO: 400653 - DNA, 16 bp, M. musculus
cttcatcccaaggatg

SEQ ID NO: 400654 - DNA, 16 bp, M. musculus
cttcatcctcagccag

SEQ ID NO: 400655 - DNA, 16 bp, M. musculus
cttcatcctcctcatc

SEQ ID NO: 400656 - DNA, 16 bp, M. musculus
cttcatcctgagtgag

SEQ ID NO: 400657 - DNA, 16 bp, M. musculus
cttcatctccctgcct

SEQ ID NO: 400658 - DNA, 16 bp, M. musculus
cttcatctctgagaag

SEQ ID NO: 400659 - DNA, 16 bp, M. musculus
cttcatctgaaggcca

SEQ ID NO: 400660 - DNA, 16 bp, M. musculus
cttcatctgaaggcta

SEQ ID NO: 400661 - DNA, 16 bp, M. musculus
cttcatctgagtcttt

SEQ ID NO: 400662 - DNA, 16 bp, M. musculus
cttcatctgatggctg

SEQ ID NO: 400663 - DNA, 16 bp, M. musculus
cttcatctggcctcct

SEQ ID NO: 400664 - DNA, 16 bp, M. musculus
cttcatctgtgaaatg

SEQ ID NO: 400665 - DNA, 16 bp, M. musculus
cttcatcttctccaag

SEQ ID NO: 400666 - DNA, 16 bp, M. musculus
cttcatcttctgccaa

SEQ ID NO: 400667 - DNA, 16 bp, M. musculus
cttcatcttggtggat

SEQ ID NO: 400668 - DNA, 16 bp, M. musculus
cttcatctttgtcttc

SEQ ID NO: 400669 - DNA, 16 bp, M. musculus
cttcatctttgtgtca

SEQ ID NO: 400670 - DNA, 16 bp, M. musculus
cttcatgaaatttgta

SEQ ID NO: 400671 - DNA, 16 bp, M. musculus
cttcatgaattcatca

SEQ ID NO: 400672 - DNA, 16 bp, M. musculus
cttcatgacatggtag

SEQ ID NO: 400673 - DNA, 16 bp, M. musculus
cttcatgacctgcttg

SEQ ID NO: 400674 - DNA, 16 bp, M. musculus
cttcatgacttcaaaa

SEQ ID NO: 400675 - DNA, 16 bp, M. musculus
cttcatgcctcagcct

SEQ ID NO: 400676 - DNA, 16 bp, M. musculus
cttcatggtaaaagtt

SEQ ID NO: 400677 - DNA, 16 bp, M. musculus
cttcatggtgccaagc

SEQ ID NO: 400678 - DNA, 16 bp, M. musculus
cttcatgtatgtatat

SEQ ID NO: 400679 - DNA, 16 bp, M. musculus
cttcatgtatgtgagt

SEQ ID NO: 400680 - DNA, 16 bp, M. musculus
cttcatgtggatcctg

SEQ ID NO: 400681 - DNA, 16 bp, M. musculus
cttcatgttgtgctga

SEQ ID NO: 400682 - DNA, 16 bp, M. musculus
cttcattattttcaaa

SEQ ID NO: 400683 - DNA, 16 bp, M. musculus
cttcattcataatagc

SEQ ID NO: 400684 - DNA, 16 bp, M. musculus
cttcattctcacctac

SEQ ID NO: 400685 - DNA, 16 bp, M. musculus
cttcattctcctctat

SEQ ID NO: 400686 - DNA, 16 bp, M. musculus
cttcattctccttgag

SEQ ID NO: 400687 - DNA, 16 bp, M. musculus
cttcattgaatttctg

SEQ ID NO: 400688 - DNA, 16 bp, M. musculus
cttcattgacctcaac

SEQ ID NO: 400689 - DNA, 16 bp, M. musculus
cttcattggggacccc

SEQ ID NO: 400690 - DNA, 16 bp, M. musculus
cttcattggggacctg

SEQ ID NO: 400691 - DNA, 16 bp, M. musculus
cttcattgtataaatg

SEQ ID NO: 400692 - DNA, 16 bp, M. musculus
cttcattgtcttctct

SEQ ID NO: 400693 - DNA, 16 bp, M. musculus
cttcattgtttctatt

SEQ ID NO: 400694 - DNA, 16 bp, M. musculus
cttcatttaaaagaaa

SEQ ID NO: 400695 - DNA, 16 bp, M. musculus
cttcatttctccatct

SEQ ID NO: 400696 - DNA, 16 bp, M. musculus
cttcatttggttcttt

SEQ ID NO: 400697 - DNA, 16 bp, M. musculus
cttcattttcattaaa

SEQ ID NO: 400698 - DNA, 16 bp, M. musculus
cttcattttctttaaa

SEQ ID NO: 400699 - DNA, 16 bp, M. musculus
cttcatttttaaaaaa

SEQ ID NO: 400700 - DNA, 16 bp, M. musculus
cttcatttttgagaca

SEQ ID NO: 400701 - DNA, 16 bp, M. musculus
cttccaaaagctgaca

SEQ ID NO: 400702 - DNA, 16 bp, M. musculus
cttccaaaaggtcctg

SEQ ID NO: 400703 - DNA, 16 bp, M. musculus
cttccaaaggaccaga

SEQ ID NO: 400704 - DNA, 16 bp, M. musculus
cttccaaaggagagaa

SEQ ID NO: 400705 - DNA, 16 bp, M. musculus
cttccaaaggagggaa

SEQ ID NO: 400706 - DNA, 16 bp, M. musculus
cttccaaaggatccag

SEQ ID NO: 400707 - DNA, 16 bp, M. musculus
cttccaaaggggagac

SEQ ID NO: 400708 - DNA, 16 bp, M. musculus
cttccaaattctggga

SEQ ID NO: 400709 - DNA, 16 bp, M. musculus
cttccaacaagaccac

SEQ ID NO: 400710 - DNA, 16 bp, M. musculus
cttccaacccaaaggt

SEQ ID NO: 400711 - DNA, 16 bp, M. musculus
cttccaagcctcgggg

SEQ ID NO: 400712 - DNA, 16 bp, M. musculus
cttccaaggactcagg

SEQ ID NO: 400713 - DNA, 16 bp, M. musculus
cttccaaggattctgg

SEQ ID NO: 400714 - DNA, 16 bp, M. musculus
cttccaaggtcctgag

SEQ ID NO: 400715 - DNA, 16 bp, M. musculus
cttccaagtactggaa

SEQ ID NO: 400716 - DNA, 16 bp, M. musculus
cttccaagtgaatgtt

SEQ ID NO: 400717 - DNA, 16 bp, M. musculus
cttccaagtgctggaa

SEQ ID NO: 400718 - DNA, 16 bp, M. musculus
cttccaagtgctgggg

SEQ ID NO: 400719 - DNA, 16 bp, M. musculus
cttccacactggcagc

SEQ ID NO: 400720 - DNA, 16 bp, M. musculus
cttccacagatgcctg

SEQ ID NO: 400721 - DNA, 16 bp, M. musculus
cttccacagcctctgc

SEQ ID NO: 400722 - DNA, 16 bp, M. musculus
cttccacattcctact

SEQ ID NO: 400723 - DNA, 16 bp, M. musculus
cttccaccagcagcct

SEQ ID NO: 400724 - DNA, 16 bp, M. musculus
cttccaccatgtgggt

SEQ ID NO: 400725 - DNA, 16 bp, M. musculus
cttccacccttctcta

SEQ ID NO: 400726 - DNA, 16 bp, M. musculus
cttccacctcagcctc

SEQ ID NO: 400727 - DNA, 16 bp, M. musculus
cttccacctccctgcc

SEQ ID NO: 400728 - DNA, 16 bp, M. musculus
cttccactgcctctgc

SEQ ID NO: 400729 - DNA, 16 bp, M. musculus
cttccactgtgggttc

SEQ ID NO: 400730 - DNA, 16 bp, M. musculus
cttccacttccacttc

SEQ ID NO: 400731 - DNA, 16 bp, M. musculus
cttccacttcctggcc

SEQ ID NO: 400732 - DNA, 16 bp, M. musculus
cttccactttgtgggt

SEQ ID NO: 400733 - DNA, 16 bp, M. musculus
cttccagaaaaacact

SEQ ID NO: 400734 - DNA, 16 bp, M. musculus
cttccagaagacccag

SEQ ID NO: 400735 - DNA, 16 bp, M. musculus
cttccagaagcttttc

SEQ ID NO: 400736 - DNA, 16 bp, M. musculus
cttccagaatcttcca

SEQ ID NO: 400737 - DNA, 16 bp, M. musculus
cttccagacacaacag

SEQ ID NO: 400738 - DNA, 16 bp, M. musculus
cttccagagaacctaa

SEQ ID NO: 400739 - DNA, 16 bp, M. musculus
cttccagagaatccag

SEQ ID NO: 400740 - DNA, 16 bp, M. musculus
cttccagagacagaga

SEQ ID NO: 400741 - DNA, 16 bp, M. musculus
cttccagagcctgaca

SEQ ID NO: 400742 - DNA, 16 bp, M. musculus
cttccagagcctgacc

SEQ ID NO: 400743 - DNA, 16 bp, M. musculus
cttccagaggacaagg

SEQ ID NO: 400744 - DNA, 16 bp, M. musculus
cttccagaggacagag

SEQ ID NO: 400745 - DNA, 16 bp, M. musculus
cttccagaggaccagt

SEQ ID NO: 400746 - DNA, 16 bp, M. musculus
cttccagaggaccggg

SEQ ID NO: 400747 - DNA, 16 bp, M. musculus
cttccagaggacgtgg

SEQ ID NO: 400748 - DNA, 16 bp, M. musculus
cttccagaggagccag

SEQ ID NO: 400749 - DNA, 16 bp, M. musculus
cttccagaggagctgg

SEQ ID NO: 400750 - DNA, 16 bp, M. musculus
cttccagaggtaccac

SEQ ID NO: 400751 - DNA, 16 bp, M. musculus
cttccagaggtctgag

SEQ ID NO: 400752 - DNA, 16 bp, M. musculus
cttccagatcacagtc

SEQ ID NO: 400753 - DNA, 16 bp, M. musculus
cttccagatgacccag

SEQ ID NO: 400754 - DNA, 16 bp, M. musculus
cttccagcaccatgcc

SEQ ID NO: 400755 - DNA, 16 bp, M. musculus
cttccagcagctgact

SEQ ID NO: 400756 - DNA, 16 bp, M. musculus
cttccagcctcagcct

SEQ ID NO: 400757 - DNA, 16 bp, M. musculus
cttccagcctctgctg

SEQ ID NO: 400758 - DNA, 16 bp, M. musculus
cttccagccttcccta

SEQ ID NO: 400759 - DNA, 16 bp, M. musculus
cttccagccttttcct

SEQ ID NO: 400760 - DNA, 16 bp, M. musculus
cttccagctccttctc

SEQ ID NO: 400761 - DNA, 16 bp, M. musculus
cttccagcttcaagat

SEQ ID NO: 400762 - DNA, 16 bp, M. musculus
cttccagcttctcacc

SEQ ID NO: 400763 - DNA, 16 bp, M. musculus
cttccagcttctgtct

SEQ ID NO: 400764 - DNA, 16 bp, M. musculus
cttccaggaagccctc

SEQ ID NO: 400765 - DNA, 16 bp, M. musculus
cttccaggagttctga

SEQ ID NO: 400766 - DNA, 16 bp, M. musculus
cttccaggcaactaga

SEQ ID NO: 400767 - DNA, 16 bp, M. musculus
cttccaggcctctcag

SEQ ID NO: 400768 - DNA, 16 bp, M. musculus
cttccaggctcgaacc

SEQ ID NO: 400769 - DNA, 16 bp, M. musculus
cttccaggctcttccc

SEQ ID NO: 400770 - DNA, 16 bp, M. musculus
cttccaggggacctgg

SEQ ID NO: 400771 - DNA, 16 bp, M. musculus
cttccaggtcccagga

SEQ ID NO: 400772 - DNA, 16 bp, M. musculus
cttccaggtcctgagt

SEQ ID NO: 400773 - DNA, 16 bp, M. musculus
cttccagtctccatct

SEQ ID NO: 400774 - DNA, 16 bp, M. musculus
cttccagtgcctgaca

SEQ ID NO: 400775 - DNA, 16 bp, M. musculus
cttccagttcactctc

SEQ ID NO: 400776 - DNA, 16 bp, M. musculus
cttccagttttctttc

SEQ ID NO: 400777 - DNA, 16 bp, M. musculus
cttccataggcaccag

SEQ ID NO: 400778 - DNA, 16 bp, M. musculus
cttccatccatcaact

SEQ ID NO: 400779 - DNA, 16 bp, M. musculus
cttccatctccacctg

SEQ ID NO: 400780 - DNA, 16 bp, M. musculus
cttccatcttcttgat

SEQ ID NO: 400781 - DNA, 16 bp, M. musculus
cttccatcttgtattc

SEQ ID NO: 400782 - DNA, 16 bp, M. musculus
cttccatgagtatttt

SEQ ID NO: 400783 - DNA, 16 bp, M. musculus
cttccatgattttgtt

SEQ ID NO: 400784 - DNA, 16 bp, M. musculus
cttccatggactcagg

SEQ ID NO: 400785 - DNA, 16 bp, M. musculus
cttccatgggcaccag

SEQ ID NO: 400786 - DNA, 16 bp, M. musculus
cttccatggggttccc

SEQ ID NO: 400787 - DNA, 16 bp, M. musculus
cttccatgtgtatttt

SEQ ID NO: 400788 - DNA, 16 bp, M. musculus
cttccatgtgtgtttt

SEQ ID NO: 400789 - DNA, 16 bp, M. musculus
cttccatttcagctcc

SEQ ID NO: 400790 - DNA, 16 bp, M. musculus
cttccatttgtgtgtg

SEQ ID NO: 400791 - DNA, 16 bp, M. musculus
cttccatttttacatc

SEQ ID NO: 400792 - DNA, 16 bp, M. musculus
cttcccaaaacagttc

SEQ ID NO: 400793 - DNA, 16 bp, M. musculus
cttcccaaaagatttc

SEQ ID NO: 400794 - DNA, 16 bp, M. musculus
cttcccaaacctgaag

SEQ ID NO: 400795 - DNA, 16 bp, M. musculus
cttcccaacttcatgt

SEQ ID NO: 400796 - DNA, 16 bp, M. musculus
cttcccaagtattggg

SEQ ID NO: 400797 - DNA, 16 bp, M. musculus
cttcccaagtcctggg

SEQ ID NO: 400798 - DNA, 16 bp, M. musculus
cttcccaagtgctagg

SEQ ID NO: 400799 - DNA, 16 bp, M. musculus
cttcccacagccagac

SEQ ID NO: 400800 - DNA, 16 bp, M. musculus
cttcccacagtccctt

SEQ ID NO: 400801 - DNA, 16 bp, M. musculus
cttcccacatcaatca

SEQ ID NO: 400802 - DNA, 16 bp, M. musculus
cttcccacatcaatta

SEQ ID NO: 400803 - DNA, 16 bp, M. musculus
cttcccacccttgatc

SEQ ID NO: 400804 - DNA, 16 bp, M. musculus
cttcccacctcagaag

SEQ ID NO: 400805 - DNA, 16 bp, M. musculus
cttcccactctccaag

SEQ ID NO: 400806 - DNA, 16 bp, M. musculus
cttcccagaaaatgtc

SEQ ID NO: 400807 - DNA, 16 bp, M. musculus
cttcccagaagacttc

SEQ ID NO: 400808 - DNA, 16 bp, M. musculus
cttcccagaattccca

SEQ ID NO: 400809 - DNA, 16 bp, M. musculus
cttcccagacattctt

SEQ ID NO: 400810 - DNA, 16 bp, M. musculus
cttcccagagttcctt

SEQ ID NO: 400811 - DNA, 16 bp, M. musculus
cttcccagatgctggg

SEQ ID NO: 400812 - DNA, 16 bp, M. musculus
cttcccagcaaccaca

SEQ ID NO: 400813 - DNA, 16 bp, M. musculus
cttcccagcatcctct

SEQ ID NO: 400814 - DNA, 16 bp, M. musculus
cttcccagcatctgct

SEQ ID NO: 400815 - DNA, 16 bp, M. musculus
cttcccagccttttgg

SEQ ID NO: 400816 - DNA, 16 bp, M. musculus
cttcccagcttccctt

SEQ ID NO: 400817 - DNA, 16 bp, M. musculus
cttcccagcttgcttt

SEQ ID NO: 400818 - DNA, 16 bp, M. musculus
cttcccaggaccaaag

SEQ ID NO: 400819 - DNA, 16 bp, M. musculus
cttcccaggaccaagg

SEQ ID NO: 400820 - DNA, 16 bp, M. musculus
cttcccagggagattc

SEQ ID NO: 400821 - DNA, 16 bp, M. musculus
cttcccagtttccctt

SEQ ID NO: 400822 - DNA, 16 bp, M. musculus
cttcccatcttctgag

SEQ ID NO: 400823 - DNA, 16 bp, M. musculus
cttcccatttctcagt

SEQ ID NO: 400824 - DNA, 16 bp, M. musculus
cttccccaacttgctt

SEQ ID NO: 400825 - DNA, 16 bp, M. musculus
cttccccaccatgatg

SEQ ID NO: 400826 - DNA, 16 bp, M. musculus
cttccccactgagcca

SEQ ID NO: 400827 - DNA, 16 bp, M. musculus
cttccccagccctgct

SEQ ID NO: 400828 - DNA, 16 bp, M. musculus
cttccccagcttgctt

SEQ ID NO: 400829 - DNA, 16 bp, M. musculus
cttccccagggcctcc

SEQ ID NO: 400830 - DNA, 16 bp, M. musculus
cttcccccaattcttc

SEQ ID NO: 400831 - DNA, 24 bp, M. musculus
cttcccccacctgatagtcaatca

SEQ ID NO: 400832 - DNA, 16 bp, M. musculus
cttccctaacttaaag

SEQ ID NO: 400833 - DNA, 16 bp, M. musculus
cttccctcagtgatgg

SEQ ID NO: 400834 - DNA, 16 bp, M. musculus
cttccctcctcagtta

SEQ ID NO: 400835 - DNA, 16 bp, M. musculus
cttccctgaggctgct

SEQ ID NO: 400836 - DNA, 16 bp, M. musculus
cttccctgcctgcctg

SEQ ID NO: 400837 - DNA, 16 bp, M. musculus
cttccctgctgtgatg

SEQ ID NO: 400838 - DNA, 16 bp, M. musculus
cttccctggagaagac

SEQ ID NO: 400839 - DNA, 16 bp, M. musculus
cttccctggcctctca

SEQ ID NO: 400840 - DNA, 16 bp, M. musculus
cttccctggctcttac

SEQ ID NO: 400841 - DNA, 16 bp, M. musculus
cttccctgggaaagac

SEQ ID NO: 400842 - DNA, 16 bp, M. musculus
cttccctggggtatca

SEQ ID NO: 400843 - DNA, 16 bp, M. musculus
cttccctggtgctcct

SEQ ID NO: 400844 - DNA, 16 bp, M. musculus
cttccctgtcacttct

SEQ ID NO: 400845 - DNA, 16 bp, M. musculus
cttccctgtgatgcag

SEQ ID NO: 400846 - DNA, 16 bp, M. musculus
cttccctgtggctgtg

SEQ ID NO: 400847 - DNA, 16 bp, M. musculus
cttccctgttcttgat

SEQ ID NO: 400848 - DNA, 16 bp, M. musculus
cttcccttgaatccac

SEQ ID NO: 400849 - DNA, 16 bp, M. musculus
cttcccttgcatttgg

SEQ ID NO: 400850 - DNA, 16 bp, M. musculus
cttcccttgggccctc

SEQ ID NO: 400851 - DNA, 17 bp, M. musculus
cttccgaaggtcaggag

SEQ ID NO: 400852 - DNA, 48 bp, M. musculus
cttccggatccagcacccagacttgatcctgctacagtacgtggatga

SEQ ID NO: 400853 - DNA, 16 bp, M. musculus
cttcctaaactgatta

SEQ ID NO: 400854 - DNA, 16 bp, M. musculus
cttcctaaggggttgc

SEQ ID NO: 400855 - DNA, 16 bp, M. musculus
cttcctaagtgatggt

SEQ ID NO: 400856 - DNA, 16 bp, M. musculus
cttcctaatgctatga

SEQ ID NO: 400857 - DNA, 16 bp, M. musculus
cttcctaatgctgctg

SEQ ID NO: 400858 - DNA, 16 bp, M. musculus
cttcctaatgctgggg

SEQ ID NO: 400859 - DNA, 16 bp, M. musculus
cttcctacctcagcct

SEQ ID NO: 400860 - DNA, 16 bp, M. musculus
cttcctagaaggggga

SEQ ID NO: 400861 - DNA, 17 bp, M. musculus
cttcctaggtaagggct

SEQ ID NO: 400862 - DNA, 16 bp, M. musculus
cttcctagtgctgtga

SEQ ID NO: 400863 - DNA, 16 bp, M. musculus
cttcctatgatcctgg

SEQ ID NO: 400864 - DNA, 16 bp, M. musculus
cttcctatggcttgct

SEQ ID NO: 400865 - DNA, 16 bp, M. musculus
cttcctatggggctac

SEQ ID NO: 400866 - DNA, 16 bp, M. musculus
cttcctatggggtctc

SEQ ID NO: 400867 - DNA, 16 bp, M. musculus
cttcctcaaccccatc

SEQ ID NO: 400868 - DNA, 16 bp, M. musculus
cttcctcaagggaggc

SEQ ID NO: 400869 - DNA, 16 bp, M. musculus
cttcctcaccccagag

SEQ ID NO: 400870 - DNA, 16 bp, M. musculus
cttcctcacttgggca

SEQ ID NO: 400871 - DNA, 16 bp, M. musculus
cttcctcagactcagg

SEQ ID NO: 400872 - DNA, 16 bp, M. musculus
cttcctcagcctcctg

SEQ ID NO: 400873 - DNA, 16 bp, M. musculus
cttcctcagcttcctg

SEQ ID NO: 400874 - DNA, 16 bp, M. musculus
cttcctcagtctccca

SEQ ID NO: 400875 - DNA, 16 bp, M. musculus
cttcctcatatctaca

SEQ ID NO: 400876 - DNA, 16 bp, M. musculus
cttcctccaaagtccc

SEQ ID NO: 400877 - DNA, 16 bp, M. musculus
cttcctccaagttcct

SEQ ID NO: 400878 - DNA, 16 bp, M. musculus
cttcctccagcagcag

SEQ ID NO: 400879 - DNA, 16 bp, M. musculus
cttcctccagcagggc

SEQ ID NO: 400880 - DNA, 16 bp, M. musculus
cttcctccagctcccc

SEQ ID NO: 400881 - DNA, 16 bp, M. musculus
cttcctccagctcttc

SEQ ID NO: 400882 - DNA, 16 bp, M. musculus
cttcctccaggaagtc

SEQ ID NO: 400883 - DNA, 16 bp, M. musculus
cttcctcccaggaggc

SEQ ID NO: 400884 - DNA, 16 bp, M. musculus
cttcctccctcagaag

SEQ ID NO: 400885 - DNA, 16 bp, M. musculus
cttcctccctcagcct

SEQ ID NO: 400886 - DNA, 16 bp, M. musculus
cttcctcctacagcag

SEQ ID NO: 400887 - DNA, 16 bp, M. musculus
cttcctcctcctgtgc

SEQ ID NO: 400888 - DNA, 16 bp, M. musculus
cttcctcctctggcct

SEQ ID NO: 400889 - DNA, 16 bp, M. musculus
cttcctcctgagaagt

SEQ ID NO: 400890 - DNA, 16 bp, M. musculus
cttcctcctgctcacc

SEQ ID NO: 400891 - DNA, 16 bp, M. musculus
cttcctcctgctcctg

SEQ ID NO: 400892 - DNA, 16 bp, M. musculus
cttcctctcatggtcc

SEQ ID NO: 400893 - DNA, 16 bp, M. musculus
cttcctctctcagacc

SEQ ID NO: 400894 - DNA, 16 bp, M. musculus
cttcctctctccacaa

SEQ ID NO: 400895 - DNA, 16 bp, M. musculus
cttcctctgccctgct

SEQ ID NO: 400896 - DNA, 16 bp, M. musculus
cttcctctgcctccca

SEQ ID NO: 400897 - DNA, 16 bp, M. musculus
cttcctctgcctcctg

SEQ ID NO: 400898 - DNA, 16 bp, M. musculus
cttcctctgcctctgc

SEQ ID NO: 400899 - DNA, 16 bp, M. musculus
cttcctctggcctctg

SEQ ID NO: 400900 - DNA, 16 bp, M. musculus
cttcctctgtctccca

SEQ ID NO: 400901 - DNA, 17 bp, M. musculus
cttcctcttcatgctga

SEQ ID NO: 400902 - DNA, 16 bp, M. musculus
cttcctcttcatgttg

SEQ ID NO: 400903 - DNA, 16 bp, M. musculus
cttcctcttcctctga

SEQ ID NO: 400904 - DNA, 16 bp, M. musculus
cttcctcttcctgagg

SEQ ID NO: 400905 - DNA, 16 bp, M. musculus
cttcctcttctggcct

SEQ ID NO: 400906 - DNA, 16 bp, M. musculus
cttcctcttgcagcag

SEQ ID NO: 400907 - DNA, 16 bp, M. musculus
cttcctgaaatttaat

SEQ ID NO: 400908 - DNA, 16 bp, M. musculus
cttcctgaagacccag

SEQ ID NO: 400909 - DNA, 16 bp, M. musculus
cttcctgaagttgctt

SEQ ID NO: 400910 - DNA, 16 bp, M. musculus
cttcctgacccaggca

SEQ ID NO: 400911 - DNA, 16 bp, M. musculus
cttcctgactgaggat

SEQ ID NO: 400912 - DNA, 16 bp, M. musculus
cttcctgactgcagat

SEQ ID NO: 400913 - DNA, 16 bp, M. musculus
cttcctgaggaaccac

SEQ ID NO: 400914 - DNA, 16 bp, M. musculus
cttcctgaggaagcac

SEQ ID NO: 400915 - DNA, 16 bp, M. musculus
cttcctgagttcttta

SEQ ID NO: 400916 - DNA, 16 bp, M. musculus
cttcctgatcttcctg

SEQ ID NO: 400917 - DNA, 16 bp, M. musculus
cttcctgatgctggga

SEQ ID NO: 400918 - DNA, 16 bp, M. musculus
cttcctgattggctgc

SEQ ID NO: 400919 - DNA, 16 bp, M. musculus
cttcctgatttctttt

SEQ ID NO: 400920 - DNA, 16 bp, M. musculus
cttcctgcacctgtgt

SEQ ID NO: 400921 - DNA, 16 bp, M. musculus
cttcctgcagatccag

SEQ ID NO: 400922 - DNA, 16 bp, M. musculus
cttcctgcagcagatg

SEQ ID NO: 400923 - DNA, 16 bp, M. musculus
cttcctgcaggaggtg

SEQ ID NO: 400924 - DNA, 16 bp, M. musculus
cttcctgcatgctggg

SEQ ID NO: 400925 - DNA, 16 bp, M. musculus
cttcctgccagaggag

SEQ ID NO: 400926 - DNA, 16 bp, M. musculus
cttcctgcccctccca

SEQ ID NO: 400927 - DNA, 16 bp, M. musculus
cttcctgcccctggca

SEQ ID NO: 400928 - DNA, 16 bp, M. musculus
cttcctgcctcagccc

SEQ ID NO: 400929 - DNA, 16 bp, M. musculus
cttcctgcctcagcct

SEQ ID NO: 400930 - DNA, 16 bp, M. musculus
cttcctgcctccacct

SEQ ID NO: 400931 - DNA, 16 bp, M. musculus
cttcctgcctccagct

SEQ ID NO: 400932 - DNA, 16 bp, M. musculus
cttcctgcctcctgct

SEQ ID NO: 400933 - DNA, 16 bp, M. musculus
cttcctgcctctacct

SEQ ID NO: 400934 - DNA, 16 bp, M. musculus
cttcctgcctgccttc

SEQ ID NO: 400935 - DNA, 16 bp, M. musculus
cttcctgcctgtcact

SEQ ID NO: 400936 - DNA, 16 bp, M. musculus
cttcctgcctgtctcc

SEQ ID NO: 400937 - DNA, 16 bp, M. musculus
cttcctgccttagcct

SEQ ID NO: 400938 - DNA, 16 bp, M. musculus
cttcctgccttcatct

SEQ ID NO: 400939 - DNA, 16 bp, M. musculus
cttcctgccttcctgc

SEQ ID NO: 400940 - DNA, 16 bp, M. musculus
cttcctgcgctccagc

SEQ ID NO: 400941 - DNA, 16 bp, M. musculus
cttcctgctccagctg

SEQ ID NO: 400942 - DNA, 16 bp, M. musculus
cttcctgctctgcctc

SEQ ID NO: 400943 - DNA, 16 bp, M. musculus
cttcctgctcttctgg

SEQ ID NO: 400944 - DNA, 16 bp, M. musculus
cttcctgctgccttct

SEQ ID NO: 400945 - DNA, 16 bp, M. musculus
cttcctgctgctgctg

SEQ ID NO: 400946 - DNA, 16 bp, M. musculus
cttcctgctgcttcct

SEQ ID NO: 400947 - DNA, 16 bp, M. musculus
cttcctgctgcttgtg

SEQ ID NO: 400948 - DNA, 16 bp, M. musculus
cttcctgctggaggtg

SEQ ID NO: 400949 - DNA, 16 bp, M. musculus
cttcctgctgtgtcag

SEQ ID NO: 400950 - DNA, 16 bp, M. musculus
cttcctgcttcctgtt

SEQ ID NO: 400951 - DNA, 16 bp, M. musculus
cttcctgcttctactg

SEQ ID NO: 400952 - DNA, 16 bp, M. musculus
cttcctgcttctgctc

SEQ ID NO: 400953 - DNA, 16 bp, M. musculus
cttcctgcttctgctg

SEQ ID NO: 400954 - DNA, 16 bp, M. musculus
cttcctggaactcact

SEQ ID NO: 400955 - DNA, 16 bp, M. musculus
cttcctggaagaggtg

SEQ ID NO: 400956 - DNA, 16 bp, M. musculus
cttcctggagcctgct

SEQ ID NO: 400957 - DNA, 16 bp, M. musculus
cttcctggaggaggaa

SEQ ID NO: 400958 - DNA, 16 bp, M. musculus
cttcctggaggaggtg

SEQ ID NO: 400959 - DNA, 16 bp, M. musculus
cttcctggaggtggcc

SEQ ID NO: 400960 - DNA, 16 bp, M. musculus
cttcctggatgcccag

SEQ ID NO: 400961 - DNA, 16 bp, M. musculus
cttcctggccatgatg

SEQ ID NO: 400962 - DNA, 16 bp, M. musculus
cttcctggccctggga

SEQ ID NO: 400963 - DNA, 16 bp, M. musculus
cttcctggccctggtg

SEQ ID NO: 400964 - DNA, 16 bp, M. musculus
cttcctggctgccttc

SEQ ID NO: 400965 - DNA, 16 bp, M. musculus
cttcctggcttgcttt

SEQ ID NO: 400966 - DNA, 16 bp, M. musculus
cttcctgggccagagg

SEQ ID NO: 400967 - DNA, 16 bp, M. musculus
cttcctgggctgagca

SEQ ID NO: 400968 - DNA, 16 bp, M. musculus
cttcctgggtctgggt

SEQ ID NO: 400969 - DNA, 16 bp, M. musculus
cttcctggtccaagga

SEQ ID NO: 400970 - DNA, 16 bp, M. musculus
cttcctggtccctcct

SEQ ID NO: 400971 - DNA, 16 bp, M. musculus
cttcctggtcctggta

SEQ ID NO: 400972 - DNA, 16 bp, M. musculus
cttcctggtgccccct

SEQ ID NO: 400973 - DNA, 16 bp, M. musculus
cttcctggtgtccctt

SEQ ID NO: 400974 - DNA, 16 bp, M. musculus
cttcctgtccccacct

SEQ ID NO: 400975 - DNA, 16 bp, M. musculus
cttcctgtctcagcct

SEQ ID NO: 400976 - DNA, 16 bp, M. musculus
cttcctgtctccatct

SEQ ID NO: 400977 - DNA, 16 bp, M. musculus
cttcctgtctctcatt

SEQ ID NO: 400978 - DNA, 16 bp, M. musculus
cttcctgtctctctgt

SEQ ID NO: 400979 - DNA, 16 bp, M. musculus
cttcctgtctgtcact

SEQ ID NO: 400980 - DNA, 16 bp, M. musculus
cttcctgtcttccatt

SEQ ID NO: 400981 - DNA, 16 bp, M. musculus
cttcctgtgcatggct

SEQ ID NO: 400982 - DNA, 16 bp, M. musculus
cttcctgtggtgttcc

SEQ ID NO: 400983 - DNA, 16 bp, M. musculus
cttcctgttattcttg

SEQ ID NO: 400984 - DNA, 16 bp, M. musculus
cttcctgttcctgctg

SEQ ID NO: 400985 - DNA, 16 bp, M. musculus
cttcctgtttccatct

SEQ ID NO: 400986 - DNA, 16 bp, M. musculus
cttcctgtttctactt

SEQ ID NO: 400987 - DNA, 16 bp, M. musculus
cttcctgtttgtggtt

SEQ ID NO: 400988 - DNA, 16 bp, M. musculus
cttccttaagttgatt

SEQ ID NO: 400989 - DNA, 16 bp, M. musculus
cttccttattgaattt

SEQ ID NO: 400990 - DNA, 17 bp, M. musculus
cttccttattgtcttct

SEQ ID NO: 400991 - DNA, 16 bp, M. musculus
cttccttcaaagctct

SEQ ID NO: 400992 - DNA, 16 bp, M. musculus
cttccttcaactcttc

SEQ ID NO: 400993 - DNA, 16 bp, M. musculus
cttccttcagtgatga

SEQ ID NO: 400994 - DNA, 16 bp, M. musculus
cttccttcctgcctgc

SEQ ID NO: 400995 - DNA, 16 bp, M. musculus
cttccttccttaagct

SEQ ID NO: 400996 - DNA, 16 bp, M. musculus
cttccttccttccagg

SEQ ID NO: 400997 - DNA, 16 bp, M. musculus
cttccttccttcctga

SEQ ID NO: 400998 - DNA, 16 bp, M. musculus
cttccttcctttctga

SEQ ID NO: 400999 - DNA, 16 bp, M. musculus
cttccttctgagccca

SEQ ID NO: 401000 - DNA, 16 bp, M. musculus
cttccttctgtctcag

SEQ ID NO: 401001 - DNA, 16 bp, M. musculus
cttccttctgtctgtc

SEQ ID NO: 401002 - DNA, 16 bp, M. musculus
cttccttcttcagttt

SEQ ID NO: 401003 - DNA, 16 bp, M. musculus
cttccttcttccatgt

SEQ ID NO: 401004 - DNA, 16 bp, M. musculus
cttccttcttcttcag

SEQ ID NO: 401005 - DNA, 16 bp, M. musculus
cttccttctttttgat

SEQ ID NO: 401006 - DNA, 16 bp, M. musculus
cttccttgaaactctt

SEQ ID NO: 401007 - DNA, 16 bp, M. musculus
cttccttgaaagtctg

SEQ ID NO: 401008 - DNA, 16 bp, M. musculus
cttccttgaccatggt

SEQ ID NO: 401009 - DNA, 16 bp, M. musculus
cttccttgagtatttt

SEQ ID NO: 401010 - DNA, 16 bp, M. musculus
cttccttgtgtgtgtg

SEQ ID NO: 401011 - DNA, 16 bp, M. musculus
cttcctttaaaaaaat

SEQ ID NO: 401012 - DNA, 16 bp, M. musculus
cttcctttccaatctg

SEQ ID NO: 401013 - DNA, 16 bp, M. musculus
cttcctttccagttta

SEQ ID NO: 401014 - DNA, 16 bp, M. musculus
cttcctttctctagct

SEQ ID NO: 401015 - DNA, 16 bp, M. musculus
cttcctttctgagatg

SEQ ID NO: 401016 - DNA, 16 bp, M. musculus
cttcctttgatgatga

SEQ ID NO: 401017 - DNA, 16 bp, M. musculus
cttcctttggtggtga

SEQ ID NO: 401018 - DNA, 16 bp, M. musculus
cttcctttgtagacca

SEQ ID NO: 401019 - DNA, 16 bp, M. musculus
cttccttttgttcaag

SEQ ID NO: 401020 - DNA, 16 bp, M. musculus
cttccttttttattag

SEQ ID NO: 401021 - DNA, 16 bp, M. musculus
cttcgcaataccaagg

SEQ ID NO: 401022 - DNA, 16 bp, M. musculus
cttcggggccagagga

SEQ ID NO: 401023 - DNA, 16 bp, M. musculus
cttcgtcaaatggcct

SEQ ID NO: 401024 - DNA, 16 bp, M. musculus
cttcgtcttcgtcttc

SEQ ID NO: 401025 - DNA, 16 bp, M. musculus
cttctaaaagaaagca

SEQ ID NO: 401026 - DNA, 16 bp, M. musculus
cttctaaagatttatt

SEQ ID NO: 401027 - DNA, 16 bp, M. musculus
cttctaagccttcctc

SEQ ID NO: 401028 - DNA, 16 bp, M. musculus
cttctaatttgttgaa

SEQ ID NO: 401029 - DNA, 16 bp, M. musculus
cttctacagcaccatg

SEQ ID NO: 401030 - DNA, 27 bp, M. musculus
cttctacatcacaatcatcttcaaatc

SEQ ID NO: 401031 - DNA, 16 bp, M. musculus
cttctacattgggggc

SEQ ID NO: 401032 - DNA, 16 bp, M. musculus
cttctaccatgtgggc

SEQ ID NO: 401033 - DNA, 16 bp, M. musculus
cttctacctcagcttc

SEQ ID NO: 401034 - DNA, 16 bp, M. musculus
cttctacctgttcagc

SEQ ID NO: 401035 - DNA, 16 bp, M. musculus
cttctacctgtttagc

SEQ ID NO: 401036 - DNA, 16 bp, M. musculus
cttctacttctgtttt

SEQ ID NO: 401037 - DNA, 19 bp, M. musculus
cttctacttgtttagcagt

SEQ ID NO: 401038 - DNA, 16 bp, M. musculus
cttctactttcatgtc

SEQ ID NO: 401039 - DNA, 16 bp, M. musculus
cttctagaaacttggc

SEQ ID NO: 401040 - DNA, 16 bp, M. musculus
cttctagaaatgacag

SEQ ID NO: 401041 - DNA, 16 bp, M. musculus
cttctagaaatgtcag

SEQ ID NO: 401042 - DNA, 16 bp, M. musculus
cttctagaacacagga

SEQ ID NO: 401043 - DNA, 16 bp, M. musculus
cttctagaagcttctg

SEQ ID NO: 401044 - DNA, 16 bp, M. musculus
cttctagagtggttgt

SEQ ID NO: 401045 - DNA, 16 bp, M. musculus
cttctagatgcctctg

SEQ ID NO: 401046 - DNA, 16 bp, M. musculus
cttctagcctctgtga

SEQ ID NO: 401047 - DNA, 16 bp, M. musculus
cttctagtgcatctga

SEQ ID NO: 401048 - DNA, 16 bp, M. musculus
cttctatcatcttcat

SEQ ID NO: 401049 - DNA, 16 bp, M. musculus
cttctatgaggatgct

SEQ ID NO: 401050 - DNA, 16 bp, M. musculus
cttctatggtaattga

SEQ ID NO: 401051 - DNA, 16 bp, M. musculus
cttctatgtgggtgct

SEQ ID NO: 401052 - DNA, 16 bp, M. musculus
cttctattggatgaga

SEQ ID NO: 401053 - DNA, 16 bp, M. musculus
cttctattttcatgtt

SEQ ID NO: 401054 - DNA, 16 bp, M. musculus
cttctatttttacatc

SEQ ID NO: 401055 - DNA, 16 bp, M. musculus
cttctcaaagataaaa

SEQ ID NO: 401056 - DNA, 16 bp, M. musculus
cttctcaaggatacct

SEQ ID NO: 401057 - DNA, 16 bp, M. musculus
cttctcaaggatagaa

SEQ ID NO: 401058 - DNA, 16 bp, M. musculus
cttctcaatagttaca

SEQ ID NO: 401059 - DNA, 16 bp, M. musculus
cttctcacagcccaac

SEQ ID NO: 401060 - DNA, 16 bp, M. musculus
cttctcacatcaatca

SEQ ID NO: 401061 - DNA, 16 bp, M. musculus
cttctcaccctgcccc

SEQ ID NO: 401062 - DNA, 16 bp, M. musculus
cttctcactgaacctg

SEQ ID NO: 401063 - DNA, 16 bp, M. musculus
cttctcagagaagaag

SEQ ID NO: 401064 - DNA, 16 bp, M. musculus
cttctcagaggaggag

SEQ ID NO: 401065 - DNA, 16 bp, M. musculus
cttctcagcaggaggg

SEQ ID NO: 401066 - DNA, 16 bp, M. musculus
cttctcagccattcga

SEQ ID NO: 401067 - DNA, 16 bp, M. musculus
cttctcaggaccaagg

SEQ ID NO: 401068 - DNA, 16 bp, M. musculus
cttctcaggaggaaga

SEQ ID NO: 401069 - DNA, 16 bp, M. musculus
cttctcagtgagattc

SEQ ID NO: 401070 - DNA, 16 bp, M. musculus
cttctcagtgccacat

SEQ ID NO: 401071 - DNA, 16 bp, M. musculus
cttctccaaaactgat

SEQ ID NO: 401072 - DNA, 16 bp, M. musculus
cttctccagccacact

SEQ ID NO: 401073 - DNA, 17 bp, M. musculus
cttctccagccaggccc

SEQ ID NO: 401074 - DNA, 16 bp, M. musculus
cttctccagccccatg

SEQ ID NO: 401075 - DNA, 16 bp, M. musculus
cttctccagccctgcc

SEQ ID NO: 401076 - DNA, 16 bp, M. musculus
cttctccagctctgtc

SEQ ID NO: 401077 - DNA, 16 bp, M. musculus
cttctccagggaagag

SEQ ID NO: 401078 - DNA, 16 bp, M. musculus
cttctccatctctgcc

SEQ ID NO: 401079 - DNA, 16 bp, M. musculus
cttctccatctctgtc

SEQ ID NO: 401080 - DNA, 16 bp, M. musculus
cttctccatcttgctg

SEQ ID NO: 401081 - DNA, 16 bp, M. musculus
cttctccatctttatc

SEQ ID NO: 401082 - DNA, 16 bp, M. musculus
cttctccatctttgtc

SEQ ID NO: 401083 - DNA, 16 bp, M. musculus
cttctccatgctgtct

SEQ ID NO: 401084 - DNA, 16 bp, M. musculus
cttctccattgggggt

SEQ ID NO: 401085 - DNA, 16 bp, M. musculus
cttctccattgtgggc

SEQ ID NO: 401086 - DNA, 16 bp, M. musculus
cttctccatttttgtc

SEQ ID NO: 401087 - DNA, 16 bp, M. musculus
cttctcccaggaggca

SEQ ID NO: 401088 - DNA, 16 bp, M. musculus
cttctcccagtccagg

SEQ ID NO: 401089 - DNA, 16 bp, M. musculus
cttctccccagcccac

SEQ ID NO: 401090 - DNA, 16 bp, M. musculus
cttctcccccagatcc

SEQ ID NO: 401091 - DNA, 16 bp, M. musculus
cttctcctcagcacct

SEQ ID NO: 401092 - DNA, 16 bp, M. musculus
cttctcctcagctttt

SEQ ID NO: 401093 - DNA, 16 bp, M. musculus
cttctcctctgagaag

SEQ ID NO: 401094 - DNA, 16 bp, M. musculus
cttctcctctgagtgg

SEQ ID NO: 401095 - DNA, 16 bp, M. musculus
cttctcctgctcctgc

SEQ ID NO: 401096 - DNA, 16 bp, M. musculus
cttctcctggcagcct

SEQ ID NO: 401097 - DNA, 16 bp, M. musculus
cttctcctggctgcct

SEQ ID NO: 401098 - DNA, 16 bp, M. musculus
cttctcctgtttgact

SEQ ID NO: 401099 - DNA, 16 bp, M. musculus
cttctccttcagccag

SEQ ID NO: 401100 - DNA, 16 bp, M. musculus
cttctctaaggtcctg

SEQ ID NO: 401101 - DNA, 16 bp, M. musculus
cttctctaatgctgtc

SEQ ID NO: 401102 - DNA, 16 bp, M. musculus
cttctctacccaccca

SEQ ID NO: 401103 - DNA, 16 bp, M. musculus
cttctctagtccctga

SEQ ID NO: 401104 - DNA, 16 bp, M. musculus
cttctctcagcttttc

SEQ ID NO: 401105 - DNA, 16 bp, M. musculus
cttctctccaagctga

SEQ ID NO: 401106 - DNA, 16 bp, M. musculus
cttctctccagcagcc

SEQ ID NO: 401107 - DNA, 16 bp, M. musculus
cttctctccatttagt

SEQ ID NO: 401108 - DNA, 16 bp, M. musculus
cttctctccatttcca

SEQ ID NO: 401109 - DNA, 16 bp, M. musculus
cttctctccttccagt

SEQ ID NO: 401110 - DNA, 16 bp, M. musculus
cttctctccttcttag

SEQ ID NO: 401111 - DNA, 16 bp, M. musculus
cttctctctcacacac

SEQ ID NO: 401112 - DNA, 16 bp, M. musculus
cttctctctcagcctc

SEQ ID NO: 401113 - DNA, 16 bp, M. musculus
cttctctctcagctct

SEQ ID NO: 401114 - DNA, 16 bp, M. musculus
cttctctctctcaagt

SEQ ID NO: 401115 - DNA, 16 bp, M. musculus
cttctctgaagagaaa

SEQ ID NO: 401116 - DNA, 16 bp, M. musculus
cttctctgagaagaaa

SEQ ID NO: 401117 - DNA, 16 bp, M. musculus
cttctctgaggagaag

SEQ ID NO: 401118 - DNA, 16 bp, M. musculus
cttctctgcatgaccc

SEQ ID NO: 401119 - DNA, 16 bp, M. musculus
cttctctgcctctctg

SEQ ID NO: 401120 - DNA, 16 bp, M. musculus
cttctctgcctctgtg

SEQ ID NO: 401121 - DNA, 16 bp, M. musculus
cttctctgctgctgtg

SEQ ID NO: 401122 - DNA, 16 bp, M. musculus
cttctctggctctcct

SEQ ID NO: 401123 - DNA, 16 bp, M. musculus
cttctctggcttctct

SEQ ID NO: 401124 - DNA, 16 bp, M. musculus
cttctctggggaagac

SEQ ID NO: 401125 - DNA, 16 bp, M. musculus
cttctctgggtctgtg

SEQ ID NO: 401126 - DNA, 16 bp, M. musculus
cttctctgtatagccc

SEQ ID NO: 401127 - DNA, 16 bp, M. musculus
cttctctgtatagtcc

SEQ ID NO: 401128 - DNA, 16 bp, M. musculus
cttctcttcagagaag

SEQ ID NO: 401129 - DNA, 16 bp, M. musculus
cttctcttccagttcc

SEQ ID NO: 401130 - DNA, 16 bp, M. musculus
cttctcttggccatgg

SEQ ID NO: 401131 - DNA, 16 bp, M. musculus
cttctcttggcttctc

SEQ ID NO: 401132 - DNA, 16 bp, M. musculus
cttctctttcagctcc

SEQ ID NO: 401133 - DNA, 16 bp, M. musculus
cttctctttctgctgc

SEQ ID NO: 401134 - DNA, 16 bp, M. musculus
cttctctttgcagcag

SEQ ID NO: 401135 - DNA, 16 bp, M. musculus
cttctgaaacctcaaa

SEQ ID NO: 401136 - DNA, 16 bp, M. musculus
cttctgaagtgctggg

SEQ ID NO: 401137 - DNA, 16 bp, M. musculus
cttctgaattgctctg

SEQ ID NO: 401138 - DNA, 16 bp, M. musculus
cttctgacctccaagg

SEQ ID NO: 401139 - DNA, 16 bp, M. musculus
cttctgacctccctgg

SEQ ID NO: 401140 - DNA, 16 bp, M. musculus
cttctgacctctgtag

SEQ ID NO: 401141 - DNA, 16 bp, M. musculus
cttctgactatcacaa

SEQ ID NO: 401142 - DNA, 16 bp, M. musculus
cttctgacttccacag

SEQ ID NO: 401143 - DNA, 16 bp, M. musculus
cttctgagaaagatcc

SEQ ID NO: 401144 - DNA, 16 bp, M. musculus
cttctgagaagaggga

SEQ ID NO: 401145 - DNA, 16 bp, M. musculus
cttctgagaaggactg

SEQ ID NO: 401146 - DNA, 16 bp, M. musculus
cttctgagaaggggga

SEQ ID NO: 401147 - DNA, 16 bp, M. musculus
cttctgagacagggtc

SEQ ID NO: 401148 - DNA, 16 bp, M. musculus
cttctgagatagaaag

SEQ ID NO: 401149 - DNA, 16 bp, M. musculus
cttctgagatcttcat

SEQ ID NO: 401150 - DNA, 16 bp, M. musculus
cttctgagccatcttt

SEQ ID NO: 401151 - DNA, 16 bp, M. musculus
cttctgaggaagattc

SEQ ID NO: 401152 - DNA, 16 bp, M. musculus
cttctgagtgctagga

SEQ ID NO: 401153 - DNA, 16 bp, M. musculus
cttctgagtgctggca

SEQ ID NO: 401154 - DNA, 16 bp, M. musculus
cttctgatagcttctt

SEQ ID NO: 401155 - DNA, 16 bp, M. musculus
cttctgatcttcctgc

SEQ ID NO: 401156 - DNA, 16 bp, M. musculus
cttctgatgattctgt

SEQ ID NO: 401157 - DNA, 16 bp, M. musculus
cttctgatgtttttga

SEQ ID NO: 401158 - DNA, 16 bp, M. musculus
cttctgcacacacatg

SEQ ID NO: 401159 - DNA, 16 bp, M. musculus
cttctgcacagcaaag

SEQ ID NO: 401160 - DNA, 16 bp, M. musculus
cttctgcaccatcctt

SEQ ID NO: 401161 - DNA, 16 bp, M. musculus
cttctgcacctctcag

SEQ ID NO: 401162 - DNA, 16 bp, M. musculus
cttctgcacctgagtt

SEQ ID NO: 401163 - DNA, 16 bp, M. musculus
cttctgcactgggcag

SEQ ID NO: 401164 - DNA, 16 bp, M. musculus
cttctgcagcagatgg

SEQ ID NO: 401165 - DNA, 16 bp, M. musculus
cttctgcaggagcagc

SEQ ID NO: 401166 - DNA, 16 bp, M. musculus
cttctgcatcagcttc

SEQ ID NO: 401167 - DNA, 16 bp, M. musculus
cttctgcatcatctcc

SEQ ID NO: 401168 - DNA, 16 bp, M. musculus
cttctgccaggaggca

SEQ ID NO: 401169 - DNA, 18 bp, M. musculus
cttctgccaggagtctgg

SEQ ID NO: 401170 - DNA, 16 bp, M. musculus
cttctgcccagctaca

SEQ ID NO: 401171 - DNA, 16 bp, M. musculus
cttctgccccagcctc

SEQ ID NO: 401172 - DNA, 16 bp, M. musculus
cttctgcccccacctc

SEQ ID NO: 401173 - DNA, 16 bp, M. musculus
cttctgccctccacag

SEQ ID NO: 401174 - DNA, 16 bp, M. musculus
cttctgcctcagcctc

SEQ ID NO: 401175 - DNA, 16 bp, M. musculus
cttctgcctcagcctt

SEQ ID NO: 401176 - DNA, 16 bp, M. musculus
cttctgcctcagcttc

SEQ ID NO: 401177 - DNA, 16 bp, M. musculus
cttctgcctcagtctc

SEQ ID NO: 401178 - DNA, 16 bp, M. musculus
cttctgcctccacttc

SEQ ID NO: 401179 - DNA, 16 bp, M. musculus
cttctgcctcctgggt

SEQ ID NO: 401180 - DNA, 16 bp, M. musculus
cttctgcctctacctc

SEQ ID NO: 401181 - DNA, 16 bp, M. musculus
cttctgcctctcaagt

SEQ ID NO: 401182 - DNA, 16 bp, M. musculus
cttctgcctctctgcc

SEQ ID NO: 401183 - DNA, 16 bp, M. musculus
cttctgcctctgctct

SEQ ID NO: 401184 - DNA, 16 bp, M. musculus
cttctgcctctggagt

SEQ ID NO: 401185 - DNA, 16 bp, M. musculus
cttctgcctgtcccaa

SEQ ID NO: 401186 - DNA, 16 bp, M. musculus
cttctgcctgtcccag

SEQ ID NO: 401187 - DNA, 16 bp, M. musculus
cttctgccttacagaa

SEQ ID NO: 401188 - DNA, 16 bp, M. musculus
cttctgctccaccttc

SEQ ID NO: 401189 - DNA, 16 bp, M. musculus
cttctgctccatcttc

SEQ ID NO: 401190 - DNA, 16 bp, M. musculus
cttctgctcctgctcc

SEQ ID NO: 401191 - DNA, 16 bp, M. musculus
cttctgctcttcctgc

SEQ ID NO: 401192 - DNA, 16 bp, M. musculus
cttctgctgacttgtg

SEQ ID NO: 401193 - DNA, 16 bp, M. musculus
cttctgctgctgcagt

SEQ ID NO: 401194 - DNA, 16 bp, M. musculus
cttctgctgctgcttc

SEQ ID NO: 401195 - DNA, 16 bp, M. musculus
cttctgctgcttctgc

SEQ ID NO: 401196 - DNA, 16 bp, M. musculus
cttctgctggaaacct

SEQ ID NO: 401197 - DNA, 16 bp, M. musculus
cttctgctggagacaa

SEQ ID NO: 401198 - DNA, 16 bp, M. musculus
cttctgctggagacca

SEQ ID NO: 401199 - DNA, 16 bp, M. musculus
cttctgctgtctgtgg

SEQ ID NO: 401200 - DNA, 16 bp, M. musculus
cttctgcttccacctc

SEQ ID NO: 401201 - DNA, 16 bp, M. musculus
cttctggaacaggcag

SEQ ID NO: 401202 - DNA, 16 bp, M. musculus
cttctggaagagtagt

SEQ ID NO: 401203 - DNA, 16 bp, M. musculus
cttctggaatgttctt

SEQ ID NO: 401204 - DNA, 16 bp, M. musculus
cttctggactcctcca

SEQ ID NO: 401205 - DNA, 16 bp, M. musculus
cttctggaggagcagt

SEQ ID NO: 401206 - DNA, 16 bp, M. musculus
cttctggagtgtatga

SEQ ID NO: 401207 - DNA, 16 bp, M. musculus
cttctggatatgtgcc

SEQ ID NO: 401208 - DNA, 16 bp, M. musculus
cttctggccaccatgg

SEQ ID NO: 401209 - DNA, 16 bp, M. musculus
cttctggcctccacag

SEQ ID NO: 401210 - DNA, 16 bp, M. musculus
cttctggcctccatgg

SEQ ID NO: 401211 - DNA, 16 bp, M. musculus
cttctggcctcctggg

SEQ ID NO: 401212 - DNA, 16 bp, M. musculus
cttctggcctccttgg

SEQ ID NO: 401213 - DNA, 16 bp, M. musculus
cttctggcctcctttg

SEQ ID NO: 401214 - DNA, 16 bp, M. musculus
cttctggcctctgagg

SEQ ID NO: 401215 - DNA, 16 bp, M. musculus
cttctggcctctttgg

SEQ ID NO: 401216 - DNA, 16 bp, M. musculus
cttctggcctgcacac

SEQ ID NO: 401217 - DNA, 16 bp, M. musculus
cttctggcctgcagga

SEQ ID NO: 401218 - DNA, 16 bp, M. musculus
cttctggcctgcaggc

SEQ ID NO: 401219 - DNA, 16 bp, M. musculus
cttctggccttctcag

SEQ ID NO: 401220 - DNA, 16 bp, M. musculus
cttctggcctttgagg

SEQ ID NO: 401221 - DNA, 16 bp, M. musculus
cttctggcctttgcag

SEQ ID NO: 401222 - DNA, 16 bp, M. musculus
cttctggcctttgtgg

SEQ ID NO: 401223 - DNA, 16 bp, M. musculus
cttctggctattctaa

SEQ ID NO: 401224 - DNA, 16 bp, M. musculus
cttctggctcctcctc

SEQ ID NO: 401225 - DNA, 16 bp, M. musculus
cttctggctctcacag

SEQ ID NO: 401226 - DNA, 16 bp, M. musculus
cttctggctgtcttct

SEQ ID NO: 401227 - DNA, 16 bp, M. musculus
cttctggcttccatgg

SEQ ID NO: 401228 - DNA, 16 bp, M. musculus
cttctggcttcctttg

SEQ ID NO: 401229 - DNA, 16 bp, M. musculus
cttctggcttctacaa

SEQ ID NO: 401230 - DNA, 16 bp, M. musculus
cttctggcttctggct

SEQ ID NO: 401231 - DNA, 16 bp, M. musculus
cttctggcttctgtgg

SEQ ID NO: 401232 - DNA, 16 bp, M. musculus
cttctgggaaatgttt

SEQ ID NO: 401233 - DNA, 16 bp, M. musculus
cttctgggacaagcag

SEQ ID NO: 401234 - DNA, 16 bp, M. musculus
cttctgggacacaatg

SEQ ID NO: 401235 - DNA, 16 bp, M. musculus
cttctgggacatcagt

SEQ ID NO: 401236 - DNA, 16 bp, M. musculus
cttctgggagaatcac

SEQ ID NO: 401237 - DNA, 16 bp, M. musculus
cttctgggagaggaag

SEQ ID NO: 401238 - DNA, 16 bp, M. musculus
cttctgggccatctct

SEQ ID NO: 401239 - DNA, 16 bp, M. musculus
cttctgggctggagag

SEQ ID NO: 401240 - DNA, 16 bp, M. musculus
cttctgggcttctcca

SEQ ID NO: 401241 - DNA, 16 bp, M. musculus
cttctggggaaaaaaa

SEQ ID NO: 401242 - DNA, 16 bp, M. musculus
cttctggggctggaga

SEQ ID NO: 401243 - DNA, 16 bp, M. musculus
cttctgggtgctggga

SEQ ID NO: 401244 - DNA, 16 bp, M. musculus
cttctgggttttagag

SEQ ID NO: 401245 - DNA, 16 bp, M. musculus
cttctggtcagtgctg

SEQ ID NO: 401246 - DNA, 16 bp, M. musculus
cttctggtccactcca

SEQ ID NO: 401247 - DNA, 16 bp, M. musculus
cttctggtggtgtgct

SEQ ID NO: 401248 - DNA, 16 bp, M. musculus
cttctggtgtctgtgg

SEQ ID NO: 401249 - DNA, 16 bp, M. musculus
cttctggtttccatgg

SEQ ID NO: 401250 - DNA, 16 bp, M. musculus
cttctgtaattgccag

SEQ ID NO: 401251 - DNA, 16 bp, M. musculus
cttctgtaattgtaag

SEQ ID NO: 401252 - DNA, 16 bp, M. musculus
cttctgtagctcagga

SEQ ID NO: 401253 - DNA, 16 bp, M. musculus
cttctgtatgtgtgtg

SEQ ID NO: 401254 - DNA, 16 bp, M. musculus
cttctgtatttgcaag

SEQ ID NO: 401255 - DNA, 16 bp, M. musculus
cttctgtatttgtaag

SEQ ID NO: 401256 - DNA, 16 bp, M. musculus
cttctgtctattggtt

SEQ ID NO: 401257 - DNA, 16 bp, M. musculus
cttctgtcttagtcag

SEQ ID NO: 401258 - DNA, 16 bp, M. musculus
cttctgtctttgccag

SEQ ID NO: 401259 - DNA, 16 bp, M. musculus
cttctgtgaggcaaag

SEQ ID NO: 401260 - DNA, 16 bp, M. musculus
cttctgtgatattccc

SEQ ID NO: 401261 - DNA, 16 bp, M. musculus
cttctgtgcctggctt

SEQ ID NO: 401262 - DNA, 16 bp, M. musculus
cttctgtgggaatcac

SEQ ID NO: 401263 - DNA, 16 bp, M. musculus
cttctgtgtgctggga

SEQ ID NO: 401264 - DNA, 16 bp, M. musculus
cttctgtgtttctctg

SEQ ID NO: 401265 - DNA, 16 bp, M. musculus
cttctgtgtttgcctg

SEQ ID NO: 401266 - DNA, 16 bp, M. musculus
cttctgtgtttgcttg

SEQ ID NO: 401267 - DNA, 16 bp, M. musculus
cttctgtgttttgaaa

SEQ ID NO: 401268 - DNA, 16 bp, M. musculus
cttctgtttctcttca

SEQ ID NO: 401269 - DNA, 16 bp, M. musculus
cttctgtttgctctgg

SEQ ID NO: 401270 - DNA, 16 bp, M. musculus
cttctgttttccttca

SEQ ID NO: 401271 - DNA, 16 bp, M. musculus
cttcttaaaggaacag

SEQ ID NO: 401272 - DNA, 16 bp, M. musculus
cttcttaaagtactct

SEQ ID NO: 401273 - DNA, 16 bp, M. musculus
cttcttagaaggtgga

SEQ ID NO: 401274 - DNA, 16 bp, M. musculus
cttcttcaaccaggag

SEQ ID NO: 401275 - DNA, 16 bp, M. musculus
cttcttcaacttcttc

SEQ ID NO: 401276 - DNA, 16 bp, M. musculus
cttcttcagcttcttc

SEQ ID NO: 401277 - DNA, 16 bp, M. musculus
cttcttcatcatcttc

SEQ ID NO: 401278 - DNA, 16 bp, M. musculus
cttcttcatccccaag

SEQ ID NO: 401279 - DNA, 16 bp, M. musculus
cttcttcatgtcctct

SEQ ID NO: 401280 - DNA, 16 bp, M. musculus
cttcttcattggggac

SEQ ID NO: 401281 - DNA, 16 bp, M. musculus
cttcttcattgttgtt

SEQ ID NO: 401282 - DNA, 16 bp, M. musculus
cttcttcatttacatt

SEQ ID NO: 401283 - DNA, 16 bp, M. musculus
cttcttccagctcttc

SEQ ID NO: 401284 - DNA, 16 bp, M. musculus
cttcttccagctttcc

SEQ ID NO: 401285 - DNA, 16 bp, M. musculus
cttcttccagctttct

SEQ ID NO: 401286 - DNA, 16 bp, M. musculus
cttcttccaggcagct

SEQ ID NO: 401287 - DNA, 16 bp, M. musculus
cttcttcctcagccag

SEQ ID NO: 401288 - DNA, 16 bp, M. musculus
cttcttcctcagcctc

SEQ ID NO: 401289 - DNA, 16 bp, M. musculus
cttcttcctcagcttc

SEQ ID NO: 401290 - DNA, 16 bp, M. musculus
cttcttcctggccctg

SEQ ID NO: 401291 - DNA, 16 bp, M. musculus
cttcttcctgtggaaa

SEQ ID NO: 401292 - DNA, 16 bp, M. musculus
cttcttccttcaggtc

SEQ ID NO: 401293 - DNA, 16 bp, M. musculus
cttcttctaagaagga

SEQ ID NO: 401294 - DNA, 16 bp, M. musculus
cttcttctaagcacct

SEQ ID NO: 401295 - DNA, 16 bp, M. musculus
cttcttctcagctcct

SEQ ID NO: 401296 - DNA, 16 bp, M. musculus
cttcttctctgagaag

SEQ ID NO: 401297 - DNA, 16 bp, M. musculus
cttcttctgcctccca

SEQ ID NO: 401298 - DNA, 16 bp, M. musculus
cttcttctgcctcctg

SEQ ID NO: 401299 - DNA, 16 bp, M. musculus
cttcttctgctgctgc

SEQ ID NO: 401300 - DNA, 16 bp, M. musculus
cttcttctgctgcttc

SEQ ID NO: 401301 - DNA, 16 bp, M. musculus
cttcttctggtgtgca

SEQ ID NO: 401302 - DNA, 16 bp, M. musculus
cttcttctgtgatgtt

SEQ ID NO: 401303 - DNA, 16 bp, M. musculus
cttcttcttcatcatc

SEQ ID NO: 401304 - DNA, 16 bp, M. musculus
cttcttcttctgctgc

SEQ ID NO: 401305 - DNA, 16 bp, M. musculus
cttcttcttttaaaaa

SEQ ID NO: 401306 - DNA, 16 bp, M. musculus
cttcttcttttcaaat

SEQ ID NO: 401307 - DNA, 16 bp, M. musculus
cttcttgagatctttg

SEQ ID NO: 401308 - DNA, 16 bp, M. musculus
cttcttgagcttcagg

SEQ ID NO: 401309 - DNA, 16 bp, M. musculus
cttcttgagtcctttg

SEQ ID NO: 401310 - DNA, 16 bp, M. musculus
cttcttgccatcagca

SEQ ID NO: 401311 - DNA, 16 bp, M. musculus
cttcttgctcctgctc

SEQ ID NO: 401312 - DNA, 16 bp, M. musculus
cttcttgctgcttctg

SEQ ID NO: 401313 - DNA, 16 bp, M. musculus
cttcttgcttctgcct

SEQ ID NO: 401314 - DNA, 16 bp, M. musculus
cttcttggacctggca

SEQ ID NO: 401315 - DNA, 16 bp, M. musculus
cttcttggagacaggg

SEQ ID NO: 401316 - DNA, 16 bp, M. musculus
cttcttggatttcttt

SEQ ID NO: 401317 - DNA, 16 bp, M. musculus
cttcttggcaacagca

SEQ ID NO: 401318 - DNA, 16 bp, M. musculus
cttcttggccctggcc

SEQ ID NO: 401319 - DNA, 22 bp, M. musculus
cttcttggccctggcgttcccc

SEQ ID NO: 401320 - DNA, 16 bp, M. musculus
cttcttgggcagcagt

SEQ ID NO: 401321 - DNA, 16 bp, M. musculus
cttcttgggtgtattt

SEQ ID NO: 401322 - DNA, 16 bp, M. musculus
cttcttggtcctggca

SEQ ID NO: 401323 - DNA, 16 bp, M. musculus
cttcttggtgtgtgtg

SEQ ID NO: 401324 - DNA, 16 bp, M. musculus
cttcttgtaggcagga

SEQ ID NO: 401325 - DNA, 16 bp, M. musculus
cttcttgtggaatcac

SEQ ID NO: 401326 - DNA, 16 bp, M. musculus
cttcttgttaaaagtc

SEQ ID NO: 401327 - DNA, 16 bp, M. musculus
cttctttaatttttga

SEQ ID NO: 401328 - DNA, 16 bp, M. musculus
cttctttacttgtggc

SEQ ID NO: 401329 - DNA, 16 bp, M. musculus
cttctttccaatttgt

SEQ ID NO: 401330 - DNA, 16 bp, M. musculus
cttctttccattggat

SEQ ID NO: 401331 - DNA, 16 bp, M. musculus
cttctttcctgtccca

SEQ ID NO: 401332 - DNA, 16 bp, M. musculus
cttctttctcagcagt

SEQ ID NO: 401333 - DNA, 18 bp, M. musculus
cttctttctgcaccacct

SEQ ID NO: 401334 - DNA, 16 bp, M. musculus
cttctttgaagctgtt

SEQ ID NO: 401335 - DNA, 16 bp, M. musculus
cttctttgaaggtttg

SEQ ID NO: 401336 - DNA, 16 bp, M. musculus
cttctttgaatccatg

SEQ ID NO: 401337 - DNA, 16 bp, M. musculus
cttctttgactgaacc

SEQ ID NO: 401338 - DNA, 16 bp, M. musculus
cttctttgagacaggg

SEQ ID NO: 401339 - DNA, 16 bp, M. musculus
cttctttgaggagaag

SEQ ID NO: 401340 - DNA, 16 bp, M. musculus
cttctttgagttcttt

SEQ ID NO: 401341 - DNA, 16 bp, M. musculus
cttctttgtgtctgtg

SEQ ID NO: 401342 - DNA, 16 bp, M. musculus
cttcttttcctgggct

SEQ ID NO: 401343 - DNA, 16 bp, M. musculus
cttcttttctgagaca

SEQ ID NO: 401344 - DNA, 16 bp, M. musculus
cttcttttggtctgtg

SEQ ID NO: 401345 - DNA, 16 bp, M. musculus
cttctttttaaaaaga

SEQ ID NO: 401346 - DNA, 16 bp, M. musculus
cttctttttgttcaag

SEQ ID NO: 401347 - DNA, 16 bp, M. musculus
cttctttttgtttcca

SEQ ID NO: 401348 - DNA, 16 bp, M. musculus
cttcttttttaaaaaa

SEQ ID NO: 401349 - DNA, 16 bp, M. musculus
cttcttttttaaaaag

SEQ ID NO: 401350 - DNA, 16 bp, M. musculus
cttgaaaaaacaaaac

SEQ ID NO: 401351 - DNA, 16 bp, M. musculus
cttgaaaaaggaaaaa

SEQ ID NO: 401352 - DNA, 16 bp, M. musculus
cttgaaaaccaaacca

SEQ ID NO: 401353 - DNA, 16 bp, M. musculus
cttgaaaatattatcc

SEQ ID NO: 401354 - DNA, 16 bp, M. musculus
cttgaaaattaaaata

SEQ ID NO: 401355 - DNA, 16 bp, M. musculus
cttgaaactcactttg

SEQ ID NO: 401356 - DNA, 16 bp, M. musculus
cttgaaactctttcct

SEQ ID NO: 401357 - DNA, 16 bp, M. musculus
cttgaaatatcttttt

SEQ ID NO: 401358 - DNA, 16 bp, M. musculus
cttgaaatcacagaga

SEQ ID NO: 401359 - DNA, 16 bp, M. musculus
cttgaaatgtaaataa

SEQ ID NO: 401360 - DNA, 16 bp, M. musculus
cttgaaccaggctacc

SEQ ID NO: 401361 - DNA, 16 bp, M. musculus
cttgaacccacagaga

SEQ ID NO: 401362 - DNA, 16 bp, M. musculus
cttgaactcacagaaa

SEQ ID NO: 401363 - DNA, 16 bp, M. musculus
cttgaactcacagatc

SEQ ID NO: 401364 - DNA, 16 bp, M. musculus
cttgaactcactgaga

SEQ ID NO: 401365 - DNA, 16 bp, M. musculus
cttgaactcagagatc

SEQ ID NO: 401366 - DNA, 16 bp, M. musculus
cttgaactcctgaact

SEQ ID NO: 401367 - DNA, 16 bp, M. musculus
cttgaactcctgggct

SEQ ID NO: 401368 - DNA, 16 bp, M. musculus
cttgaactctgagatc

SEQ ID NO: 401369 - DNA, 16 bp, M. musculus
cttgaactgtgagcca

SEQ ID NO: 401370 - DNA, 16 bp, M. musculus
cttgaacttgttatgt

SEQ ID NO: 401371 - DNA, 16 bp, M. musculus
cttgaagaaatgttca

SEQ ID NO: 401372 - DNA, 16 bp, M. musculus
cttgaagaagttatga

SEQ ID NO: 401373 - DNA, 16 bp, M. musculus
cttgaagacaggagcc

SEQ ID NO: 401374 - DNA, 16 bp, M. musculus
cttgaagtcacagaga

SEQ ID NO: 401375 - DNA, 16 bp, M. musculus
cttgaagttcttatca

SEQ ID NO: 401376 - DNA, 16 bp, M. musculus
cttgaatccacagata

SEQ ID NO: 401377 - DNA, 16 bp, M. musculus
cttgaattattattat

SEQ ID NO: 401378 - DNA, 16 bp, M. musculus
cttgaattcagtttgc

SEQ ID NO: 401379 - DNA, 16 bp, M. musculus
cttgaatttagaaatc

SEQ ID NO: 401380 - DNA, 16 bp, M. musculus
cttgaatttcatccag

SEQ ID NO: 401381 - DNA, 16 bp, M. musculus
cttgaatttgatcccc

SEQ ID NO: 401382 - DNA, 16 bp, M. musculus
cttgaatttttaatct

SEQ ID NO: 401383 - DNA, 16 bp, M. musculus
cttgacacaacccaga

SEQ ID NO: 401384 - DNA, 16 bp, M. musculus
cttgacacaagctagg

SEQ ID NO: 401385 - DNA, 16 bp, M. musculus
cttgacacagctggac

SEQ ID NO: 401386 - DNA, 16 bp, M. musculus
cttgacactgtgagag

SEQ ID NO: 401387 - DNA, 16 bp, M. musculus
cttgacaggatctaga

SEQ ID NO: 401388 - DNA, 16 bp, M. musculus
cttgacattcttgtca

SEQ ID NO: 401389 - DNA, 16 bp, M. musculus
cttgaccaagatggaa

SEQ ID NO: 401390 - DNA, 17 bp, M. musculus
cttgaccaatgttacct

SEQ ID NO: 401391 - DNA, 16 bp, M. musculus
cttgaccctgtggaaa

SEQ ID NO: 401392 - DNA, 16 bp, M. musculus
cttgacctctttttgt

SEQ ID NO: 401393 - DNA, 16 bp, M. musculus
cttgaccttttcccct

SEQ ID NO: 401394 - DNA, 16 bp, M. musculus
cttgactctagctcca

SEQ ID NO: 401395 - DNA, 16 bp, M. musculus
cttgactctgcctccc

SEQ ID NO: 401396 - DNA, 16 bp, M. musculus
cttgactgtcactata

SEQ ID NO: 401397 - DNA, 16 bp, M. musculus
cttgactgtgaatgtg

SEQ ID NO: 401398 - DNA, 16 bp, M. musculus
cttgacttaaaaaaaa

SEQ ID NO: 401399 - DNA, 16 bp, M. musculus
cttgacttttgacaaa

SEQ ID NO: 401400 - DNA, 16 bp, M. musculus
cttgagaatttcatat

SEQ ID NO: 401401 - DNA, 16 bp, M. musculus
cttgagaatttttttt

SEQ ID NO: 401402 - DNA, 16 bp, M. musculus
cttgagacaagatctc

SEQ ID NO: 401403 - DNA, 16 bp, M. musculus
cttgagacaaggtctc

SEQ ID NO: 401404 - DNA, 16 bp, M. musculus
cttgagacagagtctc

SEQ ID NO: 401405 - DNA, 16 bp, M. musculus
cttgagagagacagag

SEQ ID NO: 401406 - DNA, 16 bp, M. musculus
cttgagaggacacgtg

SEQ ID NO: 401407 - DNA, 16 bp, M. musculus
cttgagaggctttgcc

SEQ ID NO: 401408 - DNA, 16 bp, M. musculus
cttgagatcactggtg

SEQ ID NO: 401409 - DNA, 16 bp, M. musculus
cttgagcacaggagac

SEQ ID NO: 401410 - DNA, 16 bp, M. musculus
cttgagcaggctaaac

SEQ ID NO: 401411 - DNA, 16 bp, M. musculus
cttgagcccaggaatt

SEQ ID NO: 401412 - DNA, 16 bp, M. musculus
cttgagctcacagaga

SEQ ID NO: 401413 - DNA, 16 bp, M. musculus
cttgagctgggtccca

SEQ ID NO: 401414 - DNA, 16 bp, M. musculus
cttgaggagcaagcca

SEQ ID NO: 401415 - DNA, 16 bp, M. musculus
cttgaggccagcctgg

SEQ ID NO: 401416 - DNA, 16 bp, M. musculus
cttgagggtgttgggc

SEQ ID NO: 401417 - DNA, 16 bp, M. musculus
cttgagtattctaggt

SEQ ID NO: 401418 - DNA, 16 bp, M. musculus
cttgagtccctgccct

SEQ ID NO: 401419 - DNA, 16 bp, M. musculus
cttgagtctccagttc

SEQ ID NO: 401420 - DNA, 16 bp, M. musculus
cttgagtgaccaagaa

SEQ ID NO: 401421 - DNA, 16 bp, M. musculus
cttgagtgctttctct

SEQ ID NO: 401422 - DNA, 16 bp, M. musculus
cttgagtgtgtttgct

SEQ ID NO: 401423 - DNA, 16 bp, M. musculus
cttgagttcaaatccc

SEQ ID NO: 401424 - DNA, 16 bp, M. musculus
cttgagttcaagtcct

SEQ ID NO: 401425 - DNA, 16 bp, M. musculus
cttgagttccagtcat

SEQ ID NO: 401426 - DNA, 16 bp, M. musculus
cttgagttcctgccct

SEQ ID NO: 401427 - DNA, 16 bp, M. musculus
cttgagttcctgttct

SEQ ID NO: 401428 - DNA, 16 bp, M. musculus
cttgagttctctgtat

SEQ ID NO: 401429 - DNA, 16 bp, M. musculus
cttgagtttgaggcca

SEQ ID NO: 401430 - DNA, 16 bp, M. musculus
cttgagtttgattatg

SEQ ID NO: 401431 - DNA, 16 bp, M. musculus
cttgagttttactata

SEQ ID NO: 401432 - DNA, 16 bp, M. musculus
cttgagttttctgttt

SEQ ID NO: 401433 - DNA, 16 bp, M. musculus
cttgatacagctggag

SEQ ID NO: 401434 - DNA, 16 bp, M. musculus
cttgatcatggtgaat

SEQ ID NO: 401435 - DNA, 16 bp, M. musculus
cttgatccaaaggcaa

SEQ ID NO: 401436 - DNA, 16 bp, M. musculus
cttgatcctttagggc

SEQ ID NO: 401437 - DNA, 16 bp, M. musculus
cttgatctctctctct

SEQ ID NO: 401438 - DNA, 16 bp, M. musculus
cttgatctgaaggcaa

SEQ ID NO: 401439 - DNA, 16 bp, M. musculus
cttgatctgactgcag

SEQ ID NO: 401440 - DNA, 16 bp, M. musculus
cttgatcttgatcttg

SEQ ID NO: 401441 - DNA, 16 bp, M. musculus
cttgatctttgaaaaa

SEQ ID NO: 401442 - DNA, 16 bp, M. musculus
cttgatctttgacata

SEQ ID NO: 401443 - DNA, 16 bp, M. musculus
cttgatctttgccaaa

SEQ ID NO: 401444 - DNA, 16 bp, M. musculus
cttgatgaacaaagac

SEQ ID NO: 401445 - DNA, 16 bp, M. musculus
cttgatgaatatgaag

SEQ ID NO: 401446 - DNA, 16 bp, M. musculus
cttgatgagcagagac

SEQ ID NO: 401447 - DNA, 16 bp, M. musculus
cttgatgatcatggac

SEQ ID NO: 401448 - DNA, 16 bp, M. musculus
cttgatgcttctcaga

SEQ ID NO: 401449 - DNA, 16 bp, M. musculus
cttgatggaaaaagct

SEQ ID NO: 401450 - DNA, 16 bp, M. musculus
cttgatggtggcacta

SEQ ID NO: 401451 - DNA, 16 bp, M. musculus
cttgatgttctgtcag

SEQ ID NO: 401452 - DNA, 16 bp, M. musculus
cttgattaaaaaaaaa

SEQ ID NO: 401453 - DNA, 16 bp, M. musculus
cttgattattttgttc

SEQ ID NO: 401454 - DNA, 16 bp, M. musculus
cttgattctaaagcca

SEQ ID NO: 401455 - DNA, 16 bp, M. musculus
cttgattctgatgaga

SEQ ID NO: 401456 - DNA, 16 bp, M. musculus
cttgattctgtgaagg

SEQ ID NO: 401457 - DNA, 16 bp, M. musculus
cttgattctttggagc

SEQ ID NO: 401458 - DNA, 16 bp, M. musculus
cttgatttaaatttgg

SEQ ID NO: 401459 - DNA, 16 bp, M. musculus
cttgatttctgttaat

SEQ ID NO: 401460 - DNA, 16 bp, M. musculus
cttgattttcttctgt

SEQ ID NO: 401461 - DNA, 16 bp, M. musculus
cttgattttgtgcagg

SEQ ID NO: 401462 - DNA, 16 bp, M. musculus
cttgcaaacaataatt

SEQ ID NO: 401463 - DNA, 16 bp, M. musculus
cttgcaaactgaattc

SEQ ID NO: 401464 - DNA, 16 bp, M. musculus
cttgcaaatacagaag

SEQ ID NO: 401465 - DNA, 16 bp, M. musculus
cttgcaaatgttcatt

SEQ ID NO: 401466 - DNA, 16 bp, M. musculus
cttgcaaattttatat

SEQ ID NO: 401467 - DNA, 16 bp, M. musculus
cttgcacaaaaaactt

SEQ ID NO: 401468 - DNA, 16 bp, M. musculus
cttgcacacatacatg

SEQ ID NO: 401469 - DNA, 16 bp, M. musculus
cttgcacagacacaca

SEQ ID NO: 401470 - DNA, 21 bp, M. musculus
cttgcacctgacttcctcata

SEQ ID NO: 401471 - DNA, 16 bp, M. musculus
cttgcactcagagatc

SEQ ID NO: 401472 - DNA, 16 bp, M. musculus
cttgcacttccacatt

SEQ ID NO: 401473 - DNA, 16 bp, M. musculus
cttgcagaagaccaag

SEQ ID NO: 401474 - DNA, 16 bp, M. musculus
cttgcagaagaccaga

SEQ ID NO: 401475 - DNA, 16 bp, M. musculus
cttgcagaagactggg

SEQ ID NO: 401476 - DNA, 16 bp, M. musculus
cttgcagaagctctgc

SEQ ID NO: 401477 - DNA, 16 bp, M. musculus
cttgcagaagctttga

SEQ ID NO: 401478 - DNA, 16 bp, M. musculus
cttgcagacaggagcc

SEQ ID NO: 401479 - DNA, 16 bp, M. musculus
cttgcagagagctctg

SEQ ID NO: 401480 - DNA, 16 bp, M. musculus
cttgcagaggaccaag

SEQ ID NO: 401481 - DNA, 16 bp, M. musculus
cttgcagaggactctg

SEQ ID NO: 401482 - DNA, 16 bp, M. musculus
cttgcagaggagccag

SEQ ID NO: 401483 - DNA, 16 bp, M. musculus
cttgcagaggatccag

SEQ ID NO: 401484 - DNA, 16 bp, M. musculus
cttgcagaggccctgg

SEQ ID NO: 401485 - DNA, 16 bp, M. musculus
cttgcagatgacccag

SEQ ID NO: 401486 - DNA, 16 bp, M. musculus
cttgcagcaaatgctt

SEQ ID NO: 401487 - DNA, 16 bp, M. musculus
cttgcagccaagcctg

SEQ ID NO: 401488 - DNA, 16 bp, M. musculus
cttgcaggagctggtt

SEQ ID NO: 401489 - DNA, 16 bp, M. musculus
cttgcagggaaagtgc

SEQ ID NO: 401490 - DNA, 21 bp, M. musculus
cttgcagggaacccacgcgca

SEQ ID NO: 401491 - DNA, 16 bp, M. musculus
cttgcatctgttgttc

SEQ ID NO: 401492 - DNA, 16 bp, M. musculus
cttgcatttggaacat

SEQ ID NO: 401493 - DNA, 16 bp, M. musculus
cttgcatttgtagcat

SEQ ID NO: 401494 - DNA, 16 bp, M. musculus
cttgcattttgagcat

SEQ ID NO: 401495 - DNA, 16 bp, M. musculus
cttgccacccagcctg

SEQ ID NO: 401496 - DNA, 16 bp, M. musculus
cttgccacctagcccc

SEQ ID NO: 401497 - DNA, 16 bp, M. musculus
cttgccactctttgct

SEQ ID NO: 401498 - DNA, 16 bp, M. musculus
cttgccagagacctgg

SEQ ID NO: 401499 - DNA, 16 bp, M. musculus
cttgccagctgcagca

SEQ ID NO: 401500 - DNA, 16 bp, M. musculus
cttgcccaaggacaga

SEQ ID NO: 401501 - DNA, 16 bp, M. musculus
cttgcccaaggtcaca

SEQ ID NO: 401502 - DNA, 16 bp, M. musculus
cttgcccacctgcccc

SEQ ID NO: 401503 - DNA, 16 bp, M. musculus
cttgcccagcctgctc

SEQ ID NO: 401504 - DNA, 16 bp, M. musculus
cttgcccagtgattgg

SEQ ID NO: 401505 - DNA, 16 bp, M. musculus
cttgccccaaggaact

SEQ ID NO: 401506 - DNA, 16 bp, M. musculus
cttgccctatttggaa

SEQ ID NO: 401507 - DNA, 16 bp, M. musculus
cttgcctagcaagcac

SEQ ID NO: 401508 - DNA, 16 bp, M. musculus
cttgcctagcacgcat

SEQ ID NO: 401509 - DNA, 16 bp, M. musculus
cttgcctcagcctcca

SEQ ID NO: 401510 - DNA, 16 bp, M. musculus
cttgcctccatctccc

SEQ ID NO: 401511 - DNA, 16 bp, M. musculus
cttgcctcctagccct

SEQ ID NO: 401512 - DNA, 16 bp, M. musculus
cttgcctctacctccc

SEQ ID NO: 401513 - DNA, 16 bp, M. musculus
cttgcctctgcctcct

SEQ ID NO: 401514 - DNA, 16 bp, M. musculus
cttgcctctgtctccc

SEQ ID NO: 401515 - DNA, 16 bp, M. musculus
cttgcctctgtttcct

SEQ ID NO: 401516 - DNA, 16 bp, M. musculus
cttgcctgaggtcaca

SEQ ID NO: 401517 - DNA, 16 bp, M. musculus
cttgcctgcacagagt

SEQ ID NO: 401518 - DNA, 16 bp, M. musculus
cttgcctgcctgcctg

SEQ ID NO: 401519 - DNA, 16 bp, M. musculus
cttgcctgctccttag

SEQ ID NO: 401520 - DNA, 16 bp, M. musculus
cttgcctgcttgcttg

SEQ ID NO: 401521 - DNA, 16 bp, M. musculus
cttgcctggacagcac

SEQ ID NO: 401522 - DNA, 16 bp, M. musculus
cttgcctggacttgcc

SEQ ID NO: 401523 - DNA, 16 bp, M. musculus
cttgcctggcattcat

SEQ ID NO: 401524 - DNA, 16 bp, M. musculus
cttgcctggctccctg

SEQ ID NO: 401525 - DNA, 16 bp, M. musculus
cttgcctggcttcctg

SEQ ID NO: 401526 - DNA, 16 bp, M. musculus
cttgcctgggcagcag

SEQ ID NO: 401527 - DNA, 16 bp, M. musculus
cttgcctggtttcttg

SEQ ID NO: 401528 - DNA, 16 bp, M. musculus
cttgccttagtctcct

SEQ ID NO: 401529 - DNA, 16 bp, M. musculus
cttgccttccctggct

SEQ ID NO: 401530 - DNA, 16 bp, M. musculus
cttgccttgagttcct

SEQ ID NO: 401531 - DNA, 16 bp, M. musculus
cttgcctttaacaaca

SEQ ID NO: 401532 - DNA, 16 bp, M. musculus
cttgctaccaaacctg

SEQ ID NO: 401533 - DNA, 16 bp, M. musculus
cttgctagccaataga

SEQ ID NO: 401534 - DNA, 25 bp, M. musculus
cttgctagtgtatgcaatggtgtca

SEQ ID NO: 401535 - DNA, 16 bp, M. musculus
cttgctatatagccca

SEQ ID NO: 401536 - DNA, 16 bp, M. musculus
cttgctatgtaaccca

SEQ ID NO: 401537 - DNA, 16 bp, M. musculus
cttgctatgtagacaa

SEQ ID NO: 401538 - DNA, 16 bp, M. musculus
cttgctatgtagccca

SEQ ID NO: 401539 - DNA, 16 bp, M. musculus
cttgctattgtgaata

SEQ ID NO: 401540 - DNA, 16 bp, M. musculus
cttgctcaccctctgc

SEQ ID NO: 401541 - DNA, 16 bp, M. musculus
cttgctcacttctatc

SEQ ID NO: 401542 - DNA, 16 bp, M. musculus
cttgctcagcctgttc

SEQ ID NO: 401543 - DNA, 16 bp, M. musculus
cttgctcctctcttgc

SEQ ID NO: 401544 - DNA, 16 bp, M. musculus
cttgctccttatggct

SEQ ID NO: 401545 - DNA, 16 bp, M. musculus
cttgctctcactctct

SEQ ID NO: 401546 - DNA, 16 bp, M. musculus
cttgctctccacagct

SEQ ID NO: 401547 - DNA, 16 bp, M. musculus
cttgctctcctggctc

SEQ ID NO: 401548 - DNA, 16 bp, M. musculus
cttgctctctctgcct

SEQ ID NO: 401549 - DNA, 17 bp, M. musculus
cttgctctcttatagaa

SEQ ID NO: 401550 - DNA, 18 bp, M. musculus
cttgctctcttgcactct

SEQ ID NO: 401551 - DNA, 16 bp, M. musculus
cttgctctgcctcttg

SEQ ID NO: 401552 - DNA, 16 bp, M. musculus
cttgctctggagaccc

SEQ ID NO: 401553 - DNA, 16 bp, M. musculus
cttgctctggggatcc

SEQ ID NO: 401554 - DNA, 16 bp, M. musculus
cttgctctggtcaacc

SEQ ID NO: 401555 - DNA, 16 bp, M. musculus
cttgctgacaaaagcc

SEQ ID NO: 401556 - DNA, 17 bp, M. musculus
cttgctgacaggagcct

SEQ ID NO: 401557 - DNA, 16 bp, M. musculus
cttgctgcaagaagga

SEQ ID NO: 401558 - DNA, 16 bp, M. musculus
cttgctgcagaagaat

SEQ ID NO: 401559 - DNA, 16 bp, M. musculus
cttgctgccaagactg

SEQ ID NO: 401560 - DNA, 16 bp, M. musculus
cttgctgccaagccta

SEQ ID NO: 401561 - DNA, 16 bp, M. musculus
cttgctgccaagcctg

SEQ ID NO: 401562 - DNA, 16 bp, M. musculus
cttgctgccaaggctg

SEQ ID NO: 401563 - DNA, 16 bp, M. musculus
cttgctgccatgcctt

SEQ ID NO: 401564 - DNA, 16 bp, M. musculus
cttgctgcctctgtct

SEQ ID NO: 401565 - DNA, 16 bp, M. musculus
cttgctgctaagtctg

SEQ ID NO: 401566 - DNA, 16 bp, M. musculus
cttgctgctcttccag

SEQ ID NO: 401567 - DNA, 16 bp, M. musculus
cttgctgctgctgctg

SEQ ID NO: 401568 - DNA, 16 bp, M. musculus
cttgctgcttccacag

SEQ ID NO: 401569 - DNA, 16 bp, M. musculus
cttgctgctttcccag

SEQ ID NO: 401570 - DNA, 16 bp, M. musculus
cttgctgcttttccag

SEQ ID NO: 401571 - DNA, 16 bp, M. musculus
cttgctggcatctgcc

SEQ ID NO: 401572 - DNA, 16 bp, M. musculus
cttgctggccagtgag

SEQ ID NO: 401573 - DNA, 16 bp, M. musculus
cttgctggctgcttat

SEQ ID NO: 401574 - DNA, 16 bp, M. musculus
cttgctggtacagcta

SEQ ID NO: 401575 - DNA, 16 bp, M. musculus
cttgctggtcagccag

SEQ ID NO: 401576 - DNA, 16 bp, M. musculus
cttgctggttgagagc

SEQ ID NO: 401577 - DNA, 16 bp, M. musculus
cttgctgtcagtttgg

SEQ ID NO: 401578 - DNA, 16 bp, M. musculus
cttgctgtgcaaacct

SEQ ID NO: 401579 - DNA, 16 bp, M. musculus
cttgctgtgcaggcat

SEQ ID NO: 401580 - DNA, 16 bp, M. musculus
cttgctgtgcttgatt

SEQ ID NO: 401581 - DNA, 16 bp, M. musculus
cttgctgtggtcatgg

SEQ ID NO: 401582 - DNA, 16 bp, M. musculus
cttgctgtggtgggca

SEQ ID NO: 401583 - DNA, 16 bp, M. musculus
cttgctgtttctcctg

SEQ ID NO: 401584 - DNA, 16 bp, M. musculus
cttgcttacagttcca

SEQ ID NO: 401585 - DNA, 16 bp, M. musculus
cttgcttacagtttca

SEQ ID NO: 401586 - DNA, 16 bp, M. musculus
cttgcttagcaagcac

SEQ ID NO: 401587 - DNA, 16 bp, M. musculus
cttgcttagttagagt

SEQ ID NO: 401588 - DNA, 16 bp, M. musculus
cttgcttcaaaagaat

SEQ ID NO: 401589 - DNA, 16 bp, M. musculus
cttgcttcagcacatg

SEQ ID NO: 401590 - DNA, 16 bp, M. musculus
cttgcttcagcctccc

SEQ ID NO: 401591 - DNA, 16 bp, M. musculus
cttgcttcagtctccc

SEQ ID NO: 401592 - DNA, 16 bp, M. musculus
cttgcttccctggagt

SEQ ID NO: 401593 - DNA, 16 bp, M. musculus
cttgcttctctggtgt

SEQ ID NO: 401594 - DNA, 16 bp, M. musculus
cttgcttctgcctccc

SEQ ID NO: 401595 - DNA, 16 bp, M. musculus
cttgcttctgcttcct

SEQ ID NO: 401596 - DNA, 16 bp, M. musculus
cttgcttgcttgcttc

SEQ ID NO: 401597 - DNA, 16 bp, M. musculus
cttgcttgctttttaa

SEQ ID NO: 401598 - DNA, 16 bp, M. musculus
cttgcttggcctgctt

SEQ ID NO: 401599 - DNA, 16 bp, M. musculus
cttgcttgtttgctta

SEQ ID NO: 401600 - DNA, 16 bp, M. musculus
cttgctttaaaaaaaa

SEQ ID NO: 401601 - DNA, 16 bp, M. musculus
cttgctttcctataga

SEQ ID NO: 401602 - DNA, 16 bp, M. musculus
cttgctttcctgacat

SEQ ID NO: 401603 - DNA, 16 bp, M. musculus
cttgctttctccatct

SEQ ID NO: 401604 - DNA, 16 bp, M. musculus
cttgctttctctgcct

SEQ ID NO: 401605 - DNA, 16 bp, M. musculus
cttgctttcttcactg

SEQ ID NO: 401606 - DNA, 16 bp, M. musculus
cttgctttgcaaacat

SEQ ID NO: 401607 - DNA, 16 bp, M. musculus
cttgctttggttcagt

SEQ ID NO: 401608 - DNA, 16 bp, M. musculus
cttgcttttcatgtgt

SEQ ID NO: 401609 - DNA, 16 bp, M. musculus
cttgcttttgctttat

SEQ ID NO: 401610 - DNA, 16 bp, M. musculus
cttgctttttaaaaaa

SEQ ID NO: 401611 - DNA, 16 bp, M. musculus
cttggaaaaaaacaaa

SEQ ID NO: 401612 - DNA, 16 bp, M. musculus
cttggaaaacaaaaac

SEQ ID NO: 401613 - DNA, 16 bp, M. musculus
cttggaaaacaaaaca

SEQ ID NO: 401614 - DNA, 16 bp, M. musculus
cttggaaaaccaaaaa

SEQ ID NO: 401615 - DNA, 16 bp, M. musculus
cttggaaaactgtttt

SEQ ID NO: 401616 - DNA, 16 bp, M. musculus
cttggaaactgaacaa

SEQ ID NO: 401617 - DNA, 16 bp, M. musculus
cttggaaaggaaaggg

SEQ ID NO: 401618 - DNA, 16 bp, M. musculus
cttggaaagttcagga

SEQ ID NO: 401619 - DNA, 16 bp, M. musculus
cttggaactcactgtg

SEQ ID NO: 401620 - DNA, 16 bp, M. musculus
cttggaactcagagat

SEQ ID NO: 401621 - DNA, 16 bp, M. musculus
cttggaactggaatta

SEQ ID NO: 401622 - DNA, 16 bp, M. musculus
cttggaactggactta

SEQ ID NO: 401623 - DNA, 16 bp, M. musculus
cttggaactggagcta

SEQ ID NO: 401624 - DNA, 16 bp, M. musculus
cttggaagaaaaaaaa

SEQ ID NO: 401625 - DNA, 16 bp, M. musculus
cttggaagagaggccc

SEQ ID NO: 401626 - DNA, 16 bp, M. musculus
cttggaagagctgaga

SEQ ID NO: 401627 - DNA, 16 bp, M. musculus
cttggaagcagaggca

SEQ ID NO: 401628 - DNA, 16 bp, M. musculus
cttggaatcccaccaa

SEQ ID NO: 401629 - DNA, 16 bp, M. musculus
cttggaatgcagaggc

SEQ ID NO: 401630 - DNA, 16 bp, M. musculus
cttggaattcactctg

SEQ ID NO: 401631 - DNA, 16 bp, M. musculus
cttggaattcagcagt

SEQ ID NO: 401632 - DNA, 16 bp, M. musculus
cttggaattctgggaa

SEQ ID NO: 401633 - DNA, 16 bp, M. musculus
cttggaatttcataag

SEQ ID NO: 401634 - DNA, 16 bp, M. musculus
cttggacctgtccctg

SEQ ID NO: 401635 - DNA, 16 bp, M. musculus
cttggacttctgggaa

SEQ ID NO: 401636 - DNA, 16 bp, M. musculus
cttggacttgagattt

SEQ ID NO: 401637 - DNA, 16 bp, M. musculus
cttggacttgagcctt

SEQ ID NO: 401638 - DNA, 16 bp, M. musculus
cttggacttggccatg

SEQ ID NO: 401639 - DNA, 16 bp, M. musculus
cttggagaactctgag

SEQ ID NO: 401640 - DNA, 16 bp, M. musculus
cttggagaagagcagc

SEQ ID NO: 401641 - DNA, 16 bp, M. musculus
cttggagaagagcagt

SEQ ID NO: 401642 - DNA, 16 bp, M. musculus
cttggagaagatgaag

SEQ ID NO: 401643 - DNA, 16 bp, M. musculus
cttggagacagggtgg

SEQ ID NO: 401644 - DNA, 16 bp, M. musculus
cttggagactttacct

SEQ ID NO: 401645 - DNA, 16 bp, M. musculus
cttggagaggagtttt

SEQ ID NO: 401646 - DNA, 16 bp, M. musculus
cttggagcctcaggct

SEQ ID NO: 401647 - DNA, 16 bp, M. musculus
cttggagcctcccttt

SEQ ID NO: 401648 - DNA, 16 bp, M. musculus
cttggagctggagtca

SEQ ID NO: 401649 - DNA, 16 bp, M. musculus
cttggaggagaggaag

SEQ ID NO: 401650 - DNA, 16 bp, M. musculus
cttggaggaggtgtgg

SEQ ID NO: 401651 - DNA, 17 bp, M. musculus
cttggaggattttatct

SEQ ID NO: 401652 - DNA, 16 bp, M. musculus
cttggagtcctagcca

SEQ ID NO: 401653 - DNA, 16 bp, M. musculus
cttggagttcttgtca

SEQ ID NO: 401654 - DNA, 16 bp, M. musculus
cttggatactttctgt

SEQ ID NO: 401655 - DNA, 16 bp, M. musculus
cttggatatctctgga

SEQ ID NO: 401656 - DNA, 16 bp, M. musculus
cttggatcttctgcaa

SEQ ID NO: 401657 - DNA, 16 bp, M. musculus
cttggatgagtgggca

SEQ ID NO: 401658 - DNA, 16 bp, M. musculus
cttggatgcccacctg

SEQ ID NO: 401659 - DNA, 16 bp, M. musculus
cttggatgtcattcct

SEQ ID NO: 401660 - DNA, 16 bp, M. musculus
cttggatgttttgagt

SEQ ID NO: 401661 - DNA, 16 bp, M. musculus
cttggattcagttttt

SEQ ID NO: 401662 - DNA, 16 bp, M. musculus
cttggattctgtttgc

SEQ ID NO: 401663 - DNA, 16 bp, M. musculus
cttggattctttctct

SEQ ID NO: 401664 - DNA, 16 bp, M. musculus
cttggatttccattca

SEQ ID NO: 401665 - DNA, 16 bp, M. musculus
cttggcaaacacagaa

SEQ ID NO: 401666 - DNA, 16 bp, M. musculus
cttggcaaacctacaa

SEQ ID NO: 401667 - DNA, 16 bp, M. musculus
cttggcaacagaggta

SEQ ID NO: 401668 - DNA, 16 bp, M. musculus
cttggcaacagccagg

SEQ ID NO: 401669 - DNA, 16 bp, M. musculus
cttggcaagctccagg

SEQ ID NO: 401670 - DNA, 16 bp, M. musculus
cttggcacaagctgga

SEQ ID NO: 401671 - DNA, 16 bp, M. musculus
cttggcacagcctaga

SEQ ID NO: 401672 - DNA, 16 bp, M. musculus
cttggcagcaccagtg

SEQ ID NO: 401673 - DNA, 16 bp, M. musculus
cttggcaggaatttga

SEQ ID NO: 401674 - DNA, 16 bp, M. musculus
cttggcatcatcagaa

SEQ ID NO: 401675 - DNA, 16 bp, M. musculus
cttggccatggtgtct

SEQ ID NO: 401676 - DNA, 16 bp, M. musculus
cttggcccaggaagtg

SEQ ID NO: 401677 - DNA, 16 bp, M. musculus
cttggcccagggggtg

SEQ ID NO: 401678 - DNA, 16 bp, M. musculus
cttggccccacctcac

SEQ ID NO: 401679 - DNA, 16 bp, M. musculus
cttggccccaggtggg

SEQ ID NO: 401680 - DNA, 16 bp, M. musculus
cttggccttcacagag

SEQ ID NO: 401681 - DNA, 18 bp, M. musculus
cttggcctttgtctgata

SEQ ID NO: 401682 - DNA, 16 bp, M. musculus
cttggcgggctgcaga

SEQ ID NO: 401683 - DNA, 16 bp, M. musculus
cttggctacacagaga

SEQ ID NO: 401684 - DNA, 16 bp, M. musculus
cttggctacacagtga

SEQ ID NO: 401685 - DNA, 16 bp, M. musculus
cttggctatctttgga

SEQ ID NO: 401686 - DNA, 16 bp, M. musculus
cttggctctgggactc

SEQ ID NO: 401687 - DNA, 16 bp, M. musculus
cttggctcttccagca

SEQ ID NO: 401688 - DNA, 16 bp, M. musculus
cttggctgaagcagca

SEQ ID NO: 401689 - DNA, 16 bp, M. musculus
cttggctgacctggaa

SEQ ID NO: 401690 - DNA, 16 bp, M. musculus
cttggctggcctgaaa

SEQ ID NO: 401691 - DNA, 16 bp, M. musculus
cttggctgggcagtgg

SEQ ID NO: 401692 - DNA, 16 bp, M. musculus
cttggctggtggtcct

SEQ ID NO: 401693 - DNA, 16 bp, M. musculus
cttggctgtcctgaac

SEQ ID NO: 401694 - DNA, 16 bp, M. musculus
cttggctgtctctgct

SEQ ID NO: 401695 - DNA, 16 bp, M. musculus
cttggcttcttcatct

SEQ ID NO: 401696 - DNA, 16 bp, M. musculus
cttgggaaaaataaaa

SEQ ID NO: 401697 - DNA, 16 bp, M. musculus
cttgggaagagcagcc

SEQ ID NO: 401698 - DNA, 16 bp, M. musculus
cttgggaaggaaagag

SEQ ID NO: 401699 - DNA, 16 bp, M. musculus
cttgggaccaagacca

SEQ ID NO: 401700 - DNA, 16 bp, M. musculus
cttgggactggagaga

SEQ ID NO: 401701 - DNA, 16 bp, M. musculus
cttgggagacaggcag

SEQ ID NO: 401702 - DNA, 16 bp, M. musculus
cttgggagctctcaga

SEQ ID NO: 401703 - DNA, 16 bp, M. musculus
cttgggaggaagaagc

SEQ ID NO: 401704 - DNA, 16 bp, M. musculus
cttgggaggaagagaa

SEQ ID NO: 401705 - DNA, 16 bp, M. musculus
cttgggaggaggaggc

SEQ ID NO: 401706 - DNA, 16 bp, M. musculus
cttgggaggcagaggt

SEQ ID NO: 401707 - DNA, 16 bp, M. musculus
cttgggaggtggaagc

SEQ ID NO: 401708 - DNA, 16 bp, M. musculus
cttgggatacccaaga

SEQ ID NO: 401709 - DNA, 16 bp, M. musculus
cttgggattggagtta

SEQ ID NO: 401710 - DNA, 16 bp, M. musculus
cttgggcacaaactcc

SEQ ID NO: 401711 - DNA, 16 bp, M. musculus
cttgggcacttcagct

SEQ ID NO: 401712 - DNA, 16 bp, M. musculus
cttgggcttgagtttt

SEQ ID NO: 401713 - DNA, 16 bp, M. musculus
cttgggcttgatggcc

SEQ ID NO: 401714 - DNA, 16 bp, M. musculus
cttgggcttttgaaaa

SEQ ID NO: 401715 - DNA, 16 bp, M. musculus
cttggggaagaaaggg

SEQ ID NO: 401716 - DNA, 16 bp, M. musculus
cttggggctcactggc

SEQ ID NO: 401717 - DNA, 16 bp, M. musculus
cttggggctggagtta

SEQ ID NO: 401718 - DNA, 16 bp, M. musculus
cttggggcttgctggc

SEQ ID NO: 401719 - DNA, 16 bp, M. musculus
cttggggctttcagag

SEQ ID NO: 401720 - DNA, 16 bp, M. musculus
cttgggggaaaaaaag

SEQ ID NO: 401721 - DNA, 16 bp, M. musculus
cttgggggaagaaagg

SEQ ID NO: 401722 - DNA, 16 bp, M. musculus
cttgggggaggggaag

SEQ ID NO: 401723 - DNA, 16 bp, M. musculus
cttgggggctggagag

SEQ ID NO: 401724 - DNA, 16 bp, M. musculus
cttggggtctgaggca

SEQ ID NO: 401725 - DNA, 16 bp, M. musculus
cttggggttggagaga

SEQ ID NO: 401726 - DNA, 16 bp, M. musculus
cttgggtaatttcttt

SEQ ID NO: 401727 - DNA, 16 bp, M. musculus
cttgggtaccaccctg

SEQ ID NO: 401728 - DNA, 16 bp, M. musculus
cttgggtaccactcca

SEQ ID NO: 401729 - DNA, 16 bp, M. musculus
cttgggtatgttctct

SEQ ID NO: 401730 - DNA, 16 bp, M. musculus
cttgggtcccctgcaa

SEQ ID NO: 401731 - DNA, 16 bp, M. musculus
cttgggtcctttttct

SEQ ID NO: 401732 - DNA, 16 bp, M. musculus
cttgggtctgtggagt

SEQ ID NO: 401733 - DNA, 16 bp, M. musculus
cttgggtctgtttgct

SEQ ID NO: 401734 - DNA, 16 bp, M. musculus
cttgggtggtagaggc

SEQ ID NO: 401735 - DNA, 16 bp, M. musculus
cttgggttccatccca

SEQ ID NO: 401736 - DNA, 16 bp, M. musculus
cttggtagcaagcacc

SEQ ID NO: 401737 - DNA, 16 bp, M. musculus
cttggtcacagtgtct

SEQ ID NO: 401738 - DNA, 16 bp, M. musculus
cttggtcaccaggctg

SEQ ID NO: 401739 - DNA, 16 bp, M. musculus
cttggtcagagaagaa

SEQ ID NO: 401740 - DNA, 16 bp, M. musculus
cttggtcatgatgtct

SEQ ID NO: 401741 - DNA, 25 bp, M. musculus
cttggtcatgatgtttgtgcaggac

SEQ ID NO: 401742 - DNA, 16 bp, M. musculus
cttggtccaggaagtg

SEQ ID NO: 401743 - DNA, 16 bp, M. musculus
cttggtcccagctggt

SEQ ID NO: 401744 - DNA, 16 bp, M. musculus
cttggtccccaggtgg

SEQ ID NO: 401745 - DNA, 16 bp, M. musculus
cttggtccctcctgct

SEQ ID NO: 401746 - DNA, 16 bp, M. musculus
cttggtcctatgaagg

SEQ ID NO: 401747 - DNA, 16 bp, M. musculus
cttggtcctcctgcct

SEQ ID NO: 401748 - DNA, 16 bp, M. musculus
cttggtcctcctgtga

SEQ ID NO: 401749 - DNA, 16 bp, M. musculus
cttggtctacacagtg

SEQ ID NO: 401750 - DNA, 16 bp, M. musculus
cttggtctctctgtct

SEQ ID NO: 401751 - DNA, 16 bp, M. musculus
cttggtctctgtctct

SEQ ID NO: 401752 - DNA, 16 bp, M. musculus
cttggtctggcctcag

SEQ ID NO: 401753 - DNA, 16 bp, M. musculus
cttggtcttcctgtgg

SEQ ID NO: 401754 - DNA, 16 bp, M. musculus
cttggtcttctcattg

SEQ ID NO: 401755 - DNA, 16 bp, M. musculus
cttggtcttcttgtag

SEQ ID NO: 401756 - DNA, 16 bp, M. musculus
cttggtgaaggcatgc

SEQ ID NO: 401757 - DNA, 16 bp, M. musculus
cttggtgatgtccagg

SEQ ID NO: 401758 - DNA, 16 bp, M. musculus
cttggtgattttctca

SEQ ID NO: 401759 - DNA, 16 bp, M. musculus
cttggtgcacagacat

SEQ ID NO: 401760 - DNA, 16 bp, M. musculus
cttggtgcagctacta

SEQ ID NO: 401761 - DNA, 16 bp, M. musculus
cttggtgccccagtgt

SEQ ID NO: 401762 - DNA, 16 bp, M. musculus
cttggtgctgtttgta

SEQ ID NO: 401763 - DNA, 16 bp, M. musculus
cttggtggaaggagaa

SEQ ID NO: 401764 - DNA, 16 bp, M. musculus
cttggtggaggaagta

SEQ ID NO: 401765 - DNA, 16 bp, M. musculus
cttggtggattttttt

SEQ ID NO: 401766 - DNA, 16 bp, M. musculus
cttggtggcaaatgcc

SEQ ID NO: 401767 - DNA, 16 bp, M. musculus
cttggtggcacacacc

SEQ ID NO: 401768 - DNA, 16 bp, M. musculus
cttggtggccaggggc

SEQ ID NO: 401769 - DNA, 16 bp, M. musculus
cttggtgtctgtctct

SEQ ID NO: 401770 - DNA, 16 bp, M. musculus
cttggtgttttgatta

SEQ ID NO: 401771 - DNA, 16 bp, M. musculus
cttggttcccagttgg

SEQ ID NO: 401772 - DNA, 16 bp, M. musculus
cttggttcctccagca

SEQ ID NO: 401773 - DNA, 16 bp, M. musculus
cttggttctgaacaca

SEQ ID NO: 401774 - DNA, 16 bp, M. musculus
cttggttgacttcagc

SEQ ID NO: 401775 - DNA, 16 bp, M. musculus
cttggttgttttcagc

SEQ ID NO: 401776 - DNA, 16 bp, M. musculus
cttggtttaaaaaaaa

SEQ ID NO: 401777 - DNA, 16 bp, M. musculus
cttggtttacctctgc

SEQ ID NO: 401778 - DNA, 16 bp, M. musculus
cttggtttccccatct

SEQ ID NO: 401779 - DNA, 16 bp, M. musculus
cttggtttctgttact

SEQ ID NO: 401780 - DNA, 16 bp, M. musculus
cttgtaaaagaaagca

SEQ ID NO: 401781 - DNA, 16 bp, M. musculus
cttgtaaccccagtgc

SEQ ID NO: 401782 - DNA, 16 bp, M. musculus
cttgtaacttttgaga

SEQ ID NO: 401783 - DNA, 20 bp, M. musculus
cttgtacaccttcttcatgc

SEQ ID NO: 401784 - DNA, 16 bp, M. musculus
cttgtacaggtcttgt

SEQ ID NO: 401785 - DNA, 16 bp, M. musculus
cttgtagaagacctga

SEQ ID NO: 401786 - DNA, 16 bp, M. musculus
cttgtagtccaggctg

SEQ ID NO: 401787 - DNA, 16 bp, M. musculus
cttgtatgtatgtatg

SEQ ID NO: 401788 - DNA, 16 bp, M. musculus
cttgtattctgctgct

SEQ ID NO: 401789 - DNA, 16 bp, M. musculus
cttgtcaaccaggatg

SEQ ID NO: 401790 - DNA, 16 bp, M. musculus
cttgtcacacacacac

SEQ ID NO: 401791 - DNA, 16 bp, M. musculus
cttgtcaccactgtca

SEQ ID NO: 401792 - DNA, 16 bp, M. musculus
cttgtcactgtgacaa

SEQ ID NO: 401793 - DNA, 16 bp, M. musculus
cttgtcaggcatcaat

SEQ ID NO: 401794 - DNA, 16 bp, M. musculus
cttgtcaggtatttgg

SEQ ID NO: 401795 - DNA, 16 bp, M. musculus
cttgtcagtttcaggg

SEQ ID NO: 401796 - DNA, 16 bp, M. musculus
cttgtcatggaagctg

SEQ ID NO: 401797 - DNA, 16 bp, M. musculus
cttgtcccaaggaact

SEQ ID NO: 401798 - DNA, 16 bp, M. musculus
cttgtcccagggtctg

SEQ ID NO: 401799 - DNA, 16 bp, M. musculus
cttgtcctgacttcct

SEQ ID NO: 401800 - DNA, 16 bp, M. musculus
cttgtcctggcattcc

SEQ ID NO: 401801 - DNA, 16 bp, M. musculus
cttgtctcaaaataaa

SEQ ID NO: 401802 - DNA, 16 bp, M. musculus
cttgtctccattcttc

SEQ ID NO: 401803 - DNA, 16 bp, M. musculus
cttgtctcccactgtc

SEQ ID NO: 401804 - DNA, 16 bp, M. musculus
cttgtctcccaggaag

SEQ ID NO: 401805 - DNA, 17 bp, M. musculus
cttgtctcgaaaaaacc

SEQ ID NO: 401806 - DNA, 16 bp, M. musculus
cttgtctctaccttcc

SEQ ID NO: 401807 - DNA, 16 bp, M. musculus
cttgtctctcttactt

SEQ ID NO: 401808 - DNA, 16 bp, M. musculus
cttgtctctgcttcct

SEQ ID NO: 401809 - DNA, 16 bp, M. musculus
cttgtctctgcttctc

SEQ ID NO: 401810 - DNA, 16 bp, M. musculus
cttgtctgacctcaat

SEQ ID NO: 401811 - DNA, 16 bp, M. musculus
cttgtctgtcattata

SEQ ID NO: 401812 - DNA, 16 bp, M. musculus
cttgtctgtcctggaa

SEQ ID NO: 401813 - DNA, 16 bp, M. musculus
cttgtcttgaaaaaaa

SEQ ID NO: 401814 - DNA, 16 bp, M. musculus
cttgtcttgaaaagcc

SEQ ID NO: 401815 - DNA, 16 bp, M. musculus
cttgtcttgctcctga

SEQ ID NO: 401816 - DNA, 16 bp, M. musculus
cttgtcttttgagaca

SEQ ID NO: 401817 - DNA, 16 bp, M. musculus
cttgtgaaaacccaca

SEQ ID NO: 401818 - DNA, 16 bp, M. musculus
cttgtgaagtttcaga

SEQ ID NO: 401819 - DNA, 16 bp, M. musculus
cttgtgaccccaggag

SEQ ID NO: 401820 - DNA, 16 bp, M. musculus
cttgtgagagtcagtt

SEQ ID NO: 401821 - DNA, 16 bp, M. musculus
cttgtgatggtttgta

SEQ ID NO: 401822 - DNA, 16 bp, M. musculus
cttgtgattgcttttt

SEQ ID NO: 401823 - DNA, 16 bp, M. musculus
cttgtgatttttctct

SEQ ID NO: 401824 - DNA, 16 bp, M. musculus
cttgtgcaggcaacca

SEQ ID NO: 401825 - DNA, 16 bp, M. musculus
cttgtgcatgcatgtg

SEQ ID NO: 401826 - DNA, 16 bp, M. musculus
cttgtgcatgctatca

SEQ ID NO: 401827 - DNA, 16 bp, M. musculus
cttgtgccttggtttt

SEQ ID NO: 401828 - DNA, 16 bp, M. musculus
cttgtgctccatccaa

SEQ ID NO: 401829 - DNA, 16 bp, M. musculus
cttgtgctgcagctgg

SEQ ID NO: 401830 - DNA, 16 bp, M. musculus
cttgtggaagatcaag

SEQ ID NO: 401831 - DNA, 16 bp, M. musculus
cttgtggaagccagaa

SEQ ID NO: 401832 - DNA, 16 bp, M. musculus
cttgtggaagccagag

SEQ ID NO: 401833 - DNA, 16 bp, M. musculus
cttgtggcatggtggg

SEQ ID NO: 401834 - DNA, 16 bp, M. musculus
cttgtggctgccttct

SEQ ID NO: 401835 - DNA, 16 bp, M. musculus
cttgtgggacagagaa

SEQ ID NO: 401836 - DNA, 16 bp, M. musculus
cttgtgggagctgtgg

SEQ ID NO: 401837 - DNA, 16 bp, M. musculus
cttgtgggccttctga

SEQ ID NO: 401838 - DNA, 16 bp, M. musculus
cttgtggggcattttc

SEQ ID NO: 401839 - DNA, 16 bp, M. musculus
cttgtggggctggaga

SEQ ID NO: 401840 - DNA, 16 bp, M. musculus
cttgtgggtgtctgca

SEQ ID NO: 401841 - DNA, 16 bp, M. musculus
cttgtgggttttgcct

SEQ ID NO: 401842 - DNA, 16 bp, M. musculus
cttgtggttcctcaga

SEQ ID NO: 401843 - DNA, 16 bp, M. musculus
cttgtgtatgtgtgtg

SEQ ID NO: 401844 - DNA, 16 bp, M. musculus
cttgtgtcctgatggc

SEQ ID NO: 401845 - DNA, 16 bp, M. musculus
cttgtgtctctaattg

SEQ ID NO: 401846 - DNA, 16 bp, M. musculus
cttgtgtctggagcct

SEQ ID NO: 401847 - DNA, 16 bp, M. musculus
cttgtgtctgtagctg

SEQ ID NO: 401848 - DNA, 16 bp, M. musculus
cttgtgtgagagcaag

SEQ ID NO: 401849 - DNA, 16 bp, M. musculus
cttgtgtgctgtgtgt

SEQ ID NO: 401850 - DNA, 17 bp, M. musculus
cttgtgtggcacttctt

SEQ ID NO: 401851 - DNA, 16 bp, M. musculus
cttgtgtgtatgtgtg

SEQ ID NO: 401852 - DNA, 16 bp, M. musculus
cttgtgtgtctttaag

SEQ ID NO: 401853 - DNA, 16 bp, M. musculus
cttgtgtgtgcgtgtg

SEQ ID NO: 401854 - DNA, 16 bp, M. musculus
cttgtgtgtgtctctg

SEQ ID NO: 401855 - DNA, 16 bp, M. musculus
cttgtgtttgtgtgca

SEQ ID NO: 401856 - DNA, 16 bp, M. musculus
cttgttacacagagaa

SEQ ID NO: 401857 - DNA, 16 bp, M. musculus
cttgttagacatcagt

SEQ ID NO: 401858 - DNA, 16 bp, M. musculus
cttgttatgtagccca

SEQ ID NO: 401859 - DNA, 16 bp, M. musculus
cttgttcagcctgttt

SEQ ID NO: 401860 - DNA, 16 bp, M. musculus
cttgttccccaaccca

SEQ ID NO: 401861 - DNA, 16 bp, M. musculus
cttgttcctccagtga

SEQ ID NO: 401862 - DNA, 16 bp, M. musculus
cttgttcctgtggagg

SEQ ID NO: 401863 - DNA, 16 bp, M. musculus
cttgttccttatggct

SEQ ID NO: 401864 - DNA, 16 bp, M. musculus
cttgttctcaaccact

SEQ ID NO: 401865 - DNA, 16 bp, M. musculus
cttgttctttctgaac

SEQ ID NO: 401866 - DNA, 16 bp, M. musculus
cttgttgatattctca

SEQ ID NO: 401867 - DNA, 16 bp, M. musculus
cttgttgattttcaca

SEQ ID NO: 401868 - DNA, 17 bp, M. musculus
cttgttgattttctcaa

SEQ ID NO: 401869 - DNA, 16 bp, M. musculus
cttgttgattttgtca

SEQ ID NO: 401870 - DNA, 16 bp, M. musculus
cttgttgccatatcta

SEQ ID NO: 401871 - DNA, 16 bp, M. musculus
cttgttgctctataag

SEQ ID NO: 401872 - DNA, 16 bp, M. musculus
cttgttgctgtgacaa

SEQ ID NO: 401873 - DNA, 16 bp, M. musculus
cttgttggaagaagtt

SEQ ID NO: 401874 - DNA, 16 bp, M. musculus
cttgttggagaaaatg

SEQ ID NO: 401875 - DNA, 16 bp, M. musculus
cttgttggagaaagta

SEQ ID NO: 401876 - DNA, 16 bp, M. musculus
cttgttggagaagatg

SEQ ID NO: 401877 - DNA, 16 bp, M. musculus
cttgttggagaaggtg

SEQ ID NO: 401878 - DNA, 16 bp, M. musculus
cttgttggaggaagag

SEQ ID NO: 401879 - DNA, 16 bp, M. musculus
cttgtttatatctctc

SEQ ID NO: 401880 - DNA, 16 bp, M. musculus
cttgtttcaaaagaaa

SEQ ID NO: 401881 - DNA, 16 bp, M. musculus
cttgtttctgcctcct

SEQ ID NO: 401882 - DNA, 16 bp, M. musculus
cttgtttcttcataac

SEQ ID NO: 401883 - DNA, 16 bp, M. musculus
cttgtttgaattcctg

SEQ ID NO: 401884 - DNA, 16 bp, M. musculus
cttgtttgcatccaca

SEQ ID NO: 401885 - DNA, 16 bp, M. musculus
cttgttttaagacagg

SEQ ID NO: 401886 - DNA, 16 bp, M. musculus
cttgttttctccattt

SEQ ID NO: 401887 - DNA, 16 bp, M. musculus
cttgttttcttcatct

SEQ ID NO: 401888 - DNA, 16 bp, M. musculus
cttgttttgaattgct

SEQ ID NO: 401889 - DNA, 16 bp, M. musculus
cttgttttgattttca

SEQ ID NO: 401890 - DNA, 16 bp, M. musculus
cttgtttttaaaagaa

SEQ ID NO: 401891 - DNA, 16 bp, M. musculus
cttgtttttaaagaca

SEQ ID NO: 401892 - DNA, 16 bp, M. musculus
cttgtttttaatagca

SEQ ID NO: 401893 - DNA, 16 bp, M. musculus
cttgtttttctgagac

SEQ ID NO: 401894 - DNA, 16 bp, M. musculus
cttgtttttgagacag

SEQ ID NO: 401895 - DNA, 16 bp, M. musculus
cttgtttttttctagg

SEQ ID NO: 401896 - DNA, 16 bp, M. musculus
ctttaaaaaaaaaagt

SEQ ID NO: 401897 - DNA, 16 bp, M. musculus
ctttaaaaaaaaagta

SEQ ID NO: 401898 - DNA, 16 bp, M. musculus
ctttaaaaaaaattga

SEQ ID NO: 401899 - DNA, 16 bp, M. musculus
ctttaaaaaaagaaag

SEQ ID NO: 401900 - DNA, 16 bp, M. musculus
ctttaaaaaaatactt

SEQ ID NO: 401901 - DNA, 16 bp, M. musculus
ctttaaaaaagatttt

SEQ ID NO: 401902 - DNA, 16 bp, M. musculus
ctttaaaaaagcaaaa

SEQ ID NO: 401903 - DNA, 16 bp, M. musculus
ctttaaaaaatattct

SEQ ID NO: 401904 - DNA, 16 bp, M. musculus
ctttaaaaaatgataa

SEQ ID NO: 401905 - DNA, 16 bp, M. musculus
ctttaaaaacatattt

SEQ ID NO: 401906 - DNA, 16 bp, M. musculus
ctttaaaaaccaagaa

SEQ ID NO: 401907 - DNA, 16 bp, M. musculus
ctttaaaaaccactct

SEQ ID NO: 401908 - DNA, 16 bp, M. musculus
ctttaaaaactatacc

SEQ ID NO: 401909 - DNA, 16 bp, M. musculus
ctttaaaaataaagta

SEQ ID NO: 401910 - DNA, 16 bp, M. musculus
ctttaaaaataacatt

SEQ ID NO: 401911 - DNA, 16 bp, M. musculus
ctttaaaaatatgttt

SEQ ID NO: 401912 - DNA, 16 bp, M. musculus
ctttaaaaatcaaaca

SEQ ID NO: 401913 - DNA, 16 bp, M. musculus
ctttaaaaatgaagaa

SEQ ID NO: 401914 - DNA, 16 bp, M. musculus
ctttaaaacaaagcaa

SEQ ID NO: 401915 - DNA, 16 bp, M. musculus
ctttaaaacaaatgaa

SEQ ID NO: 401916 - DNA, 16 bp, M. musculus
ctttaaaacagaaaaa

SEQ ID NO: 401917 - DNA, 16 bp, M. musculus
ctttaaaacatatttt

SEQ ID NO: 401918 - DNA, 16 bp, M. musculus
ctttaaaacttttaaa

SEQ ID NO: 401919 - DNA, 16 bp, M. musculus
ctttaaaagaaagaaa

SEQ ID NO: 401920 - DNA, 16 bp, M. musculus
ctttaaaagaagaaaa

SEQ ID NO: 401921 - DNA, 16 bp, M. musculus
ctttaaaagtaaaaat

SEQ ID NO: 401922 - DNA, 16 bp, M. musculus
ctttaaaatgaaataa

SEQ ID NO: 401923 - DNA, 16 bp, M. musculus
ctttaaaatgatgttt

SEQ ID NO: 401924 - DNA, 16 bp, M. musculus
ctttaaaatgattttt

SEQ ID NO: 401925 - DNA, 16 bp, M. musculus
ctttaaaatgtttgtg

SEQ ID NO: 401926 - DNA, 16 bp, M. musculus
ctttaaagaaagaaag

SEQ ID NO: 401927 - DNA, 16 bp, M. musculus
ctttaaagaagaaaca

SEQ ID NO: 401928 - DNA, 16 bp, M. musculus
ctttaaagaggaaagg

SEQ ID NO: 401929 - DNA, 16 bp, M. musculus
ctttaaaggaattaat

SEQ ID NO: 401930 - DNA, 16 bp, M. musculus
ctttaaagtatttatt

SEQ ID NO: 401931 - DNA, 16 bp, M. musculus
ctttaaagttttattt

SEQ ID NO: 401932 - DNA, 16 bp, M. musculus
ctttaaataaaaaaag

SEQ ID NO: 401933 - DNA, 16 bp, M. musculus
ctttaaataaaaagaa

SEQ ID NO: 401934 - DNA, 16 bp, M. musculus
ctttaaataccccctt

SEQ ID NO: 401935 - DNA, 16 bp, M. musculus
ctttaaatatgaacaa

SEQ ID NO: 401936 - DNA, 16 bp, M. musculus
ctttaaatgccccagt

SEQ ID NO: 401937 - DNA, 16 bp, M. musculus
ctttaaattggcagag

SEQ ID NO: 401938 - DNA, 16 bp, M. musculus
ctttaacaacaaaatt

SEQ ID NO: 401939 - DNA, 16 bp, M. musculus
ctttaacacagttcct

SEQ ID NO: 401940 - DNA, 16 bp, M. musculus
ctttaaccccaacact

SEQ ID NO: 401941 - DNA, 16 bp, M. musculus
ctttaaccccagcact

SEQ ID NO: 401942 - DNA, 16 bp, M. musculus
ctttaaccccagcatt

SEQ ID NO: 401943 - DNA, 16 bp, M. musculus
ctttaacctcccttgt

SEQ ID NO: 401944 - DNA, 16 bp, M. musculus
ctttaaccttggcttg

SEQ ID NO: 401945 - DNA, 16 bp, M. musculus
ctttaactcagaaatc

SEQ ID NO: 401946 - DNA, 16 bp, M. musculus
ctttaactccagttcc

SEQ ID NO: 401947 - DNA, 16 bp, M. musculus
ctttaacttcccttct

SEQ ID NO: 401948 - DNA, 16 bp, M. musculus
ctttaagaaacagaaa

SEQ ID NO: 401949 - DNA, 16 bp, M. musculus
ctttaagaagactgtt

SEQ ID NO: 401950 - DNA, 16 bp, M. musculus
ctttaagaccctcctc

SEQ ID NO: 401951 - DNA, 16 bp, M. musculus
ctttaagcccagcact

SEQ ID NO: 401952 - DNA, 16 bp, M. musculus
ctttaaggaaaagaaa

SEQ ID NO: 401953 - DNA, 16 bp, M. musculus
ctttaaggaattctac

SEQ ID NO: 401954 - DNA, 16 bp, M. musculus
ctttaaggcattttct

SEQ ID NO: 401955 - DNA, 16 bp, M. musculus
ctttaaggtgtgctgt

SEQ ID NO: 401956 - DNA, 16 bp, M. musculus
ctttaagtgtgtgtgt

SEQ ID NO: 401957 - DNA, 16 bp, M. musculus
ctttaagttcttctca

SEQ ID NO: 401958 - DNA, 16 bp, M. musculus
ctttaataaaagaaaa

SEQ ID NO: 401959 - DNA, 16 bp, M. musculus
ctttaataaagtttct

SEQ ID NO: 401960 - DNA, 16 bp, M. musculus
ctttaataagggttct

SEQ ID NO: 401961 - DNA, 16 bp, M. musculus
ctttaatacagttcct

SEQ ID NO: 401962 - DNA, 16 bp, M. musculus
ctttaataccagcact

SEQ ID NO: 401963 - DNA, 16 bp, M. musculus
ctttaataccctccac

SEQ ID NO: 401964 - DNA, 16 bp, M. musculus
ctttaatatcagcact

SEQ ID NO: 401965 - DNA, 16 bp, M. musculus
ctttaatcacagcact

SEQ ID NO: 401966 - DNA, 16 bp, M. musculus
ctttaatcatcagaga

SEQ ID NO: 401967 - DNA, 16 bp, M. musculus
ctttaatccaagcact

SEQ ID NO: 401968 - DNA, 16 bp, M. musculus
ctttaatccaagtact

SEQ ID NO: 401969 - DNA, 16 bp, M. musculus
ctttaatcccaacact

SEQ ID NO: 401970 - DNA, 16 bp, M. musculus
ctttaatcccagaaca

SEQ ID NO: 401971 - DNA, 16 bp, M. musculus
ctttaatcccagcaat

SEQ ID NO: 401972 - DNA, 16 bp, M. musculus
ctttaatcccagcaca

SEQ ID NO: 401973 - DNA, 16 bp, M. musculus
ctttaatcccagcacc

SEQ ID NO: 401974 - DNA, 16 bp, M. musculus
ctttaatcccagcact

SEQ ID NO: 401975 - DNA, 16 bp, M. musculus
ctttaatcccagcatt

SEQ ID NO: 401976 - DNA, 16 bp, M. musculus
ctttaatcccagccct

SEQ ID NO: 401977 - DNA, 16 bp, M. musculus
ctttaatcccagcgct

SEQ ID NO: 401978 - DNA, 16 bp, M. musculus
ctttaatcccagctct

SEQ ID NO: 401979 - DNA, 16 bp, M. musculus
ctttaatcccagggct

SEQ ID NO: 401980 - DNA, 16 bp, M. musculus
ctttaatcccagtacc

SEQ ID NO: 401981 - DNA, 16 bp, M. musculus
ctttaatcccagtact

SEQ ID NO: 401982 - DNA, 16 bp, M. musculus
ctttaatcccagtgct

SEQ ID NO: 401983 - DNA, 16 bp, M. musculus
ctttaatcccggcact

SEQ ID NO: 401984 - DNA, 16 bp, M. musculus
ctttaatcctaacact

SEQ ID NO: 401985 - DNA, 16 bp, M. musculus
ctttaatcctaatact

SEQ ID NO: 401986 - DNA, 16 bp, M. musculus
ctttaatcctagcacc

SEQ ID NO: 401987 - DNA, 16 bp, M. musculus
ctttaatcctagcact

SEQ ID NO: 401988 - DNA, 16 bp, M. musculus
ctttaatcctagcatt

SEQ ID NO: 401989 - DNA, 16 bp, M. musculus
ctttaatcctgacact

SEQ ID NO: 401990 - DNA, 16 bp, M. musculus
ctttaatcctggcact

SEQ ID NO: 401991 - DNA, 16 bp, M. musculus
ctttaatcctttaatc

SEQ ID NO: 401992 - DNA, 16 bp, M. musculus
ctttaatcgcagcact

SEQ ID NO: 401993 - DNA, 16 bp, M. musculus
ctttaatctaagcact

SEQ ID NO: 401994 - DNA, 16 bp, M. musculus
ctttaatctcaacatt

SEQ ID NO: 401995 - DNA, 16 bp, M. musculus
ctttaatctcagcact

SEQ ID NO: 401996 - DNA, 16 bp, M. musculus
ctttaatctcagcatt

SEQ ID NO: 401997 - DNA, 16 bp, M. musculus
ctttaatctcagtact

SEQ ID NO: 401998 - DNA, 16 bp, M. musculus
ctttaatcttagcact

SEQ ID NO: 401999 - DNA, 16 bp, M. musculus
ctttaatgaaagctgc

SEQ ID NO: 402000 - DNA, 16 bp, M. musculus
ctttaatgaatatggc

SEQ ID NO: 402001 - DNA, 16 bp, M. musculus
ctttaatgagtatgaa

SEQ ID NO: 402002 - DNA, 16 bp, M. musculus
ctttaatgccagcact

SEQ ID NO: 402003 - DNA, 16 bp, M. musculus
ctttaatggtcagtgc

SEQ ID NO: 402004 - DNA, 16 bp, M. musculus
ctttaatgttttcttg

SEQ ID NO: 402005 - DNA, 16 bp, M. musculus
ctttaattccagcacc

SEQ ID NO: 402006 - DNA, 16 bp, M. musculus
ctttaattccagcact

SEQ ID NO: 402007 - DNA, 16 bp, M. musculus
ctttaattccggcact

SEQ ID NO: 402008 - DNA, 16 bp, M. musculus
ctttaattcctgcact

SEQ ID NO: 402009 - DNA, 16 bp, M. musculus
ctttaattctagcact

SEQ ID NO: 402010 - DNA, 16 bp, M. musculus
ctttaatttgttcttg

SEQ ID NO: 402011 - DNA, 16 bp, M. musculus
ctttacaaaagaaaaa

SEQ ID NO: 402012 - DNA, 16 bp, M. musculus
ctttacaactgaataa

SEQ ID NO: 402013 - DNA, 16 bp, M. musculus
ctttacagaaaaaaaa

SEQ ID NO: 402014 - DNA, 16 bp, M. musculus
ctttacagagtgagtt

SEQ ID NO: 402015 - DNA, 16 bp, M. musculus
ctttacagcctttgtt

SEQ ID NO: 402016 - DNA, 16 bp, M. musculus
ctttacagtttcatga

SEQ ID NO: 402017 - DNA, 16 bp, M. musculus
ctttacatctcaatca

SEQ ID NO: 402018 - DNA, 16 bp, M. musculus
ctttaccaccaaagaa

SEQ ID NO: 402019 - DNA, 16 bp, M. musculus
ctttacctgctgaacc

SEQ ID NO: 402020 - DNA, 16 bp, M. musculus
ctttaccttcattgct

SEQ ID NO: 402021 - DNA, 16 bp, M. musculus
ctttactcactgagct

SEQ ID NO: 402022 - DNA, 16 bp, M. musculus
ctttactcccagcact

SEQ ID NO: 402023 - DNA, 16 bp, M. musculus
ctttactccccaagtt

SEQ ID NO: 402024 - DNA, 18 bp, M. musculus
ctttactgcctatgtatg

SEQ ID NO: 402025 - DNA, 16 bp, M. musculus
ctttactgctgagcta

SEQ ID NO: 402026 - DNA, 16 bp, M. musculus
ctttactggcttgcct

SEQ ID NO: 402027 - DNA, 17 bp, M. musculus
ctttactggcttgcctc

SEQ ID NO: 402028 - DNA, 16 bp, M. musculus
ctttacttctgataga

SEQ ID NO: 402029 - DNA, 16 bp, M. musculus
ctttagaaataatttt

SEQ ID NO: 402030 - DNA, 16 bp, M. musculus
ctttagagaaaaaaaa

SEQ ID NO: 402031 - DNA, 16 bp, M. musculus
ctttagagaaccctga

SEQ ID NO: 402032 - DNA, 16 bp, M. musculus
ctttagagttgccttt

SEQ ID NO: 402033 - DNA, 53 bp, M. musculus
ctttagatagccctgtcctggtggtattttcaatagccactaaccttgcctgg

SEQ ID NO: 402034 - DNA, 16 bp, M. musculus
ctttagcaaagtagct

SEQ ID NO: 402035 - DNA, 16 bp, M. musculus
ctttagcaagacatcc

SEQ ID NO: 402036 - DNA, 16 bp, M. musculus
ctttagccactgcttc

SEQ ID NO: 402037 - DNA, 16 bp, M. musculus
ctttagctattgtgac

SEQ ID NO: 402038 - DNA, 16 bp, M. musculus
ctttagctccttcagt

SEQ ID NO: 402039 - DNA, 16 bp, M. musculus
ctttagctgctgagcc

SEQ ID NO: 402040 - DNA, 16 bp, M. musculus
ctttagctggggaagt

SEQ ID NO: 402041 - DNA, 16 bp, M. musculus
ctttagcttcagcact

SEQ ID NO: 402042 - DNA, 16 bp, M. musculus
ctttagcttcttcagt

SEQ ID NO: 402043 - DNA, 16 bp, M. musculus
ctttaggcccagcact

SEQ ID NO: 402044 - DNA, 16 bp, M. musculus
ctttagggacttgaag

SEQ ID NO: 402045 - DNA, 16 bp, M. musculus
ctttagggctggagag

SEQ ID NO: 402046 - DNA, 16 bp, M. musculus
ctttaggtatggaaag

SEQ ID NO: 402047 - DNA, 16 bp, M. musculus
ctttagtcatcaggaa

SEQ ID NO: 402048 - DNA, 16 bp, M. musculus
ctttagtcccagcact

SEQ ID NO: 402049 - DNA, 16 bp, M. musculus
ctttagtcccaggact

SEQ ID NO: 402050 - DNA, 16 bp, M. musculus
ctttagtcccagtact

SEQ ID NO: 402051 - DNA, 16 bp, M. musculus
ctttagtcccagtgct

SEQ ID NO: 402052 - DNA, 16 bp, M. musculus
ctttagtcctagcact

SEQ ID NO: 402053 - DNA, 16 bp, M. musculus
ctttagtcttttctct

SEQ ID NO: 402054 - DNA, 16 bp, M. musculus
ctttagtgtgtgtgtg

SEQ ID NO: 402055 - DNA, 16 bp, M. musculus
ctttagttccttggtt

SEQ ID NO: 402056 - DNA, 16 bp, M. musculus
ctttataactgtgatt

SEQ ID NO: 402057 - DNA, 17 bp, M. musculus
ctttataattaacctag

SEQ ID NO: 402058 - DNA, 16 bp, M. musculus
ctttatatatttttgg

SEQ ID NO: 402059 - DNA, 23 bp, M. musculus
ctttatatgttacttgacctttt

SEQ ID NO: 402060 - DNA, 16 bp, M. musculus
ctttatatgttgcttg

SEQ ID NO: 402061 - DNA, 16 bp, M. musculus
ctttatattcatcaaa

SEQ ID NO: 402062 - DNA, 16 bp, M. musculus
ctttatcaaaaatcag

SEQ ID NO: 402063 - DNA, 16 bp, M. musculus
ctttatcatcatcatg

SEQ ID NO: 402064 - DNA, 16 bp, M. musculus
ctttatccattcctct

SEQ ID NO: 402065 - DNA, 16 bp, M. musculus
ctttatccctgtacat

SEQ ID NO: 402066 - DNA, 16 bp, M. musculus
ctttatcctttttgat

SEQ ID NO: 402067 - DNA, 16 bp, M. musculus
ctttatctccatattt

SEQ ID NO: 402068 - DNA, 16 bp, M. musculus
ctttatctctctgtct

SEQ ID NO: 402069 - DNA, 16 bp, M. musculus
ctttatctgacatcaa

SEQ ID NO: 402070 - DNA, 16 bp, M. musculus
ctttatctgccccagt

SEQ ID NO: 402071 - DNA, 16 bp, M. musculus
ctttatgaatatgata

SEQ ID NO: 402072 - DNA, 16 bp, M. musculus
ctttatggcaaaagaa

SEQ ID NO: 402073 - DNA, 16 bp, M. musculus
ctttatgggtgtggct

SEQ ID NO: 402074 - DNA, 16 bp, M. musculus
ctttatgtctgaggca

SEQ ID NO: 402075 - DNA, 16 bp, M. musculus
ctttatgtgcctcagt

SEQ ID NO: 402076 - DNA, 16 bp, M. musculus
ctttatgtgggctctg

SEQ ID NO: 402077 - DNA, 16 bp, M. musculus
ctttatgtgtatgagt

SEQ ID NO: 402078 - DNA, 16 bp, M. musculus
ctttattacaaccaat

SEQ ID NO: 402079 - DNA, 16 bp, M. musculus
ctttattattacagat

SEQ ID NO: 402080 - DNA, 16 bp, M. musculus
ctttattcaattcctt

SEQ ID NO: 402081 - DNA, 16 bp, M. musculus
ctttattcccagcact

SEQ ID NO: 402082 - DNA, 16 bp, M. musculus
ctttattgaccagtca

SEQ ID NO: 402083 - DNA, 25 bp, M. musculus
ctttattgcttacatcttcaggagc

SEQ ID NO: 402084 - DNA, 16 bp, M. musculus
ctttattgtgtaaatg

SEQ ID NO: 402085 - DNA, 16 bp, M. musculus
ctttatttaccaatca

SEQ ID NO: 402086 - DNA, 16 bp, M. musculus
ctttatttccccaaga

SEQ ID NO: 402087 - DNA, 16 bp, M. musculus
ctttatttcttcctgg

SEQ ID NO: 402088 - DNA, 16 bp, M. musculus
ctttattttcaataaa

SEQ ID NO: 402089 - DNA, 16 bp, M. musculus
ctttattttgagacag

SEQ ID NO: 402090 - DNA, 16 bp, M. musculus
ctttattttgtctact

SEQ ID NO: 402091 - DNA, 16 bp, M. musculus
ctttatttttaaagtt

SEQ ID NO: 402092 - DNA, 16 bp, M. musculus
ctttcaaaatatttat

SEQ ID NO: 402093 - DNA, 16 bp, M. musculus
ctttcaaaatatttta

SEQ ID NO: 402094 - DNA, 16 bp, M. musculus
ctttcaaacatttttt

SEQ ID NO: 402095 - DNA, 16 bp, M. musculus
ctttcaaagaagaact

SEQ ID NO: 402096 - DNA, 16 bp, M. musculus
ctttcaacagaagaat

SEQ ID NO: 402097 - DNA, 16 bp, M. musculus
ctttcaacctgtgggt

SEQ ID NO: 402098 - DNA, 16 bp, M. musculus
ctttcaagacagagtt

SEQ ID NO: 402099 - DNA, 16 bp, M. musculus
ctttcaagcctcagcc

SEQ ID NO: 402100 - DNA, 16 bp, M. musculus
ctttcacacaagcatt

SEQ ID NO: 402101 - DNA, 16 bp, M. musculus
ctttcacacacacaca

SEQ ID NO: 402102 - DNA, 16 bp, M. musculus
ctttcacagtgccaag

SEQ ID NO: 402103 - DNA, 16 bp, M. musculus
ctttcacctccttttg

SEQ ID NO: 402104 - DNA, 16 bp, M. musculus
ctttcacctggctcct

SEQ ID NO: 402105 - DNA, 35 bp, M. musculus
ctttcacctgggcagtatttagattggaaagcctt

SEQ ID NO: 402106 - DNA, 16 bp, M. musculus
ctttcacctgtttgga

SEQ ID NO: 402107 - DNA, 16 bp, M. musculus
ctttcactgaacccag

SEQ ID NO: 402108 - DNA, 16 bp, M. musculus
ctttcactgaagaaaa

SEQ ID NO: 402109 - DNA, 16 bp, M. musculus
ctttcacttgctttgt

SEQ ID NO: 402110 - DNA, 16 bp, M. musculus
ctttcagaagacctgg

SEQ ID NO: 402111 - DNA, 16 bp, M. musculus
ctttcagacacacaca

SEQ ID NO: 402112 - DNA, 16 bp, M. musculus
ctttcagagaacccaa

SEQ ID NO: 402113 - DNA, 16 bp, M. musculus
ctttcagaggaccagg

SEQ ID NO: 402114 - DNA, 16 bp, M. musculus
ctttcagaggactcag

SEQ ID NO: 402115 - DNA, 16 bp, M. musculus
ctttcagatcctcagc

SEQ ID NO: 402116 - DNA, 16 bp, M. musculus
ctttcagatgaagata

SEQ ID NO: 402117 - DNA, 16 bp, M. musculus
ctttcagcaaactctt

SEQ ID NO: 402118 - DNA, 16 bp, M. musculus
ctttcagcaatggaca

SEQ ID NO: 402119 - DNA, 16 bp, M. musculus
ctttcagcaggaagga

SEQ ID NO: 402120 - DNA, 16 bp, M. musculus
ctttcagccaaaagtt

SEQ ID NO: 402121 - DNA, 16 bp, M. musculus
ctttcagccccagccc

SEQ ID NO: 402122 - DNA, 16 bp, M. musculus
ctttcagccttcccta

SEQ ID NO: 402123 - DNA, 16 bp, M. musculus
ctttcagctttgttga

SEQ ID NO: 402124 - DNA, 16 bp, M. musculus
ctttcaggaaacagct

SEQ ID NO: 402125 - DNA, 16 bp, M. musculus
ctttcaggatagcatt

SEQ ID NO: 402126 - DNA, 19 bp, M. musculus
ctttcagggttgtcccaga

SEQ ID NO: 402127 - DNA, 16 bp, M. musculus
ctttcagtgagttatt

SEQ ID NO: 402128 - DNA, 16 bp, M. musculus
ctttcatcaaaggaca

SEQ ID NO: 402129 - DNA, 16 bp, M. musculus
ctttcatcatcatcat

SEQ ID NO: 402130 - DNA, 16 bp, M. musculus
ctttcatcccagcact

SEQ ID NO: 402131 - DNA, 16 bp, M. musculus
ctttcatctcagcact

SEQ ID NO: 402132 - DNA, 16 bp, M. musculus
ctttcatctgagctcc

SEQ ID NO: 402133 - DNA, 16 bp, M. musculus
ctttcatcttagctct

SEQ ID NO: 402134 - DNA, 16 bp, M. musculus
ctttcatctttgttga

SEQ ID NO: 402135 - DNA, 16 bp, M. musculus
ctttcatgcctttgtc

SEQ ID NO: 402136 - DNA, 16 bp, M. musculus
ctttcatggatatttt

SEQ ID NO: 402137 - DNA, 16 bp, M. musculus
ctttcatggcctctca

SEQ ID NO: 402138 - DNA, 16 bp, M. musculus
ctttcatgggtatttt

SEQ ID NO: 402139 - DNA, 16 bp, M. musculus
ctttcattgctggtgg

SEQ ID NO: 402140 - DNA, 16 bp, M. musculus
ctttcattgtgcccca

SEQ ID NO: 402141 - DNA, 16 bp, M. musculus
ctttcattgttaagaa

SEQ ID NO: 402142 - DNA, 16 bp, M. musculus
ctttcatttctgattt

SEQ ID NO: 402143 - DNA, 17 bp, M. musculus
ctttccaaaacttttat

SEQ ID NO: 402144 - DNA, 16 bp, M. musculus
ctttccaagtctgtga

SEQ ID NO: 402145 - DNA, 16 bp, M. musculus
ctttccaagtgattct

SEQ ID NO: 402146 - DNA, 16 bp, M. musculus
ctttccacaaacccag

SEQ ID NO: 402147 - DNA, 16 bp, M. musculus
ctttccacagagatct

SEQ ID NO: 402148 - DNA, 16 bp, M. musculus
ctttccaccttcctaa

SEQ ID NO: 402149 - DNA, 16 bp, M. musculus
ctttccagaaccttct

SEQ ID NO: 402150 - DNA, 16 bp, M. musculus
ctttccagatgaccct

SEQ ID NO: 402151 - DNA, 16 bp, M. musculus
ctttccagatgactct

SEQ ID NO: 402152 - DNA, 16 bp, M. musculus
ctttccagatgcattt

SEQ ID NO: 402153 - DNA, 16 bp, M. musculus
ctttccagcttctgga

SEQ ID NO: 402154 - DNA, 16 bp, M. musculus
ctttccaggaccaagg

SEQ ID NO: 402155 - DNA, 16 bp, M. musculus
ctttccagtgatggcg

SEQ ID NO: 402156 - DNA, 16 bp, M. musculus
ctttccagtggcatgg

SEQ ID NO: 402157 - DNA, 16 bp, M. musculus
ctttccagtttctagc

SEQ ID NO: 402158 - DNA, 16 bp, M. musculus
ctttccagttttgttg

SEQ ID NO: 402159 - DNA, 16 bp, M. musculus
ctttccatttagtttg

SEQ ID NO: 402160 - DNA, 16 bp, M. musculus
ctttcccactatctct

SEQ ID NO: 402161 - DNA, 16 bp, M. musculus
ctttcccagaatcctt

SEQ ID NO: 402162 - DNA, 16 bp, M. musculus
ctttcccaggtctcag

SEQ ID NO: 402163 - DNA, 16 bp, M. musculus
ctttcccattctgtag

SEQ ID NO: 402164 - DNA, 16 bp, M. musculus
ctttcccctctgaaaa

SEQ ID NO: 402165 - DNA, 16 bp, M. musculus
ctttccctcagcctct

SEQ ID NO: 402166 - DNA, 16 bp, M. musculus
ctttccctgccctgct

SEQ ID NO: 402167 - DNA, 16 bp, M. musculus
ctttccctgtccctgt

SEQ ID NO: 402168 - DNA, 16 bp, M. musculus
ctttccctgtgccttc

SEQ ID NO: 402169 - DNA, 16 bp, M. musculus
ctttccctttccatgg

SEQ ID NO: 402170 - DNA, 16 bp, M. musculus
ctttcccttttatctg

SEQ ID NO: 402171 - DNA, 19 bp, M. musculus
ctttccgagacagggtttc

SEQ ID NO: 402172 - DNA, 16 bp, M. musculus
ctttcctacccaagtt

SEQ ID NO: 402173 - DNA, 16 bp, M. musculus
ctttcctcaagggagg

SEQ ID NO: 402174 - DNA, 16 bp, M. musculus
ctttcctcagtttccc

SEQ ID NO: 402175 - DNA, 22 bp, M. musculus
ctttcctccccaactgcttctt

SEQ ID NO: 402176 - DNA, 20 bp, M. musculus
ctttcctccccaacttgttt

SEQ ID NO: 402177 - DNA, 16 bp, M. musculus
ctttcctccctccaag

SEQ ID NO: 402178 - DNA, 16 bp, M. musculus
ctttcctgactgagcc

SEQ ID NO: 402179 - DNA, 16 bp, M. musculus
ctttcctgccagagga

SEQ ID NO: 402180 - DNA, 16 bp, M. musculus
ctttcctgcttctggc

SEQ ID NO: 402181 - DNA, 16 bp, M. musculus
ctttcctgggttttct

SEQ ID NO: 402182 - DNA, 16 bp, M. musculus
ctttcctggtttccat

SEQ ID NO: 402183 - DNA, 16 bp, M. musculus
ctttcctggtttcctc

SEQ ID NO: 402184 - DNA, 16 bp, M. musculus
ctttcctgtatttcag

SEQ ID NO: 402185 - DNA, 16 bp, M. musculus
ctttcctgtggagctc

SEQ ID NO: 402186 - DNA, 16 bp, M. musculus
ctttccttcccaagtt

SEQ ID NO: 402187 - DNA, 16 bp, M. musculus
ctttccttcccaggtt

SEQ ID NO: 402188 - DNA, 17 bp, M. musculus
ctttcctttttaaaaaa

SEQ ID NO: 402189 - DNA, 16 bp, M. musculus
ctttctaaaataaaat

SEQ ID NO: 402190 - DNA, 16 bp, M. musculus
ctttctaactatatga

SEQ ID NO: 402191 - DNA, 16 bp, M. musculus
ctttctaagcctgttt

SEQ ID NO: 402192 - DNA, 16 bp, M. musculus
ctttctacctacctat

SEQ ID NO: 402193 - DNA, 16 bp, M. musculus
ctttctaccttacctg

SEQ ID NO: 402194 - DNA, 16 bp, M. musculus
ctttctactgatggcc

SEQ ID NO: 402195 - DNA, 16 bp, M. musculus
ctttctagaaacttct

SEQ ID NO: 402196 - DNA, 16 bp, M. musculus
ctttctagaagtttct

SEQ ID NO: 402197 - DNA, 16 bp, M. musculus
ctttctataactgctt

SEQ ID NO: 402198 - DNA, 16 bp, M. musculus
ctttctatcactgtga

SEQ ID NO: 402199 - DNA, 16 bp, M. musculus
ctttctatgcctttta

SEQ ID NO: 402200 - DNA, 16 bp, M. musculus
ctttctattttattga

SEQ ID NO: 402201 - DNA, 16 bp, M. musculus
ctttctcaaaaaaaaa

SEQ ID NO: 402202 - DNA, 16 bp, M. musculus
ctttctcaaaacaaaa

SEQ ID NO: 402203 - DNA, 25 bp, M. musculus
ctttctcacgggatggtctctgaca

SEQ ID NO: 402204 - DNA, 16 bp, M. musculus
ctttctcagcctgctt

SEQ ID NO: 402205 - DNA, 16 bp, M. musculus
ctttctcagcttctaa

SEQ ID NO: 402206 - DNA, 16 bp, M. musculus
ctttctcagtcagctg

SEQ ID NO: 402207 - DNA, 16 bp, M. musculus
ctttctcagtctcttt

SEQ ID NO: 402208 - DNA, 16 bp, M. musculus
ctttctcagtgagatt

SEQ ID NO: 402209 - DNA, 16 bp, M. musculus
ctttctcagtgtgtgt

SEQ ID NO: 402210 - DNA, 16 bp, M. musculus
ctttctccaaaattga

SEQ ID NO: 402211 - DNA, 16 bp, M. musculus
ctttctccaaaattta

SEQ ID NO: 402212 - DNA, 16 bp, M. musculus
ctttctccaagaggat

SEQ ID NO: 402213 - DNA, 17 bp, M. musculus
ctttctccacatcctcg

SEQ ID NO: 402214 - DNA, 16 bp, M. musculus
ctttctccagatcctc

SEQ ID NO: 402215 - DNA, 16 bp, M. musculus
ctttctccagcaaagc

SEQ ID NO: 402216 - DNA, 16 bp, M. musculus
ctttctccagcaaggc

SEQ ID NO: 402217 - DNA, 16 bp, M. musculus
ctttctccagctcctc

SEQ ID NO: 402218 - DNA, 16 bp, M. musculus
ctttctccagtgttag

SEQ ID NO: 402219 - DNA, 16 bp, M. musculus
ctttctccagttcctc

SEQ ID NO: 402220 - DNA, 17 bp, M. musculus
ctttctccagttcttcc

SEQ ID NO: 402221 - DNA, 16 bp, M. musculus
ctttctcccaggttcc

SEQ ID NO: 402222 - DNA, 16 bp, M. musculus
ctttctcctactcaga

SEQ ID NO: 402223 - DNA, 16 bp, M. musculus
ctttctcctctacaag

SEQ ID NO: 402224 - DNA, 16 bp, M. musculus
ctttctcctctatgag

SEQ ID NO: 402225 - DNA, 16 bp, M. musculus
ctttctcctctgaaag

SEQ ID NO: 402226 - DNA, 16 bp, M. musculus
ctttctcctgggctgg

SEQ ID NO: 402227 - DNA, 16 bp, M. musculus
ctttctcgagctcctc

SEQ ID NO: 402228 - DNA, 16 bp, M. musculus
ctttctctaaatattt

SEQ ID NO: 402229 - DNA, 16 bp, M. musculus
ctttctctaactcctc

SEQ ID NO: 402230 - DNA, 16 bp, M. musculus
ctttctctacagaaag

SEQ ID NO: 402231 - DNA, 16 bp, M. musculus
ctttctctacatcctc

SEQ ID NO: 402232 - DNA, 16 bp, M. musculus
ctttctctacatcctg

SEQ ID NO: 402233 - DNA, 16 bp, M. musculus
ctttctctacatcttc

SEQ ID NO: 402234 - DNA, 16 bp, M. musculus
ctttctctagctccct

SEQ ID NO: 402235 - DNA, 16 bp, M. musculus
ctttctctagctcctc

SEQ ID NO: 402236 - DNA, 16 bp, M. musculus
ctttctctagctcctg

SEQ ID NO: 402237 - DNA, 16 bp, M. musculus
ctttctctagcttctc

SEQ ID NO: 402238 - DNA, 16 bp, M. musculus
ctttctctagcttttc

SEQ ID NO: 402239 - DNA, 16 bp, M. musculus
ctttctctagtgttag

SEQ ID NO: 402240 - DNA, 16 bp, M. musculus
ctttctctatatatct

SEQ ID NO: 402241 - DNA, 22 bp, M. musculus
ctttctctatgataactccagc

SEQ ID NO: 402242 - DNA, 16 bp, M. musculus
ctttctctattgcttt

SEQ ID NO: 402243 - DNA, 16 bp, M. musculus
ctttctctctccatgt

SEQ ID NO: 402244 - DNA, 16 bp, M. musculus
ctttctctctgactcc

SEQ ID NO: 402245 - DNA, 16 bp, M. musculus
ctttctctcttgaacc

SEQ ID NO: 402246 - DNA, 16 bp, M. musculus
ctttctctgaatctaa

SEQ ID NO: 402247 - DNA, 16 bp, M. musculus
ctttctctgcatctct

SEQ ID NO: 402248 - DNA, 16 bp, M. musculus
ctttctctgctccctg

SEQ ID NO: 402249 - DNA, 16 bp, M. musculus
ctttctcttatttctg

SEQ ID NO: 402250 - DNA, 16 bp, M. musculus
ctttctcttccaccat

SEQ ID NO: 402251 - DNA, 16 bp, M. musculus
ctttctcttcctgcta

SEQ ID NO: 402252 - DNA, 16 bp, M. musculus
ctttctcttctataaa

SEQ ID NO: 402253 - DNA, 16 bp, M. musculus
ctttctcttggagaag

SEQ ID NO: 402254 - DNA, 16 bp, M. musculus
ctttctcttttaaaac

SEQ ID NO: 402255 - DNA, 16 bp, M. musculus
ctttctgaactctggc

SEQ ID NO: 402256 - DNA, 16 bp, M. musculus
ctttctgacccctgac

SEQ ID NO: 402257 - DNA, 16 bp, M. musculus
ctttctgaggtagtgt

SEQ ID NO: 402258 - DNA, 16 bp, M. musculus
ctttctgatagtcaaa

SEQ ID NO: 402259 - DNA, 16 bp, M. musculus
ctttctgatctgcttg

SEQ ID NO: 402260 - DNA, 16 bp, M. musculus
ctttctgcacatcctt

SEQ ID NO: 402261 - DNA, 16 bp, M. musculus
ctttctgcctcaacct

SEQ ID NO: 402262 - DNA, 16 bp, M. musculus
ctttctgcctctgccc

SEQ ID NO: 402263 - DNA, 16 bp, M. musculus
ctttctgcctcttctg

SEQ ID NO: 402264 - DNA, 16 bp, M. musculus
ctttctgcctgtctgt

SEQ ID NO: 402265 - DNA, 16 bp, M. musculus
ctttctgctctctgct

SEQ ID NO: 402266 - DNA, 16 bp, M. musculus
ctttctgctgctggga

SEQ ID NO: 402267 - DNA, 16 bp, M. musculus
ctttctgctggccccc

SEQ ID NO: 402268 - DNA, 16 bp, M. musculus
ctttctgcttcccaga

SEQ ID NO: 402269 - DNA, 16 bp, M. musculus
ctttctggaaagttct

SEQ ID NO: 402270 - DNA, 16 bp, M. musculus
ctttctggaagtttct

SEQ ID NO: 402271 - DNA, 16 bp, M. musculus
ctttctggaatgttct

SEQ ID NO: 402272 - DNA, 16 bp, M. musculus
ctttctggccctggca

SEQ ID NO: 402273 - DNA, 16 bp, M. musculus
ctttctggcttgcttc

SEQ ID NO: 402274 - DNA, 16 bp, M. musculus
ctttctggggctggag

SEQ ID NO: 402275 - DNA, 16 bp, M. musculus
ctttctggttctgggt

SEQ ID NO: 402276 - DNA, 16 bp, M. musculus
ctttctggttgctacc

SEQ ID NO: 402277 - DNA, 16 bp, M. musculus
ctttctgtatgaaagc

SEQ ID NO: 402278 - DNA, 16 bp, M. musculus
ctttctgtctctccat

SEQ ID NO: 402279 - DNA, 16 bp, M. musculus
ctttctgtctctgatt

SEQ ID NO: 402280 - DNA, 16 bp, M. musculus
ctttctgtcttcacct

SEQ ID NO: 402281 - DNA, 16 bp, M. musculus
ctttctgtggagttcc

SEQ ID NO: 402282 - DNA, 16 bp, M. musculus
ctttctgtgtctctgt

SEQ ID NO: 402283 - DNA, 16 bp, M. musculus
ctttctgtgtctgtgt

SEQ ID NO: 402284 - DNA, 16 bp, M. musculus
ctttctgtgtgtatgt

SEQ ID NO: 402285 - DNA, 16 bp, M. musculus
ctttctgttaaagcct

SEQ ID NO: 402286 - DNA, 16 bp, M. musculus
ctttctgtttccactt

SEQ ID NO: 402287 - DNA, 16 bp, M. musculus
ctttctgttttattag

SEQ ID NO: 402288 - DNA, 16 bp, M. musculus
ctttcttatctttggt

SEQ ID NO: 402289 - DNA, 16 bp, M. musculus
ctttcttatttcaaga

SEQ ID NO: 402290 - DNA, 16 bp, M. musculus
ctttcttcagagactc

SEQ ID NO: 402291 - DNA, 16 bp, M. musculus
ctttcttcagaggctt

SEQ ID NO: 402292 - DNA, 18 bp, M. musculus
ctttcttcagggacttga

SEQ ID NO: 402293 - DNA, 16 bp, M. musculus
ctttcttcagtggtgt

SEQ ID NO: 402294 - DNA, 16 bp, M. musculus
ctttcttcccccaagt

SEQ ID NO: 402295 - DNA, 16 bp, M. musculus
ctttcttccctgagtt

SEQ ID NO: 402296 - DNA, 16 bp, M. musculus
ctttcttcctgctgga

SEQ ID NO: 402297 - DNA, 16 bp, M. musculus
ctttcttcggagactt

SEQ ID NO: 402298 - DNA, 16 bp, M. musculus
ctttcttctcagaaaa

SEQ ID NO: 402299 - DNA, 16 bp, M. musculus
ctttcttctcttccag

SEQ ID NO: 402300 - DNA, 16 bp, M. musculus
ctttcttctggtgtgt

SEQ ID NO: 402301 - DNA, 16 bp, M. musculus
ctttcttcttcagtat

SEQ ID NO: 402302 - DNA, 16 bp, M. musculus
ctttcttctttaaaaa

SEQ ID NO: 402303 - DNA, 16 bp, M. musculus
ctttcttgtatccttg

SEQ ID NO: 402304 - DNA, 16 bp, M. musculus
ctttctttaaaaagaa

SEQ ID NO: 402305 - DNA, 16 bp, M. musculus
ctttctttaaaagaaa

SEQ ID NO: 402306 - DNA, 16 bp, M. musculus
ctttctttaaataaaa

SEQ ID NO: 402307 - DNA, 16 bp, M. musculus
ctttctttcaagacag

SEQ ID NO: 402308 - DNA, 16 bp, M. musculus
ctttctttcccttgat

SEQ ID NO: 402309 - DNA, 16 bp, M. musculus
ctttctttctctgact

SEQ ID NO: 402310 - DNA, 16 bp, M. musculus
ctttctttgagacaga

SEQ ID NO: 402311 - DNA, 16 bp, M. musculus
ctttctttgcaattaa

SEQ ID NO: 402312 - DNA, 16 bp, M. musculus
ctttctttggtgcagg

SEQ ID NO: 402313 - DNA, 16 bp, M. musculus
ctttctttgttttgca

SEQ ID NO: 402314 - DNA, 16 bp, M. musculus
ctttcttttaaaaaaa

SEQ ID NO: 402315 - DNA, 16 bp, M. musculus
ctttcttttatgagag

SEQ ID NO: 402316 - DNA, 16 bp, M. musculus
ctttcttttctatcag

SEQ ID NO: 402317 - DNA, 16 bp, M. musculus
ctttcttttgagacag

SEQ ID NO: 402318 - DNA, 16 bp, M. musculus
ctttcttttgtcttac

SEQ ID NO: 402319 - DNA, 16 bp, M. musculus
ctttctttttctcaaa

SEQ ID NO: 402320 - DNA, 16 bp, M. musculus
ctttctttttctcagt

SEQ ID NO: 402321 - DNA, 16 bp, M. musculus
ctttcttttttgagac

SEQ ID NO: 402322 - DNA, 16 bp, M. musculus
ctttctttttttaaga

SEQ ID NO: 402323 - DNA, 16 bp, M. musculus
ctttgaaaaaattatt

SEQ ID NO: 402324 - DNA, 16 bp, M. musculus
ctttgaaaagggagct

SEQ ID NO: 402325 - DNA, 16 bp, M. musculus
ctttgaaaagtgatta

SEQ ID NO: 402326 - DNA, 16 bp, M. musculus
ctttgaaaatttcaca

SEQ ID NO: 402327 - DNA, 16 bp, M. musculus
ctttgaaacagggtct

SEQ ID NO: 402328 - DNA, 16 bp, M. musculus
ctttgaaagccccaca

SEQ ID NO: 402329 - DNA, 16 bp, M. musculus
ctttgaaaggattggt

SEQ ID NO: 402330 - DNA, 16 bp, M. musculus
ctttgaaatattaaaa

SEQ ID NO: 402331 - DNA, 16 bp, M. musculus
ctttgaaatatttatt

SEQ ID NO: 402332 - DNA, 16 bp, M. musculus
ctttgaaatgtttttt

SEQ ID NO: 402333 - DNA, 16 bp, M. musculus
ctttgaacaaggagat

SEQ ID NO: 402334 - DNA, 16 bp, M. musculus
ctttgaacagacacca

SEQ ID NO: 402335 - DNA, 16 bp, M. musculus
ctttgaacccaggaag

SEQ ID NO: 402336 - DNA, 16 bp, M. musculus
ctttgaactcagagac

SEQ ID NO: 402337 - DNA, 16 bp, M. musculus
ctttgaactcctgaac

SEQ ID NO: 402338 - DNA, 16 bp, M. musculus
ctttgaacttgctgtg

SEQ ID NO: 402339 - DNA, 16 bp, M. musculus
ctttgaagaaaaaaaa

SEQ ID NO: 402340 - DNA, 17 bp, M. musculus
ctttgaagaccaggctg

SEQ ID NO: 402341 - DNA, 16 bp, M. musculus
ctttgaagggctgggt

SEQ ID NO: 402342 - DNA, 16 bp, M. musculus
ctttgaaggggtggat

SEQ ID NO: 402343 - DNA, 16 bp, M. musculus
ctttgaagttttaaaa

SEQ ID NO: 402344 - DNA, 16 bp, M. musculus
ctttgaatccatgaat

SEQ ID NO: 402345 - DNA, 16 bp, M. musculus
ctttgaatgtgtgtgt

SEQ ID NO: 402346 - DNA, 16 bp, M. musculus
ctttgaattcctgatc

SEQ ID NO: 402347 - DNA, 16 bp, M. musculus
ctttgaatttacagag

SEQ ID NO: 402348 - DNA, 16 bp, M. musculus
ctttgacaaaatccaa

SEQ ID NO: 402349 - DNA, 16 bp, M. musculus
ctttgacaaaggagat

SEQ ID NO: 402350 - DNA, 16 bp, M. musculus
ctttgacaattactgg

SEQ ID NO: 402351 - DNA, 16 bp, M. musculus
ctttgacactgaagtg

SEQ ID NO: 402352 - DNA, 16 bp, M. musculus
ctttgacatctgatca

SEQ ID NO: 402353 - DNA, 16 bp, M. musculus
ctttgaccccagcact

SEQ ID NO: 402354 - DNA, 16 bp, M. musculus
ctttgacctccatttg

SEQ ID NO: 402355 - DNA, 16 bp, M. musculus
ctttgacctctgacct

SEQ ID NO: 402356 - DNA, 16 bp, M. musculus
ctttgactatcagaaa

SEQ ID NO: 402357 - DNA, 16 bp, M. musculus
ctttgactgtcctgga

SEQ ID NO: 402358 - DNA, 16 bp, M. musculus
ctttgacttcttttcc

SEQ ID NO: 402359 - DNA, 16 bp, M. musculus
ctttgactttgtttat

SEQ ID NO: 402360 - DNA, 16 bp, M. musculus
ctttgagaagcccaca

SEQ ID NO: 402361 - DNA, 16 bp, M. musculus
ctttgagaagggccca

SEQ ID NO: 402362 - DNA, 16 bp, M. musculus
ctttgagaatttctta

SEQ ID NO: 402363 - DNA, 16 bp, M. musculus
ctttgagactgtttta

SEQ ID NO: 402364 - DNA, 16 bp, M. musculus
ctttgagaggccatgg

SEQ ID NO: 402365 - DNA, 16 bp, M. musculus
ctttgagatttaaaaa

SEQ ID NO: 402366 - DNA, 16 bp, M. musculus
ctttgagcatttcttt

SEQ ID NO: 402367 - DNA, 16 bp, M. musculus
ctttgagctagaagag

SEQ ID NO: 402368 - DNA, 16 bp, M. musculus
ctttgagctggatccc

SEQ ID NO: 402369 - DNA, 16 bp, M. musculus
ctttgagctggcaaat

SEQ ID NO: 402370 - DNA, 16 bp, M. musculus
ctttgagggaaaaaaa

SEQ ID NO: 402371 - DNA, 16 bp, M. musculus
ctttgaggtaggaaga

SEQ ID NO: 402372 - DNA, 16 bp, M. musculus
ctttgaggtgtcaaaa

SEQ ID NO: 402373 - DNA, 16 bp, M. musculus
ctttgagtactatgtt

SEQ ID NO: 402374 - DNA, 16 bp, M. musculus
ctttgagtcatttctg

SEQ ID NO: 402375 - DNA, 16 bp, M. musculus
ctttgagtctgtggat

SEQ ID NO: 402376 - DNA, 16 bp, M. musculus
ctttgagttattaaag

SEQ ID NO: 402377 - DNA, 16 bp, M. musculus
ctttgagttcctgtcc

SEQ ID NO: 402378 - DNA, 16 bp, M. musculus
ctttgataatgaacag

SEQ ID NO: 402379 - DNA, 16 bp, M. musculus
ctttgatatatagtct

SEQ ID NO: 402380 - DNA, 16 bp, M. musculus
ctttgatatcagccat

SEQ ID NO: 402381 - DNA, 16 bp, M. musculus
ctttgatcacttcctt

SEQ ID NO: 402382 - DNA, 16 bp, M. musculus
ctttgatcagaatgac

SEQ ID NO: 402383 - DNA, 16 bp, M. musculus
ctttgatcagtatgaa

SEQ ID NO: 402384 - DNA, 16 bp, M. musculus
ctttgatccagatctt

SEQ ID NO: 402385 - DNA, 16 bp, M. musculus
ctttgatcccagcaat

SEQ ID NO: 402386 - DNA, 16 bp, M. musculus
ctttgatcccagcacg

SEQ ID NO: 402387 - DNA, 16 bp, M. musculus
ctttgatcccagcact

SEQ ID NO: 402388 - DNA, 16 bp, M. musculus
ctttgatcccagcatt

SEQ ID NO: 402389 - DNA, 16 bp, M. musculus
ctttgatccctgcact

SEQ ID NO: 402390 - DNA, 16 bp, M. musculus
ctttgatcctcttaga

SEQ ID NO: 402391 - DNA, 16 bp, M. musculus
ctttgatctacaatga

SEQ ID NO: 402392 - DNA, 16 bp, M. musculus
ctttgatgaaaatgaa

SEQ ID NO: 402393 - DNA, 16 bp, M. musculus
ctttgatgaatatgaa

SEQ ID NO: 402394 - DNA, 16 bp, M. musculus
ctttgatgagaatgaa

SEQ ID NO: 402395 - DNA, 16 bp, M. musculus
ctttgatgagtatgaa

SEQ ID NO: 402396 - DNA, 16 bp, M. musculus
ctttgatgatgaacag

SEQ ID NO: 402397 - DNA, 16 bp, M. musculus
ctttgatgatgaactg

SEQ ID NO: 402398 - DNA, 16 bp, M. musculus
ctttgatgccagacaa

SEQ ID NO: 402399 - DNA, 16 bp, M. musculus
ctttgatgggctggat

SEQ ID NO: 402400 - DNA, 16 bp, M. musculus
ctttgatgtgatagtt

SEQ ID NO: 402401 - DNA, 16 bp, M. musculus
ctttgatttccttctt

SEQ ID NO: 402402 - DNA, 16 bp, M. musculus
ctttgatttctgtctt

SEQ ID NO: 402403 - DNA, 16 bp, M. musculus
ctttgatttgatttca

SEQ ID NO: 402404 - DNA, 16 bp, M. musculus
ctttgattttaaaatt

SEQ ID NO: 402405 - DNA, 28 bp, M. musculus
ctttgcacaacaacagacaggatatcca

SEQ ID NO: 402406 - DNA, 16 bp, M. musculus
ctttgcagaaagcagt

SEQ ID NO: 402407 - DNA, 16 bp, M. musculus
ctttgcagaagttgtt

SEQ ID NO: 402408 - DNA, 16 bp, M. musculus
ctttgcagcaagcatt

SEQ ID NO: 402409 - DNA, 24 bp, M. musculus
ctttgcagcaagcattgatctcca

SEQ ID NO: 402410 - DNA, 16 bp, M. musculus
ctttgcagccctggct

SEQ ID NO: 402411 - DNA, 16 bp, M. musculus
ctttgcagcttctggc

SEQ ID NO: 402412 - DNA, 16 bp, M. musculus
ctttgcaggaaaaaaa

SEQ ID NO: 402413 - DNA, 18 bp, M. musculus
ctttgccaagaagcacaa

SEQ ID NO: 402414 - DNA, 17 bp, M. musculus
ctttgccaccatcacct

SEQ ID NO: 402415 - DNA, 16 bp, M. musculus
ctttgccactgagcca

SEQ ID NO: 402416 - DNA, 16 bp, M. musculus
ctttgccagagcctga

SEQ ID NO: 402417 - DNA, 16 bp, M. musculus
ctttgccagctttgtg

SEQ ID NO: 402418 - DNA, 16 bp, M. musculus
ctttgccagtgcttgg

SEQ ID NO: 402419 - DNA, 16 bp, M. musculus
ctttgccagtgtctgg

SEQ ID NO: 402420 - DNA, 16 bp, M. musculus
ctttgcccacctgtga

SEQ ID NO: 402421 - DNA, 16 bp, M. musculus
ctttgccctggtgttc

SEQ ID NO: 402422 - DNA, 16 bp, M. musculus
ctttgcctcctggctg

SEQ ID NO: 402423 - DNA, 16 bp, M. musculus
ctttgcctcctgggtg

SEQ ID NO: 402424 - DNA, 16 bp, M. musculus
ctttgcctctaaaagg

SEQ ID NO: 402425 - DNA, 16 bp, M. musculus
ctttgcctgctcctgg

SEQ ID NO: 402426 - DNA, 16 bp, M. musculus
ctttgctatttttact

SEQ ID NO: 402427 - DNA, 16 bp, M. musculus
ctttgctccaaaatcc

SEQ ID NO: 402428 - DNA, 16 bp, M. musculus
ctttgctcttgactgt

SEQ ID NO: 402429 - DNA, 16 bp, M. musculus
ctttgctgaagctgtt

SEQ ID NO: 402430 - DNA, 16 bp, M. musculus
ctttgctgaatgtgtt

SEQ ID NO: 402431 - DNA, 16 bp, M. musculus
ctttgctgatctttgc

SEQ ID NO: 402432 - DNA, 16 bp, M. musculus
ctttgctgccaagcct

SEQ ID NO: 402433 - DNA, 16 bp, M. musculus
ctttgcttcctggcct

SEQ ID NO: 402434 - DNA, 16 bp, M. musculus
ctttgcttcctttgga

SEQ ID NO: 402435 - DNA, 16 bp, M. musculus
ctttgctttgggcttc

SEQ ID NO: 402436 - DNA, 16 bp, M. musculus
ctttggaaaaacagaa

SEQ ID NO: 402437 - DNA, 16 bp, M. musculus
ctttggaaaaatcact

SEQ ID NO: 402438 - DNA, 16 bp, M. musculus
ctttggaaagccagtt

SEQ ID NO: 402439 - DNA, 16 bp, M. musculus
ctttggaaatcaattt

SEQ ID NO: 402440 - DNA, 16 bp, M. musculus
ctttggaaatcagttt

SEQ ID NO: 402441 - DNA, 16 bp, M. musculus
ctttggaagagcaacc

SEQ ID NO: 402442 - DNA, 16 bp, M. musculus
ctttggaagagcagaa

SEQ ID NO: 402443 - DNA, 16 bp, M. musculus
ctttggaagagcaggc

SEQ ID NO: 402444 - DNA, 16 bp, M. musculus
ctttggagaaaaaaaa

SEQ ID NO: 402445 - DNA, 16 bp, M. musculus
ctttggagaagatggc

SEQ ID NO: 402446 - DNA, 16 bp, M. musculus
ctttggagacaagact

SEQ ID NO: 402447 - DNA, 16 bp, M. musculus
ctttggagactcagtt

SEQ ID NO: 402448 - DNA, 16 bp, M. musculus
ctttggagattacagt

SEQ ID NO: 402449 - DNA, 16 bp, M. musculus
ctttggagctggagag

SEQ ID NO: 402450 - DNA, 16 bp, M. musculus
ctttggaggtcagaag

SEQ ID NO: 402451 - DNA, 16 bp, M. musculus
ctttggagtgctggga

SEQ ID NO: 402452 - DNA, 16 bp, M. musculus
ctttggagtgtgtgtg

SEQ ID NO: 402453 - DNA, 16 bp, M. musculus
ctttggagtttcttta

SEQ ID NO: 402454 - DNA, 16 bp, M. musculus
ctttggatctgtggag

SEQ ID NO: 402455 - DNA, 16 bp, M. musculus
ctttggatgtgattcc

SEQ ID NO: 402456 - DNA, 16 bp, M. musculus
ctttggattagaaaag

SEQ ID NO: 402457 - DNA, 16 bp, M. musculus
ctttggatttggaatg

SEQ ID NO: 402458 - DNA, 16 bp, M. musculus
ctttggccaggaggag

SEQ ID NO: 402459 - DNA, 16 bp, M. musculus
ctttggccatgtggct

SEQ ID NO: 402460 - DNA, 16 bp, M. musculus
ctttggccatgtggtt

SEQ ID NO: 402461 - DNA, 18 bp, M. musculus
ctttggccctggcgttcc

SEQ ID NO: 402462 - DNA, 16 bp, M. musculus
ctttggccttccttcc

SEQ ID NO: 402463 - DNA, 16 bp, M. musculus
ctttggctattataaa

SEQ ID NO: 402464 - DNA, 16 bp, M. musculus
ctttggctctctctct

SEQ ID NO: 402465 - DNA, 16 bp, M. musculus
ctttggctggagcttg

SEQ ID NO: 402466 - DNA, 16 bp, M. musculus
ctttggctgtcctgga

SEQ ID NO: 402467 - DNA, 16 bp, M. musculus
ctttggcttctccatc

SEQ ID NO: 402468 - DNA, 16 bp, M. musculus
ctttggcttctttgtc

SEQ ID NO: 402469 - DNA, 16 bp, M. musculus
ctttgggaatagcatt

SEQ ID NO: 402470 - DNA, 16 bp, M. musculus
ctttggggaaaaaaaa

SEQ ID NO: 402471 - DNA, 16 bp, M. musculus
ctttgggggctggtga

SEQ ID NO: 402472 - DNA, 16 bp, M. musculus
ctttggggggaaaaaa

SEQ ID NO: 402473 - DNA, 16 bp, M. musculus
ctttgggtgtgtctgt

SEQ ID NO: 402474 - DNA, 16 bp, M. musculus
ctttggtacaggaaga

SEQ ID NO: 402475 - DNA, 16 bp, M. musculus
ctttggtattgttatt

SEQ ID NO: 402476 - DNA, 16 bp, M. musculus
ctttggtcccagcact

SEQ ID NO: 402477 - DNA, 16 bp, M. musculus
ctttggtccctggtat

SEQ ID NO: 402478 - DNA, 16 bp, M. musculus
ctttggtcttccttgt

SEQ ID NO: 402479 - DNA, 16 bp, M. musculus
ctttggtctttattct

SEQ ID NO: 402480 - DNA, 16 bp, M. musculus
ctttggtctttcttag

SEQ ID NO: 402481 - DNA, 16 bp, M. musculus
ctttggtgaccaacag

SEQ ID NO: 402482 - DNA, 16 bp, M. musculus
ctttggtgatgaaaag

SEQ ID NO: 402483 - DNA, 16 bp, M. musculus
ctttggtgtgtttctc

SEQ ID NO: 402484 - DNA, 16 bp, M. musculus
ctttggttagggacag

SEQ ID NO: 402485 - DNA, 16 bp, M. musculus
ctttggttctggcctg

SEQ ID NO: 402486 - DNA, 16 bp, M. musculus
ctttggttggtggatt

SEQ ID NO: 402487 - DNA, 16 bp, M. musculus
ctttggttggtggctt

SEQ ID NO: 402488 - DNA, 16 bp, M. musculus
ctttggtttctacatc

SEQ ID NO: 402489 - DNA, 16 bp, M. musculus
ctttggtttttccatc

SEQ ID NO: 402490 - DNA, 16 bp, M. musculus
ctttgtaaactttgta

SEQ ID NO: 402491 - DNA, 16 bp, M. musculus
ctttgtaaccagtgtt

SEQ ID NO: 402492 - DNA, 16 bp, M. musculus
ctttgtaagcataaac

SEQ ID NO: 402493 - DNA, 16 bp, M. musculus
ctttgtacaggaccca

SEQ ID NO: 402494 - DNA, 16 bp, M. musculus
ctttgtagaatgaatt

SEQ ID NO: 402495 - DNA, 16 bp, M. musculus
ctttgtagccctgact

SEQ ID NO: 402496 - DNA, 16 bp, M. musculus
ctttgtagctgaggct

SEQ ID NO: 402497 - DNA, 16 bp, M. musculus
ctttgtagtcctggct

SEQ ID NO: 402498 - DNA, 16 bp, M. musculus
ctttgtataaaggaaa

SEQ ID NO: 402499 - DNA, 16 bp, M. musculus
ctttgtataccaggct

SEQ ID NO: 402500 - DNA, 16 bp, M. musculus
ctttgtatattttgaa

SEQ ID NO: 402501 - DNA, 16 bp, M. musculus
ctttgtatattttgta

SEQ ID NO: 402502 - DNA, 16 bp, M. musculus
ctttgtatcttgcagg

SEQ ID NO: 402503 - DNA, 16 bp, M. musculus
ctttgtatttttaaaa

SEQ ID NO: 402504 - DNA, 16 bp, M. musculus
ctttgtcaaaatcaag

SEQ ID NO: 402505 - DNA, 16 bp, M. musculus
ctttgtcactgaggtt

SEQ ID NO: 402506 - DNA, 16 bp, M. musculus
ctttgtcatgatgttt

SEQ ID NO: 402507 - DNA, 16 bp, M. musculus
ctttgtccacatcctc

SEQ ID NO: 402508 - DNA, 16 bp, M. musculus
ctttgtccacatcctt

SEQ ID NO: 402509 - DNA, 16 bp, M. musculus
ctttgtccccagttgg

SEQ ID NO: 402510 - DNA, 36 bp, M. musculus
ctttgtccctgtgcctgttgaggcagatccagagaa

SEQ ID NO: 402511 - DNA, 16 bp, M. musculus
ctttgtctcaaaagaa

SEQ ID NO: 402512 - DNA, 16 bp, M. musculus
ctttgtctctatattt

SEQ ID NO: 402513 - DNA, 16 bp, M. musculus
ctttgtctctctgtat

SEQ ID NO: 402514 - DNA, 16 bp, M. musculus
ctttgtctctgtgact

SEQ ID NO: 402515 - DNA, 16 bp, M. musculus
ctttgtctgcatgtat

SEQ ID NO: 402516 - DNA, 16 bp, M. musculus
ctttgtctgccactca

SEQ ID NO: 402517 - DNA, 16 bp, M. musculus
ctttgtcttcatattt

SEQ ID NO: 402518 - DNA, 16 bp, M. musculus
ctttgtcttcatcttc

SEQ ID NO: 402519 - DNA, 16 bp, M. musculus
ctttgtcttgcaaact

SEQ ID NO: 402520 - DNA, 16 bp, M. musculus
ctttgtctttataact

SEQ ID NO: 402521 - DNA, 16 bp, M. musculus
ctttgtcttttaaaaa

SEQ ID NO: 402522 - DNA, 16 bp, M. musculus
ctttgtgagttcttta

SEQ ID NO: 402523 - DNA, 16 bp, M. musculus
ctttgtgattgagtta

SEQ ID NO: 402524 - DNA, 16 bp, M. musculus
ctttgtgcatctgtct

SEQ ID NO: 402525 - DNA, 16 bp, M. musculus
ctttgtgcatgtgtgt

SEQ ID NO: 402526 - DNA, 16 bp, M. musculus
ctttgtgcatgttagg

SEQ ID NO: 402527 - DNA, 16 bp, M. musculus
ctttgtggagttggtt

SEQ ID NO: 402528 - DNA, 16 bp, M. musculus
ctttgtggggctggag

SEQ ID NO: 402529 - DNA, 16 bp, M. musculus
ctttgtggtgcacatc

SEQ ID NO: 402530 - DNA, 18 bp, M. musculus
ctttgtgtagagaaaggc

SEQ ID NO: 402531 - DNA, 16 bp, M. musculus
ctttgtgtagccttga

SEQ ID NO: 402532 - DNA, 16 bp, M. musculus
ctttgtgtctttctga

SEQ ID NO: 402533 - DNA, 16 bp, M. musculus
ctttgtgtgtgtctct

SEQ ID NO: 402534 - DNA, 16 bp, M. musculus
ctttgttagagtcatg

SEQ ID NO: 402535 - DNA, 16 bp, M. musculus
ctttgttcattcattc

SEQ ID NO: 402536 - DNA, 16 bp, M. musculus
ctttgttctataagag

SEQ ID NO: 402537 - DNA, 16 bp, M. musculus
ctttgttctatctcag

SEQ ID NO: 402538 - DNA, 18 bp, M. musculus
ctttgttctcatcaaagg

SEQ ID NO: 402539 - DNA, 16 bp, M. musculus
ctttgttctgtcttgg

SEQ ID NO: 402540 - DNA, 16 bp, M. musculus
ctttgttcttcattct

SEQ ID NO: 402541 - DNA, 16 bp, M. musculus
ctttgttcttgagttt

SEQ ID NO: 402542 - DNA, 16 bp, M. musculus
ctttgttgctacttca

SEQ ID NO: 402543 - DNA, 16 bp, M. musculus
ctttgtttacatttta

SEQ ID NO: 402544 - DNA, 16 bp, M. musculus
ctttgtttagccctgt

SEQ ID NO: 402545 - DNA, 16 bp, M. musculus
ctttgtttccatattt

SEQ ID NO: 402546 - DNA, 16 bp, M. musculus
ctttgtttccccagtg

SEQ ID NO: 402547 - DNA, 16 bp, M. musculus
ctttgtttctgaggtg

SEQ ID NO: 402548 - DNA, 16 bp, M. musculus
ctttgttttgagacag

SEQ ID NO: 402549 - DNA, 16 bp, M. musculus
ctttgtttttcaagca

SEQ ID NO: 402550 - DNA, 16 bp, M. musculus
ctttgtttttctgaga

SEQ ID NO: 402551 - DNA, 16 bp, M. musculus
ctttgtttttgagaca

SEQ ID NO: 402552 - DNA, 16 bp, M. musculus
ctttgttttttgagat

SEQ ID NO: 402553 - DNA, 19 bp, M. musculus
ctttgttttttgcaaagga

SEQ ID NO: 402554 - DNA, 16 bp, M. musculus
cttttaaaaacaaaac

SEQ ID NO: 402555 - DNA, 16 bp, M. musculus
cttttaaaaactatta

SEQ ID NO: 402556 - DNA, 16 bp, M. musculus
cttttaaaaagaaaag

SEQ ID NO: 402557 - DNA, 16 bp, M. musculus
cttttaaaaagtttta

SEQ ID NO: 402558 - DNA, 16 bp, M. musculus
cttttaaaaattactt

SEQ ID NO: 402559 - DNA, 16 bp, M. musculus
cttttaaaaattggtt

SEQ ID NO: 402560 - DNA, 16 bp, M. musculus
cttttaaaagaaaaaa

SEQ ID NO: 402561 - DNA, 16 bp, M. musculus
cttttaaaagaaatta

SEQ ID NO: 402562 - DNA, 16 bp, M. musculus
cttttaaaataaagat

SEQ ID NO: 402563 - DNA, 16 bp, M. musculus
cttttaaaatctcaaa

SEQ ID NO: 402564 - DNA, 16 bp, M. musculus
cttttaaaatgctttt

SEQ ID NO: 402565 - DNA, 16 bp, M. musculus
cttttaaaattagaaa

SEQ ID NO: 402566 - DNA, 16 bp, M. musculus
cttttaaagattttat

SEQ ID NO: 402567 - DNA, 16 bp, M. musculus
cttttaaaggaaaaaa

SEQ ID NO: 402568 - DNA, 16 bp, M. musculus
cttttaaagttatttt

SEQ ID NO: 402569 - DNA, 16 bp, M. musculus
cttttaaatcaatcat

SEQ ID NO: 402570 - DNA, 21 bp, M. musculus
cttttaacagctagctgagga

SEQ ID NO: 402571 - DNA, 16 bp, M. musculus
cttttaagcctaaaat

SEQ ID NO: 402572 - DNA, 16 bp, M. musculus
cttttaaggaaaaatg

SEQ ID NO: 402573 - DNA, 16 bp, M. musculus
cttttaagtatctgga

SEQ ID NO: 402574 - DNA, 106 bp, M. musculus
cttttaataagagcaaataggccacccatattaatgagagtggagatagaggtcaaatccccagtgtgtaggtaaaggagccatgtacaggattagctcttaggct

SEQ ID NO: 402575 - DNA, 16 bp, M. musculus
cttttaatatgggttc

SEQ ID NO: 402576 - DNA, 16 bp, M. musculus
cttttaatcccagcac

SEQ ID NO: 402577 - DNA, 26 bp, M. musculus
cttttacattctgtcaggatctttca

SEQ ID NO: 402578 - DNA, 16 bp, M. musculus
cttttacccactgaac

SEQ ID NO: 402579 - DNA, 16 bp, M. musculus
cttttagaaaatattt

SEQ ID NO: 402580 - DNA, 16 bp, M. musculus
cttttagaaattaaaa

SEQ ID NO: 402581 - DNA, 16 bp, M. musculus
cttttagacagggtct

SEQ ID NO: 402582 - DNA, 16 bp, M. musculus
cttttagtattatctt

SEQ ID NO: 402583 - DNA, 16 bp, M. musculus
cttttagtcccagcac

SEQ ID NO: 402584 - DNA, 16 bp, M. musculus
cttttagtctcagcac

SEQ ID NO: 402585 - DNA, 16 bp, M. musculus
cttttataaataaagt

SEQ ID NO: 402586 - DNA, 16 bp, M. musculus
cttttataaattgctt

SEQ ID NO: 402587 - DNA, 16 bp, M. musculus
cttttatataaaaatc

SEQ ID NO: 402588 - DNA, 16 bp, M. musculus
cttttatcagatattt

SEQ ID NO: 402589 - DNA, 16 bp, M. musculus
cttttatcccagcact

SEQ ID NO: 402590 - DNA, 16 bp, M. musculus
cttttatcctgttgtt

SEQ ID NO: 402591 - DNA, 16 bp, M. musculus
cttttatgtatgtgta

SEQ ID NO: 402592 - DNA, 16 bp, M. musculus
cttttatgtgtgtgtg

SEQ ID NO: 402593 - DNA, 16 bp, M. musculus
cttttatgtgttaatt

SEQ ID NO: 402594 - DNA, 16 bp, M. musculus
cttttattaggtattt

SEQ ID NO: 402595 - DNA, 16 bp, M. musculus
cttttattatacagga

SEQ ID NO: 402596 - DNA, 16 bp, M. musculus
cttttattccagcact

SEQ ID NO: 402597 - DNA, 16 bp, M. musculus
cttttattgaaataaa

SEQ ID NO: 402598 - DNA, 16 bp, M. musculus
cttttattggatattt

SEQ ID NO: 402599 - DNA, 16 bp, M. musculus
cttttattgttgagaa

SEQ ID NO: 402600 - DNA, 16 bp, M. musculus
cttttatttcctcaaa

SEQ ID NO: 402601 - DNA, 16 bp, M. musculus
cttttattttgaggta

SEQ ID NO: 402602 - DNA, 16 bp, M. musculus
cttttatttttaagat

SEQ ID NO: 402603 - DNA, 16 bp, M. musculus
cttttatttttgaaaa

SEQ ID NO: 402604 - DNA, 16 bp, M. musculus
cttttcaaaacagggt

SEQ ID NO: 402605 - DNA, 16 bp, M. musculus
cttttcaaaaggaaaa

SEQ ID NO: 402606 - DNA, 16 bp, M. musculus
cttttcaagacagagt

SEQ ID NO: 402607 - DNA, 16 bp, M. musculus
cttttcaataaaatct

SEQ ID NO: 402608 - DNA, 16 bp, M. musculus
cttttcaattaaaaaa

SEQ ID NO: 402609 - DNA, 16 bp, M. musculus
cttttcacctgtgtct

SEQ ID NO: 402610 - DNA, 16 bp, M. musculus
cttttcacctgtgtgc

SEQ ID NO: 402611 - DNA, 17 bp, M. musculus
cttttcactcctagggc

SEQ ID NO: 402612 - DNA, 16 bp, M. musculus
cttttcacttaggaaa

SEQ ID NO: 402613 - DNA, 16 bp, M. musculus
cttttcaggtgtttct

SEQ ID NO: 402614 - DNA, 16 bp, M. musculus
cttttcattgctgatt

SEQ ID NO: 402615 - DNA, 16 bp, M. musculus
cttttccatctcctgt

SEQ ID NO: 402616 - DNA, 16 bp, M. musculus
cttttccattaatctt

SEQ ID NO: 402617 - DNA, 16 bp, M. musculus
cttttccattgctgtg

SEQ ID NO: 402618 - DNA, 16 bp, M. musculus
cttttcccagtctgtt

SEQ ID NO: 402619 - DNA, 16 bp, M. musculus
cttttccccactgtct

SEQ ID NO: 402620 - DNA, 16 bp, M. musculus
cttttcctcagcctcc

SEQ ID NO: 402621 - DNA, 16 bp, M. musculus
cttttcctgtggaaat

SEQ ID NO: 402622 - DNA, 16 bp, M. musculus
cttttcctgttgctgt

SEQ ID NO: 402623 - DNA, 16 bp, M. musculus
cttttccttaatatct

SEQ ID NO: 402624 - DNA, 18 bp, M. musculus
cttttccttaatatctct

SEQ ID NO: 402625 - DNA, 16 bp, M. musculus
cttttccttaatgtct

SEQ ID NO: 402626 - DNA, 16 bp, M. musculus
cttttccttcagtttc

SEQ ID NO: 402627 - DNA, 16 bp, M. musculus
cttttccttcccaagt

SEQ ID NO: 402628 - DNA, 16 bp, M. musculus
cttttccttcctccaa

SEQ ID NO: 402629 - DNA, 16 bp, M. musculus
cttttccttttgaatt

SEQ ID NO: 402630 - DNA, 18 bp, M. musculus
cttttcgagacagggttt

SEQ ID NO: 402631 - DNA, 16 bp, M. musculus
cttttctaaagaaaaa

SEQ ID NO: 402632 - DNA, 16 bp, M. musculus
cttttctaattaaaaa

SEQ ID NO: 402633 - DNA, 16 bp, M. musculus
cttttctacaataaag

SEQ ID NO: 402634 - DNA, 16 bp, M. musculus
cttttctaggttttcc

SEQ ID NO: 402635 - DNA, 16 bp, M. musculus
cttttctagtgtgtct

SEQ ID NO: 402636 - DNA, 16 bp, M. musculus
cttttctataaaaccc

SEQ ID NO: 402637 - DNA, 16 bp, M. musculus
cttttctataataaag

SEQ ID NO: 402638 - DNA, 16 bp, M. musculus
cttttctatctatcta

SEQ ID NO: 402639 - DNA, 16 bp, M. musculus
cttttctcacactgct

SEQ ID NO: 402640 - DNA, 16 bp, M. musculus
cttttctcatcataat

SEQ ID NO: 402641 - DNA, 16 bp, M. musculus
cttttctcattgctgt

SEQ ID NO: 402642 - DNA, 16 bp, M. musculus
cttttctccatcagaa

SEQ ID NO: 402643 - DNA, 16 bp, M. musculus
cttttctccatttttg

SEQ ID NO: 402644 - DNA, 16 bp, M. musculus
cttttctcctcaactt

SEQ ID NO: 402645 - DNA, 16 bp, M. musculus
cttttctccttaaaaa

SEQ ID NO: 402646 - DNA, 16 bp, M. musculus
cttttctctcagctcc

SEQ ID NO: 402647 - DNA, 16 bp, M. musculus
cttttctctttccaaa

SEQ ID NO: 402648 - DNA, 16 bp, M. musculus
cttttctcttttgtca

SEQ ID NO: 402649 - DNA, 16 bp, M. musculus
cttttctgaaaggaaa

SEQ ID NO: 402650 - DNA, 16 bp, M. musculus
cttttctgaagagaaa

SEQ ID NO: 402651 - DNA, 16 bp, M. musculus
cttttctgaagttgtt

SEQ ID NO: 402652 - DNA, 16 bp, M. musculus
cttttctgactgagcc

SEQ ID NO: 402653 - DNA, 16 bp, M. musculus
cttttctgagacaagg

SEQ ID NO: 402654 - DNA, 16 bp, M. musculus
cttttctgaggagaag

SEQ ID NO: 402655 - DNA, 16 bp, M. musculus
cttttctgatgagaaa

SEQ ID NO: 402656 - DNA, 16 bp, M. musculus
cttttctggaaaaaaa

SEQ ID NO: 402657 - DNA, 16 bp, M. musculus
cttttctggaatgtct

SEQ ID NO: 402658 - DNA, 16 bp, M. musculus
cttttctggagcaaca

SEQ ID NO: 402659 - DNA, 16 bp, M. musculus
cttttctgtgaagcag

SEQ ID NO: 402660 - DNA, 16 bp, M. musculus
cttttctgtggctgtg

SEQ ID NO: 402661 - DNA, 16 bp, M. musculus
cttttctgttgtgatg

SEQ ID NO: 402662 - DNA, 16 bp, M. musculus
cttttctgtttctcat

SEQ ID NO: 402663 - DNA, 16 bp, M. musculus
cttttctgtttttaaa

SEQ ID NO: 402664 - DNA, 16 bp, M. musculus
cttttcttccagagga

SEQ ID NO: 402665 - DNA, 16 bp, M. musculus
cttttcttcttccatg

SEQ ID NO: 402666 - DNA, 34 bp, M. musculus
cttttctttaaggacttgtaactctttagcagtg

SEQ ID NO: 402667 - DNA, 16 bp, M. musculus
cttttctttcagctcc

SEQ ID NO: 402668 - DNA, 16 bp, M. musculus
cttttctttcccaagt

SEQ ID NO: 402669 - DNA, 16 bp, M. musculus
cttttctttctcactg

SEQ ID NO: 402670 - DNA, 16 bp, M. musculus
cttttcttttaaaaaa

SEQ ID NO: 402671 - DNA, 16 bp, M. musculus
cttttcttttaagatt

SEQ ID NO: 402672 - DNA, 16 bp, M. musculus
cttttcttttattgga

SEQ ID NO: 402673 - DNA, 16 bp, M. musculus
cttttcttttgagaca

SEQ ID NO: 402674 - DNA, 16 bp, M. musculus
cttttctttttctgag

SEQ ID NO: 402675 - DNA, 16 bp, M. musculus
cttttcttttttaaag

SEQ ID NO: 402676 - DNA, 16 bp, M. musculus
cttttgaaaaaaaaaa

SEQ ID NO: 402677 - DNA, 16 bp, M. musculus
cttttgaaaattcaaa

SEQ ID NO: 402678 - DNA, 16 bp, M. musculus
cttttgaaaccttaaa

SEQ ID NO: 402679 - DNA, 16 bp, M. musculus
cttttgaagatgcagt

SEQ ID NO: 402680 - DNA, 16 bp, M. musculus
cttttgaaggtcctga

SEQ ID NO: 402681 - DNA, 16 bp, M. musculus
cttttgacattgtgac

SEQ ID NO: 402682 - DNA, 16 bp, M. musculus
cttttgagacagagtc

SEQ ID NO: 402683 - DNA, 16 bp, M. musculus
cttttgagatcttctt

SEQ ID NO: 402684 - DNA, 16 bp, M. musculus
cttttgagattttcaa

SEQ ID NO: 402685 - DNA, 16 bp, M. musculus
cttttgagccttgtgg

SEQ ID NO: 402686 - DNA, 16 bp, M. musculus
cttttgaggagactgt

SEQ ID NO: 402687 - DNA, 16 bp, M. musculus
cttttgataacaccat

SEQ ID NO: 402688 - DNA, 16 bp, M. musculus
cttttgcagaggacct

SEQ ID NO: 402689 - DNA, 16 bp, M. musculus
cttttgcagaggactc

SEQ ID NO: 402690 - DNA, 16 bp, M. musculus
cttttgcatttttaaa

SEQ ID NO: 402691 - DNA, 16 bp, M. musculus
cttttgcccactgagc

SEQ ID NO: 402692 - DNA, 16 bp, M. musculus
cttttgccctgcctct

SEQ ID NO: 402693 - DNA, 16 bp, M. musculus
cttttgctgtaagatc

SEQ ID NO: 402694 - DNA, 16 bp, M. musculus
cttttggagtttgggg

SEQ ID NO: 402695 - DNA, 16 bp, M. musculus
cttttggattctggag

SEQ ID NO: 402696 - DNA, 17 bp, M. musculus
cttttggcaactacatg

SEQ ID NO: 402697 - DNA, 16 bp, M. musculus
cttttggctccttctc

SEQ ID NO: 402698 - DNA, 16 bp, M. musculus
cttttgggacaggcag

SEQ ID NO: 402699 - DNA, 16 bp, M. musculus
cttttgggataacact

SEQ ID NO: 402700 - DNA, 16 bp, M. musculus
cttttgggggggaggg

SEQ ID NO: 402701 - DNA, 16 bp, M. musculus
cttttgggtacatgcc

SEQ ID NO: 402702 - DNA, 16 bp, M. musculus
cttttggtctctgtgg

SEQ ID NO: 402703 - DNA, 16 bp, M. musculus
cttttggtgaccttgg

SEQ ID NO: 402704 - DNA, 16 bp, M. musculus
cttttggttttgagac

SEQ ID NO: 402705 - DNA, 16 bp, M. musculus
cttttggttttttgag

SEQ ID NO: 402706 - DNA, 16 bp, M. musculus
cttttgtaccttacct

SEQ ID NO: 402707 - DNA, 16 bp, M. musculus
cttttgtatcttctat

SEQ ID NO: 402708 - DNA, 16 bp, M. musculus
cttttgtcccagctcc

SEQ ID NO: 402709 - DNA, 16 bp, M. musculus
cttttgtgattgcatt

SEQ ID NO: 402710 - DNA, 16 bp, M. musculus
cttttgtgattgggta

SEQ ID NO: 402711 - DNA, 16 bp, M. musculus
cttttgtggatgccaa

SEQ ID NO: 402712 - DNA, 16 bp, M. musculus
cttttgtggcattttt

SEQ ID NO: 402713 - DNA, 16 bp, M. musculus
cttttgtgtaatgatt

SEQ ID NO: 402714 - DNA, 16 bp, M. musculus
cttttgtgtttacatt

SEQ ID NO: 402715 - DNA, 16 bp, M. musculus
cttttgttgtctaatt

SEQ ID NO: 402716 - DNA, 16 bp, M. musculus
cttttgttgtctcatt

SEQ ID NO: 402717 - DNA, 16 bp, M. musculus
cttttgttgtgcaaac

SEQ ID NO: 402718 - DNA, 16 bp, M. musculus
cttttgtttaaaaaaa

SEQ ID NO: 402719 - DNA, 16 bp, M. musculus
cttttgttttataaaa

SEQ ID NO: 402720 - DNA, 16 bp, M. musculus
cttttgtttttaaaga

SEQ ID NO: 402721 - DNA, 16 bp, M. musculus
cttttgtttttcaaga

SEQ ID NO: 402722 - DNA, 16 bp, M. musculus
ctttttaaaaaaaaga

SEQ ID NO: 402723 - DNA, 16 bp, M. musculus
ctttttaaaaaaagat

SEQ ID NO: 402724 - DNA, 16 bp, M. musculus
ctttttaaaaaacaat

SEQ ID NO: 402725 - DNA, 16 bp, M. musculus
ctttttaaaaaacttt

SEQ ID NO: 402726 - DNA, 16 bp, M. musculus
ctttttaaaaagaaaa

SEQ ID NO: 402727 - DNA, 16 bp, M. musculus
ctttttaaaaagagaa

SEQ ID NO: 402728 - DNA, 16 bp, M. musculus
ctttttaaaaagttct

SEQ ID NO: 402729 - DNA, 16 bp, M. musculus
ctttttaaaaatagta

SEQ ID NO: 402730 - DNA, 16 bp, M. musculus
ctttttaaaaatatgt

SEQ ID NO: 402731 - DNA, 16 bp, M. musculus
ctttttaaaagttatt

SEQ ID NO: 402732 - DNA, 16 bp, M. musculus
ctttttaaaatagaaa

SEQ ID NO: 402733 - DNA, 16 bp, M. musculus
ctttttaaaattctgt

SEQ ID NO: 402734 - DNA, 16 bp, M. musculus
ctttttaaaatttcct

SEQ ID NO: 402735 - DNA, 16 bp, M. musculus
ctttttaaagaaaaag

SEQ ID NO: 402736 - DNA, 16 bp, M. musculus
ctttttaaagatttat

SEQ ID NO: 402737 - DNA, 16 bp, M. musculus
ctttttaaagtatttt

SEQ ID NO: 402738 - DNA, 16 bp, M. musculus
ctttttaaagtgtgtg

SEQ ID NO: 402739 - DNA, 16 bp, M. musculus
ctttttaaagttattt

SEQ ID NO: 402740 - DNA, 16 bp, M. musculus
ctttttaaatatttcc

SEQ ID NO: 402741 - DNA, 16 bp, M. musculus
ctttttaaatgaaaga

SEQ ID NO: 402742 - DNA, 16 bp, M. musculus
ctttttaagagaaaag

SEQ ID NO: 402743 - DNA, 16 bp, M. musculus
ctttttaaggtttatt

SEQ ID NO: 402744 - DNA, 16 bp, M. musculus
ctttttaatcataccc

SEQ ID NO: 402745 - DNA, 16 bp, M. musculus
ctttttaatgtgttct

SEQ ID NO: 402746 - DNA, 16 bp, M. musculus
ctttttaggtaaaatt

SEQ ID NO: 402747 - DNA, 16 bp, M. musculus
ctttttatacagtcca

SEQ ID NO: 402748 - DNA, 16 bp, M. musculus
ctttttatacatttca

SEQ ID NO: 402749 - DNA, 16 bp, M. musculus
ctttttatatattgaa

SEQ ID NO: 402750 - DNA, 16 bp, M. musculus
ctttttatgcagagga

SEQ ID NO: 402751 - DNA, 16 bp, M. musculus
ctttttcaacaaatgg

SEQ ID NO: 402752 - DNA, 16 bp, M. musculus
ctttttcagttttcct

SEQ ID NO: 402753 - DNA, 16 bp, M. musculus
ctttttcatctttaca

SEQ ID NO: 402754 - DNA, 16 bp, M. musculus
ctttttcatgagaaag

SEQ ID NO: 402755 - DNA, 16 bp, M. musculus
ctttttcatgtgtgtg

SEQ ID NO: 402756 - DNA, 16 bp, M. musculus
ctttttccacatcctc

SEQ ID NO: 402757 - DNA, 16 bp, M. musculus
ctttttccatttttag

SEQ ID NO: 402758 - DNA, 16 bp, M. musculus
ctttttcctttccaaa

SEQ ID NO: 402759 - DNA, 16 bp, M. musculus
ctttttctaactctat

SEQ ID NO: 402760 - DNA, 16 bp, M. musculus
ctttttctaggacgtg

SEQ ID NO: 402761 - DNA, 16 bp, M. musculus
ctttttctctgtatct

SEQ ID NO: 402762 - DNA, 16 bp, M. musculus
ctttttctgcctgaga

SEQ ID NO: 402763 - DNA, 16 bp, M. musculus
ctttttctttaaaaaa

SEQ ID NO: 402764 - DNA, 16 bp, M. musculus
ctttttctttagggga

SEQ ID NO: 402765 - DNA, 16 bp, M. musculus
ctttttgagacagagt

SEQ ID NO: 402766 - DNA, 16 bp, M. musculus
ctttttgagatagagt

SEQ ID NO: 402767 - DNA, 16 bp, M. musculus
ctttttgagatagggt

SEQ ID NO: 402768 - DNA, 16 bp, M. musculus
ctttttgaggcagggt

SEQ ID NO: 402769 - DNA, 16 bp, M. musculus
ctttttgatgtcttct

SEQ ID NO: 402770 - DNA, 16 bp, M. musculus
ctttttgcactttgca

SEQ ID NO: 402771 - DNA, 16 bp, M. musculus
ctttttgcttctactt

SEQ ID NO: 402772 - DNA, 16 bp, M. musculus
ctttttggaagcactt

SEQ ID NO: 402773 - DNA, 16 bp, M. musculus
ctttttggcatctgca

SEQ ID NO: 402774 - DNA, 16 bp, M. musculus
ctttttggccctggaa

SEQ ID NO: 402775 - DNA, 16 bp, M. musculus
ctttttggccctggcg

SEQ ID NO: 402776 - DNA, 16 bp, M. musculus
ctttttggctttttga

SEQ ID NO: 402777 - DNA, 16 bp, M. musculus
ctttttgtcttatcga

SEQ ID NO: 402778 - DNA, 16 bp, M. musculus
ctttttgtcttattga

SEQ ID NO: 402779 - DNA, 16 bp, M. musculus
ctttttgttactgtaa

SEQ ID NO: 402780 - DNA, 17 bp, M. musculus
ctttttgtttttcaaga

SEQ ID NO: 402781 - DNA, 16 bp, M. musculus
cttttttaaaaaaaag

SEQ ID NO: 402782 - DNA, 16 bp, M. musculus
cttttttaaaaaaaca

SEQ ID NO: 402783 - DNA, 16 bp, M. musculus
cttttttaaaaacaga

SEQ ID NO: 402784 - DNA, 16 bp, M. musculus
cttttttaaaaagagg

SEQ ID NO: 402785 - DNA, 16 bp, M. musculus
cttttttaaaaagtaa

SEQ ID NO: 402786 - DNA, 16 bp, M. musculus
cttttttaaaaagtag

SEQ ID NO: 402787 - DNA, 16 bp, M. musculus
cttttttaaaatgtag

SEQ ID NO: 402788 - DNA, 16 bp, M. musculus
cttttttaaagattta

SEQ ID NO: 402789 - DNA, 16 bp, M. musculus
cttttttccccccaag

SEQ ID NO: 402790 - DNA, 16 bp, M. musculus
cttttttgaaaagaaa

SEQ ID NO: 402791 - DNA, 16 bp, M. musculus
cttttttgagacagaa

SEQ ID NO: 402792 - DNA, 16 bp, M. musculus
cttttttgagacaggg

SEQ ID NO: 402793 - DNA, 16 bp, M. musculus
cttttttgcattttcc

SEQ ID NO: 402794 - DNA, 16 bp, M. musculus
cttttttggtaacttt

SEQ ID NO: 402795 - DNA, 16 bp, M. musculus
ctttttttaaaaagta

SEQ ID NO: 402796 - DNA, 16 bp, M. musculus
ctttttttaaaagaaa

SEQ ID NO: 402797 - DNA, 16 bp, M. musculus
ctttttttaaaattag

SEQ ID NO: 402798 - DNA, 16 bp, M. musculus
ctttttttaaatgtgt

SEQ ID NO: 402799 - DNA, 16 bp, M. musculus
ctttttttaagaaaag

SEQ ID NO: 402800 - DNA, 16 bp, M. musculus
ctttttttccaagaca

SEQ ID NO: 402801 - DNA, 16 bp, M. musculus
ctttttttctttaaag

SEQ ID NO: 402802 - DNA, 16 bp, M. musculus
ctttttttggggggga

SEQ ID NO: 402803 - DNA, 16 bp, M. musculus
cttttttttaaagaca

SEQ ID NO: 402804 - DNA, 16 bp, M. musculus
cttttttttaattaga

SEQ ID NO: 402805 - DNA, 16 bp, M. musculus
ctttttttttaaaaga

SEQ ID NO: 402806 - DNA, 16 bp, M. musculus
ctttttttttaaagat

SEQ ID NO: 402807 - DNA, 16 bp, M. musculus
ctttttttttaaagca

SEQ ID NO: 402808 - DNA, 16 bp, M. musculus
ctttttttttaaggta

SEQ ID NO: 402809 - DNA, 16 bp, M. musculus
ctttttttttaatgaa

SEQ ID NO: 402810 - DNA, 16 bp, M. musculus
ctttttttttccagaa

SEQ ID NO: 402811 - DNA, 16 bp, M. musculus
ctttttttttccctag

SEQ ID NO: 402812 - DNA, 16 bp, M. musculus
ctttttttttctgaga

SEQ ID NO: 402813 - DNA, 16 bp, M. musculus
cttttttttttaaaga

SEQ ID NO: 402814 - DNA, 16 bp, M. musculus
cttttttttttaaagg

SEQ ID NO: 402815 - DNA, 16 bp, M. musculus
gaaaaaaaaaagctgt

SEQ ID NO: 402816 - DNA, 16 bp, M. musculus
gaaaaaaaaatcactt

SEQ ID NO: 402817 - DNA, 16 bp, M. musculus
gaaaaaaaaatcatcc

SEQ ID NO: 402818 - DNA, 16 bp, M. musculus
gaaaaaaaaatccact

SEQ ID NO: 402819 - DNA, 16 bp, M. musculus
gaaaaaaaaatccatg

SEQ ID NO: 402820 - DNA, 16 bp, M. musculus
gaaaaaaaatcacttt

SEQ ID NO: 402821 - DNA, 16 bp, M. musculus
gaaaaaaaatcatttg

SEQ ID NO: 402822 - DNA, 16 bp, M. musculus
gaaaaaaaatccatat

SEQ ID NO: 402823 - DNA, 16 bp, M. musculus
gaaaaaaaatgtgtgt

SEQ ID NO: 402824 - DNA, 16 bp, M. musculus
gaaaaaaaatgttttc

SEQ ID NO: 402825 - DNA, 16 bp, M. musculus
gaaaaaaaattcctga

SEQ ID NO: 402826 - DNA, 16 bp, M. musculus
gaaaaaaacccagatg

SEQ ID NO: 402827 - DNA, 16 bp, M. musculus
gaaaaaaatctatttt

SEQ ID NO: 402828 - DNA, 16 bp, M. musculus
gaaaaaaatctggaaa

SEQ ID NO: 402829 - DNA, 16 bp, M. musculus
gaaaaaaatgtttttt

SEQ ID NO: 402830 - DNA, 16 bp, M. musculus
gaaaaaaattcctaaa

SEQ ID NO: 402831 - DNA, 16 bp, M. musculus
gaaaaaaatttcaata

SEQ ID NO: 402832 - DNA, 16 bp, M. musculus
gaaaaaacatttgaca

SEQ ID NO: 402833 - DNA, 16 bp, M. musculus
gaaaaaagaaaactct

SEQ ID NO: 402834 - DNA, 16 bp, M. musculus
gaaaaaagacaacatt

SEQ ID NO: 402835 - DNA, 16 bp, M. musculus
gaaaaaagacaatatt

SEQ ID NO: 402836 - DNA, 16 bp, M. musculus
gaaaaaagccaggcat

SEQ ID NO: 402837 - DNA, 16 bp, M. musculus
gaaaaaagtcaagtaa

SEQ ID NO: 402838 - DNA, 16 bp, M. musculus
gaaaaaagtcaatgaa

SEQ ID NO: 402839 - DNA, 16 bp, M. musculus
gaaaaaatatatacat

SEQ ID NO: 402840 - DNA, 16 bp, M. musculus
gaaaaaatattcaaca

SEQ ID NO: 402841 - DNA, 16 bp, M. musculus
gaaaaacaaattttaa

SEQ ID NO: 402842 - DNA, 16 bp, M. musculus
gaaaaacactatgaaa

SEQ ID NO: 402843 - DNA, 16 bp, M. musculus
gaaaaacacttgtaac

SEQ ID NO: 402844 - DNA, 16 bp, M. musculus
gaaaaacattatgaac

SEQ ID NO: 402845 - DNA, 16 bp, M. musculus
gaaaaacattttttaa

SEQ ID NO: 402846 - DNA, 16 bp, M. musculus
gaaaaaccatatatat

SEQ ID NO: 402847 - DNA, 16 bp, M. musculus
gaaaaaccatttaaaa

SEQ ID NO: 402848 - DNA, 16 bp, M. musculus
gaaaaactagttttct

SEQ ID NO: 402849 - DNA, 16 bp, M. musculus
gaaaaagaaaatgtgt

SEQ ID NO: 402850 - DNA, 16 bp, M. musculus
gaaaaagaaacagttt

SEQ ID NO: 402851 - DNA, 16 bp, M. musculus
gaaaaagatgaagcga

SEQ ID NO: 402852 - DNA, 16 bp, M. musculus
gaaaaagcaagcaagc

SEQ ID NO: 402853 - DNA, 16 bp, M. musculus
gaaaaagcagaggtaa

SEQ ID NO: 402854 - DNA, 16 bp, M. musculus
gaaaaagctggaagaa

SEQ ID NO: 402855 - DNA, 16 bp, M. musculus
gaaaaaggaagactaa

SEQ ID NO: 402856 - DNA, 16 bp, M. musculus
gaaaaaggataacatt

SEQ ID NO: 402857 - DNA, 16 bp, M. musculus
gaaaaaggtcaagaaa

SEQ ID NO: 402858 - DNA, 16 bp, M. musculus
gaaaaagtcttcacta

SEQ ID NO: 402859 - DNA, 16 bp, M. musculus
gaaaaagttcaagtaa

SEQ ID NO: 402860 - DNA, 16 bp, M. musculus
gaaaaatacattcaga

SEQ ID NO: 402861 - DNA, 16 bp, M. musculus
gaaaaatattggcaac

SEQ ID NO: 402862 - DNA, 16 bp, M. musculus
gaaaaatatttttgtt

SEQ ID NO: 402863 - DNA, 16 bp, M. musculus
gaaaaatcaacaagat

SEQ ID NO: 402864 - DNA, 16 bp, M. musculus
gaaaaatcaaccaaga

SEQ ID NO: 402865 - DNA, 16 bp, M. musculus
gaaaaatctaccaaga

SEQ ID NO: 402866 - DNA, 16 bp, M. musculus
gaaaaatgccctacag

SEQ ID NO: 402867 - DNA, 16 bp, M. musculus
gaaaaatgttgaagat

SEQ ID NO: 402868 - DNA, 16 bp, M. musculus
gaaaaattactttctt

SEQ ID NO: 402869 - DNA, 16 bp, M. musculus
gaaaaattcctgaaaa

SEQ ID NO: 402870 - DNA, 16 bp, M. musculus
gaaaaattgttcaaca

SEQ ID NO: 402871 - DNA, 16 bp, M. musculus
gaaaacaaaatatatt

SEQ ID NO: 402872 - DNA, 16 bp, M. musculus
gaaaacaaaattccaa

SEQ ID NO: 402873 - DNA, 16 bp, M. musculus
gaaaacaacctaaatg

SEQ ID NO: 402874 - DNA, 16 bp, M. musculus
gaaaacacaaactgaa

SEQ ID NO: 402875 - DNA, 16 bp, M. musculus
gaaaacacacatgcat

SEQ ID NO: 402876 - DNA, 16 bp, M. musculus
gaaaacacagatgttt

SEQ ID NO: 402877 - DNA, 17 bp, M. musculus
gaaaacactgctaaaga

SEQ ID NO: 402878 - DNA, 16 bp, M. musculus
gaaaacactgttttct

SEQ ID NO: 402879 - DNA, 16 bp, M. musculus
gaaaacacttagagca

SEQ ID NO: 402880 - DNA, 16 bp, M. musculus
gaaaacagcttttctg

SEQ ID NO: 402881 - DNA, 16 bp, M. musculus
gaaaacaggtctttaa

SEQ ID NO: 402882 - DNA, 17 bp, M. musculus
gaaaacagtgcagaaga

SEQ ID NO: 402883 - DNA, 16 bp, M. musculus
gaaaacagttacagtg

SEQ ID NO: 402884 - DNA, 16 bp, M. musculus
gaaaacataaagaacc

SEQ ID NO: 402885 - DNA, 16 bp, M. musculus
gaaaacatgagttcaa

SEQ ID NO: 402886 - DNA, 16 bp, M. musculus
gaaaacatggccctga

SEQ ID NO: 402887 - DNA, 16 bp, M. musculus
gaaaacattaccaaac

SEQ ID NO: 402888 - DNA, 16 bp, M. musculus
gaaaacattgctaaac

SEQ ID NO: 402889 - DNA, 17 bp, M. musculus
gaaaacatttaattggg

SEQ ID NO: 402890 - DNA, 16 bp, M. musculus
gaaaacatttgacaaa

SEQ ID NO: 402891 - DNA, 16 bp, M. musculus
gaaaacattttaattg

SEQ ID NO: 402892 - DNA, 16 bp, M. musculus
gaaaacattttattgg

SEQ ID NO: 402893 - DNA, 16 bp, M. musculus
gaaaacattttgaaaa

SEQ ID NO: 402894 - DNA, 16 bp, M. musculus
gaaaaccaaataaacc

SEQ ID NO: 402895 - DNA, 16 bp, M. musculus
gaaaaccaatttttat

SEQ ID NO: 402896 - DNA, 16 bp, M. musculus
gaaaaccactgctcta

SEQ ID NO: 402897 - DNA, 16 bp, M. musculus
gaaaaccagaagagcc

SEQ ID NO: 402898 - DNA, 16 bp, M. musculus
gaaaacccaaagtgtg

SEQ ID NO: 402899 - DNA, 16 bp, M. musculus
gaaaacccagaccctg

SEQ ID NO: 402900 - DNA, 16 bp, M. musculus
gaaaacctaagaaaga

SEQ ID NO: 402901 - DNA, 16 bp, M. musculus
gaaaacctaggaaaga

SEQ ID NO: 402902 - DNA, 16 bp, M. musculus
gaaaacctaggaaata

SEQ ID NO: 402903 - DNA, 16 bp, M. musculus
gaaaacctggaagaag

SEQ ID NO: 402904 - DNA, 16 bp, M. musculus
gaaaacctggatgaag

SEQ ID NO: 402905 - DNA, 16 bp, M. musculus
gaaaacctgggaaaga

SEQ ID NO: 402906 - DNA, 16 bp, M. musculus
gaaaacctgggtgctg

SEQ ID NO: 402907 - DNA, 16 bp, M. musculus
gaaaactaatttttcc

SEQ ID NO: 402908 - DNA, 16 bp, M. musculus
gaaaactcaaagctct

SEQ ID NO: 402909 - DNA, 16 bp, M. musculus
gaaaactccaacctaa

SEQ ID NO: 402910 - DNA, 16 bp, M. musculus
gaaaactgaagagctc

SEQ ID NO: 402911 - DNA, 16 bp, M. musculus
gaaaactgacttccag

SEQ ID NO: 402912 - DNA, 16 bp, M. musculus
gaaaactgaggctcag

SEQ ID NO: 402913 - DNA, 16 bp, M. musculus
gaaaactgattttttt

SEQ ID NO: 402914 - DNA, 16 bp, M. musculus
gaaaactgctaacagg

SEQ ID NO: 402915 - DNA, 16 bp, M. musculus
gaaaactggaaaacct

SEQ ID NO: 402916 - DNA, 16 bp, M. musculus
gaaaactggaaagggg

SEQ ID NO: 402917 - DNA, 16 bp, M. musculus
gaaaactggaaataga

SEQ ID NO: 402918 - DNA, 16 bp, M. musculus
gaaaactgtaaatatt

SEQ ID NO: 402919 - DNA, 16 bp, M. musculus
gaaaacttccctaacc

SEQ ID NO: 402920 - DNA, 16 bp, M. musculus
gaaaacttggatgaaa

SEQ ID NO: 402921 - DNA, 16 bp, M. musculus
gaaaactttgacacaa

SEQ ID NO: 402922 - DNA, 16 bp, M. musculus
gaaaagaaaaagtctt

SEQ ID NO: 402923 - DNA, 16 bp, M. musculus
gaaaagaaaaattcta

SEQ ID NO: 402924 - DNA, 16 bp, M. musculus
gaaaagaaaactgaag

SEQ ID NO: 402925 - DNA, 16 bp, M. musculus
gaaaagaaagcaaatg

SEQ ID NO: 402926 - DNA, 16 bp, M. musculus
gaaaagaaagtccagt

SEQ ID NO: 402927 - DNA, 16 bp, M. musculus
gaaaagaaattcagaa

SEQ ID NO: 402928 - DNA, 16 bp, M. musculus
gaaaagaaatttgtcc

SEQ ID NO: 402929 - DNA, 16 bp, M. musculus
gaaaagaagtcaaagt

SEQ ID NO: 402930 - DNA, 16 bp, M. musculus
gaaaagaatattcttt

SEQ ID NO: 402931 - DNA, 16 bp, M. musculus
gaaaagaatctttaat

SEQ ID NO: 402932 - DNA, 16 bp, M. musculus
gaaaagaatgaagatt

SEQ ID NO: 402933 - DNA, 16 bp, M. musculus
gaaaagaatttcctcc

SEQ ID NO: 402934 - DNA, 16 bp, M. musculus
gaaaagaatttttttt

SEQ ID NO: 402935 - DNA, 16 bp, M. musculus
gaaaagacaccatgac

SEQ ID NO: 402936 - DNA, 16 bp, M. musculus
gaaaagacaccctgag

SEQ ID NO: 402937 - DNA, 16 bp, M. musculus
gaaaagacagcatttt

SEQ ID NO: 402938 - DNA, 16 bp, M. musculus
gaaaagactttctgaa

SEQ ID NO: 402939 - DNA, 16 bp, M. musculus
gaaaagagcaggcctc

SEQ ID NO: 402940 - DNA, 16 bp, M. musculus
gaaaagatatttattt

SEQ ID NO: 402941 - DNA, 16 bp, M. musculus
gaaaagatcatcctga

SEQ ID NO: 402942 - DNA, 16 bp, M. musculus
gaaaagatctttacta

SEQ ID NO: 402943 - DNA, 16 bp, M. musculus
gaaaagcaacttgggg

SEQ ID NO: 402944 - DNA, 16 bp, M. musculus
gaaaagcaagaaagta

SEQ ID NO: 402945 - DNA, 16 bp, M. musculus
gaaaagcaagacccag

SEQ ID NO: 402946 - DNA, 16 bp, M. musculus
gaaaagcagaggcaga

SEQ ID NO: 402947 - DNA, 16 bp, M. musculus
gaaaagcagcaagtgc

SEQ ID NO: 402948 - DNA, 16 bp, M. musculus
gaaaagcagccagtac

SEQ ID NO: 402949 - DNA, 16 bp, M. musculus
gaaaagcattcatctc

SEQ ID NO: 402950 - DNA, 16 bp, M. musculus
gaaaagcattgaagat

SEQ ID NO: 402951 - DNA, 16 bp, M. musculus
gaaaagccagggctac

SEQ ID NO: 402952 - DNA, 16 bp, M. musculus
gaaaagccttgaagat

SEQ ID NO: 402953 - DNA, 16 bp, M. musculus
gaaaagctagacatgg

SEQ ID NO: 402954 - DNA, 16 bp, M. musculus
gaaaagctgaaagaag

SEQ ID NO: 402955 - DNA, 16 bp, M. musculus
gaaaagctgaggcagg

SEQ ID NO: 402956 - DNA, 16 bp, M. musculus
gaaaagctggggtcag

SEQ ID NO: 402957 - DNA, 16 bp, M. musculus
gaaaagcttctgcaag

SEQ ID NO: 402958 - DNA, 16 bp, M. musculus
gaaaagcttttgcaag

SEQ ID NO: 402959 - DNA, 16 bp, M. musculus
gaaaaggaagaattca

SEQ ID NO: 402960 - DNA, 16 bp, M. musculus
gaaaaggcacttgctg

SEQ ID NO: 402961 - DNA, 16 bp, M. musculus
gaaaaggctggagaga

SEQ ID NO: 402962 - DNA, 16 bp, M. musculus
gaaaagggacactggg

SEQ ID NO: 402963 - DNA, 16 bp, M. musculus
gaaaagtggatgtggt

SEQ ID NO: 402964 - DNA, 16 bp, M. musculus
gaaaagtgggcagcct

SEQ ID NO: 402965 - DNA, 16 bp, M. musculus
gaaaagttactgcagc

SEQ ID NO: 402966 - DNA, 17 bp, M. musculus
gaaaagttagggagaga

SEQ ID NO: 402967 - DNA, 16 bp, M. musculus
gaaaagttggaagaag

SEQ ID NO: 402968 - DNA, 16 bp, M. musculus
gaaaagtttccagaat

SEQ ID NO: 402969 - DNA, 16 bp, M. musculus
gaaaagttttgtcaca

SEQ ID NO: 402970 - DNA, 16 bp, M. musculus
gaaaataaaaacattt

SEQ ID NO: 402971 - DNA, 16 bp, M. musculus
gaaaataaagacattt

SEQ ID NO: 402972 - DNA, 16 bp, M. musculus
gaaaataaaggcacaa

SEQ ID NO: 402973 - DNA, 16 bp, M. musculus
gaaaataaattatctt

SEQ ID NO: 402974 - DNA, 16 bp, M. musculus
gaaaataaattcattt

SEQ ID NO: 402975 - DNA, 16 bp, M. musculus
gaaaataacttttttt

SEQ ID NO: 402976 - DNA, 16 bp, M. musculus
gaaaataagttttaga

SEQ ID NO: 402977 - DNA, 16 bp, M. musculus
gaaaataatgttttaa

SEQ ID NO: 402978 - DNA, 16 bp, M. musculus
gaaaatacaccctaga

SEQ ID NO: 402979 - DNA, 16 bp, M. musculus
gaaaatacatacatac

SEQ ID NO: 402980 - DNA, 16 bp, M. musculus
gaaaatacatttaaaa

SEQ ID NO: 402981 - DNA, 16 bp, M. musculus
gaaaatagaatcaata

SEQ ID NO: 402982 - DNA, 16 bp, M. musculus
gaaaatagatttattt

SEQ ID NO: 402983 - DNA, 16 bp, M. musculus
gaaaatagccaataaa

SEQ ID NO: 402984 - DNA, 16 bp, M. musculus
gaaaatagctttataa

SEQ ID NO: 402985 - DNA, 16 bp, M. musculus
gaaaatatcaaaatga

SEQ ID NO: 402986 - DNA, 16 bp, M. musculus
gaaaatatcctcctga

SEQ ID NO: 402987 - DNA, 16 bp, M. musculus
gaaaatatgatcaaaa

SEQ ID NO: 402988 - DNA, 16 bp, M. musculus
gaaaatatggatgaaa

SEQ ID NO: 402989 - DNA, 16 bp, M. musculus
gaaaatatgtaatatt

SEQ ID NO: 402990 - DNA, 16 bp, M. musculus
gaaaatattaaaactt

SEQ ID NO: 402991 - DNA, 16 bp, M. musculus
gaaaatattaacattt

SEQ ID NO: 402992 - DNA, 16 bp, M. musculus
gaaaatattcaagaaa

SEQ ID NO: 402993 - DNA, 16 bp, M. musculus
gaaaatatttctgaaa

SEQ ID NO: 402994 - DNA, 16 bp, M. musculus
gaaaatatttggaaaa

SEQ ID NO: 402995 - DNA, 16 bp, M. musculus
gaaaatatttgtttgt

SEQ ID NO: 402996 - DNA, 16 bp, M. musculus
gaaaatattttcctga

SEQ ID NO: 402997 - DNA, 16 bp, M. musculus
gaaaatattttctgga

SEQ ID NO: 402998 - DNA, 16 bp, M. musculus
gaaaatcaaaacaacc

SEQ ID NO: 402999 - DNA, 16 bp, M. musculus
gaaaatcaaaacaatc

SEQ ID NO: 403000 - DNA, 16 bp, M. musculus
gaaaatcaagaagaag

SEQ ID NO: 403001 - DNA, 16 bp, M. musculus
gaaaatcaagagttca

SEQ ID NO: 403002 - DNA, 16 bp, M. musculus
gaaaatcagcagttca

SEQ ID NO: 403003 - DNA, 16 bp, M. musculus
gaaaatccttgaagcc

SEQ ID NO: 403004 - DNA, 16 bp, M. musculus
gaaaatctaaatgaaa

SEQ ID NO: 403005 - DNA, 16 bp, M. musculus
gaaaatctccccagca

SEQ ID NO: 403006 - DNA, 16 bp, M. musculus
gaaaatctggaagaag

SEQ ID NO: 403007 - DNA, 16 bp, M. musculus
gaaaatcttcctgcca

SEQ ID NO: 403008 - DNA, 16 bp, M. musculus
gaaaatgaaagcacaa

SEQ ID NO: 403009 - DNA, 16 bp, M. musculus
gaaaatgaacaactct

SEQ ID NO: 403010 - DNA, 16 bp, M. musculus
gaaaatgaagaaacat

SEQ ID NO: 403011 - DNA, 16 bp, M. musculus
gaaaatgaatacacaa

SEQ ID NO: 403012 - DNA, 16 bp, M. musculus
gaaaatgacacagaaa

SEQ ID NO: 403013 - DNA, 16 bp, M. musculus
gaaaatgacagacaga

SEQ ID NO: 403014 - DNA, 16 bp, M. musculus
gaaaatgatgctgctt

SEQ ID NO: 403015 - DNA, 16 bp, M. musculus
gaaaatgatgtaatta

SEQ ID NO: 403016 - DNA, 16 bp, M. musculus
gaaaatgcaaaaaggt

SEQ ID NO: 403017 - DNA, 16 bp, M. musculus
gaaaatgcaaaacaca

SEQ ID NO: 403018 - DNA, 16 bp, M. musculus
gaaaatgccctacaga

SEQ ID NO: 403019 - DNA, 16 bp, M. musculus
gaaaatgccctgcagt

SEQ ID NO: 403020 - DNA, 16 bp, M. musculus
gaaaatgcctaattaa

SEQ ID NO: 403021 - DNA, 16 bp, M. musculus
gaaaatgcctccaaaa

SEQ ID NO: 403022 - DNA, 16 bp, M. musculus
gaaaatgctaagaaaa

SEQ ID NO: 403023 - DNA, 16 bp, M. musculus
gaaaatgctccacaga

SEQ ID NO: 403024 - DNA, 16 bp, M. musculus
gaaaatgctgtcttct

SEQ ID NO: 403025 - DNA, 16 bp, M. musculus
gaaaatgcttttaaaa

SEQ ID NO: 403026 - DNA, 16 bp, M. musculus
gaaaatggaaaaggca

SEQ ID NO: 403027 - DNA, 16 bp, M. musculus
gaaaatggaaaataca

SEQ ID NO: 403028 - DNA, 16 bp, M. musculus
gaaaatggaacagaaa

SEQ ID NO: 403029 - DNA, 16 bp, M. musculus
gaaaatggccccacag

SEQ ID NO: 403030 - DNA, 16 bp, M. musculus
gaaaatggctttgcaa

SEQ ID NO: 403031 - DNA, 16 bp, M. musculus
gaaaatgggctataaa

SEQ ID NO: 403032 - DNA, 16 bp, M. musculus
gaaaatgtaaaatgca

SEQ ID NO: 403033 - DNA, 16 bp, M. musculus
gaaaatgtcatacatt

SEQ ID NO: 403034 - DNA, 16 bp, M. musculus
gaaaatgtcccagaag

SEQ ID NO: 403035 - DNA, 16 bp, M. musculus
gaaaatgtccccacag

SEQ ID NO: 403036 - DNA, 16 bp, M. musculus
gaaaatgtctctgtaa

SEQ ID NO: 403037 - DNA, 16 bp, M. musculus
gaaaatgtcttcataa

SEQ ID NO: 403038 - DNA, 16 bp, M. musculus
gaaaatgtgtgtgtgt

SEQ ID NO: 403039 - DNA, 16 bp, M. musculus
gaaaatgttgtcttct

SEQ ID NO: 403040 - DNA, 16 bp, M. musculus
gaaaatgtttaatttt

SEQ ID NO: 403041 - DNA, 16 bp, M. musculus
gaaaatgttttaatat

SEQ ID NO: 403042 - DNA, 16 bp, M. musculus
gaaaatgttttattat

SEQ ID NO: 403043 - DNA, 16 bp, M. musculus
gaaaatgttttctttt

SEQ ID NO: 403044 - DNA, 16 bp, M. musculus
gaaaattattttctag

SEQ ID NO: 403045 - DNA, 16 bp, M. musculus
gaaaattcatagtact

SEQ ID NO: 403046 - DNA, 16 bp, M. musculus
gaaaattctcaaaaga

SEQ ID NO: 403047 - DNA, 16 bp, M. musculus
gaaaattctcaacaaa

SEQ ID NO: 403048 - DNA, 16 bp, M. musculus
gaaaattgaaataatg

SEQ ID NO: 403049 - DNA, 16 bp, M. musculus
gaaaattgcttttatt

SEQ ID NO: 403050 - DNA, 21 bp, M. musculus
gaaaattggacatagtactac

SEQ ID NO: 403051 - DNA, 16 bp, M. musculus
gaaaattgtcttctga

SEQ ID NO: 403052 - DNA, 16 bp, M. musculus
gaaaatttagaaatgt

SEQ ID NO: 403053 - DNA, 16 bp, M. musculus
gaaaattttccctgtg

SEQ ID NO: 403054 - DNA, 16 bp, M. musculus
gaaaatttttttcttt

SEQ ID NO: 403055 - DNA, 16 bp, M. musculus
gaaacaaaaatattga

SEQ ID NO: 403056 - DNA, 16 bp, M. musculus
gaaacaaaacccttca

SEQ ID NO: 403057 - DNA, 16 bp, M. musculus
gaaacaaaataatcat

SEQ ID NO: 403058 - DNA, 16 bp, M. musculus
gaaacaaagaccactc

SEQ ID NO: 403059 - DNA, 16 bp, M. musculus
gaaacaaagcccagca

SEQ ID NO: 403060 - DNA, 16 bp, M. musculus
gaaacaaatacagaga

SEQ ID NO: 403061 - DNA, 16 bp, M. musculus
gaaacaaatagattta

SEQ ID NO: 403062 - DNA, 16 bp, M. musculus
gaaacaactagatgta

SEQ ID NO: 403063 - DNA, 16 bp, M. musculus
gaaacaagaagaatta

SEQ ID NO: 403064 - DNA, 16 bp, M. musculus
gaaacaagaagatcta

SEQ ID NO: 403065 - DNA, 16 bp, M. musculus
gaaacaagattctgtt

SEQ ID NO: 403066 - DNA, 16 bp, M. musculus
gaaacaagattttttt

SEQ ID NO: 403067 - DNA, 16 bp, M. musculus
gaaacaagctgaagta

SEQ ID NO: 403068 - DNA, 16 bp, M. musculus
gaaacaattttatttt

SEQ ID NO: 403069 - DNA, 16 bp, M. musculus
gaaacacacatacaca

SEQ ID NO: 403070 - DNA, 16 bp, M. musculus
gaaacacagcctctgt

SEQ ID NO: 403071 - DNA, 16 bp, M. musculus
gaaacacattgaaact

SEQ ID NO: 403072 - DNA, 16 bp, M. musculus
gaaacaccatgaccaa

SEQ ID NO: 403073 - DNA, 16 bp, M. musculus
gaaacacccacacttt

SEQ ID NO: 403074 - DNA, 16 bp, M. musculus
gaaacacccctggaca

SEQ ID NO: 403075 - DNA, 16 bp, M. musculus
gaaacactgaaaaaca

SEQ ID NO: 403076 - DNA, 16 bp, M. musculus
gaaacactgactaaga

SEQ ID NO: 403077 - DNA, 16 bp, M. musculus
gaaacactgctgattt

SEQ ID NO: 403078 - DNA, 16 bp, M. musculus
gaaacagaaagaacat

SEQ ID NO: 403079 - DNA, 16 bp, M. musculus
gaaacagaaagctggt

SEQ ID NO: 403080 - DNA, 16 bp, M. musculus
gaaacagaagatgaaa

SEQ ID NO: 403081 - DNA, 16 bp, M. musculus
gaaacagaagcaggca

SEQ ID NO: 403082 - DNA, 16 bp, M. musculus
gaaacagacacagaga

SEQ ID NO: 403083 - DNA, 16 bp, M. musculus
gaaacagacacaggtg

SEQ ID NO: 403084 - DNA, 16 bp, M. musculus
gaaacagagacaggag

SEQ ID NO: 403085 - DNA, 16 bp, M. musculus
gaaacagagatacaga

SEQ ID NO: 403086 - DNA, 16 bp, M. musculus
gaaacagatacagaaa

SEQ ID NO: 403087 - DNA, 16 bp, M. musculus
gaaacagatacagaga

SEQ ID NO: 403088 - DNA, 17 bp, M. musculus
gaaacagatagattctt

SEQ ID NO: 403089 - DNA, 16 bp, M. musculus
gaaacagatgaagaga

SEQ ID NO: 403090 - DNA, 16 bp, M. musculus
gaaacagattcagaga

SEQ ID NO: 403091 - DNA, 16 bp, M. musculus
gaaacagcttctggga

SEQ ID NO: 403092 - DNA, 16 bp, M. musculus
gaaacaggactgaagc

SEQ ID NO: 403093 - DNA, 16 bp, M. musculus
gaaacaggagaggcag

SEQ ID NO: 403094 - DNA, 16 bp, M. musculus
gaaacaggaggatctc

SEQ ID NO: 403095 - DNA, 16 bp, M. musculus
gaaacaggctcagaga

SEQ ID NO: 403096 - DNA, 16 bp, M. musculus
gaaacagtgggacagt

SEQ ID NO: 403097 - DNA, 16 bp, M. musculus
gaaacagtgtgtgtgt

SEQ ID NO: 403098 - DNA, 16 bp, M. musculus
gaaacatcaatatgaa

SEQ ID NO: 403099 - DNA, 16 bp, M. musculus
gaaacatgaggctccc

SEQ ID NO: 403100 - DNA, 16 bp, M. musculus
gaaacatggtttctct

SEQ ID NO: 403101 - DNA, 16 bp, M. musculus
gaaacattaaagaaat

SEQ ID NO: 403102 - DNA, 16 bp, M. musculus
gaaacattatttcttt

SEQ ID NO: 403103 - DNA, 16 bp, M. musculus
gaaacattattttttt

SEQ ID NO: 403104 - DNA, 16 bp, M. musculus
gaaacattgcagaaga

SEQ ID NO: 403105 - DNA, 16 bp, M. musculus
gaaacatttttttaaa

SEQ ID NO: 403106 - DNA, 16 bp, M. musculus
gaaacatttttttttt

SEQ ID NO: 403107 - DNA, 16 bp, M. musculus
gaaaccaaacccagac

SEQ ID NO: 403108 - DNA, 16 bp, M. musculus
gaaaccaaactcagat

SEQ ID NO: 403109 - DNA, 16 bp, M. musculus
gaaaccaaccaagtag

SEQ ID NO: 403110 - DNA, 16 bp, M. musculus
gaaaccaaggcaggag

SEQ ID NO: 403111 - DNA, 16 bp, M. musculus
gaaaccagaagaatcc

SEQ ID NO: 403112 - DNA, 16 bp, M. musculus
gaaaccagaagagggc

SEQ ID NO: 403113 - DNA, 16 bp, M. musculus
gaaaccagctggacaa

SEQ ID NO: 403114 - DNA, 16 bp, M. musculus
gaaaccaggaaaggga

SEQ ID NO: 403115 - DNA, 16 bp, M. musculus
gaaaccaggaaaggtg

SEQ ID NO: 403116 - DNA, 16 bp, M. musculus
gaaaccaggaagaggg

SEQ ID NO: 403117 - DNA, 16 bp, M. musculus
gaaaccagggcaggaa

SEQ ID NO: 403118 - DNA, 16 bp, M. musculus
gaaaccaggtgtatag

SEQ ID NO: 403119 - DNA, 16 bp, M. musculus
gaaaccatttctaaga

SEQ ID NO: 403120 - DNA, 16 bp, M. musculus
gaaacccaagaagaag

SEQ ID NO: 403121 - DNA, 16 bp, M. musculus
gaaacccagaggagag

SEQ ID NO: 403122 - DNA, 16 bp, M. musculus
gaaacccatctcagag

SEQ ID NO: 403123 - DNA, 16 bp, M. musculus
gaaacccatctcatgg

SEQ ID NO: 403124 - DNA, 16 bp, M. musculus
gaaaccccatctcaga

SEQ ID NO: 403125 - DNA, 17 bp, M. musculus
gaaaccccgtccctttt

SEQ ID NO: 403126 - DNA, 16 bp, M. musculus
gaaacccctttcctct

SEQ ID NO: 403127 - DNA, 16 bp, M. musculus
gaaaccctaagacaaa

SEQ ID NO: 403128 - DNA, 16 bp, M. musculus
gaaaccctgccttaaa

SEQ ID NO: 403129 - DNA, 16 bp, M. musculus
gaaaccctgtataaaa

SEQ ID NO: 403130 - DNA, 16 bp, M. musculus
gaaaccctgtcaaaag

SEQ ID NO: 403131 - DNA, 16 bp, M. musculus
gaaaccctgtctcaaa

SEQ ID NO: 403132 - DNA, 16 bp, M. musculus
gaaaccctgtctcaac

SEQ ID NO: 403133 - DNA, 17 bp, M. musculus
gaaaccctgtctggggg

SEQ ID NO: 403134 - DNA, 16 bp, M. musculus
gaaaccctgtgttgaa

SEQ ID NO: 403135 - DNA, 16 bp, M. musculus
gaaaccctgtttctaa

SEQ ID NO: 403136 - DNA, 16 bp, M. musculus
gaaacctcaaagccca

SEQ ID NO: 403137 - DNA, 16 bp, M. musculus
gaaacctctagaacaa

SEQ ID NO: 403138 - DNA, 16 bp, M. musculus
gaaacctgccaagtat

SEQ ID NO: 403139 - DNA, 16 bp, M. musculus
gaaacctggacacagt

SEQ ID NO: 403140 - DNA, 16 bp, M. musculus
gaaacctggaggtagg

SEQ ID NO: 403141 - DNA, 18 bp, M. musculus
gaaacctggtgaatatgt

SEQ ID NO: 403142 - DNA, 16 bp, M. musculus
gaaacctgtctcaggg

SEQ ID NO: 403143 - DNA, 16 bp, M. musculus
gaaaccttaattaaga

SEQ ID NO: 403144 - DNA, 16 bp, M. musculus
gaaaccttttcccaaa

SEQ ID NO: 403145 - DNA, 16 bp, M. musculus
gaaacgggagacagca

SEQ ID NO: 403146 - DNA, 16 bp, M. musculus
gaaacgttcttgctgc

SEQ ID NO: 403147 - DNA, 16 bp, M. musculus
gaaactaacagaagct

SEQ ID NO: 403148 - DNA, 16 bp, M. musculus
gaaactaagctcaaga

SEQ ID NO: 403149 - DNA, 16 bp, M. musculus
gaaactaggaaagggg

SEQ ID NO: 403150 - DNA, 16 bp, M. musculus
gaaactatcagaagtt

SEQ ID NO: 403151 - DNA, 16 bp, M. musculus
gaaactcaaagcaatc

SEQ ID NO: 403152 - DNA, 16 bp, M. musculus
gaaactcaagaaaaac

SEQ ID NO: 403153 - DNA, 16 bp, M. musculus
gaaactcaagaacaag

SEQ ID NO: 403154 - DNA, 16 bp, M. musculus
gaaactcaagaagaaa

SEQ ID NO: 403155 - DNA, 16 bp, M. musculus
gaaactcaagaagaag

SEQ ID NO: 403156 - DNA, 16 bp, M. musculus
gaaactcaagaagaat

SEQ ID NO: 403157 - DNA, 16 bp, M. musculus
gaaactcaagaagagc

SEQ ID NO: 403158 - DNA, 16 bp, M. musculus
gaaactcaagaagagg

SEQ ID NO: 403159 - DNA, 16 bp, M. musculus
gaaactcaaggagaag

SEQ ID NO: 403160 - DNA, 16 bp, M. musculus
gaaactcactctgtaa

SEQ ID NO: 403161 - DNA, 16 bp, M. musculus
gaaactcaggaaagag

SEQ ID NO: 403162 - DNA, 16 bp, M. musculus
gaaactcaggaagaag

SEQ ID NO: 403163 - DNA, 16 bp, M. musculus
gaaactcatagctctg

SEQ ID NO: 403164 - DNA, 16 bp, M. musculus
gaaactcatctcaggg

SEQ ID NO: 403165 - DNA, 16 bp, M. musculus
gaaactccagaagaac

SEQ ID NO: 403166 - DNA, 16 bp, M. musculus
gaaactccctcctgga

SEQ ID NO: 403167 - DNA, 16 bp, M. musculus
gaaactctaagacaaa

SEQ ID NO: 403168 - DNA, 16 bp, M. musculus
gaaactctacaaggga

SEQ ID NO: 403169 - DNA, 16 bp, M. musculus
gaaactcttcattctc

SEQ ID NO: 403170 - DNA, 16 bp, M. musculus
gaaactgaagaaaagg

SEQ ID NO: 403171 - DNA, 16 bp, M. musculus
gaaactgaagaaggaa

SEQ ID NO: 403172 - DNA, 16 bp, M. musculus
gaaactgaagcagagg

SEQ ID NO: 403173 - DNA, 16 bp, M. musculus
gaaactgaagcaggaa

SEQ ID NO: 403174 - DNA, 16 bp, M. musculus
gaaactgaaggaagaa

SEQ ID NO: 403175 - DNA, 16 bp, M. musculus
gaaactgagactcaga

SEQ ID NO: 403176 - DNA, 16 bp, M. musculus
gaaactgaggaaattc

SEQ ID NO: 403177 - DNA, 16 bp, M. musculus
gaaactgaggacactg

SEQ ID NO: 403178 - DNA, 16 bp, M. musculus
gaaactgaggcacaga

SEQ ID NO: 403179 - DNA, 16 bp, M. musculus
gaaactgaggcaggag

SEQ ID NO: 403180 - DNA, 16 bp, M. musculus
gaaactgaggcataga

SEQ ID NO: 403181 - DNA, 16 bp, M. musculus
gaaactgaggcccaca

SEQ ID NO: 403182 - DNA, 16 bp, M. musculus
gaaactgaggcccaga

SEQ ID NO: 403183 - DNA, 16 bp, M. musculus
gaaactgaggcccagc

SEQ ID NO: 403184 - DNA, 21 bp, M. musculus
gaaactgaggtgggacttttt

SEQ ID NO: 403185 - DNA, 16 bp, M. musculus
gaaactgcaaacaacc

SEQ ID NO: 403186 - DNA, 16 bp, M. musculus
gaaactgcacctggat

SEQ ID NO: 403187 - DNA, 16 bp, M. musculus
gaaactggaaagaacc

SEQ ID NO: 403188 - DNA, 16 bp, M. musculus
gaaactggaaagagca

SEQ ID NO: 403189 - DNA, 16 bp, M. musculus
gaaactgtaagcccca

SEQ ID NO: 403190 - DNA, 17 bp, M. musculus
gaaactgtaccatatat

SEQ ID NO: 403191 - DNA, 16 bp, M. musculus
gaaactgtgagccaaa

SEQ ID NO: 403192 - DNA, 16 bp, M. musculus
gaaactgtggtcagga

SEQ ID NO: 403193 - DNA, 16 bp, M. musculus
gaaacttaaaatatcc

SEQ ID NO: 403194 - DNA, 16 bp, M. musculus
gaaacttctctgatga

SEQ ID NO: 403195 - DNA, 16 bp, M. musculus
gaaactttagctgtgc

SEQ ID NO: 403196 - DNA, 16 bp, M. musculus
gaaactttgcagtttt

SEQ ID NO: 403197 - DNA, 16 bp, M. musculus
gaaacttttttctttt

SEQ ID NO: 403198 - DNA, 16 bp, M. musculus
gaaagaaaaacatttc

SEQ ID NO: 403199 - DNA, 16 bp, M. musculus
gaaagaaaacttcaga

SEQ ID NO: 403200 - DNA, 16 bp, M. musculus
gaaagaaaatattttt

SEQ ID NO: 403201 - DNA, 16 bp, M. musculus
gaaagaaaatgatttt

SEQ ID NO: 403202 - DNA, 16 bp, M. musculus
gaaagaaactaaggaa

SEQ ID NO: 403203 - DNA, 16 bp, M. musculus
gaaagaaagaaactct

SEQ ID NO: 403204 - DNA, 16 bp, M. musculus
gaaagaaagaaagtct

SEQ ID NO: 403205 - DNA, 16 bp, M. musculus
gaaagaaagaaattct

SEQ ID NO: 403206 - DNA, 16 bp, M. musculus
gaaagaaagaaattgt

SEQ ID NO: 403207 - DNA, 16 bp, M. musculus
gaaagaaagcatttaa

SEQ ID NO: 403208 - DNA, 16 bp, M. musculus
gaaagaaaggattgag

SEQ ID NO: 403209 - DNA, 16 bp, M. musculus
gaaagaaaggctacat

SEQ ID NO: 403210 - DNA, 16 bp, M. musculus
gaaagaaatatatttt

SEQ ID NO: 403211 - DNA, 16 bp, M. musculus
gaaagaaatgcagaga

SEQ ID NO: 403212 - DNA, 16 bp, M. musculus
gaaagaaattatttta

SEQ ID NO: 403213 - DNA, 16 bp, M. musculus
gaaagaacacagatat

SEQ ID NO: 403214 - DNA, 16 bp, M. musculus
gaaagaacacagatgt

SEQ ID NO: 403215 - DNA, 16 bp, M. musculus
gaaagaacagcaggga

SEQ ID NO: 403216 - DNA, 16 bp, M. musculus
gaaagaacattttttt

SEQ ID NO: 403217 - DNA, 16 bp, M. musculus
gaaagaacccaaggag

SEQ ID NO: 403218 - DNA, 16 bp, M. musculus
gaaagaactagaaaag

SEQ ID NO: 403219 - DNA, 16 bp, M. musculus
gaaagaactctgaaaa

SEQ ID NO: 403220 - DNA, 16 bp, M. musculus
gaaagaactgaaggag

SEQ ID NO: 403221 - DNA, 16 bp, M. musculus
gaaagaactgcagggg

SEQ ID NO: 403222 - DNA, 16 bp, M. musculus
gaaagaacttagaaat

SEQ ID NO: 403223 - DNA, 16 bp, M. musculus
gaaagaacttcaggga

SEQ ID NO: 403224 - DNA, 16 bp, M. musculus
gaaagaagaaagattt

SEQ ID NO: 403225 - DNA, 16 bp, M. musculus
gaaagaagaacacttc

SEQ ID NO: 403226 - DNA, 16 bp, M. musculus
gaaagaagagaactga

SEQ ID NO: 403227 - DNA, 16 bp, M. musculus
gaaagaagatctgagg

SEQ ID NO: 403228 - DNA, 16 bp, M. musculus
gaaagaagctgagaag

SEQ ID NO: 403229 - DNA, 16 bp, M. musculus
gaaagaaggaccatcc

SEQ ID NO: 403230 - DNA, 16 bp, M. musculus
gaaagaagttacagag

SEQ ID NO: 403231 - DNA, 16 bp, M. musculus
gaaagaatatgatcaa

SEQ ID NO: 403232 - DNA, 16 bp, M. musculus
gaaagaatccaaggag

SEQ ID NO: 403233 - DNA, 16 bp, M. musculus
gaaagaatccagatat

SEQ ID NO: 403234 - DNA, 16 bp, M. musculus
gaaagaattactttat

SEQ ID NO: 403235 - DNA, 16 bp, M. musculus
gaaagaattctgggat

SEQ ID NO: 403236 - DNA, 16 bp, M. musculus
gaaagaatttagggaa

SEQ ID NO: 403237 - DNA, 16 bp, M. musculus
gaaagaatttgaggag

SEQ ID NO: 403238 - DNA, 16 bp, M. musculus
gaaagaattttattga

SEQ ID NO: 403239 - DNA, 16 bp, M. musculus
gaaagacagacaggca

SEQ ID NO: 403240 - DNA, 16 bp, M. musculus
gaaagaccaaagagtg

SEQ ID NO: 403241 - DNA, 16 bp, M. musculus
gaaagaccagaaccaa

SEQ ID NO: 403242 - DNA, 16 bp, M. musculus
gaaagacccaacaaag

SEQ ID NO: 403243 - DNA, 16 bp, M. musculus
gaaagacccctgaagg

SEQ ID NO: 403244 - DNA, 16 bp, M. musculus
gaaagaccctgactca

SEQ ID NO: 403245 - DNA, 16 bp, M. musculus
gaaagactgaaggaac

SEQ ID NO: 403246 - DNA, 16 bp, M. musculus
gaaagactggaagaag

SEQ ID NO: 403247 - DNA, 16 bp, M. musculus
gaaagactgtaagagc

SEQ ID NO: 403248 - DNA, 16 bp, M. musculus
gaaagactgtctcaaa

SEQ ID NO: 403249 - DNA, 16 bp, M. musculus
gaaagactttttagaa

SEQ ID NO: 403250 - DNA, 16 bp, M. musculus
gaaagagaactccaga

SEQ ID NO: 403251 - DNA, 16 bp, M. musculus
gaaagagaagagcttg

SEQ ID NO: 403252 - DNA, 16 bp, M. musculus
gaaagagaagccagtg

SEQ ID NO: 403253 - DNA, 16 bp, M. musculus
gaaagagaagcccatt

SEQ ID NO: 403254 - DNA, 16 bp, M. musculus
gaaagagaagctgggg

SEQ ID NO: 403255 - DNA, 16 bp, M. musculus
gaaagagaaggagcca

SEQ ID NO: 403256 - DNA, 16 bp, M. musculus
gaaagagaagttcaga

SEQ ID NO: 403257 - DNA, 16 bp, M. musculus
gaaagagacagagtca

SEQ ID NO: 403258 - DNA, 16 bp, M. musculus
gaaagagagatacaga

SEQ ID NO: 403259 - DNA, 16 bp, M. musculus
gaaagagagcaagagc

SEQ ID NO: 403260 - DNA, 16 bp, M. musculus
gaaagagagcaagcag

SEQ ID NO: 403261 - DNA, 19 bp, M. musculus
gaaagagaggcccattggt

SEQ ID NO: 403262 - DNA, 16 bp, M. musculus
gaaagagcaatctgaa

SEQ ID NO: 403263 - DNA, 16 bp, M. musculus
gaaagagcaattatca

SEQ ID NO: 403264 - DNA, 16 bp, M. musculus
gaaagagcagagcaga

SEQ ID NO: 403265 - DNA, 16 bp, M. musculus
gaaagagcagcaggtg

SEQ ID NO: 403266 - DNA, 16 bp, M. musculus
gaaagagcagccaggg

SEQ ID NO: 403267 - DNA, 16 bp, M. musculus
gaaagagcagtcagtg

SEQ ID NO: 403268 - DNA, 16 bp, M. musculus
gaaagagctagagaaa

SEQ ID NO: 403269 - DNA, 16 bp, M. musculus
gaaagagctgaagagg

SEQ ID NO: 403270 - DNA, 16 bp, M. musculus
gaaagagctgaaggag

SEQ ID NO: 403271 - DNA, 16 bp, M. musculus
gaaagaggaaaactct

SEQ ID NO: 403272 - DNA, 22 bp, M. musculus
gaaagaggaacactcctccatt

SEQ ID NO: 403273 - DNA, 16 bp, M. musculus
gaaagaggaacactgc

SEQ ID NO: 403274 - DNA, 16 bp, M. musculus
gaaagaggaagaggct

SEQ ID NO: 403275 - DNA, 16 bp, M. musculus
gaaagaggacttcaga

SEQ ID NO: 403276 - DNA, 16 bp, M. musculus
gaaagaggcagacaga

SEQ ID NO: 403277 - DNA, 16 bp, M. musculus
gaaagagggcatcaga

SEQ ID NO: 403278 - DNA, 16 bp, M. musculus
gaaagaggtgggactt

SEQ ID NO: 403279 - DNA, 16 bp, M. musculus
gaaagagtcagaggca

SEQ ID NO: 403280 - DNA, 16 bp, M. musculus
gaaagatccagcaaag

SEQ ID NO: 403281 - DNA, 16 bp, M. musculus
gaaagatcctgttttg

SEQ ID NO: 403282 - DNA, 16 bp, M. musculus
gaaagatctgcctgcc

SEQ ID NO: 403283 - DNA, 16 bp, M. musculus
gaaagatgcacatgaa

SEQ ID NO: 403284 - DNA, 16 bp, M. musculus
gaaagatggagacaga

SEQ ID NO: 403285 - DNA, 16 bp, M. musculus
gaaagatggggttgcc

SEQ ID NO: 403286 - DNA, 16 bp, M. musculus
gaaagatggtggagag

SEQ ID NO: 403287 - DNA, 16 bp, M. musculus
gaaagatgtctcagtg

SEQ ID NO: 403288 - DNA, 17 bp, M. musculus
gaaagattcctgaggtc

SEQ ID NO: 403289 - DNA, 16 bp, M. musculus
gaaagatttctttttt

SEQ ID NO: 403290 - DNA, 16 bp, M. musculus
gaaagcaaccaagtgg

SEQ ID NO: 403291 - DNA, 16 bp, M. musculus
gaaagcaactgaagaa

SEQ ID NO: 403292 - DNA, 16 bp, M. musculus
gaaagcaagagactcc

SEQ ID NO: 403293 - DNA, 16 bp, M. musculus
gaaagcaagccagtaa

SEQ ID NO: 403294 - DNA, 16 bp, M. musculus
gaaagcaagctgagaa

SEQ ID NO: 403295 - DNA, 16 bp, M. musculus
gaaagcaatagagaaa

SEQ ID NO: 403296 - DNA, 16 bp, M. musculus
gaaagcaatgctaaga

SEQ ID NO: 403297 - DNA, 16 bp, M. musculus
gaaagcaattagggaa

SEQ ID NO: 403298 - DNA, 16 bp, M. musculus
gaaagcacagaggctg

SEQ ID NO: 403299 - DNA, 16 bp, M. musculus
gaaagcacagtctgag

SEQ ID NO: 403300 - DNA, 16 bp, M. musculus
gaaagcacccaaggat

SEQ ID NO: 403301 - DNA, 16 bp, M. musculus
gaaagcactctctagg

SEQ ID NO: 403302 - DNA, 16 bp, M. musculus
gaaagcagaaaataat

SEQ ID NO: 403303 - DNA, 16 bp, M. musculus
gaaagcagaagaaata

SEQ ID NO: 403304 - DNA, 16 bp, M. musculus
gaaagcagaagcagga

SEQ ID NO: 403305 - DNA, 16 bp, M. musculus
gaaagcagacagagca

SEQ ID NO: 403306 - DNA, 16 bp, M. musculus
gaaagcagaggcaagc

SEQ ID NO: 403307 - DNA, 16 bp, M. musculus
gaaagcagaggcagga

SEQ ID NO: 403308 - DNA, 16 bp, M. musculus
gaaagcaggaactgat

SEQ ID NO: 403309 - DNA, 16 bp, M. musculus
gaaagcaggcaggcag

SEQ ID NO: 403310 - DNA, 16 bp, M. musculus
gaaagcaggctgaaga

SEQ ID NO: 403311 - DNA, 16 bp, M. musculus
gaaagcagggcagaag

SEQ ID NO: 403312 - DNA, 16 bp, M. musculus
gaaagcagtcctgaga

SEQ ID NO: 403313 - DNA, 16 bp, M. musculus
gaaagcatctggcagt

SEQ ID NO: 403314 - DNA, 16 bp, M. musculus
gaaagcatttcactgg

SEQ ID NO: 403315 - DNA, 16 bp, M. musculus
gaaagcatttctgaga

SEQ ID NO: 403316 - DNA, 16 bp, M. musculus
gaaagcatttgaaatg

SEQ ID NO: 403317 - DNA, 16 bp, M. musculus
gaaagcatttgacaaa

SEQ ID NO: 403318 - DNA, 16 bp, M. musculus
gaaagcatttgtaaga

SEQ ID NO: 403319 - DNA, 16 bp, M. musculus
gaaagccaagacagga

SEQ ID NO: 403320 - DNA, 16 bp, M. musculus
gaaagccaagcagaag

SEQ ID NO: 403321 - DNA, 16 bp, M. musculus
gaaagccaaggccaag

SEQ ID NO: 403322 - DNA, 16 bp, M. musculus
gaaagccaattttatt

SEQ ID NO: 403323 - DNA, 16 bp, M. musculus
gaaagccacacacaca

SEQ ID NO: 403324 - DNA, 16 bp, M. musculus
gaaagccagaacatcc

SEQ ID NO: 403325 - DNA, 16 bp, M. musculus
gaaagccagaggagcc

SEQ ID NO: 403326 - DNA, 16 bp, M. musculus
gaaagccagcattcac

SEQ ID NO: 403327 - DNA, 17 bp, M. musculus
gaaagccgggcgtggtg

SEQ ID NO: 403328 - DNA, 16 bp, M. musculus
gaaagcctatctcatc

SEQ ID NO: 403329 - DNA, 16 bp, M. musculus
gaaagcctccttcctg

SEQ ID NO: 403330 - DNA, 16 bp, M. musculus
gaaagcctggaagata

SEQ ID NO: 403331 - DNA, 16 bp, M. musculus
gaaagcctgtctcaaa

SEQ ID NO: 403332 - DNA, 16 bp, M. musculus
gaaagcctttaaagaa

SEQ ID NO: 403333 - DNA, 16 bp, M. musculus
gaaagctagctgtagc

SEQ ID NO: 403334 - DNA, 16 bp, M. musculus
gaaagctgaaggctga

SEQ ID NO: 403335 - DNA, 16 bp, M. musculus
gaaagctgagacagga

SEQ ID NO: 403336 - DNA, 16 bp, M. musculus
gaaagctgcactgcag

SEQ ID NO: 403337 - DNA, 18 bp, M. musculus
gaaagctgcaggttactt

SEQ ID NO: 403338 - DNA, 16 bp, M. musculus
gaaagctgctagtgga

SEQ ID NO: 403339 - DNA, 16 bp, M. musculus
gaaagctgtcctctga

SEQ ID NO: 403340 - DNA, 16 bp, M. musculus
gaaagctttttaaaat

SEQ ID NO: 403341 - DNA, 16 bp, M. musculus
gaaagctttttttttt

SEQ ID NO: 403342 - DNA, 16 bp, M. musculus
gaaaggaaactgggaa

SEQ ID NO: 403343 - DNA, 16 bp, M. musculus
gaaaggaaagaactga

SEQ ID NO: 403344 - DNA, 16 bp, M. musculus
gaaaggaacaagctct

SEQ ID NO: 403345 - DNA, 17 bp, M. musculus
gaaaggaagacattggg

SEQ ID NO: 403346 - DNA, 16 bp, M. musculus
gaaaggaattttaaaa

SEQ ID NO: 403347 - DNA, 16 bp, M. musculus
gaaaggacacacagag

SEQ ID NO: 403348 - DNA, 16 bp, M. musculus
gaaaggacactctcca

SEQ ID NO: 403349 - DNA, 16 bp, M. musculus
gaaaggacatgtgata

SEQ ID NO: 403350 - DNA, 16 bp, M. musculus
gaaaggaccatccaga

SEQ ID NO: 403351 - DNA, 16 bp, M. musculus
gaaaggactacaccaa

SEQ ID NO: 403352 - DNA, 16 bp, M. musculus
gaaaggactgaagaag

SEQ ID NO: 403353 - DNA, 16 bp, M. musculus
gaaaggactgaaggag

SEQ ID NO: 403354 - DNA, 16 bp, M. musculus
gaaaggactttctgaa

SEQ ID NO: 403355 - DNA, 16 bp, M. musculus
gaaaggactttttttt

SEQ ID NO: 403356 - DNA, 16 bp, M. musculus
gaaaggagaaaaggct

SEQ ID NO: 403357 - DNA, 16 bp, M. musculus
gaaaggagaaagccag

SEQ ID NO: 403358 - DNA, 16 bp, M. musculus
gaaaggagacacagtg

SEQ ID NO: 403359 - DNA, 16 bp, M. musculus
gaaaggagacagacag

SEQ ID NO: 403360 - DNA, 16 bp, M. musculus
gaaaggagcttctgtt

SEQ ID NO: 403361 - DNA, 16 bp, M. musculus
gaaaggagtgtgtgtg

SEQ ID NO: 403362 - DNA, 16 bp, M. musculus
gaaaggatacagggaa

SEQ ID NO: 403363 - DNA, 16 bp, M. musculus
gaaaggataggggatt

SEQ ID NO: 403364 - DNA, 16 bp, M. musculus
gaaaggatggaccatc

SEQ ID NO: 403365 - DNA, 16 bp, M. musculus
gaaaggatggatcatc

SEQ ID NO: 403366 - DNA, 16 bp, M. musculus
gaaaggatgtaagagc

SEQ ID NO: 403367 - DNA, 16 bp, M. musculus
gaaaggattgaaggag

SEQ ID NO: 403368 - DNA, 16 bp, M. musculus
gaaaggatttattcag

SEQ ID NO: 403369 - DNA, 16 bp, M. musculus
gaaaggcacacacaca

SEQ ID NO: 403370 - DNA, 50 bp, M. musculus
gaaaggcagaacacatggcgggaaaactgcccctgcacgtgtgcagatta

SEQ ID NO: 403371 - DNA, 16 bp, M. musculus
gaaaggcagagaagca

SEQ ID NO: 403372 - DNA, 16 bp, M. musculus
gaaaggcatatcttct

SEQ ID NO: 403373 - DNA, 16 bp, M. musculus
gaaaggccaggctggg

SEQ ID NO: 403374 - DNA, 16 bp, M. musculus
gaaaggccattgactt

SEQ ID NO: 403375 - DNA, 16 bp, M. musculus
gaaaggcctgaaggag

SEQ ID NO: 403376 - DNA, 16 bp, M. musculus
gaaaggctagaaaaaa

SEQ ID NO: 403377 - DNA, 16 bp, M. musculus
gaaaggctcaaggctt

SEQ ID NO: 403378 - DNA, 16 bp, M. musculus
gaaaggctggaaaaaa

SEQ ID NO: 403379 - DNA, 16 bp, M. musculus
gaaaggctttattcag

SEQ ID NO: 403380 - DNA, 16 bp, M. musculus
gaaagggaggctggga

SEQ ID NO: 403381 - DNA, 16 bp, M. musculus
gaaagggcttatttga

SEQ ID NO: 403382 - DNA, 16 bp, M. musculus
gaaaggggagaacatt

SEQ ID NO: 403383 - DNA, 16 bp, M. musculus
gaaaggggtgtgtgtg

SEQ ID NO: 403384 - DNA, 16 bp, M. musculus
gaaagggtcattctac

SEQ ID NO: 403385 - DNA, 16 bp, M. musculus
gaaagggtttatttca

SEQ ID NO: 403386 - DNA, 16 bp, M. musculus
gaaagggtttatttgc

SEQ ID NO: 403387 - DNA, 16 bp, M. musculus
gaaaggtcattcagag

SEQ ID NO: 403388 - DNA, 16 bp, M. musculus
gaaaggtctgatgcaa

SEQ ID NO: 403389 - DNA, 16 bp, M. musculus
gaaaggtggaactgga

SEQ ID NO: 403390 - DNA, 16 bp, M. musculus
gaaaggtgttttgttt

SEQ ID NO: 403391 - DNA, 16 bp, M. musculus
gaaaggtttcatctct

SEQ ID NO: 403392 - DNA, 16 bp, M. musculus
gaaaggttttatttgg

SEQ ID NO: 403393 - DNA, 16 bp, M. musculus
gaaagtaccctaggag

SEQ ID NO: 403394 - DNA, 16 bp, M. musculus
gaaagtactgaaggag

SEQ ID NO: 403395 - DNA, 16 bp, M. musculus
gaaagtatccaagaag

SEQ ID NO: 403396 - DNA, 16 bp, M. musculus
gaaagtatgtcactgt

SEQ ID NO: 403397 - DNA, 16 bp, M. musculus
gaaagtatttatttat

SEQ ID NO: 403398 - DNA, 16 bp, M. musculus
gaaagtattttggaaa

SEQ ID NO: 403399 - DNA, 16 bp, M. musculus
gaaagtcaagaagaag

SEQ ID NO: 403400 - DNA, 16 bp, M. musculus
gaaagtcagagcagga

SEQ ID NO: 403401 - DNA, 16 bp, M. musculus
gaaagtcagttttctt

SEQ ID NO: 403402 - DNA, 16 bp, M. musculus
gaaagtccaagaatct

SEQ ID NO: 403403 - DNA, 16 bp, M. musculus
gaaagtcccttcagag

SEQ ID NO: 403404 - DNA, 16 bp, M. musculus
gaaagtccttgagctg

SEQ ID NO: 403405 - DNA, 16 bp, M. musculus
gaaagtccttttgaag

SEQ ID NO: 403406 - DNA, 16 bp, M. musculus
gaaagtctggaaaaca

SEQ ID NO: 403407 - DNA, 16 bp, M. musculus
gaaagtcttggaaaga

SEQ ID NO: 403408 - DNA, 16 bp, M. musculus
gaaagtgaaagacaaa

SEQ ID NO: 403409 - DNA, 16 bp, M. musculus
gaaagtgaggctcaga

SEQ ID NO: 403410 - DNA, 16 bp, M. musculus
gaaagtgcagaggagg

SEQ ID NO: 403411 - DNA, 16 bp, M. musculus
gaaagtggatgctcac

SEQ ID NO: 403412 - DNA, 16 bp, M. musculus
gaaagtggccagatgt

SEQ ID NO: 403413 - DNA, 16 bp, M. musculus
gaaagtggggaatagt

SEQ ID NO: 403414 - DNA, 16 bp, M. musculus
gaaagtgggggaaagt

SEQ ID NO: 403415 - DNA, 16 bp, M. musculus
gaaagtgtctggcagc

SEQ ID NO: 403416 - DNA, 16 bp, M. musculus
gaaagtgtttaattgg

SEQ ID NO: 403417 - DNA, 16 bp, M. musculus
gaaagtgtttatttca

SEQ ID NO: 403418 - DNA, 16 bp, M. musculus
gaaagttaaaaaccat

SEQ ID NO: 403419 - DNA, 16 bp, M. musculus
gaaagttcaaggacag

SEQ ID NO: 403420 - DNA, 16 bp, M. musculus
gaaagttcaaggccaa

SEQ ID NO: 403421 - DNA, 16 bp, M. musculus
gaaagttcaaggccag

SEQ ID NO: 403422 - DNA, 16 bp, M. musculus
gaaagttctagaacaa

SEQ ID NO: 403423 - DNA, 16 bp, M. musculus
gaaagttctgtatgac

SEQ ID NO: 403424 - DNA, 16 bp, M. musculus
gaaagtttggctggtt

SEQ ID NO: 403425 - DNA, 16 bp, M. musculus
gaaagttttcttctgt

SEQ ID NO: 403426 - DNA, 16 bp, M. musculus
gaaagttttgtgtgtg

SEQ ID NO: 403427 - DNA, 16 bp, M. musculus
gaaagtttttccctgt

SEQ ID NO: 403428 - DNA, 16 bp, M. musculus
gaaataaaaccacata

SEQ ID NO: 403429 - DNA, 16 bp, M. musculus
gaaataaaacttgaga

SEQ ID NO: 403430 - DNA, 16 bp, M. musculus
gaaataaaagatacat

SEQ ID NO: 403431 - DNA, 16 bp, M. musculus
gaaataaaagtgactt

SEQ ID NO: 403432 - DNA, 16 bp, M. musculus
gaaataaaatcttttt

SEQ ID NO: 403433 - DNA, 16 bp, M. musculus
gaaataaaatttcttt

SEQ ID NO: 403434 - DNA, 16 bp, M. musculus
gaaataaacctttcct

SEQ ID NO: 403435 - DNA, 16 bp, M. musculus
gaaataaaggaagcaa

SEQ ID NO: 403436 - DNA, 16 bp, M. musculus
gaaataaaggagaaca

SEQ ID NO: 403437 - DNA, 16 bp, M. musculus
gaaataaataaaactg

SEQ ID NO: 403438 - DNA, 16 bp, M. musculus
gaaataaataccaaat

SEQ ID NO: 403439 - DNA, 16 bp, M. musculus
gaaataaatacttaat

SEQ ID NO: 403440 - DNA, 16 bp, M. musculus
gaaataaatgattttt

SEQ ID NO: 403441 - DNA, 16 bp, M. musculus
gaaataaatggattta

SEQ ID NO: 403442 - DNA, 16 bp, M. musculus
gaaataacatttgaaa

SEQ ID NO: 403443 - DNA, 16 bp, M. musculus
gaaataacttttaaaa

SEQ ID NO: 403444 - DNA, 16 bp, M. musculus
gaaataagccagtcac

SEQ ID NO: 403445 - DNA, 16 bp, M. musculus
gaaataagcctaaaaa

SEQ ID NO: 403446 - DNA, 16 bp, M. musculus
gaaataagtctggtgg

SEQ ID NO: 403447 - DNA, 16 bp, M. musculus
gaaataatcaaactga

SEQ ID NO: 403448 - DNA, 16 bp, M. musculus
gaaataatcaacctca

SEQ ID NO: 403449 - DNA, 16 bp, M. musculus
gaaatacaaatgaaga

SEQ ID NO: 403450 - DNA, 16 bp, M. musculus
gaaatacacactggaa

SEQ ID NO: 403451 - DNA, 17 bp, M. musculus
gaaatacaccctttaac

SEQ ID NO: 403452 - DNA, 16 bp, M. musculus
gaaatacagaacacaa

SEQ ID NO: 403453 - DNA, 16 bp, M. musculus
gaaatacaggagcaca

SEQ ID NO: 403454 - DNA, 16 bp, M. musculus
gaaatacaggggcaaa

SEQ ID NO: 403455 - DNA, 16 bp, M. musculus
gaaatacatttatttt

SEQ ID NO: 403456 - DNA, 16 bp, M. musculus
gaaataccgaatggct

SEQ ID NO: 403457 - DNA, 16 bp, M. musculus
gaaatacctccatgag

SEQ ID NO: 403458 - DNA, 16 bp, M. musculus
gaaatagaaacagtaa

SEQ ID NO: 403459 - DNA, 16 bp, M. musculus
gaaatagtcaaaagct

SEQ ID NO: 403460 - DNA, 16 bp, M. musculus
gaaatagtgaagatat

SEQ ID NO: 403461 - DNA, 16 bp, M. musculus
gaaatagttttctttt

SEQ ID NO: 403462 - DNA, 16 bp, M. musculus
gaaatataaacaccaa

SEQ ID NO: 403463 - DNA, 16 bp, M. musculus
gaaatatattttgaat

SEQ ID NO: 403464 - DNA, 16 bp, M. musculus
gaaatatcatcaaaaa

SEQ ID NO: 403465 - DNA, 16 bp, M. musculus
gaaatatcattctgag

SEQ ID NO: 403466 - DNA, 16 bp, M. musculus
gaaatatctttagaga

SEQ ID NO: 403467 - DNA, 16 bp, M. musculus
gaaatattaaaaggtc

SEQ ID NO: 403468 - DNA, 16 bp, M. musculus
gaaatattattcagct

SEQ ID NO: 403469 - DNA, 16 bp, M. musculus
gaaatatttctctttt

SEQ ID NO: 403470 - DNA, 16 bp, M. musculus
gaaatatttgttttct

SEQ ID NO: 403471 - DNA, 16 bp, M. musculus
gaaatatttttaaaga

SEQ ID NO: 403472 - DNA, 16 bp, M. musculus
gaaatcaaacttgggt

SEQ ID NO: 403473 - DNA, 16 bp, M. musculus
gaaatcaaagaagatg

SEQ ID NO: 403474 - DNA, 16 bp, M. musculus
gaaatcaaatagaaat

SEQ ID NO: 403475 - DNA, 16 bp, M. musculus
gaaatcaagaaggtgg

SEQ ID NO: 403476 - DNA, 16 bp, M. musculus
gaaatcaagatcactc

SEQ ID NO: 403477 - DNA, 16 bp, M. musculus
gaaatcaatataacat

SEQ ID NO: 403478 - DNA, 16 bp, M. musculus
gaaatcacagatattt

SEQ ID NO: 403479 - DNA, 16 bp, M. musculus
gaaatcagagatggtg

SEQ ID NO: 403480 - DNA, 16 bp, M. musculus
gaaatcagcagttcag

SEQ ID NO: 403481 - DNA, 16 bp, M. musculus
gaaatcaggacaggaa

SEQ ID NO: 403482 - DNA, 16 bp, M. musculus
gaaatcagggcagaaa

SEQ ID NO: 403483 - DNA, 16 bp, M. musculus
gaaatcagtgctaaga

SEQ ID NO: 403484 - DNA, 16 bp, M. musculus
gaaatcatgtcttgaa

SEQ ID NO: 403485 - DNA, 16 bp, M. musculus
gaaatcattaaagaaa

SEQ ID NO: 403486 - DNA, 16 bp, M. musculus
gaaatccaaaatacca

SEQ ID NO: 403487 - DNA, 16 bp, M. musculus
gaaatccaaagcacca

SEQ ID NO: 403488 - DNA, 16 bp, M. musculus
gaaatccaacaagaat

SEQ ID NO: 403489 - DNA, 16 bp, M. musculus
gaaatccacctgcatc

SEQ ID NO: 403490 - DNA, 16 bp, M. musculus
gaaatccaccttcttg

SEQ ID NO: 403491 - DNA, 16 bp, M. musculus
gaaatccacttgcttc

SEQ ID NO: 403492 - DNA, 16 bp, M. musculus
gaaatccaggtggaga

SEQ ID NO: 403493 - DNA, 16 bp, M. musculus
gaaatccatttttttt

SEQ ID NO: 403494 - DNA, 16 bp, M. musculus
gaaatcctaaacctga

SEQ ID NO: 403495 - DNA, 16 bp, M. musculus
gaaatcctaattaaga

SEQ ID NO: 403496 - DNA, 16 bp, M. musculus
gaaatcctgaagaagt

SEQ ID NO: 403497 - DNA, 16 bp, M. musculus
gaaatcctgtctaaaa

SEQ ID NO: 403498 - DNA, 16 bp, M. musculus
gaaatctctcagacac

SEQ ID NO: 403499 - DNA, 16 bp, M. musculus
gaaatctctggtgtta

SEQ ID NO: 403500 - DNA, 16 bp, M. musculus
gaaatctgcagctgcc

SEQ ID NO: 403501 - DNA, 16 bp, M. musculus
gaaatctgcctgcttc

SEQ ID NO: 403502 - DNA, 16 bp, M. musculus
gaaatcttcccaaggt

SEQ ID NO: 403503 - DNA, 16 bp, M. musculus
gaaatctttaaaaaaa

SEQ ID NO: 403504 - DNA, 16 bp, M. musculus
gaaatgaaaaggaagc

SEQ ID NO: 403505 - DNA, 16 bp, M. musculus
gaaatgaagacagaaa

SEQ ID NO: 403506 - DNA, 16 bp, M. musculus
gaaatgaatgcttttc

SEQ ID NO: 403507 - DNA, 16 bp, M. musculus
gaaatgaccatccaga

SEQ ID NO: 403508 - DNA, 16 bp, M. musculus
gaaatgactcagcagg

SEQ ID NO: 403509 - DNA, 16 bp, M. musculus
gaaatgaggaagtcaa

SEQ ID NO: 403510 - DNA, 16 bp, M. musculus
gaaatgattttttaaa

SEQ ID NO: 403511 - DNA, 16 bp, M. musculus
gaaatgcacactgaag

SEQ ID NO: 403512 - DNA, 16 bp, M. musculus
gaaatgcaccaaaaac

SEQ ID NO: 403513 - DNA, 16 bp, M. musculus
gaaatgcacctgcctc

SEQ ID NO: 403514 - DNA, 16 bp, M. musculus
gaaatgcaggcacagg

SEQ ID NO: 403515 - DNA, 16 bp, M. musculus
gaaatgccttacagct

SEQ ID NO: 403516 - DNA, 16 bp, M. musculus
gaaatgcttccccatg

SEQ ID NO: 403517 - DNA, 16 bp, M. musculus
gaaatggaaaacttcc

SEQ ID NO: 403518 - DNA, 16 bp, M. musculus
gaaatggaaacaatca

SEQ ID NO: 403519 - DNA, 16 bp, M. musculus
gaaatggaaatgaaat

SEQ ID NO: 403520 - DNA, 16 bp, M. musculus
gaaatggaagaagaca

SEQ ID NO: 403521 - DNA, 16 bp, M. musculus
gaaatggaggcacaga

SEQ ID NO: 403522 - DNA, 16 bp, M. musculus
gaaatggaggcaggag

SEQ ID NO: 403523 - DNA, 16 bp, M. musculus
gaaatggatggatctg

SEQ ID NO: 403524 - DNA, 20 bp, M. musculus
gaaatggcagcccccttgta

SEQ ID NO: 403525 - DNA, 16 bp, M. musculus
gaaatggccctgaaaa

SEQ ID NO: 403526 - DNA, 16 bp, M. musculus
gaaatgggattttttt

SEQ ID NO: 403527 - DNA, 16 bp, M. musculus
gaaatggggctggaga

SEQ ID NO: 403528 - DNA, 16 bp, M. musculus
gaaatgggtctgaagt

SEQ ID NO: 403529 - DNA, 16 bp, M. musculus
gaaatgtaagtgaaaa

SEQ ID NO: 403530 - DNA, 16 bp, M. musculus
gaaatgtagataaata

SEQ ID NO: 403531 - DNA, 16 bp, M. musculus
gaaatgtctttttaaa

SEQ ID NO: 403532 - DNA, 16 bp, M. musculus
gaaatgtgtcactggg

SEQ ID NO: 403533 - DNA, 16 bp, M. musculus
gaaatgttccttttct

SEQ ID NO: 403534 - DNA, 16 bp, M. musculus
gaaatgtttttaaaaa

SEQ ID NO: 403535 - DNA, 16 bp, M. musculus
gaaatgtttttttaaa

SEQ ID NO: 403536 - DNA, 16 bp, M. musculus
gaaattaaaaatgttt

SEQ ID NO: 403537 - DNA, 16 bp, M. musculus
gaaattaaagaagttc

SEQ ID NO: 403538 - DNA, 16 bp, M. musculus
gaaattaaagactttc

SEQ ID NO: 403539 - DNA, 16 bp, M. musculus
gaaattaaagattttt

SEQ ID NO: 403540 - DNA, 16 bp, M. musculus
gaaattacagagacaa

SEQ ID NO: 403541 - DNA, 16 bp, M. musculus
gaaattaccaaagaat

SEQ ID NO: 403542 - DNA, 16 bp, M. musculus
gaaattagaaaagggg

SEQ ID NO: 403543 - DNA, 16 bp, M. musculus
gaaattatctttcttt

SEQ ID NO: 403544 - DNA, 16 bp, M. musculus
gaaattatggaaacaa

SEQ ID NO: 403545 - DNA, 16 bp, M. musculus
gaaattcaagaagaat

SEQ ID NO: 403546 - DNA, 16 bp, M. musculus
gaaattcaaggccagc

SEQ ID NO: 403547 - DNA, 16 bp, M. musculus
gaaattcaccaaggct

SEQ ID NO: 403548 - DNA, 30 bp, M. musculus
gaaattcaggacaagctatcagaagtaaag

SEQ ID NO: 403549 - DNA, 16 bp, M. musculus
gaaattcataccagag

SEQ ID NO: 403550 - DNA, 16 bp, M. musculus
gaaattcatagccaaa

SEQ ID NO: 403551 - DNA, 16 bp, M. musculus
gaaattccaagcccag

SEQ ID NO: 403552 - DNA, 16 bp, M. musculus
gaaattcctcctgaaa

SEQ ID NO: 403553 - DNA, 16 bp, M. musculus
gaaattctgcctcaaa

SEQ ID NO: 403554 - DNA, 16 bp, M. musculus
gaaattctgtcctaat

SEQ ID NO: 403555 - DNA, 16 bp, M. musculus
gaaattcttggaaaaa

SEQ ID NO: 403556 - DNA, 16 bp, M. musculus
gaaattgaacagaaat

SEQ ID NO: 403557 - DNA, 16 bp, M. musculus
gaaattgagtccatta

SEQ ID NO: 403558 - DNA, 16 bp, M. musculus
gaaattgatttttaaa

SEQ ID NO: 403559 - DNA, 17 bp, M. musculus
gaaattgccgagtcggt

SEQ ID NO: 403560 - DNA, 16 bp, M. musculus
gaaattgtcccaggca

SEQ ID NO: 403561 - DNA, 16 bp, M. musculus
gaaattgtcccatgtg

SEQ ID NO: 403562 - DNA, 16 bp, M. musculus
gaaatttaaggttgtt

SEQ ID NO: 403563 - DNA, 16 bp, M. musculus
gaaatttatttttctt

SEQ ID NO: 403564 - DNA, 16 bp, M. musculus
gaaatttcagaaggaa

SEQ ID NO: 403565 - DNA, 16 bp, M. musculus
gaaatttgacaacaaa

SEQ ID NO: 403566 - DNA, 16 bp, M. musculus
gaaatttgtccatttt

SEQ ID NO: 403567 - DNA, 16 bp, M. musculus
gaaatttgtctatttt

SEQ ID NO: 403568 - DNA, 16 bp, M. musculus
gaaatttgttcatttc

SEQ ID NO: 403569 - DNA, 16 bp, M. musculus
gaaattttaagaattt

SEQ ID NO: 403570 - DNA, 16 bp, M. musculus
gaaattttaagcatat

SEQ ID NO: 403571 - DNA, 16 bp, M. musculus
gaaattttctttattt

SEQ ID NO: 403572 - DNA, 16 bp, M. musculus
gaacaaaacagccatg

SEQ ID NO: 403573 - DNA, 16 bp, M. musculus
gaacaaaagactcaga

SEQ ID NO: 403574 - DNA, 16 bp, M. musculus
gaacaaaaggctcaga

SEQ ID NO: 403575 - DNA, 16 bp, M. musculus
gaacaaaaggctttgc

SEQ ID NO: 403576 - DNA, 16 bp, M. musculus
gaacaaaatacccttg

SEQ ID NO: 403577 - DNA, 16 bp, M. musculus
gaacaaaatattcaca

SEQ ID NO: 403578 - DNA, 16 bp, M. musculus
gaacaaaatcatccaa

SEQ ID NO: 403579 - DNA, 16 bp, M. musculus
gaacaaagaaagaatg

SEQ ID NO: 403580 - DNA, 16 bp, M. musculus
gaacaaagaccaaatt

SEQ ID NO: 403581 - DNA, 16 bp, M. musculus
gaacaaagaggaaata

SEQ ID NO: 403582 - DNA, 16 bp, M. musculus
gaacaaaggagtgaga

SEQ ID NO: 403583 - DNA, 16 bp, M. musculus
gaacaaagtatctaca

SEQ ID NO: 403584 - DNA, 16 bp, M. musculus
gaacaaatgaataaat

SEQ ID NO: 403585 - DNA, 16 bp, M. musculus
gaacaacaaagattgg

SEQ ID NO: 403586 - DNA, 16 bp, M. musculus
gaacaacaacaataac

SEQ ID NO: 403587 - DNA, 16 bp, M. musculus
gaacaacaacatcaac

SEQ ID NO: 403588 - DNA, 16 bp, M. musculus
gaacaacaatgtgaac

SEQ ID NO: 403589 - DNA, 16 bp, M. musculus
gaacaacattgtaaaa

SEQ ID NO: 403590 - DNA, 16 bp, M. musculus
gaacaaccagtgttct

SEQ ID NO: 403591 - DNA, 16 bp, M. musculus
gaacaactggtggtta

SEQ ID NO: 403592 - DNA, 16 bp, M. musculus
gaacaacttgcagaaa

SEQ ID NO: 403593 - DNA, 16 bp, M. musculus
gaacaagatgcagaac

SEQ ID NO: 403594 - DNA, 16 bp, M. musculus
gaacaagccaggggag

SEQ ID NO: 403595 - DNA, 16 bp, M. musculus
gaacaagctcctggtt

SEQ ID NO: 403596 - DNA, 16 bp, M. musculus
gaacaaggacatcatg

SEQ ID NO: 403597 - DNA, 16 bp, M. musculus
gaacaagtactcttaa

SEQ ID NO: 403598 - DNA, 16 bp, M. musculus
gaacaagttcaaggcc

SEQ ID NO: 403599 - DNA, 16 bp, M. musculus
gaacaataatatgaac

SEQ ID NO: 403600 - DNA, 16 bp, M. musculus
gaacaataatatgaat

SEQ ID NO: 403601 - DNA, 16 bp, M. musculus
gaacaatgtgaacttg

SEQ ID NO: 403602 - DNA, 16 bp, M. musculus
gaacaattcctgaaca

SEQ ID NO: 403603 - DNA, 16 bp, M. musculus
gaacaatttcaatatt

SEQ ID NO: 403604 - DNA, 16 bp, M. musculus
gaacaatttttttttt

SEQ ID NO: 403605 - DNA, 16 bp, M. musculus
gaacacaacttctgcc

SEQ ID NO: 403606 - DNA, 16 bp, M. musculus
gaacacaatgaaagaa

SEQ ID NO: 403607 - DNA, 16 bp, M. musculus
gaacacacacacatac

SEQ ID NO: 403608 - DNA, 16 bp, M. musculus
gaacacacaggtgatt

SEQ ID NO: 403609 - DNA, 17 bp, M. musculus
gaacacagccactgtgc

SEQ ID NO: 403610 - DNA, 16 bp, M. musculus
gaacacagcttctgcc

SEQ ID NO: 403611 - DNA, 16 bp, M. musculus
gaacacagcttctgct

SEQ ID NO: 403612 - DNA, 16 bp, M. musculus
gaacacagggaaaaac

SEQ ID NO: 403613 - DNA, 16 bp, M. musculus
gaacacatcaaagcca

SEQ ID NO: 403614 - DNA, 16 bp, M. musculus
gaacacatgctcctct

SEQ ID NO: 403615 - DNA, 16 bp, M. musculus
gaacaccagactccag

SEQ ID NO: 403616 - DNA, 16 bp, M. musculus
gaacaccagggccagg

SEQ ID NO: 403617 - DNA, 16 bp, M. musculus
gaacaccaggtccaag

SEQ ID NO: 403618 - DNA, 16 bp, M. musculus
gaacaccatgaccaaa

SEQ ID NO: 403619 - DNA, 16 bp, M. musculus
gaacactccttcatta

SEQ ID NO: 403620 - DNA, 16 bp, M. musculus
gaacactgattgttct

SEQ ID NO: 403621 - DNA, 16 bp, M. musculus
gaacactgctcactgg

SEQ ID NO: 403622 - DNA, 16 bp, M. musculus
gaacactgtggaagag

SEQ ID NO: 403623 - DNA, 16 bp, M. musculus
gaacacttctccactg

SEQ ID NO: 403624 - DNA, 16 bp, M. musculus
gaacagaaatgaagac

SEQ ID NO: 403625 - DNA, 16 bp, M. musculus
gaacagaacagaaatg

SEQ ID NO: 403626 - DNA, 16 bp, M. musculus
gaacagaatgccaaca

SEQ ID NO: 403627 - DNA, 16 bp, M. musculus
gaacagacacacacac

SEQ ID NO: 403628 - DNA, 16 bp, M. musculus
gaacagagaacctgaa

SEQ ID NO: 403629 - DNA, 16 bp, M. musculus
gaacagagactctggt

SEQ ID NO: 403630 - DNA, 16 bp, M. musculus
gaacagagcaagttcc

SEQ ID NO: 403631 - DNA, 16 bp, M. musculus
gaacagagccagcagg

SEQ ID NO: 403632 - DNA, 16 bp, M. musculus
gaacagagcctggcca

SEQ ID NO: 403633 - DNA, 16 bp, M. musculus
gaacagaggcagctgc

SEQ ID NO: 403634 - DNA, 16 bp, M. musculus
gaacagatacaaaaat

SEQ ID NO: 403635 - DNA, 16 bp, M. musculus
gaacagatatcacagt

SEQ ID NO: 403636 - DNA, 16 bp, M. musculus
gaacagatctaaacag

SEQ ID NO: 403637 - DNA, 16 bp, M. musculus
gaacagcaatatggaa

SEQ ID NO: 403638 - DNA, 16 bp, M. musculus
gaacagcacacacaca

SEQ ID NO: 403639 - DNA, 16 bp, M. musculus
gaacagcactgtggaa

SEQ ID NO: 403640 - DNA, 16 bp, M. musculus
gaacagcagcagcaac

SEQ ID NO: 403641 - DNA, 16 bp, M. musculus
gaacagcagcagtggc

SEQ ID NO: 403642 - DNA, 16 bp, M. musculus
gaacagcagctgagag

SEQ ID NO: 403643 - DNA, 16 bp, M. musculus
gaacagcagtagcagt

SEQ ID NO: 403644 - DNA, 16 bp, M. musculus
gaacagcagtgtgaaa

SEQ ID NO: 403645 - DNA, 16 bp, M. musculus
gaacagccatggctac

SEQ ID NO: 403646 - DNA, 16 bp, M. musculus
gaacagccccagctcc

SEQ ID NO: 403647 - DNA, 16 bp, M. musculus
gaacagcttcaggaat

SEQ ID NO: 403648 - DNA, 16 bp, M. musculus
gaacaggaacaacaga

SEQ ID NO: 403649 - DNA, 16 bp, M. musculus
gaacaggaactacaga

SEQ ID NO: 403650 - DNA, 16 bp, M. musculus
gaacaggaactgaaat

SEQ ID NO: 403651 - DNA, 16 bp, M. musculus
gaacaggaagtggggc

SEQ ID NO: 403652 - DNA, 16 bp, M. musculus
gaacaggacaggacag

SEQ ID NO: 403653 - DNA, 16 bp, M. musculus
gaacaggcaaagacca

SEQ ID NO: 403654 - DNA, 16 bp, M. musculus
gaacagggaaaactgt

SEQ ID NO: 403655 - DNA, 16 bp, M. musculus
gaacagggagtttgct

SEQ ID NO: 403656 - DNA, 16 bp, M. musculus
gaacagtaaaattgag

SEQ ID NO: 403657 - DNA, 16 bp, M. musculus
gaacagtcagagggca

SEQ ID NO: 403658 - DNA, 16 bp, M. musculus
gaacagtgatatagaa

SEQ ID NO: 403659 - DNA, 16 bp, M. musculus
gaacagtgcccattcc

SEQ ID NO: 403660 - DNA, 16 bp, M. musculus
gaacagtgtggggctt

SEQ ID NO: 403661 - DNA, 16 bp, M. musculus
gaacatagaagagcat

SEQ ID NO: 403662 - DNA, 16 bp, M. musculus
gaacatatcaaaaaga

SEQ ID NO: 403663 - DNA, 16 bp, M. musculus
gaacatcaaggaagag

SEQ ID NO: 403664 - DNA, 16 bp, M. musculus
gaacatcaatgtgaac

SEQ ID NO: 403665 - DNA, 16 bp, M. musculus
gaacatcagaaagcct

SEQ ID NO: 403666 - DNA, 16 bp, M. musculus
gaacatcagacttttt

SEQ ID NO: 403667 - DNA, 16 bp, M. musculus
gaacatcctggacaga

SEQ ID NO: 403668 - DNA, 16 bp, M. musculus
gaacatcgtggagcat

SEQ ID NO: 403669 - DNA, 16 bp, M. musculus
gaacatcttggaagag

SEQ ID NO: 403670 - DNA, 16 bp, M. musculus
gaacatgagaacagat

SEQ ID NO: 403671 - DNA, 16 bp, M. musculus
gaacatggccagcaga

SEQ ID NO: 403672 - DNA, 16 bp, M. musculus
gaacatggtggagcac

SEQ ID NO: 403673 - DNA, 16 bp, M. musculus
gaacattattaaatta

SEQ ID NO: 403674 - DNA, 16 bp, M. musculus
gaacattggggcaggt

SEQ ID NO: 403675 - DNA, 16 bp, M. musculus
gaacatttcactctaa

SEQ ID NO: 403676 - DNA, 16 bp, M. musculus
gaacattttaaacaag

SEQ ID NO: 403677 - DNA, 16 bp, M. musculus
gaacattttgttaaag

SEQ ID NO: 403678 - DNA, 16 bp, M. musculus
gaacatttttttctgg

SEQ ID NO: 403679 - DNA, 16 bp, M. musculus
gaacatttttttttca

SEQ ID NO: 403680 - DNA, 16 bp, M. musculus
gaacatttttttttct

SEQ ID NO: 403681 - DNA, 16 bp, M. musculus
gaaccaaactcaagtc

SEQ ID NO: 403682 - DNA, 16 bp, M. musculus
gaaccaaatattcaaa

SEQ ID NO: 403683 - DNA, 16 bp, M. musculus
gaaccaactcctcttt

SEQ ID NO: 403684 - DNA, 16 bp, M. musculus
gaaccaactcttgaaa

SEQ ID NO: 403685 - DNA, 16 bp, M. musculus
gaaccaagatggctcc

SEQ ID NO: 403686 - DNA, 16 bp, M. musculus
gaaccaagatggtgcc

SEQ ID NO: 403687 - DNA, 16 bp, M. musculus
gaaccaagatgtctgc

SEQ ID NO: 403688 - DNA, 16 bp, M. musculus
gaaccaaggtggctcc

SEQ ID NO: 403689 - DNA, 16 bp, M. musculus
gaaccaccatatgggt

SEQ ID NO: 403690 - DNA, 16 bp, M. musculus
gaaccacgccctagaa

SEQ ID NO: 403691 - DNA, 16 bp, M. musculus
gaaccactgccctaag

SEQ ID NO: 403692 - DNA, 16 bp, M. musculus
gaaccagaagttcaag

SEQ ID NO: 403693 - DNA, 16 bp, M. musculus
gaaccagcagctgcag

SEQ ID NO: 403694 - DNA, 16 bp, M. musculus
gaaccagccagccaga

SEQ ID NO: 403695 - DNA, 16 bp, M. musculus
gaaccaggagaagact

SEQ ID NO: 403696 - DNA, 16 bp, M. musculus
gaaccaggagctgtca

SEQ ID NO: 403697 - DNA, 16 bp, M. musculus
gaaccagggtcctctg

SEQ ID NO: 403698 - DNA, 16 bp, M. musculus
gaaccagttcttggtt

SEQ ID NO: 403699 - DNA, 16 bp, M. musculus
gaaccatctctccagg

SEQ ID NO: 403700 - DNA, 16 bp, M. musculus
gaaccatctcttcatc

SEQ ID NO: 403701 - DNA, 16 bp, M. musculus
gaacccaacttggtgt

SEQ ID NO: 403702 - DNA, 16 bp, M. musculus
gaacccaaggccttgt

SEQ ID NO: 403703 - DNA, 16 bp, M. musculus
gaacccaattctccta

SEQ ID NO: 403704 - DNA, 16 bp, M. musculus
gaacccacagaaaggt

SEQ ID NO: 403705 - DNA, 16 bp, M. musculus
gaacccacatgtccct

SEQ ID NO: 403706 - DNA, 16 bp, M. musculus
gaacccagaaccacct

SEQ ID NO: 403707 - DNA, 16 bp, M. musculus
gaacccagaacctctg

SEQ ID NO: 403708 - DNA, 16 bp, M. musculus
gaacccagagcttgct

SEQ ID NO: 403709 - DNA, 16 bp, M. musculus
gaacccagaggcagga

SEQ ID NO: 403710 - DNA, 16 bp, M. musculus
gaacccagatgagcca

SEQ ID NO: 403711 - DNA, 16 bp, M. musculus
gaacccagatggtgac

SEQ ID NO: 403712 - DNA, 16 bp, M. musculus
gaacccaggaaaacag

SEQ ID NO: 403713 - DNA, 16 bp, M. musculus
gaacccaggattacca

SEQ ID NO: 403714 - DNA, 16 bp, M. musculus
gaacccagggccctgt

SEQ ID NO: 403715 - DNA, 16 bp, M. musculus
gaacccagggcctcac

SEQ ID NO: 403716 - DNA, 16 bp, M. musculus
gaacccagggcctcag

SEQ ID NO: 403717 - DNA, 16 bp, M. musculus
gaacccagggccttgc

SEQ ID NO: 403718 - DNA, 16 bp, M. musculus
gaacccagggccttgt

SEQ ID NO: 403719 - DNA, 16 bp, M. musculus
gaacccagggtcttgc

SEQ ID NO: 403720 - DNA, 16 bp, M. musculus
gaacccagggtttcat

SEQ ID NO: 403721 - DNA, 16 bp, M. musculus
gaacccaggtcctctg

SEQ ID NO: 403722 - DNA, 16 bp, M. musculus
gaacccagttgcccct

SEQ ID NO: 403723 - DNA, 16 bp, M. musculus
gaaccccctggtgcta

SEQ ID NO: 403724 - DNA, 16 bp, M. musculus
gaacccctctccaagc

SEQ ID NO: 403725 - DNA, 16 bp, M. musculus
gaaccctgcagaagag

SEQ ID NO: 403726 - DNA, 16 bp, M. musculus
gaaccctggtcctctg

SEQ ID NO: 403727 - DNA, 16 bp, M. musculus
gaaccctgtctcgaaa

SEQ ID NO: 403728 - DNA, 16 bp, M. musculus
gaaccctgtcttgaaa

SEQ ID NO: 403729 - DNA, 16 bp, M. musculus
gaaccctgtggaagag

SEQ ID NO: 403730 - DNA, 16 bp, M. musculus
gaacctacaactgcca

SEQ ID NO: 403731 - DNA, 16 bp, M. musculus
gaacctcaaacacatt

SEQ ID NO: 403732 - DNA, 16 bp, M. musculus
gaacctcagggttgtt

SEQ ID NO: 403733 - DNA, 18 bp, M. musculus
gaacctcccctctgtcta

SEQ ID NO: 403734 - DNA, 16 bp, M. musculus
gaacctcctcctggct

SEQ ID NO: 403735 - DNA, 18 bp, M. musculus
gaacctctgaaactgtaa

SEQ ID NO: 403736 - DNA, 16 bp, M. musculus
gaacctctggaggaat

SEQ ID NO: 403737 - DNA, 33 bp, M. musculus
gaacctctttgggtgccggagagattggtgaga

SEQ ID NO: 403738 - DNA, 48 bp, M. musculus
gaacctctttgggtgctggagagattggtgagacgctgcaagaatgag

SEQ ID NO: 403739 - DNA, 16 bp, M. musculus
gaacctgaagctcacc

SEQ ID NO: 403740 - DNA, 16 bp, M. musculus
gaacctgaatgaaatg

SEQ ID NO: 403741 - DNA, 16 bp, M. musculus
gaacctgacagaagag

SEQ ID NO: 403742 - DNA, 17 bp, M. musculus
gaacctgagactgcagt

SEQ ID NO: 403743 - DNA, 16 bp, M. musculus
gaacctgaggcaggag

SEQ ID NO: 403744 - DNA, 16 bp, M. musculus
gaacctgagttcaaat

SEQ ID NO: 403745 - DNA, 16 bp, M. musculus
gaacctgatagaagag

SEQ ID NO: 403746 - DNA, 16 bp, M. musculus
gaacctgcagagacca

SEQ ID NO: 403747 - DNA, 16 bp, M. musculus
gaacctgcctcctgga

SEQ ID NO: 403748 - DNA, 16 bp, M. musculus
gaacctggaagaaatg

SEQ ID NO: 403749 - DNA, 16 bp, M. musculus
gaacctggagacagga

SEQ ID NO: 403750 - DNA, 16 bp, M. musculus
gaacctggagctcaca

SEQ ID NO: 403751 - DNA, 16 bp, M. musculus
gaacctggagctcact

SEQ ID NO: 403752 - DNA, 16 bp, M. musculus
gaacctggaggcagga

SEQ ID NO: 403753 - DNA, 16 bp, M. musculus
gaacctggaggcaggt

SEQ ID NO: 403754 - DNA, 16 bp, M. musculus
gaacctggaggccagg

SEQ ID NO: 403755 - DNA, 16 bp, M. musculus
gaacctggagttcact

SEQ ID NO: 403756 - DNA, 16 bp, M. musculus
gaacctgggtactctg

SEQ ID NO: 403757 - DNA, 16 bp, M. musculus
gaacctgggtcccctg

SEQ ID NO: 403758 - DNA, 16 bp, M. musculus
gaacctgggtcctctg

SEQ ID NO: 403759 - DNA, 16 bp, M. musculus
gaacctgtagagatca

SEQ ID NO: 403760 - DNA, 16 bp, M. musculus
gaacctgtgtcttctg

SEQ ID NO: 403761 - DNA, 17 bp, M. musculus
gaaccttctggacaaag

SEQ ID NO: 403762 - DNA, 16 bp, M. musculus
gaaccttgaagaaatg

SEQ ID NO: 403763 - DNA, 16 bp, M. musculus
gaaccttggaaaattt

SEQ ID NO: 403764 - DNA, 16 bp, M. musculus
gaaccttggagagtgg

SEQ ID NO: 403765 - DNA, 16 bp, M. musculus
gaacgaacgaacgaac

SEQ ID NO: 403766 - DNA, 17 bp, M. musculus
gaacgaaggaacgaagg

SEQ ID NO: 403767 - DNA, 17 bp, M. musculus
gaacgaagtgcccctcc

SEQ ID NO: 403768 - DNA, 16 bp, M. musculus
gaacgccagactccag

SEQ ID NO: 403769 - DNA, 16 bp, M. musculus
gaacgccagagccaag

SEQ ID NO: 403770 - DNA, 16 bp, M. musculus
gaacgccagggccaaa

SEQ ID NO: 403771 - DNA, 16 bp, M. musculus
gaactaaacttaggtc

SEQ ID NO: 403772 - DNA, 16 bp, M. musculus
gaactaaaggaagcaa

SEQ ID NO: 403773 - DNA, 16 bp, M. musculus
gaactacaactcccag

SEQ ID NO: 403774 - DNA, 16 bp, M. musculus
gaactacaattcccag

SEQ ID NO: 403775 - DNA, 16 bp, M. musculus
gaactacatttcccag

SEQ ID NO: 403776 - DNA, 16 bp, M. musculus
gaactagaaaacatca

SEQ ID NO: 403777 - DNA, 16 bp, M. musculus
gaactagagttagaga

SEQ ID NO: 403778 - DNA, 16 bp, M. musculus
gaactatacaaagaaa

SEQ ID NO: 403779 - DNA, 16 bp, M. musculus
gaactatgttaaaggg

SEQ ID NO: 403780 - DNA, 16 bp, M. musculus
gaactattcccttttc

SEQ ID NO: 403781 - DNA, 16 bp, M. musculus
gaactatttctaaaca

SEQ ID NO: 403782 - DNA, 16 bp, M. musculus
gaactatttgggaaag

SEQ ID NO: 403783 - DNA, 16 bp, M. musculus
gaactcaaaaagttca

SEQ ID NO: 403784 - DNA, 16 bp, M. musculus
gaactcaaaacctctg

SEQ ID NO: 403785 - DNA, 16 bp, M. musculus
gaactcaaagcaggaa

SEQ ID NO: 403786 - DNA, 16 bp, M. musculus
gaactcaagcaggagc

SEQ ID NO: 403787 - DNA, 16 bp, M. musculus
gaactcacagagatcc

SEQ ID NO: 403788 - DNA, 16 bp, M. musculus
gaactcacagagttcc

SEQ ID NO: 403789 - DNA, 16 bp, M. musculus
gaactcaccatataga

SEQ ID NO: 403790 - DNA, 16 bp, M. musculus
gaactcacgttgtaga

SEQ ID NO: 403791 - DNA, 16 bp, M. musculus
gaactcactatgtaga

SEQ ID NO: 403792 - DNA, 18 bp, M. musculus
gaactcactatgtagact

SEQ ID NO: 403793 - DNA, 17 bp, M. musculus
gaactcactctgtagag

SEQ ID NO: 403794 - DNA, 16 bp, M. musculus
gaactcactttgtagg

SEQ ID NO: 403795 - DNA, 16 bp, M. musculus
gaactcagagaaatcc

SEQ ID NO: 403796 - DNA, 16 bp, M. musculus
gaactcagagactgag

SEQ ID NO: 403797 - DNA, 16 bp, M. musculus
gaactcagagatacac

SEQ ID NO: 403798 - DNA, 16 bp, M. musculus
gaactcagagatccac

SEQ ID NO: 403799 - DNA, 16 bp, M. musculus
gaactcagagcagctg

SEQ ID NO: 403800 - DNA, 16 bp, M. musculus
gaactcagagctctgc

SEQ ID NO: 403801 - DNA, 16 bp, M. musculus
gaactcaggaagtggg

SEQ ID NO: 403802 - DNA, 16 bp, M. musculus
gaactcaggagctctg

SEQ ID NO: 403803 - DNA, 16 bp, M. musculus
gaactcaggccttctg

SEQ ID NO: 403804 - DNA, 16 bp, M. musculus
gaactcagggcctctg

SEQ ID NO: 403805 - DNA, 16 bp, M. musculus
gaactcaggtactcat

SEQ ID NO: 403806 - DNA, 16 bp, M. musculus
gaactcagtttgtcag

SEQ ID NO: 403807 - DNA, 16 bp, M. musculus
gaactcatgaaggtgg

SEQ ID NO: 403808 - DNA, 16 bp, M. musculus
gaactcatggagatct

SEQ ID NO: 403809 - DNA, 16 bp, M. musculus
gaactcattctgcaga

SEQ ID NO: 403810 - DNA, 16 bp, M. musculus
gaactcattctgtaga

SEQ ID NO: 403811 - DNA, 16 bp, M. musculus
gaactcattctgttga

SEQ ID NO: 403812 - DNA, 16 bp, M. musculus
gaactccacaaactga

SEQ ID NO: 403813 - DNA, 16 bp, M. musculus
gaactccacaggaaaa

SEQ ID NO: 403814 - DNA, 16 bp, M. musculus
gaactccagatcttcc

SEQ ID NO: 403815 - DNA, 16 bp, M. musculus
gaactccctatgtagc

SEQ ID NO: 403816 - DNA, 16 bp, M. musculus
gaactcctgatcctct

SEQ ID NO: 403817 - DNA, 16 bp, M. musculus
gaactcctgattttct

SEQ ID NO: 403818 - DNA, 16 bp, M. musculus
gaactcctggtcctct

SEQ ID NO: 403819 - DNA, 16 bp, M. musculus
gaactccttctccctg

SEQ ID NO: 403820 - DNA, 16 bp, M. musculus
gaactcgaactcagaa

SEQ ID NO: 403821 - DNA, 16 bp, M. musculus
gaactcgctatgtaga

SEQ ID NO: 403822 - DNA, 16 bp, M. musculus
gaactcgctttgtaga

SEQ ID NO: 403823 - DNA, 16 bp, M. musculus
gaactcggaacctctg

SEQ ID NO: 403824 - DNA, 16 bp, M. musculus
gaactctagctccagg

SEQ ID NO: 403825 - DNA, 16 bp, M. musculus
gaactctattaaaggg

SEQ ID NO: 403826 - DNA, 16 bp, M. musculus
gaactctcagatctgc

SEQ ID NO: 403827 - DNA, 16 bp, M. musculus
gaactctcagctccag

SEQ ID NO: 403828 - DNA, 16 bp, M. musculus
gaactctcctgtgtgt

SEQ ID NO: 403829 - DNA, 16 bp, M. musculus
gaactctgccagtctt

SEQ ID NO: 403830 - DNA, 16 bp, M. musculus
gaactctggaggcaga

SEQ ID NO: 403831 - DNA, 16 bp, M. musculus
gaactctgggaaagag

SEQ ID NO: 403832 - DNA, 16 bp, M. musculus
gaactctggttgtcag

SEQ ID NO: 403833 - DNA, 16 bp, M. musculus
gaactctgtggaagag

SEQ ID NO: 403834 - DNA, 16 bp, M. musculus
gaactcttcatcctcc

SEQ ID NO: 403835 - DNA, 16 bp, M. musculus
gaactgaaagcagaaa

SEQ ID NO: 403836 - DNA, 16 bp, M. musculus
gaactgaacaactact

SEQ ID NO: 403837 - DNA, 16 bp, M. musculus
gaactgaacccagggc

SEQ ID NO: 403838 - DNA, 16 bp, M. musculus
gaactgaacccaggtc

SEQ ID NO: 403839 - DNA, 16 bp, M. musculus
gaactgaacctctgag

SEQ ID NO: 403840 - DNA, 16 bp, M. musculus
gaactgaacctgggtc

SEQ ID NO: 403841 - DNA, 16 bp, M. musculus
gaactgaacctggttc

SEQ ID NO: 403842 - DNA, 16 bp, M. musculus
gaactgaactcagaac

SEQ ID NO: 403843 - DNA, 16 bp, M. musculus
gaactgaactcaggtc

SEQ ID NO: 403844 - DNA, 16 bp, M. musculus
gaactgaactctggtc

SEQ ID NO: 403845 - DNA, 16 bp, M. musculus
gaactgaacttgggcc

SEQ ID NO: 403846 - DNA, 16 bp, M. musculus
gaactgaacttgggtg

SEQ ID NO: 403847 - DNA, 16 bp, M. musculus
gaactgactcttgaaa

SEQ ID NO: 403848 - DNA, 16 bp, M. musculus
gaactgagagagagag

SEQ ID NO: 403849 - DNA, 16 bp, M. musculus
gaactgagcccaggtc

SEQ ID NO: 403850 - DNA, 16 bp, M. musculus
gaactgagctgaggag

SEQ ID NO: 403851 - DNA, 16 bp, M. musculus
gaactgatacagaaaa

SEQ ID NO: 403852 - DNA, 16 bp, M. musculus
gaactgatcctcctgc

SEQ ID NO: 403853 - DNA, 16 bp, M. musculus
gaactgcaaacttctg

SEQ ID NO: 403854 - DNA, 16 bp, M. musculus
gaactgcacagagaaa

SEQ ID NO: 403855 - DNA, 16 bp, M. musculus
gaactgcctctgcctc

SEQ ID NO: 403856 - DNA, 16 bp, M. musculus
gaactgctggagcaca

SEQ ID NO: 403857 - DNA, 16 bp, M. musculus
gaactggaaaatatca

SEQ ID NO: 403858 - DNA, 16 bp, M. musculus
gaactggaagaaaaga

SEQ ID NO: 403859 - DNA, 16 bp, M. musculus
gaactggaattgcaga

SEQ ID NO: 403860 - DNA, 16 bp, M. musculus
gaactggactgctggt

SEQ ID NO: 403861 - DNA, 16 bp, M. musculus
gaactggacttacaga

SEQ ID NO: 403862 - DNA, 16 bp, M. musculus
gaactggacttctggt

SEQ ID NO: 403863 - DNA, 16 bp, M. musculus
gaactggagaagtgac

SEQ ID NO: 403864 - DNA, 16 bp, M. musculus
gaactggagagagaga

SEQ ID NO: 403865 - DNA, 16 bp, M. musculus
gaactggagctgcaga

SEQ ID NO: 403866 - DNA, 16 bp, M. musculus
gaactggagtgacaga

SEQ ID NO: 403867 - DNA, 16 bp, M. musculus
gaactggagttacagg

SEQ ID NO: 403868 - DNA, 16 bp, M. musculus
gaactggagttacagt

SEQ ID NO: 403869 - DNA, 16 bp, M. musculus
gaactggagttataga

SEQ ID NO: 403870 - DNA, 16 bp, M. musculus
gaactggagttatgag

SEQ ID NO: 403871 - DNA, 16 bp, M. musculus
gaactggagttccaga

SEQ ID NO: 403872 - DNA, 16 bp, M. musculus
gaactggagttgcagg

SEQ ID NO: 403873 - DNA, 16 bp, M. musculus
gaactggcaagatggc

SEQ ID NO: 403874 - DNA, 16 bp, M. musculus
gaactgggtgagagag

SEQ ID NO: 403875 - DNA, 16 bp, M. musculus
gaactggtggtagcca

SEQ ID NO: 403876 - DNA, 16 bp, M. musculus
gaactgtaataaaggg

SEQ ID NO: 403877 - DNA, 16 bp, M. musculus
gaactgtgatgtggaa

SEQ ID NO: 403878 - DNA, 16 bp, M. musculus
gaactgtggcatcctg

SEQ ID NO: 403879 - DNA, 16 bp, M. musculus
gaacttaaagaagcta

SEQ ID NO: 403880 - DNA, 16 bp, M. musculus
gaacttacagagccca

SEQ ID NO: 403881 - DNA, 16 bp, M. musculus
gaacttactatgtaga

SEQ ID NO: 403882 - DNA, 16 bp, M. musculus
gaacttagaaatctac

SEQ ID NO: 403883 - DNA, 16 bp, M. musculus
gaacttatggatcagc

SEQ ID NO: 403884 - DNA, 16 bp, M. musculus
gaacttcaagtgtctg

SEQ ID NO: 403885 - DNA, 16 bp, M. musculus
gaacttcagaaaatca

SEQ ID NO: 403886 - DNA, 16 bp, M. musculus
gaacttccaagatggc

SEQ ID NO: 403887 - DNA, 16 bp, M. musculus
gaacttctaatcctcc

SEQ ID NO: 403888 - DNA, 16 bp, M. musculus
gaacttctccaaaatt

SEQ ID NO: 403889 - DNA, 16 bp, M. musculus
gaacttctctatcttt

SEQ ID NO: 403890 - DNA, 16 bp, M. musculus
gaacttctgatccttc

SEQ ID NO: 403891 - DNA, 16 bp, M. musculus
gaacttctggaggaat

SEQ ID NO: 403892 - DNA, 16 bp, M. musculus
gaacttctggcagaat

SEQ ID NO: 403893 - DNA, 16 bp, M. musculus
gaacttctggctttca

SEQ ID NO: 403894 - DNA, 16 bp, M. musculus
gaacttcttcagctga

SEQ ID NO: 403895 - DNA, 16 bp, M. musculus
gaacttcttctgggta

SEQ ID NO: 403896 - DNA, 16 bp, M. musculus
gaacttgaagcagaaa

SEQ ID NO: 403897 - DNA, 16 bp, M. musculus
gaacttgctctgcaga

SEQ ID NO: 403898 - DNA, 16 bp, M. musculus
gaacttgctgacagga

SEQ ID NO: 403899 - DNA, 16 bp, M. musculus
gaacttgggaggaaga

SEQ ID NO: 403900 - DNA, 16 bp, M. musculus
gaacttggggacatca

SEQ ID NO: 403901 - DNA, 16 bp, M. musculus
gaacttgtcacacaga

SEQ ID NO: 403902 - DNA, 16 bp, M. musculus
gaactttaaaacaata

SEQ ID NO: 403903 - DNA, 16 bp, M. musculus
gaactttgtgaaaatg

SEQ ID NO: 403904 - DNA, 16 bp, M. musculus
gaacttttaaacagtg

SEQ ID NO: 403905 - DNA, 16 bp, M. musculus
gaactttttcccttac

SEQ ID NO: 403906 - DNA, 16 bp, M. musculus
gaactttttgttttgt

SEQ ID NO: 403907 - DNA, 16 bp, M. musculus
gaagaaaaaccaaagt

SEQ ID NO: 403908 - DNA, 16 bp, M. musculus
gaagaaaaagaaatcc

SEQ ID NO: 403909 - DNA, 16 bp, M. musculus
gaagaaaaagctggag

SEQ ID NO: 403910 - DNA, 16 bp, M. musculus
gaagaaaaagtttatt

SEQ ID NO: 403911 - DNA, 16 bp, M. musculus
gaagaaaacaatcaca

SEQ ID NO: 403912 - DNA, 16 bp, M. musculus
gaagaaaacagatttt

SEQ ID NO: 403913 - DNA, 16 bp, M. musculus
gaagaaaactaaaatg

SEQ ID NO: 403914 - DNA, 16 bp, M. musculus
gaagaaaactgacttt

SEQ ID NO: 403915 - DNA, 16 bp, M. musculus
gaagaaaactgatttt

SEQ ID NO: 403916 - DNA, 16 bp, M. musculus
gaagaaaacttcacaa

SEQ ID NO: 403917 - DNA, 17 bp, M. musculus
gaagaaaacttcccaaa

SEQ ID NO: 403918 - DNA, 16 bp, M. musculus
gaagaaaacttcctga

SEQ ID NO: 403919 - DNA, 17 bp, M. musculus
gaagaaaactttccaaa

SEQ ID NO: 403920 - DNA, 16 bp, M. musculus
gaagaaaataatctca

SEQ ID NO: 403921 - DNA, 16 bp, M. musculus
gaagaaaataattttt

SEQ ID NO: 403922 - DNA, 16 bp, M. musculus
gaagaaaatatctaat

SEQ ID NO: 403923 - DNA, 16 bp, M. musculus
gaagaaaatatctagt

SEQ ID NO: 403924 - DNA, 16 bp, M. musculus
gaagaaaatgaagcaa

SEQ ID NO: 403925 - DNA, 16 bp, M. musculus
gaagaaaattaatttt

SEQ ID NO: 403926 - DNA, 16 bp, M. musculus
gaagaaacaagcttga

SEQ ID NO: 403927 - DNA, 16 bp, M. musculus
gaagaaacaccatgac

SEQ ID NO: 403928 - DNA, 16 bp, M. musculus
gaagaaacagaaatca

SEQ ID NO: 403929 - DNA, 16 bp, M. musculus
gaagaaacagcagcag

SEQ ID NO: 403930 - DNA, 16 bp, M. musculus
gaagaaacatgctgga

SEQ ID NO: 403931 - DNA, 16 bp, M. musculus
gaagaaaccaaggtat

SEQ ID NO: 403932 - DNA, 16 bp, M. musculus
gaagaaacccaggtca

SEQ ID NO: 403933 - DNA, 16 bp, M. musculus
gaagaaactgaagaca

SEQ ID NO: 403934 - DNA, 16 bp, M. musculus
gaagaaactgaggaaa

SEQ ID NO: 403935 - DNA, 16 bp, M. musculus
gaagaaactgatacat

SEQ ID NO: 403936 - DNA, 16 bp, M. musculus
gaagaaagaaattcaa

SEQ ID NO: 403937 - DNA, 16 bp, M. musculus
gaagaaagaacccaca

SEQ ID NO: 403938 - DNA, 16 bp, M. musculus
gaagaaagaatcacag

SEQ ID NO: 403939 - DNA, 16 bp, M. musculus
gaagaaagacattgaa

SEQ ID NO: 403940 - DNA, 16 bp, M. musculus
gaagaaagaccaaaat

SEQ ID NO: 403941 - DNA, 16 bp, M. musculus
gaagaaagcaaagatt

SEQ ID NO: 403942 - DNA, 16 bp, M. musculus
gaagaaagcaaattga

SEQ ID NO: 403943 - DNA, 16 bp, M. musculus
gaagaaagccagtaag

SEQ ID NO: 403944 - DNA, 16 bp, M. musculus
gaagaaagcctatgag

SEQ ID NO: 403945 - DNA, 16 bp, M. musculus
gaagaaagctatgctg

SEQ ID NO: 403946 - DNA, 16 bp, M. musculus
gaagaaaggcaggcag

SEQ ID NO: 403947 - DNA, 16 bp, M. musculus
gaagaaagggtttatt

SEQ ID NO: 403948 - DNA, 16 bp, M. musculus
gaagaaagtgacagtg

SEQ ID NO: 403949 - DNA, 16 bp, M. musculus
gaagaaagttctagaa

SEQ ID NO: 403950 - DNA, 16 bp, M. musculus
gaagaaataaagacag

SEQ ID NO: 403951 - DNA, 16 bp, M. musculus
gaagaaatacaaatga

SEQ ID NO: 403952 - DNA, 16 bp, M. musculus
gaagaaatacagaaag

SEQ ID NO: 403953 - DNA, 16 bp, M. musculus
gaagaaatacagagac

SEQ ID NO: 403954 - DNA, 16 bp, M. musculus
gaagaaatccaaaaga

SEQ ID NO: 403955 - DNA, 16 bp, M. musculus
gaagaaatccaaagca

SEQ ID NO: 403956 - DNA, 16 bp, M. musculus
gaagaaatggacttgg

SEQ ID NO: 403957 - DNA, 16 bp, M. musculus
gaagaaatggctcagt

SEQ ID NO: 403958 - DNA, 16 bp, M. musculus
gaagaaattaaagact

SEQ ID NO: 403959 - DNA, 16 bp, M. musculus
gaagaaattcaaaata

SEQ ID NO: 403960 - DNA, 16 bp, M. musculus
gaagaaattgaagaca

SEQ ID NO: 403961 - DNA, 16 bp, M. musculus
gaagaaattgaggaag

SEQ ID NO: 403962 - DNA, 16 bp, M. musculus
gaagaacaacaatatc

SEQ ID NO: 403963 - DNA, 16 bp, M. musculus
gaagaacaccaaagag

SEQ ID NO: 403964 - DNA, 16 bp, M. musculus
gaagaacacccagtgc

SEQ ID NO: 403965 - DNA, 16 bp, M. musculus
gaagaacagcagcagc

SEQ ID NO: 403966 - DNA, 16 bp, M. musculus
gaagaacagccagtgt

SEQ ID NO: 403967 - DNA, 16 bp, M. musculus
gaagaacatcaatatc

SEQ ID NO: 403968 - DNA, 16 bp, M. musculus
gaagaacattccagaa

SEQ ID NO: 403969 - DNA, 16 bp, M. musculus
gaagaacctgaaccag

SEQ ID NO: 403970 - DNA, 16 bp, M. musculus
gaagaacctggacaga

SEQ ID NO: 403971 - DNA, 16 bp, M. musculus
gaagaactagattcca

SEQ ID NO: 403972 - DNA, 16 bp, M. musculus
gaagaactgaaggaaa

SEQ ID NO: 403973 - DNA, 16 bp, M. musculus
gaagaactgatttgga

SEQ ID NO: 403974 - DNA, 16 bp, M. musculus
gaagaactgtactaaa

SEQ ID NO: 403975 - DNA, 16 bp, M. musculus
gaagaagaaaagctga

SEQ ID NO: 403976 - DNA, 16 bp, M. musculus
gaagaagaaacttcaa

SEQ ID NO: 403977 - DNA, 16 bp, M. musculus
gaagaagaacttagaa

SEQ ID NO: 403978 - DNA, 16 bp, M. musculus
gaagaagaagaaagct

SEQ ID NO: 403979 - DNA, 16 bp, M. musculus
gaagaagaagaaattt

SEQ ID NO: 403980 - DNA, 16 bp, M. musculus
gaagaagaagaagtcg

SEQ ID NO: 403981 - DNA, 16 bp, M. musculus
gaagaagaagaagtct

SEQ ID NO: 403982 - DNA, 16 bp, M. musculus
gaagaagaagaagttg

SEQ ID NO: 403983 - DNA, 16 bp, M. musculus
gaagaagaagaatcag

SEQ ID NO: 403984 - DNA, 16 bp, M. musculus
gaagaagaagcagcag

SEQ ID NO: 403985 - DNA, 21 bp, M. musculus
gaagaagaagcagcagcagca

SEQ ID NO: 403986 - DNA, 17 bp, M. musculus
gaagaagacgacgacga

SEQ ID NO: 403987 - DNA, 16 bp, M. musculus
gaagaagagagaatct

SEQ ID NO: 403988 - DNA, 16 bp, M. musculus
gaagaagagccagtgc

SEQ ID NO: 403989 - DNA, 16 bp, M. musculus
gaagaagagggcatca

SEQ ID NO: 403990 - DNA, 16 bp, M. musculus
gaagaagaggtagaca

SEQ ID NO: 403991 - DNA, 16 bp, M. musculus
gaagaagatctcaaaa

SEQ ID NO: 403992 - DNA, 16 bp, M. musculus
gaagaagatctcagaa

SEQ ID NO: 403993 - DNA, 16 bp, M. musculus
gaagaagatctcagat

SEQ ID NO: 403994 - DNA, 16 bp, M. musculus
gaagaagatctgtcca

SEQ ID NO: 403995 - DNA, 16 bp, M. musculus
gaagaagatgaaggcc

SEQ ID NO: 403996 - DNA, 16 bp, M. musculus
gaagaagatgatgatg

SEQ ID NO: 403997 - DNA, 16 bp, M. musculus
gaagaagatttcagaa

SEQ ID NO: 403998 - DNA, 16 bp, M. musculus
gaagaagcaagcaagc

SEQ ID NO: 403999 - DNA, 16 bp, M. musculus
gaagaagcagaagcag

SEQ ID NO: 404000 - DNA, 16 bp, M. musculus
gaagaagcagcagaag

SEQ ID NO: 404001 - DNA, 16 bp, M. musculus
gaagaagcagcagcaa

SEQ ID NO: 404002 - DNA, 16 bp, M. musculus
gaagaagccagaagag

SEQ ID NO: 404003 - DNA, 16 bp, M. musculus
gaagaagccccaactg

SEQ ID NO: 404004 - DNA, 16 bp, M. musculus
gaagaagcccttggtc

SEQ ID NO: 404005 - DNA, 16 bp, M. musculus
gaagaagctaaagaaa

SEQ ID NO: 404006 - DNA, 16 bp, M. musculus
gaagaagctaagagtt

SEQ ID NO: 404007 - DNA, 16 bp, M. musculus
gaagaagctatcagaa

SEQ ID NO: 404008 - DNA, 16 bp, M. musculus
gaagaagctgaaaggg

SEQ ID NO: 404009 - DNA, 16 bp, M. musculus
gaagaagctgaagaag

SEQ ID NO: 404010 - DNA, 16 bp, M. musculus
gaagaagctgaaggga

SEQ ID NO: 404011 - DNA, 16 bp, M. musculus
gaagaagctgaagggg

SEQ ID NO: 404012 - DNA, 16 bp, M. musculus
gaagaagctgaggcag

SEQ ID NO: 404013 - DNA, 16 bp, M. musculus
gaagaagctgatcttg

SEQ ID NO: 404014 - DNA, 16 bp, M. musculus
gaagaagctgctgggg

SEQ ID NO: 404015 - DNA, 16 bp, M. musculus
gaagaaggaacaccaa

SEQ ID NO: 404016 - DNA, 16 bp, M. musculus
gaagaaggagctgatg

SEQ ID NO: 404017 - DNA, 16 bp, M. musculus
gaagaaggcactggat

SEQ ID NO: 404018 - DNA, 16 bp, M. musculus
gaagaaggcatttgct

SEQ ID NO: 404019 - DNA, 16 bp, M. musculus
gaagaaggggtcagat

SEQ ID NO: 404020 - DNA, 16 bp, M. musculus
gaagaaggtgtcagag

SEQ ID NO: 404021 - DNA, 16 bp, M. musculus
gaagaaggtgttggat

SEQ ID NO: 404022 - DNA, 16 bp, M. musculus
gaagaagtggccaaat

SEQ ID NO: 404023 - DNA, 16 bp, M. musculus
gaagaagttacaaaga

SEQ ID NO: 404024 - DNA, 16 bp, M. musculus
gaagaagttatagaga

SEQ ID NO: 404025 - DNA, 16 bp, M. musculus
gaagaagttgaagaag

SEQ ID NO: 404026 - DNA, 16 bp, M. musculus
gaagaagtttctagaa

SEQ ID NO: 404027 - DNA, 16 bp, M. musculus
gaagaatctgaggagg

SEQ ID NO: 404028 - DNA, 16 bp, M. musculus
gaagaatgaaaacaga

SEQ ID NO: 404029 - DNA, 16 bp, M. musculus
gaagaatgaagccaag

SEQ ID NO: 404030 - DNA, 16 bp, M. musculus
gaagaatgaatgaatg

SEQ ID NO: 404031 - DNA, 16 bp, M. musculus
gaagaatgcaaaatga

SEQ ID NO: 404032 - DNA, 16 bp, M. musculus
gaagaatggatacaca

SEQ ID NO: 404033 - DNA, 16 bp, M. musculus
gaagaatgtgaataga

SEQ ID NO: 404034 - DNA, 16 bp, M. musculus
gaagaatgtgaatgga

SEQ ID NO: 404035 - DNA, 16 bp, M. musculus
gaagaattagaggaag

SEQ ID NO: 404036 - DNA, 16 bp, M. musculus
gaagaattatttttcc

SEQ ID NO: 404037 - DNA, 16 bp, M. musculus
gaagaattggagaaag

SEQ ID NO: 404038 - DNA, 16 bp, M. musculus
gaagaatttttcctat

SEQ ID NO: 404039 - DNA, 16 bp, M. musculus
gaagacaagatgtgtg

SEQ ID NO: 404040 - DNA, 16 bp, M. musculus
gaagacacaagaatca

SEQ ID NO: 404041 - DNA, 16 bp, M. musculus
gaagacacacacacac

SEQ ID NO: 404042 - DNA, 16 bp, M. musculus
gaagacacagagatga

SEQ ID NO: 404043 - DNA, 16 bp, M. musculus
gaagacactgaaggaa

SEQ ID NO: 404044 - DNA, 16 bp, M. musculus
gaagacagaagaccaa

SEQ ID NO: 404045 - DNA, 16 bp, M. musculus
gaagacagaagcagag

SEQ ID NO: 404046 - DNA, 16 bp, M. musculus
gaagacagacagacag

SEQ ID NO: 404047 - DNA, 16 bp, M. musculus
gaagacagacagactg

SEQ ID NO: 404048 - DNA, 16 bp, M. musculus
gaagacagagcaggaa

SEQ ID NO: 404049 - DNA, 16 bp, M. musculus
gaagacagaggacaac

SEQ ID NO: 404050 - DNA, 16 bp, M. musculus
gaagacagcaacattg

SEQ ID NO: 404051 - DNA, 16 bp, M. musculus
gaagacagcaggaaat

SEQ ID NO: 404052 - DNA, 16 bp, M. musculus
gaagacagcagtgttt

SEQ ID NO: 404053 - DNA, 16 bp, M. musculus
gaagacagcggcagtg

SEQ ID NO: 404054 - DNA, 16 bp, M. musculus
gaagacagctacagta

SEQ ID NO: 404055 - DNA, 16 bp, M. musculus
gaagacagctgcagta

SEQ ID NO: 404056 - DNA, 16 bp, M. musculus
gaagacaggacaggaa

SEQ ID NO: 404057 - DNA, 16 bp, M. musculus
gaagacagggcagaaa

SEQ ID NO: 404058 - DNA, 16 bp, M. musculus
gaagacagtgacagtg

SEQ ID NO: 404059 - DNA, 16 bp, M. musculus
gaagacagtgctctta

SEQ ID NO: 404060 - DNA, 16 bp, M. musculus
gaagacagtggcagtg

SEQ ID NO: 404061 - DNA, 16 bp, M. musculus
gaagacatacaagaat

SEQ ID NO: 404062 - DNA, 16 bp, M. musculus
gaagacatcaagaagg

SEQ ID NO: 404063 - DNA, 16 bp, M. musculus
gaagacatcagaagat

SEQ ID NO: 404064 - DNA, 16 bp, M. musculus
gaagacatctgacatc

SEQ ID NO: 404065 - DNA, 16 bp, M. musculus
gaagacatttgctggc

SEQ ID NO: 404066 - DNA, 16 bp, M. musculus
gaagaccaaaatgtgg

SEQ ID NO: 404067 - DNA, 16 bp, M. musculus
gaagaccagaagttca

SEQ ID NO: 404068 - DNA, 16 bp, M. musculus
gaagaccagagttcag

SEQ ID NO: 404069 - DNA, 16 bp, M. musculus
gaagaccagcagctct

SEQ ID NO: 404070 - DNA, 16 bp, M. musculus
gaagaccatcagaaaa

SEQ ID NO: 404071 - DNA, 16 bp, M. musculus
gaagaccatcagtctc

SEQ ID NO: 404072 - DNA, 16 bp, M. musculus
gaagacccaaacataa

SEQ ID NO: 404073 - DNA, 16 bp, M. musculus
gaagacccagctgcac

SEQ ID NO: 404074 - DNA, 16 bp, M. musculus
gaagaccccaaaataa

SEQ ID NO: 404075 - DNA, 16 bp, M. musculus
gaagaccctggacaga

SEQ ID NO: 404076 - DNA, 16 bp, M. musculus
gaagacctacaaggac

SEQ ID NO: 404077 - DNA, 16 bp, M. musculus
gaagacctcagaagat

SEQ ID NO: 404078 - DNA, 16 bp, M. musculus
gaagacctgagtttgg

SEQ ID NO: 404079 - DNA, 16 bp, M. musculus
gaagacctgggagact

SEQ ID NO: 404080 - DNA, 16 bp, M. musculus
gaagacctggtgcaga

SEQ ID NO: 404081 - DNA, 16 bp, M. musculus
gaagaccttaaagaaa

SEQ ID NO: 404082 - DNA, 16 bp, M. musculus
gaagacctttttccat

SEQ ID NO: 404083 - DNA, 16 bp, M. musculus
gaagactacaagccat

SEQ ID NO: 404084 - DNA, 16 bp, M. musculus
gaagactgaagagtgg

SEQ ID NO: 404085 - DNA, 16 bp, M. musculus
gaagactgactcccag

SEQ ID NO: 404086 - DNA, 16 bp, M. musculus
gaagactgacttccag

SEQ ID NO: 404087 - DNA, 16 bp, M. musculus
gaagactgctacagtg

SEQ ID NO: 404088 - DNA, 16 bp, M. musculus
gaagactgctaggaga

SEQ ID NO: 404089 - DNA, 16 bp, M. musculus
gaagactgtgagttca

SEQ ID NO: 404090 - DNA, 16 bp, M. musculus
gaagacttaattccag

SEQ ID NO: 404091 - DNA, 16 bp, M. musculus
gaagacttcagaagat

SEQ ID NO: 404092 - DNA, 16 bp, M. musculus
gaagactttgttgctg

SEQ ID NO: 404093 - DNA, 16 bp, M. musculus
gaagactttttaaaaa

SEQ ID NO: 404094 - DNA, 16 bp, M. musculus
gaagagaacaacagtg

SEQ ID NO: 404095 - DNA, 16 bp, M. musculus
gaagagaacaatggtg

SEQ ID NO: 404096 - DNA, 16 bp, M. musculus
gaagagaagagaagct

SEQ ID NO: 404097 - DNA, 16 bp, M. musculus
gaagagaaggaagcca

SEQ ID NO: 404098 - DNA, 18 bp, M. musculus
gaagagaagggcttaaaa

SEQ ID NO: 404099 - DNA, 16 bp, M. musculus
gaagagacaccatgac

SEQ ID NO: 404100 - DNA, 16 bp, M. musculus
gaagagacagaggcag

SEQ ID NO: 404101 - DNA, 16 bp, M. musculus
gaagagacattatgaa

SEQ ID NO: 404102 - DNA, 16 bp, M. musculus
gaagagaccagcatca

SEQ ID NO: 404103 - DNA, 16 bp, M. musculus
gaagagacgaagagac

SEQ ID NO: 404104 - DNA, 16 bp, M. musculus
gaagagactgaaggag

SEQ ID NO: 404105 - DNA, 16 bp, M. musculus
gaagagactggagaga

SEQ ID NO: 404106 - DNA, 26 bp, M. musculus
gaagagagaatctcaggtgcagaaga

SEQ ID NO: 404107 - DNA, 16 bp, M. musculus
gaagagagaatgtcag

SEQ ID NO: 404108 - DNA, 16 bp, M. musculus
gaagagagacacagag

SEQ ID NO: 404109 - DNA, 16 bp, M. musculus
gaagagagcagcagtg

SEQ ID NO: 404110 - DNA, 16 bp, M. musculus
gaagagagcatctgat

SEQ ID NO: 404111 - DNA, 16 bp, M. musculus
gaagagagcccaggag

SEQ ID NO: 404112 - DNA, 16 bp, M. musculus
gaagagagcgaagatt

SEQ ID NO: 404113 - DNA, 16 bp, M. musculus
gaagagagctttcctg

SEQ ID NO: 404114 - DNA, 16 bp, M. musculus
gaagagaggcaggcag

SEQ ID NO: 404115 - DNA, 16 bp, M. musculus
gaagagaggccccttg

SEQ ID NO: 404116 - DNA, 16 bp, M. musculus
gaagagaggcccttgg

SEQ ID NO: 404117 - DNA, 16 bp, M. musculus
gaagagagtgacagtg

SEQ ID NO: 404118 - DNA, 16 bp, M. musculus
gaagagagtggcagtg

SEQ ID NO: 404119 - DNA, 16 bp, M. musculus
gaagagatgccatgac

SEQ ID NO: 404120 - DNA, 16 bp, M. musculus
gaagagatggcttagt

SEQ ID NO: 404121 - DNA, 16 bp, M. musculus
gaagagcaacaagtac

SEQ ID NO: 404122 - DNA, 16 bp, M. musculus
gaagagcaagtcagtg

SEQ ID NO: 404123 - DNA, 16 bp, M. musculus
gaagagcagagaatgg

SEQ ID NO: 404124 - DNA, 16 bp, M. musculus
gaagagcagagagtgc

SEQ ID NO: 404125 - DNA, 16 bp, M. musculus
gaagagcagcaagtgc

SEQ ID NO: 404126 - DNA, 17 bp, M. musculus
gaagagcagcagcagca

SEQ ID NO: 404127 - DNA, 16 bp, M. musculus
gaagagcagcagcagg

SEQ ID NO: 404128 - DNA, 16 bp, M. musculus
gaagagcagcagcagt

SEQ ID NO: 404129 - DNA, 16 bp, M. musculus
gaagagcagccagtac

SEQ ID NO: 404130 - DNA, 16 bp, M. musculus
gaagagcagccagtgc

SEQ ID NO: 404131 - DNA, 16 bp, M. musculus
gaagagcagcctgtgc

SEQ ID NO: 404132 - DNA, 16 bp, M. musculus
gaagagcagctgaggc

SEQ ID NO: 404133 - DNA, 16 bp, M. musculus
gaagagcagtatggaa

SEQ ID NO: 404134 - DNA, 16 bp, M. musculus
gaagagcagtcaatgc

SEQ ID NO: 404135 - DNA, 16 bp, M. musculus
gaagagcagtcagtat

SEQ ID NO: 404136 - DNA, 16 bp, M. musculus
gaagagcagtcagtga

SEQ ID NO: 404137 - DNA, 16 bp, M. musculus
gaagagcagtcagtgg

SEQ ID NO: 404138 - DNA, 16 bp, M. musculus
gaagagcagtcggagc

SEQ ID NO: 404139 - DNA, 23 bp, M. musculus
gaagagcagtcggcgctcttaac

SEQ ID NO: 404140 - DNA, 24 bp, M. musculus
gaagagcagtcgggtactcttacc

SEQ ID NO: 404141 - DNA, 24 bp, M. musculus
gaagagcagtcgggtgctcttacc

SEQ ID NO: 404142 - DNA, 24 bp, M. musculus
gaagagcagttgggtgctcttacc

SEQ ID NO: 404143 - DNA, 16 bp, M. musculus
gaagagccaggacaga

SEQ ID NO: 404144 - DNA, 16 bp, M. musculus
gaagagcctgaagaaa

SEQ ID NO: 404145 - DNA, 16 bp, M. musculus
gaagagcctgagaaaa

SEQ ID NO: 404146 - DNA, 16 bp, M. musculus
gaagagcctgagagaa

SEQ ID NO: 404147 - DNA, 16 bp, M. musculus
gaagagcctggacaaa

SEQ ID NO: 404148 - DNA, 16 bp, M. musculus
gaagagccttgaagat

SEQ ID NO: 404149 - DNA, 16 bp, M. musculus
gaagagctacaggcaa

SEQ ID NO: 404150 - DNA, 16 bp, M. musculus
gaagagctagagaaat

SEQ ID NO: 404151 - DNA, 16 bp, M. musculus
gaagagctagaggaag

SEQ ID NO: 404152 - DNA, 16 bp, M. musculus
gaagagctgagttgaa

SEQ ID NO: 404153 - DNA, 16 bp, M. musculus
gaagagctggaggaag

SEQ ID NO: 404154 - DNA, 16 bp, M. musculus
gaagagctggccctgg

SEQ ID NO: 404155 - DNA, 16 bp, M. musculus
gaagagctggttcttt

SEQ ID NO: 404156 - DNA, 16 bp, M. musculus
gaagaggaaacctcag

SEQ ID NO: 404157 - DNA, 16 bp, M. musculus
gaagaggaaacttcaa

SEQ ID NO: 404158 - DNA, 16 bp, M. musculus
gaagaggacatgtttg

SEQ ID NO: 404159 - DNA, 17 bp, M. musculus
gaagaggagaagggctt

SEQ ID NO: 404160 - DNA, 16 bp, M. musculus
gaagaggagacctgga

SEQ ID NO: 404161 - DNA, 16 bp, M. musculus
gaagaggagttgaagg

SEQ ID NO: 404162 - DNA, 16 bp, M. musculus
gaagaggccacctcca

SEQ ID NO: 404163 - DNA, 16 bp, M. musculus
gaagaggccagaggag

SEQ ID NO: 404164 - DNA, 16 bp, M. musculus
gaagaggcccaattca

SEQ ID NO: 404165 - DNA, 16 bp, M. musculus
gaagaggctcagacca

SEQ ID NO: 404166 - DNA, 16 bp, M. musculus
gaagaggctgaggcag

SEQ ID NO: 404167 - DNA, 16 bp, M. musculus
gaagaggctgctgggg

SEQ ID NO: 404168 - DNA, 16 bp, M. musculus
gaagagggcagcagac

SEQ ID NO: 404169 - DNA, 16 bp, M. musculus
gaagagggcagtggat

SEQ ID NO: 404170 - DNA, 23 bp, M. musculus
gaagagggcatcagatcctatta

SEQ ID NO: 404171 - DNA, 16 bp, M. musculus
gaagagggcatcatgt

SEQ ID NO: 404172 - DNA, 16 bp, M. musculus
gaagagggcctcagat

SEQ ID NO: 404173 - DNA, 16 bp, M. musculus
gaagagggcgccagat

SEQ ID NO: 404174 - DNA, 16 bp, M. musculus
gaagagggctttagat

SEQ ID NO: 404175 - DNA, 16 bp, M. musculus
gaagagggctttgttt

SEQ ID NO: 404176 - DNA, 16 bp, M. musculus
gaagagggtgtcacat

SEQ ID NO: 404177 - DNA, 16 bp, M. musculus
gaagaggtcaaaatat

SEQ ID NO: 404178 - DNA, 16 bp, M. musculus
gaagaggtcagctcag

SEQ ID NO: 404179 - DNA, 16 bp, M. musculus
gaagagtagacagcag

SEQ ID NO: 404180 - DNA, 16 bp, M. musculus
gaagagtgggtcagag

SEQ ID NO: 404181 - DNA, 16 bp, M. musculus
gaagagtgtttctctt

SEQ ID NO: 404182 - DNA, 16 bp, M. musculus
gaagagttaggagaaa

SEQ ID NO: 404183 - DNA, 16 bp, M. musculus
gaagagttctacatct

SEQ ID NO: 404184 - DNA, 16 bp, M. musculus
gaagagttggaagaag

SEQ ID NO: 404185 - DNA, 16 bp, M. musculus
gaagagttggggaaag

SEQ ID NO: 404186 - DNA, 16 bp, M. musculus
gaagagtttcacagaa

SEQ ID NO: 404187 - DNA, 16 bp, M. musculus
gaagataacatttgaa

SEQ ID NO: 404188 - DNA, 16 bp, M. musculus
gaagataatgttgaaa

SEQ ID NO: 404189 - DNA, 16 bp, M. musculus
gaagataatgttgaga

SEQ ID NO: 404190 - DNA, 16 bp, M. musculus
gaagatacaaatcaca

SEQ ID NO: 404191 - DNA, 16 bp, M. musculus
gaagataccagaagat

SEQ ID NO: 404192 - DNA, 16 bp, M. musculus
gaagatactgtttcct

SEQ ID NO: 404193 - DNA, 16 bp, M. musculus
gaagatagcaacaatg

SEQ ID NO: 404194 - DNA, 16 bp, M. musculus
gaagatagctgctttc

SEQ ID NO: 404195 - DNA, 16 bp, M. musculus
gaagataggtgggaaa

SEQ ID NO: 404196 - DNA, 16 bp, M. musculus
gaagatatcatccaga

SEQ ID NO: 404197 - DNA, 57 bp, M. musculus
gaagatcaacaacaaattgtgtgagcagaagtttgatatggatatacagaaattcaa

SEQ ID NO: 404198 - DNA, 16 bp, M. musculus
gaagatcagcgaagac

SEQ ID NO: 404199 - DNA, 16 bp, M. musculus
gaagatccttgatcca

SEQ ID NO: 404200 - DNA, 16 bp, M. musculus
gaagatctgagtttga

SEQ ID NO: 404201 - DNA, 16 bp, M. musculus
gaagatctgcagttag

SEQ ID NO: 404202 - DNA, 16 bp, M. musculus
gaagatctgggttcaa

SEQ ID NO: 404203 - DNA, 16 bp, M. musculus
gaagatgaagaaaagc

SEQ ID NO: 404204 - DNA, 16 bp, M. musculus
gaagatgaagatgaag

SEQ ID NO: 404205 - DNA, 16 bp, M. musculus
gaagatgaaggcagag

SEQ ID NO: 404206 - DNA, 16 bp, M. musculus
gaagatgaaggccaga

SEQ ID NO: 404207 - DNA, 16 bp, M. musculus
gaagatgaaggccgga

SEQ ID NO: 404208 - DNA, 17 bp, M. musculus
gaagatgaaggcctgaa

SEQ ID NO: 404209 - DNA, 16 bp, M. musculus
gaagatgacctagttg

SEQ ID NO: 404210 - DNA, 16 bp, M. musculus
gaagatgaccttaaat

SEQ ID NO: 404211 - DNA, 16 bp, M. musculus
gaagatgaccttgaat

SEQ ID NO: 404212 - DNA, 16 bp, M. musculus
gaagatgcagaaatga

SEQ ID NO: 404213 - DNA, 16 bp, M. musculus
gaagatgcagcaatac

SEQ ID NO: 404214 - DNA, 16 bp, M. musculus
gaagatgctccaacat

SEQ ID NO: 404215 - DNA, 16 bp, M. musculus
gaagatgctgagagtt

SEQ ID NO: 404216 - DNA, 16 bp, M. musculus
gaagatgctttgtttt

SEQ ID NO: 404217 - DNA, 16 bp, M. musculus
gaagatggaaagaacc

SEQ ID NO: 404218 - DNA, 16 bp, M. musculus
gaagatggaaagagct

SEQ ID NO: 404219 - DNA, 16 bp, M. musculus
gaagatggaaagatca

SEQ ID NO: 404220 - DNA, 16 bp, M. musculus
gaagatggaaagctct

SEQ ID NO: 404221 - DNA, 16 bp, M. musculus
gaagatggaagcctgg

SEQ ID NO: 404222 - DNA, 16 bp, M. musculus
gaagatggagacagag

SEQ ID NO: 404223 - DNA, 16 bp, M. musculus
gaagatggagcagaag

SEQ ID NO: 404224 - DNA, 16 bp, M. musculus
gaagatggcgccaccc

SEQ ID NO: 404225 - DNA, 16 bp, M. musculus
gaagatggcggggctg

SEQ ID NO: 404226 - DNA, 16 bp, M. musculus
gaagatggctggttca

SEQ ID NO: 404227 - DNA, 16 bp, M. musculus
gaagatgggaggcaga

SEQ ID NO: 404228 - DNA, 16 bp, M. musculus
gaagatggtagtgtaa

SEQ ID NO: 404229 - DNA, 16 bp, M. musculus
gaagatgtagctcagt

SEQ ID NO: 404230 - DNA, 16 bp, M. musculus
gaagatgtggagcaag

SEQ ID NO: 404231 - DNA, 16 bp, M. musculus
gaagatgtggtacatt

SEQ ID NO: 404232 - DNA, 16 bp, M. musculus
gaagatgttccaagtg

SEQ ID NO: 404233 - DNA, 16 bp, M. musculus
gaagatgttttctggc

SEQ ID NO: 404234 - DNA, 16 bp, M. musculus
gaagattaaagtgtgg

SEQ ID NO: 404235 - DNA, 16 bp, M. musculus
gaagattattttcttg

SEQ ID NO: 404236 - DNA, 16 bp, M. musculus
gaagattcctcattcc

SEQ ID NO: 404237 - DNA, 16 bp, M. musculus
gaagattcctggagag

SEQ ID NO: 404238 - DNA, 16 bp, M. musculus
gaagattctgagttca

SEQ ID NO: 404239 - DNA, 16 bp, M. musculus
gaagattctgagtttg

SEQ ID NO: 404240 - DNA, 16 bp, M. musculus
gaagatttgagtttga

SEQ ID NO: 404241 - DNA, 16 bp, M. musculus
gaagattttaagaaag

SEQ ID NO: 404242 - DNA, 16 bp, M. musculus
gaagatttttcccaat

SEQ ID NO: 404243 - DNA, 16 bp, M. musculus
gaagattttttcccaa

SEQ ID NO: 404244 - DNA, 16 bp, M. musculus
gaagcaaaggccatgg

SEQ ID NO: 404245 - DNA, 16 bp, M. musculus
gaagcaaatatatcca

SEQ ID NO: 404246 - DNA, 16 bp, M. musculus
gaagcaaatttaccca

SEQ ID NO: 404247 - DNA, 16 bp, M. musculus
gaagcaacagcagcag

SEQ ID NO: 404248 - DNA, 16 bp, M. musculus
gaagcaacttgaggaa

SEQ ID NO: 404249 - DNA, 16 bp, M. musculus
gaagcaagagagcaag

SEQ ID NO: 404250 - DNA, 16 bp, M. musculus
gaagcaagagagcttc

SEQ ID NO: 404251 - DNA, 16 bp, M. musculus
gaagcaagaggttccc

SEQ ID NO: 404252 - DNA, 16 bp, M. musculus
gaagcaagtctctgga

SEQ ID NO: 404253 - DNA, 16 bp, M. musculus
gaagcaataaagaaat

SEQ ID NO: 404254 - DNA, 37 bp, M. musculus
gaagcaatacaaggacggaaatcacgccctagaacaa

SEQ ID NO: 404255 - DNA, 16 bp, M. musculus
gaagcaatcctcctgc

SEQ ID NO: 404256 - DNA, 16 bp, M. musculus
gaagcacacaccttta

SEQ ID NO: 404257 - DNA, 16 bp, M. musculus
gaagcactaaaagaaa

SEQ ID NO: 404258 - DNA, 16 bp, M. musculus
gaagcactcagagcta

SEQ ID NO: 404259 - DNA, 16 bp, M. musculus
gaagcactgaaagaaa

SEQ ID NO: 404260 - DNA, 16 bp, M. musculus
gaagcactgaagcacc

SEQ ID NO: 404261 - DNA, 16 bp, M. musculus
gaagcactgagggcca

SEQ ID NO: 404262 - DNA, 16 bp, M. musculus
gaagcagaaaaccctg

SEQ ID NO: 404263 - DNA, 16 bp, M. musculus
gaagcagaaacaggag

SEQ ID NO: 404264 - DNA, 16 bp, M. musculus
gaagcagaaaccacag

SEQ ID NO: 404265 - DNA, 16 bp, M. musculus
gaagcagaaagcacag

SEQ ID NO: 404266 - DNA, 16 bp, M. musculus
gaagcagaactacaga

SEQ ID NO: 404267 - DNA, 16 bp, M. musculus
gaagcagaactggaga

SEQ ID NO: 404268 - DNA, 16 bp, M. musculus
gaagcagaagcaagag

SEQ ID NO: 404269 - DNA, 16 bp, M. musculus
gaagcagaagcagaca

SEQ ID NO: 404270 - DNA, 16 bp, M. musculus
gaagcagaagcaggct

SEQ ID NO: 404271 - DNA, 16 bp, M. musculus
gaagcagaagcaggta

SEQ ID NO: 404272 - DNA, 16 bp, M. musculus
gaagcagaagcaggtg

SEQ ID NO: 404273 - DNA, 16 bp, M. musculus
gaagcagaagccagag

SEQ ID NO: 404274 - DNA, 16 bp, M. musculus
gaagcagaagccatga

SEQ ID NO: 404275 - DNA, 16 bp, M. musculus
gaagcagaagggtcag

SEQ ID NO: 404276 - DNA, 16 bp, M. musculus
gaagcagaagtgagag

SEQ ID NO: 404277 - DNA, 16 bp, M. musculus
gaagcagaagtggatg

SEQ ID NO: 404278 - DNA, 16 bp, M. musculus
gaagcagaagtgggtg

SEQ ID NO: 404279 - DNA, 16 bp, M. musculus
gaagcagaagtgtgtg

SEQ ID NO: 404280 - DNA, 16 bp, M. musculus
gaagcagacacaggtg

SEQ ID NO: 404281 - DNA, 16 bp, M. musculus
gaagcagacacgggtg

SEQ ID NO: 404282 - DNA, 16 bp, M. musculus
gaagcagagaacagac

SEQ ID NO: 404283 - DNA, 16 bp, M. musculus
gaagcagagacagaca

SEQ ID NO: 404284 - DNA, 16 bp, M. musculus
gaagcagagaccctgg

SEQ ID NO: 404285 - DNA, 16 bp, M. musculus
gaagcagagagaagcc

SEQ ID NO: 404286 - DNA, 16 bp, M. musculus
gaagcagagagagaca

SEQ ID NO: 404287 - DNA, 16 bp, M. musculus
gaagcagagagagatg

SEQ ID NO: 404288 - DNA, 16 bp, M. musculus
gaagcagagagagcaa

SEQ ID NO: 404289 - DNA, 16 bp, M. musculus
gaagcagagagatgag

SEQ ID NO: 404290 - DNA, 16 bp, M. musculus
gaagcagagagcacag

SEQ ID NO: 404291 - DNA, 16 bp, M. musculus
gaagcagagatggaag

SEQ ID NO: 404292 - DNA, 16 bp, M. musculus
gaagcagagcagagca

SEQ ID NO: 404293 - DNA, 16 bp, M. musculus
gaagcagagccatgga

SEQ ID NO: 404294 - DNA, 16 bp, M. musculus
gaagcagagctgagac

SEQ ID NO: 404295 - DNA, 16 bp, M. musculus
gaagcagaggaagatg

SEQ ID NO: 404296 - DNA, 17 bp, M. musculus
gaagcagaggcagagag

SEQ ID NO: 404297 - DNA, 16 bp, M. musculus
gaagcagaggcagcag

SEQ ID NO: 404298 - DNA, 16 bp, M. musculus
gaagcagaggcaggag

SEQ ID NO: 404299 - DNA, 16 bp, M. musculus
gaagcagaggcaggca

SEQ ID NO: 404300 - DNA, 16 bp, M. musculus
gaagcagaggctgaag

SEQ ID NO: 404301 - DNA, 16 bp, M. musculus
gaagcagaggctggcc

SEQ ID NO: 404302 - DNA, 16 bp, M. musculus
gaagcagaggctggtg

SEQ ID NO: 404303 - DNA, 17 bp, M. musculus
gaagcagagtcttggag

SEQ ID NO: 404304 - DNA, 17 bp, M. musculus
gaagcagcagcagcaga

SEQ ID NO: 404305 - DNA, 16 bp, M. musculus
gaagcagcaggagcag

SEQ ID NO: 404306 - DNA, 16 bp, M. musculus
gaagcagccatgtttg

SEQ ID NO: 404307 - DNA, 16 bp, M. musculus
gaagcagccattaaaa

SEQ ID NO: 404308 - DNA, 16 bp, M. musculus
gaagcagctgacccct

SEQ ID NO: 404309 - DNA, 16 bp, M. musculus
gaagcagctgctcaca

SEQ ID NO: 404310 - DNA, 16 bp, M. musculus
gaagcaggaagatcac

SEQ ID NO: 404311 - DNA, 16 bp, M. musculus
gaagcaggaagcagga

SEQ ID NO: 404312 - DNA, 16 bp, M. musculus
gaagcaggaaggtcag

SEQ ID NO: 404313 - DNA, 16 bp, M. musculus
gaagcaggagaagcag

SEQ ID NO: 404314 - DNA, 16 bp, M. musculus
gaagcaggagaatcat

SEQ ID NO: 404315 - DNA, 16 bp, M. musculus
gaagcaggagatgatg

SEQ ID NO: 404316 - DNA, 16 bp, M. musculus
gaagcaggagcagcag

SEQ ID NO: 404317 - DNA, 16 bp, M. musculus
gaagcaggaggagcag

SEQ ID NO: 404318 - DNA, 16 bp, M. musculus
gaagcaggaggatttc

SEQ ID NO: 404319 - DNA, 16 bp, M. musculus
gaagcaggagtggctg

SEQ ID NO: 404320 - DNA, 16 bp, M. musculus
gaagcagggagtttcc

SEQ ID NO: 404321 - DNA, 16 bp, M. musculus
gaagcagggtctcttg

SEQ ID NO: 404322 - DNA, 16 bp, M. musculus
gaagcaggtggatctt

SEQ ID NO: 404323 - DNA, 16 bp, M. musculus
gaagcaggtgtgtgtg

SEQ ID NO: 404324 - DNA, 16 bp, M. musculus
gaagcaggttggggag

SEQ ID NO: 404325 - DNA, 16 bp, M. musculus
gaagcagtcatgaggc

SEQ ID NO: 404326 - DNA, 16 bp, M. musculus
gaagcagttttttttt

SEQ ID NO: 404327 - DNA, 16 bp, M. musculus
gaagcatacttctatc

SEQ ID NO: 404328 - DNA, 16 bp, M. musculus
gaagcatcaggggcag

SEQ ID NO: 404329 - DNA, 16 bp, M. musculus
gaagcatccatgtttg

SEQ ID NO: 404330 - DNA, 16 bp, M. musculus
gaagcatcctcataga

SEQ ID NO: 404331 - DNA, 16 bp, M. musculus
gaagcatgtggcctgg

SEQ ID NO: 404332 - DNA, 16 bp, M. musculus
gaagcatgtgtccttg

SEQ ID NO: 404333 - DNA, 16 bp, M. musculus
gaagcattggaaatgt

SEQ ID NO: 404334 - DNA, 16 bp, M. musculus
gaagcatttaaagaaa

SEQ ID NO: 404335 - DNA, 16 bp, M. musculus
gaagcattttctcaat

SEQ ID NO: 404336 - DNA, 16 bp, M. musculus
gaagcatttttttttt

SEQ ID NO: 404337 - DNA, 16 bp, M. musculus
gaagccaaagcaggaa

SEQ ID NO: 404338 - DNA, 16 bp, M. musculus
gaagccaacctggact

SEQ ID NO: 404339 - DNA, 16 bp, M. musculus
gaagccaagagaagcc

SEQ ID NO: 404340 - DNA, 16 bp, M. musculus
gaagccacagttactc

SEQ ID NO: 404341 - DNA, 16 bp, M. musculus
gaagccacatgtgcca

SEQ ID NO: 404342 - DNA, 26 bp, M. musculus
gaagccactgggcaattaacaaagat

SEQ ID NO: 404343 - DNA, 16 bp, M. musculus
gaagccagaacatacc

SEQ ID NO: 404344 - DNA, 16 bp, M. musculus
gaagccagaagagggc

SEQ ID NO: 404345 - DNA, 16 bp, M. musculus
gaagccagaagccaga

SEQ ID NO: 404346 - DNA, 16 bp, M. musculus
gaagccagacatggtg

SEQ ID NO: 404347 - DNA, 16 bp, M. musculus
gaagccagagaaagca

SEQ ID NO: 404348 - DNA, 16 bp, M. musculus
gaagccagagagatgg

SEQ ID NO: 404349 - DNA, 16 bp, M. musculus
gaagccagaggacaaa

SEQ ID NO: 404350 - DNA, 16 bp, M. musculus
gaagccagccagggct

SEQ ID NO: 404351 - DNA, 16 bp, M. musculus
gaagccagccccagtt

SEQ ID NO: 404352 - DNA, 16 bp, M. musculus
gaagccagcctgagat

SEQ ID NO: 404353 - DNA, 16 bp, M. musculus
gaagccagcctgctct

SEQ ID NO: 404354 - DNA, 16 bp, M. musculus
gaagccagccttgtct

SEQ ID NO: 404355 - DNA, 16 bp, M. musculus
gaagccaggaacagac

SEQ ID NO: 404356 - DNA, 16 bp, M. musculus
gaagccaggaagcaga

SEQ ID NO: 404357 - DNA, 16 bp, M. musculus
gaagccaggcacagtg

SEQ ID NO: 404358 - DNA, 16 bp, M. musculus
gaagccaggcgtggtg

SEQ ID NO: 404359 - DNA, 16 bp, M. musculus
gaagccagtattctgc

SEQ ID NO: 404360 - DNA, 16 bp, M. musculus
gaagccagtattttgc

SEQ ID NO: 404361 - DNA, 16 bp, M. musculus
gaagccatcatcatca

SEQ ID NO: 404362 - DNA, 16 bp, M. musculus
gaagccatcctgggct

SEQ ID NO: 404363 - DNA, 16 bp, M. musculus
gaagccatgaatttga

SEQ ID NO: 404364 - DNA, 16 bp, M. musculus
gaagccatggagaaat

SEQ ID NO: 404365 - DNA, 16 bp, M. musculus
gaagccatgggtctct

SEQ ID NO: 404366 - DNA, 16 bp, M. musculus
gaagcccaggctagcc

SEQ ID NO: 404367 - DNA, 16 bp, M. musculus
gaagcccaggctggcc

SEQ ID NO: 404368 - DNA, 16 bp, M. musculus
gaagcccataaagagg

SEQ ID NO: 404369 - DNA, 16 bp, M. musculus
gaagcccattggtctt

SEQ ID NO: 404370 - DNA, 16 bp, M. musculus
gaagcccctaaagagg

SEQ ID NO: 404371 - DNA, 16 bp, M. musculus
gaagcccctgagacat

SEQ ID NO: 404372 - DNA, 16 bp, M. musculus
gaagccctaggttcaa

SEQ ID NO: 404373 - DNA, 16 bp, M. musculus
gaagccctatttataa

SEQ ID NO: 404374 - DNA, 16 bp, M. musculus
gaagccctgaaggcca

SEQ ID NO: 404375 - DNA, 16 bp, M. musculus
gaagccctgggtttga

SEQ ID NO: 404376 - DNA, 16 bp, M. musculus
gaagccctgtgttcca

SEQ ID NO: 404377 - DNA, 16 bp, M. musculus
gaagcccttgctcctg

SEQ ID NO: 404378 - DNA, 16 bp, M. musculus
gaagcctcagaaatca

SEQ ID NO: 404379 - DNA, 16 bp, M. musculus
gaagcctgatgacctg

SEQ ID NO: 404380 - DNA, 16 bp, M. musculus
gaagcctggcatggct

SEQ ID NO: 404381 - DNA, 16 bp, M. musculus
gaagcctttggtcctg

SEQ ID NO: 404382 - DNA, 16 bp, M. musculus
gaagcctttttttttt

SEQ ID NO: 404383 - DNA, 16 bp, M. musculus
gaagctaaagcaggag

SEQ ID NO: 404384 - DNA, 16 bp, M. musculus
gaagctaacagtttct

SEQ ID NO: 404385 - DNA, 16 bp, M. musculus
gaagctacatgcagac

SEQ ID NO: 404386 - DNA, 16 bp, M. musculus
gaagctagaaacaact

SEQ ID NO: 404387 - DNA, 16 bp, M. musculus
gaagctagagttacag

SEQ ID NO: 404388 - DNA, 16 bp, M. musculus
gaagctaggtgtggtg

SEQ ID NO: 404389 - DNA, 16 bp, M. musculus
gaagctatggagcact

SEQ ID NO: 404390 - DNA, 16 bp, M. musculus
gaagctcaacaagaag

SEQ ID NO: 404391 - DNA, 16 bp, M. musculus
gaagctcaagaagaaa

SEQ ID NO: 404392 - DNA, 16 bp, M. musculus
gaagctcaagaagaag

SEQ ID NO: 404393 - DNA, 16 bp, M. musculus
gaagctcaccaagatg

SEQ ID NO: 404394 - DNA, 16 bp, M. musculus
gaagctccacttccag

SEQ ID NO: 404395 - DNA, 16 bp, M. musculus
gaagctcccaggagtc

SEQ ID NO: 404396 - DNA, 16 bp, M. musculus
gaagctctaccagcag

SEQ ID NO: 404397 - DNA, 16 bp, M. musculus
gaagctctcctcttgc

SEQ ID NO: 404398 - DNA, 16 bp, M. musculus
gaagctctgggtggtc

SEQ ID NO: 404399 - DNA, 17 bp, M. musculus
gaagctctgtggctctc

SEQ ID NO: 404400 - DNA, 16 bp, M. musculus
gaagctgaacaacaat

SEQ ID NO: 404401 - DNA, 18 bp, M. musculus
gaagctgaactccagaaa

SEQ ID NO: 404402 - DNA, 16 bp, M. musculus
gaagctgaagaagagg

SEQ ID NO: 404403 - DNA, 16 bp, M. musculus
gaagctgaagaggagg

SEQ ID NO: 404404 - DNA, 16 bp, M. musculus
gaagctgaagcaagag

SEQ ID NO: 404405 - DNA, 16 bp, M. musculus
gaagctgaagcagaag

SEQ ID NO: 404406 - DNA, 16 bp, M. musculus
gaagctgaagcagagg

SEQ ID NO: 404407 - DNA, 16 bp, M. musculus
gaagctgaaggagttt

SEQ ID NO: 404408 - DNA, 16 bp, M. musculus
gaagctgaaggggaga

SEQ ID NO: 404409 - DNA, 16 bp, M. musculus
gaagctgaaggggagg

SEQ ID NO: 404410 - DNA, 16 bp, M. musculus
gaagctgagacaggag

SEQ ID NO: 404411 - DNA, 16 bp, M. musculus
gaagctgaggaagaag

SEQ ID NO: 404412 - DNA, 16 bp, M. musculus
gaagctgaggaagaga

SEQ ID NO: 404413 - DNA, 16 bp, M. musculus
gaagctgaggaaggag

SEQ ID NO: 404414 - DNA, 16 bp, M. musculus
gaagctgaggagaagg

SEQ ID NO: 404415 - DNA, 16 bp, M. musculus
gaagctgaggaggaga

SEQ ID NO: 404416 - DNA, 16 bp, M. musculus
gaagctgaggcaagag

SEQ ID NO: 404417 - DNA, 16 bp, M. musculus
gaagctgaggcagaag

SEQ ID NO: 404418 - DNA, 16 bp, M. musculus
gaagctgaggcaggaa

SEQ ID NO: 404419 - DNA, 16 bp, M. musculus
gaagctgaggcaggag

SEQ ID NO: 404420 - DNA, 16 bp, M. musculus
gaagctgaggctcaga

SEQ ID NO: 404421 - DNA, 16 bp, M. musculus
gaagctgaggctggag

SEQ ID NO: 404422 - DNA, 16 bp, M. musculus
gaagctgaggcttggc

SEQ ID NO: 404423 - DNA, 16 bp, M. musculus
gaagctgatgcagaga

SEQ ID NO: 404424 - DNA, 16 bp, M. musculus
gaagctgattatgggg

SEQ ID NO: 404425 - DNA, 16 bp, M. musculus
gaagctgccatgttcc

SEQ ID NO: 404426 - DNA, 16 bp, M. musculus
gaagctgcttcttgca

SEQ ID NO: 404427 - DNA, 16 bp, M. musculus
gaagctggacaaggca

SEQ ID NO: 404428 - DNA, 16 bp, M. musculus
gaagctggactccaga

SEQ ID NO: 404429 - DNA, 16 bp, M. musculus
gaagctggagaaagca

SEQ ID NO: 404430 - DNA, 16 bp, M. musculus
gaagctggagccatga

SEQ ID NO: 404431 - DNA, 16 bp, M. musculus
gaagctggagctgatg

SEQ ID NO: 404432 - DNA, 16 bp, M. musculus
gaagctggaggatcag

SEQ ID NO: 404433 - DNA, 16 bp, M. musculus
gaagctggatagaacc

SEQ ID NO: 404434 - DNA, 16 bp, M. musculus
gaagctggcaagaacc

SEQ ID NO: 404435 - DNA, 17 bp, M. musculus
gaagctggccatctccc

SEQ ID NO: 404436 - DNA, 16 bp, M. musculus
gaagctggccttgaac

SEQ ID NO: 404437 - DNA, 16 bp, M. musculus
gaagctggctttgaac

SEQ ID NO: 404438 - DNA, 16 bp, M. musculus
gaagctgggaaagggg

SEQ ID NO: 404439 - DNA, 16 bp, M. musculus
gaagctgggaagaacc

SEQ ID NO: 404440 - DNA, 16 bp, M. musculus
gaagctgtaaagttga

SEQ ID NO: 404441 - DNA, 16 bp, M. musculus
gaagctgtaagccagc

SEQ ID NO: 404442 - DNA, 16 bp, M. musculus
gaagctgtcttcagac

SEQ ID NO: 404443 - DNA, 16 bp, M. musculus
gaagctgtgctccaga

SEQ ID NO: 404444 - DNA, 16 bp, M. musculus
gaagctgtggaggagg

SEQ ID NO: 404445 - DNA, 16 bp, M. musculus
gaagctgtgtcacttc

SEQ ID NO: 404446 - DNA, 16 bp, M. musculus
gaagctgttgggagat

SEQ ID NO: 404447 - DNA, 16 bp, M. musculus
gaagcttaagaagaag

SEQ ID NO: 404448 - DNA, 16 bp, M. musculus
gaagcttctagcctct

SEQ ID NO: 404449 - DNA, 16 bp, M. musculus
gaagcttctctaatga

SEQ ID NO: 404450 - DNA, 16 bp, M. musculus
gaagcttctctgacca

SEQ ID NO: 404451 - DNA, 16 bp, M. musculus
gaagcttctctgatga

SEQ ID NO: 404452 - DNA, 16 bp, M. musculus
gaagctttgcaaattt

SEQ ID NO: 404453 - DNA, 16 bp, M. musculus
gaagcttttccccact

SEQ ID NO: 404454 - DNA, 16 bp, M. musculus
gaaggaaaacaaaagt

SEQ ID NO: 404455 - DNA, 16 bp, M. musculus
gaaggaaaaggctgaa

SEQ ID NO: 404456 - DNA, 16 bp, M. musculus
gaaggaaaatgaatgt

SEQ ID NO: 404457 - DNA, 16 bp, M. musculus
gaaggaaaatgttgag

SEQ ID NO: 404458 - DNA, 16 bp, M. musculus
gaaggaaaccattgaa

SEQ ID NO: 404459 - DNA, 16 bp, M. musculus
gaaggaaagcagacag

SEQ ID NO: 404460 - DNA, 16 bp, M. musculus
gaaggaaagcaggcag

SEQ ID NO: 404461 - DNA, 16 bp, M. musculus
gaaggaaagcatttaa

SEQ ID NO: 404462 - DNA, 16 bp, M. musculus
gaaggaaaggccaccc

SEQ ID NO: 404463 - DNA, 16 bp, M. musculus
gaaggaaaggctgtcc

SEQ ID NO: 404464 - DNA, 16 bp, M. musculus
gaaggaaatcaagaca

SEQ ID NO: 404465 - DNA, 16 bp, M. musculus
gaaggaaatgaagaca

SEQ ID NO: 404466 - DNA, 16 bp, M. musculus
gaaggaaattaaagac

SEQ ID NO: 404467 - DNA, 16 bp, M. musculus
gaaggaacaaaatatc

SEQ ID NO: 404468 - DNA, 16 bp, M. musculus
gaaggaacaggaagtg

SEQ ID NO: 404469 - DNA, 16 bp, M. musculus
gaaggaactaaagaaa

SEQ ID NO: 404470 - DNA, 16 bp, M. musculus
gaaggaactgaaggag

SEQ ID NO: 404471 - DNA, 16 bp, M. musculus
gaaggaacttggaggc

SEQ ID NO: 404472 - DNA, 16 bp, M. musculus
gaaggaagaccaagtg

SEQ ID NO: 404473 - DNA, 16 bp, M. musculus
gaaggaagaccagggt

SEQ ID NO: 404474 - DNA, 16 bp, M. musculus
gaaggaagaccccaaa

SEQ ID NO: 404475 - DNA, 16 bp, M. musculus
gaaggaagctgaggag

SEQ ID NO: 404476 - DNA, 16 bp, M. musculus
gaaggaagcttgctct

SEQ ID NO: 404477 - DNA, 16 bp, M. musculus
gaaggaagcttttgtt

SEQ ID NO: 404478 - DNA, 16 bp, M. musculus
gaaggaaggaagagtc

SEQ ID NO: 404479 - DNA, 16 bp, M. musculus
gaaggaaggaaggact

SEQ ID NO: 404480 - DNA, 16 bp, M. musculus
gaaggaaggaagggct

SEQ ID NO: 404481 - DNA, 16 bp, M. musculus
gaaggaaggacagaca

SEQ ID NO: 404482 - DNA, 16 bp, M. musculus
gaaggaaggcaggaca

SEQ ID NO: 404483 - DNA, 16 bp, M. musculus
gaaggaagtcaaggca

SEQ ID NO: 404484 - DNA, 16 bp, M. musculus
gaaggaagtgtgtcat

SEQ ID NO: 404485 - DNA, 16 bp, M. musculus
gaaggaattgaataaa

SEQ ID NO: 404486 - DNA, 16 bp, M. musculus
gaaggacaagccacag

SEQ ID NO: 404487 - DNA, 16 bp, M. musculus
gaaggacagaaccaac

SEQ ID NO: 404488 - DNA, 16 bp, M. musculus
gaaggacagacagaag

SEQ ID NO: 404489 - DNA, 16 bp, M. musculus
gaaggacagacagaca

SEQ ID NO: 404490 - DNA, 16 bp, M. musculus
gaaggacatctggctt

SEQ ID NO: 404491 - DNA, 16 bp, M. musculus
gaaggacatctgggct

SEQ ID NO: 404492 - DNA, 16 bp, M. musculus
gaaggaccccatggct

SEQ ID NO: 404493 - DNA, 16 bp, M. musculus
gaaggactatccagag

SEQ ID NO: 404494 - DNA, 16 bp, M. musculus
gaaggactgggtctaa

SEQ ID NO: 404495 - DNA, 16 bp, M. musculus
gaaggacttgaagttt

SEQ ID NO: 404496 - DNA, 16 bp, M. musculus
gaaggacttggaggag

SEQ ID NO: 404497 - DNA, 16 bp, M. musculus
gaaggagaaactgagg

SEQ ID NO: 404498 - DNA, 16 bp, M. musculus
gaaggagaagctgcca

SEQ ID NO: 404499 - DNA, 16 bp, M. musculus
gaaggagaaggagcca

SEQ ID NO: 404500 - DNA, 16 bp, M. musculus
gaaggagacacagaga

SEQ ID NO: 404501 - DNA, 16 bp, M. musculus
gaaggagactcagagt

SEQ ID NO: 404502 - DNA, 16 bp, M. musculus
gaaggagagaaccagc

SEQ ID NO: 404503 - DNA, 16 bp, M. musculus
gaaggagagacctgac

SEQ ID NO: 404504 - DNA, 16 bp, M. musculus
gaaggagagagccagc

SEQ ID NO: 404505 - DNA, 16 bp, M. musculus
gaaggagagctgggga

SEQ ID NO: 404506 - DNA, 16 bp, M. musculus
gaaggagaggcccttg

SEQ ID NO: 404507 - DNA, 16 bp, M. musculus
gaaggagatgcagaga

SEQ ID NO: 404508 - DNA, 16 bp, M. musculus
gaaggagatggctcag

SEQ ID NO: 404509 - DNA, 16 bp, M. musculus
gaaggagcagcagcag

SEQ ID NO: 404510 - DNA, 16 bp, M. musculus
gaaggagcaggaagca

SEQ ID NO: 404511 - DNA, 17 bp, M. musculus
gaaggagcaggagcaag

SEQ ID NO: 404512 - DNA, 16 bp, M. musculus
gaaggagcaggtccag

SEQ ID NO: 404513 - DNA, 16 bp, M. musculus
gaaggagccagaaggt

SEQ ID NO: 404514 - DNA, 16 bp, M. musculus
gaaggagccagaggat

SEQ ID NO: 404515 - DNA, 16 bp, M. musculus
gaaggagctaaagaaa

SEQ ID NO: 404516 - DNA, 16 bp, M. musculus
gaaggagctacagaaa

SEQ ID NO: 404517 - DNA, 16 bp, M. musculus
gaaggagctagaagat

SEQ ID NO: 404518 - DNA, 16 bp, M. musculus
gaaggagctagaggaa

SEQ ID NO: 404519 - DNA, 16 bp, M. musculus
gaaggagctgaagaag

SEQ ID NO: 404520 - DNA, 16 bp, M. musculus
gaaggagctgaatggg

SEQ ID NO: 404521 - DNA, 16 bp, M. musculus
gaaggagctgagagct

SEQ ID NO: 404522 - DNA, 16 bp, M. musculus
gaaggagctggagaaa

SEQ ID NO: 404523 - DNA, 16 bp, M. musculus
gaaggagctggagggg

SEQ ID NO: 404524 - DNA, 16 bp, M. musculus
gaaggaggaacctggg

SEQ ID NO: 404525 - DNA, 16 bp, M. musculus
gaaggaggaccagcag

SEQ ID NO: 404526 - DNA, 16 bp, M. musculus
gaaggaggagctgaga

SEQ ID NO: 404527 - DNA, 16 bp, M. musculus
gaaggaggctggagag

SEQ ID NO: 404528 - DNA, 16 bp, M. musculus
gaaggaggctttcagg

SEQ ID NO: 404529 - DNA, 16 bp, M. musculus
gaaggagggaaccaac

SEQ ID NO: 404530 - DNA, 16 bp, M. musculus
gaaggagtcaaaatat

SEQ ID NO: 404531 - DNA, 16 bp, M. musculus
gaaggagttccaggac

SEQ ID NO: 404532 - DNA, 16 bp, M. musculus
gaaggagttggaaaac

SEQ ID NO: 404533 - DNA, 16 bp, M. musculus
gaaggatcctgtccca

SEQ ID NO: 404534 - DNA, 16 bp, M. musculus
gaaggatgctcccctg

SEQ ID NO: 404535 - DNA, 28 bp, M. musculus
gaaggatggggcagtagaattgcacaag

SEQ ID NO: 404536 - DNA, 16 bp, M. musculus
gaaggatggggccacc

SEQ ID NO: 404537 - DNA, 16 bp, M. musculus
gaaggattactttctt

SEQ ID NO: 404538 - DNA, 16 bp, M. musculus
gaaggattgcaggccc

SEQ ID NO: 404539 - DNA, 16 bp, M. musculus
gaaggattgtgggaga

SEQ ID NO: 404540 - DNA, 16 bp, M. musculus
gaaggatttacagaga

SEQ ID NO: 404541 - DNA, 16 bp, M. musculus
gaaggatttgatggag

SEQ ID NO: 404542 - DNA, 16 bp, M. musculus
gaaggcaaaatatcac

SEQ ID NO: 404543 - DNA, 16 bp, M. musculus
gaaggcaaccaggaga

SEQ ID NO: 404544 - DNA, 16 bp, M. musculus
gaaggcaagagagcaa

SEQ ID NO: 404545 - DNA, 17 bp, M. musculus
gaaggcaagatttaata

SEQ ID NO: 404546 - DNA, 16 bp, M. musculus
gaaggcacagaggcag

SEQ ID NO: 404547 - DNA, 16 bp, M. musculus
gaaggcacataataaa

SEQ ID NO: 404548 - DNA, 16 bp, M. musculus
gaaggcacttcaggaa

SEQ ID NO: 404549 - DNA, 16 bp, M. musculus
gaaggcagaagagggc

SEQ ID NO: 404550 - DNA, 16 bp, M. musculus
gaaggcagaaggcaga

SEQ ID NO: 404551 - DNA, 16 bp, M. musculus
gaaggcagagacaagc

SEQ ID NO: 404552 - DNA, 16 bp, M. musculus
gaaggcagagacaggg

SEQ ID NO: 404553 - DNA, 16 bp, M. musculus
gaaggcagagacaggt

SEQ ID NO: 404554 - DNA, 16 bp, M. musculus
gaaggcagagactgga

SEQ ID NO: 404555 - DNA, 16 bp, M. musculus
gaaggcagagagacag

SEQ ID NO: 404556 - DNA, 16 bp, M. musculus
gaaggcagagagagtg

SEQ ID NO: 404557 - DNA, 16 bp, M. musculus
gaaggcagagctgaga

SEQ ID NO: 404558 - DNA, 16 bp, M. musculus
gaaggcagaggaaggt

SEQ ID NO: 404559 - DNA, 16 bp, M. musculus
gaaggcagaggcagag

SEQ ID NO: 404560 - DNA, 16 bp, M. musculus
gaaggcagcagaagga

SEQ ID NO: 404561 - DNA, 16 bp, M. musculus
gaaggcagccagaaga

SEQ ID NO: 404562 - DNA, 16 bp, M. musculus
gaaggcagccaggaga

SEQ ID NO: 404563 - DNA, 16 bp, M. musculus
gaaggcaggaagacag

SEQ ID NO: 404564 - DNA, 16 bp, M. musculus
gaaggcaggagggtca

SEQ ID NO: 404565 - DNA, 16 bp, M. musculus
gaaggcaggcagagag

SEQ ID NO: 404566 - DNA, 16 bp, M. musculus
gaaggcaggcatggtg

SEQ ID NO: 404567 - DNA, 16 bp, M. musculus
gaaggcatcagatcct

SEQ ID NO: 404568 - DNA, 16 bp, M. musculus
gaaggcatcttggaat

SEQ ID NO: 404569 - DNA, 16 bp, M. musculus
gaaggcatggtggcag

SEQ ID NO: 404570 - DNA, 16 bp, M. musculus
gaaggccactggagaa

SEQ ID NO: 404571 - DNA, 16 bp, M. musculus
gaaggccagaaaaggg

SEQ ID NO: 404572 - DNA, 16 bp, M. musculus
gaaggccagaggttga

SEQ ID NO: 404573 - DNA, 16 bp, M. musculus
gaaggccagcagtctc

SEQ ID NO: 404574 - DNA, 16 bp, M. musculus
gaaggccagcttgctg

SEQ ID NO: 404575 - DNA, 16 bp, M. musculus
gaaggcccaaaacagg

SEQ ID NO: 404576 - DNA, 16 bp, M. musculus
gaaggcccaagtgaag

SEQ ID NO: 404577 - DNA, 16 bp, M. musculus
gaaggcccagaagaca

SEQ ID NO: 404578 - DNA, 16 bp, M. musculus
gaaggcccaggactga

SEQ ID NO: 404579 - DNA, 16 bp, M. musculus
gaaggcccaggattga

SEQ ID NO: 404580 - DNA, 16 bp, M. musculus
gaaggcctgaagggac

SEQ ID NO: 404581 - DNA, 16 bp, M. musculus
gaaggcctgagtttgg

SEQ ID NO: 404582 - DNA, 16 bp, M. musculus
gaaggcctgatgcccc

SEQ ID NO: 404583 - DNA, 16 bp, M. musculus
gaaggccttcctgtgc

SEQ ID NO: 404584 - DNA, 16 bp, M. musculus
gaaggccttctggcag

SEQ ID NO: 404585 - DNA, 16 bp, M. musculus
gaaggcgaaggcgaag

SEQ ID NO: 404586 - DNA, 16 bp, M. musculus
gaaggctcaagtgagg

SEQ ID NO: 404587 - DNA, 16 bp, M. musculus
gaaggctccaccctag

SEQ ID NO: 404588 - DNA, 16 bp, M. musculus
gaaggctgagacagga

SEQ ID NO: 404589 - DNA, 16 bp, M. musculus
gaaggctgaggcagga

SEQ ID NO: 404590 - DNA, 16 bp, M. musculus
gaaggctgattgcaaa

SEQ ID NO: 404591 - DNA, 16 bp, M. musculus
gaaggctgctggtgga

SEQ ID NO: 404592 - DNA, 16 bp, M. musculus
gaaggctggagagatg

SEQ ID NO: 404593 - DNA, 16 bp, M. musculus
gaaggctgttagtgga

SEQ ID NO: 404594 - DNA, 16 bp, M. musculus
gaagggaaagtggaca

SEQ ID NO: 404595 - DNA, 16 bp, M. musculus
gaagggaagctcattg

SEQ ID NO: 404596 - DNA, 16 bp, M. musculus
gaagggaaggtggagc

SEQ ID NO: 404597 - DNA, 16 bp, M. musculus
gaagggaatgcagaga

SEQ ID NO: 404598 - DNA, 16 bp, M. musculus
gaagggacacacacac

SEQ ID NO: 404599 - DNA, 16 bp, M. musculus
gaagggacagagacag

SEQ ID NO: 404600 - DNA, 16 bp, M. musculus
gaagggacctgggtgg

SEQ ID NO: 404601 - DNA, 16 bp, M. musculus
gaagggactgggagga

SEQ ID NO: 404602 - DNA, 17 bp, M. musculus
gaagggacttgtgcccc

SEQ ID NO: 404603 - DNA, 16 bp, M. musculus
gaagggactttccaaa

SEQ ID NO: 404604 - DNA, 16 bp, M. musculus
gaagggatgaggcagg

SEQ ID NO: 404605 - DNA, 16 bp, M. musculus
gaagggcagtcagtgc

SEQ ID NO: 404606 - DNA, 16 bp, M. musculus
gaagggctcatgacca

SEQ ID NO: 404607 - DNA, 16 bp, M. musculus
gaagggctgcaccaca

SEQ ID NO: 404608 - DNA, 16 bp, M. musculus
gaaggggaataacatt

SEQ ID NO: 404609 - DNA, 16 bp, M. musculus
gaaggggatccaaagg

SEQ ID NO: 404610 - DNA, 16 bp, M. musculus
gaaggggctgggtggt

SEQ ID NO: 404611 - DNA, 16 bp, M. musculus
gaagggggaaattata
